United States Patent 7,655,785 (BIOINFORMATICALLY DETECTABLE GROUP OF NOVEL REGULATORY OLIGONUCLEOTIDES AND USES THEREOF) - sequence listing, part 21

SEQ ID NO: 839813 - RNA, 21 nt, Homo sapiens
cauuaaacucuaaagauuagg

SEQ ID NO: 839814 - RNA, 18 nt, Homo sapiens
cauucaugcaacuugauu

SEQ ID NO: 839815 - RNA, 11 nt, Homo sapiens
cauucugacca

SEQ ID NO: 839816 - RNA, 21 nt, Homo sapiens
cauugaaaucagcaugacaaa

SEQ ID NO: 839817 - RNA, 14 nt, Homo sapiens
cauugcaucauuua

SEQ ID NO: 839818 - RNA, 11 nt, Homo sapiens
cauuugcugcc

SEQ ID NO: 839819 - RNA, 14 nt, Homo sapiens
cauuuucaauuugg

SEQ ID NO: 839820 - RNA, 13 nt, Homo sapiens
ccaaaaauaucuu

SEQ ID NO: 839821 - RNA, 23 nt, Homo sapiens
ccaaauaaacucuaaacauuaau

SEQ ID NO: 839822 - RNA, 18 nt, Homo sapiens
ccaaauguaacuauguuu

SEQ ID NO: 839823 - RNA, 23 nt, Homo sapiens
ccaaauugucugucugcucuuau

SEQ ID NO: 839824 - RNA, 21 nt, Homo sapiens
ccaaauuuaauuaaagccuua

SEQ ID NO: 839825 - RNA, 13 nt, Homo sapiens
ccaagaacuugca

SEQ ID NO: 839826 - RNA, 16 nt, Homo sapiens
ccaagaacuugcaaua

SEQ ID NO: 839827 - RNA, 14 nt, Homo sapiens
ccaauucugaaaua

SEQ ID NO: 839828 - RNA, 13 nt, Homo sapiens
ccaggagcagcug

SEQ ID NO: 839829 - RNA, 13 nt, Homo sapiens
ccagugacuuuca

SEQ ID NO: 839830 - RNA, 16 nt, Homo sapiens
ccauaaaucaauucau

SEQ ID NO: 839831 - RNA, 17 nt, Homo sapiens
ccaucugugugcaacua

SEQ ID NO: 839832 - RNA, 20 nt, Homo sapiens
ccaugcuucacucaugcaaa

SEQ ID NO: 839833 - RNA, 20 nt, Homo sapiens
ccauuguguaugauuuugau

SEQ ID NO: 839834 - RNA, 16 nt, Homo sapiens
cccaccauagggcaug

SEQ ID NO: 839835 - RNA, 23 nt, Homo sapiens
cccaggagcagcuggcacugaca

SEQ ID NO: 839836 - RNA, 15 nt, Homo sapiens
ccccaauccaugcuu

SEQ ID NO: 839837 - RNA, 20 nt, Homo sapiens
cccuauaucuauaaacacug

SEQ ID NO: 839838 - RNA, 22 nt, Homo sapiens
cccuaucucuacuaaaaauaca

SEQ ID NO: 839839 - RNA, 20 nt, Homo sapiens
cccugggcagugagugccau

SEQ ID NO: 839840 - RNA, 12 nt, Homo sapiens
cccuuuuccucu

SEQ ID NO: 839841 - RNA, 21 nt, Homo sapiens
ccgagcuacaaagcaugggaa

SEQ ID NO: 839842 - RNA, 23 nt, Homo sapiens
ccuaaaauaucuggguggcuuaa

SEQ ID NO: 839843 - RNA, 12 nt, Homo sapiens
ccuacagcagca

SEQ ID NO: 839844 - RNA, 16 nt, Homo sapiens
ccucacucaggaaccc

SEQ ID NO: 839845 - RNA, 14 nt, Homo sapiens
ccucucacuuucag

SEQ ID NO: 839846 - RNA, 23 nt, Homo sapiens
ccucuggggcaggaccacuagcu

SEQ ID NO: 839847 - RNA, 14 nt, Homo sapiens
ccucuugaaccaga

SEQ ID NO: 839848 - RNA, 15 nt, Homo sapiens
ccugacuucuggaau

SEQ ID NO: 839849 - RNA, 22 nt, Homo sapiens
ccugcuuuccuaucuagcauuu

SEQ ID NO: 839850 - RNA, 14 nt, Homo sapiens
ccuuaacuggcaua

SEQ ID NO: 839851 - RNA, 16 nt, Homo sapiens
ccuuuugguuccucac

SEQ ID NO: 839852 - RNA, 22 nt, Homo sapiens
ccuuuugguuccucacauauua

SEQ ID NO: 839853 - RNA, 17 nt, Homo sapiens
cgaggaaaaacaaaaca

SEQ ID NO: 839854 - RNA, 19 nt, Homo sapiens
cggaggacgcuggggaaau

SEQ ID NO: 839855 - RNA, 13 nt, Homo sapiens
cggccacagcacu

SEQ ID NO: 839856 - RNA, 15 nt, Homo sapiens
cggguuacuuucaca

SEQ ID NO: 839857 - RNA, 20 nt, Homo sapiens
cggugcacaguaauaugaaa

SEQ ID NO: 839858 - RNA, 21 nt, Homo sapiens
cggugguucaugccuguaauc

SEQ ID NO: 839859 - RNA, 18 nt, Homo sapiens
cguagcuuucccaaauaa

SEQ ID NO: 839860 - RNA, 19 nt, Homo sapiens
cgucuccaaggaggugaca

SEQ ID NO: 839861 - RNA, 22 nt, Homo sapiens
cgugacagccucugacucacca

SEQ ID NO: 839862 - RNA, 23 nt, Homo sapiens
cgugguggccagcagcagcuaca

SEQ ID NO: 839863 - RNA, 14 nt, Homo sapiens
cuaaaaggaugucu

SEQ ID NO: 839864 - RNA, 17 nt, Homo sapiens
cuaaaguuuugcaacaa

SEQ ID NO: 839865 - RNA, 14 nt, Homo sapiens
cuaauauggcaaaa

SEQ ID NO: 839866 - RNA, 16 nt, Homo sapiens
cuacagaaaaaggaaa

SEQ ID NO: 839867 - RNA, 22 nt, Homo sapiens
cuaguugcauuuucauauugcu

SEQ ID NO: 839868 - RNA, 21 nt, Homo sapiens
cuauaacauagaauugcaauc

SEQ ID NO: 839869 - RNA, 18 nt, Homo sapiens
cuaucaaucaccuugcau

SEQ ID NO: 839870 - RNA, 14 nt, Homo sapiens
cuaucuagcauuua

SEQ ID NO: 839871 - RNA, 15 nt, Homo sapiens
cuauggaaugguuau

SEQ ID NO: 839872 - RNA, 13 nt, Homo sapiens
cucaaaacuuaac

SEQ ID NO: 839873 - RNA, 22 nt, Homo sapiens
cucacucaggaacccuggagac

SEQ ID NO: 839874 - RNA, 20 nt, Homo sapiens
cucaugucuguaaucccagc

SEQ ID NO: 839875 - RNA, 21 nt, Homo sapiens
cucauuagcugaauugagcua

SEQ ID NO: 839876 - RNA, 17 nt, Homo sapiens
cuccaguauucuuguca

SEQ ID NO: 839877 - RNA, 20 nt, Homo sapiens
cucuaauuagagaacuggag

SEQ ID NO: 839878 - RNA, 21 nt, Homo sapiens
cucugauacuuuuuugaaauc

SEQ ID NO: 839879 - RNA, 20 nt, Homo sapiens
cucugaucccuuccuuguua

SEQ ID NO: 839880 - RNA, 14 nt, Homo sapiens
cucuugcauuucac

SEQ ID NO: 839881 - RNA, 15 nt, Homo sapiens
cugaaaaucuaauau

SEQ ID NO: 839882 - RNA, 18 nt, Homo sapiens
cugaacaaagagagcuca

SEQ ID NO: 839883 - RNA, 14 nt, Homo sapiens
cugaauaagcacuu

SEQ ID NO: 839884 - RNA, 16 nt, Homo sapiens
cugacuaugugccgag

SEQ ID NO: 839885 - RNA, 14 nt, Homo sapiens
cugagugugaugaa

SEQ ID NO: 839886 - RNA, 23 nt, Homo sapiens
cugauacuuuuuugaaaucagua

SEQ ID NO: 839887 - RNA, 19 nt, Homo sapiens
cugcccuggggcaucaugg

SEQ ID NO: 839888 - RNA, 21 nt, Homo sapiens
cuggagggggcagaguggccu

SEQ ID NO: 839889 - RNA, 15 nt, Homo sapiens
cuguaguagcccuuu

SEQ ID NO: 839890 - RNA, 14 nt, Homo sapiens
cugucugcucuuau

SEQ ID NO: 839891 - RNA, 13 nt, Homo sapiens
gcuggcacugaca

SEQ ID NO: 839892 - RNA, 15 nt, Homo sapiens
gcuuuaaaagucauu

SEQ ID NO: 839893 - RNA, 18 nt, Homo sapiens
ggaaaccugugaaagcug

SEQ ID NO: 839894 - RNA, 17 nt, Homo sapiens
ggaaacuaacaauauga

SEQ ID NO: 839895 - RNA, 14 nt, Homo sapiens
ggaaauuagucuuu

SEQ ID NO: 839896 - RNA, 17 nt, Homo sapiens
ggaauguguccaagaca

SEQ ID NO: 839897 - RNA, 13 nt, Homo sapiens
ggagaaaugccag

SEQ ID NO: 839898 - RNA, 19 nt, Homo sapiens
ggaguagaauuaagucaga

SEQ ID NO: 839899 - RNA, 14 nt, Homo sapiens
ggagugcugcagcu

SEQ ID NO: 839900 - RNA, 18 nt, Homo sapiens
ggcaaacuuuucuuucuu

SEQ ID NO: 839901 - RNA, 15 nt, Homo sapiens
ggcaggaccacuagc

SEQ ID NO: 839902 - RNA, 21 nt, Homo sapiens
ggcagggcuuuggggggcacu

SEQ ID NO: 839903 - RNA, 17 nt, Homo sapiens
ggccaagacuuggcaac

SEQ ID NO: 839904 - RNA, 15 nt, Homo sapiens
ggccaggcacggugg

SEQ ID NO: 839905 - RNA, 12 nt, Homo sapiens
ggcccucacuca

SEQ ID NO: 839906 - RNA, 23 nt, Homo sapiens
ggccucuggggcaggaccacuag

SEQ ID NO: 839907 - RNA, 21 nt, Homo sapiens
ggcuagacacccauuuucaca

SEQ ID NO: 839908 - RNA, 15 nt, Homo sapiens
ggcuuuaaaagucau

SEQ ID NO: 839909 - RNA, 20 nt, Homo sapiens
gggaugcaaagguugcagug

SEQ ID NO: 839910 - RNA, 21 nt, Homo sapiens
ggggaaaacagaccgugaaca

SEQ ID NO: 839911 - RNA, 14 nt, Homo sapiens
ggguuacuuucaca

SEQ ID NO: 839912 - RNA, 22 nt, Homo sapiens
gguauccagaauggaauuuugc

SEQ ID NO: 839913 - RNA, 23 nt, Homo sapiens
ggucauccgggaggacaaccaga

SEQ ID NO: 839914 - RNA, 18 nt, Homo sapiens
ggugguucaugccuguaa

SEQ ID NO: 839915 - RNA, 19 nt, Homo sapiens
gguuggccaggcacggugg

SEQ ID NO: 839916 - RNA, 14 nt, Homo sapiens
gguuuaaaagucac

SEQ ID NO: 839917 - RNA, 14 nt, Homo sapiens
guaaucuaaguaua

SEQ ID NO: 839918 - RNA, 15 nt, Homo sapiens
guaaucuaaguauau

SEQ ID NO: 839919 - RNA, 17 nt, Homo sapiens
guacccugcaggccagg

SEQ ID NO: 839920 - RNA, 15 nt, Homo sapiens
guauaaacuaucagu

SEQ ID NO: 839921 - RNA, 19 nt, Homo sapiens
guauuauaauuguugauau

SEQ ID NO: 839922 - RNA, 17 nt, Homo sapiens
gucaauuacauguuugg

SEQ ID NO: 839923 - RNA, 13 nt, Homo sapiens
gucagagccaaca

SEQ ID NO: 839924 - RNA, 18 nt, Homo sapiens
gucauggaggccaagaac

SEQ ID NO: 839925 - RNA, 20 nt, Homo sapiens
gucauggaggccaagaacuu

SEQ ID NO: 839926 - RNA, 12 nt, Homo sapiens
guccagugacuu

SEQ ID NO: 839927 - RNA, 20 nt, Homo sapiens
gucugugugaugaacuuucu

SEQ ID NO: 839928 - RNA, 18 nt, Homo sapiens
gugaaggaaacagaaaaa

SEQ ID NO: 839929 - RNA, 11 nt, Homo sapiens
gugcgugccug

SEQ ID NO: 839930 - RNA, 20 nt, Homo sapiens
guggacaaagucaacuucca

SEQ ID NO: 839931 - RNA, 21 nt, Homo sapiens
guggguggccagcgcgaugaa

SEQ ID NO: 839932 - RNA, 20 nt, Homo sapiens
gugugccauagaguuuaaca

SEQ ID NO: 839933 - RNA, 19 nt, Homo sapiens
guguucacuaaacucugaa

SEQ ID NO: 839934 - RNA, 18 nt, Homo sapiens
guuuaaaagucacauaaa

SEQ ID NO: 839935 - RNA, 20 nt, Homo sapiens
guuuacaguuuguguuuuaa

SEQ ID NO: 839936 - RNA, 18 nt, Homo sapiens
guuucugaggaucagcac

SEQ ID NO: 839937 - RNA, 11 nt, Homo sapiens
guuuggcacug

SEQ ID NO: 839938 - RNA, 18 nt, Homo sapiens
guuuuacccuauaucuau

SEQ ID NO: 839939 - RNA, 22 nt, Homo sapiens
guuuucauccauuaaaauuaau

SEQ ID NO: 839940 - RNA, 14 nt, Homo sapiens
uaaaaaagcuauaa

SEQ ID NO: 839941 - RNA, 20 nt, Homo sapiens
uaaaauaucuggguggcuua

SEQ ID NO: 839942 - RNA, 21 nt, Homo sapiens
uaaacacuguguauuguugua

SEQ ID NO: 839943 - RNA, 18 nt, Homo sapiens
uaaacaguuuuggagaaa

SEQ ID NO: 839944 - RNA, 16 nt, Homo sapiens
uaaaguuuugcaacaa

SEQ ID NO: 839945 - RNA, 22 nt, Homo sapiens
uaaauaaaacagcagcagcaaa

SEQ ID NO: 839946 - RNA, 16 nt, Homo sapiens
uaaauaaccacacuga

SEQ ID NO: 839947 - RNA, 20 nt, Homo sapiens
uaaauauuguguugugcagc

SEQ ID NO: 839948 - RNA, 18 nt, Homo sapiens
uaaaucaauucauugugu

SEQ ID NO: 839949 - RNA, 14 nt, Homo sapiens
uaaaugugagcaaa

SEQ ID NO: 839950 - RNA, 14 nt, Homo sapiens
uaaauuauauuccu

SEQ ID NO: 839951 - RNA, 17 nt, Homo sapiens
uaacuaaaugcucauac

SEQ ID NO: 839952 - RNA, 15 nt, Homo sapiens
uaacuacaucugccu

SEQ ID NO: 839953 - RNA, 15 nt, Homo sapiens
uaacuauguuuuauc

SEQ ID NO: 839954 - RNA, 17 nt, Homo sapiens
uaacuggugauauaucu

SEQ ID NO: 839955 - RNA, 23 nt, Homo sapiens
uaacuguauuucaguauuuucca

SEQ ID NO: 839956 - RNA, 15 nt, Homo sapiens
uaagguaauguaggg

SEQ ID NO: 839957 - RNA, 17 nt, Homo sapiens
uaauaaaaauaagaaau

SEQ ID NO: 839958 - RNA, 21 nt, Homo sapiens
uaaucagacaaaguaauuccu

SEQ ID NO: 839959 - RNA, 14 nt, Homo sapiens
uaaucccagcacua

SEQ ID NO: 839960 - RNA, 19 nt, Homo sapiens
uaaugauuguuuaaagguu

SEQ ID NO: 839961 - RNA, 14 nt, Homo sapiens
uacaaguuugcuaa

SEQ ID NO: 839962 - RNA, 16 nt, Homo sapiens
uacauccugaguguga

SEQ ID NO: 839963 - RNA, 23 nt, Homo sapiens
uacauucuugguuguuaauuuag

SEQ ID NO: 839964 - RNA, 15 nt, Homo sapiens
uaccagucaccuccu

SEQ ID NO: 839965 - RNA, 19 nt, Homo sapiens
uuacagaucauauaagcaa

SEQ ID NO: 839966 - RNA, 15 nt, Homo sapiens
uuacccuauaucuau

SEQ ID NO: 839967 - RNA, 23 nt, Homo sapiens
uuacuggcacuguggcacugcca

SEQ ID NO: 839968 - RNA, 15 nt, Homo sapiens
uuagcauggauuuau

SEQ ID NO: 839969 - RNA, 14 nt, Homo sapiens
uuaggagugucucu

SEQ ID NO: 839970 - RNA, 14 nt, Homo sapiens
uuaguacccugcag

SEQ ID NO: 839971 - RNA, 18 nt, Homo sapiens
uuaguacccugcaggcca

SEQ ID NO: 839972 - RNA, 18 nt, Homo sapiens
uuaguauuuaacuacauc

SEQ ID NO: 839973 - RNA, 18 nt, Homo sapiens
uuauuaaaagaguagaaa

SEQ ID NO: 839974 - RNA, 13 nt, Homo sapiens
uuauugagugcca

SEQ ID NO: 839975 - RNA, 19 nt, Homo sapiens
uucacauucccaucuguca

SEQ ID NO: 839976 - RNA, 20 nt, Homo sapiens
uucacuggggcaugagauuu

SEQ ID NO: 839977 - RNA, 21 nt, Homo sapiens
uucagagaaaacuucagagaa

SEQ ID NO: 839978 - RNA, 21 nt, Homo sapiens
uucagcugacuccaguauaau

SEQ ID NO: 839979 - RNA, 16 nt, Homo sapiens
uucaggcuuuaggcau

SEQ ID NO: 839980 - RNA, 23 nt, Homo sapiens
uucuaacauaaguaagacuugau

SEQ ID NO: 839981 - RNA, 16 nt, Homo sapiens
uucuauuuucucugau

SEQ ID NO: 839982 - RNA, 20 nt, Homo sapiens
uucuggaaucuuugagacca

SEQ ID NO: 839983 - RNA, 22 nt, Homo sapiens
uucuggaaucuuugagaccaag

SEQ ID NO: 839984 - RNA, 18 nt, Homo sapiens
uugaaaaauauugcuaaa

SEQ ID NO: 839985 - RNA, 22 nt, Homo sapiens
uugaaaucaguaaacacugugu

SEQ ID NO: 839986 - RNA, 16 nt, Homo sapiens
uugacuggccaaaaau

SEQ ID NO: 839987 - RNA, 20 nt, Homo sapiens
uugcaacaauaaaguacuuu

SEQ ID NO: 839988 - RNA, 14 nt, Homo sapiens
uugcaaucuauaau

SEQ ID NO: 839989 - RNA, 13 nt, Homo sapiens
uugcuaccaaaaa

SEQ ID NO: 839990 - RNA, 14 nt, Homo sapiens
uugcuaccaaaaac

SEQ ID NO: 839991 - RNA, 21 nt, Homo sapiens
uugcuaccaaaaacuagacau

SEQ ID NO: 839992 - RNA, 21 nt, Homo sapiens
uuggcgagaccagagcagucu

SEQ ID NO: 839993 - RNA, 22 nt, Homo sapiens
uugguacaguucauaauucacc

SEQ ID NO: 839994 - RNA, 19 nt, Homo sapiens
uuguauaaggaaagccaaa

SEQ ID NO: 839995 - RNA, 21 nt, Homo sapiens
uugucauuagugagacauauu

SEQ ID NO: 839996 - RNA, 18 nt, Homo sapiens
uuguguugugcagcauua

SEQ ID NO: 839997 - RNA, 12 nt, Homo sapiens
uuuaaaagucac

SEQ ID NO: 839998 - RNA, 14 nt, Homo sapiens
uuuaaaagucacau

SEQ ID NO: 839999 - RNA, 19 nt, Homo sapiens
uuuaaagauaagucuacau

SEQ ID NO: 840000 - RNA, 15 nt, Homo sapiens
uuuaagugacauaau

SEQ ID NO: 840001 - RNA, 17 nt, Homo sapiens
uuuacaaguguauauca

SEQ ID NO: 840002 - RNA, 14 nt, Homo sapiens
uuuauacauaaaca

SEQ ID NO: 840003 - RNA, 19 nt, Homo sapiens
uuuaucguccagugacuuu

SEQ ID NO: 840004 - RNA, 22 nt, Homo sapiens
uuuauuaguuaauauaucccag

SEQ ID NO: 840005 - RNA, 16 nt, Homo sapiens
uuucaacucauugcau

SEQ ID NO: 840006 - RNA, 21 nt, Homo sapiens
aagaaggccagcccacugggc

SEQ ID NO: 840007 - RNA, 20 nt, Homo sapiens
aagacaccugccuuaugcaa

SEQ ID NO: 840008 - RNA, 23 nt, Homo sapiens
aagacuuauuauuuuauccugaa

SEQ ID NO: 840009 - RNA, 13 nt, Homo sapiens
aagagaaugaacu

SEQ ID NO: 840010 - RNA, 23 nt, Homo sapiens
aagagagcucaucaucagucuua

SEQ ID NO: 840011 - RNA, 23 nt, Homo sapiens
aagaggcccugucuguaccuaac

SEQ ID NO: 840012 - RNA, 19 nt, Homo sapiens
aagaucgcgccacugcacu

SEQ ID NO: 840013 - RNA, 14 nt, Homo sapiens
aagccaaauuuuau

SEQ ID NO: 840014 - RNA, 14 nt, Homo sapiens
aagcuaaucugccu

SEQ ID NO: 840015 - RNA, 17 nt, Homo sapiens
aaggccagcccacuggg

SEQ ID NO: 840016 - RNA, 22 nt, Homo sapiens
aagguuucuauuuucucugaua

SEQ ID NO: 840017 - RNA, 11 nt, Homo sapiens
aaguacuuuac

SEQ ID NO: 840018 - RNA, 12 nt, Homo sapiens
aagucaccuaca

SEQ ID NO: 840019 - RNA, 13 nt, Homo sapiens
aagucagagccaa

SEQ ID NO: 840020 - RNA, 14 nt, Homo sapiens
aauaaaaauaagaa

SEQ ID NO: 840021 - RNA, 22 nt, Homo sapiens
aauaaacccuuaacuggcauag

SEQ ID NO: 840022 - RNA, 20 nt, Homo sapiens
aauaaauauuguguugugca

SEQ ID NO: 840023 - RNA, 20 nt, Homo sapiens
aauaagaagggggagugaaa

SEQ ID NO: 840024 - RNA, 22 nt, Homo sapiens
aauaagguauaaggaucuuuug

SEQ ID NO: 840025 - RNA, 13 nt, Homo sapiens
aauacacuuuauu

SEQ ID NO: 840026 - RNA, 17 nt, Homo sapiens
aauagauuaguacugga

SEQ ID NO: 840027 - RNA, 14 nt, Homo sapiens
aauauaaccauaaa

SEQ ID NO: 840028 - RNA, 18 nt, Homo sapiens
aauauagauuaaaucaua

SEQ ID NO: 840029 - RNA, 16 nt, Homo sapiens
aaucaauucauugugu

SEQ ID NO: 840030 - RNA, 14 nt, Homo sapiens
aaucagcaugacaa

SEQ ID NO: 840031 - RNA, 22 nt, Homo sapiens
aaucaugcucauguauauuuag

SEQ ID NO: 840032 - RNA, 14 nt, Homo sapiens
aaucguuugaacuc

SEQ ID NO: 840033 - RNA, 15 nt, Homo sapiens
aaucuauaacuacau

SEQ ID NO: 840034 - RNA, 17 nt, Homo sapiens
aaucuauaacuacauau

SEQ ID NO: 840035 - RNA, 15 nt, Homo sapiens
aaugagacacauaca

SEQ ID NO: 840036 - RNA, 14 nt, Homo sapiens
aaugauuguuuaaa

SEQ ID NO: 840037 - RNA, 19 nt, Homo sapiens
aaugcuuuuugaauguuau

SEQ ID NO: 840038 - RNA, 20 nt, Homo sapiens
aaugguaacuuuacaacugg

SEQ ID NO: 840039 - RNA, 15 nt, Homo sapiens
aauuaaaaacuuuaa

SEQ ID NO: 840040 - RNA, 13 nt, Homo sapiens
aauuaaagccuua

SEQ ID NO: 840041 - RNA, 21 nt, Homo sapiens
aauuaaagccuuaagcacaau

SEQ ID NO: 840042 - RNA, 23 nt, Homo sapiens
aauuauauuccucuugcauuuca

SEQ ID NO: 840043 - RNA, 16 nt, Homo sapiens
aauuuagaaagcuuaa

SEQ ID NO: 840044 - RNA, 20 nt, Homo sapiens
acaaccagaccaaccgccug

SEQ ID NO: 840045 - RNA, 15 nt, Homo sapiens
acaauaaaguacuuu

SEQ ID NO: 840046 - RNA, 20 nt, Homo sapiens
acaauccgagcuacaaagca

SEQ ID NO: 840047 - RNA, 13 nt, Homo sapiens
acaaugugacuuu

SEQ ID NO: 840048 - RNA, 16 nt, Homo sapiens
acaaugugacuuugaa

SEQ ID NO: 840049 - RNA, 14 nt, Homo sapiens
acacuccaggugug

SEQ ID NO: 840050 - RNA, 15 nt, Homo sapiens
acacuguuuguucca

SEQ ID NO: 840051 - RNA, 19 nt, Homo sapiens
acauaaguaagacuugauu

SEQ ID NO: 840052 - RNA, 21 nt, Homo sapiens
acauggggucugggugggggc

SEQ ID NO: 840053 - RNA, 21 nt, Homo sapiens
accaaagugcaggacaucaaa

SEQ ID NO: 840054 - RNA, 12 nt, Homo sapiens
accaauguucua

SEQ ID NO: 840055 - RNA, 20 nt, Homo sapiens
accacaaaaauugacucaaa

SEQ ID NO: 840056 - RNA, 19 nt, Homo sapiens
accauaaaucaauucauug

SEQ ID NO: 840057 - RNA, 20 nt, Homo sapiens
accauccuggcuaacacggu

SEQ ID NO: 840058 - RNA, 15 nt, Homo sapiens
acccccuuuucccuu

SEQ ID NO: 840059 - RNA, 22 nt, Homo sapiens
acccuauaucuauaaacacugu

SEQ ID NO: 840060 - RNA, 15 nt, Homo sapiens
accugcccaugucca

SEQ ID NO: 840061 - RNA, 20 nt, Homo sapiens
accugcgcuguggacacuga

SEQ ID NO: 840062 - RNA, 18 nt, Homo sapiens
accuuaccaacuuucugu

SEQ ID NO: 840063 - RNA, 19 nt, Homo sapiens
acuaaacucugaauaagca

SEQ ID NO: 840064 - RNA, 15 nt, Homo sapiens
acuacgcuugcucau

SEQ ID NO: 840065 - RNA, 20 nt, Homo sapiens
acuccagccugggugacaga

SEQ ID NO: 840066 - RNA, 15 nt, Homo sapiens
acugaguccaugaaa

SEQ ID NO: 840067 - RNA, 20 nt, Homo sapiens
acugcacuccagccugggug

SEQ ID NO: 840068 - RNA, 13 nt, Homo sapiens
acugcgugccagg

SEQ ID NO: 840069 - RNA, 23 nt, Homo sapiens
acuucuuaaaaguugugauucca

SEQ ID NO: 840070 - RNA, 17 nt, Homo sapiens
acuuuucugguuccaaa

SEQ ID NO: 840071 - RNA, 12 nt, Homo sapiens
agaaaacuucag

SEQ ID NO: 840072 - RNA, 17 nt, Homo sapiens
agaaaacuucagagaaa

SEQ ID NO: 840073 - RNA, 13 nt, Homo sapiens
agaaaccaugaca

SEQ ID NO: 840074 - RNA, 14 nt, Homo sapiens
agaaaccaugacaa

SEQ ID NO: 840075 - RNA, 12 nt, Homo sapiens
agaaagcuuaag

SEQ ID NO: 840076 - RNA, 15 nt, Homo sapiens
agaaaggaaccuguc

SEQ ID NO: 840077 - RNA, 13 nt, Homo sapiens
agaacuugcaaua

SEQ ID NO: 840078 - RNA, 20 nt, Homo sapiens
agaaggcaaccaaagugcag

SEQ ID NO: 840079 - RNA, 15 nt, Homo sapiens
agaagggacauggga

SEQ ID NO: 840080 - RNA, 22 nt, Homo sapiens
agaagggggccuaggguggucu

SEQ ID NO: 840081 - RNA, 20 nt, Homo sapiens
agaaucguuugaacucagga

SEQ ID NO: 840082 - RNA, 15 nt, Homo sapiens
agaaugcuacaagaa

SEQ ID NO: 840083 - RNA, 16 nt, Homo sapiens
agaauugcaaucuaua

SEQ ID NO: 840084 - RNA, 14 nt, Homo sapiens
agacauccauguuu

SEQ ID NO: 840085 - RNA, 21 nt, Homo sapiens
agacauuauuuuguauggaau

SEQ ID NO: 840086 - RNA, 14 nt, Homo sapiens
agacuuugcuguua

SEQ ID NO: 840087 - RNA, 22 nt, Homo sapiens
agagaaauuauguuuucaucca

SEQ ID NO: 840088 - RNA, 11 nt, Homo sapiens
agagacucaga

SEQ ID NO: 840089 - RNA, 20 nt, Homo sapiens
agagagaugagcacuucuaa

SEQ ID NO: 840090 - RNA, 21 nt, Homo sapiens
agagcaucuggaacaacagau

SEQ ID NO: 840091 - RNA, 17 nt, Homo sapiens
agagcgagaccgucuca

SEQ ID NO: 840092 - RNA, 16 nt, Homo sapiens
agagguucugcacucc

SEQ ID NO: 840093 - RNA, 20 nt, Homo sapiens
agaucgagaccauccuggcc

SEQ ID NO: 840094 - RNA, 19 nt, Homo sapiens
agaucgcgccacugcacuc

SEQ ID NO: 840095 - RNA, 21 nt, Homo sapiens
agaugggcgucacuacugcua

SEQ ID NO: 840096 - RNA, 13 nt, Homo sapiens
agauuaaaucaua

SEQ ID NO: 840097 - RNA, 23 nt, Homo sapiens
agcaacagcgauggcagugagaa

SEQ ID NO: 840098 - RNA, 15 nt, Homo sapiens
agcaaccuuucccuu

SEQ ID NO: 840099 - RNA, 18 nt, Homo sapiens
agcaaugcccugccuugc

SEQ ID NO: 840100 - RNA, 22 nt, Homo sapiens
agcaaugcccugccuugcugcc

SEQ ID NO: 840101 - RNA, 22 nt, Homo sapiens
agcacaauuaauuaaaagugaa

SEQ ID NO: 840102 - RNA, 15 nt, Homo sapiens
agcacugccagugga

SEQ ID NO: 840103 - RNA, 20 nt, Homo sapiens
agcaggcugacuaugugccg

SEQ ID NO: 840104 - RNA, 17 nt, Homo sapiens
agcccagggaugcaaag

SEQ ID NO: 840105 - RNA, 16 nt, Homo sapiens
agcccggagaggaccc

SEQ ID NO: 840106 - RNA, 19 nt, Homo sapiens
agcccucccccagcaguug

SEQ ID NO: 840107 - RNA, 16 nt, Homo sapiens
agcgauggcagugaga

SEQ ID NO: 840108 - RNA, 13 nt, Homo sapiens
agcgcgaugaacg

SEQ ID NO: 840109 - RNA, 21 nt, Homo sapiens
agcuggagaacaggauucuag

SEQ ID NO: 840110 - RNA, 13 nt, Homo sapiens
agcuggcacugac

SEQ ID NO: 840111 - RNA, 22 nt, Homo sapiens
agcuggccaaccccgagaacca

SEQ ID NO: 840112 - RNA, 14 nt, Homo sapiens
agcugguaaacuau

SEQ ID NO: 840113 - RNA, 21 nt, Homo sapiens
agcuuaaggcggccuacagaa

SEQ ID NO: 840114 - RNA, 22 nt, Homo sapiens
aggaaagccaaauuuuauuaaa

SEQ ID NO: 840115 - RNA, 18 nt, Homo sapiens
aggaauguguccaagaca

SEQ ID NO: 840116 - RNA, 20 nt, Homo sapiens
aggagaucgagaccauccug

SEQ ID NO: 840117 - RNA, 20 nt, Homo sapiens
aggagcaacagcgauggcag

SEQ ID NO: 840118 - RNA, 19 nt, Homo sapiens
aggagcagcuggcacugac

SEQ ID NO: 840119 - RNA, 17 nt, Homo sapiens
aggaggcagagguugca

SEQ ID NO: 840120 - RNA, 20 nt, Homo sapiens
aggagugcgugccugcuacg

SEQ ID NO: 840121 - RNA, 23 nt, Homo sapiens
aggcaaaggcccuugggcaggaa

SEQ ID NO: 840122 - RNA, 16 nt, Homo sapiens
ucaugacauguuauau

SEQ ID NO: 840123 - RNA, 18 nt, Homo sapiens
ucaugcaaacugcuuuau

SEQ ID NO: 840124 - RNA, 23 nt, Homo sapiens
ucaugccuguaaucccagcacua

SEQ ID NO: 840125 - RNA, 14 nt, Homo sapiens
ucaugggaucccag

SEQ ID NO: 840126 - RNA, 15 nt, Homo sapiens
uccaaaccaguuuau

SEQ ID NO: 840127 - RNA, 22 nt, Homo sapiens
uccaaugauacccaacaguuua

SEQ ID NO: 840128 - RNA, 19 nt, Homo sapiens
uccacacacgcuauggaau

SEQ ID NO: 840129 - RNA, 21 nt, Homo sapiens
uccagaguuguuguuugccaa

SEQ ID NO: 840130 - RNA, 13 nt, Homo sapiens
uccagguggacaa

SEQ ID NO: 840131 - RNA, 17 nt, Homo sapiens
uccaguauucuugucaa

SEQ ID NO: 840132 - RNA, 23 nt, Homo sapiens
uccaguuauaagcguauuuagac

SEQ ID NO: 840133 - RNA, 15 nt, Homo sapiens
uccauguuuguaaaa

SEQ ID NO: 840134 - RNA, 20 nt, Homo sapiens
ucccagcaccuauugaauua

SEQ ID NO: 840135 - RNA, 15 nt, Homo sapiens
ucccuggagaaggga

SEQ ID NO: 840136 - RNA, 16 nt, Homo sapiens
uccucuuuugugagaa

SEQ ID NO: 840137 - RNA, 17 nt, Homo sapiens
uccuuuugguuccucac

SEQ ID NO: 840138 - RNA, 13 nt, Homo sapiens
ucgugacagccuc

SEQ ID NO: 840139 - RNA, 22 nt, Homo sapiens
ucuaauuagagaacuggaggaa

SEQ ID NO: 840140 - RNA, 15 nt, Homo sapiens
ucuauaacuacauau

SEQ ID NO: 840141 - RNA, 16 nt, Homo sapiens
ucuauuuucucugaua

SEQ ID NO: 840142 - RNA, 15 nt, Homo sapiens
ucucaaauuguaauu

SEQ ID NO: 840143 - RNA, 17 nt, Homo sapiens
ucucauagguugccaau

SEQ ID NO: 840144 - RNA, 17 nt, Homo sapiens
ucugaauaagcacuuuu

SEQ ID NO: 840145 - RNA, 21 nt, Homo sapiens
ucugaaucuucugaaaccaaa

SEQ ID NO: 840146 - RNA, 19 nt, Homo sapiens
uccaacagugagucuguca

SEQ ID NO: 840147 - RNA, 19 nt, Homo sapiens
uccaguauucuugucaaaa

SEQ ID NO: 840148 - RNA, 14 nt, Homo sapiens
uccagugacuuuca

SEQ ID NO: 840149 - RNA, 21 nt, Homo sapiens
uccaguuauaagcguauuuag

SEQ ID NO: 840150 - RNA, 22 nt, Homo sapiens
uccccaaaagaaaccaugacaa

SEQ ID NO: 840151 - RNA, 16 nt, Homo sapiens
uccucuugaaccagaa

SEQ ID NO: 840152 - RNA, 13 nt, Homo sapiens
uccuugacuuuuu

SEQ ID NO: 840153 - RNA, 19 nt, Homo sapiens
ucggggaaugacacacugc

SEQ ID NO: 840154 - RNA, 13 nt, Homo sapiens
ucuaaauguuugu

SEQ ID NO: 840155 - RNA, 14 nt, Homo sapiens
ucuauaacuacaua

SEQ ID NO: 840156 - RNA, 18 nt, Homo sapiens
ucucaaauuguaauuaau

SEQ ID NO: 840157 - RNA, 14 nt, Homo sapiens
ucuuaaaaacugug

SEQ ID NO: 840158 - RNA, 23 nt, Homo sapiens
ucuuuugugagaagaugggggcu

SEQ ID NO: 840159 - RNA, 19 nt, Homo sapiens
ugaaaccccaucucuacua

SEQ ID NO: 840160 - RNA, 18 nt, Homo sapiens
ugaaaucaguaaacacug

SEQ ID NO: 840161 - RNA, 21 nt, Homo sapiens
ugaaauuuucuagacuuucug

SEQ ID NO: 840162 - RNA, 23 nt, Homo sapiens
ugaacaaagagagcucaucauca

SEQ ID NO: 840163 - RNA, 13 nt, Homo sapiens
ugaauaagcacuu

SEQ ID NO: 840164 - RNA, 14 nt, Homo sapiens
ugaauaagcacuuu

SEQ ID NO: 840165 - RNA, 13 nt, Homo sapiens
ugaccacccugcc

SEQ ID NO: 840166 - RNA, 15 nt, Homo sapiens
ugacuuugacuuccc

SEQ ID NO: 840167 - RNA, 11 nt, Homo sapiens
ugaggcucacc

SEQ ID NO: 840168 - RNA, 17 nt, Homo sapiens
ugagucaugggauccca

SEQ ID NO: 840169 - RNA, 20 nt, Homo sapiens
ugaguuacuuagaaugccau

SEQ ID NO: 840170 - RNA, 22 nt, Homo sapiens
ugauaaucaucagguuuacuca

SEQ ID NO: 840171 - RNA, 19 nt, Homo sapiens
ugauacccaacaguuuauu

SEQ ID NO: 840172 - RNA, 14 nt, Homo sapiens
ugaucuguacuuug

SEQ ID NO: 840173 - RNA, 23 nt, Homo sapiens
ugaugccuuccgacaccacuggg

SEQ ID NO: 840174 - RNA, 19 nt, Homo sapiens
ugauucccagaaauacaac

SEQ ID NO: 840175 - RNA, 20 nt, Homo sapiens
ugauuguuuaaagguuucua

SEQ ID NO: 840176 - RNA, 15 nt, Homo sapiens
ugcaaacugcuuuau

SEQ ID NO: 840177 - RNA, 19 nt, Homo sapiens
ugcaauaccaauguucuaa

SEQ ID NO: 840178 - RNA, 14 nt, Homo sapiens
ugcaauguccugca

SEQ ID NO: 840179 - RNA, 16 nt, Homo sapiens
ugcacucucucucugu

SEQ ID NO: 840180 - RNA, 22 nt, Homo sapiens
ugcagucuuuugcugugcugua

SEQ ID NO: 840181 - RNA, 16 nt, Homo sapiens
ugcaguguuaguauuc

SEQ ID NO: 840182 - RNA, 18 nt, Homo sapiens
ugcaucagaaaaugcagc

SEQ ID NO: 840183 - RNA, 20 nt, Homo sapiens
ugcccuggggcaucaugggc

SEQ ID NO: 840184 - RNA, 23 nt, Homo sapiens
ugcccuggggcaucaugggcaac

SEQ ID NO: 840185 - RNA, 17 nt, Homo sapiens
ugccuucacccugaaca

SEQ ID NO: 840186 - RNA, 19 nt, Homo sapiens
ugccuuccgacaccacugg

SEQ ID NO: 840187 - RNA, 20 nt, Homo sapiens
ugccuuccgacaccacuggg

SEQ ID NO: 840188 - RNA, 11 nt, Homo sapiens
ugcgugccugc

SEQ ID NO: 840189 - RNA, 18 nt, Homo sapiens
ugcuaaaagugcauuuaa

SEQ ID NO: 840190 - RNA, 20 nt, Homo sapiens
ugcuaaagggagaaaugcca

SEQ ID NO: 840191 - RNA, 11 nt, Homo sapiens
ugcucauguau

SEQ ID NO: 840192 - RNA, 15 nt, Homo sapiens
ugcucauuguggcca

SEQ ID NO: 840193 - RNA, 14 nt, Homo sapiens
ugcucgcugagaaa

SEQ ID NO: 840194 - RNA, 14 nt, Homo sapiens
ugcuguacauuacu

SEQ ID NO: 840195 - RNA, 22 nt, Homo sapiens
ugcuucacucaugcaaacugcu

SEQ ID NO: 840196 - RNA, 22 nt, Homo sapiens
uggaaacaugcuguacuaaaau

SEQ ID NO: 840197 - RNA, 19 nt, Homo sapiens
uggagccgggaaagcuguu

SEQ ID NO: 840198 - RNA, 21 nt, Homo sapiens
uggaggccaagaacuugcaau

SEQ ID NO: 840199 - RNA, 16 nt, Homo sapiens
uggcacugacagccug

SEQ ID NO: 840200 - RNA, 16 nt, Homo sapiens
uggccaggcacggugg

SEQ ID NO: 840201 - RNA, 14 nt, Homo sapiens
uggccugugagcaa

SEQ ID NO: 840202 - RNA, 16 nt, Homo sapiens
ugggaggaugaaggag

SEQ ID NO: 840203 - RNA, 15 nt, Homo sapiens
ugggaucccagacuu

SEQ ID NO: 840204 - RNA, 18 nt, Homo sapiens
ugguaacuuuacaacugg

SEQ ID NO: 840205 - RNA, 16 nt, Homo sapiens
ugguauacacacucgu

SEQ ID NO: 840206 - RNA, 13 nt, Homo sapiens
uguaaugagcucc

SEQ ID NO: 840207 - RNA, 12 nt, Homo sapiens
uguagcccugga

SEQ ID NO: 840208 - RNA, 21 nt, Homo sapiens
uguagcccuggauggccucug

SEQ ID NO: 840209 - RNA, 14 nt, Homo sapiens
ugugcagcauuaaa

SEQ ID NO: 840210 - RNA, 13 nt, Homo sapiens
uguuaauuuagag

SEQ ID NO: 840211 - RNA, 13 nt, Homo sapiens
uguugaaugccug

SEQ ID NO: 840212 - RNA, 14 nt, Homo sapiens
uuaaaaaaacugaa

SEQ ID NO: 840213 - RNA, 15 nt, Homo sapiens
uuaaaaaagcuauaa

SEQ ID NO: 840214 - RNA, 15 nt, Homo sapiens
uuaaaaaauaccauu

SEQ ID NO: 840215 - RNA, 20 nt, Homo sapiens
uuaaaacugaguccaugaaa

SEQ ID NO: 840216 - RNA, 15 nt, Homo sapiens
uuaaaagaguagaaa

SEQ ID NO: 840217 - RNA, 16 nt, Homo sapiens
uuaaaucauacuccua

SEQ ID NO: 840218 - RNA, 19 nt, Homo sapiens
uuaacuguauuucaguauu

SEQ ID NO: 840219 - RNA, 16 nt, Homo sapiens
uuacaaguuugcuaaa

SEQ ID NO: 840220 - RNA, 15 nt, Homo sapiens
uuacacuccaggugu

SEQ ID NO: 840221 - RNA, 19 nt, Homo sapiens
gucauggaggccaagaacu

SEQ ID NO: 840222 - RNA, 13 nt, Homo sapiens
gucggcugugagg

SEQ ID NO: 840223 - RNA, 12 nt, Homo sapiens
gugaacacaaaa

SEQ ID NO: 840224 - RNA, 22 nt, Homo sapiens
gugacagccucugacucaccac

SEQ ID NO: 840225 - RNA, 22 nt, Homo sapiens
gugaguuuuacucuuaaaucau

SEQ ID NO: 840226 - RNA, 17 nt, Homo sapiens
gugcauuggagauucuu

SEQ ID NO: 840227 - RNA, 23 nt, Homo sapiens
gugcccaguacuuccuggacaag

SEQ ID NO: 840228 - RNA, 17 nt, Homo sapiens
guguugugcagcauuaa

SEQ ID NO: 840229 - RNA, 18 nt, Homo sapiens
guuaaaaguuaccagggu

SEQ ID NO: 840230 - RNA, 23 nt, Homo sapiens
guuacaaggguauccugugcuau

SEQ ID NO: 840231 - RNA, 17 nt, Homo sapiens
guuacaaguuugcuaaa

SEQ ID NO: 840232 - RNA, 17 nt, Homo sapiens
guucagagaaccagggu

SEQ ID NO: 840233 - RNA, 11 nt, Homo sapiens
guucauauaau

SEQ ID NO: 840234 - RNA, 22 nt, Homo sapiens
guuccucgggaugaaaagccau

SEQ ID NO: 840235 - RNA, 13 nt, Homo sapiens
guugugcagcauu

SEQ ID NO: 840236 - RNA, 16 nt, Homo sapiens
guuguuuuaaagucag

SEQ ID NO: 840237 - RNA, 19 nt, Homo sapiens
guuucuauuuucucugaua

SEQ ID NO: 840238 - RNA, 12 nt, Homo sapiens
guuuugcaacaa

SEQ ID NO: 840239 - RNA, 21 nt, Homo sapiens
uaaaaaggaaauuagucuuuu

SEQ ID NO: 840240 - RNA, 23 nt, Homo sapiens
uaaaaagugaacuuuuguaauuu

SEQ ID NO: 840241 - RNA, 19 nt, Homo sapiens
uaaaaauuaaaugugagca

SEQ ID NO: 840242 - RNA, 17 nt, Homo sapiens
uaaaagcaccauuguga

SEQ ID NO: 840243 - RNA, 21 nt, Homo sapiens
uaaaagcaccauugugaagca

SEQ ID NO: 840244 - RNA, 23 nt, Homo sapiens
uaaaaggauguuacaaguuugcu

SEQ ID NO: 840245 - RNA, 14 nt, Homo sapiens
cugugaauuucaaa

SEQ ID NO: 840246 - RNA, 14 nt, Homo sapiens
cuguggcacugcca

SEQ ID NO: 840247 - RNA, 18 nt, Homo sapiens
cuguuccucaacaagcaa

SEQ ID NO: 840248 - RNA, 12 nt, Homo sapiens
cuuaaaaacugu

SEQ ID NO: 840249 - RNA, 13 nt, Homo sapiens
cuuaaagcuugau

SEQ ID NO: 840250 - RNA, 17 nt, Homo sapiens
cuucuccaauucugaaa

SEQ ID NO: 840251 - RNA, 16 nt, Homo sapiens
cuugcauuucacuuga

SEQ ID NO: 840252 - RNA, 13 nt, Homo sapiens
cuuuaaaaggcaa

SEQ ID NO: 840253 - RNA, 15 nt, Homo sapiens
cuuuaaaagucauua

SEQ ID NO: 840254 - RNA, 11 nt, Homo sapiens
cuuuaugcaaa

SEQ ID NO: 840255 - RNA, 17 nt, Homo sapiens
cuuucaacucauugcau

SEQ ID NO: 840256 - RNA, 18 nt, Homo sapiens
cuuucaggaauugcccau

SEQ ID NO: 840257 - RNA, 15 nt, Homo sapiens
cuuucaggaccuuuu

SEQ ID NO: 840258 - RNA, 13 nt, Homo sapiens
cuuugaaacaugc

SEQ ID NO: 840259 - RNA, 16 nt, Homo sapiens
gaaaacuucagagaaa

SEQ ID NO: 840260 - RNA, 16 nt, Homo sapiens
gaaaaggauugcuuaa

SEQ ID NO: 840261 - RNA, 21 nt, Homo sapiens
gaaaccccaucucuacuaaaa

SEQ ID NO: 840262 - RNA, 14 nt, Homo sapiens
gaaagaagugacua

SEQ ID NO: 840263 - RNA, 12 nt, Homo sapiens
gaaagaggugaa

SEQ ID NO: 840264 - RNA, 14 nt, Homo sapiens
gaaagaggugaaag

SEQ ID NO: 840265 - RNA, 15 nt, Homo sapiens
gaaagaggugaaaga

SEQ ID NO: 840266 - RNA, 18 nt, Homo sapiens
gaaauaaauauuguguug

SEQ ID NO: 840267 - RNA, 12 nt, Homo sapiens
gaaauacuuuug

SEQ ID NO: 840268 - RNA, 15 nt, Homo sapiens
gaaaucagcaugaca

SEQ ID NO: 840269 - RNA, 11 nt, Homo sapiens
aaaaaaacuga

SEQ ID NO: 840270 - RNA, 11 nt, Homo sapiens
aaaaacugaag

SEQ ID NO: 840271 - RNA, 22 nt, Homo sapiens
aaaaaugcccauuuuugcuaau

SEQ ID NO: 840272 - RNA, 21 nt, Homo sapiens
aaaagacugguuuguuugcuu

SEQ ID NO: 840273 - RNA, 18 nt, Homo sapiens
aaaagggaaguugugccu

SEQ ID NO: 840274 - RNA, 21 nt, Homo sapiens
aaaaguucccucucacuuuca

SEQ ID NO: 840275 - RNA, 14 nt, Homo sapiens
aaaaugcagccuua

SEQ ID NO: 840276 - RNA, 18 nt, Homo sapiens
acuuuaaagauaagucua

SEQ ID NO: 840277 - RNA, 16 nt, Homo sapiens
acuuucucuuggacau

SEQ ID NO: 840278 - RNA, 11 nt, Homo sapiens
agaaacaaaug

SEQ ID NO: 840279 - RNA, 16 nt, Homo sapiens
agaaagagaaugaacu

SEQ ID NO: 840280 - RNA, 15 nt, Homo sapiens
agaaaguaagucuuu

SEQ ID NO: 840281 - RNA, 23 nt, Homo sapiens
agaauaaaugguuucucauuaaa

SEQ ID NO: 840282 - RNA, 14 nt, Homo sapiens
agaauuaaaacuga

SEQ ID NO: 840283 - RNA, 19 nt, Homo sapiens
agaauuaagucagagccaa

SEQ ID NO: 840284 - RNA, 19 nt, Homo sapiens
agacaggaagguggugcuu

SEQ ID NO: 840285 - RNA, 14 nt, Homo sapiens
agacauauuuacaa

SEQ ID NO: 840286 - RNA, 16 nt, Homo sapiens
agacuugauugguuua

SEQ ID NO: 840287 - RNA, 15 nt, Homo sapiens
agagaaaacuucaga

SEQ ID NO: 840288 - RNA, 14 nt, Homo sapiens
agagcucaucauca

SEQ ID NO: 840289 - RNA, 21 nt, Homo sapiens
agagcucaucaucagucuuaa

SEQ ID NO: 840290 - RNA, 17 nt, Homo sapiens
agaucugugagcacguu

SEQ ID NO: 840291 - RNA, 20 nt, Homo sapiens
agaugugcugcuuugauaua

SEQ ID NO: 840292 - RNA, 16 nt, Homo sapiens
agcagcuggcacugac

SEQ ID NO: 840293 - RNA, 14 nt, Homo sapiens
agcaugaaaacuga

SEQ ID NO: 840294 - RNA, 22 nt, Homo sapiens
agcaugccaaggcucuguggga

SEQ ID NO: 840295 - RNA, 22 nt, Homo sapiens
agccauauucuaaauucacugu

SEQ ID NO: 840296 - RNA, 12 nt, Homo sapiens
agcccacugggc

SEQ ID NO: 840297 - RNA, 16 nt, Homo sapiens
agccgcggggacaccg

SEQ ID NO: 840298 - RNA, 11 nt, Homo sapiens
agccucugggg

SEQ ID NO: 840299 - RNA, 18 nt, Homo sapiens
agccuuaagcacaauuaa

SEQ ID NO: 840300 - RNA, 19 nt, Homo sapiens
agcgcagguuuaguuuacu

SEQ ID NO: 840301 - RNA, 22 nt, Homo sapiens
agcgcagguuuaguuuacucaa

SEQ ID NO: 840302 - RNA, 18 nt, Homo sapiens
agcuccugcucauugugg

SEQ ID NO: 840303 - RNA, 16 nt, Homo sapiens
agcugaauugagcuag

SEQ ID NO: 840304 - RNA, 11 nt, Homo sapiens
agcugcacuca

SEQ ID NO: 840305 - RNA, 14 nt, Homo sapiens
agcuggcacugaca

SEQ ID NO: 840306 - RNA, 18 nt, Homo sapiens
agcugguaaacuauuugu

SEQ ID NO: 840307 - RNA, 18 nt, Homo sapiens
aggaaaaaaggccacaaa

SEQ ID NO: 840308 - RNA, 12 nt, Homo sapiens
aggaaagccaaa

SEQ ID NO: 840309 - RNA, 22 nt, Homo sapiens
aggaaauguugacuggccaaaa

SEQ ID NO: 840310 - RNA, 21 nt, Homo sapiens
aggaaccacauauaacacuua

SEQ ID NO: 840311 - RNA, 14 nt, Homo sapiens
aggacuacuuucca

SEQ ID NO: 840312 - RNA, 16 nt, Homo sapiens
aggagacugagaccau

SEQ ID NO: 840313 - RNA, 16 nt, Homo sapiens
aggagaucgagaccau

SEQ ID NO: 840314 - RNA, 15 nt, Homo sapiens
aggagcaacagcgau

SEQ ID NO: 840315 - RNA, 20 nt, Homo sapiens
aggaggcagagguugcaaug

SEQ ID NO: 840316 - RNA, 21 nt, Homo sapiens
aggauuuccucuugaaccaga

SEQ ID NO: 840317 - RNA, 15 nt, Homo sapiens
aggccagcccacugg

SEQ ID NO: 840318 - RNA, 19 nt, Homo sapiens
agguacucuggacuuucuc

SEQ ID NO: 840319 - RNA, 12 nt, Homo sapiens
aggucaggagac

SEQ ID NO: 840320 - RNA, 20 nt, Homo sapiens
agguggggagagacagagaa

SEQ ID NO: 840321 - RNA, 14 nt, Homo sapiens
agguucugcacucc

SEQ ID NO: 840322 - RNA, 14 nt, Homo sapiens
aguaagacuugauu

SEQ ID NO: 840323 - RNA, 22 nt, Homo sapiens
aguaagacuugauugguuuaaa

SEQ ID NO: 840324 - RNA, 19 nt, Homo sapiens
aguacuuccuggacaagau

SEQ ID NO: 840325 - RNA, 14 nt, Homo sapiens
aguacuuuaccuaa

SEQ ID NO: 840326 - RNA, 14 nt, Homo sapiens
aguaugaaguauaa

SEQ ID NO: 840327 - RNA, 20 nt, Homo sapiens
aguauguccuucagcugacu

SEQ ID NO: 840328 - RNA, 17 nt, Homo sapiens
aguccaaauugucuguc

SEQ ID NO: 840329 - RNA, 16 nt, Homo sapiens
agucuuaauauucaga

SEQ ID NO: 840330 - RNA, 20 nt, Homo sapiens
agugaaacguaauuguacaa

SEQ ID NO: 840331 - RNA, 21 nt, Homo sapiens
aguguccaggagaugggaugg

SEQ ID NO: 840332 - RNA, 14 nt, Homo sapiens
aguugcauuuucau

SEQ ID NO: 840333 - RNA, 23 nt, Homo sapiens
aguuuaaggguggaaaaaugccc

SEQ ID NO: 840334 - RNA, 22 nt, Homo sapiens
aguuucugaggaucagcacugc

SEQ ID NO: 840335 - RNA, 22 nt, Homo sapiens
aguuucuuuuauuuucauuucu

SEQ ID NO: 840336 - RNA, 14 nt, Homo sapiens
auaaaaagugaacu

SEQ ID NO: 840337 - RNA, 16 nt, Homo sapiens
auaaaaauaagaaaua

SEQ ID NO: 840338 - RNA, 19 nt, Homo sapiens
auaaauagaaagaguucua

SEQ ID NO: 840339 - RNA, 20 nt, Homo sapiens
auaauauuuguguguucacu

SEQ ID NO: 840340 - RNA, 19 nt, Homo sapiens
auaauuugucuuaguugau

SEQ ID NO: 840341 - RNA, 12 nt, Homo sapiens
auaccagucacc

SEQ ID NO: 840342 - RNA, 22 nt, Homo sapiens
auaccagucaccuccugcuccu

SEQ ID NO: 840343 - RNA, 18 nt, Homo sapiens
auacuuuuuuucacaguu

SEQ ID NO: 840344 - RNA, 13 nt, Homo sapiens
auagaauugcaau

SEQ ID NO: 840345 - RNA, 18 nt, Homo sapiens
auagaggugaugcugcua

SEQ ID NO: 840346 - RNA, 18 nt, Homo sapiens
auagauuaguacuggauu

SEQ ID NO: 840347 - RNA, 20 nt, Homo sapiens
auagucccagcuacucggga

SEQ ID NO: 840348 - RNA, 12 nt, Homo sapiens
auauugcuaaaa

SEQ ID NO: 840349 - RNA, 23 nt, Homo sapiens
cuaacaauaugauugcacuaaau

SEQ ID NO: 840350 - RNA, 13 nt, Homo sapiens
cuaagaagggaac

SEQ ID NO: 840351 - RNA, 22 nt, Homo sapiens
cuaauuagagaacuggaggaac

SEQ ID NO: 840352 - RNA, 19 nt, Homo sapiens
cuacauauugaauagggcu

SEQ ID NO: 840353 - RNA, 17 nt, Homo sapiens
cuauaauaaguuuugau

SEQ ID NO: 840354 - RNA, 18 nt, Homo sapiens
cucagccuuggcuggagu

SEQ ID NO: 840355 - RNA, 16 nt, Homo sapiens
cucggugaugccuucc

SEQ ID NO: 840356 - RNA, 19 nt, Homo sapiens
cucuuaaaucauuugguua

SEQ ID NO: 840357 - RNA, 17 nt, Homo sapiens
cucuugaaccagaacca

SEQ ID NO: 840358 - RNA, 17 nt, Homo sapiens
cugaccugcccaugucc

SEQ ID NO: 840359 - RNA, 20 nt, Homo sapiens
cugaggaucagcacugccag

SEQ ID NO: 840360 - RNA, 15 nt, Homo sapiens
cugaguccaugaaaa

SEQ ID NO: 840361 - RNA, 13 nt, Homo sapiens
cugaguggggaaa

SEQ ID NO: 840362 - RNA, 12 nt, Homo sapiens
cugcaagcauuu

SEQ ID NO: 840363 - RNA, 17 nt, Homo sapiens
cugcagccgugcaggac

SEQ ID NO: 840364 - RNA, 18 nt, Homo sapiens
cugccccuccccaaaaga

SEQ ID NO: 840365 - RNA, 14 nt, Homo sapiens
cugccuuaugcaag

SEQ ID NO: 840366 - RNA, 13 nt, Homo sapiens
cugcgcaccaucu

SEQ ID NO: 840367 - RNA, 22 nt, Homo sapiens
cugcuaaagggagaaaugccag

SEQ ID NO: 840368 - RNA, 20 nt, Homo sapiens
cugggacggcccaucuuggc

SEQ ID NO: 840369 - RNA, 17 nt, Homo sapiens
cugggaggcgucuccaa

SEQ ID NO: 840370 - RNA, 19 nt, Homo sapiens
cugggaggcgucuccaagg

SEQ ID NO: 840371 - RNA, 17 nt, Homo sapiens
cuggggaagagguuuua

SEQ ID NO: 840372 - RNA, 17 nt, Homo sapiens
cuggggcaggaccacua

SEQ ID NO: 840373 - RNA, 21 nt, Homo sapiens
cugggggggccgcucuccccc

SEQ ID NO: 840374 - RNA, 12 nt, Homo sapiens
cugguuuuaaca

SEQ ID NO: 840375 - RNA, 14 nt, Homo sapiens
cuguaaaugaacac

SEQ ID NO: 840376 - RNA, 16 nt, Homo sapiens
cugugagcaagagcca

SEQ ID NO: 840377 - RNA, 19 nt, Homo sapiens
cugugcccaguacuuccug

SEQ ID NO: 840378 - RNA, 16 nt, Homo sapiens
cuguguaucauuaaaa

SEQ ID NO: 840379 - RNA, 13 nt, Homo sapiens
cuuaaaaacugug

SEQ ID NO: 840380 - RNA, 15 nt, Homo sapiens
cuuaaaaaucuuggu

SEQ ID NO: 840381 - RNA, 15 nt, Homo sapiens
cuuaccaacuuucug

SEQ ID NO: 840382 - RNA, 15 nt, Homo sapiens
cuucaagagcaucug

SEQ ID NO: 840383 - RNA, 15 nt, Homo sapiens
cuucacucaugcaaa

SEQ ID NO: 840384 - RNA, 16 nt, Homo sapiens
cuugcaauaccaaugu

SEQ ID NO: 840385 - RNA, 21 nt, Homo sapiens
cuugcaauaccaauguucuaa

SEQ ID NO: 840386 - RNA, 20 nt, Homo sapiens
cuuggcuucuuaaaaacugu

SEQ ID NO: 840387 - RNA, 12 nt, Homo sapiens
cuuuagcuuauu

SEQ ID NO: 840388 - RNA, 15 nt, Homo sapiens
cuuuaucuuugugua

SEQ ID NO: 840389 - RNA, 20 nt, Homo sapiens
cuuucaacucauugcaucau

SEQ ID NO: 840390 - RNA, 19 nt, Homo sapiens
cuuucaguaaaaauaaaua

SEQ ID NO: 840391 - RNA, 16 nt, Homo sapiens
cuuuguuuaaaugcca

SEQ ID NO: 840392 - RNA, 21 nt, Homo sapiens
cuuuuacagaaugcauuaaaa

SEQ ID NO: 840393 - RNA, 14 nt, Homo sapiens
cuuuuuaaaaaacu

SEQ ID NO: 840394 - RNA, 14 nt, Homo sapiens
gaaacaaaugaaau

SEQ ID NO: 840395 - RNA, 19 nt, Homo sapiens
gaaacccuaucucuacuaa

SEQ ID NO: 840396 - RNA, 14 nt, Homo sapiens
gaaagggaaagcug

SEQ ID NO: 840397 - RNA, 20 nt, Homo sapiens
gaaccaagggcccucacuca

SEQ ID NO: 840398 - RNA, 21 nt, Homo sapiens
gaacuguuuggucgagucuuu

SEQ ID NO: 840399 - RNA, 22 nt, Homo sapiens
gaagaauuuaauggacugugaa

SEQ ID NO: 840400 - RNA, 20 nt, Homo sapiens
gaagucaggugucaucauca

SEQ ID NO: 840401 - RNA, 13 nt, Homo sapiens
gaaguuuggcaau

SEQ ID NO: 840402 - RNA, 15 nt, Homo sapiens
gaaucuguaugauuc

SEQ ID NO: 840403 - RNA, 18 nt, Homo sapiens
gaaucuucugaaaccaaa

SEQ ID NO: 840404 - RNA, 15 nt, Homo sapiens
gaaugacaacagaag

SEQ ID NO: 840405 - RNA, 18 nt, Homo sapiens
gaauuaagucagagccaa

SEQ ID NO: 840406 - RNA, 18 nt, Homo sapiens
gaauucugacuuacuuaa

SEQ ID NO: 840407 - RNA, 21 nt, Homo sapiens
gaauugagcuagaaaucacaa

SEQ ID NO: 840408 - RNA, 20 nt, Homo sapiens
gaauugcaaucuauaauauu

SEQ ID NO: 840409 - RNA, 20 nt, Homo sapiens
gacaaagucaacuuccacau

SEQ ID NO: 840410 - RNA, 23 nt, Homo sapiens
gacaccugccuuaugcaagggga

SEQ ID NO: 840411 - RNA, 17 nt, Homo sapiens
gaccaaccgccugcagg

SEQ ID NO: 840412 - RNA, 22 nt, Homo sapiens
gaccuguuaggucucaugccca

SEQ ID NO: 840413 - RNA, 20 nt, Homo sapiens
gacuacauccugagugugau

SEQ ID NO: 840414 - RNA, 15 nt, Homo sapiens
gagauuggauuugcu

SEQ ID NO: 840415 - RNA, 13 nt, Homo sapiens
gagcacuucuaag

SEQ ID NO: 840416 - RNA, 12 nt, Homo sapiens
gagccaacaggu

SEQ ID NO: 840417 - RNA, 21 nt, Homo sapiens
gaggacuacuuuccagaauuu

SEQ ID NO: 840418 - RNA, 14 nt, Homo sapiens
gagugcugcagcuu

SEQ ID NO: 840419 - RNA, 16 nt, Homo sapiens
gaguggaaagucaccu

SEQ ID NO: 840420 - RNA, 15 nt, Homo sapiens
gaguggccugugagc

SEQ ID NO: 840421 - RNA, 13 nt, Homo sapiens
gagugugaugaac

SEQ ID NO: 840422 - RNA, 11 nt, Homo sapiens
gauauguuugu

SEQ ID NO: 840423 - RNA, 11 nt, Homo sapiens
gaacuugcaau

SEQ ID NO: 840424 - RNA, 20 nt, Homo sapiens
gaacuugcaauaccaauguu

SEQ ID NO: 840425 - RNA, 15 nt, Homo sapiens
gaagaccccugccca

SEQ ID NO: 840426 - RNA, 17 nt, Homo sapiens
gaaguuuuuuacuuugg

SEQ ID NO: 840427 - RNA, 14 nt, Homo sapiens
gaauaagcacuuuu

SEQ ID NO: 840428 - RNA, 15 nt, Homo sapiens
gaaugaacuguggaa

SEQ ID NO: 840429 - RNA, 21 nt, Homo sapiens
gaauggagaaaguaagucuuu

SEQ ID NO: 840430 - RNA, 19 nt, Homo sapiens
gaauuggcauaauuugucu

SEQ ID NO: 840431 - RNA, 14 nt, Homo sapiens
gacaacauuguaag

SEQ ID NO: 840432 - RNA, 14 nt, Homo sapiens
gacacuuaagccau

SEQ ID NO: 840433 - RNA, 13 nt, Homo sapiens
gacaguggcacua

SEQ ID NO: 840434 - RNA, 23 nt, Homo sapiens
gacauaaaacuuuaaaaggcaac

SEQ ID NO: 840435 - RNA, 11 nt, Homo sapiens
gacaucugccu

SEQ ID NO: 840436 - RNA, 16 nt, Homo sapiens
gaccugcccaugucca

SEQ ID NO: 840437 - RNA, 19 nt, Homo sapiens
gacuacauccugaguguga

SEQ ID NO: 840438 - RNA, 19 nt, Homo sapiens
gacuggggucauuguguaa

SEQ ID NO: 840439 - RNA, 17 nt, Homo sapiens
gacuugauugguuuaaa

SEQ ID NO: 840440 - RNA, 19 nt, Homo sapiens
gacuuuuuuaaauguuugc

SEQ ID NO: 840441 - RNA, 12 nt, Homo sapiens
gagaaaugccag

SEQ ID NO: 840442 - RNA, 23 nt, Homo sapiens
gagcaacagcgauggcagugaga

SEQ ID NO: 840443 - RNA, 18 nt, Homo sapiens
gagcacaagaaggccagc

SEQ ID NO: 840444 - RNA, 21 nt, Homo sapiens
gagcacguuggcgaggaaaaa

SEQ ID NO: 840445 - RNA, 15 nt, Homo sapiens
gaggacuacuuucca

SEQ ID NO: 840446 - RNA, 20 nt, Homo sapiens
gaggcagagguugcaaugag

SEQ ID NO: 840447 - RNA, 22 nt, Homo sapiens
gagguaccagcaauauguaaau

SEQ ID NO: 840448 - RNA, 13 nt, Homo sapiens
gagugccaugcuu

SEQ ID NO: 840449 - RNA, 16 nt, Homo sapiens
gauagcauaggcaaag

SEQ ID NO: 840450 - RNA, 20 nt, Homo sapiens
gaucuuuguuuaaaugccaa

SEQ ID NO: 840451 - RNA, 18 nt, Homo sapiens
gauguacuauaacauaga

SEQ ID NO: 840452 - RNA, 14 nt, Homo sapiens
gaugugacugccau

SEQ ID NO: 840453 - RNA, 17 nt, Homo sapiens
gauucccagaaauacaa

SEQ ID NO: 840454 - RNA, 21 nt, Homo sapiens
gauuuauugagugccaacugc

SEQ ID NO: 840455 - RNA, 20 nt, Homo sapiens
gcaaagagacccagucaauu

SEQ ID NO: 840456 - RNA, 18 nt, Homo sapiens
gcaacaauaaaguacuuu

SEQ ID NO: 840457 - RNA, 20 nt, Homo sapiens
gcaacucgugacagccucug

SEQ ID NO: 840458 - RNA, 16 nt, Homo sapiens
gcaagcauuuuuccau

SEQ ID NO: 840459 - RNA, 14 nt, Homo sapiens
gcacaguaauauga

SEQ ID NO: 840460 - RNA, 18 nt, Homo sapiens
gcaccuuaccaacuuucu

SEQ ID NO: 840461 - RNA, 22 nt, Homo sapiens
gcagcccccacugaccugccca

SEQ ID NO: 840462 - RNA, 14 nt, Homo sapiens
gcaucaugggcaac

SEQ ID NO: 840463 - RNA, 14 nt, Homo sapiens
gcaucuuuuccucc

SEQ ID NO: 840464 - RNA, 14 nt, Homo sapiens
gcaugguggugcac

SEQ ID NO: 840465 - RNA, 18 nt, Homo sapiens
gcauuuucauauugcuac

SEQ ID NO: 840466 - RNA, 12 nt, Homo sapiens
gccaagaacuug

SEQ ID NO: 840467 - RNA, 13 nt, Homo sapiens
gccacacuuugaa

SEQ ID NO: 840468 - RNA, 21 nt, Homo sapiens
gccacagcacuagagucaccc

SEQ ID NO: 840469 - RNA, 20 nt, Homo sapiens
gccagcagcagcuacaacau

SEQ ID NO: 840470 - RNA, 15 nt, Homo sapiens
gccagcccacugggc

SEQ ID NO: 840471 - RNA, 15 nt, Homo sapiens
gccagcgcgaugaac

SEQ ID NO: 840472 - RNA, 15 nt, Homo sapiens
gcccaaguggcucuu

SEQ ID NO: 840473 - RNA, 14 nt, Homo sapiens
gcccagggccucug

SEQ ID NO: 840474 - RNA, 16 nt, Homo sapiens
gcccccacugaccugc

SEQ ID NO: 840475 - RNA, 19 nt, Homo sapiens
gcccuucuggagaugacaa

SEQ ID NO: 840476 - RNA, 17 nt, Homo sapiens
gccucuggggcaggacc

SEQ ID NO: 840477 - RNA, 18 nt, Homo sapiens
gccuuccgacaccacugg

SEQ ID NO: 840478 - RNA, 22 nt, Homo sapiens
gcgcuggacaccuacagcagca

SEQ ID NO: 840479 - RNA, 13 nt, Homo sapiens
gcuaacacgguga

SEQ ID NO: 840480 - RNA, 21 nt, Homo sapiens
gcuaaucugccugguuuuauu

SEQ ID NO: 840481 - RNA, 18 nt, Homo sapiens
gcucugugggaggaugaa

SEQ ID NO: 840482 - RNA, 13 nt, Homo sapiens
gcugagguuuuga

SEQ ID NO: 840483 - RNA, 15 nt, Homo sapiens
gcugcaaggagcaac

SEQ ID NO: 840484 - RNA, 15 nt, Homo sapiens
gcuggacaccuacag

SEQ ID NO: 840485 - RNA, 21 nt, Homo sapiens
gcuggggaaauggugaaggaa

SEQ ID NO: 840486 - RNA, 17 nt, Homo sapiens
gcuguggacacugagaa

SEQ ID NO: 840487 - RNA, 17 nt, Homo sapiens
ggaaaaaucauaaccac

SEQ ID NO: 840488 - RNA, 18 nt, Homo sapiens
ggagaaucguuugaacuc

SEQ ID NO: 840489 - RNA, 11 nt, Homo sapiens
ggagaggaccc

SEQ ID NO: 840490 - RNA, 16 nt, Homo sapiens
ggagcagcuggcacug

SEQ ID NO: 840491 - RNA, 20 nt, Homo sapiens
ggaggcagagguugcaauga

SEQ ID NO: 840492 - RNA, 21 nt, Homo sapiens
ggaggccaagaacuugcaaua

SEQ ID NO: 840493 - RNA, 16 nt, Homo sapiens
ggaggugacacuuaag

SEQ ID NO: 840494 - RNA, 13 nt, Homo sapiens
ggauucagauuuc

SEQ ID NO: 840495 - RNA, 14 nt, Homo sapiens
ggcacuguggcacu

SEQ ID NO: 840496 - RNA, 13 nt, Homo sapiens
ggcagaguggccu

SEQ ID NO: 840497 - RNA, 19 nt, Homo sapiens
ggcagaguggccugugagc

SEQ ID NO: 840498 - RNA, 21 nt, Homo sapiens
ggcagugagaaggcaaccaaa

SEQ ID NO: 840499 - RNA, 17 nt, Homo sapiens
ggcugcaaggagcaaca

SEQ ID NO: 840500 - RNA, 14 nt, Homo sapiens
gggagaaaugccag

SEQ ID NO: 840501 - RNA, 22 nt, Homo sapiens
ggguaguuuuacccuauaucua

SEQ ID NO: 840502 - RNA, 16 nt, Homo sapiens
ggugaaggaaacagaa

SEQ ID NO: 840503 - RNA, 18 nt, Homo sapiens
gguuucuauuuucucuga

SEQ ID NO: 840504 - RNA, 19 nt, Homo sapiens
guaaaagcaccauugugaa

SEQ ID NO: 840505 - RNA, 12 nt, Homo sapiens
guaaugagcucc

SEQ ID NO: 840506 - RNA, 13 nt, Homo sapiens
guacuuuaccuaa

SEQ ID NO: 840507 - RNA, 20 nt, Homo sapiens
gucaccuacaggacugggcc

SEQ ID NO: 840508 - RNA, 12 nt, Homo sapiens
gucaucaucaga

SEQ ID NO: 840509 - RNA, 13 nt, Homo sapiens
guccagugacuuu

SEQ ID NO: 840510 - RNA, 20 nt, Homo sapiens
gucuccaaggaggugacacu

SEQ ID NO: 840511 - RNA, 11 nt, Homo sapiens
gucugcagcuc

SEQ ID NO: 840512 - RNA, 14 nt, Homo sapiens
gucuuugcaaagga

SEQ ID NO: 840513 - RNA, 19 nt, Homo sapiens
gugaagucgagcacucuaa

SEQ ID NO: 840514 - RNA, 14 nt, Homo sapiens
gugacaucauucag

SEQ ID NO: 840515 - RNA, 23 nt, Homo sapiens
gugcacaguaauaugaaagccac

SEQ ID NO: 840516 - RNA, 20 nt, Homo sapiens
guuaaucuauaacuacauau

SEQ ID NO: 840517 - RNA, 23 nt, Homo sapiens
guuacaaauuuuuuaauuuccaa

SEQ ID NO: 840518 - RNA, 17 nt, Homo sapiens
guuacuuagaaugccau

SEQ ID NO: 840519 - RNA, 15 nt, Homo sapiens
guuaggauagcauuu

SEQ ID NO: 840520 - RNA, 22 nt, Homo sapiens
guucuauaauaaguuuugauau

SEQ ID NO: 840521 - RNA, 19 nt, Homo sapiens
guugagucgucaucacuuu

SEQ ID NO: 840522 - RNA, 12 nt, Homo sapiens
guuggcacuuau

SEQ ID NO: 840523 - RNA, 21 nt, Homo sapiens
guuugccaagcuaaucugccu

SEQ ID NO: 840524 - RNA, 13 nt, Homo sapiens
guuuuauauccau

SEQ ID NO: 840525 - RNA, 13 nt, Homo sapiens
uaaaaaagcuaua

SEQ ID NO: 840526 - RNA, 21 nt, Homo sapiens
uaaaagugaaacguaauugua

SEQ ID NO: 840527 - RNA, 21 nt, Homo sapiens
uaaaaugggaauucugacuua

SEQ ID NO: 840528 - RNA, 15 nt, Homo sapiens
uaaaauguaaagguc

SEQ ID NO: 840529 - RNA, 16 nt, Homo sapiens
uaaaauguuuaauuca

SEQ ID NO: 840530 - RNA, 19 nt, Homo sapiens
uaaaauuaauuugugcauc

SEQ ID NO: 840531 - RNA, 17 nt, Homo sapiens
uaaaauugcaguuucau

SEQ ID NO: 840532 - RNA, 20 nt, Homo sapiens
uaaacucugaauaagcacuu

SEQ ID NO: 840533 - RNA, 23 nt, Homo sapiens
uaaacuuguguauugagucuuaa

SEQ ID NO: 840534 - RNA, 16 nt, Homo sapiens
uaaagcuugauuugau

SEQ ID NO: 840535 - RNA, 12 nt, Homo sapiens
uaaagcuuuauc

SEQ ID NO: 840536 - RNA, 18 nt, Homo sapiens
uaaagggagaaaugccag

SEQ ID NO: 840537 - RNA, 14 nt, Homo sapiens
uaaaguauguccuu

SEQ ID NO: 840538 - RNA, 14 nt, Homo sapiens
uaaaguuuugcaac

SEQ ID NO: 840539 - RNA, 12 nt, Homo sapiens
uaaauacaguca

SEQ ID NO: 840540 - RNA, 12 nt, Homo sapiens
uaaaugcucaua

SEQ ID NO: 840541 - RNA, 21 nt, Homo sapiens
ugcaacaauaaaguacuuuac

SEQ ID NO: 840542 - RNA, 17 nt, Homo sapiens
ugcaagaauuaaaacug

SEQ ID NO: 840543 - RNA, 17 nt, Homo sapiens
ugcaaggagcaacagcg

SEQ ID NO: 840544 - RNA, 15 nt, Homo sapiens
ugcaauaccaauguu

SEQ ID NO: 840545 - RNA, 18 nt, Homo sapiens
ugcaauaccaauguucua

SEQ ID NO: 840546 - RNA, 19 nt, Homo sapiens
ugcagcuuugggaaagcug

SEQ ID NO: 840547 - RNA, 13 nt, Homo sapiens
ugcccucggcaac

SEQ ID NO: 840548 - RNA, 21 nt, Homo sapiens
ugcgcuguggacacugagaac

SEQ ID NO: 840549 - RNA, 17 nt, Homo sapiens
ugcucauguauauuuag

SEQ ID NO: 840550 - RNA, 20 nt, Homo sapiens
ugcucgcuacacuacuccug

SEQ ID NO: 840551 - RNA, 22 nt, Homo sapiens
ugcuuuauuuucccuacuugca

SEQ ID NO: 840552 - RNA, 14 nt, Homo sapiens
uggaacaacagaug

SEQ ID NO: 840553 - RNA, 16 nt, Homo sapiens
uggacuacauccugag

SEQ ID NO: 840554 - RNA, 17 nt, Homo sapiens
uggagccgggaaagcug

SEQ ID NO: 840555 - RNA, 12 nt, Homo sapiens
uggagugcugca

SEQ ID NO: 840556 - RNA, 20 nt, Homo sapiens
uggauucaggugcuggagaa

SEQ ID NO: 840557 - RNA, 13 nt, Homo sapiens
uggcucauuagcu

SEQ ID NO: 840558 - RNA, 19 nt, Homo sapiens
ugggacggcccaucuuggc

SEQ ID NO: 840559 - RNA, 13 nt, Homo sapiens
uggggaaaacaga

SEQ ID NO: 840560 - RNA, 16 nt, Homo sapiens
uggggagagacagaga

SEQ ID NO: 840561 - RNA, 17 nt, Homo sapiens
uggggauucagauuucu

SEQ ID NO: 840562 - RNA, 16 nt, Homo sapiens
uggugaaggaaacaga

SEQ ID NO: 840563 - RNA, 15 nt, Homo sapiens
ugguggccagcagca

SEQ ID NO: 840564 - RNA, 14 nt, Homo sapiens
ugguucaugccugu

SEQ ID NO: 840565 - RNA, 14 nt, Homo sapiens
uguaaucaacaugg

SEQ ID NO: 840566 - RNA, 16 nt, Homo sapiens
uguauaaaaaggaaau

SEQ ID NO: 840567 - RNA, 15 nt, Homo sapiens
uguauaaacuaucag

SEQ ID NO: 840568 - RNA, 16 nt, Homo sapiens
ugucgggaauuuuccc

SEQ ID NO: 840569 - RNA, 17 nt, Homo sapiens
ugugaauaaugauuugg

SEQ ID NO: 840570 - RNA, 12 nt, Homo sapiens
ugugacugccau

SEQ ID NO: 840571 - RNA, 18 nt, Homo sapiens
ugugaugaacgugccuga

SEQ ID NO: 840572 - RNA, 12 nt, Homo sapiens
uguguaaucuaa

SEQ ID NO: 840573 - RNA, 14 nt, Homo sapiens
uguguccaagacac

SEQ ID NO: 840574 - RNA, 22 nt, Homo sapiens
uguguuauauuccaaggaaaau

SEQ ID NO: 840575 - RNA, 18 nt, Homo sapiens
uguuaggucucaugccca

SEQ ID NO: 840576 - RNA, 18 nt, Homo sapiens
uguucacuaaacucugaa

SEQ ID NO: 840577 - RNA, 19 nt, Homo sapiens
uguuguaaaauguaaaggu

SEQ ID NO: 840578 - RNA, 17 nt, Homo sapiens
uguugugcagcauuaaa

SEQ ID NO: 840579 - RNA, 16 nt, Homo sapiens
uguuuaauucauuaau

SEQ ID NO: 840580 - RNA, 12 nt, Homo sapiens
uguuugcaaugu

SEQ ID NO: 840581 - RNA, 15 nt, Homo sapiens
uuaaaaaaacugaag

SEQ ID NO: 840582 - RNA, 22 nt, Homo sapiens
uuaaaauauauguucugcaaga

SEQ ID NO: 840583 - RNA, 21 nt, Homo sapiens
uuaaacaaaauuucacaguuc

SEQ ID NO: 840584 - RNA, 20 nt, Homo sapiens
uuaaagaaagucgaauuaau

SEQ ID NO: 840585 - RNA, 22 nt, Homo sapiens
uuaaaggaaaaaucauaaccac

SEQ ID NO: 840586 - RNA, 12 nt, Homo sapiens
uuaacaaagcaa

SEQ ID NO: 840587 - RNA, 16 nt, Homo sapiens
uuaacuaaaugcucau

SEQ ID NO: 840588 - RNA, 14 nt, Homo sapiens
uuaagucagagcca

SEQ ID NO: 840589 - RNA, 22 nt, Homo sapiens
uuaaguuugaaacuaacucaua

SEQ ID NO: 840590 - RNA, 15 nt, Homo sapiens
uuaauuaaagccuua

SEQ ID NO: 840591 - RNA, 16 nt, Homo sapiens
uuauucugugguucua

SEQ ID NO: 840592 - RNA, 14 nt, Homo sapiens
uucaacgacugccg

SEQ ID NO: 840593 - RNA, 19 nt, Homo sapiens
uucaugccuguaaucccag

SEQ ID NO: 840594 - RNA, 20 nt, Homo sapiens
uuccaaauuuagaaagcuua

SEQ ID NO: 840595 - RNA, 17 nt, Homo sapiens
uuccgacaccacuggga

SEQ ID NO: 840596 - RNA, 16 nt, Homo sapiens
uuccucuugaaccaga

SEQ ID NO: 840597 - RNA, 20 nt, Homo sapiens
uucugaaaccaaauguaacu

SEQ ID NO: 840598 - RNA, 13 nt, Homo sapiens
uucugaacaaaga

SEQ ID NO: 840599 - RNA, 13 nt, Homo sapiens
uucugguuccaaa

SEQ ID NO: 840600 - RNA, 22 nt, Homo sapiens
uucuuaaaaguugugauuccag

SEQ ID NO: 840601 - RNA, 21 nt, Homo sapiens
uugaaaaacuuuuagguuguu

SEQ ID NO: 840602 - RNA, 18 nt, Homo sapiens
uugaauagggcuaggaau

SEQ ID NO: 840603 - RNA, 23 nt, Homo sapiens
uugauuaaacagcaaagccauau

SEQ ID NO: 840604 - RNA, 22 nt, Homo sapiens
uugauugguuuaaaagucacau

SEQ ID NO: 840605 - RNA, 12 nt, Homo sapiens
uugcugccuuca

SEQ ID NO: 840606 - RNA, 20 nt, Homo sapiens
uugcuuccugauuaccaguc

SEQ ID NO: 840607 - RNA, 23 nt, Homo sapiens
uugcuuccugauuaccagucuga

SEQ ID NO: 840608 - RNA, 20 nt, Homo sapiens
uuggcaacagaagcaguuga

SEQ ID NO: 840609 - RNA, 17 nt, Homo sapiens
uuggcacugaugcaaug

SEQ ID NO: 840610 - RNA, 22 nt, Homo sapiens
uuggcacuuauagguaacguga

SEQ ID NO: 840611 - RNA, 22 nt, Homo sapiens
uugugauugacuuuuuggcuca

SEQ ID NO: 840612 - RNA, 18 nt, Homo sapiens
uuguuaauaaaaauaaga

SEQ ID NO: 840613 - RNA, 16 nt, Homo sapiens
uuuaaaaaaacugaag

SEQ ID NO: 840614 - RNA, 17 nt, Homo sapiens
uuuaaaccaauugcagg

SEQ ID NO: 840615 - RNA, 13 nt, Homo sapiens
uuuaaagucagau

SEQ ID NO: 840616 - RNA, 20 nt, Homo sapiens
uuuacaguguauuuaagaaa

SEQ ID NO: 840617 - RNA, 14 nt, Homo sapiens
uuuagaaagcuuaa

SEQ ID NO: 840618 - RNA, 17 nt, Homo sapiens
uuuagagcguuugguua

SEQ ID NO: 840619 - RNA, 16 nt, Homo sapiens
uuuaguuacguauaau

SEQ ID NO: 840620 - RNA, 18 nt, Homo sapiens
uuuauaucuuuaugcaaa

SEQ ID NO: 840621 - RNA, 17 nt, Homo sapiens
uuucaggaauugcccau

SEQ ID NO: 840622 - RNA, 17 nt, Homo sapiens
uuucuauuuucucugau

SEQ ID NO: 840623 - RNA, 14 nt, Homo sapiens
uuugaggucuacau

SEQ ID NO: 840624 - RNA, 22 nt, Homo sapiens
uuuggcucauuagcugaauuga

SEQ ID NO: 840625 - RNA, 18 nt, Homo sapiens
uuuggcuugcuguuuacu

SEQ ID NO: 840626 - RNA, 15 nt, Homo sapiens
uuuggggggcacuag

SEQ ID NO: 840627 - RNA, 12 nt, Homo sapiens
uuuuaaagucag

SEQ ID NO: 840628 - RNA, 13 nt, Homo sapiens
uuuucuuacauaa

SEQ ID NO: 840629 - RNA, 17 nt, Homo sapiens
uuuuucccccacugcga

SEQ ID NO: 840630 - RNA, 15 nt, Homo sapiens
uuuuuguacuuugcu

SEQ ID NO: 840631 - RNA, 21 nt, Homo sapiens
uuuuuguacuuuucugguucc

SEQ ID NO: 840632 - RNA, 13 nt, Homo sapiens
uuuuuucccccac

SEQ ID NO: 840633 - RNA, 22 nt, Homo sapiens
uaaauuauauuccucuugcauu

SEQ ID NO: 840634 - RNA, 19 nt, Homo sapiens
uaacacaaguccugugaau

SEQ ID NO: 840635 - RNA, 16 nt, Homo sapiens
uaacuaaaugcucaua

SEQ ID NO: 840636 - RNA, 15 nt, Homo sapiens
uaacuggcauaggaa

SEQ ID NO: 840637 - RNA, 20 nt, Homo sapiens
uaacuggugauauaucucaa

SEQ ID NO: 840638 - RNA, 14 nt, Homo sapiens
uaagcaagccagga

SEQ ID NO: 840639 - RNA, 20 nt, Homo sapiens
uaaguuugaaacuaacucau

SEQ ID NO: 840640 - RNA, 23 nt, Homo sapiens
uaauaaguuuugauauaaucuug

SEQ ID NO: 840641 - RNA, 13 nt, Homo sapiens
uaaucaugcucau

SEQ ID NO: 840642 - RNA, 11 nt, Homo sapiens
uaaugagcucc

SEQ ID NO: 840643 - RNA, 17 nt, Homo sapiens
uaauuagagaacuggag

SEQ ID NO: 840644 - RNA, 20 nt, Homo sapiens
uaauuuaaagaaacacuaaa

SEQ ID NO: 840645 - RNA, 21 nt, Homo sapiens
uacaaggguauccugugcuau

SEQ ID NO: 840646 - RNA, 14 nt, Homo sapiens
uacaaugugacuuu

SEQ ID NO: 840647 - RNA, 13 nt, Homo sapiens
uacacuacuccug

SEQ ID NO: 840648 - RNA, 20 nt, Homo sapiens
uacagcagcacgcauguccc

SEQ ID NO: 840649 - RNA, 18 nt, Homo sapiens
uacaguucauaauucacc

SEQ ID NO: 840650 - RNA, 14 nt, Homo sapiens
uacauauugaauag

SEQ ID NO: 840651 - RNA, 13 nt, Homo sapiens
uaccaauguucua

SEQ ID NO: 840652 - RNA, 14 nt, Homo sapiens
uaccaugugugcua

SEQ ID NO: 840653 - RNA, 22 nt, Homo sapiens
uacuauaacauagaauugcaau

SEQ ID NO: 840654 - RNA, 11 nt, Homo sapiens
uacugcuaccc

SEQ ID NO: 840655 - RNA, 23 nt, Homo sapiens
uagacacccauuuucacauuccc

SEQ ID NO: 840656 - RNA, 22 nt, Homo sapiens
uaguauuuaacuacaucugccu

SEQ ID NO: 840657 - RNA, 20 nt, Homo sapiens
uagugggguuuuauauccau

SEQ ID NO: 840658 - RNA, 15 nt, Homo sapiens
uauaagguaauguag

SEQ ID NO: 840659 - RNA, 14 nt, Homo sapiens
uauaauaacugaac

SEQ ID NO: 840660 - RNA, 22 nt, Homo sapiens
uauaauauuuguguguucacua

SEQ ID NO: 840661 - RNA, 19 nt, Homo sapiens
uauaccaugugugcuaaua

SEQ ID NO: 840662 - RNA, 17 nt, Homo sapiens
uauagauuaaaucauac

SEQ ID NO: 840663 - RNA, 23 nt, Homo sapiens
uauaguuaaucuauaacuacaua

SEQ ID NO: 840664 - RNA, 17 nt, Homo sapiens
uauauagguugugcaaa

SEQ ID NO: 840665 - RNA, 21 nt, Homo sapiens
uaucaaucaccuugcauuuca

SEQ ID NO: 840666 - RNA, 14 nt, Homo sapiens
uauccagaauggaa

SEQ ID NO: 840667 - RNA, 17 nt, Homo sapiens
uaucuauaaacacuguu

SEQ ID NO: 840668 - RNA, 20 nt, Homo sapiens
uauguggacguaaucuccac

SEQ ID NO: 840669 - RNA, 17 nt, Homo sapiens
uauuaaaaaaacacaaa

SEQ ID NO: 840670 - RNA, 15 nt, Homo sapiens
uauuauuugauaucu

SEQ ID NO: 840671 - RNA, 14 nt, Homo sapiens
uauucccagccuug

SEQ ID NO: 840672 - RNA, 12 nt, Homo sapiens
uauucuugucaa

SEQ ID NO: 840673 - RNA, 19 nt, Homo sapiens
uauugaaaguugcuuuuau

SEQ ID NO: 840674 - RNA, 23 nt, Homo sapiens
uauugcuaccaaaaacuagacau

SEQ ID NO: 840675 - RNA, 22 nt, Homo sapiens
ucaaaauaaaaauuaaauguga

SEQ ID NO: 840676 - RNA, 14 nt, Homo sapiens
ucaaaugaacuuuu

SEQ ID NO: 840677 - RNA, 18 nt, Homo sapiens
ucaacgaugugacugcca

SEQ ID NO: 840678 - RNA, 14 nt, Homo sapiens
ucaacucauugcau

SEQ ID NO: 840679 - RNA, 19 nt, Homo sapiens
ucaaucaucugugugaaaa

SEQ ID NO: 840680 - RNA, 22 nt, Homo sapiens
ucacauauuauuggucaagaaa

SEQ ID NO: 840681 - RNA, 16 nt, Homo sapiens
ucacauccuugacuuu

SEQ ID NO: 840682 - RNA, 17 nt, Homo sapiens
ucacaucuaaagcuuua

SEQ ID NO: 840683 - RNA, 21 nt, Homo sapiens
ucaccuugcauuucaaaaugg

SEQ ID NO: 840684 - RNA, 22 nt, Homo sapiens
ucagccuuggcuggaguagaau

SEQ ID NO: 840685 - RNA, 20 nt, Homo sapiens
ucaggaggcagagguugcaa

SEQ ID NO: 840686 - RNA, 18 nt, Homo sapiens
ucagggcaguacaaugug

SEQ ID NO: 840687 - RNA, 18 nt, Homo sapiens
ucauauugcuaccaaaaa

SEQ ID NO: 840688 - RNA, 14 nt, Homo sapiens
ucauauuuuguaua

SEQ ID NO: 840689 - RNA, 20 nt, Homo sapiens
ucauauuuuguauauaucug

SEQ ID NO: 840690 - RNA, 19 nt, Homo sapiens
ucaugccuguaaucccagc

SEQ ID NO: 840691 - RNA, 23 nt, Homo sapiens
ucaugucuguaaucccagcacuu

SEQ ID NO: 840692 - RNA, 17 nt, Homo sapiens
ucauuguggccaguuua

SEQ ID NO: 840693 - RNA, 20 nt, Homo sapiens
uccaaaacacucuggaucuu

SEQ ID NO: 840694 - RNA, 18 nt, Homo sapiens
uccaacgaguaccagcug

SEQ ID NO: 840695 - RNA, 22 nt, Homo sapiens
uccaaucccccagcgcuuagaa

SEQ ID NO: 840696 - RNA, 22 nt, Homo sapiens
uccagaaccuuacuggcacugu

SEQ ID NO: 840697 - RNA, 13 nt, Homo sapiens
uccagugcuucaa

SEQ ID NO: 840698 - RNA, 15 nt, Homo sapiens
uccaugaaaauacca

SEQ ID NO: 840699 - RNA, 15 nt, Homo sapiens
ucccagcuacucggg

SEQ ID NO: 840700 - RNA, 18 nt, Homo sapiens
ucccagucccagccucug

SEQ ID NO: 840701 - RNA, 16 nt, Homo sapiens
ucccccaggagcagcu

SEQ ID NO: 840702 - RNA, 15 nt, Homo sapiens
uccgacaccacuggg

SEQ ID NO: 840703 - RNA, 23 nt, Homo sapiens
uccgggaggacaaccagaccaac

SEQ ID NO: 840704 - RNA, 14 nt, Homo sapiens
uccguggauuuggc

SEQ ID NO: 840705 - RNA, 18 nt, Homo sapiens
uccuaugcuuuagcuuau

SEQ ID NO: 840706 - RNA, 14 nt, Homo sapiens
uccucgggaugaaa

SEQ ID NO: 840707 - RNA, 23 nt, Homo sapiens
uccucugccucccauucugacca

SEQ ID NO: 840708 - RNA, 20 nt, Homo sapiens
uccuuggagugcugcagcuu

SEQ ID NO: 840709 - RNA, 18 nt, Homo sapiens
ucuaaaguuuugcaacaa

SEQ ID NO: 840710 - RNA, 22 nt, Homo sapiens
ucuaaguugaguauauuauaau

SEQ ID NO: 840711 - RNA, 14 nt, Homo sapiens
ucuauaaacacugu

SEQ ID NO: 840712 - RNA, 20 nt, Homo sapiens
ucuauaacuacauauugaau

SEQ ID NO: 840713 - RNA, 13 nt, Homo sapiens
ucuauaccugccu

SEQ ID NO: 840714 - RNA, 17 nt, Homo sapiens
ucuaugagcaugccaag

SEQ ID NO: 840715 - RNA, 12 nt, Homo sapiens
ucucugaucccu

SEQ ID NO: 840716 - RNA, 20 nt, Homo sapiens
ucugaggaucagcacugcca

SEQ ID NO: 840717 - RNA, 20 nt, Homo sapiens
ucugcaagaauuaaaacuga

SEQ ID NO: 840718 - RNA, 14 nt, Homo sapiens
ucuguaauguaggc

SEQ ID NO: 840719 - RNA, 16 nt, Homo sapiens
ucuuaaaaaucuuggu

SEQ ID NO: 840720 - RNA, 15 nt, Homo sapiens
ucuucugaaaccaaa

SEQ ID NO: 840721 - RNA, 12 nt, Homo sapiens
ucuugugauuga

SEQ ID NO: 840722 - RNA, 18 nt, Homo sapiens
ucuuucaacucauugcau

SEQ ID NO: 840723 - RNA, 16 nt, Homo sapiens
ugaaaaauauugcuaa

SEQ ID NO: 840724 - RNA, 16 nt, Homo sapiens
ugaaaccuuucuacuu

SEQ ID NO: 840725 - RNA, 22 nt, Homo sapiens
ugaaacguaauuguacaagcag

SEQ ID NO: 840726 - RNA, 17 nt, Homo sapiens
ugaaaguugcuuuuauu

SEQ ID NO: 840727 - RNA, 19 nt, Homo sapiens
ugaaaucaguaaacacugu

SEQ ID NO: 840728 - RNA, 20 nt, Homo sapiens
ugaaaucaguaaacacugug

SEQ ID NO: 840729 - RNA, 14 nt, Homo sapiens
ugaacgugccugac

SEQ ID NO: 840730 - RNA, 13 nt, Homo sapiens
ugaauaaugauuu

SEQ ID NO: 840731 - RNA, 15 nt, Homo sapiens
ugacaacacaugugg

SEQ ID NO: 840732 - RNA, 21 nt, Homo sapiens
ugacacacugcggugucugca

SEQ ID NO: 840733 - RNA, 22 nt, Homo sapiens
ugacggccaggcucccugacca

SEQ ID NO: 840734 - RNA, 13 nt, Homo sapiens
ugacucaccacga

SEQ ID NO: 840735 - RNA, 14 nt, Homo sapiens
ugacuggccaaaaa

SEQ ID NO: 840736 - RNA, 16 nt, Homo sapiens
ugagacauauuuacaa

SEQ ID NO: 840737 - RNA, 14 nt, Homo sapiens
ugagcaagagccag

SEQ ID NO: 840738 - RNA, 13 nt, Homo sapiens
ugagcacuucuaa

SEQ ID NO: 840739 - RNA, 19 nt, Homo sapiens
ugaguauggcuaucuauac

SEQ ID NO: 840740 - RNA, 23 nt, Homo sapiens
ugaguuucugaggaucagcacug

SEQ ID NO: 840741 - RNA, 19 nt, Homo sapiens
ugauacuuuuuugaaauca

SEQ ID NO: 840742 - RNA, 16 nt, Homo sapiens
ugauagcuaagugagu

SEQ ID NO: 840743 - RNA, 20 nt, Homo sapiens
ugaucuuuguuuaaaugcca

SEQ ID NO: 840744 - RNA, 21 nt, Homo sapiens
ugaucuuuguuuaaaugccaa

SEQ ID NO: 840745 - RNA, 22 nt, Homo sapiens
ugaugccuuccgacaccacugg

SEQ ID NO: 840746 - RNA, 13 nt, Homo sapiens
ugauucccagaaa

SEQ ID NO: 840747 - RNA, 19 nt, Homo sapiens
ugauugguuuaaaagucac

SEQ ID NO: 840748 - RNA, 16 nt, Homo sapiens
ugcaaacugcuuuauu

SEQ ID NO: 840749 - RNA, 12 nt, Homo sapiens
aaaaaauaccau

SEQ ID NO: 840750 - RNA, 11 nt, Homo sapiens
aaaaauaccau

SEQ ID NO: 840751 - RNA, 19 nt, Homo sapiens
aaaacugaaaaucuaauau

SEQ ID NO: 840752 - RNA, 20 nt, Homo sapiens
aaaagacugguuuguuugcu

SEQ ID NO: 840753 - RNA, 22 nt, Homo sapiens
aaaaggauguuacaaguuugcu

SEQ ID NO: 840754 - RNA, 23 nt, Homo sapiens
aaaaggauguuacaaguuugcua

SEQ ID NO: 840755 - RNA, 14 nt, Homo sapiens
aaaauaaaaauuaa

SEQ ID NO: 840756 - RNA, 20 nt, Homo sapiens
aaaaugggaauucugacuua

SEQ ID NO: 840757 - RNA, 21 nt, Homo sapiens
aaaauuagccaggcgcauugg

SEQ ID NO: 840758 - RNA, 19 nt, Homo sapiens
aaacaaaaaaaagaaccuu

SEQ ID NO: 840759 - RNA, 22 nt, Homo sapiens
aaacauaugucugucuuugcaa

SEQ ID NO: 840760 - RNA, 18 nt, Homo sapiens
aaacucuuuaacuuguaa

SEQ ID NO: 840761 - RNA, 17 nt, Homo sapiens
aaacugaaaaucuaaua

SEQ ID NO: 840762 - RNA, 20 nt, Homo sapiens
aaacuuucuacucauuuuaa

SEQ ID NO: 840763 - RNA, 12 nt, Homo sapiens
aaagacugucaa

SEQ ID NO: 840764 - RNA, 13 nt, Homo sapiens
aaagacugucaaa

SEQ ID NO: 840765 - RNA, 15 nt, Homo sapiens
aaagaugauggaaac

SEQ ID NO: 840766 - RNA, 15 nt, Homo sapiens
aaagccuuaagcaca

SEQ ID NO: 840767 - RNA, 16 nt, Homo sapiens
aaagguugcagugagu

SEQ ID NO: 840768 - RNA, 19 nt, Homo sapiens
aaaucagauuuucuccugu

SEQ ID NO: 840769 - RNA, 15 nt, Homo sapiens
aaaucagcaugacaa

SEQ ID NO: 840770 - RNA, 20 nt, Homo sapiens
aaaucaguaaacacugugua

SEQ ID NO: 840771 - RNA, 13 nt, Homo sapiens
aaaucucuaauau

SEQ ID NO: 840772 - RNA, 13 nt, Homo sapiens
aaauggugaagga

SEQ ID NO: 840773 - RNA, 22 nt, Homo sapiens
aaauuacguucuuacaagcuua

SEQ ID NO: 840774 - RNA, 18 nt, Homo sapiens
aaauuauguuuucaucca

SEQ ID NO: 840775 - RNA, 18 nt, Homo sapiens
aacaaauaaaaugaaaua

SEQ ID NO: 840776 - RNA, 12 nt, Homo sapiens
aacaugcuugug

SEQ ID NO: 840777 - RNA, 16 nt, Homo sapiens
aacauggcuacuugcu

SEQ ID NO: 840778 - RNA, 20 nt, Homo sapiens
aacauuaccuugucuuucaa

SEQ ID NO: 840779 - RNA, 15 nt, Homo sapiens
aaccaaagugcagga

SEQ ID NO: 840780 - RNA, 23 nt, Homo sapiens
aaccagaccaaccgccugcagga

SEQ ID NO: 840781 - RNA, 17 nt, Homo sapiens
aaccguggggaggccau

SEQ ID NO: 840782 - RNA, 17 nt, Homo sapiens
aacgugccugacuuuga

SEQ ID NO: 840783 - RNA, 17 nt, Homo sapiens
aacuaguuaaaagccuu

SEQ ID NO: 840784 - RNA, 17 nt, Homo sapiens
aacuauguuuuaucguc

SEQ ID NO: 840785 - RNA, 13 nt, Homo sapiens
aacuggugauaua

SEQ ID NO: 840786 - RNA, 16 nt, Homo sapiens
aacuugcaauaccaau

SEQ ID NO: 840787 - RNA, 15 nt, Homo sapiens
aagaacuugcaauac

SEQ ID NO: 840788 - RNA, 22 nt, Homo sapiens
aaucuauaacuacauauugaau

SEQ ID NO: 840789 - RNA, 23 nt, Homo sapiens
aaucuuggcuucuuaaaaacugu

SEQ ID NO: 840790 - RNA, 15 nt, Homo sapiens
aaugaggacauguuu

SEQ ID NO: 840791 - RNA, 14 nt, Homo sapiens
aaugcagccuuaaa

SEQ ID NO: 840792 - RNA, 20 nt, Homo sapiens
aaugcccugccuugcugccu

SEQ ID NO: 840793 - RNA, 19 nt, Homo sapiens
aaugcuuugguucuggguu

SEQ ID NO: 840794 - RNA, 20 nt, Homo sapiens
aaugguaggucaaguaauaa

SEQ ID NO: 840795 - RNA, 16 nt, Homo sapiens
aauuaaacuaguuuaa

SEQ ID NO: 840796 - RNA, 14 nt, Homo sapiens
aauuaaagccuuaa

SEQ ID NO: 840797 - RNA, 19 nt, Homo sapiens
aauuaauaauagauuguga

SEQ ID NO: 840798 - RNA, 22 nt, Homo sapiens
aauuacguucuuacaagcuuaa

SEQ ID NO: 840799 - RNA, 23 nt, Homo sapiens
aauuuuugaaaaauauugcuaaa

SEQ ID NO: 840800 - RNA, 16 nt, Homo sapiens
acaaagucaacuucca

SEQ ID NO: 840801 - RNA, 22 nt, Homo sapiens
acaaaugaaauaaauauugugu

SEQ ID NO: 840802 - RNA, 12 nt, Homo sapiens
acacauacacac

SEQ ID NO: 840803 - RNA, 21 nt, Homo sapiens
acaccacugggaaccaagggc

SEQ ID NO: 840804 - RNA, 23 nt, Homo sapiens
acagaagucaggugucaucauca

SEQ ID NO: 840805 - RNA, 15 nt, Homo sapiens
acagaccgugaacac

SEQ ID NO: 840806 - RNA, 21 nt, Homo sapiens
acagcagcagcaaacaaauaa

SEQ ID NO: 840807 - RNA, 15 nt, Homo sapiens
acagccucugacuca

SEQ ID NO: 840808 - RNA, 21 nt, Homo sapiens
acauacaaaaaaaaucuuuaa

SEQ ID NO: 840809 - RNA, 15 nt, Homo sapiens
acauagaauugcaau

SEQ ID NO: 840810 - RNA, 20 nt, Homo sapiens
acauaugucugucuuugcaa

SEQ ID NO: 840811 - RNA, 10 nt, Homo sapiens
acaucugccu

SEQ ID NO: 840812 - RNA, 18 nt, Homo sapiens
acauguuugguaccaaga

SEQ ID NO: 840813 - RNA, 19 nt, Homo sapiens
acauuaaacaaugaucaca

SEQ ID NO: 840814 - RNA, 12 nt, Homo sapiens
accaacuuucug

SEQ ID NO: 840815 - RNA, 21 nt, Homo sapiens
accaauguucuaaaguuuugc

SEQ ID NO: 840816 - RNA, 17 nt, Homo sapiens
accguggggaggccauu

SEQ ID NO: 840817 - RNA, 16 nt, Homo sapiens
accuaaaccaccagug

SEQ ID NO: 840818 - RNA, 13 nt, Homo sapiens
accucggugaugc

SEQ ID NO: 840819 - RNA, 19 nt, Homo sapiens
accuugcauuucaaaaugg

SEQ ID NO: 840820 - RNA, 12 nt, Homo sapiens
acuaaacucuga

SEQ ID NO: 840821 - RNA, 13 nt, Homo sapiens
acuacaucugccu

SEQ ID NO: 840822 - RNA, 19 nt, Homo sapiens
acuacuccugaggaugcua

SEQ ID NO: 840823 - RNA, 14 nt, Homo sapiens
acucagaggaccca

SEQ ID NO: 840824 - RNA, 13 nt, Homo sapiens
acugacucuguua

SEQ ID NO: 840825 - RNA, 14 nt, Homo sapiens
acugcaagcauuuu

SEQ ID NO: 840826 - RNA, 15 nt, Homo sapiens
acuggacagccaggg

SEQ ID NO: 840827 - RNA, 19 nt, Homo sapiens
acuggcacuguggcacugc

SEQ ID NO: 840828 - RNA, 13 nt, Homo sapiens
acuggccaaaaau

SEQ ID NO: 840829 - RNA, 23 nt, Homo sapiens
acuugauucuugugauugacuuu

SEQ ID NO: 840830 - RNA, 12 nt, Homo sapiens
acuugcaauacc

SEQ ID NO: 840831 - RNA, 15 nt, Homo sapiens
acuugcuacuuauca

SEQ ID NO: 840832 - RNA, 21 nt, Homo sapiens
gaauaauguacguacuaccua

SEQ ID NO: 840833 - RNA, 15 nt, Homo sapiens
gaauugagcuagaaa

SEQ ID NO: 840834 - RNA, 12 nt, Homo sapiens
gaauugcaaucu

SEQ ID NO: 840835 - RNA, 16 nt, Homo sapiens
gacagccucugacuca

SEQ ID NO: 840836 - RNA, 17 nt, Homo sapiens
gacagccucugacucac

SEQ ID NO: 840837 - RNA, 17 nt, Homo sapiens
gacugugcccaguacuu

SEQ ID NO: 840838 - RNA, 23 nt, Homo sapiens
gacuuuuuuaaauguuugcaaug

SEQ ID NO: 840839 - RNA, 18 nt, Homo sapiens
gagaaugacauugauucu

SEQ ID NO: 840840 - RNA, 18 nt, Homo sapiens
gagcuauuuuaaaccaau

SEQ ID NO: 840841 - RNA, 17 nt, Homo sapiens
gagcuggagaacaggau

SEQ ID NO: 840842 - RNA, 13 nt, Homo sapiens
gagguugcaauga

SEQ ID NO: 840843 - RNA, 20 nt, Homo sapiens
gagucacccccccaggccuc

SEQ ID NO: 840844 - RNA, 19 nt, Homo sapiens
gaguccaugaaaauaccau

SEQ ID NO: 840845 - RNA, 19 nt, Homo sapiens
gaguuacuuagaaugccau

SEQ ID NO: 840846 - RNA, 18 nt, Homo sapiens
gaguuuuuaauggccauu

SEQ ID NO: 840847 - RNA, 17 nt, Homo sapiens
gauauauaggacauuga

SEQ ID NO: 840848 - RNA, 12 nt, Homo sapiens
gauauaucucaa

SEQ ID NO: 840849 - RNA, 21 nt, Homo sapiens
gaucagaugcugaauugagaa

SEQ ID NO: 840850 - RNA, 15 nt, Homo sapiens
gaucagcacugccag

SEQ ID NO: 840851 - RNA, 16 nt, Homo sapiens
gaucugcucgcugaga

SEQ ID NO: 840852 - RNA, 15 nt, Homo sapiens
gaucuguacuuugug

SEQ ID NO: 840853 - RNA, 20 nt, Homo sapiens
gaugaaauuuucuagacuuu

SEQ ID NO: 840854 - RNA, 15 nt, Homo sapiens
gaugaacgugccuga

SEQ ID NO: 840855 - RNA, 18 nt, Homo sapiens
gauuaccagucugauuau

SEQ ID NO: 840856 - RNA, 17 nt, Homo sapiens
gauuaguacuggauuau

SEQ ID NO: 840857 - RNA, 14 nt, Homo sapiens
gauuuccucuugaa

SEQ ID NO: 840858 - RNA, 14 nt, Homo sapiens
gauuucucuuugaa

SEQ ID NO: 840859 - RNA, 21 nt, Homo sapiens
gauuuguauaaggaaagccaa

SEQ ID NO: 840860 - RNA, 19 nt, Homo sapiens
gcaaagguugcagugaguu

SEQ ID NO: 840861 - RNA, 20 nt, Homo sapiens
gcaacucaaagaugauggaa

SEQ ID NO: 840862 - RNA, 17 nt, Homo sapiens
gcaacucgugacagccu

SEQ ID NO: 840863 - RNA, 19 nt, Homo sapiens
gcaagacaguggcacuaaa

SEQ ID NO: 840864 - RNA, 20 nt, Homo sapiens
gcaagaucugcucgcugaga

SEQ ID NO: 840865 - RNA, 16 nt, Homo sapiens
gcaagauguacuauaa

SEQ ID NO: 840866 - RNA, 13 nt, Homo sapiens
gcaauaccaaugu

SEQ ID NO: 840867 - RNA, 15 nt, Homo sapiens
gcacaagaaggccag

SEQ ID NO: 840868 - RNA, 21 nt, Homo sapiens
gcacaguaauaugaaagccac

SEQ ID NO: 840869 - RNA, 13 nt, Homo sapiens
gcacucagaggga

SEQ ID NO: 840870 - RNA, 13 nt, Homo sapiens
gcagcagcaaaca

SEQ ID NO: 840871 - RNA, 16 nt, Homo sapiens
gcagccgugcaggacu

SEQ ID NO: 840872 - RNA, 16 nt, Homo sapiens
gcagcuggcacugaca

SEQ ID NO: 840873 - RNA, 16 nt, Homo sapiens
gcaguacaaugugacu

SEQ ID NO: 840874 - RNA, 12 nt, Homo sapiens
gcaucagcuuuu

SEQ ID NO: 840875 - RNA, 15 nt, Homo sapiens
gcaugaaaacugaga

SEQ ID NO: 840876 - RNA, 15 nt, Homo sapiens
gcauuaauauucuuu

SEQ ID NO: 840877 - RNA, 22 nt, Homo sapiens
gccaacagguggggagagacag

SEQ ID NO: 840878 - RNA, 20 nt, Homo sapiens
gccaagaucgcgccacugca

SEQ ID NO: 840879 - RNA, 16 nt, Homo sapiens
gcccagggaugcaaag

SEQ ID NO: 840880 - RNA, 13 nt, Homo sapiens
gcccucacucagg

SEQ ID NO: 840881 - RNA, 14 nt, Homo sapiens
gccgccaugagcaa

SEQ ID NO: 840882 - RNA, 21 nt, Homo sapiens
gccuccagaaccuuacuggca

SEQ ID NO: 840883 - RNA, 14 nt, Homo sapiens
gccugggugacaga

SEQ ID NO: 840884 - RNA, 12 nt, Homo sapiens
gcggccacagca

SEQ ID NO: 840885 - RNA, 20 nt, Homo sapiens
gcggccuacagaaaaaggaa

SEQ ID NO: 840886 - RNA, 12 nt, Homo sapiens
gcgucacuacug

SEQ ID NO: 840887 - RNA, 22 nt, Homo sapiens
gcuaccaaaaacuagacauuau

SEQ ID NO: 840888 - RNA, 14 nt, Homo sapiens
gcuacuugcuuuga

SEQ ID NO: 840889 - RNA, 24 nt, Homo sapiens
gcuauggaaugguuaugaagggaa

SEQ ID NO: 840890 - RNA, 20 nt, Homo sapiens
gcucagccuuggcuggagua

SEQ ID NO: 840891 - RNA, 16 nt, Homo sapiens
gcucgcuacacuacuc

SEQ ID NO: 840892 - RNA, 16 nt, Homo sapiens
gcucuagaaaguauag

SEQ ID NO: 840893 - RNA, 18 nt, Homo sapiens
gcugcucuaagaagggaa

SEQ ID NO: 840894 - RNA, 16 nt, Homo sapiens
gcuguggacacugaga

SEQ ID NO: 840895 - RNA, 15 nt, Homo sapiens
gcuuaaagcuugauu

SEQ ID NO: 840896 - RNA, 23 nt, Homo sapiens
gcuuacuuacaaaagcagcuuuu

SEQ ID NO: 840897 - RNA, 16 nt, Homo sapiens
ggaaagucaccuacag

SEQ ID NO: 840898 - RNA, 24 nt, Homo sapiens
ggagaauuauauagguugugcaaa

SEQ ID NO: 840899 - RNA, 19 nt, Homo sapiens
ggaggcagagguugcaaug

SEQ ID NO: 840900 - RNA, 15 nt, Homo sapiens
ggagugcugcagcuu

SEQ ID NO: 840901 - RNA, 18 nt, Homo sapiens
ggauggccucuggggcag

SEQ ID NO: 840902 - RNA, 20 nt, Homo sapiens
ggauuuauugagugccaacu

SEQ ID NO: 840903 - RNA, 18 nt, Homo sapiens
ggcacuguggcacugcca

SEQ ID NO: 840904 - RNA, 17 nt, Homo sapiens
ggcacuuuuauuuucau

SEQ ID NO: 840905 - RNA, 12 nt, Homo sapiens
ggcaguacaaug

SEQ ID NO: 840906 - RNA, 21 nt, Homo sapiens
ggccacaaaaguucccucuca

SEQ ID NO: 840907 - RNA, 16 nt, Homo sapiens
ggccagcgcgaugaac

SEQ ID NO: 840908 - RNA, 22 nt, Homo sapiens
ggcccucacucaggaacccugg

SEQ ID NO: 840909 - RNA, 19 nt, Homo sapiens
ggccucuggggcaggacca

SEQ ID NO: 840910 - RNA, 18 nt, Homo sapiens
ggcgcuggacaccuacag

SEQ ID NO: 840911 - RNA, 14 nt, Homo sapiens
ggcuaacacgguga

SEQ ID NO: 840912 - RNA, 20 nt, Homo sapiens
ggcugucuucucccagagca

SEQ ID NO: 840913 - RNA, 23 nt, Homo sapiens
gggaaccaagggcccucacucag

SEQ ID NO: 840914 - RNA, 20 nt, Homo sapiens
gggauuucauuucaggugca

SEQ ID NO: 840915 - RNA, 19 nt, Homo sapiens
gggccgcucucccccugca

SEQ ID NO: 840916 - RNA, 19 nt, Homo sapiens
gguaaaagcaccauuguga

SEQ ID NO: 840917 - RNA, 23 nt, Homo sapiens
ggucugggugggggcaaagagac

SEQ ID NO: 840918 - RNA, 17 nt, Homo sapiens
ggugaaaccccaucucu

SEQ ID NO: 840919 - RNA, 23 nt, Homo sapiens
ggugacagagcgagaccgucuca

SEQ ID NO: 840920 - RNA, 20 nt, Homo sapiens
guaagagagaugagcacuuc

SEQ ID NO: 840921 - RNA, 20 nt, Homo sapiens
guaaucccagcacuauggga

SEQ ID NO: 840922 - RNA, 15 nt, Homo sapiens
guacaaugugacuuu

SEQ ID NO: 840923 - RNA, 18 nt, Homo sapiens
guacaaugugacuuugaa

SEQ ID NO: 840924 - RNA, 18 nt, Homo sapiens
guagagguuuuguuguuu

SEQ ID NO: 840925 - RNA, 16 nt, Homo sapiens
guauuuaagaaaggga

SEQ ID NO: 840926 - RNA, 17 nt, Homo sapiens
gucaguacgagcugcuc

SEQ ID NO: 840927 - RNA, 14 nt, Homo sapiens
gucauggaggccaa

SEQ ID NO: 840928 - RNA, 23 nt, Homo sapiens
guccauuucuuauuuaauuagaa

SEQ ID NO: 840929 - RNA, 23 nt, Homo sapiens
guccuuggagugcugcagcuuug

SEQ ID NO: 840930 - RNA, 14 nt, Homo sapiens
gucuaaauguuugu

SEQ ID NO: 840931 - RNA, 15 nt, Homo sapiens
gugaauuucuucacu

SEQ ID NO: 840932 - RNA, 11 nt, Homo sapiens
gugacuuugaa

SEQ ID NO: 840933 - RNA, 13 nt, Homo sapiens
gugagaaggcaac

SEQ ID NO: 840934 - RNA, 16 nt, Homo sapiens
gugaugaacgugccug

SEQ ID NO: 840935 - RNA, 12 nt, Homo sapiens
gugcagcauuaa

SEQ ID NO: 840936 - RNA, 13 nt, Homo sapiens
gugcagcauuaaa

SEQ ID NO: 840937 - RNA, 14 nt, Homo sapiens
gugcugcuuugaua

SEQ ID NO: 840938 - RNA, 18 nt, Homo sapiens
guggaaagucaccuacag

SEQ ID NO: 840939 - RNA, 18 nt, Homo sapiens
guggcacugccaccagca

SEQ ID NO: 840940 - RNA, 16 nt, Homo sapiens
gugguggccagcagca

SEQ ID NO: 840941 - RNA, 13 nt, Homo sapiens
gugucugcagcuc

SEQ ID NO: 840942 - RNA, 16 nt, Homo sapiens
guuaauaaaaauaaga

SEQ ID NO: 840943 - RNA, 15 nt, Homo sapiens
guuaccaaguaugaa

SEQ ID NO: 840944 - RNA, 19 nt, Homo sapiens
guuaugaagggaagcgaga

SEQ ID NO: 840945 - RNA, 16 nt, Homo sapiens
guuccagguggacaaa

SEQ ID NO: 840946 - RNA, 16 nt, Homo sapiens
guugacuggccaaaaa

SEQ ID NO: 840947 - RNA, 10 nt, Homo sapiens
guugcaauga

SEQ ID NO: 840948 - RNA, 13 nt, Homo sapiens
guuuaaaugccaa

SEQ ID NO: 840949 - RNA, 21 nt, Homo sapiens
ugacaucauucagcgcaugca

SEQ ID NO: 840950 - RNA, 13 nt, Homo sapiens
ugacuggccaaaa

SEQ ID NO: 840951 - RNA, 15 nt, Homo sapiens
ugacuggccaaaaau

SEQ ID NO: 840952 - RNA, 17 nt, Homo sapiens
ugacuuuuuagaugugc

SEQ ID NO: 840953 - RNA, 23 nt, Homo sapiens
ugagaaggcaaccaaagugcagg

SEQ ID NO: 840954 - RNA, 23 nt, Homo sapiens
ugagagcaaaaugcauguaauca

SEQ ID NO: 840955 - RNA, 12 nt, Homo sapiens
ugaguuacuuag

SEQ ID NO: 840956 - RNA, 15 nt, Homo sapiens
ugauuaaacagcaaa

SEQ ID NO: 840957 - RNA, 21 nt, Homo sapiens
ugauuaccagucugauuauac

SEQ ID NO: 840958 - RNA, 20 nt, Homo sapiens
ugauuucuaguaucuauugu

SEQ ID NO: 840959 - RNA, 16 nt, Homo sapiens
ugcaaagguugcagug

SEQ ID NO: 840960 - RNA, 21 nt, Homo sapiens
ugcaaauauugguuaguauuu

SEQ ID NO: 840961 - RNA, 20 nt, Homo sapiens
ugcaacaauaaaguacuuua

SEQ ID NO: 840962 - RNA, 19 nt, Homo sapiens
ugcaagaauuaaaacugag

SEQ ID NO: 840963 - RNA, 22 nt, Homo sapiens
ugcacaguaauaugaaagccac

SEQ ID NO: 840964 - RNA, 22 nt, Homo sapiens
ugcaggccaggccagcuucccc

SEQ ID NO: 840965 - RNA, 22 nt, Homo sapiens
ugcaggucugauucccagaaau

SEQ ID NO: 840966 - RNA, 23 nt, Homo sapiens
ugcagugaguugagucaugggau

SEQ ID NO: 840967 - RNA, 14 nt, Homo sapiens
ugcaucauuuacaa

SEQ ID NO: 840968 - RNA, 17 nt, Homo sapiens
ugcauuuucauauugcu

SEQ ID NO: 840969 - RNA, 13 nt, Homo sapiens
ugccaugcuuuuu

SEQ ID NO: 840970 - RNA, 19 nt, Homo sapiens
ugccugggguguaaugagc

SEQ ID NO: 840971 - RNA, 13 nt, Homo sapiens
ugccugguuuuau

SEQ ID NO: 840972 - RNA, 20 nt, Homo sapiens
ugcgcuguggacacugagaa

SEQ ID NO: 840973 - RNA, 13 nt, Homo sapiens
ugcuacauggggu

SEQ ID NO: 840974 - RNA, 12 nt, Homo sapiens
ugcuaccaaaaa

SEQ ID NO: 840975 - RNA, 17 nt, Homo sapiens
ugcuaugcuggacauua

SEQ ID NO: 840976 - RNA, 18 nt, Homo sapiens
ugcucauguauauuuagu

SEQ ID NO: 840977 - RNA, 13 nt, Homo sapiens
ugcugcccugggg

SEQ ID NO: 840978 - RNA, 14 nt, Homo sapiens
ugcuugauuaaaca

SEQ ID NO: 840979 - RNA, 14 nt, Homo sapiens
uggaaggugucauu

SEQ ID NO: 840980 - RNA, 14 nt, Homo sapiens
uggacacugagaac

SEQ ID NO: 840981 - RNA, 16 nt, Homo sapiens
uggagcaaauguccua

SEQ ID NO: 840982 - RNA, 22 nt, Homo sapiens
uggaguagaauuaagucagagc

SEQ ID NO: 840983 - RNA, 15 nt, Homo sapiens
uggcacugacagccu

SEQ ID NO: 840984 - RNA, 16 nt, Homo sapiens
uggcucuuuguguguc

SEQ ID NO: 840985 - RNA, 12 nt, Homo sapiens
uggcuuacuuac

SEQ ID NO: 840986 - RNA, 16 nt, Homo sapiens
uggcuuuacaaauaau

SEQ ID NO: 840987 - RNA, 17 nt, Homo sapiens
ugggagaggagguccuu

SEQ ID NO: 840988 - RNA, 21 nt, Homo sapiens
ugggcaacucgugacagccuc

SEQ ID NO: 840989 - RNA, 17 nt, Homo sapiens
ugggcagugagugccau

SEQ ID NO: 840990 - RNA, 19 nt, Homo sapiens
uggggaaauggugaaggaa

SEQ ID NO: 840991 - RNA, 14 nt, Homo sapiens
uggggagagacaga

SEQ ID NO: 840992 - RNA, 17 nt, Homo sapiens
uggggcagcagcugccu

SEQ ID NO: 840993 - RNA, 23 nt, Homo sapiens
uggucauccgggaggacaaccag

SEQ ID NO: 840994 - RNA, 12 nt, Homo sapiens
ugguuaaaguau

SEQ ID NO: 840995 - RNA, 16 nt, Homo sapiens
ugguugauucacacuu

SEQ ID NO: 840996 - RNA, 15 nt, Homo sapiens
ugguuuaaaagucac

SEQ ID NO: 840997 - RNA, 23 nt, Homo sapiens
uguaacacagcugagagacuuuu

SEQ ID NO: 840998 - RNA, 14 nt, Homo sapiens
uguaacagugcaag

SEQ ID NO: 840999 - RNA, 19 nt, Homo sapiens
uguaaucccagcacuaugg

SEQ ID NO: 841000 - RNA, 21 nt, Homo sapiens
uguacuuuucugguuccaaac

SEQ ID NO: 841001 - RNA, 23 nt, Homo sapiens
uguauccccccccuguauaguua

SEQ ID NO: 841002 - RNA, 19 nt, Homo sapiens
ugucagggcaguacaaugu

SEQ ID NO: 841003 - RNA, 17 nt, Homo sapiens
ugugacugccaucaucu

SEQ ID NO: 841004 - RNA, 18 nt, Homo sapiens
ugugcccaguacuuccug

SEQ ID NO: 841005 - RNA, 13 nt, Homo sapiens
uguggccaguuua

SEQ ID NO: 841006 - RNA, 21 nt, Homo sapiens
uguucaguuagcauggauuua

SEQ ID NO: 841007 - RNA, 18 nt, Homo sapiens
uguugacuggccaaaaau

SEQ ID NO: 841008 - RNA, 22 nt, Homo sapiens
uguugacuggccaaaaauaucu

SEQ ID NO: 841009 - RNA, 15 nt, Homo sapiens
uuaaaaaacuuucua

SEQ ID NO: 841010 - RNA, 14 nt, Homo sapiens
uuaaaaaucuuggu

SEQ ID NO: 841011 - RNA, 15 nt, Homo sapiens
uuaaaagucauuauu

SEQ ID NO: 841012 - RNA, 15 nt, Homo sapiens
uuaaaguauguccuu

SEQ ID NO: 841013 - RNA, 17 nt, Homo sapiens
uuaaauguuugcaaugu

SEQ ID NO: 841014 - RNA, 14 nt, Homo sapiens
uuaauauaucccag

SEQ ID NO: 841015 - RNA, 16 nt, Homo sapiens
uuaaucuauaacuaca

SEQ ID NO: 841016 - RNA, 18 nt, Homo sapiens
uuaaucuauaacuacaua

SEQ ID NO: 841017 - RNA, 14 nt, Homo sapiens
uuaauggacuguga

SEQ ID NO: 841018 - RNA, 17 nt, Homo sapiens
uuacaaaagcagcuuuu

SEQ ID NO: 841019 - RNA, 13 nt, Homo sapiens
uuagaaagcuuaa

SEQ ID NO: 841020 - RNA, 20 nt, Homo sapiens
uuagaugugcugcuuugaua

SEQ ID NO: 841021 - RNA, 22 nt, Homo sapiens
uuagaugugcugcuuugauaua

SEQ ID NO: 841022 - RNA, 15 nt, Homo sapiens
uuauaauaacugaac

SEQ ID NO: 841023 - RNA, 17 nt, Homo sapiens
uuauaguuaaucuauaa

SEQ ID NO: 841024 - RNA, 21 nt, Homo sapiens
uuaucguccagugacuuucag

SEQ ID NO: 841025 - RNA, 22 nt, Homo sapiens
uucaacgacugccgugacauca

SEQ ID NO: 841026 - RNA, 15 nt, Homo sapiens
uucaacgaugugacu

SEQ ID NO: 841027 - RNA, 20 nt, Homo sapiens
uucaggugcuggagaaucug

SEQ ID NO: 841028 - RNA, 10 nt, Homo sapiens
uucauugugu

SEQ ID NO: 841029 - RNA, 20 nt, Homo sapiens
uuccagguggacaaagucaa

SEQ ID NO: 841030 - RNA, 12 nt, Homo sapiens
uuccaugcacuc

SEQ ID NO: 841031 - RNA, 18 nt, Homo sapiens
uucuaaaguuuugcaaca

SEQ ID NO: 841032 - RNA, 14 nt, Homo sapiens
uucuaacauaagua

SEQ ID NO: 841033 - RNA, 17 nt, Homo sapiens
uucucuuggacauugua

SEQ ID NO: 841034 - RNA, 20 nt, Homo sapiens
uucugagugaguuuuacucu

SEQ ID NO: 841035 - RNA, 12 nt, Homo sapiens
uucuugugauug

SEQ ID NO: 841036 - RNA, 16 nt, Homo sapiens
uugacuuuuuggcuca

SEQ ID NO: 841037 - RNA, 21 nt, Homo sapiens
uugcaaauauugguuaguauu

SEQ ID NO: 841038 - RNA, 22 nt, Homo sapiens
uugcaaauauugguuaguauuu

SEQ ID NO: 841039 - RNA, 10 nt, Homo sapiens
uugcaauacc

SEQ ID NO: 841040 - RNA, 11 nt, Homo sapiens
uugcacauaaa

SEQ ID NO: 841041 - RNA, 20 nt, Homo sapiens
uugcccauuguuuuucugau

SEQ ID NO: 841042 - RNA, 13 nt, Homo sapiens
uuggcaacagaag

SEQ ID NO: 841043 - RNA, 22 nt, Homo sapiens
uuggcucaugucuguaauccca

SEQ ID NO: 841044 - RNA, 15 nt, Homo sapiens
uugggaaagcugccu

SEQ ID NO: 841045 - RNA, 16 nt, Homo sapiens
uuguacaagauuguca

SEQ ID NO: 841046 - RNA, 23 nt, Homo sapiens
uuguguguucacuaaacucugaa

SEQ ID NO: 841047 - RNA, 14 nt, Homo sapiens
uuuaaaaaauacca

SEQ ID NO: 841048 - RNA, 16 nt, Homo sapiens
uuuaaaagucacauaa

SEQ ID NO: 841049 - RNA, 13 nt, Homo sapiens
uuuaaaagucauu

SEQ ID NO: 841050 - RNA, 19 nt, Homo sapiens
uuuaauuaaaaacuuuaaa

SEQ ID NO: 841051 - RNA, 19 nt, Homo sapiens
uuuagaugugcugcuuuga

SEQ ID NO: 841052 - RNA, 21 nt, Homo sapiens
uuuagaugugcugcuuugaua

SEQ ID NO: 841053 - RNA, 13 nt, Homo sapiens
uuucauagauuug

SEQ ID NO: 841054 - RNA, 19 nt, Homo sapiens
uuucauguauguauauaau

SEQ ID NO: 841055 - RNA, 18 nt, Homo sapiens
uuuccucuugaaccagaa

SEQ ID NO: 841056 - RNA, 13 nt, Homo sapiens
uuucuguaaacuc

SEQ ID NO: 841057 - RNA, 21 nt, Homo sapiens
uuugcaauggcuauauggcaa

SEQ ID NO: 841058 - RNA, 14 nt, Homo sapiens
uuugguaccaagaa

SEQ ID NO: 841059 - RNA, 18 nt, Homo sapiens
uuuguacaagauugucau

SEQ ID NO: 841060 - RNA, 20 nt, Homo sapiens
uuuuaaaguaaacuugugua

SEQ ID NO: 841061 - RNA, 22 nt, Homo sapiens
uuuuaaguuugaaacuaacuca

SEQ ID NO: 841062 - RNA, 15 nt, Homo sapiens
uuuuacuuugguuua

SEQ ID NO: 841063 - RNA, 19 nt, Homo sapiens
uuuugguuccucacauauu

SEQ ID NO: 841064 - RNA, 11 nt, Homo sapiens
uuuuuccaaau

SEQ ID NO: 841065 - RNA, 15 nt, Homo sapiens
gaucgacgugaucaa

SEQ ID NO: 841066 - RNA, 17 nt, Homo sapiens
gaugaaacccuaucucu

SEQ ID NO: 841067 - RNA, 23 nt, Homo sapiens
gaugccuuccgacaccacuggga

SEQ ID NO: 841068 - RNA, 18 nt, Homo sapiens
gauucaggugcuggagaa

SEQ ID NO: 841069 - RNA, 20 nt, Homo sapiens
gauucuaggcggaagcgaua

SEQ ID NO: 841070 - RNA, 15 nt, Homo sapiens
gauugaggacuacuu

SEQ ID NO: 841071 - RNA, 18 nt, Homo sapiens
gcaaacaaauaaaaugaa

SEQ ID NO: 841072 - RNA, 20 nt, Homo sapiens
gcaaacaaauaaaaugaaau

SEQ ID NO: 841073 - RNA, 23 nt, Homo sapiens
gcaaacaaauggcuuacuuacaa

SEQ ID NO: 841074 - RNA, 14 nt, Homo sapiens
gcaaacugcuuuau

SEQ ID NO: 841075 - RNA, 15 nt, Homo sapiens
gcaaagguugcagug

SEQ ID NO: 841076 - RNA, 17 nt, Homo sapiens
gcaacaauaaaguacuu

SEQ ID NO: 841077 - RNA, 21 nt, Homo sapiens
gcacaauuaauuaaaagugaa

SEQ ID NO: 841078 - RNA, 22 nt, Homo sapiens
gcacaauuaauuaaaagugaaa

SEQ ID NO: 841079 - RNA, 16 nt, Homo sapiens
gcacccaaguugggau

SEQ ID NO: 841080 - RNA, 19 nt, Homo sapiens
gcacuaaauaaacuacuuu

SEQ ID NO: 841081 - RNA, 23 nt, Homo sapiens
gcagcaaacaaauaaaaugaaau

SEQ ID NO: 841082 - RNA, 20 nt, Homo sapiens
gcagcauuaaaaaaaaucaa

SEQ ID NO: 841083 - RNA, 17 nt, Homo sapiens
gcagcccccacugaccu

SEQ ID NO: 841084 - RNA, 18 nt, Homo sapiens
gcagcccccacugaccug

SEQ ID NO: 841085 - RNA, 22 nt, Homo sapiens
gcagucauggaggccaagaacu

SEQ ID NO: 841086 - RNA, 16 nt, Homo sapiens
gcaucuggaacaacag

SEQ ID NO: 841087 - RNA, 18 nt, Homo sapiens
gcaugauuaacaaagcaa

SEQ ID NO: 841088 - RNA, 12 nt, Homo sapiens
gccaacaggugg

SEQ ID NO: 841089 - RNA, 17 nt, Homo sapiens
gccaagcuaaucugccu

SEQ ID NO: 841090 - RNA, 20 nt, Homo sapiens
gccacagcacuagagucacc

SEQ ID NO: 841091 - RNA, 11 nt, Homo sapiens
gcccacugggc

SEQ ID NO: 841092 - RNA, 12 nt, Homo sapiens
gcccacugggcc

SEQ ID NO: 841093 - RNA, 19 nt, Homo sapiens
gcccucccccagcaguuga

SEQ ID NO: 841094 - RNA, 19 nt, Homo sapiens
gccgcagcccccacugacc

SEQ ID NO: 841095 - RNA, 15 nt, Homo sapiens
gccgccaugagcaac

SEQ ID NO: 841096 - RNA, 19 nt, Homo sapiens
gccuaggguggucugggag

SEQ ID NO: 841097 - RNA, 13 nt, Homo sapiens
gcgaagaggaccc

SEQ ID NO: 841098 - RNA, 15 nt, Homo sapiens
gcgauggcagugaga

SEQ ID NO: 841099 - RNA, 23 nt, Homo sapiens
gcgcugggacggcccaucuuggc

SEQ ID NO: 841100 - RNA, 12 nt, Homo sapiens
gcuaaucugccu

SEQ ID NO: 841101 - RNA, 18 nt, Homo sapiens
gcuacauggggucugggu

SEQ ID NO: 841102 - RNA, 13 nt, Homo sapiens
gcuagugccaaau

SEQ ID NO: 841103 - RNA, 18 nt, Homo sapiens
gcuaguucguagcuuucc

SEQ ID NO: 841104 - RNA, 14 nt, Homo sapiens
gcuauuacugucug

SEQ ID NO: 841105 - RNA, 17 nt, Homo sapiens
gcucauuuuuucuuaca

SEQ ID NO: 841106 - RNA, 17 nt, Homo sapiens
gcuccugcucauugugg

SEQ ID NO: 841107 - RNA, 23 nt, Homo sapiens
gcugcuaaagggagaaaugccag

SEQ ID NO: 841108 - RNA, 19 nt, Homo sapiens
uaccauuauuuuacagucu

SEQ ID NO: 841109 - RNA, 23 nt, Homo sapiens
uacccuauaucuauaaacacugu

SEQ ID NO: 841110 - RNA, 18 nt, Homo sapiens
uagaaagcaagauguacu

SEQ ID NO: 841111 - RNA, 17 nt, Homo sapiens
uagaguuuacaguuugu

SEQ ID NO: 841112 - RNA, 14 nt, Homo sapiens
uagauugugaauaa

SEQ ID NO: 841113 - RNA, 22 nt, Homo sapiens
uagcaaacaaauggcuuacuua

SEQ ID NO: 841114 - RNA, 20 nt, Homo sapiens
uagcuuucccaaauaaacuc

SEQ ID NO: 841115 - RNA, 15 nt, Homo sapiens
uaggaagacauaaaa

SEQ ID NO: 841116 - RNA, 22 nt, Homo sapiens
uaggaauauagauuaaaucaua

SEQ ID NO: 841117 - RNA, 16 nt, Homo sapiens
uaggacauugauuuga

SEQ ID NO: 841118 - RNA, 21 nt, Homo sapiens
uagggcaugauuaacaaagca

SEQ ID NO: 841119 - RNA, 22 nt, Homo sapiens
uagggcaugauuaacaaagcaa

SEQ ID NO: 841120 - RNA, 15 nt, Homo sapiens
uaggucucaugccca

SEQ ID NO: 841121 - RNA, 17 nt, Homo sapiens
uaguacccugcaggcca

SEQ ID NO: 841122 - RNA, 20 nt, Homo sapiens
uaguuuuacccuauaucuau

SEQ ID NO: 841123 - RNA, 17 nt, Homo sapiens
uauauuccucuugcauu

SEQ ID NO: 841124 - RNA, 13 nt, Homo sapiens
uaucuauaaacac

SEQ ID NO: 841125 - RNA, 21 nt, Homo sapiens
uaucucaaauuguaauuaaua

SEQ ID NO: 841126 - RNA, 17 nt, Homo sapiens
uaugaagggaagcgaga

SEQ ID NO: 841127 - RNA, 13 nt, Homo sapiens
uauuaaugcuuug

SEQ ID NO: 841128 - RNA, 14 nt, Homo sapiens
uauucuugucaaaa

SEQ ID NO: 841129 - RNA, 16 nt, Homo sapiens
uauugcuaccaaaaac

SEQ ID NO: 841130 - RNA, 22 nt, Homo sapiens
uauuuguguguucacuaaacuc

SEQ ID NO: 841131 - RNA, 15 nt, Homo sapiens
uauuuuaaaccaauu

SEQ ID NO: 841132 - RNA, 18 nt, Homo sapiens
ucaaaccucugcaucucu

SEQ ID NO: 841133 - RNA, 20 nt, Homo sapiens
ucaaaccucugcaucucuga

SEQ ID NO: 841134 - RNA, 15 nt, Homo sapiens
ucaaagcccagggau

SEQ ID NO: 841135 - RNA, 19 nt, Homo sapiens
ucaacauggcuacuugcuu

SEQ ID NO: 841136 - RNA, 18 nt, Homo sapiens
ucaagagcaucuggaaca

SEQ ID NO: 841137 - RNA, 14 nt, Homo sapiens
ucacucaggaaccc

SEQ ID NO: 841138 - RNA, 21 nt, Homo sapiens
ucacucaugcaaacugcuuua

SEQ ID NO: 841139 - RNA, 18 nt, Homo sapiens
ucacuggggcaugagauu

SEQ ID NO: 841140 - RNA, 18 nt, Homo sapiens
ucagaaaaugcagccuua

SEQ ID NO: 841141 - RNA, 16 nt, Homo sapiens
ucagaacaacuugcua

SEQ ID NO: 841142 - RNA, 15 nt, Homo sapiens
ucagaucugugagca

SEQ ID NO: 841143 - RNA, 22 nt, Homo sapiens
ucagcuugcuuagauguuccaa

SEQ ID NO: 841144 - RNA, 14 nt, Homo sapiens
ucaguauuuuccag

SEQ ID NO: 841145 - RNA, 17 nt, Homo sapiens
ucauggaggccaagaac

SEQ ID NO: 841146 - RNA, 22 nt, Homo sapiens
ucauggaggccaagaacuugca

SEQ ID NO: 841147 - RNA, 21 nt, Homo sapiens
ucaugggaucccagacuuuuu

SEQ ID NO: 841148 - RNA, 17 nt, Homo sapiens
ucauugcaucauuuaca

SEQ ID NO: 841149 - RNA, 20 nt, Homo sapiens
ucauuguguaagacuuauua

SEQ ID NO: 841150 - RNA, 18 nt, Homo sapiens
uuucauuucuaacauaag

SEQ ID NO: 841151 - RNA, 21 nt, Homo sapiens
uuucugaacaaagagagcuca

SEQ ID NO: 841152 - RNA, 20 nt, Homo sapiens
uuugaaaaauauugcuaaaa

SEQ ID NO: 841153 - RNA, 21 nt, Homo sapiens
uuugaaaaauauugcuaaaag

SEQ ID NO: 841154 - RNA, 21 nt, Homo sapiens
uuugaaaucaguaaacacugu

SEQ ID NO: 841155 - RNA, 17 nt, Homo sapiens
uuugaggcucaccagaa

SEQ ID NO: 841156 - RNA, 18 nt, Homo sapiens
uuugaucuuuguuuaaau

SEQ ID NO: 841157 - RNA, 22 nt, Homo sapiens
uuugcaaaggacuguaagcaga

SEQ ID NO: 841158 - RNA, 20 nt, Homo sapiens
uuugcaacaauaaaguacuu

SEQ ID NO: 841159 - RNA, 19 nt, Homo sapiens
uuuggagcauuaacuaaau

SEQ ID NO: 841160 - RNA, 14 nt, Homo sapiens
uuuguuuuaaauac

SEQ ID NO: 841161 - RNA, 18 nt, Homo sapiens
uuuugaaaucaguaaaca

SEQ ID NO: 841162 - RNA, 20 nt, Homo sapiens
uuuuugaaaucaguaaacac

SEQ ID NO: 841163 - RNA, 14 nt, Homo sapiens
aggcagaucuuuaa

SEQ ID NO: 841164 - RNA, 19 nt, Homo sapiens
aggcauaugcuucuuuaaa

SEQ ID NO: 841165 - RNA, 14 nt, Homo sapiens
aggccaagaacuug

SEQ ID NO: 841166 - RNA, 20 nt, Homo sapiens
aggcucccugaccacccugc

SEQ ID NO: 841167 - RNA, 14 nt, Homo sapiens
agggcaugauuaac

SEQ ID NO: 841168 - RNA, 18 nt, Homo sapiens
aggggugucccaguccca

SEQ ID NO: 841169 - RNA, 18 nt, Homo sapiens
agggugucggcugugagg

SEQ ID NO: 841170 - RNA, 23 nt, Homo sapiens
agguccuuggagugcugcagcuu

SEQ ID NO: 841171 - RNA, 20 nt, Homo sapiens
aggugaagucgagcacucua

SEQ ID NO: 841172 - RNA, 23 nt, Homo sapiens
aguaaaaauaaauaaaacagcag

SEQ ID NO: 841173 - RNA, 13 nt, Homo sapiens
aguaaacacugug

SEQ ID NO: 841174 - RNA, 16 nt, Homo sapiens
aguaacuggugauaua

SEQ ID NO: 841175 - RNA, 22 nt, Homo sapiens
aguaacuggugauauaucucaa

SEQ ID NO: 841176 - RNA, 19 nt, Homo sapiens
agucaccuccugcuccuuu

SEQ ID NO: 841177 - RNA, 17 nt, Homo sapiens
agucaugggaucccaga

SEQ ID NO: 841178 - RNA, 21 nt, Homo sapiens
agugcuucaacgaugugacug

SEQ ID NO: 841179 - RNA, 18 nt, Homo sapiens
aguucauaauucaccaaa

SEQ ID NO: 841180 - RNA, 17 nt, Homo sapiens
aguuuuuuuuuuuccag

SEQ ID NO: 841181 - RNA, 12 nt, Homo sapiens
auaaacacuguu

SEQ ID NO: 841182 - RNA, 23 nt, Homo sapiens
auaaauaaaacagcagcagcaaa

SEQ ID NO: 841183 - RNA, 22 nt, Homo sapiens
auaaauauuguguugugcagca

SEQ ID NO: 841184 - RNA, 14 nt, Homo sapiens
auaaaucaauucau

SEQ ID NO: 841185 - RNA, 19 nt, Homo sapiens
auaacacuguuggcacuua

SEQ ID NO: 841186 - RNA, 14 nt, Homo sapiens
auaaccauaaauca

SEQ ID NO: 841187 - RNA, 15 nt, Homo sapiens
auaagucuacauuaa

SEQ ID NO: 841188 - RNA, 15 nt, Homo sapiens
auacacuuuauuaau

SEQ ID NO: 841189 - RNA, 20 nt, Homo sapiens
auagauugugaauaaugauu

SEQ ID NO: 841190 - RNA, 21 nt, Homo sapiens
auagggcaugauuaacaaagc

SEQ ID NO: 841191 - RNA, 23 nt, Homo sapiens
auagggcaugauuaacaaagcaa

SEQ ID NO: 841192 - RNA, 21 nt, Homo sapiens
auaguagaaagacaucugccu

SEQ ID NO: 841193 - RNA, 17 nt, Homo sapiens
auaguuaaucuauaacu

SEQ ID NO: 841194 - RNA, 20 nt, Homo sapiens
auauugaaaguugcuuuuau

SEQ ID NO: 841195 - RNA, 11 nt, Homo sapiens
auauugcuaaa

SEQ ID NO: 841196 - RNA, 17 nt, Homo sapiens
auauugcuaccaaaaac

SEQ ID NO: 841197 - RNA, 23 nt, Homo sapiens
auauugcucuuaaaaaucuuggu

SEQ ID NO: 841198 - RNA, 16 nt, Homo sapiens
auauuuacaaccuaga

SEQ ID NO: 841199 - RNA, 16 nt, Homo sapiens
aucaaaaacaaccuga

SEQ ID NO: 841200 - RNA, 22 nt, Homo sapiens
aucauaaccacccuagcuuuau

SEQ ID NO: 841201 - RNA, 18 nt, Homo sapiens
aucauuaaaauauauguu

SEQ ID NO: 841202 - RNA, 17 nt, Homo sapiens
aucucauagguugccaa

SEQ ID NO: 841203 - RNA, 12 nt, Homo sapiens
augaaaagccau

SEQ ID NO: 841204 - RNA, 13 nt, Homo sapiens
augaaaauaccau

SEQ ID NO: 841205 - RNA, 15 nt, Homo sapiens
augaaacccuaucuc

SEQ ID NO: 841206 - RNA, 14 nt, Homo sapiens
augagcacuucuaa

SEQ ID NO: 841207 - RNA, 21 nt, Homo sapiens
augagcuccugcucauugugg

SEQ ID NO: 841208 - RNA, 21 nt, Homo sapiens
augagggugucggcugugagg

SEQ ID NO: 841209 - RNA, 14 nt, Homo sapiens
augauuguuuaaag

SEQ ID NO: 841210 - RNA, 13 nt, Homo sapiens
auggccucugggg

SEQ ID NO: 841211 - RNA, 13 nt, Homo sapiens
auggcuuacuuac

SEQ ID NO: 841212 - RNA, 18 nt, Homo sapiens
augguaccuccuaggagu

SEQ ID NO: 841213 - RNA, 18 nt, Homo sapiens
augguaggucaaguaaua

SEQ ID NO: 841214 - RNA, 19 nt, Homo sapiens
auggucugcaucagcuuuu

SEQ ID NO: 841215 - RNA, 15 nt, Homo sapiens
auggugaaggaaaca

SEQ ID NO: 841216 - RNA, 17 nt, Homo sapiens
augucuguaaucccagc

SEQ ID NO: 841217 - RNA, 16 nt, Homo sapiens
auguguccaagacaca

SEQ ID NO: 841218 - RNA, 19 nt, Homo sapiens
auguugacuggccaaaaau

SEQ ID NO: 841219 - RNA, 13 nt, Homo sapiens
auuaaagccuuaa

SEQ ID NO: 841220 - RNA, 15 nt, Homo sapiens
auuaagucagagcca

SEQ ID NO: 841221 - RNA, 18 nt, Homo sapiens
auuaagucagagccaaca

SEQ ID NO: 841222 - RNA, 19 nt, Homo sapiens
auuaauguuucuucuccaa

SEQ ID NO: 841223 - RNA, 23 nt, Homo sapiens
auuagccgggcaugguggugcac

SEQ ID NO: 841224 - RNA, 19 nt, Homo sapiens
auuaguaauaaaaauaaga

SEQ ID NO: 841225 - RNA, 23 nt, Homo sapiens
auuaguacuggauuauucaggcu

SEQ ID NO: 841226 - RNA, 19 nt, Homo sapiens
auuaucaaugggauaugau

SEQ ID NO: 841227 - RNA, 20 nt, Homo sapiens
auucagauuucucuuugaaa

SEQ ID NO: 841228 - RNA, 16 nt, Homo sapiens
auucaugcaacuugau

SEQ ID NO: 841229 - RNA, 15 nt, Homo sapiens
auuccucuugcauuu

SEQ ID NO: 841230 - RNA, 16 nt, Homo sapiens
auugaaaccauugugg

SEQ ID NO: 841231 - RNA, 17 nt, Homo sapiens
auugcaguuucauguau

SEQ ID NO: 841232 - RNA, 19 nt, Homo sapiens
auugcuaccaaaaacuaga

SEQ ID NO: 841233 - RNA, 15 nt, Homo sapiens
auugugaauaaugau

SEQ ID NO: 841234 - RNA, 18 nt, Homo sapiens
auuuaauuaaagccuuaa

SEQ ID NO: 841235 - RNA, 22 nt, Homo sapiens
auuuacugcucuagaaaguaua

SEQ ID NO: 841236 - RNA, 14 nt, Homo sapiens
auuucuaacauaag

SEQ ID NO: 841237 - RNA, 16 nt, Homo sapiens
auuuggcuugcuguuu

SEQ ID NO: 841238 - RNA, 21 nt, Homo sapiens
auuuucaauuuggagcauuaa

SEQ ID NO: 841239 - RNA, 19 nt, Homo sapiens
auuuucccuacuugcagcg

SEQ ID NO: 841240 - RNA, 15 nt, Homo sapiens
auuuucuagacuuuc

SEQ ID NO: 841241 - RNA, 18 nt, Homo sapiens
auuuucucugauacuuuu

SEQ ID NO: 841242 - RNA, 12 nt, Homo sapiens
auuuuugcaaug

SEQ ID NO: 841243 - RNA, 14 nt, Homo sapiens
caaaagcagcuuuu

SEQ ID NO: 841244 - RNA, 18 nt, Homo sapiens
caaaauaaucuauauuaa

SEQ ID NO: 841245 - RNA, 18 nt, Homo sapiens
caaagaaaugcugaugga

SEQ ID NO: 841246 - RNA, 23 nt, Homo sapiens
caaagccgcggggacaccgggaa

SEQ ID NO: 841247 - RNA, 18 nt, Homo sapiens
caaagucugugugaugaa

SEQ ID NO: 841248 - RNA, 13 nt, Homo sapiens
caaauacacuuua

SEQ ID NO: 841249 - RNA, 20 nt, Homo sapiens
caaauauugguuaguauuua

SEQ ID NO: 841250 - RNA, 22 nt, Homo sapiens
caaaucuccaguauucuuguca

SEQ ID NO: 841251 - RNA, 23 nt, Homo sapiens
caacagauggcugcgcaccaucu

SEQ ID NO: 841252 - RNA, 18 nt, Homo sapiens
caaccagaccaaccgccu

SEQ ID NO: 841253 - RNA, 14 nt, Homo sapiens
caacgacugccgug

SEQ ID NO: 841254 - RNA, 18 nt, Homo sapiens
caacucauugcaucauuu

SEQ ID NO: 841255 - RNA, 18 nt, Homo sapiens
caagcuuaaagcuugauu

SEQ ID NO: 841256 - RNA, 21 nt, Homo sapiens
caaguccugugaauuucuuca

SEQ ID NO: 841257 - RNA, 16 nt, Homo sapiens
caauaaaguacuuuac

SEQ ID NO: 841258 - RNA, 14 nt, Homo sapiens
caauaccaauguuc

SEQ ID NO: 841259 - RNA, 22 nt, Homo sapiens
caaugcccugccuugcugccuu

SEQ ID NO: 841260 - RNA, 15 nt, Homo sapiens
cacaaguccugugaa

SEQ ID NO: 841261 - RNA, 23 nt, Homo sapiens
cacagcugagagacuuuuaauca

SEQ ID NO: 841262 - RNA, 16 nt, Homo sapiens
cacaucuaaagcuuua

SEQ ID NO: 841263 - RNA, 16 nt, Homo sapiens
caccaucucugugauc

SEQ ID NO: 841264 - RNA, 16 nt, Homo sapiens
cacccuucucauucca

SEQ ID NO: 841265 - RNA, 15 nt, Homo sapiens
caccugggccaagga

SEQ ID NO: 841266 - RNA, 23 nt, Homo sapiens
cacucucucucuguuaaagauca

SEQ ID NO: 841267 - RNA, 16 nt, Homo sapiens
cacugaccugcccaug

SEQ ID NO: 841268 - RNA, 19 nt, Homo sapiens
cacuuaaccaccccauacc

SEQ ID NO: 841269 - RNA, 17 nt, Homo sapiens
cagaaccagucuuucaa

SEQ ID NO: 841270 - RNA, 15 nt, Homo sapiens
cagaagucagguguc

SEQ ID NO: 841271 - RNA, 23 nt, Homo sapiens
cagaaucucauagguugccaaua

SEQ ID NO: 841272 - RNA, 23 nt, Homo sapiens
cagaauuauuuuuaagugguuuu

SEQ ID NO: 841273 - RNA, 21 nt, Homo sapiens
cagacugggaguugcuagcaa

SEQ ID NO: 841274 - RNA, 18 nt, Homo sapiens
cagagaaagaaaaggcaa

SEQ ID NO: 841275 - RNA, 13 nt, Homo sapiens
cagagggacugga

SEQ ID NO: 841276 - RNA, 12 nt, Homo sapiens
cagaucuuuaaa

SEQ ID NO: 841277 - RNA, 16 nt, Homo sapiens
cagauuuuagagcaaa

SEQ ID NO: 841278 - RNA, 15 nt, Homo sapiens
cagcccccaaagagc

SEQ ID NO: 841279 - RNA, 13 nt, Homo sapiens
uaaaagugcauuu

SEQ ID NO: 841280 - RNA, 17 nt, Homo sapiens
uaaaauaagaaugauuu

SEQ ID NO: 841281 - RNA, 16 nt, Homo sapiens
uaaaauauuauuugau

SEQ ID NO: 841282 - RNA, 21 nt, Homo sapiens
uaaaaugcggcacuauuucug

SEQ ID NO: 841283 - RNA, 15 nt, Homo sapiens
uaaaauuaauuugug

SEQ ID NO: 841284 - RNA, 18 nt, Homo sapiens
uaaacacuguuuguucca

SEQ ID NO: 841285 - RNA, 14 nt, Homo sapiens
uaaaccaauugcag

SEQ ID NO: 841286 - RNA, 13 nt, Homo sapiens
uaaacuaguuuaa

SEQ ID NO: 841287 - RNA, 21 nt, Homo sapiens
uaaagcuuuaucuuuguguaa

SEQ ID NO: 841288 - RNA, 14 nt, Homo sapiens
uaaaggucacuuuu

SEQ ID NO: 841289 - RNA, 22 nt, Homo sapiens
uaaaguauguccuucagcugac

SEQ ID NO: 841290 - RNA, 20 nt, Homo sapiens
uaaaguuuugcaacaauaaa

SEQ ID NO: 841291 - RNA, 14 nt, Homo sapiens
uaaauagugcagaa

SEQ ID NO: 841292 - RNA, 22 nt, Homo sapiens
uaaaucauacuccuaugcuuua

SEQ ID NO: 841293 - RNA, 13 nt, Homo sapiens
uaaaugugagcaa

SEQ ID NO: 841294 - RNA, 21 nt, Homo sapiens
uaacaagaucauuaucuucau

SEQ ID NO: 841295 - RNA, 18 nt, Homo sapiens
uaacacuguuggcacuua

SEQ ID NO: 841296 - RNA, 22 nt, Homo sapiens
uaacauagaauugcaaucuaua

SEQ ID NO: 841297 - RNA, 18 nt, Homo sapiens
uaaccauaaaucaauuca

SEQ ID NO: 841298 - RNA, 12 nt, Homo sapiens
uaacuacauauu

SEQ ID NO: 841299 - RNA, 13 nt, Homo sapiens
uaacuauguuuua

SEQ ID NO: 841300 - RNA, 13 nt, Homo sapiens
uaacucauagauu

SEQ ID NO: 841301 - RNA, 20 nt, Homo sapiens
uaagcaagccaggagaagac

SEQ ID NO: 841302 - RNA, 13 nt, Homo sapiens
uaaggaaagccaa

SEQ ID NO: 841303 - RNA, 13 nt, Homo sapiens
uaauaaaauaaua

SEQ ID NO: 841304 - RNA, 19 nt, Homo sapiens
uaauagcuuuuauuguaua

SEQ ID NO: 841305 - RNA, 12 nt, Homo sapiens
uaauauaaccau

SEQ ID NO: 841306 - RNA, 13 nt, Homo sapiens
uaauauggcaaaa

SEQ ID NO: 841307 - RNA, 19 nt, Homo sapiens
uaauauuuguguguucacu

SEQ ID NO: 841308 - RNA, 17 nt, Homo sapiens
uaaucaacauggcuacu

SEQ ID NO: 841309 - RNA, 13 nt, Homo sapiens
uaaucccagcacu

SEQ ID NO: 841310 - RNA, 18 nt, Homo sapiens
uaaucuccucugcucauu

SEQ ID NO: 841311 - RNA, 18 nt, Homo sapiens
uaauggaaacaugcugua

SEQ ID NO: 841312 - RNA, 21 nt, Homo sapiens
uaauuaaagccuuaagcacaa

SEQ ID NO: 841313 - RNA, 13 nt, Homo sapiens
uaauugaucagau

SEQ ID NO: 841314 - RNA, 19 nt, Homo sapiens
uaauuuaaaaaauaacuac

SEQ ID NO: 841315 - RNA, 16 nt, Homo sapiens
uaauuuuuugcagucu

SEQ ID NO: 841316 - RNA, 20 nt, Homo sapiens
uacaagcuuaaagcuugauu

SEQ ID NO: 841317 - RNA, 13 nt, Homo sapiens
uacaaguuugcua

SEQ ID NO: 841318 - RNA, 18 nt, Homo sapiens
uacaaguuugcuaaaaga

SEQ ID NO: 841319 - RNA, 14 nt, Homo sapiens
uacacuccaggugu

SEQ ID NO: 841320 - RNA, 15 nt, Homo sapiens
uacagaaugcauuaa

SEQ ID NO: 841321 - RNA, 15 nt, Homo sapiens
uacagaucauauaag

SEQ ID NO: 841322 - RNA, 23 nt, Homo sapiens
uacagauggagcaaauguccuaa

SEQ ID NO: 841323 - RNA, 17 nt, Homo sapiens
uacagugacagauuuua

SEQ ID NO: 841324 - RNA, 21 nt, Homo sapiens
uacauguuugguaccaagaaa

SEQ ID NO: 841325 - RNA, 16 nt, Homo sapiens
uaccauauugcucuua

SEQ ID NO: 841326 - RNA, 14 nt, Homo sapiens
uacccuauaucuau

SEQ ID NO: 841327 - RNA, 19 nt, Homo sapiens
uacccuugguuugcacaua

SEQ ID NO: 841328 - RNA, 18 nt, Homo sapiens
uacucauuuuaaugauug

SEQ ID NO: 841329 - RNA, 17 nt, Homo sapiens
uacugauuuuugugauu

SEQ ID NO: 841330 - RNA, 16 nt, Homo sapiens
uagaaagcaagaugua

SEQ ID NO: 841331 - RNA, 12 nt, Homo sapiens
uagaaugccaua

SEQ ID NO: 841332 - RNA, 18 nt, Homo sapiens
uagaauugcaaucuauaa

SEQ ID NO: 841333 - RNA, 14 nt, Homo sapiens
uagcauggauuuau

SEQ ID NO: 841334 - RNA, 14 nt, Homo sapiens
uagcugaauugagc

SEQ ID NO: 841335 - RNA, 12 nt, Homo sapiens
uaggaguacaag

SEQ ID NO: 841336 - RNA, 18 nt, Homo sapiens
uaggcauaugcuucuuua

SEQ ID NO: 841337 - RNA, 14 nt, Homo sapiens
uaggguucagagaa

SEQ ID NO: 841338 - RNA, 22 nt, Homo sapiens
uaggucucaugcccacuccccc

SEQ ID NO: 841339 - RNA, 14 nt, Homo sapiens
uagguugugcaaau

SEQ ID NO: 841340 - RNA, 20 nt, Homo sapiens
uaguagaaagacaucugccu

SEQ ID NO: 841341 - RNA, 21 nt, Homo sapiens
uauaaaaggauguuacaaguu

SEQ ID NO: 841342 - RNA, 17 nt, Homo sapiens
uauaaggaaagccaaau

SEQ ID NO: 841343 - RNA, 23 nt, Homo sapiens
uauaccugccuuuuaaguuugaa

SEQ ID NO: 841344 - RNA, 20 nt, Homo sapiens
uauaguuaaucuauaacuac

SEQ ID NO: 841345 - RNA, 18 nt, Homo sapiens
uauaucuauaaacacugu

SEQ ID NO: 841346 - RNA, 19 nt, Homo sapiens
uauccugugcuaugcugga

SEQ ID NO: 841347 - RNA, 19 nt, Homo sapiens
uaucguccagugacuuuca

SEQ ID NO: 841348 - RNA, 14 nt, Homo sapiens
uaugagcaugccaa

SEQ ID NO: 841349 - RNA, 18 nt, Homo sapiens
uaugauuuugaugcacaa

SEQ ID NO: 841350 - RNA, 16 nt, Homo sapiens
uauguaaaguauguaa

SEQ ID NO: 841351 - RNA, 18 nt, Homo sapiens
uaugugagaaaucagaau

SEQ ID NO: 841352 - RNA, 19 nt, Homo sapiens
uauuagaagcuaucaauca

SEQ ID NO: 841353 - RNA, 16 nt, Homo sapiens
uauuauaauagauuag

SEQ ID NO: 841354 - RNA, 23 nt, Homo sapiens
uauucaggcuuuaggcauaugcu

SEQ ID NO: 841355 - RNA, 20 nt, Homo sapiens
uauucccuucugaucuugga

SEQ ID NO: 841356 - RNA, 15 nt, Homo sapiens
uauuguauaaacuau

SEQ ID NO: 841357 - RNA, 16 nt, Homo sapiens
uauuuuuguaccauau

SEQ ID NO: 841358 - RNA, 20 nt, Homo sapiens
ucaaaaacaaccugaaagag

SEQ ID NO: 841359 - RNA, 17 nt, Homo sapiens
ucacggggucaggagau

SEQ ID NO: 841360 - RNA, 19 nt, Homo sapiens
ucacuugaguggagguuua

SEQ ID NO: 841361 - RNA, 20 nt, Homo sapiens
ucagacuugcggccacagca

SEQ ID NO: 841362 - RNA, 23 nt, Homo sapiens
ucagacuugcggccacagcacua

SEQ ID NO: 841363 - RNA, 17 nt, Homo sapiens
ucagauuucucuuugaa

SEQ ID NO: 841364 - RNA, 12 nt, Homo sapiens
ucagcaugacaa

SEQ ID NO: 841365 - RNA, 22 nt, Homo sapiens
ucaguaaaaauaaauaaaacag

SEQ ID NO: 841366 - RNA, 19 nt, Homo sapiens
ucaguacgagcugcucuaa

SEQ ID NO: 841367 - RNA, 19 nt, Homo sapiens
ucaguauuuuccagccuua

SEQ ID NO: 841368 - RNA, 19 nt, Homo sapiens
ucaguuuuuuuuuuuccag

SEQ ID NO: 841369 - RNA, 22 nt, Homo sapiens
ucauauugcuaccaaaaacuag

SEQ ID NO: 841370 - RNA, 23 nt, Homo sapiens
ucauauugguauucacuaaucug

SEQ ID NO: 841371 - RNA, 13 nt, Homo sapiens
ucaucuguuguuu

SEQ ID NO: 841372 - RNA, 13 nt, Homo sapiens
caauaaaguacuu

SEQ ID NO: 841373 - RNA, 14 nt, Homo sapiens
caauaaaguacuuu

SEQ ID NO: 841374 - RNA, 12 nt, Homo sapiens
caauaccaaugu

SEQ ID NO: 841375 - RNA, 18 nt, Homo sapiens
caaucuccccuugcacua

SEQ ID NO: 841376 - RNA, 14 nt, Homo sapiens
cacaaguccuguga

SEQ ID NO: 841377 - RNA, 18 nt, Homo sapiens
cacauucccaucugucac

SEQ ID NO: 841378 - RNA, 15 nt, Homo sapiens
caccugcgcugugga

SEQ ID NO: 841379 - RNA, 21 nt, Homo sapiens
cacgaugacgccucuggaccu

SEQ ID NO: 841380 - RNA, 11 nt, Homo sapiens
cacuaauuccu

SEQ ID NO: 841381 - RNA, 22 nt, Homo sapiens
cacuacuccugaggaugcuacu

SEQ ID NO: 841382 - RNA, 19 nt, Homo sapiens
cacucaggaacccuggaga

SEQ ID NO: 841383 - RNA, 20 nt, Homo sapiens
cacucaggaacccuggagac

SEQ ID NO: 841384 - RNA, 14 nt, Homo sapiens
cacugccaccagca

SEQ ID NO: 841385 - RNA, 20 nt, Homo sapiens
cacugcggugucugcagcuc

SEQ ID NO: 841386 - RNA, 23 nt, Homo sapiens
cagaaccuuacuggcacuguggc

SEQ ID NO: 841387 - RNA, 17 nt, Homo sapiens
cagaauuugcucgcuac

SEQ ID NO: 841388 - RNA, 15 nt, Homo sapiens
cagaguggccuguga

SEQ ID NO: 841389 - RNA, 17 nt, Homo sapiens
cagaguggccugugagc

SEQ ID NO: 841390 - RNA, 16 nt, Homo sapiens
cagaucuuuaaauaca

SEQ ID NO: 841391 - RNA, 12 nt, Homo sapiens
cagcaaagccau

SEQ ID NO: 841392 - RNA, 14 nt, Homo sapiens
cagcacuagaguca

SEQ ID NO: 841393 - RNA, 15 nt, Homo sapiens
cagcagcaaacaaau

SEQ ID NO: 841394 - RNA, 20 nt, Homo sapiens
caggagcagcuggcacugac

SEQ ID NO: 841395 - RNA, 19 nt, Homo sapiens
gaaaucaguaaacacugug

SEQ ID NO: 841396 - RNA, 21 nt, Homo sapiens
gaaauguugacuggccaaaaa

SEQ ID NO: 841397 - RNA, 16 nt, Homo sapiens
gaacaaagagagcuca

SEQ ID NO: 841398 - RNA, 16 nt, Homo sapiens
gaaccaagggcccuca

SEQ ID NO: 841399 - RNA, 17 nt, Homo sapiens
gaaccaagggcccucac

SEQ ID NO: 841400 - RNA, 12 nt, Homo sapiens
gaacuugcaaua

SEQ ID NO: 841401 - RNA, 16 nt, Homo sapiens
gaacuugcaauaccaa

SEQ ID NO: 841402 - RNA, 18 nt, Homo sapiens
gaaggagugcgugccugc

SEQ ID NO: 841403 - RNA, 19 nt, Homo sapiens
gaaggccagcccacugggc

SEQ ID NO: 841404 - RNA, 16 nt, Homo sapiens
gaagguaauaaauaca

SEQ ID NO: 841405 - RNA, 15 nt, Homo sapiens
gaaucguuugaacuc

SEQ ID NO: 841406 - RNA, 13 nt, Homo sapiens
gacaccacuggga

SEQ ID NO: 841407 - RNA, 17 nt, Homo sapiens
gacagaagucagguguc

SEQ ID NO: 841408 - RNA, 16 nt, Homo sapiens
gaccgucucaaaaaga

SEQ ID NO: 841409 - RNA, 23 nt, Homo sapiens
gaccuuuauccagcuagugccaa

SEQ ID NO: 841410 - RNA, 15 nt, Homo sapiens
gacguaaucuccaca

SEQ ID NO: 841411 - RNA, 14 nt, Homo sapiens
gacuggacagccag

SEQ ID NO: 841412 - RNA, 14 nt, Homo sapiens
gacuggccaaaaau

SEQ ID NO: 841413 - RNA, 23 nt, Homo sapiens
gagccaggggugucccaguccca

SEQ ID NO: 841414 - RNA, 17 nt, Homo sapiens
gagcgagaccgucucaa

SEQ ID NO: 841415 - RNA, 14 nt, Homo sapiens
gaggaucagcacug

SEQ ID NO: 841416 - RNA, 22 nt, Homo sapiens
gaggaucagcacugccagugga

SEQ ID NO: 841417 - RNA, 19 nt, Homo sapiens
gagggugucggcugugagg

SEQ ID NO: 841418 - RNA, 19 nt, Homo sapiens
gagguuguuuuaaagucag

SEQ ID NO: 841419 - RNA, 23 nt, Homo sapiens
gaguaaugauguaacagugcaag

SEQ ID NO: 841420 - RNA, 11 nt, Homo sapiens
gagugccaacu

SEQ ID NO: 841421 - RNA, 23 nt, Homo sapiens
gaguggggaaaacagaccgugaa

SEQ ID NO: 841422 - RNA, 22 nt, Homo sapiens
gaguucuauuagaagcuaucaa

SEQ ID NO: 841423 - RNA, 17 nt, Homo sapiens
gauauguuuguacaaga

SEQ ID NO: 841424 - RNA, 19 nt, Homo sapiens
gauccuguuccucaacaag

SEQ ID NO: 841425 - RNA, 13 nt, Homo sapiens
gaugaaaagccau

SEQ ID NO: 841426 - RNA, 16 nt, Homo sapiens
gaugacgccucuggac

SEQ ID NO: 841427 - RNA, 16 nt, Homo sapiens
gaugacggccaggcuc

SEQ ID NO: 841428 - RNA, 16 nt, Homo sapiens
gaugcaaagguugcag

SEQ ID NO: 841429 - RNA, 14 nt, Homo sapiens
gauggcagugagaa

SEQ ID NO: 841430 - RNA, 16 nt, Homo sapiens
gaugggcgucacuacu

SEQ ID NO: 841431 - RNA, 12 nt, Homo sapiens
gauguacuauaa

SEQ ID NO: 841432 - RNA, 21 nt, Homo sapiens
gauugacugugcccaguacuu

SEQ ID NO: 841433 - RNA, 21 nt, Homo sapiens
gauuucucuuugaaacaugcu

SEQ ID NO: 841434 - RNA, 14 nt, Homo sapiens
gcaaaaacauaugu

SEQ ID NO: 841435 - RNA, 20 nt, Homo sapiens
gcaacaauaaaguacuuuac

SEQ ID NO: 841436 - RNA, 19 nt, Homo sapiens
gcaaccaaagugcaggaca

SEQ ID NO: 841437 - RNA, 15 nt, Homo sapiens
gcaauaccaauguuc

SEQ ID NO: 841438 - RNA, 16 nt, Homo sapiens
gcacaagaaggccagc

SEQ ID NO: 841439 - RNA, 23 nt, Homo sapiens
gcacaauuaauuaaaagugaaac

SEQ ID NO: 841440 - RNA, 15 nt, Homo sapiens
gcagagguugcaaug

SEQ ID NO: 841441 - RNA, 18 nt, Homo sapiens
gcagugagugccaugcuu

SEQ ID NO: 841442 - RNA, 20 nt, Homo sapiens
gcaguuucauguauguauau

SEQ ID NO: 841443 - RNA, 20 nt, Homo sapiens
gcaucauuuacaagacaaca

SEQ ID NO: 841444 - RNA, 22 nt, Homo sapiens
gcaucauuuacaagacaacauu

SEQ ID NO: 841445 - RNA, 20 nt, Homo sapiens
gcauuggcucaugucuguaa

SEQ ID NO: 841446 - RNA, 15 nt, Homo sapiens
gccaagaacuugcaa

SEQ ID NO: 841447 - RNA, 17 nt, Homo sapiens
gccaagaacuugcaaua

SEQ ID NO: 841448 - RNA, 14 nt, Homo sapiens
gccagcccacuggg

SEQ ID NO: 841449 - RNA, 17 nt, Homo sapiens
gccaggcucccugacca

SEQ ID NO: 841450 - RNA, 20 nt, Homo sapiens
gccaggggugucccaguccc

SEQ ID NO: 841451 - RNA, 17 nt, Homo sapiens
gccauauaugcuguauu

SEQ ID NO: 841452 - RNA, 20 nt, Homo sapiens
gccauccccgaaagagguga

SEQ ID NO: 841453 - RNA, 17 nt, Homo sapiens
gccugcuacgaacgcuc

SEQ ID NO: 841454 - RNA, 20 nt, Homo sapiens
gccuuccgacaccacuggga

SEQ ID NO: 841455 - RNA, 21 nt, Homo sapiens
gccuuccgacaccacugggaa

SEQ ID NO: 841456 - RNA, 13 nt, Homo sapiens
gcgcaccaucucu

SEQ ID NO: 841457 - RNA, 13 nt, Homo sapiens
gcuaccaaaaacu

SEQ ID NO: 841458 - RNA, 19 nt, Homo sapiens
gcucgcuacacuacuccug

SEQ ID NO: 841459 - RNA, 14 nt, Homo sapiens
gcuuaguucuugaa

SEQ ID NO: 841460 - RNA, 22 nt, Homo sapiens
gcuucuuaaaaacuguguauca

SEQ ID NO: 841461 - RNA, 14 nt, Homo sapiens
ggaaacgcacuuac

SEQ ID NO: 841462 - RNA, 23 nt, Homo sapiens
ggaaaugguauccagaauggaau

SEQ ID NO: 841463 - RNA, 20 nt, Homo sapiens
ggagcagcuggcacugacag

SEQ ID NO: 841464 - RNA, 19 nt, Homo sapiens
ggaggccaagaacuugcaa

SEQ ID NO: 841465 - RNA, 16 nt, Homo sapiens
ggaugaugguugcaaa

SEQ ID NO: 841466 - RNA, 20 nt, Homo sapiens
ggaugcaaagguugcaguga

SEQ ID NO: 841467 - RNA, 21 nt, Homo sapiens
ggauucagauuucucuuugaa

SEQ ID NO: 841468 - RNA, 15 nt, Homo sapiens
ggcagugagugccau

SEQ ID NO: 841469 - RNA, 22 nt, Homo sapiens
ggcagugagugccaugcuuuuu

SEQ ID NO: 841470 - RNA, 20 nt, Homo sapiens
ggccagcuuccccucacuua

SEQ ID NO: 841471 - RNA, 18 nt, Homo sapiens
ggccaggcucccugacca

SEQ ID NO: 841472 - RNA, 13 nt, Homo sapiens
ggccuccagaacc

SEQ ID NO: 841473 - RNA, 23 nt, Homo sapiens
ggcgucuccaaggaggugacacu

SEQ ID NO: 841474 - RNA, 23 nt, Homo sapiens
gggcacccaaguugggauuucau

SEQ ID NO: 841475 - RNA, 14 nt, Homo sapiens
ggguuuuauaucca

SEQ ID NO: 841476 - RNA, 18 nt, Homo sapiens
ggugaccuguuaggucuc

SEQ ID NO: 841477 - RNA, 14 nt, Homo sapiens
ggugauauaucuca

SEQ ID NO: 841478 - RNA, 13 nt, Homo sapiens
ggugucugcagcu

SEQ ID NO: 841479 - RNA, 14 nt, Homo sapiens
ggugucugcagcuc

SEQ ID NO: 841480 - RNA, 20 nt, Homo sapiens
gguuucuauuuucucugaua

SEQ ID NO: 841481 - RNA, 16 nt, Homo sapiens
gguuuuaacaauuucc

SEQ ID NO: 841482 - RNA, 16 nt, Homo sapiens
guaauuguacaagcag

SEQ ID NO: 841483 - RNA, 14 nt, Homo sapiens
guacaagcaguuaa

SEQ ID NO: 841484 - RNA, 17 nt, Homo sapiens
guacaaugugacuuuga

SEQ ID NO: 841485 - RNA, 18 nt, Homo sapiens
guagaaagacaucugccu

SEQ ID NO: 841486 - RNA, 23 nt, Homo sapiens
guauaguagaaagacaucugccu

SEQ ID NO: 841487 - RNA, 20 nt, Homo sapiens
guauuuaacuacaucugccu

SEQ ID NO: 841488 - RNA, 14 nt, Homo sapiens
ucugacuuacuuaa

SEQ ID NO: 841489 - RNA, 21 nt, Homo sapiens
ucugaggaucagcacugccag

SEQ ID NO: 841490 - RNA, 12 nt, Homo sapiens
ucugaucuugga

SEQ ID NO: 841491 - RNA, 20 nt, Homo sapiens
ucugguuuuaacaauuuccu

SEQ ID NO: 841492 - RNA, 17 nt, Homo sapiens
ucuuagaguuuacaguu

SEQ ID NO: 841493 - RNA, 20 nt, Homo sapiens
ucuuagaguuuacaguuugu

SEQ ID NO: 841494 - RNA, 13 nt, Homo sapiens
ucuugaaccagaa

SEQ ID NO: 841495 - RNA, 21 nt, Homo sapiens
ucuugccccaaaucacaaaca

SEQ ID NO: 841496 - RNA, 19 nt, Homo sapiens
ucuuugagaccaaguucca

SEQ ID NO: 841497 - RNA, 14 nt, Homo sapiens
ucuuugucuaaaca

SEQ ID NO: 841498 - RNA, 23 nt, Homo sapiens
ucuuugugcaguguuaguauuca

SEQ ID NO: 841499 - RNA, 14 nt, Homo sapiens
ucuuuuguuauuaa

SEQ ID NO: 841500 - RNA, 17 nt, Homo sapiens
ugaaaaauauugcuaaa

SEQ ID NO: 841501 - RNA, 17 nt, Homo sapiens
ugaaaccaaauguaacu

SEQ ID NO: 841502 - RNA, 20 nt, Homo sapiens
ugaaaccccaucucuacuaa

SEQ ID NO: 841503 - RNA, 19 nt, Homo sapiens
ugaaacccuaucucuacua

SEQ ID NO: 841504 - RNA, 20 nt, Homo sapiens
ugaaacccuaucucuacuaa

SEQ ID NO: 841505 - RNA, 22 nt, Homo sapiens
ugaaaucaguaaacacugugua

SEQ ID NO: 841506 - RNA, 17 nt, Homo sapiens
ugaacaaagagagcuca

SEQ ID NO: 841507 - RNA, 12 nt, Homo sapiens
ugaacuguggaa

SEQ ID NO: 841508 - RNA, 14 nt, Homo sapiens
ugaaggaaacagaa

SEQ ID NO: 841509 - RNA, 15 nt, Homo sapiens
ugaagucaaaccuua

SEQ ID NO: 841510 - RNA, 18 nt, Homo sapiens
ugaauaagcacuuuuuaa

SEQ ID NO: 841511 - RNA, 20 nt, Homo sapiens
ugaaucuucugaaaccaaau

SEQ ID NO: 841512 - RNA, 17 nt, Homo sapiens
ugaauugaaauggggcg

SEQ ID NO: 841513 - RNA, 16 nt, Homo sapiens
ugaauugagcuagaaa

SEQ ID NO: 841514 - RNA, 20 nt, Homo sapiens
ugagacauauuuacaaccua

SEQ ID NO: 841515 - RNA, 17 nt, Homo sapiens
ugagugccaugcuuuuu

SEQ ID NO: 841516 - RNA, 16 nt, Homo sapiens
ugaguggagguuuaua

SEQ ID NO: 841517 - RNA, 18 nt, Homo sapiens
ugaguggggaaaacagac

SEQ ID NO: 841518 - RNA, 18 nt, Homo sapiens
ugauaaucaucagguuua

SEQ ID NO: 841519 - RNA, 21 nt, Homo sapiens
ugaucacaucuaaagcuuuau

SEQ ID NO: 841520 - RNA, 22 nt, Homo sapiens
ugaucacaucuaaagcuuuauc

SEQ ID NO: 841521 - RNA, 14 nt, Homo sapiens
ugaugguugcaaaa

SEQ ID NO: 841522 - RNA, 13 nt, Homo sapiens
ugauuuacaugcu

SEQ ID NO: 841523 - RNA, 15 nt, Homo sapiens
ugcaaucuauaauau

SEQ ID NO: 841524 - RNA, 20 nt, Homo sapiens
ugcaccuuaccaacuuucug

SEQ ID NO: 841525 - RNA, 21 nt, Homo sapiens
ugcagcauuaaaaaaaaucaa

SEQ ID NO: 841526 - RNA, 23 nt, Homo sapiens
ugcaggacaucaaaaacaaccug

SEQ ID NO: 841527 - RNA, 13 nt, Homo sapiens
ugcaggacucuag

SEQ ID NO: 841528 - RNA, 15 nt, Homo sapiens
ugcaguuucauguau

SEQ ID NO: 841529 - RNA, 16 nt, Homo sapiens
ugcaguuucauguaug

SEQ ID NO: 841530 - RNA, 22 nt, Homo sapiens
ugcaucagaaaaugcagccuua

SEQ ID NO: 841531 - RNA, 14 nt, Homo sapiens
ugccaccagcaaug

SEQ ID NO: 841532 - RNA, 19 nt, Homo sapiens
ugccugguuuuauuuauau

SEQ ID NO: 841533 - RNA, 16 nt, Homo sapiens
ugcuaaaagugcauuu

SEQ ID NO: 841534 - RNA, 13 nt, Homo sapiens
ugcuaccaaaaac

SEQ ID NO: 841535 - RNA, 17 nt, Homo sapiens
ugcuacccucauuucac

SEQ ID NO: 841536 - RNA, 13 nt, Homo sapiens
ugcucauguauau

SEQ ID NO: 841537 - RNA, 13 nt, Homo sapiens
ugcucgcugagaa

SEQ ID NO: 841538 - RNA, 17 nt, Homo sapiens
ugcugaggcucugaccc

SEQ ID NO: 841539 - RNA, 20 nt, Homo sapiens
ugcuuugaggcucaccagaa

SEQ ID NO: 841540 - RNA, 17 nt, Homo sapiens
uggaaagagguucugca

SEQ ID NO: 841541 - RNA, 15 nt, Homo sapiens
uggaacuucuaauau

SEQ ID NO: 841542 - RNA, 22 nt, Homo sapiens
uggaggccaagaacuugcaaua

SEQ ID NO: 841543 - RNA, 13 nt, Homo sapiens
uggauggccucug

SEQ ID NO: 841544 - RNA, 15 nt, Homo sapiens
uggcaggaugcgcug

SEQ ID NO: 841545 - RNA, 16 nt, Homo sapiens
uggccaacaugaugaa

SEQ ID NO: 841546 - RNA, 12 nt, Homo sapiens
uggccugugagc

SEQ ID NO: 841547 - RNA, 17 nt, Homo sapiens
uggccugugagcaagag

SEQ ID NO: 841548 - RNA, 10 nt, Homo sapiens
uggcuucccu

SEQ ID NO: 841549 - RNA, 21 nt, Homo sapiens
ugggaggaugaaggagugcgu

SEQ ID NO: 841550 - RNA, 18 nt, Homo sapiens
uggggaagagguuuuauu

SEQ ID NO: 841551 - RNA, 14 nt, Homo sapiens
ugguaccuccuagg

SEQ ID NO: 841552 - RNA, 12 nt, Homo sapiens
ugguuaaaucau

SEQ ID NO: 841553 - RNA, 16 nt, Homo sapiens
uguaaaggucacuuuu

SEQ ID NO: 841554 - RNA, 20 nt, Homo sapiens
uguaaaggucacuuuucaca

SEQ ID NO: 841555 - RNA, 20 nt, Homo sapiens
uguaaauaaccacacugaaa

SEQ ID NO: 841556 - RNA, 19 nt, Homo sapiens
uguaaaugagacacauaca

SEQ ID NO: 841557 - RNA, 20 nt, Homo sapiens
uguaagcagauuacaauaaa

SEQ ID NO: 841558 - RNA, 18 nt, Homo sapiens
uguaaucccagcacuuug

SEQ ID NO: 841559 - RNA, 17 nt, Homo sapiens
uguguaaucuaaguaua

SEQ ID NO: 841560 - RNA, 20 nt, Homo sapiens
uguguaugagacuguguuuc

SEQ ID NO: 841561 - RNA, 19 nt, Homo sapiens
uguguuuuaaaaaaacuga

SEQ ID NO: 841562 - RNA, 19 nt, Homo sapiens
uguuaauaaaaauaagaaa

SEQ ID NO: 841563 - RNA, 20 nt, Homo sapiens
uguuacaaguuugcuaaaag

SEQ ID NO: 841564 - RNA, 22 nt, Homo sapiens
uguuacauuauuccaaugauac

SEQ ID NO: 841565 - RNA, 16 nt, Homo sapiens
uguugacuggccaaaa

SEQ ID NO: 841566 - RNA, 16 nt, Homo sapiens
uguuugguaccaagaa

SEQ ID NO: 841567 - RNA, 14 nt, Homo sapiens
uguuuguacaagau

SEQ ID NO: 841568 - RNA, 19 nt, Homo sapiens
uguuuuaaaaaaacugaag

SEQ ID NO: 841569 - RNA, 15 nt, Homo sapiens
uuaaaagucacauaa

SEQ ID NO: 841570 - RNA, 19 nt, Homo sapiens
uuaaaaguugugauuccag

SEQ ID NO: 841571 - RNA, 12 nt, Homo sapiens
uuaaaaugauug

SEQ ID NO: 841572 - RNA, 21 nt, Homo sapiens
uuaaacaaaauagaagcugua

SEQ ID NO: 841573 - RNA, 16 nt, Homo sapiens
uuaaagaaacacuaaa

SEQ ID NO: 841574 - RNA, 17 nt, Homo sapiens
uuaaagaaacacuaaau

SEQ ID NO: 841575 - RNA, 18 nt, Homo sapiens
uuaacuggcauaggaaau

SEQ ID NO: 841576 - RNA, 23 nt, Homo sapiens
uuaagaaagagaaugaacugugg

SEQ ID NO: 841577 - RNA, 18 nt, Homo sapiens
uuaauaaaaauaagaaau

SEQ ID NO: 841578 - RNA, 19 nt, Homo sapiens
uuaauuuuuguacuuugcu

SEQ ID NO: 841579 - RNA, 13 nt, Homo sapiens
uuacagaucauau

SEQ ID NO: 841580 - RNA, 20 nt, Homo sapiens
uuacauguuugguaccaaga

SEQ ID NO: 841581 - RNA, 23 nt, Homo sapiens
aaaaacucuuuaacuuguaauaa

SEQ ID NO: 841582 - RNA, 13 nt, Homo sapiens
aaaaauaagaaau

SEQ ID NO: 841583 - RNA, 13 nt, Homo sapiens
aaaaguugugauu

SEQ ID NO: 841584 - RNA, 23 nt, Homo sapiens
aaaauuaguaauaaaaauaagaa

SEQ ID NO: 841585 - RNA, 21 nt, Homo sapiens
aaaauugcaguuucauguaug

SEQ ID NO: 841586 - RNA, 14 nt, Homo sapiens
aaacaaaugaaaua

SEQ ID NO: 841587 - RNA, 12 nt, Homo sapiens
aaaccaugacaa

SEQ ID NO: 841588 - RNA, 13 nt, Homo sapiens
aaaccaugacaaa

SEQ ID NO: 841589 - RNA, 21 nt, Homo sapiens
aaaccugugaaagcugcacuc

SEQ ID NO: 841590 - RNA, 16 nt, Homo sapiens
aaacuacuuugaauag

SEQ ID NO: 841591 - RNA, 15 nt, Homo sapiens
aaagcaccauuguga

SEQ ID NO: 841592 - RNA, 16 nt, Homo sapiens
aaagccuuucauacca

SEQ ID NO: 841593 - RNA, 17 nt, Homo sapiens
aaagggagaaaugccag

SEQ ID NO: 841594 - RNA, 21 nt, Homo sapiens
aaaguauagauggccaaagga

SEQ ID NO: 841595 - RNA, 21 nt, Homo sapiens
aaaguugcuuuuauugcacca

SEQ ID NO: 841596 - RNA, 14 nt, Homo sapiens
aaauaaaaauuaaa

SEQ ID NO: 841597 - RNA, 22 nt, Homo sapiens
aaauagcuacagugacagauuu

SEQ ID NO: 841598 - RNA, 23 nt, Homo sapiens
aaauauuguguugugcagcauua

SEQ ID NO: 841599 - RNA, 16 nt, Homo sapiens
aaauggguuggugcuu

SEQ ID NO: 841600 - RNA, 20 nt, Homo sapiens
aaauuuaauuaaagccuuaa

SEQ ID NO: 841601 - RNA, 21 nt, Homo sapiens
aaauuuaauuaaagccuuaag

SEQ ID NO: 841602 - RNA, 17 nt, Homo sapiens
aaauuuagaaagcuuaa

SEQ ID NO: 841603 - RNA, 18 nt, Homo sapiens
aacaauaaaguacuuuac

SEQ ID NO: 841604 - RNA, 22 nt, Homo sapiens
aacacggugaaaccccaucucu

SEQ ID NO: 841605 - RNA, 14 nt, Homo sapiens
aacagaagcaguug

SEQ ID NO: 841606 - RNA, 14 nt, Homo sapiens
aacagcaaagccau

SEQ ID NO: 841607 - RNA, 12 nt, Homo sapiens
aaccaggguuca

SEQ ID NO: 841608 - RNA, 17 nt, Homo sapiens
aaccauaaaucaauuca

SEQ ID NO: 841609 - RNA, 21 nt, Homo sapiens
aaccugugaaagcugcacuca

SEQ ID NO: 841610 - RNA, 13 nt, Homo sapiens
aaccuuucuacuu

SEQ ID NO: 841611 - RNA, 23 nt, Homo sapiens
aacguaauuguacaagcaguuaa

SEQ ID NO: 841612 - RNA, 23 nt, Homo sapiens
aacuguauuucaguauuuuccag

SEQ ID NO: 841613 - RNA, 20 nt, Homo sapiens
aacuugauucuugugauuga

SEQ ID NO: 841614 - RNA, 18 nt, Homo sapiens
aacuugcaauaccaaugu

SEQ ID NO: 841615 - RNA, 15 nt, Homo sapiens
aacuugcuacuuauc

SEQ ID NO: 841616 - RNA, 18 nt, Homo sapiens
aacuuuuagguuguuacc

SEQ ID NO: 841617 - RNA, 20 nt, Homo sapiens
aagaacuugcaauaccaaug

SEQ ID NO: 841618 - RNA, 19 nt, Homo sapiens
aagaaggccagcccacugg

SEQ ID NO: 841619 - RNA, 22 nt, Homo sapiens
aagaauaauguacguacuaccu

SEQ ID NO: 841620 - RNA, 11 nt, Homo sapiens
aagacugucaa

SEQ ID NO: 841621 - RNA, 22 nt, Homo sapiens
aagacugucaaaugaacuuuua

SEQ ID NO: 841622 - RNA, 22 nt, Homo sapiens
aagagaaugaacuguggaauuu

SEQ ID NO: 841623 - RNA, 17 nt, Homo sapiens
aagcuuuaucuuugugu

SEQ ID NO: 841624 - RNA, 12 nt, Homo sapiens
aaggaaacagaa

SEQ ID NO: 841625 - RNA, 20 nt, Homo sapiens
aaggaauguguccaagacac

SEQ ID NO: 841626 - RNA, 21 nt, Homo sapiens
aaggacuguaagcagauuaca

SEQ ID NO: 841627 - RNA, 19 nt, Homo sapiens
aaggagugcgugccugcua

SEQ ID NO: 841628 - RNA, 13 nt, Homo sapiens
aagggacauggga

SEQ ID NO: 841629 - RNA, 15 nt, Homo sapiens
aagggcccucacuca

SEQ ID NO: 841630 - RNA, 18 nt, Homo sapiens
aaggguggaaaaaugccc

SEQ ID NO: 841631 - RNA, 13 nt, Homo sapiens
aagguugcaguga

SEQ ID NO: 841632 - RNA, 20 nt, Homo sapiens
aaguaauuccucucacuaaa

SEQ ID NO: 841633 - RNA, 22 nt, Homo sapiens
aaguaauuccucucacuaaacu

SEQ ID NO: 841634 - RNA, 15 nt, Homo sapiens
aaguugggauuucau

SEQ ID NO: 841635 - RNA, 14 nt, Homo sapiens
aauaauacacuaau

SEQ ID NO: 841636 - RNA, 16 nt, Homo sapiens
aauacacuaauuccuu

SEQ ID NO: 841637 - RNA, 13 nt, Homo sapiens
aauaccaauguuc

SEQ ID NO: 841638 - RNA, 12 nt, Homo sapiens
aauaucugggug

SEQ ID NO: 841639 - RNA, 14 nt, Homo sapiens
aauauucagagaaa

SEQ ID NO: 841640 - RNA, 19 nt, Homo sapiens
aaucaguaaacacugugua

SEQ ID NO: 841641 - RNA, 18 nt, Homo sapiens
auccugagugugaugaac

SEQ ID NO: 841642 - RNA, 19 nt, Homo sapiens
auccugagugugaugaacg

SEQ ID NO: 841643 - RNA, 16 nt, Homo sapiens
aucguccagugacuuu

SEQ ID NO: 841644 - RNA, 13 nt, Homo sapiens
aucuagcauuuau

SEQ ID NO: 841645 - RNA, 18 nt, Homo sapiens
aucuauaacuacauauug

SEQ ID NO: 841646 - RNA, 16 nt, Homo sapiens
aucucuaauauggcaa

SEQ ID NO: 841647 - RNA, 21 nt, Homo sapiens
aucucuacuaaaaauacaaaa

SEQ ID NO: 841648 - RNA, 21 nt, Homo sapiens
aucucugaucccuuccuuguu

SEQ ID NO: 841649 - RNA, 15 nt, Homo sapiens
aucuguacuuugugu

SEQ ID NO: 841650 - RNA, 23 nt, Homo sapiens
aucuuuguguaaucuaaguauau

SEQ ID NO: 841651 - RNA, 18 nt, Homo sapiens
aucuuuguuuaaaugcca

SEQ ID NO: 841652 - RNA, 19 nt, Homo sapiens
aucuuuguuuaaaugccaa

SEQ ID NO: 841653 - RNA, 20 nt, Homo sapiens
aucuuuguuuaaaugccaaa

SEQ ID NO: 841654 - RNA, 17 nt, Homo sapiens
augaaacccuaucucua

SEQ ID NO: 841655 - RNA, 14 nt, Homo sapiens
augaacgugccuga

SEQ ID NO: 841656 - RNA, 13 nt, Homo sapiens
augagcaaccugg

SEQ ID NO: 841657 - RNA, 21 nt, Homo sapiens
augaguuacuuagaaugccau

SEQ ID NO: 841658 - RNA, 17 nt, Homo sapiens
augauuuugaugcacaa

SEQ ID NO: 841659 - RNA, 21 nt, Homo sapiens
augcaaaaacauaugucuguc

SEQ ID NO: 841660 - RNA, 16 nt, Homo sapiens
augcaaacugcuuuau

SEQ ID NO: 841661 - RNA, 13 nt, Homo sapiens
augcaacuugauu

SEQ ID NO: 841662 - RNA, 20 nt, Homo sapiens
augcaaggggaaaccuguga

SEQ ID NO: 841663 - RNA, 17 nt, Homo sapiens
augccuguaaucccagc

SEQ ID NO: 841664 - RNA, 22 nt, Homo sapiens
augccuuccgacaccacuggga

SEQ ID NO: 841665 - RNA, 19 nt, Homo sapiens
augcuggacauuaacaaga

SEQ ID NO: 841666 - RNA, 17 nt, Homo sapiens
auggcugcgcaccaucu

SEQ ID NO: 841667 - RNA, 22 nt, Homo sapiens
auguaaaggucacuuuucacau

SEQ ID NO: 841668 - RNA, 15 nt, Homo sapiens
auguacuauaacaua

SEQ ID NO: 841669 - RNA, 16 nt, Homo sapiens
auguuugguaccaaga

SEQ ID NO: 841670 - RNA, 12 nt, Homo sapiens
auuaaaacugag

SEQ ID NO: 841671 - RNA, 21 nt, Homo sapiens
auuaaaucauacuccuaugcu

SEQ ID NO: 841672 - RNA, 14 nt, Homo sapiens
auuaaaugugagca

SEQ ID NO: 841673 - RNA, 16 nt, Homo sapiens
auuaaaugugagcaaa

SEQ ID NO: 841674 - RNA, 14 nt, Homo sapiens
auuaauauaaccau

SEQ ID NO: 841675 - RNA, 19 nt, Homo sapiens
auucaggcuuuaggcauau

SEQ ID NO: 841676 - RNA, 17 nt, Homo sapiens
auucaugcaacuugauu

SEQ ID NO: 841677 - RNA, 21 nt, Homo sapiens
auucaugcaacuugauucuug

SEQ ID NO: 841678 - RNA, 22 nt, Homo sapiens
auuccaugcacucucucucugu

SEQ ID NO: 841679 - RNA, 18 nt, Homo sapiens
auucuccuguccuuguac

SEQ ID NO: 841680 - RNA, 18 nt, Homo sapiens
auucugaaauacuuuuga

SEQ ID NO: 841681 - RNA, 19 nt, Homo sapiens
auugagcuagaaaucacaa

SEQ ID NO: 841682 - RNA, 15 nt, Homo sapiens
auugcuaccaaaaac

SEQ ID NO: 841683 - RNA, 14 nt, Homo sapiens
auugucauuaguga

SEQ ID NO: 841684 - RNA, 23 nt, Homo sapiens
auugucauuagugagacauauuu

SEQ ID NO: 841685 - RNA, 13 nt, Homo sapiens
auuguguaugaga

SEQ ID NO: 841686 - RNA, 17 nt, Homo sapiens
auuguuaugaaaauccu

SEQ ID NO: 841687 - RNA, 19 nt, Homo sapiens
auuguuguaaaauguaaag

SEQ ID NO: 841688 - RNA, 22 nt, Homo sapiens
auuuaguacccugcaggccagg

SEQ ID NO: 841689 - RNA, 19 nt, Homo sapiens
auuucuaacauaaguaaga

SEQ ID NO: 841690 - RNA, 17 nt, Homo sapiens
caaaaacuagacauuau

SEQ ID NO: 841691 - RNA, 15 nt, Homo sapiens
caaaaauuaguaaua

SEQ ID NO: 841692 - RNA, 19 nt, Homo sapiens
caaaacacucuggaucuua

SEQ ID NO: 841693 - RNA, 16 nt, Homo sapiens
caaaaugcauguaauc

SEQ ID NO: 841694 - RNA, 16 nt, Homo sapiens
caaauaaaaugaaaua

SEQ ID NO: 841695 - RNA, 14 nt, Homo sapiens
caaauacacuuuau

SEQ ID NO: 841696 - RNA, 15 nt, Homo sapiens
caaaugaaauaaaua

SEQ ID NO: 841697 - RNA, 11 nt, Homo sapiens
caaauguccua

SEQ ID NO: 841698 - RNA, 22 nt, Homo sapiens
caaauuuaauuaaagccuuaag

SEQ ID NO: 841699 - RNA, 19 nt, Homo sapiens
caaauuuagaaagcuuaag

SEQ ID NO: 841700 - RNA, 15 nt, Homo sapiens
caacaagcaagaucu

SEQ ID NO: 841701 - RNA, 17 nt, Homo sapiens
caacaauaaaguacuuu

SEQ ID NO: 841702 - RNA, 21 nt, Homo sapiens
caacaugaugaaacccuaucu

SEQ ID NO: 841703 - RNA, 15 nt, Homo sapiens
caaccgccugcagga

SEQ ID NO: 841704 - RNA, 23 nt, Homo sapiens
caacgaugugacugccaucaucu

SEQ ID NO: 841705 - RNA, 21 nt, Homo sapiens
caacugaguggggaaaacaga

SEQ ID NO: 841706 - RNA, 16 nt, Homo sapiens
caagauguacuauaac

SEQ ID NO: 841707 - RNA, 16 nt, Homo sapiens
caagccaggagaagac

SEQ ID NO: 841708 - RNA, 22 nt, Homo sapiens
caaggagcaacagcgauggcag

SEQ ID NO: 841709 - RNA, 13 nt, Homo sapiens
cacacuuugaagg

SEQ ID NO: 841710 - RNA, 18 nt, Homo sapiens
cacaucuaaagcuuuauc

SEQ ID NO: 841711 - RNA, 17 nt, Homo sapiens
cacauucccaucuguca

SEQ ID NO: 841712 - RNA, 19 nt, Homo sapiens
cacccagcagaaauacaau

SEQ ID NO: 841713 - RNA, 14 nt, Homo sapiens
caccuauugaauua

SEQ ID NO: 841714 - RNA, 14 nt, Homo sapiens
caccuccugcuccu

SEQ ID NO: 841715 - RNA, 23 nt, Homo sapiens
caccugccccgucccccuagaga

SEQ ID NO: 841716 - RNA, 13 nt, Homo sapiens
cacuccaggugug

SEQ ID NO: 841717 - RNA, 13 nt, Homo sapiens
cacugacagccug

SEQ ID NO: 841718 - RNA, 17 nt, Homo sapiens
cacugccaccagcaaug

SEQ ID NO: 841719 - RNA, 17 nt, Homo sapiens
cacuguggcacugccac

SEQ ID NO: 841720 - RNA, 22 nt, Homo sapiens
cacuuugaagguaauaaauaca

SEQ ID NO: 841721 - RNA, 22 nt, Homo sapiens
cacuuuggggagagcuggagaa

SEQ ID NO: 841722 - RNA, 14 nt, Homo sapiens
cagaaucuguauga

SEQ ID NO: 841723 - RNA, 17 nt, Homo sapiens
cagacaaaguaauuccu

SEQ ID NO: 841724 - RNA, 21 nt, Homo sapiens
cagacaaaguaauuccucuca

SEQ ID NO: 841725 - RNA, 22 nt, Homo sapiens
cagagaaagaaaaggcaaaaga

SEQ ID NO: 841726 - RNA, 20 nt, Homo sapiens
cagagguugcaaugagccaa

SEQ ID NO: 841727 - RNA, 12 nt, Homo sapiens
cagcacugccag

SEQ ID NO: 841728 - RNA, 21 nt, Homo sapiens
cagcauuaaaaaaaaucaaaa

SEQ ID NO: 841729 - RNA, 13 nt, Homo sapiens
cagcuggcacuga

SEQ ID NO: 841730 - RNA, 15 nt, Homo sapiens
cagcuggcacugaca

SEQ ID NO: 841731 - RNA, 17 nt, Homo sapiens
caggagacugagaccau

SEQ ID NO: 841732 - RNA, 18 nt, Homo sapiens
caggcagcgauggucuca

SEQ ID NO: 841733 - RNA, 14 nt, Homo sapiens
cagggcaguacaau

SEQ ID NO: 841734 - RNA, 11 nt, Homo sapiens
cagggccucug

SEQ ID NO: 841735 - RNA, 13 nt, Homo sapiens
caguaaacacugu

SEQ ID NO: 841736 - RNA, 17 nt, Homo sapiens
caguauucuugucaaaa

SEQ ID NO: 841737 - RNA, 19 nt, Homo sapiens
cagugcuucaacgauguga

SEQ ID NO: 841738 - RNA, 17 nt, Homo sapiens
caguguuacaaggguau

SEQ ID NO: 841739 - RNA, 21 nt, Homo sapiens
caguugaaugacaacagaagc

SEQ ID NO: 841740 - RNA, 19 nt, Homo sapiens
cauaaccacccuagcuuua

SEQ ID NO: 841741 - RNA, 12 nt, Homo sapiens
cauaugcuucuu

SEQ ID NO: 841742 - RNA, 17 nt, Homo sapiens
cauauuuacaaccuaga

SEQ ID NO: 841743 - RNA, 19 nt, Homo sapiens
cauccgggaggacaaccag

SEQ ID NO: 841744 - RNA, 18 nt, Homo sapiens
caugauuaacaaagcaac

SEQ ID NO: 841745 - RNA, 15 nt, Homo sapiens
cauggaggccaagaa

SEQ ID NO: 841746 - RNA, 15 nt, Homo sapiens
caugugugcuaauau

SEQ ID NO: 841747 - RNA, 14 nt, Homo sapiens
cauguuugacgugg

SEQ ID NO: 841748 - RNA, 16 nt, Homo sapiens
cauuaacaagaucauu

SEQ ID NO: 841749 - RNA, 22 nt, Homo sapiens
cauuagugagacauauuuacaa

SEQ ID NO: 841750 - RNA, 15 nt, Homo sapiens
cauucccaucuguca

SEQ ID NO: 841751 - RNA, 20 nt, Homo sapiens
cauugaaaucagcaugacaa

SEQ ID NO: 841752 - RNA, 20 nt, Homo sapiens
cauugauuugauuuuuauua

SEQ ID NO: 841753 - RNA, 19 nt, Homo sapiens
cauuguuuuucugauaugu

SEQ ID NO: 841754 - RNA, 19 nt, Homo sapiens
cauuuauuucucuggcaaa

SEQ ID NO: 841755 - RNA, 18 nt, Homo sapiens
cauuucuguauacuguaa

SEQ ID NO: 841756 - RNA, 23 nt, Homo sapiens
cauuucuuauuuaauuagaaugg

SEQ ID NO: 841757 - RNA, 13 nt, Homo sapiens
ccaaaaacuaaau

SEQ ID NO: 841758 - RNA, 17 nt, Homo sapiens
aaucaugcucauguaua

SEQ ID NO: 841759 - RNA, 14 nt, Homo sapiens
aaucccagcacuuu

SEQ ID NO: 841760 - RNA, 17 nt, Homo sapiens
aaucuguaaaugaacac

SEQ ID NO: 841761 - RNA, 23 nt, Homo sapiens
aaugaagcaauuuauaucuuuau

SEQ ID NO: 841762 - RNA, 22 nt, Homo sapiens
aaugagcuccugcucauugugg

SEQ ID NO: 841763 - RNA, 13 nt, Homo sapiens
aaugcagccuuaa

SEQ ID NO: 841764 - RNA, 22 nt, Homo sapiens
aaugcccugccuugcugccuuc

SEQ ID NO: 841765 - RNA, 22 nt, Homo sapiens
aauggggcgcuggacaccuaca

SEQ ID NO: 841766 - RNA, 20 nt, Homo sapiens
aauguucuaaaguuuugcaa

SEQ ID NO: 841767 - RNA, 12 nt, Homo sapiens
aauuaaaacuga

SEQ ID NO: 841768 - RNA, 19 nt, Homo sapiens
aauuaauuugugcaucaga

SEQ ID NO: 841769 - RNA, 17 nt, Homo sapiens
aauuauguuuucaucca

SEQ ID NO: 841770 - RNA, 22 nt, Homo sapiens
aauuauguuuucauccauuaaa

SEQ ID NO: 841771 - RNA, 16 nt, Homo sapiens
aauucauuguguauga

SEQ ID NO: 841772 - RNA, 15 nt, Homo sapiens
aauuccaugcacucu

SEQ ID NO: 841773 - RNA, 13 nt, Homo sapiens
aauuguacaagca

SEQ ID NO: 841774 - RNA, 18 nt, Homo sapiens
aauuuaauggacugugaa

SEQ ID NO: 841775 - RNA, 18 nt, Homo sapiens
aauuuauuaaaaugauug

SEQ ID NO: 841776 - RNA, 13 nt, Homo sapiens
aauuuugcuacau

SEQ ID NO: 841777 - RNA, 15 nt, Homo sapiens
acaacagauggcugc

SEQ ID NO: 841778 - RNA, 14 nt, Homo sapiens
acaagaaggccagc

SEQ ID NO: 841779 - RNA, 14 nt, Homo sapiens
acaaguuugcuaaa

SEQ ID NO: 841780 - RNA, 13 nt, Homo sapiens
acaauuaauuaaa

SEQ ID NO: 841781 - RNA, 18 nt, Homo sapiens
acagagcgagaccgucuc

SEQ ID NO: 841782 - RNA, 20 nt, Homo sapiens
acagcagcagcaaacaaaua

SEQ ID NO: 841783 - RNA, 19 nt, Homo sapiens
acagguggggagagacaga

SEQ ID NO: 841784 - RNA, 19 nt, Homo sapiens
acaguuauagaaagcaaga

SEQ ID NO: 841785 - RNA, 20 nt, Homo sapiens
acauagaauugcaaucuaua

SEQ ID NO: 841786 - RNA, 18 nt, Homo sapiens
accaagggcccucacuca

SEQ ID NO: 841787 - RNA, 10 nt, Homo sapiens
accagucacc

SEQ ID NO: 841788 - RNA, 13 nt, Homo sapiens
accagucuuucaa

SEQ ID NO: 841789 - RNA, 16 nt, Homo sapiens
accauauugcucuuaa

SEQ ID NO: 841790 - RNA, 14 nt, Homo sapiens
accaucucugugau

SEQ ID NO: 841791 - RNA, 20 nt, Homo sapiens
accaugcaggcaacauuacc

SEQ ID NO: 841792 - RNA, 22 nt, Homo sapiens
accauuauuuuacagucucugu

SEQ ID NO: 841793 - RNA, 22 nt, Homo sapiens
accggccgcagcccccacugac

SEQ ID NO: 841794 - RNA, 17 nt, Homo sapiens
accuacaggacugggcc

SEQ ID NO: 841795 - RNA, 17 nt, Homo sapiens
accuccuaggaguacaa

SEQ ID NO: 841796 - RNA, 20 nt, Homo sapiens
accugaaaaaaaguuuacaa

SEQ ID NO: 841797 - RNA, 16 nt, Homo sapiens
acggcccaucuuggca

SEQ ID NO: 841798 - RNA, 20 nt, Homo sapiens
acggugguucaugccuguaa

SEQ ID NO: 841799 - RNA, 21 nt, Homo sapiens
acguaauuguacaagcaguua

SEQ ID NO: 841800 - RNA, 20 nt, Homo sapiens
acgugcugcuuacacuccag

SEQ ID NO: 841801 - RNA, 15 nt, Homo sapiens
acuacuccugaggau

SEQ ID NO: 841802 - RNA, 18 nt, Homo sapiens
acuauuucugaacaaaga

SEQ ID NO: 841803 - RNA, 14 nt, Homo sapiens
acugacucuguuau

SEQ ID NO: 841804 - RNA, 15 nt, Homo sapiens
acugcagcuuuacau

SEQ ID NO: 841805 - RNA, 13 nt, Homo sapiens
acugccaccagca

SEQ ID NO: 841806 - RNA, 19 nt, Homo sapiens
acugcgagguuguuuuaaa

SEQ ID NO: 841807 - RNA, 21 nt, Homo sapiens
acuguggcacugccaccagca

SEQ ID NO: 841808 - RNA, 14 nt, Homo sapiens
agaaaagcaugaaa

SEQ ID NO: 841809 - RNA, 21 nt, Homo sapiens
agaaauagaggugaugcugcu

SEQ ID NO: 841810 - RNA, 11 nt, Homo sapiens
agaaaugccag

SEQ ID NO: 841811 - RNA, 20 nt, Homo sapiens
agaaauuauguuuucaucca

SEQ ID NO: 841812 - RNA, 15 nt, Homo sapiens
agaacaaauacacuu

SEQ ID NO: 841813 - RNA, 15 nt, Homo sapiens
agaacaggauucuag

SEQ ID NO: 841814 - RNA, 20 nt, Homo sapiens
agaacuugcaauaccaaugu

SEQ ID NO: 841815 - RNA, 18 nt, Homo sapiens
agaagaccccugcccaag

SEQ ID NO: 841816 - RNA, 14 nt, Homo sapiens
agaaggccagccca

SEQ ID NO: 841817 - RNA, 20 nt, Homo sapiens
agaagggaacccccaaauuu

SEQ ID NO: 841818 - RNA, 18 nt, Homo sapiens
agaaguuuuuuacuuugg

SEQ ID NO: 841819 - RNA, 23 nt, Homo sapiens
agaauuauuuuuaagugguuuua

SEQ ID NO: 841820 - RNA, 17 nt, Homo sapiens
agacaaaguaauuccuc

SEQ ID NO: 841821 - RNA, 18 nt, Homo sapiens
agacagaagucagguguc

SEQ ID NO: 841822 - RNA, 12 nt, Homo sapiens
agacaucugccu

SEQ ID NO: 841823 - RNA, 21 nt, Homo sapiens
agaccacaaaaauugacucaa

SEQ ID NO: 841824 - RNA, 18 nt, Homo sapiens
agacuugcggccacagca

SEQ ID NO: 841825 - RNA, 16 nt, Homo sapiens
agaguggccugugagc

SEQ ID NO: 841826 - RNA, 23 nt, Homo sapiens
agaugagggugucggcugugagg

SEQ ID NO: 841827 - RNA, 23 nt, Homo sapiens
agaugggcgucacuacugcuacc

SEQ ID NO: 841828 - RNA, 20 nt, Homo sapiens
agauguacuauaacauagaa

SEQ ID NO: 841829 - RNA, 22 nt, Homo sapiens
agcaaacaaauaaaaugaaaua

SEQ ID NO: 841830 - RNA, 22 nt, Homo sapiens
agcaagaucugcucgcugagaa

SEQ ID NO: 841831 - RNA, 14 nt, Homo sapiens
agcaagauguacua

SEQ ID NO: 841832 - RNA, 15 nt, Homo sapiens
agcagcuggcacuga

SEQ ID NO: 841833 - RNA, 20 nt, Homo sapiens
agccaagaucgcgccacugc

SEQ ID NO: 841834 - RNA, 18 nt, Homo sapiens
agccaggagaagaccccu

SEQ ID NO: 841835 - RNA, 12 nt, Homo sapiens
agcccccacuga

SEQ ID NO: 841836 - RNA, 13 nt, Homo sapiens
agcuaaucugccu

SEQ ID NO: 841837 - RNA, 15 nt, Homo sapiens
agcugagagacuuuu

SEQ ID NO: 841838 - RNA, 22 nt, Homo sapiens
aggaagguggugcuuacauccu

SEQ ID NO: 841839 - RNA, 15 nt, Homo sapiens
aggacaucaaaaaca

SEQ ID NO: 841840 - RNA, 21 nt, Homo sapiens
aggcacggugguucaugccug

SEQ ID NO: 841841 - RNA, 19 nt, Homo sapiens
aggcagaucuuuaaauaca

SEQ ID NO: 841842 - RNA, 21 nt, Homo sapiens
aggccauuugcugcccugggg

SEQ ID NO: 841843 - RNA, 18 nt, Homo sapiens
aggcgauugaaaccauug

SEQ ID NO: 841844 - RNA, 17 nt, Homo sapiens
aggguauccugugcuau

SEQ ID NO: 841845 - RNA, 17 nt, Homo sapiens
agguugcaaugagccaa

SEQ ID NO: 841846 - RNA, 21 nt, Homo sapiens
agguuuugaauaaaaagugaa

SEQ ID NO: 841847 - RNA, 14 nt, Homo sapiens
aguaaacacugugu

SEQ ID NO: 841848 - RNA, 15 nt, Homo sapiens
aguaaacacugugua

SEQ ID NO: 841849 - RNA, 22 nt, Homo sapiens
aguagaauuaagucagagccaa

SEQ ID NO: 841850 - RNA, 22 nt, Homo sapiens
agugacauaauuguccaguuau

SEQ ID NO: 841851 - RNA, 18 nt, Homo sapiens
agugacugcaagcauuuu

SEQ ID NO: 841852 - RNA, 14 nt, Homo sapiens
agugccuggggugu

SEQ ID NO: 841853 - RNA, 21 nt, Homo sapiens
agugggguuuuauauccauuu

SEQ ID NO: 841854 - RNA, 14 nt, Homo sapiens
aguguccaggagau

SEQ ID NO: 841855 - RNA, 17 nt, Homo sapiens
aguuauaauaacugaac

SEQ ID NO: 841856 - RNA, 16 nt, Homo sapiens
aguugcuuuuauugca

SEQ ID NO: 841857 - RNA, 23 nt, Homo sapiens
auaaaauugcaguuucauguaug

SEQ ID NO: 841858 - RNA, 13 nt, Homo sapiens
auaaaauuucccc

SEQ ID NO: 841859 - RNA, 19 nt, Homo sapiens
auaaacacuguuuguucca

SEQ ID NO: 841860 - RNA, 21 nt, Homo sapiens
auaaaucaauucauuguguau

SEQ ID NO: 841861 - RNA, 19 nt, Homo sapiens
auaaccacccuagcuuuau

SEQ ID NO: 841862 - RNA, 21 nt, Homo sapiens
auaaccauaaaucaauucauu

SEQ ID NO: 841863 - RNA, 14 nt, Homo sapiens
auaacugaacuguu

SEQ ID NO: 841864 - RNA, 19 nt, Homo sapiens
auaaucaugcucauguaua

SEQ ID NO: 841865 - RNA, 15 nt, Homo sapiens
auaauuguugauauu

SEQ ID NO: 841866 - RNA, 20 nt, Homo sapiens
auacacuuuauuaauauaac

SEQ ID NO: 841867 - RNA, 13 nt, Homo sapiens
auaccgugggggu

SEQ ID NO: 841868 - RNA, 14 nt, Homo sapiens
auagaaaacugaaa

SEQ ID NO: 841869 - RNA, 18 nt, Homo sapiens
auagaauugcaaucuaua

SEQ ID NO: 841870 - RNA, 14 nt, Homo sapiens
auagcauaggcaaa

SEQ ID NO: 841871 - RNA, 18 nt, Homo sapiens
auaguuaaucuauaacua

SEQ ID NO: 841872 - RNA, 13 nt, Homo sapiens
auauguaucuuug

SEQ ID NO: 841873 - RNA, 14 nt, Homo sapiens
aucagcaugacaaa

SEQ ID NO: 841874 - RNA, 14 nt, Homo sapiens
auccuauaucuguu

SEQ ID NO: 841875 - RNA, 17 nt, Homo sapiens
caaagguugcagugagu

SEQ ID NO: 841876 - RNA, 17 nt, Homo sapiens
caaauaaacucuaaaca

SEQ ID NO: 841877 - RNA, 20 nt, Homo sapiens
caaauuuaauuaaagccuua

SEQ ID NO: 841878 - RNA, 17 nt, Homo sapiens
caaauuuagaaagcuua

SEQ ID NO: 841879 - RNA, 23 nt, Homo sapiens
caacaauaaaguacuuuaccuaa

SEQ ID NO: 841880 - RNA, 17 nt, Homo sapiens
caacagugagucuguca

SEQ ID NO: 841881 - RNA, 17 nt, Homo sapiens
caacucgugacagccuc

SEQ ID NO: 841882 - RNA, 12 nt, Homo sapiens
caacuuucugua

SEQ ID NO: 841883 - RNA, 13 nt, Homo sapiens
caacuuucuguaa

SEQ ID NO: 841884 - RNA, 13 nt, Homo sapiens
caagaacuugcaa

SEQ ID NO: 841885 - RNA, 21 nt, Homo sapiens
caagaguuuauuuccaaauaa

SEQ ID NO: 841886 - RNA, 21 nt, Homo sapiens
caagaucgcgccacugcacuc

SEQ ID NO: 841887 - RNA, 16 nt, Homo sapiens
caagcaagaucugcuc

SEQ ID NO: 841888 - RNA, 15 nt, Homo sapiens
caagcuaaucugccu

SEQ ID NO: 841889 - RNA, 16 nt, Homo sapiens
caagggcccucacuca

SEQ ID NO: 841890 - RNA, 12 nt, Homo sapiens
caaguacuucau

SEQ ID NO: 841891 - RNA, 18 nt, Homo sapiens
caauaaauccuuuacuuu

SEQ ID NO: 841892 - RNA, 14 nt, Homo sapiens
caauaguuugcaua

SEQ ID NO: 841893 - RNA, 21 nt, Homo sapiens
caaugauacccaacaguuuau

SEQ ID NO: 841894 - RNA, 13 nt, Homo sapiens
cacaaacauaugu

SEQ ID NO: 841895 - RNA, 20 nt, Homo sapiens
cacaagaacaaauacacuuu

SEQ ID NO: 841896 - RNA, 22 nt, Homo sapiens
cacacugcggugucugcagcuc

SEQ ID NO: 841897 - RNA, 15 nt, Homo sapiens
cacagcacuagaguc

SEQ ID NO: 841898 - RNA, 16 nt, Homo sapiens
cacagcacuagaguca

SEQ ID NO: 841899 - RNA, 18 nt, Homo sapiens
cacaguuggcuggaugaa

SEQ ID NO: 841900 - RNA, 14 nt, Homo sapiens
caccauugugaagc

SEQ ID NO: 841901 - RNA, 22 nt, Homo sapiens
cacccugggcagugagugccau

SEQ ID NO: 841902 - RNA, 15 nt, Homo sapiens
caccuccugcuccuu

SEQ ID NO: 841903 - RNA, 14 nt, Homo sapiens
caccuugcauuuca

SEQ ID NO: 841904 - RNA, 18 nt, Homo sapiens
cacuuagcuaucagaaga

SEQ ID NO: 841905 - RNA, 23 nt, Homo sapiens
cagaaauacaacagaaguuauau

SEQ ID NO: 841906 - RNA, 23 nt, Homo sapiens
cagaagcaguugagucgucauca

SEQ ID NO: 841907 - RNA, 18 nt, Homo sapiens
cagagcgagaccgucuca

SEQ ID NO: 841908 - RNA, 14 nt, Homo sapiens
cagagguugcaaug

SEQ ID NO: 841909 - RNA, 15 nt, Homo sapiens
cagagguugcaauga

SEQ ID NO: 841910 - RNA, 23 nt, Homo sapiens
cagcaaacaaauaaaaugaaaua

SEQ ID NO: 841911 - RNA, 14 nt, Homo sapiens
cagcacugccagug

SEQ ID NO: 841912 - RNA, 13 nt, Homo sapiens
cagcccacugggc

SEQ ID NO: 841913 - RNA, 16 nt, Homo sapiens
cagcccccacugaccu

SEQ ID NO: 841914 - RNA, 15 nt, Homo sapiens
cagcgauggcaguga

SEQ ID NO: 841915 - RNA, 18 nt, Homo sapiens
cagcgauggcagugagaa

SEQ ID NO: 841916 - RNA, 17 nt, Homo sapiens
cagcugauugacugugc

SEQ ID NO: 841917 - RNA, 21 nt, Homo sapiens
cagcuuccccucacuuaacca

SEQ ID NO: 841918 - RNA, 17 nt, Homo sapiens
caggaacccuggagaca

SEQ ID NO: 841919 - RNA, 13 nt, Homo sapiens
caggcucccugac

SEQ ID NO: 841920 - RNA, 19 nt, Homo sapiens
cagggaugcaaagguugca

SEQ ID NO: 841921 - RNA, 23 nt, Homo sapiens
caggguuggccaggcacgguggu

SEQ ID NO: 841922 - RNA, 15 nt, Homo sapiens
caggugucaucauca

SEQ ID NO: 841923 - RNA, 15 nt, Homo sapiens
caguaaaaauaaaua

SEQ ID NO: 841924 - RNA, 18 nt, Homo sapiens
caguauuuuccagccuua

SEQ ID NO: 841925 - RNA, 15 nt, Homo sapiens
cagucuuaauauuca

SEQ ID NO: 841926 - RNA, 14 nt, Homo sapiens
cagucuuucaacuc

SEQ ID NO: 841927 - RNA, 23 nt, Homo sapiens
cagugacuuucaggaauugccca

SEQ ID NO: 841928 - RNA, 16 nt, Homo sapiens
cagugaguugagucau

SEQ ID NO: 841929 - RNA, 12 nt, Homo sapiens
caguuauagaaa

SEQ ID NO: 841930 - RNA, 18 nt, Homo sapiens
caguuuuuuuuuuuccag

SEQ ID NO: 841931 - RNA, 13 nt, Homo sapiens
cauaccagucacc

SEQ ID NO: 841932 - RNA, 12 nt, Homo sapiens
cauagaauugca

SEQ ID NO: 841933 - RNA, 15 nt, Homo sapiens
cauagauugcaaaua

SEQ ID NO: 841934 - RNA, 19 nt, Homo sapiens
cauauugcuaccaaaaacu

SEQ ID NO: 841935 - RNA, 18 nt, Homo sapiens
caucagucuuaauauuca

SEQ ID NO: 841936 - RNA, 19 nt, Homo sapiens
cauccccgaaagaggugaa

SEQ ID NO: 841937 - RNA, 14 nt, Homo sapiens
cauggaggccaaga

SEQ ID NO: 841938 - RNA, 18 nt, Homo sapiens
cauggaggccaagaacuu

SEQ ID NO: 841939 - RNA, 22 nt, Homo sapiens
cauggaggccaagaacuugcaa

SEQ ID NO: 841940 - RNA, 23 nt, Homo sapiens
cauggaggccaagaacuugcaau

SEQ ID NO: 841941 - RNA, 18 nt, Homo sapiens
cauguauguauauaauca

SEQ ID NO: 841942 - RNA, 21 nt, Homo sapiens
cauguuugucugugugcugua

SEQ ID NO: 841943 - RNA, 23 nt, Homo sapiens
cauuucuaacauaaguaagacuu

SEQ ID NO: 841944 - RNA, 13 nt, Homo sapiens
ccaaaauaaucua

SEQ ID NO: 841945 - RNA, 16 nt, Homo sapiens
ccaaaauguacuuaaa

SEQ ID NO: 841946 - RNA, 15 nt, Homo sapiens
ccaaauuuaauuaaa

SEQ ID NO: 841947 - RNA, 20 nt, Homo sapiens
ccaaauuuagaaagcuuaag

SEQ ID NO: 841948 - RNA, 22 nt, Homo sapiens
ccaaggaauguguccaagacac

SEQ ID NO: 841949 - RNA, 20 nt, Homo sapiens
aaaaugcauguaaucaacau

SEQ ID NO: 841950 - RNA, 19 nt, Homo sapiens
aaacagcagcagcaaacaa

SEQ ID NO: 841951 - RNA, 12 nt, Homo sapiens
aaaccauugugg

SEQ ID NO: 841952 - RNA, 13 nt, Homo sapiens
aaaccccaucucu

SEQ ID NO: 841953 - RNA, 14 nt, Homo sapiens
aaacguauuuugau

SEQ ID NO: 841954 - RNA, 16 nt, Homo sapiens
aaacuaaaucucuaau

SEQ ID NO: 841955 - RNA, 23 nt, Homo sapiens
aaacuaacaauaugauugcacua

SEQ ID NO: 841956 - RNA, 18 nt, Homo sapiens
aaacuacacaucccuaau

SEQ ID NO: 841957 - RNA, 18 nt, Homo sapiens
aaacugcuuuauuuuccc

SEQ ID NO: 841958 - RNA, 14 nt, Homo sapiens
aaagaggugaaaga

SEQ ID NO: 841959 - RNA, 15 nt, Homo sapiens
aaagcaugggaaaaa

SEQ ID NO: 841960 - RNA, 17 nt, Homo sapiens
aaagcaugggaaaaaga

SEQ ID NO: 841961 - RNA, 17 nt, Homo sapiens
aaagccaccuuguuaca

SEQ ID NO: 841962 - RNA, 15 nt, Homo sapiens
aaagucaacuuccac

SEQ ID NO: 841963 - RNA, 19 nt, Homo sapiens
aaaguuuugcaacaauaaa

SEQ ID NO: 841964 - RNA, 21 nt, Homo sapiens
aaauaaaacagcagcagcaaa

SEQ ID NO: 841965 - RNA, 15 nt, Homo sapiens
aaauaagaaugauuu

SEQ ID NO: 841966 - RNA, 18 nt, Homo sapiens
aaauaucuggguggcuua

SEQ ID NO: 841967 - RNA, 20 nt, Homo sapiens
aaauauggaacuucuaauau

SEQ ID NO: 841968 - RNA, 18 nt, Homo sapiens
aaaucaauucauugugua

SEQ ID NO: 841969 - RNA, 18 nt, Homo sapiens
aaaucacaagaacaaaua

SEQ ID NO: 841970 - RNA, 16 nt, Homo sapiens
aaaucagcaugacaaa

SEQ ID NO: 841971 - RNA, 12 nt, Homo sapiens
aaaugaacacau

SEQ ID NO: 841972 - RNA, 14 nt, Homo sapiens
aaaugcauguaauc

SEQ ID NO: 841973 - RNA, 16 nt, Homo sapiens
aaauggcuuacuuaca

SEQ ID NO: 841974 - RNA, 17 nt, Homo sapiens
aaauuaacaguccuaac

SEQ ID NO: 841975 - RNA, 23 nt, Homo sapiens
aaauuauguuuucauccauuaaa

SEQ ID NO: 841976 - RNA, 17 nt, Homo sapiens
aaauucacuguugaaug

SEQ ID NO: 841977 - RNA, 21 nt, Homo sapiens
aacaaagagagcucaucauca

SEQ ID NO: 841978 - RNA, 22 nt, Homo sapiens
aacaauaaaguacuuuaccuaa

SEQ ID NO: 841979 - RNA, 19 nt, Homo sapiens
aacauaaguaagacuugau

SEQ ID NO: 841980 - RNA, 21 nt, Homo sapiens
aaccaccccauaccagucacc

SEQ ID NO: 841981 - RNA, 20 nt, Homo sapiens
aaccagaccaaccgccugca

SEQ ID NO: 841982 - RNA, 15 nt, Homo sapiens
aacccuggagacaga

SEQ ID NO: 841983 - RNA, 19 nt, Homo sapiens
aaccuuacuggcacugugg

SEQ ID NO: 841984 - RNA, 20 nt, Homo sapiens
aacgacugccgugacaucau

SEQ ID NO: 841985 - RNA, 16 nt, Homo sapiens
aacgaugugacugcca

SEQ ID NO: 841986 - RNA, 18 nt, Homo sapiens
aacucaggaggcagaggu

SEQ ID NO: 841987 - RNA, 13 nt, Homo sapiens
aacucgugacagc

SEQ ID NO: 841988 - RNA, 16 nt, Homo sapiens
aacugacucuguuauu

SEQ ID NO: 841989 - RNA, 17 nt, Homo sapiens
aacugcuuuauuuuccc

SEQ ID NO: 841990 - RNA, 17 nt, Homo sapiens
aacuggugauauaucuc

SEQ ID NO: 841991 - RNA, 13 nt, Homo sapiens
aacuugcaauacc

SEQ ID NO: 841992 - RNA, 15 nt, Homo sapiens
aacuugcaauaccaa

SEQ ID NO: 841993 - RNA, 14 nt, Homo sapiens
aacuuucuacucau

SEQ ID NO: 841994 - RNA, 15 nt, Homo sapiens
aagaaagaagugacu

SEQ ID NO: 841995 - RNA, 11 nt, Homo sapiens
aagaaggccag

SEQ ID NO: 841996 - RNA, 13 nt, Homo sapiens
aagacaucugccu

SEQ ID NO: 841997 - RNA, 19 nt, Homo sapiens
aagacugucaaaugaacuu

SEQ ID NO: 841998 - RNA, 24 nt, Homo sapiens
aagaguucuauggagacuuugcug

SEQ ID NO: 841999 - RNA, 17 nt, Homo sapiens
aagaucauuaucuucau

SEQ ID NO: 842000 - RNA, 22 nt, Homo sapiens
aagaugagggugucggcuguga

SEQ ID NO: 842001 - RNA, 22 nt, Homo sapiens
aagaugauggaaacgcacuuac

SEQ ID NO: 842002 - RNA, 23 nt, Homo sapiens
aagcaauuuauaucuuuaugcaa

SEQ ID NO: 842003 - RNA, 13 nt, Homo sapiens
aagcagaugagga

SEQ ID NO: 842004 - RNA, 14 nt, Homo sapiens
aagcauuuuuccau

SEQ ID NO: 842005 - RNA, 19 nt, Homo sapiens
aagccuuaagcacaauuaa

SEQ ID NO: 842006 - RNA, 16 nt, Homo sapiens
aagcuuuaucuuugug

SEQ ID NO: 842007 - RNA, 14 nt, Homo sapiens
aaggacuccaaagc

SEQ ID NO: 842008 - RNA, 15 nt, Homo sapiens
aagggagaaaugcca

SEQ ID NO: 842009 - RNA, 15 nt, Homo sapiens
aaguaagacuugauu

SEQ ID NO: 842010 - RNA, 19 nt, Homo sapiens
aagucaggugucaucauca

SEQ ID NO: 842011 - RNA, 17 nt, Homo sapiens
aaguuuugcaacaauaa

SEQ ID NO: 842012 - RNA, 16 nt, Homo sapiens
aauaaaaagugaacuu

SEQ ID NO: 842013 - RNA, 16 nt, Homo sapiens
aauaaaaauaagaaau

SEQ ID NO: 842014 - RNA, 15 nt, Homo sapiens
aauaaucuauauuaa

SEQ ID NO: 842015 - RNA, 22 nt, Homo sapiens
aauacaauccgagcuacaaagc

SEQ ID NO: 842016 - RNA, 15 nt, Homo sapiens
aauaccaauguucua

SEQ ID NO: 842017 - RNA, 22 nt, Homo sapiens
aauauuguguugugcagcauua

SEQ ID NO: 842018 - RNA, 18 nt, Homo sapiens
aaucaaaauaaaaauuaa

SEQ ID NO: 842019 - RNA, 23 nt, Homo sapiens
aaucacccaccauagggcaugau

SEQ ID NO: 842020 - RNA, 16 nt, Homo sapiens
aaucaugcucauguau

SEQ ID NO: 842021 - RNA, 18 nt, Homo sapiens
aaucuauaacuacauauu

SEQ ID NO: 842022 - RNA, 18 nt, Homo sapiens
ccaagggcccucacucag

SEQ ID NO: 842023 - RNA, 23 nt, Homo sapiens
ccaauguucuaaaguuuugcaac

SEQ ID NO: 842024 - RNA, 22 nt, Homo sapiens
ccagcaccuauugaauuaccau

SEQ ID NO: 842025 - RNA, 15 nt, Homo sapiens
ccagcuagugccaaa

SEQ ID NO: 842026 - RNA, 17 nt, Homo sapiens
ccagcuagugccaaaua

SEQ ID NO: 842027 - RNA, 17 nt, Homo sapiens
ccaggcacggugguuca

SEQ ID NO: 842028 - RNA, 17 nt, Homo sapiens
ccaggcucccugaccac

SEQ ID NO: 842029 - RNA, 18 nt, Homo sapiens
ccagucaauuacauguuu

SEQ ID NO: 842030 - RNA, 19 nt, Homo sapiens
ccagugagauuacagagga

SEQ ID NO: 842031 - RNA, 18 nt, Homo sapiens
ccauauucuaaauucacu

SEQ ID NO: 842032 - RNA, 16 nt, Homo sapiens
cccagggaugcaaagg

SEQ ID NO: 842033 - RNA, 13 nt, Homo sapiens
ccccaggccucca

SEQ ID NO: 842034 - RNA, 19 nt, Homo sapiens
cccgaauucuaugagcaug

SEQ ID NO: 842035 - RNA, 22 nt, Homo sapiens
cccugaccacccugccugugga

SEQ ID NO: 842036 - RNA, 17 nt, Homo sapiens
cccugccuugcugccuu

SEQ ID NO: 842037 - RNA, 18 nt, Homo sapiens
cccuggagacagaaguca

SEQ ID NO: 842038 - RNA, 13 nt, Homo sapiens
cccuucuggagau

SEQ ID NO: 842039 - RNA, 15 nt, Homo sapiens
ccgagcuacaaagca

SEQ ID NO: 842040 - RNA, 17 nt, Homo sapiens
ccgggcaugguggugca

SEQ ID NO: 842041 - RNA, 12 nt, Homo sapiens
ccgugaacacaa

SEQ ID NO: 842042 - RNA, 19 nt, Homo sapiens
ccuaggaguacaagugccu

SEQ ID NO: 842043 - RNA, 13 nt, Homo sapiens
ccucaacaagcaa

SEQ ID NO: 842044 - RNA, 22 nt, Homo sapiens
ccucauuucaccugcgcugugg

SEQ ID NO: 842045 - RNA, 22 nt, Homo sapiens
ccuccuaggaguacaagugccu

SEQ ID NO: 842046 - RNA, 23 nt, Homo sapiens
ccuccugugccucccuuuucucc

SEQ ID NO: 842047 - RNA, 18 nt, Homo sapiens
ccucuuuugugagaagau

SEQ ID NO: 842048 - RNA, 22 nt, Homo sapiens
ccugacuucuggaaucuuugag

SEQ ID NO: 842049 - RNA, 21 nt, Homo sapiens
ccugcagccgugcaggacucu

SEQ ID NO: 842050 - RNA, 19 nt, Homo sapiens
ccuggcuaacacggugaaa

SEQ ID NO: 842051 - RNA, 14 nt, Homo sapiens
ccuguuaggucuca

SEQ ID NO: 842052 - RNA, 16 nt, Homo sapiens
ccuuaaacagugucca

SEQ ID NO: 842053 - RNA, 12 nt, Homo sapiens
ccuuaaauauca

SEQ ID NO: 842054 - RNA, 12 nt, Homo sapiens
ccuuaagcacaa

SEQ ID NO: 842055 - RNA, 20 nt, Homo sapiens
ccuuuugguuccucacauau

SEQ ID NO: 842056 - RNA, 14 nt, Homo sapiens
cgacaccacuggga

SEQ ID NO: 842057 - RNA, 15 nt, Homo sapiens
cgaugugacugccau

SEQ ID NO: 842058 - RNA, 23 nt, Homo sapiens
cgcauuggcucaugucuguaauc

SEQ ID NO: 842059 - RNA, 23 nt, Homo sapiens
cgccguguguucaacgacugccg

SEQ ID NO: 842060 - RNA, 20 nt, Homo sapiens
cggccacagcacuagaguca

SEQ ID NO: 842061 - RNA, 17 nt, Homo sapiens
cguaauuguacaagcag

SEQ ID NO: 842062 - RNA, 16 nt, Homo sapiens
cgugacagccucugac

SEQ ID NO: 842063 - RNA, 23 nt, Homo sapiens
cgugccugcuacgaacgcuccaa

SEQ ID NO: 842064 - RNA, 19 nt, Homo sapiens
cuaaagggagaaaugccag

SEQ ID NO: 842065 - RNA, 15 nt, Homo sapiens
aaaaauauugcuaaa

SEQ ID NO: 842066 - RNA, 15 nt, Homo sapiens
aaaacaaaacaaaca

SEQ ID NO: 842067 - RNA, 22 nt, Homo sapiens
aaaagacugguuuguuugcuua

SEQ ID NO: 842068 - RNA, 12 nt, Homo sapiens
aaaauaaucuau

SEQ ID NO: 842069 - RNA, 22 nt, Homo sapiens
aaaauccuauaucuguuuguau

SEQ ID NO: 842070 - RNA, 22 nt, Homo sapiens
agaagugacuaggguucagaga

SEQ ID NO: 842071 - RNA, 16 nt, Homo sapiens
agaauggaauuuugcu

SEQ ID NO: 842072 - RNA, 17 nt, Homo sapiens
agaauuugcucgcuaca

SEQ ID NO: 842073 - RNA, 22 nt, Homo sapiens
agacucagaggacccaccuggg

SEQ ID NO: 842074 - RNA, 18 nt, Homo sapiens
agagcgagaccgucucaa

SEQ ID NO: 842075 - RNA, 16 nt, Homo sapiens
agagguugcaaugagc

SEQ ID NO: 842076 - RNA, 18 nt, Homo sapiens
agaguucuauuagaagcu

SEQ ID NO: 842077 - RNA, 19 nt, Homo sapiens
agaguuguuguuugccaag

SEQ ID NO: 842078 - RNA, 18 nt, Homo sapiens
agauaagucuacauuaaa

SEQ ID NO: 842079 - RNA, 18 nt, Homo sapiens
agaucugcucgcugagaa

SEQ ID NO: 842080 - RNA, 22 nt, Homo sapiens
agaugggggcuggagggggcag

SEQ ID NO: 842081 - RNA, 12 nt, Homo sapiens
agcaaacaaaua

SEQ ID NO: 842082 - RNA, 14 nt, Homo sapiens
agcaagagccaggg

SEQ ID NO: 842083 - RNA, 20 nt, Homo sapiens
agccaggagaagaccccugc

SEQ ID NO: 842084 - RNA, 14 nt, Homo sapiens
agcccccacugacc

SEQ ID NO: 842085 - RNA, 21 nt, Homo sapiens
agcccuggauggccucugggg

SEQ ID NO: 842086 - RNA, 19 nt, Homo sapiens
agccgggcaugguggugca

SEQ ID NO: 842087 - RNA, 17 nt, Homo sapiens
agcuauuuuaaaccaau

SEQ ID NO: 842088 - RNA, 21 nt, Homo sapiens
agcuguaguagcccuuucugu

SEQ ID NO: 842089 - RNA, 21 nt, Homo sapiens
agcuucagaaguuuggcaaua

SEQ ID NO: 842090 - RNA, 14 nt, Homo sapiens
aggaacccuggaga

SEQ ID NO: 842091 - RNA, 15 nt, Homo sapiens
aggaagguggugcuu

SEQ ID NO: 842092 - RNA, 20 nt, Homo sapiens
aggagacugagaccauccug

SEQ ID NO: 842093 - RNA, 18 nt, Homo sapiens
uuggggagagcuggagaa

SEQ ID NO: 842094 - RNA, 23 nt, Homo sapiens
uuguguaugauuuugaugcacaa

SEQ ID NO: 842095 - RNA, 18 nt, Homo sapiens
uuguguguucacuaaacu

SEQ ID NO: 842096 - RNA, 20 nt, Homo sapiens
uuuaaaaaacuuucuacuca

SEQ ID NO: 842097 - RNA, 22 nt, Homo sapiens
uuuaaggagauugggagacaau

SEQ ID NO: 842098 - RNA, 17 nt, Homo sapiens
uuuagaacuguauguca

SEQ ID NO: 842099 - RNA, 15 nt, Homo sapiens
uuucaacucauugca

SEQ ID NO: 842100 - RNA, 18 nt, Homo sapiens
uuugaggcucaccagaau

SEQ ID NO: 842101 - RNA, 23 nt, Homo sapiens
uuugcaacaauaaaguacuuuac

SEQ ID NO: 842102 - RNA, 19 nt, Homo sapiens
uuuuacccuauaucuauaa

SEQ ID NO: 842103 - RNA, 19 nt, Homo sapiens
aaacaaauaaaaugaaaua

SEQ ID NO: 842104 - RNA, 11 nt, Homo sapiens
aaacacuguuu

SEQ ID NO: 842105 - RNA, 17 nt, Homo sapiens
aaacuaaaucucuaaua

SEQ ID NO: 842106 - RNA, 13 nt, Homo sapiens
aaacuucagagaa

SEQ ID NO: 842107 - RNA, 19 nt, Homo sapiens
aaagacugucaaaugaacu

SEQ ID NO: 842108 - RNA, 13 nt, Homo sapiens
aaaggucacuuuu

SEQ ID NO: 842109 - RNA, 23 nt, Homo sapiens
aaagguuucuauuuucucugaua

SEQ ID NO: 842110 - RNA, 13 nt, Homo sapiens
aaagucacauaaa

SEQ ID NO: 842111 - RNA, 17 nt, Homo sapiens
aaagucagauuuguaua

SEQ ID NO: 842112 - RNA, 16 nt, Homo sapiens
aaauaaaacagcagca

SEQ ID NO: 842113 - RNA, 14 nt, Homo sapiens
aaauaaaagaaaca

SEQ ID NO: 842114 - RNA, 17 nt, Homo sapiens
aaauaaucuauauuaaa

SEQ ID NO: 842115 - RNA, 13 nt, Homo sapiens
aaauacacuuuau

SEQ ID NO: 842116 - RNA, 17 nt, Homo sapiens
aaaucaauucauugugu

SEQ ID NO: 842117 - RNA, 15 nt, Homo sapiens
aaaucauacuccuau

SEQ ID NO: 842118 - RNA, 13 nt, Homo sapiens
aaaucuuuaaugg

SEQ ID NO: 842119 - RNA, 15 nt, Homo sapiens
aaaugcagccuuaaa

SEQ ID NO: 842120 - RNA, 22 nt, Homo sapiens
aaaugguauccagaauggaauu

SEQ ID NO: 842121 - RNA, 15 nt, Homo sapiens
aaauuccaugcacuc

SEQ ID NO: 842122 - RNA, 13 nt, Homo sapiens
aacaaaugaaaua

SEQ ID NO: 842123 - RNA, 15 nt, Homo sapiens
aacaacuugcuacuu

SEQ ID NO: 842124 - RNA, 16 nt, Homo sapiens
aacaagaucauuaucu

SEQ ID NO: 842125 - RNA, 20 nt, Homo sapiens
aacacuguuggcacuuauag

SEQ ID NO: 842126 - RNA, 19 nt, Homo sapiens
aaccaaauguaacuauguu

SEQ ID NO: 842127 - RNA, 23 nt, Homo sapiens
aaccauaaaucaauucauugugu

SEQ ID NO: 842128 - RNA, 14 nt, Homo sapiens
aacuacaucugccu

SEQ ID NO: 842129 - RNA, 14 nt, Homo sapiens
aacugagaugcuga

SEQ ID NO: 842130 - RNA, 18 nt, Homo sapiens
aacuugauucuugugauu

SEQ ID NO: 842131 - RNA, 14 nt, Homo sapiens
aacuugcaauacca

SEQ ID NO: 842132 - RNA, 20 nt, Homo sapiens
aacuugcaauaccaauguuc

SEQ ID NO: 842133 - RNA, 16 nt, Homo sapiens
aacuugcuacuuauca

SEQ ID NO: 842134 - RNA, 15 nt, Homo sapiens
aacuuuaaaaggcaa

SEQ ID NO: 842135 - RNA, 19 nt, Homo sapiens
aagaagugacuaggguuca

SEQ ID NO: 842136 - RNA, 16 nt, Homo sapiens
aagaauuuaauggacu

SEQ ID NO: 842137 - RNA, 23 nt, Homo sapiens
aagacugucaaaugaacuuuuac

SEQ ID NO: 842138 - RNA, 21 nt, Homo sapiens
aagagacccagucaauuacau

SEQ ID NO: 842139 - RNA, 16 nt, Homo sapiens
aagagguucugcacuc

SEQ ID NO: 842140 - RNA, 21 nt, Homo sapiens
aagaguagaaaaggauugcuu

SEQ ID NO: 842141 - RNA, 19 nt, Homo sapiens
aagaugauggaaacgcacu

SEQ ID NO: 842142 - RNA, 15 nt, Homo sapiens
aagcaugaaaacuga

SEQ ID NO: 842143 - RNA, 22 nt, Homo sapiens
aagcugguaaacuauuugucuu

SEQ ID NO: 842144 - RNA, 20 nt, Homo sapiens
aaggagugcgugccugcuac

SEQ ID NO: 842145 - RNA, 15 nt, Homo sapiens
aagguaauaaauaca

SEQ ID NO: 842146 - RNA, 19 nt, Homo sapiens
aagguacucuggacuuucu

SEQ ID NO: 842147 - RNA, 22 nt, Homo sapiens
aagguugcugaggcucugaccc

SEQ ID NO: 842148 - RNA, 13 nt, Homo sapiens
aaguaagucuuuu

SEQ ID NO: 842149 - RNA, 18 nt, Homo sapiens
aaguauguaaacaggaga

SEQ ID NO: 842150 - RNA, 20 nt, Homo sapiens
aagucacauaaaaugcggca

SEQ ID NO: 842151 - RNA, 12 nt, Homo sapiens
aagugaacuuuu

SEQ ID NO: 842152 - RNA, 18 nt, Homo sapiens
aaguuauaauaacugaac

SEQ ID NO: 842153 - RNA, 19 nt, Homo sapiens
aauaaaguacuuuaccuaa

SEQ ID NO: 842154 - RNA, 24 nt, Homo sapiens
aauaaauaaaacagcagcagcaaa

SEQ ID NO: 842155 - RNA, 20 nt, Homo sapiens
aauaaaugguuucucauuaa

SEQ ID NO: 842156 - RNA, 16 nt, Homo sapiens
aauacaaaaaccaaaa

SEQ ID NO: 842157 - RNA, 20 nt, Homo sapiens
aauaccauaggaagacauaa

SEQ ID NO: 842158 - RNA, 20 nt, Homo sapiens
aauagaggugaugcugcuaa

SEQ ID NO: 842159 - RNA, 15 nt, Homo sapiens
aauagauugugaaua

SEQ ID NO: 842160 - RNA, 20 nt, Homo sapiens
aauauacuuuuuuuguuaua

SEQ ID NO: 842161 - RNA, 19 nt, Homo sapiens
aauaucuggguggcuuaaa

SEQ ID NO: 842162 - RNA, 14 nt, Homo sapiens
aauaugaaagccac

SEQ ID NO: 842163 - RNA, 15 nt, Homo sapiens
aaucaccuugcauuu

SEQ ID NO: 842164 - RNA, 18 nt, Homo sapiens
aaucaccuugcauuucaa

SEQ ID NO: 842165 - RNA, 18 nt, Homo sapiens
aaucagauuuucuccugu

SEQ ID NO: 842166 - RNA, 11 nt, Homo sapiens
aauccaugcuu

SEQ ID NO: 842167 - RNA, 15 nt, Homo sapiens
aaucccagcacuaug

SEQ ID NO: 842168 - RNA, 14 nt, Homo sapiens
aaucuauaacuaca

SEQ ID NO: 842169 - RNA, 18 nt, Homo sapiens
aaucugguaaaagcacca

SEQ ID NO: 842170 - RNA, 22 nt, Homo sapiens
aaugaucacaucuaaagcuuua

SEQ ID NO: 842171 - RNA, 18 nt, Homo sapiens
aaugcccauuuuugcuaa

SEQ ID NO: 842172 - RNA, 14 nt, Homo sapiens
aaugguaacuuuac

SEQ ID NO: 842173 - RNA, 13 nt, Homo sapiens
aauggugaaggaa

SEQ ID NO: 842174 - RNA, 20 nt, Homo sapiens
aauuaaagccuuaagcacaa

SEQ ID NO: 842175 - RNA, 17 nt, Homo sapiens
aauuaaaugugagcaaa

SEQ ID NO: 842176 - RNA, 20 nt, Homo sapiens
aauuuccaaaauaaucuaua

SEQ ID NO: 842177 - RNA, 22 nt, Homo sapiens
aauuuccccuaaucuuuucuga

SEQ ID NO: 842178 - RNA, 18 nt, Homo sapiens
aauuugugcaucagaaaa

SEQ ID NO: 842179 - RNA, 15 nt, Homo sapiens
acaaaacaaacaaaa

SEQ ID NO: 842180 - RNA, 16 nt, Homo sapiens
acaaagagagcucauc

SEQ ID NO: 842181 - RNA, 19 nt, Homo sapiens
acaaauggcuuacuuacaa

SEQ ID NO: 842182 - RNA, 17 nt, Homo sapiens
acacuacuccugaggau

SEQ ID NO: 842183 - RNA, 10 nt, Homo sapiens
acagugcaag

SEQ ID NO: 842184 - RNA, 20 nt, Homo sapiens
acaucaaguuccacacacgc

SEQ ID NO: 842185 - RNA, 17 nt, Homo sapiens
acauccugagugugaug

SEQ ID NO: 842186 - RNA, 21 nt, Homo sapiens
acaugcugagguuuugaauaa

SEQ ID NO: 842187 - RNA, 17 nt, Homo sapiens
acauucuugguuguuaa

SEQ ID NO: 842188 - RNA, 17 nt, Homo sapiens
acauuuaguacccugca

SEQ ID NO: 842189 - RNA, 14 nt, Homo sapiens
accacugggaacca

SEQ ID NO: 842190 - RNA, 18 nt, Homo sapiens
accagucuuucaacucau

SEQ ID NO: 842191 - RNA, 19 nt, Homo sapiens
accauagggcaugauuaac

SEQ ID NO: 842192 - RNA, 11 nt, Homo sapiens
accaugacaaa

SEQ ID NO: 842193 - RNA, 20 nt, Homo sapiens
acccccaaauuuaauuaaag

SEQ ID NO: 842194 - RNA, 21 nt, Homo sapiens
acccuauaucuauaaacacug

SEQ ID NO: 842195 - RNA, 15 nt, Homo sapiens
accuagaaguaacug

SEQ ID NO: 842196 - RNA, 15 nt, Homo sapiens
accugcgcuguggac

SEQ ID NO: 842197 - RNA, 23 nt, Homo sapiens
accugcgcuguggacacugagaa

SEQ ID NO: 842198 - RNA, 19 nt, Homo sapiens
accuguuuuuaacauguga

SEQ ID NO: 842199 - RNA, 16 nt, Homo sapiens
acgaugugacugccau

SEQ ID NO: 842200 - RNA, 23 nt, Homo sapiens
acgcagucauggaggccaagaac

SEQ ID NO: 842201 - RNA, 20 nt, Homo sapiens
acgccguccagauucuccuu

SEQ ID NO: 842202 - RNA, 17 nt, Homo sapiens
acguaauuguacaagca

SEQ ID NO: 842203 - RNA, 14 nt, Homo sapiens
acuaaacucugaau

SEQ ID NO: 842204 - RNA, 24 nt, Homo sapiens
acuaaaugcucauacacaguuaaa

SEQ ID NO: 842205 - RNA, 20 nt, Homo sapiens
acugaccugcccauguccag

SEQ ID NO: 842206 - RNA, 18 nt, Homo sapiens
acugagaccauccuggcu

SEQ ID NO: 842207 - RNA, 17 nt, Homo sapiens
acugccgugacaucauu

SEQ ID NO: 842208 - RNA, 17 nt, Homo sapiens
acugcuucucuuugugc

SEQ ID NO: 842209 - RNA, 14 nt, Homo sapiens
acuuagaaugccau

SEQ ID NO: 842210 - RNA, 16 nt, Homo sapiens
acuuccuggacaagau

SEQ ID NO: 842211 - RNA, 11 nt, Homo sapiens
acuugcaauac

SEQ ID NO: 842212 - RNA, 17 nt, Homo sapiens
acuugcaauaccaaugu

SEQ ID NO: 842213 - RNA, 19 nt, Homo sapiens
acuuuaaagauaagucuac

SEQ ID NO: 842214 - RNA, 19 nt, Homo sapiens
acuuucucuucauacuuuu

SEQ ID NO: 842215 - RNA, 19 nt, Homo sapiens
acuuugaaaauauauaccg

SEQ ID NO: 842216 - RNA, 21 nt, Homo sapiens
acuuuuacagaaugcauuaaa

SEQ ID NO: 842217 - RNA, 22 nt, Homo sapiens
acuuuucacauccuugacuuuu

SEQ ID NO: 842218 - RNA, 14 nt, Homo sapiens
agaaauacaacaga

SEQ ID NO: 842219 - RNA, 16 nt, Homo sapiens
agaagaccccugccca

SEQ ID NO: 842220 - RNA, 17 nt, Homo sapiens
aaaacaaggaugaauua

SEQ ID NO: 842221 - RNA, 13 nt, Homo sapiens
aaaacugggacag

SEQ ID NO: 842222 - RNA, 21 nt, Homo sapiens
aaacaacuuguguucuauuaa

SEQ ID NO: 842223 - RNA, 22 nt, Homo sapiens
aaaccuauacucacuuucccaa

SEQ ID NO: 842224 - RNA, 17 nt, Homo sapiens
aaacguauucagaguua

SEQ ID NO: 842225 - RNA, 17 nt, Homo sapiens
aaacucccuaguuccuu

SEQ ID NO: 842226 - RNA, 17 nt, Homo sapiens
aaacuccuguuucacuu

SEQ ID NO: 842227 - RNA, 12 nt, Homo sapiens
aaacugugaacc

SEQ ID NO: 842228 - RNA, 21 nt, Homo sapiens
aaagcaccucaagugcaagga

SEQ ID NO: 842229 - RNA, 16 nt, Homo sapiens
aaagucaagauuucca

SEQ ID NO: 842230 - RNA, 16 nt, Homo sapiens
aaauaauuuuucacuu

SEQ ID NO: 842231 - RNA, 22 nt, Homo sapiens
aaaucaggguuaguauugucca

SEQ ID NO: 842232 - RNA, 21 nt, Homo sapiens
aaaucaugaagauauuuuucc

SEQ ID NO: 842233 - RNA, 17 nt, Homo sapiens
aaauuccuuuucccgaa

SEQ ID NO: 842234 - RNA, 13 nt, Homo sapiens
aacaaggaugaau

SEQ ID NO: 842235 - RNA, 16 nt, Homo sapiens
aacacuagacaugcca

SEQ ID NO: 842236 - RNA, 20 nt, Homo sapiens
aacacucucacuaugcugcu

SEQ ID NO: 842237 - RNA, 18 nt, Homo sapiens
aacaguauugacuuguau

SEQ ID NO: 842238 - RNA, 17 nt, Homo sapiens
aacaguugugucauaaa

SEQ ID NO: 842239 - RNA, 21 nt, Homo sapiens
aacuaauucuuggguguuuau

SEQ ID NO: 842240 - RNA, 15 nt, Homo sapiens
aacucaccagccucu

SEQ ID NO: 842241 - RNA, 14 nt, Homo sapiens
aagaaaacauuuaa

SEQ ID NO: 842242 - RNA, 15 nt, Homo sapiens
aagaaaauaucacuu

SEQ ID NO: 842243 - RNA, 14 nt, Homo sapiens
aagaagugccaguu

SEQ ID NO: 842244 - RNA, 21 nt, Homo sapiens
aagacuacauauugucacuga

SEQ ID NO: 842245 - RNA, 13 nt, Homo sapiens
aagagauacccac

SEQ ID NO: 842246 - RNA, 22 nt, Homo sapiens
aagagauuuuucaugauuuuga

SEQ ID NO: 842247 - RNA, 13 nt, Homo sapiens
aagagccacagua

SEQ ID NO: 842248 - RNA, 17 nt, Homo sapiens
aagauaguaucuuuuaa

SEQ ID NO: 842249 - RNA, 15 nt, Homo sapiens
aagaucacauaccag

SEQ ID NO: 842250 - RNA, 22 nt, Homo sapiens
aagcaaauaauuuuucacuuca

SEQ ID NO: 842251 - RNA, 18 nt, Homo sapiens
aagccagauuuuccugaa

SEQ ID NO: 842252 - RNA, 20 nt, Homo sapiens
aagccucugugucacuggcu

SEQ ID NO: 842253 - RNA, 22 nt, Homo sapiens
aagccuuggggcugaugcaguu

SEQ ID NO: 842254 - RNA, 18 nt, Homo sapiens
aaggauggagccagcucu

SEQ ID NO: 842255 - RNA, 17 nt, Homo sapiens
aaggcuuggcacacagc

SEQ ID NO: 842256 - RNA, 16 nt, Homo sapiens
aaggguccuuucucca

SEQ ID NO: 842257 - RNA, 21 nt, Homo sapiens
aagguacuucaaauccuugaa

SEQ ID NO: 842258 - RNA, 20 nt, Homo sapiens
aaguaccccugauaagcaaa

SEQ ID NO: 842259 - RNA, 17 nt, Homo sapiens
aaguagcacccuggauu

SEQ ID NO: 842260 - RNA, 23 nt, Homo sapiens
aaucacugcucacacugcugaug

SEQ ID NO: 842261 - RNA, 14 nt, Homo sapiens
aaucgugucuucaa

SEQ ID NO: 842262 - RNA, 18 nt, Homo sapiens
aaugagagacacacugaa

SEQ ID NO: 842263 - RNA, 21 nt, Homo sapiens
aaugagagacacacugaagaa

SEQ ID NO: 842264 - RNA, 21 nt, Homo sapiens
aaugcagugccuuucuucucu

SEQ ID NO: 842265 - RNA, 22 nt, Homo sapiens
aaugcuguuuuaaaaacaaaga

SEQ ID NO: 842266 - RNA, 18 nt, Homo sapiens
aauuaccacaccaucucc

SEQ ID NO: 842267 - RNA, 23 nt, Homo sapiens
aauucauccucacucaguccagc

SEQ ID NO: 842268 - RNA, 17 nt, Homo sapiens
aauugaggacacugaua

SEQ ID NO: 842269 - RNA, 23 nt, Homo sapiens
aauugucagaucguucauugccu

SEQ ID NO: 842270 - RNA, 15 nt, Homo sapiens
aauuuucccacugca

SEQ ID NO: 842271 - RNA, 15 nt, Homo sapiens
acaaagaggacacca

SEQ ID NO: 842272 - RNA, 20 nt, Homo sapiens
acaagugcaggcgacuggag

SEQ ID NO: 842273 - RNA, 18 nt, Homo sapiens
acaauaaagcaguccugu

SEQ ID NO: 842274 - RNA, 21 nt, Homo sapiens
acaaucuuaagagcuugaucu

SEQ ID NO: 842275 - RNA, 13 nt, Homo sapiens
acaaugcuguauu

SEQ ID NO: 842276 - RNA, 19 nt, Homo sapiens
acacacacguuauaaucau

SEQ ID NO: 842277 - RNA, 22 nt, Homo sapiens
acacagauguucacccaaccac

SEQ ID NO: 842278 - RNA, 19 nt, Homo sapiens
acacaugaaguccaagcau

SEQ ID NO: 842279 - RNA, 17 nt, Homo sapiens
acaccaucucccaugaa

SEQ ID NO: 842280 - RNA, 22 nt, Homo sapiens
acaccccuggccugacucccau

SEQ ID NO: 842281 - RNA, 14 nt, Homo sapiens
acacuagucugugu

SEQ ID NO: 842282 - RNA, 20 nt, Homo sapiens
acagaagugcuuucuucucc

SEQ ID NO: 842283 - RNA, 16 nt, Homo sapiens
acagaccuuugaacua

SEQ ID NO: 842284 - RNA, 22 nt, Homo sapiens
acagaguguggucccuccacua

SEQ ID NO: 842285 - RNA, 19 nt, Homo sapiens
acagcgcuggccgggaccc

SEQ ID NO: 842286 - RNA, 21 nt, Homo sapiens
acagcuucacaaauucucaca

SEQ ID NO: 842287 - RNA, 23 nt, Homo sapiens
acaguaaauaaauuguuugacca

SEQ ID NO: 842288 - RNA, 23 nt, Homo sapiens
acagucaugguggccacggccac

SEQ ID NO: 842289 - RNA, 18 nt, Homo sapiens
acagugcagcuugcaguc

SEQ ID NO: 842290 - RNA, 19 nt, Homo sapiens
acagugcccuuuucaucuc

SEQ ID NO: 842291 - RNA, 15 nt, Homo sapiens
acaugagugucaacu

SEQ ID NO: 842292 - RNA, 15 nt, Homo sapiens
acaugggacauuugc

SEQ ID NO: 842293 - RNA, 20 nt, Homo sapiens
accaaccuuuucccaaccau

SEQ ID NO: 842294 - RNA, 23 nt, Homo sapiens
accaagaucacauaccagagucu

SEQ ID NO: 842295 - RNA, 13 nt, Homo sapiens
accaaucaugaau

SEQ ID NO: 842296 - RNA, 21 nt, Homo sapiens
accacaggaaccacaagacug

SEQ ID NO: 842297 - RNA, 16 nt, Homo sapiens
accacuguguauuuaa

SEQ ID NO: 842298 - RNA, 21 nt, Homo sapiens
accagaaaguguguguguucu

SEQ ID NO: 842299 - RNA, 16 nt, Homo sapiens
accagcuccacuggcc

SEQ ID NO: 842300 - RNA, 17 nt, Homo sapiens
accagcuccacuggccu

SEQ ID NO: 842301 - RNA, 22 nt, Homo sapiens
acccacuuaccuugcaucucac

SEQ ID NO: 842302 - RNA, 19 nt, Homo sapiens
acccagaaaaaaagcccaa

SEQ ID NO: 842303 - RNA, 23 nt, Homo sapiens
ccaccuaguggcuguccagugcc

SEQ ID NO: 842304 - RNA, 20 nt, Homo sapiens
ccacugcacccccuccugcu

SEQ ID NO: 842305 - RNA, 10 nt, Homo sapiens
ccagaggcag

SEQ ID NO: 842306 - RNA, 17 nt, Homo sapiens
ccagcccugaacaaagc

SEQ ID NO: 842307 - RNA, 15 nt, Homo sapiens
ccaggccaucuucca

SEQ ID NO: 842308 - RNA, 18 nt, Homo sapiens
ccagggucaaaguacaga

SEQ ID NO: 842309 - RNA, 22 nt, Homo sapiens
ccaggugggcgggcagcacagc

SEQ ID NO: 842310 - RNA, 17 nt, Homo sapiens
ccaguccucacaugccc

SEQ ID NO: 842311 - RNA, 19 nt, Homo sapiens
ccagugcaccugucauaug

SEQ ID NO: 842312 - RNA, 17 nt, Homo sapiens
ccauguaucuaccucac

SEQ ID NO: 842313 - RNA, 16 nt, Homo sapiens
ccauuuccauggugca

SEQ ID NO: 842314 - RNA, 18 nt, Homo sapiens
cccacuuaccuugcaucu

SEQ ID NO: 842315 - RNA, 10 nt, Homo sapiens
cccacuuccc

SEQ ID NO: 842316 - RNA, 18 nt, Homo sapiens
cccagcccugaacaaagc

SEQ ID NO: 842317 - RNA, 22 nt, Homo sapiens
cccagcccugaacaaagcaccu

SEQ ID NO: 842318 - RNA, 23 nt, Homo sapiens
cccaugucuacacagauguucac

SEQ ID NO: 842319 - RNA, 15 nt, Homo sapiens
ccccagcugggcugu

SEQ ID NO: 842320 - RNA, 20 nt, Homo sapiens
ccccuggugggacaacaaag

SEQ ID NO: 842321 - RNA, 15 nt, Homo sapiens
cccuccccuccaucc

SEQ ID NO: 842322 - RNA, 14 nt, Homo sapiens
cccugauaagcaaa

SEQ ID NO: 842323 - RNA, 15 nt, Homo sapiens
cccuggaugacauua

SEQ ID NO: 842324 - RNA, 15 nt, Homo sapiens
cccugucucuacuaa

SEQ ID NO: 842325 - RNA, 14 nt, Homo sapiens
cccuguuaagcaau

SEQ ID NO: 842326 - RNA, 14 nt, Homo sapiens
cccuugaugaagaa

SEQ ID NO: 842327 - RNA, 20 nt, Homo sapiens
cccuuugcuucauucaaguc

SEQ ID NO: 842328 - RNA, 18 nt, Homo sapiens
ccggccaggugggcgggc

SEQ ID NO: 842329 - RNA, 21 nt, Homo sapiens
ccuaaucaagucaaauggaga

SEQ ID NO: 842330 - RNA, 17 nt, Homo sapiens
ccuaucucuccaaccag

SEQ ID NO: 842331 - RNA, 16 nt, Homo sapiens
ccucaaagaggccuua

SEQ ID NO: 842332 - RNA, 20 nt, Homo sapiens
ccucaaccccuccccuccau

SEQ ID NO: 842333 - RNA, 23 nt, Homo sapiens
ccucagaaaacaaggaugaauua

SEQ ID NO: 842334 - RNA, 14 nt, Homo sapiens
ccucccacagugac

SEQ ID NO: 842335 - RNA, 14 nt, Homo sapiens
ccucuuauuugcuc

SEQ ID NO: 842336 - RNA, 13 nt, Homo sapiens
ccugaaaaaucua

SEQ ID NO: 842337 - RNA, 12 nt, Homo sapiens
ccugaacaaagc

SEQ ID NO: 842338 - RNA, 19 nt, Homo sapiens
ccugaacaaagcaccucaa

SEQ ID NO: 842339 - RNA, 22 nt, Homo sapiens
ccugacccagcccugaacaaag

SEQ ID NO: 842340 - RNA, 15 nt, Homo sapiens
ccugacucugugcug

SEQ ID NO: 842341 - RNA, 22 nt, Homo sapiens
ccugacucugugcugagcacag

SEQ ID NO: 842342 - RNA, 16 nt, Homo sapiens
ccuggaugacauuaaa

SEQ ID NO: 842343 - RNA, 13 nt, Homo sapiens
ccuggcacagugu

SEQ ID NO: 842344 - RNA, 11 nt, Homo sapiens
ccuggugggac

SEQ ID NO: 842345 - RNA, 18 nt, Homo sapiens
ccuggugggacaacaaag

SEQ ID NO: 842346 - RNA, 18 nt, Homo sapiens
ccugucauaugcucugau

SEQ ID NO: 842347 - RNA, 14 nt, Homo sapiens
ccuguuaagcaauu

SEQ ID NO: 842348 - RNA, 12 nt, Homo sapiens
ccuucucaaaag

SEQ ID NO: 842349 - RNA, 22 nt, Homo sapiens
ccuugauggagauauuuacaug

SEQ ID NO: 842350 - RNA, 14 nt, Homo sapiens
ccuuguaauuugaa

SEQ ID NO: 842351 - RNA, 12 nt, Homo sapiens
ccuuuccagggu

SEQ ID NO: 842352 - RNA, 15 nt, Homo sapiens
ccuuuucaucuccag

SEQ ID NO: 842353 - RNA, 21 nt, Homo sapiens
cgaaggaaaagggcuuucuca

SEQ ID NO: 842354 - RNA, 20 nt, Homo sapiens
cgccuucucccccccggggc

SEQ ID NO: 842355 - RNA, 19 nt, Homo sapiens
cggaucuuuggacagaagc

SEQ ID NO: 842356 - RNA, 12 nt, Homo sapiens
cggccacggcca

SEQ ID NO: 842357 - RNA, 14 nt, Homo sapiens
cgggaccccgagcc

SEQ ID NO: 842358 - RNA, 14 nt, Homo sapiens
cggucagugccuuu

SEQ ID NO: 842359 - RNA, 21 nt, Homo sapiens
cgucuacucauuccccggggc

SEQ ID NO: 842360 - RNA, 18 nt, Homo sapiens
cguuaagaauuguuaaag

SEQ ID NO: 842361 - RNA, 15 nt, Homo sapiens
cuaaagagcuuuagu

SEQ ID NO: 842362 - RNA, 19 nt, Homo sapiens
cuaaaguuagaaaguugau

SEQ ID NO: 842363 - RNA, 14 nt, Homo sapiens
cuaaaugucaauca

SEQ ID NO: 842364 - RNA, 23 nt, Homo sapiens
cuaacacccagucuguuccccau

SEQ ID NO: 842365 - RNA, 20 nt, Homo sapiens
cuacacccuuggacuugagg

SEQ ID NO: 842366 - RNA, 13 nt, Homo sapiens
cuacucauucccc

SEQ ID NO: 842367 - RNA, 18 nt, Homo sapiens
cuagaguuuagcuggaaa

SEQ ID NO: 842368 - RNA, 17 nt, Homo sapiens
cuagauacaugcuuuuu

SEQ ID NO: 842369 - RNA, 14 nt, Homo sapiens
cuagcaguaaauac

SEQ ID NO: 842370 - RNA, 20 nt, Homo sapiens
cuagcugagcuuuaaaucau

SEQ ID NO: 842371 - RNA, 18 nt, Homo sapiens
cuagugagcagucaggaa

SEQ ID NO: 842372 - RNA, 18 nt, Homo sapiens
cuauaguccagcuuuguu

SEQ ID NO: 842373 - RNA, 17 nt, Homo sapiens
cuaucuuuugcauccua

SEQ ID NO: 842374 - RNA, 19 nt, Homo sapiens
cucaaaagauuguuuuaua

SEQ ID NO: 842375 - RNA, 20 nt, Homo sapiens
cucaaccccuccccuccauc

SEQ ID NO: 842376 - RNA, 23 nt, Homo sapiens
cucaaccccuccccuccaucccu

SEQ ID NO: 842377 - RNA, 20 nt, Homo sapiens
cucaauaccccuaguaucug

SEQ ID NO: 842378 - RNA, 15 nt, Homo sapiens
cucacuuuucaauuu

SEQ ID NO: 842379 - RNA, 19 nt, Homo sapiens
cucauggaauuggagcucg

SEQ ID NO: 842380 - RNA, 13 nt, Homo sapiens
cucccacagugac

SEQ ID NO: 842381 - RNA, 15 nt, Homo sapiens
cucccacagugacuc

SEQ ID NO: 842382 - RNA, 14 nt, Homo sapiens
cucccuggaugaca

SEQ ID NO: 842383 - RNA, 15 nt, Homo sapiens
cuccuucuugcccug

SEQ ID NO: 842384 - RNA, 13 nt, Homo sapiens
cuccuugaagcaa

SEQ ID NO: 842385 - RNA, 14 nt, Homo sapiens
cuccuugcccuggg

SEQ ID NO: 842386 - RNA, 21 nt, Homo sapiens
cucuccaggccccaggucauc

SEQ ID NO: 842387 - RNA, 14 nt, Homo sapiens
cucucccacaccac

SEQ ID NO: 842388 - RNA, 19 nt, Homo sapiens
cucugugguccagagucaa

SEQ ID NO: 842389 - RNA, 21 nt, Homo sapiens
cugaaaucauacuucuuaggg

SEQ ID NO: 842390 - RNA, 17 nt, Homo sapiens
cugaaggagauuuuccu

SEQ ID NO: 842391 - RNA, 16 nt, Homo sapiens
cugacucugugcugag

SEQ ID NO: 842392 - RNA, 23 nt, Homo sapiens
cugagcccuccuucuugcccuga

SEQ ID NO: 842393 - RNA, 15 nt, Homo sapiens
cugagugcaccacuu

SEQ ID NO: 842394 - RNA, 13 nt, Homo sapiens
cugauaagcaaau

SEQ ID NO: 842395 - RNA, 16 nt, Homo sapiens
cugcagagagcaccug

SEQ ID NO: 842396 - RNA, 22 nt, Homo sapiens
cugcauuauauuuauuacugua

SEQ ID NO: 842397 - RNA, 13 nt, Homo sapiens
cugccuucucacu

SEQ ID NO: 842398 - RNA, 24 nt, Homo sapiens
cugcuauauauuuuaagccuucau

SEQ ID NO: 842399 - RNA, 20 nt, Homo sapiens
cugcugguaauuuguaucug

SEQ ID NO: 842400 - RNA, 21 nt, Homo sapiens
acugcaggaagagaggaccca

SEQ ID NO: 842401 - RNA, 14 nt, Homo sapiens
acuggagcuccgau

SEQ ID NO: 842402 - RNA, 16 nt, Homo sapiens
acuguaaagccaguug

SEQ ID NO: 842403 - RNA, 13 nt, Homo sapiens
acuguuuuccuua

SEQ ID NO: 842404 - RNA, 17 nt, Homo sapiens
acuuaccuugcaucuca

SEQ ID NO: 842405 - RNA, 20 nt, Homo sapiens
acuugagacagcacuaugua

SEQ ID NO: 842406 - RNA, 21 nt, Homo sapiens
acuugugcagacgccacaguc

SEQ ID NO: 842407 - RNA, 17 nt, Homo sapiens
agaaaagucaggugcag

SEQ ID NO: 842408 - RNA, 16 nt, Homo sapiens
agaaaaucaguaauug

SEQ ID NO: 842409 - RNA, 15 nt, Homo sapiens
agaaaauuaguaauu

SEQ ID NO: 842410 - RNA, 23 nt, Homo sapiens
agaacugcccauuuccauggugc

SEQ ID NO: 842411 - RNA, 13 nt, Homo sapiens
agaagugcuuucu

SEQ ID NO: 842412 - RNA, 18 nt, Homo sapiens
agaauagaauacauugau

SEQ ID NO: 842413 - RNA, 19 nt, Homo sapiens
agaaucgcuuaaacccagg

SEQ ID NO: 842414 - RNA, 17 nt, Homo sapiens
agaaugauuaugaauua

SEQ ID NO: 842415 - RNA, 20 nt, Homo sapiens
agaauuuaaaccuauacuca

SEQ ID NO: 842416 - RNA, 22 nt, Homo sapiens
agacacacaugaaguccaagca

SEQ ID NO: 842417 - RNA, 14 nt, Homo sapiens
agacaucaccauca

SEQ ID NO: 842418 - RNA, 16 nt, Homo sapiens
agacgccacagucucc

SEQ ID NO: 842419 - RNA, 22 nt, Homo sapiens
agacuacauauugucacugaca

SEQ ID NO: 842420 - RNA, 19 nt, Homo sapiens
agacuuggcuccaccacug

SEQ ID NO: 842421 - RNA, 23 nt, Homo sapiens
agaggacaccauuuuuccagagc

SEQ ID NO: 842422 - RNA, 16 nt, Homo sapiens
agaggagaguaccccc

SEQ ID NO: 842423 - RNA, 15 nt, Homo sapiens
agagggacugaauag

SEQ ID NO: 842424 - RNA, 22 nt, Homo sapiens
agagguugaggaugcacuggcc

SEQ ID NO: 842425 - RNA, 18 nt, Homo sapiens
agagugagacucgucuca

SEQ ID NO: 842426 - RNA, 13 nt, Homo sapiens
agauaaucacaau

SEQ ID NO: 842427 - RNA, 12 nt, Homo sapiens
agauaguaucuu

SEQ ID NO: 842428 - RNA, 21 nt, Homo sapiens
agauauuuuucaugauuuuga

SEQ ID NO: 842429 - RNA, 18 nt, Homo sapiens
agaucagccagugaccaa

SEQ ID NO: 842430 - RNA, 15 nt, Homo sapiens
agcaaauuaguaauu

SEQ ID NO: 842431 - RNA, 20 nt, Homo sapiens
agcaauacccaugucuacac

SEQ ID NO: 842432 - RNA, 14 nt, Homo sapiens
agcaccuggugggg

SEQ ID NO: 842433 - RNA, 20 nt, Homo sapiens
agcagacccauaccuuucca

SEQ ID NO: 842434 - RNA, 22 nt, Homo sapiens
agcagcagugagcuucuauuaa

SEQ ID NO: 842435 - RNA, 21 nt, Homo sapiens
agcagcuucaguuguuuuccc

SEQ ID NO: 842436 - RNA, 12 nt, Homo sapiens
agccacaguaua

SEQ ID NO: 842437 - RNA, 14 nt, Homo sapiens
agcccuuuacuuga

SEQ ID NO: 842438 - RNA, 15 nt, Homo sapiens
agccuccucucucaa

SEQ ID NO: 842439 - RNA, 18 nt, Homo sapiens
agccuggcuccaaacccu

SEQ ID NO: 842440 - RNA, 17 nt, Homo sapiens
agccuucauuugcaauu

SEQ ID NO: 842441 - RNA, 20 nt, Homo sapiens
agcuacauagcagacuuucc

SEQ ID NO: 842442 - RNA, 22 nt, Homo sapiens
agcucuucuccauccuaccaca

SEQ ID NO: 842443 - RNA, 12 nt, Homo sapiens
agcuucagggcu

SEQ ID NO: 842444 - RNA, 17 nt, Homo sapiens
agcuugaucugugauuu

SEQ ID NO: 842445 - RNA, 19 nt, Homo sapiens
agcuuucuccucugcuaug

SEQ ID NO: 842446 - RNA, 15 nt, Homo sapiens
aggaaagcauguauu

SEQ ID NO: 842447 - RNA, 16 nt, Homo sapiens
aggacagcccuucuuu

SEQ ID NO: 842448 - RNA, 19 nt, Homo sapiens
aggaccaacccaugcccug

SEQ ID NO: 842449 - RNA, 22 nt, Homo sapiens
aggacccagaaaaaaagcccaa

SEQ ID NO: 842450 - RNA, 16 nt, Homo sapiens
aggacuuuauagauca

SEQ ID NO: 842451 - RNA, 20 nt, Homo sapiens
aggagaguaccccccugaga

SEQ ID NO: 842452 - RNA, 19 nt, Homo sapiens
aggagauuuuccuuccuac

SEQ ID NO: 842453 - RNA, 13 nt, Homo sapiens
aggagcagcuuca

SEQ ID NO: 842454 - RNA, 19 nt, Homo sapiens
aggagggguuaaagcugcc

SEQ ID NO: 842455 - RNA, 13 nt, Homo sapiens
aggaguagucuca

SEQ ID NO: 842456 - RNA, 20 nt, Homo sapiens
aggccacccugccucuaccc

SEQ ID NO: 842457 - RNA, 16 nt, Homo sapiens
aggccuggcacagugu

SEQ ID NO: 842458 - RNA, 22 nt, Homo sapiens
aggcggaucuuuggacagaagc

SEQ ID NO: 842459 - RNA, 16 nt, Homo sapiens
aggcgggggagccugg

SEQ ID NO: 842460 - RNA, 14 nt, Homo sapiens
aggcuccaguugaa

SEQ ID NO: 842461 - RNA, 11 nt, Homo sapiens
aggcuuggcac

SEQ ID NO: 842462 - RNA, 14 nt, Homo sapiens
agggaccagguguc

SEQ ID NO: 842463 - RNA, 18 nt, Homo sapiens
agggcaagagccacagua

SEQ ID NO: 842464 - RNA, 19 nt, Homo sapiens
agggcccacccaugucacc

SEQ ID NO: 842465 - RNA, 21 nt, Homo sapiens
aggggacaccuuggcuccuca

SEQ ID NO: 842466 - RNA, 15 nt, Homo sapiens
aggggcuggggccaa

SEQ ID NO: 842467 - RNA, 14 nt, Homo sapiens
agguagacaguaua

SEQ ID NO: 842468 - RNA, 21 nt, Homo sapiens
aggucucgcugaugcugggcu

SEQ ID NO: 842469 - RNA, 22 nt, Homo sapiens
aggucucgcugaugcugggcug

SEQ ID NO: 842470 - RNA, 13 nt, Homo sapiens
aggugauggccag

SEQ ID NO: 842471 - RNA, 16 nt, Homo sapiens
aggugccaacaguguu

SEQ ID NO: 842472 - RNA, 19 nt, Homo sapiens
aggugcuaucgcaccacug

SEQ ID NO: 842473 - RNA, 13 nt, Homo sapiens
aggugggggagcc

SEQ ID NO: 842474 - RNA, 14 nt, Homo sapiens
aguauaugucaugc

SEQ ID NO: 842475 - RNA, 14 nt, Homo sapiens
agucaccucaugga

SEQ ID NO: 842476 - RNA, 22 nt, Homo sapiens
agucaggaaagagaacuuccag

SEQ ID NO: 842477 - RNA, 20 nt, Homo sapiens
aguccaguccucacaugccc

SEQ ID NO: 842478 - RNA, 13 nt, Homo sapiens
agucuaaaguuua

SEQ ID NO: 842479 - RNA, 14 nt, Homo sapiens
agucucauaucagg

SEQ ID NO: 842480 - RNA, 15 nt, Homo sapiens
agucuuauuuauuca

SEQ ID NO: 842481 - RNA, 21 nt, Homo sapiens
agugauaucccccagccucaa

SEQ ID NO: 842482 - RNA, 16 nt, Homo sapiens
agugcaaggaccaaag

SEQ ID NO: 842483 - RNA, 20 nt, Homo sapiens
aguguaacucaccagccucu

SEQ ID NO: 842484 - RNA, 15 nt, Homo sapiens
aguguggucccucca

SEQ ID NO: 842485 - RNA, 14 nt, Homo sapiens
aguuauucuugaca

SEQ ID NO: 842486 - RNA, 13 nt, Homo sapiens
aguuauuuuuaca

SEQ ID NO: 842487 - RNA, 15 nt, Homo sapiens
aguuuaauaccacag

SEQ ID NO: 842488 - RNA, 21 nt, Homo sapiens
aguuuaggugauggccaguca

SEQ ID NO: 842489 - RNA, 20 nt, Homo sapiens
auaaaauuguaaaauuguau

SEQ ID NO: 842490 - RNA, 23 nt, Homo sapiens
auaaacaugaugucaacuuccuu

SEQ ID NO: 842491 - RNA, 16 nt, Homo sapiens
auaaauuacacaauaa

SEQ ID NO: 842492 - RNA, 21 nt, Homo sapiens
auaaauuauaucaauuuccuc

SEQ ID NO: 842493 - RNA, 14 nt, Homo sapiens
auaaccccuaguca

SEQ ID NO: 842494 - RNA, 16 nt, Homo sapiens
gcugagugcaccacuu

SEQ ID NO: 842495 - RNA, 14 nt, Homo sapiens
gcugauggcugcug

SEQ ID NO: 842496 - RNA, 17 nt, Homo sapiens
gcugcagagagcaccug

SEQ ID NO: 842497 - RNA, 17 nt, Homo sapiens
gcugccuccacucccac

SEQ ID NO: 842498 - RNA, 23 nt, Homo sapiens
gcuggaaaaguauguuagugcaa

SEQ ID NO: 842499 - RNA, 12 nt, Homo sapiens
gcuggggccaaa

SEQ ID NO: 842500 - RNA, 17 nt, Homo sapiens
gcuggguuuucaggggc

SEQ ID NO: 842501 - RNA, 22 nt, Homo sapiens
gcuguccagugcccauuccuca

SEQ ID NO: 842502 - RNA, 16 nt, Homo sapiens
gcugugaacauggacu

SEQ ID NO: 842503 - RNA, 17 nt, Homo sapiens
gcuguggccaucaaccu

SEQ ID NO: 842504 - RNA, 20 nt, Homo sapiens
gcuguuuuaaaaacaaagaa

SEQ ID NO: 842505 - RNA, 16 nt, Homo sapiens
gcuuaaauugucagau

SEQ ID NO: 842506 - RNA, 17 nt, Homo sapiens
gcuucugccacuuccca

SEQ ID NO: 842507 - RNA, 23 nt, Homo sapiens
ggaaccacaagacugcacaucaa

SEQ ID NO: 842508 - RNA, 19 nt, Homo sapiens
ggagaaacaggcccagaga

SEQ ID NO: 842509 - RNA, 21 nt, Homo sapiens
ggagagagcagcuucugccac

SEQ ID NO: 842510 - RNA, 17 nt, Homo sapiens
ggagaugaguugcaguu

SEQ ID NO: 842511 - RNA, 18 nt, Homo sapiens
ggagaugaguugcaguuu

SEQ ID NO: 842512 - RNA, 16 nt, Homo sapiens
ggagcucgugggacag

SEQ ID NO: 842513 - RNA, 15 nt, Homo sapiens
ucaacaucuagugag

SEQ ID NO: 842514 - RNA, 20 nt, Homo sapiens
ucaaguauuagggguaauau

SEQ ID NO: 842515 - RNA, 21 nt, Homo sapiens
ucaauaccccuguuaagcaau

SEQ ID NO: 842516 - RNA, 13 nt, Homo sapiens
ucaauuucuacaa

SEQ ID NO: 842517 - RNA, 12 nt, Homo sapiens
ucacacugcuga

SEQ ID NO: 842518 - RNA, 18 nt, Homo sapiens
ucacagguagacaguaua

SEQ ID NO: 842519 - RNA, 15 nt, Homo sapiens
ucacuaugcugcuau

SEQ ID NO: 842520 - RNA, 13 nt, Homo sapiens
ucacugacacaca

SEQ ID NO: 842521 - RNA, 14 nt, Homo sapiens
ucagaguccuugca

SEQ ID NO: 842522 - RNA, 14 nt, Homo sapiens
ucagccugugcagg

SEQ ID NO: 842523 - RNA, 18 nt, Homo sapiens
ucagcuucugcugggcug

SEQ ID NO: 842524 - RNA, 16 nt, Homo sapiens
ucagggaccacagcaa

SEQ ID NO: 842525 - RNA, 23 nt, Homo sapiens
ucaggugcagucccaguccuuga

SEQ ID NO: 842526 - RNA, 12 nt, Homo sapiens
ucaucauguauc

SEQ ID NO: 842527 - RNA, 13 nt, Homo sapiens
ucauggaauugga

SEQ ID NO: 842528 - RNA, 14 nt, Homo sapiens
ucauguaacuagaa

SEQ ID NO: 842529 - RNA, 14 nt, Homo sapiens
ucaugucaugugua

SEQ ID NO: 842530 - RNA, 11 nt, Homo sapiens
ucaugugcugg

SEQ ID NO: 842531 - RNA, 21 nt, Homo sapiens
ucauucacagggacauggaaa

SEQ ID NO: 842532 - RNA, 14 nt, Homo sapiens
ucauuccccggggc

SEQ ID NO: 842533 - RNA, 18 nt, Homo sapiens
uccaacuaucucauuucc

SEQ ID NO: 842534 - RNA, 15 nt, Homo sapiens
uccacguacugcagc

SEQ ID NO: 842535 - RNA, 12 nt, Homo sapiens
uccagcucucag

SEQ ID NO: 842536 - RNA, 14 nt, Homo sapiens
uccagcucucaguu

SEQ ID NO: 842537 - RNA, 14 nt, Homo sapiens
uccaucagaugugu

SEQ ID NO: 842538 - RNA, 12 nt, Homo sapiens
ucccaauucauc

SEQ ID NO: 842539 - RNA, 21 nt, Homo sapiens
ucccacagcgcuggccgggac

SEQ ID NO: 842540 - RNA, 23 nt, Homo sapiens
ucccacugcacccccuccugcug

SEQ ID NO: 842541 - RNA, 16 nt, Homo sapiens
uccccaguacugaggu

SEQ ID NO: 842542 - RNA, 17 nt, Homo sapiens
ucccuggaugacauuaa

SEQ ID NO: 842543 - RNA, 18 nt, Homo sapiens
ucccuggaugacauuaaa

SEQ ID NO: 842544 - RNA, 23 nt, Homo sapiens
ucccuggaugacauuaaagaagg

SEQ ID NO: 842545 - RNA, 22 nt, Homo sapiens
ucccugggaaagaggguacuag

SEQ ID NO: 842546 - RNA, 21 nt, Homo sapiens
uccuacacccuuggacuugag

SEQ ID NO: 842547 - RNA, 20 nt, Homo sapiens
uccucagauccccagcuuuc

SEQ ID NO: 842548 - RNA, 21 nt, Homo sapiens
uccucuccccaugauguuuag

SEQ ID NO: 842549 - RNA, 16 nt, Homo sapiens
uccuggcaauagucaa

SEQ ID NO: 842550 - RNA, 15 nt, Homo sapiens
uccuggcuacuccau

SEQ ID NO: 842551 - RNA, 22 nt, Homo sapiens
uccuucccucaaagaggccuua

SEQ ID NO: 842552 - RNA, 16 nt, Homo sapiens
ucuagauuaagauaug

SEQ ID NO: 842553 - RNA, 23 nt, Homo sapiens
ucucaacuccaaacugacucuua

SEQ ID NO: 842554 - RNA, 19 nt, Homo sapiens
ucucacuagcugucucagg

SEQ ID NO: 842555 - RNA, 19 nt, Homo sapiens
ucuccaggccccaggucau

SEQ ID NO: 842556 - RNA, 18 nt, Homo sapiens
ucuccagugugaauauau

SEQ ID NO: 842557 - RNA, 12 nt, Homo sapiens
ucuccuugcccu

SEQ ID NO: 842558 - RNA, 17 nt, Homo sapiens
ucucugccacuccugac

SEQ ID NO: 842559 - RNA, 14 nt, Homo sapiens
ucugaaggagauuu

SEQ ID NO: 842560 - RNA, 14 nt, Homo sapiens
ucugcauacccuca

SEQ ID NO: 842561 - RNA, 12 nt, Homo sapiens
ucugccacuucc

SEQ ID NO: 842562 - RNA, 16 nt, Homo sapiens
ucuggaccccaggcca

SEQ ID NO: 842563 - RNA, 22 nt, Homo sapiens
ucuuagaugcaguucugaagaa

SEQ ID NO: 842564 - RNA, 23 nt, Homo sapiens
ucuucccuguaugauuccuugau

SEQ ID NO: 842565 - RNA, 20 nt, Homo sapiens
ucuucuagcugagcuuuaaa

SEQ ID NO: 842566 - RNA, 16 nt, Homo sapiens
ucuucucccaauucau

SEQ ID NO: 842567 - RNA, 13 nt, Homo sapiens
ucuuuggacagaa

SEQ ID NO: 842568 - RNA, 18 nt, Homo sapiens
ucuuuggacagaagcagc

SEQ ID NO: 842569 - RNA, 17 nt, Homo sapiens
ugaaauguaacaugaag

SEQ ID NO: 842570 - RNA, 15 nt, Homo sapiens
ugaacaaagcaccuc

SEQ ID NO: 842571 - RNA, 15 nt, Homo sapiens
ugaacacuagucugu

SEQ ID NO: 842572 - RNA, 19 nt, Homo sapiens
ugaacacuagucuguguaa

SEQ ID NO: 842573 - RNA, 22 nt, Homo sapiens
ugaaugaccagcagcagcuuuc

SEQ ID NO: 842574 - RNA, 10 nt, Homo sapiens
ugacaugaag

SEQ ID NO: 842575 - RNA, 21 nt, Homo sapiens
ugacccagcccugaacaaagc

SEQ ID NO: 842576 - RNA, 18 nt, Homo sapiens
ugagauuucccaguuuag

SEQ ID NO: 842577 - RNA, 13 nt, Homo sapiens
ugaggacacugau

SEQ ID NO: 842578 - RNA, 10 nt, Homo sapiens
ugagugucaa

SEQ ID NO: 842579 - RNA, 23 nt, Homo sapiens
ugaucggagccuccucucucaaa

SEQ ID NO: 842580 - RNA, 17 nt, Homo sapiens
ugauuuugaaaccauga

SEQ ID NO: 842581 - RNA, 17 nt, Homo sapiens
ugcaccacuucaaguga

SEQ ID NO: 842582 - RNA, 23 nt, Homo sapiens
ugcacucugugcccaugggcacu

SEQ ID NO: 842583 - RNA, 23 nt, Homo sapiens
ugcagguuucuccuugaagcaaa

SEQ ID NO: 842584 - RNA, 15 nt, Homo sapiens
ugccaggccuggcaa

SEQ ID NO: 842585 - RNA, 22 nt, Homo sapiens
ugccaugugcuaguaauuggaa

SEQ ID NO: 842586 - RNA, 17 nt, Homo sapiens
ugcccaugggcacugcu

SEQ ID NO: 842587 - RNA, 20 nt, Homo sapiens
ugccuggaagagcagcccua

SEQ ID NO: 842588 - RNA, 15 nt, Homo sapiens
ugcuaucgcaccacu

SEQ ID NO: 842589 - RNA, 23 nt, Homo sapiens
ugcugcugagugcaccacuucaa

SEQ ID NO: 842590 - RNA, 16 nt, Homo sapiens
ugcuguucagugcuuu

SEQ ID NO: 842591 - RNA, 22 nt, Homo sapiens
uggaaaaguauguuagugcaaa

SEQ ID NO: 842592 - RNA, 17 nt, Homo sapiens
uggaauuuguaaguuua

SEQ ID NO: 842593 - RNA, 12 nt, Homo sapiens
uggacagaagca

SEQ ID NO: 842594 - RNA, 15 nt, Homo sapiens
uggacagaagcagcu

SEQ ID NO: 842595 - RNA, 18 nt, Homo sapiens
uggagaaacaggcccaga

SEQ ID NO: 842596 - RNA, 19 nt, Homo sapiens
uggagcuccgauuuaacug

SEQ ID NO: 842597 - RNA, 17 nt, Homo sapiens
uggagcucgugggacag

SEQ ID NO: 842598 - RNA, 16 nt, Homo sapiens
uggaggagguggcuuc

SEQ ID NO: 842599 - RNA, 22 nt, Homo sapiens
uggaguguaauuaccugucauc

SEQ ID NO: 842600 - RNA, 17 nt, Homo sapiens
uggccacggccacggcc

SEQ ID NO: 842601 - RNA, 21 nt, Homo sapiens
uggccacggccacggccacag

SEQ ID NO: 842602 - RNA, 16 nt, Homo sapiens
uggccucaaacagcca

SEQ ID NO: 842603 - RNA, 12 nt, Homo sapiens
uggcuccaaacc

SEQ ID NO: 842604 - RNA, 15 nt, Homo sapiens
uggcuccaccacuga

SEQ ID NO: 842605 - RNA, 21 nt, Homo sapiens
ugggacagucaccucauggaa

SEQ ID NO: 842606 - RNA, 22 nt, Homo sapiens
ugggacagucaccucauggaau

SEQ ID NO: 842607 - RNA, 20 nt, Homo sapiens
ugggacauuugcucauggaa

SEQ ID NO: 842608 - RNA, 21 nt, Homo sapiens
ugggcauuuauauuccacuug

SEQ ID NO: 842609 - RNA, 23 nt, Homo sapiens
ugggggaaggccuugcugucaug

SEQ ID NO: 842610 - RNA, 14 nt, Homo sapiens
ugguagcucugagc

SEQ ID NO: 842611 - RNA, 17 nt, Homo sapiens
uggugggacaacaaaga

SEQ ID NO: 842612 - RNA, 21 nt, Homo sapiens
ugguguuacauuaaagcccug

SEQ ID NO: 842613 - RNA, 23 nt, Homo sapiens
uguaaguaccccugauaagcaaa

SEQ ID NO: 842614 - RNA, 22 nt, Homo sapiens
uuaccugggaaagggcuguuau

SEQ ID NO: 842615 - RNA, 18 nt, Homo sapiens
uuagaaacagcuucucaa

SEQ ID NO: 842616 - RNA, 12 nt, Homo sapiens
uuagaugcaguu

SEQ ID NO: 842617 - RNA, 14 nt, Homo sapiens
uuaggcagggauuu

SEQ ID NO: 842618 - RNA, 13 nt, Homo sapiens
uuaguaauuguaa

SEQ ID NO: 842619 - RNA, 14 nt, Homo sapiens
uuauccacaaagua

SEQ ID NO: 842620 - RNA, 16 nt, Homo sapiens
uuaucuuaaaacuccu

SEQ ID NO: 842621 - RNA, 22 nt, Homo sapiens
uucaacaucuagugagcaguca

SEQ ID NO: 842622 - RNA, 18 nt, Homo sapiens
uucagcugugaacaugga

SEQ ID NO: 842623 - RNA, 20 nt, Homo sapiens
uucaugacuuuuccauguau

SEQ ID NO: 842624 - RNA, 14 nt, Homo sapiens
uuccaagcaaguau

SEQ ID NO: 842625 - RNA, 14 nt, Homo sapiens
uucccaaauguauu

SEQ ID NO: 842626 - RNA, 20 nt, Homo sapiens
uucccuguaugauuccuuga

SEQ ID NO: 842627 - RNA, 14 nt, Homo sapiens
uucccuucugccac

SEQ ID NO: 842628 - RNA, 15 nt, Homo sapiens
uucccuucugccacc

SEQ ID NO: 842629 - RNA, 16 nt, Homo sapiens
uuccuggcuacuccau

SEQ ID NO: 842630 - RNA, 19 nt, Homo sapiens
uucgagaccagccugacca

SEQ ID NO: 842631 - RNA, 14 nt, Homo sapiens
uucuacaaaauccu

SEQ ID NO: 842632 - RNA, 22 nt, Homo sapiens
uucucacuagcugucucaggag

SEQ ID NO: 842633 - RNA, 21 nt, Homo sapiens
uucuguagcucaguucccaga

SEQ ID NO: 842634 - RNA, 17 nt, Homo sapiens
uugacaggggcucagga

SEQ ID NO: 842635 - RNA, 20 nt, Homo sapiens
uugagaagucuaauucacag

SEQ ID NO: 842636 - RNA, 14 nt, Homo sapiens
uugaggacacugau

SEQ ID NO: 842637 - RNA, 13 nt, Homo sapiens
uugauacaaagua

SEQ ID NO: 842638 - RNA, 17 nt, Homo sapiens
uugauacaaaguacaga

SEQ ID NO: 842639 - RNA, 12 nt, Homo sapiens
uugaucaaugaa

SEQ ID NO: 842640 - RNA, 13 nt, Homo sapiens
uugcaagccagau

SEQ ID NO: 842641 - RNA, 11 nt, Homo sapiens
uugcaucucac

SEQ ID NO: 842642 - RNA, 12 nt, Homo sapiens
uugccuuuccag

SEQ ID NO: 842643 - RNA, 13 nt, Homo sapiens
uugcuaagcauuc

SEQ ID NO: 842644 - RNA, 17 nt, Homo sapiens
uugcucagcuucuccaa

SEQ ID NO: 842645 - RNA, 15 nt, Homo sapiens
uugcugguacuaaga

SEQ ID NO: 842646 - RNA, 14 nt, Homo sapiens
uugcuuccauuauu

SEQ ID NO: 842647 - RNA, 17 nt, Homo sapiens
uuggaaauugggugugc

SEQ ID NO: 842648 - RNA, 17 nt, Homo sapiens
uuggacagaagcagcuc

SEQ ID NO: 842649 - RNA, 20 nt, Homo sapiens
uuggcugagagaguggcauu

SEQ ID NO: 842650 - RNA, 23 nt, Homo sapiens
uuguaaacagcuaauaaugaagu

SEQ ID NO: 842651 - RNA, 14 nt, Homo sapiens
uuguccguuuacuu

SEQ ID NO: 842652 - RNA, 22 nt, Homo sapiens
uugugaaauguaacaugaagca

SEQ ID NO: 842653 - RNA, 17 nt, Homo sapiens
uugugauuacguguaug

SEQ ID NO: 842654 - RNA, 23 nt, Homo sapiens
uuguuuucccgagcaaagucuaa

SEQ ID NO: 842655 - RNA, 16 nt, Homo sapiens
uuuaacuugaggguaa

SEQ ID NO: 842656 - RNA, 20 nt, Homo sapiens
uuuaaucuguauuuccccaa

SEQ ID NO: 842657 - RNA, 16 nt, Homo sapiens
uuuaauuauaccgcua

SEQ ID NO: 842658 - RNA, 15 nt, Homo sapiens
uuuacucuguguaaa

SEQ ID NO: 842659 - RNA, 20 nt, Homo sapiens
uuuaucauauauauacauac

SEQ ID NO: 842660 - RNA, 12 nt, Homo sapiens
uuuaugcuccua

SEQ ID NO: 842661 - RNA, 18 nt, Homo sapiens
uuucccuguuucuuccac

SEQ ID NO: 842662 - RNA, 13 nt, Homo sapiens
uuucuucucccaa

SEQ ID NO: 842663 - RNA, 19 nt, Homo sapiens
uuucuucucuccagugcac

SEQ ID NO: 842664 - RNA, 23 nt, Homo sapiens
uuugaaauugagcuggaccucac

SEQ ID NO: 842665 - RNA, 12 nt, Homo sapiens
uuugcucaugga

SEQ ID NO: 842666 - RNA, 13 nt, Homo sapiens
uuugcucauggaa

SEQ ID NO: 842667 - RNA, 21 nt, Homo sapiens
uuuggggaaaggcuuggcaca

SEQ ID NO: 842668 - RNA, 16 nt, Homo sapiens
uuuguagaacugccca

SEQ ID NO: 842669 - RNA, 12 nt, Homo sapiens
uuuguucacuua

SEQ ID NO: 842670 - RNA, 22 nt, Homo sapiens
uuuucacuucaaaacaguauug

SEQ ID NO: 842671 - RNA, 20 nt, Homo sapiens
uuuucuauuguuguacacag

SEQ ID NO: 842672 - RNA, 22 nt, Homo sapiens
aggaggugcuaucgcaccacug

SEQ ID NO: 842673 - RNA, 15 nt, Homo sapiens
aggaugcacuggccu

SEQ ID NO: 842674 - RNA, 16 nt, Homo sapiens
aggcgcgguggcucuu

SEQ ID NO: 842675 - RNA, 18 nt, Homo sapiens
agggagaugaguugcagu

SEQ ID NO: 842676 - RNA, 21 nt, Homo sapiens
agggcugaguuugcacagugg

SEQ ID NO: 842677 - RNA, 20 nt, Homo sapiens
aggggcaggcacagcacagg

SEQ ID NO: 842678 - RNA, 22 nt, Homo sapiens
aggggcuuuggaagcucuguug

SEQ ID NO: 842679 - RNA, 21 nt, Homo sapiens
agggguaauauauugcugcug

SEQ ID NO: 842680 - RNA, 16 nt, Homo sapiens
agggucaaaguacaga

SEQ ID NO: 842681 - RNA, 22 nt, Homo sapiens
agguccuggggaggcugagacu

SEQ ID NO: 842682 - RNA, 13 nt, Homo sapiens
aggucuccuccac

SEQ ID NO: 842683 - RNA, 14 nt, Homo sapiens
aggugauggccagu

SEQ ID NO: 842684 - RNA, 22 nt, Homo sapiens
aggugcuggccucaaacagcca

SEQ ID NO: 842685 - RNA, 15 nt, Homo sapiens
agguuucuccuugaa

SEQ ID NO: 842686 - RNA, 13 nt, Homo sapiens
aguaauuguaagu

SEQ ID NO: 842687 - RNA, 19 nt, Homo sapiens
aguaauugucaauaccccu

SEQ ID NO: 842688 - RNA, 16 nt, Homo sapiens
aguauauaacuaacaa

SEQ ID NO: 842689 - RNA, 12 nt, Homo sapiens
aguccuugcaaa

SEQ ID NO: 842690 - RNA, 14 nt, Homo sapiens
agucuaaaguuuac

SEQ ID NO: 842691 - RNA, 13 nt, Homo sapiens
agucucauaucag

SEQ ID NO: 842692 - RNA, 18 nt, Homo sapiens
agugccuuucuucucucc

SEQ ID NO: 842693 - RNA, 22 nt, Homo sapiens
aguuauucuugacaugagaaaa

SEQ ID NO: 842694 - RNA, 22 nt, Homo sapiens
aguucaaguccugccucuuaaa

SEQ ID NO: 842695 - RNA, 19 nt, Homo sapiens
aguuguuuucccgagcaaa

SEQ ID NO: 842696 - RNA, 20 nt, Homo sapiens
aguuuguugaaaacaaaaac

SEQ ID NO: 842697 - RNA, 20 nt, Homo sapiens
auaaacacuccacaguguuu

SEQ ID NO: 842698 - RNA, 16 nt, Homo sapiens
auaacuggaaacuuca

SEQ ID NO: 842699 - RNA, 19 nt, Homo sapiens
auaagaaaaaauucuuuca

SEQ ID NO: 842700 - RNA, 15 nt, Homo sapiens
auaaucuuucacagg

SEQ ID NO: 842701 - RNA, 18 nt, Homo sapiens
auacaugcuuuuuaauga

SEQ ID NO: 842702 - RNA, 18 nt, Homo sapiens
auaccccuguuaagcaau

SEQ ID NO: 842703 - RNA, 17 nt, Homo sapiens
auacucacuuucccaaa

SEQ ID NO: 842704 - RNA, 17 nt, Homo sapiens
auacuugcaguugugau

SEQ ID NO: 842705 - RNA, 22 nt, Homo sapiens
auaguuauuguuuuauguucua

SEQ ID NO: 842706 - RNA, 14 nt, Homo sapiens
auauauauacauac

SEQ ID NO: 842707 - RNA, 20 nt, Homo sapiens
auauggcagggaagcuuuca

SEQ ID NO: 842708 - RNA, 23 nt, Homo sapiens
auauuguuugcuaagcauuccaa

SEQ ID NO: 842709 - RNA, 10 nt, Homo sapiens
aucaccacug

SEQ ID NO: 842710 - RNA, 20 nt, Homo sapiens
aucaccaguguguggcuuuc

SEQ ID NO: 842711 - RNA, 17 nt, Homo sapiens
caugcugauuguuauug

SEQ ID NO: 842712 - RNA, 20 nt, Homo sapiens
caugcuggaugaccccaugc

SEQ ID NO: 842713 - RNA, 22 nt, Homo sapiens
cauguaucuaccucacuauuca

SEQ ID NO: 842714 - RNA, 16 nt, Homo sapiens
cauuuaacuggagcuc

SEQ ID NO: 842715 - RNA, 17 nt, Homo sapiens
ccaaacugacucuuaag

SEQ ID NO: 842716 - RNA, 21 nt, Homo sapiens
ccaccucugaggacucuggac

SEQ ID NO: 842717 - RNA, 17 nt, Homo sapiens
ccacgcccuggggagug

SEQ ID NO: 842718 - RNA, 13 nt, Homo sapiens
ccacgguggacuu

SEQ ID NO: 842719 - RNA, 18 nt, Homo sapiens
ccacguccugucagugcc

SEQ ID NO: 842720 - RNA, 16 nt, Homo sapiens
ccacuugggaggguca

SEQ ID NO: 842721 - RNA, 17 nt, Homo sapiens
ccagaggcagcuaaggg

SEQ ID NO: 842722 - RNA, 14 nt, Homo sapiens
ccagaucagguaua

SEQ ID NO: 842723 - RNA, 13 nt, Homo sapiens
ccaggugcuaggg

SEQ ID NO: 842724 - RNA, 14 nt, Homo sapiens
ccauccuaccacaa

SEQ ID NO: 842725 - RNA, 20 nt, Homo sapiens
ccauuuuuccagagcugcag

SEQ ID NO: 842726 - RNA, 14 nt, Homo sapiens
cccacagcuguaug

SEQ ID NO: 842727 - RNA, 18 nt, Homo sapiens
cccaccagcccacaucca

SEQ ID NO: 842728 - RNA, 18 nt, Homo sapiens
cccacuguaaagccaguu

SEQ ID NO: 842729 - RNA, 21 nt, Homo sapiens
cccacuuaccuugcaucucac

SEQ ID NO: 842730 - RNA, 17 nt, Homo sapiens
cccagcccugaacaaag

SEQ ID NO: 842731 - RNA, 23 nt, Homo sapiens
cccaguuuaggugauggccaguc

SEQ ID NO: 842732 - RNA, 22 nt, Homo sapiens
cccaugcaaguagcuggcugua

SEQ ID NO: 842733 - RNA, 15 nt, Homo sapiens
ccccagccuggccca

SEQ ID NO: 842734 - RNA, 12 nt, Homo sapiens
ccccagcuuucu

SEQ ID NO: 842735 - RNA, 13 nt, Homo sapiens
cccccacucugca

SEQ ID NO: 842736 - RNA, 19 nt, Homo sapiens
ccccucccacagcgcuggc

SEQ ID NO: 842737 - RNA, 20 nt, Homo sapiens
ccccucccagcugacagucc

SEQ ID NO: 842738 - RNA, 14 nt, Homo sapiens
ccccucccuggaug

SEQ ID NO: 842739 - RNA, 21 nt, Homo sapiens
ccccucccuggaugacauuaa

SEQ ID NO: 842740 - RNA, 16 nt, Homo sapiens
cccgagccuggcucca

SEQ ID NO: 842741 - RNA, 15 nt, Homo sapiens
cccuacaccucuggg

SEQ ID NO: 842742 - RNA, 22 nt, Homo sapiens
cccuagucaucguuugugugua

SEQ ID NO: 842743 - RNA, 24 nt, Homo sapiens
cccucaaggccucccacagugacu

SEQ ID NO: 842744 - RNA, 12 nt, Homo sapiens
cccucaucaaaa

SEQ ID NO: 842745 - RNA, 15 nt, Homo sapiens
cccucccuggaugac

SEQ ID NO: 842746 - RNA, 20 nt, Homo sapiens
cccucccuggaugacauuaa

SEQ ID NO: 842747 - RNA, 21 nt, Homo sapiens
cccuggaugacauuaaagaag

SEQ ID NO: 842748 - RNA, 18 nt, Homo sapiens
ccguugcugaaaaugauu

SEQ ID NO: 842749 - RNA, 21 nt, Homo sapiens
ccucaagugcaaggaccaaag

SEQ ID NO: 842750 - RNA, 19 nt, Homo sapiens
ccucaucaaaaacacucuc

SEQ ID NO: 842751 - RNA, 15 nt, Homo sapiens
ccucccuggucccuu

SEQ ID NO: 842752 - RNA, 12 nt, Homo sapiens
ccugauaagcaa

SEQ ID NO: 842753 - RNA, 13 nt, Homo sapiens
ccugauaagcaaa

SEQ ID NO: 842754 - RNA, 16 nt, Homo sapiens
ccugcacuguccugcu

SEQ ID NO: 842755 - RNA, 15 nt, Homo sapiens
ccuggaaaucagggu

SEQ ID NO: 842756 - RNA, 11 nt, Homo sapiens
ccuugaugaag

SEQ ID NO: 842757 - RNA, 21 nt, Homo sapiens
ccuuguguacaguuauuuaug

SEQ ID NO: 842758 - RNA, 14 nt, Homo sapiens
ccuuuccaggguca

SEQ ID NO: 842759 - RNA, 23 nt, Homo sapiens
ccuuuccagggucaaaguacaga

SEQ ID NO: 842760 - RNA, 13 nt, Homo sapiens
ccuuucuucucuc

SEQ ID NO: 842761 - RNA, 20 nt, Homo sapiens
cgagauugcaccacugcacu

SEQ ID NO: 842762 - RNA, 19 nt, Homo sapiens
cgaggugguagcucugagc

SEQ ID NO: 842763 - RNA, 16 nt, Homo sapiens
cggagguugcagugag

SEQ ID NO: 842764 - RNA, 21 nt, Homo sapiens
cgugagcuccggaauagaugu

SEQ ID NO: 842765 - RNA, 17 nt, Homo sapiens
cguucccaccucugagg

SEQ ID NO: 842766 - RNA, 13 nt, Homo sapiens
cuaaagagcuuua

SEQ ID NO: 842767 - RNA, 22 nt, Homo sapiens
cuaacaaguagcacccuggauu

SEQ ID NO: 842768 - RNA, 22 nt, Homo sapiens
cuaaguguuucauaaauuugag

SEQ ID NO: 842769 - RNA, 21 nt, Homo sapiens
cuaccccucccagcugacagu

SEQ ID NO: 842770 - RNA, 23 nt, Homo sapiens
cuaccccucccagcugacagucc

SEQ ID NO: 842771 - RNA, 23 nt, Homo sapiens
cuaggacuuuagggaucugggga

SEQ ID NO: 842772 - RNA, 23 nt, Homo sapiens
cuaggagccagugugaggcugua

SEQ ID NO: 842773 - RNA, 21 nt, Homo sapiens
cuaggggcuggggccaaauaa

SEQ ID NO: 842774 - RNA, 10 nt, Homo sapiens
cuagucaucg

SEQ ID NO: 842775 - RNA, 17 nt, Homo sapiens
cuauaguguaauaaugu

SEQ ID NO: 842776 - RNA, 14 nt, Homo sapiens
cuaucgcaccacug

SEQ ID NO: 842777 - RNA, 20 nt, Homo sapiens
cuauuaaauguauaugucau

SEQ ID NO: 842778 - RNA, 15 nt, Homo sapiens
cuauuuaacuugagg

SEQ ID NO: 842779 - RNA, 17 nt, Homo sapiens
cuauuuaacuugagggu

SEQ ID NO: 842780 - RNA, 23 nt, Homo sapiens
cucaaagcaaauaauuuuucacu

SEQ ID NO: 842781 - RNA, 20 nt, Homo sapiens
cucaaggccucccacaguga

SEQ ID NO: 842782 - RNA, 19 nt, Homo sapiens
cucacacgggguauuuuag

SEQ ID NO: 842783 - RNA, 14 nt, Homo sapiens
cucacuaugcugcu

SEQ ID NO: 842784 - RNA, 19 nt, Homo sapiens
cucacuauucaaguauuag

SEQ ID NO: 842785 - RNA, 20 nt, Homo sapiens
cucaggauauucacucugug

SEQ ID NO: 842786 - RNA, 23 nt, Homo sapiens
cucaguccaguccucacaugccc

SEQ ID NO: 842787 - RNA, 14 nt, Homo sapiens
cucaguguugacug

SEQ ID NO: 842788 - RNA, 17 nt, Homo sapiens
cuccaccgccauggcuu

SEQ ID NO: 842789 - RNA, 20 nt, Homo sapiens
cuccaccuaguggcugucca

SEQ ID NO: 842790 - RNA, 20 nt, Homo sapiens
cuccagcucucaguuacaag

SEQ ID NO: 842791 - RNA, 13 nt, Homo sapiens
cugucuacacuaa

SEQ ID NO: 842792 - RNA, 13 nt, Homo sapiens
cugucucuacuaa

SEQ ID NO: 842793 - RNA, 12 nt, Homo sapiens
cuguuaugucaa

SEQ ID NO: 842794 - RNA, 13 nt, Homo sapiens
cuguucccauaac

SEQ ID NO: 842795 - RNA, 14 nt, Homo sapiens
cuguugcagguguc

SEQ ID NO: 842796 - RNA, 18 nt, Homo sapiens
cuuagaauaaaauuguaa

SEQ ID NO: 842797 - RNA, 20 nt, Homo sapiens
cuuauuaauuugacuagaaa

SEQ ID NO: 842798 - RNA, 14 nt, Homo sapiens
cuucauuugcaauu

SEQ ID NO: 842799 - RNA, 22 nt, Homo sapiens
cuuccaggggagguucagugaa

SEQ ID NO: 842800 - RNA, 13 nt, Homo sapiens
cuucccugacacu

SEQ ID NO: 842801 - RNA, 23 nt, Homo sapiens
cuucucacuagcugucucaggag

SEQ ID NO: 842802 - RNA, 14 nt, Homo sapiens
cuucucuccagugc

SEQ ID NO: 842803 - RNA, 16 nt, Homo sapiens
cuugaagcaaaugugu

SEQ ID NO: 842804 - RNA, 13 nt, Homo sapiens
cuugagauuuccc

SEQ ID NO: 842805 - RNA, 21 nt, Homo sapiens
cuugaggauuuugaguaucuc

SEQ ID NO: 842806 - RNA, 22 nt, Homo sapiens
cuugaggguaauaaacuuagaa

SEQ ID NO: 842807 - RNA, 18 nt, Homo sapiens
cuugauggagauauuuac

SEQ ID NO: 842808 - RNA, 16 nt, Homo sapiens
cuugcugcugagugca

SEQ ID NO: 842809 - RNA, 18 nt, Homo sapiens
cuuggcuccaccacugau

SEQ ID NO: 842810 - RNA, 19 nt, Homo sapiens
cuuggugcgguaggugcug

SEQ ID NO: 842811 - RNA, 18 nt, Homo sapiens
cuugguucaguaccacau

SEQ ID NO: 842812 - RNA, 11 nt, Homo sapiens
cuuuacuugac

SEQ ID NO: 842813 - RNA, 22 nt, Homo sapiens
cuuucaagaagugccaguugau

SEQ ID NO: 842814 - RNA, 19 nt, Homo sapiens
cuuucucaucuugucccca

SEQ ID NO: 842815 - RNA, 15 nt, Homo sapiens
cuuucuucucuccag

SEQ ID NO: 842816 - RNA, 14 nt, Homo sapiens
cuuuucccaaccau

SEQ ID NO: 842817 - RNA, 15 nt, Homo sapiens
gaaaagggcuuucuc

SEQ ID NO: 842818 - RNA, 14 nt, Homo sapiens
gaaagauggaacuu

SEQ ID NO: 842819 - RNA, 19 nt, Homo sapiens
gaaaggcaagagcucaagg

SEQ ID NO: 842820 - RNA, 22 nt, Homo sapiens
gaacacuaaacagacuauuuaa

SEQ ID NO: 842821 - RNA, 20 nt, Homo sapiens
gaacauggucacccccacuc

SEQ ID NO: 842822 - RNA, 18 nt, Homo sapiens
gaagaaguugauaugccu

SEQ ID NO: 842823 - RNA, 21 nt, Homo sapiens
gaagcuuucaccagccacaca

SEQ ID NO: 842824 - RNA, 17 nt, Homo sapiens
gaaggccuugcugucau

SEQ ID NO: 842825 - RNA, 15 nt, Homo sapiens
gaaguugauaugccu

SEQ ID NO: 842826 - RNA, 23 nt, Homo sapiens
gaauauauggucugugugucuga

SEQ ID NO: 842827 - RNA, 11 nt, Homo sapiens
gacaacaaaga

SEQ ID NO: 842828 - RNA, 12 nt, Homo sapiens
gacaacaaagag

SEQ ID NO: 842829 - RNA, 15 nt, Homo sapiens
gacacugauaugggu

SEQ ID NO: 842830 - RNA, 15 nt, Homo sapiens
gacaguauauaacua

SEQ ID NO: 842831 - RNA, 16 nt, Homo sapiens
gacauauaccuucuca

SEQ ID NO: 842832 - RNA, 17 nt, Homo sapiens
gaccuuucagcugugaa

SEQ ID NO: 842833 - RNA, 19 nt, Homo sapiens
gacgcuggcuaaagugggu

SEQ ID NO: 842834 - RNA, 12 nt, Homo sapiens
gacucugugcug

SEQ ID NO: 842835 - RNA, 21 nt, Homo sapiens
gacuggaggcaggacuccugg

SEQ ID NO: 842836 - RNA, 22 nt, Homo sapiens
gacuuucccaaauguauugauu

SEQ ID NO: 842837 - RNA, 18 nt, Homo sapiens
gagagacacacugaagaa

SEQ ID NO: 842838 - RNA, 18 nt, Homo sapiens
gagagauucaugcugauu

SEQ ID NO: 842839 - RNA, 23 nt, Homo sapiens
gagagcagcuucugccacuuccc

SEQ ID NO: 842840 - RNA, 13 nt, Homo sapiens
gagauauuuacau

SEQ ID NO: 842841 - RNA, 13 nt, Homo sapiens
gagaucaccagug

SEQ ID NO: 842842 - RNA, 21 nt, Homo sapiens
gagccgagauugcaccacugc

SEQ ID NO: 842843 - RNA, 14 nt, Homo sapiens
gagcuggaccucac

SEQ ID NO: 842844 - RNA, 22 nt, Homo sapiens
gaggagaacacuagacaugcca

SEQ ID NO: 842845 - RNA, 14 nt, Homo sapiens
gaggccccaggugg

SEQ ID NO: 842846 - RNA, 21 nt, Homo sapiens
gaguaucugaggcacauguca

SEQ ID NO: 842847 - RNA, 17 nt, Homo sapiens
gagugagacucgucuca

SEQ ID NO: 842848 - RNA, 18 nt, Homo sapiens
gaguugaccuucugaaca

SEQ ID NO: 842849 - RNA, 15 nt, Homo sapiens
gauacaaaguacaga

SEQ ID NO: 842850 - RNA, 18 nt, Homo sapiens
gauacuguuucuugcacu

SEQ ID NO: 842851 - RNA, 17 nt, Homo sapiens
gaucacaguggccacgg

SEQ ID NO: 842852 - RNA, 14 nt, Homo sapiens
gauccccagcuuuc

SEQ ID NO: 842853 - RNA, 15 nt, Homo sapiens
gauccucucuccagg

SEQ ID NO: 842854 - RNA, 17 nt, Homo sapiens
gauguauuuuucuugcu

SEQ ID NO: 842855 - RNA, 19 nt, Homo sapiens
gcacacagcaggcuuucaa

SEQ ID NO: 842856 - RNA, 22 nt, Homo sapiens
gcacagccucuuagaugcaguu

SEQ ID NO: 842857 - RNA, 23 nt, Homo sapiens
gcacagccucuuagaugcaguuc

SEQ ID NO: 842858 - RNA, 20 nt, Homo sapiens
gcaccacugcacuccagccu

SEQ ID NO: 842859 - RNA, 12 nt, Homo sapiens
gcacccuggauu

SEQ ID NO: 842860 - RNA, 19 nt, Homo sapiens
gcagacgccacagucuccc

SEQ ID NO: 842861 - RNA, 15 nt, Homo sapiens
gcagagagcaccugg

SEQ ID NO: 842862 - RNA, 21 nt, Homo sapiens
gcagagugagacucgucucaa

SEQ ID NO: 842863 - RNA, 19 nt, Homo sapiens
gcagggcccacccauguca

SEQ ID NO: 842864 - RNA, 20 nt, Homo sapiens
gcaguaaauacuugcaguug

SEQ ID NO: 842865 - RNA, 18 nt, Homo sapiens
gcagugagcuucuauuaa

SEQ ID NO: 842866 - RNA, 22 nt, Homo sapiens
gcagugccuuucuucucuccag

SEQ ID NO: 842867 - RNA, 20 nt, Homo sapiens
gcauaauguuaagcuuuauu

SEQ ID NO: 842868 - RNA, 14 nt, Homo sapiens
gcaucugcucugag

SEQ ID NO: 842869 - RNA, 18 nt, Homo sapiens
gcauuuucuucacagugc

SEQ ID NO: 842870 - RNA, 16 nt, Homo sapiens
gccaagaucacagugg

SEQ ID NO: 842871 - RNA, 19 nt, Homo sapiens
gccaagaucacaguggcca

SEQ ID NO: 842872 - RNA, 23 nt, Homo sapiens
ggaguccagccuaaucaagucaa

SEQ ID NO: 842873 - RNA, 17 nt, Homo sapiens
ggcaaccagaccauugu

SEQ ID NO: 842874 - RNA, 22 nt, Homo sapiens
ggcacuaguauuucuaugaaau

SEQ ID NO: 842875 - RNA, 20 nt, Homo sapiens
ggcacugcuggguggcccau

SEQ ID NO: 842876 - RNA, 20 nt, Homo sapiens
ggccaagaucacaguggcca

SEQ ID NO: 842877 - RNA, 17 nt, Homo sapiens
ggccacagccacuaauc

SEQ ID NO: 842878 - RNA, 17 nt, Homo sapiens
ggccucccacagugacu

SEQ ID NO: 842879 - RNA, 17 nt, Homo sapiens
ggcugagagaguggcau

SEQ ID NO: 842880 - RNA, 21 nt, Homo sapiens
ggcuuuggaagccaugugauu

SEQ ID NO: 842881 - RNA, 16 nt, Homo sapiens
gggacagucaccucau

SEQ ID NO: 842882 - RNA, 13 nt, Homo sapiens
gggaggagccuug

SEQ ID NO: 842883 - RNA, 18 nt, Homo sapiens
gggauccucucuccaggc

SEQ ID NO: 842884 - RNA, 14 nt, Homo sapiens
gggccaagucacag

SEQ ID NO: 842885 - RNA, 16 nt, Homo sapiens
gggccuguuaugucaa

SEQ ID NO: 842886 - RNA, 22 nt, Homo sapiens
gggcugcccgcucccagugucu

SEQ ID NO: 842887 - RNA, 23 nt, Homo sapiens
gggugccacgguggacuuagcuc

SEQ ID NO: 842888 - RNA, 20 nt, Homo sapiens
ggguggacgagggagugucu

SEQ ID NO: 842889 - RNA, 18 nt, Homo sapiens
gguaauuuguaucugaag

SEQ ID NO: 842890 - RNA, 20 nt, Homo sapiens
gguaccuagguuggagucca

SEQ ID NO: 842891 - RNA, 14 nt, Homo sapiens
gguggcucuugccu

SEQ ID NO: 842892 - RNA, 22 nt, Homo sapiens
gguggugcagccccaggaccaa

SEQ ID NO: 842893 - RNA, 23 nt, Homo sapiens
guaaugagggcugaguuugcaca

SEQ ID NO: 842894 - RNA, 16 nt, Homo sapiens
guacacugccuucuca

SEQ ID NO: 842895 - RNA, 18 nt, Homo sapiens
guaccccugauaagcaaa

SEQ ID NO: 842896 - RNA, 19 nt, Homo sapiens
guacuaagaggcuauuuaa

SEQ ID NO: 842897 - RNA, 15 nt, Homo sapiens
guagaauagauaucc

SEQ ID NO: 842898 - RNA, 20 nt, Homo sapiens
guaggccuuggcccaccuga

SEQ ID NO: 842899 - RNA, 17 nt, Homo sapiens
guauauuucccuguuuc

SEQ ID NO: 842900 - RNA, 19 nt, Homo sapiens
guaucuaccucacuauuca

SEQ ID NO: 842901 - RNA, 20 nt, Homo sapiens
guaucuaccucacuauucaa

SEQ ID NO: 842902 - RNA, 21 nt, Homo sapiens
guaugauucccagccagcaca

SEQ ID NO: 842903 - RNA, 23 nt, Homo sapiens
guauguuucuucuuucuuuuaag

SEQ ID NO: 842904 - RNA, 23 nt, Homo sapiens
guauucagcuuuaguagauauua

SEQ ID NO: 842905 - RNA, 18 nt, Homo sapiens
gucaccggucagugccuu

SEQ ID NO: 842906 - RNA, 23 nt, Homo sapiens
gucauuuugggaccuauaucuca

SEQ ID NO: 842907 - RNA, 22 nt, Homo sapiens
guccuacggagggaccaggugu

SEQ ID NO: 842908 - RNA, 15 nt, Homo sapiens
guccugacuucaggg

SEQ ID NO: 842909 - RNA, 17 nt, Homo sapiens
guccugcuccacagugu

SEQ ID NO: 842910 - RNA, 18 nt, Homo sapiens
gucucaggaguagucuca

SEQ ID NO: 842911 - RNA, 17 nt, Homo sapiens
gucucugccacuccuga

SEQ ID NO: 842912 - RNA, 19 nt, Homo sapiens
gugaaauguaacaugaagc

SEQ ID NO: 842913 - RNA, 23 nt, Homo sapiens
gugauggccagucaugugcuggu

SEQ ID NO: 842914 - RNA, 17 nt, Homo sapiens
gugcuaucgcaccacug

SEQ ID NO: 842915 - RNA, 20 nt, Homo sapiens
gugcuggccucaaacagcca

SEQ ID NO: 842916 - RNA, 12 nt, Homo sapiens
guggacgaggga

SEQ ID NO: 842917 - RNA, 16 nt, Homo sapiens
gugggaacauggucac

SEQ ID NO: 842918 - RNA, 15 nt, Homo sapiens
gugggacaacaaaga

SEQ ID NO: 842919 - RNA, 16 nt, Homo sapiens
gugggucccacuuccc

SEQ ID NO: 842920 - RNA, 17 nt, Homo sapiens
gugggucccacuucccc

SEQ ID NO: 842921 - RNA, 22 nt, Homo sapiens
guggugucgcgccuucuccccc

SEQ ID NO: 842922 - RNA, 19 nt, Homo sapiens
guguuuauccuaucucucc

SEQ ID NO: 842923 - RNA, 19 nt, Homo sapiens
guuaggccuggcacagugu

SEQ ID NO: 842924 - RNA, 13 nt, Homo sapiens
guuauucuugaca

SEQ ID NO: 842925 - RNA, 19 nt, Homo sapiens
guuauuuaugccucuguau

SEQ ID NO: 842926 - RNA, 14 nt, Homo sapiens
guuuaaagugcagu

SEQ ID NO: 842927 - RNA, 18 nt, Homo sapiens
guuuauccuaucucucca

SEQ ID NO: 842928 - RNA, 18 nt, Homo sapiens
guuuuauauguaguacua

SEQ ID NO: 842929 - RNA, 14 nt, Homo sapiens
uaaaaaacugugaa

SEQ ID NO: 842930 - RNA, 16 nt, Homo sapiens
uaaaagaaugauuaug

SEQ ID NO: 842931 - RNA, 17 nt, Homo sapiens
uaaacacuccacagugu

SEQ ID NO: 842932 - RNA, 22 nt, Homo sapiens
uaaacacuccacaguguuuaua

SEQ ID NO: 842933 - RNA, 15 nt, Homo sapiens
uaaacauucuaucua

SEQ ID NO: 842934 - RNA, 22 nt, Homo sapiens
uaaaccuuuuuggacacacaaa

SEQ ID NO: 842935 - RNA, 22 nt, Homo sapiens
uaaagcugccggcacagaacuu

SEQ ID NO: 842936 - RNA, 17 nt, Homo sapiens
uaaaguuuguucacuua

SEQ ID NO: 842937 - RNA, 21 nt, Homo sapiens
uaaauacuugcaguugugaua

SEQ ID NO: 842938 - RNA, 19 nt, Homo sapiens
uaaaugccaggccuggcaa

SEQ ID NO: 842939 - RNA, 19 nt, Homo sapiens
uaaauguauaugucauuua

SEQ ID NO: 842940 - RNA, 17 nt, Homo sapiens
uaaauguugacauggga

SEQ ID NO: 842941 - RNA, 17 nt, Homo sapiens
uaaauuguuugaccaug

SEQ ID NO: 842942 - RNA, 20 nt, Homo sapiens
uaacaaguagcacccuggau

SEQ ID NO: 842943 - RNA, 16 nt, Homo sapiens
uaacaguugugucaua

SEQ ID NO: 842944 - RNA, 12 nt, Homo sapiens
uaagaagacugc

SEQ ID NO: 842945 - RNA, 23 nt, Homo sapiens
uaagcagacccauaccuuuccag

SEQ ID NO: 842946 - RNA, 19 nt, Homo sapiens
uaagccuucauuugcaauu

SEQ ID NO: 842947 - RNA, 20 nt, Homo sapiens
uaaguaccccugauaagcaa

SEQ ID NO: 842948 - RNA, 22 nt, Homo sapiens
uaaguaccccugauaagcaaau

SEQ ID NO: 842949 - RNA, 23 nt, Homo sapiens
uaaguaccccugauaagcaaauu

SEQ ID NO: 842950 - RNA, 12 nt, Homo sapiens
uaauauauugcu

SEQ ID NO: 842951 - RNA, 17 nt, Homo sapiens
uaaucuuucacagggga

SEQ ID NO: 842952 - RNA, 21 nt, Homo sapiens
ugugauuaucaauuaccacac

SEQ ID NO: 842953 - RNA, 12 nt, Homo sapiens
uguggcacuugg

SEQ ID NO: 842954 - RNA, 18 nt, Homo sapiens
uguggcacuugggcauuu

SEQ ID NO: 842955 - RNA, 14 nt, Homo sapiens
uguuaaaacuggga

SEQ ID NO: 842956 - RNA, 21 nt, Homo sapiens
uguuaaaacugggacagggga

SEQ ID NO: 842957 - RNA, 20 nt, Homo sapiens
uguuagggagaugaguugca

SEQ ID NO: 842958 - RNA, 22 nt, Homo sapiens
uguuauaaucuuucacagggga

SEQ ID NO: 842959 - RNA, 16 nt, Homo sapiens
uguuauuuguacaguu

SEQ ID NO: 842960 - RNA, 22 nt, Homo sapiens
uguucccauaaccccuagucau

SEQ ID NO: 842961 - RNA, 16 nt, Homo sapiens
uguugacaugggacau

SEQ ID NO: 842962 - RNA, 16 nt, Homo sapiens
uguuggcuagccucug

SEQ ID NO: 842963 - RNA, 17 nt, Homo sapiens
uguuuccaucaagggua

SEQ ID NO: 842964 - RNA, 15 nt, Homo sapiens
uuaaagaaggguuga

SEQ ID NO: 842965 - RNA, 20 nt, Homo sapiens
uuaagagcuugaucugugau

SEQ ID NO: 842966 - RNA, 21 nt, Homo sapiens
uuaagagcuugaucugugauu

SEQ ID NO: 842967 - RNA, 17 nt, Homo sapiens
uuaagcuuuauugugau

SEQ ID NO: 842968 - RNA, 14 nt, Homo sapiens
uuaauaauguuuca

SEQ ID NO: 842969 - RNA, 17 nt, Homo sapiens
uuaauauauacuaugag

SEQ ID NO: 842970 - RNA, 14 nt, Homo sapiens
uuaauauuccucag

SEQ ID NO: 842971 - RNA, 16 nt, Homo sapiens
uuauauguaguacuaa

SEQ ID NO: 842972 - RNA, 17 nt, Homo sapiens
uuauccuaucucuccaa

SEQ ID NO: 842973 - RNA, 18 nt, Homo sapiens
uucaaguauuagggguaa

SEQ ID NO: 842974 - RNA, 13 nt, Homo sapiens
uucaccaauaagu

SEQ ID NO: 842975 - RNA, 22 nt, Homo sapiens
uucacuugguucaguaccacau

SEQ ID NO: 842976 - RNA, 23 nt, Homo sapiens
uucaguaccacaugggugaacac

SEQ ID NO: 842977 - RNA, 15 nt, Homo sapiens
uucauguaacuagaa

SEQ ID NO: 842978 - RNA, 17 nt, Homo sapiens
uuccaagcaaguauuag

SEQ ID NO: 842979 - RNA, 19 nt, Homo sapiens
uuccagggucaaaguacag

SEQ ID NO: 842980 - RNA, 13 nt, Homo sapiens
uucccaacuccag

SEQ ID NO: 842981 - RNA, 22 nt, Homo sapiens
uucccaacuccagaaagugaca

SEQ ID NO: 842982 - RNA, 17 nt, Homo sapiens
uucccaguuuaggugau

SEQ ID NO: 842983 - RNA, 23 nt, Homo sapiens
uuccuacacccuuggacuugagg

SEQ ID NO: 842984 - RNA, 16 nt, Homo sapiens
uucuccaacaauaaga

SEQ ID NO: 842985 - RNA, 18 nt, Homo sapiens
uucuuuguagaacugccc

SEQ ID NO: 842986 - RNA, 18 nt, Homo sapiens
uugaacacuagucugugu

SEQ ID NO: 842987 - RNA, 21 nt, Homo sapiens
uugaaccuugguaaauuguaa

SEQ ID NO: 842988 - RNA, 22 nt, Homo sapiens
uugaaucacugcucacacugcu

SEQ ID NO: 842989 - RNA, 18 nt, Homo sapiens
uugacaggggcucaggau

SEQ ID NO: 842990 - RNA, 22 nt, Homo sapiens
uugacaugggacauuugcucau

SEQ ID NO: 842991 - RNA, 16 nt, Homo sapiens
uugauacaaaguacag

SEQ ID NO: 842992 - RNA, 17 nt, Homo sapiens
uugcaguugugauauaa

SEQ ID NO: 842993 - RNA, 18 nt, Homo sapiens
uugccuuuccaggguuau

SEQ ID NO: 842994 - RNA, 16 nt, Homo sapiens
uuggacagaagcagcu

SEQ ID NO: 842995 - RNA, 16 nt, Homo sapiens
uuggacuugaggauuu

SEQ ID NO: 842996 - RNA, 13 nt, Homo sapiens
uuggcacacagca

SEQ ID NO: 842997 - RNA, 17 nt, Homo sapiens
uuggcuucugugccuga

SEQ ID NO: 842998 - RNA, 17 nt, Homo sapiens
uugguucaguaccacau

SEQ ID NO: 842999 - RNA, 19 nt, Homo sapiens
uuguaaguuuaugucuaaa

SEQ ID NO: 843000 - RNA, 15 nt, Homo sapiens
uuguuauuuguacag

SEQ ID NO: 843001 - RNA, 16 nt, Homo sapiens
uuuaaaagaaugauua

SEQ ID NO: 843002 - RNA, 17 nt, Homo sapiens
uuuaaaccuauacucac

SEQ ID NO: 843003 - RNA, 23 nt, Homo sapiens
uuucaagaaaggcaagagcucaa

SEQ ID NO: 843004 - RNA, 20 nt, Homo sapiens
uuuccauguaucuaccucac

SEQ ID NO: 843005 - RNA, 17 nt, Homo sapiens
uuucccuguuucuucca

SEQ ID NO: 843006 - RNA, 18 nt, Homo sapiens
uuugaggagcagcuucag

SEQ ID NO: 843007 - RNA, 21 nt, Homo sapiens
uuuucccgagcaaagucuaaa

SEQ ID NO: 843008 - RNA, 15 nt, Homo sapiens
uuuugaaaccaugaa

SEQ ID NO: 843009 - RNA, 23 nt, Homo sapiens
uuuuuauaaaaaauggugccuga

SEQ ID NO: 843010 - RNA, 11 nt, Homo sapiens
uuuuucaugau

SEQ ID NO: 843011 - RNA, 23 nt, Homo sapiens
gagaguaucugaggcacauguca

SEQ ID NO: 843012 - RNA, 17 nt, Homo sapiens
gagagucugugacccac

SEQ ID NO: 843013 - RNA, 17 nt, Homo sapiens
gagauggaggaaaguga

SEQ ID NO: 843014 - RNA, 20 nt, Homo sapiens
gagcagcccuaggcuuccac

SEQ ID NO: 843015 - RNA, 16 nt, Homo sapiens
gagcagcuucugccac

SEQ ID NO: 843016 - RNA, 21 nt, Homo sapiens
gagcagcuucugccacuuccc

SEQ ID NO: 843017 - RNA, 15 nt, Homo sapiens
gagcuugaucuguga

SEQ ID NO: 843018 - RNA, 22 nt, Homo sapiens
gagcuuggugcgguaggugcug

SEQ ID NO: 843019 - RNA, 19 nt, Homo sapiens
gaggcgggggagccuggag

SEQ ID NO: 843020 - RNA, 12 nt, Homo sapiens
gaggcugagacu

SEQ ID NO: 843021 - RNA, 14 nt, Homo sapiens
gagggagugucugu

SEQ ID NO: 843022 - RNA, 22 nt, Homo sapiens
gagguggcuucauguggcacuu

SEQ ID NO: 843023 - RNA, 20 nt, Homo sapiens
gauaaucacaauacaucccu

SEQ ID NO: 843024 - RNA, 15 nt, Homo sapiens
gauauucacucugug

SEQ ID NO: 843025 - RNA, 18 nt, Homo sapiens
gauauucacucugugguc

SEQ ID NO: 843026 - RNA, 20 nt, Homo sapiens
gaucggagccuccucucuca

SEQ ID NO: 843027 - RNA, 19 nt, Homo sapiens
gaucuggggaaggaccaac

SEQ ID NO: 843028 - RNA, 13 nt, Homo sapiens
gaugcacuggccu

SEQ ID NO: 843029 - RNA, 22 nt, Homo sapiens
gaugcaguucugaagaagaugg

SEQ ID NO: 843030 - RNA, 14 nt, Homo sapiens
gauguuuguugcua

SEQ ID NO: 843031 - RNA, 11 nt, Homo sapiens
gcaaacauaau

SEQ ID NO: 843032 - RNA, 22 nt, Homo sapiens
gcaaagucuaaaguuuacagua

SEQ ID NO: 843033 - RNA, 15 nt, Homo sapiens
gcaagagccacagua

SEQ ID NO: 843034 - RNA, 23 nt, Homo sapiens
gcacaccuuagguugacauucag

SEQ ID NO: 843035 - RNA, 18 nt, Homo sapiens
gcacaucaaaauaugccc

SEQ ID NO: 843036 - RNA, 15 nt, Homo sapiens
gcaccacuguguauu

SEQ ID NO: 843037 - RNA, 19 nt, Homo sapiens
gcacuaguauuucuaugaa

SEQ ID NO: 843038 - RNA, 22 nt, Homo sapiens
gcacuguccugcuccacagugu

SEQ ID NO: 843039 - RNA, 14 nt, Homo sapiens
gcagcagcuuucag

SEQ ID NO: 843040 - RNA, 21 nt, Homo sapiens
gcagcagugagcuucuauuaa

SEQ ID NO: 843041 - RNA, 19 nt, Homo sapiens
gcagccccaggaccaagcu

SEQ ID NO: 843042 - RNA, 19 nt, Homo sapiens
gcagugggucccacuuccc

SEQ ID NO: 843043 - RNA, 23 nt, Homo sapiens
gcaucucacagguagacaguaua

SEQ ID NO: 843044 - RNA, 17 nt, Homo sapiens
gccacagccacuaauca

SEQ ID NO: 843045 - RNA, 20 nt, Homo sapiens
gccacggccacagccacuaa

SEQ ID NO: 843046 - RNA, 17 nt, Homo sapiens
gccacggccacagucau

SEQ ID NO: 843047 - RNA, 21 nt, Homo sapiens
gccaggccacccugccucuac

SEQ ID NO: 843048 - RNA, 17 nt, Homo sapiens
gcccaggccaucuucca

SEQ ID NO: 843049 - RNA, 16 nt, Homo sapiens
gcccaugggcacugcu

SEQ ID NO: 843050 - RNA, 21 nt, Homo sapiens
gcccccucccuggaugacauu

SEQ ID NO: 843051 - RNA, 16 nt, Homo sapiens
gcccucuguccugacu

SEQ ID NO: 843052 - RNA, 15 nt, Homo sapiens
gcccugaacaaagca

SEQ ID NO: 843053 - RNA, 14 nt, Homo sapiens
gcccugagcuuucc

SEQ ID NO: 843054 - RNA, 19 nt, Homo sapiens
uggugacaugugccuguaa

SEQ ID NO: 843055 - RNA, 20 nt, Homo sapiens
uggugcccaguuagccucug

SEQ ID NO: 843056 - RNA, 14 nt, Homo sapiens
uguaaaacauucac

SEQ ID NO: 843057 - RNA, 19 nt, Homo sapiens
uguacaaaaguuucauccu

SEQ ID NO: 843058 - RNA, 20 nt, Homo sapiens
uguacacagaaauacaguua

SEQ ID NO: 843059 - RNA, 16 nt, Homo sapiens
ugucauaaauuacaca

SEQ ID NO: 843060 - RNA, 16 nt, Homo sapiens
ugucuaaagagcuuua

SEQ ID NO: 843061 - RNA, 18 nt, Homo sapiens
ugugacccacuuaccuug

SEQ ID NO: 843062 - RNA, 23 nt, Homo sapiens
ugugggaggagugacaugaagca

SEQ ID NO: 843063 - RNA, 21 nt, Homo sapiens
ugugguccagguccuuuccac

SEQ ID NO: 843064 - RNA, 17 nt, Homo sapiens
uguguauuuaacugccu

SEQ ID NO: 843065 - RNA, 19 nt, Homo sapiens
uguguuucagccauguauu

SEQ ID NO: 843066 - RNA, 13 nt, Homo sapiens
uguuaagcaauuc

SEQ ID NO: 843067 - RNA, 11 nt, Homo sapiens
uguuaugucaa

SEQ ID NO: 843068 - RNA, 19 nt, Homo sapiens
uguuaugucaaacugucuu

SEQ ID NO: 843069 - RNA, 18 nt, Homo sapiens
uguugcuaggacauauac

SEQ ID NO: 843070 - RNA, 14 nt, Homo sapiens
uuaaaccauguaaa

SEQ ID NO: 843071 - RNA, 16 nt, Homo sapiens
uuaaagcccuguguua

SEQ ID NO: 843072 - RNA, 13 nt, Homo sapiens
uuaacguggcuug

SEQ ID NO: 843073 - RNA, 13 nt, Homo sapiens
uuaacuggagcuc

SEQ ID NO: 843074 - RNA, 12 nt, Homo sapiens
uuacaagugcag

SEQ ID NO: 843075 - RNA, 20 nt, Homo sapiens
uuaggccuggcacagugucu

SEQ ID NO: 843076 - RNA, 19 nt, Homo sapiens
uuagguaaauaaagcucaa

SEQ ID NO: 843077 - RNA, 13 nt, Homo sapiens
uuaguaauuguca

SEQ ID NO: 843078 - RNA, 12 nt, Homo sapiens
uuauaaucuuuc

SEQ ID NO: 843079 - RNA, 15 nt, Homo sapiens
uuauccacaaaguac

SEQ ID NO: 843080 - RNA, 22 nt, Homo sapiens
uuaucuaaucaugaaacucccu

SEQ ID NO: 843081 - RNA, 18 nt, Homo sapiens
uuaucugagucaacuccu

SEQ ID NO: 843082 - RNA, 20 nt, Homo sapiens
uuauguuaaaacugggacag

SEQ ID NO: 843083 - RNA, 19 nt, Homo sapiens
uuauuaauaaacauucuau

SEQ ID NO: 843084 - RNA, 13 nt, Homo sapiens
uuauugugauuac

SEQ ID NO: 843085 - RNA, 17 nt, Homo sapiens
uuauuuguacaguucag

SEQ ID NO: 843086 - RNA, 23 nt, Homo sapiens
uucaagaagugccaguugaucaa

SEQ ID NO: 843087 - RNA, 23 nt, Homo sapiens
uucaguuccucuuugcauggaau

SEQ ID NO: 843088 - RNA, 16 nt, Homo sapiens
uuccaagcaaguauua

SEQ ID NO: 843089 - RNA, 21 nt, Homo sapiens
uuccuacacccuuggacuuga

SEQ ID NO: 843090 - RNA, 18 nt, Homo sapiens
uucuaccacccaccaguu

SEQ ID NO: 843091 - RNA, 19 nt, Homo sapiens
uucucacacacauacauac

SEQ ID NO: 843092 - RNA, 22 nt, Homo sapiens
uucuugguucuuuuuucaguua

SEQ ID NO: 843093 - RNA, 12 nt, Homo sapiens
uucuuucacuug

SEQ ID NO: 843094 - RNA, 17 nt, Homo sapiens
uugcccacagcuguaug

SEQ ID NO: 843095 - RNA, 14 nt, Homo sapiens
uuggcccaccugag

SEQ ID NO: 843096 - RNA, 13 nt, Homo sapiens
uugggagggucag

SEQ ID NO: 843097 - RNA, 12 nt, Homo sapiens
uugucacaggac

SEQ ID NO: 843098 - RNA, 16 nt, Homo sapiens
uugucacugacacaca

SEQ ID NO: 843099 - RNA, 20 nt, Homo sapiens
uugugucauaaauuacacaa

SEQ ID NO: 843100 - RNA, 20 nt, Homo sapiens
uuguuuuauauguaguacua

SEQ ID NO: 843101 - RNA, 14 nt, Homo sapiens
uuuaagaacgaagg

SEQ ID NO: 843102 - RNA, 13 nt, Homo sapiens
uuuaagcuguaaa

SEQ ID NO: 843103 - RNA, 18 nt, Homo sapiens
uuuaggugauggccaguc

SEQ ID NO: 843104 - RNA, 14 nt, Homo sapiens
uuucaccagccaca

SEQ ID NO: 843105 - RNA, 14 nt, Homo sapiens
uuucacuaccuauc

SEQ ID NO: 843106 - RNA, 21 nt, Homo sapiens
uuucaucuguuguucuguggu

SEQ ID NO: 843107 - RNA, 18 nt, Homo sapiens
uuucccaaauguauugau

SEQ ID NO: 843108 - RNA, 16 nt, Homo sapiens
uuuccccaguacugag

SEQ ID NO: 843109 - RNA, 17 nt, Homo sapiens
uuugaacuagaguuuag

SEQ ID NO: 843110 - RNA, 23 nt, Homo sapiens
uuugacuagaaaauuuaaaacau

SEQ ID NO: 843111 - RNA, 20 nt, Homo sapiens
uuuguucuucuaccacccac

SEQ ID NO: 843112 - RNA, 14 nt, Homo sapiens
uuuuaaaguuuguu

SEQ ID NO: 843113 - RNA, 14 nt, Homo sapiens
uuuuaagcuguaaa

SEQ ID NO: 843114 - RNA, 14 nt, Homo sapiens
uuuugaguaucucg

SEQ ID NO: 843115 - RNA, 22 nt, Homo sapiens
uuuuuaaguuauuuuuacauuc

SEQ ID NO: 843116 - RNA, 14 nt, Homo sapiens
ugaucaaugaauaa

SEQ ID NO: 843117 - RNA, 21 nt, Homo sapiens
ugauggagauauuuacaugaa

SEQ ID NO: 843118 - RNA, 13 nt, Homo sapiens
ugauggccaguca

SEQ ID NO: 843119 - RNA, 21 nt, Homo sapiens
ugauuuaucugagucaacucc

SEQ ID NO: 843120 - RNA, 16 nt, Homo sapiens
ugcacccccuccugcu

SEQ ID NO: 843121 - RNA, 23 nt, Homo sapiens
ugcaccugucauaugcucugauu

SEQ ID NO: 843122 - RNA, 11 nt, Homo sapiens
ugcacuggccu

SEQ ID NO: 843123 - RNA, 23 nt, Homo sapiens
ugcaguauauuucugaaaugaca

SEQ ID NO: 843124 - RNA, 15 nt, Homo sapiens
ugcauacacucucaa

SEQ ID NO: 843125 - RNA, 16 nt, Homo sapiens
ugcauagucauguaag

SEQ ID NO: 843126 - RNA, 14 nt, Homo sapiens
ugccaguugaucaa

SEQ ID NO: 843127 - RNA, 18 nt, Homo sapiens
ugcccguugccgggccug

SEQ ID NO: 843128 - RNA, 15 nt, Homo sapiens
ugccucuguauuuaa

SEQ ID NO: 843129 - RNA, 20 nt, Homo sapiens
ugccuguaaucccagcacuu

SEQ ID NO: 843130 - RNA, 16 nt, Homo sapiens
ugcuccgucauuugac

SEQ ID NO: 843131 - RNA, 23 nt, Homo sapiens
ugcugagugcaccacuucaagug

SEQ ID NO: 843132 - RNA, 21 nt, Homo sapiens
ugcuggcuccacgcccugggg

SEQ ID NO: 843133 - RNA, 21 nt, Homo sapiens
uggaaaaagcuccccaccccu

SEQ ID NO: 843134 - RNA, 18 nt, Homo sapiens
uggacuugaggauuuuga

SEQ ID NO: 843135 - RNA, 14 nt, Homo sapiens
uggagccccugugu

SEQ ID NO: 843136 - RNA, 15 nt, Homo sapiens
uggagccccugugug

SEQ ID NO: 843137 - RNA, 19 nt, Homo sapiens
uggaggggacgcuggcuaa

SEQ ID NO: 843138 - RNA, 13 nt, Homo sapiens
uggaugacauuaa

SEQ ID NO: 843139 - RNA, 21 nt, Homo sapiens
uggaugacauuaaagaagggu

SEQ ID NO: 843140 - RNA, 17 nt, Homo sapiens
uggccacggccacagcc

SEQ ID NO: 843141 - RNA, 18 nt, Homo sapiens
uggccacggccacggcca

SEQ ID NO: 843142 - RNA, 11 nt, Homo sapiens
uggccagucau

SEQ ID NO: 843143 - RNA, 21 nt, Homo sapiens
uggcccccucccuggaugaca

SEQ ID NO: 843144 - RNA, 13 nt, Homo sapiens
uggccgggacccc

SEQ ID NO: 843145 - RNA, 14 nt, Homo sapiens
uggcuccaaacccu

SEQ ID NO: 843146 - RNA, 15 nt, Homo sapiens
uggcucuugccugua

SEQ ID NO: 843147 - RNA, 20 nt, Homo sapiens
uggcuuuggaagccauguga

SEQ ID NO: 843148 - RNA, 14 nt, Homo sapiens
ugggacaacaaaga

SEQ ID NO: 843149 - RNA, 20 nt, Homo sapiens
uggggaggaagaaguguaac

SEQ ID NO: 843150 - RNA, 22 nt, Homo sapiens
uggggcuaggggcuggggccaa

SEQ ID NO: 843151 - RNA, 15 nt, Homo sapiens
ugggugaacacucaa

SEQ ID NO: 843152 - RNA, 12 nt, Homo sapiens
ugguaaccucuu

SEQ ID NO: 843153 - RNA, 12 nt, Homo sapiens
ugguagcucuga

SEQ ID NO: 843154 - RNA, 20 nt, Homo sapiens
ugguauuguaaaacauucac

SEQ ID NO: 843155 - RNA, 20 nt, Homo sapiens
uggucuggaauggacugggu

SEQ ID NO: 843156 - RNA, 16 nt, Homo sapiens
ugguucaguaccacau

SEQ ID NO: 843157 - RNA, 21 nt, Homo sapiens
uguaaacagcuaauaaugaag

SEQ ID NO: 843158 - RNA, 18 nt, Homo sapiens
uguaaagugauauuuccc

SEQ ID NO: 843159 - RNA, 18 nt, Homo sapiens
uguaacucaccagccucu

SEQ ID NO: 843160 - RNA, 23 nt, Homo sapiens
uguaagaaaauaucacuugucaa

SEQ ID NO: 843161 - RNA, 14 nt, Homo sapiens
uguagcugcuauau

SEQ ID NO: 843162 - RNA, 22 nt, Homo sapiens
uguauaauuuaacagugcccuu

SEQ ID NO: 843163 - RNA, 20 nt, Homo sapiens
uguaucuaccucacuauuca

SEQ ID NO: 843164 - RNA, 20 nt, Homo sapiens
ugucaccggucagugccuuu

SEQ ID NO: 843165 - RNA, 23 nt, Homo sapiens
uguccgguggagaucccacccga

SEQ ID NO: 843166 - RNA, 17 nt, Homo sapiens
ugucuaaaaugucagug

SEQ ID NO: 843167 - RNA, 18 nt, Homo sapiens
ugugggaucauugcauuu

SEQ ID NO: 843168 - RNA, 23 nt, Homo sapiens
uguggguagacacacaugaaguc

SEQ ID NO: 843169 - RNA, 21 nt, Homo sapiens
ugugucaaacaguacacuauc

SEQ ID NO: 843170 - RNA, 17 nt, Homo sapiens
uguuacuaaaugguguu

SEQ ID NO: 843171 - RNA, 21 nt, Homo sapiens
uguuauuggguaucaccacug

SEQ ID NO: 843172 - RNA, 18 nt, Homo sapiens
uguugcccacagcuguau

SEQ ID NO: 843173 - RNA, 15 nt, Homo sapiens
uguuuaaguggcuuu

SEQ ID NO: 843174 - RNA, 17 nt, Homo sapiens
uuaaagaaggguugagc

SEQ ID NO: 843175 - RNA, 15 nt, Homo sapiens
uuaacuugaggguaa

SEQ ID NO: 843176 - RNA, 14 nt, Homo sapiens
uuaaguuguauuaa

SEQ ID NO: 843177 - RNA, 17 nt, Homo sapiens
uuaauaccacagcuuuu

SEQ ID NO: 843178 - RNA, 16 nt, Homo sapiens
uuaccuugcaucucac

SEQ ID NO: 843179 - RNA, 17 nt, Homo sapiens
uuagauguugguggugc

SEQ ID NO: 843180 - RNA, 12 nt, Homo sapiens
uuagguugacau

SEQ ID NO: 843181 - RNA, 18 nt, Homo sapiens
uuauacauaacacauauc

SEQ ID NO: 843182 - RNA, 20 nt, Homo sapiens
uuauaccgcuaucauuccaa

SEQ ID NO: 843183 - RNA, 20 nt, Homo sapiens
uuaucauauauauacauaca

SEQ ID NO: 843184 - RNA, 15 nt, Homo sapiens
uucaacaucuaguga

SEQ ID NO: 843185 - RNA, 21 nt, Homo sapiens
uucacuugguucaguaccaca

SEQ ID NO: 843186 - RNA, 17 nt, Homo sapiens
uucagaaaacuucaaga

SEQ ID NO: 843187 - RNA, 17 nt, Homo sapiens
uucagaguccuugcaaa

SEQ ID NO: 843188 - RNA, 18 nt, Homo sapiens
uucagaguccuugcaaaa

SEQ ID NO: 843189 - RNA, 13 nt, Homo sapiens
uucagcucuuaaa

SEQ ID NO: 843190 - RNA, 21 nt, Homo sapiens
uucagggcugggcagguccug

SEQ ID NO: 843191 - RNA, 22 nt, Homo sapiens
uucaguuccucuuugcauggaa

SEQ ID NO: 843192 - RNA, 16 nt, Homo sapiens
uucauugccuuuccag

SEQ ID NO: 843193 - RNA, 22 nt, Homo sapiens
uuccccaguacugagguggugg

SEQ ID NO: 843194 - RNA, 21 nt, Homo sapiens
uuccuugauggagauauuuac

SEQ ID NO: 843195 - RNA, 20 nt, Homo sapiens
uucuaccacccaccaguuga

SEQ ID NO: 843196 - RNA, 20 nt, Homo sapiens
uucucaacuccaaacugacu

SEQ ID NO: 843197 - RNA, 14 nt, Homo sapiens
uucugccacuuccc

SEQ ID NO: 843198 - RNA, 22 nt, Homo sapiens
uucuuccacagugccuaauaau

SEQ ID NO: 843199 - RNA, 19 nt, Homo sapiens
uugaacacuagucugugua

SEQ ID NO: 843200 - RNA, 17 nt, Homo sapiens
uugacuuguauaccuug

SEQ ID NO: 843201 - RNA, 14 nt, Homo sapiens
uugauacaaaguac

SEQ ID NO: 843202 - RNA, 22 nt, Homo sapiens
uugcagguguccgggggucuag

SEQ ID NO: 843203 - RNA, 14 nt, Homo sapiens
uugcucauggaauu

SEQ ID NO: 843204 - RNA, 20 nt, Homo sapiens
uugcuucuucccaauugcuu

SEQ ID NO: 843205 - RNA, 19 nt, Homo sapiens
uuggacagaagcagcucuu

SEQ ID NO: 843206 - RNA, 18 nt, Homo sapiens
uugugcuugcugguacua

SEQ ID NO: 843207 - RNA, 11 nt, Homo sapiens
uuuaagaacga

SEQ ID NO: 843208 - RNA, 20 nt, Homo sapiens
uuuaaguggcuuucagcaaa

SEQ ID NO: 843209 - RNA, 12 nt, Homo sapiens
uuuacucugugu

SEQ ID NO: 843210 - RNA, 14 nt, Homo sapiens
uuuaugacaggaug

SEQ ID NO: 843211 - RNA, 15 nt, Homo sapiens
uuuauguucuaguga

SEQ ID NO: 843212 - RNA, 15 nt, Homo sapiens
uuucaucuccagugu

SEQ ID NO: 843213 - RNA, 13 nt, Homo sapiens
uuucucaauaagc

SEQ ID NO: 843214 - RNA, 13 nt, Homo sapiens
uuucuucucucca

SEQ ID NO: 843215 - RNA, 22 nt, Homo sapiens
uuugaugaacaaaauuuccuaa

SEQ ID NO: 843216 - RNA, 18 nt, Homo sapiens
uuuuaaaagaaugauuau

SEQ ID NO: 843217 - RNA, 19 nt, Homo sapiens
uuuucccgagcaaagucua

SEQ ID NO: 843218 - RNA, 15 nt, Homo sapiens
uuuuggaacuguccu

SEQ ID NO: 843219 - RNA, 19 nt, Homo sapiens
uuuuuccuuuucaucuguu

SEQ ID NO: 843220 - RNA, 13 nt, Homo sapiens
aaaaaagcccaac

SEQ ID NO: 843221 - RNA, 18 nt, Homo sapiens
aaaaacuaacacccaguc

SEQ ID NO: 843222 - RNA, 17 nt, Homo sapiens
aaaacuucaagacauca

SEQ ID NO: 843223 - RNA, 16 nt, Homo sapiens
aaaagaaugauuauga

SEQ ID NO: 843224 - RNA, 20 nt, Homo sapiens
aaaagaaugauuaugaauua

SEQ ID NO: 843225 - RNA, 20 nt, Homo sapiens
aaaagucaggugcaguccca

SEQ ID NO: 843226 - RNA, 12 nt, Homo sapiens
aaaauaucacuu

SEQ ID NO: 843227 - RNA, 21 nt, Homo sapiens
aaaaucuauuuuguaacuuuc

SEQ ID NO: 843228 - RNA, 18 nt, Homo sapiens
aaaauucuuucacuugau

SEQ ID NO: 843229 - RNA, 16 nt, Homo sapiens
aaacacuccacagugu

SEQ ID NO: 843230 - RNA, 16 nt, Homo sapiens
aaacauuuaacauaau

SEQ ID NO: 843231 - RNA, 14 nt, Homo sapiens
aaacccugucucua

SEQ ID NO: 843232 - RNA, 16 nt, Homo sapiens
aaacuaacacccaguc

SEQ ID NO: 843233 - RNA, 14 nt, Homo sapiens
aaacugucuuggcu

SEQ ID NO: 843234 - RNA, 15 nt, Homo sapiens
aaagaccauuuuucc

SEQ ID NO: 843235 - RNA, 22 nt, Homo sapiens
aaagauuguuuuauauguagua

SEQ ID NO: 843236 - RNA, 13 nt, Homo sapiens
aaaguacagaaaa

SEQ ID NO: 843237 - RNA, 19 nt, Homo sapiens
aaagucaggugcaguccca

SEQ ID NO: 843238 - RNA, 17 nt, Homo sapiens
aaauaaagucucuuccu

SEQ ID NO: 843239 - RNA, 20 nt, Homo sapiens
aaauaauuuuucacuucaaa

SEQ ID NO: 843240 - RNA, 15 nt, Homo sapiens
aaauuacacaauaaa

SEQ ID NO: 843241 - RNA, 13 nt, Homo sapiens
aaauucauauaaa

SEQ ID NO: 843242 - RNA, 23 nt, Homo sapiens
aacacuagucuguguaacuuuaa

SEQ ID NO: 843243 - RNA, 16 nt, Homo sapiens
aacaguguucugagcc

SEQ ID NO: 843244 - RNA, 16 nt, Homo sapiens
aaccagaccauugucu

SEQ ID NO: 843245 - RNA, 14 nt, Homo sapiens
aaccagauugucag

SEQ ID NO: 843246 - RNA, 18 nt, Homo sapiens
aaccagauugucagcucc

SEQ ID NO: 843247 - RNA, 17 nt, Homo sapiens
aaccaggggccaugaau

SEQ ID NO: 843248 - RNA, 16 nt, Homo sapiens
aaccccuccccuccau

SEQ ID NO: 843249 - RNA, 17 nt, Homo sapiens
aaccccuccccuccauc

SEQ ID NO: 843250 - RNA, 15 nt, Homo sapiens
aaccuccuuccaggg

SEQ ID NO: 843251 - RNA, 19 nt, Homo sapiens
aacucuguuuucuuucuaa

SEQ ID NO: 843252 - RNA, 19 nt, Homo sapiens
aacuuccagauccuggaaa

SEQ ID NO: 843253 - RNA, 11 nt, Homo sapiens
aagagcacagc

SEQ ID NO: 843254 - RNA, 11 nt, Homo sapiens
aagagccacag

SEQ ID NO: 843255 - RNA, 16 nt, Homo sapiens
aagauauuuuucauga

SEQ ID NO: 843256 - RNA, 23 nt, Homo sapiens
aagccucugugucacuggcugcc

SEQ ID NO: 843257 - RNA, 20 nt, Homo sapiens
aagcugugccacccugggcu

SEQ ID NO: 843258 - RNA, 21 nt, Homo sapiens
aaggacuuuauagaucagcca

SEQ ID NO: 843259 - RNA, 23 nt, Homo sapiens
aaggauggagccagcucugcauu

SEQ ID NO: 843260 - RNA, 17 nt, Homo sapiens
aaggccucccacaguga

SEQ ID NO: 843261 - RNA, 18 nt, Homo sapiens
aaggccucccacagugac

SEQ ID NO: 843262 - RNA, 17 nt, Homo sapiens
aagggaggcccauguga

SEQ ID NO: 843263 - RNA, 11 nt, Homo sapiens
aaggguccuac

SEQ ID NO: 843264 - RNA, 22 nt, Homo sapiens
aagguuguguugccugcugagc

SEQ ID NO: 843265 - RNA, 16 nt, Homo sapiens
aagucagcucuucucc

SEQ ID NO: 843266 - RNA, 23 nt, Homo sapiens
aagucuaaaguuuacaguaaaua

SEQ ID NO: 843267 - RNA, 16 nt, Homo sapiens
aagucuaauucacagg

SEQ ID NO: 843268 - RNA, 22 nt, Homo sapiens
aagugauaucccccagccucaa

SEQ ID NO: 843269 - RNA, 16 nt, Homo sapiens
aagugcuuucuucucc

SEQ ID NO: 843270 - RNA, 18 nt, Homo sapiens
aauaaucauucuuauuuc

SEQ ID NO: 843271 - RNA, 17 nt, Homo sapiens
aauaauuuuucacuuca

SEQ ID NO: 843272 - RNA, 18 nt, Homo sapiens
aauaauuuuucacuucaa

SEQ ID NO: 843273 - RNA, 15 nt, Homo sapiens
aaugauaacuggaaa

SEQ ID NO: 843274 - RNA, 14 nt, Homo sapiens
aaugauagaacuuu

SEQ ID NO: 843275 - RNA, 12 nt, Homo sapiens
aaugguguuaca

SEQ ID NO: 843276 - RNA, 20 nt, Homo sapiens
aauguaacucuauaguuauu

SEQ ID NO: 843277 - RNA, 15 nt, Homo sapiens
aauguauaugucauu

SEQ ID NO: 843278 - RNA, 17 nt, Homo sapiens
aauguauaugucauuua

SEQ ID NO: 843279 - RNA, 16 nt, Homo sapiens
aauucauccucacuca

SEQ ID NO: 843280 - RNA, 15 nt, Homo sapiens
aauugaggacacuga

SEQ ID NO: 843281 - RNA, 19 nt, Homo sapiens
aauugucuaaaaugucagu

SEQ ID NO: 843282 - RNA, 14 nt, Homo sapiens
acaaugcagugccu

SEQ ID NO: 843283 - RNA, 20 nt, Homo sapiens
acaccaguugaacugcagga

SEQ ID NO: 843284 - RNA, 23 nt, Homo sapiens
gcccugcauaauguuaagcuuua

SEQ ID NO: 843285 - RNA, 19 nt, Homo sapiens
gccuccacucccacuuccc

SEQ ID NO: 843286 - RNA, 17 nt, Homo sapiens
gccugacucugugcuga

SEQ ID NO: 843287 - RNA, 14 nt, Homo sapiens
gccuguaaucccag

SEQ ID NO: 843288 - RNA, 19 nt, Homo sapiens
gccuucauuugcaauucau

SEQ ID NO: 843289 - RNA, 13 nt, Homo sapiens
gccuuuccagggu

SEQ ID NO: 843290 - RNA, 18 nt, Homo sapiens
gccuuuuauaaaccucua

SEQ ID NO: 843291 - RNA, 23 nt, Homo sapiens
gcucgggcccaggccaucuucca

SEQ ID NO: 843292 - RNA, 15 nt, Homo sapiens
gcucuaaaugucaau

SEQ ID NO: 843293 - RNA, 20 nt, Homo sapiens
gcucucaguuacaagugcag

SEQ ID NO: 843294 - RNA, 20 nt, Homo sapiens
gcucuuaaaaagacacuuau

SEQ ID NO: 843295 - RNA, 19 nt, Homo sapiens
gcugagugcaccacuucaa

SEQ ID NO: 843296 - RNA, 15 nt, Homo sapiens
gcuugaucugugauu

SEQ ID NO: 843297 - RNA, 14 nt, Homo sapiens
gcuuuauugugauu

SEQ ID NO: 843298 - RNA, 16 nt, Homo sapiens
gcuuucagagccuccu

SEQ ID NO: 843299 - RNA, 17 nt, Homo sapiens
ggaauaaacuccauuua

SEQ ID NO: 843300 - RNA, 16 nt, Homo sapiens
ggacagaagcagcucu

SEQ ID NO: 843301 - RNA, 14 nt, Homo sapiens
ggaccaucagugac

SEQ ID NO: 843302 - RNA, 18 nt, Homo sapiens
ggaccuggcacaccuuag

SEQ ID NO: 843303 - RNA, 19 nt, Homo sapiens
ggacgaccuccagcucuca

SEQ ID NO: 843304 - RNA, 18 nt, Homo sapiens
ggagagcaucugcucuga

SEQ ID NO: 843305 - RNA, 19 nt, Homo sapiens
ggagggaccaggugucuag

SEQ ID NO: 843306 - RNA, 15 nt, Homo sapiens
ggaguuaacuacccu

SEQ ID NO: 843307 - RNA, 19 nt, Homo sapiens
ggaucuggggaaggaccaa

SEQ ID NO: 843308 - RNA, 23 nt, Homo sapiens
ggauguuugcucagcuucuccaa

SEQ ID NO: 843309 - RNA, 18 nt, Homo sapiens
ggcaagagccacaguaua

SEQ ID NO: 843310 - RNA, 13 nt, Homo sapiens
ggccaagucacag

SEQ ID NO: 843311 - RNA, 20 nt, Homo sapiens
ggccacagucaugguggcca

SEQ ID NO: 843312 - RNA, 23 nt, Homo sapiens
ggccacagucaugguggccacgg

SEQ ID NO: 843313 - RNA, 21 nt, Homo sapiens
ggccacccugccucuacccaa

SEQ ID NO: 843314 - RNA, 15 nt, Homo sapiens
ggccagucaugugcu

SEQ ID NO: 843315 - RNA, 19 nt, Homo sapiens
ggccugauggagaggagaa

SEQ ID NO: 843316 - RNA, 17 nt, Homo sapiens
ggccuggcacagugucu

SEQ ID NO: 843317 - RNA, 13 nt, Homo sapiens
ggcugaugcaguu

SEQ ID NO: 843318 - RNA, 23 nt, Homo sapiens
ggcugccuccacucccacuuccc

SEQ ID NO: 843319 - RNA, 16 nt, Homo sapiens
ggcuggagguggcgcc

SEQ ID NO: 843320 - RNA, 18 nt, Homo sapiens
ggcuguacugccaaggua

SEQ ID NO: 843321 - RNA, 13 nt, Homo sapiens
gggacaacaaaga

SEQ ID NO: 843322 - RNA, 15 nt, Homo sapiens
gggaccuauaucuca

SEQ ID NO: 843323 - RNA, 22 nt, Homo sapiens
gggcaggauggcaaccagacca

SEQ ID NO: 843324 - RNA, 21 nt, Homo sapiens
gggcaugggggaggcucugaa

SEQ ID NO: 843325 - RNA, 14 nt, Homo sapiens
gggccauacuggcc

SEQ ID NO: 843326 - RNA, 16 nt, Homo sapiens
gggcccacccauguca

SEQ ID NO: 843327 - RNA, 20 nt, Homo sapiens
gggcgaggcgggggagccug

SEQ ID NO: 843328 - RNA, 15 nt, Homo sapiens
ggggagguucaguga

SEQ ID NO: 843329 - RNA, 16 nt, Homo sapiens
ggggcugaugcaguug

SEQ ID NO: 843330 - RNA, 16 nt, Homo sapiens
gggggaagagcacagc

SEQ ID NO: 843331 - RNA, 21 nt, Homo sapiens
gggguauuuuaggcagggauu

SEQ ID NO: 843332 - RNA, 17 nt, Homo sapiens
ggguagacacacaugaa

SEQ ID NO: 843333 - RNA, 12 nt, Homo sapiens
gggucaaaguac

SEQ ID NO: 843334 - RNA, 22 nt, Homo sapiens
gggucucggugguaccaggucu

SEQ ID NO: 843335 - RNA, 11 nt, Homo sapiens
ggucacaguga

SEQ ID NO: 843336 - RNA, 16 nt, Homo sapiens
ggugaaagauggaacu

SEQ ID NO: 843337 - RNA, 20 nt, Homo sapiens
ggugcuaucgcaccacugug

SEQ ID NO: 843338 - RNA, 17 nt, Homo sapiens
gguggcuuaccaagauc

SEQ ID NO: 843339 - RNA, 22 nt, Homo sapiens
gguguuuauccuaucucuccaa

SEQ ID NO: 843340 - RNA, 13 nt, Homo sapiens
guaaaacauucac

SEQ ID NO: 843341 - RNA, 14 nt, Homo sapiens
guaaauaaagcuca

SEQ ID NO: 843342 - RNA, 16 nt, Homo sapiens
guaaauguuaagccau

SEQ ID NO: 843343 - RNA, 19 nt, Homo sapiens
guacagaaaaauacuuuga

SEQ ID NO: 843344 - RNA, 21 nt, Homo sapiens
guacagaauagaauacauuga

SEQ ID NO: 843345 - RNA, 11 nt, Homo sapiens
guauccaaaaa

SEQ ID NO: 843346 - RNA, 18 nt, Homo sapiens
guaucucggaccuuucag

SEQ ID NO: 843347 - RNA, 11 nt, Homo sapiens
gucaaacuguc

SEQ ID NO: 843348 - RNA, 15 nt, Homo sapiens
gucaacuccuuucuc

SEQ ID NO: 843349 - RNA, 23 nt, Homo sapiens
gucaauaccccuguuaagcaauu

SEQ ID NO: 843350 - RNA, 13 nt, Homo sapiens
gucaccucaugga

SEQ ID NO: 843351 - RNA, 19 nt, Homo sapiens
gucaucugggccaccagcu

SEQ ID NO: 843352 - RNA, 19 nt, Homo sapiens
guccuaagccuguuagcau

SEQ ID NO: 843353 - RNA, 16 nt, Homo sapiens
gucucccugagccugc

SEQ ID NO: 843354 - RNA, 14 nt, Homo sapiens
gucucuacuaaaaa

SEQ ID NO: 843355 - RNA, 13 nt, Homo sapiens
gugaccaaccuuu

SEQ ID NO: 843356 - RNA, 16 nt, Homo sapiens
gugcaaggaccaaagg

SEQ ID NO: 843357 - RNA, 20 nt, Homo sapiens
gugcuaucgcaccacugugu

SEQ ID NO: 843358 - RNA, 16 nt, Homo sapiens
guggauguaaagugau

SEQ ID NO: 843359 - RNA, 13 nt, Homo sapiens
guggcucuugccu

SEQ ID NO: 843360 - RNA, 20 nt, Homo sapiens
guggcuuaccaagaucacau

SEQ ID NO: 843361 - RNA, 13 nt, Homo sapiens
gugguagcucuga

SEQ ID NO: 843362 - RNA, 14 nt, Homo sapiens
guucaguaccacau

SEQ ID NO: 843363 - RNA, 17 nt, Homo sapiens
guucccagacagcuuuu

SEQ ID NO: 843364 - RNA, 17 nt, Homo sapiens
guuccucuuugcaugga

SEQ ID NO: 843365 - RNA, 18 nt, Homo sapiens
guucuguggucacaguga

SEQ ID NO: 843366 - RNA, 13 nt, Homo sapiens
guucuucuaccac

SEQ ID NO: 843367 - RNA, 12 nt, Homo sapiens
guugacauucag

SEQ ID NO: 843368 - RNA, 16 nt, Homo sapiens
guugaggaugcacugg

SEQ ID NO: 843369 - RNA, 17 nt, Homo sapiens
guuguucuguggucaca

SEQ ID NO: 843370 - RNA, 21 nt, Homo sapiens
guuuaccgaaaaucauauaau

SEQ ID NO: 843371 - RNA, 23 nt, Homo sapiens
guuucagaguuuguauugugauu

SEQ ID NO: 843372 - RNA, 16 nt, Homo sapiens
guuucuuccacagugc

SEQ ID NO: 843373 - RNA, 16 nt, Homo sapiens
guuucuugcacugaau

SEQ ID NO: 843374 - RNA, 16 nt, Homo sapiens
uaaaaacaaagaaaua

SEQ ID NO: 843375 - RNA, 20 nt, Homo sapiens
uaaaagaugaaggcuguauc

SEQ ID NO: 843376 - RNA, 13 nt, Homo sapiens
uaaauuauaucaa

SEQ ID NO: 843377 - RNA, 20 nt, Homo sapiens
uaacaaccaaagacuacaua

SEQ ID NO: 843378 - RNA, 22 nt, Homo sapiens
uaacaaccaaagacuacauauu

SEQ ID NO: 843379 - RNA, 15 nt, Homo sapiens
uaacaaugcuguauu

SEQ ID NO: 843380 - RNA, 19 nt, Homo sapiens
uaacaugaagcaaacuaac

SEQ ID NO: 843381 - RNA, 16 nt, Homo sapiens
uaacucaccagccucu

SEQ ID NO: 843382 - RNA, 19 nt, Homo sapiens
uaacuugcugcaguaugaa

SEQ ID NO: 843383 - RNA, 18 nt, Homo sapiens
uaagaagacugcauuaua

SEQ ID NO: 843384 - RNA, 14 nt, Homo sapiens
uaagaggcuauuua

SEQ ID NO: 843385 - RNA, 15 nt, Homo sapiens
uaagaggcuauuuaa

SEQ ID NO: 843386 - RNA, 15 nt, Homo sapiens
uaaucccagcacuuu

SEQ ID NO: 843387 - RNA, 13 nt, Homo sapiens
uaaucgugucuuc

SEQ ID NO: 843388 - RNA, 22 nt, Homo sapiens
uaaugagauaaugugauauuau

SEQ ID NO: 843389 - RNA, 17 nt, Homo sapiens
uaaugagggcugaguuu

SEQ ID NO: 843390 - RNA, 14 nt, Homo sapiens
uaauuuguaucuga

SEQ ID NO: 843391 - RNA, 22 nt, Homo sapiens
uacacugccuucucaacuccaa

SEQ ID NO: 843392 - RNA, 18 nt, Homo sapiens
uacaucccuuaccuggga

SEQ ID NO: 843393 - RNA, 20 nt, Homo sapiens
uacaucccuuaccugggaaa

SEQ ID NO: 843394 - RNA, 18 nt, Homo sapiens
uacaugcauacacucuca

SEQ ID NO: 843395 - RNA, 23 nt, Homo sapiens
uaccaagaucacauaccagaguc

SEQ ID NO: 843396 - RNA, 17 nt, Homo sapiens
uacccucaucaaaaaca

SEQ ID NO: 843397 - RNA, 19 nt, Homo sapiens
uaccuuguaauuugaaaua

SEQ ID NO: 843398 - RNA, 15 nt, Homo sapiens
uacuaaaaauacaaa

SEQ ID NO: 843399 - RNA, 16 nt, Homo sapiens
uagaacugcccauuuc

SEQ ID NO: 843400 - RNA, 21 nt, Homo sapiens
uagaacugcccauuuccaugg

SEQ ID NO: 843401 - RNA, 19 nt, Homo sapiens
uagaccagaaagugugugu

SEQ ID NO: 843402 - RNA, 14 nt, Homo sapiens
uagaggcuuucaaa

SEQ ID NO: 843403 - RNA, 23 nt, Homo sapiens
uagcuacauagcagacuuuccca

SEQ ID NO: 843404 - RNA, 11 nt, Homo sapiens
uagcugcuaua

SEQ ID NO: 843405 - RNA, 21 nt, Homo sapiens
uagcuggcuguacugccaagg

SEQ ID NO: 843406 - RNA, 17 nt, Homo sapiens
uaggacauauaccuucu

SEQ ID NO: 843407 - RNA, 19 nt, Homo sapiens
uaggaguuaacuacccuac

SEQ ID NO: 843408 - RNA, 22 nt, Homo sapiens
uaguaauuguaaguaccccuga

SEQ ID NO: 843409 - RNA, 20 nt, Homo sapiens
uaguaauugucaauaccccu

SEQ ID NO: 843410 - RNA, 17 nt, Homo sapiens
uagugauuuccuguaua

SEQ ID NO: 843411 - RNA, 22 nt, Homo sapiens
uaguggcuguccagugcccauu

SEQ ID NO: 843412 - RNA, 17 nt, Homo sapiens
uauaagcccugcauaau

SEQ ID NO: 843413 - RNA, 16 nt, Homo sapiens
uauagaucagccagug

SEQ ID NO: 843414 - RNA, 13 nt, Homo sapiens
uauauaacuaaca

SEQ ID NO: 843415 - RNA, 20 nt, Homo sapiens
uauaucaauuuccucauauc

SEQ ID NO: 843416 - RNA, 16 nt, Homo sapiens
uaucucuccaaccaga

SEQ ID NO: 843417 - RNA, 21 nt, Homo sapiens
uaugcauuuucuucacagugc

SEQ ID NO: 843418 - RNA, 16 nt, Homo sapiens
uauuuuaaaacauaag

SEQ ID NO: 843419 - RNA, 17 nt, Homo sapiens
uauuuuaaaacauaaga

SEQ ID NO: 843420 - RNA, 18 nt, Homo sapiens
uauuuuuuuaagcuguaa

SEQ ID NO: 843421 - RNA, 13 nt, Homo sapiens
ucaaauccuugaa

SEQ ID NO: 843422 - RNA, 17 nt, Homo sapiens
ucaacuccuuucucauc

SEQ ID NO: 843423 - RNA, 19 nt, Homo sapiens
ucaaggccucccacaguga

SEQ ID NO: 843424 - RNA, 22 nt, Homo sapiens
ucaccaauaaguauucuguguu

SEQ ID NO: 843425 - RNA, 21 nt, Homo sapiens
ucaccaggggcaggcacagca

SEQ ID NO: 843426 - RNA, 18 nt, Homo sapiens
ucacccaaccacauccca

SEQ ID NO: 843427 - RNA, 15 nt, Homo sapiens
ucacccccacucugc

SEQ ID NO: 843428 - RNA, 18 nt, Homo sapiens
ucaccggucagugccuuu

SEQ ID NO: 843429 - RNA, 18 nt, Homo sapiens
ucacuagcugucucagga

SEQ ID NO: 843430 - RNA, 16 nt, Homo sapiens
ucagaguccuugcaaa

SEQ ID NO: 843431 - RNA, 15 nt, Homo sapiens
ucagaucguucauug

SEQ ID NO: 843432 - RNA, 23 nt, Homo sapiens
ucagaucguucauugccuuucca

SEQ ID NO: 843433 - RNA, 15 nt, Homo sapiens
ucagcaaaccucagu

SEQ ID NO: 843434 - RNA, 17 nt, Homo sapiens
ucagcugugaacaugga

SEQ ID NO: 843435 - RNA, 20 nt, Homo sapiens
ucagcuuuaguagauauuac

SEQ ID NO: 843436 - RNA, 20 nt, Homo sapiens
ucaggugcagucccaguccu

SEQ ID NO: 843437 - RNA, 14 nt, Homo sapiens
ucagugaauugugu

SEQ ID NO: 843438 - RNA, 15 nt, Homo sapiens
ucaguguuugggaaa

SEQ ID NO: 843439 - RNA, 18 nt, Homo sapiens
ucaguucauccauucuau

SEQ ID NO: 843440 - RNA, 17 nt, Homo sapiens
ucaguuccucuuugcau

SEQ ID NO: 843441 - RNA, 16 nt, Homo sapiens
ucauauuuucuuucaa

SEQ ID NO: 843442 - RNA, 16 nt, Homo sapiens
ucaucaaaaacacucu

SEQ ID NO: 843443 - RNA, 13 nt, Homo sapiens
ucaugaagauauu

SEQ ID NO: 843444 - RNA, 22 nt, Homo sapiens
ucaugacuuuuccauguaucua

SEQ ID NO: 843445 - RNA, 17 nt, Homo sapiens
ucauggaauuggagcuc

SEQ ID NO: 843446 - RNA, 23 nt, Homo sapiens
ucauuagagcuuaaauugucaga

SEQ ID NO: 843447 - RNA, 23 nt, Homo sapiens
ucauucaagucagcucuucucca

SEQ ID NO: 843448 - RNA, 23 nt, Homo sapiens
ucauuuugggaccuauaucucag

SEQ ID NO: 843449 - RNA, 20 nt, Homo sapiens
uccaaaaauagcccugcaaa

SEQ ID NO: 843450 - RNA, 21 nt, Homo sapiens
uccaaaaauagcccugcaaaa

SEQ ID NO: 843451 - RNA, 22 nt, Homo sapiens
uccagagcugcagagagcaccu

SEQ ID NO: 843452 - RNA, 17 nt, Homo sapiens
uccagcucucaguuaca

SEQ ID NO: 843453 - RNA, 12 nt, Homo sapiens
uccauguaucua

SEQ ID NO: 843454 - RNA, 23 nt, Homo sapiens
uccauuucuuuuacucuguguaa

SEQ ID NO: 843455 - RNA, 12 nt, Homo sapiens
ucccuggaugac

SEQ ID NO: 843456 - RNA, 14 nt, Homo sapiens
ucccuggaugacau

SEQ ID NO: 843457 - RNA, 19 nt, Homo sapiens
uccguucccaccucugagg

SEQ ID NO: 843458 - RNA, 15 nt, Homo sapiens
uccucuuugcaugga

SEQ ID NO: 843459 - RNA, 16 nt, Homo sapiens
uccugcuccacagugu

SEQ ID NO: 843460 - RNA, 13 nt, Homo sapiens
uccuucuugcccu

SEQ ID NO: 843461 - RNA, 21 nt, Homo sapiens
uccuuuucaucuguuguucug

SEQ ID NO: 843462 - RNA, 16 nt, Homo sapiens
uccuuuuugcaguaua

SEQ ID NO: 843463 - RNA, 15 nt, Homo sapiens
ucuauuaaauguaua

SEQ ID NO: 843464 - RNA, 15 nt, Homo sapiens
ucucauaucagggau

SEQ ID NO: 843465 - RNA, 21 nt, Homo sapiens
ucuccaaccagauugucagcu

SEQ ID NO: 843466 - RNA, 14 nt, Homo sapiens
ucugacacauuaau

SEQ ID NO: 843467 - RNA, 15 nt, Homo sapiens
ucuggagcugagcua

SEQ ID NO: 843468 - RNA, 23 nt, Homo sapiens
ucuguauuuccccaacauguaau

SEQ ID NO: 843469 - RNA, 14 nt, Homo sapiens
ucuuccacagugcc

SEQ ID NO: 843470 - RNA, 17 nt, Homo sapiens
ucuugcacugaauauau

SEQ ID NO: 843471 - RNA, 19 nt, Homo sapiens
ucuuggguguuuauccuau

SEQ ID NO: 843472 - RNA, 19 nt, Homo sapiens
ucuuuaacuuaauugcuau

SEQ ID NO: 843473 - RNA, 12 nt, Homo sapiens
ucuuugcaugga

SEQ ID NO: 843474 - RNA, 15 nt, Homo sapiens
ucuuuggacagaagc

SEQ ID NO: 843475 - RNA, 16 nt, Homo sapiens
ugaaaacccuugccau

SEQ ID NO: 843476 - RNA, 17 nt, Homo sapiens
ugaacaaagcaccucaa

SEQ ID NO: 843477 - RNA, 17 nt, Homo sapiens
ugaaguacuaagcgcua

SEQ ID NO: 843478 - RNA, 19 nt, Homo sapiens
ugaccaaccuuuucccaac

SEQ ID NO: 843479 - RNA, 16 nt, Homo sapiens
ugagagacacacugaa

SEQ ID NO: 843480 - RNA, 13 nt, Homo sapiens
ugauaagcaaauu

SEQ ID NO: 843481 - RNA, 18 nt, Homo sapiens
ugauaucccccagccuca

SEQ ID NO: 843482 - RNA, 17 nt, Homo sapiens
ugauaugggucuugaua

SEQ ID NO: 843483 - RNA, 13 nt, Homo sapiens
ugauuaugaauua

SEQ ID NO: 843484 - RNA, 23 nt, Homo sapiens
ugauuguuauuggguaucaccac

SEQ ID NO: 843485 - RNA, 15 nt, Homo sapiens
ugauuuugaaaucau

SEQ ID NO: 843486 - RNA, 18 nt, Homo sapiens
ugauuuugaaaucaugaa

SEQ ID NO: 843487 - RNA, 14 nt, Homo sapiens
ugcacuguccugcu

SEQ ID NO: 843488 - RNA, 16 nt, Homo sapiens
ugcagagagcaccugg

SEQ ID NO: 843489 - RNA, 14 nt, Homo sapiens
ugcauggaauuugu

SEQ ID NO: 843490 - RNA, 23 nt, Homo sapiens
ugcauuuucuucacagugcagcu

SEQ ID NO: 843491 - RNA, 13 nt, Homo sapiens
ugcccugggccag

SEQ ID NO: 843492 - RNA, 21 nt, Homo sapiens
ugccuccacucccacuucccu

SEQ ID NO: 843493 - RNA, 14 nt, Homo sapiens
ugccugacucugug

SEQ ID NO: 843494 - RNA, 14 nt, Homo sapiens
ugccugcugagcug

SEQ ID NO: 843495 - RNA, 14 nt, Homo sapiens
ugcgguaggugcug

SEQ ID NO: 843496 - RNA, 19 nt, Homo sapiens
ugcuagcagggcauggcac

SEQ ID NO: 843497 - RNA, 23 nt, Homo sapiens
ugcuaguaauuggaaaggcagcu

SEQ ID NO: 843498 - RNA, 14 nt, Homo sapiens
ugcuuuguauccau

SEQ ID NO: 843499 - RNA, 15 nt, Homo sapiens
uggaacuguccuucc

SEQ ID NO: 843500 - RNA, 14 nt, Homo sapiens
uggaauuggagcuc

SEQ ID NO: 843501 - RNA, 17 nt, Homo sapiens
uggacagaagcagcucu

SEQ ID NO: 843502 - RNA, 14 nt, Homo sapiens
uggacugggugcca

SEQ ID NO: 843503 - RNA, 17 nt, Homo sapiens
uggacugggugccacgg

SEQ ID NO: 843504 - RNA, 13 nt, Homo sapiens
uggagaucaccag

SEQ ID NO: 843505 - RNA, 13 nt, Homo sapiens
uggagcugagcua

SEQ ID NO: 843506 - RNA, 12 nt, Homo sapiens
uggccacggcca

SEQ ID NO: 843507 - RNA, 18 nt, Homo sapiens
uggccacggccacagcca

SEQ ID NO: 843508 - RNA, 24 nt, Homo sapiens
uggcccccucccuggaugacauua

SEQ ID NO: 843509 - RNA, 17 nt, Homo sapiens
uggccugacucccaugc

SEQ ID NO: 843510 - RNA, 16 nt, Homo sapiens
uggcucuugccuguaa

SEQ ID NO: 843511 - RNA, 19 nt, Homo sapiens
uggcuucugugccugacuc

SEQ ID NO: 843512 - RNA, 21 nt, Homo sapiens
ugggacauuugcucauggaau

SEQ ID NO: 843513 - RNA, 15 nt, Homo sapiens
ugggagaaggugcuu

SEQ ID NO: 843514 - RNA, 16 nt, Homo sapiens
uggggcugaugcaguu

SEQ ID NO: 843515 - RNA, 15 nt, Homo sapiens
ugggucuucccugua

SEQ ID NO: 843516 - RNA, 16 nt, Homo sapiens
ugguaauuuguaucug

SEQ ID NO: 843517 - RNA, 23 nt, Homo sapiens
ugguaccaccagucugacuguuu

SEQ ID NO: 843518 - RNA, 15 nt, Homo sapiens
uggucuggaauggac

SEQ ID NO: 843519 - RNA, 17 nt, Homo sapiens
uggugacaugugccugu

SEQ ID NO: 843520 - RNA, 11 nt, Homo sapiens
aaaacaguauu

SEQ ID NO: 843521 - RNA, 12 nt, Homo sapiens
acucccacuucc

SEQ ID NO: 843522 - RNA, 17 nt, Homo sapiens
acugaauauauaaacac

SEQ ID NO: 843523 - RNA, 14 nt, Homo sapiens
acugauauccuccu

SEQ ID NO: 843524 - RNA, 19 nt, Homo sapiens
acugccuucucaacuccaa

SEQ ID NO: 843525 - RNA, 19 nt, Homo sapiens
acugcucacacugcugaug

SEQ ID NO: 843526 - RNA, 16 nt, Homo sapiens
acugcuuuguauccau

SEQ ID NO: 843527 - RNA, 19 nt, Homo sapiens
acuggcugccuccacuccc

SEQ ID NO: 843528 - RNA, 13 nt, Homo sapiens
acuguaaagccag

SEQ ID NO: 843529 - RNA, 14 nt, Homo sapiens
acuguguguugaca

SEQ ID NO: 843530 - RNA, 18 nt, Homo sapiens
acuguuucuugcacugaa

SEQ ID NO: 843531 - RNA, 19 nt, Homo sapiens
acuuaaggauggagccagc

SEQ ID NO: 843532 - RNA, 18 nt, Homo sapiens
acuucaagacaucaccau

SEQ ID NO: 843533 - RNA, 13 nt, Homo sapiens
acuucaagugacc

SEQ ID NO: 843534 - RNA, 17 nt, Homo sapiens
acuugcugcaguaugaa

SEQ ID NO: 843535 - RNA, 14 nt, Homo sapiens
acuugguucaguac

SEQ ID NO: 843536 - RNA, 16 nt, Homo sapiens
agaaaauuaguaauug

SEQ ID NO: 843537 - RNA, 18 nt, Homo sapiens
agaaaauuaguaauugua

SEQ ID NO: 843538 - RNA, 23 nt, Homo sapiens
agaaacagcuucucaauuucuac

SEQ ID NO: 843539 - RNA, 18 nt, Homo sapiens
agaagaugguaccaccag

SEQ ID NO: 843540 - RNA, 14 nt, Homo sapiens
agaagcaccaauca

SEQ ID NO: 843541 - RNA, 21 nt, Homo sapiens
agaaguguaacucaccagccu

SEQ ID NO: 843542 - RNA, 19 nt, Homo sapiens
agaauugacugcaguugaa

SEQ ID NO: 843543 - RNA, 16 nt, Homo sapiens
agacaguauauaacua

SEQ ID NO: 843544 - RNA, 24 nt, Homo sapiens
agaccagccugaccaacaugguga

SEQ ID NO: 843545 - RNA, 21 nt, Homo sapiens
agacucgucucaaaaaaaaga

SEQ ID NO: 843546 - RNA, 21 nt, Homo sapiens
agacuuggcuccaccacugau

SEQ ID NO: 843547 - RNA, 13 nt, Homo sapiens
agagaaaacuuau

SEQ ID NO: 843548 - RNA, 12 nt, Homo sapiens
agagacuggcca

SEQ ID NO: 843549 - RNA, 20 nt, Homo sapiens
agagcugcagagagcaccug

SEQ ID NO: 843550 - RNA, 19 nt, Homo sapiens
agaggaccugagucugcua

SEQ ID NO: 843551 - RNA, 22 nt, Homo sapiens
agaggagaguaccccccugaga

SEQ ID NO: 843552 - RNA, 22 nt, Homo sapiens
agaguaucugaggcacauguca

SEQ ID NO: 843553 - RNA, 19 nt, Homo sapiens
agagugagacucgucucaa

SEQ ID NO: 843554 - RNA, 17 nt, Homo sapiens
agauaggccaugggcac

SEQ ID NO: 843555 - RNA, 18 nt, Homo sapiens
agauauggaccaucagug

SEQ ID NO: 843556 - RNA, 15 nt, Homo sapiens
agauccccagcuuuc

SEQ ID NO: 843557 - RNA, 13 nt, Homo sapiens
agauccuggaaau

SEQ ID NO: 843558 - RNA, 10 nt, Homo sapiens
agaugcaguu

SEQ ID NO: 843559 - RNA, 18 nt, Homo sapiens
agauguucacccaaccac

SEQ ID NO: 843560 - RNA, 20 nt, Homo sapiens
agauguucacccaaccacau

SEQ ID NO: 843561 - RNA, 15 nt, Homo sapiens
agauugcaccacugc

SEQ ID NO: 843562 - RNA, 14 nt, Homo sapiens
agauuuaccacuug

SEQ ID NO: 843563 - RNA, 16 nt, Homo sapiens
agcaaauuaguaauug

SEQ ID NO: 843564 - RNA, 18 nt, Homo sapiens
agcagagcagcucugcua

SEQ ID NO: 843565 - RNA, 13 nt, Homo sapiens
agcagguggcuug

SEQ ID NO: 843566 - RNA, 22 nt, Homo sapiens
agcauccugauuaaaugucuga

SEQ ID NO: 843567 - RNA, 16 nt, Homo sapiens
agcaucugcucugaga

SEQ ID NO: 843568 - RNA, 16 nt, Homo sapiens
agccagcucugcauua

SEQ ID NO: 843569 - RNA, 15 nt, Homo sapiens
agcccccaccugccu

SEQ ID NO: 843570 - RNA, 18 nt, Homo sapiens
agccggggguggugacau

SEQ ID NO: 843571 - RNA, 22 nt, Homo sapiens
agccggggguggugacaugugc

SEQ ID NO: 843572 - RNA, 23 nt, Homo sapiens
agccucaagucuuauuuccucaa

SEQ ID NO: 843573 - RNA, 18 nt, Homo sapiens
agccuggagccccugugu

SEQ ID NO: 843574 - RNA, 20 nt, Homo sapiens
agccuggcuccaaacccucg

SEQ ID NO: 843575 - RNA, 18 nt, Homo sapiens
agcucaaggucaaugaca

SEQ ID NO: 843576 - RNA, 18 nt, Homo sapiens
agcucuguugcagguguc

SEQ ID NO: 843577 - RNA, 17 nt, Homo sapiens
agcugcuguggccauca

SEQ ID NO: 843578 - RNA, 16 nt, Homo sapiens
agcuuaaauugucaga

SEQ ID NO: 843579 - RNA, 18 nt, Homo sapiens
agcuucugccacuuccca

SEQ ID NO: 843580 - RNA, 17 nt, Homo sapiens
agcuuuccggggaggag

SEQ ID NO: 843581 - RNA, 15 nt, Homo sapiens
aggaagggcauccuu

SEQ ID NO: 843582 - RNA, 21 nt, Homo sapiens
aggaccaggacuugugcagac

SEQ ID NO: 843583 - RNA, 21 nt, Homo sapiens
aggagaacacuagacaugcca

SEQ ID NO: 843584 - RNA, 13 nt, Homo sapiens
aggagguggcuuc

SEQ ID NO: 843585 - RNA, 18 nt, Homo sapiens
aggaugguucccuugaug

SEQ ID NO: 843586 - RNA, 14 nt, Homo sapiens
aggcaagagcucaa

SEQ ID NO: 843587 - RNA, 20 nt, Homo sapiens
aggcagugggucccacuucc

SEQ ID NO: 843588 - RNA, 21 nt, Homo sapiens
aggccacccugccucuaccca

SEQ ID NO: 843589 - RNA, 16 nt, Homo sapiens
aggccugggagggcaa

SEQ ID NO: 843590 - RNA, 13 nt, Homo sapiens
aggcgggggagcc

SEQ ID NO: 843591 - RNA, 14 nt, Homo sapiens
aggcuucaguuacc

SEQ ID NO: 843592 - RNA, 14 nt, Homo sapiens
aggcuuucaagaag

SEQ ID NO: 843593 - RNA, 22 nt, Homo sapiens
aggcuuucaagaagugccaguu

SEQ ID NO: 843594 - RNA, 15 nt, Homo sapiens
agggaagcuuucacc

SEQ ID NO: 843595 - RNA, 13 nt, Homo sapiens
agggaccaggugu

SEQ ID NO: 843596 - RNA, 22 nt, Homo sapiens
agggcugggcagguccugggga

SEQ ID NO: 843597 - RNA, 22 nt, Homo sapiens
aggggcaggcccugcacugucc

SEQ ID NO: 843598 - RNA, 20 nt, Homo sapiens
aggguccuacggagggacca

SEQ ID NO: 843599 - RNA, 14 nt, Homo sapiens
aggguuaugauuaa

SEQ ID NO: 843600 - RNA, 13 nt, Homo sapiens
aggguugagcugg

SEQ ID NO: 843601 - RNA, 19 nt, Homo sapiens
agguccuuuccacccugag

SEQ ID NO: 843602 - RNA, 16 nt, Homo sapiens
aggugcuagggugccu

SEQ ID NO: 843603 - RNA, 17 nt, Homo sapiens
aggugcuggcucuuucc

SEQ ID NO: 843604 - RNA, 18 nt, Homo sapiens
aggugggggagccuggag

SEQ ID NO: 843605 - RNA, 13 nt, Homo sapiens
agguguccggggg

SEQ ID NO: 843606 - RNA, 19 nt, Homo sapiens
aguaauuguaaguaccccu

SEQ ID NO: 843607 - RNA, 13 nt, Homo sapiens
aguaauugucaau

SEQ ID NO: 843608 - RNA, 19 nt, Homo sapiens
aguaccccugauaagcaaa

SEQ ID NO: 843609 - RNA, 23 nt, Homo sapiens
aguauguuagugcaaauugucac

SEQ ID NO: 843610 - RNA, 20 nt, Homo sapiens
aguauugacuuguauaccuu

SEQ ID NO: 843611 - RNA, 15 nt, Homo sapiens
agucaagauuuccau

SEQ ID NO: 843612 - RNA, 15 nt, Homo sapiens
agucaccucauggaa

SEQ ID NO: 843613 - RNA, 14 nt, Homo sapiens
agucaggugcaguc

SEQ ID NO: 843614 - RNA, 17 nt, Homo sapiens
agucuuauuuccucaac

SEQ ID NO: 843615 - RNA, 22 nt, Homo sapiens
agugauaucccccagccucaag

SEQ ID NO: 843616 - RNA, 15 nt, Homo sapiens
agugcuuucuucucc

SEQ ID NO: 843617 - RNA, 17 nt, Homo sapiens
agugggucccacuuccc

SEQ ID NO: 843618 - RNA, 20 nt, Homo sapiens
aguguuggagaagaacugaa

SEQ ID NO: 843619 - RNA, 14 nt, Homo sapiens
aguuacaagugcag

SEQ ID NO: 843620 - RNA, 19 nt, Homo sapiens
aguugaacacuagucugug

SEQ ID NO: 843621 - RNA, 20 nt, Homo sapiens
aguuguuuucccgagcaaag

SEQ ID NO: 843622 - RNA, 18 nt, Homo sapiens
aguuuaggugauggccag

SEQ ID NO: 843623 - RNA, 17 nt, Homo sapiens
auaaaaguugcguuuaa

SEQ ID NO: 843624 - RNA, 14 nt, Homo sapiens
auaacaaugcugua

SEQ ID NO: 843625 - RNA, 14 nt, Homo sapiens
auaagaacgucauu

SEQ ID NO: 843626 - RNA, 15 nt, Homo sapiens
auaagcccugcauaa

SEQ ID NO: 843627 - RNA, 22 nt, Homo sapiens
auaaucauucuuauuucaugaa

SEQ ID NO: 843628 - RNA, 16 nt, Homo sapiens
auaauguuaagcuuua

SEQ ID NO: 843629 - RNA, 14 nt, Homo sapiens
auacacucucaaag

SEQ ID NO: 843630 - RNA, 14 nt, Homo sapiens
auacaugcauacac

SEQ ID NO: 843631 - RNA, 19 nt, Homo sapiens
auacaugcauacacucuca

SEQ ID NO: 843632 - RNA, 14 nt, Homo sapiens
auaccacagcuuuu

SEQ ID NO: 843633 - RNA, 12 nt, Homo sapiens
auaccuuuccag

SEQ ID NO: 843634 - RNA, 15 nt, Homo sapiens
auaccuuuccagggu

SEQ ID NO: 843635 - RNA, 23 nt, Homo sapiens
auacuguuucuugcacugaauau

SEQ ID NO: 843636 - RNA, 19 nt, Homo sapiens
auauacauacaugcauaca

SEQ ID NO: 843637 - RNA, 12 nt, Homo sapiens
auauacuaugag

SEQ ID NO: 843638 - RNA, 17 nt, Homo sapiens
auauauaacaaugcugu

SEQ ID NO: 843639 - RNA, 14 nt, Homo sapiens
aucaaaaacacucu

SEQ ID NO: 843640 - RNA, 11 nt, Homo sapiens
caguccagcuu

SEQ ID NO: 843641 - RNA, 19 nt, Homo sapiens
cagugcccuuuucaucucc

SEQ ID NO: 843642 - RNA, 21 nt, Homo sapiens
cagugccuuucuucucuccag

SEQ ID NO: 843643 - RNA, 19 nt, Homo sapiens
caguguuaggccuggcaca

SEQ ID NO: 843644 - RNA, 21 nt, Homo sapiens
caguuuaccgaaaaucauaua

SEQ ID NO: 843645 - RNA, 16 nt, Homo sapiens
cauauauauacauaca

SEQ ID NO: 843646 - RNA, 16 nt, Homo sapiens
caucaaaaacacucuc

SEQ ID NO: 843647 - RNA, 19 nt, Homo sapiens
caucccacucacaacagcu

SEQ ID NO: 843648 - RNA, 21 nt, Homo sapiens
caucccacucacaacagcugc

SEQ ID NO: 843649 - RNA, 17 nt, Homo sapiens
caucccaugagcagucc

SEQ ID NO: 843650 - RNA, 14 nt, Homo sapiens
caucuuguccccaa

SEQ ID NO: 843651 - RNA, 20 nt, Homo sapiens
caugagugucaacuccagga

SEQ ID NO: 843652 - RNA, 17 nt, Homo sapiens
caugucagcaaguccua

SEQ ID NO: 843653 - RNA, 18 nt, Homo sapiens
cauguuggcuagccucug

SEQ ID NO: 843654 - RNA, 13 nt, Homo sapiens
cauuacucugaaa

SEQ ID NO: 843655 - RNA, 15 nt, Homo sapiens
cauucuaucuauucc

SEQ ID NO: 843656 - RNA, 17 nt, Homo sapiens
cauugccuuuccagggu

SEQ ID NO: 843657 - RNA, 23 nt, Homo sapiens
cauuguguguuagcagcagugag

SEQ ID NO: 843658 - RNA, 21 nt, Homo sapiens
cauuugacaggggcucaggau

SEQ ID NO: 843659 - RNA, 17 nt, Homo sapiens
cauuuucuucacagugc

SEQ ID NO: 843660 - RNA, 14 nt, Homo sapiens
ccaaucaugaauua

SEQ ID NO: 843661 - RNA, 19 nt, Homo sapiens
ccacagcgcuggccgggac

SEQ ID NO: 843662 - RNA, 11 nt, Homo sapiens
ccacaguauau

SEQ ID NO: 843663 - RNA, 19 nt, Homo sapiens
ccaccaguugaauuucauc

SEQ ID NO: 843664 - RNA, 13 nt, Homo sapiens
ccaccugccugac

SEQ ID NO: 843665 - RNA, 16 nt, Homo sapiens
ccacgaggaggaacca

SEQ ID NO: 843666 - RNA, 21 nt, Homo sapiens
ccacgaggugguagcucugag

SEQ ID NO: 843667 - RNA, 15 nt, Homo sapiens
ccacggccacagcca

SEQ ID NO: 843668 - RNA, 15 nt, Homo sapiens
ccacggccacaguca

SEQ ID NO: 843669 - RNA, 12 nt, Homo sapiens
ccacugauaucc

SEQ ID NO: 843670 - RNA, 15 nt, Homo sapiens
ccagaaaaaaagccc

SEQ ID NO: 843671 - RNA, 18 nt, Homo sapiens
ccagaaagugacaagcuc

SEQ ID NO: 843672 - RNA, 15 nt, Homo sapiens
ccagaccauugucuc

SEQ ID NO: 843673 - RNA, 15 nt, Homo sapiens
ccagcagcagcuuuc

SEQ ID NO: 843674 - RNA, 11 nt, Homo sapiens
ccagguccuuu

SEQ ID NO: 843675 - RNA, 20 nt, Homo sapiens
ccagguggggugaggcagug

SEQ ID NO: 843676 - RNA, 18 nt, Homo sapiens
ccaggugucuagaggcaa

SEQ ID NO: 843677 - RNA, 17 nt, Homo sapiens
ccagucaugugcuggua

SEQ ID NO: 843678 - RNA, 19 nt, Homo sapiens
ccaguugaucaaugaauaa

SEQ ID NO: 843679 - RNA, 12 nt, Homo sapiens
ccauacauuugu

SEQ ID NO: 843680 - RNA, 15 nt, Homo sapiens
ccauuuccauggugc

SEQ ID NO: 843681 - RNA, 13 nt, Homo sapiens
cccaaauguauug

SEQ ID NO: 843682 - RNA, 19 nt, Homo sapiens
cccacguccugucagugcc

SEQ ID NO: 843683 - RNA, 20 nt, Homo sapiens
cccacucugcauacccucau

SEQ ID NO: 843684 - RNA, 13 nt, Homo sapiens
cccauggccacuu

SEQ ID NO: 843685 - RNA, 12 nt, Homo sapiens
ccccacagccca

SEQ ID NO: 843686 - RNA, 15 nt, Homo sapiens
ccccauccuggccca

SEQ ID NO: 843687 - RNA, 13 nt, Homo sapiens
cccccucccugga

SEQ ID NO: 843688 - RNA, 18 nt, Homo sapiens
ccccgcccaggcuggcca

SEQ ID NO: 843689 - RNA, 21 nt, Homo sapiens
ccccucccagcugacaguccu

SEQ ID NO: 843690 - RNA, 21 nt, Homo sapiens
ccccuggugggacaacaaaga

SEQ ID NO: 843691 - RNA, 16 nt, Homo sapiens
cccuauuguguggucg

SEQ ID NO: 843692 - RNA, 18 nt, Homo sapiens
cccucccuggaugacauu

SEQ ID NO: 843693 - RNA, 23 nt, Homo sapiens
cccucccuggaugacauuaaaga

SEQ ID NO: 843694 - RNA, 22 nt, Homo sapiens
cccucgaggcggaucuuuggac

SEQ ID NO: 843695 - RNA, 13 nt, Homo sapiens
cccucgugccagu

SEQ ID NO: 843696 - RNA, 18 nt, Homo sapiens
cccucuugccccaacccc

SEQ ID NO: 843697 - RNA, 22 nt, Homo sapiens
cccugagccugccccagcuggg

SEQ ID NO: 843698 - RNA, 15 nt, Homo sapiens
cccugauaagcaaau

SEQ ID NO: 843699 - RNA, 20 nt, Homo sapiens
cccuggugggacaacaaaga

SEQ ID NO: 843700 - RNA, 18 nt, Homo sapiens
cccugucucuacuaaaaa

SEQ ID NO: 843701 - RNA, 15 nt, Homo sapiens
cccuguuaagcaauu

SEQ ID NO: 843702 - RNA, 15 nt, Homo sapiens
ccgaaaaucauauaa

SEQ ID NO: 843703 - RNA, 17 nt, Homo sapiens
ccgagccuggcuccaaa

SEQ ID NO: 843704 - RNA, 18 nt, Homo sapiens
ccgagccuggcuccaaac

SEQ ID NO: 843705 - RNA, 19 nt, Homo sapiens
ccgcucaggcugaccacuu

SEQ ID NO: 843706 - RNA, 14 nt, Homo sapiens
ccucacucagucca

SEQ ID NO: 843707 - RNA, 12 nt, Homo sapiens
ccucauggaauu

SEQ ID NO: 843708 - RNA, 20 nt, Homo sapiens
ccucauggaauuggagcucg

SEQ ID NO: 843709 - RNA, 16 nt, Homo sapiens
ccucccuggaugacau

SEQ ID NO: 843710 - RNA, 20 nt, Homo sapiens
ccucccuggaugacauuaaa

SEQ ID NO: 843711 - RNA, 18 nt, Homo sapiens
ccucgaggcggaucuuug

SEQ ID NO: 843712 - RNA, 20 nt, Homo sapiens
ccucucgcuccucaaccccu

SEQ ID NO: 843713 - RNA, 21 nt, Homo sapiens
ccucuuagaugcaguucugaa

SEQ ID NO: 843714 - RNA, 17 nt, Homo sapiens
ccugaacaaagcaccuc

SEQ ID NO: 843715 - RNA, 19 nt, Homo sapiens
ccugaccaacauggugaaa

SEQ ID NO: 843716 - RNA, 15 nt, Homo sapiens
ccugcuccacagugu

SEQ ID NO: 843717 - RNA, 12 nt, Homo sapiens
ccuggaugacau

SEQ ID NO: 843718 - RNA, 18 nt, Homo sapiens
ccuggaugacauuaaaga

SEQ ID NO: 843719 - RNA, 15 nt, Homo sapiens
ccuggcccaucagug

SEQ ID NO: 843720 - RNA, 16 nt, Homo sapiens
ccuggcccaucagugu

SEQ ID NO: 843721 - RNA, 17 nt, Homo sapiens
ccuggcucccaagggag

SEQ ID NO: 843722 - RNA, 22 nt, Homo sapiens
ccugggcugggagaaggugcuu

SEQ ID NO: 843723 - RNA, 22 nt, Homo sapiens
ccuguguuggggggcaaggugg

SEQ ID NO: 843724 - RNA, 21 nt, Homo sapiens
ccuucugaacaugagugucaa

SEQ ID NO: 843725 - RNA, 20 nt, Homo sapiens
ccuuucuucucuccagugca

SEQ ID NO: 843726 - RNA, 14 nt, Homo sapiens
ccuuugcuucauuc

SEQ ID NO: 843727 - RNA, 16 nt, Homo sapiens
ccuuugcuucauucaa

SEQ ID NO: 843728 - RNA, 17 nt, Homo sapiens
cgagccuggcuccaaac

SEQ ID NO: 843729 - RNA, 15 nt, Homo sapiens
cgaggcgggggagcc

SEQ ID NO: 843730 - RNA, 20 nt, Homo sapiens
cgaggugguagcucugagcc

SEQ ID NO: 843731 - RNA, 16 nt, Homo sapiens
cgcaccacuguguauu

SEQ ID NO: 843732 - RNA, 17 nt, Homo sapiens
cgcuggcuaaagugggu

SEQ ID NO: 843733 - RNA, 17 nt, Homo sapiens
cggagccuccucucuca

SEQ ID NO: 843734 - RNA, 20 nt, Homo sapiens
cuaaacagacuauuuaacuu

SEQ ID NO: 843735 - RNA, 12 nt, Homo sapiens
cuaaucaaguca

SEQ ID NO: 843736 - RNA, 14 nt, Homo sapiens
cuaaucaagucaaa

SEQ ID NO: 843737 - RNA, 20 nt, Homo sapiens
cuaauucacaggcaaaccaa

SEQ ID NO: 843738 - RNA, 16 nt, Homo sapiens
cuagcugucucaggag

SEQ ID NO: 843739 - RNA, 19 nt, Homo sapiens
cuagcugucucaggaguag

SEQ ID NO: 843740 - RNA, 12 nt, Homo sapiens
cuaggacauaua

SEQ ID NO: 843741 - RNA, 20 nt, Homo sapiens
cuaggaguuaacuacccuac

SEQ ID NO: 843742 - RNA, 15 nt, Homo sapiens
cuaucgcaccacugu

SEQ ID NO: 843743 - RNA, 23 nt, Homo sapiens
cuaugcauuuucuucacagugca

SEQ ID NO: 843744 - RNA, 23 nt, Homo sapiens
cuauggacgaccuccagcucuca

SEQ ID NO: 843745 - RNA, 19 nt, Homo sapiens
cuauucaaguauuaggggu

SEQ ID NO: 843746 - RNA, 22 nt, Homo sapiens
cucaaacagccacgagguggua

SEQ ID NO: 843747 - RNA, 18 nt, Homo sapiens
cucaacguugcuccccau

SEQ ID NO: 843748 - RNA, 13 nt, Homo sapiens
cucaagugcaagg

SEQ ID NO: 843749 - RNA, 15 nt, Homo sapiens
cucaauaaguuuauu

SEQ ID NO: 843750 - RNA, 14 nt, Homo sapiens
cucacuagcugucu

SEQ ID NO: 843751 - RNA, 23 nt, Homo sapiens
cucacuauucaaguauuaggggu

SEQ ID NO: 843752 - RNA, 22 nt, Homo sapiens
cucagaaaacaaggaugaauua

SEQ ID NO: 843753 - RNA, 18 nt, Homo sapiens
cucaguuacaagugcagg

SEQ ID NO: 843754 - RNA, 16 nt, Homo sapiens
cuccagugugaauaua

SEQ ID NO: 843755 - RNA, 16 nt, Homo sapiens
cuccauccuaccacaa

SEQ ID NO: 843756 - RNA, 22 nt, Homo sapiens
cucccaagggaggcccauguga

SEQ ID NO: 843757 - RNA, 16 nt, Homo sapiens
cucccuggaugacauu

SEQ ID NO: 843758 - RNA, 22 nt, Homo sapiens
cugaaaucauacuucuuagggu

SEQ ID NO: 843759 - RNA, 11 nt, Homo sapiens
cugaacaaagc

SEQ ID NO: 843760 - RNA, 13 nt, Homo sapiens
cugacucccaugc

SEQ ID NO: 843761 - RNA, 14 nt, Homo sapiens
cugacucccaugca

SEQ ID NO: 843762 - RNA, 11 nt, Homo sapiens
cugacucugug

SEQ ID NO: 843763 - RNA, 21 nt, Homo sapiens
cugacuguuuccaucaagggu

SEQ ID NO: 843764 - RNA, 22 nt, Homo sapiens
cugagugcaccacuucaaguga

SEQ ID NO: 843765 - RNA, 22 nt, Homo sapiens
cugcagcaggcagaggagagua

SEQ ID NO: 843766 - RNA, 14 nt, Homo sapiens
cugccucuuaaaua

SEQ ID NO: 843767 - RNA, 20 nt, Homo sapiens
cugccuucucacuagcuguc

SEQ ID NO: 843768 - RNA, 14 nt, Homo sapiens
cugccuuguguaca

SEQ ID NO: 843769 - RNA, 16 nt, Homo sapiens
cugcucacacugcuga

SEQ ID NO: 843770 - RNA, 18 nt, Homo sapiens
cugcugagugcaccacuu

SEQ ID NO: 843771 - RNA, 18 nt, Homo sapiens
cugcuuuguauccaugag

SEQ ID NO: 843772 - RNA, 15 nt, Homo sapiens
cuggagccccugugu

SEQ ID NO: 843773 - RNA, 16 nt, Homo sapiens
cuggcuccaaacccuc

SEQ ID NO: 843774 - RNA, 15 nt, Homo sapiens
cuggggaaggaccaa

SEQ ID NO: 843775 - RNA, 12 nt, Homo sapiens
cuggugggacaa

SEQ ID NO: 843776 - RNA, 24 nt, Homo sapiens
cuguaagaaaauaucacuugucaa

SEQ ID NO: 843777 - RNA, 12 nt, Homo sapiens
cuguacugccaa

SEQ ID NO: 843778 - RNA, 16 nt, Homo sapiens
cuguaugauuccuuga

SEQ ID NO: 843779 - RNA, 19 nt, Homo sapiens
cuguccugcuccacagugu

SEQ ID NO: 843780 - RNA, 14 nt, Homo sapiens
cugugacccacuua

SEQ ID NO: 843781 - RNA, 20 nt, Homo sapiens
cugugggggaagagcacagc

SEQ ID NO: 843782 - RNA, 22 nt, Homo sapiens
cuguggguagacacacaugaag

SEQ ID NO: 843783 - RNA, 16 nt, Homo sapiens
cugugguccagaguca

SEQ ID NO: 843784 - RNA, 23 nt, Homo sapiens
cuguuguucuguggucacaguga

SEQ ID NO: 843785 - RNA, 17 nt, Homo sapiens
cuguuucuuccacagug

SEQ ID NO: 843786 - RNA, 13 nt, Homo sapiens
cuguuucuugcac

SEQ ID NO: 843787 - RNA, 18 nt, Homo sapiens
cuuagcucugaggaguac

SEQ ID NO: 843788 - RNA, 18 nt, Homo sapiens
cuuauacuaaagguugug

SEQ ID NO: 843789 - RNA, 17 nt, Homo sapiens
cuuaucuaaucaugaaa

SEQ ID NO: 843790 - RNA, 19 nt, Homo sapiens
cuuauuaauuugacuagaa

SEQ ID NO: 843791 - RNA, 22 nt, Homo sapiens
cuucagggcugggcagguccug

SEQ ID NO: 843792 - RNA, 21 nt, Homo sapiens
cuuccaggggagguucaguga

SEQ ID NO: 843793 - RNA, 11 nt, Homo sapiens
cuucucaaaag

SEQ ID NO: 843794 - RNA, 20 nt, Homo sapiens
cuuggagacaaaaucuuaaa

SEQ ID NO: 843795 - RNA, 22 nt, Homo sapiens
cuuuauagaucagccagugacc

SEQ ID NO: 843796 - RNA, 19 nt, Homo sapiens
cuuucaagaagugccaguu

SEQ ID NO: 843797 - RNA, 22 nt, Homo sapiens
cuuuccagggucaaaguacaga

SEQ ID NO: 843798 - RNA, 19 nt, Homo sapiens
cuuugcuucauucaaguca

SEQ ID NO: 843799 - RNA, 21 nt, Homo sapiens
cuuuggacagaagcagcucuu

SEQ ID NO: 843800 - RNA, 14 nt, Homo sapiens
cuuuguauccauga

SEQ ID NO: 843801 - RNA, 15 nt, Homo sapiens
cuuuguucuucuacc

SEQ ID NO: 843802 - RNA, 22 nt, Homo sapiens
cuuuuuaugacaggauguuugc

SEQ ID NO: 843803 - RNA, 16 nt, Homo sapiens
gaaaagggcuuucuca

SEQ ID NO: 843804 - RNA, 21 nt, Homo sapiens
gaaaagucaggugcaguccca

SEQ ID NO: 843805 - RNA, 19 nt, Homo sapiens
gaaacaacuuguguucuau

SEQ ID NO: 843806 - RNA, 22 nt, Homo sapiens
gaaacaacuuguguucuauuaa

SEQ ID NO: 843807 - RNA, 18 nt, Homo sapiens
gaaaggcaagagcucaag

SEQ ID NO: 843808 - RNA, 23 nt, Homo sapiens
gaaagguacuucaaauccuugaa

SEQ ID NO: 843809 - RNA, 12 nt, Homo sapiens
gaaagugauauc

SEQ ID NO: 843810 - RNA, 14 nt, Homo sapiens
gaacaaagcaccuc

SEQ ID NO: 843811 - RNA, 21 nt, Homo sapiens
gaacacuucagccugugcagg

SEQ ID NO: 843812 - RNA, 22 nt, Homo sapiens
gaagaacugaaaucauacuucu

SEQ ID NO: 843813 - RNA, 18 nt, Homo sapiens
gaagauuuaccacuugug

SEQ ID NO: 843814 - RNA, 22 nt, Homo sapiens
gaaggccuugcugucaugugaa

SEQ ID NO: 843815 - RNA, 17 nt, Homo sapiens
gaagugcuuucuucucc

SEQ ID NO: 843816 - RNA, 19 nt, Homo sapiens
gaagugcuuucuucuccca

SEQ ID NO: 843817 - RNA, 21 nt, Homo sapiens
gaauuaguuuuauaugcuucu

SEQ ID NO: 843818 - RNA, 18 nt, Homo sapiens
gacacacaaauuaucuua

SEQ ID NO: 843819 - RNA, 22 nt, Homo sapiens
gacaguauauaacuaacaacca

SEQ ID NO: 843820 - RNA, 22 nt, Homo sapiens
gaccagaaaguguguguguucu

SEQ ID NO: 843821 - RNA, 14 nt, Homo sapiens
gaccccgagccugg

SEQ ID NO: 843822 - RNA, 16 nt, Homo sapiens
gacuauuuaacuugag

SEQ ID NO: 843823 - RNA, 18 nt, Homo sapiens
gacucuucccccacuccu

SEQ ID NO: 843824 - RNA, 11 nt, Homo sapiens
gacugcaguug

SEQ ID NO: 843825 - RNA, 13 nt, Homo sapiens
gacugcaguugaa

SEQ ID NO: 843826 - RNA, 16 nt, Homo sapiens
gacuugaggauuuuga

SEQ ID NO: 843827 - RNA, 18 nt, Homo sapiens
gacuuuagggaucugggg

SEQ ID NO: 843828 - RNA, 22 nt, Homo sapiens
gagaaaacuuauuugagugauu

SEQ ID NO: 843829 - RNA, 14 nt, Homo sapiens
gagaacacuagaca

SEQ ID NO: 843830 - RNA, 21 nt, Homo sapiens
gagaaugagagacacacugaa

SEQ ID NO: 843831 - RNA, 15 nt, Homo sapiens
gagagcaccuggugg

SEQ ID NO: 843832 - RNA, 19 nt, Homo sapiens
auuuuuaguuuaaaaaccu

SEQ ID NO: 843833 - RNA, 13 nt, Homo sapiens
auuuuuccauuuu

SEQ ID NO: 843834 - RNA, 21 nt, Homo sapiens
caaacauaauaccaccauuua

SEQ ID NO: 843835 - RNA, 21 nt, Homo sapiens
caaaggcuuauuaauuugacu

SEQ ID NO: 843836 - RNA, 17 nt, Homo sapiens
caacaguguucugagcc

SEQ ID NO: 843837 - RNA, 19 nt, Homo sapiens
caaccuuuucccaaccaua

SEQ ID NO: 843838 - RNA, 23 nt, Homo sapiens
caaccuuuucccaaccauacaaa

SEQ ID NO: 843839 - RNA, 18 nt, Homo sapiens
caacuuguguucuauuaa

SEQ ID NO: 843840 - RNA, 12 nt, Homo sapiens
caagagccacag

SEQ ID NO: 843841 - RNA, 15 nt, Homo sapiens
caagagccacaguau

SEQ ID NO: 843842 - RNA, 12 nt, Homo sapiens
caagagcucaag

SEQ ID NO: 843843 - RNA, 16 nt, Homo sapiens
caagagcucaagguca

SEQ ID NO: 843844 - RNA, 17 nt, Homo sapiens
caaggccucccacagug

SEQ ID NO: 843845 - RNA, 15 nt, Homo sapiens
caaguagcacccugg

SEQ ID NO: 843846 - RNA, 17 nt, Homo sapiens
caagucagcucuucucc

SEQ ID NO: 843847 - RNA, 22 nt, Homo sapiens
caaugcagugccuuucuucucu

SEQ ID NO: 843848 - RNA, 14 nt, Homo sapiens
caauucauccucac

SEQ ID NO: 843849 - RNA, 14 nt, Homo sapiens
cacagcuuuuuacc

SEQ ID NO: 843850 - RNA, 16 nt, Homo sapiens
cacagguagacaguau

SEQ ID NO: 843851 - RNA, 22 nt, Homo sapiens
caccaagcugcuguggccauca

SEQ ID NO: 843852 - RNA, 19 nt, Homo sapiens
caccaguugaauuucauca

SEQ ID NO: 843853 - RNA, 19 nt, Homo sapiens
cacuaaacagacuauuuaa

SEQ ID NO: 843854 - RNA, 19 nt, Homo sapiens
cacuagucuguguaacuuu

SEQ ID NO: 843855 - RNA, 18 nt, Homo sapiens
cacuguggguagacacac

SEQ ID NO: 843856 - RNA, 17 nt, Homo sapiens
cacuucaaaacaguauu

SEQ ID NO: 843857 - RNA, 19 nt, Homo sapiens
cacuugggucuucccugua

SEQ ID NO: 843858 - RNA, 11 nt, Homo sapiens
cacuugucaau

SEQ ID NO: 843859 - RNA, 13 nt, Homo sapiens
cagagaaaaguca

SEQ ID NO: 843860 - RNA, 19 nt, Homo sapiens
cagagaaaagucaggugca

SEQ ID NO: 843861 - RNA, 18 nt, Homo sapiens
cagaggcagcuaaggggc

SEQ ID NO: 843862 - RNA, 17 nt, Homo sapiens
cagaguccuugcaaaau

SEQ ID NO: 843863 - RNA, 12 nt, Homo sapiens
cagauaaucaca

SEQ ID NO: 843864 - RNA, 21 nt, Homo sapiens
cagauguucacccaaccacau

SEQ ID NO: 843865 - RNA, 21 nt, Homo sapiens
cagcaccuccgucauucacag

SEQ ID NO: 843866 - RNA, 15 nt, Homo sapiens
cagccccaggaccaa

SEQ ID NO: 843867 - RNA, 22 nt, Homo sapiens
cagcccugaacaaagcaccuca

SEQ ID NO: 843868 - RNA, 13 nt, Homo sapiens
cagccucaagucu

SEQ ID NO: 843869 - RNA, 19 nt, Homo sapiens
cagcuaauaaugaaguuau

SEQ ID NO: 843870 - RNA, 19 nt, Homo sapiens
cagcuacucaggaggcuaa

SEQ ID NO: 843871 - RNA, 16 nt, Homo sapiens
cagcugacaguccucu

SEQ ID NO: 843872 - RNA, 21 nt, Homo sapiens
caggacuugugcagacgccac

SEQ ID NO: 843873 - RNA, 21 nt, Homo sapiens
caggcagaggagaguaccccc

SEQ ID NO: 843874 - RNA, 14 nt, Homo sapiens
caggcuagauguau

SEQ ID NO: 843875 - RNA, 19 nt, Homo sapiens
caggcuuucaagaagugcc

SEQ ID NO: 843876 - RNA, 21 nt, Homo sapiens
caguccaguccucacaugccc

SEQ ID NO: 843877 - RNA, 18 nt, Homo sapiens
cagugcccauuccucacc

SEQ ID NO: 843878 - RNA, 15 nt, Homo sapiens
cagugccuuucuucu

SEQ ID NO: 843879 - RNA, 22 nt, Homo sapiens
cagugugccccccauccuggcc

SEQ ID NO: 843880 - RNA, 16 nt, Homo sapiens
caguucaguuccucuu

SEQ ID NO: 843881 - RNA, 16 nt, Homo sapiens
caguugaucaaugaau

SEQ ID NO: 843882 - RNA, 16 nt, Homo sapiens
cauaaauguugacaug

SEQ ID NO: 843883 - RNA, 14 nt, Homo sapiens
cauaagaacgucau

SEQ ID NO: 843884 - RNA, 18 nt, Homo sapiens
cauaauguuaagcuuuau

SEQ ID NO: 843885 - RNA, 18 nt, Homo sapiens
cauauauaacaaugcugu

SEQ ID NO: 843886 - RNA, 16 nt, Homo sapiens
cauauugucacugaca

SEQ ID NO: 843887 - RNA, 16 nt, Homo sapiens
caucagauguguuccu

SEQ ID NO: 843888 - RNA, 21 nt, Homo sapiens
cauccugccacaggacccaga

SEQ ID NO: 843889 - RNA, 13 nt, Homo sapiens
caucugcucugag

SEQ ID NO: 843890 - RNA, 14 nt, Homo sapiens
caucugcucugaga

SEQ ID NO: 843891 - RNA, 22 nt, Homo sapiens
caucuuguccccaacaccccac

SEQ ID NO: 843892 - RNA, 17 nt, Homo sapiens
caugagaaaaucaguaa

SEQ ID NO: 843893 - RNA, 20 nt, Homo sapiens
caugauguuuagaaacacaa

SEQ ID NO: 843894 - RNA, 20 nt, Homo sapiens
caugcaaguagcuggcugua

SEQ ID NO: 843895 - RNA, 14 nt, Homo sapiens
caugggacauuugc

SEQ ID NO: 843896 - RNA, 18 nt, Homo sapiens
caugggggaggcucugaa

SEQ ID NO: 843897 - RNA, 19 nt, Homo sapiens
cauuacucugaaauuguaa

SEQ ID NO: 843898 - RNA, 15 nt, Homo sapiens
cauuccaacuaucuc

SEQ ID NO: 843899 - RNA, 14 nt, Homo sapiens
cauugccuuuccag

SEQ ID NO: 843900 - RNA, 16 nt, Homo sapiens
cauuugcucauggaau

SEQ ID NO: 843901 - RNA, 22 nt, Homo sapiens
cauuuugggaccuauaucucag

SEQ ID NO: 843902 - RNA, 22 nt, Homo sapiens
ccaaagacuacauauugucacu

SEQ ID NO: 843903 - RNA, 15 nt, Homo sapiens
ccaaauucauauaaa

SEQ ID NO: 843904 - RNA, 15 nt, Homo sapiens
ccaagaucacagugg

SEQ ID NO: 843905 - RNA, 13 nt, Homo sapiens
ccacaggacccag

SEQ ID NO: 843906 - RNA, 19 nt, Homo sapiens
ccaccacugauauccuccu

SEQ ID NO: 843907 - RNA, 23 nt, Homo sapiens
ccacccgaacgucuuaucuaauc

SEQ ID NO: 843908 - RNA, 18 nt, Homo sapiens
ccacccugccucuaccca

SEQ ID NO: 843909 - RNA, 19 nt, Homo sapiens
ccacucugcauacccucau

SEQ ID NO: 843910 - RNA, 15 nt, Homo sapiens
ccacuguguauuuaa

SEQ ID NO: 843911 - RNA, 19 nt, Homo sapiens
ccacuuccccuccuacccc

SEQ ID NO: 843912 - RNA, 14 nt, Homo sapiens
ccagagcuucaggg

SEQ ID NO: 843913 - RNA, 21 nt, Homo sapiens
ccagagucuggagcugagcua

SEQ ID NO: 843914 - RNA, 19 nt, Homo sapiens
ccagcacagccucuuagau

SEQ ID NO: 843915 - RNA, 16 nt, Homo sapiens
ccagcauccugauuaa

SEQ ID NO: 843916 - RNA, 19 nt, Homo sapiens
ccagccuaaucaagucaaa

SEQ ID NO: 843917 - RNA, 16 nt, Homo sapiens
ccagccucugcucuua

SEQ ID NO: 843918 - RNA, 16 nt, Homo sapiens
ccagcuccacuggccu

SEQ ID NO: 843919 - RNA, 18 nt, Homo sapiens
ccaggaccaagcuuaagg

SEQ ID NO: 843920 - RNA, 16 nt, Homo sapiens
ccaggacuugugcaga

SEQ ID NO: 843921 - RNA, 20 nt, Homo sapiens
ccaggccauaccaggugcua

SEQ ID NO: 843922 - RNA, 15 nt, Homo sapiens
ccaggggccaugaau

SEQ ID NO: 843923 - RNA, 19 nt, Homo sapiens
ccaggggucucccugagcc

SEQ ID NO: 843924 - RNA, 16 nt, Homo sapiens
ccagugugaggcugua

SEQ ID NO: 843925 - RNA, 23 nt, Homo sapiens
ccaguuuaggugauggccaguca

SEQ ID NO: 843926 - RNA, 17 nt, Homo sapiens
ccaucaaggguacacug

SEQ ID NO: 843927 - RNA, 15 nt, Homo sapiens
cccacauccaguggg

SEQ ID NO: 843928 - RNA, 22 nt, Homo sapiens
cccagcugacaguccucuccac

SEQ ID NO: 843929 - RNA, 22 nt, Homo sapiens
cccccuggugggacaacaaaga

SEQ ID NO: 843930 - RNA, 14 nt, Homo sapiens
ccccuccugcugca

SEQ ID NO: 843931 - RNA, 14 nt, Homo sapiens
cccugaacaaagca

SEQ ID NO: 843932 - RNA, 16 nt, Homo sapiens
cccuggugggacaaca

SEQ ID NO: 843933 - RNA, 14 nt, Homo sapiens
cccuguaugauucc

SEQ ID NO: 843934 - RNA, 19 nt, Homo sapiens
ccgaaaaucauauaaucuu

SEQ ID NO: 843935 - RNA, 14 nt, Homo sapiens
ccgggcucagggac

SEQ ID NO: 843936 - RNA, 16 nt, Homo sapiens
ccggggguggugacau

SEQ ID NO: 843937 - RNA, 17 nt, Homo sapiens
ccguuuacuuguuucag

SEQ ID NO: 843938 - RNA, 21 nt, Homo sapiens
ccuacggagggaccagguguc

SEQ ID NO: 843939 - RNA, 12 nt, Homo sapiens
ccucaagugcaa

SEQ ID NO: 843940 - RNA, 22 nt, Homo sapiens
ccucaagugcaaggaccaaagg

SEQ ID NO: 843941 - RNA, 13 nt, Homo sapiens
ccucacuauucaa

SEQ ID NO: 843942 - RNA, 18 nt, Homo sapiens
ccuccacucccacuuccc

SEQ ID NO: 843943 - RNA, 19 nt, Homo sapiens
ccucccuggaugacauuaa

SEQ ID NO: 843944 - RNA, 13 nt, Homo sapiens
ccugaaaauaugu

SEQ ID NO: 843945 - RNA, 17 nt, Homo sapiens
ccugacucccaugcaag

SEQ ID NO: 843946 - RNA, 20 nt, Homo sapiens
ccugaggccccaggugggaa

SEQ ID NO: 843947 - RNA, 16 nt, Homo sapiens
ccugcaagaguggucc

SEQ ID NO: 843948 - RNA, 18 nt, Homo sapiens
ccuggcaagugggugaaa

SEQ ID NO: 843949 - RNA, 18 nt, Homo sapiens
ccuggucccuuggagaca

SEQ ID NO: 843950 - RNA, 19 nt, Homo sapiens
ccuggucccuuggagacaa

SEQ ID NO: 843951 - RNA, 14 nt, Homo sapiens
cuggaggcucccau

SEQ ID NO: 843952 - RNA, 15 nt, Homo sapiens
cuggaugacauuaaa

SEQ ID NO: 843953 - RNA, 22 nt, Homo sapiens
cuggaugacauuaaagaagggu

SEQ ID NO: 843954 - RNA, 14 nt, Homo sapiens
cugggccaccagcu

SEQ ID NO: 843955 - RNA, 16 nt, Homo sapiens
cuggggagugagcuug

SEQ ID NO: 843956 - RNA, 20 nt, Homo sapiens
cuggguuggcgcacccuccc

SEQ ID NO: 843957 - RNA, 13 nt, Homo sapiens
cuguaaagccagu

SEQ ID NO: 843958 - RNA, 19 nt, Homo sapiens
cuguaaucccagcuacuca

SEQ ID NO: 843959 - RNA, 12 nt, Homo sapiens
cuguaugauucc

SEQ ID NO: 843960 - RNA, 15 nt, Homo sapiens
cuguccagugcccau

SEQ ID NO: 843961 - RNA, 15 nt, Homo sapiens
cuguggucacaguga

SEQ ID NO: 843962 - RNA, 11 nt, Homo sapiens
cuguguuaaaa

SEQ ID NO: 843963 - RNA, 13 nt, Homo sapiens
cuguuaagcaauu

SEQ ID NO: 843964 - RNA, 22 nt, Homo sapiens
cuuaaggagaggagagcaucug

SEQ ID NO: 843965 - RNA, 20 nt, Homo sapiens
cuuacuuauuaucuucagga

SEQ ID NO: 843966 - RNA, 13 nt, Homo sapiens
cuuagaugcaguu

SEQ ID NO: 843967 - RNA, 15 nt, Homo sapiens
cuuauccacaaagua

SEQ ID NO: 843968 - RNA, 23 nt, Homo sapiens
cuuauuugagugauuauuuguua

SEQ ID NO: 843969 - RNA, 16 nt, Homo sapiens
cuucaguuguuuuccc

SEQ ID NO: 843970 - RNA, 21 nt, Homo sapiens
cuucauguaacuucccugaaa

SEQ ID NO: 843971 - RNA, 22 nt, Homo sapiens
cuucauguaacuucccugaaaa

SEQ ID NO: 843972 - RNA, 20 nt, Homo sapiens
ggaggagccuuggaguguaa

SEQ ID NO: 843973 - RNA, 20 nt, Homo sapiens
ggaggcggagguugcaguga

SEQ ID NO: 843974 - RNA, 11 nt, Homo sapiens
ggaugacauua

SEQ ID NO: 843975 - RNA, 23 nt, Homo sapiens
ggauuuuguauaugcauagucau

SEQ ID NO: 843976 - RNA, 17 nt, Homo sapiens
ggcaggcagaucacaag

SEQ ID NO: 843977 - RNA, 16 nt, Homo sapiens
ggccacccugccucua

SEQ ID NO: 843978 - RNA, 16 nt, Homo sapiens
ggcggaucuuuggaca

SEQ ID NO: 843979 - RNA, 22 nt, Homo sapiens
ggcggaucuuuggacagaagca

SEQ ID NO: 843980 - RNA, 15 nt, Homo sapiens
ggcugggagaaggug

SEQ ID NO: 843981 - RNA, 23 nt, Homo sapiens
ggcuucugugccugacucugugc

SEQ ID NO: 843982 - RNA, 22 nt, Homo sapiens
gggaggagccuuggaguguaau

SEQ ID NO: 843983 - RNA, 14 nt, Homo sapiens
gggcugacugggac

SEQ ID NO: 843984 - RNA, 19 nt, Homo sapiens
gggcugggagaaggugcuu

SEQ ID NO: 843985 - RNA, 13 nt, Homo sapiens
ggggaaaggcuug

SEQ ID NO: 843986 - RNA, 21 nt, Homo sapiens
ggggcaaggugggggagccug

SEQ ID NO: 843987 - RNA, 15 nt, Homo sapiens
ggggcugaugcaguu

SEQ ID NO: 843988 - RNA, 13 nt, Homo sapiens
ggggggcaaggug

SEQ ID NO: 843989 - RNA, 18 nt, Homo sapiens
ggggucucccugagccug

SEQ ID NO: 843990 - RNA, 18 nt, Homo sapiens
ggguaggccuuggcccac

SEQ ID NO: 843991 - RNA, 14 nt, Homo sapiens
gguaucaccacugg

SEQ ID NO: 843992 - RNA, 16 nt, Homo sapiens
ggugggacaacaaaga

SEQ ID NO: 843993 - RNA, 24 nt, Homo sapiens
guaaagccaguuggcuucugugcc

SEQ ID NO: 843994 - RNA, 23 nt, Homo sapiens
guaagaaaauaucacuugucaau

SEQ ID NO: 843995 - RNA, 17 nt, Homo sapiens
guaaucccagcuacuca

SEQ ID NO: 843996 - RNA, 18 nt, Homo sapiens
guaaucccagcuacucag

SEQ ID NO: 843997 - RNA, 12 nt, Homo sapiens
guaccuggugac

SEQ ID NO: 843998 - RNA, 23 nt, Homo sapiens
guagaggaccaggacuugugcag

SEQ ID NO: 843999 - RNA, 15 nt, Homo sapiens
guagauaggccaugg

SEQ ID NO: 844000 - RNA, 23 nt, Homo sapiens
guauauuucccuguuucuuccac

SEQ ID NO: 844001 - RNA, 18 nt, Homo sapiens
gucaauaaaauccauaca

SEQ ID NO: 844002 - RNA, 20 nt, Homo sapiens
gucaucugggccaccagcuc

SEQ ID NO: 844003 - RNA, 16 nt, Homo sapiens
guccagagcuucaggg

SEQ ID NO: 844004 - RNA, 13 nt, Homo sapiens
gucccuuggagac

SEQ ID NO: 844005 - RNA, 16 nt, Homo sapiens
gucuaaagagcuuuag

SEQ ID NO: 844006 - RNA, 21 nt, Homo sapiens
gucuagaggcaacaguguucu

SEQ ID NO: 844007 - RNA, 19 nt, Homo sapiens
gucucaggaguagucucau

SEQ ID NO: 844008 - RNA, 19 nt, Homo sapiens
gucugacuguuuccaucaa

SEQ ID NO: 844009 - RNA, 22 nt, Homo sapiens
gucugagagauucaugcugauu

SEQ ID NO: 844010 - RNA, 13 nt, Homo sapiens
gucuucccuguau

SEQ ID NO: 844011 - RNA, 21 nt, Homo sapiens
gugaaacccugucucuacuaa

SEQ ID NO: 844012 - RNA, 12 nt, Homo sapiens
gugacaugaagc

SEQ ID NO: 844013 - RNA, 23 nt, Homo sapiens
gugauauuaaccaggggccauga

SEQ ID NO: 844014 - RNA, 19 nt, Homo sapiens
gugcaaauugucacaggac

SEQ ID NO: 844015 - RNA, 17 nt, Homo sapiens
gugcaaggaccaaaggg

SEQ ID NO: 844016 - RNA, 23 nt, Homo sapiens
gugcaaggaccaaagggggcccu

SEQ ID NO: 844017 - RNA, 18 nt, Homo sapiens
gugcaccacuucaaguga

SEQ ID NO: 844018 - RNA, 15 nt, Homo sapiens
gugcagcuugcaguc

SEQ ID NO: 844019 - RNA, 19 nt, Homo sapiens
gugcagucccaguccuuga

SEQ ID NO: 844020 - RNA, 21 nt, Homo sapiens
gugccugacucugugcugagc

SEQ ID NO: 844021 - RNA, 16 nt, Homo sapiens
guggccaucaaccucu

SEQ ID NO: 844022 - RNA, 16 nt, Homo sapiens
guggccgucgaguuga

SEQ ID NO: 844023 - RNA, 19 nt, Homo sapiens
guggcgcccccugguggga

SEQ ID NO: 844024 - RNA, 14 nt, Homo sapiens
gugggacaacaaag

SEQ ID NO: 844025 - RNA, 14 nt, Homo sapiens
gugguagcucugag

SEQ ID NO: 844026 - RNA, 23 nt, Homo sapiens
guggugcagccccaggaccaagc

SEQ ID NO: 844027 - RNA, 16 nt, Homo sapiens
guguaguaaaguauca

SEQ ID NO: 844028 - RNA, 20 nt, Homo sapiens
gugugccccccauccuggcc

SEQ ID NO: 844029 - RNA, 22 nt, Homo sapiens
guuacauuaaagcccuguguua

SEQ ID NO: 844030 - RNA, 21 nt, Homo sapiens
guuagggagaugaguugcagu

SEQ ID NO: 844031 - RNA, 18 nt, Homo sapiens
guuaugccgcuagauaca

SEQ ID NO: 844032 - RNA, 13 nt, Homo sapiens
guuggggggcaag

SEQ ID NO: 844033 - RNA, 18 nt, Homo sapiens
guuugcucagcuucucca

SEQ ID NO: 844034 - RNA, 15 nt, Homo sapiens
guuuguauugugauu

SEQ ID NO: 844035 - RNA, 18 nt, Homo sapiens
guuuuauguucuagugau

SEQ ID NO: 844036 - RNA, 14 nt, Homo sapiens
uaaaagaccacaga

SEQ ID NO: 844037 - RNA, 14 nt, Homo sapiens
uaaaauuguaaaau

SEQ ID NO: 844038 - RNA, 17 nt, Homo sapiens
uaaacucaauaaguuua

SEQ ID NO: 844039 - RNA, 11 nt, Homo sapiens
uaaagccaguu

SEQ ID NO: 844040 - RNA, 18 nt, Homo sapiens
uaaagguuguguugccug

SEQ ID NO: 844041 - RNA, 19 nt, Homo sapiens
uaaaguuugguauuguaaa

SEQ ID NO: 844042 - RNA, 19 nt, Homo sapiens
uaaaguuuguucacuuaaa

SEQ ID NO: 844043 - RNA, 14 nt, Homo sapiens
uaaccccuagucau

SEQ ID NO: 844044 - RNA, 17 nt, Homo sapiens
uaacugccuuguguaca

SEQ ID NO: 844045 - RNA, 12 nt, Homo sapiens
uaacuugagggu

SEQ ID NO: 844046 - RNA, 23 nt, Homo sapiens
uaagaaaaaauucuuucacuuga

SEQ ID NO: 844047 - RNA, 17 nt, Homo sapiens
uaagcauuccaacuauc

SEQ ID NO: 844048 - RNA, 21 nt, Homo sapiens
uaagccauuuaacuggagcuc

SEQ ID NO: 844049 - RNA, 15 nt, Homo sapiens
uaauauauugcugcu

SEQ ID NO: 844050 - RNA, 21 nt, Homo sapiens
uaaucauuucugauauuugcu

SEQ ID NO: 844051 - RNA, 21 nt, Homo sapiens
uacacucucaaagcaaauaau

SEQ ID NO: 844052 - RNA, 21 nt, Homo sapiens
uacagaauugacugcaguuga

SEQ ID NO: 844053 - RNA, 17 nt, Homo sapiens
uacaguaaauaaauugu

SEQ ID NO: 844054 - RNA, 15 nt, Homo sapiens
uacauaacacauauc

SEQ ID NO: 844055 - RNA, 16 nt, Homo sapiens
uacauagcagacuuuc

SEQ ID NO: 844056 - RNA, 15 nt, Homo sapiens
uacaugaauugcauu

SEQ ID NO: 844057 - RNA, 22 nt, Homo sapiens
uaccaaaaaucucaauauuuca

SEQ ID NO: 844058 - RNA, 11 nt, Homo sapiens
uaccacaggaa

SEQ ID NO: 844059 - RNA, 22 nt, Homo sapiens
uaccuguuccauuguugucaaa

SEQ ID NO: 844060 - RNA, 16 nt, Homo sapiens
uacucacuuucccaaa

SEQ ID NO: 844061 - RNA, 17 nt, Homo sapiens
uacugaggugguggaca

SEQ ID NO: 844062 - RNA, 18 nt, Homo sapiens
uacuguuucuugcacuga

SEQ ID NO: 844063 - RNA, 22 nt, Homo sapiens
uacuucuuaggguuaugauuaa

SEQ ID NO: 844064 - RNA, 19 nt, Homo sapiens
uagaacuuugccagucuuu

SEQ ID NO: 844065 - RNA, 12 nt, Homo sapiens
uagaccauuaau

SEQ ID NO: 844066 - RNA, 19 nt, Homo sapiens
uagagcuuaaauugucaga

SEQ ID NO: 844067 - RNA, 15 nt, Homo sapiens
uagcaagaccugaaa

SEQ ID NO: 844068 - RNA, 21 nt, Homo sapiens
uagcaguaaauacuugcaguu

SEQ ID NO: 844069 - RNA, 18 nt, Homo sapiens
uagccggggguggugaca

SEQ ID NO: 844070 - RNA, 16 nt, Homo sapiens
uaggagagacuggcca

SEQ ID NO: 844071 - RNA, 18 nt, Homo sapiens
uguaaguuuaugucuaaa

SEQ ID NO: 844072 - RNA, 19 nt, Homo sapiens
uguaucuaccucacuauuc

SEQ ID NO: 844073 - RNA, 15 nt, Homo sapiens
uguauuuaacugccu

SEQ ID NO: 844074 - RNA, 15 nt, Homo sapiens
ugucagcaaguccua

SEQ ID NO: 844075 - RNA, 20 nt, Homo sapiens
uguccccaacaccccacaga

SEQ ID NO: 844076 - RNA, 11 nt, Homo sapiens
ugucucaggag

SEQ ID NO: 844077 - RNA, 19 nt, Homo sapiens
ugucuuuguucuucuacca

SEQ ID NO: 844078 - RNA, 18 nt, Homo sapiens
uguggccaucaaccucug

SEQ ID NO: 844079 - RNA, 12 nt, Homo sapiens
uguuaagcaauu

SEQ ID NO: 844080 - RNA, 20 nt, Homo sapiens
uguuaggccuggcacagugu

SEQ ID NO: 844081 - RNA, 18 nt, Homo sapiens
uguuauuuguacaguuca

SEQ ID NO: 844082 - RNA, 22 nt, Homo sapiens
uguucuucuaccacccaccagu

SEQ ID NO: 844083 - RNA, 22 nt, Homo sapiens
uguuuaaguggcuuucagcaaa

SEQ ID NO: 844084 - RNA, 17 nt, Homo sapiens
uuaaaacauaagaacgu

SEQ ID NO: 844085 - RNA, 22 nt, Homo sapiens
uuaaauaaaccuuuuuggacac

SEQ ID NO: 844086 - RNA, 16 nt, Homo sapiens
uuaauacacacaguua

SEQ ID NO: 844087 - RNA, 18 nt, Homo sapiens
uuaauuauuguacauuua

SEQ ID NO: 844088 - RNA, 19 nt, Homo sapiens
uagaauaaaauuguaaaau

SEQ ID NO: 844089 - RNA, 14 nt, Homo sapiens
uagagauaugcaga

SEQ ID NO: 844090 - RNA, 22 nt, Homo sapiens
uagccaauauuuuucuuacuga

SEQ ID NO: 844091 - RNA, 12 nt, Homo sapiens
uaggagccagug

SEQ ID NO: 844092 - RNA, 15 nt, Homo sapiens
uaggcagggauuuga

SEQ ID NO: 844093 - RNA, 18 nt, Homo sapiens
uagggagaugaguugcag

SEQ ID NO: 844094 - RNA, 15 nt, Homo sapiens
uauaacaaugcugua

SEQ ID NO: 844095 - RNA, 18 nt, Homo sapiens
uauacaguuuaccgaaaa

SEQ ID NO: 844096 - RNA, 19 nt, Homo sapiens
uauacucacuuucccaaau

SEQ ID NO: 844097 - RNA, 14 nt, Homo sapiens
uauagagauaugca

SEQ ID NO: 844098 - RNA, 20 nt, Homo sapiens
uauauguaguacuaacuaag

SEQ ID NO: 844099 - RNA, 15 nt, Homo sapiens
uauauugcugcuggu

SEQ ID NO: 844100 - RNA, 14 nt, Homo sapiens
uaucaggauacuau

SEQ ID NO: 844101 - RNA, 16 nt, Homo sapiens
uaucucggaccuuuca

SEQ ID NO: 844102 - RNA, 11 nt, Homo sapiens
uaugcugcuau

SEQ ID NO: 844103 - RNA, 14 nt, Homo sapiens
uaugcugcuaugga

SEQ ID NO: 844104 - RNA, 21 nt, Homo sapiens
uauggcagggaagcuuucacc

SEQ ID NO: 844105 - RNA, 15 nt, Homo sapiens
uauugcugcugguaa

SEQ ID NO: 844106 - RNA, 18 nt, Homo sapiens
uauuguaaaacauucaca

SEQ ID NO: 844107 - RNA, 13 nt, Homo sapiens
uauugucuaguga

SEQ ID NO: 844108 - RNA, 16 nt, Homo sapiens
uauuuaaaaguauaaa

SEQ ID NO: 844109 - RNA, 14 nt, Homo sapiens
uauuuaugccucug

SEQ ID NO: 844110 - RNA, 17 nt, Homo sapiens
uauuuaugccucuguau

SEQ ID NO: 844111 - RNA, 22 nt, Homo sapiens
uauuucccuguuucuuccacag

SEQ ID NO: 844112 - RNA, 15 nt, Homo sapiens
uauuucucuuugcac

SEQ ID NO: 844113 - RNA, 13 nt, Homo sapiens
uauuuuucaugau

SEQ ID NO: 844114 - RNA, 17 nt, Homo sapiens
uauuuuuuuaagcugua

SEQ ID NO: 844115 - RNA, 15 nt, Homo sapiens
ucaaaaacacucuca

SEQ ID NO: 844116 - RNA, 20 nt, Homo sapiens
ucaaccccuccccuccaucc

SEQ ID NO: 844117 - RNA, 22 nt, Homo sapiens
ucaaccccuccccuccaucccu

SEQ ID NO: 844118 - RNA, 14 nt, Homo sapiens
ucaaccucuguauu

SEQ ID NO: 844119 - RNA, 18 nt, Homo sapiens
ucaagcccuuuacuugac

SEQ ID NO: 844120 - RNA, 15 nt, Homo sapiens
ucaaggccucccaca

SEQ ID NO: 844121 - RNA, 16 nt, Homo sapiens
ucaaguccugccucuu

SEQ ID NO: 844122 - RNA, 20 nt, Homo sapiens
ucaauaccccuguuaagcaa

SEQ ID NO: 844123 - RNA, 15 nt, Homo sapiens
ucacacgggguauuu

SEQ ID NO: 844124 - RNA, 22 nt, Homo sapiens
ucaccaggggcaggcacagcac

SEQ ID NO: 844125 - RNA, 12 nt, Homo sapiens
ucaccucaugga

SEQ ID NO: 844126 - RNA, 17 nt, Homo sapiens
ucaccuuuucccgggga

SEQ ID NO: 844127 - RNA, 15 nt, Homo sapiens
ucacucaguccagcu

SEQ ID NO: 844128 - RNA, 14 nt, Homo sapiens
ucacucuguggucc

SEQ ID NO: 844129 - RNA, 18 nt, Homo sapiens
ucacuucaaaacaguauu

SEQ ID NO: 844130 - RNA, 21 nt, Homo sapiens
ucacuugguucaguaccacau

SEQ ID NO: 844131 - RNA, 21 nt, Homo sapiens
ucacuugucaauaaaauccau

SEQ ID NO: 844132 - RNA, 17 nt, Homo sapiens
ucagauccccagcuuuc

SEQ ID NO: 844133 - RNA, 19 nt, Homo sapiens
ucagggaccacagcaaggc

SEQ ID NO: 844134 - RNA, 16 nt, Homo sapiens
ucaguuacaagugcag

SEQ ID NO: 844135 - RNA, 12 nt, Homo sapiens
ucauaagauauu

SEQ ID NO: 844136 - RNA, 13 nt, Homo sapiens
ucauaagauauuu

SEQ ID NO: 844137 - RNA, 17 nt, Homo sapiens
ucauauauauacauaca

SEQ ID NO: 844138 - RNA, 22 nt, Homo sapiens
ucauauauauacauacaugcau

SEQ ID NO: 844139 - RNA, 21 nt, Homo sapiens
ucaucaaaaacacucucacua

SEQ ID NO: 844140 - RNA, 21 nt, Homo sapiens
ucauccucacucaguccagcu

SEQ ID NO: 844141 - RNA, 14 nt, Homo sapiens
ucaugacuuuucca

SEQ ID NO: 844142 - RNA, 21 nt, Homo sapiens
ucaugauuuugaaaccaugaa

SEQ ID NO: 844143 - RNA, 21 nt, Homo sapiens
ucauguaucgcuucauguaac

SEQ ID NO: 844144 - RNA, 12 nt, Homo sapiens
ucauucaaguca

SEQ ID NO: 844145 - RNA, 15 nt, Homo sapiens
ucauucaagucagcu

SEQ ID NO: 844146 - RNA, 21 nt, Homo sapiens
uccaaacguuaagaauuguua

SEQ ID NO: 844147 - RNA, 11 nt, Homo sapiens
uccaagcauuu

SEQ ID NO: 844148 - RNA, 16 nt, Homo sapiens
uccaauccguucccuu

SEQ ID NO: 844149 - RNA, 13 nt, Homo sapiens
uccacagugccua

SEQ ID NO: 844150 - RNA, 12 nt, Homo sapiens
uccacucccacu

SEQ ID NO: 844151 - RNA, 11 nt, Homo sapiens
uccacuggccu

SEQ ID NO: 844152 - RNA, 18 nt, Homo sapiens
uccagcuuaguucaaguc

SEQ ID NO: 844153 - RNA, 19 nt, Homo sapiens
uccagggucaaaguacaga

SEQ ID NO: 844154 - RNA, 17 nt, Homo sapiens
uccaucagauguguucc

SEQ ID NO: 844155 - RNA, 15 nt, Homo sapiens
uccauccuaccacaa

SEQ ID NO: 844156 - RNA, 21 nt, Homo sapiens
ucccaagggaggcccauguga

SEQ ID NO: 844157 - RNA, 17 nt, Homo sapiens
ucccaauucauccucac

SEQ ID NO: 844158 - RNA, 11 nt, Homo sapiens
ucccagugucu

SEQ ID NO: 844159 - RNA, 17 nt, Homo sapiens
ucccccagccucaaguc

SEQ ID NO: 844160 - RNA, 15 nt, Homo sapiens
ucccuggaugacauu

SEQ ID NO: 844161 - RNA, 23 nt, Homo sapiens
ucccuggcccccucccuggauga

SEQ ID NO: 844162 - RNA, 20 nt, Homo sapiens
uccuaacaaguagcacccug

SEQ ID NO: 844163 - RNA, 15 nt, Homo sapiens
uccuaccacaaugca

SEQ ID NO: 844164 - RNA, 22 nt, Homo sapiens
uccuaccacaaugcagugccuu

SEQ ID NO: 844165 - RNA, 15 nt, Homo sapiens
uccucaguucaucca

SEQ ID NO: 844166 - RNA, 16 nt, Homo sapiens
uccuuaucgaaacuca

SEQ ID NO: 844167 - RNA, 14 nt, Homo sapiens
uccuucuugcccug

SEQ ID NO: 844168 - RNA, 14 nt, Homo sapiens
ucuaaguguuucau

SEQ ID NO: 844169 - RNA, 12 nt, Homo sapiens
ucuaccacccac

SEQ ID NO: 844170 - RNA, 12 nt, Homo sapiens
ucucacuaugcu

SEQ ID NO: 844171 - RNA, 14 nt, Homo sapiens
ucuccagugcaccu

SEQ ID NO: 844172 - RNA, 21 nt, Homo sapiens
ucuccauccuaccacaaugca

SEQ ID NO: 844173 - RNA, 19 nt, Homo sapiens
ucucccaauucauccucac

SEQ ID NO: 844174 - RNA, 13 nt, Homo sapiens
ucuccuugcccug

SEQ ID NO: 844175 - RNA, 21 nt, Homo sapiens
ucucggaccuuucagcuguga

SEQ ID NO: 844176 - RNA, 21 nt, Homo sapiens
ucucuccaggccccaggucau

SEQ ID NO: 844177 - RNA, 16 nt, Homo sapiens
ucucuccagugcaccu

SEQ ID NO: 844178 - RNA, 21 nt, Homo sapiens
ucugcauuaucugaggucaca

SEQ ID NO: 844179 - RNA, 12 nt, Homo sapiens
ucugcucugaga

SEQ ID NO: 844180 - RNA, 20 nt, Homo sapiens
ucugggaggcuucaguuacc

SEQ ID NO: 844181 - RNA, 22 nt, Homo sapiens
ucuguauuuccccaacauguaa

SEQ ID NO: 844182 - RNA, 19 nt, Homo sapiens
ucugucacuuaauugcuac

SEQ ID NO: 844183 - RNA, 22 nt, Homo sapiens
ucugugccugacucugugcuga

SEQ ID NO: 844184 - RNA, 20 nt, Homo sapiens
ucuguuuauaaacauuguau

SEQ ID NO: 844185 - RNA, 21 nt, Homo sapiens
ucuguuuauaaacauuguaua

SEQ ID NO: 844186 - RNA, 13 nt, Homo sapiens
ucuuacaaugaaa

SEQ ID NO: 844187 - RNA, 14 nt, Homo sapiens
ucuuagaugcaguu

SEQ ID NO: 844188 - RNA, 22 nt, Homo sapiens
ucuucaucacuucuuccacugu

SEQ ID NO: 844189 - RNA, 15 nt, Homo sapiens
ucuuccacagugccu

SEQ ID NO: 844190 - RNA, 20 nt, Homo sapiens
ucuucuccauccuaccacaa

SEQ ID NO: 844191 - RNA, 23 nt, Homo sapiens
ucuugcccugagcuuuccgggga

SEQ ID NO: 844192 - RNA, 13 nt, Homo sapiens
ugaagcaaaugug

SEQ ID NO: 844193 - RNA, 15 nt, Homo sapiens
ugaauauauggucug

SEQ ID NO: 844194 - RNA, 15 nt, Homo sapiens
ugaaucucuaaucaa

SEQ ID NO: 844195 - RNA, 17 nt, Homo sapiens
ugacacuguuuuccuua

SEQ ID NO: 844196 - RNA, 23 nt, Homo sapiens
ugacccacuuaccuugcaucuca

SEQ ID NO: 844197 - RNA, 14 nt, Homo sapiens
ugaccccuuuucag

SEQ ID NO: 844198 - RNA, 15 nt, Homo sapiens
ugagagacacacuga

SEQ ID NO: 844199 - RNA, 19 nt, Homo sapiens
ugagagacacacugaagaa

SEQ ID NO: 844200 - RNA, 16 nt, Homo sapiens
ugagauuucccaguuu

SEQ ID NO: 844201 - RNA, 21 nt, Homo sapiens
ugagauuucccaguuuaggug

SEQ ID NO: 844202 - RNA, 23 nt, Homo sapiens
ugagcuaccuggggugggggcca

SEQ ID NO: 844203 - RNA, 17 nt, Homo sapiens
ugaggaaagcauguauu

SEQ ID NO: 844204 - RNA, 12 nt, Homo sapiens
ugaggacacuga

SEQ ID NO: 844205 - RNA, 12 nt, Homo sapiens
ugaggacucugg

SEQ ID NO: 844206 - RNA, 18 nt, Homo sapiens
ugaggauauggcagggaa

SEQ ID NO: 844207 - RNA, 18 nt, Homo sapiens
aaaaacucuuauggccaa

SEQ ID NO: 844208 - RNA, 12 nt, Homo sapiens
aaaaauauacag

SEQ ID NO: 844209 - RNA, 15 nt, Homo sapiens
aaaacacucucacua

SEQ ID NO: 844210 - RNA, 21 nt, Homo sapiens
aaaacucuuauggccaaauuc

SEQ ID NO: 844211 - RNA, 22 nt, Homo sapiens
aaaagauuguuuuauauguagu

SEQ ID NO: 844212 - RNA, 13 nt, Homo sapiens
aaaagggcuuucu

SEQ ID NO: 844213 - RNA, 13 nt, Homo sapiens
aaaauacuuugau

SEQ ID NO: 844214 - RNA, 18 nt, Homo sapiens
aaaauaucacuugucaau

SEQ ID NO: 844215 - RNA, 21 nt, Homo sapiens
aaaaugucaguguuugggaaa

SEQ ID NO: 844216 - RNA, 21 nt, Homo sapiens
aaaauucagaguccuugcaaa

SEQ ID NO: 844217 - RNA, 13 nt, Homo sapiens
aaacccucgaggc

SEQ ID NO: 844218 - RNA, 19 nt, Homo sapiens
aaagaaaauuaguaauugu

SEQ ID NO: 844219 - RNA, 19 nt, Homo sapiens
aaagacuacauauugucac

SEQ ID NO: 844220 - RNA, 14 nt, Homo sapiens
aaagggcuuucuca

SEQ ID NO: 844221 - RNA, 15 nt, Homo sapiens
aaagucaggugcagu

SEQ ID NO: 844222 - RNA, 23 nt, Homo sapiens
aaauaagacggauuuauuuuucc

SEQ ID NO: 844223 - RNA, 18 nt, Homo sapiens
aaauaugccccauucaac

SEQ ID NO: 844224 - RNA, 21 nt, Homo sapiens
aaauccugaugagguuucuac

SEQ ID NO: 844225 - RNA, 15 nt, Homo sapiens
aacacuccacagugu

SEQ ID NO: 844226 - RNA, 13 nt, Homo sapiens
aacacucucacua

SEQ ID NO: 844227 - RNA, 17 nt, Homo sapiens
aacaugaugucaacuuc

SEQ ID NO: 844228 - RNA, 23 nt, Homo sapiens
aacauggucacccccacucugca

SEQ ID NO: 844229 - RNA, 14 nt, Homo sapiens
aacauuacucugaa

SEQ ID NO: 844230 - RNA, 17 nt, Homo sapiens
aaccaaagacuacauau

SEQ ID NO: 844231 - RNA, 23 nt, Homo sapiens
aaccagggccccggggccuguua

SEQ ID NO: 844232 - RNA, 13 nt, Homo sapiens
aaccuauacucac

SEQ ID NO: 844233 - RNA, 18 nt, Homo sapiens
acaaugcagugccuuucu

SEQ ID NO: 844234 - RNA, 17 nt, Homo sapiens
acacacaugaaguccaa

SEQ ID NO: 844235 - RNA, 17 nt, Homo sapiens
acaccucugucccucaa

SEQ ID NO: 844236 - RNA, 16 nt, Homo sapiens
acaccuuagguugaca

SEQ ID NO: 844237 - RNA, 20 nt, Homo sapiens
acaccuuagguugacauuca

SEQ ID NO: 844238 - RNA, 13 nt, Homo sapiens
acacucucacuau

SEQ ID NO: 844239 - RNA, 23 nt, Homo sapiens
acagaauagaauacauugauaca

SEQ ID NO: 844240 - RNA, 23 nt, Homo sapiens
acagagaaaagucaggugcaguc

SEQ ID NO: 844241 - RNA, 22 nt, Homo sapiens
acagauguucacccaaccacau

SEQ ID NO: 844242 - RNA, 20 nt, Homo sapiens
acagcuucucaauuucuaca

SEQ ID NO: 844243 - RNA, 19 nt, Homo sapiens
acagugccuaauaauacug

SEQ ID NO: 844244 - RNA, 22 nt, Homo sapiens
acaguuaccucugccucagaaa

SEQ ID NO: 844245 - RNA, 20 nt, Homo sapiens
acaugaagcaaacuaacuuu

SEQ ID NO: 844246 - RNA, 23 nt, Homo sapiens
acaugaauugcauuuuacuuuaa

SEQ ID NO: 844247 - RNA, 18 nt, Homo sapiens
acaugcauacacucucaa

SEQ ID NO: 844248 - RNA, 17 nt, Homo sapiens
acauggugaaacccugu

SEQ ID NO: 844249 - RNA, 13 nt, Homo sapiens
acaugugccugua

SEQ ID NO: 844250 - RNA, 12 nt, Homo sapiens
acauucacaccu

SEQ ID NO: 844251 - RNA, 12 nt, Homo sapiens
acauucagaaaa

SEQ ID NO: 844252 - RNA, 15 nt, Homo sapiens
acauuugcucaugga

SEQ ID NO: 844253 - RNA, 15 nt, Homo sapiens
accaaucaugaauua

SEQ ID NO: 844254 - RNA, 22 nt, Homo sapiens
accacaucccacucacaacagc

SEQ ID NO: 844255 - RNA, 14 nt, Homo sapiens
accacuggagauca

SEQ ID NO: 844256 - RNA, 19 nt, Homo sapiens
accaggugucuagaggcaa

SEQ ID NO: 844257 - RNA, 12 nt, Homo sapiens
accauacaaaaa

SEQ ID NO: 844258 - RNA, 19 nt, Homo sapiens
acccacgaggaggaaccag

SEQ ID NO: 844259 - RNA, 23 nt, Homo sapiens
acccagcccugaacaaagcaccu

SEQ ID NO: 844260 - RNA, 20 nt, Homo sapiens
accccgagccuggcuccaaa

SEQ ID NO: 844261 - RNA, 17 nt, Homo sapiens
accccuggccugacucc

SEQ ID NO: 844262 - RNA, 19 nt, Homo sapiens
accucaccaagcugcugug

SEQ ID NO: 844263 - RNA, 13 nt, Homo sapiens
accucacuauuca

SEQ ID NO: 844264 - RNA, 14 nt, Homo sapiens
accucacuauucaa

SEQ ID NO: 844265 - RNA, 17 nt, Homo sapiens
accuccagcucucaguu

SEQ ID NO: 844266 - RNA, 18 nt, Homo sapiens
accuccagcucucaguua

SEQ ID NO: 844267 - RNA, 14 nt, Homo sapiens
accuugcaucucac

SEQ ID NO: 844268 - RNA, 15 nt, Homo sapiens
accuuuucccgggga

SEQ ID NO: 844269 - RNA, 19 nt, Homo sapiens
accuuuuuggacacacaaa

SEQ ID NO: 844270 - RNA, 20 nt, Homo sapiens
acgaggugguagcucugagc

SEQ ID NO: 844271 - RNA, 21 nt, Homo sapiens
acgaggugguagcucugagcc

SEQ ID NO: 844272 - RNA, 12 nt, Homo sapiens
acggccacaguc

SEQ ID NO: 844273 - RNA, 17 nt, Homo sapiens
acuaaacagacuauuua

SEQ ID NO: 844274 - RNA, 21 nt, Homo sapiens
acuaacuccuaggaaaauacu

SEQ ID NO: 844275 - RNA, 22 nt, Homo sapiens
acuaucucauuuccaagcaagu

SEQ ID NO: 844276 - RNA, 21 nt, Homo sapiens
acucacuuucccaaauugaau

SEQ ID NO: 844277 - RNA, 13 nt, Homo sapiens
acucccacuuccc

SEQ ID NO: 844278 - RNA, 13 nt, Homo sapiens
acucuacacugaa

SEQ ID NO: 844279 - RNA, 14 nt, Homo sapiens
acucucacuaugcu

SEQ ID NO: 844280 - RNA, 20 nt, Homo sapiens
acucucacuaugcugcuaug

SEQ ID NO: 844281 - RNA, 16 nt, Homo sapiens
acucugcauacccuca

SEQ ID NO: 844282 - RNA, 19 nt, Homo sapiens
acucuggaccccaggccau

SEQ ID NO: 844283 - RNA, 12 nt, Homo sapiens
acucugugcuga

SEQ ID NO: 844284 - RNA, 14 nt, Homo sapiens
acucuuauggccaa

SEQ ID NO: 844285 - RNA, 17 nt, Homo sapiens
acugcagccuccagaga

SEQ ID NO: 844286 - RNA, 22 nt, Homo sapiens
acuggaggcaggacuccugggu

SEQ ID NO: 844287 - RNA, 22 nt, Homo sapiens
acugggacaggggagaaccuag

SEQ ID NO: 844288 - RNA, 14 nt, Homo sapiens
acugggugccacgg

SEQ ID NO: 844289 - RNA, 12 nt, Homo sapiens
acuguccugcuc

SEQ ID NO: 844290 - RNA, 19 nt, Homo sapiens
acuguccugcuccacagug

SEQ ID NO: 844291 - RNA, 22 nt, Homo sapiens
acuguggguagacacacaugaa

SEQ ID NO: 844292 - RNA, 23 nt, Homo sapiens
acuugcugcugagugcaccacuu

SEQ ID NO: 844293 - RNA, 17 nt, Homo sapiens
acuugcuuccaagcccu

SEQ ID NO: 844294 - RNA, 19 nt, Homo sapiens
acuuuucaauuugucaugu

SEQ ID NO: 844295 - RNA, 15 nt, Homo sapiens
agaaaaucaguaauu

SEQ ID NO: 844296 - RNA, 17 nt, Homo sapiens
agaaacacaacuauauu

SEQ ID NO: 844297 - RNA, 18 nt, Homo sapiens
agaacacuagacaugcca

SEQ ID NO: 844298 - RNA, 13 nt, Homo sapiens
agaagaacugaaa

SEQ ID NO: 844299 - RNA, 13 nt, Homo sapiens
agaagcagcucuu

SEQ ID NO: 844300 - RNA, 15 nt, Homo sapiens
agaauuuaaaccuau

SEQ ID NO: 844301 - RNA, 16 nt, Homo sapiens
agacccauaccuuucc

SEQ ID NO: 844302 - RNA, 22 nt, Homo sapiens
agacuuggcuccaccacugaua

SEQ ID NO: 844303 - RNA, 17 nt, Homo sapiens
agacuuucccaaaugua

SEQ ID NO: 844304 - RNA, 15 nt, Homo sapiens
agagaacuuccagau

SEQ ID NO: 844305 - RNA, 18 nt, Homo sapiens
cagaauugacugcaguug

SEQ ID NO: 844306 - RNA, 22 nt, Homo sapiens
cagacccauaccuuuccagggu

SEQ ID NO: 844307 - RNA, 15 nt, Homo sapiens
cagacgccacagucu

SEQ ID NO: 844308 - RNA, 21 nt, Homo sapiens
cagacuauuuaacuugagggu

SEQ ID NO: 844309 - RNA, 18 nt, Homo sapiens
cagaguuuguauugugau

SEQ ID NO: 844310 - RNA, 16 nt, Homo sapiens
cagcaaaccucaguca

SEQ ID NO: 844311 - RNA, 11 nt, Homo sapiens
cagcacagcaa

SEQ ID NO: 844312 - RNA, 15 nt, Homo sapiens
cagcagcagcuuuca

SEQ ID NO: 844313 - RNA, 12 nt, Homo sapiens
cagccauguauu

SEQ ID NO: 844314 - RNA, 22 nt, Homo sapiens
cagccuccagagaguaucugag

SEQ ID NO: 844315 - RNA, 12 nt, Homo sapiens
cagcucuucucc

SEQ ID NO: 844316 - RNA, 15 nt, Homo sapiens
cagcuuauugucuag

SEQ ID NO: 844317 - RNA, 18 nt, Homo sapiens
cagcuuauugucuaguga

SEQ ID NO: 844318 - RNA, 18 nt, Homo sapiens
caggaagagaggacccau

SEQ ID NO: 844319 - RNA, 17 nt, Homo sapiens
caggaggugcuaucgca

SEQ ID NO: 844320 - RNA, 14 nt, Homo sapiens
caggaguagucuca

SEQ ID NO: 844321 - RNA, 19 nt, Homo sapiens
caggccauaccaggugcua

SEQ ID NO: 844322 - RNA, 23 nt, Homo sapiens
caggcccuccuugucuuuuuacu

SEQ ID NO: 844323 - RNA, 20 nt, Homo sapiens
caggcuuucaagaagugcca

SEQ ID NO: 844324 - RNA, 18 nt, Homo sapiens
caggggucucccugagcc

SEQ ID NO: 844325 - RNA, 21 nt, Homo sapiens
caggucuaccaaaaaucucaa

SEQ ID NO: 844326 - RNA, 23 nt, Homo sapiens
caggucuccuccaccgccauggc

SEQ ID NO: 844327 - RNA, 14 nt, Homo sapiens
caggugcaguccca

SEQ ID NO: 844328 - RNA, 16 nt, Homo sapiens
cagugcccauuccuca

SEQ ID NO: 844329 - RNA, 15 nt, Homo sapiens
caguguguggcuuuc

SEQ ID NO: 844330 - RNA, 14 nt, Homo sapiens
caguuacaagugca

SEQ ID NO: 844331 - RNA, 20 nt, Homo sapiens
caguuaccucugccucagaa

SEQ ID NO: 844332 - RNA, 13 nt, Homo sapiens
caguucugaagaa

SEQ ID NO: 844333 - RNA, 19 nt, Homo sapiens
caguuuaccgaaaaucaua

SEQ ID NO: 844334 - RNA, 18 nt, Homo sapiens
cauaaagagcuucagcag

SEQ ID NO: 844335 - RNA, 17 nt, Homo sapiens
cauaaccccuagucauc

SEQ ID NO: 844336 - RNA, 17 nt, Homo sapiens
cauaauguuaagcuuua

SEQ ID NO: 844337 - RNA, 17 nt, Homo sapiens
caucaaaaacacucuca

SEQ ID NO: 844338 - RNA, 20 nt, Homo sapiens
caucaaccucuguauuugaa

SEQ ID NO: 844339 - RNA, 20 nt, Homo sapiens
caucaaggguacacugccuu

SEQ ID NO: 844340 - RNA, 21 nt, Homo sapiens
cauccuggcccaucaguguac

SEQ ID NO: 844341 - RNA, 20 nt, Homo sapiens
caucuguuguucugugguca

SEQ ID NO: 844342 - RNA, 13 nt, Homo sapiens
caucuuccaggug

SEQ ID NO: 844343 - RNA, 12 nt, Homo sapiens
cucccacaguga

SEQ ID NO: 844344 - RNA, 19 nt, Homo sapiens
cucccagcugacaguccuc

SEQ ID NO: 844345 - RNA, 23 nt, Homo sapiens
cuccccuccaucccuggcccccu

SEQ ID NO: 844346 - RNA, 18 nt, Homo sapiens
cucccuggaugacauuaa

SEQ ID NO: 844347 - RNA, 20 nt, Homo sapiens
cuccguucccaccucugagg

SEQ ID NO: 844348 - RNA, 22 nt, Homo sapiens
cuccucaaccccuccccuccau

SEQ ID NO: 844349 - RNA, 18 nt, Homo sapiens
cuccucugcuaugcauuu

SEQ ID NO: 844350 - RNA, 13 nt, Homo sapiens
cucgucucaaaaa

SEQ ID NO: 844351 - RNA, 15 nt, Homo sapiens
cucgugggacaguca

SEQ ID NO: 844352 - RNA, 21 nt, Homo sapiens
cucugcauacccucaucaaaa

SEQ ID NO: 844353 - RNA, 17 nt, Homo sapiens
cugaaaucauacuucuu

SEQ ID NO: 844354 - RNA, 16 nt, Homo sapiens
cugaagagauacccac

SEQ ID NO: 844355 - RNA, 13 nt, Homo sapiens
cugaauauauaaa

SEQ ID NO: 844356 - RNA, 20 nt, Homo sapiens
cugacccagcccugaacaaa

SEQ ID NO: 844357 - RNA, 17 nt, Homo sapiens
cugagacuuggcuccac

SEQ ID NO: 844358 - RNA, 20 nt, Homo sapiens
cugagcccccaccugccuga

SEQ ID NO: 844359 - RNA, 20 nt, Homo sapiens
cugaggccccaggugggaac

SEQ ID NO: 844360 - RNA, 13 nt, Homo sapiens
cugagguggugga

SEQ ID NO: 844361 - RNA, 18 nt, Homo sapiens
cugccacuccugacccag

SEQ ID NO: 844362 - RNA, 12 nt, Homo sapiens
cugccacuuccc

SEQ ID NO: 844363 - RNA, 18 nt, Homo sapiens
cugccuucucacuagcug

SEQ ID NO: 844364 - RNA, 19 nt, Homo sapiens
cugcugagugcaccacuuc

SEQ ID NO: 844365 - RNA, 17 nt, Homo sapiens
cuggagcagguggcuug

SEQ ID NO: 844366 - RNA, 19 nt, Homo sapiens
cuggaggcucccaugggcu

SEQ ID NO: 844367 - RNA, 12 nt, Homo sapiens
cuggaugacauu

SEQ ID NO: 844368 - RNA, 13 nt, Homo sapiens
cuggcacaguguc

SEQ ID NO: 844369 - RNA, 14 nt, Homo sapiens
cuggcccaucagug

SEQ ID NO: 844370 - RNA, 13 nt, Homo sapiens
cuggccgggaccc

SEQ ID NO: 844371 - RNA, 13 nt, Homo sapiens
cuggccugacucc

SEQ ID NO: 844372 - RNA, 12 nt, Homo sapiens
cuggcuccaaac

SEQ ID NO: 844373 - RNA, 16 nt, Homo sapiens
cuggcuguacugccaa

SEQ ID NO: 844374 - RNA, 17 nt, Homo sapiens
cuggggaggcugagacu

SEQ ID NO: 844375 - RNA, 12 nt, Homo sapiens
cuggggccaaau

SEQ ID NO: 844376 - RNA, 20 nt, Homo sapiens
cuggggugggggccaaguca

SEQ ID NO: 844377 - RNA, 17 nt, Homo sapiens
cugguaauuuguaucug

SEQ ID NO: 844378 - RNA, 19 nt, Homo sapiens
cugguaauuuguaucugaa

SEQ ID NO: 844379 - RNA, 18 nt, Homo sapiens
cuggugggacaacaaaga

SEQ ID NO: 844380 - RNA, 14 nt, Homo sapiens
cuguacugccaagg

SEQ ID NO: 844381 - RNA, 20 nt, Homo sapiens
gccaccagcuccacuggccu

SEQ ID NO: 844382 - RNA, 19 nt, Homo sapiens
gccacccugccucuaccca

SEQ ID NO: 844383 - RNA, 12 nt, Homo sapiens
gccacgaggugg

SEQ ID NO: 844384 - RNA, 13 nt, Homo sapiens
gccagcacagccu

SEQ ID NO: 844385 - RNA, 22 nt, Homo sapiens
gccagugaccaaccuuuuccca

SEQ ID NO: 844386 - RNA, 14 nt, Homo sapiens
gccauaccaggugc

SEQ ID NO: 844387 - RNA, 17 nt, Homo sapiens
gcccaaggacggcacca

SEQ ID NO: 844388 - RNA, 17 nt, Homo sapiens
gcccauuuccauggugc

SEQ ID NO: 844389 - RNA, 18 nt, Homo sapiens
gcccauuuccauggugca

SEQ ID NO: 844390 - RNA, 14 nt, Homo sapiens
gcccccugguggga

SEQ ID NO: 844391 - RNA, 19 nt, Homo sapiens
gcccuggcuuggagugggu

SEQ ID NO: 844392 - RNA, 17 nt, Homo sapiens
gccuauuucucuuugca

SEQ ID NO: 844393 - RNA, 14 nt, Homo sapiens
gccucccacaguga

SEQ ID NO: 844394 - RNA, 21 nt, Homo sapiens
gccuccucucucaaacugggg

SEQ ID NO: 844395 - RNA, 19 nt, Homo sapiens
gccuggcaagugggugaaa

SEQ ID NO: 844396 - RNA, 23 nt, Homo sapiens
gccuggcuccaaacccucgaggc

SEQ ID NO: 844397 - RNA, 20 nt, Homo sapiens
gcuaccuggggugggggcca

SEQ ID NO: 844398 - RNA, 15 nt, Homo sapiens
gcucagcuucuccaa

SEQ ID NO: 844399 - RNA, 12 nt, Homo sapiens
gcuccacagugu

SEQ ID NO: 844400 - RNA, 16 nt, Homo sapiens
gcucuccuugcccugg

SEQ ID NO: 844401 - RNA, 18 nt, Homo sapiens
gcucugugugguccaggu

SEQ ID NO: 844402 - RNA, 13 nt, Homo sapiens
gcugaccacuuua

SEQ ID NO: 844403 - RNA, 12 nt, Homo sapiens
gcugaugcaguu

SEQ ID NO: 844404 - RNA, 13 nt, Homo sapiens
gcugaugcaguug

SEQ ID NO: 844405 - RNA, 20 nt, Homo sapiens
gcugcuauggacgaccucca

SEQ ID NO: 844406 - RNA, 24 nt, Homo sapiens
gcugcuggaggggacgcuggcuaa

SEQ ID NO: 844407 - RNA, 15 nt, Homo sapiens
gcuggcugcaccccu

SEQ ID NO: 844408 - RNA, 22 nt, Homo sapiens
gcugguacuaagaggcuauuua

SEQ ID NO: 844409 - RNA, 13 nt, Homo sapiens
gcuuggagugggu

SEQ ID NO: 844410 - RNA, 16 nt, Homo sapiens
gcuuuuuccuuuucau

SEQ ID NO: 844411 - RNA, 13 nt, Homo sapiens
ggacagaagcagc

SEQ ID NO: 844412 - RNA, 18 nt, Homo sapiens
ggacauuugcucauggaa

SEQ ID NO: 844413 - RNA, 19 nt, Homo sapiens
ggacugggugccacggugg

SEQ ID NO: 844414 - RNA, 17 nt, Homo sapiens
ggacuugcuuccaagcc

SEQ ID NO: 844415 - RNA, 23 nt, Homo sapiens
ggagagagguugaggaugcacug

SEQ ID NO: 844416 - RNA, 13 nt, Homo sapiens
ggagagcaucugc

SEQ ID NO: 844417 - RNA, 22 nt, Homo sapiens
ggaggcucugaagagauaccca

SEQ ID NO: 844418 - RNA, 14 nt, Homo sapiens
ggagggaccaggug

SEQ ID NO: 844419 - RNA, 14 nt, Homo sapiens
uaaugagauauuaa

SEQ ID NO: 844420 - RNA, 15 nt, Homo sapiens
uaaugauaacuggaa

SEQ ID NO: 844421 - RNA, 15 nt, Homo sapiens
uaauuuaauguauua

SEQ ID NO: 844422 - RNA, 23 nt, Homo sapiens
uacaaaaauuccuuuucccgaag

SEQ ID NO: 844423 - RNA, 21 nt, Homo sapiens
uacaaaggcuuauuaauuuga

SEQ ID NO: 844424 - RNA, 18 nt, Homo sapiens
uacauauugucacugaca

SEQ ID NO: 844425 - RNA, 21 nt, Homo sapiens
uaccacaugggugaacacuca

SEQ ID NO: 844426 - RNA, 16 nt, Homo sapiens
uacccacagagugugg

SEQ ID NO: 844427 - RNA, 21 nt, Homo sapiens
uaccccccugagagcaugugg

SEQ ID NO: 844428 - RNA, 17 nt, Homo sapiens
uaccccugauaagcaaa

SEQ ID NO: 844429 - RNA, 18 nt, Homo sapiens
uaccccuguuaagcaauu

SEQ ID NO: 844430 - RNA, 18 nt, Homo sapiens
uacccuacaccucugggc

SEQ ID NO: 844431 - RNA, 18 nt, Homo sapiens
uaccgaaaaucauauaau

SEQ ID NO: 844432 - RNA, 15 nt, Homo sapiens
uaccuguuccauugu

SEQ ID NO: 844433 - RNA, 22 nt, Homo sapiens
uacuaaaugguguuacauuaaa

SEQ ID NO: 844434 - RNA, 20 nt, Homo sapiens
uacuaggggcccggauccag

SEQ ID NO: 844435 - RNA, 17 nt, Homo sapiens
uacuguuucuugcacug

SEQ ID NO: 844436 - RNA, 16 nt, Homo sapiens
uagaaacacaacuaua

SEQ ID NO: 844437 - RNA, 16 nt, Homo sapiens
uagaauaccacaggaa

SEQ ID NO: 844438 - RNA, 16 nt, Homo sapiens
uagaauagauauccac

SEQ ID NO: 844439 - RNA, 18 nt, Homo sapiens
uagagauaugcagaagga

SEQ ID NO: 844440 - RNA, 23 nt, Homo sapiens
uaggaaagaccauuuuuccucca

SEQ ID NO: 844441 - RNA, 16 nt, Homo sapiens
uaggacuuuagggauc

SEQ ID NO: 844442 - RNA, 17 nt, Homo sapiens
uaggccuggcacagugu

SEQ ID NO: 844443 - RNA, 20 nt, Homo sapiens
uaggugaccccaucucugcu

SEQ ID NO: 844444 - RNA, 18 nt, Homo sapiens
uaggugauggccagucau

SEQ ID NO: 844445 - RNA, 13 nt, Homo sapiens
uaguaaaguuugu

SEQ ID NO: 844446 - RNA, 21 nt, Homo sapiens
uauaccgcuaucauuccaaag

SEQ ID NO: 844447 - RNA, 15 nt, Homo sapiens
uauaguccagcuuug

SEQ ID NO: 844448 - RNA, 15 nt, Homo sapiens
uaucaauuaccacac

SEQ ID NO: 844449 - RNA, 15 nt, Homo sapiens
uaucaauuuccucau

SEQ ID NO: 844450 - RNA, 23 nt, Homo sapiens
uaucuaaacuggauucacagcuc

SEQ ID NO: 844451 - RNA, 18 nt, Homo sapiens
uaucuaccucacuauuca

SEQ ID NO: 844452 - RNA, 19 nt, Homo sapiens
uaucucggaccuuucagcu

SEQ ID NO: 844453 - RNA, 18 nt, Homo sapiens
uaucugagucaacuccuu

SEQ ID NO: 844454 - RNA, 17 nt, Homo sapiens
uaucuuaaaacuccugu

SEQ ID NO: 844455 - RNA, 17 nt, Homo sapiens
uaucuucaggacacuca

SEQ ID NO: 844456 - RNA, 17 nt, Homo sapiens
aucagcaggcuccaguu

SEQ ID NO: 844457 - RNA, 18 nt, Homo sapiens
aucaggaggccaggccac

SEQ ID NO: 844458 - RNA, 14 nt, Homo sapiens
aucccagcuacuca

SEQ ID NO: 844459 - RNA, 19 nt, Homo sapiens
aucccccagccucaagucu

SEQ ID NO: 844460 - RNA, 18 nt, Homo sapiens
auccugccacaggaccca

SEQ ID NO: 844461 - RNA, 20 nt, Homo sapiens
aucucugcugcuucugggcc

SEQ ID NO: 844462 - RNA, 21 nt, Homo sapiens
aucugaggcacaugucagcaa

SEQ ID NO: 844463 - RNA, 21 nt, Homo sapiens
aucuguuguucuguggucaca

SEQ ID NO: 844464 - RNA, 20 nt, Homo sapiens
aucuuuggacagaagcagcu

SEQ ID NO: 844465 - RNA, 15 nt, Homo sapiens
augaggauauggcag

SEQ ID NO: 844466 - RNA, 14 nt, Homo sapiens
augauaacuggaaa

SEQ ID NO: 844467 - RNA, 12 nt, Homo sapiens
augcauacacuc

SEQ ID NO: 844468 - RNA, 20 nt, Homo sapiens
augcauuuucuucacagugc

SEQ ID NO: 844469 - RNA, 21 nt, Homo sapiens
auggacgaccuccagcucuca

SEQ ID NO: 844470 - RNA, 14 nt, Homo sapiens
auggacucuucccc

SEQ ID NO: 844471 - RNA, 22 nt, Homo sapiens
auggacucuucccccacuccuc

SEQ ID NO: 844472 - RNA, 21 nt, Homo sapiens
auggagauauuuacaugaauu

SEQ ID NO: 844473 - RNA, 22 nt, Homo sapiens
auggcacuaguauuucuaugaa

SEQ ID NO: 844474 - RNA, 23 nt, Homo sapiens
auggcacuaguauuucuaugaaa

SEQ ID NO: 844475 - RNA, 20 nt, Homo sapiens
auggucacccccacucugca

SEQ ID NO: 844476 - RNA, 15 nt, Homo sapiens
auguaucuaccucac

SEQ ID NO: 844477 - RNA, 19 nt, Homo sapiens
augucaaacugucuuggcu

SEQ ID NO: 844478 - RNA, 22 nt, Homo sapiens
augucuucaucacuucuuccac

SEQ ID NO: 844479 - RNA, 18 nt, Homo sapiens
augugauuccaucuugcc

SEQ ID NO: 844480 - RNA, 13 nt, Homo sapiens
auuaccaguuuuc

SEQ ID NO: 844481 - RNA, 19 nt, Homo sapiens
auuaccugucaucugggcc

SEQ ID NO: 844482 - RNA, 15 nt, Homo sapiens
auuauaccgcuauca

SEQ ID NO: 844483 - RNA, 14 nt, Homo sapiens
auuaucuucaggac

SEQ ID NO: 844484 - RNA, 15 nt, Homo sapiens
auucaagucagcucu

SEQ ID NO: 844485 - RNA, 13 nt, Homo sapiens
auugccuuuccag

SEQ ID NO: 844486 - RNA, 16 nt, Homo sapiens
auugccuuuccagggu

SEQ ID NO: 844487 - RNA, 21 nt, Homo sapiens
auugugugaaagguacuucaa

SEQ ID NO: 844488 - RNA, 16 nt, Homo sapiens
auuguuuuauguucua

SEQ ID NO: 844489 - RNA, 21 nt, Homo sapiens
auuuaaaaaacuaacacccag

SEQ ID NO: 844490 - RNA, 13 nt, Homo sapiens
auuuaacuugagg

SEQ ID NO: 844491 - RNA, 21 nt, Homo sapiens
auuuagguaaauaaagcucaa

SEQ ID NO: 844492 - RNA, 19 nt, Homo sapiens
auuucuucucccuccuccc

SEQ ID NO: 844493 - RNA, 19 nt, Homo sapiens
auuugcaauucauguaaca

SEQ ID NO: 844494 - RNA, 16 nt, Homo sapiens
auuuuaaaacauaaga

SEQ ID NO: 844495 - RNA, 19 nt, Homo sapiens
auuuuaaaagaaugauuau

SEQ ID NO: 844496 - RNA, 21 nt, Homo sapiens
auuuuaggcagggauuugagg

SEQ ID NO: 844497 - RNA, 16 nt, Homo sapiens
auuuucuucacagugc

SEQ ID NO: 844498 - RNA, 23 nt, Homo sapiens
auuuucuucacagugcagcuugc

SEQ ID NO: 844499 - RNA, 19 nt, Homo sapiens
caaaauugauaauuacguu

SEQ ID NO: 844500 - RNA, 21 nt, Homo sapiens
caaagacuacauauugucacu

SEQ ID NO: 844501 - RNA, 11 nt, Homo sapiens
caaaguacaga

SEQ ID NO: 844502 - RNA, 21 nt, Homo sapiens
caaauaauuuuucacuucaaa

SEQ ID NO: 844503 - RNA, 15 nt, Homo sapiens
caagaagugccaguu

SEQ ID NO: 844504 - RNA, 16 nt, Homo sapiens
caagagccacaguaua

SEQ ID NO: 844505 - RNA, 22 nt, Homo sapiens
caagagcucaaggucaaugaca

SEQ ID NO: 844506 - RNA, 16 nt, Homo sapiens
caagcauuuagaugua

SEQ ID NO: 844507 - RNA, 17 nt, Homo sapiens
caagcauuuagauguau

SEQ ID NO: 844508 - RNA, 20 nt, Homo sapiens
caagggaggcccaugugacu

SEQ ID NO: 844509 - RNA, 19 nt, Homo sapiens
caauaccccuguuaagcaa

SEQ ID NO: 844510 - RNA, 19 nt, Homo sapiens
caauccguucccuucugcc

SEQ ID NO: 844511 - RNA, 21 nt, Homo sapiens
caauccguucccuucugccac

SEQ ID NO: 844512 - RNA, 19 nt, Homo sapiens
cacaggaaccacaagacug

SEQ ID NO: 844513 - RNA, 17 nt, Homo sapiens
cacagguagacaguaua

SEQ ID NO: 844514 - RNA, 20 nt, Homo sapiens
cacagugaccuuagcuacau

SEQ ID NO: 844515 - RNA, 18 nt, Homo sapiens
cacaguggccaagaucac

SEQ ID NO: 844516 - RNA, 20 nt, Homo sapiens
cacaguggccaagaucacag

SEQ ID NO: 844517 - RNA, 21 nt, Homo sapiens
cacaguggucuggaauggacu

SEQ ID NO: 844518 - RNA, 16 nt, Homo sapiens
caccagcuccacuggc

SEQ ID NO: 844519 - RNA, 17 nt, Homo sapiens
caccgccauggcuucca

SEQ ID NO: 844520 - RNA, 22 nt, Homo sapiens
caccuaguggcuguccagugcc

SEQ ID NO: 844521 - RNA, 14 nt, Homo sapiens
caccucaagugcaa

SEQ ID NO: 844522 - RNA, 15 nt, Homo sapiens
caccucaagugcaag

SEQ ID NO: 844523 - RNA, 14 nt, Homo sapiens
cacggccacaguca

SEQ ID NO: 844524 - RNA, 17 nt, Homo sapiens
cacuagucuguguaacu

SEQ ID NO: 844525 - RNA, 20 nt, Homo sapiens
cacucaaugguuaacuaauu

SEQ ID NO: 844526 - RNA, 13 nt, Homo sapiens
cacuccacagugu

SEQ ID NO: 844527 - RNA, 19 nt, Homo sapiens
cacucucacuaugcugcua

SEQ ID NO: 844528 - RNA, 14 nt, Homo sapiens
cacucugugcccau

SEQ ID NO: 844529 - RNA, 16 nt, Homo sapiens
cacuggcugccuccac

SEQ ID NO: 844530 - RNA, 16 nt, Homo sapiens
cacuguaaagccaguu

SEQ ID NO: 844531 - RNA, 16 nt, Homo sapiens
cacuguccugcuccac

SEQ ID NO: 844532 - RNA, 14 nt, Homo sapiens
cagaaaaauacuuu

SEQ ID NO: 844533 - RNA, 21 nt, Homo sapiens
cagaacacuucagccugugca

SEQ ID NO: 844534 - RNA, 22 nt, Homo sapiens
cagaagugcuuucuucucccaa

SEQ ID NO: 844535 - RNA, 22 nt, Homo sapiens
acacugaagaagcaccaaucau

SEQ ID NO: 844536 - RNA, 16 nt, Homo sapiens
acacuuauauuuugau

SEQ ID NO: 844537 - RNA, 20 nt, Homo sapiens
acaggauguuugcucagcuu

SEQ ID NO: 844538 - RNA, 20 nt, Homo sapiens
acagguagacaguauauaac

SEQ ID NO: 844539 - RNA, 20 nt, Homo sapiens
acaguauugacuuguauacc

SEQ ID NO: 844540 - RNA, 21 nt, Homo sapiens
acagugcccuuuucaucucca

SEQ ID NO: 844541 - RNA, 15 nt, Homo sapiens
acagugucugggcug

SEQ ID NO: 844542 - RNA, 15 nt, Homo sapiens
acauaauaccaccau

SEQ ID NO: 844543 - RNA, 21 nt, Homo sapiens
acauacaugcauacacucuca

SEQ ID NO: 844544 - RNA, 21 nt, Homo sapiens
acauaccagagucuggagcug

SEQ ID NO: 844545 - RNA, 14 nt, Homo sapiens
acauagcagacuuu

SEQ ID NO: 844546 - RNA, 16 nt, Homo sapiens
acauauaccuucucaa

SEQ ID NO: 844547 - RNA, 22 nt, Homo sapiens
acaucgucucugccacuccuga

SEQ ID NO: 844548 - RNA, 19 nt, Homo sapiens
acaugcauacacucucaaa

SEQ ID NO: 844549 - RNA, 18 nt, Homo sapiens
acaugggugaacacucaa

SEQ ID NO: 844550 - RNA, 21 nt, Homo sapiens
acauggucacccccacucugc

SEQ ID NO: 844551 - RNA, 20 nt, Homo sapiens
acauuaaagaaggguugagc

SEQ ID NO: 844552 - RNA, 15 nt, Homo sapiens
accaacauggugaaa

SEQ ID NO: 844553 - RNA, 17 nt, Homo sapiens
accaaccuuuucccaac

SEQ ID NO: 844554 - RNA, 20 nt, Homo sapiens
accacagcaaggcaccugca

SEQ ID NO: 844555 - RNA, 17 nt, Homo sapiens
accacaucccacucaca

SEQ ID NO: 844556 - RNA, 16 nt, Homo sapiens
accagcccacauccag

SEQ ID NO: 844557 - RNA, 17 nt, Homo sapiens
accaggacuugugcaga

SEQ ID NO: 844558 - RNA, 13 nt, Homo sapiens
accaggucuccuc

SEQ ID NO: 844559 - RNA, 16 nt, Homo sapiens
accaucagugacucau

SEQ ID NO: 844560 - RNA, 23 nt, Homo sapiens
acccaccaguugaauuucaucau

SEQ ID NO: 844561 - RNA, 20 nt, Homo sapiens
acccaugcccugccaagccu

SEQ ID NO: 844562 - RNA, 17 nt, Homo sapiens
accccuguuaagcaauu

SEQ ID NO: 844563 - RNA, 15 nt, Homo sapiens
acccuccguugacag

SEQ ID NO: 844564 - RNA, 16 nt, Homo sapiens
acccugagacuuggcu

SEQ ID NO: 844565 - RNA, 20 nt, Homo sapiens
acccugucucuacuaaaaau

SEQ ID NO: 844566 - RNA, 14 nt, Homo sapiens
accuccagcucuca

SEQ ID NO: 844567 - RNA, 22 nt, Homo sapiens
accugggcugggagaaggugcu

SEQ ID NO: 844568 - RNA, 20 nt, Homo sapiens
accuguuccauuguugucaa

SEQ ID NO: 844569 - RNA, 13 nt, Homo sapiens
accuuuucccaac

SEQ ID NO: 844570 - RNA, 14 nt, Homo sapiens
acgaggaggaacca

SEQ ID NO: 844571 - RNA, 14 nt, Homo sapiens
acggccacagucau

SEQ ID NO: 844572 - RNA, 16 nt, Homo sapiens
acgucuuaucuaauca

SEQ ID NO: 844573 - RNA, 13 nt, Homo sapiens
acuaagaggcuau

SEQ ID NO: 844574 - RNA, 20 nt, Homo sapiens
acuagcugucucaggaguag

SEQ ID NO: 844575 - RNA, 16 nt, Homo sapiens
cucgaggcggaucuuu

SEQ ID NO: 844576 - RNA, 22 nt, Homo sapiens
cucgaggcggaucuuuggacag

SEQ ID NO: 844577 - RNA, 13 nt, Homo sapiens
cucuguccugacu

SEQ ID NO: 844578 - RNA, 20 nt, Homo sapiens
cucuuauggccaaauucaaa

SEQ ID NO: 844579 - RNA, 15 nt, Homo sapiens
cugaacaaagcaccu

SEQ ID NO: 844580 - RNA, 20 nt, Homo sapiens
cugaauauauaaacacucca

SEQ ID NO: 844581 - RNA, 17 nt, Homo sapiens
cugaccaacauggugaa

SEQ ID NO: 844582 - RNA, 14 nt, Homo sapiens
cugacuucaggggc

SEQ ID NO: 844583 - RNA, 16 nt, Homo sapiens
cugagcugugcccuau

SEQ ID NO: 844584 - RNA, 16 nt, Homo sapiens
cugagcuuuccgggga

SEQ ID NO: 844585 - RNA, 22 nt, Homo sapiens
cugagucaacuccuuucucauc

SEQ ID NO: 844586 - RNA, 14 nt, Homo sapiens
cugaguuugcacag

SEQ ID NO: 844587 - RNA, 12 nt, Homo sapiens
cugauaagcaaa

SEQ ID NO: 844588 - RNA, 19 nt, Homo sapiens
cugcccauuuccauggugc

SEQ ID NO: 844589 - RNA, 21 nt, Homo sapiens
cugcggugaggcaggggaguc

SEQ ID NO: 844590 - RNA, 17 nt, Homo sapiens
cugcucuccuugcccug

SEQ ID NO: 844591 - RNA, 23 nt, Homo sapiens
cugcuggaggggacgcuggcuaa

SEQ ID NO: 844592 - RNA, 17 nt, Homo sapiens
cuggaguccugcucugu

SEQ ID NO: 844593 - RNA, 14 nt, Homo sapiens
cuggaugacauuaa

SEQ ID NO: 844594 - RNA, 21 nt, Homo sapiens
cuggcccccucccuggaugac

SEQ ID NO: 844595 - RNA, 15 nt, Homo sapiens
cuggccugacuccca

SEQ ID NO: 844596 - RNA, 19 nt, Homo sapiens
cuggcuacuccauguuggc

SEQ ID NO: 844597 - RNA, 16 nt, Homo sapiens
cugggagaaggugcuu

SEQ ID NO: 844598 - RNA, 22 nt, Homo sapiens
cuggggugggggccaagucaca

SEQ ID NO: 844599 - RNA, 16 nt, Homo sapiens
cuggguuuucaggggc

SEQ ID NO: 844600 - RNA, 14 nt, Homo sapiens
cugucuacacuaag

SEQ ID NO: 844601 - RNA, 21 nt, Homo sapiens
cuguguauuuaacugccuugu

SEQ ID NO: 844602 - RNA, 12 nt, Homo sapiens
cuguuaagcaau

SEQ ID NO: 844603 - RNA, 18 nt, Homo sapiens
cuguucccauaaccccua

SEQ ID NO: 844604 - RNA, 22 nt, Homo sapiens
cuguuucugggcugucuauucu

SEQ ID NO: 844605 - RNA, 17 nt, Homo sapiens
cuguuuuccuuaccuau

SEQ ID NO: 844606 - RNA, 14 nt, Homo sapiens
cuuaccaagaucac

SEQ ID NO: 844607 - RNA, 16 nt, Homo sapiens
cuuaccuugcaucuca

SEQ ID NO: 844608 - RNA, 17 nt, Homo sapiens
cuuagguugacauucag

SEQ ID NO: 844609 - RNA, 14 nt, Homo sapiens
cuuauuaauuugac

SEQ ID NO: 844610 - RNA, 14 nt, Homo sapiens
cuucaggacacuca

SEQ ID NO: 844611 - RNA, 17 nt, Homo sapiens
cuucauuugcaauucau

SEQ ID NO: 844612 - RNA, 18 nt, Homo sapiens
cuuccgcucccaccagcc

SEQ ID NO: 844613 - RNA, 21 nt, Homo sapiens
cuucucacuagcugucucagg

SEQ ID NO: 844614 - RNA, 16 nt, Homo sapiens
cuucugccaccugccu

SEQ ID NO: 844615 - RNA, 12 nt, Homo sapiens
cuugcacugaau

SEQ ID NO: 844616 - RNA, 17 nt, Homo sapiens
cuugccuguaaucccag

SEQ ID NO: 844617 - RNA, 10 nt, Homo sapiens
cuugcugaug

SEQ ID NO: 844618 - RNA, 13 nt, Homo sapiens
cuuggacuugagg

SEQ ID NO: 844619 - RNA, 15 nt, Homo sapiens
cuugguaaauuguaa

SEQ ID NO: 844620 - RNA, 19 nt, Homo sapiens
cuugucaauaaaauccaua

SEQ ID NO: 844621 - RNA, 13 nt, Homo sapiens
cuuucuggcuuug

SEQ ID NO: 844622 - RNA, 13 nt, Homo sapiens
cuuucuucucucc

SEQ ID NO: 844623 - RNA, 14 nt, Homo sapiens
cuuucuucucucca

SEQ ID NO: 844624 - RNA, 11 nt, Homo sapiens
cuuuguuaaaa

SEQ ID NO: 844625 - RNA, 14 nt, Homo sapiens
cuuuucaucuccag

SEQ ID NO: 844626 - RNA, 20 nt, Homo sapiens
cuuuuuaaaguuuguucacu

SEQ ID NO: 844627 - RNA, 13 nt, Homo sapiens
gaaaaaauucuuu

SEQ ID NO: 844628 - RNA, 19 nt, Homo sapiens
gaaaaaucuaaguguuuca

SEQ ID NO: 844629 - RNA, 15 nt, Homo sapiens
gaaaacuuauuugag

SEQ ID NO: 844630 - RNA, 17 nt, Homo sapiens
gaaaaucauauaaucuu

SEQ ID NO: 844631 - RNA, 20 nt, Homo sapiens
gaacuugcugcugagugcac

SEQ ID NO: 844632 - RNA, 12 nt, Homo sapiens
gaagaacugaaa

SEQ ID NO: 844633 - RNA, 13 nt, Homo sapiens
gaagcaugaguua

SEQ ID NO: 844634 - RNA, 14 nt, Homo sapiens
gaagccaugugauu

SEQ ID NO: 844635 - RNA, 16 nt, Homo sapiens
gaaguuauucuugaca

SEQ ID NO: 844636 - RNA, 18 nt, Homo sapiens
gaauaaaauuguaaaauu

SEQ ID NO: 844637 - RNA, 21 nt, Homo sapiens
gaaucagccuacaggccucac

SEQ ID NO: 844638 - RNA, 19 nt, Homo sapiens
gacacacacguuauaauca

SEQ ID NO: 844639 - RNA, 15 nt, Homo sapiens
gacaggggcucagga

SEQ ID NO: 844640 - RNA, 13 nt, Homo sapiens
gacagucaccuca

SEQ ID NO: 844641 - RNA, 20 nt, Homo sapiens
gacagucaccucauggaauu

SEQ ID NO: 844642 - RNA, 19 nt, Homo sapiens
gacauuugcucauggaauu

SEQ ID NO: 844643 - RNA, 22 nt, Homo sapiens
gaccaacauggugaaacccugu

SEQ ID NO: 844644 - RNA, 21 nt, Homo sapiens
gaccacaguggccaagaucac

SEQ ID NO: 844645 - RNA, 22 nt, Homo sapiens
gaccacaguggccaagaucaca

SEQ ID NO: 844646 - RNA, 22 nt, Homo sapiens
gaccuucugaacaugaguguca

SEQ ID NO: 844647 - RNA, 13 nt, Homo sapiens
gacucaguguuga

SEQ ID NO: 844648 - RNA, 15 nt, Homo sapiens
gacucgucucaaaaa

SEQ ID NO: 844649 - RNA, 14 nt, Homo sapiens
gacucuuaagaaga

SEQ ID NO: 844650 - RNA, 23 nt, Homo sapiens
gacugcagaggagccaccugggc

SEQ ID NO: 844651 - RNA, 20 nt, Homo sapiens
gacuguaggcgccccugggg

SEQ ID NO: 844652 - RNA, 19 nt, Homo sapiens
gagaaacaggcccagagag

SEQ ID NO: 844653 - RNA, 17 nt, Homo sapiens
gagagauucaugcugau

SEQ ID NO: 844654 - RNA, 16 nt, Homo sapiens
gagaugaguugcaguu

SEQ ID NO: 844655 - RNA, 21 nt, Homo sapiens
gagcaaagucuaaaguuuaca

SEQ ID NO: 844656 - RNA, 21 nt, Homo sapiens
gagcccccaccugccugacca

SEQ ID NO: 844657 - RNA, 11 nt, Homo sapiens
gagcucaaggu

SEQ ID NO: 844658 - RNA, 17 nt, Homo sapiens
gagcuuuaguccuagag

SEQ ID NO: 844659 - RNA, 23 nt, Homo sapiens
gaggaagaaguguaacucaccag

SEQ ID NO: 844660 - RNA, 14 nt, Homo sapiens
gaggcccaugugac

SEQ ID NO: 844661 - RNA, 16 nt, Homo sapiens
gaggccccagguggga

SEQ ID NO: 844662 - RNA, 19 nt, Homo sapiens
gaggcgggggauccuggag

SEQ ID NO: 844663 - RNA, 21 nt, Homo sapiens
gaguaccccccugagagcaug

SEQ ID NO: 844664 - RNA, 20 nt, Homo sapiens
gaguagucucauaucaggga

SEQ ID NO: 844665 - RNA, 20 nt, Homo sapiens
gagugcaccacuucaaguga

SEQ ID NO: 844666 - RNA, 22 nt, Homo sapiens
gauauuaaccaggggccaugaa

SEQ ID NO: 844667 - RNA, 16 nt, Homo sapiens
gauauuuuuccauuuu

SEQ ID NO: 844668 - RNA, 15 nt, Homo sapiens
gaucuuuggacagaa

SEQ ID NO: 844669 - RNA, 16 nt, Homo sapiens
gaucuuuggacagaag

SEQ ID NO: 844670 - RNA, 17 nt, Homo sapiens
gaugacauuaaagaagg

SEQ ID NO: 844671 - RNA, 21 nt, Homo sapiens
gaugacauuaaagaaggguug

SEQ ID NO: 844672 - RNA, 15 nt, Homo sapiens
gaugaguugcaguuu

SEQ ID NO: 844673 - RNA, 18 nt, Homo sapiens
gauggagccagcucugca

SEQ ID NO: 844674 - RNA, 13 nt, Homo sapiens
gauuuuccuuccu

SEQ ID NO: 844675 - RNA, 21 nt, Homo sapiens
gcaaaauugucuaaaauguca

SEQ ID NO: 844676 - RNA, 12 nt, Homo sapiens
gcaaagucuaaa

SEQ ID NO: 844677 - RNA, 20 nt, Homo sapiens
gcaaccagaccauugucuca

SEQ ID NO: 844678 - RNA, 18 nt, Homo sapiens
gcaagagcucaaggucaa

SEQ ID NO: 844679 - RNA, 19 nt, Homo sapiens
gcaccacuguguauuuaac

SEQ ID NO: 844680 - RNA, 21 nt, Homo sapiens
gcacccuggauugaucggagc

SEQ ID NO: 844681 - RNA, 16 nt, Homo sapiens
gcacuugggcauuuau

SEQ ID NO: 844682 - RNA, 20 nt, Homo sapiens
gcagccccaggaccaagcuu

SEQ ID NO: 844683 - RNA, 13 nt, Homo sapiens
gcaggcuuucaag

SEQ ID NO: 844684 - RNA, 16 nt, Homo sapiens
gcaguucugaagaaga

SEQ ID NO: 844685 - RNA, 17 nt, Homo sapiens
gcaucugcucugagacg

SEQ ID NO: 844686 - RNA, 17 nt, Homo sapiens
gcauuccaacuaucuca

SEQ ID NO: 844687 - RNA, 22 nt, Homo sapiens
gccagauuuuccugaaaacccu

SEQ ID NO: 844688 - RNA, 22 nt, Homo sapiens
gccaguuggcuucugugccuga

SEQ ID NO: 844689 - RNA, 17 nt, Homo sapiens
gccaugauuuuagcaau

SEQ ID NO: 844690 - RNA, 18 nt, Homo sapiens
gccaugggcacugugggu

SEQ ID NO: 844691 - RNA, 23 nt, Homo sapiens
gcccccucccuggaugacauuaa

SEQ ID NO: 844692 - RNA, 17 nt, Homo sapiens
gccccggggccuguuau

SEQ ID NO: 844693 - RNA, 21 nt, Homo sapiens
gccgagauugcaccacugcac

SEQ ID NO: 844694 - RNA, 21 nt, Homo sapiens
gccuaaucaagucaaauggag

SEQ ID NO: 844695 - RNA, 16 nt, Homo sapiens
gccucccacagugacu

SEQ ID NO: 844696 - RNA, 17 nt, Homo sapiens
gccucuuagaugcaguu

SEQ ID NO: 844697 - RNA, 14 nt, Homo sapiens
gccugggagggcaa

SEQ ID NO: 844698 - RNA, 16 nt, Homo sapiens
gccuucucacuagcug

SEQ ID NO: 844699 - RNA, 19 nt, Homo sapiens
gccuucucccccccggggc

SEQ ID NO: 844700 - RNA, 17 nt, Homo sapiens
gcuaucgcaccacugug

SEQ ID NO: 844701 - RNA, 13 nt, Homo sapiens
gcuccaaacccuc

SEQ ID NO: 844702 - RNA, 22 nt, Homo sapiens
gcucugaagagauacccacaga

SEQ ID NO: 844703 - RNA, 17 nt, Homo sapiens
gcucugugggcugcacu

SEQ ID NO: 844704 - RNA, 22 nt, Homo sapiens
gcucuucuccauccuaccacaa

SEQ ID NO: 844705 - RNA, 20 nt, Homo sapiens
gcucuuuccuggcuacucca

SEQ ID NO: 844706 - RNA, 16 nt, Homo sapiens
gcugcagagagcaccu

SEQ ID NO: 844707 - RNA, 22 nt, Homo sapiens
gcugccuccacucccacuuccc

SEQ ID NO: 844708 - RNA, 21 nt, Homo sapiens
gcuggcuggggccuaucagug

SEQ ID NO: 844709 - RNA, 19 nt, Homo sapiens
gcuggguggcccauccccc

SEQ ID NO: 844710 - RNA, 14 nt, Homo sapiens
gcugguacuaagag

SEQ ID NO: 844711 - RNA, 13 nt, Homo sapiens
gcugucucaggag

SEQ ID NO: 844712 - RNA, 22 nt, Homo sapiens
gcuguggccaucaaccucugua

SEQ ID NO: 844713 - RNA, 22 nt, Homo sapiens
gcuguuggcugggggcaugggg

SEQ ID NO: 844714 - RNA, 23 nt, Homo sapiens
gcuuaguucaaguccugccucuu

SEQ ID NO: 844715 - RNA, 19 nt, Homo sapiens
gcuuauugucuagugaaac

SEQ ID NO: 844716 - RNA, 21 nt, Homo sapiens
gcuucauucaagucagcucuu

SEQ ID NO: 844717 - RNA, 16 nt, Homo sapiens
gcuucugccacuuccc

SEQ ID NO: 844718 - RNA, 20 nt, Homo sapiens
gcuuuaguccuagaggaccu

SEQ ID NO: 844719 - RNA, 14 nt, Homo sapiens
gcuuucaccagcca

SEQ ID NO: 844720 - RNA, 19 nt, Homo sapiens
ggaaggccuugcugucaug

SEQ ID NO: 844721 - RNA, 15 nt, Homo sapiens
ggacagaagcagcuc

SEQ ID NO: 844722 - RNA, 23 nt, Homo sapiens
ggacagcccuucuuuccacagaa

SEQ ID NO: 844723 - RNA, 19 nt, Homo sapiens
ggacagucaccucauggaa

SEQ ID NO: 844724 - RNA, 22 nt, Homo sapiens
ggaccccgagccuggcuccaaa

SEQ ID NO: 844725 - RNA, 13 nt, Homo sapiens
ggaucuuuggaca

SEQ ID NO: 844726 - RNA, 19 nt, Homo sapiens
ggauuuauuuuuccauuua

SEQ ID NO: 844727 - RNA, 14 nt, Homo sapiens
ggcaauagucaaau

SEQ ID NO: 844728 - RNA, 20 nt, Homo sapiens
ggcagugggucccacuuccc

SEQ ID NO: 844729 - RNA, 22 nt, Homo sapiens
ggccacagccacuaaucaggag

SEQ ID NO: 844730 - RNA, 16 nt, Homo sapiens
ggccacagucauggug

SEQ ID NO: 844731 - RNA, 16 nt, Homo sapiens
ggccaucaaccucugu

SEQ ID NO: 844732 - RNA, 13 nt, Homo sapiens
ggccaucuuccag

SEQ ID NO: 844733 - RNA, 17 nt, Homo sapiens
ggccuggcaagugggug

SEQ ID NO: 844734 - RNA, 15 nt, Homo sapiens
ggccugggagggcaa

SEQ ID NO: 844735 - RNA, 23 nt, Homo sapiens
ggcggaucuuuggacagaagcag

SEQ ID NO: 844736 - RNA, 19 nt, Homo sapiens
ggcuaggggcuggggccaa

SEQ ID NO: 844737 - RNA, 17 nt, Homo sapiens
ggcuccacgcccugggg

SEQ ID NO: 844738 - RNA, 18 nt, Homo sapiens
ggcugggagaaggugcuu

SEQ ID NO: 844739 - RNA, 20 nt, Homo sapiens
ggcuggguuuucaggggcuu

SEQ ID NO: 844740 - RNA, 19 nt, Homo sapiens
gggaauugaggacacugau

SEQ ID NO: 844741 - RNA, 22 nt, Homo sapiens
gggccuguuaugucaaacuguc

SEQ ID NO: 844742 - RNA, 17 nt, Homo sapiens
gggcugaguuugcacag

SEQ ID NO: 844743 - RNA, 14 nt, Homo sapiens
gggcugaugcaguu

SEQ ID NO: 844744 - RNA, 17 nt, Homo sapiens
ggggaauuaaguuucaa

SEQ ID NO: 844745 - RNA, 22 nt, Homo sapiens
ggguguuuauccuaucucucca

SEQ ID NO: 844746 - RNA, 15 nt, Homo sapiens
gguacuaggggcccg

SEQ ID NO: 844747 - RNA, 21 nt, Homo sapiens
ggucuggaauggacugggugc

SEQ ID NO: 844748 - RNA, 12 nt, Homo sapiens
ggugauggccag

SEQ ID NO: 844749 - RNA, 21 nt, Homo sapiens
ggugauggccagucaugugcu

SEQ ID NO: 844750 - RNA, 22 nt, Homo sapiens
gguuuaagaacgaaggagaaaa

SEQ ID NO: 844751 - RNA, 16 nt, Homo sapiens
guaaauacuugcaguu

SEQ ID NO: 844752 - RNA, 15 nt, Homo sapiens
guaacaguuguguca

SEQ ID NO: 844753 - RNA, 22 nt, Homo sapiens
guaaguaccccugauaagcaaa

SEQ ID NO: 844754 - RNA, 22 nt, Homo sapiens
guaauaauguuauuauuacucu

SEQ ID NO: 844755 - RNA, 18 nt, Homo sapiens
guacuccucacuuuucaa

SEQ ID NO: 844756 - RNA, 20 nt, Homo sapiens
guagaaaagaaaacauuuaa

SEQ ID NO: 844757 - RNA, 21 nt, Homo sapiens
guauauaacuaacaaccaaag

SEQ ID NO: 844758 - RNA, 23 nt, Homo sapiens
guauguuagugcaaauugucaca

SEQ ID NO: 844759 - RNA, 20 nt, Homo sapiens
guauuagaauaccacaggaa

SEQ ID NO: 844760 - RNA, 17 nt, Homo sapiens
guauugugauuaucaau

SEQ ID NO: 844761 - RNA, 19 nt, Homo sapiens
guauuuuaaaacauaagaa

SEQ ID NO: 844762 - RNA, 21 nt, Homo sapiens
guauuuuaggcagggauuuga

SEQ ID NO: 844763 - RNA, 22 nt, Homo sapiens
guauuuuaggcagggauuugag

SEQ ID NO: 844764 - RNA, 19 nt, Homo sapiens
gucacccccacucugcaua

SEQ ID NO: 844765 - RNA, 16 nt, Homo sapiens
gucauuugacaggggc

SEQ ID NO: 844766 - RNA, 21 nt, Homo sapiens
gucauuugacaggggcucagg

SEQ ID NO: 844767 - RNA, 22 nt, Homo sapiens
guccagccuaaucaagucaaau

SEQ ID NO: 844768 - RNA, 19 nt, Homo sapiens
guccaggucuaccaaaaau

SEQ ID NO: 844769 - RNA, 14 nt, Homo sapiens
guccucacaugccc

SEQ ID NO: 844770 - RNA, 13 nt, Homo sapiens
guccugucagugc

SEQ ID NO: 844771 - RNA, 14 nt, Homo sapiens
gucuuuguucuucu

SEQ ID NO: 844772 - RNA, 17 nt, Homo sapiens
gugacaagcucacagac

SEQ ID NO: 844773 - RNA, 13 nt, Homo sapiens
gugaggcagggga

SEQ ID NO: 844774 - RNA, 15 nt, Homo sapiens
gugccuguaauccca

SEQ ID NO: 844775 - RNA, 18 nt, Homo sapiens
gugcuuguaaaaagucaa

SEQ ID NO: 844776 - RNA, 22 nt, Homo sapiens
guggcucuugccuguaauccca

SEQ ID NO: 844777 - RNA, 17 nt, Homo sapiens
gugggacaacaaagagg

SEQ ID NO: 844778 - RNA, 21 nt, Homo sapiens
guggugcagccccaggaccaa

SEQ ID NO: 844779 - RNA, 22 nt, Homo sapiens
gugugguccagguccuuuccac

SEQ ID NO: 844780 - RNA, 16 nt, Homo sapiens
guguguaguaaaguau

SEQ ID NO: 844781 - RNA, 17 nt, Homo sapiens
guuauuggguaucacca

SEQ ID NO: 844782 - RNA, 16 nt, Homo sapiens
guucacccaaccacau

SEQ ID NO: 844783 - RNA, 17 nt, Homo sapiens
guucuucuuaaagucaa

SEQ ID NO: 844784 - RNA, 12 nt, Homo sapiens
guugacauggga

SEQ ID NO: 844785 - RNA, 16 nt, Homo sapiens
guuucauuguguguua

SEQ ID NO: 844786 - RNA, 15 nt, Homo sapiens
guuuguucacuuaaa

SEQ ID NO: 844787 - RNA, 23 nt, Homo sapiens
guuuguugugcuugcugguacua

SEQ ID NO: 844788 - RNA, 23 nt, Homo sapiens
guuuucuuucuaaugagauauua

SEQ ID NO: 844789 - RNA, 15 nt, Homo sapiens
uaaaacuccuguuuc

SEQ ID NO: 844790 - RNA, 18 nt, Homo sapiens
uaaaacuccuguuucacu

SEQ ID NO: 844791 - RNA, 15 nt, Homo sapiens
uaaauaacaaaucuc

SEQ ID NO: 844792 - RNA, 16 nt, Homo sapiens
uaaauguauaugucau

SEQ ID NO: 844793 - RNA, 12 nt, Homo sapiens
uaacaguugugu

SEQ ID NO: 844794 - RNA, 22 nt, Homo sapiens
uaacuaacaaccaaagacuaca

SEQ ID NO: 844795 - RNA, 16 nt, Homo sapiens
uaacuuucucuaugaa

SEQ ID NO: 844796 - RNA, 22 nt, Homo sapiens
uaagaaaaaauucuuucacuug

SEQ ID NO: 844797 - RNA, 15 nt, Homo sapiens
uaagacggauuuauu

SEQ ID NO: 844798 - RNA, 14 nt, Homo sapiens
uaagccuucauuug

SEQ ID NO: 844799 - RNA, 13 nt, Homo sapiens
uaagcuguaaaaa

SEQ ID NO: 844800 - RNA, 20 nt, Homo sapiens
uaauaaauguuaaagccaga

SEQ ID NO: 844801 - RNA, 17 nt, Homo sapiens
uaaugauaacuggaaac

SEQ ID NO: 844802 - RNA, 18 nt, Homo sapiens
uaauuuguaucugaagga

SEQ ID NO: 844803 - RNA, 13 nt, Homo sapiens
uacaaaguacaga

SEQ ID NO: 844804 - RNA, 15 nt, Homo sapiens
uacaaaguacagaaa

SEQ ID NO: 844805 - RNA, 14 nt, Homo sapiens
uacaccucugggcc

SEQ ID NO: 844806 - RNA, 24 nt, Homo sapiens
uacccucaucaaaaacacucucac

SEQ ID NO: 844807 - RNA, 17 nt, Homo sapiens
uaccuuuccagggucaa

SEQ ID NO: 844808 - RNA, 12 nt, Homo sapiens
uacucugaaauu

SEQ ID NO: 844809 - RNA, 17 nt, Homo sapiens
uacuugcaguugugaua

SEQ ID NO: 844810 - RNA, 22 nt, Homo sapiens
acuaggggcccggauccaggau

SEQ ID NO: 844811 - RNA, 22 nt, Homo sapiens
acucaccagccucugcucuuau

SEQ ID NO: 844812 - RNA, 18 nt, Homo sapiens
acucacuuucuagauuaa

SEQ ID NO: 844813 - RNA, 18 nt, Homo sapiens
acuccucuuauuugcuca

SEQ ID NO: 844814 - RNA, 18 nt, Homo sapiens
acucucacuaugcugcua

SEQ ID NO: 844815 - RNA, 19 nt, Homo sapiens
acucucacuaugcugcuau

SEQ ID NO: 844816 - RNA, 18 nt, Homo sapiens
acucugugcccaugggca

SEQ ID NO: 844817 - RNA, 20 nt, Homo sapiens
acucugugguccagagucaa

SEQ ID NO: 844818 - RNA, 11 nt, Homo sapiens
acucuguguaa

SEQ ID NO: 844819 - RNA, 20 nt, Homo sapiens
acucuuaagaagacugcauu

SEQ ID NO: 844820 - RNA, 19 nt, Homo sapiens
acugcacccccuccugcug

SEQ ID NO: 844821 - RNA, 14 nt, Homo sapiens
acuggaaacuucag

SEQ ID NO: 844822 - RNA, 20 nt, Homo sapiens
acuguccugcuccacagugu

SEQ ID NO: 844823 - RNA, 16 nt, Homo sapiens
acuguguguugacacu

SEQ ID NO: 844824 - RNA, 17 nt, Homo sapiens
acuguuuuccuuaccua

SEQ ID NO: 844825 - RNA, 19 nt, Homo sapiens
acuuagcaagaccugaaaa

SEQ ID NO: 844826 - RNA, 15 nt, Homo sapiens
acuuauauuuugauu

SEQ ID NO: 844827 - RNA, 20 nt, Homo sapiens
acuugagaagucuaauucac

SEQ ID NO: 844828 - RNA, 19 nt, Homo sapiens
acuugguucaguaccacau

SEQ ID NO: 844829 - RNA, 21 nt, Homo sapiens
acuuuauagaucagccaguga

SEQ ID NO: 844830 - RNA, 22 nt, Homo sapiens
acuuuauagaucagccagugac

SEQ ID NO: 844831 - RNA, 19 nt, Homo sapiens
acuuuccccaguacugagg

SEQ ID NO: 844832 - RNA, 22 nt, Homo sapiens
acuuucuucuagcugagcuuua

SEQ ID NO: 844833 - RNA, 18 nt, Homo sapiens
agaaaaucaguaauugga

SEQ ID NO: 844834 - RNA, 12 nt, Homo sapiens
agaaacauuugg

SEQ ID NO: 844835 - RNA, 12 nt, Homo sapiens
agaaagugacaa

SEQ ID NO: 844836 - RNA, 17 nt, Homo sapiens
agaaagugacaagcuca

SEQ ID NO: 844837 - RNA, 20 nt, Homo sapiens
agaacacuucagccugugca

SEQ ID NO: 844838 - RNA, 23 nt, Homo sapiens
agaacacuucagccugugcaggu

SEQ ID NO: 844839 - RNA, 12 nt, Homo sapiens
agaagugccagu

SEQ ID NO: 844840 - RNA, 16 nt, Homo sapiens
agaagugccaguugau

SEQ ID NO: 844841 - RNA, 21 nt, Homo sapiens
agaauacauugauacaaagua

SEQ ID NO: 844842 - RNA, 19 nt, Homo sapiens
agacaaaaucuuaaaugcc

SEQ ID NO: 844843 - RNA, 14 nt, Homo sapiens
agacaguauauaac

SEQ ID NO: 844844 - RNA, 22 nt, Homo sapiens
agacaugccaacucgggagcau

SEQ ID NO: 844845 - RNA, 18 nt, Homo sapiens
agacccauaccuuuccag

SEQ ID NO: 844846 - RNA, 23 nt, Homo sapiens
agacuuggcuccaccacugauau

SEQ ID NO: 844847 - RNA, 20 nt, Homo sapiens
agagaguaucugaggcacau

SEQ ID NO: 844848 - RNA, 20 nt, Homo sapiens
agagcaucugcucugagacg

SEQ ID NO: 844849 - RNA, 20 nt, Homo sapiens
agagccucucccacaccacu

SEQ ID NO: 844850 - RNA, 20 nt, Homo sapiens
agaguaccccccugagagca

SEQ ID NO: 844851 - RNA, 18 nt, Homo sapiens
agaguggcauuggcagca

SEQ ID NO: 844852 - RNA, 15 nt, Homo sapiens
agaguuuagcuggaa

SEQ ID NO: 844853 - RNA, 16 nt, Homo sapiens
agaguuuagcuggaaa

SEQ ID NO: 844854 - RNA, 22 nt, Homo sapiens
agaucacaguggccacggccac

SEQ ID NO: 844855 - RNA, 22 nt, Homo sapiens
agaucaccaguguguggcuuuc

SEQ ID NO: 844856 - RNA, 14 nt, Homo sapiens
agaucagccaguga

SEQ ID NO: 844857 - RNA, 22 nt, Homo sapiens
agaucguucauugccuuuccag

SEQ ID NO: 844858 - RNA, 19 nt, Homo sapiens
agaucuaacaagauagcca

SEQ ID NO: 844859 - RNA, 22 nt, Homo sapiens
agauguauguacuucaugcugu

SEQ ID NO: 844860 - RNA, 22 nt, Homo sapiens
agaugucuucaucacuucuucc

SEQ ID NO: 844861 - RNA, 14 nt, Homo sapiens
agauugucagcucc

SEQ ID NO: 844862 - RNA, 14 nt, Homo sapiens
agauuuuccugaaa

SEQ ID NO: 844863 - RNA, 21 nt, Homo sapiens
agauuuuccugaaaacccuug

SEQ ID NO: 844864 - RNA, 22 nt, Homo sapiens
agcagcuucugccacuucccag

SEQ ID NO: 844865 - RNA, 16 nt, Homo sapiens
agcagcuuucagcucu

SEQ ID NO: 844866 - RNA, 20 nt, Homo sapiens
agcaguaaauacuugcaguu

SEQ ID NO: 844867 - RNA, 15 nt, Homo sapiens
agcaugugggggaag

SEQ ID NO: 844868 - RNA, 12 nt, Homo sapiens
agcccacaucca

SEQ ID NO: 844869 - RNA, 14 nt, Homo sapiens
agccccacagccca

SEQ ID NO: 844870 - RNA, 14 nt, Homo sapiens
agcccugaacaaag

SEQ ID NO: 844871 - RNA, 20 nt, Homo sapiens
agcccugaacaaagcaccuc

SEQ ID NO: 844872 - RNA, 21 nt, Homo sapiens
agcccugaacaaagcaccuca

SEQ ID NO: 844873 - RNA, 21 nt, Homo sapiens
agccgagauugcaccacugca

SEQ ID NO: 844874 - RNA, 23 nt, Homo sapiens
agccuccguucccaccucugagg

SEQ ID NO: 844875 - RNA, 20 nt, Homo sapiens
agccucugguaaccucuuac

SEQ ID NO: 844876 - RNA, 18 nt, Homo sapiens
agccucuuagaugcaguu

SEQ ID NO: 844877 - RNA, 20 nt, Homo sapiens
agccuggagccccuguguug

SEQ ID NO: 844878 - RNA, 12 nt, Homo sapiens
agccuggcccag

SEQ ID NO: 844879 - RNA, 14 nt, Homo sapiens
agccuggcuccaaa

SEQ ID NO: 844880 - RNA, 21 nt, Homo sapiens
agccuuggggcugaugcaguu

SEQ ID NO: 844881 - RNA, 21 nt, Homo sapiens
agcucuucuccauccuaccac

SEQ ID NO: 844882 - RNA, 13 nt, Homo sapiens
agcugagcuuuaa

SEQ ID NO: 844883 - RNA, 18 nt, Homo sapiens
agcugcagagagcaccug

SEQ ID NO: 844884 - RNA, 15 nt, Homo sapiens
agcuucugcugggcu

SEQ ID NO: 844885 - RNA, 20 nt, Homo sapiens
aggacuuuagggaucugggg

SEQ ID NO: 844886 - RNA, 21 nt, Homo sapiens
aggagagcaucugcucugaga

SEQ ID NO: 844887 - RNA, 17 nt, Homo sapiens
aaaacucuuauggccaa

SEQ ID NO: 844888 - RNA, 16 nt, Homo sapiens
aaaauccauacauuug

SEQ ID NO: 844889 - RNA, 18 nt, Homo sapiens
aaacacucucacuaugcu

SEQ ID NO: 844890 - RNA, 15 nt, Homo sapiens
aaacagacuauuuaa

SEQ ID NO: 844891 - RNA, 22 nt, Homo sapiens
aaacagacuauuuaacuugagg

SEQ ID NO: 844892 - RNA, 15 nt, Homo sapiens
aaacaguauugacuu

SEQ ID NO: 844893 - RNA, 18 nt, Homo sapiens
aaacauaauaccaccauu

SEQ ID NO: 844894 - RNA, 16 nt, Homo sapiens
aaacauucacaccucu

SEQ ID NO: 844895 - RNA, 16 nt, Homo sapiens
aaaccuauacucacuu

SEQ ID NO: 844896 - RNA, 22 nt, Homo sapiens
aaacucuuauggccaaauucaa

SEQ ID NO: 844897 - RNA, 14 nt, Homo sapiens
aaacuggauucaca

SEQ ID NO: 844898 - RNA, 19 nt, Homo sapiens
aaacuuauuugagugauua

SEQ ID NO: 844899 - RNA, 14 nt, Homo sapiens
aaagaaaauuagua

SEQ ID NO: 844900 - RNA, 14 nt, Homo sapiens
aaagacuacauauu

SEQ ID NO: 844901 - RNA, 14 nt, Homo sapiens
aaagagaacuucca

SEQ ID NO: 844902 - RNA, 17 nt, Homo sapiens
aaaggcuaugauugucu

SEQ ID NO: 844903 - RNA, 14 nt, Homo sapiens
aaaguuuguugaaa

SEQ ID NO: 844904 - RNA, 14 nt, Homo sapiens
aaauaaagcucaag

SEQ ID NO: 844905 - RNA, 13 nt, Homo sapiens
aaauaugaguuuu

SEQ ID NO: 844906 - RNA, 12 nt, Homo sapiens
aaauauuuugcu

SEQ ID NO: 844907 - RNA, 16 nt, Homo sapiens
aaaucuaaguguuuca

SEQ ID NO: 844908 - RNA, 22 nt, Homo sapiens
aaaucuauuuuguaacuuucuc

SEQ ID NO: 844909 - RNA, 17 nt, Homo sapiens
aaauggcuuccuggcaa

SEQ ID NO: 844910 - RNA, 13 nt, Homo sapiens
aaauuguauagag

SEQ ID NO: 844911 - RNA, 12 nt, Homo sapiens
aacaaagcaccu

SEQ ID NO: 844912 - RNA, 22 nt, Homo sapiens
aacacucucacuaugcugcuau

SEQ ID NO: 844913 - RNA, 15 nt, Homo sapiens
aacaguuguuacuua

SEQ ID NO: 844914 - RNA, 20 nt, Homo sapiens
aacauaauaccaccauuuaa

SEQ ID NO: 844915 - RNA, 16 nt, Homo sapiens
aacaucuagcaguaaa

SEQ ID NO: 844916 - RNA, 20 nt, Homo sapiens
aacccaggaggcggagguug

SEQ ID NO: 844917 - RNA, 17 nt, Homo sapiens
aaccucuguauuugaau

SEQ ID NO: 844918 - RNA, 16 nt, Homo sapiens
aacuaacaaccaaaga

SEQ ID NO: 844919 - RNA, 17 nt, Homo sapiens
aacuaacaaccaaagac

SEQ ID NO: 844920 - RNA, 13 nt, Homo sapiens
aacuccuguuuca

SEQ ID NO: 844921 - RNA, 13 nt, Homo sapiens
aacuccuuucuca

SEQ ID NO: 844922 - RNA, 16 nt, Homo sapiens
aacuggguaugaggcu

SEQ ID NO: 844923 - RNA, 14 nt, Homo sapiens
aacuucccugaaaa

SEQ ID NO: 844924 - RNA, 12 nt, Homo sapiens
aagaaaggcaag

SEQ ID NO: 844925 - RNA, 14 nt, Homo sapiens
aagaaauuuuugcc

SEQ ID NO: 844926 - RNA, 14 nt, Homo sapiens
aagaacgucauuuu

SEQ ID NO: 844927 - RNA, 19 nt, Homo sapiens
aagagaacuuccagauccu

SEQ ID NO: 844928 - RNA, 17 nt, Homo sapiens
aagaggguacuaggggc

SEQ ID NO: 844929 - RNA, 21 nt, Homo sapiens
aagaugguaccaccagucuga

SEQ ID NO: 844930 - RNA, 17 nt, Homo sapiens
aagcaccucaagugcaa

SEQ ID NO: 844931 - RNA, 22 nt, Homo sapiens
aagcagacccauaccuuuccag

SEQ ID NO: 844932 - RNA, 15 nt, Homo sapiens
aagcccuuuacuuga

SEQ ID NO: 844933 - RNA, 21 nt, Homo sapiens
aagcugugccacccugggcuc

SEQ ID NO: 844934 - RNA, 13 nt, Homo sapiens
aaggcuuggcaca

SEQ ID NO: 844935 - RNA, 17 nt, Homo sapiens
aagucuuauuuccucaa

SEQ ID NO: 844936 - RNA, 19 nt, Homo sapiens
aagugacaagcucacagac

SEQ ID NO: 844937 - RNA, 21 nt, Homo sapiens
aaguugauuuuaagaauccaa

SEQ ID NO: 844938 - RNA, 16 nt, Homo sapiens
aauaaagucucuuccu

SEQ ID NO: 844939 - RNA, 15 nt, Homo sapiens
aauaaauaaacgagc

SEQ ID NO: 844940 - RNA, 19 nt, Homo sapiens
aauaccccuguuaagcaau

SEQ ID NO: 844941 - RNA, 21 nt, Homo sapiens
aauauugacuuuuuauggcac

SEQ ID NO: 844942 - RNA, 16 nt, Homo sapiens
aaucaugaaacucccu

SEQ ID NO: 844943 - RNA, 22 nt, Homo sapiens
aauccuugaagauuuaccacuu

SEQ ID NO: 844944 - RNA, 15 nt, Homo sapiens
aaucucaagcaaaca

SEQ ID NO: 844945 - RNA, 15 nt, Homo sapiens
aaucucaauauuuca

SEQ ID NO: 844946 - RNA, 21 nt, Homo sapiens
aaucucaauauuucagauaau

SEQ ID NO: 844947 - RNA, 16 nt, Homo sapiens
aaucugccuccuucac

SEQ ID NO: 844948 - RNA, 22 nt, Homo sapiens
aaugacagaaugcuguuuuaaa

SEQ ID NO: 844949 - RNA, 21 nt, Homo sapiens
aaugaccagcagcagcuuuca

SEQ ID NO: 844950 - RNA, 17 nt, Homo sapiens
aaugagagacacacuga

SEQ ID NO: 844951 - RNA, 17 nt, Homo sapiens
aauguaccgaugauacu

SEQ ID NO: 844952 - RNA, 14 nt, Homo sapiens
aauguuaagcuuua

SEQ ID NO: 844953 - RNA, 16 nt, Homo sapiens
aauuaguaauugucaa

SEQ ID NO: 844954 - RNA, 13 nt, Homo sapiens
aauuaucuuaaaa

SEQ ID NO: 844955 - RNA, 14 nt, Homo sapiens
aauucagaguccuu

SEQ ID NO: 844956 - RNA, 15 nt, Homo sapiens
aauuccuuuuugcag

SEQ ID NO: 844957 - RNA, 14 nt, Homo sapiens
aauucuuucacuug

SEQ ID NO: 844958 - RNA, 22 nt, Homo sapiens
aauuguaaguaccccugauaag

SEQ ID NO: 844959 - RNA, 12 nt, Homo sapiens
aauuguuugacc

SEQ ID NO: 844960 - RNA, 14 nt, Homo sapiens
acaaagcaccucaa

SEQ ID NO: 844961 - RNA, 10 nt, Homo sapiens
acaacaaaga

SEQ ID NO: 844962 - RNA, 20 nt, Homo sapiens
acaacuuguguucuauuaau

SEQ ID NO: 844963 - RNA, 14 nt, Homo sapiens
acaaggaugaauua

SEQ ID NO: 844964 - RNA, 19 nt, Homo sapiens
acacccagucuguucccca

SEQ ID NO: 844965 - RNA, 12 nt, Homo sapiens
acacucucacua

SEQ ID NO: 844966 - RNA, 13 nt, Homo sapiens
acagcacuaugua

SEQ ID NO: 844967 - RNA, 15 nt, Homo sapiens
acagcaggcuuucaa

SEQ ID NO: 844968 - RNA, 20 nt, Homo sapiens
acagccucuuagaugcaguu

SEQ ID NO: 844969 - RNA, 12 nt, Homo sapiens
acagcuaauaau

SEQ ID NO: 844970 - RNA, 22 nt, Homo sapiens
acaggacagcccuucuuuccac

SEQ ID NO: 844971 - RNA, 24 nt, Homo sapiens
acagucuccccagauauggaccau

SEQ ID NO: 844972 - RNA, 15 nt, Homo sapiens
acagugccuaauaau

SEQ ID NO: 844973 - RNA, 21 nt, Homo sapiens
acaguggccaagaucacagug

SEQ ID NO: 844974 - RNA, 17 nt, Homo sapiens
acauagcagacuuuccc

SEQ ID NO: 844975 - RNA, 15 nt, Homo sapiens
acauuuuuaguuuaa

SEQ ID NO: 844976 - RNA, 14 nt, Homo sapiens
accaaaaaucucaa

SEQ ID NO: 844977 - RNA, 18 nt, Homo sapiens
accaccagaucagguaua

SEQ ID NO: 844978 - RNA, 14 nt, Homo sapiens
accacccaccaguu

SEQ ID NO: 844979 - RNA, 20 nt, Homo sapiens
accacuggagaucaccagug

SEQ ID NO: 844980 - RNA, 17 nt, Homo sapiens
accagauugucagcucc

SEQ ID NO: 844981 - RNA, 21 nt, Homo sapiens
acccaaccacaucccacucac

SEQ ID NO: 844982 - RNA, 15 nt, Homo sapiens
acccaccaguugaau

SEQ ID NO: 844983 - RNA, 14 nt, Homo sapiens
accccaucugccca

SEQ ID NO: 844984 - RNA, 22 nt, Homo sapiens
accccucccagcugacaguccu

SEQ ID NO: 844985 - RNA, 18 nt, Homo sapiens
accccugauaagcaaauu

SEQ ID NO: 844986 - RNA, 16 nt, Homo sapiens
acccugccucuaccca

SEQ ID NO: 844987 - RNA, 21 nt, Homo sapiens
accgcuggccgagcugaagaa

SEQ ID NO: 844988 - RNA, 20 nt, Homo sapiens
accucaagugcaaggaccaa

SEQ ID NO: 844989 - RNA, 11 nt, Homo sapiens
accucaccaag

SEQ ID NO: 844990 - RNA, 20 nt, Homo sapiens
accuccagcucucaguuaca

SEQ ID NO: 844991 - RNA, 15 nt, Homo sapiens
accugccuucucacu

SEQ ID NO: 844992 - RNA, 16 nt, Homo sapiens
accugucaucugggcc

SEQ ID NO: 844993 - RNA, 20 nt, Homo sapiens
accuuuucccaaccauacaa

SEQ ID NO: 844994 - RNA, 15 nt, Homo sapiens
accuuuuuggacaca

SEQ ID NO: 844995 - RNA, 22 nt, Homo sapiens
acgagccuauuucucuuugcac

SEQ ID NO: 844996 - RNA, 14 nt, Homo sapiens
acgccacagucucc

SEQ ID NO: 844997 - RNA, 21 nt, Homo sapiens
acggcaccauccagcaccucc

SEQ ID NO: 844998 - RNA, 16 nt, Homo sapiens
acguuuaaagugcagu

SEQ ID NO: 844999 - RNA, 19 nt, Homo sapiens
acuacagggaccagggaug

SEQ ID NO: 845000 - RNA, 13 nt, Homo sapiens
acuagacaugcca

SEQ ID NO: 845001 - RNA, 14 nt, Homo sapiens
acuagucuguguaa

SEQ ID NO: 845002 - RNA, 16 nt, Homo sapiens
acuagucuguguaacu

SEQ ID NO: 845003 - RNA, 13 nt, Homo sapiens
acuaugcugcuau

SEQ ID NO: 845004 - RNA, 17 nt, Homo sapiens
acucaccagccucugcu

SEQ ID NO: 845005 - RNA, 19 nt, Homo sapiens
acucaccagccucugcucu

SEQ ID NO: 845006 - RNA, 20 nt, Homo sapiens
aucaauguucaucauguauc

SEQ ID NO: 845007 - RNA, 13 nt, Homo sapiens
aucaggaggccag

SEQ ID NO: 845008 - RNA, 17 nt, Homo sapiens
aucauauaaucuuacaa

SEQ ID NO: 845009 - RNA, 12 nt, Homo sapiens
aucauugcauuu

SEQ ID NO: 845010 - RNA, 21 nt, Homo sapiens
auccaguggggucucagucca

SEQ ID NO: 845011 - RNA, 12 nt, Homo sapiens
aucccagcacuu

SEQ ID NO: 845012 - RNA, 14 nt, Homo sapiens
auccccagcuuucu

SEQ ID NO: 845013 - RNA, 15 nt, Homo sapiens
aucccccagccucaa

SEQ ID NO: 845014 - RNA, 12 nt, Homo sapiens
auccuggcccau

SEQ ID NO: 845015 - RNA, 20 nt, Homo sapiens
aucgucucugccacuccuga

SEQ ID NO: 845016 - RNA, 21 nt, Homo sapiens
aucuagcaguaaauacuugca

SEQ ID NO: 845017 - RNA, 14 nt, Homo sapiens
aucucaguggcaca

SEQ ID NO: 845018 - RNA, 13 nt, Homo sapiens
aucugaggcacau

SEQ ID NO: 845019 - RNA, 15 nt, Homo sapiens
aucugcucugagacg

SEQ ID NO: 845020 - RNA, 14 nt, Homo sapiens
aucuuaaaugccag

SEQ ID NO: 845021 - RNA, 18 nt, Homo sapiens
aucuucaggacacucacu

SEQ ID NO: 845022 - RNA, 14 nt, Homo sapiens
aucuuguccccaac

SEQ ID NO: 845023 - RNA, 15 nt, Homo sapiens
aucuuucacagggga

SEQ ID NO: 845024 - RNA, 11 nt, Homo sapiens
aucuuuggaca

SEQ ID NO: 845025 - RNA, 23 nt, Homo sapiens
aucuuuggacagaagcagcucuu

SEQ ID NO: 845026 - RNA, 17 nt, Homo sapiens
augaaaaggacuuuaua

SEQ ID NO: 845027 - RNA, 19 nt, Homo sapiens
augaccagcagcagcuuuc

SEQ ID NO: 845028 - RNA, 20 nt, Homo sapiens
augaccagcagcagcuuuca

SEQ ID NO: 845029 - RNA, 13 nt, Homo sapiens
augacuuuuccau

SEQ ID NO: 845030 - RNA, 13 nt, Homo sapiens
augagcaguccag

SEQ ID NO: 845031 - RNA, 20 nt, Homo sapiens
augauuuuagcaauacccau

SEQ ID NO: 845032 - RNA, 12 nt, Homo sapiens
augcacuggccu

SEQ ID NO: 845033 - RNA, 15 nt, Homo sapiens
augcauacacucuca

SEQ ID NO: 845034 - RNA, 17 nt, Homo sapiens
augcauuuucuucacag

SEQ ID NO: 845035 - RNA, 19 nt, Homo sapiens
augccucacuuucuucuag

SEQ ID NO: 845036 - RNA, 20 nt, Homo sapiens
augccuuuucccaacuccag

SEQ ID NO: 845037 - RNA, 21 nt, Homo sapiens
augcuguuuuaaaaacaaaga

SEQ ID NO: 845038 - RNA, 19 nt, Homo sapiens
augcuuucgauaguguuaa

SEQ ID NO: 845039 - RNA, 19 nt, Homo sapiens
auggaauaaacuccauuua

SEQ ID NO: 845040 - RNA, 18 nt, Homo sapiens
auggacgaccuccagcuc

SEQ ID NO: 845041 - RNA, 12 nt, Homo sapiens
auggcauauaau

SEQ ID NO: 845042 - RNA, 19 nt, Homo sapiens
auggugcacuaauuucacu

SEQ ID NO: 845043 - RNA, 13 nt, Homo sapiens
auguaacuucccu

SEQ ID NO: 845044 - RNA, 18 nt, Homo sapiens
auguaguacuaacuaagg

SEQ ID NO: 845045 - RNA, 15 nt, Homo sapiens
auguauucagcuuua

SEQ ID NO: 845046 - RNA, 15 nt, Homo sapiens
auguauugauuacaa

SEQ ID NO: 845047 - RNA, 15 nt, Homo sapiens
augugaaucccucaa

SEQ ID NO: 845048 - RNA, 14 nt, Homo sapiens
auguguuccuccau

SEQ ID NO: 845049 - RNA, 23 nt, Homo sapiens
auguucacccaaccacaucccac

SEQ ID NO: 845050 - RNA, 17 nt, Homo sapiens
auguugacaugggacau

SEQ ID NO: 845051 - RNA, 14 nt, Homo sapiens
auuaaauccaauaa

SEQ ID NO: 845052 - RNA, 18 nt, Homo sapiens
auuaauuaucuaguuuaa

SEQ ID NO: 845053 - RNA, 13 nt, Homo sapiens
auuagagcuuaaa

SEQ ID NO: 845054 - RNA, 18 nt, Homo sapiens
auuaugaauuacauuugu

SEQ ID NO: 845055 - RNA, 13 nt, Homo sapiens
auucaugcugauu

SEQ ID NO: 845056 - RNA, 15 nt, Homo sapiens
auucauguaacaguu

SEQ ID NO: 845057 - RNA, 13 nt, Homo sapiens
auuccaucuugcc

SEQ ID NO: 845058 - RNA, 14 nt, Homo sapiens
auucccagccagca

SEQ ID NO: 845059 - RNA, 17 nt, Homo sapiens
auucucacacacauaca

SEQ ID NO: 845060 - RNA, 22 nt, Homo sapiens
auucucacacacauacauaccu

SEQ ID NO: 845061 - RNA, 21 nt, Homo sapiens
auucuuggguguuuauccuau

SEQ ID NO: 845062 - RNA, 17 nt, Homo sapiens
auuguaaaacauucaca

SEQ ID NO: 845063 - RNA, 15 nt, Homo sapiens
auuguaaguaccccu

SEQ ID NO: 845064 - RNA, 15 nt, Homo sapiens
auuguccguuuacuu

SEQ ID NO: 845065 - RNA, 21 nt, Homo sapiens
auuuaacauaaugguugugaa

SEQ ID NO: 845066 - RNA, 21 nt, Homo sapiens
auuuacaugaauugcauuuua

SEQ ID NO: 845067 - RNA, 17 nt, Homo sapiens
auuuaguaaaguuuguu

SEQ ID NO: 845068 - RNA, 17 nt, Homo sapiens
auuucugaaaugacaga

SEQ ID NO: 845069 - RNA, 14 nt, Homo sapiens
auuugcucauggaa

SEQ ID NO: 845070 - RNA, 14 nt, Homo sapiens
auuuguaaguuuau

SEQ ID NO: 845071 - RNA, 14 nt, Homo sapiens
auuuuuauccauuu

SEQ ID NO: 845072 - RNA, 23 nt, Homo sapiens
auuuuucacuucaaaacaguauu

SEQ ID NO: 845073 - RNA, 17 nt, Homo sapiens
caaaauuagugcuuuuu

SEQ ID NO: 845074 - RNA, 21 nt, Homo sapiens
caaagcaccucaagugcaagg

SEQ ID NO: 845075 - RNA, 19 nt, Homo sapiens
caaauaauuuuucacuuca

SEQ ID NO: 845076 - RNA, 22 nt, Homo sapiens
caaauguauugauuacaaauaa

SEQ ID NO: 845077 - RNA, 14 nt, Homo sapiens
caacaaagaggaca

SEQ ID NO: 845078 - RNA, 17 nt, Homo sapiens
caacaaagaggacacca

SEQ ID NO: 845079 - RNA, 17 nt, Homo sapiens
caacuaucucauuucca

SEQ ID NO: 845080 - RNA, 17 nt, Homo sapiens
caacucgggagcauucu

SEQ ID NO: 845081 - RNA, 19 nt, Homo sapiens
caacuuguguucuauuaau

SEQ ID NO: 845082 - RNA, 18 nt, Homo sapiens
caaggccucccacaguga

SEQ ID NO: 845083 - RNA, 18 nt, Homo sapiens
caagucagcucuucucca

SEQ ID NO: 845084 - RNA, 21 nt, Homo sapiens
caauuaccacaccaucuccca

SEQ ID NO: 845085 - RNA, 13 nt, Homo sapiens
cacaaauuaucuu

SEQ ID NO: 845086 - RNA, 20 nt, Homo sapiens
cacacacaaugugucugaga

SEQ ID NO: 845087 - RNA, 17 nt, Homo sapiens
cacauugagucuaucaa

SEQ ID NO: 845088 - RNA, 20 nt, Homo sapiens
cacgaggugguagcucugag

SEQ ID NO: 845089 - RNA, 20 nt, Homo sapiens
cacgggguauuuuaggcagg

SEQ ID NO: 845090 - RNA, 18 nt, Homo sapiens
cacuagcugucucaggag

SEQ ID NO: 845091 - RNA, 14 nt, Homo sapiens
cacucacuacaggg

SEQ ID NO: 845092 - RNA, 20 nt, Homo sapiens
cacuccugacccagcccuga

SEQ ID NO: 845093 - RNA, 16 nt, Homo sapiens
cacucucaaagcaaau

SEQ ID NO: 845094 - RNA, 19 nt, Homo sapiens
cacugccuucucaacucca

SEQ ID NO: 845095 - RNA, 15 nt, Homo sapiens
cacuggagaucacca

SEQ ID NO: 845096 - RNA, 15 nt, Homo sapiens
cacuggcugccucca

SEQ ID NO: 845097 - RNA, 17 nt, Homo sapiens
cacuguaaagccaguug

SEQ ID NO: 845098 - RNA, 15 nt, Homo sapiens
cacuguguguugaca

SEQ ID NO: 845099 - RNA, 16 nt, Homo sapiens
cacuuccccuccuacc

SEQ ID NO: 845100 - RNA, 17 nt, Homo sapiens
cacuuguguuuugcaag

SEQ ID NO: 845101 - RNA, 17 nt, Homo sapiens
cagacgccacagucucc

SEQ ID NO: 845102 - RNA, 22 nt, Homo sapiens
cagagaaaagucaggugcaguc

SEQ ID NO: 845103 - RNA, 22 nt, Homo sapiens
cagagcugcagagagcaccugg

SEQ ID NO: 845104 - RNA, 20 nt, Homo sapiens
cagagucaacuguucccaua

SEQ ID NO: 845105 - RNA, 19 nt, Homo sapiens
cagagugagacucgucuca

SEQ ID NO: 845106 - RNA, 16 nt, Homo sapiens
cagaucguucauugcc

SEQ ID NO: 845107 - RNA, 17 nt, Homo sapiens
cagccacuaaucaggag

SEQ ID NO: 845108 - RNA, 20 nt, Homo sapiens
cagccccuccccacaccagu

SEQ ID NO: 845109 - RNA, 16 nt, Homo sapiens
cagcccugaacaaagc

SEQ ID NO: 845110 - RNA, 20 nt, Homo sapiens
cagccuccagagaguaucug

SEQ ID NO: 845111 - RNA, 16 nt, Homo sapiens
cagccuggguggcaga

SEQ ID NO: 845112 - RNA, 14 nt, Homo sapiens
cagcuccuugaggg

SEQ ID NO: 845113 - RNA, 21 nt, Homo sapiens
cagcucugcauuaucugaggu

SEQ ID NO: 845114 - RNA, 23 nt, Homo sapiens
cagcugugaacauggacucuucc

SEQ ID NO: 845115 - RNA, 18 nt, Homo sapiens
caggaaagagaacuucca

SEQ ID NO: 845116 - RNA, 20 nt, Homo sapiens
caggaaagagaacuuccaga

SEQ ID NO: 845117 - RNA, 23 nt, Homo sapiens
caggaggaggugccaacaguguu

SEQ ID NO: 845118 - RNA, 21 nt, Homo sapiens
caggagggguuaaagcugccg

SEQ ID NO: 845119 - RNA, 18 nt, Homo sapiens
caggauauucacucugug

SEQ ID NO: 845120 - RNA, 19 nt, Homo sapiens
caggauguuugcucagcuu

SEQ ID NO: 845121 - RNA, 17 nt, Homo sapiens
caggccucacacacaau

SEQ ID NO: 845122 - RNA, 14 nt, Homo sapiens
caggggcucaggau

SEQ ID NO: 845123 - RNA, 20 nt, Homo sapiens
caguauauaacuaacaacca

SEQ ID NO: 845124 - RNA, 16 nt, Homo sapiens
cagucaccucauggaa

SEQ ID NO: 845125 - RNA, 13 nt, Homo sapiens
auaaucauuuauc

SEQ ID NO: 845126 - RNA, 15 nt, Homo sapiens
auacaaaaauuccuu

SEQ ID NO: 845127 - RNA, 23 nt, Homo sapiens
auacaaaaauuccuuuucccgaa

SEQ ID NO: 845128 - RNA, 14 nt, Homo sapiens
auacauacaugcau

SEQ ID NO: 845129 - RNA, 11 nt, Homo sapiens
auaccaggugc

SEQ ID NO: 845130 - RNA, 12 nt, Homo sapiens
auagaucagcca

SEQ ID NO: 845131 - RNA, 20 nt, Homo sapiens
auauaaacacuccacagugu

SEQ ID NO: 845132 - RNA, 14 nt, Homo sapiens
auauacucacuuuc

SEQ ID NO: 845133 - RNA, 14 nt, Homo sapiens
auauauugcugcug

SEQ ID NO: 845134 - RNA, 21 nt, Homo sapiens
auaugccuuuucccaacucca

SEQ ID NO: 845135 - RNA, 16 nt, Homo sapiens
auaugcucugauuuau

SEQ ID NO: 845136 - RNA, 17 nt, Homo sapiens
auaugcucugauuuauc

SEQ ID NO: 845137 - RNA, 18 nt, Homo sapiens
auauggaggaggcucugg

SEQ ID NO: 845138 - RNA, 16 nt, Homo sapiens
auauuuuaagccuuca

SEQ ID NO: 845139 - RNA, 14 nt, Homo sapiens
aucaauuaccacac

SEQ ID NO: 845140 - RNA, 17 nt, Homo sapiens
aucacuucuuccacugu

SEQ ID NO: 845141 - RNA, 15 nt, Homo sapiens
aucauugcauuucca

SEQ ID NO: 845142 - RNA, 12 nt, Homo sapiens
auccacaaagua

SEQ ID NO: 845143 - RNA, 11 nt, Homo sapiens
aucccacucac

SEQ ID NO: 845144 - RNA, 22 nt, Homo sapiens
aucccccacuguaaagccaguu

SEQ ID NO: 845145 - RNA, 12 nt, Homo sapiens
auccuaccacaa

SEQ ID NO: 845146 - RNA, 19 nt, Homo sapiens
auccuaucucuccaaccag

SEQ ID NO: 845147 - RNA, 18 nt, Homo sapiens
auccuggagccccugugu

SEQ ID NO: 845148 - RNA, 20 nt, Homo sapiens
aucguucauugccuuuccag

SEQ ID NO: 845149 - RNA, 17 nt, Homo sapiens
aucuaccucacuauuca

SEQ ID NO: 845150 - RNA, 16 nt, Homo sapiens
aucuucaggacacuca

SEQ ID NO: 845151 - RNA, 16 nt, Homo sapiens
augaaguccaagcauu

SEQ ID NO: 845152 - RNA, 19 nt, Homo sapiens
augaauugcauuuuacuuu

SEQ ID NO: 845153 - RNA, 20 nt, Homo sapiens
augacagaaugcuguuuuaa

SEQ ID NO: 845154 - RNA, 21 nt, Homo sapiens
augaccagcagcagcuuucag

SEQ ID NO: 845155 - RNA, 17 nt, Homo sapiens
augagugucaacuccag

SEQ ID NO: 845156 - RNA, 15 nt, Homo sapiens
augauaacuggaaac

SEQ ID NO: 845157 - RNA, 18 nt, Homo sapiens
augauacuguuucuugca

SEQ ID NO: 845158 - RNA, 23 nt, Homo sapiens
augaucuagagccaguuacuuug

SEQ ID NO: 845159 - RNA, 16 nt, Homo sapiens
augcauacacucucaa

SEQ ID NO: 845160 - RNA, 17 nt, Homo sapiens
augcuccgucauuugac

SEQ ID NO: 845161 - RNA, 19 nt, Homo sapiens
augcucugauuuaucugag

SEQ ID NO: 845162 - RNA, 17 nt, Homo sapiens
auggacucuucccccac

SEQ ID NO: 845163 - RNA, 18 nt, Homo sapiens
auggaggaaagugauauc

SEQ ID NO: 845164 - RNA, 19 nt, Homo sapiens
auggucacccccacucugc

SEQ ID NO: 845165 - RNA, 13 nt, Homo sapiens
auguaacaugaag

SEQ ID NO: 845166 - RNA, 15 nt, Homo sapiens
auguauguacuucau

SEQ ID NO: 845167 - RNA, 18 nt, Homo sapiens
augucaugccucacuuuc

SEQ ID NO: 845168 - RNA, 15 nt, Homo sapiens
augucugcagguuuc

SEQ ID NO: 845169 - RNA, 21 nt, Homo sapiens
auguuacuaaaugguguuaca

SEQ ID NO: 845170 - RNA, 12 nt, Homo sapiens
auguuagugcaa

SEQ ID NO: 845171 - RNA, 22 nt, Homo sapiens
auguucacccaaccacauccca

SEQ ID NO: 845172 - RNA, 18 nt, Homo sapiens
auuaccugucaucugggc

SEQ ID NO: 845173 - RNA, 22 nt, Homo sapiens
auuauaccgcuaucauuccaaa

SEQ ID NO: 845174 - RNA, 17 nt, Homo sapiens
auuaucaauuaccacac

SEQ ID NO: 845175 - RNA, 23 nt, Homo sapiens
auucacucugugguccagaguca

SEQ ID NO: 845176 - RNA, 17 nt, Homo sapiens
auucagaaaacuucaag

SEQ ID NO: 845177 - RNA, 17 nt, Homo sapiens
auucuugacaugagaaa

SEQ ID NO: 845178 - RNA, 15 nt, Homo sapiens
auucuuucacuugau

SEQ ID NO: 845179 - RNA, 17 nt, Homo sapiens
auugacuuguauaccuu

SEQ ID NO: 845180 - RNA, 14 nt, Homo sapiens
auugaggacacuga

SEQ ID NO: 845181 - RNA, 15 nt, Homo sapiens
auugaggacacugau

SEQ ID NO: 845182 - RNA, 15 nt, Homo sapiens
auuggaaaggcagcu

SEQ ID NO: 845183 - RNA, 14 nt, Homo sapiens
auugggaagcugua

SEQ ID NO: 845184 - RNA, 22 nt, Homo sapiens
auuguaaacagcuaauaaugaa

SEQ ID NO: 845185 - RNA, 14 nt, Homo sapiens
auugucagcuccuu

SEQ ID NO: 845186 - RNA, 15 nt, Homo sapiens
auuuauauuccacuu

SEQ ID NO: 845187 - RNA, 20 nt, Homo sapiens
auuuaugccucuguauuuaa

SEQ ID NO: 845188 - RNA, 13 nt, Homo sapiens
auuugcucaugga

SEQ ID NO: 845189 - RNA, 16 nt, Homo sapiens
auuugcucauggaauu

SEQ ID NO: 845190 - RNA, 12 nt, Homo sapiens
auuuuagcuuca

SEQ ID NO: 845191 - RNA, 18 nt, Homo sapiens
auuuuagcuucaguuguu

SEQ ID NO: 845192 - RNA, 13 nt, Homo sapiens
auuuuccugaaaa

SEQ ID NO: 845193 - RNA, 19 nt, Homo sapiens
auuuuccuuccuacacccu

SEQ ID NO: 845194 - RNA, 18 nt, Homo sapiens
auuuugaaaccaugaaga

SEQ ID NO: 845195 - RNA, 13 nt, Homo sapiens
auuuuuccauuua

SEQ ID NO: 845196 - RNA, 20 nt, Homo sapiens
caaaaauagcccugcaaaaa

SEQ ID NO: 845197 - RNA, 20 nt, Homo sapiens
caaacguuaagaauuguuaa

SEQ ID NO: 845198 - RNA, 21 nt, Homo sapiens
caaacuggggccucccugguc

SEQ ID NO: 845199 - RNA, 22 nt, Homo sapiens
caaagacuacauauugucacug

SEQ ID NO: 845200 - RNA, 20 nt, Homo sapiens
caaagcaccucaagugcaag

SEQ ID NO: 845201 - RNA, 13 nt, Homo sapiens
caacaucuaguga

SEQ ID NO: 845202 - RNA, 20 nt, Homo sapiens
caaccccuccccuccauccc

SEQ ID NO: 845203 - RNA, 23 nt, Homo sapiens
caagagccacaguauauuucccu

SEQ ID NO: 845204 - RNA, 20 nt, Homo sapiens
caagccuggagccccugugu

SEQ ID NO: 845205 - RNA, 15 nt, Homo sapiens
caaggugggggagcc

SEQ ID NO: 845206 - RNA, 13 nt, Homo sapiens
caagucagcucuu

SEQ ID NO: 845207 - RNA, 16 nt, Homo sapiens
cacaagacugcacauc

SEQ ID NO: 845208 - RNA, 15 nt, Homo sapiens
cacaaugcagugccu

SEQ ID NO: 845209 - RNA, 12 nt, Homo sapiens
cacacugaagaa

SEQ ID NO: 845210 - RNA, 16 nt, Homo sapiens
cacagauguucaccca

SEQ ID NO: 845211 - RNA, 20 nt, Homo sapiens
cacagcaggcuuucaagaag

SEQ ID NO: 845212 - RNA, 21 nt, Homo sapiens
cacagccucuuagaugcaguu

SEQ ID NO: 845213 - RNA, 12 nt, Homo sapiens
caccagucugac

SEQ ID NO: 845214 - RNA, 19 nt, Homo sapiens
caccaguguguggcuuuca

SEQ ID NO: 845215 - RNA, 19 nt, Homo sapiens
caccuaguggcuguccagu

SEQ ID NO: 845216 - RNA, 20 nt, Homo sapiens
caccuaguggcuguccagug

SEQ ID NO: 845217 - RNA, 20 nt, Homo sapiens
cacucucaaagcaaauaauu

SEQ ID NO: 845218 - RNA, 10 nt, Homo sapiens
cacugaagaa

SEQ ID NO: 845219 - RNA, 13 nt, Homo sapiens
cacugauauccuc

SEQ ID NO: 845220 - RNA, 19 nt, Homo sapiens
cacuggagaucaccagugu

SEQ ID NO: 845221 - RNA, 16 nt, Homo sapiens
cacuucaaaacaguau

SEQ ID NO: 845222 - RNA, 22 nt, Homo sapiens
cagaaagugacaagcucacaga

SEQ ID NO: 845223 - RNA, 20 nt, Homo sapiens
cagaacuuaaggauggagcc

SEQ ID NO: 845224 - RNA, 21 nt, Homo sapiens
cagaauuuaaaccuauacuca

SEQ ID NO: 845225 - RNA, 21 nt, Homo sapiens
cagacucuuuuuguaccuggu

SEQ ID NO: 845226 - RNA, 14 nt, Homo sapiens
cagaguuuguauug

SEQ ID NO: 845227 - RNA, 14 nt, Homo sapiens
cagcaaaccucagu

SEQ ID NO: 845228 - RNA, 20 nt, Homo sapiens
cagcagugagcuucuauuaa

SEQ ID NO: 845229 - RNA, 21 nt, Homo sapiens
cagcagugagcuucuauuaaa

SEQ ID NO: 845230 - RNA, 19 nt, Homo sapiens
cagccucuuagaugcaguu

SEQ ID NO: 845231 - RNA, 21 nt, Homo sapiens
cagccugaccaacauggugaa

SEQ ID NO: 845232 - RNA, 20 nt, Homo sapiens
caggaggcggagguugcagu

SEQ ID NO: 845233 - RNA, 15 nt, Homo sapiens
caggcacagcacagg

SEQ ID NO: 845234 - RNA, 17 nt, Homo sapiens
caggcagaucacaaggu

SEQ ID NO: 845235 - RNA, 14 nt, Homo sapiens
caggggcaggcaca

SEQ ID NO: 845236 - RNA, 21 nt, Homo sapiens
caggggcuuuggaagcucugu

SEQ ID NO: 845237 - RNA, 14 nt, Homo sapiens
cagguccuuuccac

SEQ ID NO: 845238 - RNA, 20 nt, Homo sapiens
cagguccuuuccacccugag

SEQ ID NO: 845239 - RNA, 13 nt, Homo sapiens
caguauauaacua

SEQ ID NO: 845240 - RNA, 15 nt, Homo sapiens
cagucaccucaugga

SEQ ID NO: 845241 - RNA, 22 nt, Homo sapiens
cagucaugguggccacggccac

SEQ ID NO: 845242 - RNA, 15 nt, Homo sapiens
cagugucuuccugug

SEQ ID NO: 845243 - RNA, 23 nt, Homo sapiens
cagugugaggcuguaacuuauac

SEQ ID NO: 845244 - RNA, 23 nt, Homo sapiens
cuuccagguggggugaggcagug

SEQ ID NO: 845245 - RNA, 17 nt, Homo sapiens
cuucucccccccggggc

SEQ ID NO: 845246 - RNA, 19 nt, Homo sapiens
cuucuuaggguuaugauua

SEQ ID NO: 845247 - RNA, 15 nt, Homo sapiens
cuugcccugagcuuu

SEQ ID NO: 845248 - RNA, 16 nt, Homo sapiens
cuugcugauggcugcu

SEQ ID NO: 845249 - RNA, 23 nt, Homo sapiens
cuuggcacacagcaggcuuucaa

SEQ ID NO: 845250 - RNA, 18 nt, Homo sapiens
cuuggggcugaugcaguu

SEQ ID NO: 845251 - RNA, 20 nt, Homo sapiens
cuugucaauaaaauccauac

SEQ ID NO: 845252 - RNA, 13 nt, Homo sapiens
cuuucagcuguga

SEQ ID NO: 845253 - RNA, 16 nt, Homo sapiens
cuuucagcugugaaca

SEQ ID NO: 845254 - RNA, 21 nt, Homo sapiens
cuuuccagggucaaaguacag

SEQ ID NO: 845255 - RNA, 12 nt, Homo sapiens
cuuucuucuccc

SEQ ID NO: 845256 - RNA, 21 nt, Homo sapiens
cuuucuucucccaauucaucc

SEQ ID NO: 845257 - RNA, 19 nt, Homo sapiens
cuuuggacagaagcagcuc

SEQ ID NO: 845258 - RNA, 22 nt, Homo sapiens
cuuuguagaacugcccauuucc

SEQ ID NO: 845259 - RNA, 16 nt, Homo sapiens
cuuuuauaaaccucua

SEQ ID NO: 845260 - RNA, 18 nt, Homo sapiens
cuuuucaucuccagugug

SEQ ID NO: 845261 - RNA, 16 nt, Homo sapiens
cuuuuccauguaucua

SEQ ID NO: 845262 - RNA, 17 nt, Homo sapiens
cuuuuuggacacacaaa

SEQ ID NO: 845263 - RNA, 23 nt, Homo sapiens
gaaaagaaaacauuuaacauaau

SEQ ID NO: 845264 - RNA, 22 nt, Homo sapiens
gaaaggcuuggcacacagcagg

SEQ ID NO: 845265 - RNA, 17 nt, Homo sapiens
gaacacuagacaugcca

SEQ ID NO: 845266 - RNA, 19 nt, Homo sapiens
gaacaucuggggacuaaua

SEQ ID NO: 845267 - RNA, 20 nt, Homo sapiens
gaagaagaugguaccaccag

SEQ ID NO: 845268 - RNA, 18 nt, Homo sapiens
gaagagauacccacagag

SEQ ID NO: 845269 - RNA, 18 nt, Homo sapiens
gaagagauuuuucaugau

SEQ ID NO: 845270 - RNA, 17 nt, Homo sapiens
gaagcaccaaucaugaa

SEQ ID NO: 845271 - RNA, 23 nt, Homo sapiens
gaagccuuggggcugaugcaguu

SEQ ID NO: 845272 - RNA, 12 nt, Homo sapiens
gaagugccaguu

SEQ ID NO: 845273 - RNA, 20 nt, Homo sapiens
gaagugcuuucuucucccaa

SEQ ID NO: 845274 - RNA, 17 nt, Homo sapiens
gaaguguaacucaccag

SEQ ID NO: 845275 - RNA, 19 nt, Homo sapiens
gaaucacugcucacacugc

SEQ ID NO: 845276 - RNA, 15 nt, Homo sapiens
gaaugagagacacac

SEQ ID NO: 845277 - RNA, 22 nt, Homo sapiens
gaaugauuaugaauuacauuug

SEQ ID NO: 845278 - RNA, 13 nt, Homo sapiens
gacagaagcagcu

SEQ ID NO: 845279 - RNA, 14 nt, Homo sapiens
gacagaagcagcuc

SEQ ID NO: 845280 - RNA, 16 nt, Homo sapiens
gacaggggcucaggau

SEQ ID NO: 845281 - RNA, 17 nt, Homo sapiens
gacauauaccuucucaa

SEQ ID NO: 845282 - RNA, 19 nt, Homo sapiens
gacaucgucucugccacuc

SEQ ID NO: 845283 - RNA, 15 nt, Homo sapiens
gacaugggacauuug

SEQ ID NO: 845284 - RNA, 20 nt, Homo sapiens
gacccagcccugaacaaagc

SEQ ID NO: 845285 - RNA, 20 nt, Homo sapiens
gacucccaugcaaguagcug

SEQ ID NO: 845286 - RNA, 20 nt, Homo sapiens
gagaaaacuuauuugaguga

SEQ ID NO: 845287 - RNA, 21 nt, Homo sapiens
gagacaaaaucuuaaaugcca

SEQ ID NO: 845288 - RNA, 17 nt, Homo sapiens
gagagcaucugcucuga

SEQ ID NO: 845289 - RNA, 21 nt, Homo sapiens
gagaucccacccgaacgucuu

SEQ ID NO: 845290 - RNA, 15 nt, Homo sapiens
gagauuuuucaugau

SEQ ID NO: 845291 - RNA, 16 nt, Homo sapiens
gagccuggcuccaaac

SEQ ID NO: 845292 - RNA, 19 nt, Homo sapiens
gagccuggcuccaaacccu

SEQ ID NO: 845293 - RNA, 17 nt, Homo sapiens
gagcuggaccucaccaa

SEQ ID NO: 845294 - RNA, 16 nt, Homo sapiens
gaggaggaaccaggcu

SEQ ID NO: 845295 - RNA, 14 nt, Homo sapiens
gaggcggaucuuug

SEQ ID NO: 845296 - RNA, 18 nt, Homo sapiens
gagggaccaggugucuag

SEQ ID NO: 845297 - RNA, 17 nt, Homo sapiens
gagggcgaggcggggga

SEQ ID NO: 845298 - RNA, 20 nt, Homo sapiens
gagguugucuguggccagaa

SEQ ID NO: 845299 - RNA, 18 nt, Homo sapiens
gagucaacuccuuucuca

SEQ ID NO: 845300 - RNA, 15 nt, Homo sapiens
gauauuuuucaugau

SEQ ID NO: 845301 - RNA, 14 nt, Homo sapiens
gaucuuuggacaga

SEQ ID NO: 845302 - RNA, 19 nt, Homo sapiens
gauggagauauuuacauga

SEQ ID NO: 845303 - RNA, 20 nt, Homo sapiens
gauggccagucaugugcugg

SEQ ID NO: 845304 - RNA, 22 nt, Homo sapiens
gauuaaguaaugauaacuggaa

SEQ ID NO: 845305 - RNA, 18 nt, Homo sapiens
gauuaucaauuaccacac

SEQ ID NO: 845306 - RNA, 23 nt, Homo sapiens
gauuauuuguuauuuguacaguu

SEQ ID NO: 845307 - RNA, 17 nt, Homo sapiens
gauuguacgugggagag

SEQ ID NO: 845308 - RNA, 14 nt, Homo sapiens
gcaaauugucacag

SEQ ID NO: 845309 - RNA, 20 nt, Homo sapiens
gcagacccauaccuuuccag

SEQ ID NO: 845310 - RNA, 14 nt, Homo sapiens
gcagagagcaccug

SEQ ID NO: 845311 - RNA, 15 nt, Homo sapiens
gcagccccaggacca

SEQ ID NO: 845312 - RNA, 15 nt, Homo sapiens
gcagcuucugccacu

SEQ ID NO: 845313 - RNA, 16 nt, Homo sapiens
gcaggcuccaguugaa

SEQ ID NO: 845314 - RNA, 21 nt, Homo sapiens
gcaggguauugcgaaacaacu

SEQ ID NO: 845315 - RNA, 15 nt, Homo sapiens
gcagugagcuucuau

SEQ ID NO: 845316 - RNA, 23 nt, Homo sapiens
gccaaauaaagucucuuccucca

SEQ ID NO: 845317 - RNA, 11 nt, Homo sapiens
gccacaguaua

SEQ ID NO: 845318 - RNA, 19 nt, Homo sapiens
gccacagucaugguggcca

SEQ ID NO: 845319 - RNA, 16 nt, Homo sapiens
gccacggccacaguca

SEQ ID NO: 845320 - RNA, 16 nt, Homo sapiens
gccauaccaggugcua

SEQ ID NO: 845321 - RNA, 23 nt, Homo sapiens
gcccccuggugggacaacaaaga

SEQ ID NO: 845322 - RNA, 19 nt, Homo sapiens
gcccuccuucuugcccuga

SEQ ID NO: 845323 - RNA, 14 nt, Homo sapiens
gcccugaacaaagc

SEQ ID NO: 845324 - RNA, 19 nt, Homo sapiens
gcccugaacaaagcaccuc

SEQ ID NO: 845325 - RNA, 19 nt, Homo sapiens
gccgucgaguugaccuucu

SEQ ID NO: 845326 - RNA, 16 nt, Homo sapiens
gccuaaucaagucaaa

SEQ ID NO: 845327 - RNA, 14 nt, Homo sapiens
gccuacaggccuca

SEQ ID NO: 845328 - RNA, 15 nt, Homo sapiens
gccucccacagugac

SEQ ID NO: 845329 - RNA, 18 nt, Homo sapiens
gccucugugucacuggcu

SEQ ID NO: 845330 - RNA, 13 nt, Homo sapiens
gccugacucugug

SEQ ID NO: 845331 - RNA, 11 nt, Homo sapiens
gccugcugagc

SEQ ID NO: 845332 - RNA, 15 nt, Homo sapiens
gccuggcuccaaacc

SEQ ID NO: 845333 - RNA, 20 nt, Homo sapiens
gccuuggggcugaugcaguu

SEQ ID NO: 845334 - RNA, 15 nt, Homo sapiens
gcgaccccaucugcc

SEQ ID NO: 845335 - RNA, 18 nt, Homo sapiens
gcgacuggaggcaggacu

SEQ ID NO: 845336 - RNA, 18 nt, Homo sapiens
gcggaucuuuggacagaa

SEQ ID NO: 845337 - RNA, 19 nt, Homo sapiens
gcuacuuuccccaguacug

SEQ ID NO: 845338 - RNA, 13 nt, Homo sapiens
gcuaggagccagu

SEQ ID NO: 845339 - RNA, 12 nt, Homo sapiens
gcucccaccagc

SEQ ID NO: 845340 - RNA, 15 nt, Homo sapiens
gcucugcuaugagug

SEQ ID NO: 845341 - RNA, 16 nt, Homo sapiens
gcucuggaguccugcu

SEQ ID NO: 845342 - RNA, 13 nt, Homo sapiens
caguuagccucug

SEQ ID NO: 845343 - RNA, 20 nt, Homo sapiens
cauacaugcauacacucuca

SEQ ID NO: 845344 - RNA, 20 nt, Homo sapiens
cauaccagagucuggagcug

SEQ ID NO: 845345 - RNA, 14 nt, Homo sapiens
cauaccaggugcua

SEQ ID NO: 845346 - RNA, 15 nt, Homo sapiens
cauauaaucuuacaa

SEQ ID NO: 845347 - RNA, 23 nt, Homo sapiens
cauauggaggaggcucuggaguc

SEQ ID NO: 845348 - RNA, 20 nt, Homo sapiens
caucccaugagcaguccaga

SEQ ID NO: 845349 - RNA, 13 nt, Homo sapiens
cauccuaccacaa

SEQ ID NO: 845350 - RNA, 19 nt, Homo sapiens
caucuggaggcucccaugg

SEQ ID NO: 845351 - RNA, 17 nt, Homo sapiens
caucuggggacuaauau

SEQ ID NO: 845352 - RNA, 17 nt, Homo sapiens
caugacuuuuccaugua

SEQ ID NO: 845353 - RNA, 17 nt, Homo sapiens
caugagcaguccagagc

SEQ ID NO: 845354 - RNA, 16 nt, Homo sapiens
cauggaauuggagcuc

SEQ ID NO: 845355 - RNA, 12 nt, Homo sapiens
caugugccugua

SEQ ID NO: 845356 - RNA, 18 nt, Homo sapiens
cauuaaagaaggguugag

SEQ ID NO: 845357 - RNA, 15 nt, Homo sapiens
cauugauacaaagua

SEQ ID NO: 845358 - RNA, 18 nt, Homo sapiens
cauugauacaaaguacag

SEQ ID NO: 845359 - RNA, 13 nt, Homo sapiens
cauuuaucauaua

SEQ ID NO: 845360 - RNA, 19 nt, Homo sapiens
cauuuccauggugcaaaaa

SEQ ID NO: 845361 - RNA, 14 nt, Homo sapiens
cauuugcucaugga

SEQ ID NO: 845362 - RNA, 22 nt, Homo sapiens
ccacagaagugcuuucuucucc

SEQ ID NO: 845363 - RNA, 15 nt, Homo sapiens
ccacaggaaccacaa

SEQ ID NO: 845364 - RNA, 14 nt, Homo sapiens
ccaccgcaugcccc

SEQ ID NO: 845365 - RNA, 21 nt, Homo sapiens
uauuaucuucaggacacucac

SEQ ID NO: 845366 - RNA, 13 nt, Homo sapiens
uauucaaguauua

SEQ ID NO: 845367 - RNA, 12 nt, Homo sapiens
uauugauuacaa

SEQ ID NO: 845368 - RNA, 16 nt, Homo sapiens
uauuuuuuaaagucua

SEQ ID NO: 845369 - RNA, 21 nt, Homo sapiens
uauuuuuuuaagcuguaaaaa

SEQ ID NO: 845370 - RNA, 21 nt, Homo sapiens
ucaaccccuccccuccauccc

SEQ ID NO: 845371 - RNA, 17 nt, Homo sapiens
ucaauaagccucagcuu

SEQ ID NO: 845372 - RNA, 22 nt, Homo sapiens
ucaauaccccuguuaagcaauu

SEQ ID NO: 845373 - RNA, 19 nt, Homo sapiens
ucacagguagacaguauau

SEQ ID NO: 845374 - RNA, 12 nt, Homo sapiens
ucaccagugugu

SEQ ID NO: 845375 - RNA, 14 nt, Homo sapiens
ucaccucauggaau

SEQ ID NO: 845376 - RNA, 14 nt, Homo sapiens
ucacuagcugucuc

SEQ ID NO: 845377 - RNA, 19 nt, Homo sapiens
ucacuagcugucucaggag

SEQ ID NO: 845378 - RNA, 19 nt, Homo sapiens
ucacuucaaaacaguauug

SEQ ID NO: 845379 - RNA, 20 nt, Homo sapiens
ucacuuuucaauuugucaug

SEQ ID NO: 845380 - RNA, 19 nt, Homo sapiens
ucagaucguucauugccuu

SEQ ID NO: 845381 - RNA, 22 nt, Homo sapiens
ucaggaguagucucauaucagg

SEQ ID NO: 845382 - RNA, 18 nt, Homo sapiens
ucagggauccucucucca

SEQ ID NO: 845383 - RNA, 15 nt, Homo sapiens
ucaguccaguccuca

SEQ ID NO: 845384 - RNA, 20 nt, Homo sapiens
ucaguucccagacagcuuuu

SEQ ID NO: 845385 - RNA, 14 nt, Homo sapiens
ucaguuguuuuccc

SEQ ID NO: 845386 - RNA, 17 nt, Homo sapiens
ucauauaaucuuacaau

SEQ ID NO: 845387 - RNA, 14 nt, Homo sapiens
ucaugaagauauuu

SEQ ID NO: 845388 - RNA, 18 nt, Homo sapiens
ucauucuuauuucaugaa

SEQ ID NO: 845389 - RNA, 15 nt, Homo sapiens
ucauugccuuuccag

SEQ ID NO: 845390 - RNA, 22 nt, Homo sapiens
uccaaaggaggauggcauauaa

SEQ ID NO: 845391 - RNA, 19 nt, Homo sapiens
uccaaccagauugucagcu

SEQ ID NO: 845392 - RNA, 23 nt, Homo sapiens
uccaauccguucccuucugccac

SEQ ID NO: 845393 - RNA, 20 nt, Homo sapiens
uccaccuaguggcuguccag

SEQ ID NO: 845394 - RNA, 16 nt, Homo sapiens
uccacucccacuuccc

SEQ ID NO: 845395 - RNA, 18 nt, Homo sapiens
uccacuguguguugacac

SEQ ID NO: 845396 - RNA, 14 nt, Homo sapiens
uccagaaagugaca

SEQ ID NO: 845397 - RNA, 20 nt, Homo sapiens
ucccaaaaucauaagauauu

SEQ ID NO: 845398 - RNA, 16 nt, Homo sapiens
ucccaaauugaaucac

SEQ ID NO: 845399 - RNA, 23 nt, Homo sapiens
ucccaaauugaaucacugcucac

SEQ ID NO: 845400 - RNA, 18 nt, Homo sapiens
ucccaagggaggcccaug

SEQ ID NO: 845401 - RNA, 14 nt, Homo sapiens
ucccaccucugagg

SEQ ID NO: 845402 - RNA, 22 nt, Homo sapiens
ucccaugggcuaggagccagug

SEQ ID NO: 845403 - RNA, 16 nt, Homo sapiens
ucccuggaugacauua

SEQ ID NO: 845404 - RNA, 18 nt, Homo sapiens
uccgucauuugacagggg

SEQ ID NO: 845405 - RNA, 15 nt, Homo sapiens
uccuacauuaauuau

SEQ ID NO: 845406 - RNA, 13 nt, Homo sapiens
uccucacaugccc

SEQ ID NO: 845407 - RNA, 17 nt, Homo sapiens
uccugcuccacaguguu

SEQ ID NO: 845408 - RNA, 19 nt, Homo sapiens
uccuugaagauuuaccacu

SEQ ID NO: 845409 - RNA, 13 nt, Homo sapiens
ucggcuccugcug

SEQ ID NO: 845410 - RNA, 18 nt, Homo sapiens
ucgggcuccugugcccuu

SEQ ID NO: 845411 - RNA, 23 nt, Homo sapiens
ucgggggaugaggauauggcagg

SEQ ID NO: 845412 - RNA, 23 nt, Homo sapiens
ucuaccaaaaaucucaauauuuc

SEQ ID NO: 845413 - RNA, 12 nt, Homo sapiens
ucuccagugcac

SEQ ID NO: 845414 - RNA, 16 nt, Homo sapiens
ucuccagugcaccugu

SEQ ID NO: 845415 - RNA, 17 nt, Homo sapiens
ucuccccagauauggac

SEQ ID NO: 845416 - RNA, 18 nt, Homo sapiens
ucucgcuccucaaccccu

SEQ ID NO: 845417 - RNA, 13 nt, Homo sapiens
ucucuccagugca

SEQ ID NO: 845418 - RNA, 16 nt, Homo sapiens
ucucugccacuccuga

SEQ ID NO: 845419 - RNA, 19 nt, Homo sapiens
ucugcggugaggcagggga

SEQ ID NO: 845420 - RNA, 16 nt, Homo sapiens
ucugcuauauuuucau

SEQ ID NO: 845421 - RNA, 21 nt, Homo sapiens
ucuggcuggguuuucaggggc

SEQ ID NO: 845422 - RNA, 21 nt, Homo sapiens
ucugugccugacucugugcug

SEQ ID NO: 845423 - RNA, 16 nt, Homo sapiens
ucuguggucacaguga

SEQ ID NO: 845424 - RNA, 17 nt, Homo sapiens
ucuguuccccauggcca

SEQ ID NO: 845425 - RNA, 22 nt, Homo sapiens
ucuuaauuauuguacauuuaua

SEQ ID NO: 845426 - RNA, 14 nt, Homo sapiens
ucuuauuuccucaa

SEQ ID NO: 845427 - RNA, 13 nt, Homo sapiens
ucuuauuugcuca

SEQ ID NO: 845428 - RNA, 19 nt, Homo sapiens
ucuucuccauccuaccaca

SEQ ID NO: 845429 - RNA, 15 nt, Homo sapiens
ucuucucccaauuca

SEQ ID NO: 845430 - RNA, 18 nt, Homo sapiens
ucuuuccuggcuacucca

SEQ ID NO: 845431 - RNA, 20 nt, Homo sapiens
ucuuuggacagaagcagcuc

SEQ ID NO: 845432 - RNA, 17 nt, Homo sapiens
ugacaggggcucaggau

SEQ ID NO: 845433 - RNA, 16 nt, Homo sapiens
ugacaguccucuccac

SEQ ID NO: 845434 - RNA, 18 nt, Homo sapiens
ugacaucaccacaguuua

SEQ ID NO: 845435 - RNA, 13 nt, Homo sapiens
ugaccacuuuauu

SEQ ID NO: 845436 - RNA, 21 nt, Homo sapiens
ugacuguaggcgccccugggg

SEQ ID NO: 845437 - RNA, 13 nt, Homo sapiens
ugagaaaaucagu

SEQ ID NO: 845438 - RNA, 23 nt, Homo sapiens
ugauagaacuuugccagucuuua

SEQ ID NO: 845439 - RNA, 23 nt, Homo sapiens
ugaucagcuuauugucuagugaa

SEQ ID NO: 845440 - RNA, 14 nt, Homo sapiens
ugcaaaaacucuua

SEQ ID NO: 845441 - RNA, 22 nt, Homo sapiens
ugcaaaaacucuuauggccaaa

SEQ ID NO: 845442 - RNA, 15 nt, Homo sapiens
ugcacuguccugcuc

SEQ ID NO: 845443 - RNA, 23 nt, Homo sapiens
ugcacuguccugcuccacagugu

SEQ ID NO: 845444 - RNA, 17 nt, Homo sapiens
ugcauuuucuucacagu

SEQ ID NO: 845445 - RNA, 19 nt, Homo sapiens
ugcauuuucuucacagugc

SEQ ID NO: 845446 - RNA, 23 nt, Homo sapiens
ugccaagccuggagccccugugu

SEQ ID NO: 845447 - RNA, 11 nt, Homo sapiens
ugccacggugg

SEQ ID NO: 845448 - RNA, 14 nt, Homo sapiens
ugccccagcugggc

SEQ ID NO: 845449 - RNA, 24 nt, Homo sapiens
ugcccggcgcccucuguccugacu

SEQ ID NO: 845450 - RNA, 13 nt, Homo sapiens
ugccucuacccaa

SEQ ID NO: 845451 - RNA, 14 nt, Homo sapiens
ugccucuacccaac

SEQ ID NO: 845452 - RNA, 20 nt, Homo sapiens
ugccugaccaucccaugagc

SEQ ID NO: 845453 - RNA, 15 nt, Homo sapiens
ugcgguaggugcugg

SEQ ID NO: 845454 - RNA, 18 nt, Homo sapiens
ugcuauggacgaccucca

SEQ ID NO: 845455 - RNA, 14 nt, Homo sapiens
ugcuccacaguguu

SEQ ID NO: 845456 - RNA, 18 nt, Homo sapiens
ugcugauggcugcuggag

SEQ ID NO: 845457 - RNA, 19 nt, Homo sapiens
ugcugcugagugcaccacu

SEQ ID NO: 845458 - RNA, 17 nt, Homo sapiens
ugcuuccaagcccuucc

SEQ ID NO: 845459 - RNA, 17 nt, Homo sapiens
uggaaaggcagcucuaa

SEQ ID NO: 845460 - RNA, 22 nt, Homo sapiens
uggaacuguccuucccucaaag

SEQ ID NO: 845461 - RNA, 20 nt, Homo sapiens
uggacgaccuccagcucuca

SEQ ID NO: 845462 - RNA, 16 nt, Homo sapiens
uggagccccuguguug

SEQ ID NO: 845463 - RNA, 18 nt, Homo sapiens
uggaggaaagugauaucc

SEQ ID NO: 845464 - RNA, 14 nt, Homo sapiens
uggcaauagucaaa

SEQ ID NO: 845465 - RNA, 23 nt, Homo sapiens
uggcacuaguauuucuaugaaau

SEQ ID NO: 845466 - RNA, 11 nt, Homo sapiens
uggcauauaau

SEQ ID NO: 845467 - RNA, 21 nt, Homo sapiens
uggccaagaucacaguggcca

SEQ ID NO: 845468 - RNA, 14 nt, Homo sapiens
uggccgagcugaag

SEQ ID NO: 845469 - RNA, 22 nt, Homo sapiens
uggcugagagaguggcauuggc

SEQ ID NO: 845470 - RNA, 16 nt, Homo sapiens
ugggaaagggcuguua

SEQ ID NO: 845471 - RNA, 14 nt, Homo sapiens
ugggaucauugcau

SEQ ID NO: 845472 - RNA, 18 nt, Homo sapiens
ugggcucugugggcugca

SEQ ID NO: 845473 - RNA, 22 nt, Homo sapiens
uggggccaaauaaagucucuuc

SEQ ID NO: 845474 - RNA, 15 nt, Homo sapiens
ugggggaggcucuga

SEQ ID NO: 845475 - RNA, 21 nt, Homo sapiens
ugggucuucccuguaugauuc

SEQ ID NO: 845476 - RNA, 18 nt, Homo sapiens
ugguggccacggccacag

SEQ ID NO: 845477 - RNA, 16 nt, Homo sapiens
uguaacaugaagcaaa

SEQ ID NO: 845478 - RNA, 21 nt, Homo sapiens
uguaacuauaguccagcuuug

SEQ ID NO: 845479 - RNA, 20 nt, Homo sapiens
ugucaacuccaggacuugcu

SEQ ID NO: 845480 - RNA, 13 nt, Homo sapiens
ugucaauaccccu

SEQ ID NO: 845481 - RNA, 19 nt, Homo sapiens
ugucaucugggccaccagc

SEQ ID NO: 845482 - RNA, 19 nt, Homo sapiens
ugugaacauggacucuucc

SEQ ID NO: 845483 - RNA, 16 nt, Homo sapiens
acccagcccugaacaa

SEQ ID NO: 845484 - RNA, 20 nt, Homo sapiens
acccagcccugaacaaagca

SEQ ID NO: 845485 - RNA, 14 nt, Homo sapiens
acccaugucuacac

SEQ ID NO: 845486 - RNA, 15 nt, Homo sapiens
accccccugagagca

SEQ ID NO: 845487 - RNA, 18 nt, Homo sapiens
acccuacaccucugggcc

SEQ ID NO: 845488 - RNA, 16 nt, Homo sapiens
acccuuggacuugagg

SEQ ID NO: 845489 - RNA, 23 nt, Homo sapiens
accucaagugcaaggaccaaagg

SEQ ID NO: 845490 - RNA, 13 nt, Homo sapiens
accucauggaauu

SEQ ID NO: 845491 - RNA, 23 nt, Homo sapiens
accugccuucucacuagcugucu

SEQ ID NO: 845492 - RNA, 17 nt, Homo sapiens
accuuuuuggacacaca

SEQ ID NO: 845493 - RNA, 18 nt, Homo sapiens
acuaaacagacuauuuaa

SEQ ID NO: 845494 - RNA, 20 nt, Homo sapiens
acuaaaugguguuacauuaa

SEQ ID NO: 845495 - RNA, 21 nt, Homo sapiens
acuagucuguguaacuuuaaa

SEQ ID NO: 845496 - RNA, 16 nt, Homo sapiens
acuauaaacaugaugu

SEQ ID NO: 845497 - RNA, 22 nt, Homo sapiens
acuauauuguuugcuaagcauu

SEQ ID NO: 845498 - RNA, 12 nt, Homo sapiens
acuccacagugu

SEQ ID NO: 845499 - RNA, 22 nt, Homo sapiens
acucccaugcaaguagcuggcu

SEQ ID NO: 845500 - RNA, 17 nt, Homo sapiens
acuccuccuaguacuaa

SEQ ID NO: 845501 - RNA, 23 nt, Homo sapiens
acuccugacccagcccugaacaa

SEQ ID NO: 845502 - RNA, 19 nt, Homo sapiens
acuccugggucccugggaa

SEQ ID NO: 845503 - RNA, 20 nt, Homo sapiens
acuccuuucucaucuugucc

SEQ ID NO: 845504 - RNA, 18 nt, Homo sapiens
acucugugcugagcacag

SEQ ID NO: 845505 - RNA, 19 nt, Homo sapiens
acugaggugguggacaucg

SEQ ID NO: 845506 - RNA, 20 nt, Homo sapiens
acugcacuccagccugggug

SEQ ID NO: 845507 - RNA, 20 nt, Homo sapiens
uaguaauuguaaguaccccu

SEQ ID NO: 845508 - RNA, 16 nt, Homo sapiens
uagucaugcuaauuau

SEQ ID NO: 845509 - RNA, 21 nt, Homo sapiens
uauauaaacacuccacagugu

SEQ ID NO: 845510 - RNA, 21 nt, Homo sapiens
uauauaacuaacaaccaaaga

SEQ ID NO: 845511 - RNA, 14 nt, Homo sapiens
uaucaauuaccaca

SEQ ID NO: 845512 - RNA, 15 nt, Homo sapiens
uauccuaucucucca

SEQ ID NO: 845513 - RNA, 14 nt, Homo sapiens
uaucugaggucaca

SEQ ID NO: 845514 - RNA, 14 nt, Homo sapiens
uaugaggcuggggc

SEQ ID NO: 845515 - RNA, 15 nt, Homo sapiens
uaugccucuguauuu

SEQ ID NO: 845516 - RNA, 18 nt, Homo sapiens
uauuaaaaauagauauau

SEQ ID NO: 845517 - RNA, 18 nt, Homo sapiens
uauuacucuacacugaaa

SEQ ID NO: 845518 - RNA, 12 nt, Homo sapiens
uauucagcuuua

SEQ ID NO: 845519 - RNA, 16 nt, Homo sapiens
uauucuugacaugaga

SEQ ID NO: 845520 - RNA, 14 nt, Homo sapiens
uauuuaaaaguaua

SEQ ID NO: 845521 - RNA, 24 nt, Homo sapiens
uauuuuaggucuuaauacacacag

SEQ ID NO: 845522 - RNA, 21 nt, Homo sapiens
uauuuuuuaaagucuauuguu

SEQ ID NO: 845523 - RNA, 18 nt, Homo sapiens
ucaaaaacacucucacua

SEQ ID NO: 845524 - RNA, 14 nt, Homo sapiens
ucaaagaggccuua

SEQ ID NO: 845525 - RNA, 19 nt, Homo sapiens
ccuggugggacaacaaaga

SEQ ID NO: 845526 - RNA, 23 nt, Homo sapiens
ccugugcagguuuauauugggaa

SEQ ID NO: 845527 - RNA, 16 nt, Homo sapiens
ccuuaucgaaacucau

SEQ ID NO: 845528 - RNA, 18 nt, Homo sapiens
ccuuggcccaccugaggc

SEQ ID NO: 845529 - RNA, 19 nt, Homo sapiens
ccuuggggcugaugcaguu

SEQ ID NO: 845530 - RNA, 14 nt, Homo sapiens
ccuuucuggcuuug

SEQ ID NO: 845531 - RNA, 18 nt, Homo sapiens
ccuuuucaucuccagugu

SEQ ID NO: 845532 - RNA, 15 nt, Homo sapiens
cgagccuggcuccaa

SEQ ID NO: 845533 - RNA, 17 nt, Homo sapiens
cgaggcggaucuuugga

SEQ ID NO: 845534 - RNA, 19 nt, Homo sapiens
cgaugauacuguuucuugc

SEQ ID NO: 845535 - RNA, 15 nt, Homo sapiens
cgauuuaacugggaa

SEQ ID NO: 845536 - RNA, 14 nt, Homo sapiens
cggaucuuuggaca

SEQ ID NO: 845537 - RNA, 15 nt, Homo sapiens
cggauggaaggagag

SEQ ID NO: 845538 - RNA, 18 nt, Homo sapiens
cgguggcucuugccugua

SEQ ID NO: 845539 - RNA, 14 nt, Homo sapiens
cuaaggaaauugag

SEQ ID NO: 845540 - RNA, 14 nt, Homo sapiens
cuaauaguuuuauu

SEQ ID NO: 845541 - RNA, 20 nt, Homo sapiens
cuaaucaagucaaauggaga

SEQ ID NO: 845542 - RNA, 18 nt, Homo sapiens
cuacucauuccccggggc

SEQ ID NO: 845543 - RNA, 15 nt, Homo sapiens
cuagcugucucagga

SEQ ID NO: 845544 - RNA, 17 nt, Homo sapiens
cuaggggcuggggccaa

SEQ ID NO: 845545 - RNA, 20 nt, Homo sapiens
cuagucuguguaacuuuaaa

SEQ ID NO: 845546 - RNA, 17 nt, Homo sapiens
cuaguugaucagcuuau

SEQ ID NO: 845547 - RNA, 21 nt, Homo sapiens
cuaguuuuugacuugcuccua

SEQ ID NO: 845548 - RNA, 22 nt, Homo sapiens
cuaugcauuuucuucacagugc

SEQ ID NO: 845549 - RNA, 12 nt, Homo sapiens
cucaaaauugau

SEQ ID NO: 845550 - RNA, 20 nt, Homo sapiens
cucaagugcaaggaccaaag

SEQ ID NO: 845551 - RNA, 23 nt, Homo sapiens
cucacuuucuagauuaagauaug

SEQ ID NO: 845552 - RNA, 13 nt, Homo sapiens
cuccaaacccucg

SEQ ID NO: 845553 - RNA, 12 nt, Homo sapiens
cuccaacaauaa

SEQ ID NO: 845554 - RNA, 14 nt, Homo sapiens
cuccacgcccuggg

SEQ ID NO: 845555 - RNA, 17 nt, Homo sapiens
cucccagcugacagucc

SEQ ID NO: 845556 - RNA, 17 nt, Homo sapiens
cuccccuccaucccugg

SEQ ID NO: 845557 - RNA, 17 nt, Homo sapiens
cucccuggaugacauua

SEQ ID NO: 845558 - RNA, 12 nt, Homo sapiens
cuccuguuucac

SEQ ID NO: 845559 - RNA, 15 nt, Homo sapiens
cuccuuucucaucuu

SEQ ID NO: 845560 - RNA, 16 nt, Homo sapiens
cucgcuccucaacccc

SEQ ID NO: 845561 - RNA, 15 nt, Homo sapiens
cucguggaacaguua

SEQ ID NO: 845562 - RNA, 20 nt, Homo sapiens
cucugcauuaucugagguca

SEQ ID NO: 845563 - RNA, 23 nt, Homo sapiens
cucugcuaugcauuuucuucaca

SEQ ID NO: 845564 - RNA, 13 nt, Homo sapiens
cucugugcugagc

SEQ ID NO: 845565 - RNA, 17 nt, Homo sapiens
cucuuacuuauuaucuu

SEQ ID NO: 845566 - RNA, 23 nt, Homo sapiens
cucuuagaugcaguucugaagaa

SEQ ID NO: 845567 - RNA, 15 nt, Homo sapiens
cucuuauuugcucac

SEQ ID NO: 845568 - RNA, 19 nt, Homo sapiens
cucuucccccacuccucuu

SEQ ID NO: 845569 - RNA, 12 nt, Homo sapiens
agagagcaccug

SEQ ID NO: 845570 - RNA, 17 nt, Homo sapiens
agagcaucugcucugag

SEQ ID NO: 845571 - RNA, 17 nt, Homo sapiens
agaggcuuucaaaugua

SEQ ID NO: 845572 - RNA, 17 nt, Homo sapiens
agaguuuagcuggaaaa

SEQ ID NO: 845573 - RNA, 20 nt, Homo sapiens
agauauuauuuuagcuucag

SEQ ID NO: 845574 - RNA, 12 nt, Homo sapiens
agaucacagugg

SEQ ID NO: 845575 - RNA, 23 nt, Homo sapiens
agaugucuucaucacuucuucca

SEQ ID NO: 845576 - RNA, 16 nt, Homo sapiens
agcaaaccucagucau

SEQ ID NO: 845577 - RNA, 14 nt, Homo sapiens
agcaaauuaguaau

SEQ ID NO: 845578 - RNA, 24 nt, Homo sapiens
agcaggcuuucaagaagugccagu

SEQ ID NO: 845579 - RNA, 20 nt, Homo sapiens
agcccuaggcuuccacguac

SEQ ID NO: 845580 - RNA, 15 nt, Homo sapiens
agcccugaacaaagc

SEQ ID NO: 845581 - RNA, 15 nt, Homo sapiens
agcccuuuacuugac

SEQ ID NO: 845582 - RNA, 20 nt, Homo sapiens
agccgagauugcaccacugc

SEQ ID NO: 845583 - RNA, 12 nt, Homo sapiens
agccucaagucu

SEQ ID NO: 845584 - RNA, 19 nt, Homo sapiens
agccuccuuucuggcuuug

SEQ ID NO: 845585 - RNA, 19 nt, Homo sapiens
agccucuuagaugcaguuc

SEQ ID NO: 845586 - RNA, 19 nt, Homo sapiens
agccuggagccccugugug

SEQ ID NO: 845587 - RNA, 15 nt, Homo sapiens
agcucugaggaguac

SEQ ID NO: 845588 - RNA, 23 nt, Homo sapiens
agcucuucuccauccuaccacaa

SEQ ID NO: 845589 - RNA, 19 nt, Homo sapiens
agcugacaguccucuccac

SEQ ID NO: 845590 - RNA, 20 nt, Homo sapiens
agcuguaaaaagagagaaaa

SEQ ID NO: 845591 - RNA, 19 nt, Homo sapiens
agcuuauugucuagugaaa

SEQ ID NO: 845592 - RNA, 14 nt, Homo sapiens
agcuucucaauuuc

SEQ ID NO: 845593 - RNA, 17 nt, Homo sapiens
agcuucugccacuuccc

SEQ ID NO: 845594 - RNA, 13 nt, Homo sapiens
agcuuuccgggga

SEQ ID NO: 845595 - RNA, 17 nt, Homo sapiens
aggaccugagucugcua

SEQ ID NO: 845596 - RNA, 14 nt, Homo sapiens
aggagaacacuaga

SEQ ID NO: 845597 - RNA, 15 nt, Homo sapiens
aggagagacuggcca

SEQ ID NO: 845598 - RNA, 15 nt, Homo sapiens
aggagccaccugggc

SEQ ID NO: 845599 - RNA, 20 nt, Homo sapiens
aggaggccugggagggcaag

SEQ ID NO: 845600 - RNA, 20 nt, Homo sapiens
aggaggcggagguugcagug

SEQ ID NO: 845601 - RNA, 23 nt, Homo sapiens
aggaggugcuaucgcaccacugu

SEQ ID NO: 845602 - RNA, 14 nt, Homo sapiens
aggaguagucucau

SEQ ID NO: 845603 - RNA, 15 nt, Homo sapiens
aggagugacaugaag

SEQ ID NO: 845604 - RNA, 22 nt, Homo sapiens
aggaguucgagaccagccugac

SEQ ID NO: 845605 - RNA, 16 nt, Homo sapiens
aggaugggauguauuu

SEQ ID NO: 845606 - RNA, 14 nt, Homo sapiens
aggcacagcacagg

SEQ ID NO: 845607 - RNA, 18 nt, Homo sapiens
aggccauaccaggugcua

SEQ ID NO: 845608 - RNA, 14 nt, Homo sapiens
aggccaucuuccag

SEQ ID NO: 845609 - RNA, 16 nt, Homo sapiens
aggccucccacaguga

SEQ ID NO: 845610 - RNA, 15 nt, Homo sapiens
aggcggaucuuugga

SEQ ID NO: 845611 - RNA, 23 nt, Homo sapiens
aggcugagacugcagaggagcca

SEQ ID NO: 845612 - RNA, 16 nt, Homo sapiens
agggaggcccauguga

SEQ ID NO: 845613 - RNA, 15 nt, Homo sapiens
agggaucuggggaag

SEQ ID NO: 845614 - RNA, 13 nt, Homo sapiens
agggccccggggc

SEQ ID NO: 845615 - RNA, 19 nt, Homo sapiens
agggccccggggccuguua

SEQ ID NO: 845616 - RNA, 16 nt, Homo sapiens
aggggcccgcuugccu

SEQ ID NO: 845617 - RNA, 17 nt, Homo sapiens
agggggcccuggcuugg

SEQ ID NO: 845618 - RNA, 20 nt, Homo sapiens
aggugggcgggcagcacagc

SEQ ID NO: 845619 - RNA, 16 nt, Homo sapiens
aggugggggagccugg

SEQ ID NO: 845620 - RNA, 23 nt, Homo sapiens
agguuguguugccugcugagcug

SEQ ID NO: 845621 - RNA, 15 nt, Homo sapiens
aguacagaaaaauac

SEQ ID NO: 845622 - RNA, 16 nt, Homo sapiens
aguaucugaggcacau

SEQ ID NO: 845623 - RNA, 13 nt, Homo sapiens
agucagcucuucu

SEQ ID NO: 845624 - RNA, 13 nt, Homo sapiens
agucaugugcugg

SEQ ID NO: 845625 - RNA, 15 nt, Homo sapiens
aguccucacaugccc

SEQ ID NO: 845626 - RNA, 17 nt, Homo sapiens
agucuggagcugagcua

SEQ ID NO: 845627 - RNA, 18 nt, Homo sapiens
agucugugacccacuuac

SEQ ID NO: 845628 - RNA, 14 nt, Homo sapiens
agugaauuguguag

SEQ ID NO: 845629 - RNA, 22 nt, Homo sapiens
agugauuuccuguauaauuuaa

SEQ ID NO: 845630 - RNA, 12 nt, Homo sapiens
agugcaccacuu

SEQ ID NO: 845631 - RNA, 16 nt, Homo sapiens
aguggguaggccuugg

SEQ ID NO: 845632 - RNA, 16 nt, Homo sapiens
agugggucccacuucc

SEQ ID NO: 845633 - RNA, 18 nt, Homo sapiens
agugggucccacuucccc

SEQ ID NO: 845634 - RNA, 22 nt, Homo sapiens
aguguuaggccuggcacagugu

SEQ ID NO: 845635 - RNA, 18 nt, Homo sapiens
aguucccagacagcuuuu

SEQ ID NO: 845636 - RNA, 23 nt, Homo sapiens
aguuggcuucugugccugacucu

SEQ ID NO: 845637 - RNA, 20 nt, Homo sapiens
aguuuaggugauggccaguc

SEQ ID NO: 845638 - RNA, 16 nt, Homo sapiens
aguuuuauaugcuucu

SEQ ID NO: 845639 - RNA, 21 nt, Homo sapiens
auaaucauucuuauuucauga

SEQ ID NO: 845640 - RNA, 16 nt, Homo sapiens
auaauuuuucacuuca

SEQ ID NO: 845641 - RNA, 14 nt, Homo sapiens
auacaaaguacaga

SEQ ID NO: 845642 - RNA, 20 nt, Homo sapiens
auacaugcauacacucucaa

SEQ ID NO: 845643 - RNA, 18 nt, Homo sapiens
auaccccuaguaucuggc

SEQ ID NO: 845644 - RNA, 14 nt, Homo sapiens
auagaacuuugcca

SEQ ID NO: 845645 - RNA, 20 nt, Homo sapiens
auauaacuaacaaccaaaga

SEQ ID NO: 845646 - RNA, 23 nt, Homo sapiens
auauacauacaugcauacacucu

SEQ ID NO: 845647 - RNA, 19 nt, Homo sapiens
auaugucaugccucacuuu

SEQ ID NO: 845648 - RNA, 15 nt, Homo sapiens
auauucacucugugg

SEQ ID NO: 845649 - RNA, 17 nt, Homo sapiens
aucaagcccuuuacuug

SEQ ID NO: 845650 - RNA, 15 nt, Homo sapiens
aucauauauauacau

SEQ ID NO: 845651 - RNA, 20 nt, Homo sapiens
auccaaaaauagcccugcaa

SEQ ID NO: 845652 - RNA, 17 nt, Homo sapiens
auccaggauucugggag

SEQ ID NO: 845653 - RNA, 14 nt, Homo sapiens
auccauacauuugu

SEQ ID NO: 845654 - RNA, 16 nt, Homo sapiens
auccuaucucuccaac

SEQ ID NO: 845655 - RNA, 23 nt, Homo sapiens
aucguucauugccuuuccagggu

SEQ ID NO: 845656 - RNA, 23 nt, Homo sapiens
aucucaguggcacagguuuaaga

SEQ ID NO: 845657 - RNA, 19 nt, Homo sapiens
aucucauuuccaagcaagu

SEQ ID NO: 845658 - RNA, 18 nt, Homo sapiens
aucuggaggcucccaugg

SEQ ID NO: 845659 - RNA, 17 nt, Homo sapiens
aucuggggaaggaccaa

SEQ ID NO: 845660 - RNA, 23 nt, Homo sapiens
aucuguuugugcaaacauaauac

SEQ ID NO: 845661 - RNA, 12 nt, Homo sapiens
aucuuuggacag

SEQ ID NO: 845662 - RNA, 14 nt, Homo sapiens
aucuuuggacagaa

SEQ ID NO: 845663 - RNA, 21 nt, Homo sapiens
aucuuuggacagaagcagcuc

SEQ ID NO: 845664 - RNA, 18 nt, Homo sapiens
augaaguuauucuugaca

SEQ ID NO: 845665 - RNA, 16 nt, Homo sapiens
augagagacacacuga

SEQ ID NO: 845666 - RNA, 16 nt, Homo sapiens
augagugucaacucca

SEQ ID NO: 845667 - RNA, 16 nt, Homo sapiens
augccucuguauuuaa

SEQ ID NO: 845668 - RNA, 22 nt, Homo sapiens
augcuccgucauuugacagggg

SEQ ID NO: 845669 - RNA, 14 nt, Homo sapiens
auggacgaccucca

SEQ ID NO: 845670 - RNA, 18 nt, Homo sapiens
auggagccagcucugcau

SEQ ID NO: 845671 - RNA, 23 nt, Homo sapiens
auggucacccccacucugcauac

SEQ ID NO: 845672 - RNA, 22 nt, Homo sapiens
auguaucuaccucacuauucaa

SEQ ID NO: 845673 - RNA, 16 nt, Homo sapiens
auguauuuuucuugcu

SEQ ID NO: 845674 - RNA, 14 nt, Homo sapiens
auguucuagugauu

SEQ ID NO: 845675 - RNA, 20 nt, Homo sapiens
auguuguuaugggcaggaug

SEQ ID NO: 845676 - RNA, 12 nt, Homo sapiens
auuacucugaaa

SEQ ID NO: 845677 - RNA, 16 nt, Homo sapiens
auuagaauaccacagg

SEQ ID NO: 845678 - RNA, 15 nt, Homo sapiens
auuaucuucaggaca

SEQ ID NO: 845679 - RNA, 19 nt, Homo sapiens
auuauuacucuacacugaa

SEQ ID NO: 845680 - RNA, 17 nt, Homo sapiens
auucagaguccuugcaa

SEQ ID NO: 845681 - RNA, 15 nt, Homo sapiens
auugauuacaaauaa

SEQ ID NO: 845682 - RNA, 20 nt, Homo sapiens
auuguacgugggagaggcag

SEQ ID NO: 845683 - RNA, 12 nt, Homo sapiens
auuuaacuugag

SEQ ID NO: 845684 - RNA, 20 nt, Homo sapiens
auuuaauguauuaaucuguu

SEQ ID NO: 845685 - RNA, 17 nt, Homo sapiens
auuuacaacaaacaccu

SEQ ID NO: 845686 - RNA, 17 nt, Homo sapiens
auuuauuacuguaagaa

SEQ ID NO: 845687 - RNA, 18 nt, Homo sapiens
auuuugaaaucaugaaga

SEQ ID NO: 845688 - RNA, 13 nt, Homo sapiens
aaccuuuucccaa

SEQ ID NO: 845689 - RNA, 17 nt, Homo sapiens
aaccuuuucccaaccau

SEQ ID NO: 845690 - RNA, 21 nt, Homo sapiens
aacuaaaguuagaaaguugau

SEQ ID NO: 845691 - RNA, 18 nt, Homo sapiens
aacuagguuuuaauaauu

SEQ ID NO: 845692 - RNA, 18 nt, Homo sapiens
aacuccuguuucacuugg

SEQ ID NO: 845693 - RNA, 15 nt, Homo sapiens
aacuugcugcugagu

SEQ ID NO: 845694 - RNA, 18 nt, Homo sapiens
aacuuugccagucuuuaa

SEQ ID NO: 845695 - RNA, 15 nt, Homo sapiens
aagaaaauuaguaau

SEQ ID NO: 845696 - RNA, 23 nt, Homo sapiens
aagaacugaaaucauacuucuua

SEQ ID NO: 845697 - RNA, 11 nt, Homo sapiens
aagaaggguug

SEQ ID NO: 845698 - RNA, 18 nt, Homo sapiens
aagaaguguaacucacca

SEQ ID NO: 845699 - RNA, 16 nt, Homo sapiens
aagaaugauuaugaau

SEQ ID NO: 845700 - RNA, 16 nt, Homo sapiens
aagagauuuuucauga

SEQ ID NO: 845701 - RNA, 21 nt, Homo sapiens
aagaggcuauuuaaaaguaua

SEQ ID NO: 845702 - RNA, 18 nt, Homo sapiens
aagcaaauuaguaauugu

SEQ ID NO: 845703 - RNA, 13 nt, Homo sapiens
aagcaccaaucau

SEQ ID NO: 845704 - RNA, 16 nt, Homo sapiens
aagcaccucaagugca

SEQ ID NO: 845705 - RNA, 19 nt, Homo sapiens
aagccagauuuuccugaaa

SEQ ID NO: 845706 - RNA, 21 nt, Homo sapiens
aagccuuggggcugaugcagu

SEQ ID NO: 845707 - RNA, 21 nt, Homo sapiens
aaggcaggagaaucgcuuaaa

SEQ ID NO: 845708 - RNA, 21 nt, Homo sapiens
aaggccuugcugucaugugaa

SEQ ID NO: 845709 - RNA, 13 nt, Homo sapiens
aaggguugagcug

SEQ ID NO: 845710 - RNA, 20 nt, Homo sapiens
aaggucccauaauaaaaaga

SEQ ID NO: 845711 - RNA, 18 nt, Homo sapiens
aaguaaugagggcugagu

SEQ ID NO: 845712 - RNA, 19 nt, Homo sapiens
aaguaccccugauaagcaa

SEQ ID NO: 845713 - RNA, 18 nt, Homo sapiens
aagucaggugcaguccca

SEQ ID NO: 845714 - RNA, 14 nt, Homo sapiens
aagucuaauucaca

SEQ ID NO: 845715 - RNA, 15 nt, Homo sapiens
aaguuauucuugaca

SEQ ID NO: 845716 - RNA, 22 nt, Homo sapiens
aauaaugaaguuauucuugaca

SEQ ID NO: 845717 - RNA, 18 nt, Homo sapiens
aauaccccuguuaagcaa

SEQ ID NO: 845718 - RNA, 19 nt, Homo sapiens
aauaugaguuuuauugucc

SEQ ID NO: 845719 - RNA, 14 nt, Homo sapiens
aauauuucagauaa

SEQ ID NO: 845720 - RNA, 18 nt, Homo sapiens
aaucauauaaucuuacaa

SEQ ID NO: 845721 - RNA, 23 nt, Homo sapiens
aauccugcuccugacucggucaa

SEQ ID NO: 845722 - RNA, 17 nt, Homo sapiens
aaugaaaaggacuuuau

SEQ ID NO: 845723 - RNA, 17 nt, Homo sapiens
aauguaacaugaagcaa

SEQ ID NO: 845724 - RNA, 19 nt, Homo sapiens
aaugucaguguuugggaaa

SEQ ID NO: 845725 - RNA, 18 nt, Homo sapiens
aauguuaagccauuuaac

SEQ ID NO: 845726 - RNA, 21 nt, Homo sapiens
aauguuauuauuacucuacac

SEQ ID NO: 845727 - RNA, 13 nt, Homo sapiens
aauuacguuuaaa

SEQ ID NO: 845728 - RNA, 15 nt, Homo sapiens
aauucuuucacuuga

SEQ ID NO: 845729 - RNA, 18 nt, Homo sapiens
aauugaaucacugcucac

SEQ ID NO: 845730 - RNA, 21 nt, Homo sapiens
aauugagcuggaccucaccaa

SEQ ID NO: 845731 - RNA, 22 nt, Homo sapiens
aauugucaauaccccuguuaag

SEQ ID NO: 845732 - RNA, 18 nt, Homo sapiens
aauuuaaaacauuacucu

SEQ ID NO: 845733 - RNA, 23 nt, Homo sapiens
acaagauagccaccgagauccuu

SEQ ID NO: 845734 - RNA, 14 nt, Homo sapiens
auguaacugugcca

SEQ ID NO: 845735 - RNA, 19 nt, Homo sapiens
auguaguuuuauuacacau

SEQ ID NO: 845736 - RNA, 19 nt, Homo sapiens
augugcuggccaccugcug

SEQ ID NO: 845737 - RNA, 22 nt, Homo sapiens
auuaaacugaaucacaauguaa

SEQ ID NO: 845738 - RNA, 23 nt, Homo sapiens
auuaauuuuuaaggauguugcca

SEQ ID NO: 845739 - RNA, 18 nt, Homo sapiens
auuagcauggccacaucu

SEQ ID NO: 845740 - RNA, 21 nt, Homo sapiens
auuguccccuaaaccaaaaac

SEQ ID NO: 845741 - RNA, 15 nt, Homo sapiens
auuucacaagcuauu

SEQ ID NO: 845742 - RNA, 16 nt, Homo sapiens
auuucacaagcuauuc

SEQ ID NO: 845743 - RNA, 19 nt, Homo sapiens
auuuuuaaggauguugcca

SEQ ID NO: 845744 - RNA, 23 nt, Homo sapiens
caaagccacacucugggcuccag

SEQ ID NO: 845745 - RNA, 13 nt, Homo sapiens
caaaucugaggga

SEQ ID NO: 845746 - RNA, 14 nt, Homo sapiens
caacacccugaggu

SEQ ID NO: 845747 - RNA, 17 nt, Homo sapiens
caacacugggaaacaga

SEQ ID NO: 845748 - RNA, 22 nt, Homo sapiens
caacagacuucucaauaaucaa

SEQ ID NO: 845749 - RNA, 23 nt, Homo sapiens
caaccuucugaggagcuguugag

SEQ ID NO: 845750 - RNA, 21 nt, Homo sapiens
caagaucauagcucauugcaa

SEQ ID NO: 845751 - RNA, 16 nt, Homo sapiens
caagccccugcuccag

SEQ ID NO: 845752 - RNA, 15 nt, Homo sapiens
caagcuaugugagcu

SEQ ID NO: 845753 - RNA, 12 nt, Homo sapiens
caagcugccucc

SEQ ID NO: 845754 - RNA, 19 nt, Homo sapiens
caaggagggugagugcaag

SEQ ID NO: 845755 - RNA, 20 nt, Homo sapiens
caaggagggugagugcaagg

SEQ ID NO: 845756 - RNA, 18 nt, Homo sapiens
aacuaaugucucuacaau

SEQ ID NO: 845757 - RNA, 18 nt, Homo sapiens
aacuguucccaccugcug

SEQ ID NO: 845758 - RNA, 22 nt, Homo sapiens
aagagagcaacauuuuacccac

SEQ ID NO: 845759 - RNA, 18 nt, Homo sapiens
aagaguccucugaaugaa

SEQ ID NO: 845760 - RNA, 22 nt, Homo sapiens
aagaucccuuuguccacaagua

SEQ ID NO: 845761 - RNA, 18 nt, Homo sapiens
aagcaacagacuucucaa

SEQ ID NO: 845762 - RNA, 15 nt, Homo sapiens
aagccacacucuggg

SEQ ID NO: 845763 - RNA, 16 nt, Homo sapiens
aagcgaugaaacugga

SEQ ID NO: 845764 - RNA, 12 nt, Homo sapiens
aagcugcucagg

SEQ ID NO: 845765 - RNA, 22 nt, Homo sapiens
aaggaccggccuuugcaccucc

SEQ ID NO: 845766 - RNA, 19 nt, Homo sapiens
aagguuggugaauuucaca

SEQ ID NO: 845767 - RNA, 16 nt, Homo sapiens
aauaaaauuuaacuca

SEQ ID NO: 845768 - RNA, 16 nt, Homo sapiens
aauaagauuuaauuca

SEQ ID NO: 845769 - RNA, 18 nt, Homo sapiens
aauauuuuaagaauuuca

SEQ ID NO: 845770 - RNA, 16 nt, Homo sapiens
aaucccagcuaccuca

SEQ ID NO: 845771 - RNA, 19 nt, Homo sapiens
aaugacucaggacaucccc

SEQ ID NO: 845772 - RNA, 21 nt, Homo sapiens
aaugauacaguugcauguuau

SEQ ID NO: 845773 - RNA, 12 nt, Homo sapiens
aaugccaaaaaa

SEQ ID NO: 845774 - RNA, 15 nt, Homo sapiens
aauguaacugugcca

SEQ ID NO: 845775 - RNA, 24 nt, Homo sapiens
aauuaggaaagaaaaaaaguagga

SEQ ID NO: 845776 - RNA, 17 nt, Homo sapiens
aauuuuauuuacauucu

SEQ ID NO: 845777 - RNA, 21 nt, Homo sapiens
acaaagugaggagaaugaaau

SEQ ID NO: 845778 - RNA, 20 nt, Homo sapiens
acaaugauacaguugcaugu

SEQ ID NO: 845779 - RNA, 18 nt, Homo sapiens
acaaugcugagguuauga

SEQ ID NO: 845780 - RNA, 14 nt, Homo sapiens
acaauugucaugua

SEQ ID NO: 845781 - RNA, 17 nt, Homo sapiens
acaauugucauguaugu

SEQ ID NO: 845782 - RNA, 19 nt, Homo sapiens
acacucauccccucacuug

SEQ ID NO: 845783 - RNA, 14 nt, Homo sapiens
acagaaacuccugu

SEQ ID NO: 845784 - RNA, 18 nt, Homo sapiens
acagggacugaaaaccuc

SEQ ID NO: 845785 - RNA, 18 nt, Homo sapiens
acaguugcauguuauauu

SEQ ID NO: 845786 - RNA, 14 nt, Homo sapiens
acaugcacucagcu

SEQ ID NO: 845787 - RNA, 17 nt, Homo sapiens
acaugcacucagcucuu

SEQ ID NO: 845788 - RNA, 21 nt, Homo sapiens
acaugcacucagcucuuggcu

SEQ ID NO: 845789 - RNA, 22 nt, Homo sapiens
accaaugccaaaaaaagacagg

SEQ ID NO: 845790 - RNA, 13 nt, Homo sapiens
accagacagacaa

SEQ ID NO: 845791 - RNA, 14 nt, Homo sapiens
acccccaugaccaa

SEQ ID NO: 845792 - RNA, 21 nt, Homo sapiens
acccugaggugagcaucaucu

SEQ ID NO: 845793 - RNA, 19 nt, Homo sapiens
accggccuuugcaccucca

SEQ ID NO: 845794 - RNA, 22 nt, Homo sapiens
accuccauggaaacgaagcacc

SEQ ID NO: 845795 - RNA, 18 nt, Homo sapiens
accuccuaagaaggcacc

SEQ ID NO: 845796 - RNA, 15 nt, Homo sapiens
acgccgcccuaaaag

SEQ ID NO: 845797 - RNA, 20 nt, Homo sapiens
acgguggcucacgccuguaa

SEQ ID NO: 845798 - RNA, 23 nt, Homo sapiens
acucacugaggguaucugacaau

SEQ ID NO: 845799 - RNA, 15 nt, Homo sapiens
acucagcucuuggcu

SEQ ID NO: 845800 - RNA, 18 nt, Homo sapiens
acucagcucuuggcucca

SEQ ID NO: 845801 - RNA, 15 nt, Homo sapiens
acuccugcuagaaca

SEQ ID NO: 845802 - RNA, 13 nt, Homo sapiens
acucugggcucca

SEQ ID NO: 845803 - RNA, 14 nt, Homo sapiens
acucugggcuccag

SEQ ID NO: 845804 - RNA, 15 nt, Homo sapiens
acugaaaaccucucc

SEQ ID NO: 845805 - RNA, 14 nt, Homo sapiens
acugaaagugaaag

SEQ ID NO: 845806 - RNA, 14 nt, Homo sapiens
acuuuauaguuguu

SEQ ID NO: 845807 - RNA, 16 nt, Homo sapiens
agaaaaaaaguaggaa

SEQ ID NO: 845808 - RNA, 14 nt, Homo sapiens
agaaaacuaaguca

SEQ ID NO: 845809 - RNA, 21 nt, Homo sapiens
agaaaauaaaauuuaacucac

SEQ ID NO: 845810 - RNA, 15 nt, Homo sapiens
agaauaaccaacacc

SEQ ID NO: 845811 - RNA, 17 nt, Homo sapiens
agaaugggggcagcacc

SEQ ID NO: 845812 - RNA, 15 nt, Homo sapiens
agaauuucacaagcu

SEQ ID NO: 845813 - RNA, 15 nt, Homo sapiens
agacaagcagcccuu

SEQ ID NO: 845814 - RNA, 14 nt, Homo sapiens
agagguuucaguga

SEQ ID NO: 845815 - RNA, 20 nt, Homo sapiens
agcaccuccuaagaaggcac

SEQ ID NO: 845816 - RNA, 21 nt, Homo sapiens
agcccuuccccucugcagcuu

SEQ ID NO: 845817 - RNA, 13 nt, Homo sapiens
agcuaacaccaga

SEQ ID NO: 845818 - RNA, 20 nt, Homo sapiens
agcucuuggcuccacuggga

SEQ ID NO: 845819 - RNA, 13 nt, Homo sapiens
agcugcucaggga

SEQ ID NO: 845820 - RNA, 17 nt, Homo sapiens
agcuggaugugguggca

SEQ ID NO: 845821 - RNA, 21 nt, Homo sapiens
agcugguggcucugugugcuc

SEQ ID NO: 845822 - RNA, 19 nt, Homo sapiens
aggaaaagcggacaucagc

SEQ ID NO: 845823 - RNA, 20 nt, Homo sapiens
aggaaaagcggacaucagcu

SEQ ID NO: 845824 - RNA, 13 nt, Homo sapiens
aggaaacaacagc

SEQ ID NO: 845825 - RNA, 20 nt, Homo sapiens
aggaagaucccuuuguccac

SEQ ID NO: 845826 - RNA, 15 nt, Homo sapiens
aggacaagggaaaug

SEQ ID NO: 845827 - RNA, 21 nt, Homo sapiens
aggacaagggaaaugucaggg

SEQ ID NO: 845828 - RNA, 20 nt, Homo sapiens
aggacauccccccgccaaaa

SEQ ID NO: 845829 - RNA, 16 nt, Homo sapiens
aggaccggccuuugca

SEQ ID NO: 845830 - RNA, 17 nt, Homo sapiens
aggagggugagugcaag

SEQ ID NO: 845831 - RNA, 11 nt, Homo sapiens
aggauguugcc

SEQ ID NO: 845832 - RNA, 16 nt, Homo sapiens
aggcacagaaacuccu

SEQ ID NO: 845833 - RNA, 15 nt, Homo sapiens
aggcaccucucuggg

SEQ ID NO: 845834 - RNA, 16 nt, Homo sapiens
aggcaggcacugccaa

SEQ ID NO: 845835 - RNA, 18 nt, Homo sapiens
aggccaggccagcugccu

SEQ ID NO: 845836 - RNA, 20 nt, Homo sapiens
aggcgggcagaucacgaguu

SEQ ID NO: 845837 - RNA, 14 nt, Homo sapiens
agggagcugaguaa

SEQ ID NO: 845838 - RNA, 12 nt, Homo sapiens
agggagucucag

SEQ ID NO: 845839 - RNA, 15 nt, Homo sapiens
agggugagugcaagg

SEQ ID NO: 845840 - RNA, 16 nt, Homo sapiens
aguaucuugguuguga

SEQ ID NO: 845841 - RNA, 19 nt, Homo sapiens
agucccuccccaaaugcuu

SEQ ID NO: 845842 - RNA, 20 nt, Homo sapiens
agugcauuaaacugaaucac

SEQ ID NO: 845843 - RNA, 18 nt, Homo sapiens
aguuaacucacugagggu

SEQ ID NO: 845844 - RNA, 13 nt, Homo sapiens
auaaucaaugaag

SEQ ID NO: 845845 - RNA, 19 nt, Homo sapiens
auagggagcagaugcaaug

SEQ ID NO: 845846 - RNA, 21 nt, Homo sapiens
auaguuguuuuauauguugcu

SEQ ID NO: 845847 - RNA, 13 nt, Homo sapiens
auauguugcuaua

SEQ ID NO: 845848 - RNA, 22 nt, Homo sapiens
auauuacacaucaagcgaugaa

SEQ ID NO: 845849 - RNA, 23 nt, Homo sapiens
auauuuuaagaauuucacaagcu

SEQ ID NO: 845850 - RNA, 20 nt, Homo sapiens
aucccuuuguccacaaguaa

SEQ ID NO: 845851 - RNA, 14 nt, Homo sapiens
aucgaucaugaugu

SEQ ID NO: 845852 - RNA, 16 nt, Homo sapiens
aucgaugaaggaauau

SEQ ID NO: 845853 - RNA, 20 nt, Homo sapiens
aucucagguguguugcagug

SEQ ID NO: 845854 - RNA, 15 nt, Homo sapiens
aucuccaagaccaga

SEQ ID NO: 845855 - RNA, 23 nt, Homo sapiens
aucuggcucuggacaggcacuau

SEQ ID NO: 845856 - RNA, 14 nt, Homo sapiens
augaaacuggaaaa

SEQ ID NO: 845857 - RNA, 21 nt, Homo sapiens
augacaugcacucagcucuug

SEQ ID NO: 845858 - RNA, 19 nt, Homo sapiens
augcacucagcucuuggcu

SEQ ID NO: 845859 - RNA, 19 nt, Homo sapiens
augcucagaccagcucuuc

SEQ ID NO: 845860 - RNA, 22 nt, Homo sapiens
augcugagguuaugaacaaagu

SEQ ID NO: 845861 - RNA, 20 nt, Homo sapiens
auggaaacgaagcaccauca

SEQ ID NO: 845862 - RNA, 18 nt, Homo sapiens
auuaauuuuuaaggaugu

SEQ ID NO: 845863 - RNA, 18 nt, Homo sapiens
auuguccccuaaaccaaa

SEQ ID NO: 845864 - RNA, 14 nt, Homo sapiens
auuucacaagcuau

SEQ ID NO: 845865 - RNA, 17 nt, Homo sapiens
auuuuaagaauuucaca

SEQ ID NO: 845866 - RNA, 19 nt, Homo sapiens
auuuuaagaauuucacaag

SEQ ID NO: 845867 - RNA, 14 nt, Homo sapiens
caaaaaaagacagg

SEQ ID NO: 845868 - RNA, 12 nt, Homo sapiens
caaaacugccuc

SEQ ID NO: 845869 - RNA, 13 nt, Homo sapiens
caaaacugccuca

SEQ ID NO: 845870 - RNA, 12 nt, Homo sapiens
caaagugaggag

SEQ ID NO: 845871 - RNA, 21 nt, Homo sapiens
caacagacuucucaauaauca

SEQ ID NO: 845872 - RNA, 17 nt, Homo sapiens
caagccacgaaugaaug

SEQ ID NO: 845873 - RNA, 18 nt, Homo sapiens
caaggagggugagugcaa

SEQ ID NO: 845874 - RNA, 20 nt, Homo sapiens
caaguaaaaggaaaugcucc

SEQ ID NO: 845875 - RNA, 17 nt, Homo sapiens
ccccacacuccauggag

SEQ ID NO: 845876 - RNA, 16 nt, Homo sapiens
ccccuaaaccaaaaac

SEQ ID NO: 845877 - RNA, 15 nt, Homo sapiens
ccccucagagugcaa

SEQ ID NO: 845878 - RNA, 14 nt, Homo sapiens
ccccugcuccagaa

SEQ ID NO: 845879 - RNA, 17 nt, Homo sapiens
cccuaaaagcacacuca

SEQ ID NO: 845880 - RNA, 15 nt, Homo sapiens
cccucagagugcaag

SEQ ID NO: 845881 - RNA, 19 nt, Homo sapiens
cccugaggugagcaucauc

SEQ ID NO: 845882 - RNA, 16 nt, Homo sapiens
cccuuuguccacaagu

SEQ ID NO: 845883 - RNA, 13 nt, Homo sapiens
ccuaaaagcacac

SEQ ID NO: 845884 - RNA, 23 nt, Homo sapiens
ccuaagaaggcaccucucugggu

SEQ ID NO: 845885 - RNA, 20 nt, Homo sapiens
ccucaaccaaugccaaaaaa

SEQ ID NO: 845886 - RNA, 19 nt, Homo sapiens
ccuccuuggagacagggcc

SEQ ID NO: 845887 - RNA, 13 nt, Homo sapiens
ccucucuggguug

SEQ ID NO: 845888 - RNA, 20 nt, Homo sapiens
ccucugcagcuuccaggcug

SEQ ID NO: 845889 - RNA, 15 nt, Homo sapiens
ccugaggugagcauc

SEQ ID NO: 845890 - RNA, 15 nt, Homo sapiens
ccuguaaucccagcu

SEQ ID NO: 845891 - RNA, 23 nt, Homo sapiens
ccuguaauuccagcacuuuggga

SEQ ID NO: 845892 - RNA, 21 nt, Homo sapiens
ccuguguguccaaaacugccu

SEQ ID NO: 845893 - RNA, 14 nt, Homo sapiens
ccuucugaggagcu

SEQ ID NO: 845894 - RNA, 22 nt, Homo sapiens
ccuucugaggagcuguugaggu

SEQ ID NO: 845895 - RNA, 15 nt, Homo sapiens
cgagaccaucuuggc

SEQ ID NO: 845896 - RNA, 21 nt, Homo sapiens
cgcagacacaugugcuggcca

SEQ ID NO: 845897 - RNA, 17 nt, Homo sapiens
cgguuuauucacuguau

SEQ ID NO: 845898 - RNA, 15 nt, Homo sapiens
cguugaacgucacau

SEQ ID NO: 845899 - RNA, 17 nt, Homo sapiens
cguugaacgucacaucu

SEQ ID NO: 845900 - RNA, 18 nt, Homo sapiens
cuaaaagcacacucaucc

SEQ ID NO: 845901 - RNA, 12 nt, Homo sapiens
cuaaaccaaaaa

SEQ ID NO: 845902 - RNA, 22 nt, Homo sapiens
cuacaagccacgaaugaaugaa

SEQ ID NO: 845903 - RNA, 19 nt, Homo sapiens
cucaagcuaugugagcuca

SEQ ID NO: 845904 - RNA, 16 nt, Homo sapiens
cucagaccagcucuuc

SEQ ID NO: 845905 - RNA, 18 nt, Homo sapiens
cucagagugcaagccccu

SEQ ID NO: 845906 - RNA, 17 nt, Homo sapiens
cucagcuucacccugag

SEQ ID NO: 845907 - RNA, 22 nt, Homo sapiens
cucagguguguugcagugucug

SEQ ID NO: 845908 - RNA, 18 nt, Homo sapiens
cuccccucagagugcaag

SEQ ID NO: 845909 - RNA, 15 nt, Homo sapiens
cucugggcuccagag

SEQ ID NO: 845910 - RNA, 19 nt, Homo sapiens
cugagaaaacuaagucaga

SEQ ID NO: 845911 - RNA, 23 nt, Homo sapiens
cugaggugagcaucaucuucugg

SEQ ID NO: 845912 - RNA, 17 nt, Homo sapiens
cugauccgagcucaggg

SEQ ID NO: 845913 - RNA, 12 nt, Homo sapiens
cugcuccagaag

SEQ ID NO: 845914 - RNA, 17 nt, Homo sapiens
cuggacaggcacuaucu

SEQ ID NO: 845915 - RNA, 23 nt, Homo sapiens
cuggcgacagagggagacuccau

SEQ ID NO: 845916 - RNA, 18 nt, Homo sapiens
cuggggcuuuaacuccug

SEQ ID NO: 845917 - RNA, 14 nt, Homo sapiens
cuggugucuucagg

SEQ ID NO: 845918 - RNA, 20 nt, Homo sapiens
cugucgguuuauucacugua

SEQ ID NO: 845919 - RNA, 13 nt, Homo sapiens
cugugccaguucu

SEQ ID NO: 845920 - RNA, 14 nt, Homo sapiens
cugugugcucugau

SEQ ID NO: 845921 - RNA, 14 nt, Homo sapiens
cuguuccugcagua

SEQ ID NO: 845922 - RNA, 19 nt, Homo sapiens
cuuagcccuuccccucugc

SEQ ID NO: 845923 - RNA, 22 nt, Homo sapiens
cuucgggcugugcccggggaaa

SEQ ID NO: 845924 - RNA, 21 nt, Homo sapiens
cuugaggcacagaaacuccug

SEQ ID NO: 845925 - RNA, 13 nt, Homo sapiens
cuugucccugugg

SEQ ID NO: 845926 - RNA, 19 nt, Homo sapiens
gaaaagcggacaucagcug

SEQ ID NO: 845927 - RNA, 16 nt, Homo sapiens
gaaaauaaaauuuaac

SEQ ID NO: 845928 - RNA, 14 nt, Homo sapiens
gaaauguaugugcu

SEQ ID NO: 845929 - RNA, 19 nt, Homo sapiens
gaaauuuaaauaagauuua

SEQ ID NO: 845930 - RNA, 19 nt, Homo sapiens
gaacagucucuugaggcac

SEQ ID NO: 845931 - RNA, 10 nt, Homo sapiens
gaauuucaca

SEQ ID NO: 845932 - RNA, 14 nt, Homo sapiens
gaauuucacaagcu

SEQ ID NO: 845933 - RNA, 14 nt, Homo sapiens
gacagccugaguca

SEQ ID NO: 845934 - RNA, 15 nt, Homo sapiens
gacucaggacauccc

SEQ ID NO: 845935 - RNA, 22 nt, Homo sapiens
gagcagaugcaaugacucagga

SEQ ID NO: 845936 - RNA, 21 nt, Homo sapiens
gagccaagaucgcaccacugc

SEQ ID NO: 845937 - RNA, 18 nt, Homo sapiens
gagggaccucucccaggg

SEQ ID NO: 845938 - RNA, 15 nt, Homo sapiens
gagggagacuccauc

SEQ ID NO: 845939 - RNA, 18 nt, Homo sapiens
gagugaaggggccaagga

SEQ ID NO: 845940 - RNA, 18 nt, Homo sapiens
gagugugguuaugaacuu

SEQ ID NO: 845941 - RNA, 16 nt, Homo sapiens
gauauugucagucuuu

SEQ ID NO: 845942 - RNA, 20 nt, Homo sapiens
gaugaaacuggaaaacuaca

SEQ ID NO: 845943 - RNA, 22 nt, Homo sapiens
gaugccgagguaaaaguucuuu

SEQ ID NO: 845944 - RNA, 14 nt, Homo sapiens
gauuuaauucacau

SEQ ID NO: 845945 - RNA, 14 nt, Homo sapiens
gcaccucucugggu

SEQ ID NO: 845946 - RNA, 14 nt, Homo sapiens
gcacugccaaaaca

SEQ ID NO: 845947 - RNA, 23 nt, Homo sapiens
gcagcucuccccucagagugcaa

SEQ ID NO: 845948 - RNA, 14 nt, Homo sapiens
gcauuaaacugaau

SEQ ID NO: 845949 - RNA, 14 nt, Homo sapiens
gccaaaagcugcuc

SEQ ID NO: 845950 - RNA, 12 nt, Homo sapiens
gccacacucugg

SEQ ID NO: 845951 - RNA, 16 nt, Homo sapiens
gccacgaaugaaugaa

SEQ ID NO: 845952 - RNA, 17 nt, Homo sapiens
gcccaggcuggucuuga

SEQ ID NO: 845953 - RNA, 18 nt, Homo sapiens
gcccauccccaggcaccu

SEQ ID NO: 845954 - RNA, 21 nt, Homo sapiens
gcccauccccaggcaccucac

SEQ ID NO: 845955 - RNA, 15 nt, Homo sapiens
gccuugugaggagcu

SEQ ID NO: 845956 - RNA, 14 nt, Homo sapiens
gcguugagccacca

SEQ ID NO: 845957 - RNA, 13 nt, Homo sapiens
gcuccacugggau

SEQ ID NO: 845958 - RNA, 19 nt, Homo sapiens
gcucuuggcuccacuggga

SEQ ID NO: 845959 - RNA, 21 nt, Homo sapiens
caucccuagaaagccaugugc

SEQ ID NO: 845960 - RNA, 19 nt, Homo sapiens
cauguuauauuauuacuaa

SEQ ID NO: 845961 - RNA, 22 nt, Homo sapiens
cauugaggcaggcacugccaaa

SEQ ID NO: 845962 - RNA, 14 nt, Homo sapiens
cauuuaauguauau

SEQ ID NO: 845963 - RNA, 16 nt, Homo sapiens
ccaaaagcugcucagg

SEQ ID NO: 845964 - RNA, 19 nt, Homo sapiens
ccaaaagcugcucagggaa

SEQ ID NO: 845965 - RNA, 21 nt, Homo sapiens
ccaacaucgcagacacaugug

SEQ ID NO: 845966 - RNA, 19 nt, Homo sapiens
ccaaggagggugagugcaa

SEQ ID NO: 845967 - RNA, 20 nt, Homo sapiens
ccaaggagggugagugcaag

SEQ ID NO: 845968 - RNA, 18 nt, Homo sapiens
ccaaugccaaaaaaagac

SEQ ID NO: 845969 - RNA, 12 nt, Homo sapiens
ccaccugcugag

SEQ ID NO: 845970 - RNA, 13 nt, Homo sapiens
ccagaaacuguuc

SEQ ID NO: 845971 - RNA, 21 nt, Homo sapiens
ccagacagacaacacugggaa

SEQ ID NO: 845972 - RNA, 16 nt, Homo sapiens
ccagcuauuugggagg

SEQ ID NO: 845973 - RNA, 14 nt, Homo sapiens
ccaggaaaggccca

SEQ ID NO: 845974 - RNA, 22 nt, Homo sapiens
ccaggcuggcgugcagcaucag

SEQ ID NO: 845975 - RNA, 12 nt, Homo sapiens
gugagugcaagg

SEQ ID NO: 845976 - RNA, 14 nt, Homo sapiens
gugaucaaagccac

SEQ ID NO: 845977 - RNA, 19 nt, Homo sapiens
gugcauuaaacugaaucac

SEQ ID NO: 845978 - RNA, 15 nt, Homo sapiens
gugccaguucuuucc

SEQ ID NO: 845979 - RNA, 18 nt, Homo sapiens
gugucauauacaauuguc

SEQ ID NO: 845980 - RNA, 12 nt, Homo sapiens
guguguccaaaa

SEQ ID NO: 845981 - RNA, 19 nt, Homo sapiens
guguguccaaaacugccuc

SEQ ID NO: 845982 - RNA, 17 nt, Homo sapiens
gugugugcagcauuguu

SEQ ID NO: 845983 - RNA, 12 nt, Homo sapiens
guugcuauaaua

SEQ ID NO: 845984 - RNA, 16 nt, Homo sapiens
guugcuauaauaaaga

SEQ ID NO: 845985 - RNA, 16 nt, Homo sapiens
guuggugaauuucaca

SEQ ID NO: 845986 - RNA, 15 nt, Homo sapiens
guuuuauauguugcu

SEQ ID NO: 845987 - RNA, 17 nt, Homo sapiens
guuuucccaucucaggu

SEQ ID NO: 845988 - RNA, 14 nt, Homo sapiens
uaaaauuuaacuca

SEQ ID NO: 845989 - RNA, 19 nt, Homo sapiens
uaaaccaaaaacugaaagu

SEQ ID NO: 845990 - RNA, 22 nt, Homo sapiens
uaaagaagguuggugaauuuca

SEQ ID NO: 845991 - RNA, 16 nt, Homo sapiens
uaaauaacuaaugucu

SEQ ID NO: 845992 - RNA, 23 nt, Homo sapiens
uaacaccagacagacaacacugg

SEQ ID NO: 845993 - RNA, 12 nt, Homo sapiens
uaagaauuucac

SEQ ID NO: 845994 - RNA, 13 nt, Homo sapiens
uaagaauuucaca

SEQ ID NO: 845995 - RNA, 14 nt, Homo sapiens
uaagaauuucacaa

SEQ ID NO: 845996 - RNA, 14 nt, Homo sapiens
uaaucaaugaagua

SEQ ID NO: 845997 - RNA, 22 nt, Homo sapiens
uaaucaaugaaguagcugagaa

SEQ ID NO: 845998 - RNA, 20 nt, Homo sapiens
uaauuagcauggccacaucu

SEQ ID NO: 845999 - RNA, 12 nt, Homo sapiens
uacaauugucau

SEQ ID NO: 846000 - RNA, 13 nt, Homo sapiens
uacauucuugcua

SEQ ID NO: 846001 - RNA, 16 nt, Homo sapiens
uacccccaugaccaac

SEQ ID NO: 846002 - RNA, 20 nt, Homo sapiens
uaccucaaccaaugccaaaa

SEQ ID NO: 846003 - RNA, 22 nt, Homo sapiens
uagaaugggggcagcaccuccu

SEQ ID NO: 846004 - RNA, 20 nt, Homo sapiens
uagagugugguuaugaacuu

SEQ ID NO: 846005 - RNA, 19 nt, Homo sapiens
uagaugagagaacagggcu

SEQ ID NO: 846006 - RNA, 18 nt, Homo sapiens
uauacaauugucauguau

SEQ ID NO: 846007 - RNA, 16 nt, Homo sapiens
uaucugacaaugcuga

SEQ ID NO: 846008 - RNA, 22 nt, Homo sapiens
uauguaauuuuauuuacauucu

SEQ ID NO: 846009 - RNA, 17 nt, Homo sapiens
ucaaacaaacucucuga

SEQ ID NO: 846010 - RNA, 17 nt, Homo sapiens
ucaaagccacacucugg

SEQ ID NO: 846011 - RNA, 15 nt, Homo sapiens
ucaaaucugagggag

SEQ ID NO: 846012 - RNA, 15 nt, Homo sapiens
ucaaccaaugccaaa

SEQ ID NO: 846013 - RNA, 17 nt, Homo sapiens
ucaagcuaugugagcuc

SEQ ID NO: 846014 - RNA, 18 nt, Homo sapiens
ucaagggugugugcagca

SEQ ID NO: 846015 - RNA, 20 nt, Homo sapiens
ucaaugaaguagcugagaaa

SEQ ID NO: 846016 - RNA, 16 nt, Homo sapiens
ucacagggacugaaaa

SEQ ID NO: 846017 - RNA, 21 nt, Homo sapiens
ucaccuacauuugagaauuau

SEQ ID NO: 846018 - RNA, 17 nt, Homo sapiens
ucacgaguucaggagau

SEQ ID NO: 846019 - RNA, 14 nt, Homo sapiens
ucacuguccuccaa

SEQ ID NO: 846020 - RNA, 12 nt, Homo sapiens
ucagagugcaag

SEQ ID NO: 846021 - RNA, 14 nt, Homo sapiens
ucauauacaauugu

SEQ ID NO: 846022 - RNA, 17 nt, Homo sapiens
ucauauacaauugucau

SEQ ID NO: 846023 - RNA, 15 nt, Homo sapiens
uccccuaaaccaaaa

SEQ ID NO: 846024 - RNA, 17 nt, Homo sapiens
uccccuaaaccaaaaac

SEQ ID NO: 846025 - RNA, 16 nt, Homo sapiens
uccccucagagugcaa

SEQ ID NO: 846026 - RNA, 17 nt, Homo sapiens
uccccucagagugcaag

SEQ ID NO: 846027 - RNA, 22 nt, Homo sapiens
ucccugggguggggauagggag

SEQ ID NO: 846028 - RNA, 21 nt, Homo sapiens
ucucagcuucacccugaggug

SEQ ID NO: 846029 - RNA, 18 nt, Homo sapiens
ucugacaaugcugagguu

SEQ ID NO: 846030 - RNA, 15 nt, Homo sapiens
ucuucucagaaggaa

SEQ ID NO: 846031 - RNA, 17 nt, Homo sapiens
ugaaauguaugugcucu

SEQ ID NO: 846032 - RNA, 15 nt, Homo sapiens
ugaaucacaauguaa

SEQ ID NO: 846033 - RNA, 13 nt, Homo sapiens
ugaggcaggagaa

SEQ ID NO: 846034 - RNA, 11 nt, Homo sapiens
ugagugcaagg

SEQ ID NO: 846035 - RNA, 18 nt, Homo sapiens
ugaucaaagccacacucu

SEQ ID NO: 846036 - RNA, 14 nt, Homo sapiens
ugccaaaacaucaa

SEQ ID NO: 846037 - RNA, 21 nt, Homo sapiens
ugccacgccgcccuaaaagca

SEQ ID NO: 846038 - RNA, 22 nt, Homo sapiens
uggaaacgaagcaccaucauuc

SEQ ID NO: 846039 - RNA, 13 nt, Homo sapiens
uggagacauugag

SEQ ID NO: 846040 - RNA, 16 nt, Homo sapiens
uggcucuggacaggca

SEQ ID NO: 846041 - RNA, 17 nt, Homo sapiens
uggggagacuucuuggc

SEQ ID NO: 846042 - RNA, 14 nt, Homo sapiens
uggugaauuucaca

SEQ ID NO: 846043 - RNA, 15 nt, Homo sapiens
ugguggaugaacaaa

SEQ ID NO: 846044 - RNA, 23 nt, Homo sapiens
uguaacugugccaguucuuucca

SEQ ID NO: 846045 - RNA, 14 nt, Homo sapiens
uguccaaaacugcc

SEQ ID NO: 846046 - RNA, 15 nt, Homo sapiens
uguccuccaagccag

SEQ ID NO: 846047 - RNA, 19 nt, Homo sapiens
ugugccaguucuuuccaua

SEQ ID NO: 846048 - RNA, 19 nt, Homo sapiens
uguggaaggugaucuggcu

SEQ ID NO: 846049 - RNA, 11 nt, Homo sapiens
uguguccaaaa

SEQ ID NO: 846050 - RNA, 19 nt, Homo sapiens
uuaaauaagauuuaauuca

SEQ ID NO: 846051 - RNA, 20 nt, Homo sapiens
uuaaauaagauuuaauucac

SEQ ID NO: 846052 - RNA, 21 nt, Homo sapiens
uuaaauaagauuuaauucaca

SEQ ID NO: 846053 - RNA, 18 nt, Homo sapiens
uuaacucacacugcccag

SEQ ID NO: 846054 - RNA, 14 nt, Homo sapiens
uuaagaauuucaca

SEQ ID NO: 846055 - RNA, 18 nt, Homo sapiens
uuaagaauuucacaagcu

SEQ ID NO: 846056 - RNA, 16 nt, Homo sapiens
uuauauguugcuauaa

SEQ ID NO: 846057 - RNA, 20 nt, Homo sapiens
uuccaggcuggcgugcagca

SEQ ID NO: 846058 - RNA, 14 nt, Homo sapiens
uucuuuuugcucua

SEQ ID NO: 846059 - RNA, 16 nt, Homo sapiens
uugaacgucacaucuu

SEQ ID NO: 846060 - RNA, 22 nt, Homo sapiens
uugacccucacaggagcaucuc

SEQ ID NO: 846061 - RNA, 20 nt, Homo sapiens
uugaggcaggcacugccaaa

SEQ ID NO: 846062 - RNA, 17 nt, Homo sapiens
uugcagugucugcugga

SEQ ID NO: 846063 - RNA, 20 nt, Homo sapiens
uugggcuggaugccgaggua

SEQ ID NO: 846064 - RNA, 14 nt, Homo sapiens
uuggugaauuucac

SEQ ID NO: 846065 - RNA, 16 nt, Homo sapiens
uuggugaauuucacaa

SEQ ID NO: 846066 - RNA, 19 nt, Homo sapiens
uugucacagggacugaaaa

SEQ ID NO: 846067 - RNA, 23 nt, Homo sapiens
uugucuacuucuggagucuauaa

SEQ ID NO: 846068 - RNA, 13 nt, Homo sapiens
uuguguguggaag

SEQ ID NO: 846069 - RNA, 14 nt, Homo sapiens
uuuaagaauuucac

SEQ ID NO: 846070 - RNA, 20 nt, Homo sapiens
uuuuaauuuuuugucaagac

SEQ ID NO: 846071 - RNA, 13 nt, Homo sapiens
uuuuauauguugc

SEQ ID NO: 846072 - RNA, 16 nt, Homo sapiens
cacacuccauggaguc

SEQ ID NO: 846073 - RNA, 16 nt, Homo sapiens
cacagauaaaguuuuc

SEQ ID NO: 846074 - RNA, 14 nt, Homo sapiens
caccaagcuggugg

SEQ ID NO: 846075 - RNA, 16 nt, Homo sapiens
caccauuggaccccac

SEQ ID NO: 846076 - RNA, 12 nt, Homo sapiens
cacccugagguu

SEQ ID NO: 846077 - RNA, 20 nt, Homo sapiens
caccucacaggccccaggaa

SEQ ID NO: 846078 - RNA, 18 nt, Homo sapiens
cacucauccccucacuug

SEQ ID NO: 846079 - RNA, 16 nt, Homo sapiens
cagacaacacugggaa

SEQ ID NO: 846080 - RNA, 19 nt, Homo sapiens
cagacaacacugggaaaca

SEQ ID NO: 846081 - RNA, 16 nt, Homo sapiens
cagacagacaacacug

SEQ ID NO: 846082 - RNA, 16 nt, Homo sapiens
cagacucaaaugcuca

SEQ ID NO: 846083 - RNA, 18 nt, Homo sapiens
cagaguggggaugacaug

SEQ ID NO: 846084 - RNA, 14 nt, Homo sapiens
cagaucuaugccac

SEQ ID NO: 846085 - RNA, 15 nt, Homo sapiens
cagaucuaugccaca

SEQ ID NO: 846086 - RNA, 20 nt, Homo sapiens
cagaucuaugccacaagaac

SEQ ID NO: 846087 - RNA, 16 nt, Homo sapiens
cagaugcaaugacuca

SEQ ID NO: 846088 - RNA, 18 nt, Homo sapiens
cagcuaccucaaccaaug

SEQ ID NO: 846089 - RNA, 19 nt, Homo sapiens
cagcucuuccgaaaaccag

SEQ ID NO: 846090 - RNA, 22 nt, Homo sapiens
cagcucuuggcuccacugggau

SEQ ID NO: 846091 - RNA, 22 nt, Homo sapiens
cagcuucacccugaggugagca

SEQ ID NO: 846092 - RNA, 13 nt, Homo sapiens
caggagaaucgcu

SEQ ID NO: 846093 - RNA, 14 nt, Homo sapiens
cagugccuguaauc

SEQ ID NO: 846094 - RNA, 15 nt, Homo sapiens
caucaucuucugggu

SEQ ID NO: 846095 - RNA, 21 nt, Homo sapiens
cauggaaacgaagcaccauca

SEQ ID NO: 846096 - RNA, 14 nt, Homo sapiens
cauggccacaucug

SEQ ID NO: 846097 - RNA, 17 nt, Homo sapiens
ccaaaugcuuuccauga

SEQ ID NO: 846098 - RNA, 17 nt, Homo sapiens
ccaggagacucugggaa

SEQ ID NO: 846099 - RNA, 20 nt, Homo sapiens
ccagggagucucagcuucac

SEQ ID NO: 846100 - RNA, 16 nt, Homo sapiens
ccauccccaggcaccu

SEQ ID NO: 846101 - RNA, 12 nt, Homo sapiens
ccaugugcagcc

SEQ ID NO: 846102 - RNA, 15 nt, Homo sapiens
ccauugggcaggcag

SEQ ID NO: 846103 - RNA, 16 nt, Homo sapiens
cccaaaugcuuuccau

SEQ ID NO: 846104 - RNA, 22 nt, Homo sapiens
cccacacuccauggagucugga

SEQ ID NO: 846105 - RNA, 16 nt, Homo sapiens
cccaggcuggucuuga

SEQ ID NO: 846106 - RNA, 10 nt, Homo sapiens
cccaucucag

SEQ ID NO: 846107 - RNA, 13 nt, Homo sapiens
ccccuaaaccaaa

SEQ ID NO: 846108 - RNA, 14 nt, Homo sapiens
ccccuaaaccaaaa

SEQ ID NO: 846109 - RNA, 17 nt, Homo sapiens
cccucaaaucugaggga

SEQ ID NO: 846110 - RNA, 16 nt, Homo sapiens
cccucacaggagcauc

SEQ ID NO: 846111 - RNA, 18 nt, Homo sapiens
cccucacaggagcaucuc

SEQ ID NO: 846112 - RNA, 18 nt, Homo sapiens
cccucagagugcaagccc

SEQ ID NO: 846113 - RNA, 17 nt, Homo sapiens
cccuccccaaaugcuuu

SEQ ID NO: 846114 - RNA, 10 nt, Homo sapiens
cccugagguu

SEQ ID NO: 846115 - RNA, 14 nt, Homo sapiens
cccugccucaagcu

SEQ ID NO: 846116 - RNA, 14 nt, Homo sapiens
ccgagcucaggggg

SEQ ID NO: 846117 - RNA, 23 nt, Homo sapiens
ccgcgugaucaaagccacacucu

SEQ ID NO: 846118 - RNA, 15 nt, Homo sapiens
ccggggaaaggcaag

SEQ ID NO: 846119 - RNA, 16 nt, Homo sapiens
ccuaaaagcacacuca

SEQ ID NO: 846120 - RNA, 15 nt, Homo sapiens
ccucaaccaaugcca

SEQ ID NO: 846121 - RNA, 20 nt, Homo sapiens
ccucaagcuaugugagcuca

SEQ ID NO: 846122 - RNA, 22 nt, Homo sapiens
ccucaugagggcuggaugcucu

SEQ ID NO: 846123 - RNA, 15 nt, Homo sapiens
ccuguaauuccagca

SEQ ID NO: 846124 - RNA, 20 nt, Homo sapiens
ccuguguguccaaaacugcc

SEQ ID NO: 846125 - RNA, 14 nt, Homo sapiens
cgcagacacaugug

SEQ ID NO: 846126 - RNA, 15 nt, Homo sapiens
cgcccaaggcccacg

SEQ ID NO: 846127 - RNA, 17 nt, Homo sapiens
cgggcugugcccgggga

SEQ ID NO: 846128 - RNA, 15 nt, Homo sapiens
cgugaucaaagccac

SEQ ID NO: 846129 - RNA, 15 nt, Homo sapiens
cuaaaagcacacuca

SEQ ID NO: 846130 - RNA, 18 nt, Homo sapiens
cucaaaucugagggagcu

SEQ ID NO: 846131 - RNA, 18 nt, Homo sapiens
cucaaccaaugccaaaaa

SEQ ID NO: 846132 - RNA, 18 nt, Homo sapiens
cucacugaggguaucuga

SEQ ID NO: 846133 - RNA, 14 nt, Homo sapiens
cucagcucuuggcu

SEQ ID NO: 846134 - RNA, 19 nt, Homo sapiens
cucagcucuuggcuccacu

SEQ ID NO: 846135 - RNA, 15 nt, Homo sapiens
cucaggggggugguu

SEQ ID NO: 846136 - RNA, 12 nt, Homo sapiens
cuccaaggaccg

SEQ ID NO: 846137 - RNA, 16 nt, Homo sapiens
cuccuaagaaggcacc

SEQ ID NO: 846138 - RNA, 24 nt, Homo sapiens
cuccuccagggagucucagcuuca

SEQ ID NO: 846139 - RNA, 15 nt, Homo sapiens
cucuaaaagaaaaag

SEQ ID NO: 846140 - RNA, 21 nt, Homo sapiens
cugaaagugaaaguccagaaa

SEQ ID NO: 846141 - RNA, 15 nt, Homo sapiens
cugaggagcuguuga

SEQ ID NO: 846142 - RNA, 21 nt, Homo sapiens
cugaggugagcaucaucuucu

SEQ ID NO: 846143 - RNA, 19 nt, Homo sapiens
cugauaagcuaacaccaga

SEQ ID NO: 846144 - RNA, 15 nt, Homo sapiens
cugccaaaacaucaa

SEQ ID NO: 846145 - RNA, 18 nt, Homo sapiens
cugccucaagcuauguga

SEQ ID NO: 846146 - RNA, 15 nt, Homo sapiens
cuggaugcucucguu

SEQ ID NO: 846147 - RNA, 20 nt, Homo sapiens
cuggguugaagggcaguguu

SEQ ID NO: 846148 - RNA, 23 nt, Homo sapiens
cuguaauuccagcacuuugggag

SEQ ID NO: 846149 - RNA, 16 nt, Homo sapiens
cuguguguccaaaacu

SEQ ID NO: 846150 - RNA, 18 nt, Homo sapiens
cuguugagguaccuccaa

SEQ ID NO: 846151 - RNA, 18 nt, Homo sapiens
cuuaucuccaagaccaga

SEQ ID NO: 846152 - RNA, 23 nt, Homo sapiens
cuucacccugaggugagcaucau

SEQ ID NO: 846153 - RNA, 23 nt, Homo sapiens
cuucacuguccuccaagccagcg

SEQ ID NO: 846154 - RNA, 22 nt, Homo sapiens
cuuccuguguguccaaaacugc

SEQ ID NO: 846155 - RNA, 16 nt, Homo sapiens
cuucugaggagcuguu

SEQ ID NO: 846156 - RNA, 19 nt, Homo sapiens
cuugaaccagggagucaga

SEQ ID NO: 846157 - RNA, 16 nt, Homo sapiens
cuugucccuguggaag

SEQ ID NO: 846158 - RNA, 22 nt, Homo sapiens
cuugugaggagcuggaaacaca

SEQ ID NO: 846159 - RNA, 13 nt, Homo sapiens
gaaacaacagcuu

SEQ ID NO: 846160 - RNA, 18 nt, Homo sapiens
gaaacuccuguucaugcc

SEQ ID NO: 846161 - RNA, 18 nt, Homo sapiens
gaaagccaugugcagcca

SEQ ID NO: 846162 - RNA, 22 nt, Homo sapiens
gaaagugcauuaaacugaauca

SEQ ID NO: 846163 - RNA, 17 nt, Homo sapiens
gaaaugcuccuccaggg

SEQ ID NO: 846164 - RNA, 16 nt, Homo sapiens
gaagcaccaucauucc

SEQ ID NO: 846165 - RNA, 19 nt, Homo sapiens
gaagguuggugaauuucac

SEQ ID NO: 846166 - RNA, 20 nt, Homo sapiens
gaagguuggugaauuucaca

SEQ ID NO: 846167 - RNA, 20 nt, Homo sapiens
gaauauuuuaagaauuucac

SEQ ID NO: 846168 - RNA, 14 nt, Homo sapiens
gaauggcagcugcc

SEQ ID NO: 846169 - RNA, 17 nt, Homo sapiens
gaauuucacaagcuauu

SEQ ID NO: 846170 - RNA, 13 nt, Homo sapiens
gacaacacuggga

SEQ ID NO: 846171 - RNA, 14 nt, Homo sapiens
gacaacacugggaa

SEQ ID NO: 846172 - RNA, 22 nt, Homo sapiens
gacaaugcugagguuaugaaca

SEQ ID NO: 846173 - RNA, 18 nt, Homo sapiens
gacacaugugcuggccac

SEQ ID NO: 846174 - RNA, 18 nt, Homo sapiens
gacagacaacacugggaa

SEQ ID NO: 846175 - RNA, 19 nt, Homo sapiens
gacauccccccgccaaaag

SEQ ID NO: 846176 - RNA, 20 nt, Homo sapiens
gaccggccuuugcaccucca

SEQ ID NO: 846177 - RNA, 17 nt, Homo sapiens
gacgcuauaggaugugg

SEQ ID NO: 846178 - RNA, 17 nt, Homo sapiens
gagacccaagcugccuc

SEQ ID NO: 846179 - RNA, 21 nt, Homo sapiens
gagcaucuccucaacucugag

SEQ ID NO: 846180 - RNA, 19 nt, Homo sapiens
gaggugagcaucaucuucu

SEQ ID NO: 846181 - RNA, 19 nt, Homo sapiens
gaucgagaccaucuuggcc

SEQ ID NO: 846182 - RNA, 13 nt, Homo sapiens
gaugaaacuggaa

SEQ ID NO: 846183 - RNA, 18 nt, Homo sapiens
gaugcaaugacucaggac

SEQ ID NO: 846184 - RNA, 22 nt, Homo sapiens
gcaaaaacauguaugugcauuu

SEQ ID NO: 846185 - RNA, 16 nt, Homo sapiens
gcaaauguaacugugc

SEQ ID NO: 846186 - RNA, 22 nt, Homo sapiens
gcaagaucauagcucauugcaa

SEQ ID NO: 846187 - RNA, 20 nt, Homo sapiens
gcaaugacucaggacauccc

SEQ ID NO: 846188 - RNA, 17 nt, Homo sapiens
gcaggagaaucgcuuga

SEQ ID NO: 846189 - RNA, 12 nt, Homo sapiens
gcaucagcaucc

SEQ ID NO: 846190 - RNA, 13 nt, Homo sapiens
aaauguaacugug

SEQ ID NO: 846191 - RNA, 18 nt, Homo sapiens
aaauguaacugugccagu

SEQ ID NO: 846192 - RNA, 20 nt, Homo sapiens
aacaccaucgaucaugaugu

SEQ ID NO: 846193 - RNA, 19 nt, Homo sapiens
aacauguaugugcauuuca

SEQ ID NO: 846194 - RNA, 15 nt, Homo sapiens
aacauuacuaacaau

SEQ ID NO: 846195 - RNA, 13 nt, Homo sapiens
aacgucacaucuu

SEQ ID NO: 846196 - RNA, 15 nt, Homo sapiens
aacuacaagccacga

SEQ ID NO: 846197 - RNA, 19 nt, Homo sapiens
aagaaaaaaaaagucuuug

SEQ ID NO: 846198 - RNA, 17 nt, Homo sapiens
aagaauuucacaagcua

SEQ ID NO: 846199 - RNA, 16 nt, Homo sapiens
aagccacacucugggc

SEQ ID NO: 846200 - RNA, 16 nt, Homo sapiens
aagccaugugcagcca

SEQ ID NO: 846201 - RNA, 17 nt, Homo sapiens
aagcuaugugagcucac

SEQ ID NO: 846202 - RNA, 14 nt, Homo sapiens
aaggaaaugcuccu

SEQ ID NO: 846203 - RNA, 18 nt, Homo sapiens
aaggagggugagugcaag

SEQ ID NO: 846204 - RNA, 14 nt, Homo sapiens
aaggcuuugaguua

SEQ ID NO: 846205 - RNA, 23 nt, Homo sapiens
aaguccagaaacuguucccaccu

SEQ ID NO: 846206 - RNA, 21 nt, Homo sapiens
aagucuuugguaaauggcaaa

SEQ ID NO: 846207 - RNA, 17 nt, Homo sapiens
aagugcauuaaacugaa

SEQ ID NO: 846208 - RNA, 16 nt, Homo sapiens
aauaaagcaacagacu

SEQ ID NO: 846209 - RNA, 20 nt, Homo sapiens
aauaacuaaugucucuacaa

SEQ ID NO: 846210 - RNA, 19 nt, Homo sapiens
aauauuuuaagaauuucac

SEQ ID NO: 846211 - RNA, 21 nt, Homo sapiens
aaucaaugaaguagcugagaa

SEQ ID NO: 846212 - RNA, 18 nt, Homo sapiens
aaucacaauguaaauauu

SEQ ID NO: 846213 - RNA, 17 nt, Homo sapiens
aaugaaauguaugugcu

SEQ ID NO: 846214 - RNA, 17 nt, Homo sapiens
aaugaaugaucuuggcu

SEQ ID NO: 846215 - RNA, 15 nt, Homo sapiens
aaugauacaguugca

SEQ ID NO: 846216 - RNA, 13 nt, Homo sapiens
aaugaucuuggcu

SEQ ID NO: 846217 - RNA, 13 nt, Homo sapiens
aaugcugagguua

SEQ ID NO: 846218 - RNA, 17 nt, Homo sapiens
aauguaacugugccagu

SEQ ID NO: 846219 - RNA, 20 nt, Homo sapiens
aauucguucaccuacauuug

SEQ ID NO: 846220 - RNA, 16 nt, Homo sapiens
aauuucacaagcuauu

SEQ ID NO: 846221 - RNA, 13 nt, Homo sapiens
acaaaaauuagcu

SEQ ID NO: 846222 - RNA, 17 nt, Homo sapiens
acaagcuauucccucaa

SEQ ID NO: 846223 - RNA, 13 nt, Homo sapiens
acaaugauacagu

SEQ ID NO: 846224 - RNA, 15 nt, Homo sapiens
acaaugauacaguug

SEQ ID NO: 846225 - RNA, 13 nt, Homo sapiens
acacaugugcugg

SEQ ID NO: 846226 - RNA, 21 nt, Homo sapiens
acacucauccccucacuugcc

SEQ ID NO: 846227 - RNA, 22 nt, Homo sapiens
acaucaagcgaugaaacuggaa

SEQ ID NO: 846228 - RNA, 13 nt, Homo sapiens
acaugcacucagc

SEQ ID NO: 846229 - RNA, 13 nt, Homo sapiens
acauguaugugca

SEQ ID NO: 846230 - RNA, 19 nt, Homo sapiens
acauguaugugcauuucaa

SEQ ID NO: 846231 - RNA, 19 nt, Homo sapiens
acauuuuacccacacacag

SEQ ID NO: 846232 - RNA, 12 nt, Homo sapiens
accaucuuggcc

SEQ ID NO: 846233 - RNA, 16 nt, Homo sapiens
acccacuaacuggcua

SEQ ID NO: 846234 - RNA, 18 nt, Homo sapiens
acccucacaggagcaucu

SEQ ID NO: 846235 - RNA, 15 nt, Homo sapiens
acccugagguugugu

SEQ ID NO: 846236 - RNA, 18 nt, Homo sapiens
acccugagguugugugug

SEQ ID NO: 846237 - RNA, 16 nt, Homo sapiens
accucucuggguugaa

SEQ ID NO: 846238 - RNA, 12 nt, Homo sapiens
acuaaaugcuca

SEQ ID NO: 846239 - RNA, 17 nt, Homo sapiens
acucaauucugcaguau

SEQ ID NO: 846240 - RNA, 15 nt, Homo sapiens
acuccaucucaaauu

SEQ ID NO: 846241 - RNA, 11 nt, Homo sapiens
acucucugaac

SEQ ID NO: 846242 - RNA, 18 nt, Homo sapiens
agaaagccaugugcagcc

SEQ ID NO: 846243 - RNA, 21 nt, Homo sapiens
agaaagugcauuaaacugaau

SEQ ID NO: 846244 - RNA, 20 nt, Homo sapiens
agaauaaccaacacccugag

SEQ ID NO: 846245 - RNA, 18 nt, Homo sapiens
agacaaggucuugcuaug

SEQ ID NO: 846246 - RNA, 18 nt, Homo sapiens
agacagacaacacuggga

SEQ ID NO: 846247 - RNA, 13 nt, Homo sapiens
agacucugggaac

SEQ ID NO: 846248 - RNA, 15 nt, Homo sapiens
agacuucucaauaau

SEQ ID NO: 846249 - RNA, 13 nt, Homo sapiens
agagguuucagug

SEQ ID NO: 846250 - RNA, 14 nt, Homo sapiens
agaguccucugaau

SEQ ID NO: 846251 - RNA, 15 nt, Homo sapiens
agagugugguuauga

SEQ ID NO: 846252 - RNA, 16 nt, Homo sapiens
agauagcuucacccca

SEQ ID NO: 846253 - RNA, 23 nt, Homo sapiens
agauaguggggagacuucuuggc

SEQ ID NO: 846254 - RNA, 19 nt, Homo sapiens
agcaaaaacauguaugugc

SEQ ID NO: 846255 - RNA, 22 nt, Homo sapiens
agccacacucugggcuccagag

SEQ ID NO: 846256 - RNA, 14 nt, Homo sapiens
agccaugugcagcc

SEQ ID NO: 846257 - RNA, 13 nt, Homo sapiens
agcccugccucaa

SEQ ID NO: 846258 - RNA, 17 nt, Homo sapiens
agccuacuaaaugcuca

SEQ ID NO: 846259 - RNA, 18 nt, Homo sapiens
agccugagucaccugcag

SEQ ID NO: 846260 - RNA, 14 nt, Homo sapiens
agcgggaauggcag

SEQ ID NO: 846261 - RNA, 22 nt, Homo sapiens
agcucuccccucagagugcaag

SEQ ID NO: 846262 - RNA, 17 nt, Homo sapiens
agcucuuccgaaaacca

SEQ ID NO: 846263 - RNA, 17 nt, Homo sapiens
agcugagaaaacuaagu

SEQ ID NO: 846264 - RNA, 16 nt, Homo sapiens
agcugguggcucugug

SEQ ID NO: 846265 - RNA, 18 nt, Homo sapiens
agcuguguccucaugagg

SEQ ID NO: 846266 - RNA, 21 nt, Homo sapiens
agcuucacccugaggugagca

SEQ ID NO: 846267 - RNA, 17 nt, Homo sapiens
aggaaacaacagcuuua

SEQ ID NO: 846268 - RNA, 20 nt, Homo sapiens
aggaacuggugucuucaggg

SEQ ID NO: 846269 - RNA, 18 nt, Homo sapiens
aggagaaugaaauguaug

SEQ ID NO: 846270 - RNA, 23 nt, Homo sapiens
aggauguugccacuggcaaaugu

SEQ ID NO: 846271 - RNA, 19 nt, Homo sapiens
aggcuuugaguuaacucac

SEQ ID NO: 846272 - RNA, 14 nt, Homo sapiens
agggugagugcaag

SEQ ID NO: 846273 - RNA, 17 nt, Homo sapiens
aguauaaauaacuaaug

SEQ ID NO: 846274 - RNA, 15 nt, Homo sapiens
aguaucuugguugug

SEQ ID NO: 846275 - RNA, 20 nt, Homo sapiens
agucaagggugugugcagca

SEQ ID NO: 846276 - RNA, 13 nt, Homo sapiens
agucccuccccaa

SEQ ID NO: 846277 - RNA, 12 nt, Homo sapiens
aguccucugaau

SEQ ID NO: 846278 - RNA, 23 nt, Homo sapiens
auaaagaagguuggugaauuuca

SEQ ID NO: 846279 - RNA, 15 nt, Homo sapiens
auaagauuuaauuca

SEQ ID NO: 846280 - RNA, 15 nt, Homo sapiens
auagcccugccucaa

SEQ ID NO: 846281 - RNA, 15 nt, Homo sapiens
auaguggcaagauca

SEQ ID NO: 846282 - RNA, 16 nt, Homo sapiens
aucaaagccacacucu

SEQ ID NO: 846283 - RNA, 20 nt, Homo sapiens
aucaaugaaguagcugagaa

SEQ ID NO: 846284 - RNA, 18 nt, Homo sapiens
aucgagaccaucuuggcc

SEQ ID NO: 846285 - RNA, 13 nt, Homo sapiens
augaaguagcuga

SEQ ID NO: 846286 - RNA, 12 nt, Homo sapiens
augaaugaucuu

SEQ ID NO: 846287 - RNA, 17 nt, Homo sapiens
augagggcuggaugcuc

SEQ ID NO: 846288 - RNA, 15 nt, Homo sapiens
augauacaguugcau

SEQ ID NO: 846289 - RNA, 12 nt, Homo sapiens
augaucuuggcu

SEQ ID NO: 846290 - RNA, 22 nt, Homo sapiens
augaucuuggcuuuccuauaag

SEQ ID NO: 846291 - RNA, 14 nt, Homo sapiens
augcucagaccagc

SEQ ID NO: 846292 - RNA, 22 nt, Homo sapiens
augggaggagaggacaagggaa

SEQ ID NO: 846293 - RNA, 17 nt, Homo sapiens
augggggcagcaccucc

SEQ ID NO: 846294 - RNA, 23 nt, Homo sapiens
auggugaaacccugucucuccua

SEQ ID NO: 846295 - RNA, 16 nt, Homo sapiens
augugagcucaccagu

SEQ ID NO: 846296 - RNA, 13 nt, Homo sapiens
auguucugcuuuc

SEQ ID NO: 846297 - RNA, 20 nt, Homo sapiens
auguuuuuaaacagugucau

SEQ ID NO: 846298 - RNA, 21 nt, Homo sapiens
auuacacaucaagcgaugaaa

SEQ ID NO: 846299 - RNA, 20 nt, Homo sapiens
auucacuguauguccuuggu

SEQ ID NO: 846300 - RNA, 13 nt, Homo sapiens
auuucacaagcua

SEQ ID NO: 846301 - RNA, 12 nt, Homo sapiens
caaaaacugaaa

SEQ ID NO: 846302 - RNA, 14 nt, Homo sapiens
caaaagcugcucag

SEQ ID NO: 846303 - RNA, 20 nt, Homo sapiens
caaaagcugcucagggaaaa

SEQ ID NO: 846304 - RNA, 16 nt, Homo sapiens
caagaucauagcucau

SEQ ID NO: 846305 - RNA, 18 nt, Homo sapiens
caagccacgaaugaauga

SEQ ID NO: 846306 - RNA, 18 nt, Homo sapiens
caagcuaugugagcucac

SEQ ID NO: 846307 - RNA, 21 nt, Homo sapiens
caaguaaaaggaaaugcuccu

SEQ ID NO: 846308 - RNA, 21 nt, Homo sapiens
caauguaguuuuauuacacau

SEQ ID NO: 846309 - RNA, 13 nt, Homo sapiens
acucaggacaucc

SEQ ID NO: 846310 - RNA, 15 nt, Homo sapiens
acuucuggagucuau

SEQ ID NO: 846311 - RNA, 11 nt, Homo sapiens
acuucuuggcu

SEQ ID NO: 846312 - RNA, 12 nt, Homo sapiens
agaacagucucu

SEQ ID NO: 846313 - RNA, 19 nt, Homo sapiens
agaacccccuuuaccccca

SEQ ID NO: 846314 - RNA, 19 nt, Homo sapiens
agaaggaaagaauaaccaa

SEQ ID NO: 846315 - RNA, 21 nt, Homo sapiens
agaagguuggugaauuucaca

SEQ ID NO: 846316 - RNA, 21 nt, Homo sapiens
agaauauuuuaagaauuucac

SEQ ID NO: 846317 - RNA, 18 nt, Homo sapiens
agaaugaaauguaugugc

SEQ ID NO: 846318 - RNA, 12 nt, Homo sapiens
agaauuucacaa

SEQ ID NO: 846319 - RNA, 18 nt, Homo sapiens
agaauuucacaagcuauu

SEQ ID NO: 846320 - RNA, 20 nt, Homo sapiens
agacccaacauuacuaacaa

SEQ ID NO: 846321 - RNA, 13 nt, Homo sapiens
agacuucuuggcu

SEQ ID NO: 846322 - RNA, 22 nt, Homo sapiens
agagugcaagccccugcuccag

SEQ ID NO: 846323 - RNA, 19 nt, Homo sapiens
agaguggggaugacaugca

SEQ ID NO: 846324 - RNA, 16 nt, Homo sapiens
agcaaaaacauguaug

SEQ ID NO: 846325 - RNA, 16 nt, Homo sapiens
agccacgaaugaauga

SEQ ID NO: 846326 - RNA, 16 nt, Homo sapiens
agccccugcuccagaa

SEQ ID NO: 846327 - RNA, 11 nt, Homo sapiens
agcggacauca

SEQ ID NO: 846328 - RNA, 23 nt, Homo sapiens
agcuaccucaaccaaugccaaaa

SEQ ID NO: 846329 - RNA, 15 nt, Homo sapiens
agcucuccccucaga

SEQ ID NO: 846330 - RNA, 23 nt, Homo sapiens
agcucuccccucagagugcaagc

SEQ ID NO: 846331 - RNA, 19 nt, Homo sapiens
agcugagaaaacuaaguca

SEQ ID NO: 846332 - RNA, 20 nt, Homo sapiens
agcugagaaaacuaagucag

SEQ ID NO: 846333 - RNA, 19 nt, Homo sapiens
agcuguugagguaccucca

SEQ ID NO: 846334 - RNA, 21 nt, Homo sapiens
aggaaaugaaugaucuuggcu

SEQ ID NO: 846335 - RNA, 22 nt, Homo sapiens
aggaccggccuuugcaccucca

SEQ ID NO: 846336 - RNA, 22 nt, Homo sapiens
aggagaaugaaauguaugugcu

SEQ ID NO: 846337 - RNA, 23 nt, Homo sapiens
aggagaucgagaccaucuuggcc

SEQ ID NO: 846338 - RNA, 12 nt, Homo sapiens
aggagcaucucc

SEQ ID NO: 846339 - RNA, 15 nt, Homo sapiens
agggacugaaaaccu

SEQ ID NO: 846340 - RNA, 16 nt, Homo sapiens
agggagcagaugcaau

SEQ ID NO: 846341 - RNA, 14 nt, Homo sapiens
aggggccacaccaa

SEQ ID NO: 846342 - RNA, 13 nt, Homo sapiens
agggugagugcaa

SEQ ID NO: 846343 - RNA, 15 nt, Homo sapiens
aggugagcaucaucu

SEQ ID NO: 846344 - RNA, 20 nt, Homo sapiens
agguguguugcagugucugc

SEQ ID NO: 846345 - RNA, 19 nt, Homo sapiens
agguuggugaauuucacaa

SEQ ID NO: 846346 - RNA, 17 nt, Homo sapiens
agucuuuagggguuggg

SEQ ID NO: 846347 - RNA, 19 nt, Homo sapiens
agucuuugguaaauggcaa

SEQ ID NO: 846348 - RNA, 19 nt, Homo sapiens
agugcaagccccugcucca

SEQ ID NO: 846349 - RNA, 21 nt, Homo sapiens
agugcaagccccugcuccaga

SEQ ID NO: 846350 - RNA, 19 nt, Homo sapiens
aguuguuuuauauguugcu

SEQ ID NO: 846351 - RNA, 18 nt, Homo sapiens
aguuuuauuacacauuua

SEQ ID NO: 846352 - RNA, 20 nt, Homo sapiens
auaaaauguuuuuaaacagu

SEQ ID NO: 846353 - RNA, 12 nt, Homo sapiens
auaaagcuucug

SEQ ID NO: 846354 - RNA, 19 nt, Homo sapiens
auaaauaacuaaugucucu

SEQ ID NO: 846355 - RNA, 18 nt, Homo sapiens
auaagauuuaauucacau

SEQ ID NO: 846356 - RNA, 13 nt, Homo sapiens
auacaauugucau

SEQ ID NO: 846357 - RNA, 15 nt, Homo sapiens
auauugucagucuuu

SEQ ID NO: 846358 - RNA, 13 nt, Homo sapiens
aucaagcgaugaa

SEQ ID NO: 846359 - RNA, 16 nt, Homo sapiens
aucccagcuaccucaa

SEQ ID NO: 846360 - RNA, 16 nt, Homo sapiens
auccccaggcaccuca

SEQ ID NO: 846361 - RNA, 18 nt, Homo sapiens
augaaguagcugagaaaa

SEQ ID NO: 846362 - RNA, 23 nt, Homo sapiens
augauguagagugugguuaugaa

SEQ ID NO: 846363 - RNA, 13 nt, Homo sapiens
auggcagcugcca

SEQ ID NO: 846364 - RNA, 16 nt, Homo sapiens
augugcagccaccagu

SEQ ID NO: 846365 - RNA, 21 nt, Homo sapiens
auuaaacugaaucacaaugua

SEQ ID NO: 846366 - RNA, 22 nt, Homo sapiens
auuaauuuuuaaggauguugcc

SEQ ID NO: 846367 - RNA, 13 nt, Homo sapiens
auuacacauuuau

SEQ ID NO: 846368 - RNA, 22 nt, Homo sapiens
auucccguugaacgucacaucu

SEQ ID NO: 846369 - RNA, 12 nt, Homo sapiens
auuuacauucuu

SEQ ID NO: 846370 - RNA, 16 nt, Homo sapiens
auuucacaagcuauuu

SEQ ID NO: 846371 - RNA, 21 nt, Homo sapiens
auuuuaagaauuucacaagcu

SEQ ID NO: 846372 - RNA, 18 nt, Homo sapiens
auuuuacccacacacaga

SEQ ID NO: 846373 - RNA, 23 nt, Homo sapiens
caaaaacauguaugugcauuuca

SEQ ID NO: 846374 - RNA, 14 nt, Homo sapiens
caaagccacacucu

SEQ ID NO: 846375 - RNA, 20 nt, Homo sapiens
caaaucugagggagcugagu

SEQ ID NO: 846376 - RNA, 18 nt, Homo sapiens
caaaugcuuuccaugagu

SEQ ID NO: 846377 - RNA, 15 nt, Homo sapiens
caagaucauagcuca

SEQ ID NO: 846378 - RNA, 12 nt, Homo sapiens
caagcucaagug

SEQ ID NO: 846379 - RNA, 22 nt, Homo sapiens
caagcugguggcucugugugcu

SEQ ID NO: 846380 - RNA, 17 nt, Homo sapiens
caagggugugugcagca

SEQ ID NO: 846381 - RNA, 21 nt, Homo sapiens
caaguggaacgagacaagcag

SEQ ID NO: 846382 - RNA, 19 nt, Homo sapiens
caauaaauaaugaucacag

SEQ ID NO: 846383 - RNA, 20 nt, Homo sapiens
caaucccacguacuuauaaa

SEQ ID NO: 846384 - RNA, 22 nt, Homo sapiens
caauguaaauauuacacaucaa

SEQ ID NO: 846385 - RNA, 15 nt, Homo sapiens
cacagggacugaaaa

SEQ ID NO: 846386 - RNA, 15 nt, Homo sapiens
cacaucaagcgauga

SEQ ID NO: 846387 - RNA, 15 nt, Homo sapiens
cacccagccuggauc

SEQ ID NO: 846388 - RNA, 20 nt, Homo sapiens
cacccugaggugagcaucau

SEQ ID NO: 846389 - RNA, 16 nt, Homo sapiens
caccugcuggagugaa

SEQ ID NO: 846390 - RNA, 23 nt, Homo sapiens
cacgguggcucacgccuguaauu

SEQ ID NO: 846391 - RNA, 13 nt, Homo sapiens
cacucagcucuug

SEQ ID NO: 846392 - RNA, 16 nt, Homo sapiens
cagaaacuccuguuca

SEQ ID NO: 846393 - RNA, 19 nt, Homo sapiens
cagaaacuccuguucaugc

SEQ ID NO: 846394 - RNA, 15 nt, Homo sapiens
cagacaacacuggga

SEQ ID NO: 846395 - RNA, 20 nt, Homo sapiens
cagacagacaacacugggaa

SEQ ID NO: 846396 - RNA, 18 nt, Homo sapiens
cagaccccacacuccaug

SEQ ID NO: 846397 - RNA, 18 nt, Homo sapiens
cagagacccaagcugccu

SEQ ID NO: 846398 - RNA, 11 nt, Homo sapiens
cagagugcaag

SEQ ID NO: 846399 - RNA, 12 nt, Homo sapiens
cagagugcaagc

SEQ ID NO: 846400 - RNA, 14 nt, Homo sapiens
cagccucccaagua

SEQ ID NO: 846401 - RNA, 23 nt, Homo sapiens
cagcuaccucaaccaaugccaaa

SEQ ID NO: 846402 - RNA, 16 nt, Homo sapiens
cagcuggccuugugag

SEQ ID NO: 846403 - RNA, 18 nt, Homo sapiens
caggagacucugggaacu

SEQ ID NO: 846404 - RNA, 17 nt, Homo sapiens
caggagaucgagaccau

SEQ ID NO: 846405 - RNA, 18 nt, Homo sapiens
caggcacuaucuggguuu

SEQ ID NO: 846406 - RNA, 16 nt, Homo sapiens
caggcagauguuccua

SEQ ID NO: 846407 - RNA, 13 nt, Homo sapiens
cagggcugauaag

SEQ ID NO: 846408 - RNA, 19 nt, Homo sapiens
caguagaaugggggcagca

SEQ ID NO: 846409 - RNA, 16 nt, Homo sapiens
cauaccccuggccaag

SEQ ID NO: 846410 - RNA, 16 nt, Homo sapiens
cauauacaauugucau

SEQ ID NO: 846411 - RNA, 13 nt, Homo sapiens
gggugagugcaag

SEQ ID NO: 846412 - RNA, 23 nt, Homo sapiens
gggugugugcagcauuguuggcu

SEQ ID NO: 846413 - RNA, 22 nt, Homo sapiens
gguaaaaguucuuuuugcucua

SEQ ID NO: 846414 - RNA, 14 nt, Homo sapiens
ggugagcaucaucu

SEQ ID NO: 846415 - RNA, 20 nt, Homo sapiens
gguggcucugugugcucuga

SEQ ID NO: 846416 - RNA, 19 nt, Homo sapiens
guaacugugccaguucuuu

SEQ ID NO: 846417 - RNA, 22 nt, Homo sapiens
guaacugugccaguucuuucca

SEQ ID NO: 846418 - RNA, 16 nt, Homo sapiens
guaauuuuauuuacau

SEQ ID NO: 846419 - RNA, 22 nt, Homo sapiens
guacuuauaaagaagguuggug

SEQ ID NO: 846420 - RNA, 21 nt, Homo sapiens
guagcugagaaaacuaaguca

SEQ ID NO: 846421 - RNA, 22 nt, Homo sapiens
gucaggggcggggagggugaca

SEQ ID NO: 846422 - RNA, 20 nt, Homo sapiens
guccaaaacugccucaggag

SEQ ID NO: 846423 - RNA, 15 nt, Homo sapiens
guccuccaagccagc

SEQ ID NO: 846424 - RNA, 18 nt, Homo sapiens
gucucuugaggcacagaa

SEQ ID NO: 846425 - RNA, 16 nt, Homo sapiens
gugaauuucacaagcu

SEQ ID NO: 846426 - RNA, 15 nt, Homo sapiens
uuggugaauuucaca

SEQ ID NO: 846427 - RNA, 19 nt, Homo sapiens
uugguugugacagagucaa

SEQ ID NO: 846428 - RNA, 21 nt, Homo sapiens
uuuaaacagugucauauacaa

SEQ ID NO: 846429 - RNA, 15 nt, Homo sapiens
uuuaagaauuucaca

SEQ ID NO: 846430 - RNA, 23 nt, Homo sapiens
uuuaaggauguugccacuggcaa

SEQ ID NO: 846431 - RNA, 18 nt, Homo sapiens
uuuaauguuaaauucaau

SEQ ID NO: 846432 - RNA, 22 nt, Homo sapiens
uuuaauguuaaauucaauguag

SEQ ID NO: 846433 - RNA, 15 nt, Homo sapiens
uuuaauucacaucaa

SEQ ID NO: 846434 - RNA, 19 nt, Homo sapiens
uuuauauguugcuauaaua

SEQ ID NO: 846435 - RNA, 15 nt, Homo sapiens
uuuuaaggauguugc

SEQ ID NO: 846436 - RNA, 16 nt, Homo sapiens
uuuuugucaagacaag

SEQ ID NO: 846437 - RNA, 12 nt, Homo sapiens
caaugcugaggu

SEQ ID NO: 846438 - RNA, 22 nt, Homo sapiens
cacaucaagcgaugaaacugga

SEQ ID NO: 846439 - RNA, 22 nt, Homo sapiens
caccuccuaagaaggcaccucu

SEQ ID NO: 846440 - RNA, 20 nt, Homo sapiens
cacucagcucuuggcuccac

SEQ ID NO: 846441 - RNA, 19 nt, Homo sapiens
cacuccauggagucuggaa

SEQ ID NO: 846442 - RNA, 15 nt, Homo sapiens
cacugggaaacagag

SEQ ID NO: 846443 - RNA, 12 nt, Homo sapiens
cagacaacacug

SEQ ID NO: 846444 - RNA, 17 nt, Homo sapiens
cagagggagacuccauc

SEQ ID NO: 846445 - RNA, 12 nt, Homo sapiens
cagaugcaauga

SEQ ID NO: 846446 - RNA, 19 nt, Homo sapiens
cagcauuguuggcuguucc

SEQ ID NO: 846447 - RNA, 21 nt, Homo sapiens
cagcauuguuggcuguuccug

SEQ ID NO: 846448 - RNA, 23 nt, Homo sapiens
cagcucuccccucagagugcaag

SEQ ID NO: 846449 - RNA, 17 nt, Homo sapiens
cagcuucacccugaggu

SEQ ID NO: 846450 - RNA, 16 nt, Homo sapiens
caggagaaucgcuuga

SEQ ID NO: 846451 - RNA, 12 nt, Homo sapiens
caggcaccucac

SEQ ID NO: 846452 - RNA, 13 nt, Homo sapiens
caggcacugccaa

SEQ ID NO: 846453 - RNA, 15 nt, Homo sapiens
caggccaggccagcu

SEQ ID NO: 846454 - RNA, 19 nt, Homo sapiens
cagguguguugcagugucu

SEQ ID NO: 846455 - RNA, 13 nt, Homo sapiens
caguggacaccau

SEQ ID NO: 846456 - RNA, 19 nt, Homo sapiens
cauaccccuggccaaggaa

SEQ ID NO: 846457 - RNA, 20 nt, Homo sapiens
cauagcccugccucaagcua

SEQ ID NO: 846458 - RNA, 17 nt, Homo sapiens
caucaagcgaugaaacu

SEQ ID NO: 846459 - RNA, 19 nt, Homo sapiens
caucguuuucuucacuguc

SEQ ID NO: 846460 - RNA, 10 nt, Homo sapiens
caucucaggu

SEQ ID NO: 846461 - RNA, 19 nt, Homo sapiens
caucuccucaacucugagu

SEQ ID NO: 846462 - RNA, 15 nt, Homo sapiens
caugauguagagugu

SEQ ID NO: 846463 - RNA, 12 nt, Homo sapiens
ccaaguagcuag

SEQ ID NO: 846464 - RNA, 18 nt, Homo sapiens
ccaaucccagcuaccuca

SEQ ID NO: 846465 - RNA, 18 nt, Homo sapiens
ccacagacucaaaugcuc

SEQ ID NO: 846466 - RNA, 21 nt, Homo sapiens
ccacagacucaaaugcucaga

SEQ ID NO: 846467 - RNA, 19 nt, Homo sapiens
ccaccugcuggagugaagg

SEQ ID NO: 846468 - RNA, 20 nt, Homo sapiens
ccacuggcaaauguaacugu

SEQ ID NO: 846469 - RNA, 16 nt, Homo sapiens
ccagcacuuugggagg

SEQ ID NO: 846470 - RNA, 15 nt, Homo sapiens
cccacuaacuggcua

SEQ ID NO: 846471 - RNA, 16 nt, Homo sapiens
cccaggagacucuggg

SEQ ID NO: 846472 - RNA, 20 nt, Homo sapiens
gcuggagcauaguggcaaga

SEQ ID NO: 846473 - RNA, 17 nt, Homo sapiens
gcuuugaguuaacucac

SEQ ID NO: 846474 - RNA, 20 nt, Homo sapiens
ggaaguaucuugguugugac

SEQ ID NO: 846475 - RNA, 22 nt, Homo sapiens
ggacaucagcuggucaaacaaa

SEQ ID NO: 846476 - RNA, 11 nt, Homo sapiens
ggcaccucucu

SEQ ID NO: 846477 - RNA, 16 nt, Homo sapiens
ggcagugccuguaauc

SEQ ID NO: 846478 - RNA, 22 nt, Homo sapiens
ggcuauuguccccuaaaccaaa

SEQ ID NO: 846479 - RNA, 17 nt, Homo sapiens
ggcucacgccuguaauu

SEQ ID NO: 846480 - RNA, 16 nt, Homo sapiens
ggcucucaacagggga

SEQ ID NO: 846481 - RNA, 19 nt, Homo sapiens
gggccacaccaaccuucug

SEQ ID NO: 846482 - RNA, 23 nt, Homo sapiens
ggggaaguuaggaacuggugucu

SEQ ID NO: 846483 - RNA, 19 nt, Homo sapiens
ggggaugacaugcacucag

SEQ ID NO: 846484 - RNA, 15 nt, Homo sapiens
ggggcagcaccuccu

SEQ ID NO: 846485 - RNA, 19 nt, Homo sapiens
ggucaaacaaacucucuga

SEQ ID NO: 846486 - RNA, 20 nt, Homo sapiens
guaguuuuauuacacauuua

SEQ ID NO: 846487 - RNA, 22 nt, Homo sapiens
gucauguaugugaaacaaugug

SEQ ID NO: 846488 - RNA, 13 nt, Homo sapiens
guccaaaacugcc

SEQ ID NO: 846489 - RNA, 17 nt, Homo sapiens
guccccuaaaccaaaaa

SEQ ID NO: 846490 - RNA, 17 nt, Homo sapiens
gucuggaaugcauggga

SEQ ID NO: 846491 - RNA, 16 nt, Homo sapiens
gugaaacccugucucu

SEQ ID NO: 846492 - RNA, 13 nt, Homo sapiens
guuaugaacaaag

SEQ ID NO: 846493 - RNA, 18 nt, Homo sapiens
guucuuugucacagggac

SEQ ID NO: 846494 - RNA, 14 nt, Homo sapiens
guuuuauuacacau

SEQ ID NO: 846495 - RNA, 23 nt, Homo sapiens
uaaaagcacacucauccccucac

SEQ ID NO: 846496 - RNA, 12 nt, Homo sapiens
uaaaaguucuuu

SEQ ID NO: 846497 - RNA, 20 nt, Homo sapiens
uaaaaguucuuuuugcucua

SEQ ID NO: 846498 - RNA, 15 nt, Homo sapiens
uaaacagugucauau

SEQ ID NO: 846499 - RNA, 23 nt, Homo sapiens
uaaauauuacacaucaagcgaug

SEQ ID NO: 846500 - RNA, 18 nt, Homo sapiens
uaacugugccaguucuuu

SEQ ID NO: 846501 - RNA, 17 nt, Homo sapiens
uaagaauuucacaagcu

SEQ ID NO: 846502 - RNA, 13 nt, Homo sapiens
uaauaaagcuucu

SEQ ID NO: 846503 - RNA, 17 nt, Homo sapiens
uaaugucucuacaauuu

SEQ ID NO: 846504 - RNA, 20 nt, Homo sapiens
uacaagccacgaaugaauga

SEQ ID NO: 846505 - RNA, 18 nt, Homo sapiens
uacaguugcauguuauau

SEQ ID NO: 846506 - RNA, 19 nt, Homo sapiens
gccaaaagcugcucaggga

SEQ ID NO: 846507 - RNA, 18 nt, Homo sapiens
gccacgaaugaaugaauu

SEQ ID NO: 846508 - RNA, 21 nt, Homo sapiens
gccaugugcagccaccagucc

SEQ ID NO: 846509 - RNA, 13 nt, Homo sapiens
gcccccccagugg

SEQ ID NO: 846510 - RNA, 22 nt, Homo sapiens
gcccuuccccucugcagcuucc

SEQ ID NO: 846511 - RNA, 19 nt, Homo sapiens
gccucaagcuaugugagcu

SEQ ID NO: 846512 - RNA, 22 nt, Homo sapiens
gccuggacuagagggaccucuc

SEQ ID NO: 846513 - RNA, 18 nt, Homo sapiens
gcuaauucucagcagaaa

SEQ ID NO: 846514 - RNA, 15 nt, Homo sapiens
gcuaccucaaccaau

SEQ ID NO: 846515 - RNA, 15 nt, Homo sapiens
gcuauaauaaagaag

SEQ ID NO: 846516 - RNA, 20 nt, Homo sapiens
gcucacgccuguaauuccag

SEQ ID NO: 846517 - RNA, 18 nt, Homo sapiens
gcuccagaagauagcuuc

SEQ ID NO: 846518 - RNA, 19 nt, Homo sapiens
gcuccuccagggagucuca

SEQ ID NO: 846519 - RNA, 21 nt, Homo sapiens
gcucuccccucagagugcaag

SEQ ID NO: 846520 - RNA, 13 nt, Homo sapiens
gcugcucagggaa

SEQ ID NO: 846521 - RNA, 16 nt, Homo sapiens
gcuucaccccaauccc

SEQ ID NO: 846522 - RNA, 14 nt, Homo sapiens
ggaaacaacagcuu

SEQ ID NO: 846523 - RNA, 16 nt, Homo sapiens
ggagggugagugcaag

SEQ ID NO: 846524 - RNA, 20 nt, Homo sapiens
ggagucagagguuucaguga

SEQ ID NO: 846525 - RNA, 23 nt, Homo sapiens
ggaugccgagguaaaaguucuuu

SEQ ID NO: 846526 - RNA, 16 nt, Homo sapiens
ggaugugguggcagug

SEQ ID NO: 846527 - RNA, 19 nt, Homo sapiens
ggcaggcacugccaaaaca

SEQ ID NO: 846528 - RNA, 16 nt, Homo sapiens
ggcaggcagauguucc

SEQ ID NO: 846529 - RNA, 22 nt, Homo sapiens
ggccaacauggugaaacccugu

SEQ ID NO: 846530 - RNA, 18 nt, Homo sapiens
ggccucccacagacucaa

SEQ ID NO: 846531 - RNA, 21 nt, Homo sapiens
ggccuuaucuccaagaccaga

SEQ ID NO: 846532 - RNA, 20 nt, Homo sapiens
ggcgacagagggagacucca

SEQ ID NO: 846533 - RNA, 13 nt, Homo sapiens
ggcuccacuggga

SEQ ID NO: 846534 - RNA, 18 nt, Homo sapiens
gggacugaaaaccucucc

SEQ ID NO: 846535 - RNA, 16 nt, Homo sapiens
gggcagcaccuccuaa

SEQ ID NO: 846536 - RNA, 19 nt, Homo sapiens
ggggccacaccaaccuucu

SEQ ID NO: 846537 - RNA, 15 nt, Homo sapiens
ggugaauuucacaag

SEQ ID NO: 846538 - RNA, 19 nt, Homo sapiens
ggugguuuucccaucucag

SEQ ID NO: 846539 - RNA, 17 nt, Homo sapiens
gguugaagggcaguguu

SEQ ID NO: 846540 - RNA, 16 nt, Homo sapiens
guaggaaaugaaugau

SEQ ID NO: 846541 - RNA, 20 nt, Homo sapiens
guaucugacaaugcugaggu

SEQ ID NO: 846542 - RNA, 11 nt, Homo sapiens
gucacagggac

SEQ ID NO: 846543 - RNA, 22 nt, Homo sapiens
gucuuuagggguugggcuggau

SEQ ID NO: 846544 - RNA, 14 nt, Homo sapiens
gugagcaucaucuu

SEQ ID NO: 846545 - RNA, 21 nt, Homo sapiens
gugccaguucuuuccauaaua

SEQ ID NO: 846546 - RNA, 15 nt, Homo sapiens
guggacaccauugga

SEQ ID NO: 846547 - RNA, 17 nt, Homo sapiens
gugguuuucccaucuca

SEQ ID NO: 846548 - RNA, 14 nt, Homo sapiens
gugucuucaggggc

SEQ ID NO: 846549 - RNA, 15 nt, Homo sapiens
guuaaauucaaugua

SEQ ID NO: 846550 - RNA, 16 nt, Homo sapiens
guugaagggcaguguu

SEQ ID NO: 846551 - RNA, 18 nt, Homo sapiens
guuguuuuauauguugcu

SEQ ID NO: 846552 - RNA, 16 nt, Homo sapiens
guuuuauauguugcua

SEQ ID NO: 846553 - RNA, 14 nt, Homo sapiens
uaaaagcacacuca

SEQ ID NO: 846554 - RNA, 22 nt, Homo sapiens
uaaaagcacacucauccccuca

SEQ ID NO: 846555 - RNA, 12 nt, Homo sapiens
uaaaccaaaaac

SEQ ID NO: 846556 - RNA, 19 nt, Homo sapiens
uaaagacccaacauuacua

SEQ ID NO: 846557 - RNA, 15 nt, Homo sapiens
uaacucacugagggu

SEQ ID NO: 846558 - RNA, 20 nt, Homo sapiens
uaagaauuucacaagcuauu

SEQ ID NO: 846559 - RNA, 16 nt, Homo sapiens
uaagauuuaauucaca

SEQ ID NO: 846560 - RNA, 21 nt, Homo sapiens
uaauuagcauggccacaucug

SEQ ID NO: 846561 - RNA, 15 nt, Homo sapiens
uacauucuugcuaau

SEQ ID NO: 846562 - RNA, 13 nt, Homo sapiens
uaccucaaccaau

SEQ ID NO: 846563 - RNA, 21 nt, Homo sapiens
uaccucaaccaaugccaaaaa

SEQ ID NO: 846564 - RNA, 22 nt, Homo sapiens
uaccucaaccaaugccaaaaaa

SEQ ID NO: 846565 - RNA, 19 nt, Homo sapiens
uacuucuggagucuauaaa

SEQ ID NO: 846566 - RNA, 19 nt, Homo sapiens
uagcccugccucaagcuau

SEQ ID NO: 846567 - RNA, 13 nt, Homo sapiens
uagcucauugcaa

SEQ ID NO: 846568 - RNA, 17 nt, Homo sapiens
uaggccuugccuaggca

SEQ ID NO: 846569 - RNA, 21 nt, Homo sapiens
uaguggggagacuucuuggcu

SEQ ID NO: 846570 - RNA, 23 nt, Homo sapiens
uauaaaauguuuuuaaacagugu

SEQ ID NO: 846571 - RNA, 20 nt, Homo sapiens
uauaaauaacuaaugucucu

SEQ ID NO: 846572 - RNA, 19 nt, Homo sapiens
uauaauaaagaaguguucu

SEQ ID NO: 846573 - RNA, 23 nt, Homo sapiens
uauaguuguuuuauauguugcua

SEQ ID NO: 846574 - RNA, 18 nt, Homo sapiens
uauauuauuacuaauugu

SEQ ID NO: 846575 - RNA, 13 nt, Homo sapiens
uaugaacuuuaua

SEQ ID NO: 846576 - RNA, 24 nt, Homo sapiens
uauuaauuuuuaaggauguugcca

SEQ ID NO: 846577 - RNA, 18 nt, Homo sapiens
uauuacacauuuauguaa

SEQ ID NO: 846578 - RNA, 15 nt, Homo sapiens
ucaaaaaucuguccg

SEQ ID NO: 846579 - RNA, 18 nt, Homo sapiens
ucaaccaaugccaaaaaa

SEQ ID NO: 846580 - RNA, 22 nt, Homo sapiens
ucaagugauccuccugacucag

SEQ ID NO: 846581 - RNA, 13 nt, Homo sapiens
ucagagugcaagc

SEQ ID NO: 846582 - RNA, 21 nt, Homo sapiens
ucagcaucccuagaaagccau

SEQ ID NO: 846583 - RNA, 16 nt, Homo sapiens
ucagcuucacccugag

SEQ ID NO: 846584 - RNA, 22 nt, Homo sapiens
ucaggggcggggagggugacag

SEQ ID NO: 846585 - RNA, 11 nt, Homo sapiens
ucauagcucau

SEQ ID NO: 846586 - RNA, 18 nt, Homo sapiens
ucauagcucauugcaagc

SEQ ID NO: 846587 - RNA, 18 nt, Homo sapiens
ucauauacaauugucaug

SEQ ID NO: 846588 - RNA, 22 nt, Homo sapiens
ucccacguacuuauaaagaagg

SEQ ID NO: 846589 - RNA, 16 nt, Homo sapiens
uccccaggcaccucac

SEQ ID NO: 846590 - RNA, 23 nt, Homo sapiens
uccccuaaaccaaaaacugaaag

SEQ ID NO: 846591 - RNA, 23 nt, Homo sapiens
uccccuugggggugguggaugaa

SEQ ID NO: 846592 - RNA, 20 nt, Homo sapiens
ucccguugaacgucacaucu

SEQ ID NO: 846593 - RNA, 13 nt, Homo sapiens
uccuaaaaauaca

SEQ ID NO: 846594 - RNA, 14 nt, Homo sapiens
uccuaaaaauacaa

SEQ ID NO: 846595 - RNA, 20 nt, Homo sapiens
uccucaugagggcuggaugc

SEQ ID NO: 846596 - RNA, 17 nt, Homo sapiens
uccuccagggagucuca

SEQ ID NO: 846597 - RNA, 15 nt, Homo sapiens
uccuguucaugccca

SEQ ID NO: 846598 - RNA, 16 nt, Homo sapiens
ucgagaccaucuuggc

SEQ ID NO: 846599 - RNA, 21 nt, Homo sapiens
ucgguuuauucacuguauguc

SEQ ID NO: 846600 - RNA, 15 nt, Homo sapiens
ucuaccccaggagac

SEQ ID NO: 846601 - RNA, 21 nt, Homo sapiens
ucucuacaauuuugaaauaaa

SEQ ID NO: 846602 - RNA, 18 nt, Homo sapiens
ucugaaccccucccucca

SEQ ID NO: 846603 - RNA, 23 nt, Homo sapiens
ucuggacaggcacuaucuggguu

SEQ ID NO: 846604 - RNA, 16 nt, Homo sapiens
ugaaaaccucuccuca

SEQ ID NO: 846605 - RNA, 15 nt, Homo sapiens
ugaaacccugucucu

SEQ ID NO: 846606 - RNA, 19 nt, Homo sapiens
ugaagaguccucugaauga

SEQ ID NO: 846607 - RNA, 14 nt, Homo sapiens
ugaaggaauaucuc

SEQ ID NO: 846608 - RNA, 15 nt, Homo sapiens
ugacaugcacucagc

SEQ ID NO: 846609 - RNA, 16 nt, Homo sapiens
ugagaaaacuaaguca

SEQ ID NO: 846610 - RNA, 19 nt, Homo sapiens
ugagagaacagggcugaag

SEQ ID NO: 846611 - RNA, 21 nt, Homo sapiens
ugaggaaaagcggacaucagc

SEQ ID NO: 846612 - RNA, 14 nt, Homo sapiens
ugaggagcuggaaa

SEQ ID NO: 846613 - RNA, 19 nt, Homo sapiens
ugauacaguugcauguuau

SEQ ID NO: 846614 - RNA, 22 nt, Homo sapiens
ugcaagccccugcuccagaaga

SEQ ID NO: 846615 - RNA, 20 nt, Homo sapiens
ugcaggccaggccagcugcc

SEQ ID NO: 846616 - RNA, 15 nt, Homo sapiens
ugccaaaaaaagaca

SEQ ID NO: 846617 - RNA, 16 nt, Homo sapiens
ugcucagggaaaagca

SEQ ID NO: 846618 - RNA, 20 nt, Homo sapiens
ugcuggagacauugaggcag

SEQ ID NO: 846619 - RNA, 13 nt, Homo sapiens
uggaaaacuacaa

SEQ ID NO: 846620 - RNA, 16 nt, Homo sapiens
uggaucuaccccagga

SEQ ID NO: 846621 - RNA, 16 nt, Homo sapiens
uggccaaggaagaucc

SEQ ID NO: 846622 - RNA, 15 nt, Homo sapiens
uggccucccacagac

SEQ ID NO: 846623 - RNA, 22 nt, Homo sapiens
uggccugaagaguccucugaau

SEQ ID NO: 846624 - RNA, 18 nt, Homo sapiens
uugaggaaacaacagcuu

SEQ ID NO: 846625 - RNA, 16 nt, Homo sapiens
uugcaguuuuuuccua

SEQ ID NO: 846626 - RNA, 18 nt, Homo sapiens
uugcuauaauaaagaagu

SEQ ID NO: 846627 - RNA, 15 nt, Homo sapiens
uuggcuguuccugca

SEQ ID NO: 846628 - RNA, 22 nt, Homo sapiens
uuggugaauuucacaagcuauu

SEQ ID NO: 846629 - RNA, 23 nt, Homo sapiens
uuggugaggaaaagcggacauca

SEQ ID NO: 846630 - RNA, 13 nt, Homo sapiens
uuuauauguugcu

SEQ ID NO: 846631 - RNA, 11 nt, Homo sapiens
uuucacaagcu

SEQ ID NO: 846632 - RNA, 12 nt, Homo sapiens
uuucccaucuca

SEQ ID NO: 846633 - RNA, 23 nt, Homo sapiens
uuugagaauuauaaaauuaacau

SEQ ID NO: 846634 - RNA, 17 nt, Homo sapiens
uuuuacccacacacaga

SEQ ID NO: 846635 - RNA, 16 nt, Homo sapiens
uuuuauuacacauuua

SEQ ID NO: 846636 - RNA, 16 nt, Homo sapiens
uuuuauuuacauucuu

SEQ ID NO: 846637 - RNA, 20 nt, Homo sapiens
gcccuaaaagcacacucauc

SEQ ID NO: 846638 - RNA, 21 nt, Homo sapiens
gccuccccucuccuuccugug

SEQ ID NO: 846639 - RNA, 18 nt, Homo sapiens
gccugaagaguccucuga

SEQ ID NO: 846640 - RNA, 23 nt, Homo sapiens
gccuggacuagagggaccucucc

SEQ ID NO: 846641 - RNA, 14 nt, Homo sapiens
gcggacaucagcug

SEQ ID NO: 846642 - RNA, 21 nt, Homo sapiens
gcuaugugagcucaccagucc

SEQ ID NO: 846643 - RNA, 17 nt, Homo sapiens
gcucugauccgagcuca

SEQ ID NO: 846644 - RNA, 23 nt, Homo sapiens
gcugaagcuguguccucaugagg

SEQ ID NO: 846645 - RNA, 14 nt, Homo sapiens
gcuuuaacuccugc

SEQ ID NO: 846646 - RNA, 16 nt, Homo sapiens
ggaaacgaagcaccau

SEQ ID NO: 846647 - RNA, 21 nt, Homo sapiens
ggaagccagaucuaugccaca

SEQ ID NO: 846648 - RNA, 19 nt, Homo sapiens
ggacuagagggaccucucc

SEQ ID NO: 846649 - RNA, 16 nt, Homo sapiens
ggagcagaugcaauga

SEQ ID NO: 846650 - RNA, 12 nt, Homo sapiens
ggagcaucuccu

SEQ ID NO: 846651 - RNA, 17 nt, Homo sapiens
ggauauugucagucuuu

SEQ ID NO: 846652 - RNA, 14 nt, Homo sapiens
ggcacagaaacucc

SEQ ID NO: 846653 - RNA, 20 nt, Homo sapiens
ggcaggagaaucgcuugaac

SEQ ID NO: 846654 - RNA, 15 nt, Homo sapiens
ggcgugcagcaucag

SEQ ID NO: 846655 - RNA, 14 nt, Homo sapiens
ggcuccacugggau

SEQ ID NO: 846656 - RNA, 22 nt, Homo sapiens
ggcucuggacaggcacuaucug

SEQ ID NO: 846657 - RNA, 15 nt, Homo sapiens
gggagcagaugcaau

SEQ ID NO: 846658 - RNA, 22 nt, Homo sapiens
ggguugaagggcaguguucccu

SEQ ID NO: 846659 - RNA, 12 nt, Homo sapiens
ggugagugcaag

SEQ ID NO: 846660 - RNA, 21 nt, Homo sapiens
guaaaaguucuuuuugcucua

SEQ ID NO: 846661 - RNA, 22 nt, Homo sapiens
guaggaaaugaaugaucuuggc

SEQ ID NO: 846662 - RNA, 12 nt, Homo sapiens
guaugugcucuu

SEQ ID NO: 846663 - RNA, 13 nt, Homo sapiens
gucaaaaaucugu

SEQ ID NO: 846664 - RNA, 18 nt, Homo sapiens
guccccuaaaccaaaaac

SEQ ID NO: 846665 - RNA, 12 nt, Homo sapiens
gucuugaacucc

SEQ ID NO: 846666 - RNA, 20 nt, Homo sapiens
gugcagcauuguuggcuguu

SEQ ID NO: 846667 - RNA, 17 nt, Homo sapiens
guggaacgagacaagca

SEQ ID NO: 846668 - RNA, 17 nt, Homo sapiens
guguuuuaaaauugaug

SEQ ID NO: 846669 - RNA, 20 nt, Homo sapiens
guuggugaauuucacaagcu

SEQ ID NO: 846670 - RNA, 14 nt, Homo sapiens
guuguguguggaag

SEQ ID NO: 846671 - RNA, 16 nt, Homo sapiens
uaaaauuuaacucaca

SEQ ID NO: 846672 - RNA, 15 nt, Homo sapiens
uaaaccaaaaacuga

SEQ ID NO: 846673 - RNA, 15 nt, Homo sapiens
uaaacugaaucacaa

SEQ ID NO: 846674 - RNA, 20 nt, Homo sapiens
uaaauaagauuuaauucaca

SEQ ID NO: 846675 - RNA, 21 nt, Homo sapiens
uaaauaagauuuaauucacau

SEQ ID NO: 846676 - RNA, 17 nt, Homo sapiens
uaaauauuacacaucaa

SEQ ID NO: 846677 - RNA, 22 nt, Homo sapiens
uaaauauuacacaucaagcgau

SEQ ID NO: 846678 - RNA, 20 nt, Homo sapiens
uaacaccaucgaucaugaug

SEQ ID NO: 846679 - RNA, 18 nt, Homo sapiens
uaacuaaugucucuacaa

SEQ ID NO: 846680 - RNA, 14 nt, Homo sapiens
uaagauuuaauuca

SEQ ID NO: 846681 - RNA, 14 nt, Homo sapiens
uaaggauguugcca

SEQ ID NO: 846682 - RNA, 22 nt, Homo sapiens
uaauaaagcuucuguuccgugc

SEQ ID NO: 846683 - RNA, 15 nt, Homo sapiens
uaaucccagcuauuu

SEQ ID NO: 846684 - RNA, 15 nt, Homo sapiens
uaauuccagcacuuu

SEQ ID NO: 846685 - RNA, 20 nt, Homo sapiens
uaauuuuuaaggauguugcc

SEQ ID NO: 846686 - RNA, 14 nt, Homo sapiens
uacauucuugcuaa

SEQ ID NO: 846687 - RNA, 16 nt, Homo sapiens
uacuucuggagucuau

SEQ ID NO: 846688 - RNA, 22 nt, Homo sapiens
uagcaaaaacauguaugugcau

SEQ ID NO: 846689 - RNA, 14 nt, Homo sapiens
uaggaaaugaauga

SEQ ID NO: 846690 - RNA, 14 nt, Homo sapiens
uauauguugcuaua

SEQ ID NO: 846691 - RNA, 21 nt, Homo sapiens
uaucucuucucagaaggaaag

SEQ ID NO: 846692 - RNA, 14 nt, Homo sapiens
uaugugcauuucaa

SEQ ID NO: 846693 - RNA, 23 nt, Homo sapiens
uauuaauuuuuaaggauguugcc

SEQ ID NO: 846694 - RNA, 22 nt, Homo sapiens
uauuguccccuaaaccaaaaac

SEQ ID NO: 846695 - RNA, 19 nt, Homo sapiens
uauuuuaagaauuucacaa

SEQ ID NO: 846696 - RNA, 22 nt, Homo sapiens
uauuuuaagaauuucacaagcu

SEQ ID NO: 846697 - RNA, 16 nt, Homo sapiens
ucaagcuaugugagcu

SEQ ID NO: 846698 - RNA, 14 nt, Homo sapiens
ucaauaaucaauga

SEQ ID NO: 846699 - RNA, 17 nt, Homo sapiens
ucacaggccccaggaaa

SEQ ID NO: 846700 - RNA, 13 nt, Homo sapiens
ucagcucuuggcu

SEQ ID NO: 846701 - RNA, 23 nt, Homo sapiens
ucagcucuuggcuccacugggau

SEQ ID NO: 846702 - RNA, 22 nt, Homo sapiens
ucaugagggcuggaugcucucg

SEQ ID NO: 846703 - RNA, 22 nt, Homo sapiens
uccagaagauagcuucacccca

SEQ ID NO: 846704 - RNA, 14 nt, Homo sapiens
uccccuaaaccaaa

SEQ ID NO: 846705 - RNA, 16 nt, Homo sapiens
uccccuaaaccaaaaa

SEQ ID NO: 846706 - RNA, 23 nt, Homo sapiens
ucccuagaaagccaugugcagcc

SEQ ID NO: 846707 - RNA, 17 nt, Homo sapiens
ucccuugaggaaacaac

SEQ ID NO: 846708 - RNA, 20 nt, Homo sapiens
ucccuugaggaaacaacagc

SEQ ID NO: 846709 - RNA, 19 nt, Homo sapiens
uccugcuagaacagucucu

SEQ ID NO: 846710 - RNA, 13 nt, Homo sapiens
uccuuggagacag

SEQ ID NO: 846711 - RNA, 18 nt, Homo sapiens
ucucaauaaucaaugaag

SEQ ID NO: 846712 - RNA, 16 nt, Homo sapiens
ucugauccgagcucag

SEQ ID NO: 846713 - RNA, 19 nt, Homo sapiens
ucuggaaugcaugggagcu

SEQ ID NO: 846714 - RNA, 15 nt, Homo sapiens
ucugugugcucugau

SEQ ID NO: 846715 - RNA, 16 nt, Homo sapiens
ucuugcuaauucucag

SEQ ID NO: 846716 - RNA, 18 nt, Homo sapiens
ucuugcuauguugcccag

SEQ ID NO: 846717 - RNA, 19 nt, Homo sapiens
ugaaacuggaaaacuacaa

SEQ ID NO: 846718 - RNA, 12 nt, Homo sapiens
ugaaauaaagca

SEQ ID NO: 846719 - RNA, 23 nt, Homo sapiens
ugaaauguaugugcucuuagcaa

SEQ ID NO: 846720 - RNA, 14 nt, Homo sapiens
ugaaugaucuuggc

SEQ ID NO: 846721 - RNA, 15 nt, Homo sapiens
ugacucaggacaucc

SEQ ID NO: 846722 - RNA, 19 nt, Homo sapiens
ugagaaaacuaagucagaa

SEQ ID NO: 846723 - RNA, 20 nt, Homo sapiens
ugaggguaucugacaaugcu

SEQ ID NO: 846724 - RNA, 21 nt, Homo sapiens
ugaguuaacucacugagggua

SEQ ID NO: 846725 - RNA, 14 nt, Homo sapiens
ugauccgagcucag

SEQ ID NO: 846726 - RNA, 20 nt, Homo sapiens
ugcaaugacucaggacaucc

SEQ ID NO: 846727 - RNA, 21 nt, Homo sapiens
ugcagugucugcuggagacau

SEQ ID NO: 846728 - RNA, 15 nt, Homo sapiens
ugcauuaaacugaau

SEQ ID NO: 846729 - RNA, 13 nt, Homo sapiens
ugcccauaccccu

SEQ ID NO: 846730 - RNA, 16 nt, Homo sapiens
ugccucaagcuaugug

SEQ ID NO: 846731 - RNA, 16 nt, Homo sapiens
uggagcauaguggcaa

SEQ ID NO: 846732 - RNA, 21 nt, Homo sapiens
uggcaaauguaacugugccag

SEQ ID NO: 846733 - RNA, 14 nt, Homo sapiens
uggcuccacuggga

SEQ ID NO: 846734 - RNA, 18 nt, Homo sapiens
ugggguggggauagggag

SEQ ID NO: 846735 - RNA, 22 nt, Homo sapiens
uggucaaacaaacucucugaac

SEQ ID NO: 846736 - RNA, 12 nt, Homo sapiens
ugugcccgggga

SEQ ID NO: 846737 - RNA, 13 nt, Homo sapiens
aaauuagcuggau

SEQ ID NO: 846738 - RNA, 10 nt, Homo sapiens
aacacauguu

SEQ ID NO: 846739 - RNA, 23 nt, Homo sapiens
aacagugucauauacaauuguca

SEQ ID NO: 846740 - RNA, 13 nt, Homo sapiens
aacauguaugugc

SEQ ID NO: 846741 - RNA, 14 nt, Homo sapiens
aacauguaugugca

SEQ ID NO: 846742 - RNA, 16 nt, Homo sapiens
aacauguaugugcauu

SEQ ID NO: 846743 - RNA, 15 nt, Homo sapiens
aacgaagcaccauca

SEQ ID NO: 846744 - RNA, 14 nt, Homo sapiens
aacucacugagggu

SEQ ID NO: 846745 - RNA, 22 nt, Homo sapiens
aagaagguuggugaauuucaca

SEQ ID NO: 846746 - RNA, 12 nt, Homo sapiens
aagaauuucaca

SEQ ID NO: 846747 - RNA, 14 nt, Homo sapiens
aagcugcucaggga

SEQ ID NO: 846748 - RNA, 12 nt, Homo sapiens
aaggauguugcc

SEQ ID NO: 846749 - RNA, 18 nt, Homo sapiens
aaggcaccucucuggguu

SEQ ID NO: 846750 - RNA, 19 nt, Homo sapiens
aaguaaaaggaaaugcucc

SEQ ID NO: 846751 - RNA, 14 nt, Homo sapiens
aaguaggaaaugaa

SEQ ID NO: 846752 - RNA, 15 nt, Homo sapiens
aagucagaaagugca

SEQ ID NO: 846753 - RNA, 23 nt, Homo sapiens
aauaaaauuuaacucacacugcc

SEQ ID NO: 846754 - RNA, 22 nt, Homo sapiens
aauaaagcaacagacuucucaa

SEQ ID NO: 846755 - RNA, 13 nt, Homo sapiens
aaugaaccuucug

SEQ ID NO: 846756 - RNA, 16 nt, Homo sapiens
aaugaaccuucuggcc

SEQ ID NO: 846757 - RNA, 19 nt, Homo sapiens
aaugcucagaccagcucuu

SEQ ID NO: 846758 - RNA, 17 nt, Homo sapiens
aaugcugagguuaugaa

SEQ ID NO: 846759 - RNA, 14 nt, Homo sapiens
aauguaugugcucu

SEQ ID NO: 846760 - RNA, 15 nt, Homo sapiens
aauguaugugcucuu

SEQ ID NO: 846761 - RNA, 13 nt, Homo sapiens
aauguuaaauuca

SEQ ID NO: 846762 - RNA, 16 nt, Homo sapiens
aauuagcauggccaca

SEQ ID NO: 846763 - RNA, 22 nt, Homo sapiens
aauuuaaauaagauuuaauuca

SEQ ID NO: 846764 - RNA, 19 nt, Homo sapiens
aauuuuuaaggauguugcc

SEQ ID NO: 846765 - RNA, 13 nt, Homo sapiens
acaacacugggaa

SEQ ID NO: 846766 - RNA, 21 nt, Homo sapiens
acaaguaaaaggaaaugcucc

SEQ ID NO: 846767 - RNA, 21 nt, Homo sapiens
acaaugauacaguugcauguu

SEQ ID NO: 846768 - RNA, 15 nt, Homo sapiens
acaaugcugagguua

SEQ ID NO: 846769 - RNA, 23 nt, Homo sapiens
acaauguaaauauuacacaucaa

SEQ ID NO: 846770 - RNA, 16 nt, Homo sapiens
acacaugugcuggcca

SEQ ID NO: 846771 - RNA, 17 nt, Homo sapiens
acacccugagguugugu

SEQ ID NO: 846772 - RNA, 18 nt, Homo sapiens
acagaaacuccuguucau

SEQ ID NO: 846773 - RNA, 14 nt, Homo sapiens
acagagucaagggu

SEQ ID NO: 846774 - RNA, 14 nt, Homo sapiens
acaggagcaucucc

SEQ ID NO: 846775 - RNA, 15 nt, Homo sapiens
acaucaagcgaugaa

SEQ ID NO: 846776 - RNA, 18 nt, Homo sapiens
acaucaagcgaugaaacu

SEQ ID NO: 846777 - RNA, 20 nt, Homo sapiens
uacauucuugcuaauucuca

SEQ ID NO: 846778 - RNA, 21 nt, Homo sapiens
uaccccaggagacucugggaa

SEQ ID NO: 846779 - RNA, 13 nt, Homo sapiens
uacuaauugucua

SEQ ID NO: 846780 - RNA, 22 nt, Homo sapiens
uagaacagucucuugaggcaca

SEQ ID NO: 846781 - RNA, 21 nt, Homo sapiens
uagaauauuuuaagaauuuca

SEQ ID NO: 846782 - RNA, 18 nt, Homo sapiens
uagagugugguuaugaac

SEQ ID NO: 846783 - RNA, 19 nt, Homo sapiens
uagcauggccacaucugag

SEQ ID NO: 846784 - RNA, 18 nt, Homo sapiens
uagcccuuccccucugca

SEQ ID NO: 846785 - RNA, 18 nt, Homo sapiens
uaggaaaugaaugaucuu

SEQ ID NO: 846786 - RNA, 17 nt, Homo sapiens
uauaaaauuaacauaaa

SEQ ID NO: 846787 - RNA, 14 nt, Homo sapiens
uauaaauaacuaau

SEQ ID NO: 846788 - RNA, 13 nt, Homo sapiens
uaucucuucucag

SEQ ID NO: 846789 - RNA, 15 nt, Homo sapiens
uaugccacaagaacc

SEQ ID NO: 846790 - RNA, 13 nt, Homo sapiens
uaugugagcucac

SEQ ID NO: 846791 - RNA, 17 nt, Homo sapiens
uauuuuaagaauuucac

SEQ ID NO: 846792 - RNA, 23 nt, Homo sapiens
ucaaaugcucagaccagcucuuc

SEQ ID NO: 846793 - RNA, 12 nt, Homo sapiens
ucaacucugagu

SEQ ID NO: 846794 - RNA, 18 nt, Homo sapiens
ucaagcuaugugagcuca

SEQ ID NO: 846795 - RNA, 19 nt, Homo sapiens
ucaagcuaugugagcucac

SEQ ID NO: 846796 - RNA, 15 nt, Homo sapiens
ucaauaaucaaugaa

SEQ ID NO: 846797 - RNA, 12 nt, Homo sapiens
ucacaagcuauu

SEQ ID NO: 846798 - RNA, 21 nt, Homo sapiens
ucacccugaggugagcaucau

SEQ ID NO: 846799 - RNA, 13 nt, Homo sapiens
ucacuguccucca

SEQ ID NO: 846800 - RNA, 23 nt, Homo sapiens
ucagaaagugcauuaaacugaau

SEQ ID NO: 846801 - RNA, 18 nt, Homo sapiens
ucagcuggucaaacaaac

SEQ ID NO: 846802 - RNA, 20 nt, Homo sapiens
ucaggggcggggagggugac

SEQ ID NO: 846803 - RNA, 16 nt, Homo sapiens
ucaugagggcuggaug

SEQ ID NO: 846804 - RNA, 16 nt, Homo sapiens
ucauugcaagcucaag

SEQ ID NO: 846805 - RNA, 14 nt, Homo sapiens
uccaagaccagaga

SEQ ID NO: 846806 - RNA, 17 nt, Homo sapiens
uccacaaguaaaaggaa

SEQ ID NO: 846807 - RNA, 19 nt, Homo sapiens
uccaggcuggcgugcagca

SEQ ID NO: 846808 - RNA, 22 nt, Homo sapiens
uccaggcuggcgugcagcauca

SEQ ID NO: 846809 - RNA, 16 nt, Homo sapiens
uccagggagucucagc

SEQ ID NO: 846810 - RNA, 18 nt, Homo sapiens
ucguugacccucacagga

SEQ ID NO: 846811 - RNA, 11 nt, Homo sapiens
ucuaugccaca

SEQ ID NO: 846812 - RNA, 18 nt, Homo sapiens
ucuccccucagagugcaa

SEQ ID NO: 846813 - RNA, 17 nt, Homo sapiens
ucucuucucagaaggaa

SEQ ID NO: 846814 - RNA, 20 nt, Homo sapiens
ucugaggagcuguugaggua

SEQ ID NO: 846815 - RNA, 17 nt, Homo sapiens
ucugagggagcugagua

SEQ ID NO: 846816 - RNA, 20 nt, Homo sapiens
ucuggguuaggccuugccua

SEQ ID NO: 846817 - RNA, 21 nt, Homo sapiens
ucuuuaacccacuaacuggcu

SEQ ID NO: 846818 - RNA, 21 nt, Homo sapiens
ugaacaaagugaggagaauga

SEQ ID NO: 846819 - RNA, 15 nt, Homo sapiens
ugaagaguccucuga

SEQ ID NO: 846820 - RNA, 15 nt, Homo sapiens
ugaauuucacaagcu

SEQ ID NO: 846821 - RNA, 18 nt, Homo sapiens
ugaauuucacaagcuauu

SEQ ID NO: 846822 - RNA, 15 nt, Homo sapiens
ugaggaaacaacagc

SEQ ID NO: 846823 - RNA, 17 nt, Homo sapiens
ugaggagcuggaaacac

SEQ ID NO: 846824 - RNA, 19 nt, Homo sapiens
ugaggguaucugacaaugc

SEQ ID NO: 846825 - RNA, 13 nt, Homo sapiens
ugagguaccucca

SEQ ID NO: 846826 - RNA, 23 nt, Homo sapiens
ugaggugagcaucaucuucuggg

SEQ ID NO: 846827 - RNA, 18 nt, Homo sapiens
ugcacucagcucuuggcu

SEQ ID NO: 846828 - RNA, 11 nt, Homo sapiens
ugcagcuucca

SEQ ID NO: 846829 - RNA, 16 nt, Homo sapiens
ugcaguauaaauaacu

SEQ ID NO: 846830 - RNA, 10 nt, Homo sapiens
ugccaaaaaa

SEQ ID NO: 846831 - RNA, 14 nt, Homo sapiens
ugcccccccagugg

SEQ ID NO: 846832 - RNA, 16 nt, Homo sapiens
ugcuagaacagucucu

SEQ ID NO: 846833 - RNA, 21 nt, Homo sapiens
ugcucaauaaauaaugaucac

SEQ ID NO: 846834 - RNA, 17 nt, Homo sapiens
ugcuugucccuguggaa

SEQ ID NO: 846835 - RNA, 19 nt, Homo sapiens
uggaaacgaagcaccauca

SEQ ID NO: 846836 - RNA, 16 nt, Homo sapiens
uggacagccugaguca

SEQ ID NO: 846837 - RNA, 17 nt, Homo sapiens
uggcaagaucauagcuc

SEQ ID NO: 846838 - RNA, 23 nt, Homo sapiens
uggcgacagagggagacuccauc

SEQ ID NO: 846839 - RNA, 23 nt, Homo sapiens
uggggcuuuaacuccugcuagaa

SEQ ID NO: 846840 - RNA, 14 nt, Homo sapiens
uggugucuucaggg

SEQ ID NO: 846841 - RNA, 22 nt, Homo sapiens
ugucaagacaaggucuugcuau

SEQ ID NO: 846842 - RNA, 12 nt, Homo sapiens
ugucacagggac

SEQ ID NO: 846843 - RNA, 19 nt, Homo sapiens
uguccccuaaaccaaaaac

SEQ ID NO: 846844 - RNA, 12 nt, Homo sapiens
ugucccugugga

SEQ ID NO: 846845 - RNA, 22 nt, Homo sapiens
uguggggaaguuaggaacuggu

SEQ ID NO: 846846 - RNA, 19 nt, Homo sapiens
uguuaagcguugagccacc

SEQ ID NO: 846847 - RNA, 22 nt, Homo sapiens
uguuauauuauuacuaauuguc

SEQ ID NO: 846848 - RNA, 16 nt, Homo sapiens
uguugagguaccucca

SEQ ID NO: 846849 - RNA, 16 nt, Homo sapiens
uguuuuauauguugcu

SEQ ID NO: 846850 - RNA, 16 nt, Homo sapiens
uuaaacagugucauau

SEQ ID NO: 846851 - RNA, 16 nt, Homo sapiens
uuaacuccugcuagaa

SEQ ID NO: 846852 - RNA, 22 nt, Homo sapiens
uuaauuuuuaaggauguugcca

SEQ ID NO: 846853 - RNA, 17 nt, Homo sapiens
uuauuacuaauugucua

SEQ ID NO: 846854 - RNA, 22 nt, Homo sapiens
uuccgugcuugucccuguggaa

SEQ ID NO: 846855 - RNA, 14 nt, Homo sapiens
uuccugcaguagaa

SEQ ID NO: 846856 - RNA, 16 nt, Homo sapiens
uucuugcuaauucuca

SEQ ID NO: 846857 - RNA, 14 nt, Homo sapiens
uucuuuccauaaua

SEQ ID NO: 846858 - RNA, 18 nt, Homo sapiens
uugcaccuccauggaaac

SEQ ID NO: 846859 - RNA, 17 nt, Homo sapiens
uugccgcgucgcccucc

SEQ ID NO: 846860 - RNA, 17 nt, Homo sapiens
uuggccaacauggugaa

SEQ ID NO: 846861 - RNA, 21 nt, Homo sapiens
uugggcaggcagauguuccua

SEQ ID NO: 846862 - RNA, 11 nt, Homo sapiens
aaaacauguau

SEQ ID NO: 846863 - RNA, 16 nt, Homo sapiens
aaaacauguaugugca

SEQ ID NO: 846864 - RNA, 11 nt, Homo sapiens
aaacacauguu

SEQ ID NO: 846865 - RNA, 14 nt, Homo sapiens
aaacgaagcaccau

SEQ ID NO: 846866 - RNA, 17 nt, Homo sapiens
aaacuaagucagaaagu

SEQ ID NO: 846867 - RNA, 15 nt, Homo sapiens
aaacuacaagccacg

SEQ ID NO: 846868 - RNA, 19 nt, Homo sapiens
aaagacccaacauuacuaa

SEQ ID NO: 846869 - RNA, 19 nt, Homo sapiens
aaagcaacagacuucucaa

SEQ ID NO: 846870 - RNA, 13 nt, Homo sapiens
aaagccacacucu

SEQ ID NO: 846871 - RNA, 22 nt, Homo sapiens
aaagccacacucugggcuccag

SEQ ID NO: 846872 - RNA, 14 nt, Homo sapiens
aaagcugcucaggg

SEQ ID NO: 846873 - RNA, 21 nt, Homo sapiens
aaaggaaaugcuccuccaggg

SEQ ID NO: 846874 - RNA, 17 nt, Homo sapiens
aaauauuacacaucaag

SEQ ID NO: 846875 - RNA, 20 nt, Homo sapiens
aaaucugagggagcugagua

SEQ ID NO: 846876 - RNA, 21 nt, Homo sapiens
uggcuaauuagcauggccaca

SEQ ID NO: 846877 - RNA, 20 nt, Homo sapiens
uggcuguuccugcaguagaa

SEQ ID NO: 846878 - RNA, 18 nt, Homo sapiens
ugguggcagugccuguaa

SEQ ID NO: 846879 - RNA, 13 nt, Homo sapiens
ugguuaugaacuu

SEQ ID NO: 846880 - RNA, 17 nt, Homo sapiens
ugguuuucccaucucag

SEQ ID NO: 846881 - RNA, 19 nt, Homo sapiens
ugguuuucccaucucaggu

SEQ ID NO: 846882 - RNA, 19 nt, Homo sapiens
uguaaauauuacacaucaa

SEQ ID NO: 846883 - RNA, 19 nt, Homo sapiens
ugucaagacaaggucuugc

SEQ ID NO: 846884 - RNA, 17 nt, Homo sapiens
ugucauauacaauuguc

SEQ ID NO: 846885 - RNA, 18 nt, Homo sapiens
uguccaaaacugccucag

SEQ ID NO: 846886 - RNA, 23 nt, Homo sapiens
uguucccuggggcuuuaacuccu

SEQ ID NO: 846887 - RNA, 13 nt, Homo sapiens
uguuuucccuccu

SEQ ID NO: 846888 - RNA, 20 nt, Homo sapiens
uuaaacugaaucacaaugua

SEQ ID NO: 846889 - RNA, 15 nt, Homo sapiens
uuacuaauugucuac

SEQ ID NO: 846890 - RNA, 10 nt, Homo sapiens
uucacaagcu

SEQ ID NO: 846891 - RNA, 20 nt, Homo sapiens
uucccaccugcuggagugaa

SEQ ID NO: 846892 - RNA, 15 nt, Homo sapiens
uugguaaauggcaaa

SEQ ID NO: 846893 - RNA, 16 nt, Homo sapiens
uugucauguaugugaa

SEQ ID NO: 846894 - RNA, 23 nt, Homo sapiens
uuuaaauaagauuuaauucacau

SEQ ID NO: 846895 - RNA, 15 nt, Homo sapiens
uuuaaggauguugcc

SEQ ID NO: 846896 - RNA, 22 nt, Homo sapiens
uuugggaggcugaggcaggaga

SEQ ID NO: 846897 - RNA, 22 nt, Homo sapiens
uuuuaaacagugucauauacaa

SEQ ID NO: 846898 - RNA, 17 nt, Homo sapiens
uuuuaauuuuuugucaa

SEQ ID NO: 846899 - RNA, 18 nt, Homo sapiens
uuuuauuuacauucuugc

SEQ ID NO: 846900 - RNA, 17 nt, Homo sapiens
uuuuuaaacagugucau

SEQ ID NO: 846901 - RNA, 19 nt, Homo sapiens
uuuuuaauuuuuugucaag

SEQ ID NO: 846902 - RNA, 19 nt, Homo sapiens
aaaaccaggccuuaucucc

SEQ ID NO: 846903 - RNA, 16 nt, Homo sapiens
aaaacuacaagccacg

SEQ ID NO: 846904 - RNA, 11 nt, Homo sapiens
aaaacugccuc

SEQ ID NO: 846905 - RNA, 18 nt, Homo sapiens
aaaagcacacucaucccc

SEQ ID NO: 846906 - RNA, 12 nt, Homo sapiens
aaacaacagcuu

SEQ ID NO: 846907 - RNA, 16 nt, Homo sapiens
aaacauguaugugcau

SEQ ID NO: 846908 - RNA, 13 nt, Homo sapiens
aaacucucugaac

SEQ ID NO: 846909 - RNA, 22 nt, Homo sapiens
aaagaagguuggugaauuucac

SEQ ID NO: 846910 - RNA, 12 nt, Homo sapiens
aaagcacacuca

SEQ ID NO: 846911 - RNA, 22 nt, Homo sapiens
aaaggaaaugcuccuccaggga

SEQ ID NO: 846912 - RNA, 18 nt, Homo sapiens
aaagugcauuaaacugaa

SEQ ID NO: 846913 - RNA, 20 nt, Homo sapiens
aaauaagauuuaauucacau

SEQ ID NO: 846914 - RNA, 17 nt, Homo sapiens
aaaugaaugaucuuggc

SEQ ID NO: 846915 - RNA, 13 nt, Homo sapiens
aaauguaugugcu

SEQ ID NO: 846916 - RNA, 14 nt, Homo sapiens
aaauguaugugcuc

SEQ ID NO: 846917 - RNA, 17 nt, Homo sapiens
aaauguaugugcucuua

SEQ ID NO: 846918 - RNA, 18 nt, Homo sapiens
acauguaugugcauuuca

SEQ ID NO: 846919 - RNA, 12 nt, Homo sapiens
accaaaaacuga

SEQ ID NO: 846920 - RNA, 14 nt, Homo sapiens
accaaaaacugaaa

SEQ ID NO: 846921 - RNA, 16 nt, Homo sapiens
accaacacccugaggu

SEQ ID NO: 846922 - RNA, 22 nt, Homo sapiens
accaacaucgcagacacaugug

SEQ ID NO: 846923 - RNA, 20 nt, Homo sapiens
accaagcugguggcucugug

SEQ ID NO: 846924 - RNA, 19 nt, Homo sapiens
accagacagacaacacugg

SEQ ID NO: 846925 - RNA, 22 nt, Homo sapiens
accagacagacaacacugggaa

SEQ ID NO: 846926 - RNA, 19 nt, Homo sapiens
acccugaggugagcaucau

SEQ ID NO: 846927 - RNA, 12 nt, Homo sapiens
accuacauuuga

SEQ ID NO: 846928 - RNA, 20 nt, Homo sapiens
accucacaggccccaggaaa

SEQ ID NO: 846929 - RNA, 21 nt, Homo sapiens
accuccuaagaaggcaccucu

SEQ ID NO: 846930 - RNA, 16 nt, Homo sapiens
acuaaugucucuacaa

SEQ ID NO: 846931 - RNA, 15 nt, Homo sapiens
acucaaaugcucaga

SEQ ID NO: 846932 - RNA, 21 nt, Homo sapiens
acucaaaugcucagaccagcu

SEQ ID NO: 846933 - RNA, 19 nt, Homo sapiens
acucagcucuuggcuccac

SEQ ID NO: 846934 - RNA, 13 nt, Homo sapiens
agaaggcaccucu

SEQ ID NO: 846935 - RNA, 22 nt, Homo sapiens
agaagguuggugaauuucacaa

SEQ ID NO: 846936 - RNA, 21 nt, Homo sapiens
agaauaaccaacacccugagg

SEQ ID NO: 846937 - RNA, 16 nt, Homo sapiens
agaaugaaauguaugu

SEQ ID NO: 846938 - RNA, 19 nt, Homo sapiens
agaaugaaauguaugugcu

SEQ ID NO: 846939 - RNA, 20 nt, Homo sapiens
agaaugaaauguaugugcuc

SEQ ID NO: 846940 - RNA, 18 nt, Homo sapiens
agaaugggggcagcaccu

SEQ ID NO: 846941 - RNA, 14 nt, Homo sapiens
agacaacacuggga

SEQ ID NO: 846942 - RNA, 19 nt, Homo sapiens
agacagacaacacugggaa

SEQ ID NO: 846943 - RNA, 15 nt, Homo sapiens
agacagggcccuguc

SEQ ID NO: 846944 - RNA, 14 nt, Homo sapiens
agaccaucuuggcc

SEQ ID NO: 846945 - RNA, 16 nt, Homo sapiens
agacucaaaugcucag

SEQ ID NO: 846946 - RNA, 17 nt, Homo sapiens
agacucaaaugcucaga

SEQ ID NO: 846947 - RNA, 16 nt, Homo sapiens
agagacccaagcugcc

SEQ ID NO: 846948 - RNA, 20 nt, Homo sapiens
agagggagacuccaucucaa

SEQ ID NO: 846949 - RNA, 17 nt, Homo sapiens
agagucaagggugugug

SEQ ID NO: 846950 - RNA, 22 nt, Homo sapiens
agauagcuucaccccaauccca

SEQ ID NO: 846951 - RNA, 21 nt, Homo sapiens
agcaaaaacauguaugugcau

SEQ ID NO: 846952 - RNA, 23 nt, Homo sapiens
agcaacagacuucucaauaauca

SEQ ID NO: 846953 - RNA, 13 nt, Homo sapiens
agcauaguggcaa

SEQ ID NO: 846954 - RNA, 20 nt, Homo sapiens
agccaagaucgcaccacugc

SEQ ID NO: 846955 - RNA, 12 nt, Homo sapiens
agccacacucug

SEQ ID NO: 846956 - RNA, 17 nt, Homo sapiens
agccaugugcagccacc

SEQ ID NO: 846957 - RNA, 15 nt, Homo sapiens
agcuaccucaaccaa

SEQ ID NO: 846958 - RNA, 17 nt, Homo sapiens
agcuaccucaaccaaug

SEQ ID NO: 846959 - RNA, 11 nt, Homo sapiens
agcugcucagg

SEQ ID NO: 846960 - RNA, 20 nt, Homo sapiens
agcuguugagguaccuccaa

SEQ ID NO: 846961 - RNA, 23 nt, Homo sapiens
agcuuccaggcuggcgugcagca

SEQ ID NO: 846962 - RNA, 14 nt, Homo sapiens
aggaaacaacagcu

SEQ ID NO: 846963 - RNA, 17 nt, Homo sapiens
aggaaagaaaaaaagua

SEQ ID NO: 846964 - RNA, 13 nt, Homo sapiens
aggaaaugaauga

SEQ ID NO: 846965 - RNA, 19 nt, Homo sapiens
aggaaaugcuccuccaggg

SEQ ID NO: 846966 - RNA, 17 nt, Homo sapiens
aggaccggccuuugcac

SEQ ID NO: 846967 - RNA, 14 nt, Homo sapiens
aggauauugucagu

SEQ ID NO: 846968 - RNA, 13 nt, Homo sapiens
agggaaaagcagc

SEQ ID NO: 846969 - RNA, 20 nt, Homo sapiens
agggagcugaguaacaccau

SEQ ID NO: 846970 - RNA, 17 nt, Homo sapiens
agguaccuccaaggacc

SEQ ID NO: 846971 - RNA, 17 nt, Homo sapiens
aggucaaaaaucugucc

SEQ ID NO: 846972 - RNA, 17 nt, Homo sapiens
agguuggugaauuucac

SEQ ID NO: 846973 - RNA, 22 nt, Homo sapiens
agguuggugaauuucacaagcu

SEQ ID NO: 846974 - RNA, 19 nt, Homo sapiens
aguggggagacuucuuggc

SEQ ID NO: 846975 - RNA, 15 nt, Homo sapiens
aguuuuauuacacau

SEQ ID NO: 846976 - RNA, 15 nt, Homo sapiens
auaaaauuuaacuca

SEQ ID NO: 846977 - RNA, 14 nt, Homo sapiens
auaaugaucacagg

SEQ ID NO: 846978 - RNA, 18 nt, Homo sapiens
auacaaaaauuagcugga

SEQ ID NO: 846979 - RNA, 15 nt, Homo sapiens
auauguugcuauaau

SEQ ID NO: 846980 - RNA, 16 nt, Homo sapiens
aucaaccugccagcug

SEQ ID NO: 846981 - RNA, 20 nt, Homo sapiens
aucaagcgaugaaacuggaa

SEQ ID NO: 846982 - RNA, 13 nt, Homo sapiens
aucaaugaaguag

SEQ ID NO: 846983 - RNA, 23 nt, Homo sapiens
auccccccgccaaaagcugcuca

SEQ ID NO: 846984 - RNA, 12 nt, Homo sapiens
auccgagcucag

SEQ ID NO: 846985 - RNA, 17 nt, Homo sapiens
aucgagaccaucuuggc

SEQ ID NO: 846986 - RNA, 19 nt, Homo sapiens
aucgcaccacugcucucca

SEQ ID NO: 846987 - RNA, 16 nt, Homo sapiens
aucuaugccacaagaa

SEQ ID NO: 846988 - RNA, 18 nt, Homo sapiens
aucuccaagaccagagau

SEQ ID NO: 846989 - RNA, 18 nt, Homo sapiens
aucucuucucagaaggaa

SEQ ID NO: 846990 - RNA, 12 nt, Homo sapiens
aucuucuggguu

SEQ ID NO: 846991 - RNA, 18 nt, Homo sapiens
augaaauguaugugcucu

SEQ ID NO: 846992 - RNA, 16 nt, Homo sapiens
augaaguagcugagaa

SEQ ID NO: 846993 - RNA, 16 nt, Homo sapiens
augcaaugacucagga

SEQ ID NO: 846994 - RNA, 11 nt, Homo sapiens
augccaaaaaa

SEQ ID NO: 846995 - RNA, 19 nt, Homo sapiens
augccgagguaaaaguucu

SEQ ID NO: 846996 - RNA, 23 nt, Homo sapiens
augcucaauaaauaaugaucaca

SEQ ID NO: 846997 - RNA, 12 nt, Homo sapiens
auggccacaucu

SEQ ID NO: 846998 - RNA, 16 nt, Homo sapiens
ugugugcagcauuguu

SEQ ID NO: 846999 - RNA, 20 nt, Homo sapiens
uguguggaaggugaucuggc

SEQ ID NO: 847000 - RNA, 18 nt, Homo sapiens
uguuaagcguugagccac

SEQ ID NO: 847001 - RNA, 19 nt, Homo sapiens
uguucaugcccauaccccu

SEQ ID NO: 847002 - RNA, 24 nt, Homo sapiens
uguugccacuggcaaauguaacug

SEQ ID NO: 847003 - RNA, 14 nt, Homo sapiens
uuaaggauguugcc

SEQ ID NO: 847004 - RNA, 19 nt, Homo sapiens
uuacccacacacagauaaa

SEQ ID NO: 847005 - RNA, 23 nt, Homo sapiens
uuagaaaauaaaauuuaacucac

SEQ ID NO: 847006 - RNA, 21 nt, Homo sapiens
uuagcauggccacaucugagc

SEQ ID NO: 847007 - RNA, 12 nt, Homo sapiens
uuauauguugcu

SEQ ID NO: 847008 - RNA, 14 nt, Homo sapiens
uuauauuauuacua

SEQ ID NO: 847009 - RNA, 21 nt, Homo sapiens
uucacccugaggugagcauca

SEQ ID NO: 847010 - RNA, 13 nt, Homo sapiens
uucccaucucagg

SEQ ID NO: 847011 - RNA, 16 nt, Homo sapiens
uucccuccuuggagac

SEQ ID NO: 847012 - RNA, 17 nt, Homo sapiens
uucuggccucccacaga

SEQ ID NO: 847013 - RNA, 15 nt, Homo sapiens
uucuuuuugcucuaa

SEQ ID NO: 847014 - RNA, 19 nt, Homo sapiens
uugaaccagggagucagag

SEQ ID NO: 847015 - RNA, 18 nt, Homo sapiens
gaauuucacaagcuauuu

SEQ ID NO: 847016 - RNA, 19 nt, Homo sapiens
gaauuucacaagcuauuuu

SEQ ID NO: 847017 - RNA, 16 nt, Homo sapiens
gacaagggaaauguca

SEQ ID NO: 847018 - RNA, 19 nt, Homo sapiens
gacaaggucuugcuauguu

SEQ ID NO: 847019 - RNA, 17 nt, Homo sapiens
gagccaagaucgcacca

SEQ ID NO: 847020 - RNA, 20 nt, Homo sapiens
gagcuguugagguaccucca

SEQ ID NO: 847021 - RNA, 22 nt, Homo sapiens
gaggacaagggaaaugucaggg

SEQ ID NO: 847022 - RNA, 14 nt, Homo sapiens
gaguggggaugaca

SEQ ID NO: 847023 - RNA, 19 nt, Homo sapiens
gauagggagcagaugcaau

SEQ ID NO: 847024 - RNA, 19 nt, Homo sapiens
gaucauagcucauugcaag

SEQ ID NO: 847025 - RNA, 18 nt, Homo sapiens
gaucaugauguagagugu

SEQ ID NO: 847026 - RNA, 18 nt, Homo sapiens
gaucgagaccaucuuggc

SEQ ID NO: 847027 - RNA, 23 nt, Homo sapiens
gaugccgagguaaaaguucuuuu

SEQ ID NO: 847028 - RNA, 20 nt, Homo sapiens
gcaccacugcucuccagccu

SEQ ID NO: 847029 - RNA, 16 nt, Homo sapiens
gcaucaucuucugggu

SEQ ID NO: 847030 - RNA, 21 nt, Homo sapiens
gccaaggagggugagugcaag

SEQ ID NO: 847031 - RNA, 15 nt, Homo sapiens
gcccuaaaagcacac

SEQ ID NO: 847032 - RNA, 16 nt, Homo sapiens
gcccuaaaagcacacu

SEQ ID NO: 847033 - RNA, 12 nt, Homo sapiens
aauuucacaagc

SEQ ID NO: 847034 - RNA, 13 nt, Homo sapiens
acagacaacacug

SEQ ID NO: 847035 - RNA, 17 nt, Homo sapiens
acagacuucucaauaau

SEQ ID NO: 847036 - RNA, 20 nt, Homo sapiens
acagccugagucaccugcag

SEQ ID NO: 847037 - RNA, 15 nt, Homo sapiens
acauucuugcuaauu

SEQ ID NO: 847038 - RNA, 23 nt, Homo sapiens
acauuuauguaauuuuauuuaca

SEQ ID NO: 847039 - RNA, 14 nt, Homo sapiens
accaaugccaaaaa

SEQ ID NO: 847040 - RNA, 21 nt, Homo sapiens
accaaugccaaaaaaagacag

SEQ ID NO: 847041 - RNA, 15 nt, Homo sapiens
accacugcucuccag

SEQ ID NO: 847042 - RNA, 16 nt, Homo sapiens
accagucccuccccaa

SEQ ID NO: 847043 - RNA, 22 nt, Homo sapiens
accagucccuccccaaaugcuu

SEQ ID NO: 847044 - RNA, 17 nt, Homo sapiens
accaucgaucaugaugu

SEQ ID NO: 847045 - RNA, 24 nt, Homo sapiens
acccucacaggagcaucuccucaa

SEQ ID NO: 847046 - RNA, 23 nt, Homo sapiens
accuccuaagaaggcaccucucu

SEQ ID NO: 847047 - RNA, 12 nt, Homo sapiens
acgaaugaauga

SEQ ID NO: 847048 - RNA, 12 nt, Homo sapiens
acuaagucagaa

SEQ ID NO: 847049 - RNA, 15 nt, Homo sapiens
acucaauucugcagu

SEQ ID NO: 847050 - RNA, 13 nt, Homo sapiens
cccacacuccaug

SEQ ID NO: 847051 - RNA, 13 nt, Homo sapiens
ccccccaguggac

SEQ ID NO: 847052 - RNA, 13 nt, Homo sapiens
cccccgccaaaag

SEQ ID NO: 847053 - RNA, 14 nt, Homo sapiens
cccuaaaccaaaaa

SEQ ID NO: 847054 - RNA, 21 nt, Homo sapiens
cccuaaaccaaaaacugaaag

SEQ ID NO: 847055 - RNA, 14 nt, Homo sapiens
cccucaaaucugag

SEQ ID NO: 847056 - RNA, 14 nt, Homo sapiens
cccucagagugcaa

SEQ ID NO: 847057 - RNA, 19 nt, Homo sapiens
ccucacaggagcaucuccu

SEQ ID NO: 847058 - RNA, 14 nt, Homo sapiens
ccucagagugcaag

SEQ ID NO: 847059 - RNA, 16 nt, Homo sapiens
ccucccaaguagcuag

SEQ ID NO: 847060 - RNA, 23 nt, Homo sapiens
ccugcaguagaaugggggcagca

SEQ ID NO: 847061 - RNA, 13 nt, Homo sapiens
ccugcuccagaag

SEQ ID NO: 847062 - RNA, 22 nt, Homo sapiens
ccuggacuagagggaccucucc

SEQ ID NO: 847063 - RNA, 15 nt, Homo sapiens
cgaaggauauuguca

SEQ ID NO: 847064 - RNA, 12 nt, Homo sapiens
cgcagaccccac

SEQ ID NO: 847065 - RNA, 22 nt, Homo sapiens
cgccuguggacagccugaguca

SEQ ID NO: 847066 - RNA, 16 nt, Homo sapiens
cgugaucaaagccaca

SEQ ID NO: 847067 - RNA, 21 nt, Homo sapiens
cuaccucaaccaaugccaaaa

SEQ ID NO: 847068 - RNA, 16 nt, Homo sapiens
cuagaaagccaugugc

SEQ ID NO: 847069 - RNA, 22 nt, Homo sapiens
cucaagugauccuccugacuca

SEQ ID NO: 847070 - RNA, 12 nt, Homo sapiens
cucagaccagcu

SEQ ID NO: 847071 - RNA, 12 nt, Homo sapiens
cucagguguguu

SEQ ID NO: 847072 - RNA, 20 nt, Homo sapiens
cucuggacaggcacuaucug

SEQ ID NO: 847073 - RNA, 14 nt, Homo sapiens
cugaaaaccucucc

SEQ ID NO: 847074 - RNA, 16 nt, Homo sapiens
cugaaucacaauguaa

SEQ ID NO: 847075 - RNA, 17 nt, Homo sapiens
cugagaaaacuaaguca

SEQ ID NO: 847076 - RNA, 17 nt, Homo sapiens
cugaggguaucugacaa

SEQ ID NO: 847077 - RNA, 17 nt, Homo sapiens
cugaggugagcaucauc

SEQ ID NO: 847078 - RNA, 14 nt, Homo sapiens
cugagguuaugaac

SEQ ID NO: 847079 - RNA, 16 nt, Homo sapiens
cugcagcuuccaggcu

SEQ ID NO: 847080 - RNA, 18 nt, Homo sapiens
cugcaggccaggccagcu

SEQ ID NO: 847081 - RNA, 22 nt, Homo sapiens
cugccacgccgcccuaaaagca

SEQ ID NO: 847082 - RNA, 19 nt, Homo sapiens
cugccagcuggccuuguga

SEQ ID NO: 847083 - RNA, 14 nt, Homo sapiens
cugguggcucugug

SEQ ID NO: 847084 - RNA, 14 nt, Homo sapiens
cuguaaucccagcu

SEQ ID NO: 847085 - RNA, 23 nt, Homo sapiens
cuguaaucccagcuauuugggag

SEQ ID NO: 847086 - RNA, 14 nt, Homo sapiens
cuguaauuccagca

SEQ ID NO: 847087 - RNA, 15 nt, Homo sapiens
cuguggaaguaucuu

SEQ ID NO: 847088 - RNA, 18 nt, Homo sapiens
cuguggaaguaucuuggu

SEQ ID NO: 847089 - RNA, 14 nt, Homo sapiens
cuguguguccaaaa

SEQ ID NO: 847090 - RNA, 15 nt, Homo sapiens
cuucacccugaggug

SEQ ID NO: 847091 - RNA, 13 nt, Homo sapiens
cuuccgaaaacca

SEQ ID NO: 847092 - RNA, 20 nt, Homo sapiens
cuucucaauaaucaaugaag

SEQ ID NO: 847093 - RNA, 22 nt, Homo sapiens
cuucuggccucccacagacuca

SEQ ID NO: 847094 - RNA, 20 nt, Homo sapiens
cuuggagacagggcccuguc

SEQ ID NO: 847095 - RNA, 15 nt, Homo sapiens
gaaaacuaagucaga

SEQ ID NO: 847096 - RNA, 18 nt, Homo sapiens
gaaaacuacaagccacga

SEQ ID NO: 847097 - RNA, 14 nt, Homo sapiens
gaaacgaagcacca

SEQ ID NO: 847098 - RNA, 17 nt, Homo sapiens
gaaacgaagcaccauca

SEQ ID NO: 847099 - RNA, 16 nt, Homo sapiens
gaaacuguucccaccu

SEQ ID NO: 847100 - RNA, 19 nt, Homo sapiens
gaaagugcauuaaacugaa

SEQ ID NO: 847101 - RNA, 20 nt, Homo sapiens
gaaagugcauuaaacugaau

SEQ ID NO: 847102 - RNA, 21 nt, Homo sapiens
gaaccuucuggccucccacag

SEQ ID NO: 847103 - RNA, 17 nt, Homo sapiens
gaagccagaucuaugcc

SEQ ID NO: 847104 - RNA, 19 nt, Homo sapiens
gaagccagaucuaugccac

SEQ ID NO: 847105 - RNA, 17 nt, Homo sapiens
gaaggcaccucucuggg

SEQ ID NO: 847106 - RNA, 15 nt, Homo sapiens
gaaguagcugagaaa

SEQ ID NO: 847107 - RNA, 21 nt, Homo sapiens
gaaugaaccuucuggccuccc

SEQ ID NO: 847108 - RNA, 15 nt, Homo sapiens
gacaaggucuugcua

SEQ ID NO: 847109 - RNA, 20 nt, Homo sapiens
gacauccccccgccaaaagc

SEQ ID NO: 847110 - RNA, 13 nt, Homo sapiens
gacccaagcugcc

SEQ ID NO: 847111 - RNA, 16 nt, Homo sapiens
gaccccacacuccaug

SEQ ID NO: 847112 - RNA, 21 nt, Homo sapiens
gacccucacaggagcaucucc

SEQ ID NO: 847113 - RNA, 16 nt, Homo sapiens
gacucaggacaucccc

SEQ ID NO: 847114 - RNA, 19 nt, Homo sapiens
gagacauugaggcaggcac

SEQ ID NO: 847115 - RNA, 14 nt, Homo sapiens
gagcaucuccucaa

SEQ ID NO: 847116 - RNA, 20 nt, Homo sapiens
gaggcaggagaaucgcuuga

SEQ ID NO: 847117 - RNA, 18 nt, Homo sapiens
gauaagcuaacaccagac

SEQ ID NO: 847118 - RNA, 21 nt, Homo sapiens
gauagcuucaccccaauccca

SEQ ID NO: 847119 - RNA, 23 nt, Homo sapiens
gauaguggggagacuucuuggcu

SEQ ID NO: 847120 - RNA, 14 nt, Homo sapiens
gaugaaacuggaaa

SEQ ID NO: 847121 - RNA, 19 nt, Homo sapiens
gaugaaacuggaaaacuac

SEQ ID NO: 847122 - RNA, 17 nt, Homo sapiens
gcaagaucauagcucau

SEQ ID NO: 847123 - RNA, 13 nt, Homo sapiens
gcaaugacucagg

SEQ ID NO: 847124 - RNA, 13 nt, Homo sapiens
gcaccaucauucc

SEQ ID NO: 847125 - RNA, 21 nt, Homo sapiens
gcaccucacaggccccaggaa

SEQ ID NO: 847126 - RNA, 20 nt, Homo sapiens
gcagcauuguuggcuguucc

SEQ ID NO: 847127 - RNA, 13 nt, Homo sapiens
gcagugucugcug

SEQ ID NO: 847128 - RNA, 20 nt, Homo sapiens
gccaaggagggugagugcaa

SEQ ID NO: 847129 - RNA, 16 nt, Homo sapiens
gccaccgcccagagac

SEQ ID NO: 847130 - RNA, 17 nt, Homo sapiens
gccaugugcagccacca

SEQ ID NO: 847131 - RNA, 17 nt, Homo sapiens
gccccugcuccagaaga

SEQ ID NO: 847132 - RNA, 13 nt, Homo sapiens
gccugagucaccu

SEQ ID NO: 847133 - RNA, 22 nt, Homo sapiens
gccuggagccuacuaaaugcuc

SEQ ID NO: 847134 - RNA, 18 nt, Homo sapiens
gcuauaauaaagaagugu

SEQ ID NO: 847135 - RNA, 20 nt, Homo sapiens
gcuauucccucaaaucugag

SEQ ID NO: 847136 - RNA, 14 nt, Homo sapiens
gcucagaccagcuc

SEQ ID NO: 847137 - RNA, 18 nt, Homo sapiens
gcucagggaaaagcagcu

SEQ ID NO: 847138 - RNA, 19 nt, Homo sapiens
gcucagggaaaagcagcuc

SEQ ID NO: 847139 - RNA, 21 nt, Homo sapiens
gcucagggaaaagcagcucuc

SEQ ID NO: 847140 - RNA, 20 nt, Homo sapiens
gcucauugcaagcucaagug

SEQ ID NO: 847141 - RNA, 24 nt, Homo sapiens
gcucuggacaggcacuaucugggu

SEQ ID NO: 847142 - RNA, 16 nt, Homo sapiens
gcucugugugcucuga

SEQ ID NO: 847143 - RNA, 16 nt, Homo sapiens
gcuguguccucaugag

SEQ ID NO: 847144 - RNA, 17 nt, Homo sapiens
gcuugucccuguggaag

SEQ ID NO: 847145 - RNA, 12 nt, Homo sapiens
gcuuuccaugag

SEQ ID NO: 847146 - RNA, 14 nt, Homo sapiens
ggaaacgaagcacc

SEQ ID NO: 847147 - RNA, 15 nt, Homo sapiens
ggaucuaccccagga

SEQ ID NO: 847148 - RNA, 10 nt, Homo sapiens
ggauguugcc

SEQ ID NO: 847149 - RNA, 12 nt, Homo sapiens
ggcacugccaaa

SEQ ID NO: 847150 - RNA, 16 nt, Homo sapiens
ggcaggcacugccaaa

SEQ ID NO: 847151 - RNA, 22 nt, Homo sapiens
ggccaaggagggugagugcaag

SEQ ID NO: 847152 - RNA, 17 nt, Homo sapiens
ggggagacuucuuggcu

SEQ ID NO: 847153 - RNA, 11 nt, Homo sapiens
aaaaacaugua

SEQ ID NO: 847154 - RNA, 14 nt, Homo sapiens
aaaaagacagggcu

SEQ ID NO: 847155 - RNA, 12 nt, Homo sapiens
aaaacauguaug

SEQ ID NO: 847156 - RNA, 15 nt, Homo sapiens
aaaacuacaagccac

SEQ ID NO: 847157 - RNA, 19 nt, Homo sapiens
aaaaguucuuuuugcucua

SEQ ID NO: 847158 - RNA, 21 nt, Homo sapiens
aaaauguuuuuaaacaguguc

SEQ ID NO: 847159 - RNA, 16 nt, Homo sapiens
aaacaacagcuuuaaa

SEQ ID NO: 847160 - RNA, 17 nt, Homo sapiens
aaacauguaugugcauu

SEQ ID NO: 847161 - RNA, 21 nt, Homo sapiens
aaagaagguuggugaauuuca

SEQ ID NO: 847162 - RNA, 17 nt, Homo sapiens
aaagcggacaucagcug

SEQ ID NO: 847163 - RNA, 21 nt, Homo sapiens
aaagcggacaucagcugguca

SEQ ID NO: 847164 - RNA, 12 nt, Homo sapiens
aaagcugcucag

SEQ ID NO: 847165 - RNA, 13 nt, Homo sapiens
aaagcugcucagg

SEQ ID NO: 847166 - RNA, 15 nt, Homo sapiens
aaaggaaaugcuccu

SEQ ID NO: 847167 - RNA, 18 nt, Homo sapiens
aaaguucuuuuugcucua

SEQ ID NO: 847168 - RNA, 15 nt, Homo sapiens
aaauaacuaaugucu

SEQ ID NO: 847169 - RNA, 12 nt, Homo sapiens
aaaucugaggga

SEQ ID NO: 847170 - RNA, 23 nt, Homo sapiens
aaaugcuccuccagggagucuca

SEQ ID NO: 847171 - RNA, 17 nt, Homo sapiens
aaaugcuuuccaugagu

SEQ ID NO: 847172 - RNA, 14 nt, Homo sapiens
aacagacuucucaa

SEQ ID NO: 847173 - RNA, 15 nt, Homo sapiens
aacagacuucucaau

SEQ ID NO: 847174 - RNA, 23 nt, Homo sapiens
aaccaucgaugaaggaauaucuc

SEQ ID NO: 847175 - RNA, 20 nt, Homo sapiens
aaccuucuggccucccacag

SEQ ID NO: 847176 - RNA, 23 nt, Homo sapiens
aaaacugaaagugaaaguccaga

SEQ ID NO: 847177 - RNA, 22 nt, Homo sapiens
aaaauguuuuuaaacaguguca

SEQ ID NO: 847178 - RNA, 23 nt, Homo sapiens
aaaauguuuuuaaacagugucau

SEQ ID NO: 847179 - RNA, 18 nt, Homo sapiens
aaacagugucauauacaa

SEQ ID NO: 847180 - RNA, 15 nt, Homo sapiens
aaaccaaaaacugaa

SEQ ID NO: 847181 - RNA, 14 nt, Homo sapiens
aaaccucuccucau

SEQ ID NO: 847182 - RNA, 15 nt, Homo sapiens
aaacugaaucacaau

SEQ ID NO: 847183 - RNA, 13 nt, Homo sapiens
aaagaaaaaaagu

SEQ ID NO: 847184 - RNA, 22 nt, Homo sapiens
aaagaauaaccaacacccugag

SEQ ID NO: 847185 - RNA, 18 nt, Homo sapiens
aaagcaacagacuucuca

SEQ ID NO: 847186 - RNA, 21 nt, Homo sapiens
aaagcacacucauccccucac

SEQ ID NO: 847187 - RNA, 18 nt, Homo sapiens
aaauaacuaaugucucua

SEQ ID NO: 847188 - RNA, 22 nt, Homo sapiens
aaauauuacacaucaagcgaug

SEQ ID NO: 847189 - RNA, 17 nt, Homo sapiens
aaaugcucagaccagcu

SEQ ID NO: 847190 - RNA, 15 nt, Homo sapiens
aaauguaacugugcc

SEQ ID NO: 847191 - RNA, 19 nt, Homo sapiens
aaauguaacugugccaguu

SEQ ID NO: 847192 - RNA, 12 nt, Homo sapiens
aaauguaugugc

SEQ ID NO: 847193 - RNA, 23 nt, Homo sapiens
aacaccagacagacaacacuggg

SEQ ID NO: 847194 - RNA, 20 nt, Homo sapiens
aacagggcugaagcuguguc

SEQ ID NO: 847195 - RNA, 18 nt, Homo sapiens
aacagugucauauacaau

SEQ ID NO: 847196 - RNA, 15 nt, Homo sapiens
aacauguaugugcau

SEQ ID NO: 847197 - RNA, 21 nt, Homo sapiens
aacucacugaggguaucugac

SEQ ID NO: 847198 - RNA, 15 nt, Homo sapiens
aagaaaaaggaacua

SEQ ID NO: 847199 - RNA, 17 nt, Homo sapiens
aagaaggcaccucucug

SEQ ID NO: 847200 - RNA, 19 nt, Homo sapiens
aagaauuuuguauuuucau

SEQ ID NO: 847201 - RNA, 17 nt, Homo sapiens
aagauagcuucacccca

SEQ ID NO: 847202 - RNA, 11 nt, Homo sapiens
aagcacacuca

SEQ ID NO: 847203 - RNA, 14 nt, Homo sapiens
aagccacgaaugaa

SEQ ID NO: 847204 - RNA, 21 nt, Homo sapiens
aagccacgaaugaaugaauua

SEQ ID NO: 847205 - RNA, 15 nt, Homo sapiens
aagccaugugcagcc

SEQ ID NO: 847206 - RNA, 18 nt, Homo sapiens
aagcuaacaccagacaga

SEQ ID NO: 847207 - RNA, 19 nt, Homo sapiens
aagcuaugugagcucacca

SEQ ID NO: 847208 - RNA, 23 nt, Homo sapiens
aagcugcucagggaaaagcagcu

SEQ ID NO: 847209 - RNA, 15 nt, Homo sapiens
aaggcuuugaguuaa

SEQ ID NO: 847210 - RNA, 22 nt, Homo sapiens
aaggucuugcuauguugcccag

SEQ ID NO: 847211 - RNA, 17 nt, Homo sapiens
aaguaggaaaugaauga

SEQ ID NO: 847212 - RNA, 22 nt, Homo sapiens
aagugaggagaaugaaauguau

SEQ ID NO: 847213 - RNA, 12 nt, Homo sapiens
aauaagauuuaa

SEQ ID NO: 847214 - RNA, 12 nt, Homo sapiens
aaucaaugaagu

SEQ ID NO: 847215 - RNA, 18 nt, Homo sapiens
aaucuguccgugaccuau

SEQ ID NO: 847216 - RNA, 14 nt, Homo sapiens
aauggcagcugcca

SEQ ID NO: 847217 - RNA, 20 nt, Homo sapiens
aaugggggcagcaccuccua

SEQ ID NO: 847218 - RNA, 13 nt, Homo sapiens
aauguaugugcuc

SEQ ID NO: 847219 - RNA, 21 nt, Homo sapiens
aauguaugugcucuuagcaaa

SEQ ID NO: 847220 - RNA, 17 nt, Homo sapiens
caauaaucaaugaagua

SEQ ID NO: 847221 - RNA, 17 nt, Homo sapiens
caaugauacaguugcau

SEQ ID NO: 847222 - RNA, 23 nt, Homo sapiens
caaugccaaaaaaagacagggcu

SEQ ID NO: 847223 - RNA, 22 nt, Homo sapiens
cacaaguaaaaggaaaugcucc

SEQ ID NO: 847224 - RNA, 20 nt, Homo sapiens
cagaaagugcauuaaacuga

SEQ ID NO: 847225 - RNA, 21 nt, Homo sapiens
cagaaagugcauuaaacugaa

SEQ ID NO: 847226 - RNA, 21 nt, Homo sapiens
cagacaacacugggaaacaga

SEQ ID NO: 847227 - RNA, 20 nt, Homo sapiens
cagagggagacuccaucuca

SEQ ID NO: 847228 - RNA, 21 nt, Homo sapiens
cagagggagacuccaucucaa

SEQ ID NO: 847229 - RNA, 24 nt, Homo sapiens
cagaguggggaugacaugcacuca

SEQ ID NO: 847230 - RNA, 21 nt, Homo sapiens
cagcuggucaaacaaacucuc

SEQ ID NO: 847231 - RNA, 15 nt, Homo sapiens
cagcuucacccugag

SEQ ID NO: 847232 - RNA, 14 nt, Homo sapiens
caggccagcugccu

SEQ ID NO: 847233 - RNA, 16 nt, Homo sapiens
caggccuuaucuccaa

SEQ ID NO: 847234 - RNA, 17 nt, Homo sapiens
caggcuggcgugcagca

SEQ ID NO: 847235 - RNA, 18 nt, Homo sapiens
caggcuggucuugaacuc

SEQ ID NO: 847236 - RNA, 15 nt, Homo sapiens
caggggggugguuuu

SEQ ID NO: 847237 - RNA, 23 nt, Homo sapiens
cauaaagaauuuuguauuuucau

SEQ ID NO: 847238 - RNA, 20 nt, Homo sapiens
caucaagcgaugaaacugga

SEQ ID NO: 847239 - RNA, 17 nt, Homo sapiens
caucaucuucuggguua

SEQ ID NO: 847240 - RNA, 21 nt, Homo sapiens
caugaccaacaucgcagacac

SEQ ID NO: 847241 - RNA, 17 nt, Homo sapiens
caugagggcuggaugcu

SEQ ID NO: 847242 - RNA, 11 nt, Homo sapiens
caugugcagcc

SEQ ID NO: 847243 - RNA, 14 nt, Homo sapiens
cauuaaacugaauc

SEQ ID NO: 847244 - RNA, 15 nt, Homo sapiens
cauuaaacugaauca

SEQ ID NO: 847245 - RNA, 20 nt, Homo sapiens
cauucccguugaacgucaca

SEQ ID NO: 847246 - RNA, 13 nt, Homo sapiens
cauucuugcuaau

SEQ ID NO: 847247 - RNA, 19 nt, Homo sapiens
cauucuugcuaauucucag

SEQ ID NO: 847248 - RNA, 13 nt, Homo sapiens
cauugcaagcuca

SEQ ID NO: 847249 - RNA, 13 nt, Homo sapiens
ccaacacccugag

SEQ ID NO: 847250 - RNA, 15 nt, Homo sapiens
ccaagcugguggcuc

SEQ ID NO: 847251 - RNA, 14 nt, Homo sapiens
ccaaggagggugag

SEQ ID NO: 847252 - RNA, 21 nt, Homo sapiens
ccaaggagggugagugcaagg

SEQ ID NO: 847253 - RNA, 14 nt, Homo sapiens
ccaccgcccagaga

SEQ ID NO: 847254 - RNA, 18 nt, Homo sapiens
ccaggcuggcgugcagca

SEQ ID NO: 847255 - RNA, 14 nt, Homo sapiens
ccagggagucagag

SEQ ID NO: 847256 - RNA, 20 nt, Homo sapiens
ccaucguuuucuucacuguc

SEQ ID NO: 847257 - RNA, 22 nt, Homo sapiens
ccaugugcagccaccaguccau

SEQ ID NO: 847258 - RNA, 14 nt, Homo sapiens
cccagccaccgaag

SEQ ID NO: 847259 - RNA, 18 nt, Homo sapiens
cccagcuaccucaaccaa

SEQ ID NO: 847260 - RNA, 16 nt, Homo sapiens
cccauaccccuggcca

SEQ ID NO: 847261 - RNA, 15 nt, Homo sapiens
cccuaaaccaaaaac

SEQ ID NO: 847262 - RNA, 17 nt, Homo sapiens
cccucagagugcaagcc

SEQ ID NO: 847263 - RNA, 18 nt, Homo sapiens
cccuugaggaaacaacag

SEQ ID NO: 847264 - RNA, 20 nt, Homo sapiens
ccgcccuaaaagcacacuca

SEQ ID NO: 847265 - RNA, 17 nt, Homo sapiens
ccuaaaagcacacucau

SEQ ID NO: 847266 - RNA, 15 nt, Homo sapiens
ccuacuaaaugcuca

SEQ ID NO: 847267 - RNA, 18 nt, Homo sapiens
ccuaucaguuauuaauuu

SEQ ID NO: 847268 - RNA, 18 nt, Homo sapiens
ccucacaggccccaggaa

SEQ ID NO: 847269 - RNA, 13 nt, Homo sapiens
ccucagagugcaa

SEQ ID NO: 847270 - RNA, 16 nt, Homo sapiens
ccuccagggagucuca

SEQ ID NO: 847271 - RNA, 20 nt, Homo sapiens
ccugcgccaccgcccagaga

SEQ ID NO: 847272 - RNA, 22 nt, Homo sapiens
ccuuccccucugcagcuuccag

SEQ ID NO: 847273 - RNA, 21 nt, Homo sapiens
ccuucgggcugugcccgggga

SEQ ID NO: 847274 - RNA, 15 nt, Homo sapiens
ccuuugcaccuccau

SEQ ID NO: 847275 - RNA, 13 nt, Homo sapiens
cgaugaaacugga

SEQ ID NO: 847276 - RNA, 23 nt, Homo sapiens
cgcgugaucaaagccacacucug

SEQ ID NO: 847277 - RNA, 18 nt, Homo sapiens
cuaaaagaaaaaggaacu

SEQ ID NO: 847278 - RNA, 14 nt, Homo sapiens
cuagaacagucucu

SEQ ID NO: 847279 - RNA, 14 nt, Homo sapiens
cuaugugagcucac

SEQ ID NO: 847280 - RNA, 20 nt, Homo sapiens
cucaagcuaugugagcucac

SEQ ID NO: 847281 - RNA, 18 nt, Homo sapiens
cucacaggccccaggaaa

SEQ ID NO: 847282 - RNA, 21 nt, Homo sapiens
cucacugaggguaucugacaa

SEQ ID NO: 847283 - RNA, 13 nt, Homo sapiens
cucagagugcaag

SEQ ID NO: 847284 - RNA, 21 nt, Homo sapiens
cucaugagggcuggaugcucu

SEQ ID NO: 847285 - RNA, 21 nt, Homo sapiens
cuccauggaaacgaagcacca

SEQ ID NO: 847286 - RNA, 20 nt, Homo sapiens
cucguugacccucacaggag

SEQ ID NO: 847287 - RNA, 20 nt, Homo sapiens
cucuccccucagagugcaag

SEQ ID NO: 847288 - RNA, 20 nt, Homo sapiens
cucugaaccccucccuccau

SEQ ID NO: 847289 - RNA, 20 nt, Homo sapiens
cucugaaugaaccuucuggc

SEQ ID NO: 847290 - RNA, 16 nt, Homo sapiens
cucugauccgagcuca

SEQ ID NO: 847291 - RNA, 20 nt, Homo sapiens
cucugauccgagcucagggg

SEQ ID NO: 847292 - RNA, 14 nt, Homo sapiens
cucuuagcaaaaac

SEQ ID NO: 847293 - RNA, 13 nt, Homo sapiens
cucuugaggcaca

SEQ ID NO: 847294 - RNA, 19 nt, Homo sapiens
cucuuggcuccacugggau

SEQ ID NO: 847295 - RNA, 12 nt, Homo sapiens
cugaaagugaaa

SEQ ID NO: 847296 - RNA, 16 nt, Homo sapiens
cugagaaaacuaaguc

SEQ ID NO: 847297 - RNA, 16 nt, Homo sapiens
cugcaguauaaauaac

SEQ ID NO: 847298 - RNA, 23 nt, Homo sapiens
cugccucaagcuaugugagcuca

SEQ ID NO: 847299 - RNA, 21 nt, Homo sapiens
cugcuggagugaaggggccaa

SEQ ID NO: 847300 - RNA, 15 nt, Homo sapiens
cuggaaacacauguu

SEQ ID NO: 847301 - RNA, 22 nt, Homo sapiens
cuggagccuacuaaaugcucaa

SEQ ID NO: 847302 - RNA, 20 nt, Homo sapiens
cugugcccggggaaaggcaa

SEQ ID NO: 847303 - RNA, 19 nt, Homo sapiens
cuguuccugcaguagaaug

SEQ ID NO: 847304 - RNA, 19 nt, Homo sapiens
cuucacuguccuccaagcc

SEQ ID NO: 847305 - RNA, 22 nt, Homo sapiens
cuucacuguccuccaagccagc

SEQ ID NO: 847306 - RNA, 17 nt, Homo sapiens
cuuggcuccacugggau

SEQ ID NO: 847307 - RNA, 13 nt, Homo sapiens
cuuggggguggug

SEQ ID NO: 847308 - RNA, 14 nt, Homo sapiens
cuuugcaccuccau

SEQ ID NO: 847309 - RNA, 19 nt, Homo sapiens
gaaaauaaaauuuaacuca

SEQ ID NO: 847310 - RNA, 16 nt, Homo sapiens
gaaacccugucucucc

SEQ ID NO: 847311 - RNA, 17 nt, Homo sapiens
gaaauguaugugcucuu

SEQ ID NO: 847312 - RNA, 12 nt, Homo sapiens
gaagcaccauca

SEQ ID NO: 847313 - RNA, 20 nt, Homo sapiens
gaaguagcugagaaaacuaa

SEQ ID NO: 847314 - RNA, 15 nt, Homo sapiens
gaaucgcuugaacca

SEQ ID NO: 847315 - RNA, 14 nt, Homo sapiens
gaaugaucuuggcu

SEQ ID NO: 847316 - RNA, 20 nt, Homo sapiens
acacuuugccuugcuguuua

SEQ ID NO: 847317 - RNA, 17 nt, Homo sapiens
acagagagagauacucu

SEQ ID NO: 847318 - RNA, 14 nt, Homo sapiens
acagaggcuguggu

SEQ ID NO: 847319 - RNA, 15 nt, Homo sapiens
acagauuuggaaaga

SEQ ID NO: 847320 - RNA, 21 nt, Homo sapiens
acagccuucuucauguacaau

SEQ ID NO: 847321 - RNA, 22 nt, Homo sapiens
acagcuaauuguaccauagugu

SEQ ID NO: 847322 - RNA, 23 nt, Homo sapiens
acaggauugaagcuuuagugaaa

SEQ ID NO: 847323 - RNA, 16 nt, Homo sapiens
acagggccgccggcaa

SEQ ID NO: 847324 - RNA, 23 nt, Homo sapiens
acagggccggucgggggggaccc

SEQ ID NO: 847325 - RNA, 23 nt, Homo sapiens
acagggucucuagugcugugaaa

SEQ ID NO: 847326 - RNA, 12 nt, Homo sapiens
acagucucacca

SEQ ID NO: 847327 - RNA, 22 nt, Homo sapiens
acaguggacaaaguuaccagug

SEQ ID NO: 847328 - RNA, 13 nt, Homo sapiens
acaguuuacuugg

SEQ ID NO: 847329 - RNA, 14 nt, Homo sapiens
acauaaaagaacaa

SEQ ID NO: 847330 - RNA, 20 nt, Homo sapiens
acauaauucuaaggaguuuu

SEQ ID NO: 847331 - RNA, 22 nt, Homo sapiens
acauacguuuguguggugacau

SEQ ID NO: 847332 - RNA, 14 nt, Homo sapiens
acaucaagcucaag

SEQ ID NO: 847333 - RNA, 16 nt, Homo sapiens
acaucacugagacaau

SEQ ID NO: 847334 - RNA, 21 nt, Homo sapiens
acaucacugagacaaucaugu

SEQ ID NO: 847335 - RNA, 22 nt, Homo sapiens
acaucgcauagaaaucaauaau

SEQ ID NO: 847336 - RNA, 18 nt, Homo sapiens
acaugaaaauagcaauau

SEQ ID NO: 847337 - RNA, 21 nt, Homo sapiens
acaugagcuuacauucuuaca

SEQ ID NO: 847338 - RNA, 19 nt, Homo sapiens
acaugccuguuaauauuca

SEQ ID NO: 847339 - RNA, 16 nt, Homo sapiens
acauuccucaaaaugg

SEQ ID NO: 847340 - RNA, 12 nt, Homo sapiens
acauuugaauaa

SEQ ID NO: 847341 - RNA, 21 nt, Homo sapiens
acauuuuagaaugucaauaaa

SEQ ID NO: 847342 - RNA, 14 nt, Homo sapiens
acauuuugaaauaa

SEQ ID NO: 847343 - RNA, 22 nt, Homo sapiens
acauuuugaaauaaaaauggau

SEQ ID NO: 847344 - RNA, 23 nt, Homo sapiens
accaaaaugagaguuuugcuaaa

SEQ ID NO: 847345 - RNA, 22 nt, Homo sapiens
accaaaugaguccaaacuggaa

SEQ ID NO: 847346 - RNA, 16 nt, Homo sapiens
accaaccgaaacugaa

SEQ ID NO: 847347 - RNA, 18 nt, Homo sapiens
accaaggaaaaagcagag

SEQ ID NO: 847348 - RNA, 23 nt, Homo sapiens
accaaguguauuguaauguauac

SEQ ID NO: 847349 - RNA, 22 nt, Homo sapiens
accacauuuauggaccaugaaa

SEQ ID NO: 847350 - RNA, 20 nt, Homo sapiens
accacugcccugacugucac

SEQ ID NO: 847351 - RNA, 23 nt, Homo sapiens
accacuuuucuauauugcagugu

SEQ ID NO: 847352 - RNA, 19 nt, Homo sapiens
accagcccagaagugcaga

SEQ ID NO: 847353 - RNA, 16 nt, Homo sapiens
accagccccaccaugc

SEQ ID NO: 847354 - RNA, 20 nt, Homo sapiens
accagccccaccaugcaacu

SEQ ID NO: 847355 - RNA, 19 nt, Homo sapiens
accaugaaagguugguucu

SEQ ID NO: 847356 - RNA, 15 nt, Homo sapiens
accaugcaacuuccu

SEQ ID NO: 847357 - RNA, 19 nt, Homo sapiens
accauucaccaagagccaa

SEQ ID NO: 847358 - RNA, 23 nt, Homo sapiens
acccagaaaaucugaauuggaau

SEQ ID NO: 847359 - RNA, 15 nt, Homo sapiens
acccagaguagccau

SEQ ID NO: 847360 - RNA, 17 nt, Homo sapiens
acccagaguagccauga

SEQ ID NO: 847361 - RNA, 20 nt, Homo sapiens
acccaugggcaggagacugu

SEQ ID NO: 847362 - RNA, 12 nt, Homo sapiens
acccgcagccuc

SEQ ID NO: 847363 - RNA, 19 nt, Homo sapiens
acccuaaaguauaacaugu

SEQ ID NO: 847364 - RNA, 15 nt, Homo sapiens
acccuccaaggccag

SEQ ID NO: 847365 - RNA, 19 nt, Homo sapiens
acccuccccaggucuucca

SEQ ID NO: 847366 - RNA, 19 nt, Homo sapiens
acccucucaaguccaucaa

SEQ ID NO: 847367 - RNA, 19 nt, Homo sapiens
acccugaagaggcauuuca

SEQ ID NO: 847368 - RNA, 15 nt, Homo sapiens
acccuggugcugcca

SEQ ID NO: 847369 - RNA, 19 nt, Homo sapiens
acccuugauggauuuucaa

SEQ ID NO: 847370 - RNA, 14 nt, Homo sapiens
acccuuucugccag

SEQ ID NO: 847371 - RNA, 20 nt, Homo sapiens
acccuuucugccagggaugg

SEQ ID NO: 847372 - RNA, 14 nt, Homo sapiens
acccuuucuggcac

SEQ ID NO: 847373 - RNA, 19 nt, Homo sapiens
accgugaagauacuuugua

SEQ ID NO: 847374 - RNA, 13 nt, Homo sapiens
accuaauugcaca

SEQ ID NO: 847375 - RNA, 20 nt, Homo sapiens
accuaauugcacaacagaga

SEQ ID NO: 847376 - RNA, 20 nt, Homo sapiens
accucacgugcaaagccacc

SEQ ID NO: 847377 - RNA, 20 nt, Homo sapiens
accucauguccuucuugucc

SEQ ID NO: 847378 - RNA, 14 nt, Homo sapiens
accucuuccuggcc

SEQ ID NO: 847379 - RNA, 15 nt, Homo sapiens
accugaccugauguc

SEQ ID NO: 847380 - RNA, 21 nt, Homo sapiens
accugcccccagcuucugcca

SEQ ID NO: 847381 - RNA, 18 nt, Homo sapiens
accuucccuccucaugcc

SEQ ID NO: 847382 - RNA, 14 nt, Homo sapiens
accuuccugggaaa

SEQ ID NO: 847383 - RNA, 19 nt, Homo sapiens
accuucuauagcaucacuu

SEQ ID NO: 847384 - RNA, 18 nt, Homo sapiens
accuugucauuuuggucu

SEQ ID NO: 847385 - RNA, 23 nt, Homo sapiens
accuuuaccccaccuuccuggga

SEQ ID NO: 847386 - RNA, 20 nt, Homo sapiens
accuuuugagcuucauuuca

SEQ ID NO: 847387 - RNA, 18 nt, Homo sapiens
acgcuuuaugcccuugcc

SEQ ID NO: 847388 - RNA, 23 nt, Homo sapiens
acggccuucgucugguuccucaa

SEQ ID NO: 847389 - RNA, 19 nt, Homo sapiens
acgguucaaaccugugaag

SEQ ID NO: 847390 - RNA, 23 nt, Homo sapiens
acguggugaccucacacaccucu

SEQ ID NO: 847391 - RNA, 13 nt, Homo sapiens
acguuuacauucu

SEQ ID NO: 847392 - RNA, 17 nt, Homo sapiens
acuaacaaacagauucu

SEQ ID NO: 847393 - RNA, 21 nt, Homo sapiens
acuacaguaagcugguuuaca

SEQ ID NO: 847394 - RNA, 15 nt, Homo sapiens
acuagacugccacaa

SEQ ID NO: 847395 - RNA, 19 nt, Homo sapiens
acuagaugacucucaaagg

SEQ ID NO: 847396 - RNA, 22 nt, Homo sapiens
acuagcacugacugaacuguaa

SEQ ID NO: 847397 - RNA, 16 nt, Homo sapiens
acuauuuaaagaaaua

SEQ ID NO: 847398 - RNA, 18 nt, Homo sapiens
acucaagugucuaccugg

SEQ ID NO: 847399 - RNA, 21 nt, Homo sapiens
acucacugacucuucuaugca

SEQ ID NO: 847400 - RNA, 20 nt, Homo sapiens
acucacuguguggccucaga

SEQ ID NO: 847401 - RNA, 17 nt, Homo sapiens
acucauccguuugccaa

SEQ ID NO: 847402 - RNA, 17 nt, Homo sapiens
acuccaguccaagucuc

SEQ ID NO: 847403 - RNA, 17 nt, Homo sapiens
acuccccauuggugcua

SEQ ID NO: 847404 - RNA, 20 nt, Homo sapiens
acuccccauuggugcuaccu

SEQ ID NO: 847405 - RNA, 12 nt, Homo sapiens
acuccugccuau

SEQ ID NO: 847406 - RNA, 20 nt, Homo sapiens
acuccuuaaaauaaaacacu

SEQ ID NO: 847407 - RNA, 16 nt, Homo sapiens
acucucaggcauggau

SEQ ID NO: 847408 - RNA, 17 nt, Homo sapiens
acucucaggcauggaug

SEQ ID NO: 847409 - RNA, 13 nt, Homo sapiens
acucugagcucau

SEQ ID NO: 847410 - RNA, 17 nt, Homo sapiens
acucuucucauuacuug

SEQ ID NO: 847411 - RNA, 17 nt, Homo sapiens
acucuuuaaacaguuuu

SEQ ID NO: 847412 - RNA, 19 nt, Homo sapiens
acugaaaaugaacuguaaa

SEQ ID NO: 847413 - RNA, 22 nt, Homo sapiens
acugaauucaaauauucuuuca

SEQ ID NO: 847414 - RNA, 20 nt, Homo sapiens
acugacuauaccaacugggc

SEQ ID NO: 847415 - RNA, 14 nt, Homo sapiens
acugagguuuacau

SEQ ID NO: 847416 - RNA, 20 nt, Homo sapiens
acugaguauguucauugcca

SEQ ID NO: 847417 - RNA, 17 nt, Homo sapiens
acugauuacguuuacau

SEQ ID NO: 847418 - RNA, 16 nt, Homo sapiens
acugcagucacugcac

SEQ ID NO: 847419 - RNA, 20 nt, Homo sapiens
acugcgccugggaucucgcc

SEQ ID NO: 847420 - RNA, 13 nt, Homo sapiens
acugcucauuuca

SEQ ID NO: 847421 - RNA, 13 nt, Homo sapiens
acugcuugaauaa

SEQ ID NO: 847422 - RNA, 21 nt, Homo sapiens
acuggagucucucucucucca

SEQ ID NO: 847423 - RNA, 13 nt, Homo sapiens
acuggagugaaug

SEQ ID NO: 847424 - RNA, 14 nt, Homo sapiens
acugggggaaucaa

SEQ ID NO: 847425 - RNA, 21 nt, Homo sapiens
acuguccacuuggagcuaaaa

SEQ ID NO: 847426 - RNA, 13 nt, Homo sapiens
acuguguaccuca

SEQ ID NO: 847427 - RNA, 20 nt, Homo sapiens
acuguucaguauugcaauaa

SEQ ID NO: 847428 - RNA, 13 nt, Homo sapiens
acuguuuucccaa

SEQ ID NO: 847429 - RNA, 20 nt, Homo sapiens
acuucaucucaauagugauu

SEQ ID NO: 847430 - RNA, 12 nt, Homo sapiens
acuuccuuugac

SEQ ID NO: 847431 - RNA, 14 nt, Homo sapiens
acuucgaaguucua

SEQ ID NO: 847432 - RNA, 20 nt, Homo sapiens
acuuggacuagaugacucuc

SEQ ID NO: 847433 - RNA, 15 nt, Homo sapiens
acuuguuucccuuuc

SEQ ID NO: 847434 - RNA, 15 nt, Homo sapiens
acuuucaaaguggau

SEQ ID NO: 847435 - RNA, 15 nt, Homo sapiens
ucucuuaaucacaag

SEQ ID NO: 847436 - RNA, 14 nt, Homo sapiens
ucucuucucugcca

SEQ ID NO: 847437 - RNA, 11 nt, Homo sapiens
ucucuugcccc

SEQ ID NO: 847438 - RNA, 21 nt, Homo sapiens
ucucuuuucccuccuuuccuu

SEQ ID NO: 847439 - RNA, 22 nt, Homo sapiens
ucugaaaacaagagacugcuug

SEQ ID NO: 847440 - RNA, 20 nt, Homo sapiens
ucugacuuuagccuaccuaa

SEQ ID NO: 847441 - RNA, 23 nt, Homo sapiens
ucugaguuccggcaccaguagca

SEQ ID NO: 847442 - RNA, 19 nt, Homo sapiens
ucugauacuuagaccaaaa

SEQ ID NO: 847443 - RNA, 16 nt, Homo sapiens
ucugauaguagucuuu

SEQ ID NO: 847444 - RNA, 18 nt, Homo sapiens
ucugccugcugaccauaa

SEQ ID NO: 847445 - RNA, 20 nt, Homo sapiens
ucugcuccccuaaagccuca

SEQ ID NO: 847446 - RNA, 20 nt, Homo sapiens
ucugcucuaauugcugccag

SEQ ID NO: 847447 - RNA, 14 nt, Homo sapiens
ucugcuuccaacau

SEQ ID NO: 847448 - RNA, 22 nt, Homo sapiens
ucuggauuuuauucaucauaua

SEQ ID NO: 847449 - RNA, 15 nt, Homo sapiens
ucuggggagugaugg

SEQ ID NO: 847450 - RNA, 19 nt, Homo sapiens
ucuggggcuggcaccagca

SEQ ID NO: 847451 - RNA, 21 nt, Homo sapiens
ucuggucuucgcagccuagau

SEQ ID NO: 847452 - RNA, 13 nt, Homo sapiens
ucuguagccugaa

SEQ ID NO: 847453 - RNA, 20 nt, Homo sapiens
ucugugguuuauaaucuugc

SEQ ID NO: 847454 - RNA, 11 nt, Homo sapiens
ucuuacuuugu

SEQ ID NO: 847455 - RNA, 21 nt, Homo sapiens
ucuuacuuuguaaauucugau

SEQ ID NO: 847456 - RNA, 20 nt, Homo sapiens
ucuuagaaacucaggaaaga

SEQ ID NO: 847457 - RNA, 15 nt, Homo sapiens
ucuuagagggugaug

SEQ ID NO: 847458 - RNA, 14 nt, Homo sapiens
ucuuauauuuacaa

SEQ ID NO: 847459 - RNA, 14 nt, Homo sapiens
ucuucauccaggga

SEQ ID NO: 847460 - RNA, 15 nt, Homo sapiens
ucuugacagcuauaa

SEQ ID NO: 847461 - RNA, 20 nt, Homo sapiens
ucuugcacgaggcaccagag

SEQ ID NO: 847462 - RNA, 11 nt, Homo sapiens
ucuugccaaaa

SEQ ID NO: 847463 - RNA, 19 nt, Homo sapiens
ucuugcgggucugucaggg

SEQ ID NO: 847464 - RNA, 20 nt, Homo sapiens
ucuugcuggauuugugcuuu

SEQ ID NO: 847465 - RNA, 15 nt, Homo sapiens
ucuuggaaccacgaa

SEQ ID NO: 847466 - RNA, 18 nt, Homo sapiens
ucuugggacauccuguca

SEQ ID NO: 847467 - RNA, 16 nt, Homo sapiens
ucuugggggugguuuu

SEQ ID NO: 847468 - RNA, 20 nt, Homo sapiens
ucuuguccaaguuguuucau

SEQ ID NO: 847469 - RNA, 13 nt, Homo sapiens
ucuugugucuacu

SEQ ID NO: 847470 - RNA, 18 nt, Homo sapiens
ucuuucuaagagaccuga

SEQ ID NO: 847471 - RNA, 22 nt, Homo sapiens
ucuuucuuaaccacuuucagcc

SEQ ID NO: 847472 - RNA, 15 nt, Homo sapiens
ugaaaaaugaucucu

SEQ ID NO: 847473 - RNA, 19 nt, Homo sapiens
ugaaaagauuauuggaaag

SEQ ID NO: 847474 - RNA, 14 nt, Homo sapiens
ugaaaauauagcua

SEQ ID NO: 847475 - RNA, 16 nt, Homo sapiens
ugaaacagacuuguau

SEQ ID NO: 847476 - RNA, 18 nt, Homo sapiens
ugaaagaaaaaguacaag

SEQ ID NO: 847477 - RNA, 21 nt, Homo sapiens
ugaaagaaauuaaguacuuaa

SEQ ID NO: 847478 - RNA, 19 nt, Homo sapiens
ugaaaguaaaagcagcaua

SEQ ID NO: 847479 - RNA, 20 nt, Homo sapiens
ugaaauaaagauaaaugcaa

SEQ ID NO: 847480 - RNA, 22 nt, Homo sapiens
ugaaauaaagauaaaugcaacc

SEQ ID NO: 847481 - RNA, 14 nt, Homo sapiens
ugaaauaacacagc

SEQ ID NO: 847482 - RNA, 15 nt, Homo sapiens
ugaaauaacacagca

SEQ ID NO: 847483 - RNA, 23 nt, Homo sapiens
ugaacauacaaaugcaucuuuga

SEQ ID NO: 847484 - RNA, 15 nt, Homo sapiens
ugaaccccaccuccc

SEQ ID NO: 847485 - RNA, 18 nt, Homo sapiens
ugaaccugaauauugcca

SEQ ID NO: 847486 - RNA, 18 nt, Homo sapiens
ugaacuggccucugccuu

SEQ ID NO: 847487 - RNA, 20 nt, Homo sapiens
ugaacugggcagacugcaaa

SEQ ID NO: 847488 - RNA, 17 nt, Homo sapiens
ugaagaaucugcucuga

SEQ ID NO: 847489 - RNA, 18 nt, Homo sapiens
ugaagcuuguaucugaua

SEQ ID NO: 847490 - RNA, 20 nt, Homo sapiens
ugaagggguuuucuugauaa

SEQ ID NO: 847491 - RNA, 13 nt, Homo sapiens
ugaagguuuuuga

SEQ ID NO: 847492 - RNA, 14 nt, Homo sapiens
ugaagugcaugggu

SEQ ID NO: 847493 - RNA, 16 nt, Homo sapiens
ugaagugcauggguca

SEQ ID NO: 847494 - RNA, 20 nt, Homo sapiens
ugaagugcaugggucagggu

SEQ ID NO: 847495 - RNA, 22 nt, Homo sapiens
ugaauaaauguuauagcugcau

SEQ ID NO: 847496 - RNA, 16 nt, Homo sapiens
ugaauaguaagcauaa

SEQ ID NO: 847497 - RNA, 19 nt, Homo sapiens
ugaauauacagaaguucca

SEQ ID NO: 847498 - RNA, 15 nt, Homo sapiens
ugaaucugacuuuag

SEQ ID NO: 847499 - RNA, 16 nt, Homo sapiens
ugaauuuggucucucc

SEQ ID NO: 847500 - RNA, 16 nt, Homo sapiens
ugacagcgcacagcug

SEQ ID NO: 847501 - RNA, 15 nt, Homo sapiens
ugacaucacuggcau

SEQ ID NO: 847502 - RNA, 13 nt, Homo sapiens
ugaccaguuuuga

SEQ ID NO: 847503 - RNA, 17 nt, Homo sapiens
ugaccaguuuugauauu

SEQ ID NO: 847504 - RNA, 15 nt, Homo sapiens
ugaccccugccugug

SEQ ID NO: 847505 - RNA, 15 nt, Homo sapiens
ugaccucacgugcaa

SEQ ID NO: 847506 - RNA, 13 nt, Homo sapiens
ugacuacagggcc

SEQ ID NO: 847507 - RNA, 14 nt, Homo sapiens
ugacugaacuguaa

SEQ ID NO: 847508 - RNA, 22 nt, Homo sapiens
ugacugggacccugaagaggca

SEQ ID NO: 847509 - RNA, 17 nt, Homo sapiens
ugacuucauacuuugaa

SEQ ID NO: 847510 - RNA, 15 nt, Homo sapiens
ugagacugaguucua

SEQ ID NO: 847511 - RNA, 19 nt, Homo sapiens
ugagacugggcaucucuga

SEQ ID NO: 847512 - RNA, 20 nt, Homo sapiens
ugagacugggcaucucugag

SEQ ID NO: 847513 - RNA, 14 nt, Homo sapiens
ugagagccugugau

SEQ ID NO: 847514 - RNA, 23 nt, Homo sapiens
ugagaggcugucuguuguauuca

SEQ ID NO: 847515 - RNA, 20 nt, Homo sapiens
ugagauaaguuuuguuucaa

SEQ ID NO: 847516 - RNA, 15 nt, Homo sapiens
ugagauggagucucg

SEQ ID NO: 847517 - RNA, 15 nt, Homo sapiens
ugagaugguggcauu

SEQ ID NO: 847518 - RNA, 21 nt, Homo sapiens
ugagcacagggggccuccagg

SEQ ID NO: 847519 - RNA, 20 nt, Homo sapiens
ugagcagcuuuagcaaagaa

SEQ ID NO: 847520 - RNA, 15 nt, Homo sapiens
ugagcuaugacuuaa

SEQ ID NO: 847521 - RNA, 19 nt, Homo sapiens
ugagcuuuggugcaucuca

SEQ ID NO: 847522 - RNA, 20 nt, Homo sapiens
ugaggcaucucucugggaug

SEQ ID NO: 847523 - RNA, 21 nt, Homo sapiens
ugaguaacgacauggaacuga

SEQ ID NO: 847524 - RNA, 17 nt, Homo sapiens
ugauaacaaguuuaaua

SEQ ID NO: 847525 - RNA, 19 nt, Homo sapiens
ugauaauaaucaugaucac

SEQ ID NO: 847526 - RNA, 20 nt, Homo sapiens
ugauagagugcagugauguu

SEQ ID NO: 847527 - RNA, 15 nt, Homo sapiens
ugauauaaacagcuu

SEQ ID NO: 847528 - RNA, 15 nt, Homo sapiens
ugauaucagcacugg

SEQ ID NO: 847529 - RNA, 20 nt, Homo sapiens
ugauauugaaagguagcaau

SEQ ID NO: 847530 - RNA, 22 nt, Homo sapiens
ugaucaucgaggagcuagaaca

SEQ ID NO: 847531 - RNA, 13 nt, Homo sapiens
ugaugaagcugag

SEQ ID NO: 847532 - RNA, 13 nt, Homo sapiens
ugauguacuguaa

SEQ ID NO: 847533 - RNA, 13 nt, Homo sapiens
ugauguauguuau

SEQ ID NO: 847534 - RNA, 19 nt, Homo sapiens
ugauguuugccauuugcug

SEQ ID NO: 847535 - RNA, 18 nt, Homo sapiens
ugauucuaaaaugucuca

SEQ ID NO: 847536 - RNA, 21 nt, Homo sapiens
ugauuuaugguaguaauauua

SEQ ID NO: 847537 - RNA, 17 nt, Homo sapiens
ugauuucuuuguagcau

SEQ ID NO: 847538 - RNA, 19 nt, Homo sapiens
ugauuuugaccuuguauug

SEQ ID NO: 847539 - RNA, 16 nt, Homo sapiens
ugcaaaccuauuuccc

SEQ ID NO: 847540 - RNA, 20 nt, Homo sapiens
ugcaaaggaaauaccaguuc

SEQ ID NO: 847541 - RNA, 15 nt, Homo sapiens
ugcaacuuccuuuga

SEQ ID NO: 847542 - RNA, 16 nt, Homo sapiens
ugcaacuuccuuugac

SEQ ID NO: 847543 - RNA, 23 nt, Homo sapiens
ugcaauaugugaacgcccagaga

SEQ ID NO: 847544 - RNA, 19 nt, Homo sapiens
ugcaaucgcuuuccuaaaa

SEQ ID NO: 847545 - RNA, 11 nt, Homo sapiens
ugcacaacaga

SEQ ID NO: 847546 - RNA, 18 nt, Homo sapiens
ucaaggcagaggcaggaa

SEQ ID NO: 847547 - RNA, 19 nt, Homo sapiens
ucaaguaccucaucugcac

SEQ ID NO: 847548 - RNA, 17 nt, Homo sapiens
ucaagucuacccugauc

SEQ ID NO: 847549 - RNA, 23 nt, Homo sapiens
ucaauaaauggcccggacauguc

SEQ ID NO: 847550 - RNA, 17 nt, Homo sapiens
ucaaugaacaagcauuc

SEQ ID NO: 847551 - RNA, 19 nt, Homo sapiens
ucaaugcuuuccacauuuc

SEQ ID NO: 847552 - RNA, 20 nt, Homo sapiens
ucaaugugauauaaacagcu

SEQ ID NO: 847553 - RNA, 21 nt, Homo sapiens
ucacaggaaggacuucuucca

SEQ ID NO: 847554 - RNA, 23 nt, Homo sapiens
ucacaggaaggacuucuuccagg

SEQ ID NO: 847555 - RNA, 13 nt, Homo sapiens
ucacagucaccaa

SEQ ID NO: 847556 - RNA, 16 nt, Homo sapiens
ucacauuuauuuggua

SEQ ID NO: 847557 - RNA, 14 nt, Homo sapiens
ucaccacagacuuu

SEQ ID NO: 847558 - RNA, 16 nt, Homo sapiens
ucaccaugaacaaaga

SEQ ID NO: 847559 - RNA, 20 nt, Homo sapiens
ucaccaugaacaaagauaua

SEQ ID NO: 847560 - RNA, 19 nt, Homo sapiens
ucaccuuugucagaccaua

SEQ ID NO: 847561 - RNA, 21 nt, Homo sapiens
ucacuaaauaaaggaagugcc

SEQ ID NO: 847562 - RNA, 15 nt, Homo sapiens
ucacuaccugucagc

SEQ ID NO: 847563 - RNA, 17 nt, Homo sapiens
ucacuccaaaccuuacu

SEQ ID NO: 847564 - RNA, 17 nt, Homo sapiens
ucacucuguugccauua

SEQ ID NO: 847565 - RNA, 18 nt, Homo sapiens
ucacucuguugccauuaa

SEQ ID NO: 847566 - RNA, 16 nt, Homo sapiens
ucacuggcaugguggu

SEQ ID NO: 847567 - RNA, 21 nt, Homo sapiens
ucacuggccacaguuguuuga

SEQ ID NO: 847568 - RNA, 22 nt, Homo sapiens
ucacugggggacacuguggcag

SEQ ID NO: 847569 - RNA, 19 nt, Homo sapiens
ucagaaaagacgcaccagc

SEQ ID NO: 847570 - RNA, 14 nt, Homo sapiens
ucagaaacuguuuc

SEQ ID NO: 847571 - RNA, 13 nt, Homo sapiens
ucagaaaugacuu

SEQ ID NO: 847572 - RNA, 22 nt, Homo sapiens
ucagaagaaagaaucuuuccau

SEQ ID NO: 847573 - RNA, 17 nt, Homo sapiens
ucagaauccacucuucu

SEQ ID NO: 847574 - RNA, 21 nt, Homo sapiens
ucagagaucuugcauuucugc

SEQ ID NO: 847575 - RNA, 19 nt, Homo sapiens
ucagagggccucaucucag

SEQ ID NO: 847576 - RNA, 19 nt, Homo sapiens
ucagauaauuaugcuuuua

SEQ ID NO: 847577 - RNA, 14 nt, Homo sapiens
ucagauacaaaacu

SEQ ID NO: 847578 - RNA, 15 nt, Homo sapiens
ucagcagacaaguga

SEQ ID NO: 847579 - RNA, 16 nt, Homo sapiens
ucagcaggacgacugu

SEQ ID NO: 847580 - RNA, 23 nt, Homo sapiens
ucagccuugagagaggccacacu

SEQ ID NO: 847581 - RNA, 13 nt, Homo sapiens
ucaguauugcaau

SEQ ID NO: 847582 - RNA, 13 nt, Homo sapiens
ucaguuaucuuga

SEQ ID NO: 847583 - RNA, 19 nt, Homo sapiens
ucaguuucccuaucugcaa

SEQ ID NO: 847584 - RNA, 14 nt, Homo sapiens
ucauaauacugaaa

SEQ ID NO: 847585 - RNA, 20 nt, Homo sapiens
ucauagcaccuaacaacauu

SEQ ID NO: 847586 - RNA, 17 nt, Homo sapiens
ucauauauuagcaccug

SEQ ID NO: 847587 - RNA, 19 nt, Homo sapiens
ucauauuauaaauuucuaa

SEQ ID NO: 847588 - RNA, 17 nt, Homo sapiens
ucaucaguccuaccuga

SEQ ID NO: 847589 - RNA, 19 nt, Homo sapiens
ucaucccacccucucacag

SEQ ID NO: 847590 - RNA, 22 nt, Homo sapiens
ucaugaaaaaugaucucugcuu

SEQ ID NO: 847591 - RNA, 20 nt, Homo sapiens
ucaugaauaaaaacuuugca

SEQ ID NO: 847592 - RNA, 20 nt, Homo sapiens
ucaugauuucuuuguagcau

SEQ ID NO: 847593 - RNA, 20 nt, Homo sapiens
ucauggaugcuuuggcaaug

SEQ ID NO: 847594 - RNA, 18 nt, Homo sapiens
ucauggcccaucaggggc

SEQ ID NO: 847595 - RNA, 18 nt, Homo sapiens
ucauguuggggcucuucc

SEQ ID NO: 847596 - RNA, 15 nt, Homo sapiens
ucauuaaaauuguga

SEQ ID NO: 847597 - RNA, 18 nt, Homo sapiens
ucauucgcuacuaugauu

SEQ ID NO: 847598 - RNA, 15 nt, Homo sapiens
ucauuuguaaucuag

SEQ ID NO: 847599 - RNA, 17 nt, Homo sapiens
ucauuuucacagcacua

SEQ ID NO: 847600 - RNA, 15 nt, Homo sapiens
ucauuuucuuuccuu

SEQ ID NO: 847601 - RNA, 23 nt, Homo sapiens
uccaagagggugaaguccacaga

SEQ ID NO: 847602 - RNA, 18 nt, Homo sapiens
uccacagaagugagcucc

SEQ ID NO: 847603 - RNA, 13 nt, Homo sapiens
uccagacucucau

SEQ ID NO: 847604 - RNA, 18 nt, Homo sapiens
uccagcaauacaguuuac

SEQ ID NO: 847605 - RNA, 17 nt, Homo sapiens
uccagcacaaaguuuac

SEQ ID NO: 847606 - RNA, 17 nt, Homo sapiens
uccagcacagauuugcu

SEQ ID NO: 847607 - RNA, 15 nt, Homo sapiens
uccagggaacugagc

SEQ ID NO: 847608 - RNA, 23 nt, Homo sapiens
uccagugaaaauaagccaugaga

SEQ ID NO: 847609 - RNA, 12 nt, Homo sapiens
uccauacuuuga

SEQ ID NO: 847610 - RNA, 14 nt, Homo sapiens
uccaucugauucca

SEQ ID NO: 847611 - RNA, 15 nt, Homo sapiens
uccaucugauuccag

SEQ ID NO: 847612 - RNA, 23 nt, Homo sapiens
ucccaagagggcuccucacuauc

SEQ ID NO: 847613 - RNA, 16 nt, Homo sapiens
ucccaauuacauucac

SEQ ID NO: 847614 - RNA, 19 nt, Homo sapiens
ucccaggacccugugccca

SEQ ID NO: 847615 - RNA, 17 nt, Homo sapiens
uccccaagaacacaaga

SEQ ID NO: 847616 - RNA, 18 nt, Homo sapiens
uccccaagaacacaagaa

SEQ ID NO: 847617 - RNA, 20 nt, Homo sapiens
uccccuccauaauguaagaa

SEQ ID NO: 847618 - RNA, 19 nt, Homo sapiens
uccccugcuggccggacac

SEQ ID NO: 847619 - RNA, 22 nt, Homo sapiens
uccccuuaaaucaggaaauaca

SEQ ID NO: 847620 - RNA, 22 nt, Homo sapiens
ucccucacggggagagagacca

SEQ ID NO: 847621 - RNA, 17 nt, Homo sapiens
ucccuccccugcucaga

SEQ ID NO: 847622 - RNA, 17 nt, Homo sapiens
ucccucugccccagcca

SEQ ID NO: 847623 - RNA, 17 nt, Homo sapiens
ucccugacgucugccac

SEQ ID NO: 847624 - RNA, 20 nt, Homo sapiens
ucccugcuguaucuuccaga

SEQ ID NO: 847625 - RNA, 13 nt, Homo sapiens
ucccuucuuuuuc

SEQ ID NO: 847626 - RNA, 23 nt, Homo sapiens
ucccuuuauauuucccugaaaua

SEQ ID NO: 847627 - RNA, 21 nt, Homo sapiens
ucccuuucagcugcugcuuaa

SEQ ID NO: 847628 - RNA, 13 nt, Homo sapiens
uccuaucaaaaag

SEQ ID NO: 847629 - RNA, 15 nt, Homo sapiens
uccucaaaaugggag

SEQ ID NO: 847630 - RNA, 16 nt, Homo sapiens
uccucaaaaugggaga

SEQ ID NO: 847631 - RNA, 16 nt, Homo sapiens
uccucagugacugugu

SEQ ID NO: 847632 - RNA, 22 nt, Homo sapiens
uccuccagaaagcaccaaggaa

SEQ ID NO: 847633 - RNA, 13 nt, Homo sapiens
uccucgcauuaaa

SEQ ID NO: 847634 - RNA, 14 nt, Homo sapiens
uccucugcugcauc

SEQ ID NO: 847635 - RNA, 14 nt, Homo sapiens
uccugggaggacuc

SEQ ID NO: 847636 - RNA, 14 nt, Homo sapiens
uccuggggcaucca

SEQ ID NO: 847637 - RNA, 18 nt, Homo sapiens
uccuguaagaccuucggg

SEQ ID NO: 847638 - RNA, 22 nt, Homo sapiens
uccuucuggggcuuugccauua

SEQ ID NO: 847639 - RNA, 13 nt, Homo sapiens
uccuugacucuua

SEQ ID NO: 847640 - RNA, 21 nt, Homo sapiens
uccuuggaaaucaaauguaaa

SEQ ID NO: 847641 - RNA, 12 nt, Homo sapiens
uccuuguguuua

SEQ ID NO: 847642 - RNA, 20 nt, Homo sapiens
uccuuuaccgaggacagccu

SEQ ID NO: 847643 - RNA, 18 nt, Homo sapiens
uccuuucauuuucuuucc

SEQ ID NO: 847644 - RNA, 23 nt, Homo sapiens
uccuuuccucuggcccagugaau

SEQ ID NO: 847645 - RNA, 19 nt, Homo sapiens
uccuuugacuuucugugua

SEQ ID NO: 847646 - RNA, 14 nt, Homo sapiens
uccuuugauuccaa

SEQ ID NO: 847647 - RNA, 21 nt, Homo sapiens
ucgaagauguauuucaucuca

SEQ ID NO: 847648 - RNA, 22 nt, Homo sapiens
ucgcugacaucuggggcuuuga

SEQ ID NO: 847649 - RNA, 16 nt, Homo sapiens
ucgggggugggcuccg

SEQ ID NO: 847650 - RNA, 19 nt, Homo sapiens
ucguccuguguugccccaa

SEQ ID NO: 847651 - RNA, 22 nt, Homo sapiens
ucguucucugccacagggacuu

SEQ ID NO: 847652 - RNA, 13 nt, Homo sapiens
ucuaaacuuuauu

SEQ ID NO: 847653 - RNA, 15 nt, Homo sapiens
ucuaaacuuuauucc

SEQ ID NO: 847654 - RNA, 14 nt, Homo sapiens
ucuacuuguucuaa

SEQ ID NO: 847655 - RNA, 21 nt, Homo sapiens
ucuagaggcuggcaagaacca

SEQ ID NO: 847656 - RNA, 15 nt, Homo sapiens
ucuagccagugaaca

SEQ ID NO: 847657 - RNA, 15 nt, Homo sapiens
ucuaguacugugaau

SEQ ID NO: 847658 - RNA, 19 nt, Homo sapiens
ucuagucuggaacugcugc

SEQ ID NO: 847659 - RNA, 17 nt, Homo sapiens
uaaacugucgugucaua

SEQ ID NO: 847660 - RNA, 15 nt, Homo sapiens
uaaacuuuagugcua

SEQ ID NO: 847661 - RNA, 15 nt, Homo sapiens
uaaacuuuauuccaa

SEQ ID NO: 847662 - RNA, 19 nt, Homo sapiens
uaaacuuuauuccaaguca

SEQ ID NO: 847663 - RNA, 21 nt, Homo sapiens
uaaagacaaagacauuucaaa

SEQ ID NO: 847664 - RNA, 18 nt, Homo sapiens
uaaagauauggcugcuuc

SEQ ID NO: 847665 - RNA, 10 nt, Homo sapiens
uaaagcacau

SEQ ID NO: 847666 - RNA, 13 nt, Homo sapiens
uaaaggaaucuag

SEQ ID NO: 847667 - RNA, 15 nt, Homo sapiens
uaaaguauacucuua

SEQ ID NO: 847668 - RNA, 13 nt, Homo sapiens
uaaauaguuugac

SEQ ID NO: 847669 - RNA, 20 nt, Homo sapiens
uaaauauauuuuagugacag

SEQ ID NO: 847670 - RNA, 18 nt, Homo sapiens
uaacaaauugaguuuaga

SEQ ID NO: 847671 - RNA, 22 nt, Homo sapiens
uaacagugccagcuucuuugca

SEQ ID NO: 847672 - RNA, 16 nt, Homo sapiens
uaacaguggacaaagu

SEQ ID NO: 847673 - RNA, 20 nt, Homo sapiens
uaaccaugucuguuggucaa

SEQ ID NO: 847674 - RNA, 17 nt, Homo sapiens
uaacguuuucuacuuug

SEQ ID NO: 847675 - RNA, 22 nt, Homo sapiens
uaacucauccguuugccaauca

SEQ ID NO: 847676 - RNA, 14 nt, Homo sapiens
uaagaacugcuuuc

SEQ ID NO: 847677 - RNA, 14 nt, Homo sapiens
uaagcaagagccaa

SEQ ID NO: 847678 - RNA, 13 nt, Homo sapiens
uaagcuuuguaau

SEQ ID NO: 847679 - RNA, 14 nt, Homo sapiens
uaaggaacauuuau

SEQ ID NO: 847680 - RNA, 19 nt, Homo sapiens
uaaggagggucacuggggc

SEQ ID NO: 847681 - RNA, 18 nt, Homo sapiens
uaaggcaaugguuucaca

SEQ ID NO: 847682 - RNA, 19 nt, Homo sapiens
uaaggcaaugguuucacau

SEQ ID NO: 847683 - RNA, 13 nt, Homo sapiens
uaagucucaaggu

SEQ ID NO: 847684 - RNA, 15 nt, Homo sapiens
uaagucucaagguag

SEQ ID NO: 847685 - RNA, 16 nt, Homo sapiens
uaaguggacucucuga

SEQ ID NO: 847686 - RNA, 16 nt, Homo sapiens
uaaguuuuguuucaau

SEQ ID NO: 847687 - RNA, 15 nt, Homo sapiens
uaaucacuguguaua

SEQ ID NO: 847688 - RNA, 21 nt, Homo sapiens
uaaugaguuucacagugugau

SEQ ID NO: 847689 - RNA, 18 nt, Homo sapiens
uaaugcuaaucuugugaa

SEQ ID NO: 847690 - RNA, 20 nt, Homo sapiens
uaauggauguaauacauuuc

SEQ ID NO: 847691 - RNA, 20 nt, Homo sapiens
uaauguaagaagcuuuggug

SEQ ID NO: 847692 - RNA, 21 nt, Homo sapiens
uaauucacccaccagacuuuu

SEQ ID NO: 847693 - RNA, 15 nt, Homo sapiens
uaauuuguaagaaua

SEQ ID NO: 847694 - RNA, 23 nt, Homo sapiens
uaauuuucaggaagaaagggaaa

SEQ ID NO: 847695 - RNA, 21 nt, Homo sapiens
uacaacaaggcuagaguuugu

SEQ ID NO: 847696 - RNA, 21 nt, Homo sapiens
uacacgguucaaaccugugaa

SEQ ID NO: 847697 - RNA, 16 nt, Homo sapiens
uacacugccugccuua

SEQ ID NO: 847698 - RNA, 22 nt, Homo sapiens
uacagcugggagccuuugccau

SEQ ID NO: 847699 - RNA, 15 nt, Homo sapiens
uacaguguacuuugu

SEQ ID NO: 847700 - RNA, 15 nt, Homo sapiens
uacauaaaaguuucu

SEQ ID NO: 847701 - RNA, 18 nt, Homo sapiens
uacauaucaaaacauccc

SEQ ID NO: 847702 - RNA, 19 nt, Homo sapiens
uacauguccuccuaagggg

SEQ ID NO: 847703 - RNA, 21 nt, Homo sapiens
uacauuugaaaauauuugcac

SEQ ID NO: 847704 - RNA, 20 nt, Homo sapiens
uaccaaguuauaauagcauu

SEQ ID NO: 847705 - RNA, 15 nt, Homo sapiens
uacccaucaaauuga

SEQ ID NO: 847706 - RNA, 15 nt, Homo sapiens
uacccugaucaccuc

SEQ ID NO: 847707 - RNA, 20 nt, Homo sapiens
uacccuguacauaucuuuga

SEQ ID NO: 847708 - RNA, 16 nt, Homo sapiens
uaccugagaaauaacu

SEQ ID NO: 847709 - RNA, 20 nt, Homo sapiens
uaccugcaccguugacucag

SEQ ID NO: 847710 - RNA, 17 nt, Homo sapiens
uaccuggcucuccuguc

SEQ ID NO: 847711 - RNA, 19 nt, Homo sapiens
uaccuuaaaugcugagauc

SEQ ID NO: 847712 - RNA, 14 nt, Homo sapiens
uacguuuacauucu

SEQ ID NO: 847713 - RNA, 17 nt, Homo sapiens
uacuaaauaugagacag

SEQ ID NO: 847714 - RNA, 15 nt, Homo sapiens
uacuagaaucagaua

SEQ ID NO: 847715 - RNA, 17 nt, Homo sapiens
uacuaucuuuguguugc

SEQ ID NO: 847716 - RNA, 19 nt, Homo sapiens
uacucaagugucuaccugg

SEQ ID NO: 847717 - RNA, 14 nt, Homo sapiens
uacugugacuuuau

SEQ ID NO: 847718 - RNA, 12 nt, Homo sapiens
uacuugaacuca

SEQ ID NO: 847719 - RNA, 15 nt, Homo sapiens
uacuuuccaaucuca

SEQ ID NO: 847720 - RNA, 19 nt, Homo sapiens
uacuuugaacaaccaaaug

SEQ ID NO: 847721 - RNA, 18 nt, Homo sapiens
uagaaaauuguccuccuu

SEQ ID NO: 847722 - RNA, 16 nt, Homo sapiens
uagaagugaguguaau

SEQ ID NO: 847723 - RNA, 17 nt, Homo sapiens
uagacugccacaaggaa

SEQ ID NO: 847724 - RNA, 18 nt, Homo sapiens
uagacuugcuuuggucac

SEQ ID NO: 847725 - RNA, 19 nt, Homo sapiens
uagauaugaagaaucugcu

SEQ ID NO: 847726 - RNA, 21 nt, Homo sapiens
uagauuauugaauucuucaca

SEQ ID NO: 847727 - RNA, 22 nt, Homo sapiens
uagauuuacauagaauuaagag

SEQ ID NO: 847728 - RNA, 16 nt, Homo sapiens
uagauuuucaccuauc

SEQ ID NO: 847729 - RNA, 20 nt, Homo sapiens
uagcaauuuccgccugguga

SEQ ID NO: 847730 - RNA, 23 nt, Homo sapiens
uagcacauguugauuuccuaugu

SEQ ID NO: 847731 - RNA, 16 nt, Homo sapiens
uagcauacauucagac

SEQ ID NO: 847732 - RNA, 23 nt, Homo sapiens
uagcccaccuggguuggaggaag

SEQ ID NO: 847733 - RNA, 18 nt, Homo sapiens
uagcccuugcugccacac

SEQ ID NO: 847734 - RNA, 19 nt, Homo sapiens
uaggaugugaucacuuuca

SEQ ID NO: 847735 - RNA, 19 nt, Homo sapiens
uaggccccugauucacugc

SEQ ID NO: 847736 - RNA, 14 nt, Homo sapiens
uaggcuuggauguu

SEQ ID NO: 847737 - RNA, 18 nt, Homo sapiens
uaggcuuuaaaaaagcau

SEQ ID NO: 847738 - RNA, 16 nt, Homo sapiens
uagguuugaaaguacu

SEQ ID NO: 847739 - RNA, 17 nt, Homo sapiens
uagugucucgaguacua

SEQ ID NO: 847740 - RNA, 10 nt, Homo sapiens
uaguuccuuc

SEQ ID NO: 847741 - RNA, 19 nt, Homo sapiens
uaguuuaaaaaucugccac

SEQ ID NO: 847742 - RNA, 22 nt, Homo sapiens
uauaacuggaguaauaaaacau

SEQ ID NO: 847743 - RNA, 12 nt, Homo sapiens
uauaagccaaaa

SEQ ID NO: 847744 - RNA, 22 nt, Homo sapiens
uauagaaaauaucuagcccaaa

SEQ ID NO: 847745 - RNA, 15 nt, Homo sapiens
uauagagagcccaaa

SEQ ID NO: 847746 - RNA, 20 nt, Homo sapiens
uauagcuaauaacaugugaa

SEQ ID NO: 847747 - RNA, 21 nt, Homo sapiens
uauaggaacugagguuuacau

SEQ ID NO: 847748 - RNA, 18 nt, Homo sapiens
uauauaauaaaagugccu

SEQ ID NO: 847749 - RNA, 24 nt, Homo sapiens
uauauauuuauguuuucacaguca

SEQ ID NO: 847750 - RNA, 18 nt, Homo sapiens
uauaugaucaaacuucca

SEQ ID NO: 847751 - RNA, 14 nt, Homo sapiens
uauauuccucugcu

SEQ ID NO: 847752 - RNA, 12 nt, Homo sapiens
uaucaaaggcac

SEQ ID NO: 847753 - RNA, 15 nt, Homo sapiens
uaucaaauacauuua

SEQ ID NO: 847754 - RNA, 14 nt, Homo sapiens
uaucaacacacauu

SEQ ID NO: 847755 - RNA, 13 nt, Homo sapiens
uaucagugugcaa

SEQ ID NO: 847756 - RNA, 14 nt, Homo sapiens
uaucagugugcaau

SEQ ID NO: 847757 - RNA, 19 nt, Homo sapiens
uauccacuuguccauguga

SEQ ID NO: 847758 - RNA, 16 nt, Homo sapiens
uaucucuaauauaucc

SEQ ID NO: 847759 - RNA, 14 nt, Homo sapiens
uaucugugaacuga

SEQ ID NO: 847760 - RNA, 20 nt, Homo sapiens
uaucuuuauaauugaugaug

SEQ ID NO: 847761 - RNA, 17 nt, Homo sapiens
uaugaagaaucugcucu

SEQ ID NO: 847762 - RNA, 20 nt, Homo sapiens
uaugaagaaucugcucugaa

SEQ ID NO: 847763 - RNA, 21 nt, Homo sapiens
uaugagacugggcaucucuga

SEQ ID NO: 847764 - RNA, 20 nt, Homo sapiens
uaugcccuugccucucugga

SEQ ID NO: 847765 - RNA, 20 nt, Homo sapiens
uaugggcuaccaggaagaag

SEQ ID NO: 847766 - RNA, 16 nt, Homo sapiens
uaugguaaaauuuugu

SEQ ID NO: 847767 - RNA, 22 nt, Homo sapiens
uauguauguguuuagaauugaa

SEQ ID NO: 847768 - RNA, 13 nt, Homo sapiens
uauguuucacagu

SEQ ID NO: 847769 - RNA, 20 nt, Homo sapiens
uauuaaguaugucaacagcc

SEQ ID NO: 847770 - RNA, 18 nt, Homo sapiens
uauuauauguaacuacuu

SEQ ID NO: 847771 - RNA, 20 nt, Homo sapiens
uauuccugggaggacucuga

SEQ ID NO: 847772 - RNA, 22 nt, Homo sapiens
uauuccugggaggacucugaug

SEQ ID NO: 847773 - RNA, 14 nt, Homo sapiens
uauucuaauaagcu

SEQ ID NO: 847774 - RNA, 14 nt, Homo sapiens
uauugagauuuacc

SEQ ID NO: 847775 - RNA, 16 nt, Homo sapiens
uauugcagugugaaug

SEQ ID NO: 847776 - RNA, 12 nt, Homo sapiens
uauuuacuauuu

SEQ ID NO: 847777 - RNA, 18 nt, Homo sapiens
uauuuauguaacaaaguu

SEQ ID NO: 847778 - RNA, 22 nt, Homo sapiens
uauuuauugucuuccuguaaga

SEQ ID NO: 847779 - RNA, 12 nt, Homo sapiens
uauuucuugaua

SEQ ID NO: 847780 - RNA, 17 nt, Homo sapiens
uauuugaaagugccuuu

SEQ ID NO: 847781 - RNA, 18 nt, Homo sapiens
uauuugugggugugcuau

SEQ ID NO: 847782 - RNA, 15 nt, Homo sapiens
ucaaaaagauaucaa

SEQ ID NO: 847783 - RNA, 14 nt, Homo sapiens
ucaaaaccuuucaa

SEQ ID NO: 847784 - RNA, 15 nt, Homo sapiens
ucaaacaccucugua

SEQ ID NO: 847785 - RNA, 22 nt, Homo sapiens
ucaaacuuccauauuugccuug

SEQ ID NO: 847786 - RNA, 21 nt, Homo sapiens
ucaaaucacauggcuuuccac

SEQ ID NO: 847787 - RNA, 19 nt, Homo sapiens
ucaaaugucagcagcuuua

SEQ ID NO: 847788 - RNA, 22 nt, Homo sapiens
ucaaauuucuguucucucuucc

SEQ ID NO: 847789 - RNA, 19 nt, Homo sapiens
ucaacccccuuaacuguau

SEQ ID NO: 847790 - RNA, 19 nt, Homo sapiens
ucaagaagucacugucaga

SEQ ID NO: 847791 - RNA, 22 nt, Homo sapiens
ucaagaagucacugucagagaa

SEQ ID NO: 847792 - RNA, 17 nt, Homo sapiens
ucaagaauagcauugua

SEQ ID NO: 847793 - RNA, 21 nt, Homo sapiens
cucauggaugcuuuggcaaug

SEQ ID NO: 847794 - RNA, 16 nt, Homo sapiens
cucauguuggggcucu

SEQ ID NO: 847795 - RNA, 17 nt, Homo sapiens
cucauuaaaauugugau

SEQ ID NO: 847796 - RNA, 20 nt, Homo sapiens
cucauuaaaauugugaugcu

SEQ ID NO: 847797 - RNA, 23 nt, Homo sapiens
cucauuaaaauugugaugcuccu

SEQ ID NO: 847798 - RNA, 21 nt, Homo sapiens
cucauuccuuuccucuggccc

SEQ ID NO: 847799 - RNA, 16 nt, Homo sapiens
cucauuuggggaccac

SEQ ID NO: 847800 - RNA, 18 nt, Homo sapiens
cucauuuucacagcacua

SEQ ID NO: 847801 - RNA, 18 nt, Homo sapiens
cuccaaaccuuacucuga

SEQ ID NO: 847802 - RNA, 13 nt, Homo sapiens
cuccaaccccucg

SEQ ID NO: 847803 - RNA, 13 nt, Homo sapiens
cuccaacuggauu

SEQ ID NO: 847804 - RNA, 13 nt, Homo sapiens
cuccacauauuuc

SEQ ID NO: 847805 - RNA, 19 nt, Homo sapiens
cuccagaugccacaaugga

SEQ ID NO: 847806 - RNA, 18 nt, Homo sapiens
cucccaacacucuugggg

SEQ ID NO: 847807 - RNA, 22 nt, Homo sapiens
cucccaacacucuuggggacca

SEQ ID NO: 847808 - RNA, 19 nt, Homo sapiens
cucccacccuuucugccag

SEQ ID NO: 847809 - RNA, 17 nt, Homo sapiens
cucccagggaauccgac

SEQ ID NO: 847810 - RNA, 13 nt, Homo sapiens
cuccggacuccuc

SEQ ID NO: 847811 - RNA, 23 nt, Homo sapiens
cuccggccccaccucgugaacac

SEQ ID NO: 847812 - RNA, 13 nt, Homo sapiens
cuccucaugccuu

SEQ ID NO: 847813 - RNA, 12 nt, Homo sapiens
cuccugccaugu

SEQ ID NO: 847814 - RNA, 17 nt, Homo sapiens
cuccugugcuggugacc

SEQ ID NO: 847815 - RNA, 19 nt, Homo sapiens
cucgaguacuaauaugcaa

SEQ ID NO: 847816 - RNA, 12 nt, Homo sapiens
cucgagucugag

SEQ ID NO: 847817 - RNA, 18 nt, Homo sapiens
cucuacagccucccuggc

SEQ ID NO: 847818 - RNA, 17 nt, Homo sapiens
cucucaggaucaaugac

SEQ ID NO: 847819 - RNA, 21 nt, Homo sapiens
cucucaggcauggaugaauaa

SEQ ID NO: 847820 - RNA, 20 nt, Homo sapiens
cucuccaggggucuugcaaa

SEQ ID NO: 847821 - RNA, 21 nt, Homo sapiens
cucucuaacccacagguguug

SEQ ID NO: 847822 - RNA, 16 nt, Homo sapiens
cucucucaacaucaca

SEQ ID NO: 847823 - RNA, 16 nt, Homo sapiens
cucugaaggaggccac

SEQ ID NO: 847824 - RNA, 12 nt, Homo sapiens
cucugagcucau

SEQ ID NO: 847825 - RNA, 23 nt, Homo sapiens
cucugcaaaggaaauaccaguuc

SEQ ID NO: 847826 - RNA, 17 nt, Homo sapiens
cucugcauauucuagua

SEQ ID NO: 847827 - RNA, 18 nt, Homo sapiens
cucugcuuugucaugcca

SEQ ID NO: 847828 - RNA, 19 nt, Homo sapiens
cucuggaauggcucaggga

SEQ ID NO: 847829 - RNA, 18 nt, Homo sapiens
cugaaaaugaacuguaaa

SEQ ID NO: 847830 - RNA, 15 nt, Homo sapiens
cugaaagaggccaaa

SEQ ID NO: 847831 - RNA, 19 nt, Homo sapiens
cugaaauguggaugugauu

SEQ ID NO: 847832 - RNA, 15 nt, Homo sapiens
cugaacauugcauau

SEQ ID NO: 847833 - RNA, 20 nt, Homo sapiens
cugaacucugaccacuuaaa

SEQ ID NO: 847834 - RNA, 12 nt, Homo sapiens
cugaacugggau

SEQ ID NO: 847835 - RNA, 14 nt, Homo sapiens
cugaagaggcauuu

SEQ ID NO: 847836 - RNA, 18 nt, Homo sapiens
cugaaggaggccaccucc

SEQ ID NO: 847837 - RNA, 12 nt, Homo sapiens
cugaauauugcc

SEQ ID NO: 847838 - RNA, 17 nt, Homo sapiens
cugaauucaaauauucu

SEQ ID NO: 847839 - RNA, 17 nt, Homo sapiens
cugacucugccagggug

SEQ ID NO: 847840 - RNA, 11 nt, Homo sapiens
cugacuuugaa

SEQ ID NO: 847841 - RNA, 15 nt, Homo sapiens
cugacuuugccaaaa

SEQ ID NO: 847842 - RNA, 18 nt, Homo sapiens
cugagcccccagcuucca

SEQ ID NO: 847843 - RNA, 21 nt, Homo sapiens
cugagcuuuggugcaucucau

SEQ ID NO: 847844 - RNA, 23 nt, Homo sapiens
cugaggacaagagaaaaaagcca

SEQ ID NO: 847845 - RNA, 14 nt, Homo sapiens
cugaggagcuguga

SEQ ID NO: 847846 - RNA, 19 nt, Homo sapiens
cugagggcuuguaguucuu

SEQ ID NO: 847847 - RNA, 20 nt, Homo sapiens
cugagucccaauuacauuca

SEQ ID NO: 847848 - RNA, 18 nt, Homo sapiens
cugaguuagguuccagca

SEQ ID NO: 847849 - RNA, 19 nt, Homo sapiens
cugauauucaaauggacaa

SEQ ID NO: 847850 - RNA, 17 nt, Homo sapiens
cugauuuugaccuugua

SEQ ID NO: 847851 - RNA, 16 nt, Homo sapiens
cugcaaaaugggauga

SEQ ID NO: 847852 - RNA, 16 nt, Homo sapiens
cugcaaugccaggugg

SEQ ID NO: 847853 - RNA, 22 nt, Homo sapiens
cugcacugaauggcugaccuga

SEQ ID NO: 847854 - RNA, 16 nt, Homo sapiens
cugcagccuccgcuuc

SEQ ID NO: 847855 - RNA, 20 nt, Homo sapiens
cugcaggcguucucucucua

SEQ ID NO: 847856 - RNA, 14 nt, Homo sapiens
cugccgcauuuccu

SEQ ID NO: 847857 - RNA, 16 nt, Homo sapiens
cugccgcccggugcca

SEQ ID NO: 847858 - RNA, 13 nt, Homo sapiens
cugccucugccac

SEQ ID NO: 847859 - RNA, 21 nt, Homo sapiens
cugccugugggcuggggagcc

SEQ ID NO: 847860 - RNA, 22 nt, Homo sapiens
cugcucagaaucugauaccaaa

SEQ ID NO: 847861 - RNA, 13 nt, Homo sapiens
cugcuuaguacau

SEQ ID NO: 847862 - RNA, 23 nt, Homo sapiens
cugcuugacaaaggagcauugca

SEQ ID NO: 847863 - RNA, 14 nt, Homo sapiens
cugcuuuagacuug

SEQ ID NO: 847864 - RNA, 23 nt, Homo sapiens
cugcuuuuaaagauauggcugcu

SEQ ID NO: 847865 - RNA, 14 nt, Homo sapiens
cugcuuuuucucag

SEQ ID NO: 847866 - RNA, 15 nt, Homo sapiens
cuggaaaaggcauau

SEQ ID NO: 847867 - RNA, 21 nt, Homo sapiens
cuggaaaugguuuaccuaaaa

SEQ ID NO: 847868 - RNA, 19 nt, Homo sapiens
cuggaaugagcagcuuuag

SEQ ID NO: 847869 - RNA, 18 nt, Homo sapiens
cuggaauggcucagggau

SEQ ID NO: 847870 - RNA, 17 nt, Homo sapiens
cuggaccccagccucaa

SEQ ID NO: 847871 - RNA, 20 nt, Homo sapiens
cuggagucucucucucucca

SEQ ID NO: 847872 - RNA, 19 nt, Homo sapiens
cuggccacaguuguuugau

SEQ ID NO: 847873 - RNA, 21 nt, Homo sapiens
cuggcccaugugcccacuguc

SEQ ID NO: 847874 - RNA, 21 nt, Homo sapiens
cuggccguguccaccuuucag

SEQ ID NO: 847875 - RNA, 21 nt, Homo sapiens
cuggcgcuguuggggcugcuc

SEQ ID NO: 847876 - RNA, 16 nt, Homo sapiens
cuggcucccucacucu

SEQ ID NO: 847877 - RNA, 21 nt, Homo sapiens
cuggcucuccugucucugcag

SEQ ID NO: 847878 - RNA, 17 nt, Homo sapiens
cugggagcccucgggaa

SEQ ID NO: 847879 - RNA, 16 nt, Homo sapiens
cugggccuccaccucu

SEQ ID NO: 847880 - RNA, 18 nt, Homo sapiens
cuggggaagacuuaugcc

SEQ ID NO: 847881 - RNA, 14 nt, Homo sapiens
cuggggaccagcuu

SEQ ID NO: 847882 - RNA, 14 nt, Homo sapiens
cugguaaauugcca

SEQ ID NO: 847883 - RNA, 13 nt, Homo sapiens
cuguagccugaag

SEQ ID NO: 847884 - RNA, 14 nt, Homo sapiens
cugucacaaaggag

SEQ ID NO: 847885 - RNA, 16 nt, Homo sapiens
cugucaccaagcauga

SEQ ID NO: 847886 - RNA, 22 nt, Homo sapiens
cugugaauugugcucuguugua

SEQ ID NO: 847887 - RNA, 17 nt, Homo sapiens
cugugagcacauaagca

SEQ ID NO: 847888 - RNA, 14 nt, Homo sapiens
cugugccucuucag

SEQ ID NO: 847889 - RNA, 17 nt, Homo sapiens
cuguggccuucacuuug

SEQ ID NO: 847890 - RNA, 13 nt, Homo sapiens
cuguguaccacug

SEQ ID NO: 847891 - RNA, 16 nt, Homo sapiens
cuguguaccucaugga

SEQ ID NO: 847892 - RNA, 16 nt, Homo sapiens
cugugucaaacaccuc

SEQ ID NO: 847893 - RNA, 16 nt, Homo sapiens
cugugugacaucacag

SEQ ID NO: 847894 - RNA, 19 nt, Homo sapiens
cugugugacaucacagggc

SEQ ID NO: 847895 - RNA, 21 nt, Homo sapiens
cuguguuaauuuaaguuuuga

SEQ ID NO: 847896 - RNA, 14 nt, Homo sapiens
cuguuaaaggucau

SEQ ID NO: 847897 - RNA, 21 nt, Homo sapiens
cuguugacucuaguacuguga

SEQ ID NO: 847898 - RNA, 21 nt, Homo sapiens
cuguuggucaaaaucugcaaa

SEQ ID NO: 847899 - RNA, 16 nt, Homo sapiens
cuguuucagaccagcc

SEQ ID NO: 847900 - RNA, 13 nt, Homo sapiens
cuguuucuggucu

SEQ ID NO: 847901 - RNA, 14 nt, Homo sapiens
cuuaaaacacguuu

SEQ ID NO: 847902 - RNA, 20 nt, Homo sapiens
cuuaaaauggcaaguuuucc

SEQ ID NO: 847903 - RNA, 16 nt, Homo sapiens
cuuaaacucuguuaca

SEQ ID NO: 847904 - RNA, 11 nt, Homo sapiens
cuuaaauaucc

SEQ ID NO: 847905 - RNA, 18 nt, Homo sapiens
cuuaagaacugcuuucuu

SEQ ID NO: 847906 - RNA, 18 nt, Homo sapiens
cuuaagguggaaaguguu

SEQ ID NO: 847907 - RNA, 23 nt, Homo sapiens
cuuacuguauaaaggugugcugu

SEQ ID NO: 847908 - RNA, 17 nt, Homo sapiens
cuuagcugaugucuuug

SEQ ID NO: 847909 - RNA, 20 nt, Homo sapiens
cuuauaaacagaagugacug

SEQ ID NO: 847910 - RNA, 16 nt, Homo sapiens
cuucaauuagucucag

SEQ ID NO: 847911 - RNA, 22 nt, Homo sapiens
cuucagcugccuggaggccaga

SEQ ID NO: 847912 - RNA, 16 nt, Homo sapiens
cuucauacacuguacc

SEQ ID NO: 847913 - RNA, 18 nt, Homo sapiens
cuucauucuuuucugaag

SEQ ID NO: 847914 - RNA, 21 nt, Homo sapiens
cuuccauauuugccuugggaa

SEQ ID NO: 847915 - RNA, 19 nt, Homo sapiens
cuuccuugaacccuaauaa

SEQ ID NO: 847916 - RNA, 17 nt, Homo sapiens
cuucgcagccuagauau

SEQ ID NO: 847917 - RNA, 21 nt, Homo sapiens
cuucgcagccuagauaugaag

SEQ ID NO: 847918 - RNA, 19 nt, Homo sapiens
cuucuaugcccagcugugc

SEQ ID NO: 847919 - RNA, 15 nt, Homo sapiens
cuucucauuacuugu

SEQ ID NO: 847920 - RNA, 18 nt, Homo sapiens
cuucucugguucaugucc

SEQ ID NO: 847921 - RNA, 16 nt, Homo sapiens
auuugugaacugucau

SEQ ID NO: 847922 - RNA, 18 nt, Homo sapiens
auuuuaaauaguuugaca

SEQ ID NO: 847923 - RNA, 15 nt, Homo sapiens
auuuuagaaugucaa

SEQ ID NO: 847924 - RNA, 20 nt, Homo sapiens
auuuucaccuauccagagag

SEQ ID NO: 847925 - RNA, 14 nt, Homo sapiens
cagcaucggaaaga

SEQ ID NO: 847926 - RNA, 18 nt, Homo sapiens
cagcaugcaaacuuggau

SEQ ID NO: 847927 - RNA, 21 nt, Homo sapiens
cagcauguaaagagcugggag

SEQ ID NO: 847928 - RNA, 21 nt, Homo sapiens
cagccacauuucagaccugcu

SEQ ID NO: 847929 - RNA, 13 nt, Homo sapiens
cagccaccacuga

SEQ ID NO: 847930 - RNA, 14 nt, Homo sapiens
cagccaccacugac

SEQ ID NO: 847931 - RNA, 23 nt, Homo sapiens
cagccauuugggagaagaucuca

SEQ ID NO: 847932 - RNA, 17 nt, Homo sapiens
cagcccagaagugcaga

SEQ ID NO: 847933 - RNA, 13 nt, Homo sapiens
cagcccugagguu

SEQ ID NO: 847934 - RNA, 17 nt, Homo sapiens
cagccuagauaugaaga

SEQ ID NO: 847935 - RNA, 19 nt, Homo sapiens
cagccuagauaugaagaau

SEQ ID NO: 847936 - RNA, 22 nt, Homo sapiens
cagccuagauaugaagaaucug

SEQ ID NO: 847937 - RNA, 17 nt, Homo sapiens
cagccucuggaauggcu

SEQ ID NO: 847938 - RNA, 15 nt, Homo sapiens
cagccugagauggau

SEQ ID NO: 847939 - RNA, 18 nt, Homo sapiens
cagccuucuucucuuaau

SEQ ID NO: 847940 - RNA, 13 nt, Homo sapiens
cagcguuaugugu

SEQ ID NO: 847941 - RNA, 16 nt, Homo sapiens
cagcucuacaggugag

SEQ ID NO: 847942 - RNA, 14 nt, Homo sapiens
caggaaaccagaaa

SEQ ID NO: 847943 - RNA, 16 nt, Homo sapiens
caggaaacuaacuggu

SEQ ID NO: 847944 - RNA, 15 nt, Homo sapiens
caggaaaugcugacc

SEQ ID NO: 847945 - RNA, 18 nt, Homo sapiens
caggaagaaagggaaauu

SEQ ID NO: 847946 - RNA, 22 nt, Homo sapiens
caggaaggacuucuuccaggga

SEQ ID NO: 847947 - RNA, 16 nt, Homo sapiens
caggaaggcugucuca

SEQ ID NO: 847948 - RNA, 18 nt, Homo sapiens
caggacagggguuccuuc

SEQ ID NO: 847949 - RNA, 21 nt, Homo sapiens
caggaggaaccccuucucugg

SEQ ID NO: 847950 - RNA, 22 nt, Homo sapiens
caggauugaagcuuuagugaaa

SEQ ID NO: 847951 - RNA, 16 nt, Homo sapiens
caggauugucacucca

SEQ ID NO: 847952 - RNA, 13 nt, Homo sapiens
caggcguucucuc

SEQ ID NO: 847953 - RNA, 19 nt, Homo sapiens
caggcugagugcaggccca

SEQ ID NO: 847954 - RNA, 23 nt, Homo sapiens
cagggccuucugccugcugacca

SEQ ID NO: 847955 - RNA, 20 nt, Homo sapiens
cagggcugaaccccaccucc

SEQ ID NO: 847956 - RNA, 17 nt, Homo sapiens
cagggcugcaucccgca

SEQ ID NO: 847957 - RNA, 21 nt, Homo sapiens
caggggauccagcucaaggga

SEQ ID NO: 847958 - RNA, 20 nt, Homo sapiens
caggggcuagcuaagccaag

SEQ ID NO: 847959 - RNA, 23 nt, Homo sapiens
caggguacaaaaaauucagugau

SEQ ID NO: 847960 - RNA, 21 nt, Homo sapiens
caggguuucaccauguuggcc

SEQ ID NO: 847961 - RNA, 15 nt, Homo sapiens
cagguccaugugcac

SEQ ID NO: 847962 - RNA, 18 nt, Homo sapiens
caggugcccgccaccaca

SEQ ID NO: 847963 - RNA, 21 nt, Homo sapiens
caggugcuuuuauuuucacag

SEQ ID NO: 847964 - RNA, 19 nt, Homo sapiens
caguaaauauuuacuauuu

SEQ ID NO: 847965 - RNA, 12 nt, Homo sapiens
caguaagcuggu

SEQ ID NO: 847966 - RNA, 16 nt, Homo sapiens
caguacacuucaguua

SEQ ID NO: 847967 - RNA, 21 nt, Homo sapiens
caguacuuucaaugaacauaa

SEQ ID NO: 847968 - RNA, 19 nt, Homo sapiens
caguaguguauuaaaugaa

SEQ ID NO: 847969 - RNA, 20 nt, Homo sapiens
cagucaccaaguguauugua

SEQ ID NO: 847970 - RNA, 13 nt, Homo sapiens
cagucacuuugac

SEQ ID NO: 847971 - RNA, 17 nt, Homo sapiens
cagucagguccaugugc

SEQ ID NO: 847972 - RNA, 19 nt, Homo sapiens
cagucagguccaugugcac

SEQ ID NO: 847973 - RNA, 13 nt, Homo sapiens
caguccuauuuag

SEQ ID NO: 847974 - RNA, 12 nt, Homo sapiens
cagugacugugu

SEQ ID NO: 847975 - RNA, 22 nt, Homo sapiens
cagugauguuugccauuugcug

SEQ ID NO: 847976 - RNA, 22 nt, Homo sapiens
cagugcaugggggauguuucuu

SEQ ID NO: 847977 - RNA, 12 nt, Homo sapiens
caguggcuguga

SEQ ID NO: 847978 - RNA, 19 nt, Homo sapiens
caguuaucuugaucucccu

SEQ ID NO: 847979 - RNA, 17 nt, Homo sapiens
caguuaugugaccucac

SEQ ID NO: 847980 - RNA, 21 nt, Homo sapiens
caguuucagguagaggugcau

SEQ ID NO: 847981 - RNA, 15 nt, Homo sapiens
cauaaagcauguuuc

SEQ ID NO: 847982 - RNA, 22 nt, Homo sapiens
cauaacuaggauuauaaugcug

SEQ ID NO: 847983 - RNA, 14 nt, Homo sapiens
cauaauucuuauua

SEQ ID NO: 847984 - RNA, 20 nt, Homo sapiens
cauagugauagagugcagug

SEQ ID NO: 847985 - RNA, 17 nt, Homo sapiens
cauaucaaaacauccca

SEQ ID NO: 847986 - RNA, 23 nt, Homo sapiens
cauaucugcuuaucagugugcaa

SEQ ID NO: 847987 - RNA, 16 nt, Homo sapiens
cauauguuugcuugua

SEQ ID NO: 847988 - RNA, 12 nt, Homo sapiens
cauauuacugua

SEQ ID NO: 847989 - RNA, 13 nt, Homo sapiens
caucaccauggaa

SEQ ID NO: 847990 - RNA, 23 nt, Homo sapiens
caucaggacccuucgugacaaug

SEQ ID NO: 847991 - RNA, 19 nt, Homo sapiens
caucaggggcaggaaccag

SEQ ID NO: 847992 - RNA, 15 nt, Homo sapiens
caucccacccucuca

SEQ ID NO: 847993 - RNA, 18 nt, Homo sapiens
cauccuugggaccugaau

SEQ ID NO: 847994 - RNA, 15 nt, Homo sapiens
caucucugaaaacaa

SEQ ID NO: 847995 - RNA, 21 nt, Homo sapiens
caucugucacuugcauuccac

SEQ ID NO: 847996 - RNA, 11 nt, Homo sapiens
caucugugaau

SEQ ID NO: 847997 - RNA, 18 nt, Homo sapiens
caugaaaaaugaucucug

SEQ ID NO: 847998 - RNA, 16 nt, Homo sapiens
caugaacaaagauaua

SEQ ID NO: 847999 - RNA, 17 nt, Homo sapiens
caugcauuggucuuaga

SEQ ID NO: 848000 - RNA, 21 nt, Homo sapiens
cauggaccaugcugucuggca

SEQ ID NO: 848001 - RNA, 22 nt, Homo sapiens
cauggagaaugcaccauacuca

SEQ ID NO: 848002 - RNA, 22 nt, Homo sapiens
cauggaugaauaaauguuauag

SEQ ID NO: 848003 - RNA, 17 nt, Homo sapiens
cauggcccaucaggggc

SEQ ID NO: 848004 - RNA, 18 nt, Homo sapiens
cauguccuucuuguccac

SEQ ID NO: 848005 - RNA, 22 nt, Homo sapiens
caugucuugcuaacaggauaug

SEQ ID NO: 848006 - RNA, 20 nt, Homo sapiens
cauguguugcagcugucacc

SEQ ID NO: 848007 - RNA, 15 nt, Homo sapiens
cauguuggggcucuu

SEQ ID NO: 848008 - RNA, 15 nt, Homo sapiens
cauuaagcucacaau

SEQ ID NO: 848009 - RNA, 18 nt, Homo sapiens
cauuacucccuaugugcg

SEQ ID NO: 848010 - RNA, 23 nt, Homo sapiens
cauuauucucuaacuauuacaca

SEQ ID NO: 848011 - RNA, 20 nt, Homo sapiens
cauucagacguuuuuucugc

SEQ ID NO: 848012 - RNA, 21 nt, Homo sapiens
cauugccugauuuguuccuuc

SEQ ID NO: 848013 - RNA, 17 nt, Homo sapiens
cauugguaagaaugagc

SEQ ID NO: 848014 - RNA, 23 nt, Homo sapiens
cauugguucuuucauuugcuuug

SEQ ID NO: 848015 - RNA, 14 nt, Homo sapiens
cauuguaaaagcau

SEQ ID NO: 848016 - RNA, 16 nt, Homo sapiens
cauuugaauaaugucu

SEQ ID NO: 848017 - RNA, 20 nt, Homo sapiens
cauuugcuggacaaccaaca

SEQ ID NO: 848018 - RNA, 20 nt, Homo sapiens
cauuugggagaagaucucaa

SEQ ID NO: 848019 - RNA, 14 nt, Homo sapiens
cauuuuaaggcaau

SEQ ID NO: 848020 - RNA, 15 nt, Homo sapiens
cauuuucaaugugau

SEQ ID NO: 848021 - RNA, 14 nt, Homo sapiens
cauuuuguaauaau

SEQ ID NO: 848022 - RNA, 16 nt, Homo sapiens
cauuuuuuaccacaau

SEQ ID NO: 848023 - RNA, 20 nt, Homo sapiens
cauuuuuuuuuuuuaaagga

SEQ ID NO: 848024 - RNA, 24 nt, Homo sapiens
ccaaacaaaaauguuaagcaucua

SEQ ID NO: 848025 - RNA, 21 nt, Homo sapiens
ccaaaccuuacucugagcuca

SEQ ID NO: 848026 - RNA, 13 nt, Homo sapiens
ccaaauguauucu

SEQ ID NO: 848027 - RNA, 20 nt, Homo sapiens
ccaacaccucacccucuguc

SEQ ID NO: 848028 - RNA, 11 nt, Homo sapiens
ccaagagucug

SEQ ID NO: 848029 - RNA, 20 nt, Homo sapiens
ccaaguacuuuccaaucuca

SEQ ID NO: 848030 - RNA, 19 nt, Homo sapiens
ccaauuaaggcaucaucag

SEQ ID NO: 848031 - RNA, 10 nt, Homo sapiens
ccacagccuc

SEQ ID NO: 848032 - RNA, 12 nt, Homo sapiens
ccacaucccucu

SEQ ID NO: 848033 - RNA, 15 nt, Homo sapiens
ccacauuuauggacc

SEQ ID NO: 848034 - RNA, 19 nt, Homo sapiens
ccaccuucccuccucaugc

SEQ ID NO: 848035 - RNA, 18 nt, Homo sapiens
ccacugacuauaccaacu

SEQ ID NO: 848036 - RNA, 16 nt, Homo sapiens
ccacuggagucucucu

SEQ ID NO: 848037 - RNA, 15 nt, Homo sapiens
ccacugucucuucca

SEQ ID NO: 848038 - RNA, 14 nt, Homo sapiens
ccagaaaaucugaa

SEQ ID NO: 848039 - RNA, 17 nt, Homo sapiens
ccagaaauaccacauuu

SEQ ID NO: 848040 - RNA, 19 nt, Homo sapiens
ccagaagugcagaacugca

SEQ ID NO: 848041 - RNA, 13 nt, Homo sapiens
ccagacaaucucg

SEQ ID NO: 848042 - RNA, 19 nt, Homo sapiens
ccagaguagccaugaggag

SEQ ID NO: 848043 - RNA, 19 nt, Homo sapiens
ccagcacagauuugcuuuu

SEQ ID NO: 848044 - RNA, 12 nt, Homo sapiens
ccagcucaaggg

SEQ ID NO: 848045 - RNA, 20 nt, Homo sapiens
ccagcucugggggacuccuu

SEQ ID NO: 848046 - RNA, 17 nt, Homo sapiens
ccagcuuggcucaggcu

SEQ ID NO: 848047 - RNA, 15 nt, Homo sapiens
ccaggaaguagcaca

SEQ ID NO: 848048 - RNA, 12 nt, Homo sapiens
ccaggaaucuca

SEQ ID NO: 848049 - RNA, 16 nt, Homo sapiens
ccaggacccugccagg

SEQ ID NO: 848050 - RNA, 18 nt, Homo sapiens
ccaggauugucacuccaa

SEQ ID NO: 848051 - RNA, 13 nt, Homo sapiens
ccaggcacaggca

SEQ ID NO: 848052 - RNA, 18 nt, Homo sapiens
ccaggcguggugacucac

SEQ ID NO: 848053 - RNA, 21 nt, Homo sapiens
ccagggcguggagagcccuca

SEQ ID NO: 848054 - RNA, 14 nt, Homo sapiens
ccaggugggagcca

SEQ ID NO: 848055 - RNA, 15 nt, Homo sapiens
ccagugccauuucag

SEQ ID NO: 848056 - RNA, 16 nt, Homo sapiens
ccagugccauuucaga

SEQ ID NO: 848057 - RNA, 15 nt, Homo sapiens
ugcccuccugugugg

SEQ ID NO: 848058 - RNA, 19 nt, Homo sapiens
ugccgcauuuccuuucagu

SEQ ID NO: 848059 - RNA, 16 nt, Homo sapiens
ugccgggcgcaggaac

SEQ ID NO: 848060 - RNA, 16 nt, Homo sapiens
ugccuauaagccaaaa

SEQ ID NO: 848061 - RNA, 20 nt, Homo sapiens
ugccucauaggcuucuggga

SEQ ID NO: 848062 - RNA, 13 nt, Homo sapiens
ugccucugccaca

SEQ ID NO: 848063 - RNA, 16 nt, Homo sapiens
ugccuggcagccauuu

SEQ ID NO: 848064 - RNA, 15 nt, Homo sapiens
ugccugucucccacc

SEQ ID NO: 848065 - RNA, 21 nt, Homo sapiens
ugccuuugguuuacucagggu

SEQ ID NO: 848066 - RNA, 14 nt, Homo sapiens
ugcgccugaguaac

SEQ ID NO: 848067 - RNA, 19 nt, Homo sapiens
ugcgccugggaucucgcca

SEQ ID NO: 848068 - RNA, 19 nt, Homo sapiens
ugcuaacuggacauucugg

SEQ ID NO: 848069 - RNA, 19 nt, Homo sapiens
ugcuaauccggaaaucagc

SEQ ID NO: 848070 - RNA, 20 nt, Homo sapiens
ugcuagccucacgaaacugg

SEQ ID NO: 848071 - RNA, 17 nt, Homo sapiens
ugcucaagucuacccug

SEQ ID NO: 848072 - RNA, 16 nt, Homo sapiens
ugcucauaugaacuuu

SEQ ID NO: 848073 - RNA, 16 nt, Homo sapiens
ugcucuguuguagggg

SEQ ID NO: 848074 - RNA, 20 nt, Homo sapiens
ugcugaaauaaaaugauuaa

SEQ ID NO: 848075 - RNA, 19 nt, Homo sapiens
ugcugaccccugugugaca

SEQ ID NO: 848076 - RNA, 13 nt, Homo sapiens
ugcugaguacuca

SEQ ID NO: 848077 - RNA, 20 nt, Homo sapiens
ugcugauuuugaccuuguau

SEQ ID NO: 848078 - RNA, 14 nt, Homo sapiens
ugcugcucucucaa

SEQ ID NO: 848079 - RNA, 19 nt, Homo sapiens
ugcuggaaacauucacuuu

SEQ ID NO: 848080 - RNA, 18 nt, Homo sapiens
ugcuggaacucuugacag

SEQ ID NO: 848081 - RNA, 13 nt, Homo sapiens
ugcuguaccacaa

SEQ ID NO: 848082 - RNA, 12 nt, Homo sapiens
ugcuuacaggaa

SEQ ID NO: 848083 - RNA, 16 nt, Homo sapiens
ugcuuaguacauuuga

SEQ ID NO: 848084 - RNA, 12 nt, Homo sapiens
ugcuucugccac

SEQ ID NO: 848085 - RNA, 22 nt, Homo sapiens
ugcuugaagcaaacaguugaca

SEQ ID NO: 848086 - RNA, 22 nt, Homo sapiens
uggaaaaggaagguaguucaag

SEQ ID NO: 848087 - RNA, 13 nt, Homo sapiens
uggaaauuguuaa

SEQ ID NO: 848088 - RNA, 21 nt, Homo sapiens
uggaagcacaccaaucuuacu

SEQ ID NO: 848089 - RNA, 17 nt, Homo sapiens
uggaaugagcagcuuua

SEQ ID NO: 848090 - RNA, 22 nt, Homo sapiens
uggaaugcacucagacuguaua

SEQ ID NO: 848091 - RNA, 17 nt, Homo sapiens
uggaauggcucagggau

SEQ ID NO: 848092 - RNA, 16 nt, Homo sapiens
uggagaaucacaggcu

SEQ ID NO: 848093 - RNA, 11 nt, Homo sapiens
uggagcaauaa

SEQ ID NO: 848094 - RNA, 20 nt, Homo sapiens
uggagggcuggucauucaca

SEQ ID NO: 848095 - RNA, 17 nt, Homo sapiens
uggauaccauuauaugu

SEQ ID NO: 848096 - RNA, 21 nt, Homo sapiens
uggaugcuugaggaauauugc

SEQ ID NO: 848097 - RNA, 19 nt, Homo sapiens
uggauucagaaccaagacc

SEQ ID NO: 848098 - RNA, 18 nt, Homo sapiens
uggauuguagaacuuguu

SEQ ID NO: 848099 - RNA, 14 nt, Homo sapiens
uggcaaacagaaug

SEQ ID NO: 848100 - RNA, 17 nt, Homo sapiens
uggcagggcacagggcc

SEQ ID NO: 848101 - RNA, 20 nt, Homo sapiens
uggcaggggauccagcucaa

SEQ ID NO: 848102 - RNA, 15 nt, Homo sapiens
uggcaguggcuguga

SEQ ID NO: 848103 - RNA, 16 nt, Homo sapiens
uggcauauggaaggga

SEQ ID NO: 848104 - RNA, 16 nt, Homo sapiens
uggccaggaaguagca

SEQ ID NO: 848105 - RNA, 14 nt, Homo sapiens
uggcccaggccaga

SEQ ID NO: 848106 - RNA, 22 nt, Homo sapiens
uggcccauguauggccaggaag

SEQ ID NO: 848107 - RNA, 17 nt, Homo sapiens
uggcccucucugaagga

SEQ ID NO: 848108 - RNA, 15 nt, Homo sapiens
uggccucaugucaaa

SEQ ID NO: 848109 - RNA, 13 nt, Homo sapiens
uggccuucacuuu

SEQ ID NO: 848110 - RNA, 20 nt, Homo sapiens
uggcgggcccuggagcucaa

SEQ ID NO: 848111 - RNA, 19 nt, Homo sapiens
uggcuuauauucuaaguca

SEQ ID NO: 848112 - RNA, 20 nt, Homo sapiens
uggcuuauauucuaagucac

SEQ ID NO: 848113 - RNA, 17 nt, Homo sapiens
uggcuucccagagcucc

SEQ ID NO: 848114 - RNA, 15 nt, Homo sapiens
uggcuucucccaaca

SEQ ID NO: 848115 - RNA, 19 nt, Homo sapiens
uggcuuggugagucugugu

SEQ ID NO: 848116 - RNA, 18 nt, Homo sapiens
ugggagccaacugucagg

SEQ ID NO: 848117 - RNA, 16 nt, Homo sapiens
ugggagcugcuccuaa

SEQ ID NO: 848118 - RNA, 19 nt, Homo sapiens
ugggaugauugaagaaaca

SEQ ID NO: 848119 - RNA, 13 nt, Homo sapiens
ugggcacacugaa

SEQ ID NO: 848120 - RNA, 14 nt, Homo sapiens
ugggcuaccaggaa

SEQ ID NO: 848121 - RNA, 20 nt, Homo sapiens
ugggcuggccagccaccacu

SEQ ID NO: 848122 - RNA, 22 nt, Homo sapiens
ugggcuggccagccaccacuga

SEQ ID NO: 848123 - RNA, 14 nt, Homo sapiens
ugggcuggggagcc

SEQ ID NO: 848124 - RNA, 17 nt, Homo sapiens
ugggggaaucaaaucaa

SEQ ID NO: 848125 - RNA, 16 nt, Homo sapiens
uggguacuuucugaaa

SEQ ID NO: 848126 - RNA, 21 nt, Homo sapiens
ugguaaagaaauacacaggga

SEQ ID NO: 848127 - RNA, 14 nt, Homo sapiens
ugguaaauugccau

SEQ ID NO: 848128 - RNA, 20 nt, Homo sapiens
ugguacacaccaaaugaguc

SEQ ID NO: 848129 - RNA, 17 nt, Homo sapiens
uggugaugcgcaguugc

SEQ ID NO: 848130 - RNA, 13 nt, Homo sapiens
uggugcuaccugg

SEQ ID NO: 848131 - RNA, 12 nt, Homo sapiens
uggugcugccac

SEQ ID NO: 848132 - RNA, 19 nt, Homo sapiens
ugguuacauaucaaaacau

SEQ ID NO: 848133 - RNA, 17 nt, Homo sapiens
ugguuauuucugugcaa

SEQ ID NO: 848134 - RNA, 19 nt, Homo sapiens
ugguuccaugccugcucuc

SEQ ID NO: 848135 - RNA, 12 nt, Homo sapiens
ugguucuuucau

SEQ ID NO: 848136 - RNA, 14 nt, Homo sapiens
ugguuuaccugcac

SEQ ID NO: 848137 - RNA, 23 nt, Homo sapiens
ugguuucacaugguuacauauca

SEQ ID NO: 848138 - RNA, 16 nt, Homo sapiens
uguaaaaagugcagua

SEQ ID NO: 848139 - RNA, 16 nt, Homo sapiens
uguaagaaauacugua

SEQ ID NO: 848140 - RNA, 15 nt, Homo sapiens
uguaauccagcaaua

SEQ ID NO: 848141 - RNA, 18 nt, Homo sapiens
uguaauuccagcacuuca

SEQ ID NO: 848142 - RNA, 20 nt, Homo sapiens
uguaccaccaacuacuaccu

SEQ ID NO: 848143 - RNA, 20 nt, Homo sapiens
uguagaacuuguugcugauu

SEQ ID NO: 848144 - RNA, 16 nt, Homo sapiens
uguagaccuguuucau

SEQ ID NO: 848145 - RNA, 14 nt, Homo sapiens
uguauaugcugcau

SEQ ID NO: 848146 - RNA, 13 nt, Homo sapiens
uguaucaacacac

SEQ ID NO: 848147 - RNA, 15 nt, Homo sapiens
uguauucugugauaa

SEQ ID NO: 848148 - RNA, 14 nt, Homo sapiens
uguauuucaucuca

SEQ ID NO: 848149 - RNA, 14 nt, Homo sapiens
ugucacuugcauuc

SEQ ID NO: 848150 - RNA, 18 nt, Homo sapiens
ugucauggauagauuuuc

SEQ ID NO: 848151 - RNA, 15 nt, Homo sapiens
uguccaccacugacu

SEQ ID NO: 848152 - RNA, 13 nt, Homo sapiens
uguccugccugug

SEQ ID NO: 848153 - RNA, 23 nt, Homo sapiens
ugucuguguuccaaccacugaau

SEQ ID NO: 848154 - RNA, 13 nt, Homo sapiens
ugucuuaauggau

SEQ ID NO: 848155 - RNA, 19 nt, Homo sapiens
ugucuuuggcucaguucau

SEQ ID NO: 848156 - RNA, 17 nt, Homo sapiens
ugugaacaagucccugu

SEQ ID NO: 848157 - RNA, 20 nt, Homo sapiens
ugugaaggaguaaugggaua

SEQ ID NO: 848158 - RNA, 21 nt, Homo sapiens
ugugacguuuuuccaguucac

SEQ ID NO: 848159 - RNA, 18 nt, Homo sapiens
ugugaggccacacccaga

SEQ ID NO: 848160 - RNA, 15 nt, Homo sapiens
ugugauguacuguaa

SEQ ID NO: 848161 - RNA, 19 nt, Homo sapiens
uguggaacugcuauuuucc

SEQ ID NO: 848162 - RNA, 20 nt, Homo sapiens
uguggccuucacuuuguuca

SEQ ID NO: 848163 - RNA, 23 nt, Homo sapiens
uguggggugugugcagggcugca

SEQ ID NO: 848164 - RNA, 13 nt, Homo sapiens
uguggucagagag

SEQ ID NO: 848165 - RNA, 12 nt, Homo sapiens
uguggugacauu

SEQ ID NO: 848166 - RNA, 17 nt, Homo sapiens
uguguaccacugggaua

SEQ ID NO: 848167 - RNA, 17 nt, Homo sapiens
acauauaaauugucuua

SEQ ID NO: 848168 - RNA, 12 nt, Homo sapiens
acaucacagggc

SEQ ID NO: 848169 - RNA, 13 nt, Homo sapiens
acaucauuccuuu

SEQ ID NO: 848170 - RNA, 21 nt, Homo sapiens
acauccccugcuggccggaca

SEQ ID NO: 848171 - RNA, 23 nt, Homo sapiens
acaucucccuuuuccaugacugu

SEQ ID NO: 848172 - RNA, 16 nt, Homo sapiens
acaucuucuguuauug

SEQ ID NO: 848173 - RNA, 22 nt, Homo sapiens
acauggcguauuuuguauuuaa

SEQ ID NO: 848174 - RNA, 15 nt, Homo sapiens
acaugguuacauauc

SEQ ID NO: 848175 - RNA, 13 nt, Homo sapiens
acauguaacuuuc

SEQ ID NO: 848176 - RNA, 16 nt, Homo sapiens
acauguaacuuucgua

SEQ ID NO: 848177 - RNA, 17 nt, Homo sapiens
acaugucuugcuaacag

SEQ ID NO: 848178 - RNA, 13 nt, Homo sapiens
acauuccagagaa

SEQ ID NO: 848179 - RNA, 20 nt, Homo sapiens
acauuccucaaaaugggaga

SEQ ID NO: 848180 - RNA, 18 nt, Homo sapiens
acauucguucucuaacca

SEQ ID NO: 848181 - RNA, 12 nt, Homo sapiens
acauuguagccu

SEQ ID NO: 848182 - RNA, 19 nt, Homo sapiens
acauuuccgccacaucccu

SEQ ID NO: 848183 - RNA, 15 nt, Homo sapiens
accaaaaugagaguu

SEQ ID NO: 848184 - RNA, 14 nt, Homo sapiens
accaaaaugccaaa

SEQ ID NO: 848185 - RNA, 15 nt, Homo sapiens
accaaaaugccaaaa

SEQ ID NO: 848186 - RNA, 16 nt, Homo sapiens
accaaacaucuuucag

SEQ ID NO: 848187 - RNA, 21 nt, Homo sapiens
accaaacaucuuucagcugcu

SEQ ID NO: 848188 - RNA, 20 nt, Homo sapiens
accaacugggccucugaugu

SEQ ID NO: 848189 - RNA, 20 nt, Homo sapiens
accacugaggaaucaugaaa

SEQ ID NO: 848190 - RNA, 21 nt, Homo sapiens
accagaagacaaaggcccaaa

SEQ ID NO: 848191 - RNA, 22 nt, Homo sapiens
accagauggcauccuugggacc

SEQ ID NO: 848192 - RNA, 20 nt, Homo sapiens
accagcgcccccacuccucc

SEQ ID NO: 848193 - RNA, 15 nt, Homo sapiens
accagcuuggcucag

SEQ ID NO: 848194 - RNA, 17 nt, Homo sapiens
accaggagugccuucau

SEQ ID NO: 848195 - RNA, 21 nt, Homo sapiens
accauucguacauaauacuga

SEQ ID NO: 848196 - RNA, 24 nt, Homo sapiens
accauuuuuaggaagcuagacuag

SEQ ID NO: 848197 - RNA, 18 nt, Homo sapiens
acccagaaaaucugaauu

SEQ ID NO: 848198 - RNA, 19 nt, Homo sapiens
acccagaaacaacacaauc

SEQ ID NO: 848199 - RNA, 13 nt, Homo sapiens
acccagaccugcc

SEQ ID NO: 848200 - RNA, 23 nt, Homo sapiens
acccagaccugccugucucccac

SEQ ID NO: 848201 - RNA, 20 nt, Homo sapiens
acccagaguagccaugagga

SEQ ID NO: 848202 - RNA, 14 nt, Homo sapiens
acccaggaaucuca

SEQ ID NO: 848203 - RNA, 22 nt, Homo sapiens
acccaguggcagggcacagggc

SEQ ID NO: 848204 - RNA, 19 nt, Homo sapiens
acccauccugaacugggau

SEQ ID NO: 848205 - RNA, 19 nt, Homo sapiens
acccuagcccuugcugcca

SEQ ID NO: 848206 - RNA, 20 nt, Homo sapiens
acccuagcccuugcugccac

SEQ ID NO: 848207 - RNA, 17 nt, Homo sapiens
acccuagcuauaugcau

SEQ ID NO: 848208 - RNA, 16 nt, Homo sapiens
acccucucaaguccau

SEQ ID NO: 848209 - RNA, 20 nt, Homo sapiens
acccuuccaucugauuccag

SEQ ID NO: 848210 - RNA, 21 nt, Homo sapiens
acccuuccaucugauuccagc

SEQ ID NO: 848211 - RNA, 16 nt, Homo sapiens
acccuuggagcucuga

SEQ ID NO: 848212 - RNA, 13 nt, Homo sapiens
acccuuucugcca

SEQ ID NO: 848213 - RNA, 18 nt, Homo sapiens
accgugaagauacuuugu

SEQ ID NO: 848214 - RNA, 18 nt, Homo sapiens
accuauuucccuugccuc

SEQ ID NO: 848215 - RNA, 15 nt, Homo sapiens
accucagggcauaaa

SEQ ID NO: 848216 - RNA, 17 nt, Homo sapiens
accuccccuugccagcu

SEQ ID NO: 848217 - RNA, 23 nt, Homo sapiens
accugaacugggcagacugcaaa

SEQ ID NO: 848218 - RNA, 15 nt, Homo sapiens
accugaguuccugag

SEQ ID NO: 848219 - RNA, 21 nt, Homo sapiens
accugcacacgagcagacacc

SEQ ID NO: 848220 - RNA, 13 nt, Homo sapiens
accugcaccguug

SEQ ID NO: 848221 - RNA, 23 nt, Homo sapiens
accugcuguuggaugcagcaaua

SEQ ID NO: 848222 - RNA, 16 nt, Homo sapiens
accugucgcacccacu

SEQ ID NO: 848223 - RNA, 18 nt, Homo sapiens
accuuaaaugcugagauc

SEQ ID NO: 848224 - RNA, 24 nt, Homo sapiens
accuuugguacaugccuguuaaua

SEQ ID NO: 848225 - RNA, 17 nt, Homo sapiens
acgcugacuacagggcc

SEQ ID NO: 848226 - RNA, 20 nt, Homo sapiens
acggauccugcacugacucu

SEQ ID NO: 848227 - RNA, 16 nt, Homo sapiens
acguauaauauguaca

SEQ ID NO: 848228 - RNA, 18 nt, Homo sapiens
acgugcacaaauucaugu

SEQ ID NO: 848229 - RNA, 12 nt, Homo sapiens
acgugucagggc

SEQ ID NO: 848230 - RNA, 15 nt, Homo sapiens
acuaaaaauaucaca

SEQ ID NO: 848231 - RNA, 21 nt, Homo sapiens
acuaaauguacagauaugcaa

SEQ ID NO: 848232 - RNA, 22 nt, Homo sapiens
acuaacaaaguuuucaugugcu

SEQ ID NO: 848233 - RNA, 15 nt, Homo sapiens
acuacacacaccaga

SEQ ID NO: 848234 - RNA, 15 nt, Homo sapiens
acuagaaucagauac

SEQ ID NO: 848235 - RNA, 20 nt, Homo sapiens
acuagacugccacaaggaag

SEQ ID NO: 848236 - RNA, 14 nt, Homo sapiens
acuagauuacauuc

SEQ ID NO: 848237 - RNA, 18 nt, Homo sapiens
acuaucuuuguguugcag

SEQ ID NO: 848238 - RNA, 23 nt, Homo sapiens
acuauuaaguaugucaacagcca

SEQ ID NO: 848239 - RNA, 16 nt, Homo sapiens
acuauuuacaaggaug

SEQ ID NO: 848240 - RNA, 12 nt, Homo sapiens
acucacagccag

SEQ ID NO: 848241 - RNA, 23 nt, Homo sapiens
acucacuguguggccucagagaa

SEQ ID NO: 848242 - RNA, 18 nt, Homo sapiens
acucagaaaagacgcacc

SEQ ID NO: 848243 - RNA, 19 nt, Homo sapiens
acuccaaaccuuacucuga

SEQ ID NO: 848244 - RNA, 21 nt, Homo sapiens
acuccucucguacuugaacuc

SEQ ID NO: 848245 - RNA, 16 nt, Homo sapiens
acucuaggacucugca

SEQ ID NO: 848246 - RNA, 16 nt, Homo sapiens
acucuaguacugugaa

SEQ ID NO: 848247 - RNA, 15 nt, Homo sapiens
acucucuuccuuuca

SEQ ID NO: 848248 - RNA, 16 nt, Homo sapiens
acucucuuccuuucau

SEQ ID NO: 848249 - RNA, 15 nt, Homo sapiens
acucugaaugcauga

SEQ ID NO: 848250 - RNA, 16 nt, Homo sapiens
acucugcagacugaaa

SEQ ID NO: 848251 - RNA, 16 nt, Homo sapiens
acucuucucauuacuu

SEQ ID NO: 848252 - RNA, 19 nt, Homo sapiens
acucuugggacauccuguc

SEQ ID NO: 848253 - RNA, 18 nt, Homo sapiens
acucuuggggaccaaaua

SEQ ID NO: 848254 - RNA, 20 nt, Homo sapiens
acugaaauguggaugugauu

SEQ ID NO: 848255 - RNA, 15 nt, Homo sapiens
acugaaccacuugua

SEQ ID NO: 848256 - RNA, 19 nt, Homo sapiens
acugaaccacuuguagauu

SEQ ID NO: 848257 - RNA, 24 nt, Homo sapiens
acugaaucuggaccccaucuguga

SEQ ID NO: 848258 - RNA, 13 nt, Homo sapiens
acugacucuggaa

SEQ ID NO: 848259 - RNA, 15 nt, Homo sapiens
acugacugaacugua

SEQ ID NO: 848260 - RNA, 22 nt, Homo sapiens
acugacugcuuauaaacauuua

SEQ ID NO: 848261 - RNA, 20 nt, Homo sapiens
acugauuacguuuacauucu

SEQ ID NO: 848262 - RNA, 14 nt, Homo sapiens
acugcaaugccagg

SEQ ID NO: 848263 - RNA, 15 nt, Homo sapiens
acugcacccaugaga

SEQ ID NO: 848264 - RNA, 20 nt, Homo sapiens
acugcucuccccacccagac

SEQ ID NO: 848265 - RNA, 22 nt, Homo sapiens
acugcugggcuccacuuggcuc

SEQ ID NO: 848266 - RNA, 18 nt, Homo sapiens
acuguaccccagcucucu

SEQ ID NO: 848267 - RNA, 19 nt, Homo sapiens
acuguccuaggcuucugau

SEQ ID NO: 848268 - RNA, 19 nt, Homo sapiens
acugugaaaguuggaauau

SEQ ID NO: 848269 - RNA, 21 nt, Homo sapiens
acugugacuuuauuagcagcu

SEQ ID NO: 848270 - RNA, 13 nt, Homo sapiens
acugugguagcca

SEQ ID NO: 848271 - RNA, 22 nt, Homo sapiens
acuguuuuguauaugcugcauu

SEQ ID NO: 848272 - RNA, 22 nt, Homo sapiens
acuuagaccaaaagcaacauuc

SEQ ID NO: 848273 - RNA, 23 nt, Homo sapiens
acuuccuuggaaaucaaauguaa

SEQ ID NO: 848274 - RNA, 23 nt, Homo sapiens
acuuguguaguccuaugcaauaa

SEQ ID NO: 848275 - RNA, 22 nt, Homo sapiens
acuuguugccuauaagccaaaa

SEQ ID NO: 848276 - RNA, 17 nt, Homo sapiens
acuuuaaaacugcucau

SEQ ID NO: 848277 - RNA, 21 nt, Homo sapiens
acuuuaaaacugcucauuuca

SEQ ID NO: 848278 - RNA, 12 nt, Homo sapiens
acuuucugugua

SEQ ID NO: 848279 - RNA, 21 nt, Homo sapiens
acuuucuguguaccacuggga

SEQ ID NO: 848280 - RNA, 12 nt, Homo sapiens
acuuugcauuac

SEQ ID NO: 848281 - RNA, 15 nt, Homo sapiens
acuuuuucauuucca

SEQ ID NO: 848282 - RNA, 13 nt, Homo sapiens
agaaaaccaaaca

SEQ ID NO: 848283 - RNA, 13 nt, Homo sapiens
agaaaaccuggag

SEQ ID NO: 848284 - RNA, 23 nt, Homo sapiens
agaaagagccuuggccuuaagga

SEQ ID NO: 848285 - RNA, 14 nt, Homo sapiens
agaaauacuguauu

SEQ ID NO: 848286 - RNA, 14 nt, Homo sapiens
agaaaucugcugca

SEQ ID NO: 848287 - RNA, 21 nt, Homo sapiens
agaaauggaacccccagccca

SEQ ID NO: 848288 - RNA, 11 nt, Homo sapiens
agaacacaaga

SEQ ID NO: 848289 - RNA, 19 nt, Homo sapiens
ugucuuaauuuucuuucac

SEQ ID NO: 848290 - RNA, 11 nt, Homo sapiens
ugugaccucac

SEQ ID NO: 848291 - RNA, 18 nt, Homo sapiens
ugugaccucacgugcaaa

SEQ ID NO: 848292 - RNA, 17 nt, Homo sapiens
ugugagagccugugauc

SEQ ID NO: 848293 - RNA, 13 nt, Homo sapiens
ugugccaccuccc

SEQ ID NO: 848294 - RNA, 22 nt, Homo sapiens
uguggagucauuucugauuuca

SEQ ID NO: 848295 - RNA, 13 nt, Homo sapiens
uguggcacuggga

SEQ ID NO: 848296 - RNA, 19 nt, Homo sapiens
uguggugucuguguuccaa

SEQ ID NO: 848297 - RNA, 20 nt, Homo sapiens
ugugguuucucuggcccuga

SEQ ID NO: 848298 - RNA, 19 nt, Homo sapiens
uguguaagaaauacagacu

SEQ ID NO: 848299 - RNA, 13 nt, Homo sapiens
ugugucccaaaaa

SEQ ID NO: 848300 - RNA, 16 nt, Homo sapiens
uguguggggaucucaa

SEQ ID NO: 848301 - RNA, 18 nt, Homo sapiens
uguuaaaggucauaugca

SEQ ID NO: 848302 - RNA, 17 nt, Homo sapiens
uguuaccguucaccagu

SEQ ID NO: 848303 - RNA, 18 nt, Homo sapiens
uguuacuggccaaggcua

SEQ ID NO: 848304 - RNA, 14 nt, Homo sapiens
uguucacuaccugu

SEQ ID NO: 848305 - RNA, 18 nt, Homo sapiens
uguucauacugauguguu

SEQ ID NO: 848306 - RNA, 18 nt, Homo sapiens
uguugagaggaacaagaa

SEQ ID NO: 848307 - RNA, 21 nt, Homo sapiens
uguugcagccucaaccaacaa

SEQ ID NO: 848308 - RNA, 20 nt, Homo sapiens
uguuggggaggggaauggga

SEQ ID NO: 848309 - RNA, 18 nt, Homo sapiens
uguugucucugcucuucc

SEQ ID NO: 848310 - RNA, 14 nt, Homo sapiens
uguuuaaaaguaau

SEQ ID NO: 848311 - RNA, 15 nt, Homo sapiens
uguuuaaagugaauu

SEQ ID NO: 848312 - RNA, 21 nt, Homo sapiens
uguuucuuucucugaggacaa

SEQ ID NO: 848313 - RNA, 12 nt, Homo sapiens
uguuuuuggaca

SEQ ID NO: 848314 - RNA, 23 nt, Homo sapiens
uuaaaaagauaaaaaaacagcuu

SEQ ID NO: 848315 - RNA, 16 nt, Homo sapiens
uuaaaacaucaauuga

SEQ ID NO: 848316 - RNA, 12 nt, Homo sapiens
uuaaaacaucau

SEQ ID NO: 848317 - RNA, 14 nt, Homo sapiens
uuaaaauaacuaac

SEQ ID NO: 848318 - RNA, 16 nt, Homo sapiens
agaauguuuuagcaca

SEQ ID NO: 848319 - RNA, 17 nt, Homo sapiens
agacaaagcauucuaaa

SEQ ID NO: 848320 - RNA, 13 nt, Homo sapiens
agacagaccacuu

SEQ ID NO: 848321 - RNA, 21 nt, Homo sapiens
agacagacuagaaguuccuag

SEQ ID NO: 848322 - RNA, 15 nt, Homo sapiens
agacagacucugaau

SEQ ID NO: 848323 - RNA, 14 nt, Homo sapiens
agaccaaaagcaac

SEQ ID NO: 848324 - RNA, 22 nt, Homo sapiens
agaccaauuuuuugugugugaa

SEQ ID NO: 848325 - RNA, 19 nt, Homo sapiens
agaccagccccaccaugca

SEQ ID NO: 848326 - RNA, 17 nt, Homo sapiens
agacccuggugcugcca

SEQ ID NO: 848327 - RNA, 14 nt, Homo sapiens
agacccuuauuuaa

SEQ ID NO: 848328 - RNA, 19 nt, Homo sapiens
agaccugccugucucccac

SEQ ID NO: 848329 - RNA, 19 nt, Homo sapiens
agacgcucauucagcaucu

SEQ ID NO: 848330 - RNA, 16 nt, Homo sapiens
agacugcuugacaaag

SEQ ID NO: 848331 - RNA, 16 nt, Homo sapiens
agacugguuugggcaa

SEQ ID NO: 848332 - RNA, 16 nt, Homo sapiens
agacuuguauauucua

SEQ ID NO: 848333 - RNA, 16 nt, Homo sapiens
agagaaguacuaucuu

SEQ ID NO: 848334 - RNA, 16 nt, Homo sapiens
agagacugcuugacaa

SEQ ID NO: 848335 - RNA, 22 nt, Homo sapiens
agagagaagagccccacucuca

SEQ ID NO: 848336 - RNA, 16 nt, Homo sapiens
agagaggccacacuac

SEQ ID NO: 848337 - RNA, 9 nt, Homo sapiens
agagccaau

SEQ ID NO: 848338 - RNA, 14 nt, Homo sapiens
agagccugugaucc

SEQ ID NO: 848339 - RNA, 22 nt, Homo sapiens
agagcuaaggccaaugggcuag

SEQ ID NO: 848340 - RNA, 19 nt, Homo sapiens
agaggccccaauaccccau

SEQ ID NO: 848341 - RNA, 15 nt, Homo sapiens
agagggccucaucuc

SEQ ID NO: 848342 - RNA, 16 nt, Homo sapiens
agagggccucaucuca

SEQ ID NO: 848343 - RNA, 11 nt, Homo sapiens
agagugcagug

SEQ ID NO: 848344 - RNA, 18 nt, Homo sapiens
agagugguacaagggaga

SEQ ID NO: 848345 - RNA, 21 nt, Homo sapiens
agauacuauuuauaaguugaa

SEQ ID NO: 848346 - RNA, 18 nt, Homo sapiens
agauaugaagaaucugcu

SEQ ID NO: 848347 - RNA, 23 nt, Homo sapiens
agaucucuucccuccugcuccca

SEQ ID NO: 848348 - RNA, 19 nt, Homo sapiens
agaugggaaagaaccacac

SEQ ID NO: 848349 - RNA, 22 nt, Homo sapiens
agauucuuuuaugugaugcugg

SEQ ID NO: 848350 - RNA, 14 nt, Homo sapiens
agauuucauguuau

SEQ ID NO: 848351 - RNA, 18 nt, Homo sapiens
agcaaaaucagaaguaua

SEQ ID NO: 848352 - RNA, 19 nt, Homo sapiens
agcaaaaucagaaguauau

SEQ ID NO: 848353 - RNA, 14 nt, Homo sapiens
agcaaacuuugcau

SEQ ID NO: 848354 - RNA, 20 nt, Homo sapiens
agcaaagcuagguagccauu

SEQ ID NO: 848355 - RNA, 14 nt, Homo sapiens
agcaaauggccuca

SEQ ID NO: 848356 - RNA, 21 nt, Homo sapiens
agcaaauggccucaugucaaa

SEQ ID NO: 848357 - RNA, 12 nt, Homo sapiens
agcaagagccaa

SEQ ID NO: 848358 - RNA, 16 nt, Homo sapiens
agcaagugugaauacu

SEQ ID NO: 848359 - RNA, 13 nt, Homo sapiens
agcaauaaaagac

SEQ ID NO: 848360 - RNA, 21 nt, Homo sapiens
agcacuaaucccccucugccc

SEQ ID NO: 848361 - RNA, 21 nt, Homo sapiens
agcagaaggcaggaccaugag

SEQ ID NO: 848362 - RNA, 19 nt, Homo sapiens
agcagacaucaagcucaag

SEQ ID NO: 848363 - RNA, 21 nt, Homo sapiens
agcagacaucaagcucaaggc

SEQ ID NO: 848364 - RNA, 17 nt, Homo sapiens
agcagaggcugcaggaa

SEQ ID NO: 848365 - RNA, 23 nt, Homo sapiens
agcagcgcggauuucucuuucuc

SEQ ID NO: 848366 - RNA, 16 nt, Homo sapiens
agcaggucccugugag

SEQ ID NO: 848367 - RNA, 15 nt, Homo sapiens
agcauaaagaauuug

SEQ ID NO: 848368 - RNA, 16 nt, Homo sapiens
agcauagucuuauuaa

SEQ ID NO: 848369 - RNA, 18 nt, Homo sapiens
agcaucacuuaaaacacg

SEQ ID NO: 848370 - RNA, 15 nt, Homo sapiens
agcauccacgucaau

SEQ ID NO: 848371 - RNA, 16 nt, Homo sapiens
agcaucuaaggacaag

SEQ ID NO: 848372 - RNA, 16 nt, Homo sapiens
agcauggaugucaagu

SEQ ID NO: 848373 - RNA, 18 nt, Homo sapiens
agcauuuucaaugugaua

SEQ ID NO: 848374 - RNA, 14 nt, Homo sapiens
agccaagaggcagu

SEQ ID NO: 848375 - RNA, 12 nt, Homo sapiens
agccaccacuga

SEQ ID NO: 848376 - RNA, 22 nt, Homo sapiens
agccauuugggagaagaucuca

SEQ ID NO: 848377 - RNA, 13 nt, Homo sapiens
agccccacucuca

SEQ ID NO: 848378 - RNA, 20 nt, Homo sapiens
agcccgcaucagcugcucag

SEQ ID NO: 848379 - RNA, 16 nt, Homo sapiens
agcccuauuucuugau

SEQ ID NO: 848380 - RNA, 14 nt, Homo sapiens
agcccuugcugcca

SEQ ID NO: 848381 - RNA, 16 nt, Homo sapiens
agccucugaucugugc

SEQ ID NO: 848382 - RNA, 22 nt, Homo sapiens
agccucuggaauggcucaggga

SEQ ID NO: 848383 - RNA, 14 nt, Homo sapiens
agccugagagucua

SEQ ID NO: 848384 - RNA, 17 nt, Homo sapiens
agccugugggcaggcag

SEQ ID NO: 848385 - RNA, 19 nt, Homo sapiens
agcuaauaacaugugaaaa

SEQ ID NO: 848386 - RNA, 19 nt, Homo sapiens
agcuagcagaucucuuccc

SEQ ID NO: 848387 - RNA, 14 nt, Homo sapiens
agcuaugcaaaaag

SEQ ID NO: 848388 - RNA, 16 nt, Homo sapiens
agcuaugcaaaaagcu

SEQ ID NO: 848389 - RNA, 18 nt, Homo sapiens
agcucaauaaaagaaucu

SEQ ID NO: 848390 - RNA, 21 nt, Homo sapiens
agcucaauaaaagaaucugau

SEQ ID NO: 848391 - RNA, 20 nt, Homo sapiens
agcucacuguggugucugug

SEQ ID NO: 848392 - RNA, 14 nt, Homo sapiens
agcucuacagguga

SEQ ID NO: 848393 - RNA, 17 nt, Homo sapiens
agcucucuauaccaaag

SEQ ID NO: 848394 - RNA, 18 nt, Homo sapiens
agcugaaagaggccaaac

SEQ ID NO: 848395 - RNA, 22 nt, Homo sapiens
agcugaaaugguccaguacaaa

SEQ ID NO: 848396 - RNA, 19 nt, Homo sapiens
agcugcauuugucuggccu

SEQ ID NO: 848397 - RNA, 12 nt, Homo sapiens
agcugggaccac

SEQ ID NO: 848398 - RNA, 15 nt, Homo sapiens
agcuuaauggaugua

SEQ ID NO: 848399 - RNA, 22 nt, Homo sapiens
agcuuccucuucuaccauuucc

SEQ ID NO: 848400 - RNA, 22 nt, Homo sapiens
agcuugaggggucugcagucca

SEQ ID NO: 848401 - RNA, 15 nt, Homo sapiens
agcuuguugaaaaag

SEQ ID NO: 848402 - RNA, 18 nt, Homo sapiens
agcuuuggugcaucucau

SEQ ID NO: 848403 - RNA, 13 nt, Homo sapiens
aggaaaggacuga

SEQ ID NO: 848404 - RNA, 22 nt, Homo sapiens
aggaaauaccaguucugggcaa

SEQ ID NO: 848405 - RNA, 23 nt, Homo sapiens
aggaaaugucuuuagagcacagg

SEQ ID NO: 848406 - RNA, 16 nt, Homo sapiens
aggacaaucuagcucu

SEQ ID NO: 848407 - RNA, 21 nt, Homo sapiens
aggacuuguuucccuuuccug

SEQ ID NO: 848408 - RNA, 22 nt, Homo sapiens
aggagcaggcccugggccucca

SEQ ID NO: 848409 - RNA, 18 nt, Homo sapiens
aggagcuagaacauucca

SEQ ID NO: 848410 - RNA, 14 nt, Homo sapiens
aggagcucacugug

SEQ ID NO: 848411 - RNA, 14 nt, Homo sapiens
aggaggaugugcug

SEQ ID NO: 848412 - RNA, 15 nt, Homo sapiens
aggcagaaagcaaaa

SEQ ID NO: 848413 - RNA, 14 nt, Homo sapiens
aggcagcagugggu

SEQ ID NO: 848414 - RNA, 21 nt, Homo sapiens
aggcaggaaacuaacuggugu

SEQ ID NO: 848415 - RNA, 16 nt, Homo sapiens
aggcaggaccaugagg

SEQ ID NO: 848416 - RNA, 15 nt, Homo sapiens
aggcagggcaagaac

SEQ ID NO: 848417 - RNA, 21 nt, Homo sapiens
aggcagggguuccagcacaaa

SEQ ID NO: 848418 - RNA, 14 nt, Homo sapiens
aggcaucaaucugg

SEQ ID NO: 848419 - RNA, 15 nt, Homo sapiens
aggccaagaguggcc

SEQ ID NO: 848420 - RNA, 14 nt, Homo sapiens
aggccaaucagaag

SEQ ID NO: 848421 - RNA, 15 nt, Homo sapiens
aggccacacccagag

SEQ ID NO: 848422 - RNA, 22 nt, Homo sapiens
aggccaccuccuaaaaggccca

SEQ ID NO: 848423 - RNA, 22 nt, Homo sapiens
aggcccacccugcuuggcccag

SEQ ID NO: 848424 - RNA, 20 nt, Homo sapiens
aggccuacaugcuuugugaa

SEQ ID NO: 848425 - RNA, 13 nt, Homo sapiens
aggccuauuuuca

SEQ ID NO: 848426 - RNA, 15 nt, Homo sapiens
aggcugcugccaggc

SEQ ID NO: 848427 - RNA, 17 nt, Homo sapiens
agggaacugagcacagg

SEQ ID NO: 848428 - RNA, 19 nt, Homo sapiens
agggaacugagcacagggg

SEQ ID NO: 848429 - RNA, 17 nt, Homo sapiens
agggcaggcccccgggg

SEQ ID NO: 848430 - RNA, 19 nt, Homo sapiens
agggcucugacucugccag

SEQ ID NO: 848431 - RNA, 16 nt, Homo sapiens
agggcugggucagggg

SEQ ID NO: 848432 - RNA, 14 nt, Homo sapiens
aggggaggcucagg

SEQ ID NO: 848433 - RNA, 16 nt, Homo sapiens
aggggccagacccugc

SEQ ID NO: 848434 - RNA, 23 nt, Homo sapiens
aggguacaaaaaauucagugaug

SEQ ID NO: 848435 - RNA, 17 nt, Homo sapiens
agggucucuagugcugu

SEQ ID NO: 848436 - RNA, 18 nt, Homo sapiens
agggugguuuaccugcac

SEQ ID NO: 848437 - RNA, 18 nt, Homo sapiens
aggguuaauguguggcau

SEQ ID NO: 848438 - RNA, 16 nt, Homo sapiens
aggucccugugagcac

SEQ ID NO: 848439 - RNA, 16 nt, Homo sapiens
agguggcaggugagca

SEQ ID NO: 848440 - RNA, 16 nt, Homo sapiens
agguucaaugagaugg

SEQ ID NO: 848441 - RNA, 15 nt, Homo sapiens
aguaagucucaaggu

SEQ ID NO: 848442 - RNA, 20 nt, Homo sapiens
aguacuaucuuuguguugca

SEQ ID NO: 848443 - RNA, 23 nt, Homo sapiens
aguacuccuuaaaauaaaacacu

SEQ ID NO: 848444 - RNA, 18 nt, Homo sapiens
caaaugcccccugaguga

SEQ ID NO: 848445 - RNA, 23 nt, Homo sapiens
caaauuagacaaccaaguaugaa

SEQ ID NO: 848446 - RNA, 15 nt, Homo sapiens
caaauucaugugccg

SEQ ID NO: 848447 - RNA, 19 nt, Homo sapiens
caaauugcugggauuacag

SEQ ID NO: 848448 - RNA, 23 nt, Homo sapiens
caaauuugugaacugucaugaua

SEQ ID NO: 848449 - RNA, 20 nt, Homo sapiens
caacacaucucccuuuucca

SEQ ID NO: 848450 - RNA, 16 nt, Homo sapiens
caaccaacaacaaugu

SEQ ID NO: 848451 - RNA, 12 nt, Homo sapiens
caaccacaaaac

SEQ ID NO: 848452 - RNA, 18 nt, Homo sapiens
caaccccaggcuacugag

SEQ ID NO: 848453 - RNA, 14 nt, Homo sapiens
caaccucacaggau

SEQ ID NO: 848454 - RNA, 17 nt, Homo sapiens
caacugaaagaaaaagu

SEQ ID NO: 848455 - RNA, 14 nt, Homo sapiens
caacugaauagcaa

SEQ ID NO: 848456 - RNA, 15 nt, Homo sapiens
caacugggccucuga

SEQ ID NO: 848457 - RNA, 20 nt, Homo sapiens
caacugggggaaucaaauca

SEQ ID NO: 848458 - RNA, 11 nt, Homo sapiens
caacuugcaag

SEQ ID NO: 848459 - RNA, 21 nt, Homo sapiens
caagaacagaaguguucacau

SEQ ID NO: 848460 - RNA, 20 nt, Homo sapiens
caagaagguggaaggcagug

SEQ ID NO: 848461 - RNA, 23 nt, Homo sapiens
caagacagcauuuguguguuaca

SEQ ID NO: 848462 - RNA, 18 nt, Homo sapiens
caagacuuauuuucacau

SEQ ID NO: 848463 - RNA, 16 nt, Homo sapiens
caagagaaguacuauc

SEQ ID NO: 848464 - RNA, 10 nt, Homo sapiens
caagagggug

SEQ ID NO: 848465 - RNA, 20 nt, Homo sapiens
caagagucuggggaccagcu

SEQ ID NO: 848466 - RNA, 12 nt, Homo sapiens
caagcaggcacu

SEQ ID NO: 848467 - RNA, 13 nt, Homo sapiens
caagcgagucacg

SEQ ID NO: 848468 - RNA, 22 nt, Homo sapiens
caagcgugucaggcugucagug

SEQ ID NO: 848469 - RNA, 15 nt, Homo sapiens
caaggaagaaauuaa

SEQ ID NO: 848470 - RNA, 18 nt, Homo sapiens
caaggauccagacucuca

SEQ ID NO: 848471 - RNA, 10 nt, Homo sapiens
caaguagcca

SEQ ID NO: 848472 - RNA, 13 nt, Homo sapiens
caaguccaucaag

SEQ ID NO: 848473 - RNA, 17 nt, Homo sapiens
caagucucgcuacauuu

SEQ ID NO: 848474 - RNA, 15 nt, Homo sapiens
caagucuguggcuug

SEQ ID NO: 848475 - RNA, 13 nt, Homo sapiens
caaguggcucauc

SEQ ID NO: 848476 - RNA, 15 nt, Homo sapiens
caaguguauuguaau

SEQ ID NO: 848477 - RNA, 21 nt, Homo sapiens
caagugugaauacugcuugaa

SEQ ID NO: 848478 - RNA, 14 nt, Homo sapiens
caauaaauuugcuu

SEQ ID NO: 848479 - RNA, 15 nt, Homo sapiens
caauaacaguagugu

SEQ ID NO: 848480 - RNA, 21 nt, Homo sapiens
caauaauaaguccaucuguca

SEQ ID NO: 848481 - RNA, 21 nt, Homo sapiens
caauagaacaguuuacuugga

SEQ ID NO: 848482 - RNA, 17 nt, Homo sapiens
caauauaaaaacauuca

SEQ ID NO: 848483 - RNA, 14 nt, Homo sapiens
caaucagguagcuu

SEQ ID NO: 848484 - RNA, 14 nt, Homo sapiens
caaucuuacuuugu

SEQ ID NO: 848485 - RNA, 15 nt, Homo sapiens
caaucuuacuuugua

SEQ ID NO: 848486 - RNA, 21 nt, Homo sapiens
caaugcuguuuggguuuccaa

SEQ ID NO: 848487 - RNA, 14 nt, Homo sapiens
caaugguuucacau

SEQ ID NO: 848488 - RNA, 19 nt, Homo sapiens
caauucucgauucuuugaa

SEQ ID NO: 848489 - RNA, 21 nt, Homo sapiens
cacaaaaguccacugaugcaa

SEQ ID NO: 848490 - RNA, 23 nt, Homo sapiens
cacaaggggaaggguacugaaaa

SEQ ID NO: 848491 - RNA, 15 nt, Homo sapiens
cacacaaguuugaga

SEQ ID NO: 848492 - RNA, 13 nt, Homo sapiens
cacacgcaguauu

SEQ ID NO: 848493 - RNA, 16 nt, Homo sapiens
cacacuggagugaaug

SEQ ID NO: 848494 - RNA, 16 nt, Homo sapiens
cacacugugaaccacu

SEQ ID NO: 848495 - RNA, 19 nt, Homo sapiens
cacagaaggggacugccac

SEQ ID NO: 848496 - RNA, 21 nt, Homo sapiens
cacagauccccauggucuuca

SEQ ID NO: 848497 - RNA, 16 nt, Homo sapiens
cacagcccauaauuca

SEQ ID NO: 848498 - RNA, 22 nt, Homo sapiens
cacaggcugggcugggcacugc

SEQ ID NO: 848499 - RNA, 22 nt, Homo sapiens
cacauauuuugacccaagugga

SEQ ID NO: 848500 - RNA, 15 nt, Homo sapiens
cacaucccucucugc

SEQ ID NO: 848501 - RNA, 15 nt, Homo sapiens
cacaugguaccugga

SEQ ID NO: 848502 - RNA, 21 nt, Homo sapiens
cacauguugauuuccuaugua

SEQ ID NO: 848503 - RNA, 14 nt, Homo sapiens
cacauugcauagua

SEQ ID NO: 848504 - RNA, 20 nt, Homo sapiens
caccagcccagaagugcaga

SEQ ID NO: 848505 - RNA, 12 nt, Homo sapiens
caccaguagcag

SEQ ID NO: 848506 - RNA, 14 nt, Homo sapiens
caccaguugccguu

SEQ ID NO: 848507 - RNA, 14 nt, Homo sapiens
cacccuuucuggca

SEQ ID NO: 848508 - RNA, 16 nt, Homo sapiens
caccuaaguacuuaaa

SEQ ID NO: 848509 - RNA, 16 nt, Homo sapiens
caccucagggcauaaa

SEQ ID NO: 848510 - RNA, 20 nt, Homo sapiens
caccuguaauuccagcacuu

SEQ ID NO: 848511 - RNA, 21 nt, Homo sapiens
caccugucgcacccacuguga

SEQ ID NO: 848512 - RNA, 12 nt, Homo sapiens
cacgcaguauug

SEQ ID NO: 848513 - RNA, 22 nt, Homo sapiens
cacguugugaugaagcugaggc

SEQ ID NO: 848514 - RNA, 16 nt, Homo sapiens
cacuaagaggaggcag

SEQ ID NO: 848515 - RNA, 22 nt, Homo sapiens
cacuaauguuuuggucugaaaa

SEQ ID NO: 848516 - RNA, 15 nt, Homo sapiens
cacucagacuguaua

SEQ ID NO: 848517 - RNA, 14 nt, Homo sapiens
cacucccauggcuc

SEQ ID NO: 848518 - RNA, 19 nt, Homo sapiens
cacucuugggcuuggccca

SEQ ID NO: 848519 - RNA, 20 nt, Homo sapiens
cacuuggagcuaaaacuggc

SEQ ID NO: 848520 - RNA, 21 nt, Homo sapiens
cacuuggagcuaaaacuggcc

SEQ ID NO: 848521 - RNA, 20 nt, Homo sapiens
cagaacuucccuccauccac

SEQ ID NO: 848522 - RNA, 22 nt, Homo sapiens
cagaaggcaauaccaaccugaa

SEQ ID NO: 848523 - RNA, 13 nt, Homo sapiens
cagaaggcuuuuu

SEQ ID NO: 848524 - RNA, 21 nt, Homo sapiens
cagaaggggacugccaccucc

SEQ ID NO: 848525 - RNA, 18 nt, Homo sapiens
cagaaguguucacauggc

SEQ ID NO: 848526 - RNA, 22 nt, Homo sapiens
cagaauauucuuuuuauauucu

SEQ ID NO: 848527 - RNA, 15 nt, Homo sapiens
cagacaccacagccu

SEQ ID NO: 848528 - RNA, 20 nt, Homo sapiens
cagacaucaagcucaaggca

SEQ ID NO: 848529 - RNA, 14 nt, Homo sapiens
cagacgcucauuca

SEQ ID NO: 848530 - RNA, 15 nt, Homo sapiens
cagacugaaaagaca

SEQ ID NO: 848531 - RNA, 23 nt, Homo sapiens
cagacuuuuaaagacuugcacaa

SEQ ID NO: 848532 - RNA, 21 nt, Homo sapiens
cagacuuuuuuuaaaaagaua

SEQ ID NO: 848533 - RNA, 20 nt, Homo sapiens
cagagacccuggugcugcca

SEQ ID NO: 848534 - RNA, 23 nt, Homo sapiens
cagagagguaaaauggaggccag

SEQ ID NO: 848535 - RNA, 21 nt, Homo sapiens
cagagauggcaguugcuuccu

SEQ ID NO: 848536 - RNA, 20 nt, Homo sapiens
cagaggauaucggcauuugu

SEQ ID NO: 848537 - RNA, 16 nt, Homo sapiens
cagagggccucaucuc

SEQ ID NO: 848538 - RNA, 18 nt, Homo sapiens
cagauauuaauaauucca

SEQ ID NO: 848539 - RNA, 15 nt, Homo sapiens
cagaugcagcacaua

SEQ ID NO: 848540 - RNA, 19 nt, Homo sapiens
cagauuugcucaaagcaau

SEQ ID NO: 848541 - RNA, 14 nt, Homo sapiens
cagcacuucaggag

SEQ ID NO: 848542 - RNA, 22 nt, Homo sapiens
cagcagccucugaucugugcag

SEQ ID NO: 848543 - RNA, 11 nt, Homo sapiens
cagcaggcacu

SEQ ID NO: 848544 - RNA, 21 nt, Homo sapiens
cagcaucugaccucuaccuuc

SEQ ID NO: 848545 - RNA, 23 nt, Homo sapiens
cagcaucugaccucuaccuucau

SEQ ID NO: 848546 - RNA, 21 nt, Homo sapiens
cagcccucccugccgcugccu

SEQ ID NO: 848547 - RNA, 15 nt, Homo sapiens
cagcccucucuugcc

SEQ ID NO: 848548 - RNA, 12 nt, Homo sapiens
cagcccuuucag

SEQ ID NO: 848549 - RNA, 15 nt, Homo sapiens
cagccuagauaugaa

SEQ ID NO: 848550 - RNA, 15 nt, Homo sapiens
cagccugggugcaca

SEQ ID NO: 848551 - RNA, 23 nt, Homo sapiens
cagcuaagggagggccuggggag

SEQ ID NO: 848552 - RNA, 19 nt, Homo sapiens
cagcuuccccaguagcugg

SEQ ID NO: 848553 - RNA, 20 nt, Homo sapiens
cagcuuuagcaaagaacucu

SEQ ID NO: 848554 - RNA, 14 nt, Homo sapiens
cagcuuuugccuuu

SEQ ID NO: 848555 - RNA, 13 nt, Homo sapiens
caggaaacuaacu

SEQ ID NO: 848556 - RNA, 16 nt, Homo sapiens
caggaagaaagggaaa

SEQ ID NO: 848557 - RNA, 16 nt, Homo sapiens
caggaaggcuucuugc

SEQ ID NO: 848558 - RNA, 13 nt, Homo sapiens
caggaaucucaaa

SEQ ID NO: 848559 - RNA, 17 nt, Homo sapiens
caggauugucacuccaa

SEQ ID NO: 848560 - RNA, 23 nt, Homo sapiens
caggauugucacuccaaaccuua

SEQ ID NO: 848561 - RNA, 17 nt, Homo sapiens
caggcacugaagcugcg

SEQ ID NO: 848562 - RNA, 20 nt, Homo sapiens
cagggcguggagagcccuca

SEQ ID NO: 848563 - RNA, 18 nt, Homo sapiens
cagggcugggucaggggu

SEQ ID NO: 848564 - RNA, 15 nt, Homo sapiens
caggggaagcucuca

SEQ ID NO: 848565 - RNA, 21 nt, Homo sapiens
caggggagauccuuguguuua

SEQ ID NO: 848566 - RNA, 21 nt, Homo sapiens
cagggggccuccaggagaccc

SEQ ID NO: 848567 - RNA, 20 nt, Homo sapiens
caggucccugugagcacaua

SEQ ID NO: 848568 - RNA, 17 nt, Homo sapiens
caggugcccgccaccac

SEQ ID NO: 848569 - RNA, 23 nt, Homo sapiens
caguagcagccuacaacugaaua

SEQ ID NO: 848570 - RNA, 15 nt, Homo sapiens
caguauuguauauga

SEQ ID NO: 848571 - RNA, 23 nt, Homo sapiens
cagucacuuugacagguuccuuu

SEQ ID NO: 848572 - RNA, 16 nt, Homo sapiens
cagugaggcaucucuc

SEQ ID NO: 848573 - RNA, 14 nt, Homo sapiens
cagugccauuucag

SEQ ID NO: 848574 - RNA, 19 nt, Homo sapiens
cagugccuuaaacucuguu

SEQ ID NO: 848575 - RNA, 13 nt, Homo sapiens
caguggcugugaa

SEQ ID NO: 848576 - RNA, 20 nt, Homo sapiens
cagugugcaauacuguguac

SEQ ID NO: 848577 - RNA, 22 nt, Homo sapiens
caguuggauucagaaccaagac

SEQ ID NO: 848578 - RNA, 15 nt, Homo sapiens
caguuguuagcauuu

SEQ ID NO: 848579 - RNA, 22 nt, Homo sapiens
caguuuaagaaguggugacauu

SEQ ID NO: 848580 - RNA, 22 nt, Homo sapiens
caguuuguuuggaagacuucua

SEQ ID NO: 848581 - RNA, 17 nt, Homo sapiens
cauaaaaguuucuuucc

SEQ ID NO: 848582 - RNA, 17 nt, Homo sapiens
cauaaagcauguuucau

SEQ ID NO: 848583 - RNA, 14 nt, Homo sapiens
cauaacuaggauua

SEQ ID NO: 848584 - RNA, 21 nt, Homo sapiens
cauaauaaauagacacuugag

SEQ ID NO: 848585 - RNA, 21 nt, Homo sapiens
cauaauacugaaccacuugua

SEQ ID NO: 848586 - RNA, 20 nt, Homo sapiens
cauaaugaauaaagugcaaa

SEQ ID NO: 848587 - RNA, 20 nt, Homo sapiens
cauacguaaaaaucucucau

SEQ ID NO: 848588 - RNA, 15 nt, Homo sapiens
cauacugauguguug

SEQ ID NO: 848589 - RNA, 17 nt, Homo sapiens
cauagaagcagugugca

SEQ ID NO: 848590 - RNA, 14 nt, Homo sapiens
cauagcacuguaua

SEQ ID NO: 848591 - RNA, 13 nt, Homo sapiens
cauagucuuauua

SEQ ID NO: 848592 - RNA, 14 nt, Homo sapiens
cauauacuagggaa

SEQ ID NO: 848593 - RNA, 22 nt, Homo sapiens
cauauauuaaagcaucaggacc

SEQ ID NO: 848594 - RNA, 15 nt, Homo sapiens
cauaucaaaacaucc

SEQ ID NO: 848595 - RNA, 15 nt, Homo sapiens
cauaugccuacaaag

SEQ ID NO: 848596 - RNA, 13 nt, Homo sapiens
caucaccaugaac

SEQ ID NO: 848597 - RNA, 22 nt, Homo sapiens
caucacugagacaaucauguac

SEQ ID NO: 848598 - RNA, 16 nt, Homo sapiens
caucacuuaaaacacg

SEQ ID NO: 848599 - RNA, 18 nt, Homo sapiens
cauccugucaucugagaa

SEQ ID NO: 848600 - RNA, 22 nt, Homo sapiens
caucgaggagcuagaacauucc

SEQ ID NO: 848601 - RNA, 18 nt, Homo sapiens
caucugaguuagguucca

SEQ ID NO: 848602 - RNA, 18 nt, Homo sapiens
caucugcacccgguacaa

SEQ ID NO: 848603 - RNA, 20 nt, Homo sapiens
caucuggacuauggguugua

SEQ ID NO: 848604 - RNA, 16 nt, Homo sapiens
caucuggguagcugua

SEQ ID NO: 848605 - RNA, 15 nt, Homo sapiens
caucuuggucuuguu

SEQ ID NO: 848606 - RNA, 14 nt, Homo sapiens
caugaagcaagaau

SEQ ID NO: 848607 - RNA, 15 nt, Homo sapiens
caugaaggaugccaa

SEQ ID NO: 848608 - RNA, 23 nt, Homo sapiens
caugaagugauauaaaagcugca

SEQ ID NO: 848609 - RNA, 21 nt, Homo sapiens
caugagacucgguccaagagu

SEQ ID NO: 848610 - RNA, 18 nt, Homo sapiens
caugaggccuccugccau

SEQ ID NO: 848611 - RNA, 13 nt, Homo sapiens
caugcauucacau

SEQ ID NO: 848612 - RNA, 18 nt, Homo sapiens
caugccuaauguuaguua

SEQ ID NO: 848613 - RNA, 22 nt, Homo sapiens
caugccuguaaucccagcacuu

SEQ ID NO: 848614 - RNA, 23 nt, Homo sapiens
cauggagaaugcaccauacucau

SEQ ID NO: 848615 - RNA, 18 nt, Homo sapiens
cauggaugcuuuggcaau

SEQ ID NO: 848616 - RNA, 19 nt, Homo sapiens
cauggaugcuuuggcaaug

SEQ ID NO: 848617 - RNA, 16 nt, Homo sapiens
cauggcaaguacagua

SEQ ID NO: 848618 - RNA, 16 nt, Homo sapiens
cauggcccaucagggg

SEQ ID NO: 848619 - RNA, 22 nt, Homo sapiens
caugggacuaugcuuuucucaa

SEQ ID NO: 848620 - RNA, 16 nt, Homo sapiens
caugggcauauucuga

SEQ ID NO: 848621 - RNA, 14 nt, Homo sapiens
caugguuacauauc

SEQ ID NO: 848622 - RNA, 21 nt, Homo sapiens
caugucguaguuacucucagg

SEQ ID NO: 848623 - RNA, 21 nt, Homo sapiens
cauuaaaauugugaugcuccu

SEQ ID NO: 848624 - RNA, 19 nt, Homo sapiens
cauuagcauugaguuuuga

SEQ ID NO: 848625 - RNA, 20 nt, Homo sapiens
cauuagugggaaaaaguggg

SEQ ID NO: 848626 - RNA, 22 nt, Homo sapiens
cauuauucucuaacuauuacac

SEQ ID NO: 848627 - RNA, 14 nt, Homo sapiens
cauucaacugaaaa

SEQ ID NO: 848628 - RNA, 14 nt, Homo sapiens
cauuccauuugcuu

SEQ ID NO: 848629 - RNA, 16 nt, Homo sapiens
cauucgcuacuaugau

SEQ ID NO: 848630 - RNA, 15 nt, Homo sapiens
cauugaauacucuga

SEQ ID NO: 848631 - RNA, 16 nt, Homo sapiens
cauugaauacucugaa

SEQ ID NO: 848632 - RNA, 15 nt, Homo sapiens
cauugccauugucau

SEQ ID NO: 848633 - RNA, 15 nt, Homo sapiens
cauuggcugccuuau

SEQ ID NO: 848634 - RNA, 19 nt, Homo sapiens
cauuuaaagacaaagacau

SEQ ID NO: 848635 - RNA, 20 nt, Homo sapiens
cauuuaggcaaauaagcacu

SEQ ID NO: 848636 - RNA, 19 nt, Homo sapiens
cauuugggagaagaucuca

SEQ ID NO: 848637 - RNA, 22 nt, Homo sapiens
cauuuguaaucuaguugucaau

SEQ ID NO: 848638 - RNA, 14 nt, Homo sapiens
cauuuucagauuca

SEQ ID NO: 848639 - RNA, 22 nt, Homo sapiens
cauuuuuaggaagcuagacuag

SEQ ID NO: 848640 - RNA, 22 nt, Homo sapiens
ccaaaaugagaguuuugcuaaa

SEQ ID NO: 848641 - RNA, 15 nt, Homo sapiens
ccaaacaucuuucag

SEQ ID NO: 848642 - RNA, 16 nt, Homo sapiens
ccaaacaucuuucagc

SEQ ID NO: 848643 - RNA, 23 nt, Homo sapiens
ccaaaccuucugacuuugccaaa

SEQ ID NO: 848644 - RNA, 11 nt, Homo sapiens
ccaacaauuca

SEQ ID NO: 848645 - RNA, 15 nt, Homo sapiens
ccaacagaacacuug

SEQ ID NO: 848646 - RNA, 18 nt, Homo sapiens
ccaacagccacucagaaa

SEQ ID NO: 848647 - RNA, 22 nt, Homo sapiens
ccaaccacaggaagcugcaauu

SEQ ID NO: 848648 - RNA, 14 nt, Homo sapiens
ccaacugucaggga

SEQ ID NO: 848649 - RNA, 20 nt, Homo sapiens
ccaaggaaauaaugugaaug

SEQ ID NO: 848650 - RNA, 18 nt, Homo sapiens
ccaagucucgcuacauuu

SEQ ID NO: 848651 - RNA, 20 nt, Homo sapiens
ccaauagaacaguuuacuug

SEQ ID NO: 848652 - RNA, 17 nt, Homo sapiens
ccaaucagguagcuuaa

SEQ ID NO: 848653 - RNA, 14 nt, Homo sapiens
ccaaucauugcaaa

SEQ ID NO: 848654 - RNA, 20 nt, Homo sapiens
ccacacuacacacaccagau

SEQ ID NO: 848655 - RNA, 23 nt, Homo sapiens
ccacagaggcuguggucagagag

SEQ ID NO: 848656 - RNA, 19 nt, Homo sapiens
ccacaggugcccgccacca

SEQ ID NO: 848657 - RNA, 12 nt, Homo sapiens
ccacauccucau

SEQ ID NO: 848658 - RNA, 20 nt, Homo sapiens
ccaccaacagccacucagaa

SEQ ID NO: 848659 - RNA, 17 nt, Homo sapiens
ccaccucgugaacacaa

SEQ ID NO: 848660 - RNA, 14 nt, Homo sapiens
ccaccuggcccucu

SEQ ID NO: 848661 - RNA, 21 nt, Homo sapiens
ccaccuucccuccucaugccu

SEQ ID NO: 848662 - RNA, 13 nt, Homo sapiens
ccaccuuucagga

SEQ ID NO: 848663 - RNA, 17 nt, Homo sapiens
ccacuuguagauuugau

SEQ ID NO: 848664 - RNA, 21 nt, Homo sapiens
ccacuuuucuauauugcagug

SEQ ID NO: 848665 - RNA, 22 nt, Homo sapiens
ccacuuuucuauauugcagugu

SEQ ID NO: 848666 - RNA, 15 nt, Homo sapiens
ccacuuuugccagac

SEQ ID NO: 848667 - RNA, 19 nt, Homo sapiens
ccagaaaucugcugcauuu

SEQ ID NO: 848668 - RNA, 22 nt, Homo sapiens
ccagaaaucugcugcauuucac

SEQ ID NO: 848669 - RNA, 13 nt, Homo sapiens
ccagaagugcaga

SEQ ID NO: 848670 - RNA, 17 nt, Homo sapiens
ccagacucucauuccuu

SEQ ID NO: 848671 - RNA, 18 nt, Homo sapiens
ccagagaacaagcacugu

SEQ ID NO: 848672 - RNA, 21 nt, Homo sapiens
ccagagcucccucugccccag

SEQ ID NO: 848673 - RNA, 17 nt, Homo sapiens
ccagagggacacuagga

SEQ ID NO: 848674 - RNA, 21 nt, Homo sapiens
ccagauuuaaccauuccauaa

SEQ ID NO: 848675 - RNA, 19 nt, Homo sapiens
ccagauuucagaaaacuga

SEQ ID NO: 848676 - RNA, 17 nt, Homo sapiens
ccagcaacacgucauug

SEQ ID NO: 848677 - RNA, 12 nt, Homo sapiens
ccagccaccacu

SEQ ID NO: 848678 - RNA, 15 nt, Homo sapiens
ccagcgcggcugcuu

SEQ ID NO: 848679 - RNA, 21 nt, Homo sapiens
ccaggaaucucaaacucccuu

SEQ ID NO: 848680 - RNA, 18 nt, Homo sapiens
ccaggagaaugcugcaau

SEQ ID NO: 848681 - RNA, 16 nt, Homo sapiens
ccaggccagagccugu

SEQ ID NO: 848682 - RNA, 17 nt, Homo sapiens
ccaggcuggagugcagu

SEQ ID NO: 848683 - RNA, 17 nt, Homo sapiens
ccagggauggcaguggc

SEQ ID NO: 848684 - RNA, 15 nt, Homo sapiens
ccagugaaaauaagc

SEQ ID NO: 848685 - RNA, 14 nt, Homo sapiens
ccaguugcugucac

SEQ ID NO: 848686 - RNA, 17 nt, Homo sapiens
ccauacucaugcaugca

SEQ ID NO: 848687 - RNA, 16 nt, Homo sapiens
ccauaucaggagaccu

SEQ ID NO: 848688 - RNA, 12 nt, Homo sapiens
ccauccagcugg

SEQ ID NO: 848689 - RNA, 17 nt, Homo sapiens
ccaucccaacaccucac

SEQ ID NO: 848690 - RNA, 17 nt, Homo sapiens
ccaucccucuccucugc

SEQ ID NO: 848691 - RNA, 21 nt, Homo sapiens
ccauggcuucccagagcuccc

SEQ ID NO: 848692 - RNA, 16 nt, Homo sapiens
ccaugugcccacuguc

SEQ ID NO: 848693 - RNA, 21 nt, Homo sapiens
ccauuugggagaagaucucaa

SEQ ID NO: 848694 - RNA, 13 nt, Homo sapiens
cccaaauguauuc

SEQ ID NO: 848695 - RNA, 14 nt, Homo sapiens
cccaaauguauucu

SEQ ID NO: 848696 - RNA, 14 nt, Homo sapiens
cccaaccacaggaa

SEQ ID NO: 848697 - RNA, 20 nt, Homo sapiens
cccaaggcgauauaagcaaa

SEQ ID NO: 848698 - RNA, 13 nt, Homo sapiens
cccacuuuugcca

SEQ ID NO: 848699 - RNA, 18 nt, Homo sapiens
cccagcagacaucaagcu

SEQ ID NO: 848700 - RNA, 20 nt, Homo sapiens
cccagcuuauaaacagaagu

SEQ ID NO: 848701 - RNA, 14 nt, Homo sapiens
cccaggaaucucaa

SEQ ID NO: 848702 - RNA, 22 nt, Homo sapiens
cccaggccagagccugugggca

SEQ ID NO: 848703 - RNA, 19 nt, Homo sapiens
cccaucaaauugaucugca

SEQ ID NO: 848704 - RNA, 16 nt, Homo sapiens
ccccaccuucuuggga

SEQ ID NO: 848705 - RNA, 13 nt, Homo sapiens
ccccagcuaggaa

SEQ ID NO: 848706 - RNA, 14 nt, Homo sapiens
ccccaucugugaau

SEQ ID NO: 848707 - RNA, 18 nt, Homo sapiens
ggggucgcccuuugcuca

SEQ ID NO: 848708 - RNA, 23 nt, Homo sapiens
ggguuguacugugaccaucccaa

SEQ ID NO: 848709 - RNA, 22 nt, Homo sapiens
gguacaugccuguuaauauuca

SEQ ID NO: 848710 - RNA, 11 nt, Homo sapiens
gguacuuucau

SEQ ID NO: 848711 - RNA, 21 nt, Homo sapiens
gguaggcacaaauacauuccu

SEQ ID NO: 848712 - RNA, 20 nt, Homo sapiens
ggucagagagggaagcugag

SEQ ID NO: 848713 - RNA, 14 nt, Homo sapiens
ggucagaggggagc

SEQ ID NO: 848714 - RNA, 14 nt, Homo sapiens
gguccaucucugaa

SEQ ID NO: 848715 - RNA, 15 nt, Homo sapiens
ggucgggggggaccc

SEQ ID NO: 848716 - RNA, 16 nt, Homo sapiens
ggucucucuugcccca

SEQ ID NO: 848717 - RNA, 16 nt, Homo sapiens
ggugaugggugaugga

SEQ ID NO: 848718 - RNA, 15 nt, Homo sapiens
ggugggcacacugaa

SEQ ID NO: 848719 - RNA, 20 nt, Homo sapiens
gguugugagagccugugauc

SEQ ID NO: 848720 - RNA, 14 nt, Homo sapiens
guaaaaagugcagu

SEQ ID NO: 848721 - RNA, 15 nt, Homo sapiens
guaaaaucugacaua

SEQ ID NO: 848722 - RNA, 12 nt, Homo sapiens
guaaacauuucu

SEQ ID NO: 848723 - RNA, 23 nt, Homo sapiens
guaaaguauuuacugacugcuua

SEQ ID NO: 848724 - RNA, 12 nt, Homo sapiens
guaaauugccau

SEQ ID NO: 848725 - RNA, 20 nt, Homo sapiens
guaacuuugguuaaaaucuc

SEQ ID NO: 848726 - RNA, 16 nt, Homo sapiens
guaagggaacaaguug

SEQ ID NO: 848727 - RNA, 11 nt, Homo sapiens
guaaguauuuu

SEQ ID NO: 848728 - RNA, 13 nt, Homo sapiens
guaaguuuuugca

SEQ ID NO: 848729 - RNA, 22 nt, Homo sapiens
guaauaggugucauggauagau

SEQ ID NO: 848730 - RNA, 14 nt, Homo sapiens
guaauccagcaaua

SEQ ID NO: 848731 - RNA, 22 nt, Homo sapiens
guaauuguagaccuguuucaua

SEQ ID NO: 848732 - RNA, 15 nt, Homo sapiens
guacaaaagcacugg

SEQ ID NO: 848733 - RNA, 15 nt, Homo sapiens
guaccucaucugcac

SEQ ID NO: 848734 - RNA, 15 nt, Homo sapiens
guacuaguccaucau

SEQ ID NO: 848735 - RNA, 15 nt, Homo sapiens
guacucucucucuuu

SEQ ID NO: 848736 - RNA, 16 nt, Homo sapiens
guagcacaaauuuucu

SEQ ID NO: 848737 - RNA, 20 nt, Homo sapiens
guagcuuccuccaacccgca

SEQ ID NO: 848738 - RNA, 19 nt, Homo sapiens
guaggaaccugcacacgag

SEQ ID NO: 848739 - RNA, 20 nt, Homo sapiens
guaggaaccugcacacgagc

SEQ ID NO: 848740 - RNA, 14 nt, Homo sapiens
guagggcucgccau

SEQ ID NO: 848741 - RNA, 18 nt, Homo sapiens
guaguuaacaauuuugca

SEQ ID NO: 848742 - RNA, 13 nt, Homo sapiens
guauaacaugucg

SEQ ID NO: 848743 - RNA, 21 nt, Homo sapiens
guauaauucaaagcaccaaaa

SEQ ID NO: 848744 - RNA, 21 nt, Homo sapiens
guauaguuuaaaaaucugcca

SEQ ID NO: 848745 - RNA, 22 nt, Homo sapiens
guauauugguuuuaugaugacg

SEQ ID NO: 848746 - RNA, 19 nt, Homo sapiens
guauauuuuugaucuuuga

SEQ ID NO: 848747 - RNA, 14 nt, Homo sapiens
guaucacuguauca

SEQ ID NO: 848748 - RNA, 18 nt, Homo sapiens
guaucacuguaucaucuu

SEQ ID NO: 848749 - RNA, 21 nt, Homo sapiens
guauguuauuugaugacugaa

SEQ ID NO: 848750 - RNA, 14 nt, Homo sapiens
guauuaccaaagca

SEQ ID NO: 848751 - RNA, 17 nt, Homo sapiens
guauucuacuuguucua

SEQ ID NO: 848752 - RNA, 17 nt, Homo sapiens
guauuuacugacugcuu

SEQ ID NO: 848753 - RNA, 18 nt, Homo sapiens
guauuuacugacugcuua

SEQ ID NO: 848754 - RNA, 19 nt, Homo sapiens
guauuuucucuuucuuccu

SEQ ID NO: 848755 - RNA, 17 nt, Homo sapiens
gucaagaauagcauugu

SEQ ID NO: 848756 - RNA, 21 nt, Homo sapiens
gucacaaaggagugagugaaa

SEQ ID NO: 848757 - RNA, 19 nt, Homo sapiens
gucagagagggaagcugag

SEQ ID NO: 848758 - RNA, 23 nt, Homo sapiens
guccaagucucgcuacauuuccg

SEQ ID NO: 848759 - RNA, 22 nt, Homo sapiens
guccaguacaaaagcacuggaa

SEQ ID NO: 848760 - RNA, 17 nt, Homo sapiens
guccauagcacuguaua

SEQ ID NO: 848761 - RNA, 23 nt, Homo sapiens
guccaucaaguaccucaucugca

SEQ ID NO: 848762 - RNA, 13 nt, Homo sapiens
guccaucucugaa

SEQ ID NO: 848763 - RNA, 20 nt, Homo sapiens
guccaugugcacugcaaugc

SEQ ID NO: 848764 - RNA, 17 nt, Homo sapiens
guccauuccccaggugg

SEQ ID NO: 848765 - RNA, 16 nt, Homo sapiens
gucccagcagccagcc

SEQ ID NO: 848766 - RNA, 18 nt, Homo sapiens
guccuccagaaagcacca

SEQ ID NO: 848767 - RNA, 14 nt, Homo sapiens
gucucaagugcaau

SEQ ID NO: 848768 - RNA, 15 nt, Homo sapiens
gucuccuguuucaga

SEQ ID NO: 848769 - RNA, 19 nt, Homo sapiens
gucucgcucuguugcccag

SEQ ID NO: 848770 - RNA, 19 nt, Homo sapiens
gucucucuggcccacucau

SEQ ID NO: 848771 - RNA, 14 nt, Homo sapiens
gucuggccagggag

SEQ ID NO: 848772 - RNA, 15 nt, Homo sapiens
gucuggcccacugug

SEQ ID NO: 848773 - RNA, 16 nt, Homo sapiens
gucuggcccacugugc

SEQ ID NO: 848774 - RNA, 15 nt, Homo sapiens
gucuggggaccagcu

SEQ ID NO: 848775 - RNA, 22 nt, Homo sapiens
gucuggguuuggcaggcacugc

SEQ ID NO: 848776 - RNA, 18 nt, Homo sapiens
gucuguggcuuggugagu

SEQ ID NO: 848777 - RNA, 20 nt, Homo sapiens
gucuguguuuaaagugaauu

SEQ ID NO: 848778 - RNA, 23 nt, Homo sapiens
gucuuucauguaaaaagugcagu

SEQ ID NO: 848779 - RNA, 14 nt, Homo sapiens
gucuuuggccagaa

SEQ ID NO: 848780 - RNA, 21 nt, Homo sapiens
gugaacauugguucuuucauu

SEQ ID NO: 848781 - RNA, 17 nt, Homo sapiens
gugaccaaaaugccaaa

SEQ ID NO: 848782 - RNA, 14 nt, Homo sapiens
gugaggcaucucuc

SEQ ID NO: 848783 - RNA, 20 nt, Homo sapiens
gugaggcaucucucugggau

SEQ ID NO: 848784 - RNA, 17 nt, Homo sapiens
gugauacuuuugcccuc

SEQ ID NO: 848785 - RNA, 15 nt, Homo sapiens
gugauagagugcagu

SEQ ID NO: 848786 - RNA, 14 nt, Homo sapiens
gugauauaaacagc

SEQ ID NO: 848787 - RNA, 14 nt, Homo sapiens
gugaugaacuacau

SEQ ID NO: 848788 - RNA, 22 nt, Homo sapiens
gugauguauguuauuugaugac

SEQ ID NO: 848789 - RNA, 22 nt, Homo sapiens
gugcccacugucucuuccacuu

SEQ ID NO: 848790 - RNA, 14 nt, Homo sapiens
gugcugaguacuca

SEQ ID NO: 848791 - RNA, 13 nt, Homo sapiens
gugcuggugaccc

SEQ ID NO: 848792 - RNA, 20 nt, Homo sapiens
gugcuguggcccaggccaga

SEQ ID NO: 848793 - RNA, 19 nt, Homo sapiens
guggagguugcugguacac

SEQ ID NO: 848794 - RNA, 22 nt, Homo sapiens
guggccccaccuggcccucucu

SEQ ID NO: 848795 - RNA, 14 nt, Homo sapiens
guggccggggucca

SEQ ID NO: 848796 - RNA, 13 nt, Homo sapiens
gugggcacacuga

SEQ ID NO: 848797 - RNA, 14 nt, Homo sapiens
guguaccacuggga

SEQ ID NO: 848798 - RNA, 19 nt, Homo sapiens
guguccuacacaauggugc

SEQ ID NO: 848799 - RNA, 23 nt, Homo sapiens
gugucuccuguuucagaccagcc

SEQ ID NO: 848800 - RNA, 23 nt, Homo sapiens
gugucucugcgccugaguaacga

SEQ ID NO: 848801 - RNA, 13 nt, Homo sapiens
guguggccucuuc

SEQ ID NO: 848802 - RNA, 23 nt, Homo sapiens
guguuguaaaaaugucuuucaug

SEQ ID NO: 848803 - RNA, 14 nt, Homo sapiens
guuaaaaacacugc

SEQ ID NO: 848804 - RNA, 21 nt, Homo sapiens
guuaacauaggcuuauacaaa

SEQ ID NO: 848805 - RNA, 21 nt, Homo sapiens
guuaagauaauuguacuuuga

SEQ ID NO: 848806 - RNA, 13 nt, Homo sapiens
guuacucucaggc

SEQ ID NO: 848807 - RNA, 15 nt, Homo sapiens
guucaaaccugugaa

SEQ ID NO: 848808 - RNA, 18 nt, Homo sapiens
guucaggcccaucagcua

SEQ ID NO: 848809 - RNA, 19 nt, Homo sapiens
guuccccuaaucuaucacu

SEQ ID NO: 848810 - RNA, 13 nt, Homo sapiens
guucgacaaaagc

SEQ ID NO: 848811 - RNA, 18 nt, Homo sapiens
guucucuaaccauucugu

SEQ ID NO: 848812 - RNA, 19 nt, Homo sapiens
guucuggcugucaccaagc

SEQ ID NO: 848813 - RNA, 18 nt, Homo sapiens
guugaagaucgugaugcu

SEQ ID NO: 848814 - RNA, 13 nt, Homo sapiens
guugcagcuguca

SEQ ID NO: 848815 - RNA, 12 nt, Homo sapiens
guuggacucuga

SEQ ID NO: 848816 - RNA, 19 nt, Homo sapiens
guugugagagccugugauc

SEQ ID NO: 848817 - RNA, 15 nt, Homo sapiens
guuuaaaugucaaau

SEQ ID NO: 848818 - RNA, 17 nt, Homo sapiens
guuucucuggcccugag

SEQ ID NO: 848819 - RNA, 23 nt, Homo sapiens
guuucuuuccuaaaccauucacc

SEQ ID NO: 848820 - RNA, 13 nt, Homo sapiens
guuugaaucugac

SEQ ID NO: 848821 - RNA, 16 nt, Homo sapiens
uaaaauugugaugcuc

SEQ ID NO: 848822 - RNA, 22 nt, Homo sapiens
uaaacauugguaagaaugagcu

SEQ ID NO: 848823 - RNA, 13 nt, Homo sapiens
uaaaccauucacc

SEQ ID NO: 848824 - RNA, 17 nt, Homo sapiens
uaaacgccuucccaaaa

SEQ ID NO: 848825 - RNA, 17 nt, Homo sapiens
uaaacguauaauaugua

SEQ ID NO: 848826 - RNA, 13 nt, Homo sapiens
uaaagaauucuuu

SEQ ID NO: 848827 - RNA, 15 nt, Homo sapiens
uaaagcacauuccaa

SEQ ID NO: 848828 - RNA, 19 nt, Homo sapiens
uaaaguguuguggccuuaa

SEQ ID NO: 848829 - RNA, 16 nt, Homo sapiens
uaaauagacacuugag

SEQ ID NO: 848830 - RNA, 17 nt, Homo sapiens
uaaaugaacaucuauaa

SEQ ID NO: 848831 - RNA, 12 nt, Homo sapiens
uaaaugaacuca

SEQ ID NO: 848832 - RNA, 20 nt, Homo sapiens
uaaauuguauucucauaaua

SEQ ID NO: 848833 - RNA, 18 nt, Homo sapiens
uaaauuuuuuuguaugaa

SEQ ID NO: 848834 - RNA, 23 nt, Homo sapiens
uaacaaaguuuucaugugcucag

SEQ ID NO: 848835 - RNA, 15 nt, Homo sapiens
uaacaagucauuuca

SEQ ID NO: 848836 - RNA, 13 nt, Homo sapiens
uaacaugugaaaa

SEQ ID NO: 848837 - RNA, 13 nt, Homo sapiens
uaacgugucaggg

SEQ ID NO: 848838 - RNA, 20 nt, Homo sapiens
uaacucauccguuugccaau

SEQ ID NO: 848839 - RNA, 18 nt, Homo sapiens
uaacuggacauucugggg

SEQ ID NO: 848840 - RNA, 20 nt, Homo sapiens
uaacuggacauucuggggaa

SEQ ID NO: 848841 - RNA, 17 nt, Homo sapiens
uaagaaauagacagcau

SEQ ID NO: 848842 - RNA, 20 nt, Homo sapiens
uaagaagccaagggggaccu

SEQ ID NO: 848843 - RNA, 17 nt, Homo sapiens
uaagacguauguaaaca

SEQ ID NO: 848844 - RNA, 13 nt, Homo sapiens
uaagcaagagcca

SEQ ID NO: 848845 - RNA, 15 nt, Homo sapiens
uaaggaaacauuggc

SEQ ID NO: 848846 - RNA, 18 nt, Homo sapiens
uaagggagcagacuuuua

SEQ ID NO: 848847 - RNA, 13 nt, Homo sapiens
uaagguguuugaa

SEQ ID NO: 848848 - RNA, 15 nt, Homo sapiens
uaaguaagucucaag

SEQ ID NO: 848849 - RNA, 22 nt, Homo sapiens
uaaguauccugagagcccagaa

SEQ ID NO: 848850 - RNA, 20 nt, Homo sapiens
uaaguauuuuccuguuguca

SEQ ID NO: 848851 - RNA, 18 nt, Homo sapiens
uaauaagaccccacugga

SEQ ID NO: 848852 - RNA, 15 nt, Homo sapiens
uaauaaguccaucug

SEQ ID NO: 848853 - RNA, 12 nt, Homo sapiens
uaauagauuuaa

SEQ ID NO: 848854 - RNA, 15 nt, Homo sapiens
uaauaggcucugccu

SEQ ID NO: 848855 - RNA, 19 nt, Homo sapiens
uaauaguauccagcacaga

SEQ ID NO: 848856 - RNA, 15 nt, Homo sapiens
uaauaguccuuugau

SEQ ID NO: 848857 - RNA, 20 nt, Homo sapiens
uaaucauggcucuuagaaac

SEQ ID NO: 848858 - RNA, 13 nt, Homo sapiens
uaauccagcaaua

SEQ ID NO: 848859 - RNA, 22 nt, Homo sapiens
uaaugcaagggucucacacugu

SEQ ID NO: 848860 - RNA, 17 nt, Homo sapiens
uaauggacaaagggaaa

SEQ ID NO: 848861 - RNA, 13 nt, Homo sapiens
uaauuauuauuca

SEQ ID NO: 848862 - RNA, 14 nt, Homo sapiens
uaauuguacuuuga

SEQ ID NO: 848863 - RNA, 20 nt, Homo sapiens
uaauuguagaccuguuucau

SEQ ID NO: 848864 - RNA, 12 nt, Homo sapiens
uaauugugugaa

SEQ ID NO: 848865 - RNA, 13 nt, Homo sapiens
uaauuuacuguga

SEQ ID NO: 848866 - RNA, 19 nt, Homo sapiens
uaauuuucgaaaacuuccc

SEQ ID NO: 848867 - RNA, 14 nt, Homo sapiens
uacaaagaccuaga

SEQ ID NO: 848868 - RNA, 19 nt, Homo sapiens
uacaagauuuuuuuacuua

SEQ ID NO: 848869 - RNA, 14 nt, Homo sapiens
uacaaguaguucug

SEQ ID NO: 848870 - RNA, 19 nt, Homo sapiens
uacaaguggcucaucauca

SEQ ID NO: 848871 - RNA, 20 nt, Homo sapiens
uacaauuucuuuugguucau

SEQ ID NO: 848872 - RNA, 16 nt, Homo sapiens
uacacugcucucccca

SEQ ID NO: 848873 - RNA, 23 nt, Homo sapiens
uacacugcucuccccacccagac

SEQ ID NO: 848874 - RNA, 20 nt, Homo sapiens
uacacuuuuuggaagugaaa

SEQ ID NO: 848875 - RNA, 23 nt, Homo sapiens
uacaguguacuuuguuaaaaaca

SEQ ID NO: 848876 - RNA, 13 nt, Homo sapiens
uacauaauacuga

SEQ ID NO: 848877 - RNA, 16 nt, Homo sapiens
uacauaggaugacaaa

SEQ ID NO: 848878 - RNA, 19 nt, Homo sapiens
uacauaucaaaacauccca

SEQ ID NO: 848879 - RNA, 22 nt, Homo sapiens
uacaucuaucccagaguacaaa

SEQ ID NO: 848880 - RNA, 22 nt, Homo sapiens
uacaugacaggcaucaaucugg

SEQ ID NO: 848881 - RNA, 19 nt, Homo sapiens
uacauucacgacaguacuu

SEQ ID NO: 848882 - RNA, 21 nt, Homo sapiens
uaccaaccugaaaguuccuuc

SEQ ID NO: 848883 - RNA, 19 nt, Homo sapiens
uaccaacugggccucugau

SEQ ID NO: 848884 - RNA, 22 nt, Homo sapiens
uaccacaaugcgcauguaguua

SEQ ID NO: 848885 - RNA, 15 nt, Homo sapiens
uaccauuaucuuauc

SEQ ID NO: 848886 - RNA, 22 nt, Homo sapiens
uaccauuuaauggggaggacaa

SEQ ID NO: 848887 - RNA, 20 nt, Homo sapiens
uacccuugauggauuuucaa

SEQ ID NO: 848888 - RNA, 23 nt, Homo sapiens
uaccucauggaugcuuuggcaau

SEQ ID NO: 848889 - RNA, 13 nt, Homo sapiens
uaccuucugccag

SEQ ID NO: 848890 - RNA, 14 nt, Homo sapiens
uacguacuaaggau

SEQ ID NO: 848891 - RNA, 18 nt, Homo sapiens
uacguguuacuggccaag

SEQ ID NO: 848892 - RNA, 19 nt, Homo sapiens
uacuagaaucagauacaaa

SEQ ID NO: 848893 - RNA, 23 nt, Homo sapiens
uacuaguggcauggagaaugcac

SEQ ID NO: 848894 - RNA, 13 nt, Homo sapiens
uacucacagccag

SEQ ID NO: 848895 - RNA, 15 nt, Homo sapiens
uacucaugcaugcaa

SEQ ID NO: 848896 - RNA, 12 nt, Homo sapiens
uacucucaggca

SEQ ID NO: 848897 - RNA, 13 nt, Homo sapiens
uacucucaggcau

SEQ ID NO: 848898 - RNA, 23 nt, Homo sapiens
uacucucaggcauggaugaauaa

SEQ ID NO: 848899 - RNA, 18 nt, Homo sapiens
uacugacugcuuauaaac

SEQ ID NO: 848900 - RNA, 19 nt, Homo sapiens
uacugacugcuuauaaaca

SEQ ID NO: 848901 - RNA, 21 nt, Homo sapiens
uacugaugguuacauauacua

SEQ ID NO: 848902 - RNA, 14 nt, Homo sapiens
uacuuaaguagccu

SEQ ID NO: 848903 - RNA, 17 nt, Homo sapiens
uacuuagaccaaaagca

SEQ ID NO: 848904 - RNA, 19 nt, Homo sapiens
uacuugaaaaauguuauaa

SEQ ID NO: 848905 - RNA, 17 nt, Homo sapiens
uacuugcuccauucaua

SEQ ID NO: 848906 - RNA, 23 nt, Homo sapiens
uacuuuguuaaaaacacugcuga

SEQ ID NO: 848907 - RNA, 21 nt, Homo sapiens
uacuuuuuggugucucauacc

SEQ ID NO: 848908 - RNA, 21 nt, Homo sapiens
uagaaaauaucuagcccaaag

SEQ ID NO: 848909 - RNA, 13 nt, Homo sapiens
uagaacauuccau

SEQ ID NO: 848910 - RNA, 19 nt, Homo sapiens
uagaagacuacaauucagu

SEQ ID NO: 848911 - RNA, 18 nt, Homo sapiens
uagaaguuccuagugaug

SEQ ID NO: 848912 - RNA, 19 nt, Homo sapiens
uagaauacccuaaaguaua

SEQ ID NO: 848913 - RNA, 16 nt, Homo sapiens
uagaaucagauacaaa

SEQ ID NO: 848914 - RNA, 18 nt, Homo sapiens
uagaggugcaugccuaau

SEQ ID NO: 848915 - RNA, 16 nt, Homo sapiens
uagauuugccauagag

SEQ ID NO: 848916 - RNA, 20 nt, Homo sapiens
uagauuuugaaaaauuaccu

SEQ ID NO: 848917 - RNA, 14 nt, Homo sapiens
uagcaaagaacucu

SEQ ID NO: 848918 - RNA, 12 nt, Homo sapiens
uagcauggggcu

SEQ ID NO: 848919 - RNA, 13 nt, Homo sapiens
uagcuauaugcau

SEQ ID NO: 848920 - RNA, 11 nt, Homo sapiens
uagcugcauuu

SEQ ID NO: 848921 - RNA, 15 nt, Homo sapiens
uagcugggaccacag

SEQ ID NO: 848922 - RNA, 17 nt, Homo sapiens
uagcuguaaggcaugaa

SEQ ID NO: 848923 - RNA, 19 nt, Homo sapiens
uaggaaaaaaagauuucca

SEQ ID NO: 848924 - RNA, 21 nt, Homo sapiens
uaggaagcaugagggcaacua

SEQ ID NO: 848925 - RNA, 17 nt, Homo sapiens
uaggacucugcacugaa

SEQ ID NO: 848926 - RNA, 15 nt, Homo sapiens
uaggaggacaaggac

SEQ ID NO: 848927 - RNA, 15 nt, Homo sapiens
uaggaguuugcuaag

SEQ ID NO: 848928 - RNA, 18 nt, Homo sapiens
uaggcacaaauacauucc

SEQ ID NO: 848929 - RNA, 18 nt, Homo sapiens
uagggugauacuuuugcc

SEQ ID NO: 848930 - RNA, 15 nt, Homo sapiens
uagguuccagcaugu

SEQ ID NO: 848931 - RNA, 14 nt, Homo sapiens
uaguaauguagauu

SEQ ID NO: 848932 - RNA, 16 nt, Homo sapiens
uagugagacuagacau

SEQ ID NO: 848933 - RNA, 18 nt, Homo sapiens
uagugauagagugcagug

SEQ ID NO: 848934 - RNA, 13 nt, Homo sapiens
uagugcugugaaa

SEQ ID NO: 848935 - RNA, 14 nt, Homo sapiens
uaguuccacugaga

SEQ ID NO: 848936 - RNA, 16 nt, Homo sapiens
uaguucugacuuugaa

SEQ ID NO: 848937 - RNA, 16 nt, Homo sapiens
uaguuggaaagcaaag

SEQ ID NO: 848938 - RNA, 16 nt, Homo sapiens
uaguuucagugcauua

SEQ ID NO: 848939 - RNA, 16 nt, Homo sapiens
uaguuuuaaguauguc

SEQ ID NO: 848940 - RNA, 23 nt, Homo sapiens
uauaaauuuauuuacugcuaguc

SEQ ID NO: 848941 - RNA, 21 nt, Homo sapiens
uauaauucacccaccagacuu

SEQ ID NO: 848942 - RNA, 20 nt, Homo sapiens
uauaugaacauacaaaugca

SEQ ID NO: 848943 - RNA, 12 nt, Homo sapiens
uauaugcugcau

SEQ ID NO: 848944 - RNA, 22 nt, Homo sapiens
uauauuggcugguaaauugcca

SEQ ID NO: 848945 - RNA, 16 nt, Homo sapiens
uauauuuaagaagcca

SEQ ID NO: 848946 - RNA, 14 nt, Homo sapiens
uauauuuacaacac

SEQ ID NO: 848947 - RNA, 16 nt, Homo sapiens
uaucaaaaagauauca

SEQ ID NO: 848948 - RNA, 15 nt, Homo sapiens
uaucaaaacauccca

SEQ ID NO: 848949 - RNA, 16 nt, Homo sapiens
uaucaaauacauuuaa

SEQ ID NO: 848950 - RNA, 17 nt, Homo sapiens
uaucagaaucuugucca

SEQ ID NO: 848951 - RNA, 15 nt, Homo sapiens
uaucagugugcaaua

SEQ ID NO: 848952 - RNA, 18 nt, Homo sapiens
uauccuuuuagucugcau

SEQ ID NO: 848953 - RNA, 20 nt, Homo sapiens
uauccuuuuagucugcauau

SEQ ID NO: 848954 - RNA, 21 nt, Homo sapiens
uaucguguacaagaagacaaa

SEQ ID NO: 848955 - RNA, 17 nt, Homo sapiens
uaucugcaaaaugggau

SEQ ID NO: 848956 - RNA, 21 nt, Homo sapiens
aggcaaauccgaaaucagcag

SEQ ID NO: 848957 - RNA, 14 nt, Homo sapiens
aggcaaugggcuac

SEQ ID NO: 848958 - RNA, 17 nt, Homo sapiens
aggcacauggaauauau

SEQ ID NO: 848959 - RNA, 17 nt, Homo sapiens
aggcacccuuccaucug

SEQ ID NO: 848960 - RNA, 21 nt, Homo sapiens
aggcagucagguccaugugca

SEQ ID NO: 848961 - RNA, 22 nt, Homo sapiens
aggcaguucgaccagccaggga

SEQ ID NO: 848962 - RNA, 17 nt, Homo sapiens
aggccagcagccuucca

SEQ ID NO: 848963 - RNA, 16 nt, Homo sapiens
aggccaggggaggggu

SEQ ID NO: 848964 - RNA, 14 nt, Homo sapiens
aggcccaucagcua

SEQ ID NO: 848965 - RNA, 17 nt, Homo sapiens
aggccccaauaccccau

SEQ ID NO: 848966 - RNA, 16 nt, Homo sapiens
aggccuccugccaugu

SEQ ID NO: 848967 - RNA, 19 nt, Homo sapiens
aggccuuggggacaaccuu

SEQ ID NO: 848968 - RNA, 23 nt, Homo sapiens
aggcuauuuuucagaacuguuaa

SEQ ID NO: 848969 - RNA, 16 nt, Homo sapiens
aggcugucggggucaa

SEQ ID NO: 848970 - RNA, 13 nt, Homo sapiens
agggaacaaggaa

SEQ ID NO: 848971 - RNA, 17 nt, Homo sapiens
agggacacuaggaauca

SEQ ID NO: 848972 - RNA, 13 nt, Homo sapiens
agggacagucuca

SEQ ID NO: 848973 - RNA, 15 nt, Homo sapiens
agggacagucucacc

SEQ ID NO: 848974 - RNA, 16 nt, Homo sapiens
agggauggcaguggcu

SEQ ID NO: 848975 - RNA, 19 nt, Homo sapiens
agggcagggaaacccuggg

SEQ ID NO: 848976 - RNA, 18 nt, Homo sapiens
agggcauagcgacagugu

SEQ ID NO: 848977 - RNA, 15 nt, Homo sapiens
agggccucaucucag

SEQ ID NO: 848978 - RNA, 22 nt, Homo sapiens
agggcggccuuucccacugguc

SEQ ID NO: 848979 - RNA, 19 nt, Homo sapiens
aggggacaaguagccaccu

SEQ ID NO: 848980 - RNA, 13 nt, Homo sapiens
aggggagacuuug

SEQ ID NO: 848981 - RNA, 13 nt, Homo sapiens
aggggaugaugac

SEQ ID NO: 848982 - RNA, 14 nt, Homo sapiens
auauuuggcuuaua

SEQ ID NO: 848983 - RNA, 13 nt, Homo sapiens
aucaaauugaucu

SEQ ID NO: 848984 - RNA, 21 nt, Homo sapiens
aucaagcucaaggcaaugggc

SEQ ID NO: 848985 - RNA, 22 nt, Homo sapiens
aucacugaaauaaaagcuauau

SEQ ID NO: 848986 - RNA, 21 nt, Homo sapiens
aucagagacccuggugcugcc

SEQ ID NO: 848987 - RNA, 22 nt, Homo sapiens
aucaguccuaccugagcaacaa

SEQ ID NO: 848988 - RNA, 15 nt, Homo sapiens
aucagugugcaauac

SEQ ID NO: 848989 - RNA, 15 nt, Homo sapiens
aucaguguuaccguu

SEQ ID NO: 848990 - RNA, 21 nt, Homo sapiens
auccaaggaaauaaugugaau

SEQ ID NO: 848991 - RNA, 14 nt, Homo sapiens
auccagcucaaggg

SEQ ID NO: 848992 - RNA, 18 nt, Homo sapiens
auccccacguggacaaga

SEQ ID NO: 848993 - RNA, 20 nt, Homo sapiens
auccccacguggacaagaaa

SEQ ID NO: 848994 - RNA, 16 nt, Homo sapiens
aucccucuccucugcc

SEQ ID NO: 848995 - RNA, 22 nt, Homo sapiens
auccguuugccaaucauugcaa

SEQ ID NO: 848996 - RNA, 20 nt, Homo sapiens
auccugggcagcuugggcug

SEQ ID NO: 848997 - RNA, 23 nt, Homo sapiens
auccugucuguuuuuguauuuau

SEQ ID NO: 848998 - RNA, 13 nt, Homo sapiens
auccuuguguuua

SEQ ID NO: 848999 - RNA, 20 nt, Homo sapiens
auccuuguguuuaucagaaa

SEQ ID NO: 849000 - RNA, 14 nt, Homo sapiens
aucguguacaagaa

SEQ ID NO: 849001 - RNA, 13 nt, Homo sapiens
aucuaacaguaac

SEQ ID NO: 849002 - RNA, 21 nt, Homo sapiens
aucuagcucuccauacuuuga

SEQ ID NO: 849003 - RNA, 21 nt, Homo sapiens
aucuaucacccaggaaucuca

SEQ ID NO: 849004 - RNA, 22 nt, Homo sapiens
aucuaucacccaggaaucucaa

SEQ ID NO: 849005 - RNA, 13 nt, Homo sapiens
auuucaugaagca

SEQ ID NO: 849006 - RNA, 15 nt, Homo sapiens
auuuccgccacaucc

SEQ ID NO: 849007 - RNA, 17 nt, Homo sapiens
auuuccgccacaucccu

SEQ ID NO: 849008 - RNA, 14 nt, Homo sapiens
auuucucuccuuaa

SEQ ID NO: 849009 - RNA, 17 nt, Homo sapiens
auuucucuuucucucuc

SEQ ID NO: 849010 - RNA, 17 nt, Homo sapiens
auuucugaguaccauua

SEQ ID NO: 849011 - RNA, 19 nt, Homo sapiens
auuucuucagacucaaaac

SEQ ID NO: 849012 - RNA, 18 nt, Homo sapiens
auuuggcuuccucugcug

SEQ ID NO: 849013 - RNA, 19 nt, Homo sapiens
auuugggagaagaucucaa

SEQ ID NO: 849014 - RNA, 22 nt, Homo sapiens
auuuggggaccacagaggcugu

SEQ ID NO: 849015 - RNA, 16 nt, Homo sapiens
auuuuagugacagagu

SEQ ID NO: 849016 - RNA, 14 nt, Homo sapiens
auuuuaugugaccu

SEQ ID NO: 849017 - RNA, 16 nt, Homo sapiens
auuuucaccuauccag

SEQ ID NO: 849018 - RNA, 22 nt, Homo sapiens
auuuucaccuauccagagagua

SEQ ID NO: 849019 - RNA, 21 nt, Homo sapiens
auuuuccuguugucaagaaua

SEQ ID NO: 849020 - RNA, 21 nt, Homo sapiens
auuuugaaaaauuaccuguau

SEQ ID NO: 849021 - RNA, 22 nt, Homo sapiens
auuuugaaaaauuaccuguaua

SEQ ID NO: 849022 - RNA, 14 nt, Homo sapiens
auuuugaccuugua

SEQ ID NO: 849023 - RNA, 20 nt, Homo sapiens
auuuugcacuguagauuuaa

SEQ ID NO: 849024 - RNA, 17 nt, Homo sapiens
auuuuguguaagaaaua

SEQ ID NO: 849025 - RNA, 21 nt, Homo sapiens
auuuuuguauccaaggaaaua

SEQ ID NO: 849026 - RNA, 16 nt, Homo sapiens
auuuuuuugaacucuu

SEQ ID NO: 849027 - RNA, 15 nt, Homo sapiens
caaaaguagcuuccu

SEQ ID NO: 849028 - RNA, 17 nt, Homo sapiens
caaaaguuuguuugcuu

SEQ ID NO: 849029 - RNA, 15 nt, Homo sapiens
caaaaugacuuauua

SEQ ID NO: 849030 - RNA, 17 nt, Homo sapiens
caaaccuaauugcacaa

SEQ ID NO: 849031 - RNA, 14 nt, Homo sapiens
caaagcaaaggauc

SEQ ID NO: 849032 - RNA, 18 nt, Homo sapiens
caaagccaccaacagcca

SEQ ID NO: 849033 - RNA, 23 nt, Homo sapiens
caaaggccuaauucuaugccugu

SEQ ID NO: 849034 - RNA, 17 nt, Homo sapiens
caaauacggauccugca

SEQ ID NO: 849035 - RNA, 15 nt, Homo sapiens
caaaugugcauugaa

SEQ ID NO: 849036 - RNA, 14 nt, Homo sapiens
caaauucaugugcc

SEQ ID NO: 849037 - RNA, 13 nt, Homo sapiens
caacaacauuccu

SEQ ID NO: 849038 - RNA, 23 nt, Homo sapiens
caacaauguguuguaaaaauguc

SEQ ID NO: 849039 - RNA, 19 nt, Homo sapiens
caacagccauuuaggcaaa

SEQ ID NO: 849040 - RNA, 19 nt, Homo sapiens
caacaucagcucugugcca

SEQ ID NO: 849041 - RNA, 23 nt, Homo sapiens
caaccccuggaccccagccucaa

SEQ ID NO: 849042 - RNA, 21 nt, Homo sapiens
caacccucucaaguccaucaa

SEQ ID NO: 849043 - RNA, 22 nt, Homo sapiens
caacguggaggaaagggagcag

SEQ ID NO: 849044 - RNA, 14 nt, Homo sapiens
caacugucagggag

SEQ ID NO: 849045 - RNA, 13 nt, Homo sapiens
caagacagcauuu

SEQ ID NO: 849046 - RNA, 16 nt, Homo sapiens
caagaccuaacuccug

SEQ ID NO: 849047 - RNA, 15 nt, Homo sapiens
caagacuuauuuuca

SEQ ID NO: 849048 - RNA, 16 nt, Homo sapiens
caagagccuuaaaaca

SEQ ID NO: 849049 - RNA, 17 nt, Homo sapiens
caagagucuggggacca

SEQ ID NO: 849050 - RNA, 21 nt, Homo sapiens
caagagucuggggaccagcuu

SEQ ID NO: 849051 - RNA, 13 nt, Homo sapiens
caagaucaaaaag

SEQ ID NO: 849052 - RNA, 20 nt, Homo sapiens
caagauuuuuuuacuuauua

SEQ ID NO: 849053 - RNA, 14 nt, Homo sapiens
caagcacuguggaa

SEQ ID NO: 849054 - RNA, 16 nt, Homo sapiens
caagccaaaugugcag

SEQ ID NO: 849055 - RNA, 18 nt, Homo sapiens
caagcuggcuuacacugg

SEQ ID NO: 849056 - RNA, 12 nt, Homo sapiens
caaggaagguga

SEQ ID NO: 849057 - RNA, 14 nt, Homo sapiens
caaggcagauccuc

SEQ ID NO: 849058 - RNA, 17 nt, Homo sapiens
caagggaggcccagcgc

SEQ ID NO: 849059 - RNA, 22 nt, Homo sapiens
caaggugggaagaucauuugag

SEQ ID NO: 849060 - RNA, 12 nt, Homo sapiens
caaguccaucaa

SEQ ID NO: 849061 - RNA, 16 nt, Homo sapiens
caagucucgcuacauu

SEQ ID NO: 849062 - RNA, 21 nt, Homo sapiens
caagugcugccccugccugug

SEQ ID NO: 849063 - RNA, 20 nt, Homo sapiens
caaguggauauuuucuuaaa

SEQ ID NO: 849064 - RNA, 17 nt, Homo sapiens
caaguggcucaucauca

SEQ ID NO: 849065 - RNA, 14 nt, Homo sapiens
caaguugagacaga

SEQ ID NO: 849066 - RNA, 22 nt, Homo sapiens
caaguugagacagagaagggaa

SEQ ID NO: 849067 - RNA, 20 nt, Homo sapiens
caaguugagcuaugacuuaa

SEQ ID NO: 849068 - RNA, 14 nt, Homo sapiens
caauaaaacugcua

SEQ ID NO: 849069 - RNA, 22 nt, Homo sapiens
caauaaagagaaccaugugcua

SEQ ID NO: 849070 - RNA, 16 nt, Homo sapiens
caauagaacaguuuac

SEQ ID NO: 849071 - RNA, 12 nt, Homo sapiens
caaucauagcau

SEQ ID NO: 849072 - RNA, 20 nt, Homo sapiens
caaugcuggaaacauucacu

SEQ ID NO: 849073 - RNA, 21 nt, Homo sapiens
caaugcuggagaaaaauaucu

SEQ ID NO: 849074 - RNA, 12 nt, Homo sapiens
caauuacauuca

SEQ ID NO: 849075 - RNA, 11 nt, Homo sapiens
caauucucugg

SEQ ID NO: 849076 - RNA, 12 nt, Homo sapiens
caauuucucugc

SEQ ID NO: 849077 - RNA, 15 nt, Homo sapiens
cacaaauacauuccu

SEQ ID NO: 849078 - RNA, 13 nt, Homo sapiens
cacaaauucaugu

SEQ ID NO: 849079 - RNA, 19 nt, Homo sapiens
cacaauaaggaagaaauaa

SEQ ID NO: 849080 - RNA, 16 nt, Homo sapiens
cacaccaguugcccag

SEQ ID NO: 849081 - RNA, 23 nt, Homo sapiens
cacacugaauaagagagcaggau

SEQ ID NO: 849082 - RNA, 21 nt, Homo sapiens
cacagagagguaaaauggagg

SEQ ID NO: 849083 - RNA, 11 nt, Homo sapiens
cacagcaguuu

SEQ ID NO: 849084 - RNA, 21 nt, Homo sapiens
cacaggaagcugcaauucucu

SEQ ID NO: 849085 - RNA, 20 nt, Homo sapiens
cacagggaggggaugaugac

SEQ ID NO: 849086 - RNA, 13 nt, Homo sapiens
cacaguacaggau

SEQ ID NO: 849087 - RNA, 21 nt, Homo sapiens
cacaugguuacauaucaaaac

SEQ ID NO: 849088 - RNA, 16 nt, Homo sapiens
cacauuggcugccuua

SEQ ID NO: 849089 - RNA, 22 nt, Homo sapiens
caccaagagccaauaucuaggc

SEQ ID NO: 849090 - RNA, 18 nt, Homo sapiens
caccaaucuuacuuugua

SEQ ID NO: 849091 - RNA, 15 nt, Homo sapiens
caccacuacaguaag

SEQ ID NO: 849092 - RNA, 20 nt, Homo sapiens
caccacuacaguaagcuggu

SEQ ID NO: 849093 - RNA, 14 nt, Homo sapiens
caccagcaggcacu

SEQ ID NO: 849094 - RNA, 17 nt, Homo sapiens
caccauguaaggucaca

SEQ ID NO: 849095 - RNA, 21 nt, Homo sapiens
cacccuagcccuugcugccac

SEQ ID NO: 849096 - RNA, 15 nt, Homo sapiens
cacccucuggcugag

SEQ ID NO: 849097 - RNA, 14 nt, Homo sapiens
cacccuuucugcca

SEQ ID NO: 849098 - RNA, 16 nt, Homo sapiens
caccgaguuuccagau

SEQ ID NO: 849099 - RNA, 22 nt, Homo sapiens
caccuggguuggucuaauccua

SEQ ID NO: 849100 - RNA, 17 nt, Homo sapiens
caccuguaauuccagca

SEQ ID NO: 849101 - RNA, 13 nt, Homo sapiens
cacgcaguauuga

SEQ ID NO: 849102 - RNA, 22 nt, Homo sapiens
cacgguuuuguugaguuuucac

SEQ ID NO: 849103 - RNA, 20 nt, Homo sapiens
cacguuaaaaguugaccaau

SEQ ID NO: 849104 - RNA, 21 nt, Homo sapiens
cacuaaauaaaggaagugccu

SEQ ID NO: 849105 - RNA, 19 nt, Homo sapiens
cacugacucuggaaaaggc

SEQ ID NO: 849106 - RNA, 11 nt, Homo sapiens
cacugccccag

SEQ ID NO: 849107 - RNA, 18 nt, Homo sapiens
cacugcugaggcuucaua

SEQ ID NO: 849108 - RNA, 22 nt, Homo sapiens
cacugcugaggcuucauaauca

SEQ ID NO: 849109 - RNA, 15 nt, Homo sapiens
cacuggagugaauga

SEQ ID NO: 849110 - RNA, 18 nt, Homo sapiens
cacugggagcugcuccua

SEQ ID NO: 849111 - RNA, 19 nt, Homo sapiens
cacuguaccccagcucucu

SEQ ID NO: 849112 - RNA, 14 nt, Homo sapiens
cacuguuuagauuu

SEQ ID NO: 849113 - RNA, 21 nt, Homo sapiens
cacuucaguuaucuugaucuc

SEQ ID NO: 849114 - RNA, 20 nt, Homo sapiens
cacuugaugggccacacaag

SEQ ID NO: 849115 - RNA, 22 nt, Homo sapiens
cacuugcuagcgguugaaucuu

SEQ ID NO: 849116 - RNA, 19 nt, Homo sapiens
cacuuggagcuaaaacugg

SEQ ID NO: 849117 - RNA, 13 nt, Homo sapiens
cacuuguagauuu

SEQ ID NO: 849118 - RNA, 15 nt, Homo sapiens
cacuuguagauuuga

SEQ ID NO: 849119 - RNA, 17 nt, Homo sapiens
cacuuuucuauauugca

SEQ ID NO: 849120 - RNA, 20 nt, Homo sapiens
cagaaaucugcugcauuuca

SEQ ID NO: 849121 - RNA, 12 nt, Homo sapiens
cagaaccaaacc

SEQ ID NO: 849122 - RNA, 17 nt, Homo sapiens
cagaagaccucccuuca

SEQ ID NO: 849123 - RNA, 14 nt, Homo sapiens
cagaagcuugcaga

SEQ ID NO: 849124 - RNA, 13 nt, Homo sapiens
cagaagugcagaa

SEQ ID NO: 849125 - RNA, 13 nt, Homo sapiens
cagaaucugauac

SEQ ID NO: 849126 - RNA, 21 nt, Homo sapiens
cagacaucaagcucaaggcaa

SEQ ID NO: 849127 - RNA, 14 nt, Homo sapiens
cagacaucagaaca

SEQ ID NO: 849128 - RNA, 21 nt, Homo sapiens
cagaccagccccaccaugcaa

SEQ ID NO: 849129 - RNA, 20 nt, Homo sapiens
cagacgcucauucagcaucu

SEQ ID NO: 849130 - RNA, 21 nt, Homo sapiens
cagacuagaaguuccuaguga

SEQ ID NO: 849131 - RNA, 19 nt, Homo sapiens
cagacuauaaaaucuggau

SEQ ID NO: 849132 - RNA, 22 nt, Homo sapiens
cagacucucauuccuuuccucu

SEQ ID NO: 849133 - RNA, 19 nt, Homo sapiens
cagacuuuuuuaaacauca

SEQ ID NO: 849134 - RNA, 16 nt, Homo sapiens
cagagagagauacucu

SEQ ID NO: 849135 - RNA, 17 nt, Homo sapiens
cagagggccucaucuca

SEQ ID NO: 849136 - RNA, 18 nt, Homo sapiens
cagauaaauuaugguaaa

SEQ ID NO: 849137 - RNA, 12 nt, Homo sapiens
cagaugaacugg

SEQ ID NO: 849138 - RNA, 20 nt, Homo sapiens
cagaugcguccgaagggaaa

SEQ ID NO: 849139 - RNA, 22 nt, Homo sapiens
cagauguccuaauggugaugca

SEQ ID NO: 849140 - RNA, 18 nt, Homo sapiens
caggaaguagcacaggcu

SEQ ID NO: 849141 - RNA, 17 nt, Homo sapiens
caggaaugaaggcuggg

SEQ ID NO: 849142 - RNA, 17 nt, Homo sapiens
caggaccccugcauuua

SEQ ID NO: 849143 - RNA, 21 nt, Homo sapiens
caggagacccuagaugugcuc

SEQ ID NO: 849144 - RNA, 17 nt, Homo sapiens
caggagggacagucuca

SEQ ID NO: 849145 - RNA, 18 nt, Homo sapiens
caggaguucgaguuacag

SEQ ID NO: 849146 - RNA, 17 nt, Homo sapiens
caggauuaggagcuggg

SEQ ID NO: 849147 - RNA, 23 nt, Homo sapiens
caggcagucagguccaugugcac

SEQ ID NO: 849148 - RNA, 21 nt, Homo sapiens
caggccagagccugugggcag

SEQ ID NO: 849149 - RNA, 16 nt, Homo sapiens
caggcccaauccugaa

SEQ ID NO: 849150 - RNA, 15 nt, Homo sapiens
caggccuuggggaca

SEQ ID NO: 849151 - RNA, 16 nt, Homo sapiens
caggccuuggggacaa

SEQ ID NO: 849152 - RNA, 12 nt, Homo sapiens
caggcguucucu

SEQ ID NO: 849153 - RNA, 21 nt, Homo sapiens
caggcuccuguggcugucuug

SEQ ID NO: 849154 - RNA, 21 nt, Homo sapiens
cagggcauaaagcauguuuca

SEQ ID NO: 849155 - RNA, 18 nt, Homo sapiens
caggggccaagcaggcac

SEQ ID NO: 849156 - RNA, 14 nt, Homo sapiens
caggggucuugcaa

SEQ ID NO: 849157 - RNA, 18 nt, Homo sapiens
caggguacaaaaaauuca

SEQ ID NO: 849158 - RNA, 21 nt, Homo sapiens
cagggucucuagugcugugaa

SEQ ID NO: 849159 - RNA, 17 nt, Homo sapiens
cagggugugaggccaca

SEQ ID NO: 849160 - RNA, 19 nt, Homo sapiens
cagguagucaaaggcaguu

SEQ ID NO: 849161 - RNA, 23 nt, Homo sapiens
caggucccaguugcugucacaaa

SEQ ID NO: 849162 - RNA, 18 nt, Homo sapiens
caguacuuugaauuuuag

SEQ ID NO: 849163 - RNA, 22 nt, Homo sapiens
caguacuuugaauuuuagcaca

SEQ ID NO: 849164 - RNA, 16 nt, Homo sapiens
caguagcugggaccac

SEQ ID NO: 849165 - RNA, 16 nt, Homo sapiens
caguauugagcugccu

SEQ ID NO: 849166 - RNA, 19 nt, Homo sapiens
caguauugagcugccugag

SEQ ID NO: 849167 - RNA, 22 nt, Homo sapiens
cagucccuuucagcugcugcuu

SEQ ID NO: 849168 - RNA, 21 nt, Homo sapiens
caguccuaccugagcaacaag

SEQ ID NO: 849169 - RNA, 19 nt, Homo sapiens
cagugcuauucugagugaa

SEQ ID NO: 849170 - RNA, 20 nt, Homo sapiens
caguggcagggcacagggcc

SEQ ID NO: 849171 - RNA, 12 nt, Homo sapiens
cagugugcaaua

SEQ ID NO: 849172 - RNA, 21 nt, Homo sapiens
caguguuuggugcacgcuggg

SEQ ID NO: 849173 - RNA, 17 nt, Homo sapiens
caguugcugucacaaag

SEQ ID NO: 849174 - RNA, 19 nt, Homo sapiens
caguuggauucagaaccaa

SEQ ID NO: 849175 - RNA, 20 nt, Homo sapiens
caguuucccuaucugcaaaa

SEQ ID NO: 849176 - RNA, 22 nt, Homo sapiens
caguuucccuaucugcaaaaug

SEQ ID NO: 849177 - RNA, 16 nt, Homo sapiens
cauaaagaauuuguca

SEQ ID NO: 849178 - RNA, 17 nt, Homo sapiens
cauaagaguuucuccaa

SEQ ID NO: 849179 - RNA, 17 nt, Homo sapiens
cauaauucuaaggaguu

SEQ ID NO: 849180 - RNA, 17 nt, Homo sapiens
cauacuaauucuauguc

SEQ ID NO: 849181 - RNA, 18 nt, Homo sapiens
cauacucaugcaugcaaa

SEQ ID NO: 849182 - RNA, 19 nt, Homo sapiens
cauagaauuaagaguugaa

SEQ ID NO: 849183 - RNA, 22 nt, Homo sapiens
cauaguaccgaauuuaguucau

SEQ ID NO: 849184 - RNA, 14 nt, Homo sapiens
cauauauuagcacc

SEQ ID NO: 849185 - RNA, 15 nt, Homo sapiens
cauaugaacuuucau

SEQ ID NO: 849186 - RNA, 12 nt, Homo sapiens
cauauuaaguaa

SEQ ID NO: 849187 - RNA, 13 nt, Homo sapiens
cauauuugccuug

SEQ ID NO: 849188 - RNA, 20 nt, Homo sapiens
cauauuuugacccaagugga

SEQ ID NO: 849189 - RNA, 21 nt, Homo sapiens
caucacugagacaaucaugua

SEQ ID NO: 849190 - RNA, 16 nt, Homo sapiens
caucagcugcucagau

SEQ ID NO: 849191 - RNA, 23 nt, Homo sapiens
cauccaccguccccucccaggga

SEQ ID NO: 849192 - RNA, 14 nt, Homo sapiens
cauccagcugggag

SEQ ID NO: 849193 - RNA, 17 nt, Homo sapiens
caucccccacuccuugg

SEQ ID NO: 849194 - RNA, 17 nt, Homo sapiens
cauccugucaucugaga

SEQ ID NO: 849195 - RNA, 15 nt, Homo sapiens
cauccuugggaccug

SEQ ID NO: 849196 - RNA, 14 nt, Homo sapiens
caucuaaggacaag

SEQ ID NO: 849197 - RNA, 21 nt, Homo sapiens
caucuaucccagaguacaaag

SEQ ID NO: 849198 - RNA, 21 nt, Homo sapiens
caucucgcuaaagagugaaug

SEQ ID NO: 849199 - RNA, 16 nt, Homo sapiens
caucucuagggaccag

SEQ ID NO: 849200 - RNA, 16 nt, Homo sapiens
caucucugagcaauug

SEQ ID NO: 849201 - RNA, 17 nt, Homo sapiens
caucugucacuugcauu

SEQ ID NO: 849202 - RNA, 18 nt, Homo sapiens
caucugugaauaagccau

SEQ ID NO: 849203 - RNA, 11 nt, Homo sapiens
caugacugugg

SEQ ID NO: 849204 - RNA, 12 nt, Homo sapiens
caugcauucaca

SEQ ID NO: 849205 - RNA, 15 nt, Homo sapiens
caugccuucccugag

SEQ ID NO: 849206 - RNA, 18 nt, Homo sapiens
cauggacggggcccagcu

SEQ ID NO: 849207 - RNA, 15 nt, Homo sapiens
cauggaguugcuaag

SEQ ID NO: 849208 - RNA, 19 nt, Homo sapiens
cauggucuucagcagacaa

SEQ ID NO: 849209 - RNA, 15 nt, Homo sapiens
caugguuacauauca

SEQ ID NO: 849210 - RNA, 12 nt, Homo sapiens
cauguauggcca

SEQ ID NO: 849211 - RNA, 21 nt, Homo sapiens
cauguccuucuuguccacggu

SEQ ID NO: 849212 - RNA, 16 nt, Homo sapiens
cauuagugggaaaaag

SEQ ID NO: 849213 - RNA, 23 nt, Homo sapiens
cauucagacguuuuuucugcaca

SEQ ID NO: 849214 - RNA, 12 nt, Homo sapiens
cauuccauuugc

SEQ ID NO: 849215 - RNA, 15 nt, Homo sapiens
cauucuucugaucac

SEQ ID NO: 849216 - RNA, 20 nt, Homo sapiens
cauuguaaaagcauuuugua

SEQ ID NO: 849217 - RNA, 14 nt, Homo sapiens
cauuguagccucaa

SEQ ID NO: 849218 - RNA, 16 nt, Homo sapiens
cauuguagccucaauc

SEQ ID NO: 849219 - RNA, 18 nt, Homo sapiens
cauuguggucauagcacc

SEQ ID NO: 849220 - RNA, 12 nt, Homo sapiens
cauuuaaaacau

SEQ ID NO: 849221 - RNA, 19 nt, Homo sapiens
cauuuaaaacauuaaaaua

SEQ ID NO: 849222 - RNA, 17 nt, Homo sapiens
cauuucaaauaacugca

SEQ ID NO: 849223 - RNA, 18 nt, Homo sapiens
cauuucaaauaacugcag

SEQ ID NO: 849224 - RNA, 19 nt, Homo sapiens
cauuuccacacuaauguau

SEQ ID NO: 849225 - RNA, 17 nt, Homo sapiens
cauuucuccauggaguu

SEQ ID NO: 849226 - RNA, 15 nt, Homo sapiens
cauuucugauuucag

SEQ ID NO: 849227 - RNA, 16 nt, Homo sapiens
cauuugaguucaggag

SEQ ID NO: 849228 - RNA, 17 nt, Homo sapiens
cauuuggggaccacaga

SEQ ID NO: 849229 - RNA, 19 nt, Homo sapiens
cauuuguugccagauuuca

SEQ ID NO: 849230 - RNA, 17 nt, Homo sapiens
cauuuuagaaugucaau

SEQ ID NO: 849231 - RNA, 19 nt, Homo sapiens
ccaaaacucucauuauucu

SEQ ID NO: 849232 - RNA, 16 nt, Homo sapiens
ccaaaccuuacucuga

SEQ ID NO: 849233 - RNA, 21 nt, Homo sapiens
ccaaacuggaaugagcagcuu

SEQ ID NO: 849234 - RNA, 15 nt, Homo sapiens
ccaaccccucucuca

SEQ ID NO: 849235 - RNA, 13 nt, Homo sapiens
ccaagaacacaag

SEQ ID NO: 849236 - RNA, 21 nt, Homo sapiens
ccaagagucuggggaccagcu

SEQ ID NO: 849237 - RNA, 15 nt, Homo sapiens
ccaagcaggcacucu

SEQ ID NO: 849238 - RNA, 23 nt, Homo sapiens
ccaagccguaggacccaguuucc

SEQ ID NO: 849239 - RNA, 18 nt, Homo sapiens
ccaauaguugguuucaaa

SEQ ID NO: 849240 - RNA, 11 nt, Homo sapiens
ccaaugggcua

SEQ ID NO: 849241 - RNA, 18 nt, Homo sapiens
ccaauuuuuuaagugaaa

SEQ ID NO: 849242 - RNA, 20 nt, Homo sapiens
ccaauuuuuuaagugaaaau

SEQ ID NO: 849243 - RNA, 16 nt, Homo sapiens
ccacacccaacuaauu

SEQ ID NO: 849244 - RNA, 14 nt, Homo sapiens
ccacagccacauuu

SEQ ID NO: 849245 - RNA, 14 nt, Homo sapiens
ccacccuucuucag

SEQ ID NO: 849246 - RNA, 10 nt, Homo sapiens
ccacucucag

SEQ ID NO: 849247 - RNA, 12 nt, Homo sapiens
ccagaaaaucug

SEQ ID NO: 849248 - RNA, 18 nt, Homo sapiens
ccagaugcagcacauaua

SEQ ID NO: 849249 - RNA, 15 nt, Homo sapiens
ccagauggcauccuu

SEQ ID NO: 849250 - RNA, 20 nt, Homo sapiens
ccagcagacaucaagcucaa

SEQ ID NO: 849251 - RNA, 22 nt, Homo sapiens
ccagcaucugaguuagguucca

SEQ ID NO: 849252 - RNA, 19 nt, Homo sapiens
ccagcccagaagugcagaa

SEQ ID NO: 849253 - RNA, 12 nt, Homo sapiens
ccagccugcuuu

SEQ ID NO: 849254 - RNA, 19 nt, Homo sapiens
ccagccugcuuuuucucag

SEQ ID NO: 849255 - RNA, 15 nt, Homo sapiens
ccagcucucuucuaa

SEQ ID NO: 849256 - RNA, 20 nt, Homo sapiens
ccagcuuggcucaggcugag

SEQ ID NO: 849257 - RNA, 16 nt, Homo sapiens
cguuuucuacuuugaa

SEQ ID NO: 849258 - RNA, 21 nt, Homo sapiens
cguuuugaaauaaaaagagua

SEQ ID NO: 849259 - RNA, 18 nt, Homo sapiens
cguuuuuccaguucacau

SEQ ID NO: 849260 - RNA, 14 nt, Homo sapiens
cuaaaaauaucaca

SEQ ID NO: 849261 - RNA, 14 nt, Homo sapiens
cuaaaccauucacc

SEQ ID NO: 849262 - RNA, 16 nt, Homo sapiens
cuaaaguauaacaugu

SEQ ID NO: 849263 - RNA, 11 nt, Homo sapiens
cuaacagagag

SEQ ID NO: 849264 - RNA, 19 nt, Homo sapiens
cuaacguuuucuacuuuga

SEQ ID NO: 849265 - RNA, 18 nt, Homo sapiens
cuaagguuuagauaaaua

SEQ ID NO: 849266 - RNA, 17 nt, Homo sapiens
cuaauauauccacacau

SEQ ID NO: 849267 - RNA, 13 nt, Homo sapiens
cuaauaugcaauu

SEQ ID NO: 849268 - RNA, 19 nt, Homo sapiens
gaagauguauuucaucuca

SEQ ID NO: 849269 - RNA, 14 nt, Homo sapiens
gaaggcuucuugcu

SEQ ID NO: 849270 - RNA, 18 nt, Homo sapiens
gaaguaaaguuucugaua

SEQ ID NO: 849271 - RNA, 17 nt, Homo sapiens
gaagugaaaacuuugua

SEQ ID NO: 849272 - RNA, 20 nt, Homo sapiens
gaagugacugauguucccuc

SEQ ID NO: 849273 - RNA, 13 nt, Homo sapiens
gaaguguucacau

SEQ ID NO: 849274 - RNA, 13 nt, Homo sapiens
uccauacuuugaa

SEQ ID NO: 849275 - RNA, 16 nt, Homo sapiens
uccaucaaguaccuca

SEQ ID NO: 849276 - RNA, 19 nt, Homo sapiens
uccauccaccccucuggca

SEQ ID NO: 849277 - RNA, 17 nt, Homo sapiens
uccaugccugcucucga

SEQ ID NO: 849278 - RNA, 20 nt, Homo sapiens
uccaugugaaacauguugcc

SEQ ID NO: 849279 - RNA, 18 nt, Homo sapiens
uccauguuugcugccuua

SEQ ID NO: 849280 - RNA, 21 nt, Homo sapiens
uccauucuguuccacugcucu

SEQ ID NO: 849281 - RNA, 17 nt, Homo sapiens
uggggcuggcaccagca

SEQ ID NO: 849282 - RNA, 18 nt, Homo sapiens
ugggguugguuugugauc

SEQ ID NO: 849283 - RNA, 20 nt, Homo sapiens
ugguacuccacauauuucag

SEQ ID NO: 849284 - RNA, 15 nt, Homo sapiens
uggucaaaaagcucc

SEQ ID NO: 849285 - RNA, 19 nt, Homo sapiens
uggugacucacaccuguaa

SEQ ID NO: 849286 - RNA, 12 nt, Homo sapiens
uggugaugcagu

SEQ ID NO: 849287 - RNA, 23 nt, Homo sapiens
ugguggcauuuugagaaugguaa

SEQ ID NO: 849288 - RNA, 23 nt, Homo sapiens
ugguuaagggacuugucccaagu

SEQ ID NO: 849289 - RNA, 14 nt, Homo sapiens
ugguuacagcauaa

SEQ ID NO: 849290 - RNA, 13 nt, Homo sapiens
ugguuacauauca

SEQ ID NO: 849291 - RNA, 21 nt, Homo sapiens
ugguuccaugccugcucucga

SEQ ID NO: 849292 - RNA, 20 nt, Homo sapiens
ugguuccucaacccucucaa

SEQ ID NO: 849293 - RNA, 15 nt, Homo sapiens
uguaaaaagugcagu

SEQ ID NO: 849294 - RNA, 19 nt, Homo sapiens
uguaaaaucugacauaaaa

SEQ ID NO: 849295 - RNA, 20 nt, Homo sapiens
aaaaaaugcugaacauugca

SEQ ID NO: 849296 - RNA, 12 nt, Homo sapiens
aaaaagugcagu

SEQ ID NO: 849297 - RNA, 19 nt, Homo sapiens
aaaaauguuaagcaucuaa

SEQ ID NO: 849298 - RNA, 23 nt, Homo sapiens
aaaaauuaccuguauaauggaga

SEQ ID NO: 849299 - RNA, 23 nt, Homo sapiens
aaaacagcccuauuucuugauaa

SEQ ID NO: 849300 - RNA, 23 nt, Homo sapiens
aaaaccuuaagaguucuaaccau

SEQ ID NO: 849301 - RNA, 17 nt, Homo sapiens
aaaacuggcccuguuuc

SEQ ID NO: 849302 - RNA, 14 nt, Homo sapiens
aaaagcccagcuuu

SEQ ID NO: 849303 - RNA, 20 nt, Homo sapiens
aaaaggcauauauguacuag

SEQ ID NO: 849304 - RNA, 12 nt, Homo sapiens
aaaaguaauauu

SEQ ID NO: 849305 - RNA, 15 nt, Homo sapiens
aaaaguaauauuuau

SEQ ID NO: 849306 - RNA, 12 nt, Homo sapiens
aaaagugcagua

SEQ ID NO: 849307 - RNA, 14 nt, Homo sapiens
aaaauaaaacacug

SEQ ID NO: 849308 - RNA, 14 nt, Homo sapiens
aaaaucaaaucaug

SEQ ID NO: 849309 - RNA, 19 nt, Homo sapiens
aaaaucauccuauuacuua

SEQ ID NO: 849310 - RNA, 23 nt, Homo sapiens
aaaaucugaauuggaaugcacuc

SEQ ID NO: 849311 - RNA, 16 nt, Homo sapiens
aaaauguaucaacaca

SEQ ID NO: 849312 - RNA, 12 nt, Homo sapiens
aaaauuccugac

SEQ ID NO: 849313 - RNA, 20 nt, Homo sapiens
aaacaaaucgcagccagcuu

SEQ ID NO: 849314 - RNA, 21 nt, Homo sapiens
aaacaaaucgcagccagcuuu

SEQ ID NO: 849315 - RNA, 17 nt, Homo sapiens
aaacaaccguauaccug

SEQ ID NO: 849316 - RNA, 19 nt, Homo sapiens
aaacacaauccauugucau

SEQ ID NO: 849317 - RNA, 15 nt, Homo sapiens
aaacauuucuuguag

SEQ ID NO: 849318 - RNA, 21 nt, Homo sapiens
aaacccuccccaggucuucca

SEQ ID NO: 849319 - RNA, 20 nt, Homo sapiens
aaaccgaagggacuggaucu

SEQ ID NO: 849320 - RNA, 21 nt, Homo sapiens
aaaccuuucuauaauuuuaca

SEQ ID NO: 849321 - RNA, 15 nt, Homo sapiens
aaacucucauuauuc

SEQ ID NO: 849322 - RNA, 20 nt, Homo sapiens
aaacugccaguuuuguuucc

SEQ ID NO: 849323 - RNA, 16 nt, Homo sapiens
aaacugcucauuucau

SEQ ID NO: 849324 - RNA, 14 nt, Homo sapiens
aaagaaaaccugga

SEQ ID NO: 849325 - RNA, 15 nt, Homo sapiens
aaagaaauacuguau

SEQ ID NO: 849326 - RNA, 15 nt, Homo sapiens
aaagacuugcacaaa

SEQ ID NO: 849327 - RNA, 20 nt, Homo sapiens
aaagagaaagaaaaccugga

SEQ ID NO: 849328 - RNA, 19 nt, Homo sapiens
aaagagaauccaacuuuau

SEQ ID NO: 849329 - RNA, 15 nt, Homo sapiens
aaagagcuccuguaa

SEQ ID NO: 849330 - RNA, 15 nt, Homo sapiens
aaagaggccaaacag

SEQ ID NO: 849331 - RNA, 17 nt, Homo sapiens
aaagagucugacccuuu

SEQ ID NO: 849332 - RNA, 18 nt, Homo sapiens
aaagauauaagacuuaau

SEQ ID NO: 849333 - RNA, 19 nt, Homo sapiens
aaagccccauuaacugcuu

SEQ ID NO: 849334 - RNA, 18 nt, Homo sapiens
aaagcucucuauaccaaa

SEQ ID NO: 849335 - RNA, 17 nt, Homo sapiens
aaaggccagagucacag

SEQ ID NO: 849336 - RNA, 14 nt, Homo sapiens
aaaggcccuuuuag

SEQ ID NO: 849337 - RNA, 19 nt, Homo sapiens
aaaggucauaugcacguua

SEQ ID NO: 849338 - RNA, 21 nt, Homo sapiens
aaaggugugccuggcagccau

SEQ ID NO: 849339 - RNA, 19 nt, Homo sapiens
aaaguaaaagcagcauaaa

SEQ ID NO: 849340 - RNA, 18 nt, Homo sapiens
aaaguaagggaagcagaa

SEQ ID NO: 849341 - RNA, 15 nt, Homo sapiens
aaaguagaacuuugu

SEQ ID NO: 849342 - RNA, 14 nt, Homo sapiens
aaaguagcuuccuc

SEQ ID NO: 849343 - RNA, 15 nt, Homo sapiens
aaaguauaacauguc

SEQ ID NO: 849344 - RNA, 16 nt, Homo sapiens
aaaguauaacaugucg

SEQ ID NO: 849345 - RNA, 20 nt, Homo sapiens
aaaguauuuacugacugcuu

SEQ ID NO: 849346 - RNA, 19 nt, Homo sapiens
aaagucuguugauuaaaga

SEQ ID NO: 849347 - RNA, 18 nt, Homo sapiens
aaagugaacagauuuuau

SEQ ID NO: 849348 - RNA, 11 nt, Homo sapiens
aaagugacaug

SEQ ID NO: 849349 - RNA, 15 nt, Homo sapiens
aaagugacaugcauu

SEQ ID NO: 849350 - RNA, 18 nt, Homo sapiens
aaaguguaaaucuaaaca

SEQ ID NO: 849351 - RNA, 19 nt, Homo sapiens
aaaguguucauugcacaau

SEQ ID NO: 849352 - RNA, 13 nt, Homo sapiens
aaauaaaaagagu

SEQ ID NO: 849353 - RNA, 22 nt, Homo sapiens
aaauaccaaaccuucugacuuu

SEQ ID NO: 849354 - RNA, 16 nt, Homo sapiens
aaauauaggcuuuaaa

SEQ ID NO: 849355 - RNA, 19 nt, Homo sapiens
aaauauccauauuaaguaa

SEQ ID NO: 849356 - RNA, 12 nt, Homo sapiens
aaauauguguau

SEQ ID NO: 849357 - RNA, 20 nt, Homo sapiens
aaaucccaccuuuaccccac

SEQ ID NO: 849358 - RNA, 19 nt, Homo sapiens
aaaucccugcucacugcag

SEQ ID NO: 849359 - RNA, 23 nt, Homo sapiens
aaaugaauuuacagaacaguuua

SEQ ID NO: 849360 - RNA, 11 nt, Homo sapiens
aaaugcuuguc

SEQ ID NO: 849361 - RNA, 12 nt, Homo sapiens
aaauggacaaac

SEQ ID NO: 849362 - RNA, 19 nt, Homo sapiens
aaauggcccggacaugucu

SEQ ID NO: 849363 - RNA, 22 nt, Homo sapiens
aaauguccaguaagaucacugu

SEQ ID NO: 849364 - RNA, 23 nt, Homo sapiens
aaaugugcagaugcuaacuggac

SEQ ID NO: 849365 - RNA, 22 nt, Homo sapiens
aaaugugcauugaauacucuga

SEQ ID NO: 849366 - RNA, 14 nt, Homo sapiens
aaauuaaguacuua

SEQ ID NO: 849367 - RNA, 23 nt, Homo sapiens
aaauuauguuugccacuuugcaa

SEQ ID NO: 849368 - RNA, 15 nt, Homo sapiens
aaauuccagaaugaa

SEQ ID NO: 849369 - RNA, 10 nt, Homo sapiens
aaauugccau

SEQ ID NO: 849370 - RNA, 21 nt, Homo sapiens
aaauugucuuaauggaugaaa

SEQ ID NO: 849371 - RNA, 14 nt, Homo sapiens
aaauuuugaguuau

SEQ ID NO: 849372 - RNA, 23 nt, Homo sapiens
aaauuuuuaaugucuuugagugg

SEQ ID NO: 849373 - RNA, 21 nt, Homo sapiens
aacaaaaaaaaauuacccuuu

SEQ ID NO: 849374 - RNA, 13 nt, Homo sapiens
aacaaaaauguua

SEQ ID NO: 849375 - RNA, 18 nt, Homo sapiens
aacaaaguuuucaugugc

SEQ ID NO: 849376 - RNA, 18 nt, Homo sapiens
aacaacuuaugacuaaaa

SEQ ID NO: 849377 - RNA, 23 nt, Homo sapiens
aacaagagacugcuugacaaagg

SEQ ID NO: 849378 - RNA, 20 nt, Homo sapiens
aacaaguugagcuaugacuu

SEQ ID NO: 849379 - RNA, 15 nt, Homo sapiens
aacaauaaagcaaua

SEQ ID NO: 849380 - RNA, 22 nt, Homo sapiens
aacaauuuugcacuguagauuu

SEQ ID NO: 849381 - RNA, 14 nt, Homo sapiens
aacaguggacaaag

SEQ ID NO: 849382 - RNA, 16 nt, Homo sapiens
aacaguuuacuuggaa

SEQ ID NO: 849383 - RNA, 22 nt, Homo sapiens
aacauacaaaugcaucuuugau

SEQ ID NO: 849384 - RNA, 18 nt, Homo sapiens
aacauggcaaguacagua

SEQ ID NO: 849385 - RNA, 19 nt, Homo sapiens
aacauucguucucuaacca

SEQ ID NO: 849386 - RNA, 17 nt, Homo sapiens
aacauugguucuuucau

SEQ ID NO: 849387 - RNA, 14 nt, Homo sapiens
aacauuuuuagguu

SEQ ID NO: 849388 - RNA, 14 nt, Homo sapiens
aaccacacagcuaa

SEQ ID NO: 849389 - RNA, 21 nt, Homo sapiens
aaccacgaaugagguaggcac

SEQ ID NO: 849390 - RNA, 12 nt, Homo sapiens
aaccaugugcua

SEQ ID NO: 849391 - RNA, 23 nt, Homo sapiens
aacccacagguguuggcugccug

SEQ ID NO: 849392 - RNA, 22 nt, Homo sapiens
aaccccagacccccaucacuug

SEQ ID NO: 849393 - RNA, 22 nt, Homo sapiens
aaccccaggcuacugagccacc

SEQ ID NO: 849394 - RNA, 16 nt, Homo sapiens
aaccccucgcccaguc

SEQ ID NO: 849395 - RNA, 20 nt, Homo sapiens
aacccgcagccucucugcac

SEQ ID NO: 849396 - RNA, 20 nt, Homo sapiens
aacguauaauauguacauca

SEQ ID NO: 849397 - RNA, 23 nt, Homo sapiens
aggagugccuucauacacuguac

SEQ ID NO: 849398 - RNA, 14 nt, Homo sapiens
aggaguuggaguua

SEQ ID NO: 849399 - RNA, 20 nt, Homo sapiens
aggauccagacucucauucc

SEQ ID NO: 849400 - RNA, 15 nt, Homo sapiens
aggauuaaugaucau

SEQ ID NO: 849401 - RNA, 17 nt, Homo sapiens
aggcaaucccuguagcc

SEQ ID NO: 849402 - RNA, 18 nt, Homo sapiens
aggcaauuucucugcaca

SEQ ID NO: 849403 - RNA, 20 nt, Homo sapiens
aggcagaggcaggaaacuaa

SEQ ID NO: 849404 - RNA, 20 nt, Homo sapiens
aggcagcccugccucugacu

SEQ ID NO: 849405 - RNA, 16 nt, Homo sapiens
aggcagccucuggaau

SEQ ID NO: 849406 - RNA, 15 nt, Homo sapiens
aggcaggcagggcau

SEQ ID NO: 849407 - RNA, 14 nt, Homo sapiens
aggcagggcaagaa

SEQ ID NO: 849408 - RNA, 15 nt, Homo sapiens
aggcaucaccaugaa

SEQ ID NO: 849409 - RNA, 16 nt, Homo sapiens
aggcaugggccaccac

SEQ ID NO: 849410 - RNA, 15 nt, Homo sapiens
aggccaaugggcuag

SEQ ID NO: 849411 - RNA, 18 nt, Homo sapiens
aggccacacccagaguag

SEQ ID NO: 849412 - RNA, 15 nt, Homo sapiens
aggccagaagaccuc

SEQ ID NO: 849413 - RNA, 16 nt, Homo sapiens
aggccagugccauuuc

SEQ ID NO: 849414 - RNA, 15 nt, Homo sapiens
aggcccaggcuccag

SEQ ID NO: 849415 - RNA, 14 nt, Homo sapiens
aggccuccaaagca

SEQ ID NO: 849416 - RNA, 19 nt, Homo sapiens
aggcgccacccuucuucag

SEQ ID NO: 849417 - RNA, 15 nt, Homo sapiens
aggcuggagugcagu

SEQ ID NO: 849418 - RNA, 15 nt, Homo sapiens
aggcuucauaaucau

SEQ ID NO: 849419 - RNA, 16 nt, Homo sapiens
agggacagucucacca

SEQ ID NO: 849420 - RNA, 20 nt, Homo sapiens
agggagaacucuaucugugg

SEQ ID NO: 849421 - RNA, 16 nt, Homo sapiens
agggagacagaccacu

SEQ ID NO: 849422 - RNA, 23 nt, Homo sapiens
agggccuucugccugcugaccau

SEQ ID NO: 849423 - RNA, 17 nt, Homo sapiens
agggcuggucauucaca

SEQ ID NO: 849424 - RNA, 21 nt, Homo sapiens
aggggagggagaaguuucugu

SEQ ID NO: 849425 - RNA, 17 nt, Homo sapiens
aggggauccagcucaag

SEQ ID NO: 849426 - RNA, 18 nt, Homo sapiens
agggggccuccaggagac

SEQ ID NO: 849427 - RNA, 21 nt, Homo sapiens
agguaaggagggucacugggg

SEQ ID NO: 849428 - RNA, 12 nt, Homo sapiens
agguauaauuca

SEQ ID NO: 849429 - RNA, 11 nt, Homo sapiens
aggucagucuu

SEQ ID NO: 849430 - RNA, 18 nt, Homo sapiens
agguccaugugcacugca

SEQ ID NO: 849431 - RNA, 17 nt, Homo sapiens
aggucuuuuuacauugu

SEQ ID NO: 849432 - RNA, 17 nt, Homo sapiens
aggugaccauagggcuc

SEQ ID NO: 849433 - RNA, 18 nt, Homo sapiens
aggugagaacuaaugccu

SEQ ID NO: 849434 - RNA, 22 nt, Homo sapiens
aggugaucugcugcagagcagu

SEQ ID NO: 849435 - RNA, 17 nt, Homo sapiens
agguuauuuugauguaa

SEQ ID NO: 849436 - RNA, 21 nt, Homo sapiens
aguaacgacauggaacugaaa

SEQ ID NO: 849437 - RNA, 21 nt, Homo sapiens
aguagaacuuuguauaguuau

SEQ ID NO: 849438 - RNA, 20 nt, Homo sapiens
aguaggaaaggacugagagu

SEQ ID NO: 849439 - RNA, 17 nt, Homo sapiens
aguaguuguacuaugau

SEQ ID NO: 849440 - RNA, 22 nt, Homo sapiens
aguauauuccucugcugaacaa

SEQ ID NO: 849441 - RNA, 20 nt, Homo sapiens
aguauauuuuugcaggugcu

SEQ ID NO: 849442 - RNA, 22 nt, Homo sapiens
aguauauuuuugcaggugcuuu

SEQ ID NO: 849443 - RNA, 16 nt, Homo sapiens
aguauguucauugcca

SEQ ID NO: 849444 - RNA, 16 nt, Homo sapiens
aguauuaauagguuaa

SEQ ID NO: 849445 - RNA, 15 nt, Homo sapiens
agucaccaaguguau

SEQ ID NO: 849446 - RNA, 16 nt, Homo sapiens
agucaccaaguguauu

SEQ ID NO: 849447 - RNA, 20 nt, Homo sapiens
agucagguccaugugcacug

SEQ ID NO: 849448 - RNA, 21 nt, Homo sapiens
aguccacagaagugagcuccu

SEQ ID NO: 849449 - RNA, 20 nt, Homo sapiens
aguccuauuuagacauguaa

SEQ ID NO: 849450 - RNA, 17 nt, Homo sapiens
agucucgcuacauuucc

SEQ ID NO: 849451 - RNA, 14 nt, Homo sapiens
agucuggagggcug

SEQ ID NO: 849452 - RNA, 14 nt, Homo sapiens
agucuggggaccag

SEQ ID NO: 849453 - RNA, 21 nt, Homo sapiens
agucuguguuuaaagugaauu

SEQ ID NO: 849454 - RNA, 14 nt, Homo sapiens
agucuguugauuaa

SEQ ID NO: 849455 - RNA, 18 nt, Homo sapiens
agugaauuuggucucucc

SEQ ID NO: 849456 - RNA, 20 nt, Homo sapiens
agugaauuuggucucuccca

SEQ ID NO: 849457 - RNA, 13 nt, Homo sapiens
agugagacccugu

SEQ ID NO: 849458 - RNA, 21 nt, Homo sapiens
agugagcuccugccuuagggc

SEQ ID NO: 849459 - RNA, 17 nt, Homo sapiens
agugaggaauggcagug

SEQ ID NO: 849460 - RNA, 19 nt, Homo sapiens
agugcagugauguuugcca

SEQ ID NO: 849461 - RNA, 17 nt, Homo sapiens
agugcaugggucagggu

SEQ ID NO: 849462 - RNA, 17 nt, Homo sapiens
agugcccaggcacuccu

SEQ ID NO: 849463 - RNA, 21 nt, Homo sapiens
agugccuuaaacucuguuaca

SEQ ID NO: 849464 - RNA, 14 nt, Homo sapiens
aguggguacuuucu

SEQ ID NO: 849465 - RNA, 13 nt, Homo sapiens
agugucuaccugg

SEQ ID NO: 849466 - RNA, 21 nt, Homo sapiens
agugugaccaguuuugauauu

SEQ ID NO: 849467 - RNA, 13 nt, Homo sapiens
aguguggucagag

SEQ ID NO: 849468 - RNA, 21 nt, Homo sapiens
aguguucugggauuucucuag

SEQ ID NO: 849469 - RNA, 20 nt, Homo sapiens
aguuaaacuuuagugcuaca

SEQ ID NO: 849470 - RNA, 19 nt, Homo sapiens
aguuaggucuuuaaggaaa

SEQ ID NO: 849471 - RNA, 15 nt, Homo sapiens
aguuaguuccacuga

SEQ ID NO: 849472 - RNA, 13 nt, Homo sapiens
aguucaaccuuua

SEQ ID NO: 849473 - RNA, 16 nt, Homo sapiens
aguucucaaagaccug

SEQ ID NO: 849474 - RNA, 19 nt, Homo sapiens
aguucugacuuugaauuua

SEQ ID NO: 849475 - RNA, 14 nt, Homo sapiens
aguuguuagauuaa

SEQ ID NO: 849476 - RNA, 21 nt, Homo sapiens
aguuuauauuuuuucucaaaa

SEQ ID NO: 849477 - RNA, 18 nt, Homo sapiens
aguuucugugguuggcug

SEQ ID NO: 849478 - RNA, 22 nt, Homo sapiens
aguuucuuuccuaaaccauuca

SEQ ID NO: 849479 - RNA, 15 nt, Homo sapiens
aguuugaauauuuaa

SEQ ID NO: 849480 - RNA, 16 nt, Homo sapiens
aguuugacacuugaaa

SEQ ID NO: 849481 - RNA, 17 nt, Homo sapiens
aguuugcuguaccacaa

SEQ ID NO: 849482 - RNA, 17 nt, Homo sapiens
aguuuuaaguaugucua

SEQ ID NO: 849483 - RNA, 18 nt, Homo sapiens
aguuuucaugugcucaga

SEQ ID NO: 849484 - RNA, 17 nt, Homo sapiens
auaaaaacuuugcagaa

SEQ ID NO: 849485 - RNA, 12 nt, Homo sapiens
auaaaacaugag

SEQ ID NO: 849486 - RNA, 21 nt, Homo sapiens
auaaaccuugcggauguggcu

SEQ ID NO: 849487 - RNA, 13 nt, Homo sapiens
auaaagcacauuc

SEQ ID NO: 849488 - RNA, 16 nt, Homo sapiens
auaaagcacauuccaa

SEQ ID NO: 849489 - RNA, 23 nt, Homo sapiens
auaacagugccagcuucuuugca

SEQ ID NO: 849490 - RNA, 16 nt, Homo sapiens
auaacuguuguugaua

SEQ ID NO: 849491 - RNA, 20 nt, Homo sapiens
auaagaacaaauacaauaca

SEQ ID NO: 849492 - RNA, 15 nt, Homo sapiens
auaagaccccacugg

SEQ ID NO: 849493 - RNA, 17 nt, Homo sapiens
auaagaccccacuggag

SEQ ID NO: 849494 - RNA, 22 nt, Homo sapiens
auaagaccccacuggagucucu

SEQ ID NO: 849495 - RNA, 23 nt, Homo sapiens
auaagacguauguaaacaaaaac

SEQ ID NO: 849496 - RNA, 15 nt, Homo sapiens
auaagaggaggagaa

SEQ ID NO: 849497 - RNA, 19 nt, Homo sapiens
auaagcaaaaucagaagua

SEQ ID NO: 849498 - RNA, 18 nt, Homo sapiens
auaagcuaguugaauacu

SEQ ID NO: 849499 - RNA, 23 nt, Homo sapiens
auaagcuaguugaauacuugaac

SEQ ID NO: 849500 - RNA, 19 nt, Homo sapiens
auaaucgacuuguucuuga

SEQ ID NO: 849501 - RNA, 20 nt, Homo sapiens
auaaugaauaaagugcaaac

SEQ ID NO: 849502 - RNA, 18 nt, Homo sapiens
auaauucaaagcaccaaa

SEQ ID NO: 849503 - RNA, 15 nt, Homo sapiens
auacaaaacuauuaa

SEQ ID NO: 849504 - RNA, 16 nt, Homo sapiens
auacaaaugcaucuuu

SEQ ID NO: 849505 - RNA, 17 nt, Homo sapiens
auacauaggaugacaaa

SEQ ID NO: 849506 - RNA, 15 nt, Homo sapiens
auacaucaaggaguu

SEQ ID NO: 849507 - RNA, 16 nt, Homo sapiens
auacauuccuuuuaga

SEQ ID NO: 849508 - RNA, 16 nt, Homo sapiens
auaccaagcaugugga

SEQ ID NO: 849509 - RNA, 18 nt, Homo sapiens
auacuaaauaugagacag

SEQ ID NO: 849510 - RNA, 14 nt, Homo sapiens
auacuuagaccaaa

SEQ ID NO: 849511 - RNA, 12 nt, Homo sapiens
auacuucagguu

SEQ ID NO: 849512 - RNA, 16 nt, Homo sapiens
auagcaaauggccuca

SEQ ID NO: 849513 - RNA, 18 nt, Homo sapiens
auagcgacagugugggac

SEQ ID NO: 849514 - RNA, 21 nt, Homo sapiens
auaguuuaaaaaucugccacc

SEQ ID NO: 849515 - RNA, 14 nt, Homo sapiens
auauaaaacuauaa

SEQ ID NO: 849516 - RNA, 12 nt, Homo sapiens
auauaacuggag

SEQ ID NO: 849517 - RNA, 17 nt, Homo sapiens
auauauuaaagcaucag

SEQ ID NO: 849518 - RNA, 17 nt, Homo sapiens
auaucaaaacaucccaa

SEQ ID NO: 849519 - RNA, 13 nt, Homo sapiens
auaucuaggcauu

SEQ ID NO: 849520 - RNA, 22 nt, Homo sapiens
auaucuuugaguucaaccuuua

SEQ ID NO: 849521 - RNA, 14 nt, Homo sapiens
auaugaagaaucug

SEQ ID NO: 849522 - RNA, 16 nt, Homo sapiens
auaugaagaaucugcu

SEQ ID NO: 849523 - RNA, 23 nt, Homo sapiens
auauggcugcuucaaaggccaga

SEQ ID NO: 849524 - RNA, 18 nt, Homo sapiens
auauguuucacaguacag

SEQ ID NO: 849525 - RNA, 20 nt, Homo sapiens
auauuccccuaagauuugau

SEQ ID NO: 849526 - RNA, 18 nt, Homo sapiens
auauuccucugcugaaca

SEQ ID NO: 849527 - RNA, 23 nt, Homo sapiens
auauucuaguaauaaagacucua

SEQ ID NO: 849528 - RNA, 19 nt, Homo sapiens
auauucugauguuucucau

SEQ ID NO: 849529 - RNA, 21 nt, Homo sapiens
ccagcaggagggacagucuca

SEQ ID NO: 849530 - RNA, 18 nt, Homo sapiens
ccagccaaacacacagaa

SEQ ID NO: 849531 - RNA, 17 nt, Homo sapiens
ccaggauugucacucca

SEQ ID NO: 849532 - RNA, 23 nt, Homo sapiens
ccaggcccaccuggaaucccaca

SEQ ID NO: 849533 - RNA, 17 nt, Homo sapiens
ccaggccuuggggacaa

SEQ ID NO: 849534 - RNA, 14 nt, Homo sapiens
ccaggcugcucuca

SEQ ID NO: 849535 - RNA, 21 nt, Homo sapiens
ccagguggagaaaucacagag

SEQ ID NO: 849536 - RNA, 22 nt, Homo sapiens
ccagguggagguggcaucccca

SEQ ID NO: 849537 - RNA, 15 nt, Homo sapiens
ccaggugggagccaa

SEQ ID NO: 849538 - RNA, 21 nt, Homo sapiens
ccaguaccuucugccagaaga

SEQ ID NO: 849539 - RNA, 20 nt, Homo sapiens
ccagugaauuuggucucucc

SEQ ID NO: 849540 - RNA, 16 nt, Homo sapiens
ccauaacagugccagc

SEQ ID NO: 849541 - RNA, 20 nt, Homo sapiens
ccauacucaugcaugcaaau

SEQ ID NO: 849542 - RNA, 21 nt, Homo sapiens
ccaucaaguaccucaucugca

SEQ ID NO: 849543 - RNA, 16 nt, Homo sapiens
ccaucccaacaccuca

SEQ ID NO: 849544 - RNA, 23 nt, Homo sapiens
ccaucuuuuguuacucuugggac

SEQ ID NO: 849545 - RNA, 16 nt, Homo sapiens
ccauggucuucagcag

SEQ ID NO: 849546 - RNA, 14 nt, Homo sapiens
ccauuccauaauca

SEQ ID NO: 849547 - RNA, 17 nt, Homo sapiens
ccauuggugcuaccugg

SEQ ID NO: 849548 - RNA, 16 nt, Homo sapiens
cccacagccacauuuc

SEQ ID NO: 849549 - RNA, 12 nt, Homo sapiens
cccacuggaguc

SEQ ID NO: 849550 - RNA, 20 nt, Homo sapiens
cccagaaaagguacacuuug

SEQ ID NO: 849551 - RNA, 15 nt, Homo sapiens
cccagaaacaacaca

SEQ ID NO: 849552 - RNA, 13 nt, Homo sapiens
cccagaauacuga

SEQ ID NO: 849553 - RNA, 18 nt, Homo sapiens
cccagguagucaaaggca

SEQ ID NO: 849554 - RNA, 16 nt, Homo sapiens
cccaggugggagccaa

SEQ ID NO: 849555 - RNA, 16 nt, Homo sapiens
cccagucccuuucagc

SEQ ID NO: 849556 - RNA, 17 nt, Homo sapiens
cccaguggcagggcaca

SEQ ID NO: 849557 - RNA, 13 nt, Homo sapiens
cccaucugugaau

SEQ ID NO: 849558 - RNA, 17 nt, Homo sapiens
cccauggaccaugcugu

SEQ ID NO: 849559 - RNA, 15 nt, Homo sapiens
ccccacguggacaag

SEQ ID NO: 849560 - RNA, 17 nt, Homo sapiens
ccccaggauugaccucu

SEQ ID NO: 849561 - RNA, 14 nt, Homo sapiens
ccccucucagcuuu

SEQ ID NO: 849562 - RNA, 14 nt, Homo sapiens
ccccugagcccacu

SEQ ID NO: 849563 - RNA, 18 nt, Homo sapiens
ccccugauucacugccua

SEQ ID NO: 849564 - RNA, 23 nt, Homo sapiens
ccccugcucaagucuacccugau

SEQ ID NO: 849565 - RNA, 16 nt, Homo sapiens
cccgacuccaguccaa

SEQ ID NO: 849566 - RNA, 18 nt, Homo sapiens
cccgguacaaguggcuca

SEQ ID NO: 849567 - RNA, 20 nt, Homo sapiens
cccuaagauuugauauaugu

SEQ ID NO: 849568 - RNA, 13 nt, Homo sapiens
cccucauuucaca

SEQ ID NO: 849569 - RNA, 21 nt, Homo sapiens
cccuccucaugccuucccuga

SEQ ID NO: 849570 - RNA, 23 nt, Homo sapiens
cccucucuuucuaagagaccuga

SEQ ID NO: 849571 - RNA, 19 nt, Homo sapiens
cccugcuguaucuuccaga

SEQ ID NO: 849572 - RNA, 19 nt, Homo sapiens
cccuguacauaucuuugag

SEQ ID NO: 849573 - RNA, 20 nt, Homo sapiens
cccuguggccuucacuuugu

SEQ ID NO: 849574 - RNA, 15 nt, Homo sapiens
cccuuuggcccugaa

SEQ ID NO: 849575 - RNA, 17 nt, Homo sapiens
ccgguacaaguggcuca

SEQ ID NO: 849576 - RNA, 16 nt, Homo sapiens
ccguagcuucuagucu

SEQ ID NO: 849577 - RNA, 21 nt, Homo sapiens
ccguccccucccagggagcaa

SEQ ID NO: 849578 - RNA, 16 nt, Homo sapiens
ccgugggcuguuacuu

SEQ ID NO: 849579 - RNA, 21 nt, Homo sapiens
ccuaacguuuucuacuuugaa

SEQ ID NO: 849580 - RNA, 21 nt, Homo sapiens
ccuaacuguuuuguauaugcu

SEQ ID NO: 849581 - RNA, 12 nt, Homo sapiens
ccuacaacugaa

SEQ ID NO: 849582 - RNA, 20 nt, Homo sapiens
ccuagaguauauuccucugc

SEQ ID NO: 849583 - RNA, 12 nt, Homo sapiens
ccuagauaugaa

SEQ ID NO: 849584 - RNA, 15 nt, Homo sapiens
ccuagauaugaagaa

SEQ ID NO: 849585 - RNA, 15 nt, Homo sapiens
ccuagcuauaugcau

SEQ ID NO: 849586 - RNA, 18 nt, Homo sapiens
ccuaucaaaaagauauca

SEQ ID NO: 849587 - RNA, 12 nt, Homo sapiens
ccuaucugcaaa

SEQ ID NO: 849588 - RNA, 14 nt, Homo sapiens
ccuaucugcaaaau

SEQ ID NO: 849589 - RNA, 16 nt, Homo sapiens
ccuaugacacagaagc

SEQ ID NO: 849590 - RNA, 19 nt, Homo sapiens
ccucaaccaacaacaaugu

SEQ ID NO: 849591 - RNA, 18 nt, Homo sapiens
ccucaacccucucaaguc

SEQ ID NO: 849592 - RNA, 20 nt, Homo sapiens
ccucauggaugcuuuggcaa

SEQ ID NO: 849593 - RNA, 19 nt, Homo sapiens
ccucauuuucacagcacua

SEQ ID NO: 849594 - RNA, 20 nt, Homo sapiens
ccuccaggcccagcugagga

SEQ ID NO: 849595 - RNA, 22 nt, Homo sapiens
ccuccauaauguaagaagcuuu

SEQ ID NO: 849596 - RNA, 19 nt, Homo sapiens
ccucccccgacgcucucuc

SEQ ID NO: 849597 - RNA, 18 nt, Homo sapiens
ccucccugacgucugcca

SEQ ID NO: 849598 - RNA, 21 nt, Homo sapiens
ccuccuuucauugcuguuguc

SEQ ID NO: 849599 - RNA, 18 nt, Homo sapiens
ccucuccaccugcauuau

SEQ ID NO: 849600 - RNA, 18 nt, Homo sapiens
ccucuccuggcugugguu

SEQ ID NO: 849601 - RNA, 15 nt, Homo sapiens
ccucucugcacacua

SEQ ID NO: 849602 - RNA, 19 nt, Homo sapiens
ccucugaccccugccugug

SEQ ID NO: 849603 - RNA, 21 nt, Homo sapiens
ccucugauguucuuccaguga

SEQ ID NO: 849604 - RNA, 16 nt, Homo sapiens
ccucuggaauggcuca

SEQ ID NO: 849605 - RNA, 15 nt, Homo sapiens
ccucuggcaccuggg

SEQ ID NO: 849606 - RNA, 22 nt, Homo sapiens
ccucuguauuuuuuaaaacauc

SEQ ID NO: 849607 - RNA, 20 nt, Homo sapiens
ccugaaccagggccagauaa

SEQ ID NO: 849608 - RNA, 22 nt, Homo sapiens
ccugagcuuuggugcaucucau

SEQ ID NO: 849609 - RNA, 17 nt, Homo sapiens
ccugagggaggaggcag

SEQ ID NO: 849610 - RNA, 22 nt, Homo sapiens
ccugagugagaggggaggccaa

SEQ ID NO: 849611 - RNA, 16 nt, Homo sapiens
ccugauuuguuccuuc

SEQ ID NO: 849612 - RNA, 20 nt, Homo sapiens
ccugcugcgcucggcccuca

SEQ ID NO: 849613 - RNA, 17 nt, Homo sapiens
ccugcuguccuccagaa

SEQ ID NO: 849614 - RNA, 23 nt, Homo sapiens
ccuggaacccaacaguucaugga

SEQ ID NO: 849615 - RNA, 23 nt, Homo sapiens
ccuggaaugggucucucuugccc

SEQ ID NO: 849616 - RNA, 22 nt, Homo sapiens
ccuggacucccguguaggaacc

SEQ ID NO: 849617 - RNA, 21 nt, Homo sapiens
ccuggcagcccgcaucagcug

SEQ ID NO: 849618 - RNA, 14 nt, Homo sapiens
ccuggcccaugugc

SEQ ID NO: 849619 - RNA, 20 nt, Homo sapiens
ccuggccucagggcucugac

SEQ ID NO: 849620 - RNA, 19 nt, Homo sapiens
ccuggcucccucacucuca

SEQ ID NO: 849621 - RNA, 20 nt, Homo sapiens
ccuguaaggggccagagccu

SEQ ID NO: 849622 - RNA, 15 nt, Homo sapiens
ccuguugucaagaau

SEQ ID NO: 849623 - RNA, 22 nt, Homo sapiens
ccuguugucaagaauagcauug

SEQ ID NO: 849624 - RNA, 16 nt, Homo sapiens
ccuucauacacuguac

SEQ ID NO: 849625 - RNA, 14 nt, Homo sapiens
ccuucccuccucau

SEQ ID NO: 849626 - RNA, 13 nt, Homo sapiens
ccuuccuugaacc

SEQ ID NO: 849627 - RNA, 17 nt, Homo sapiens
ccuuccuugaacccuaa

SEQ ID NO: 849628 - RNA, 14 nt, Homo sapiens
ccuucuauacaugu

SEQ ID NO: 849629 - RNA, 17 nt, Homo sapiens
ccuucuggggcuuugcc

SEQ ID NO: 849630 - RNA, 20 nt, Homo sapiens
ccuucuggggcuuugccauu

SEQ ID NO: 849631 - RNA, 14 nt, Homo sapiens
ccuugucagauauu

SEQ ID NO: 849632 - RNA, 23 nt, Homo sapiens
ccuuuaccccaccuuccugggaa

SEQ ID NO: 849633 - RNA, 18 nt, Homo sapiens
ccuuuaguuauaaaggaa

SEQ ID NO: 849634 - RNA, 20 nt, Homo sapiens
ccuuucaccccauccacaug

SEQ ID NO: 849635 - RNA, 20 nt, Homo sapiens
ccuuucuacuuccaagacuu

SEQ ID NO: 849636 - RNA, 22 nt, Homo sapiens
ccuuucugccagggauggcagu

SEQ ID NO: 849637 - RNA, 11 nt, Homo sapiens
cgaacaccagg

SEQ ID NO: 849638 - RNA, 17 nt, Homo sapiens
cgauucucuugccucag

SEQ ID NO: 849639 - RNA, 23 nt, Homo sapiens
cgcacccuccuuucucaccagcc

SEQ ID NO: 849640 - RNA, 22 nt, Homo sapiens
cgcagccagcuuuuccagaaau

SEQ ID NO: 849641 - RNA, 17 nt, Homo sapiens
cgcagccuagauaugaa

SEQ ID NO: 849642 - RNA, 19 nt, Homo sapiens
cgccacaucccucucugcu

SEQ ID NO: 849643 - RNA, 15 nt, Homo sapiens
cgccagcucccgcca

SEQ ID NO: 849644 - RNA, 21 nt, Homo sapiens
cgcccagagaacaagcacugu

SEQ ID NO: 849645 - RNA, 20 nt, Homo sapiens
cgccugaguaacgacaugga

SEQ ID NO: 849646 - RNA, 16 nt, Homo sapiens
cgcuaaagagugaaug

SEQ ID NO: 849647 - RNA, 15 nt, Homo sapiens
cgcucuguugcccag

SEQ ID NO: 849648 - RNA, 22 nt, Homo sapiens
cgcuguuggggcugcucauguu

SEQ ID NO: 849649 - RNA, 20 nt, Homo sapiens
cggaaaacaagccugaggga

SEQ ID NO: 849650 - RNA, 15 nt, Homo sapiens
cggggucaagcugga

SEQ ID NO: 849651 - RNA, 15 nt, Homo sapiens
cguaguuacucucag

SEQ ID NO: 849652 - RNA, 22 nt, Homo sapiens
cguauguaaacaaaaacaacug

SEQ ID NO: 849653 - RNA, 21 nt, Homo sapiens
cgucuguugcuccccuggguc

SEQ ID NO: 849654 - RNA, 17 nt, Homo sapiens
cguguaggaaccugcac

SEQ ID NO: 849655 - RNA, 18 nt, Homo sapiens
cguuuguuuguuucaaua

SEQ ID NO: 849656 - RNA, 12 nt, Homo sapiens
cuaaagccucaa

SEQ ID NO: 849657 - RNA, 17 nt, Homo sapiens
cuaaaguauaacauguc

SEQ ID NO: 849658 - RNA, 15 nt, Homo sapiens
cuaaauaaguuauaa

SEQ ID NO: 849659 - RNA, 16 nt, Homo sapiens
cuaaaugaacucaaua

SEQ ID NO: 849660 - RNA, 23 nt, Homo sapiens
ggcauggugguugggacccagug

SEQ ID NO: 849661 - RNA, 21 nt, Homo sapiens
ggccaaugcuggaaacauuca

SEQ ID NO: 849662 - RNA, 18 nt, Homo sapiens
ggccaauucguucucugc

SEQ ID NO: 849663 - RNA, 14 nt, Homo sapiens
ggccacacccagag

SEQ ID NO: 849664 - RNA, 20 nt, Homo sapiens
ggcccaagagucuggggacc

SEQ ID NO: 849665 - RNA, 13 nt, Homo sapiens
ggcccacccugcu

SEQ ID NO: 849666 - RNA, 19 nt, Homo sapiens
ggcccaccuggaaucccac

SEQ ID NO: 849667 - RNA, 18 nt, Homo sapiens
ggcccaccuuauagagag

SEQ ID NO: 849668 - RNA, 11 nt, Homo sapiens
ggcccacugug

SEQ ID NO: 849669 - RNA, 14 nt, Homo sapiens
ggcccacugugcag

SEQ ID NO: 849670 - RNA, 20 nt, Homo sapiens
ggcccagcgcggacaucccc

SEQ ID NO: 849671 - RNA, 15 nt, Homo sapiens
ggcccggcaugaggc

SEQ ID NO: 849672 - RNA, 14 nt, Homo sapiens
ggcccugaaccagg

SEQ ID NO: 849673 - RNA, 16 nt, Homo sapiens
ggcccugagccacuga

SEQ ID NO: 849674 - RNA, 11 nt, Homo sapiens
ggccucaggug

SEQ ID NO: 849675 - RNA, 13 nt, Homo sapiens
ggccuccaccucu

SEQ ID NO: 849676 - RNA, 19 nt, Homo sapiens
ggccuccaccucugugcag

SEQ ID NO: 849677 - RNA, 16 nt, Homo sapiens
ggccuccugccaugua

SEQ ID NO: 849678 - RNA, 14 nt, Homo sapiens
ggccuuacuguaua

SEQ ID NO: 849679 - RNA, 13 nt, Homo sapiens
ggcuaucagagac

SEQ ID NO: 849680 - RNA, 20 nt, Homo sapiens
ggcucagauuguaauaugua

SEQ ID NO: 849681 - RNA, 12 nt, Homo sapiens
ggcucagggauu

SEQ ID NO: 849682 - RNA, 20 nt, Homo sapiens
ggcucagucgcuagcauuuc

SEQ ID NO: 849683 - RNA, 18 nt, Homo sapiens
ggcucccucacucucagg

SEQ ID NO: 849684 - RNA, 18 nt, Homo sapiens
ggcuccucucacuuccca

SEQ ID NO: 849685 - RNA, 17 nt, Homo sapiens
ggcucugacucugccag

SEQ ID NO: 849686 - RNA, 19 nt, Homo sapiens
ggcugaguguucugggauu

SEQ ID NO: 849687 - RNA, 19 nt, Homo sapiens
ggcuucuugcuuacaggaa

SEQ ID NO: 849688 - RNA, 13 nt, Homo sapiens
ggcuugcccaguc

SEQ ID NO: 849689 - RNA, 13 nt, Homo sapiens
gggaaauugcagc

SEQ ID NO: 849690 - RNA, 17 nt, Homo sapiens
gggaauccgacacagga

SEQ ID NO: 849691 - RNA, 20 nt, Homo sapiens
gggacaacuguagaggcagu

SEQ ID NO: 849692 - RNA, 17 nt, Homo sapiens
gggaccacagaggcugu

SEQ ID NO: 849693 - RNA, 18 nt, Homo sapiens
gggacccuccaaggccag

SEQ ID NO: 849694 - RNA, 17 nt, Homo sapiens
gggcaggaaccagacaa

SEQ ID NO: 849695 - RNA, 14 nt, Homo sapiens
gggcaucauucucu

SEQ ID NO: 849696 - RNA, 17 nt, Homo sapiens
gggccagacccugccca

SEQ ID NO: 849697 - RNA, 16 nt, Homo sapiens
gggccccgucucaggu

SEQ ID NO: 849698 - RNA, 16 nt, Homo sapiens
gggcuaccaggaagaa

SEQ ID NO: 849699 - RNA, 17 nt, Homo sapiens
gggcucagcaaggccac

SEQ ID NO: 849700 - RNA, 15 nt, Homo sapiens
gggcuggcaccagca

SEQ ID NO: 849701 - RNA, 16 nt, Homo sapiens
ggggacaaccuuggcu

SEQ ID NO: 849702 - RNA, 15 nt, Homo sapiens
ggggagcaaugggcu

SEQ ID NO: 849703 - RNA, 16 nt, Homo sapiens
gggucucuagugcugu

SEQ ID NO: 849704 - RNA, 14 nt, Homo sapiens
gggucugucagggu

SEQ ID NO: 849705 - RNA, 23 nt, Homo sapiens
gggugcuucucuccuaucugugc

SEQ ID NO: 849706 - RNA, 17 nt, Homo sapiens
ggguuccagcacaaagu

SEQ ID NO: 849707 - RNA, 21 nt, Homo sapiens
gguacaaguggcucaucauca

SEQ ID NO: 849708 - RNA, 16 nt, Homo sapiens
gguacacaccaaauga

SEQ ID NO: 849709 - RNA, 21 nt, Homo sapiens
gguauccuuaucuaguguuug

SEQ ID NO: 849710 - RNA, 19 nt, Homo sapiens
ggucaguuuggcugggcaa

SEQ ID NO: 849711 - RNA, 17 nt, Homo sapiens
ggucccaguugcuguca

SEQ ID NO: 849712 - RNA, 17 nt, Homo sapiens
ggucucuagugcuguga

SEQ ID NO: 849713 - RNA, 15 nt, Homo sapiens
ggucucucuugcccc

SEQ ID NO: 849714 - RNA, 19 nt, Homo sapiens
ggucuucgcagccuagaua

SEQ ID NO: 849715 - RNA, 16 nt, Homo sapiens
ggucuuuugguuauga

SEQ ID NO: 849716 - RNA, 23 nt, Homo sapiens
ggugaaguccacagaagugagcu

SEQ ID NO: 849717 - RNA, 20 nt, Homo sapiens
ggugaccucacacaccucug

SEQ ID NO: 849718 - RNA, 11 nt, Homo sapiens
ggugagccaau

SEQ ID NO: 849719 - RNA, 13 nt, Homo sapiens
ggugagucugugu

SEQ ID NO: 849720 - RNA, 17 nt, Homo sapiens
ggugauggaacaagaga

SEQ ID NO: 849721 - RNA, 12 nt, Homo sapiens
ggugcaucucau

SEQ ID NO: 849722 - RNA, 19 nt, Homo sapiens
gguggccccaaccacagga

SEQ ID NO: 849723 - RNA, 15 nt, Homo sapiens
gguguggcacuggga

SEQ ID NO: 849724 - RNA, 23 nt, Homo sapiens
gguuacagcauaacuaggauuau

SEQ ID NO: 849725 - RNA, 21 nt, Homo sapiens
gguuacauaucaaaacauccc

SEQ ID NO: 849726 - RNA, 22 nt, Homo sapiens
gguuacauaucaaaacauccca

SEQ ID NO: 849727 - RNA, 16 nt, Homo sapiens
gguucaaaccugugaa

SEQ ID NO: 849728 - RNA, 17 nt, Homo sapiens
gguucaaaccugugaag

SEQ ID NO: 849729 - RNA, 24 nt, Homo sapiens
gguucaagcgauucucuugccuca

SEQ ID NO: 849730 - RNA, 17 nt, Homo sapiens
gguuccuacacaggaca

SEQ ID NO: 849731 - RNA, 17 nt, Homo sapiens
gguuuccaacaauucag

SEQ ID NO: 849732 - RNA, 22 nt, Homo sapiens
gguuuggggaccauaucaggag

SEQ ID NO: 849733 - RNA, 24 nt, Homo sapiens
gguuuggggaccauaucaggagac

SEQ ID NO: 849734 - RNA, 17 nt, Homo sapiens
guaaaauggaggccagu

SEQ ID NO: 849735 - RNA, 17 nt, Homo sapiens
guaaaucuaaacauaaa

SEQ ID NO: 849736 - RNA, 22 nt, Homo sapiens
guaacauuuugacaacugaaag

SEQ ID NO: 849737 - RNA, 13 nt, Homo sapiens
guaagaguguuua

SEQ ID NO: 849738 - RNA, 23 nt, Homo sapiens
guaagaucacuguuuagauuugc

SEQ ID NO: 849739 - RNA, 16 nt, Homo sapiens
guaagcaagagccaac

SEQ ID NO: 849740 - RNA, 15 nt, Homo sapiens
guaauucccaaaacu

SEQ ID NO: 849741 - RNA, 22 nt, Homo sapiens
guaccauuaucuuaucuaguaa

SEQ ID NO: 849742 - RNA, 14 nt, Homo sapiens
guaccccucuagcu

SEQ ID NO: 849743 - RNA, 15 nt, Homo sapiens
guacguguggcuugg

SEQ ID NO: 849744 - RNA, 15 nt, Homo sapiens
guacuaauaugcaau

SEQ ID NO: 849745 - RNA, 18 nt, Homo sapiens
guacugugaccaucccaa

SEQ ID NO: 849746 - RNA, 21 nt, Homo sapiens
guagccauuucuucuguucua

SEQ ID NO: 849747 - RNA, 15 nt, Homo sapiens
guagcucguccucac

SEQ ID NO: 849748 - RNA, 21 nt, Homo sapiens
guagcuuuuaugcccucagga

SEQ ID NO: 849749 - RNA, 19 nt, Homo sapiens
guaggagaaagagccuugg

SEQ ID NO: 849750 - RNA, 23 nt, Homo sapiens
guaguucaagaaaugaagagcug

SEQ ID NO: 849751 - RNA, 22 nt, Homo sapiens
guauaacaugucgauguucgau

SEQ ID NO: 849752 - RNA, 21 nt, Homo sapiens
guaucugauaucagcacugga

SEQ ID NO: 849753 - RNA, 18 nt, Homo sapiens
guauuaacgugucagggc

SEQ ID NO: 849754 - RNA, 20 nt, Homo sapiens
guauucucauaauacugaaa

SEQ ID NO: 849755 - RNA, 17 nt, Homo sapiens
guauuuaguaagugcuu

SEQ ID NO: 849756 - RNA, 14 nt, Homo sapiens
gucaaggcucaguc

SEQ ID NO: 849757 - RNA, 22 nt, Homo sapiens
gucacaggaaggacuucuucca

SEQ ID NO: 849758 - RNA, 13 nt, Homo sapiens
gucagaauauucu

SEQ ID NO: 849759 - RNA, 17 nt, Homo sapiens
gucagguccaugugcac

SEQ ID NO: 849760 - RNA, 14 nt, Homo sapiens
gucauaaugaauaa

SEQ ID NO: 849761 - RNA, 23 nt, Homo sapiens
gucauucgcuacuaugauuuaau

SEQ ID NO: 849762 - RNA, 21 nt, Homo sapiens
guccaccccagucccuuucag

SEQ ID NO: 849763 - RNA, 15 nt, Homo sapiens
guccaguaagaucac

SEQ ID NO: 849764 - RNA, 23 nt, Homo sapiens
guccaugugaaacauguugccaa

SEQ ID NO: 849765 - RNA, 19 nt, Homo sapiens
guccauguuugcugccuua

SEQ ID NO: 849766 - RNA, 23 nt, Homo sapiens
gucccaaacccuucuuguucucu

SEQ ID NO: 849767 - RNA, 13 nt, Homo sapiens
guccccaaggcca

SEQ ID NO: 849768 - RNA, 12 nt, Homo sapiens
gucccucugcag

SEQ ID NO: 849769 - RNA, 19 nt, Homo sapiens
gucccuuucgacuugcauu

SEQ ID NO: 849770 - RNA, 17 nt, Homo sapiens
guccuaauggugaugca

SEQ ID NO: 849771 - RNA, 18 nt, Homo sapiens
guccuauuaguguuauau

SEQ ID NO: 849772 - RNA, 21 nt, Homo sapiens
gucuaauccuaguuugcugug

SEQ ID NO: 849773 - RNA, 17 nt, Homo sapiens
gucuaccuggagccccu

SEQ ID NO: 849774 - RNA, 22 nt, Homo sapiens
gucuagaggccuuuaguuauaa

SEQ ID NO: 849775 - RNA, 20 nt, Homo sapiens
gucuauuucaucagaacagc

SEQ ID NO: 849776 - RNA, 22 nt, Homo sapiens
gucuauuucaucagaacagcug

SEQ ID NO: 849777 - RNA, 13 nt, Homo sapiens
gucucgcuacauu

SEQ ID NO: 849778 - RNA, 19 nt, Homo sapiens
gucucucagagaucuugca

SEQ ID NO: 849779 - RNA, 18 nt, Homo sapiens
gucuggcccacugugcag

SEQ ID NO: 849780 - RNA, 19 nt, Homo sapiens
gucuggccuuuucuuguaa

SEQ ID NO: 849781 - RNA, 15 nt, Homo sapiens
gucuuccaaguacag

SEQ ID NO: 849782 - RNA, 14 nt, Homo sapiens
gucuugcauuuaaa

SEQ ID NO: 849783 - RNA, 16 nt, Homo sapiens
gucuuuauacugcaaa

SEQ ID NO: 849784 - RNA, 21 nt, Homo sapiens
gucuuuuuacauugugaaugc

SEQ ID NO: 849785 - RNA, 15 nt, Homo sapiens
gugaacgcccagaga

SEQ ID NO: 849786 - RNA, 13 nt, Homo sapiens
gugaagauacuuu

SEQ ID NO: 849787 - RNA, 16 nt, Homo sapiens
gugagagccugugauc

SEQ ID NO: 849788 - RNA, 21 nt, Homo sapiens
gugaggaaaucaaagugcuau

SEQ ID NO: 849789 - RNA, 21 nt, Homo sapiens
gugaggcaucucucugggaug

SEQ ID NO: 849790 - RNA, 18 nt, Homo sapiens
gugauagagugcagugau

SEQ ID NO: 849791 - RNA, 16 nt, Homo sapiens
gugauauaaacagcuu

SEQ ID NO: 849792 - RNA, 13 nt, Homo sapiens
gugcaaacagaag

SEQ ID NO: 849793 - RNA, 15 nt, Homo sapiens
gaaguucaagaucaa

SEQ ID NO: 849794 - RNA, 20 nt, Homo sapiens
gaaguuccauuuaagggcaa

SEQ ID NO: 849795 - RNA, 17 nt, Homo sapiens
gaauaaaaacuuugcag

SEQ ID NO: 849796 - RNA, 19 nt, Homo sapiens
gaauaaacgccuucccaaa

SEQ ID NO: 849797 - RNA, 22 nt, Homo sapiens
gaauaaacuagauuacauucag

SEQ ID NO: 849798 - RNA, 21 nt, Homo sapiens
gaauacccuaaaguauaacau

SEQ ID NO: 849799 - RNA, 13 nt, Homo sapiens
gaauacugaugga

SEQ ID NO: 849800 - RNA, 20 nt, Homo sapiens
gaauauugcugcugguucuc

SEQ ID NO: 849801 - RNA, 15 nt, Homo sapiens
gaauauuuaagcaau

SEQ ID NO: 849802 - RNA, 12 nt, Homo sapiens
gaaucagaguau

SEQ ID NO: 849803 - RNA, 18 nt, Homo sapiens
gaaugacagcaaacagau

SEQ ID NO: 849804 - RNA, 21 nt, Homo sapiens
gaaugaccugacuuuuagcca

SEQ ID NO: 849805 - RNA, 22 nt, Homo sapiens
gaaugagcagcuuuagcaaaga

SEQ ID NO: 849806 - RNA, 15 nt, Homo sapiens
gaaugauuaaucaua

SEQ ID NO: 849807 - RNA, 18 nt, Homo sapiens
gaaugcacucagacugua

SEQ ID NO: 849808 - RNA, 23 nt, Homo sapiens
gaauguacauacugaaaaauaca

SEQ ID NO: 849809 - RNA, 19 nt, Homo sapiens
gaauucuagaaagagccuu

SEQ ID NO: 849810 - RNA, 20 nt, Homo sapiens
gaauucuuagcauacauuca

SEQ ID NO: 849811 - RNA, 14 nt, Homo sapiens
gaauucuucacaug

SEQ ID NO: 849812 - RNA, 15 nt, Homo sapiens
gacaaguagccaccu

SEQ ID NO: 849813 - RNA, 14 nt, Homo sapiens
gacacagaagcccc

SEQ ID NO: 849814 - RNA, 23 nt, Homo sapiens
gacacccuucccuggauccagac

SEQ ID NO: 849815 - RNA, 19 nt, Homo sapiens
gacagcaaagauccacuuu

SEQ ID NO: 849816 - RNA, 23 nt, Homo sapiens
gacaguccuauuuagacauguaa

SEQ ID NO: 849817 - RNA, 15 nt, Homo sapiens
gacaucaagcucaag

SEQ ID NO: 849818 - RNA, 16 nt, Homo sapiens
gacaucaagcucaagg

SEQ ID NO: 849819 - RNA, 21 nt, Homo sapiens
gacaucaagcucaaggcaaug

SEQ ID NO: 849820 - RNA, 20 nt, Homo sapiens
gacaucuggggcuuugaccc

SEQ ID NO: 849821 - RNA, 14 nt, Homo sapiens
gacaugcauucaca

SEQ ID NO: 849822 - RNA, 18 nt, Homo sapiens
gacauggaacugaaagac

SEQ ID NO: 849823 - RNA, 12 nt, Homo sapiens
gacauucugggg

SEQ ID NO: 849824 - RNA, 20 nt, Homo sapiens
gacauuuuagaaugucaaua

SEQ ID NO: 849825 - RNA, 22 nt, Homo sapiens
gaccagaucagauaauuaugcu

SEQ ID NO: 849826 - RNA, 15 nt, Homo sapiens
gaccagccccaccau

SEQ ID NO: 849827 - RNA, 16 nt, Homo sapiens
gaccagcuuggcucag

SEQ ID NO: 849828 - RNA, 17 nt, Homo sapiens
gaccauaacagugccag

SEQ ID NO: 849829 - RNA, 14 nt, Homo sapiens
gaccauaagaguuu

SEQ ID NO: 849830 - RNA, 18 nt, Homo sapiens
gaccaucccccacuccuu

SEQ ID NO: 849831 - RNA, 23 nt, Homo sapiens
gacccaaguacuuuccaaucuca

SEQ ID NO: 849832 - RNA, 20 nt, Homo sapiens
gacccagguagucaaaggca

SEQ ID NO: 849833 - RNA, 16 nt, Homo sapiens
gacccaguggcagggc

SEQ ID NO: 849834 - RNA, 20 nt, Homo sapiens
gaccccugugugacaucaca

SEQ ID NO: 849835 - RNA, 20 nt, Homo sapiens
gacccugaagaggcauuuca

SEQ ID NO: 849836 - RNA, 15 nt, Homo sapiens
gaccuggguugugcu

SEQ ID NO: 849837 - RNA, 19 nt, Homo sapiens
gaccuggguugugcugaca

SEQ ID NO: 849838 - RNA, 14 nt, Homo sapiens
gaccuuaaaugcaa

SEQ ID NO: 849839 - RNA, 16 nt, Homo sapiens
gacgacuguuuuccca

SEQ ID NO: 849840 - RNA, 23 nt, Homo sapiens
gacuagcacugacugaacuguaa

SEQ ID NO: 849841 - RNA, 14 nt, Homo sapiens
gacuauuccuggga

SEQ ID NO: 849842 - RNA, 23 nt, Homo sapiens
gacucacuguguggccucagaga

SEQ ID NO: 849843 - RNA, 24 nt, Homo sapiens
gacucacuguguggccucagagaa

SEQ ID NO: 849844 - RNA, 23 nt, Homo sapiens
gacuccucucguacuugaacuca

SEQ ID NO: 849845 - RNA, 20 nt, Homo sapiens
gacucuaaagucuguugauu

SEQ ID NO: 849846 - RNA, 19 nt, Homo sapiens
gacucugucuggccaggga

SEQ ID NO: 849847 - RNA, 20 nt, Homo sapiens
gacucuuggcagcagaccag

SEQ ID NO: 849848 - RNA, 14 nt, Homo sapiens
gacugaacuguaau

SEQ ID NO: 849849 - RNA, 20 nt, Homo sapiens
gacugacugaggcaguuuga

SEQ ID NO: 849850 - RNA, 22 nt, Homo sapiens
gacuuucuguguaccacuggga

SEQ ID NO: 849851 - RNA, 21 nt, Homo sapiens
gagaagcacuaagacugcuuc

SEQ ID NO: 849852 - RNA, 11 nt, Homo sapiens
gagaguacucu

SEQ ID NO: 849853 - RNA, 14 nt, Homo sapiens
gagcagcugcugaa

SEQ ID NO: 849854 - RNA, 20 nt, Homo sapiens
gagcaggcccugggccucca

SEQ ID NO: 849855 - RNA, 17 nt, Homo sapiens
gagcaguaucaugaagc

SEQ ID NO: 849856 - RNA, 18 nt, Homo sapiens
gagccaaccucacaggau

SEQ ID NO: 849857 - RNA, 16 nt, Homo sapiens
gagccccacucucaga

SEQ ID NO: 849858 - RNA, 14 nt, Homo sapiens
gagcuaaggccaau

SEQ ID NO: 849859 - RNA, 17 nt, Homo sapiens
gaggacaaucuagcucu

SEQ ID NO: 849860 - RNA, 16 nt, Homo sapiens
gaggccacacccagag

SEQ ID NO: 849861 - RNA, 13 nt, Homo sapiens
gaggccaccuccu

SEQ ID NO: 849862 - RNA, 15 nt, Homo sapiens
gaggggaaugggagg

SEQ ID NO: 849863 - RNA, 12 nt, Homo sapiens
gaggguacuuga

SEQ ID NO: 849864 - RNA, 14 nt, Homo sapiens
gaggguacuugaau

SEQ ID NO: 849865 - RNA, 20 nt, Homo sapiens
gaggugagaacuaaugccua

SEQ ID NO: 849866 - RNA, 20 nt, Homo sapiens
gaguacacugccugccuuaa

SEQ ID NO: 849867 - RNA, 14 nt, Homo sapiens
gagucuggggacca

SEQ ID NO: 849868 - RNA, 11 nt, Homo sapiens
gaguugcuaag

SEQ ID NO: 849869 - RNA, 14 nt, Homo sapiens
gauaaaaaaacagc

SEQ ID NO: 849870 - RNA, 15 nt, Homo sapiens
gauaacaaguuuaau

SEQ ID NO: 849871 - RNA, 17 nt, Homo sapiens
gauagcaaauggccuca

SEQ ID NO: 849872 - RNA, 18 nt, Homo sapiens
gauagcaaauggccucau

SEQ ID NO: 849873 - RNA, 15 nt, Homo sapiens
gauagcucauauuau

SEQ ID NO: 849874 - RNA, 16 nt, Homo sapiens
gauaucagcacuggau

SEQ ID NO: 849875 - RNA, 17 nt, Homo sapiens
gauauuaauaauuccaa

SEQ ID NO: 849876 - RNA, 20 nt, Homo sapiens
gauauuuauuuaugcuaaua

SEQ ID NO: 849877 - RNA, 20 nt, Homo sapiens
gaucaucgaggagcuagaac

SEQ ID NO: 849878 - RNA, 16 nt, Homo sapiens
gaugaaauaacacagc

SEQ ID NO: 849879 - RNA, 23 nt, Homo sapiens
gaugaagacagcccgauccuccc

SEQ ID NO: 849880 - RNA, 21 nt, Homo sapiens
gaugagcuuugucuacuucaa

SEQ ID NO: 849881 - RNA, 20 nt, Homo sapiens
gaugauuugcuuaaauaucc

SEQ ID NO: 849882 - RNA, 15 nt, Homo sapiens
gaugccuaacagaga

SEQ ID NO: 849883 - RNA, 13 nt, Homo sapiens
gaugcuaacugga

SEQ ID NO: 849884 - RNA, 15 nt, Homo sapiens
gaugcuuuggcaaug

SEQ ID NO: 849885 - RNA, 20 nt, Homo sapiens
gauggaauggcagcaugcaa

SEQ ID NO: 849886 - RNA, 16 nt, Homo sapiens
gauguauucugugaua

SEQ ID NO: 849887 - RNA, 17 nt, Homo sapiens
gauguauuucaucucaa

SEQ ID NO: 849888 - RNA, 17 nt, Homo sapiens
gaugucagcaguugcug

SEQ ID NO: 849889 - RNA, 19 nt, Homo sapiens
gauguugacaucacuggca

SEQ ID NO: 849890 - RNA, 15 nt, Homo sapiens
gauuauauaagcaaa

SEQ ID NO: 849891 - RNA, 17 nt, Homo sapiens
gauucacugccuaugaa

SEQ ID NO: 849892 - RNA, 16 nt, Homo sapiens
gauucagaaccaagac

SEQ ID NO: 849893 - RNA, 15 nt, Homo sapiens
gauucucuugccuca

SEQ ID NO: 849894 - RNA, 19 nt, Homo sapiens
gcaaaccuaauugcacaac

SEQ ID NO: 849895 - RNA, 17 nt, Homo sapiens
gcaacauuuuaaggcaa

SEQ ID NO: 849896 - RNA, 22 nt, Homo sapiens
gcaacuccccauuggugcuacc

SEQ ID NO: 849897 - RNA, 14 nt, Homo sapiens
gcaacuucccacag

SEQ ID NO: 849898 - RNA, 15 nt, Homo sapiens
gcaacuuccuuugac

SEQ ID NO: 849899 - RNA, 22 nt, Homo sapiens
gcaagccuccugaucaggaaac

SEQ ID NO: 849900 - RNA, 20 nt, Homo sapiens
gcaagggucucacacuguga

SEQ ID NO: 849901 - RNA, 16 nt, Homo sapiens
gcaaugguuucacaug

SEQ ID NO: 849902 - RNA, 22 nt, Homo sapiens
gcacacucaaguccugcaguca

SEQ ID NO: 849903 - RNA, 15 nt, Homo sapiens
gcaccagcaggcacu

SEQ ID NO: 849904 - RNA, 12 nt, Homo sapiens
gcacccacugug

SEQ ID NO: 849905 - RNA, 21 nt, Homo sapiens
gcaccggucuuugauccgcag

SEQ ID NO: 849906 - RNA, 14 nt, Homo sapiens
gcacucagacugua

SEQ ID NO: 849907 - RNA, 14 nt, Homo sapiens
gcacugaagcugcg

SEQ ID NO: 849908 - RNA, 12 nt, Homo sapiens
gcagaaagcaaa

SEQ ID NO: 849909 - RNA, 14 nt, Homo sapiens
gcagaaguagggga

SEQ ID NO: 849910 - RNA, 16 nt, Homo sapiens
gcagacuauaaaaucu

SEQ ID NO: 849911 - RNA, 23 nt, Homo sapiens
gcagcaggggccaagcaggcacu

SEQ ID NO: 849912 - RNA, 15 nt, Homo sapiens
gcagcaguggguuca

SEQ ID NO: 849913 - RNA, 19 nt, Homo sapiens
gcagcaugcaaacuuggau

SEQ ID NO: 849914 - RNA, 18 nt, Homo sapiens
gcagcucuacaggugagg

SEQ ID NO: 849915 - RNA, 18 nt, Homo sapiens
gcagcugacuaaaggcca

SEQ ID NO: 849916 - RNA, 14 nt, Homo sapiens
gcaggaaacuaacu

SEQ ID NO: 849917 - RNA, 18 nt, Homo sapiens
gcaggacacugcagaaca

SEQ ID NO: 849918 - RNA, 15 nt, Homo sapiens
gcaggaccagcccac

SEQ ID NO: 849919 - RNA, 20 nt, Homo sapiens
gcaggacgacuguuuuccca

SEQ ID NO: 849920 - RNA, 17 nt, Homo sapiens
gcaggaggagcaacuca

SEQ ID NO: 849921 - RNA, 22 nt, Homo sapiens
gcaggcccccggggaggggcca

SEQ ID NO: 849922 - RNA, 20 nt, Homo sapiens
gcaguaaauauuuacuauuu

SEQ ID NO: 849923 - RNA, 19 nt, Homo sapiens
gcaguaucaugaagccuaa

SEQ ID NO: 849924 - RNA, 18 nt, Homo sapiens
gcaguuaugugaccucac

SEQ ID NO: 849925 - RNA, 24 nt, Homo sapiens
gcaguuaugugaccucacgugcaa

SEQ ID NO: 849926 - RNA, 18 nt, Homo sapiens
gcaguugcugucagucuu

SEQ ID NO: 849927 - RNA, 14 nt, Homo sapiens
gcauauauguacua

SEQ ID NO: 849928 - RNA, 14 nt, Homo sapiens
gcaucagcugcuca

SEQ ID NO: 849929 - RNA, 12 nt, Homo sapiens
gcaucauucucu

SEQ ID NO: 849930 - RNA, 23 nt, Homo sapiens
gcauccacgucaaugucauucuc

SEQ ID NO: 849931 - RNA, 14 nt, Homo sapiens
gcaucucugagcaa

SEQ ID NO: 849932 - RNA, 21 nt, Homo sapiens
gcaucuggguagcuguaaggc

SEQ ID NO: 849933 - RNA, 23 nt, Homo sapiens
gcaugugccuaaaggcucaaggg

SEQ ID NO: 849934 - RNA, 20 nt, Homo sapiens
gcauguguugcagcugucac

SEQ ID NO: 849935 - RNA, 21 nt, Homo sapiens
gcauuacucccuaugugcgua

SEQ ID NO: 849936 - RNA, 13 nt, Homo sapiens
gcauuagugggaa

SEQ ID NO: 849937 - RNA, 14 nt, Homo sapiens
gcauucacauaucu

SEQ ID NO: 849938 - RNA, 14 nt, Homo sapiens
gcauuuccuuucag

SEQ ID NO: 849939 - RNA, 13 nt, Homo sapiens
gccaagaaguuua

SEQ ID NO: 849940 - RNA, 13 nt, Homo sapiens
gccaagggggacc

SEQ ID NO: 849941 - RNA, 16 nt, Homo sapiens
gccaauucguucucug

SEQ ID NO: 849942 - RNA, 21 nt, Homo sapiens
gccagagcguuagaggggcca

SEQ ID NO: 849943 - RNA, 17 nt, Homo sapiens
gccagagucacaggaag

SEQ ID NO: 849944 - RNA, 16 nt, Homo sapiens
gccaggaaguagcaca

SEQ ID NO: 849945 - RNA, 14 nt, Homo sapiens
gccaggacuuggcc

SEQ ID NO: 849946 - RNA, 19 nt, Homo sapiens
gccaggcccggcaugaggc

SEQ ID NO: 849947 - RNA, 20 nt, Homo sapiens
gccaggcguggugacucaca

SEQ ID NO: 849948 - RNA, 11 nt, Homo sapiens
gccagggaugg

SEQ ID NO: 849949 - RNA, 23 nt, Homo sapiens
gccaugaggaggcagagaggguc

SEQ ID NO: 849950 - RNA, 20 nt, Homo sapiens
gcccaccuggaaucccacaa

SEQ ID NO: 849951 - RNA, 23 nt, Homo sapiens
gcccaccuuauagagagcccaaa

SEQ ID NO: 849952 - RNA, 16 nt, Homo sapiens
gcccacgcugacuaca

SEQ ID NO: 849953 - RNA, 21 nt, Homo sapiens
gcccagaaaagguacacuuug

SEQ ID NO: 849954 - RNA, 14 nt, Homo sapiens
gcccagaagugcag

SEQ ID NO: 849955 - RNA, 15 nt, Homo sapiens
gcccagaauacugau

SEQ ID NO: 849956 - RNA, 20 nt, Homo sapiens
gcccagagaacaagcacugu

SEQ ID NO: 849957 - RNA, 17 nt, Homo sapiens
gcccaggcacuccugag

SEQ ID NO: 849958 - RNA, 21 nt, Homo sapiens
gccccaauaccccauggacca

SEQ ID NO: 849959 - RNA, 13 nt, Homo sapiens
gcccccuugcccu

SEQ ID NO: 849960 - RNA, 14 nt, Homo sapiens
gccccgucucaggu

SEQ ID NO: 849961 - RNA, 15 nt, Homo sapiens
gccccuaacuccugc

SEQ ID NO: 849962 - RNA, 21 nt, Homo sapiens
gcccugagguuugaaucugac

SEQ ID NO: 849963 - RNA, 22 nt, Homo sapiens
gcccugccgcauuuccuuucag

SEQ ID NO: 849964 - RNA, 21 nt, Homo sapiens
gcccuguuucuggucuucgca

SEQ ID NO: 849965 - RNA, 23 nt, Homo sapiens
gccgaaaccugcaggcguucucu

SEQ ID NO: 849966 - RNA, 18 nt, Homo sapiens
gccggucgggggggaccc

SEQ ID NO: 849967 - RNA, 19 nt, Homo sapiens
gccucacgaaacuggaaua

SEQ ID NO: 849968 - RNA, 20 nt, Homo sapiens
gccucauuuucacagcacua

SEQ ID NO: 849969 - RNA, 18 nt, Homo sapiens
gccucccagcuucuuaua

SEQ ID NO: 849970 - RNA, 23 nt, Homo sapiens
gccucuucugagcuuacguaguu

SEQ ID NO: 849971 - RNA, 20 nt, Homo sapiens
gccuggcucccucacucuca

SEQ ID NO: 849972 - RNA, 19 nt, Homo sapiens
gccuucgucugguuccuca

SEQ ID NO: 849973 - RNA, 14 nt, Homo sapiens
gccuucuuggaaaa

SEQ ID NO: 849974 - RNA, 17 nt, Homo sapiens
gcgggacugucaaugga

SEQ ID NO: 849975 - RNA, 18 nt, Homo sapiens
gcuaaaacuggcccuguu

SEQ ID NO: 849976 - RNA, 19 nt, Homo sapiens
gcuacauuuccgccacauc

SEQ ID NO: 849977 - RNA, 14 nt, Homo sapiens
gcuaggaggacaag

SEQ ID NO: 849978 - RNA, 13 nt, Homo sapiens
gcuauagcuuuag

SEQ ID NO: 849979 - RNA, 15 nt, Homo sapiens
gcuauccaaauaacu

SEQ ID NO: 849980 - RNA, 14 nt, Homo sapiens
gcuauuacugcaga

SEQ ID NO: 849981 - RNA, 13 nt, Homo sapiens
gcucagaucccac

SEQ ID NO: 849982 - RNA, 18 nt, Homo sapiens
gcuccagaggaagacucc

SEQ ID NO: 849983 - RNA, 21 nt, Homo sapiens
gcuccuguggcugucuuguca

SEQ ID NO: 849984 - RNA, 14 nt, Homo sapiens
gcucgagcucgggg

SEQ ID NO: 849985 - RNA, 20 nt, Homo sapiens
gcucggcccucaagugcccg

SEQ ID NO: 849986 - RNA, 17 nt, Homo sapiens
gcucuccauacuuugaa

SEQ ID NO: 849987 - RNA, 13 nt, Homo sapiens
gcucugaaauaua

SEQ ID NO: 849988 - RNA, 19 nt, Homo sapiens
gcucugaguuccggcacca

SEQ ID NO: 849989 - RNA, 16 nt, Homo sapiens
gcugaaagaggccaaa

SEQ ID NO: 849990 - RNA, 23 nt, Homo sapiens
gcugaaccccaccucccucccac

SEQ ID NO: 849991 - RNA, 21 nt, Homo sapiens
gcugcagggcugggucagggg

SEQ ID NO: 849992 - RNA, 22 nt, Homo sapiens
gcugcagggcugggucaggggu

SEQ ID NO: 849993 - RNA, 16 nt, Homo sapiens
gcugcauaugccuaca

SEQ ID NO: 849994 - RNA, 17 nt, Homo sapiens
gcugcauccccuuccag

SEQ ID NO: 849995 - RNA, 22 nt, Homo sapiens
gcugccaggauugucacuccaa

SEQ ID NO: 849996 - RNA, 14 nt, Homo sapiens
gcugccugcugaag

SEQ ID NO: 849997 - RNA, 17 nt, Homo sapiens
gcugccuggaggccaga

SEQ ID NO: 849998 - RNA, 13 nt, Homo sapiens
gcuggagugcagu

SEQ ID NO: 849999 - RNA, 16 nt, Homo sapiens
gcugggccccugcuca

SEQ ID NO: 850000 - RNA, 21 nt, Homo sapiens
gcugucaccaagcaugaccca

SEQ ID NO: 850001 - RNA, 20 nt, Homo sapiens
gcuguuguauuaccaaagca

SEQ ID NO: 850002 - RNA, 20 nt, Homo sapiens
gcuuaacuggacugaauuca

SEQ ID NO: 850003 - RNA, 13 nt, Homo sapiens
gcuuaccccuuca

SEQ ID NO: 850004 - RNA, 13 nt, Homo sapiens
gcuucagccuccc

SEQ ID NO: 850005 - RNA, 18 nt, Homo sapiens
gcuuccagcaggagggac

SEQ ID NO: 850006 - RNA, 22 nt, Homo sapiens
gcuuccuccugaaccagcacua

SEQ ID NO: 850007 - RNA, 23 nt, Homo sapiens
gcuucuauaagugugaccaguuu

SEQ ID NO: 850008 - RNA, 20 nt, Homo sapiens
gcuucuucccacaaagaaua

SEQ ID NO: 850009 - RNA, 16 nt, Homo sapiens
gcuucuuugcagcuuc

SEQ ID NO: 850010 - RNA, 13 nt, Homo sapiens
gcuuuaagccuaa

SEQ ID NO: 850011 - RNA, 15 nt, Homo sapiens
gcuuuagacuugaaa

SEQ ID NO: 850012 - RNA, 14 nt, Homo sapiens
gcuuuaugcccuug

SEQ ID NO: 850013 - RNA, 20 nt, Homo sapiens
gcuuuauuuuuuugaacucu

SEQ ID NO: 850014 - RNA, 17 nt, Homo sapiens
gcuuuggucacuuuuag

SEQ ID NO: 850015 - RNA, 21 nt, Homo sapiens
gcuuuucuuugcuagcacaau

SEQ ID NO: 850016 - RNA, 14 nt, Homo sapiens
ggaacaaguugagc

SEQ ID NO: 850017 - RNA, 23 nt, Homo sapiens
ggaacugcuauuuuccuguucua

SEQ ID NO: 850018 - RNA, 18 nt, Homo sapiens
ggaacuucuuugcaguuc

SEQ ID NO: 850019 - RNA, 16 nt, Homo sapiens
ggaagcagugcccagg

SEQ ID NO: 850020 - RNA, 22 nt, Homo sapiens
ggaaggcaauuucucugcacac

SEQ ID NO: 850021 - RNA, 18 nt, Homo sapiens
ggaagugaaaacuuugua

SEQ ID NO: 850022 - RNA, 23 nt, Homo sapiens
ggaauacaagacaaaacuuccuc

SEQ ID NO: 850023 - RNA, 13 nt, Homo sapiens
ggaauacugucuc

SEQ ID NO: 850024 - RNA, 18 nt, Homo sapiens
ggaauauaauauugucuc

SEQ ID NO: 850025 - RNA, 14 nt, Homo sapiens
ggacaaacugccag

SEQ ID NO: 850026 - RNA, 19 nt, Homo sapiens
ggacaaacugccaguuuug

SEQ ID NO: 850027 - RNA, 23 nt, Homo sapiens
ggacaaguagccaccugaguucc

SEQ ID NO: 850028 - RNA, 23 nt, Homo sapiens
ggacacccgacuccaguccaagu

SEQ ID NO: 850029 - RNA, 15 nt, Homo sapiens
ggaccauaucaggag

SEQ ID NO: 850030 - RNA, 17 nt, Homo sapiens
ggaccuaaacauuauuu

SEQ ID NO: 850031 - RNA, 16 nt, Homo sapiens
ggaccugcaaacgcuu

SEQ ID NO: 850032 - RNA, 19 nt, Homo sapiens
ggacgacuguuuucccaac

SEQ ID NO: 850033 - RNA, 21 nt, Homo sapiens
ggacguccagguggagguggc

SEQ ID NO: 850034 - RNA, 17 nt, Homo sapiens
ggacuucuuccagggag

SEQ ID NO: 850035 - RNA, 15 nt, Homo sapiens
ggagcuaaaacuggc

SEQ ID NO: 850036 - RNA, 10 nt, Homo sapiens
ggagcucaag

SEQ ID NO: 850037 - RNA, 14 nt, Homo sapiens
ggaggaguggcauc

SEQ ID NO: 850038 - RNA, 13 nt, Homo sapiens
ggagggacucugu

SEQ ID NO: 850039 - RNA, 19 nt, Homo sapiens
ggagucucucucucuccau

SEQ ID NO: 850040 - RNA, 12 nt, Homo sapiens
ggaguugcuaag

SEQ ID NO: 850041 - RNA, 19 nt, Homo sapiens
ggauagaggguacuugaau

SEQ ID NO: 850042 - RNA, 16 nt, Homo sapiens
ggauaggaaaaaaaga

SEQ ID NO: 850043 - RNA, 16 nt, Homo sapiens
ggauccagcucaaggg

SEQ ID NO: 850044 - RNA, 19 nt, Homo sapiens
ggaucucuaaccccucuga

SEQ ID NO: 850045 - RNA, 16 nt, Homo sapiens
ggauggagaggugaga

SEQ ID NO: 850046 - RNA, 22 nt, Homo sapiens
ggauucagcccucccugccgcu

SEQ ID NO: 850047 - RNA, 15 nt, Homo sapiens
ggauugucacuccaa

SEQ ID NO: 850048 - RNA, 23 nt, Homo sapiens
ggcaagaaaagaguuaaggcaaa

SEQ ID NO: 850049 - RNA, 19 nt, Homo sapiens
ggcaauuuuuguauccaag

SEQ ID NO: 850050 - RNA, 15 nt, Homo sapiens
ggcaccagcaggcac

SEQ ID NO: 850051 - RNA, 13 nt, Homo sapiens
ggcagcuccucag

SEQ ID NO: 850052 - RNA, 21 nt, Homo sapiens
ggcaggaccagcccacgcuga

SEQ ID NO: 850053 - RNA, 19 nt, Homo sapiens
ggcaggagaagggguguuc

SEQ ID NO: 850054 - RNA, 17 nt, Homo sapiens
ggcaucucucugggaug

SEQ ID NO: 850055 - RNA, 18 nt, Homo sapiens
gugccuucauacacugua

SEQ ID NO: 850056 - RNA, 21 nt, Homo sapiens
gugcuccguagcuucuagucu

SEQ ID NO: 850057 - RNA, 18 nt, Homo sapiens
guggaaaaauaaaggaaa

SEQ ID NO: 850058 - RNA, 19 nt, Homo sapiens
guggaaaguguucauugca

SEQ ID NO: 850059 - RNA, 13 nt, Homo sapiens
guggagguugcug

SEQ ID NO: 850060 - RNA, 15 nt, Homo sapiens
guggcccaggccaga

SEQ ID NO: 850061 - RNA, 22 nt, Homo sapiens
guggggggaacgcccacuuccc

SEQ ID NO: 850062 - RNA, 16 nt, Homo sapiens
gugguccaucucugaa

SEQ ID NO: 850063 - RNA, 16 nt, Homo sapiens
guguaccacugggaua

SEQ ID NO: 850064 - RNA, 20 nt, Homo sapiens
guguaccucauggaugcuuu

SEQ ID NO: 850065 - RNA, 16 nt, Homo sapiens
gugucugaacagcuau

SEQ ID NO: 850066 - RNA, 17 nt, Homo sapiens
gugugacaucacagggc

SEQ ID NO: 850067 - RNA, 23 nt, Homo sapiens
gugugaggccacacccagaguag

SEQ ID NO: 850068 - RNA, 20 nt, Homo sapiens
guguguagggggguuucagg

SEQ ID NO: 850069 - RNA, 11 nt, Homo sapiens
guguguuacaa

SEQ ID NO: 850070 - RNA, 12 nt, Homo sapiens
guguucauugca

SEQ ID NO: 850071 - RNA, 15 nt, Homo sapiens
guuaacaauuuugca

SEQ ID NO: 850072 - RNA, 17 nt, Homo sapiens
guuaauuuaaguuuuga

SEQ ID NO: 850073 - RNA, 17 nt, Homo sapiens
guuacaauuuacagugu

SEQ ID NO: 850074 - RNA, 11 nt, Homo sapiens
guuacauauac

SEQ ID NO: 850075 - RNA, 14 nt, Homo sapiens
guuacuugcuuuga

SEQ ID NO: 850076 - RNA, 13 nt, Homo sapiens
guuagacugccag

SEQ ID NO: 850077 - RNA, 21 nt, Homo sapiens
guuagcauuuucaaugugaua

SEQ ID NO: 850078 - RNA, 22 nt, Homo sapiens
guuauaauacgcugcugaucua

SEQ ID NO: 850079 - RNA, 15 nt, Homo sapiens
guuauucaacagcaa

SEQ ID NO: 850080 - RNA, 15 nt, Homo sapiens
guuauuucugugcaa

SEQ ID NO: 850081 - RNA, 16 nt, Homo sapiens
guucaaaccugugaag

SEQ ID NO: 850082 - RNA, 13 nt, Homo sapiens
guucacuaccugu

SEQ ID NO: 850083 - RNA, 13 nt, Homo sapiens
guucauugcacaa

SEQ ID NO: 850084 - RNA, 14 nt, Homo sapiens
guuccuacacagga

SEQ ID NO: 850085 - RNA, 21 nt, Homo sapiens
guuccuacacaggacaggggu

SEQ ID NO: 850086 - RNA, 21 nt, Homo sapiens
guuccucuccaccugcauuau

SEQ ID NO: 850087 - RNA, 14 nt, Homo sapiens
guucugacuuugaa

SEQ ID NO: 850088 - RNA, 22 nt, Homo sapiens
guugcaaacccaaaggacccaa

SEQ ID NO: 850089 - RNA, 16 nt, Homo sapiens
guugccauugcugcua

SEQ ID NO: 850090 - RNA, 12 nt, Homo sapiens
guugccuggaca

SEQ ID NO: 850091 - RNA, 14 nt, Homo sapiens
guugcugacuuaga

SEQ ID NO: 850092 - RNA, 15 nt, Homo sapiens
guugcugacuuagaa

SEQ ID NO: 850093 - RNA, 13 nt, Homo sapiens
guuggcugccugg

SEQ ID NO: 850094 - RNA, 18 nt, Homo sapiens
guuggucaaaaucugcaa

SEQ ID NO: 850095 - RNA, 14 nt, Homo sapiens
guuuaaaacaccuu

SEQ ID NO: 850096 - RNA, 21 nt, Homo sapiens
guuucuggucuucgcagccua

SEQ ID NO: 850097 - RNA, 16 nt, Homo sapiens
guuucuggugagccaa

SEQ ID NO: 850098 - RNA, 15 nt, Homo sapiens
guuucuuaaacaauu

SEQ ID NO: 850099 - RNA, 18 nt, Homo sapiens
guuugaaucugacuuuag

SEQ ID NO: 850100 - RNA, 19 nt, Homo sapiens
guuuggcaggcacugccug

SEQ ID NO: 850101 - RNA, 21 nt, Homo sapiens
guuuucacucuucuaaugcaa

SEQ ID NO: 850102 - RNA, 16 nt, Homo sapiens
guuuuuccaguucaca

SEQ ID NO: 850103 - RNA, 17 nt, Homo sapiens
guuuuuccaguucacau

SEQ ID NO: 850104 - RNA, 22 nt, Homo sapiens
guuuuucugcuuuagacuugaa

SEQ ID NO: 850105 - RNA, 14 nt, Homo sapiens
uaaaaaaacagcuu

SEQ ID NO: 850106 - RNA, 13 nt, Homo sapiens
uaaaaaagauauc

SEQ ID NO: 850107 - RNA, 13 nt, Homo sapiens
uaaaaagugcagu

SEQ ID NO: 850108 - RNA, 20 nt, Homo sapiens
uaaaaauaucacacugaaua

SEQ ID NO: 850109 - RNA, 21 nt, Homo sapiens
uaaaaauaucacacugaauaa

SEQ ID NO: 850110 - RNA, 10 nt, Homo sapiens
uaaaaaucug

SEQ ID NO: 850111 - RNA, 14 nt, Homo sapiens
uaaaacuggcccug

SEQ ID NO: 850112 - RNA, 18 nt, Homo sapiens
uaaaagaagcaucucuga

SEQ ID NO: 850113 - RNA, 22 nt, Homo sapiens
uaaaagaagcaucucugaccag

SEQ ID NO: 850114 - RNA, 21 nt, Homo sapiens
uaaaagcagcauaaagaauuu

SEQ ID NO: 850115 - RNA, 19 nt, Homo sapiens
uaaaagcauuuuguaauaa

SEQ ID NO: 850116 - RNA, 19 nt, Homo sapiens
uaaaagcccaggagcccau

SEQ ID NO: 850117 - RNA, 15 nt, Homo sapiens
uaaaaguaaugcaau

SEQ ID NO: 850118 - RNA, 13 nt, Homo sapiens
uaaaaucuggaua

SEQ ID NO: 850119 - RNA, 17 nt, Homo sapiens
uaaaaugaccucauguc

SEQ ID NO: 850120 - RNA, 14 nt, Homo sapiens
uaaaauugugaugc

SEQ ID NO: 850121 - RNA, 12 nt, Homo sapiens
uaaacagaggau

SEQ ID NO: 850122 - RNA, 19 nt, Homo sapiens
uaaacugauuacguuuaca

SEQ ID NO: 850123 - RNA, 18 nt, Homo sapiens
uaaagaaauacacaggga

SEQ ID NO: 850124 - RNA, 19 nt, Homo sapiens
uaaagaaauacacagggag

SEQ ID NO: 850125 - RNA, 15 nt, Homo sapiens
uaaagaauagcuuua

SEQ ID NO: 850126 - RNA, 17 nt, Homo sapiens
uaaagucuguugauuaa

SEQ ID NO: 850127 - RNA, 11 nt, Homo sapiens
uaaagugaauu

SEQ ID NO: 850128 - RNA, 16 nt, Homo sapiens
uaaaucuaaacauaaa

SEQ ID NO: 850129 - RNA, 18 nt, Homo sapiens
uaaaugcugagauccuca

SEQ ID NO: 850130 - RNA, 20 nt, Homo sapiens
uaaauggcccggacaugucu

SEQ ID NO: 850131 - RNA, 12 nt, Homo sapiens
uaaauguuauag

SEQ ID NO: 850132 - RNA, 22 nt, Homo sapiens
uaaauguuauagcugcauuugu

SEQ ID NO: 850133 - RNA, 23 nt, Homo sapiens
uaacaaauugaguuuagaaguga

SEQ ID NO: 850134 - RNA, 13 nt, Homo sapiens
uaacaagucauuu

SEQ ID NO: 850135 - RNA, 19 nt, Homo sapiens
uaacauaggcuuauacaaa

SEQ ID NO: 850136 - RNA, 14 nt, Homo sapiens
uaaccuuugcugua

SEQ ID NO: 850137 - RNA, 14 nt, Homo sapiens
uaacuccugccuau

SEQ ID NO: 850138 - RNA, 18 nt, Homo sapiens
uaacuguuccccuuggua

SEQ ID NO: 850139 - RNA, 20 nt, Homo sapiens
uaagaacaaaagaagcagca

SEQ ID NO: 850140 - RNA, 16 nt, Homo sapiens
uaagaccccacuggag

SEQ ID NO: 850141 - RNA, 15 nt, Homo sapiens
uaagaguucuaacca

SEQ ID NO: 850142 - RNA, 19 nt, Homo sapiens
uaagauuccuuuugugaaa

SEQ ID NO: 850143 - RNA, 20 nt, Homo sapiens
uaagcaaaaucagaaguaua

SEQ ID NO: 850144 - RNA, 22 nt, Homo sapiens
uaaggagggucacuggggccca

SEQ ID NO: 850145 - RNA, 13 nt, Homo sapiens
uaaggcaugaagg

SEQ ID NO: 850146 - RNA, 19 nt, Homo sapiens
uaagucaccuaaguacuua

SEQ ID NO: 850147 - RNA, 21 nt, Homo sapiens
uaagucaccuaaguacuuaaa

SEQ ID NO: 850148 - RNA, 23 nt, Homo sapiens
uaagugccaacaauuuucuagau

SEQ ID NO: 850149 - RNA, 13 nt, Homo sapiens
uaauagcauucau

SEQ ID NO: 850150 - RNA, 19 nt, Homo sapiens
uaauauuuuuaacaaguca

SEQ ID NO: 850151 - RNA, 23 nt, Homo sapiens
uaauauuuuugaaaaaugcacug

SEQ ID NO: 850152 - RNA, 22 nt, Homo sapiens
uaauccagcaauacaguuuacu

SEQ ID NO: 850153 - RNA, 18 nt, Homo sapiens
uaaucuaucacuuuguuc

SEQ ID NO: 850154 - RNA, 19 nt, Homo sapiens
uaaucuuuaacugaacucu

SEQ ID NO: 850155 - RNA, 14 nt, Homo sapiens
uaaugaggaacuaa

SEQ ID NO: 850156 - RNA, 14 nt, Homo sapiens
uaaugcuaaucuug

SEQ ID NO: 850157 - RNA, 16 nt, Homo sapiens
uaaugucuagauuuug

SEQ ID NO: 850158 - RNA, 22 nt, Homo sapiens
uaauucacccaccagacuuuuu

SEQ ID NO: 850159 - RNA, 16 nt, Homo sapiens
uaauugcugccaggau

SEQ ID NO: 850160 - RNA, 14 nt, Homo sapiens
uaauuggcuuuacu

SEQ ID NO: 850161 - RNA, 21 nt, Homo sapiens
uaauuugguauccuuaucuag

SEQ ID NO: 850162 - RNA, 23 nt, Homo sapiens
uaauuuguguaaauuauugauga

SEQ ID NO: 850163 - RNA, 14 nt, Homo sapiens
uaauuuucuuucac

SEQ ID NO: 850164 - RNA, 21 nt, Homo sapiens
uaauuuuucuuuauugcuuac

SEQ ID NO: 850165 - RNA, 17 nt, Homo sapiens
uacacaauggugcuauu

SEQ ID NO: 850166 - RNA, 22 nt, Homo sapiens
uacacgguucaaaccugugaag

SEQ ID NO: 850167 - RNA, 20 nt, Homo sapiens
uacacugaauuuuuaugugu

SEQ ID NO: 850168 - RNA, 13 nt, Homo sapiens
uacagaugccaua

SEQ ID NO: 850169 - RNA, 20 nt, Homo sapiens
uacagcuucagcugccugga

SEQ ID NO: 850170 - RNA, 16 nt, Homo sapiens
uacaguagaaggagau

SEQ ID NO: 850171 - RNA, 14 nt, Homo sapiens
uacauaacugauaa

SEQ ID NO: 850172 - RNA, 20 nt, Homo sapiens
uaccaacugggccucugaug

SEQ ID NO: 850173 - RNA, 15 nt, Homo sapiens
uaccauauaacugga

SEQ ID NO: 850174 - RNA, 22 nt, Homo sapiens
uaccaugucguaguuacucuca

SEQ ID NO: 850175 - RNA, 23 nt, Homo sapiens
uaccaugucguaguuacucucag

SEQ ID NO: 850176 - RNA, 21 nt, Homo sapiens
uacccagacugguuugggcaa

SEQ ID NO: 850177 - RNA, 23 nt, Homo sapiens
uaccugaagggguuuucuugaua

SEQ ID NO: 850178 - RNA, 18 nt, Homo sapiens
uacguguggcuuggucac

SEQ ID NO: 850179 - RNA, 19 nt, Homo sapiens
uacuaauaugcaauuauga

SEQ ID NO: 850180 - RNA, 20 nt, Homo sapiens
uacuagacugccacaaggaa

SEQ ID NO: 850181 - RNA, 19 nt, Homo sapiens
uacucgcuauuuuguagua

SEQ ID NO: 850182 - RNA, 20 nt, Homo sapiens
uacucucaggcauggaugaa

SEQ ID NO: 850183 - RNA, 14 nt, Homo sapiens
uacucugagcucau

SEQ ID NO: 850184 - RNA, 17 nt, Homo sapiens
uacugaugguuacauau

SEQ ID NO: 850185 - RNA, 16 nt, Homo sapiens
uacuucauuucuagag

SEQ ID NO: 850186 - RNA, 14 nt, Homo sapiens
uacuugaaccauaa

SEQ ID NO: 850187 - RNA, 12 nt, Homo sapiens
uagaacauucca

SEQ ID NO: 850188 - RNA, 17 nt, Homo sapiens
uagaacuggcuauccuu

SEQ ID NO: 850189 - RNA, 21 nt, Homo sapiens
uagauaugaagaaucugcucu

SEQ ID NO: 850190 - RNA, 22 nt, Homo sapiens
ggugaaguccacagaagugagc

SEQ ID NO: 850191 - RNA, 18 nt, Homo sapiens
ggugcugguuccaugccu

SEQ ID NO: 850192 - RNA, 18 nt, Homo sapiens
ggugcuuuuauuuucaca

SEQ ID NO: 850193 - RNA, 23 nt, Homo sapiens
gguggccuggcuugucuucugaa

SEQ ID NO: 850194 - RNA, 20 nt, Homo sapiens
gguggcuucagaaauggaac

SEQ ID NO: 850195 - RNA, 13 nt, Homo sapiens
ggugggagccaac

SEQ ID NO: 850196 - RNA, 23 nt, Homo sapiens
ggugggaugagggagacagacca

SEQ ID NO: 850197 - RNA, 13 nt, Homo sapiens
ggugugaggccac

SEQ ID NO: 850198 - RNA, 17 nt, Homo sapiens
gguuaauguguggcaua

SEQ ID NO: 850199 - RNA, 19 nt, Homo sapiens
gguugccuggacaccccac

SEQ ID NO: 850200 - RNA, 21 nt, Homo sapiens
gguuucacaugguuacauauc

SEQ ID NO: 850201 - RNA, 17 nt, Homo sapiens
gguuugugauccaggaa

SEQ ID NO: 850202 - RNA, 23 nt, Homo sapiens
guaaaaccccgucucuacuaaaa

SEQ ID NO: 850203 - RNA, 15 nt, Homo sapiens
guaaaagcagcauaa

SEQ ID NO: 850204 - RNA, 19 nt, Homo sapiens
guaaagaaauacacaggga

SEQ ID NO: 850205 - RNA, 18 nt, Homo sapiens
guaagaguguuuauacag

SEQ ID NO: 850206 - RNA, 18 nt, Homo sapiens
guaagggagcagacuuuu

SEQ ID NO: 850207 - RNA, 19 nt, Homo sapiens
guaaugggauaugggguua

SEQ ID NO: 850208 - RNA, 12 nt, Homo sapiens
guacaaugacuu

SEQ ID NO: 850209 - RNA, 15 nt, Homo sapiens
guacacauauuuuga

SEQ ID NO: 850210 - RNA, 14 nt, Homo sapiens
guacauaauacuga

SEQ ID NO: 850211 - RNA, 14 nt, Homo sapiens
guacauauguuuca

SEQ ID NO: 850212 - RNA, 13 nt, Homo sapiens
guaccacugggau

SEQ ID NO: 850213 - RNA, 12 nt, Homo sapiens
guaccauuuaau

SEQ ID NO: 850214 - RNA, 21 nt, Homo sapiens
guaccuuuugagcuucauuuc

SEQ ID NO: 850215 - RNA, 19 nt, Homo sapiens
guacucuuuaaacaguuuu

SEQ ID NO: 850216 - RNA, 23 nt, Homo sapiens
guacucuuuugggcaacggcccu

SEQ ID NO: 850217 - RNA, 20 nt, Homo sapiens
guacuuugaauuuuagcaca

SEQ ID NO: 850218 - RNA, 21 nt, Homo sapiens
guacuuuguuaaaaacacugc

SEQ ID NO: 850219 - RNA, 22 nt, Homo sapiens
guacuuuguuaaaaacacugcu

SEQ ID NO: 850220 - RNA, 13 nt, Homo sapiens
guagaacuuugua

SEQ ID NO: 850221 - RNA, 19 nt, Homo sapiens
guagaggugcaugccuaau

SEQ ID NO: 850222 - RNA, 14 nt, Homo sapiens
guagcugggaccac

SEQ ID NO: 850223 - RNA, 13 nt, Homo sapiens
guagucaaaggca

SEQ ID NO: 850224 - RNA, 23 nt, Homo sapiens
guaguguguuuucauaacaacuu

SEQ ID NO: 850225 - RNA, 13 nt, Homo sapiens
guaguuacucuca

SEQ ID NO: 850226 - RNA, 13 nt, Homo sapiens
guauaugcugcau

SEQ ID NO: 850227 - RNA, 20 nt, Homo sapiens
guauauuuuugaucuuugag

SEQ ID NO: 850228 - RNA, 19 nt, Homo sapiens
guauauuuuugcaggugcu

SEQ ID NO: 850229 - RNA, 18 nt, Homo sapiens
guaucaaauacauuuaaa

SEQ ID NO: 850230 - RNA, 18 nt, Homo sapiens
guauuaaaugaacaucua

SEQ ID NO: 850231 - RNA, 22 nt, Homo sapiens
gucaaaugcccccugagugacu

SEQ ID NO: 850232 - RNA, 15 nt, Homo sapiens
gucaccaaguguauu

SEQ ID NO: 850233 - RNA, 18 nt, Homo sapiens
gucaccuaaguacuuaaa

SEQ ID NO: 850234 - RNA, 15 nt, Homo sapiens
gucacuggggcccaa

SEQ ID NO: 850235 - RNA, 15 nt, Homo sapiens
gucacugucagagaa

SEQ ID NO: 850236 - RNA, 19 nt, Homo sapiens
gucacuuuuagaugugguu

SEQ ID NO: 850237 - RNA, 22 nt, Homo sapiens
gucauaaugaauaaagugcaaa

SEQ ID NO: 850238 - RNA, 11 nt, Homo sapiens
gucauaugcac

SEQ ID NO: 850239 - RNA, 18 nt, Homo sapiens
guccacagaagugagcuc

SEQ ID NO: 850240 - RNA, 20 nt, Homo sapiens
guccacagaagugagcuccu

SEQ ID NO: 850241 - RNA, 23 nt, Homo sapiens
guccaggcauguuggacucugag

SEQ ID NO: 850242 - RNA, 22 nt, Homo sapiens
guccaguagggcaggcagucag

SEQ ID NO: 850243 - RNA, 17 nt, Homo sapiens
guccccggcgggacugu

SEQ ID NO: 850244 - RNA, 19 nt, Homo sapiens
guccccucccagggagcaa

SEQ ID NO: 850245 - RNA, 16 nt, Homo sapiens
gucccuguggccuuca

SEQ ID NO: 850246 - RNA, 18 nt, Homo sapiens
guccuucuuguccacggu

SEQ ID NO: 850247 - RNA, 18 nt, Homo sapiens
gucucuagugcugugaaa

SEQ ID NO: 850248 - RNA, 14 nt, Homo sapiens
gucucugcagcucu

SEQ ID NO: 850249 - RNA, 23 nt, Homo sapiens
gucuggagggcuggucauucaca

SEQ ID NO: 850250 - RNA, 16 nt, Homo sapiens
gucuuccuaucaaaaa

SEQ ID NO: 850251 - RNA, 21 nt, Homo sapiens
gucuucgcagccuagauauga

SEQ ID NO: 850252 - RNA, 21 nt, Homo sapiens
gucuugcgggucugucagggu

SEQ ID NO: 850253 - RNA, 22 nt, Homo sapiens
gucuuugguuauuucugugcaa

SEQ ID NO: 850254 - RNA, 19 nt, Homo sapiens
gugacauuuuagaauguca

SEQ ID NO: 850255 - RNA, 17 nt, Homo sapiens
gugaccucacgugcaaa

SEQ ID NO: 850256 - RNA, 20 nt, Homo sapiens
gugacgguuccuacacagga

SEQ ID NO: 850257 - RNA, 15 nt, Homo sapiens
gugagaacuaaugcc

SEQ ID NO: 850258 - RNA, 14 nt, Homo sapiens
gugaucacuuucag

SEQ ID NO: 850259 - RNA, 13 nt, Homo sapiens
gugauguacugua

SEQ ID NO: 850260 - RNA, 13 nt, Homo sapiens
gugcacuucaaga

SEQ ID NO: 850261 - RNA, 18 nt, Homo sapiens
gugcaugggucagggugu

SEQ ID NO: 850262 - RNA, 18 nt, Homo sapiens
gugcauugaauacucuga

SEQ ID NO: 850263 - RNA, 20 nt, Homo sapiens
gugcugccagucagccugga

SEQ ID NO: 850264 - RNA, 14 nt, Homo sapiens
gugcugggaggucc

SEQ ID NO: 850265 - RNA, 17 nt, Homo sapiens
gugcugguuccaugccu

SEQ ID NO: 850266 - RNA, 23 nt, Homo sapiens
gugcugguuccaugccugcucuc

SEQ ID NO: 850267 - RNA, 23 nt, Homo sapiens
guggaaaguguucauugcacaau

SEQ ID NO: 850268 - RNA, 17 nt, Homo sapiens
guggcagguuacagagu

SEQ ID NO: 850269 - RNA, 21 nt, Homo sapiens
guggcauccccacguggacaa

SEQ ID NO: 850270 - RNA, 15 nt, Homo sapiens
guggcucaucaucaa

SEQ ID NO: 850271 - RNA, 22 nt, Homo sapiens
guggggagguuaaucuaggaau

SEQ ID NO: 850272 - RNA, 20 nt, Homo sapiens
gugggggccccgucucaggu

SEQ ID NO: 850273 - RNA, 12 nt, Homo sapiens
guguaccacugg

SEQ ID NO: 850274 - RNA, 12 nt, Homo sapiens
gugucuaccugg

SEQ ID NO: 850275 - RNA, 13 nt, Homo sapiens
gugugacaucaca

SEQ ID NO: 850276 - RNA, 14 nt, Homo sapiens
guguuggcugccug

SEQ ID NO: 850277 - RNA, 15 nt, Homo sapiens
guguuguggccuuaa

SEQ ID NO: 850278 - RNA, 22 nt, Homo sapiens
guguuuguauguaaacauuucu

SEQ ID NO: 850279 - RNA, 17 nt, Homo sapiens
guuaaaaacacugcuga

SEQ ID NO: 850280 - RNA, 19 nt, Homo sapiens
guuaccguucaccaguugc

SEQ ID NO: 850281 - RNA, 17 nt, Homo sapiens
guuauagcugcauuugu

SEQ ID NO: 850282 - RNA, 17 nt, Homo sapiens
guuauaugaacauacaa

SEQ ID NO: 850283 - RNA, 18 nt, Homo sapiens
guuaugcauuuuuuacca

SEQ ID NO: 850284 - RNA, 23 nt, Homo sapiens
guuauugguguaagguacuuuca

SEQ ID NO: 850285 - RNA, 16 nt, Homo sapiens
guuccacagaggacac

SEQ ID NO: 850286 - RNA, 16 nt, Homo sapiens
guuccaugccugcucu

SEQ ID NO: 850287 - RNA, 15 nt, Homo sapiens
guucccccuguuuca

SEQ ID NO: 850288 - RNA, 16 nt, Homo sapiens
guuccuacacaggaca

SEQ ID NO: 850289 - RNA, 21 nt, Homo sapiens
guucuggauaccauuauaugu

SEQ ID NO: 850290 - RNA, 20 nt, Homo sapiens
guugacucuaguacugugaa

SEQ ID NO: 850291 - RNA, 21 nt, Homo sapiens
guugacucuaguacugugaau

SEQ ID NO: 850292 - RNA, 15 nt, Homo sapiens
guugcagcugucacc

SEQ ID NO: 850293 - RNA, 22 nt, Homo sapiens
guugggggaggggagacuuuga

SEQ ID NO: 850294 - RNA, 23 nt, Homo sapiens
guugggggaggggagacuuugau

SEQ ID NO: 850295 - RNA, 19 nt, Homo sapiens
guuggucaaaaucugcaaa

SEQ ID NO: 850296 - RNA, 21 nt, Homo sapiens
guuguauucauuguggucaua

SEQ ID NO: 850297 - RNA, 17 nt, Homo sapiens
guuuaaaaaucugccac

SEQ ID NO: 850298 - RNA, 23 nt, Homo sapiens
guuuaauacccuguacauaucuu

SEQ ID NO: 850299 - RNA, 13 nt, Homo sapiens
guuuacucagggu

SEQ ID NO: 850300 - RNA, 15 nt, Homo sapiens
guuuauaaucuugca

SEQ ID NO: 850301 - RNA, 13 nt, Homo sapiens
guuucacaguaca

SEQ ID NO: 850302 - RNA, 15 nt, Homo sapiens
guuuccaacaauuca

SEQ ID NO: 850303 - RNA, 13 nt, Homo sapiens
guuuccauggcuu

SEQ ID NO: 850304 - RNA, 15 nt, Homo sapiens
guuugaaaguacucc

SEQ ID NO: 850305 - RNA, 19 nt, Homo sapiens
guuugcaguguuaagauaa

SEQ ID NO: 850306 - RNA, 15 nt, Homo sapiens
guuuucuacuuugaa

SEQ ID NO: 850307 - RNA, 19 nt, Homo sapiens
guuuuuggacacauuuaag

SEQ ID NO: 850308 - RNA, 19 nt, Homo sapiens
guuuuuguacucugcagac

SEQ ID NO: 850309 - RNA, 15 nt, Homo sapiens
guuuuuucugcacaa

SEQ ID NO: 850310 - RNA, 13 nt, Homo sapiens
uaaaaaauuauua

SEQ ID NO: 850311 - RNA, 15 nt, Homo sapiens
uaaaaacacugcuga

SEQ ID NO: 850312 - RNA, 13 nt, Homo sapiens
uaaaaaguuugaa

SEQ ID NO: 850313 - RNA, 14 nt, Homo sapiens
uaaaaaucucucau

SEQ ID NO: 850314 - RNA, 16 nt, Homo sapiens
uaaaacaaucugucca

SEQ ID NO: 850315 - RNA, 18 nt, Homo sapiens
uaaaacuggcccuguuuc

SEQ ID NO: 850316 - RNA, 13 nt, Homo sapiens
uaaaagcauuuug

SEQ ID NO: 850317 - RNA, 12 nt, Homo sapiens
uaaaagcuauau

SEQ ID NO: 850318 - RNA, 14 nt, Homo sapiens
uaaaauaacuaaca

SEQ ID NO: 850319 - RNA, 16 nt, Homo sapiens
uaaaauauaggcuuua

SEQ ID NO: 850320 - RNA, 22 nt, Homo sapiens
uaaaaugaauuuguuguuccuu

SEQ ID NO: 850321 - RNA, 18 nt, Homo sapiens
uaaaauguuauauaauaa

SEQ ID NO: 850322 - RNA, 12 nt, Homo sapiens
uaaacauugccu

SEQ ID NO: 850323 - RNA, 22 nt, Homo sapiens
uaaacguggagaaucacaggcu

SEQ ID NO: 850324 - RNA, 12 nt, Homo sapiens
gccuuacuguau

SEQ ID NO: 850325 - RNA, 12 nt, Homo sapiens
gccuugaugaaa

SEQ ID NO: 850326 - RNA, 20 nt, Homo sapiens
gccuugauucccuuguuauu

SEQ ID NO: 850327 - RNA, 15 nt, Homo sapiens
gccuugcuguuuaaa

SEQ ID NO: 850328 - RNA, 18 nt, Homo sapiens
gccuuggccuuaaggaaa

SEQ ID NO: 850329 - RNA, 22 nt, Homo sapiens
gcgaaaucccugcucacugcag

SEQ ID NO: 850330 - RNA, 14 nt, Homo sapiens
gcgcggugucucug

SEQ ID NO: 850331 - RNA, 15 nt, Homo sapiens
gcgggacugucaaug

SEQ ID NO: 850332 - RNA, 19 nt, Homo sapiens
gcgggacugucaauggagg

SEQ ID NO: 850333 - RNA, 18 nt, Homo sapiens
gcguauuuuguauuuaaa

SEQ ID NO: 850334 - RNA, 14 nt, Homo sapiens
gcuaaaacuggccc

SEQ ID NO: 850335 - RNA, 21 nt, Homo sapiens
gcuaaaaucauccuauuacuu

SEQ ID NO: 850336 - RNA, 20 nt, Homo sapiens
gcuaagaauagauggaagac

SEQ ID NO: 850337 - RNA, 13 nt, Homo sapiens
gcuagaacauucc

SEQ ID NO: 850338 - RNA, 18 nt, Homo sapiens
gcuagcuauuacugcaga

SEQ ID NO: 850339 - RNA, 18 nt, Homo sapiens
gcuauucgccagcagaca

SEQ ID NO: 850340 - RNA, 20 nt, Homo sapiens
gcucaaagcaaucccaguga

SEQ ID NO: 850341 - RNA, 18 nt, Homo sapiens
gcucauaugaacuuucau

SEQ ID NO: 850342 - RNA, 15 nt, Homo sapiens
gcuccagcuuuugca

SEQ ID NO: 850343 - RNA, 18 nt, Homo sapiens
gcucccagcgcacacaaa

SEQ ID NO: 850344 - RNA, 18 nt, Homo sapiens
gcucccucacucucagga

SEQ ID NO: 850345 - RNA, 13 nt, Homo sapiens
gcucucacucugu

SEQ ID NO: 850346 - RNA, 12 nt, Homo sapiens
gcucucuucuaa

SEQ ID NO: 850347 - RNA, 15 nt, Homo sapiens
gcucuuuaacauggu

SEQ ID NO: 850348 - RNA, 18 nt, Homo sapiens
gcugaacaaaauuaaacu

SEQ ID NO: 850349 - RNA, 14 nt, Homo sapiens
gcugaacauugcau

SEQ ID NO: 850350 - RNA, 22 nt, Homo sapiens
gcugaccauaacagugccagcu

SEQ ID NO: 850351 - RNA, 14 nt, Homo sapiens
gcugagacugcuga

SEQ ID NO: 850352 - RNA, 20 nt, Homo sapiens
gcugauacuucuacaacuuu

SEQ ID NO: 850353 - RNA, 14 nt, Homo sapiens
gcugccugcugcgc

SEQ ID NO: 850354 - RNA, 16 nt, Homo sapiens
gcugcuuaugagcaca

SEQ ID NO: 850355 - RNA, 16 nt, Homo sapiens
gcuggaaacauucacu

SEQ ID NO: 850356 - RNA, 15 nt, Homo sapiens
gcuggauuugugcuu

SEQ ID NO: 850357 - RNA, 23 nt, Homo sapiens
gcuggccaauuaaggcaucauca

SEQ ID NO: 850358 - RNA, 21 nt, Homo sapiens
gcuggcgggcccuggagcuca

SEQ ID NO: 850359 - RNA, 22 nt, Homo sapiens
gcuggcgggcccuggagcucaa

SEQ ID NO: 850360 - RNA, 13 nt, Homo sapiens
gcugggucagggg

SEQ ID NO: 850361 - RNA, 14 nt, Homo sapiens
gcugggucaggggu

SEQ ID NO: 850362 - RNA, 20 nt, Homo sapiens
gcuguuggaugcagcaauaa

SEQ ID NO: 850363 - RNA, 16 nt, Homo sapiens
gcuuacauuugaauaa

SEQ ID NO: 850364 - RNA, 14 nt, Homo sapiens
gcuuauacaaauuu

SEQ ID NO: 850365 - RNA, 14 nt, Homo sapiens
gcuuaugagcacag

SEQ ID NO: 850366 - RNA, 20 nt, Homo sapiens
gcuucauguucccaaaauca

SEQ ID NO: 850367 - RNA, 22 nt, Homo sapiens
gcuucuagucuggaacugcugc

SEQ ID NO: 850368 - RNA, 16 nt, Homo sapiens
gcuucuauaaguguga

SEQ ID NO: 850369 - RNA, 15 nt, Homo sapiens
gcuugguacuguaau

SEQ ID NO: 850370 - RNA, 16 nt, Homo sapiens
gcuuuggugcaucuca

SEQ ID NO: 850371 - RNA, 18 nt, Homo sapiens
ggaacaaggaaggugaug

SEQ ID NO: 850372 - RNA, 18 nt, Homo sapiens
ggaacuugauguugagau

SEQ ID NO: 850373 - RNA, 19 nt, Homo sapiens
ggaaggcaauuucucugca

SEQ ID NO: 850374 - RNA, 16 nt, Homo sapiens
ggaaguuuuaaucucu

SEQ ID NO: 850375 - RNA, 14 nt, Homo sapiens
ggaaugagcagcuu

SEQ ID NO: 850376 - RNA, 21 nt, Homo sapiens
ggaaugggucucucuugcccc

SEQ ID NO: 850377 - RNA, 17 nt, Homo sapiens
ggacaaacugccaguuu

SEQ ID NO: 850378 - RNA, 19 nt, Homo sapiens
ggacaaguagccaccugag

SEQ ID NO: 850379 - RNA, 16 nt, Homo sapiens
ggacaugaaaauagca

SEQ ID NO: 850380 - RNA, 21 nt, Homo sapiens
ggaccacagaggcugugguca

SEQ ID NO: 850381 - RNA, 24 nt, Homo sapiens
ggaccagcuuggcucaggcugagc

SEQ ID NO: 850382 - RNA, 18 nt, Homo sapiens
ggacccaguggcagggca

SEQ ID NO: 850383 - RNA, 22 nt, Homo sapiens
ggacccugaagaggcauuucag

SEQ ID NO: 850384 - RNA, 14 nt, Homo sapiens
ggacuagaugacuc

SEQ ID NO: 850385 - RNA, 21 nt, Homo sapiens
ggagaaagcucucuauaccaa

SEQ ID NO: 850386 - RNA, 22 nt, Homo sapiens
ggagaccuguaucaaacugcuu

SEQ ID NO: 850387 - RNA, 18 nt, Homo sapiens
ggagacuuugaguggcag

SEQ ID NO: 850388 - RNA, 16 nt, Homo sapiens
ggagacuuugauguca

SEQ ID NO: 850389 - RNA, 16 nt, Homo sapiens
ggagcuaaaacuggcc

SEQ ID NO: 850390 - RNA, 15 nt, Homo sapiens
ggaggccagugccau

SEQ ID NO: 850391 - RNA, 21 nt, Homo sapiens
ggaggcucaaauuuugaguua

SEQ ID NO: 850392 - RNA, 20 nt, Homo sapiens
ggagggucacuggggcccaa

SEQ ID NO: 850393 - RNA, 18 nt, Homo sapiens
ggauaaacauuccagaga

SEQ ID NO: 850394 - RNA, 12 nt, Homo sapiens
ggaucagccuug

SEQ ID NO: 850395 - RNA, 20 nt, Homo sapiens
ggauccugcacugacucugg

SEQ ID NO: 850396 - RNA, 18 nt, Homo sapiens
ggaugaauaaauguuaua

SEQ ID NO: 850397 - RNA, 11 nt, Homo sapiens
ggaugaugacu

SEQ ID NO: 850398 - RNA, 20 nt, Homo sapiens
ggauucuagaacugugaauu

SEQ ID NO: 850399 - RNA, 14 nt, Homo sapiens
ggauugucacucca

SEQ ID NO: 850400 - RNA, 20 nt, Homo sapiens
ggauugucacuccaaaccuu

SEQ ID NO: 850401 - RNA, 16 nt, Homo sapiens
ggauuuucaaggucau

SEQ ID NO: 850402 - RNA, 17 nt, Homo sapiens
ggcaagcccugccucug

SEQ ID NO: 850403 - RNA, 15 nt, Homo sapiens
ggcagcaggggccaa

SEQ ID NO: 850404 - RNA, 17 nt, Homo sapiens
ggcaggggaagcucuca

SEQ ID NO: 850405 - RNA, 19 nt, Homo sapiens
ggcaguucgaccagccagg

SEQ ID NO: 850406 - RNA, 22 nt, Homo sapiens
ggcauuuucuugguagcacaaa

SEQ ID NO: 850407 - RNA, 14 nt, Homo sapiens
ggccaagcaggcac

SEQ ID NO: 850408 - RNA, 21 nt, Homo sapiens
ggccaaugggcuagagggugc

SEQ ID NO: 850409 - RNA, 17 nt, Homo sapiens
ggccagagucacaggaa

SEQ ID NO: 850410 - RNA, 17 nt, Homo sapiens
ggccagcagccuuccag

SEQ ID NO: 850411 - RNA, 16 nt, Homo sapiens
ggccaggaaguagcac

SEQ ID NO: 850412 - RNA, 22 nt, Homo sapiens
ggccaggaugcucccccaggga

SEQ ID NO: 850413 - RNA, 16 nt, Homo sapiens
ggccagugccauuuca

SEQ ID NO: 850414 - RNA, 17 nt, Homo sapiens
ggccagugccauuucag

SEQ ID NO: 850415 - RNA, 12 nt, Homo sapiens
ggcccaggccag

SEQ ID NO: 850416 - RNA, 14 nt, Homo sapiens
ggcccaucaggggc

SEQ ID NO: 850417 - RNA, 16 nt, Homo sapiens
ggccccagagugccca

SEQ ID NO: 850418 - RNA, 16 nt, Homo sapiens
ggccgccuguccucac

SEQ ID NO: 850419 - RNA, 19 nt, Homo sapiens
ggccggaaaacaagccuga

SEQ ID NO: 850420 - RNA, 18 nt, Homo sapiens
ggccguguccaccuuuca

SEQ ID NO: 850421 - RNA, 15 nt, Homo sapiens
ggccucauuugcucu

SEQ ID NO: 850422 - RNA, 14 nt, Homo sapiens
ggccucugcaaagg

SEQ ID NO: 850423 - RNA, 21 nt, Homo sapiens
ggccuucugccugcugaccau

SEQ ID NO: 850424 - RNA, 14 nt, Homo sapiens
ggccuugaugguga

SEQ ID NO: 850425 - RNA, 19 nt, Homo sapiens
ggcuaccaggaagaaggac

SEQ ID NO: 850426 - RNA, 21 nt, Homo sapiens
ggcuccacuuggcuccucuca

SEQ ID NO: 850427 - RNA, 19 nt, Homo sapiens
ggcucccucacucucagga

SEQ ID NO: 850428 - RNA, 19 nt, Homo sapiens
ggcuccucucacuucccag

SEQ ID NO: 850429 - RNA, 14 nt, Homo sapiens
ggcucugacucugc

SEQ ID NO: 850430 - RNA, 14 nt, Homo sapiens
ggcugaagugcaug

SEQ ID NO: 850431 - RNA, 14 nt, Homo sapiens
ggcugucgggguca

SEQ ID NO: 850432 - RNA, 23 nt, Homo sapiens
ggcuucugugcccagaauacuga

SEQ ID NO: 850433 - RNA, 13 nt, Homo sapiens
gggaagaaacgga

SEQ ID NO: 850434 - RNA, 15 nt, Homo sapiens
gggauccagcucaag

SEQ ID NO: 850435 - RNA, 19 nt, Homo sapiens
gggcaauuuuuguauccaa

SEQ ID NO: 850436 - RNA, 20 nt, Homo sapiens
gggcaauuuuuguauccaag

SEQ ID NO: 850437 - RNA, 21 nt, Homo sapiens
gggcacagggccuggcccaug

SEQ ID NO: 850438 - RNA, 16 nt, Homo sapiens
gggcaggaaccagaca

SEQ ID NO: 850439 - RNA, 15 nt, Homo sapiens
gggcaucauucucua

SEQ ID NO: 850440 - RNA, 13 nt, Homo sapiens
gggccacacaagu

SEQ ID NO: 850441 - RNA, 20 nt, Homo sapiens
gggcccaagagucuggggac

SEQ ID NO: 850442 - RNA, 19 nt, Homo sapiens
gggccggucgggggggacc

SEQ ID NO: 850443 - RNA, 16 nt, Homo sapiens
gggccucccacuccca

SEQ ID NO: 850444 - RNA, 15 nt, Homo sapiens
gggccuugaugguga

SEQ ID NO: 850445 - RNA, 22 nt, Homo sapiens
gggcuccucuugggaaucagag

SEQ ID NO: 850446 - RNA, 16 nt, Homo sapiens
ggggaccagcuuggcu

SEQ ID NO: 850447 - RNA, 15 nt, Homo sapiens
ggggcaggaaccaga

SEQ ID NO: 850448 - RNA, 16 nt, Homo sapiens
gggucucucuugcccc

SEQ ID NO: 850449 - RNA, 19 nt, Homo sapiens
gggucugucaggguuggaa

SEQ ID NO: 850450 - RNA, 17 nt, Homo sapiens
ggguuagacugccagcu

SEQ ID NO: 850451 - RNA, 20 nt, Homo sapiens
ggguucauuugugaugacau

SEQ ID NO: 850452 - RNA, 20 nt, Homo sapiens
ggguuuccauggcuucccag

SEQ ID NO: 850453 - RNA, 13 nt, Homo sapiens
gguaaauugccau

SEQ ID NO: 850454 - RNA, 21 nt, Homo sapiens
gguaacauuuugacaacugaa

SEQ ID NO: 850455 - RNA, 21 nt, Homo sapiens
gguacacagagcuaaggccaa

SEQ ID NO: 850456 - RNA, 22 nt, Homo sapiens
gguaugucauucgcuacuauga

SEQ ID NO: 850457 - RNA, 21 nt, Homo sapiens
ggucuuauauuuacaacacuu

SEQ ID NO: 850458 - RNA, 22 nt, Homo sapiens
ggucuucgcagccuagauauga

SEQ ID NO: 850459 - RNA, 18 nt, Homo sapiens
aaaaacccguaagauucc

SEQ ID NO: 850460 - RNA, 13 nt, Homo sapiens
aaaaauaucugua

SEQ ID NO: 850461 - RNA, 17 nt, Homo sapiens
aaaaaugucuuucaugu

SEQ ID NO: 850462 - RNA, 17 nt, Homo sapiens
aaaacaaaggccuaauu

SEQ ID NO: 850463 - RNA, 21 nt, Homo sapiens
aaaacaagagacugcuugaca

SEQ ID NO: 850464 - RNA, 19 nt, Homo sapiens
aaaacauaacugauaccaa

SEQ ID NO: 850465 - RNA, 12 nt, Homo sapiens
aaaacucuauuu

SEQ ID NO: 850466 - RNA, 15 nt, Homo sapiens
aaaaguagcuuccuc

SEQ ID NO: 850467 - RNA, 21 nt, Homo sapiens
aaaagucuggcccacugugca

SEQ ID NO: 850468 - RNA, 21 nt, Homo sapiens
aaaagugccuuagcauguguu

SEQ ID NO: 850469 - RNA, 20 nt, Homo sapiens
aaaaguugaugucaauaaca

SEQ ID NO: 850470 - RNA, 12 nt, Homo sapiens
aaaaugccaaaa

SEQ ID NO: 850471 - RNA, 17 nt, Homo sapiens
aaaaugggagaucuucu

SEQ ID NO: 850472 - RNA, 21 nt, Homo sapiens
aaaauuaccuguauaauggag

SEQ ID NO: 850473 - RNA, 19 nt, Homo sapiens
aaaauuauguuugccacuu

SEQ ID NO: 850474 - RNA, 19 nt, Homo sapiens
aaaauugcccccacauugg

SEQ ID NO: 850475 - RNA, 17 nt, Homo sapiens
aaaauugugaugcuccu

SEQ ID NO: 850476 - RNA, 23 nt, Homo sapiens
aaacaacacaauccguugcaaac

SEQ ID NO: 850477 - RNA, 15 nt, Homo sapiens
aaacagaagugcauc

SEQ ID NO: 850478 - RNA, 11 nt, Homo sapiens
aaacagacuug

SEQ ID NO: 850479 - RNA, 13 nt, Homo sapiens
aaacaguugacaa

SEQ ID NO: 850480 - RNA, 17 nt, Homo sapiens
aaacaucccaauucuuu

SEQ ID NO: 850481 - RNA, 14 nt, Homo sapiens
aaacaugauauauc

SEQ ID NO: 850482 - RNA, 13 nt, Homo sapiens
aaacauguggcuu

SEQ ID NO: 850483 - RNA, 12 nt, Homo sapiens
aaaccauucacc

SEQ ID NO: 850484 - RNA, 18 nt, Homo sapiens
aaacccguaagauuccuu

SEQ ID NO: 850485 - RNA, 23 nt, Homo sapiens
aaaccgaacugggcauauuucua

SEQ ID NO: 850486 - RNA, 12 nt, Homo sapiens
aaaccugugaag

SEQ ID NO: 850487 - RNA, 22 nt, Homo sapiens
aaaccuucugacuuugccaaaa

SEQ ID NO: 850488 - RNA, 16 nt, Homo sapiens
aaacggcuuuucuugg

SEQ ID NO: 850489 - RNA, 19 nt, Homo sapiens
aaacguggagaaucacagg

SEQ ID NO: 850490 - RNA, 16 nt, Homo sapiens
aaacucaccucccaau

SEQ ID NO: 850491 - RNA, 16 nt, Homo sapiens
aaacuccagaugccac

SEQ ID NO: 850492 - RNA, 18 nt, Homo sapiens
aaacucuauggucuuaua

SEQ ID NO: 850493 - RNA, 21 nt, Homo sapiens
aaacuucccucucuagacagu

SEQ ID NO: 850494 - RNA, 13 nt, Homo sapiens
aaagaaaacucua

SEQ ID NO: 850495 - RNA, 22 nt, Homo sapiens
aaagacauuucaaauaacugca

SEQ ID NO: 850496 - RNA, 12 nt, Homo sapiens
aaagaggccaaa

SEQ ID NO: 850497 - RNA, 22 nt, Homo sapiens
aaagauaaaaaaacagcuuuau

SEQ ID NO: 850498 - RNA, 17 nt, Homo sapiens
aaagauauggcugcuuc

SEQ ID NO: 850499 - RNA, 13 nt, Homo sapiens
aaagcauggaugu

SEQ ID NO: 850500 - RNA, 22 nt, Homo sapiens
aaagccagguuccacagaggac

SEQ ID NO: 850501 - RNA, 13 nt, Homo sapiens
aaagcuagucaac

SEQ ID NO: 850502 - RNA, 20 nt, Homo sapiens
aaagcucucuauaccaaaga

SEQ ID NO: 850503 - RNA, 16 nt, Homo sapiens
aaaggaagugccuugg

SEQ ID NO: 850504 - RNA, 12 nt, Homo sapiens
aaaggcauauau

SEQ ID NO: 850505 - RNA, 22 nt, Homo sapiens
aaagggaaauacucuuaauuca

SEQ ID NO: 850506 - RNA, 23 nt, Homo sapiens
aaaggugugccuggcagccauuu

SEQ ID NO: 850507 - RNA, 11 nt, Homo sapiens
aaagugcagua

SEQ ID NO: 850508 - RNA, 13 nt, Homo sapiens
aaagugcaguaaa

SEQ ID NO: 850509 - RNA, 23 nt, Homo sapiens
aaaguuguuuuaucuggugggaa

SEQ ID NO: 850510 - RNA, 19 nt, Homo sapiens
aaaguuugguaaugggaua

SEQ ID NO: 850511 - RNA, 13 nt, Homo sapiens
aaauaacacagca

SEQ ID NO: 850512 - RNA, 16 nt, Homo sapiens
aaauaaucaacugcau

SEQ ID NO: 850513 - RNA, 21 nt, Homo sapiens
aaauauuguaguuugaauauu

SEQ ID NO: 850514 - RNA, 16 nt, Homo sapiens
aaauauuuagauguaa

SEQ ID NO: 850515 - RNA, 11 nt, Homo sapiens
aaaucugccac

SEQ ID NO: 850516 - RNA, 13 nt, Homo sapiens
aaaugaacuguaa

SEQ ID NO: 850517 - RNA, 13 nt, Homo sapiens
aaaugaaugaaua

SEQ ID NO: 850518 - RNA, 20 nt, Homo sapiens
aaauggcccggacaugucuu

SEQ ID NO: 850519 - RNA, 23 nt, Homo sapiens
aaauggcccggacaugucuugcu

SEQ ID NO: 850520 - RNA, 17 nt, Homo sapiens
aaaugguccaguacaaa

SEQ ID NO: 850521 - RNA, 20 nt, Homo sapiens
aaauguaucaacacacauuu

SEQ ID NO: 850522 - RNA, 20 nt, Homo sapiens
aaauguaugagacugggcau

SEQ ID NO: 850523 - RNA, 14 nt, Homo sapiens
aaaugugugcccag

SEQ ID NO: 850524 - RNA, 18 nt, Homo sapiens
aaaugugugcccagcuua

SEQ ID NO: 850525 - RNA, 15 nt, Homo sapiens
aaauuauugaugaaa

SEQ ID NO: 850526 - RNA, 18 nt, Homo sapiens
aaauucagugaugugccu

SEQ ID NO: 850527 - RNA, 16 nt, Homo sapiens
aaauugcuugacccag

SEQ ID NO: 850528 - RNA, 13 nt, Homo sapiens
aacaaagugaagu

SEQ ID NO: 850529 - RNA, 19 nt, Homo sapiens
aacaaaguuuucaugugcu

SEQ ID NO: 850530 - RNA, 19 nt, Homo sapiens
aacaaaucaucucgcuaaa

SEQ ID NO: 850531 - RNA, 17 nt, Homo sapiens
aacaagcauucucucca

SEQ ID NO: 850532 - RNA, 23 nt, Homo sapiens
aacaauucucccgggacucugca

SEQ ID NO: 850533 - RNA, 20 nt, Homo sapiens
aacacugcugaggcuucaua

SEQ ID NO: 850534 - RNA, 19 nt, Homo sapiens
aacagagaguaagcacuua

SEQ ID NO: 850535 - RNA, 21 nt, Homo sapiens
aacagauuuggaaagacugga

SEQ ID NO: 850536 - RNA, 15 nt, Homo sapiens
aacagcuguugacuc

SEQ ID NO: 850537 - RNA, 22 nt, Homo sapiens
aacagugcuauucugagugaaa

SEQ ID NO: 850538 - RNA, 19 nt, Homo sapiens
aacaucagcucugugccac

SEQ ID NO: 850539 - RNA, 19 nt, Homo sapiens
aacaucccaauucuuuagu

SEQ ID NO: 850540 - RNA, 15 nt, Homo sapiens
aacauuccagagaaa

SEQ ID NO: 850541 - RNA, 21 nt, Homo sapiens
aacauuucuuguaggcaucac

SEQ ID NO: 850542 - RNA, 13 nt, Homo sapiens
aaccauagcauua

SEQ ID NO: 850543 - RNA, 19 nt, Homo sapiens
aaccuauuucccuugccuc

SEQ ID NO: 850544 - RNA, 23 nt, Homo sapiens
aaccucccccgacgcucucucuc

SEQ ID NO: 850545 - RNA, 13 nt, Homo sapiens
aaccuuacucuga

SEQ ID NO: 850546 - RNA, 16 nt, Homo sapiens
aacgacauggaacuga

SEQ ID NO: 850547 - RNA, 22 nt, Homo sapiens
aacgaggcagucaccgccgucg

SEQ ID NO: 850548 - RNA, 19 nt, Homo sapiens
aacgaucacaaaugacuuu

SEQ ID NO: 850549 - RNA, 13 nt, Homo sapiens
aacguuugguuca

SEQ ID NO: 850550 - RNA, 15 nt, Homo sapiens
aacucacucccucac

SEQ ID NO: 850551 - RNA, 18 nt, Homo sapiens
aacugacccuuccuucau

SEQ ID NO: 850552 - RNA, 20 nt, Homo sapiens
aacugagcugcaaucgcuuu

SEQ ID NO: 850553 - RNA, 17 nt, Homo sapiens
aacugauuacguuuaca

SEQ ID NO: 850554 - RNA, 15 nt, Homo sapiens
aacuggcccuguuuc

SEQ ID NO: 850555 - RNA, 20 nt, Homo sapiens
aacuguaaauugagauuuaa

SEQ ID NO: 850556 - RNA, 22 nt, Homo sapiens
aacugucagggaggucuuuccc

SEQ ID NO: 850557 - RNA, 18 nt, Homo sapiens
aacuguuccccuugguau

SEQ ID NO: 850558 - RNA, 14 nt, Homo sapiens
aacuuaugacuaaa

SEQ ID NO: 850559 - RNA, 17 nt, Homo sapiens
aacuuuaaaacugcuca

SEQ ID NO: 850560 - RNA, 16 nt, Homo sapiens
gagacugcuugacaaa

SEQ ID NO: 850561 - RNA, 13 nt, Homo sapiens
gagagccugugau

SEQ ID NO: 850562 - RNA, 15 nt, Homo sapiens
gagaggggaggccaa

SEQ ID NO: 850563 - RNA, 16 nt, Homo sapiens
gagaguaagcacuuaa

SEQ ID NO: 850564 - RNA, 14 nt, Homo sapiens
gagauaagcaguua

SEQ ID NO: 850565 - RNA, 21 nt, Homo sapiens
gagcaaugggcuuugcugcuu

SEQ ID NO: 850566 - RNA, 21 nt, Homo sapiens
gagcauugcagucacuuugac

SEQ ID NO: 850567 - RNA, 18 nt, Homo sapiens
gagcuaaggccaaugggc

SEQ ID NO: 850568 - RNA, 21 nt, Homo sapiens
gagcugaauuaccuuucacuu

SEQ ID NO: 850569 - RNA, 11 nt, Homo sapiens
gagcugagacc

SEQ ID NO: 850570 - RNA, 19 nt, Homo sapiens
gagcugggguagaacuggc

SEQ ID NO: 850571 - RNA, 16 nt, Homo sapiens
gaggaauauugcugcu

SEQ ID NO: 850572 - RNA, 21 nt, Homo sapiens
gaggacagccugccucugcca

SEQ ID NO: 850573 - RNA, 18 nt, Homo sapiens
gaggaguggauuccuccc

SEQ ID NO: 850574 - RNA, 21 nt, Homo sapiens
gaggcaacccgugcucagcug

SEQ ID NO: 850575 - RNA, 18 nt, Homo sapiens
gaggccccaauaccccau

SEQ ID NO: 850576 - RNA, 16 nt, Homo sapiens
gaggcucgagcucggg

SEQ ID NO: 850577 - RNA, 11 nt, Homo sapiens
gaggggccaga

SEQ ID NO: 850578 - RNA, 18 nt, Homo sapiens
gagggugauggaacaaga

SEQ ID NO: 850579 - RNA, 18 nt, Homo sapiens
gaguauguucauugccac

SEQ ID NO: 850580 - RNA, 23 nt, Homo sapiens
gagucauuucugauuucagggga

SEQ ID NO: 850581 - RNA, 9 nt, Homo sapiens
gagugaaug

SEQ ID NO: 850582 - RNA, 21 nt, Homo sapiens
gagugcugacccaacagccuc

SEQ ID NO: 850583 - RNA, 13 nt, Homo sapiens
gaguuaaggcaaa

SEQ ID NO: 850584 - RNA, 21 nt, Homo sapiens
gaguucugggauuucuucuca

SEQ ID NO: 850585 - RNA, 23 nt, Homo sapiens
gaguucugggauuucuucucaca

SEQ ID NO: 850586 - RNA, 18 nt, Homo sapiens
gaguuuuaaaaaugcaaa

SEQ ID NO: 850587 - RNA, 16 nt, Homo sapiens
gauaauuguacuuuga

SEQ ID NO: 850588 - RNA, 17 nt, Homo sapiens
gauaauuguacuuugaa

SEQ ID NO: 850589 - RNA, 20 nt, Homo sapiens
gauacaaaacuauuaaguau

SEQ ID NO: 850590 - RNA, 18 nt, Homo sapiens
gauacuugcuccauucau

SEQ ID NO: 850591 - RNA, 13 nt, Homo sapiens
gauagagugcagu

SEQ ID NO: 850592 - RNA, 12 nt, Homo sapiens
gauauaaacagc

SEQ ID NO: 850593 - RNA, 16 nt, Homo sapiens
gauauaagcaaaauca

SEQ ID NO: 850594 - RNA, 16 nt, Homo sapiens
gaucaaugaccccugu

SEQ ID NO: 850595 - RNA, 22 nt, Homo sapiens
gaucacugaaauaaaagcuaua

SEQ ID NO: 850596 - RNA, 21 nt, Homo sapiens
gauccaauggaauacugaaaa

SEQ ID NO: 850597 - RNA, 15 nt, Homo sapiens
gauccagcucaaggg

SEQ ID NO: 850598 - RNA, 12 nt, Homo sapiens
gaucucaaggau

SEQ ID NO: 850599 - RNA, 12 nt, Homo sapiens
gaugaagcugag

SEQ ID NO: 850600 - RNA, 23 nt, Homo sapiens
gaugacugaaaaugaacuguaaa

SEQ ID NO: 850601 - RNA, 15 nt, Homo sapiens
gaugcuugguacugu

SEQ ID NO: 850602 - RNA, 21 nt, Homo sapiens
gauggaacaagagaaguacua

SEQ ID NO: 850603 - RNA, 16 nt, Homo sapiens
gaugggccacacaagu

SEQ ID NO: 850604 - RNA, 13 nt, Homo sapiens
gauuaaugaucau

SEQ ID NO: 850605 - RNA, 16 nt, Homo sapiens
gauuacguuuacauuc

SEQ ID NO: 850606 - RNA, 22 nt, Homo sapiens
gauuagagaccagaucagauaa

SEQ ID NO: 850607 - RNA, 16 nt, Homo sapiens
gauucucuugccucag

SEQ ID NO: 850608 - RNA, 23 nt, Homo sapiens
gauuguagaacuuguugcugauu

SEQ ID NO: 850609 - RNA, 21 nt, Homo sapiens
gcaaaauuauguuugccacuu

SEQ ID NO: 850610 - RNA, 20 nt, Homo sapiens
gcaaacucuaaaagaagaaa

SEQ ID NO: 850611 - RNA, 18 nt, Homo sapiens
gcaaaggaaauaccaguu

SEQ ID NO: 850612 - RNA, 12 nt, Homo sapiens
gcaagaaccagu

SEQ ID NO: 850613 - RNA, 13 nt, Homo sapiens
gcaaggccaccuc

SEQ ID NO: 850614 - RNA, 17 nt, Homo sapiens
gcaagugugaauacugc

SEQ ID NO: 850615 - RNA, 16 nt, Homo sapiens
gcaauaaaacugcuag

SEQ ID NO: 850616 - RNA, 15 nt, Homo sapiens
gcaauaaaagacaaa

SEQ ID NO: 850617 - RNA, 21 nt, Homo sapiens
gcaauuaaaggguuaaugugu

SEQ ID NO: 850618 - RNA, 18 nt, Homo sapiens
gcaauucucgauucuuug

SEQ ID NO: 850619 - RNA, 14 nt, Homo sapiens
gcacaaaguuuacu

SEQ ID NO: 850620 - RNA, 17 nt, Homo sapiens
gcacacaccucaugcua

SEQ ID NO: 850621 - RNA, 17 nt, Homo sapiens
gcacagcugcucuguga

SEQ ID NO: 850622 - RNA, 21 nt, Homo sapiens
gcaccagcccagaagugcaga

SEQ ID NO: 850623 - RNA, 16 nt, Homo sapiens
gcaccauacucaugca

SEQ ID NO: 850624 - RNA, 19 nt, Homo sapiens
gcacccuccuuucucacca

SEQ ID NO: 850625 - RNA, 13 nt, Homo sapiens
gcacgugcacaaa

SEQ ID NO: 850626 - RNA, 22 nt, Homo sapiens
gcacugaagcugcggcccugau

SEQ ID NO: 850627 - RNA, 19 nt, Homo sapiens
gcacuugggggcucagcaa

SEQ ID NO: 850628 - RNA, 17 nt, Homo sapiens
gcagaaggaaggcuuug

SEQ ID NO: 850629 - RNA, 17 nt, Homo sapiens
gcagacaucaagcucaa

SEQ ID NO: 850630 - RNA, 21 nt, Homo sapiens
gcagaugcguccgaagggaaa

SEQ ID NO: 850631 - RNA, 16 nt, Homo sapiens
gcagccuagauaugaa

SEQ ID NO: 850632 - RNA, 15 nt, Homo sapiens
gcagcuccuuuggac

SEQ ID NO: 850633 - RNA, 22 nt, Homo sapiens
gcaggaacucuaagaccacaga

SEQ ID NO: 850634 - RNA, 14 nt, Homo sapiens
gcaggacacugcag

SEQ ID NO: 850635 - RNA, 18 nt, Homo sapiens
gcaggagggacagucuca

SEQ ID NO: 850636 - RNA, 17 nt, Homo sapiens
gcaggcacugaagcugc

SEQ ID NO: 850637 - RNA, 19 nt, Homo sapiens
gcaggucccugugagcaca

SEQ ID NO: 850638 - RNA, 18 nt, Homo sapiens
gcaggugagcaagcccag

SEQ ID NO: 850639 - RNA, 14 nt, Homo sapiens
gcagucacuuugac

SEQ ID NO: 850640 - RNA, 20 nt, Homo sapiens
gcagucagguccaugugcac

SEQ ID NO: 850641 - RNA, 14 nt, Homo sapiens
gcaguggcugugaa

SEQ ID NO: 850642 - RNA, 19 nt, Homo sapiens
gcaguggguucaggcccau

SEQ ID NO: 850643 - RNA, 17 nt, Homo sapiens
gcaguggucccaauagg

SEQ ID NO: 850644 - RNA, 14 nt, Homo sapiens
gcauaaagaauuug

SEQ ID NO: 850645 - RNA, 23 nt, Homo sapiens
gcauauaacuuauauuguaagaa

SEQ ID NO: 850646 - RNA, 21 nt, Homo sapiens
gcaucauucucuaauauccac

SEQ ID NO: 850647 - RNA, 15 nt, Homo sapiens
gcaucucaucuggac

SEQ ID NO: 850648 - RNA, 18 nt, Homo sapiens
gcaugaugaaugaccuga

SEQ ID NO: 850649 - RNA, 14 nt, Homo sapiens
gcaugggucagggu

SEQ ID NO: 850650 - RNA, 15 nt, Homo sapiens
gcauuagaaauaagu

SEQ ID NO: 850651 - RNA, 14 nt, Homo sapiens
gcauucucuccauu

SEQ ID NO: 850652 - RNA, 17 nt, Homo sapiens
gcauucucuccauuuca

SEQ ID NO: 850653 - RNA, 20 nt, Homo sapiens
gcauuuccuuucaguggcuu

SEQ ID NO: 850654 - RNA, 14 nt, Homo sapiens
gccaagggggaccu

SEQ ID NO: 850655 - RNA, 16 nt, Homo sapiens
gccaaucagaagcuaa

SEQ ID NO: 850656 - RNA, 17 nt, Homo sapiens
gccacagggacuugccu

SEQ ID NO: 850657 - RNA, 18 nt, Homo sapiens
gccacaucccucucugcu

SEQ ID NO: 850658 - RNA, 17 nt, Homo sapiens
gccaccaacagccacuc

SEQ ID NO: 850659 - RNA, 18 nt, Homo sapiens
gccaccacgccuagccuc

SEQ ID NO: 850660 - RNA, 23 nt, Homo sapiens
gccaccuucccuccucaugccuu

SEQ ID NO: 850661 - RNA, 15 nt, Homo sapiens
gccacuuugcaaagg

SEQ ID NO: 850662 - RNA, 13 nt, Homo sapiens
gccagaagacuca

SEQ ID NO: 850663 - RNA, 15 nt, Homo sapiens
gccagcagccuucca

SEQ ID NO: 850664 - RNA, 15 nt, Homo sapiens
gccagccaccacuga

SEQ ID NO: 850665 - RNA, 18 nt, Homo sapiens
gccagcuuuuccagaaau

SEQ ID NO: 850666 - RNA, 14 nt, Homo sapiens
gcccaaagccuuca

SEQ ID NO: 850667 - RNA, 21 nt, Homo sapiens
gcccagagaacaagcacugug

SEQ ID NO: 850668 - RNA, 18 nt, Homo sapiens
gcccagcagacaucaagc

SEQ ID NO: 850669 - RNA, 18 nt, Homo sapiens
gcccagcgcggacauccc

SEQ ID NO: 850670 - RNA, 15 nt, Homo sapiens
gcccaggccagagcc

SEQ ID NO: 850671 - RNA, 19 nt, Homo sapiens
gcccaggcuggagugcagu

SEQ ID NO: 850672 - RNA, 20 nt, Homo sapiens
gcccauaauucauagugaua

SEQ ID NO: 850673 - RNA, 16 nt, Homo sapiens
gccccucucagcuuuc

SEQ ID NO: 850674 - RNA, 21 nt, Homo sapiens
gccccucucagcuuuccaucc

SEQ ID NO: 850675 - RNA, 14 nt, Homo sapiens
gcccggacaugucu

SEQ ID NO: 850676 - RNA, 11 nt, Homo sapiens
gcccucaggaa

SEQ ID NO: 850677 - RNA, 23 nt, Homo sapiens
gcccuccaguaccuucugccaga

SEQ ID NO: 850678 - RNA, 17 nt, Homo sapiens
gcccucucuugccaaaa

SEQ ID NO: 850679 - RNA, 21 nt, Homo sapiens
gcccugacuuucuaaugggcu

SEQ ID NO: 850680 - RNA, 15 nt, Homo sapiens
gcccugagccacuga

SEQ ID NO: 850681 - RNA, 18 nt, Homo sapiens
gcccuugccucucuggac

SEQ ID NO: 850682 - RNA, 23 nt, Homo sapiens
gccuagauaugaagaaucugcuc

SEQ ID NO: 850683 - RNA, 16 nt, Homo sapiens
gccuauaagccaaaau

SEQ ID NO: 850684 - RNA, 17 nt, Homo sapiens
gccucacgaaacuggaa

SEQ ID NO: 850685 - RNA, 17 nt, Homo sapiens
gccucagggcucugacu

SEQ ID NO: 850686 - RNA, 20 nt, Homo sapiens
gccucauaggcuucugggau

SEQ ID NO: 850687 - RNA, 12 nt, Homo sapiens
gccucaucucag

SEQ ID NO: 850688 - RNA, 22 nt, Homo sapiens
gccucggaucagccuugagaga

SEQ ID NO: 850689 - RNA, 16 nt, Homo sapiens
gccucucugcacacua

SEQ ID NO: 850690 - RNA, 12 nt, Homo sapiens
gccucugauguu

SEQ ID NO: 850691 - RNA, 14 nt, Homo sapiens
gccuggaggccaga

SEQ ID NO: 850692 - RNA, 17 nt, Homo sapiens
gccuggcaggggaucca

SEQ ID NO: 850693 - RNA, 22 nt, Homo sapiens
gccuguaaauguauucauucuu

SEQ ID NO: 850694 - RNA, 21 nt, Homo sapiens
gccugucuuaauuuucuuuca

SEQ ID NO: 850695 - RNA, 15 nt, Homo sapiens
cuuggacucuuuccc

SEQ ID NO: 850696 - RNA, 15 nt, Homo sapiens
cuuggagcucugagu

SEQ ID NO: 850697 - RNA, 18 nt, Homo sapiens
cuuggagcucugaguucc

SEQ ID NO: 850698 - RNA, 23 nt, Homo sapiens
cuugggacccuagcuauaugcau

SEQ ID NO: 850699 - RNA, 16 nt, Homo sapiens
cuuggugagucugugu

SEQ ID NO: 850700 - RNA, 16 nt, Homo sapiens
cuuguaaacauugccu

SEQ ID NO: 850701 - RNA, 17 nt, Homo sapiens
cuuguuccccuaaucua

SEQ ID NO: 850702 - RNA, 21 nt, Homo sapiens
cuuuaaaacugcucauuucau

SEQ ID NO: 850703 - RNA, 15 nt, Homo sapiens
cuuuaacugaacucu

SEQ ID NO: 850704 - RNA, 24 nt, Homo sapiens
cuuuauugcaucuggguagcugua

SEQ ID NO: 850705 - RNA, 18 nt, Homo sapiens
cuuucauuugcuuuggaa

SEQ ID NO: 850706 - RNA, 18 nt, Homo sapiens
cuuuccccccuaggucag

SEQ ID NO: 850707 - RNA, 19 nt, Homo sapiens
cuuuccucagugacugugu

SEQ ID NO: 850708 - RNA, 18 nt, Homo sapiens
cuuuccugcagccucuug

SEQ ID NO: 850709 - RNA, 17 nt, Homo sapiens
cuuucuaagagaccuga

SEQ ID NO: 850710 - RNA, 22 nt, Homo sapiens
cuuucuaagagaccugaacugg

SEQ ID NO: 850711 - RNA, 15 nt, Homo sapiens
cuuuuagucugcaua

SEQ ID NO: 850712 - RNA, 15 nt, Homo sapiens
cuuuuauuuucacag

SEQ ID NO: 850713 - RNA, 13 nt, Homo sapiens
cuuuuccaaacac

SEQ ID NO: 850714 - RNA, 20 nt, Homo sapiens
cuuuucuuuugugguuucuc

SEQ ID NO: 850715 - RNA, 18 nt, Homo sapiens
cuuuugugguuucucugg

SEQ ID NO: 850716 - RNA, 21 nt, Homo sapiens
gaaaaaaagauuuccaagaaa

SEQ ID NO: 850717 - RNA, 19 nt, Homo sapiens
gaaaaauaaaggaaauuca

SEQ ID NO: 850718 - RNA, 13 nt, Homo sapiens
gaaaaccaaacaa

SEQ ID NO: 850719 - RNA, 19 nt, Homo sapiens
gaaaauaagccaugagaau

SEQ ID NO: 850720 - RNA, 19 nt, Homo sapiens
gaaaccgaagggacuggau

SEQ ID NO: 850721 - RNA, 20 nt, Homo sapiens
gaaaccgaagggacuggauc

SEQ ID NO: 850722 - RNA, 21 nt, Homo sapiens
gaaaccugcaggcguucucuc

SEQ ID NO: 850723 - RNA, 21 nt, Homo sapiens
gaaacugcuccagcuuuugca

SEQ ID NO: 850724 - RNA, 20 nt, Homo sapiens
gaaacuuaaaugaacacagc

SEQ ID NO: 850725 - RNA, 17 nt, Homo sapiens
gaaagacuggacucuaa

SEQ ID NO: 850726 - RNA, 12 nt, Homo sapiens
gaaagauaugua

SEQ ID NO: 850727 - RNA, 15 nt, Homo sapiens
gaaauaaaaauggau

SEQ ID NO: 850728 - RNA, 14 nt, Homo sapiens
gaaauacacaggga

SEQ ID NO: 850729 - RNA, 13 nt, Homo sapiens
gaaauaccaguuc

SEQ ID NO: 850730 - RNA, 18 nt, Homo sapiens
gaaaucacugaaccucuc

SEQ ID NO: 850731 - RNA, 22 nt, Homo sapiens
gaaaugaauuuacagaacaguu

SEQ ID NO: 850732 - RNA, 14 nt, Homo sapiens
gaaaugacuuuuug

SEQ ID NO: 850733 - RNA, 17 nt, Homo sapiens
gaaauguggaugugauu

SEQ ID NO: 850734 - RNA, 14 nt, Homo sapiens
gaaauuauuauuca

SEQ ID NO: 850735 - RNA, 17 nt, Homo sapiens
gaaauuccuagugucuu

SEQ ID NO: 850736 - RNA, 18 nt, Homo sapiens
gaaauuccuagugucuuu

SEQ ID NO: 850737 - RNA, 16 nt, Homo sapiens
gaacaaaagaagcagc

SEQ ID NO: 850738 - RNA, 21 nt, Homo sapiens
gaacaaaagaagcagcaacuu

SEQ ID NO: 850739 - RNA, 22 nt, Homo sapiens
gaacaauuaaaauauucuuuaa

SEQ ID NO: 850740 - RNA, 16 nt, Homo sapiens
gaacagcuaauuguac

SEQ ID NO: 850741 - RNA, 15 nt, Homo sapiens
gaacauugcauauaa

SEQ ID NO: 850742 - RNA, 18 nt, Homo sapiens
gaaccacuuguagauuug

SEQ ID NO: 850743 - RNA, 15 nt, Homo sapiens
gaacccaacaguuca

SEQ ID NO: 850744 - RNA, 17 nt, Homo sapiens
gaacccaacaguucaug

SEQ ID NO: 850745 - RNA, 18 nt, Homo sapiens
gaacgcccagagaacaag

SEQ ID NO: 850746 - RNA, 13 nt, Homo sapiens
gaacucacucccu

SEQ ID NO: 850747 - RNA, 21 nt, Homo sapiens
gaacugacauuaaaauaacua

SEQ ID NO: 850748 - RNA, 16 nt, Homo sapiens
gaacugagguuuacau

SEQ ID NO: 850749 - RNA, 22 nt, Homo sapiens
gaacugggauggaauggcagca

SEQ ID NO: 850750 - RNA, 17 nt, Homo sapiens
gaacuguuaaaggucau

SEQ ID NO: 850751 - RNA, 14 nt, Homo sapiens
gaacuucuuugcag

SEQ ID NO: 850752 - RNA, 14 nt, Homo sapiens
gaagaaauuaacuu

SEQ ID NO: 850753 - RNA, 18 nt, Homo sapiens
gaagaauucagauugcug

SEQ ID NO: 850754 - RNA, 21 nt, Homo sapiens
gaagaccucccuucaggugcc

SEQ ID NO: 850755 - RNA, 20 nt, Homo sapiens
gaagagccccacucucagag

SEQ ID NO: 850756 - RNA, 20 nt, Homo sapiens
gaagaucucaaggauccaga

SEQ ID NO: 850757 - RNA, 18 nt, Homo sapiens
gaagcagcaacuugcaag

SEQ ID NO: 850758 - RNA, 16 nt, Homo sapiens
gaagcaucucugacca

SEQ ID NO: 850759 - RNA, 17 nt, Homo sapiens
gaagcaucucugaccag

SEQ ID NO: 850760 - RNA, 17 nt, Homo sapiens
gaagccaagggggaccu

SEQ ID NO: 850761 - RNA, 23 nt, Homo sapiens
gaagugacgguuccuacacagga

SEQ ID NO: 850762 - RNA, 10 nt, Homo sapiens
gaagugcaga

SEQ ID NO: 850763 - RNA, 15 nt, Homo sapiens
gaauaauggacaaag

SEQ ID NO: 850764 - RNA, 19 nt, Homo sapiens
gaauacucugaaaccgaag

SEQ ID NO: 850765 - RNA, 23 nt, Homo sapiens
gaauagaaauuugccccuggcaa

SEQ ID NO: 850766 - RNA, 23 nt, Homo sapiens
gaauagugacgcaaaucugcaug

SEQ ID NO: 850767 - RNA, 14 nt, Homo sapiens
gaaucauuaucuua

SEQ ID NO: 850768 - RNA, 18 nt, Homo sapiens
gaauccuugacucuuaca

SEQ ID NO: 850769 - RNA, 13 nt, Homo sapiens
gaaucuauuugug

SEQ ID NO: 850770 - RNA, 15 nt, Homo sapiens
gaauguuuuagcaca

SEQ ID NO: 850771 - RNA, 17 nt, Homo sapiens
gaauuaaaacuuuguag

SEQ ID NO: 850772 - RNA, 19 nt, Homo sapiens
gaauuaguuuuuucuuccu

SEQ ID NO: 850773 - RNA, 23 nt, Homo sapiens
gaauuguuuccuuauuugcacuu

SEQ ID NO: 850774 - RNA, 19 nt, Homo sapiens
gaauuuacagaacaguuua

SEQ ID NO: 850775 - RNA, 17 nt, Homo sapiens
gaauuuggucucuccca

SEQ ID NO: 850776 - RNA, 13 nt, Homo sapiens
gacaaaugcaaca

SEQ ID NO: 850777 - RNA, 12 nt, Homo sapiens
gacaaucaugua

SEQ ID NO: 850778 - RNA, 18 nt, Homo sapiens
gacaaucuagcucuccau

SEQ ID NO: 850779 - RNA, 15 nt, Homo sapiens
gacacagaagcccca

SEQ ID NO: 850780 - RNA, 17 nt, Homo sapiens
gacagacaccacagccu

SEQ ID NO: 850781 - RNA, 21 nt, Homo sapiens
gacagagaagggaaguaggcc

SEQ ID NO: 850782 - RNA, 15 nt, Homo sapiens
gacaggcaggugauc

SEQ ID NO: 850783 - RNA, 17 nt, Homo sapiens
gacaucaagcucaaggc

SEQ ID NO: 850784 - RNA, 13 nt, Homo sapiens
gacaucacuggca

SEQ ID NO: 850785 - RNA, 15 nt, Homo sapiens
gacaucagaacacac

SEQ ID NO: 850786 - RNA, 21 nt, Homo sapiens
gacauucuggggaacugggca

SEQ ID NO: 850787 - RNA, 18 nt, Homo sapiens
gacauuucaaauaacugc

SEQ ID NO: 850788 - RNA, 19 nt, Homo sapiens
gacauuuuagaaugucaau

SEQ ID NO: 850789 - RNA, 16 nt, Homo sapiens
gaccaaaaugccaaaa

SEQ ID NO: 850790 - RNA, 17 nt, Homo sapiens
gaccacagaggcugugg

SEQ ID NO: 850791 - RNA, 21 nt, Homo sapiens
gaccacaggugcccgccacca

SEQ ID NO: 850792 - RNA, 18 nt, Homo sapiens
gaccauaucaggagaccu

SEQ ID NO: 850793 - RNA, 19 nt, Homo sapiens
gacccugucacuaacaaaa

SEQ ID NO: 850794 - RNA, 17 nt, Homo sapiens
gacccuuuaauccaaaa

SEQ ID NO: 850795 - RNA, 16 nt, Homo sapiens
gaccuaaacauuauuu

SEQ ID NO: 850796 - RNA, 16 nt, Homo sapiens
gaccucacacaccucu

SEQ ID NO: 850797 - RNA, 17 nt, Homo sapiens
gaccucacacaccucug

SEQ ID NO: 850798 - RNA, 16 nt, Homo sapiens
gaccucacgugcaaag

SEQ ID NO: 850799 - RNA, 20 nt, Homo sapiens
gaccucacgugcaaagccac

SEQ ID NO: 850800 - RNA, 22 nt, Homo sapiens
gaccucacgugcaaagccacca

SEQ ID NO: 850801 - RNA, 20 nt, Homo sapiens
gaccugauguccauucaucc

SEQ ID NO: 850802 - RNA, 17 nt, Homo sapiens
gaccuguaucaaacugc

SEQ ID NO: 850803 - RNA, 21 nt, Homo sapiens
gacguuuuuccaguucacauu

SEQ ID NO: 850804 - RNA, 19 nt, Homo sapiens
gacuaugacggugacucuu

SEQ ID NO: 850805 - RNA, 19 nt, Homo sapiens
gacuccuguggacuccacu

SEQ ID NO: 850806 - RNA, 16 nt, Homo sapiens
gacuccuuccuugaac

SEQ ID NO: 850807 - RNA, 14 nt, Homo sapiens
gacucugagcucau

SEQ ID NO: 850808 - RNA, 16 nt, Homo sapiens
gacucuuuuccaaaca

SEQ ID NO: 850809 - RNA, 15 nt, Homo sapiens
gacugaguucuauau

SEQ ID NO: 850810 - RNA, 19 nt, Homo sapiens
gacugcugugaacaugccu

SEQ ID NO: 850811 - RNA, 17 nt, Homo sapiens
gacugugguagccagca

SEQ ID NO: 850812 - RNA, 13 nt, Homo sapiens
gacuguuuuccca

SEQ ID NO: 850813 - RNA, 23 nt, Homo sapiens
gacuuagaaucccuguguuaauu

SEQ ID NO: 850814 - RNA, 16 nt, Homo sapiens
gacuucauacuuugaa

SEQ ID NO: 850815 - RNA, 18 nt, Homo sapiens
gacuuccuuggaaaucaa

SEQ ID NO: 850816 - RNA, 20 nt, Homo sapiens
gacuuucaaaguggaugcaa

SEQ ID NO: 850817 - RNA, 22 nt, Homo sapiens
gacuuucuaaugggcuuucccc

SEQ ID NO: 850818 - RNA, 13 nt, Homo sapiens
gacuuugccaaaa

SEQ ID NO: 850819 - RNA, 20 nt, Homo sapiens
gacuuuuaaagacuugcaca

SEQ ID NO: 850820 - RNA, 12 nt, Homo sapiens
gacuuuucuccc

SEQ ID NO: 850821 - RNA, 13 nt, Homo sapiens
gagaaaaauaucu

SEQ ID NO: 850822 - RNA, 16 nt, Homo sapiens
gagaaagugacaugca

SEQ ID NO: 850823 - RNA, 13 nt, Homo sapiens
gagaagaucucaa

SEQ ID NO: 850824 - RNA, 21 nt, Homo sapiens
gagaagggguguucauagaag

SEQ ID NO: 850825 - RNA, 16 nt, Homo sapiens
gagaaguacuaucuuu

SEQ ID NO: 850826 - RNA, 23 nt, Homo sapiens
gagaauaaacgccuucccaaaau

SEQ ID NO: 850827 - RNA, 14 nt, Homo sapiens
gagacagaccacuu

SEQ ID NO: 850828 - RNA, 19 nt, Homo sapiens
gagacaggaugcuccagau

SEQ ID NO: 850829 - RNA, 14 nt, Homo sapiens
acaauguaacuuug

SEQ ID NO: 850830 - RNA, 17 nt, Homo sapiens
acacaauccauugucau

SEQ ID NO: 850831 - RNA, 23 nt, Homo sapiens
acacagcucuuuaacaugguuca

SEQ ID NO: 850832 - RNA, 16 nt, Homo sapiens
acacagggaggggaug

SEQ ID NO: 850833 - RNA, 19 nt, Homo sapiens
acaccaaucuuacuuugua

SEQ ID NO: 850834 - RNA, 12 nt, Homo sapiens
acaccacagccu

SEQ ID NO: 850835 - RNA, 14 nt, Homo sapiens
acaccagcuguaua

SEQ ID NO: 850836 - RNA, 21 nt, Homo sapiens
acacccuuggagcucugaguu

SEQ ID NO: 850837 - RNA, 14 nt, Homo sapiens
acaccgaguuucca

SEQ ID NO: 850838 - RNA, 18 nt, Homo sapiens
acaccuggacaauuucua

SEQ ID NO: 850839 - RNA, 20 nt, Homo sapiens
acacgguucaaaccugugaa

SEQ ID NO: 850840 - RNA, 17 nt, Homo sapiens
acacguucgacaaaagc

SEQ ID NO: 850841 - RNA, 19 nt, Homo sapiens
acacuaauguauuauaugu

SEQ ID NO: 850842 - RNA, 21 nt, Homo sapiens
acacuaauguauuauauguaa

SEQ ID NO: 850843 - RNA, 20 nt, Homo sapiens
aacuuuagugcuacagaaaa

SEQ ID NO: 850844 - RNA, 14 nt, Homo sapiens
aagaaauacuguac

SEQ ID NO: 850845 - RNA, 20 nt, Homo sapiens
aagaaauuccuagugucuuu

SEQ ID NO: 850846 - RNA, 14 nt, Homo sapiens
aagaauagcuuuaa

SEQ ID NO: 850847 - RNA, 17 nt, Homo sapiens
aagaaucuaaacuuuau

SEQ ID NO: 850848 - RNA, 16 nt, Homo sapiens
aagaaucugcucugaa

SEQ ID NO: 850849 - RNA, 16 nt, Homo sapiens
aagaaucuguagcuug

SEQ ID NO: 850850 - RNA, 22 nt, Homo sapiens
aagaccccacuggagucucucu

SEQ ID NO: 850851 - RNA, 15 nt, Homo sapiens
aagaccuaacuccug

SEQ ID NO: 850852 - RNA, 14 nt, Homo sapiens
aagacuuauuuuca

SEQ ID NO: 850853 - RNA, 19 nt, Homo sapiens
aagacuuccccaagccugg

SEQ ID NO: 850854 - RNA, 13 nt, Homo sapiens
aagagacugcuug

SEQ ID NO: 850855 - RNA, 13 nt, Homo sapiens
aagaggccaaaca

SEQ ID NO: 850856 - RNA, 21 nt, Homo sapiens
aagauaaaaaaacagcuuuau

SEQ ID NO: 850857 - RNA, 18 nt, Homo sapiens
aagauauaagacuuaaua

SEQ ID NO: 850858 - RNA, 20 nt, Homo sapiens
aagaucgugcuggcgcuguu

SEQ ID NO: 850859 - RNA, 20 nt, Homo sapiens
aagaugagcuuugucuacuu

SEQ ID NO: 850860 - RNA, 23 nt, Homo sapiens
aagcaacauucguucucuaacca

SEQ ID NO: 850861 - RNA, 18 nt, Homo sapiens
aagcaauaaaacugcuag

SEQ ID NO: 850862 - RNA, 23 nt, Homo sapiens
aagcacauuccaauugugcagug

SEQ ID NO: 850863 - RNA, 16 nt, Homo sapiens
aagcagcaacuugcaa

SEQ ID NO: 850864 - RNA, 16 nt, Homo sapiens
aagcaucuaaggacaa

SEQ ID NO: 850865 - RNA, 13 nt, Homo sapiens
aagcaugacccag

SEQ ID NO: 850866 - RNA, 15 nt, Homo sapiens
aagcaugacccaggu

SEQ ID NO: 850867 - RNA, 17 nt, Homo sapiens
aagcauucuaaaugaac

SEQ ID NO: 850868 - RNA, 24 nt, Homo sapiens
aagccaugagaauguuuuagcaca

SEQ ID NO: 850869 - RNA, 12 nt, Homo sapiens
aagcucacaaua

SEQ ID NO: 850870 - RNA, 21 nt, Homo sapiens
aagcugaggcccauggccaca

SEQ ID NO: 850871 - RNA, 16 nt, Homo sapiens
aagcugaugaggaaua

SEQ ID NO: 850872 - RNA, 19 nt, Homo sapiens
aagcugcggcccugaucuc

SEQ ID NO: 850873 - RNA, 15 nt, Homo sapiens
aaggaaaaagcagag

SEQ ID NO: 850874 - RNA, 21 nt, Homo sapiens
aaggaaggugaugugugaguc

SEQ ID NO: 850875 - RNA, 15 nt, Homo sapiens
aaggaagugccuugg

SEQ ID NO: 850876 - RNA, 15 nt, Homo sapiens
aaggacaguccuauu

SEQ ID NO: 850877 - RNA, 15 nt, Homo sapiens
aaggacuucuuccag

SEQ ID NO: 850878 - RNA, 15 nt, Homo sapiens
aaggagagugauuga

SEQ ID NO: 850879 - RNA, 16 nt, Homo sapiens
aaggagcucacugugg

SEQ ID NO: 850880 - RNA, 23 nt, Homo sapiens
aaggagcucacuguggugucugu

SEQ ID NO: 850881 - RNA, 23 nt, Homo sapiens
aaggagggucacuggggcccaag

SEQ ID NO: 850882 - RNA, 16 nt, Homo sapiens
aaggccgccagcuccc

SEQ ID NO: 850883 - RNA, 23 nt, Homo sapiens
aaggcuauuuuucagaacuguua

SEQ ID NO: 850884 - RNA, 12 nt, Homo sapiens
aagggaagcaga

SEQ ID NO: 850885 - RNA, 22 nt, Homo sapiens
aagggagagaucaaguugagac

SEQ ID NO: 850886 - RNA, 16 nt, Homo sapiens
aagggaguuagaccaa

SEQ ID NO: 850887 - RNA, 16 nt, Homo sapiens
aagggguuuucuugau

SEQ ID NO: 850888 - RNA, 21 nt, Homo sapiens
aagguucauugccauugucau

SEQ ID NO: 850889 - RNA, 21 nt, Homo sapiens
aaguacuaucuuuguguugca

SEQ ID NO: 850890 - RNA, 23 nt, Homo sapiens
aagucccagcgcggcugcuucug

SEQ ID NO: 850891 - RNA, 18 nt, Homo sapiens
aagucuggcccacugugc

SEQ ID NO: 850892 - RNA, 20 nt, Homo sapiens
aagugggugggcacacugaa

SEQ ID NO: 850893 - RNA, 14 nt, Homo sapiens
aagugucuaccugg

SEQ ID NO: 850894 - RNA, 18 nt, Homo sapiens
aaguguucauugcacaau

SEQ ID NO: 850895 - RNA, 15 nt, Homo sapiens
aaguuaaaagcacaa

SEQ ID NO: 850896 - RNA, 18 nt, Homo sapiens
aaguuaguuccacugaga

SEQ ID NO: 850897 - RNA, 18 nt, Homo sapiens
aaguuguguguugcugcu

SEQ ID NO: 850898 - RNA, 14 nt, Homo sapiens
aaguuugcuguacc

SEQ ID NO: 850899 - RNA, 18 nt, Homo sapiens
aaguuugcuguaccacaa

SEQ ID NO: 850900 - RNA, 16 nt, Homo sapiens
aauaaaggaagugccu

SEQ ID NO: 850901 - RNA, 17 nt, Homo sapiens
aauaaguccaucuguca

SEQ ID NO: 850902 - RNA, 20 nt, Homo sapiens
aauaaguuauaaagauuuag

SEQ ID NO: 850903 - RNA, 12 nt, Homo sapiens
aauacacaggga

SEQ ID NO: 850904 - RNA, 19 nt, Homo sapiens
aauacauuuaaaacauuaa

SEQ ID NO: 850905 - RNA, 20 nt, Homo sapiens
aauagaauacccuaaaguau

SEQ ID NO: 850906 - RNA, 18 nt, Homo sapiens
aauagauuuaauuaugaa

SEQ ID NO: 850907 - RNA, 20 nt, Homo sapiens
aauagcauuguaaaagcauu

SEQ ID NO: 850908 - RNA, 23 nt, Homo sapiens
aauagucuugcagaaaaugaaug

SEQ ID NO: 850909 - RNA, 21 nt, Homo sapiens
aauaguugguuucaaauccuu

SEQ ID NO: 850910 - RNA, 21 nt, Homo sapiens
aauauagcuaauaacauguga

SEQ ID NO: 850911 - RNA, 14 nt, Homo sapiens
aauaucucuaauau

SEQ ID NO: 850912 - RNA, 15 nt, Homo sapiens
aauauguauucugua

SEQ ID NO: 850913 - RNA, 16 nt, Homo sapiens
aauauguguaucucaa

SEQ ID NO: 850914 - RNA, 22 nt, Homo sapiens
aauauucauguucugaaaauau

SEQ ID NO: 850915 - RNA, 21 nt, Homo sapiens
aaucacugaaccucucaggau

SEQ ID NO: 850916 - RNA, 19 nt, Homo sapiens
aauccccaagaacacaaga

SEQ ID NO: 850917 - RNA, 15 nt, Homo sapiens
aauccuugacucuua

SEQ ID NO: 850918 - RNA, 14 nt, Homo sapiens
aaucuaaacuuuau

SEQ ID NO: 850919 - RNA, 23 nt, Homo sapiens
aaucuaucacccaggaaucucaa

SEQ ID NO: 850920 - RNA, 13 nt, Homo sapiens
aaucugacuuuag

SEQ ID NO: 850921 - RNA, 16 nt, Homo sapiens
aaucugcugcauuuca

SEQ ID NO: 850922 - RNA, 22 nt, Homo sapiens
aaucuggaccccaucugugaau

SEQ ID NO: 850923 - RNA, 13 nt, Homo sapiens
aaucuuacuuugu

SEQ ID NO: 850924 - RNA, 15 nt, Homo sapiens
aaugaacaaagacca

SEQ ID NO: 850925 - RNA, 16 nt, Homo sapiens
aaugaacaagcauucu

SEQ ID NO: 850926 - RNA, 17 nt, Homo sapiens
aaugaauaaacaguuau

SEQ ID NO: 850927 - RNA, 19 nt, Homo sapiens
aaugaauuuacagaacagu

SEQ ID NO: 850928 - RNA, 23 nt, Homo sapiens
aaugacuuuuugaaaguaaaagc

SEQ ID NO: 850929 - RNA, 17 nt, Homo sapiens
aaugcaagggucucaca

SEQ ID NO: 850930 - RNA, 17 nt, Homo sapiens
aaugcccccugagugac

SEQ ID NO: 850931 - RNA, 20 nt, Homo sapiens
aaugcccccugagugacugc

SEQ ID NO: 850932 - RNA, 23 nt, Homo sapiens
aaugcugagauccucauuuaugu

SEQ ID NO: 850933 - RNA, 15 nt, Homo sapiens
aauggaauacugaaa

SEQ ID NO: 850934 - RNA, 20 nt, Homo sapiens
aauggaauuucucaguagca

SEQ ID NO: 850935 - RNA, 19 nt, Homo sapiens
aauggaguuaaacuuuagu

SEQ ID NO: 850936 - RNA, 20 nt, Homo sapiens
aauggcucagggauucagcc

SEQ ID NO: 850937 - RNA, 21 nt, Homo sapiens
aauggcugaagugcauggguc

SEQ ID NO: 850938 - RNA, 18 nt, Homo sapiens
aaugggagaucuucucag

SEQ ID NO: 850939 - RNA, 18 nt, Homo sapiens
aaugggucucucuugccc

SEQ ID NO: 850940 - RNA, 21 nt, Homo sapiens
aaugggucucucuugccccac

SEQ ID NO: 850941 - RNA, 23 nt, Homo sapiens
aauguaacuuugguuaaaaucuc

SEQ ID NO: 850942 - RNA, 18 nt, Homo sapiens
aaugugauauaaacagcu

SEQ ID NO: 850943 - RNA, 19 nt, Homo sapiens
aaugugauauaaacagcuu

SEQ ID NO: 850944 - RNA, 21 nt, Homo sapiens
aauguuauagcugcauuuguc

SEQ ID NO: 850945 - RNA, 15 nt, Homo sapiens
aauuaaaacuuugua

SEQ ID NO: 850946 - RNA, 15 nt, Homo sapiens
aauuaaggcaucauc

SEQ ID NO: 850947 - RNA, 15 nt, Homo sapiens
aauucaaauauucuu

SEQ ID NO: 850948 - RNA, 17 nt, Homo sapiens
aauucaccacagacuuu

SEQ ID NO: 850949 - RNA, 21 nt, Homo sapiens
aauucagugaugugccuaaau

SEQ ID NO: 850950 - RNA, 23 nt, Homo sapiens
aauucauagugauagagugcagu

SEQ ID NO: 850951 - RNA, 13 nt, Homo sapiens
aauucguucucug

SEQ ID NO: 850952 - RNA, 19 nt, Homo sapiens
aauucuaugucuagcacau

SEQ ID NO: 850953 - RNA, 19 nt, Homo sapiens
aauucuuagcauacauuca

SEQ ID NO: 850954 - RNA, 22 nt, Homo sapiens
aauugaugaaaugcaaaaggaa

SEQ ID NO: 850955 - RNA, 17 nt, Homo sapiens
aauugcuugacccaggu

SEQ ID NO: 850956 - RNA, 14 nt, Homo sapiens
aauuguacuuugaa

SEQ ID NO: 850957 - RNA, 23 nt, Homo sapiens
aauugucuuaauggaugaaauca

SEQ ID NO: 850958 - RNA, 17 nt, Homo sapiens
aauuuaaacguauaaua

SEQ ID NO: 850959 - RNA, 20 nt, Homo sapiens
aauuuacuuuggaaaguaga

SEQ ID NO: 850960 - RNA, 16 nt, Homo sapiens
aauuuguuguuccuuu

SEQ ID NO: 850961 - RNA, 18 nt, Homo sapiens
aauuuucgaaaacuuccc

SEQ ID NO: 850962 - RNA, 17 nt, Homo sapiens
aauuuuguaauguauca

SEQ ID NO: 850963 - RNA, 13 nt, Homo sapiens
acaaacagauucu

SEQ ID NO: 850964 - RNA, 23 nt, Homo sapiens
acaaagcauucuaaaugaacuca

SEQ ID NO: 850965 - RNA, 18 nt, Homo sapiens
acaaaggagcauugcagu

SEQ ID NO: 850966 - RNA, 13 nt, Homo sapiens
acaacaauguguu

SEQ ID NO: 850967 - RNA, 14 nt, Homo sapiens
acaaccaaaugugc

SEQ ID NO: 850968 - RNA, 18 nt, Homo sapiens
acaagaaagucaauguca

SEQ ID NO: 850969 - RNA, 19 nt, Homo sapiens
acaagaaucuaaacuuuau

SEQ ID NO: 850970 - RNA, 18 nt, Homo sapiens
acaagagacugcuugaca

SEQ ID NO: 850971 - RNA, 21 nt, Homo sapiens
acaagcacuguggaacugcua

SEQ ID NO: 850972 - RNA, 22 nt, Homo sapiens
acaaggaaggugaugugugagu

SEQ ID NO: 850973 - RNA, 22 nt, Homo sapiens
acaagguaaggagggucacugg

SEQ ID NO: 850974 - RNA, 18 nt, Homo sapiens
acaaugacuuuauugcau

SEQ ID NO: 850975 - RNA, 11 nt, Homo sapiens
acaauggugcu

SEQ ID NO: 850976 - RNA, 21 nt, Homo sapiens
aaggcaaaaaaggaugcaaca

SEQ ID NO: 850977 - RNA, 15 nt, Homo sapiens
aaggcagauccucuc

SEQ ID NO: 850978 - RNA, 20 nt, Homo sapiens
aaggcagggcaagaacagaa

SEQ ID NO: 850979 - RNA, 15 nt, Homo sapiens
aaggccuccaaagca

SEQ ID NO: 850980 - RNA, 18 nt, Homo sapiens
aaggcugucucagauaaa

SEQ ID NO: 850981 - RNA, 22 nt, Homo sapiens
aagggaacaaguugagcuauga

SEQ ID NO: 850982 - RNA, 13 nt, Homo sapiens
aagggaagcagaa

SEQ ID NO: 850983 - RNA, 22 nt, Homo sapiens
aagggaguaaguagagguggcu

SEQ ID NO: 850984 - RNA, 15 nt, Homo sapiens
aagguggaaggcagu

SEQ ID NO: 850985 - RNA, 20 nt, Homo sapiens
aaggugugccuggcagccau

SEQ ID NO: 850986 - RNA, 13 nt, Homo sapiens
aaguacuccuuaa

SEQ ID NO: 850987 - RNA, 18 nt, Homo sapiens
aaguacuuuccaaucuca

SEQ ID NO: 850988 - RNA, 22 nt, Homo sapiens
aaguacuuuccaaucucaguca

SEQ ID NO: 850989 - RNA, 15 nt, Homo sapiens
aaguagaacuuugua

SEQ ID NO: 850990 - RNA, 14 nt, Homo sapiens
aaguagcacaggcu

SEQ ID NO: 850991 - RNA, 20 nt, Homo sapiens
aaguauuuacugacugcuua

SEQ ID NO: 850992 - RNA, 16 nt, Homo sapiens
aagucaaugucaauga

SEQ ID NO: 850993 - RNA, 17 nt, Homo sapiens
aagugaguguaauccag

SEQ ID NO: 850994 - RNA, 20 nt, Homo sapiens
aagugcugccccugccugug

SEQ ID NO: 850995 - RNA, 20 nt, Homo sapiens
aaguggacucucugacaaag

SEQ ID NO: 850996 - RNA, 16 nt, Homo sapiens
aaguuaaaagcacaaa

SEQ ID NO: 850997 - RNA, 19 nt, Homo sapiens
aaguugaccaaugaaauga

SEQ ID NO: 850998 - RNA, 20 nt, Homo sapiens
aauaaacuagauuacauuca

SEQ ID NO: 850999 - RNA, 18 nt, Homo sapiens
aauaaacuuacauauuua

SEQ ID NO: 851000 - RNA, 21 nt, Homo sapiens
aauaauaaagaauagcuuuaa

SEQ ID NO: 851001 - RNA, 20 nt, Homo sapiens
aauaauagcuagcuauuacu

SEQ ID NO: 851002 - RNA, 19 nt, Homo sapiens
aauaauugaagagacaaua

SEQ ID NO: 851003 - RNA, 19 nt, Homo sapiens
aauacugaaccacuuguag

SEQ ID NO: 851004 - RNA, 12 nt, Homo sapiens
aauacuguacaa

SEQ ID NO: 851005 - RNA, 16 nt, Homo sapiens
aauacuguguaccuca

SEQ ID NO: 851006 - RNA, 13 nt, Homo sapiens
aauagaauacccu

SEQ ID NO: 851007 - RNA, 15 nt, Homo sapiens
aauagcaauauucuu

SEQ ID NO: 851008 - RNA, 21 nt, Homo sapiens
aauagcccaggauauauuuua

SEQ ID NO: 851009 - RNA, 18 nt, Homo sapiens
aauaguauccagcacaga

SEQ ID NO: 851010 - RNA, 16 nt, Homo sapiens
aauauagcaguagucu

SEQ ID NO: 851011 - RNA, 14 nt, Homo sapiens
aauauauccacaca

SEQ ID NO: 851012 - RNA, 14 nt, Homo sapiens
aauauguguaucuc

SEQ ID NO: 851013 - RNA, 14 nt, Homo sapiens
aauauguuuuauuc

SEQ ID NO: 851014 - RNA, 18 nt, Homo sapiens
aauauuuaagcaauaaaa

SEQ ID NO: 851015 - RNA, 17 nt, Homo sapiens
aauauuugucauaugaa

SEQ ID NO: 851016 - RNA, 18 nt, Homo sapiens
aauauuuuuaacaaguca

SEQ ID NO: 851017 - RNA, 19 nt, Homo sapiens
aauauuuuuaacaagucau

SEQ ID NO: 851018 - RNA, 21 nt, Homo sapiens
aaucaagaggacaaucuagcu

SEQ ID NO: 851019 - RNA, 13 nt, Homo sapiens
aaucaguguuacc

SEQ ID NO: 851020 - RNA, 21 nt, Homo sapiens
aauccaaaaggucuuuuuaca

SEQ ID NO: 851021 - RNA, 14 nt, Homo sapiens
aauccagugaaaau

SEQ ID NO: 851022 - RNA, 13 nt, Homo sapiens
aaucccagcacuu

SEQ ID NO: 851023 - RNA, 17 nt, Homo sapiens
aauccgaaaucagcagg

SEQ ID NO: 851024 - RNA, 18 nt, Homo sapiens
aaucuaaaaauugaacua

SEQ ID NO: 851025 - RNA, 13 nt, Homo sapiens
aaucuaaacauaa

SEQ ID NO: 851026 - RNA, 19 nt, Homo sapiens
aaucuaaacuuuauuccaa

SEQ ID NO: 851027 - RNA, 17 nt, Homo sapiens
aaucuaucacccaggaa

SEQ ID NO: 851028 - RNA, 13 nt, Homo sapiens
aaucuaucacuuu

SEQ ID NO: 851029 - RNA, 20 nt, Homo sapiens
aaucugaauuggaaugcacu

SEQ ID NO: 851030 - RNA, 22 nt, Homo sapiens
aaucugacuuuagccuaccuaa

SEQ ID NO: 851031 - RNA, 17 nt, Homo sapiens
aaucugauaccaaagag

SEQ ID NO: 851032 - RNA, 21 nt, Homo sapiens
aaucuguacaucucuacuuau

SEQ ID NO: 851033 - RNA, 14 nt, Homo sapiens
aaucuuacuuugua

SEQ ID NO: 851034 - RNA, 17 nt, Homo sapiens
aaugagggaguccaguc

SEQ ID NO: 851035 - RNA, 23 nt, Homo sapiens
aaugauauccaauauuaaaagau

SEQ ID NO: 851036 - RNA, 15 nt, Homo sapiens
aaugaucauugcaug

SEQ ID NO: 851037 - RNA, 23 nt, Homo sapiens
aaugcaaccauuuuuaggaagcu

SEQ ID NO: 851038 - RNA, 16 nt, Homo sapiens
aaugcacucagacugu

SEQ ID NO: 851039 - RNA, 18 nt, Homo sapiens
aaugcacucagacuguau

SEQ ID NO: 851040 - RNA, 10 nt, Homo sapiens
aaugcaguuu

SEQ ID NO: 851041 - RNA, 21 nt, Homo sapiens
aaugcgaggaaaugucuuuag

SEQ ID NO: 851042 - RNA, 17 nt, Homo sapiens
aaugcuaaucuugugaa

SEQ ID NO: 851043 - RNA, 21 nt, Homo sapiens
aaugcuggagaaaaauaucug

SEQ ID NO: 851044 - RNA, 22 nt, Homo sapiens
aauggagaauuaaaacuuugua

SEQ ID NO: 851045 - RNA, 18 nt, Homo sapiens
aauggaggaauccuugac

SEQ ID NO: 851046 - RNA, 18 nt, Homo sapiens
aaugggcuuugcugcuua

SEQ ID NO: 851047 - RNA, 16 nt, Homo sapiens
aauggggaggacaaaa

SEQ ID NO: 851048 - RNA, 23 nt, Homo sapiens
aaugguaaagaaauacacaggga

SEQ ID NO: 851049 - RNA, 17 nt, Homo sapiens
aaugguuucacaugguu

SEQ ID NO: 851050 - RNA, 17 nt, Homo sapiens
aauguacagauaugcaa

SEQ ID NO: 851051 - RNA, 15 nt, Homo sapiens
aauguauacuugaaa

SEQ ID NO: 851052 - RNA, 17 nt, Homo sapiens
aauguaucaaauacauu

SEQ ID NO: 851053 - RNA, 20 nt, Homo sapiens
aaugucaaugaacaagcauu

SEQ ID NO: 851054 - RNA, 22 nt, Homo sapiens
aauguugaaugucuuuggcuca

SEQ ID NO: 851055 - RNA, 22 nt, Homo sapiens
aauguugucaagaccaaaagca

SEQ ID NO: 851056 - RNA, 19 nt, Homo sapiens
aauuaaaggguuaaugugu

SEQ ID NO: 851057 - RNA, 14 nt, Homo sapiens
aauuacccuuuugu

SEQ ID NO: 851058 - RNA, 16 nt, Homo sapiens
aauuacguacuaagga

SEQ ID NO: 851059 - RNA, 19 nt, Homo sapiens
aauuagucucaguucucuu

SEQ ID NO: 851060 - RNA, 20 nt, Homo sapiens
aauuaguucccauucuuuca

SEQ ID NO: 851061 - RNA, 14 nt, Homo sapiens
aauuauacaaugau

SEQ ID NO: 851062 - RNA, 17 nt, Homo sapiens
aauuccauagcucaaua

SEQ ID NO: 851063 - RNA, 19 nt, Homo sapiens
aauucccaaauguauucua

SEQ ID NO: 851064 - RNA, 17 nt, Homo sapiens
aauucguucucugccac

SEQ ID NO: 851065 - RNA, 19 nt, Homo sapiens
aauucuaugccugucuuaa

SEQ ID NO: 851066 - RNA, 21 nt, Homo sapiens
aauugccauggcccugagcca

SEQ ID NO: 851067 - RNA, 13 nt, Homo sapiens
aauugugaugcuc

SEQ ID NO: 851068 - RNA, 14 nt, Homo sapiens
aauuuaaagacaaa

SEQ ID NO: 851069 - RNA, 18 nt, Homo sapiens
aauuuacugugacuuuau

SEQ ID NO: 851070 - RNA, 17 nt, Homo sapiens
aauuuacuuguauuccu

SEQ ID NO: 851071 - RNA, 23 nt, Homo sapiens
aauuugcucauaugaacuuucau

SEQ ID NO: 851072 - RNA, 17 nt, Homo sapiens
aauuuucuagauauuau

SEQ ID NO: 851073 - RNA, 21 nt, Homo sapiens
aauuuugguuuucuacuguua

SEQ ID NO: 851074 - RNA, 17 nt, Homo sapiens
acaaaaugagcucuccu

SEQ ID NO: 851075 - RNA, 18 nt, Homo sapiens
acaaaauuaaacuucaaa

SEQ ID NO: 851076 - RNA, 22 nt, Homo sapiens
acaaacucuuuccuucaaagag

SEQ ID NO: 851077 - RNA, 12 nt, Homo sapiens
acaaaguuugcu

SEQ ID NO: 851078 - RNA, 16 nt, Homo sapiens
acaaauacauuccuuu

SEQ ID NO: 851079 - RNA, 20 nt, Homo sapiens
acaaauauaaaacuauaagu

SEQ ID NO: 851080 - RNA, 17 nt, Homo sapiens
acaaaugcaucuuugau

SEQ ID NO: 851081 - RNA, 16 nt, Homo sapiens
acaaauuacguacuaa

SEQ ID NO: 851082 - RNA, 14 nt, Homo sapiens
acaaauugaguuua

SEQ ID NO: 851083 - RNA, 23 nt, Homo sapiens
acaacuuaugacuaaaaauauca

SEQ ID NO: 851084 - RNA, 19 nt, Homo sapiens
acaagagacugcuugacaa

SEQ ID NO: 851085 - RNA, 22 nt, Homo sapiens
acaagcacuguggaacugcuau

SEQ ID NO: 851086 - RNA, 21 nt, Homo sapiens
acaagcauucucuccauuuca

SEQ ID NO: 851087 - RNA, 18 nt, Homo sapiens
acaaguagccaccugagu

SEQ ID NO: 851088 - RNA, 17 nt, Homo sapiens
acaaguggcucaucauc

SEQ ID NO: 851089 - RNA, 14 nt, Homo sapiens
acaauaaagcaaua

SEQ ID NO: 851090 - RNA, 15 nt, Homo sapiens
acaauauaagagcuu

SEQ ID NO: 851091 - RNA, 18 nt, Homo sapiens
acaauuucuuuugguuca

SEQ ID NO: 851092 - RNA, 23 nt, Homo sapiens
acacaucucccuuuuccaugacu

SEQ ID NO: 851093 - RNA, 20 nt, Homo sapiens
acacaugcuccgucugacaa

SEQ ID NO: 851094 - RNA, 18 nt, Homo sapiens
acaccucaugcuagccuc

SEQ ID NO: 851095 - RNA, 23 nt, Homo sapiens
acacuucaguuaucuugaucucc

SEQ ID NO: 851096 - RNA, 15 nt, Homo sapiens
ucuaguugucaauaa

SEQ ID NO: 851097 - RNA, 13 nt, Homo sapiens
ucuauaaauaacc

SEQ ID NO: 851098 - RNA, 17 nt, Homo sapiens
ucuauagaaaugaucau

SEQ ID NO: 851099 - RNA, 17 nt, Homo sapiens
ucuaucccagaguacaa

SEQ ID NO: 851100 - RNA, 11 nt, Homo sapiens
ucuauuuagau

SEQ ID NO: 851101 - RNA, 13 nt, Homo sapiens
ucucaagcuugcu

SEQ ID NO: 851102 - RNA, 13 nt, Homo sapiens
ucucacucucuuc

SEQ ID NO: 851103 - RNA, 17 nt, Homo sapiens
ucucagagaucuugcau

SEQ ID NO: 851104 - RNA, 20 nt, Homo sapiens
ucucaggaaaugcugaccca

SEQ ID NO: 851105 - RNA, 20 nt, Homo sapiens
ucucagucacucuaggacuc

SEQ ID NO: 851106 - RNA, 14 nt, Homo sapiens
ucuccucagaagaa

SEQ ID NO: 851107 - RNA, 17 nt, Homo sapiens
ucucgaggcagcagugg

SEQ ID NO: 851108 - RNA, 12 nt, Homo sapiens
ucucguacuuga

SEQ ID NO: 851109 - RNA, 14 nt, Homo sapiens
ucucguacuugaac

SEQ ID NO: 851110 - RNA, 21 nt, Homo sapiens
ucucucagagaucuugcauuu

SEQ ID NO: 851111 - RNA, 14 nt, Homo sapiens
ucucuccuaucugu

SEQ ID NO: 851112 - RNA, 16 nt, Homo sapiens
ucucucguacucucuc

SEQ ID NO: 851113 - RNA, 12 nt, Homo sapiens
ucucucucguuc

SEQ ID NO: 851114 - RNA, 14 nt, Homo sapiens
ucucucuugcccca

SEQ ID NO: 851115 - RNA, 14 nt, Homo sapiens
ucucugacaaagug

SEQ ID NO: 851116 - RNA, 17 nt, Homo sapiens
ucucuggcccugagaau

SEQ ID NO: 851117 - RNA, 22 nt, Homo sapiens
ucucugggaugcagaacuuccc

SEQ ID NO: 851118 - RNA, 18 nt, Homo sapiens
ucucugucugauccuguc

SEQ ID NO: 851119 - RNA, 20 nt, Homo sapiens
ucugaaaagcuguguacuuu

SEQ ID NO: 851120 - RNA, 17 nt, Homo sapiens
ucugacuuugaauuuau

SEQ ID NO: 851121 - RNA, 16 nt, Homo sapiens
ucugacuuugccaaaa

SEQ ID NO: 851122 - RNA, 15 nt, Homo sapiens
ucugauaccaaagag

SEQ ID NO: 851123 - RNA, 13 nt, Homo sapiens
ucugcauauucua

SEQ ID NO: 851124 - RNA, 22 nt, Homo sapiens
ucugccagaagacucacugugu

SEQ ID NO: 851125 - RNA, 14 nt, Homo sapiens
ucuggaacugcugc

SEQ ID NO: 851126 - RNA, 18 nt, Homo sapiens
ucuggaauggcucaggga

SEQ ID NO: 851127 - RNA, 17 nt, Homo sapiens
ucuggaccccaucugug

SEQ ID NO: 851128 - RNA, 19 nt, Homo sapiens
ucuggaccccaucugugaa

SEQ ID NO: 851129 - RNA, 22 nt, Homo sapiens
ucuggagggcuggucauucaca

SEQ ID NO: 851130 - RNA, 20 nt, Homo sapiens
ucuggauaccauuauauguu

SEQ ID NO: 851131 - RNA, 21 nt, Homo sapiens
ucuggauuuuauucaucauau

SEQ ID NO: 851132 - RNA, 11 nt, Homo sapiens
ucuggcccacu

SEQ ID NO: 851133 - RNA, 15 nt, Homo sapiens
ucuggcccagugaau

SEQ ID NO: 851134 - RNA, 18 nt, Homo sapiens
ucuggggaccagcuuggc

SEQ ID NO: 851135 - RNA, 14 nt, Homo sapiens
ucuggucuuugguu

SEQ ID NO: 851136 - RNA, 20 nt, Homo sapiens
ucugucuucuccagaaggca

SEQ ID NO: 851137 - RNA, 14 nt, Homo sapiens
ucugugcaggguau

SEQ ID NO: 851138 - RNA, 20 nt, Homo sapiens
ucuguguaccacugggauag

SEQ ID NO: 851139 - RNA, 14 nt, Homo sapiens
ucuguuauuguuga

SEQ ID NO: 851140 - RNA, 13 nt, Homo sapiens
ucuuacacacugg

SEQ ID NO: 851141 - RNA, 13 nt, Homo sapiens
ucuucgcagccua

SEQ ID NO: 851142 - RNA, 20 nt, Homo sapiens
ucuugccaaaaagcacaaga

SEQ ID NO: 851143 - RNA, 18 nt, Homo sapiens
ucuuguaaacauugccug

SEQ ID NO: 851144 - RNA, 12 nt, Homo sapiens
ucuuuaauacuu

SEQ ID NO: 851145 - RNA, 19 nt, Homo sapiens
ucuuuauugcuuacugugu

SEQ ID NO: 851146 - RNA, 19 nt, Homo sapiens
ucuuucuaagagaccugaa

SEQ ID NO: 851147 - RNA, 18 nt, Homo sapiens
ucuuucucucucacucuc

SEQ ID NO: 851148 - RNA, 15 nt, Homo sapiens
ucuuucucugaggac

SEQ ID NO: 851149 - RNA, 16 nt, Homo sapiens
ucuuuggccagaacac

SEQ ID NO: 851150 - RNA, 18 nt, Homo sapiens
ugaaaaacaaaaauaaca

SEQ ID NO: 851151 - RNA, 14 nt, Homo sapiens
ugaaaacauggaac

SEQ ID NO: 851152 - RNA, 13 nt, Homo sapiens
ugaaaacuuugua

SEQ ID NO: 851153 - RNA, 18 nt, Homo sapiens
ugaaaagaauagaagcua

SEQ ID NO: 851154 - RNA, 11 nt, Homo sapiens
ugaaaauaacu

SEQ ID NO: 851155 - RNA, 16 nt, Homo sapiens
ugaaaaugaacuguaa

SEQ ID NO: 851156 - RNA, 22 nt, Homo sapiens
ugaaaccgaagggacuggaucu

SEQ ID NO: 851157 - RNA, 17 nt, Homo sapiens
ugaaacuccagaugcca

SEQ ID NO: 851158 - RNA, 19 nt, Homo sapiens
ugaaagagaagcacuaaga

SEQ ID NO: 851159 - RNA, 14 nt, Homo sapiens
ugaaagaggccaaa

SEQ ID NO: 851160 - RNA, 14 nt, Homo sapiens
ugaaagauauguau

SEQ ID NO: 851161 - RNA, 17 nt, Homo sapiens
ugaaagggaacaaggaa

SEQ ID NO: 851162 - RNA, 18 nt, Homo sapiens
ugaaaguaaaagcagcau

SEQ ID NO: 851163 - RNA, 17 nt, Homo sapiens
ugaaaguauguuuuacu

SEQ ID NO: 851164 - RNA, 15 nt, Homo sapiens
ugaaauaaagcacau

SEQ ID NO: 851165 - RNA, 17 nt, Homo sapiens
ugaacagcuaauuguac

SEQ ID NO: 851166 - RNA, 22 nt, Homo sapiens
ugaacccagaaacaacacaauc

SEQ ID NO: 851167 - RNA, 16 nt, Homo sapiens
ugaacuguaaaugcuc

SEQ ID NO: 851168 - RNA, 21 nt, Homo sapiens
ugaacuuuuuaagaugaggca

SEQ ID NO: 851169 - RNA, 15 nt, Homo sapiens
ugaagaauucagauu

SEQ ID NO: 851170 - RNA, 22 nt, Homo sapiens
ugaaggcugggggcauuuugcu

SEQ ID NO: 851171 - RNA, 16 nt, Homo sapiens
ugaauaaaaacuuugc

SEQ ID NO: 851172 - RNA, 14 nt, Homo sapiens
ugaauaaagugcaa

SEQ ID NO: 851173 - RNA, 12 nt, Homo sapiens
ugaauacucuga

SEQ ID NO: 851174 - RNA, 23 nt, Homo sapiens
ugaaugaaaaaauaaacgaguga

SEQ ID NO: 851175 - RNA, 14 nt, Homo sapiens
ugaaugcgaggaaa

SEQ ID NO: 851176 - RNA, 20 nt, Homo sapiens
ugaaugucuuuggcucaguu

SEQ ID NO: 851177 - RNA, 18 nt, Homo sapiens
ugacaaaggagcauugca

SEQ ID NO: 851178 - RNA, 16 nt, Homo sapiens
ugacaugcauucacau

SEQ ID NO: 851179 - RNA, 19 nt, Homo sapiens
ugacaugcauucacauauc

SEQ ID NO: 851180 - RNA, 20 nt, Homo sapiens
ugacaugcauucacauaucu

SEQ ID NO: 851181 - RNA, 12 nt, Homo sapiens
ugaccucuaccu

SEQ ID NO: 851182 - RNA, 17 nt, Homo sapiens
ugacgagauaagcaguu

SEQ ID NO: 851183 - RNA, 13 nt, Homo sapiens
ugacgucugccac

SEQ ID NO: 851184 - RNA, 14 nt, Homo sapiens
ugacgucugccacc

SEQ ID NO: 851185 - RNA, 21 nt, Homo sapiens
ugacguuuuuccaguucacau

SEQ ID NO: 851186 - RNA, 21 nt, Homo sapiens
ugacuaaaaauaucacacuga

SEQ ID NO: 851187 - RNA, 19 nt, Homo sapiens
ugacuuaacauagccaaaa

SEQ ID NO: 851188 - RNA, 17 nt, Homo sapiens
ugacuuuauugcaucug

SEQ ID NO: 851189 - RNA, 14 nt, Homo sapiens
ugacuuugaauuua

SEQ ID NO: 851190 - RNA, 14 nt, Homo sapiens
ugacuuugccaaaa

SEQ ID NO: 851191 - RNA, 17 nt, Homo sapiens
ugagacagagaagggaa

SEQ ID NO: 851192 - RNA, 15 nt, Homo sapiens
ugagagccugugauc

SEQ ID NO: 851193 - RNA, 21 nt, Homo sapiens
ugagccaccuucccuccucau

SEQ ID NO: 851194 - RNA, 24 nt, Homo sapiens
ugaggaauauugcugcugguucuc

SEQ ID NO: 851195 - RNA, 20 nt, Homo sapiens
ugaggccacacccagaguag

SEQ ID NO: 851196 - RNA, 22 nt, Homo sapiens
ugagguuuuauacuucagguua

SEQ ID NO: 851197 - RNA, 14 nt, Homo sapiens
ugaguguauucuau

SEQ ID NO: 851198 - RNA, 21 nt, Homo sapiens
ugaguuccggcaccaguagca

SEQ ID NO: 851199 - RNA, 13 nt, Homo sapiens
ugauaguagauau

SEQ ID NO: 851200 - RNA, 15 nt, Homo sapiens
ugauaguagucuuua

SEQ ID NO: 851201 - RNA, 15 nt, Homo sapiens
ugauuacguuuacau

SEQ ID NO: 851202 - RNA, 15 nt, Homo sapiens
ugauuauauaagcaa

SEQ ID NO: 851203 - RNA, 17 nt, Homo sapiens
ugauuauauaagcaaaa

SEQ ID NO: 851204 - RNA, 17 nt, Homo sapiens
ugauugucuccucccag

SEQ ID NO: 851205 - RNA, 12 nt, Homo sapiens
ugcucacugcag

SEQ ID NO: 851206 - RNA, 20 nt, Homo sapiens
ugcucauaugaacuuucauu

SEQ ID NO: 851207 - RNA, 17 nt, Homo sapiens
ugcuccagaugguggga

SEQ ID NO: 851208 - RNA, 23 nt, Homo sapiens
ugcucucaaaccccugaccucaa

SEQ ID NO: 851209 - RNA, 15 nt, Homo sapiens
ugcucuggugucaau

SEQ ID NO: 851210 - RNA, 15 nt, Homo sapiens
ugcucuguuguaggg

SEQ ID NO: 851211 - RNA, 20 nt, Homo sapiens
ugcugaccccugugugacau

SEQ ID NO: 851212 - RNA, 14 nt, Homo sapiens
ugcugcauuucaca

SEQ ID NO: 851213 - RNA, 19 nt, Homo sapiens
ugcugcgcucggcccucaa

SEQ ID NO: 851214 - RNA, 18 nt, Homo sapiens
ugcuggagaaaaauaucu

SEQ ID NO: 851215 - RNA, 13 nt, Homo sapiens
ugcugguucucau

SEQ ID NO: 851216 - RNA, 13 nt, Homo sapiens
ugcuuaaauaucc

SEQ ID NO: 851217 - RNA, 13 nt, Homo sapiens
ugcuucucuccua

SEQ ID NO: 851218 - RNA, 23 nt, Homo sapiens
ugcuugacaaaggagcauugcag

SEQ ID NO: 851219 - RNA, 19 nt, Homo sapiens
ugcuugacaugguuuccaa

SEQ ID NO: 851220 - RNA, 22 nt, Homo sapiens
ugcuuguauuuuuuaaugcuaa

SEQ ID NO: 851221 - RNA, 21 nt, Homo sapiens
ugcuuuggucacuuuuagaug

SEQ ID NO: 851222 - RNA, 15 nt, Homo sapiens
ugcuuuuucucagcc

SEQ ID NO: 851223 - RNA, 14 nt, Homo sapiens
uggaaacauucacu

SEQ ID NO: 851224 - RNA, 22 nt, Homo sapiens
uggaaacauucacuuuccugca

SEQ ID NO: 851225 - RNA, 23 nt, Homo sapiens
uggaaaggccagcagccuuccag

SEQ ID NO: 851226 - RNA, 18 nt, Homo sapiens
uggaaaguagaaaagccc

SEQ ID NO: 851227 - RNA, 19 nt, Homo sapiens
uggaacucuugacagcuau

SEQ ID NO: 851228 - RNA, 16 nt, Homo sapiens
uggaagacuucuaaag

SEQ ID NO: 851229 - RNA, 23 nt, Homo sapiens
uggaauaaaaauuccagaaugaa

SEQ ID NO: 851230 - RNA, 16 nt, Homo sapiens
uggacaagaaagucaa

SEQ ID NO: 851231 - RNA, 21 nt, Homo sapiens
uggaccaugcugucuggcaca

SEQ ID NO: 851232 - RNA, 14 nt, Homo sapiens
uggaccccaucugu

SEQ ID NO: 851233 - RNA, 19 nt, Homo sapiens
uggacgcucugcaccaacc

SEQ ID NO: 851234 - RNA, 16 nt, Homo sapiens
uggacucugagcucau

SEQ ID NO: 851235 - RNA, 16 nt, Homo sapiens
uggagaagaggaagac

SEQ ID NO: 851236 - RNA, 17 nt, Homo sapiens
uggagagaaagugacau

SEQ ID NO: 851237 - RNA, 18 nt, Homo sapiens
uggagcaauaaaagacaa

SEQ ID NO: 851238 - RNA, 16 nt, Homo sapiens
uggagcuaaaacuggc

SEQ ID NO: 851239 - RNA, 22 nt, Homo sapiens
uggagcuaaaacuggcccuguu

SEQ ID NO: 851240 - RNA, 11 nt, Homo sapiens
uggagcucaag

SEQ ID NO: 851241 - RNA, 17 nt, Homo sapiens
uggaggcagggguucca

SEQ ID NO: 851242 - RNA, 20 nt, Homo sapiens
uggauaauucuuuuacauau

SEQ ID NO: 851243 - RNA, 15 nt, Homo sapiens
uggaugcagcaauaa

SEQ ID NO: 851244 - RNA, 16 nt, Homo sapiens
uggauuaaaaccuuaa

SEQ ID NO: 851245 - RNA, 17 nt, Homo sapiens
uggauucagaaccaaga

SEQ ID NO: 851246 - RNA, 17 nt, Homo sapiens
uggcaaacagaauguuc

SEQ ID NO: 851247 - RNA, 20 nt, Homo sapiens
uggcaguugcuuccuccuga

SEQ ID NO: 851248 - RNA, 21 nt, Homo sapiens
uggcauaguggcuuaacugga

SEQ ID NO: 851249 - RNA, 16 nt, Homo sapiens
uggcauggagaaugca

SEQ ID NO: 851250 - RNA, 24 nt, Homo sapiens
uggcauggagaaugcaccauacuc

SEQ ID NO: 851251 - RNA, 18 nt, Homo sapiens
uggccaggaaguagcaca

SEQ ID NO: 851252 - RNA, 13 nt, Homo sapiens
uggccccuucuau

SEQ ID NO: 851253 - RNA, 23 nt, Homo sapiens
uggccucugcaaaggaaauacca

SEQ ID NO: 851254 - RNA, 15 nt, Homo sapiens
uggccucugccuuug

SEQ ID NO: 851255 - RNA, 20 nt, Homo sapiens
uggccuuaaggaaaucuuua

SEQ ID NO: 851256 - RNA, 22 nt, Homo sapiens
uggcucccucacucucaggaaa

SEQ ID NO: 851257 - RNA, 18 nt, Homo sapiens
uggcugguaaauugccau

SEQ ID NO: 851258 - RNA, 16 nt, Homo sapiens
uggcugucucucagag

SEQ ID NO: 851259 - RNA, 21 nt, Homo sapiens
uggcuguuguauuaccaaagc

SEQ ID NO: 851260 - RNA, 18 nt, Homo sapiens
ugggaaagaaccacacag

SEQ ID NO: 851261 - RNA, 21 nt, Homo sapiens
ugggacccuagcuauaugcau

SEQ ID NO: 851262 - RNA, 16 nt, Homo sapiens
ugggacugcugugaac

SEQ ID NO: 851263 - RNA, 17 nt, Homo sapiens
ugggaggggaaauggga

SEQ ID NO: 851264 - RNA, 14 nt, Homo sapiens
ugggaucucgccaa

SEQ ID NO: 851265 - RNA, 19 nt, Homo sapiens
ugggauucuagaacuguga

SEQ ID NO: 851266 - RNA, 13 nt, Homo sapiens
ugggcaagcagac

SEQ ID NO: 851267 - RNA, 20 nt, Homo sapiens
ugggcaauuuuuguauccaa

SEQ ID NO: 851268 - RNA, 14 nt, Homo sapiens
ugggccacacaagu

SEQ ID NO: 851269 - RNA, 22 nt, Homo sapiens
ugggcuguuacuugcuuugagu

SEQ ID NO: 851270 - RNA, 21 nt, Homo sapiens
uggggagaggugugugacguu

SEQ ID NO: 851271 - RNA, 11 nt, Homo sapiens
uggggcccaag

SEQ ID NO: 851272 - RNA, 17 nt, Homo sapiens
ugggugggcacacugaa

SEQ ID NO: 851273 - RNA, 23 nt, Homo sapiens
uggguucauuugugaugacauaa

SEQ ID NO: 851274 - RNA, 17 nt, Homo sapiens
ugguaaaguauuuacug

SEQ ID NO: 851275 - RNA, 16 nt, Homo sapiens
uggucaaaaucugcaa

SEQ ID NO: 851276 - RNA, 17 nt, Homo sapiens
uggucaaaaucugcaaa

SEQ ID NO: 851277 - RNA, 23 nt, Homo sapiens
uggucaaaaucugcaaacucuaa

SEQ ID NO: 851278 - RNA, 17 nt, Homo sapiens
uggucagaggggagcaa

SEQ ID NO: 851279 - RNA, 17 nt, Homo sapiens
uggucuggguuuggcag

SEQ ID NO: 851280 - RNA, 23 nt, Homo sapiens
uggucuuagagggugauggaaca

SEQ ID NO: 851281 - RNA, 17 nt, Homo sapiens
uggucuucgcagccuag

SEQ ID NO: 851282 - RNA, 19 nt, Homo sapiens
uggucuucgcagccuagau

SEQ ID NO: 851283 - RNA, 12 nt, Homo sapiens
uggugcaucuca

SEQ ID NO: 851284 - RNA, 17 nt, Homo sapiens
ugguuaauuuugcauau

SEQ ID NO: 851285 - RNA, 21 nt, Homo sapiens
ugguuacauaucaaaacaucc

SEQ ID NO: 851286 - RNA, 13 nt, Homo sapiens
ugguuccaugccu

SEQ ID NO: 851287 - RNA, 17 nt, Homo sapiens
uguaaacauuucuugua

SEQ ID NO: 851288 - RNA, 23 nt, Homo sapiens
uguaaagauguucuggauaccau

SEQ ID NO: 851289 - RNA, 16 nt, Homo sapiens
uguaaaucuaaacaua

SEQ ID NO: 851290 - RNA, 21 nt, Homo sapiens
uguaaauugagauuuaauucc

SEQ ID NO: 851291 - RNA, 17 nt, Homo sapiens
uguaaauuguauucuca

SEQ ID NO: 851292 - RNA, 22 nt, Homo sapiens
uguaagaaauacagacuggaug

SEQ ID NO: 851293 - RNA, 22 nt, Homo sapiens
uguaagaugucuuccuaucaaa

SEQ ID NO: 851294 - RNA, 17 nt, Homo sapiens
uguaagguacuuucaua

SEQ ID NO: 851295 - RNA, 19 nt, Homo sapiens
uguaauuguuguuuguaug

SEQ ID NO: 851296 - RNA, 16 nt, Homo sapiens
uguacagauaugcaaa

SEQ ID NO: 851297 - RNA, 19 nt, Homo sapiens
uguaccucauggaugcuuu

SEQ ID NO: 851298 - RNA, 17 nt, Homo sapiens
uguacuuuguuaaaaac

SEQ ID NO: 851299 - RNA, 17 nt, Homo sapiens
uguagacggaacagugu

SEQ ID NO: 851300 - RNA, 17 nt, Homo sapiens
uguaggagaaagagccu

SEQ ID NO: 851301 - RNA, 18 nt, Homo sapiens
uguaguccuaugcaauaa

SEQ ID NO: 851302 - RNA, 17 nt, Homo sapiens
uguaguuggaaagcaaa

SEQ ID NO: 851303 - RNA, 15 nt, Homo sapiens
ugucacccugaggaa

SEQ ID NO: 851304 - RNA, 18 nt, Homo sapiens
uguccaaguuguuucauu

SEQ ID NO: 851305 - RNA, 19 nt, Homo sapiens
uguccacuuggagcuaaaa

SEQ ID NO: 851306 - RNA, 22 nt, Homo sapiens
ugucccaggcagcgccacuguc

SEQ ID NO: 851307 - RNA, 23 nt, Homo sapiens
uguccuauuaguguuauaugaac

SEQ ID NO: 851308 - RNA, 19 nt, Homo sapiens
ugucucugcgccugaguaa

SEQ ID NO: 851309 - RNA, 14 nt, Homo sapiens
ugucuguuggucaa

SEQ ID NO: 851310 - RNA, 19 nt, Homo sapiens
ccccugcacucuuauugga

SEQ ID NO: 851311 - RNA, 19 nt, Homo sapiens
ccccuuuucaguuucuuau

SEQ ID NO: 851312 - RNA, 16 nt, Homo sapiens
cccgagggugguuuac

SEQ ID NO: 851313 - RNA, 13 nt, Homo sapiens
cccuaucugcaaa

SEQ ID NO: 851314 - RNA, 19 nt, Homo sapiens
cccuccuugugcugccagu

SEQ ID NO: 851315 - RNA, 20 nt, Homo sapiens
cccucugcagauacacugcu

SEQ ID NO: 851316 - RNA, 16 nt, Homo sapiens
cccugcagcuggggaa

SEQ ID NO: 851317 - RNA, 20 nt, Homo sapiens
cccuggaagcagugcccagg

SEQ ID NO: 851318 - RNA, 12 nt, Homo sapiens
cccuggagcuca

SEQ ID NO: 851319 - RNA, 19 nt, Homo sapiens
cccuggguuagacugccag

SEQ ID NO: 851320 - RNA, 23 nt, Homo sapiens
cccugucuccucucuguuacuca

SEQ ID NO: 851321 - RNA, 15 nt, Homo sapiens
cccuuacauguccuc

SEQ ID NO: 851322 - RNA, 19 nt, Homo sapiens
cccuuuucaguuucuuauc

SEQ ID NO: 851323 - RNA, 14 nt, Homo sapiens
ccgaaagaggcacc

SEQ ID NO: 851324 - RNA, 14 nt, Homo sapiens
ccgaggacagccug

SEQ ID NO: 851325 - RNA, 19 nt, Homo sapiens
ccgcuagguagagucugag

SEQ ID NO: 851326 - RNA, 12 nt, Homo sapiens
ccggacaugucu

SEQ ID NO: 851327 - RNA, 13 nt, Homo sapiens
ccggcuuugccau

SEQ ID NO: 851328 - RNA, 13 nt, Homo sapiens
ccgggcgcaggaa

SEQ ID NO: 851329 - RNA, 18 nt, Homo sapiens
ccguacgacucuuuucca

SEQ ID NO: 851330 - RNA, 12 nt, Homo sapiens
ccguagcuucua

SEQ ID NO: 851331 - RNA, 13 nt, Homo sapiens
ccuaaaacaguag

SEQ ID NO: 851332 - RNA, 20 nt, Homo sapiens
ccuaaauaaauuauuuguua

SEQ ID NO: 851333 - RNA, 16 nt, Homo sapiens
ccuaaucuaucacuuu

SEQ ID NO: 851334 - RNA, 23 nt, Homo sapiens
ccuaggucagucuugcuggauuu

SEQ ID NO: 851335 - RNA, 17 nt, Homo sapiens
ccuauuuucaugauuuc

SEQ ID NO: 851336 - RNA, 22 nt, Homo sapiens
ccucacuuucccugauccugca

SEQ ID NO: 851337 - RNA, 22 nt, Homo sapiens
ccucagggcucugacucugcca

SEQ ID NO: 851338 - RNA, 20 nt, Homo sapiens
ccucaggugaaacuccagau

SEQ ID NO: 851339 - RNA, 18 nt, Homo sapiens
ccucauaggcuucuggga

SEQ ID NO: 851340 - RNA, 17 nt, Homo sapiens
ccuccaggcccagcuga

SEQ ID NO: 851341 - RNA, 18 nt, Homo sapiens
ccuccugaaccagcacua

SEQ ID NO: 851342 - RNA, 22 nt, Homo sapiens
ccuccuuuaccgaggacagccu

SEQ ID NO: 851343 - RNA, 16 nt, Homo sapiens
ccucucguacuugaac

SEQ ID NO: 851344 - RNA, 17 nt, Homo sapiens
ccucugcagauacacug

SEQ ID NO: 851345 - RNA, 16 nt, Homo sapiens
ccucuggcccagugaa

SEQ ID NO: 851346 - RNA, 16 nt, Homo sapiens
ccucuggcucuacaca

SEQ ID NO: 851347 - RNA, 19 nt, Homo sapiens
ccucuucuaccauuuccca

SEQ ID NO: 851348 - RNA, 12 nt, Homo sapiens
ccucuuugccuc

SEQ ID NO: 851349 - RNA, 19 nt, Homo sapiens
ccugaaccagggccagaua

SEQ ID NO: 851350 - RNA, 21 nt, Homo sapiens
ccugaacccagaaacaacaca

SEQ ID NO: 851351 - RNA, 13 nt, Homo sapiens
ccugaaucuauca

SEQ ID NO: 851352 - RNA, 19 nt, Homo sapiens
ccugaugggccaagggaag

SEQ ID NO: 851353 - RNA, 21 nt, Homo sapiens
ccugauuuguuccuucugggg

SEQ ID NO: 851354 - RNA, 17 nt, Homo sapiens
ccugcaccguugacuca

SEQ ID NO: 851355 - RNA, 22 nt, Homo sapiens
ccugccagcagcugccugggaa

SEQ ID NO: 851356 - RNA, 20 nt, Homo sapiens
ccugccgcauuuccuuucag

SEQ ID NO: 851357 - RNA, 14 nt, Homo sapiens
ccugcucaagucua

SEQ ID NO: 851358 - RNA, 12 nt, Homo sapiens
ccugcugaccau

SEQ ID NO: 851359 - RNA, 17 nt, Homo sapiens
ccuggaccccagccuca

SEQ ID NO: 851360 - RNA, 21 nt, Homo sapiens
ccuggcaaagcagcaacacac

SEQ ID NO: 851361 - RNA, 22 nt, Homo sapiens
ccuggcaggggauccagcucaa

SEQ ID NO: 851362 - RNA, 15 nt, Homo sapiens
ccuggccucagggcu

SEQ ID NO: 851363 - RNA, 22 nt, Homo sapiens
ccugggauucuagaacugugaa

SEQ ID NO: 851364 - RNA, 23 nt, Homo sapiens
ccuggucauacauaggaugacaa

SEQ ID NO: 851365 - RNA, 20 nt, Homo sapiens
ccugucgcacccacugugaa

SEQ ID NO: 851366 - RNA, 22 nt, Homo sapiens
ccugugaagaaaggaccugcaa

SEQ ID NO: 851367 - RNA, 18 nt, Homo sapiens
ccuuaaggaaaucuuuac

SEQ ID NO: 851368 - RNA, 17 nt, Homo sapiens
ccuuacucugagcucau

SEQ ID NO: 851369 - RNA, 23 nt, Homo sapiens
ccuuagaugugucuccuguuuca

SEQ ID NO: 851370 - RNA, 17 nt, Homo sapiens
ccuuauagagagcccaa

SEQ ID NO: 851371 - RNA, 18 nt, Homo sapiens
ccuucuggggcuuugcca

SEQ ID NO: 851372 - RNA, 21 nt, Homo sapiens
ccuucugguuacaauuuacag

SEQ ID NO: 851373 - RNA, 16 nt, Homo sapiens
ccuugaacccuaauaa

SEQ ID NO: 851374 - RNA, 11 nt, Homo sapiens
ccuugaagcuu

SEQ ID NO: 851375 - RNA, 14 nt, Homo sapiens
ccuugcccuuccag

SEQ ID NO: 851376 - RNA, 23 nt, Homo sapiens
ccuuucauugcuguugucucugc

SEQ ID NO: 851377 - RNA, 14 nt, Homo sapiens
ccuuucgacuugca

SEQ ID NO: 851378 - RNA, 18 nt, Homo sapiens
ccuuuuccaugacugugg

SEQ ID NO: 851379 - RNA, 21 nt, Homo sapiens
ccuuuucuuguaaacauugcc

SEQ ID NO: 851380 - RNA, 16 nt, Homo sapiens
cgaaugauuaaucaua

SEQ ID NO: 851381 - RNA, 14 nt, Homo sapiens
cgacuguuuuccca

SEQ ID NO: 851382 - RNA, 13 nt, Homo sapiens
cgagagucccugc

SEQ ID NO: 851383 - RNA, 23 nt, Homo sapiens
cgaggacagccugccucugccac

SEQ ID NO: 851384 - RNA, 20 nt, Homo sapiens
cgaggagcuagaacauucca

SEQ ID NO: 851385 - RNA, 18 nt, Homo sapiens
cgaguacuaauaugcaau

SEQ ID NO: 851386 - RNA, 16 nt, Homo sapiens
cgauucucuugccuca

SEQ ID NO: 851387 - RNA, 17 nt, Homo sapiens
cgcaagcaccauccccu

SEQ ID NO: 851388 - RNA, 11 nt, Homo sapiens
cgcaagggagg

SEQ ID NO: 851389 - RNA, 22 nt, Homo sapiens
cgcaccagcccagaagugcaga

SEQ ID NO: 851390 - RNA, 21 nt, Homo sapiens
cgcauuuccuuucaguggcuu

SEQ ID NO: 851391 - RNA, 18 nt, Homo sapiens
cgccaggacuuggccuca

SEQ ID NO: 851392 - RNA, 22 nt, Homo sapiens
cgcccagagaacaagcacugug

SEQ ID NO: 851393 - RNA, 20 nt, Homo sapiens
cggacuccucucguacuuga

SEQ ID NO: 851394 - RNA, 20 nt, Homo sapiens
cggaguuuccucgcauuaaa

SEQ ID NO: 851395 - RNA, 11 nt, Homo sapiens
cggcacccaca

SEQ ID NO: 851396 - RNA, 18 nt, Homo sapiens
cgggagggguggggagaa

SEQ ID NO: 851397 - RNA, 17 nt, Homo sapiens
cgggcccuggagcucaa

SEQ ID NO: 851398 - RNA, 12 nt, Homo sapiens
cgggucugucag

SEQ ID NO: 851399 - RNA, 17 nt, Homo sapiens
cgggucugucaggguug

SEQ ID NO: 851400 - RNA, 14 nt, Homo sapiens
cgguccagaaggag

SEQ ID NO: 851401 - RNA, 18 nt, Homo sapiens
cgguucaaaccugugaag

SEQ ID NO: 851402 - RNA, 20 nt, Homo sapiens
cgguugugagagccugugau

SEQ ID NO: 851403 - RNA, 18 nt, Homo sapiens
cguaguuacucucaggca

SEQ ID NO: 851404 - RNA, 19 nt, Homo sapiens
cgucugacaagguggucaa

SEQ ID NO: 851405 - RNA, 22 nt, Homo sapiens
cgugccugagucccaauuacau

SEQ ID NO: 851406 - RNA, 20 nt, Homo sapiens
cguggggcucccgccuccaa

SEQ ID NO: 851407 - RNA, 21 nt, Homo sapiens
cguuguguacagaauuuuucu

SEQ ID NO: 851408 - RNA, 15 nt, Homo sapiens
cguuuucuacuuuga

SEQ ID NO: 851409 - RNA, 19 nt, Homo sapiens
cuaaaccauucaccaagag

SEQ ID NO: 851410 - RNA, 20 nt, Homo sapiens
cuaaaccauucaccaagagc

SEQ ID NO: 851411 - RNA, 18 nt, Homo sapiens
cuaaagucuguugauuaa

SEQ ID NO: 851412 - RNA, 21 nt, Homo sapiens
cuaaauaaaagaagucaagca

SEQ ID NO: 851413 - RNA, 13 nt, Homo sapiens
cuaaaugaacuca

SEQ ID NO: 851414 - RNA, 15 nt, Homo sapiens
cuaacaguggacaaa

SEQ ID NO: 851415 - RNA, 20 nt, Homo sapiens
cuaaccauucuguauugauu

SEQ ID NO: 851416 - RNA, 15 nt, Homo sapiens
cuaacuggacauucu

SEQ ID NO: 851417 - RNA, 19 nt, Homo sapiens
cuaagaguagcaggaacuc

SEQ ID NO: 851418 - RNA, 21 nt, Homo sapiens
cuaagucaccuaaguacuuaa

SEQ ID NO: 851419 - RNA, 17 nt, Homo sapiens
cuaauauccacuugucc

SEQ ID NO: 851420 - RNA, 19 nt, Homo sapiens
cuaaugugaaaauguauuc

SEQ ID NO: 851421 - RNA, 20 nt, Homo sapiens
cuaaugugaaaauguauucu

SEQ ID NO: 851422 - RNA, 13 nt, Homo sapiens
cuacagaaaagaa

SEQ ID NO: 851423 - RNA, 17 nt, Homo sapiens
cuaccaggaagaaggac

SEQ ID NO: 851424 - RNA, 16 nt, Homo sapiens
cuaccugagcaacaag

SEQ ID NO: 851425 - RNA, 14 nt, Homo sapiens
cuacuuccaagacu

SEQ ID NO: 851426 - RNA, 14 nt, Homo sapiens
cuagaacauuccau

SEQ ID NO: 851427 - RNA, 16 nt, Homo sapiens
cuagacuagcuguaaa

SEQ ID NO: 851428 - RNA, 17 nt, Homo sapiens
cuagaggccuuuaguua

SEQ ID NO: 851429 - RNA, 15 nt, Homo sapiens
cuagcccuugcugcc

SEQ ID NO: 851430 - RNA, 13 nt, Homo sapiens
cuagcuauuacug

SEQ ID NO: 851431 - RNA, 20 nt, Homo sapiens
cuagcuauuacugcagacua

SEQ ID NO: 851432 - RNA, 19 nt, Homo sapiens
cuaggccuacaugcuuugu

SEQ ID NO: 851433 - RNA, 16 nt, Homo sapiens
cuagggcagggaaacc

SEQ ID NO: 851434 - RNA, 19 nt, Homo sapiens
cuagucaacaguacccugg

SEQ ID NO: 851435 - RNA, 23 nt, Homo sapiens
cuagucuggaacugcugcugacc

SEQ ID NO: 851436 - RNA, 20 nt, Homo sapiens
cuauagcaucacuuaaaaca

SEQ ID NO: 851437 - RNA, 22 nt, Homo sapiens
cuauagugucucgaguacuaau

SEQ ID NO: 851438 - RNA, 20 nt, Homo sapiens
uccuaucugugccucuucag

SEQ ID NO: 851439 - RNA, 17 nt, Homo sapiens
uccucaaugcauugacu

SEQ ID NO: 851440 - RNA, 15 nt, Homo sapiens
uccucccaccucacc

SEQ ID NO: 851441 - RNA, 16 nt, Homo sapiens
uccucucguacuugaa

SEQ ID NO: 851442 - RNA, 16 nt, Homo sapiens
uccugagagcccagaa

SEQ ID NO: 851443 - RNA, 15 nt, Homo sapiens
uccugucaucugaga

SEQ ID NO: 851444 - RNA, 18 nt, Homo sapiens
uccuuaucuaguguuuga

SEQ ID NO: 851445 - RNA, 15 nt, Homo sapiens
uccuucuauacaugu

SEQ ID NO: 851446 - RNA, 16 nt, Homo sapiens
uccuucuauacauguu

SEQ ID NO: 851447 - RNA, 19 nt, Homo sapiens
uccuugaagcuuguaucug

SEQ ID NO: 851448 - RNA, 18 nt, Homo sapiens
uccuuggguauccccaac

SEQ ID NO: 851449 - RNA, 20 nt, Homo sapiens
uccuuucaccccauccacau

SEQ ID NO: 851450 - RNA, 15 nt, Homo sapiens
uccuuucucaccagc

SEQ ID NO: 851451 - RNA, 12 nt, Homo sapiens
uccuuucuuuuc

SEQ ID NO: 851452 - RNA, 23 nt, Homo sapiens
uccuuugauagaaaggaauuuua

SEQ ID NO: 851453 - RNA, 14 nt, Homo sapiens
uccuuuuucuuucc

SEQ ID NO: 851454 - RNA, 14 nt, Homo sapiens
ucgcccuuugcuca

SEQ ID NO: 851455 - RNA, 15 nt, Homo sapiens
ucgcuaaagagugaa

SEQ ID NO: 851456 - RNA, 13 nt, Homo sapiens
ucguguacaagaa

SEQ ID NO: 851457 - RNA, 16 nt, Homo sapiens
ucguuaaaaacagauu

SEQ ID NO: 851458 - RNA, 22 nt, Homo sapiens
ucuaaaaaaauaaacaaaguga

SEQ ID NO: 851459 - RNA, 20 nt, Homo sapiens
ucuacccugaucaccucagg

SEQ ID NO: 851460 - RNA, 23 nt, Homo sapiens
ucuacccugaucaccucagggca

SEQ ID NO: 851461 - RNA, 15 nt, Homo sapiens
ucuagugcugugaaa

SEQ ID NO: 851462 - RNA, 14 nt, Homo sapiens
ucuaguugucaaua

SEQ ID NO: 851463 - RNA, 21 nt, Homo sapiens
acagaagugacugauguuccc

SEQ ID NO: 851464 - RNA, 19 nt, Homo sapiens
acagaauguucauacugau

SEQ ID NO: 851465 - RNA, 14 nt, Homo sapiens
acagaguucuggga

SEQ ID NO: 851466 - RNA, 21 nt, Homo sapiens
acagaguuuuuuauaaaugua

SEQ ID NO: 851467 - RNA, 20 nt, Homo sapiens
acagcugggagccuuugcca

SEQ ID NO: 851468 - RNA, 19 nt, Homo sapiens
acaggaagcugcaauucuc

SEQ ID NO: 851469 - RNA, 16 nt, Homo sapiens
acaggauuaggagcug

SEQ ID NO: 851470 - RNA, 22 nt, Homo sapiens
acaggcaaauccgaaaucagca

SEQ ID NO: 851471 - RNA, 14 nt, Homo sapiens
acagggaggggaug

SEQ ID NO: 851472 - RNA, 19 nt, Homo sapiens
acaggugcccgccaccaca

SEQ ID NO: 851473 - RNA, 15 nt, Homo sapiens
acaguccuauuuaga

SEQ ID NO: 851474 - RNA, 12 nt, Homo sapiens
aguacugugaau

SEQ ID NO: 851475 - RNA, 15 nt, Homo sapiens
aguagcugggaccac

SEQ ID NO: 851476 - RNA, 17 nt, Homo sapiens
aguaggaguuugcuaag

SEQ ID NO: 851477 - RNA, 18 nt, Homo sapiens
aguaguucuguauuugaa

SEQ ID NO: 851478 - RNA, 17 nt, Homo sapiens
aguauguucauugccac

SEQ ID NO: 851479 - RNA, 23 nt, Homo sapiens
aguauucuaauaagcuaguugaa

SEQ ID NO: 851480 - RNA, 21 nt, Homo sapiens
aguauuuacugacugcuuaua

SEQ ID NO: 851481 - RNA, 19 nt, Homo sapiens
aguccaucaaguaccucau

SEQ ID NO: 851482 - RNA, 22 nt, Homo sapiens
agucccuuucagcugcugcuua

SEQ ID NO: 851483 - RNA, 16 nt, Homo sapiens
agucucgcuacauuuc

SEQ ID NO: 851484 - RNA, 14 nt, Homo sapiens
agucugacagccag

SEQ ID NO: 851485 - RNA, 17 nt, Homo sapiens
agucuggggaccagcuu

SEQ ID NO: 851486 - RNA, 16 nt, Homo sapiens
agugacaugcauucac

SEQ ID NO: 851487 - RNA, 21 nt, Homo sapiens
agugacaugcauucacauauc

SEQ ID NO: 851488 - RNA, 13 nt, Homo sapiens
agugagacagacu

SEQ ID NO: 851489 - RNA, 23 nt, Homo sapiens
agugaggccuuauugccaggagg

SEQ ID NO: 851490 - RNA, 21 nt, Homo sapiens
agugauggcuuaugauagcaa

SEQ ID NO: 851491 - RNA, 15 nt, Homo sapiens
agugaugugccuaaa

SEQ ID NO: 851492 - RNA, 15 nt, Homo sapiens
agugcagugauguuu

SEQ ID NO: 851493 - RNA, 13 nt, Homo sapiens
agugccauuucag

SEQ ID NO: 851494 - RNA, 15 nt, Homo sapiens
agugccauuucagag

SEQ ID NO: 851495 - RNA, 15 nt, Homo sapiens
aguggcucaucauca

SEQ ID NO: 851496 - RNA, 18 nt, Homo sapiens
agugggcuaggaggacaa

SEQ ID NO: 851497 - RNA, 19 nt, Homo sapiens
aguguauuaaaugaacauc

SEQ ID NO: 851498 - RNA, 20 nt, Homo sapiens
agugucucgaguacuaauau

SEQ ID NO: 851499 - RNA, 14 nt, Homo sapiens
agugugaauacugc

SEQ ID NO: 851500 - RNA, 23 nt, Homo sapiens
aguguucacauggcucucaugua

SEQ ID NO: 851501 - RNA, 13 nt, Homo sapiens
aguguuuggugca

SEQ ID NO: 851502 - RNA, 17 nt, Homo sapiens
aguuaccagugccuuaa

SEQ ID NO: 851503 - RNA, 16 nt, Homo sapiens
aguuaugugaccucac

SEQ ID NO: 851504 - RNA, 19 nt, Homo sapiens
aguuccuucuauacauguu

SEQ ID NO: 851505 - RNA, 18 nt, Homo sapiens
aguucugagauuccagaa

SEQ ID NO: 851506 - RNA, 13 nt, Homo sapiens
aguugcugucaca

SEQ ID NO: 851507 - RNA, 13 nt, Homo sapiens
aguugcugucagu

SEQ ID NO: 851508 - RNA, 18 nt, Homo sapiens
aguuggauucagaaccaa

SEQ ID NO: 851509 - RNA, 17 nt, Homo sapiens
aguuuaaaaaucugcca

SEQ ID NO: 851510 - RNA, 22 nt, Homo sapiens
aguuuaaggaauaugggagaaa

SEQ ID NO: 851511 - RNA, 21 nt, Homo sapiens
aguuuacuuggaaauuguuaa

SEQ ID NO: 851512 - RNA, 23 nt, Homo sapiens
aguuuaucuuggccuuacuguau

SEQ ID NO: 851513 - RNA, 19 nt, Homo sapiens
aguuugcugaaagauaugu

SEQ ID NO: 851514 - RNA, 20 nt, Homo sapiens
aguuuguaaaugacuuucau

SEQ ID NO: 851515 - RNA, 22 nt, Homo sapiens
auaaaaacaaauaauaucucua

SEQ ID NO: 851516 - RNA, 13 nt, Homo sapiens
auaaaaagaguau

SEQ ID NO: 851517 - RNA, 15 nt, Homo sapiens
auaaaagacaaaugc

SEQ ID NO: 851518 - RNA, 20 nt, Homo sapiens
auaaaagcccaggagcccau

SEQ ID NO: 851519 - RNA, 21 nt, Homo sapiens
auaaaauguaucaacacacau

SEQ ID NO: 851520 - RNA, 18 nt, Homo sapiens
auaaacgccuucccaaaa

SEQ ID NO: 851521 - RNA, 15 nt, Homo sapiens
auaaagcacauucca

SEQ ID NO: 851522 - RNA, 20 nt, Homo sapiens
auaaauggcccggacauguc

SEQ ID NO: 851523 - RNA, 21 nt, Homo sapiens
auaaauggcccggacaugucu

SEQ ID NO: 851524 - RNA, 20 nt, Homo sapiens
auaaauguuauagcugcauu

SEQ ID NO: 851525 - RNA, 22 nt, Homo sapiens
auaauagguuugaaaguacucc

SEQ ID NO: 851526 - RNA, 14 nt, Homo sapiens
auaaucaugaucac

SEQ ID NO: 851527 - RNA, 14 nt, Homo sapiens
auaaucauggcucu

SEQ ID NO: 851528 - RNA, 13 nt, Homo sapiens
auaauccuuguca

SEQ ID NO: 851529 - RNA, 15 nt, Homo sapiens
auaauccuugucaga

SEQ ID NO: 851530 - RNA, 16 nt, Homo sapiens
auaaugaauaaacagu

SEQ ID NO: 851531 - RNA, 22 nt, Homo sapiens
auaaugcugccucauuuucaca

SEQ ID NO: 851532 - RNA, 14 nt, Homo sapiens
auaauguugucaag

SEQ ID NO: 851533 - RNA, 22 nt, Homo sapiens
auaauucacccaccagacuuuu

SEQ ID NO: 851534 - RNA, 16 nt, Homo sapiens
auaauucauagugaua

SEQ ID NO: 851535 - RNA, 17 nt, Homo sapiens
auaauugaagagacaau

SEQ ID NO: 851536 - RNA, 22 nt, Homo sapiens
auaauuuugauagugggaccac

SEQ ID NO: 851537 - RNA, 12 nt, Homo sapiens
auacagcaaacc

SEQ ID NO: 851538 - RNA, 19 nt, Homo sapiens
auacagcuucagcugccug

SEQ ID NO: 851539 - RNA, 13 nt, Homo sapiens
auacaguuuacug

SEQ ID NO: 851540 - RNA, 19 nt, Homo sapiens
auacauguuugcaguguua

SEQ ID NO: 851541 - RNA, 17 nt, Homo sapiens
auacggauccugcacug

SEQ ID NO: 851542 - RNA, 13 nt, Homo sapiens
auacuugcuccau

SEQ ID NO: 851543 - RNA, 23 nt, Homo sapiens
auacuugcuccauucauacacaa

SEQ ID NO: 851544 - RNA, 22 nt, Homo sapiens
auacuuugcagcacagcugaga

SEQ ID NO: 851545 - RNA, 13 nt, Homo sapiens
auacuuuugcccu

SEQ ID NO: 851546 - RNA, 14 nt, Homo sapiens
auagaaaauaucua

SEQ ID NO: 851547 - RNA, 16 nt, Homo sapiens
auagacacuugaguua

SEQ ID NO: 851548 - RNA, 16 nt, Homo sapiens
auagaggguacuugaa

SEQ ID NO: 851549 - RNA, 17 nt, Homo sapiens
auaguggcuuaacugga

SEQ ID NO: 851550 - RNA, 20 nt, Homo sapiens
auaguuuaaaaaucugccac

SEQ ID NO: 851551 - RNA, 17 nt, Homo sapiens
auaguuugacacuugaa

SEQ ID NO: 851552 - RNA, 12 nt, Homo sapiens
auauauuucaca

SEQ ID NO: 851553 - RNA, 22 nt, Homo sapiens
auauccuuuuagucugcauaua

SEQ ID NO: 851554 - RNA, 22 nt, Homo sapiens
auaucuagcccaaagccuucau

SEQ ID NO: 851555 - RNA, 14 nt, Homo sapiens
auaucugcuuauca

SEQ ID NO: 851556 - RNA, 14 nt, Homo sapiens
auaugaacuuucau

SEQ ID NO: 851557 - RNA, 21 nt, Homo sapiens
auaugaagaaucugcucugaa

SEQ ID NO: 851558 - RNA, 18 nt, Homo sapiens
auaugaucaaacuuccau

SEQ ID NO: 851559 - RNA, 21 nt, Homo sapiens
auaugcaaauuccauagcuca

SEQ ID NO: 851560 - RNA, 15 nt, Homo sapiens
auauggagugaccaa

SEQ ID NO: 851561 - RNA, 18 nt, Homo sapiens
auauguacuaguggcaug

SEQ ID NO: 851562 - RNA, 11 nt, Homo sapiens
auaugugcacu

SEQ ID NO: 851563 - RNA, 19 nt, Homo sapiens
auaugugguccaucucuga

SEQ ID NO: 851564 - RNA, 15 nt, Homo sapiens
auauguguaucucaa

SEQ ID NO: 851565 - RNA, 14 nt, Homo sapiens
auauguuuuauuca

SEQ ID NO: 851566 - RNA, 16 nt, Homo sapiens
auauuaaaucugggau

SEQ ID NO: 851567 - RNA, 19 nt, Homo sapiens
auauugaaagguagcaaug

SEQ ID NO: 851568 - RNA, 21 nt, Homo sapiens
auauuggcugguaaauugcca

SEQ ID NO: 851569 - RNA, 16 nt, Homo sapiens
auauuuaagcaauaaa

SEQ ID NO: 851570 - RNA, 23 nt, Homo sapiens
auauuuaagcaauaaaacugcua

SEQ ID NO: 851571 - RNA, 16 nt, Homo sapiens
auauuuauugacucuu

SEQ ID NO: 851572 - RNA, 16 nt, Homo sapiens
auauuuuuacugcuuu

SEQ ID NO: 851573 - RNA, 16 nt, Homo sapiens
auauuuuuauaugugg

SEQ ID NO: 851574 - RNA, 14 nt, Homo sapiens
aucacaaaugacuu

SEQ ID NO: 851575 - RNA, 19 nt, Homo sapiens
aucacuaggccucugacca

SEQ ID NO: 851576 - RNA, 15 nt, Homo sapiens
aucacuuucaggugg

SEQ ID NO: 851577 - RNA, 16 nt, Homo sapiens
aucacuuucagguggc

SEQ ID NO: 851578 - RNA, 20 nt, Homo sapiens
aucagcaaacuuugcauuac

SEQ ID NO: 851579 - RNA, 23 nt, Homo sapiens
aucaguccuaccugagcaacaag

SEQ ID NO: 851580 - RNA, 14 nt, Homo sapiens
aucagugugcaaua

SEQ ID NO: 851581 - RNA, 20 nt, Homo sapiens
aucaugaaaaugucuauuca

SEQ ID NO: 851582 - RNA, 14 nt, Homo sapiens
aucaugaagugaua

SEQ ID NO: 851583 - RNA, 21 nt, Homo sapiens
aucaugaucacaacugagauc

SEQ ID NO: 851584 - RNA, 19 nt, Homo sapiens
auccacugauauccaugau

SEQ ID NO: 851585 - RNA, 13 nt, Homo sapiens
auccacuugucca

SEQ ID NO: 851586 - RNA, 11 nt, Homo sapiens
auccacuuugg

SEQ ID NO: 851587 - RNA, 12 nt, Homo sapiens
auccagcaauac

SEQ ID NO: 851588 - RNA, 16 nt, Homo sapiens
auccauauuaaguaag

SEQ ID NO: 851589 - RNA, 15 nt, Homo sapiens
auccaugaugcuggg

SEQ ID NO: 851590 - RNA, 12 nt, Homo sapiens
auccuuugccag

SEQ ID NO: 851591 - RNA, 16 nt, Homo sapiens
aucuagcucuccauac

SEQ ID NO: 851592 - RNA, 22 nt, Homo sapiens
aucuagcucuccauacuuugaa

SEQ ID NO: 851593 - RNA, 15 nt, Homo sapiens
aucuaguugucaaua

SEQ ID NO: 851594 - RNA, 17 nt, Homo sapiens
aucuaguugucaauaaa

SEQ ID NO: 851595 - RNA, 17 nt, Homo sapiens
aucuaucacccaggaau

SEQ ID NO: 851596 - RNA, 20 nt, Homo sapiens
aucuaucacccaggaaucuc

SEQ ID NO: 851597 - RNA, 16 nt, Homo sapiens
aucuaucccagaguac

SEQ ID NO: 851598 - RNA, 15 nt, Homo sapiens
aucucuagggaccag

SEQ ID NO: 851599 - RNA, 21 nt, Homo sapiens
aucugacuuuagccuaccuaa

SEQ ID NO: 851600 - RNA, 20 nt, Homo sapiens
aucugaguuagguuccagca

SEQ ID NO: 851601 - RNA, 18 nt, Homo sapiens
aucugauaucagcacugg

SEQ ID NO: 851602 - RNA, 23 nt, Homo sapiens
aucugugguuuauaaucuugcac

SEQ ID NO: 851603 - RNA, 21 nt, Homo sapiens
aucuguguaaaaucugacaua

SEQ ID NO: 851604 - RNA, 13 nt, Homo sapiens
aucuuaagucaua

SEQ ID NO: 851605 - RNA, 18 nt, Homo sapiens
aucuucuguuauuguuga

SEQ ID NO: 851606 - RNA, 19 nt, Homo sapiens
aucuuggccuuacuguaua

SEQ ID NO: 851607 - RNA, 14 nt, Homo sapiens
augaagaaucugcu

SEQ ID NO: 851608 - RNA, 18 nt, Homo sapiens
augaagaaucugcucuga

SEQ ID NO: 851609 - RNA, 12 nt, Homo sapiens
augaagcaagaa

SEQ ID NO: 851610 - RNA, 15 nt, Homo sapiens
augaauaaacaguua

SEQ ID NO: 851611 - RNA, 16 nt, Homo sapiens
augaauaaagugcaaa

SEQ ID NO: 851612 - RNA, 20 nt, Homo sapiens
augagacugggcaucucuga

SEQ ID NO: 851613 - RNA, 20 nt, Homo sapiens
augauaauaaucaugaucac

SEQ ID NO: 851614 - RNA, 20 nt, Homo sapiens
augauagcaaauggccucau

SEQ ID NO: 851615 - RNA, 17 nt, Homo sapiens
augauggagaagugugg

SEQ ID NO: 851616 - RNA, 20 nt, Homo sapiens
augcaaaaugacuuauuagg

SEQ ID NO: 851617 - RNA, 20 nt, Homo sapiens
augcaacauuuuaaggcaau

SEQ ID NO: 851618 - RNA, 15 nt, Homo sapiens
augcauauuacugua

SEQ ID NO: 851619 - RNA, 15 nt, Homo sapiens
augcauucacauauc

SEQ ID NO: 851620 - RNA, 18 nt, Homo sapiens
augcauuuuuuaccacaa

SEQ ID NO: 851621 - RNA, 24 nt, Homo sapiens
augcuaauauuuuuaacaagucau

SEQ ID NO: 851622 - RNA, 16 nt, Homo sapiens
augcugaacauugcau

SEQ ID NO: 851623 - RNA, 20 nt, Homo sapiens
augcugagauccucauuuau

SEQ ID NO: 851624 - RNA, 11 nt, Homo sapiens
augcuggaaac

SEQ ID NO: 851625 - RNA, 18 nt, Homo sapiens
augcuuuucucaaagccc

SEQ ID NO: 851626 - RNA, 16 nt, Homo sapiens
auggaagacagcagga

SEQ ID NO: 851627 - RNA, 13 nt, Homo sapiens
auggagaaugcac

SEQ ID NO: 851628 - RNA, 21 nt, Homo sapiens
auggagaaugcaccauacuca

SEQ ID NO: 851629 - RNA, 23 nt, Homo sapiens
auggagugaccaaaaugccaaaa

SEQ ID NO: 851630 - RNA, 23 nt, Homo sapiens
auggaugaauaaauguuauagcu

SEQ ID NO: 851631 - RNA, 18 nt, Homo sapiens
auggaugcuuuggcaaug

SEQ ID NO: 851632 - RNA, 15 nt, Homo sapiens
augggccacacaagu

SEQ ID NO: 851633 - RNA, 18 nt, Homo sapiens
augggcuaccaggaagaa

SEQ ID NO: 851634 - RNA, 14 nt, Homo sapiens
augggucagggugu

SEQ ID NO: 851635 - RNA, 14 nt, Homo sapiens
augggucagugccc

SEQ ID NO: 851636 - RNA, 14 nt, Homo sapiens
augguuacauauca

SEQ ID NO: 851637 - RNA, 15 nt, Homo sapiens
augguuacauaucaa

SEQ ID NO: 851638 - RNA, 16 nt, Homo sapiens
auguaaaaagugcagu

SEQ ID NO: 851639 - RNA, 19 nt, Homo sapiens
auguaaacaaaaacaacug

SEQ ID NO: 851640 - RNA, 13 nt, Homo sapiens
auguaaaugguau

SEQ ID NO: 851641 - RNA, 21 nt, Homo sapiens
auguacagauaugcaaauucc

SEQ ID NO: 851642 - RNA, 22 nt, Homo sapiens
auguaccaccaacuacuaccug

SEQ ID NO: 851643 - RNA, 14 nt, Homo sapiens
auguauacuugaaa

SEQ ID NO: 851644 - RNA, 20 nt, Homo sapiens
auguauacuugaaaaauguu

SEQ ID NO: 851645 - RNA, 21 nt, Homo sapiens
auguaucaagccaaaugugca

SEQ ID NO: 851646 - RNA, 15 nt, Homo sapiens
auguauuucaucuca

SEQ ID NO: 851647 - RNA, 21 nt, Homo sapiens
auguauuugauguauucugug

SEQ ID NO: 851648 - RNA, 16 nt, Homo sapiens
augucagcagcuuuaa

SEQ ID NO: 851649 - RNA, 17 nt, Homo sapiens
augugaaaauguauucu

SEQ ID NO: 851650 - RNA, 19 nt, Homo sapiens
augugcacugcaaugccag

SEQ ID NO: 851651 - RNA, 17 nt, Homo sapiens
augugguccaucucuga

SEQ ID NO: 851652 - RNA, 20 nt, Homo sapiens
augugguuaauuuugcauau

SEQ ID NO: 851653 - RNA, 15 nt, Homo sapiens
augugugauucaaug

SEQ ID NO: 851654 - RNA, 19 nt, Homo sapiens
auguguugcagcugucacc

SEQ ID NO: 851655 - RNA, 18 nt, Homo sapiens
auguugacaucacuggca

SEQ ID NO: 851656 - RNA, 14 nt, Homo sapiens
auuaaaaaauuauu

SEQ ID NO: 851657 - RNA, 20 nt, Homo sapiens
auuaaaaccuuaagaguucu

SEQ ID NO: 851658 - RNA, 13 nt, Homo sapiens
auuaaaugaacau

SEQ ID NO: 851659 - RNA, 20 nt, Homo sapiens
auuaauuaucgugucugcau

SEQ ID NO: 851660 - RNA, 15 nt, Homo sapiens
auuacauucacgaca

SEQ ID NO: 851661 - RNA, 16 nt, Homo sapiens
auuacguuuacauucu

SEQ ID NO: 851662 - RNA, 15 nt, Homo sapiens
auuacuuguugccua

SEQ ID NO: 851663 - RNA, 22 nt, Homo sapiens
auuauucaaaugcuucuuccca

SEQ ID NO: 851664 - RNA, 16 nt, Homo sapiens
auuauuuuucucucuc

SEQ ID NO: 851665 - RNA, 15 nt, Homo sapiens
auucaaauggacaaa

SEQ ID NO: 851666 - RNA, 21 nt, Homo sapiens
auucagauuguuuaaaugccu

SEQ ID NO: 851667 - RNA, 22 nt, Homo sapiens
auucaggucccaguugcuguca

SEQ ID NO: 851668 - RNA, 18 nt, Homo sapiens
auucagucuagccacaaa

SEQ ID NO: 851669 - RNA, 19 nt, Homo sapiens
auucagugaugugccuaaa

SEQ ID NO: 851670 - RNA, 17 nt, Homo sapiens
auucauuguggucauag

SEQ ID NO: 851671 - RNA, 15 nt, Homo sapiens
auuccagaaugaaga

SEQ ID NO: 851672 - RNA, 24 nt, Homo sapiens
auuccagaaugaagaauucagauu

SEQ ID NO: 851673 - RNA, 22 nt, Homo sapiens
auucguucucugccacagggac

SEQ ID NO: 851674 - RNA, 16 nt, Homo sapiens
auucuaaaugaacuca

SEQ ID NO: 851675 - RNA, 20 nt, Homo sapiens
auucucccuaaaguguugug

SEQ ID NO: 851676 - RNA, 14 nt, Homo sapiens
auucugacucauau

SEQ ID NO: 851677 - RNA, 13 nt, Homo sapiens
auucuuagcauac

SEQ ID NO: 851678 - RNA, 19 nt, Homo sapiens
auucuuagcauacauucag

SEQ ID NO: 851679 - RNA, 14 nt, Homo sapiens
auucuugaaugagg

SEQ ID NO: 851680 - RNA, 23 nt, Homo sapiens
auucuuuauuauuuuucucucuc

SEQ ID NO: 851681 - RNA, 15 nt, Homo sapiens
auugaauacucugaa

SEQ ID NO: 851682 - RNA, 17 nt, Homo sapiens
auugagauuuaauuccc

SEQ ID NO: 851683 - RNA, 13 nt, Homo sapiens
auugagguauaau

SEQ ID NO: 851684 - RNA, 21 nt, Homo sapiens
auugccauggcccugagccac

SEQ ID NO: 851685 - RNA, 13 nt, Homo sapiens
auuggauuccucu

SEQ ID NO: 851686 - RNA, 14 nt, Homo sapiens
auuggcugccuuau

SEQ ID NO: 851687 - RNA, 15 nt, Homo sapiens
auuguaagaaauacu

SEQ ID NO: 851688 - RNA, 12 nt, Homo sapiens
auuguacuuuga

SEQ ID NO: 851689 - RNA, 22 nt, Homo sapiens
auuguauucucauaauacugaa

SEQ ID NO: 851690 - RNA, 20 nt, Homo sapiens
auugucuuccuguaagaccu

SEQ ID NO: 851691 - RNA, 22 nt, Homo sapiens
auuguugccagaugcagcacau

SEQ ID NO: 851692 - RNA, 18 nt, Homo sapiens
auuuaaaaaagauaucua

SEQ ID NO: 851693 - RNA, 14 nt, Homo sapiens
auuuaaccauucca

SEQ ID NO: 851694 - RNA, 14 nt, Homo sapiens
auuuaagaagccaa

SEQ ID NO: 851695 - RNA, 22 nt, Homo sapiens
auuuaagcaauaaaacugcuag

SEQ ID NO: 851696 - RNA, 12 nt, Homo sapiens
auuuagacaugu

SEQ ID NO: 851697 - RNA, 16 nt, Homo sapiens
auuuauguaacaaagu

SEQ ID NO: 851698 - RNA, 22 nt, Homo sapiens
auuuauuucuuuuuugccaaau

SEQ ID NO: 851699 - RNA, 17 nt, Homo sapiens
auuuauuugguagccca

SEQ ID NO: 851700 - RNA, 22 nt, Homo sapiens
auuuauuugugauguacuguaa

SEQ ID NO: 851701 - RNA, 17 nt, Homo sapiens
auuuauuuuccagcuua

SEQ ID NO: 851702 - RNA, 17 nt, Homo sapiens
auuucuccauggaguug

SEQ ID NO: 851703 - RNA, 14 nt, Homo sapiens
auuucugauuucag

SEQ ID NO: 851704 - RNA, 17 nt, Homo sapiens
auuucuuguaggcauca

SEQ ID NO: 851705 - RNA, 18 nt, Homo sapiens
auuucuuuuuugccaaau

SEQ ID NO: 851706 - RNA, 13 nt, Homo sapiens
auuugauauaugu

SEQ ID NO: 851707 - RNA, 19 nt, Homo sapiens
auuugcuggacaaccaaca

SEQ ID NO: 851708 - RNA, 12 nt, Homo sapiens
auuuggggacca

SEQ ID NO: 851709 - RNA, 18 nt, Homo sapiens
auuugguauccuuaucua

SEQ ID NO: 851710 - RNA, 16 nt, Homo sapiens
auuugugaauuaucca

SEQ ID NO: 851711 - RNA, 18 nt, Homo sapiens
auuuguuucuuucucuga

SEQ ID NO: 851712 - RNA, 12 nt, Homo sapiens
auuuuaaaacaa

SEQ ID NO: 851713 - RNA, 16 nt, Homo sapiens
auuuuaaaauuaggaa

SEQ ID NO: 851714 - RNA, 16 nt, Homo sapiens
auuuuaaacagaggau

SEQ ID NO: 851715 - RNA, 12 nt, Homo sapiens
auuuuagcacau

SEQ ID NO: 851716 - RNA, 18 nt, Homo sapiens
auuuuaguuccuucuaua

SEQ ID NO: 851717 - RNA, 16 nt, Homo sapiens
auuuucaaugugauau

SEQ ID NO: 851718 - RNA, 18 nt, Homo sapiens
auuuucaccuauccagag

SEQ ID NO: 851719 - RNA, 18 nt, Homo sapiens
auuuucuugguagcacaa

SEQ ID NO: 851720 - RNA, 16 nt, Homo sapiens
auuuucuuucacuuaa

SEQ ID NO: 851721 - RNA, 18 nt, Homo sapiens
auuuuguaauaauaaaga

SEQ ID NO: 851722 - RNA, 20 nt, Homo sapiens
auuuuguaauguaucaaaua

SEQ ID NO: 851723 - RNA, 23 nt, Homo sapiens
auuuuuauaagaaaaccaaacaa

SEQ ID NO: 851724 - RNA, 18 nt, Homo sapiens
auuuuucucucucucucg

SEQ ID NO: 851725 - RNA, 19 nt, Homo sapiens
caaaaaaaucuaacaguaa

SEQ ID NO: 851726 - RNA, 16 nt, Homo sapiens
caaaaaauucagugau

SEQ ID NO: 851727 - RNA, 14 nt, Homo sapiens
caaaaagcacaaga

SEQ ID NO: 851728 - RNA, 19 nt, Homo sapiens
caaaaauguuaagcaucua

SEQ ID NO: 851729 - RNA, 21 nt, Homo sapiens
caaaagucuggcccacugugc

SEQ ID NO: 851730 - RNA, 23 nt, Homo sapiens
caaaagucuggcccacugugcag

SEQ ID NO: 851731 - RNA, 17 nt, Homo sapiens
caaaauaaaaucucggu

SEQ ID NO: 851732 - RNA, 12 nt, Homo sapiens
caaaauaugugu

SEQ ID NO: 851733 - RNA, 14 nt, Homo sapiens
caaacagaucacua

SEQ ID NO: 851734 - RNA, 17 nt, Homo sapiens
caaaccccugaccucaa

SEQ ID NO: 851735 - RNA, 13 nt, Homo sapiens
caaaccuuacucu

SEQ ID NO: 851736 - RNA, 16 nt, Homo sapiens
caaaccuuacucugag

SEQ ID NO: 851737 - RNA, 23 nt, Homo sapiens
caaaccuucugacuuugccaaaa

SEQ ID NO: 851738 - RNA, 13 nt, Homo sapiens
caaacugccaguu

SEQ ID NO: 851739 - RNA, 14 nt, Homo sapiens
caaacuuugcauua

SEQ ID NO: 851740 - RNA, 21 nt, Homo sapiens
caaagccucggaucagccuug

SEQ ID NO: 851741 - RNA, 21 nt, Homo sapiens
caaagcuguuggccucugcaa

SEQ ID NO: 851742 - RNA, 18 nt, Homo sapiens
caaagggucuaucuugua

SEQ ID NO: 851743 - RNA, 13 nt, Homo sapiens
caaauacauuccu

SEQ ID NO: 851744 - RNA, 14 nt, Homo sapiens
agaacagcuucaug

SEQ ID NO: 851745 - RNA, 17 nt, Homo sapiens
agaacauuccauuugcu

SEQ ID NO: 851746 - RNA, 23 nt, Homo sapiens
agaacuguuaaaggucauaugca

SEQ ID NO: 851747 - RNA, 17 nt, Homo sapiens
agaacuuguugcugauu

SEQ ID NO: 851748 - RNA, 12 nt, Homo sapiens
agaagaucucaa

SEQ ID NO: 851749 - RNA, 16 nt, Homo sapiens
agaaggggacugccac

SEQ ID NO: 851750 - RNA, 23 nt, Homo sapiens
agaaguuuaaggaauaugggaga

SEQ ID NO: 851751 - RNA, 18 nt, Homo sapiens
agaauacccuaaaguaua

SEQ ID NO: 851752 - RNA, 21 nt, Homo sapiens
agaaucccuguguuaauuuaa

SEQ ID NO: 851753 - RNA, 21 nt, Homo sapiens
caaauccccaagaacacaaga

SEQ ID NO: 851754 - RNA, 16 nt, Homo sapiens
caaaugcaucuuugau

SEQ ID NO: 851755 - RNA, 18 nt, Homo sapiens
ccagcuuuuccugggaca

SEQ ID NO: 851756 - RNA, 18 nt, Homo sapiens
ccaggcacuccugaggua

SEQ ID NO: 851757 - RNA, 13 nt, Homo sapiens
ccagguggagaaa

SEQ ID NO: 851758 - RNA, 15 nt, Homo sapiens
ccaguugcugucaca

SEQ ID NO: 851759 - RNA, 17 nt, Homo sapiens
ccaguuguuuugucuug

SEQ ID NO: 851760 - RNA, 14 nt, Homo sapiens
ccauccugaacugg

SEQ ID NO: 851761 - RNA, 20 nt, Homo sapiens
ccaucugucacuugcauucc

SEQ ID NO: 851762 - RNA, 21 nt, Homo sapiens
ccaugagacucgguccaagag

SEQ ID NO: 851763 - RNA, 19 nt, Homo sapiens
ccaugcuucagugaacaua

SEQ ID NO: 851764 - RNA, 21 nt, Homo sapiens
ccauuaaagguggaaaaucua

SEQ ID NO: 851765 - RNA, 20 nt, Homo sapiens
ccauucaucccacccucuca

SEQ ID NO: 851766 - RNA, 21 nt, Homo sapiens
ccauuucagaggggaggcuca

SEQ ID NO: 851767 - RNA, 21 nt, Homo sapiens
ccauuugcuggacaaccaaca

SEQ ID NO: 851768 - RNA, 20 nt, Homo sapiens
ccauuugggagaagaucuca

SEQ ID NO: 851769 - RNA, 22 nt, Homo sapiens
cuggccggacacccgacuccag

SEQ ID NO: 851770 - RNA, 14 nt, Homo sapiens
cuggccucagggcu

SEQ ID NO: 851771 - RNA, 19 nt, Homo sapiens
cuggccucugccuuugguu

SEQ ID NO: 851772 - RNA, 17 nt, Homo sapiens
cuggcucuacacauaua

SEQ ID NO: 851773 - RNA, 18 nt, Homo sapiens
cugggacaucuucuguua

SEQ ID NO: 851774 - RNA, 19 nt, Homo sapiens
cugggcaauuuuuguaucc

SEQ ID NO: 851775 - RNA, 18 nt, Homo sapiens
cugggcacugcucucacc

SEQ ID NO: 851776 - RNA, 16 nt, Homo sapiens
cugggcaucucugagc

SEQ ID NO: 851777 - RNA, 21 nt, Homo sapiens
ugaagugccuuaaauauagca

SEQ ID NO: 851778 - RNA, 13 nt, Homo sapiens
ugaauacuugaac

SEQ ID NO: 851779 - RNA, 16 nt, Homo sapiens
ugaauauuuaagcaau

SEQ ID NO: 851780 - RNA, 14 nt, Homo sapiens
ugaaugcaugaccu

SEQ ID NO: 851781 - RNA, 11 nt, Homo sapiens
ugaaugugccc

SEQ ID NO: 851782 - RNA, 20 nt, Homo sapiens
ugaauuuacagaacaguuua

SEQ ID NO: 851783 - RNA, 23 nt, Homo sapiens
ugacagagugccaacuucuuuca

SEQ ID NO: 851784 - RNA, 15 nt, Homo sapiens
ugacagcgcacagcu

SEQ ID NO: 851785 - RNA, 17 nt, Homo sapiens
ugaccaaaaugccaaaa

SEQ ID NO: 851786 - RNA, 17 nt, Homo sapiens
ugaccauaacagugcca

SEQ ID NO: 851787 - RNA, 22 nt, Homo sapiens
ugaccauagggcucugcuuuua

SEQ ID NO: 851788 - RNA, 16 nt, Homo sapiens
uuccuuuccuuuccuu

SEQ ID NO: 851789 - RNA, 21 nt, Homo sapiens
uucgaaguucuagaauucuag

SEQ ID NO: 851790 - RNA, 20 nt, Homo sapiens
uucgacuugcauuuuugcag

SEQ ID NO: 851791 - RNA, 20 nt, Homo sapiens
uucgcuauucgccagcagac

SEQ ID NO: 851792 - RNA, 18 nt, Homo sapiens
uucguaauaggugucaug

SEQ ID NO: 851793 - RNA, 15 nt, Homo sapiens
uucuaaaugaacuca

SEQ ID NO: 851794 - RNA, 22 nt, Homo sapiens
uucucacaggcccaauccugaa

SEQ ID NO: 851795 - RNA, 17 nt, Homo sapiens
uucucauccuuugccag

SEQ ID NO: 851796 - RNA, 20 nt, Homo sapiens
uucuccagaaggcaauacca

SEQ ID NO: 851797 - RNA, 18 nt, Homo sapiens
uucugaaaauuuauauaa

SEQ ID NO: 851798 - RNA, 13 nt, Homo sapiens
uucugacuuugaa

SEQ ID NO: 851799 - RNA, 19 nt, Homo sapiens
uucugacuuugaauuuaua

SEQ ID NO: 851800 - RNA, 17 nt, Homo sapiens
uucugacuuugccaaaa

SEQ ID NO: 851801 - RNA, 23 nt, Homo sapiens
uucugcacaauaauaaguccauc

SEQ ID NO: 851802 - RNA, 18 nt, Homo sapiens
uucugggcaaucaguguu

SEQ ID NO: 851803 - RNA, 22 nt, Homo sapiens
uucugguggccccuucuaugcc

SEQ ID NO: 851804 - RNA, 19 nt, Homo sapiens
cucaggcauggaugaauaa

SEQ ID NO: 851805 - RNA, 14 nt, Homo sapiens
cucagugacugugu

SEQ ID NO: 851806 - RNA, 14 nt, Homo sapiens
cucauccuuugcca

SEQ ID NO: 851807 - RNA, 16 nt, Homo sapiens
cucaucuggacuaugg

SEQ ID NO: 851808 - RNA, 15 nt, Homo sapiens
cucaugcaugcaaau

SEQ ID NO: 851809 - RNA, 15 nt, Homo sapiens
auuuuccuguuguca

SEQ ID NO: 851810 - RNA, 12 nt, Homo sapiens
auuuucuagaua

SEQ ID NO: 851811 - RNA, 21 nt, Homo sapiens
auuuuguaauaauaaagaaua

SEQ ID NO: 851812 - RNA, 20 nt, Homo sapiens
auuuuuaaaaaguuugaaua

SEQ ID NO: 851813 - RNA, 21 nt, Homo sapiens
auuuuuaacaagucauuucaa

SEQ ID NO: 851814 - RNA, 16 nt, Homo sapiens
auuuuuaaccuuuuca

SEQ ID NO: 851815 - RNA, 19 nt, Homo sapiens
auuuuugaaaaaugcacug

SEQ ID NO: 851816 - RNA, 20 nt, Homo sapiens
auuuuugcaggugcuuuuau

SEQ ID NO: 851817 - RNA, 14 nt, Homo sapiens
auuuuuuaccacaa

SEQ ID NO: 851818 - RNA, 22 nt, Homo sapiens
caaaaaaggaugcaacaauucu

SEQ ID NO: 851819 - RNA, 20 nt, Homo sapiens
caaaagcacuggaaaugagu

SEQ ID NO: 851820 - RNA, 13 nt, Homo sapiens
caaaaugccaaaa

SEQ ID NO: 851821 - RNA, 22 nt, Homo sapiens
caaacaaaaauguuaagcaucu

SEQ ID NO: 851822 - RNA, 20 nt, Homo sapiens
caaacaacugaaauguggau

SEQ ID NO: 851823 - RNA, 23 nt, Homo sapiens
caaacccacccuuucuacuucca

SEQ ID NO: 851824 - RNA, 16 nt, Homo sapiens
caaaccccugaccuca

SEQ ID NO: 851825 - RNA, 20 nt, Homo sapiens
caaaggaucuggaccaguuu

SEQ ID NO: 851826 - RNA, 17 nt, Homo sapiens
caaaguccagauaccaa

SEQ ID NO: 851827 - RNA, 16 nt, Homo sapiens
caaagugaaguaaaag

SEQ ID NO: 851828 - RNA, 14 nt, Homo sapiens
caaauggccucaug

SEQ ID NO: 851829 - RNA, 20 nt, Homo sapiens
caaaugugugcccagcuuau

SEQ ID NO: 851830 - RNA, 16 nt, Homo sapiens
caaauuccauagcuca

SEQ ID NO: 851831 - RNA, 17 nt, Homo sapiens
caaauuccauagcucaa

SEQ ID NO: 851832 - RNA, 14 nt, Homo sapiens
caaauuugugaacu

SEQ ID NO: 851833 - RNA, 12 nt, Homo sapiens
caacacacauuu

SEQ ID NO: 851834 - RNA, 18 nt, Homo sapiens
caaccacaggaagcugca

SEQ ID NO: 851835 - RNA, 17 nt, Homo sapiens
caaccuuuaguacgugu

SEQ ID NO: 851836 - RNA, 15 nt, Homo sapiens
caacgaggcagucac

SEQ ID NO: 851837 - RNA, 15 nt, Homo sapiens
caacgaucacaaaug

SEQ ID NO: 851838 - RNA, 11 nt, Homo sapiens
caacugucagg

SEQ ID NO: 851839 - RNA, 19 nt, Homo sapiens
caacuuuaaaacugcucau

SEQ ID NO: 851840 - RNA, 13 nt, Homo sapiens
caagaaaagaguu

SEQ ID NO: 851841 - RNA, 15 nt, Homo sapiens
caagaaaagaguuaa

SEQ ID NO: 851842 - RNA, 19 nt, Homo sapiens
caagaaagucaaugucaau

SEQ ID NO: 851843 - RNA, 18 nt, Homo sapiens
caagaagguggaaggcag

SEQ ID NO: 851844 - RNA, 13 nt, Homo sapiens
caagaauagcauu

SEQ ID NO: 851845 - RNA, 20 nt, Homo sapiens
caagagccaaccucacagga

SEQ ID NO: 851846 - RNA, 17 nt, Homo sapiens
caagaggcagugguuug

SEQ ID NO: 851847 - RNA, 17 nt, Homo sapiens
caagcauucucuccauu

SEQ ID NO: 851848 - RNA, 23 nt, Homo sapiens
caagccaaaugugcagaugcuaa

SEQ ID NO: 851849 - RNA, 18 nt, Homo sapiens
caagcucaaggcaauggg

SEQ ID NO: 851850 - RNA, 19 nt, Homo sapiens
caagcucaaggcaaugggc

SEQ ID NO: 851851 - RNA, 13 nt, Homo sapiens
caaggaaaaagca

SEQ ID NO: 851852 - RNA, 17 nt, Homo sapiens
caaggcagaggcaggaa

SEQ ID NO: 851853 - RNA, 22 nt, Homo sapiens
caaggccaggccuuggggacaa

SEQ ID NO: 851854 - RNA, 22 nt, Homo sapiens
caaggcgauauaagcaaaauca

SEQ ID NO: 851855 - RNA, 13 nt, Homo sapiens
caaguaccucauc

SEQ ID NO: 851856 - RNA, 17 nt, Homo sapiens
caaguaccucaucugca

SEQ ID NO: 851857 - RNA, 23 nt, Homo sapiens
caaguacuuuccaaucucaguca

SEQ ID NO: 851858 - RNA, 19 nt, Homo sapiens
caaguaucuaaauuuggaa

SEQ ID NO: 851859 - RNA, 19 nt, Homo sapiens
caaguugagcuaugacuua

SEQ ID NO: 851860 - RNA, 14 nt, Homo sapiens
caaucguucucugu

SEQ ID NO: 851861 - RNA, 12 nt, Homo sapiens
caaucucuuaaa

SEQ ID NO: 851862 - RNA, 23 nt, Homo sapiens
caaugcuggaaacauucacuuuc

SEQ ID NO: 851863 - RNA, 21 nt, Homo sapiens
caaugggcuagagggugccgg

SEQ ID NO: 851864 - RNA, 21 nt, Homo sapiens
caauuaaaauauucuuuaaua

SEQ ID NO: 851865 - RNA, 14 nt, Homo sapiens
caauucguucucug

SEQ ID NO: 851866 - RNA, 23 nt, Homo sapiens
caauuuuuaaaaaguuugaauag

SEQ ID NO: 851867 - RNA, 14 nt, Homo sapiens
cacacaaguuugag

SEQ ID NO: 851868 - RNA, 15 nt, Homo sapiens
cacaccgaguuucca

SEQ ID NO: 851869 - RNA, 17 nt, Homo sapiens
cacacguggugaccuca

SEQ ID NO: 851870 - RNA, 11 nt, Homo sapiens
cacacugaacu

SEQ ID NO: 851871 - RNA, 14 nt, Homo sapiens
cacagaggacacag

SEQ ID NO: 851872 - RNA, 15 nt, Homo sapiens
cacagauuugcuaau

SEQ ID NO: 851873 - RNA, 13 nt, Homo sapiens
cacaggaggaacc

SEQ ID NO: 851874 - RNA, 17 nt, Homo sapiens
cacaggcugagugcagg

SEQ ID NO: 851875 - RNA, 16 nt, Homo sapiens
cacagugugauuuuga

SEQ ID NO: 851876 - RNA, 22 nt, Homo sapiens
cacauacguaaaaaucucucau

SEQ ID NO: 851877 - RNA, 21 nt, Homo sapiens
cacauaucugcuuaucagugu

SEQ ID NO: 851878 - RNA, 17 nt, Homo sapiens
cacaugguuacauauca

SEQ ID NO: 851879 - RNA, 17 nt, Homo sapiens
caccaaucuuacuuugu

SEQ ID NO: 851880 - RNA, 19 nt, Homo sapiens
caccaaucuuacuuuguaa

SEQ ID NO: 851881 - RNA, 12 nt, Homo sapiens
caccacagccuc

SEQ ID NO: 851882 - RNA, 22 nt, Homo sapiens
caccagacuuuuuuaaacauca

SEQ ID NO: 851883 - RNA, 13 nt, Homo sapiens
caccauucguaca

SEQ ID NO: 851884 - RNA, 13 nt, Homo sapiens
cacccacugugaa

SEQ ID NO: 851885 - RNA, 19 nt, Homo sapiens
caccccucuggcaccuggg

SEQ ID NO: 851886 - RNA, 13 nt, Homo sapiens
cacccgacuccag

SEQ ID NO: 851887 - RNA, 16 nt, Homo sapiens
cacccuuccaucugau

SEQ ID NO: 851888 - RNA, 18 nt, Homo sapiens
cacccuuccaucugauuc

SEQ ID NO: 851889 - RNA, 20 nt, Homo sapiens
cacccuuccaucugauucca

SEQ ID NO: 851890 - RNA, 20 nt, Homo sapiens
cacccuuggagcucugaguu

SEQ ID NO: 851891 - RNA, 21 nt, Homo sapiens
caccguacgacucuuuuccaa

SEQ ID NO: 851892 - RNA, 13 nt, Homo sapiens
caccucagggcau

SEQ ID NO: 851893 - RNA, 14 nt, Homo sapiens
caccuggcugaggc

SEQ ID NO: 851894 - RNA, 20 nt, Homo sapiens
caccugucgcacccacugug

SEQ ID NO: 851895 - RNA, 19 nt, Homo sapiens
caccuuccucccaccucac

SEQ ID NO: 851896 - RNA, 15 nt, Homo sapiens
cacgagcagacaccc

SEQ ID NO: 851897 - RNA, 16 nt, Homo sapiens
cacgcuuuaugcccuu

SEQ ID NO: 851898 - RNA, 17 nt, Homo sapiens
cacgggcaucauucucu

SEQ ID NO: 851899 - RNA, 22 nt, Homo sapiens
cacgguggagagaaagugacau

SEQ ID NO: 851900 - RNA, 19 nt, Homo sapiens
cacucucuuccuuucauuc

SEQ ID NO: 851901 - RNA, 17 nt, Homo sapiens
cacugacugaacuguaa

SEQ ID NO: 851902 - RNA, 13 nt, Homo sapiens
cacuggagucucu

SEQ ID NO: 851903 - RNA, 14 nt, Homo sapiens
cacuggggcccaag

SEQ ID NO: 851904 - RNA, 17 nt, Homo sapiens
cacuguguauauuugau

SEQ ID NO: 851905 - RNA, 19 nt, Homo sapiens
cacuguuuagauuugccau

SEQ ID NO: 851906 - RNA, 13 nt, Homo sapiens
cacuuaaaacacg

SEQ ID NO: 851907 - RNA, 22 nt, Homo sapiens
cacuuaggaugugaucacuuuc

SEQ ID NO: 851908 - RNA, 22 nt, Homo sapiens
cacuucaagaagucacugucag

SEQ ID NO: 851909 - RNA, 16 nt, Homo sapiens
cacuuguagauuugau

SEQ ID NO: 851910 - RNA, 12 nt, Homo sapiens
cacuuugacagc

SEQ ID NO: 851911 - RNA, 19 nt, Homo sapiens
cacuuuguucacuaccugu

SEQ ID NO: 851912 - RNA, 14 nt, Homo sapiens
cagaaaaugaauga

SEQ ID NO: 851913 - RNA, 11 nt, Homo sapiens
cagaaacaaca

SEQ ID NO: 851914 - RNA, 21 nt, Homo sapiens
cagaaaucugcugcauuucac

SEQ ID NO: 851915 - RNA, 14 nt, Homo sapiens
cagaaggaaagggc

SEQ ID NO: 851916 - RNA, 15 nt, Homo sapiens
cagaaggaaggcuuu

SEQ ID NO: 851917 - RNA, 23 nt, Homo sapiens
cagaaggcaauaccaaccugaaa

SEQ ID NO: 851918 - RNA, 16 nt, Homo sapiens
cagaaggcuuuuuuaa

SEQ ID NO: 851919 - RNA, 13 nt, Homo sapiens
cagaagugagcuc

SEQ ID NO: 851920 - RNA, 21 nt, Homo sapiens
cagaaguugaaguagcuuuua

SEQ ID NO: 851921 - RNA, 19 nt, Homo sapiens
cagaaucugauaccaaaga

SEQ ID NO: 851922 - RNA, 21 nt, Homo sapiens
cagaaucuuguccaaguuguu

SEQ ID NO: 851923 - RNA, 16 nt, Homo sapiens
cagaaugaagaauuca

SEQ ID NO: 851924 - RNA, 18 nt, Homo sapiens
cagacuauaaaaucugga

SEQ ID NO: 851925 - RNA, 20 nt, Homo sapiens
cagacuuuuaaagacuugca

SEQ ID NO: 851926 - RNA, 16 nt, Homo sapiens
cagacuuuuuuaaaca

SEQ ID NO: 851927 - RNA, 20 nt, Homo sapiens
cagagaagugacgguuccua

SEQ ID NO: 851928 - RNA, 22 nt, Homo sapiens
cagagagaagagccccacucuc

SEQ ID NO: 851929 - RNA, 23 nt, Homo sapiens
cagagagggucacugggggacac

SEQ ID NO: 851930 - RNA, 18 nt, Homo sapiens
cagagaguaagcacuuaa

SEQ ID NO: 851931 - RNA, 23 nt, Homo sapiens
cagagcuaaggccaaugggcuag

SEQ ID NO: 851932 - RNA, 20 nt, Homo sapiens
cagaggcuguggucagagag

SEQ ID NO: 851933 - RNA, 13 nt, Homo sapiens
cagaguagccaug

SEQ ID NO: 851934 - RNA, 17 nt, Homo sapiens
cagaguagccaugagga

SEQ ID NO: 851935 - RNA, 22 nt, Homo sapiens
cagaguauauuuaagaagccaa

SEQ ID NO: 851936 - RNA, 23 nt, Homo sapiens
cagaguauauuuaagaagccaag

SEQ ID NO: 851937 - RNA, 13 nt, Homo sapiens
cagaguucuggga

SEQ ID NO: 851938 - RNA, 14 nt, Homo sapiens
cagcacaaccuuca

SEQ ID NO: 851939 - RNA, 22 nt, Homo sapiens
cagcaggacgacuguuuuccca

SEQ ID NO: 851940 - RNA, 15 nt, Homo sapiens
aggcuggaaaguaag

SEQ ID NO: 851941 - RNA, 19 nt, Homo sapiens
aggcugggcuggccagcca

SEQ ID NO: 851942 - RNA, 22 nt, Homo sapiens
aggcugucggggucaagcugga

SEQ ID NO: 851943 - RNA, 17 nt, Homo sapiens
aggcuucugaugaucau

SEQ ID NO: 851944 - RNA, 19 nt, Homo sapiens
agggaacaaguugagcuau

SEQ ID NO: 851945 - RNA, 15 nt, Homo sapiens
agggaacugagcaca

SEQ ID NO: 851946 - RNA, 18 nt, Homo sapiens
agggagaaguuugggaaa

SEQ ID NO: 851947 - RNA, 23 nt, Homo sapiens
agggagagaucaaguugagacag

SEQ ID NO: 851948 - RNA, 14 nt, Homo sapiens
agggagcagacuuu

SEQ ID NO: 851949 - RNA, 19 nt, Homo sapiens
agggaguagggcucgccau

SEQ ID NO: 851950 - RNA, 21 nt, Homo sapiens
agggcacagggccuggcccau

SEQ ID NO: 851951 - RNA, 13 nt, Homo sapiens
agggccucaucuc

SEQ ID NO: 851952 - RNA, 14 nt, Homo sapiens
aggggaaugggagg

SEQ ID NO: 851953 - RNA, 14 nt, Homo sapiens
aggggacugccacc

SEQ ID NO: 851954 - RNA, 12 nt, Homo sapiens
aggggagacaga

SEQ ID NO: 851955 - RNA, 15 nt, Homo sapiens
aggggagacuuugau

SEQ ID NO: 851956 - RNA, 15 nt, Homo sapiens
aggggauccagcuca

SEQ ID NO: 851957 - RNA, 10 nt, Homo sapiens
aggggccaga

SEQ ID NO: 851958 - RNA, 22 nt, Homo sapiens
aggggccagaguuuucuaugaa

SEQ ID NO: 851959 - RNA, 15 nt, Homo sapiens
agggggccuccagga

SEQ ID NO: 851960 - RNA, 22 nt, Homo sapiens
agggggguuucagggcugaacc

SEQ ID NO: 851961 - RNA, 15 nt, Homo sapiens
agggugauggaacaa

SEQ ID NO: 851962 - RNA, 17 nt, Homo sapiens
agggugguuuaccugca

SEQ ID NO: 851963 - RNA, 17 nt, Homo sapiens
agguagcuucuggaaau

SEQ ID NO: 851964 - RNA, 22 nt, Homo sapiens
agguaggcacaaauacauuccu

SEQ ID NO: 851965 - RNA, 13 nt, Homo sapiens
aggucauaugcac

SEQ ID NO: 851966 - RNA, 16 nt, Homo sapiens
aggucauaugcacguu

SEQ ID NO: 851967 - RNA, 21 nt, Homo sapiens
aggucugaguuguuaccccaa

SEQ ID NO: 851968 - RNA, 11 nt, Homo sapiens
aggucuuccaa

SEQ ID NO: 851969 - RNA, 15 nt, Homo sapiens
aggugaugugugagu

SEQ ID NO: 851970 - RNA, 18 nt, Homo sapiens
agguggagaaaucacaga

SEQ ID NO: 851971 - RNA, 24 nt, Homo sapiens
agguguggcagaagcuugcagaug

SEQ ID NO: 851972 - RNA, 12 nt, Homo sapiens
agguugccauug

SEQ ID NO: 851973 - RNA, 24 nt, Homo sapiens
agguugcugguacacaccaaauga

SEQ ID NO: 851974 - RNA, 14 nt, Homo sapiens
aguaaauauuuacu

SEQ ID NO: 851975 - RNA, 20 nt, Homo sapiens
aguacacugccugccuuaag

SEQ ID NO: 851976 - RNA, 22 nt, Homo sapiens
aguacucagcagcccucauaua

SEQ ID NO: 851977 - RNA, 13 nt, Homo sapiens
aguauaacauguc

SEQ ID NO: 851978 - RNA, 13 nt, Homo sapiens
aguaucaugaagc

SEQ ID NO: 851979 - RNA, 15 nt, Homo sapiens
agucaaugucaauga

SEQ ID NO: 851980 - RNA, 18 nt, Homo sapiens
agucaccuaaguacuuaa

SEQ ID NO: 851981 - RNA, 14 nt, Homo sapiens
agucacugucagag

SEQ ID NO: 851982 - RNA, 12 nt, Homo sapiens
agucacuuugac

SEQ ID NO: 851983 - RNA, 15 nt, Homo sapiens
aguccaguagggcag

SEQ ID NO: 851984 - RNA, 21 nt, Homo sapiens
aguccaucaaguaccucaucu

SEQ ID NO: 851985 - RNA, 22 nt, Homo sapiens
aguccaucaaguaccucaucug

SEQ ID NO: 851986 - RNA, 17 nt, Homo sapiens
agucccagcagccagcc

SEQ ID NO: 851987 - RNA, 15 nt, Homo sapiens
agucccuuucagcug

SEQ ID NO: 851988 - RNA, 17 nt, Homo sapiens
agucccuuucagcugcu

SEQ ID NO: 851989 - RNA, 16 nt, Homo sapiens
agucggggcaggccag

SEQ ID NO: 851990 - RNA, 20 nt, Homo sapiens
agugaacauacuaauucuau

SEQ ID NO: 851991 - RNA, 19 nt, Homo sapiens
agugagacuagacauagua

SEQ ID NO: 851992 - RNA, 22 nt, Homo sapiens
agugagcuccggccccaccucg

SEQ ID NO: 851993 - RNA, 18 nt, Homo sapiens
agugagugaaacucccac

SEQ ID NO: 851994 - RNA, 16 nt, Homo sapiens
agugauagagugcagu

SEQ ID NO: 851995 - RNA, 14 nt, Homo sapiens
agugaugugccuaa

SEQ ID NO: 851996 - RNA, 15 nt, Homo sapiens
agugcuuguuuuaca

SEQ ID NO: 851997 - RNA, 18 nt, Homo sapiens
agugcuuguuuuacauaa

SEQ ID NO: 851998 - RNA, 18 nt, Homo sapiens
aguggcagggcacagggc

SEQ ID NO: 851999 - RNA, 13 nt, Homo sapiens
agugggcccucau

SEQ ID NO: 852000 - RNA, 19 nt, Homo sapiens
agugggcuaggaggacaag

SEQ ID NO: 852001 - RNA, 13 nt, Homo sapiens
agugguugaauau

SEQ ID NO: 852002 - RNA, 18 nt, Homo sapiens
aguguuauaugaacauac

SEQ ID NO: 852003 - RNA, 16 nt, Homo sapiens
aguguucacauggcuc

SEQ ID NO: 852004 - RNA, 21 nt, Homo sapiens
aguuaacaauuuugcacugua

SEQ ID NO: 852005 - RNA, 19 nt, Homo sapiens
aguuaacuuuuuguaggau

SEQ ID NO: 852006 - RNA, 14 nt, Homo sapiens
aguuacucucaggc

SEQ ID NO: 852007 - RNA, 13 nt, Homo sapiens
aguucaugcauug

SEQ ID NO: 852008 - RNA, 14 nt, Homo sapiens
aguucaugcauugg

SEQ ID NO: 852009 - RNA, 20 nt, Homo sapiens
aguucauggauauccacuga

SEQ ID NO: 852010 - RNA, 17 nt, Homo sapiens
aguugagcuaugacuua

SEQ ID NO: 852011 - RNA, 17 nt, Homo sapiens
aguugccguugaggguu

SEQ ID NO: 852012 - RNA, 20 nt, Homo sapiens
aguuguacauauguuucaca

SEQ ID NO: 852013 - RNA, 20 nt, Homo sapiens
aguuuaagaaguggugacau

SEQ ID NO: 852014 - RNA, 19 nt, Homo sapiens
aguuucccuaucugcaaaa

SEQ ID NO: 852015 - RNA, 22 nt, Homo sapiens
aguuucuccaaaaguggucagu

SEQ ID NO: 852016 - RNA, 13 nt, Homo sapiens
aguuuuguuucaa

SEQ ID NO: 852017 - RNA, 12 nt, Homo sapiens
aguuuuuggacu

SEQ ID NO: 852018 - RNA, 22 nt, Homo sapiens
auaaaaaucuuuuuugauauga

SEQ ID NO: 852019 - RNA, 15 nt, Homo sapiens
auaaaagaaucugau

SEQ ID NO: 852020 - RNA, 17 nt, Homo sapiens
auaaacagcuucuccaa

SEQ ID NO: 852021 - RNA, 14 nt, Homo sapiens
auaaacauuccaga

SEQ ID NO: 852022 - RNA, 16 nt, Homo sapiens
auaaaugcaaccauuu

SEQ ID NO: 852023 - RNA, 16 nt, Homo sapiens
auaacaguaguguuac

SEQ ID NO: 852024 - RNA, 13 nt, Homo sapiens
auaacagugccag

SEQ ID NO: 852025 - RNA, 21 nt, Homo sapiens
auaagcaaaaucagaaguaua

SEQ ID NO: 852026 - RNA, 19 nt, Homo sapiens
auaagugugaccaguuuug

SEQ ID NO: 852027 - RNA, 15 nt, Homo sapiens
auaauaaaauuauca

SEQ ID NO: 852028 - RNA, 18 nt, Homo sapiens
auaauaaucaugaucaca

SEQ ID NO: 852029 - RNA, 15 nt, Homo sapiens
auaauugaagagaca

SEQ ID NO: 852030 - RNA, 20 nt, Homo sapiens
auaauuuacugugacuuuau

SEQ ID NO: 852031 - RNA, 15 nt, Homo sapiens
auacaaaugcaucuu

SEQ ID NO: 852032 - RNA, 15 nt, Homo sapiens
auacaccuggacaau

SEQ ID NO: 852033 - RNA, 15 nt, Homo sapiens
auacagaaguuccau

SEQ ID NO: 852034 - RNA, 23 nt, Homo sapiens
auacagaugccauauaguguuau

SEQ ID NO: 852035 - RNA, 21 nt, Homo sapiens
auacauuccuuuuagaguuaa

SEQ ID NO: 852036 - RNA, 18 nt, Homo sapiens
auaccaguggaggaauuu

SEQ ID NO: 852037 - RNA, 15 nt, Homo sapiens
auaccauuauauguu

SEQ ID NO: 852038 - RNA, 16 nt, Homo sapiens
auacuucuacaacuuu

SEQ ID NO: 852039 - RNA, 12 nt, Homo sapiens
auagagugcagu

SEQ ID NO: 852040 - RNA, 13 nt, Homo sapiens
auagagugcagug

SEQ ID NO: 852041 - RNA, 15 nt, Homo sapiens
auaggcuucugggau

SEQ ID NO: 852042 - RNA, 17 nt, Homo sapiens
auaguauccagcacaga

SEQ ID NO: 852043 - RNA, 11 nt, Homo sapiens
auauaagcaaa

SEQ ID NO: 852044 - RNA, 22 nt, Homo sapiens
auauaaggaaagugauccaaaa

SEQ ID NO: 852045 - RNA, 15 nt, Homo sapiens
auaugaagaaucugc

SEQ ID NO: 852046 - RNA, 17 nt, Homo sapiens
auaugaucaaacuucca

SEQ ID NO: 852047 - RNA, 12 nt, Homo sapiens
auaugcugcauu

SEQ ID NO: 852048 - RNA, 14 nt, Homo sapiens
auauguguaucuca

SEQ ID NO: 852049 - RNA, 20 nt, Homo sapiens
auauguuuagcuacguuuac

SEQ ID NO: 852050 - RNA, 20 nt, Homo sapiens
auauuaaaagauuauaggaa

SEQ ID NO: 852051 - RNA, 16 nt, Homo sapiens
auauucuaagucaccu

SEQ ID NO: 852052 - RNA, 19 nt, Homo sapiens
auauuuauuuaugcuaaua

SEQ ID NO: 852053 - RNA, 16 nt, Homo sapiens
auauuucccugaaaua

SEQ ID NO: 852054 - RNA, 16 nt, Homo sapiens
aucaaggucccuucau

SEQ ID NO: 852055 - RNA, 15 nt, Homo sapiens
aucaaguaccucauc

SEQ ID NO: 852056 - RNA, 19 nt, Homo sapiens
aucacacguggugaccuca

SEQ ID NO: 852057 - RNA, 19 nt, Homo sapiens
aucacagcagggccuucug

SEQ ID NO: 852058 - RNA, 18 nt, Homo sapiens
aucacuguuuagauuugc

SEQ ID NO: 852059 - RNA, 19 nt, Homo sapiens
aucagauaauuaugcuuuu

SEQ ID NO: 852060 - RNA, 13 nt, Homo sapiens
aucagugugcaau

SEQ ID NO: 852061 - RNA, 18 nt, Homo sapiens
aucaugaaaaaugaucuc

SEQ ID NO: 852062 - RNA, 21 nt, Homo sapiens
auccacacauuuguugccaga

SEQ ID NO: 852063 - RNA, 13 nt, Homo sapiens
auccacaugggua

SEQ ID NO: 852064 - RNA, 22 nt, Homo sapiens
auccaccguccccucccaggga

SEQ ID NO: 852065 - RNA, 23 nt, Homo sapiens
auccauugucaugaaauuacccu

SEQ ID NO: 852066 - RNA, 16 nt, Homo sapiens
agaacagaaguguuca

SEQ ID NO: 852067 - RNA, 20 nt, Homo sapiens
agaacagcuucauguuccca

SEQ ID NO: 852068 - RNA, 18 nt, Homo sapiens
agaacuucccuccaucca

SEQ ID NO: 852069 - RNA, 16 nt, Homo sapiens
agaagacucacugugu

SEQ ID NO: 852070 - RNA, 18 nt, Homo sapiens
agaagcaucucugaccag

SEQ ID NO: 852071 - RNA, 15 nt, Homo sapiens
agaaggaaggcuuug

SEQ ID NO: 852072 - RNA, 22 nt, Homo sapiens
agaagguggaaggcaguguuau

SEQ ID NO: 852073 - RNA, 12 nt, Homo sapiens
agaaguacuauc

SEQ ID NO: 852074 - RNA, 22 nt, Homo sapiens
agaaguacuaucuuuguguugc

SEQ ID NO: 852075 - RNA, 11 nt, Homo sapiens
agaagugcaga

SEQ ID NO: 852076 - RNA, 20 nt, Homo sapiens
agaaguggugacauuuugca

SEQ ID NO: 852077 - RNA, 20 nt, Homo sapiens
agaaguguggucagagggga

SEQ ID NO: 852078 - RNA, 15 nt, Homo sapiens
agaaguguucacaug

SEQ ID NO: 852079 - RNA, 19 nt, Homo sapiens
agaauacccuaaaguauaa

SEQ ID NO: 852080 - RNA, 11 nt, Homo sapiens
agaauauucuu

SEQ ID NO: 852081 - RNA, 17 nt, Homo sapiens
agaaugcaccauacuca

SEQ ID NO: 852082 - RNA, 19 nt, Homo sapiens
agaauguucauacugaugu

SEQ ID NO: 852083 - RNA, 13 nt, Homo sapiens
agacaaaggccca

SEQ ID NO: 852084 - RNA, 21 nt, Homo sapiens
agacacuugaguuaacuuuuu

SEQ ID NO: 852085 - RNA, 18 nt, Homo sapiens
agacccauccugaacugg

SEQ ID NO: 852086 - RNA, 13 nt, Homo sapiens
agaccugaacugg

SEQ ID NO: 852087 - RNA, 21 nt, Homo sapiens
agacugccagcucuuccuagc

SEQ ID NO: 852088 - RNA, 19 nt, Homo sapiens
agacuggcaagaaaagagu

SEQ ID NO: 852089 - RNA, 12 nt, Homo sapiens
agacuucugucu

SEQ ID NO: 852090 - RNA, 17 nt, Homo sapiens
agacuuuuaaagacuug

SEQ ID NO: 852091 - RNA, 20 nt, Homo sapiens
agacuuuuaaagacuugcac

SEQ ID NO: 852092 - RNA, 21 nt, Homo sapiens
agagaaagugacaugcauuca

SEQ ID NO: 852093 - RNA, 23 nt, Homo sapiens
agagaagagccccacucucagag

SEQ ID NO: 852094 - RNA, 14 nt, Homo sapiens
agagaaguacuauc

SEQ ID NO: 852095 - RNA, 19 nt, Homo sapiens
agagaagugggugggcaca

SEQ ID NO: 852096 - RNA, 21 nt, Homo sapiens
agagaauaaacgccuucccaa

SEQ ID NO: 852097 - RNA, 20 nt, Homo sapiens
agagacccuggugcugccac

SEQ ID NO: 852098 - RNA, 20 nt, Homo sapiens
agagagccuuuuucuaggcc

SEQ ID NO: 852099 - RNA, 16 nt, Homo sapiens
agagagggaagcugag

SEQ ID NO: 852100 - RNA, 16 nt, Homo sapiens
agagagggucacuggg

SEQ ID NO: 852101 - RNA, 14 nt, Homo sapiens
agagcgaccagcag

SEQ ID NO: 852102 - RNA, 15 nt, Homo sapiens
agagcuccuguaaga

SEQ ID NO: 852103 - RNA, 16 nt, Homo sapiens
agagcuccuguaagag

SEQ ID NO: 852104 - RNA, 14 nt, Homo sapiens
agagggaguagggc

SEQ ID NO: 852105 - RNA, 17 nt, Homo sapiens
agagggccucaucucag

SEQ ID NO: 852106 - RNA, 12 nt, Homo sapiens
agaguacacugc

SEQ ID NO: 852107 - RNA, 21 nt, Homo sapiens
agaguauauuuaagaagccaa

SEQ ID NO: 852108 - RNA, 23 nt, Homo sapiens
agaguauauuuaagaagccaagg

SEQ ID NO: 852109 - RNA, 16 nt, Homo sapiens
agauaaaaaaacagcu

SEQ ID NO: 852110 - RNA, 19 nt, Homo sapiens
agauacacugcucucccca

SEQ ID NO: 852111 - RNA, 12 nt, Homo sapiens
agauacucuggg

SEQ ID NO: 852112 - RNA, 20 nt, Homo sapiens
agauaugaagaaucugcucu

SEQ ID NO: 852113 - RNA, 15 nt, Homo sapiens
agaucacagcagggc

SEQ ID NO: 852114 - RNA, 15 nt, Homo sapiens
agauccucucuccca

SEQ ID NO: 852115 - RNA, 22 nt, Homo sapiens
agauucugaccuuaaaugcaac

SEQ ID NO: 852116 - RNA, 18 nt, Homo sapiens
agauugaaccugaauauu

SEQ ID NO: 852117 - RNA, 15 nt, Homo sapiens
agauuuaauucccaa

SEQ ID NO: 852118 - RNA, 13 nt, Homo sapiens
agauuuccaagaa

SEQ ID NO: 852119 - RNA, 20 nt, Homo sapiens
agcaagagccaaccucacag

SEQ ID NO: 852120 - RNA, 11 nt, Homo sapiens
agcaagggcag

SEQ ID NO: 852121 - RNA, 14 nt, Homo sapiens
agcacagggacaga

SEQ ID NO: 852122 - RNA, 14 nt, Homo sapiens
agcagaaggcagga

SEQ ID NO: 852123 - RNA, 17 nt, Homo sapiens
agcagcuuuagcaaaga

SEQ ID NO: 852124 - RNA, 19 nt, Homo sapiens
agcaggggccaagcaggca

SEQ ID NO: 852125 - RNA, 15 nt, Homo sapiens
agcaucuaaggacaa

SEQ ID NO: 852126 - RNA, 21 nt, Homo sapiens
agcaugaggcagcacgugcac

SEQ ID NO: 852127 - RNA, 14 nt, Homo sapiens
agcauggggcuugu

SEQ ID NO: 852128 - RNA, 17 nt, Homo sapiens
agcauucucuccauuuc

SEQ ID NO: 852129 - RNA, 18 nt, Homo sapiens
agcauucucuccauuuca

SEQ ID NO: 852130 - RNA, 14 nt, Homo sapiens
agccaacugucagg

SEQ ID NO: 852131 - RNA, 19 nt, Homo sapiens
agccagcgaacugacauua

SEQ ID NO: 852132 - RNA, 17 nt, Homo sapiens
agcccagaagugcagaa

SEQ ID NO: 852133 - RNA, 16 nt, Homo sapiens
agcccagcagacauca

SEQ ID NO: 852134 - RNA, 24 nt, Homo sapiens
agcccagcagacaucaagcucaag

SEQ ID NO: 852135 - RNA, 22 nt, Homo sapiens
agcccagcuuuuccugggacau

SEQ ID NO: 852136 - RNA, 14 nt, Homo sapiens
agccccauuaacug

SEQ ID NO: 852137 - RNA, 18 nt, Homo sapiens
agcccccagcuuccagca

SEQ ID NO: 852138 - RNA, 20 nt, Homo sapiens
agccccuggggcggugcugg

SEQ ID NO: 852139 - RNA, 20 nt, Homo sapiens
agcccuuucagcugcagcug

SEQ ID NO: 852140 - RNA, 14 nt, Homo sapiens
agccgcagagaaua

SEQ ID NO: 852141 - RNA, 17 nt, Homo sapiens
agccuagauaugaagaa

SEQ ID NO: 852142 - RNA, 21 nt, Homo sapiens
agccucccugacgucugccac

SEQ ID NO: 852143 - RNA, 18 nt, Homo sapiens
agccuccugaucaggaaa

SEQ ID NO: 852144 - RNA, 20 nt, Homo sapiens
agccucuggaauggcucagg

SEQ ID NO: 852145 - RNA, 13 nt, Homo sapiens
agccuucauuuua

SEQ ID NO: 852146 - RNA, 16 nt, Homo sapiens
agcgacagugugggac

SEQ ID NO: 852147 - RNA, 20 nt, Homo sapiens
agcguccacucuucaugccu

SEQ ID NO: 852148 - RNA, 15 nt, Homo sapiens
agcgugucaggcugu

SEQ ID NO: 852149 - RNA, 13 nt, Homo sapiens
agcuaaaacuggc

SEQ ID NO: 852150 - RNA, 15 nt, Homo sapiens
agcuaaaacuggccc

SEQ ID NO: 852151 - RNA, 21 nt, Homo sapiens
agcuacguuuacucacagcca

SEQ ID NO: 852152 - RNA, 16 nt, Homo sapiens
agcuagaacauuccau

SEQ ID NO: 852153 - RNA, 19 nt, Homo sapiens
agcuagaacauuccauuug

SEQ ID NO: 852154 - RNA, 22 nt, Homo sapiens
agcuagacuagcuguaaaggac

SEQ ID NO: 852155 - RNA, 18 nt, Homo sapiens
agcucaaggcaaugggcu

SEQ ID NO: 852156 - RNA, 17 nt, Homo sapiens
agcucguccccauugcu

SEQ ID NO: 852157 - RNA, 20 nt, Homo sapiens
agcucguccccauugcuuaa

SEQ ID NO: 852158 - RNA, 18 nt, Homo sapiens
agcucuuuaacaugguuc

SEQ ID NO: 852159 - RNA, 23 nt, Homo sapiens
agcucuuuaacaugguucaggua

SEQ ID NO: 852160 - RNA, 20 nt, Homo sapiens
agcugaggcccauggccaca

SEQ ID NO: 852161 - RNA, 21 nt, Homo sapiens
agcuggcccgucaagugcugc

SEQ ID NO: 852162 - RNA, 23 nt, Homo sapiens
agcuguugacucuaguacuguga

SEQ ID NO: 852163 - RNA, 23 nt, Homo sapiens
agcuuauaaacagaagugacuga

SEQ ID NO: 852164 - RNA, 15 nt, Homo sapiens
agcuuuaaugauaug

SEQ ID NO: 852165 - RNA, 18 nt, Homo sapiens
aggaaaaaaagauuucca

SEQ ID NO: 852166 - RNA, 12 nt, Homo sapiens
aggaaaggcccu

SEQ ID NO: 852167 - RNA, 21 nt, Homo sapiens
aggaaaucuuuacuccuguaa

SEQ ID NO: 852168 - RNA, 17 nt, Homo sapiens
aggaacagcucgggcca

SEQ ID NO: 852169 - RNA, 14 nt, Homo sapiens
aggaagaaagggaa

SEQ ID NO: 852170 - RNA, 15 nt, Homo sapiens
aggaauaugggagaa

SEQ ID NO: 852171 - RNA, 14 nt, Homo sapiens
aggacaaucuagcu

SEQ ID NO: 852172 - RNA, 11 nt, Homo sapiens
aggaccacuga

SEQ ID NO: 852173 - RNA, 20 nt, Homo sapiens
aggacgacuguuuucccaac

SEQ ID NO: 852174 - RNA, 20 nt, Homo sapiens
aggagacccuagaugugcuc

SEQ ID NO: 852175 - RNA, 21 nt, Homo sapiens
aggagaccuguaucaaacugc

SEQ ID NO: 852176 - RNA, 16 nt, Homo sapiens
aggagcauugcaguca

SEQ ID NO: 852177 - RNA, 16 nt, Homo sapiens
aggagccccaguggug

SEQ ID NO: 852178 - RNA, 19 nt, Homo sapiens
aggagcuagaacauuccau

SEQ ID NO: 852179 - RNA, 14 nt, Homo sapiens
aggaggacaaggac

SEQ ID NO: 852180 - RNA, 20 nt, Homo sapiens
aggaguggauuccuccccac

SEQ ID NO: 852181 - RNA, 19 nt, Homo sapiens
aggauacuugcuccauuca

SEQ ID NO: 852182 - RNA, 16 nt, Homo sapiens
aggaugugcugcagug

SEQ ID NO: 852183 - RNA, 14 nt, Homo sapiens
aggauugucacucc

SEQ ID NO: 852184 - RNA, 12 nt, Homo sapiens
aggcacugccug

SEQ ID NO: 852185 - RNA, 17 nt, Homo sapiens
aggcauauauguacuag

SEQ ID NO: 852186 - RNA, 17 nt, Homo sapiens
aggcaucaccaugaaca

SEQ ID NO: 852187 - RNA, 15 nt, Homo sapiens
aggccacacuacaca

SEQ ID NO: 852188 - RNA, 18 nt, Homo sapiens
uuucaaguacacugaauu

SEQ ID NO: 852189 - RNA, 20 nt, Homo sapiens
uuucagaauuuaaucuuuga

SEQ ID NO: 852190 - RNA, 15 nt, Homo sapiens
uuucagguggccagg

SEQ ID NO: 852191 - RNA, 21 nt, Homo sapiens
uuucaucagaacagcuguuga

SEQ ID NO: 852192 - RNA, 20 nt, Homo sapiens
uuucaugaagcaagaaugga

SEQ ID NO: 852193 - RNA, 19 nt, Homo sapiens
uuucccuguagauguauca

SEQ ID NO: 852194 - RNA, 17 nt, Homo sapiens
uuuccuuucaguggcuu

SEQ ID NO: 852195 - RNA, 19 nt, Homo sapiens
uuucucugcacacaagagg

SEQ ID NO: 852196 - RNA, 20 nt, Homo sapiens
uuucugcuuuagacuugaaa

SEQ ID NO: 852197 - RNA, 19 nt, Homo sapiens
uuucuuguaaacauugccu

SEQ ID NO: 852198 - RNA, 18 nt, Homo sapiens
uuucuuugcuagcacaau

SEQ ID NO: 852199 - RNA, 14 nt, Homo sapiens
uuugaaaacaccag

SEQ ID NO: 852200 - RNA, 17 nt, Homo sapiens
uuugaaaguacuccuua

SEQ ID NO: 852201 - RNA, 20 nt, Homo sapiens
uuugaaauaaaaauggauca

SEQ ID NO: 852202 - RNA, 12 nt, Homo sapiens
uuugaaucugac

SEQ ID NO: 852203 - RNA, 22 nt, Homo sapiens
uuugagcucccacuucugccag

SEQ ID NO: 852204 - RNA, 12 nt, Homo sapiens
uuugcagugucu

SEQ ID NO: 852205 - RNA, 16 nt, Homo sapiens
uuugccaaucauugca

SEQ ID NO: 852206 - RNA, 12 nt, Homo sapiens
uuugccauuugc

SEQ ID NO: 852207 - RNA, 15 nt, Homo sapiens
uuugccccuggcaaa

SEQ ID NO: 852208 - RNA, 22 nt, Homo sapiens
uuugcuaagaauagauggaaga

SEQ ID NO: 852209 - RNA, 14 nt, Homo sapiens
uuugcuguaccaca

SEQ ID NO: 852210 - RNA, 15 nt, Homo sapiens
uuugcuguaccacaa

SEQ ID NO: 852211 - RNA, 14 nt, Homo sapiens
uuuggaacuuacaa

SEQ ID NO: 852212 - RNA, 20 nt, Homo sapiens
uuugucaugccauuaagcuc

SEQ ID NO: 852213 - RNA, 17 nt, Homo sapiens
uuuuaaagacuugcaca

SEQ ID NO: 852214 - RNA, 17 nt, Homo sapiens
uuuuagaaugucaauaa

SEQ ID NO: 852215 - RNA, 13 nt, Homo sapiens
uuuuaggaagcua

SEQ ID NO: 852216 - RNA, 17 nt, Homo sapiens
uuuuccagauuugcuca

SEQ ID NO: 852217 - RNA, 18 nt, Homo sapiens
uuuuccucccgugccuga

SEQ ID NO: 852218 - RNA, 13 nt, Homo sapiens
uuuucuacuuuga

SEQ ID NO: 852219 - RNA, 14 nt, Homo sapiens
uuuucuacuuugaa

SEQ ID NO: 852220 - RNA, 22 nt, Homo sapiens
uuuucuuuauugcuuacugugu

SEQ ID NO: 852221 - RNA, 16 nt, Homo sapiens
uuuucuuuccuuuuca

SEQ ID NO: 852222 - RNA, 13 nt, Homo sapiens
uuuuuauaggcuu

SEQ ID NO: 852223 - RNA, 14 nt, Homo sapiens
uuuuucaugcuuua

SEQ ID NO: 852224 - RNA, 14 nt, Homo sapiens
uuuuucugcacaau

SEQ ID NO: 852225 - RNA, 17 nt, Homo sapiens
uuuuucuuuccuuuccc

SEQ ID NO: 852226 - RNA, 21 nt, Homo sapiens
uuuuuguaugaaaacauggaa

SEQ ID NO: 852227 - RNA, 13 nt, Homo sapiens
uuuuuuuaaagga

SEQ ID NO: 852228 - RNA, 15 nt, Homo sapiens
cuguauaucagggua

SEQ ID NO: 852229 - RNA, 17 nt, Homo sapiens
cuguccacuuggagcua

SEQ ID NO: 852230 - RNA, 20 nt, Homo sapiens
cuguccacuuggagcuaaaa

SEQ ID NO: 852231 - RNA, 19 nt, Homo sapiens
cugucgcacccacugugaa

SEQ ID NO: 852232 - RNA, 14 nt, Homo sapiens
cugugaacaugccu

SEQ ID NO: 852233 - RNA, 12 nt, Homo sapiens
cugugagcacau

SEQ ID NO: 852234 - RNA, 20 nt, Homo sapiens
cugugcccagcuuccaugcu

SEQ ID NO: 852235 - RNA, 22 nt, Homo sapiens
cugugcccagcuuccaugcuga

SEQ ID NO: 852236 - RNA, 17 nt, Homo sapiens
cuguggcugucuuguca

SEQ ID NO: 852237 - RNA, 14 nt, Homo sapiens
cuguguaccacugg

SEQ ID NO: 852238 - RNA, 17 nt, Homo sapiens
cuguguaccacugggau

SEQ ID NO: 852239 - RNA, 18 nt, Homo sapiens
cuguguaccacugggaua

SEQ ID NO: 852240 - RNA, 20 nt, Homo sapiens
cuguuaaaggucauaugcac

SEQ ID NO: 852241 - RNA, 18 nt, Homo sapiens
cuguuacacuuuuuggaa

SEQ ID NO: 852242 - RNA, 19 nt, Homo sapiens
cuguuggcaaauuugugaa

SEQ ID NO: 852243 - RNA, 19 nt, Homo sapiens
cuguuggucaaaaucugca

SEQ ID NO: 852244 - RNA, 19 nt, Homo sapiens
cuguuguauuaccaaagca

SEQ ID NO: 852245 - RNA, 14 nt, Homo sapiens
cuguuucagaccag

SEQ ID NO: 852246 - RNA, 14 nt, Homo sapiens
cuuaaccacuuuca

SEQ ID NO: 852247 - RNA, 14 nt, Homo sapiens
cuuacguaguucua

SEQ ID NO: 852248 - RNA, 16 nt, Homo sapiens
cuuagaaucccugugu

SEQ ID NO: 852249 - RNA, 16 nt, Homo sapiens
cuuagccagcccuggc

SEQ ID NO: 852250 - RNA, 21 nt, Homo sapiens
cuuaguacauuugaugcaaaa

SEQ ID NO: 852251 - RNA, 17 nt, Homo sapiens
cuuaucagugugcaaua

SEQ ID NO: 852252 - RNA, 20 nt, Homo sapiens
cuuaugacuaaaaauaucac

SEQ ID NO: 852253 - RNA, 22 nt, Homo sapiens
cuuaugauagcaaauggccuca

SEQ ID NO: 852254 - RNA, 19 nt, Homo sapiens
cuuauuaaccaugucuguu

SEQ ID NO: 852255 - RNA, 19 nt, Homo sapiens
cuuauuuauguaacaaagu

SEQ ID NO: 852256 - RNA, 21 nt, Homo sapiens
cuuauuuauguaacaaaguuu

SEQ ID NO: 852257 - RNA, 14 nt, Homo sapiens
cuucauccagggaa

SEQ ID NO: 852258 - RNA, 20 nt, Homo sapiens
cuuccaguggcuucucccaa

SEQ ID NO: 852259 - RNA, 22 nt, Homo sapiens
cuucccaaaauggcaacuuccc

SEQ ID NO: 852260 - RNA, 16 nt, Homo sapiens
cuucgcagccuagaua

SEQ ID NO: 852261 - RNA, 23 nt, Homo sapiens
cuucuaaugcaagggucucacac

SEQ ID NO: 852262 - RNA, 20 nt, Homo sapiens
cuucugaacguuugguucaa

SEQ ID NO: 852263 - RNA, 21 nt, Homo sapiens
cuucugccacugcugggcucc

SEQ ID NO: 852264 - RNA, 21 nt, Homo sapiens
cuucuggacccuugaguccaa

SEQ ID NO: 852265 - RNA, 21 nt, Homo sapiens
cuucugugcccagaauacuga

SEQ ID NO: 852266 - RNA, 14 nt, Homo sapiens
cuugaagcuuguau

SEQ ID NO: 852267 - RNA, 17 nt, Homo sapiens
cuugaauaaacaccacu

SEQ ID NO: 852268 - RNA, 21 nt, Homo sapiens
cuugacaaaggagcauugcag

SEQ ID NO: 852269 - RNA, 13 nt, Homo sapiens
cuugacucuuaca

SEQ ID NO: 852270 - RNA, 16 nt, Homo sapiens
cuugagagaggccaca

SEQ ID NO: 852271 - RNA, 21 nt, Homo sapiens
cuugcugccacaccacauugc

SEQ ID NO: 852272 - RNA, 11 nt, Homo sapiens
cuuggaaccac

SEQ ID NO: 852273 - RNA, 14 nt, Homo sapiens
cuuggagcuaaaac

SEQ ID NO: 852274 - RNA, 20 nt, Homo sapiens
cuuggagcuaaaacuggccc

SEQ ID NO: 852275 - RNA, 18 nt, Homo sapiens
cuuggauguuuuuaguuc

SEQ ID NO: 852276 - RNA, 12 nt, Homo sapiens
cuugggggcuca

SEQ ID NO: 852277 - RNA, 15 nt, Homo sapiens
cuugggugucugaac

SEQ ID NO: 852278 - RNA, 15 nt, Homo sapiens
cuuguaacuaaaaua

SEQ ID NO: 852279 - RNA, 19 nt, Homo sapiens
cuuguucuggcugucacca

SEQ ID NO: 852280 - RNA, 15 nt, Homo sapiens
cuuuaauccaaaagg

SEQ ID NO: 852281 - RNA, 17 nt, Homo sapiens
cuuuaugcccuugccuc

SEQ ID NO: 852282 - RNA, 18 nt, Homo sapiens
cuuuccuuuccuuucauu

SEQ ID NO: 852283 - RNA, 20 nt, Homo sapiens
cuuucuauaauuuuacaagg

SEQ ID NO: 852284 - RNA, 14 nt, Homo sapiens
cuuucucaccagcc

SEQ ID NO: 852285 - RNA, 19 nt, Homo sapiens
cuuucuguguaccacuggg

SEQ ID NO: 852286 - RNA, 22 nt, Homo sapiens
cuuugaaaacaccagcuguaua

SEQ ID NO: 852287 - RNA, 14 nt, Homo sapiens
cuuugcagcacagc

SEQ ID NO: 852288 - RNA, 22 nt, Homo sapiens
cuuuuaaacugauuacguuuac

SEQ ID NO: 852289 - RNA, 20 nt, Homo sapiens
cuuuuaaauuauacaaugau

SEQ ID NO: 852290 - RNA, 20 nt, Homo sapiens
cuuuucaaccacaaaacuca

SEQ ID NO: 852291 - RNA, 17 nt, Homo sapiens
cuuuucuauauugcagu

SEQ ID NO: 852292 - RNA, 22 nt, Homo sapiens
cuuuugaacacguucgacaaaa

SEQ ID NO: 852293 - RNA, 17 nt, Homo sapiens
cuuuuuacaucuauccc

SEQ ID NO: 852294 - RNA, 14 nt, Homo sapiens
cuuuuuugccaaau

SEQ ID NO: 852295 - RNA, 22 nt, Homo sapiens
cuuuuuuuauaucagaaugagg

SEQ ID NO: 852296 - RNA, 21 nt, Homo sapiens
cuuuuuuucccuuuucuuucc

SEQ ID NO: 852297 - RNA, 15 nt, Homo sapiens
gaaaaaaaugucaaa

SEQ ID NO: 852298 - RNA, 17 nt, Homo sapiens
gaaaacauaacugauac

SEQ ID NO: 852299 - RNA, 13 nt, Homo sapiens
gaaaagcugugua

SEQ ID NO: 852300 - RNA, 12 nt, Homo sapiens
gaaacauucacu

SEQ ID NO: 852301 - RNA, 21 nt, Homo sapiens
gaaacuuaaaugaacacagcu

SEQ ID NO: 852302 - RNA, 21 nt, Homo sapiens
gaaagaaaacuuuuaugcaag

SEQ ID NO: 852303 - RNA, 13 nt, Homo sapiens
gaaagaggccaaa

SEQ ID NO: 852304 - RNA, 22 nt, Homo sapiens
gaaagaggccaaacaggcccuc

SEQ ID NO: 852305 - RNA, 18 nt, Homo sapiens
gaaagcaaaauaacaaaa

SEQ ID NO: 852306 - RNA, 22 nt, Homo sapiens
gaaaggcuuuucaaccacaaaa

SEQ ID NO: 852307 - RNA, 23 nt, Homo sapiens
gaaaggggagaaauaaacauaag

SEQ ID NO: 852308 - RNA, 20 nt, Homo sapiens
gaaaguaagggaagcagaag

SEQ ID NO: 852309 - RNA, 13 nt, Homo sapiens
gaaauacacaggg

SEQ ID NO: 852310 - RNA, 15 nt, Homo sapiens
gaaauacaccuggac

SEQ ID NO: 852311 - RNA, 19 nt, Homo sapiens
gaaauacaccuggacaauu

SEQ ID NO: 852312 - RNA, 15 nt, Homo sapiens
gaaaucccugcucac

SEQ ID NO: 852313 - RNA, 12 nt, Homo sapiens
gaaaugaucauu

SEQ ID NO: 852314 - RNA, 21 nt, Homo sapiens
gaaauuguuuugcaaauggau

SEQ ID NO: 852315 - RNA, 21 nt, Homo sapiens
gaacaaugaauuauccagcau

SEQ ID NO: 852316 - RNA, 20 nt, Homo sapiens
gaacaauuaaaauauucuuu

SEQ ID NO: 852317 - RNA, 17 nt, Homo sapiens
gaacacaagaagaccca

SEQ ID NO: 852318 - RNA, 22 nt, Homo sapiens
gaacaccgugggcuguuacuug

SEQ ID NO: 852319 - RNA, 18 nt, Homo sapiens
gaacagaaguguucacau

SEQ ID NO: 852320 - RNA, 18 nt, Homo sapiens
gaacauugguucuuucau

SEQ ID NO: 852321 - RNA, 18 nt, Homo sapiens
gaaccacacagcuaaggg

SEQ ID NO: 852322 - RNA, 20 nt, Homo sapiens
gaaccacuuguagauuugau

SEQ ID NO: 852323 - RNA, 18 nt, Homo sapiens
gaacccagaaacaacaca

SEQ ID NO: 852324 - RNA, 22 nt, Homo sapiens
gaaccccaccucccucccaccu

SEQ ID NO: 852325 - RNA, 15 nt, Homo sapiens
gaaccucacugaaaa

SEQ ID NO: 852326 - RNA, 22 nt, Homo sapiens
gaacucuucucauuacuuguug

SEQ ID NO: 852327 - RNA, 15 nt, Homo sapiens
gaacugcugcugacc

SEQ ID NO: 852328 - RNA, 23 nt, Homo sapiens
gaacuuucauuuuauauguuucu

SEQ ID NO: 852329 - RNA, 13 nt, Homo sapiens
gaagaaaagaaga

SEQ ID NO: 852330 - RNA, 15 nt, Homo sapiens
gaagaaucugcucug

SEQ ID NO: 852331 - RNA, 16 nt, Homo sapiens
gaagaauuuacuuugg

SEQ ID NO: 852332 - RNA, 13 nt, Homo sapiens
gaagacuacaauu

SEQ ID NO: 852333 - RNA, 16 nt, Homo sapiens
gaagacucacugugug

SEQ ID NO: 852334 - RNA, 23 nt, Homo sapiens
gaagaggcaagcccugccucugg

SEQ ID NO: 852335 - RNA, 15 nt, Homo sapiens
gaagaucgugaugcu

SEQ ID NO: 852336 - RNA, 18 nt, Homo sapiens
gaagcauuugauuuucaa

SEQ ID NO: 852337 - RNA, 16 nt, Homo sapiens
gaagccaagggggacc

SEQ ID NO: 852338 - RNA, 19 nt, Homo sapiens
gaagcugaggcugcugcca

SEQ ID NO: 852339 - RNA, 21 nt, Homo sapiens
gaagcugaggcugcugccagg

SEQ ID NO: 852340 - RNA, 21 nt, Homo sapiens
gaagcugcggcccugaucucc

SEQ ID NO: 852341 - RNA, 19 nt, Homo sapiens
gaagggguuuucuugauaa

SEQ ID NO: 852342 - RNA, 11 nt, Homo sapiens
gaagugaaaac

SEQ ID NO: 852343 - RNA, 17 nt, Homo sapiens
gaagugaguguaaucca

SEQ ID NO: 852344 - RNA, 19 nt, Homo sapiens
gaagugcaugggucagggu

SEQ ID NO: 852345 - RNA, 17 nt, Homo sapiens
gaaguuaaaagcacaaa

SEQ ID NO: 852346 - RNA, 14 nt, Homo sapiens
gaauaugggagaaa

SEQ ID NO: 852347 - RNA, 23 nt, Homo sapiens
gaauauuuaagcaauaaaacugc

SEQ ID NO: 852348 - RNA, 17 nt, Homo sapiens
gaaugaggcaauuucaa

SEQ ID NO: 852349 - RNA, 16 nt, Homo sapiens
gaauggaggaauccuu

SEQ ID NO: 852350 - RNA, 22 nt, Homo sapiens
gaauuuaaucuuugaggaaaag

SEQ ID NO: 852351 - RNA, 13 nt, Homo sapiens
gaauuuuagcaca

SEQ ID NO: 852352 - RNA, 20 nt, Homo sapiens
gacaauauaagagcuuccaa

SEQ ID NO: 852353 - RNA, 22 nt, Homo sapiens
gacaauuucuagaagacuacaa

SEQ ID NO: 852354 - RNA, 23 nt, Homo sapiens
gacaccacagccuccccuuccca

SEQ ID NO: 852355 - RNA, 15 nt, Homo sapiens
gacacuguggcagca

SEQ ID NO: 852356 - RNA, 19 nt, Homo sapiens
gacagcaaacagaucacua

SEQ ID NO: 852357 - RNA, 14 nt, Homo sapiens
gacagcuauaauua

SEQ ID NO: 852358 - RNA, 14 nt, Homo sapiens
gacaucaagcucaa

SEQ ID NO: 852359 - RNA, 23 nt, Homo sapiens
gcauguuggacucugagcucauu

SEQ ID NO: 852360 - RNA, 18 nt, Homo sapiens
gcauucuaaaugaacuca

SEQ ID NO: 852361 - RNA, 15 nt, Homo sapiens
gcauugcagucacuu

SEQ ID NO: 852362 - RNA, 15 nt, Homo sapiens
gcauuuuuuaccaca

SEQ ID NO: 852363 - RNA, 16 nt, Homo sapiens
gccaagggaaggcuau

SEQ ID NO: 852364 - RNA, 13 nt, Homo sapiens
gccaaucauugca

SEQ ID NO: 852365 - RNA, 15 nt, Homo sapiens
gccaauucguucucu

SEQ ID NO: 852366 - RNA, 21 nt, Homo sapiens
gccacacccagaguagccaug

SEQ ID NO: 852367 - RNA, 20 nt, Homo sapiens
gccaccacgccuagccucac

SEQ ID NO: 852368 - RNA, 16 nt, Homo sapiens
gccagcagccucugau

SEQ ID NO: 852369 - RNA, 17 nt, Homo sapiens
gccagccauuugggaga

SEQ ID NO: 852370 - RNA, 17 nt, Homo sapiens
gccagcuuuuccagaaa

SEQ ID NO: 852371 - RNA, 18 nt, Homo sapiens
gccaggccuuggggacaa

SEQ ID NO: 852372 - RNA, 14 nt, Homo sapiens
gccaggcugcucuc

SEQ ID NO: 852373 - RNA, 16 nt, Homo sapiens
gccagugccauuucag

SEQ ID NO: 852374 - RNA, 13 nt, Homo sapiens
gcccacugugcag

SEQ ID NO: 852375 - RNA, 15 nt, Homo sapiens
gcccagaagugcaga

SEQ ID NO: 852376 - RNA, 16 nt, Homo sapiens
gcccagcucggaucaa

SEQ ID NO: 852377 - RNA, 17 nt, Homo sapiens
gcccaucagcuaccccu

SEQ ID NO: 852378 - RNA, 13 nt, Homo sapiens
gcccaucaggggc

SEQ ID NO: 852379 - RNA, 18 nt, Homo sapiens
gcccaugugcccacuguc

SEQ ID NO: 852380 - RNA, 14 nt, Homo sapiens
gccccaaccacaaa

SEQ ID NO: 852381 - RNA, 16 nt, Homo sapiens
gccccaaccacaggaa

SEQ ID NO: 852382 - RNA, 22 nt, Homo sapiens
gccccaggcugcggcuugccca

SEQ ID NO: 852383 - RNA, 24 nt, Homo sapiens
gcccccagcuucugccacgcuuua

SEQ ID NO: 852384 - RNA, 17 nt, Homo sapiens
gcccuauuucuugauaa

SEQ ID NO: 852385 - RNA, 21 nt, Homo sapiens
gcccucugcucuaauugcugc

SEQ ID NO: 852386 - RNA, 17 nt, Homo sapiens
gcccugagccacugagu

SEQ ID NO: 852387 - RNA, 14 nt, Homo sapiens
gcccuggagcucaa

SEQ ID NO: 852388 - RNA, 23 nt, Homo sapiens
gccgcaucucacagcuaugcaaa

SEQ ID NO: 852389 - RNA, 16 nt, Homo sapiens
gccguggguucaggug

SEQ ID NO: 852390 - RNA, 12 nt, Homo sapiens
gccuagccucac

SEQ ID NO: 852391 - RNA, 15 nt, Homo sapiens
gccuauaagccaaaa

SEQ ID NO: 852392 - RNA, 13 nt, Homo sapiens
gccuccaccucug

SEQ ID NO: 852393 - RNA, 21 nt, Homo sapiens
gccuccagaacuuagcaauuu

SEQ ID NO: 852394 - RNA, 16 nt, Homo sapiens
gccucugaucugugca

SEQ ID NO: 852395 - RNA, 14 nt, Homo sapiens
gccucuugggugcu

SEQ ID NO: 852396 - RNA, 13 nt, Homo sapiens
gccuguuaauauu

SEQ ID NO: 852397 - RNA, 12 nt, Homo sapiens
gccuuaaauaua

SEQ ID NO: 852398 - RNA, 13 nt, Homo sapiens
gccuuaacccugu

SEQ ID NO: 852399 - RNA, 16 nt, Homo sapiens
gccuuaacuguucagu

SEQ ID NO: 852400 - RNA, 18 nt, Homo sapiens
gccuucugccugcugacc

SEQ ID NO: 852401 - RNA, 17 nt, Homo sapiens
gccuugugggugugagc

SEQ ID NO: 852402 - RNA, 23 nt, Homo sapiens
gcgaaaucccugcucacugcagc

SEQ ID NO: 852403 - RNA, 16 nt, Homo sapiens
gcggagcuugcaguga

SEQ ID NO: 852404 - RNA, 22 nt, Homo sapiens
gcuaaaaucauccuauuacuua

SEQ ID NO: 852405 - RNA, 23 nt, Homo sapiens
gcuaauccggaaaucagcaaacu

SEQ ID NO: 852406 - RNA, 21 nt, Homo sapiens
gcuacaagauuuuuuuacuua

SEQ ID NO: 852407 - RNA, 14 nt, Homo sapiens
gcuagaacauucca

SEQ ID NO: 852408 - RNA, 19 nt, Homo sapiens
gcuaggaggacaaggaccg

SEQ ID NO: 852409 - RNA, 11 nt, Homo sapiens
gcuauaugcau

SEQ ID NO: 852410 - RNA, 17 nt, Homo sapiens
gcucccacuucugccag

SEQ ID NO: 852411 - RNA, 14 nt, Homo sapiens
gcuccgacugcccu

SEQ ID NO: 852412 - RNA, 19 nt, Homo sapiens
gcuccguagcuucuagucu

SEQ ID NO: 852413 - RNA, 17 nt, Homo sapiens
gcuccuagaguauauuc

SEQ ID NO: 852414 - RNA, 12 nt, Homo sapiens
gcucuccauacu

SEQ ID NO: 852415 - RNA, 16 nt, Homo sapiens
gcucugaaaacaaaaa

SEQ ID NO: 852416 - RNA, 17 nt, Homo sapiens
gcugaaagaggccaaac

SEQ ID NO: 852417 - RNA, 21 nt, Homo sapiens
gcugaaaugguccaguacaaa

SEQ ID NO: 852418 - RNA, 16 nt, Homo sapiens
gcugaacauugcauau

SEQ ID NO: 852419 - RNA, 12 nt, Homo sapiens
gcugacaucugg

SEQ ID NO: 852420 - RNA, 18 nt, Homo sapiens
gcugauacuucuacaacu

SEQ ID NO: 852421 - RNA, 16 nt, Homo sapiens
gcugcagugcaugggg

SEQ ID NO: 852422 - RNA, 14 nt, Homo sapiens
gcuggaauauuaaa

SEQ ID NO: 852423 - RNA, 18 nt, Homo sapiens
gcugggguagaacuggcu

SEQ ID NO: 852424 - RNA, 20 nt, Homo sapiens
gcuggugacccagcaucuga

SEQ ID NO: 852425 - RNA, 17 nt, Homo sapiens
gcuguaaggcaugaagg

SEQ ID NO: 852426 - RNA, 12 nt, Homo sapiens
gcuguaccacaa

SEQ ID NO: 852427 - RNA, 21 nt, Homo sapiens
gcugugaaggaguaaugggau

SEQ ID NO: 852428 - RNA, 22 nt, Homo sapiens
gcuguuuaaaaguaaugcaaua

SEQ ID NO: 852429 - RNA, 23 nt, Homo sapiens
gcuuaagguggaaaguguucauu

SEQ ID NO: 852430 - RNA, 23 nt, Homo sapiens
gcuuagaaaauuguccuccuugu

SEQ ID NO: 852431 - RNA, 19 nt, Homo sapiens
gcuucucuccuaucugugc

SEQ ID NO: 852432 - RNA, 23 nt, Homo sapiens
gcuucugaugaucauuguugcca

SEQ ID NO: 852433 - RNA, 16 nt, Homo sapiens
gcuucuugcuuacagg

SEQ ID NO: 852434 - RNA, 18 nt, Homo sapiens
gcuugaauaaacaccacu

SEQ ID NO: 852435 - RNA, 16 nt, Homo sapiens
gcuuuaucaauagccc

SEQ ID NO: 852436 - RNA, 15 nt, Homo sapiens
gcuuuccacauuucu

SEQ ID NO: 852437 - RNA, 14 nt, Homo sapiens
gcuuugcugcuuau

SEQ ID NO: 852438 - RNA, 16 nt, Homo sapiens
gcuuuggcaaugccca

SEQ ID NO: 852439 - RNA, 16 nt, Homo sapiens
gcuuuuaaacugauua

SEQ ID NO: 852440 - RNA, 19 nt, Homo sapiens
gcuuuuucucagcccugac

SEQ ID NO: 852441 - RNA, 14 nt, Homo sapiens
ggaaaaugggacau

SEQ ID NO: 852442 - RNA, 15 nt, Homo sapiens
ggaacuuacaaaggg

SEQ ID NO: 852443 - RNA, 14 nt, Homo sapiens
ggaagaaagggaaa

SEQ ID NO: 852444 - RNA, 15 nt, Homo sapiens
ggaagcugaggccca

SEQ ID NO: 852445 - RNA, 17 nt, Homo sapiens
ggaaggcuaucagagac

SEQ ID NO: 852446 - RNA, 15 nt, Homo sapiens
ggaagguucauugcc

SEQ ID NO: 852447 - RNA, 15 nt, Homo sapiens
ggacaccccacggga

SEQ ID NO: 852448 - RNA, 14 nt, Homo sapiens
ggacccaguggcag

SEQ ID NO: 852449 - RNA, 15 nt, Homo sapiens
ggaccccaucuguga

SEQ ID NO: 852450 - RNA, 17 nt, Homo sapiens
ggaccccaucugugaau

SEQ ID NO: 852451 - RNA, 10 nt, Homo sapiens
ggacccugcc

SEQ ID NO: 852452 - RNA, 12 nt, Homo sapiens
ggacguccaggu

SEQ ID NO: 852453 - RNA, 16 nt, Homo sapiens
ggacuagaugacucuc

SEQ ID NO: 852454 - RNA, 21 nt, Homo sapiens
ggacuccucucguacuugaac

SEQ ID NO: 852455 - RNA, 18 nt, Homo sapiens
ggagaaauaaacauaaga

SEQ ID NO: 852456 - RNA, 19 nt, Homo sapiens
ggagaaugcaccauacuca

SEQ ID NO: 852457 - RNA, 17 nt, Homo sapiens
ggagauccuuguguuua

SEQ ID NO: 852458 - RNA, 21 nt, Homo sapiens
ggagauccuuguguuuaucag

SEQ ID NO: 852459 - RNA, 18 nt, Homo sapiens
ggagcagccagccauuug

SEQ ID NO: 852460 - RNA, 20 nt, Homo sapiens
ggagccccaucuaggggagc

SEQ ID NO: 852461 - RNA, 13 nt, Homo sapiens
ggagcuaaaacug

SEQ ID NO: 852462 - RNA, 16 nt, Homo sapiens
ggagcuagaacauucc

SEQ ID NO: 852463 - RNA, 23 nt, Homo sapiens
ggagcuagaacauuccauuugcu

SEQ ID NO: 852464 - RNA, 12 nt, Homo sapiens
ggaggccaccuc

SEQ ID NO: 852465 - RNA, 16 nt, Homo sapiens
ggagggacagucucac

SEQ ID NO: 852466 - RNA, 23 nt, Homo sapiens
ggaguagggcucgccauguuucu

SEQ ID NO: 852467 - RNA, 18 nt, Homo sapiens
ggagugaccaaaaugcca

SEQ ID NO: 852468 - RNA, 21 nt, Homo sapiens
ggagugccuucauacacugua

SEQ ID NO: 852469 - RNA, 13 nt, Homo sapiens
ggauagauuucau

SEQ ID NO: 852470 - RNA, 15 nt, Homo sapiens
ggaugaaaucauauu

SEQ ID NO: 852471 - RNA, 18 nt, Homo sapiens
ggaugcuccagauggugg

SEQ ID NO: 852472 - RNA, 15 nt, Homo sapiens
ggauggcaguggcug

SEQ ID NO: 852473 - RNA, 11 nt, Homo sapiens
ggaugggacaa

SEQ ID NO: 852474 - RNA, 17 nt, Homo sapiens
ggauguaauacauuucu

SEQ ID NO: 852475 - RNA, 14 nt, Homo sapiens
ggauuaaugaucau

SEQ ID NO: 852476 - RNA, 13 nt, Homo sapiens
ggauuacaggcau

SEQ ID NO: 852477 - RNA, 19 nt, Homo sapiens
ggauucuagaacugugaau

SEQ ID NO: 852478 - RNA, 22 nt, Homo sapiens
ggauuucucuagaggcuggcaa

SEQ ID NO: 852479 - RNA, 13 nt, Homo sapiens
ggauuugugcuuu

SEQ ID NO: 852480 - RNA, 19 nt, Homo sapiens
ggauuuuguuuuuugaaca

SEQ ID NO: 852481 - RNA, 18 nt, Homo sapiens
ggcaaaaacuuccaucac

SEQ ID NO: 852482 - RNA, 13 nt, Homo sapiens
ggcaacuucccac

SEQ ID NO: 852483 - RNA, 13 nt, Homo sapiens
ggcaccaguagca

SEQ ID NO: 852484 - RNA, 15 nt, Homo sapiens
ggcagagagggucac

SEQ ID NO: 852485 - RNA, 14 nt, Homo sapiens
ggcaggcagggcau

SEQ ID NO: 852486 - RNA, 15 nt, Homo sapiens
ggcaucauucucuaa

SEQ ID NO: 852487 - RNA, 20 nt, Homo sapiens
ggcauccauggggucucuca

SEQ ID NO: 852488 - RNA, 15 nt, Homo sapiens
ggcaucucugagcaa

SEQ ID NO: 852489 - RNA, 16 nt, Homo sapiens
ggccagccaccacuga

SEQ ID NO: 852490 - RNA, 20 nt, Homo sapiens
ggcccauguauggccaggaa

SEQ ID NO: 852491 - RNA, 12 nt, Homo sapiens
ggcccucauaca

SEQ ID NO: 852492 - RNA, 16 nt, Homo sapiens
ggcccuggucuccgga

SEQ ID NO: 852493 - RNA, 12 nt, Homo sapiens
guugcugacuua

SEQ ID NO: 852494 - RNA, 18 nt, Homo sapiens
guugguucuugacucuga

SEQ ID NO: 852495 - RNA, 15 nt, Homo sapiens
guugugagagccugu

SEQ ID NO: 852496 - RNA, 23 nt, Homo sapiens
guuuaaaugccuaaaaguuuuga

SEQ ID NO: 852497 - RNA, 17 nt, Homo sapiens
guuuacucacagccagc

SEQ ID NO: 852498 - RNA, 15 nt, Homo sapiens
guuuagaacagguuu

SEQ ID NO: 852499 - RNA, 15 nt, Homo sapiens
guuuagauuugccau

SEQ ID NO: 852500 - RNA, 12 nt, Homo sapiens
guuucacagugu

SEQ ID NO: 852501 - RNA, 23 nt, Homo sapiens
guuucccuaucugcaaaauggga

SEQ ID NO: 852502 - RNA, 20 nt, Homo sapiens
guuugaggauuaguuuagaa

SEQ ID NO: 852503 - RNA, 22 nt, Homo sapiens
guuuuaaggacugacugaggca

SEQ ID NO: 852504 - RNA, 18 nt, Homo sapiens
guuuucauaacaacuuau

SEQ ID NO: 852505 - RNA, 14 nt, Homo sapiens
guuuucuacuuuga

SEQ ID NO: 852506 - RNA, 12 nt, Homo sapiens
guuuucuugaua

SEQ ID NO: 852507 - RNA, 21 nt, Homo sapiens
guuuuuaguucugacuuugaa

SEQ ID NO: 852508 - RNA, 21 nt, Homo sapiens
guuuuucugcuuuagacuuga

SEQ ID NO: 852509 - RNA, 16 nt, Homo sapiens
uaaaaaauuuguuuaa

SEQ ID NO: 852510 - RNA, 19 nt, Homo sapiens
uaaaaaguuugaauagaaa

SEQ ID NO: 852511 - RNA, 17 nt, Homo sapiens
uaaaacuauaaguaaua

SEQ ID NO: 852512 - RNA, 15 nt, Homo sapiens
uaaaacucaccuccc

SEQ ID NO: 852513 - RNA, 17 nt, Homo sapiens
uaaaaguaaugcaauau

SEQ ID NO: 852514 - RNA, 15 nt, Homo sapiens
uaaaauaacuaacaa

SEQ ID NO: 852515 - RNA, 21 nt, Homo sapiens
uaaaauaacuaacaaacagau

SEQ ID NO: 852516 - RNA, 19 nt, Homo sapiens
uaaaauauaaucucuauaa

SEQ ID NO: 852517 - RNA, 20 nt, Homo sapiens
uaaaaucauccuauuacuua

SEQ ID NO: 852518 - RNA, 22 nt, Homo sapiens
uaaaauguaucaacacacauuu

SEQ ID NO: 852519 - RNA, 20 nt, Homo sapiens
uaaaaugucucaagugcaau

SEQ ID NO: 852520 - RNA, 15 nt, Homo sapiens
uaaaauugugaugcu

SEQ ID NO: 852521 - RNA, 19 nt, Homo sapiens
uaaacaaagugaaguaaaa

SEQ ID NO: 852522 - RNA, 19 nt, Homo sapiens
uaaacauugccugauuugu

SEQ ID NO: 852523 - RNA, 17 nt, Homo sapiens
uaaagacaaagcauucu

SEQ ID NO: 852524 - RNA, 16 nt, Homo sapiens
uaaagcauguuucauu

SEQ ID NO: 852525 - RNA, 23 nt, Homo sapiens
uaaagcucguccccauugcuuaa

SEQ ID NO: 852526 - RNA, 16 nt, Homo sapiens
uaaaggucauaugcac

SEQ ID NO: 852527 - RNA, 12 nt, Homo sapiens
uaaauuacaguc

SEQ ID NO: 852528 - RNA, 14 nt, Homo sapiens
uaaauuauuuguua

SEQ ID NO: 852529 - RNA, 17 nt, Homo sapiens
uaacaaaguuugcugaa

SEQ ID NO: 852530 - RNA, 15 nt, Homo sapiens
uaacaagaagcaaug

SEQ ID NO: 852531 - RNA, 12 nt, Homo sapiens
uaacaaguuuaa

SEQ ID NO: 852532 - RNA, 16 nt, Homo sapiens
uaacagagaguaagca

SEQ ID NO: 852533 - RNA, 21 nt, Homo sapiens
uaacagagaguaagcacuuaa

SEQ ID NO: 852534 - RNA, 23 nt, Homo sapiens
uaacagggucucuagugcuguga

SEQ ID NO: 852535 - RNA, 19 nt, Homo sapiens
uaacauagccaaaauguga

SEQ ID NO: 852536 - RNA, 15 nt, Homo sapiens
uaacaugugaaaaga

SEQ ID NO: 852537 - RNA, 14 nt, Homo sapiens
uaaccaugucuguu

SEQ ID NO: 852538 - RNA, 17 nt, Homo sapiens
uaacccugucuccucuc

SEQ ID NO: 852539 - RNA, 15 nt, Homo sapiens
uaaccuuugcuguag

SEQ ID NO: 852540 - RNA, 18 nt, Homo sapiens
uaacguuuucuacuuuga

SEQ ID NO: 852541 - RNA, 18 nt, Homo sapiens
uaacuaaaccacuuaaaa

SEQ ID NO: 852542 - RNA, 17 nt, Homo sapiens
uaacuggugugagucaa

SEQ ID NO: 852543 - RNA, 19 nt, Homo sapiens
uaacuguuccccuugguau

SEQ ID NO: 852544 - RNA, 22 nt, Homo sapiens
uaacuguuuuguauaugcugca

SEQ ID NO: 852545 - RNA, 15 nt, Homo sapiens
uaacuucuguugaca

SEQ ID NO: 852546 - RNA, 21 nt, Homo sapiens
uaagaaguggugacauuuugc

SEQ ID NO: 852547 - RNA, 23 nt, Homo sapiens
uaagaccccacuggagucucucu

SEQ ID NO: 852548 - RNA, 22 nt, Homo sapiens
uaagacugcuucuaggcuuuau

SEQ ID NO: 852549 - RNA, 22 nt, Homo sapiens
uaagauacuggacuccucuucc

SEQ ID NO: 852550 - RNA, 14 nt, Homo sapiens
uaagaugucuuccu

SEQ ID NO: 852551 - RNA, 14 nt, Homo sapiens
uaagcaggcgcaag

SEQ ID NO: 852552 - RNA, 18 nt, Homo sapiens
uaagcaucuaaggacaag

SEQ ID NO: 852553 - RNA, 23 nt, Homo sapiens
uaagccaaaauuaagguguuuga

SEQ ID NO: 852554 - RNA, 12 nt, Homo sapiens
uaagccuucgaa

SEQ ID NO: 852555 - RNA, 23 nt, Homo sapiens
uaaggacuuuggcuuacauuuga

SEQ ID NO: 852556 - RNA, 22 nt, Homo sapiens
uaaggcaggagaauggcgugaa

SEQ ID NO: 852557 - RNA, 14 nt, Homo sapiens
uaaggccaaugggc

SEQ ID NO: 852558 - RNA, 22 nt, Homo sapiens
uaaguggacucucugacaaagu

SEQ ID NO: 852559 - RNA, 22 nt, Homo sapiens
uaaguggccggaaaacaagccu

SEQ ID NO: 852560 - RNA, 19 nt, Homo sapiens
uaaguugguaaaguauuua

SEQ ID NO: 852561 - RNA, 20 nt, Homo sapiens
uaauacauuucugaguacca

SEQ ID NO: 852562 - RNA, 17 nt, Homo sapiens
uaauacccuguacauau

SEQ ID NO: 852563 - RNA, 22 nt, Homo sapiens
uaauauccacuuguccauguga

SEQ ID NO: 852564 - RNA, 21 nt, Homo sapiens
uaauaucucuaauauauccac

SEQ ID NO: 852565 - RNA, 21 nt, Homo sapiens
uaauauuauacuguccuaggc

SEQ ID NO: 852566 - RNA, 13 nt, Homo sapiens
uaaucaugaucac

SEQ ID NO: 852567 - RNA, 21 nt, Homo sapiens
uaauccaaaaggucuuuuuac

SEQ ID NO: 852568 - RNA, 14 nt, Homo sapiens
uaaucccagcacuu

SEQ ID NO: 852569 - RNA, 10 nt, Homo sapiens
uaaugaucau

SEQ ID NO: 852570 - RNA, 17 nt, Homo sapiens
uaaugcauuuaucaaua

SEQ ID NO: 852571 - RNA, 21 nt, Homo sapiens
uaauggagaauuaaaacuuug

SEQ ID NO: 852572 - RNA, 15 nt, Homo sapiens
uaauggggaggacaa

SEQ ID NO: 852573 - RNA, 16 nt, Homo sapiens
uaauguauuauaugua

SEQ ID NO: 852574 - RNA, 18 nt, Homo sapiens
uaauuaucgugucugcau

SEQ ID NO: 852575 - RNA, 16 nt, Homo sapiens
uaauuccagcacuuca

SEQ ID NO: 852576 - RNA, 15 nt, Homo sapiens
uaauuguacuuugaa

SEQ ID NO: 852577 - RNA, 18 nt, Homo sapiens
uaauugugugaacuugga

SEQ ID NO: 852578 - RNA, 18 nt, Homo sapiens
uaauuuuguaauguauca

SEQ ID NO: 852579 - RNA, 19 nt, Homo sapiens
uacaaugacuuuauugcau

SEQ ID NO: 852580 - RNA, 20 nt, Homo sapiens
uacagaauuuuucuucauua

SEQ ID NO: 852581 - RNA, 18 nt, Homo sapiens
uacaggaucuguacauaa

SEQ ID NO: 852582 - RNA, 16 nt, Homo sapiens
uacaugcuuugugaac

SEQ ID NO: 852583 - RNA, 20 nt, Homo sapiens
uacauucacgacaguacuuu

SEQ ID NO: 852584 - RNA, 22 nt, Homo sapiens
uacauuugaugcaaaaugacuu

SEQ ID NO: 852585 - RNA, 14 nt, Homo sapiens
uaccaccuacugau

SEQ ID NO: 852586 - RNA, 15 nt, Homo sapiens
uaccaguucugggca

SEQ ID NO: 852587 - RNA, 14 nt, Homo sapiens
uaccauuaucuuau

SEQ ID NO: 852588 - RNA, 14 nt, Homo sapiens
uaccuuaggccccu

SEQ ID NO: 852589 - RNA, 17 nt, Homo sapiens
uacgacucuuuuccaaa

SEQ ID NO: 852590 - RNA, 21 nt, Homo sapiens
uacgcuuaagguggaaagugu

SEQ ID NO: 852591 - RNA, 21 nt, Homo sapiens
uacggauccugcacugacucu

SEQ ID NO: 852592 - RNA, 15 nt, Homo sapiens
uacggcaagaaggca

SEQ ID NO: 852593 - RNA, 20 nt, Homo sapiens
uacguuuguguggugacauu

SEQ ID NO: 852594 - RNA, 23 nt, Homo sapiens
uacguuuguguggugacauuuua

SEQ ID NO: 852595 - RNA, 16 nt, Homo sapiens
uacuaccuguaaugac

SEQ ID NO: 852596 - RNA, 18 nt, Homo sapiens
uacucaagugucuaccug

SEQ ID NO: 852597 - RNA, 14 nt, Homo sapiens
uacucucucucuuu

SEQ ID NO: 852598 - RNA, 16 nt, Homo sapiens
uacucuuuugggcaac

SEQ ID NO: 852599 - RNA, 18 nt, Homo sapiens
uacugaaccacuuguaga

SEQ ID NO: 852600 - RNA, 12 nt, Homo sapiens
uacuugaaccau

SEQ ID NO: 852601 - RNA, 23 nt, Homo sapiens
uacuuguguaguccuaugcaaua

SEQ ID NO: 852602 - RNA, 23 nt, Homo sapiens
uacuuugaacaaccaaaugugca

SEQ ID NO: 852603 - RNA, 17 nt, Homo sapiens
uagaaaggagaccugua

SEQ ID NO: 852604 - RNA, 14 nt, Homo sapiens
uagaagacuacaau

SEQ ID NO: 852605 - RNA, 17 nt, Homo sapiens
uagaagugaguguaauc

SEQ ID NO: 852606 - RNA, 16 nt, Homo sapiens
uagacaguagauacca

SEQ ID NO: 852607 - RNA, 15 nt, Homo sapiens
uagaccuguuucaua

SEQ ID NO: 852608 - RNA, 15 nt, Homo sapiens
uagacggaacagugu

SEQ ID NO: 852609 - RNA, 22 nt, Homo sapiens
uagaggguacuugaaucuucag

SEQ ID NO: 852610 - RNA, 12 nt, Homo sapiens
uagauaugaaga

SEQ ID NO: 852611 - RNA, 20 nt, Homo sapiens
uagauaugaagaaucugcuc

SEQ ID NO: 852612 - RNA, 22 nt, Homo sapiens
uagauguaucaaaauacuacca

SEQ ID NO: 852613 - RNA, 17 nt, Homo sapiens
uagauuaagaaauagac

SEQ ID NO: 852614 - RNA, 17 nt, Homo sapiens
uagcacaggcugagugc

SEQ ID NO: 852615 - RNA, 20 nt, Homo sapiens
uagcauuguaaaagcauuuu

SEQ ID NO: 852616 - RNA, 19 nt, Homo sapiens
uagcauuucccaacacaaa

SEQ ID NO: 852617 - RNA, 16 nt, Homo sapiens
uagcccuugcugccac

SEQ ID NO: 852618 - RNA, 23 nt, Homo sapiens
uagcuauuacugcagacuauaaa

SEQ ID NO: 852619 - RNA, 20 nt, Homo sapiens
uagcucuccauacuuugaac

SEQ ID NO: 852620 - RNA, 21 nt, Homo sapiens
uagcugaaaugguccaguaca

SEQ ID NO: 852621 - RNA, 13 nt, Homo sapiens
uagcugcauuugu

SEQ ID NO: 852622 - RNA, 20 nt, Homo sapiens
uagcuuccuccaacccgcag

SEQ ID NO: 852623 - RNA, 20 nt, Homo sapiens
uaggaaccugcacacgagca

SEQ ID NO: 852624 - RNA, 22 nt, Homo sapiens
uaggauaagauuccaguauugu

SEQ ID NO: 852625 - RNA, 21 nt, Homo sapiens
uaggcacaaauacauuccuuu

SEQ ID NO: 852626 - RNA, 17 nt, Homo sapiens
uaggcuuuaaaaaagca

SEQ ID NO: 852627 - RNA, 13 nt, Homo sapiens
uagguuccagcau

SEQ ID NO: 852628 - RNA, 22 nt, Homo sapiens
uaguaccaugucguaguuacuc

SEQ ID NO: 852629 - RNA, 13 nt, Homo sapiens
uaguacugugaau

SEQ ID NO: 852630 - RNA, 14 nt, Homo sapiens
uaguauucuuuauu

SEQ ID NO: 852631 - RNA, 22 nt, Homo sapiens
uagucugcauauauuaaagcau

SEQ ID NO: 852632 - RNA, 17 nt, Homo sapiens
uagugauagagugcagu

SEQ ID NO: 852633 - RNA, 14 nt, Homo sapiens
uaguuguacuauga

SEQ ID NO: 852634 - RNA, 14 nt, Homo sapiens
uauaaaagcugcau

SEQ ID NO: 852635 - RNA, 18 nt, Homo sapiens
uauaaacauuuaaagaca

SEQ ID NO: 852636 - RNA, 17 nt, Homo sapiens
uauaagaaaaccaaaca

SEQ ID NO: 852637 - RNA, 15 nt, Homo sapiens
uauaagugugaccag

SEQ ID NO: 852638 - RNA, 15 nt, Homo sapiens
uauaauccuugucag

SEQ ID NO: 852639 - RNA, 19 nt, Homo sapiens
uauaauugaugauguugua

SEQ ID NO: 852640 - RNA, 22 nt, Homo sapiens
uauaauuuugauagugggacca

SEQ ID NO: 852641 - RNA, 12 nt, Homo sapiens
uauaccaaagac

SEQ ID NO: 852642 - RNA, 19 nt, Homo sapiens
uauagcuuuagccguguca

SEQ ID NO: 852643 - RNA, 21 nt, Homo sapiens
uauaguuuaaaaaucugccac

SEQ ID NO: 852644 - RNA, 18 nt, Homo sapiens
uauaucagcuuuugccuu

SEQ ID NO: 852645 - RNA, 13 nt, Homo sapiens
uauaugcugcauu

SEQ ID NO: 852646 - RNA, 21 nt, Homo sapiens
uauauuccccuaagauuugau

SEQ ID NO: 852647 - RNA, 12 nt, Homo sapiens
uauauugcagug

SEQ ID NO: 852648 - RNA, 21 nt, Homo sapiens
uauauuguaagaaauacugua

SEQ ID NO: 852649 - RNA, 18 nt, Homo sapiens
uauauuuacaacacuuua

SEQ ID NO: 852650 - RNA, 19 nt, Homo sapiens
uauauuuacaacacuuuaa

SEQ ID NO: 852651 - RNA, 18 nt, Homo sapiens
uaucacccaggaaucuca

SEQ ID NO: 852652 - RNA, 21 nt, Homo sapiens
uaucagagacccuggugcugc

SEQ ID NO: 852653 - RNA, 20 nt, Homo sapiens
uaucaguuuuauagcuuuau

SEQ ID NO: 852654 - RNA, 14 nt, Homo sapiens
uaucaucuuggucu

SEQ ID NO: 852655 - RNA, 14 nt, Homo sapiens
uaucuagcccaaag

SEQ ID NO: 852656 - RNA, 22 nt, Homo sapiens
uaucuuuguguugcagccucaa

SEQ ID NO: 852657 - RNA, 19 nt, Homo sapiens
uaugaagaaucugcucuga

SEQ ID NO: 852658 - RNA, 14 nt, Homo sapiens
uaugacuuucacau

SEQ ID NO: 852659 - RNA, 13 nt, Homo sapiens
uaugaugauuugc

SEQ ID NO: 852660 - RNA, 18 nt, Homo sapiens
uauggaagggacucccag

SEQ ID NO: 852661 - RNA, 19 nt, Homo sapiens
uaugugaccucacgugcaa

SEQ ID NO: 852662 - RNA, 13 nt, Homo sapiens
uauguguaucuca

SEQ ID NO: 852663 - RNA, 14 nt, Homo sapiens
uauguucauugcca

SEQ ID NO: 852664 - RNA, 16 nt, Homo sapiens
uauguuuucacaguca

SEQ ID NO: 852665 - RNA, 22 nt, Homo sapiens
uauuacuagacugccacaagga

SEQ ID NO: 852666 - RNA, 20 nt, Homo sapiens
uauucaacagcaagugugaa

SEQ ID NO: 852667 - RNA, 12 nt, Homo sapiens
uauucugcuuag

SEQ ID NO: 852668 - RNA, 15 nt, Homo sapiens
uauucugugcuguua

SEQ ID NO: 852669 - RNA, 21 nt, Homo sapiens
uauugcaucuggguagcugua

SEQ ID NO: 852670 - RNA, 20 nt, Homo sapiens
uauuggcugguaaauugcca

SEQ ID NO: 852671 - RNA, 22 nt, Homo sapiens
uauugucuuccuguaagaccuu

SEQ ID NO: 852672 - RNA, 17 nt, Homo sapiens
uauuuauuuuuaggaca

SEQ ID NO: 852673 - RNA, 19 nt, Homo sapiens
uauuucaucagaacagcug

SEQ ID NO: 852674 - RNA, 13 nt, Homo sapiens
uauuucccuugcc

SEQ ID NO: 852675 - RNA, 19 nt, Homo sapiens
uauuugugauguacuguaa

SEQ ID NO: 852676 - RNA, 14 nt, Homo sapiens
uauuuguuacugua

SEQ ID NO: 852677 - RNA, 13 nt, Homo sapiens
ucaaaacauccca

SEQ ID NO: 852678 - RNA, 19 nt, Homo sapiens
ucaaaaguagaacuuugua

SEQ ID NO: 852679 - RNA, 19 nt, Homo sapiens
ucaaaaguuuguuugcuua

SEQ ID NO: 852680 - RNA, 21 nt, Homo sapiens
ucaaauacauuuaaaacauua

SEQ ID NO: 852681 - RNA, 22 nt, Homo sapiens
ucaaauguguuuugguccugga

SEQ ID NO: 852682 - RNA, 22 nt, Homo sapiens
ucaaccaacaacaauguguugu

SEQ ID NO: 852683 - RNA, 18 nt, Homo sapiens
ucaaccuuuaguacgugu

SEQ ID NO: 852684 - RNA, 16 nt, Homo sapiens
ucaagaagucacuguc

SEQ ID NO: 852685 - RNA, 16 nt, Homo sapiens
ucaaggcaaugggcua

SEQ ID NO: 852686 - RNA, 21 nt, Homo sapiens
ucaagucuacccugaucaccu

SEQ ID NO: 852687 - RNA, 15 nt, Homo sapiens
ucaauaaauuugcuu

SEQ ID NO: 852688 - RNA, 18 nt, Homo sapiens
ucaauaauuuguggugau

SEQ ID NO: 852689 - RNA, 15 nt, Homo sapiens
ucacacuggagugaa

SEQ ID NO: 852690 - RNA, 14 nt, Homo sapiens
ucaccaagagccaa

SEQ ID NO: 852691 - RNA, 15 nt, Homo sapiens
ucaccaagagccaau

SEQ ID NO: 852692 - RNA, 16 nt, Homo sapiens
ucacccaccagacuuu

SEQ ID NO: 852693 - RNA, 12 nt, Homo sapiens
ucacgugcaaag

SEQ ID NO: 852694 - RNA, 14 nt, Homo sapiens
ucacuaggccucug

SEQ ID NO: 852695 - RNA, 21 nt, Homo sapiens
ucacuccaaaccuuacucuga

SEQ ID NO: 852696 - RNA, 12 nt, Homo sapiens
ucacucucagga

SEQ ID NO: 852697 - RNA, 18 nt, Homo sapiens
ucacucucuuccuuucau

SEQ ID NO: 852698 - RNA, 15 nt, Homo sapiens
ucacucuguugccau

SEQ ID NO: 852699 - RNA, 14 nt, Homo sapiens
ucacuggugguuuu

SEQ ID NO: 852700 - RNA, 16 nt, Homo sapiens
ucacugugucccaaaa

SEQ ID NO: 852701 - RNA, 21 nt, Homo sapiens
ucacuguuuagauuugccaua

SEQ ID NO: 852702 - RNA, 22 nt, Homo sapiens
ucacuugaugggccacacaagu

SEQ ID NO: 852703 - RNA, 14 nt, Homo sapiens
ucacuuucccugau

SEQ ID NO: 852704 - RNA, 18 nt, Homo sapiens
ucagaaucugauaccaaa

SEQ ID NO: 852705 - RNA, 20 nt, Homo sapiens
ucagaaucugauaccaaaga

SEQ ID NO: 852706 - RNA, 22 nt, Homo sapiens
ucagagagccuuuuucuaggcc

SEQ ID NO: 852707 - RNA, 19 nt, Homo sapiens
ucagaggggaggcucagga

SEQ ID NO: 852708 - RNA, 17 nt, Homo sapiens
ucagcccucucuugcca

SEQ ID NO: 852709 - RNA, 21 nt, Homo sapiens
ucagcccucucuugccaaaaa

SEQ ID NO: 852710 - RNA, 14 nt, Homo sapiens
ucagcugcugcuua

SEQ ID NO: 852711 - RNA, 15 nt, Homo sapiens
ucagcuuuugccuuu

SEQ ID NO: 852712 - RNA, 18 nt, Homo sapiens
ucaggaaggcuucuugcu

SEQ ID NO: 852713 - RNA, 17 nt, Homo sapiens
ucaggaggccaaggugg

SEQ ID NO: 852714 - RNA, 16 nt, Homo sapiens
ucagguccaugugcac

SEQ ID NO: 852715 - RNA, 20 nt, Homo sapiens
ucagguccaugugcacugca

SEQ ID NO: 852716 - RNA, 21 nt, Homo sapiens
ucaggucccaguugcugucac

SEQ ID NO: 852717 - RNA, 23 nt, Homo sapiens
ucagucacucuaggacucugcac

SEQ ID NO: 852718 - RNA, 13 nt, Homo sapiens
ucagugugcaaua

SEQ ID NO: 852719 - RNA, 20 nt, Homo sapiens
ucauaauuucuagaguaaau

SEQ ID NO: 852720 - RNA, 20 nt, Homo sapiens
ucauagugauagagugcagu

SEQ ID NO: 852721 - RNA, 22 nt, Homo sapiens
ucaucccacccucucacaguuc

SEQ ID NO: 852722 - RNA, 23 nt, Homo sapiens
ucauccguuugccaaucauugca

SEQ ID NO: 852723 - RNA, 17 nt, Homo sapiens
ucauccuauuacuuaug

SEQ ID NO: 852724 - RNA, 15 nt, Homo sapiens
ucaucucaagcuugc

SEQ ID NO: 852725 - RNA, 17 nt, Homo sapiens
ucaugaugguaucuaua

SEQ ID NO: 852726 - RNA, 23 nt, Homo sapiens
ucaugccuguaaucccagcacuu

SEQ ID NO: 852727 - RNA, 18 nt, Homo sapiens
ucauggauagauuuucac

SEQ ID NO: 852728 - RNA, 19 nt, Homo sapiens
ucauguaaaaagugcagua

SEQ ID NO: 852729 - RNA, 20 nt, Homo sapiens
ucauuucccuuuauauuucc

SEQ ID NO: 852730 - RNA, 14 nt, Homo sapiens
ucauuucugauuuc

SEQ ID NO: 852731 - RNA, 13 nt, Homo sapiens
ucauuuucuuucc

SEQ ID NO: 852732 - RNA, 22 nt, Homo sapiens
uccaaaaggucuuuuuacauug

SEQ ID NO: 852733 - RNA, 20 nt, Homo sapiens
uccaacccgcagccucucug

SEQ ID NO: 852734 - RNA, 17 nt, Homo sapiens
uccacagaagugagcuc

SEQ ID NO: 852735 - RNA, 12 nt, Homo sapiens
uccacagaggac

SEQ ID NO: 852736 - RNA, 17 nt, Homo sapiens
uccacuuggagcuaaaa

SEQ ID NO: 852737 - RNA, 12 nt, Homo sapiens
uccacuuuuugu

SEQ ID NO: 852738 - RNA, 19 nt, Homo sapiens
uccagaaagcaccaaggaa

SEQ ID NO: 852739 - RNA, 18 nt, Homo sapiens
uccagcacaaaguuuacu

SEQ ID NO: 852740 - RNA, 13 nt, Homo sapiens
uccagcucaaggg

SEQ ID NO: 852741 - RNA, 14 nt, Homo sapiens
uccaguaagaucac

SEQ ID NO: 852742 - RNA, 17 nt, Homo sapiens
uccaguaagaucacugu

SEQ ID NO: 852743 - RNA, 14 nt, Homo sapiens
uccauauuugccuu

SEQ ID NO: 852744 - RNA, 14 nt, Homo sapiens
uccaucucuuccuu

SEQ ID NO: 852745 - RNA, 19 nt, Homo sapiens
uccauucuguuccacugcu

SEQ ID NO: 852746 - RNA, 15 nt, Homo sapiens
uccauugucaugaaa

SEQ ID NO: 852747 - RNA, 14 nt, Homo sapiens
ucccaacaccucac

SEQ ID NO: 852748 - RNA, 22 nt, Homo sapiens
ucccaauaggagacaaaggaga

SEQ ID NO: 852749 - RNA, 14 nt, Homo sapiens
uccccauugcuuaa

SEQ ID NO: 852750 - RNA, 20 nt, Homo sapiens
uccccggcgggacugucaau

SEQ ID NO: 852751 - RNA, 21 nt, Homo sapiens
uccccggcgggacugucaaug

SEQ ID NO: 852752 - RNA, 23 nt, Homo sapiens
uccccugggcaccccucacuuuc

SEQ ID NO: 852753 - RNA, 14 nt, Homo sapiens
ucccucccagcucc

SEQ ID NO: 852754 - RNA, 16 nt, Homo sapiens
ucccuccccugggcac

SEQ ID NO: 852755 - RNA, 15 nt, Homo sapiens
ucccuccucaugccu

SEQ ID NO: 852756 - RNA, 15 nt, Homo sapiens
ccaguucacauuuau

SEQ ID NO: 852757 - RNA, 16 nt, Homo sapiens
ccauacucaugcaugc

SEQ ID NO: 852758 - RNA, 11 nt, Homo sapiens
acuugaacuca

SEQ ID NO: 852759 - RNA, 17 nt, Homo sapiens
acuugaacucacucccu

SEQ ID NO: 852760 - RNA, 14 nt, Homo sapiens
acuuggagcuaaaa

SEQ ID NO: 852761 - RNA, 18 nt, Homo sapiens
acuuggagcuaaaacugg

SEQ ID NO: 852762 - RNA, 16 nt, Homo sapiens
acuuuguaaauucuga

SEQ ID NO: 852763 - RNA, 23 nt, Homo sapiens
acuuuucuauauugcagugugaa

SEQ ID NO: 852764 - RNA, 21 nt, Homo sapiens
acuuuuugguaauagauuuaa

SEQ ID NO: 852765 - RNA, 13 nt, Homo sapiens
agaaaaaguacaa

SEQ ID NO: 852766 - RNA, 18 nt, Homo sapiens
agaaagcaccaaggaaaa

SEQ ID NO: 852767 - RNA, 20 nt, Homo sapiens
agaaaggagaccuguaucaa

SEQ ID NO: 852768 - RNA, 15 nt, Homo sapiens
agaaagugacaugca

SEQ ID NO: 852769 - RNA, 23 nt, Homo sapiens
agaaagugacaugcauucacaua

SEQ ID NO: 852770 - RNA, 21 nt, Homo sapiens
agaaaguuugcuguaccacaa

SEQ ID NO: 852771 - RNA, 15 nt, Homo sapiens
agaaauaaacauaag

SEQ ID NO: 852772 - RNA, 15 nt, Homo sapiens
agaaauuaaguacuu

SEQ ID NO: 852773 - RNA, 16 nt, Homo sapiens
agaaauucaauugaug

SEQ ID NO: 852774 - RNA, 23 nt, Homo sapiens
agaacagaaguguucacauggcu

SEQ ID NO: 852775 - RNA, 18 nt, Homo sapiens
agaacauuccauuugcuu

SEQ ID NO: 852776 - RNA, 14 nt, Homo sapiens
agaacucuaucugu

SEQ ID NO: 852777 - RNA, 16 nt, Homo sapiens
agaacucuaucugugg

SEQ ID NO: 852778 - RNA, 14 nt, Homo sapiens
agaacuucccucca

SEQ ID NO: 852779 - RNA, 18 nt, Homo sapiens
agaagcagcaacuugcaa

SEQ ID NO: 852780 - RNA, 14 nt, Homo sapiens
agaaggagcaggcc

SEQ ID NO: 852781 - RNA, 16 nt, Homo sapiens
agaagucacugucaga

SEQ ID NO: 852782 - RNA, 12 nt, Homo sapiens
agaagugagcuc

SEQ ID NO: 852783 - RNA, 21 nt, Homo sapiens
agaagugggugggcacacuga

SEQ ID NO: 852784 - RNA, 23 nt, Homo sapiens
agaagugggugggcacacugaac

SEQ ID NO: 852785 - RNA, 22 nt, Homo sapiens
agaaguuccuagugauggcuua

SEQ ID NO: 852786 - RNA, 15 nt, Homo sapiens
agaauagauggaaga

SEQ ID NO: 852787 - RNA, 16 nt, Homo sapiens
agaaucuaaacuuuau

SEQ ID NO: 852788 - RNA, 17 nt, Homo sapiens
agaauucuuuuuacauc

SEQ ID NO: 852789 - RNA, 14 nt, Homo sapiens
agacaaagacauuu

SEQ ID NO: 852790 - RNA, 21 nt, Homo sapiens
agacauaguaccgaauuuagu

SEQ ID NO: 852791 - RNA, 13 nt, Homo sapiens
agacaucagaaca

SEQ ID NO: 852792 - RNA, 21 nt, Homo sapiens
agaccagagggacacuaggaa

SEQ ID NO: 852793 - RNA, 22 nt, Homo sapiens
agacgcucauucagcaucugac

SEQ ID NO: 852794 - RNA, 15 nt, Homo sapiens
agacuaugacgguga

SEQ ID NO: 852795 - RNA, 12 nt, Homo sapiens
agacucacugug

SEQ ID NO: 852796 - RNA, 17 nt, Homo sapiens
agacuugcuuuggucac

SEQ ID NO: 852797 - RNA, 15 nt, Homo sapiens
agagaaaucacugaa

SEQ ID NO: 852798 - RNA, 22 nt, Homo sapiens
agagaagggaaguaggcccuua

SEQ ID NO: 852799 - RNA, 13 nt, Homo sapiens
agagagauacucu

SEQ ID NO: 852800 - RNA, 14 nt, Homo sapiens
agagagcugagacc

SEQ ID NO: 852801 - RNA, 19 nt, Homo sapiens
agagaucaaguugagacag

SEQ ID NO: 852802 - RNA, 17 nt, Homo sapiens
agagauggcaguugcuu

SEQ ID NO: 852803 - RNA, 16 nt, Homo sapiens
agagcccaaagagcuc

SEQ ID NO: 852804 - RNA, 17 nt, Homo sapiens
agagccccacucucaga

SEQ ID NO: 852805 - RNA, 14 nt, Homo sapiens
agagcuaaggccaa

SEQ ID NO: 852806 - RNA, 14 nt, Homo sapiens
agagggaagcugag

SEQ ID NO: 852807 - RNA, 14 nt, Homo sapiens
agaggggaggccaa

SEQ ID NO: 852808 - RNA, 13 nt, Homo sapiens
agaggugugugac

SEQ ID NO: 852809 - RNA, 10 nt, Homo sapiens
agagugaaug

SEQ ID NO: 852810 - RNA, 20 nt, Homo sapiens
agaguuguacauauguuuca

SEQ ID NO: 852811 - RNA, 19 nt, Homo sapiens
agauaugaagaaucugcuc

SEQ ID NO: 852812 - RNA, 22 nt, Homo sapiens
agaugaguaggaguuugcuaag

SEQ ID NO: 852813 - RNA, 19 nt, Homo sapiens
agauggcaguugcuuccuc

SEQ ID NO: 852814 - RNA, 16 nt, Homo sapiens
agaugucuuccuauca

SEQ ID NO: 852815 - RNA, 17 nt, Homo sapiens
agaugucuuccuaucaa

SEQ ID NO: 852816 - RNA, 21 nt, Homo sapiens
agaugucuuccuaucaaaaag

SEQ ID NO: 852817 - RNA, 19 nt, Homo sapiens
agauguucuggauaccauu

SEQ ID NO: 852818 - RNA, 16 nt, Homo sapiens
agauguuuaaaacacc

SEQ ID NO: 852819 - RNA, 15 nt, Homo sapiens
agauucugaccuuaa

SEQ ID NO: 852820 - RNA, 22 nt, Homo sapiens
agauugauaaccauagcauuaa

SEQ ID NO: 852821 - RNA, 22 nt, Homo sapiens
agauuuaauuaugaaugauuag

SEQ ID NO: 852822 - RNA, 16 nt, Homo sapiens
agcaaacagaucacua

SEQ ID NO: 852823 - RNA, 16 nt, Homo sapiens
agcaaaggaucuggac

SEQ ID NO: 852824 - RNA, 18 nt, Homo sapiens
agcaaaggaucuggacca

SEQ ID NO: 852825 - RNA, 17 nt, Homo sapiens
agcaacacacaugcucc

SEQ ID NO: 852826 - RNA, 13 nt, Homo sapiens
agcacccauccac

SEQ ID NO: 852827 - RNA, 19 nt, Homo sapiens
agcacugacugaacuguaa

SEQ ID NO: 852828 - RNA, 21 nt, Homo sapiens
agcacuguggaacugcuauuu

SEQ ID NO: 852829 - RNA, 17 nt, Homo sapiens
agcagacaucaagcuca

SEQ ID NO: 852830 - RNA, 11 nt, Homo sapiens
agcagacuuuu

SEQ ID NO: 852831 - RNA, 19 nt, Homo sapiens
agcagagggaguagggcuc

SEQ ID NO: 852832 - RNA, 22 nt, Homo sapiens
agcaggauaaacauuccagaga

SEQ ID NO: 852833 - RNA, 24 nt, Homo sapiens
agcaggguccauguuugcugccuu

SEQ ID NO: 852834 - RNA, 17 nt, Homo sapiens
agcaggucccugugagc

SEQ ID NO: 852835 - RNA, 23 nt, Homo sapiens
agcaguuucagguagaggugcau

SEQ ID NO: 852836 - RNA, 20 nt, Homo sapiens
agcauaaagaauuugucaca

SEQ ID NO: 852837 - RNA, 19 nt, Homo sapiens
agcauaauuuuaguuuugu

SEQ ID NO: 852838 - RNA, 22 nt, Homo sapiens
agcauagucuuauuaaccaugu

SEQ ID NO: 852839 - RNA, 19 nt, Homo sapiens
agcauucucuccauuucac

SEQ ID NO: 852840 - RNA, 21 nt, Homo sapiens
agcauugcagucacuuugaca

SEQ ID NO: 852841 - RNA, 23 nt, Homo sapiens
agccacauuucagaccugcugag

SEQ ID NO: 852842 - RNA, 13 nt, Homo sapiens
agccaccugaguu

SEQ ID NO: 852843 - RNA, 18 nt, Homo sapiens
agccagcuuuuccagaaa

SEQ ID NO: 852844 - RNA, 19 nt, Homo sapiens
agccauuucuucuguucua

SEQ ID NO: 852845 - RNA, 14 nt, Homo sapiens
agccauuugggaga

SEQ ID NO: 852846 - RNA, 16 nt, Homo sapiens
agcccagaagugcaga

SEQ ID NO: 852847 - RNA, 14 nt, Homo sapiens
agcccagcguccac

SEQ ID NO: 852848 - RNA, 14 nt, Homo sapiens
agccccaccaugca

SEQ ID NO: 852849 - RNA, 21 nt, Homo sapiens
agccccugccagcagcugccu

SEQ ID NO: 852850 - RNA, 15 nt, Homo sapiens
agcccgcaucagcug

SEQ ID NO: 852851 - RNA, 23 nt, Homo sapiens
agccuaggcuuggcuccuuucac

SEQ ID NO: 852852 - RNA, 16 nt, Homo sapiens
agccucaaauccagga

SEQ ID NO: 852853 - RNA, 16 nt, Homo sapiens
agccuccccuucccag

SEQ ID NO: 852854 - RNA, 16 nt, Homo sapiens
agccugccucugccac

SEQ ID NO: 852855 - RNA, 15 nt, Homo sapiens
agccugggugcacag

SEQ ID NO: 852856 - RNA, 20 nt, Homo sapiens
agccuuggaggacacuaaga

SEQ ID NO: 852857 - RNA, 12 nt, Homo sapiens
agccuuugccau

SEQ ID NO: 852858 - RNA, 18 nt, Homo sapiens
agcgacagugugggaccu

SEQ ID NO: 852859 - RNA, 15 nt, Homo sapiens
agcgcggacaucccc

SEQ ID NO: 852860 - RNA, 18 nt, Homo sapiens
agcguuagaggggccagc

SEQ ID NO: 852861 - RNA, 18 nt, Homo sapiens
agcuaacagcaguuucag

SEQ ID NO: 852862 - RNA, 14 nt, Homo sapiens
agcuagaacauucc

SEQ ID NO: 852863 - RNA, 14 nt, Homo sapiens
agcuaguugaauac

SEQ ID NO: 852864 - RNA, 19 nt, Homo sapiens
agcuaugacuuaacauagc

SEQ ID NO: 852865 - RNA, 17 nt, Homo sapiens
agcucaaggcaaugggc

SEQ ID NO: 852866 - RNA, 16 nt, Homo sapiens
agcucaauaaaagaau

SEQ ID NO: 852867 - RNA, 21 nt, Homo sapiens
agcucugcuccccuaaagccu

SEQ ID NO: 852868 - RNA, 15 nt, Homo sapiens
agcucuuuaacaugg

SEQ ID NO: 852869 - RNA, 13 nt, Homo sapiens
agcugacuuucaa

SEQ ID NO: 852870 - RNA, 18 nt, Homo sapiens
agcugcucagaucccacu

SEQ ID NO: 852871 - RNA, 15 nt, Homo sapiens
agcugcuccuaagga

SEQ ID NO: 852872 - RNA, 21 nt, Homo sapiens
agcuguugaugggaugauuga

SEQ ID NO: 852873 - RNA, 16 nt, Homo sapiens
agcuuccccaguagcu

SEQ ID NO: 852874 - RNA, 17 nt, Homo sapiens
agcuuccucuucuacca

SEQ ID NO: 852875 - RNA, 22 nt, Homo sapiens
agcuucuauaagugugaccagu

SEQ ID NO: 852876 - RNA, 15 nt, Homo sapiens
aggaaacuuugaacu

SEQ ID NO: 852877 - RNA, 17 nt, Homo sapiens
aggaaauacaccuggac

SEQ ID NO: 852878 - RNA, 15 nt, Homo sapiens
aggaaauaccaguuc

SEQ ID NO: 852879 - RNA, 12 nt, Homo sapiens
aggaaccugcac

SEQ ID NO: 852880 - RNA, 23 nt, Homo sapiens
aggaagguucauugccauuguca

SEQ ID NO: 852881 - RNA, 15 nt, Homo sapiens
aggaaguagcacagg

SEQ ID NO: 852882 - RNA, 22 nt, Homo sapiens
aggaauauugcugcugguucuc

SEQ ID NO: 852883 - RNA, 19 nt, Homo sapiens
aggaaucuagccagugaac

SEQ ID NO: 852884 - RNA, 13 nt, Homo sapiens
aggacacuaagag

SEQ ID NO: 852885 - RNA, 18 nt, Homo sapiens
aggacugacugaggcagu

SEQ ID NO: 852886 - RNA, 15 nt, Homo sapiens
aggacuuguuucccu

SEQ ID NO: 852887 - RNA, 17 nt, Homo sapiens
aggaggcagagaggguc

SEQ ID NO: 852888 - RNA, 16 nt, Homo sapiens
aggagggacagucuca

SEQ ID NO: 852889 - RNA, 22 nt, Homo sapiens
aggagugccuucauacacugua

SEQ ID NO: 852890 - RNA, 16 nt, Homo sapiens
cagcccucucuugcca

SEQ ID NO: 852891 - RNA, 18 nt, Homo sapiens
cagcccucucuugccaaa

SEQ ID NO: 852892 - RNA, 14 nt, Homo sapiens
cagcguaaggggau

SEQ ID NO: 852893 - RNA, 20 nt, Homo sapiens
cagcuaccccugcagcuggg

SEQ ID NO: 852894 - RNA, 15 nt, Homo sapiens
cagcuaugcaaaaag

SEQ ID NO: 852895 - RNA, 13 nt, Homo sapiens
cagcucaagggag

SEQ ID NO: 852896 - RNA, 13 nt, Homo sapiens
cagcucuacaggu

SEQ ID NO: 852897 - RNA, 19 nt, Homo sapiens
cagcugacuaaaggccaca

SEQ ID NO: 852898 - RNA, 16 nt, Homo sapiens
cagcugcagcugggag

SEQ ID NO: 852899 - RNA, 19 nt, Homo sapiens
cagcugggagccuuugcca

SEQ ID NO: 852900 - RNA, 16 nt, Homo sapiens
cagcuucauguuccca

SEQ ID NO: 852901 - RNA, 12 nt, Homo sapiens
caggaacugugu

SEQ ID NO: 852902 - RNA, 17 nt, Homo sapiens
caggaaucucaaacucc

SEQ ID NO: 852903 - RNA, 20 nt, Homo sapiens
caggacacugcagaacagcu

SEQ ID NO: 852904 - RNA, 22 nt, Homo sapiens
caggaccaugaggccuccugcc

SEQ ID NO: 852905 - RNA, 20 nt, Homo sapiens
caggagacuguggagacugc

SEQ ID NO: 852906 - RNA, 16 nt, Homo sapiens
caggaggccaaggugg

SEQ ID NO: 852907 - RNA, 21 nt, Homo sapiens
caggaucaaugaccccuguaa

SEQ ID NO: 852908 - RNA, 13 nt, Homo sapiens
caggaugcuccag

SEQ ID NO: 852909 - RNA, 16 nt, Homo sapiens
caggcuggagugcagu

SEQ ID NO: 852910 - RNA, 16 nt, Homo sapiens
cagggcacagaaggcu

SEQ ID NO: 852911 - RNA, 16 nt, Homo sapiens
cagggcaggaccagcc

SEQ ID NO: 852912 - RNA, 23 nt, Homo sapiens
cagggcugcaucccgcagauggc

SEQ ID NO: 852913 - RNA, 19 nt, Homo sapiens
cagggcugggucaggggua

SEQ ID NO: 852914 - RNA, 14 nt, Homo sapiens
caggggauccagcu

SEQ ID NO: 852915 - RNA, 18 nt, Homo sapiens
caggggauccagcucaag

SEQ ID NO: 852916 - RNA, 22 nt, Homo sapiens
caggggauccagcucaagggag

SEQ ID NO: 852917 - RNA, 14 nt, Homo sapiens
cagggguacacaga

SEQ ID NO: 852918 - RNA, 22 nt, Homo sapiens
cagggucucuagugcugugaaa

SEQ ID NO: 852919 - RNA, 20 nt, Homo sapiens
cagguacccccugcacucuu

SEQ ID NO: 852920 - RNA, 13 nt, Homo sapiens
caggugaggcaaa

SEQ ID NO: 852921 - RNA, 21 nt, Homo sapiens
caggugggagccaacugucag

SEQ ID NO: 852922 - RNA, 20 nt, Homo sapiens
caguaaauauuuacuauuua

SEQ ID NO: 852923 - RNA, 17 nt, Homo sapiens
caguaagcugguuuaca

SEQ ID NO: 852924 - RNA, 12 nt, Homo sapiens
caguaaggauuu

SEQ ID NO: 852925 - RNA, 20 nt, Homo sapiens
cagucagguccaugugcacu

SEQ ID NO: 852926 - RNA, 14 nt, Homo sapiens
caguccaguagggc

SEQ ID NO: 852927 - RNA, 13 nt, Homo sapiens
cagucccuuucag

SEQ ID NO: 852928 - RNA, 21 nt, Homo sapiens
caguccuauuuagacauguaa

SEQ ID NO: 852929 - RNA, 14 nt, Homo sapiens
caguggaggaauuu

SEQ ID NO: 852930 - RNA, 17 nt, Homo sapiens
caguggcugugaaggag

SEQ ID NO: 852931 - RNA, 15 nt, Homo sapiens
caguggguucaggcc

SEQ ID NO: 852932 - RNA, 16 nt, Homo sapiens
caguggucccaauagg

SEQ ID NO: 852933 - RNA, 16 nt, Homo sapiens
caguuaugugaccuca

SEQ ID NO: 852934 - RNA, 15 nt, Homo sapiens
caguugcugucacaa

SEQ ID NO: 852935 - RNA, 13 nt, Homo sapiens
caguugcuuccuc

SEQ ID NO: 852936 - RNA, 20 nt, Homo sapiens
caguuuaagaaguggugaca

SEQ ID NO: 852937 - RNA, 14 nt, Homo sapiens
cauaaaaacagugc

SEQ ID NO: 852938 - RNA, 19 nt, Homo sapiens
cauaauacugaaccacuug

SEQ ID NO: 852939 - RNA, 15 nt, Homo sapiens
cauaaucauggcucu

SEQ ID NO: 852940 - RNA, 23 nt, Homo sapiens
cauaaucauggcucuuagaaacu

SEQ ID NO: 852941 - RNA, 20 nt, Homo sapiens
cauacuuugaacaaccaaau

SEQ ID NO: 852942 - RNA, 17 nt, Homo sapiens
cauagcaccuaacaaca

SEQ ID NO: 852943 - RNA, 14 nt, Homo sapiens
cauagcgacagugu

SEQ ID NO: 852944 - RNA, 15 nt, Homo sapiens
cauaggcuucuggga

SEQ ID NO: 852945 - RNA, 19 nt, Homo sapiens
cauagugauagagugcagu

SEQ ID NO: 852946 - RNA, 14 nt, Homo sapiens
cauaugccuacaaa

SEQ ID NO: 852947 - RNA, 18 nt, Homo sapiens
cauauucuaguaauaaag

SEQ ID NO: 852948 - RNA, 18 nt, Homo sapiens
caucaagaucgugcuggc

SEQ ID NO: 852949 - RNA, 18 nt, Homo sapiens
caucacugagacaaucau

SEQ ID NO: 852950 - RNA, 18 nt, Homo sapiens
caucagaacagcuguuga

SEQ ID NO: 852951 - RNA, 20 nt, Homo sapiens
cauccagggaacugagcaca

SEQ ID NO: 852952 - RNA, 15 nt, Homo sapiens
caucccccacuccuu

SEQ ID NO: 852953 - RNA, 15 nt, Homo sapiens
caucuaacaaacaca

SEQ ID NO: 852954 - RNA, 18 nt, Homo sapiens
caucucaagcuugcucuu

SEQ ID NO: 852955 - RNA, 20 nt, Homo sapiens
caucucgcuaaagagugaau

SEQ ID NO: 852956 - RNA, 13 nt, Homo sapiens
caucucugaccag

SEQ ID NO: 852957 - RNA, 13 nt, Homo sapiens
caucugagaauga

SEQ ID NO: 852958 - RNA, 20 nt, Homo sapiens
caucugaguuagguuccagc

SEQ ID NO: 852959 - RNA, 15 nt, Homo sapiens
caucuuucagcugcu

SEQ ID NO: 852960 - RNA, 12 nt, Homo sapiens
caugaugaauga

SEQ ID NO: 852961 - RNA, 12 nt, Homo sapiens
caugcaugcaaa

SEQ ID NO: 852962 - RNA, 16 nt, Homo sapiens
cauggagaaugcacca

SEQ ID NO: 852963 - RNA, 17 nt, Homo sapiens
cauggcaaguacaguac

SEQ ID NO: 852964 - RNA, 12 nt, Homo sapiens
cauggucuucag

SEQ ID NO: 852965 - RNA, 17 nt, Homo sapiens
cauguaaaaagugcagu

SEQ ID NO: 852966 - RNA, 18 nt, Homo sapiens
cauguaaaaagugcagua

SEQ ID NO: 852967 - RNA, 16 nt, Homo sapiens
cauguggauauguuua

SEQ ID NO: 852968 - RNA, 14 nt, Homo sapiens
cauguucccaaaau

SEQ ID NO: 852969 - RNA, 17 nt, Homo sapiens
cauuaaaauugugaugc

SEQ ID NO: 852970 - RNA, 13 nt, Homo sapiens
cauucacauaucu

SEQ ID NO: 852971 - RNA, 14 nt, Homo sapiens
cauucaccaagagc

SEQ ID NO: 852972 - RNA, 16 nt, Homo sapiens
cauucacuuuccugca

SEQ ID NO: 852973 - RNA, 12 nt, Homo sapiens
cauucucuccau

SEQ ID NO: 852974 - RNA, 17 nt, Homo sapiens
cauucugacucauaucc

SEQ ID NO: 852975 - RNA, 22 nt, Homo sapiens
cauugcacaauauauuuuuacu

SEQ ID NO: 852976 - RNA, 17 nt, Homo sapiens
cauugcagucacuuuga

SEQ ID NO: 852977 - RNA, 18 nt, Homo sapiens
cauugcagucacuuugac

SEQ ID NO: 852978 - RNA, 22 nt, Homo sapiens
cauuguagccucaaucgaguga

SEQ ID NO: 852979 - RNA, 19 nt, Homo sapiens
cauuuaaaaaagauaucua

SEQ ID NO: 852980 - RNA, 16 nt, Homo sapiens
cauuucaugaagcaag

SEQ ID NO: 852981 - RNA, 17 nt, Homo sapiens
cauuucaugaagcaaga

SEQ ID NO: 852982 - RNA, 21 nt, Homo sapiens
cauuugcucuucauccaggga

SEQ ID NO: 852983 - RNA, 21 nt, Homo sapiens
cauuugggagaagaucucaag

SEQ ID NO: 852984 - RNA, 21 nt, Homo sapiens
cauuuguaaucuaguugucaa

SEQ ID NO: 852985 - RNA, 16 nt, Homo sapiens
cauuuuagaaugucaa

SEQ ID NO: 852986 - RNA, 21 nt, Homo sapiens
cauuuuauguuuuuguacucu

SEQ ID NO: 852987 - RNA, 16 nt, Homo sapiens
cauuuucacagcacua

SEQ ID NO: 852988 - RNA, 12 nt, Homo sapiens
ccaaaaugccaa

SEQ ID NO: 852989 - RNA, 13 nt, Homo sapiens
ccaaacacaggca

SEQ ID NO: 852990 - RNA, 22 nt, Homo sapiens
ccaaacuggaaugagcagcuuu

SEQ ID NO: 852991 - RNA, 19 nt, Homo sapiens
ccaaaggacccaaguacuu

SEQ ID NO: 852992 - RNA, 20 nt, Homo sapiens
ccaaaggacccaaguacuuu

SEQ ID NO: 852993 - RNA, 22 nt, Homo sapiens
ccaaaugugugcccagcuuaua

SEQ ID NO: 852994 - RNA, 23 nt, Homo sapiens
ccaacaacaauguguuguaaaaa

SEQ ID NO: 852995 - RNA, 11 nt, Homo sapiens
ccaacacaaag

SEQ ID NO: 852996 - RNA, 19 nt, Homo sapiens
ccaacacucuuggggacca

SEQ ID NO: 852997 - RNA, 15 nt, Homo sapiens
ccaacaguucaugga

SEQ ID NO: 852998 - RNA, 11 nt, Homo sapiens
ccaacugucag

SEQ ID NO: 852999 - RNA, 20 nt, Homo sapiens
ccaacuuuccccacguuaaa

SEQ ID NO: 853000 - RNA, 16 nt, Homo sapiens
ccaagcaggcacucug

SEQ ID NO: 853001 - RNA, 15 nt, Homo sapiens
ccaagcaugacccag

SEQ ID NO: 853002 - RNA, 12 nt, Homo sapiens
ccaaggugggaa

SEQ ID NO: 853003 - RNA, 20 nt, Homo sapiens
ccaagucucgcuacauuucc

SEQ ID NO: 853004 - RNA, 13 nt, Homo sapiens
ccaaucauugcaa

SEQ ID NO: 853005 - RNA, 15 nt, Homo sapiens
ccacaaacucuuucc

SEQ ID NO: 853006 - RNA, 21 nt, Homo sapiens
ccacaaugcgcauguaguuaa

SEQ ID NO: 853007 - RNA, 17 nt, Homo sapiens
ccacacagcuaagggag

SEQ ID NO: 853008 - RNA, 22 nt, Homo sapiens
ccacacauuuguugccagauuu

SEQ ID NO: 853009 - RNA, 17 nt, Homo sapiens
ccacauuggcugccuua

SEQ ID NO: 853010 - RNA, 18 nt, Homo sapiens
ccacauuggcugccuuau

SEQ ID NO: 853011 - RNA, 16 nt, Homo sapiens
ccaccagguacucuuu

SEQ ID NO: 853012 - RNA, 16 nt, Homo sapiens
ccaccucgugaacaca

SEQ ID NO: 853013 - RNA, 18 nt, Homo sapiens
ccacuacgggcaccuaaa

SEQ ID NO: 853014 - RNA, 22 nt, Homo sapiens
ccacugaguauguucauugcca

SEQ ID NO: 853015 - RNA, 17 nt, Homo sapiens
ccacugcugggcuccac

SEQ ID NO: 853016 - RNA, 15 nt, Homo sapiens
ccacuuggagcuaaa

SEQ ID NO: 853017 - RNA, 18 nt, Homo sapiens
ccagaaaagguacacuuu

SEQ ID NO: 853018 - RNA, 19 nt, Homo sapiens
ccagaaggaaagggcagug

SEQ ID NO: 853019 - RNA, 21 nt, Homo sapiens
ccagaagugcagaacugcagu

SEQ ID NO: 853020 - RNA, 12 nt, Homo sapiens
ccagaauacuga

SEQ ID NO: 853021 - RNA, 23 nt, Homo sapiens
ccagagccuuggaggacacuaag

SEQ ID NO: 853022 - RNA, 15 nt, Homo sapiens
ccagcagacaucaga

SEQ ID NO: 853023 - RNA, 14 nt, Homo sapiens
uucuauauugcagu

SEQ ID NO: 853024 - RNA, 17 nt, Homo sapiens
uucucaccagcccgcca

SEQ ID NO: 853025 - RNA, 12 nt, Homo sapiens
uucucacugccu

SEQ ID NO: 853026 - RNA, 16 nt, Homo sapiens
uucucauccuuugcca

SEQ ID NO: 853027 - RNA, 18 nt, Homo sapiens
uucuccaauacagcaaac

SEQ ID NO: 853028 - RNA, 22 nt, Homo sapiens
uucuccccucucuuucuaagag

SEQ ID NO: 853029 - RNA, 14 nt, Homo sapiens
uucucuccauuuca

SEQ ID NO: 853030 - RNA, 23 nt, Homo sapiens
uucucugccacagggacuugccu

SEQ ID NO: 853031 - RNA, 13 nt, Homo sapiens
uucugauguuucu

SEQ ID NO: 853032 - RNA, 23 nt, Homo sapiens
uucugccacgcuuuaugcccuug

SEQ ID NO: 853033 - RNA, 19 nt, Homo sapiens
uucugugauaagagguacu

SEQ ID NO: 853034 - RNA, 20 nt, Homo sapiens
uucugugcccagaauacuga

SEQ ID NO: 853035 - RNA, 16 nt, Homo sapiens
uucuuaaacaauuuga

SEQ ID NO: 853036 - RNA, 14 nt, Homo sapiens
uucuuagcauacau

SEQ ID NO: 853037 - RNA, 22 nt, Homo sapiens
uucuuauuuauguaacaaaguu

SEQ ID NO: 853038 - RNA, 18 nt, Homo sapiens
uucuuuuucccuuuccuu

SEQ ID NO: 853039 - RNA, 21 nt, Homo sapiens
uugaaaaauguuauaacuuau

SEQ ID NO: 853040 - RNA, 18 nt, Homo sapiens
uugaaagagaagcacuaa

SEQ ID NO: 853041 - RNA, 20 nt, Homo sapiens
uugacaaaggagcauugcag

SEQ ID NO: 853042 - RNA, 14 nt, Homo sapiens
uugaccaaugaaau

SEQ ID NO: 853043 - RNA, 21 nt, Homo sapiens
uugacuuucuguguaccacug

SEQ ID NO: 853044 - RNA, 23 nt, Homo sapiens
uugagaccgugaagauacuuugu

SEQ ID NO: 853045 - RNA, 18 nt, Homo sapiens
uugauuuccuauguauuc

SEQ ID NO: 853046 - RNA, 12 nt, Homo sapiens
uugcauauccuu

SEQ ID NO: 853047 - RNA, 19 nt, Homo sapiens
uugcaucuggguagcugua

SEQ ID NO: 853048 - RNA, 15 nt, Homo sapiens
uugcucuggugucaa

SEQ ID NO: 853049 - RNA, 22 nt, Homo sapiens
uugcugauuuugaccuuguauu

SEQ ID NO: 853050 - RNA, 18 nt, Homo sapiens
uugcugcuuaugagcaca

SEQ ID NO: 853051 - RNA, 11 nt, Homo sapiens
uugcugucaca

SEQ ID NO: 853052 - RNA, 16 nt, Homo sapiens
uuggaacuauuuacaa

SEQ ID NO: 853053 - RNA, 22 nt, Homo sapiens
uuggaguuuugaaaaacuccuu

SEQ ID NO: 853054 - RNA, 16 nt, Homo sapiens
uugggaaucagaguau

SEQ ID NO: 853055 - RNA, 14 nt, Homo sapiens
uugggcuagauccc

SEQ ID NO: 853056 - RNA, 13 nt, Homo sapiens
uuggggacaaccu

SEQ ID NO: 853057 - RNA, 17 nt, Homo sapiens
uuggggacaaccuuggc

SEQ ID NO: 853058 - RNA, 22 nt, Homo sapiens
uugggggaggggagacuuugau

SEQ ID NO: 853059 - RNA, 23 nt, Homo sapiens
uugggggaggggagacuuugaug

SEQ ID NO: 853060 - RNA, 16 nt, Homo sapiens
uuguaaaaaugucuuu

SEQ ID NO: 853061 - RNA, 14 nt, Homo sapiens
uuguaaaagcauuu

SEQ ID NO: 853062 - RNA, 12 nt, Homo sapiens
uuguacuuugaa

SEQ ID NO: 853063 - RNA, 23 nt, Homo sapiens
uugucaauaaauggcccggacau

SEQ ID NO: 853064 - RNA, 16 nt, Homo sapiens
uugucaucaccaugga

SEQ ID NO: 853065 - RNA, 16 nt, Homo sapiens
uugucuuaauggauga

SEQ ID NO: 853066 - RNA, 16 nt, Homo sapiens
uugugaaacagacuug

SEQ ID NO: 853067 - RNA, 14 nt, Homo sapiens
uuguuagcauuuuc

SEQ ID NO: 853068 - RNA, 19 nt, Homo sapiens
uuguuuaaaguauacucuu

SEQ ID NO: 853069 - RNA, 13 nt, Homo sapiens
uuguuuuacauaa

SEQ ID NO: 853070 - RNA, 13 nt, Homo sapiens
uuuaaaacugcuc

SEQ ID NO: 853071 - RNA, 22 nt, Homo sapiens
uuuaaacugauuacguuuacau

SEQ ID NO: 853072 - RNA, 22 nt, Homo sapiens
uuuaaauaguuugacacuugaa

SEQ ID NO: 853073 - RNA, 23 nt, Homo sapiens
uuuaaggcaaugguuucacaugg

SEQ ID NO: 853074 - RNA, 23 nt, Homo sapiens
uuuaaguuuggcaaacagaaugu

SEQ ID NO: 853075 - RNA, 15 nt, Homo sapiens
uuuacagaacaguuu

SEQ ID NO: 853076 - RNA, 19 nt, Homo sapiens
uuuacugcuuucugaaugu

SEQ ID NO: 853077 - RNA, 22 nt, Homo sapiens
uuuaggcaaauaagcacuccuu

SEQ ID NO: 853078 - RNA, 18 nt, Homo sapiens
uuuagucugcauauauua

SEQ ID NO: 853079 - RNA, 17 nt, Homo sapiens
uuuaugcccucaggaaa

SEQ ID NO: 853080 - RNA, 21 nt, Homo sapiens
uuuaugcccuugccucucugg

SEQ ID NO: 853081 - RNA, 21 nt, Homo sapiens
uuuauucaggggaaacuugau

SEQ ID NO: 853082 - RNA, 23 nt, Homo sapiens
uuuauugagguauaauucaccca

SEQ ID NO: 853083 - RNA, 15 nt, Homo sapiens
uuuauuuugaaaugg

SEQ ID NO: 853084 - RNA, 13 nt, Homo sapiens
uuucaauuuauca

SEQ ID NO: 853085 - RNA, 14 nt, Homo sapiens
uuucacagcacuac

SEQ ID NO: 853086 - RNA, 18 nt, Homo sapiens
uuucacaguacaggaucu

SEQ ID NO: 853087 - RNA, 10 nt, Homo sapiens
uuucagggcu

SEQ ID NO: 853088 - RNA, 21 nt, Homo sapiens
uuucauaauaaauagacacuu

SEQ ID NO: 853089 - RNA, 18 nt, Homo sapiens
uuucaucucaagcuugcu

SEQ ID NO: 853090 - RNA, 17 nt, Homo sapiens
uuuccauuaaaggugga

SEQ ID NO: 853091 - RNA, 14 nt, Homo sapiens
uuucccaacacaaa

SEQ ID NO: 853092 - RNA, 18 nt, Homo sapiens
uuuccucuggcccaguga

SEQ ID NO: 853093 - RNA, 21 nt, Homo sapiens
uuucgcacaaugggaaucucu

SEQ ID NO: 853094 - RNA, 14 nt, Homo sapiens
uuucucagcccuga

SEQ ID NO: 853095 - RNA, 12 nt, Homo sapiens
uuucucucuggc

SEQ ID NO: 853096 - RNA, 21 nt, Homo sapiens
uuucugucguuaaaaacagau

SEQ ID NO: 853097 - RNA, 21 nt, Homo sapiens
uuucuuguaaacauugccuga

SEQ ID NO: 853098 - RNA, 16 nt, Homo sapiens
uuugaaaaacuccuuc

SEQ ID NO: 853099 - RNA, 20 nt, Homo sapiens
uuugaaaaauuaccuguaua

SEQ ID NO: 853100 - RNA, 20 nt, Homo sapiens
uuugaaacaaaaugagcucu

SEQ ID NO: 853101 - RNA, 12 nt, Homo sapiens
uuugaacaacca

SEQ ID NO: 853102 - RNA, 19 nt, Homo sapiens
uuugacccgaaguaguuga

SEQ ID NO: 853103 - RNA, 22 nt, Homo sapiens
uuugauaagaaaaccgaacugg

SEQ ID NO: 853104 - RNA, 20 nt, Homo sapiens
uuugauuagagaccagauca

SEQ ID NO: 853105 - RNA, 12 nt, Homo sapiens
uuugcaggugcu

SEQ ID NO: 853106 - RNA, 17 nt, Homo sapiens
uuugccaaucauugcaa

SEQ ID NO: 853107 - RNA, 17 nt, Homo sapiens
uuugcucuucauccagg

SEQ ID NO: 853108 - RNA, 22 nt, Homo sapiens
uuugcuugaagcaaacaguuga

SEQ ID NO: 853109 - RNA, 17 nt, Homo sapiens
uuuggcuuacauuugaa

SEQ ID NO: 853110 - RNA, 18 nt, Homo sapiens
uuugguuuucuacuguua

SEQ ID NO: 853111 - RNA, 17 nt, Homo sapiens
uuuguagacauuuugaa

SEQ ID NO: 853112 - RNA, 21 nt, Homo sapiens
uuuguaguaguuguacuauga

SEQ ID NO: 853113 - RNA, 17 nt, Homo sapiens
uuuguugccagauuuca

SEQ ID NO: 853114 - RNA, 23 nt, Homo sapiens
uuuuaaguggacucucugacaaa

SEQ ID NO: 853115 - RNA, 11 nt, Homo sapiens
uuuuaccacaa

SEQ ID NO: 853116 - RNA, 19 nt, Homo sapiens
uuuuaguucugacuuugaa

SEQ ID NO: 853117 - RNA, 21 nt, Homo sapiens
uuuucaccuauccagagagua

SEQ ID NO: 853118 - RNA, 12 nt, Homo sapiens
uuuuccagaaau

SEQ ID NO: 853119 - RNA, 22 nt, Homo sapiens
uuuuccccuuaaaucaggaaau

SEQ ID NO: 853120 - RNA, 17 nt, Homo sapiens
uuuuccccuuucuugua

SEQ ID NO: 853121 - RNA, 22 nt, Homo sapiens
uuuucccuuuccuuuccuuuca

SEQ ID NO: 853122 - RNA, 21 nt, Homo sapiens
uuuucuaggccuacaugcuuu

SEQ ID NO: 853123 - RNA, 12 nt, Homo sapiens
uuuucugcacaa

SEQ ID NO: 853124 - RNA, 22 nt, Homo sapiens
uuuucuuguaaacauugccuga

SEQ ID NO: 853125 - RNA, 22 nt, Homo sapiens
uuuucuuuugugguuucucugg

SEQ ID NO: 853126 - RNA, 19 nt, Homo sapiens
uuuuuaaaacaucaauuga

SEQ ID NO: 853127 - RNA, 20 nt, Homo sapiens
uuuuugaaaguaaaagcagc

SEQ ID NO: 853128 - RNA, 21 nt, Homo sapiens
uuuuuucuguugccgaaauag

SEQ ID NO: 853129 - RNA, 15 nt, Homo sapiens
uuuuuugccaaauag

SEQ ID NO: 853130 - RNA, 12 nt, Homo sapiens
uuuuuuuguacg

SEQ ID NO: 853131 - RNA, 22 nt, Homo sapiens
aggggccaauucguucucugcc

SEQ ID NO: 853132 - RNA, 11 nt, Homo sapiens
aggggccagag

SEQ ID NO: 853133 - RNA, 16 nt, Homo sapiens
agggguuccagcacaa

SEQ ID NO: 853134 - RNA, 17 nt, Homo sapiens
agggucucacacuguga

SEQ ID NO: 853135 - RNA, 20 nt, Homo sapiens
agggucucuagugcugugaa

SEQ ID NO: 853136 - RNA, 19 nt, Homo sapiens
agguaaggagggucacugg

SEQ ID NO: 853137 - RNA, 12 nt, Homo sapiens
agguagccauuu

SEQ ID NO: 853138 - RNA, 21 nt, Homo sapiens
agguaggcacaaauacauucc

SEQ ID NO: 853139 - RNA, 14 nt, Homo sapiens
agguccaugugcac

SEQ ID NO: 853140 - RNA, 19 nt, Homo sapiens
aggucccugugagcacaua

SEQ ID NO: 853141 - RNA, 15 nt, Homo sapiens
aggugcaugccuaau

SEQ ID NO: 853142 - RNA, 18 nt, Homo sapiens
agguggagccuccuggcu

SEQ ID NO: 853143 - RNA, 19 nt, Homo sapiens
agguggccaggaauguuga

SEQ ID NO: 853144 - RNA, 23 nt, Homo sapiens
agguggucaacaacauuccucaa

SEQ ID NO: 853145 - RNA, 13 nt, Homo sapiens
agguuacagaguu

SEQ ID NO: 853146 - RNA, 14 nt, Homo sapiens
agguucaaugagau

SEQ ID NO: 853147 - RNA, 20 nt, Homo sapiens
agguucaaugagaugguggc

SEQ ID NO: 853148 - RNA, 18 nt, Homo sapiens
agguuccacagaggacac

SEQ ID NO: 853149 - RNA, 22 nt, Homo sapiens
aguaaaugagggaguccagucc

SEQ ID NO: 853150 - RNA, 15 nt, Homo sapiens
aguaauaaagacucu

SEQ ID NO: 853151 - RNA, 23 nt, Homo sapiens
aguaaucuuguugguucaccauu

SEQ ID NO: 853152 - RNA, 16 nt, Homo sapiens
aguaccccucuagcuu

SEQ ID NO: 853153 - RNA, 15 nt, Homo sapiens
aguacguguggcuug

SEQ ID NO: 853154 - RNA, 17 nt, Homo sapiens
aguacuuucaaugaaca

SEQ ID NO: 853155 - RNA, 17 nt, Homo sapiens
aguagaaugacagcuag

SEQ ID NO: 853156 - RNA, 23 nt, Homo sapiens
aguagacuugcuuuggucacuuu

SEQ ID NO: 853157 - RNA, 20 nt, Homo sapiens
aguagcugggaccacaggug

SEQ ID NO: 853158 - RNA, 17 nt, Homo sapiens
aguaggcccuuacuucu

SEQ ID NO: 853159 - RNA, 20 nt, Homo sapiens
aguauauuuaagaagccaag

SEQ ID NO: 853160 - RNA, 18 nt, Homo sapiens
aguaucaugaagccuaaa

SEQ ID NO: 853161 - RNA, 23 nt, Homo sapiens
agucagguccaugugcacugcaa

SEQ ID NO: 853162 - RNA, 22 nt, Homo sapiens
agucauaaugaauaaagugcaa

SEQ ID NO: 853163 - RNA, 21 nt, Homo sapiens
agucccuuucagcugcugcuu

SEQ ID NO: 853164 - RNA, 19 nt, Homo sapiens
agucuauagaaaugaucau

SEQ ID NO: 853165 - RNA, 15 nt, Homo sapiens
agucucaguucucuu

SEQ ID NO: 853166 - RNA, 18 nt, Homo sapiens
agucucgcucuguugccc

SEQ ID NO: 853167 - RNA, 22 nt, Homo sapiens
agucuggagggcuggucauuca

SEQ ID NO: 853168 - RNA, 23 nt, Homo sapiens
agucuggagggcuggucauucac

SEQ ID NO: 853169 - RNA, 15 nt, Homo sapiens
agugaaaacuuugua

SEQ ID NO: 853170 - RNA, 18 nt, Homo sapiens
agugaaaauaagccauga

SEQ ID NO: 853171 - RNA, 14 nt, Homo sapiens
agugaaacucccac

SEQ ID NO: 853172 - RNA, 14 nt, Homo sapiens
agugacaugcauuc

SEQ ID NO: 853173 - RNA, 18 nt, Homo sapiens
agugacaugcauucacau

SEQ ID NO: 853174 - RNA, 19 nt, Homo sapiens
agugacuguguguaggggg

SEQ ID NO: 853175 - RNA, 15 nt, Homo sapiens
agugaggaauggcag

SEQ ID NO: 853176 - RNA, 19 nt, Homo sapiens
agugauagagugcagugau

SEQ ID NO: 853177 - RNA, 15 nt, Homo sapiens
aguggcuucucccaa

SEQ ID NO: 853178 - RNA, 19 nt, Homo sapiens
agugguugaauaugauuaa

SEQ ID NO: 853179 - RNA, 18 nt, Homo sapiens
agugguugccuggacacc

SEQ ID NO: 853180 - RNA, 20 nt, Homo sapiens
aguguaaaucuaaacauaaa

SEQ ID NO: 853181 - RNA, 14 nt, Homo sapiens
agugucuaccugga

SEQ ID NO: 853182 - RNA, 15 nt, Homo sapiens
agugucuuaguuuga

SEQ ID NO: 853183 - RNA, 17 nt, Homo sapiens
agugucuuaguuugaau

SEQ ID NO: 853184 - RNA, 20 nt, Homo sapiens
aguguucacauggcucucau

SEQ ID NO: 853185 - RNA, 14 nt, Homo sapiens
aguguucauugcac

SEQ ID NO: 853186 - RNA, 16 nt, Homo sapiens
aguguuuauacaguac

SEQ ID NO: 853187 - RNA, 14 nt, Homo sapiens
aguuaagaacuaug

SEQ ID NO: 853188 - RNA, 17 nt, Homo sapiens
aguuacucucaggcaug

SEQ ID NO: 853189 - RNA, 13 nt, Homo sapiens
aguucgaccagcc

SEQ ID NO: 853190 - RNA, 15 nt, Homo sapiens
aguucugacuuugaa

SEQ ID NO: 853191 - RNA, 18 nt, Homo sapiens
aguugaccaaugaaauga

SEQ ID NO: 853192 - RNA, 14 nt, Homo sapiens
aguuuaauauaaag

SEQ ID NO: 853193 - RNA, 13 nt, Homo sapiens
aguuucacagugu

SEQ ID NO: 853194 - RNA, 20 nt, Homo sapiens
aguuugacacuugaaaaaag

SEQ ID NO: 853195 - RNA, 15 nt, Homo sapiens
aguuuucaugugcuc

SEQ ID NO: 853196 - RNA, 14 nt, Homo sapiens
aguuuugacaagcu

SEQ ID NO: 853197 - RNA, 13 nt, Homo sapiens
auaaaaaaugaca

SEQ ID NO: 853198 - RNA, 18 nt, Homo sapiens
auaaaaauuccagaauga

SEQ ID NO: 853199 - RNA, 21 nt, Homo sapiens
auaaaacugcuagugaguuau

SEQ ID NO: 853200 - RNA, 12 nt, Homo sapiens
auaaaagaaucu

SEQ ID NO: 853201 - RNA, 15 nt, Homo sapiens
auaaaagcugcauau

SEQ ID NO: 853202 - RNA, 12 nt, Homo sapiens
auaaaaucucgg

SEQ ID NO: 853203 - RNA, 20 nt, Homo sapiens
auaaaaucucgguguucuau

SEQ ID NO: 853204 - RNA, 22 nt, Homo sapiens
auaaaggaaucuagccagugaa

SEQ ID NO: 853205 - RNA, 19 nt, Homo sapiens
auaaauguuauagcugcau

SEQ ID NO: 853206 - RNA, 17 nt, Homo sapiens
auaacagauaaguccau

SEQ ID NO: 853207 - RNA, 18 nt, Homo sapiens
auaagacucacaguauaa

SEQ ID NO: 853208 - RNA, 11 nt, Homo sapiens
auaagccaaaa

SEQ ID NO: 853209 - RNA, 16 nt, Homo sapiens
auaaguccaucuguca

SEQ ID NO: 853210 - RNA, 12 nt, Homo sapiens
auaauaaucaug

SEQ ID NO: 853211 - RNA, 14 nt, Homo sapiens
auaauagcauucau

SEQ ID NO: 853212 - RNA, 15 nt, Homo sapiens
auaaucaagagccuu

SEQ ID NO: 853213 - RNA, 14 nt, Homo sapiens
auaauugaugaugu

SEQ ID NO: 853214 - RNA, 16 nt, Homo sapiens
auaauuguacuuugaa

SEQ ID NO: 853215 - RNA, 17 nt, Homo sapiens
auaauuuuacaagggag

SEQ ID NO: 853216 - RNA, 15 nt, Homo sapiens
auacccuaaaguaua

SEQ ID NO: 853217 - RNA, 18 nt, Homo sapiens
auacgcuuaagguggaaa

SEQ ID NO: 853218 - RNA, 14 nt, Homo sapiens
auagaaaggaauuu

SEQ ID NO: 853219 - RNA, 14 nt, Homo sapiens
auagaaaugaucau

SEQ ID NO: 853220 - RNA, 22 nt, Homo sapiens
auagaggguacuugaaucuuca

SEQ ID NO: 853221 - RNA, 22 nt, Homo sapiens
auagauuucauguuaugcauuu

SEQ ID NO: 853222 - RNA, 14 nt, Homo sapiens
auagcucaauaaaa

SEQ ID NO: 853223 - RNA, 12 nt, Homo sapiens
auagcugcauuu

SEQ ID NO: 853224 - RNA, 20 nt, Homo sapiens
auagcuuuagccgugucacg

SEQ ID NO: 853225 - RNA, 17 nt, Homo sapiens
auaggauuaaugaucau

SEQ ID NO: 853226 - RNA, 23 nt, Homo sapiens
auagucaccugcuguuggaugca

SEQ ID NO: 853227 - RNA, 20 nt, Homo sapiens
auagugauagagugcaguga

SEQ ID NO: 853228 - RNA, 21 nt, Homo sapiens
auauaaaagcugcauaugccu

SEQ ID NO: 853229 - RNA, 23 nt, Homo sapiens
auauaggcuuuaaaaaagcauag

SEQ ID NO: 853230 - RNA, 21 nt, Homo sapiens
auauauauuuauguuuucaca

SEQ ID NO: 853231 - RNA, 22 nt, Homo sapiens
auauauuccccuaagauuugau

SEQ ID NO: 853232 - RNA, 16 nt, Homo sapiens
auaucaaaacauccca

SEQ ID NO: 853233 - RNA, 22 nt, Homo sapiens
auauccauauuaaguaagucuc

SEQ ID NO: 853234 - RNA, 15 nt, Homo sapiens
auauccaugaugcug

SEQ ID NO: 853235 - RNA, 18 nt, Homo sapiens
auaugcuuguaacuaaaa

SEQ ID NO: 853236 - RNA, 23 nt, Homo sapiens
auaugugaacuagaaguacgugu

SEQ ID NO: 853237 - RNA, 16 nt, Homo sapiens
auauuaauaauuccaa

SEQ ID NO: 853238 - RNA, 17 nt, Homo sapiens
auauuauacagaccgaa

SEQ ID NO: 853239 - RNA, 21 nt, Homo sapiens
auauuuauguuuucacaguca

SEQ ID NO: 853240 - RNA, 15 nt, Homo sapiens
uuaaaauaacuaaca

SEQ ID NO: 853241 - RNA, 19 nt, Homo sapiens
uuaaacugucgugucauac

SEQ ID NO: 853242 - RNA, 21 nt, Homo sapiens
uuaaauuauguuuuacuguuc

SEQ ID NO: 853243 - RNA, 21 nt, Homo sapiens
uuaacuggacugaauucaaau

SEQ ID NO: 853244 - RNA, 23 nt, Homo sapiens
uuaacuguucaguauugcaauaa

SEQ ID NO: 853245 - RNA, 13 nt, Homo sapiens
uuaagaucccagu

SEQ ID NO: 853246 - RNA, 22 nt, Homo sapiens
uuaaguggacucucugacaaag

SEQ ID NO: 853247 - RNA, 17 nt, Homo sapiens
uuaauggggaggacaaa

SEQ ID NO: 853248 - RNA, 15 nt, Homo sapiens
uuacagaguucuggg

SEQ ID NO: 853249 - RNA, 16 nt, Homo sapiens
uuacagaguucuggga

SEQ ID NO: 853250 - RNA, 21 nt, Homo sapiens
uuacaggcaugggccaccacg

SEQ ID NO: 853251 - RNA, 19 nt, Homo sapiens
uuacaucuaucccagagua

SEQ ID NO: 853252 - RNA, 23 nt, Homo sapiens
uuacaucuaucccagaguacaaa

SEQ ID NO: 853253 - RNA, 14 nt, Homo sapiens
uuaccucuuuggaa

SEQ ID NO: 853254 - RNA, 15 nt, Homo sapiens
uuagaaacucaggaa

SEQ ID NO: 853255 - RNA, 21 nt, Homo sapiens
uuagcaauuuccgccugguga

SEQ ID NO: 853256 - RNA, 18 nt, Homo sapiens
uuagcagcugacuuucaa

SEQ ID NO: 853257 - RNA, 18 nt, Homo sapiens
uuagcuacguuuacucac

SEQ ID NO: 853258 - RNA, 23 nt, Homo sapiens
uuaggccccugauucacugccua

SEQ ID NO: 853259 - RNA, 16 nt, Homo sapiens
uuaguuccacugagac

SEQ ID NO: 853260 - RNA, 17 nt, Homo sapiens
uuaguucugacuuugaa

SEQ ID NO: 853261 - RNA, 13 nt, Homo sapiens
uuaucagugugca

SEQ ID NO: 853262 - RNA, 21 nt, Homo sapiens
uuaucagugugcaauacugug

SEQ ID NO: 853263 - RNA, 16 nt, Homo sapiens
uuaucguguacaagaa

SEQ ID NO: 853264 - RNA, 19 nt, Homo sapiens
uuaucuuggccuuacugua

SEQ ID NO: 853265 - RNA, 14 nt, Homo sapiens
uuauggaccaugaa

SEQ ID NO: 853266 - RNA, 13 nt, Homo sapiens
uuauguuugccac

SEQ ID NO: 853267 - RNA, 16 nt, Homo sapiens
uuauugaauucuucac

SEQ ID NO: 853268 - RNA, 14 nt, Homo sapiens
uuauugacucuuga

SEQ ID NO: 853269 - RNA, 22 nt, Homo sapiens
uuauuuaaaacucaccucccaa

SEQ ID NO: 853270 - RNA, 18 nt, Homo sapiens
uuauuugugauguacugu

SEQ ID NO: 853271 - RNA, 19 nt, Homo sapiens
uuauuuuuaagaaagaaau

SEQ ID NO: 853272 - RNA, 21 nt, Homo sapiens
uucaaaauauguguaucucaa

SEQ ID NO: 853273 - RNA, 20 nt, Homo sapiens
uucaacgaggcagucaccgc

SEQ ID NO: 853274 - RNA, 18 nt, Homo sapiens
uucaagaagucacuguca

SEQ ID NO: 853275 - RNA, 22 nt, Homo sapiens
uucaauaaaggaaauaugcacu

SEQ ID NO: 853276 - RNA, 20 nt, Homo sapiens
uucaaugccucuggcucuac

SEQ ID NO: 853277 - RNA, 22 nt, Homo sapiens
uucaaugugauauaaacagcuu

SEQ ID NO: 853278 - RNA, 15 nt, Homo sapiens
uucaccaagagccaa

SEQ ID NO: 853279 - RNA, 18 nt, Homo sapiens
uucacuggcuucccaaau

SEQ ID NO: 853280 - RNA, 13 nt, Homo sapiens
uucagaagcugau

SEQ ID NO: 853281 - RNA, 23 nt, Homo sapiens
uucagaccagccccaccaugcaa

SEQ ID NO: 853282 - RNA, 18 nt, Homo sapiens
uucaggaagaaagggaaa

SEQ ID NO: 853283 - RNA, 15 nt, Homo sapiens
uucauacacaacgua

SEQ ID NO: 853284 - RNA, 19 nt, Homo sapiens
uucauacacuguaccccag

SEQ ID NO: 853285 - RNA, 21 nt, Homo sapiens
uucauagugauagagugcagu

SEQ ID NO: 853286 - RNA, 18 nt, Homo sapiens
uucaucccacccucucac

SEQ ID NO: 853287 - RNA, 23 nt, Homo sapiens
uucaugugccgugccuuaucuga

SEQ ID NO: 853288 - RNA, 23 nt, Homo sapiens
uucauugauuuaguaaguguucu

SEQ ID NO: 853289 - RNA, 16 nt, Homo sapiens
uucauugccauuguca

SEQ ID NO: 853290 - RNA, 14 nt, Homo sapiens
uucauuuucuuucc

SEQ ID NO: 853291 - RNA, 22 nt, Homo sapiens
uuccauggcuucccagagcucc

SEQ ID NO: 853292 - RNA, 12 nt, Homo sapiens
uucccacaaaga

SEQ ID NO: 853293 - RNA, 21 nt, Homo sapiens
uucccagagcucccucugccc

SEQ ID NO: 853294 - RNA, 22 nt, Homo sapiens
uucccaucuccuuucucuggua

SEQ ID NO: 853295 - RNA, 12 nt, Homo sapiens
uuccccaggugg

SEQ ID NO: 853296 - RNA, 15 nt, Homo sapiens
uuccccuuaaaucag

SEQ ID NO: 853297 - RNA, 19 nt, Homo sapiens
uucccuccucaugccuucc

SEQ ID NO: 853298 - RNA, 21 nt, Homo sapiens
uuccgagucuuucucacugcc

SEQ ID NO: 853299 - RNA, 22 nt, Homo sapiens
uuccuaacguuuucuacuuuga

SEQ ID NO: 853300 - RNA, 18 nt, Homo sapiens
uuccuauguauucugggu

SEQ ID NO: 853301 - RNA, 16 nt, Homo sapiens
uuccucaaaaugggag

SEQ ID NO: 853302 - RNA, 16 nt, Homo sapiens
uuccucuacagccucc

SEQ ID NO: 853303 - RNA, 14 nt, Homo sapiens
uuccucugcugcau

SEQ ID NO: 853304 - RNA, 21 nt, Homo sapiens
uuccugacgagauaagcaguu

SEQ ID NO: 853305 - RNA, 23 nt, Homo sapiens
uuccugggaaaggccuccaaagc

SEQ ID NO: 853306 - RNA, 12 nt, Homo sapiens
uuccuguaagac

SEQ ID NO: 853307 - RNA, 16 nt, Homo sapiens
uucgcagccuagauau

SEQ ID NO: 853308 - RNA, 18 nt, Homo sapiens
uucgcagccuagauauga

SEQ ID NO: 853309 - RNA, 22 nt, Homo sapiens
uucgcuauucgccagcagacau

SEQ ID NO: 853310 - RNA, 22 nt, Homo sapiens
uucguaauaggugucauggaua

SEQ ID NO: 853311 - RNA, 22 nt, Homo sapiens
uucguacauaauacugaaccac

SEQ ID NO: 853312 - RNA, 18 nt, Homo sapiens
uucuauauugcaguguga

SEQ ID NO: 853313 - RNA, 19 nt, Homo sapiens
uucuccauggaguugcuaa

SEQ ID NO: 853314 - RNA, 15 nt, Homo sapiens
uucucgauucuuuga

SEQ ID NO: 853315 - RNA, 14 nt, Homo sapiens
uucucuaaccauuc

SEQ ID NO: 853316 - RNA, 13 nt, Homo sapiens
uucucugguacaa

SEQ ID NO: 853317 - RNA, 22 nt, Homo sapiens
uucucugguugagcugggccag

SEQ ID NO: 853318 - RNA, 15 nt, Homo sapiens
uucugaaaauuuaua

SEQ ID NO: 853319 - RNA, 22 nt, Homo sapiens
uucugacuuugaauuuauauaa

SEQ ID NO: 853320 - RNA, 14 nt, Homo sapiens
uucuggauaccauu

SEQ ID NO: 853321 - RNA, 20 nt, Homo sapiens
uucuggcacgaaauggcuga

SEQ ID NO: 853322 - RNA, 17 nt, Homo sapiens
uucuggggcuuugccau

SEQ ID NO: 853323 - RNA, 15 nt, Homo sapiens
uucuugauagccuca

SEQ ID NO: 853324 - RNA, 14 nt, Homo sapiens
uucuuuccuuuuca

SEQ ID NO: 853325 - RNA, 15 nt, Homo sapiens
uucuuuccuuuucau

SEQ ID NO: 853326 - RNA, 16 nt, Homo sapiens
uucuuuugcuuuccuu

SEQ ID NO: 853327 - RNA, 15 nt, Homo sapiens
uugaaaguaaaagca

SEQ ID NO: 853328 - RNA, 15 nt, Homo sapiens
uugaaaguacuccuu

SEQ ID NO: 853329 - RNA, 17 nt, Homo sapiens
uugaaauuaaagcugcc

SEQ ID NO: 853330 - RNA, 19 nt, Homo sapiens
uugaagagacaauagcauu

SEQ ID NO: 853331 - RNA, 20 nt, Homo sapiens
uugaauacucugaaaccgaa

SEQ ID NO: 853332 - RNA, 20 nt, Homo sapiens
uugaauacuugaaccauaaa

SEQ ID NO: 853333 - RNA, 18 nt, Homo sapiens
uugaaugucuuuggcuca

SEQ ID NO: 853334 - RNA, 23 nt, Homo sapiens
uugacagagagagauacucuggg

SEQ ID NO: 853335 - RNA, 17 nt, Homo sapiens
uugacuuucuguguacc

SEQ ID NO: 853336 - RNA, 23 nt, Homo sapiens
uugaguuuagaagugaguguaau

SEQ ID NO: 853337 - RNA, 20 nt, Homo sapiens
uugaugacugaaaaugaacu

SEQ ID NO: 853338 - RNA, 15 nt, Homo sapiens
uugauggauuuucaa

SEQ ID NO: 853339 - RNA, 18 nt, Homo sapiens
uugauuauauaagcaaaa

SEQ ID NO: 853340 - RNA, 19 nt, Homo sapiens
uugcaaacaacugaaaugu

SEQ ID NO: 853341 - RNA, 20 nt, Homo sapiens
uugcaucuggguagcuguaa

SEQ ID NO: 853342 - RNA, 20 nt, Homo sapiens
guuuguaguuggaaagcaaa

SEQ ID NO: 853343 - RNA, 22 nt, Homo sapiens
guuuuagguggcauaguggcuu

SEQ ID NO: 853344 - RNA, 18 nt, Homo sapiens
guuuucaucucuagggac

SEQ ID NO: 853345 - RNA, 23 nt, Homo sapiens
guuuugucuugcgggucugucag

SEQ ID NO: 853346 - RNA, 23 nt, Homo sapiens
uaaaaaaaauuugcucauaugaa

SEQ ID NO: 853347 - RNA, 14 nt, Homo sapiens
uaaaaaaugacaaa

SEQ ID NO: 853348 - RNA, 22 nt, Homo sapiens
uaaaaacaaauaauaucucuaa

SEQ ID NO: 853349 - RNA, 22 nt, Homo sapiens
uaaaaaguguuuaaaugucaaa

SEQ ID NO: 853350 - RNA, 14 nt, Homo sapiens
uaaaaaucugccac

SEQ ID NO: 853351 - RNA, 17 nt, Homo sapiens
uaaaacaugagcuuaca

SEQ ID NO: 853352 - RNA, 18 nt, Homo sapiens
uaaaaccuuaagaguucu

SEQ ID NO: 853353 - RNA, 19 nt, Homo sapiens
uaaaagauauaagacuuaa

SEQ ID NO: 853354 - RNA, 13 nt, Homo sapiens
uaaaagcugcaua

SEQ ID NO: 853355 - RNA, 21 nt, Homo sapiens
uaaaaguaaugcaauauguga

SEQ ID NO: 853356 - RNA, 22 nt, Homo sapiens
uaaaaguaaugcaauaugugaa

SEQ ID NO: 853357 - RNA, 18 nt, Homo sapiens
uaaaaucucgguguucua

SEQ ID NO: 853358 - RNA, 23 nt, Homo sapiens
uaaaaugaauuuguuguuccuuu

SEQ ID NO: 853359 - RNA, 19 nt, Homo sapiens
uaaaauggcaaguuuucca

SEQ ID NO: 853360 - RNA, 16 nt, Homo sapiens
uaaaaugguucaugaa

SEQ ID NO: 853361 - RNA, 15 nt, Homo sapiens
uaaaaugucucaagu

SEQ ID NO: 853362 - RNA, 22 nt, Homo sapiens
gggacauccugucaucugagaa

SEQ ID NO: 853363 - RNA, 15 nt, Homo sapiens
gggacccaguggcag

SEQ ID NO: 853364 - RNA, 10 nt, Homo sapiens
gggacucugc

SEQ ID NO: 853365 - RNA, 14 nt, Homo sapiens
gggacugcugugaa

SEQ ID NO: 853366 - RNA, 21 nt, Homo sapiens
gggaucucaaugcuuuccaca

SEQ ID NO: 853367 - RNA, 22 nt, Homo sapiens
gggaucucaaugcuuuccacau

SEQ ID NO: 853368 - RNA, 23 nt, Homo sapiens
gggcaagaacagaaguguucaca

SEQ ID NO: 853369 - RNA, 17 nt, Homo sapiens
gggcaagagcagcuccu

SEQ ID NO: 853370 - RNA, 17 nt, Homo sapiens
gggcaauggaaauacca

SEQ ID NO: 853371 - RNA, 22 nt, Homo sapiens
gggcagcuugggcuggcgggcc

SEQ ID NO: 853372 - RNA, 14 nt, Homo sapiens
gggcuggccagcca

SEQ ID NO: 853373 - RNA, 19 nt, Homo sapiens
ggggacaaccuuggcuugg

SEQ ID NO: 853374 - RNA, 15 nt, Homo sapiens
ggggacaaguccccu

SEQ ID NO: 853375 - RNA, 16 nt, Homo sapiens
ggggacacuguggcag

SEQ ID NO: 853376 - RNA, 19 nt, Homo sapiens
ggggagggcgcuggaugca

SEQ ID NO: 853377 - RNA, 16 nt, Homo sapiens
ggggcuggcaccagca

SEQ ID NO: 853378 - RNA, 12 nt, Homo sapiens
gggguacacaga

SEQ ID NO: 853379 - RNA, 15 nt, Homo sapiens
gggguccaggcaugu

SEQ ID NO: 853380 - RNA, 16 nt, Homo sapiens
cccccagcuucugcca

SEQ ID NO: 853381 - RNA, 16 nt, Homo sapiens
cccccuggucuuugag

SEQ ID NO: 853382 - RNA, 17 nt, Homo sapiens
ccccuaacuccugccua

SEQ ID NO: 853383 - RNA, 12 nt, Homo sapiens
uaucugcuuauc

SEQ ID NO: 853384 - RNA, 18 nt, Homo sapiens
uaucuguaagaguguuua

SEQ ID NO: 853385 - RNA, 22 nt, Homo sapiens
uaugaaaggcagggcaagaaca

SEQ ID NO: 853386 - RNA, 19 nt, Homo sapiens
uaugcauuuuuuaccacaa

SEQ ID NO: 853387 - RNA, 13 nt, Homo sapiens
uauguaacaaagu

SEQ ID NO: 853388 - RNA, 20 nt, Homo sapiens
uauguagauaauggauuuuu

SEQ ID NO: 853389 - RNA, 17 nt, Homo sapiens
uaugugaccuugccaug

SEQ ID NO: 853390 - RNA, 13 nt, Homo sapiens
uauuaaucacugu

SEQ ID NO: 853391 - RNA, 12 nt, Homo sapiens
uauuagcagcug

SEQ ID NO: 853392 - RNA, 14 nt, Homo sapiens
uauuauaugugcac

SEQ ID NO: 853393 - RNA, 20 nt, Homo sapiens
uauucuuuuuauauucugug

SEQ ID NO: 853394 - RNA, 23 nt, Homo sapiens
uauuuaagcaauaaaacugcuag

SEQ ID NO: 853395 - RNA, 15 nt, Homo sapiens
uauuuagaugcauau

SEQ ID NO: 853396 - RNA, 20 nt, Homo sapiens
uauuuaugaacagacuuuuu

SEQ ID NO: 853397 - RNA, 16 nt, Homo sapiens
uauuugaaaguucuca

SEQ ID NO: 853398 - RNA, 20 nt, Homo sapiens
uauuuguguaaggacuuugg

SEQ ID NO: 853399 - RNA, 14 nt, Homo sapiens
uauuuuaguuccuu

SEQ ID NO: 853400 - RNA, 12 nt, Homo sapiens
ucaaaaucugca

SEQ ID NO: 853401 - RNA, 18 nt, Homo sapiens
ucaaaccccugaccucaa

SEQ ID NO: 853402 - RNA, 14 nt, Homo sapiens
ucaaaccugugaag

SEQ ID NO: 853403 - RNA, 15 nt, Homo sapiens
ucaaaggcaguuugu

SEQ ID NO: 853404 - RNA, 21 nt, Homo sapiens
ucaaaggccagagucacagga

SEQ ID NO: 853405 - RNA, 21 nt, Homo sapiens
ucaaaguccagauaccaagca

SEQ ID NO: 853406 - RNA, 15 nt, Homo sapiens
ucaaauuaauugugu

SEQ ID NO: 853407 - RNA, 14 nt, Homo sapiens
ucaaauugaucugc

SEQ ID NO: 853408 - RNA, 19 nt, Homo sapiens
ucaaauuuugaguuauucc

SEQ ID NO: 853409 - RNA, 13 nt, Homo sapiens
ucaacccucucaa

SEQ ID NO: 853410 - RNA, 17 nt, Homo sapiens
ucaagaagucacuguca

SEQ ID NO: 853411 - RNA, 23 nt, Homo sapiens
ucaagaagucacugucagagaaa

SEQ ID NO: 853412 - RNA, 16 nt, Homo sapiens
ucaagaggacaaucua

SEQ ID NO: 853413 - RNA, 18 nt, Homo sapiens
ucaaggucccuucaugcg

SEQ ID NO: 853414 - RNA, 18 nt, Homo sapiens
ucaaguaccucaucugca

SEQ ID NO: 853415 - RNA, 21 nt, Homo sapiens
ucaaguccaucaaguaccuca

SEQ ID NO: 853416 - RNA, 22 nt, Homo sapiens
ucaaucucuuaaagagaaucca

SEQ ID NO: 853417 - RNA, 11 nt, Homo sapiens
ucaaugagaug

SEQ ID NO: 853418 - RNA, 19 nt, Homo sapiens
ucaaugagaugguggcauu

SEQ ID NO: 853419 - RNA, 16 nt, Homo sapiens
ucaauucgcuauucgc

SEQ ID NO: 853420 - RNA, 19 nt, Homo sapiens
ucacaccuguaauuccagc

SEQ ID NO: 853421 - RNA, 18 nt, Homo sapiens
ucacaugguuacauauca

SEQ ID NO: 853422 - RNA, 21 nt, Homo sapiens
ucaccuugguuccuggggcau

SEQ ID NO: 853423 - RNA, 14 nt, Homo sapiens
ucacgaaugauuaa

SEQ ID NO: 853424 - RNA, 21 nt, Homo sapiens
ucacgugcaaagccaccaaca

SEQ ID NO: 853425 - RNA, 11 nt, Homo sapiens
ucacuaccugu

SEQ ID NO: 853426 - RNA, 17 nt, Homo sapiens
ucacuggggcccaagag

SEQ ID NO: 853427 - RNA, 17 nt, Homo sapiens
ucacuggugguuuuccg

SEQ ID NO: 853428 - RNA, 18 nt, Homo sapiens
ucacuguguauauuugau

SEQ ID NO: 853429 - RNA, 14 nt, Homo sapiens
ucacuugcauucca

SEQ ID NO: 853430 - RNA, 20 nt, Homo sapiens
ucacuuugacagguuccuuu

SEQ ID NO: 853431 - RNA, 20 nt, Homo sapiens
ucacuuuuagaugugguuaa

SEQ ID NO: 853432 - RNA, 20 nt, Homo sapiens
ucagaaaagacgcaccagcc

SEQ ID NO: 853433 - RNA, 22 nt, Homo sapiens
ucagaaaagacgcaccagccca

SEQ ID NO: 853434 - RNA, 12 nt, Homo sapiens
ucagaacagcug

SEQ ID NO: 853435 - RNA, 20 nt, Homo sapiens
ucagaaguauauuuuugcag

SEQ ID NO: 853436 - RNA, 19 nt, Homo sapiens
ucagaaucugauaccaaag

SEQ ID NO: 853437 - RNA, 20 nt, Homo sapiens
ucagauauuaauaauuccaa

SEQ ID NO: 853438 - RNA, 18 nt, Homo sapiens
ucagcuuccccaguagcu

SEQ ID NO: 853439 - RNA, 19 nt, Homo sapiens
ucaggaaauacaccuggac

SEQ ID NO: 853440 - RNA, 17 nt, Homo sapiens
ucaggaagaaagggaaa

SEQ ID NO: 853441 - RNA, 14 nt, Homo sapiens
ucaggaucaaugac

SEQ ID NO: 853442 - RNA, 21 nt, Homo sapiens
ucagggcauaaagcauguuuc

SEQ ID NO: 853443 - RNA, 15 nt, Homo sapiens
ucaguaaggauuuug

SEQ ID NO: 853444 - RNA, 20 nt, Homo sapiens
ucauaaugaauaaagugcaa

SEQ ID NO: 853445 - RNA, 16 nt, Homo sapiens
ucauaugaacuuucau

SEQ ID NO: 853446 - RNA, 21 nt, Homo sapiens
ucauccuauuacuuaugauuu

SEQ ID NO: 853447 - RNA, 18 nt, Homo sapiens
ucaucuggaguucucaaa

SEQ ID NO: 853448 - RNA, 17 nt, Homo sapiens
ucauggauauccacuga

SEQ ID NO: 853449 - RNA, 17 nt, Homo sapiens
ucauggcccaucagggg

SEQ ID NO: 853450 - RNA, 19 nt, Homo sapiens
ucauuaaaauugugaugcu

SEQ ID NO: 853451 - RNA, 17 nt, Homo sapiens
ucauuacuuguugccua

SEQ ID NO: 853452 - RNA, 19 nt, Homo sapiens
ucauuuucuuuccuuuccc

SEQ ID NO: 853453 - RNA, 20 nt, Homo sapiens
uccaaggaaauaaugugaau

SEQ ID NO: 853454 - RNA, 14 nt, Homo sapiens
uccaauauuaaaag

SEQ ID NO: 853455 - RNA, 16 nt, Homo sapiens
uccaaucguucucugu

SEQ ID NO: 853456 - RNA, 19 nt, Homo sapiens
uccaauggaauacugaaaa

SEQ ID NO: 853457 - RNA, 20 nt, Homo sapiens
uccacacauuuguugccaga

SEQ ID NO: 853458 - RNA, 16 nt, Homo sapiens
uccacauuucuuucuc

SEQ ID NO: 853459 - RNA, 18 nt, Homo sapiens
uccaccccgcaagcacca

SEQ ID NO: 853460 - RNA, 21 nt, Homo sapiens
uccaccccgcaagcaccaucc

SEQ ID NO: 853461 - RNA, 16 nt, Homo sapiens
uccacuuggagcuaaa

SEQ ID NO: 853462 - RNA, 21 nt, Homo sapiens
uccacuuggagcuaaaacugg

SEQ ID NO: 853463 - RNA, 17 nt, Homo sapiens
uccacuuguccauguga

SEQ ID NO: 853464 - RNA, 13 nt, Homo sapiens
uccagacccucau

SEQ ID NO: 853465 - RNA, 21 nt, Homo sapiens
uccagauaccaagcaugugga

SEQ ID NO: 853466 - RNA, 23 nt, Homo sapiens
uccagcaggagggacagucucac

SEQ ID NO: 853467 - RNA, 15 nt, Homo sapiens
uccauauuugccuug

SEQ ID NO: 853468 - RNA, 22 nt, Homo sapiens
uccaugugaaacauguugccaa

SEQ ID NO: 853469 - RNA, 17 nt, Homo sapiens
uccauguuugcugccuu

SEQ ID NO: 853470 - RNA, 16 nt, Homo sapiens
uccauucaacugaaaa

SEQ ID NO: 853471 - RNA, 16 nt, Homo sapiens
uccauuccccaggugg

SEQ ID NO: 853472 - RNA, 14 nt, Homo sapiens
uccauuuacugcau

SEQ ID NO: 853473 - RNA, 17 nt, Homo sapiens
ucccacccuuucugcca

SEQ ID NO: 853474 - RNA, 21 nt, Homo sapiens
ucccacuacgggcaccuaaaa

SEQ ID NO: 853475 - RNA, 19 nt, Homo sapiens
ucccacuuuugccagacgc

SEQ ID NO: 853476 - RNA, 22 nt, Homo sapiens
ucccaggcgaucuugugucuac

SEQ ID NO: 853477 - RNA, 20 nt, Homo sapiens
ucccagggagcaagggcagg

SEQ ID NO: 853478 - RNA, 15 nt, Homo sapiens
uccccauugcuuaag

SEQ ID NO: 853479 - RNA, 20 nt, Homo sapiens
uccccauuggugcuaccugg

SEQ ID NO: 853480 - RNA, 15 nt, Homo sapiens
uccccugcuccauuu

SEQ ID NO: 853481 - RNA, 14 nt, Homo sapiens
ucccgguugugaga

SEQ ID NO: 853482 - RNA, 23 nt, Homo sapiens
ucccuaaaguguuguggccuuaa

SEQ ID NO: 853483 - RNA, 16 nt, Homo sapiens
ucccuccucaugccuu

SEQ ID NO: 853484 - RNA, 16 nt, Homo sapiens
ucccugcucacugcag

SEQ ID NO: 853485 - RNA, 18 nt, Homo sapiens
ucccuuucagcugcugcu

SEQ ID NO: 853486 - RNA, 20 nt, Homo sapiens
ucccuuuccuuuccuuucau

SEQ ID NO: 853487 - RNA, 19 nt, Homo sapiens
ucccuuuggaacuauuuac

SEQ ID NO: 853488 - RNA, 12 nt, Homo sapiens
uccgaagggaaa

SEQ ID NO: 853489 - RNA, 21 nt, Homo sapiens
uccuaacguuuucuacuuuga

SEQ ID NO: 853490 - RNA, 17 nt, Homo sapiens
uccuacacaauggugcu

SEQ ID NO: 853491 - RNA, 15 nt, Homo sapiens
uccuauaauuuugau

SEQ ID NO: 853492 - RNA, 15 nt, Homo sapiens
aucuaucccagagua

SEQ ID NO: 853493 - RNA, 22 nt, Homo sapiens
aucuauuugaaaguucucagag

SEQ ID NO: 853494 - RNA, 21 nt, Homo sapiens
aucucgccaaccccucucuca

SEQ ID NO: 853495 - RNA, 20 nt, Homo sapiens
aucucgcuaaagagugaaug

SEQ ID NO: 853496 - RNA, 17 nt, Homo sapiens
aucucuaaccccucuga

SEQ ID NO: 853497 - RNA, 22 nt, Homo sapiens
aucucuaauauauccacacauu

SEQ ID NO: 853498 - RNA, 14 nt, Homo sapiens
aucucucugggaug

SEQ ID NO: 853499 - RNA, 13 nt, Homo sapiens
aucugaauuggaa

SEQ ID NO: 853500 - RNA, 13 nt, Homo sapiens
aucugacuuuagc

SEQ ID NO: 853501 - RNA, 21 nt, Homo sapiens
aucugaguuagguuccagcau

SEQ ID NO: 853502 - RNA, 12 nt, Homo sapiens
aucugauuccag

SEQ ID NO: 853503 - RNA, 17 nt, Homo sapiens
aucugcaggugggauga

SEQ ID NO: 853504 - RNA, 20 nt, Homo sapiens
aucugucacuugcauuccac

SEQ ID NO: 853505 - RNA, 18 nt, Homo sapiens
aucuuggccuuacuguau

SEQ ID NO: 853506 - RNA, 23 nt, Homo sapiens
aucuugggugucugaacagcuau

SEQ ID NO: 853507 - RNA, 15 nt, Homo sapiens
augaaaauagcaaua

SEQ ID NO: 853508 - RNA, 12 nt, Homo sapiens
augaaaggcagg

SEQ ID NO: 853509 - RNA, 19 nt, Homo sapiens
augaaaggcagggcaagaa

SEQ ID NO: 853510 - RNA, 11 nt, Homo sapiens
augaagcaaga

SEQ ID NO: 853511 - RNA, 22 nt, Homo sapiens
augaagcugaggcugcugccag

SEQ ID NO: 853512 - RNA, 16 nt, Homo sapiens
augaauaaacaguuau

SEQ ID NO: 853513 - RNA, 18 nt, Homo sapiens
augacagcaaacagauca

SEQ ID NO: 853514 - RNA, 23 nt, Homo sapiens
augacauaagucagcaaacugcg

SEQ ID NO: 853515 - RNA, 16 nt, Homo sapiens
augacgguaucacugu

SEQ ID NO: 853516 - RNA, 16 nt, Homo sapiens
augacuuuauugcauc

SEQ ID NO: 853517 - RNA, 16 nt, Homo sapiens
augacuuucauaauaa

SEQ ID NO: 853518 - RNA, 18 nt, Homo sapiens
augagagggaugaggcaa

SEQ ID NO: 853519 - RNA, 11 nt, Homo sapiens
augagcacaga

SEQ ID NO: 853520 - RNA, 23 nt, Homo sapiens
augagcuuacauucuuacaauaa

SEQ ID NO: 853521 - RNA, 19 nt, Homo sapiens
augaggaggcagagagggu

SEQ ID NO: 853522 - RNA, 15 nt, Homo sapiens
augaucaaacuucca

SEQ ID NO: 853523 - RNA, 12 nt, Homo sapiens
augcaacuuccu

SEQ ID NO: 853524 - RNA, 15 nt, Homo sapiens
augcaaggucuugca

SEQ ID NO: 853525 - RNA, 20 nt, Homo sapiens
augcaaggucuugcauuuaa

SEQ ID NO: 853526 - RNA, 20 nt, Homo sapiens
augcacugggaaaaaguuga

SEQ ID NO: 853527 - RNA, 22 nt, Homo sapiens
augcauucacauaucugcuuau

SEQ ID NO: 853528 - RNA, 19 nt, Homo sapiens
augcauuuuuuaccacaau

SEQ ID NO: 853529 - RNA, 15 nt, Homo sapiens
augcccaaggcgaua

SEQ ID NO: 853530 - RNA, 22 nt, Homo sapiens
augccuucccugagcuuuggug

SEQ ID NO: 853531 - RNA, 15 nt, Homo sapiens
augcuaucaguuuua

SEQ ID NO: 853532 - RNA, 18 nt, Homo sapiens
augcugaacauugcauau

SEQ ID NO: 853533 - RNA, 16 nt, Homo sapiens
augcugagauccucau

SEQ ID NO: 853534 - RNA, 12 nt, Homo sapiens
augcuuuggcaa

SEQ ID NO: 853535 - RNA, 13 nt, Homo sapiens
auggaccaugaaa

SEQ ID NO: 853536 - RNA, 14 nt, Homo sapiens
auggagaaugcacc

SEQ ID NO: 853537 - RNA, 13 nt, Homo sapiens
auggaggccagug

SEQ ID NO: 853538 - RNA, 17 nt, Homo sapiens
auggaggccagugccau

SEQ ID NO: 853539 - RNA, 16 nt, Homo sapiens
auggcacaguaccaua

SEQ ID NO: 853540 - RNA, 14 nt, Homo sapiens
augggcuagagggu

SEQ ID NO: 853541 - RNA, 13 nt, Homo sapiens
auggggaggacaa

SEQ ID NO: 853542 - RNA, 21 nt, Homo sapiens
augguaaagaaauacacaggg

SEQ ID NO: 853543 - RNA, 23 nt, Homo sapiens
auguaagguuuuuuuuguacgca

SEQ ID NO: 853544 - RNA, 14 nt, Homo sapiens
auguaguuaacaau

SEQ ID NO: 853545 - RNA, 14 nt, Homo sapiens
auguauucuaugaa

SEQ ID NO: 853546 - RNA, 14 nt, Homo sapiens
augugaaaagaaua

SEQ ID NO: 853547 - RNA, 22 nt, Homo sapiens
augugaacgcccagagaacaag

SEQ ID NO: 853548 - RNA, 20 nt, Homo sapiens
augugaucacuuucaggugg

SEQ ID NO: 853549 - RNA, 20 nt, Homo sapiens
augugcagaugcuaacugga

SEQ ID NO: 853550 - RNA, 18 nt, Homo sapiens
augugcccacugucucuu

SEQ ID NO: 853551 - RNA, 23 nt, Homo sapiens
augugccugcuucagccucccac

SEQ ID NO: 853552 - RNA, 21 nt, Homo sapiens
auguuaagcaucuaaggacaa

SEQ ID NO: 853553 - RNA, 15 nt, Homo sapiens
auguucuuccaguga

SEQ ID NO: 853554 - RNA, 16 nt, Homo sapiens
auguucuuccagugag

SEQ ID NO: 853555 - RNA, 20 nt, Homo sapiens
auguuggacucugagcucau

SEQ ID NO: 853556 - RNA, 16 nt, Homo sapiens
auguuggggcucuucc

SEQ ID NO: 853557 - RNA, 15 nt, Homo sapiens
auguugguguuggca

SEQ ID NO: 853558 - RNA, 15 nt, Homo sapiens
auguuuucacaguca

SEQ ID NO: 853559 - RNA, 23 nt, Homo sapiens
auguuuuuaguucugacuuugaa

SEQ ID NO: 853560 - RNA, 16 nt, Homo sapiens
auuaaacuacccuuga

SEQ ID NO: 853561 - RNA, 18 nt, Homo sapiens
auuaaaggaaacuuugaa

SEQ ID NO: 853562 - RNA, 16 nt, Homo sapiens
auuaagcucacaauaa

SEQ ID NO: 853563 - RNA, 14 nt, Homo sapiens
auuaaguacuuaag

SEQ ID NO: 853564 - RNA, 21 nt, Homo sapiens
auuacuagacugccacaagga

SEQ ID NO: 853565 - RNA, 17 nt, Homo sapiens
auuacugcagacuauaa

SEQ ID NO: 853566 - RNA, 16 nt, Homo sapiens
auuaucaccuuuguca

SEQ ID NO: 853567 - RNA, 18 nt, Homo sapiens
auuaucgugucugcauuu

SEQ ID NO: 853568 - RNA, 13 nt, Homo sapiens
auuaucuuaucua

SEQ ID NO: 853569 - RNA, 13 nt, Homo sapiens
auuaugcuuuuaa

SEQ ID NO: 853570 - RNA, 18 nt, Homo sapiens
auuauguuugccacuuug

SEQ ID NO: 853571 - RNA, 22 nt, Homo sapiens
auucaauugaugaaaugcaaaa

SEQ ID NO: 853572 - RNA, 16 nt, Homo sapiens
auucacauaucugcuu

SEQ ID NO: 853573 - RNA, 13 nt, Homo sapiens
auucacugccuau

SEQ ID NO: 853574 - RNA, 22 nt, Homo sapiens
auucauagugauagagugcagu

SEQ ID NO: 853575 - RNA, 23 nt, Homo sapiens
auucauagugauagagugcagug

SEQ ID NO: 853576 - RNA, 15 nt, Homo sapiens
auucauuguggucau

SEQ ID NO: 853577 - RNA, 13 nt, Homo sapiens
auuccuuuccucu

SEQ ID NO: 853578 - RNA, 18 nt, Homo sapiens
auuccuuuccucuggccc

SEQ ID NO: 853579 - RNA, 23 nt, Homo sapiens
auuccuuuccucuggcccaguga

SEQ ID NO: 853580 - RNA, 18 nt, Homo sapiens
auucguacauaauacuga

SEQ ID NO: 853581 - RNA, 19 nt, Homo sapiens
auucuagaaagagccuuaa

SEQ ID NO: 853582 - RNA, 23 nt, Homo sapiens
auucuaguaauaaagacucuaca

SEQ ID NO: 853583 - RNA, 21 nt, Homo sapiens
auucucuccauuucacuggcu

SEQ ID NO: 853584 - RNA, 18 nt, Homo sapiens
auucugugucaaacaccu

SEQ ID NO: 853585 - RNA, 20 nt, Homo sapiens
auucuuucaacuucaucuca

SEQ ID NO: 853586 - RNA, 15 nt, Homo sapiens
auugagauuuaauuc

SEQ ID NO: 853587 - RNA, 18 nt, Homo sapiens
auugaugaaaauaauuua

SEQ ID NO: 853588 - RNA, 20 nt, Homo sapiens
auugaugauguuguaaaaug

SEQ ID NO: 853589 - RNA, 22 nt, Homo sapiens
auugcaucuggguagcuguaag

SEQ ID NO: 853590 - RNA, 18 nt, Homo sapiens
auugcugcuaaagguuac

SEQ ID NO: 853591 - RNA, 20 nt, Homo sapiens
auugcuguugucucugcucu

SEQ ID NO: 853592 - RNA, 19 nt, Homo sapiens
auuggcugguaaauugcca

SEQ ID NO: 853593 - RNA, 20 nt, Homo sapiens
auuggcugguaaauugccau

SEQ ID NO: 853594 - RNA, 19 nt, Homo sapiens
auuguagaccuguuucaua

SEQ ID NO: 853595 - RNA, 13 nt, Homo sapiens
auuguagccucaa

SEQ ID NO: 853596 - RNA, 14 nt, Homo sapiens
auuguagccucaau

SEQ ID NO: 853597 - RNA, 12 nt, Homo sapiens
auugugaugcuc

SEQ ID NO: 853598 - RNA, 15 nt, Homo sapiens
auuguuacuccauau

SEQ ID NO: 853599 - RNA, 21 nt, Homo sapiens
auuuaagcaauaaaacugcua

SEQ ID NO: 853600 - RNA, 17 nt, Homo sapiens
auuuaaugguuaaggga

SEQ ID NO: 853601 - RNA, 16 nt, Homo sapiens
auuuacugacugcuua

SEQ ID NO: 853602 - RNA, 13 nt, Homo sapiens
auuuaucaaucuc

SEQ ID NO: 853603 - RNA, 22 nt, Homo sapiens
cugggcccgagggugguuuacc

SEQ ID NO: 853604 - RNA, 22 nt, Homo sapiens
cugggcuggccagccaccacug

SEQ ID NO: 853605 - RNA, 15 nt, Homo sapiens
cuggggcggugcugg

SEQ ID NO: 853606 - RNA, 15 nt, Homo sapiens
cuggggcuuugccau

SEQ ID NO: 853607 - RNA, 15 nt, Homo sapiens
cugggggacacugug

SEQ ID NO: 853608 - RNA, 21 nt, Homo sapiens
cugggucagggguacacagag

SEQ ID NO: 853609 - RNA, 18 nt, Homo sapiens
cugggucuugugaugaac

SEQ ID NO: 853610 - RNA, 15 nt, Homo sapiens
cugguaaauugccau

SEQ ID NO: 853611 - RNA, 21 nt, Homo sapiens
cuguaaaggaccuccuaaaua

SEQ ID NO: 853612 - RNA, 15 nt, Homo sapiens
cuguaagaguguuua

SEQ ID NO: 853613 - RNA, 17 nt, Homo sapiens
cuguaauuccagcacuu

SEQ ID NO: 853614 - RNA, 22 nt, Homo sapiens
cuguaauuguuguuuguaugua

SEQ ID NO: 853615 - RNA, 18 nt, Homo sapiens
cuguaugguccauagcac

SEQ ID NO: 853616 - RNA, 21 nt, Homo sapiens
cuguauuugaaagugccuuug

SEQ ID NO: 853617 - RNA, 19 nt, Homo sapiens
cugucacuugcauuccacu

SEQ ID NO: 853618 - RNA, 18 nt, Homo sapiens
cugucgcacccacuguga

SEQ ID NO: 853619 - RNA, 13 nt, Homo sapiens
cugucggcugcuu

SEQ ID NO: 853620 - RNA, 21 nt, Homo sapiens
cugugacuuuauuagcagcug

SEQ ID NO: 853621 - RNA, 18 nt, Homo sapiens
cugugcccagaauacuga

SEQ ID NO: 853622 - RNA, 21 nt, Homo sapiens
cuguguaccucauggaugcuu

SEQ ID NO: 853623 - RNA, 16 nt, Homo sapiens
cuguuaauauucaugu

SEQ ID NO: 853624 - RNA, 13 nt, Homo sapiens
cuuaaaucaggaa

SEQ ID NO: 853625 - RNA, 12 nt, Homo sapiens
cuuaacccuguc

SEQ ID NO: 853626 - RNA, 17 nt, Homo sapiens
cuuaagggucauauguu

SEQ ID NO: 853627 - RNA, 19 nt, Homo sapiens
cuuaagucauaaugaauaa

SEQ ID NO: 853628 - RNA, 21 nt, Homo sapiens
cuuaauaaucaagagccuuaa

SEQ ID NO: 853629 - RNA, 15 nt, Homo sapiens
cuuacacacuggaaa

SEQ ID NO: 853630 - RNA, 13 nt, Homo sapiens
cuuacggcaagaa

SEQ ID NO: 853631 - RNA, 16 nt, Homo sapiens
cuuacucugagcucau

SEQ ID NO: 853632 - RNA, 15 nt, Homo sapiens
cuuagcauacauuca

SEQ ID NO: 853633 - RNA, 17 nt, Homo sapiens
cuuauauucuaagucac

SEQ ID NO: 853634 - RNA, 20 nt, Homo sapiens
cuuauauuuacaacacuuua

SEQ ID NO: 853635 - RNA, 17 nt, Homo sapiens
cuuaugaaguaaaguuu

SEQ ID NO: 853636 - RNA, 16 nt, Homo sapiens
cuuauuaggggcuguu

SEQ ID NO: 853637 - RNA, 19 nt, Homo sapiens
cuucaagaagucacuguca

SEQ ID NO: 853638 - RNA, 22 nt, Homo sapiens
cuucacuuuguucacuaccugu

SEQ ID NO: 853639 - RNA, 14 nt, Homo sapiens
cuucauacuuugaa

SEQ ID NO: 853640 - RNA, 21 nt, Homo sapiens
cuucauccagggaacugagca

SEQ ID NO: 853641 - RNA, 16 nt, Homo sapiens
cuuccagcccuuucag

SEQ ID NO: 853642 - RNA, 20 nt, Homo sapiens
cuuccaucugauuccagcac

SEQ ID NO: 853643 - RNA, 16 nt, Homo sapiens
cuucccucuccuggcu

SEQ ID NO: 853644 - RNA, 20 nt, Homo sapiens
cuucccugguucaagcgauu

SEQ ID NO: 853645 - RNA, 21 nt, Homo sapiens
cuuccuucauccucaaccugc

SEQ ID NO: 853646 - RNA, 18 nt, Homo sapiens
cuucgcagccuagauaug

SEQ ID NO: 853647 - RNA, 14 nt, Homo sapiens
cuucugaaggccaa

SEQ ID NO: 853648 - RNA, 15 nt, Homo sapiens
cuucugccacgcuuu

SEQ ID NO: 853649 - RNA, 19 nt, Homo sapiens
cuucuggggcuuugccauu

SEQ ID NO: 853650 - RNA, 22 nt, Homo sapiens
cuucugugcccagaauacugau

SEQ ID NO: 853651 - RNA, 17 nt, Homo sapiens
cuugaguccaaggcaga

SEQ ID NO: 853652 - RNA, 12 nt, Homo sapiens
cuugagugguga

SEQ ID NO: 853653 - RNA, 22 nt, Homo sapiens
cuugcccuuccagcccuuucag

SEQ ID NO: 853654 - RNA, 20 nt, Homo sapiens
cuugcuagcgguugaaucuu

SEQ ID NO: 853655 - RNA, 14 nt, Homo sapiens
cuugcuuacaggaa

SEQ ID NO: 853656 - RNA, 15 nt, Homo sapiens
cuugcuuacaggaau

SEQ ID NO: 853657 - RNA, 15 nt, Homo sapiens
cuuggccuuacugua

SEQ ID NO: 853658 - RNA, 15 nt, Homo sapiens
cuugggccucccacu

SEQ ID NO: 853659 - RNA, 15 nt, Homo sapiens
cuuguaaauauuguu

SEQ ID NO: 853660 - RNA, 23 nt, Homo sapiens
cuuguaacuaaaauaauuuugua

SEQ ID NO: 853661 - RNA, 22 nt, Homo sapiens
cuuguggaagacaagucugugg

SEQ ID NO: 853662 - RNA, 21 nt, Homo sapiens
cuuuaccccaccuuccuggga

SEQ ID NO: 853663 - RNA, 14 nt, Homo sapiens
cuuuagacuugaaa

SEQ ID NO: 853664 - RNA, 13 nt, Homo sapiens
cuuuagcaaagaa

SEQ ID NO: 853665 - RNA, 18 nt, Homo sapiens
cuuuauaauugaugaugu

SEQ ID NO: 853666 - RNA, 18 nt, Homo sapiens
cuuuaugcccuugccucu

SEQ ID NO: 853667 - RNA, 15 nt, Homo sapiens
cuuuauuagcagcug

SEQ ID NO: 853668 - RNA, 19 nt, Homo sapiens
cuuucagcugcagcuggga

SEQ ID NO: 853669 - RNA, 21 nt, Homo sapiens
cuuuccuaaaacaguagugua

SEQ ID NO: 853670 - RNA, 18 nt, Homo sapiens
cuuuccuaaaccauucac

SEQ ID NO: 853671 - RNA, 20 nt, Homo sapiens
cuuuccucagugacugugug

SEQ ID NO: 853672 - RNA, 17 nt, Homo sapiens
cuuuccucuggcccagu

SEQ ID NO: 853673 - RNA, 20 nt, Homo sapiens
cuuuccucuggcccagugaa

SEQ ID NO: 853674 - RNA, 16 nt, Homo sapiens
cuuuccuucaaagagg

SEQ ID NO: 853675 - RNA, 12 nt, Homo sapiens
cuuuccuuucau

SEQ ID NO: 853676 - RNA, 18 nt, Homo sapiens
cuuucuaagagaccugaa

SEQ ID NO: 853677 - RNA, 11 nt, Homo sapiens
cuuugcauuac

SEQ ID NO: 853678 - RNA, 19 nt, Homo sapiens
cuuugcugcuuaugagcac

SEQ ID NO: 853679 - RNA, 14 nt, Homo sapiens
cuuuucaaccacaa

SEQ ID NO: 853680 - RNA, 15 nt, Homo sapiens
cuuuuccugggacau

SEQ ID NO: 853681 - RNA, 20 nt, Homo sapiens
cuuuucuuuccuuuucauaa

SEQ ID NO: 853682 - RNA, 14 nt, Homo sapiens
cuuuugcagccaau

SEQ ID NO: 853683 - RNA, 16 nt, Homo sapiens
cuuuuuauauucugug

SEQ ID NO: 853684 - RNA, 20 nt, Homo sapiens
cuuuuuauuuuaguuccuuc

SEQ ID NO: 853685 - RNA, 17 nt, Homo sapiens
cuuuuucucagcccuga

SEQ ID NO: 853686 - RNA, 14 nt, Homo sapiens
gaaaaacaccagcu

SEQ ID NO: 853687 - RNA, 17 nt, Homo sapiens
gaaaaacaccagcuuug

SEQ ID NO: 853688 - RNA, 20 nt, Homo sapiens
gaaaacauggaacagugugg

SEQ ID NO: 853689 - RNA, 20 nt, Homo sapiens
gaaaagaaauuguccuugaa

SEQ ID NO: 853690 - RNA, 11 nt, Homo sapiens
gaaaaucugaa

SEQ ID NO: 853691 - RNA, 23 nt, Homo sapiens
gaaacaaccguauaccugagaaa

SEQ ID NO: 853692 - RNA, 17 nt, Homo sapiens
gaaaccagaaauaccac

SEQ ID NO: 853693 - RNA, 19 nt, Homo sapiens
gaaaccagaaauaccacau

SEQ ID NO: 853694 - RNA, 15 nt, Homo sapiens
gaaacgccaacaaaa

SEQ ID NO: 853695 - RNA, 14 nt, Homo sapiens
gaaagaaaaccugg

SEQ ID NO: 853696 - RNA, 19 nt, Homo sapiens
gaaagaaauuaaguacuua

SEQ ID NO: 853697 - RNA, 23 nt, Homo sapiens
gaaagaaccacacagcuaaggga

SEQ ID NO: 853698 - RNA, 16 nt, Homo sapiens
gaaagaauaaacuuac

SEQ ID NO: 853699 - RNA, 15 nt, Homo sapiens
gaaagaauggcacuc

SEQ ID NO: 853700 - RNA, 22 nt, Homo sapiens
gaaagaggcacccuuccaucug

SEQ ID NO: 853701 - RNA, 14 nt, Homo sapiens
gaaagaggccaaac

SEQ ID NO: 853702 - RNA, 20 nt, Homo sapiens
gaaaguaaagaaaggggaga

SEQ ID NO: 853703 - RNA, 15 nt, Homo sapiens
gaaaguccaagccgu

SEQ ID NO: 853704 - RNA, 14 nt, Homo sapiens
gaaagugacaugca

SEQ ID NO: 853705 - RNA, 17 nt, Homo sapiens
gaaagugacaugcauuc

SEQ ID NO: 853706 - RNA, 19 nt, Homo sapiens
gaaaguguucauugcacaa

SEQ ID NO: 853707 - RNA, 13 nt, Homo sapiens
gaaauaaagcaca

SEQ ID NO: 853708 - RNA, 23 nt, Homo sapiens
gaaauacacagggaggggaugau

SEQ ID NO: 853709 - RNA, 14 nt, Homo sapiens
gaaauacuguacaa

SEQ ID NO: 853710 - RNA, 18 nt, Homo sapiens
gaaauagaaaauucugcc

SEQ ID NO: 853711 - RNA, 19 nt, Homo sapiens
gaaauagucauuugugaau

SEQ ID NO: 853712 - RNA, 15 nt, Homo sapiens
gaaaucugcugcauu

SEQ ID NO: 853713 - RNA, 23 nt, Homo sapiens
gaaaugguccaguacaaaagcac

SEQ ID NO: 853714 - RNA, 17 nt, Homo sapiens
gaacaagagaaguacua

SEQ ID NO: 853715 - RNA, 14 nt, Homo sapiens
gaacacaaagccuc

SEQ ID NO: 853716 - RNA, 20 nt, Homo sapiens
gaacacguucgacaaaagca

SEQ ID NO: 853717 - RNA, 12 nt, Homo sapiens
gaacagacuuuu

SEQ ID NO: 853718 - RNA, 21 nt, Homo sapiens
gaacagcuucauguucccaaa

SEQ ID NO: 853719 - RNA, 22 nt, Homo sapiens
gaaccacgaaugagguaggcac

SEQ ID NO: 853720 - RNA, 21 nt, Homo sapiens
gaaccagggccagauaaggaa

SEQ ID NO: 853721 - RNA, 23 nt, Homo sapiens
gaaccucucaggaucaaugaccc

SEQ ID NO: 853722 - RNA, 22 nt, Homo sapiens
gaacugaaagaccagagggaca

SEQ ID NO: 853723 - RNA, 23 nt, Homo sapiens
gaagaaacgcuuggagugcuucu

SEQ ID NO: 853724 - RNA, 12 nt, Homo sapiens
gaagaacauuuu

SEQ ID NO: 853725 - RNA, 17 nt, Homo sapiens
gaagaaucugcucugaa

SEQ ID NO: 853726 - RNA, 21 nt, Homo sapiens
gaagaauugauguaugccucu

SEQ ID NO: 853727 - RNA, 18 nt, Homo sapiens
gaagaauuuacuuuggaa

SEQ ID NO: 853728 - RNA, 23 nt, Homo sapiens
gaagauacuuuguauuguccuau

SEQ ID NO: 853729 - RNA, 19 nt, Homo sapiens
uccauugguggacagccuu

SEQ ID NO: 853730 - RNA, 21 nt, Homo sapiens
ucccaacacggguaaaucuag

SEQ ID NO: 853731 - RNA, 23 nt, Homo sapiens
ucccaccccugcccccuugcccu

SEQ ID NO: 853732 - RNA, 14 nt, Homo sapiens
ucccagggagcaag

SEQ ID NO: 853733 - RNA, 16 nt, Homo sapiens
ucccagggcccuagaa

SEQ ID NO: 853734 - RNA, 14 nt, Homo sapiens
uccccagcuaggaa

SEQ ID NO: 853735 - RNA, 12 nt, Homo sapiens
uccccauugcuu

SEQ ID NO: 853736 - RNA, 16 nt, Homo sapiens
ucccccgacgcucucu

SEQ ID NO: 853737 - RNA, 18 nt, Homo sapiens
uccccugggucaccuccu

SEQ ID NO: 853738 - RNA, 22 nt, Homo sapiens
ucccgguugugagagccuguga

SEQ ID NO: 853739 - RNA, 21 nt, Homo sapiens
ucccucggccugggauuucag

SEQ ID NO: 853740 - RNA, 21 nt, Homo sapiens
ucccuguaauuguuguuugua

SEQ ID NO: 853741 - RNA, 15 nt, Homo sapiens
ucccuuuggaacuau

SEQ ID NO: 853742 - RNA, 15 nt, Homo sapiens
uccgccacaucccuc

SEQ ID NO: 853743 - RNA, 16 nt, Homo sapiens
uccguagcuucuaguc

SEQ ID NO: 853744 - RNA, 20 nt, Homo sapiens
uccguuugccaaucauugca

SEQ ID NO: 853745 - RNA, 20 nt, Homo sapiens
uccuaaaccauucaccaaga

SEQ ID NO: 853746 - RNA, 20 nt, Homo sapiens
uccucauggcccaucagggg

SEQ ID NO: 853747 - RNA, 22 nt, Homo sapiens
uccuccugaaccagcacuaauc

SEQ ID NO: 853748 - RNA, 20 nt, Homo sapiens
uccugagcccccagcuucca

SEQ ID NO: 853749 - RNA, 15 nt, Homo sapiens
uccugaucaggaaac

SEQ ID NO: 853750 - RNA, 17 nt, Homo sapiens
uccugaucaggaaacca

SEQ ID NO: 853751 - RNA, 21 nt, Homo sapiens
uccugaucaggaaaccagaaa

SEQ ID NO: 853752 - RNA, 22 nt, Homo sapiens
uccugaucaggaaaccagaaau

SEQ ID NO: 853753 - RNA, 17 nt, Homo sapiens
uccugccccaaccacaa

SEQ ID NO: 853754 - RNA, 21 nt, Homo sapiens
uccugcucccagcgcacacaa

SEQ ID NO: 853755 - RNA, 14 nt, Homo sapiens
uccuggcugagaaa

SEQ ID NO: 853756 - RNA, 14 nt, Homo sapiens
uccuguaagaccuu

SEQ ID NO: 853757 - RNA, 22 nt, Homo sapiens
uccuguaagaccuucgggucaa

SEQ ID NO: 853758 - RNA, 19 nt, Homo sapiens
uccuguaagcaagagccaa

SEQ ID NO: 853759 - RNA, 16 nt, Homo sapiens
uccuugaagcuuguau

SEQ ID NO: 853760 - RNA, 15 nt, Homo sapiens
uccuugggaccugaa

SEQ ID NO: 853761 - RNA, 18 nt, Homo sapiens
uccuuucaccccauccac

SEQ ID NO: 853762 - RNA, 13 nt, Homo sapiens
uccuuuccuuuca

SEQ ID NO: 853763 - RNA, 16 nt, Homo sapiens
ucgaaaagaaauuguc

SEQ ID NO: 853764 - RNA, 21 nt, Homo sapiens
ucgaggagcuagaacauucca

SEQ ID NO: 853765 - RNA, 23 nt, Homo sapiens
ucgauauuaauguauccaaugaa

SEQ ID NO: 853766 - RNA, 15 nt, Homo sapiens
ucguaguuacucuca

SEQ ID NO: 853767 - RNA, 19 nt, Homo sapiens
ucguccucacuggucuaca

SEQ ID NO: 853768 - RNA, 16 nt, Homo sapiens
ucgucugguuccucaa

SEQ ID NO: 853769 - RNA, 14 nt, Homo sapiens
ucguuaaaaacaga

SEQ ID NO: 853770 - RNA, 19 nt, Homo sapiens
ucuaauauauccacacauu

SEQ ID NO: 853771 - RNA, 16 nt, Homo sapiens
ucuagaagacuacaau

SEQ ID NO: 853772 - RNA, 21 nt, Homo sapiens
ucuagggaccagaaccaaacc

SEQ ID NO: 853773 - RNA, 19 nt, Homo sapiens
ucuauaauuuuacaaggga

SEQ ID NO: 853774 - RNA, 16 nt, Homo sapiens
ucuauagcaucacuua

SEQ ID NO: 853775 - RNA, 14 nt, Homo sapiens
ucuauauugcagug

SEQ ID NO: 853776 - RNA, 14 nt, Homo sapiens
ucuauuuuuguaug

SEQ ID NO: 853777 - RNA, 13 nt, Homo sapiens
ucucaaggaucca

SEQ ID NO: 853778 - RNA, 21 nt, Homo sapiens
ucucaaggauccagacucuca

SEQ ID NO: 853779 - RNA, 11 nt, Homo sapiens
ucucaccagcc

SEQ ID NO: 853780 - RNA, 18 nt, Homo sapiens
ucuccaggggucuugcaa

SEQ ID NO: 853781 - RNA, 19 nt, Homo sapiens
ucuccauggaguugcuaag

SEQ ID NO: 853782 - RNA, 21 nt, Homo sapiens
ucuccauucuguuccacugcu

SEQ ID NO: 853783 - RNA, 16 nt, Homo sapiens
ucucgcuacauuuccg

SEQ ID NO: 853784 - RNA, 18 nt, Homo sapiens
ucucgcucuguugcccag

SEQ ID NO: 853785 - RNA, 17 nt, Homo sapiens
ucucucauuugggguga

SEQ ID NO: 853786 - RNA, 21 nt, Homo sapiens
ucucucccagggaauccgaca

SEQ ID NO: 853787 - RNA, 19 nt, Homo sapiens
ucucugagcaauuguaggg

SEQ ID NO: 853788 - RNA, 13 nt, Homo sapiens
ucucugaggacaa

SEQ ID NO: 853789 - RNA, 21 nt, Homo sapiens
ucucuuaaucacaagauuauu

SEQ ID NO: 853790 - RNA, 19 nt, Homo sapiens
ucucuuaauuuucaggaag

SEQ ID NO: 853791 - RNA, 20 nt, Homo sapiens
ucucuuccuuugguuauuaa

SEQ ID NO: 853792 - RNA, 20 nt, Homo sapiens
ucucuugccucagcuucccc

SEQ ID NO: 853793 - RNA, 17 nt, Homo sapiens
ucugaacguuugguuca

SEQ ID NO: 853794 - RNA, 15 nt, Homo sapiens
ucugaaugcaugacc

SEQ ID NO: 853795 - RNA, 23 nt, Homo sapiens
ucugacaagguggucaacaacau

SEQ ID NO: 853796 - RNA, 20 nt, Homo sapiens
ucugagggcuuguaguucuu

SEQ ID NO: 853797 - RNA, 17 nt, Homo sapiens
ucugauguucuuccagu

SEQ ID NO: 853798 - RNA, 20 nt, Homo sapiens
ucugcagcugacuaaaggcc

SEQ ID NO: 853799 - RNA, 22 nt, Homo sapiens
ucugccacauuaacuacacggu

SEQ ID NO: 853800 - RNA, 13 nt, Homo sapiens
ucugccagggaug

SEQ ID NO: 853801 - RNA, 22 nt, Homo sapiens
ucugccaggguggggcucucua

SEQ ID NO: 853802 - RNA, 13 nt, Homo sapiens
ucugcgccugagu

SEQ ID NO: 853803 - RNA, 13 nt, Homo sapiens
ucugcucucuuau

SEQ ID NO: 853804 - RNA, 15 nt, Homo sapiens
ucugcugcauuucac

SEQ ID NO: 853805 - RNA, 18 nt, Homo sapiens
ucugcuuuuaaagauaug

SEQ ID NO: 853806 - RNA, 20 nt, Homo sapiens
ucuggaccccaucugugaau

SEQ ID NO: 853807 - RNA, 15 nt, Homo sapiens
ucuggcccacugugc

SEQ ID NO: 853808 - RNA, 23 nt, Homo sapiens
ucuggggcuggcaccagcaggca

SEQ ID NO: 853809 - RNA, 16 nt, Homo sapiens
ucuggggcuuugccau

SEQ ID NO: 853810 - RNA, 15 nt, Homo sapiens
ucuggguagcuguaa

SEQ ID NO: 853811 - RNA, 22 nt, Homo sapiens
ucuggucuucgcagccuagaua

SEQ ID NO: 853812 - RNA, 13 nt, Homo sapiens
ucugucuggccag

SEQ ID NO: 853813 - RNA, 15 nt, Homo sapiens
ucugugcccagaaua

SEQ ID NO: 853814 - RNA, 15 nt, Homo sapiens
ucuguguaccacugg

SEQ ID NO: 853815 - RNA, 12 nt, Homo sapiens
ucuguguguuga

SEQ ID NO: 853816 - RNA, 15 nt, Homo sapiens
ucuguugccauuaaa

SEQ ID NO: 853817 - RNA, 18 nt, Homo sapiens
ucuuaaaacacuuuucaa

SEQ ID NO: 853818 - RNA, 18 nt, Homo sapiens
ucuuacccuggcaaagca

SEQ ID NO: 853819 - RNA, 15 nt, Homo sapiens
ucuuagcauacauuc

SEQ ID NO: 853820 - RNA, 18 nt, Homo sapiens
ucuuagcauacauucaga

SEQ ID NO: 853821 - RNA, 19 nt, Homo sapiens
ucuuauuuauguaacaaag

SEQ ID NO: 853822 - RNA, 12 nt, Homo sapiens
ucuuccuuucau

SEQ ID NO: 853823 - RNA, 14 nt, Homo sapiens
ucuucgcagccuag

SEQ ID NO: 853824 - RNA, 21 nt, Homo sapiens
ucuucgcagccuagauaugaa

SEQ ID NO: 853825 - RNA, 16 nt, Homo sapiens
ucuucucauuacuugu

SEQ ID NO: 853826 - RNA, 16 nt, Homo sapiens
ucuucuccagaaggca

SEQ ID NO: 853827 - RNA, 16 nt, Homo sapiens
ucuucugaucacugaa

SEQ ID NO: 853828 - RNA, 16 nt, Homo sapiens
ucuuguaaacauugcc

SEQ ID NO: 853829 - RNA, 23 nt, Homo sapiens
ucuuuaaaagauauaagacuuaa

SEQ ID NO: 853830 - RNA, 16 nt, Homo sapiens
ucuuucucacugccuu

SEQ ID NO: 853831 - RNA, 19 nt, Homo sapiens
ugaaaauaauuuacuguga

SEQ ID NO: 853832 - RNA, 16 nt, Homo sapiens
ugaaaaugcaccccaa

SEQ ID NO: 853833 - RNA, 18 nt, Homo sapiens
ugaaacuccagaugccac

SEQ ID NO: 853834 - RNA, 13 nt, Homo sapiens
ugaaacucccacc

SEQ ID NO: 853835 - RNA, 13 nt, Homo sapiens
ugaaagaggccaa

SEQ ID NO: 853836 - RNA, 16 nt, Homo sapiens
ugaaagaggccaaaca

SEQ ID NO: 853837 - RNA, 17 nt, Homo sapiens
ugaaagaggccaaacag

SEQ ID NO: 853838 - RNA, 23 nt, Homo sapiens
ugaaagaugaguaggaguuugcu

SEQ ID NO: 853839 - RNA, 16 nt, Homo sapiens
ugaaaggcagggcaag

SEQ ID NO: 853840 - RNA, 20 nt, Homo sapiens
ugaaaugcuuuagcauacua

SEQ ID NO: 853841 - RNA, 19 nt, Homo sapiens
ugaaaugguccaguacaaa

SEQ ID NO: 853842 - RNA, 15 nt, Homo sapiens
ugaaauguggaugug

SEQ ID NO: 853843 - RNA, 20 nt, Homo sapiens
ugaacauacuaauucuaugu

SEQ ID NO: 853844 - RNA, 15 nt, Homo sapiens
ugaagaaaguuugcu

SEQ ID NO: 853845 - RNA, 12 nt, Homo sapiens
ugaagaaucugc

SEQ ID NO: 853846 - RNA, 15 nt, Homo sapiens
ugaagaaucugcucu

SEQ ID NO: 853847 - RNA, 15 nt, Homo sapiens
ugaagcaaacaguug

SEQ ID NO: 853848 - RNA, 17 nt, Homo sapiens
ugaagggguuuucuuga

SEQ ID NO: 853849 - RNA, 18 nt, Homo sapiens
ugaaguauauauuccccu

SEQ ID NO: 853850 - RNA, 15 nt, Homo sapiens
ugaaguccacagaag

SEQ ID NO: 853851 - RNA, 20 nt, Homo sapiens
ugaaguccacagaagugagc

SEQ ID NO: 853852 - RNA, 21 nt, Homo sapiens
ugaagugcaugggucagggug

SEQ ID NO: 853853 - RNA, 21 nt, Homo sapiens
uguacaaugacuuuauugcau

SEQ ID NO: 853854 - RNA, 12 nt, Homo sapiens
uguaccacuggg

SEQ ID NO: 853855 - RNA, 11 nt, Homo sapiens
uguagauuuga

SEQ ID NO: 853856 - RNA, 12 nt, Homo sapiens
uguaggccucag

SEQ ID NO: 853857 - RNA, 15 nt, Homo sapiens
uguaucaaacugcuu

SEQ ID NO: 853858 - RNA, 20 nt, Homo sapiens
ugucaagaauagcauuguaa

SEQ ID NO: 853859 - RNA, 22 nt, Homo sapiens
ugucaauucgcuauucgccagc

SEQ ID NO: 853860 - RNA, 23 nt, Homo sapiens
ugucacuccaaaccuuacucuga

SEQ ID NO: 853861 - RNA, 14 nt, Homo sapiens
ugucagaauauucu

SEQ ID NO: 853862 - RNA, 23 nt, Homo sapiens
ugucauuuuggucuaagguugcc

SEQ ID NO: 853863 - RNA, 23 nt, Homo sapiens
uguccacuuggagcuaaaacugg

SEQ ID NO: 853864 - RNA, 12 nt, Homo sapiens
uguccuacacaa

SEQ ID NO: 853865 - RNA, 17 nt, Homo sapiens
ugucguaguuacucuca

SEQ ID NO: 853866 - RNA, 22 nt, Homo sapiens
ugucucgaguacuaauaugcaa

SEQ ID NO: 853867 - RNA, 21 nt, Homo sapiens
ugucucugcagcucuacaggu

SEQ ID NO: 853868 - RNA, 15 nt, Homo sapiens
ugucuggccagggag

SEQ ID NO: 853869 - RNA, 14 nt, Homo sapiens
ugugaccagggaca

SEQ ID NO: 853870 - RNA, 16 nt, Homo sapiens
ugugaccaucccaaca

SEQ ID NO: 853871 - RNA, 23 nt, Homo sapiens
ugugacguuuuuccaguucacau

SEQ ID NO: 853872 - RNA, 23 nt, Homo sapiens
ugugagacugaguucuauauucu

SEQ ID NO: 853873 - RNA, 13 nt, Homo sapiens
ugugaggccacac

SEQ ID NO: 853874 - RNA, 12 nt, Homo sapiens
ugugauugccuc

SEQ ID NO: 853875 - RNA, 17 nt, Homo sapiens
ugugcaguaucugugaa

SEQ ID NO: 853876 - RNA, 15 nt, Homo sapiens
uguggaagacaaguc

SEQ ID NO: 853877 - RNA, 23 nt, Homo sapiens
uguggccucagagaaaucacuga

SEQ ID NO: 853878 - RNA, 22 nt, Homo sapiens
ugugugaagcuuaagggucaua

SEQ ID NO: 853879 - RNA, 19 nt, Homo sapiens
ugugugcccccagauuuaa

SEQ ID NO: 853880 - RNA, 14 nt, Homo sapiens
uguguggagucauu

SEQ ID NO: 853881 - RNA, 23 nt, Homo sapiens
uguguugcagccucaaccaacaa

SEQ ID NO: 853882 - RNA, 19 nt, Homo sapiens
uguuaaaggucauaugcac

SEQ ID NO: 853883 - RNA, 11 nt, Homo sapiens
uguucacaugg

SEQ ID NO: 853884 - RNA, 12 nt, Homo sapiens
uguucauugcac

SEQ ID NO: 853885 - RNA, 12 nt, Homo sapiens
uguucauugcca

SEQ ID NO: 853886 - RNA, 18 nt, Homo sapiens
uguucgaugcugauacuu

SEQ ID NO: 853887 - RNA, 19 nt, Homo sapiens
uguucucuccuccaaaagu

SEQ ID NO: 853888 - RNA, 24 nt, Homo sapiens
uguugacaaaggaaacacauacuc

SEQ ID NO: 853889 - RNA, 23 nt, Homo sapiens
uguugcugauuuugaccuuguau

SEQ ID NO: 853890 - RNA, 14 nt, Homo sapiens
uuaaaaacacugcu

SEQ ID NO: 853891 - RNA, 14 nt, Homo sapiens
uuaaaaauaucaaa

SEQ ID NO: 853892 - RNA, 17 nt, Homo sapiens
uuaaaaccaaucaauaa

SEQ ID NO: 853893 - RNA, 20 nt, Homo sapiens
uuaaaaguguaaaucuaaac

SEQ ID NO: 853894 - RNA, 23 nt, Homo sapiens
uuaaaucaggaaauacaccugga

SEQ ID NO: 853895 - RNA, 16 nt, Homo sapiens
uuaaaugaacacagcu

SEQ ID NO: 853896 - RNA, 16 nt, Homo sapiens
uuaaauucacaauuga

SEQ ID NO: 853897 - RNA, 17 nt, Homo sapiens
uuaacaagucauuucaa

SEQ ID NO: 853898 - RNA, 14 nt, Homo sapiens
uuaacauagccaaa

SEQ ID NO: 853899 - RNA, 17 nt, Homo sapiens
uuaacuguucaguauug

SEQ ID NO: 853900 - RNA, 13 nt, Homo sapiens
uuaagaguugaaa

SEQ ID NO: 853901 - RNA, 19 nt, Homo sapiens
uuaagaucccagugugaag

SEQ ID NO: 853902 - RNA, 13 nt, Homo sapiens
uuaaggucacuaa

SEQ ID NO: 853903 - RNA, 14 nt, Homo sapiens
uuaagguguuugaa

SEQ ID NO: 853904 - RNA, 17 nt, Homo sapiens
uuaaguggacucucuga

SEQ ID NO: 853905 - RNA, 20 nt, Homo sapiens
uuaauaaucaagagccuuaa

SEQ ID NO: 853906 - RNA, 18 nt, Homo sapiens
uuaauacuucacacagaa

SEQ ID NO: 853907 - RNA, 19 nt, Homo sapiens
uuaaugaguuucacagugu

SEQ ID NO: 853908 - RNA, 16 nt, Homo sapiens
uuaauggggaggacaa

SEQ ID NO: 853909 - RNA, 14 nt, Homo sapiens
uuacaccacaagua

SEQ ID NO: 853910 - RNA, 22 nt, Homo sapiens
uuacacuggcaaugguaguuuc

SEQ ID NO: 853911 - RNA, 17 nt, Homo sapiens
uuaccguucaccaguug

SEQ ID NO: 853912 - RNA, 13 nt, Homo sapiens
uuacguaguucua

SEQ ID NO: 853913 - RNA, 14 nt, Homo sapiens
uuacuccauauaua

SEQ ID NO: 853914 - RNA, 18 nt, Homo sapiens
uuacucucaggcauggau

SEQ ID NO: 853915 - RNA, 18 nt, Homo sapiens
uuacugcuuucugaaugu

SEQ ID NO: 853916 - RNA, 20 nt, Homo sapiens
uuagaccaaaagcaacauuc

SEQ ID NO: 853917 - RNA, 12 nt, Homo sapiens
uuagaggggcca

SEQ ID NO: 853918 - RNA, 20 nt, Homo sapiens
uuagauguaauuuuguguaa

SEQ ID NO: 853919 - RNA, 13 nt, Homo sapiens
uuagcauuuucaa

SEQ ID NO: 853920 - RNA, 18 nt, Homo sapiens
uuagcauuuucaauguga

SEQ ID NO: 853921 - RNA, 13 nt, Homo sapiens
uuaggaugugauc

SEQ ID NO: 853922 - RNA, 22 nt, Homo sapiens
uuaggaugugaucacuuucagg

SEQ ID NO: 853923 - RNA, 18 nt, Homo sapiens
uuagggccucauuugcuc

SEQ ID NO: 853924 - RNA, 13 nt, Homo sapiens
uuagucugcauau

SEQ ID NO: 853925 - RNA, 15 nt, Homo sapiens
uuauaaguugaagaa

SEQ ID NO: 853926 - RNA, 16 nt, Homo sapiens
uuauaauagcauucau

SEQ ID NO: 853927 - RNA, 20 nt, Homo sapiens
uuauaauagcauucauuucc

SEQ ID NO: 853928 - RNA, 17 nt, Homo sapiens
uuauacaaugauaucca

SEQ ID NO: 853929 - RNA, 13 nt, Homo sapiens
uuauauaagcaaa

SEQ ID NO: 853930 - RNA, 20 nt, Homo sapiens
uuaucaaugaaaauuucacu

SEQ ID NO: 853931 - RNA, 15 nt, Homo sapiens
uuaugaacagacuuu

SEQ ID NO: 853932 - RNA, 20 nt, Homo sapiens
uuaugaaguaaaguuucuga

SEQ ID NO: 853933 - RNA, 13 nt, Homo sapiens
uuaugagcacaga

SEQ ID NO: 853934 - RNA, 20 nt, Homo sapiens
uuaugcauuuuuuaccacaa

SEQ ID NO: 853935 - RNA, 17 nt, Homo sapiens
uuauucagcuucuauaa

SEQ ID NO: 853936 - RNA, 16 nt, Homo sapiens
uuauuccaagucagaa

SEQ ID NO: 853937 - RNA, 18 nt, Homo sapiens
uuauuuaaaacucaccuc

SEQ ID NO: 853938 - RNA, 16 nt, Homo sapiens
uuauuucaucauauua

SEQ ID NO: 853939 - RNA, 22 nt, Homo sapiens
uuauuuugaaauggaaauuaau

SEQ ID NO: 853940 - RNA, 23 nt, Homo sapiens
uucaaaggccagagucacaggaa

SEQ ID NO: 853941 - RNA, 18 nt, Homo sapiens
uucaaaguggaugcaauu

SEQ ID NO: 853942 - RNA, 21 nt, Homo sapiens
uucaaauggacaaacugccag

SEQ ID NO: 853943 - RNA, 23 nt, Homo sapiens
uucaagcgauucucuugccucag

SEQ ID NO: 853944 - RNA, 18 nt, Homo sapiens
uucacagcccauaauuca

SEQ ID NO: 853945 - RNA, 15 nt, Homo sapiens
uucacaguacaggau

SEQ ID NO: 853946 - RNA, 19 nt, Homo sapiens
uucacgacaguacuuucaa

SEQ ID NO: 853947 - RNA, 12 nt, Homo sapiens
uucacuggccac

SEQ ID NO: 853948 - RNA, 19 nt, Homo sapiens
uucacuuaaguuaguucca

SEQ ID NO: 853949 - RNA, 21 nt, Homo sapiens
uucacuuuguucacuaccugu

SEQ ID NO: 853950 - RNA, 17 nt, Homo sapiens
uucagauugcugaaugg

SEQ ID NO: 853951 - RNA, 21 nt, Homo sapiens
uucagugcauuaucuacuugu

SEQ ID NO: 853952 - RNA, 12 nt, Homo sapiens
uucauccaggga

SEQ ID NO: 853953 - RNA, 14 nt, Homo sapiens
uucaugaagcaaga

SEQ ID NO: 853954 - RNA, 23 nt, Homo sapiens
uucaugccuugggccgagccugc

SEQ ID NO: 853955 - RNA, 19 nt, Homo sapiens
uucauguaaaaagugcagu

SEQ ID NO: 853956 - RNA, 19 nt, Homo sapiens
uucauguccaccacugacu

SEQ ID NO: 853957 - RNA, 10 nt, Homo sapiens
uucauugcac

SEQ ID NO: 853958 - RNA, 16 nt, Homo sapiens
uucauuuucuuuccuu

SEQ ID NO: 853959 - RNA, 15 nt, Homo sapiens
uuccacagaggacac

SEQ ID NO: 853960 - RNA, 23 nt, Homo sapiens
uuccagcaggagggacagucuca

SEQ ID NO: 853961 - RNA, 16 nt, Homo sapiens
uuccaucugauuccag

SEQ ID NO: 853962 - RNA, 14 nt, Homo sapiens
uucccaaauguauu

SEQ ID NO: 853963 - RNA, 22 nt, Homo sapiens
uucccaaauguauucuacuugu

SEQ ID NO: 853964 - RNA, 21 nt, Homo sapiens
uucccacuacgggcaccuaaa

SEQ ID NO: 853965 - RNA, 17 nt, Homo sapiens
uuccccuuuuucuuucc

SEQ ID NO: 853966 - RNA, 20 nt, Homo sapiens
uuccuaucaaaaagauauca

SEQ ID NO: 853967 - RNA, 17 nt, Homo sapiens
uuccucagugacugugu

SEQ ID NO: 853968 - RNA, 13 nt, Homo sapiens
uuccucgcauuaa

SEQ ID NO: 853969 - RNA, 16 nt, Homo sapiens
uuccucuccaccugca

SEQ ID NO: 853970 - RNA, 15 nt, Homo sapiens
uuccuuuccuuucau

SEQ ID NO: 853971 - RNA, 19 nt, Homo sapiens
uucuguguaccacugggau

SEQ ID NO: 853972 - RNA, 14 nt, Homo sapiens
uucuucacauguaa

SEQ ID NO: 853973 - RNA, 14 nt, Homo sapiens
uucuugacucugaa

SEQ ID NO: 853974 - RNA, 20 nt, Homo sapiens
uucuuuauugcuuacugugu

SEQ ID NO: 853975 - RNA, 13 nt, Homo sapiens
uucuuuuugccaa

SEQ ID NO: 853976 - RNA, 21 nt, Homo sapiens
uugaaaguaaaagcagcauaa

SEQ ID NO: 853977 - RNA, 19 nt, Homo sapiens
uugaauaaacaccacugga

SEQ ID NO: 853978 - RNA, 14 nt, Homo sapiens
uugaauaaacuaga

SEQ ID NO: 853979 - RNA, 20 nt, Homo sapiens
uugacacuugaaaaaagaua

SEQ ID NO: 853980 - RNA, 13 nt, Homo sapiens
uugacagcuauaa

SEQ ID NO: 853981 - RNA, 18 nt, Homo sapiens
uugcacaccagccuuaca

SEQ ID NO: 853982 - RNA, 15 nt, Homo sapiens
uugcagucacuuuga

SEQ ID NO: 853983 - RNA, 21 nt, Homo sapiens
uugcauugucuguuggcaaau

SEQ ID NO: 853984 - RNA, 13 nt, Homo sapiens
uugccauugcugc

SEQ ID NO: 853985 - RNA, 17 nt, Homo sapiens
uugccuauaagccaaaa

SEQ ID NO: 853986 - RNA, 13 nt, Homo sapiens
uugcuuuggucac

SEQ ID NO: 853987 - RNA, 13 nt, Homo sapiens
uuggaagacuucu

SEQ ID NO: 853988 - RNA, 20 nt, Homo sapiens
uuggaagugaaaacuuugua

SEQ ID NO: 853989 - RNA, 16 nt, Homo sapiens
uuggauagacuucugc

SEQ ID NO: 853990 - RNA, 20 nt, Homo sapiens
uugggaccugaaucuaucac

SEQ ID NO: 853991 - RNA, 22 nt, Homo sapiens
uuggggaccacagaggcugugg

SEQ ID NO: 853992 - RNA, 15 nt, Homo sapiens
uugguaauagauuua

SEQ ID NO: 853993 - RNA, 20 nt, Homo sapiens
uugguggccccaaccacagg

SEQ ID NO: 853994 - RNA, 17 nt, Homo sapiens
uugguuucaaauccuuu

SEQ ID NO: 853995 - RNA, 21 nt, Homo sapiens
uugguuugugauccaggaaua

SEQ ID NO: 853996 - RNA, 17 nt, Homo sapiens
uuguaagaaauacugua

SEQ ID NO: 853997 - RNA, 17 nt, Homo sapiens
uuguaauguaucaaaua

SEQ ID NO: 853998 - RNA, 14 nt, Homo sapiens
uuguauaugcugca

SEQ ID NO: 853999 - RNA, 17 nt, Homo sapiens
uuguauccaaggaaaua

SEQ ID NO: 854000 - RNA, 19 nt, Homo sapiens
uugucacuccaaaccuuac

SEQ ID NO: 854001 - RNA, 16 nt, Homo sapiens
uugucagaccauaaga

SEQ ID NO: 854002 - RNA, 20 nt, Homo sapiens
uugucauuuuggucuaaggu

SEQ ID NO: 854003 - RNA, 20 nt, Homo sapiens
uuguccuugaagcuuguauc

SEQ ID NO: 854004 - RNA, 23 nt, Homo sapiens
uugucuugcgggucugucagggu

SEQ ID NO: 854005 - RNA, 17 nt, Homo sapiens
uugugagagccugugau

SEQ ID NO: 854006 - RNA, 18 nt, Homo sapiens
uugugagagccugugauc

SEQ ID NO: 854007 - RNA, 12 nt, Homo sapiens
uugugcugccag

SEQ ID NO: 854008 - RNA, 17 nt, Homo sapiens
uuguugaaagaaaguau

SEQ ID NO: 854009 - RNA, 20 nt, Homo sapiens
uuguugauaaggaacauuua

SEQ ID NO: 854010 - RNA, 22 nt, Homo sapiens
uuguugccagaugcagcacaua

SEQ ID NO: 854011 - RNA, 21 nt, Homo sapiens
uuguugccagauuucagaaaa

SEQ ID NO: 854012 - RNA, 16 nt, Homo sapiens
uuuaaaaaguuugaau

SEQ ID NO: 854013 - RNA, 23 nt, Homo sapiens
uuuaaaugucaaaugugaauugg

SEQ ID NO: 854014 - RNA, 23 nt, Homo sapiens
uuuaacauuuuguuaagaggaua

SEQ ID NO: 854015 - RNA, 19 nt, Homo sapiens
uuuaaucucuaacagugga

SEQ ID NO: 854016 - RNA, 20 nt, Homo sapiens
uuuaaugaguuucacagugu

SEQ ID NO: 854017 - RNA, 21 nt, Homo sapiens
uuuacauacguuuguguggug

SEQ ID NO: 854018 - RNA, 16 nt, Homo sapiens
uuuacaucuaucccag

SEQ ID NO: 854019 - RNA, 19 nt, Homo sapiens
uuuacaucuaucccagagu

SEQ ID NO: 854020 - RNA, 23 nt, Homo sapiens
uuuaggaagcuagacuagcugua

SEQ ID NO: 854021 - RNA, 23 nt, Homo sapiens
uuuaguaagugcuuguuuuacau

SEQ ID NO: 854022 - RNA, 17 nt, Homo sapiens
uuuauaaauguauugau

SEQ ID NO: 854023 - RNA, 14 nt, Homo sapiens
uuuauaaguugaag

SEQ ID NO: 854024 - RNA, 24 nt, Homo sapiens
uuuauuacgauuaguauaugauca

SEQ ID NO: 854025 - RNA, 14 nt, Homo sapiens
uuuauugacucuug

SEQ ID NO: 854026 - RNA, 17 nt, Homo sapiens
uuucaaaauauguguau

SEQ ID NO: 854027 - RNA, 20 nt, Homo sapiens
uuucacagcccauaauucau

SEQ ID NO: 854028 - RNA, 20 nt, Homo sapiens
uuucacagucaccaagugua

SEQ ID NO: 854029 - RNA, 13 nt, Homo sapiens
uuucaccuaucca

SEQ ID NO: 854030 - RNA, 18 nt, Homo sapiens
uuucagaccagccccacc

SEQ ID NO: 854031 - RNA, 19 nt, Homo sapiens
uuucaucaggaaaccuuau

SEQ ID NO: 854032 - RNA, 16 nt, Homo sapiens
uuuccagauuugcuca

SEQ ID NO: 854033 - RNA, 15 nt, Homo sapiens
uuuccuccuuugcag

SEQ ID NO: 854034 - RNA, 22 nt, Homo sapiens
uuuccuuucuuagcugaugucu

SEQ ID NO: 854035 - RNA, 13 nt, Homo sapiens
uuucucaccagcc

SEQ ID NO: 854036 - RNA, 13 nt, Homo sapiens
uuucucucuggcc

SEQ ID NO: 854037 - RNA, 15 nt, Homo sapiens
uuucugccagggaug

SEQ ID NO: 854038 - RNA, 23 nt, Homo sapiens
uuucuuuugugguuucucuggcc

SEQ ID NO: 854039 - RNA, 21 nt, Homo sapiens
uuugaaaacaccagcuguaua

SEQ ID NO: 854040 - RNA, 13 nt, Homo sapiens
uuugaaagcaaaa

SEQ ID NO: 854041 - RNA, 14 nt, Homo sapiens
uuugaacaaccaaa

SEQ ID NO: 854042 - RNA, 15 nt, Homo sapiens
uuugaacaguuggau

SEQ ID NO: 854043 - RNA, 22 nt, Homo sapiens
uuugauccgcagcaggggccag

SEQ ID NO: 854044 - RNA, 18 nt, Homo sapiens
uuugcuaagaugcauuua

SEQ ID NO: 854045 - RNA, 19 nt, Homo sapiens
uuugcuguggccuucccgg

SEQ ID NO: 854046 - RNA, 16 nt, Homo sapiens
uuuggaaagacuggac

SEQ ID NO: 854047 - RNA, 16 nt, Homo sapiens
uuuggaaggaagaaca

SEQ ID NO: 854048 - RNA, 12 nt, Homo sapiens
uuuggucucucc

SEQ ID NO: 854049 - RNA, 17 nt, Homo sapiens
uuuguaaaugacuuuca

SEQ ID NO: 854050 - RNA, 19 nt, Homo sapiens
uuuguaauaauaaagaaua

SEQ ID NO: 854051 - RNA, 14 nt, Homo sapiens
uuuguacucugcag

SEQ ID NO: 854052 - RNA, 15 nt, Homo sapiens
uuuguuuagucuuua

SEQ ID NO: 854053 - RNA, 10 nt, Homo sapiens
uuuguuucaa

SEQ ID NO: 854054 - RNA, 16 nt, Homo sapiens
uuuuacaucuauccca

SEQ ID NO: 854055 - RNA, 22 nt, Homo sapiens
uuuuaggaagcuagacuagcug

SEQ ID NO: 854056 - RNA, 20 nt, Homo sapiens
uuuugagauguugagaggaa

SEQ ID NO: 854057 - RNA, 14 nt, Homo sapiens
uuuuguuacauaga

SEQ ID NO: 854058 - RNA, 22 nt, Homo sapiens
uuuuuacaucuaucccagagua

SEQ ID NO: 854059 - RNA, 20 nt, Homo sapiens
uuuuuauaaugacuggucuu

SEQ ID NO: 854060 - RNA, 20 nt, Homo sapiens
uuuuuggugucucauaccca

SEQ ID NO: 854061 - RNA, 15 nt, Homo sapiens
uuuuuguaucagaau

SEQ ID NO: 854062 - RNA, 13 nt, Homo sapiens
uuuuuuaccacaa

SEQ ID NO: 854063 - RNA, 14 nt, Homo sapiens
aucccaacaccuca

SEQ ID NO: 854064 - RNA, 18 nt, Homo sapiens
aucccaccuuuaccccac

SEQ ID NO: 854065 - RNA, 13 nt, Homo sapiens
aucccucucugcu

SEQ ID NO: 854066 - RNA, 17 nt, Homo sapiens
aucccugcucacugcag

SEQ ID NO: 854067 - RNA, 15 nt, Homo sapiens
aucgaggagcuagaa

SEQ ID NO: 854068 - RNA, 22 nt, Homo sapiens
aucgaggagcuagaacauucca

SEQ ID NO: 854069 - RNA, 13 nt, Homo sapiens
aucuaaacauaaa

SEQ ID NO: 854070 - RNA, 16 nt, Homo sapiens
aggccagaagaccucc

SEQ ID NO: 854071 - RNA, 17 nt, Homo sapiens
aggccagugccauuuca

SEQ ID NO: 854072 - RNA, 14 nt, Homo sapiens
aggcccaccuggaa

SEQ ID NO: 854073 - RNA, 16 nt, Homo sapiens
aggcccagcugaggag

SEQ ID NO: 854074 - RNA, 12 nt, Homo sapiens
aggccuguccaa

SEQ ID NO: 854075 - RNA, 13 nt, Homo sapiens
aggcgagcagggc

SEQ ID NO: 854076 - RNA, 15 nt, Homo sapiens
aggcucaaauuuuga

SEQ ID NO: 854077 - RNA, 15 nt, Homo sapiens
aggcucagauuguaa

SEQ ID NO: 854078 - RNA, 23 nt, Homo sapiens
aggcuccuguggcugucuuguca

SEQ ID NO: 854079 - RNA, 18 nt, Homo sapiens
aggcugcggcuugcccag

SEQ ID NO: 854080 - RNA, 13 nt, Homo sapiens
aaaaaagauuucc

SEQ ID NO: 854081 - RNA, 13 nt, Homo sapiens
aaaaagucacaaa

SEQ ID NO: 854082 - RNA, 11 nt, Homo sapiens
aaaaaugcacu

SEQ ID NO: 854083 - RNA, 13 nt, Homo sapiens
aaaaaugcugaac

SEQ ID NO: 854084 - RNA, 12 nt, Homo sapiens
aaaaaugguacu

SEQ ID NO: 854085 - RNA, 14 nt, Homo sapiens
aaaaaugucuuuca

SEQ ID NO: 854086 - RNA, 23 nt, Homo sapiens
aaaaauucagugaugugccuaaa

SEQ ID NO: 854087 - RNA, 13 nt, Homo sapiens
aaaaauugaacua

SEQ ID NO: 854088 - RNA, 15 nt, Homo sapiens
aaaaauuugcucaua

SEQ ID NO: 854089 - RNA, 15 nt, Homo sapiens
aaaacaaauaauauc

SEQ ID NO: 854090 - RNA, 12 nt, Homo sapiens
aaaaccaaacaa

SEQ ID NO: 854091 - RNA, 22 nt, Homo sapiens
aaaaccuuaagaguucuaacca

SEQ ID NO: 854092 - RNA, 16 nt, Homo sapiens
aaaagacgcaccagcc

SEQ ID NO: 854093 - RNA, 13 nt, Homo sapiens
aaaagauguagau

SEQ ID NO: 854094 - RNA, 12 nt, Homo sapiens
aaaagcugcaua

SEQ ID NO: 854095 - RNA, 22 nt, Homo sapiens
aaaagucuggcccacugugcag

SEQ ID NO: 854096 - RNA, 11 nt, Homo sapiens
aaaagugcagu

SEQ ID NO: 854097 - RNA, 19 nt, Homo sapiens
aaaagugccuuagcaugug

SEQ ID NO: 854098 - RNA, 12 nt, Homo sapiens
aaaaucuaacag

SEQ ID NO: 854099 - RNA, 23 nt, Homo sapiens
aaaaucuuuuuugauaugauaau

SEQ ID NO: 854100 - RNA, 13 nt, Homo sapiens
aaaaugucaaaag

SEQ ID NO: 854101 - RNA, 19 nt, Homo sapiens
aaaauuuuuugagugaagu

SEQ ID NO: 854102 - RNA, 15 nt, Homo sapiens
aaacagaauguucau

SEQ ID NO: 854103 - RNA, 20 nt, Homo sapiens
aaacaucaaauaauugaaga

SEQ ID NO: 854104 - RNA, 19 nt, Homo sapiens
aaacaugaccuuccacaau

SEQ ID NO: 854105 - RNA, 20 nt, Homo sapiens
aaacauucacuuuccugcag

SEQ ID NO: 854106 - RNA, 17 nt, Homo sapiens
aaacauuuaaagacaaa

SEQ ID NO: 854107 - RNA, 16 nt, Homo sapiens
aaaccccugaccucaa

SEQ ID NO: 854108 - RNA, 21 nt, Homo sapiens
aaacucaucuggaguucucaa

SEQ ID NO: 854109 - RNA, 20 nt, Homo sapiens
aaacucuguuacacuuuuug

SEQ ID NO: 854110 - RNA, 19 nt, Homo sapiens
aaacugauuacguuuacau

SEQ ID NO: 854111 - RNA, 19 nt, Homo sapiens
aaacuggaaugagcagcuu

SEQ ID NO: 854112 - RNA, 17 nt, Homo sapiens
aaagaacgcugauuuaa

SEQ ID NO: 854113 - RNA, 15 nt, Homo sapiens
aaagaaucugauacu

SEQ ID NO: 854114 - RNA, 14 nt, Homo sapiens
aaagacuugcacaa

SEQ ID NO: 854115 - RNA, 23 nt, Homo sapiens
aaagagccuuggccuuaaggaaa

SEQ ID NO: 854116 - RNA, 11 nt, Homo sapiens
aaagagugaau

SEQ ID NO: 854117 - RNA, 12 nt, Homo sapiens
aaagagugaaug

SEQ ID NO: 854118 - RNA, 13 nt, Homo sapiens
aaagcacuggaaa

SEQ ID NO: 854119 - RNA, 15 nt, Homo sapiens
aaaggaaaugacuag

SEQ ID NO: 854120 - RNA, 17 nt, Homo sapiens
aaaggcagggcaagaac

SEQ ID NO: 854121 - RNA, 18 nt, Homo sapiens
aaaggcaguugacuagaa

SEQ ID NO: 854122 - RNA, 19 nt, Homo sapiens
aaaggcauauauguacuag

SEQ ID NO: 854123 - RNA, 22 nt, Homo sapiens
aaaggggcaagagcagcuccuu

SEQ ID NO: 854124 - RNA, 15 nt, Homo sapiens
aaaggguuaaugugu

SEQ ID NO: 854125 - RNA, 19 nt, Homo sapiens
aaaguaaagaaaggggaga

SEQ ID NO: 854126 - RNA, 22 nt, Homo sapiens
aaaguagaaaagcccagcuuuu

SEQ ID NO: 854127 - RNA, 19 nt, Homo sapiens
aaagucuggcccacugugc

SEQ ID NO: 854128 - RNA, 16 nt, Homo sapiens
aaagugacaugcauuc

SEQ ID NO: 854129 - RNA, 15 nt, Homo sapiens
aaaguuccuucugua

SEQ ID NO: 854130 - RNA, 23 nt, Homo sapiens
aaaguucucagaguuguacauau

SEQ ID NO: 854131 - RNA, 11 nt, Homo sapiens
aaaguuuacuu

SEQ ID NO: 854132 - RNA, 20 nt, Homo sapiens
aaaguuugcuguaccacaau

SEQ ID NO: 854133 - RNA, 17 nt, Homo sapiens
aaauaaaaagaguauau

SEQ ID NO: 854134 - RNA, 13 nt, Homo sapiens
aaauaaaacacug

SEQ ID NO: 854135 - RNA, 13 nt, Homo sapiens
aaauaaacaaagu

SEQ ID NO: 854136 - RNA, 16 nt, Homo sapiens
aaauaacuaacaaaca

SEQ ID NO: 854137 - RNA, 14 nt, Homo sapiens
aaauaagugauuaa

SEQ ID NO: 854138 - RNA, 19 nt, Homo sapiens
aaauagaaaauucugccgu

SEQ ID NO: 854139 - RNA, 15 nt, Homo sapiens
aaauagacacuugag

SEQ ID NO: 854140 - RNA, 22 nt, Homo sapiens
aaauagauuuauuuuccagcuu

SEQ ID NO: 854141 - RNA, 22 nt, Homo sapiens
aaauauagcuaauaacauguga

SEQ ID NO: 854142 - RNA, 16 nt, Homo sapiens
aaauauuuacuauuua

SEQ ID NO: 854143 - RNA, 18 nt, Homo sapiens
aaaucauccuauuacuua

SEQ ID NO: 854144 - RNA, 11 nt, Homo sapiens
aaauccccaag

SEQ ID NO: 854145 - RNA, 18 nt, Homo sapiens
aaauuagacaaccaagua

SEQ ID NO: 854146 - RNA, 20 nt, Homo sapiens
aaauuccauagcucaauaaa

SEQ ID NO: 854147 - RNA, 20 nt, Homo sapiens
aaauucugccgucugagguu

SEQ ID NO: 854148 - RNA, 19 nt, Homo sapiens
aaauugaaauaaagauaaa

SEQ ID NO: 854149 - RNA, 14 nt, Homo sapiens
aaauuguccuugaa

SEQ ID NO: 854150 - RNA, 15 nt, Homo sapiens
aaauugucuuaaugg

SEQ ID NO: 854151 - RNA, 13 nt, Homo sapiens
aaauugugaugcu

SEQ ID NO: 854152 - RNA, 16 nt, Homo sapiens
aaauuguuaacauagg

SEQ ID NO: 854153 - RNA, 16 nt, Homo sapiens
aacaaaguuuucaugu

SEQ ID NO: 854154 - RNA, 15 nt, Homo sapiens
aacaaauaauaucuc

SEQ ID NO: 854155 - RNA, 15 nt, Homo sapiens
aacaaauugaugcaa

SEQ ID NO: 854156 - RNA, 13 nt, Homo sapiens
aacaagucccugu

SEQ ID NO: 854157 - RNA, 16 nt, Homo sapiens
aacaagucccuguaau

SEQ ID NO: 854158 - RNA, 22 nt, Homo sapiens
aacaccuucuauagcaucacuu

SEQ ID NO: 854159 - RNA, 13 nt, Homo sapiens
aacagaacacuug

SEQ ID NO: 854160 - RNA, 13 nt, Homo sapiens
aacagaagugcau

SEQ ID NO: 854161 - RNA, 21 nt, Homo sapiens
aacagcaagugugaauacugc

SEQ ID NO: 854162 - RNA, 23 nt, Homo sapiens
aacauaauuguuaggaccacuga

SEQ ID NO: 854163 - RNA, 18 nt, Homo sapiens
aacaucccaauucuuuag

SEQ ID NO: 854164 - RNA, 17 nt, Homo sapiens
aacaucuuucagcugcu

SEQ ID NO: 854165 - RNA, 23 nt, Homo sapiens
aacaugguucagguacacauauu

SEQ ID NO: 854166 - RNA, 12 nt, Homo sapiens
aacaugugaaaa

SEQ ID NO: 854167 - RNA, 20 nt, Homo sapiens
aacauucguucucuaaccau

SEQ ID NO: 854168 - RNA, 13 nt, Homo sapiens
aacauugccugau

SEQ ID NO: 854169 - RNA, 16 nt, Homo sapiens
aaccaaaugugcauug

SEQ ID NO: 854170 - RNA, 18 nt, Homo sapiens
aaccaaaugugcauugaa

SEQ ID NO: 854171 - RNA, 13 nt, Homo sapiens
aaccccucucuca

SEQ ID NO: 854172 - RNA, 14 nt, Homo sapiens
aaccccugaccuca

SEQ ID NO: 854173 - RNA, 16 nt, Homo sapiens
aacccguaagauuccu

SEQ ID NO: 854174 - RNA, 23 nt, Homo sapiens
aaccgaagggacuggaucugcag

SEQ ID NO: 854175 - RNA, 17 nt, Homo sapiens
aaccugcuguccuccag

SEQ ID NO: 854176 - RNA, 14 nt, Homo sapiens
aacgccaacaaaaa

SEQ ID NO: 854177 - RNA, 21 nt, Homo sapiens
aacuacacgguucaaaccugu

SEQ ID NO: 854178 - RNA, 13 nt, Homo sapiens
aacucaaaucccc

SEQ ID NO: 854179 - RNA, 13 nt, Homo sapiens
aacuccugccuau

SEQ ID NO: 854180 - RNA, 17 nt, Homo sapiens
aacucucauuauucucu

SEQ ID NO: 854181 - RNA, 13 nt, Homo sapiens
aacucuugacagc

SEQ ID NO: 854182 - RNA, 12 nt, Homo sapiens
aacugagcacag

SEQ ID NO: 854183 - RNA, 17 nt, Homo sapiens
aacugcagucacugcac

SEQ ID NO: 854184 - RNA, 21 nt, Homo sapiens
aacugcucauuucaugaagca

SEQ ID NO: 854185 - RNA, 19 nt, Homo sapiens
aacugcuuccuuucuugau

SEQ ID NO: 854186 - RNA, 21 nt, Homo sapiens
aacuggcuauccuuggggaag

SEQ ID NO: 854187 - RNA, 22 nt, Homo sapiens
aacuguuaaaggucauaugcac

SEQ ID NO: 854188 - RNA, 18 nt, Homo sapiens
aacuuuguagacauuuug

SEQ ID NO: 854189 - RNA, 13 nt, Homo sapiens
aagaaaaccaaac

SEQ ID NO: 854190 - RNA, 19 nt, Homo sapiens
aagaaacucuauggucuua

SEQ ID NO: 854191 - RNA, 12 nt, Homo sapiens
aagaaagggaaa

SEQ ID NO: 854192 - RNA, 16 nt, Homo sapiens
aagaaagucaauguca

SEQ ID NO: 854193 - RNA, 16 nt, Homo sapiens
aagaacaaaagaagca

SEQ ID NO: 854194 - RNA, 21 nt, Homo sapiens
aagaacaauuaaaauauucuu

SEQ ID NO: 854195 - RNA, 17 nt, Homo sapiens
aagaacugcuuucuuuc

SEQ ID NO: 854196 - RNA, 22 nt, Homo sapiens
aagaagguggaaggcaguguua

SEQ ID NO: 854197 - RNA, 12 nt, Homo sapiens
aagaagguuuac

SEQ ID NO: 854198 - RNA, 16 nt, Homo sapiens
aagaauagcauuguaa

SEQ ID NO: 854199 - RNA, 17 nt, Homo sapiens
aagaauaugcaucuuaa

SEQ ID NO: 854200 - RNA, 13 nt, Homo sapiens
aagaaucugcucu

SEQ ID NO: 854201 - RNA, 14 nt, Homo sapiens
aagaaucugcucug

SEQ ID NO: 854202 - RNA, 22 nt, Homo sapiens
aagaauucuuuuuacaucuauc

SEQ ID NO: 854203 - RNA, 20 nt, Homo sapiens
aagaccagagggacacuagg

SEQ ID NO: 854204 - RNA, 19 nt, Homo sapiens
aaaacaccagcuguauaua

SEQ ID NO: 854205 - RNA, 19 nt, Homo sapiens
aaaacauggaacagugugg

SEQ ID NO: 854206 - RNA, 15 nt, Homo sapiens
aaaacuuuguagaca

SEQ ID NO: 854207 - RNA, 15 nt, Homo sapiens
aaaagaaacucuaug

SEQ ID NO: 854208 - RNA, 18 nt, Homo sapiens
aaaagacgcaccagccca

SEQ ID NO: 854209 - RNA, 12 nt, Homo sapiens
aaaagcagugga

SEQ ID NO: 854210 - RNA, 20 nt, Homo sapiens
aaaagucuggcccacugugc

SEQ ID NO: 854211 - RNA, 20 nt, Homo sapiens
aaaauaaacaaagugaagua

SEQ ID NO: 854212 - RNA, 20 nt, Homo sapiens
aaaauacaucaaggaguuau

SEQ ID NO: 854213 - RNA, 19 nt, Homo sapiens
aaaauauguguaucucaaa

SEQ ID NO: 854214 - RNA, 17 nt, Homo sapiens
aaaaucuaacaguaaca

SEQ ID NO: 854215 - RNA, 19 nt, Homo sapiens
aaaaucugccaccugcaca

SEQ ID NO: 854216 - RNA, 15 nt, Homo sapiens
aaaaugaacuguaaa

SEQ ID NO: 854217 - RNA, 14 nt, Homo sapiens
aaaaugagaguuuu

SEQ ID NO: 854218 - RNA, 19 nt, Homo sapiens
aaaaugcugaacauugcau

SEQ ID NO: 854219 - RNA, 11 nt, Homo sapiens
aaaaugggaga

SEQ ID NO: 854220 - RNA, 19 nt, Homo sapiens
aaaaugggaugauauggag

SEQ ID NO: 854221 - RNA, 15 nt, Homo sapiens
aagagaaccaugugc

SEQ ID NO: 854222 - RNA, 18 nt, Homo sapiens
aagagaaguacuaucuuu

SEQ ID NO: 854223 - RNA, 17 nt, Homo sapiens
aagagacaggcagguga

SEQ ID NO: 854224 - RNA, 23 nt, Homo sapiens
aagagccaauaucuaggcauuuu

SEQ ID NO: 854225 - RNA, 20 nt, Homo sapiens
aagagucuggggaccagcuu

SEQ ID NO: 854226 - RNA, 15 nt, Homo sapiens
aagaguucuaaccau

SEQ ID NO: 854227 - RNA, 17 nt, Homo sapiens
aagaugggaaagaacca

SEQ ID NO: 854228 - RNA, 17 nt, Homo sapiens
aagauguauuucaucuc

SEQ ID NO: 854229 - RNA, 23 nt, Homo sapiens
aagauucugaccuuaaaugcaac

SEQ ID NO: 854230 - RNA, 16 nt, Homo sapiens
aagcaagaauggagga

SEQ ID NO: 854231 - RNA, 16 nt, Homo sapiens
aagcaauaaaacugcu

SEQ ID NO: 854232 - RNA, 19 nt, Homo sapiens
aagcacaaaggaaugaacu

SEQ ID NO: 854233 - RNA, 11 nt, Homo sapiens
aagcaccaucc

SEQ ID NO: 854234 - RNA, 15 nt, Homo sapiens
aagcaggguccaugu

SEQ ID NO: 854235 - RNA, 19 nt, Homo sapiens
aagcaguuaugugaccuca

SEQ ID NO: 854236 - RNA, 21 nt, Homo sapiens
aagccaccaacagccacucag

SEQ ID NO: 854237 - RNA, 15 nt, Homo sapiens
aagccccacaccagu

SEQ ID NO: 854238 - RNA, 17 nt, Homo sapiens
aagccucggaucagccu

SEQ ID NO: 854239 - RNA, 22 nt, Homo sapiens
aagccugagggaggaggcagga

SEQ ID NO: 854240 - RNA, 20 nt, Homo sapiens
aagcgauucucuugccucag

SEQ ID NO: 854241 - RNA, 21 nt, Homo sapiens
aagcuaguugaauacuugaac

SEQ ID NO: 854242 - RNA, 15 nt, Homo sapiens
aagcucucacucugu

SEQ ID NO: 854243 - RNA, 10 nt, Homo sapiens
aagcugaggc

SEQ ID NO: 854244 - RNA, 20 nt, Homo sapiens
aagcugggggugaaagggaa

SEQ ID NO: 854245 - RNA, 14 nt, Homo sapiens
aaggaaaaagcaga

SEQ ID NO: 854246 - RNA, 15 nt, Homo sapiens
aaggaaugaacuuau

SEQ ID NO: 854247 - RNA, 23 nt, Homo sapiens
aaggacugacugaggcaguuuga

SEQ ID NO: 854248 - RNA, 18 nt, Homo sapiens
aaggacuucuuccaggga

SEQ ID NO: 854249 - RNA, 16 nt, Homo sapiens
aaggagacuucugucu

SEQ ID NO: 854250 - RNA, 14 nt, Homo sapiens
aaggauccagacuc

SEQ ID NO: 854251 - RNA, 17 nt, Homo sapiens
aaggauccagacucuca

SEQ ID NO: 854252 - RNA, 19 nt, Homo sapiens
aaggaucuggaccaguuuc

SEQ ID NO: 854253 - RNA, 22 nt, Homo sapiens
aaggcaaaaaaggaugcaacaa

SEQ ID NO: 854254 - RNA, 23 nt, Homo sapiens
aaggcaguguuauuuauuucuuu

SEQ ID NO: 854255 - RNA, 17 nt, Homo sapiens
aaggccguguuucagcc

SEQ ID NO: 854256 - RNA, 17 nt, Homo sapiens
aaggcgauauaagcaaa

SEQ ID NO: 854257 - RNA, 14 nt, Homo sapiens
aaguaaaagcagca

SEQ ID NO: 854258 - RNA, 18 nt, Homo sapiens
aaguaaaagcagcauaaa

SEQ ID NO: 854259 - RNA, 15 nt, Homo sapiens
aaguauaacaugucg

SEQ ID NO: 854260 - RNA, 19 nt, Homo sapiens
aaguauuuacugacugcuu

SEQ ID NO: 854261 - RNA, 20 nt, Homo sapiens
aagugccuuagcauguguug

SEQ ID NO: 854262 - RNA, 15 nt, Homo sapiens
aaguggacucucuga

SEQ ID NO: 854263 - RNA, 21 nt, Homo sapiens
aaguggccggaaaacaagccu

SEQ ID NO: 854264 - RNA, 15 nt, Homo sapiens
aaguguucauugcac

SEQ ID NO: 854265 - RNA, 14 nt, Homo sapiens
aaguuucugauagu

SEQ ID NO: 854266 - RNA, 15 nt, Homo sapiens
aaguuuucaugugcu

SEQ ID NO: 854267 - RNA, 19 nt, Homo sapiens
aaguuuuugcaugcuacaa

SEQ ID NO: 854268 - RNA, 14 nt, Homo sapiens
aauaaaaauggauc

SEQ ID NO: 854269 - RNA, 12 nt, Homo sapiens
aauaaacaguua

SEQ ID NO: 854270 - RNA, 22 nt, Homo sapiens
aauaaauggcccggacaugucu

SEQ ID NO: 854271 - RNA, 20 nt, Homo sapiens
aauaagcuaguugaauacuu

SEQ ID NO: 854272 - RNA, 16 nt, Homo sapiens
aauaauagcuagcuau

SEQ ID NO: 854273 - RNA, 13 nt, Homo sapiens
aauaauaucucua

SEQ ID NO: 854274 - RNA, 13 nt, Homo sapiens
aauaauguucacg

SEQ ID NO: 854275 - RNA, 13 nt, Homo sapiens
aauaauuucugua

SEQ ID NO: 854276 - RNA, 19 nt, Homo sapiens
aauaauuugguauccuuau

SEQ ID NO: 854277 - RNA, 16 nt, Homo sapiens
aauacagcaaaccuaa

SEQ ID NO: 854278 - RNA, 13 nt, Homo sapiens
aauacuucacaca

SEQ ID NO: 854279 - RNA, 14 nt, Homo sapiens
aauagacacuugag

SEQ ID NO: 854280 - RNA, 18 nt, Homo sapiens
aauagcaauauucuugga

SEQ ID NO: 854281 - RNA, 18 nt, Homo sapiens
aauaggauuaaugaucau

SEQ ID NO: 854282 - RNA, 18 nt, Homo sapiens
aauaguuugacacuugaa

SEQ ID NO: 854283 - RNA, 19 nt, Homo sapiens
aauauaauagaauacccua

SEQ ID NO: 854284 - RNA, 17 nt, Homo sapiens
aauauauccacacauuu

SEQ ID NO: 854285 - RNA, 19 nt, Homo sapiens
aauauguacaucacugaga

SEQ ID NO: 854286 - RNA, 22 nt, Homo sapiens
aauauucuuuuuauauucugug

SEQ ID NO: 854287 - RNA, 15 nt, Homo sapiens
aauauuuucucucau

SEQ ID NO: 854288 - RNA, 13 nt, Homo sapiens
aaucagaaguaua

SEQ ID NO: 854289 - RNA, 14 nt, Homo sapiens
aaucaugaagugau

SEQ ID NO: 854290 - RNA, 18 nt, Homo sapiens
aaucgacuuguucuugau

SEQ ID NO: 854291 - RNA, 14 nt, Homo sapiens
aaucuaguugucaa

SEQ ID NO: 854292 - RNA, 12 nt, Homo sapiens
aaucugcuccaa

SEQ ID NO: 854293 - RNA, 13 nt, Homo sapiens
aaucugcucugaa

SEQ ID NO: 854294 - RNA, 15 nt, Homo sapiens
aaucuuuaacugaac

SEQ ID NO: 854295 - RNA, 21 nt, Homo sapiens
aaucuuuuuugauaugauaau

SEQ ID NO: 854296 - RNA, 17 nt, Homo sapiens
aaugaacaucuauaaaa

SEQ ID NO: 854297 - RNA, 13 nt, Homo sapiens
aaugaacuguaaa

SEQ ID NO: 854298 - RNA, 17 nt, Homo sapiens
aaugaauaaagugcaaa

SEQ ID NO: 854299 - RNA, 22 nt, Homo sapiens
aaugacaaaugacugucucuug

SEQ ID NO: 854300 - RNA, 12 nt, Homo sapiens
aaugacagcuag

SEQ ID NO: 854301 - RNA, 17 nt, Homo sapiens
aaugaccugacuuuuag

SEQ ID NO: 854302 - RNA, 16 nt, Homo sapiens
aaugacuuuauugcau

SEQ ID NO: 854303 - RNA, 18 nt, Homo sapiens
aaugauuaaugcauuuau

SEQ ID NO: 854304 - RNA, 23 nt, Homo sapiens
aaugcaccauacucaugcaugca

SEQ ID NO: 854305 - RNA, 23 nt, Homo sapiens
aaugccagguggagaaaucacag

SEQ ID NO: 854306 - RNA, 21 nt, Homo sapiens
aaugcuccuagaguauauucc

SEQ ID NO: 854307 - RNA, 22 nt, Homo sapiens
aaugcugaaauaaaaugauuaa

SEQ ID NO: 854308 - RNA, 17 nt, Homo sapiens
aauggacaaacugccag

SEQ ID NO: 854309 - RNA, 16 nt, Homo sapiens
aaugggcuagagggug

SEQ ID NO: 854310 - RNA, 16 nt, Homo sapiens
aauguaugagacuggg

SEQ ID NO: 854311 - RNA, 16 nt, Homo sapiens
aaugucucaagugcaa

SEQ ID NO: 854312 - RNA, 14 nt, Homo sapiens
aaugucuuucaugu

SEQ ID NO: 854313 - RNA, 14 nt, Homo sapiens
aauguuaagcaucu

SEQ ID NO: 854314 - RNA, 14 nt, Homo sapiens
aauuaaaacuuugu

SEQ ID NO: 854315 - RNA, 17 nt, Homo sapiens
aauucagauuguuuaaa

SEQ ID NO: 854316 - RNA, 21 nt, Homo sapiens
aauuccagaaugaagaauuca

SEQ ID NO: 854317 - RNA, 16 nt, Homo sapiens
aauucuucacauguaa

SEQ ID NO: 854318 - RNA, 22 nt, Homo sapiens
aauugcacaacagagacugaaa

SEQ ID NO: 854319 - RNA, 21 nt, Homo sapiens
aauuguccuugaagcuuguau

SEQ ID NO: 854320 - RNA, 19 nt, Homo sapiens
aauugugugaacuuggaag

SEQ ID NO: 854321 - RNA, 23 nt, Homo sapiens
aauuuauuugugauguacuguaa

SEQ ID NO: 854322 - RNA, 16 nt, Homo sapiens
aauuucuuuugguuca

SEQ ID NO: 854323 - RNA, 12 nt, Homo sapiens
aauuugcucaua

SEQ ID NO: 854324 - RNA, 22 nt, Homo sapiens
aauuuuauugacacaguaccau

SEQ ID NO: 854325 - RNA, 13 nt, Homo sapiens
aauuuucuuucac

SEQ ID NO: 854326 - RNA, 21 nt, Homo sapiens
acaaaacuuccucaaugcauu

SEQ ID NO: 854327 - RNA, 12 nt, Homo sapiens
acaaacauuucu

SEQ ID NO: 854328 - RNA, 14 nt, Homo sapiens
acaaacugccaguu

SEQ ID NO: 854329 - RNA, 18 nt, Homo sapiens
acaaauauaaaacuauaa

SEQ ID NO: 854330 - RNA, 22 nt, Homo sapiens
acaaaugccuccaaaguauugu

SEQ ID NO: 854331 - RNA, 14 nt, Homo sapiens
acaaauuguuacuc

SEQ ID NO: 854332 - RNA, 20 nt, Homo sapiens
acaaauuguuacuccauaua

SEQ ID NO: 854333 - RNA, 17 nt, Homo sapiens
acaacauuguagccuca

SEQ ID NO: 854334 - RNA, 19 nt, Homo sapiens
acaaccguauaccugagaa

SEQ ID NO: 854335 - RNA, 20 nt, Homo sapiens
acaagaagacccauccugaa

SEQ ID NO: 854336 - RNA, 18 nt, Homo sapiens
acaagaagcaauguuaua

SEQ ID NO: 854337 - RNA, 22 nt, Homo sapiens
acaagguggucaacaacauucc

SEQ ID NO: 854338 - RNA, 19 nt, Homo sapiens
acaaguggcucaucaucaa

SEQ ID NO: 854339 - RNA, 15 nt, Homo sapiens
acaauaaagcaauaa

SEQ ID NO: 854340 - RNA, 15 nt, Homo sapiens
acaauuugaaacaaa

SEQ ID NO: 854341 - RNA, 16 nt, Homo sapiens
acacaauccauuguca

SEQ ID NO: 854342 - RNA, 22 nt, Homo sapiens
acacacagaaggggacugccac

SEQ ID NO: 854343 - RNA, 20 nt, Homo sapiens
acacagagcuaaggccaaug

SEQ ID NO: 854344 - RNA, 19 nt, Homo sapiens
acacaugggcauauucuga

SEQ ID NO: 854345 - RNA, 16 nt, Homo sapiens
acaccaguugcccaga

SEQ ID NO: 854346 - RNA, 21 nt, Homo sapiens
acaccuguaauuccagcacuu

SEQ ID NO: 854347 - RNA, 19 nt, Homo sapiens
acacugaauuuuuaugugu

SEQ ID NO: 854348 - RNA, 15 nt, Homo sapiens
acacuggagugaaug

SEQ ID NO: 854349 - RNA, 14 nt, Homo sapiens
acacuguaccccag

SEQ ID NO: 854350 - RNA, 17 nt, Homo sapiens
acacuguggcagcagga

SEQ ID NO: 854351 - RNA, 20 nt, Homo sapiens
acacuuuuuggaagugaaaa

SEQ ID NO: 854352 - RNA, 16 nt, Homo sapiens
acagaaguguucacau

SEQ ID NO: 854353 - RNA, 21 nt, Homo sapiens
acagagagagauacucuggga

SEQ ID NO: 854354 - RNA, 15 nt, Homo sapiens
acagaguucugggau

SEQ ID NO: 854355 - RNA, 18 nt, Homo sapiens
acagaugccauauagugu

SEQ ID NO: 854356 - RNA, 18 nt, Homo sapiens
acagauguuuuccacuga

SEQ ID NO: 854357 - RNA, 20 nt, Homo sapiens
acagauguuuuccacugagc

SEQ ID NO: 854358 - RNA, 13 nt, Homo sapiens
acagcaaacagau

SEQ ID NO: 854359 - RNA, 19 nt, Homo sapiens
acagcuucauguucccaaa

SEQ ID NO: 854360 - RNA, 14 nt, Homo sapiens
acaggugcugagua

SEQ ID NO: 854361 - RNA, 20 nt, Homo sapiens
acaguaacacaccccugcuu

SEQ ID NO: 854362 - RNA, 16 nt, Homo sapiens
acaguaguguauuaaa

SEQ ID NO: 854363 - RNA, 13 nt, Homo sapiens
acaguggacaaag

SEQ ID NO: 854364 - RNA, 21 nt, Homo sapiens
acaguguggaagcagaaggcu

SEQ ID NO: 854365 - RNA, 21 nt, Homo sapiens
acaguucauggauauccacug

SEQ ID NO: 854366 - RNA, 13 nt, Homo sapiens
acaguuuucuuca

SEQ ID NO: 854367 - RNA, 15 nt, Homo sapiens
acauaaaagaacaau

SEQ ID NO: 854368 - RNA, 11 nt, Homo sapiens
acauaauacug

SEQ ID NO: 854369 - RNA, 16 nt, Homo sapiens
acaucaagcucaaggc

SEQ ID NO: 854370 - RNA, 12 nt, Homo sapiens
acaucauuccuu

SEQ ID NO: 854371 - RNA, 20 nt, Homo sapiens
acaucccucucugcuggacg

SEQ ID NO: 854372 - RNA, 11 nt, Homo sapiens
acaucuuucag

SEQ ID NO: 854373 - RNA, 23 nt, Homo sapiens
acauggcucucauguacuuuuaa

SEQ ID NO: 854374 - RNA, 16 nt, Homo sapiens
acaugguuacauauca

SEQ ID NO: 854375 - RNA, 21 nt, Homo sapiens
acauguugauuuccuauguau

SEQ ID NO: 854376 - RNA, 12 nt, Homo sapiens
acauguuugcag

SEQ ID NO: 854377 - RNA, 17 nt, Homo sapiens
acauucacuuuccugca

SEQ ID NO: 854378 - RNA, 16 nt, Homo sapiens
acauugguucuuucau

SEQ ID NO: 854379 - RNA, 16 nt, Homo sapiens
acauugugaaugcugu

SEQ ID NO: 854380 - RNA, 17 nt, Homo sapiens
acauuuaguaaaugcug

SEQ ID NO: 854381 - RNA, 18 nt, Homo sapiens
acauuucaaauaacugca

SEQ ID NO: 854382 - RNA, 17 nt, Homo sapiens
acauuugaugcaaaaug

SEQ ID NO: 854383 - RNA, 14 nt, Homo sapiens
accaaagacugaaa

SEQ ID NO: 854384 - RNA, 19 nt, Homo sapiens
accaaucaauaauagcuag

SEQ ID NO: 854385 - RNA, 14 nt, Homo sapiens
accacaaguaucua

SEQ ID NO: 854386 - RNA, 20 nt, Homo sapiens
accacaaugcgcauguaguu

SEQ ID NO: 854387 - RNA, 23 nt, Homo sapiens
accacagaggcuguggucagaga

SEQ ID NO: 854388 - RNA, 21 nt, Homo sapiens
accacaggugcccgccaccac

SEQ ID NO: 854389 - RNA, 20 nt, Homo sapiens
accacauacguaaaaaucuc

SEQ ID NO: 854390 - RNA, 16 nt, Homo sapiens
accacgccuagccuca

SEQ ID NO: 854391 - RNA, 19 nt, Homo sapiens
accacugacuauaccaacu

SEQ ID NO: 854392 - RNA, 15 nt, Homo sapiens
accacuuaaaaugau

SEQ ID NO: 854393 - RNA, 20 nt, Homo sapiens
accacuuuucuauauugcag

SEQ ID NO: 854394 - RNA, 23 nt, Homo sapiens
accagagggacacuaggaaucaa

SEQ ID NO: 854395 - RNA, 16 nt, Homo sapiens
accagcccgccaguug

SEQ ID NO: 854396 - RNA, 18 nt, Homo sapiens
accaguugcccagaugaa

SEQ ID NO: 854397 - RNA, 14 nt, Homo sapiens
accauaacagugcc

SEQ ID NO: 854398 - RNA, 16 nt, Homo sapiens
accauaacagugccag

SEQ ID NO: 854399 - RNA, 20 nt, Homo sapiens
accauaucaggagaccuggg

SEQ ID NO: 854400 - RNA, 17 nt, Homo sapiens
accaugucguaguuacu

SEQ ID NO: 854401 - RNA, 21 nt, Homo sapiens
accaugucguaguuacucuca

SEQ ID NO: 854402 - RNA, 23 nt, Homo sapiens
accauuuaauggggaggacaaaa

SEQ ID NO: 854403 - RNA, 16 nt, Homo sapiens
accauuuccccagggc

SEQ ID NO: 854404 - RNA, 16 nt, Homo sapiens
acccagaaaaucugaa

SEQ ID NO: 854405 - RNA, 15 nt, Homo sapiens
acccaggaaucucaa

SEQ ID NO: 854406 - RNA, 18 nt, Homo sapiens
acccaguggcagggcaca

SEQ ID NO: 854407 - RNA, 12 nt, Homo sapiens
accccaggcuac

SEQ ID NO: 854408 - RNA, 15 nt, Homo sapiens
accccaucugugaau

SEQ ID NO: 854409 - RNA, 22 nt, Homo sapiens
accccgcaagcaccauccccuc

SEQ ID NO: 854410 - RNA, 15 nt, Homo sapiens
acccguaagauuccu

SEQ ID NO: 854411 - RNA, 13 nt, Homo sapiens
acccucauuucac

SEQ ID NO: 854412 - RNA, 18 nt, Homo sapiens
acccugccaggcacaggc

SEQ ID NO: 854413 - RNA, 22 nt, Homo sapiens
accgaagggacuggaucugcag

SEQ ID NO: 854414 - RNA, 22 nt, Homo sapiens
accgaauuuaguucaugcauug

SEQ ID NO: 854415 - RNA, 15 nt, Homo sapiens
accguucaccaguug

SEQ ID NO: 854416 - RNA, 14 nt, Homo sapiens
accuaaguacuuaa

SEQ ID NO: 854417 - RNA, 13 nt, Homo sapiens
accucacacaccu

SEQ ID NO: 854418 - RNA, 22 nt, Homo sapiens
accucauggaugcuuuggcaau

SEQ ID NO: 854419 - RNA, 15 nt, Homo sapiens
accucauguccuucu

SEQ ID NO: 854420 - RNA, 12 nt, Homo sapiens
accucuuuggaa

SEQ ID NO: 854421 - RNA, 21 nt, Homo sapiens
accugaaucuaucacccagga

SEQ ID NO: 854422 - RNA, 13 nt, Homo sapiens
accugagcaacaa

SEQ ID NO: 854423 - RNA, 16 nt, Homo sapiens
accugauguccauuca

SEQ ID NO: 854424 - RNA, 15 nt, Homo sapiens
accuggaaugggucu

SEQ ID NO: 854425 - RNA, 18 nt, Homo sapiens
accuguaucaaacugcuu

SEQ ID NO: 854426 - RNA, 12 nt, Homo sapiens
accuuacucuga

SEQ ID NO: 854427 - RNA, 17 nt, Homo sapiens
accuucugccagaagac

SEQ ID NO: 854428 - RNA, 14 nt, Homo sapiens
accuugccaugcuu

SEQ ID NO: 854429 - RNA, 17 nt, Homo sapiens
accuuucaggagacuuu

SEQ ID NO: 854430 - RNA, 17 nt, Homo sapiens
acgacuguuuucccaac

SEQ ID NO: 854431 - RNA, 18 nt, Homo sapiens
acgcaguauugagcugcc

SEQ ID NO: 854432 - RNA, 19 nt, Homo sapiens
acgcccagagaacaagcac

SEQ ID NO: 854433 - RNA, 17 nt, Homo sapiens
acgcucauucagcaucu

SEQ ID NO: 854434 - RNA, 20 nt, Homo sapiens
acgcuuuaugcccuugccuc

SEQ ID NO: 854435 - RNA, 16 nt, Homo sapiens
acgggcaucauucucu

SEQ ID NO: 854436 - RNA, 22 nt, Homo sapiens
acggggucgcccuuugcucacg

SEQ ID NO: 854437 - RNA, 17 nt, Homo sapiens
acuacuuggaaaaaaua

SEQ ID NO: 854438 - RNA, 23 nt, Homo sapiens
acuaugauuuaauuugaaauaug

SEQ ID NO: 854439 - RNA, 15 nt, Homo sapiens
acuauuuacaaggau

SEQ ID NO: 854440 - RNA, 16 nt, Homo sapiens
acucagagggccucau

SEQ ID NO: 854441 - RNA, 20 nt, Homo sapiens
acucauaggcuuauuuccaa

SEQ ID NO: 854442 - RNA, 17 nt, Homo sapiens
acuccaaaccuuacucu

SEQ ID NO: 854443 - RNA, 14 nt, Homo sapiens
acuccagaugccac

SEQ ID NO: 854444 - RNA, 22 nt, Homo sapiens
acucccguguaggaaccugcac

SEQ ID NO: 854445 - RNA, 15 nt, Homo sapiens
acuccgucucaaaaa

SEQ ID NO: 854446 - RNA, 17 nt, Homo sapiens
acuccuuccuugaaccc

SEQ ID NO: 854447 - RNA, 21 nt, Homo sapiens
acucuaaagucuguugauuaa

SEQ ID NO: 854448 - RNA, 9 nt, Homo sapiens
acucucuuc

SEQ ID NO: 854449 - RNA, 12 nt, Homo sapiens
acucucuuccuu

SEQ ID NO: 854450 - RNA, 13 nt, Homo sapiens
acucugaagggac

SEQ ID NO: 854451 - RNA, 16 nt, Homo sapiens
acucugagcucauuaa

SEQ ID NO: 854452 - RNA, 14 nt, Homo sapiens
acucugcacugaau

SEQ ID NO: 854453 - RNA, 14 nt, Homo sapiens
acucugcauauucu

SEQ ID NO: 854454 - RNA, 21 nt, Homo sapiens
acucuggggcuggcaccagca

SEQ ID NO: 854455 - RNA, 17 nt, Homo sapiens
acucuucugaaggccaa

SEQ ID NO: 854456 - RNA, 22 nt, Homo sapiens
acucuuuuccaaacacaggcaa

SEQ ID NO: 854457 - RNA, 19 nt, Homo sapiens
acugaauggcugaccugac

SEQ ID NO: 854458 - RNA, 22 nt, Homo sapiens
acugacucuggaaaaggcauau

SEQ ID NO: 854459 - RNA, 18 nt, Homo sapiens
acugaguucuauauucug

SEQ ID NO: 854460 - RNA, 18 nt, Homo sapiens
acugcaaaauaaaaucuc

SEQ ID NO: 854461 - RNA, 21 nt, Homo sapiens
acugcacguuuucaucucuag

SEQ ID NO: 854462 - RNA, 20 nt, Homo sapiens
acugccagcucuuccuagcu

SEQ ID NO: 854463 - RNA, 15 nt, Homo sapiens
acugcugggcuccac

SEQ ID NO: 854464 - RNA, 19 nt, Homo sapiens
acugcuuauaaacauuuaa

SEQ ID NO: 854465 - RNA, 21 nt, Homo sapiens
acuggaaauugaaauaaagau

SEQ ID NO: 854466 - RNA, 17 nt, Homo sapiens
acugggagcugcuccua

SEQ ID NO: 854467 - RNA, 19 nt, Homo sapiens
acuguguaccucauggaug

SEQ ID NO: 854468 - RNA, 15 nt, Homo sapiens
acuguguguguccua

SEQ ID NO: 854469 - RNA, 22 nt, Homo sapiens
acuguuccuucccccuuucccc

SEQ ID NO: 854470 - RNA, 17 nt, Homo sapiens
acuuaacauagccaaaa

SEQ ID NO: 854471 - RNA, 20 nt, Homo sapiens
acuuagaccaaaagcaacau

SEQ ID NO: 854472 - RNA, 23 nt, Homo sapiens
acuucaaaaaaaucuaacaguaa

SEQ ID NO: 854473 - RNA, 21 nt, Homo sapiens
acuuccuuugacuuucugugu

SEQ ID NO: 854474 - RNA, 12 nt, Homo sapiens
acuucuuccagg

SEQ ID NO: 854475 - RNA, 14 nt, Homo sapiens
acuucuuccaggga

SEQ ID NO: 854476 - RNA, 20 nt, Homo sapiens
acuugaacucacucccucac

SEQ ID NO: 854477 - RNA, 15 nt, Homo sapiens
acuugcuccauucau

SEQ ID NO: 854478 - RNA, 15 nt, Homo sapiens
acuuguagauuugau

SEQ ID NO: 854479 - RNA, 14 nt, Homo sapiens
acuuguucuugaua

SEQ ID NO: 854480 - RNA, 15 nt, Homo sapiens
acuuuccucagugac

SEQ ID NO: 854481 - RNA, 18 nt, Homo sapiens
acuuugaauuuuagcaca

SEQ ID NO: 854482 - RNA, 12 nt, Homo sapiens
acuuugccaaaa

SEQ ID NO: 854483 - RNA, 19 nt, Homo sapiens
acuuuguuaaaaacacugc

SEQ ID NO: 854484 - RNA, 20 nt, Homo sapiens
acuuuucuauauugcagugu

SEQ ID NO: 854485 - RNA, 17 nt, Homo sapiens
acuuuuuguuacauaga

SEQ ID NO: 854486 - RNA, 14 nt, Homo sapiens
agaaaaaguacaag

SEQ ID NO: 854487 - RNA, 16 nt, Homo sapiens
agaaaacauaacugau

SEQ ID NO: 854488 - RNA, 17 nt, Homo sapiens
agaaagggaaauugcag

SEQ ID NO: 854489 - RNA, 19 nt, Homo sapiens
agaaagucaaugucaauga

SEQ ID NO: 854490 - RNA, 12 nt, Homo sapiens
agaaauagugug

SEQ ID NO: 854491 - RNA, 17 nt, Homo sapiens
agaaaucuuaagucaua

SEQ ID NO: 854492 - RNA, 16 nt, Homo sapiens
agaaauuaaguacuua

SEQ ID NO: 854493 - RNA, 19 nt, Homo sapiens
agaacaagcacuguggaac

SEQ ID NO: 854494 - RNA, 20 nt, Homo sapiens
agaacaauuaaaauauucuu

SEQ ID NO: 854495 - RNA, 22 nt, Homo sapiens
agaacagcuucauguucccaaa

SEQ ID NO: 854496 - RNA, 13 nt, Homo sapiens
agaaccaagaccu

SEQ ID NO: 854497 - RNA, 10 nt, Homo sapiens
agaagaccuc

SEQ ID NO: 854498 - RNA, 22 nt, Homo sapiens
agaagaucucaaggauccagac

SEQ ID NO: 854499 - RNA, 18 nt, Homo sapiens
agaagguggaaggcagug

SEQ ID NO: 854500 - RNA, 13 nt, Homo sapiens
agaaguacuaucu

SEQ ID NO: 854501 - RNA, 14 nt, Homo sapiens
agaagucacuguca

SEQ ID NO: 854502 - RNA, 22 nt, Homo sapiens
agaagugggugggcacacugaa

SEQ ID NO: 854503 - RNA, 19 nt, Homo sapiens
agaauagcauggggcuugu

SEQ ID NO: 854504 - RNA, 14 nt, Homo sapiens
agaaucugcucuga

SEQ ID NO: 854505 - RNA, 15 nt, Homo sapiens
agaaucugcucugaa

SEQ ID NO: 854506 - RNA, 17 nt, Homo sapiens
agaaugacagcaaacag

SEQ ID NO: 854507 - RNA, 14 nt, Homo sapiens
agaauggaggaauc

SEQ ID NO: 854508 - RNA, 20 nt, Homo sapiens
agaaugucaauaaauuugcu

SEQ ID NO: 854509 - RNA, 15 nt, Homo sapiens
agaauuaaaacuuug

SEQ ID NO: 854510 - RNA, 17 nt, Homo sapiens
agaauuauuaauuaucg

SEQ ID NO: 854511 - RNA, 15 nt, Homo sapiens
agaauuuuucuucau

SEQ ID NO: 854512 - RNA, 13 nt, Homo sapiens
agacaagucugug

SEQ ID NO: 854513 - RNA, 18 nt, Homo sapiens
agacaagucuguggcuug

SEQ ID NO: 854514 - RNA, 11 nt, Homo sapiens
agacagaccac

SEQ ID NO: 854515 - RNA, 21 nt, Homo sapiens
agacagcauuuguguguuaca

SEQ ID NO: 854516 - RNA, 20 nt, Homo sapiens
agacaucaagcucaaggcaa

SEQ ID NO: 854517 - RNA, 14 nt, Homo sapiens
agacauuuugaaau

SEQ ID NO: 854518 - RNA, 20 nt, Homo sapiens
agaccgugaagauacuuugu

SEQ ID NO: 854519 - RNA, 20 nt, Homo sapiens
aacguggagaaucacaggcu

SEQ ID NO: 854520 - RNA, 17 nt, Homo sapiens
aacuccccauuggugcu

SEQ ID NO: 854521 - RNA, 22 nt, Homo sapiens
aacucccgcacccuccuuucuc

SEQ ID NO: 854522 - RNA, 15 nt, Homo sapiens
aacuccugccuauga

SEQ ID NO: 854523 - RNA, 14 nt, Homo sapiens
aacucuaagaccac

SEQ ID NO: 854524 - RNA, 12 nt, Homo sapiens
aacucuguuaca

SEQ ID NO: 854525 - RNA, 15 nt, Homo sapiens
aacugagguuuacau

SEQ ID NO: 854526 - RNA, 23 nt, Homo sapiens
aacugcuuccuauaauuuugaua

SEQ ID NO: 854527 - RNA, 20 nt, Homo sapiens
aacugcuuccuuucuugauu

SEQ ID NO: 854528 - RNA, 14 nt, Homo sapiens
aacugggccucuga

SEQ ID NO: 854529 - RNA, 15 nt, Homo sapiens
aacuguaaaugcucc

SEQ ID NO: 854530 - RNA, 21 nt, Homo sapiens
aacugucagggaggucuuucc

SEQ ID NO: 854531 - RNA, 15 nt, Homo sapiens
aacugucgugucaua

SEQ ID NO: 854532 - RNA, 20 nt, Homo sapiens
aacuucaaaaaaaucuaaca

SEQ ID NO: 854533 - RNA, 16 nt, Homo sapiens
aacuucccuccaucca

SEQ ID NO: 854534 - RNA, 22 nt, Homo sapiens
aacuucccuccauccaccccuc

SEQ ID NO: 854535 - RNA, 13 nt, Homo sapiens
aacuuuauuccaa

SEQ ID NO: 854536 - RNA, 17 nt, Homo sapiens
aacuuuguaguaugaua

SEQ ID NO: 854537 - RNA, 14 nt, Homo sapiens
aagaaaaccaaaca

SEQ ID NO: 854538 - RNA, 17 nt, Homo sapiens
aagaaauuaaguacuua

SEQ ID NO: 854539 - RNA, 19 nt, Homo sapiens
aagaagcaucucugaccag

SEQ ID NO: 854540 - RNA, 13 nt, Homo sapiens
aagaauaugcauc

SEQ ID NO: 854541 - RNA, 15 nt, Homo sapiens
aagaaucugcucuga

SEQ ID NO: 854542 - RNA, 17 nt, Homo sapiens
aagaauuuacuuuggaa

SEQ ID NO: 854543 - RNA, 17 nt, Homo sapiens
aagacaaagacauuuca

SEQ ID NO: 854544 - RNA, 17 nt, Homo sapiens
aagacaagacagcauuu

SEQ ID NO: 854545 - RNA, 15 nt, Homo sapiens
aagacacacgaugcu

SEQ ID NO: 854546 - RNA, 22 nt, Homo sapiens
aagaccaauuuuuuguguguga

SEQ ID NO: 854547 - RNA, 14 nt, Homo sapiens
aagacucacugugu

SEQ ID NO: 854548 - RNA, 22 nt, Homo sapiens
aagacuggcaagaaaagaguua

SEQ ID NO: 854549 - RNA, 17 nt, Homo sapiens
aagagaaccaugugcua

SEQ ID NO: 854550 - RNA, 22 nt, Homo sapiens
aagaguccauuccccagguggg

SEQ ID NO: 854551 - RNA, 14 nt, Homo sapiens
aagaguucuaacca

SEQ ID NO: 854552 - RNA, 21 nt, Homo sapiens
aagauacaguaccccucuagc

SEQ ID NO: 854553 - RNA, 17 nt, Homo sapiens
aagauauaagacuuaau

SEQ ID NO: 854554 - RNA, 19 nt, Homo sapiens
aagaucccagugugaagua

SEQ ID NO: 854555 - RNA, 17 nt, Homo sapiens
aagaucgugaugcuaug

SEQ ID NO: 854556 - RNA, 23 nt, Homo sapiens
aagauguugaggcgagcagggca

SEQ ID NO: 854557 - RNA, 19 nt, Homo sapiens
aagcaaaauuauguuugcc

SEQ ID NO: 854558 - RNA, 15 nt, Homo sapiens
aagcaauaagaacaa

SEQ ID NO: 854559 - RNA, 22 nt, Homo sapiens
aagcacaccaaucuuacuuugu

SEQ ID NO: 854560 - RNA, 13 nt, Homo sapiens
aagcaccaucccc

SEQ ID NO: 854561 - RNA, 22 nt, Homo sapiens
aagcacuguggaacugcuauuu

SEQ ID NO: 854562 - RNA, 20 nt, Homo sapiens
aagcucguccccauugcuua

SEQ ID NO: 854563 - RNA, 13 nt, Homo sapiens
aaggacuucuucc

SEQ ID NO: 854564 - RNA, 14 nt, Homo sapiens
aaggagcauugcag

SEQ ID NO: 854565 - RNA, 16 nt, Homo sapiens
aaggaguaaugggaua

SEQ ID NO: 854566 - RNA, 21 nt, Homo sapiens
aaggagugagugaaacuccca

SEQ ID NO: 854567 - RNA, 17 nt, Homo sapiens
aaggcaauuucucugca

SEQ ID NO: 854568 - RNA, 16 nt, Homo sapiens
aaggcauauauguacu

SEQ ID NO: 854569 - RNA, 13 nt, Homo sapiens
aaggccaaugggc

SEQ ID NO: 854570 - RNA, 16 nt, Homo sapiens
aaggccaaugggcuag

SEQ ID NO: 854571 - RNA, 21 nt, Homo sapiens
aaggcucagucgcuagcauuu

SEQ ID NO: 854572 - RNA, 13 nt, Homo sapiens
aaggcuucuugcu

SEQ ID NO: 854573 - RNA, 17 nt, Homo sapiens
aaggcuucuugcuuaca

SEQ ID NO: 854574 - RNA, 16 nt, Homo sapiens
aagggaaauugcagcc

SEQ ID NO: 854575 - RNA, 16 nt, Homo sapiens
aagggaguaaguagag

SEQ ID NO: 854576 - RNA, 20 nt, Homo sapiens
aaggggagaaauaaacauaa

SEQ ID NO: 854577 - RNA, 13 nt, Homo sapiens
aaggguacugaaa

SEQ ID NO: 854578 - RNA, 18 nt, Homo sapiens
aagggucucacacuguga

SEQ ID NO: 854579 - RNA, 20 nt, Homo sapiens
aaggucuuuuuacauuguga

SEQ ID NO: 854580 - RNA, 20 nt, Homo sapiens
aaggugggaagaucauuuga

SEQ ID NO: 854581 - RNA, 17 nt, Homo sapiens
aaguacuaucuuugugu

SEQ ID NO: 854582 - RNA, 17 nt, Homo sapiens
aaguacuuuccaaucuc

SEQ ID NO: 854583 - RNA, 22 nt, Homo sapiens
aaguaguugaagagcuacuuca

SEQ ID NO: 854584 - RNA, 22 nt, Homo sapiens
aaguaucuaaauuuggaacuua

SEQ ID NO: 854585 - RNA, 16 nt, Homo sapiens
aagucaccuaaguacu

SEQ ID NO: 854586 - RNA, 14 nt, Homo sapiens
aagucacugucaga

SEQ ID NO: 854587 - RNA, 20 nt, Homo sapiens
aaguccacagaagugagcuc

SEQ ID NO: 854588 - RNA, 19 nt, Homo sapiens
aagucuggcccacugugca

SEQ ID NO: 854589 - RNA, 17 nt, Homo sapiens
aagugaacagauuuuau

SEQ ID NO: 854590 - RNA, 16 nt, Homo sapiens
aagugacaugcauuca

SEQ ID NO: 854591 - RNA, 19 nt, Homo sapiens
aagugauauaaaagcugca

SEQ ID NO: 854592 - RNA, 19 nt, Homo sapiens
aagugggugggcacacuga

SEQ ID NO: 854593 - RNA, 17 nt, Homo sapiens
aaguguaaaucuaaaca

SEQ ID NO: 854594 - RNA, 21 nt, Homo sapiens
aaguugagacagagaagggaa

SEQ ID NO: 854595 - RNA, 16 nt, Homo sapiens
aaguuuucaugugcuc

SEQ ID NO: 854596 - RNA, 19 nt, Homo sapiens
aauaaacuagauuacauuc

SEQ ID NO: 854597 - RNA, 12 nt, Homo sapiens
aauaaagugugu

SEQ ID NO: 854598 - RNA, 20 nt, Homo sapiens
aauaaauuauuuguuacugu

SEQ ID NO: 854599 - RNA, 22 nt, Homo sapiens
aauaacaguaguguuacaugua

SEQ ID NO: 854600 - RNA, 16 nt, Homo sapiens
aauaauaucucuaaua

SEQ ID NO: 854601 - RNA, 16 nt, Homo sapiens
aauaaucaugaucaca

SEQ ID NO: 854602 - RNA, 12 nt, Homo sapiens
aauaauuccaac

SEQ ID NO: 854603 - RNA, 18 nt, Homo sapiens
aauaauuugguauccuua

SEQ ID NO: 854604 - RNA, 12 nt, Homo sapiens
aauacugaacca

SEQ ID NO: 854605 - RNA, 23 nt, Homo sapiens
aauacuuugcagcacagcugaga

SEQ ID NO: 854606 - RNA, 20 nt, Homo sapiens
aauagcuagcuauuacugca

SEQ ID NO: 854607 - RNA, 22 nt, Homo sapiens
aauagucauuugugaauuaucc

SEQ ID NO: 854608 - RNA, 16 nt, Homo sapiens
aauauaaaaacauuca

SEQ ID NO: 854609 - RNA, 21 nt, Homo sapiens
aauauagaaaauaucuagccc

SEQ ID NO: 854610 - RNA, 15 nt, Homo sapiens
aauauauccacacau

SEQ ID NO: 854611 - RNA, 16 nt, Homo sapiens
aauauguaaaugguau

SEQ ID NO: 854612 - RNA, 20 nt, Homo sapiens
aaucacugaaccucucagga

SEQ ID NO: 854613 - RNA, 12 nt, Homo sapiens
aaucaugaucac

SEQ ID NO: 854614 - RNA, 15 nt, Homo sapiens
aaucauuuguucaaa

SEQ ID NO: 854615 - RNA, 17 nt, Homo sapiens
aauccccaagaacacaa

SEQ ID NO: 854616 - RNA, 15 nt, Homo sapiens
aaucgcagccagcuu

SEQ ID NO: 854617 - RNA, 12 nt, Homo sapiens
aaucuaaacuuu

SEQ ID NO: 854618 - RNA, 15 nt, Homo sapiens
aaucuaacaguaaca

SEQ ID NO: 854619 - RNA, 23 nt, Homo sapiens
aaucuagcucuccauacuuugaa

SEQ ID NO: 854620 - RNA, 15 nt, Homo sapiens
aaucugccaccugca

SEQ ID NO: 854621 - RNA, 18 nt, Homo sapiens
aaucuguuuauuggaugg

SEQ ID NO: 854622 - RNA, 18 nt, Homo sapiens
aaucuuuaacugaacucu

SEQ ID NO: 854623 - RNA, 23 nt, Homo sapiens
aaugaccucauguccuucuuguc

SEQ ID NO: 854624 - RNA, 22 nt, Homo sapiens
aaugacuuuuugaaaguaaaag

SEQ ID NO: 854625 - RNA, 19 nt, Homo sapiens
aaugaguccaaacuggaau

SEQ ID NO: 854626 - RNA, 21 nt, Homo sapiens
aaugagugugauccaguuuuu

SEQ ID NO: 854627 - RNA, 15 nt, Homo sapiens
aaugauuaaugcauu

SEQ ID NO: 854628 - RNA, 13 nt, Homo sapiens
aaugcaaccauuu

SEQ ID NO: 854629 - RNA, 22 nt, Homo sapiens
aaugcaccauacucaugcaugc

SEQ ID NO: 854630 - RNA, 13 nt, Homo sapiens
aaugccaggugga

SEQ ID NO: 854631 - RNA, 17 nt, Homo sapiens
aaugcugaacauugcau

SEQ ID NO: 854632 - RNA, 21 nt, Homo sapiens
aaugcugagauccucauuuau

SEQ ID NO: 854633 - RNA, 22 nt, Homo sapiens
aaugcugauagcucauauuaua

SEQ ID NO: 854634 - RNA, 13 nt, Homo sapiens
aaugcuucuuccc

SEQ ID NO: 854635 - RNA, 14 nt, Homo sapiens
aauggaaauaccaa

SEQ ID NO: 854636 - RNA, 23 nt, Homo sapiens
aaugggauaugggguuacuucag

SEQ ID NO: 854637 - RNA, 15 nt, Homo sapiens
aaugguccaguacaa

SEQ ID NO: 854638 - RNA, 17 nt, Homo sapiens
aauguaucaacacacau

SEQ ID NO: 854639 - RNA, 15 nt, Homo sapiens
aauguaugauuacau

SEQ ID NO: 854640 - RNA, 18 nt, Homo sapiens
aaugucauucucuucucu

SEQ ID NO: 854641 - RNA, 15 nt, Homo sapiens
aauguuauagcugca

SEQ ID NO: 854642 - RNA, 17 nt, Homo sapiens
aauguucauacugaugu

SEQ ID NO: 854643 - RNA, 15 nt, Homo sapiens
aauuaaguacuuaag

SEQ ID NO: 854644 - RNA, 19 nt, Homo sapiens
aauucacccaccagacuuu

SEQ ID NO: 854645 - RNA, 20 nt, Homo sapiens
aauucacccaccagacuuuu

SEQ ID NO: 854646 - RNA, 20 nt, Homo sapiens
aauuccugacgagauaagca

SEQ ID NO: 854647 - RNA, 16 nt, Homo sapiens
aauucuaugucuagca

SEQ ID NO: 854648 - RNA, 19 nt, Homo sapiens
aauugaugaaaugcaaaag

SEQ ID NO: 854649 - RNA, 15 nt, Homo sapiens
aauuguuuaaauuca

SEQ ID NO: 854650 - RNA, 22 nt, Homo sapiens
aauuuaaacguauaauauguac

SEQ ID NO: 854651 - RNA, 18 nt, Homo sapiens
auauucuuuaauacuuca

SEQ ID NO: 854652 - RNA, 18 nt, Homo sapiens
auauugaaagguagcaau

SEQ ID NO: 854653 - RNA, 22 nt, Homo sapiens
auauuggcugguaaauugccau

SEQ ID NO: 854654 - RNA, 16 nt, Homo sapiens
auauuuaagaagccaa

SEQ ID NO: 854655 - RNA, 13 nt, Homo sapiens
auauuuaagcaau

SEQ ID NO: 854656 - RNA, 20 nt, Homo sapiens
auauuuauuuaugcuaauau

SEQ ID NO: 854657 - RNA, 21 nt, Homo sapiens
auauuucacacuggagugaau

SEQ ID NO: 854658 - RNA, 22 nt, Homo sapiens
auauuuucuuaaaaccaaucaa

SEQ ID NO: 854659 - RNA, 14 nt, Homo sapiens
aucaaaacauccca

SEQ ID NO: 854660 - RNA, 12 nt, Homo sapiens
aucaaacuucca

SEQ ID NO: 854661 - RNA, 15 nt, Homo sapiens
aucaagagccuuaaa

SEQ ID NO: 854662 - RNA, 15 nt, Homo sapiens
aucaauugauauuaa

SEQ ID NO: 854663 - RNA, 21 nt, Homo sapiens
aucaccaugaacaaagauaua

SEQ ID NO: 854664 - RNA, 22 nt, Homo sapiens
aucaccguacgacucuuuucca

SEQ ID NO: 854665 - RNA, 14 nt, Homo sapiens
aucauugcaaacaa

SEQ ID NO: 854666 - RNA, 18 nt, Homo sapiens
aucauuugaguucaggag

SEQ ID NO: 854667 - RNA, 20 nt, Homo sapiens
auccacucuucuagggauau

SEQ ID NO: 854668 - RNA, 15 nt, Homo sapiens
auccacuuuggcagg

SEQ ID NO: 854669 - RNA, 13 nt, Homo sapiens
auccagacucuca

SEQ ID NO: 854670 - RNA, 12 nt, Homo sapiens
auccagcucaag

SEQ ID NO: 854671 - RNA, 20 nt, Homo sapiens
auccaucguaauuguucucu

SEQ ID NO: 854672 - RNA, 12 nt, Homo sapiens
aucccagcacuu

SEQ ID NO: 854673 - RNA, 19 nt, Homo sapiens
auccggaaaucagcaaacu

SEQ ID NO: 854674 - RNA, 21 nt, Homo sapiens
auccugaacugggauggaaug

SEQ ID NO: 854675 - RNA, 21 nt, Homo sapiens
auccuuuuagucugcauauau

SEQ ID NO: 854676 - RNA, 16 nt, Homo sapiens
aucuaguugucaauaa

SEQ ID NO: 854677 - RNA, 13 nt, Homo sapiens
aucuaucacccag

SEQ ID NO: 854678 - RNA, 21 nt, Homo sapiens
aucuauuugugggugugcuau

SEQ ID NO: 854679 - RNA, 21 nt, Homo sapiens
aucucaaacucccuuuggccc

SEQ ID NO: 854680 - RNA, 21 nt, Homo sapiens
aucucaaggauccagacucuc

SEQ ID NO: 854681 - RNA, 18 nt, Homo sapiens
aucucccuuuuccaugac

SEQ ID NO: 854682 - RNA, 22 nt, Homo sapiens
aucucgccaaccccucucucau

SEQ ID NO: 854683 - RNA, 14 nt, Homo sapiens
aucucuaauauauc

SEQ ID NO: 854684 - RNA, 15 nt, Homo sapiens
aucucucugggaugc

SEQ ID NO: 854685 - RNA, 18 nt, Homo sapiens
aucucugcuuaguacauu

SEQ ID NO: 854686 - RNA, 16 nt, Homo sapiens
aucugcugcauuucac

SEQ ID NO: 854687 - RNA, 20 nt, Homo sapiens
aucuugaucucccuuuccua

SEQ ID NO: 854688 - RNA, 20 nt, Homo sapiens
aucuuuguguugcagccuca

SEQ ID NO: 854689 - RNA, 23 nt, Homo sapiens
aucuuuucucauuaaaauuguga

SEQ ID NO: 854690 - RNA, 13 nt, Homo sapiens
augaacagacuuu

SEQ ID NO: 854691 - RNA, 17 nt, Homo sapiens
augaacuggccucugcc

SEQ ID NO: 854692 - RNA, 20 nt, Homo sapiens
augaaggcugggggcauuuu

SEQ ID NO: 854693 - RNA, 18 nt, Homo sapiens
augaauaccuuuguucaa

SEQ ID NO: 854694 - RNA, 23 nt, Homo sapiens
augaggcaacccgugcucagcug

SEQ ID NO: 854695 - RNA, 19 nt, Homo sapiens
augauaauaaucaugauca

SEQ ID NO: 854696 - RNA, 22 nt, Homo sapiens
augauauggagguucaaugaga

SEQ ID NO: 854697 - RNA, 15 nt, Homo sapiens
augauuaaaaauauc

SEQ ID NO: 854698 - RNA, 23 nt, Homo sapiens
augcaaccauuuuuaggaagcua

SEQ ID NO: 854699 - RNA, 14 nt, Homo sapiens
augcagaacuuccc

SEQ ID NO: 854700 - RNA, 15 nt, Homo sapiens
augcagaacuucccu

SEQ ID NO: 854701 - RNA, 13 nt, Homo sapiens
augcccaaggcga

SEQ ID NO: 854702 - RNA, 14 nt, Homo sapiens
augccuaacagaga

SEQ ID NO: 854703 - RNA, 21 nt, Homo sapiens
augccuaauaguccuuugaua

SEQ ID NO: 854704 - RNA, 18 nt, Homo sapiens
augcuggaaacauucacu

SEQ ID NO: 854705 - RNA, 22 nt, Homo sapiens
augcuggagaaaaauaucugua

SEQ ID NO: 854706 - RNA, 21 nt, Homo sapiens
augcuugguacuguaauguua

SEQ ID NO: 854707 - RNA, 19 nt, Homo sapiens
augcuuuagcauacuagaa

SEQ ID NO: 854708 - RNA, 23 nt, Homo sapiens
augcuuuagcauacuagaaucag

SEQ ID NO: 854709 - RNA, 17 nt, Homo sapiens
auggaacaagagaagua

SEQ ID NO: 854710 - RNA, 22 nt, Homo sapiens
auggagucucgcucuguugccc

SEQ ID NO: 854711 - RNA, 19 nt, Homo sapiens
auggcaaguacaguacuuu

SEQ ID NO: 854712 - RNA, 15 nt, Homo sapiens
auggcugaagugcau

SEQ ID NO: 854713 - RNA, 13 nt, Homo sapiens
auggcuggaauau

SEQ ID NO: 854714 - RNA, 17 nt, Homo sapiens
augggaugauugaagaa

SEQ ID NO: 854715 - RNA, 16 nt, Homo sapiens
augggucucucuugcc

SEQ ID NO: 854716 - RNA, 21 nt, Homo sapiens
auggucuuauauuuacaacac

SEQ ID NO: 854717 - RNA, 13 nt, Homo sapiens
augguuacauauc

SEQ ID NO: 854718 - RNA, 17 nt, Homo sapiens
auguaaaaagugcagua

SEQ ID NO: 854719 - RNA, 22 nt, Homo sapiens
auguacuuuuaaauuauacaau

SEQ ID NO: 854720 - RNA, 18 nt, Homo sapiens
auguaggagaaagagccu

SEQ ID NO: 854721 - RNA, 21 nt, Homo sapiens
auguauguguuuagaauugaa

SEQ ID NO: 854722 - RNA, 21 nt, Homo sapiens
augucaacagccauuuaggca

SEQ ID NO: 854723 - RNA, 12 nt, Homo sapiens
augucauucucu

SEQ ID NO: 854724 - RNA, 15 nt, Homo sapiens
auguccuucuugucc

SEQ ID NO: 854725 - RNA, 20 nt, Homo sapiens
augucgauguucgaugcuga

SEQ ID NO: 854726 - RNA, 23 nt, Homo sapiens
augucguaguuacucucaggcau

SEQ ID NO: 854727 - RNA, 17 nt, Homo sapiens
augucucaagugcaaug

SEQ ID NO: 854728 - RNA, 14 nt, Homo sapiens
augucuuuggcuca

SEQ ID NO: 854729 - RNA, 16 nt, Homo sapiens
augucuuuggcucagu

SEQ ID NO: 854730 - RNA, 22 nt, Homo sapiens
augugcccacugucucuuccac

SEQ ID NO: 854731 - RNA, 21 nt, Homo sapiens
augugccuaaauaaguuauaa

SEQ ID NO: 854732 - RNA, 17 nt, Homo sapiens
auguguugcagcuguca

SEQ ID NO: 854733 - RNA, 23 nt, Homo sapiens
auguuaugcauuuuuuaccacaa

SEQ ID NO: 854734 - RNA, 17 nt, Homo sapiens
auguucccccuguuuca

SEQ ID NO: 854735 - RNA, 19 nt, Homo sapiens
auguugacaucacuggcau

SEQ ID NO: 854736 - RNA, 19 nt, Homo sapiens
auguuggacucugagcuca

SEQ ID NO: 854737 - RNA, 14 nt, Homo sapiens
auguuuuagcacag

SEQ ID NO: 854738 - RNA, 23 nt, Homo sapiens
auguuuuccacugagcaucacaa

SEQ ID NO: 854739 - RNA, 13 nt, Homo sapiens
auuaaaagauuau

SEQ ID NO: 854740 - RNA, 13 nt, Homo sapiens
auuaaaauauucu

SEQ ID NO: 854741 - RNA, 15 nt, Homo sapiens
auuaauaauuccaac

SEQ ID NO: 854742 - RNA, 20 nt, Homo sapiens
auuacuuaugauuuauggua

SEQ ID NO: 854743 - RNA, 16 nt, Homo sapiens
auuagcagcugacuuu

SEQ ID NO: 854744 - RNA, 16 nt, Homo sapiens
auuauauaagcaaaau

SEQ ID NO: 854745 - RNA, 17 nt, Homo sapiens
auuaucaccuuugucag

SEQ ID NO: 854746 - RNA, 19 nt, Homo sapiens
auuaugacgguaucacugu

SEQ ID NO: 854747 - RNA, 17 nt, Homo sapiens
auuauucaaaugcuucu

SEQ ID NO: 854748 - RNA, 21 nt, Homo sapiens
auuauuguccuuugauuccaa

SEQ ID NO: 854749 - RNA, 22 nt, Homo sapiens
auucaccaagagccaauaucua

SEQ ID NO: 854750 - RNA, 18 nt, Homo sapiens
auucacuuuccugcagcc

SEQ ID NO: 854751 - RNA, 23 nt, Homo sapiens
auucaggucccaguugcugucac

SEQ ID NO: 854752 - RNA, 19 nt, Homo sapiens
auuccacuuuuuguuacau

SEQ ID NO: 854753 - RNA, 19 nt, Homo sapiens
auucgcuacuaugauuuaa

SEQ ID NO: 854754 - RNA, 16 nt, Homo sapiens
auucuagaacugugaa

SEQ ID NO: 854755 - RNA, 13 nt, Homo sapiens
auucuaguauucu

SEQ ID NO: 854756 - RNA, 16 nt, Homo sapiens
auucugauguuucuca

SEQ ID NO: 854757 - RNA, 17 nt, Homo sapiens
auucuuaauuuauguaa

SEQ ID NO: 854758 - RNA, 22 nt, Homo sapiens
auugaaauaaagauaaaugcaa

SEQ ID NO: 854759 - RNA, 14 nt, Homo sapiens
auugaauacucuga

SEQ ID NO: 854760 - RNA, 21 nt, Homo sapiens
auugaugaaaugcaaaaggaa

SEQ ID NO: 854761 - RNA, 13 nt, Homo sapiens
auugcacaacaga

SEQ ID NO: 854762 - RNA, 17 nt, Homo sapiens
auugcagucacuuugac

SEQ ID NO: 854763 - RNA, 14 nt, Homo sapiens
auugcuuacugugu

SEQ ID NO: 854764 - RNA, 12 nt, Homo sapiens
auuguagccuca

SEQ ID NO: 854765 - RNA, 12 nt, Homo sapiens
auugucacucca

SEQ ID NO: 854766 - RNA, 15 nt, Homo sapiens
auugucacuccaaac

SEQ ID NO: 854767 - RNA, 18 nt, Homo sapiens
auuguccuuugauuccaa

SEQ ID NO: 854768 - RNA, 14 nt, Homo sapiens
auugugaugcuccu

SEQ ID NO: 854769 - RNA, 19 nt, Homo sapiens
auuuaacagggucucuagu

SEQ ID NO: 854770 - RNA, 19 nt, Homo sapiens
auuuaagcaauaaaacugc

SEQ ID NO: 854771 - RNA, 21 nt, Homo sapiens
auuuaccaaaauuugugcaca

SEQ ID NO: 854772 - RNA, 21 nt, Homo sapiens
auuuauuauaugugcacuuca

SEQ ID NO: 854773 - RNA, 22 nt, Homo sapiens
auuucagaggggaggcucagga

SEQ ID NO: 854774 - RNA, 15 nt, Homo sapiens
auuucauguuaugca

SEQ ID NO: 854775 - RNA, 21 nt, Homo sapiens
auuuccacacuaauguauuau

SEQ ID NO: 854776 - RNA, 17 nt, Homo sapiens
auuucccaacacaaaga

SEQ ID NO: 854777 - RNA, 12 nt, Homo sapiens
auuucucugcac

SEQ ID NO: 854778 - RNA, 19 nt, Homo sapiens
auuucucuuucucucucac

SEQ ID NO: 854779 - RNA, 23 nt, Homo sapiens
auuugaaaccccuguaggccuca

SEQ ID NO: 854780 - RNA, 16 nt, Homo sapiens
auuugaaauauggucu

SEQ ID NO: 854781 - RNA, 15 nt, Homo sapiens
auuugauauauguau

SEQ ID NO: 854782 - RNA, 19 nt, Homo sapiens
ugacagcuagcagaucucu

SEQ ID NO: 854783 - RNA, 17 nt, Homo sapiens
ugacaugcauucacaua

SEQ ID NO: 854784 - RNA, 15 nt, Homo sapiens
ugacauuuugcauga

SEQ ID NO: 854785 - RNA, 17 nt, Homo sapiens
ugacccagguagucaaa

SEQ ID NO: 854786 - RNA, 16 nt, Homo sapiens
ugaccugacuuuuagc

SEQ ID NO: 854787 - RNA, 16 nt, Homo sapiens
ugacuaaaaauaucac

SEQ ID NO: 854788 - RNA, 18 nt, Homo sapiens
ugacucuaguacugugaa

SEQ ID NO: 854789 - RNA, 23 nt, Homo sapiens
ugacugaggcaguuugaggauua

SEQ ID NO: 854790 - RNA, 21 nt, Homo sapiens
ugacuuucuguguaccacugg

SEQ ID NO: 854791 - RNA, 12 nt, Homo sapiens
ugagacagacua

SEQ ID NO: 854792 - RNA, 21 nt, Homo sapiens
ugagacuagacauaguaccga

SEQ ID NO: 854793 - RNA, 19 nt, Homo sapiens
ugagagaggccacacuaca

SEQ ID NO: 854794 - RNA, 23 nt, Homo sapiens
ugagauguugagaggaacaagaa

SEQ ID NO: 854795 - RNA, 13 nt, Homo sapiens
ugaggcaucucuc

SEQ ID NO: 854796 - RNA, 24 nt, Homo sapiens
ugaggccacacccagaguagccau

SEQ ID NO: 854797 - RNA, 18 nt, Homo sapiens
ugaggcccauggccacau

SEQ ID NO: 854798 - RNA, 16 nt, Homo sapiens
ugaggccuccugccau

SEQ ID NO: 854799 - RNA, 22 nt, Homo sapiens
ugagguuugaaucugacuuuag

SEQ ID NO: 854800 - RNA, 22 nt, Homo sapiens
ugaguaacgacauggaacugaa

SEQ ID NO: 854801 - RNA, 16 nt, Homo sapiens
ugagugaaacucccac

SEQ ID NO: 854802 - RNA, 18 nt, Homo sapiens
ugagugaggaauggcagu

SEQ ID NO: 854803 - RNA, 22 nt, Homo sapiens
ugagugggcgugguaccugcug

SEQ ID NO: 854804 - RNA, 22 nt, Homo sapiens
ugaguuccggcaccaguagcag

SEQ ID NO: 854805 - RNA, 16 nt, Homo sapiens
ugaguuguuaccccaa

SEQ ID NO: 854806 - RNA, 17 nt, Homo sapiens
ugauacuuagaccaaaa

SEQ ID NO: 854807 - RNA, 14 nt, Homo sapiens
ugauagagugcagu

SEQ ID NO: 854808 - RNA, 13 nt, Homo sapiens
ugauauaaacagc

SEQ ID NO: 854809 - RNA, 15 nt, Homo sapiens
ugaucugugcagggu

SEQ ID NO: 854810 - RNA, 23 nt, Homo sapiens
ugaugaaaauaauuuacugugac

SEQ ID NO: 854811 - RNA, 20 nt, Homo sapiens
ugaugaaauaacacagcagu

SEQ ID NO: 854812 - RNA, 22 nt, Homo sapiens
ugaugcagucuuagaucauagu

SEQ ID NO: 854813 - RNA, 18 nt, Homo sapiens
ugaugguaucuauaguca

SEQ ID NO: 854814 - RNA, 16 nt, Homo sapiens
ugauuauauaagcaaa

SEQ ID NO: 854815 - RNA, 18 nt, Homo sapiens
ugauucacugccuaugaa

SEQ ID NO: 854816 - RNA, 16 nt, Homo sapiens
ugcaaaaugggaugau

SEQ ID NO: 854817 - RNA, 19 nt, Homo sapiens
ugcaaagccaccaacagcc

SEQ ID NO: 854818 - RNA, 16 nt, Homo sapiens
ugcaaaggaaauacca

SEQ ID NO: 854819 - RNA, 18 nt, Homo sapiens
ugcaaauuccauagcuca

SEQ ID NO: 854820 - RNA, 19 nt, Homo sapiens
ugcaacauuuuaaggcaau

SEQ ID NO: 854821 - RNA, 17 nt, Homo sapiens
ugcaacuuccuuugacu

SEQ ID NO: 854822 - RNA, 22 nt, Homo sapiens
ugcaagccuccugaucaggaaa

SEQ ID NO: 854823 - RNA, 18 nt, Homo sapiens
ugcacaauaauaagucca

SEQ ID NO: 854824 - RNA, 15 nt, Homo sapiens
ugcaccguugacuca

SEQ ID NO: 854825 - RNA, 15 nt, Homo sapiens
ugcacgcugggcaau

SEQ ID NO: 854826 - RNA, 18 nt, Homo sapiens
ugcagccuccgcuucccu

SEQ ID NO: 854827 - RNA, 17 nt, Homo sapiens
ugcagcucuacagguga

SEQ ID NO: 854828 - RNA, 19 nt, Homo sapiens
ugcagggcugggucagggg

SEQ ID NO: 854829 - RNA, 13 nt, Homo sapiens
ugcagucacugca

SEQ ID NO: 854830 - RNA, 15 nt, Homo sapiens
ugcagucacuuugac

SEQ ID NO: 854831 - RNA, 13 nt, Homo sapiens
ugcaucuuugaug

SEQ ID NO: 854832 - RNA, 13 nt, Homo sapiens
ugcaugccuaaug

SEQ ID NO: 854833 - RNA, 15 nt, Homo sapiens
ugcauucacauaucu

SEQ ID NO: 854834 - RNA, 23 nt, Homo sapiens
ugcauuuaccaaaauuugugcac

SEQ ID NO: 854835 - RNA, 21 nt, Homo sapiens
ugcauuuacgccuguaaaugu

SEQ ID NO: 854836 - RNA, 15 nt, Homo sapiens
ugcauuucugcucuc

SEQ ID NO: 854837 - RNA, 18 nt, Homo sapiens
ugcauuuuuuaccacaau

SEQ ID NO: 854838 - RNA, 15 nt, Homo sapiens
ugccaaucauugcaa

SEQ ID NO: 854839 - RNA, 16 nt, Homo sapiens
ugccacaaggaagaaa

SEQ ID NO: 854840 - RNA, 12 nt, Homo sapiens
ugccacuuugca

SEQ ID NO: 854841 - RNA, 21 nt, Homo sapiens
ugccucauuuucacagcacua

SEQ ID NO: 854842 - RNA, 22 nt, Homo sapiens
ugccucucuggacgcucugcac

SEQ ID NO: 854843 - RNA, 19 nt, Homo sapiens
ugccucugaguagggcaau

SEQ ID NO: 854844 - RNA, 21 nt, Homo sapiens
ugccuggacaccccacgggag

SEQ ID NO: 854845 - RNA, 18 nt, Homo sapiens
ugccuggcccaugugccc

SEQ ID NO: 854846 - RNA, 16 nt, Homo sapiens
ugccugggaaggccgu

SEQ ID NO: 854847 - RNA, 21 nt, Homo sapiens
ugcuaugauguuaguuuuccu

SEQ ID NO: 854848 - RNA, 21 nt, Homo sapiens
ugcuccauuucgugacuuuuu

SEQ ID NO: 854849 - RNA, 19 nt, Homo sapiens
ugcucucgaggcagcagug

SEQ ID NO: 854850 - RNA, 14 nt, Homo sapiens
ugcugaauggaguu

SEQ ID NO: 854851 - RNA, 21 nt, Homo sapiens
ugcugaccccugugugacauc

SEQ ID NO: 854852 - RNA, 18 nt, Homo sapiens
ugcugcauccccuuccag

SEQ ID NO: 854853 - RNA, 22 nt, Homo sapiens
ugcugccaggauugucacucca

SEQ ID NO: 854854 - RNA, 11 nt, Homo sapiens
ugcugccaggc

SEQ ID NO: 854855 - RNA, 14 nt, Homo sapiens
ugcugggacuuuuu

SEQ ID NO: 854856 - RNA, 19 nt, Homo sapiens
ugcuggugacccagcaucu

SEQ ID NO: 854857 - RNA, 14 nt, Homo sapiens
ugcuguggccuucc

SEQ ID NO: 854858 - RNA, 16 nt, Homo sapiens
ugcugugggaaggcaa

SEQ ID NO: 854859 - RNA, 18 nt, Homo sapiens
ugcuuaucagugugcaau

SEQ ID NO: 854860 - RNA, 20 nt, Homo sapiens
ugcuugaggaauauugcugc

SEQ ID NO: 854861 - RNA, 19 nt, Homo sapiens
ugcuugggacccuagcuau

SEQ ID NO: 854862 - RNA, 22 nt, Homo sapiens
uggaaacauuggugaugcuauc

SEQ ID NO: 854863 - RNA, 18 nt, Homo sapiens
uggaaaguguucauugca

SEQ ID NO: 854864 - RNA, 19 nt, Homo sapiens
uggaacaagagaaguacua

SEQ ID NO: 854865 - RNA, 20 nt, Homo sapiens
uggaacucuugacagcuaua

SEQ ID NO: 854866 - RNA, 19 nt, Homo sapiens
uggaagagaagagaaagga

SEQ ID NO: 854867 - RNA, 23 nt, Homo sapiens
uggacaaagggaaauacucuuaa

SEQ ID NO: 854868 - RNA, 17 nt, Homo sapiens
uggacucucugacaaag

SEQ ID NO: 854869 - RNA, 15 nt, Homo sapiens
uggagaagaggaaga

SEQ ID NO: 854870 - RNA, 22 nt, Homo sapiens
uggagcaauaaaagacaaaugc

SEQ ID NO: 854871 - RNA, 23 nt, Homo sapiens
uggagccccuggggcggugcugg

SEQ ID NO: 854872 - RNA, 15 nt, Homo sapiens
uggagcuaaaacugg

SEQ ID NO: 854873 - RNA, 19 nt, Homo sapiens
uggagucucucucucucca

SEQ ID NO: 854874 - RNA, 18 nt, Homo sapiens
uggaugcuugaggaauau

SEQ ID NO: 854875 - RNA, 17 nt, Homo sapiens
uggaugugauugccuca

SEQ ID NO: 854876 - RNA, 12 nt, Homo sapiens
uggcacucuugg

SEQ ID NO: 854877 - RNA, 14 nt, Homo sapiens
uggcaggacacugc

SEQ ID NO: 854878 - RNA, 22 nt, Homo sapiens
uggcauaguggcuuaacuggac

SEQ ID NO: 854879 - RNA, 18 nt, Homo sapiens
uggccucuucugagcuua

SEQ ID NO: 854880 - RNA, 19 nt, Homo sapiens
uggccugcugcucucucaa

SEQ ID NO: 854881 - RNA, 14 nt, Homo sapiens
uggccuuacuguau

SEQ ID NO: 854882 - RNA, 20 nt, Homo sapiens
uggcucccucacucucagga

SEQ ID NO: 854883 - RNA, 13 nt, Homo sapiens
uggcuccucucac

SEQ ID NO: 854884 - RNA, 10 nt, Homo sapiens
uggcucucaa

SEQ ID NO: 854885 - RNA, 16 nt, Homo sapiens
uggcucucauguacuu

SEQ ID NO: 854886 - RNA, 19 nt, Homo sapiens
uggcugcuucaaaggccag

SEQ ID NO: 854887 - RNA, 21 nt, Homo sapiens
uggcugguaaauugccauggc

SEQ ID NO: 854888 - RNA, 24 nt, Homo sapiens
uggcuuacacuggcaaugguaguu

SEQ ID NO: 854889 - RNA, 17 nt, Homo sapiens
ugggaaggcaauuucuc

SEQ ID NO: 854890 - RNA, 16 nt, Homo sapiens
ugggacccaguggcag

SEQ ID NO: 854891 - RNA, 16 nt, Homo sapiens
ugggagccaacuguca

SEQ ID NO: 854892 - RNA, 24 nt, Homo sapiens
ugggauaggaaaaaaagauuucca

SEQ ID NO: 854893 - RNA, 21 nt, Homo sapiens
ugggauucuagaacugugaau

SEQ ID NO: 854894 - RNA, 21 nt, Homo sapiens
ugggauuucagagcuggaaau

SEQ ID NO: 854895 - RNA, 21 nt, Homo sapiens
ugggcaccaggagugccuuca

SEQ ID NO: 854896 - RNA, 16 nt, Homo sapiens
ugggcuuugcugcuua

SEQ ID NO: 854897 - RNA, 19 nt, Homo sapiens
ugggggccccgucucaggu

SEQ ID NO: 854898 - RNA, 16 nt, Homo sapiens
ugggggugaaagggaa

SEQ ID NO: 854899 - RNA, 12 nt, Homo sapiens
ugggucaggggu

SEQ ID NO: 854900 - RNA, 19 nt, Homo sapiens
ugggucagggguacacaga

SEQ ID NO: 854901 - RNA, 22 nt, Homo sapiens
uggguccccggcgggacuguca

SEQ ID NO: 854902 - RNA, 20 nt, Homo sapiens
ugggugauuugauaacaagu

SEQ ID NO: 854903 - RNA, 12 nt, Homo sapiens
uggucauucaca

SEQ ID NO: 854904 - RNA, 16 nt, Homo sapiens
ugguccaucucugaaa

SEQ ID NO: 854905 - RNA, 17 nt, Homo sapiens
ugguccaucucugaaaa

SEQ ID NO: 854906 - RNA, 22 nt, Homo sapiens
uggugaauuuguuuaagguuaa

SEQ ID NO: 854907 - RNA, 22 nt, Homo sapiens
uggugacauuuugcaugaugaa

SEQ ID NO: 854908 - RNA, 20 nt, Homo sapiens
uggugaccucacacaccucu

SEQ ID NO: 854909 - RNA, 22 nt, Homo sapiens
uggugcuaccuggcucuccugu

SEQ ID NO: 854910 - RNA, 19 nt, Homo sapiens
ugguggccccaaccacagg

SEQ ID NO: 854911 - RNA, 17 nt, Homo sapiens
ugguguggcacugggag

SEQ ID NO: 854912 - RNA, 19 nt, Homo sapiens
ugguguuggcggucccugu

SEQ ID NO: 854913 - RNA, 12 nt, Homo sapiens
aauuuacuguga

SEQ ID NO: 854914 - RNA, 17 nt, Homo sapiens
aauuuaguucaugcauu

SEQ ID NO: 854915 - RNA, 15 nt, Homo sapiens
aauuucucugcacac

SEQ ID NO: 854916 - RNA, 20 nt, Homo sapiens
aauuugcucauaugaacuuu

SEQ ID NO: 854917 - RNA, 14 nt, Homo sapiens
aauuuuuuuguacg

SEQ ID NO: 854918 - RNA, 16 nt, Homo sapiens
acaaagggaaauacuc

SEQ ID NO: 854919 - RNA, 23 nt, Homo sapiens
acaaauaagugugcaguaucugu

SEQ ID NO: 854920 - RNA, 14 nt, Homo sapiens
acaaauacauuccu

SEQ ID NO: 854921 - RNA, 14 nt, Homo sapiens
acaaaugacuuuau

SEQ ID NO: 854922 - RNA, 15 nt, Homo sapiens
acaaauuuaacuuuu

SEQ ID NO: 854923 - RNA, 16 nt, Homo sapiens
acaaauuuaacuuuua

SEQ ID NO: 854924 - RNA, 18 nt, Homo sapiens
acaaccaaguaugaaucu

SEQ ID NO: 854925 - RNA, 22 nt, Homo sapiens
acaacugaauagcaaguggcau

SEQ ID NO: 854926 - RNA, 13 nt, Homo sapiens
acaagaagacaaa

SEQ ID NO: 854927 - RNA, 20 nt, Homo sapiens
acaagaagguggaaggcagu

SEQ ID NO: 854928 - RNA, 21 nt, Homo sapiens
acaagaagguggaaggcagug

SEQ ID NO: 854929 - RNA, 19 nt, Homo sapiens
acaagcuggcuuacacugg

SEQ ID NO: 854930 - RNA, 14 nt, Homo sapiens
acaaguaguucugu

SEQ ID NO: 854931 - RNA, 20 nt, Homo sapiens
acaaguggcucaucaucaag

SEQ ID NO: 854932 - RNA, 22 nt, Homo sapiens
acaaguugagcuaugacuuaac

SEQ ID NO: 854933 - RNA, 23 nt, Homo sapiens
acaauucagucuagccacaaagg

SEQ ID NO: 854934 - RNA, 12 nt, Homo sapiens
acaauuucugca

SEQ ID NO: 854935 - RNA, 13 nt, Homo sapiens
acacaccucugcc

SEQ ID NO: 854936 - RNA, 15 nt, Homo sapiens
acacccuagcccuua

SEQ ID NO: 854937 - RNA, 13 nt, Homo sapiens
acacgcaguauug

SEQ ID NO: 854938 - RNA, 17 nt, Homo sapiens
acacuaggaaucaaaac

SEQ ID NO: 854939 - RNA, 19 nt, Homo sapiens
acacuguaccccagcucuc

SEQ ID NO: 854940 - RNA, 23 nt, Homo sapiens
acagaagugagcuccugccuuag

SEQ ID NO: 854941 - RNA, 21 nt, Homo sapiens
acagagugccaacuucuuuca

SEQ ID NO: 854942 - RNA, 17 nt, Homo sapiens
acagcaaagauccacuu

SEQ ID NO: 854943 - RNA, 21 nt, Homo sapiens
acagcauuuguguguuacaau

SEQ ID NO: 854944 - RNA, 16 nt, Homo sapiens
acagccugccucugcc

SEQ ID NO: 854945 - RNA, 17 nt, Homo sapiens
acagccugccucugcca

SEQ ID NO: 854946 - RNA, 18 nt, Homo sapiens
acagcuucauguucccaa

SEQ ID NO: 854947 - RNA, 23 nt, Homo sapiens
acaggaggaaccccuucucuggu

SEQ ID NO: 854948 - RNA, 16 nt, Homo sapiens
acagggccucaguuuc

SEQ ID NO: 854949 - RNA, 20 nt, Homo sapiens
acagggucucuagugcugug

SEQ ID NO: 854950 - RNA, 17 nt, Homo sapiens
acagugugggaccugcc

SEQ ID NO: 854951 - RNA, 12 nt, Homo sapiens
acauagccaaaa

SEQ ID NO: 854952 - RNA, 15 nt, Homo sapiens
acauauguuucacag

SEQ ID NO: 854953 - RNA, 14 nt, Homo sapiens
acaucuuucagcug

SEQ ID NO: 854954 - RNA, 17 nt, Homo sapiens
acaugaaaauagcaaua

SEQ ID NO: 854955 - RNA, 13 nt, Homo sapiens
acaugcauucaca

SEQ ID NO: 854956 - RNA, 22 nt, Homo sapiens
acaugccuguuaauauucaugu

SEQ ID NO: 854957 - RNA, 18 nt, Homo sapiens
acauggcaaguacaguac

SEQ ID NO: 854958 - RNA, 17 nt, Homo sapiens
acaugguuacauaucaa

SEQ ID NO: 854959 - RNA, 21 nt, Homo sapiens
acauuuauccccuuuccugcc

SEQ ID NO: 854960 - RNA, 20 nt, Homo sapiens
accaaaugaguccaaacugg

SEQ ID NO: 854961 - RNA, 23 nt, Homo sapiens
accaaaugaguccaaacuggaau

SEQ ID NO: 854962 - RNA, 14 nt, Homo sapiens
accaacagccacuc

SEQ ID NO: 854963 - RNA, 17 nt, Homo sapiens
accaacuacuaccugua

SEQ ID NO: 854964 - RNA, 23 nt, Homo sapiens
accaacuacuaccuguaaugaca

SEQ ID NO: 854965 - RNA, 18 nt, Homo sapiens
accaaggaccauggguca

SEQ ID NO: 854966 - RNA, 16 nt, Homo sapiens
accaaucuuacuuugu

SEQ ID NO: 854967 - RNA, 17 nt, Homo sapiens
accaaucuuacuuugua

SEQ ID NO: 854968 - RNA, 13 nt, Homo sapiens
accacacagcuaa

SEQ ID NO: 854969 - RNA, 14 nt, Homo sapiens
accagaucagauaa

SEQ ID NO: 854970 - RNA, 19 nt, Homo sapiens
accaggcccaccuggaauc

SEQ ID NO: 854971 - RNA, 13 nt, Homo sapiens
accaguugccguu

SEQ ID NO: 854972 - RNA, 15 nt, Homo sapiens
accaugccuacuaaa

SEQ ID NO: 854973 - RNA, 18 nt, Homo sapiens
accaugcugucuggcaca

SEQ ID NO: 854974 - RNA, 15 nt, Homo sapiens
acccaccagacuuuu

SEQ ID NO: 854975 - RNA, 17 nt, Homo sapiens
acccagaaaaucugaau

SEQ ID NO: 854976 - RNA, 14 nt, Homo sapiens
acccagaguagcca

SEQ ID NO: 854977 - RNA, 15 nt, Homo sapiens
acccccuuaacugua

SEQ ID NO: 854978 - RNA, 13 nt, Homo sapiens
accccucucucau

SEQ ID NO: 854979 - RNA, 23 nt, Homo sapiens
accccugucccuccccugggcac

SEQ ID NO: 854980 - RNA, 21 nt, Homo sapiens
acccuaaaguauaacaugucg

SEQ ID NO: 854981 - RNA, 17 nt, Homo sapiens
acccuaauaagacccca

SEQ ID NO: 854982 - RNA, 17 nt, Homo sapiens
acccuagaugugcucgu

SEQ ID NO: 854983 - RNA, 14 nt, Homo sapiens
acccuuccaucuga

SEQ ID NO: 854984 - RNA, 13 nt, Homo sapiens
accguucaccagu

SEQ ID NO: 854985 - RNA, 13 nt, Homo sapiens
accuaaacauuau

SEQ ID NO: 854986 - RNA, 14 nt, Homo sapiens
accucacgugcaaa

SEQ ID NO: 854987 - RNA, 14 nt, Homo sapiens
accucccucccacc

SEQ ID NO: 854988 - RNA, 20 nt, Homo sapiens
accucugugcagggcacaga

SEQ ID NO: 854989 - RNA, 15 nt, Homo sapiens
accugcauuauguac

SEQ ID NO: 854990 - RNA, 17 nt, Homo sapiens
accuuaaaugcugagau

SEQ ID NO: 854991 - RNA, 17 nt, Homo sapiens
accuuacucugagcuca

SEQ ID NO: 854992 - RNA, 12 nt, Homo sapiens
accuugucauuu

SEQ ID NO: 854993 - RNA, 12 nt, Homo sapiens
acgccaacaaaa

SEQ ID NO: 854994 - RNA, 19 nt, Homo sapiens
acgguaucacuguaucauc

SEQ ID NO: 854995 - RNA, 17 nt, Homo sapiens
acgguuccuacacagga

SEQ ID NO: 854996 - RNA, 15 nt, Homo sapiens
acguggugaccucac

SEQ ID NO: 854997 - RNA, 23 nt, Homo sapiens
acguuuucaucucuagggaccag

SEQ ID NO: 854998 - RNA, 22 nt, Homo sapiens
acuaauaguauccagcacagau

SEQ ID NO: 854999 - RNA, 22 nt, Homo sapiens
acuaauucuaugucuagcacau

SEQ ID NO: 855000 - RNA, 17 nt, Homo sapiens
acuacacacaccagaug

SEQ ID NO: 855001 - RNA, 15 nt, Homo sapiens
acuagaaguacgugu

SEQ ID NO: 855002 - RNA, 11 nt, Homo sapiens
acuagcuguaa

SEQ ID NO: 855003 - RNA, 22 nt, Homo sapiens
acuauaaauaauauucuauuca

SEQ ID NO: 855004 - RNA, 16 nt, Homo sapiens
acuauaccaacugggc

SEQ ID NO: 855005 - RNA, 23 nt, Homo sapiens
acuauaccaacugggccucugau

SEQ ID NO: 855006 - RNA, 11 nt, Homo sapiens
acucacugugu

SEQ ID NO: 855007 - RNA, 22 nt, Homo sapiens
acucacuguguggccucagaga

SEQ ID NO: 855008 - RNA, 20 nt, Homo sapiens
acuccaaaccuuacucugag

SEQ ID NO: 855009 - RNA, 22 nt, Homo sapiens
acuccccauuggugcuaccugg

SEQ ID NO: 855010 - RNA, 18 nt, Homo sapiens
acuccucucguacuugaa

SEQ ID NO: 855011 - RNA, 14 nt, Homo sapiens
acuccuuccuugaa

SEQ ID NO: 855012 - RNA, 17 nt, Homo sapiens
acucuaguacugugaau

SEQ ID NO: 855013 - RNA, 13 nt, Homo sapiens
acucucuuccuuu

SEQ ID NO: 855014 - RNA, 20 nt, Homo sapiens
acucucuuccuuucauucua

SEQ ID NO: 855015 - RNA, 18 nt, Homo sapiens
acucugucuggccaggga

SEQ ID NO: 855016 - RNA, 13 nt, Homo sapiens
acucuugacagcu

SEQ ID NO: 855017 - RNA, 14 nt, Homo sapiens
acucuuggggacca

SEQ ID NO: 855018 - RNA, 13 nt, Homo sapiens
acucuuuccuuca

SEQ ID NO: 855019 - RNA, 15 nt, Homo sapiens
acucuuuugggcaac

SEQ ID NO: 855020 - RNA, 20 nt, Homo sapiens
acugaaaagacaaaguuuau

SEQ ID NO: 855021 - RNA, 18 nt, Homo sapiens
acugaaaaugaacuguaa

SEQ ID NO: 855022 - RNA, 19 nt, Homo sapiens
acugacugaggcaguuuga

SEQ ID NO: 855023 - RNA, 14 nt, Homo sapiens
acugacugcuuaua

SEQ ID NO: 855024 - RNA, 17 nt, Homo sapiens
acugagguuuacauacg

SEQ ID NO: 855025 - RNA, 21 nt, Homo sapiens
acugaguauguucauugccac

SEQ ID NO: 855026 - RNA, 21 nt, Homo sapiens
acugaugguuaaauaauguga

SEQ ID NO: 855027 - RNA, 17 nt, Homo sapiens
acugccaccuccccuug

SEQ ID NO: 855028 - RNA, 23 nt, Homo sapiens
acugccaccuccccuugccagcu

SEQ ID NO: 855029 - RNA, 12 nt, Homo sapiens
acugcucauuuc

SEQ ID NO: 855030 - RNA, 14 nt, Homo sapiens
acugcucauuucau

SEQ ID NO: 855031 - RNA, 13 nt, Homo sapiens
acuggauguacca

SEQ ID NO: 855032 - RNA, 13 nt, Homo sapiens
acugguccaucug

SEQ ID NO: 855033 - RNA, 23 nt, Homo sapiens
acuguacaaugacuuuauugcau

SEQ ID NO: 855034 - RNA, 17 nt, Homo sapiens
acuguacaugggacuau

SEQ ID NO: 855035 - RNA, 13 nt, Homo sapiens
acuguagauuuaa

SEQ ID NO: 855036 - RNA, 16 nt, Homo sapiens
acugugaccaucccaa

SEQ ID NO: 855037 - RNA, 17 nt, Homo sapiens
acuguguaccucaugga

SEQ ID NO: 855038 - RNA, 17 nt, Homo sapiens
acuguguguguccuaca

SEQ ID NO: 855039 - RNA, 22 nt, Homo sapiens
acuguguguguccuacacaaug

SEQ ID NO: 855040 - RNA, 16 nt, Homo sapiens
acuuacaaagggucua

SEQ ID NO: 855041 - RNA, 15 nt, Homo sapiens
acuuauuuaugaaca

SEQ ID NO: 855042 - RNA, 19 nt, Homo sapiens
acuuauuuaugaacagacu

SEQ ID NO: 855043 - RNA, 22 nt, Homo sapiens
acuuauuuaugaacagacuuuu

SEQ ID NO: 855044 - RNA, 23 nt, Homo sapiens
acuucccuggguuagacugccag

SEQ ID NO: 855045 - RNA, 22 nt, Homo sapiens
acuuccuuugacuuucugugua

SEQ ID NO: 855046 - RNA, 20 nt, Homo sapiens
auuugcucuucauccaggga

SEQ ID NO: 855047 - RNA, 19 nt, Homo sapiens
auuuguuacuguauccuca

SEQ ID NO: 855048 - RNA, 17 nt, Homo sapiens
auuuuaaaacagaagaa

SEQ ID NO: 855049 - RNA, 13 nt, Homo sapiens
auuuuaaggcaau

SEQ ID NO: 855050 - RNA, 18 nt, Homo sapiens
auuuuagaaugucaauaa

SEQ ID NO: 855051 - RNA, 16 nt, Homo sapiens
auuuuauauguuucuu

SEQ ID NO: 855052 - RNA, 15 nt, Homo sapiens
auuuucacagcacua

SEQ ID NO: 855053 - RNA, 15 nt, Homo sapiens
auuuucaccuaucca

SEQ ID NO: 855054 - RNA, 19 nt, Homo sapiens
auuuucagaauuuaaucuu

SEQ ID NO: 855055 - RNA, 21 nt, Homo sapiens
auuuucucuuucuuccuguca

SEQ ID NO: 855056 - RNA, 15 nt, Homo sapiens
auuuugaccuuguau

SEQ ID NO: 855057 - RNA, 17 nt, Homo sapiens
auuuuuguauccaagga

SEQ ID NO: 855058 - RNA, 15 nt, Homo sapiens
auuuuuuaccacaau

SEQ ID NO: 855059 - RNA, 22 nt, Homo sapiens
caaaaacaaaucgcagccagcu

SEQ ID NO: 855060 - RNA, 18 nt, Homo sapiens
caaaaguagaacuuugua

SEQ ID NO: 855061 - RNA, 22 nt, Homo sapiens
caaaagucuggcccacugugca

SEQ ID NO: 855062 - RNA, 13 nt, Homo sapiens
caaacagauucuu

SEQ ID NO: 855063 - RNA, 15 nt, Homo sapiens
caaaccuaauugcac

SEQ ID NO: 855064 - RNA, 22 nt, Homo sapiens
caaacugcuuccuuucuugauu

SEQ ID NO: 855065 - RNA, 16 nt, Homo sapiens
caaaggagcauugcag

SEQ ID NO: 855066 - RNA, 22 nt, Homo sapiens
caaaggagugagugaaacuccc

SEQ ID NO: 855067 - RNA, 20 nt, Homo sapiens
caaagggaaauacucuuaau

SEQ ID NO: 855068 - RNA, 16 nt, Homo sapiens
caaaguccagauacca

SEQ ID NO: 855069 - RNA, 12 nt, Homo sapiens
caaauacauucc

SEQ ID NO: 855070 - RNA, 16 nt, Homo sapiens
caaauaugugguccau

SEQ ID NO: 855071 - RNA, 22 nt, Homo sapiens
caaauaugugguccaucucuga

SEQ ID NO: 855072 - RNA, 14 nt, Homo sapiens
caaaugaaauaaua

SEQ ID NO: 855073 - RNA, 19 nt, Homo sapiens
caaaugacuuuauuauuua

SEQ ID NO: 855074 - RNA, 18 nt, Homo sapiens
caaaugugugcccagcuu

SEQ ID NO: 855075 - RNA, 17 nt, Homo sapiens
caaauuaaaaaaucaaa

SEQ ID NO: 855076 - RNA, 16 nt, Homo sapiens
caacaauguguuguaa

SEQ ID NO: 855077 - RNA, 17 nt, Homo sapiens
caacaauucucccggga

SEQ ID NO: 855078 - RNA, 16 nt, Homo sapiens
caacauuguagccuca

SEQ ID NO: 855079 - RNA, 18 nt, Homo sapiens
caaccauuugaaaccccu

SEQ ID NO: 855080 - RNA, 18 nt, Homo sapiens
caacccccuuaacuguau

SEQ ID NO: 855081 - RNA, 22 nt, Homo sapiens
caaccugaaaguuccuucugua

SEQ ID NO: 855082 - RNA, 19 nt, Homo sapiens
caacuccccauuggugcua

SEQ ID NO: 855083 - RNA, 17 nt, Homo sapiens
caacugcacccaugaga

SEQ ID NO: 855084 - RNA, 14 nt, Homo sapiens
caacuuccuuugac

SEQ ID NO: 855085 - RNA, 13 nt, Homo sapiens
caagaacacaaga

SEQ ID NO: 855086 - RNA, 15 nt, Homo sapiens
caagaacacaagaag

SEQ ID NO: 855087 - RNA, 19 nt, Homo sapiens
caagaagguggaaggcagu

SEQ ID NO: 855088 - RNA, 16 nt, Homo sapiens
caagaaucuaaacuuu

SEQ ID NO: 855089 - RNA, 22 nt, Homo sapiens
caagacagcauuuguguguuac

SEQ ID NO: 855090 - RNA, 18 nt, Homo sapiens
caagagaaguacuaucuu

SEQ ID NO: 855091 - RNA, 17 nt, Homo sapiens
caagauuuuuuuacuua

SEQ ID NO: 855092 - RNA, 16 nt, Homo sapiens
caagcacuguggaacu

SEQ ID NO: 855093 - RNA, 18 nt, Homo sapiens
caagcauucucuccauuu

SEQ ID NO: 855094 - RNA, 12 nt, Homo sapiens
caagcucaaggc

SEQ ID NO: 855095 - RNA, 19 nt, Homo sapiens
caaggaaauaaugugaaug

SEQ ID NO: 855096 - RNA, 21 nt, Homo sapiens
caagggucucacacugugaac

SEQ ID NO: 855097 - RNA, 23 nt, Homo sapiens
caagguggucaacaacauuccuc

SEQ ID NO: 855098 - RNA, 19 nt, Homo sapiens
caaguacuuuccaaucuca

SEQ ID NO: 855099 - RNA, 20 nt, Homo sapiens
caaguagccaccugaguucc

SEQ ID NO: 855100 - RNA, 21 nt, Homo sapiens
caaguaucuaaauuuggaacu

SEQ ID NO: 855101 - RNA, 18 nt, Homo sapiens
caauaaaagaaucugaua

SEQ ID NO: 855102 - RNA, 23 nt, Homo sapiens
caauaaauggcccggacaugucu

SEQ ID NO: 855103 - RNA, 23 nt, Homo sapiens
caauauauuuuuacugcuuucug

SEQ ID NO: 855104 - RNA, 13 nt, Homo sapiens
caauaugugaacg

SEQ ID NO: 855105 - RNA, 22 nt, Homo sapiens
caauauuuuccuucucucucaa

SEQ ID NO: 855106 - RNA, 15 nt, Homo sapiens
caauauuuucucuca

SEQ ID NO: 855107 - RNA, 19 nt, Homo sapiens
caaucagguagcuuaaugg

SEQ ID NO: 855108 - RNA, 12 nt, Homo sapiens
caaucauugcaa

SEQ ID NO: 855109 - RNA, 16 nt, Homo sapiens
caauccugaaugugcc

SEQ ID NO: 855110 - RNA, 23 nt, Homo sapiens
caaucgcuuuccuaaaacaguag

SEQ ID NO: 855111 - RNA, 15 nt, Homo sapiens
caaucuguccacaaa

SEQ ID NO: 855112 - RNA, 17 nt, Homo sapiens
caaucuguccacaaaua

SEQ ID NO: 855113 - RNA, 20 nt, Homo sapiens
caaugaccccuguaaggggc

SEQ ID NO: 855114 - RNA, 18 nt, Homo sapiens
caaugggcuuugcugcuu

SEQ ID NO: 855115 - RNA, 17 nt, Homo sapiens
caaugguuucacauggu

SEQ ID NO: 855116 - RNA, 16 nt, Homo sapiens
caauucguucucugcc

SEQ ID NO: 855117 - RNA, 17 nt, Homo sapiens
caauuuuugguugaaua

SEQ ID NO: 855118 - RNA, 18 nt, Homo sapiens
cacaaacucuuuccuuca

SEQ ID NO: 855119 - RNA, 19 nt, Homo sapiens
cacaaaggagugagugaaa

SEQ ID NO: 855120 - RNA, 14 nt, Homo sapiens
cacaaauacauucc

SEQ ID NO: 855121 - RNA, 13 nt, Homo sapiens
cacaaaugacuuu

SEQ ID NO: 855122 - RNA, 15 nt, Homo sapiens
cacaagucccagcgc

SEQ ID NO: 855123 - RNA, 14 nt, Homo sapiens
cacacccaacuaau

SEQ ID NO: 855124 - RNA, 18 nt, Homo sapiens
cacagaaggggacugcca

SEQ ID NO: 855125 - RNA, 17 nt, Homo sapiens
cacagagcuaaggccaa

SEQ ID NO: 855126 - RNA, 17 nt, Homo sapiens
cacagcuaugcaaaaag

SEQ ID NO: 855127 - RNA, 20 nt, Homo sapiens
cacaggugcugaguacucag

SEQ ID NO: 855128 - RNA, 22 nt, Homo sapiens
caccaaggaaaaagcagagaau

SEQ ID NO: 855129 - RNA, 17 nt, Homo sapiens
caccacgccuagccuca

SEQ ID NO: 855130 - RNA, 14 nt, Homo sapiens
caccagcccagaag

SEQ ID NO: 855131 - RNA, 17 nt, Homo sapiens
cacccuuucuacuucca

SEQ ID NO: 855132 - RNA, 20 nt, Homo sapiens
caccuggacaauuucuagaa

SEQ ID NO: 855133 - RNA, 23 nt, Homo sapiens
caccuggguuggaggaagggcac

SEQ ID NO: 855134 - RNA, 16 nt, Homo sapiens
cacgucaaugucauuc

SEQ ID NO: 855135 - RNA, 17 nt, Homo sapiens
cacgugcacaaauucau

SEQ ID NO: 855136 - RNA, 21 nt, Homo sapiens
cacucuaggacucugcacuga

SEQ ID NO: 855137 - RNA, 22 nt, Homo sapiens
cacucuggggcuggcaccagca

SEQ ID NO: 855138 - RNA, 16 nt, Homo sapiens
cacucuguugccauua

SEQ ID NO: 855139 - RNA, 23 nt, Homo sapiens
cacugacucuggaaaaggcauau

SEQ ID NO: 855140 - RNA, 22 nt, Homo sapiens
cacugaguauguucauugccac

SEQ ID NO: 855141 - RNA, 14 nt, Homo sapiens
cacugguccaucug

SEQ ID NO: 855142 - RNA, 18 nt, Homo sapiens
cacugugcaguggagcag

SEQ ID NO: 855143 - RNA, 16 nt, Homo sapiens
cacugugucccaaaaa

SEQ ID NO: 855144 - RNA, 16 nt, Homo sapiens
cacuuggagcuaaaac

SEQ ID NO: 855145 - RNA, 12 nt, Homo sapiens
cacuuugacagg

SEQ ID NO: 855146 - RNA, 18 nt, Homo sapiens
cagaaaagguacacuuug

SEQ ID NO: 855147 - RNA, 14 nt, Homo sapiens
cagaaaaucugaau

SEQ ID NO: 855148 - RNA, 22 nt, Homo sapiens
cagaaaucugcugcauuucaca

SEQ ID NO: 855149 - RNA, 20 nt, Homo sapiens
cagaacacaccgaguuucca

SEQ ID NO: 855150 - RNA, 19 nt, Homo sapiens
cagaacuucccuccaucca

SEQ ID NO: 855151 - RNA, 12 nt, Homo sapiens
cagaagaccucc

SEQ ID NO: 855152 - RNA, 12 nt, Homo sapiens
cagaagugcaga

SEQ ID NO: 855153 - RNA, 15 nt, Homo sapiens
cagaaguguucacau

SEQ ID NO: 855154 - RNA, 19 nt, Homo sapiens
cagaauguucauacugaug

SEQ ID NO: 855155 - RNA, 15 nt, Homo sapiens
cagacaucaagcuca

SEQ ID NO: 855156 - RNA, 20 nt, Homo sapiens
cagaccagccccaccaugca

SEQ ID NO: 855157 - RNA, 19 nt, Homo sapiens
cagacccccaucacuugau

SEQ ID NO: 855158 - RNA, 15 nt, Homo sapiens
cagacgcucauucag

SEQ ID NO: 855159 - RNA, 17 nt, Homo sapiens
cagacugaaaagacaaa

SEQ ID NO: 855160 - RNA, 16 nt, Homo sapiens
cagagaaaucacugaa

SEQ ID NO: 855161 - RNA, 18 nt, Homo sapiens
cagagacccuggugcugc

SEQ ID NO: 855162 - RNA, 19 nt, Homo sapiens
cagagagagauacucuggg

SEQ ID NO: 855163 - RNA, 17 nt, Homo sapiens
cagagagcgaccagcag

SEQ ID NO: 855164 - RNA, 17 nt, Homo sapiens
cagagagggaagcugag

SEQ ID NO: 855165 - RNA, 19 nt, Homo sapiens
cagaggaagacuccugaaa

SEQ ID NO: 855166 - RNA, 14 nt, Homo sapiens
cagaggacacagag

SEQ ID NO: 855167 - RNA, 15 nt, Homo sapiens
cagagggaguagggc

SEQ ID NO: 855168 - RNA, 18 nt, Homo sapiens
cagagggccucaucucag

SEQ ID NO: 855169 - RNA, 19 nt, Homo sapiens
cagagguggucuggugcca

SEQ ID NO: 855170 - RNA, 19 nt, Homo sapiens
cagauauuaauaauuccaa

SEQ ID NO: 855171 - RNA, 16 nt, Homo sapiens
cagauggugggacacc

SEQ ID NO: 855172 - RNA, 15 nt, Homo sapiens
cagauugcugaaugg

SEQ ID NO: 855173 - RNA, 16 nt, Homo sapiens
cagcaacacacaugcu

SEQ ID NO: 855174 - RNA, 23 nt, Homo sapiens
cagcagaccagugggggauggcu

SEQ ID NO: 855175 - RNA, 19 nt, Homo sapiens
cagcagagggaguagggcu

SEQ ID NO: 855176 - RNA, 22 nt, Homo sapiens
cagcaggauaaacauuccagag

SEQ ID NO: 855177 - RNA, 16 nt, Homo sapiens
cagcauuagugggaaa

SEQ ID NO: 855178 - RNA, 20 nt, Homo sapiens
ugguuacaauuuacagugua

SEQ ID NO: 855179 - RNA, 18 nt, Homo sapiens
ugguucaagcgauucucu

SEQ ID NO: 855180 - RNA, 22 nt, Homo sapiens
ugguuucacaugguuacauauc

SEQ ID NO: 855181 - RNA, 18 nt, Homo sapiens
uguaaauauuguuuugca

SEQ ID NO: 855182 - RNA, 14 nt, Homo sapiens
uguaagaguguuua

SEQ ID NO: 855183 - RNA, 22 nt, Homo sapiens
uguaauccagcaauacaguuua

SEQ ID NO: 855184 - RNA, 14 nt, Homo sapiens
uguacagauaugca

SEQ ID NO: 855185 - RNA, 17 nt, Homo sapiens
uguacauauguuucaca

SEQ ID NO: 855186 - RNA, 14 nt, Homo sapiens
uguaccacugggau

SEQ ID NO: 855187 - RNA, 17 nt, Homo sapiens
uguagggggcaggggaa

SEQ ID NO: 855188 - RNA, 21 nt, Homo sapiens
uguaucaagccaaaugugcag

SEQ ID NO: 855189 - RNA, 23 nt, Homo sapiens
uguaucccgcuguaauucccaaa

SEQ ID NO: 855190 - RNA, 16 nt, Homo sapiens
uguaugaaaacaugga

SEQ ID NO: 855191 - RNA, 15 nt, Homo sapiens
ugucagcagcuuuaa

SEQ ID NO: 855192 - RNA, 11 nt, Homo sapiens
ugucauaugaa

SEQ ID NO: 855193 - RNA, 15 nt, Homo sapiens
uguccacaaauauaa

SEQ ID NO: 855194 - RNA, 10 nt, Homo sapiens
uguccaccuu

SEQ ID NO: 855195 - RNA, 13 nt, Homo sapiens
uguccuccagaaa

SEQ ID NO: 855196 - RNA, 18 nt, Homo sapiens
uguccuugaagcuuguau

SEQ ID NO: 855197 - RNA, 15 nt, Homo sapiens
ugucuguuggcaaau

SEQ ID NO: 855198 - RNA, 15 nt, Homo sapiens
ugucuuccuaucaaa

SEQ ID NO: 855199 - RNA, 22 nt, Homo sapiens
ugucuuccuaucaaaaagauau

SEQ ID NO: 855200 - RNA, 12 nt, Homo sapiens
ugugaacaaguc

SEQ ID NO: 855201 - RNA, 20 nt, Homo sapiens
ugugaacaugccuccuccug

SEQ ID NO: 855202 - RNA, 12 nt, Homo sapiens
ugugaauacugc

SEQ ID NO: 855203 - RNA, 15 nt, Homo sapiens
ugugaauccagugaa

SEQ ID NO: 855204 - RNA, 16 nt, Homo sapiens
ugugaaugcgaggaaa

SEQ ID NO: 855205 - RNA, 15 nt, Homo sapiens
ugugacaucacaggg

SEQ ID NO: 855206 - RNA, 16 nt, Homo sapiens
ugugacaucacagggc

SEQ ID NO: 855207 - RNA, 14 nt, Homo sapiens
ugugaccaucccaa

SEQ ID NO: 855208 - RNA, 21 nt, Homo sapiens
ugugaccaucccaacaccuca

SEQ ID NO: 855209 - RNA, 22 nt, Homo sapiens
ugugaccaucccaacaccucac

SEQ ID NO: 855210 - RNA, 18 nt, Homo sapiens
ugugagcagcacccaucc

SEQ ID NO: 855211 - RNA, 14 nt, Homo sapiens
ugugauccaggaau

SEQ ID NO: 855212 - RNA, 17 nt, Homo sapiens
ugugcagggcacagaag

SEQ ID NO: 855213 - RNA, 18 nt, Homo sapiens
ugugcauugaauacucug

SEQ ID NO: 855214 - RNA, 19 nt, Homo sapiens
ugugcauugaauacucuga

SEQ ID NO: 855215 - RNA, 17 nt, Homo sapiens
uguggaagcagaaggcu

SEQ ID NO: 855216 - RNA, 16 nt, Homo sapiens
uguggaugugauugcc

SEQ ID NO: 855217 - RNA, 16 nt, Homo sapiens
uguggcccaggccaga

SEQ ID NO: 855218 - RNA, 19 nt, Homo sapiens
ugugguuuauaaucuugca

SEQ ID NO: 855219 - RNA, 22 nt, Homo sapiens
uguguagggggguuucagggcu

SEQ ID NO: 855220 - RNA, 14 nt, Homo sapiens
uguuaaaggucaua

SEQ ID NO: 855221 - RNA, 16 nt, Homo sapiens
uguuacucuugggaca

SEQ ID NO: 855222 - RNA, 21 nt, Homo sapiens
uguuaugcauuuuuuaccaca

SEQ ID NO: 855223 - RNA, 23 nt, Homo sapiens
uguuccuucuggggcuuugccau

SEQ ID NO: 855224 - RNA, 16 nt, Homo sapiens
uguucugcuuccaaca

SEQ ID NO: 855225 - RNA, 22 nt, Homo sapiens
uguugacucuaguacugugaau

SEQ ID NO: 855226 - RNA, 20 nt, Homo sapiens
uguugccagaugcagcacau

SEQ ID NO: 855227 - RNA, 19 nt, Homo sapiens
uguuggacucugagcucau

SEQ ID NO: 855228 - RNA, 19 nt, Homo sapiens
uguuguuccuucauauaau

SEQ ID NO: 855229 - RNA, 21 nt, Homo sapiens
uguuuccugaauaccagugga

SEQ ID NO: 855230 - RNA, 20 nt, Homo sapiens
uguuucucauccuuugccag

SEQ ID NO: 855231 - RNA, 13 nt, Homo sapiens
uguuucuggucuu

SEQ ID NO: 855232 - RNA, 19 nt, Homo sapiens
uuaaaaaaaauuugcucau

SEQ ID NO: 855233 - RNA, 17 nt, Homo sapiens
uuaaaaaguuugaauag

SEQ ID NO: 855234 - RNA, 21 nt, Homo sapiens
uuaaaagauauaagacuuaau

SEQ ID NO: 855235 - RNA, 19 nt, Homo sapiens
uuaaaauauucuuuaauac

SEQ ID NO: 855236 - RNA, 13 nt, Homo sapiens
uuaaacaauuuga

SEQ ID NO: 855237 - RNA, 20 nt, Homo sapiens
uuaaacugauuacguuuaca

SEQ ID NO: 855238 - RNA, 17 nt, Homo sapiens
uuaaacuuuagugcuac

SEQ ID NO: 855239 - RNA, 15 nt, Homo sapiens
uuaaagauacaguac

SEQ ID NO: 855240 - RNA, 17 nt, Homo sapiens
uuaaaggucauaugcac

SEQ ID NO: 855241 - RNA, 17 nt, Homo sapiens
uuaaaucaggaaauaca

SEQ ID NO: 855242 - RNA, 18 nt, Homo sapiens
uuaacaaauugaguuuag

SEQ ID NO: 855243 - RNA, 20 nt, Homo sapiens
uuaacauaggcuuauacaaa

SEQ ID NO: 855244 - RNA, 17 nt, Homo sapiens
uuaacaugguucaggua

SEQ ID NO: 855245 - RNA, 20 nt, Homo sapiens
uuaacucauccguuugccaa

SEQ ID NO: 855246 - RNA, 20 nt, Homo sapiens
uuaacuguucaguauugcaa

SEQ ID NO: 855247 - RNA, 15 nt, Homo sapiens
uuaagaaauuccuag

SEQ ID NO: 855248 - RNA, 14 nt, Homo sapiens
uuaagaacuaugac

SEQ ID NO: 855249 - RNA, 16 nt, Homo sapiens
uuaagaagaaacuagg

SEQ ID NO: 855250 - RNA, 18 nt, Homo sapiens
uuaagaggauagauuuca

SEQ ID NO: 855251 - RNA, 20 nt, Homo sapiens
uuaaggcaaugguuucacau

SEQ ID NO: 855252 - RNA, 16 nt, Homo sapiens
uuaagguggaaagugu

SEQ ID NO: 855253 - RNA, 18 nt, Homo sapiens
uuaaguaagucucaaggu

SEQ ID NO: 855254 - RNA, 23 nt, Homo sapiens
uuaauaaaaacaaauaauaucuc

SEQ ID NO: 855255 - RNA, 21 nt, Homo sapiens
uuaauguauuugauguauucu

SEQ ID NO: 855256 - RNA, 14 nt, Homo sapiens
uuaauugaaagaau

SEQ ID NO: 855257 - RNA, 19 nt, Homo sapiens
uuacacaugggcauauucu

SEQ ID NO: 855258 - RNA, 22 nt, Homo sapiens
uuacacuuuuuggaagugaaaa

SEQ ID NO: 855259 - RNA, 23 nt, Homo sapiens
uuacagcugggagccuuugccau

SEQ ID NO: 855260 - RNA, 16 nt, Homo sapiens
uuacaucuaucccaga

SEQ ID NO: 855261 - RNA, 17 nt, Homo sapiens
uuacaucuaucccagag

SEQ ID NO: 855262 - RNA, 19 nt, Homo sapiens
uuaccgaggacagccugcc

SEQ ID NO: 855263 - RNA, 23 nt, Homo sapiens
uuaccugaagggguuuucuugau

SEQ ID NO: 855264 - RNA, 15 nt, Homo sapiens
uuacguuuacauucu

SEQ ID NO: 855265 - RNA, 15 nt, Homo sapiens
uuacugacugcuuau

SEQ ID NO: 855266 - RNA, 17 nt, Homo sapiens
uuagauaauguugucaa

SEQ ID NO: 855267 - RNA, 21 nt, Homo sapiens
uuagcauacuagaaucagaua

SEQ ID NO: 855268 - RNA, 21 nt, Homo sapiens
uuagcauguguugcagcuguc

SEQ ID NO: 855269 - RNA, 21 nt, Homo sapiens
uuaguaagugcuuguuuuaca

SEQ ID NO: 855270 - RNA, 15 nt, Homo sapiens
uuagugagacuagac

SEQ ID NO: 855271 - RNA, 10 nt, Homo sapiens
uuaguuccca

SEQ ID NO: 855272 - RNA, 19 nt, Homo sapiens
uuaguucugagauuccaga

SEQ ID NO: 855273 - RNA, 21 nt, Homo sapiens
uuauaauucuugaaugaggca

SEQ ID NO: 855274 - RNA, 18 nt, Homo sapiens
uuauugcuuacuguguua

SEQ ID NO: 855275 - RNA, 22 nt, Homo sapiens
uuauugguguaagguacuuuca

SEQ ID NO: 855276 - RNA, 19 nt, Homo sapiens
uuauuguccuuugauucca

SEQ ID NO: 855277 - RNA, 21 nt, Homo sapiens
uuauuuucagaagcugaugag

SEQ ID NO: 855278 - RNA, 19 nt, Homo sapiens
uucacaugguuacauauca

SEQ ID NO: 855279 - RNA, 14 nt, Homo sapiens
uucaccaagagcca

SEQ ID NO: 855280 - RNA, 12 nt, Homo sapiens
uucacuaccugu

SEQ ID NO: 855281 - RNA, 21 nt, Homo sapiens
uucagaacuguuaaaggucau

SEQ ID NO: 855282 - RNA, 21 nt, Homo sapiens
uucauaagcuuuguaauucag

SEQ ID NO: 855283 - RNA, 12 nt, Homo sapiens
uucauacuuuga

SEQ ID NO: 855284 - RNA, 22 nt, Homo sapiens
uucauagugauagagugcagug

SEQ ID NO: 855285 - RNA, 17 nt, Homo sapiens
uucauauuuuaaacaga

SEQ ID NO: 855286 - RNA, 18 nt, Homo sapiens
uucauauuuuaaacagag

SEQ ID NO: 855287 - RNA, 16 nt, Homo sapiens
uucaucagaacagcug

SEQ ID NO: 855288 - RNA, 16 nt, Homo sapiens
uucaugaagcaagaau

SEQ ID NO: 855289 - RNA, 16 nt, Homo sapiens
uucauuuucagauuca

SEQ ID NO: 855290 - RNA, 15 nt, Homo sapiens
uuccaguucacauuu

SEQ ID NO: 855291 - RNA, 16 nt, Homo sapiens
uuccaugcugacugau

SEQ ID NO: 855292 - RNA, 21 nt, Homo sapiens
uucccaucuccuuucucuggu

SEQ ID NO: 855293 - RNA, 23 nt, Homo sapiens
uucccgguugugagagccuguga

SEQ ID NO: 855294 - RNA, 16 nt, Homo sapiens
uucccuaucugcaaaa

SEQ ID NO: 855295 - RNA, 15 nt, Homo sapiens
uucccuuuucuuucc

SEQ ID NO: 855296 - RNA, 21 nt, Homo sapiens
uuccuaaaccauucaccaaga

SEQ ID NO: 855297 - RNA, 16 nt, Homo sapiens
uuccuaacguuuucua

SEQ ID NO: 855298 - RNA, 21 nt, Homo sapiens
uuccuccuuugcagugucuua

SEQ ID NO: 855299 - RNA, 18 nt, Homo sapiens
uuccugccccaaccacaa

SEQ ID NO: 855300 - RNA, 13 nt, Homo sapiens
uuccuguugucaa

SEQ ID NO: 855301 - RNA, 20 nt, Homo sapiens
uuccuucuggggcuuugcca

SEQ ID NO: 855302 - RNA, 22 nt, Homo sapiens
uuccuuuaaccuuugcuguagu

SEQ ID NO: 855303 - RNA, 17 nt, Homo sapiens
uuccuuucacuggccac

SEQ ID NO: 855304 - RNA, 17 nt, Homo sapiens
uuccuuuccccuucccu

SEQ ID NO: 855305 - RNA, 16 nt, Homo sapiens
uuccuuuccucuggcc

SEQ ID NO: 855306 - RNA, 14 nt, Homo sapiens
uuccuuucuugauu

SEQ ID NO: 855307 - RNA, 17 nt, Homo sapiens
uuccuuuuucuuuccuu

SEQ ID NO: 855308 - RNA, 19 nt, Homo sapiens
uucgugacaauguuuacaa

SEQ ID NO: 855309 - RNA, 15 nt, Homo sapiens
uucuagaagacuaca

SEQ ID NO: 855310 - RNA, 17 nt, Homo sapiens
aaaaaagauacuauuua

SEQ ID NO: 855311 - RNA, 12 nt, Homo sapiens
aaaaaaugacaa

SEQ ID NO: 855312 - RNA, 12 nt, Homo sapiens
aaaaaauuauua

SEQ ID NO: 855313 - RNA, 22 nt, Homo sapiens
aaaaacacugcugaggcuucau

SEQ ID NO: 855314 - RNA, 13 nt, Homo sapiens
aaaaaucugccac

SEQ ID NO: 855315 - RNA, 17 nt, Homo sapiens
aaaaaugcugaacauug

SEQ ID NO: 855316 - RNA, 14 nt, Homo sapiens
aaaaauuaccugua

SEQ ID NO: 855317 - RNA, 17 nt, Homo sapiens
aaaaauuaccuguauaa

SEQ ID NO: 855318 - RNA, 14 nt, Homo sapiens
aaaauuaucaccuu

SEQ ID NO: 855319 - RNA, 21 nt, Homo sapiens
aaaauuaucaccuuugucaga

SEQ ID NO: 855320 - RNA, 15 nt, Homo sapiens
aaaauuguccuccuu

SEQ ID NO: 855321 - RNA, 14 nt, Homo sapiens
aaacaaaaugagcu

SEQ ID NO: 855322 - RNA, 21 nt, Homo sapiens
aaacauuaaaauauaaucucu

SEQ ID NO: 855323 - RNA, 22 nt, Homo sapiens
aaacauuaaaauauaaucucua

SEQ ID NO: 855324 - RNA, 14 nt, Homo sapiens
aaacauugccugau

SEQ ID NO: 855325 - RNA, 18 nt, Homo sapiens
aaaccauucaccaagagc

SEQ ID NO: 855326 - RNA, 12 nt, Homo sapiens
aaacccuucuug

SEQ ID NO: 855327 - RNA, 19 nt, Homo sapiens
aaaccuauuucccuugccu

SEQ ID NO: 855328 - RNA, 21 nt, Homo sapiens
aaaccuuaagaguucuaacca

SEQ ID NO: 855329 - RNA, 19 nt, Homo sapiens
aaaccuuacucugagcuca

SEQ ID NO: 855330 - RNA, 20 nt, Homo sapiens
aaaccuuacucugagcucau

SEQ ID NO: 855331 - RNA, 18 nt, Homo sapiens
aaacgguaauacgugaaa

SEQ ID NO: 855332 - RNA, 20 nt, Homo sapiens
aaacucaucuggaguucuca

SEQ ID NO: 855333 - RNA, 22 nt, Homo sapiens
aaacugauuacguuuacauucu

SEQ ID NO: 855334 - RNA, 14 nt, Homo sapiens
aaacuggcccuguu

SEQ ID NO: 855335 - RNA, 22 nt, Homo sapiens
aaacuggcccuguuucuggucu

SEQ ID NO: 855336 - RNA, 16 nt, Homo sapiens
aaacuuuagugcuaca

SEQ ID NO: 855337 - RNA, 16 nt, Homo sapiens
aaagaaaaaguacaag

SEQ ID NO: 855338 - RNA, 21 nt, Homo sapiens
aaagaauucuuuuuacaucua

SEQ ID NO: 855339 - RNA, 17 nt, Homo sapiens
aaagacauuucaaauaa

SEQ ID NO: 855340 - RNA, 15 nt, Homo sapiens
aaagagaaccaugug

SEQ ID NO: 855341 - RNA, 21 nt, Homo sapiens
aaagagcuccuguaagaggga

SEQ ID NO: 855342 - RNA, 19 nt, Homo sapiens
aaagauaaaaaaacagcuu

SEQ ID NO: 855343 - RNA, 17 nt, Homo sapiens
aaagauguagauuuauu

SEQ ID NO: 855344 - RNA, 17 nt, Homo sapiens
aaagcaaaauaacaaaa

SEQ ID NO: 855345 - RNA, 18 nt, Homo sapiens
aaagcaaaauaacaaaaa

SEQ ID NO: 855346 - RNA, 23 nt, Homo sapiens
aaagcauuuuguaauaauaaaga

SEQ ID NO: 855347 - RNA, 19 nt, Homo sapiens
aaagccaccaacagccacu

SEQ ID NO: 855348 - RNA, 18 nt, Homo sapiens
aaaggaaacaaacucuca

SEQ ID NO: 855349 - RNA, 21 nt, Homo sapiens
aaaggagagagagagagagua

SEQ ID NO: 855350 - RNA, 16 nt, Homo sapiens
aaaggccuccaaagca

SEQ ID NO: 855351 - RNA, 12 nt, Homo sapiens
aaaguaaaagca

SEQ ID NO: 855352 - RNA, 11 nt, Homo sapiens
aaaguauuuac

SEQ ID NO: 855353 - RNA, 19 nt, Homo sapiens
aaaguccagauaccaagca

SEQ ID NO: 855354 - RNA, 17 nt, Homo sapiens
aaagugccuuugcagcu

SEQ ID NO: 855355 - RNA, 19 nt, Homo sapiens
aaaguggcaggacacugca

SEQ ID NO: 855356 - RNA, 21 nt, Homo sapiens
aaaguguaaaucuaaacauaa

SEQ ID NO: 855357 - RNA, 13 nt, Homo sapiens
aaaguuugcugua

SEQ ID NO: 855358 - RNA, 18 nt, Homo sapiens
aaauaaagcacauuccaa

SEQ ID NO: 855359 - RNA, 16 nt, Homo sapiens
aaauaagccaugagaa

SEQ ID NO: 855360 - RNA, 15 nt, Homo sapiens
aaauaauaucucuaa

SEQ ID NO: 855361 - RNA, 23 nt, Homo sapiens
aaauaauugaagagacaauagca

SEQ ID NO: 855362 - RNA, 18 nt, Homo sapiens
aaauacagacuggaugua

SEQ ID NO: 855363 - RNA, 19 nt, Homo sapiens
aaauacaucaaggaguuau

SEQ ID NO: 855364 - RNA, 12 nt, Homo sapiens
aaauacauuccu

SEQ ID NO: 855365 - RNA, 12 nt, Homo sapiens
aaauaccaguuc

SEQ ID NO: 855366 - RNA, 16 nt, Homo sapiens
aaauacggauccugca

SEQ ID NO: 855367 - RNA, 14 nt, Homo sapiens
aaauagacacuuga

SEQ ID NO: 855368 - RNA, 14 nt, Homo sapiens
aaauaucuagccca

SEQ ID NO: 855369 - RNA, 16 nt, Homo sapiens
aaaucagcaaacuuug

SEQ ID NO: 855370 - RNA, 21 nt, Homo sapiens
aaauccccaagaacacaagaa

SEQ ID NO: 855371 - RNA, 15 nt, Homo sapiens
aaaucuaaacauaaa

SEQ ID NO: 855372 - RNA, 17 nt, Homo sapiens
aaaucugcaaacucuaa

SEQ ID NO: 855373 - RNA, 17 nt, Homo sapiens
aaaucugccaccugcac

SEQ ID NO: 855374 - RNA, 18 nt, Homo sapiens
aaaucuuuacuccuguaa

SEQ ID NO: 855375 - RNA, 17 nt, Homo sapiens
aaaugaauuuacagaac

SEQ ID NO: 855376 - RNA, 18 nt, Homo sapiens
aaaugcaaccauuuuuag

SEQ ID NO: 855377 - RNA, 21 nt, Homo sapiens
aaaugcuucuucccacaaaga

SEQ ID NO: 855378 - RNA, 13 nt, Homo sapiens
aaaugguauguca

SEQ ID NO: 855379 - RNA, 19 nt, Homo sapiens
aaauguuauagcugcauuu

SEQ ID NO: 855380 - RNA, 21 nt, Homo sapiens
aaauguuauagcugcauuugu

SEQ ID NO: 855381 - RNA, 20 nt, Homo sapiens
aaauuguuuugcaaauggau

SEQ ID NO: 855382 - RNA, 19 nt, Homo sapiens
aaauuuauuugugauguac

SEQ ID NO: 855383 - RNA, 15 nt, Homo sapiens
aacaacauuccucaa

SEQ ID NO: 855384 - RNA, 17 nt, Homo sapiens
aacaagaagcaauguua

SEQ ID NO: 855385 - RNA, 22 nt, Homo sapiens
aacaagagaaguacuaucuuug

SEQ ID NO: 855386 - RNA, 19 nt, Homo sapiens
aacaauuuugcacuguaga

SEQ ID NO: 855387 - RNA, 22 nt, Homo sapiens
aacacaagaagacccauccuga

SEQ ID NO: 855388 - RNA, 17 nt, Homo sapiens
aacacucuuggggacca

SEQ ID NO: 855389 - RNA, 15 nt, Homo sapiens
aacagaagugacuga

SEQ ID NO: 855390 - RNA, 22 nt, Homo sapiens
aacagaccaucccccacuccuu

SEQ ID NO: 855391 - RNA, 14 nt, Homo sapiens
aacagaguaaucuu

SEQ ID NO: 855392 - RNA, 14 nt, Homo sapiens
aacagauaagucca

SEQ ID NO: 855393 - RNA, 14 nt, Homo sapiens
aacagcaaguguga

SEQ ID NO: 855394 - RNA, 13 nt, Homo sapiens
aacauagccaaaa

SEQ ID NO: 855395 - RNA, 14 nt, Homo sapiens
aacauagccaaaau

SEQ ID NO: 855396 - RNA, 14 nt, Homo sapiens
aaccaaaugugcau

SEQ ID NO: 855397 - RNA, 19 nt, Homo sapiens
aaccacacagcuaagggag

SEQ ID NO: 855398 - RNA, 19 nt, Homo sapiens
aaccacuuguagauuugau

SEQ ID NO: 855399 - RNA, 18 nt, Homo sapiens
aaccauuuuuaggaagcu

SEQ ID NO: 855400 - RNA, 21 nt, Homo sapiens
aaccauuuuuaggaagcuaga

SEQ ID NO: 855401 - RNA, 19 nt, Homo sapiens
aacccugucuccucucugu

SEQ ID NO: 855402 - RNA, 20 nt, Homo sapiens
aaccgaagggacuggaucug

SEQ ID NO: 855403 - RNA, 22 nt, Homo sapiens
aaccgaagggacuggaucugca

SEQ ID NO: 855404 - RNA, 17 nt, Homo sapiens
aaccggccccagagugc

SEQ ID NO: 855405 - RNA, 9 nt, Homo sapiens
aaccuggag

SEQ ID NO: 855406 - RNA, 11 nt, Homo sapiens
aaccugugaag

SEQ ID NO: 855407 - RNA, 17 nt, Homo sapiens
aacgcccagagaacaag

SEQ ID NO: 855408 - RNA, 15 nt, Homo sapiens
aacgcuccucugaaa

SEQ ID NO: 855409 - RNA, 18 nt, Homo sapiens
aacguuccucuccaccug

SEQ ID NO: 855410 - RNA, 18 nt, Homo sapiens
aacguuuucuacuuugaa

SEQ ID NO: 855411 - RNA, 19 nt, Homo sapiens
aacucauccguuugccaau

SEQ ID NO: 855412 - RNA, 23 nt, Homo sapiens
aacuccccauuggugcuaccugg

SEQ ID NO: 855413 - RNA, 21 nt, Homo sapiens
aacuccugccuaugacacaga

SEQ ID NO: 855414 - RNA, 16 nt, Homo sapiens
aacucuaaaagaagaa

SEQ ID NO: 855415 - RNA, 20 nt, Homo sapiens
aacucuaagaccacagaguu

SEQ ID NO: 855416 - RNA, 12 nt, Homo sapiens
aacucuucucau

SEQ ID NO: 855417 - RNA, 20 nt, Homo sapiens
aacugaauagcaaguggcau

SEQ ID NO: 855418 - RNA, 17 nt, Homo sapiens
aacugacccuuccuuca

SEQ ID NO: 855419 - RNA, 14 nt, Homo sapiens
aacugagguuuaca

SEQ ID NO: 855420 - RNA, 15 nt, Homo sapiens
aacuguuguugauaa

SEQ ID NO: 855421 - RNA, 14 nt, Homo sapiens
aacuguuucugcag

SEQ ID NO: 855422 - RNA, 17 nt, Homo sapiens
aagaaauacagacugga

SEQ ID NO: 855423 - RNA, 21 nt, Homo sapiens
aagaaauuaacuuacccugua

SEQ ID NO: 855424 - RNA, 21 nt, Homo sapiens
aagaacugaaaggcuuuucaa

SEQ ID NO: 855425 - RNA, 15 nt, Homo sapiens
aagaaggacuuguuu

SEQ ID NO: 855426 - RNA, 12 nt, Homo sapiens
aagaaucugcuc

SEQ ID NO: 855427 - RNA, 21 nt, Homo sapiens
aagaauggcacucuugggcuu

SEQ ID NO: 855428 - RNA, 20 nt, Homo sapiens
aagacaaaugcaacauuuua

SEQ ID NO: 855429 - RNA, 18 nt, Homo sapiens
aagagaaccaugugcuac

SEQ ID NO: 855430 - RNA, 19 nt, Homo sapiens
aagagacugcuugacaaag

SEQ ID NO: 855431 - RNA, 16 nt, Homo sapiens
aagagccccacucuca

SEQ ID NO: 855432 - RNA, 14 nt, Homo sapiens
aagaggaggcagga

SEQ ID NO: 855433 - RNA, 16 nt, Homo sapiens
aagagucuggggacca

SEQ ID NO: 855434 - RNA, 18 nt, Homo sapiens
aagaguguuuauacagua

SEQ ID NO: 855435 - RNA, 14 nt, Homo sapiens
aagauauggcugcu

SEQ ID NO: 855436 - RNA, 20 nt, Homo sapiens
cuauuucaucagaacagcug

SEQ ID NO: 855437 - RNA, 15 nt, Homo sapiens
cuauuucccuugccu

SEQ ID NO: 855438 - RNA, 16 nt, Homo sapiens
cuauuuuuguaugaaa

SEQ ID NO: 855439 - RNA, 20 nt, Homo sapiens
cuauuuuuuuccuccuuugc

SEQ ID NO: 855440 - RNA, 17 nt, Homo sapiens
cucaaauuuugaguuau

SEQ ID NO: 855441 - RNA, 21 nt, Homo sapiens
cucaaggauccagacucucau

SEQ ID NO: 855442 - RNA, 13 nt, Homo sapiens
cucaaguccauca

SEQ ID NO: 855443 - RNA, 17 nt, Homo sapiens
cucaagugucuaccugg

SEQ ID NO: 855444 - RNA, 19 nt, Homo sapiens
cucaauaaaagaaucugau

SEQ ID NO: 855445 - RNA, 19 nt, Homo sapiens
cucaaucgagugagacaga

SEQ ID NO: 855446 - RNA, 23 nt, Homo sapiens
cucacgcuccuuucugaucuuca

SEQ ID NO: 855447 - RNA, 11 nt, Homo sapiens
cucacucucag

SEQ ID NO: 855448 - RNA, 20 nt, Homo sapiens
cucacuguggugucuguguu

SEQ ID NO: 855449 - RNA, 20 nt, Homo sapiens
cucagauaaauuaugguaaa

SEQ ID NO: 855450 - RNA, 22 nt, Homo sapiens
cucaugcaugcaaauuagacaa

SEQ ID NO: 855451 - RNA, 14 nt, Homo sapiens
cucauucagcaucu

SEQ ID NO: 855452 - RNA, 22 nt, Homo sapiens
cuccaaaguauuguacaaauaa

SEQ ID NO: 855453 - RNA, 17 nt, Homo sapiens
cuccaauacagcaaacc

SEQ ID NO: 855454 - RNA, 13 nt, Homo sapiens
cucccacucccau

SEQ ID NO: 855455 - RNA, 19 nt, Homo sapiens
cucccuccccugcucagaa

SEQ ID NO: 855456 - RNA, 20 nt, Homo sapiens
cucccuggcuacauggucaa

SEQ ID NO: 855457 - RNA, 19 nt, Homo sapiens
cuccggccccaccucguga

SEQ ID NO: 855458 - RNA, 16 nt, Homo sapiens
cuccuaaggggccccu

SEQ ID NO: 855459 - RNA, 15 nt, Homo sapiens
cuccugaucaggaaa

SEQ ID NO: 855460 - RNA, 14 nt, Homo sapiens
cuccugauucuaaa

SEQ ID NO: 855461 - RNA, 13 nt, Homo sapiens
cuccugccaugua

SEQ ID NO: 855462 - RNA, 20 nt, Homo sapiens
cuccugcgucuggauuuuau

SEQ ID NO: 855463 - RNA, 21 nt, Homo sapiens
cuccuuaaaauaaaacacugu

SEQ ID NO: 855464 - RNA, 19 nt, Homo sapiens
cuccuuccuugaacccuaa

SEQ ID NO: 855465 - RNA, 17 nt, Homo sapiens
cuccuuucucugguaca

SEQ ID NO: 855466 - RNA, 16 nt, Homo sapiens
cuccuuugcagugucu

SEQ ID NO: 855467 - RNA, 15 nt, Homo sapiens
cucguccccauugcu

SEQ ID NO: 855468 - RNA, 15 nt, Homo sapiens
cucguuuaaggccua

SEQ ID NO: 855469 - RNA, 19 nt, Homo sapiens
cucuaauugcugccaggau

SEQ ID NO: 855470 - RNA, 16 nt, Homo sapiens
cucuagaggcuggcaa

SEQ ID NO: 855471 - RNA, 19 nt, Homo sapiens
cucuaggacucugcacuga

SEQ ID NO: 855472 - RNA, 14 nt, Homo sapiens
cucuaguacuguga

SEQ ID NO: 855473 - RNA, 23 nt, Homo sapiens
cucucaacaucacauacagcuuc

SEQ ID NO: 855474 - RNA, 15 nt, Homo sapiens
cucucauguacuuuu

SEQ ID NO: 855475 - RNA, 17 nt, Homo sapiens
cucucccagcucugggg

SEQ ID NO: 855476 - RNA, 17 nt, Homo sapiens
cucucguacucucucuc

SEQ ID NO: 855477 - RNA, 14 nt, Homo sapiens
cucucucucuccau

SEQ ID NO: 855478 - RNA, 14 nt, Homo sapiens
cucucuugccaaaa

SEQ ID NO: 855479 - RNA, 17 nt, Homo sapiens
cucugaaggaggccacc

SEQ ID NO: 855480 - RNA, 13 nt, Homo sapiens
cucugacaaagug

SEQ ID NO: 855481 - RNA, 16 nt, Homo sapiens
cucugacuccaagagg

SEQ ID NO: 855482 - RNA, 11 nt, Homo sapiens
cucugcacuga

SEQ ID NO: 855483 - RNA, 12 nt, Homo sapiens
cucugcugcauc

SEQ ID NO: 855484 - RNA, 15 nt, Homo sapiens
cucuggcccagugaa

SEQ ID NO: 855485 - RNA, 18 nt, Homo sapiens
cucuggcuuagggugaua

SEQ ID NO: 855486 - RNA, 12 nt, Homo sapiens
cucugugccacc

SEQ ID NO: 855487 - RNA, 16 nt, Homo sapiens
cucuucauccagggaa

SEQ ID NO: 855488 - RNA, 23 nt, Homo sapiens
cucuugcggaugcuugguacugu

SEQ ID NO: 855489 - RNA, 18 nt, Homo sapiens
cugaaagaaaaaguacaa

SEQ ID NO: 855490 - RNA, 18 nt, Homo sapiens
cugaaagaauaggauuaa

SEQ ID NO: 855491 - RNA, 21 nt, Homo sapiens
cugaauauacagaaguuccau

SEQ ID NO: 855492 - RNA, 20 nt, Homo sapiens
cugaauggaguuaaacuuua

SEQ ID NO: 855493 - RNA, 21 nt, Homo sapiens
cugaauggaguuaaacuuuag

SEQ ID NO: 855494 - RNA, 23 nt, Homo sapiens
cugaaugugccccuggaccuucu

SEQ ID NO: 855495 - RNA, 15 nt, Homo sapiens
cugaccucuaccuuc

SEQ ID NO: 855496 - RNA, 20 nt, Homo sapiens
cugagcucauuuggggacca

SEQ ID NO: 855497 - RNA, 15 nt, Homo sapiens
cugagguuuacauac

SEQ ID NO: 855498 - RNA, 19 nt, Homo sapiens
cugaguauguucauugcca

SEQ ID NO: 855499 - RNA, 20 nt, Homo sapiens
cugaguauguucauugccac

SEQ ID NO: 855500 - RNA, 14 nt, Homo sapiens
cugagugaggaaug

SEQ ID NO: 855501 - RNA, 17 nt, Homo sapiens
cugaguuguuaccccaa

SEQ ID NO: 855502 - RNA, 12 nt, Homo sapiens
cugauaccaaag

SEQ ID NO: 855503 - RNA, 15 nt, Homo sapiens
cugauaccaaagaga

SEQ ID NO: 855504 - RNA, 17 nt, Homo sapiens
cugauauccaugaugcu

SEQ ID NO: 855505 - RNA, 18 nt, Homo sapiens
cugaucaucgaggagcua

SEQ ID NO: 855506 - RNA, 16 nt, Homo sapiens
cugauguucuuccagu

SEQ ID NO: 855507 - RNA, 15 nt, Homo sapiens
cugcaaaaugggaug

SEQ ID NO: 855508 - RNA, 16 nt, Homo sapiens
cugcacugacucugga

SEQ ID NO: 855509 - RNA, 21 nt, Homo sapiens
cugcagagacagacucugaau

SEQ ID NO: 855510 - RNA, 17 nt, Homo sapiens
cugcagcucuacaggug

SEQ ID NO: 855511 - RNA, 22 nt, Homo sapiens
cugcagucccuuucgacuugca

SEQ ID NO: 855512 - RNA, 21 nt, Homo sapiens
cugccaggauugucacuccaa

SEQ ID NO: 855513 - RNA, 17 nt, Homo sapiens
cugccuggcccaugugc

SEQ ID NO: 855514 - RNA, 19 nt, Homo sapiens
cugccugugggcuggggag

SEQ ID NO: 855515 - RNA, 21 nt, Homo sapiens
cugccuuagggccucauuugc

SEQ ID NO: 855516 - RNA, 17 nt, Homo sapiens
cugcggcccugaucucc

SEQ ID NO: 855517 - RNA, 22 nt, Homo sapiens
cugcugaacaaaauuaaacuuc

SEQ ID NO: 855518 - RNA, 21 nt, Homo sapiens
cugcuggacguccagguggag

SEQ ID NO: 855519 - RNA, 20 nt, Homo sapiens
cugcuuaucagugugcaaua

SEQ ID NO: 855520 - RNA, 15 nt, Homo sapiens
cugcuugacaaagga

SEQ ID NO: 855521 - RNA, 20 nt, Homo sapiens
cugcuuuuaaagauauggcu

SEQ ID NO: 855522 - RNA, 20 nt, Homo sapiens
cugcuuuuucucagcccuga

SEQ ID NO: 855523 - RNA, 13 nt, Homo sapiens
cuggaauaagccu

SEQ ID NO: 855524 - RNA, 15 nt, Homo sapiens
cuggacauucugggg

SEQ ID NO: 855525 - RNA, 18 nt, Homo sapiens
cuggaccccaucugugaa

SEQ ID NO: 855526 - RNA, 13 nt, Homo sapiens
cuggagucucucu

SEQ ID NO: 855527 - RNA, 19 nt, Homo sapiens
cuggaugggacaacuguag

SEQ ID NO: 855528 - RNA, 13 nt, Homo sapiens
cuggcaggggauc

SEQ ID NO: 855529 - RNA, 19 nt, Homo sapiens
cuggcccuguuucuggucu

SEQ ID NO: 855530 - RNA, 16 nt, Homo sapiens
cuggccucugccuuug

SEQ ID NO: 855531 - RNA, 18 nt, Homo sapiens
cuggcucccucacucuca

SEQ ID NO: 855532 - RNA, 18 nt, Homo sapiens
cuggcuguuguauuacca

SEQ ID NO: 855533 - RNA, 14 nt, Homo sapiens
cugggcaccccuca

SEQ ID NO: 855534 - RNA, 19 nt, Homo sapiens
cugggcaucucugagcaau

SEQ ID NO: 855535 - RNA, 14 nt, Homo sapiens
cugggcugcucuca

SEQ ID NO: 855536 - RNA, 18 nt, Homo sapiens
cuggggcuggcaccagca

SEQ ID NO: 855537 - RNA, 23 nt, Homo sapiens
cuggucuucgcagccuagauaug

SEQ ID NO: 855538 - RNA, 13 nt, Homo sapiens
cuggucuuugguu

SEQ ID NO: 855539 - RNA, 17 nt, Homo sapiens
cuggugacccagcaucu

SEQ ID NO: 855540 - RNA, 18 nt, Homo sapiens
cuggugaugcgcaguugc

SEQ ID NO: 855541 - RNA, 17 nt, Homo sapiens
cuguaaaugcuccuaga

SEQ ID NO: 855542 - RNA, 17 nt, Homo sapiens
cuguaauucccaaaacu

SEQ ID NO: 855543 - RNA, 12 nt, Homo sapiens
cuguaccacaau

SEQ ID NO: 855544 - RNA, 12 nt, Homo sapiens
cuguagauuuaa

SEQ ID NO: 855545 - RNA, 22 nt, Homo sapiens
cugucaggguuggaaaguccaa

SEQ ID NO: 855546 - RNA, 22 nt, Homo sapiens
cugucuccucucuguuacucag

SEQ ID NO: 855547 - RNA, 18 nt, Homo sapiens
cugucugauccuguccau

SEQ ID NO: 855548 - RNA, 13 nt, Homo sapiens
cugugagcacaua

SEQ ID NO: 855549 - RNA, 16 nt, Homo sapiens
cugugcguggggcucc

SEQ ID NO: 855550 - RNA, 21 nt, Homo sapiens
cuguggagguugcugguacac

SEQ ID NO: 855551 - RNA, 13 nt, Homo sapiens
cuguucaguauug

SEQ ID NO: 855552 - RNA, 23 nt, Homo sapiens
cuguugacucuaguacugugaau

SEQ ID NO: 855553 - RNA, 19 nt, Homo sapiens
cuguugaugggaugauuga

SEQ ID NO: 855554 - RNA, 17 nt, Homo sapiens
cuuaaaacacguuuuaa

SEQ ID NO: 855555 - RNA, 13 nt, Homo sapiens
cuuaaacucuguu

SEQ ID NO: 855556 - RNA, 15 nt, Homo sapiens
cuuaagaguucuaac

SEQ ID NO: 855557 - RNA, 19 nt, Homo sapiens
cuuaagaguucuaaccaug

SEQ ID NO: 855558 - RNA, 12 nt, Homo sapiens
cuuaagucauaa

SEQ ID NO: 855559 - RNA, 23 nt, Homo sapiens
cuuaauggauguaauacauuucu

SEQ ID NO: 855560 - RNA, 23 nt, Homo sapiens
cuuaccuggaaaaacaugcgaug

SEQ ID NO: 855561 - RNA, 15 nt, Homo sapiens
cuuacucugagcuca

SEQ ID NO: 855562 - RNA, 17 nt, Homo sapiens
cuuagagggugauggaa

SEQ ID NO: 855563 - RNA, 20 nt, Homo sapiens
cuuauaagacucacaguaua

SEQ ID NO: 855564 - RNA, 19 nt, Homo sapiens
cuuauagagagcccaaaga

SEQ ID NO: 855565 - RNA, 12 nt, Homo sapiens
cuuauauuguaa

SEQ ID NO: 855566 - RNA, 14 nt, Homo sapiens
cuucauauaaugcc

SEQ ID NO: 855567 - RNA, 13 nt, Homo sapiens
cuucauccaggga

SEQ ID NO: 855568 - RNA, 19 nt, Homo sapiens
cuucccaaaugugugccca

SEQ ID NO: 855569 - RNA, 14 nt, Homo sapiens
cuucccuccaucca

SEQ ID NO: 855570 - RNA, 20 nt, Homo sapiens
cuuccuaucaaaaagauauc

SEQ ID NO: 855571 - RNA, 19 nt, Homo sapiens
cuaucacccaggaaucuca

SEQ ID NO: 855572 - RNA, 21 nt, Homo sapiens
cuaucacccaggaaucucaaa

SEQ ID NO: 855573 - RNA, 13 nt, Homo sapiens
cuaugaaaggcag

SEQ ID NO: 855574 - RNA, 16 nt, Homo sapiens
cuaugucuagcacaug

SEQ ID NO: 855575 - RNA, 15 nt, Homo sapiens
cuauucugagugaaa

SEQ ID NO: 855576 - RNA, 21 nt, Homo sapiens
cuauuuauaaguugaagaaag

SEQ ID NO: 855577 - RNA, 19 nt, Homo sapiens
gccccuggaccuucuggac

SEQ ID NO: 855578 - RNA, 16 nt, Homo sapiens
gcccgcaucagcugcu

SEQ ID NO: 855579 - RNA, 14 nt, Homo sapiens
gcccucugcucuaa

SEQ ID NO: 855580 - RNA, 22 nt, Homo sapiens
gcccugagaauagcauggggcu

SEQ ID NO: 855581 - RNA, 21 nt, Homo sapiens
gccuaauauuuaugacuuuca

SEQ ID NO: 855582 - RNA, 16 nt, Homo sapiens
gccuacaugcuuugug

SEQ ID NO: 855583 - RNA, 13 nt, Homo sapiens
gccuagauaugaa

SEQ ID NO: 855584 - RNA, 22 nt, Homo sapiens
gccuagauaugaagaaucugcu

SEQ ID NO: 855585 - RNA, 12 nt, Homo sapiens
gccuccaaagca

SEQ ID NO: 855586 - RNA, 20 nt, Homo sapiens
gccucccugacgucugccac

SEQ ID NO: 855587 - RNA, 23 nt, Homo sapiens
gccugcucucgaggcagcagugg

SEQ ID NO: 855588 - RNA, 11 nt, Homo sapiens
gccuggcagcc

SEQ ID NO: 855589 - RNA, 16 nt, Homo sapiens
gccuuaauguauuuga

SEQ ID NO: 855590 - RNA, 18 nt, Homo sapiens
gccuucccaaaauggcaa

SEQ ID NO: 855591 - RNA, 15 nt, Homo sapiens
gccuucgugcuccga

SEQ ID NO: 855592 - RNA, 19 nt, Homo sapiens
gccuucugccugcugacca

SEQ ID NO: 855593 - RNA, 17 nt, Homo sapiens
gccuugaugaaauaaca

SEQ ID NO: 855594 - RNA, 13 nt, Homo sapiens
gccuuggggacaa

SEQ ID NO: 855595 - RNA, 20 nt, Homo sapiens
gcgcuguuggggcugcucau

SEQ ID NO: 855596 - RNA, 19 nt, Homo sapiens
gcgggcccuggagcucaag

SEQ ID NO: 855597 - RNA, 15 nt, Homo sapiens
gcguccgaagggaaa

SEQ ID NO: 855598 - RNA, 22 nt, Homo sapiens
gcuaaguggccggaaaacaagc

SEQ ID NO: 855599 - RNA, 23 nt, Homo sapiens
gcuauucugugucaaacaccucu

SEQ ID NO: 855600 - RNA, 20 nt, Homo sapiens
gcucacuguggugucugugu

SEQ ID NO: 855601 - RNA, 17 nt, Homo sapiens
gcucagauuguaauaug

SEQ ID NO: 855602 - RNA, 18 nt, Homo sapiens
gcucagauuguaauaugu

SEQ ID NO: 855603 - RNA, 14 nt, Homo sapiens
gcucagcaaggcca

SEQ ID NO: 855604 - RNA, 19 nt, Homo sapiens
gcucagucgcuagcauuuc

SEQ ID NO: 855605 - RNA, 15 nt, Homo sapiens
gcucccucacucuca

SEQ ID NO: 855606 - RNA, 22 nt, Homo sapiens
gcucucaaaccccugaccucaa

SEQ ID NO: 855607 - RNA, 19 nt, Homo sapiens
gcucuccccacccagaccu

SEQ ID NO: 855608 - RNA, 16 nt, Homo sapiens
gcucuucauccaggga

SEQ ID NO: 855609 - RNA, 23 nt, Homo sapiens
gcugagaaauuguuuugcaaaug

SEQ ID NO: 855610 - RNA, 19 nt, Homo sapiens
gcugagacccuuauuuaaa

SEQ ID NO: 855611 - RNA, 23 nt, Homo sapiens
gcugaggcgccacccuucuucag

SEQ ID NO: 855612 - RNA, 12 nt, Homo sapiens
gcugaguacuca

SEQ ID NO: 855613 - RNA, 13 nt, Homo sapiens
gcugaguacucag

SEQ ID NO: 855614 - RNA, 17 nt, Homo sapiens
gcugcuucaaaggccag

SEQ ID NO: 855615 - RNA, 21 nt, Homo sapiens
gcuggagaggagcccugccuc

SEQ ID NO: 855616 - RNA, 13 nt, Homo sapiens
gcuggcaccagca

SEQ ID NO: 855617 - RNA, 14 nt, Homo sapiens
gcugggcacugcuc

SEQ ID NO: 855618 - RNA, 21 nt, Homo sapiens
gcugguacacaccaaaugagu

SEQ ID NO: 855619 - RNA, 19 nt, Homo sapiens
gcuguuggccucugcaaag

SEQ ID NO: 855620 - RNA, 18 nt, Homo sapiens
gcuucauaaucauggcuc

SEQ ID NO: 855621 - RNA, 21 nt, Homo sapiens
gcuucuccaauacagcaaacc

SEQ ID NO: 855622 - RNA, 17 nt, Homo sapiens
gcuucucuccuaucugu

SEQ ID NO: 855623 - RNA, 14 nt, Homo sapiens
gcuugaagcaaaca

SEQ ID NO: 855624 - RNA, 22 nt, Homo sapiens
gcuugacaaaggagcauugcag

SEQ ID NO: 855625 - RNA, 16 nt, Homo sapiens
gcuuuauuuuuuugaa

SEQ ID NO: 855626 - RNA, 18 nt, Homo sapiens
gcuuucuagaaagaauaa

SEQ ID NO: 855627 - RNA, 15 nt, Homo sapiens
gcuuugucuacuuca

SEQ ID NO: 855628 - RNA, 16 nt, Homo sapiens
ggaaaaacaugcgaug

SEQ ID NO: 855629 - RNA, 16 nt, Homo sapiens
ggaaaucuuuacuccu

SEQ ID NO: 855630 - RNA, 21 nt, Homo sapiens
ggaagaaacggaauagugugg

SEQ ID NO: 855631 - RNA, 13 nt, Homo sapiens
ggaagaauuuacu

SEQ ID NO: 855632 - RNA, 17 nt, Homo sapiens
ggaagacaagucugugg

SEQ ID NO: 855633 - RNA, 15 nt, Homo sapiens
ggaauggcucaggga

SEQ ID NO: 855634 - RNA, 16 nt, Homo sapiens
ggacaaguagccaccu

SEQ ID NO: 855635 - RNA, 18 nt, Homo sapiens
ggacaaucuagcucucca

SEQ ID NO: 855636 - RNA, 19 nt, Homo sapiens
ggacaaucuagcucuccau

SEQ ID NO: 855637 - RNA, 14 nt, Homo sapiens
ggacagucucacca

SEQ ID NO: 855638 - RNA, 15 nt, Homo sapiens
ggaccccagccucaa

SEQ ID NO: 855639 - RNA, 17 nt, Homo sapiens
ggacccugccaggcaca

SEQ ID NO: 855640 - RNA, 12 nt, Homo sapiens
ggacucucugac

SEQ ID NO: 855641 - RNA, 18 nt, Homo sapiens
ggacucucugacaaagug

SEQ ID NO: 855642 - RNA, 16 nt, Homo sapiens
ggagaaaucacagaga

SEQ ID NO: 855643 - RNA, 15 nt, Homo sapiens
ggagagcccucaguc

SEQ ID NO: 855644 - RNA, 18 nt, Homo sapiens
ggagaguuaaaaugaccu

SEQ ID NO: 855645 - RNA, 19 nt, Homo sapiens
ggagccaacugucagggag

SEQ ID NO: 855646 - RNA, 15 nt, Homo sapiens
ggagcucugaguucc

SEQ ID NO: 855647 - RNA, 24 nt, Homo sapiens
ggaggagaaagcucucuauaccaa

SEQ ID NO: 855648 - RNA, 18 nt, Homo sapiens
ggaggaucucuaaccccu

SEQ ID NO: 855649 - RNA, 19 nt, Homo sapiens
ggauccugcacugacucug

SEQ ID NO: 855650 - RNA, 13 nt, Homo sapiens
ggaugugauugcc

SEQ ID NO: 855651 - RNA, 14 nt, Homo sapiens
ggauuucucuagag

SEQ ID NO: 855652 - RNA, 15 nt, Homo sapiens
ggauuucucuuucuc

SEQ ID NO: 855653 - RNA, 17 nt, Homo sapiens
ggcaauaaaagcccagg

SEQ ID NO: 855654 - RNA, 23 nt, Homo sapiens
ggcaauaaagugagacccuguca

SEQ ID NO: 855655 - RNA, 12 nt, Homo sapiens
ggcaaugggcua

SEQ ID NO: 855656 - RNA, 22 nt, Homo sapiens
ggcaauuuuuguauccaaggaa

SEQ ID NO: 855657 - RNA, 17 nt, Homo sapiens
ggcacaaauacauuccu

SEQ ID NO: 855658 - RNA, 13 nt, Homo sapiens
ggcagagaggguc

SEQ ID NO: 855659 - RNA, 19 nt, Homo sapiens
ggcagccucuggaauggcu

SEQ ID NO: 855660 - RNA, 12 nt, Homo sapiens
ggcagcuccuca

SEQ ID NO: 855661 - RNA, 16 nt, Homo sapiens
ggcaggagacugugga

SEQ ID NO: 855662 - RNA, 16 nt, Homo sapiens
ggcaggcacugccugc

SEQ ID NO: 855663 - RNA, 14 nt, Homo sapiens
ggcaggccagggga

SEQ ID NO: 855664 - RNA, 23 nt, Homo sapiens
ggcaguucgaccagccagggaaa

SEQ ID NO: 855665 - RNA, 22 nt, Homo sapiens
ggcaguuugaggauuaguuuag

SEQ ID NO: 855666 - RNA, 19 nt, Homo sapiens
ggcauaauuuuucuuuauu

SEQ ID NO: 855667 - RNA, 18 nt, Homo sapiens
ggcaucucucugggaugc

SEQ ID NO: 855668 - RNA, 17 nt, Homo sapiens
ggcaucucugagcaauu

SEQ ID NO: 855669 - RNA, 13 nt, Homo sapiens
ggccaaugggcua

SEQ ID NO: 855670 - RNA, 17 nt, Homo sapiens
ggccaggccuuggggac

SEQ ID NO: 855671 - RNA, 15 nt, Homo sapiens
ggcccaccuggaauc

SEQ ID NO: 855672 - RNA, 19 nt, Homo sapiens
ggcccaugugcccacuguc

SEQ ID NO: 855673 - RNA, 22 nt, Homo sapiens
ggccccaccuggcccucucuga

SEQ ID NO: 855674 - RNA, 19 nt, Homo sapiens
ggcccccggggaggggcca

SEQ ID NO: 855675 - RNA, 15 nt, Homo sapiens
ggccccgucucaggu

SEQ ID NO: 855676 - RNA, 21 nt, Homo sapiens
ggcccugggccuccaccucug

SEQ ID NO: 855677 - RNA, 13 nt, Homo sapiens
ggccucaucucag

SEQ ID NO: 855678 - RNA, 15 nt, Homo sapiens
ggccuggcucccuca

SEQ ID NO: 855679 - RNA, 22 nt, Homo sapiens
ggccuugaugaaauaacacagc

SEQ ID NO: 855680 - RNA, 19 nt, Homo sapiens
ggcgaaagaaaacucuauu

SEQ ID NO: 855681 - RNA, 21 nt, Homo sapiens
ggcgaaucauuuguucaaagc

SEQ ID NO: 855682 - RNA, 19 nt, Homo sapiens
ggcucagauuguaauaugu

SEQ ID NO: 855683 - RNA, 16 nt, Homo sapiens
ggcucccucacucuca

SEQ ID NO: 855684 - RNA, 21 nt, Homo sapiens
ggcucgccauguuucugguga

SEQ ID NO: 855685 - RNA, 16 nt, Homo sapiens
ggcucugggcggucca

SEQ ID NO: 855686 - RNA, 18 nt, Homo sapiens
ggcucuuggcccucccac

SEQ ID NO: 855687 - RNA, 13 nt, Homo sapiens
ggcugaagugcau

SEQ ID NO: 855688 - RNA, 18 nt, Homo sapiens
ggcugcagggcuggguca

SEQ ID NO: 855689 - RNA, 16 nt, Homo sapiens
ggcugcggcuugccca

SEQ ID NO: 855690 - RNA, 14 nt, Homo sapiens
ggcuggagugcagu

SEQ ID NO: 855691 - RNA, 20 nt, Homo sapiens
ggcuggccagccaccacuga

SEQ ID NO: 855692 - RNA, 18 nt, Homo sapiens
ggcuucccaaaugugugc

SEQ ID NO: 855693 - RNA, 21 nt, Homo sapiens
ggcuucuugcuuacaggaaug

SEQ ID NO: 855694 - RNA, 14 nt, Homo sapiens
cuuccuccaauagu

SEQ ID NO: 855695 - RNA, 14 nt, Homo sapiens
cuuccucugcugca

SEQ ID NO: 855696 - RNA, 11 nt, Homo sapiens
cuuccuuucau

SEQ ID NO: 855697 - RNA, 12 nt, Homo sapiens
cuuccuuucauu

SEQ ID NO: 855698 - RNA, 18 nt, Homo sapiens
cuucgucugguuccucaa

SEQ ID NO: 855699 - RNA, 20 nt, Homo sapiens
cuucuaaagaaacugcucca

SEQ ID NO: 855700 - RNA, 15 nt, Homo sapiens
cuucuauacauguuu

SEQ ID NO: 855701 - RNA, 16 nt, Homo sapiens
cuucucacaggcccaa

SEQ ID NO: 855702 - RNA, 14 nt, Homo sapiens
cuucucauuacuug

SEQ ID NO: 855703 - RNA, 17 nt, Homo sapiens
cuucuccaauacagcaa

SEQ ID NO: 855704 - RNA, 16 nt, Homo sapiens
cuucugcguaagaaag

SEQ ID NO: 855705 - RNA, 15 nt, Homo sapiens
cuucuggaaaugggg

SEQ ID NO: 855706 - RNA, 13 nt, Homo sapiens
cuucuuccaggga

SEQ ID NO: 855707 - RNA, 19 nt, Homo sapiens
cuucuugggacugcuguga

SEQ ID NO: 855708 - RNA, 15 nt, Homo sapiens
cuugaacccuaauaa

SEQ ID NO: 855709 - RNA, 21 nt, Homo sapiens
cuugagagaggccacacuaca

SEQ ID NO: 855710 - RNA, 21 nt, Homo sapiens
cuuggaaaaaauaauuauuca

SEQ ID NO: 855711 - RNA, 18 nt, Homo sapiens
cuuggagcuaaaacuggc

SEQ ID NO: 855712 - RNA, 16 nt, Homo sapiens
cuuggagugcuucuga

SEQ ID NO: 855713 - RNA, 16 nt, Homo sapiens
cuuggccuuacuguau

SEQ ID NO: 855714 - RNA, 23 nt, Homo sapiens
cuuguaaacauugccugauuugu

SEQ ID NO: 855715 - RNA, 13 nt, Homo sapiens
cuuguauuccuaa

SEQ ID NO: 855716 - RNA, 19 nt, Homo sapiens
cuuguccaaguuguuucau

SEQ ID NO: 855717 - RNA, 16 nt, Homo sapiens
cuuuaaaaaagcauag

SEQ ID NO: 855718 - RNA, 20 nt, Homo sapiens
cuuuaaugauaugcuuguaa

SEQ ID NO: 855719 - RNA, 19 nt, Homo sapiens
cuuuacuccuguaagcaag

SEQ ID NO: 855720 - RNA, 21 nt, Homo sapiens
cuuuagugcuacagaaaagaa

SEQ ID NO: 855721 - RNA, 13 nt, Homo sapiens
cuuuauauuuccc

SEQ ID NO: 855722 - RNA, 16 nt, Homo sapiens
cuuuaugcccuugccu

SEQ ID NO: 855723 - RNA, 16 nt, Homo sapiens
cuuucagcugcugcuu

SEQ ID NO: 855724 - RNA, 21 nt, Homo sapiens
cuuucauguaaaaagugcagu

SEQ ID NO: 855725 - RNA, 19 nt, Homo sapiens
cuuucauugcuguugucuc

SEQ ID NO: 855726 - RNA, 17 nt, Homo sapiens
cuuucccugauccugca

SEQ ID NO: 855727 - RNA, 14 nt, Homo sapiens
cuuucuaaugggcu

SEQ ID NO: 855728 - RNA, 14 nt, Homo sapiens
cuuucuacuuccaa

SEQ ID NO: 855729 - RNA, 16 nt, Homo sapiens
cuuucuauucuuggaa

SEQ ID NO: 855730 - RNA, 15 nt, Homo sapiens
cuuucuccauucugu

SEQ ID NO: 855731 - RNA, 17 nt, Homo sapiens
cuuucugaucuucacua

SEQ ID NO: 855732 - RNA, 14 nt, Homo sapiens
cuuugcagugucuu

SEQ ID NO: 855733 - RNA, 11 nt, Homo sapiens
cuuugcugcuu

SEQ ID NO: 855734 - RNA, 16 nt, Homo sapiens
cuuuggcucaguucau

SEQ ID NO: 855735 - RNA, 20 nt, Homo sapiens
cuuugguuauuucugugcaa

SEQ ID NO: 855736 - RNA, 20 nt, Homo sapiens
cuuugugaacaagucccugu

SEQ ID NO: 855737 - RNA, 21 nt, Homo sapiens
cuuuuaaagacuugcacaaau

SEQ ID NO: 855738 - RNA, 20 nt, Homo sapiens
cuuuucuuugcuagcacaau

SEQ ID NO: 855739 - RNA, 14 nt, Homo sapiens
cuuuugccuuucaa

SEQ ID NO: 855740 - RNA, 21 nt, Homo sapiens
cuuuugguuaugaauacuuug

SEQ ID NO: 855741 - RNA, 23 nt, Homo sapiens
cuuuuguaguguguuuucauaac

SEQ ID NO: 855742 - RNA, 20 nt, Homo sapiens
cuuuuuuaaucuacuuuugc

SEQ ID NO: 855743 - RNA, 22 nt, Homo sapiens
gaaaaacccguaagauuccuuu

SEQ ID NO: 855744 - RNA, 24 nt, Homo sapiens
gaaaaccuggagcagcugcugaaa

SEQ ID NO: 855745 - RNA, 21 nt, Homo sapiens
gaaaaguuugguaaugggaua

SEQ ID NO: 855746 - RNA, 16 nt, Homo sapiens
gaaaauauuuuguuaa

SEQ ID NO: 855747 - RNA, 16 nt, Homo sapiens
gaaaaugggacauuag

SEQ ID NO: 855748 - RNA, 15 nt, Homo sapiens
gaaacauguugccaa

SEQ ID NO: 855749 - RNA, 14 nt, Homo sapiens
gaaacauucacuuu

SEQ ID NO: 855750 - RNA, 21 nt, Homo sapiens
gaaacuaacuggugugaguca

SEQ ID NO: 855751 - RNA, 23 nt, Homo sapiens
gaaacuccagaugccacaaugga

SEQ ID NO: 855752 - RNA, 12 nt, Homo sapiens
gaaacucccacc

SEQ ID NO: 855753 - RNA, 21 nt, Homo sapiens
gaaagcucucuauaccaaaga

SEQ ID NO: 855754 - RNA, 19 nt, Homo sapiens
gaaagugagcccccaagau

SEQ ID NO: 855755 - RNA, 18 nt, Homo sapiens
gaaaguuggaauaugugg

SEQ ID NO: 855756 - RNA, 13 nt, Homo sapiens
gaaauaaacauaa

SEQ ID NO: 855757 - RNA, 15 nt, Homo sapiens
gaaauaaacauaaga

SEQ ID NO: 855758 - RNA, 16 nt, Homo sapiens
gaaauaaaguguguug

SEQ ID NO: 855759 - RNA, 20 nt, Homo sapiens
gaaauaaugugaaugcgagg

SEQ ID NO: 855760 - RNA, 19 nt, Homo sapiens
gaaauaccaguucugggca

SEQ ID NO: 855761 - RNA, 20 nt, Homo sapiens
gaaauaccaguucugggcaa

SEQ ID NO: 855762 - RNA, 16 nt, Homo sapiens
gaaauaugcacugcuc

SEQ ID NO: 855763 - RNA, 17 nt, Homo sapiens
gaaaucagcaaacuuug

SEQ ID NO: 855764 - RNA, 15 nt, Homo sapiens
gaaaucagcaggacg

SEQ ID NO: 855765 - RNA, 16 nt, Homo sapiens
gaaaucuuaagucaua

SEQ ID NO: 855766 - RNA, 18 nt, Homo sapiens
gaacaaaagaagcagcaa

SEQ ID NO: 855767 - RNA, 21 nt, Homo sapiens
gaacaaccaaaugugcauuga

SEQ ID NO: 855768 - RNA, 21 nt, Homo sapiens
gaacaagaagguggaaggcag

SEQ ID NO: 855769 - RNA, 18 nt, Homo sapiens
gaacaauuaaaauauucu

SEQ ID NO: 855770 - RNA, 17 nt, Homo sapiens
gaacaguuuacuuggaa

SEQ ID NO: 855771 - RNA, 18 nt, Homo sapiens
gaacauugcauauaacuu

SEQ ID NO: 855772 - RNA, 14 nt, Homo sapiens
gaaccucucaggau

SEQ ID NO: 855773 - RNA, 13 nt, Homo sapiens
gaacucuaucugu

SEQ ID NO: 855774 - RNA, 18 nt, Homo sapiens
gaacucuccuuuugugcu

SEQ ID NO: 855775 - RNA, 17 nt, Homo sapiens
gaacucuugacagcuau

SEQ ID NO: 855776 - RNA, 15 nt, Homo sapiens
gaacugagcacaggg

SEQ ID NO: 855777 - RNA, 13 nt, Homo sapiens
gaacugggcacca

SEQ ID NO: 855778 - RNA, 19 nt, Homo sapiens
gaacugguaaguuuuugca

SEQ ID NO: 855779 - RNA, 15 nt, Homo sapiens
gaacugugaauugug

SEQ ID NO: 855780 - RNA, 23 nt, Homo sapiens
gaacuguuaaaggucauaugcac

SEQ ID NO: 855781 - RNA, 16 nt, Homo sapiens
gaacuuguugcugauu

SEQ ID NO: 855782 - RNA, 16 nt, Homo sapiens
gaagaaacagcuauga

SEQ ID NO: 855783 - RNA, 14 nt, Homo sapiens
gaagaaucugcucu

SEQ ID NO: 855784 - RNA, 14 nt, Homo sapiens
gaagauacuuugua

SEQ ID NO: 855785 - RNA, 20 nt, Homo sapiens
gaagcugaggcccauggcca

SEQ ID NO: 855786 - RNA, 17 nt, Homo sapiens
gaagcuuguaucugaua

SEQ ID NO: 855787 - RNA, 17 nt, Homo sapiens
gaaggaaggcuuugaaa

SEQ ID NO: 855788 - RNA, 12 nt, Homo sapiens
gaaggaggccac

SEQ ID NO: 855789 - RNA, 15 nt, Homo sapiens
gaaggggacugccac

SEQ ID NO: 855790 - RNA, 18 nt, Homo sapiens
gaaggggacugccaccuc

SEQ ID NO: 855791 - RNA, 15 nt, Homo sapiens
gaagucacugucaga

SEQ ID NO: 855792 - RNA, 19 nt, Homo sapiens
gaaguggugacauuuugca

SEQ ID NO: 855793 - RNA, 21 nt, Homo sapiens
gaaguuacuguuacuugauaa

SEQ ID NO: 855794 - RNA, 14 nt, Homo sapiens
gaauaaagugcaaa

SEQ ID NO: 855795 - RNA, 19 nt, Homo sapiens
gaauaaugucuagauuuug

SEQ ID NO: 855796 - RNA, 21 nt, Homo sapiens
gaauaaugucuagauuuugaa

SEQ ID NO: 855797 - RNA, 14 nt, Homo sapiens
gaauacuugaacca

SEQ ID NO: 855798 - RNA, 13 nt, Homo sapiens
gaauagcuuuaau

SEQ ID NO: 855799 - RNA, 21 nt, Homo sapiens
gaauaugauuaaaaauaucaa

SEQ ID NO: 855800 - RNA, 22 nt, Homo sapiens
gaauaugauuaaaaauaucaaa

SEQ ID NO: 855801 - RNA, 23 nt, Homo sapiens
gaauauucuuuuuauauucugug

SEQ ID NO: 855802 - RNA, 23 nt, Homo sapiens
gaaucaagaggacaaucuagcuc

SEQ ID NO: 855803 - RNA, 14 nt, Homo sapiens
gaaucuaucaccca

SEQ ID NO: 855804 - RNA, 16 nt, Homo sapiens
gaaucugauaccaaag

SEQ ID NO: 855805 - RNA, 17 nt, Homo sapiens
gaaucugauaccaaaga

SEQ ID NO: 855806 - RNA, 23 nt, Homo sapiens
gaaucuggaccccaucugugaau

SEQ ID NO: 855807 - RNA, 18 nt, Homo sapiens
gaaugagguaggcacaaa

SEQ ID NO: 855808 - RNA, 13 nt, Homo sapiens
gaauggcucaggg

SEQ ID NO: 855809 - RNA, 21 nt, Homo sapiens
gaaugucuuuggcucaguuca

SEQ ID NO: 855810 - RNA, 23 nt, Homo sapiens
gaaugucuuuggcucaguucauu

SEQ ID NO: 855811 - RNA, 14 nt, Homo sapiens
gaauuaaaacuuug

SEQ ID NO: 855812 - RNA, 16 nt, Homo sapiens
gaauuuaaucuuugag

SEQ ID NO: 855813 - RNA, 22 nt, Homo sapiens
gaauuuacuuuggaaaguagaa

SEQ ID NO: 855814 - RNA, 20 nt, Homo sapiens
gacaaccaaguaugaaucua

SEQ ID NO: 855815 - RNA, 18 nt, Homo sapiens
gacaagucuguggcuugg

SEQ ID NO: 855816 - RNA, 14 nt, Homo sapiens
gacaaucuagcucu

SEQ ID NO: 855817 - RNA, 11 nt, Homo sapiens
gacagcaaaca

SEQ ID NO: 855818 - RNA, 23 nt, Homo sapiens
gacagcugccgcccggugccacc

SEQ ID NO: 855819 - RNA, 18 nt, Homo sapiens
gacaucaagcucaaggca

SEQ ID NO: 855820 - RNA, 16 nt, Homo sapiens
gacauuaaaauaacua

SEQ ID NO: 855821 - RNA, 13 nt, Homo sapiens
gacauuagcauug

SEQ ID NO: 855822 - RNA, 21 nt, Homo sapiens
gaccaugaggccuccugccau

SEQ ID NO: 855823 - RNA, 20 nt, Homo sapiens
gacccauccugaacugggau

SEQ ID NO: 855824 - RNA, 16 nt, Homo sapiens
gaccccaucugugaau

SEQ ID NO: 855825 - RNA, 16 nt, Homo sapiens
gacccuagaugugcuc

SEQ ID NO: 855826 - RNA, 17 nt, Homo sapiens
gaccugacuuuuagcca

SEQ ID NO: 855827 - RNA, 19 nt, Homo sapiens
gaccuggagcaauaaaaga

SEQ ID NO: 855828 - RNA, 21 nt, Homo sapiens
gaccuguaucaaacugcuuuu

SEQ ID NO: 855829 - RNA, 18 nt, Homo sapiens
gacggaacaguguggaag

SEQ ID NO: 855830 - RNA, 13 nt, Homo sapiens
gacguccaggugg

SEQ ID NO: 855831 - RNA, 12 nt, Homo sapiens
gacgucugccac

SEQ ID NO: 855832 - RNA, 18 nt, Homo sapiens
gacuagacauaguaccga

SEQ ID NO: 855833 - RNA, 23 nt, Homo sapiens
gacuaugacggugacucuuggca

SEQ ID NO: 855834 - RNA, 19 nt, Homo sapiens
gacuccacugcgccuggga

SEQ ID NO: 855835 - RNA, 11 nt, Homo sapiens
gacucucugac

SEQ ID NO: 855836 - RNA, 18 nt, Homo sapiens
gacucugucuggccaggg

SEQ ID NO: 855837 - RNA, 19 nt, Homo sapiens
gacugaauucaaauauucu

SEQ ID NO: 855838 - RNA, 22 nt, Homo sapiens
gacugaugguuaaauaauguga

SEQ ID NO: 855839 - RNA, 16 nt, Homo sapiens
gacuuaacauagccaa

SEQ ID NO: 855840 - RNA, 18 nt, Homo sapiens
gacuuaacauagccaaaa

SEQ ID NO: 855841 - RNA, 15 nt, Homo sapiens
gacuucuuccaggga

SEQ ID NO: 855842 - RNA, 16 nt, Homo sapiens
gacuuguucuugauag

SEQ ID NO: 855843 - RNA, 15 nt, Homo sapiens
gacuuuauugcaucu

SEQ ID NO: 855844 - RNA, 18 nt, Homo sapiens
gacuuucuguguaccacu

SEQ ID NO: 855845 - RNA, 17 nt, Homo sapiens
gacuuuuuuuaaaaaga

SEQ ID NO: 855846 - RNA, 14 nt, Homo sapiens
gagaaauaaacaua

SEQ ID NO: 855847 - RNA, 15 nt, Homo sapiens
gagacaggcagguga

SEQ ID NO: 855848 - RNA, 20 nt, Homo sapiens
gagaccuggguugugcugac

SEQ ID NO: 855849 - RNA, 20 nt, Homo sapiens
gagaccuguaucaaacugcu

SEQ ID NO: 855850 - RNA, 19 nt, Homo sapiens
gagacugcuugacaaagga

SEQ ID NO: 855851 - RNA, 20 nt, Homo sapiens
gagagggucacugggggaca

SEQ ID NO: 855852 - RNA, 15 nt, Homo sapiens
gagaguaagcacuua

SEQ ID NO: 855853 - RNA, 23 nt, Homo sapiens
gagcccagaaaagguacacuuug

SEQ ID NO: 855854 - RNA, 18 nt, Homo sapiens
gagccuggaacugacccu

SEQ ID NO: 855855 - RNA, 19 nt, Homo sapiens
gagcguuagaggggccagc

SEQ ID NO: 855856 - RNA, 14 nt, Homo sapiens
gagcuaaaacuggc

SEQ ID NO: 855857 - RNA, 16 nt, Homo sapiens
gagcuagaacauucca

SEQ ID NO: 855858 - RNA, 17 nt, Homo sapiens
gagcucauuuggggacc

SEQ ID NO: 855859 - RNA, 18 nt, Homo sapiens
gagcucauuuggggacca

SEQ ID NO: 855860 - RNA, 23 nt, Homo sapiens
gaggaaucaugaaaaaugaucuc

SEQ ID NO: 855861 - RNA, 18 nt, Homo sapiens
gaggcagcacgugcacaa

SEQ ID NO: 855862 - RNA, 15 nt, Homo sapiens
gaggccacacccaga

SEQ ID NO: 855863 - RNA, 22 nt, Homo sapiens
gaggcccagcgcggacaucccc

SEQ ID NO: 855864 - RNA, 18 nt, Homo sapiens
gaggccuccggacuccuc

SEQ ID NO: 855865 - RNA, 22 nt, Homo sapiens
gaggcuucauaaucauggcucu

SEQ ID NO: 855866 - RNA, 15 nt, Homo sapiens
gagggccucaucuca

SEQ ID NO: 855867 - RNA, 18 nt, Homo sapiens
gagguaggcacaaauaca

SEQ ID NO: 855868 - RNA, 20 nt, Homo sapiens
gagguaggcacaaauacauu

SEQ ID NO: 855869 - RNA, 15 nt, Homo sapiens
gaggugcaugccuaa

SEQ ID NO: 855870 - RNA, 16 nt, Homo sapiens
gaggugcaugccuaau

SEQ ID NO: 855871 - RNA, 18 nt, Homo sapiens
gagguugcugguacacac

SEQ ID NO: 855872 - RNA, 18 nt, Homo sapiens
gaguaggaguuugcuaag

SEQ ID NO: 855873 - RNA, 18 nt, Homo sapiens
gagucuuucucacugccu

SEQ ID NO: 855874 - RNA, 20 nt, Homo sapiens
gagugccuucauacacugua

SEQ ID NO: 855875 - RNA, 16 nt, Homo sapiens
gauaaaaaaacagcuu

SEQ ID NO: 855876 - RNA, 21 nt, Homo sapiens
gauacuuagaccaaaagcaac

SEQ ID NO: 855877 - RNA, 14 nt, Homo sapiens
gauauaaacagcuu

SEQ ID NO: 855878 - RNA, 13 nt, Homo sapiens
gauaucaaaggca

SEQ ID NO: 855879 - RNA, 21 nt, Homo sapiens
gauaucuauuugaaaguucuc

SEQ ID NO: 855880 - RNA, 17 nt, Homo sapiens
gauaugaagaaucugcu

SEQ ID NO: 855881 - RNA, 16 nt, Homo sapiens
gauauuaauaauucca

SEQ ID NO: 855882 - RNA, 18 nt, Homo sapiens
gauauucaaauggacaaa

SEQ ID NO: 855883 - RNA, 19 nt, Homo sapiens
gaucagauaauuaugcuuu

SEQ ID NO: 855884 - RNA, 22 nt, Homo sapiens
gaucagccuugagagaggccac

SEQ ID NO: 855885 - RNA, 16 nt, Homo sapiens
gauccagcucaaggga

SEQ ID NO: 855886 - RNA, 15 nt, Homo sapiens
gauccaguugcacua

SEQ ID NO: 855887 - RNA, 17 nt, Homo sapiens
gaucccacuuuugccag

SEQ ID NO: 855888 - RNA, 23 nt, Homo sapiens
gaugaaacaaccguauaccugag

SEQ ID NO: 855889 - RNA, 23 nt, Homo sapiens
gaugauauggagguucaaugaga

SEQ ID NO: 855890 - RNA, 22 nt, Homo sapiens
gaugcuaugauguuaguuuucc

SEQ ID NO: 855891 - RNA, 16 nt, Homo sapiens
gaugucaagugucagu

SEQ ID NO: 855892 - RNA, 16 nt, Homo sapiens
gaugugauugccucaa

SEQ ID NO: 855893 - RNA, 12 nt, Homo sapiens
gaugugccuaaa

SEQ ID NO: 855894 - RNA, 13 nt, Homo sapiens
gaugugccuaaau

SEQ ID NO: 855895 - RNA, 14 nt, Homo sapiens
gauuaaugaucaua

SEQ ID NO: 855896 - RNA, 15 nt, Homo sapiens
gauucagaaccaaga

SEQ ID NO: 855897 - RNA, 20 nt, Homo sapiens
gauuuucuuccuccaauagu

SEQ ID NO: 855898 - RNA, 21 nt, Homo sapiens
gauuuuuuuuuuuugguaaca

SEQ ID NO: 855899 - RNA, 23 nt, Homo sapiens
gcaaaccuauuucccuugccuca

SEQ ID NO: 855900 - RNA, 19 nt, Homo sapiens
gcaaauccgaaaucagcag

SEQ ID NO: 855901 - RNA, 23 nt, Homo sapiens
gcaacaauucucccgggacucug

SEQ ID NO: 855902 - RNA, 14 nt, Homo sapiens
gcaacuuccuuuga

SEQ ID NO: 855903 - RNA, 19 nt, Homo sapiens
gcaauaaaagacaaaugca

SEQ ID NO: 855904 - RNA, 19 nt, Homo sapiens
gcaauaacaguaguguuac

SEQ ID NO: 855905 - RNA, 16 nt, Homo sapiens
gcaaucacugaucuca

SEQ ID NO: 855906 - RNA, 19 nt, Homo sapiens
gcacaaauacggauccugc

SEQ ID NO: 855907 - RNA, 16 nt, Homo sapiens
gcacagggggccucca

SEQ ID NO: 855908 - RNA, 13 nt, Homo sapiens
gcaccagcaggca

SEQ ID NO: 855909 - RNA, 19 nt, Homo sapiens
gcaccauacucaugcaugc

SEQ ID NO: 855910 - RNA, 15 nt, Homo sapiens
gcacugacucuggaa

SEQ ID NO: 855911 - RNA, 22 nt, Homo sapiens
gcagaacagcuucauguuccca

SEQ ID NO: 855912 - RNA, 17 nt, Homo sapiens
gcagaacuucccuccau

SEQ ID NO: 855913 - RNA, 23 nt, Homo sapiens
gcagacaucaagcucaaggcaau

SEQ ID NO: 855914 - RNA, 15 nt, Homo sapiens
gcagcacccauccac

SEQ ID NO: 855915 - RNA, 21 nt, Homo sapiens
gcagcaggggccaagcaggca

SEQ ID NO: 855916 - RNA, 16 nt, Homo sapiens
gcaggaacucuaagac

SEQ ID NO: 855917 - RNA, 16 nt, Homo sapiens
gcaggagggacagucu

SEQ ID NO: 855918 - RNA, 15 nt, Homo sapiens
gcaggccccagucuc

SEQ ID NO: 855919 - RNA, 22 nt, Homo sapiens
gcaggggaagcucucacucugu

SEQ ID NO: 855920 - RNA, 21 nt, Homo sapiens
gcagguuuggacuuggacuag

SEQ ID NO: 855921 - RNA, 17 nt, Homo sapiens
gcagucagguccaugug

SEQ ID NO: 855922 - RNA, 17 nt, Homo sapiens
gcaguuaugugaccuca

SEQ ID NO: 855923 - RNA, 22 nt, Homo sapiens
gcaguucgaccagccagggaaa

SEQ ID NO: 855924 - RNA, 13 nt, Homo sapiens
gcauaaagcaugu

SEQ ID NO: 855925 - RNA, 19 nt, Homo sapiens
gcauaaagcauguuucauu

SEQ ID NO: 855926 - RNA, 14 nt, Homo sapiens
gcauauaacuuaua

SEQ ID NO: 855927 - RNA, 14 nt, Homo sapiens
gcauauccuuuuag

SEQ ID NO: 855928 - RNA, 17 nt, Homo sapiens
gcaucagcugcucagau

SEQ ID NO: 855929 - RNA, 23 nt, Homo sapiens
gcaucccgcagauggcuggaaua

SEQ ID NO: 855930 - RNA, 20 nt, Homo sapiens
gcaucucacagcuaugcaaa

SEQ ID NO: 855931 - RNA, 15 nt, Homo sapiens
gcaucucugagcaau

SEQ ID NO: 855932 - RNA, 16 nt, Homo sapiens
gcaugaaggaugccaa

SEQ ID NO: 855933 - RNA, 15 nt, Homo sapiens
gcauggagaaugcac

SEQ ID NO: 855934 - RNA, 13 nt, Homo sapiens
gcauggaugaaua

SEQ ID NO: 855935 - RNA, 22 nt, Homo sapiens
gcauguaguuaacaauuuugca

SEQ ID NO: 855936 - RNA, 13 nt, Homo sapiens
gcauuauguacua

SEQ ID NO: 855937 - RNA, 19 nt, Homo sapiens
gcauuauguacuacaugac

SEQ ID NO: 855938 - RNA, 17 nt, Homo sapiens
gcauugaauacucugaa

SEQ ID NO: 855939 - RNA, 19 nt, Homo sapiens
gcauugcagucacuuugac

SEQ ID NO: 855940 - RNA, 18 nt, Homo sapiens
gcauuguaaaagcauuuu

SEQ ID NO: 855941 - RNA, 16 nt, Homo sapiens
gcauuuuuuaccacaa

SEQ ID NO: 855942 - RNA, 15 nt, Homo sapiens
gccaaacacacagaa

SEQ ID NO: 855943 - RNA, 14 nt, Homo sapiens
gccaagcaggcacu

SEQ ID NO: 855944 - RNA, 14 nt, Homo sapiens
gccaaucauugcaa

SEQ ID NO: 855945 - RNA, 23 nt, Homo sapiens
gccacaccacauugccucaacaa

SEQ ID NO: 855946 - RNA, 16 nt, Homo sapiens
gccacacccagaguag

SEQ ID NO: 855947 - RNA, 19 nt, Homo sapiens
gccacagggacuugccuca

SEQ ID NO: 855948 - RNA, 23 nt, Homo sapiens
gccacgcuuuaugcccuugccuc

SEQ ID NO: 855949 - RNA, 22 nt, Homo sapiens
gccacucagaaaagacgcacca

SEQ ID NO: 855950 - RNA, 21 nt, Homo sapiens
gccagaagaccucccuucagg

SEQ ID NO: 855951 - RNA, 20 nt, Homo sapiens
gccaggaaguagcacaggcu

SEQ ID NO: 855952 - RNA, 17 nt, Homo sapiens
gccaggccuuggggaca

SEQ ID NO: 855953 - RNA, 18 nt, Homo sapiens
gccaggcguggugacuca

SEQ ID NO: 855954 - RNA, 23 nt, Homo sapiens
gccaucccggcagcgaggcuggg

SEQ ID NO: 855955 - RNA, 14 nt, Homo sapiens
gccauugcugcuaa

SEQ ID NO: 855956 - RNA, 13 nt, Homo sapiens
gcccaaggcgaua

SEQ ID NO: 855957 - RNA, 20 nt, Homo sapiens
gcccagaaaagguacacuuu

SEQ ID NO: 855958 - RNA, 20 nt, Homo sapiens
gcccaggcuggagugcagug

SEQ ID NO: 855959 - RNA, 19 nt, Homo sapiens
gcccauguauggccaggaa

SEQ ID NO: 855960 - RNA, 19 nt, Homo sapiens
gcccaugugcccacugucu

SEQ ID NO: 855961 - RNA, 21 nt, Homo sapiens
gccccacaccaguugcccaga

SEQ ID NO: 855962 - RNA, 17 nt, Homo sapiens
gcccccagcccuccagu

SEQ ID NO: 855963 - RNA, 21 nt, Homo sapiens
gugcacugcaaugccaggugg

SEQ ID NO: 855964 - RNA, 23 nt, Homo sapiens
ugaccgcggcagcuccucagcgg

SEQ ID NO: 855965 - RNA, 16 nt, Homo sapiens
ugaccugauguccauu

SEQ ID NO: 855966 - RNA, 17 nt, Homo sapiens
ugaccuuaaaugcaacc

SEQ ID NO: 855967 - RNA, 22 nt, Homo sapiens
ugacuaaaaauaucacacugaa

SEQ ID NO: 855968 - RNA, 19 nt, Homo sapiens
ugacucuaguacugugaau

SEQ ID NO: 855969 - RNA, 22 nt, Homo sapiens
ugacucuggaaaaggcauauau

SEQ ID NO: 855970 - RNA, 12 nt, Homo sapiens
ugacugugguag

SEQ ID NO: 855971 - RNA, 20 nt, Homo sapiens
ugacuuucuguguaccacug

SEQ ID NO: 855972 - RNA, 23 nt, Homo sapiens
ugagaauguuuuagcacagcguu

SEQ ID NO: 855973 - RNA, 16 nt, Homo sapiens
ugagaggaacaagaag

SEQ ID NO: 855974 - RNA, 19 nt, Homo sapiens
ugagauguugagaggaaca

SEQ ID NO: 855975 - RNA, 16 nt, Homo sapiens
ugagcaauuguagggc

SEQ ID NO: 855976 - RNA, 22 nt, Homo sapiens
ugagcugaaagaggccaaacag

SEQ ID NO: 855977 - RNA, 19 nt, Homo sapiens
ugagggccaggaugcuccc

SEQ ID NO: 855978 - RNA, 23 nt, Homo sapiens
ugagggugguaaauguaggagaa

SEQ ID NO: 855979 - RNA, 16 nt, Homo sapiens
ugaguagggcaaugga

SEQ ID NO: 855980 - RNA, 18 nt, Homo sapiens
ugaguauguucauugcca

SEQ ID NO: 855981 - RNA, 15 nt, Homo sapiens
ugaguguucugggau

SEQ ID NO: 855982 - RNA, 23 nt, Homo sapiens
ugaguuuucacucuucuaaugca

SEQ ID NO: 855983 - RNA, 21 nt, Homo sapiens
ugauacgcuuaagguggaaag

SEQ ID NO: 855984 - RNA, 17 nt, Homo sapiens
ugauauaaaagcugcau

SEQ ID NO: 855985 - RNA, 18 nt, Homo sapiens
ugaucaucgaggagcuag

SEQ ID NO: 855986 - RNA, 15 nt, Homo sapiens
ugaugcagucuuaga

SEQ ID NO: 855987 - RNA, 18 nt, Homo sapiens
ugaugggaugauugaaga

SEQ ID NO: 855988 - RNA, 18 nt, Homo sapiens
ugauguuugccauuugcu

SEQ ID NO: 855989 - RNA, 13 nt, Homo sapiens
ugauuaaucauaa

SEQ ID NO: 855990 - RNA, 20 nt, Homo sapiens
ugauucccuuguuauucaac

SEQ ID NO: 855991 - RNA, 17 nt, Homo sapiens
ugcaaaaagcuagucaa

SEQ ID NO: 855992 - RNA, 15 nt, Homo sapiens
ugcaagggucucaca

SEQ ID NO: 855993 - RNA, 23 nt, Homo sapiens
ugcaaucacacguggugaccuca

SEQ ID NO: 855994 - RNA, 15 nt, Homo sapiens
ugcaaugccaggugg

SEQ ID NO: 855995 - RNA, 15 nt, Homo sapiens
ugcacaguagcugca

SEQ ID NO: 855996 - RNA, 18 nt, Homo sapiens
ugcacuucaagaagucac

SEQ ID NO: 855997 - RNA, 14 nt, Homo sapiens
ugcagcaugugccu

SEQ ID NO: 855998 - RNA, 14 nt, Homo sapiens
ugcaggugggauga

SEQ ID NO: 855999 - RNA, 16 nt, Homo sapiens
ugcauaguaguuuuaa

SEQ ID NO: 856000 - RNA, 17 nt, Homo sapiens
ugcaucuuugauguguu

SEQ ID NO: 856001 - RNA, 15 nt, Homo sapiens
ugcaugaugaaugac

SEQ ID NO: 856002 - RNA, 19 nt, Homo sapiens
ugcauuaaaagaaaauaaa

SEQ ID NO: 856003 - RNA, 21 nt, Homo sapiens
ugcauuauguacuacaugaca

SEQ ID NO: 856004 - RNA, 17 nt, Homo sapiens
ugccaaaaagcauacaa

SEQ ID NO: 856005 - RNA, 14 nt, Homo sapiens
ugccaaucauugca

SEQ ID NO: 856006 - RNA, 15 nt, Homo sapiens
ugccaccugcacagg

SEQ ID NO: 856007 - RNA, 17 nt, Homo sapiens
ugccaccugcacaggua

SEQ ID NO: 856008 - RNA, 19 nt, Homo sapiens
ugccacgcuuuaugcccuu

SEQ ID NO: 856009 - RNA, 14 nt, Homo sapiens
ugccagcagcugcc

SEQ ID NO: 856010 - RNA, 22 nt, Homo sapiens
ugccagguggagaaaucacaga

SEQ ID NO: 856011 - RNA, 19 nt, Homo sapiens
ugccauguacccauugcag

SEQ ID NO: 856012 - RNA, 20 nt, Homo sapiens
ugccauguacccauugcaga

SEQ ID NO: 856013 - RNA, 19 nt, Homo sapiens
ugcccacaagucccagcgc

SEQ ID NO: 856014 - RNA, 22 nt, Homo sapiens
ugcccagcccccuggucuuuga

SEQ ID NO: 856015 - RNA, 16 nt, Homo sapiens
ugccccaaccacaaac

SEQ ID NO: 856016 - RNA, 23 nt, Homo sapiens
ugcccccagauuuaaccauucca

SEQ ID NO: 856017 - RNA, 19 nt, Homo sapiens
ugcccccagcuucugccac

SEQ ID NO: 856018 - RNA, 16 nt, Homo sapiens
ugcccucugcucuaau

SEQ ID NO: 856019 - RNA, 16 nt, Homo sapiens
ugccuaaaaguuuuga

SEQ ID NO: 856020 - RNA, 20 nt, Homo sapiens
ugccucacugugucccaaaa

SEQ ID NO: 856021 - RNA, 15 nt, Homo sapiens
ugccucuucaguggg

SEQ ID NO: 856022 - RNA, 23 nt, Homo sapiens
ugccugauuuguuccuucugggg

SEQ ID NO: 856023 - RNA, 16 nt, Homo sapiens
ugccuuaaacucuguu

SEQ ID NO: 856024 - RNA, 19 nt, Homo sapiens
ugccuuaucugaguuuucg

SEQ ID NO: 856025 - RNA, 17 nt, Homo sapiens
ugcgggucugucagggu

SEQ ID NO: 856026 - RNA, 22 nt, Homo sapiens
ugcucagaaucugauaccaaag

SEQ ID NO: 856027 - RNA, 22 nt, Homo sapiens
ugcucauuucaugaagcaagaa

SEQ ID NO: 856028 - RNA, 20 nt, Homo sapiens
ugcuccccuaaagccucaaa

SEQ ID NO: 856029 - RNA, 18 nt, Homo sapiens
ugcucucucaacaucaca

SEQ ID NO: 856030 - RNA, 16 nt, Homo sapiens
ugcucuucucugguuc

SEQ ID NO: 856031 - RNA, 15 nt, Homo sapiens
ugcugaacauugcau

SEQ ID NO: 856032 - RNA, 14 nt, Homo sapiens
ugcugacagcaaag

SEQ ID NO: 856033 - RNA, 15 nt, Homo sapiens
ugcugcagagcagua

SEQ ID NO: 856034 - RNA, 13 nt, Homo sapiens
ugcugcucucuca

SEQ ID NO: 856035 - RNA, 19 nt, Homo sapiens
ugcuggcgcuuguguauaa

SEQ ID NO: 856036 - RNA, 17 nt, Homo sapiens
ugcuggugacccagcau

SEQ ID NO: 856037 - RNA, 16 nt, Homo sapiens
ugcugguuccaugccu

SEQ ID NO: 856038 - RNA, 15 nt, Homo sapiens
ugcugucacaaagga

SEQ ID NO: 856039 - RNA, 20 nt, Homo sapiens
ugcuuaucagugugcaauac

SEQ ID NO: 856040 - RNA, 18 nt, Homo sapiens
ugcuucucuccuaucugu

SEQ ID NO: 856041 - RNA, 12 nt, Homo sapiens
ugcuugacaaag

SEQ ID NO: 856042 - RNA, 19 nt, Homo sapiens
ugcuuuauaauccuuguca

SEQ ID NO: 856043 - RNA, 19 nt, Homo sapiens
uggaaacauuggugaugcu

SEQ ID NO: 856044 - RNA, 23 nt, Homo sapiens
uggaaacggcuuuucuuggccaa

SEQ ID NO: 856045 - RNA, 16 nt, Homo sapiens
uggaaggcaguguuau

SEQ ID NO: 856046 - RNA, 18 nt, Homo sapiens
uggaaugagcagcuuuag

SEQ ID NO: 856047 - RNA, 21 nt, Homo sapiens
uggaaugcacucagacuguau

SEQ ID NO: 856048 - RNA, 18 nt, Homo sapiens
uggaauggcagcaugcaa

SEQ ID NO: 856049 - RNA, 18 nt, Homo sapiens
uggaccccaucugugaau

SEQ ID NO: 856050 - RNA, 17 nt, Homo sapiens
uggagaaaucacagaga

SEQ ID NO: 856051 - RNA, 23 nt, Homo sapiens
uggagcaauaaaagacaaaugca

SEQ ID NO: 856052 - RNA, 17 nt, Homo sapiens
uggagcuaaaacuggcc

SEQ ID NO: 856053 - RNA, 18 nt, Homo sapiens
uggagcuaaaacuggccc

SEQ ID NO: 856054 - RNA, 10 nt, Homo sapiens
uggagcucaa

SEQ ID NO: 856055 - RNA, 16 nt, Homo sapiens
uggagguugcugguac

SEQ ID NO: 856056 - RNA, 17 nt, Homo sapiens
uggagucucgcucuguu

SEQ ID NO: 856057 - RNA, 16 nt, Homo sapiens
uggaguuaaacuuuag

SEQ ID NO: 856058 - RNA, 22 nt, Homo sapiens
uggaguuaaacuuuagugcuac

SEQ ID NO: 856059 - RNA, 22 nt, Homo sapiens
uggauauagaaaggagaccugu

SEQ ID NO: 856060 - RNA, 17 nt, Homo sapiens
uggaugcuuuggcaaug

SEQ ID NO: 856061 - RNA, 23 nt, Homo sapiens
uggaugggguggggaccuggaau

SEQ ID NO: 856062 - RNA, 15 nt, Homo sapiens
uggauuccucucugu

SEQ ID NO: 856063 - RNA, 13 nt, Homo sapiens
uggcagcaugcaa

SEQ ID NO: 856064 - RNA, 18 nt, Homo sapiens
uggcagccauuucuccau

SEQ ID NO: 856065 - RNA, 20 nt, Homo sapiens
uggcagccauuucuccaugg

SEQ ID NO: 856066 - RNA, 16 nt, Homo sapiens
uggcauaguggcuuaa

SEQ ID NO: 856067 - RNA, 20 nt, Homo sapiens
uggcauccccacguggacaa

SEQ ID NO: 856068 - RNA, 20 nt, Homo sapiens
uggccaacagaacacuugcu

SEQ ID NO: 856069 - RNA, 17 nt, Homo sapiens
uggccaggaaguagcac

SEQ ID NO: 856070 - RNA, 16 nt, Homo sapiens
uggcccggacaugucu

SEQ ID NO: 856071 - RNA, 14 nt, Homo sapiens
uggccucugccuuu

SEQ ID NO: 856072 - RNA, 20 nt, Homo sapiens
uggcucuuagaaacucagga

SEQ ID NO: 856073 - RNA, 19 nt, Homo sapiens
uggcugaagugcauggguc

SEQ ID NO: 856074 - RNA, 18 nt, Homo sapiens
uggcuuccucugcugcau

SEQ ID NO: 856075 - RNA, 13 nt, Homo sapiens
ugggacaucuucu

SEQ ID NO: 856076 - RNA, 15 nt, Homo sapiens
ugggagaagaucuca

SEQ ID NO: 856077 - RNA, 17 nt, Homo sapiens
ugggagaagaucucaag

SEQ ID NO: 856078 - RNA, 18 nt, Homo sapiens
ugggccucugauguucuu

SEQ ID NO: 856079 - RNA, 18 nt, Homo sapiens
ugggcgggaaaaacacca

SEQ ID NO: 856080 - RNA, 14 nt, Homo sapiens
ugggcugggucccc

SEQ ID NO: 856081 - RNA, 14 nt, Homo sapiens
uggggaagaggcaa

SEQ ID NO: 856082 - RNA, 13 nt, Homo sapiens
uggggaccacaga

SEQ ID NO: 856083 - RNA, 21 nt, Homo sapiens
uggggaccagcuuggcucagg

SEQ ID NO: 856084 - RNA, 18 nt, Homo sapiens
agaccugccugucuccca

SEQ ID NO: 856085 - RNA, 20 nt, Homo sapiens
agaccuggagcaauaaaaga

SEQ ID NO: 856086 - RNA, 21 nt, Homo sapiens
agaccuguaucaaacugcuuu

SEQ ID NO: 856087 - RNA, 15 nt, Homo sapiens
agacugcuccugagc

SEQ ID NO: 856088 - RNA, 22 nt, Homo sapiens
agacuuaauauguuuuauucag

SEQ ID NO: 856089 - RNA, 23 nt, Homo sapiens
agacuuuuaaagacuugcacaaa

SEQ ID NO: 856090 - RNA, 17 nt, Homo sapiens
agagaaagugacaugca

SEQ ID NO: 856091 - RNA, 18 nt, Homo sapiens
agagaagugggugggcac

SEQ ID NO: 856092 - RNA, 17 nt, Homo sapiens
agagaccugaacugggc

SEQ ID NO: 856093 - RNA, 12 nt, Homo sapiens
agagacugcuug

SEQ ID NO: 856094 - RNA, 20 nt, Homo sapiens
agagacugcuugacaaagga

SEQ ID NO: 856095 - RNA, 19 nt, Homo sapiens
agagagcgaccagcaggcu

SEQ ID NO: 856096 - RNA, 22 nt, Homo sapiens
agagagcuuaggaagcaugagg

SEQ ID NO: 856097 - RNA, 16 nt, Homo sapiens
agagccccacucucag

SEQ ID NO: 856098 - RNA, 13 nt, Homo sapiens
agagcuaaggcca

SEQ ID NO: 856099 - RNA, 19 nt, Homo sapiens
agagcuguugaugggauga

SEQ ID NO: 856100 - RNA, 18 nt, Homo sapiens
agaggaagacuccugaaa

SEQ ID NO: 856101 - RNA, 13 nt, Homo sapiens
agaggaggagaaa

SEQ ID NO: 856102 - RNA, 13 nt, Homo sapiens
agaggccaaacag

SEQ ID NO: 856103 - RNA, 18 nt, Homo sapiens
agaggccuuuaguuauaa

SEQ ID NO: 856104 - RNA, 11 nt, Homo sapiens
agagggcuccu

SEQ ID NO: 856105 - RNA, 15 nt, Homo sapiens
agaggguacuugaau

SEQ ID NO: 856106 - RNA, 21 nt, Homo sapiens
agagggugauggaacaagaga

SEQ ID NO: 856107 - RNA, 20 nt, Homo sapiens
agagggugccggaaagagag

SEQ ID NO: 856108 - RNA, 22 nt, Homo sapiens
agaggugagaacuaaugccuag

SEQ ID NO: 856109 - RNA, 20 nt, Homo sapiens
agaguauauuccucugcuga

SEQ ID NO: 856110 - RNA, 22 nt, Homo sapiens
agauaaauauugagcagaucua

SEQ ID NO: 856111 - RNA, 22 nt, Homo sapiens
agauaaggaacagcucgggcca

SEQ ID NO: 856112 - RNA, 21 nt, Homo sapiens
agauauaagacuuaauauguu

SEQ ID NO: 856113 - RNA, 23 nt, Homo sapiens
agauaugcaaauuccauagcuca

SEQ ID NO: 856114 - RNA, 18 nt, Homo sapiens
agauauuaauaauuccaa

SEQ ID NO: 856115 - RNA, 17 nt, Homo sapiens
agaucaaguugagacag

SEQ ID NO: 856116 - RNA, 19 nt, Homo sapiens
agaucacuguuuagauuug

SEQ ID NO: 856117 - RNA, 21 nt, Homo sapiens
agauccacuuuggcaggagcc

SEQ ID NO: 856118 - RNA, 15 nt, Homo sapiens
agaucccagugugaa

SEQ ID NO: 856119 - RNA, 14 nt, Homo sapiens
agaugcagcacaua

SEQ ID NO: 856120 - RNA, 18 nt, Homo sapiens
agauguugagaggaacaa

SEQ ID NO: 856121 - RNA, 18 nt, Homo sapiens
agauuccagaaaucugcu

SEQ ID NO: 856122 - RNA, 21 nt, Homo sapiens
agauuccagaaaucugcugca

SEQ ID NO: 856123 - RNA, 19 nt, Homo sapiens
agauugauaaccauagcau

SEQ ID NO: 856124 - RNA, 19 nt, Homo sapiens
agcaaauggccucauguca

SEQ ID NO: 856125 - RNA, 15 nt, Homo sapiens
agcacaaaguuuacu

SEQ ID NO: 856126 - RNA, 17 nt, Homo sapiens
agcacagcguuaugugu

SEQ ID NO: 856127 - RNA, 22 nt, Homo sapiens
agcagaaggcaggaccaugagg

SEQ ID NO: 856128 - RNA, 14 nt, Homo sapiens
agcagccagccauu

SEQ ID NO: 856129 - RNA, 18 nt, Homo sapiens
agcagccucugaucugug

SEQ ID NO: 856130 - RNA, 21 nt, Homo sapiens
agcaggacgacuguuuuccca

SEQ ID NO: 856131 - RNA, 19 nt, Homo sapiens
agcaggagggacagucuca

SEQ ID NO: 856132 - RNA, 21 nt, Homo sapiens
agcaggauaaacauuccagag

SEQ ID NO: 856133 - RNA, 14 nt, Homo sapiens
agcaucucugacca

SEQ ID NO: 856134 - RNA, 24 nt, Homo sapiens
agcauggugccuauguagacaaua

SEQ ID NO: 856135 - RNA, 22 nt, Homo sapiens
agcauguguugcagcugucacc

SEQ ID NO: 856136 - RNA, 20 nt, Homo sapiens
agcauucucuccauuucacu

SEQ ID NO: 856137 - RNA, 20 nt, Homo sapiens
agcauugcagucacuuugac

SEQ ID NO: 856138 - RNA, 15 nt, Homo sapiens
agcauuuguguguua

SEQ ID NO: 856139 - RNA, 13 nt, Homo sapiens
agccacauuucag

SEQ ID NO: 856140 - RNA, 11 nt, Homo sapiens
agccaccacug

SEQ ID NO: 856141 - RNA, 23 nt, Homo sapiens
agcccagcagacaucaagcucaa

SEQ ID NO: 856142 - RNA, 15 nt, Homo sapiens
agcccauaauucaua

SEQ ID NO: 856143 - RNA, 22 nt, Homo sapiens
agcccgacuuagccagcccugg

SEQ ID NO: 856144 - RNA, 16 nt, Homo sapiens
agcccgggaggggugg

SEQ ID NO: 856145 - RNA, 14 nt, Homo sapiens
agccuagauaugaa

SEQ ID NO: 856146 - RNA, 20 nt, Homo sapiens
agccuagauaugaagaaucu

SEQ ID NO: 856147 - RNA, 14 nt, Homo sapiens
agccucaaccaaca

SEQ ID NO: 856148 - RNA, 16 nt, Homo sapiens
agccucacgaaacugg

SEQ ID NO: 856149 - RNA, 12 nt, Homo sapiens
agccucccugac

SEQ ID NO: 856150 - RNA, 20 nt, Homo sapiens
agccucucugcacacuaaua

SEQ ID NO: 856151 - RNA, 23 nt, Homo sapiens
agccuggcaggggauccagcuca

SEQ ID NO: 856152 - RNA, 22 nt, Homo sapiens
agccugggugcacaguagcugc

SEQ ID NO: 856153 - RNA, 17 nt, Homo sapiens
agccuuaaaacaucauu

SEQ ID NO: 856154 - RNA, 20 nt, Homo sapiens
agccuugugggugugagcag

SEQ ID NO: 856155 - RNA, 16 nt, Homo sapiens
agcgauucucuugccu

SEQ ID NO: 856156 - RNA, 15 nt, Homo sapiens
agcgcccccacuccu

SEQ ID NO: 856157 - RNA, 14 nt, Homo sapiens
agcuaaaacuggcc

SEQ ID NO: 856158 - RNA, 18 nt, Homo sapiens
agcuaaggccaaugggcu

SEQ ID NO: 856159 - RNA, 15 nt, Homo sapiens
agcuagaacauucca

SEQ ID NO: 856160 - RNA, 20 nt, Homo sapiens
agcuaguugaauacuugaac

SEQ ID NO: 856161 - RNA, 19 nt, Homo sapiens
agcucauuuggggaccaca

SEQ ID NO: 856162 - RNA, 19 nt, Homo sapiens
agcugaaagaggccaaaca

SEQ ID NO: 856163 - RNA, 20 nt, Homo sapiens
agcugacuuucaaaguggau

SEQ ID NO: 856164 - RNA, 15 nt, Homo sapiens
agcugaugaggaaua

SEQ ID NO: 856165 - RNA, 23 nt, Homo sapiens
agcugcauaugccuacaaagcuc

SEQ ID NO: 856166 - RNA, 18 nt, Homo sapiens
agcugccuggaggccaga

SEQ ID NO: 856167 - RNA, 22 nt, Homo sapiens
agcugccuggaggccagaagga

SEQ ID NO: 856168 - RNA, 14 nt, Homo sapiens
agcugccugggaag

SEQ ID NO: 856169 - RNA, 12 nt, Homo sapiens
agcugcucagau

SEQ ID NO: 856170 - RNA, 22 nt, Homo sapiens
agcuguugacucuaguacugug

SEQ ID NO: 856171 - RNA, 12 nt, Homo sapiens
agcuucuagucu

SEQ ID NO: 856172 - RNA, 13 nt, Homo sapiens
agcuugcagugag

SEQ ID NO: 856173 - RNA, 13 nt, Homo sapiens
aggaaacaaacuc

SEQ ID NO: 856174 - RNA, 17 nt, Homo sapiens
aggaacugagguuuaca

SEQ ID NO: 856175 - RNA, 15 nt, Homo sapiens
aggaaggcugucuca

SEQ ID NO: 856176 - RNA, 18 nt, Homo sapiens
aggaagguaguucaagaa

SEQ ID NO: 856177 - RNA, 17 nt, Homo sapiens
aggaauaugggagaaau

SEQ ID NO: 856178 - RNA, 21 nt, Homo sapiens
aggaaucaugaaaaaugaucu

SEQ ID NO: 856179 - RNA, 15 nt, Homo sapiens
aggacaaucuagcuc

SEQ ID NO: 856180 - RNA, 19 nt, Homo sapiens
aggacaaucuagcucucca

SEQ ID NO: 856181 - RNA, 22 nt, Homo sapiens
aggacagccugccucugccaca

SEQ ID NO: 856182 - RNA, 14 nt, Homo sapiens
aggagaaagagccu

SEQ ID NO: 856183 - RNA, 16 nt, Homo sapiens
aggaggcagagagggu

SEQ ID NO: 856184 - RNA, 16 nt, Homo sapiens
aggaguaaugggauau

SEQ ID NO: 856185 - RNA, 20 nt, Homo sapiens
aggauagauuucauguuaug

SEQ ID NO: 856186 - RNA, 14 nt, Homo sapiens
aggauugccaggua

SEQ ID NO: 856187 - RNA, 16 nt, Homo sapiens
aggauugucacuccaa

SEQ ID NO: 856188 - RNA, 18 nt, Homo sapiens
aggauugucacuccaaac

SEQ ID NO: 856189 - RNA, 16 nt, Homo sapiens
aggcaaauaagcacuc

SEQ ID NO: 856190 - RNA, 19 nt, Homo sapiens
cccaaaugugugcccagcu

SEQ ID NO: 856191 - RNA, 23 nt, Homo sapiens
cccaagaacacaagaagacccau

SEQ ID NO: 856192 - RNA, 22 nt, Homo sapiens
cccaagagucuggggaccagcu

SEQ ID NO: 856193 - RNA, 23 nt, Homo sapiens
cccaagagucuggggaccagcuu

SEQ ID NO: 856194 - RNA, 22 nt, Homo sapiens
cccaaggcgauauaagcaaaau

SEQ ID NO: 856195 - RNA, 21 nt, Homo sapiens
cccaaguacuuuccaaucuca

SEQ ID NO: 856196 - RNA, 19 nt, Homo sapiens
cccacguggacaagaaagu

SEQ ID NO: 856197 - RNA, 15 nt, Homo sapiens
cccagcuuccaugcu

SEQ ID NO: 856198 - RNA, 18 nt, Homo sapiens
cccaggagcccauuugga

SEQ ID NO: 856199 - RNA, 18 nt, Homo sapiens
cccaggccagaagaccuc

SEQ ID NO: 856200 - RNA, 18 nt, Homo sapiens
cccaggcuggagugcagu

SEQ ID NO: 856201 - RNA, 18 nt, Homo sapiens
cccaguagcugggaccac

SEQ ID NO: 856202 - RNA, 20 nt, Homo sapiens
cccaucaggggcaggaacca

SEQ ID NO: 856203 - RNA, 23 nt, Homo sapiens
cccaucuuuuguuacucuuggga

SEQ ID NO: 856204 - RNA, 18 nt, Homo sapiens
cccauuggugcuaccugg

SEQ ID NO: 856205 - RNA, 23 nt, Homo sapiens
cccauuggugcuaccuggcucuc

SEQ ID NO: 856206 - RNA, 14 nt, Homo sapiens
ccccaauaccccau

SEQ ID NO: 856207 - RNA, 22 nt, Homo sapiens
ccccagccagcgccuccaggcc

SEQ ID NO: 856208 - RNA, 13 nt, Homo sapiens
ccccaucacuuga

SEQ ID NO: 856209 - RNA, 14 nt, Homo sapiens
cccccagcuucugc

SEQ ID NO: 856210 - RNA, 12 nt, Homo sapiens
ccccugaccuca

SEQ ID NO: 856211 - RNA, 15 nt, Homo sapiens
cccgcaucagcugcu

SEQ ID NO: 856212 - RNA, 19 nt, Homo sapiens
cccggcgggacugucaaug

SEQ ID NO: 856213 - RNA, 15 nt, Homo sapiens
cccgggacucugcau

SEQ ID NO: 856214 - RNA, 19 nt, Homo sapiens
cccgguacaaguggcucau

SEQ ID NO: 856215 - RNA, 21 nt, Homo sapiens
cccgguugugagagccuguga

SEQ ID NO: 856216 - RNA, 21 nt, Homo sapiens
cccucggccugggauuucaga

SEQ ID NO: 856217 - RNA, 16 nt, Homo sapiens
cccugacgucugccac

SEQ ID NO: 856218 - RNA, 14 nt, Homo sapiens
cccugacuuucuaa

SEQ ID NO: 856219 - RNA, 22 nt, Homo sapiens
cccugagcuuuggugcaucuca

SEQ ID NO: 856220 - RNA, 14 nt, Homo sapiens
cccugaugggccaa

SEQ ID NO: 856221 - RNA, 14 nt, Homo sapiens
cccuggagcucaag

SEQ ID NO: 856222 - RNA, 17 nt, Homo sapiens
cccuggcuacaugguca

SEQ ID NO: 856223 - RNA, 18 nt, Homo sapiens
cccuggguuagacugcca

SEQ ID NO: 856224 - RNA, 18 nt, Homo sapiens
cccuguauaucaggguac

SEQ ID NO: 856225 - RNA, 12 nt, Homo sapiens
cccugugugaca

SEQ ID NO: 856226 - RNA, 18 nt, Homo sapiens
cccugugugacaucacag

SEQ ID NO: 856227 - RNA, 12 nt, Homo sapiens
cccuguguuaau

SEQ ID NO: 856228 - RNA, 16 nt, Homo sapiens
cccuucccuggaucca

SEQ ID NO: 856229 - RNA, 17 nt, Homo sapiens
cccuugcccuuccagcc

SEQ ID NO: 856230 - RNA, 14 nt, Homo sapiens
cccuuggcucucaa

SEQ ID NO: 856231 - RNA, 20 nt, Homo sapiens
cccuuuggcccugaaccagg

SEQ ID NO: 856232 - RNA, 12 nt, Homo sapiens
ccgggguccagg

SEQ ID NO: 856233 - RNA, 22 nt, Homo sapiens
ccgguugugagagccugugauc

SEQ ID NO: 856234 - RNA, 18 nt, Homo sapiens
ccgugaagauacuuugua

SEQ ID NO: 856235 - RNA, 20 nt, Homo sapiens
ccuaaagccucaaaacaaag

SEQ ID NO: 856236 - RNA, 19 nt, Homo sapiens
ccuaaaguauaacaugucg

SEQ ID NO: 856237 - RNA, 19 nt, Homo sapiens
ccuaacguuuucuacuuug

SEQ ID NO: 856238 - RNA, 20 nt, Homo sapiens
ccuacaaagcucugaauuca

SEQ ID NO: 856239 - RNA, 23 nt, Homo sapiens
ccuagauaugaagaaucugcucu

SEQ ID NO: 856240 - RNA, 18 nt, Homo sapiens
ccuaugugcguauuuucu

SEQ ID NO: 856241 - RNA, 16 nt, Homo sapiens
ccuauuacuuaugauu

SEQ ID NO: 856242 - RNA, 15 nt, Homo sapiens
ccuauuuucaugauu

SEQ ID NO: 856243 - RNA, 17 nt, Homo sapiens
ccucaaaacaaaggccu

SEQ ID NO: 856244 - RNA, 12 nt, Homo sapiens
ccucacugaaaa

SEQ ID NO: 856245 - RNA, 22 nt, Homo sapiens
ccucauggaugcuuuggcaaug

SEQ ID NO: 856246 - RNA, 15 nt, Homo sapiens
ccucccagcuucuua

SEQ ID NO: 856247 - RNA, 20 nt, Homo sapiens
ccuccugaaccagcacuaau

SEQ ID NO: 856248 - RNA, 15 nt, Homo sapiens
ccucgcccaguccca

SEQ ID NO: 856249 - RNA, 17 nt, Homo sapiens
ccucucuagacaguaga

SEQ ID NO: 856250 - RNA, 18 nt, Homo sapiens
ccucucuugccaaaaagc

SEQ ID NO: 856251 - RNA, 15 nt, Homo sapiens
ccucugcugaacaaa

SEQ ID NO: 856252 - RNA, 20 nt, Homo sapiens
ccucuggaauggcucaggga

SEQ ID NO: 856253 - RNA, 15 nt, Homo sapiens
ccugaaaguuccuuc

SEQ ID NO: 856254 - RNA, 15 nt, Homo sapiens
ccugaaccagcacua

SEQ ID NO: 856255 - RNA, 17 nt, Homo sapiens
ccugaaucuaucaccca

SEQ ID NO: 856256 - RNA, 11 nt, Homo sapiens
ccugaccucaa

SEQ ID NO: 856257 - RNA, 21 nt, Homo sapiens
ccugagagcccagaaaaggua

SEQ ID NO: 856258 - RNA, 17 nt, Homo sapiens
ccugaggagcccagcgu

SEQ ID NO: 856259 - RNA, 18 nt, Homo sapiens
ccugaggggagacagagc

SEQ ID NO: 856260 - RNA, 20 nt, Homo sapiens
ccugagguuugaaucugacu

SEQ ID NO: 856261 - RNA, 23 nt, Homo sapiens
ccugagugggcgugguaccugcu

SEQ ID NO: 856262 - RNA, 18 nt, Homo sapiens
ccugaugggccaagggaa

SEQ ID NO: 856263 - RNA, 23 nt, Homo sapiens
ccugauucacugccuaugaacag

SEQ ID NO: 856264 - RNA, 12 nt, Homo sapiens
ccugcagcaugu

SEQ ID NO: 856265 - RNA, 14 nt, Homo sapiens
ccugccucugccac

SEQ ID NO: 856266 - RNA, 16 nt, Homo sapiens
ccuggaaugggucucu

SEQ ID NO: 856267 - RNA, 12 nt, Homo sapiens
ccuggagcucaa

SEQ ID NO: 856268 - RNA, 17 nt, Homo sapiens
ccuggcccaugugccca

SEQ ID NO: 856269 - RNA, 15 nt, Homo sapiens
ccugggacaucuucu

SEQ ID NO: 856270 - RNA, 18 nt, Homo sapiens
ccugggcaauaaagugag

SEQ ID NO: 856271 - RNA, 19 nt, Homo sapiens
ccugggguucuuuuugcca

SEQ ID NO: 856272 - RNA, 22 nt, Homo sapiens
ccuggguguggcugggcugcuc

SEQ ID NO: 856273 - RNA, 15 nt, Homo sapiens
ccuggguuagacugc

SEQ ID NO: 856274 - RNA, 18 nt, Homo sapiens
ccuguaaucccagcacuu

SEQ ID NO: 856275 - RNA, 15 nt, Homo sapiens
ccuguccugccugug

SEQ ID NO: 856276 - RNA, 21 nt, Homo sapiens
ccugucuuaauuuucuuucac

SEQ ID NO: 856277 - RNA, 18 nt, Homo sapiens
ccuguggguuuccauggc

SEQ ID NO: 856278 - RNA, 10 nt, Homo sapiens
ccuguuucau

SEQ ID NO: 856279 - RNA, 18 nt, Homo sapiens
ccuguuucuggucuucgc

SEQ ID NO: 856280 - RNA, 13 nt, Homo sapiens
ccuuaacuguaua

SEQ ID NO: 856281 - RNA, 23 nt, Homo sapiens
ccuuacauguccuccuaaggggc

SEQ ID NO: 856282 - RNA, 23 nt, Homo sapiens
ccuuacucugagcucauuaauaa

SEQ ID NO: 856283 - RNA, 14 nt, Homo sapiens
ccuuaucuaguguu

SEQ ID NO: 856284 - RNA, 20 nt, Homo sapiens
ccuuccuugaacccuaauaa

SEQ ID NO: 856285 - RNA, 17 nt, Homo sapiens
ccuugauggauuuucaa

SEQ ID NO: 856286 - RNA, 18 nt, Homo sapiens
ccuugcuguuuaaaagua

SEQ ID NO: 856287 - RNA, 15 nt, Homo sapiens
ccuugggaccugaau

SEQ ID NO: 856288 - RNA, 13 nt, Homo sapiens
ccuuuccuuucau

SEQ ID NO: 856289 - RNA, 17 nt, Homo sapiens
ccuuucgacuugcauuu

SEQ ID NO: 856290 - RNA, 19 nt, Homo sapiens
ccuuucuauaauuuuacaa

SEQ ID NO: 856291 - RNA, 14 nt, Homo sapiens
ccuuucuuguaaua

SEQ ID NO: 856292 - RNA, 22 nt, Homo sapiens
ccuuugcagcucagaaccacag

SEQ ID NO: 856293 - RNA, 20 nt, Homo sapiens
ccuuuucuuguaaacauugc

SEQ ID NO: 856294 - RNA, 22 nt, Homo sapiens
ccuuuugaaacucugcaugguc

SEQ ID NO: 856295 - RNA, 23 nt, Homo sapiens
cgaaagaggcacccuuccaucug

SEQ ID NO: 856296 - RNA, 16 nt, Homo sapiens
cgacuuguucuugaua

SEQ ID NO: 856297 - RNA, 23 nt, Homo sapiens
cgccgcuagguagagucugaggg

SEQ ID NO: 856298 - RNA, 15 nt, Homo sapiens
cgcuagcauuuccca

SEQ ID NO: 856299 - RNA, 16 nt, Homo sapiens
cgcucgcucucucgua

SEQ ID NO: 856300 - RNA, 23 nt, Homo sapiens
cggacacccgacuccaguccaag

SEQ ID NO: 856301 - RNA, 17 nt, Homo sapiens
cggcgggacugucaaug

SEQ ID NO: 856302 - RNA, 18 nt, Homo sapiens
cggcuaagcaggcgcaag

SEQ ID NO: 856303 - RNA, 15 nt, Homo sapiens
cggggauagagggua

SEQ ID NO: 856304 - RNA, 15 nt, Homo sapiens
cguacauaauacuga

SEQ ID NO: 856305 - RNA, 14 nt, Homo sapiens
cgucaagugcugcc

SEQ ID NO: 856306 - RNA, 13 nt, Homo sapiens
cguccacucuuca

SEQ ID NO: 856307 - RNA, 13 nt, Homo sapiens
cguccgaagggaa

SEQ ID NO: 856308 - RNA, 15 nt, Homo sapiens
cgugaugcuaugaug

SEQ ID NO: 856309 - RNA, 13 nt, Homo sapiens
cguucaccaguug

SEQ ID NO: 856310 - RNA, 13 nt, Homo sapiens
cuacaacuuuaaa

SEQ ID NO: 856311 - RNA, 19 nt, Homo sapiens
cuacaugcuuguugacaga

SEQ ID NO: 856312 - RNA, 22 nt, Homo sapiens
cuacauuuccgccacaucccuc

SEQ ID NO: 856313 - RNA, 16 nt, Homo sapiens
cuacugaugguuacau

SEQ ID NO: 856314 - RNA, 23 nt, Homo sapiens
cuacuuugaaauauuuaauuucc

SEQ ID NO: 856315 - RNA, 13 nt, Homo sapiens
cuagaacauucca

SEQ ID NO: 856316 - RNA, 16 nt, Homo sapiens
cuagacauaguaccga

SEQ ID NO: 856317 - RNA, 20 nt, Homo sapiens
cuagaggccuuuaguuauaa

SEQ ID NO: 856318 - RNA, 22 nt, Homo sapiens
cuagauaugaagaaucugcucu

SEQ ID NO: 856319 - RNA, 22 nt, Homo sapiens
cuagcccaaagccuucauuuua

SEQ ID NO: 856320 - RNA, 14 nt, Homo sapiens
cuagcuauaugcau

SEQ ID NO: 856321 - RNA, 21 nt, Homo sapiens
cuagcucuccauacuuugaac

SEQ ID NO: 856322 - RNA, 18 nt, Homo sapiens
cuaggacucugcacugaa

SEQ ID NO: 856323 - RNA, 13 nt, Homo sapiens
cuaggucagucuu

SEQ ID NO: 856324 - RNA, 23 nt, Homo sapiens
cuaguaccaugucguaguuacuc

SEQ ID NO: 856325 - RNA, 17 nt, Homo sapiens
cuagucuggaacugcug

SEQ ID NO: 856326 - RNA, 10 nt, Homo sapiens
cuagugucuu

SEQ ID NO: 856327 - RNA, 17 nt, Homo sapiens
cuaguugaauacuugaa

SEQ ID NO: 856328 - RNA, 23 nt, Homo sapiens
cuaguugaauacuugaaccauaa

SEQ ID NO: 856329 - RNA, 16 nt, Homo sapiens
cuauagcaucacuuaa

SEQ ID NO: 856330 - RNA, 12 nt, Homo sapiens
cuauaugcauuu

SEQ ID NO: 856331 - RNA, 14 nt, Homo sapiens
cuaugacacagaag

SEQ ID NO: 856332 - RNA, 21 nt, Homo sapiens
cuaugagaauugggauuacau

SEQ ID NO: 856333 - RNA, 18 nt, Homo sapiens
cuauuacuuaugauuuau

SEQ ID NO: 856334 - RNA, 18 nt, Homo sapiens
cuauucuuggaaccacga

SEQ ID NO: 856335 - RNA, 22 nt, Homo sapiens
cuauuuguguaaggacuuuggc

SEQ ID NO: 856336 - RNA, 20 nt, Homo sapiens
cucaaaaauuuuagcagugu

SEQ ID NO: 856337 - RNA, 20 nt, Homo sapiens
cucaacaaccggccccagag

SEQ ID NO: 856338 - RNA, 14 nt, Homo sapiens
cucaaggauccaga

SEQ ID NO: 856339 - RNA, 20 nt, Homo sapiens
cucaaggauccagacucuca

SEQ ID NO: 856340 - RNA, 20 nt, Homo sapiens
cucacagccagcgaacugac

SEQ ID NO: 856341 - RNA, 21 nt, Homo sapiens
cucacagccagcgaacugaca

SEQ ID NO: 856342 - RNA, 21 nt, Homo sapiens
cucacgucucucuggcccacu

SEQ ID NO: 856343 - RNA, 20 nt, Homo sapiens
cucacucuguugccauuaaa

SEQ ID NO: 856344 - RNA, 23 nt, Homo sapiens
cucagggcauaaagcauguuuca

SEQ ID NO: 856345 - RNA, 16 nt, Homo sapiens
cucauaauacugaaau

SEQ ID NO: 856346 - RNA, 12 nt, Homo sapiens
cucaugcaugca

SEQ ID NO: 856347 - RNA, 21 nt, Homo sapiens
cucauuaaaauugugaugcuc

SEQ ID NO: 856348 - RNA, 15 nt, Homo sapiens
cucauuugcucuuca

SEQ ID NO: 856349 - RNA, 15 nt, Homo sapiens
cucauuuggggacca

SEQ ID NO: 856350 - RNA, 19 nt, Homo sapiens
cuccaaaaguagcuuccuc

SEQ ID NO: 856351 - RNA, 19 nt, Homo sapiens
cuccacuuggcuccucuca

SEQ ID NO: 856352 - RNA, 16 nt, Homo sapiens
cuccauucauacacaa

SEQ ID NO: 856353 - RNA, 19 nt, Homo sapiens
cucccaaauugcugggauu

SEQ ID NO: 856354 - RNA, 17 nt, Homo sapiens
cucccagcgcacacaaa

SEQ ID NO: 856355 - RNA, 18 nt, Homo sapiens
cuccccuucccagacccc

SEQ ID NO: 856356 - RNA, 20 nt, Homo sapiens
cucccguguaggaaccugca

SEQ ID NO: 856357 - RNA, 20 nt, Homo sapiens
cucccuaugugcguauuuuc

SEQ ID NO: 856358 - RNA, 15 nt, Homo sapiens
cucccucacucucag

SEQ ID NO: 856359 - RNA, 14 nt, Homo sapiens
cucccuggcccacc

SEQ ID NO: 856360 - RNA, 20 nt, Homo sapiens
cucccuuuggcccugaacca

SEQ ID NO: 856361 - RNA, 14 nt, Homo sapiens
cuccugaucaggaa

SEQ ID NO: 856362 - RNA, 15 nt, Homo sapiens
cuccuggcugagaaa

SEQ ID NO: 856363 - RNA, 12 nt, Homo sapiens
cuccuguuucag

SEQ ID NO: 856364 - RNA, 14 nt, Homo sapiens
cuccuuccuugaac

SEQ ID NO: 856365 - RNA, 17 nt, Homo sapiens
cuccuuccuugaacccu

SEQ ID NO: 856366 - RNA, 22 nt, Homo sapiens
cucuaaccauucuguauugauu

SEQ ID NO: 856367 - RNA, 18 nt, Homo sapiens
cucuacaggugaggccca

SEQ ID NO: 856368 - RNA, 14 nt, Homo sapiens
cucuacaugcuugu

SEQ ID NO: 856369 - RNA, 13 nt, Homo sapiens
cucuaguacugug

SEQ ID NO: 856370 - RNA, 16 nt, Homo sapiens
cucuaguacugugaau

SEQ ID NO: 856371 - RNA, 13 nt, Homo sapiens
cucuagugcugug

SEQ ID NO: 856372 - RNA, 16 nt, Homo sapiens
cucuagugcugugaaa

SEQ ID NO: 856373 - RNA, 21 nt, Homo sapiens
cucucaaaccccugaccucaa

SEQ ID NO: 856374 - RNA, 13 nt, Homo sapiens
cucucaaugcugu

SEQ ID NO: 856375 - RNA, 21 nt, Homo sapiens
cucucaauuuuugguugaaua

SEQ ID NO: 856376 - RNA, 23 nt, Homo sapiens
cucucauuuguguggagucauuu

SEQ ID NO: 856377 - RNA, 16 nt, Homo sapiens
cucuccauacuuugaa

SEQ ID NO: 856378 - RNA, 12 nt, Homo sapiens
cucucguacucu

SEQ ID NO: 856379 - RNA, 16 nt, Homo sapiens
cucucuauaccaaaga

SEQ ID NO: 856380 - RNA, 14 nt, Homo sapiens
cucucucaacauca

SEQ ID NO: 856381 - RNA, 17 nt, Homo sapiens
cucucugucuucuugga

SEQ ID NO: 856382 - RNA, 22 nt, Homo sapiens
cucucuuccuuucauucuagua

SEQ ID NO: 856383 - RNA, 14 nt, Homo sapiens
cucugaaugcauga

SEQ ID NO: 856384 - RNA, 15 nt, Homo sapiens
cucugacuccaagag

SEQ ID NO: 856385 - RNA, 13 nt, Homo sapiens
cucugcauauucu

SEQ ID NO: 856386 - RNA, 17 nt, Homo sapiens
cucuuaauuuucaggaa

SEQ ID NO: 856387 - RNA, 15 nt, Homo sapiens
cucuuacacacugga

SEQ ID NO: 856388 - RNA, 22 nt, Homo sapiens
cucuugaguuguuuuuguauau

SEQ ID NO: 856389 - RNA, 14 nt, Homo sapiens
cucuugccaaaaag

SEQ ID NO: 856390 - RNA, 21 nt, Homo sapiens
cugaaaccgaagggacuggau

SEQ ID NO: 856391 - RNA, 18 nt, Homo sapiens
cugaaauaaaaugauuaa

SEQ ID NO: 856392 - RNA, 14 nt, Homo sapiens
cugaacauugcaua

SEQ ID NO: 856393 - RNA, 18 nt, Homo sapiens
cugaacccagaaacaaca

SEQ ID NO: 856394 - RNA, 14 nt, Homo sapiens
cugacuacagggcc

SEQ ID NO: 856395 - RNA, 14 nt, Homo sapiens
cugacucugccagg

SEQ ID NO: 856396 - RNA, 20 nt, Homo sapiens
cugagaaugaacaaagacca

SEQ ID NO: 856397 - RNA, 23 nt, Homo sapiens
cugagcacagggggccuccagga

SEQ ID NO: 856398 - RNA, 17 nt, Homo sapiens
cugagcaucacaauaaa

SEQ ID NO: 856399 - RNA, 12 nt, Homo sapiens
cugagccacuga

SEQ ID NO: 856400 - RNA, 19 nt, Homo sapiens
cugagcugaaagaggccaa

SEQ ID NO: 856401 - RNA, 17 nt, Homo sapiens
cugaggaaucaugaaaa

SEQ ID NO: 856402 - RNA, 21 nt, Homo sapiens
cugaggccuccggacuccucu

SEQ ID NO: 856403 - RNA, 21 nt, Homo sapiens
cugagggaggaggcaggaguu

SEQ ID NO: 856404 - RNA, 22 nt, Homo sapiens
cugagguuugaaucugacuuua

SEQ ID NO: 856405 - RNA, 17 nt, Homo sapiens
cugagugcaggcccacc

SEQ ID NO: 856406 - RNA, 14 nt, Homo sapiens
cugauaucagcacu

SEQ ID NO: 856407 - RNA, 14 nt, Homo sapiens
cugauauccaugau

SEQ ID NO: 856408 - RNA, 17 nt, Homo sapiens
cugaucugugcagggua

SEQ ID NO: 856409 - RNA, 14 nt, Homo sapiens
cugauguccauuca

SEQ ID NO: 856410 - RNA, 21 nt, Homo sapiens
cugauguuucucauccuuugc

SEQ ID NO: 856411 - RNA, 22 nt, Homo sapiens
cugauuccagcacaaccuucaa

SEQ ID NO: 856412 - RNA, 22 nt, Homo sapiens
cugcaaacgcuucaguuguuag

SEQ ID NO: 856413 - RNA, 13 nt, Homo sapiens
cugcacacuaaua

SEQ ID NO: 856414 - RNA, 16 nt, Homo sapiens
cugcacguuuucaucu

SEQ ID NO: 856415 - RNA, 20 nt, Homo sapiens
cugcaggugggaugagggag

SEQ ID NO: 856416 - RNA, 16 nt, Homo sapiens
cugcauauucuaguaa

SEQ ID NO: 856417 - RNA, 22 nt, Homo sapiens
cugcauuuagggaguauucuaa

SEQ ID NO: 856418 - RNA, 22 nt, Homo sapiens
cugccucauuuucacagcacua

SEQ ID NO: 856419 - RNA, 20 nt, Homo sapiens
cugccucuggccguguccac

SEQ ID NO: 856420 - RNA, 16 nt, Homo sapiens
cugccugcuacuugag

SEQ ID NO: 856421 - RNA, 21 nt, Homo sapiens
cugccugcugaagcuggugac

SEQ ID NO: 856422 - RNA, 15 nt, Homo sapiens
cugccugcugaccau

SEQ ID NO: 856423 - RNA, 18 nt, Homo sapiens
cugcggcccugaucuccg

SEQ ID NO: 856424 - RNA, 18 nt, Homo sapiens
cugcucuccccacccaga

SEQ ID NO: 856425 - RNA, 14 nt, Homo sapiens
cugcugguucucau

SEQ ID NO: 856426 - RNA, 22 nt, Homo sapiens
cugcuuaguacauuugaugcaa

SEQ ID NO: 856427 - RNA, 19 nt, Homo sapiens
cugcuuaucagugugcaau

SEQ ID NO: 856428 - RNA, 14 nt, Homo sapiens
cugcuucagccucc

SEQ ID NO: 856429 - RNA, 22 nt, Homo sapiens
cuggagcaauaaaagacaaaug

SEQ ID NO: 856430 - RNA, 12 nt, Homo sapiens
cuggagugaaug

SEQ ID NO: 856431 - RNA, 12 nt, Homo sapiens
cuggagugcagu

SEQ ID NO: 856432 - RNA, 22 nt, Homo sapiens
cuggcauaucucuguucaguua

SEQ ID NO: 856433 - RNA, 16 nt, Homo sapiens
cuggccagccaccacu

SEQ ID NO: 856434 - RNA, 23 nt, Homo sapiens
uagaugugguuaauuuugcauau

SEQ ID NO: 856435 - RNA, 13 nt, Homo sapiens
uagauuuucaccu

SEQ ID NO: 856436 - RNA, 19 nt, Homo sapiens
uagauuuucaccuauccag

SEQ ID NO: 856437 - RNA, 18 nt, Homo sapiens
uagcacugacugaacugu

SEQ ID NO: 856438 - RNA, 18 nt, Homo sapiens
uagcagccuacaacugaa

SEQ ID NO: 856439 - RNA, 20 nt, Homo sapiens
uagccauuucuucuguucua

SEQ ID NO: 856440 - RNA, 14 nt, Homo sapiens
uagcuaauaacaug

SEQ ID NO: 856441 - RNA, 20 nt, Homo sapiens
uagcuaauaacaugugaaaa

SEQ ID NO: 856442 - RNA, 16 nt, Homo sapiens
uagcuacguuuacuca

SEQ ID NO: 856443 - RNA, 13 nt, Homo sapiens
uaggaaaaaaaga

SEQ ID NO: 856444 - RNA, 18 nt, Homo sapiens
uagggccucauuugcucu

SEQ ID NO: 856445 - RNA, 14 nt, Homo sapiens
uaguauugauucaa

SEQ ID NO: 856446 - RNA, 13 nt, Homo sapiens
uagucaaaggcag

SEQ ID NO: 856447 - RNA, 12 nt, Homo sapiens
uagucugcauau

SEQ ID NO: 856448 - RNA, 13 nt, Homo sapiens
uagugcuacagaa

SEQ ID NO: 856449 - RNA, 16 nt, Homo sapiens
uauaaaauguaucaac

SEQ ID NO: 856450 - RNA, 12 nt, Homo sapiens
uauaaacagcuu

SEQ ID NO: 856451 - RNA, 15 nt, Homo sapiens
uauaaaggggcaaga

SEQ ID NO: 856452 - RNA, 15 nt, Homo sapiens
uauaaaggugugcug

SEQ ID NO: 856453 - RNA, 20 nt, Homo sapiens
uauaaauuuauuuacugcua

SEQ ID NO: 856454 - RNA, 22 nt, Homo sapiens
uauaacuaaacaugauauauca

SEQ ID NO: 856455 - RNA, 15 nt, Homo sapiens
uauagaguguuugua

SEQ ID NO: 856456 - RNA, 13 nt, Homo sapiens
uauagcugcauuu

SEQ ID NO: 856457 - RNA, 15 nt, Homo sapiens
uauauuaaagcauca

SEQ ID NO: 856458 - RNA, 20 nt, Homo sapiens
uauauuccccuaagauuuga

SEQ ID NO: 856459 - RNA, 19 nt, Homo sapiens
uaucacccaggaaucucaa

SEQ ID NO: 856460 - RNA, 22 nt, Homo sapiens
uaucacuguaucaucuuggucu

SEQ ID NO: 856461 - RNA, 23 nt, Homo sapiens
uauccacugauauccaugaugcu

SEQ ID NO: 856462 - RNA, 13 nt, Homo sapiens
uauccagagagua

SEQ ID NO: 856463 - RNA, 16 nt, Homo sapiens
uauccaggaauugaua

SEQ ID NO: 856464 - RNA, 19 nt, Homo sapiens
uaucuuggccuuacuguau

SEQ ID NO: 856465 - RNA, 15 nt, Homo sapiens
uaugaacagacuuuu

SEQ ID NO: 856466 - RNA, 16 nt, Homo sapiens
uaugaagaaucugcuc

SEQ ID NO: 856467 - RNA, 23 nt, Homo sapiens
uaugaugauuugcuuaaauaucc

SEQ ID NO: 856468 - RNA, 22 nt, Homo sapiens
uaugauuaaaaauaucaaauua

SEQ ID NO: 856469 - RNA, 18 nt, Homo sapiens
uauggagguucaaugaga

SEQ ID NO: 856470 - RNA, 14 nt, Homo sapiens
uauggucauuuaaa

SEQ ID NO: 856471 - RNA, 21 nt, Homo sapiens
uauguauucuggguauucuau

SEQ ID NO: 856472 - RNA, 13 nt, Homo sapiens
uaugugaccucac

SEQ ID NO: 856473 - RNA, 19 nt, Homo sapiens
uauguucccccuguuucag

SEQ ID NO: 856474 - RNA, 21 nt, Homo sapiens
uauuacgaaguucaagaucaa

SEQ ID NO: 856475 - RNA, 19 nt, Homo sapiens
uauuacuagacugccacaa

SEQ ID NO: 856476 - RNA, 15 nt, Homo sapiens
uauucagaaaugacu

SEQ ID NO: 856477 - RNA, 14 nt, Homo sapiens
uauucaucauauau

SEQ ID NO: 856478 - RNA, 23 nt, Homo sapiens
uauucuaaaaaaauaaacaaagu

SEQ ID NO: 856479 - RNA, 13 nt, Homo sapiens
uauugaauucuuc

SEQ ID NO: 856480 - RNA, 19 nt, Homo sapiens
uauuguaagaaauacugua

SEQ ID NO: 856481 - RNA, 12 nt, Homo sapiens
uauuuaagcaau

SEQ ID NO: 856482 - RNA, 22 nt, Homo sapiens
uauuuacaacacuuuaaugggu

SEQ ID NO: 856483 - RNA, 14 nt, Homo sapiens
uauuuagacaugua

SEQ ID NO: 856484 - RNA, 23 nt, Homo sapiens
uauuuauuucuuuuuugccaaau

SEQ ID NO: 856485 - RNA, 12 nt, Homo sapiens
uauuucaucuca

SEQ ID NO: 856486 - RNA, 19 nt, Homo sapiens
uauuucuuuuuugccaaau

SEQ ID NO: 856487 - RNA, 17 nt, Homo sapiens
uauuugaaaguucucag

SEQ ID NO: 856488 - RNA, 19 nt, Homo sapiens
uauuuucagaagcugauga

SEQ ID NO: 856489 - RNA, 13 nt, Homo sapiens
uauuuucucucau

SEQ ID NO: 856490 - RNA, 24 nt, Homo sapiens
uauuuuuuaaugcuaaucuuguga

SEQ ID NO: 856491 - RNA, 17 nt, Homo sapiens
ucaaaacaaacauuucu

SEQ ID NO: 856492 - RNA, 22 nt, Homo sapiens
ucaaaagucuggcccacugugc

SEQ ID NO: 856493 - RNA, 11 nt, Homo sapiens
ucaaaauggga

SEQ ID NO: 856494 - RNA, 23 nt, Homo sapiens
ucaaauaugugguccaucucuga

SEQ ID NO: 856495 - RNA, 18 nt, Homo sapiens
ucaaauuaauugugugaa

SEQ ID NO: 856496 - RNA, 16 nt, Homo sapiens
ucaacagcaaguguga

SEQ ID NO: 856497 - RNA, 17 nt, Homo sapiens
ucaacagcaagugugaa

SEQ ID NO: 856498 - RNA, 20 nt, Homo sapiens
ucaacagccauuuaggcaaa

SEQ ID NO: 856499 - RNA, 18 nt, Homo sapiens
ucaaccaacaacaaugug

SEQ ID NO: 856500 - RNA, 18 nt, Homo sapiens
ucaaccugcuguccucca

SEQ ID NO: 856501 - RNA, 14 nt, Homo sapiens
ucaagaauagcauu

SEQ ID NO: 856502 - RNA, 13 nt, Homo sapiens
ucaagcucaaggc

SEQ ID NO: 856503 - RNA, 17 nt, Homo sapiens
ucaaggcaaugggcuac

SEQ ID NO: 856504 - RNA, 15 nt, Homo sapiens
ucaagucuacccuga

SEQ ID NO: 856505 - RNA, 18 nt, Homo sapiens
ucaagucuacccugauca

SEQ ID NO: 856506 - RNA, 15 nt, Homo sapiens
ucaaugucaaugaac

SEQ ID NO: 856507 - RNA, 15 nt, Homo sapiens
ucaauuuaaauaacc

SEQ ID NO: 856508 - RNA, 18 nt, Homo sapiens
ucacagcuaugcaaaaag

SEQ ID NO: 856509 - RNA, 15 nt, Homo sapiens
ucacaugguuacaua

SEQ ID NO: 856510 - RNA, 17 nt, Homo sapiens
ucacaugguuacauauc

SEQ ID NO: 856511 - RNA, 16 nt, Homo sapiens
ucacccaggaaucuca

SEQ ID NO: 856512 - RNA, 17 nt, Homo sapiens
ucacccaggaaucucaa

SEQ ID NO: 856513 - RNA, 18 nt, Homo sapiens
ucaccuaaguacuuaaaa

SEQ ID NO: 856514 - RNA, 22 nt, Homo sapiens
ucaccugucgcacccacuguga

SEQ ID NO: 856515 - RNA, 20 nt, Homo sapiens
ucacuaggccucugaccaca

SEQ ID NO: 856516 - RNA, 22 nt, Homo sapiens
ucacuccaaaccuuacucugag

SEQ ID NO: 856517 - RNA, 18 nt, Homo sapiens
ucacucuaggacucugca

SEQ ID NO: 856518 - RNA, 11 nt, Homo sapiens
ucacucucuuc

SEQ ID NO: 856519 - RNA, 16 nt, Homo sapiens
ucagaaaugacuuuuu

SEQ ID NO: 856520 - RNA, 13 nt, Homo sapiens
ucagaauuauuaa

SEQ ID NO: 856521 - RNA, 15 nt, Homo sapiens
ucagagaaauaaaga

SEQ ID NO: 856522 - RNA, 19 nt, Homo sapiens
ucagagacccuggugcugc

SEQ ID NO: 856523 - RNA, 18 nt, Homo sapiens
ucagagggccucaucuca

SEQ ID NO: 856524 - RNA, 16 nt, Homo sapiens
ucagauguuuaaaaca

SEQ ID NO: 856525 - RNA, 16 nt, Homo sapiens
ucagcccccaggauug

SEQ ID NO: 856526 - RNA, 19 nt, Homo sapiens
ucagcccucucuugccaaa

SEQ ID NO: 856527 - RNA, 20 nt, Homo sapiens
ucagcugccuggaggccaga

SEQ ID NO: 856528 - RNA, 19 nt, Homo sapiens
ucaggaccccugcauuuac

SEQ ID NO: 856529 - RNA, 20 nt, Homo sapiens
ucagggguacacagagcuaa

SEQ ID NO: 856530 - RNA, 20 nt, Homo sapiens
ucaggugccgggcgcaggaa

SEQ ID NO: 856531 - RNA, 23 nt, Homo sapiens
ucaggugccgggcgcaggaacug

SEQ ID NO: 856532 - RNA, 17 nt, Homo sapiens
ucagucgcuagcauuuc

SEQ ID NO: 856533 - RNA, 20 nt, Homo sapiens
ucaguggcuuggacucuuuc

SEQ ID NO: 856534 - RNA, 19 nt, Homo sapiens
ucaguucauuuaaaaaaga

SEQ ID NO: 856535 - RNA, 22 nt, Homo sapiens
ucauaacaacuuaugacuaaaa

SEQ ID NO: 856536 - RNA, 21 nt, Homo sapiens
ucauaaugaauaaagugcaaa

SEQ ID NO: 856537 - RNA, 12 nt, Homo sapiens
ucauagugauag

SEQ ID NO: 856538 - RNA, 21 nt, Homo sapiens
ucauagugauagagugcagug

SEQ ID NO: 856539 - RNA, 20 nt, Homo sapiens
ucauauuuuaaacagaggau

SEQ ID NO: 856540 - RNA, 14 nt, Homo sapiens
ucaucagaacagcu

SEQ ID NO: 856541 - RNA, 15 nt, Homo sapiens
ucaucagaacagcug

SEQ ID NO: 856542 - RNA, 16 nt, Homo sapiens
ucaucucaagcuugcu

SEQ ID NO: 856543 - RNA, 17 nt, Homo sapiens
ucaucugagaaugaaca

SEQ ID NO: 856544 - RNA, 18 nt, Homo sapiens
ucaugcuagccucacgaa

SEQ ID NO: 856545 - RNA, 11 nt, Homo sapiens
ucauguaaaaa

SEQ ID NO: 856546 - RNA, 18 nt, Homo sapiens
ucauguaaaaagugcagu

SEQ ID NO: 856547 - RNA, 14 nt, Homo sapiens
ucauguuaugcauu

SEQ ID NO: 856548 - RNA, 11 nt, Homo sapiens
ucauucacaga

SEQ ID NO: 856549 - RNA, 23 nt, Homo sapiens
uccaaaccuuacucugagcucau

SEQ ID NO: 856550 - RNA, 16 nt, Homo sapiens
uccaacacaucucccu

SEQ ID NO: 856551 - RNA, 21 nt, Homo sapiens
uccaaggaaauaaugugaaug

SEQ ID NO: 856552 - RNA, 20 nt, Homo sapiens
uccaauuuuuuaagugaaaa

SEQ ID NO: 856553 - RNA, 18 nt, Homo sapiens
uccacauauuucagugag

SEQ ID NO: 856554 - RNA, 23 nt, Homo sapiens
uccacauggguacugucucggca

SEQ ID NO: 856555 - RNA, 15 nt, Homo sapiens
uccaccuuucaggag

SEQ ID NO: 856556 - RNA, 22 nt, Homo sapiens
uccacuuggagcuaaaacuggc

SEQ ID NO: 856557 - RNA, 23 nt, Homo sapiens
uccagaaaucugcugcauuucac

SEQ ID NO: 856558 - RNA, 16 nt, Homo sapiens
uccagaaugaagaauu

SEQ ID NO: 856559 - RNA, 14 nt, Homo sapiens
uccagcucaaggga

SEQ ID NO: 856560 - RNA, 21 nt, Homo sapiens
uccaguagggcaggcagucag

SEQ ID NO: 856561 - RNA, 15 nt, Homo sapiens
cagauucaggcauuu

SEQ ID NO: 856562 - RNA, 17 nt, Homo sapiens
cagcaacacacaugcuc

SEQ ID NO: 856563 - RNA, 13 nt, Homo sapiens
cagcaaggccacc

SEQ ID NO: 856564 - RNA, 15 nt, Homo sapiens
cagcacccauccacc

SEQ ID NO: 856565 - RNA, 22 nt, Homo sapiens
cagcaggggccaagcaggcacu

SEQ ID NO: 856566 - RNA, 16 nt, Homo sapiens
cagcaguuucagguag

SEQ ID NO: 856567 - RNA, 20 nt, Homo sapiens
cagcauuagugggaaaaagu

SEQ ID NO: 856568 - RNA, 14 nt, Homo sapiens
cagccacauuucag

SEQ ID NO: 856569 - RNA, 14 nt, Homo sapiens
cagcccauaauuca

SEQ ID NO: 856570 - RNA, 18 nt, Homo sapiens
cagcccuuucagcugcag

SEQ ID NO: 856571 - RNA, 20 nt, Homo sapiens
cagccucucugcacacuaau

SEQ ID NO: 856572 - RNA, 17 nt, Homo sapiens
cagccugccucugccac

SEQ ID NO: 856573 - RNA, 18 nt, Homo sapiens
cagcucugugccaccucc

SEQ ID NO: 856574 - RNA, 18 nt, Homo sapiens
cagcugaggagcugugag

SEQ ID NO: 856575 - RNA, 15 nt, Homo sapiens
cagcuuccaugcuga

SEQ ID NO: 856576 - RNA, 22 nt, Homo sapiens
caggaagaaagggaaauugcag

SEQ ID NO: 856577 - RNA, 16 nt, Homo sapiens
caggaagaaggacuug

SEQ ID NO: 856578 - RNA, 17 nt, Homo sapiens
caggaaggacuucuucc

SEQ ID NO: 856579 - RNA, 23 nt, Homo sapiens
uugcauuuuugcaggagcaguau

SEQ ID NO: 856580 - RNA, 21 nt, Homo sapiens
uugcccaggcuggagugcagu

SEQ ID NO: 856581 - RNA, 18 nt, Homo sapiens
uugccgaauuuacuugua

SEQ ID NO: 856582 - RNA, 18 nt, Homo sapiens
uugcuaaaaucauccuau

SEQ ID NO: 856583 - RNA, 22 nt, Homo sapiens
uugcuaaguggccggaaaacaa

SEQ ID NO: 856584 - RNA, 23 nt, Homo sapiens
uugcuagcacaauguguguugcu

SEQ ID NO: 856585 - RNA, 23 nt, Homo sapiens
uugcucuuucucuuccuuugguu

SEQ ID NO: 856586 - RNA, 14 nt, Homo sapiens
uugcugcuaaaggu

SEQ ID NO: 856587 - RNA, 14 nt, Homo sapiens
uugcuguaccacaa

SEQ ID NO: 856588 - RNA, 23 nt, Homo sapiens
uugcuguuuaaaaguaaugcaau

SEQ ID NO: 856589 - RNA, 17 nt, Homo sapiens
uuggacucugagcucau

SEQ ID NO: 856590 - RNA, 19 nt, Homo sapiens
uuggagcuaaaacuggccc

SEQ ID NO: 856591 - RNA, 23 nt, Homo sapiens
uuggagcuaaaacuggcccuguu

SEQ ID NO: 856592 - RNA, 20 nt, Homo sapiens
uuggauucagaaccaagacc

SEQ ID NO: 856593 - RNA, 13 nt, Homo sapiens
uuggccuuaagga

SEQ ID NO: 856594 - RNA, 15 nt, Homo sapiens
uuggccuuacuguau

SEQ ID NO: 856595 - RNA, 14 nt, Homo sapiens
uuggugagucugug

SEQ ID NO: 856596 - RNA, 15 nt, Homo sapiens
uuguaauaauaaaga

SEQ ID NO: 856597 - RNA, 11 nt, Homo sapiens
uuguacuuuga

SEQ ID NO: 856598 - RNA, 20 nt, Homo sapiens
uuguauaaauuuauuuacug

SEQ ID NO: 856599 - RNA, 20 nt, Homo sapiens
uuguauuuuuuaaugcuaau

SEQ ID NO: 856600 - RNA, 18 nt, Homo sapiens
uugugaacaagucccugu

SEQ ID NO: 856601 - RNA, 19 nt, Homo sapiens
uugugaauaguaagcauaa

SEQ ID NO: 856602 - RNA, 17 nt, Homo sapiens
uugugguuucucuggcc

SEQ ID NO: 856603 - RNA, 21 nt, Homo sapiens
uugugguuucucuggcccuga

SEQ ID NO: 856604 - RNA, 22 nt, Homo sapiens
uuguuaagaggauagauuucau

SEQ ID NO: 856605 - RNA, 21 nt, Homo sapiens
uuguuagcauuuucaauguga

SEQ ID NO: 856606 - RNA, 13 nt, Homo sapiens
uuguucuugauag

SEQ ID NO: 856607 - RNA, 15 nt, Homo sapiens
uuuaaaaaagauauc

SEQ ID NO: 856608 - RNA, 20 nt, Homo sapiens
uuuaaaaaagcauagucuua

SEQ ID NO: 856609 - RNA, 17 nt, Homo sapiens
uuuaaaaaucugccacc

SEQ ID NO: 856610 - RNA, 17 nt, Homo sapiens
aagauuauaggaacuga

SEQ ID NO: 856611 - RNA, 14 nt, Homo sapiens
aagauuuccaagaa

SEQ ID NO: 856612 - RNA, 17 nt, Homo sapiens
aagcaauaaaacugcua

SEQ ID NO: 856613 - RNA, 15 nt, Homo sapiens
aagcaucucugacca

SEQ ID NO: 856614 - RNA, 21 nt, Homo sapiens
aagcgagucacgaaugauuaa

SEQ ID NO: 856615 - RNA, 14 nt, Homo sapiens
aagcugaggcugcu

SEQ ID NO: 856616 - RNA, 20 nt, Homo sapiens
aagcugcggcccugaucucc

SEQ ID NO: 856617 - RNA, 17 nt, Homo sapiens
aagcuuuuccuaauaaa

SEQ ID NO: 856618 - RNA, 17 nt, Homo sapiens
aaggaaacaaacucuca

SEQ ID NO: 856619 - RNA, 14 nt, Homo sapiens
aaggagacuucugu

SEQ ID NO: 856620 - RNA, 15 nt, Homo sapiens
aaggauacaggcugg

SEQ ID NO: 856621 - RNA, 12 nt, Homo sapiens
aaggauccagac

SEQ ID NO: 856622 - RNA, 18 nt, Homo sapiens
aaggauccagacucucau

SEQ ID NO: 856623 - RNA, 22 nt, Homo sapiens
aaggauccagacucucauuccu

SEQ ID NO: 856624 - RNA, 17 nt, Homo sapiens
ugauuuugaccuuguau

SEQ ID NO: 856625 - RNA, 16 nt, Homo sapiens
ugcaaagccaccaaca

SEQ ID NO: 856626 - RNA, 22 nt, Homo sapiens
ugcaaagccaccaacagccacu

SEQ ID NO: 856627 - RNA, 14 nt, Homo sapiens
ugcaauucucuggc

SEQ ID NO: 856628 - RNA, 22 nt, Homo sapiens
ugcacacuaauaaaacaugugg

SEQ ID NO: 856629 - RNA, 18 nt, Homo sapiens
ugcacgcugggcaaugag

SEQ ID NO: 856630 - RNA, 20 nt, Homo sapiens
ugcacugcaaugccaggugg

SEQ ID NO: 856631 - RNA, 13 nt, Homo sapiens
ugcacuguagauu

SEQ ID NO: 856632 - RNA, 16 nt, Homo sapiens
ugcacuguagauuuaa

SEQ ID NO: 856633 - RNA, 22 nt, Homo sapiens
ugcagaugcguccgaagggaaa

SEQ ID NO: 856634 - RNA, 14 nt, Homo sapiens
ugcaggugcuuuua

SEQ ID NO: 856635 - RNA, 17 nt, Homo sapiens
ugcagucacuuugacag

SEQ ID NO: 856636 - RNA, 18 nt, Homo sapiens
ugcagugauguuugccau

SEQ ID NO: 856637 - RNA, 19 nt, Homo sapiens
ugcauauccuuuuagucug

SEQ ID NO: 856638 - RNA, 15 nt, Homo sapiens
ugcauccccuuccag

SEQ ID NO: 856639 - RNA, 18 nt, Homo sapiens
ugcauugaauacucugaa

SEQ ID NO: 856640 - RNA, 18 nt, Homo sapiens
ugccagacgcucauucag

SEQ ID NO: 856641 - RNA, 20 nt, Homo sapiens
ugccaggauugucacuccaa

SEQ ID NO: 856642 - RNA, 20 nt, Homo sapiens
ugccauuaagcucacaauaa

SEQ ID NO: 856643 - RNA, 20 nt, Homo sapiens
ugcccagguggcuguggaau

SEQ ID NO: 856644 - RNA, 23 nt, Homo sapiens
ugccccaggcugcggcuugccca

SEQ ID NO: 856645 - RNA, 14 nt, Homo sapiens
ugcccgccaccaca

SEQ ID NO: 856646 - RNA, 15 nt, Homo sapiens
ugccucagcuucccc

SEQ ID NO: 856647 - RNA, 12 nt, Homo sapiens
ugccucugccac

SEQ ID NO: 856648 - RNA, 17 nt, Homo sapiens
ugccucugccacagcaa

SEQ ID NO: 856649 - RNA, 11 nt, Homo sapiens
ugccugcugaa

SEQ ID NO: 856650 - RNA, 14 nt, Homo sapiens
ugcuaacaggauau

SEQ ID NO: 856651 - RNA, 21 nt, Homo sapiens
uuuaaagaauucuuuuuacau

SEQ ID NO: 856652 - RNA, 17 nt, Homo sapiens
uuuaaaguauacucuua

SEQ ID NO: 856653 - RNA, 17 nt, Homo sapiens
uuuaaauuauacaauga

SEQ ID NO: 856654 - RNA, 16 nt, Homo sapiens
uuuaaccauuccauaa

SEQ ID NO: 856655 - RNA, 14 nt, Homo sapiens
uuuaaucucuaaca

SEQ ID NO: 856656 - RNA, 15 nt, Homo sapiens
uuuacaucuauccca

SEQ ID NO: 856657 - RNA, 19 nt, Homo sapiens
uuuaccccaccuuccuggg

SEQ ID NO: 856658 - RNA, 11 nt, Homo sapiens
uuuaccugcac

SEQ ID NO: 856659 - RNA, 14 nt, Homo sapiens
uuuacugacugcuu

SEQ ID NO: 856660 - RNA, 11 nt, Homo sapiens
uuuacuuggaa

SEQ ID NO: 856661 - RNA, 14 nt, Homo sapiens
uuuagaugcauauu

SEQ ID NO: 856662 - RNA, 15 nt, Homo sapiens
uuuaguaaguguucu

SEQ ID NO: 856663 - RNA, 17 nt, Homo sapiens
uuuaguucugacuuuga

SEQ ID NO: 856664 - RNA, 13 nt, Homo sapiens
uuuauauguggaa

SEQ ID NO: 856665 - RNA, 22 nt, Homo sapiens
uuuauugagguauaauucaccc

SEQ ID NO: 856666 - RNA, 14 nt, Homo sapiens
uuuauuuucacagc

SEQ ID NO: 856667 - RNA, 18 nt, Homo sapiens
uuucaacuucaucucaau

SEQ ID NO: 856668 - RNA, 19 nt, Homo sapiens
uuucaauuuaucaaucucu

SEQ ID NO: 856669 - RNA, 17 nt, Homo sapiens
uuucaccauguuggcca

SEQ ID NO: 856670 - RNA, 18 nt, Homo sapiens
uuucaccuauccagagag

SEQ ID NO: 856671 - RNA, 11 nt, Homo sapiens
uuucaggagac

SEQ ID NO: 856672 - RNA, 22 nt, Homo sapiens
uuucagugcauuaucuacuugu

SEQ ID NO: 856673 - RNA, 17 nt, Homo sapiens
uuucauguuaugcauuu

SEQ ID NO: 856674 - RNA, 23 nt, Homo sapiens
uuucccuguagauguaucaaaau

SEQ ID NO: 856675 - RNA, 14 nt, Homo sapiens
uuuccuuucuuagc

SEQ ID NO: 856676 - RNA, 16 nt, Homo sapiens
uuucuaauuggcuuua

SEQ ID NO: 856677 - RNA, 12 nt, Homo sapiens
uuucuacuuuga

SEQ ID NO: 856678 - RNA, 12 nt, Homo sapiens
uuucuagaagac

SEQ ID NO: 856679 - RNA, 19 nt, Homo sapiens
uuucuauuucucuccuuaa

SEQ ID NO: 856680 - RNA, 15 nt, Homo sapiens
uuucucugcacacaa

SEQ ID NO: 856681 - RNA, 15 nt, Homo sapiens
uuucucuggcccuga

SEQ ID NO: 856682 - RNA, 16 nt, Homo sapiens
uuucugaguaccauua

SEQ ID NO: 856683 - RNA, 12 nt, Homo sapiens
uuucugccaggg

SEQ ID NO: 856684 - RNA, 21 nt, Homo sapiens
uuucuguguaccacugggaua

SEQ ID NO: 856685 - RNA, 14 nt, Homo sapiens
uuugaaaguacucc

SEQ ID NO: 856686 - RNA, 16 nt, Homo sapiens
uuugacuuucugugua

SEQ ID NO: 856687 - RNA, 12 nt, Homo sapiens
uuugaugcauua

SEQ ID NO: 856688 - RNA, 22 nt, Homo sapiens
uuugccagaagacuaccuuaca

SEQ ID NO: 856689 - RNA, 21 nt, Homo sapiens
uuugccaugugcuucugccac

SEQ ID NO: 856690 - RNA, 14 nt, Homo sapiens
uuugcuagcacaau

SEQ ID NO: 856691 - RNA, 18 nt, Homo sapiens
uuugcuuuucuuugcuag

SEQ ID NO: 856692 - RNA, 14 nt, Homo sapiens
uuuggccagaacac

SEQ ID NO: 856693 - RNA, 22 nt, Homo sapiens
uuuggcccugaaccagggccag

SEQ ID NO: 856694 - RNA, 21 nt, Homo sapiens
uuuggggaccauaucaggaga

SEQ ID NO: 856695 - RNA, 20 nt, Homo sapiens
uuuguuaaaaacacugcuga

SEQ ID NO: 856696 - RNA, 12 nt, Homo sapiens
uuuuacugcuuu

SEQ ID NO: 856697 - RNA, 22 nt, Homo sapiens
uuuuaguuccuucuauacaugu

SEQ ID NO: 856698 - RNA, 18 nt, Homo sapiens
uuuuccaaacacaggcaa

SEQ ID NO: 856699 - RNA, 22 nt, Homo sapiens
uuuucuagcuauagugucucga

SEQ ID NO: 856700 - RNA, 21 nt, Homo sapiens
uuuugucuugcgggucuguca

SEQ ID NO: 856701 - RNA, 17 nt, Homo sapiens
uuuuuaaaaaguguuua

SEQ ID NO: 856702 - RNA, 12 nt, Homo sapiens
uuuuuaaugucu

SEQ ID NO: 856703 - RNA, 18 nt, Homo sapiens
uuuuuccagauuugcuca

SEQ ID NO: 856704 - RNA, 12 nt, Homo sapiens
uuuuuccugcau

SEQ ID NO: 856705 - RNA, 21 nt, Homo sapiens
uuuuucugcuuuagacuugaa

SEQ ID NO: 856706 - RNA, 21 nt, Homo sapiens
uuuuucuguaucccgcuguaa

SEQ ID NO: 856707 - RNA, 11 nt, Homo sapiens
cuaacaaaguu

SEQ ID NO: 856708 - RNA, 15 nt, Homo sapiens
cuaacaacauuguag

SEQ ID NO: 856709 - RNA, 20 nt, Homo sapiens
cuaacguuuucuacuuugaa

SEQ ID NO: 856710 - RNA, 18 nt, Homo sapiens
cuaacuccugccuaugac

SEQ ID NO: 856711 - RNA, 13 nt, Homo sapiens
cuaagaugcauuu

SEQ ID NO: 856712 - RNA, 17 nt, Homo sapiens
cuaaggccaaugggcua

SEQ ID NO: 856713 - RNA, 19 nt, Homo sapiens
cuaaggggccccuccuugu

SEQ ID NO: 856714 - RNA, 16 nt, Homo sapiens
cuaauaacaugugaaa

SEQ ID NO: 856715 - RNA, 17 nt, Homo sapiens
cuacacacaccagaugg

SEQ ID NO: 856716 - RNA, 23 nt, Homo sapiens
cuacacgguucaaaccugugaag

SEQ ID NO: 856717 - RNA, 22 nt, Homo sapiens
cuacagccucccuggcuacaug

SEQ ID NO: 856718 - RNA, 14 nt, Homo sapiens
cuacaguaagcugg

SEQ ID NO: 856719 - RNA, 23 nt, Homo sapiens
cuaccuaacccagaaaaucugaa

SEQ ID NO: 856720 - RNA, 21 nt, Homo sapiens
cuacuuuugcuaagaugcauu

SEQ ID NO: 856721 - RNA, 13 nt, Homo sapiens
cuagaaucagaua

SEQ ID NO: 856722 - RNA, 20 nt, Homo sapiens
cuagauaugaagaaucugcu

SEQ ID NO: 856723 - RNA, 22 nt, Homo sapiens
cuagcauuucccaacacaaaga

SEQ ID NO: 856724 - RNA, 18 nt, Homo sapiens
cuaguaauguagauuuac

SEQ ID NO: 856725 - RNA, 13 nt, Homo sapiens
cuagugcugugaa

SEQ ID NO: 856726 - RNA, 15 nt, Homo sapiens
cuauaaaauguauca

SEQ ID NO: 856727 - RNA, 20 nt, Homo sapiens
cuauauucuggugaguuaau

SEQ ID NO: 856728 - RNA, 17 nt, Homo sapiens
cuaucaaaaagauauca

SEQ ID NO: 856729 - RNA, 23 nt, Homo sapiens
cuaucaaaaagauaucaaaggca

SEQ ID NO: 856730 - RNA, 16 nt, Homo sapiens
cuaucugugccucuuc

SEQ ID NO: 856731 - RNA, 17 nt, Homo sapiens
cuaugacggugacucuu

SEQ ID NO: 856732 - RNA, 18 nt, Homo sapiens
cuauuuacaaggaugaaa

SEQ ID NO: 856733 - RNA, 17 nt, Homo sapiens
cuauuucccuugccuca

SEQ ID NO: 856734 - RNA, 18 nt, Homo sapiens
cucaaaccccugaccuca

SEQ ID NO: 856735 - RNA, 23 nt, Homo sapiens
cucaaacuccugaccuugugauu

SEQ ID NO: 856736 - RNA, 18 nt, Homo sapiens
cucaaggcaaugggcuac

SEQ ID NO: 856737 - RNA, 21 nt, Homo sapiens
cucaaugcuuuccacauuucu

SEQ ID NO: 856738 - RNA, 22 nt, Homo sapiens
cucacucucaggaaaugcugac

SEQ ID NO: 856739 - RNA, 22 nt, Homo sapiens
cucacuguguggccucagagaa

SEQ ID NO: 856740 - RNA, 21 nt, Homo sapiens
cucagcggagccgcagacugu

SEQ ID NO: 856741 - RNA, 23 nt, Homo sapiens
cucaucuaacaaacacaauccau

SEQ ID NO: 856742 - RNA, 14 nt, Homo sapiens
cuccauacuuugaa

SEQ ID NO: 856743 - RNA, 19 nt, Homo sapiens
cucccacagugcugggauu

SEQ ID NO: 856744 - RNA, 15 nt, Homo sapiens
cucccacccuacccc

SEQ ID NO: 856745 - RNA, 22 nt, Homo sapiens
cuccccauuggugcuaccuggc

SEQ ID NO: 856746 - RNA, 15 nt, Homo sapiens
cuccccuggggagcc

SEQ ID NO: 856747 - RNA, 14 nt, Homo sapiens
cucccucccagcuc

SEQ ID NO: 856748 - RNA, 15 nt, Homo sapiens
cucccuuuccuauau

SEQ ID NO: 856749 - RNA, 16 nt, Homo sapiens
cuccugugcuggugac

SEQ ID NO: 856750 - RNA, 14 nt, Homo sapiens
cucgagucugaggc

SEQ ID NO: 856751 - RNA, 14 nt, Homo sapiens
cucgcuacauuucc

SEQ ID NO: 856752 - RNA, 19 nt, Homo sapiens
cucgcugacaucuggggcu

SEQ ID NO: 856753 - RNA, 17 nt, Homo sapiens
cucggccugggauuuca

SEQ ID NO: 856754 - RNA, 20 nt, Homo sapiens
cucguccucacuggucuaca

SEQ ID NO: 856755 - RNA, 18 nt, Homo sapiens
cucuauuuagaugcauau

SEQ ID NO: 856756 - RNA, 13 nt, Homo sapiens
cucucugggaugc

SEQ ID NO: 856757 - RNA, 20 nt, Homo sapiens
cucugauguucuuccaguga

SEQ ID NO: 856758 - RNA, 17 nt, Homo sapiens
cucugcuggacguccag

SEQ ID NO: 856759 - RNA, 20 nt, Homo sapiens
cucugcuuaguacauuugau

SEQ ID NO: 856760 - RNA, 17 nt, Homo sapiens
cucuggcccacucauga

SEQ ID NO: 856761 - RNA, 14 nt, Homo sapiens
cucuggcccaguga

SEQ ID NO: 856762 - RNA, 22 nt, Homo sapiens
cucuguauuuuuuaaaacauca

SEQ ID NO: 856763 - RNA, 19 nt, Homo sapiens
cucugugcagggcacagaa

SEQ ID NO: 856764 - RNA, 17 nt, Homo sapiens
cucuuuaacaugguuca

SEQ ID NO: 856765 - RNA, 17 nt, Homo sapiens
cugaaagaauaggauua

SEQ ID NO: 856766 - RNA, 20 nt, Homo sapiens
cugaaauaaagcacauucca

SEQ ID NO: 856767 - RNA, 17 nt, Homo sapiens
cugaaccagcacuaauc

SEQ ID NO: 856768 - RNA, 23 nt, Homo sapiens
cugaacccagaaacaacacaauc

SEQ ID NO: 856769 - RNA, 17 nt, Homo sapiens
cugaacguuugguucaa

SEQ ID NO: 856770 - RNA, 23 nt, Homo sapiens
cugaaucuggaccccaucuguga

SEQ ID NO: 856771 - RNA, 15 nt, Homo sapiens
cugaccuuaaaugca

SEQ ID NO: 856772 - RNA, 17 nt, Homo sapiens
cugaccuuaaaugcaac

SEQ ID NO: 856773 - RNA, 14 nt, Homo sapiens
cugacuccaagagg

SEQ ID NO: 856774 - RNA, 22 nt, Homo sapiens
cugagaucaaaaaaauauauga

SEQ ID NO: 856775 - RNA, 15 nt, Homo sapiens
cugagccgcagagaa

SEQ ID NO: 856776 - RNA, 18 nt, Homo sapiens
cugauucuaaaaugucuc

SEQ ID NO: 856777 - RNA, 14 nt, Homo sapiens
cugcacacuaauaa

SEQ ID NO: 856778 - RNA, 13 nt, Homo sapiens
cugcacccaugag

SEQ ID NO: 856779 - RNA, 14 nt, Homo sapiens
cugcacccaugaga

SEQ ID NO: 856780 - RNA, 21 nt, Homo sapiens
cugcacuugggggcucagcaa

SEQ ID NO: 856781 - RNA, 14 nt, Homo sapiens
cugcagacuauaaa

SEQ ID NO: 856782 - RNA, 21 nt, Homo sapiens
cugcagggcugggucaggggu

SEQ ID NO: 856783 - RNA, 15 nt, Homo sapiens
cugcaggugggauga

SEQ ID NO: 856784 - RNA, 13 nt, Homo sapiens
cugcaguccagua

SEQ ID NO: 856785 - RNA, 14 nt, Homo sapiens
cugcauaguuccca

SEQ ID NO: 856786 - RNA, 13 nt, Homo sapiens
cugccaccugcac

SEQ ID NO: 856787 - RNA, 18 nt, Homo sapiens
cugccagaagacucacug

SEQ ID NO: 856788 - RNA, 16 nt, Homo sapiens
cugccaggcacaggca

SEQ ID NO: 856789 - RNA, 21 nt, Homo sapiens
cugccccuaacuccugccuau

SEQ ID NO: 856790 - RNA, 19 nt, Homo sapiens
cugccucugacuccaagag

SEQ ID NO: 856791 - RNA, 15 nt, Homo sapiens
cugccucugccacag

SEQ ID NO: 856792 - RNA, 13 nt, Homo sapiens
cugcgccugggau

SEQ ID NO: 856793 - RNA, 17 nt, Homo sapiens
cugcgccugggaucucg

SEQ ID NO: 856794 - RNA, 19 nt, Homo sapiens
cugcucaagucuacccuga

SEQ ID NO: 856795 - RNA, 23 nt, Homo sapiens
cugcucagaaucugauaccaaag

SEQ ID NO: 856796 - RNA, 20 nt, Homo sapiens
cugcuccauuucgugacuuu

SEQ ID NO: 856797 - RNA, 22 nt, Homo sapiens
cugcucuaauugcugccaggau

SEQ ID NO: 856798 - RNA, 18 nt, Homo sapiens
cugcucucuuaugucaca

SEQ ID NO: 856799 - RNA, 23 nt, Homo sapiens
cugcuuaguacauuugaugcaaa

SEQ ID NO: 856800 - RNA, 13 nt, Homo sapiens
cugcuuaugagca

SEQ ID NO: 856801 - RNA, 22 nt, Homo sapiens
cugcuugaauaaacaccacugg

SEQ ID NO: 856802 - RNA, 17 nt, Homo sapiens
cugcuugggacccuagc

SEQ ID NO: 856803 - RNA, 16 nt, Homo sapiens
cugcuuuagacuugaa

SEQ ID NO: 856804 - RNA, 21 nt, Homo sapiens
cugcuuuauaauccuugucag

SEQ ID NO: 856805 - RNA, 15 nt, Homo sapiens
cuggaaauugaaaua

SEQ ID NO: 856806 - RNA, 21 nt, Homo sapiens
cuggaaauugaaauaaagaua

SEQ ID NO: 856807 - RNA, 14 nt, Homo sapiens
cuggaacccaacag

SEQ ID NO: 856808 - RNA, 16 nt, Homo sapiens
cuggaaugagcagcuu

SEQ ID NO: 856809 - RNA, 16 nt, Homo sapiens
cuggagaaaaauaucu

SEQ ID NO: 856810 - RNA, 18 nt, Homo sapiens
cuggagcaauaaaagaca

SEQ ID NO: 856811 - RNA, 23 nt, Homo sapiens
cuggauuguagaacuuguugcug

SEQ ID NO: 856812 - RNA, 14 nt, Homo sapiens
cuggcaagaaccag

SEQ ID NO: 856813 - RNA, 16 nt, Homo sapiens
cuggcacagccugcac

SEQ ID NO: 856814 - RNA, 16 nt, Homo sapiens
cuggcagcccgcauca

SEQ ID NO: 856815 - RNA, 16 nt, Homo sapiens
cuggcccacugugcag

SEQ ID NO: 856816 - RNA, 19 nt, Homo sapiens
cuggcccccacauggugau

SEQ ID NO: 856817 - RNA, 14 nt, Homo sapiens
cuggcucuacacau

SEQ ID NO: 856818 - RNA, 21 nt, Homo sapiens
cuggcuuacacuggcaauggu

SEQ ID NO: 856819 - RNA, 23 nt, Homo sapiens
cuggcuuagggugauacuuuugc

SEQ ID NO: 856820 - RNA, 22 nt, Homo sapiens
cugggauucuagaacugugaau

SEQ ID NO: 856821 - RNA, 16 nt, Homo sapiens
cugggcaauauuuucu

SEQ ID NO: 856822 - RNA, 16 nt, Homo sapiens
cugggcagacugcaaa

SEQ ID NO: 856823 - RNA, 22 nt, Homo sapiens
cugggcaucucugagcaauugu

SEQ ID NO: 856824 - RNA, 16 nt, Homo sapiens
cuggggcuuugccauu

SEQ ID NO: 856825 - RNA, 14 nt, Homo sapiens
cuggguagcuguaa

SEQ ID NO: 856826 - RNA, 18 nt, Homo sapiens
cugguaaauugccauggc

SEQ ID NO: 856827 - RNA, 23 nt, Homo sapiens
cuggucauacauaggaugacaaa

SEQ ID NO: 856828 - RNA, 13 nt, Homo sapiens
cuggucauucaca

SEQ ID NO: 856829 - RNA, 13 nt, Homo sapiens
cugguuccaugcc

SEQ ID NO: 856830 - RNA, 14 nt, Homo sapiens
cugguuccaugccu

SEQ ID NO: 856831 - RNA, 15 nt, Homo sapiens
cuguaaauguauuca

SEQ ID NO: 856832 - RNA, 22 nt, Homo sapiens
cuguaaauguauucauucuuaa

SEQ ID NO: 856833 - RNA, 13 nt, Homo sapiens
cuguaagaguguu

SEQ ID NO: 856834 - RNA, 17 nt, Homo sapiens
cuguaaucccagcacuu

SEQ ID NO: 856835 - RNA, 23 nt, Homo sapiens
cuguacaaugacuuuauugcauc

SEQ ID NO: 856836 - RNA, 11 nt, Homo sapiens
cuguaccacaa

SEQ ID NO: 856837 - RNA, 18 nt, Homo sapiens
cuguaccacaaugcgcau

SEQ ID NO: 856838 - RNA, 14 nt, Homo sapiens
cuguagaggcaguu

SEQ ID NO: 856839 - RNA, 17 nt, Homo sapiens
gacauuaaaauaacuaa

SEQ ID NO: 856840 - RNA, 21 nt, Homo sapiens
gacauuucaaauaacugcaga

SEQ ID NO: 856841 - RNA, 17 nt, Homo sapiens
gaccacacgcaguauug

SEQ ID NO: 856842 - RNA, 16 nt, Homo sapiens
gaccagagggacacua

SEQ ID NO: 856843 - RNA, 20 nt, Homo sapiens
gaccagagggacacuaggaa

SEQ ID NO: 856844 - RNA, 19 nt, Homo sapiens
gaccagccccaccaugcaa

SEQ ID NO: 856845 - RNA, 18 nt, Homo sapiens
gacccaugggcaggagac

SEQ ID NO: 856846 - RNA, 23 nt, Homo sapiens
gaccccugugugacaucacaggg

SEQ ID NO: 856847 - RNA, 22 nt, Homo sapiens
gaccucugccuuuguggugaau

SEQ ID NO: 856848 - RNA, 11 nt, Homo sapiens
gaccugcaaac

SEQ ID NO: 856849 - RNA, 19 nt, Homo sapiens
gaccugggagcccucggga

SEQ ID NO: 856850 - RNA, 13 nt, Homo sapiens
gaccuuaaaugca

SEQ ID NO: 856851 - RNA, 22 nt, Homo sapiens
gacuaaaaauaucacacugaau

SEQ ID NO: 856852 - RNA, 12 nt, Homo sapiens
gacucacugugu

SEQ ID NO: 856853 - RNA, 18 nt, Homo sapiens
gacuccaagagggugaag

SEQ ID NO: 856854 - RNA, 22 nt, Homo sapiens
gacuccucucguacuugaacuc

SEQ ID NO: 856855 - RNA, 17 nt, Homo sapiens
gacucuaguacugugaa

SEQ ID NO: 856856 - RNA, 18 nt, Homo sapiens
gacucuaguacugugaau

SEQ ID NO: 856857 - RNA, 13 nt, Homo sapiens
gacucugcacuga

SEQ ID NO: 856858 - RNA, 17 nt, Homo sapiens
gacucugucuggccagg

SEQ ID NO: 856859 - RNA, 15 nt, Homo sapiens
gacugaaaaugaacu

SEQ ID NO: 856860 - RNA, 14 nt, Homo sapiens
gacugccacaagga

SEQ ID NO: 856861 - RNA, 17 nt, Homo sapiens
gacuggauguaccacca

SEQ ID NO: 856862 - RNA, 20 nt, Homo sapiens
gacugggcaucucugagcaa

SEQ ID NO: 856863 - RNA, 17 nt, Homo sapiens
gacuuaacauagccaaa

SEQ ID NO: 856864 - RNA, 13 nt, Homo sapiens
gacuugcacaaau

SEQ ID NO: 856865 - RNA, 20 nt, Homo sapiens
gacuuucuguguaccacugg

SEQ ID NO: 856866 - RNA, 19 nt, Homo sapiens
gacuuugccaaaaagcaua

SEQ ID NO: 856867 - RNA, 18 nt, Homo sapiens
gagaaagaaaaccuggag

SEQ ID NO: 856868 - RNA, 18 nt, Homo sapiens
gagaauagaaauuugccc

SEQ ID NO: 856869 - RNA, 18 nt, Homo sapiens
gagacccuagaugugcuc

SEQ ID NO: 856870 - RNA, 17 nt, Homo sapiens
gagacccuggugcugcc

SEQ ID NO: 856871 - RNA, 16 nt, Homo sapiens
gagacugggcaucucu

SEQ ID NO: 856872 - RNA, 17 nt, Homo sapiens
gagacugggcaucucug

SEQ ID NO: 856873 - RNA, 19 nt, Homo sapiens
gagacuguggagacugcuc

SEQ ID NO: 856874 - RNA, 14 nt, Homo sapiens
gagagccugugauc

SEQ ID NO: 856875 - RNA, 16 nt, Homo sapiens
gagagggucacugggg

SEQ ID NO: 856876 - RNA, 11 nt, Homo sapiens
gagcauugcag

SEQ ID NO: 856877 - RNA, 16 nt, Homo sapiens
gagccuggaacugacc

SEQ ID NO: 856878 - RNA, 17 nt, Homo sapiens
gagcguuagaggggcca

SEQ ID NO: 856879 - RNA, 14 nt, Homo sapiens
gagcuagaacauuc

SEQ ID NO: 856880 - RNA, 16 nt, Homo sapiens
gagcucuggcugucuc

SEQ ID NO: 856881 - RNA, 21 nt, Homo sapiens
gagcugaaagaggccaaacag

SEQ ID NO: 856882 - RNA, 21 nt, Homo sapiens
gagcugggccaggccuaagag

SEQ ID NO: 856883 - RNA, 22 nt, Homo sapiens
gaggacagccugccucugccac

SEQ ID NO: 856884 - RNA, 15 nt, Homo sapiens
gaggagcccugccuc

SEQ ID NO: 856885 - RNA, 18 nt, Homo sapiens
gaggcaucucucugggau

SEQ ID NO: 856886 - RNA, 14 nt, Homo sapiens
gaggccacacuaca

SEQ ID NO: 856887 - RNA, 18 nt, Homo sapiens
gagggcauuuggcuuccu

SEQ ID NO: 856888 - RNA, 14 nt, Homo sapiens
gagggccucaucuc

SEQ ID NO: 856889 - RNA, 18 nt, Homo sapiens
gagggcuggucauucaca

SEQ ID NO: 856890 - RNA, 17 nt, Homo sapiens
gaggugaugaagacagc

SEQ ID NO: 856891 - RNA, 17 nt, Homo sapiens
gaguaaucuuguugguu

SEQ ID NO: 856892 - RNA, 20 nt, Homo sapiens
gagucucgcucuguugccca

SEQ ID NO: 856893 - RNA, 19 nt, Homo sapiens
gagucugaggccguugcug

SEQ ID NO: 856894 - RNA, 21 nt, Homo sapiens
gagugccuucauacacuguac

SEQ ID NO: 856895 - RNA, 20 nt, Homo sapiens
gagugggcgugguaccugcu

SEQ ID NO: 856896 - RNA, 23 nt, Homo sapiens
gagugggcuaggaggacaaggac

SEQ ID NO: 856897 - RNA, 14 nt, Homo sapiens
gaguuaaacuuuag

SEQ ID NO: 856898 - RNA, 23 nt, Homo sapiens
gaguuacagccugggcaauaaag

SEQ ID NO: 856899 - RNA, 20 nt, Homo sapiens
gaguugcuaaguggccggaa

SEQ ID NO: 856900 - RNA, 17 nt, Homo sapiens
gaguuuccucgcauuaa

SEQ ID NO: 856901 - RNA, 14 nt, Homo sapiens
gauaaacauuccag

SEQ ID NO: 856902 - RNA, 22 nt, Homo sapiens
gauaagcaguuaugugaccuca

SEQ ID NO: 856903 - RNA, 23 nt, Homo sapiens
gauaagcaguuaugugaccucac

SEQ ID NO: 856904 - RNA, 16 nt, Homo sapiens
gauaaguuuuguuuca

SEQ ID NO: 856905 - RNA, 18 nt, Homo sapiens
gauaauaaucaugaucac

SEQ ID NO: 856906 - RNA, 16 nt, Homo sapiens
gauaauguugucaaga

SEQ ID NO: 856907 - RNA, 14 nt, Homo sapiens
gauacuuuugcccu

SEQ ID NO: 856908 - RNA, 13 nt, Homo sapiens
gauagaggguacu

SEQ ID NO: 856909 - RNA, 13 nt, Homo sapiens
gauauaagcaaaa

SEQ ID NO: 856910 - RNA, 22 nt, Homo sapiens
gauauagaaaggagaccuguau

SEQ ID NO: 856911 - RNA, 16 nt, Homo sapiens
gauauccaugaugcug

SEQ ID NO: 856912 - RNA, 19 nt, Homo sapiens
gauaugaagaaucugcucu

SEQ ID NO: 856913 - RNA, 22 nt, Homo sapiens
gauaugcaaauuccauagcuca

SEQ ID NO: 856914 - RNA, 18 nt, Homo sapiens
gaucagauaauuaugcuu

SEQ ID NO: 856915 - RNA, 22 nt, Homo sapiens
gauccacuuuggcaggagcccu

SEQ ID NO: 856916 - RNA, 13 nt, Homo sapiens
gauccugcacuga

SEQ ID NO: 856917 - RNA, 22 nt, Homo sapiens
gaucgucugguuagaaaacaua

SEQ ID NO: 856918 - RNA, 22 nt, Homo sapiens
gaugaaaauaauuuacugugac

SEQ ID NO: 856919 - RNA, 16 nt, Homo sapiens
gaugaaacaaccguau

SEQ ID NO: 856920 - RNA, 22 nt, Homo sapiens
gaugauauggagguucaaugag

SEQ ID NO: 856921 - RNA, 22 nt, Homo sapiens
gaugauuugcuuaaauauccau

SEQ ID NO: 856922 - RNA, 15 nt, Homo sapiens
gaugcagaacuuccc

SEQ ID NO: 856923 - RNA, 18 nt, Homo sapiens
gaugccauauaguguuau

SEQ ID NO: 856924 - RNA, 16 nt, Homo sapiens
gaugcugauacuucua

SEQ ID NO: 856925 - RNA, 20 nt, Homo sapiens
gauggugaaaaugcacccca

SEQ ID NO: 856926 - RNA, 13 nt, Homo sapiens
gauguauucugug

SEQ ID NO: 856927 - RNA, 14 nt, Homo sapiens
gaugugaucacuuu

SEQ ID NO: 856928 - RNA, 20 nt, Homo sapiens
gauguugacaucacuggcau

SEQ ID NO: 856929 - RNA, 13 nt, Homo sapiens
gauuccucucugu

SEQ ID NO: 856930 - RNA, 17 nt, Homo sapiens
gauucuagaacugugaa

SEQ ID NO: 856931 - RNA, 16 nt, Homo sapiens
gauugcugaauggagu

SEQ ID NO: 856932 - RNA, 14 nt, Homo sapiens
gauugucacuccaa

SEQ ID NO: 856933 - RNA, 22 nt, Homo sapiens
gauuucaaaguccagauaccaa

SEQ ID NO: 856934 - RNA, 11 nt, Homo sapiens
gauuucagagc

SEQ ID NO: 856935 - RNA, 23 nt, Homo sapiens
gcaaaaaaggaugcaacaauucu

SEQ ID NO: 856936 - RNA, 20 nt, Homo sapiens
gcaaauuuuggaccuaaaca

SEQ ID NO: 856937 - RNA, 22 nt, Homo sapiens
gcaacauucguucucuaaccau

SEQ ID NO: 856938 - RNA, 15 nt, Homo sapiens
gcaacgcuccucuga

SEQ ID NO: 856939 - RNA, 14 nt, Homo sapiens
gcaacggcccucca

SEQ ID NO: 856940 - RNA, 20 nt, Homo sapiens
gcaauaaaagacaaaugcaa

SEQ ID NO: 856941 - RNA, 16 nt, Homo sapiens
gcacaaauucaugugc

SEQ ID NO: 856942 - RNA, 15 nt, Homo sapiens
gcacacugaacuguu

SEQ ID NO: 856943 - RNA, 14 nt, Homo sapiens
gcacagaaggcugg

SEQ ID NO: 856944 - RNA, 19 nt, Homo sapiens
gcacauugcauaguaguuu

SEQ ID NO: 856945 - RNA, 21 nt, Homo sapiens
gcaccaggagugccuucauac

SEQ ID NO: 856946 - RNA, 22 nt, Homo sapiens
gcacccgguacaaguggcucau

SEQ ID NO: 856947 - RNA, 15 nt, Homo sapiens
gcacguuuucaucuc

SEQ ID NO: 856948 - RNA, 20 nt, Homo sapiens
gcacugaauggcugaccuga

SEQ ID NO: 856949 - RNA, 15 nt, Homo sapiens
gcacugcucucaccu

SEQ ID NO: 856950 - RNA, 23 nt, Homo sapiens
gcagaaaaaauauuguaguuuga

SEQ ID NO: 856951 - RNA, 21 nt, Homo sapiens
gcagaacagcuucauguuccc

SEQ ID NO: 856952 - RNA, 21 nt, Homo sapiens
gcagaacugcagucacugcac

SEQ ID NO: 856953 - RNA, 23 nt, Homo sapiens
gcagagagggucacugggggaca

SEQ ID NO: 856954 - RNA, 15 nt, Homo sapiens
gcagaggcaggaaac

SEQ ID NO: 856955 - RNA, 14 nt, Homo sapiens
gcagauacacugcu

SEQ ID NO: 856956 - RNA, 20 nt, Homo sapiens
gcagaugcguagcauuugcu

SEQ ID NO: 856957 - RNA, 21 nt, Homo sapiens
gcagccuacaacugaauagca

SEQ ID NO: 856958 - RNA, 14 nt, Homo sapiens
gcagcugucaccac

SEQ ID NO: 856959 - RNA, 23 nt, Homo sapiens
gcaggguauuaacgugucagggc

SEQ ID NO: 856960 - RNA, 21 nt, Homo sapiens
gcagucagguccaugugcacu

SEQ ID NO: 856961 - RNA, 11 nt, Homo sapiens
gcagugucuua

SEQ ID NO: 856962 - RNA, 23 nt, Homo sapiens
gcaguuugaggauuaguuuagaa

SEQ ID NO: 856963 - RNA, 23 nt, Homo sapiens
gcauaaagaauuugucacaggaa

SEQ ID NO: 856964 - RNA, 21 nt, Homo sapiens
gcauccauggggucucucaca

SEQ ID NO: 856965 - RNA, 13 nt, Homo sapiens
gcaucucugacca

SEQ ID NO: 856966 - RNA, 17 nt, Homo sapiens
gcaucuggguagcugua

SEQ ID NO: 856967 - RNA, 18 nt, Homo sapiens
gcaucuggguagcuguaa

SEQ ID NO: 856968 - RNA, 16 nt, Homo sapiens
gcaugcaaauuagaca

SEQ ID NO: 856969 - RNA, 22 nt, Homo sapiens
gcauguuggacucugagcucau

SEQ ID NO: 856970 - RNA, 23 nt, Homo sapiens
ggcccuuuuuuuuuuuucuuugc

SEQ ID NO: 856971 - RNA, 20 nt, Homo sapiens
ggccuucugccugcugacca

SEQ ID NO: 856972 - RNA, 14 nt, Homo sapiens
ggccuuggggacaa

SEQ ID NO: 856973 - RNA, 23 nt, Homo sapiens
ggccuuucccacugguccaucug

SEQ ID NO: 856974 - RNA, 12 nt, Homo sapiens
ggcuagagggug

SEQ ID NO: 856975 - RNA, 23 nt, Homo sapiens
ggcuccacuuggcuccucucacu

SEQ ID NO: 856976 - RNA, 15 nt, Homo sapiens
ggcuccggcacccac

SEQ ID NO: 856977 - RNA, 21 nt, Homo sapiens
ggcucuccugucucugcagcu

SEQ ID NO: 856978 - RNA, 21 nt, Homo sapiens
ggcucuuccucuacagccucc

SEQ ID NO: 856979 - RNA, 17 nt, Homo sapiens
ggcugcggcuugcccag

SEQ ID NO: 856980 - RNA, 18 nt, Homo sapiens
ggcugcuucugccacugc

SEQ ID NO: 856981 - RNA, 19 nt, Homo sapiens
ggcuggccagccaccacug

SEQ ID NO: 856982 - RNA, 18 nt, Homo sapiens
gggaaggcuaucagagac

SEQ ID NO: 856983 - RNA, 21 nt, Homo sapiens
gggagccugaggagcccagcg

SEQ ID NO: 856984 - RNA, 18 nt, Homo sapiens
gggaguuuggucaguggg

SEQ ID NO: 856985 - RNA, 20 nt, Homo sapiens
gggauccagcucaagggagu

SEQ ID NO: 856986 - RNA, 15 nt, Homo sapiens
gggcaggaaccagac

SEQ ID NO: 856987 - RNA, 17 nt, Homo sapiens
gggcccuggagcucaag

SEQ ID NO: 856988 - RNA, 19 nt, Homo sapiens
gggccuccaccucugugca

SEQ ID NO: 856989 - RNA, 22 nt, Homo sapiens
gggcucagcaaggccaccucuu

SEQ ID NO: 856990 - RNA, 14 nt, Homo sapiens
gggcuuugccauua

SEQ ID NO: 856991 - RNA, 14 nt, Homo sapiens
ggggaccagcuugg

SEQ ID NO: 856992 - RNA, 23 nt, Homo sapiens
ggggagcaaugggcuuugcugcu

SEQ ID NO: 856993 - RNA, 20 nt, Homo sapiens
gggucacugggggacacugu

SEQ ID NO: 856994 - RNA, 15 nt, Homo sapiens
gggucagugcccagg

SEQ ID NO: 856995 - RNA, 14 nt, Homo sapiens
ggguccaggcaugu

SEQ ID NO: 856996 - RNA, 20 nt, Homo sapiens
gggucucuagugcugugaaa

SEQ ID NO: 856997 - RNA, 17 nt, Homo sapiens
gggugaaguccacagaa

SEQ ID NO: 856998 - RNA, 19 nt, Homo sapiens
ggguuuccauggcuuccca

SEQ ID NO: 856999 - RNA, 23 nt, Homo sapiens
gguaaaucuaguaccaugucgua

SEQ ID NO: 857000 - RNA, 17 nt, Homo sapiens
gguacaaaaaauucagu

SEQ ID NO: 857001 - RNA, 18 nt, Homo sapiens
gguagcaaugccuggaua

SEQ ID NO: 857002 - RNA, 23 nt, Homo sapiens
ggucacugggggacacuguggca

SEQ ID NO: 857003 - RNA, 13 nt, Homo sapiens
ggucauucacaga

SEQ ID NO: 857004 - RNA, 16 nt, Homo sapiens
ggucuaagguugccau

SEQ ID NO: 857005 - RNA, 12 nt, Homo sapiens
ggucuugcaaaa

SEQ ID NO: 857006 - RNA, 15 nt, Homo sapiens
gguggcaggugagca

SEQ ID NO: 857007 - RNA, 20 nt, Homo sapiens
gguggccccaaccacaggaa

SEQ ID NO: 857008 - RNA, 20 nt, Homo sapiens
gguguuugaaaauaguuuau

SEQ ID NO: 857009 - RNA, 17 nt, Homo sapiens
gguuacauaucaaaaca

SEQ ID NO: 857010 - RNA, 16 nt, Homo sapiens
gguuauuucugugcaa

SEQ ID NO: 857011 - RNA, 18 nt, Homo sapiens
gguucaggcccaucagcu

SEQ ID NO: 857012 - RNA, 19 nt, Homo sapiens
gguucauuuucagauucag

SEQ ID NO: 857013 - RNA, 19 nt, Homo sapiens
gguugggacccaguggcag

SEQ ID NO: 857014 - RNA, 22 nt, Homo sapiens
guaaaauggaggccagugccau

SEQ ID NO: 857015 - RNA, 21 nt, Homo sapiens
guaaacauugccugauuuguu

SEQ ID NO: 857016 - RNA, 15 nt, Homo sapiens
guaaaucuaaacaua

SEQ ID NO: 857017 - RNA, 16 nt, Homo sapiens
guaaaucuaaacauaa

SEQ ID NO: 857018 - RNA, 18 nt, Homo sapiens
guaaaucuaaacauaaaa

SEQ ID NO: 857019 - RNA, 21 nt, Homo sapiens
guaacauuuugacaacugaaa

SEQ ID NO: 857020 - RNA, 18 nt, Homo sapiens
guaaggagggucacuggg

SEQ ID NO: 857021 - RNA, 16 nt, Homo sapiens
guaauaaauuguuauu

SEQ ID NO: 857022 - RNA, 16 nt, Homo sapiens
guaauccagcaauaca

SEQ ID NO: 857023 - RNA, 15 nt, Homo sapiens
guaaucccagcacuu

SEQ ID NO: 857024 - RNA, 17 nt, Homo sapiens
guaaucuaguugucaau

SEQ ID NO: 857025 - RNA, 20 nt, Homo sapiens
guaaucuuuaacugaacucu

SEQ ID NO: 857026 - RNA, 13 nt, Homo sapiens
guacaaguggcuc

SEQ ID NO: 857027 - RNA, 18 nt, Homo sapiens
guacaaguggcucaucau

SEQ ID NO: 857028 - RNA, 21 nt, Homo sapiens
guacaugccuguuaauauuca

SEQ ID NO: 857029 - RNA, 18 nt, Homo sapiens
guacucugcagacugaaa

SEQ ID NO: 857030 - RNA, 20 nt, Homo sapiens
guacuugaacucacucccuc

SEQ ID NO: 857031 - RNA, 19 nt, Homo sapiens
guacuuucaaugaacauaa

SEQ ID NO: 857032 - RNA, 20 nt, Homo sapiens
guagaacuggcuauccuugg

SEQ ID NO: 857033 - RNA, 18 nt, Homo sapiens
guagacauuuugaaauaa

SEQ ID NO: 857034 - RNA, 20 nt, Homo sapiens
guagacggaacaguguggaa

SEQ ID NO: 857035 - RNA, 17 nt, Homo sapiens
guagauuuacauagaau

SEQ ID NO: 857036 - RNA, 22 nt, Homo sapiens
guagccauuucuucuguucuac

SEQ ID NO: 857037 - RNA, 23 nt, Homo sapiens
guaggcgaaucauuuguucaaag

SEQ ID NO: 857038 - RNA, 20 nt, Homo sapiens
guaguuaacaauuuugcacu

SEQ ID NO: 857039 - RNA, 22 nt, Homo sapiens
guaguucuaccggcuuugccau

SEQ ID NO: 857040 - RNA, 12 nt, Homo sapiens
guauaauggaga

SEQ ID NO: 857041 - RNA, 18 nt, Homo sapiens
guauauuuaagaagccaa

SEQ ID NO: 857042 - RNA, 20 nt, Homo sapiens
guauccugagagcccagaaa

SEQ ID NO: 857043 - RNA, 14 nt, Homo sapiens
guauguguuuagaa

SEQ ID NO: 857044 - RNA, 18 nt, Homo sapiens
guauucucauaauacuga

SEQ ID NO: 857045 - RNA, 18 nt, Homo sapiens
guauuuaguaagugcuug

SEQ ID NO: 857046 - RNA, 19 nt, Homo sapiens
guauuugauguauucugug

SEQ ID NO: 857047 - RNA, 22 nt, Homo sapiens
guauuuuuaguagagacagggu

SEQ ID NO: 857048 - RNA, 18 nt, Homo sapiens
gucaccaagcaugaccca

SEQ ID NO: 857049 - RNA, 18 nt, Homo sapiens
gucacucuaggacucugc

SEQ ID NO: 857050 - RNA, 18 nt, Homo sapiens
gucagggugugaggccac

SEQ ID NO: 857051 - RNA, 17 nt, Homo sapiens
gucaguguuuggugcac

SEQ ID NO: 857052 - RNA, 13 nt, Homo sapiens
guccaccuuucag

SEQ ID NO: 857053 - RNA, 17 nt, Homo sapiens
guccaguaagaucacug

SEQ ID NO: 857054 - RNA, 21 nt, Homo sapiens
guccuccagaaagcaccaagg

SEQ ID NO: 857055 - RNA, 14 nt, Homo sapiens
guccuucuugucca

SEQ ID NO: 857056 - RNA, 17 nt, Homo sapiens
guccuuguuccccuaau

SEQ ID NO: 857057 - RNA, 15 nt, Homo sapiens
gucgcacccacugug

SEQ ID NO: 857058 - RNA, 18 nt, Homo sapiens
gucuauagaaaugaucau

SEQ ID NO: 857059 - RNA, 19 nt, Homo sapiens
gucucucacagacaggacc

SEQ ID NO: 857060 - RNA, 18 nt, Homo sapiens
gucucugcgccugaguaa

SEQ ID NO: 857061 - RNA, 15 nt, Homo sapiens
gucugcaguccagua

SEQ ID NO: 857062 - RNA, 13 nt, Homo sapiens
gucuggggaccag

SEQ ID NO: 857063 - RNA, 12 nt, Homo sapiens
gucugucagggu

SEQ ID NO: 857064 - RNA, 18 nt, Homo sapiens
gucuucgcagccuagaua

SEQ ID NO: 857065 - RNA, 21 nt, Homo sapiens
gucuuuagcugaaauggucca

SEQ ID NO: 857066 - RNA, 22 nt, Homo sapiens
gugaaugcugggccccugcuca

SEQ ID NO: 857067 - RNA, 15 nt, Homo sapiens
gugacaucacagggc

SEQ ID NO: 857068 - RNA, 18 nt, Homo sapiens
gugaccaguuuugauauu

SEQ ID NO: 857069 - RNA, 22 nt, Homo sapiens
gugagacuagacauaguaccga

SEQ ID NO: 857070 - RNA, 18 nt, Homo sapiens
gugauauaaaagcugcau

SEQ ID NO: 857071 - RNA, 11 nt, Homo sapiens
gugaugcuccu

SEQ ID NO: 857072 - RNA, 14 nt, Homo sapiens
gugauguacuguaa

SEQ ID NO: 857073 - RNA, 15 nt, Homo sapiens
gugcagggcacagaa

SEQ ID NO: 857074 - RNA, 11 nt, Homo sapiens
gugcaucucau

SEQ ID NO: 857075 - RNA, 20 nt, Homo sapiens
gugcaugggucaggguguga

SEQ ID NO: 857076 - RNA, 15 nt, Homo sapiens
gugccauuucagagg

SEQ ID NO: 857077 - RNA, 20 nt, Homo sapiens
gugccccagcgcacacggga

SEQ ID NO: 857078 - RNA, 17 nt, Homo sapiens
gugcuccguagcuucua

SEQ ID NO: 857079 - RNA, 18 nt, Homo sapiens
guggaacugcuauuuucc

SEQ ID NO: 857080 - RNA, 15 nt, Homo sapiens
guggacucucugaca

SEQ ID NO: 857081 - RNA, 21 nt, Homo sapiens
guggagagaaagugacaugca

SEQ ID NO: 857082 - RNA, 14 nt, Homo sapiens
guggauuccucccc

SEQ ID NO: 857083 - RNA, 18 nt, Homo sapiens
gugggcuccggcacccac

SEQ ID NO: 857084 - RNA, 20 nt, Homo sapiens
guggucucccuggccucagg

SEQ ID NO: 857085 - RNA, 13 nt, Homo sapiens
guggugauuugga

SEQ ID NO: 857086 - RNA, 22 nt, Homo sapiens
guguacuuuguuaaaaacacug

SEQ ID NO: 857087 - RNA, 17 nt, Homo sapiens
guguccaccuuucagga

SEQ ID NO: 857088 - RNA, 18 nt, Homo sapiens
guguccaccuuucaggag

SEQ ID NO: 857089 - RNA, 17 nt, Homo sapiens
gugucuccuguuucaga

SEQ ID NO: 857090 - RNA, 14 nt, Homo sapiens
guuaaauaauguga

SEQ ID NO: 857091 - RNA, 18 nt, Homo sapiens
guuacagaguucugggau

SEQ ID NO: 857092 - RNA, 15 nt, Homo sapiens
guuauagcugcauuu

SEQ ID NO: 857093 - RNA, 15 nt, Homo sapiens
guuaugugaccucac

SEQ ID NO: 857094 - RNA, 12 nt, Homo sapiens
guucaaugagau

SEQ ID NO: 857095 - RNA, 16 nt, Homo sapiens
guucacuaccugucag

SEQ ID NO: 857096 - RNA, 17 nt, Homo sapiens
guucacuaccugucagc

SEQ ID NO: 857097 - RNA, 12 nt, Homo sapiens
guucauugccac

SEQ ID NO: 857098 - RNA, 20 nt, Homo sapiens
guuccucaacccucucaagu

SEQ ID NO: 857099 - RNA, 14 nt, Homo sapiens
guucuguauuugaa

SEQ ID NO: 857100 - RNA, 22 nt, Homo sapiens
guugaaagaaauuaaguacuua

SEQ ID NO: 857101 - RNA, 18 nt, Homo sapiens
guugacaucacuggcaug

SEQ ID NO: 857102 - RNA, 23 nt, Homo sapiens
ucccugagcuuuggugcaucuca

SEQ ID NO: 857103 - RNA, 16 nt, Homo sapiens
ucccugcucgcugaca

SEQ ID NO: 857104 - RNA, 20 nt, Homo sapiens
ucccuggguuagacugccag

SEQ ID NO: 857105 - RNA, 14 nt, Homo sapiens
ucccuucaggugcc

SEQ ID NO: 857106 - RNA, 21 nt, Homo sapiens
ucccuuuucuuuccuuuucau

SEQ ID NO: 857107 - RNA, 23 nt, Homo sapiens
uccggacuccucucguacuugaa

SEQ ID NO: 857108 - RNA, 19 nt, Homo sapiens
uccuaaaccauucaccaag

SEQ ID NO: 857109 - RNA, 16 nt, Homo sapiens
uccuaccugagcaaca

SEQ ID NO: 857110 - RNA, 13 nt, Homo sapiens
uccuauuacuuau

SEQ ID NO: 857111 - RNA, 13 nt, Homo sapiens
uccuauuuagaca

SEQ ID NO: 857112 - RNA, 20 nt, Homo sapiens
uccuauuuagacauguaauu

SEQ ID NO: 857113 - RNA, 13 nt, Homo sapiens
uccucacuggucu

SEQ ID NO: 857114 - RNA, 15 nt, Homo sapiens
uccucacuggucuac

SEQ ID NO: 857115 - RNA, 23 nt, Homo sapiens
uccucagcccucucuugccaaaa

SEQ ID NO: 857116 - RNA, 20 nt, Homo sapiens
uccucauuuguaaucuaguu

SEQ ID NO: 857117 - RNA, 17 nt, Homo sapiens
uccucugcugcaucccc

SEQ ID NO: 857118 - RNA, 13 nt, Homo sapiens
uccucuucuacca

SEQ ID NO: 857119 - RNA, 14 nt, Homo sapiens
uccugaaccagcac

SEQ ID NO: 857120 - RNA, 13 nt, Homo sapiens
uccugccuguggg

SEQ ID NO: 857121 - RNA, 13 nt, Homo sapiens
uccuuaaaauaaa

SEQ ID NO: 857122 - RNA, 19 nt, Homo sapiens
uccuuucaccccauccaca

SEQ ID NO: 857123 - RNA, 14 nt, Homo sapiens
uccuuuccuuucau

SEQ ID NO: 857124 - RNA, 16 nt, Homo sapiens
uccuuucucaccagcc

SEQ ID NO: 857125 - RNA, 18 nt, Homo sapiens
uccuuugauagaaaggaa

SEQ ID NO: 857126 - RNA, 23 nt, Homo sapiens
uccuuuuuuucccuuuucuuucc

SEQ ID NO: 857127 - RNA, 21 nt, Homo sapiens
ucgacaaaagcaguggagaag

SEQ ID NO: 857128 - RNA, 14 nt, Homo sapiens
ucgauucuuugaag

SEQ ID NO: 857129 - RNA, 15 nt, Homo sapiens
ucgcacccacuguga

SEQ ID NO: 857130 - RNA, 18 nt, Homo sapiens
ucgcacccacugugaaag

SEQ ID NO: 857131 - RNA, 15 nt, Homo sapiens
ucgcagccuagauau

SEQ ID NO: 857132 - RNA, 21 nt, Homo sapiens
ucgccagcagacaucagaaca

SEQ ID NO: 857133 - RNA, 14 nt, Homo sapiens
ucgcugacaucugg

SEQ ID NO: 857134 - RNA, 19 nt, Homo sapiens
ucuaaaaaaauaaacaaag

SEQ ID NO: 857135 - RNA, 15 nt, Homo sapiens
ucuaaaaauugaacu

SEQ ID NO: 857136 - RNA, 18 nt, Homo sapiens
ucuaaaacaaucugucca

SEQ ID NO: 857137 - RNA, 17 nt, Homo sapiens
ucuaaaaucccuuucaa

SEQ ID NO: 857138 - RNA, 16 nt, Homo sapiens
ucuaacuauuacacau

SEQ ID NO: 857139 - RNA, 20 nt, Homo sapiens
ucuaauauauccacacauuu

SEQ ID NO: 857140 - RNA, 16 nt, Homo sapiens
ucuacaaggaaauggg

SEQ ID NO: 857141 - RNA, 15 nt, Homo sapiens
ucuaccuagccccuu

SEQ ID NO: 857142 - RNA, 13 nt, Homo sapiens
ucuagccagugaa

SEQ ID NO: 857143 - RNA, 22 nt, Homo sapiens
ucuauagaaaugaucauugcau

SEQ ID NO: 857144 - RNA, 20 nt, Homo sapiens
ucucaaaccccugaccucaa

SEQ ID NO: 857145 - RNA, 22 nt, Homo sapiens
ucucaaggauccagacucucau

SEQ ID NO: 857146 - RNA, 12 nt, Homo sapiens
ucucaaguccau

SEQ ID NO: 857147 - RNA, 22 nt, Homo sapiens
ucucaaugcuuuccacauuucu

SEQ ID NO: 857148 - RNA, 21 nt, Homo sapiens
ucucacucucuuccuuucauu

SEQ ID NO: 857149 - RNA, 15 nt, Homo sapiens
ucucauuugugugga

SEQ ID NO: 857150 - RNA, 21 nt, Homo sapiens
ucucccacccuuucugccagg

SEQ ID NO: 857151 - RNA, 21 nt, Homo sapiens
ucucuaaauaaaagaagucaa

SEQ ID NO: 857152 - RNA, 17 nt, Homo sapiens
ucucuaacaguggacaa

SEQ ID NO: 857153 - RNA, 22 nt, Homo sapiens
ucucucacucucuuccuuucau

SEQ ID NO: 857154 - RNA, 21 nt, Homo sapiens
ucucuccaggggucuugcaaa

SEQ ID NO: 857155 - RNA, 18 nt, Homo sapiens
ucucucggaacucccgca

SEQ ID NO: 857156 - RNA, 17 nt, Homo sapiens
ucucuugccucagcuuc

SEQ ID NO: 857157 - RNA, 13 nt, Homo sapiens
ucugaacagcuau

SEQ ID NO: 857158 - RNA, 15 nt, Homo sapiens
ucugaaggaggccac

SEQ ID NO: 857159 - RNA, 19 nt, Homo sapiens
ucugaccccugccuguggg

SEQ ID NO: 857160 - RNA, 12 nt, Homo sapiens
ucugacuuugaa

SEQ ID NO: 857161 - RNA, 21 nt, Homo sapiens
ucugagcucauuuggggacca

SEQ ID NO: 857162 - RNA, 20 nt, Homo sapiens
ucugaguaccauuaucuuau

SEQ ID NO: 857163 - RNA, 14 nt, Homo sapiens
ucugauaccaaaga

SEQ ID NO: 857164 - RNA, 19 nt, Homo sapiens
ucugaucugugcaggguau

SEQ ID NO: 857165 - RNA, 21 nt, Homo sapiens
ucugcaaaggaaauaccaguu

SEQ ID NO: 857166 - RNA, 17 nt, Homo sapiens
ucugcacaauaauaagu

SEQ ID NO: 857167 - RNA, 16 nt, Homo sapiens
ucugcagagccacucu

SEQ ID NO: 857168 - RNA, 19 nt, Homo sapiens
ucugcagcucuacagguga

SEQ ID NO: 857169 - RNA, 15 nt, Homo sapiens
ucugcaggugggaug

SEQ ID NO: 857170 - RNA, 14 nt, Homo sapiens
ucugccaccugcac

SEQ ID NO: 857171 - RNA, 16 nt, Homo sapiens
ucugccacgcuuuaug

SEQ ID NO: 857172 - RNA, 21 nt, Homo sapiens
ucugccacgcuuuaugcccuu

SEQ ID NO: 857173 - RNA, 13 nt, Homo sapiens
ucugccuuugguu

SEQ ID NO: 857174 - RNA, 21 nt, Homo sapiens
ucuggaccccaucugugaaua

SEQ ID NO: 857175 - RNA, 17 nt, Homo sapiens
ucuggcacagccugcac

SEQ ID NO: 857176 - RNA, 14 nt, Homo sapiens
ucuggcccagugaa

SEQ ID NO: 857177 - RNA, 15 nt, Homo sapiens
ucuggcucuacacau

SEQ ID NO: 857178 - RNA, 13 nt, Homo sapiens
ucugggcauuaca

SEQ ID NO: 857179 - RNA, 15 nt, Homo sapiens
ucuggggaccagcuu

SEQ ID NO: 857180 - RNA, 18 nt, Homo sapiens
ucuggugaguuaaugggg

SEQ ID NO: 857181 - RNA, 16 nt, Homo sapiens
ucugucacuugcauuc

SEQ ID NO: 857182 - RNA, 17 nt, Homo sapiens
ucugucacuugcauucc

SEQ ID NO: 857183 - RNA, 22 nt, Homo sapiens
ucugucaggguuggaaagucca

SEQ ID NO: 857184 - RNA, 22 nt, Homo sapiens
ucugugcagggcacagaaggcu

SEQ ID NO: 857185 - RNA, 18 nt, Homo sapiens
ucuguguaccacugggau

SEQ ID NO: 857186 - RNA, 14 nt, Homo sapiens
ucuguguguugacu

SEQ ID NO: 857187 - RNA, 20 nt, Homo sapiens
ucuguuuuucuucugaaaua

SEQ ID NO: 857188 - RNA, 14 nt, Homo sapiens
ucuuacacacugga

SEQ ID NO: 857189 - RNA, 23 nt, Homo sapiens
ucuuagucuauagaaaugaucau

SEQ ID NO: 857190 - RNA, 13 nt, Homo sapiens
ucuucacauguaa

SEQ ID NO: 857191 - RNA, 16 nt, Homo sapiens
ucuucgcagccuagau

SEQ ID NO: 857192 - RNA, 20 nt, Homo sapiens
ucuugacucugaagggacuu

SEQ ID NO: 857193 - RNA, 17 nt, Homo sapiens
ucuugcaaaauuccuga

SEQ ID NO: 857194 - RNA, 16 nt, Homo sapiens
ucuuggcccucccacc

SEQ ID NO: 857195 - RNA, 21 nt, Homo sapiens
ucuuggcccucccaccuggag

SEQ ID NO: 857196 - RNA, 14 nt, Homo sapiens
ucuuuaaacaguuu

SEQ ID NO: 857197 - RNA, 20 nt, Homo sapiens
ucuuuaauacuucacacaga

SEQ ID NO: 857198 - RNA, 18 nt, Homo sapiens
ucuuucaacuucaucuca

SEQ ID NO: 857199 - RNA, 15 nt, Homo sapiens
ucuuucccaccaaac

SEQ ID NO: 857200 - RNA, 22 nt, Homo sapiens
ucuuucccaccaaacaucuuuc

SEQ ID NO: 857201 - RNA, 19 nt, Homo sapiens
ucuuuccuaaaccauucac

SEQ ID NO: 857202 - RNA, 20 nt, Homo sapiens
ucuuuccuaaaccauucacc

SEQ ID NO: 857203 - RNA, 23 nt, Homo sapiens
ucuuucguuuguuuguuucaaua

SEQ ID NO: 857204 - RNA, 15 nt, Homo sapiens
ucuuugcaguuccca

SEQ ID NO: 857205 - RNA, 17 nt, Homo sapiens
ugaaaagagaaacuuaa

SEQ ID NO: 857206 - RNA, 22 nt, Homo sapiens
ugaaaagagaaacuuaaaugaa

SEQ ID NO: 857207 - RNA, 22 nt, Homo sapiens
ugaaacaaaaugagcucuccua

SEQ ID NO: 857208 - RNA, 16 nt, Homo sapiens
ugaaagaugaguagga

SEQ ID NO: 857209 - RNA, 19 nt, Homo sapiens
ugaaaggcagggcaagaac

SEQ ID NO: 857210 - RNA, 21 nt, Homo sapiens
ugaaauaaaaagaguauauuc

SEQ ID NO: 857211 - RNA, 20 nt, Homo sapiens
ugaaauaacacagcaguuuc

SEQ ID NO: 857212 - RNA, 12 nt, Homo sapiens
ugaaaucauauu

SEQ ID NO: 857213 - RNA, 16 nt, Homo sapiens
ugaaaugcaaaaggaa

SEQ ID NO: 857214 - RNA, 15 nt, Homo sapiens
ugaaaugcuuuagca

SEQ ID NO: 857215 - RNA, 18 nt, Homo sapiens
ugaaaugguccaguacaa

SEQ ID NO: 857216 - RNA, 20 nt, Homo sapiens
ugaacaaaauuaaacuucaa

SEQ ID NO: 857217 - RNA, 15 nt, Homo sapiens
ugaacauugcauaua

SEQ ID NO: 857218 - RNA, 21 nt, Homo sapiens
ugaaccccaccucccucccac

SEQ ID NO: 857219 - RNA, 13 nt, Homo sapiens
ugaaccucucagg

SEQ ID NO: 857220 - RNA, 22 nt, Homo sapiens
ugaacuaccuauaguagucugu

SEQ ID NO: 857221 - RNA, 20 nt, Homo sapiens
ugaagacagcccgauccucc

SEQ ID NO: 857222 - RNA, 14 nt, Homo sapiens
ugaagcugaggcug

SEQ ID NO: 857223 - RNA, 22 nt, Homo sapiens
ugaagcugcggcccugaucucc

SEQ ID NO: 857224 - RNA, 12 nt, Homo sapiens
ugaauauacaga

SEQ ID NO: 857225 - RNA, 17 nt, Homo sapiens
ugaauauugccauuaug

SEQ ID NO: 857226 - RNA, 20 nt, Homo sapiens
ugaauccagugaaaauaagc

SEQ ID NO: 857227 - RNA, 16 nt, Homo sapiens
ugaaugauuaguagga

SEQ ID NO: 857228 - RNA, 16 nt, Homo sapiens
ugaauggcugaccuga

SEQ ID NO: 857229 - RNA, 18 nt, Homo sapiens
ugaauguaauagucuugc

SEQ ID NO: 857230 - RNA, 22 nt, Homo sapiens
ugacaaaggagcauugcaguca

SEQ ID NO: 857231 - RNA, 13 nt, Homo sapiens
ugacaacugaaag

SEQ ID NO: 857232 - RNA, 14 nt, Homo sapiens
ugacaauguuuaca

SEQ ID NO: 857233 - RNA, 16 nt, Homo sapiens
ugacagcaaacagauc

SEQ ID NO: 857234 - RNA, 14 nt, Homo sapiens
ccauccccuccggc

SEQ ID NO: 857235 - RNA, 19 nt, Homo sapiens
ccaucuccuuucucuggua

SEQ ID NO: 857236 - RNA, 20 nt, Homo sapiens
ccauggcuucccagagcucc

SEQ ID NO: 857237 - RNA, 19 nt, Homo sapiens
ccauggucuucagcagaca

SEQ ID NO: 857238 - RNA, 20 nt, Homo sapiens
ccaugucguaguuacucuca

SEQ ID NO: 857239 - RNA, 13 nt, Homo sapiens
ccauuucacuggc

SEQ ID NO: 857240 - RNA, 14 nt, Homo sapiens
cccaaagagcuccu

SEQ ID NO: 857241 - RNA, 20 nt, Homo sapiens
cccaaaugugugcccagcuu

SEQ ID NO: 857242 - RNA, 13 nt, Homo sapiens
cccaacaguucau

SEQ ID NO: 857243 - RNA, 16 nt, Homo sapiens
cccaagcagcuggcca

SEQ ID NO: 857244 - RNA, 17 nt, Homo sapiens
cccaagucugacagcca

SEQ ID NO: 857245 - RNA, 14 nt, Homo sapiens
cccacaagucccag

SEQ ID NO: 857246 - RNA, 13 nt, Homo sapiens
cccacauggugau

SEQ ID NO: 857247 - RNA, 14 nt, Homo sapiens
cccaccacccugac

SEQ ID NO: 857248 - RNA, 18 nt, Homo sapiens
cccagaaacaacacaauc

SEQ ID NO: 857249 - RNA, 14 nt, Homo sapiens
cccagaagugcaga

SEQ ID NO: 857250 - RNA, 19 nt, Homo sapiens
cccagagaacaagcacugu

SEQ ID NO: 857251 - RNA, 19 nt, Homo sapiens
cccagcgcggacauccccu

SEQ ID NO: 857252 - RNA, 15 nt, Homo sapiens
cccagcguccacucu

SEQ ID NO: 857253 - RNA, 13 nt, Homo sapiens
cccaggaaucuca

SEQ ID NO: 857254 - RNA, 16 nt, Homo sapiens
cccaguugcugucaca

SEQ ID NO: 857255 - RNA, 14 nt, Homo sapiens
cccauguauggcca

SEQ ID NO: 857256 - RNA, 15 nt, Homo sapiens
ccccacccuagcccu

SEQ ID NO: 857257 - RNA, 14 nt, Homo sapiens
ccccauggucuuca

SEQ ID NO: 857258 - RNA, 18 nt, Homo sapiens
ccccuaagauuugauaua

SEQ ID NO: 857259 - RNA, 18 nt, Homo sapiens
ccccuccuugugcugcca

SEQ ID NO: 857260 - RNA, 17 nt, Homo sapiens
cccgcaagcaccauccc

SEQ ID NO: 857261 - RNA, 14 nt, Homo sapiens
cccguaagauuccu

SEQ ID NO: 857262 - RNA, 12 nt, Homo sapiens
cccucaagugcc

SEQ ID NO: 857263 - RNA, 16 nt, Homo sapiens
cccucacucucaggaa

SEQ ID NO: 857264 - RNA, 13 nt, Homo sapiens
cccuccauccacc

SEQ ID NO: 857265 - RNA, 19 nt, Homo sapiens
cccugaaauaaagcacauu

SEQ ID NO: 857266 - RNA, 21 nt, Homo sapiens
cccuggcagcccgcaucagcu

SEQ ID NO: 857267 - RNA, 20 nt, Homo sapiens
cccuggcuguuguauuacca

SEQ ID NO: 857268 - RNA, 15 nt, Homo sapiens
cccuggugcugccac

SEQ ID NO: 857269 - RNA, 19 nt, Homo sapiens
cccuuacauguccuccuaa

SEQ ID NO: 857270 - RNA, 20 nt, Homo sapiens
ccgaggcucgagcucggggc

SEQ ID NO: 857271 - RNA, 15 nt, Homo sapiens
ccgcaagcaccaucc

SEQ ID NO: 857272 - RNA, 19 nt, Homo sapiens
ccgcaagcaccauccccuc

SEQ ID NO: 857273 - RNA, 23 nt, Homo sapiens
ccgguacaaguggcucaucauca

SEQ ID NO: 857274 - RNA, 22 nt, Homo sapiens
ccggucgggggggacccuccaa

SEQ ID NO: 857275 - RNA, 16 nt, Homo sapiens
ccuaauaagaccccac

SEQ ID NO: 857276 - RNA, 17 nt, Homo sapiens
ccuacacaggacagggg

SEQ ID NO: 857277 - RNA, 20 nt, Homo sapiens
ccuaccugagcaacaagaau

SEQ ID NO: 857278 - RNA, 19 nt, Homo sapiens
ccuacuaaauguacagaua

SEQ ID NO: 857279 - RNA, 19 nt, Homo sapiens
ccuagauaugaagaaucug

SEQ ID NO: 857280 - RNA, 21 nt, Homo sapiens
ccuagauaugaagaaucugcu

SEQ ID NO: 857281 - RNA, 17 nt, Homo sapiens
ccuauaagccaaaauua

SEQ ID NO: 857282 - RNA, 22 nt, Homo sapiens
ccucaaccaacaacaauguguu

SEQ ID NO: 857283 - RNA, 16 nt, Homo sapiens
ccucauaggcuucugg

SEQ ID NO: 857284 - RNA, 12 nt, Homo sapiens
ccuccugccaug

SEQ ID NO: 857285 - RNA, 14 nt, Homo sapiens
ccucucguacuuga

SEQ ID NO: 857286 - RNA, 20 nt, Homo sapiens
ccucucugcuggacguccag

SEQ ID NO: 857287 - RNA, 16 nt, Homo sapiens
ccucucuguuacucag

SEQ ID NO: 857288 - RNA, 23 nt, Homo sapiens
ccucugcaaaggaaauaccaguu

SEQ ID NO: 857289 - RNA, 17 nt, Homo sapiens
ccucugccucacaacau

SEQ ID NO: 857290 - RNA, 22 nt, Homo sapiens
ccucugccucacaacauggcaa

SEQ ID NO: 857291 - RNA, 22 nt, Homo sapiens
ccugaaacccuccccaggucuu

SEQ ID NO: 857292 - RNA, 20 nt, Homo sapiens
ccugacccugucuuucucuc

SEQ ID NO: 857293 - RNA, 15 nt, Homo sapiens
ccugacgucugccac

SEQ ID NO: 857294 - RNA, 22 nt, Homo sapiens
ccugauccugcaauuaaagggu

SEQ ID NO: 857295 - RNA, 17 nt, Homo sapiens
ccugcacugacucugga

SEQ ID NO: 857296 - RNA, 18 nt, Homo sapiens
ccugcacugacucuggaa

SEQ ID NO: 857297 - RNA, 16 nt, Homo sapiens
ccugccucuccgcccc

SEQ ID NO: 857298 - RNA, 23 nt, Homo sapiens
ccugcucagaaucugauaccaaa

SEQ ID NO: 857299 - RNA, 21 nt, Homo sapiens
ccugcucucgaggcagcagug

SEQ ID NO: 857300 - RNA, 16 nt, Homo sapiens
ccugcugugcuguggc

SEQ ID NO: 857301 - RNA, 15 nt, Homo sapiens
ccuggcaaagcagca

SEQ ID NO: 857302 - RNA, 17 nt, Homo sapiens
ccuggguugugcugaca

SEQ ID NO: 857303 - RNA, 21 nt, Homo sapiens
ccuuaaagacaagacagcauu

SEQ ID NO: 857304 - RNA, 23 nt, Homo sapiens
ccuuaauguauuugauguauucu

SEQ ID NO: 857305 - RNA, 20 nt, Homo sapiens
ccuuacucugagcucauuaa

SEQ ID NO: 857306 - RNA, 23 nt, Homo sapiens
ccuuauuguguuaaccauggugg

SEQ ID NO: 857307 - RNA, 19 nt, Homo sapiens
ccuucccugagcuuuggug

SEQ ID NO: 857308 - RNA, 21 nt, Homo sapiens
ccuucgugacaauguuuacaa

SEQ ID NO: 857309 - RNA, 19 nt, Homo sapiens
ccuucugacuuugccaaaa

SEQ ID NO: 857310 - RNA, 17 nt, Homo sapiens
ccuugagaaauucugaa

SEQ ID NO: 857311 - RNA, 20 nt, Homo sapiens
ccuugcccuuccagcccuuu

SEQ ID NO: 857312 - RNA, 18 nt, Homo sapiens
ccuuggggaagaggcaag

SEQ ID NO: 857313 - RNA, 16 nt, Homo sapiens
ccuuguauugaaguua

SEQ ID NO: 857314 - RNA, 12 nt, Homo sapiens
ccuuucauucua

SEQ ID NO: 857315 - RNA, 15 nt, Homo sapiens
ccuuucucaccagcc

SEQ ID NO: 857316 - RNA, 22 nt, Homo sapiens
ccuuucuuugcuguuugcaauc

SEQ ID NO: 857317 - RNA, 19 nt, Homo sapiens
ccuuuggaacuauuuacaa

SEQ ID NO: 857318 - RNA, 17 nt, Homo sapiens
ccuuuggcccugaacca

SEQ ID NO: 857319 - RNA, 21 nt, Homo sapiens
cgaaaucccugcucacugcag

SEQ ID NO: 857320 - RNA, 15 nt, Homo sapiens
cgaacauguagcaug

SEQ ID NO: 857321 - RNA, 12 nt, Homo sapiens
cgaagggaaaua

SEQ ID NO: 857322 - RNA, 16 nt, Homo sapiens
cgaccagccagggaaa

SEQ ID NO: 857323 - RNA, 15 nt, Homo sapiens
cgcauuuccuuucag

SEQ ID NO: 857324 - RNA, 18 nt, Homo sapiens
cgccauguuucuggugag

SEQ ID NO: 857325 - RNA, 20 nt, Homo sapiens
cgccuccaaccccucgccca

SEQ ID NO: 857326 - RNA, 17 nt, Homo sapiens
cgccugggaucucgcca

SEQ ID NO: 857327 - RNA, 22 nt, Homo sapiens
cggacuccucucguacuugaac

SEQ ID NO: 857328 - RNA, 16 nt, Homo sapiens
cggcccucaagugccc

SEQ ID NO: 857329 - RNA, 17 nt, Homo sapiens
cggcuuuucuuggccaa

SEQ ID NO: 857330 - RNA, 14 nt, Homo sapiens
cgggagccccaucu

SEQ ID NO: 857331 - RNA, 20 nt, Homo sapiens
cgggauggagaggugagaac

SEQ ID NO: 857332 - RNA, 17 nt, Homo sapiens
cgggggggacccuccaa

SEQ ID NO: 857333 - RNA, 16 nt, Homo sapiens
cguacaaguaguucug

SEQ ID NO: 857334 - RNA, 14 nt, Homo sapiens
cguacuugaacuca

SEQ ID NO: 857335 - RNA, 20 nt, Homo sapiens
cgucagauguuuaaaacacc

SEQ ID NO: 857336 - RNA, 14 nt, Homo sapiens
cguccgaagggaaa

SEQ ID NO: 857337 - RNA, 20 nt, Homo sapiens
cgugucacgggcaucauucu

SEQ ID NO: 857338 - RNA, 16 nt, Homo sapiens
cgugucaggcugucag

SEQ ID NO: 857339 - RNA, 19 nt, Homo sapiens
cuaaaaaaauaaacaaagu

SEQ ID NO: 857340 - RNA, 17 nt, Homo sapiens
cuaaaacuggcccuguu

SEQ ID NO: 857341 - RNA, 19 nt, Homo sapiens
cuaaagccucaaaacaaag

SEQ ID NO: 857342 - RNA, 18 nt, Homo sapiens
cuaaaggccacagcugag

SEQ ID NO: 857343 - RNA, 22 nt, Homo sapiens
cuaagguuuagauaaauauuga

SEQ ID NO: 857344 - RNA, 13 nt, Homo sapiens
cuaaguacuuaaa

SEQ ID NO: 857345 - RNA, 19 nt, Homo sapiens
cuaauaugcaauuaugaaa

SEQ ID NO: 857346 - RNA, 21 nt, Homo sapiens
cuacacgguucaaaccuguga

SEQ ID NO: 857347 - RNA, 17 nt, Homo sapiens
cuacaugcuuguugaca

SEQ ID NO: 857348 - RNA, 14 nt, Homo sapiens
cuaccugagcaaca

SEQ ID NO: 857349 - RNA, 19 nt, Homo sapiens
cuaccuggcucuccugucu

SEQ ID NO: 857350 - RNA, 19 nt, Homo sapiens
cuacugaugguuacauaua

SEQ ID NO: 857351 - RNA, 16 nt, Homo sapiens
cuacuuccaagacuua

SEQ ID NO: 857352 - RNA, 16 nt, Homo sapiens
cuagaaauagucauuu

SEQ ID NO: 857353 - RNA, 19 nt, Homo sapiens
cuaggacucugcacugaau

SEQ ID NO: 857354 - RNA, 21 nt, Homo sapiens
cuaucugugguuuauaaucuu

SEQ ID NO: 857355 - RNA, 15 nt, Homo sapiens
cuauggguuguacug

SEQ ID NO: 857356 - RNA, 23 nt, Homo sapiens
cuauuuauuuauuauaugugcac

SEQ ID NO: 857357 - RNA, 13 nt, Homo sapiens
cuauuucuugaua

SEQ ID NO: 857358 - RNA, 23 nt, Homo sapiens
cucaaacucccuuuggcccugaa

SEQ ID NO: 857359 - RNA, 17 nt, Homo sapiens
cucaaggcaaugggcua

SEQ ID NO: 857360 - RNA, 23 nt, Homo sapiens
cucaccugucgcacccacuguga

SEQ ID NO: 857361 - RNA, 22 nt, Homo sapiens
cucagaaucugauaccaaagag

SEQ ID NO: 857362 - RNA, 17 nt, Homo sapiens
cucagagaucuugcauu

SEQ ID NO: 857363 - RNA, 16 nt, Homo sapiens
cuucuggaugggacaa

SEQ ID NO: 857364 - RNA, 17 nt, Homo sapiens
cuucuggggcuuugcca

SEQ ID NO: 857365 - RNA, 23 nt, Homo sapiens
cuucuugcuuacaggaaugaagg

SEQ ID NO: 857366 - RNA, 18 nt, Homo sapiens
cuucuuugcaguucccau

SEQ ID NO: 857367 - RNA, 15 nt, Homo sapiens
cuuggaaaaugggac

SEQ ID NO: 857368 - RNA, 19 nt, Homo sapiens
cuuggaagcacaccaaucu

SEQ ID NO: 857369 - RNA, 16 nt, Homo sapiens
acuuuccaaucucagu

SEQ ID NO: 857370 - RNA, 17 nt, Homo sapiens
acuuuggcuuacauuug

SEQ ID NO: 857371 - RNA, 22 nt, Homo sapiens
acuuuggcuuacauuugaauaa

SEQ ID NO: 857372 - RNA, 17 nt, Homo sapiens
acuuuguaaauucugau

SEQ ID NO: 857373 - RNA, 15 nt, Homo sapiens
acuuuuaaauuauac

SEQ ID NO: 857374 - RNA, 22 nt, Homo sapiens
acuuuuuggugucucauaccca

SEQ ID NO: 857375 - RNA, 14 nt, Homo sapiens
agaaaaccaaacaa

SEQ ID NO: 857376 - RNA, 18 nt, Homo sapiens
agaaaaucugaauuggaa

SEQ ID NO: 857377 - RNA, 21 nt, Homo sapiens
agaaacggaauaguguggggu

SEQ ID NO: 857378 - RNA, 16 nt, Homo sapiens
agaaagugacaugcau

SEQ ID NO: 857379 - RNA, 15 nt, Homo sapiens
agaaauacacaggga

SEQ ID NO: 857380 - RNA, 12 nt, Homo sapiens
agaaaucacuga

SEQ ID NO: 857381 - RNA, 12 nt, Homo sapiens
agaaaugaucau

SEQ ID NO: 857382 - RNA, 23 nt, Homo sapiens
aucuaaacauaaaagaacaauua

SEQ ID NO: 857383 - RNA, 14 nt, Homo sapiens
aucuaaggacaagg

SEQ ID NO: 857384 - RNA, 19 nt, Homo sapiens
aucuagcccaaagccuuca

SEQ ID NO: 857385 - RNA, 18 nt, Homo sapiens
aucuaucccagaguacaa

SEQ ID NO: 857386 - RNA, 20 nt, Homo sapiens
aucuauuugugggugugcua

SEQ ID NO: 857387 - RNA, 14 nt, Homo sapiens
aucucaaggaucca

SEQ ID NO: 857388 - RNA, 22 nt, Homo sapiens
aucucaaggauccagacucuca

SEQ ID NO: 857389 - RNA, 17 nt, Homo sapiens
aucuccccuggggagcc

SEQ ID NO: 857390 - RNA, 20 nt, Homo sapiens
aucuccccuggggagccuga

SEQ ID NO: 857391 - RNA, 19 nt, Homo sapiens
aucucugaccagaagacaa

SEQ ID NO: 857392 - RNA, 12 nt, Homo sapiens
aucucuuccuuu

SEQ ID NO: 857393 - RNA, 15 nt, Homo sapiens
aucugcaaaauggga

SEQ ID NO: 857394 - RNA, 9 nt, Homo sapiens
aucugccac

SEQ ID NO: 857395 - RNA, 14 nt, Homo sapiens
aucugcuuaucagu

SEQ ID NO: 857396 - RNA, 18 nt, Homo sapiens
aucugcuuaucagugugc

SEQ ID NO: 857397 - RNA, 21 nt, Homo sapiens
aucugcuuaucagugugcaau

SEQ ID NO: 857398 - RNA, 21 nt, Homo sapiens
aucuggaccccaucugugaau

SEQ ID NO: 857399 - RNA, 21 nt, Homo sapiens
aucugucacuugcauuccacu

SEQ ID NO: 857400 - RNA, 20 nt, Homo sapiens
aucuuaagucauaaugaaua

SEQ ID NO: 857401 - RNA, 21 nt, Homo sapiens
aucuuguccaaguuguuucau

SEQ ID NO: 857402 - RNA, 22 nt, Homo sapiens
augaaaugaauuuacagaacag

SEQ ID NO: 857403 - RNA, 21 nt, Homo sapiens
augaacaagcauucucuccau

SEQ ID NO: 857404 - RNA, 16 nt, Homo sapiens
augaagaaucugcucu

SEQ ID NO: 857405 - RNA, 20 nt, Homo sapiens
augaauaaauguuauagcug

SEQ ID NO: 857406 - RNA, 19 nt, Homo sapiens
augaauacuuugcagcaca

SEQ ID NO: 857407 - RNA, 13 nt, Homo sapiens
augaauuuacaga

SEQ ID NO: 857408 - RNA, 21 nt, Homo sapiens
augaccuuugguacaugccug

SEQ ID NO: 857409 - RNA, 21 nt, Homo sapiens
augacugaaaaugaacuguaa

SEQ ID NO: 857410 - RNA, 21 nt, Homo sapiens
augagugggcuaggaggacaa

SEQ ID NO: 857411 - RNA, 15 nt, Homo sapiens
augaguuucacagug

SEQ ID NO: 857412 - RNA, 23 nt, Homo sapiens
augauaaaauuccgagucuuucu

SEQ ID NO: 857413 - RNA, 19 nt, Homo sapiens
augauagcaaauggccuca

SEQ ID NO: 857414 - RNA, 16 nt, Homo sapiens
augaucaaacuuccau

SEQ ID NO: 857415 - RNA, 13 nt, Homo sapiens
augcaacaauucu

SEQ ID NO: 857416 - RNA, 19 nt, Homo sapiens
augcaacauuuuaaggcaa

SEQ ID NO: 857417 - RNA, 13 nt, Homo sapiens
augcaacuuccuu

SEQ ID NO: 857418 - RNA, 20 nt, Homo sapiens
augcacgcugggcaaugaga

SEQ ID NO: 857419 - RNA, 22 nt, Homo sapiens
augcagaacuucccuccaucca

SEQ ID NO: 857420 - RNA, 16 nt, Homo sapiens
augcagcacauauacu

SEQ ID NO: 857421 - RNA, 22 nt, Homo sapiens
augccuaauguuaguuagugua

SEQ ID NO: 857422 - RNA, 17 nt, Homo sapiens
augccuguuaauauuca

SEQ ID NO: 857423 - RNA, 16 nt, Homo sapiens
augcguccgaagggaa

SEQ ID NO: 857424 - RNA, 22 nt, Homo sapiens
augcuggaacucuugacagcua

SEQ ID NO: 857425 - RNA, 18 nt, Homo sapiens
augcuuuuaaacugauua

SEQ ID NO: 857426 - RNA, 12 nt, Homo sapiens
auggaugucaag

SEQ ID NO: 857427 - RNA, 17 nt, Homo sapiens
auggcaguugcuuccuc

SEQ ID NO: 857428 - RNA, 21 nt, Homo sapiens
auggcucuuagaaacucagga

SEQ ID NO: 857429 - RNA, 16 nt, Homo sapiens
auggcugaagugcaug

SEQ ID NO: 857430 - RNA, 14 nt, Homo sapiens
augggcauauucug

SEQ ID NO: 857431 - RNA, 14 nt, Homo sapiens
augggccugaguga

SEQ ID NO: 857432 - RNA, 17 nt, Homo sapiens
augggucucucuugccc

SEQ ID NO: 857433 - RNA, 15 nt, Homo sapiens
augguccaguacaaa

SEQ ID NO: 857434 - RNA, 20 nt, Homo sapiens
augguuucacaugguuacau

SEQ ID NO: 857435 - RNA, 16 nt, Homo sapiens
auguauuucaucucaa

SEQ ID NO: 857436 - RNA, 16 nt, Homo sapiens
augucaucaccuccag

SEQ ID NO: 857437 - RNA, 15 nt, Homo sapiens
auguccaccacugac

SEQ ID NO: 857438 - RNA, 15 nt, Homo sapiens
augucuguguguuga

SEQ ID NO: 857439 - RNA, 15 nt, Homo sapiens
augucuguuggucaa

SEQ ID NO: 857440 - RNA, 14 nt, Homo sapiens
augucuugcuaaca

SEQ ID NO: 857441 - RNA, 18 nt, Homo sapiens
augugcacugcaaugcca

SEQ ID NO: 857442 - RNA, 23 nt, Homo sapiens
augugcacuucaagaagucacug

SEQ ID NO: 857443 - RNA, 21 nt, Homo sapiens
augugcauugaauacucugaa

SEQ ID NO: 857444 - RNA, 12 nt, Homo sapiens
augugugauuca

SEQ ID NO: 857445 - RNA, 14 nt, Homo sapiens
auguucauugccac

SEQ ID NO: 857446 - RNA, 19 nt, Homo sapiens
auguugagaggaacaagaa

SEQ ID NO: 857447 - RNA, 14 nt, Homo sapiens
auguuuaaaacacc

SEQ ID NO: 857448 - RNA, 16 nt, Homo sapiens
auguuuucacagucac

SEQ ID NO: 857449 - RNA, 15 nt, Homo sapiens
auguuuuccacugag

SEQ ID NO: 857450 - RNA, 17 nt, Homo sapiens
auuaagaguugaaagaa

SEQ ID NO: 857451 - RNA, 20 nt, Homo sapiens
auuaaguaugucaacagcca

SEQ ID NO: 857452 - RNA, 18 nt, Homo sapiens
auuaauguauccaaugaa

SEQ ID NO: 857453 - RNA, 18 nt, Homo sapiens
auuaauuuuguguuuaag

SEQ ID NO: 857454 - RNA, 19 nt, Homo sapiens
auuaguucccauucuuuca

SEQ ID NO: 857455 - RNA, 13 nt, Homo sapiens
auuauaugugcac

SEQ ID NO: 857456 - RNA, 19 nt, Homo sapiens
auuauauuuuuccugggau

SEQ ID NO: 857457 - RNA, 15 nt, Homo sapiens
auuaugguagcaaau

SEQ ID NO: 857458 - RNA, 17 nt, Homo sapiens
auuauuuguuacuguau

SEQ ID NO: 857459 - RNA, 22 nt, Homo sapiens
auuauuuucagaagcugaugag

SEQ ID NO: 857460 - RNA, 12 nt, Homo sapiens
auucaaaauacu

SEQ ID NO: 857461 - RNA, 15 nt, Homo sapiens
auucaccaagagcca

SEQ ID NO: 857462 - RNA, 23 nt, Homo sapiens
auucacuuauggcagaggaauau

SEQ ID NO: 857463 - RNA, 13 nt, Homo sapiens
auucagaaauccu

SEQ ID NO: 857464 - RNA, 15 nt, Homo sapiens
auucauguucugaaa

SEQ ID NO: 857465 - RNA, 18 nt, Homo sapiens
auuccacuuuuuguuaca

SEQ ID NO: 857466 - RNA, 18 nt, Homo sapiens
auuccagcacuucaggag

SEQ ID NO: 857467 - RNA, 16 nt, Homo sapiens
auuccucaaaauggga

SEQ ID NO: 857468 - RNA, 17 nt, Homo sapiens
auucggaaccaggccca

SEQ ID NO: 857469 - RNA, 11 nt, Homo sapiens
auucucuggcu

SEQ ID NO: 857470 - RNA, 22 nt, Homo sapiens
auucugugcuguuacaguuuuc

SEQ ID NO: 857471 - RNA, 22 nt, Homo sapiens
auucuuuuuacaucuaucccag

SEQ ID NO: 857472 - RNA, 13 nt, Homo sapiens
auugagauuuacc

SEQ ID NO: 857473 - RNA, 13 nt, Homo sapiens
auugaguuuagaa

SEQ ID NO: 857474 - RNA, 16 nt, Homo sapiens
auugauacguuuauua

SEQ ID NO: 857475 - RNA, 17 nt, Homo sapiens
auugcagccccucagcc

SEQ ID NO: 857476 - RNA, 13 nt, Homo sapiens
auugccauuguca

SEQ ID NO: 857477 - RNA, 15 nt, Homo sapiens
auugcccccacauug

SEQ ID NO: 857478 - RNA, 16 nt, Homo sapiens
auuggaaugcacucag

SEQ ID NO: 857479 - RNA, 21 nt, Homo sapiens
auuggcucccaucuuuuguua

SEQ ID NO: 857480 - RNA, 11 nt, Homo sapiens
auugugaugcu

SEQ ID NO: 857481 - RNA, 22 nt, Homo sapiens
auugugugaacuuggaagcaca

SEQ ID NO: 857482 - RNA, 21 nt, Homo sapiens
auuguuaggaccacugaggaa

SEQ ID NO: 857483 - RNA, 20 nt, Homo sapiens
auuuaaagacaaaaauacau

SEQ ID NO: 857484 - RNA, 23 nt, Homo sapiens
auuuaagaagccaagggggaccu

SEQ ID NO: 857485 - RNA, 13 nt, Homo sapiens
auuuaagcaauaa

SEQ ID NO: 857486 - RNA, 13 nt, Homo sapiens
auuuaauuaugaa

SEQ ID NO: 857487 - RNA, 18 nt, Homo sapiens
auuuacagaacaguuuaa

SEQ ID NO: 857488 - RNA, 20 nt, Homo sapiens
auuuaguaaaugcugaaaua

SEQ ID NO: 857489 - RNA, 15 nt, Homo sapiens
auuuauaaguugaag

SEQ ID NO: 857490 - RNA, 18 nt, Homo sapiens
auuuaugaacagacuuuu

SEQ ID NO: 857491 - RNA, 16 nt, Homo sapiens
auuuaugacuuucaca

SEQ ID NO: 857492 - RNA, 21 nt, Homo sapiens
auuuauuucuuucuauucuug

SEQ ID NO: 857493 - RNA, 19 nt, Homo sapiens
auuucaaaguccagauacc

SEQ ID NO: 857494 - RNA, 15 nt, Homo sapiens
auuucaaauaacugc

SEQ ID NO: 857495 - RNA, 21 nt, Homo sapiens
auuucagaggggaggcucagg

SEQ ID NO: 857496 - RNA, 18 nt, Homo sapiens
auuucaugaagcaagaau

SEQ ID NO: 857497 - RNA, 23 nt, Homo sapiens
auuuccaauagaacaguuuacuu

SEQ ID NO: 857498 - RNA, 14 nt, Homo sapiens
auuucccuuuauau

SEQ ID NO: 857499 - RNA, 22 nt, Homo sapiens
auuucugaaagaauaggauuaa

SEQ ID NO: 857500 - RNA, 12 nt, Homo sapiens
auuucugugcaa

SEQ ID NO: 857501 - RNA, 18 nt, Homo sapiens
auuugauaacaaguuuaa

SEQ ID NO: 857502 - RNA, 15 nt, Homo sapiens
auuugaugcaaaaug

SEQ ID NO: 857503 - RNA, 23 nt, Homo sapiens
auuugauuuuuuuuuuuaaucua

SEQ ID NO: 857504 - RNA, 20 nt, Homo sapiens
auuugccauagaguacacug

SEQ ID NO: 857505 - RNA, 20 nt, Homo sapiens
auuugcuuuggaaguuuuaa

SEQ ID NO: 857506 - RNA, 18 nt, Homo sapiens
auuugggagaagaucuca

SEQ ID NO: 857507 - RNA, 20 nt, Homo sapiens
auuuggucucucccagcucu

SEQ ID NO: 857508 - RNA, 19 nt, Homo sapiens
auuuguaauaauggauaau

SEQ ID NO: 857509 - RNA, 15 nt, Homo sapiens
uuacaaggaugaaac

SEQ ID NO: 857510 - RNA, 23 nt, Homo sapiens
uuacacacuggaaauugaaauaa

SEQ ID NO: 857511 - RNA, 20 nt, Homo sapiens
uuacacuuuuuggaagugaa

SEQ ID NO: 857512 - RNA, 20 nt, Homo sapiens
uuacauagaaagagucugac

SEQ ID NO: 857513 - RNA, 16 nt, Homo sapiens
uuaccuuaaaugcuga

SEQ ID NO: 857514 - RNA, 15 nt, Homo sapiens
uuacgauuaguauau

SEQ ID NO: 857515 - RNA, 21 nt, Homo sapiens
uuacucucaggcauggaugaa

SEQ ID NO: 857516 - RNA, 14 nt, Homo sapiens
uuacucugagcuca

SEQ ID NO: 857517 - RNA, 15 nt, Homo sapiens
uuacucugagcucau

SEQ ID NO: 857518 - RNA, 15 nt, Homo sapiens
uuacuguuacuugau

SEQ ID NO: 857519 - RNA, 11 nt, Homo sapiens
uuacuugauaa

SEQ ID NO: 857520 - RNA, 21 nt, Homo sapiens
uuagacauguaauuuguguaa

SEQ ID NO: 857521 - RNA, 18 nt, Homo sapiens
uuagaggggccagcggcc

SEQ ID NO: 857522 - RNA, 22 nt, Homo sapiens
uuagcaauuuccgccuggugau

SEQ ID NO: 857523 - RNA, 15 nt, Homo sapiens
uuaggugaaaauaau

SEQ ID NO: 857524 - RNA, 17 nt, Homo sapiens
uuaguacguguggcuug

SEQ ID NO: 857525 - RNA, 21 nt, Homo sapiens
uuauaaacauuuaaagacaaa

SEQ ID NO: 857526 - RNA, 19 nt, Homo sapiens
uuauaagaaaaccaaacaa

SEQ ID NO: 857527 - RNA, 16 nt, Homo sapiens
uuauacaaauuuaacu

SEQ ID NO: 857528 - RNA, 12 nt, Homo sapiens
uuauaugugcac

SEQ ID NO: 857529 - RNA, 10 nt, Homo sapiens
uuauguuugc

SEQ ID NO: 857530 - RNA, 22 nt, Homo sapiens
uuauucugugcuguuacaguuu

SEQ ID NO: 857531 - RNA, 18 nt, Homo sapiens
uuauuucugugcaaacaa

SEQ ID NO: 857532 - RNA, 19 nt, Homo sapiens
uuauuugugauguacugua

SEQ ID NO: 857533 - RNA, 23 nt, Homo sapiens
uucaaaagucuggcccacugugc

SEQ ID NO: 857534 - RNA, 12 nt, Homo sapiens
uucaaugaacau

SEQ ID NO: 857535 - RNA, 21 nt, Homo sapiens
uucacacguugugaugaagcu

SEQ ID NO: 857536 - RNA, 12 nt, Homo sapiens
uucacagcacua

SEQ ID NO: 857537 - RNA, 15 nt, Homo sapiens
uucaccuauccagag

SEQ ID NO: 857538 - RNA, 14 nt, Homo sapiens
uucacuaccuguca

SEQ ID NO: 857539 - RNA, 22 nt, Homo sapiens
uucagaccagccccaccaugca

SEQ ID NO: 857540 - RNA, 20 nt, Homo sapiens
uucagaggcucagauuguaa

SEQ ID NO: 857541 - RNA, 20 nt, Homo sapiens
uucagaggggaggcucagga

SEQ ID NO: 857542 - RNA, 16 nt, Homo sapiens
uucagauuguuuaaau

SEQ ID NO: 857543 - RNA, 10 nt, Homo sapiens
uucagcugcu

SEQ ID NO: 857544 - RNA, 16 nt, Homo sapiens
uucagguggccaggaa

SEQ ID NO: 857545 - RNA, 22 nt, Homo sapiens
uucauaauaaauagacacuuga

SEQ ID NO: 857546 - RNA, 22 nt, Homo sapiens
uucauccagggaacugagcaca

SEQ ID NO: 857547 - RNA, 22 nt, Homo sapiens
uucaugaauaaaaacuuugcag

SEQ ID NO: 857548 - RNA, 20 nt, Homo sapiens
uucauguaaaaagugcagua

SEQ ID NO: 857549 - RNA, 17 nt, Homo sapiens
uucauguccaccacuga

SEQ ID NO: 857550 - RNA, 14 nt, Homo sapiens
uucauuuuaacaga

SEQ ID NO: 857551 - RNA, 17 nt, Homo sapiens
uucauuuucagauucag

SEQ ID NO: 857552 - RNA, 14 nt, Homo sapiens
uuccaacaauucag

SEQ ID NO: 857553 - RNA, 15 nt, Homo sapiens
uuccacugagcauca

SEQ ID NO: 857554 - RNA, 15 nt, Homo sapiens
uuccagaaaucugcu

SEQ ID NO: 857555 - RNA, 19 nt, Homo sapiens
uuccaguggcuucucccaa

SEQ ID NO: 857556 - RNA, 19 nt, Homo sapiens
uuccccaagccuggcaggg

SEQ ID NO: 857557 - RNA, 23 nt, Homo sapiens
uucccuaucugcaaaaugggaug

SEQ ID NO: 857558 - RNA, 19 nt, Homo sapiens
uucccuccauccaccccuc

SEQ ID NO: 857559 - RNA, 14 nt, Homo sapiens
uuccuucauauaau

SEQ ID NO: 857560 - RNA, 11 nt, Homo sapiens
uuccuuucauu

SEQ ID NO: 857561 - RNA, 18 nt, Homo sapiens
uucgccagcagacaucag

SEQ ID NO: 857562 - RNA, 22 nt, Homo sapiens
uucuaaaaaaauaaacaaagug

SEQ ID NO: 857563 - RNA, 23 nt, Homo sapiens
uucuaaaaugucucaagugcaau

SEQ ID NO: 857564 - RNA, 17 nt, Homo sapiens
uucuaaagcaggcaauc

SEQ ID NO: 857565 - RNA, 12 nt, Homo sapiens
uucuacuuugaa

SEQ ID NO: 857566 - RNA, 17 nt, Homo sapiens
uucuagaagacuacaau

SEQ ID NO: 857567 - RNA, 19 nt, Homo sapiens
uucugaaggccaacgugga

SEQ ID NO: 857568 - RNA, 19 nt, Homo sapiens
uucugauaguagucuuuaa

SEQ ID NO: 857569 - RNA, 17 nt, Homo sapiens
uucugccugcugaccau

SEQ ID NO: 857570 - RNA, 18 nt, Homo sapiens
uucugggaugucaucacc

SEQ ID NO: 857571 - RNA, 20 nt, Homo sapiens
uucugggauuucuucucaca

SEQ ID NO: 857572 - RNA, 19 nt, Homo sapiens
uucuggucuucgcagccua

SEQ ID NO: 857573 - RNA, 12 nt, Homo sapiens
uucuguauuuga

SEQ ID NO: 857574 - RNA, 17 nt, Homo sapiens
uucuuagcauacauuca

SEQ ID NO: 857575 - RNA, 20 nt, Homo sapiens
uucuuagcugaugucuuugg

SEQ ID NO: 857576 - RNA, 21 nt, Homo sapiens
uucuuauuacuagacugccac

SEQ ID NO: 857577 - RNA, 12 nt, Homo sapiens
uucuuccuguca

SEQ ID NO: 857578 - RNA, 16 nt, Homo sapiens
uucuugggacugcugu

SEQ ID NO: 857579 - RNA, 17 nt, Homo sapiens
uucuuguaaacauugcc

SEQ ID NO: 857580 - RNA, 17 nt, Homo sapiens
uucuuucuuaaccacuu

SEQ ID NO: 857581 - RNA, 20 nt, Homo sapiens
uucuuucuuaaccacuuuca

SEQ ID NO: 857582 - RNA, 17 nt, Homo sapiens
uucuuugcuagcacaau

SEQ ID NO: 857583 - RNA, 16 nt, Homo sapiens
uugaacaguuggauag

SEQ ID NO: 857584 - RNA, 12 nt, Homo sapiens
uugaagcaaaca

SEQ ID NO: 857585 - RNA, 17 nt, Homo sapiens
uugaauauuuaagcaau

SEQ ID NO: 857586 - RNA, 14 nt, Homo sapiens
uugagaaauucuga

SEQ ID NO: 857587 - RNA, 20 nt, Homo sapiens
uugagacuuacggcaagaag

SEQ ID NO: 857588 - RNA, 21 nt, Homo sapiens
uugagagaggccacacuacac

SEQ ID NO: 857589 - RNA, 17 nt, Homo sapiens
uugauuuguacagauuc

SEQ ID NO: 857590 - RNA, 16 nt, Homo sapiens
uugcacuguagauuua

SEQ ID NO: 857591 - RNA, 16 nt, Homo sapiens
uugccaaucauugcaa

SEQ ID NO: 857592 - RNA, 17 nt, Homo sapiens
uugccaaucauugcaaa

SEQ ID NO: 857593 - RNA, 12 nt, Homo sapiens
uugccauuguca

SEQ ID NO: 857594 - RNA, 13 nt, Homo sapiens
uugccauuugcug

SEQ ID NO: 857595 - RNA, 16 nt, Homo sapiens
uugcccagucccgccc

SEQ ID NO: 857596 - RNA, 19 nt, Homo sapiens
uugccucccagcuucuuau

SEQ ID NO: 857597 - RNA, 15 nt, Homo sapiens
uugcuaacaggauau

SEQ ID NO: 857598 - RNA, 14 nt, Homo sapiens
uugcugaauggagu

SEQ ID NO: 857599 - RNA, 21 nt, Homo sapiens
uugcuugaagcaaacaguuga

SEQ ID NO: 857600 - RNA, 21 nt, Homo sapiens
uugcuugacccagguagucaa

SEQ ID NO: 857601 - RNA, 14 nt, Homo sapiens
uuggaaaguccaag

SEQ ID NO: 857602 - RNA, 20 nt, Homo sapiens
uuggaacuauuuacaaggau

SEQ ID NO: 857603 - RNA, 16 nt, Homo sapiens
uuggaaucugcuccaa

SEQ ID NO: 857604 - RNA, 14 nt, Homo sapiens
uuggaccuaaacau

SEQ ID NO: 857605 - RNA, 14 nt, Homo sapiens
uuggauagacuucu

SEQ ID NO: 857606 - RNA, 23 nt, Homo sapiens
uuggcugccuggcccaugugccc

SEQ ID NO: 857607 - RNA, 18 nt, Homo sapiens
uugggaaguuacuguuac

SEQ ID NO: 857608 - RNA, 16 nt, Homo sapiens
uugggacccaguggca

SEQ ID NO: 857609 - RNA, 16 nt, Homo sapiens
uugguaauagauuuaa

SEQ ID NO: 857610 - RNA, 23 nt, Homo sapiens
uugguaauagauuuaauuaugaa

SEQ ID NO: 857611 - RNA, 15 nt, Homo sapiens
uugguacaugccugu

SEQ ID NO: 857612 - RNA, 19 nt, Homo sapiens
uuguagaccuguuucauaa

SEQ ID NO: 857613 - RNA, 20 nt, Homo sapiens
uuguauaugcugcauugaga

SEQ ID NO: 857614 - RNA, 14 nt, Homo sapiens
uuguauccaaggaa

SEQ ID NO: 857615 - RNA, 21 nt, Homo sapiens
uugucagaccauaagaguuuc

SEQ ID NO: 857616 - RNA, 11 nt, Homo sapiens
uugugaugcuc

SEQ ID NO: 857617 - RNA, 15 nt, Homo sapiens
uugugauguacugua

SEQ ID NO: 857618 - RNA, 16 nt, Homo sapiens
uugugauguacuguaa

SEQ ID NO: 857619 - RNA, 20 nt, Homo sapiens
uuguggaagacaagucugug

SEQ ID NO: 857620 - RNA, 19 nt, Homo sapiens
uuguguaagaaauacagac

SEQ ID NO: 857621 - RNA, 16 nt, Homo sapiens
uugugugaacuuggaa

SEQ ID NO: 857622 - RNA, 23 nt, Homo sapiens
uuguuacuguauccucauuugua

SEQ ID NO: 857623 - RNA, 23 nt, Homo sapiens
uuguuauuuucgcacaaugggaa

SEQ ID NO: 857624 - RNA, 22 nt, Homo sapiens
uuguuggggaggggaaugggag

SEQ ID NO: 857625 - RNA, 13 nt, Homo sapiens
uuguuuaaaguau

SEQ ID NO: 857626 - RNA, 16 nt, Homo sapiens
uuguuuaaaugccuaa

SEQ ID NO: 857627 - RNA, 22 nt, Homo sapiens
uuguuuagucuuuauacugcaa

SEQ ID NO: 857628 - RNA, 12 nt, Homo sapiens
uuguuugcuuac

SEQ ID NO: 857629 - RNA, 23 nt, Homo sapiens
uuguuuuuaaacaauaaagcaau

SEQ ID NO: 857630 - RNA, 16 nt, Homo sapiens
uuuaaaaaucugccac

SEQ ID NO: 857631 - RNA, 14 nt, Homo sapiens
uuuaaccauuccau

SEQ ID NO: 857632 - RNA, 14 nt, Homo sapiens
uuuaagaaauuccu

SEQ ID NO: 857633 - RNA, 21 nt, Homo sapiens
uuuaagaaauuccuagugucu

SEQ ID NO: 857634 - RNA, 21 nt, Homo sapiens
uuuaaggcaaugguuucacau

SEQ ID NO: 857635 - RNA, 23 nt, Homo sapiens
uuuacuccuguaagcaagagcca

SEQ ID NO: 857636 - RNA, 16 nt, Homo sapiens
uuuacugacugcuuau

SEQ ID NO: 857637 - RNA, 22 nt, Homo sapiens
uuuacuuggaaauuguuaacau

SEQ ID NO: 857638 - RNA, 19 nt, Homo sapiens
uuuagguggcauaguggcu

SEQ ID NO: 857639 - RNA, 14 nt, Homo sapiens
uuuauaaugaauaa

SEQ ID NO: 857640 - RNA, 14 nt, Homo sapiens
uuuauaauugauga

SEQ ID NO: 857641 - RNA, 16 nt, Homo sapiens
uuuauauaacuguugu

SEQ ID NO: 857642 - RNA, 16 nt, Homo sapiens
uuuauggaccaugaaa

SEQ ID NO: 857643 - RNA, 15 nt, Homo sapiens
uuucaaaauucaaaa

SEQ ID NO: 857644 - RNA, 22 nt, Homo sapiens
ucuauaagugugaccaguuuug

SEQ ID NO: 857645 - RNA, 20 nt, Homo sapiens
ucuaucacccaggaaucuca

SEQ ID NO: 857646 - RNA, 19 nt, Homo sapiens
ucuauucuuggaaccacga

SEQ ID NO: 857647 - RNA, 17 nt, Homo sapiens
ucuauuucucuccuuaa

SEQ ID NO: 857648 - RNA, 16 nt, Homo sapiens
ucuauuuuuguaugaa

SEQ ID NO: 857649 - RNA, 13 nt, Homo sapiens
ucucaaacucccu

SEQ ID NO: 857650 - RNA, 16 nt, Homo sapiens
ucucaggcauggauga

SEQ ID NO: 857651 - RNA, 11 nt, Homo sapiens
ucucauuauuc

SEQ ID NO: 857652 - RNA, 14 nt, Homo sapiens
ucuccauacuuuga

SEQ ID NO: 857653 - RNA, 12 nt, Homo sapiens
ucuccauuucac

SEQ ID NO: 857654 - RNA, 23 nt, Homo sapiens
ucuccccuggggagccugaggag

SEQ ID NO: 857655 - RNA, 17 nt, Homo sapiens
ucucccgggacucugca

SEQ ID NO: 857656 - RNA, 19 nt, Homo sapiens
ucuccgccccugagcccac

SEQ ID NO: 857657 - RNA, 15 nt, Homo sapiens
ucucgcuacauuucc

SEQ ID NO: 857658 - RNA, 14 nt, Homo sapiens
ucucuagugcugug

SEQ ID NO: 857659 - RNA, 22 nt, Homo sapiens
ucucucagagaucuugcauuuc

SEQ ID NO: 857660 - RNA, 23 nt, Homo sapiens
ucucucugggaugcagaacuucc

SEQ ID NO: 857661 - RNA, 11 nt, Homo sapiens
ucucugaccag

SEQ ID NO: 857662 - RNA, 13 nt, Homo sapiens
ucucugaccagaa

SEQ ID NO: 857663 - RNA, 17 nt, Homo sapiens
ucucugaggacaagaga

SEQ ID NO: 857664 - RNA, 20 nt, Homo sapiens
ucucugcuuaguacauuuga

SEQ ID NO: 857665 - RNA, 17 nt, Homo sapiens
uguguauugagauuuac

SEQ ID NO: 857666 - RNA, 22 nt, Homo sapiens
ugugugcccagcuuauaaacag

SEQ ID NO: 857667 - RNA, 17 nt, Homo sapiens
uguuaaaggucauaugc

SEQ ID NO: 857668 - RNA, 20 nt, Homo sapiens
uguuaagcaucuaaggacaa

SEQ ID NO: 857669 - RNA, 12 nt, Homo sapiens
uguuacauagaa

SEQ ID NO: 857670 - RNA, 17 nt, Homo sapiens
uguuacucuugggacau

SEQ ID NO: 857671 - RNA, 15 nt, Homo sapiens
uguucauacugaugu

SEQ ID NO: 857672 - RNA, 18 nt, Homo sapiens
uguucugguggccccuuc

SEQ ID NO: 857673 - RNA, 15 nt, Homo sapiens
uguugaugggaugau

SEQ ID NO: 857674 - RNA, 17 nt, Homo sapiens
uguugguuuuguuucca

SEQ ID NO: 857675 - RNA, 22 nt, Homo sapiens
uguuuaauacccuguacauauc

SEQ ID NO: 857676 - RNA, 23 nt, Homo sapiens
uguuugugcuccguagcuucuag

SEQ ID NO: 857677 - RNA, 19 nt, Homo sapiens
uguuuuacauaacugauaa

SEQ ID NO: 857678 - RNA, 22 nt, Homo sapiens
uguuuuuaguucugacuuugaa

SEQ ID NO: 857679 - RNA, 21 nt, Homo sapiens
uguuuuuuuuuaccuugucau

SEQ ID NO: 857680 - RNA, 23 nt, Homo sapiens
uuaaaaaauauuugucauaugaa

SEQ ID NO: 857681 - RNA, 17 nt, Homo sapiens
uuaaaaccaggcuuucu

SEQ ID NO: 857682 - RNA, 15 nt, Homo sapiens
uuaaaauguauuuac

SEQ ID NO: 857683 - RNA, 17 nt, Homo sapiens
uuaaauuauguuuuacu

SEQ ID NO: 857684 - RNA, 16 nt, Homo sapiens
uuaagaguugaaagaa

SEQ ID NO: 857685 - RNA, 20 nt, Homo sapiens
uuaagauaauuguacuuuga

SEQ ID NO: 857686 - RNA, 18 nt, Homo sapiens
uuaagcaauaaaacugcu

SEQ ID NO: 857687 - RNA, 18 nt, Homo sapiens
uuaagcaucuaaggacaa

SEQ ID NO: 857688 - RNA, 21 nt, Homo sapiens
uuaauaaaaugguucaugaau

SEQ ID NO: 857689 - RNA, 18 nt, Homo sapiens
uuaaucuaggaaugacuc

SEQ ID NO: 857690 - RNA, 20 nt, Homo sapiens
ugcacacaccucaugcuagc

SEQ ID NO: 857691 - RNA, 15 nt, Homo sapiens
ugcacucagacugua

SEQ ID NO: 857692 - RNA, 24 nt, Homo sapiens
ugcacuucaagaagucacugucag

SEQ ID NO: 857693 - RNA, 22 nt, Homo sapiens
ugcagacugaaaagacaaaguu

SEQ ID NO: 857694 - RNA, 22 nt, Homo sapiens
ugcagccucuugggugcuucuc

SEQ ID NO: 857695 - RNA, 12 nt, Homo sapiens
ugcagcugucac

SEQ ID NO: 857696 - RNA, 13 nt, Homo sapiens
ugcagcugucacc

SEQ ID NO: 857697 - RNA, 13 nt, Homo sapiens
ugcaggugcuuuu

SEQ ID NO: 857698 - RNA, 14 nt, Homo sapiens
ugcagucacugcac

SEQ ID NO: 857699 - RNA, 16 nt, Homo sapiens
ugcagucacuuugaca

SEQ ID NO: 857700 - RNA, 23 nt, Homo sapiens
ugcagugauguuugccauuugcu

SEQ ID NO: 857701 - RNA, 19 nt, Homo sapiens
ugcaguggagcagaaggca

SEQ ID NO: 857702 - RNA, 15 nt, Homo sapiens
ugcaguucccaucuc

SEQ ID NO: 857703 - RNA, 18 nt, Homo sapiens
ugcaucuggguagcugua

SEQ ID NO: 857704 - RNA, 17 nt, Homo sapiens
ugcauuuuuuaccacaa

SEQ ID NO: 857705 - RNA, 13 nt, Homo sapiens
ugccagacgcuca

SEQ ID NO: 857706 - RNA, 23 nt, Homo sapiens
ugccagacgcucauucagcaucu

SEQ ID NO: 857707 - RNA, 15 nt, Homo sapiens
ugccaggcacaggca

SEQ ID NO: 857708 - RNA, 21 nt, Homo sapiens
ugccaggcccggcaugaggcc

SEQ ID NO: 857709 - RNA, 23 nt, Homo sapiens
ugccauuugcuggacaaccaaca

SEQ ID NO: 857710 - RNA, 16 nt, Homo sapiens
ugcccagaugaacugg

SEQ ID NO: 857711 - RNA, 20 nt, Homo sapiens
ugcccaggcuggagugcagu

SEQ ID NO: 857712 - RNA, 19 nt, Homo sapiens
ugcccgccaccacacccaa

SEQ ID NO: 857713 - RNA, 23 nt, Homo sapiens
cuugccauuuucaagaaagcauu

SEQ ID NO: 857714 - RNA, 18 nt, Homo sapiens
cuugccccuguuaccuaa

SEQ ID NO: 857715 - RNA, 14 nt, Homo sapiens
cuuggagugccacg

SEQ ID NO: 857716 - RNA, 16 nt, Homo sapiens
cuugggcuccauuccc

SEQ ID NO: 857717 - RNA, 13 nt, Homo sapiens
cuugggcucccug

SEQ ID NO: 857718 - RNA, 23 nt, Homo sapiens
cuugguguguucguggagccaca

SEQ ID NO: 857719 - RNA, 17 nt, Homo sapiens
cuuguaaaugugguaaa

SEQ ID NO: 857720 - RNA, 18 nt, Homo sapiens
cuuguaauucuaaaugaa

SEQ ID NO: 857721 - RNA, 14 nt, Homo sapiens
cuuguacagccuuu

SEQ ID NO: 857722 - RNA, 15 nt, Homo sapiens
cuuguugaugccagc

SEQ ID NO: 857723 - RNA, 17 nt, Homo sapiens
cuuguuuucuacuuugc

SEQ ID NO: 857724 - RNA, 18 nt, Homo sapiens
cuuuacuguuagucauuu

SEQ ID NO: 857725 - RNA, 19 nt, Homo sapiens
cuuuacuguuagucauuug

SEQ ID NO: 857726 - RNA, 24 nt, Homo sapiens
cuuucaggccacauggcuaaagaa

SEQ ID NO: 857727 - RNA, 15 nt, Homo sapiens
cuuuccaaauugaug

SEQ ID NO: 857728 - RNA, 22 nt, Homo sapiens
cuuuccagaacuaccaaaauga

SEQ ID NO: 857729 - RNA, 18 nt, Homo sapiens
cuuuccagcaguauccuc

SEQ ID NO: 857730 - RNA, 22 nt, Homo sapiens
cuuucuuacauuagcaguuugc

SEQ ID NO: 857731 - RNA, 19 nt, Homo sapiens
cuuucuucucucuuugucc

SEQ ID NO: 857732 - RNA, 21 nt, Homo sapiens
cuuugaaaauauuucuaugua

SEQ ID NO: 857733 - RNA, 15 nt, Homo sapiens
cuuugagucaaguca

SEQ ID NO: 857734 - RNA, 16 nt, Homo sapiens
cuuugauugaguucau

SEQ ID NO: 857735 - RNA, 21 nt, Homo sapiens
cuuugauuuuuugcugcagac

SEQ ID NO: 857736 - RNA, 15 nt, Homo sapiens
cuuuggaaaucacac

SEQ ID NO: 857737 - RNA, 15 nt, Homo sapiens
cuuuguaugcacuuu

SEQ ID NO: 857738 - RNA, 18 nt, Homo sapiens
cuuuuauggaccaauuag

SEQ ID NO: 857739 - RNA, 19 nt, Homo sapiens
cuuuucaauguuagccaca

SEQ ID NO: 857740 - RNA, 19 nt, Homo sapiens
cuuuucuggaauguaauca

SEQ ID NO: 857741 - RNA, 21 nt, Homo sapiens
cuuuugcauaagugcaugaca

SEQ ID NO: 857742 - RNA, 16 nt, Homo sapiens
cuuuugguaugugaca

SEQ ID NO: 857743 - RNA, 15 nt, Homo sapiens
cuuuuguaagguacu

SEQ ID NO: 857744 - RNA, 16 nt, Homo sapiens
gaaaacacugugcaca

SEQ ID NO: 857745 - RNA, 16 nt, Homo sapiens
gaaaaccucuuuccaa

SEQ ID NO: 857746 - RNA, 21 nt, Homo sapiens
gaaaaugcuguauuagucaca

SEQ ID NO: 857747 - RNA, 22 nt, Homo sapiens
gaaacaguacagcuauuucuca

SEQ ID NO: 857748 - RNA, 21 nt, Homo sapiens
gaaaccagaaugauuuugaca

SEQ ID NO: 857749 - RNA, 22 nt, Homo sapiens
gaaacccuguuuuauugaguuc

SEQ ID NO: 857750 - RNA, 16 nt, Homo sapiens
gaaacugaguccuguu

SEQ ID NO: 857751 - RNA, 23 nt, Homo sapiens
gaaacuggaaugcuguuacuuug

SEQ ID NO: 857752 - RNA, 14 nt, Homo sapiens
gaaagaagugggga

SEQ ID NO: 857753 - RNA, 14 nt, Homo sapiens
gaaagauggaacuu

SEQ ID NO: 857754 - RNA, 22 nt, Homo sapiens
gaaagccauauuccagcaguga

SEQ ID NO: 857755 - RNA, 17 nt, Homo sapiens
gaaauaucaugcuccau

SEQ ID NO: 857756 - RNA, 12 nt, Homo sapiens
gaaaucaagggc

SEQ ID NO: 857757 - RNA, 17 nt, Homo sapiens
gaaaucaaguuaaugua

SEQ ID NO: 857758 - RNA, 19 nt, Homo sapiens
gaaaucuaugaaauaucau

SEQ ID NO: 857759 - RNA, 19 nt, Homo sapiens
gaaauugcauuuccugaca

SEQ ID NO: 857760 - RNA, 22 nt, Homo sapiens
gaacccuuggagccaauggaga

SEQ ID NO: 857761 - RNA, 13 nt, Homo sapiens
gaacuagacuccc

SEQ ID NO: 857762 - RNA, 15 nt, Homo sapiens
gaacuagagaaggac

SEQ ID NO: 857763 - RNA, 15 nt, Homo sapiens
uugacucuccagaaa

SEQ ID NO: 857764 - RNA, 20 nt, Homo sapiens
uugagggacgaggucaagga

SEQ ID NO: 857765 - RNA, 13 nt, Homo sapiens
uugauauugucac

SEQ ID NO: 857766 - RNA, 17 nt, Homo sapiens
uugauccucacugagaa

SEQ ID NO: 857767 - RNA, 14 nt, Homo sapiens
uugauggugaugaa

SEQ ID NO: 857768 - RNA, 14 nt, Homo sapiens
uugcaaccucgcug

SEQ ID NO: 857769 - RNA, 13 nt, Homo sapiens
uugcaaggcauuu

SEQ ID NO: 857770 - RNA, 21 nt, Homo sapiens
uugcagcuuauauucauccau

SEQ ID NO: 857771 - RNA, 15 nt, Homo sapiens
uugccgcugggagag

SEQ ID NO: 857772 - RNA, 23 nt, Homo sapiens
uugcuauggggagaaaagacaug

SEQ ID NO: 857773 - RNA, 20 nt, Homo sapiens
uuggagaggagguguggagu

SEQ ID NO: 857774 - RNA, 23 nt, Homo sapiens
uuggauuuuccaccaaauucuga

SEQ ID NO: 857775 - RNA, 13 nt, Homo sapiens
uuggcaaugccau

SEQ ID NO: 857776 - RNA, 20 nt, Homo sapiens
uuggccacagccccaaacaa

SEQ ID NO: 857777 - RNA, 20 nt, Homo sapiens
uugggauugagucugugcca

SEQ ID NO: 857778 - RNA, 20 nt, Homo sapiens
uugggcuuguuuucuacuuu

SEQ ID NO: 857779 - RNA, 20 nt, Homo sapiens
uugggggauggcuaaaacca

SEQ ID NO: 857780 - RNA, 14 nt, Homo sapiens
uuggguuccagaca

SEQ ID NO: 857781 - RNA, 20 nt, Homo sapiens
uuguaagaguggaaccaaca

SEQ ID NO: 857782 - RNA, 20 nt, Homo sapiens
uuguaucaaaugugacauua

SEQ ID NO: 857783 - RNA, 18 nt, Homo sapiens
uuguaugauccuaaugaa

SEQ ID NO: 857784 - RNA, 13 nt, Homo sapiens
uuguccaugaugu

SEQ ID NO: 857785 - RNA, 18 nt, Homo sapiens
uuguugcuguuguucaga

SEQ ID NO: 857786 - RNA, 22 nt, Homo sapiens
uuuaaaucaacgaguacuucaa

SEQ ID NO: 857787 - RNA, 20 nt, Homo sapiens
uuuauagucgaacaauucau

SEQ ID NO: 857788 - RNA, 15 nt, Homo sapiens
uuuauauuacuuuug

SEQ ID NO: 857789 - RNA, 23 nt, Homo sapiens
uuuauggaccaauuagcauucca

SEQ ID NO: 857790 - RNA, 16 nt, Homo sapiens
uuuauguuuuaauauc

SEQ ID NO: 857791 - RNA, 21 nt, Homo sapiens
uuuauuacaguuuaucuaugg

SEQ ID NO: 857792 - RNA, 18 nt, Homo sapiens
uuucaaugguugggacaa

SEQ ID NO: 857793 - RNA, 11 nt, Homo sapiens
uuucacugaca

SEQ ID NO: 857794 - RNA, 12 nt, Homo sapiens
uuucacugacac

SEQ ID NO: 857795 - RNA, 16 nt, Homo sapiens
uuucaggccacauggc

SEQ ID NO: 857796 - RNA, 21 nt, Homo sapiens
uuucaggccacauggcuaaag

SEQ ID NO: 857797 - RNA, 19 nt, Homo sapiens
uuucuuguaaacauugccu

SEQ ID NO: 857798 - RNA, 15 nt, Homo sapiens
uuugagcacacauuu

SEQ ID NO: 857799 - RNA, 17 nt, Homo sapiens
uuugauuaaagacucca

SEQ ID NO: 857800 - RNA, 20 nt, Homo sapiens
uuugcaagggaaaagucucu

SEQ ID NO: 857801 - RNA, 19 nt, Homo sapiens
uuugcauaagugcaugaca

SEQ ID NO: 857802 - RNA, 22 nt, Homo sapiens
uuuggaaaucacacgucuggcu

SEQ ID NO: 857803 - RNA, 15 nt, Homo sapiens
uuuggccuccuccag

SEQ ID NO: 857804 - RNA, 20 nt, Homo sapiens
uuugggaacugcaauaaccu

SEQ ID NO: 857805 - RNA, 16 nt, Homo sapiens
uuugguaugugacaug

SEQ ID NO: 857806 - RNA, 20 nt, Homo sapiens
uuuguuuuguaucauuauga

SEQ ID NO: 857807 - RNA, 19 nt, Homo sapiens
uuuuaaaaauucacuucua

SEQ ID NO: 857808 - RNA, 19 nt, Homo sapiens
uuuuaacaaaugauuuaca

SEQ ID NO: 857809 - RNA, 20 nt, Homo sapiens
uuuuacacucuagugccaua

SEQ ID NO: 857810 - RNA, 21 nt, Homo sapiens
uuuucacugcuggcugccuua

SEQ ID NO: 857811 - RNA, 17 nt, Homo sapiens
uuuucauuggaugcagu

SEQ ID NO: 857812 - RNA, 13 nt, Homo sapiens
uuuuccacuuaga

SEQ ID NO: 857813 - RNA, 21 nt, Homo sapiens
uuuucuaagaaagaaauugua

SEQ ID NO: 857814 - RNA, 19 nt, Homo sapiens
uuuugcuggucacugccau

SEQ ID NO: 857815 - RNA, 21 nt, Homo sapiens
uuuuguaaauauucuugucca

SEQ ID NO: 857816 - RNA, 22 nt, Homo sapiens
uuuuuaucuccccuucacaugc

SEQ ID NO: 857817 - RNA, 18 nt, Homo sapiens
uuuuuguucaaagccagc

SEQ ID NO: 857818 - RNA, 15 nt, Homo sapiens
ugauucacaguguga

SEQ ID NO: 857819 - RNA, 13 nt, Homo sapiens
ugauugaaguauc

SEQ ID NO: 857820 - RNA, 11 nt, Homo sapiens
ugauuugcaac

SEQ ID NO: 857821 - RNA, 22 nt, Homo sapiens
ugcaaaaggacucucaggacca

SEQ ID NO: 857822 - RNA, 21 nt, Homo sapiens
ugcaaagacugaguguucaaa

SEQ ID NO: 857823 - RNA, 13 nt, Homo sapiens
ugcaacuuguaaa

SEQ ID NO: 857824 - RNA, 13 nt, Homo sapiens
ugcaagucccaug

SEQ ID NO: 857825 - RNA, 14 nt, Homo sapiens
ugcacacuuugcca

SEQ ID NO: 857826 - RNA, 19 nt, Homo sapiens
ugcacauacuugagacugu

SEQ ID NO: 857827 - RNA, 13 nt, Homo sapiens
ugcaccucauucc

SEQ ID NO: 857828 - RNA, 14 nt, Homo sapiens
ugcaccucauucca

SEQ ID NO: 857829 - RNA, 21 nt, Homo sapiens
ugcacuguucccccugugcag

SEQ ID NO: 857830 - RNA, 13 nt, Homo sapiens
ugcagagacagag

SEQ ID NO: 857831 - RNA, 15 nt, Homo sapiens
ugcagcuuauauuca

SEQ ID NO: 857832 - RNA, 19 nt, Homo sapiens
ugcagcuuauauucaucca

SEQ ID NO: 857833 - RNA, 14 nt, Homo sapiens
ugcaggguaggggg

SEQ ID NO: 857834 - RNA, 20 nt, Homo sapiens
ugcauaagugcaugacauau

SEQ ID NO: 857835 - RNA, 18 nt, Homo sapiens
ugccacuuggccaccagg

SEQ ID NO: 857836 - RNA, 22 nt, Homo sapiens
ugccaggacucucuuucuucca

SEQ ID NO: 857837 - RNA, 15 nt, Homo sapiens
ugccauuucuuccca

SEQ ID NO: 857838 - RNA, 16 nt, Homo sapiens
ugcccacgucccgggc

SEQ ID NO: 857839 - RNA, 21 nt, Homo sapiens
ugcccacgucccgggcacugu

SEQ ID NO: 857840 - RNA, 22 nt, Homo sapiens
ugcccacgucccgggcacuguc

SEQ ID NO: 857841 - RNA, 20 nt, Homo sapiens
ugcccagcuuggagugccac

SEQ ID NO: 857842 - RNA, 21 nt, Homo sapiens
ugccucauuaccuugugcuaa

SEQ ID NO: 857843 - RNA, 15 nt, Homo sapiens
ugccucuguauuuaa

SEQ ID NO: 857844 - RNA, 14 nt, Homo sapiens
ugccugaacacugc

SEQ ID NO: 857845 - RNA, 21 nt, Homo sapiens
ugccugccucaugcucucuau

SEQ ID NO: 857846 - RNA, 18 nt, Homo sapiens
ugccuuuagaaacugagu

SEQ ID NO: 857847 - RNA, 16 nt, Homo sapiens
ugccuuuuaccuucag

SEQ ID NO: 857848 - RNA, 15 nt, Homo sapiens
ugcuaucgcaccacu

SEQ ID NO: 857849 - RNA, 22 nt, Homo sapiens
ugcuccuaccccuguccugggg

SEQ ID NO: 857850 - RNA, 15 nt, Homo sapiens
ugcucucccagguga

SEQ ID NO: 857851 - RNA, 14 nt, Homo sapiens
ugcuggcugccuua

SEQ ID NO: 857852 - RNA, 13 nt, Homo sapiens
ugcugucaugccc

SEQ ID NO: 857853 - RNA, 21 nt, Homo sapiens
ugcuuauaagcaacaugaauu

SEQ ID NO: 857854 - RNA, 17 nt, Homo sapiens
ugcuucugcucacauuc

SEQ ID NO: 857855 - RNA, 14 nt, Homo sapiens
ugcuuguuauuaga

SEQ ID NO: 857856 - RNA, 17 nt, Homo sapiens
ugcuuuguaugcacuuu

SEQ ID NO: 857857 - RNA, 19 nt, Homo sapiens
uggaaaacaguauuuucca

SEQ ID NO: 857858 - RNA, 14 nt, Homo sapiens
uggaaaauaaauca

SEQ ID NO: 857859 - RNA, 14 nt, Homo sapiens
uggaacacaaccau

SEQ ID NO: 857860 - RNA, 16 nt, Homo sapiens
uggaauauaaauauca

SEQ ID NO: 857861 - RNA, 16 nt, Homo sapiens
uggaauuuaagaaaua

SEQ ID NO: 857862 - RNA, 19 nt, Homo sapiens
uggaccaauuagcauucca

SEQ ID NO: 857863 - RNA, 19 nt, Homo sapiens
uggacuuuugcagcuuccu

SEQ ID NO: 857864 - RNA, 17 nt, Homo sapiens
uggagagagaguucuca

SEQ ID NO: 857865 - RNA, 18 nt, Homo sapiens
uggaggaaagugauaucc

SEQ ID NO: 857866 - RNA, 21 nt, Homo sapiens
uggauacuauuaaaguaacau

SEQ ID NO: 857867 - RNA, 19 nt, Homo sapiens
uggauuuagagacuguaaa

SEQ ID NO: 857868 - RNA, 15 nt, Homo sapiens
uggcaaggugacauu

SEQ ID NO: 857869 - RNA, 22 nt, Homo sapiens
uggcaauucuucuucucaagca

SEQ ID NO: 857870 - RNA, 16 nt, Homo sapiens
uggcacccaugcaccu

SEQ ID NO: 857871 - RNA, 17 nt, Homo sapiens
uggcagccgugccuuca

SEQ ID NO: 857872 - RNA, 14 nt, Homo sapiens
uggcaggacacugc

SEQ ID NO: 857873 - RNA, 19 nt, Homo sapiens
uggccaaauaugcacuuuc

SEQ ID NO: 857874 - RNA, 14 nt, Homo sapiens
uggccaaucccugu

SEQ ID NO: 857875 - RNA, 12 nt, Homo sapiens
uggccccaguga

SEQ ID NO: 857876 - RNA, 23 nt, Homo sapiens
uggcccuguugugggggugucac

SEQ ID NO: 857877 - RNA, 17 nt, Homo sapiens
uggccggcaucuggccc

SEQ ID NO: 857878 - RNA, 19 nt, Homo sapiens
uggcuaaaaccaucauagu

SEQ ID NO: 857879 - RNA, 18 nt, Homo sapiens
gucccugcgucuccugcc

SEQ ID NO: 857880 - RNA, 15 nt, Homo sapiens
guccuaagcccacaa

SEQ ID NO: 857881 - RNA, 14 nt, Homo sapiens
guccuggggugguu

SEQ ID NO: 857882 - RNA, 19 nt, Homo sapiens
guccuguuaugucauugug

SEQ ID NO: 857883 - RNA, 13 nt, Homo sapiens
gucuaagucauga

SEQ ID NO: 857884 - RNA, 18 nt, Homo sapiens
gucuaggaacauacuuca

SEQ ID NO: 857885 - RNA, 19 nt, Homo sapiens
gucucauaauugucaaaaa

SEQ ID NO: 857886 - RNA, 19 nt, Homo sapiens
gucucauggcagucccaaa

SEQ ID NO: 857887 - RNA, 22 nt, Homo sapiens
gucugaaggagaggagugcgcu

SEQ ID NO: 857888 - RNA, 14 nt, Homo sapiens
gucuucaagcagau

SEQ ID NO: 857889 - RNA, 13 nt, Homo sapiens
gucuucccuguau

SEQ ID NO: 857890 - RNA, 15 nt, Homo sapiens
gucuuuacagaauca

SEQ ID NO: 857891 - RNA, 20 nt, Homo sapiens
gucuuugaaauaugcaugua

SEQ ID NO: 857892 - RNA, 17 nt, Homo sapiens
gugaaacuugugcuaua

SEQ ID NO: 857893 - RNA, 16 nt, Homo sapiens
gugaacauaacuguaa

SEQ ID NO: 857894 - RNA, 15 nt, Homo sapiens
gugaagugguuuaaa

SEQ ID NO: 857895 - RNA, 16 nt, Homo sapiens
gugaauaaaccaucau

SEQ ID NO: 857896 - RNA, 22 nt, Homo sapiens
gugaucagaccauaauguuaca

SEQ ID NO: 857897 - RNA, 18 nt, Homo sapiens
gugcaccacuucaaguga

SEQ ID NO: 857898 - RNA, 22 nt, Homo sapiens
gugcacugaaucguuucaugua

SEQ ID NO: 857899 - RNA, 21 nt, Homo sapiens
gugccacguggccgcugccca

SEQ ID NO: 857900 - RNA, 15 nt, Homo sapiens
gugccagcuguuuca

SEQ ID NO: 857901 - RNA, 11 nt, Homo sapiens
gugcugucaug

SEQ ID NO: 857902 - RNA, 18 nt, Homo sapiens
guggcuucccgcucagcc

SEQ ID NO: 857903 - RNA, 16 nt, Homo sapiens
guggggcagcacagag

SEQ ID NO: 857904 - RNA, 17 nt, Homo sapiens
gugguccuuugggguga

SEQ ID NO: 857905 - RNA, 14 nt, Homo sapiens
guguggaguggagg

SEQ ID NO: 857906 - RNA, 21 nt, Homo sapiens
guuaccugaaaacacugugca

SEQ ID NO: 857907 - RNA, 22 nt, Homo sapiens
guuaccugaaaacacugugcac

SEQ ID NO: 857908 - RNA, 22 nt, Homo sapiens
guuacuaagaugaaauugccaa

SEQ ID NO: 857909 - RNA, 23 nt, Homo sapiens
guuacuaauuuguauaacccaua

SEQ ID NO: 857910 - RNA, 23 nt, Homo sapiens
guuagaaucccauggauguuucu

SEQ ID NO: 857911 - RNA, 14 nt, Homo sapiens
guuaguuccuucau

SEQ ID NO: 857912 - RNA, 14 nt, Homo sapiens
guugcccagugugu

SEQ ID NO: 857913 - RNA, 14 nt, Homo sapiens
guuuauccuuaaga

SEQ ID NO: 857914 - RNA, 20 nt, Homo sapiens
guuucugaucugaugcaagc

SEQ ID NO: 857915 - RNA, 17 nt, Homo sapiens
guuugaauuacagggaa

SEQ ID NO: 857916 - RNA, 14 nt, Homo sapiens
guuugaguuacuau

SEQ ID NO: 857917 - RNA, 17 nt, Homo sapiens
guuugauuauucagugu

SEQ ID NO: 857918 - RNA, 20 nt, Homo sapiens
guuugcucccauuacucaaa

SEQ ID NO: 857919 - RNA, 15 nt, Homo sapiens
guuuuacaguauauc

SEQ ID NO: 857920 - RNA, 16 nt, Homo sapiens
guuuuauuagcauuuu

SEQ ID NO: 857921 - RNA, 17 nt, Homo sapiens
uaaaaaauaaaguacgu

SEQ ID NO: 857922 - RNA, 13 nt, Homo sapiens
uaaaaaauaucuu

SEQ ID NO: 857923 - RNA, 16 nt, Homo sapiens
uaaaaauaugugagca

SEQ ID NO: 857924 - RNA, 17 nt, Homo sapiens
uaaaacuucugauuucu

SEQ ID NO: 857925 - RNA, 23 nt, Homo sapiens
uaaaacuucugauuucucuucag

SEQ ID NO: 857926 - RNA, 22 nt, Homo sapiens
uaaaacuuuaaucccacuugcc

SEQ ID NO: 857927 - RNA, 21 nt, Homo sapiens
uaaaagaugcauuaucuauga

SEQ ID NO: 857928 - RNA, 23 nt, Homo sapiens
uaaaaguaccuauugaacaugug

SEQ ID NO: 857929 - RNA, 14 nt, Homo sapiens
uaaaaugugcagua

SEQ ID NO: 857930 - RNA, 10 nt, Homo sapiens
uaaaccaaac

SEQ ID NO: 857931 - RNA, 17 nt, Homo sapiens
uaaaccaucaucuugcc

SEQ ID NO: 857932 - RNA, 14 nt, Homo sapiens
uaaacucacuagaa

SEQ ID NO: 857933 - RNA, 13 nt, Homo sapiens
uaaacugugcacc

SEQ ID NO: 857934 - RNA, 21 nt, Homo sapiens
uaaacuuaccugggcauucuu

SEQ ID NO: 857935 - RNA, 22 nt, Homo sapiens
uaaagggagauaacaaucugua

SEQ ID NO: 857936 - RNA, 14 nt, Homo sapiens
uaaauagaugaguc

SEQ ID NO: 857937 - RNA, 18 nt, Homo sapiens
uaaauagaugaguccugu

SEQ ID NO: 857938 - RNA, 15 nt, Homo sapiens
uaaauaucacaaagu

SEQ ID NO: 857939 - RNA, 23 nt, Homo sapiens
uaaauaucccagagaacaaucac

SEQ ID NO: 857940 - RNA, 14 nt, Homo sapiens
uaaaucaaugcuau

SEQ ID NO: 857941 - RNA, 14 nt, Homo sapiens
uaaauguacauuaa

SEQ ID NO: 857942 - RNA, 20 nt, Homo sapiens
uaacaaguagcacccuggau

SEQ ID NO: 857943 - RNA, 23 nt, Homo sapiens
uaacaucugaagugucuaaugca

SEQ ID NO: 857944 - RNA, 15 nt, Homo sapiens
uaacugaauucugaa

SEQ ID NO: 857945 - RNA, 17 nt, Homo sapiens
uaacugccuuguguaca

SEQ ID NO: 857946 - RNA, 20 nt, Homo sapiens
uaagagaauccacauaaaag

SEQ ID NO: 857947 - RNA, 24 nt, Homo sapiens
uaagaguggaaccaacacuaacau

SEQ ID NO: 857948 - RNA, 13 nt, Homo sapiens
uaagauucaucca

SEQ ID NO: 857949 - RNA, 16 nt, Homo sapiens
uaagcagaccacugau

SEQ ID NO: 857950 - RNA, 17 nt, Homo sapiens
uaagucaaccugccuga

SEQ ID NO: 857951 - RNA, 14 nt, Homo sapiens
uaagugcaugacau

SEQ ID NO: 857952 - RNA, 13 nt, Homo sapiens
uaaguuucacuga

SEQ ID NO: 857953 - RNA, 14 nt, Homo sapiens
uaaguuucugggac

SEQ ID NO: 857954 - RNA, 20 nt, Homo sapiens
uaauaaaaaucaugcuuaua

SEQ ID NO: 857955 - RNA, 15 nt, Homo sapiens
uaauaaaaccaaaga

SEQ ID NO: 857956 - RNA, 18 nt, Homo sapiens
uaauaaguuucacugacu

SEQ ID NO: 857957 - RNA, 20 nt, Homo sapiens
uccaacuccuaccgcgauac

SEQ ID NO: 857958 - RNA, 22 nt, Homo sapiens
uccaagucuuccugaccaccuu

SEQ ID NO: 857959 - RNA, 14 nt, Homo sapiens
uccaaucuccauca

SEQ ID NO: 857960 - RNA, 16 nt, Homo sapiens
uccaaucuccaucacc

SEQ ID NO: 857961 - RNA, 15 nt, Homo sapiens
uccacaucuaacaaa

SEQ ID NO: 857962 - RNA, 18 nt, Homo sapiens
uccaccccccggccacac

SEQ ID NO: 857963 - RNA, 23 nt, Homo sapiens
uccacggagccacuccucugacu

SEQ ID NO: 857964 - RNA, 13 nt, Homo sapiens
uccacuccuccca

SEQ ID NO: 857965 - RNA, 24 nt, Homo sapiens
uccagacaaaccagaagcaacaga

SEQ ID NO: 857966 - RNA, 20 nt, Homo sapiens
uccagccguguuguagcuaa

SEQ ID NO: 857967 - RNA, 18 nt, Homo sapiens
uccagcuucccuuugauu

SEQ ID NO: 857968 - RNA, 18 nt, Homo sapiens
uccaugaaaaacagcaga

SEQ ID NO: 857969 - RNA, 19 nt, Homo sapiens
uccauguagaagagggaga

SEQ ID NO: 857970 - RNA, 21 nt, Homo sapiens
ucccagcugaaauacugaggg

SEQ ID NO: 857971 - RNA, 13 nt, Homo sapiens
uccccauggugca

SEQ ID NO: 857972 - RNA, 12 nt, Homo sapiens
ucccccacugau

SEQ ID NO: 857973 - RNA, 17 nt, Homo sapiens
ucccccagccucaaguc

SEQ ID NO: 857974 - RNA, 22 nt, Homo sapiens
uccccucacuucucccaccugc

SEQ ID NO: 857975 - RNA, 21 nt, Homo sapiens
uccccucauccacuaggugcc

SEQ ID NO: 857976 - RNA, 16 nt, Homo sapiens
ucccgggcacugucau

SEQ ID NO: 857977 - RNA, 21 nt, Homo sapiens
ucccgggcacugucaugccca

SEQ ID NO: 857978 - RNA, 21 nt, Homo sapiens
ucccuacgaggaguguuccca

SEQ ID NO: 857979 - RNA, 11 nt, Homo sapiens
ucccuccacuc

SEQ ID NO: 857980 - RNA, 23 nt, Homo sapiens
ucccugaaguaagcaaagacuuu

SEQ ID NO: 857981 - RNA, 20 nt, Homo sapiens
ucccugcaaggugcaccugc

SEQ ID NO: 857982 - RNA, 18 nt, Homo sapiens
ucccuuugaaaugaauau

SEQ ID NO: 857983 - RNA, 13 nt, Homo sapiens
ucccuuuguugcu

SEQ ID NO: 857984 - RNA, 18 nt, Homo sapiens
uccggaauccuguccuca

SEQ ID NO: 857985 - RNA, 18 nt, Homo sapiens
uccuaaaauaaacaugaa

SEQ ID NO: 857986 - RNA, 20 nt, Homo sapiens
uccuaacaaguagcacccug

SEQ ID NO: 857987 - RNA, 18 nt, Homo sapiens
uccuccagaauggagcug

SEQ ID NO: 857988 - RNA, 14 nt, Homo sapiens
uccuccaugggaga

SEQ ID NO: 857989 - RNA, 12 nt, Homo sapiens
uccucggcagcu

SEQ ID NO: 857990 - RNA, 21 nt, Homo sapiens
uccucuaauuaaaaugugcag

SEQ ID NO: 857991 - RNA, 14 nt, Homo sapiens
uccucuguccucau

SEQ ID NO: 857992 - RNA, 16 nt, Homo sapiens
uccucugugaccaaug

SEQ ID NO: 857993 - RNA, 14 nt, Homo sapiens
uccugacccuguga

SEQ ID NO: 857994 - RNA, 19 nt, Homo sapiens
uccugaggggauaucccua

SEQ ID NO: 857995 - RNA, 21 nt, Homo sapiens
uccugccuucucuucuauccu

SEQ ID NO: 857996 - RNA, 15 nt, Homo sapiens
uccugggugcuguca

SEQ ID NO: 857997 - RNA, 16 nt, Homo sapiens
uccugggugcugucau

SEQ ID NO: 857998 - RNA, 20 nt, Homo sapiens
uccugggugcugucaugccc

SEQ ID NO: 857999 - RNA, 22 nt, Homo sapiens
uccugggugcugucaugcccag

SEQ ID NO: 858000 - RNA, 18 nt, Homo sapiens
uccuuucuuuaaacuaua

SEQ ID NO: 858001 - RNA, 15 nt, Homo sapiens
ucgaacaauucauau

SEQ ID NO: 858002 - RNA, 18 nt, Homo sapiens
ucgcuggugaagacccag

SEQ ID NO: 858003 - RNA, 17 nt, Homo sapiens
ucgggacuucaaaauca

SEQ ID NO: 858004 - RNA, 20 nt, Homo sapiens
ucggggcccccgcagcagca

SEQ ID NO: 858005 - RNA, 21 nt, Homo sapiens
ucuaaaagggggcuauucccu

SEQ ID NO: 858006 - RNA, 16 nt, Homo sapiens
ucuaacccacccucac

SEQ ID NO: 858007 - RNA, 15 nt, Homo sapiens
ucuacuaacaaucag

SEQ ID NO: 858008 - RNA, 21 nt, Homo sapiens
ucuacuaacaaucagcuccuu

SEQ ID NO: 858009 - RNA, 20 nt, Homo sapiens
ucuagaaccaggcaacuugg

SEQ ID NO: 858010 - RNA, 18 nt, Homo sapiens
ucucacuugugcaguguu

SEQ ID NO: 858011 - RNA, 23 nt, Homo sapiens
ucucagaacagucugaaauaccu

SEQ ID NO: 858012 - RNA, 14 nt, Homo sapiens
ucucagccucugaa

SEQ ID NO: 858013 - RNA, 21 nt, Homo sapiens
ucucauaauugucaaaaacca

SEQ ID NO: 858014 - RNA, 13 nt, Homo sapiens
ucucauccaucau

SEQ ID NO: 858015 - RNA, 16 nt, Homo sapiens
aaaaacaccuaaguga

SEQ ID NO: 858016 - RNA, 15 nt, Homo sapiens
aaaaauaaaguacgu

SEQ ID NO: 858017 - RNA, 14 nt, Homo sapiens
aaaacaaagccuua

SEQ ID NO: 858018 - RNA, 21 nt, Homo sapiens
aaaacacugcuguucuuuaaa

SEQ ID NO: 858019 - RNA, 15 nt, Homo sapiens
aaaacacugugcaca

SEQ ID NO: 858020 - RNA, 20 nt, Homo sapiens
aaaacauagaguagaccuga

SEQ ID NO: 858021 - RNA, 17 nt, Homo sapiens
aaaacauugcugccuaa

SEQ ID NO: 858022 - RNA, 19 nt, Homo sapiens
aaaacccacaaaaguacaa

SEQ ID NO: 858023 - RNA, 11 nt, Homo sapiens
aaaauaugcau

SEQ ID NO: 858024 - RNA, 17 nt, Homo sapiens
aaaauugugaucagacc

SEQ ID NO: 858025 - RNA, 17 nt, Homo sapiens
aaacaaauguauuucaa

SEQ ID NO: 858026 - RNA, 19 nt, Homo sapiens
aaacaguaacuaagcacau

SEQ ID NO: 858027 - RNA, 16 nt, Homo sapiens
aaacaugaagcacaaa

SEQ ID NO: 858028 - RNA, 22 nt, Homo sapiens
aaacgauuuugaacauacuuca

SEQ ID NO: 858029 - RNA, 20 nt, Homo sapiens
aaacggaacucuucaucuua

SEQ ID NO: 858030 - RNA, 23 nt, Homo sapiens
aaacuagauucauggcuuuaaca

SEQ ID NO: 858031 - RNA, 17 nt, Homo sapiens
aaacuauguaacaugua

SEQ ID NO: 858032 - RNA, 18 nt, Homo sapiens
aaacuauguaacauguag

SEQ ID NO: 858033 - RNA, 20 nt, Homo sapiens
aaacuuccacuaccuuuaaa

SEQ ID NO: 858034 - RNA, 13 nt, Homo sapiens
aaagaagguuuca

SEQ ID NO: 858035 - RNA, 14 nt, Homo sapiens
aaagaaguggggac

SEQ ID NO: 858036 - RNA, 20 nt, Homo sapiens
aaagacauucugacaucuua

SEQ ID NO: 858037 - RNA, 22 nt, Homo sapiens
aaagccucagcaacagccagug

SEQ ID NO: 858038 - RNA, 23 nt, Homo sapiens
aaagcuuucauguaaacugugca

SEQ ID NO: 858039 - RNA, 16 nt, Homo sapiens
aaaggagggucaggaa

SEQ ID NO: 858040 - RNA, 19 nt, Homo sapiens
aaaggggacagaucuugag

SEQ ID NO: 858041 - RNA, 18 nt, Homo sapiens
aaagggggcuauucccug

SEQ ID NO: 858042 - RNA, 15 nt, Homo sapiens
aaaguaaauugccuu

SEQ ID NO: 858043 - RNA, 13 nt, Homo sapiens
aaagucuucuuuc

SEQ ID NO: 858044 - RNA, 15 nt, Homo sapiens
aaaguuuuaaccuca

SEQ ID NO: 858045 - RNA, 16 nt, Homo sapiens
aaaguuuuuacagugu

SEQ ID NO: 858046 - RNA, 13 nt, Homo sapiens
aaauaauuguaug

SEQ ID NO: 858047 - RNA, 17 nt, Homo sapiens
aaauagagccugaggga

SEQ ID NO: 858048 - RNA, 14 nt, Homo sapiens
aaauaucacaaagu

SEQ ID NO: 858049 - RNA, 23 nt, Homo sapiens
aaauaucuuagguuggagaugac

SEQ ID NO: 858050 - RNA, 22 nt, Homo sapiens
aaauauuuaaaaaaaaacauuc

SEQ ID NO: 858051 - RNA, 21 nt, Homo sapiens
aaaucaaguuggcuucuaauc

SEQ ID NO: 858052 - RNA, 17 nt, Homo sapiens
aaaucgcauuaaugaaa

SEQ ID NO: 858053 - RNA, 15 nt, Homo sapiens
aaaucuuaagagaau

SEQ ID NO: 858054 - RNA, 17 nt, Homo sapiens
aaaugaaaaugucuugu

SEQ ID NO: 858055 - RNA, 23 nt, Homo sapiens
aaaugucuuuccuuuugcucuua

SEQ ID NO: 858056 - RNA, 19 nt, Homo sapiens
aaauguuauagcugcauuu

SEQ ID NO: 858057 - RNA, 21 nt, Homo sapiens
aaauguuauagcugcauuugu

SEQ ID NO: 858058 - RNA, 22 nt, Homo sapiens
aaauuaccccggggcacccuua

SEQ ID NO: 858059 - RNA, 13 nt, Homo sapiens
aaauuauaaguaa

SEQ ID NO: 858060 - RNA, 20 nt, Homo sapiens
gccacuccagaccccuggcu

SEQ ID NO: 858061 - RNA, 17 nt, Homo sapiens
gccaggaguggguuucc

SEQ ID NO: 858062 - RNA, 15 nt, Homo sapiens
gccaguaaaaguaua

SEQ ID NO: 858063 - RNA, 16 nt, Homo sapiens
gccaguaaggcagcuc

SEQ ID NO: 858064 - RNA, 23 nt, Homo sapiens
gccaugagaaaagggaagccgcc

SEQ ID NO: 858065 - RNA, 14 nt, Homo sapiens
gccauuucuuccca

SEQ ID NO: 858066 - RNA, 14 nt, Homo sapiens
gcccaagaauagau

SEQ ID NO: 858067 - RNA, 14 nt, Homo sapiens
gcccaaucacugcc

SEQ ID NO: 858068 - RNA, 13 nt, Homo sapiens
gcccagugcacac

SEQ ID NO: 858069 - RNA, 16 nt, Homo sapiens
gccccaggcauugcca

SEQ ID NO: 858070 - RNA, 19 nt, Homo sapiens
gccccaggcauugccaagg

SEQ ID NO: 858071 - RNA, 17 nt, Homo sapiens
gcccccagcugcuccuc

SEQ ID NO: 858072 - RNA, 14 nt, Homo sapiens
gccccccuucccac

SEQ ID NO: 858073 - RNA, 15 nt, Homo sapiens
gccccuguuaccuaa

SEQ ID NO: 858074 - RNA, 14 nt, Homo sapiens
gcccucaguuuuca

SEQ ID NO: 858075 - RNA, 21 nt, Homo sapiens
gcccugcgaccacagcaggga

SEQ ID NO: 858076 - RNA, 15 nt, Homo sapiens
gcccuggugcugcca

SEQ ID NO: 858077 - RNA, 18 nt, Homo sapiens
gcccuuccucuccacugc

SEQ ID NO: 858078 - RNA, 23 nt, Homo sapiens
gccgcugugcuguugucugccgu

SEQ ID NO: 858079 - RNA, 18 nt, Homo sapiens
gccguguuguagcuaauu

SEQ ID NO: 858080 - RNA, 21 nt, Homo sapiens
gccuccucucucaaacugggg

SEQ ID NO: 858081 - RNA, 16 nt, Homo sapiens
gccugaacacugcuuc

SEQ ID NO: 858082 - RNA, 17 nt, Homo sapiens
gccugagguuugccagc

SEQ ID NO: 858083 - RNA, 18 nt, Homo sapiens
gccugugcuuuuggagcu

SEQ ID NO: 858084 - RNA, 23 nt, Homo sapiens
gccuucuccagacaaaccagaag

SEQ ID NO: 858085 - RNA, 16 nt, Homo sapiens
gccuuuuauggaccaa

SEQ ID NO: 858086 - RNA, 23 nt, Homo sapiens
gcgcacuucccauuuguguuuca

SEQ ID NO: 858087 - RNA, 21 nt, Homo sapiens
gcggcucuuccuggacaguga

SEQ ID NO: 858088 - RNA, 14 nt, Homo sapiens
gcgucuccugccca

SEQ ID NO: 858089 - RNA, 20 nt, Homo sapiens
gcuaaaauuagaugaacuca

SEQ ID NO: 858090 - RNA, 22 nt, Homo sapiens
gcuaugugaagaguaagucaac

SEQ ID NO: 858091 - RNA, 19 nt, Homo sapiens
gcucagggaauaauccaga

SEQ ID NO: 858092 - RNA, 18 nt, Homo sapiens
gcucauauuguucccuau

SEQ ID NO: 858093 - RNA, 15 nt, Homo sapiens
gcucaucauucucug

SEQ ID NO: 858094 - RNA, 13 nt, Homo sapiens
gcuccacuguaaa

SEQ ID NO: 858095 - RNA, 21 nt, Homo sapiens
gcuccaucgcugucaucucag

SEQ ID NO: 858096 - RNA, 13 nt, Homo sapiens
gcuccauguagaa

SEQ ID NO: 858097 - RNA, 20 nt, Homo sapiens
gcuccauguagaagccacua

SEQ ID NO: 858098 - RNA, 15 nt, Homo sapiens
gcuccccaauacucu

SEQ ID NO: 858099 - RNA, 19 nt, Homo sapiens
gcucgcccaggacuccccg

SEQ ID NO: 858100 - RNA, 16 nt, Homo sapiens
gcucgcuuugagugac

SEQ ID NO: 858101 - RNA, 21 nt, Homo sapiens
gcucuguauucugcaacagcc

SEQ ID NO: 858102 - RNA, 20 nt, Homo sapiens
gcucuuacccacacuacgca

SEQ ID NO: 858103 - RNA, 14 nt, Homo sapiens
gcucuucagcacca

SEQ ID NO: 858104 - RNA, 19 nt, Homo sapiens
gcucuuccuggacagugag

SEQ ID NO: 858105 - RNA, 19 nt, Homo sapiens
gcugacagauguuccaucc

SEQ ID NO: 858106 - RNA, 18 nt, Homo sapiens
gcugacuguacuccuccc

SEQ ID NO: 858107 - RNA, 21 nt, Homo sapiens
gcugaugaacucuuaaucaaa

SEQ ID NO: 858108 - RNA, 13 nt, Homo sapiens
gcugcagggacag

SEQ ID NO: 858109 - RNA, 18 nt, Homo sapiens
gcugccagcucuguauca

SEQ ID NO: 858110 - RNA, 19 nt, Homo sapiens
gcugccucuaccugacacu

SEQ ID NO: 858111 - RNA, 13 nt, Homo sapiens
gcugcugugacag

SEQ ID NO: 858112 - RNA, 23 nt, Homo sapiens
gcuggcagcuucgugugcagcua

SEQ ID NO: 858113 - RNA, 17 nt, Homo sapiens
gcugggcgccucugucc

SEQ ID NO: 858114 - RNA, 21 nt, Homo sapiens
gcuggguuugggcaguggaga

SEQ ID NO: 858115 - RNA, 13 nt, Homo sapiens
gcugucaucucag

SEQ ID NO: 858116 - RNA, 16 nt, Homo sapiens
gcuucacggacaggaa

SEQ ID NO: 858117 - RNA, 17 nt, Homo sapiens
gcuucccuuugauuuuu

SEQ ID NO: 858118 - RNA, 19 nt, Homo sapiens
gcuuccgagggcacuaccg

SEQ ID NO: 858119 - RNA, 15 nt, Homo sapiens
ggaaaacaguaacua

SEQ ID NO: 858120 - RNA, 13 nt, Homo sapiens
ggaaaacaguauu

SEQ ID NO: 858121 - RNA, 11 nt, Homo sapiens
ggaaaucacac

SEQ ID NO: 858122 - RNA, 13 nt, Homo sapiens
ggaacugcaauaa

SEQ ID NO: 858123 - RNA, 17 nt, Homo sapiens
ggaagagggugauugcu

SEQ ID NO: 858124 - RNA, 20 nt, Homo sapiens
ggacccuggaagcagggacu

SEQ ID NO: 858125 - RNA, 21 nt, Homo sapiens
ggagacagagcugguugggaa

SEQ ID NO: 858126 - RNA, 21 nt, Homo sapiens
ggagacuagauuuaugaauac

SEQ ID NO: 858127 - RNA, 16 nt, Homo sapiens
ggagcuggcccucucc

SEQ ID NO: 858128 - RNA, 20 nt, Homo sapiens
ggagcuuuugguaugugaca

SEQ ID NO: 858129 - RNA, 22 nt, Homo sapiens
ggagugggcucucuggaccuga

SEQ ID NO: 858130 - RNA, 11 nt, Homo sapiens
ggauagcacug

SEQ ID NO: 858131 - RNA, 20 nt, Homo sapiens
ggaucaucuauugcuggcaa

SEQ ID NO: 858132 - RNA, 17 nt, Homo sapiens
ggauccagccauuccug

SEQ ID NO: 858133 - RNA, 13 nt, Homo sapiens
ggaucugcagcuc

SEQ ID NO: 858134 - RNA, 18 nt, Homo sapiens
ggaugaauaaauguuaua

SEQ ID NO: 858135 - RNA, 22 nt, Homo sapiens
ugggguuucucuuuuccacuga

SEQ ID NO: 858136 - RNA, 18 nt, Homo sapiens
ugggucuucagggggcca

SEQ ID NO: 858137 - RNA, 15 nt, Homo sapiens
ugggucuucccugua

SEQ ID NO: 858138 - RNA, 17 nt, Homo sapiens
ugggugcugucaugccc

SEQ ID NO: 858139 - RNA, 17 nt, Homo sapiens
uggguuccagacagagu

SEQ ID NO: 858140 - RNA, 23 nt, Homo sapiens
uggucaucgugacagcagcagcu

SEQ ID NO: 858141 - RNA, 18 nt, Homo sapiens
uggugcuaagcccgggcg

SEQ ID NO: 858142 - RNA, 19 nt, Homo sapiens
ugguucccccacugaucac

SEQ ID NO: 858143 - RNA, 23 nt, Homo sapiens
ugguuccggaauccuguccucag

SEQ ID NO: 858144 - RNA, 14 nt, Homo sapiens
uguaaucauauaau

SEQ ID NO: 858145 - RNA, 20 nt, Homo sapiens
uguacaacuuuuuaccuagu

SEQ ID NO: 858146 - RNA, 12 nt, Homo sapiens
uguacagccuuu

SEQ ID NO: 858147 - RNA, 13 nt, Homo sapiens
uguaccauguaca

SEQ ID NO: 858148 - RNA, 17 nt, Homo sapiens
uguagaagccacuauua

SEQ ID NO: 858149 - RNA, 15 nt, Homo sapiens
uguaucaaaugugac

SEQ ID NO: 858150 - RNA, 18 nt, Homo sapiens
uguaucauuaugaaguca

SEQ ID NO: 858151 - RNA, 21 nt, Homo sapiens
uguaugauccuaaugaaugca

SEQ ID NO: 858152 - RNA, 17 nt, Homo sapiens
uguauuagucacagaga

SEQ ID NO: 858153 - RNA, 21 nt, Homo sapiens
uguauucucugagcugugcag

SEQ ID NO: 858154 - RNA, 23 nt, Homo sapiens
ugucaaccuugugugagugugac

SEQ ID NO: 858155 - RNA, 12 nt, Homo sapiens
ugucaaugucuu

SEQ ID NO: 858156 - RNA, 11 nt, Homo sapiens
ugucaucucag

SEQ ID NO: 858157 - RNA, 15 nt, Homo sapiens
uguccaaucacauuc

SEQ ID NO: 858158 - RNA, 19 nt, Homo sapiens
uguccacauucuacuucag

SEQ ID NO: 858159 - RNA, 21 nt, Homo sapiens
uguccuucccacggccacugc

SEQ ID NO: 858160 - RNA, 17 nt, Homo sapiens
ugucguaguuacucuca

SEQ ID NO: 858161 - RNA, 13 nt, Homo sapiens
ugucuucuugggg

SEQ ID NO: 858162 - RNA, 18 nt, Homo sapiens
ugugaaagcaccaucauc

SEQ ID NO: 858163 - RNA, 21 nt, Homo sapiens
ugugcaguguugacaguucau

SEQ ID NO: 858164 - RNA, 18 nt, Homo sapiens
ugugcucagagaccccuc

SEQ ID NO: 858165 - RNA, 12 nt, Homo sapiens
ugugcucaggga

SEQ ID NO: 858166 - RNA, 18 nt, Homo sapiens
ugugugaucugugggcac

SEQ ID NO: 858167 - RNA, 17 nt, Homo sapiens
uguguggggugggcaca

SEQ ID NO: 858168 - RNA, 18 nt, Homo sapiens
uguguuuauaauuguuau

SEQ ID NO: 858169 - RNA, 19 nt, Homo sapiens
uguguuuuguuuuguauca

SEQ ID NO: 858170 - RNA, 12 nt, Homo sapiens
uguuagugauuu

SEQ ID NO: 858171 - RNA, 17 nt, Homo sapiens
uguucaaacuacuguac

SEQ ID NO: 858172 - RNA, 16 nt, Homo sapiens
uguucccccugugcag

SEQ ID NO: 858173 - RNA, 23 nt, Homo sapiens
uguuccuucuggggcuuugccau

SEQ ID NO: 858174 - RNA, 22 nt, Homo sapiens
uguucuaagucuuuccauugga

SEQ ID NO: 858175 - RNA, 11 nt, Homo sapiens
uguucuugggg

SEQ ID NO: 858176 - RNA, 17 nt, Homo sapiens
uguugacauccaagcuu

SEQ ID NO: 858177 - RNA, 21 nt, Homo sapiens
uguuuggguauauucauuuca

SEQ ID NO: 858178 - RNA, 22 nt, Homo sapiens
uuaaaacccacaaaaguacaau

SEQ ID NO: 858179 - RNA, 17 nt, Homo sapiens
uuaaguugauggugaug

SEQ ID NO: 858180 - RNA, 17 nt, Homo sapiens
uuaauaacuaaaccaga

SEQ ID NO: 858181 - RNA, 23 nt, Homo sapiens
uuaauauccuaggcaucugcugu

SEQ ID NO: 858182 - RNA, 17 nt, Homo sapiens
uuacaaugugcacugaa

SEQ ID NO: 858183 - RNA, 20 nt, Homo sapiens
uuacacucuagugccauaua

SEQ ID NO: 858184 - RNA, 21 nt, Homo sapiens
uuacagaagaagcuccugaau

SEQ ID NO: 858185 - RNA, 19 nt, Homo sapiens
uuacaguuuaucuauggca

SEQ ID NO: 858186 - RNA, 17 nt, Homo sapiens
uuacauuauuacuccuu

SEQ ID NO: 858187 - RNA, 19 nt, Homo sapiens
uuaccuaguagucauuuca

SEQ ID NO: 858188 - RNA, 22 nt, Homo sapiens
uuaccugaaauaaaauucauua

SEQ ID NO: 858189 - RNA, 18 nt, Homo sapiens
uuacucucaggcauggau

SEQ ID NO: 858190 - RNA, 21 nt, Homo sapiens
uuacucucaggcauggaugaa

SEQ ID NO: 858191 - RNA, 17 nt, Homo sapiens
uuagaauggggcuucca

SEQ ID NO: 858192 - RNA, 23 nt, Homo sapiens
uuagacagucaaggaguggcuua

SEQ ID NO: 858193 - RNA, 15 nt, Homo sapiens
uuagucgagccaagu

SEQ ID NO: 858194 - RNA, 15 nt, Homo sapiens
uuagugauggagcuu

SEQ ID NO: 858195 - RNA, 15 nt, Homo sapiens
uuauaaaagaugcau

SEQ ID NO: 858196 - RNA, 12 nt, Homo sapiens
uauauacuaaua

SEQ ID NO: 858197 - RNA, 20 nt, Homo sapiens
uauauauuuuugugcacauu

SEQ ID NO: 858198 - RNA, 21 nt, Homo sapiens
uauauauuuuugugcacauuu

SEQ ID NO: 858199 - RNA, 16 nt, Homo sapiens
uauauguauaugcaau

SEQ ID NO: 858200 - RNA, 16 nt, Homo sapiens
uauauucauccaugcc

SEQ ID NO: 858201 - RNA, 19 nt, Homo sapiens
uauauuugaaguggagcca

SEQ ID NO: 858202 - RNA, 15 nt, Homo sapiens
uauauuuuugugcac

SEQ ID NO: 858203 - RNA, 19 nt, Homo sapiens
uaucauuuucugcauuuaa

SEQ ID NO: 858204 - RNA, 13 nt, Homo sapiens
uaucccaucucac

SEQ ID NO: 858205 - RNA, 15 nt, Homo sapiens
uauccucgcugguga

SEQ ID NO: 858206 - RNA, 23 nt, Homo sapiens
uaucucaaacuacuggcaauuug

SEQ ID NO: 858207 - RNA, 23 nt, Homo sapiens
uaugaggaugcagagucagcaga

SEQ ID NO: 858208 - RNA, 15 nt, Homo sapiens
uaugauugugcacau

SEQ ID NO: 858209 - RNA, 19 nt, Homo sapiens
uaugauugugcacauacuu

SEQ ID NO: 858210 - RNA, 18 nt, Homo sapiens
uauggcacccaugcaccu

SEQ ID NO: 858211 - RNA, 20 nt, Homo sapiens
uauguaaauuauaaguaacu

SEQ ID NO: 858212 - RNA, 21 nt, Homo sapiens
uauguuuuauuagcauuuuca

SEQ ID NO: 858213 - RNA, 20 nt, Homo sapiens
uauuacaguuuaucuauggc

SEQ ID NO: 858214 - RNA, 17 nt, Homo sapiens
uauuauucuucauaaca

SEQ ID NO: 858215 - RNA, 15 nt, Homo sapiens
uauucauuuugcaac

SEQ ID NO: 858216 - RNA, 13 nt, Homo sapiens
uauucgugcagca

SEQ ID NO: 858217 - RNA, 15 nt, Homo sapiens
uauucugcaacagcc

SEQ ID NO: 858218 - RNA, 21 nt, Homo sapiens
uauugaggaaaauuaauauca

SEQ ID NO: 858219 - RNA, 21 nt, Homo sapiens
uauuuaaaaaaaaacauucaa

SEQ ID NO: 858220 - RNA, 12 nt, Homo sapiens
uauuuaccugaa

SEQ ID NO: 858221 - RNA, 14 nt, Homo sapiens
uauuugcauaacaa

SEQ ID NO: 858222 - RNA, 18 nt, Homo sapiens
uauuuugcauaguaccaa

SEQ ID NO: 858223 - RNA, 22 nt, Homo sapiens
uauuuugccagugggaacuccu

SEQ ID NO: 858224 - RNA, 21 nt, Homo sapiens
ucaaaaaaauccuagagauuc

SEQ ID NO: 858225 - RNA, 22 nt, Homo sapiens
ucaaacgugaaaaugcuguauu

SEQ ID NO: 858226 - RNA, 13 nt, Homo sapiens
ucaaagacauucu

SEQ ID NO: 858227 - RNA, 13 nt, Homo sapiens
ucaaauagcauaa

SEQ ID NO: 858228 - RNA, 22 nt, Homo sapiens
ucaaauauguagauugccuuug

SEQ ID NO: 858229 - RNA, 18 nt, Homo sapiens
ucaacccaauaauucugu

SEQ ID NO: 858230 - RNA, 12 nt, Homo sapiens
ucaagccaggag

SEQ ID NO: 858231 - RNA, 14 nt, Homo sapiens
ucaagccaggagac

SEQ ID NO: 858232 - RNA, 16 nt, Homo sapiens
ucaaguuggcuucuaa

SEQ ID NO: 858233 - RNA, 20 nt, Homo sapiens
ucaaguuggcuucuaaucaa

SEQ ID NO: 858234 - RNA, 19 nt, Homo sapiens
ucaauacccuuggcacuga

SEQ ID NO: 858235 - RNA, 16 nt, Homo sapiens
ucaaucaaacuuucag

SEQ ID NO: 858236 - RNA, 12 nt, Homo sapiens
ucaauccagcua

SEQ ID NO: 858237 - RNA, 18 nt, Homo sapiens
ucaaucucugauucuguc

SEQ ID NO: 858238 - RNA, 18 nt, Homo sapiens
ucaaucuuaacaaaagug

SEQ ID NO: 858239 - RNA, 22 nt, Homo sapiens
ucaaugcuauaacuauguugau

SEQ ID NO: 858240 - RNA, 16 nt, Homo sapiens
ucaauuuuauaucuag

SEQ ID NO: 858241 - RNA, 21 nt, Homo sapiens
ucacaaagugagaaauuauga

SEQ ID NO: 858242 - RNA, 15 nt, Homo sapiens
ucacaacacaaucaa

SEQ ID NO: 858243 - RNA, 16 nt, Homo sapiens
ucacagaugugugauu

SEQ ID NO: 858244 - RNA, 22 nt, Homo sapiens
ucacaggacgauuucacugaca

SEQ ID NO: 858245 - RNA, 16 nt, Homo sapiens
ucacagugaacauaac

SEQ ID NO: 858246 - RNA, 18 nt, Homo sapiens
ucacauucgaguguuuca

SEQ ID NO: 858247 - RNA, 19 nt, Homo sapiens
ucaccauuuggcaaugcca

SEQ ID NO: 858248 - RNA, 23 nt, Homo sapiens
ucaccauuuggcaaugccaucau

SEQ ID NO: 858249 - RNA, 14 nt, Homo sapiens
ucacccaaugcaua

SEQ ID NO: 858250 - RNA, 15 nt, Homo sapiens
ucacccccacacugg

SEQ ID NO: 858251 - RNA, 18 nt, Homo sapiens
ucacgaggugucucucac

SEQ ID NO: 858252 - RNA, 18 nt, Homo sapiens
ucacucaaucucugauuc

SEQ ID NO: 858253 - RNA, 14 nt, Homo sapiens
ucacuccacucccc

SEQ ID NO: 858254 - RNA, 14 nt, Homo sapiens
ucacuucucccacc

SEQ ID NO: 858255 - RNA, 22 nt, Homo sapiens
ucagaguggccaaucccugugu

SEQ ID NO: 858256 - RNA, 14 nt, Homo sapiens
ucagaguugugcac

SEQ ID NO: 858257 - RNA, 16 nt, Homo sapiens
ucagaguugugcacau

SEQ ID NO: 858258 - RNA, 16 nt, Homo sapiens
ucagcaccugggaccc

SEQ ID NO: 858259 - RNA, 16 nt, Homo sapiens
ucagcaggacgacugu

SEQ ID NO: 858260 - RNA, 18 nt, Homo sapiens
ucagcuggaucuccauuc

SEQ ID NO: 858261 - RNA, 17 nt, Homo sapiens
ucagcuucuuaauauaa

SEQ ID NO: 858262 - RNA, 21 nt, Homo sapiens
ucaggaaggaugagcauuuag

SEQ ID NO: 858263 - RNA, 23 nt, Homo sapiens
ucaggccacauggcuaaagaagg

SEQ ID NO: 858264 - RNA, 17 nt, Homo sapiens
ugauaauuacuuuccag

SEQ ID NO: 858265 - RNA, 16 nt, Homo sapiens
ugauagaguguuauca

SEQ ID NO: 858266 - RNA, 22 nt, Homo sapiens
ugauauucaaucuuaacaaaag

SEQ ID NO: 858267 - RNA, 18 nt, Homo sapiens
ugauccuaaugaaugcau

SEQ ID NO: 858268 - RNA, 21 nt, Homo sapiens
ugaugggaggaaaagcccagg

SEQ ID NO: 858269 - RNA, 19 nt, Homo sapiens
ugauuauuuuuuaaagucu

SEQ ID NO: 858270 - RNA, 13 nt, Homo sapiens
ugauucacagugu

SEQ ID NO: 858271 - RNA, 15 nt, Homo sapiens
ugauucuaaagggga

SEQ ID NO: 858272 - RNA, 14 nt, Homo sapiens
ugauuucauuucaa

SEQ ID NO: 858273 - RNA, 15 nt, Homo sapiens
ugcaagucccaugau

SEQ ID NO: 858274 - RNA, 17 nt, Homo sapiens
ugcaccacuucaaguga

SEQ ID NO: 858275 - RNA, 20 nt, Homo sapiens
ugcaccgugcagcccgccau

SEQ ID NO: 858276 - RNA, 21 nt, Homo sapiens
ugcacuuugugaguauucuau

SEQ ID NO: 858277 - RNA, 16 nt, Homo sapiens
ugcauaagugcaugac

SEQ ID NO: 858278 - RNA, 21 nt, Homo sapiens
ugcauauccaacaugugcuca

SEQ ID NO: 858279 - RNA, 14 nt, Homo sapiens
ugcauuaucuauga

SEQ ID NO: 858280 - RNA, 23 nt, Homo sapiens
ugcauuuaaauacagucuuccau

SEQ ID NO: 858281 - RNA, 21 nt, Homo sapiens
ugcauuucuucacgcaccucg

SEQ ID NO: 858282 - RNA, 16 nt, Homo sapiens
ugccaagauaccuuca

SEQ ID NO: 858283 - RNA, 23 nt, Homo sapiens
ugccacagccuccccugccaggg

SEQ ID NO: 858284 - RNA, 21 nt, Homo sapiens
ugccacauggccgcugcccac

SEQ ID NO: 858285 - RNA, 18 nt, Homo sapiens
ugccaccucucacacugg

SEQ ID NO: 858286 - RNA, 19 nt, Homo sapiens
ugccagcuguuucaucacc

SEQ ID NO: 858287 - RNA, 14 nt, Homo sapiens
ugccaguccugcaa

SEQ ID NO: 858288 - RNA, 21 nt, Homo sapiens
ugccaucccugagagaccaga

SEQ ID NO: 858289 - RNA, 19 nt, Homo sapiens
ugcccagcuuggagugcca

SEQ ID NO: 858290 - RNA, 19 nt, Homo sapiens
ugcccaggaaccucagggc

SEQ ID NO: 858291 - RNA, 13 nt, Homo sapiens
ugccugacauuug

SEQ ID NO: 858292 - RNA, 15 nt, Homo sapiens
ugccuucaccuccuc

SEQ ID NO: 858293 - RNA, 15 nt, Homo sapiens
ugccuucucuucuau

SEQ ID NO: 858294 - RNA, 19 nt, Homo sapiens
ugcguuccucauccaugca

SEQ ID NO: 858295 - RNA, 21 nt, Homo sapiens
ugcuaaucagggaggucauuu

SEQ ID NO: 858296 - RNA, 21 nt, Homo sapiens
ugcuauaacuauguugauaaa

SEQ ID NO: 858297 - RNA, 12 nt, Homo sapiens
ugcucacauucc

SEQ ID NO: 858298 - RNA, 22 nt, Homo sapiens
ugcucagggaauaauccagaaa

SEQ ID NO: 858299 - RNA, 19 nt, Homo sapiens
ugcuccuugggcccuuuga

SEQ ID NO: 858300 - RNA, 19 nt, Homo sapiens
ugcuuauguaugccuauuc

SEQ ID NO: 858301 - RNA, 16 nt, Homo sapiens
ugcuuuggaaaucaca

SEQ ID NO: 858302 - RNA, 23 nt, Homo sapiens
uggaaauaaaguuauuacucuga

SEQ ID NO: 858303 - RNA, 21 nt, Homo sapiens
uggaacuuuuauuacuggggu

SEQ ID NO: 858304 - RNA, 15 nt, Homo sapiens
uggaagugugugauc

SEQ ID NO: 858305 - RNA, 13 nt, Homo sapiens
uggaauguaauca

SEQ ID NO: 858306 - RNA, 12 nt, Homo sapiens
uggacccuggaa

SEQ ID NO: 858307 - RNA, 12 nt, Homo sapiens
uggagagccacc

SEQ ID NO: 858308 - RNA, 16 nt, Homo sapiens
uggagaggaaaagcca

SEQ ID NO: 858309 - RNA, 17 nt, Homo sapiens
uggagaggcggguccca

SEQ ID NO: 858310 - RNA, 16 nt, Homo sapiens
uggaggcacacagcug

SEQ ID NO: 858311 - RNA, 20 nt, Homo sapiens
uggauacuauuaaaguaaca

SEQ ID NO: 858312 - RNA, 16 nt, Homo sapiens
uggaucaucuauugcu

SEQ ID NO: 858313 - RNA, 17 nt, Homo sapiens
uggauugggagauuuca

SEQ ID NO: 858314 - RNA, 20 nt, Homo sapiens
uggauuggggauggggacaa

SEQ ID NO: 858315 - RNA, 16 nt, Homo sapiens
uggcaagagacuacuc

SEQ ID NO: 858316 - RNA, 15 nt, Homo sapiens
uggcacccaugcacc

SEQ ID NO: 858317 - RNA, 21 nt, Homo sapiens
uggcacuugcaagucccauga

SEQ ID NO: 858318 - RNA, 12 nt, Homo sapiens
uggccacagccc

SEQ ID NO: 858319 - RNA, 23 nt, Homo sapiens
uggcuucacagaugugugauuca

SEQ ID NO: 858320 - RNA, 19 nt, Homo sapiens
uggcuuuggguagugccau

SEQ ID NO: 858321 - RNA, 15 nt, Homo sapiens
ugggaacugcaauaa

SEQ ID NO: 858322 - RNA, 22 nt, Homo sapiens
ugggaauggggugggagccaca

SEQ ID NO: 858323 - RNA, 23 nt, Homo sapiens
ugggaccucaguuuuaucauuuu

SEQ ID NO: 858324 - RNA, 18 nt, Homo sapiens
ugggagacugcugaguca

SEQ ID NO: 858325 - RNA, 14 nt, Homo sapiens
ugggcagagcccaa

SEQ ID NO: 858326 - RNA, 13 nt, Homo sapiens
ugggcagcuguua

SEQ ID NO: 858327 - RNA, 18 nt, Homo sapiens
ugggcauucuuguuucaa

SEQ ID NO: 858328 - RNA, 11 nt, Homo sapiens
ugggcuucuag

SEQ ID NO: 858329 - RNA, 19 nt, Homo sapiens
uggggagaaaagacaugaa

SEQ ID NO: 858330 - RNA, 22 nt, Homo sapiens
uggggagaaaagacaugaauau

SEQ ID NO: 858331 - RNA, 12 nt, Homo sapiens
ugggggauuuca

SEQ ID NO: 858332 - RNA, 22 nt, Homo sapiens
ugggguuuaaaagaacugucuc

SEQ ID NO: 858333 - RNA, 18 nt, Homo sapiens
cucaacguugcuccccau

SEQ ID NO: 858334 - RNA, 16 nt, Homo sapiens
cucaagaugaaggcaa

SEQ ID NO: 858335 - RNA, 12 nt, Homo sapiens
cucaaucucuga

SEQ ID NO: 858336 - RNA, 16 nt, Homo sapiens
cucacacaugagaucu

SEQ ID NO: 858337 - RNA, 14 nt, Homo sapiens
cucagcagccucag

SEQ ID NO: 858338 - RNA, 14 nt, Homo sapiens
cucagcuucuuaau

SEQ ID NO: 858339 - RNA, 17 nt, Homo sapiens
cucaggcugcccagcgg

SEQ ID NO: 858340 - RNA, 22 nt, Homo sapiens
cucaucacacgucacaaugucc

SEQ ID NO: 858341 - RNA, 16 nt, Homo sapiens
cucauggcagucccaa

SEQ ID NO: 858342 - RNA, 18 nt, Homo sapiens
cucauuaccuugugcuaa

SEQ ID NO: 858343 - RNA, 24 nt, Homo sapiens
cucauucagggauagcacugagca

SEQ ID NO: 858344 - RNA, 17 nt, Homo sapiens
cuccacccuuggacuuu

SEQ ID NO: 858345 - RNA, 12 nt, Homo sapiens
cuccacuguaaa

SEQ ID NO: 858346 - RNA, 19 nt, Homo sapiens
cuccagaaagcucaucuca

SEQ ID NO: 858347 - RNA, 21 nt, Homo sapiens
cuccauguagaagccacuauu

SEQ ID NO: 858348 - RNA, 20 nt, Homo sapiens
cuccauuguucagaugcuuc

SEQ ID NO: 858349 - RNA, 18 nt, Homo sapiens
cuccccuccagaccccua

SEQ ID NO: 858350 - RNA, 17 nt, Homo sapiens
cucccuggccccaguga

SEQ ID NO: 858351 - RNA, 18 nt, Homo sapiens
cuccgugagccucagcca

SEQ ID NO: 858352 - RNA, 20 nt, Homo sapiens
cuccuaaaauaaacaugaag

SEQ ID NO: 858353 - RNA, 22 nt, Homo sapiens
cuccucuuucaaccucagugau

SEQ ID NO: 858354 - RNA, 17 nt, Homo sapiens
cuccugaaucccuuuca

SEQ ID NO: 858355 - RNA, 17 nt, Homo sapiens
cuccuggaucccuuuca

SEQ ID NO: 858356 - RNA, 21 nt, Homo sapiens
cucgucuuccucucucucacc

SEQ ID NO: 858357 - RNA, 15 nt, Homo sapiens
cucuaaaagggggcu

SEQ ID NO: 858358 - RNA, 21 nt, Homo sapiens
cucuaauuaaaaugugcagua

SEQ ID NO: 858359 - RNA, 20 nt, Homo sapiens
cucuaucauguugaagucaa

SEQ ID NO: 858360 - RNA, 18 nt, Homo sapiens
cucucacccccacacugg

SEQ ID NO: 858361 - RNA, 17 nt, Homo sapiens
cucucacuauaccagua

SEQ ID NO: 858362 - RNA, 21 nt, Homo sapiens
cucucuggaccugaccagacu

SEQ ID NO: 858363 - RNA, 15 nt, Homo sapiens
cucugaaaccagugu

SEQ ID NO: 858364 - RNA, 17 nt, Homo sapiens
cucugaaaccaguguua

SEQ ID NO: 858365 - RNA, 15 nt, Homo sapiens
cucugagcugugcag

SEQ ID NO: 858366 - RNA, 20 nt, Homo sapiens
cucugcauuaucugagguca

SEQ ID NO: 858367 - RNA, 15 nt, Homo sapiens
cucugcauucuagua

SEQ ID NO: 858368 - RNA, 19 nt, Homo sapiens
cucugcuaugucugugaug

SEQ ID NO: 858369 - RNA, 13 nt, Homo sapiens
cucuggcuggaga

SEQ ID NO: 858370 - RNA, 21 nt, Homo sapiens
cucugggccaagucaaagaca

SEQ ID NO: 858371 - RNA, 10 nt, Homo sapiens
cucuguccag

SEQ ID NO: 858372 - RNA, 14 nt, Homo sapiens
cucugugaccaaug

SEQ ID NO: 858373 - RNA, 17 nt, Homo sapiens
cucuuaaucaaauagca

SEQ ID NO: 858374 - RNA, 16 nt, Homo sapiens
cucuuccuggacagug

SEQ ID NO: 858375 - RNA, 14 nt, Homo sapiens
cucuucuccacugg

SEQ ID NO: 858376 - RNA, 19 nt, Homo sapiens
cucuuugagucaagucaaa

SEQ ID NO: 858377 - RNA, 11 nt, Homo sapiens
cugaauaugaa

SEQ ID NO: 858378 - RNA, 15 nt, Homo sapiens
cugaccaccuugcac

SEQ ID NO: 858379 - RNA, 13 nt, Homo sapiens
cugagcuuuccag

SEQ ID NO: 858380 - RNA, 12 nt, Homo sapiens
cugaguccuguu

SEQ ID NO: 858381 - RNA, 18 nt, Homo sapiens
cugaguucucauccacag

SEQ ID NO: 858382 - RNA, 24 nt, Homo sapiens
cugauacagccuuacaauacaaua

SEQ ID NO: 858383 - RNA, 13 nt, Homo sapiens
cugauauuggugu

SEQ ID NO: 858384 - RNA, 13 nt, Homo sapiens
cugaugcaagcaa

SEQ ID NO: 858385 - RNA, 23 nt, Homo sapiens
cugauuucucuucagcuuugaaa

SEQ ID NO: 858386 - RNA, 21 nt, Homo sapiens
cugcccacgucccgggcacug

SEQ ID NO: 858387 - RNA, 22 nt, Homo sapiens
cugcccacgucccgggcacugu

SEQ ID NO: 858388 - RNA, 15 nt, Homo sapiens
cugcccagugcacac

SEQ ID NO: 858389 - RNA, 21 nt, Homo sapiens
cugccccaggcucaggcugcc

SEQ ID NO: 858390 - RNA, 15 nt, Homo sapiens
cugccugaacacugc

SEQ ID NO: 858391 - RNA, 21 nt, Homo sapiens
cugccuucaccuccucuuuca

SEQ ID NO: 858392 - RNA, 21 nt, Homo sapiens
cugcuguccaggaacuuucca

SEQ ID NO: 858393 - RNA, 14 nt, Homo sapiens
cuggaaaccagaau

SEQ ID NO: 858394 - RNA, 18 nt, Homo sapiens
cuggaacacaaccauagc

SEQ ID NO: 858395 - RNA, 23 nt, Homo sapiens
cuggaacacaaccauagccuguu

SEQ ID NO: 858396 - RNA, 15 nt, Homo sapiens
cuggaagaacaucaa

SEQ ID NO: 858397 - RNA, 21 nt, Homo sapiens
cuggauuggggauggggacaa

SEQ ID NO: 858398 - RNA, 14 nt, Homo sapiens
cuggcuugugaucu

SEQ ID NO: 858399 - RNA, 13 nt, Homo sapiens
cugggccaaguca

SEQ ID NO: 858400 - RNA, 19 nt, Homo sapiens
cugggccaagucaaagaca

SEQ ID NO: 858401 - RNA, 19 nt, Homo sapiens
cuggguuugggcaguggag

SEQ ID NO: 858402 - RNA, 23 nt, Homo sapiens
cugguuaaaucaauucugauaca

SEQ ID NO: 858403 - RNA, 17 nt, Homo sapiens
cugguuccuuaaguggc

SEQ ID NO: 858404 - RNA, 18 nt, Homo sapiens
cuguaccugugcacguug

SEQ ID NO: 858405 - RNA, 14 nt, Homo sapiens
cuguaugaagucau

SEQ ID NO: 858406 - RNA, 16 nt, Homo sapiens
cuguauuaagccacuu

SEQ ID NO: 858407 - RNA, 14 nt, Homo sapiens
cuguauuagucaca

SEQ ID NO: 858408 - RNA, 15 nt, Homo sapiens
cuguauucugcaaca

SEQ ID NO: 858409 - RNA, 19 nt, Homo sapiens
cugucacguagaacuugga

SEQ ID NO: 858410 - RNA, 14 nt, Homo sapiens
cugucagaccuucu

SEQ ID NO: 858411 - RNA, 19 nt, Homo sapiens
cugucaugcccagcuugga

SEQ ID NO: 858412 - RNA, 21 nt, Homo sapiens
cugucccggguacucagucag

SEQ ID NO: 858413 - RNA, 18 nt, Homo sapiens
cguaguuacucucaggca

SEQ ID NO: 858414 - RNA, 19 nt, Homo sapiens
cguauaauaaaaccaaaga

SEQ ID NO: 858415 - RNA, 18 nt, Homo sapiens
cgucccgggcacugucau

SEQ ID NO: 858416 - RNA, 13 nt, Homo sapiens
cguccuacuguau

SEQ ID NO: 858417 - RNA, 14 nt, Homo sapiens
cguggaugaccucc

SEQ ID NO: 858418 - RNA, 20 nt, Homo sapiens
cguggccgagggcuucccua

SEQ ID NO: 858419 - RNA, 14 nt, Homo sapiens
cguggccgcugccc

SEQ ID NO: 858420 - RNA, 13 nt, Homo sapiens
cgugggcucccug

SEQ ID NO: 858421 - RNA, 21 nt, Homo sapiens
cguguagacccuaacccggag

SEQ ID NO: 858422 - RNA, 13 nt, Homo sapiens
cguucagcuguga

SEQ ID NO: 858423 - RNA, 13 nt, Homo sapiens
cguuuaaucacau

SEQ ID NO: 858424 - RNA, 14 nt, Homo sapiens
cuaaaaccaucaua

SEQ ID NO: 858425 - RNA, 21 nt, Homo sapiens
cuaaaagggggcuauucccug

SEQ ID NO: 858426 - RNA, 15 nt, Homo sapiens
cuaaagaagguuuca

SEQ ID NO: 858427 - RNA, 23 nt, Homo sapiens
cuaaaggacugguuaaaucaauu

SEQ ID NO: 858428 - RNA, 19 nt, Homo sapiens
cuaagaaauaugcacaaua

SEQ ID NO: 858429 - RNA, 17 nt, Homo sapiens
cuaagaugaaauugcca

SEQ ID NO: 858430 - RNA, 19 nt, Homo sapiens
cuaagaugaaauugccaaa

SEQ ID NO: 858431 - RNA, 17 nt, Homo sapiens
cuaagcagaccacugau

SEQ ID NO: 858432 - RNA, 19 nt, Homo sapiens
cuaagccguuggcaccucu

SEQ ID NO: 858433 - RNA, 20 nt, Homo sapiens
cuaagcucaaggcgugagga

SEQ ID NO: 858434 - RNA, 23 nt, Homo sapiens
cuaaugccugcggaguugugcac

SEQ ID NO: 858435 - RNA, 17 nt, Homo sapiens
cuaauuagagcagauga

SEQ ID NO: 858436 - RNA, 22 nt, Homo sapiens
cuacagagcuucccugacucau

SEQ ID NO: 858437 - RNA, 13 nt, Homo sapiens
cuaccagauuuga

SEQ ID NO: 858438 - RNA, 16 nt, Homo sapiens
cuagauuuaugaauac

SEQ ID NO: 858439 - RNA, 14 nt, Homo sapiens
cuagggaucccuca

SEQ ID NO: 858440 - RNA, 18 nt, Homo sapiens
cuaggugcccagucuuga

SEQ ID NO: 858441 - RNA, 20 nt, Homo sapiens
cuagguucuaaaaauuguga

SEQ ID NO: 858442 - RNA, 16 nt, Homo sapiens
cuaguagucauuucau

SEQ ID NO: 858443 - RNA, 18 nt, Homo sapiens
cuagucugugccucagug

SEQ ID NO: 858444 - RNA, 13 nt, Homo sapiens
cuaucauauauua

SEQ ID NO: 858445 - RNA, 14 nt, Homo sapiens
cuaucauguugaag

SEQ ID NO: 858446 - RNA, 14 nt, Homo sapiens
cuaucgcaccacug

SEQ ID NO: 858447 - RNA, 15 nt, Homo sapiens
cuaucgcaccacugu

SEQ ID NO: 858448 - RNA, 17 nt, Homo sapiens
cuauggcucuacuuuca

SEQ ID NO: 858449 - RNA, 20 nt, Homo sapiens
cuaugucacccaaugcauau

SEQ ID NO: 858450 - RNA, 12 nt, Homo sapiens
cuaugucuguga

SEQ ID NO: 858451 - RNA, 13 nt, Homo sapiens
cuauguugauaaa

SEQ ID NO: 858452 - RNA, 19 nt, Homo sapiens
cuauucuuaagcacuuuga

SEQ ID NO: 858453 - RNA, 21 nt, Homo sapiens
cuauucuuaagcacuuugaaa

SEQ ID NO: 858454 - RNA, 21 nt, Homo sapiens
cucaagcacugacacucauua

SEQ ID NO: 858455 - RNA, 13 nt, Homo sapiens
cucacauucccuc

SEQ ID NO: 858456 - RNA, 13 nt, Homo sapiens
cucacuagcacau

SEQ ID NO: 858457 - RNA, 17 nt, Homo sapiens
cucacugcaagcacugc

SEQ ID NO: 858458 - RNA, 18 nt, Homo sapiens
cucacuugugcaguguug

SEQ ID NO: 858459 - RNA, 19 nt, Homo sapiens
cucagaacagucugaaaua

SEQ ID NO: 858460 - RNA, 17 nt, Homo sapiens
cucagcaacagccagug

SEQ ID NO: 858461 - RNA, 15 nt, Homo sapiens
cucagccaccccuca

SEQ ID NO: 858462 - RNA, 17 nt, Homo sapiens
cucagcuggaucuccau

SEQ ID NO: 858463 - RNA, 16 nt, Homo sapiens
cucaggagaaggccug

SEQ ID NO: 858464 - RNA, 19 nt, Homo sapiens
cucauaugauugugcacau

SEQ ID NO: 858465 - RNA, 20 nt, Homo sapiens
cucauaugauugugcacaua

SEQ ID NO: 858466 - RNA, 17 nt, Homo sapiens
cucaucccgagcaccuc

SEQ ID NO: 858467 - RNA, 16 nt, Homo sapiens
cucauuaauucaauua

SEQ ID NO: 858468 - RNA, 21 nt, Homo sapiens
cucauucagggauagcacuga

SEQ ID NO: 858469 - RNA, 12 nt, Homo sapiens
cuccacuccucc

SEQ ID NO: 858470 - RNA, 19 nt, Homo sapiens
cuccauguagaagccacua

SEQ ID NO: 858471 - RNA, 17 nt, Homo sapiens
cucccagauaaugugaa

SEQ ID NO: 858472 - RNA, 16 nt, Homo sapiens
cuccccagccaggugc

SEQ ID NO: 858473 - RNA, 20 nt, Homo sapiens
cuccccauggugcagugaag

SEQ ID NO: 858474 - RNA, 21 nt, Homo sapiens
cuccuaaaauaaacaugaagc

SEQ ID NO: 858475 - RNA, 22 nt, Homo sapiens
cuccuaccccuguccuggggcu

SEQ ID NO: 858476 - RNA, 22 nt, Homo sapiens
cuccuccccuccccucacuucu

SEQ ID NO: 858477 - RNA, 11 nt, Homo sapiens
cuccucugucc

SEQ ID NO: 858478 - RNA, 16 nt, Homo sapiens
cuccugacccugugau

SEQ ID NO: 858479 - RNA, 17 nt, Homo sapiens
cuccugaggucuggauu

SEQ ID NO: 858480 - RNA, 14 nt, Homo sapiens
cucuaccuccuagc

SEQ ID NO: 858481 - RNA, 13 nt, Homo sapiens
cucuagugccaua

SEQ ID NO: 858482 - RNA, 14 nt, Homo sapiens
cucucaccuccuaa

SEQ ID NO: 858483 - RNA, 21 nt, Homo sapiens
cucucagucucugagcaguga

SEQ ID NO: 858484 - RNA, 19 nt, Homo sapiens
cucucggcuggaagaacau

SEQ ID NO: 858485 - RNA, 16 nt, Homo sapiens
cucuggaccugaccag

SEQ ID NO: 858486 - RNA, 21 nt, Homo sapiens
cucuggcuacgacuugggacg

SEQ ID NO: 858487 - RNA, 16 nt, Homo sapiens
cucuuccaaucuccau

SEQ ID NO: 858488 - RNA, 22 nt, Homo sapiens
cugacacugcgaacucucagga

SEQ ID NO: 858489 - RNA, 16 nt, Homo sapiens
cugaccagacuguggg

SEQ ID NO: 858490 - RNA, 17 nt, Homo sapiens
cugaccuugcacaaacu

SEQ ID NO: 858491 - RNA, 17 nt, Homo sapiens
cugacuguugcuguaaa

SEQ ID NO: 858492 - RNA, 14 nt, Homo sapiens
cugagauaccagcg

SEQ ID NO: 858493 - RNA, 22 nt, Homo sapiens
cugagcagugaaugauucagug

SEQ ID NO: 858494 - RNA, 13 nt, Homo sapiens
cugagcugugcag

SEQ ID NO: 858495 - RNA, 15 nt, Homo sapiens
cugagggcaggguuc

SEQ ID NO: 858496 - RNA, 20 nt, Homo sapiens
cugaggggauaucccuaugu

SEQ ID NO: 858497 - RNA, 14 nt, Homo sapiens
cugcaagcacugca

SEQ ID NO: 858498 - RNA, 18 nt, Homo sapiens
cugcacagugcaucucag

SEQ ID NO: 858499 - RNA, 16 nt, Homo sapiens
cugcagacucauccuu

SEQ ID NO: 858500 - RNA, 22 nt, Homo sapiens
cugcauuuauagcauacgguau

SEQ ID NO: 858501 - RNA, 23 nt, Homo sapiens
cugcccacgucccgggcacuguc

SEQ ID NO: 858502 - RNA, 17 nt, Homo sapiens
cugccucaugcucucua

SEQ ID NO: 858503 - RNA, 11 nt, Homo sapiens
cugcuccuaga

SEQ ID NO: 858504 - RNA, 16 nt, Homo sapiens
cugcucucccagguga

SEQ ID NO: 858505 - RNA, 18 nt, Homo sapiens
cugcugagugcaccacuu

SEQ ID NO: 858506 - RNA, 22 nt, Homo sapiens
cugcuguccaggaacuuuccag

SEQ ID NO: 858507 - RNA, 15 nt, Homo sapiens
cugcuucugugcauu

SEQ ID NO: 858508 - RNA, 17 nt, Homo sapiens
cugcuuuggaaaucaca

SEQ ID NO: 858509 - RNA, 20 nt, Homo sapiens
cuggaauguaaucaauguuu

SEQ ID NO: 858510 - RNA, 20 nt, Homo sapiens
cuggagaacuagagaaggac

SEQ ID NO: 858511 - RNA, 19 nt, Homo sapiens
cuggcagccgugccuucag

SEQ ID NO: 858512 - RNA, 20 nt, Homo sapiens
cuggccaaauaugcacuuuc

SEQ ID NO: 858513 - RNA, 19 nt, Homo sapiens
cuggcccuguugugggggu

SEQ ID NO: 858514 - RNA, 20 nt, Homo sapiens
cuggcuucacagauguguga

SEQ ID NO: 858515 - RNA, 15 nt, Homo sapiens
cugggaaguggcuua

SEQ ID NO: 858516 - RNA, 13 nt, Homo sapiens
cugggauggggca

SEQ ID NO: 858517 - RNA, 14 nt, Homo sapiens
cugggcacagucag

SEQ ID NO: 858518 - RNA, 13 nt, Homo sapiens
cugggcacuccuc

SEQ ID NO: 858519 - RNA, 16 nt, Homo sapiens
cugggccaagucaaag

SEQ ID NO: 858520 - RNA, 16 nt, Homo sapiens
cuggggcuuugccauu

SEQ ID NO: 858521 - RNA, 15 nt, Homo sapiens
cugggugcugucaug

SEQ ID NO: 858522 - RNA, 20 nt, Homo sapiens
cugguaauuuaagauuccag

SEQ ID NO: 858523 - RNA, 14 nt, Homo sapiens
cuguaaccucuuca

SEQ ID NO: 858524 - RNA, 18 nt, Homo sapiens
cuguauuaacugaauucu

SEQ ID NO: 858525 - RNA, 16 nt, Homo sapiens
cuguauuaccuauuca

SEQ ID NO: 858526 - RNA, 21 nt, Homo sapiens
cuguccaggaacuuuccagca

SEQ ID NO: 858527 - RNA, 21 nt, Homo sapiens
cugucucauaugauugugcac

SEQ ID NO: 858528 - RNA, 14 nt, Homo sapiens
cugucuuucacuga

SEQ ID NO: 858529 - RNA, 15 nt, Homo sapiens
cugucuuucacugaa

SEQ ID NO: 858530 - RNA, 22 nt, Homo sapiens
cugugcagguggggagacuggg

SEQ ID NO: 858531 - RNA, 21 nt, Homo sapiens
cuguguauuuaacugccuugu

SEQ ID NO: 858532 - RNA, 13 nt, Homo sapiens
cuguuagagucca

SEQ ID NO: 858533 - RNA, 16 nt, Homo sapiens
cuguuagucauuugcu

SEQ ID NO: 858534 - RNA, 14 nt, Homo sapiens
cuguuauagagggu

SEQ ID NO: 858535 - RNA, 18 nt, Homo sapiens
cuguucugucucauauga

SEQ ID NO: 858536 - RNA, 20 nt, Homo sapiens
cuuaagagaauccacauaaa

SEQ ID NO: 858537 - RNA, 18 nt, Homo sapiens
cuuacaaugugcacugaa

SEQ ID NO: 858538 - RNA, 18 nt, Homo sapiens
cuuagaaauugcauuucc

SEQ ID NO: 858539 - RNA, 13 nt, Homo sapiens
cuuagcauguccc

SEQ ID NO: 858540 - RNA, 22 nt, Homo sapiens
cuuaguguuuggguauauucau

SEQ ID NO: 858541 - RNA, 14 nt, Homo sapiens
cuuauauucaucca

SEQ ID NO: 858542 - RNA, 14 nt, Homo sapiens
cuuauccagcauua

SEQ ID NO: 858543 - RNA, 23 nt, Homo sapiens
cuucacagaugugugauucacag

SEQ ID NO: 858544 - RNA, 15 nt, Homo sapiens
cuucacucaaucucu

SEQ ID NO: 858545 - RNA, 21 nt, Homo sapiens
cuucaguggugagacuguauc

SEQ ID NO: 858546 - RNA, 17 nt, Homo sapiens
acagaccucggcugugu

SEQ ID NO: 858547 - RNA, 17 nt, Homo sapiens
acagacuaugucaccca

SEQ ID NO: 858548 - RNA, 20 nt, Homo sapiens
acagagauaauucuagcuuu

SEQ ID NO: 858549 - RNA, 15 nt, Homo sapiens
acagagcagaacuuu

SEQ ID NO: 858550 - RNA, 18 nt, Homo sapiens
acagagcagaacuuucac

SEQ ID NO: 858551 - RNA, 19 nt, Homo sapiens
acagagcuucccugacuca

SEQ ID NO: 858552 - RNA, 18 nt, Homo sapiens
acagagugccaucccuga

SEQ ID NO: 858553 - RNA, 22 nt, Homo sapiens
acagauuaucuuguacagccuu

SEQ ID NO: 858554 - RNA, 18 nt, Homo sapiens
acagauuuuuucuuuaaa

SEQ ID NO: 858555 - RNA, 14 nt, Homo sapiens
acagcuauuucuca

SEQ ID NO: 858556 - RNA, 21 nt, Homo sapiens
acagcugcuucugugcauuug

SEQ ID NO: 858557 - RNA, 15 nt, Homo sapiens
acaggcagcauuuag

SEQ ID NO: 858558 - RNA, 14 nt, Homo sapiens
acaggcguucucag

SEQ ID NO: 858559 - RNA, 15 nt, Homo sapiens
acaggcguucucagc

SEQ ID NO: 858560 - RNA, 15 nt, Homo sapiens
acagggcauggccag

SEQ ID NO: 858561 - RNA, 13 nt, Homo sapiens
acaguauugccac

SEQ ID NO: 858562 - RNA, 14 nt, Homo sapiens
acagucagcaacau

SEQ ID NO: 858563 - RNA, 23 nt, Homo sapiens
acaugaacguuuucucuucaccg

SEQ ID NO: 858564 - RNA, 14 nt, Homo sapiens
acaugaagaagcua

SEQ ID NO: 858565 - RNA, 10 nt, Homo sapiens
acaugaauau

SEQ ID NO: 858566 - RNA, 15 nt, Homo sapiens
acauuagccuaugug

SEQ ID NO: 858567 - RNA, 19 nt, Homo sapiens
acauuauuacuccuugcca

SEQ ID NO: 858568 - RNA, 17 nt, Homo sapiens
acauucaggcaugcgaa

SEQ ID NO: 858569 - RNA, 13 nt, Homo sapiens
acauuuccaugca

SEQ ID NO: 858570 - RNA, 19 nt, Homo sapiens
accaacuaugcguaaauca

SEQ ID NO: 858571 - RNA, 13 nt, Homo sapiens
accaaugucuuga

SEQ ID NO: 858572 - RNA, 13 nt, Homo sapiens
accagaaugauuu

SEQ ID NO: 858573 - RNA, 14 nt, Homo sapiens
accauaauguuaca

SEQ ID NO: 858574 - RNA, 21 nt, Homo sapiens
accaugagaccacuguuauca

SEQ ID NO: 858575 - RNA, 20 nt, Homo sapiens
accauguacaugaagaagcu

SEQ ID NO: 858576 - RNA, 16 nt, Homo sapiens
acccacagagugccau

SEQ ID NO: 858577 - RNA, 21 nt, Homo sapiens
acccagucagaguugugcaca

SEQ ID NO: 858578 - RNA, 15 nt, Homo sapiens
acccuaggucuccac

SEQ ID NO: 858579 - RNA, 16 nt, Homo sapiens
acccuauauguggcau

SEQ ID NO: 858580 - RNA, 19 nt, Homo sapiens
acccugcaccucauuccaa

SEQ ID NO: 858581 - RNA, 21 nt, Homo sapiens
acccuuggcacugaugggcac

SEQ ID NO: 858582 - RNA, 15 nt, Homo sapiens
accugaccagacugu

SEQ ID NO: 858583 - RNA, 14 nt, Homo sapiens
agcacacauuuuaa

SEQ ID NO: 858584 - RNA, 11 nt, Homo sapiens
agcacugacac

SEQ ID NO: 858585 - RNA, 12 nt, Homo sapiens
agcacugacacu

SEQ ID NO: 858586 - RNA, 17 nt, Homo sapiens
agcacugagcaaagcau

SEQ ID NO: 858587 - RNA, 22 nt, Homo sapiens
agcagauggucccauuauucua

SEQ ID NO: 858588 - RNA, 16 nt, Homo sapiens
agcagcagcagcagca

SEQ ID NO: 858589 - RNA, 18 nt, Homo sapiens
agcagccucaggcccaau

SEQ ID NO: 858590 - RNA, 21 nt, Homo sapiens
agcagcgccccucccaagagg

SEQ ID NO: 858591 - RNA, 14 nt, Homo sapiens
agcaggcaccagca

SEQ ID NO: 858592 - RNA, 21 nt, Homo sapiens
agcaguugaaacaagaagcca

SEQ ID NO: 858593 - RNA, 18 nt, Homo sapiens
agcauaaguuucugggac

SEQ ID NO: 858594 - RNA, 21 nt, Homo sapiens
agcauacgguaugauauugca

SEQ ID NO: 858595 - RNA, 17 nt, Homo sapiens
agcauuuagacccugca

SEQ ID NO: 858596 - RNA, 16 nt, Homo sapiens
agcauuuagcacauac

SEQ ID NO: 858597 - RNA, 19 nt, Homo sapiens
agccaaggccuaugccacc

SEQ ID NO: 858598 - RNA, 15 nt, Homo sapiens
agccaaguuaagaau

SEQ ID NO: 858599 - RNA, 18 nt, Homo sapiens
agccauuccugaagccca

SEQ ID NO: 858600 - RNA, 22 nt, Homo sapiens
agcccagugggaucuuacccac

SEQ ID NO: 858601 - RNA, 15 nt, Homo sapiens
agcccccuguccuuc

SEQ ID NO: 858602 - RNA, 13 nt, Homo sapiens
agcccucaucccg

SEQ ID NO: 858603 - RNA, 16 nt, Homo sapiens
agccguugcuaaugcc

SEQ ID NO: 858604 - RNA, 12 nt, Homo sapiens
agccucaagucu

SEQ ID NO: 858605 - RNA, 22 nt, Homo sapiens
agccucacugcaagcacugcau

SEQ ID NO: 858606 - RNA, 16 nt, Homo sapiens
agccugggccacuggc

SEQ ID NO: 858607 - RNA, 13 nt, Homo sapiens
agccuuuccagaa

SEQ ID NO: 858608 - RNA, 13 nt, Homo sapiens
agcucaucucagc

SEQ ID NO: 858609 - RNA, 23 nt, Homo sapiens
agcucugaaaccaguguuaggga

SEQ ID NO: 858610 - RNA, 13 nt, Homo sapiens
agcugcuguccag

SEQ ID NO: 858611 - RNA, 15 nt, Homo sapiens
agcugcuucugugca

SEQ ID NO: 858612 - RNA, 20 nt, Homo sapiens
agcuggagagagaguucuca

SEQ ID NO: 858613 - RNA, 19 nt, Homo sapiens
agcugguugggaagacaug

SEQ ID NO: 858614 - RNA, 17 nt, Homo sapiens
agcuuggagugccacgu

SEQ ID NO: 858615 - RNA, 15 nt, Homo sapiens
aggaacauacuucag

SEQ ID NO: 858616 - RNA, 15 nt, Homo sapiens
aggaagccacgugcu

SEQ ID NO: 858617 - RNA, 14 nt, Homo sapiens
aggaagccacugcc

SEQ ID NO: 858618 - RNA, 16 nt, Homo sapiens
aggaagccacugccag

SEQ ID NO: 858619 - RNA, 16 nt, Homo sapiens
aggacagcugcuucug

SEQ ID NO: 858620 - RNA, 21 nt, Homo sapiens
aggacauauucacagugaaca

SEQ ID NO: 858621 - RNA, 22 nt, Homo sapiens
aggaggugcuaucgcaccacug

SEQ ID NO: 858622 - RNA, 23 nt, Homo sapiens
aggaggugcuaucgcaccacugu

SEQ ID NO: 858623 - RNA, 16 nt, Homo sapiens
uuuaaucccacuugcc

SEQ ID NO: 858624 - RNA, 16 nt, Homo sapiens
uuuaauuuuccucuaa

SEQ ID NO: 858625 - RNA, 12 nt, Homo sapiens
uuuacacugacu

SEQ ID NO: 858626 - RNA, 21 nt, Homo sapiens
uuuaccugaaauaaaauucau

SEQ ID NO: 858627 - RNA, 16 nt, Homo sapiens
uuuacuaucuuuucau

SEQ ID NO: 858628 - RNA, 15 nt, Homo sapiens
uuuagaaacugaguc

SEQ ID NO: 858629 - RNA, 23 nt, Homo sapiens
uuuauaaagggagauaacaaucu

SEQ ID NO: 858630 - RNA, 20 nt, Homo sapiens
uuuauaccccuuuggcacac

SEQ ID NO: 858631 - RNA, 15 nt, Homo sapiens
uuuauucacuugugu

SEQ ID NO: 858632 - RNA, 16 nt, Homo sapiens
uuucaaaaccuuuuga

SEQ ID NO: 858633 - RNA, 19 nt, Homo sapiens
uuucaagaaagcauugcca

SEQ ID NO: 858634 - RNA, 14 nt, Homo sapiens
uuucaagugcuaaa

SEQ ID NO: 858635 - RNA, 12 nt, Homo sapiens
uuucaauugcau

SEQ ID NO: 858636 - RNA, 16 nt, Homo sapiens
uuucaguucaaucaaa

SEQ ID NO: 858637 - RNA, 14 nt, Homo sapiens
uuucuacuuugcca

SEQ ID NO: 858638 - RNA, 19 nt, Homo sapiens
uuucuagacaguauugcca

SEQ ID NO: 858639 - RNA, 14 nt, Homo sapiens
uuugaaaucuauga

SEQ ID NO: 858640 - RNA, 16 nt, Homo sapiens
uuugaauaacaaggaa

SEQ ID NO: 858641 - RNA, 16 nt, Homo sapiens
uuugaaucacaguaua

SEQ ID NO: 858642 - RNA, 23 nt, Homo sapiens
uuugccauauuuucaccauuuga

SEQ ID NO: 858643 - RNA, 16 nt, Homo sapiens
uuugcuggucacugcc

SEQ ID NO: 858644 - RNA, 12 nt, Homo sapiens
uuuggauuuucc

SEQ ID NO: 858645 - RNA, 18 nt, Homo sapiens
uuuggcucgggacuucaa

SEQ ID NO: 858646 - RNA, 11 nt, Homo sapiens
uuuggugccag

SEQ ID NO: 858647 - RNA, 17 nt, Homo sapiens
uuuuaacaacuaugauu

SEQ ID NO: 858648 - RNA, 12 nt, Homo sapiens
uuuucacuugua

SEQ ID NO: 858649 - RNA, 15 nt, Homo sapiens
uuuucuagucuucau

SEQ ID NO: 858650 - RNA, 13 nt, Homo sapiens
uuuugaacauacu

SEQ ID NO: 858651 - RNA, 13 nt, Homo sapiens
uuuugugauugcc

SEQ ID NO: 858652 - RNA, 20 nt, Homo sapiens
uuuuuaaagucuucuuucau

SEQ ID NO: 858653 - RNA, 22 nt, Homo sapiens
cacuucccugcaaggugcaccu

SEQ ID NO: 858654 - RNA, 12 nt, Homo sapiens
cacuugccccag

SEQ ID NO: 858655 - RNA, 23 nt, Homo sapiens
cacuuucccuagaaagccauauu

SEQ ID NO: 858656 - RNA, 14 nt, Homo sapiens
cagaaaaacugugg

SEQ ID NO: 858657 - RNA, 12 nt, Homo sapiens
cagaaaugugua

SEQ ID NO: 858658 - RNA, 20 nt, Homo sapiens
cagaacuuaaggauggagcc

SEQ ID NO: 858659 - RNA, 21 nt, Homo sapiens
cagaagcuccgugagccucag

SEQ ID NO: 858660 - RNA, 13 nt, Homo sapiens
cagaaggacucag

SEQ ID NO: 858661 - RNA, 11 nt, Homo sapiens
cagaagugugu

SEQ ID NO: 858662 - RNA, 21 nt, Homo sapiens
cagaauaaauggguaacacug

SEQ ID NO: 858663 - RNA, 18 nt, Homo sapiens
cagaauggggaauggaga

SEQ ID NO: 858664 - RNA, 19 nt, Homo sapiens
cagacccacagagugccau

SEQ ID NO: 858665 - RNA, 23 nt, Homo sapiens
cagacuaugucacccaaugcaua

SEQ ID NO: 858666 - RNA, 23 nt, Homo sapiens
cagagaggacuguugacauccaa

SEQ ID NO: 858667 - RNA, 15 nt, Homo sapiens
cagagagggggccac

SEQ ID NO: 858668 - RNA, 22 nt, Homo sapiens
cagagugagacccagcccucau

SEQ ID NO: 858669 - RNA, 23 nt, Homo sapiens
cagagugagacccagcccucauc

SEQ ID NO: 858670 - RNA, 12 nt, Homo sapiens
cagagugccauc

SEQ ID NO: 858671 - RNA, 13 nt, Homo sapiens
cagauaaugugaa

SEQ ID NO: 858672 - RNA, 14 nt, Homo sapiens
cagaugaaugggag

SEQ ID NO: 858673 - RNA, 13 nt, Homo sapiens
cagaugugugauu

SEQ ID NO: 858674 - RNA, 17 nt, Homo sapiens
cagauuaucuuguacag

SEQ ID NO: 858675 - RNA, 14 nt, Homo sapiens
cagcaacaugauac

SEQ ID NO: 858676 - RNA, 19 nt, Homo sapiens
cagcaacaugauaccugga

SEQ ID NO: 858677 - RNA, 18 nt, Homo sapiens
cagcaaugccugccugaa

SEQ ID NO: 858678 - RNA, 23 nt, Homo sapiens
cagcauaaccccacccuuuacau

SEQ ID NO: 858679 - RNA, 14 nt, Homo sapiens
cagcaucuaaguaa

SEQ ID NO: 858680 - RNA, 21 nt, Homo sapiens
cagcauuauuugaaaacacug

SEQ ID NO: 858681 - RNA, 17 nt, Homo sapiens
cagcauucucacuccua

SEQ ID NO: 858682 - RNA, 15 nt, Homo sapiens
cagccaaaccuuucc

SEQ ID NO: 858683 - RNA, 13 nt, Homo sapiens
cagccucaagucu

SEQ ID NO: 858684 - RNA, 12 nt, Homo sapiens
cagccucccacc

SEQ ID NO: 858685 - RNA, 16 nt, Homo sapiens
cagcgcuccuggaaaa

SEQ ID NO: 858686 - RNA, 21 nt, Homo sapiens
cagcguggccuccgugaccca

SEQ ID NO: 858687 - RNA, 20 nt, Homo sapiens
cagcucaaguuagcauuuca

SEQ ID NO: 858688 - RNA, 14 nt, Homo sapiens
cagcucacacauga

SEQ ID NO: 858689 - RNA, 22 nt, Homo sapiens
cagcugaaaaguaaauugccuu

SEQ ID NO: 858690 - RNA, 13 nt, Homo sapiens
cagcugcuucugu

SEQ ID NO: 858691 - RNA, 18 nt, Homo sapiens
cagcugcuucugugcauu

SEQ ID NO: 858692 - RNA, 17 nt, Homo sapiens
cagcuuauauucaucca

SEQ ID NO: 858693 - RNA, 20 nt, Homo sapiens
cagcuuggagugccacgugg

SEQ ID NO: 858694 - RNA, 23 nt, Homo sapiens
caggaaccucagggcugugugua

SEQ ID NO: 858695 - RNA, 15 nt, Homo sapiens
caggagagcugcagu

SEQ ID NO: 858696 - RNA, 16 nt, Homo sapiens
caggagguacugugag

SEQ ID NO: 858697 - RNA, 23 nt, Homo sapiens
caggaguuggaagugugugaucu

SEQ ID NO: 858698 - RNA, 17 nt, Homo sapiens
caggauuagacagucaa

SEQ ID NO: 858699 - RNA, 13 nt, Homo sapiens
caggcauugccaa

SEQ ID NO: 858700 - RNA, 15 nt, Homo sapiens
caggccacauggcua

SEQ ID NO: 858701 - RNA, 21 nt, Homo sapiens
caggcccuuccucuccacugc

SEQ ID NO: 858702 - RNA, 23 nt, Homo sapiens
caggcugcaggugggguuuucac

SEQ ID NO: 858703 - RNA, 15 nt, Homo sapiens
cagggauagcacuga

SEQ ID NO: 858704 - RNA, 21 nt, Homo sapiens
cagggccuggccugguccagg

SEQ ID NO: 858705 - RNA, 23 nt, Homo sapiens
cagggccuggccugguccaggcu

SEQ ID NO: 858706 - RNA, 17 nt, Homo sapiens
caggggacacugaaccu

SEQ ID NO: 858707 - RNA, 23 nt, Homo sapiens
cagggggguuggguuccagacag

SEQ ID NO: 858708 - RNA, 23 nt, Homo sapiens
cagggugugagggauggggagca

SEQ ID NO: 858709 - RNA, 13 nt, Homo sapiens
cagguaaggugag

SEQ ID NO: 858710 - RNA, 13 nt, Homo sapiens
caggugcacagac

SEQ ID NO: 858711 - RNA, 17 nt, Homo sapiens
caguauuuucaguguca

SEQ ID NO: 858712 - RNA, 13 nt, Homo sapiens
cagucaaccuggg

SEQ ID NO: 858713 - RNA, 17 nt, Homo sapiens
cagucagaguugugcac

SEQ ID NO: 858714 - RNA, 13 nt, Homo sapiens
cagucagcccagu

SEQ ID NO: 858715 - RNA, 11 nt, Homo sapiens
cagucuacauu

SEQ ID NO: 858716 - RNA, 14 nt, Homo sapiens
cagucugaaccuga

SEQ ID NO: 858717 - RNA, 20 nt, Homo sapiens
caguggagaggggacuugga

SEQ ID NO: 858718 - RNA, 20 nt, Homo sapiens
caguguguuucugaucugau

SEQ ID NO: 858719 - RNA, 18 nt, Homo sapiens
caguuuguccacacaaga

SEQ ID NO: 858720 - RNA, 19 nt, Homo sapiens
cauaaaacuucugauuucu

SEQ ID NO: 858721 - RNA, 13 nt, Homo sapiens
cauaacaauuccu

SEQ ID NO: 858722 - RNA, 18 nt, Homo sapiens
cauaauguuacauuauua

SEQ ID NO: 858723 - RNA, 21 nt, Homo sapiens
cauaauguuacauuauuauca

SEQ ID NO: 858724 - RNA, 23 nt, Homo sapiens
cauaauuucuucacucaaucucu

SEQ ID NO: 858725 - RNA, 22 nt, Homo sapiens
cauagaggugagggaagccuga

SEQ ID NO: 858726 - RNA, 23 nt, Homo sapiens
cauagaggugagggaagccugaa

SEQ ID NO: 858727 - RNA, 17 nt, Homo sapiens
cauagaguucagacuuu

SEQ ID NO: 858728 - RNA, 16 nt, Homo sapiens
cauagauaauaguaca

SEQ ID NO: 858729 - RNA, 13 nt, Homo sapiens
cauauaauguugu

SEQ ID NO: 858730 - RNA, 14 nt, Homo sapiens
cauauauaugcaua

SEQ ID NO: 858731 - RNA, 15 nt, Homo sapiens
cauaugauugugcac

SEQ ID NO: 858732 - RNA, 18 nt, Homo sapiens
cauaugauugugcacaua

SEQ ID NO: 858733 - RNA, 12 nt, Homo sapiens
cauauucacagu

SEQ ID NO: 858734 - RNA, 12 nt, Homo sapiens
caucaagcacag

SEQ ID NO: 858735 - RNA, 13 nt, Homo sapiens
caucagcagugau

SEQ ID NO: 858736 - RNA, 17 nt, Homo sapiens
caucagugcucccucac

SEQ ID NO: 858737 - RNA, 14 nt, Homo sapiens
cauccaagcuuccu

SEQ ID NO: 858738 - RNA, 19 nt, Homo sapiens
cauccuuuuuaaaugagac

SEQ ID NO: 858739 - RNA, 16 nt, Homo sapiens
agaggcccaagcugcc

SEQ ID NO: 858740 - RNA, 14 nt, Homo sapiens
agagggagggagca

SEQ ID NO: 858741 - RNA, 16 nt, Homo sapiens
agaggggacaagccag

SEQ ID NO: 858742 - RNA, 20 nt, Homo sapiens
agaguguggaaaaaaaaaga

SEQ ID NO: 858743 - RNA, 12 nt, Homo sapiens
agaguugugcac

SEQ ID NO: 858744 - RNA, 16 nt, Homo sapiens
agauaaaaacaauaua

SEQ ID NO: 858745 - RNA, 20 nt, Homo sapiens
agauaacaaucuguauauaa

SEQ ID NO: 858746 - RNA, 14 nt, Homo sapiens
agaugaaauugcca

SEQ ID NO: 858747 - RNA, 15 nt, Homo sapiens
agaugaaauugccaa

SEQ ID NO: 858748 - RNA, 14 nt, Homo sapiens
agaugaguccuguu

SEQ ID NO: 858749 - RNA, 20 nt, Homo sapiens
agaugccuucuccagacaaa

SEQ ID NO: 858750 - RNA, 22 nt, Homo sapiens
agaugggcaaauuaaggcauaa

SEQ ID NO: 858751 - RNA, 19 nt, Homo sapiens
agauguuccauccuguaca

SEQ ID NO: 858752 - RNA, 15 nt, Homo sapiens
agauucuuagcucuu

SEQ ID NO: 858753 - RNA, 21 nt, Homo sapiens
agcaaacagggcuuuacuauc

SEQ ID NO: 858754 - RNA, 16 nt, Homo sapiens
agcaacagccagugga

SEQ ID NO: 858755 - RNA, 23 nt, Homo sapiens
agcaacaugaauuaagaacugac

SEQ ID NO: 858756 - RNA, 16 nt, Homo sapiens
agcaauaugcauuuaa

SEQ ID NO: 858757 - RNA, 20 nt, Homo sapiens
agcacaggauuaggacugaa

SEQ ID NO: 858758 - RNA, 19 nt, Homo sapiens
agcacauuauguuugcaac

SEQ ID NO: 858759 - RNA, 23 nt, Homo sapiens
agcacauuauguuugcaacuggu

SEQ ID NO: 858760 - RNA, 20 nt, Homo sapiens
agcacugagcaaagcauuga

SEQ ID NO: 858761 - RNA, 21 nt, Homo sapiens
agcagguguuuuccuucacaa

SEQ ID NO: 858762 - RNA, 20 nt, Homo sapiens
agcagugaaugauucagugu

SEQ ID NO: 858763 - RNA, 20 nt, Homo sapiens
agcaguuaguuccuucauga

SEQ ID NO: 858764 - RNA, 21 nt, Homo sapiens
agcauaaccccacccuuuaca

SEQ ID NO: 858765 - RNA, 19 nt, Homo sapiens
agcauugccagcucuucca

SEQ ID NO: 858766 - RNA, 23 nt, Homo sapiens
agcauugccagcucuuccaaucu

SEQ ID NO: 858767 - RNA, 20 nt, Homo sapiens
agccaccccucagacugggu

SEQ ID NO: 858768 - RNA, 16 nt, Homo sapiens
agccagcucugcauua

SEQ ID NO: 858769 - RNA, 13 nt, Homo sapiens
agccauaugaaug

SEQ ID NO: 858770 - RNA, 19 nt, Homo sapiens
agcccacccugcaccucau

SEQ ID NO: 858771 - RNA, 23 nt, Homo sapiens
agcccagccugcauacuugccac

SEQ ID NO: 858772 - RNA, 22 nt, Homo sapiens
agcccaggcggucacugcccac

SEQ ID NO: 858773 - RNA, 24 nt, Homo sapiens
agcccuauggaagucucaagguca

SEQ ID NO: 858774 - RNA, 19 nt, Homo sapiens
agcccucaguuuucaguca

SEQ ID NO: 858775 - RNA, 15 nt, Homo sapiens
agcccuuuacuugac

SEQ ID NO: 858776 - RNA, 21 nt, Homo sapiens
agccuauguaugccauggagg

SEQ ID NO: 858777 - RNA, 23 nt, Homo sapiens
agccucaagucuuauuuccucaa

SEQ ID NO: 858778 - RNA, 18 nt, Homo sapiens
agccucacugcaagcacu

SEQ ID NO: 858779 - RNA, 18 nt, Homo sapiens
agccucagcaacagccag

SEQ ID NO: 858780 - RNA, 15 nt, Homo sapiens
agccuccucucucaa

SEQ ID NO: 858781 - RNA, 17 nt, Homo sapiens
agccucugaauaugaac

SEQ ID NO: 858782 - RNA, 14 nt, Homo sapiens
agccugggccacug

SEQ ID NO: 858783 - RNA, 15 nt, Homo sapiens
agccuuauccagcau

SEQ ID NO: 858784 - RNA, 19 nt, Homo sapiens
agcgaggaggcuccagagg

SEQ ID NO: 858785 - RNA, 14 nt, Homo sapiens
agcggguaaaaaga

SEQ ID NO: 858786 - RNA, 17 nt, Homo sapiens
agcuagagcucaguaua

SEQ ID NO: 858787 - RNA, 18 nt, Homo sapiens
agcuagagcuuuaccuga

SEQ ID NO: 858788 - RNA, 19 nt, Homo sapiens
agcucaguauacuaaugcc

SEQ ID NO: 858789 - RNA, 14 nt, Homo sapiens
agcucuuuggugcc

SEQ ID NO: 858790 - RNA, 13 nt, Homo sapiens
agcugagcaggga

SEQ ID NO: 858791 - RNA, 19 nt, Homo sapiens
agcugcauuugucuggccu

SEQ ID NO: 858792 - RNA, 16 nt, Homo sapiens
agcugcuguccaggaa

SEQ ID NO: 858793 - RNA, 15 nt, Homo sapiens
agcuggcaggagggu

SEQ ID NO: 858794 - RNA, 18 nt, Homo sapiens
agcuuagacuaaggccau

SEQ ID NO: 858795 - RNA, 21 nt, Homo sapiens
agcuucuuaaaugagaaggaa

SEQ ID NO: 858796 - RNA, 21 nt, Homo sapiens
agcuucuuaauauaacugccu

SEQ ID NO: 858797 - RNA, 14 nt, Homo sapiens
agcuuggagugcca

SEQ ID NO: 858798 - RNA, 19 nt, Homo sapiens
agcuuggcuguagaaggag

SEQ ID NO: 858799 - RNA, 13 nt, Homo sapiens
aggaaaacaguaa

SEQ ID NO: 858800 - RNA, 14 nt, Homo sapiens
aggaaccucagggc

SEQ ID NO: 858801 - RNA, 15 nt, Homo sapiens
aggacaaaggugauu

SEQ ID NO: 858802 - RNA, 20 nt, Homo sapiens
aggacgacuguuuucccaac

SEQ ID NO: 858803 - RNA, 20 nt, Homo sapiens
aggacgauuucacugacacu

SEQ ID NO: 858804 - RNA, 21 nt, Homo sapiens
aggacucucuuucuuccacua

SEQ ID NO: 858805 - RNA, 22 nt, Homo sapiens
aggacuugugccucuugggaga

SEQ ID NO: 858806 - RNA, 14 nt, Homo sapiens
aggagacacuguuc

SEQ ID NO: 858807 - RNA, 15 nt, Homo sapiens
aggaugagcauuuag

SEQ ID NO: 858808 - RNA, 12 nt, Homo sapiens
aggaugcuucug

SEQ ID NO: 858809 - RNA, 17 nt, Homo sapiens
aggaugggaaggaggga

SEQ ID NO: 858810 - RNA, 15 nt, Homo sapiens
aggauuucaugauuu

SEQ ID NO: 858811 - RNA, 16 nt, Homo sapiens
aggcaagcuggcagga

SEQ ID NO: 858812 - RNA, 13 nt, Homo sapiens
aggcacagaugaa

SEQ ID NO: 858813 - RNA, 21 nt, Homo sapiens
aggcacgcuggcuugugaucu

SEQ ID NO: 858814 - RNA, 13 nt, Homo sapiens
aggccaucuguaa

SEQ ID NO: 858815 - RNA, 14 nt, Homo sapiens
aggccguggcugcc

SEQ ID NO: 858816 - RNA, 17 nt, Homo sapiens
aggcggucacugcccac

SEQ ID NO: 858817 - RNA, 12 nt, Homo sapiens
aggcucuucucc

SEQ ID NO: 858818 - RNA, 16 nt, Homo sapiens
agggacgacccggggc

SEQ ID NO: 858819 - RNA, 16 nt, Homo sapiens
agggacgccugggggu

SEQ ID NO: 858820 - RNA, 17 nt, Homo sapiens
agggauagcacugagca

SEQ ID NO: 858821 - RNA, 17 nt, Homo sapiens
agggcauggccaggugg

SEQ ID NO: 858822 - RNA, 16 nt, Homo sapiens
agggccacaugggagg

SEQ ID NO: 858823 - RNA, 20 nt, Homo sapiens
agggcugggcgccucugucc

SEQ ID NO: 858824 - RNA, 22 nt, Homo sapiens
aggggaucuaaaaggaggacag

SEQ ID NO: 858825 - RNA, 22 nt, Homo sapiens
aggguucaccaggucagggaga

SEQ ID NO: 858826 - RNA, 15 nt, Homo sapiens
aggucagggugagga

SEQ ID NO: 858827 - RNA, 21 nt, Homo sapiens
aggucuaggaacauacuucag

SEQ ID NO: 858828 - RNA, 23 nt, Homo sapiens
aggucuccaccccucaagccagg

SEQ ID NO: 858829 - RNA, 20 nt, Homo sapiens
aggugguauguuugggagac

SEQ ID NO: 858830 - RNA, 23 nt, Homo sapiens
agguugucugaagucacugcaca

SEQ ID NO: 858831 - RNA, 15 nt, Homo sapiens
agguuugccagcauu

SEQ ID NO: 858832 - RNA, 15 nt, Homo sapiens
aguaacauguguuaa

SEQ ID NO: 858833 - RNA, 13 nt, Homo sapiens
aguaacauuuaag

SEQ ID NO: 858834 - RNA, 17 nt, Homo sapiens
aguaagcaaagacuuuc

SEQ ID NO: 858835 - RNA, 14 nt, Homo sapiens
aguaaguggugaga

SEQ ID NO: 858836 - RNA, 13 nt, Homo sapiens
aguaaugaugucg

SEQ ID NO: 858837 - RNA, 17 nt, Homo sapiens
aguacaaccacuaucuu

SEQ ID NO: 858838 - RNA, 17 nt, Homo sapiens
aguaggaguugcuccua

SEQ ID NO: 858839 - RNA, 21 nt, Homo sapiens
agucaaauuuggauuuuccac

SEQ ID NO: 858840 - RNA, 21 nt, Homo sapiens
agucaaccugccugacauuug

SEQ ID NO: 858841 - RNA, 13 nt, Homo sapiens
agucacagagaua

SEQ ID NO: 858842 - RNA, 17 nt, Homo sapiens
agucagaguugugcaca

SEQ ID NO: 858843 - RNA, 19 nt, Homo sapiens
agucauuugcugagcaugu

SEQ ID NO: 858844 - RNA, 15 nt, Homo sapiens
agucgaacaauucau

SEQ ID NO: 858845 - RNA, 17 nt, Homo sapiens
agucuuauuuccucaac

SEQ ID NO: 858846 - RNA, 22 nt, Homo sapiens
agugauugauagaguguuauca

SEQ ID NO: 858847 - RNA, 16 nt, Homo sapiens
agugauuggcucugug

SEQ ID NO: 858848 - RNA, 17 nt, Homo sapiens
agugauuugggggugca

SEQ ID NO: 858849 - RNA, 20 nt, Homo sapiens
agugauuugggggugcaaug

SEQ ID NO: 858850 - RNA, 17 nt, Homo sapiens
agugcauuugagcacac

SEQ ID NO: 858851 - RNA, 13 nt, Homo sapiens
agugccugugauc

SEQ ID NO: 858852 - RNA, 14 nt, Homo sapiens
aguggccugagaag

SEQ ID NO: 858853 - RNA, 15 nt, Homo sapiens
aguguucccaaugcu

SEQ ID NO: 858854 - RNA, 23 nt, Homo sapiens
aguguuccccuuccacugagggc

SEQ ID NO: 858855 - RNA, 18 nt, Homo sapiens
aguuacucauucagggau

SEQ ID NO: 858856 - RNA, 17 nt, Homo sapiens
aguuacucucaggcaug

SEQ ID NO: 858857 - RNA, 17 nt, Homo sapiens
aguucauauguaccaug

SEQ ID NO: 858858 - RNA, 18 nt, Homo sapiens
aguucauauguaccaugu

SEQ ID NO: 858859 - RNA, 20 nt, Homo sapiens
aguuccauuuaaauugacuu

SEQ ID NO: 858860 - RNA, 13 nt, Homo sapiens
aguugaaacaaga

SEQ ID NO: 858861 - RNA, 16 nt, Homo sapiens
aguugcugaugaacuc

SEQ ID NO: 858862 - RNA, 22 nt, Homo sapiens
aguuuaggacccaagguggucu

SEQ ID NO: 858863 - RNA, 15 nt, Homo sapiens
aguuuauacuucucu

SEQ ID NO: 858864 - RNA, 14 nt, Homo sapiens
auaaaaccaaagaa

SEQ ID NO: 858865 - RNA, 13 nt, Homo sapiens
auaaaaguaccua

SEQ ID NO: 858866 - RNA, 19 nt, Homo sapiens
auaaauagaugaguccugu

SEQ ID NO: 858867 - RNA, 18 nt, Homo sapiens
auaaauggugagaauuaa

SEQ ID NO: 858868 - RNA, 17 nt, Homo sapiens
auaaauguacauuaauu

SEQ ID NO: 858869 - RNA, 14 nt, Homo sapiens
auaagucauuuuaa

SEQ ID NO: 858870 - RNA, 14 nt, Homo sapiens
auaaguuucacuga

SEQ ID NO: 858871 - RNA, 20 nt, Homo sapiens
auaaucauauauaugcauac

SEQ ID NO: 858872 - RNA, 18 nt, Homo sapiens
auaaugaagaauggccau

SEQ ID NO: 858873 - RNA, 21 nt, Homo sapiens
auaauguuacauuauuaucaa

SEQ ID NO: 858874 - RNA, 16 nt, Homo sapiens
auaauucuguauuaac

SEQ ID NO: 858875 - RNA, 22 nt, Homo sapiens
auacagacccacagagugccau

SEQ ID NO: 858876 - RNA, 17 nt, Homo sapiens
auacauuguauaggcca

SEQ ID NO: 858877 - RNA, 21 nt, Homo sapiens
auacauuuggcuccacuguaa

SEQ ID NO: 858878 - RNA, 14 nt, Homo sapiens
auacuaaauaugaa

SEQ ID NO: 858879 - RNA, 20 nt, Homo sapiens
auacuaaugcccuaucuuag

SEQ ID NO: 858880 - RNA, 15 nt, Homo sapiens
auagaguagaccuga

SEQ ID NO: 858881 - RNA, 16 nt, Homo sapiens
auagaugaguccuguu

SEQ ID NO: 858882 - RNA, 18 nt, Homo sapiens
auaggaggacagaaccaa

SEQ ID NO: 858883 - RNA, 15 nt, Homo sapiens
auaggauauacugua

SEQ ID NO: 858884 - RNA, 13 nt, Homo sapiens
auauauaugcaua

SEQ ID NO: 858885 - RNA, 19 nt, Homo sapiens
auauauauuuuugugcaca

SEQ ID NO: 858886 - RNA, 14 nt, Homo sapiens
auaucaugcuccau

SEQ ID NO: 858887 - RNA, 22 nt, Homo sapiens
auauccaacaugugcucaggga

SEQ ID NO: 858888 - RNA, 15 nt, Homo sapiens
auauccuaggcaucu

SEQ ID NO: 858889 - RNA, 16 nt, Homo sapiens
auaugaacggugagca

SEQ ID NO: 858890 - RNA, 14 nt, Homo sapiens
auaugauugugcac

SEQ ID NO: 858891 - RNA, 16 nt, Homo sapiens
auaugauugugcacau

SEQ ID NO: 858892 - RNA, 14 nt, Homo sapiens
auauguaccaugua

SEQ ID NO: 858893 - RNA, 22 nt, Homo sapiens
auauguugaugaaaaauagcaa

SEQ ID NO: 858894 - RNA, 13 nt, Homo sapiens
auauucauuucaa

SEQ ID NO: 858895 - RNA, 13 nt, Homo sapiens
auauucauuugga

SEQ ID NO: 858896 - RNA, 21 nt, Homo sapiens
auauuccagcagugaaacuug

SEQ ID NO: 858897 - RNA, 20 nt, Homo sapiens
auauugcagcuuauauucau

SEQ ID NO: 858898 - RNA, 15 nt, Homo sapiens
auauuuuugugcaca

SEQ ID NO: 858899 - RNA, 12 nt, Homo sapiens
aucaauguuucu

SEQ ID NO: 858900 - RNA, 23 nt, Homo sapiens
aucacacgucuggcuucacagau

SEQ ID NO: 858901 - RNA, 22 nt, Homo sapiens
aucaccguacgacucuuuucca

SEQ ID NO: 858902 - RNA, 16 nt, Homo sapiens
aucagaacuguuggca

SEQ ID NO: 858903 - RNA, 22 nt, Homo sapiens
aucagaccauaauguuacauua

SEQ ID NO: 858904 - RNA, 23 nt, Homo sapiens
aucagaguggccaaucccugugu

SEQ ID NO: 858905 - RNA, 16 nt, Homo sapiens
aucagucauaacuaaa

SEQ ID NO: 858906 - RNA, 23 nt, Homo sapiens
aucauauaauaaauguacauuaa

SEQ ID NO: 858907 - RNA, 16 nt, Homo sapiens
aucaucaucauucuca

SEQ ID NO: 858908 - RNA, 14 nt, Homo sapiens
aucaucauucucau

SEQ ID NO: 858909 - RNA, 21 nt, Homo sapiens
aucaucuuagcuuagcuuucu

SEQ ID NO: 858910 - RNA, 17 nt, Homo sapiens
aucauucucugucucau

SEQ ID NO: 858911 - RNA, 18 nt, Homo sapiens
aucauuuucugcauuuaa

SEQ ID NO: 858912 - RNA, 17 nt, Homo sapiens
auccaacaugugcucag

SEQ ID NO: 858913 - RNA, 21 nt, Homo sapiens
auccaccugcagcccuuuuag

SEQ ID NO: 858914 - RNA, 20 nt, Homo sapiens
aucccacuugccccuguuac

SEQ ID NO: 858915 - RNA, 19 nt, Homo sapiens
auccgccucugagccagga

SEQ ID NO: 858916 - RNA, 20 nt, Homo sapiens
auccuguacaagugcucagu

SEQ ID NO: 858917 - RNA, 15 nt, Homo sapiens
aucuaaaaaauaucu

SEQ ID NO: 858918 - RNA, 23 nt, Homo sapiens
aucucagcuccugaaaaaugccu

SEQ ID NO: 858919 - RNA, 22 nt, Homo sapiens
aucucauuggacccuuccaugg

SEQ ID NO: 858920 - RNA, 15 nt, Homo sapiens
aucucuggagugugu

SEQ ID NO: 858921 - RNA, 19 nt, Homo sapiens
aucugaacagaaauaccaa

SEQ ID NO: 858922 - RNA, 15 nt, Homo sapiens
aucugccacguguau

SEQ ID NO: 858923 - RNA, 20 nt, Homo sapiens
aucuguaugggucauucuca

SEQ ID NO: 858924 - RNA, 20 nt, Homo sapiens
aucuugcuucugcuucucau

SEQ ID NO: 858925 - RNA, 15 nt, Homo sapiens
augaaaaacagcaga

SEQ ID NO: 858926 - RNA, 16 nt, Homo sapiens
augaaagggcaaagac

SEQ ID NO: 858927 - RNA, 14 nt, Homo sapiens
augaacggugagca

SEQ ID NO: 858928 - RNA, 20 nt, Homo sapiens
augaauaaauguuauagcug

SEQ ID NO: 858929 - RNA, 22 nt, Homo sapiens
augaccccuccccuaaugccug

SEQ ID NO: 858930 - RNA, 16 nt, Homo sapiens
augagaaggaauuuga

SEQ ID NO: 858931 - RNA, 22 nt, Homo sapiens
augagaauuugagugcucugau

SEQ ID NO: 858932 - RNA, 11 nt, Homo sapiens
augagcauuua

SEQ ID NO: 858933 - RNA, 14 nt, Homo sapiens
augaguaaaaucac

SEQ ID NO: 858934 - RNA, 21 nt, Homo sapiens
augaguuugccauguugagca

SEQ ID NO: 858935 - RNA, 22 nt, Homo sapiens
augaucaucacaaucaucauca

SEQ ID NO: 858936 - RNA, 16 nt, Homo sapiens
augauccuaaugaaug

SEQ ID NO: 858937 - RNA, 12 nt, Homo sapiens
augauuaguaaa

SEQ ID NO: 858938 - RNA, 14 nt, Homo sapiens
augauugugcacau

SEQ ID NO: 858939 - RNA, 16 nt, Homo sapiens
augauugugcacauac

SEQ ID NO: 858940 - RNA, 14 nt, Homo sapiens
augauuugcaacuu

SEQ ID NO: 858941 - RNA, 22 nt, Homo sapiens
augcacuguucccccugugcag

SEQ ID NO: 858942 - RNA, 13 nt, Homo sapiens
augcagcaucuaa

SEQ ID NO: 858943 - RNA, 16 nt, Homo sapiens
augcagcaucuaagua

SEQ ID NO: 858944 - RNA, 15 nt, Homo sapiens
augcauaaaauguua

SEQ ID NO: 858945 - RNA, 22 nt, Homo sapiens
augcaucaaguuauugacaaac

SEQ ID NO: 858946 - RNA, 20 nt, Homo sapiens
augccagcuguacugaguuc

SEQ ID NO: 858947 - RNA, 18 nt, Homo sapiens
augcuauaacuauguuga

SEQ ID NO: 858948 - RNA, 16 nt, Homo sapiens
augcuucugacuucau

SEQ ID NO: 858949 - RNA, 19 nt, Homo sapiens
auggaccaauuagcauucc

SEQ ID NO: 858950 - RNA, 20 nt, Homo sapiens
auggaccaauuagcauucca

SEQ ID NO: 858951 - RNA, 18 nt, Homo sapiens
auggagccagcucugcau

SEQ ID NO: 858952 - RNA, 14 nt, Homo sapiens
auggaggcacacag

SEQ ID NO: 858953 - RNA, 16 nt, Homo sapiens
auggaggcacacagcu

SEQ ID NO: 858954 - RNA, 20 nt, Homo sapiens
augggcaaauuaaggcauaa

SEQ ID NO: 858955 - RNA, 15 nt, Homo sapiens
augggccaagccagg

SEQ ID NO: 858956 - RNA, 21 nt, Homo sapiens
augggccaagccaggguucca

SEQ ID NO: 858957 - RNA, 14 nt, Homo sapiens
auggugaugaaaug

SEQ ID NO: 858958 - RNA, 13 nt, Homo sapiens
auggugggcucca

SEQ ID NO: 858959 - RNA, 14 nt, Homo sapiens
auguaaacugugca

SEQ ID NO: 858960 - RNA, 16 nt, Homo sapiens
auguaaacugugcacc

SEQ ID NO: 858961 - RNA, 21 nt, Homo sapiens
auguacaugaagaagcuaaau

SEQ ID NO: 858962 - RNA, 23 nt, Homo sapiens
augucguaguuacucucaggcau

SEQ ID NO: 858963 - RNA, 21 nt, Homo sapiens
augugagcaugaaacuaugca

SEQ ID NO: 858964 - RNA, 18 nt, Homo sapiens
auguggccaagggcucca

SEQ ID NO: 858965 - RNA, 12 nt, Homo sapiens
auuaauaucaca

SEQ ID NO: 858966 - RNA, 13 nt, Homo sapiens
auuaauaucacag

SEQ ID NO: 858967 - RNA, 12 nt, Homo sapiens
auuacaauuucu

SEQ ID NO: 858968 - RNA, 22 nt, Homo sapiens
auuaccuugugcuaauccucuu

SEQ ID NO: 858969 - RNA, 13 nt, Homo sapiens
auuagaugaacuc

SEQ ID NO: 858970 - RNA, 13 nt, Homo sapiens
auuaucaacagca

SEQ ID NO: 858971 - RNA, 16 nt, Homo sapiens
auuaucaacagcauuu

SEQ ID NO: 858972 - RNA, 18 nt, Homo sapiens
auuaucuaugauaugcua

SEQ ID NO: 858973 - RNA, 18 nt, Homo sapiens
auuauuacuccuugccau

SEQ ID NO: 858974 - RNA, 18 nt, Homo sapiens
auuauuauucuucauaac

SEQ ID NO: 858975 - RNA, 22 nt, Homo sapiens
auucaaucuuaacaaaagugaa

SEQ ID NO: 858976 - RNA, 16 nt, Homo sapiens
auucaguaaauuuugg

SEQ ID NO: 858977 - RNA, 16 nt, Homo sapiens
auucauuuugcaacuu

SEQ ID NO: 858978 - RNA, 19 nt, Homo sapiens
auucuagagggauccaccg

SEQ ID NO: 858979 - RNA, 23 nt, Homo sapiens
auugagccuuuuauuaacauaua

SEQ ID NO: 858980 - RNA, 12 nt, Homo sapiens
auugccuucuag

SEQ ID NO: 858981 - RNA, 22 nt, Homo sapiens
auugcugccccaucagugcucc

SEQ ID NO: 858982 - RNA, 23 nt, Homo sapiens
auugcuuauguaugccuauucag

SEQ ID NO: 858983 - RNA, 20 nt, Homo sapiens
auuguaucaaaugugacauu

SEQ ID NO: 858984 - RNA, 17 nt, Homo sapiens
auugucaccuagcagau

SEQ ID NO: 858985 - RNA, 19 nt, Homo sapiens
auuuaaaaaaaaacauuca

SEQ ID NO: 858986 - RNA, 13 nt, Homo sapiens
auuuagcacauac

SEQ ID NO: 858987 - RNA, 12 nt, Homo sapiens
auuuauauaugu

SEQ ID NO: 858988 - RNA, 20 nt, Homo sapiens
auuucaugauuucauuucaa

SEQ ID NO: 858989 - RNA, 13 nt, Homo sapiens
auuuccugacaga

SEQ ID NO: 858990 - RNA, 21 nt, Homo sapiens
auuucuagacaguauugccac

SEQ ID NO: 858991 - RNA, 22 nt, Homo sapiens
auuucucccuucaauccuguca

SEQ ID NO: 858992 - RNA, 19 nt, Homo sapiens
auuugcauaacaauuccuc

SEQ ID NO: 858993 - RNA, 19 nt, Homo sapiens
auuugcugagcauguacug

SEQ ID NO: 858994 - RNA, 22 nt, Homo sapiens
auuuucaagaaagcauugccag

SEQ ID NO: 858995 - RNA, 19 nt, Homo sapiens
auuuuccucuaauuaaaau

SEQ ID NO: 858996 - RNA, 15 nt, Homo sapiens
auuuuuaagacuuuu

SEQ ID NO: 858997 - RNA, 19 nt, Homo sapiens
auuuuugaauacaggcaua

SEQ ID NO: 858998 - RNA, 13 nt, Homo sapiens
auuuuugugcaca

SEQ ID NO: 858999 - RNA, 16 nt, Homo sapiens
caaaaugauauucaau

SEQ ID NO: 859000 - RNA, 21 nt, Homo sapiens
caaacagggcuuuacuaucuu

SEQ ID NO: 859001 - RNA, 22 nt, Homo sapiens
caaacucuuaguuacucauuca

SEQ ID NO: 859002 - RNA, 21 nt, Homo sapiens
caaacuggggccucccugguc

SEQ ID NO: 859003 - RNA, 18 nt, Homo sapiens
cuuauuuguaguuguuag

SEQ ID NO: 859004 - RNA, 23 nt, Homo sapiens
cuucagcucacacaugagaucua

SEQ ID NO: 859005 - RNA, 17 nt, Homo sapiens
cuucagcuuugaaaagg

SEQ ID NO: 859006 - RNA, 20 nt, Homo sapiens
cuucauaauuucuucacuca

SEQ ID NO: 859007 - RNA, 16 nt, Homo sapiens
cuucauuuuuccuaac

SEQ ID NO: 859008 - RNA, 14 nt, Homo sapiens
cuuccacugagggc

SEQ ID NO: 859009 - RNA, 18 nt, Homo sapiens
cuuccaucagcagugauu

SEQ ID NO: 859010 - RNA, 18 nt, Homo sapiens
cuuccauuugcaagggaa

SEQ ID NO: 859011 - RNA, 18 nt, Homo sapiens
cuuccugccucucucaug

SEQ ID NO: 859012 - RNA, 17 nt, Homo sapiens
cuucuaaucaaagcuuu

SEQ ID NO: 859013 - RNA, 15 nt, Homo sapiens
cuucuagacacugaa

SEQ ID NO: 859014 - RNA, 16 nt, Homo sapiens
cuucuauccugcaauu

SEQ ID NO: 859015 - RNA, 15 nt, Homo sapiens
cuucucaagcacuga

SEQ ID NO: 859016 - RNA, 21 nt, Homo sapiens
cuucucaagcacugacacuca

SEQ ID NO: 859017 - RNA, 17 nt, Homo sapiens
cuucugaauauuggaca

SEQ ID NO: 859018 - RNA, 17 nt, Homo sapiens
cuucuggggcuuugcca

SEQ ID NO: 859019 - RNA, 16 nt, Homo sapiens
cuucuucaccauuugg

SEQ ID NO: 859020 - RNA, 13 nt, Homo sapiens
cuucuuucaugua

SEQ ID NO: 859021 - RNA, 19 nt, Homo sapiens
cuugaaagaaaauaugcau

SEQ ID NO: 859022 - RNA, 18 nt, Homo sapiens
cuugauggagauauuuac

SEQ ID NO: 859023 - RNA, 14 nt, Homo sapiens
cuugccauuuucaa

SEQ ID NO: 859024 - RNA, 22 nt, Homo sapiens
cuugccccuguuaccuaauuag

SEQ ID NO: 859025 - RNA, 23 nt, Homo sapiens
cuuggcacugaugggcacuggaa

SEQ ID NO: 859026 - RNA, 18 nt, Homo sapiens
cuugggagaccuguaauc

SEQ ID NO: 859027 - RNA, 23 nt, Homo sapiens
cuuguaaaugugguaaagaguua

SEQ ID NO: 859028 - RNA, 12 nt, Homo sapiens
cuugucaaggaa

SEQ ID NO: 859029 - RNA, 16 nt, Homo sapiens
cuugucucacuugugc

SEQ ID NO: 859030 - RNA, 18 nt, Homo sapiens
cuuguuuucuacuuugcc

SEQ ID NO: 859031 - RNA, 22 nt, Homo sapiens
cuuuauuacaguuuaucuaugg

SEQ ID NO: 859032 - RNA, 16 nt, Homo sapiens
cuuucaaccucaguga

SEQ ID NO: 859033 - RNA, 19 nt, Homo sapiens
cuuucccuagaaagccaua

SEQ ID NO: 859034 - RNA, 20 nt, Homo sapiens
cuuugaaauaugcauguacu

SEQ ID NO: 859035 - RNA, 16 nt, Homo sapiens
cuuugagugacugggu

SEQ ID NO: 859036 - RNA, 14 nt, Homo sapiens
cuuuguugcugucu

SEQ ID NO: 859037 - RNA, 13 nt, Homo sapiens
cuuuuaaguugcu

SEQ ID NO: 859038 - RNA, 23 nt, Homo sapiens
cuuuucacugcuggcugccuuag

SEQ ID NO: 859039 - RNA, 17 nt, Homo sapiens
cuuuugacaaaggcaag

SEQ ID NO: 859040 - RNA, 15 nt, Homo sapiens
cuuuuggagcugaga

SEQ ID NO: 859041 - RNA, 18 nt, Homo sapiens
cuuuuggagcugagauca

SEQ ID NO: 859042 - RNA, 24 nt, Homo sapiens
cuuuuguaaauauucuuguccaca

SEQ ID NO: 859043 - RNA, 19 nt, Homo sapiens
gaaaacacugugcacaucu

SEQ ID NO: 859044 - RNA, 22 nt, Homo sapiens
gaaaauuaauaucacagcauaa

SEQ ID NO: 859045 - RNA, 11 nt, Homo sapiens
gaaacugaguc

SEQ ID NO: 859046 - RNA, 23 nt, Homo sapiens
gaaagcaucuauucccaaagaac

SEQ ID NO: 859047 - RNA, 13 nt, Homo sapiens
gaaagcauugcca

SEQ ID NO: 859048 - RNA, 14 nt, Homo sapiens
gaaagcauugccag

SEQ ID NO: 859049 - RNA, 12 nt, Homo sapiens
gaaagugauauc

SEQ ID NO: 859050 - RNA, 20 nt, Homo sapiens
gaaauacugaggggucucca

SEQ ID NO: 859051 - RNA, 13 nt, Homo sapiens
gaaaucuaugaaa

SEQ ID NO: 859052 - RNA, 17 nt, Homo sapiens
gaacaaauaugauucuc

SEQ ID NO: 859053 - RNA, 21 nt, Homo sapiens
gaacagcuucauguucccaaa

SEQ ID NO: 859054 - RNA, 12 nt, Homo sapiens
gaaccucagggc

SEQ ID NO: 859055 - RNA, 13 nt, Homo sapiens
gaacuaccaaaau

SEQ ID NO: 859056 - RNA, 20 nt, Homo sapiens
gaagaacaucaagauaccuu

SEQ ID NO: 859057 - RNA, 16 nt, Homo sapiens
gaagagaaugugacag

SEQ ID NO: 859058 - RNA, 21 nt, Homo sapiens
gaagauggauugguguaaaag

SEQ ID NO: 859059 - RNA, 17 nt, Homo sapiens
gaagccuauguaugcca

SEQ ID NO: 859060 - RNA, 22 nt, Homo sapiens
gaagcucccugaaguaagcaaa

SEQ ID NO: 859061 - RNA, 14 nt, Homo sapiens
gaaggacacaguca

SEQ ID NO: 859062 - RNA, 12 nt, Homo sapiens
gaaggagggaga

SEQ ID NO: 859063 - RNA, 14 nt, Homo sapiens
gaaggcucugggau

SEQ ID NO: 859064 - RNA, 19 nt, Homo sapiens
gaaggcucugggaucuccc

SEQ ID NO: 859065 - RNA, 22 nt, Homo sapiens
gaaggguucaccaggucaggga

SEQ ID NO: 859066 - RNA, 18 nt, Homo sapiens
gaagucccaccagggacc

SEQ ID NO: 859067 - RNA, 19 nt, Homo sapiens
gaagugguuuaaaccaaac

SEQ ID NO: 859068 - RNA, 18 nt, Homo sapiens
gaagugucuaaugcauua

SEQ ID NO: 859069 - RNA, 13 nt, Homo sapiens
gaagugugugauc

SEQ ID NO: 859070 - RNA, 21 nt, Homo sapiens
gaauaaaccaucaucuugcca

SEQ ID NO: 859071 - RNA, 19 nt, Homo sapiens
gaauaaugacguauuguga

SEQ ID NO: 859072 - RNA, 15 nt, Homo sapiens
gaauagaugcugacu

SEQ ID NO: 859073 - RNA, 14 nt, Homo sapiens
gaauaugaacggug

SEQ ID NO: 859074 - RNA, 18 nt, Homo sapiens
gaauguugaauguuugaa

SEQ ID NO: 859075 - RNA, 18 nt, Homo sapiens
gaauuacaauuucuuuaa

SEQ ID NO: 859076 - RNA, 15 nt, Homo sapiens
gaauucugaacuuuu

SEQ ID NO: 859077 - RNA, 13 nt, Homo sapiens
gaauuucuagaca

SEQ ID NO: 859078 - RNA, 13 nt, Homo sapiens
gacaaucuaaaaa

SEQ ID NO: 859079 - RNA, 19 nt, Homo sapiens
gacacugaaggcaaaucuc

SEQ ID NO: 859080 - RNA, 19 nt, Homo sapiens
gacagagcagaacuuucac

SEQ ID NO: 859081 - RNA, 13 nt, Homo sapiens
gacagccuggcac

SEQ ID NO: 859082 - RNA, 20 nt, Homo sapiens
gacaucccccuccuugccgc

SEQ ID NO: 859083 - RNA, 17 nt, Homo sapiens
gaccagagcaccucagc

SEQ ID NO: 859084 - RNA, 17 nt, Homo sapiens
gacccacagagugccau

SEQ ID NO: 859085 - RNA, 20 nt, Homo sapiens
gacccggaggggccuggcag

SEQ ID NO: 859086 - RNA, 15 nt, Homo sapiens
gaccuaggauuucau

SEQ ID NO: 859087 - RNA, 22 nt, Homo sapiens
gaccuucucuuaggacaguaaa

SEQ ID NO: 859088 - RNA, 23 nt, Homo sapiens
gacucuccagaaagcucaucuca

SEQ ID NO: 859089 - RNA, 13 nt, Homo sapiens
gacugagcuugau

SEQ ID NO: 859090 - RNA, 16 nt, Homo sapiens
gagaacaaugugcuau

SEQ ID NO: 859091 - RNA, 13 nt, Homo sapiens
gagaacuacucag

SEQ ID NO: 859092 - RNA, 21 nt, Homo sapiens
gagacaaaaucuuaaaugcca

SEQ ID NO: 859093 - RNA, 19 nt, Homo sapiens
gagacaugagcauggcuga

SEQ ID NO: 859094 - RNA, 11 nt, Homo sapiens
gagacuguaaa

SEQ ID NO: 859095 - RNA, 22 nt, Homo sapiens
gagagcucgcuuugagugacug

SEQ ID NO: 859096 - RNA, 23 nt, Homo sapiens
gagaggagaaggagggagacaug

SEQ ID NO: 859097 - RNA, 13 nt, Homo sapiens
gagagggggccac

SEQ ID NO: 859098 - RNA, 18 nt, Homo sapiens
gagauaauucuagcuuug

SEQ ID NO: 859099 - RNA, 14 nt, Homo sapiens
gagcauacccagug

SEQ ID NO: 859100 - RNA, 22 nt, Homo sapiens
gagccaggagccuccugacccu

SEQ ID NO: 859101 - RNA, 14 nt, Homo sapiens
gagcccccuguccu

SEQ ID NO: 859102 - RNA, 20 nt, Homo sapiens
gagcuuuugguaugugacau

SEQ ID NO: 859103 - RNA, 13 nt, Homo sapiens
gaggcacacagcu

SEQ ID NO: 859104 - RNA, 13 nt, Homo sapiens
gaggcaguggcag

SEQ ID NO: 859105 - RNA, 16 nt, Homo sapiens
gaggcaguggcagcaa

SEQ ID NO: 859106 - RNA, 22 nt, Homo sapiens
gagggauaguggggucagggcu

SEQ ID NO: 859107 - RNA, 17 nt, Homo sapiens
gagggccacaugggagg

SEQ ID NO: 859108 - RNA, 16 nt, Homo sapiens
gagucacgagcugcug

SEQ ID NO: 859109 - RNA, 17 nt, Homo sapiens
gagucagcagaacuggg

SEQ ID NO: 859110 - RNA, 22 nt, Homo sapiens
gaguguuccccuuccacugagg

SEQ ID NO: 859111 - RNA, 16 nt, Homo sapiens
gaguuaguuugaguua

SEQ ID NO: 859112 - RNA, 23 nt, Homo sapiens
gauaauaguacaugucaccuuag

SEQ ID NO: 859113 - RNA, 17 nt, Homo sapiens
gauaccuucaugguguu

SEQ ID NO: 859114 - RNA, 13 nt, Homo sapiens
gauauugcagcuu

SEQ ID NO: 859115 - RNA, 21 nt, Homo sapiens
gauccgucuuuggccuccucc

SEQ ID NO: 859116 - RNA, 20 nt, Homo sapiens
gaucggagccuccucucuca

SEQ ID NO: 859117 - RNA, 17 nt, Homo sapiens
gaucuuggggugcagca

SEQ ID NO: 859118 - RNA, 19 nt, Homo sapiens
gaucuuggggugcagcacu

SEQ ID NO: 859119 - RNA, 20 nt, Homo sapiens
gaucuuggggugcagcacuu

SEQ ID NO: 859120 - RNA, 16 nt, Homo sapiens
gaugagaaacaacaga

SEQ ID NO: 859121 - RNA, 12 nt, Homo sapiens
gaugagcauuua

SEQ ID NO: 859122 - RNA, 16 nt, Homo sapiens
gaugcagagucagcag

SEQ ID NO: 859123 - RNA, 21 nt, Homo sapiens
gaugcugccugcccagugcac

SEQ ID NO: 859124 - RNA, 18 nt, Homo sapiens
gauggagccagcucugca

SEQ ID NO: 859125 - RNA, 21 nt, Homo sapiens
gauggucaucgugacagcagc

SEQ ID NO: 859126 - RNA, 14 nt, Homo sapiens
gauuagacagucaa

SEQ ID NO: 859127 - RNA, 14 nt, Homo sapiens
gauucacaguguga

SEQ ID NO: 859128 - RNA, 12 nt, Homo sapiens
gauuccagagag

SEQ ID NO: 859129 - RNA, 13 nt, Homo sapiens
gauuugcaacuuu

SEQ ID NO: 859130 - RNA, 15 nt, Homo sapiens
gcaaaacauugcugc

SEQ ID NO: 859131 - RNA, 21 nt, Homo sapiens
gcaaagcauugagcaaagggg

SEQ ID NO: 859132 - RNA, 20 nt, Homo sapiens
gcaaaggggggaagggacau

SEQ ID NO: 859133 - RNA, 14 nt, Homo sapiens
gcaacaguagcaua

SEQ ID NO: 859134 - RNA, 14 nt, Homo sapiens
gcaagaaacacugg

SEQ ID NO: 859135 - RNA, 18 nt, Homo sapiens
gcaaguacuuugucuuga

SEQ ID NO: 859136 - RNA, 17 nt, Homo sapiens
uacauuguauaggccau

SEQ ID NO: 859137 - RNA, 13 nt, Homo sapiens
uaccaaucauuuu

SEQ ID NO: 859138 - RNA, 15 nt, Homo sapiens
uaccagagcacagau

SEQ ID NO: 859139 - RNA, 22 nt, Homo sapiens
uaccagggcucuguauucugca

SEQ ID NO: 859140 - RNA, 21 nt, Homo sapiens
uaccaguauaauugaguuuuc

SEQ ID NO: 859141 - RNA, 13 nt, Homo sapiens
uaccggcaauuuc

SEQ ID NO: 859142 - RNA, 14 nt, Homo sapiens
uaccgucugugauu

SEQ ID NO: 859143 - RNA, 18 nt, Homo sapiens
uaccuaguacaaggcaac

SEQ ID NO: 859144 - RNA, 18 nt, Homo sapiens
uaccuaguagucauuuca

SEQ ID NO: 859145 - RNA, 17 nt, Homo sapiens
uaccuauugaacaugug

SEQ ID NO: 859146 - RNA, 13 nt, Homo sapiens
uaccugaaaggaa

SEQ ID NO: 859147 - RNA, 20 nt, Homo sapiens
uaccugaaauaaaauucauu

SEQ ID NO: 859148 - RNA, 14 nt, Homo sapiens
uaccuggauccagc

SEQ ID NO: 859149 - RNA, 21 nt, Homo sapiens
uaccuggauccagccauuccu

SEQ ID NO: 859150 - RNA, 21 nt, Homo sapiens
uaccugggcauucuuguuuca

SEQ ID NO: 859151 - RNA, 17 nt, Homo sapiens
uaccuugagccaguaau

SEQ ID NO: 859152 - RNA, 20 nt, Homo sapiens
uacgcuccaucgcugucauc

SEQ ID NO: 859153 - RNA, 21 nt, Homo sapiens
uacuaauuuguauaacccaua

SEQ ID NO: 859154 - RNA, 15 nt, Homo sapiens
uacuacacauucaau

SEQ ID NO: 859155 - RNA, 14 nt, Homo sapiens
uacuaucaugucaa

SEQ ID NO: 859156 - RNA, 17 nt, Homo sapiens
uacuauuaaaguaacau

SEQ ID NO: 859157 - RNA, 18 nt, Homo sapiens
uacuccuugccauuuuca

SEQ ID NO: 859158 - RNA, 21 nt, Homo sapiens
uacugggacugugcucagaga

SEQ ID NO: 859159 - RNA, 21 nt, Homo sapiens
uacuguaugccggcuccuuca

SEQ ID NO: 859160 - RNA, 21 nt, Homo sapiens
uacuucagcucacacaugaga

SEQ ID NO: 859161 - RNA, 13 nt, Homo sapiens
uagaaacugaguc

SEQ ID NO: 859162 - RNA, 17 nt, Homo sapiens
uagaaagccauauucca

SEQ ID NO: 859163 - RNA, 21 nt, Homo sapiens
uagaagccacuauuacuggga

SEQ ID NO: 859164 - RNA, 15 nt, Homo sapiens
uagaaggagacagag

SEQ ID NO: 859165 - RNA, 18 nt, Homo sapiens
uagagauuaccuccugag

SEQ ID NO: 859166 - RNA, 17 nt, Homo sapiens
uagauaauaguacaugu

SEQ ID NO: 859167 - RNA, 14 nt, Homo sapiens
uagcagacaguguu

SEQ ID NO: 859168 - RNA, 15 nt, Homo sapiens
uagcagauauguauu

SEQ ID NO: 859169 - RNA, 13 nt, Homo sapiens
uagcauacgguau

SEQ ID NO: 859170 - RNA, 20 nt, Homo sapiens
uagccuguuucguagccaua

SEQ ID NO: 859171 - RNA, 23 nt, Homo sapiens
uagcuggagagagaguucucaca

SEQ ID NO: 859172 - RNA, 15 nt, Homo sapiens
uaggaguugcuccua

SEQ ID NO: 859173 - RNA, 21 nt, Homo sapiens
uaggcaucugcuguaauaaua

SEQ ID NO: 859174 - RNA, 22 nt, Homo sapiens
uagucacagagauaauucuagc

SEQ ID NO: 859175 - RNA, 16 nt, Homo sapiens
uaguggggucagggcu

SEQ ID NO: 859176 - RNA, 16 nt, Homo sapiens
uaguuuuacacucuag

SEQ ID NO: 859177 - RNA, 13 nt, Homo sapiens
uauaaaugugauu

SEQ ID NO: 859178 - RNA, 21 nt, Homo sapiens
uauaaaugugauugcagcuuu

SEQ ID NO: 859179 - RNA, 15 nt, Homo sapiens
uauaacagcaaauaa

SEQ ID NO: 859180 - RNA, 16 nt, Homo sapiens
uauaacuauguugaua

SEQ ID NO: 859181 - RNA, 14 nt, Homo sapiens
uauaauaaaaccaa

SEQ ID NO: 859182 - RNA, 20 nt, Homo sapiens
uauacaaugaguaaaaucac

SEQ ID NO: 859183 - RNA, 16 nt, Homo sapiens
uauaggccaucuguaa

SEQ ID NO: 859184 - RNA, 20 nt, Homo sapiens
uauauaaaauauauauugca

SEQ ID NO: 859185 - RNA, 18 nt, Homo sapiens
uauauaaaugugauugca

SEQ ID NO: 859186 - RNA, 12 nt, Homo sapiens
uauaugcaauau

SEQ ID NO: 859187 - RNA, 14 nt, Homo sapiens
uaucaacagcauuu

SEQ ID NO: 859188 - RNA, 21 nt, Homo sapiens
uauccaacaugugcucaggga

SEQ ID NO: 859189 - RNA, 19 nt, Homo sapiens
uauccagaugaacugagaa

SEQ ID NO: 859190 - RNA, 19 nt, Homo sapiens
uaucuagagaauaaucaua

SEQ ID NO: 859191 - RNA, 14 nt, Homo sapiens
uaucugaggucaca

SEQ ID NO: 859192 - RNA, 15 nt, Homo sapiens
uaugauauugcagcu

SEQ ID NO: 859193 - RNA, 21 nt, Homo sapiens
uaugauucuccucucccaaau

SEQ ID NO: 859194 - RNA, 14 nt, Homo sapiens
uaugauugugcaca

SEQ ID NO: 859195 - RNA, 15 nt, Homo sapiens
uaugccucuguauuu

SEQ ID NO: 859196 - RNA, 21 nt, Homo sapiens
uauggaccaauuagcauucca

SEQ ID NO: 859197 - RNA, 16 nt, Homo sapiens
uaugggcuacacagca

SEQ ID NO: 859198 - RNA, 19 nt, Homo sapiens
uauguaccauguacaugaa

SEQ ID NO: 859199 - RNA, 15 nt, Homo sapiens
uauguagauugccuu

SEQ ID NO: 859200 - RNA, 22 nt, Homo sapiens
uauguagcaaaauacaugacau

SEQ ID NO: 859201 - RNA, 20 nt, Homo sapiens
uaugucacccaaugcauauc

SEQ ID NO: 859202 - RNA, 15 nt, Homo sapiens
uauuaagccacuuaa

SEQ ID NO: 859203 - RNA, 22 nt, Homo sapiens
uauuacaguuuaucuauggcac

SEQ ID NO: 859204 - RNA, 17 nt, Homo sapiens
uauuauuggcuugcacu

SEQ ID NO: 859205 - RNA, 19 nt, Homo sapiens
uauugcagcuuauauucau

SEQ ID NO: 859206 - RNA, 23 nt, Homo sapiens
uauuucuauguaaauuauuguaa

SEQ ID NO: 859207 - RNA, 14 nt, Homo sapiens
uauuuuugugcaca

SEQ ID NO: 859208 - RNA, 16 nt, Homo sapiens
ucaaauuggagcuuca

SEQ ID NO: 859209 - RNA, 18 nt, Homo sapiens
ucaaccugggcaaagccu

SEQ ID NO: 859210 - RNA, 19 nt, Homo sapiens
ucaacuugucacaaaguga

SEQ ID NO: 859211 - RNA, 12 nt, Homo sapiens
ucaacuuugaca

SEQ ID NO: 859212 - RNA, 18 nt, Homo sapiens
ucaagaaagcauugccag

SEQ ID NO: 859213 - RNA, 20 nt, Homo sapiens
ucaaggaauguuaucaguau

SEQ ID NO: 859214 - RNA, 22 nt, Homo sapiens
ucaauaaauagaugaguccugu

SEQ ID NO: 859215 - RNA, 20 nt, Homo sapiens
ucaaugguugggacaauggc

SEQ ID NO: 859216 - RNA, 20 nt, Homo sapiens
ucaauuccaccugcaaucaa

SEQ ID NO: 859217 - RNA, 22 nt, Homo sapiens
ucacaagaaaaaggaagccacu

SEQ ID NO: 859218 - RNA, 21 nt, Homo sapiens
ucacaaucaucaucauucuca

SEQ ID NO: 859219 - RNA, 21 nt, Homo sapiens
ucacagugaacauaacuguaa

SEQ ID NO: 859220 - RNA, 17 nt, Homo sapiens
ucacauucccucucauc

SEQ ID NO: 859221 - RNA, 19 nt, Homo sapiens
ucacauucgaguguuucag

SEQ ID NO: 859222 - RNA, 13 nt, Homo sapiens
ucacccuccucau

SEQ ID NO: 859223 - RNA, 22 nt, Homo sapiens
ucacucaaucucugauucuguc

SEQ ID NO: 859224 - RNA, 23 nt, Homo sapiens
ucacucuuucuucucucuuuguc

SEQ ID NO: 859225 - RNA, 15 nt, Homo sapiens
ucacugcccaccugc

SEQ ID NO: 859226 - RNA, 14 nt, Homo sapiens
ucagaaauguacaa

SEQ ID NO: 859227 - RNA, 15 nt, Homo sapiens
ucagaccuucuucca

SEQ ID NO: 859228 - RNA, 22 nt, Homo sapiens
ucagagcccaggaauucucaca

SEQ ID NO: 859229 - RNA, 18 nt, Homo sapiens
ucagauaccgacuggggc

SEQ ID NO: 859230 - RNA, 21 nt, Homo sapiens
ucagcuggaucuccauucucu

SEQ ID NO: 859231 - RNA, 16 nt, Homo sapiens
ucagggauagcacuga

SEQ ID NO: 859232 - RNA, 15 nt, Homo sapiens
ucaguaaauuuugga

SEQ ID NO: 859233 - RNA, 19 nt, Homo sapiens
ucagucucugagcagugaa

SEQ ID NO: 859234 - RNA, 17 nt, Homo sapiens
ucagugaagcccaggag

SEQ ID NO: 859235 - RNA, 21 nt, Homo sapiens
ucagugaagcccaggaggacc

SEQ ID NO: 859236 - RNA, 16 nt, Homo sapiens
ucaguggugagacugu

SEQ ID NO: 859237 - RNA, 18 nt, Homo sapiens
ucauaauuucuucacuca

SEQ ID NO: 859238 - RNA, 22 nt, Homo sapiens
ucauagauaauaguacauguca

SEQ ID NO: 859239 - RNA, 18 nt, Homo sapiens
ucauaugauugugcacau

SEQ ID NO: 859240 - RNA, 19 nt, Homo sapiens
ucauccaugcagauaacag

SEQ ID NO: 859241 - RNA, 23 nt, Homo sapiens
ucauccaugcagauaacagcugg

SEQ ID NO: 859242 - RNA, 17 nt, Homo sapiens
ucaugacagucagcaac

SEQ ID NO: 859243 - RNA, 16 nt, Homo sapiens
ucaugauuugcaacuu

SEQ ID NO: 859244 - RNA, 23 nt, Homo sapiens
ucaugcccagcuuggagugccac

SEQ ID NO: 859245 - RNA, 14 nt, Homo sapiens
ucaugcucucuaua

SEQ ID NO: 859246 - RNA, 17 nt, Homo sapiens
ucauguaaguagcaaac

SEQ ID NO: 859247 - RNA, 15 nt, Homo sapiens
ucauguugaagucaa

SEQ ID NO: 859248 - RNA, 13 nt, Homo sapiens
ucauuguguuugu

SEQ ID NO: 859249 - RNA, 14 nt, Homo sapiens
ucauuuugcaacuu

SEQ ID NO: 859250 - RNA, 16 nt, Homo sapiens
uccaaacuagauucau

SEQ ID NO: 859251 - RNA, 15 nt, Homo sapiens
uccaacaugugcuca

SEQ ID NO: 859252 - RNA, 12 nt, Homo sapiens
uccaaucagaac

SEQ ID NO: 859253 - RNA, 15 nt, Homo sapiens
uccaaucuccaucac

SEQ ID NO: 859254 - RNA, 18 nt, Homo sapiens
uccaaugugcccagucau

SEQ ID NO: 859255 - RNA, 13 nt, Homo sapiens
uccacaccagucc

SEQ ID NO: 859256 - RNA, 16 nt, Homo sapiens
uccaccaaauucugaa

SEQ ID NO: 859257 - RNA, 11 nt, Homo sapiens
uccacuuagaa

SEQ ID NO: 859258 - RNA, 16 nt, Homo sapiens
uccagaccccuacccu

SEQ ID NO: 859259 - RNA, 16 nt, Homo sapiens
uccagaugaacugaga

SEQ ID NO: 859260 - RNA, 17 nt, Homo sapiens
uccagaugaacugagaa

SEQ ID NO: 859261 - RNA, 23 nt, Homo sapiens
uccagcagguguuuuccuucaca

SEQ ID NO: 859262 - RNA, 16 nt, Homo sapiens
uccaggagaaggccaa

SEQ ID NO: 859263 - RNA, 18 nt, Homo sapiens
uccaucgcugucaucuca

SEQ ID NO: 859264 - RNA, 21 nt, Homo sapiens
uccauuuaccuggaaaccaga

SEQ ID NO: 859265 - RNA, 13 nt, Homo sapiens
ucccacaggacau

SEQ ID NO: 859266 - RNA, 16 nt, Homo sapiens
ucccauagccaggaaa

SEQ ID NO: 859267 - RNA, 21 nt, Homo sapiens
ucccccagcccucaguuuuca

SEQ ID NO: 859268 - RNA, 19 nt, Homo sapiens
aaaguacguguuuacuugg

SEQ ID NO: 859269 - RNA, 19 nt, Homo sapiens
aaaguggcaggacacugca

SEQ ID NO: 859270 - RNA, 21 nt, Homo sapiens
aaauaaaaguaccuauugaac

SEQ ID NO: 859271 - RNA, 15 nt, Homo sapiens
aaauacuucuugaag

SEQ ID NO: 859272 - RNA, 15 nt, Homo sapiens
aaauauauaugauau

SEQ ID NO: 859273 - RNA, 13 nt, Homo sapiens
aaauaucacaaag

SEQ ID NO: 859274 - RNA, 18 nt, Homo sapiens
aaauaugauucuccucuc

SEQ ID NO: 859275 - RNA, 22 nt, Homo sapiens
aaauaugauucuccucucccaa

SEQ ID NO: 859276 - RNA, 17 nt, Homo sapiens
aaaucauuuaucuggau

SEQ ID NO: 859277 - RNA, 12 nt, Homo sapiens
aaauccacagug

SEQ ID NO: 859278 - RNA, 15 nt, Homo sapiens
aaaugagaacaugaa

SEQ ID NO: 859279 - RNA, 20 nt, Homo sapiens
aaaugcuguauuagucacag

SEQ ID NO: 859280 - RNA, 13 nt, Homo sapiens
aaaugugaugaau

SEQ ID NO: 859281 - RNA, 19 nt, Homo sapiens
aaauuaaaccaagcagcuu

SEQ ID NO: 859282 - RNA, 13 nt, Homo sapiens
aaauuaauaucac

SEQ ID NO: 859283 - RNA, 13 nt, Homo sapiens
aacaaaaucuggg

SEQ ID NO: 859284 - RNA, 17 nt, Homo sapiens
aacaaagccuuauccag

SEQ ID NO: 859285 - RNA, 21 nt, Homo sapiens
aacaagaguaaauauugucac

SEQ ID NO: 859286 - RNA, 23 nt, Homo sapiens
aacaauuuuaggaggaccagagc

SEQ ID NO: 859287 - RNA, 19 nt, Homo sapiens
aacaggauuagacagucaa

SEQ ID NO: 859288 - RNA, 22 nt, Homo sapiens
aacaggucuuugaaauaugcau

SEQ ID NO: 859289 - RNA, 22 nt, Homo sapiens
aacaguuuuuuaugcuaaucag

SEQ ID NO: 859290 - RNA, 13 nt, Homo sapiens
aacaugaagcaca

SEQ ID NO: 859291 - RNA, 19 nt, Homo sapiens
aacaugauaccuggaucca

SEQ ID NO: 859292 - RNA, 13 nt, Homo sapiens
aacaugugcucag

SEQ ID NO: 859293 - RNA, 19 nt, Homo sapiens
aacauuugggagacugagc

SEQ ID NO: 859294 - RNA, 13 nt, Homo sapiens
aaccaaacggaac

SEQ ID NO: 859295 - RNA, 14 nt, Homo sapiens
aaccaacacuaaca

SEQ ID NO: 859296 - RNA, 21 nt, Homo sapiens
aaccagcucuuuggugccagc

SEQ ID NO: 859297 - RNA, 16 nt, Homo sapiens
aaccaucaucuugcca

SEQ ID NO: 859298 - RNA, 21 nt, Homo sapiens
aacccugagggacuuggcagu

SEQ ID NO: 859299 - RNA, 23 nt, Homo sapiens
aacccuguuuuauugaguucuga

SEQ ID NO: 859300 - RNA, 11 nt, Homo sapiens
aaccucagggc

SEQ ID NO: 859301 - RNA, 23 nt, Homo sapiens
aaccucagugauuggcucugugg

SEQ ID NO: 859302 - RNA, 14 nt, Homo sapiens
aacuaaauaaagcu

SEQ ID NO: 859303 - RNA, 14 nt, Homo sapiens
aacuacucagggaa

SEQ ID NO: 859304 - RNA, 16 nt, Homo sapiens
aacucaacuuugacaa

SEQ ID NO: 859305 - RNA, 20 nt, Homo sapiens
aacuccuggaucccuuucac

SEQ ID NO: 859306 - RNA, 21 nt, Homo sapiens
aacuguuggcaaggugacauu

SEQ ID NO: 859307 - RNA, 17 nt, Homo sapiens
aacuuggagauuuugcu

SEQ ID NO: 859308 - RNA, 18 nt, Homo sapiens
aacuugucacaaagugag

SEQ ID NO: 859309 - RNA, 16 nt, Homo sapiens
aacuuuccagcaguau

SEQ ID NO: 859310 - RNA, 23 nt, Homo sapiens
aagaaaacccgacaacauuucug

SEQ ID NO: 859311 - RNA, 16 nt, Homo sapiens
aagaacugcuugcauu

SEQ ID NO: 859312 - RNA, 14 nt, Homo sapiens
aagaagauggauug

SEQ ID NO: 859313 - RNA, 21 nt, Homo sapiens
aagaauguguuaugaaucggu

SEQ ID NO: 859314 - RNA, 14 nt, Homo sapiens
aagacaccuuccca

SEQ ID NO: 859315 - RNA, 22 nt, Homo sapiens
aagacauggggaggaaggacaa

SEQ ID NO: 859316 - RNA, 20 nt, Homo sapiens
aagagggugauugcuggggc

SEQ ID NO: 859317 - RNA, 17 nt, Homo sapiens
aagauacagaacucuuu

SEQ ID NO: 859318 - RNA, 18 nt, Homo sapiens
aagaugaaauugccaaaa

SEQ ID NO: 859319 - RNA, 19 nt, Homo sapiens
aagcauucacaacuuguuu

SEQ ID NO: 859320 - RNA, 18 nt, Homo sapiens
aagccaggguuccagaca

SEQ ID NO: 859321 - RNA, 14 nt, Homo sapiens
aagccauauuccag

SEQ ID NO: 859322 - RNA, 21 nt, Homo sapiens
aagccucagcaacagccagug

SEQ ID NO: 859323 - RNA, 23 nt, Homo sapiens
aagccucagcaacagccagugga

SEQ ID NO: 859324 - RNA, 18 nt, Homo sapiens
aagcucaucucagcuccu

SEQ ID NO: 859325 - RNA, 22 nt, Homo sapiens
aagcuuucauguaaacugugca

SEQ ID NO: 859326 - RNA, 14 nt, Homo sapiens
aaggaaaacaguaa

SEQ ID NO: 859327 - RNA, 11 nt, Homo sapiens
aaggacucuca

SEQ ID NO: 859328 - RNA, 18 nt, Homo sapiens
aaggauggagccagcucu

SEQ ID NO: 859329 - RNA, 23 nt, Homo sapiens
aaggauggagccagcucugcauu

SEQ ID NO: 859330 - RNA, 17 nt, Homo sapiens
aagggacauauucauuu

SEQ ID NO: 859331 - RNA, 20 nt, Homo sapiens
aaggugauuuuccugugucc

SEQ ID NO: 859332 - RNA, 21 nt, Homo sapiens
aaguaaauugccuucuagaca

SEQ ID NO: 859333 - RNA, 23 nt, Homo sapiens
aagucacugcacagugcaucuca

SEQ ID NO: 859334 - RNA, 17 nt, Homo sapiens
aagucuuauuuccucaa

SEQ ID NO: 859335 - RNA, 19 nt, Homo sapiens
aagucuuccugaccaccuu

SEQ ID NO: 859336 - RNA, 15 nt, Homo sapiens
aagugugugaucugu

SEQ ID NO: 859337 - RNA, 17 nt, Homo sapiens
aaguugcugaugaacuc

SEQ ID NO: 859338 - RNA, 20 nt, Homo sapiens
aaguugcugaugaacucuua

SEQ ID NO: 859339 - RNA, 15 nt, Homo sapiens
aaguuuuaaccucag

SEQ ID NO: 859340 - RNA, 14 nt, Homo sapiens
aauaaaaccaaaga

SEQ ID NO: 859341 - RNA, 18 nt, Homo sapiens
aauaaacaugaagcacaa

SEQ ID NO: 859342 - RNA, 16 nt, Homo sapiens
aauaaauguacauuaa

SEQ ID NO: 859343 - RNA, 13 nt, Homo sapiens
aauaagcugccuu

SEQ ID NO: 859344 - RNA, 13 nt, Homo sapiens
aauaauccagaaa

SEQ ID NO: 859345 - RNA, 14 nt, Homo sapiens
aauaauuguggaga

SEQ ID NO: 859346 - RNA, 20 nt, Homo sapiens
aauagcaaccuuuuuaucuc

SEQ ID NO: 859347 - RNA, 16 nt, Homo sapiens
aauaguuccagauaaa

SEQ ID NO: 859348 - RNA, 21 nt, Homo sapiens
aauaguuugguucuucaaauc

SEQ ID NO: 859349 - RNA, 13 nt, Homo sapiens
aauauaaauauca

SEQ ID NO: 859350 - RNA, 16 nt, Homo sapiens
aauauaacugccuuaa

SEQ ID NO: 859351 - RNA, 15 nt, Homo sapiens
aauaucaugcuccau

SEQ ID NO: 859352 - RNA, 23 nt, Homo sapiens
aauauuguccauuguccaauccu

SEQ ID NO: 859353 - RNA, 22 nt, Homo sapiens
aaucaacccaauaauucuguau

SEQ ID NO: 859354 - RNA, 22 nt, Homo sapiens
aaucaaguuggcuucuaaucaa

SEQ ID NO: 859355 - RNA, 15 nt, Homo sapiens
aaucaaugcuauaac

SEQ ID NO: 859356 - RNA, 20 nt, Homo sapiens
aaucacacgucuggcuucac

SEQ ID NO: 859357 - RNA, 23 nt, Homo sapiens
aaucacacgucuggcuucacaga

SEQ ID NO: 859358 - RNA, 19 nt, Homo sapiens
aaucauauaauaaauguac

SEQ ID NO: 859359 - RNA, 12 nt, Homo sapiens
aauccaugaacc

SEQ ID NO: 859360 - RNA, 22 nt, Homo sapiens
aauccccccagggcugggcacu

SEQ ID NO: 859361 - RNA, 20 nt, Homo sapiens
aaucuauuuugucugauauu

SEQ ID NO: 859362 - RNA, 14 nt, Homo sapiens
aaugaauguuuaca

SEQ ID NO: 859363 - RNA, 18 nt, Homo sapiens
aaugaguaaaaucacaga

SEQ ID NO: 859364 - RNA, 23 nt, Homo sapiens
aaugcauauccaacaugugcuca

SEQ ID NO: 859365 - RNA, 22 nt, Homo sapiens
aaugucuuuccuuuugcucuua

SEQ ID NO: 859366 - RNA, 20 nt, Homo sapiens
aaugugacauuauaugcacu

SEQ ID NO: 859367 - RNA, 15 nt, Homo sapiens
aaugugauugcagcu

SEQ ID NO: 859368 - RNA, 15 nt, Homo sapiens
aauuaaaaugugcag

SEQ ID NO: 859369 - RNA, 20 nt, Homo sapiens
aauuaauaucacagcauaac

SEQ ID NO: 859370 - RNA, 15 nt, Homo sapiens
aauuacaauuucuuu

SEQ ID NO: 859371 - RNA, 13 nt, Homo sapiens
aauuacagaagaa

SEQ ID NO: 859372 - RNA, 19 nt, Homo sapiens
aauuacagaagaagcuccu

SEQ ID NO: 859373 - RNA, 14 nt, Homo sapiens
aauuagcauuccau

SEQ ID NO: 859374 - RNA, 19 nt, Homo sapiens
aauuauaaguaacuuguca

SEQ ID NO: 859375 - RNA, 21 nt, Homo sapiens
aauuauuauuuauauauguau

SEQ ID NO: 859376 - RNA, 23 nt, Homo sapiens
aauucucuaucauguugaaguca

SEQ ID NO: 859377 - RNA, 19 nt, Homo sapiens
aauucuguauuaacugaau

SEQ ID NO: 859378 - RNA, 14 nt, Homo sapiens
aauucuucuucuca

SEQ ID NO: 859379 - RNA, 18 nt, Homo sapiens
aauucuucuucucaagca

SEQ ID NO: 859380 - RNA, 20 nt, Homo sapiens
aauugaaaaccucuuuccaa

SEQ ID NO: 859381 - RNA, 19 nt, Homo sapiens
aauugcagaagaaacuccu

SEQ ID NO: 859382 - RNA, 14 nt, Homo sapiens
aauuucuacuuuga

SEQ ID NO: 859383 - RNA, 19 nt, Homo sapiens
acaaaggugauuuuccugu

SEQ ID NO: 859384 - RNA, 13 nt, Homo sapiens
acaaauugcuuga

SEQ ID NO: 859385 - RNA, 14 nt, Homo sapiens
acaacacaaucaaa

SEQ ID NO: 859386 - RNA, 21 nt, Homo sapiens
acaaccaugagaccacuguua

SEQ ID NO: 859387 - RNA, 15 nt, Homo sapiens
acaagcgccaccgug

SEQ ID NO: 859388 - RNA, 21 nt, Homo sapiens
acaagguguuucucuguaaaa

SEQ ID NO: 859389 - RNA, 18 nt, Homo sapiens
acaauagugauugauaga

SEQ ID NO: 859390 - RNA, 20 nt, Homo sapiens
acaaugguuuuguuucuuuc

SEQ ID NO: 859391 - RNA, 11 nt, Homo sapiens
acaaugugcac

SEQ ID NO: 859392 - RNA, 20 nt, Homo sapiens
acacaagacagcagagccau

SEQ ID NO: 859393 - RNA, 21 nt, Homo sapiens
acacagcugcagagacagaga

SEQ ID NO: 859394 - RNA, 17 nt, Homo sapiens
acacguuuagaaaugau

SEQ ID NO: 859395 - RNA, 15 nt, Homo sapiens
acacuaacauauaau

SEQ ID NO: 859396 - RNA, 21 nt, Homo sapiens
acagaaccaacgggucugugg

SEQ ID NO: 859397 - RNA, 16 nt, Homo sapiens
acagagcuucccugac

SEQ ID NO: 859398 - RNA, 18 nt, Homo sapiens
acagagcuucccugacuc

SEQ ID NO: 859399 - RNA, 14 nt, Homo sapiens
caguuaaaggcaac

SEQ ID NO: 859400 - RNA, 14 nt, Homo sapiens
caguucaaucaaac

SEQ ID NO: 859401 - RNA, 14 nt, Homo sapiens
cauaaaauguuaag

SEQ ID NO: 859402 - RNA, 20 nt, Homo sapiens
cauaaccccacccuuuacau

SEQ ID NO: 859403 - RNA, 18 nt, Homo sapiens
cauaagugcaugacauau

SEQ ID NO: 859404 - RNA, 18 nt, Homo sapiens
cauaauugcuuauguaug

SEQ ID NO: 859405 - RNA, 10 nt, Homo sapiens
cauacaggag

SEQ ID NO: 859406 - RNA, 22 nt, Homo sapiens
cauacgguaugauauugcagcu

SEQ ID NO: 859407 - RNA, 15 nt, Homo sapiens
cauagaggugaggga

SEQ ID NO: 859408 - RNA, 16 nt, Homo sapiens
cauagaguagaccuga

SEQ ID NO: 859409 - RNA, 23 nt, Homo sapiens
cauaguacagguaaggugaggga

SEQ ID NO: 859410 - RNA, 23 nt, Homo sapiens
cauauauuugaaguggagccaua

SEQ ID NO: 859411 - RNA, 15 nt, Homo sapiens
cauauauuuguauga

SEQ ID NO: 859412 - RNA, 17 nt, Homo sapiens
cauauguaccauguaca

SEQ ID NO: 859413 - RNA, 23 nt, Homo sapiens
cauauucuuauguaugugaaagu

SEQ ID NO: 859414 - RNA, 16 nt, Homo sapiens
caucaauucucuauca

SEQ ID NO: 859415 - RNA, 15 nt, Homo sapiens
caucaccagacuuug

SEQ ID NO: 859416 - RNA, 20 nt, Homo sapiens
caucaugagccguugcuaau

SEQ ID NO: 859417 - RNA, 23 nt, Homo sapiens
cauccggcaugagggcugagaug

SEQ ID NO: 859418 - RNA, 21 nt, Homo sapiens
caucugaagugucuaaugcau

SEQ ID NO: 859419 - RNA, 14 nt, Homo sapiens
caugaagcacaaaa

SEQ ID NO: 859420 - RNA, 20 nt, Homo sapiens
caugaauuaagaacugacac

SEQ ID NO: 859421 - RNA, 18 nt, Homo sapiens
caugagaccacuguuauc

SEQ ID NO: 859422 - RNA, 15 nt, Homo sapiens
caugaggaccaggug

SEQ ID NO: 859423 - RNA, 22 nt, Homo sapiens
caugagucucacuagcacaugg

SEQ ID NO: 859424 - RNA, 16 nt, Homo sapiens
caugcauaaaugcgau

SEQ ID NO: 859425 - RNA, 17 nt, Homo sapiens
caugcccuguaccugug

SEQ ID NO: 859426 - RNA, 17 nt, Homo sapiens
caugcguuuaaucacau

SEQ ID NO: 859427 - RNA, 23 nt, Homo sapiens
cauggauuggauuucaguucaau

SEQ ID NO: 859428 - RNA, 14 nt, Homo sapiens
cauggccgcugccc

SEQ ID NO: 859429 - RNA, 12 nt, Homo sapiens
cauggugcagug

SEQ ID NO: 859430 - RNA, 15 nt, Homo sapiens
cauggugcagugaag

SEQ ID NO: 859431 - RNA, 17 nt, Homo sapiens
caugguggguccauggg

SEQ ID NO: 859432 - RNA, 16 nt, Homo sapiens
cauguaaacugugcac

SEQ ID NO: 859433 - RNA, 21 nt, Homo sapiens
cauguucuuguuuuguuauau

SEQ ID NO: 859434 - RNA, 12 nt, Homo sapiens
cauuacugccaa

SEQ ID NO: 859435 - RNA, 20 nt, Homo sapiens
cauuagccuaugugcaugca

SEQ ID NO: 859436 - RNA, 14 nt, Homo sapiens
cauuauaugcacua

SEQ ID NO: 859437 - RNA, 19 nt, Homo sapiens
cauucagggauagcacuga

SEQ ID NO: 859438 - RNA, 17 nt, Homo sapiens
cauucuaguacuuggga

SEQ ID NO: 859439 - RNA, 12 nt, Homo sapiens
cauucucugucu

SEQ ID NO: 859440 - RNA, 11 nt, Homo sapiens
cauucuucucu

SEQ ID NO: 859441 - RNA, 21 nt, Homo sapiens
cauugccugauuuguuccuuc

SEQ ID NO: 859442 - RNA, 22 nt, Homo sapiens
cauuuccucaggcaauuccuuu

SEQ ID NO: 859443 - RNA, 19 nt, Homo sapiens
cauuuccugacagaaggac

SEQ ID NO: 859444 - RNA, 22 nt, Homo sapiens
cauuucuauuucuccuccaugg

SEQ ID NO: 859445 - RNA, 15 nt, Homo sapiens
cauuuucugcauuua

SEQ ID NO: 859446 - RNA, 16 nt, Homo sapiens
cauuuucugcauuuaa

SEQ ID NO: 859447 - RNA, 17 nt, Homo sapiens
ccaagagguuaggugaa

SEQ ID NO: 859448 - RNA, 16 nt, Homo sapiens
ccaagucaaagacauu

SEQ ID NO: 859449 - RNA, 15 nt, Homo sapiens
ccaagucuuccugac

SEQ ID NO: 859450 - RNA, 14 nt, Homo sapiens
ccaaucauuuuaau

SEQ ID NO: 859451 - RNA, 17 nt, Homo sapiens
ccaauccuggacaugaa

SEQ ID NO: 859452 - RNA, 18 nt, Homo sapiens
ccaaugcuuuguccauga

SEQ ID NO: 859453 - RNA, 16 nt, Homo sapiens
ccaauuagcauuccau

SEQ ID NO: 859454 - RNA, 14 nt, Homo sapiens
ccacaaaaguacaa

SEQ ID NO: 859455 - RNA, 12 nt, Homo sapiens
ccacacugggac

SEQ ID NO: 859456 - RNA, 21 nt, Homo sapiens
ccacauccuccacguucugcu

SEQ ID NO: 859457 - RNA, 19 nt, Homo sapiens
ccacauggccgcugcccac

SEQ ID NO: 859458 - RNA, 15 nt, Homo sapiens
ccacauucuacuuca

SEQ ID NO: 859459 - RNA, 13 nt, Homo sapiens
ccaccaaauucug

SEQ ID NO: 859460 - RNA, 16 nt, Homo sapiens
ccacccugcaccucau

SEQ ID NO: 859461 - RNA, 22 nt, Homo sapiens
ccacgagcuguuuacuagggau

SEQ ID NO: 859462 - RNA, 12 nt, Homo sapiens
ccacgcuuaggg

SEQ ID NO: 859463 - RNA, 16 nt, Homo sapiens
ccacuccucugacuca

SEQ ID NO: 859464 - RNA, 15 nt, Homo sapiens
ccacugacaggcuuu

SEQ ID NO: 859465 - RNA, 16 nt, Homo sapiens
ccagaagcuccgugag

SEQ ID NO: 859466 - RNA, 15 nt, Homo sapiens
ccagagaguggcucc

SEQ ID NO: 859467 - RNA, 15 nt, Homo sapiens
ccagaugaacugaga

SEQ ID NO: 859468 - RNA, 16 nt, Homo sapiens
ccagaugaacugagaa

SEQ ID NO: 859469 - RNA, 20 nt, Homo sapiens
ccagcccuauggaagucuca

SEQ ID NO: 859470 - RNA, 15 nt, Homo sapiens
ccaggcugcaggugg

SEQ ID NO: 859471 - RNA, 19 nt, Homo sapiens
ccagggcugggcacuccuc

SEQ ID NO: 859472 - RNA, 15 nt, Homo sapiens
ccaggguuccagaca

SEQ ID NO: 859473 - RNA, 12 nt, Homo sapiens
ccaggugcacag

SEQ ID NO: 859474 - RNA, 13 nt, Homo sapiens
ccauaauguuaca

SEQ ID NO: 859475 - RNA, 22 nt, Homo sapiens
ccauaucugugcaauggaauau

SEQ ID NO: 859476 - RNA, 20 nt, Homo sapiens
ccauauuuucaccauuugau

SEQ ID NO: 859477 - RNA, 14 nt, Homo sapiens
ccaucagugcuccc

SEQ ID NO: 859478 - RNA, 23 nt, Homo sapiens
ccaucagugcucccucacauguc

SEQ ID NO: 859479 - RNA, 16 nt, Homo sapiens
ccaucuguaaauaucc

SEQ ID NO: 859480 - RNA, 19 nt, Homo sapiens
ccaugaaccaagaccauug

SEQ ID NO: 859481 - RNA, 13 nt, Homo sapiens
ccauggugcagug

SEQ ID NO: 859482 - RNA, 16 nt, Homo sapiens
ccauggugugaucguc

SEQ ID NO: 859483 - RNA, 21 nt, Homo sapiens
cccaacggcuacuacccggcg

SEQ ID NO: 859484 - RNA, 16 nt, Homo sapiens
cccagagaacaaucac

SEQ ID NO: 859485 - RNA, 18 nt, Homo sapiens
cccagcccucaguuuuca

SEQ ID NO: 859486 - RNA, 22 nt, Homo sapiens
cccagucagaguugugcacaug

SEQ ID NO: 859487 - RNA, 14 nt, Homo sapiens
cccaguguguuucu

SEQ ID NO: 859488 - RNA, 19 nt, Homo sapiens
cccaguuucuugagaucug

SEQ ID NO: 859489 - RNA, 20 nt, Homo sapiens
ccccagaugccuccucuguc

SEQ ID NO: 859490 - RNA, 15 nt, Homo sapiens
ccccauuccugggaa

SEQ ID NO: 859491 - RNA, 19 nt, Homo sapiens
ccccuccuugccgcuggga

SEQ ID NO: 859492 - RNA, 13 nt, Homo sapiens
cccuccaauccca

SEQ ID NO: 859493 - RNA, 22 nt, Homo sapiens
cccugaaguaagcaaagacuuu

SEQ ID NO: 859494 - RNA, 14 nt, Homo sapiens
cccuguaugauucc

SEQ ID NO: 859495 - RNA, 19 nt, Homo sapiens
cccuuuugcgugguccuua

SEQ ID NO: 859496 - RNA, 15 nt, Homo sapiens
cccuuuuguacauuu

SEQ ID NO: 859497 - RNA, 15 nt, Homo sapiens
ccgagucucuucucc

SEQ ID NO: 859498 - RNA, 17 nt, Homo sapiens
ccgggcacugucaugcc

SEQ ID NO: 859499 - RNA, 19 nt, Homo sapiens
ccgucaauaggcaaagggg

SEQ ID NO: 859500 - RNA, 17 nt, Homo sapiens
ccgucuccucuccagcc

SEQ ID NO: 859501 - RNA, 16 nt, Homo sapiens
ccgugacccaugcgau

SEQ ID NO: 859502 - RNA, 21 nt, Homo sapiens
ccguuggcaccucugugccac

SEQ ID NO: 859503 - RNA, 18 nt, Homo sapiens
ccuaagcagaccacugau

SEQ ID NO: 859504 - RNA, 18 nt, Homo sapiens
ccuaaugaaugcauaaaa

SEQ ID NO: 859505 - RNA, 15 nt, Homo sapiens
ccucaacaucuggua

SEQ ID NO: 859506 - RNA, 17 nt, Homo sapiens
ccucagcaccugggacc

SEQ ID NO: 859507 - RNA, 19 nt, Homo sapiens
ccucauccacuaggugccc

SEQ ID NO: 859508 - RNA, 10 nt, Homo sapiens
ccuccagacc

SEQ ID NO: 859509 - RNA, 14 nt, Homo sapiens
ccuccccauggugc

SEQ ID NO: 859510 - RNA, 22 nt, Homo sapiens
ccucccucgcauccgccucuga

SEQ ID NO: 859511 - RNA, 21 nt, Homo sapiens
ccucccuguccccugagguua

SEQ ID NO: 859512 - RNA, 14 nt, Homo sapiens
ccucgcugccagcu

SEQ ID NO: 859513 - RNA, 20 nt, Homo sapiens
ccucuccagcccuauggaag

SEQ ID NO: 859514 - RNA, 21 nt, Homo sapiens
ccucugggccaagucaaagac

SEQ ID NO: 859515 - RNA, 18 nt, Homo sapiens
ccucuguccaggcacuga

SEQ ID NO: 859516 - RNA, 16 nt, Homo sapiens
ccucuuuuucuagucu

SEQ ID NO: 859517 - RNA, 22 nt, Homo sapiens
ccugaaguaagcaaagacuuuc

SEQ ID NO: 859518 - RNA, 17 nt, Homo sapiens
ccugaucaccaggugaa

SEQ ID NO: 859519 - RNA, 16 nt, Homo sapiens
ccugcaggguaggggg

SEQ ID NO: 859520 - RNA, 22 nt, Homo sapiens
ccugccucucucauggcuuggg

SEQ ID NO: 859521 - RNA, 17 nt, Homo sapiens
ccugcgucuccugccca

SEQ ID NO: 859522 - RNA, 20 nt, Homo sapiens
ccugcuaccuaguuuguuag

SEQ ID NO: 859523 - RNA, 13 nt, Homo sapiens
ccuggacagugag

SEQ ID NO: 859524 - RNA, 16 nt, Homo sapiens
ccugggauggggcaug

SEQ ID NO: 859525 - RNA, 21 nt, Homo sapiens
ccuggggcuggguguguuuca

SEQ ID NO: 859526 - RNA, 22 nt, Homo sapiens
ccuggggcuggguguguuucag

SEQ ID NO: 859527 - RNA, 18 nt, Homo sapiens
ccugggugcugucaugcc

SEQ ID NO: 859528 - RNA, 18 nt, Homo sapiens
ccuggucccuuggagaca

SEQ ID NO: 859529 - RNA, 21 nt, Homo sapiens
ccuguauugucugacuucuca

SEQ ID NO: 859530 - RNA, 12 nt, Homo sapiens
ccugugaucgug

SEQ ID NO: 859531 - RNA, 16 nt, Homo sapiens
ccugugucagggcaca

SEQ ID NO: 859532 - RNA, 13 nt, Homo sapiens
ggguaacacugau

SEQ ID NO: 859533 - RNA, 12 nt, Homo sapiens
ggguagugccau

SEQ ID NO: 859534 - RNA, 23 nt, Homo sapiens
gggucugcuccugggaauggggu

SEQ ID NO: 859535 - RNA, 15 nt, Homo sapiens
gggugcaaugauaau

SEQ ID NO: 859536 - RNA, 23 nt, Homo sapiens
ggguguguuucaggacagcugcu

SEQ ID NO: 859537 - RNA, 20 nt, Homo sapiens
ggguucaccaggucagggag

SEQ ID NO: 859538 - RNA, 23 nt, Homo sapiens
gguaaagccucagcaacagccag

SEQ ID NO: 859539 - RNA, 23 nt, Homo sapiens
gguaaaucuaguaccaugucgua

SEQ ID NO: 859540 - RNA, 21 nt, Homo sapiens
gguauauucauuucaaaggga

SEQ ID NO: 859541 - RNA, 21 nt, Homo sapiens
gguaucauuuucugcauuuaa

SEQ ID NO: 859542 - RNA, 14 nt, Homo sapiens
ggucagugugccac

SEQ ID NO: 859543 - RNA, 13 nt, Homo sapiens
ggucauucucacc

SEQ ID NO: 859544 - RNA, 15 nt, Homo sapiens
ggucugcuccuggga

SEQ ID NO: 859545 - RNA, 18 nt, Homo sapiens
ggugauuuuccugugucc

SEQ ID NO: 859546 - RNA, 20 nt, Homo sapiens
gguuacuaagaugaaauugc

SEQ ID NO: 859547 - RNA, 23 nt, Homo sapiens
gguuacuaagaugaaauugccaa

SEQ ID NO: 859548 - RNA, 14 nt, Homo sapiens
guaaacugugcacc

SEQ ID NO: 859549 - RNA, 21 nt, Homo sapiens
guaaagaaauauauaugauau

SEQ ID NO: 859550 - RNA, 17 nt, Homo sapiens
guaaauauucuugucca

SEQ ID NO: 859551 - RNA, 15 nt, Homo sapiens
guaaauccacaguga

SEQ ID NO: 859552 - RNA, 21 nt, Homo sapiens
guaacccuuuucaugauuuca

SEQ ID NO: 859553 - RNA, 18 nt, Homo sapiens
guaagcaaagacuuuccu

SEQ ID NO: 859554 - RNA, 20 nt, Homo sapiens
guaagguacugaauacuuaa

SEQ ID NO: 859555 - RNA, 17 nt, Homo sapiens
guacagguaaggugagg

SEQ ID NO: 859556 - RNA, 21 nt, Homo sapiens
guaccuucaaacuagggccaa

SEQ ID NO: 859557 - RNA, 13 nt, Homo sapiens
guagaacuuggau

SEQ ID NO: 859558 - RNA, 23 nt, Homo sapiens
guagacaucccccuccuugccgc

SEQ ID NO: 859559 - RNA, 13 nt, Homo sapiens
guaguuacucuca

SEQ ID NO: 859560 - RNA, 22 nt, Homo sapiens
guauaggccaucuguaaauauc

SEQ ID NO: 859561 - RNA, 14 nt, Homo sapiens
guaucaaaugugac

SEQ ID NO: 859562 - RNA, 23 nt, Homo sapiens
guaugaggucuaggaacauacuu

SEQ ID NO: 859563 - RNA, 19 nt, Homo sapiens
guaugauccuaaugaaugc

SEQ ID NO: 859564 - RNA, 14 nt, Homo sapiens
guaugccuauucag

SEQ ID NO: 859565 - RNA, 12 nt, Homo sapiens
guauuagucaca

SEQ ID NO: 859566 - RNA, 19 nt, Homo sapiens
guauucugcaacagccugu

SEQ ID NO: 859567 - RNA, 18 nt, Homo sapiens
guauugucugacuucuca

SEQ ID NO: 859568 - RNA, 18 nt, Homo sapiens
gucaaauuuggauuuucc

SEQ ID NO: 859569 - RNA, 19 nt, Homo sapiens
gucaaccugccugacauuu

SEQ ID NO: 859570 - RNA, 23 nt, Homo sapiens
gucacaggacgauuucacugaca

SEQ ID NO: 859571 - RNA, 16 nt, Homo sapiens
gucagaguugugcaca

SEQ ID NO: 859572 - RNA, 20 nt, Homo sapiens
gucagcaggaagcaacgaag

SEQ ID NO: 859573 - RNA, 18 nt, Homo sapiens
gucaguagugccugugau

SEQ ID NO: 859574 - RNA, 16 nt, Homo sapiens
gucccgggcacuguca

SEQ ID NO: 859575 - RNA, 19 nt, Homo sapiens
gucccgggcacugucaugc

SEQ ID NO: 859576 - RNA, 21 nt, Homo sapiens
guccuucucucaccuccuaaa

SEQ ID NO: 859577 - RNA, 21 nt, Homo sapiens
gucucauaugauugugcacau

SEQ ID NO: 859578 - RNA, 19 nt, Homo sapiens
gucucccuggccccaguga

SEQ ID NO: 859579 - RNA, 21 nt, Homo sapiens
gucucucacccccacacuggg

SEQ ID NO: 859580 - RNA, 16 nt, Homo sapiens
gucugggcacagucag

SEQ ID NO: 859581 - RNA, 20 nt, Homo sapiens
gucuucagggggccaggugc

SEQ ID NO: 859582 - RNA, 22 nt, Homo sapiens
gucuucauaauuucuucacuca

SEQ ID NO: 859583 - RNA, 12 nt, Homo sapiens
gucuuucacuga

SEQ ID NO: 859584 - RNA, 18 nt, Homo sapiens
gucuuuuucuacagccag

SEQ ID NO: 859585 - RNA, 15 nt, Homo sapiens
gugaauaaaccauca

SEQ ID NO: 859586 - RNA, 23 nt, Homo sapiens
gugaauaaaccaucaucuugcca

SEQ ID NO: 859587 - RNA, 16 nt, Homo sapiens
gugaaugauucagugu

SEQ ID NO: 859588 - RNA, 17 nt, Homo sapiens
gugacauuuccaugcau

SEQ ID NO: 859589 - RNA, 12 nt, Homo sapiens
gugagacccagc

SEQ ID NO: 859590 - RNA, 16 nt, Homo sapiens
gugaucugaacagaaa

SEQ ID NO: 859591 - RNA, 15 nt, Homo sapiens
gugaugccugacaca

SEQ ID NO: 859592 - RNA, 10 nt, Homo sapiens
gugauuuucc

SEQ ID NO: 859593 - RNA, 14 nt, Homo sapiens
gugcaccugcccca

SEQ ID NO: 859594 - RNA, 16 nt, Homo sapiens
gugcauuugugucugc

SEQ ID NO: 859595 - RNA, 17 nt, Homo sapiens
gugcccagucaugacau

SEQ ID NO: 859596 - RNA, 20 nt, Homo sapiens
gugcccccagacgcacgugg

SEQ ID NO: 859597 - RNA, 16 nt, Homo sapiens
gugccucuugggagac

SEQ ID NO: 859598 - RNA, 17 nt, Homo sapiens
gugcuaucgcaccacug

SEQ ID NO: 859599 - RNA, 18 nt, Homo sapiens
guggaaaaaaaaagaaua

SEQ ID NO: 859600 - RNA, 22 nt, Homo sapiens
gugggagcuuuugguaugugac

SEQ ID NO: 859601 - RNA, 23 nt, Homo sapiens
guguauuuaaccuugaaggguuc

SEQ ID NO: 859602 - RNA, 16 nt, Homo sapiens
guguccgaggggcccc

SEQ ID NO: 859603 - RNA, 15 nt, Homo sapiens
gugucuaaugcauua

SEQ ID NO: 859604 - RNA, 15 nt, Homo sapiens
gugugaagaucacgu

SEQ ID NO: 859605 - RNA, 13 nt, Homo sapiens
guuacucucaggc

SEQ ID NO: 859606 - RNA, 15 nt, Homo sapiens
guuagugauggagcu

SEQ ID NO: 859607 - RNA, 15 nt, Homo sapiens
guuauagcugcauuu

SEQ ID NO: 859608 - RNA, 19 nt, Homo sapiens
guuauuuaugccucuguau

SEQ ID NO: 859609 - RNA, 14 nt, Homo sapiens
guuauuuuauugcc

SEQ ID NO: 859610 - RNA, 22 nt, Homo sapiens
guucaaagaaccccccucccca

SEQ ID NO: 859611 - RNA, 12 nt, Homo sapiens
guucaaagccag

SEQ ID NO: 859612 - RNA, 17 nt, Homo sapiens
guucaaucaaacuuuca

SEQ ID NO: 859613 - RNA, 17 nt, Homo sapiens
guucacucuacuuagca

SEQ ID NO: 859614 - RNA, 14 nt, Homo sapiens
guucagaugcuucu

SEQ ID NO: 859615 - RNA, 14 nt, Homo sapiens
guucccccacugau

SEQ ID NO: 859616 - RNA, 14 nt, Homo sapiens
guucccccugugca

SEQ ID NO: 859617 - RNA, 16 nt, Homo sapiens
guucugucucauauga

SEQ ID NO: 859618 - RNA, 20 nt, Homo sapiens
guuggaagugagggucagag

SEQ ID NO: 859619 - RNA, 15 nt, Homo sapiens
guuggguuccagaca

SEQ ID NO: 859620 - RNA, 19 nt, Homo sapiens
guuguggagagugcaacag

SEQ ID NO: 859621 - RNA, 22 nt, Homo sapiens
guuguuuaaaauaaaaguaccu

SEQ ID NO: 859622 - RNA, 17 nt, Homo sapiens
guuugaaucacaguaua

SEQ ID NO: 859623 - RNA, 19 nt, Homo sapiens
guuugauucugaguauuca

SEQ ID NO: 859624 - RNA, 15 nt, Homo sapiens
guuuuguauucucug

SEQ ID NO: 859625 - RNA, 16 nt, Homo sapiens
guuuuuaaaacccagu

SEQ ID NO: 859626 - RNA, 18 nt, Homo sapiens
uaaaauaguuccagauaa

SEQ ID NO: 859627 - RNA, 17 nt, Homo sapiens
uaaacaauaaaugggcc

SEQ ID NO: 859628 - RNA, 19 nt, Homo sapiens
uaaacauugccugauuugu

SEQ ID NO: 859629 - RNA, 14 nt, Homo sapiens
uaaagaaaggcaga

SEQ ID NO: 859630 - RNA, 18 nt, Homo sapiens
uaaagcaauaugcauuua

SEQ ID NO: 859631 - RNA, 21 nt, Homo sapiens
uaaagccucagcaacagccag

SEQ ID NO: 859632 - RNA, 15 nt, Homo sapiens
uaaauacagucuucc

SEQ ID NO: 859633 - RNA, 19 nt, Homo sapiens
uaaauagaugaguccuguu

SEQ ID NO: 859634 - RNA, 14 nt, Homo sapiens
uaaauaucacaaag

SEQ ID NO: 859635 - RNA, 15 nt, Homo sapiens
uaaaucaaugcuaua

SEQ ID NO: 859636 - RNA, 12 nt, Homo sapiens
uaaaucaauucu

SEQ ID NO: 859637 - RNA, 15 nt, Homo sapiens
uaaauccacagugag

SEQ ID NO: 859638 - RNA, 23 nt, Homo sapiens
uaaaucgcauuaaugaaauacca

SEQ ID NO: 859639 - RNA, 17 nt, Homo sapiens
uaaauguuuaauaucug

SEQ ID NO: 859640 - RNA, 16 nt, Homo sapiens
uaacaggauuagacag

SEQ ID NO: 859641 - RNA, 15 nt, Homo sapiens
uaacauauauuguua

SEQ ID NO: 859642 - RNA, 17 nt, Homo sapiens
uaacaugggcaaaggga

SEQ ID NO: 859643 - RNA, 18 nt, Homo sapiens
uaacuguaugaagucaua

SEQ ID NO: 859644 - RNA, 14 nt, Homo sapiens
uaagaaaacuaaga

SEQ ID NO: 859645 - RNA, 15 nt, Homo sapiens
uaagagaacaaugug

SEQ ID NO: 859646 - RNA, 16 nt, Homo sapiens
uaagcaacaugaauua

SEQ ID NO: 859647 - RNA, 15 nt, Homo sapiens
uaaguaaugaugucg

SEQ ID NO: 859648 - RNA, 19 nt, Homo sapiens
uaaguugauggugaugaaa

SEQ ID NO: 859649 - RNA, 15 nt, Homo sapiens
uaaguuugauuucau

SEQ ID NO: 859650 - RNA, 15 nt, Homo sapiens
uaauacagggcauuu

SEQ ID NO: 859651 - RNA, 14 nt, Homo sapiens
uaauaggaggacag

SEQ ID NO: 859652 - RNA, 14 nt, Homo sapiens
uaauauaacugccu

SEQ ID NO: 859653 - RNA, 15 nt, Homo sapiens
uaauauaacugccuu

SEQ ID NO: 859654 - RNA, 13 nt, Homo sapiens
uaaugaaugcaua

SEQ ID NO: 859655 - RNA, 23 nt, Homo sapiens
uaaugaugucguuugaaucacag

SEQ ID NO: 859656 - RNA, 13 nt, Homo sapiens
uaauguuacauua

SEQ ID NO: 859657 - RNA, 19 nt, Homo sapiens
uaauugucaaaaaccagaa

SEQ ID NO: 859658 - RNA, 21 nt, Homo sapiens
uacaaauaaauccaagacugu

SEQ ID NO: 859659 - RNA, 18 nt, Homo sapiens
uacacguugaaaaucaac

SEQ ID NO: 859660 - RNA, 16 nt, Homo sapiens
uacacucuagugccau

SEQ ID NO: 859661 - RNA, 17 nt, Homo sapiens
uacagaaauuaccccgg

SEQ ID NO: 859662 - RNA, 10 nt, Homo sapiens
uacaguauau

SEQ ID NO: 859663 - RNA, 14 nt, Homo sapiens
uacaguuuaucuau

SEQ ID NO: 859664 - RNA, 15 nt, Homo sapiens
uacaugaauugcauu

SEQ ID NO: 859665 - RNA, 18 nt, Homo sapiens
aggaugcuucugcucaca

SEQ ID NO: 859666 - RNA, 22 nt, Homo sapiens
aggauuuguguuuuacaguaua

SEQ ID NO: 859667 - RNA, 15 nt, Homo sapiens
aggcaaccacaggca

SEQ ID NO: 859668 - RNA, 19 nt, Homo sapiens
aggcaagacaccuucccag

SEQ ID NO: 859669 - RNA, 17 nt, Homo sapiens
aggcagaauggugggcu

SEQ ID NO: 859670 - RNA, 15 nt, Homo sapiens
aggcagcagugugag

SEQ ID NO: 859671 - RNA, 18 nt, Homo sapiens
aggcaugcgaaugagcug

SEQ ID NO: 859672 - RNA, 22 nt, Homo sapiens
aggccagucugaaccugagguu

SEQ ID NO: 859673 - RNA, 22 nt, Homo sapiens
aggccaucuguaaauaucccag

SEQ ID NO: 859674 - RNA, 14 nt, Homo sapiens
aggcggucacugcc

SEQ ID NO: 859675 - RNA, 19 nt, Homo sapiens
aggcuaaaacaaaucucag

SEQ ID NO: 859676 - RNA, 17 nt, Homo sapiens
agggaauaauccagaaa

SEQ ID NO: 859677 - RNA, 13 nt, Homo sapiens
agggacagcgggu

SEQ ID NO: 859678 - RNA, 19 nt, Homo sapiens
agggagaucuuggggugca

SEQ ID NO: 859679 - RNA, 14 nt, Homo sapiens
agggagcuggaaaa

SEQ ID NO: 859680 - RNA, 18 nt, Homo sapiens
agggauggggagcagcug

SEQ ID NO: 859681 - RNA, 12 nt, Homo sapiens
agggcacuaccg

SEQ ID NO: 859682 - RNA, 17 nt, Homo sapiens
agggcaggguucuagaa

SEQ ID NO: 859683 - RNA, 16 nt, Homo sapiens
agggggcuauucccug

SEQ ID NO: 859684 - RNA, 22 nt, Homo sapiens
agguauucguaaggaugggaag

SEQ ID NO: 859685 - RNA, 16 nt, Homo sapiens
agguccuggugguauu

SEQ ID NO: 859686 - RNA, 18 nt, Homo sapiens
aggucuaggaacauacuu

SEQ ID NO: 859687 - RNA, 21 nt, Homo sapiens
aggucuccaccccucaagcca

SEQ ID NO: 859688 - RNA, 21 nt, Homo sapiens
aggugaggauugauuaccuag

SEQ ID NO: 859689 - RNA, 22 nt, Homo sapiens
aggugcccaggaaccucagggc

SEQ ID NO: 859690 - RNA, 13 nt, Homo sapiens
agguuccaaauuc

SEQ ID NO: 859691 - RNA, 16 nt, Homo sapiens
agguuugccagcauuu

SEQ ID NO: 859692 - RNA, 15 nt, Homo sapiens
aguaaaaucacagau

SEQ ID NO: 859693 - RNA, 23 nt, Homo sapiens
aguaaauauugucacaacacuga

SEQ ID NO: 859694 - RNA, 16 nt, Homo sapiens
aguaacuguaugaagu

SEQ ID NO: 859695 - RNA, 23 nt, Homo sapiens
aguaacuguaugaagucauagau

SEQ ID NO: 859696 - RNA, 17 nt, Homo sapiens
aguaggagcugagcuuu

SEQ ID NO: 859697 - RNA, 11 nt, Homo sapiens
aguaucuguaa

SEQ ID NO: 859698 - RNA, 17 nt, Homo sapiens
aguaucuguaacccuug

SEQ ID NO: 859699 - RNA, 16 nt, Homo sapiens
agucagcaacaugaua

SEQ ID NO: 859700 - RNA, 19 nt, Homo sapiens
agucagcuccgaguggcuc

SEQ ID NO: 859701 - RNA, 20 nt, Homo sapiens
agucaugagcugagcaggga

SEQ ID NO: 859702 - RNA, 20 nt, Homo sapiens
agucaugcguuuaaucacau

SEQ ID NO: 859703 - RNA, 14 nt, Homo sapiens
agucugaaauaccu

SEQ ID NO: 859704 - RNA, 22 nt, Homo sapiens
agugauaucccccagccucaag

SEQ ID NO: 859705 - RNA, 17 nt, Homo sapiens
agugauugauagagugu

SEQ ID NO: 859706 - RNA, 14 nt, Homo sapiens
agugcaucucagcc

SEQ ID NO: 859707 - RNA, 13 nt, Homo sapiens
aguggaaacaaag

SEQ ID NO: 859708 - RNA, 21 nt, Homo sapiens
aguggaaacaaagggugggca

SEQ ID NO: 859709 - RNA, 16 nt, Homo sapiens
aguggugagacuguau

SEQ ID NO: 859710 - RNA, 17 nt, Homo sapiens
aguguuaucagucauaa

SEQ ID NO: 859711 - RNA, 22 nt, Homo sapiens
aguguuaucagucauaacuaaa

SEQ ID NO: 859712 - RNA, 20 nt, Homo sapiens
aguguuccccuuccacugag

SEQ ID NO: 859713 - RNA, 13 nt, Homo sapiens
aguuacucauuca

SEQ ID NO: 859714 - RNA, 17 nt, Homo sapiens
aguucucauccacagag

SEQ ID NO: 859715 - RNA, 18 nt, Homo sapiens
aguuggaagugugugauc

SEQ ID NO: 859716 - RNA, 12 nt, Homo sapiens
aguugugcacau

SEQ ID NO: 859717 - RNA, 19 nt, Homo sapiens
aguuuauacuucucuauua

SEQ ID NO: 859718 - RNA, 14 nt, Homo sapiens
aguuucacugacuu

SEQ ID NO: 859719 - RNA, 23 nt, Homo sapiens
aguuugaguuacuaucaugucaa

SEQ ID NO: 859720 - RNA, 18 nt, Homo sapiens
aguuugauuauucagugu

SEQ ID NO: 859721 - RNA, 21 nt, Homo sapiens
auaaaauuaaagcugaaaacu

SEQ ID NO: 859722 - RNA, 17 nt, Homo sapiens
auaaacguccuacugua

SEQ ID NO: 859723 - RNA, 15 nt, Homo sapiens
auaaagugccuauaa

SEQ ID NO: 859724 - RNA, 11 nt, Homo sapiens
auaaaugggcc

SEQ ID NO: 859725 - RNA, 19 nt, Homo sapiens
auaaauguuauagcugcau

SEQ ID NO: 859726 - RNA, 12 nt, Homo sapiens
auaacaaggaaa

SEQ ID NO: 859727 - RNA, 15 nt, Homo sapiens
auaacuauguugaua

SEQ ID NO: 859728 - RNA, 12 nt, Homo sapiens
auaauuacuuuc

SEQ ID NO: 859729 - RNA, 20 nt, Homo sapiens
auaauugucaaaaaccagaa

SEQ ID NO: 859730 - RNA, 21 nt, Homo sapiens
auacaaugaguaaaaucacag

SEQ ID NO: 859731 - RNA, 18 nt, Homo sapiens
auacauuguauaggccau

SEQ ID NO: 859732 - RNA, 20 nt, Homo sapiens
auacccagugucuaccuuca

SEQ ID NO: 859733 - RNA, 14 nt, Homo sapiens
auacuacacauuca

SEQ ID NO: 859734 - RNA, 19 nt, Homo sapiens
auacuucucuauuaucuca

SEQ ID NO: 859735 - RNA, 12 nt, Homo sapiens
auagaaagccaa

SEQ ID NO: 859736 - RNA, 17 nt, Homo sapiens
auagacuuagccccaug

SEQ ID NO: 859737 - RNA, 19 nt, Homo sapiens
auagacuuagccccaugag

SEQ ID NO: 859738 - RNA, 18 nt, Homo sapiens
auagcaguugaaacaaga

SEQ ID NO: 859739 - RNA, 23 nt, Homo sapiens
auagcaguugaaacaagaagcca

SEQ ID NO: 859740 - RNA, 12 nt, Homo sapiens
auagcugcauuu

SEQ ID NO: 859741 - RNA, 13 nt, Homo sapiens
auaggcaaagggg

SEQ ID NO: 859742 - RNA, 23 nt, Homo sapiens
auagugauugauagaguguuauc

SEQ ID NO: 859743 - RNA, 20 nt, Homo sapiens
auauaaaauauauauugcau

SEQ ID NO: 859744 - RNA, 22 nt, Homo sapiens
auauaaaauauauauugcauag

SEQ ID NO: 859745 - RNA, 12 nt, Homo sapiens
auauacuaauau

SEQ ID NO: 859746 - RNA, 20 nt, Homo sapiens
auauauauuuuugugcacau

SEQ ID NO: 859747 - RNA, 23 nt, Homo sapiens
auauaugauauauaaaugugauu

SEQ ID NO: 859748 - RNA, 13 nt, Homo sapiens
auauauuuaacua

SEQ ID NO: 859749 - RNA, 20 nt, Homo sapiens
auauauuuuugugcacauuu

SEQ ID NO: 859750 - RNA, 17 nt, Homo sapiens
auauccaacaugugcuc

SEQ ID NO: 859751 - RNA, 21 nt, Homo sapiens
auauccugccuuuuaccuuca

SEQ ID NO: 859752 - RNA, 20 nt, Homo sapiens
auaucuuugaccucaaugga

SEQ ID NO: 859753 - RNA, 20 nt, Homo sapiens
auaugauauauaaaugugau

SEQ ID NO: 859754 - RNA, 11 nt, Homo sapiens
auaugcaauau

SEQ ID NO: 859755 - RNA, 21 nt, Homo sapiens
auaugcacuuucccuagaaag

SEQ ID NO: 859756 - RNA, 23 nt, Homo sapiens
auauguagauugccuuuggcaau

SEQ ID NO: 859757 - RNA, 12 nt, Homo sapiens
auauucauuuca

SEQ ID NO: 859758 - RNA, 19 nt, Homo sapiens
auauugcagcuuauauuca

SEQ ID NO: 859759 - RNA, 22 nt, Homo sapiens
auauuuguaugauccuaaugaa

SEQ ID NO: 859760 - RNA, 22 nt, Homo sapiens
aucaaaugugacauuauaugca

SEQ ID NO: 859761 - RNA, 13 nt, Homo sapiens
aucaacagcauuu

SEQ ID NO: 859762 - RNA, 20 nt, Homo sapiens
aucaacccaauaauucugua

SEQ ID NO: 859763 - RNA, 14 nt, Homo sapiens
aucaaguccuacaa

SEQ ID NO: 859764 - RNA, 23 nt, Homo sapiens
aucacaagaaaaaggaagccacu

SEQ ID NO: 859765 - RNA, 15 nt, Homo sapiens
aucaggacccagagg

SEQ ID NO: 859766 - RNA, 17 nt, Homo sapiens
aucaguauuaagcuaau

SEQ ID NO: 859767 - RNA, 18 nt, Homo sapiens
aucaucuccugccuuccu

SEQ ID NO: 859768 - RNA, 16 nt, Homo sapiens
aucauucucauucuca

SEQ ID NO: 859769 - RNA, 17 nt, Homo sapiens
auccagaugaacugaga

SEQ ID NO: 859770 - RNA, 21 nt, Homo sapiens
auccaugcagauaacagcugg

SEQ ID NO: 859771 - RNA, 22 nt, Homo sapiens
auccccuaagcagaccacugau

SEQ ID NO: 859772 - RNA, 13 nt, Homo sapiens
auccuuuacuguu

SEQ ID NO: 859773 - RNA, 22 nt, Homo sapiens
aucgcugucaucucagcuggau

SEQ ID NO: 859774 - RNA, 21 nt, Homo sapiens
aucuauuuaucugucugagcc

SEQ ID NO: 859775 - RNA, 15 nt, Homo sapiens
aucucaaacuacugg

SEQ ID NO: 859776 - RNA, 22 nt, Homo sapiens
aucucaaacuacuggcaauuug

SEQ ID NO: 859777 - RNA, 20 nt, Homo sapiens
aucucauuggacccuuccau

SEQ ID NO: 859778 - RNA, 16 nt, Homo sapiens
aucuccccuucacaug

SEQ ID NO: 859779 - RNA, 18 nt, Homo sapiens
aucucgaagucuuccauc

SEQ ID NO: 859780 - RNA, 22 nt, Homo sapiens
aucucugcuuuggaaaucacac

SEQ ID NO: 859781 - RNA, 20 nt, Homo sapiens
aucuggacuuauuuuuggac

SEQ ID NO: 859782 - RNA, 22 nt, Homo sapiens
aucuguaugggucauucucacc

SEQ ID NO: 859783 - RNA, 16 nt, Homo sapiens
aucuucuucaccauuu

SEQ ID NO: 859784 - RNA, 15 nt, Homo sapiens
aucuuggggugcagc

SEQ ID NO: 859785 - RNA, 15 nt, Homo sapiens
aucuuuuaagcccau

SEQ ID NO: 859786 - RNA, 13 nt, Homo sapiens
augaaacuaugca

SEQ ID NO: 859787 - RNA, 11 nt, Homo sapiens
augaagcacaa

SEQ ID NO: 859788 - RNA, 19 nt, Homo sapiens
augaauugcauuuuacuuu

SEQ ID NO: 859789 - RNA, 22 nt, Homo sapiens
augacagucagcaacaugauac

SEQ ID NO: 859790 - RNA, 14 nt, Homo sapiens
augacuugacaagu

SEQ ID NO: 859791 - RNA, 14 nt, Homo sapiens
augagaaaagggaa

SEQ ID NO: 859792 - RNA, 13 nt, Homo sapiens
augagaacaugaa

SEQ ID NO: 859793 - RNA, 18 nt, Homo sapiens
augagaucuaggugagga

SEQ ID NO: 859794 - RNA, 15 nt, Homo sapiens
augagauguaugccc

SEQ ID NO: 859795 - RNA, 12 nt, Homo sapiens
augagcauuuag

SEQ ID NO: 859796 - RNA, 10 nt, Homo sapiens
augagcucug

SEQ ID NO: 859797 - RNA, 19 nt, Homo sapiens
augauucuccucucccaaa

SEQ ID NO: 859798 - RNA, 21 nt, Homo sapiens
augcaagcaagaaacacuggg

SEQ ID NO: 859799 - RNA, 16 nt, Homo sapiens
caagcuggacuauggc

SEQ ID NO: 859800 - RNA, 21 nt, Homo sapiens
caagggaauucggugugcacc

SEQ ID NO: 859801 - RNA, 21 nt, Homo sapiens
caagggccagcuggaggugaa

SEQ ID NO: 859802 - RNA, 21 nt, Homo sapiens
caagggcuuuguuuugcacac

SEQ ID NO: 859803 - RNA, 16 nt, Homo sapiens
caaguacuuugucuug

SEQ ID NO: 859804 - RNA, 17 nt, Homo sapiens
caauacaauaguaugca

SEQ ID NO: 859805 - RNA, 19 nt, Homo sapiens
caaucaucaucauucucau

SEQ ID NO: 859806 - RNA, 16 nt, Homo sapiens
caauccagcuauguua

SEQ ID NO: 859807 - RNA, 18 nt, Homo sapiens
caaugccugccugaacaa

SEQ ID NO: 859808 - RNA, 20 nt, Homo sapiens
caaugccugccugaacaaag

SEQ ID NO: 859809 - RNA, 18 nt, Homo sapiens
caauuaaaaccauuaccu

SEQ ID NO: 859810 - RNA, 21 nt, Homo sapiens
caauuaaaaccauuaccuuaa

SEQ ID NO: 859811 - RNA, 17 nt, Homo sapiens
caauuuuaaaucugaga

SEQ ID NO: 859812 - RNA, 22 nt, Homo sapiens
cacaagaagugggagugggaga

SEQ ID NO: 859813 - RNA, 12 nt, Homo sapiens
cacacuuugcca

SEQ ID NO: 859814 - RNA, 17 nt, Homo sapiens
cacagaagguccuggug

SEQ ID NO: 859815 - RNA, 13 nt, Homo sapiens
cacagagugccau

SEQ ID NO: 859816 - RNA, 16 nt, Homo sapiens
cacagcagcuguucaa

SEQ ID NO: 859817 - RNA, 21 nt, Homo sapiens
cacagcugcagagacagagag

SEQ ID NO: 859818 - RNA, 15 nt, Homo sapiens
cacaggcagcauuua

SEQ ID NO: 859819 - RNA, 16 nt, Homo sapiens
cacaggcagcauuuag

SEQ ID NO: 859820 - RNA, 13 nt, Homo sapiens
cacagugcaucuc

SEQ ID NO: 859821 - RNA, 12 nt, Homo sapiens
cacagugugaau

SEQ ID NO: 859822 - RNA, 23 nt, Homo sapiens
cacagugugaaucuuggugucua

SEQ ID NO: 859823 - RNA, 22 nt, Homo sapiens
caccaagagccucccugccguu

SEQ ID NO: 859824 - RNA, 15 nt, Homo sapiens
caccaggucagggag

SEQ ID NO: 859825 - RNA, 14 nt, Homo sapiens
caccccucaagcca

SEQ ID NO: 859826 - RNA, 18 nt, Homo sapiens
caccuagcagauauguau

SEQ ID NO: 859827 - RNA, 15 nt, Homo sapiens
caccucccugcagcu

SEQ ID NO: 859828 - RNA, 18 nt, Homo sapiens
caccugccccaggcucag

SEQ ID NO: 859829 - RNA, 23 nt, Homo sapiens
caccugguuccggaauccugucc

SEQ ID NO: 859830 - RNA, 22 nt, Homo sapiens
cacguaguagggucaggccacg

SEQ ID NO: 859831 - RNA, 22 nt, Homo sapiens
cacgucucccuggccccaguga

SEQ ID NO: 859832 - RNA, 18 nt, Homo sapiens
cacgucuggcuucacaga

SEQ ID NO: 859833 - RNA, 19 nt, Homo sapiens
cacguggccgcugcuguga

SEQ ID NO: 859834 - RNA, 21 nt, Homo sapiens
cacuagcaauaaaaugcuaau

SEQ ID NO: 859835 - RNA, 14 nt, Homo sapiens
cacuauuacuggga

SEQ ID NO: 859836 - RNA, 14 nt, Homo sapiens
cacuauuggacuuu

SEQ ID NO: 859837 - RNA, 21 nt, Homo sapiens
cacugacacugcgaacucuca

SEQ ID NO: 859838 - RNA, 15 nt, Homo sapiens
cacugagcaaagcau

SEQ ID NO: 859839 - RNA, 19 nt, Homo sapiens
cacugagcaaagcauugag

SEQ ID NO: 859840 - RNA, 18 nt, Homo sapiens
cacugaugggcacuggaa

SEQ ID NO: 859841 - RNA, 15 nt, Homo sapiens
cacugcuugaggaaa

SEQ ID NO: 859842 - RNA, 21 nt, Homo sapiens
cacuggcuuuggguagugcca

SEQ ID NO: 859843 - RNA, 15 nt, Homo sapiens
cacugucaugcccag

SEQ ID NO: 859844 - RNA, 22 nt, Homo sapiens
accuguauugucugacuucuca

SEQ ID NO: 859845 - RNA, 22 nt, Homo sapiens
accuuacauuugaaaucuauga

SEQ ID NO: 859846 - RNA, 20 nt, Homo sapiens
accuugcacuauuggacuuu

SEQ ID NO: 859847 - RNA, 17 nt, Homo sapiens
acgacugucuccauggc

SEQ ID NO: 859848 - RNA, 17 nt, Homo sapiens
acgacuguuuucccaac

SEQ ID NO: 859849 - RNA, 19 nt, Homo sapiens
acgagcugcuguccaggaa

SEQ ID NO: 859850 - RNA, 18 nt, Homo sapiens
acggcggggcccgguggc

SEQ ID NO: 859851 - RNA, 18 nt, Homo sapiens
acggcuacuacccggcgc

SEQ ID NO: 859852 - RNA, 15 nt, Homo sapiens
acguaugaaugauau

SEQ ID NO: 859853 - RNA, 17 nt, Homo sapiens
acgucccgggcacuguc

SEQ ID NO: 859854 - RNA, 18 nt, Homo sapiens
acgucccgggcacuguca

SEQ ID NO: 859855 - RNA, 20 nt, Homo sapiens
acgucccgggcacugucaug

SEQ ID NO: 859856 - RNA, 15 nt, Homo sapiens
acguggccgcugccc

SEQ ID NO: 859857 - RNA, 18 nt, Homo sapiens
acguggggcagcacagag

SEQ ID NO: 859858 - RNA, 17 nt, Homo sapiens
acguguuuacuugguga

SEQ ID NO: 859859 - RNA, 19 nt, Homo sapiens
acuaagaugaaauugccaa

SEQ ID NO: 859860 - RNA, 16 nt, Homo sapiens
acuaauacagacuaug

SEQ ID NO: 859861 - RNA, 20 nt, Homo sapiens
acuaaugcccuaucuuagua

SEQ ID NO: 859862 - RNA, 23 nt, Homo sapiens
acuacacauucaauaagcaucaa

SEQ ID NO: 859863 - RNA, 21 nt, Homo sapiens
acuacucugccugaacacugc

SEQ ID NO: 859864 - RNA, 15 nt, Homo sapiens
acuacuggcaauuug

SEQ ID NO: 859865 - RNA, 15 nt, Homo sapiens
acuagggaucccuca

SEQ ID NO: 859866 - RNA, 11 nt, Homo sapiens
acuagggccaa

SEQ ID NO: 859867 - RNA, 19 nt, Homo sapiens
acuauggcucuacuuucag

SEQ ID NO: 859868 - RNA, 20 nt, Homo sapiens
acuauucuuaagcacuuuga

SEQ ID NO: 859869 - RNA, 13 nt, Homo sapiens
acucagggcuccu

SEQ ID NO: 859870 - RNA, 20 nt, Homo sapiens
acuccgagagcaugcuuaau

SEQ ID NO: 859871 - RNA, 13 nt, Homo sapiens
acuccuaaaucaa

SEQ ID NO: 859872 - RNA, 12 nt, Homo sapiens
acucuagugcca

SEQ ID NO: 859873 - RNA, 16 nt, Homo sapiens
acucucaggcauggau

SEQ ID NO: 859874 - RNA, 19 nt, Homo sapiens
acucuuaguuacucauuca

SEQ ID NO: 859875 - RNA, 23 nt, Homo sapiens
acucuuaguuacucauucaggga

SEQ ID NO: 859876 - RNA, 18 nt, Homo sapiens
acugacuuucucagccuc

SEQ ID NO: 859877 - RNA, 20 nt, Homo sapiens
acugaguccuguucuuguua

SEQ ID NO: 859878 - RNA, 22 nt, Homo sapiens
acugcagggaaaauuauuugca

SEQ ID NO: 859879 - RNA, 16 nt, Homo sapiens
acuggcccaccccucu

SEQ ID NO: 859880 - RNA, 12 nt, Homo sapiens
acugucucaaga

SEQ ID NO: 859881 - RNA, 19 nt, Homo sapiens
acuguuggcaaggugacau

SEQ ID NO: 859882 - RNA, 17 nt, Homo sapiens
acuucuauauauacaau

SEQ ID NO: 859883 - RNA, 17 nt, Homo sapiens
acuucucuauuaucuca

SEQ ID NO: 859884 - RNA, 16 nt, Homo sapiens
acuugacaagucagga

SEQ ID NO: 859885 - RNA, 17 nt, Homo sapiens
acuuggccaccaggacu

SEQ ID NO: 859886 - RNA, 13 nt, Homo sapiens
acuugggaacuag

SEQ ID NO: 859887 - RNA, 19 nt, Homo sapiens
acuuuaaucccacuugccc

SEQ ID NO: 859888 - RNA, 23 nt, Homo sapiens
acuuuagggcuaaccaguucucu

SEQ ID NO: 859889 - RNA, 22 nt, Homo sapiens
acuuuuaaguugcugaugaacu

SEQ ID NO: 859890 - RNA, 12 nt, Homo sapiens
acuuuucacagu

SEQ ID NO: 859891 - RNA, 15 nt, Homo sapiens
acuuuucacaguaug

SEQ ID NO: 859892 - RNA, 18 nt, Homo sapiens
acuuuuuaccuaguacaa

SEQ ID NO: 859893 - RNA, 13 nt, Homo sapiens
agaaacacugggc

SEQ ID NO: 859894 - RNA, 13 nt, Homo sapiens
agaaagcauugcc

SEQ ID NO: 859895 - RNA, 23 nt, Homo sapiens
agaaagccauauuccagcaguga

SEQ ID NO: 859896 - RNA, 19 nt, Homo sapiens
agaaauucuguuaauguua

SEQ ID NO: 859897 - RNA, 14 nt, Homo sapiens
agaacagcuucaug

SEQ ID NO: 859898 - RNA, 22 nt, Homo sapiens
agaacagcuucauguucccaaa

SEQ ID NO: 859899 - RNA, 18 nt, Homo sapiens
agaacccuuggagccaau

SEQ ID NO: 859900 - RNA, 23 nt, Homo sapiens
agaagccucacugcaagcacugc

SEQ ID NO: 859901 - RNA, 23 nt, Homo sapiens
agaagcuaaauccuuuacuguua

SEQ ID NO: 859902 - RNA, 20 nt, Homo sapiens
agaaggaaaugugggguaga

SEQ ID NO: 859903 - RNA, 13 nt, Homo sapiens
agaaggagggaga

SEQ ID NO: 859904 - RNA, 20 nt, Homo sapiens
agaauaaucauauauaugca

SEQ ID NO: 859905 - RNA, 18 nt, Homo sapiens
agaauagggagacaaucu

SEQ ID NO: 859906 - RNA, 18 nt, Homo sapiens
agaaucccuagucuucaa

SEQ ID NO: 859907 - RNA, 13 nt, Homo sapiens
agaauggugggcu

SEQ ID NO: 859908 - RNA, 23 nt, Homo sapiens
agaauguucuuauguugcccagu

SEQ ID NO: 859909 - RNA, 19 nt, Homo sapiens
agacaaaaucuuaaaugcc

SEQ ID NO: 859910 - RNA, 13 nt, Homo sapiens
agacaugaauaug

SEQ ID NO: 859911 - RNA, 18 nt, Homo sapiens
agacaugagcauggcuga

SEQ ID NO: 859912 - RNA, 15 nt, Homo sapiens
agaccagcuucuagc

SEQ ID NO: 859913 - RNA, 16 nt, Homo sapiens
agaccuaggauuucau

SEQ ID NO: 859914 - RNA, 12 nt, Homo sapiens
agaccuuggcau

SEQ ID NO: 859915 - RNA, 16 nt, Homo sapiens
agacggauuaucuaga

SEQ ID NO: 859916 - RNA, 16 nt, Homo sapiens
agacucccaagcugga

SEQ ID NO: 859917 - RNA, 21 nt, Homo sapiens
agacuggguuccucuccaagc

SEQ ID NO: 859918 - RNA, 19 nt, Homo sapiens
agacugucucaagagggca

SEQ ID NO: 859919 - RNA, 18 nt, Homo sapiens
agacuuagccccaugagu

SEQ ID NO: 859920 - RNA, 22 nt, Homo sapiens
agagaacaaugugcuaugugaa

SEQ ID NO: 859921 - RNA, 13 nt, Homo sapiens
agagacuacucug

SEQ ID NO: 859922 - RNA, 19 nt, Homo sapiens
agagacuacucugccugaa

SEQ ID NO: 859923 - RNA, 15 nt, Homo sapiens
agagaggacuguuga

SEQ ID NO: 859924 - RNA, 21 nt, Homo sapiens
agagcauucugggguggggcu

SEQ ID NO: 859925 - RNA, 14 nt, Homo sapiens
agagcucaggagaa

SEQ ID NO: 859926 - RNA, 16 nt, Homo sapiens
agaguaaauauuguca

SEQ ID NO: 859927 - RNA, 22 nt, Homo sapiens
agaguggaaccaacacuaacau

SEQ ID NO: 859928 - RNA, 19 nt, Homo sapiens
agauaggauauacuguaug

SEQ ID NO: 859929 - RNA, 20 nt, Homo sapiens
agaugcauuaucuaugauau

SEQ ID NO: 859930 - RNA, 18 nt, Homo sapiens
agaugguucccuuuguug

SEQ ID NO: 859931 - RNA, 14 nt, Homo sapiens
agauguagcacuga

SEQ ID NO: 859932 - RNA, 19 nt, Homo sapiens
agauguccuugaugcucau

SEQ ID NO: 859933 - RNA, 22 nt, Homo sapiens
agaugugugauucacaguguga

SEQ ID NO: 859934 - RNA, 19 nt, Homo sapiens
agauguucuaagucuuucc

SEQ ID NO: 859935 - RNA, 19 nt, Homo sapiens
agauuagggcggggagaag

SEQ ID NO: 859936 - RNA, 15 nt, Homo sapiens
agcaauaaaaugcua

SEQ ID NO: 859937 - RNA, 16 nt, Homo sapiens
agcacaagaaguggga

SEQ ID NO: 859938 - RNA, 12 nt, Homo sapiens
cagaagccucac

SEQ ID NO: 859939 - RNA, 12 nt, Homo sapiens
cagaauggagcu

SEQ ID NO: 859940 - RNA, 21 nt, Homo sapiens
cagaauggugggcuccagagu

SEQ ID NO: 859941 - RNA, 16 nt, Homo sapiens
cagagcagaacuuuca

SEQ ID NO: 859942 - RNA, 18 nt, Homo sapiens
cagaugccuccucugucc

SEQ ID NO: 859943 - RNA, 15 nt, Homo sapiens
cagauggucccauua

SEQ ID NO: 859944 - RNA, 20 nt, Homo sapiens
cagauguccuugaugcucau

SEQ ID NO: 859945 - RNA, 16 nt, Homo sapiens
cagauucaagugcaau

SEQ ID NO: 859946 - RNA, 18 nt, Homo sapiens
cagcaccaugggccuucu

SEQ ID NO: 859947 - RNA, 19 nt, Homo sapiens
cagcccuauggaagucuca

SEQ ID NO: 859948 - RNA, 14 nt, Homo sapiens
cagccuuacaauac

SEQ ID NO: 859949 - RNA, 13 nt, Homo sapiens
cagcuaaagcaau

SEQ ID NO: 859950 - RNA, 18 nt, Homo sapiens
cagcucaaguuagcauuu

SEQ ID NO: 859951 - RNA, 21 nt, Homo sapiens
cagcucugcauuaucugaggu

SEQ ID NO: 859952 - RNA, 16 nt, Homo sapiens
cagcuguuagagucca

SEQ ID NO: 859953 - RNA, 13 nt, Homo sapiens
cagcuuauauuca

SEQ ID NO: 859954 - RNA, 14 nt, Homo sapiens
cagcuuccuuccaa

SEQ ID NO: 859955 - RNA, 16 nt, Homo sapiens
cagcuuggagugccac

SEQ ID NO: 859956 - RNA, 20 nt, Homo sapiens
caggacacugcagaacagcu

SEQ ID NO: 859957 - RNA, 17 nt, Homo sapiens
caggacuccuuguucug

SEQ ID NO: 859958 - RNA, 12 nt, Homo sapiens
caggcaccagca

SEQ ID NO: 859959 - RNA, 12 nt, Homo sapiens
caggcacugaga

SEQ ID NO: 859960 - RNA, 14 nt, Homo sapiens
caggcagcauuuag

SEQ ID NO: 859961 - RNA, 22 nt, Homo sapiens
caggcagcauuuagcacauacu

SEQ ID NO: 859962 - RNA, 22 nt, Homo sapiens
caggcccaauucugccacuucu

SEQ ID NO: 859963 - RNA, 19 nt, Homo sapiens
cagggaaaauuauuugcau

SEQ ID NO: 859964 - RNA, 14 nt, Homo sapiens
cagggaaugaaggu

SEQ ID NO: 859965 - RNA, 18 nt, Homo sapiens
cagggcauuuugguccaa

SEQ ID NO: 859966 - RNA, 20 nt, Homo sapiens
cagggcucuguauucugcaa

SEQ ID NO: 859967 - RNA, 13 nt, Homo sapiens
caggucagagccc

SEQ ID NO: 859968 - RNA, 16 nt, Homo sapiens
cagguuccaaucagaa

SEQ ID NO: 859969 - RNA, 12 nt, Homo sapiens
caguaacuaagc

SEQ ID NO: 859970 - RNA, 19 nt, Homo sapiens
caguaaggcagcucugucg

SEQ ID NO: 859971 - RNA, 16 nt, Homo sapiens
caguggugagacugua

SEQ ID NO: 859972 - RNA, 20 nt, Homo sapiens
caguguuaaaugugaugaau

SEQ ID NO: 859973 - RNA, 13 nt, Homo sapiens
caguucaaucaaa

SEQ ID NO: 859974 - RNA, 21 nt, Homo sapiens
caguuugauuguuguuuauaa

SEQ ID NO: 859975 - RNA, 20 nt, Homo sapiens
cauaaaagaagaaacuauuu

SEQ ID NO: 859976 - RNA, 16 nt, Homo sapiens
cauaauguuacauuau

SEQ ID NO: 859977 - RNA, 22 nt, Homo sapiens
cauaccaaugaaaaaauguaua

SEQ ID NO: 859978 - RNA, 16 nt, Homo sapiens
cauacuacacauucaa

SEQ ID NO: 859979 - RNA, 14 nt, Homo sapiens
cauauccaacaugu

SEQ ID NO: 859980 - RNA, 18 nt, Homo sapiens
cauauccaacaugugcuc

SEQ ID NO: 859981 - RNA, 20 nt, Homo sapiens
cauauccaacaugugcucag

SEQ ID NO: 859982 - RNA, 13 nt, Homo sapiens
cauaucugugcaa

SEQ ID NO: 859983 - RNA, 16 nt, Homo sapiens
cauaugauugugcaca

SEQ ID NO: 859984 - RNA, 17 nt, Homo sapiens
caucaucuccugccuuc

SEQ ID NO: 859985 - RNA, 17 nt, Homo sapiens
caucauucucugucuca

SEQ ID NO: 859986 - RNA, 16 nt, Homo sapiens
cauccaucaucaugug

SEQ ID NO: 859987 - RNA, 21 nt, Homo sapiens
cauccauuuauuuggcaucug

SEQ ID NO: 859988 - RNA, 21 nt, Homo sapiens
cauccggcaugagggcugaga

SEQ ID NO: 859989 - RNA, 21 nt, Homo sapiens
caucucccagauaaugugaaa

SEQ ID NO: 859990 - RNA, 10 nt, Homo sapiens
caucuggccc

SEQ ID NO: 859991 - RNA, 12 nt, Homo sapiens
caugaagcacaa

SEQ ID NO: 859992 - RNA, 13 nt, Homo sapiens
caugaagcacaaa

SEQ ID NO: 859993 - RNA, 20 nt, Homo sapiens
caugacauauuuuugcuuua

SEQ ID NO: 859994 - RNA, 17 nt, Homo sapiens
caugagaucuaggugag

SEQ ID NO: 859995 - RNA, 19 nt, Homo sapiens
caugagaucuaggugagga

SEQ ID NO: 859996 - RNA, 14 nt, Homo sapiens
caugaucaucacaa

SEQ ID NO: 859997 - RNA, 18 nt, Homo sapiens
caugaucaucacaaucau

SEQ ID NO: 859998 - RNA, 16 nt, Homo sapiens
caugauuucauuucaa

SEQ ID NO: 859999 - RNA, 15 nt, Homo sapiens
caugauuugcaacuu

SEQ ID NO: 860000 - RNA, 15 nt, Homo sapiens
cauggccgcugccca

SEQ ID NO: 860001 - RNA, 15 nt, Homo sapiens
cauuaaacuuaccug

SEQ ID NO: 860002 - RNA, 23 nt, Homo sapiens
cauuaguuguuagugauggagcu

SEQ ID NO: 860003 - RNA, 13 nt, Homo sapiens
cauuaucuaugau

SEQ ID NO: 860004 - RNA, 17 nt, Homo sapiens
cauucacaacacaauca

SEQ ID NO: 860005 - RNA, 14 nt, Homo sapiens
cauuccaucaauuu

SEQ ID NO: 860006 - RNA, 14 nt, Homo sapiens
cauucccuuucaug

SEQ ID NO: 860007 - RNA, 17 nt, Homo sapiens
cauucuacuucagcuuu

SEQ ID NO: 860008 - RNA, 17 nt, Homo sapiens
cauucuuucugcuauau

SEQ ID NO: 860009 - RNA, 18 nt, Homo sapiens
cauugaagggggaugcag

SEQ ID NO: 860010 - RNA, 12 nt, Homo sapiens
cauuuagcacau

SEQ ID NO: 860011 - RNA, 17 nt, Homo sapiens
cauuucaagugauuugg

SEQ ID NO: 860012 - RNA, 12 nt, Homo sapiens
cauuuccaugca

SEQ ID NO: 860013 - RNA, 23 nt, Homo sapiens
cauuugaaaucuaugaaauauca

SEQ ID NO: 860014 - RNA, 16 nt, Homo sapiens
cauuuggcaaugccau

SEQ ID NO: 860015 - RNA, 18 nt, Homo sapiens
ccaaacggaacucuucau

SEQ ID NO: 860016 - RNA, 20 nt, Homo sapiens
ccaaagaaccccaggcaaua

SEQ ID NO: 860017 - RNA, 17 nt, Homo sapiens
ccaaagcuuucauguaa

SEQ ID NO: 860018 - RNA, 16 nt, Homo sapiens
ccaaauaugcacuuuc

SEQ ID NO: 860019 - RNA, 11 nt, Homo sapiens
ccaaauucuga

SEQ ID NO: 860020 - RNA, 20 nt, Homo sapiens
ccaaauugaugggugggcua

SEQ ID NO: 860021 - RNA, 18 nt, Homo sapiens
ccaacaugugcucaggga

SEQ ID NO: 860022 - RNA, 21 nt, Homo sapiens
ccaacguggggcagcacagag

SEQ ID NO: 860023 - RNA, 23 nt, Homo sapiens
ccaacguggggcagcacagagag

SEQ ID NO: 860024 - RNA, 15 nt, Homo sapiens
ccaacuccaggguua

SEQ ID NO: 860025 - RNA, 11 nt, Homo sapiens
ccaagcagcuu

SEQ ID NO: 860026 - RNA, 14 nt, Homo sapiens
ccaagccaggguuc

SEQ ID NO: 860027 - RNA, 20 nt, Homo sapiens
ccaagggcuccagggccagg

SEQ ID NO: 860028 - RNA, 22 nt, Homo sapiens
cuacacauucaauaagcaucaa

SEQ ID NO: 860029 - RNA, 16 nt, Homo sapiens
cuaccuaguuuguuag

SEQ ID NO: 860030 - RNA, 12 nt, Homo sapiens
cuacucagggaa

SEQ ID NO: 860031 - RNA, 18 nt, Homo sapiens
cuagaaagccauauucca

SEQ ID NO: 860032 - RNA, 13 nt, Homo sapiens
cuagacaguauug

SEQ ID NO: 860033 - RNA, 19 nt, Homo sapiens
cuagagaaggacccggagg

SEQ ID NO: 860034 - RNA, 12 nt, Homo sapiens
cuagagccucac

SEQ ID NO: 860035 - RNA, 15 nt, Homo sapiens
cuagauuuaugaaua

SEQ ID NO: 860036 - RNA, 16 nt, Homo sapiens
cuaggcaucugcugua

SEQ ID NO: 860037 - RNA, 16 nt, Homo sapiens
cuagggccaagcccag

SEQ ID NO: 860038 - RNA, 23 nt, Homo sapiens
cuaguaccaugucguaguuacuc

SEQ ID NO: 860039 - RNA, 23 nt, Homo sapiens
cuauaaaggaaacacguuuagaa

SEQ ID NO: 860040 - RNA, 16 nt, Homo sapiens
cuaucuuuucaucuca

SEQ ID NO: 860041 - RNA, 17 nt, Homo sapiens
cuaucuuuuguucuacc

SEQ ID NO: 860042 - RNA, 16 nt, Homo sapiens
cuaugaggcaaccaca

SEQ ID NO: 860043 - RNA, 16 nt, Homo sapiens
cuaugauaugcuaaua

SEQ ID NO: 860044 - RNA, 14 nt, Homo sapiens
cuauguaacaugua

SEQ ID NO: 860045 - RNA, 14 nt, Homo sapiens
cuaugugcaugcag

SEQ ID NO: 860046 - RNA, 21 nt, Homo sapiens
cuaugugcaugcagcaucuaa

SEQ ID NO: 860047 - RNA, 14 nt, Homo sapiens
cuauguuauauuga

SEQ ID NO: 860048 - RNA, 22 nt, Homo sapiens
cuauguuuuuguucaaagccag

SEQ ID NO: 860049 - RNA, 18 nt, Homo sapiens
cuauuaaaguaacauuua

SEQ ID NO: 860050 - RNA, 20 nt, Homo sapiens
cuauucuuaagcacuuugaa

SEQ ID NO: 860051 - RNA, 21 nt, Homo sapiens
cuauuucuggcacuugcaagu

SEQ ID NO: 860052 - RNA, 13 nt, Homo sapiens
cucaccuccuaaa

SEQ ID NO: 860053 - RNA, 17 nt, Homo sapiens
cucacucuuucuucucu

SEQ ID NO: 860054 - RNA, 23 nt, Homo sapiens
cucagcaccugggacccaacaga

SEQ ID NO: 860055 - RNA, 18 nt, Homo sapiens
cucagucucugagcagug

SEQ ID NO: 860056 - RNA, 17 nt, Homo sapiens
cucauaugauugugcac

SEQ ID NO: 860057 - RNA, 20 nt, Homo sapiens
cucauccuuuuuaaaugaga

SEQ ID NO: 860058 - RNA, 19 nt, Homo sapiens
cucauucagggauagcacu

SEQ ID NO: 860059 - RNA, 21 nt, Homo sapiens
cucauuggacccuuccauggu

SEQ ID NO: 860060 - RNA, 23 nt, Homo sapiens
cuccacaauagcagacaguguuu

SEQ ID NO: 860061 - RNA, 19 nt, Homo sapiens
cucccaaauaaacuccuua

SEQ ID NO: 860062 - RNA, 14 nt, Homo sapiens
cuccccauggugca

SEQ ID NO: 860063 - RNA, 15 nt, Homo sapiens
cucccgaauccugag

SEQ ID NO: 860064 - RNA, 20 nt, Homo sapiens
cuccgucuaagucaugagcu

SEQ ID NO: 860065 - RNA, 14 nt, Homo sapiens
cuccugaagccaca

SEQ ID NO: 860066 - RNA, 15 nt, Homo sapiens
cuccuucaagcugcu

SEQ ID NO: 860067 - RNA, 21 nt, Homo sapiens
cucgaaauaauuuuuuaguua

SEQ ID NO: 860068 - RNA, 16 nt, Homo sapiens
cucgcccaggacuccc

SEQ ID NO: 860069 - RNA, 19 nt, Homo sapiens
cucgucuuccucucucuca

SEQ ID NO: 860070 - RNA, 20 nt, Homo sapiens
cucuaauuaaaaugugcagu

SEQ ID NO: 860071 - RNA, 16 nt, Homo sapiens
cucucaccuccuaaag

SEQ ID NO: 860072 - RNA, 21 nt, Homo sapiens
cucucaggcauggaugaauaa

SEQ ID NO: 860073 - RNA, 21 nt, Homo sapiens
cucucuuucuuccacuacccu

SEQ ID NO: 860074 - RNA, 18 nt, Homo sapiens
cucugacucagggcuccu

SEQ ID NO: 860075 - RNA, 13 nt, Homo sapiens
cucugaucccucu

SEQ ID NO: 860076 - RNA, 18 nt, Homo sapiens
auccaccgccacacuggc

SEQ ID NO: 860077 - RNA, 17 nt, Homo sapiens
auccaugaaccaagacc

SEQ ID NO: 860078 - RNA, 15 nt, Homo sapiens
aucccccagccucaa

SEQ ID NO: 860079 - RNA, 19 nt, Homo sapiens
aucccccagccucaagucu

SEQ ID NO: 860080 - RNA, 22 nt, Homo sapiens
auccucugagugugaccaggca

SEQ ID NO: 860081 - RNA, 21 nt, Homo sapiens
auccugguugguguugcagaa

SEQ ID NO: 860082 - RNA, 17 nt, Homo sapiens
aucggugcugucagccc

SEQ ID NO: 860083 - RNA, 15 nt, Homo sapiens
aucuaacaaagucaa

SEQ ID NO: 860084 - RNA, 22 nt, Homo sapiens
aucuaugaaauaucaugcucca

SEQ ID NO: 860085 - RNA, 16 nt, Homo sapiens
aucuaugauaugcuaa

SEQ ID NO: 860086 - RNA, 16 nt, Homo sapiens
aucugcugccaugaga

SEQ ID NO: 860087 - RNA, 17 nt, Homo sapiens
aucuuaagagaauccac

SEQ ID NO: 860088 - RNA, 17 nt, Homo sapiens
aucuuaguagagauuuc

SEQ ID NO: 860089 - RNA, 17 nt, Homo sapiens
augaaauaucaugcucc

SEQ ID NO: 860090 - RNA, 16 nt, Homo sapiens
augaaauguaaauacu

SEQ ID NO: 860091 - RNA, 16 nt, Homo sapiens
augaacucuuaaucaa

SEQ ID NO: 860092 - RNA, 13 nt, Homo sapiens
augaagcacaaaa

SEQ ID NO: 860093 - RNA, 17 nt, Homo sapiens
augaaugggagugaggg

SEQ ID NO: 860094 - RNA, 14 nt, Homo sapiens
augagaagccaaag

SEQ ID NO: 860095 - RNA, 17 nt, Homo sapiens
augagaccacuguuauc

SEQ ID NO: 860096 - RNA, 18 nt, Homo sapiens
augauccuaaugaaugca

SEQ ID NO: 860097 - RNA, 22 nt, Homo sapiens
augauccuaaugaaugcauaaa

SEQ ID NO: 860098 - RNA, 19 nt, Homo sapiens
augaugucguuugaaucac

SEQ ID NO: 860099 - RNA, 16 nt, Homo sapiens
augauuuuggccacuu

SEQ ID NO: 860100 - RNA, 17 nt, Homo sapiens
augcacuuucccuagaa

SEQ ID NO: 860101 - RNA, 14 nt, Homo sapiens
augcagcaucuaag

SEQ ID NO: 860102 - RNA, 21 nt, Homo sapiens
augcccagcuuggagugccac

SEQ ID NO: 860103 - RNA, 12 nt, Homo sapiens
augcggcuuccg

SEQ ID NO: 860104 - RNA, 15 nt, Homo sapiens
augcguuuaaucaca

SEQ ID NO: 860105 - RNA, 16 nt, Homo sapiens
augcguuuaaucacau

SEQ ID NO: 860106 - RNA, 16 nt, Homo sapiens
augcuuauaagcaaca

SEQ ID NO: 860107 - RNA, 18 nt, Homo sapiens
auggaauauaaauaucac

SEQ ID NO: 860108 - RNA, 19 nt, Homo sapiens
auggaauauaaauaucaca

SEQ ID NO: 860109 - RNA, 21 nt, Homo sapiens
auggaccacagugacuuauuu

SEQ ID NO: 860110 - RNA, 18 nt, Homo sapiens
auggaggaaagugauauc

SEQ ID NO: 860111 - RNA, 17 nt, Homo sapiens
auggcuacuaccggggc

SEQ ID NO: 860112 - RNA, 21 nt, Homo sapiens
auggcuacuaccggggcuccg

SEQ ID NO: 860113 - RNA, 17 nt, Homo sapiens
augggaaccccuucauc

SEQ ID NO: 860114 - RNA, 18 nt, Homo sapiens
auggggagaaaagacaug

SEQ ID NO: 860115 - RNA, 15 nt, Homo sapiens
auggguaacacugau

SEQ ID NO: 860116 - RNA, 17 nt, Homo sapiens
ccauagaggugagggaa

SEQ ID NO: 860117 - RNA, 12 nt, Homo sapiens
ccauauuuucac

SEQ ID NO: 860118 - RNA, 23 nt, Homo sapiens
ccaucccagcugaaauacugagg

SEQ ID NO: 860119 - RNA, 17 nt, Homo sapiens
ccaugagaaaagggaag

SEQ ID NO: 860120 - RNA, 13 nt, Homo sapiens
ccauggaggcaca

SEQ ID NO: 860121 - RNA, 19 nt, Homo sapiens
ccauggugcagugaagaaa

SEQ ID NO: 860122 - RNA, 14 nt, Homo sapiens
ccauuuaccuggaa

SEQ ID NO: 860123 - RNA, 21 nt, Homo sapiens
ccauuuggcaaugccaucauc

SEQ ID NO: 860124 - RNA, 14 nt, Homo sapiens
cccaauaauucugu

SEQ ID NO: 860125 - RNA, 16 nt, Homo sapiens
cccaauucacaucuaa

SEQ ID NO: 860126 - RNA, 20 nt, Homo sapiens
cccacgucccgggcacuguc

SEQ ID NO: 860127 - RNA, 22 nt, Homo sapiens
cccacgucccgggcacugucau

SEQ ID NO: 860128 - RNA, 21 nt, Homo sapiens
cccacguccugggugcuguca

SEQ ID NO: 860129 - RNA, 18 nt, Homo sapiens
cccagcuuggagugccac

SEQ ID NO: 860130 - RNA, 19 nt, Homo sapiens
cccaggcggucacugccca

SEQ ID NO: 860131 - RNA, 18 nt, Homo sapiens
cccagugggaucuuaccc

SEQ ID NO: 860132 - RNA, 17 nt, Homo sapiens
cccauaucugugcaaug

SEQ ID NO: 860133 - RNA, 23 nt, Homo sapiens
cccauggauguuucuucuuugac

SEQ ID NO: 860134 - RNA, 15 nt, Homo sapiens
cccauuuguguuuca

SEQ ID NO: 860135 - RNA, 14 nt, Homo sapiens
ccccaauccaugaa

SEQ ID NO: 860136 - RNA, 15 nt, Homo sapiens
ccccaggcauugcca

SEQ ID NO: 860137 - RNA, 20 nt, Homo sapiens
ccccaucugccacguguauu

SEQ ID NO: 860138 - RNA, 14 nt, Homo sapiens
ccccucucuuugag

SEQ ID NO: 860139 - RNA, 13 nt, Homo sapiens
cccgcaaugugcc

SEQ ID NO: 860140 - RNA, 23 nt, Homo sapiens
cccggggcgggcugaugucuucu

SEQ ID NO: 860141 - RNA, 13 nt, Homo sapiens
cccggguacucag

SEQ ID NO: 860142 - RNA, 17 nt, Homo sapiens
cccuaaaucuugacuac

SEQ ID NO: 860143 - RNA, 15 nt, Homo sapiens
cccuaugucccagcc

SEQ ID NO: 860144 - RNA, 13 nt, Homo sapiens
cccucagacuggg

SEQ ID NO: 860145 - RNA, 14 nt, Homo sapiens
cccuccacguucac

SEQ ID NO: 860146 - RNA, 18 nt, Homo sapiens
cccuccugaggucuggau

SEQ ID NO: 860147 - RNA, 23 nt, Homo sapiens
cccugagggacuuggcaguagaa

SEQ ID NO: 860148 - RNA, 13 nt, Homo sapiens
cccugcaccucau

SEQ ID NO: 860149 - RNA, 12 nt, Homo sapiens
cccugcauuuau

SEQ ID NO: 860150 - RNA, 20 nt, Homo sapiens
cccuggggagucugggcaca

SEQ ID NO: 860151 - RNA, 20 nt, Homo sapiens
cccuuggggcucccuguguc

SEQ ID NO: 860152 - RNA, 17 nt, Homo sapiens
cccuugugugagggcaa

SEQ ID NO: 860153 - RNA, 12 nt, Homo sapiens
cccuuuacauuu

SEQ ID NO: 860154 - RNA, 21 nt, Homo sapiens
cccuuuacauuuugugcagug

SEQ ID NO: 860155 - RNA, 20 nt, Homo sapiens
cccuuucugugugaagauca

SEQ ID NO: 860156 - RNA, 21 nt, Homo sapiens
ccggaaguugcugugccccau

SEQ ID NO: 860157 - RNA, 19 nt, Homo sapiens
ccggaugacacaaauacca

SEQ ID NO: 860158 - RNA, 20 nt, Homo sapiens
ccgggaagagggugauugcu

SEQ ID NO: 860159 - RNA, 19 nt, Homo sapiens
ccuagaaagccauauucca

SEQ ID NO: 860160 - RNA, 19 nt, Homo sapiens
ccuaguggggaggggccug

SEQ ID NO: 860161 - RNA, 18 nt, Homo sapiens
ccuaguuuguuagugcau

SEQ ID NO: 860162 - RNA, 17 nt, Homo sapiens
ccuauaccccucaucac

SEQ ID NO: 860163 - RNA, 18 nt, Homo sapiens
ccuauaccccucaucaca

SEQ ID NO: 860164 - RNA, 16 nt, Homo sapiens
ccuauggaaagggugu

SEQ ID NO: 860165 - RNA, 23 nt, Homo sapiens
ccuauguuuuuguucaaagccag

SEQ ID NO: 860166 - RNA, 18 nt, Homo sapiens
ccucaagccaggagaccc

SEQ ID NO: 860167 - RNA, 20 nt, Homo sapiens
ccucagcaccugggacccaa

SEQ ID NO: 860168 - RNA, 10 nt, Homo sapiens
ccucagggcu

SEQ ID NO: 860169 - RNA, 20 nt, Homo sapiens
ccucaguuuuaucauuuuca

SEQ ID NO: 860170 - RNA, 18 nt, Homo sapiens
ccucaucccgagcaccuc

SEQ ID NO: 860171 - RNA, 17 nt, Homo sapiens
ccucaugcucucuauag

SEQ ID NO: 860172 - RNA, 20 nt, Homo sapiens
ccucauuaccuugugcuaau

SEQ ID NO: 860173 - RNA, 16 nt, Homo sapiens
ccuccagaauggagcu

SEQ ID NO: 860174 - RNA, 15 nt, Homo sapiens
ccucccuggucccuu

SEQ ID NO: 860175 - RNA, 18 nt, Homo sapiens
ccuccugaagccacagca

SEQ ID NO: 860176 - RNA, 12 nt, Homo sapiens
ccucuccaagcu

SEQ ID NO: 860177 - RNA, 18 nt, Homo sapiens
ccucuuuccugugccagg

SEQ ID NO: 860178 - RNA, 12 nt, Homo sapiens
ccugaaaggaag

SEQ ID NO: 860179 - RNA, 19 nt, Homo sapiens
ccugaagcaacacugccag

SEQ ID NO: 860180 - RNA, 21 nt, Homo sapiens
ccugaaguaagcaaagacuuu

SEQ ID NO: 860181 - RNA, 18 nt, Homo sapiens
ccugacagaaggacucag

SEQ ID NO: 860182 - RNA, 16 nt, Homo sapiens
ccugaccagacugugg

SEQ ID NO: 860183 - RNA, 17 nt, Homo sapiens
ccugcaaaaggacucuc

SEQ ID NO: 860184 - RNA, 16 nt, Homo sapiens
ccugcaccucauucca

SEQ ID NO: 860185 - RNA, 21 nt, Homo sapiens
ccugcgaccacagcagggauu

SEQ ID NO: 860186 - RNA, 19 nt, Homo sapiens
ccugcggaguugugcacgu

SEQ ID NO: 860187 - RNA, 15 nt, Homo sapiens
ccuggaagcagggac

SEQ ID NO: 860188 - RNA, 18 nt, Homo sapiens
ccuggcaagugggugaaa

SEQ ID NO: 860189 - RNA, 16 nt, Homo sapiens
ccuggccccagugacc

SEQ ID NO: 860190 - RNA, 18 nt, Homo sapiens
ccugggagaugcagcugg

SEQ ID NO: 860191 - RNA, 19 nt, Homo sapiens
ccuggucccuuggagacaa

SEQ ID NO: 860192 - RNA, 13 nt, Homo sapiens
ccugugucagggc

SEQ ID NO: 860193 - RNA, 14 nt, Homo sapiens
ccuguucacucuac

SEQ ID NO: 860194 - RNA, 22 nt, Homo sapiens
ccuuacauuugaaaucuaugaa

SEQ ID NO: 860195 - RNA, 22 nt, Homo sapiens
ccuuagauguucuaagucuuuc

SEQ ID NO: 860196 - RNA, 23 nt, Homo sapiens
ccuuagauguucuaagucuuucc

SEQ ID NO: 860197 - RNA, 20 nt, Homo sapiens
ccuucaugguguucaugaca

SEQ ID NO: 860198 - RNA, 18 nt, Homo sapiens
ccuucauuuucuaauucu

SEQ ID NO: 860199 - RNA, 20 nt, Homo sapiens
ccuucuggggcuuugccauu

SEQ ID NO: 860200 - RNA, 22 nt, Homo sapiens
ccuugauggagauauuuacaug

SEQ ID NO: 860201 - RNA, 15 nt, Homo sapiens
ccuuucaugauuugc

SEQ ID NO: 860202 - RNA, 15 nt, Homo sapiens
ccuuucuuacauuag

SEQ ID NO: 860203 - RNA, 15 nt, Homo sapiens
ccuuugaaaugaaua

SEQ ID NO: 860204 - RNA, 16 nt, Homo sapiens
ccuuugaaaugaauau

SEQ ID NO: 860205 - RNA, 21 nt, Homo sapiens
ccuuuucuuguaaacauugcc

SEQ ID NO: 860206 - RNA, 21 nt, Homo sapiens
cgaacaauucauauauuugaa

SEQ ID NO: 860207 - RNA, 14 nt, Homo sapiens
cgagucucuucucc

SEQ ID NO: 860208 - RNA, 14 nt, Homo sapiens
cgauuucacugaca

SEQ ID NO: 860209 - RNA, 14 nt, Homo sapiens
cgccagcuccccca

SEQ ID NO: 860210 - RNA, 15 nt, Homo sapiens
cgccauggccgugua

SEQ ID NO: 860211 - RNA, 16 nt, Homo sapiens
cggagcgaguccccca

SEQ ID NO: 860212 - RNA, 15 nt, Homo sapiens
cggagguacccaggc

SEQ ID NO: 860213 - RNA, 15 nt, Homo sapiens
cggaugacacaaaua

SEQ ID NO: 860214 - RNA, 14 nt, Homo sapiens
cggccgcucgccca

SEQ ID NO: 860215 - RNA, 14 nt, Homo sapiens
cgggcacugucaug

SEQ ID NO: 860216 - RNA, 13 nt, Homo sapiens
cuuccacuaccuu

SEQ ID NO: 860217 - RNA, 12 nt, Homo sapiens
cuuccauggugg

SEQ ID NO: 860218 - RNA, 13 nt, Homo sapiens
cuuccaugguggu

SEQ ID NO: 860219 - RNA, 15 nt, Homo sapiens
cuuccucuccacugc

SEQ ID NO: 860220 - RNA, 22 nt, Homo sapiens
cuucgugugcagcuagagcuuu

SEQ ID NO: 860221 - RNA, 19 nt, Homo sapiens
cuucucaagcacugacacu

SEQ ID NO: 860222 - RNA, 17 nt, Homo sapiens
cuucuccccuccagacc

SEQ ID NO: 860223 - RNA, 19 nt, Homo sapiens
cuucucucccacacaagca

SEQ ID NO: 860224 - RNA, 16 nt, Homo sapiens
cuucucuucuauccug

SEQ ID NO: 860225 - RNA, 22 nt, Homo sapiens
cuucugauuucucuucagcuuu

SEQ ID NO: 860226 - RNA, 19 nt, Homo sapiens
cuucugcucacauucccuc

SEQ ID NO: 860227 - RNA, 13 nt, Homo sapiens
cuucugcuucuca

SEQ ID NO: 860228 - RNA, 21 nt, Homo sapiens
cuucuuaauauaacugccuua

SEQ ID NO: 860229 - RNA, 23 nt, Homo sapiens
cuugaaaagacaucaagcacaga

SEQ ID NO: 860230 - RNA, 14 nt, Homo sapiens
cuugacggcauugc

SEQ ID NO: 860231 - RNA, 20 nt, Homo sapiens
cuugagccaguaauuggucc

SEQ ID NO: 860232 - RNA, 18 nt, Homo sapiens
cuugaggaaaacaagcau

SEQ ID NO: 860233 - RNA, 12 nt, Homo sapiens
cuugcugccaaa

SEQ ID NO: 860234 - RNA, 16 nt, Homo sapiens
cuugcugcugagugca

SEQ ID NO: 860235 - RNA, 20 nt, Homo sapiens
cuuggagacaaaaucuuaaa

SEQ ID NO: 860236 - RNA, 14 nt, Homo sapiens
cuuggagugccaca

SEQ ID NO: 860237 - RNA, 21 nt, Homo sapiens
cuuggauaggagcuuccagau

SEQ ID NO: 860238 - RNA, 22 nt, Homo sapiens
cuugguggccgggggugggggc

SEQ ID NO: 860239 - RNA, 15 nt, Homo sapiens
cuugucacaaaguga

SEQ ID NO: 860240 - RNA, 19 nt, Homo sapiens
cuuguuuucuacuuugcca

SEQ ID NO: 860241 - RNA, 21 nt, Homo sapiens
cuuuacuaucuuuucaucuca

SEQ ID NO: 860242 - RNA, 11 nt, Homo sapiens
cuuuacuugac

SEQ ID NO: 860243 - RNA, 19 nt, Homo sapiens
cuuuauuugaauaacaagg

SEQ ID NO: 860244 - RNA, 21 nt, Homo sapiens
cuuuauuugaauaacaaggaa

SEQ ID NO: 860245 - RNA, 15 nt, Homo sapiens
cuuuccagccguguu

SEQ ID NO: 860246 - RNA, 15 nt, Homo sapiens
cuuucugucugugaa

SEQ ID NO: 860247 - RNA, 15 nt, Homo sapiens
cuuugaaauaugcau

SEQ ID NO: 860248 - RNA, 22 nt, Homo sapiens
cuuuggcacacccucucugucc

SEQ ID NO: 860249 - RNA, 17 nt, Homo sapiens
cuuuguaugcacuuugu

SEQ ID NO: 860250 - RNA, 23 nt, Homo sapiens
cuuuuaaguugcugaugaacucu

SEQ ID NO: 860251 - RNA, 21 nt, Homo sapiens
cuuuucaucucauuaauucaa

SEQ ID NO: 860252 - RNA, 20 nt, Homo sapiens
cuuuugcuggucacugccau

SEQ ID NO: 860253 - RNA, 23 nt, Homo sapiens
cuuuuguaaauauucuuguccac

SEQ ID NO: 860254 - RNA, 14 nt, Homo sapiens
gaaaacacugugca

SEQ ID NO: 860255 - RNA, 15 nt, Homo sapiens
gaaaacacugugcac

SEQ ID NO: 860256 - RNA, 22 nt, Homo sapiens
gaaaacaguaacuaagcacauu

SEQ ID NO: 860257 - RNA, 15 nt, Homo sapiens
gaaaacugcaacuug

SEQ ID NO: 860258 - RNA, 15 nt, Homo sapiens
gaaaagacugaccuu

SEQ ID NO: 860259 - RNA, 12 nt, Homo sapiens
gaaaagccaguu

SEQ ID NO: 860260 - RNA, 16 nt, Homo sapiens
gaaaaggcacgcuggc

SEQ ID NO: 860261 - RNA, 14 nt, Homo sapiens
gaaaauuauuugca

SEQ ID NO: 860262 - RNA, 23 nt, Homo sapiens
gaaacaacaauuucuacuuugaa

SEQ ID NO: 860263 - RNA, 13 nt, Homo sapiens
gaaacaacucuuu

SEQ ID NO: 860264 - RNA, 18 nt, Homo sapiens
gaaacacugggcuucuag

SEQ ID NO: 860265 - RNA, 18 nt, Homo sapiens
gaaaguaucaccaaaaaa

SEQ ID NO: 860266 - RNA, 17 nt, Homo sapiens
gaaauaacuuguguuac

SEQ ID NO: 860267 - RNA, 15 nt, Homo sapiens
gaaauaugcauguac

SEQ ID NO: 860268 - RNA, 15 nt, Homo sapiens
gaaaucagcaggacg

SEQ ID NO: 860269 - RNA, 22 nt, Homo sapiens
gaaauuaugaaaguuaauuuga

SEQ ID NO: 860270 - RNA, 15 nt, Homo sapiens
gaacauacuucaucg

SEQ ID NO: 860271 - RNA, 18 nt, Homo sapiens
gaaccaacgggucugugg

SEQ ID NO: 860272 - RNA, 18 nt, Homo sapiens
gaaccaggcaacuuggga

SEQ ID NO: 860273 - RNA, 15 nt, Homo sapiens
gaagaauggccauuu

SEQ ID NO: 860274 - RNA, 17 nt, Homo sapiens
gaagagaaugugacagg

SEQ ID NO: 860275 - RNA, 20 nt, Homo sapiens
gaagccacuauuacugggac

SEQ ID NO: 860276 - RNA, 18 nt, Homo sapiens
gaagucucuuuuucuucc

SEQ ID NO: 860277 - RNA, 15 nt, Homo sapiens
gaagugucuaaugca

SEQ ID NO: 860278 - RNA, 14 nt, Homo sapiens
gaauaauaccuaag

SEQ ID NO: 860279 - RNA, 15 nt, Homo sapiens
gaauaguaaguggug

SEQ ID NO: 860280 - RNA, 15 nt, Homo sapiens
gaauauaaauaucac

SEQ ID NO: 860281 - RNA, 16 nt, Homo sapiens
gaauaugauuaguaaa

SEQ ID NO: 860282 - RNA, 16 nt, Homo sapiens
gaaucaaaugcaauuu

SEQ ID NO: 860283 - RNA, 19 nt, Homo sapiens
gaaucccauggauguuucu

SEQ ID NO: 860284 - RNA, 17 nt, Homo sapiens
gaauggagcuggcccuc

SEQ ID NO: 860285 - RNA, 12 nt, Homo sapiens
gaauuugagugc

SEQ ID NO: 860286 - RNA, 17 nt, Homo sapiens
gacagcaagggcuugca

SEQ ID NO: 860287 - RNA, 20 nt, Homo sapiens
gacagcugcuucugugcauu

SEQ ID NO: 860288 - RNA, 21 nt, Homo sapiens
gacagcugcuucugugcauuu

SEQ ID NO: 860289 - RNA, 18 nt, Homo sapiens
gaccaauuagcauuccau

SEQ ID NO: 860290 - RNA, 15 nt, Homo sapiens
gaccaccuugcacua

SEQ ID NO: 860291 - RNA, 17 nt, Homo sapiens
gaccacuguuaucaaaa

SEQ ID NO: 860292 - RNA, 19 nt, Homo sapiens
gaccccagaggauugcugc

SEQ ID NO: 860293 - RNA, 23 nt, Homo sapiens
gacccccuccaccccccggccac

SEQ ID NO: 860294 - RNA, 18 nt, Homo sapiens
gaccuggggggggcaaga

SEQ ID NO: 860295 - RNA, 13 nt, Homo sapiens
gacgacccggggc

SEQ ID NO: 860296 - RNA, 16 nt, Homo sapiens
gacgacuguuuuccca

SEQ ID NO: 860297 - RNA, 14 nt, Homo sapiens
gacggaaguggccu

SEQ ID NO: 860298 - RNA, 22 nt, Homo sapiens
gacggcaguaaauccacaguga

SEQ ID NO: 860299 - RNA, 22 nt, Homo sapiens
gacuacucugccugaacacugc

SEQ ID NO: 860300 - RNA, 22 nt, Homo sapiens
gacuaugucacccaaugcauau

SEQ ID NO: 860301 - RNA, 14 nt, Homo sapiens
gacugcugagucaa

SEQ ID NO: 860302 - RNA, 13 nt, Homo sapiens
gacuguuuuccca

SEQ ID NO: 860303 - RNA, 13 nt, Homo sapiens
gacuucagacucu

SEQ ID NO: 860304 - RNA, 15 nt, Homo sapiens
gagaauaacacuggc

SEQ ID NO: 860305 - RNA, 21 nt, Homo sapiens
gagaccagcuucuagcagcua

SEQ ID NO: 860306 - RNA, 15 nt, Homo sapiens
gagacugcugaguca

SEQ ID NO: 860307 - RNA, 15 nt, Homo sapiens
gagagaguucucaca

SEQ ID NO: 860308 - RNA, 12 nt, Homo sapiens
gagagggggcca

SEQ ID NO: 860309 - RNA, 17 nt, Homo sapiens
gagauauuuuccauuuu

SEQ ID NO: 860310 - RNA, 15 nt, Homo sapiens
gagaucggccgccca

SEQ ID NO: 860311 - RNA, 18 nt, Homo sapiens
gagaugagaaacaacaga

SEQ ID NO: 860312 - RNA, 19 nt, Homo sapiens
gagauuucauagcuauuua

SEQ ID NO: 860313 - RNA, 15 nt, Homo sapiens
gagcagaacuuucac

SEQ ID NO: 860314 - RNA, 20 nt, Homo sapiens
gagcccccuguccuucccac

SEQ ID NO: 860315 - RNA, 12 nt, Homo sapiens
gagccuggacaa

SEQ ID NO: 860316 - RNA, 21 nt, Homo sapiens
gagccuuaaaacccacaaaag

SEQ ID NO: 860317 - RNA, 23 nt, Homo sapiens
gagccuuuccagaacuaccaaaa

SEQ ID NO: 860318 - RNA, 21 nt, Homo sapiens
gagcuucccugacucauucug

SEQ ID NO: 860319 - RNA, 14 nt, Homo sapiens
gaggcagaaccagc

SEQ ID NO: 860320 - RNA, 15 nt, Homo sapiens
gaggcagaauggugg

SEQ ID NO: 860321 - RNA, 19 nt, Homo sapiens
gaggcgugggauccagaga

SEQ ID NO: 860322 - RNA, 13 nt, Homo sapiens
gagggaagccuga

SEQ ID NO: 860323 - RNA, 23 nt, Homo sapiens
gagggauccaccgccacacuggc

SEQ ID NO: 860324 - RNA, 17 nt, Homo sapiens
gagggcaggguucuaga

SEQ ID NO: 860325 - RNA, 17 nt, Homo sapiens
gagguuugccagcauuu

SEQ ID NO: 860326 - RNA, 20 nt, Homo sapiens
gagugcaccacuucaaguga

SEQ ID NO: 860327 - RNA, 15 nt, Homo sapiens
gagugccaucccuga

SEQ ID NO: 860328 - RNA, 21 nt, Homo sapiens
gaguguuccccuuccacugag

SEQ ID NO: 860329 - RNA, 13 nt, Homo sapiens
gaguuuucagugg

SEQ ID NO: 860330 - RNA, 21 nt, Homo sapiens
gauaaagugccuauaaaggaa

SEQ ID NO: 860331 - RNA, 23 nt, Homo sapiens
gauacagacccacagagugccau

SEQ ID NO: 860332 - RNA, 22 nt, Homo sapiens
gauacuauuaaaguaacauuua

SEQ ID NO: 860333 - RNA, 17 nt, Homo sapiens
gauauucaaucuuaaca

SEQ ID NO: 860334 - RNA, 15 nt, Homo sapiens
gauauuuuccauuuu

SEQ ID NO: 860335 - RNA, 22 nt, Homo sapiens
gaucaugguuuagggugaucag

SEQ ID NO: 860336 - RNA, 15 nt, Homo sapiens
gauccagccauuccu

SEQ ID NO: 860337 - RNA, 22 nt, Homo sapiens
gaucucugcuuuggaaaucaca

SEQ ID NO: 860338 - RNA, 18 nt, Homo sapiens
gaucugagaagacaugaa

SEQ ID NO: 860339 - RNA, 18 nt, Homo sapiens
gaucugcagcucccagaa

SEQ ID NO: 860340 - RNA, 16 nt, Homo sapiens
gaugaaauugccaaaa

SEQ ID NO: 860341 - RNA, 16 nt, Homo sapiens
gaugccuucuccagac

SEQ ID NO: 860342 - RNA, 19 nt, Homo sapiens
gauggagaggcggguccca

SEQ ID NO: 860343 - RNA, 18 nt, Homo sapiens
gaugggaguaagagcaaa

SEQ ID NO: 860344 - RNA, 20 nt, Homo sapiens
gauggguuuuguuaggggug

SEQ ID NO: 860345 - RNA, 15 nt, Homo sapiens
gauuaucuagagaau

SEQ ID NO: 860346 - RNA, 13 nt, Homo sapiens
gauuauucagugu

SEQ ID NO: 860347 - RNA, 17 nt, Homo sapiens
gauucauggcuuuaaca

SEQ ID NO: 860348 - RNA, 14 nt, Homo sapiens
accaggucagggag

SEQ ID NO: 860349 - RNA, 13 nt, Homo sapiens
accauaauguuac

SEQ ID NO: 860350 - RNA, 22 nt, Homo sapiens
accaugagaccacuguuaucaa

SEQ ID NO: 860351 - RNA, 17 nt, Homo sapiens
accaugucguaguuacu

SEQ ID NO: 860352 - RNA, 18 nt, Homo sapiens
acccauaucugugcaaug

SEQ ID NO: 860353 - RNA, 16 nt, Homo sapiens
acccuaaaucuugacu

SEQ ID NO: 860354 - RNA, 21 nt, Homo sapiens
acccuauauguggcauuccuu

SEQ ID NO: 860355 - RNA, 22 nt, Homo sapiens
acccucugcuaugucugugaug

SEQ ID NO: 860356 - RNA, 23 nt, Homo sapiens
acccuugcgcuuuugcuggucac

SEQ ID NO: 860357 - RNA, 22 nt, Homo sapiens
acccuuuacauuuugugcagug

SEQ ID NO: 860358 - RNA, 21 nt, Homo sapiens
accgagucucuucuccacugg

SEQ ID NO: 860359 - RNA, 12 nt, Homo sapiens
accuaguacaag

SEQ ID NO: 860360 - RNA, 17 nt, Homo sapiens
accuaguagucauuuca

SEQ ID NO: 860361 - RNA, 18 nt, Homo sapiens
accuaguagucauuucau

SEQ ID NO: 860362 - RNA, 12 nt, Homo sapiens
accucaguuuua

SEQ ID NO: 860363 - RNA, 20 nt, Homo sapiens
accucuggcuagaggacaua

SEQ ID NO: 860364 - RNA, 19 nt, Homo sapiens
accugaaaacacugugcac

SEQ ID NO: 860365 - RNA, 22 nt, Homo sapiens
accugaaauaaaauucauuagu

SEQ ID NO: 860366 - RNA, 16 nt, Homo sapiens
accugagguugcuuua

SEQ ID NO: 860367 - RNA, 16 nt, Homo sapiens
accuguaaucauauaa

SEQ ID NO: 860368 - RNA, 20 nt, Homo sapiens
accuucuguggcucacagaa

SEQ ID NO: 860369 - RNA, 14 nt, Homo sapiens
accuuggcauccuu

SEQ ID NO: 860370 - RNA, 12 nt, Homo sapiens
accuugugagag

SEQ ID NO: 860371 - RNA, 18 nt, Homo sapiens
acgauuuugaacauacuu

SEQ ID NO: 860372 - RNA, 20 nt, Homo sapiens
acggagccacuccucugacu

SEQ ID NO: 860373 - RNA, 15 nt, Homo sapiens
acgucccgggcacug

SEQ ID NO: 860374 - RNA, 19 nt, Homo sapiens
acgucccgggcacugucau

SEQ ID NO: 860375 - RNA, 16 nt, Homo sapiens
acuaagcacauuaugu

SEQ ID NO: 860376 - RNA, 22 nt, Homo sapiens
acuaccacuuauuucuaaaucc

SEQ ID NO: 860377 - RNA, 15 nt, Homo sapiens
acuaccggggcuccg

SEQ ID NO: 860378 - RNA, 23 nt, Homo sapiens
acuaccuugguucccccacugau

SEQ ID NO: 860379 - RNA, 22 nt, Homo sapiens
acuaucuuuucaucucauuaau

SEQ ID NO: 860380 - RNA, 18 nt, Homo sapiens
acuauggcucuacuuuca

SEQ ID NO: 860381 - RNA, 20 nt, Homo sapiens
acuauuaaaguaacauuuaa

SEQ ID NO: 860382 - RNA, 18 nt, Homo sapiens
acuccaggcugucuuuca

SEQ ID NO: 860383 - RNA, 22 nt, Homo sapiens
uggcuagucugugccucaguga

SEQ ID NO: 860384 - RNA, 14 nt, Homo sapiens
uggcugccuuagaa

SEQ ID NO: 860385 - RNA, 20 nt, Homo sapiens
uggcuguagaaggagacaga

SEQ ID NO: 860386 - RNA, 13 nt, Homo sapiens
ugggaacuccuaa

SEQ ID NO: 860387 - RNA, 14 nt, Homo sapiens
ugggagugagggau

SEQ ID NO: 860388 - RNA, 21 nt, Homo sapiens
ugggauggggcauguggccaa

SEQ ID NO: 860389 - RNA, 13 nt, Homo sapiens
ugggcagagccca

SEQ ID NO: 860390 - RNA, 21 nt, Homo sapiens
ugggcagcuguuagaguccaa

SEQ ID NO: 860391 - RNA, 18 nt, Homo sapiens
ugggccaagccaggguuc

SEQ ID NO: 860392 - RNA, 17 nt, Homo sapiens
ugggcuagauaggauau

SEQ ID NO: 860393 - RNA, 13 nt, Homo sapiens
ugggcuucuagaa

SEQ ID NO: 860394 - RNA, 16 nt, Homo sapiens
uggggaagcuucuuaa

SEQ ID NO: 860395 - RNA, 23 nt, Homo sapiens
uggggacagagcagaacuuucac

SEQ ID NO: 860396 - RNA, 15 nt, Homo sapiens
uggggagaaaagaca

SEQ ID NO: 860397 - RNA, 16 nt, Homo sapiens
uggggagaaaagacau

SEQ ID NO: 860398 - RNA, 18 nt, Homo sapiens
uggggagaaaagacauga

SEQ ID NO: 860399 - RNA, 19 nt, Homo sapiens
uggggcuggguguguuuca

SEQ ID NO: 860400 - RNA, 21 nt, Homo sapiens
uggggucuuaggguacagccc

SEQ ID NO: 860401 - RNA, 16 nt, Homo sapiens
uggggugggcacauug

SEQ ID NO: 860402 - RNA, 19 nt, Homo sapiens
ugggucuucagggggccag

SEQ ID NO: 860403 - RNA, 15 nt, Homo sapiens
uggguuccagacaga

SEQ ID NO: 860404 - RNA, 22 nt, Homo sapiens
ugguauaaacguccuacuguau

SEQ ID NO: 860405 - RNA, 18 nt, Homo sapiens
ugguccaggcuugggcuc

SEQ ID NO: 860406 - RNA, 20 nt, Homo sapiens
ugguccuuagccccaucugc

SEQ ID NO: 860407 - RNA, 15 nt, Homo sapiens
ugguggagggccaca

SEQ ID NO: 860408 - RNA, 20 nt, Homo sapiens
ugguuaauaaguuucacuga

SEQ ID NO: 860409 - RNA, 15 nt, Homo sapiens
uguaaacugugcacc

SEQ ID NO: 860410 - RNA, 18 nt, Homo sapiens
uguaaauauucuugucca

SEQ ID NO: 860411 - RNA, 19 nt, Homo sapiens
uguaccagggcucuguauu

SEQ ID NO: 860412 - RNA, 15 nt, Homo sapiens
uguaccgagaacugg

SEQ ID NO: 860413 - RNA, 14 nt, Homo sapiens
uguaccugugcacg

SEQ ID NO: 860414 - RNA, 16 nt, Homo sapiens
uguaucaaaugugaca

SEQ ID NO: 860415 - RNA, 20 nt, Homo sapiens
uguauuaacugaauucugaa

SEQ ID NO: 860416 - RNA, 16 nt, Homo sapiens
uguauucugcaacagc

SEQ ID NO: 860417 - RNA, 19 nt, Homo sapiens
uguauucugcaacagccug

SEQ ID NO: 860418 - RNA, 15 nt, Homo sapiens
uguauuuaacugccu

SEQ ID NO: 860419 - RNA, 15 nt, Homo sapiens
ugucaaaaaccagaa

SEQ ID NO: 860420 - RNA, 15 nt, Homo sapiens
ugucacccaaugcau

SEQ ID NO: 860421 - RNA, 21 nt, Homo sapiens
ugucaucucagcuggaucucc

SEQ ID NO: 860422 - RNA, 13 nt, Homo sapiens
uguccacaucuaa

SEQ ID NO: 860423 - RNA, 17 nt, Homo sapiens
uguccaggcacugagau

SEQ ID NO: 860424 - RNA, 12 nt, Homo sapiens
ugucucauauga

SEQ ID NO: 860425 - RNA, 20 nt, Homo sapiens
ugugaaaguuacaaauugcu

SEQ ID NO: 860426 - RNA, 22 nt, Homo sapiens
ugugacauuauaugcacuagca

SEQ ID NO: 860427 - RNA, 21 nt, Homo sapiens
ugugaccaaugucuugaugca

SEQ ID NO: 860428 - RNA, 19 nt, Homo sapiens
ugugacggggguuggggug

SEQ ID NO: 860429 - RNA, 20 nt, Homo sapiens
ugugaugccugacacagggg

SEQ ID NO: 860430 - RNA, 17 nt, Homo sapiens
ugugauucacaguguga

SEQ ID NO: 860431 - RNA, 16 nt, Homo sapiens
ugugccuuacauuauu

SEQ ID NO: 860432 - RNA, 18 nt, Homo sapiens
uguggggugggcacauug

SEQ ID NO: 860433 - RNA, 15 nt, Homo sapiens
ugugguuaccgagua

SEQ ID NO: 860434 - RNA, 12 nt, Homo sapiens
ugugugaucugu

SEQ ID NO: 860435 - RNA, 20 nt, Homo sapiens
uguuaccugaaaacacugug

SEQ ID NO: 860436 - RNA, 14 nt, Homo sapiens
uguuaucaguauua

SEQ ID NO: 860437 - RNA, 20 nt, Homo sapiens
uguuaucagucauaacuaaa

SEQ ID NO: 860438 - RNA, 20 nt, Homo sapiens
uguuauuuuauugccuuuag

SEQ ID NO: 860439 - RNA, 13 nt, Homo sapiens
uguucagaugcuu

SEQ ID NO: 860440 - RNA, 18 nt, Homo sapiens
uguuccccuuccacugag

SEQ ID NO: 860441 - RNA, 15 nt, Homo sapiens
uguucccuauuuugc

SEQ ID NO: 860442 - RNA, 13 nt, Homo sapiens
uguugacauccaa

SEQ ID NO: 860443 - RNA, 20 nt, Homo sapiens
uguuucaauugcaucuccca

SEQ ID NO: 860444 - RNA, 14 nt, Homo sapiens
uguuucugaucuga

SEQ ID NO: 860445 - RNA, 19 nt, Homo sapiens
uguuuuuuuuuuccacuua

SEQ ID NO: 860446 - RNA, 18 nt, Homo sapiens
uuaaaaaaaaacauucaa

SEQ ID NO: 860447 - RNA, 11 nt, Homo sapiens
uuaaaaccauu

SEQ ID NO: 860448 - RNA, 13 nt, Homo sapiens
uuaaaaucuguca

SEQ ID NO: 860449 - RNA, 21 nt, Homo sapiens
uuaaacccuauugguaaagaa

SEQ ID NO: 860450 - RNA, 18 nt, Homo sapiens
uuaaacuuaccugggcau

SEQ ID NO: 860451 - RNA, 19 nt, Homo sapiens
uuaaagcugaaaacugcaa

SEQ ID NO: 860452 - RNA, 12 nt, Homo sapiens
uuaaauaguaaa

SEQ ID NO: 860453 - RNA, 21 nt, Homo sapiens
uuaaaucaacgaguacuucaa

SEQ ID NO: 860454 - RNA, 12 nt, Homo sapiens
uuaagaauucca

SEQ ID NO: 860455 - RNA, 23 nt, Homo sapiens
ucuccagcccuauggaagucuca

SEQ ID NO: 860456 - RNA, 23 nt, Homo sapiens
ucucccuacuuagacccagucau

SEQ ID NO: 860457 - RNA, 12 nt, Homo sapiens
ucucucucaccu

SEQ ID NO: 860458 - RNA, 12 nt, Homo sapiens
ucucugcucugc

SEQ ID NO: 860459 - RNA, 13 nt, Homo sapiens
ucucuucuauccu

SEQ ID NO: 860460 - RNA, 15 nt, Homo sapiens
ucugaagucacugca

SEQ ID NO: 860461 - RNA, 23 nt, Homo sapiens
ucugagcagugaaugauucagug

SEQ ID NO: 860462 - RNA, 14 nt, Homo sapiens
ucugauacagccuu

SEQ ID NO: 860463 - RNA, 16 nt, Homo sapiens
ucugaucugaugcaag

SEQ ID NO: 860464 - RNA, 13 nt, Homo sapiens
ucugaugcaagca

SEQ ID NO: 860465 - RNA, 14 nt, Homo sapiens
ucugcaacagccug

SEQ ID NO: 860466 - RNA, 22 nt, Homo sapiens
ucugccgugagagcccaaucac

SEQ ID NO: 860467 - RNA, 16 nt, Homo sapiens
ucugccugaacacugc

SEQ ID NO: 860468 - RNA, 14 nt, Homo sapiens
ucugcucaucauuc

SEQ ID NO: 860469 - RNA, 18 nt, Homo sapiens
ucugcucaucauucucug

SEQ ID NO: 860470 - RNA, 16 nt, Homo sapiens
ucuggagucugaagga

SEQ ID NO: 860471 - RNA, 18 nt, Homo sapiens
ucuggagugugugggggu

SEQ ID NO: 860472 - RNA, 20 nt, Homo sapiens
ucuggcccuguugugggggu

SEQ ID NO: 860473 - RNA, 18 nt, Homo sapiens
ucugggccaagucaaaga

SEQ ID NO: 860474 - RNA, 17 nt, Homo sapiens
ucuguggcacucagaua

SEQ ID NO: 860475 - RNA, 16 nt, Homo sapiens
ucuuaagcacuuugaa

SEQ ID NO: 860476 - RNA, 22 nt, Homo sapiens
ucuuaaguuguggagagugcaa

SEQ ID NO: 860477 - RNA, 15 nt, Homo sapiens
ucuuacauuagcagu

SEQ ID NO: 860478 - RNA, 16 nt, Homo sapiens
ucuuagucgagccaag

SEQ ID NO: 860479 - RNA, 18 nt, Homo sapiens
ucuucacucaaucucuga

SEQ ID NO: 860480 - RNA, 13 nt, Homo sapiens
ucuucagcuuuga

SEQ ID NO: 860481 - RNA, 16 nt, Homo sapiens
ucuucauaauuucuuc

SEQ ID NO: 860482 - RNA, 17 nt, Homo sapiens
ucuuccauuugcaaggg

SEQ ID NO: 860483 - RNA, 23 nt, Homo sapiens
ucuucucaagcacugacacucau

SEQ ID NO: 860484 - RNA, 14 nt, Homo sapiens
ucuucuccacugga

SEQ ID NO: 860485 - RNA, 19 nt, Homo sapiens
ucuugacuacagucaggaa

SEQ ID NO: 860486 - RNA, 17 nt, Homo sapiens
ucuugaugcaugcacug

SEQ ID NO: 860487 - RNA, 13 nt, Homo sapiens
ucuuggauuggua

SEQ ID NO: 860488 - RNA, 18 nt, Homo sapiens
ucuuggggugcagcacuu

SEQ ID NO: 860489 - RNA, 22 nt, Homo sapiens
ucuuguuucaauuccaccugca

SEQ ID NO: 860490 - RNA, 13 nt, Homo sapiens
ucuuuaaacuaua

SEQ ID NO: 860491 - RNA, 14 nt, Homo sapiens
ucuuucccaauuca

SEQ ID NO: 860492 - RNA, 20 nt, Homo sapiens
ucuuucuaaucuuuuuccag

SEQ ID NO: 860493 - RNA, 21 nt, Homo sapiens
ucuuuguaagaguggaaccaa

SEQ ID NO: 860494 - RNA, 17 nt, Homo sapiens
ucuuuuaagcccaucaa

SEQ ID NO: 860495 - RNA, 16 nt, Homo sapiens
ugaaauaucaugcucc

SEQ ID NO: 860496 - RNA, 19 nt, Homo sapiens
ugaaccaugugacuguauu

SEQ ID NO: 860497 - RNA, 18 nt, Homo sapiens
ugaagccuauguaugcca

SEQ ID NO: 860498 - RNA, 23 nt, Homo sapiens
ugaagucaugcguuuaaucacau

SEQ ID NO: 860499 - RNA, 23 nt, Homo sapiens
ugaagucucuuuuucuuccucuc

SEQ ID NO: 860500 - RNA, 23 nt, Homo sapiens
ugaauacacgagguaugaggucu

SEQ ID NO: 860501 - RNA, 20 nt, Homo sapiens
ugaauaugaacggugagcau

SEQ ID NO: 860502 - RNA, 17 nt, Homo sapiens
ugaauaugauuaguaaa

SEQ ID NO: 860503 - RNA, 23 nt, Homo sapiens
ugaauaugauuaguaaagaaaug

SEQ ID NO: 860504 - RNA, 23 nt, Homo sapiens
ugaauuucuagacaguauugcca

SEQ ID NO: 860505 - RNA, 16 nt, Homo sapiens
ugaauuuugaaccaug

SEQ ID NO: 860506 - RNA, 18 nt, Homo sapiens
ugacacaggggacacuga

SEQ ID NO: 860507 - RNA, 12 nt, Homo sapiens
ugacagaucucu

SEQ ID NO: 860508 - RNA, 16 nt, Homo sapiens
ugacaggcuuucccag

SEQ ID NO: 860509 - RNA, 14 nt, Homo sapiens
ugacauccaagcuu

SEQ ID NO: 860510 - RNA, 15 nt, Homo sapiens
ugacauuauaugcac

SEQ ID NO: 860511 - RNA, 17 nt, Homo sapiens
ugacauuauaugcacua

SEQ ID NO: 860512 - RNA, 16 nt, Homo sapiens
ugacccagucagaguu

SEQ ID NO: 860513 - RNA, 12 nt, Homo sapiens
ugacccugugau

SEQ ID NO: 860514 - RNA, 17 nt, Homo sapiens
ugagaccacuguuauca

SEQ ID NO: 860515 - RNA, 18 nt, Homo sapiens
ugagccguugcuaaugcc

SEQ ID NO: 860516 - RNA, 12 nt, Homo sapiens
ugagcuuuccag

SEQ ID NO: 860517 - RNA, 13 nt, Homo sapiens
ugaggaaaauuaa

SEQ ID NO: 860518 - RNA, 18 nt, Homo sapiens
ugaggaaaauuaauauca

SEQ ID NO: 860519 - RNA, 15 nt, Homo sapiens
ugaggaacccuuaca

SEQ ID NO: 860520 - RNA, 17 nt, Homo sapiens
ugaggcaaccacaggca

SEQ ID NO: 860521 - RNA, 16 nt, Homo sapiens
ugaggcgugggaucca

SEQ ID NO: 860522 - RNA, 21 nt, Homo sapiens
ugaguauucauuuugcaacuu

SEQ ID NO: 860523 - RNA, 14 nt, Homo sapiens
ugagucugugccac

SEQ ID NO: 860524 - RNA, 12 nt, Homo sapiens
ugauauugcagc

SEQ ID NO: 860525 - RNA, 12 nt, Homo sapiens
ugaucugaugca

SEQ ID NO: 860526 - RNA, 20 nt, Homo sapiens
ugaugcaagcaagaaacacu

SEQ ID NO: 860527 - RNA, 21 nt, Homo sapiens
ugauggagauauuuacaugaa

SEQ ID NO: 860528 - RNA, 20 nt, Homo sapiens
ugauuaguaaagaaaugaca

SEQ ID NO: 860529 - RNA, 14 nt, Homo sapiens
ggcuccacuguaaa

SEQ ID NO: 860530 - RNA, 21 nt, Homo sapiens
ggcuccauucccaucacugcu

SEQ ID NO: 860531 - RNA, 13 nt, Homo sapiens
ggcuugcugccaa

SEQ ID NO: 860532 - RNA, 18 nt, Homo sapiens
gggagguauucgugcagc

SEQ ID NO: 860533 - RNA, 13 nt, Homo sapiens
gggagugggagag

SEQ ID NO: 860534 - RNA, 23 nt, Homo sapiens
gggauaaguaaguuugauuucau

SEQ ID NO: 860535 - RNA, 11 nt, Homo sapiens
gggcacuguca

SEQ ID NO: 860536 - RNA, 12 nt, Homo sapiens
gggcacugucau

SEQ ID NO: 860537 - RNA, 17 nt, Homo sapiens
gggcacugucaugccca

SEQ ID NO: 860538 - RNA, 18 nt, Homo sapiens
gggcagccugugggagaa

SEQ ID NO: 860539 - RNA, 15 nt, Homo sapiens
gggcugcccuggugc

SEQ ID NO: 860540 - RNA, 17 nt, Homo sapiens
gggcuggguguguuuca

SEQ ID NO: 860541 - RNA, 15 nt, Homo sapiens
ggggagaauggcucu

SEQ ID NO: 860542 - RNA, 16 nt, Homo sapiens
ggggcauguggccaag

SEQ ID NO: 860543 - RNA, 10 nt, Homo sapiens
ggggccacag

SEQ ID NO: 860544 - RNA, 16 nt, Homo sapiens
ggggccaggugcacag

SEQ ID NO: 860545 - RNA, 13 nt, Homo sapiens
ggggcuguccaau

SEQ ID NO: 860546 - RNA, 13 nt, Homo sapiens
gggggcaagagcu

SEQ ID NO: 860547 - RNA, 16 nt, Homo sapiens
gggggccacagcagcg

SEQ ID NO: 860548 - RNA, 19 nt, Homo sapiens
gggucagagaggagucaga

SEQ ID NO: 860549 - RNA, 18 nt, Homo sapiens
gggugcugucaugcccag

SEQ ID NO: 860550 - RNA, 20 nt, Homo sapiens
gguacugugaggaagagcag

SEQ ID NO: 860551 - RNA, 12 nt, Homo sapiens
ggucacugccca

SEQ ID NO: 860552 - RNA, 23 nt, Homo sapiens
ggucaucgugacagcagcagcuc

SEQ ID NO: 860553 - RNA, 15 nt, Homo sapiens
ggugcccagucuuga

SEQ ID NO: 860554 - RNA, 15 nt, Homo sapiens
ggugcugucaugccc

SEQ ID NO: 860555 - RNA, 11 nt, Homo sapiens
gguggggcuua

SEQ ID NO: 860556 - RNA, 15 nt, Homo sapiens
gguggggcuuggaag

SEQ ID NO: 860557 - RNA, 20 nt, Homo sapiens
gguguguucguggagccaca

SEQ ID NO: 860558 - RNA, 19 nt, Homo sapiens
gguucaccaggucagggag

SEQ ID NO: 860559 - RNA, 15 nt, Homo sapiens
gguuccggaauccug

SEQ ID NO: 860560 - RNA, 22 nt, Homo sapiens
gguuucuaacccacccucacga

SEQ ID NO: 860561 - RNA, 18 nt, Homo sapiens
gguuuguuaggaggccac

SEQ ID NO: 860562 - RNA, 22 nt, Homo sapiens
guaaagccucagcaacagccag

SEQ ID NO: 860563 - RNA, 17 nt, Homo sapiens
guaagaacaccugacaa

SEQ ID NO: 860564 - RNA, 18 nt, Homo sapiens
guaaggacuugugccucu

SEQ ID NO: 860565 - RNA, 15 nt, Homo sapiens
guaaggugagggaau

SEQ ID NO: 860566 - RNA, 13 nt, Homo sapiens
guaccugugcacg

SEQ ID NO: 860567 - RNA, 15 nt, Homo sapiens
guaccuuucugacaa

SEQ ID NO: 860568 - RNA, 21 nt, Homo sapiens
guacuaauacagacuauguca

SEQ ID NO: 860569 - RNA, 16 nt, Homo sapiens
guaggugggucuugga

SEQ ID NO: 860570 - RNA, 15 nt, Homo sapiens
guauauucauuucaa

SEQ ID NO: 860571 - RNA, 21 nt, Homo sapiens
guauguuugggagacugcuga

SEQ ID NO: 860572 - RNA, 15 nt, Homo sapiens
guauuaccuauucaa

SEQ ID NO: 860573 - RNA, 12 nt, Homo sapiens
guauucuaugua

SEQ ID NO: 860574 - RNA, 18 nt, Homo sapiens
guauuuuuucacuuguac

SEQ ID NO: 860575 - RNA, 14 nt, Homo sapiens
gucagauuagggcg

SEQ ID NO: 860576 - RNA, 23 nt, Homo sapiens
gucagcagggggguuggguucca

SEQ ID NO: 860577 - RNA, 13 nt, Homo sapiens
gucagcccagugg

SEQ ID NO: 860578 - RNA, 18 nt, Homo sapiens
gucagcccugcugucaga

SEQ ID NO: 860579 - RNA, 18 nt, Homo sapiens
gucaugcguuuaaucaca

SEQ ID NO: 860580 - RNA, 13 nt, Homo sapiens
gucauucucaccu

SEQ ID NO: 860581 - RNA, 23 nt, Homo sapiens
guccauuuaccuggaaaccagaa

SEQ ID NO: 860582 - RNA, 11 nt, Homo sapiens
gucccaccagg

SEQ ID NO: 860583 - RNA, 18 nt, Homo sapiens
gucccgggcacugucaug

SEQ ID NO: 860584 - RNA, 12 nt, Homo sapiens
uauaaauaucac

SEQ ID NO: 860585 - RNA, 18 nt, Homo sapiens
uauaacuauguugauaaa

SEQ ID NO: 860586 - RNA, 22 nt, Homo sapiens
uauacaaugaguaaaaucacag

SEQ ID NO: 860587 - RNA, 18 nt, Homo sapiens
uauauauuuuugugcaca

SEQ ID NO: 860588 - RNA, 13 nt, Homo sapiens
uauauucauuuca

SEQ ID NO: 860589 - RNA, 12 nt, Homo sapiens
uaucaccaaaaa

SEQ ID NO: 860590 - RNA, 14 nt, Homo sapiens
uauccaacaugugc

SEQ ID NO: 860591 - RNA, 18 nt, Homo sapiens
uauccagaugaacugaga

SEQ ID NO: 860592 - RNA, 18 nt, Homo sapiens
uaucccagagaacaauca

SEQ ID NO: 860593 - RNA, 21 nt, Homo sapiens
uaucuauggcacccaugcacc

SEQ ID NO: 860594 - RNA, 16 nt, Homo sapiens
uaucucaaacuacugg

SEQ ID NO: 860595 - RNA, 21 nt, Homo sapiens
uaugccauggaggcacuaaca

SEQ ID NO: 860596 - RNA, 17 nt, Homo sapiens
uaugccggcuccuucaa

SEQ ID NO: 860597 - RNA, 13 nt, Homo sapiens
uauggaaagggug

SEQ ID NO: 860598 - RNA, 16 nt, Homo sapiens
uauggcacccaugcac

SEQ ID NO: 860599 - RNA, 13 nt, Homo sapiens
uauguaacaugua

SEQ ID NO: 860600 - RNA, 16 nt, Homo sapiens
uauguaugccuauuca

SEQ ID NO: 860601 - RNA, 19 nt, Homo sapiens
uaugucacccaaugcauau

SEQ ID NO: 860602 - RNA, 13 nt, Homo sapiens
uauuaccuauuca

SEQ ID NO: 860603 - RNA, 17 nt, Homo sapiens
uauuacuccuugccauu

SEQ ID NO: 860604 - RNA, 15 nt, Homo sapiens
uauucuucauaacaa

SEQ ID NO: 860605 - RNA, 15 nt, Homo sapiens
uauugcagcuuauau

SEQ ID NO: 860606 - RNA, 21 nt, Homo sapiens
uauugccuuuagaaacugagu

SEQ ID NO: 860607 - RNA, 21 nt, Homo sapiens
uauuuauagucgaacaauuca

SEQ ID NO: 860608 - RNA, 16 nt, Homo sapiens
uauuuuuaagacuuuu

SEQ ID NO: 860609 - RNA, 21 nt, Homo sapiens
ucaaaaacauggccacaucca

SEQ ID NO: 860610 - RNA, 10 nt, Homo sapiens
ucaaagccag

SEQ ID NO: 860611 - RNA, 21 nt, Homo sapiens
ucaaaguccaacuacagccaa

SEQ ID NO: 860612 - RNA, 14 nt, Homo sapiens
ucaaauagcauaag

SEQ ID NO: 860613 - RNA, 22 nt, Homo sapiens
ucaaaucuuaagagaauccaca

SEQ ID NO: 860614 - RNA, 23 nt, Homo sapiens
ucaacaagaguaaauauugucac

SEQ ID NO: 860615 - RNA, 22 nt, Homo sapiens
ucaacagcauuuucaagcaguu

SEQ ID NO: 860616 - RNA, 16 nt, Homo sapiens
ucaagaagaagaugga

SEQ ID NO: 860617 - RNA, 19 nt, Homo sapiens
ucaaguccuacaagcuaaa

SEQ ID NO: 860618 - RNA, 22 nt, Homo sapiens
ucaaguuggcuucuaaucaaag

SEQ ID NO: 860619 - RNA, 20 nt, Homo sapiens
ucaauacccuuggcacugau

SEQ ID NO: 860620 - RNA, 13 nt, Homo sapiens
ucaauaggcaaag

SEQ ID NO: 860621 - RNA, 12 nt, Homo sapiens
ucaaugcuauaa

SEQ ID NO: 860622 - RNA, 19 nt, Homo sapiens
ucaauucugauacagccuu

SEQ ID NO: 860623 - RNA, 18 nt, Homo sapiens
ucacaacacaaucaaaag

SEQ ID NO: 860624 - RNA, 20 nt, Homo sapiens
ucacaacacaaucaaaagau

SEQ ID NO: 860625 - RNA, 13 nt, Homo sapiens
ucacaacacugaa

SEQ ID NO: 860626 - RNA, 23 nt, Homo sapiens
ucacacugcugggaaguggcuua

SEQ ID NO: 860627 - RNA, 21 nt, Homo sapiens
ucacagagauaauucuagcuu

SEQ ID NO: 860628 - RNA, 17 nt, Homo sapiens
ucacaugucaguaccuu

SEQ ID NO: 860629 - RNA, 11 nt, Homo sapiens
ucacauucccu

SEQ ID NO: 860630 - RNA, 16 nt, Homo sapiens
ucaccaggucagggag

SEQ ID NO: 860631 - RNA, 20 nt, Homo sapiens
ucaccauuuggcaaugccau

SEQ ID NO: 860632 - RNA, 21 nt, Homo sapiens
ucacuauucuuaagcacuuug

SEQ ID NO: 860633 - RNA, 18 nt, Homo sapiens
ucacugcuggcugccuua

SEQ ID NO: 860634 - RNA, 17 nt, Homo sapiens
ucagaguggccaauccc

SEQ ID NO: 860635 - RNA, 15 nt, Homo sapiens
ucagaguugugcaca

SEQ ID NO: 860636 - RNA, 14 nt, Homo sapiens
ucagcaacaugaua

SEQ ID NO: 860637 - RNA, 15 nt, Homo sapiens
ucagcaacaugauac

SEQ ID NO: 860638 - RNA, 18 nt, Homo sapiens
ucagcauucucacuccua

SEQ ID NO: 860639 - RNA, 15 nt, Homo sapiens
ucagcuggaucucca

SEQ ID NO: 860640 - RNA, 20 nt, Homo sapiens
ucaggaaggaugagcauuua

SEQ ID NO: 860641 - RNA, 20 nt, Homo sapiens
ucaggaaugggccaagccag

SEQ ID NO: 860642 - RNA, 23 nt, Homo sapiens
ucagggauagcacugagcaaagc

SEQ ID NO: 860643 - RNA, 16 nt, Homo sapiens
ucaguagugccuguga

SEQ ID NO: 860644 - RNA, 13 nt, Homo sapiens
ucagucucugagc

SEQ ID NO: 860645 - RNA, 15 nt, Homo sapiens
ucagugugcaaagaa

SEQ ID NO: 860646 - RNA, 15 nt, Homo sapiens
ucaguguuaaaugug

SEQ ID NO: 860647 - RNA, 22 nt, Homo sapiens
ucauaugauugugcacauacuu

SEQ ID NO: 860648 - RNA, 16 nt, Homo sapiens
ucaucaccagacuuug

SEQ ID NO: 860649 - RNA, 16 nt, Homo sapiens
ucaucaugugugucca

SEQ ID NO: 860650 - RNA, 18 nt, Homo sapiens
ucaucauucucugucuca

SEQ ID NO: 860651 - RNA, 21 nt, Homo sapiens
ucaucccgagcaccuccacau

SEQ ID NO: 860652 - RNA, 21 nt, Homo sapiens
ucaugagccguugcuaaugcc

SEQ ID NO: 860653 - RNA, 21 nt, Homo sapiens
ucaugguguucaugacaagug

SEQ ID NO: 860654 - RNA, 17 nt, Homo sapiens
ucauguaaacugugcac

SEQ ID NO: 860655 - RNA, 23 nt, Homo sapiens
ucauguguguccacgacugucuc

SEQ ID NO: 860656 - RNA, 12 nt, Homo sapiens
ucauucagggau

SEQ ID NO: 860657 - RNA, 18 nt, Homo sapiens
ucauucuuucugcuauau

SEQ ID NO: 860658 - RNA, 14 nt, Homo sapiens
ucauuucaaaggga

SEQ ID NO: 860659 - RNA, 14 nt, Homo sapiens
uccaacaugugcuc

SEQ ID NO: 860660 - RNA, 17 nt, Homo sapiens
gauguuuuacuuuucac

SEQ ID NO: 860661 - RNA, 21 nt, Homo sapiens
gauuaccuaguagucauuuca

SEQ ID NO: 860662 - RNA, 20 nt, Homo sapiens
gauuaucuuguacagccuuu

SEQ ID NO: 860663 - RNA, 14 nt, Homo sapiens
gauucaguguuaaa

SEQ ID NO: 860664 - RNA, 19 nt, Homo sapiens
gauugauagaguguuauca

SEQ ID NO: 860665 - RNA, 15 nt, Homo sapiens
gauugccauuucuuc

SEQ ID NO: 860666 - RNA, 18 nt, Homo sapiens
gauuggcaggaguuggaa

SEQ ID NO: 860667 - RNA, 15 nt, Homo sapiens
gauuucacugacacu

SEQ ID NO: 860668 - RNA, 23 nt, Homo sapiens
gauuugagggacgaggucaagga

SEQ ID NO: 860669 - RNA, 19 nt, Homo sapiens
gcaaaauacaugacauuua

SEQ ID NO: 860670 - RNA, 22 nt, Homo sapiens
gcaaacagggcuuuacuaucuu

SEQ ID NO: 860671 - RNA, 19 nt, Homo sapiens
gcaagaagugggauucagg

SEQ ID NO: 860672 - RNA, 14 nt, Homo sapiens
gcaagagacuacuc

SEQ ID NO: 860673 - RNA, 14 nt, Homo sapiens
gcaagccacagaaa

SEQ ID NO: 860674 - RNA, 23 nt, Homo sapiens
gcaaucaaguccuacaagcuaaa

SEQ ID NO: 860675 - RNA, 23 nt, Homo sapiens
gcaaugugcccccagacgcacgu

SEQ ID NO: 860676 - RNA, 16 nt, Homo sapiens
gcaauucuucuucuca

SEQ ID NO: 860677 - RNA, 22 nt, Homo sapiens
gcacccucugcuaugucuguga

SEQ ID NO: 860678 - RNA, 14 nt, Homo sapiens
gcacccuugcgcuu

SEQ ID NO: 860679 - RNA, 13 nt, Homo sapiens
gcacugacacuca

SEQ ID NO: 860680 - RNA, 15 nt, Homo sapiens
gcacugucaugccca

SEQ ID NO: 860681 - RNA, 22 nt, Homo sapiens
gcagaacagcuucauguuccca

SEQ ID NO: 860682 - RNA, 21 nt, Homo sapiens
gcagaccacugauaaaaccau

SEQ ID NO: 860683 - RNA, 20 nt, Homo sapiens
gcagagauugggggggcuug

SEQ ID NO: 860684 - RNA, 21 nt, Homo sapiens
gcagccccuccccauggugca

SEQ ID NO: 860685 - RNA, 22 nt, Homo sapiens
gcagccugugggagaagggaca

SEQ ID NO: 860686 - RNA, 14 nt, Homo sapiens
gcaggacacugcag

SEQ ID NO: 860687 - RNA, 22 nt, Homo sapiens
gcaggugggguuuucacuuccu

SEQ ID NO: 860688 - RNA, 14 nt, Homo sapiens
gcaguuaacaucug

SEQ ID NO: 860689 - RNA, 22 nt, Homo sapiens
gcaguugaaacaagaagccaca

SEQ ID NO: 860690 - RNA, 19 nt, Homo sapiens
gcauaagaaaacuaagaaa

SEQ ID NO: 860691 - RNA, 20 nt, Homo sapiens
gcauacgguaugauauugca

SEQ ID NO: 860692 - RNA, 18 nt, Homo sapiens
gcauagaguucagacuuu

SEQ ID NO: 860693 - RNA, 19 nt, Homo sapiens
gcauagaguucagacuuuu

SEQ ID NO: 860694 - RNA, 22 nt, Homo sapiens
gcaucauucuuucugcuauauu

SEQ ID NO: 860695 - RNA, 23 nt, Homo sapiens
gcauccggcaugagggcugagau

SEQ ID NO: 860696 - RNA, 13 nt, Homo sapiens
gcauggaugaaua

SEQ ID NO: 860697 - RNA, 23 nt, Homo sapiens
gcauuuaaccgucaauaggcaaa

SEQ ID NO: 860698 - RNA, 14 nt, Homo sapiens
gcauuugugucugc

SEQ ID NO: 860699 - RNA, 14 nt, Homo sapiens
gccacauggccgcu

SEQ ID NO: 860700 - RNA, 18 nt, Homo sapiens
gccacauggccgcugccc

SEQ ID NO: 860701 - RNA, 19 nt, Homo sapiens
gccacauggccgcugccca

SEQ ID NO: 860702 - RNA, 16 nt, Homo sapiens
gccacuauuacuggga

SEQ ID NO: 860703 - RNA, 22 nt, Homo sapiens
gccaggagccuccugacccugu

SEQ ID NO: 860704 - RNA, 15 nt, Homo sapiens
gccaggugcacagac

SEQ ID NO: 860705 - RNA, 19 nt, Homo sapiens
gccaucuguaaauauccca

SEQ ID NO: 860706 - RNA, 17 nt, Homo sapiens
gccaugauuuuggccac

SEQ ID NO: 860707 - RNA, 24 nt, Homo sapiens
gccaugauuuuggccacuuugcag

SEQ ID NO: 860708 - RNA, 16 nt, Homo sapiens
gcccagcuaaagcaau

SEQ ID NO: 860709 - RNA, 18 nt, Homo sapiens
gcccagcuuggagugcca

SEQ ID NO: 860710 - RNA, 18 nt, Homo sapiens
gcccaucaauuauagaaa

SEQ ID NO: 860711 - RNA, 17 nt, Homo sapiens
aacuaagaugcugccug

SEQ ID NO: 860712 - RNA, 15 nt, Homo sapiens
aacuacuggcaauuu

SEQ ID NO: 860713 - RNA, 21 nt, Homo sapiens
aacuccagccacccagccagg

SEQ ID NO: 860714 - RNA, 13 nt, Homo sapiens
aacuccaggguua

SEQ ID NO: 860715 - RNA, 14 nt, Homo sapiens
aacugaguccuguu

SEQ ID NO: 860716 - RNA, 14 nt, Homo sapiens
aacuguaacauaua

SEQ ID NO: 860717 - RNA, 21 nt, Homo sapiens
aacuugucaaggaauguuauc

SEQ ID NO: 860718 - RNA, 16 nt, Homo sapiens
aacuuuuauuacuggg

SEQ ID NO: 860719 - RNA, 15 nt, Homo sapiens
aagaaagcauugcca

SEQ ID NO: 860720 - RNA, 17 nt, Homo sapiens
aagaacugucucuuuca

SEQ ID NO: 860721 - RNA, 15 nt, Homo sapiens
aagacaucaagcaca

SEQ ID NO: 860722 - RNA, 22 nt, Homo sapiens
aagacucuacccauauuacaga

SEQ ID NO: 860723 - RNA, 20 nt, Homo sapiens
aagcaggaaaugaaaauguc

SEQ ID NO: 860724 - RNA, 20 nt, Homo sapiens
aagcauugccagcucuucca

SEQ ID NO: 860725 - RNA, 12 nt, Homo sapiens
aagccaggguuc

SEQ ID NO: 860726 - RNA, 20 nt, Homo sapiens
aagcccacccugcaccucau

SEQ ID NO: 860727 - RNA, 14 nt, Homo sapiens
aagccguuggcacc

SEQ ID NO: 860728 - RNA, 20 nt, Homo sapiens
aagcuaaaauuagaugaacu

SEQ ID NO: 860729 - RNA, 22 nt, Homo sapiens
aagcuaaaauuagaugaacuca

SEQ ID NO: 860730 - RNA, 22 nt, Homo sapiens
aagcuaaauccuuuacuguuag

SEQ ID NO: 860731 - RNA, 13 nt, Homo sapiens
aagcucaucucag

SEQ ID NO: 860732 - RNA, 12 nt, Homo sapiens
aagcuccugaau

SEQ ID NO: 860733 - RNA, 14 nt, Homo sapiens
aagcuuguguacuu

SEQ ID NO: 860734 - RNA, 23 nt, Homo sapiens
aaggcaaaucuccuuuguccauu

SEQ ID NO: 860735 - RNA, 15 nt, Homo sapiens
aaggcagcucugucg

SEQ ID NO: 860736 - RNA, 20 nt, Homo sapiens
aaggccagucugaaccugag

SEQ ID NO: 860737 - RNA, 13 nt, Homo sapiens
aaggccucugugg

SEQ ID NO: 860738 - RNA, 17 nt, Homo sapiens
aaggcuagaucaugaag

SEQ ID NO: 860739 - RNA, 20 nt, Homo sapiens
aagggaauucggugugcacc

SEQ ID NO: 860740 - RNA, 20 nt, Homo sapiens
aagggccagcuggaggugaa

SEQ ID NO: 860741 - RNA, 22 nt, Homo sapiens
aagggccagcuggaggugaaga

SEQ ID NO: 860742 - RNA, 18 nt, Homo sapiens
aagggcucacgcauucag

SEQ ID NO: 860743 - RNA, 18 nt, Homo sapiens
aaaaacuaacacccaguc

SEQ ID NO: 860744 - RNA, 12 nt, Homo sapiens
aaaaauauguga

SEQ ID NO: 860745 - RNA, 15 nt, Homo sapiens
aaaaaucagugaaua

SEQ ID NO: 860746 - RNA, 20 nt, Homo sapiens
aaaaauguauaugcacuuau

SEQ ID NO: 860747 - RNA, 21 nt, Homo sapiens
aaaacaaagccuuauccagca

SEQ ID NO: 860748 - RNA, 18 nt, Homo sapiens
aaaacccgacaacauuuc

SEQ ID NO: 860749 - RNA, 14 nt, Homo sapiens
aaaacugucccuuu

SEQ ID NO: 860750 - RNA, 18 nt, Homo sapiens
aaaauacaugacauuuau

SEQ ID NO: 860751 - RNA, 22 nt, Homo sapiens
aaaaucaacccaauaauucugu

SEQ ID NO: 860752 - RNA, 12 nt, Homo sapiens
aaaaucacagau

SEQ ID NO: 860753 - RNA, 22 nt, Homo sapiens
aaaaugauauucaaucuuaaca

SEQ ID NO: 860754 - RNA, 16 nt, Homo sapiens
aaaauuuuuuucuuuc

SEQ ID NO: 860755 - RNA, 13 nt, Homo sapiens
aaacaaacaugac

SEQ ID NO: 860756 - RNA, 21 nt, Homo sapiens
aaacagggcuuuacuaucuuu

SEQ ID NO: 860757 - RNA, 14 nt, Homo sapiens
aaacauugccugau

SEQ ID NO: 860758 - RNA, 22 nt, Homo sapiens
aaacccgacaacauuucugcca

SEQ ID NO: 860759 - RNA, 14 nt, Homo sapiens
aaacggaacucuuc

SEQ ID NO: 860760 - RNA, 22 nt, Homo sapiens
aaacuggaaugcuguuacuuug

SEQ ID NO: 860761 - RNA, 18 nt, Homo sapiens
aaagaaauuguauuauca

SEQ ID NO: 860762 - RNA, 22 nt, Homo sapiens
aaagaugcauuaucuaugauau

SEQ ID NO: 860763 - RNA, 15 nt, Homo sapiens
aaagcaacuccauca

SEQ ID NO: 860764 - RNA, 15 nt, Homo sapiens
aaagcaggugcccag

SEQ ID NO: 860765 - RNA, 21 nt, Homo sapiens
aaagcaucuauucccaaagaa

SEQ ID NO: 860766 - RNA, 22 nt, Homo sapiens
agcaguuugcuuuguaugcacu

SEQ ID NO: 860767 - RNA, 18 nt, Homo sapiens
agcauacgguaugauauu

SEQ ID NO: 860768 - RNA, 21 nt, Homo sapiens
agcauggccgcaacuucccag

SEQ ID NO: 860769 - RNA, 17 nt, Homo sapiens
agcauugagcaaagggg

SEQ ID NO: 860770 - RNA, 15 nt, Homo sapiens
agccaccaagaggga

SEQ ID NO: 860771 - RNA, 18 nt, Homo sapiens
agccaggguuccagacag

SEQ ID NO: 860772 - RNA, 17 nt, Homo sapiens
agcccucaggucagggu

SEQ ID NO: 860773 - RNA, 13 nt, Homo sapiens
agccucagccacc

SEQ ID NO: 860774 - RNA, 12 nt, Homo sapiens
agccucuggccg

SEQ ID NO: 860775 - RNA, 21 nt, Homo sapiens
agccuggcacagggcaguggg

SEQ ID NO: 860776 - RNA, 19 nt, Homo sapiens
agccuuuuauuaacauaua

SEQ ID NO: 860777 - RNA, 18 nt, Homo sapiens
agcgaggaggcuccagag

SEQ ID NO: 860778 - RNA, 14 nt, Homo sapiens
agcuacugacuaug

SEQ ID NO: 860779 - RNA, 21 nt, Homo sapiens
agcucaguauacuaaugcccu

SEQ ID NO: 860780 - RNA, 14 nt, Homo sapiens
agcugcuguccagg

SEQ ID NO: 860781 - RNA, 18 nt, Homo sapiens
agcuggaaaaaguguccu

SEQ ID NO: 860782 - RNA, 22 nt, Homo sapiens
agcuucuuaauauaacugccuu

SEQ ID NO: 860783 - RNA, 15 nt, Homo sapiens
agcuuggagugccac

SEQ ID NO: 860784 - RNA, 15 nt, Homo sapiens
aggaacuuuccagca

SEQ ID NO: 860785 - RNA, 14 nt, Homo sapiens
aggaaggaugagca

SEQ ID NO: 860786 - RNA, 12 nt, Homo sapiens
aggaauucucac

SEQ ID NO: 860787 - RNA, 15 nt, Homo sapiens
aggacccucccaggu

SEQ ID NO: 860788 - RNA, 13 nt, Homo sapiens
aggacgauuucac

SEQ ID NO: 860789 - RNA, 16 nt, Homo sapiens
aggacgauuucacuga

SEQ ID NO: 860790 - RNA, 16 nt, Homo sapiens
ggcagcauuuagcaca

SEQ ID NO: 860791 - RNA, 22 nt, Homo sapiens
ggcagccccuccccauggugca

SEQ ID NO: 860792 - RNA, 14 nt, Homo sapiens
ggcagcuucgugug

SEQ ID NO: 860793 - RNA, 17 nt, Homo sapiens
ggcaggaggguggcacu

SEQ ID NO: 860794 - RNA, 18 nt, Homo sapiens
ggcauggccagguggcca

SEQ ID NO: 860795 - RNA, 13 nt, Homo sapiens
ggccagguggcca

SEQ ID NO: 860796 - RNA, 20 nt, Homo sapiens
ggccccuggcaccugggugc

SEQ ID NO: 860797 - RNA, 19 nt, Homo sapiens
ggcccgacagccuggcaca

SEQ ID NO: 860798 - RNA, 23 nt, Homo sapiens
ggcccuucccacaggacauuucu

SEQ ID NO: 860799 - RNA, 23 nt, Homo sapiens
ggcccuuccucuccacugccuuc

SEQ ID NO: 860800 - RNA, 17 nt, Homo sapiens
ggccucgggcccggccu

SEQ ID NO: 860801 - RNA, 14 nt, Homo sapiens
ggccuuaaccauga

SEQ ID NO: 860802 - RNA, 14 nt, Homo sapiens
ggcggccaccagcg

SEQ ID NO: 860803 - RNA, 19 nt, Homo sapiens
ggcggucaauaauugugga

SEQ ID NO: 860804 - RNA, 13 nt, Homo sapiens
ggcuccagcgugg

SEQ ID NO: 860805 - RNA, 16 nt, Homo sapiens
ggcucuguauucugca

SEQ ID NO: 860806 - RNA, 14 nt, Homo sapiens
ggcugagaugcgca

SEQ ID NO: 860807 - RNA, 19 nt, Homo sapiens
ggcugcccacacaccccaa

SEQ ID NO: 860808 - RNA, 19 nt, Homo sapiens
ggcuggacuuuugcagcuu

SEQ ID NO: 860809 - RNA, 16 nt, Homo sapiens
ggcuuagaauggggcu

SEQ ID NO: 860810 - RNA, 21 nt, Homo sapiens
ggcuugggguagagaggacag

SEQ ID NO: 860811 - RNA, 17 nt, Homo sapiens
ggcuuuaagcgaggcag

SEQ ID NO: 860812 - RNA, 20 nt, Homo sapiens
ggcuuuccucagcaccuggg

SEQ ID NO: 860813 - RNA, 18 nt, Homo sapiens
ggcuuuggguagugccau

SEQ ID NO: 860814 - RNA, 13 nt, Homo sapiens
gggacuuggauag

SEQ ID NO: 860815 - RNA, 23 nt, Homo sapiens
gggagagccaaggccuaugccac

SEQ ID NO: 860816 - RNA, 12 nt, Homo sapiens
gggagucugggc

SEQ ID NO: 860817 - RNA, 13 nt, Homo sapiens
gggaucuuaccca

SEQ ID NO: 860818 - RNA, 19 nt, Homo sapiens
gggauggcuaaaaccauca

SEQ ID NO: 860819 - RNA, 13 nt, Homo sapiens
gggcacugguggc

SEQ ID NO: 860820 - RNA, 13 nt, Homo sapiens
gggcacugucaug

SEQ ID NO: 860821 - RNA, 23 nt, Homo sapiens
gggccaagccaggguuccagaca

SEQ ID NO: 860822 - RNA, 13 nt, Homo sapiens
gggccgggcucca

SEQ ID NO: 860823 - RNA, 15 nt, Homo sapiens
gggcuccauguagaa

SEQ ID NO: 860824 - RNA, 14 nt, Homo sapiens
gggcucgugcccug

SEQ ID NO: 860825 - RNA, 23 nt, Homo sapiens
gggcuuguuuucuacuuugccac

SEQ ID NO: 860826 - RNA, 13 nt, Homo sapiens
ggggagaauggcu

SEQ ID NO: 860827 - RNA, 13 nt, Homo sapiens
ggggcagcacaga

SEQ ID NO: 860828 - RNA, 20 nt, Homo sapiens
ggggucccauagaggugagg

SEQ ID NO: 860829 - RNA, 18 nt, Homo sapiens
gguaauuaguaacaugug

SEQ ID NO: 860830 - RNA, 15 nt, Homo sapiens
ggucagagcccagga

SEQ ID NO: 860831 - RNA, 23 nt, Homo sapiens
ggucaggaaggaugagcauuuag

SEQ ID NO: 860832 - RNA, 16 nt, Homo sapiens
ggucuuugaaauaugc

SEQ ID NO: 860833 - RNA, 16 nt, Homo sapiens
ggugaaagauggaacu

SEQ ID NO: 860834 - RNA, 15 nt, Homo sapiens
ggugaagacccagag

SEQ ID NO: 860835 - RNA, 20 nt, Homo sapiens
ggugcuaucgcaccacugug

SEQ ID NO: 860836 - RNA, 14 nt, Homo sapiens
gguggucuuggaga

SEQ ID NO: 860837 - RNA, 20 nt, Homo sapiens
ggugugagaauaacacuggc

SEQ ID NO: 860838 - RNA, 16 nt, Homo sapiens
ggugugccacaggcug

SEQ ID NO: 860839 - RNA, 14 nt, Homo sapiens
gguguggcuuggaa

SEQ ID NO: 860840 - RNA, 17 nt, Homo sapiens
gguuaaagaaaggcaga

SEQ ID NO: 860841 - RNA, 15 nt, Homo sapiens
gguuccagacagggu

SEQ ID NO: 860842 - RNA, 14 nt, Homo sapiens
gguuggguuccaga

SEQ ID NO: 860843 - RNA, 13 nt, Homo sapiens
guaaacugugcac

SEQ ID NO: 860844 - RNA, 23 nt, Homo sapiens
guaaagccucagcaacagccagu

SEQ ID NO: 860845 - RNA, 16 nt, Homo sapiens
guaacuugucaaggaa

SEQ ID NO: 860846 - RNA, 23 nt, Homo sapiens
guaaggacuugugccucuuggga

SEQ ID NO: 860847 - RNA, 17 nt, Homo sapiens
guaaggcagcucugucg

SEQ ID NO: 860848 - RNA, 21 nt, Homo sapiens
guacagccuuuuauggaccaa

SEQ ID NO: 860849 - RNA, 18 nt, Homo sapiens
guaccuauugaacaugug

SEQ ID NO: 860850 - RNA, 18 nt, Homo sapiens
guaccugcccccaaucca

SEQ ID NO: 860851 - RNA, 23 nt, Homo sapiens
guacugaguucucauccacagag

SEQ ID NO: 860852 - RNA, 12 nt, Homo sapiens
guagacauacuu

SEQ ID NO: 860853 - RNA, 14 nt, Homo sapiens
guagacauacuugu

SEQ ID NO: 860854 - RNA, 12 nt, Homo sapiens
guagcacugaaa

SEQ ID NO: 860855 - RNA, 13 nt, Homo sapiens
guagucauuucau

SEQ ID NO: 860856 - RNA, 15 nt, Homo sapiens
guauaauaaaaccaa

SEQ ID NO: 860857 - RNA, 13 nt, Homo sapiens
guauaugcaauau

SEQ ID NO: 860858 - RNA, 21 nt, Homo sapiens
guaucaaaugugacauuauau

SEQ ID NO: 860859 - RNA, 18 nt, Homo sapiens
guaucuguaacccuugaa

SEQ ID NO: 860860 - RNA, 23 nt, Homo sapiens
guaugauccuaaugaaugcauaa

SEQ ID NO: 860861 - RNA, 15 nt, Homo sapiens
guauguuugggagac

SEQ ID NO: 860862 - RNA, 14 nt, Homo sapiens
guauuaccuauuca

SEQ ID NO: 860863 - RNA, 18 nt, Homo sapiens
gucaaccuugugugagug

SEQ ID NO: 860864 - RNA, 21 nt, Homo sapiens
gucaaggaauguuaucaguau

SEQ ID NO: 860865 - RNA, 14 nt, Homo sapiens
gucacaacacugaa

SEQ ID NO: 860866 - RNA, 18 nt, Homo sapiens
gucacaggacgauuucac

SEQ ID NO: 860867 - RNA, 16 nt, Homo sapiens
gucagaccuucuucca

SEQ ID NO: 860868 - RNA, 16 nt, Homo sapiens
guccaaucacauucag

SEQ ID NO: 860869 - RNA, 16 nt, Homo sapiens
guccauuuaccuggaa

SEQ ID NO: 860870 - RNA, 17 nt, Homo sapiens
gucccgggcacugucau

SEQ ID NO: 860871 - RNA, 13 nt, Homo sapiens
gucccuuggagac

SEQ ID NO: 860872 - RNA, 15 nt, Homo sapiens
guccgaucuuugacu

SEQ ID NO: 860873 - RNA, 18 nt, Homo sapiens
guccugggugcugucaug

SEQ ID NO: 860874 - RNA, 14 nt, Homo sapiens
guccuugaugcuca

SEQ ID NO: 860875 - RNA, 19 nt, Homo sapiens
gucguucccuugugucugu

SEQ ID NO: 860876 - RNA, 19 nt, Homo sapiens
gucucaagagggcacuggu

SEQ ID NO: 860877 - RNA, 22 nt, Homo sapiens
gucucuuguaauccgaaucucu

SEQ ID NO: 860878 - RNA, 19 nt, Homo sapiens
gucuggccuuuucuuguaa

SEQ ID NO: 860879 - RNA, 21 nt, Homo sapiens
gucuuggauugguaccagagc

SEQ ID NO: 860880 - RNA, 22 nt, Homo sapiens
gucuuuuaaugauacugucuaa

SEQ ID NO: 860881 - RNA, 22 nt, Homo sapiens
gugaaaaaggcaagccacagaa

SEQ ID NO: 860882 - RNA, 15 nt, Homo sapiens
gugacaggcaguguu

SEQ ID NO: 860883 - RNA, 19 nt, Homo sapiens
gugacauuuccaugcauaa

SEQ ID NO: 860884 - RNA, 20 nt, Homo sapiens
gugagaacuacucagggaau

SEQ ID NO: 860885 - RNA, 23 nt, Homo sapiens
gugagggauaguggggucagggc

SEQ ID NO: 860886 - RNA, 20 nt, Homo sapiens
gugaguuggggcgacuguga

SEQ ID NO: 860887 - RNA, 19 nt, Homo sapiens
gugauuugggggugcaaug

SEQ ID NO: 860888 - RNA, 20 nt, Homo sapiens
gugcaugcagcaucuaagua

SEQ ID NO: 860889 - RNA, 21 nt, Homo sapiens
gugccacauggccgcugccca

SEQ ID NO: 860890 - RNA, 20 nt, Homo sapiens
gugcuaucgcaccacugugu

SEQ ID NO: 860891 - RNA, 18 nt, Homo sapiens
guggaaccaacacuaaca

SEQ ID NO: 860892 - RNA, 12 nt, Homo sapiens
guggagggguca

SEQ ID NO: 860893 - RNA, 15 nt, Homo sapiens
guggaucaagcuugu

SEQ ID NO: 860894 - RNA, 14 nt, Homo sapiens
guguggcuuggaac

SEQ ID NO: 860895 - RNA, 22 nt, Homo sapiens
guguggcuuggaacauuuggga

SEQ ID NO: 860896 - RNA, 10 nt, Homo sapiens
guguguuuca

SEQ ID NO: 860897 - RNA, 14 nt, Homo sapiens
guguuaaaugugau

SEQ ID NO: 860898 - RNA, 21 nt, Homo sapiens
guguuaucagucauaacuaaa

SEQ ID NO: 860899 - RNA, 15 nt, Homo sapiens
guuaauguacuuuca

SEQ ID NO: 860900 - RNA, 15 nt, Homo sapiens
guuaauguuaauuaa

SEQ ID NO: 860901 - RNA, 15 nt, Homo sapiens
guuauuuuauugccu

SEQ ID NO: 860902 - RNA, 13 nt, Homo sapiens
guucaccagguca

SEQ ID NO: 860903 - RNA, 16 nt, Homo sapiens
guugcuuauugggagu

SEQ ID NO: 860904 - RNA, 21 nt, Homo sapiens
guugucugaagucacugcaca

SEQ ID NO: 860905 - RNA, 18 nt, Homo sapiens
guuuauaaaagaugcauu

SEQ ID NO: 860906 - RNA, 16 nt, Homo sapiens
guuuauaauuguuaua

SEQ ID NO: 860907 - RNA, 15 nt, Homo sapiens
guuucagagucagaa

SEQ ID NO: 860908 - RNA, 16 nt, Homo sapiens
uaaaacguuaucucau

SEQ ID NO: 860909 - RNA, 14 nt, Homo sapiens
uaaaacuuccacua

SEQ ID NO: 860910 - RNA, 23 nt, Homo sapiens
uaaaagaugcauuaucuaugaua

SEQ ID NO: 860911 - RNA, 20 nt, Homo sapiens
uaaaaguuuuaaccucaggu

SEQ ID NO: 860912 - RNA, 21 nt, Homo sapiens
uaaaauaaacaugaagcacaa

SEQ ID NO: 860913 - RNA, 15 nt, Homo sapiens
uaaaaugugcaguau

SEQ ID NO: 860914 - RNA, 19 nt, Homo sapiens
uaaacaugaagcacaaaaa

SEQ ID NO: 860915 - RNA, 20 nt, Homo sapiens
uaaagaaauauauaugauau

SEQ ID NO: 860916 - RNA, 16 nt, Homo sapiens
uaaagcugaaaacugc

SEQ ID NO: 860917 - RNA, 22 nt, Homo sapiens
uaaagcugccggcacagaacuu

SEQ ID NO: 860918 - RNA, 15 nt, Homo sapiens
uaaaguacguguuua

SEQ ID NO: 860919 - RNA, 17 nt, Homo sapiens
uaaauaaaaauaaguca

SEQ ID NO: 860920 - RNA, 19 nt, Homo sapiens
uaaaugccaggccuggcaa

SEQ ID NO: 860921 - RNA, 16 nt, Homo sapiens
uaaauggugagaauua

SEQ ID NO: 860922 - RNA, 12 nt, Homo sapiens
uaaauguuauag

SEQ ID NO: 860923 - RNA, 14 nt, Homo sapiens
uagacuaaggccau

SEQ ID NO: 860924 - RNA, 17 nt, Homo sapiens
uagaggaugauguaauu

SEQ ID NO: 860925 - RNA, 22 nt, Homo sapiens
uagaguccaacguggggcagca

SEQ ID NO: 860926 - RNA, 18 nt, Homo sapiens
uagaguguuaucagucau

SEQ ID NO: 860927 - RNA, 16 nt, Homo sapiens
uagaguucagacuuuu

SEQ ID NO: 860928 - RNA, 18 nt, Homo sapiens
uagauugccuuuggcaau

SEQ ID NO: 860929 - RNA, 13 nt, Homo sapiens
uagcugcauuugu

SEQ ID NO: 860930 - RNA, 13 nt, Homo sapiens
uaggaaguaggaa

SEQ ID NO: 860931 - RNA, 13 nt, Homo sapiens
uaggagcuuccag

SEQ ID NO: 860932 - RNA, 14 nt, Homo sapiens
uaggccaucuguaa

SEQ ID NO: 860933 - RNA, 20 nt, Homo sapiens
uagguuaauaggaggacaga

SEQ ID NO: 860934 - RNA, 12 nt, Homo sapiens
uaguaacaugug

SEQ ID NO: 860935 - RNA, 22 nt, Homo sapiens
uaguaccaugucguaguuacuc

SEQ ID NO: 860936 - RNA, 23 nt, Homo sapiens
uaguacuugggagaccuguaauc

SEQ ID NO: 860937 - RNA, 22 nt, Homo sapiens
uaguaggagcugagcuuuccag

SEQ ID NO: 860938 - RNA, 17 nt, Homo sapiens
uagucauuucauggguu

SEQ ID NO: 860939 - RNA, 17 nt, Homo sapiens
uagucgaacaauucaua

SEQ ID NO: 860940 - RNA, 14 nt, Homo sapiens
uagugauggagcuu

SEQ ID NO: 860941 - RNA, 17 nt, Homo sapiens
uaguguauaccaccugu

SEQ ID NO: 860942 - RNA, 13 nt, Homo sapiens
uaguuuucauaca

SEQ ID NO: 860943 - RNA, 13 nt, Homo sapiens
uauaaauaucaca

SEQ ID NO: 860944 - RNA, 19 nt, Homo sapiens
uauaaaucgcauuaaugaa

SEQ ID NO: 860945 - RNA, 23 nt, Homo sapiens
uauacaaugaguaaaaucacaga

SEQ ID NO: 860946 - RNA, 20 nt, Homo sapiens
uauacuucucuauuaucuca

SEQ ID NO: 860947 - RNA, 22 nt, Homo sapiens
uauagucgaacaauucauauau

SEQ ID NO: 860948 - RNA, 16 nt, Homo sapiens
uauauaacaacaaacu

SEQ ID NO: 860949 - RNA, 17 nt, Homo sapiens
uaucaccgugggcuccc

SEQ ID NO: 860950 - RNA, 14 nt, Homo sapiens
uaucagucauaacu

SEQ ID NO: 860951 - RNA, 15 nt, Homo sapiens
uaucugacugaaauu

SEQ ID NO: 860952 - RNA, 21 nt, Homo sapiens
uaugcguaaaucaacuuguca

SEQ ID NO: 860953 - RNA, 17 nt, Homo sapiens
uauggcucuacuuucag

SEQ ID NO: 860954 - RNA, 22 nt, Homo sapiens
uaugguuaauaaguuucacuga

SEQ ID NO: 860955 - RNA, 13 nt, Homo sapiens
uauguccaugaaa

SEQ ID NO: 860956 - RNA, 17 nt, Homo sapiens
uauguugcccagugugu

SEQ ID NO: 860957 - RNA, 15 nt, Homo sapiens
uauuacuccuugcca

SEQ ID NO: 860958 - RNA, 20 nt, Homo sapiens
uauuacugggacugugcuca

SEQ ID NO: 860959 - RNA, 18 nt, Homo sapiens
uauuauucuucauaacaa

SEQ ID NO: 860960 - RNA, 23 nt, Homo sapiens
uauuccagcagugaaacuugugc

SEQ ID NO: 860961 - RNA, 18 nt, Homo sapiens
uauugaggaaaauuaaua

SEQ ID NO: 860962 - RNA, 22 nt, Homo sapiens
uauugaggaaaauuaauaucac

SEQ ID NO: 860963 - RNA, 16 nt, Homo sapiens
uauuguuucaauugca

SEQ ID NO: 860964 - RNA, 12 nt, Homo sapiens
uauuuauagucg

SEQ ID NO: 860965 - RNA, 14 nt, Homo sapiens
uauuuaugccucug

SEQ ID NO: 860966 - RNA, 17 nt, Homo sapiens
uauuuaugccucuguau

SEQ ID NO: 860967 - RNA, 22 nt, Homo sapiens
uauuuugcauaguaccaaucau

SEQ ID NO: 860968 - RNA, 14 nt, Homo sapiens
ucaaacuacuggca

SEQ ID NO: 860969 - RNA, 18 nt, Homo sapiens
ucaaaugugacauuauau

SEQ ID NO: 860970 - RNA, 21 nt, Homo sapiens
ucaacccaauaauucuguauu

SEQ ID NO: 860971 - RNA, 18 nt, Homo sapiens
ucaagcccuuuacuugac

SEQ ID NO: 860972 - RNA, 14 nt, Homo sapiens
ucaaggagauauga

SEQ ID NO: 860973 - RNA, 15 nt, Homo sapiens
ucaagugcaauccau

SEQ ID NO: 860974 - RNA, 16 nt, Homo sapiens
ucaaucucugauucug

SEQ ID NO: 860975 - RNA, 22 nt, Homo sapiens
ucacaaucaucaucauucucau

SEQ ID NO: 860976 - RNA, 18 nt, Homo sapiens
ucacagaugugugauuca

SEQ ID NO: 860977 - RNA, 22 nt, Homo sapiens
ucacauucccucucauccaggu

SEQ ID NO: 860978 - RNA, 23 nt, Homo sapiens
ucaccaucuuucuaaucuuuuuc

SEQ ID NO: 860979 - RNA, 20 nt, Homo sapiens
ucacuugugcaguguugaca

SEQ ID NO: 860980 - RNA, 23 nt, Homo sapiens
ucagaauaaauggguaacacuga

SEQ ID NO: 860981 - RNA, 15 nt, Homo sapiens
ucagagccaccccua

SEQ ID NO: 860982 - RNA, 16 nt, Homo sapiens
ucagcaccaugggccu

SEQ ID NO: 860983 - RNA, 15 nt, Homo sapiens
ucagcaccugggacc

SEQ ID NO: 860984 - RNA, 14 nt, Homo sapiens
ucagcuggaucucc

SEQ ID NO: 860985 - RNA, 13 nt, Homo sapiens
ucaggagaaggcc

SEQ ID NO: 860986 - RNA, 18 nt, Homo sapiens
ucagggcugagaggagaa

SEQ ID NO: 860987 - RNA, 19 nt, Homo sapiens
ucagggggccaggugcaca

SEQ ID NO: 860988 - RNA, 18 nt, Homo sapiens
ucaguagugccugugauc

SEQ ID NO: 860989 - RNA, 16 nt, Homo sapiens
ucagucagcccagugg

SEQ ID NO: 860990 - RNA, 13 nt, Homo sapiens
ucauaauugucaa

SEQ ID NO: 860991 - RNA, 21 nt, Homo sapiens
ucauaauugucaaaaaccaga

SEQ ID NO: 860992 - RNA, 18 nt, Homo sapiens
ucauagauaauaguacau

SEQ ID NO: 860993 - RNA, 16 nt, Homo sapiens
ucauaugauugugcac

SEQ ID NO: 860994 - RNA, 18 nt, Homo sapiens
ucaucaauucucuaucau

SEQ ID NO: 860995 - RNA, 17 nt, Homo sapiens
ucaucgcucuacaccug

SEQ ID NO: 860996 - RNA, 23 nt, Homo sapiens
ucaugaagaaccuugacggcauu

SEQ ID NO: 860997 - RNA, 12 nt, Homo sapiens
ucaugacaguca

SEQ ID NO: 860998 - RNA, 14 nt, Homo sapiens
ucaugaucaucaca

SEQ ID NO: 860999 - RNA, 11 nt, Homo sapiens
ucaugauuuca

SEQ ID NO: 861000 - RNA, 16 nt, Homo sapiens
ucaugauuucauuuca

SEQ ID NO: 861001 - RNA, 15 nt, Homo sapiens
ucauguaaguagcaa

SEQ ID NO: 861002 - RNA, 12 nt, Homo sapiens
ucauuaauucaa

SEQ ID NO: 861003 - RNA, 20 nt, Homo sapiens
ucauucagggauagcacuga

SEQ ID NO: 861004 - RNA, 15 nt, Homo sapiens
ucauucucauucuca

SEQ ID NO: 861005 - RNA, 21 nt, Homo sapiens
ucauucucugucucauccauc

SEQ ID NO: 861006 - RNA, 17 nt, Homo sapiens
ucauucuuucugcuaua

SEQ ID NO: 861007 - RNA, 16 nt, Homo sapiens
uccaacaugugcucag

SEQ ID NO: 861008 - RNA, 20 nt, Homo sapiens
uccaacguggggcagcacag

SEQ ID NO: 861009 - RNA, 12 nt, Homo sapiens
uccacuguaaau

SEQ ID NO: 861010 - RNA, 17 nt, Homo sapiens
uccagaacuaccaaaau

SEQ ID NO: 861011 - RNA, 14 nt, Homo sapiens
uccagagagaagca

SEQ ID NO: 861012 - RNA, 22 nt, Homo sapiens
uccagccauuccugaagcccac

SEQ ID NO: 861013 - RNA, 18 nt, Homo sapiens
uccaggaacuuuccagca

SEQ ID NO: 861014 - RNA, 23 nt, Homo sapiens
uccaggcuugggcuccauuccca

SEQ ID NO: 861015 - RNA, 16 nt, Homo sapiens
uccaugaaaaacagca

SEQ ID NO: 861016 - RNA, 21 nt, Homo sapiens
ucccaacacggguaaaucuag

SEQ ID NO: 861017 - RNA, 21 nt, Homo sapiens
ucccacggccacugcagucac

SEQ ID NO: 861018 - RNA, 19 nt, Homo sapiens
ucccagcuauuccuacucu

SEQ ID NO: 861019 - RNA, 16 nt, Homo sapiens
ucccaucccagcugaa

SEQ ID NO: 861020 - RNA, 13 nt, Homo sapiens
ucccaugauuucu

SEQ ID NO: 861021 - RNA, 18 nt, Homo sapiens
uccccuccccucacuucu

SEQ ID NO: 861022 - RNA, 22 nt, Homo sapiens
ucccggcuggacuuuugcagcu

SEQ ID NO: 861023 - RNA, 13 nt, Homo sapiens
ucccgggcacugu

SEQ ID NO: 861024 - RNA, 13 nt, Homo sapiens
ucccuauguccca

SEQ ID NO: 861025 - RNA, 15 nt, Homo sapiens
uccggaauccugucc

SEQ ID NO: 861026 - RNA, 21 nt, Homo sapiens
uccuaaaauaaacaugaagca

SEQ ID NO: 861027 - RNA, 17 nt, Homo sapiens
uccuaaaguagacuuca

SEQ ID NO: 861028 - RNA, 19 nt, Homo sapiens
uccuaaugaaugcauaaaa

SEQ ID NO: 861029 - RNA, 19 nt, Homo sapiens
uccuaggcaucugcuguaa

SEQ ID NO: 861030 - RNA, 13 nt, Homo sapiens
uccucauucuucu

SEQ ID NO: 861031 - RNA, 17 nt, Homo sapiens
uccuccacaauagcaga

SEQ ID NO: 861032 - RNA, 13 nt, Homo sapiens
uccucuccaagcu

SEQ ID NO: 861033 - RNA, 13 nt, Homo sapiens
uccucuccacugc

SEQ ID NO: 861034 - RNA, 19 nt, Homo sapiens
uccucugugaccaaugucu

SEQ ID NO: 861035 - RNA, 14 nt, Homo sapiens
uccucuuccugccu

SEQ ID NO: 861036 - RNA, 11 nt, Homo sapiens
uccugcaaguc

SEQ ID NO: 861037 - RNA, 14 nt, Homo sapiens
uccuggacagugag

SEQ ID NO: 861038 - RNA, 16 nt, Homo sapiens
uccuucaagcugcuga

SEQ ID NO: 861039 - RNA, 12 nt, Homo sapiens
ucgaguguuuca

SEQ ID NO: 861040 - RNA, 14 nt, Homo sapiens
ucgccguggcugcg

SEQ ID NO: 861041 - RNA, 17 nt, Homo sapiens
ucgcuucacggacagga

SEQ ID NO: 861042 - RNA, 17 nt, Homo sapiens
ucggugcagaaacuacc

SEQ ID NO: 861043 - RNA, 12 nt, Homo sapiens
ucggugugcacc

SEQ ID NO: 861044 - RNA, 19 nt, Homo sapiens
ucguuugaaucacaguaua

SEQ ID NO: 861045 - RNA, 15 nt, Homo sapiens
ucuaagaaagaaauu

SEQ ID NO: 861046 - RNA, 20 nt, Homo sapiens
ucuaagagaacaaugugcua

SEQ ID NO: 861047 - RNA, 15 nt, Homo sapiens
ucuaggaacauacuu

SEQ ID NO: 861048 - RNA, 14 nt, Homo sapiens
ucuauauaguguau

SEQ ID NO: 861049 - RNA, 23 nt, Homo sapiens
ucuauauauacaaugaguaaaau

SEQ ID NO: 861050 - RNA, 19 nt, Homo sapiens
ucuaugaaauaucaugcuc

SEQ ID NO: 861051 - RNA, 19 nt, Homo sapiens
ucuauuucuccuccauggg

SEQ ID NO: 861052 - RNA, 17 nt, Homo sapiens
ucucacuagcacaugga

SEQ ID NO: 861053 - RNA, 16 nt, Homo sapiens
ucucaggcauggauga

SEQ ID NO: 861054 - RNA, 14 nt, Homo sapiens
ucucauccacagag

SEQ ID NO: 861055 - RNA, 20 nt, Homo sapiens
ucuccaccccucaagccagg

SEQ ID NO: 861056 - RNA, 20 nt, Homo sapiens
ucuccagaaagcucaucuca

SEQ ID NO: 861057 - RNA, 13 nt, Homo sapiens
ucuccaucaccuu

SEQ ID NO: 861058 - RNA, 19 nt, Homo sapiens
ucucccuggccccagugac

SEQ ID NO: 861059 - RNA, 14 nt, Homo sapiens
ucuccuuuguccau

SEQ ID NO: 861060 - RNA, 21 nt, Homo sapiens
ucucuaucauguugaagucaa

SEQ ID NO: 861061 - RNA, 14 nt, Homo sapiens
ucucugagcaguga

SEQ ID NO: 861062 - RNA, 15 nt, Homo sapiens
ucucugagcagugaa

SEQ ID NO: 861063 - RNA, 16 nt, Homo sapiens
ucucuguuuacccucc

SEQ ID NO: 861064 - RNA, 17 nt, Homo sapiens
ucucuuuuccacugaca

SEQ ID NO: 861065 - RNA, 19 nt, Homo sapiens
ucugagcagugaaugauuc

SEQ ID NO: 861066 - RNA, 23 nt, Homo sapiens
ucugagcccugcccucacuccac

SEQ ID NO: 861067 - RNA, 14 nt, Homo sapiens
ucugagcugugcag

SEQ ID NO: 861068 - RNA, 20 nt, Homo sapiens
ucugcgugucaccugugcuu

SEQ ID NO: 861069 - RNA, 17 nt, Homo sapiens
ucugcuaugucugugau

SEQ ID NO: 861070 - RNA, 15 nt, Homo sapiens
ucugucaaugucuug

SEQ ID NO: 861071 - RNA, 16 nt, Homo sapiens
ucugucucauaugauu

SEQ ID NO: 861072 - RNA, 17 nt, Homo sapiens
ucuguuccccauggcca

SEQ ID NO: 861073 - RNA, 12 nt, Homo sapiens
ucuuaaacuaca

SEQ ID NO: 861074 - RNA, 19 nt, Homo sapiens
ucuuaggguacagcccagg

SEQ ID NO: 861075 - RNA, 22 nt, Homo sapiens
ucuuauuuaaauuuucagaaag

SEQ ID NO: 861076 - RNA, 14 nt, Homo sapiens
ucuucaccauuugg

SEQ ID NO: 861077 - RNA, 21 nt, Homo sapiens
ucuucauaauuucuucacuca

SEQ ID NO: 861078 - RNA, 22 nt, Homo sapiens
ucuuccaaucuccaucaccuuu

SEQ ID NO: 861079 - RNA, 13 nt, Homo sapiens
ucuucuccacugg

SEQ ID NO: 861080 - RNA, 21 nt, Homo sapiens
ucuucuucucaagcacugaca

SEQ ID NO: 861081 - RNA, 23 nt, Homo sapiens
ucuucuuugacuauaacaaaauc

SEQ ID NO: 861082 - RNA, 16 nt, Homo sapiens
ucuugaguuuagugau

SEQ ID NO: 861083 - RNA, 21 nt, Homo sapiens
ucuugcuauggggagaaaaga

SEQ ID NO: 861084 - RNA, 18 nt, Homo sapiens
ucuuguaaacauugccug

SEQ ID NO: 861085 - RNA, 16 nt, Homo sapiens
ucuuugagucaaguca

SEQ ID NO: 861086 - RNA, 14 nt, Homo sapiens
ucuuuggugccagc

SEQ ID NO: 861087 - RNA, 17 nt, Homo sapiens
ucuuuucgccguggcug

SEQ ID NO: 861088 - RNA, 12 nt, Homo sapiens
ugaaaaaugccu

SEQ ID NO: 861089 - RNA, 13 nt, Homo sapiens
ugaaaaaugccuc

SEQ ID NO: 861090 - RNA, 17 nt, Homo sapiens
ugaaaacacugugcaca

SEQ ID NO: 861091 - RNA, 17 nt, Homo sapiens
ugaaaaucaacccaaua

SEQ ID NO: 861092 - RNA, 20 nt, Homo sapiens
ugaaaaugcuguauuaguca

SEQ ID NO: 861093 - RNA, 17 nt, Homo sapiens
ugaaacuugugcuauag

SEQ ID NO: 861094 - RNA, 12 nt, Homo sapiens
ugaaauccacac

SEQ ID NO: 861095 - RNA, 13 nt, Homo sapiens
ugaaauugccaaa

SEQ ID NO: 861096 - RNA, 19 nt, Homo sapiens
ugaaccugagguugcuuua

SEQ ID NO: 861097 - RNA, 19 nt, Homo sapiens
ugaacguuuucucuucacc

SEQ ID NO: 861098 - RNA, 13 nt, Homo sapiens
ugaagcacaaaaa

SEQ ID NO: 861099 - RNA, 13 nt, Homo sapiens
ugaagccacagca

SEQ ID NO: 861100 - RNA, 16 nt, Homo sapiens
ugaagcccacccugca

SEQ ID NO: 861101 - RNA, 22 nt, Homo sapiens
ugaagcccacccugcaccucau

SEQ ID NO: 861102 - RNA, 14 nt, Homo sapiens
ugaaguaagcaaag

SEQ ID NO: 861103 - RNA, 22 nt, Homo sapiens
ugaaucacaguauacgcuccau

SEQ ID NO: 861104 - RNA, 17 nt, Homo sapiens
ugaaucuuggugucuac

SEQ ID NO: 861105 - RNA, 19 nt, Homo sapiens
ugaauuuguagacauacuu

SEQ ID NO: 861106 - RNA, 15 nt, Homo sapiens
ugacacaggggacac

SEQ ID NO: 861107 - RNA, 17 nt, Homo sapiens
ugaccagagcaccucag

SEQ ID NO: 861108 - RNA, 21 nt, Homo sapiens
ugaccuugaugucuugagagc

SEQ ID NO: 861109 - RNA, 22 nt, Homo sapiens
ugacuguugcuguaaaagugaa

SEQ ID NO: 861110 - RNA, 15 nt, Homo sapiens
ugagaucagucagcu

SEQ ID NO: 861111 - RNA, 21 nt, Homo sapiens
ugagcauuguggcugucagca

SEQ ID NO: 861112 - RNA, 11 nt, Homo sapiens
ugagcauuuag

SEQ ID NO: 861113 - RNA, 22 nt, Homo sapiens
ugagccuuuuauuaacauauau

SEQ ID NO: 861114 - RNA, 21 nt, Homo sapiens
ugagcuuaagaauuuugagca

SEQ ID NO: 861115 - RNA, 19 nt, Homo sapiens
ugaggcuaaaacaaaucuc

SEQ ID NO: 861116 - RNA, 14 nt, Homo sapiens
ugagggcaggguuc

SEQ ID NO: 861117 - RNA, 19 nt, Homo sapiens
ugaguuacuaucaugucaa

SEQ ID NO: 861118 - RNA, 19 nt, Homo sapiens
ugaguucucauccacagag

SEQ ID NO: 861119 - RNA, 14 nt, Homo sapiens
ugaguuuucagugg

SEQ ID NO: 861120 - RNA, 21 nt, Homo sapiens
ugauauauaaaugugauugca

SEQ ID NO: 861121 - RNA, 13 nt, Homo sapiens
ugauauugcagcu

SEQ ID NO: 861122 - RNA, 17 nt, Homo sapiens
ugauccucacugagaag

SEQ ID NO: 861123 - RNA, 23 nt, Homo sapiens
ugaucggagccuccucucucaaa

SEQ ID NO: 861124 - RNA, 18 nt, Homo sapiens
ugaugaaauguaaauacu

SEQ ID NO: 861125 - RNA, 22 nt, Homo sapiens
ugauguuuuacuuuucacagua

SEQ ID NO: 861126 - RNA, 13 nt, Homo sapiens
ugauucuaaaggg

SEQ ID NO: 861127 - RNA, 16 nt, Homo sapiens
ugauucuccucuccca

SEQ ID NO: 861128 - RNA, 16 nt, Homo sapiens
ugauugccauuucuuc

SEQ ID NO: 861129 - RNA, 13 nt, Homo sapiens
ugauuugcaacuu

SEQ ID NO: 861130 - RNA, 16 nt, Homo sapiens
ugcaaaaggacucuca

SEQ ID NO: 861131 - RNA, 20 nt, Homo sapiens
ugcaaagacugaguguucaa

SEQ ID NO: 861132 - RNA, 21 nt, Homo sapiens
ugcaauggaauauaaauauca

SEQ ID NO: 861133 - RNA, 13 nt, Homo sapiens
ugcacacuuugcc

SEQ ID NO: 861134 - RNA, 21 nt, Homo sapiens
ugcagaaacuaccagauuuga

SEQ ID NO: 861135 - RNA, 15 nt, Homo sapiens
ugcagacccugccag

SEQ ID NO: 861136 - RNA, 19 nt, Homo sapiens
ugcaguccucggcagcucc

SEQ ID NO: 861137 - RNA, 22 nt, Homo sapiens
ugcauaaaugcgauccacagaa

SEQ ID NO: 861138 - RNA, 20 nt, Homo sapiens
ugcauauccaacaugugcuc

SEQ ID NO: 861139 - RNA, 15 nt, Homo sapiens
ugcauauucuuaugu

SEQ ID NO: 861140 - RNA, 21 nt, Homo sapiens
ugcaucauucuuucugcuaua

SEQ ID NO: 861141 - RNA, 17 nt, Homo sapiens
ugcauuaucuaugauau

SEQ ID NO: 861142 - RNA, 19 nt, Homo sapiens
uucccuugugugagggcaa

SEQ ID NO: 861143 - RNA, 23 nt, Homo sapiens
uucgauacaccgggccuggagaa

SEQ ID NO: 861144 - RNA, 13 nt, Homo sapiens
uucuacuuugcca

SEQ ID NO: 861145 - RNA, 14 nt, Homo sapiens
uucuacuuugccac

SEQ ID NO: 861146 - RNA, 14 nt, Homo sapiens
uucuaugaggcaac

SEQ ID NO: 861147 - RNA, 13 nt, Homo sapiens
uucuccuccaugg

SEQ ID NO: 861148 - RNA, 21 nt, Homo sapiens
uucugaauuuguagacauacu

SEQ ID NO: 861149 - RNA, 16 nt, Homo sapiens
uucugauuucucuuca

SEQ ID NO: 861150 - RNA, 17 nt, Homo sapiens
uucuggggcuuugccau

SEQ ID NO: 861151 - RNA, 21 nt, Homo sapiens
uucuguucugucucauaugau

SEQ ID NO: 861152 - RNA, 17 nt, Homo sapiens
uucuuauguugcccagu

SEQ ID NO: 861153 - RNA, 13 nt, Homo sapiens
uucuucuucucaa

SEQ ID NO: 861154 - RNA, 21 nt, Homo sapiens
uucuucuuugacuauaacaaa

SEQ ID NO: 861155 - RNA, 14 nt, Homo sapiens
uucuuucauguaag

SEQ ID NO: 861156 - RNA, 19 nt, Homo sapiens
uucuuuccuucugaucuga

SEQ ID NO: 861157 - RNA, 12 nt, Homo sapiens
uugaacauacuu

SEQ ID NO: 861158 - RNA, 17 nt, Homo sapiens
uugacaaccaugagacc

SEQ ID NO: 861159 - RNA, 14 nt, Homo sapiens
uugaugcaugcacu

SEQ ID NO: 861160 - RNA, 13 nt, Homo sapiens
uugauuaccuagu

SEQ ID NO: 861161 - RNA, 20 nt, Homo sapiens
uugcauaguaccaaucauuu

SEQ ID NO: 861162 - RNA, 19 nt, Homo sapiens
uugccauuaaacuuaccug

SEQ ID NO: 861163 - RNA, 13 nt, Homo sapiens
uugcccagugugu

SEQ ID NO: 861164 - RNA, 21 nt, Homo sapiens
uugccucugaagccuauguau

SEQ ID NO: 861165 - RNA, 19 nt, Homo sapiens
uugccuucuagacacugaa

SEQ ID NO: 861166 - RNA, 23 nt, Homo sapiens
uugcuggggcucgugcccugcau

SEQ ID NO: 861167 - RNA, 21 nt, Homo sapiens
uuggaacuuuuauuacugggg

SEQ ID NO: 861168 - RNA, 13 nt, Homo sapiens
uugggaagacaug

SEQ ID NO: 861169 - RNA, 20 nt, Homo sapiens
uugggaggcuggaguggaaa

SEQ ID NO: 861170 - RNA, 10 nt, Homo sapiens
uugggcucca

SEQ ID NO: 861171 - RNA, 13 nt, Homo sapiens
uuggguuccagac

SEQ ID NO: 861172 - RNA, 15 nt, Homo sapiens
uuguaagguacugaa

SEQ ID NO: 861173 - RNA, 14 nt, Homo sapiens
uuguccaugauguc

SEQ ID NO: 861174 - RNA, 16 nt, Homo sapiens
uuguccaugauguccu

SEQ ID NO: 861175 - RNA, 14 nt, Homo sapiens
uugucuggcugugg

SEQ ID NO: 861176 - RNA, 18 nt, Homo sapiens
uuguuagugauuugcuau

SEQ ID NO: 861177 - RNA, 15 nt, Homo sapiens
uuguucagaugcuuc

SEQ ID NO: 861178 - RNA, 19 nt, Homo sapiens
uuguuguuuauaaagggag

SEQ ID NO: 861179 - RNA, 19 nt, Homo sapiens
uuuaaaaaaaaacauucaa

SEQ ID NO: 861180 - RNA, 14 nt, Homo sapiens
uuuaaaaucuguca

SEQ ID NO: 861181 - RNA, 22 nt, Homo sapiens
uuuaaagucuucuuucauguaa

SEQ ID NO: 861182 - RNA, 23 nt, Homo sapiens
uuuaaauacagucuuccauuugc

SEQ ID NO: 861183 - RNA, 14 nt, Homo sapiens
uuuaagaaauaacu

SEQ ID NO: 861184 - RNA, 22 nt, Homo sapiens
uuuaagacuuuucuuuccuuaa

SEQ ID NO: 861185 - RNA, 23 nt, Homo sapiens
uuuacagaaucaaaugcaauuuu

SEQ ID NO: 861186 - RNA, 20 nt, Homo sapiens
uuuacuaucuuuucaucuca

SEQ ID NO: 861187 - RNA, 16 nt, Homo sapiens
uuuagaaaugauuuca

SEQ ID NO: 861188 - RNA, 18 nt, Homo sapiens
uuuagacccugcauuuau

SEQ ID NO: 861189 - RNA, 21 nt, Homo sapiens
uuuaucuauggcacccaugca

SEQ ID NO: 861190 - RNA, 18 nt, Homo sapiens
uuuauguuuuaauauccu

SEQ ID NO: 861191 - RNA, 18 nt, Homo sapiens
uuucaaauuggagcuuca

SEQ ID NO: 861192 - RNA, 13 nt, Homo sapiens
uuucaccauuuga

SEQ ID NO: 861193 - RNA, 14 nt, Homo sapiens
uuucaccuucauau

SEQ ID NO: 861194 - RNA, 18 nt, Homo sapiens
uuucagguuccaaucaga

SEQ ID NO: 861195 - RNA, 19 nt, Homo sapiens
uuucagguuccaaucagaa

SEQ ID NO: 861196 - RNA, 15 nt, Homo sapiens
aagauucauccauuu

SEQ ID NO: 861197 - RNA, 12 nt, Homo sapiens
aagcacuugugg

SEQ ID NO: 861198 - RNA, 15 nt, Homo sapiens
aagcagaccacugau

SEQ ID NO: 861199 - RNA, 17 nt, Homo sapiens
aagcagucuuuuucuac

SEQ ID NO: 861200 - RNA, 18 nt, Homo sapiens
aagccuauguaugccaug

SEQ ID NO: 861201 - RNA, 21 nt, Homo sapiens
aagccucagagaauugcugau

SEQ ID NO: 861202 - RNA, 21 nt, Homo sapiens
aaggacccuauauguggcauu

SEQ ID NO: 861203 - RNA, 16 nt, Homo sapiens
aaggagccccauuccu

SEQ ID NO: 861204 - RNA, 16 nt, Homo sapiens
aaggaugagcauuuag

SEQ ID NO: 861205 - RNA, 20 nt, Homo sapiens
aaggcuucugggacuugaaa

SEQ ID NO: 861206 - RNA, 20 nt, Homo sapiens
aagggaagccgccuuugcaa

SEQ ID NO: 861207 - RNA, 16 nt, Homo sapiens
aagggacauauucauu

SEQ ID NO: 861208 - RNA, 17 nt, Homo sapiens
aagggggcuauucccug

SEQ ID NO: 861209 - RNA, 18 nt, Homo sapiens
aaggguucaccaggucag

SEQ ID NO: 861210 - RNA, 22 nt, Homo sapiens
aaggguucaccaggucagggag

SEQ ID NO: 861211 - RNA, 17 nt, Homo sapiens
aaggugagcaaagggcu

SEQ ID NO: 861212 - RNA, 18 nt, Homo sapiens
aaguaaaauuauucccug

SEQ ID NO: 861213 - RNA, 17 nt, Homo sapiens
aaguaaguuugauuuca

SEQ ID NO: 861214 - RNA, 22 nt, Homo sapiens
aaguagacuucauuuuuccuaa

SEQ ID NO: 861215 - RNA, 23 nt, Homo sapiens
aaguagacuucauuuuuccuaac

SEQ ID NO: 861216 - RNA, 14 nt, Homo sapiens
aagucaaagacauu

SEQ ID NO: 861217 - RNA, 21 nt, Homo sapiens
aagucaaauuuggauuuucca

SEQ ID NO: 861218 - RNA, 14 nt, Homo sapiens
aagucaaccugccu

SEQ ID NO: 861219 - RNA, 13 nt, Homo sapiens
aagucacugcaca

SEQ ID NO: 861220 - RNA, 21 nt, Homo sapiens
aagucccagggagcucugcau

SEQ ID NO: 861221 - RNA, 17 nt, Homo sapiens
aagugggagugggagag

SEQ ID NO: 861222 - RNA, 14 nt, Homo sapiens
aagugucuaaugca

SEQ ID NO: 861223 - RNA, 16 nt, Homo sapiens
aagugucuaaugcauu

SEQ ID NO: 861224 - RNA, 13 nt, Homo sapiens
aaguuagcauuuc

SEQ ID NO: 861225 - RNA, 22 nt, Homo sapiens
aaguugcugugccccaucagca

SEQ ID NO: 861226 - RNA, 14 nt, Homo sapiens
aaguuggcuucuaa

SEQ ID NO: 861227 - RNA, 20 nt, Homo sapiens
aauaaaccaucaucuugcca

SEQ ID NO: 861228 - RNA, 19 nt, Homo sapiens
aauaaaguuauuacucuga

SEQ ID NO: 861229 - RNA, 18 nt, Homo sapiens
aauaaauccaagacuguc

SEQ ID NO: 861230 - RNA, 13 nt, Homo sapiens
aauaaccaauccu

SEQ ID NO: 861231 - RNA, 14 nt, Homo sapiens
aauaauaccuaagc

SEQ ID NO: 861232 - RNA, 20 nt, Homo sapiens
aauaauccagaaaaacugug

SEQ ID NO: 861233 - RNA, 21 nt, Homo sapiens
aauacagucuuccauuugcaa

SEQ ID NO: 861234 - RNA, 17 nt, Homo sapiens
aauacccuuggcacuga

SEQ ID NO: 861235 - RNA, 13 nt, Homo sapiens
aauacucuccuaa

SEQ ID NO: 861236 - RNA, 19 nt, Homo sapiens
aauaugcacaauagcaguu

SEQ ID NO: 861237 - RNA, 14 nt, Homo sapiens
aaucaaaugcaauu

SEQ ID NO: 861238 - RNA, 21 nt, Homo sapiens
aaucaacuugucacaaaguga

SEQ ID NO: 861239 - RNA, 21 nt, Homo sapiens
aaucaauacccuuggcacuga

SEQ ID NO: 861240 - RNA, 12 nt, Homo sapiens
aaucacaguaua

SEQ ID NO: 861241 - RNA, 17 nt, Homo sapiens
aaucagcauucucacuc

SEQ ID NO: 861242 - RNA, 21 nt, Homo sapiens
aauccugaggggauaucccua

SEQ ID NO: 861243 - RNA, 20 nt, Homo sapiens
aauccuguccucagcuucuu

SEQ ID NO: 861244 - RNA, 19 nt, Homo sapiens
aauccuuuacuguuaguca

SEQ ID NO: 861245 - RNA, 15 nt, Homo sapiens
aaugagagagugugg

SEQ ID NO: 861246 - RNA, 15 nt, Homo sapiens
aaugaguaaaaucac

SEQ ID NO: 861247 - RNA, 19 nt, Homo sapiens
aaugcauauccaacaugug

SEQ ID NO: 861248 - RNA, 17 nt, Homo sapiens
aaugcuauaacuauguu

SEQ ID NO: 861249 - RNA, 20 nt, Homo sapiens
aaugcuguaccuuucugaca

SEQ ID NO: 861250 - RNA, 17 nt, Homo sapiens
aauggaauauaaauauc

SEQ ID NO: 861251 - RNA, 19 nt, Homo sapiens
aaugguccuguuaugucau

SEQ ID NO: 861252 - RNA, 18 nt, Homo sapiens
aaugguugggacaauggc

SEQ ID NO: 861253 - RNA, 12 nt, Homo sapiens
aaugugauugca

SEQ ID NO: 861254 - RNA, 21 nt, Homo sapiens
aauguuaucaguauuaagcua

SEQ ID NO: 861255 - RNA, 21 nt, Homo sapiens
aauguuauuuuuuaauuauua

SEQ ID NO: 861256 - RNA, 22 nt, Homo sapiens
aauguuauuuuuuaauuauuau

SEQ ID NO: 861257 - RNA, 15 nt, Homo sapiens
aauguuggcuagucu

SEQ ID NO: 861258 - RNA, 20 nt, Homo sapiens
aauuaaaaccauuaccuuaa

SEQ ID NO: 861259 - RNA, 17 nt, Homo sapiens
aauuaauaucacagcau

SEQ ID NO: 861260 - RNA, 13 nt, Homo sapiens
aauuagaugaacu

SEQ ID NO: 861261 - RNA, 15 nt, Homo sapiens
aauuaguaacaugug

SEQ ID NO: 861262 - RNA, 22 nt, Homo sapiens
aauuauuugcauaacaauuccu

SEQ ID NO: 861263 - RNA, 15 nt, Homo sapiens
aauucggugugcacc

SEQ ID NO: 861264 - RNA, 20 nt, Homo sapiens
aauucuagcuuugagcuuaa

SEQ ID NO: 861265 - RNA, 16 nt, Homo sapiens
aauucugaacuuuuca

SEQ ID NO: 861266 - RNA, 12 nt, Homo sapiens
aauugcauuucc

SEQ ID NO: 861267 - RNA, 17 nt, Homo sapiens
aauugugaucagaccau

SEQ ID NO: 861268 - RNA, 19 nt, Homo sapiens
aauuguuugauauugucac

SEQ ID NO: 861269 - RNA, 20 nt, Homo sapiens
aauuuccggccaacaguuaa

SEQ ID NO: 861270 - RNA, 17 nt, Homo sapiens
aauuuguagacauacuu

SEQ ID NO: 861271 - RNA, 17 nt, Homo sapiens
aauuuucauuggaugca

SEQ ID NO: 861272 - RNA, 14 nt, Homo sapiens
acaaagaaauagca

SEQ ID NO: 861273 - RNA, 15 nt, Homo sapiens
acaaagggugggcau

SEQ ID NO: 861274 - RNA, 20 nt, Homo sapiens
acaaaggugauuuuccugug

SEQ ID NO: 861275 - RNA, 19 nt, Homo sapiens
acaaaugauuuacacugac

SEQ ID NO: 861276 - RNA, 17 nt, Homo sapiens
acaaauugcuugaaaga

SEQ ID NO: 861277 - RNA, 16 nt, Homo sapiens
acaacuaugauuugga

SEQ ID NO: 861278 - RNA, 12 nt, Homo sapiens
acaagaagccac

SEQ ID NO: 861279 - RNA, 19 nt, Homo sapiens
acaaucaucaucauucuca

SEQ ID NO: 861280 - RNA, 21 nt, Homo sapiens
acaaugguuuuguuucuuucc

SEQ ID NO: 861281 - RNA, 15 nt, Homo sapiens
acaaugugcacugaa

SEQ ID NO: 861282 - RNA, 13 nt, Homo sapiens
acaauuuaccagc

SEQ ID NO: 861283 - RNA, 15 nt, Homo sapiens
acacacacucuucaa

SEQ ID NO: 861284 - RNA, 22 nt, Homo sapiens
acacagcagcuguucaacaaga

SEQ ID NO: 861285 - RNA, 16 nt, Homo sapiens
acacaggggacacuga

SEQ ID NO: 861286 - RNA, 18 nt, Homo sapiens
acaccaugaagaugccau

SEQ ID NO: 861287 - RNA, 23 nt, Homo sapiens
acacccuauauuuugcauaguac

SEQ ID NO: 861288 - RNA, 13 nt, Homo sapiens
acacccuucccca

SEQ ID NO: 861289 - RNA, 14 nt, Homo sapiens
acacuaacauauaa

SEQ ID NO: 861290 - RNA, 18 nt, Homo sapiens
acacuaacauauaauguu

SEQ ID NO: 861291 - RNA, 15 nt, Homo sapiens
acacucuagugccau

SEQ ID NO: 861292 - RNA, 16 nt, Homo sapiens
acacucuagugccaua

SEQ ID NO: 861293 - RNA, 19 nt, Homo sapiens
acacugacuguugcuguaa

SEQ ID NO: 861294 - RNA, 18 nt, Homo sapiens
caucgcaguggacugugu

SEQ ID NO: 861295 - RNA, 17 nt, Homo sapiens
caucuaacaaagucaag

SEQ ID NO: 861296 - RNA, 20 nt, Homo sapiens
caucuacagaccugcggcuu

SEQ ID NO: 861297 - RNA, 17 nt, Homo sapiens
caucuuaguauuugcau

SEQ ID NO: 861298 - RNA, 14 nt, Homo sapiens
caugaaaacagaaa

SEQ ID NO: 861299 - RNA, 16 nt, Homo sapiens
caugaagauucuuucc

SEQ ID NO: 861300 - RNA, 13 nt, Homo sapiens
caugaauaugauu

SEQ ID NO: 861301 - RNA, 22 nt, Homo sapiens
caugacagucagcaacaugaua

SEQ ID NO: 861302 - RNA, 19 nt, Homo sapiens
caugagaccacuguuauca

SEQ ID NO: 861303 - RNA, 23 nt, Homo sapiens
caugauaccuggauccagccauu

SEQ ID NO: 861304 - RNA, 17 nt, Homo sapiens
caugaucaucacaauca

SEQ ID NO: 861305 - RNA, 22 nt, Homo sapiens
caugauuucauuucaacuguuu

SEQ ID NO: 861306 - RNA, 15 nt, Homo sapiens
caugcccagcuugga

SEQ ID NO: 861307 - RNA, 22 nt, Homo sapiens
caugcccagcuuggagugccac

SEQ ID NO: 861308 - RNA, 22 nt, Homo sapiens
cauggaugaauaaauguuauag

SEQ ID NO: 861309 - RNA, 21 nt, Homo sapiens
cauggccacauccaacauuuc

SEQ ID NO: 861310 - RNA, 21 nt, Homo sapiens
cauggccagguggccacucca

SEQ ID NO: 861311 - RNA, 12 nt, Homo sapiens
cauggcuacuac

SEQ ID NO: 861312 - RNA, 22 nt, Homo sapiens
cauggcuuaguuuucauacaca

SEQ ID NO: 861313 - RNA, 17 nt, Homo sapiens
cauguaaacugugcacc

SEQ ID NO: 861314 - RNA, 14 nt, Homo sapiens
cauguaaguagcaa

SEQ ID NO: 861315 - RNA, 21 nt, Homo sapiens
caugucguaguuacucucagg

SEQ ID NO: 861316 - RNA, 14 nt, Homo sapiens
cauguucccaaaau

SEQ ID NO: 861317 - RNA, 15 nt, Homo sapiens
cauuaauucaauuaa

SEQ ID NO: 861318 - RNA, 16 nt, Homo sapiens
cauuaccuugugcuaa

SEQ ID NO: 861319 - RNA, 14 nt, Homo sapiens
cauuauuacuccuu

SEQ ID NO: 861320 - RNA, 20 nt, Homo sapiens
cauuauuacuccuugccauu

SEQ ID NO: 861321 - RNA, 21 nt, Homo sapiens
cauuauuacuccuugccauuu

SEQ ID NO: 861322 - RNA, 17 nt, Homo sapiens
cauucagggauagcacu

SEQ ID NO: 861323 - RNA, 17 nt, Homo sapiens
cauucccucucauccag

SEQ ID NO: 861324 - RNA, 13 nt, Homo sapiens
cauucccuuucau

SEQ ID NO: 861325 - RNA, 15 nt, Homo sapiens
cauucgaguguuuca

SEQ ID NO: 861326 - RNA, 18 nt, Homo sapiens
cauucuuucugcuauauu

SEQ ID NO: 861327 - RNA, 17 nt, Homo sapiens
cauuuaaauugacuuca

SEQ ID NO: 861328 - RNA, 13 nt, Homo sapiens
cauuuaccuggaa

SEQ ID NO: 861329 - RNA, 22 nt, Homo sapiens
cauuuaguuugauuauucagug

SEQ ID NO: 861330 - RNA, 13 nt, Homo sapiens
cauuuauagcaua

SEQ ID NO: 861331 - RNA, 15 nt, Homo sapiens
cauuuccucaggcaa

SEQ ID NO: 861332 - RNA, 16 nt, Homo sapiens
cauuugaaaucuauga

SEQ ID NO: 861333 - RNA, 22 nt, Homo sapiens
ccaagcaggaaaugaaaauguc

SEQ ID NO: 861334 - RNA, 21 nt, Homo sapiens
ccaagccaggguuccagacag

SEQ ID NO: 861335 - RNA, 22 nt, Homo sapiens
ccaaguuuugaaaggcuuuccu

SEQ ID NO: 861336 - RNA, 18 nt, Homo sapiens
ccaauuagcauuccauca

SEQ ID NO: 861337 - RNA, 15 nt, Homo sapiens
ccacaaaaguacaau

SEQ ID NO: 861338 - RNA, 12 nt, Homo sapiens
ccacacuggccg

SEQ ID NO: 861339 - RNA, 16 nt, Homo sapiens
ccacaggcagcauuua

SEQ ID NO: 861340 - RNA, 17 nt, Homo sapiens
ccaccccuaaagagaua

SEQ ID NO: 861341 - RNA, 21 nt, Homo sapiens
ccaccucuggccaaauaugca

SEQ ID NO: 861342 - RNA, 13 nt, Homo sapiens
ccaccuugcacua

SEQ ID NO: 861343 - RNA, 17 nt, Homo sapiens
cuuuguggauacuauua

SEQ ID NO: 861344 - RNA, 21 nt, Homo sapiens
cuuuuaaacccuauugguaaa

SEQ ID NO: 861345 - RNA, 15 nt, Homo sapiens
cuuuuauuacugggg

SEQ ID NO: 861346 - RNA, 17 nt, Homo sapiens
cuuuucaaacacacaca

SEQ ID NO: 861347 - RNA, 22 nt, Homo sapiens
cuuuucaucucauuaauucaau

SEQ ID NO: 861348 - RNA, 13 nt, Homo sapiens
cuuuuccaaacac

SEQ ID NO: 861349 - RNA, 19 nt, Homo sapiens
cuuuugcauaagugcauga

SEQ ID NO: 861350 - RNA, 15 nt, Homo sapiens
cuuuugguaugugac

SEQ ID NO: 861351 - RNA, 18 nt, Homo sapiens
cuuuuguaagguacugaa

SEQ ID NO: 861352 - RNA, 17 nt, Homo sapiens
gaaaacaguauuuucca

SEQ ID NO: 861353 - RNA, 22 nt, Homo sapiens
gaaaaggcacgcuggcuuguga

SEQ ID NO: 861354 - RNA, 15 nt, Homo sapiens
gaaaaucaacccaau

SEQ ID NO: 861355 - RNA, 22 nt, Homo sapiens
gaaacaacaauuucuacuuuga

SEQ ID NO: 861356 - RNA, 17 nt, Homo sapiens
gaaaccggguggcagcg

SEQ ID NO: 861357 - RNA, 21 nt, Homo sapiens
gaaagcagccaaaccuuuccu

SEQ ID NO: 861358 - RNA, 15 nt, Homo sapiens
gaaaggcuucuggga

SEQ ID NO: 861359 - RNA, 20 nt, Homo sapiens
gaaauccaacuccaggguua

SEQ ID NO: 861360 - RNA, 15 nt, Homo sapiens
gaaccaggcaacuug

SEQ ID NO: 861361 - RNA, 16 nt, Homo sapiens
gaaccaggcaacuugg

SEQ ID NO: 861362 - RNA, 19 nt, Homo sapiens
gaagcuccgugagccucag

SEQ ID NO: 861363 - RNA, 14 nt, Homo sapiens
gaaggcaaacccau

SEQ ID NO: 861364 - RNA, 15 nt, Homo sapiens
gaagggacauauuca

SEQ ID NO: 861365 - RNA, 13 nt, Homo sapiens
gaagguugcaccu

SEQ ID NO: 861366 - RNA, 19 nt, Homo sapiens
gaaguaagcaaagacuuuc

SEQ ID NO: 861367 - RNA, 21 nt, Homo sapiens
gaaguaagcaaagacuuuccu

SEQ ID NO: 861368 - RNA, 15 nt, Homo sapiens
gaagucaugcguuua

SEQ ID NO: 861369 - RNA, 17 nt, Homo sapiens
gaagugggagugggaga

SEQ ID NO: 861370 - RNA, 13 nt, Homo sapiens
gaauaauccagaa

SEQ ID NO: 861371 - RNA, 16 nt, Homo sapiens
gaauauaaacacauaa

SEQ ID NO: 861372 - RNA, 20 nt, Homo sapiens
gaaucucuuuuugcuuucga

SEQ ID NO: 861373 - RNA, 15 nt, Homo sapiens
gaauguuaucaguau

SEQ ID NO: 861374 - RNA, 16 nt, Homo sapiens
gaauuaguaacuguau

SEQ ID NO: 861375 - RNA, 22 nt, Homo sapiens
gaauuucuagacaguauugcca

SEQ ID NO: 861376 - RNA, 18 nt, Homo sapiens
gaauuugaguuggaucau

SEQ ID NO: 861377 - RNA, 16 nt, Homo sapiens
gacaaauguugaccuu

SEQ ID NO: 861378 - RNA, 13 nt, Homo sapiens
gacaacuucugaa

SEQ ID NO: 861379 - RNA, 22 nt, Homo sapiens
gacaagccaggcccucucugca

SEQ ID NO: 861380 - RNA, 17 nt, Homo sapiens
gacacaggggacacuga

SEQ ID NO: 861381 - RNA, 16 nt, Homo sapiens
gacacugaaccuuguu

SEQ ID NO: 861382 - RNA, 20 nt, Homo sapiens
gacacugcgaacucucagga

SEQ ID NO: 861383 - RNA, 15 nt, Homo sapiens
gacagaaauaugauu

SEQ ID NO: 861384 - RNA, 17 nt, Homo sapiens
gacaguguuuucuggga

SEQ ID NO: 861385 - RNA, 16 nt, Homo sapiens
gacauauucacaguga

SEQ ID NO: 861386 - RNA, 19 nt, Homo sapiens
gacaucccccuccuugccg

SEQ ID NO: 861387 - RNA, 19 nt, Homo sapiens
gacauuuuaaacacuuaca

SEQ ID NO: 861388 - RNA, 18 nt, Homo sapiens
gacccuggaagcagggac

SEQ ID NO: 861389 - RNA, 17 nt, Homo sapiens
gaccuggugcugccucu

SEQ ID NO: 861390 - RNA, 17 nt, Homo sapiens
gaccuguaaucauauaa

SEQ ID NO: 861391 - RNA, 20 nt, Homo sapiens
gacuauggcucuacuuucag

SEQ ID NO: 861392 - RNA, 16 nt, Homo sapiens
gacucuuuuccaaaca

SEQ ID NO: 861393 - RNA, 14 nt, Homo sapiens
gacuuagugcaaca

SEQ ID NO: 861394 - RNA, 17 nt, Homo sapiens
gacuuagugcaacaggu

SEQ ID NO: 861395 - RNA, 21 nt, Homo sapiens
gacuucagacucucuccucuc

SEQ ID NO: 861396 - RNA, 20 nt, Homo sapiens
gacuucauuuuuccuaacag

SEQ ID NO: 861397 - RNA, 19 nt, Homo sapiens
gagaaggucagauuagggc

SEQ ID NO: 861398 - RNA, 21 nt, Homo sapiens
gagacugucucaagagggcac

SEQ ID NO: 861399 - RNA, 20 nt, Homo sapiens
gagacuuugacucuccagaa

SEQ ID NO: 861400 - RNA, 20 nt, Homo sapiens
gagagaaucccuagucuuca

SEQ ID NO: 861401 - RNA, 21 nt, Homo sapiens
gagagccaaggccuaugccac

SEQ ID NO: 861402 - RNA, 16 nt, Homo sapiens
gagaggaaaagccagu

SEQ ID NO: 861403 - RNA, 16 nt, Homo sapiens
gagaguggcuccuccc

SEQ ID NO: 861404 - RNA, 13 nt, Homo sapiens
gagaguucucaca

SEQ ID NO: 861405 - RNA, 15 nt, Homo sapiens
gagaucuaggugagg

SEQ ID NO: 861406 - RNA, 21 nt, Homo sapiens
gagcagugaaugauucagugu

SEQ ID NO: 861407 - RNA, 17 nt, Homo sapiens
gagccgggucugccucu

SEQ ID NO: 861408 - RNA, 17 nt, Homo sapiens
gagcugcuguccaggaa

SEQ ID NO: 861409 - RNA, 11 nt, Homo sapiens
gagcugugcag

SEQ ID NO: 861410 - RNA, 15 nt, Homo sapiens
gaggacagaaccaac

SEQ ID NO: 861411 - RNA, 22 nt, Homo sapiens
gaggaggauggucaucgugaca

SEQ ID NO: 861412 - RNA, 17 nt, Homo sapiens
gaggaugauguaauuaa

SEQ ID NO: 861413 - RNA, 23 nt, Homo sapiens
gaggccacaugauacuuauucaa

SEQ ID NO: 861414 - RNA, 17 nt, Homo sapiens
gaggugagggaagccug

SEQ ID NO: 861415 - RNA, 17 nt, Homo sapiens
gagucucuucuccacug

SEQ ID NO: 861416 - RNA, 18 nt, Homo sapiens
gagucucuucuccacugg

SEQ ID NO: 861417 - RNA, 23 nt, Homo sapiens
gagugucuuuccacggagccacu

SEQ ID NO: 861418 - RNA, 20 nt, Homo sapiens
gauacagccuuacaauacaa

SEQ ID NO: 861419 - RNA, 23 nt, Homo sapiens
gauaccuggauccagccauuccu

SEQ ID NO: 861420 - RNA, 17 nt, Homo sapiens
uaaacaugaagcacaaa

SEQ ID NO: 861421 - RNA, 12 nt, Homo sapiens
uaaacauugccu

SEQ ID NO: 861422 - RNA, 16 nt, Homo sapiens
uaaagcaggugcccag

SEQ ID NO: 861423 - RNA, 12 nt, Homo sapiens
uaaauacuguuu

SEQ ID NO: 861424 - RNA, 22 nt, Homo sapiens
uaaauaucccagagaacaauca

SEQ ID NO: 861425 - RNA, 22 nt, Homo sapiens
uaaauguuauagcugcauuugu

SEQ ID NO: 861426 - RNA, 20 nt, Homo sapiens
uaaauuauaaguaacuuguc

SEQ ID NO: 861427 - RNA, 21 nt, Homo sapiens
uaaccccacccuuuacauuuu

SEQ ID NO: 861428 - RNA, 21 nt, Homo sapiens
uaacccuuuucaugauuucaa

SEQ ID NO: 861429 - RNA, 21 nt, Homo sapiens
uaaccgagccagcagcugaag

SEQ ID NO: 861430 - RNA, 22 nt, Homo sapiens
uaaccgucaauaggcaaagggg

SEQ ID NO: 861431 - RNA, 14 nt, Homo sapiens
uaacuauguugaua

SEQ ID NO: 861432 - RNA, 22 nt, Homo sapiens
uaagcccacaaucaugccuccc

SEQ ID NO: 861433 - RNA, 23 nt, Homo sapiens
uaaggccggcggcucggggcccc

SEQ ID NO: 861434 - RNA, 18 nt, Homo sapiens
uaaguaaguuugauuuca

SEQ ID NO: 861435 - RNA, 22 nt, Homo sapiens
uaagucaaccugccugacauuu

SEQ ID NO: 861436 - RNA, 15 nt, Homo sapiens
uaauaguacauguca

SEQ ID NO: 861437 - RNA, 22 nt, Homo sapiens
uaauauauguauaugcaauaua

SEQ ID NO: 861438 - RNA, 22 nt, Homo sapiens
uaaucagggaggucauuuuggu

SEQ ID NO: 861439 - RNA, 16 nt, Homo sapiens
uaauuaguaacaugug

SEQ ID NO: 861440 - RNA, 16 nt, Homo sapiens
uacaaugugcacugaa

SEQ ID NO: 861441 - RNA, 17 nt, Homo sapiens
uacacucuagugccaua

SEQ ID NO: 861442 - RNA, 22 nt, Homo sapiens
uacagacccacagagugccauc

SEQ ID NO: 861443 - RNA, 15 nt, Homo sapiens
uacagccaaauugca

SEQ ID NO: 861444 - RNA, 22 nt, Homo sapiens
uacagcuaaucagcauucucac

SEQ ID NO: 861445 - RNA, 20 nt, Homo sapiens
uacaggcauagaguucagac

SEQ ID NO: 861446 - RNA, 21 nt, Homo sapiens
uacaguguaucucgaagucuu

SEQ ID NO: 861447 - RNA, 21 nt, Homo sapiens
uacauuauuacuccuugccau

SEQ ID NO: 861448 - RNA, 22 nt, Homo sapiens
uaccaugucguaguuacucuca

SEQ ID NO: 861449 - RNA, 15 nt, Homo sapiens
uacccuuucccaaac

SEQ ID NO: 861450 - RNA, 20 nt, Homo sapiens
uaccuaguuuguuagugcau

SEQ ID NO: 861451 - RNA, 21 nt, Homo sapiens
uaccuugguucccccacugau

SEQ ID NO: 861452 - RNA, 13 nt, Homo sapiens
uaccuugugcuaa

SEQ ID NO: 861453 - RNA, 12 nt, Homo sapiens
uacuaaauauga

SEQ ID NO: 861454 - RNA, 19 nt, Homo sapiens
uacucugccugaacacugc

SEQ ID NO: 861455 - RNA, 17 nt, Homo sapiens
uacugggacugugcuca

SEQ ID NO: 861456 - RNA, 21 nt, Homo sapiens
uacugggguuuuucuaagaaa

SEQ ID NO: 861457 - RNA, 14 nt, Homo sapiens
uacuuagacccagu

SEQ ID NO: 861458 - RNA, 13 nt, Homo sapiens
uacuugagacugu

SEQ ID NO: 861459 - RNA, 21 nt, Homo sapiens
uacuuugaagucauaccaaug

SEQ ID NO: 861460 - RNA, 17 nt, Homo sapiens
uagaaaacgauuuugaa

SEQ ID NO: 861461 - RNA, 16 nt, Homo sapiens
uagaauggggcuucca

SEQ ID NO: 861462 - RNA, 15 nt, Homo sapiens
uagacaguauugcca

SEQ ID NO: 861463 - RNA, 17 nt, Homo sapiens
uagacuuagccccauga

SEQ ID NO: 861464 - RNA, 16 nt, Homo sapiens
uagagaaaauggaaca

SEQ ID NO: 861465 - RNA, 15 nt, Homo sapiens
uagagaauaaucaua

SEQ ID NO: 861466 - RNA, 13 nt, Homo sapiens
uagagacuguaaa

SEQ ID NO: 861467 - RNA, 15 nt, Homo sapiens
uagaguucagacuuu

SEQ ID NO: 861468 - RNA, 15 nt, Homo sapiens
uagaugaguccuguu

SEQ ID NO: 861469 - RNA, 11 nt, Homo sapiens
uagcugcauuu

SEQ ID NO: 861470 - RNA, 12 nt, Homo sapiens
uaggaacauacu

SEQ ID NO: 861471 - RNA, 16 nt, Homo sapiens
uaggauuuguguuuua

SEQ ID NO: 861472 - RNA, 22 nt, Homo sapiens
uaggauuuguguuuuacaguau

SEQ ID NO: 861473 - RNA, 21 nt, Homo sapiens
uaguaggagcugagcuuucca

SEQ ID NO: 861474 - RNA, 23 nt, Homo sapiens
uauaaagauacagaacucuuuca

SEQ ID NO: 861475 - RNA, 14 nt, Homo sapiens
uauaaauaucacaa

SEQ ID NO: 861476 - RNA, 15 nt, Homo sapiens
uauaaguaacuuguc

SEQ ID NO: 861477 - RNA, 16 nt, Homo sapiens
uauaauugaguuuuca

SEQ ID NO: 861478 - RNA, 21 nt, Homo sapiens
uauacaaugaguaaaaucaca

SEQ ID NO: 861479 - RNA, 18 nt, Homo sapiens
uauagaaaacgauuuuga

SEQ ID NO: 861480 - RNA, 13 nt, Homo sapiens
uauagcugcauuu

SEQ ID NO: 861481 - RNA, 21 nt, Homo sapiens
uauauaaaugugauugcagcu

SEQ ID NO: 861482 - RNA, 15 nt, Homo sapiens
aucauguugaaguca

SEQ ID NO: 861483 - RNA, 14 nt, Homo sapiens
auccacaugggagc

SEQ ID NO: 861484 - RNA, 16 nt, Homo sapiens
auccagagagaagcac

SEQ ID NO: 861485 - RNA, 14 nt, Homo sapiens
auccagccauuccu

SEQ ID NO: 861486 - RNA, 19 nt, Homo sapiens
auccagguaauccaagaua

SEQ ID NO: 861487 - RNA, 14 nt, Homo sapiens
aucccccuccuugc

SEQ ID NO: 861488 - RNA, 15 nt, Homo sapiens
auccuuuacuguuag

SEQ ID NO: 861489 - RNA, 15 nt, Homo sapiens
aucgcugucaucuca

SEQ ID NO: 861490 - RNA, 16 nt, Homo sapiens
aucgcugucaucucag

SEQ ID NO: 861491 - RNA, 21 nt, Homo sapiens
aucucaaacuacuggcaauuu

SEQ ID NO: 861492 - RNA, 19 nt, Homo sapiens
aucucagcuggaucuccau

SEQ ID NO: 861493 - RNA, 23 nt, Homo sapiens
aucucauuggacccuuccauggu

SEQ ID NO: 861494 - RNA, 15 nt, Homo sapiens
aucuccauucucuca

SEQ ID NO: 861495 - RNA, 22 nt, Homo sapiens
aucucugauucugucaaugucu

SEQ ID NO: 861496 - RNA, 16 nt, Homo sapiens
aucuguaacccuugaa

SEQ ID NO: 861497 - RNA, 14 nt, Homo sapiens
aucuuaaaugccag

SEQ ID NO: 861498 - RNA, 19 nt, Homo sapiens
aucuuaagagaauccacau

SEQ ID NO: 861499 - RNA, 18 nt, Homo sapiens
aucuuaguauuugcauau

SEQ ID NO: 861500 - RNA, 15 nt, Homo sapiens
aucuuguacagccuu

SEQ ID NO: 861501 - RNA, 16 nt, Homo sapiens
augaaauaucaugcuc

SEQ ID NO: 861502 - RNA, 13 nt, Homo sapiens
augaaauugccaa

SEQ ID NO: 861503 - RNA, 18 nt, Homo sapiens
augaacguuuucucuuca

SEQ ID NO: 861504 - RNA, 15 nt, Homo sapiens
augaacucuuaauca

SEQ ID NO: 861505 - RNA, 23 nt, Homo sapiens
augaauguuuacacucuuuguaa

SEQ ID NO: 861506 - RNA, 17 nt, Homo sapiens
augagaaggaauuugag

SEQ ID NO: 861507 - RNA, 16 nt, Homo sapiens
augagaccacuguuau

SEQ ID NO: 861508 - RNA, 14 nt, Homo sapiens
augagggcugagau

SEQ ID NO: 861509 - RNA, 11 nt, Homo sapiens
aaaaacauuca

SEQ ID NO: 861510 - RNA, 16 nt, Homo sapiens
aaaacaagcauucaca

SEQ ID NO: 861511 - RNA, 11 nt, Homo sapiens
aaaacacugug

SEQ ID NO: 861512 - RNA, 13 nt, Homo sapiens
aaaacacugugca

SEQ ID NO: 861513 - RNA, 22 nt, Homo sapiens
aaaacuguggguagagacuuug

SEQ ID NO: 861514 - RNA, 21 nt, Homo sapiens
aaaacuuccacuaccuuuaaa

SEQ ID NO: 861515 - RNA, 14 nt, Homo sapiens
aaaagaacugucuc

SEQ ID NO: 861516 - RNA, 22 nt, Homo sapiens
aaaagaugcauuaucuaugaua

SEQ ID NO: 861517 - RNA, 20 nt, Homo sapiens
aaaaggacucucaggaccaa

SEQ ID NO: 861518 - RNA, 14 nt, Homo sapiens
aaaauaaaguacgu

SEQ ID NO: 861519 - RNA, 13 nt, Homo sapiens
aaaauacaugaca

SEQ ID NO: 861520 - RNA, 18 nt, Homo sapiens
aaaauagagccugaggga

SEQ ID NO: 861521 - RNA, 13 nt, Homo sapiens
aaaauuaauauca

SEQ ID NO: 861522 - RNA, 15 nt, Homo sapiens
aaaauuaauaucaca

SEQ ID NO: 861523 - RNA, 12 nt, Homo sapiens
aaacaacucuuu

SEQ ID NO: 861524 - RNA, 20 nt, Homo sapiens
aaacacugcuguucuuuaaa

SEQ ID NO: 861525 - RNA, 10 nt, Homo sapiens
aaacauuauu

SEQ ID NO: 861526 - RNA, 22 nt, Homo sapiens
aaaccaucauaguacagguaag

SEQ ID NO: 861527 - RNA, 17 nt, Homo sapiens
aaacuaccuuccaguuc

SEQ ID NO: 861528 - RNA, 23 nt, Homo sapiens
aaacuggaaugcuguuacuuuga

SEQ ID NO: 861529 - RNA, 15 nt, Homo sapiens
aaacuuccacuaccu

SEQ ID NO: 861530 - RNA, 18 nt, Homo sapiens
aaagaaagccucagagaa

SEQ ID NO: 861531 - RNA, 13 nt, Homo sapiens
aaagcucaucuca

SEQ ID NO: 861532 - RNA, 15 nt, Homo sapiens
aaaggaggacaggga

SEQ ID NO: 861533 - RNA, 13 nt, Homo sapiens
caaagaaauagca

SEQ ID NO: 861534 - RNA, 11 nt, Homo sapiens
caaagacagaa

SEQ ID NO: 861535 - RNA, 21 nt, Homo sapiens
caaagaugagaagccaaagcc

SEQ ID NO: 861536 - RNA, 17 nt, Homo sapiens
caaagcuuucauguaaa

SEQ ID NO: 861537 - RNA, 24 nt, Homo sapiens
caaaggaggcuuacaacuccugca

SEQ ID NO: 861538 - RNA, 15 nt, Homo sapiens
caaauaugcacuuuc

SEQ ID NO: 861539 - RNA, 20 nt, Homo sapiens
caaaugagauguaugcccaa

SEQ ID NO: 861540 - RNA, 17 nt, Homo sapiens
caaaugauuuacacuga

SEQ ID NO: 861541 - RNA, 22 nt, Homo sapiens
caaaugauuuacacugacuguu

SEQ ID NO: 861542 - RNA, 13 nt, Homo sapiens
caaaugcaauuuu

SEQ ID NO: 861543 - RNA, 15 nt, Homo sapiens
caaauuaaggcauaa

SEQ ID NO: 861544 - RNA, 11 nt, Homo sapiens
caacagcauuu

SEQ ID NO: 861545 - RNA, 15 nt, Homo sapiens
caacagcauuuucaa

SEQ ID NO: 861546 - RNA, 22 nt, Homo sapiens
caacagcccucaggucagggug

SEQ ID NO: 861547 - RNA, 20 nt, Homo sapiens
caaccucgcuggacucucag

SEQ ID NO: 861548 - RNA, 15 nt, Homo sapiens
caaccuugugugagu

SEQ ID NO: 861549 - RNA, 14 nt, Homo sapiens
caacgggucugugg

SEQ ID NO: 861550 - RNA, 12 nt, Homo sapiens
caacuuugacaa

SEQ ID NO: 861551 - RNA, 20 nt, Homo sapiens
caacuuuuuaccuaguacaa

SEQ ID NO: 861552 - RNA, 20 nt, Homo sapiens
caagaagugggagugggaga

SEQ ID NO: 861553 - RNA, 21 nt, Homo sapiens
caagaagugggauucaggaau

SEQ ID NO: 861554 - RNA, 23 nt, Homo sapiens
caagaauagaugcugacuguacu

SEQ ID NO: 861555 - RNA, 12 nt, Homo sapiens
caagacagcaga

SEQ ID NO: 861556 - RNA, 14 nt, Homo sapiens
caagauaccuucau

SEQ ID NO: 861557 - RNA, 20 nt, Homo sapiens
caagauaccuuugcguggau

SEQ ID NO: 861558 - RNA, 14 nt, Homo sapiens
caagaucugaauuu

SEQ ID NO: 861559 - RNA, 21 nt, Homo sapiens
caagauucccggcuggacuuu

SEQ ID NO: 861560 - RNA, 23 nt, Homo sapiens
caagcaguuaguuccuucaugau

SEQ ID NO: 861561 - RNA, 12 nt, Homo sapiens
caagccacagaa

SEQ ID NO: 861562 - RNA, 21 nt, Homo sapiens
caagcugcagggaauuuucau

SEQ ID NO: 861563 - RNA, 18 nt, Homo sapiens
caaggaaaacaguaacua

SEQ ID NO: 861564 - RNA, 15 nt, Homo sapiens
caagggcuccagggc

SEQ ID NO: 861565 - RNA, 16 nt, Homo sapiens
caaggguuuguugaac

SEQ ID NO: 861566 - RNA, 18 nt, Homo sapiens
caaguguagguaucauuu

SEQ ID NO: 861567 - RNA, 13 nt, Homo sapiens
caauaagcaucaa

SEQ ID NO: 861568 - RNA, 15 nt, Homo sapiens
caaugccugccugaa

SEQ ID NO: 861569 - RNA, 23 nt, Homo sapiens
caaugcuauaacuauguugauaa

SEQ ID NO: 861570 - RNA, 17 nt, Homo sapiens
caaugcuuuguccauga

SEQ ID NO: 861571 - RNA, 16 nt, Homo sapiens
caauggagacugucuc

SEQ ID NO: 861572 - RNA, 14 nt, Homo sapiens
caauggcuggguuu

SEQ ID NO: 861573 - RNA, 13 nt, Homo sapiens
caaugugcacuga

SEQ ID NO: 861574 - RNA, 14 nt, Homo sapiens
caaugugcacugaa

SEQ ID NO: 861575 - RNA, 15 nt, Homo sapiens
caaugugcacugaau

SEQ ID NO: 861576 - RNA, 15 nt, Homo sapiens
caauuagcauuccau

SEQ ID NO: 861577 - RNA, 15 nt, Homo sapiens
caauucuucuucuca

SEQ ID NO: 861578 - RNA, 20 nt, Homo sapiens
caauuucuuuaaaucauuua

SEQ ID NO: 861579 - RNA, 14 nt, Homo sapiens
cacaagacagcaga

SEQ ID NO: 861580 - RNA, 19 nt, Homo sapiens
cacaagacagcagagccau

SEQ ID NO: 861581 - RNA, 23 nt, Homo sapiens
cacaaugguuuuguuucuuuccu

SEQ ID NO: 861582 - RNA, 12 nt, Homo sapiens
cacacacacucu

SEQ ID NO: 861583 - RNA, 21 nt, Homo sapiens
cacagagauaauucuagcuuu

SEQ ID NO: 861584 - RNA, 18 nt, Homo sapiens
cacagaggcaguggcagc

SEQ ID NO: 861585 - RNA, 14 nt, Homo sapiens
cacagagugccauc

SEQ ID NO: 861586 - RNA, 16 nt, Homo sapiens
cacagcaaaugagaug

SEQ ID NO: 861587 - RNA, 20 nt, Homo sapiens
cacagugaacauaacuguaa

SEQ ID NO: 861588 - RNA, 17 nt, Homo sapiens
cacauacuacacauuca

SEQ ID NO: 861589 - RNA, 17 nt, Homo sapiens
cacauacuugagacugu

SEQ ID NO: 861590 - RNA, 15 nt, Homo sapiens
cacauccaacauuuc

SEQ ID NO: 861591 - RNA, 16 nt, Homo sapiens
cacaucuaaccucauc

SEQ ID NO: 861592 - RNA, 17 nt, Homo sapiens
cacaugucaguaccuuc

SEQ ID NO: 861593 - RNA, 16 nt, Homo sapiens
cacauucaauaagcau

SEQ ID NO: 861594 - RNA, 11 nt, Homo sapiens
cacauucccuc

SEQ ID NO: 861595 - RNA, 14 nt, Homo sapiens
caccaaauucugaa

SEQ ID NO: 861596 - RNA, 16 nt, Homo sapiens
caccaaauucugaauu

SEQ ID NO: 861597 - RNA, 19 nt, Homo sapiens
cacccagcgcccucuaccu

SEQ ID NO: 861598 - RNA, 20 nt, Homo sapiens
cacccagcgcccucuaccuc

SEQ ID NO: 861599 - RNA, 13 nt, Homo sapiens
cacccaugcaccu

SEQ ID NO: 861600 - RNA, 15 nt, Homo sapiens
caccccuaaagagau

SEQ ID NO: 861601 - RNA, 15 nt, Homo sapiens
cacccugcaccucau

SEQ ID NO: 861602 - RNA, 20 nt, Homo sapiens
cacccugcaccucauuccaa

SEQ ID NO: 861603 - RNA, 21 nt, Homo sapiens
cacguccugggugcugucaug

SEQ ID NO: 861604 - RNA, 15 nt, Homo sapiens
cacguucugcucauc

SEQ ID NO: 861605 - RNA, 16 nt, Homo sapiens
cacuaacaaacucuga

SEQ ID NO: 861606 - RNA, 19 nt, Homo sapiens
cacuauucuuaagcacuuu

SEQ ID NO: 861607 - RNA, 15 nt, Homo sapiens
cacuccccucaucca

SEQ ID NO: 861608 - RNA, 13 nt, Homo sapiens
cacucuagugcca

SEQ ID NO: 861609 - RNA, 13 nt, Homo sapiens
cacugcaagcacu

SEQ ID NO: 861610 - RNA, 18 nt, Homo sapiens
cacugccauggaggcaca

SEQ ID NO: 861611 - RNA, 14 nt, Homo sapiens
cacugggcuucuag

SEQ ID NO: 861612 - RNA, 22 nt, Homo sapiens
cacugggcuucuagaaccaggc

SEQ ID NO: 861613 - RNA, 18 nt, Homo sapiens
cacugguaccggaugcag

SEQ ID NO: 861614 - RNA, 19 nt, Homo sapiens
cacuugcaagucccaugau

SEQ ID NO: 861615 - RNA, 19 nt, Homo sapiens
cacuugggucuucccugua

SEQ ID NO: 861616 - RNA, 19 nt, Homo sapiens
cagaaacuaccagauuuga

SEQ ID NO: 861617 - RNA, 16 nt, Homo sapiens
cagaaagcucaucuca

SEQ ID NO: 861618 - RNA, 16 nt, Homo sapiens
cagaaggcaaacccau

SEQ ID NO: 861619 - RNA, 15 nt, Homo sapiens
cagaauaaaugggua

SEQ ID NO: 861620 - RNA, 18 nt, Homo sapiens
cagaauaaauggguaaca

SEQ ID NO: 861621 - RNA, 14 nt, Homo sapiens
cagaauaauaagag

SEQ ID NO: 861622 - RNA, 17 nt, Homo sapiens
cagaaucaaaugcaauu

SEQ ID NO: 861623 - RNA, 12 nt, Homo sapiens
cagaccacugau

SEQ ID NO: 861624 - RNA, 20 nt, Homo sapiens
cagaccacugauaaaaccau

SEQ ID NO: 861625 - RNA, 23 nt, Homo sapiens
cagaccgcuccccaauacucucc

SEQ ID NO: 861626 - RNA, 16 nt, Homo sapiens
cagaccucggcugugu

SEQ ID NO: 861627 - RNA, 15 nt, Homo sapiens
cagaccuucuuccac

SEQ ID NO: 861628 - RNA, 20 nt, Homo sapiens
cagacgcacgugggucuuca

SEQ ID NO: 861629 - RNA, 17 nt, Homo sapiens
cagagacggucaugcaa

SEQ ID NO: 861630 - RNA, 21 nt, Homo sapiens
cagagauaauucuagcuuuga

SEQ ID NO: 861631 - RNA, 15 nt, Homo sapiens
cagagcccaagggaa

SEQ ID NO: 861632 - RNA, 15 nt, Homo sapiens
cagagcuucccugac

SEQ ID NO: 861633 - RNA, 14 nt, Homo sapiens
cagauggucccauu

SEQ ID NO: 861634 - RNA, 13 nt, Homo sapiens
cagcaaaugagau

SEQ ID NO: 861635 - RNA, 18 nt, Homo sapiens
cagcaacaugauaccugg

SEQ ID NO: 861636 - RNA, 18 nt, Homo sapiens
cagcacuuaaacugccuc

SEQ ID NO: 861637 - RNA, 17 nt, Homo sapiens
cagcagcuagagcucag

SEQ ID NO: 861638 - RNA, 16 nt, Homo sapiens
cagcagguguuuuccu

SEQ ID NO: 861639 - RNA, 15 nt, Homo sapiens
cagccaggaggggcu

SEQ ID NO: 861640 - RNA, 20 nt, Homo sapiens
cagccauuccugaagcccac

SEQ ID NO: 861641 - RNA, 19 nt, Homo sapiens
cagccccuccccauggugc

SEQ ID NO: 861642 - RNA, 20 nt, Homo sapiens
cagccugugggagaagggac

SEQ ID NO: 861643 - RNA, 23 nt, Homo sapiens
cagcggcucuuccuggacaguga

SEQ ID NO: 861644 - RNA, 19 nt, Homo sapiens
cagcucuuccaaucuccau

SEQ ID NO: 861645 - RNA, 16 nt, Homo sapiens
cagcucuuuggugcca

SEQ ID NO: 861646 - RNA, 17 nt, Homo sapiens
cagcugcuucugugcau

SEQ ID NO: 861647 - RNA, 15 nt, Homo sapiens
cagcuggaucuccau

SEQ ID NO: 861648 - RNA, 19 nt, Homo sapiens
cagcuguacugaguucuca

SEQ ID NO: 861649 - RNA, 15 nt, Homo sapiens
cagcuuggagugcca

SEQ ID NO: 861650 - RNA, 19 nt, Homo sapiens
caggacgauuucacugaca

SEQ ID NO: 861651 - RNA, 18 nt, Homo sapiens
caggaggggcuguccaau

SEQ ID NO: 861652 - RNA, 16 nt, Homo sapiens
caggagugacucuggc

SEQ ID NO: 861653 - RNA, 18 nt, Homo sapiens
caggaguuggaagugugu

SEQ ID NO: 861654 - RNA, 18 nt, Homo sapiens
caggcccaauucugccac

SEQ ID NO: 861655 - RNA, 13 nt, Homo sapiens
caggcucuucucc

SEQ ID NO: 861656 - RNA, 22 nt, Homo sapiens
cagggcagcggucuucuccauc

SEQ ID NO: 861657 - RNA, 18 nt, Homo sapiens
cagucaaggaguggcuua

SEQ ID NO: 861658 - RNA, 18 nt, Homo sapiens
cagucacacugcugggaa

SEQ ID NO: 861659 - RNA, 20 nt, Homo sapiens
cagucagaguugugcacaug

SEQ ID NO: 861660 - RNA, 21 nt, Homo sapiens
cagucauaacuaaauaaagcu

SEQ ID NO: 861661 - RNA, 14 nt, Homo sapiens
cagucuuccauuug

SEQ ID NO: 861662 - RNA, 22 nt, Homo sapiens
cagucuuccauuugcaagggaa

SEQ ID NO: 861663 - RNA, 23 nt, Homo sapiens
cagugaguuggggcgacugugaa

SEQ ID NO: 861664 - RNA, 12 nt, Homo sapiens
cagugcucccuc

SEQ ID NO: 861665 - RNA, 19 nt, Homo sapiens
caguguguuucugaucuga

SEQ ID NO: 861666 - RNA, 14 nt, Homo sapiens
gcaagucccaugau

SEQ ID NO: 861667 - RNA, 22 nt, Homo sapiens
gcaauucuucuucucaagcacu

SEQ ID NO: 861668 - RNA, 18 nt, Homo sapiens
gcaauuuccggccaacag

SEQ ID NO: 861669 - RNA, 23 nt, Homo sapiens
gcacguaguagggucaggccacg

SEQ ID NO: 861670 - RNA, 14 nt, Homo sapiens
gcacugucaugccc

SEQ ID NO: 861671 - RNA, 21 nt, Homo sapiens
gcacuucccauuuguguuuca

SEQ ID NO: 861672 - RNA, 13 nt, Homo sapiens
gcagaccacugau

SEQ ID NO: 861673 - RNA, 22 nt, Homo sapiens
gcagagcuugaacacagucuca

SEQ ID NO: 861674 - RNA, 19 nt, Homo sapiens
gcagcucaaguuagcauuu

SEQ ID NO: 861675 - RNA, 20 nt, Homo sapiens
gcagcuuagacuaaggccau

SEQ ID NO: 861676 - RNA, 19 nt, Homo sapiens
gcagcuucgugugcagcua

SEQ ID NO: 861677 - RNA, 18 nt, Homo sapiens
gcaggacacugcagaaca

SEQ ID NO: 861678 - RNA, 18 nt, Homo sapiens
gcaggauccuugccucca

SEQ ID NO: 861679 - RNA, 20 nt, Homo sapiens
gcagggcagccugugggaga

SEQ ID NO: 861680 - RNA, 21 nt, Homo sapiens
gcaguggagaggggacuugga

SEQ ID NO: 861681 - RNA, 19 nt, Homo sapiens
gcaguggcagcaacaaagg

SEQ ID NO: 861682 - RNA, 15 nt, Homo sapiens
gcaguguucuugggg

SEQ ID NO: 861683 - RNA, 23 nt, Homo sapiens
gcauacgguaugauauugcagcu

SEQ ID NO: 861684 - RNA, 18 nt, Homo sapiens
gcauaugaggaugcagag

SEQ ID NO: 861685 - RNA, 19 nt, Homo sapiens
gcauggccgcaacuuccca

SEQ ID NO: 861686 - RNA, 22 nt, Homo sapiens
gcauuaucuaugauaugcuaau

SEQ ID NO: 861687 - RNA, 16 nt, Homo sapiens
gcauucagccaggaga

SEQ ID NO: 861688 - RNA, 16 nt, Homo sapiens
gcauugagcaaagggg

SEQ ID NO: 861689 - RNA, 15 nt, Homo sapiens
gcauugccagcucuu

SEQ ID NO: 861690 - RNA, 20 nt, Homo sapiens
gcauuuagacccugcauuua

SEQ ID NO: 861691 - RNA, 18 nt, Homo sapiens
gcauuucuucacgcaccu

SEQ ID NO: 861692 - RNA, 17 nt, Homo sapiens
gcauuuucaagcaguua

SEQ ID NO: 861693 - RNA, 19 nt, Homo sapiens
gccaccagcggcccucgga

SEQ ID NO: 861694 - RNA, 14 nt, Homo sapiens
gccacguggccgcu

SEQ ID NO: 861695 - RNA, 19 nt, Homo sapiens
gccacguggccgcugccca

SEQ ID NO: 861696 - RNA, 13 nt, Homo sapiens
gccacugccagcu

SEQ ID NO: 861697 - RNA, 20 nt, Homo sapiens
gccacuuggccaccaggacu

SEQ ID NO: 861698 - RNA, 20 nt, Homo sapiens
gccagcuguacugaguucuc

SEQ ID NO: 861699 - RNA, 12 nt, Homo sapiens
gccagguggcca

SEQ ID NO: 861700 - RNA, 22 nt, Homo sapiens
gccauaugaaugucaguaguuu

SEQ ID NO: 861701 - RNA, 13 nt, Homo sapiens
gccauuucuuccc

SEQ ID NO: 861702 - RNA, 18 nt, Homo sapiens
gcccacccugcaccucau

SEQ ID NO: 861703 - RNA, 19 nt, Homo sapiens
gcccacgucccgggcacug

SEQ ID NO: 861704 - RNA, 22 nt, Homo sapiens
gcccacgucccgggcacuguca

SEQ ID NO: 861705 - RNA, 15 nt, Homo sapiens
gcccagccugcauac

SEQ ID NO: 861706 - RNA, 19 nt, Homo sapiens
gcccagcuuggagugccac

SEQ ID NO: 861707 - RNA, 15 nt, Homo sapiens
gccccagugaccggg

SEQ ID NO: 861708 - RNA, 15 nt, Homo sapiens
gccccaucagcagcu

SEQ ID NO: 861709 - RNA, 18 nt, Homo sapiens
gcccgacagccuggcaca

SEQ ID NO: 861710 - RNA, 21 nt, Homo sapiens
gcccuucccacaggacauuuc

SEQ ID NO: 861711 - RNA, 12 nt, Homo sapiens
gccguggcugcg

SEQ ID NO: 861712 - RNA, 17 nt, Homo sapiens
gccuaaagaaacucagc

SEQ ID NO: 861713 - RNA, 21 nt, Homo sapiens
gccucgcuucacggacaggaa

SEQ ID NO: 861714 - RNA, 14 nt, Homo sapiens
gccucuguggcacu

SEQ ID NO: 861715 - RNA, 21 nt, Homo sapiens
gccugagguuugccagcauuu

SEQ ID NO: 861716 - RNA, 17 nt, Homo sapiens
gccugaucaccagguga

SEQ ID NO: 861717 - RNA, 22 nt, Homo sapiens
gccugaucagcgccgcaccagc

SEQ ID NO: 861718 - RNA, 20 nt, Homo sapiens
gccugccucaugcucucuau

SEQ ID NO: 861719 - RNA, 17 nt, Homo sapiens
gcgaaaaaaucagugaa

SEQ ID NO: 861720 - RNA, 14 nt, Homo sapiens
gcggaguugugcac

SEQ ID NO: 861721 - RNA, 20 nt, Homo sapiens
gcuaauuaggaagcuugauu

SEQ ID NO: 861722 - RNA, 17 nt, Homo sapiens
gcuauaacuauguugau

SEQ ID NO: 861723 - RNA, 20 nt, Homo sapiens
gcuauggggagaaaagacau

SEQ ID NO: 861724 - RNA, 15 nt, Homo sapiens
gcuaugucugugaug

SEQ ID NO: 861725 - RNA, 17 nt, Homo sapiens
gcucacacaugagaucu

SEQ ID NO: 861726 - RNA, 16 nt, Homo sapiens
gcuccagacacacagc

SEQ ID NO: 861727 - RNA, 18 nt, Homo sapiens
gcucucuggaccugacca

SEQ ID NO: 861728 - RNA, 20 nt, Homo sapiens
gcugaaaacugcaacuugua

SEQ ID NO: 861729 - RNA, 14 nt, Homo sapiens
gcugagcuuuccag

SEQ ID NO: 861730 - RNA, 16 nt, Homo sapiens
gcugagugcaccacuu

SEQ ID NO: 861731 - RNA, 18 nt, Homo sapiens
gcugaugucuucuugggg

SEQ ID NO: 861732 - RNA, 16 nt, Homo sapiens
gcugcuggaaaggccc

SEQ ID NO: 861733 - RNA, 14 nt, Homo sapiens
gcugggcagcuguu

SEQ ID NO: 861734 - RNA, 20 nt, Homo sapiens
gcuggguguguuucaggaca

SEQ ID NO: 861735 - RNA, 12 nt, Homo sapiens
gcugucaugccc

SEQ ID NO: 861736 - RNA, 14 nt, Homo sapiens
gcugucaugcccag

SEQ ID NO: 861737 - RNA, 19 nt, Homo sapiens
gcuguccaggaacuuucca

SEQ ID NO: 861738 - RNA, 20 nt, Homo sapiens
gcuguccaggaacuuuccag

SEQ ID NO: 861739 - RNA, 15 nt, Homo sapiens
gcugucuuucacuga

SEQ ID NO: 861740 - RNA, 21 nt, Homo sapiens
gcuuagacuaaggccauuauu

SEQ ID NO: 861741 - RNA, 12 nt, Homo sapiens
gcuuauauucau

SEQ ID NO: 861742 - RNA, 15 nt, Homo sapiens
gcuucccugacucau

SEQ ID NO: 861743 - RNA, 20 nt, Homo sapiens
gcuuucauguaaacugugca

SEQ ID NO: 861744 - RNA, 21 nt, Homo sapiens
gcuuucauguaaacugugcac

SEQ ID NO: 861745 - RNA, 17 nt, Homo sapiens
gcuuuggguagugccau

SEQ ID NO: 861746 - RNA, 22 nt, Homo sapiens
gcuuuggguagugccauggcca

SEQ ID NO: 861747 - RNA, 20 nt, Homo sapiens
gcuuuugcuggucacugcca

SEQ ID NO: 861748 - RNA, 20 nt, Homo sapiens
ggaaaauaaaucaaugcuau

SEQ ID NO: 861749 - RNA, 16 nt, Homo sapiens
ggaacuuuccagcagu

SEQ ID NO: 861750 - RNA, 19 nt, Homo sapiens
ggaaggaugacuugacaag

SEQ ID NO: 861751 - RNA, 14 nt, Homo sapiens
ggaauaauccagaa

SEQ ID NO: 861752 - RNA, 18 nt, Homo sapiens
ggacaaaggugauuuucc

SEQ ID NO: 861753 - RNA, 17 nt, Homo sapiens
ggacacugaaccuuguu

SEQ ID NO: 861754 - RNA, 16 nt, Homo sapiens
ggacaggaagcacagc

SEQ ID NO: 861755 - RNA, 22 nt, Homo sapiens
ggaccaauuagcauuccaucaa

SEQ ID NO: 861756 - RNA, 21 nt, Homo sapiens
ggacuauggcucuacuuucag

SEQ ID NO: 861757 - RNA, 17 nt, Homo sapiens
ggacuauuucuggcacu

SEQ ID NO: 861758 - RNA, 23 nt, Homo sapiens
ggacucagguugucugaagucac

SEQ ID NO: 861759 - RNA, 11 nt, Homo sapiens
ggacugugucc

SEQ ID NO: 861760 - RNA, 13 nt, Homo sapiens
ggagacugcugag

SEQ ID NO: 861761 - RNA, 16 nt, Homo sapiens
ggagacugucucaaga

SEQ ID NO: 861762 - RNA, 14 nt, Homo sapiens
ggagagagacucca

SEQ ID NO: 861763 - RNA, 15 nt, Homo sapiens
ggaggaccagagcua

SEQ ID NO: 861764 - RNA, 18 nt, Homo sapiens
ggaggccguucagcugug

SEQ ID NO: 861765 - RNA, 13 nt, Homo sapiens
ggagguacuguga

SEQ ID NO: 861766 - RNA, 13 nt, Homo sapiens
ggagugacucugg

SEQ ID NO: 861767 - RNA, 11 nt, Homo sapiens
ggagugccaca

SEQ ID NO: 861768 - RNA, 13 nt, Homo sapiens
ggaucccuuucac

SEQ ID NO: 861769 - RNA, 15 nt, Homo sapiens
ggaugcagagucagc

SEQ ID NO: 861770 - RNA, 15 nt, Homo sapiens
ggauggggacaaaga

SEQ ID NO: 861771 - RNA, 17 nt, Homo sapiens
ggauugggagauuucau

SEQ ID NO: 861772 - RNA, 21 nt, Homo sapiens
ggcacacccucucuguccaau

SEQ ID NO: 861773 - RNA, 12 nt, Homo sapiens
ggcacugucaug

SEQ ID NO: 861774 - RNA, 13 nt, Homo sapiens
ggcacugucaugc

SEQ ID NO: 861775 - RNA, 17 nt, Homo sapiens
ggcagcauuuagcacau

SEQ ID NO: 861776 - RNA, 20 nt, Homo sapiens
ggcagcuucgugugcagcua

SEQ ID NO: 861777 - RNA, 13 nt, Homo sapiens
ggcagucacacug

SEQ ID NO: 861778 - RNA, 13 nt, Homo sapiens
ggccacacguguc

SEQ ID NO: 861779 - RNA, 13 nt, Homo sapiens
ggcccaauucugc

SEQ ID NO: 861780 - RNA, 18 nt, Homo sapiens
ggcccaauucugccacuu

SEQ ID NO: 861781 - RNA, 14 nt, Homo sapiens
ggccgccuguccuu

SEQ ID NO: 861782 - RNA, 23 nt, Homo sapiens
ggcgacuccccaacggcuacuac

SEQ ID NO: 861783 - RNA, 12 nt, Homo sapiens
ggcgcucgccca

SEQ ID NO: 861784 - RNA, 13 nt, Homo sapiens
ggcuagaucauga

SEQ ID NO: 861785 - RNA, 15 nt, Homo sapiens
ggcucaggcugccca

SEQ ID NO: 861786 - RNA, 14 nt, Homo sapiens
ggcuggagugggcu

SEQ ID NO: 861787 - RNA, 20 nt, Homo sapiens
ggcuuccgagggcacuaccg

SEQ ID NO: 861788 - RNA, 16 nt, Homo sapiens
ggcuuggaagggcgcu

SEQ ID NO: 861789 - RNA, 19 nt, Homo sapiens
ggcuuuacuaucuuuucau

SEQ ID NO: 861790 - RNA, 13 nt, Homo sapiens
gggagacugagcu

SEQ ID NO: 861791 - RNA, 14 nt, Homo sapiens
gggaucuuacccac

SEQ ID NO: 861792 - RNA, 18 nt, Homo sapiens
gggcacugucaugcccag

SEQ ID NO: 861793 - RNA, 13 nt, Homo sapiens
gggcaggguucua

SEQ ID NO: 861794 - RNA, 13 nt, Homo sapiens
gggccacuggcau

SEQ ID NO: 861795 - RNA, 18 nt, Homo sapiens
gggccaggugcacagacg

SEQ ID NO: 861796 - RNA, 13 nt, Homo sapiens
gggcgacugugaa

SEQ ID NO: 861797 - RNA, 20 nt, Homo sapiens
gggcgccuggguccucccag

SEQ ID NO: 861798 - RNA, 17 nt, Homo sapiens
ggggcagcgcagccucc

SEQ ID NO: 861799 - RNA, 15 nt, Homo sapiens
uccccucucuuugag

SEQ ID NO: 861800 - RNA, 22 nt, Homo sapiens
uccccuggggagucugggcaca

SEQ ID NO: 861801 - RNA, 15 nt, Homo sapiens
uccccuuccacugag

SEQ ID NO: 861802 - RNA, 15 nt, Homo sapiens
ucccucaucuguccc

SEQ ID NO: 861803 - RNA, 13 nt, Homo sapiens
ucccugugucagg

SEQ ID NO: 861804 - RNA, 14 nt, Homo sapiens
uccgugagccucag

SEQ ID NO: 861805 - RNA, 22 nt, Homo sapiens
uccuaacaggauuagacaguca

SEQ ID NO: 861806 - RNA, 22 nt, Homo sapiens
uccucauuuuugaauacaggca

SEQ ID NO: 861807 - RNA, 16 nt, Homo sapiens
uccucuccacugccuu

SEQ ID NO: 861808 - RNA, 13 nt, Homo sapiens
uccucugacucag

SEQ ID NO: 861809 - RNA, 16 nt, Homo sapiens
uccucuuucaaccuca

SEQ ID NO: 861810 - RNA, 19 nt, Homo sapiens
uccugacagaaggacucag

SEQ ID NO: 861811 - RNA, 17 nt, Homo sapiens
uccugcaaguccauagc

SEQ ID NO: 861812 - RNA, 13 nt, Homo sapiens
uccugggcccucu

SEQ ID NO: 861813 - RNA, 22 nt, Homo sapiens
uccuggggcuggguguguuuca

SEQ ID NO: 861814 - RNA, 21 nt, Homo sapiens
uccugggugcugucaugccca

SEQ ID NO: 861815 - RNA, 23 nt, Homo sapiens
uccuuaaaaaauaaaguacgugu

SEQ ID NO: 861816 - RNA, 22 nt, Homo sapiens
uccuucuggggcuuugccauua

SEQ ID NO: 861817 - RNA, 15 nt, Homo sapiens
uccuuucacaaccuu

SEQ ID NO: 861818 - RNA, 23 nt, Homo sapiens
uccuuuguuuuuuuuuccugucc

SEQ ID NO: 861819 - RNA, 19 nt, Homo sapiens
ucgcauuaaugaaauacca

SEQ ID NO: 861820 - RNA, 15 nt, Homo sapiens
ucgcugucaucucag

SEQ ID NO: 861821 - RNA, 11 nt, Homo sapiens
ucggcuggaag

SEQ ID NO: 861822 - RNA, 15 nt, Homo sapiens
ucguuugaaucacag

SEQ ID NO: 861823 - RNA, 20 nt, Homo sapiens
ucuaaaagggggcuauuccc

SEQ ID NO: 861824 - RNA, 13 nt, Homo sapiens
ucuaaaggggaca

SEQ ID NO: 861825 - RNA, 17 nt, Homo sapiens
ucuaaaggggacagauc

SEQ ID NO: 861826 - RNA, 17 nt, Homo sapiens
ucuaaguaaugaugucg

SEQ ID NO: 861827 - RNA, 19 nt, Homo sapiens
ucuacagagcuucccugac

SEQ ID NO: 861828 - RNA, 18 nt, Homo sapiens
ucuaucauguugaaguca

SEQ ID NO: 861829 - RNA, 16 nt, Homo sapiens
ucuauggcacccaugc

SEQ ID NO: 861830 - RNA, 18 nt, Homo sapiens
ucuauggcacccaugcac

SEQ ID NO: 861831 - RNA, 13 nt, Homo sapiens
ucuauuaucucaa

SEQ ID NO: 861832 - RNA, 21 nt, Homo sapiens
ucucaagcacugacacucauu

SEQ ID NO: 861833 - RNA, 22 nt, Homo sapiens
ucucaaggucacgggaccccua

SEQ ID NO: 861834 - RNA, 14 nt, Homo sapiens
ucucacuugucuca

SEQ ID NO: 861835 - RNA, 21 nt, Homo sapiens
ucucagcuggaucuccauucu

SEQ ID NO: 861836 - RNA, 19 nt, Homo sapiens
ucucaggaccaaagcuuuc

SEQ ID NO: 861837 - RNA, 20 nt, Homo sapiens
ucucaggaccaaagcuuuca

SEQ ID NO: 861838 - RNA, 13 nt, Homo sapiens
ucucauccacaga

SEQ ID NO: 861839 - RNA, 18 nt, Homo sapiens
ucuccaaguaaagccacg

SEQ ID NO: 861840 - RNA, 18 nt, Homo sapiens
ucuccugcccacucugac

SEQ ID NO: 861841 - RNA, 21 nt, Homo sapiens
ucucugcuuuggaaaucacac

SEQ ID NO: 861842 - RNA, 14 nt, Homo sapiens
ucucuggaccugac

SEQ ID NO: 861843 - RNA, 11 nt, Homo sapiens
ucucuguaaaa

SEQ ID NO: 861844 - RNA, 19 nt, Homo sapiens
ucucuuugagucaagucaa

SEQ ID NO: 861845 - RNA, 21 nt, Homo sapiens
ucugaaggagccccauuccug

SEQ ID NO: 861846 - RNA, 18 nt, Homo sapiens
ucugaagugucuaaugca

SEQ ID NO: 861847 - RNA, 17 nt, Homo sapiens
ucugacucagggcuccu

SEQ ID NO: 861848 - RNA, 21 nt, Homo sapiens
ucugaugcaagcaagaaacac

SEQ ID NO: 861849 - RNA, 21 nt, Homo sapiens
ucugcauuaucugaggucaca

SEQ ID NO: 861850 - RNA, 22 nt, Homo sapiens
ucugccugccucaugcucucua

SEQ ID NO: 861851 - RNA, 23 nt, Homo sapiens
ucugcugccaugagaaaagggaa

SEQ ID NO: 861852 - RNA, 23 nt, Homo sapiens
ucuggcacuugcaagucccauga

SEQ ID NO: 861853 - RNA, 16 nt, Homo sapiens
ucuggccaaauaugca

SEQ ID NO: 861854 - RNA, 18 nt, Homo sapiens
ucuggcuacgacuuggga

SEQ ID NO: 861855 - RNA, 14 nt, Homo sapiens
ucugggcccagaac

SEQ ID NO: 861856 - RNA, 14 nt, Homo sapiens
ucugggguggggcu

SEQ ID NO: 861857 - RNA, 20 nt, Homo sapiens
ucugguugguaaagccucag

SEQ ID NO: 861858 - RNA, 14 nt, Homo sapiens
ucugguuugcagag

SEQ ID NO: 861859 - RNA, 14 nt, Homo sapiens
ucugugauugccau

SEQ ID NO: 861860 - RNA, 18 nt, Homo sapiens
ucuguugcuuauugggag

SEQ ID NO: 861861 - RNA, 13 nt, Homo sapiens
ucuuaagcacuuu

SEQ ID NO: 861862 - RNA, 18 nt, Homo sapiens
ucuuaauauaacugccuu

SEQ ID NO: 861863 - RNA, 16 nt, Homo sapiens
ucuuacucuuuguaug

SEQ ID NO: 861864 - RNA, 24 nt, Homo sapiens
ucuucaccauuuggcaaugccauc

SEQ ID NO: 861865 - RNA, 15 nt, Homo sapiens
ucuucagggggccag

SEQ ID NO: 861866 - RNA, 23 nt, Homo sapiens
ucuucagggggccaggugcacag

SEQ ID NO: 861867 - RNA, 23 nt, Homo sapiens
ucuucccuguaugauuccuugau

SEQ ID NO: 861868 - RNA, 21 nt, Homo sapiens
ucuuccugaccaccuugcacu

SEQ ID NO: 861869 - RNA, 12 nt, Homo sapiens
ucuucucaagca

SEQ ID NO: 861870 - RNA, 16 nt, Homo sapiens
ucuucucaagcacuga

SEQ ID NO: 861871 - RNA, 22 nt, Homo sapiens
ucuugguugaggaaacaaacau

SEQ ID NO: 861872 - RNA, 16 nt, Homo sapiens
ucuuguaaacauugcc

SEQ ID NO: 861873 - RNA, 22 nt, Homo sapiens
ucuuguuuuuuuuuuccacuua

SEQ ID NO: 861874 - RNA, 17 nt, Homo sapiens
ucuuucccaauucacau

SEQ ID NO: 861875 - RNA, 16 nt, Homo sapiens
ucuuugacuauaacaa

SEQ ID NO: 861876 - RNA, 13 nt, Homo sapiens
ugaaaaacagcag

SEQ ID NO: 861877 - RNA, 14 nt, Homo sapiens
ugaaaaacagcaga

SEQ ID NO: 861878 - RNA, 21 nt, Homo sapiens
ugaaaaaggcaagccacagaa

SEQ ID NO: 861879 - RNA, 16 nt, Homo sapiens
ugaaaacacugugcac

SEQ ID NO: 861880 - RNA, 17 nt, Homo sapiens
ugaaaaccucuuuccaa

SEQ ID NO: 861881 - RNA, 22 nt, Homo sapiens
ugaaaaugcuguauuagucaca

SEQ ID NO: 861882 - RNA, 19 nt, Homo sapiens
ugaaaaugguccaggagaa

SEQ ID NO: 861883 - RNA, 17 nt, Homo sapiens
ugaaaggcuuuccucag

SEQ ID NO: 861884 - RNA, 13 nt, Homo sapiens
ugaaaucuaugaa

SEQ ID NO: 861885 - RNA, 17 nt, Homo sapiens
ugaacggugagcauugu

SEQ ID NO: 861886 - RNA, 21 nt, Homo sapiens
ugaagcccacccugcaccuca

SEQ ID NO: 861887 - RNA, 22 nt, Homo sapiens
ugaagucaugcguuuaaucaca

SEQ ID NO: 861888 - RNA, 22 nt, Homo sapiens
ugaauaaaccaucaucuugcca

SEQ ID NO: 861889 - RNA, 14 nt, Homo sapiens
ugaauacaggcaua

SEQ ID NO: 861890 - RNA, 12 nt, Homo sapiens
ugaaucacagua

SEQ ID NO: 861891 - RNA, 14 nt, Homo sapiens
ugaaucacaguaua

SEQ ID NO: 861892 - RNA, 21 nt, Homo sapiens
ugaauuaagaacugacacaaa

SEQ ID NO: 861893 - RNA, 15 nt, Homo sapiens
ugaauuaguaacugu

SEQ ID NO: 861894 - RNA, 20 nt, Homo sapiens
ugaauuucuagacaguauug

SEQ ID NO: 861895 - RNA, 14 nt, Homo sapiens
ugacaggcaguguu

SEQ ID NO: 861896 - RNA, 22 nt, Homo sapiens
ugacccagucagaguugugcac

SEQ ID NO: 861897 - RNA, 14 nt, Homo sapiens
ugacgcguggucac

SEQ ID NO: 861898 - RNA, 14 nt, Homo sapiens
ugacucuccagaaa

SEQ ID NO: 861899 - RNA, 21 nt, Homo sapiens
ugacuuauuuguaguuguuag

SEQ ID NO: 861900 - RNA, 18 nt, Homo sapiens
ugagaacuacucagggaa

SEQ ID NO: 861901 - RNA, 23 nt, Homo sapiens
ugagaggagagagacuccagcug

SEQ ID NO: 861902 - RNA, 17 nt, Homo sapiens
ugagaucagucagcucc

SEQ ID NO: 861903 - RNA, 21 nt, Homo sapiens
ugagcggccgccuguccuugg

SEQ ID NO: 861904 - RNA, 21 nt, Homo sapiens
ugaggaaaauuaauaucacag

SEQ ID NO: 861905 - RNA, 15 nt, Homo sapiens
ugaggacccucccag

SEQ ID NO: 861906 - RNA, 16 nt, Homo sapiens
ugaggaugcagaguca

SEQ ID NO: 861907 - RNA, 18 nt, Homo sapiens
ugaggaugcagagucagc

SEQ ID NO: 861908 - RNA, 20 nt, Homo sapiens
ugaggcaaccacaggcagca

SEQ ID NO: 861909 - RNA, 19 nt, Homo sapiens
ugagggagccuggccccau

SEQ ID NO: 861910 - RNA, 13 nt, Homo sapiens
ugagggucagaga

SEQ ID NO: 861911 - RNA, 15 nt, Homo sapiens
ugagguuaaggggau

SEQ ID NO: 861912 - RNA, 24 nt, Homo sapiens
ugagguuaaggggaucuaaaagga

SEQ ID NO: 861913 - RNA, 16 nt, Homo sapiens
ugaguaaaaucacaga

SEQ ID NO: 861914 - RNA, 19 nt, Homo sapiens
ugaguauucauuuugcaac

SEQ ID NO: 861915 - RNA, 16 nt, Homo sapiens
ugauaauuacuuucca

SEQ ID NO: 861916 - RNA, 17 nt, Homo sapiens
ugauauauaaaugugau

SEQ ID NO: 861917 - RNA, 18 nt, Homo sapiens
ugauaucccccagccuca

SEQ ID NO: 861918 - RNA, 15 nt, Homo sapiens
ugauauugcagcuua

SEQ ID NO: 861919 - RNA, 20 nt, Homo sapiens
ugaucagcgccgcaccagcc

SEQ ID NO: 861920 - RNA, 20 nt, Homo sapiens
ugauccuaaugaaugcauaa

SEQ ID NO: 861921 - RNA, 12 nt, Homo sapiens
ugaucugagaag

SEQ ID NO: 861922 - RNA, 17 nt, Homo sapiens
ugaugucguuugaauca

SEQ ID NO: 861923 - RNA, 16 nt, Homo sapiens
ugauucugucaauguc

SEQ ID NO: 861924 - RNA, 23 nt, Homo sapiens
ugauuuuuugcugcagacucauc

SEQ ID NO: 861925 - RNA, 12 nt, Homo sapiens
ugcaaagacuga

SEQ ID NO: 861926 - RNA, 16 nt, Homo sapiens
ugcaacaguagcauag

SEQ ID NO: 861927 - RNA, 19 nt, Homo sapiens
ugcaagcaagaaacacugg

SEQ ID NO: 861928 - RNA, 23 nt, Homo sapiens
ugcaauggaauauaaauaucaca

SEQ ID NO: 861929 - RNA, 22 nt, Homo sapiens
ugcaauuucucccgaauccuga

SEQ ID NO: 861930 - RNA, 16 nt, Homo sapiens
gcaucaaagaugagaa

SEQ ID NO: 861931 - RNA, 22 nt, Homo sapiens
gcaucaaagaugagaagccaaa

SEQ ID NO: 861932 - RNA, 11 nt, Homo sapiens
gcaucuggccc

SEQ ID NO: 861933 - RNA, 22 nt, Homo sapiens
gcauguacuuuauauuuucuau

SEQ ID NO: 861934 - RNA, 15 nt, Homo sapiens
gcauuaacuuuugua

SEQ ID NO: 861935 - RNA, 20 nt, Homo sapiens
gcauucugggguggggcuug

SEQ ID NO: 861936 - RNA, 17 nt, Homo sapiens
gccaaauaugcacuuuc

SEQ ID NO: 861937 - RNA, 17 nt, Homo sapiens
gccacauccaacauuuc

SEQ ID NO: 861938 - RNA, 15 nt, Homo sapiens
gccaccagcggcccu

SEQ ID NO: 861939 - RNA, 18 nt, Homo sapiens
gccaccucucacacuggc

SEQ ID NO: 861940 - RNA, 14 nt, Homo sapiens
gccaggcugcaggg

SEQ ID NO: 861941 - RNA, 22 nt, Homo sapiens
gccaguggagacuggaacacaa

SEQ ID NO: 861942 - RNA, 22 nt, Homo sapiens
gccauauauuuuuaagacuuuu

SEQ ID NO: 861943 - RNA, 17 nt, Homo sapiens
gcccaauucugccacuu

SEQ ID NO: 861944 - RNA, 14 nt, Homo sapiens
gcccaccugccagg

SEQ ID NO: 861945 - RNA, 16 nt, Homo sapiens
gcccacucugaccggg

SEQ ID NO: 861946 - RNA, 20 nt, Homo sapiens
gcccaggcggucacugccca

SEQ ID NO: 861947 - RNA, 15 nt, Homo sapiens
gcccaguguguuucu

SEQ ID NO: 861948 - RNA, 21 nt, Homo sapiens
gccccagcuccucuuccugcc

SEQ ID NO: 861949 - RNA, 17 nt, Homo sapiens
gcccccucucuuacccc

SEQ ID NO: 861950 - RNA, 20 nt, Homo sapiens
gccccucucuguuuacccuc

SEQ ID NO: 861951 - RNA, 15 nt, Homo sapiens
gcccucacuccacuc

SEQ ID NO: 861952 - RNA, 16 nt, Homo sapiens
gcccucccucccucca

SEQ ID NO: 861953 - RNA, 15 nt, Homo sapiens
gccggcgacucccca

SEQ ID NO: 861954 - RNA, 22 nt, Homo sapiens
gccguuagggaaauccaacucc

SEQ ID NO: 861955 - RNA, 16 nt, Homo sapiens
gccguucagcugugac

SEQ ID NO: 861956 - RNA, 14 nt, Homo sapiens
gccuaugugcaugc

SEQ ID NO: 861957 - RNA, 22 nt, Homo sapiens
gccucuuccucccucccugcag

SEQ ID NO: 861958 - RNA, 20 nt, Homo sapiens
gccugcggaguugugcacgu

SEQ ID NO: 861959 - RNA, 19 nt, Homo sapiens
gccugggagaugcagcugg

SEQ ID NO: 861960 - RNA, 19 nt, Homo sapiens
gccugugaucguguguugc

SEQ ID NO: 861961 - RNA, 18 nt, Homo sapiens
gccuuuccagaacuacca

SEQ ID NO: 861962 - RNA, 14 nt, Homo sapiens
gccuuuuguguuuu

SEQ ID NO: 861963 - RNA, 22 nt, Homo sapiens
gcgacuccccaacggcuacuac

SEQ ID NO: 861964 - RNA, 18 nt, Homo sapiens
gcgagggccugcguucaa

SEQ ID NO: 861965 - RNA, 23 nt, Homo sapiens
gcggggccgccgccagcuccccc

SEQ ID NO: 861966 - RNA, 22 nt, Homo sapiens
gcggguaaaaagagaaggcaag

SEQ ID NO: 861967 - RNA, 16 nt, Homo sapiens
gcgguauccaccugca

SEQ ID NO: 861968 - RNA, 17 nt, Homo sapiens
gcuaucgcaccacugug

SEQ ID NO: 861969 - RNA, 16 nt, Homo sapiens
gcuaugucugugaugu

SEQ ID NO: 861970 - RNA, 11 nt, Homo sapiens
gcuauucccug

SEQ ID NO: 861971 - RNA, 13 nt, Homo sapiens
gcucaucauucuc

SEQ ID NO: 861972 - RNA, 22 nt, Homo sapiens
gcucggggcccccgcagcagca

SEQ ID NO: 861973 - RNA, 12 nt, Homo sapiens
gcucuggcaaga

SEQ ID NO: 861974 - RNA, 19 nt, Homo sapiens
gcucuggcuggagaggaaa

SEQ ID NO: 861975 - RNA, 18 nt, Homo sapiens
gcucuuccuggacaguga

SEQ ID NO: 861976 - RNA, 19 nt, Homo sapiens
gcugagugcaccacuucaa

SEQ ID NO: 861977 - RNA, 16 nt, Homo sapiens
gcugccucuaccugac

SEQ ID NO: 861978 - RNA, 13 nt, Homo sapiens
gcugucaugccca

SEQ ID NO: 861979 - RNA, 19 nt, Homo sapiens
gcuuacaaugugcacugaa

SEQ ID NO: 861980 - RNA, 20 nt, Homo sapiens
gcuucauguucccaaaauca

SEQ ID NO: 861981 - RNA, 14 nt, Homo sapiens
gcuucuccuggacc

SEQ ID NO: 861982 - RNA, 23 nt, Homo sapiens
gcuucucuuuuuagauguagcac

SEQ ID NO: 861983 - RNA, 19 nt, Homo sapiens
gcuucugcucacauucccu

SEQ ID NO: 861984 - RNA, 16 nt, Homo sapiens
gcuugggcuggagugg

SEQ ID NO: 861985 - RNA, 16 nt, Homo sapiens
gcuuucccaggcagcu

SEQ ID NO: 861986 - RNA, 20 nt, Homo sapiens
gcuuuggcucgggacuucaa

SEQ ID NO: 861987 - RNA, 16 nt, Homo sapiens
gcuuuggguagugcca

SEQ ID NO: 861988 - RNA, 13 nt, Homo sapiens
ggaaaaauggggu

SEQ ID NO: 861989 - RNA, 15 nt, Homo sapiens
ggaaaacaagcauuc

SEQ ID NO: 861990 - RNA, 15 nt, Homo sapiens
ggaacacaaccauag

SEQ ID NO: 861991 - RNA, 18 nt, Homo sapiens
ggaacaggagugacucug

SEQ ID NO: 861992 - RNA, 19 nt, Homo sapiens
ggaacuuuuauuacugggg

SEQ ID NO: 861993 - RNA, 17 nt, Homo sapiens
ggaagugugugaucugu

SEQ ID NO: 861994 - RNA, 16 nt, Homo sapiens
ggaauauaaauaucac

SEQ ID NO: 861995 - RNA, 18 nt, Homo sapiens
ggaauguuaucaguauua

SEQ ID NO: 861996 - RNA, 17 nt, Homo sapiens
ggacaaagaaauagcaa

SEQ ID NO: 861997 - RNA, 23 nt, Homo sapiens
ggacaaaggugauuuuccugugu

SEQ ID NO: 861998 - RNA, 17 nt, Homo sapiens
ggacaaggcuagaucau

SEQ ID NO: 861999 - RNA, 18 nt, Homo sapiens
ggacagcggguaaaaaga

SEQ ID NO: 862000 - RNA, 17 nt, Homo sapiens
ggacaugaagauucuuu

SEQ ID NO: 862001 - RNA, 19 nt, Homo sapiens
ggaccaauuagcauuccau

SEQ ID NO: 862002 - RNA, 14 nt, Homo sapiens
ggaccucaguuuua

SEQ ID NO: 862003 - RNA, 12 nt, Homo sapiens
ggacgaggucaa

SEQ ID NO: 862004 - RNA, 13 nt, Homo sapiens
ggagaacuagaga

SEQ ID NO: 862005 - RNA, 21 nt, Homo sapiens
ggagacaaucuaaaaaauauc

SEQ ID NO: 862006 - RNA, 22 nt, Homo sapiens
ggagagccaaggccuaugccac

SEQ ID NO: 862007 - RNA, 20 nt, Homo sapiens
ggagagcuggggaagcuucu

SEQ ID NO: 862008 - RNA, 14 nt, Homo sapiens
ggagagugcaacag

SEQ ID NO: 862009 - RNA, 14 nt, Homo sapiens
ggagccacaggcag

SEQ ID NO: 862010 - RNA, 11 nt, Homo sapiens
ggagugccacg

SEQ ID NO: 862011 - RNA, 17 nt, Homo sapiens
ggauaggagcuuccaga

SEQ ID NO: 862012 - RNA, 17 nt, Homo sapiens
ggaugaauugccugucc

SEQ ID NO: 862013 - RNA, 17 nt, Homo sapiens
ggaugguggagggccac

SEQ ID NO: 862014 - RNA, 15 nt, Homo sapiens
ggauuuggguuggaa

SEQ ID NO: 862015 - RNA, 23 nt, Homo sapiens
ggcaacuugggaacuagacuccc

SEQ ID NO: 862016 - RNA, 18 nt, Homo sapiens
ggcaagacaccuucccag

SEQ ID NO: 862017 - RNA, 17 nt, Homo sapiens
ggcaccauggcuacuac

SEQ ID NO: 862018 - RNA, 16 nt, Homo sapiens
ggcacugucaugccca

SEQ ID NO: 862019 - RNA, 16 nt, Homo sapiens
ggcagaauggugggcu

SEQ ID NO: 862020 - RNA, 19 nt, Homo sapiens
ggcagaauggugggcucca

SEQ ID NO: 862021 - RNA, 12 nt, Homo sapiens
ggcagcauuuag

SEQ ID NO: 862022 - RNA, 14 nt, Homo sapiens
uaacaaacucugag

SEQ ID NO: 862023 - RNA, 14 nt, Homo sapiens
uaacaacuaugauu

SEQ ID NO: 862024 - RNA, 13 nt, Homo sapiens
uaacuuguguuac

SEQ ID NO: 862025 - RNA, 20 nt, Homo sapiens
uaagaccuuggcauccuucc

SEQ ID NO: 862026 - RNA, 14 nt, Homo sapiens
uaagagaauccaca

SEQ ID NO: 862027 - RNA, 14 nt, Homo sapiens
uaagauucauccau

SEQ ID NO: 862028 - RNA, 15 nt, Homo sapiens
uaagcaaagacuuuc

SEQ ID NO: 862029 - RNA, 13 nt, Homo sapiens
uaaggugagggaa

SEQ ID NO: 862030 - RNA, 16 nt, Homo sapiens
uaaguggcugugauua

SEQ ID NO: 862031 - RNA, 16 nt, Homo sapiens
uaauaaguuucacuga

SEQ ID NO: 862032 - RNA, 17 nt, Homo sapiens
uaauaaucuucagguga

SEQ ID NO: 862033 - RNA, 18 nt, Homo sapiens
uaauacagacuaugucac

SEQ ID NO: 862034 - RNA, 18 nt, Homo sapiens
uaauccagaaaaacugug

SEQ ID NO: 862035 - RNA, 19 nt, Homo sapiens
uaauccucuuuuucuaguc

SEQ ID NO: 862036 - RNA, 11 nt, Homo sapiens
uaaugauacug

SEQ ID NO: 862037 - RNA, 22 nt, Homo sapiens
uaauuacuuuccagcagguguu

SEQ ID NO: 862038 - RNA, 16 nt, Homo sapiens
uaauucuagcuuugag

SEQ ID NO: 862039 - RNA, 20 nt, Homo sapiens
uacaaugaguaaaaucacag

SEQ ID NO: 862040 - RNA, 14 nt, Homo sapiens
uacagaacucuuuc

SEQ ID NO: 862041 - RNA, 19 nt, Homo sapiens
uacagaaucaaaugcaauu

SEQ ID NO: 862042 - RNA, 13 nt, Homo sapiens
uacagaugggcaa

SEQ ID NO: 862043 - RNA, 16 nt, Homo sapiens
uacauacauuguauag

SEQ ID NO: 862044 - RNA, 13 nt, Homo sapiens
uacaugacauuua

SEQ ID NO: 862045 - RNA, 16 nt, Homo sapiens
uaccaaaauuauuuca

SEQ ID NO: 862046 - RNA, 14 nt, Homo sapiens
uaccaaucauuuua

SEQ ID NO: 862047 - RNA, 12 nt, Homo sapiens
uaccagauuuga

SEQ ID NO: 862048 - RNA, 23 nt, Homo sapiens
uaccaugucguaguuacucucag

SEQ ID NO: 862049 - RNA, 15 nt, Homo sapiens
uaccuaguagucauu

SEQ ID NO: 862050 - RNA, 19 nt, Homo sapiens
uaccuaguagucauuucau

SEQ ID NO: 862051 - RNA, 14 nt, Homo sapiens
uaccuccugagaaa

SEQ ID NO: 862052 - RNA, 21 nt, Homo sapiens
uaccugcccccaauccaugaa

SEQ ID NO: 862053 - RNA, 16 nt, Homo sapiens
uaccuggaaaccagaa

SEQ ID NO: 862054 - RNA, 13 nt, Homo sapiens
uaccugggcauuc

SEQ ID NO: 862055 - RNA, 20 nt, Homo sapiens
uacggaaggcucugggaucu

SEQ ID NO: 862056 - RNA, 15 nt, Homo sapiens
uacguguuuacuugg

SEQ ID NO: 862057 - RNA, 15 nt, Homo sapiens
uacguuaccaggcag

SEQ ID NO: 862058 - RNA, 15 nt, Homo sapiens
uacuaucaugucaaa

SEQ ID NO: 862059 - RNA, 14 nt, Homo sapiens
uacuaucuuuucau

SEQ ID NO: 862060 - RNA, 17 nt, Homo sapiens
uacucagucagcccagu

SEQ ID NO: 862061 - RNA, 22 nt, Homo sapiens
uacucauucagggauagcacug

SEQ ID NO: 862062 - RNA, 12 nt, Homo sapiens
uacucucaggca

SEQ ID NO: 862063 - RNA, 17 nt, Homo sapiens
uagaaacugaguccugu

SEQ ID NO: 862064 - RNA, 23 nt, Homo sapiens
uagaaagaaauuguuuuucugaa

SEQ ID NO: 862065 - RNA, 17 nt, Homo sapiens
uagaauggggcuuccau

SEQ ID NO: 862066 - RNA, 23 nt, Homo sapiens
uagaauggggcuuccaugguggu

SEQ ID NO: 862067 - RNA, 21 nt, Homo sapiens
uagacccugcauuuauagcau

SEQ ID NO: 862068 - RNA, 18 nt, Homo sapiens
uggggguggggcugcauc

SEQ ID NO: 862069 - RNA, 17 nt, Homo sapiens
ugggguagagaggacag

SEQ ID NO: 862070 - RNA, 15 nt, Homo sapiens
ugggucauucucacc

SEQ ID NO: 862071 - RNA, 21 nt, Homo sapiens
ugggucuucccuguaugauuc

SEQ ID NO: 862072 - RNA, 14 nt, Homo sapiens
ugguaaaauacuuc

SEQ ID NO: 862073 - RNA, 15 nt, Homo sapiens
ugguaugcacugguu

SEQ ID NO: 862074 - RNA, 15 nt, Homo sapiens
uggucccauuauucu

SEQ ID NO: 862075 - RNA, 18 nt, Homo sapiens
uggugacccagucagagu

SEQ ID NO: 862076 - RNA, 12 nt, Homo sapiens
uggugcagugaa

SEQ ID NO: 862077 - RNA, 23 nt, Homo sapiens
uggugucuuuuauauuugaauua

SEQ ID NO: 862078 - RNA, 14 nt, Homo sapiens
ugguuuaaaccaaa

SEQ ID NO: 862079 - RNA, 21 nt, Homo sapiens
uguaaagcaggugcccaggaa

SEQ ID NO: 862080 - RNA, 21 nt, Homo sapiens
uguaaauaucccagagaacaa

SEQ ID NO: 862081 - RNA, 12 nt, Homo sapiens
uguaaguagcaa

SEQ ID NO: 862082 - RNA, 19 nt, Homo sapiens
uguaccuuucugacaauaa

SEQ ID NO: 862083 - RNA, 15 nt, Homo sapiens
uguacuugccuuauu

SEQ ID NO: 862084 - RNA, 18 nt, Homo sapiens
uguacuugccuuauuaga

SEQ ID NO: 862085 - RNA, 11 nt, Homo sapiens
uguacuuucau

SEQ ID NO: 862086 - RNA, 17 nt, Homo sapiens
uguagacccuaacccgg

SEQ ID NO: 862087 - RNA, 13 nt, Homo sapiens
uguaugccuauuc

SEQ ID NO: 862088 - RNA, 20 nt, Homo sapiens
uguccuucccacggccacug

SEQ ID NO: 862089 - RNA, 18 nt, Homo sapiens
ugucuacguuaccaggca

SEQ ID NO: 862090 - RNA, 15 nt, Homo sapiens
ugucugacuucucag

SEQ ID NO: 862091 - RNA, 16 nt, Homo sapiens
ugugaaagcaccauca

SEQ ID NO: 862092 - RNA, 20 nt, Homo sapiens
ugugaccaaugucuugaugc

SEQ ID NO: 862093 - RNA, 11 nt, Homo sapiens
ugugcacauuu

SEQ ID NO: 862094 - RNA, 15 nt, Homo sapiens
ugugggcuccaugua

SEQ ID NO: 862095 - RNA, 21 nt, Homo sapiens
ugugugaucugugggcacauu

SEQ ID NO: 862096 - RNA, 16 nt, Homo sapiens
uguguuuuacaguaua

SEQ ID NO: 862097 - RNA, 13 nt, Homo sapiens
uguugaacaauag

SEQ ID NO: 862098 - RNA, 22 nt, Homo sapiens
uguuuaaaauaaaaguaccuau

SEQ ID NO: 862099 - RNA, 19 nt, Homo sapiens
uguuucuucuuugacuaua

SEQ ID NO: 862100 - RNA, 20 nt, Homo sapiens
uguuucuucuuugacuauaa

SEQ ID NO: 862101 - RNA, 12 nt, Homo sapiens
uuaaaaauaugu

SEQ ID NO: 862102 - RNA, 16 nt, Homo sapiens
uuaaaccaaacggaac

SEQ ID NO: 862103 - RNA, 16 nt, Homo sapiens
uuaaaccaagcagcuu

SEQ ID NO: 862104 - RNA, 16 nt, Homo sapiens
uuaaguugauggugau

SEQ ID NO: 862105 - RNA, 20 nt, Homo sapiens
uuaauacagggcauuuuggu

SEQ ID NO: 862106 - RNA, 15 nt, Homo sapiens
uuaaucccacuugcc

SEQ ID NO: 862107 - RNA, 15 nt, Homo sapiens
uuaaugaaauaccaa

SEQ ID NO: 862108 - RNA, 15 nt, Homo sapiens
uuaauguacuuucau

SEQ ID NO: 862109 - RNA, 21 nt, Homo sapiens
uuaauugguuugugccuuaca

SEQ ID NO: 862110 - RNA, 23 nt, Homo sapiens
uuaauugguuugugccuuacauu

SEQ ID NO: 862111 - RNA, 19 nt, Homo sapiens
uuacauuugaaaucuauga

SEQ ID NO: 862112 - RNA, 16 nt, Homo sapiens
uuacauuuugugcagu

SEQ ID NO: 862113 - RNA, 21 nt, Homo sapiens
uuacuaagaugaaauugccaa

SEQ ID NO: 862114 - RNA, 20 nt, Homo sapiens
uuacuacaugugggagcuuu

SEQ ID NO: 862115 - RNA, 15 nt, Homo sapiens
uuacuaucaugucaa

SEQ ID NO: 862116 - RNA, 17 nt, Homo sapiens
uuacuaucaugucaaac

SEQ ID NO: 862117 - RNA, 16 nt, Homo sapiens
uuagaaaugauuucaa

SEQ ID NO: 862118 - RNA, 15 nt, Homo sapiens
uuagacccugcauuu

SEQ ID NO: 862119 - RNA, 15 nt, Homo sapiens
uuagagacuguaaau

SEQ ID NO: 862120 - RNA, 21 nt, Homo sapiens
uuagccccaugaguuugccau

SEQ ID NO: 862121 - RNA, 18 nt, Homo sapiens
uuaguauuugcauauucu

SEQ ID NO: 862122 - RNA, 14 nt, Homo sapiens
uuauaauauacuau

SEQ ID NO: 862123 - RNA, 14 nt, Homo sapiens
uuaucaauaguucc

SEQ ID NO: 862124 - RNA, 13 nt, Homo sapiens
uuaucuauggcac

SEQ ID NO: 862125 - RNA, 17 nt, Homo sapiens
uuaucuuguacagccuu

SEQ ID NO: 862126 - RNA, 22 nt, Homo sapiens
uuauguaugugaaaguuacaaa

SEQ ID NO: 862127 - RNA, 20 nt, Homo sapiens
uuauuaacauauauuguuau

SEQ ID NO: 862128 - RNA, 22 nt, Homo sapiens
uuauugaggaaaauuaauauca

SEQ ID NO: 862129 - RNA, 23 nt, Homo sapiens
uuauuuaccugaaauaaaauuca

SEQ ID NO: 862130 - RNA, 21 nt, Homo sapiens
uucaaucuuaacaaaagugaa

SEQ ID NO: 862131 - RNA, 17 nt, Homo sapiens
uucacagaugugugauu

SEQ ID NO: 862132 - RNA, 14 nt, Homo sapiens
uucacucaaucucu

SEQ ID NO: 862133 - RNA, 14 nt, Homo sapiens
uucagacucucucc

SEQ ID NO: 862134 - RNA, 18 nt, Homo sapiens
uucaggaaugggccaagc

SEQ ID NO: 862135 - RNA, 21 nt, Homo sapiens
uucaguuuguccacacaagac

SEQ ID NO: 862136 - RNA, 19 nt, Homo sapiens
uucauaauuucuucacuca

SEQ ID NO: 862137 - RNA, 18 nt, Homo sapiens
uucaucaccagacuuugg

SEQ ID NO: 862138 - RNA, 22 nt, Homo sapiens
uucaucgcaguggacugugucc

SEQ ID NO: 862139 - RNA, 16 nt, Homo sapiens
uucaugauuugcaacu

SEQ ID NO: 862140 - RNA, 18 nt, Homo sapiens
uucauuaauacagggcau

SEQ ID NO: 862141 - RNA, 14 nt, Homo sapiens
uucauuuugcaacu

SEQ ID NO: 862142 - RNA, 16 nt, Homo sapiens
uuccaagccugggcca

SEQ ID NO: 862143 - RNA, 23 nt, Homo sapiens
uuccacuuagaaauugcauuucc

SEQ ID NO: 862144 - RNA, 20 nt, Homo sapiens
uuccagaacuaccaaaauga

SEQ ID NO: 862145 - RNA, 21 nt, Homo sapiens
uuccagccguguuguagcuaa

SEQ ID NO: 862146 - RNA, 12 nt, Homo sapiens
uuccaugguggu

SEQ ID NO: 862147 - RNA, 16 nt, Homo sapiens
uucccacaggacauuu

SEQ ID NO: 862148 - RNA, 23 nt, Homo sapiens
uucccggcuggacuuuugcagcu

SEQ ID NO: 862149 - RNA, 13 nt, Homo sapiens
ugcauuuauagca

SEQ ID NO: 862150 - RNA, 17 nt, Homo sapiens
ugccagugggaacuccu

SEQ ID NO: 862151 - RNA, 17 nt, Homo sapiens
ugcccacgucccgggca

SEQ ID NO: 862152 - RNA, 23 nt, Homo sapiens
ugcccacgucccgggcacuguca

SEQ ID NO: 862153 - RNA, 19 nt, Homo sapiens
ugcccuguaccugugcacg

SEQ ID NO: 862154 - RNA, 14 nt, Homo sapiens
ugccuauaaaggaa

SEQ ID NO: 862155 - RNA, 21 nt, Homo sapiens
ugccucagugagaucagucag

SEQ ID NO: 862156 - RNA, 22 nt, Homo sapiens
ugccugcggaguugugcacgua

SEQ ID NO: 862157 - RNA, 18 nt, Homo sapiens
ugccuucuccagacaaac

SEQ ID NO: 862158 - RNA, 17 nt, Homo sapiens
ugcgacaccaccaacag

SEQ ID NO: 862159 - RNA, 16 nt, Homo sapiens
ugcggaguugugcacg

SEQ ID NO: 862160 - RNA, 23 nt, Homo sapiens
ugcuaauauauguauaugcaaua

SEQ ID NO: 862161 - RNA, 22 nt, Homo sapiens
ugcuaauccucuuuuucuaguc

SEQ ID NO: 862162 - RNA, 17 nt, Homo sapiens
ugcuauaacuauguuga

SEQ ID NO: 862163 - RNA, 22 nt, Homo sapiens
ugcuccgucuaagucaugagcu

SEQ ID NO: 862164 - RNA, 13 nt, Homo sapiens
ugcucucccaggu

SEQ ID NO: 862165 - RNA, 17 nt, Homo sapiens
ugcucuggcaagagacu

SEQ ID NO: 862166 - RNA, 19 nt, Homo sapiens
ugcugacagauguuccauc

SEQ ID NO: 862167 - RNA, 23 nt, Homo sapiens
ugcugcugagugcaccacuucaa

SEQ ID NO: 862168 - RNA, 15 nt, Homo sapiens
ugcugggaaguggcu

SEQ ID NO: 862169 - RNA, 16 nt, Homo sapiens
ugcuguaaaagugaau

SEQ ID NO: 862170 - RNA, 14 nt, Homo sapiens
ugcugucaugccca

SEQ ID NO: 862171 - RNA, 20 nt, Homo sapiens
ugcuuauguaugccuauuca

SEQ ID NO: 862172 - RNA, 16 nt, Homo sapiens
ugcuucgcagaugucc

SEQ ID NO: 862173 - RNA, 17 nt, Homo sapiens
ugcuuuuggagcugaga

SEQ ID NO: 862174 - RNA, 23 nt, Homo sapiens
uggaaccaacacuaacauauaau

SEQ ID NO: 862175 - RNA, 17 nt, Homo sapiens
uggaacugcugccauga

SEQ ID NO: 862176 - RNA, 21 nt, Homo sapiens
uggaauauuguccauugucca

SEQ ID NO: 862177 - RNA, 23 nt, Homo sapiens
uggagaaacccuugaaaagacau

SEQ ID NO: 862178 - RNA, 13 nt, Homo sapiens
uggagaagcuccc

SEQ ID NO: 862179 - RNA, 18 nt, Homo sapiens
uggaguccgaugauucuc

SEQ ID NO: 862180 - RNA, 23 nt, Homo sapiens
uggauuuggguuggaagugaggg

SEQ ID NO: 862181 - RNA, 18 nt, Homo sapiens
uggauuuuccaccaaauu

SEQ ID NO: 862182 - RNA, 11 nt, Homo sapiens
uggcaaagaca

SEQ ID NO: 862183 - RNA, 15 nt, Homo sapiens
uggcaauaggacaaa

SEQ ID NO: 862184 - RNA, 22 nt, Homo sapiens
uggcagcaacaaaggauuugaa

SEQ ID NO: 862185 - RNA, 22 nt, Homo sapiens
uggccauuuuguaccagggcuc

SEQ ID NO: 862186 - RNA, 13 nt, Homo sapiens
uggccccagcucc

SEQ ID NO: 862187 - RNA, 14 nt, Homo sapiens
uggccgcugcccac

SEQ ID NO: 862188 - RNA, 23 nt, Homo sapiens
uggccuguguggugccacccugc

SEQ ID NO: 862189 - RNA, 14 nt, Homo sapiens
uggcuagaggacau

SEQ ID NO: 862190 - RNA, 16 nt, Homo sapiens
uggcucgggacuucaa

SEQ ID NO: 862191 - RNA, 23 nt, Homo sapiens
ugggagaggagaggcugcuguca

SEQ ID NO: 862192 - RNA, 18 nt, Homo sapiens
ugggccaagucaaagaca

SEQ ID NO: 862193 - RNA, 16 nt, Homo sapiens
ugggcccuuugagugc

SEQ ID NO: 862194 - RNA, 17 nt, Homo sapiens
ugggcuacacagcagcu

SEQ ID NO: 862195 - RNA, 22 nt, Homo sapiens
uggggacagagcagaacuuuca

SEQ ID NO: 862196 - RNA, 24 nt, Homo sapiens
uggggaggugguaagaacaccuga

SEQ ID NO: 862197 - RNA, 16 nt, Homo sapiens
uggggcgacugugaaa

SEQ ID NO: 862198 - RNA, 22 nt, Homo sapiens
uggggcuuccauggugguuuca

SEQ ID NO: 862199 - RNA, 15 nt, Homo sapiens
uucacuuuugacaaa

SEQ ID NO: 862200 - RNA, 14 nt, Homo sapiens
uucagccaggagau

SEQ ID NO: 862201 - RNA, 18 nt, Homo sapiens
uucagcucacacaugaga

SEQ ID NO: 862202 - RNA, 19 nt, Homo sapiens
uucaguaaacaccaugaag

SEQ ID NO: 862203 - RNA, 16 nt, Homo sapiens
uucagugcuucgcaga

SEQ ID NO: 862204 - RNA, 20 nt, Homo sapiens
uucauggcuuuaacaguaau

SEQ ID NO: 862205 - RNA, 15 nt, Homo sapiens
uucauucccucccca

SEQ ID NO: 862206 - RNA, 17 nt, Homo sapiens
uuccaccaaauucugaa

SEQ ID NO: 862207 - RNA, 13 nt, Homo sapiens
uuccacugacagg

SEQ ID NO: 862208 - RNA, 10 nt, Homo sapiens
uuccagacag

SEQ ID NO: 862209 - RNA, 20 nt, Homo sapiens
uuccagacaggguggggcuu

SEQ ID NO: 862210 - RNA, 16 nt, Homo sapiens
uuccauuugcaaggga

SEQ ID NO: 862211 - RNA, 15 nt, Homo sapiens
uucccaaggccaguc

SEQ ID NO: 862212 - RNA, 17 nt, Homo sapiens
uucccacaggacauuuc

SEQ ID NO: 862213 - RNA, 13 nt, Homo sapiens
uuccccacucccg

SEQ ID NO: 862214 - RNA, 21 nt, Homo sapiens
uuccuucaugaucaucacaau

SEQ ID NO: 862215 - RNA, 18 nt, Homo sapiens
uuccuuccaagucuuccu

SEQ ID NO: 862216 - RNA, 22 nt, Homo sapiens
uucuaaaggggacagaucuuga

SEQ ID NO: 862217 - RNA, 15 nt, Homo sapiens
uucuacuuugccaca

SEQ ID NO: 862218 - RNA, 20 nt, Homo sapiens
uucuagacaguauugccacc

SEQ ID NO: 862219 - RNA, 20 nt, Homo sapiens
uucucacuccuaccugguaa

SEQ ID NO: 862220 - RNA, 14 nt, Homo sapiens
uucuccagacaaac

SEQ ID NO: 862221 - RNA, 16 nt, Homo sapiens
uucucucuuugucccg

SEQ ID NO: 862222 - RNA, 16 nt, Homo sapiens
uucugaucugaugcaa

SEQ ID NO: 862223 - RNA, 19 nt, Homo sapiens
uucuuaauauaacugccuu

SEQ ID NO: 862224 - RNA, 17 nt, Homo sapiens
uucuucacucaaucucu

SEQ ID NO: 862225 - RNA, 21 nt, Homo sapiens
uucuugaguuuagugaucuga

SEQ ID NO: 862226 - RNA, 17 nt, Homo sapiens
uucuuguaaacauugcc

SEQ ID NO: 862227 - RNA, 22 nt, Homo sapiens
uucuuuccuucugaucugagaa

SEQ ID NO: 862228 - RNA, 13 nt, Homo sapiens
uugaaaucuauga

SEQ ID NO: 862229 - RNA, 15 nt, Homo sapiens
uugaauuacagggaa

SEQ ID NO: 862230 - RNA, 21 nt, Homo sapiens
uugaauuuugaaccaugugac

SEQ ID NO: 862231 - RNA, 23 nt, Homo sapiens
uugacaaacucucccuucacucc

SEQ ID NO: 862232 - RNA, 19 nt, Homo sapiens
uugacaguucauauguacc

SEQ ID NO: 862233 - RNA, 19 nt, Homo sapiens
uugagcuuaagaauuuuga

SEQ ID NO: 862234 - RNA, 20 nt, Homo sapiens
uugcagcuuauauucaucca

SEQ ID NO: 862235 - RNA, 16 nt, Homo sapiens
uugccacuacccccuc

SEQ ID NO: 862236 - RNA, 15 nt, Homo sapiens
uugcuggcaaagaca

SEQ ID NO: 862237 - RNA, 16 nt, Homo sapiens
uugcuggcaaagacag

SEQ ID NO: 862238 - RNA, 23 nt, Homo sapiens
uuggcaauucuucuucucaagca

SEQ ID NO: 862239 - RNA, 22 nt, Homo sapiens
uuggcuguagaaggagacagag

SEQ ID NO: 862240 - RNA, 15 nt, Homo sapiens
uugggaacugcaaua

SEQ ID NO: 862241 - RNA, 15 nt, Homo sapiens
uugggcccuuugagu

SEQ ID NO: 862242 - RNA, 14 nt, Homo sapiens
uugguaugugacau

SEQ ID NO: 862243 - RNA, 18 nt, Homo sapiens
uuguaaaccggcuggacc

SEQ ID NO: 862244 - RNA, 19 nt, Homo sapiens
uuguauaggccaucuguaa

SEQ ID NO: 862245 - RNA, 18 nt, Homo sapiens
uugugaaagcaccaucau

SEQ ID NO: 862246 - RNA, 16 nt, Homo sapiens
uugugggggugucaca

SEQ ID NO: 862247 - RNA, 20 nt, Homo sapiens
uuguguuuuguuuuguauca

SEQ ID NO: 862248 - RNA, 17 nt, Homo sapiens
uuuaaaaauucacuucu

SEQ ID NO: 862249 - RNA, 15 nt, Homo sapiens
uuuaacaacuaugau

SEQ ID NO: 862250 - RNA, 22 nt, Homo sapiens
uuuaauaacuaaaccagauucu

SEQ ID NO: 862251 - RNA, 14 nt, Homo sapiens
uuuaaucacauucg

SEQ ID NO: 862252 - RNA, 18 nt, Homo sapiens
uuuaccuggaaaccagaa

SEQ ID NO: 862253 - RNA, 15 nt, Homo sapiens
uuuagagacuguaaa

SEQ ID NO: 862254 - RNA, 13 nt, Homo sapiens
uuuagggugauca

SEQ ID NO: 862255 - RNA, 18 nt, Homo sapiens
uuuaucuauggcacccau

SEQ ID NO: 862256 - RNA, 18 nt, Homo sapiens
uuucaggagguacuguga

SEQ ID NO: 862257 - RNA, 20 nt, Homo sapiens
uuucuagacaguauugccac

SEQ ID NO: 862258 - RNA, 16 nt, Homo sapiens
uuucugaucugaugca

SEQ ID NO: 862259 - RNA, 14 nt, Homo sapiens
uuucuuacauuagc

SEQ ID NO: 862260 - RNA, 18 nt, Homo sapiens
uuugaaaggcuuuccuca

SEQ ID NO: 862261 - RNA, 15 nt, Homo sapiens
uuugaaaucuaugaa

SEQ ID NO: 862262 - RNA, 18 nt, Homo sapiens
uuugaaauuaaccucuca

SEQ ID NO: 862263 - RNA, 19 nt, Homo sapiens
uuugaauacaggcauagag

SEQ ID NO: 862264 - RNA, 20 nt, Homo sapiens
uuugaauguugaauguuuga

SEQ ID NO: 862265 - RNA, 15 nt, Homo sapiens
uuugcugcagacuca

SEQ ID NO: 862266 - RNA, 17 nt, Homo sapiens
uuuggaauauuguccau

SEQ ID NO: 862267 - RNA, 11 nt, Homo sapiens
uuugggagacu

SEQ ID NO: 862268 - RNA, 16 nt, Homo sapiens
uuuguaucauuaugaa

SEQ ID NO: 862269 - RNA, 20 nt, Homo sapiens
uuuguaucauuaugaaguca

SEQ ID NO: 862270 - RNA, 21 nt, Homo sapiens
uuuuaagacuuuucuuuccuu

SEQ ID NO: 862271 - RNA, 21 nt, Homo sapiens
uuuuacacucuagugccauau

SEQ ID NO: 862272 - RNA, 21 nt, Homo sapiens
uuuucaagaaagcauugccag

SEQ ID NO: 862273 - RNA, 18 nt, Homo sapiens
uuuugcacacuuugccau

SEQ ID NO: 862274 - RNA, 20 nt, Homo sapiens
uuuugcuggucacugccaug

SEQ ID NO: 862275 - RNA, 17 nt, Homo sapiens
aaguagcacccuggauu

SEQ ID NO: 862276 - RNA, 16 nt, Homo sapiens
aagucauaccaaugaa

SEQ ID NO: 862277 - RNA, 14 nt, Homo sapiens
aagucccaccaggg

SEQ ID NO: 862278 - RNA, 19 nt, Homo sapiens
aaguccuacaagcuaaaau

SEQ ID NO: 862279 - RNA, 19 nt, Homo sapiens
aagucucauggcaguccca

SEQ ID NO: 862280 - RNA, 22 nt, Homo sapiens
aagugauaucccccagccucaa

SEQ ID NO: 862281 - RNA, 17 nt, Homo sapiens
aagugcaauccauguau

SEQ ID NO: 862282 - RNA, 16 nt, Homo sapiens
aaguuucacugacuua

SEQ ID NO: 862283 - RNA, 18 nt, Homo sapiens
aauaaaguucuguacuca

SEQ ID NO: 862284 - RNA, 23 nt, Homo sapiens
aauacaauaguaugcagcuaaaa

SEQ ID NO: 862285 - RNA, 20 nt, Homo sapiens
aauacagucuuccauuugca

SEQ ID NO: 862286 - RNA, 18 nt, Homo sapiens
aauaccaaaauuauuuca

SEQ ID NO: 862287 - RNA, 16 nt, Homo sapiens
aauagaugaguccugu

SEQ ID NO: 862288 - RNA, 18 nt, Homo sapiens
aauaguaauaucaauaaa

SEQ ID NO: 862289 - RNA, 21 nt, Homo sapiens
aauaugcacuuucccuagaaa

SEQ ID NO: 862290 - RNA, 15 nt, Homo sapiens
aauauggacaucugg

SEQ ID NO: 862291 - RNA, 14 nt, Homo sapiens
aauauucuugucca

SEQ ID NO: 862292 - RNA, 20 nt, Homo sapiens
aauauugucacaacacugaa

SEQ ID NO: 862293 - RNA, 18 nt, Homo sapiens
aaucaaguuggcuucuaa

SEQ ID NO: 862294 - RNA, 17 nt, Homo sapiens
aaucagaacuguuggca

SEQ ID NO: 862295 - RNA, 21 nt, Homo sapiens
aaucagaaucuuuaaagagga

SEQ ID NO: 862296 - RNA, 17 nt, Homo sapiens
aaucauuuuaauuauua

SEQ ID NO: 862297 - RNA, 20 nt, Homo sapiens
aaucccuagucuucaagcag

SEQ ID NO: 862298 - RNA, 16 nt, Homo sapiens
aauccuguccucagcu

SEQ ID NO: 862299 - RNA, 22 nt, Homo sapiens
aauccuguccucagcuucuuaa

SEQ ID NO: 862300 - RNA, 15 nt, Homo sapiens
aauccuuuacuguua

SEQ ID NO: 862301 - RNA, 18 nt, Homo sapiens
aauccuuuacuguuaguc

SEQ ID NO: 862302 - RNA, 16 nt, Homo sapiens
aaugaagaauggccau

SEQ ID NO: 862303 - RNA, 18 nt, Homo sapiens
aaugagagaguguggaaa

SEQ ID NO: 862304 - RNA, 19 nt, Homo sapiens
aaugaugucguuugaauca

SEQ ID NO: 862305 - RNA, 21 nt, Homo sapiens
aaugaugucguuugaaucaca

SEQ ID NO: 862306 - RNA, 21 nt, Homo sapiens
aaugauuuugacauacaggag

SEQ ID NO: 862307 - RNA, 20 nt, Homo sapiens
aaugcauauccaacaugugc

SEQ ID NO: 862308 - RNA, 17 nt, Homo sapiens
aaugcuucugacuucau

SEQ ID NO: 862309 - RNA, 21 nt, Homo sapiens
aauguacaacuuuuuaccuag

SEQ ID NO: 862310 - RNA, 19 nt, Homo sapiens
aaugucuugaugcaugcac

SEQ ID NO: 862311 - RNA, 23 nt, Homo sapiens
aauguuaaguugauggugaugaa

SEQ ID NO: 862312 - RNA, 15 nt, Homo sapiens
aauguuacauuauua

SEQ ID NO: 862313 - RNA, 16 nt, Homo sapiens
aauguuacauuauuau

SEQ ID NO: 862314 - RNA, 18 nt, Homo sapiens
aauguuacauuauuauca

SEQ ID NO: 862315 - RNA, 15 nt, Homo sapiens
aauguuauagcugca

SEQ ID NO: 862316 - RNA, 21 nt, Homo sapiens
aauguuauagcugcauuuguc

SEQ ID NO: 862317 - RNA, 16 nt, Homo sapiens
aauuauuguaaacuuu

SEQ ID NO: 862318 - RNA, 13 nt, Homo sapiens
aauucucuaucau

SEQ ID NO: 862319 - RNA, 18 nt, Homo sapiens
aauugguuaaucacuuaa

SEQ ID NO: 862320 - RNA, 22 nt, Homo sapiens
aauuguuuuucugaaaguauca

SEQ ID NO: 862321 - RNA, 16 nt, Homo sapiens
aauuuggauuuuccac

SEQ ID NO: 862322 - RNA, 11 nt, Homo sapiens
acaaaagugaa

SEQ ID NO: 862323 - RNA, 20 nt, Homo sapiens
acaaaauaaccaauccugga

SEQ ID NO: 862324 - RNA, 19 nt, Homo sapiens
acaaacucucccuucacuc

SEQ ID NO: 862325 - RNA, 18 nt, Homo sapiens
acaaagccuuauccagca

SEQ ID NO: 862326 - RNA, 19 nt, Homo sapiens
acaagcagucuuuuucuac

SEQ ID NO: 862327 - RNA, 17 nt, Homo sapiens
acaagugcucaguucca

SEQ ID NO: 862328 - RNA, 15 nt, Homo sapiens
acaauagaaaccugu

SEQ ID NO: 862329 - RNA, 15 nt, Homo sapiens
acaaucuguauauaa

SEQ ID NO: 862330 - RNA, 13 nt, Homo sapiens
acacacucuucaa

SEQ ID NO: 862331 - RNA, 17 nt, Homo sapiens
acacagcugcagagaca

SEQ ID NO: 862332 - RNA, 20 nt, Homo sapiens
acacgagguaugaggucuag

SEQ ID NO: 862333 - RNA, 19 nt, Homo sapiens
acacugcgaacucucagga

SEQ ID NO: 862334 - RNA, 19 nt, Homo sapiens
acacugcugggaaguggcu

SEQ ID NO: 862335 - RNA, 23 nt, Homo sapiens
acacuggcuuuggguagugccau

SEQ ID NO: 862336 - RNA, 21 nt, Homo sapiens
acacugggcuucuagaaccag

SEQ ID NO: 862337 - RNA, 12 nt, Homo sapiens
acagaagguccu

SEQ ID NO: 862338 - RNA, 20 nt, Homo sapiens
acagaccuaggauuucauga

SEQ ID NO: 862339 - RNA, 17 nt, Homo sapiens
acagagcagaacuuuca

SEQ ID NO: 862340 - RNA, 23 nt, Homo sapiens
acagagcugguugggaagacaug

SEQ ID NO: 862341 - RNA, 19 nt, Homo sapiens
acagaucuugagcaaggca

SEQ ID NO: 862342 - RNA, 22 nt, Homo sapiens
acagaugugugauucacagugu

SEQ ID NO: 862343 - RNA, 14 nt, Homo sapiens
acagccuggcacag

SEQ ID NO: 862344 - RNA, 18 nt, Homo sapiens
acagccuggcacagggca

SEQ ID NO: 862345 - RNA, 20 nt, Homo sapiens
acagcucgggcccucuguga

SEQ ID NO: 862346 - RNA, 23 nt, Homo sapiens
acagcucgggcccucugugagau

SEQ ID NO: 862347 - RNA, 18 nt, Homo sapiens
acagcuucauguucccaa

SEQ ID NO: 862348 - RNA, 19 nt, Homo sapiens
acagcuucauguucccaaa

SEQ ID NO: 862349 - RNA, 14 nt, Homo sapiens
acaggcaguguucu

SEQ ID NO: 862350 - RNA, 16 nt, Homo sapiens
acaggcccuuccucuc

SEQ ID NO: 862351 - RNA, 21 nt, Homo sapiens
acaggcccuuccucuccacug

SEQ ID NO: 862352 - RNA, 22 nt, Homo sapiens
acaggcccuuccucuccacugc

SEQ ID NO: 862353 - RNA, 14 nt, Homo sapiens
acaggggacacuga

SEQ ID NO: 862354 - RNA, 16 nt, Homo sapiens
acaguaacuaagcaca

SEQ ID NO: 862355 - RNA, 19 nt, Homo sapiens
acaguacagcuauuucuca

SEQ ID NO: 862356 - RNA, 18 nt, Homo sapiens
acagucuuccauuugcaa

SEQ ID NO: 862357 - RNA, 22 nt, Homo sapiens
acaguuaaaggcaacccugagg

SEQ ID NO: 862358 - RNA, 18 nt, Homo sapiens
acauaacuguaacauaua

SEQ ID NO: 862359 - RNA, 12 nt, Homo sapiens
acaucaagcaca

SEQ ID NO: 862360 - RNA, 13 nt, Homo sapiens
acaucaagcacag

SEQ ID NO: 862361 - RNA, 21 nt, Homo sapiens
acaugaacguuuucucuucac

SEQ ID NO: 862362 - RNA, 23 nt, Homo sapiens
acaugaauugcauuuuacuuuaa

SEQ ID NO: 862363 - RNA, 20 nt, Homo sapiens
acauuauugaggaaaauuaa

SEQ ID NO: 862364 - RNA, 17 nt, Homo sapiens
acauucccucucaucca

SEQ ID NO: 862365 - RNA, 22 nt, Homo sapiens
acauuugaaaucuaugaaauau

SEQ ID NO: 862366 - RNA, 15 nt, Homo sapiens
acauuuuaaacacuu

SEQ ID NO: 862367 - RNA, 15 nt, Homo sapiens
acauuuugugcagug

SEQ ID NO: 862368 - RNA, 12 nt, Homo sapiens
accaaauucuga

SEQ ID NO: 862369 - RNA, 18 nt, Homo sapiens
accaaauucugaauuugu

SEQ ID NO: 862370 - RNA, 19 nt, Homo sapiens
accaacaggcguucucagc

SEQ ID NO: 862371 - RNA, 13 nt, Homo sapiens
accaauuagcauu

SEQ ID NO: 862372 - RNA, 23 nt, Homo sapiens
accagaccgcuccccaauacucu

SEQ ID NO: 862373 - RNA, 16 nt, Homo sapiens
aaaaacaauauaugua

SEQ ID NO: 862374 - RNA, 14 nt, Homo sapiens
aaaacacugugcac

SEQ ID NO: 862375 - RNA, 18 nt, Homo sapiens
aaaacuuuaaucccacuu

SEQ ID NO: 862376 - RNA, 16 nt, Homo sapiens
aaaagaaauucuguua

SEQ ID NO: 862377 - RNA, 23 nt, Homo sapiens
aaaaucaugcuuauaagcaacau

SEQ ID NO: 862378 - RNA, 15 nt, Homo sapiens
aaaauggaacauuaa

SEQ ID NO: 862379 - RNA, 13 nt, Homo sapiens
aaaaugugcagua

SEQ ID NO: 862380 - RNA, 18 nt, Homo sapiens
aaaauuauuugcauaaca

SEQ ID NO: 862381 - RNA, 14 nt, Homo sapiens
aaaauucacuucua

SEQ ID NO: 862382 - RNA, 20 nt, Homo sapiens
aaacaaagccuuauccagca

SEQ ID NO: 862383 - RNA, 18 nt, Homo sapiens
aaacauggccacauccaa

SEQ ID NO: 862384 - RNA, 20 nt, Homo sapiens
aaacaugguggguccauggg

SEQ ID NO: 862385 - RNA, 19 nt, Homo sapiens
aaaccaagccguggcuucc

SEQ ID NO: 862386 - RNA, 16 nt, Homo sapiens
aaaccauuaccuuaaa

SEQ ID NO: 862387 - RNA, 17 nt, Homo sapiens
aaaccuuuccuguaaca

SEQ ID NO: 862388 - RNA, 16 nt, Homo sapiens
aaacguccuacuguau

SEQ ID NO: 862389 - RNA, 16 nt, Homo sapiens
aaacuaacacccaguc

SEQ ID NO: 862390 - RNA, 12 nt, Homo sapiens
aaacugugcacc

SEQ ID NO: 862391 - RNA, 13 nt, Homo sapiens
aaacuucaagggu

SEQ ID NO: 862392 - RNA, 19 nt, Homo sapiens
aaacuuccacuaccuuuaa

SEQ ID NO: 862393 - RNA, 19 nt, Homo sapiens
aaagaaccccccuccccaa

SEQ ID NO: 862394 - RNA, 18 nt, Homo sapiens
aaagacaccuacugagug

SEQ ID NO: 862395 - RNA, 19 nt, Homo sapiens
aaagacuuuccucuuaguc

SEQ ID NO: 862396 - RNA, 22 nt, Homo sapiens
aaaggaagucucugggcccaga

SEQ ID NO: 862397 - RNA, 16 nt, Homo sapiens
aaaggacaaaaauaua

SEQ ID NO: 862398 - RNA, 21 nt, Homo sapiens
aaaguaccuauugaacaugug

SEQ ID NO: 862399 - RNA, 14 nt, Homo sapiens
aaaguagacuucau

SEQ ID NO: 862400 - RNA, 15 nt, Homo sapiens
aaauacagucuucca

SEQ ID NO: 862401 - RNA, 15 nt, Homo sapiens
aaauauauauugcau

SEQ ID NO: 862402 - RNA, 15 nt, Homo sapiens
aaauaucccagagaa

SEQ ID NO: 862403 - RNA, 14 nt, Homo sapiens
aaauccacagugag

SEQ ID NO: 862404 - RNA, 12 nt, Homo sapiens
aaaucuaugaaa

SEQ ID NO: 862405 - RNA, 20 nt, Homo sapiens
aaaucuggggaggacaaagg

SEQ ID NO: 862406 - RNA, 22 nt, Homo sapiens
aaaugcguuccucauccaugca

SEQ ID NO: 862407 - RNA, 22 nt, Homo sapiens
aaaugcuguauuagucacagag

SEQ ID NO: 862408 - RNA, 22 nt, Homo sapiens
aaaugguccaggagaaggccaa

SEQ ID NO: 862409 - RNA, 16 nt, Homo sapiens
aaauguacauuaauua

SEQ ID NO: 862410 - RNA, 22 nt, Homo sapiens
aaauguuauuuuuuaauuauua

SEQ ID NO: 862411 - RNA, 23 nt, Homo sapiens
aaauguuuaauaucugacugaaa

SEQ ID NO: 862412 - RNA, 14 nt, Homo sapiens
aaauuaauaucaca

SEQ ID NO: 862413 - RNA, 14 nt, Homo sapiens
aaauuacagaagaa

SEQ ID NO: 862414 - RNA, 21 nt, Homo sapiens
aaauucacuucuauauauaca

SEQ ID NO: 862415 - RNA, 15 nt, Homo sapiens
aaauuguauuaucaa

SEQ ID NO: 862416 - RNA, 20 nt, Homo sapiens
aacaaaaauuaaaauccuca

SEQ ID NO: 862417 - RNA, 15 nt, Homo sapiens
aacaaauguauuuca

SEQ ID NO: 862418 - RNA, 21 nt, Homo sapiens
aacacauaauugcuuauguau

SEQ ID NO: 862419 - RNA, 17 nt, Homo sapiens
aacagcccucaggucag

SEQ ID NO: 862420 - RNA, 17 nt, Homo sapiens
aacaugggcaaagggag

SEQ ID NO: 862421 - RNA, 14 nt, Homo sapiens
aacauugcugccua

SEQ ID NO: 862422 - RNA, 18 nt, Homo sapiens
aaccacaggcagcauuua

SEQ ID NO: 862423 - RNA, 19 nt, Homo sapiens
aaccacaggcagcauuuag

SEQ ID NO: 862424 - RNA, 23 nt, Homo sapiens
aaccagaauuaggucaaguucau

SEQ ID NO: 862425 - RNA, 24 nt, Homo sapiens
aaccagaauuaggucaaguucaua

SEQ ID NO: 862426 - RNA, 20 nt, Homo sapiens
aaccagcucuuuggugccag

SEQ ID NO: 862427 - RNA, 12 nt, Homo sapiens
aaccaguucucu

SEQ ID NO: 862428 - RNA, 22 nt, Homo sapiens
aaccaugagaccacuguuauca

SEQ ID NO: 862429 - RNA, 15 nt, Homo sapiens
aaccccccuccccaa

SEQ ID NO: 862430 - RNA, 23 nt, Homo sapiens
aaccucuggcuagaggacauauu

SEQ ID NO: 862431 - RNA, 18 nt, Homo sapiens
aaccuugugugaguguga

SEQ ID NO: 862432 - RNA, 18 nt, Homo sapiens
aacggugagcauuguggc

SEQ ID NO: 862433 - RNA, 14 nt, Homo sapiens
aacguggggcagca

SEQ ID NO: 862434 - RNA, 21 nt, Homo sapiens
aacguggggcagcacagagag

SEQ ID NO: 862435 - RNA, 19 nt, Homo sapiens
aacuaagaaauaugcacaa

SEQ ID NO: 862436 - RNA, 23 nt, Homo sapiens
aacacuggcuuuggguagugcca

SEQ ID NO: 862437 - RNA, 19 nt, Homo sapiens
aacagccaaaaaggacuuu

SEQ ID NO: 862438 - RNA, 13 nt, Homo sapiens
aacagccagugga

SEQ ID NO: 862439 - RNA, 18 nt, Homo sapiens
aacagucugaaauaccuu

SEQ ID NO: 862440 - RNA, 17 nt, Homo sapiens
aacauaacuguaacaua

SEQ ID NO: 862441 - RNA, 19 nt, Homo sapiens
aacauaacuguaacauaua

SEQ ID NO: 862442 - RNA, 16 nt, Homo sapiens
aacauacuucagcuca

SEQ ID NO: 862443 - RNA, 14 nt, Homo sapiens
aacaugaagcacaa

SEQ ID NO: 862444 - RNA, 17 nt, Homo sapiens
aacauggccacauccaa

SEQ ID NO: 862445 - RNA, 14 nt, Homo sapiens
aacaugugcucagg

SEQ ID NO: 862446 - RNA, 13 nt, Homo sapiens
aacauugccugau

SEQ ID NO: 862447 - RNA, 23 nt, Homo sapiens
aaccagcucuuuggugccagcug

SEQ ID NO: 862448 - RNA, 19 nt, Homo sapiens
aacccuguuuuauugaguu

SEQ ID NO: 862449 - RNA, 21 nt, Homo sapiens
aaccucuggcuagaggacaua

SEQ ID NO: 862450 - RNA, 23 nt, Homo sapiens
aaccuguaaagcaggugcccagg

SEQ ID NO: 862451 - RNA, 17 nt, Homo sapiens
aacuaagaaauaugcac

SEQ ID NO: 862452 - RNA, 16 nt, Homo sapiens
aacuaccagauuugag

SEQ ID NO: 862453 - RNA, 11 nt, Homo sapiens
aacuacuguac

SEQ ID NO: 862454 - RNA, 13 nt, Homo sapiens
aacuacuguacau

SEQ ID NO: 862455 - RNA, 16 nt, Homo sapiens
aacuauguaacaugua

SEQ ID NO: 862456 - RNA, 15 nt, Homo sapiens
aacuauuuagagaau

SEQ ID NO: 862457 - RNA, 21 nt, Homo sapiens
aacugaauucugaacuuuuca

SEQ ID NO: 862458 - RNA, 21 nt, Homo sapiens
aacuggaaugcuguuacuuug

SEQ ID NO: 862459 - RNA, 15 nt, Homo sapiens
aacugggguggauuu

SEQ ID NO: 862460 - RNA, 14 nt, Homo sapiens
aacuuccacuaccu

SEQ ID NO: 862461 - RNA, 19 nt, Homo sapiens
aacuucugauuucucuuca

SEQ ID NO: 862462 - RNA, 15 nt, Homo sapiens
aacuugcugcugagu

SEQ ID NO: 862463 - RNA, 19 nt, Homo sapiens
aacuuggauguaccugccc

SEQ ID NO: 862464 - RNA, 13 nt, Homo sapiens
aacuuugcauguu

SEQ ID NO: 862465 - RNA, 18 nt, Homo sapiens
aagaaaauaugcaucuaa

SEQ ID NO: 862466 - RNA, 22 nt, Homo sapiens
aagacacgcccgacucucucca

SEQ ID NO: 862467 - RNA, 11 nt, Homo sapiens
aagacuuuucu

SEQ ID NO: 862468 - RNA, 12 nt, Homo sapiens
aagagaaggcaa

SEQ ID NO: 862469 - RNA, 21 nt, Homo sapiens
aagaggaaggccucuguggca

SEQ ID NO: 862470 - RNA, 20 nt, Homo sapiens
aagagguagagaaaauggaa

SEQ ID NO: 862471 - RNA, 20 nt, Homo sapiens
aagcacauuauguuugcaac

SEQ ID NO: 862472 - RNA, 14 nt, Homo sapiens
aagcagggacuggu

SEQ ID NO: 862473 - RNA, 15 nt, Homo sapiens
aagcaguuaguuccu

SEQ ID NO: 862474 - RNA, 20 nt, Homo sapiens
aagcaucuauucccaaagaa

SEQ ID NO: 862475 - RNA, 18 nt, Homo sapiens
aagcauugagcaaagggg

SEQ ID NO: 862476 - RNA, 15 nt, Homo sapiens
aagcccuuuacuuga

SEQ ID NO: 862477 - RNA, 22 nt, Homo sapiens
aagcucaucucagcuccugaaa

SEQ ID NO: 862478 - RNA, 19 nt, Homo sapiens
aagcugcagggaauuuuca

SEQ ID NO: 862479 - RNA, 21 nt, Homo sapiens
aaggaauguuaucaguauuaa

SEQ ID NO: 862480 - RNA, 23 nt, Homo sapiens
aaggacccuauauguggcauucc

SEQ ID NO: 862481 - RNA, 14 nt, Homo sapiens
aaggaugggaagga

SEQ ID NO: 862482 - RNA, 17 nt, Homo sapiens
aaggaugggaaggaggg

SEQ ID NO: 862483 - RNA, 22 nt, Homo sapiens
aagggcgcugagggcaggguuc

SEQ ID NO: 862484 - RNA, 14 nt, Homo sapiens
aaggugauuuuccu

SEQ ID NO: 862485 - RNA, 22 nt, Homo sapiens
aagucaaauauguagauugccu

SEQ ID NO: 862486 - RNA, 21 nt, Homo sapiens
aaguggugagaacuacucagg

SEQ ID NO: 862487 - RNA, 12 nt, Homo sapiens
aagugugugauc

SEQ ID NO: 862488 - RNA, 11 nt, Homo sapiens
aauaaaaccaa

SEQ ID NO: 862489 - RNA, 14 nt, Homo sapiens
aauaaagcuugcaa

SEQ ID NO: 862490 - RNA, 17 nt, Homo sapiens
aauaaauccaagacugu

SEQ ID NO: 862491 - RNA, 19 nt, Homo sapiens
aauaaauggguaacacuga

SEQ ID NO: 862492 - RNA, 20 nt, Homo sapiens
aauaauaagaggugcuacug

SEQ ID NO: 862493 - RNA, 14 nt, Homo sapiens
aauauaacugccuu

SEQ ID NO: 862494 - RNA, 16 nt, Homo sapiens
aauauauauaauacuu

SEQ ID NO: 862495 - RNA, 14 nt, Homo sapiens
aauaucccagagaa

SEQ ID NO: 862496 - RNA, 21 nt, Homo sapiens
aauaucccagagaacaaucac

SEQ ID NO: 862497 - RNA, 13 nt, Homo sapiens
aaucaaauagcau

SEQ ID NO: 862498 - RNA, 14 nt, Homo sapiens
aaucagcauucuca

SEQ ID NO: 862499 - RNA, 19 nt, Homo sapiens
aaucauuauuuucaaccau

SEQ ID NO: 862500 - RNA, 14 nt, Homo sapiens
aauccaagacuguc

SEQ ID NO: 862501 - RNA, 20 nt, Homo sapiens
aauccaugaaccaagaccau

SEQ ID NO: 862502 - RNA, 17 nt, Homo sapiens
aauccgaaaucagcagg

SEQ ID NO: 862503 - RNA, 19 nt, Homo sapiens
aaucuccuuuguccauuua

SEQ ID NO: 862504 - RNA, 22 nt, Homo sapiens
aaugauuucaaaaugauauuca

SEQ ID NO: 862505 - RNA, 15 nt, Homo sapiens
aaugauuuugacaua

SEQ ID NO: 862506 - RNA, 20 nt, Homo sapiens
aauggagggaauaauaccua

SEQ ID NO: 862507 - RNA, 14 nt, Homo sapiens
aauggggcuuccau

SEQ ID NO: 862508 - RNA, 23 nt, Homo sapiens
aaugguaaccgagccagcagcug

SEQ ID NO: 862509 - RNA, 15 nt, Homo sapiens
aaugguccuguuaug

SEQ ID NO: 862510 - RNA, 22 nt, Homo sapiens
aaugugaaaaugguccaggaga

SEQ ID NO: 862511 - RNA, 15 nt, Homo sapiens
aauguucacuuuuga

SEQ ID NO: 862512 - RNA, 22 nt, Homo sapiens
aauguuggcuagucugugccuc

SEQ ID NO: 862513 - RNA, 14 nt, Homo sapiens
aauguuuacacucu

SEQ ID NO: 862514 - RNA, 19 nt, Homo sapiens
aauuaaaauccucaaucca

SEQ ID NO: 862515 - RNA, 17 nt, Homo sapiens
aauuaaaaugugcagua

SEQ ID NO: 862516 - RNA, 15 nt, Homo sapiens
aauuaaggcagcuga

SEQ ID NO: 862517 - RNA, 14 nt, Homo sapiens
aauuagaugaacuc

SEQ ID NO: 862518 - RNA, 17 nt, Homo sapiens
aauucaauuaaaaccau

SEQ ID NO: 862519 - RNA, 20 nt, Homo sapiens
aauugccuucuagacacuga

SEQ ID NO: 862520 - RNA, 21 nt, Homo sapiens
aauugccuucuagacacugaa

SEQ ID NO: 862521 - RNA, 18 nt, Homo sapiens
aauuguaucaaaugugac

SEQ ID NO: 862522 - RNA, 19 nt, Homo sapiens
aauugugaucagaccauaa

SEQ ID NO: 862523 - RNA, 15 nt, Homo sapiens
aauuucuagacagua

SEQ ID NO: 862524 - RNA, 15 nt, Homo sapiens
aauuuguauaaccca

SEQ ID NO: 862525 - RNA, 22 nt, Homo sapiens
acaagaagccacagaccuagga

SEQ ID NO: 862526 - RNA, 15 nt, Homo sapiens
acaagaagugggagu

SEQ ID NO: 862527 - RNA, 13 nt, Homo sapiens
acaagacagcaga

SEQ ID NO: 862528 - RNA, 13 nt, Homo sapiens
acaauaguaugca

SEQ ID NO: 862529 - RNA, 14 nt, Homo sapiens
acaaucagcuccuu

SEQ ID NO: 862530 - RNA, 19 nt, Homo sapiens
acaaugaguaaaaucacag

SEQ ID NO: 862531 - RNA, 15 nt, Homo sapiens
acaauggcaauagga

SEQ ID NO: 862532 - RNA, 20 nt, Homo sapiens
acaauggcuggguuugggca

SEQ ID NO: 862533 - RNA, 23 nt, Homo sapiens
acaauggcuggguuugggcagug

SEQ ID NO: 862534 - RNA, 16 nt, Homo sapiens
acacaaccauagccug

SEQ ID NO: 862535 - RNA, 15 nt, Homo sapiens
acacaagacagcaga

SEQ ID NO: 862536 - RNA, 12 nt, Homo sapiens
acacaaucaaaa

SEQ ID NO: 862537 - RNA, 17 nt, Homo sapiens
acacacagccugugcuu

SEQ ID NO: 862538 - RNA, 22 nt, Homo sapiens
acacagcugcagagacagagag

SEQ ID NO: 862539 - RNA, 15 nt, Homo sapiens
acacaugagaucuag

SEQ ID NO: 862540 - RNA, 19 nt, Homo sapiens
acacccagucuguucccca

SEQ ID NO: 862541 - RNA, 19 nt, Homo sapiens
acacucauuaccgucugug

SEQ ID NO: 862542 - RNA, 19 nt, Homo sapiens
acacugaaccuuguugaug

SEQ ID NO: 862543 - RNA, 17 nt, Homo sapiens
acagaaaaaaucgucuc

SEQ ID NO: 862544 - RNA, 15 nt, Homo sapiens
acagaaaacgguuaa

SEQ ID NO: 862545 - RNA, 17 nt, Homo sapiens
acagaaauuaccccggg

SEQ ID NO: 862546 - RNA, 18 nt, Homo sapiens
acagaagccucacugcaa

SEQ ID NO: 862547 - RNA, 21 nt, Homo sapiens
acagacgucccuccacguuca

SEQ ID NO: 862548 - RNA, 24 nt, Homo sapiens
acagacuaugucacccaaugcaua

SEQ ID NO: 862549 - RNA, 20 nt, Homo sapiens
acagagagggggccaccucc

SEQ ID NO: 862550 - RNA, 19 nt, Homo sapiens
acagcagguuuauccagau

SEQ ID NO: 862551 - RNA, 21 nt, Homo sapiens
acagccccaaacaagcgccac

SEQ ID NO: 862552 - RNA, 14 nt, Homo sapiens
acaggcagcauuua

SEQ ID NO: 862553 - RNA, 17 nt, Homo sapiens
acaguauacgcuccauc

SEQ ID NO: 862554 - RNA, 14 nt, Homo sapiens
acauacuucagcuc

SEQ ID NO: 862555 - RNA, 21 nt, Homo sapiens
acauauucacagugaacauaa

SEQ ID NO: 862556 - RNA, 16 nt, Homo sapiens
acauccaagcuuccuu

SEQ ID NO: 862557 - RNA, 13 nt, Homo sapiens
acaucuaacaaag

SEQ ID NO: 862558 - RNA, 15 nt, Homo sapiens
acaucugugucuugu

SEQ ID NO: 862559 - RNA, 15 nt, Homo sapiens
acauggccgcugccc

SEQ ID NO: 862560 - RNA, 10 nt, Homo sapiens
acaugggagc

SEQ ID NO: 862561 - RNA, 15 nt, Homo sapiens
acauggugugccaca

SEQ ID NO: 862562 - RNA, 15 nt, Homo sapiens
acauuauuacuccuu

SEQ ID NO: 862563 - RNA, 15 nt, Homo sapiens
accaacccucagagc

SEQ ID NO: 862564 - RNA, 18 nt, Homo sapiens
accacaggcagcauuuag

SEQ ID NO: 862565 - RNA, 21 nt, Homo sapiens
accacuaucuuuuguucuacc

SEQ ID NO: 862566 - RNA, 14 nt, Homo sapiens
accagagcaccuca

SEQ ID NO: 862567 - RNA, 13 nt, Homo sapiens
accaggucaggga

SEQ ID NO: 862568 - RNA, 23 nt, Homo sapiens
accauagccuguuucguagccau

SEQ ID NO: 862569 - RNA, 15 nt, Homo sapiens
accaucauaguacag

SEQ ID NO: 862570 - RNA, 21 nt, Homo sapiens
accaugucguaguuacucuca

SEQ ID NO: 862571 - RNA, 20 nt, Homo sapiens
ucagggagaguuugggaacu

SEQ ID NO: 862572 - RNA, 17 nt, Homo sapiens
ucaggucagagcccagg

SEQ ID NO: 862573 - RNA, 17 nt, Homo sapiens
ucaguaaauuuuggaaa

SEQ ID NO: 862574 - RNA, 18 nt, Homo sapiens
ucagugaauaaaccauca

SEQ ID NO: 862575 - RNA, 21 nt, Homo sapiens
ucagugcucccucacauguca

SEQ ID NO: 862576 - RNA, 21 nt, Homo sapiens
ucagugcuucgcagauguccu

SEQ ID NO: 862577 - RNA, 22 nt, Homo sapiens
ucauaauugucaaaaaccagaa

SEQ ID NO: 862578 - RNA, 19 nt, Homo sapiens
ucauaauuucuucacucaa

SEQ ID NO: 862579 - RNA, 19 nt, Homo sapiens
ucauagauaauaguacaug

SEQ ID NO: 862580 - RNA, 21 nt, Homo sapiens
ucauaugauugugcacauacu

SEQ ID NO: 862581 - RNA, 12 nt, Homo sapiens
ucaucuugccac

SEQ ID NO: 862582 - RNA, 22 nt, Homo sapiens
ucaugacagucagcaacaugau

SEQ ID NO: 862583 - RNA, 17 nt, Homo sapiens
ucaugcccagcuuggag

SEQ ID NO: 862584 - RNA, 22 nt, Homo sapiens
ucaugcccagcuuggagugcca

SEQ ID NO: 862585 - RNA, 15 nt, Homo sapiens
ucauggcagucccaa

SEQ ID NO: 862586 - RNA, 17 nt, Homo sapiens
ucaugguguucaugaca

SEQ ID NO: 862587 - RNA, 22 nt, Homo sapiens
ucauguugaagucaaauuugga

SEQ ID NO: 862588 - RNA, 23 nt, Homo sapiens
ucauuaauucaauuaaaaccauu

SEQ ID NO: 862589 - RNA, 22 nt, Homo sapiens
ucauuaccgucugugauugcca

SEQ ID NO: 862590 - RNA, 23 nt, Homo sapiens
ucauuaccgucugugauugccau

SEQ ID NO: 862591 - RNA, 17 nt, Homo sapiens
ucauuuucugcauuuaa

SEQ ID NO: 862592 - RNA, 19 nt, Homo sapiens
uccaaacuaccuuccaguu

SEQ ID NO: 862593 - RNA, 20 nt, Homo sapiens
uccaacaugugcucagggaa

SEQ ID NO: 862594 - RNA, 18 nt, Homo sapiens
uccaacgugccuccagca

SEQ ID NO: 862595 - RNA, 20 nt, Homo sapiens
uccaaggacucuaaaagggg

SEQ ID NO: 862596 - RNA, 14 nt, Homo sapiens
uccaaucacauuca

SEQ ID NO: 862597 - RNA, 19 nt, Homo sapiens
uccacccuuggacuuucuu

SEQ ID NO: 862598 - RNA, 19 nt, Homo sapiens
uccacguucugcucaucau

SEQ ID NO: 862599 - RNA, 22 nt, Homo sapiens
uccacuaggugcccagucuuga

SEQ ID NO: 862600 - RNA, 20 nt, Homo sapiens
uccacuuagaaauugcauuu

SEQ ID NO: 862601 - RNA, 15 nt, Homo sapiens
uccagagaguggcuc

SEQ ID NO: 862602 - RNA, 19 nt, Homo sapiens
uccagaguaggugggucuu

SEQ ID NO: 862603 - RNA, 21 nt, Homo sapiens
uccagaguaggugggucuugg

SEQ ID NO: 862604 - RNA, 17 nt, Homo sapiens
uccaggcuugggcucca

SEQ ID NO: 862605 - RNA, 18 nt, Homo sapiens
uccaggguuaaagaaagg

SEQ ID NO: 862606 - RNA, 17 nt, Homo sapiens
uccauucccaucacugc

SEQ ID NO: 862607 - RNA, 16 nt, Homo sapiens
ucccacaggcccuucc

SEQ ID NO: 862608 - RNA, 23 nt, Homo sapiens
ucccaccugcagagccagugucc

SEQ ID NO: 862609 - RNA, 16 nt, Homo sapiens
ucccauuuguguuuca

SEQ ID NO: 862610 - RNA, 13 nt, Homo sapiens
uccccuccagacc

SEQ ID NO: 862611 - RNA, 20 nt, Homo sapiens
uccccuggggagucugggca

SEQ ID NO: 862612 - RNA, 21 nt, Homo sapiens
uccccuggggagucugggcac

SEQ ID NO: 862613 - RNA, 13 nt, Homo sapiens
ucccgaauccuga

SEQ ID NO: 862614 - RNA, 18 nt, Homo sapiens
ucccgggcacugucaugc

SEQ ID NO: 862615 - RNA, 19 nt, Homo sapiens
ucccgggcacugucaugcc

SEQ ID NO: 862616 - RNA, 20 nt, Homo sapiens
ucccgggcacugucaugccc

SEQ ID NO: 862617 - RNA, 14 nt, Homo sapiens
ucccuguaaccucu

SEQ ID NO: 862618 - RNA, 18 nt, Homo sapiens
ucccuugugucuguugcu

SEQ ID NO: 862619 - RNA, 22 nt, Homo sapiens
ucccuuucugugugaagaucac

SEQ ID NO: 862620 - RNA, 19 nt, Homo sapiens
uccuaaaguagacuucauu

SEQ ID NO: 862621 - RNA, 14 nt, Homo sapiens
uccuacaagcuaaa

SEQ ID NO: 862622 - RNA, 18 nt, Homo sapiens
uccuacuguaugugggaa

SEQ ID NO: 862623 - RNA, 14 nt, Homo sapiens
uccucaauccagcu

SEQ ID NO: 862624 - RNA, 14 nt, Homo sapiens
uccucauccaugca

SEQ ID NO: 862625 - RNA, 19 nt, Homo sapiens
uccucauccaugcagauaa

SEQ ID NO: 862626 - RNA, 18 nt, Homo sapiens
uccucuccacugccuucg

SEQ ID NO: 862627 - RNA, 17 nt, Homo sapiens
uccugccgcaacaguuu

SEQ ID NO: 862628 - RNA, 19 nt, Homo sapiens
uccugggugcugucaugcc

SEQ ID NO: 862629 - RNA, 18 nt, Homo sapiens
uccuucaugaucaucaca

SEQ ID NO: 862630 - RNA, 17 nt, Homo sapiens
uccuugccgcugggaga

SEQ ID NO: 862631 - RNA, 14 nt, Homo sapiens
ucgcugagucccag

SEQ ID NO: 862632 - RNA, 15 nt, Homo sapiens
ucggccucuugagag

SEQ ID NO: 862633 - RNA, 15 nt, Homo sapiens
ucguaguuacucuca

SEQ ID NO: 862634 - RNA, 15 nt, Homo sapiens
ucuaacccacccuca

SEQ ID NO: 862635 - RNA, 14 nt, Homo sapiens
ucuaagucuuucca

SEQ ID NO: 862636 - RNA, 16 nt, Homo sapiens
gauacuuauucaaaaa

SEQ ID NO: 862637 - RNA, 17 nt, Homo sapiens
gauaguggggucagggc

SEQ ID NO: 862638 - RNA, 18 nt, Homo sapiens
gaucuaaaaggaggacag

SEQ ID NO: 862639 - RNA, 21 nt, Homo sapiens
gaucuaaaaggaggacaggga

SEQ ID NO: 862640 - RNA, 23 nt, Homo sapiens
gaucugaacagaaauaccaaaau

SEQ ID NO: 862641 - RNA, 19 nt, Homo sapiens
gaucuugagcaaggcaaga

SEQ ID NO: 862642 - RNA, 16 nt, Homo sapiens
gaugacagaaauauga

SEQ ID NO: 862643 - RNA, 14 nt, Homo sapiens
gaugagaagccaaa

SEQ ID NO: 862644 - RNA, 13 nt, Homo sapiens
gaugccugacaca

SEQ ID NO: 862645 - RNA, 16 nt, Homo sapiens
gauuacuuuugggagg

SEQ ID NO: 862646 - RNA, 18 nt, Homo sapiens
gauucaggaaugggccaa

SEQ ID NO: 862647 - RNA, 21 nt, Homo sapiens
gauucuaugaggcaaccacag

SEQ ID NO: 862648 - RNA, 17 nt, Homo sapiens
gauucuuucccaauuca

SEQ ID NO: 862649 - RNA, 22 nt, Homo sapiens
gauugaguucaucaugagccgu

SEQ ID NO: 862650 - RNA, 21 nt, Homo sapiens
gauugccuuuggcaauucuuc

SEQ ID NO: 862651 - RNA, 22 nt, Homo sapiens
gauugguaccagagccuaugga

SEQ ID NO: 862652 - RNA, 17 nt, Homo sapiens
gauuugggggugcaaug

SEQ ID NO: 862653 - RNA, 19 nt, Homo sapiens
gcaaauccgaaaucagcag

SEQ ID NO: 862654 - RNA, 22 nt, Homo sapiens
gcaaaucuccuuuguccauuua

SEQ ID NO: 862655 - RNA, 14 nt, Homo sapiens
gcaacagccuguuu

SEQ ID NO: 862656 - RNA, 17 nt, Homo sapiens
gcaaccucccauuuuag

SEQ ID NO: 862657 - RNA, 19 nt, Homo sapiens
gcaaggagaccaccaacag

SEQ ID NO: 862658 - RNA, 19 nt, Homo sapiens
gcaagucccaugauuucuu

SEQ ID NO: 862659 - RNA, 20 nt, Homo sapiens
gcaaugugcccccagacgca

SEQ ID NO: 862660 - RNA, 12 nt, Homo sapiens
gcacccuggauu

SEQ ID NO: 862661 - RNA, 14 nt, Homo sapiens
gcaccugggugcuc

SEQ ID NO: 862662 - RNA, 18 nt, Homo sapiens
gcacgcuggcuugugauc

SEQ ID NO: 862663 - RNA, 19 nt, Homo sapiens
gcacugagcaaagcauuga

SEQ ID NO: 862664 - RNA, 18 nt, Homo sapiens
gcacugaugggcacugga

SEQ ID NO: 862665 - RNA, 22 nt, Homo sapiens
gcacugucaugcccagcuugga

SEQ ID NO: 862666 - RNA, 20 nt, Homo sapiens
gcacuguucccccugugcag

SEQ ID NO: 862667 - RNA, 19 nt, Homo sapiens
gcacuucguggaugaccuc

SEQ ID NO: 862668 - RNA, 13 nt, Homo sapiens
gcagaacuuucac

SEQ ID NO: 862669 - RNA, 14 nt, Homo sapiens
gcagaccacugaua

SEQ ID NO: 862670 - RNA, 21 nt, Homo sapiens
gcagagcuugaacacagucuc

SEQ ID NO: 862671 - RNA, 15 nt, Homo sapiens
gcagcagcagcagca

SEQ ID NO: 862672 - RNA, 23 nt, Homo sapiens
gcagccucaggcccaauucugcc

SEQ ID NO: 862673 - RNA, 23 nt, Homo sapiens
gcagcuccggaaggacacaguca

SEQ ID NO: 862674 - RNA, 23 nt, Homo sapiens
gcaggggcugggcagaggggaga

SEQ ID NO: 862675 - RNA, 20 nt, Homo sapiens
gcagguggggagacugggcu

SEQ ID NO: 862676 - RNA, 24 nt, Homo sapiens
gcaguggagaggggacuuggauag

SEQ ID NO: 862677 - RNA, 21 nt, Homo sapiens
gcaguuugcuuuguaugcacu

SEQ ID NO: 862678 - RNA, 21 nt, Homo sapiens
gcauaaccccacccuuuacau

SEQ ID NO: 862679 - RNA, 13 nt, Homo sapiens
gccaaaagccuuu

SEQ ID NO: 862680 - RNA, 16 nt, Homo sapiens
gccaaauaugcacuuu

SEQ ID NO: 862681 - RNA, 18 nt, Homo sapiens
gccaauggagacugucuc

SEQ ID NO: 862682 - RNA, 12 nt, Homo sapiens
gccacacguguc

SEQ ID NO: 862683 - RNA, 18 nt, Homo sapiens
gccacacuggccggccca

SEQ ID NO: 862684 - RNA, 21 nt, Homo sapiens
gccacagaccuaggauuucau

SEQ ID NO: 862685 - RNA, 19 nt, Homo sapiens
gccacagggacgacccggg

SEQ ID NO: 862686 - RNA, 18 nt, Homo sapiens
gccacauccaacauuucc

SEQ ID NO: 862687 - RNA, 11 nt, Homo sapiens
gccacauggga

SEQ ID NO: 862688 - RNA, 14 nt, Homo sapiens
gccacccucugcag

SEQ ID NO: 862689 - RNA, 19 nt, Homo sapiens
gccaccuccccaggccgug

SEQ ID NO: 862690 - RNA, 13 nt, Homo sapiens
gccacggcagccu

SEQ ID NO: 862691 - RNA, 18 nt, Homo sapiens
gccacguggccgcugccc

SEQ ID NO: 862692 - RNA, 14 nt, Homo sapiens
ccuuuucaugauuu

SEQ ID NO: 862693 - RNA, 20 nt, Homo sapiens
ccuuuucuuguaaacauugc

SEQ ID NO: 862694 - RNA, 15 nt, Homo sapiens
ccuuuuggauuuaga

SEQ ID NO: 862695 - RNA, 14 nt, Homo sapiens
cgacuguuuuccca

SEQ ID NO: 862696 - RNA, 21 nt, Homo sapiens
cgagccagcucugggggcucc

SEQ ID NO: 862697 - RNA, 10 nt, Homo sapiens
cgaguacuuc

SEQ ID NO: 862698 - RNA, 13 nt, Homo sapiens
cgaguaucuguaa

SEQ ID NO: 862699 - RNA, 13 nt, Homo sapiens
cgcaacaguuuuu

SEQ ID NO: 862700 - RNA, 18 nt, Homo sapiens
cgcagauguccuugaugc

SEQ ID NO: 862701 - RNA, 15 nt, Homo sapiens
cggaaguggccugag

SEQ ID NO: 862702 - RNA, 13 nt, Homo sapiens
cggaguugugcac

SEQ ID NO: 862703 - RNA, 14 nt, Homo sapiens
cggcggcucggggc

SEQ ID NO: 862704 - RNA, 15 nt, Homo sapiens
cggcuccuucaagcu

SEQ ID NO: 862705 - RNA, 18 nt, Homo sapiens
cggcuccuucaagcugcu

SEQ ID NO: 862706 - RNA, 12 nt, Homo sapiens
cgggcacuguca

SEQ ID NO: 862707 - RNA, 21 nt, Homo sapiens
cgggcacugucaugcccagcu

SEQ ID NO: 862708 - RNA, 19 nt, Homo sapiens
cggguacucagucagccca

SEQ ID NO: 862709 - RNA, 15 nt, Homo sapiens
cguaguuacucucag

SEQ ID NO: 862710 - RNA, 17 nt, Homo sapiens
cgucuaagucaugagcu

SEQ ID NO: 862711 - RNA, 17 nt, Homo sapiens
cgucugugauugccauu

SEQ ID NO: 862712 - RNA, 16 nt, Homo sapiens
cgugaaaaugcuguau

SEQ ID NO: 862713 - RNA, 22 nt, Homo sapiens
cgugagccucagccaccccuca

SEQ ID NO: 862714 - RNA, 17 nt, Homo sapiens
cguggccgcugcuguga

SEQ ID NO: 862715 - RNA, 15 nt, Homo sapiens
cgugggauccagaga

SEQ ID NO: 862716 - RNA, 21 nt, Homo sapiens
cgugggucuucagggggccag

SEQ ID NO: 862717 - RNA, 19 nt, Homo sapiens
cguucagcugugacgaagg

SEQ ID NO: 862718 - RNA, 14 nt, Homo sapiens
cguuugaaucacag

SEQ ID NO: 862719 - RNA, 15 nt, Homo sapiens
cuaaaauuagaugaa

SEQ ID NO: 862720 - RNA, 19 nt, Homo sapiens
cuaaaauuagaugaacuca

SEQ ID NO: 862721 - RNA, 23 nt, Homo sapiens
cuaaaccagauucuuuguggaua

SEQ ID NO: 862722 - RNA, 12 nt, Homo sapiens
cuaaaguagacu

SEQ ID NO: 862723 - RNA, 18 nt, Homo sapiens
cuaaauccuuuacuguua

SEQ ID NO: 862724 - RNA, 18 nt, Homo sapiens
cuaaaugaauguuuacac

SEQ ID NO: 862725 - RNA, 15 nt, Homo sapiens
cuaagcagaccacug

SEQ ID NO: 862726 - RNA, 20 nt, Homo sapiens
cuaauaaaaaacaccuucua

SEQ ID NO: 862727 - RNA, 21 nt, Homo sapiens
cuaauccucuuuuucuagucu

SEQ ID NO: 862728 - RNA, 21 nt, Homo sapiens
cuaccuaguuuguuagugcau

SEQ ID NO: 862729 - RNA, 22 nt, Homo sapiens
cuaccuugguucccccacugau

SEQ ID NO: 862730 - RNA, 19 nt, Homo sapiens
cuacuuugccacagauuau

SEQ ID NO: 862731 - RNA, 16 nt, Homo sapiens
cuagacaguauugcca

SEQ ID NO: 862732 - RNA, 21 nt, Homo sapiens
cuagauucauggcuuuaacag

SEQ ID NO: 862733 - RNA, 20 nt, Homo sapiens
cuaggcaucugcuguaauaa

SEQ ID NO: 862734 - RNA, 23 nt, Homo sapiens
cuagguucuaaaaauugugauca

SEQ ID NO: 862735 - RNA, 16 nt, Homo sapiens
cuauaacuauguugau

SEQ ID NO: 862736 - RNA, 20 nt, Homo sapiens
cuauaacuauguugauaaaa

SEQ ID NO: 862737 - RNA, 14 nt, Homo sapiens
cuauauauacaaug

SEQ ID NO: 862738 - RNA, 21 nt, Homo sapiens
cuaugaaauaucaugcuccau

SEQ ID NO: 862739 - RNA, 15 nt, Homo sapiens
cuaugauaugcuaau

SEQ ID NO: 862740 - RNA, 16 nt, Homo sapiens
cuauggcacccaugca

SEQ ID NO: 862741 - RNA, 18 nt, Homo sapiens
cuauggcucuacuuucag

SEQ ID NO: 862742 - RNA, 15 nt, Homo sapiens
cuauucuuaagcacu

SEQ ID NO: 862743 - RNA, 18 nt, Homo sapiens
cuauucuuaagcacuuug

SEQ ID NO: 862744 - RNA, 15 nt, Homo sapiens
ggcaaagccuaguga

SEQ ID NO: 862745 - RNA, 9 nt, Homo sapiens
ggcacauug

SEQ ID NO: 862746 - RNA, 20 nt, Homo sapiens
ggcagagaggacuguugaca

SEQ ID NO: 862747 - RNA, 21 nt, Homo sapiens
ggcaucuggcccgcacguguc

SEQ ID NO: 862748 - RNA, 12 nt, Homo sapiens
ggccaaauaugc

SEQ ID NO: 862749 - RNA, 24 nt, Homo sapiens
ggccuccccuggggcuggcagcuu

SEQ ID NO: 862750 - RNA, 14 nt, Homo sapiens
ggcgugacuucaga

SEQ ID NO: 862751 - RNA, 15 nt, Homo sapiens
ggcucgggacuucaa

SEQ ID NO: 862752 - RNA, 14 nt, Homo sapiens
ggcugcaagcugca

SEQ ID NO: 862753 - RNA, 19 nt, Homo sapiens
ggcugcaagcugcagggaa

SEQ ID NO: 862754 - RNA, 18 nt, Homo sapiens
ggcugcccacacacccca

SEQ ID NO: 862755 - RNA, 17 nt, Homo sapiens
ggcuuuccucagcaccu

SEQ ID NO: 862756 - RNA, 18 nt, Homo sapiens
ggcuuuccucagcaccug

SEQ ID NO: 862757 - RNA, 20 nt, Homo sapiens
gggacagagcagaacuuuca

SEQ ID NO: 862758 - RNA, 14 nt, Homo sapiens
gggacuuggcagua

SEQ ID NO: 862759 - RNA, 14 nt, Homo sapiens
gggagacaaucuaa

SEQ ID NO: 862760 - RNA, 19 nt, Homo sapiens
gggagacugggcugaggga

SEQ ID NO: 862761 - RNA, 21 nt, Homo sapiens
gggagaucuuggggugcagca

SEQ ID NO: 862762 - RNA, 21 nt, Homo sapiens
gggaggacaaaggugauuuuc

SEQ ID NO: 862763 - RNA, 21 nt, Homo sapiens
gggauccaccgccacacuggc

SEQ ID NO: 862764 - RNA, 21 nt, Homo sapiens
gggaucuaaaaggaggacagg

SEQ ID NO: 862765 - RNA, 22 nt, Homo sapiens
gggcacuggccuagagccucac

SEQ ID NO: 862766 - RNA, 13 nt, Homo sapiens
gggcagcacagag

SEQ ID NO: 862767 - RNA, 14 nt, Homo sapiens
gggcagucauuauc

SEQ ID NO: 862768 - RNA, 13 nt, Homo sapiens
gggcuacacagca

SEQ ID NO: 862769 - RNA, 19 nt, Homo sapiens
gggcuucuagaaccaggca

SEQ ID NO: 862770 - RNA, 14 nt, Homo sapiens
gggcuuugccauua

SEQ ID NO: 862771 - RNA, 15 nt, Homo sapiens
ggggaggugguaaga

SEQ ID NO: 862772 - RNA, 12 nt, Homo sapiens
ggggcagcacag

SEQ ID NO: 862773 - RNA, 13 nt, Homo sapiens
ggggcucccugug

SEQ ID NO: 862774 - RNA, 18 nt, Homo sapiens
gggguuggguuccagaca

SEQ ID NO: 862775 - RNA, 19 nt, Homo sapiens
ggguacucagucagcccag

SEQ ID NO: 862776 - RNA, 22 nt, Homo sapiens
gggucccauagaggugagggaa

SEQ ID NO: 862777 - RNA, 17 nt, Homo sapiens
gggugcugucaugccca

SEQ ID NO: 862778 - RNA, 14 nt, Homo sapiens
ggguuccagacagg

SEQ ID NO: 862779 - RNA, 19 nt, Homo sapiens
gguagagacuuugacucuc

SEQ ID NO: 862780 - RNA, 14 nt, Homo sapiens
gguaugauauugca

SEQ ID NO: 862781 - RNA, 21 nt, Homo sapiens
ggucccgagcccccuguccuu

SEQ ID NO: 862782 - RNA, 24 nt, Homo sapiens
ggucuaggaacauacuucagcuca

SEQ ID NO: 862783 - RNA, 22 nt, Homo sapiens
ggucuccaccccucaagccagg

SEQ ID NO: 862784 - RNA, 18 nt, Homo sapiens
ggugaggcgugggaucca

SEQ ID NO: 862785 - RNA, 23 nt, Homo sapiens
ggugcuacacccuuuuccagcug

SEQ ID NO: 862786 - RNA, 13 nt, Homo sapiens
gguggagggccac

SEQ ID NO: 862787 - RNA, 19 nt, Homo sapiens
gguuaauaaguuucacuga

SEQ ID NO: 862788 - RNA, 23 nt, Homo sapiens
gguuagaaucccauggauguuuc

SEQ ID NO: 862789 - RNA, 22 nt, Homo sapiens
gguuggaaaacaguauuuucca

SEQ ID NO: 862790 - RNA, 14 nt, Homo sapiens
gguuuaggucaaga

SEQ ID NO: 862791 - RNA, 21 nt, Homo sapiens
guaaacauugccugauuuguu

SEQ ID NO: 862792 - RNA, 18 nt, Homo sapiens
guaaagaguuaguuugag

SEQ ID NO: 862793 - RNA, 13 nt, Homo sapiens
guaaagccucagc

SEQ ID NO: 862794 - RNA, 15 nt, Homo sapiens
guaaauauucuuguc

SEQ ID NO: 862795 - RNA, 17 nt, Homo sapiens
guaaauguuuaauaucu

SEQ ID NO: 862796 - RNA, 21 nt, Homo sapiens
guaaauuuuggaaacaguaca

SEQ ID NO: 862797 - RNA, 15 nt, Homo sapiens
guaacuuugcauguu

SEQ ID NO: 862798 - RNA, 21 nt, Homo sapiens
guaagaacaccugacaacuuc

SEQ ID NO: 862799 - RNA, 23 nt, Homo sapiens
guaauucuaaaugaauguuuaca

SEQ ID NO: 862800 - RNA, 18 nt, Homo sapiens
guacaaggcaacauauag

SEQ ID NO: 862801 - RNA, 22 nt, Homo sapiens
guagaaaauuuguuauuuugca

SEQ ID NO: 862802 - RNA, 17 nt, Homo sapiens
guagaagccacuauuac

SEQ ID NO: 862803 - RNA, 13 nt, Homo sapiens
aggcagcugaaaa

SEQ ID NO: 862804 - RNA, 19 nt, Homo sapiens
aggcauaagaaaacuaaga

SEQ ID NO: 862805 - RNA, 17 nt, Homo sapiens
aggccaguaaaaguaua

SEQ ID NO: 862806 - RNA, 22 nt, Homo sapiens
aggccccgcgggccgggcucca

SEQ ID NO: 862807 - RNA, 12 nt, Homo sapiens
aggcccucgcug

SEQ ID NO: 862808 - RNA, 22 nt, Homo sapiens
aggcccuuccucuccacugccu

SEQ ID NO: 862809 - RNA, 23 nt, Homo sapiens
aggcccuuccucuccacugccuu

SEQ ID NO: 862810 - RNA, 17 nt, Homo sapiens
aggccgauggcccgggc

SEQ ID NO: 862811 - RNA, 15 nt, Homo sapiens
aggccucuguggcac

SEQ ID NO: 862812 - RNA, 21 nt, Homo sapiens
aggcgccccuucccccuccaa

SEQ ID NO: 862813 - RNA, 17 nt, Homo sapiens
aggcucguugacuggcu

SEQ ID NO: 862814 - RNA, 17 nt, Homo sapiens
aggcuuuccucagcacc

SEQ ID NO: 862815 - RNA, 19 nt, Homo sapiens
agggaagccgccuuugcaa

SEQ ID NO: 862816 - RNA, 16 nt, Homo sapiens
agggaauuuucauugg

SEQ ID NO: 862817 - RNA, 22 nt, Homo sapiens
agggagaucuuggggugcagca

SEQ ID NO: 862818 - RNA, 19 nt, Homo sapiens
agggcgcugagggcagggu

SEQ ID NO: 862819 - RNA, 21 nt, Homo sapiens
aggggacacugaaccuuguug

SEQ ID NO: 862820 - RNA, 19 nt, Homo sapiens
agggggccaggugcacaga

SEQ ID NO: 862821 - RNA, 20 nt, Homo sapiens
aggggucccauagaggugag

SEQ ID NO: 862822 - RNA, 16 nt, Homo sapiens
agggucugucccgggu

SEQ ID NO: 862823 - RNA, 19 nt, Homo sapiens
aggguuaaagaaaggcaga

SEQ ID NO: 862824 - RNA, 21 nt, Homo sapiens
aggguucaccaggucagggag

SEQ ID NO: 862825 - RNA, 17 nt, Homo sapiens
aggguuccagacagggu

SEQ ID NO: 862826 - RNA, 16 nt, Homo sapiens
agguaaggugagggaa

SEQ ID NO: 862827 - RNA, 22 nt, Homo sapiens
agguaguaggaagaauuacaau

SEQ ID NO: 862828 - RNA, 22 nt, Homo sapiens
agguaucauuuucugcauuuaa

SEQ ID NO: 862829 - RNA, 19 nt, Homo sapiens
aggugcuaucgcaccacug

SEQ ID NO: 862830 - RNA, 19 nt, Homo sapiens
aggugggguuuucacuucc

SEQ ID NO: 862831 - RNA, 13 nt, Homo sapiens
aggugucucucac

SEQ ID NO: 862832 - RNA, 17 nt, Homo sapiens
agguuuaggucaagaag

SEQ ID NO: 862833 - RNA, 15 nt, Homo sapiens
aguaaaauuacagaa

SEQ ID NO: 862834 - RNA, 13 nt, Homo sapiens
aguaaauccacag

SEQ ID NO: 862835 - RNA, 16 nt, Homo sapiens
aguaaguggugagaac

SEQ ID NO: 862836 - RNA, 13 nt, Homo sapiens
aguaggugggucu

SEQ ID NO: 862837 - RNA, 13 nt, Homo sapiens
aguagucauuuca

SEQ ID NO: 862838 - RNA, 16 nt, Homo sapiens
aguagugccugugauc

SEQ ID NO: 862839 - RNA, 14 nt, Homo sapiens
aguaucaccaaaaa

SEQ ID NO: 862840 - RNA, 13 nt, Homo sapiens
agucaaagacauu

SEQ ID NO: 862841 - RNA, 21 nt, Homo sapiens
agucaaauauguagauugccu

SEQ ID NO: 862842 - RNA, 13 nt, Homo sapiens
agucacacugcug

SEQ ID NO: 862843 - RNA, 14 nt, Homo sapiens
agucacugcacagu

SEQ ID NO: 862844 - RNA, 17 nt, Homo sapiens
aguccuacaagcuaaaa

SEQ ID NO: 862845 - RNA, 14 nt, Homo sapiens
agucuucaagcaga

SEQ ID NO: 862846 - RNA, 22 nt, Homo sapiens
agucuucauaauuucuucacuc

SEQ ID NO: 862847 - RNA, 19 nt, Homo sapiens
agugaauaaaccaucaucu

SEQ ID NO: 862848 - RNA, 12 nt, Homo sapiens
agugaugggagu

SEQ ID NO: 862849 - RNA, 12 nt, Homo sapiens
agugcaccacuu

SEQ ID NO: 862850 - RNA, 23 nt, Homo sapiens
agugccauggccaggaguggguu

SEQ ID NO: 862851 - RNA, 18 nt, Homo sapiens
aguggcagcaacaaagga

SEQ ID NO: 862852 - RNA, 14 nt, Homo sapiens
aguggggucagggc

SEQ ID NO: 862853 - RNA, 16 nt, Homo sapiens
aguguuccccuuccac

SEQ ID NO: 862854 - RNA, 19 nt, Homo sapiens
aguguuuggguauauucau

SEQ ID NO: 862855 - RNA, 13 nt, Homo sapiens
aguucagacuuuu

SEQ ID NO: 862856 - RNA, 16 nt, Homo sapiens
aguucauauguaccau

SEQ ID NO: 862857 - RNA, 14 nt, Homo sapiens
aguucucauccaca

SEQ ID NO: 862858 - RNA, 12 nt, Homo sapiens
aguugcuccuac

SEQ ID NO: 862859 - RNA, 20 nt, Homo sapiens
aguuuaggacccaagguggu

SEQ ID NO: 862860 - RNA, 13 nt, Homo sapiens
aguuugauuucau

SEQ ID NO: 862861 - RNA, 17 nt, Homo sapiens
aguuugcuuuguaugca

SEQ ID NO: 862862 - RNA, 19 nt, Homo sapiens
aguuugcuuuguaugcacu

SEQ ID NO: 862863 - RNA, 22 nt, Homo sapiens
aguuuugaaaggcuuuccucag

SEQ ID NO: 862864 - RNA, 17 nt, Homo sapiens
auaaacaugaagcacaa

SEQ ID NO: 862865 - RNA, 18 nt, Homo sapiens
auaaacaugaagcacaaa

SEQ ID NO: 862866 - RNA, 18 nt, Homo sapiens
auaaaguuauuacucuga

SEQ ID NO: 862867 - RNA, 15 nt, Homo sapiens
auaacagcaaauaac

SEQ ID NO: 862868 - RNA, 21 nt, Homo sapiens
auaaguaacuugucaaggaau

SEQ ID NO: 862869 - RNA, 15 nt, Homo sapiens
auaagugcaugacau

SEQ ID NO: 862870 - RNA, 17 nt, Homo sapiens
auaaucuucaggugaaa

SEQ ID NO: 862871 - RNA, 17 nt, Homo sapiens
auaauguuacauuauua

SEQ ID NO: 862872 - RNA, 11 nt, Homo sapiens
auaauugucaa

SEQ ID NO: 862873 - RNA, 22 nt, Homo sapiens
auacauuuggcuccacuguaaa

SEQ ID NO: 862874 - RNA, 14 nt, Homo sapiens
auacgguaugauau

SEQ ID NO: 862875 - RNA, 16 nt, Homo sapiens
auaggccaucuguaaa

SEQ ID NO: 862876 - RNA, 17 nt, Homo sapiens
auaguggggucagggcu

SEQ ID NO: 862877 - RNA, 12 nt, Homo sapiens
auauaacugccu

SEQ ID NO: 862878 - RNA, 17 nt, Homo sapiens
auauacuaauauguaau

SEQ ID NO: 862879 - RNA, 19 nt, Homo sapiens
auauauuuuuaagacuuuu

SEQ ID NO: 862880 - RNA, 22 nt, Homo sapiens
auaucacaaaguuguuuaacua

SEQ ID NO: 862881 - RNA, 13 nt, Homo sapiens
auaucaugcucca

SEQ ID NO: 862882 - RNA, 18 nt, Homo sapiens
auaugcuaauauauguau

SEQ ID NO: 862883 - RNA, 17 nt, Homo sapiens
auauguagauugccuuu

SEQ ID NO: 862884 - RNA, 16 nt, Homo sapiens
auauuuugcauaguac

SEQ ID NO: 862885 - RNA, 17 nt, Homo sapiens
auauuuuugugcacauu

SEQ ID NO: 862886 - RNA, 17 nt, Homo sapiens
aucaagcccuuuacuug

SEQ ID NO: 862887 - RNA, 17 nt, Homo sapiens
aucacauucaggcaugc

SEQ ID NO: 862888 - RNA, 14 nt, Homo sapiens
aucaccagacuuug

SEQ ID NO: 862889 - RNA, 19 nt, Homo sapiens
aucaccugcgugucccauc

SEQ ID NO: 862890 - RNA, 14 nt, Homo sapiens
aucagcagugauug

SEQ ID NO: 862891 - RNA, 18 nt, Homo sapiens
aucagcgccgcaccagcc

SEQ ID NO: 862892 - RNA, 23 nt, Homo sapiens
aucaugacagucagcaacaugau

SEQ ID NO: 862893 - RNA, 15 nt, Homo sapiens
aucauguguguccac

SEQ ID NO: 862894 - RNA, 15 nt, Homo sapiens
aucauuaugaaguca

SEQ ID NO: 862895 - RNA, 22 nt, Homo sapiens
aucauuucuauuucuccuccau

SEQ ID NO: 862896 - RNA, 20 nt, Homo sapiens
auccaacaugugcucaggga

SEQ ID NO: 862897 - RNA, 12 nt, Homo sapiens
auccacauggga

SEQ ID NO: 862898 - RNA, 12 nt, Homo sapiens
ccaagucuuccu

SEQ ID NO: 862899 - RNA, 19 nt, Homo sapiens
ccaaucccaccaacccuca

SEQ ID NO: 862900 - RNA, 21 nt, Homo sapiens
ccacaauagcagacaguguuu

SEQ ID NO: 862901 - RNA, 20 nt, Homo sapiens
ccacagaccuaggauuucau

SEQ ID NO: 862902 - RNA, 14 nt, Homo sapiens
ccacagaggccagg

SEQ ID NO: 862903 - RNA, 17 nt, Homo sapiens
ccacaggcagcauuuag

SEQ ID NO: 862904 - RNA, 11 nt, Homo sapiens
ccacagugacu

SEQ ID NO: 862905 - RNA, 23 nt, Homo sapiens
ccacauaaaagaagaaacuauuu

SEQ ID NO: 862906 - RNA, 23 nt, Homo sapiens
ccacauccuccacguucugcuca

SEQ ID NO: 862907 - RNA, 23 nt, Homo sapiens
ccaccaaauucugaauuuguaga

SEQ ID NO: 862908 - RNA, 20 nt, Homo sapiens
ccaccaacagcccucagguc

SEQ ID NO: 862909 - RNA, 15 nt, Homo sapiens
ccacggccacugcag

SEQ ID NO: 862910 - RNA, 16 nt, Homo sapiens
ccagagcuacugacua

SEQ ID NO: 862911 - RNA, 20 nt, Homo sapiens
ccagaggauugcugccccau

SEQ ID NO: 862912 - RNA, 17 nt, Homo sapiens
ccagcccagccugcaua

SEQ ID NO: 862913 - RNA, 12 nt, Homo sapiens
ccagcucuucca

SEQ ID NO: 862914 - RNA, 16 nt, Homo sapiens
ccagcuuggagugcca

SEQ ID NO: 862915 - RNA, 16 nt, Homo sapiens
ccaggaaccucagggc

SEQ ID NO: 862916 - RNA, 12 nt, Homo sapiens
ccaggaccaguc

SEQ ID NO: 862917 - RNA, 23 nt, Homo sapiens
ccaggagaagucccaccagggac

SEQ ID NO: 862918 - RNA, 21 nt, Homo sapiens
ccaggaggggcuguccaauca

SEQ ID NO: 862919 - RNA, 18 nt, Homo sapiens
ccaggcaacuugggaacu

SEQ ID NO: 862920 - RNA, 17 nt, Homo sapiens
ccaggcucaggcugccc

SEQ ID NO: 862921 - RNA, 23 nt, Homo sapiens
ccaggcuugggcuccauucccau

SEQ ID NO: 862922 - RNA, 14 nt, Homo sapiens
ccaggguuccagac

SEQ ID NO: 862923 - RNA, 21 nt, Homo sapiens
ccaggguuccagacagggugg

SEQ ID NO: 862924 - RNA, 13 nt, Homo sapiens
ccaggucagggag

SEQ ID NO: 862925 - RNA, 19 nt, Homo sapiens
ccaguaaggcagcucuguc

SEQ ID NO: 862926 - RNA, 19 nt, Homo sapiens
ccauauuccagcagugaaa

SEQ ID NO: 862927 - RNA, 16 nt, Homo sapiens
ccauggugguuucaga

SEQ ID NO: 862928 - RNA, 16 nt, Homo sapiens
ccauguacaugaagaa

SEQ ID NO: 862929 - RNA, 20 nt, Homo sapiens
ccaugucguaguuacucuca

SEQ ID NO: 862930 - RNA, 19 nt, Homo sapiens
cccaaggaagaacaaauau

SEQ ID NO: 862931 - RNA, 19 nt, Homo sapiens
cccacgucccgggcacugu

SEQ ID NO: 862932 - RNA, 11 nt, Homo sapiens
cccagcacugc

SEQ ID NO: 862933 - RNA, 17 nt, Homo sapiens
cccagcccucaguuuuc

SEQ ID NO: 862934 - RNA, 18 nt, Homo sapiens
cccagccugcauacuugc

SEQ ID NO: 862935 - RNA, 16 nt, Homo sapiens
cccagcuccucuuccu

SEQ ID NO: 862936 - RNA, 14 nt, Homo sapiens
cccaggaggaccug

SEQ ID NO: 862937 - RNA, 10 nt, Homo sapiens
cccagugugu

SEQ ID NO: 862938 - RNA, 21 nt, Homo sapiens
cccaguguguuucugaucuga

SEQ ID NO: 862939 - RNA, 13 nt, Homo sapiens
cccauggccacuu

SEQ ID NO: 862940 - RNA, 23 nt, Homo sapiens
ccccagacgcacgugggucuuca

SEQ ID NO: 862941 - RNA, 15 nt, Homo sapiens
ccccgggccucgggc

SEQ ID NO: 862942 - RNA, 13 nt, Homo sapiens
cccgacagccugg

SEQ ID NO: 862943 - RNA, 18 nt, Homo sapiens
cccuaagcagaccacuga

SEQ ID NO: 862944 - RNA, 14 nt, Homo sapiens
augcauaaaugcga

SEQ ID NO: 862945 - RNA, 16 nt, Homo sapiens
augccagcuguacuga

SEQ ID NO: 862946 - RNA, 19 nt, Homo sapiens
augccucauuaccuugugc

SEQ ID NO: 862947 - RNA, 18 nt, Homo sapiens
augcgggcugggcagcug

SEQ ID NO: 862948 - RNA, 22 nt, Homo sapiens
augcuucugacuucauagauuu

SEQ ID NO: 862949 - RNA, 12 nt, Homo sapiens
auggaccacagu

SEQ ID NO: 862950 - RNA, 17 nt, Homo sapiens
auggcacccaugcaccu

SEQ ID NO: 862951 - RNA, 20 nt, Homo sapiens
auggccacauccaacauuuc

SEQ ID NO: 862952 - RNA, 17 nt, Homo sapiens
auggcccugcaaaagga

SEQ ID NO: 862953 - RNA, 16 nt, Homo sapiens
auggcuaccaaaaaga

SEQ ID NO: 862954 - RNA, 16 nt, Homo sapiens
augggucauucucacc

SEQ ID NO: 862955 - RNA, 23 nt, Homo sapiens
augguaaccgagccagcagcuga

SEQ ID NO: 862956 - RNA, 17 nt, Homo sapiens
auggucaucgugacagc

SEQ ID NO: 862957 - RNA, 19 nt, Homo sapiens
auggugcccuuggaggcaa

SEQ ID NO: 862958 - RNA, 15 nt, Homo sapiens
auguauaugcaauau

SEQ ID NO: 862959 - RNA, 14 nt, Homo sapiens
auguauaugcacuu

SEQ ID NO: 862960 - RNA, 19 nt, Homo sapiens
augucguuugaaucacagu

SEQ ID NO: 862961 - RNA, 19 nt, Homo sapiens
augugacauuauaugcacu

SEQ ID NO: 862962 - RNA, 12 nt, Homo sapiens
augugcacugaa

SEQ ID NO: 862963 - RNA, 15 nt, Homo sapiens
augugcccccagacg

SEQ ID NO: 862964 - RNA, 14 nt, Homo sapiens
augugcucagggaa

SEQ ID NO: 862965 - RNA, 16 nt, Homo sapiens
augugugauucacagu

SEQ ID NO: 862966 - RNA, 22 nt, Homo sapiens
auguucacuuuugacaaaggca

SEQ ID NO: 862967 - RNA, 15 nt, Homo sapiens
auguugaccuuugag

SEQ ID NO: 862968 - RNA, 15 nt, Homo sapiens
auguugaugaaaaau

SEQ ID NO: 862969 - RNA, 16 nt, Homo sapiens
auguugcccagugugu

SEQ ID NO: 862970 - RNA, 20 nt, Homo sapiens
auguugcccaguguguuucu

SEQ ID NO: 862971 - RNA, 20 nt, Homo sapiens
auguuuaauaucugacugaa

SEQ ID NO: 862972 - RNA, 16 nt, Homo sapiens
auguuuuaauauccua

SEQ ID NO: 862973 - RNA, 19 nt, Homo sapiens
auguuuuacuuuucacagu

SEQ ID NO: 862974 - RNA, 17 nt, Homo sapiens
auuaaaaccauuaccuu

SEQ ID NO: 862975 - RNA, 14 nt, Homo sapiens
auuaauaucacagc

SEQ ID NO: 862976 - RNA, 15 nt, Homo sapiens
auuaccgucugugau

SEQ ID NO: 862977 - RNA, 16 nt, Homo sapiens
auuaccuaguagucau

SEQ ID NO: 862978 - RNA, 14 nt, Homo sapiens
auuaccuugugcua

SEQ ID NO: 862979 - RNA, 13 nt, Homo sapiens
auuagacagucaa

SEQ ID NO: 862980 - RNA, 17 nt, Homo sapiens
auuauuacuccuugcca

SEQ ID NO: 862981 - RNA, 16 nt, Homo sapiens
auucauuucaaaggga

SEQ ID NO: 862982 - RNA, 14 nt, Homo sapiens
auucauuuugcaac

SEQ ID NO: 862983 - RNA, 17 nt, Homo sapiens
auucauuuugcaacuug

SEQ ID NO: 862984 - RNA, 14 nt, Homo sapiens
auucuaaaggggac

SEQ ID NO: 862985 - RNA, 20 nt, Homo sapiens
auucuaaaugaauguuuaca

SEQ ID NO: 862986 - RNA, 18 nt, Homo sapiens
auucuacuucagcuuugg

SEQ ID NO: 862987 - RNA, 11 nt, Homo sapiens
auucuaugagg

SEQ ID NO: 862988 - RNA, 17 nt, Homo sapiens
auucucugucucaucca

SEQ ID NO: 862989 - RNA, 16 nt, Homo sapiens
auucugucaaugucuu

SEQ ID NO: 862990 - RNA, 16 nt, Homo sapiens
auucuuaagcacuuug

SEQ ID NO: 862991 - RNA, 23 nt, Homo sapiens
auucuucuucucaagcacugaca

SEQ ID NO: 862992 - RNA, 21 nt, Homo sapiens
auucuuguccacauucuacuu

SEQ ID NO: 862993 - RNA, 20 nt, Homo sapiens
auucuuucccaauucacauc

SEQ ID NO: 862994 - RNA, 15 nt, Homo sapiens
auugacaagguguuu

SEQ ID NO: 862995 - RNA, 14 nt, Homo sapiens
auugagcaaagggg

SEQ ID NO: 862996 - RNA, 16 nt, Homo sapiens
auugaguuuucagugg

SEQ ID NO: 862997 - RNA, 21 nt, Homo sapiens
auuggacauuuuaaacacuua

SEQ ID NO: 862998 - RNA, 20 nt, Homo sapiens
auuggcuuuugaaucaaaga

SEQ ID NO: 862999 - RNA, 23 nt, Homo sapiens
auugggaguaggaguugcuccua

SEQ ID NO: 863000 - RNA, 21 nt, Homo sapiens
auugguccgaucuuugacucu

SEQ ID NO: 863001 - RNA, 19 nt, Homo sapiens
auuguaucaaaugugacau

SEQ ID NO: 863002 - RNA, 17 nt, Homo sapiens
auugucacaacacugaa

SEQ ID NO: 863003 - RNA, 18 nt, Homo sapiens
auugugaucagaccauaa

SEQ ID NO: 863004 - RNA, 11 nt, Homo sapiens
auugugcacau

SEQ ID NO: 863005 - RNA, 21 nt, Homo sapiens
auuuaaaaaacuaacacccag

SEQ ID NO: 863006 - RNA, 14 nt, Homo sapiens
auuuacacugacug

SEQ ID NO: 863007 - RNA, 21 nt, Homo sapiens
auuuacaugaauugcauuuua

SEQ ID NO: 863008 - RNA, 12 nt, Homo sapiens
auuucacugaca

SEQ ID NO: 863009 - RNA, 16 nt, Homo sapiens
auuucuagacaguauu

SEQ ID NO: 863010 - RNA, 16 nt, Homo sapiens
auuucuccuccauggg

SEQ ID NO: 863011 - RNA, 13 nt, Homo sapiens
auuugagugcucu

SEQ ID NO: 863012 - RNA, 21 nt, Homo sapiens
auuugcaagggaaaagucucu

SEQ ID NO: 863013 - RNA, 22 nt, Homo sapiens
auuugcgguuagaaucccaugg

SEQ ID NO: 863014 - RNA, 22 nt, Homo sapiens
auuugcuagagggagggagcag

SEQ ID NO: 863015 - RNA, 16 nt, Homo sapiens
auuuggauuuuccacc

SEQ ID NO: 863016 - RNA, 19 nt, Homo sapiens
auuuguguuuuacaguaua

SEQ ID NO: 863017 - RNA, 16 nt, Homo sapiens
auuuuaaacacuuaca

SEQ ID NO: 863018 - RNA, 21 nt, Homo sapiens
auuuuaaugaagaaaguggaa

SEQ ID NO: 863019 - RNA, 14 nt, Homo sapiens
auuuucuacagugu

SEQ ID NO: 863020 - RNA, 17 nt, Homo sapiens
auuuugcauaguaccaa

SEQ ID NO: 863021 - RNA, 14 nt, Homo sapiens
auuuuugugcacau

SEQ ID NO: 863022 - RNA, 14 nt, Homo sapiens
caaacuucaagggu

SEQ ID NO: 863023 - RNA, 20 nt, Homo sapiens
caaagcauugagcaaagggg

SEQ ID NO: 863024 - RNA, 17 nt, Homo sapiens
caaagccuuauccagca

SEQ ID NO: 863025 - RNA, 18 nt, Homo sapiens
caaaggacaaaaauauaa

SEQ ID NO: 863026 - RNA, 22 nt, Homo sapiens
caaaggccguuagggaaaucca

SEQ ID NO: 863027 - RNA, 13 nt, Homo sapiens
caaagggugggca

SEQ ID NO: 863028 - RNA, 15 nt, Homo sapiens
caaaggugauuuucc

SEQ ID NO: 863029 - RNA, 22 nt, Homo sapiens
caaauaugcacuuucccuagaa

SEQ ID NO: 863030 - RNA, 14 nt, Homo sapiens
caagauaccuuugc

SEQ ID NO: 863031 - RNA, 12 nt, Homo sapiens
caagcacugaca

SEQ ID NO: 863032 - RNA, 16 nt, Homo sapiens
caagcacugacacuca

SEQ ID NO: 863033 - RNA, 18 nt, Homo sapiens
caagccaggguuccagac

SEQ ID NO: 863034 - RNA, 24 nt, Homo sapiens
uuauaaaagaugcauuaucuauga

SEQ ID NO: 863035 - RNA, 21 nt, Homo sapiens
uuauacuucucuauuaucuca

SEQ ID NO: 863036 - RNA, 13 nt, Homo sapiens
uuauauucaucca

SEQ ID NO: 863037 - RNA, 18 nt, Homo sapiens
uuaucaccgugggcuccc

SEQ ID NO: 863038 - RNA, 22 nt, Homo sapiens
uuaucaccgugggcucccugac

SEQ ID NO: 863039 - RNA, 15 nt, Homo sapiens
uuauccagaugaacu

SEQ ID NO: 863040 - RNA, 22 nt, Homo sapiens
uuaucuagagaauaaucauaua

SEQ ID NO: 863041 - RNA, 23 nt, Homo sapiens
uuauggaccaauuagcauuccau

SEQ ID NO: 863042 - RNA, 17 nt, Homo sapiens
uuauuacuccuugccau

SEQ ID NO: 863043 - RNA, 15 nt, Homo sapiens
uuauuuuauugccuu

SEQ ID NO: 863044 - RNA, 18 nt, Homo sapiens
uucaaccacauuugcuag

SEQ ID NO: 863045 - RNA, 17 nt, Homo sapiens
uucaaucaaacuuucag

SEQ ID NO: 863046 - RNA, 22 nt, Homo sapiens
uucaaugguugggacaauggca

SEQ ID NO: 863047 - RNA, 15 nt, Homo sapiens
uucaauuaaaaccau

SEQ ID NO: 863048 - RNA, 17 nt, Homo sapiens
uucaauugcaucuccca

SEQ ID NO: 863049 - RNA, 16 nt, Homo sapiens
uucacagaugugugau

SEQ ID NO: 863050 - RNA, 12 nt, Homo sapiens
uucacaguguga

SEQ ID NO: 863051 - RNA, 16 nt, Homo sapiens
uucacaucuaaccuca

SEQ ID NO: 863052 - RNA, 14 nt, Homo sapiens
uucagaaagggcag

SEQ ID NO: 863053 - RNA, 13 nt, Homo sapiens
uucagggggccag

SEQ ID NO: 863054 - RNA, 16 nt, Homo sapiens
uucauaaguauuucaa

SEQ ID NO: 863055 - RNA, 18 nt, Homo sapiens
uucauucccuuucaugau

SEQ ID NO: 863056 - RNA, 22 nt, Homo sapiens
uuccaaauucaguaaauuuugg

SEQ ID NO: 863057 - RNA, 14 nt, Homo sapiens
uuccaucaauuuua

SEQ ID NO: 863058 - RNA, 13 nt, Homo sapiens
uucccccacugau

SEQ ID NO: 863059 - RNA, 16 nt, Homo sapiens
uuccccuuccacugag

SEQ ID NO: 863060 - RNA, 23 nt, Homo sapiens
uucccguauaauaaaaccaaaga

SEQ ID NO: 863061 - RNA, 20 nt, Homo sapiens
uucccuguaugauuccuuga

SEQ ID NO: 863062 - RNA, 13 nt, Homo sapiens
uuccucucucuca

SEQ ID NO: 863063 - RNA, 20 nt, Homo sapiens
uuccuucuggggcuuugcca

SEQ ID NO: 863064 - RNA, 21 nt, Homo sapiens
uuccuugauggagauauuuac

SEQ ID NO: 863065 - RNA, 23 nt, Homo sapiens
uucuaaaugaauguuuacacucu

SEQ ID NO: 863066 - RNA, 20 nt, Homo sapiens
uucucauuucuguagccuga

SEQ ID NO: 863067 - RNA, 20 nt, Homo sapiens
uucucucaccuccuaaagua

SEQ ID NO: 863068 - RNA, 12 nt, Homo sapiens
uucugcauuuaa

SEQ ID NO: 863069 - RNA, 14 nt, Homo sapiens
uucuggaauguaau

SEQ ID NO: 863070 - RNA, 17 nt, Homo sapiens
uucuguauuaacugaau

SEQ ID NO: 863071 - RNA, 16 nt, Homo sapiens
uucugucucauaugau

SEQ ID NO: 863072 - RNA, 16 nt, Homo sapiens
uucuucccaaggccag

SEQ ID NO: 863073 - RNA, 19 nt, Homo sapiens
uucuucucaagcacugaca

SEQ ID NO: 863074 - RNA, 13 nt, Homo sapiens
uugaaaacacugc

SEQ ID NO: 863075 - RNA, 17 nt, Homo sapiens
uugaaaaccucuuucca

SEQ ID NO: 863076 - RNA, 19 nt, Homo sapiens
uugaaaauauuucuaugua

SEQ ID NO: 863077 - RNA, 16 nt, Homo sapiens
uugaacauacuucauc

SEQ ID NO: 863078 - RNA, 18 nt, Homo sapiens
uugaauuuugaaccaugu

SEQ ID NO: 863079 - RNA, 17 nt, Homo sapiens
uugagccuuaaaaccca

SEQ ID NO: 863080 - RNA, 17 nt, Homo sapiens
uugaugccagcuguacu

SEQ ID NO: 863081 - RNA, 19 nt, Homo sapiens
uugauugaguucaucauga

SEQ ID NO: 863082 - RNA, 15 nt, Homo sapiens
uugauuucauuaaua

SEQ ID NO: 863083 - RNA, 22 nt, Homo sapiens
uugcaaccucgcuggacucuca

SEQ ID NO: 863084 - RNA, 16 nt, Homo sapiens
uugccagcucuuccaa

SEQ ID NO: 863085 - RNA, 14 nt, Homo sapiens
uugccuuuggcaau

SEQ ID NO: 863086 - RNA, 17 nt, Homo sapiens
uugcuggucacugccau

SEQ ID NO: 863087 - RNA, 17 nt, Homo sapiens
uuggaaaauaaaucaau

SEQ ID NO: 863088 - RNA, 12 nt, Homo sapiens
uuggaaaucaca

SEQ ID NO: 863089 - RNA, 19 nt, Homo sapiens
uuggaagugugugaucugu

SEQ ID NO: 863090 - RNA, 20 nt, Homo sapiens
uuggacauuuuaaacacuua

SEQ ID NO: 863091 - RNA, 23 nt, Homo sapiens
uuggagaaacccuugaaaagaca

SEQ ID NO: 863092 - RNA, 17 nt, Homo sapiens
uuggcuccacuguaaau

SEQ ID NO: 863093 - RNA, 16 nt, Homo sapiens
uuggcuucuaaucaaa

SEQ ID NO: 863094 - RNA, 18 nt, Homo sapiens
uuggcuuguuuggagcau

SEQ ID NO: 863095 - RNA, 16 nt, Homo sapiens
uugggagauuucauuu

SEQ ID NO: 863096 - RNA, 22 nt, Homo sapiens
uugggagauuucauuuucuaca

SEQ ID NO: 863097 - RNA, 15 nt, Homo sapiens
uuggguuccagacag

SEQ ID NO: 863098 - RNA, 18 nt, Homo sapiens
uuguaccagggcucugua

SEQ ID NO: 863099 - RNA, 14 nt, Homo sapiens
uuguauaggccauc

SEQ ID NO: 863100 - RNA, 17 nt, Homo sapiens
uuguauuaucaacagca

SEQ ID NO: 863101 - RNA, 17 nt, Homo sapiens
uugucacaacacugaac

SEQ ID NO: 863102 - RNA, 12 nt, Homo sapiens
uugugauugccu

SEQ ID NO: 863103 - RNA, 18 nt, Homo sapiens
uuguuauuuuugucucga

SEQ ID NO: 863104 - RNA, 13 nt, Homo sapiens
uuuaaaaauucac

SEQ ID NO: 863105 - RNA, 12 nt, Homo sapiens
uuuaaaucugag

SEQ ID NO: 863106 - RNA, 18 nt, Homo sapiens
uuuaauaacuaaaccaga

SEQ ID NO: 863107 - RNA, 16 nt, Homo sapiens
augcauaaaugcgauc

SEQ ID NO: 863108 - RNA, 23 nt, Homo sapiens
augcauauccaacaugugcucag

SEQ ID NO: 863109 - RNA, 20 nt, Homo sapiens
augcaucaaguuauugacaa

SEQ ID NO: 863110 - RNA, 20 nt, Homo sapiens
augcccagcuuggagugcca

SEQ ID NO: 863111 - RNA, 19 nt, Homo sapiens
augcccuguaccugugcac

SEQ ID NO: 863112 - RNA, 22 nt, Homo sapiens
augccucauuaccuugugcuaa

SEQ ID NO: 863113 - RNA, 16 nt, Homo sapiens
augccucuguauuuaa

SEQ ID NO: 863114 - RNA, 13 nt, Homo sapiens
augcugacuguac

SEQ ID NO: 863115 - RNA, 20 nt, Homo sapiens
augcuuauaagcaacaugaa

SEQ ID NO: 863116 - RNA, 16 nt, Homo sapiens
augcuuuguccaugau

SEQ ID NO: 863117 - RNA, 21 nt, Homo sapiens
auggagauauuuacaugaauu

SEQ ID NO: 863118 - RNA, 23 nt, Homo sapiens
auggaugaauaaauguuauagcu

SEQ ID NO: 863119 - RNA, 16 nt, Homo sapiens
auggcacccaugcacc

SEQ ID NO: 863120 - RNA, 15 nt, Homo sapiens
auggcagucccaaag

SEQ ID NO: 863121 - RNA, 16 nt, Homo sapiens
auggcucuacuuucag

SEQ ID NO: 863122 - RNA, 13 nt, Homo sapiens
auggcuguugaag

SEQ ID NO: 863123 - RNA, 22 nt, Homo sapiens
augggaggaaaagcccaggaga

SEQ ID NO: 863124 - RNA, 14 nt, Homo sapiens
augggcacuggaaa

SEQ ID NO: 863125 - RNA, 21 nt, Homo sapiens
augggcacuggaaaacauaga

SEQ ID NO: 863126 - RNA, 19 nt, Homo sapiens
augggcagagcccaaggga

SEQ ID NO: 863127 - RNA, 23 nt, Homo sapiens
augguggagggccacaugggagg

SEQ ID NO: 863128 - RNA, 18 nt, Homo sapiens
auguacaugaagaagcua

SEQ ID NO: 863129 - RNA, 13 nt, Homo sapiens
auguagauugccu

SEQ ID NO: 863130 - RNA, 15 nt, Homo sapiens
augugaaaguuacaa

SEQ ID NO: 863131 - RNA, 17 nt, Homo sapiens
augugaaaguuacaaau

SEQ ID NO: 863132 - RNA, 14 nt, Homo sapiens
augugauugcagcu

SEQ ID NO: 863133 - RNA, 21 nt, Homo sapiens
augugcucagggaauaaucca

SEQ ID NO: 863134 - RNA, 12 nt, Homo sapiens
augugugauuca

SEQ ID NO: 863135 - RNA, 13 nt, Homo sapiens
augugugauucac

SEQ ID NO: 863136 - RNA, 18 nt, Homo sapiens
auguuagccacaguguau

SEQ ID NO: 863137 - RNA, 17 nt, Homo sapiens
auguuccauccuguaca

SEQ ID NO: 863138 - RNA, 12 nt, Homo sapiens
auguugaugaaa

SEQ ID NO: 863139 - RNA, 19 nt, Homo sapiens
auguuuaaaggacccuaua

SEQ ID NO: 863140 - RNA, 16 nt, Homo sapiens
auuaacugaauucuga

SEQ ID NO: 863141 - RNA, 20 nt, Homo sapiens
auuaacugaauucugaacuu

SEQ ID NO: 863142 - RNA, 21 nt, Homo sapiens
auuaccgucugugauugccau

SEQ ID NO: 863143 - RNA, 19 nt, Homo sapiens
auuaccuaguagucauuuc

SEQ ID NO: 863144 - RNA, 11 nt, Homo sapiens
auuagcauuuu

SEQ ID NO: 863145 - RNA, 19 nt, Homo sapiens
auuagccuaugugcaugca

SEQ ID NO: 863146 - RNA, 16 nt, Homo sapiens
auuauuaaaucagaau

SEQ ID NO: 863147 - RNA, 18 nt, Homo sapiens
auuauuugaaaacacugc

SEQ ID NO: 863148 - RNA, 16 nt, Homo sapiens
auucagccaggagaug

SEQ ID NO: 863149 - RNA, 17 nt, Homo sapiens
auuccaccugcaaucaa

SEQ ID NO: 863150 - RNA, 17 nt, Homo sapiens
auucccggcuggacuuu

SEQ ID NO: 863151 - RNA, 20 nt, Homo sapiens
auucccggcuggacuuuugc

SEQ ID NO: 863152 - RNA, 15 nt, Homo sapiens
auucccucucaucca

SEQ ID NO: 863153 - RNA, 12 nt, Homo sapiens
auucgugcagca

SEQ ID NO: 863154 - RNA, 14 nt, Homo sapiens
auucucacuccuac

SEQ ID NO: 863155 - RNA, 21 nt, Homo sapiens
auucucucaggcuugcugcca

SEQ ID NO: 863156 - RNA, 21 nt, Homo sapiens
auucugaguauucauuuugca

SEQ ID NO: 863157 - RNA, 13 nt, Homo sapiens
auucuuaagcacu

SEQ ID NO: 863158 - RNA, 15 nt, Homo sapiens
auucuuaagcacuuu

SEQ ID NO: 863159 - RNA, 19 nt, Homo sapiens
auugaggaaaauuaauauc

SEQ ID NO: 863160 - RNA, 18 nt, Homo sapiens
auugauagaguguuauca

SEQ ID NO: 863161 - RNA, 16 nt, Homo sapiens
auugccagcucuucca

SEQ ID NO: 863162 - RNA, 22 nt, Homo sapiens
auugcugccuaaagaaacucag

SEQ ID NO: 863163 - RNA, 18 nt, Homo sapiens
auuuagacccugcauuua

SEQ ID NO: 863164 - RNA, 16 nt, Homo sapiens
auuucaguucaaucaa

SEQ ID NO: 863165 - RNA, 23 nt, Homo sapiens
auuucaguucaaucaaacuuuca

SEQ ID NO: 863166 - RNA, 15 nt, Homo sapiens
auuucaucuuuccaa

SEQ ID NO: 863167 - RNA, 12 nt, Homo sapiens
auuucuagacag

SEQ ID NO: 863168 - RNA, 20 nt, Homo sapiens
auuucuagacaguauugcca

SEQ ID NO: 863169 - RNA, 13 nt, Homo sapiens
auuucuucacuca

SEQ ID NO: 863170 - RNA, 14 nt, Homo sapiens
auuucuucacucaa

SEQ ID NO: 863171 - RNA, 16 nt, Homo sapiens
auuuggcaaugccauc

SEQ ID NO: 863172 - RNA, 16 nt, Homo sapiens
auuuguaacuuugcau

SEQ ID NO: 863173 - RNA, 17 nt, Homo sapiens
auuuuaaaauaggccaa

SEQ ID NO: 863174 - RNA, 13 nt, Homo sapiens
auuuuaauaacua

SEQ ID NO: 863175 - RNA, 19 nt, Homo sapiens
auuuuauuuuuaucccauc

SEQ ID NO: 863176 - RNA, 16 nt, Homo sapiens
auuuuccaccaaauuc

SEQ ID NO: 863177 - RNA, 16 nt, Homo sapiens
auuuugaaccauguga

SEQ ID NO: 863178 - RNA, 23 nt, Homo sapiens
auuuugacauacaggagagcugc

SEQ ID NO: 863179 - RNA, 20 nt, Homo sapiens
caaaaaaauccuagagauuc

SEQ ID NO: 863180 - RNA, 21 nt, Homo sapiens
caaacuagauucauggcuuua

SEQ ID NO: 863181 - RNA, 16 nt, Homo sapiens
caaagacaaaggugag

SEQ ID NO: 863182 - RNA, 18 nt, Homo sapiens
caaagcacgaaauguuau

SEQ ID NO: 863183 - RNA, 17 nt, Homo sapiens
caaauaaauccaagacu

SEQ ID NO: 863184 - RNA, 18 nt, Homo sapiens
caaauguugaccuuugag

SEQ ID NO: 863185 - RNA, 18 nt, Homo sapiens
caacaguuuuuuaugcua

SEQ ID NO: 863186 - RNA, 18 nt, Homo sapiens
caacaugugcucagggaa

SEQ ID NO: 863187 - RNA, 18 nt, Homo sapiens
caaccugccugacauuug

SEQ ID NO: 863188 - RNA, 14 nt, Homo sapiens
caacgaguacuuca

SEQ ID NO: 863189 - RNA, 13 nt, Homo sapiens
caacggcuacuac

SEQ ID NO: 863190 - RNA, 18 nt, Homo sapiens
caacuccuaccgcgauac

SEQ ID NO: 863191 - RNA, 20 nt, Homo sapiens
caacuugggaacuagacucc

SEQ ID NO: 863192 - RNA, 16 nt, Homo sapiens
caacuugucacaaagu

SEQ ID NO: 863193 - RNA, 19 nt, Homo sapiens
caagaaagcauugccagcu

SEQ ID NO: 863194 - RNA, 15 nt, Homo sapiens
caagcacagaaggag

SEQ ID NO: 863195 - RNA, 14 nt, Homo sapiens
caagcacugacacu

SEQ ID NO: 863196 - RNA, 18 nt, Homo sapiens
caagcacugcaugggcaa

SEQ ID NO: 863197 - RNA, 22 nt, Homo sapiens
caagcuaaaauuagaugaacuc

SEQ ID NO: 863198 - RNA, 17 nt, Homo sapiens
caagcugccugccugag

SEQ ID NO: 863199 - RNA, 17 nt, Homo sapiens
caagcuuguguacuuga

SEQ ID NO: 863200 - RNA, 13 nt, Homo sapiens
caaggaagucaaa

SEQ ID NO: 863201 - RNA, 15 nt, Homo sapiens
caagggacugggggu

SEQ ID NO: 863202 - RNA, 17 nt, Homo sapiens
caaggugacauuuccau

SEQ ID NO: 863203 - RNA, 15 nt, Homo sapiens
caaguagcacccugg

SEQ ID NO: 863204 - RNA, 20 nt, Homo sapiens
caagucuuuacagaaucaaa

SEQ ID NO: 863205 - RNA, 19 nt, Homo sapiens
caaguucauaguuucugua

SEQ ID NO: 863206 - RNA, 20 nt, Homo sapiens
caaguuggcuucuaaucaaa

SEQ ID NO: 863207 - RNA, 15 nt, Homo sapiens
caaguuucagaguca

SEQ ID NO: 863208 - RNA, 15 nt, Homo sapiens
caauaauuguggaga

SEQ ID NO: 863209 - RNA, 14 nt, Homo sapiens
caauaggacaaaac

SEQ ID NO: 863210 - RNA, 15 nt, Homo sapiens
caauaguuguugauu

SEQ ID NO: 863211 - RNA, 12 nt, Homo sapiens
caauaugcauuu

SEQ ID NO: 863212 - RNA, 13 nt, Homo sapiens
caauccuauguuu

SEQ ID NO: 863213 - RNA, 13 nt, Homo sapiens
caaucuccaucac

SEQ ID NO: 863214 - RNA, 18 nt, Homo sapiens
caaucucugauucuguca

SEQ ID NO: 863215 - RNA, 22 nt, Homo sapiens
caaugcuauaacuauguugaua

SEQ ID NO: 863216 - RNA, 21 nt, Homo sapiens
caaugcuuuguccaugauguc

SEQ ID NO: 863217 - RNA, 14 nt, Homo sapiens
caauguuagccaca

SEQ ID NO: 863218 - RNA, 22 nt, Homo sapiens
caauucauauauuugaagugga

SEQ ID NO: 863219 - RNA, 21 nt, Homo sapiens
caauuuccggccaacaguuaa

SEQ ID NO: 863220 - RNA, 18 nt, Homo sapiens
cacaaaauaaccaauccu

SEQ ID NO: 863221 - RNA, 21 nt, Homo sapiens
cacacgucuggcuucacagau

SEQ ID NO: 863222 - RNA, 17 nt, Homo sapiens
cacacuacgcagaagag

SEQ ID NO: 863223 - RNA, 16 nt, Homo sapiens
cacacuggcuccagac

SEQ ID NO: 863224 - RNA, 12 nt, Homo sapiens
cacacugggacu

SEQ ID NO: 863225 - RNA, 17 nt, Homo sapiens
cacagagugccaucccu

SEQ ID NO: 863226 - RNA, 16 nt, Homo sapiens
cacagaugugugauuc

SEQ ID NO: 863227 - RNA, 15 nt, Homo sapiens
cacagugcaucucag

SEQ ID NO: 863228 - RNA, 18 nt, Homo sapiens
cacaucuaacaaagucaa

SEQ ID NO: 863229 - RNA, 19 nt, Homo sapiens
cacauggccgcugcccacg

SEQ ID NO: 863230 - RNA, 17 nt, Homo sapiens
cacauucgaguguuuca

SEQ ID NO: 863231 - RNA, 14 nt, Homo sapiens
cacauucuacuuca

SEQ ID NO: 863232 - RNA, 23 nt, Homo sapiens
cacauucuacuucagcuuuggau

SEQ ID NO: 863233 - RNA, 19 nt, Homo sapiens
caccaucaucauagaggau

SEQ ID NO: 863234 - RNA, 23 nt, Homo sapiens
cacccucugcuaugucugugaug

SEQ ID NO: 863235 - RNA, 20 nt, Homo sapiens
caccgccgugggguguauug

SEQ ID NO: 863236 - RNA, 21 nt, Homo sapiens
caccguacgacucuuuuccaa

SEQ ID NO: 863237 - RNA, 18 nt, Homo sapiens
caccucugugccaccucu

SEQ ID NO: 863238 - RNA, 23 nt, Homo sapiens
caccugcagcccuuuuaguggug

SEQ ID NO: 863239 - RNA, 16 nt, Homo sapiens
cacgagcugcugucca

SEQ ID NO: 863240 - RNA, 18 nt, Homo sapiens
cacgucccgggcacuguc

SEQ ID NO: 863241 - RNA, 20 nt, Homo sapiens
cacgucccgggcacugucau

SEQ ID NO: 863242 - RNA, 18 nt, Homo sapiens
gauucuaaaggggacaga

SEQ ID NO: 863243 - RNA, 23 nt, Homo sapiens
gauugccucugaagccuauguau

SEQ ID NO: 863244 - RNA, 13 nt, Homo sapiens
gauuucacugaca

SEQ ID NO: 863245 - RNA, 14 nt, Homo sapiens
gauuucacugacac

SEQ ID NO: 863246 - RNA, 15 nt, Homo sapiens
gauuucaugauuuca

SEQ ID NO: 863247 - RNA, 17 nt, Homo sapiens
gauuugcaacuuuagaa

SEQ ID NO: 863248 - RNA, 15 nt, Homo sapiens
gauuuugaacauacu

SEQ ID NO: 863249 - RNA, 18 nt, Homo sapiens
gcaaaauacaugacauuu

SEQ ID NO: 863250 - RNA, 16 nt, Homo sapiens
gcaaagacuuuccucu

SEQ ID NO: 863251 - RNA, 15 nt, Homo sapiens
gcaaagagugugcuc

SEQ ID NO: 863252 - RNA, 12 nt, Homo sapiens
gcaacaguuuuu

SEQ ID NO: 863253 - RNA, 15 nt, Homo sapiens
gcaagacaccuuccc

SEQ ID NO: 863254 - RNA, 21 nt, Homo sapiens
gcaagcaagaaacacugggcu

SEQ ID NO: 863255 - RNA, 16 nt, Homo sapiens
gcaaggaaacuaugua

SEQ ID NO: 863256 - RNA, 23 nt, Homo sapiens
gcaaggaaacuauguaacaugua

SEQ ID NO: 863257 - RNA, 13 nt, Homo sapiens
gcaaggugacauu

SEQ ID NO: 863258 - RNA, 18 nt, Homo sapiens
gcaagucccaugauuucu

SEQ ID NO: 863259 - RNA, 14 nt, Homo sapiens
gcaauaggacaaaa

SEQ ID NO: 863260 - RNA, 15 nt, Homo sapiens
gcaauagucaaaaac

SEQ ID NO: 863261 - RNA, 18 nt, Homo sapiens
gcacacagcugcagagac

SEQ ID NO: 863262 - RNA, 18 nt, Homo sapiens
gcacacccucucugucca

SEQ ID NO: 863263 - RNA, 18 nt, Homo sapiens
gcacagagagggggccac

SEQ ID NO: 863264 - RNA, 23 nt, Homo sapiens
gcacagagagggggccaccuccc

SEQ ID NO: 863265 - RNA, 22 nt, Homo sapiens
gcacauuagccuaugugcaugc

SEQ ID NO: 863266 - RNA, 15 nt, Homo sapiens
gcaccacuguguauu

SEQ ID NO: 863267 - RNA, 19 nt, Homo sapiens
gcaccacuguguauuuaac

SEQ ID NO: 863268 - RNA, 16 nt, Homo sapiens
gcaccauggcuacuac

SEQ ID NO: 863269 - RNA, 21 nt, Homo sapiens
gcacccuggauugaucggagc

SEQ ID NO: 863270 - RNA, 12 nt, Homo sapiens
gcacugucaugc

SEQ ID NO: 863271 - RNA, 21 nt, Homo sapiens
gcacuuucccuagaaagccau

SEQ ID NO: 863272 - RNA, 21 nt, Homo sapiens
gcagaacagcuucauguuccc

SEQ ID NO: 863273 - RNA, 18 nt, Homo sapiens
gcagaccugggacuuuag

SEQ ID NO: 863274 - RNA, 18 nt, Homo sapiens
gcagcuccggaaggacac

SEQ ID NO: 863275 - RNA, 18 nt, Homo sapiens
gcaggaaaugaaaauguc

SEQ ID NO: 863276 - RNA, 21 nt, Homo sapiens
gcaggaagcaacgaagggaaa

SEQ ID NO: 863277 - RNA, 20 nt, Homo sapiens
gcaggacgacuguuuuccca

SEQ ID NO: 863278 - RNA, 14 nt, Homo sapiens
gcaggguucuagaa

SEQ ID NO: 863279 - RNA, 19 nt, Homo sapiens
gcagucacacugcugggaa

SEQ ID NO: 863280 - RNA, 16 nt, Homo sapiens
gcauaaguuucuggga

SEQ ID NO: 863281 - RNA, 21 nt, Homo sapiens
gcauaaguuucugggaccuca

SEQ ID NO: 863282 - RNA, 19 nt, Homo sapiens
cacguggccgcugcccacg

SEQ ID NO: 863283 - RNA, 14 nt, Homo sapiens
cacuaccuuuaaaa

SEQ ID NO: 863284 - RNA, 18 nt, Homo sapiens
cacuauucuuaagcacuu

SEQ ID NO: 863285 - RNA, 20 nt, Homo sapiens
cacuauucuuaagcacuuug

SEQ ID NO: 863286 - RNA, 21 nt, Homo sapiens
cacucauuaccgucugugauu

SEQ ID NO: 863287 - RNA, 21 nt, Homo sapiens
cacugaaccuuguugaugcca

SEQ ID NO: 863288 - RNA, 15 nt, Homo sapiens
cacugauaaaaccau

SEQ ID NO: 863289 - RNA, 14 nt, Homo sapiens
cacugauuacuuuu

SEQ ID NO: 863290 - RNA, 12 nt, Homo sapiens
cacugcaagcac

SEQ ID NO: 863291 - RNA, 15 nt, Homo sapiens
cacugcaagcacugc

SEQ ID NO: 863292 - RNA, 23 nt, Homo sapiens
cacugcugggaaguggcuuaaua

SEQ ID NO: 863293 - RNA, 23 nt, Homo sapiens
cacugcuugaggaaaacaagcau

SEQ ID NO: 863294 - RNA, 20 nt, Homo sapiens
cacuugccccuguuaccuaa

SEQ ID NO: 863295 - RNA, 21 nt, Homo sapiens
cacuugugcaguguugacagu

SEQ ID NO: 863296 - RNA, 21 nt, Homo sapiens
cacuuugcagaccugggacuu

SEQ ID NO: 863297 - RNA, 23 nt, Homo sapiens
cagaaagcaucuauucccaaaga

SEQ ID NO: 863298 - RNA, 13 nt, Homo sapiens
cagaacagucuga

SEQ ID NO: 863299 - RNA, 14 nt, Homo sapiens
cagaacucuuucaa

SEQ ID NO: 863300 - RNA, 20 nt, Homo sapiens
cagaagagaaaguacaacca

SEQ ID NO: 863301 - RNA, 14 nt, Homo sapiens
cagaaucuuuaaag

SEQ ID NO: 863302 - RNA, 16 nt, Homo sapiens
cagagaggacuguuga

SEQ ID NO: 863303 - RNA, 15 nt, Homo sapiens
cagagaggagucaga

SEQ ID NO: 863304 - RNA, 19 nt, Homo sapiens
cagagauaauucuagcuuu

SEQ ID NO: 863305 - RNA, 17 nt, Homo sapiens
cagagcagaacuuucac

SEQ ID NO: 863306 - RNA, 20 nt, Homo sapiens
cagagcuugaacacagucuc

SEQ ID NO: 863307 - RNA, 20 nt, Homo sapiens
cagaguaaaauuacagaaga

SEQ ID NO: 863308 - RNA, 13 nt, Homo sapiens
cagaguugugcac

SEQ ID NO: 863309 - RNA, 23 nt, Homo sapiens
cagaugccuccucuguccucauu

SEQ ID NO: 863310 - RNA, 21 nt, Homo sapiens
cagauuaucuuguacagccuu

SEQ ID NO: 863311 - RNA, 14 nt, Homo sapiens
cagcagcuugacgc

SEQ ID NO: 863312 - RNA, 22 nt, Homo sapiens
cagcaggacgacuguuuuccca

SEQ ID NO: 863313 - RNA, 22 nt, Homo sapiens
cagcauaaccccacccuuuaca

SEQ ID NO: 863314 - RNA, 21 nt, Homo sapiens
cagcauuuagacccugcauuu

SEQ ID NO: 863315 - RNA, 17 nt, Homo sapiens
cagccaaaaaggacuuu

SEQ ID NO: 863316 - RNA, 20 nt, Homo sapiens
cagccaaaccuuuccuguaa

SEQ ID NO: 863317 - RNA, 20 nt, Homo sapiens
cagccaccccucagacuggg

SEQ ID NO: 863318 - RNA, 19 nt, Homo sapiens
cagcucgggcccucuguga

SEQ ID NO: 863319 - RNA, 23 nt, Homo sapiens
cagcuggguuggaaaacaguauu

SEQ ID NO: 863320 - RNA, 16 nt, Homo sapiens
cagcuucauguuccca

SEQ ID NO: 863321 - RNA, 15 nt, Homo sapiens
caggaaccucagggc

SEQ ID NO: 863322 - RNA, 21 nt, Homo sapiens
caggagggguuaaagcugccg

SEQ ID NO: 863323 - RNA, 17 nt, Homo sapiens
caggaggugcuaucgca

SEQ ID NO: 863324 - RNA, 14 nt, Homo sapiens
caggagugacucug

SEQ ID NO: 863325 - RNA, 18 nt, Homo sapiens
caggcccuuccucuccac

SEQ ID NO: 863326 - RNA, 17 nt, Homo sapiens
caggcucaggcugccca

SEQ ID NO: 863327 - RNA, 15 nt, Homo sapiens
cagggcuguguguac

SEQ ID NO: 863328 - RNA, 21 nt, Homo sapiens
cagggcuuuacuaucuuuuca

SEQ ID NO: 863329 - RNA, 17 nt, Homo sapiens
cagguaaggugagggaa

SEQ ID NO: 863330 - RNA, 17 nt, Homo sapiens
caggucagagcccagga

SEQ ID NO: 863331 - RNA, 11 nt, Homo sapiens
caggugcacag

SEQ ID NO: 863332 - RNA, 16 nt, Homo sapiens
cagguucacccagcgc

SEQ ID NO: 863333 - RNA, 17 nt, Homo sapiens
cagguuuauccagauga

SEQ ID NO: 863334 - RNA, 17 nt, Homo sapiens
caguagugccugugauc

SEQ ID NO: 863335 - RNA, 22 nt, Homo sapiens
caguauuuuccaaacuaccuuc

SEQ ID NO: 863336 - RNA, 19 nt, Homo sapiens
cagucaaggaguggcuuac

SEQ ID NO: 863337 - RNA, 18 nt, Homo sapiens
cagucagaguugugcaca

SEQ ID NO: 863338 - RNA, 19 nt, Homo sapiens
cagucagaguugugcacau

SEQ ID NO: 863339 - RNA, 17 nt, Homo sapiens
cagucuuccauuugcaa

SEQ ID NO: 863340 - RNA, 15 nt, Homo sapiens
cagugaaacuugugc

SEQ ID NO: 863341 - RNA, 21 nt, Homo sapiens
cagugaaugauucaguguuaa

SEQ ID NO: 863342 - RNA, 22 nt, Homo sapiens
cagugaguuggggcgacuguga

SEQ ID NO: 863343 - RNA, 18 nt, Homo sapiens
cagugauugaaguaucug

SEQ ID NO: 863344 - RNA, 18 nt, Homo sapiens
caguggugagacuguauc

SEQ ID NO: 863345 - RNA, 12 nt, Homo sapiens
caguguguuucu

SEQ ID NO: 863346 - RNA, 20 nt, Homo sapiens
caguuugcuuuguaugcacu

SEQ ID NO: 863347 - RNA, 14 nt, Homo sapiens
cauaaaacuucuga

SEQ ID NO: 863348 - RNA, 16 nt, Homo sapiens
cauaagaaaacuaaga

SEQ ID NO: 863349 - RNA, 18 nt, Homo sapiens
cauaauuucuucacucaa

SEQ ID NO: 863350 - RNA, 14 nt, Homo sapiens
cauacacagccugg

SEQ ID NO: 863351 - RNA, 24 nt, Homo sapiens
cauagauaauaguacaugucaccu

SEQ ID NO: 863352 - RNA, 24 nt, Homo sapiens
cauagcugagcuggaaaggaugcu

SEQ ID NO: 863353 - RNA, 19 nt, Homo sapiens
cauauaauguuguuauuua

SEQ ID NO: 863354 - RNA, 14 nt, Homo sapiens
cauauauuguuauu

SEQ ID NO: 863355 - RNA, 21 nt, Homo sapiens
cauaugauugugcacauacuu

SEQ ID NO: 863356 - RNA, 22 nt, Homo sapiens
cauauuaauugguuugugccuu

SEQ ID NO: 863357 - RNA, 13 nt, Homo sapiens
caucaauucucua

SEQ ID NO: 863358 - RNA, 13 nt, Homo sapiens
caucauaguacag

SEQ ID NO: 863359 - RNA, 19 nt, Homo sapiens
caucaucuccugccuuccu

SEQ ID NO: 863360 - RNA, 17 nt, Homo sapiens
cauccuccacaauagca

SEQ ID NO: 863361 - RNA, 22 nt, Homo sapiens
caucuaaccucaucuucuucac

SEQ ID NO: 863362 - RNA, 17 nt, Homo sapiens
caucucauuaauucaau

SEQ ID NO: 863363 - RNA, 14 nt, Homo sapiens
caucugaagugucu

SEQ ID NO: 863364 - RNA, 14 nt, Homo sapiens
caugaacguuuucu

SEQ ID NO: 863365 - RNA, 12 nt, Homo sapiens
caugaauaugau

SEQ ID NO: 863366 - RNA, 12 nt, Homo sapiens
caugauaccugg

SEQ ID NO: 863367 - RNA, 21 nt, Homo sapiens
caugcccagcuuggagugcca

SEQ ID NO: 863368 - RNA, 21 nt, Homo sapiens
cauggcagaaggcaaacccau

SEQ ID NO: 863369 - RNA, 18 nt, Homo sapiens
caugguuuagggugauca

SEQ ID NO: 863370 - RNA, 12 nt, Homo sapiens
cauguacaugaa

SEQ ID NO: 863371 - RNA, 23 nt, Homo sapiens
cauguacuuuauauuuucuauau

SEQ ID NO: 863372 - RNA, 13 nt, Homo sapiens
caugucaccuuag

SEQ ID NO: 863373 - RNA, 14 nt, Homo sapiens
caugugacuguauu

SEQ ID NO: 863374 - RNA, 15 nt, Homo sapiens
caugugcucagggaa

SEQ ID NO: 863375 - RNA, 16 nt, Homo sapiens
cauuaccgucugugau

SEQ ID NO: 863376 - RNA, 20 nt, Homo sapiens
cauuauaugcacuagcaaua

SEQ ID NO: 863377 - RNA, 12 nt, Homo sapiens
cauuaucuauga

SEQ ID NO: 863378 - RNA, 17 nt, Homo sapiens
cauuauuugaaaacacu

SEQ ID NO: 863379 - RNA, 18 nt, Homo sapiens
cauucaaaaacauggcca

SEQ ID NO: 863380 - RNA, 9 nt, Homo sapiens
cauucaguc

SEQ ID NO: 863381 - RNA, 14 nt, Homo sapiens
cauucugacaucuu

SEQ ID NO: 863382 - RNA, 14 nt, Homo sapiens
cauugaucugggau

SEQ ID NO: 863383 - RNA, 19 nt, Homo sapiens
cauuguucagaugcuucuu

SEQ ID NO: 863384 - RNA, 16 nt, Homo sapiens
cauuuagcacauacua

SEQ ID NO: 863385 - RNA, 13 nt, Homo sapiens
cauuucaaaggga

SEQ ID NO: 863386 - RNA, 15 nt, Homo sapiens
cauuuccaugcauaa

SEQ ID NO: 863387 - RNA, 17 nt, Homo sapiens
cauuuccaugcauaaau

SEQ ID NO: 863388 - RNA, 19 nt, Homo sapiens
cauuucuuuauuucugucu

SEQ ID NO: 863389 - RNA, 13 nt, Homo sapiens
cauuugugucugc

SEQ ID NO: 863390 - RNA, 23 nt, Homo sapiens
cauuuuguaccagggcucuguau

SEQ ID NO: 863391 - RNA, 13 nt, Homo sapiens
ccaaacacaggca

SEQ ID NO: 863392 - RNA, 14 nt, Homo sapiens
ccaaauaugcacuu

SEQ ID NO: 863393 - RNA, 14 nt, Homo sapiens
ccaacaugugcuca

SEQ ID NO: 863394 - RNA, 20 nt, Homo sapiens
ccaacguggggcagcacaga

SEQ ID NO: 863395 - RNA, 13 nt, Homo sapiens
ccaaucuccauca

SEQ ID NO: 863396 - RNA, 13 nt, Homo sapiens
ccacacugggacu

SEQ ID NO: 863397 - RNA, 14 nt, Homo sapiens
ccacaggacauuuc

SEQ ID NO: 863398 - RNA, 15 nt, Homo sapiens
ccacaucuaacaaag

SEQ ID NO: 863399 - RNA, 14 nt, Homo sapiens
ccacccugucugca

SEQ ID NO: 863400 - RNA, 15 nt, Homo sapiens
ccaccuccaaggacu

SEQ ID NO: 863401 - RNA, 14 nt, Homo sapiens
ccacggccacugca

SEQ ID NO: 863402 - RNA, 17 nt, Homo sapiens
ccacguggccgcugccc

SEQ ID NO: 863403 - RNA, 19 nt, Homo sapiens
ccacguggccgcugcccac

SEQ ID NO: 863404 - RNA, 15 nt, Homo sapiens
ccacuguguauuuaa

SEQ ID NO: 863405 - RNA, 19 nt, Homo sapiens
ccacuuagaaauugcauuu

SEQ ID NO: 863406 - RNA, 22 nt, Homo sapiens
ccacuucccugcaaggugcacc

SEQ ID NO: 863407 - RNA, 19 nt, Homo sapiens
ccacuuggccaccaggacu

SEQ ID NO: 863408 - RNA, 17 nt, Homo sapiens
ccagaaagcucaucuca

SEQ ID NO: 863409 - RNA, 21 nt, Homo sapiens
ccagacacacagccugugcuu

SEQ ID NO: 863410 - RNA, 15 nt, Homo sapiens
ccagagggcacucug

SEQ ID NO: 863411 - RNA, 22 nt, Homo sapiens
ccagaugccuucuccagacaaa

SEQ ID NO: 863412 - RNA, 17 nt, Homo sapiens
ccagcccucaguuuuca

SEQ ID NO: 863413 - RNA, 13 nt, Homo sapiens
ccagcuguuucau

SEQ ID NO: 863414 - RNA, 15 nt, Homo sapiens
ccaggcagcuggcua

SEQ ID NO: 863415 - RNA, 20 nt, Homo sapiens
ccagggcugggcacuccucc

SEQ ID NO: 863416 - RNA, 19 nt, Homo sapiens
ccaggguuccagacagggu

SEQ ID NO: 863417 - RNA, 17 nt, Homo sapiens
acagaguggaucuggag

SEQ ID NO: 863418 - RNA, 21 nt, Homo sapiens
acagcagaguaaaauuacaga

SEQ ID NO: 863419 - RNA, 14 nt, Homo sapiens
acagcagcagcuca

SEQ ID NO: 863420 - RNA, 14 nt, Homo sapiens
acagcugcagagac

SEQ ID NO: 863421 - RNA, 20 nt, Homo sapiens
acagcugcuucugugcauuu

SEQ ID NO: 863422 - RNA, 22 nt, Homo sapiens
acaggcaaauccgaaaucagca

SEQ ID NO: 863423 - RNA, 15 nt, Homo sapiens
acaggggacacugaa

SEQ ID NO: 863424 - RNA, 18 nt, Homo sapiens
acaguauaucuuaagaua

SEQ ID NO: 863425 - RNA, 20 nt, Homo sapiens
acauacauuguauaggccau

SEQ ID NO: 863426 - RNA, 23 nt, Homo sapiens
acauauucacagugaacauaacu

SEQ ID NO: 863427 - RNA, 14 nt, Homo sapiens
acaugaaaacagaa

SEQ ID NO: 863428 - RNA, 14 nt, Homo sapiens
acaugaagcacaaa

SEQ ID NO: 863429 - RNA, 17 nt, Homo sapiens
acaugagaucuagguga

SEQ ID NO: 863430 - RNA, 16 nt, Homo sapiens
acaugauacuuauuca

SEQ ID NO: 863431 - RNA, 21 nt, Homo sapiens
acauggcuaaagaagguuuca

SEQ ID NO: 863432 - RNA, 16 nt, Homo sapiens
acauucgaguguuuca

SEQ ID NO: 863433 - RNA, 18 nt, Homo sapiens
accaaacggaacucuuca

SEQ ID NO: 863434 - RNA, 19 nt, Homo sapiens
accaauuagcauuccauca

SEQ ID NO: 863435 - RNA, 21 nt, Homo sapiens
accacacacacccuuccccac

SEQ ID NO: 863436 - RNA, 23 nt, Homo sapiens
accacaggcagcauuuagcacau

SEQ ID NO: 863437 - RNA, 20 nt, Homo sapiens
accacauuugcuagagggag

SEQ ID NO: 863438 - RNA, 17 nt, Homo sapiens
accacugauaaaaccau

SEQ ID NO: 863439 - RNA, 16 nt, Homo sapiens
accacuguguauuuaa

SEQ ID NO: 863440 - RNA, 17 nt, Homo sapiens
accagagcacagauuca

SEQ ID NO: 863441 - RNA, 11 nt, Homo sapiens
accagcccagc

SEQ ID NO: 863442 - RNA, 20 nt, Homo sapiens
accaggguugaccccagagg

SEQ ID NO: 863443 - RNA, 22 nt, Homo sapiens
accaugaagaugccauugacaa

SEQ ID NO: 863444 - RNA, 19 nt, Homo sapiens
accaugagaccacuguuau

SEQ ID NO: 863445 - RNA, 13 nt, Homo sapiens
accauguacauga

SEQ ID NO: 863446 - RNA, 13 nt, Homo sapiens
accauuaccuuaa

SEQ ID NO: 863447 - RNA, 18 nt, Homo sapiens
acccacuucccugcaagg

SEQ ID NO: 863448 - RNA, 22 nt, Homo sapiens
acccagucagaguugugcacau

SEQ ID NO: 863449 - RNA, 23 nt, Homo sapiens
acccagucagaguugugcacaug

SEQ ID NO: 863450 - RNA, 14 nt, Homo sapiens
acccauauuacaga

SEQ ID NO: 863451 - RNA, 19 nt, Homo sapiens
acccucugcuaugucugug

SEQ ID NO: 863452 - RNA, 22 nt, Homo sapiens
acccuguuuuauugaguucuga

SEQ ID NO: 863453 - RNA, 17 nt, Homo sapiens
acccuugaaaagacauc

SEQ ID NO: 863454 - RNA, 16 nt, Homo sapiens
accgagucucuucucc

SEQ ID NO: 863455 - RNA, 20 nt, Homo sapiens
accgucaauaggcaaagggg

SEQ ID NO: 863456 - RNA, 18 nt, Homo sapiens
accgucugugauugccau

SEQ ID NO: 863457 - RNA, 12 nt, Homo sapiens
accuacuuccuc

SEQ ID NO: 863458 - RNA, 13 nt, Homo sapiens
accuaggauuuca

SEQ ID NO: 863459 - RNA, 19 nt, Homo sapiens
accuaguuuguuagugcau

SEQ ID NO: 863460 - RNA, 22 nt, Homo sapiens
accucaguuuuaucauuuucaa

SEQ ID NO: 863461 - RNA, 12 nt, Homo sapiens
accucauuccaa

SEQ ID NO: 863462 - RNA, 13 nt, Homo sapiens
accucauuccaac

SEQ ID NO: 863463 - RNA, 12 nt, Homo sapiens
accucggcugug

SEQ ID NO: 863464 - RNA, 17 nt, Homo sapiens
accucucacacuggcuc

SEQ ID NO: 863465 - RNA, 15 nt, Homo sapiens
accucuggccaaaua

SEQ ID NO: 863466 - RNA, 12 nt, Homo sapiens
accucuuuccaa

SEQ ID NO: 863467 - RNA, 18 nt, Homo sapiens
accugaaauaaaauucau

SEQ ID NO: 863468 - RNA, 21 nt, Homo sapiens
accuguauugucugacuucuc

SEQ ID NO: 863469 - RNA, 21 nt, Homo sapiens
accugugcacguuggaacuuu

SEQ ID NO: 863470 - RNA, 23 nt, Homo sapiens
accuuacauuugaaaucuaugaa

SEQ ID NO: 863471 - RNA, 13 nt, Homo sapiens
accuucuuccaca

SEQ ID NO: 863472 - RNA, 17 nt, Homo sapiens
accuugacggcauugcu

SEQ ID NO: 863473 - RNA, 22 nt, Homo sapiens
accuuugaggucuaaacaaaua

SEQ ID NO: 863474 - RNA, 18 nt, Homo sapiens
acgacacgcguccucggg

SEQ ID NO: 863475 - RNA, 20 nt, Homo sapiens
acgauguuaaaacaaauuaa

SEQ ID NO: 863476 - RNA, 22 nt, Homo sapiens
acggagccacuccucugacuca

SEQ ID NO: 863477 - RNA, 12 nt, Homo sapiens
acggccacugca

SEQ ID NO: 863478 - RNA, 23 nt, Homo sapiens
acgucccgggcacugucaugccc

SEQ ID NO: 863479 - RNA, 20 nt, Homo sapiens
acguccugggugcugucaug

SEQ ID NO: 863480 - RNA, 17 nt, Homo sapiens
acgugggcggcagagag

SEQ ID NO: 863481 - RNA, 20 nt, Homo sapiens
acuaauuuguauaacccaua

SEQ ID NO: 863482 - RNA, 17 nt, Homo sapiens
acuaauuuuguacguau

SEQ ID NO: 863483 - RNA, 22 nt, Homo sapiens
acuacacauucaauaagcauca

SEQ ID NO: 863484 - RNA, 19 nt, Homo sapiens
acuacagccaaauugcaga

SEQ ID NO: 863485 - RNA, 19 nt, Homo sapiens
acuaugcaccuauaaauac

SEQ ID NO: 863486 - RNA, 15 nt, Homo sapiens
acuauguaacaugua

SEQ ID NO: 863487 - RNA, 15 nt, Homo sapiens
acuauuaaaguaaca

SEQ ID NO: 863488 - RNA, 13 nt, Homo sapiens
acucaaucucuga

SEQ ID NO: 863489 - RNA, 19 nt, Homo sapiens
acuccacuccccucaucca

SEQ ID NO: 863490 - RNA, 16 nt, Homo sapiens
acuccaucugcugcca

SEQ ID NO: 863491 - RNA, 17 nt, Homo sapiens
acucucuccaucagaag

SEQ ID NO: 863492 - RNA, 13 nt, Homo sapiens
acucuuuguauga

SEQ ID NO: 863493 - RNA, 22 nt, Homo sapiens
acugaaccuuguugaugccagc

SEQ ID NO: 863494 - RNA, 13 nt, Homo sapiens
acugaauucugaa

SEQ ID NO: 863495 - RNA, 19 nt, Homo sapiens
acugagggcaugagucuca

SEQ ID NO: 863496 - RNA, 23 nt, Homo sapiens
acugaguguucaaacuacuguac

SEQ ID NO: 863497 - RNA, 14 nt, Homo sapiens
acugcaagcacugc

SEQ ID NO: 863498 - RNA, 21 nt, Homo sapiens
acugcaagcacugcaugggca

SEQ ID NO: 863499 - RNA, 10 nt, Homo sapiens
acugcaauaa

SEQ ID NO: 863500 - RNA, 20 nt, Homo sapiens
acugcagucaccccugucug

SEQ ID NO: 863501 - RNA, 18 nt, Homo sapiens
acugccauggaggcacac

SEQ ID NO: 863502 - RNA, 18 nt, Homo sapiens
acugcccaccugccaggc

SEQ ID NO: 863503 - RNA, 15 nt, Homo sapiens
acuggaaaacauaga

SEQ ID NO: 863504 - RNA, 17 nt, Homo sapiens
acuggccuagagccuca

SEQ ID NO: 863505 - RNA, 20 nt, Homo sapiens
acuggguuccucuccaagcu

SEQ ID NO: 863506 - RNA, 13 nt, Homo sapiens
acuguacuccucc

SEQ ID NO: 863507 - RNA, 19 nt, Homo sapiens
acuucaagaucugaauuug

SEQ ID NO: 863508 - RNA, 13 nt, Homo sapiens
acuucaagugacc

SEQ ID NO: 863509 - RNA, 16 nt, Homo sapiens
acuucuauauauacaa

SEQ ID NO: 863510 - RNA, 24 nt, Homo sapiens
acuugacaagucaggagacacugu

SEQ ID NO: 863511 - RNA, 18 nt, Homo sapiens
acuuucauucccuuucau

SEQ ID NO: 863512 - RNA, 14 nt, Homo sapiens
acuuuccagcagua

SEQ ID NO: 863513 - RNA, 19 nt, Homo sapiens
acuuucccuagaaagccau

SEQ ID NO: 863514 - RNA, 23 nt, Homo sapiens
acuuuuaaguugcugaugaacuc

SEQ ID NO: 863515 - RNA, 16 nt, Homo sapiens
acuuuucacaguaugg

SEQ ID NO: 863516 - RNA, 21 nt, Homo sapiens
agaaaacccgacaacauuucu

SEQ ID NO: 863517 - RNA, 23 nt, Homo sapiens
agaaacuccuggaucccuuucac

SEQ ID NO: 863518 - RNA, 17 nt, Homo sapiens
agaaacugaguccuguu

SEQ ID NO: 863519 - RNA, 15 nt, Homo sapiens
agaaagcauugccag

SEQ ID NO: 863520 - RNA, 15 nt, Homo sapiens
agaaagcucaucuca

SEQ ID NO: 863521 - RNA, 15 nt, Homo sapiens
agaaaucaaguuaau

SEQ ID NO: 863522 - RNA, 19 nt, Homo sapiens
agaaauuaugaaaguuaau

SEQ ID NO: 863523 - RNA, 12 nt, Homo sapiens
agaagagggaga

SEQ ID NO: 863524 - RNA, 15 nt, Homo sapiens
agaaggagaggcucu

SEQ ID NO: 863525 - RNA, 18 nt, Homo sapiens
agaaggagggagacauga

SEQ ID NO: 863526 - RNA, 17 nt, Homo sapiens
agaagguuuacucugug

SEQ ID NO: 863527 - RNA, 15 nt, Homo sapiens
agaauagggagacaa

SEQ ID NO: 863528 - RNA, 13 nt, Homo sapiens
agaaucaaaugca

SEQ ID NO: 863529 - RNA, 11 nt, Homo sapiens
agaauggagcu

SEQ ID NO: 863530 - RNA, 15 nt, Homo sapiens
agaaugugacaggca

SEQ ID NO: 863531 - RNA, 17 nt, Homo sapiens
agacacuguucccaaag

SEQ ID NO: 863532 - RNA, 19 nt, Homo sapiens
agacaguguuuucugggau

SEQ ID NO: 863533 - RNA, 13 nt, Homo sapiens
agacauacuugua

SEQ ID NO: 863534 - RNA, 14 nt, Homo sapiens
agaccacugauaaa

SEQ ID NO: 863535 - RNA, 15 nt, Homo sapiens
agaccacuguuauca

SEQ ID NO: 863536 - RNA, 14 nt, Homo sapiens
agaccauaauguua

SEQ ID NO: 863537 - RNA, 20 nt, Homo sapiens
agaccccuacccuuucccaa

SEQ ID NO: 863538 - RNA, 21 nt, Homo sapiens
agaccccuacccuuucccaaa

SEQ ID NO: 863539 - RNA, 22 nt, Homo sapiens
agacggauuaucuagagaauaa

SEQ ID NO: 863540 - RNA, 21 nt, Homo sapiens
agacugcccagcuaaagcaau

SEQ ID NO: 863541 - RNA, 11 nt, Homo sapiens
agacuguaaau

SEQ ID NO: 863542 - RNA, 12 nt, Homo sapiens
agacuuugacuc

SEQ ID NO: 863543 - RNA, 13 nt, Homo sapiens
agagaauaaucau

SEQ ID NO: 863544 - RNA, 14 nt, Homo sapiens
agagaauaaucaua

SEQ ID NO: 863545 - RNA, 12 nt, Homo sapiens
agagaccagacc

SEQ ID NO: 863546 - RNA, 14 nt, Homo sapiens
agagaguucucaca

SEQ ID NO: 863547 - RNA, 20 nt, Homo sapiens
agagauauuuuccauuuuaa

SEQ ID NO: 863548 - RNA, 13 nt, Homo sapiens
agagcugguuggg

SEQ ID NO: 863549 - RNA, 14 nt, Homo sapiens
agagcuucccugac

SEQ ID NO: 863550 - RNA, 23 nt, Homo sapiens
ccuguguccacaucuaacaaagu

SEQ ID NO: 863551 - RNA, 14 nt, Homo sapiens
ccuuacaguaggag

SEQ ID NO: 863552 - RNA, 23 nt, Homo sapiens
ccuuacauuauuacuccuugcca

SEQ ID NO: 863553 - RNA, 23 nt, Homo sapiens
ccuuaguguuuggguauauucau

SEQ ID NO: 863554 - RNA, 15 nt, Homo sapiens
ccuucccucuaagcc

SEQ ID NO: 863555 - RNA, 16 nt, Homo sapiens
ccuucuagacacugaa

SEQ ID NO: 863556 - RNA, 19 nt, Homo sapiens
ccuucuccauccacauggg

SEQ ID NO: 863557 - RNA, 18 nt, Homo sapiens
ccuucucuucuauccugc

SEQ ID NO: 863558 - RNA, 18 nt, Homo sapiens
ccuucuggggcuuugcca

SEQ ID NO: 863559 - RNA, 19 nt, Homo sapiens
ccuuguaauucuaaaugaa

SEQ ID NO: 863560 - RNA, 21 nt, Homo sapiens
ccuuuggggugaacuaccuug

SEQ ID NO: 863561 - RNA, 16 nt, Homo sapiens
cgaacaauucauauau

SEQ ID NO: 863562 - RNA, 19 nt, Homo sapiens
cgagucucuucuccacugg

SEQ ID NO: 863563 - RNA, 13 nt, Homo sapiens
cgccucgcuucac

SEQ ID NO: 863564 - RNA, 16 nt, Homo sapiens
cgcgcacacacacucu

SEQ ID NO: 863565 - RNA, 17 nt, Homo sapiens
cgcugagggcaggguuc

SEQ ID NO: 863566 - RNA, 19 nt, Homo sapiens
cgcugcccacgucccgggc

SEQ ID NO: 863567 - RNA, 17 nt, Homo sapiens
cgcuggccucuuccucc

SEQ ID NO: 863568 - RNA, 22 nt, Homo sapiens
cgcuuuugcuggucacugccau

SEQ ID NO: 863569 - RNA, 16 nt, Homo sapiens
cggaacucuucaucuu

SEQ ID NO: 863570 - RNA, 18 nt, Homo sapiens
cggcaccauggcuacuac

SEQ ID NO: 863571 - RNA, 21 nt, Homo sapiens
cgggccuggagaacuagagaa

SEQ ID NO: 863572 - RNA, 13 nt, Homo sapiens
cggugagcauugu

SEQ ID NO: 863573 - RNA, 17 nt, Homo sapiens
cguaaaucaacuuguca

SEQ ID NO: 863574 - RNA, 17 nt, Homo sapiens
cgucccuccacguucac

SEQ ID NO: 863575 - RNA, 15 nt, Homo sapiens
cgugaggaugggaag

SEQ ID NO: 863576 - RNA, 15 nt, Homo sapiens
cguggccgcugccca

SEQ ID NO: 863577 - RNA, 19 nt, Homo sapiens
cuaaaaguuuuaaccucag

SEQ ID NO: 863578 - RNA, 16 nt, Homo sapiens
cuaaaauaaacaugaa

SEQ ID NO: 863579 - RNA, 23 nt, Homo sapiens
cuaacacccagucuguuccccau

SEQ ID NO: 863580 - RNA, 21 nt, Homo sapiens
cuaacaggauuagacagucaa

SEQ ID NO: 863581 - RNA, 16 nt, Homo sapiens
cuaagagaacaaugug

SEQ ID NO: 863582 - RNA, 16 nt, Homo sapiens
cuaaucagcauucuca

SEQ ID NO: 863583 - RNA, 22 nt, Homo sapiens
cuaaucagcauucucacuccua

SEQ ID NO: 863584 - RNA, 16 nt, Homo sapiens
cuaauuaaaaugugca

SEQ ID NO: 863585 - RNA, 15 nt, Homo sapiens
cuaauucucuuuuca

SEQ ID NO: 863586 - RNA, 23 nt, Homo sapiens
cuaccgagucucuucuccacugg

SEQ ID NO: 863587 - RNA, 13 nt, Homo sapiens
cuacuuugccaca

SEQ ID NO: 863588 - RNA, 15 nt, Homo sapiens
cuagagcucaguaua

SEQ ID NO: 863589 - RNA, 16 nt, Homo sapiens
cuagaggacauauuca

SEQ ID NO: 863590 - RNA, 22 nt, Homo sapiens
cuagaggacauauucacaguga

SEQ ID NO: 863591 - RNA, 17 nt, Homo sapiens
cuagaggggacaagcca

SEQ ID NO: 863592 - RNA, 15 nt, Homo sapiens
cuagggaucccucau

SEQ ID NO: 863593 - RNA, 17 nt, Homo sapiens
cuaguuuguuagugcau

SEQ ID NO: 863594 - RNA, 19 nt, Homo sapiens
cuauagaaaacgauuuuga

SEQ ID NO: 863595 - RNA, 19 nt, Homo sapiens
cuauccugcaauuucuccc

SEQ ID NO: 863596 - RNA, 13 nt, Homo sapiens
cuaugaaauauca

SEQ ID NO: 863597 - RNA, 20 nt, Homo sapiens
cuaugaaauaucaugcucca

SEQ ID NO: 863598 - RNA, 20 nt, Homo sapiens
cuauggcacccaugcaccuu

SEQ ID NO: 863599 - RNA, 13 nt, Homo sapiens
cuaugugcaugca

SEQ ID NO: 863600 - RNA, 12 nt, Homo sapiens
cuauuaucucaa

SEQ ID NO: 863601 - RNA, 19 nt, Homo sapiens
cuauucaaaauaaacaaua

SEQ ID NO: 863602 - RNA, 17 nt, Homo sapiens
cuauugcuggcaaagac

SEQ ID NO: 863603 - RNA, 18 nt, Homo sapiens
cuauugcuggcaaagaca

SEQ ID NO: 863604 - RNA, 14 nt, Homo sapiens
cucaagcacugaca

SEQ ID NO: 863605 - RNA, 15 nt, Homo sapiens
cucaagcacugacac

SEQ ID NO: 863606 - RNA, 19 nt, Homo sapiens
cucaauggagguuugcaaa

SEQ ID NO: 863607 - RNA, 15 nt, Homo sapiens
cucacacaugagauc

SEQ ID NO: 863608 - RNA, 16 nt, Homo sapiens
cucagcuggaucucca

SEQ ID NO: 863609 - RNA, 19 nt, Homo sapiens
cucaggcauggaugaauaa

SEQ ID NO: 863610 - RNA, 13 nt, Homo sapiens
cucaggucagggu

SEQ ID NO: 863611 - RNA, 19 nt, Homo sapiens
cucagguuccaaauucagu

SEQ ID NO: 863612 - RNA, 16 nt, Homo sapiens
cucagucagcccagug

SEQ ID NO: 863613 - RNA, 17 nt, Homo sapiens
cucaugcucucuauaga

SEQ ID NO: 863614 - RNA, 15 nt, Homo sapiens
cuccaccccccggcc

SEQ ID NO: 863615 - RNA, 16 nt, Homo sapiens
cuccacugccuucgau

SEQ ID NO: 863616 - RNA, 14 nt, Homo sapiens
cuccagcccuaugg

SEQ ID NO: 863617 - RNA, 22 nt, Homo sapiens
cuccaggcugucuuucacugaa

SEQ ID NO: 863618 - RNA, 18 nt, Homo sapiens
cucccaaguuuugaaagg

SEQ ID NO: 863619 - RNA, 15 nt, Homo sapiens
cuccccuucacaugc

SEQ ID NO: 863620 - RNA, 17 nt, Homo sapiens
cucccugaaguaagcaa

SEQ ID NO: 863621 - RNA, 19 nt, Homo sapiens
cucccugaaguaagcaaag

SEQ ID NO: 863622 - RNA, 14 nt, Homo sapiens
cuccuccagagccu

SEQ ID NO: 863623 - RNA, 15 nt, Homo sapiens
cuccugaagccacag

SEQ ID NO: 863624 - RNA, 21 nt, Homo sapiens
cucgcuggugaagacccagag

SEQ ID NO: 863625 - RNA, 21 nt, Homo sapiens
cucuaucauguugaagucaaa

SEQ ID NO: 863626 - RNA, 13 nt, Homo sapiens
cucuauuaucuca

SEQ ID NO: 863627 - RNA, 13 nt, Homo sapiens
cucucacacuggc

SEQ ID NO: 863628 - RNA, 16 nt, Homo sapiens
cucucaccuacuuccu

SEQ ID NO: 863629 - RNA, 13 nt, Homo sapiens
cucucccaaauaa

SEQ ID NO: 863630 - RNA, 15 nt, Homo sapiens
cucucucucaccuac

SEQ ID NO: 863631 - RNA, 14 nt, Homo sapiens
cucugaaaccagug

SEQ ID NO: 863632 - RNA, 21 nt, Homo sapiens
cucugagguuuccgaaaucag

SEQ ID NO: 863633 - RNA, 22 nt, Homo sapiens
cucuggcaagagacuacucugc

SEQ ID NO: 863634 - RNA, 13 nt, Homo sapiens
cucuggcugccaa

SEQ ID NO: 863635 - RNA, 22 nt, Homo sapiens
cucugggccaagucaaagacau

SEQ ID NO: 863636 - RNA, 18 nt, Homo sapiens
cucugugggcuccaugua

SEQ ID NO: 863637 - RNA, 20 nt, Homo sapiens
cucuuuuuagauguagcacu

SEQ ID NO: 863638 - RNA, 15 nt, Homo sapiens
cucuuuuucuagucu

SEQ ID NO: 863639 - RNA, 19 nt, Homo sapiens
cugaaaacacugugcacau

SEQ ID NO: 863640 - RNA, 16 nt, Homo sapiens
cugaaguaagcaaaga

SEQ ID NO: 863641 - RNA, 12 nt, Homo sapiens
cugaagugaaua

SEQ ID NO: 863642 - RNA, 23 nt, Homo sapiens
cugaauagcagaagguugcaccu

SEQ ID NO: 863643 - RNA, 18 nt, Homo sapiens
cugacagaaggacucagg

SEQ ID NO: 863644 - RNA, 16 nt, Homo sapiens
cugacuguugcuguaa

SEQ ID NO: 863645 - RNA, 16 nt, Homo sapiens
cugagcaaagcauuga

SEQ ID NO: 863646 - RNA, 22 nt, Homo sapiens
cugagcaaagcauugagcaaag

SEQ ID NO: 863647 - RNA, 15 nt, Homo sapiens
cugagcuuuccagcc

SEQ ID NO: 863648 - RNA, 19 nt, Homo sapiens
cugagguuugccagcauuu

SEQ ID NO: 863649 - RNA, 22 nt, Homo sapiens
cugaguauucauuuugcaacuu

SEQ ID NO: 863650 - RNA, 18 nt, Homo sapiens
cugagucccagcaauucu

SEQ ID NO: 863651 - RNA, 15 nt, Homo sapiens
cugagugcaccacuu

SEQ ID NO: 863652 - RNA, 13 nt, Homo sapiens
cugaucugaugca

SEQ ID NO: 863653 - RNA, 11 nt, Homo sapiens
cugcaccucau

SEQ ID NO: 863654 - RNA, 18 nt, Homo sapiens
cugcagcucccagaagcu

SEQ ID NO: 863655 - RNA, 15 nt, Homo sapiens
cugccugaacaaagg

SEQ ID NO: 863656 - RNA, 14 nt, Homo sapiens
cugccuuguguaca

SEQ ID NO: 863657 - RNA, 13 nt, Homo sapiens
cugcgucuccugc

SEQ ID NO: 863658 - RNA, 16 nt, Homo sapiens
cugcucacauucccuc

SEQ ID NO: 863659 - RNA, 20 nt, Homo sapiens
cugcucuagaggcccaagcu

SEQ ID NO: 863660 - RNA, 19 nt, Homo sapiens
cugcugagugcaccacuuc

SEQ ID NO: 863661 - RNA, 16 nt, Homo sapiens
cugcuucugugcauuu

SEQ ID NO: 863662 - RNA, 22 nt, Homo sapiens
cugcuugaggaaaacaagcauu

SEQ ID NO: 863663 - RNA, 19 nt, Homo sapiens
cuggaaaggaugcuucugc

SEQ ID NO: 863664 - RNA, 13 nt, Homo sapiens
cuggacucucagu

SEQ ID NO: 863665 - RNA, 20 nt, Homo sapiens
cuggggaggacaaaggugau

SEQ ID NO: 863666 - RNA, 15 nt, Homo sapiens
cuggggcuuugccau

SEQ ID NO: 863667 - RNA, 15 nt, Homo sapiens
cuggguccucccagc

SEQ ID NO: 863668 - RNA, 22 nt, Homo sapiens
cuggguuuuguauucucugagc

SEQ ID NO: 863669 - RNA, 22 nt, Homo sapiens
cugguaccagcacuccgcggcg

SEQ ID NO: 863670 - RNA, 15 nt, Homo sapiens
cuggugacccaguca

SEQ ID NO: 863671 - RNA, 16 nt, Homo sapiens
cuggugacccagucag

SEQ ID NO: 863672 - RNA, 12 nt, Homo sapiens
cuguaaauaucc

SEQ ID NO: 863673 - RNA, 16 nt, Homo sapiens
cuguaugauuccuuga

SEQ ID NO: 863674 - RNA, 13 nt, Homo sapiens
cuguauuaacuga

SEQ ID NO: 863675 - RNA, 17 nt, Homo sapiens
cuguauuagucacagag

SEQ ID NO: 863676 - RNA, 13 nt, Homo sapiens
cugugaugccuga

SEQ ID NO: 863677 - RNA, 20 nt, Homo sapiens
cugugggucagugugccacc

SEQ ID NO: 863678 - RNA, 20 nt, Homo sapiens
cuuacauuauuacuccuugc

SEQ ID NO: 863679 - RNA, 20 nt, Homo sapiens
cuuaggcuuacaaugugcac

SEQ ID NO: 863680 - RNA, 15 nt, Homo sapiens
cuuaguagagauuuc

SEQ ID NO: 863681 - RNA, 14 nt, Homo sapiens
cuuaguauuugcau

SEQ ID NO: 863682 - RNA, 21 nt, Homo sapiens
cuuaguuacucauucagggau

SEQ ID NO: 863683 - RNA, 14 nt, Homo sapiens
ugcacaaacuccau

SEQ ID NO: 863684 - RNA, 16 nt, Homo sapiens
ugcaccaagcaggaaa

SEQ ID NO: 863685 - RNA, 15 nt, Homo sapiens
ugcaccucauuccaa

SEQ ID NO: 863686 - RNA, 22 nt, Homo sapiens
ugcacuuucccuagaaagccau

SEQ ID NO: 863687 - RNA, 15 nt, Homo sapiens
ugcagaccugggacu

SEQ ID NO: 863688 - RNA, 15 nt, Homo sapiens
ugcagauaacagcug

SEQ ID NO: 863689 - RNA, 16 nt, Homo sapiens
ugcagauaacagcugg

SEQ ID NO: 863690 - RNA, 14 nt, Homo sapiens
ugcagcucccagaa

SEQ ID NO: 863691 - RNA, 20 nt, Homo sapiens
ugcaggauccuugccuccaa

SEQ ID NO: 863692 - RNA, 16 nt, Homo sapiens
ugcagggaauuuucau

SEQ ID NO: 863693 - RNA, 19 nt, Homo sapiens
ugcaguauuuucaguguca

SEQ ID NO: 863694 - RNA, 16 nt, Homo sapiens
ugcaguggguucucca

SEQ ID NO: 863695 - RNA, 20 nt, Homo sapiens
ugcauaaaauguuaaguuga

SEQ ID NO: 863696 - RNA, 18 nt, Homo sapiens
ugcauaagugcaugacau

SEQ ID NO: 863697 - RNA, 13 nt, Homo sapiens
ugcauacuugcca

SEQ ID NO: 863698 - RNA, 16 nt, Homo sapiens
ugcaugcagcaucuaa

SEQ ID NO: 863699 - RNA, 12 nt, Homo sapiens
ugcauuaucuau

SEQ ID NO: 863700 - RNA, 14 nt, Homo sapiens
ugcauuucuuuauu

SEQ ID NO: 863701 - RNA, 21 nt, Homo sapiens
ugccacguggccgcugcccac

SEQ ID NO: 863702 - RNA, 21 nt, Homo sapiens
ugccagcauuuagacccugca

SEQ ID NO: 863703 - RNA, 15 nt, Homo sapiens
ugccaggccuggcaa

SEQ ID NO: 863704 - RNA, 19 nt, Homo sapiens
ugccaucccugagagacca

SEQ ID NO: 863705 - RNA, 23 nt, Homo sapiens
ugccauggaggcacacagcugca

SEQ ID NO: 863706 - RNA, 22 nt, Homo sapiens
ugcccagcuuggagugccacau

SEQ ID NO: 863707 - RNA, 12 nt, Homo sapiens
ugcccagugugu

SEQ ID NO: 863708 - RNA, 16 nt, Homo sapiens
ugcccaguguguuucu

SEQ ID NO: 863709 - RNA, 17 nt, Homo sapiens
ugcccccaauccaugaa

SEQ ID NO: 863710 - RNA, 15 nt, Homo sapiens
ugcccugcucuucag

SEQ ID NO: 863711 - RNA, 23 nt, Homo sapiens
ugccguucgcugagucccagcaa

SEQ ID NO: 863712 - RNA, 22 nt, Homo sapiens
ugccucauuaccuugugcuaau

SEQ ID NO: 863713 - RNA, 23 nt, Homo sapiens
ugccugauuuguuccuucugggg

SEQ ID NO: 863714 - RNA, 21 nt, Homo sapiens
ugccuucucuucuauccugca

SEQ ID NO: 863715 - RNA, 15 nt, Homo sapiens
ugcguaaaucaacuu

SEQ ID NO: 863716 - RNA, 17 nt, Homo sapiens
ugcucuuaaguugugga

SEQ ID NO: 863717 - RNA, 15 nt, Homo sapiens
ugcugagcauguacu

SEQ ID NO: 863718 - RNA, 23 nt, Homo sapiens
ugcugagugcaccacuucaagug

SEQ ID NO: 863719 - RNA, 19 nt, Homo sapiens
ugcugcugagugcaccacu

SEQ ID NO: 863720 - RNA, 16 nt, Homo sapiens
ugcuggcaaagacaga

SEQ ID NO: 863721 - RNA, 16 nt, Homo sapiens
ugcuggcuugcacuuu

SEQ ID NO: 863722 - RNA, 16 nt, Homo sapiens
ugcuggucacugccau

SEQ ID NO: 863723 - RNA, 21 nt, Homo sapiens
ugcuguccaggaacuuuccag

SEQ ID NO: 863724 - RNA, 19 nt, Homo sapiens
ugcugugacaggcaguguu

SEQ ID NO: 863725 - RNA, 14 nt, Homo sapiens
ugcuuaaucuugcu

SEQ ID NO: 863726 - RNA, 16 nt, Homo sapiens
ugcuuauguaugccua

SEQ ID NO: 863727 - RNA, 19 nt, Homo sapiens
uggacauuuuaaacacuua

SEQ ID NO: 863728 - RNA, 15 nt, Homo sapiens
uggaccacagugacu

SEQ ID NO: 863729 - RNA, 21 nt, Homo sapiens
uggacuauggcucuacuuuca

SEQ ID NO: 863730 - RNA, 20 nt, Homo sapiens
uggagacuggaacacaacca

SEQ ID NO: 863731 - RNA, 17 nt, Homo sapiens
uggauacuauuaaagua

SEQ ID NO: 863732 - RNA, 17 nt, Homo sapiens
uggauccagccauuccu

SEQ ID NO: 863733 - RNA, 18 nt, Homo sapiens
uggaucuccauucucuca

SEQ ID NO: 863734 - RNA, 19 nt, Homo sapiens
uggaucuccauucucucag

SEQ ID NO: 863735 - RNA, 23 nt, Homo sapiens
uggaugugguuaccgaguaucug

SEQ ID NO: 863736 - RNA, 18 nt, Homo sapiens
uggcaauucuucuucuca

SEQ ID NO: 863737 - RNA, 16 nt, Homo sapiens
uggcagccgugccuuc

SEQ ID NO: 863738 - RNA, 18 nt, Homo sapiens
uggccaaauaugcacuuu

SEQ ID NO: 863739 - RNA, 19 nt, Homo sapiens
uggccacauccaacauuuc

SEQ ID NO: 863740 - RNA, 16 nt, Homo sapiens
uggcccgcacgugucc

SEQ ID NO: 863741 - RNA, 17 nt, Homo sapiens
uggccgcugcugugaca

SEQ ID NO: 863742 - RNA, 15 nt, Homo sapiens
uggcucuacuuucag

SEQ ID NO: 863743 - RNA, 21 nt, Homo sapiens
uggcuggguuugggcagugga

SEQ ID NO: 863744 - RNA, 23 nt, Homo sapiens
uggcuuacuacaugugggagcuu

SEQ ID NO: 863745 - RNA, 21 nt, Homo sapiens
uggcuucacagaugugugauu

SEQ ID NO: 863746 - RNA, 18 nt, Homo sapiens
ugggaacuagacucccaa

SEQ ID NO: 863747 - RNA, 17 nt, Homo sapiens
ugggaacuccuaaauca

SEQ ID NO: 863748 - RNA, 21 nt, Homo sapiens
ugggaguaagagcaaauuuca

SEQ ID NO: 863749 - RNA, 22 nt, Homo sapiens
ugggcagggguuccagcuuccc

SEQ ID NO: 863750 - RNA, 16 nt, Homo sapiens
ugggccaagccagggu

SEQ ID NO: 863751 - RNA, 20 nt, Homo sapiens
ugggccaagccaggguucca

SEQ ID NO: 863752 - RNA, 19 nt, Homo sapiens
ugggccaagucaaagacau

SEQ ID NO: 863753 - RNA, 14 nt, Homo sapiens
ugggugcugucaug

SEQ ID NO: 863754 - RNA, 19 nt, Homo sapiens
uggguuggaaaacaguauu

SEQ ID NO: 863755 - RNA, 19 nt, Homo sapiens
ugguaaagccucagcaaca

SEQ ID NO: 863756 - RNA, 13 nt, Homo sapiens
ugguaaccgagcc

SEQ ID NO: 863757 - RNA, 21 nt, Homo sapiens
ugguauaaacguccuacugua

SEQ ID NO: 863758 - RNA, 12 nt, Homo sapiens
ugguaugugaca

SEQ ID NO: 863759 - RNA, 14 nt, Homo sapiens
ugguccgaucuuug

SEQ ID NO: 863760 - RNA, 21 nt, Homo sapiens
uggugagaacuacucagggaa

SEQ ID NO: 863761 - RNA, 21 nt, Homo sapiens
ugguuaaaucaauucugauac

SEQ ID NO: 863762 - RNA, 15 nt, Homo sapiens
uguaaagcaggugcc

SEQ ID NO: 863763 - RNA, 20 nt, Homo sapiens
uguaaauacuguuuuuaaca

SEQ ID NO: 863764 - RNA, 22 nt, Homo sapiens
uguaaauaucccagagaacaau

SEQ ID NO: 863765 - RNA, 16 nt, Homo sapiens
uguaaauuauuguaaa

SEQ ID NO: 863766 - RNA, 15 nt, Homo sapiens
uguaccugugcacgu

SEQ ID NO: 863767 - RNA, 13 nt, Homo sapiens
uguagauugccuu

SEQ ID NO: 863768 - RNA, 14 nt, Homo sapiens
uguagauugccuuu

SEQ ID NO: 863769 - RNA, 18 nt, Homo sapiens
uguauaacccauaucugu

SEQ ID NO: 863770 - RNA, 18 nt, Homo sapiens
uguaucaaaugugacauu

SEQ ID NO: 863771 - RNA, 12 nt, Homo sapiens
uguaugcacuuu

SEQ ID NO: 863772 - RNA, 14 nt, Homo sapiens
uguauuaccuauuc

SEQ ID NO: 863773 - RNA, 14 nt, Homo sapiens
uguccacacaagac

SEQ ID NO: 863774 - RNA, 22 nt, Homo sapiens
ugucuaagaauaaugacguauu

SEQ ID NO: 863775 - RNA, 15 nt, Homo sapiens
ugucugugaugucag

SEQ ID NO: 863776 - RNA, 13 nt, Homo sapiens
ugucuuucacuga

SEQ ID NO: 863777 - RNA, 12 nt, Homo sapiens
ugugauugccau

SEQ ID NO: 863778 - RNA, 18 nt, Homo sapiens
ugugccccaucagcagcu

SEQ ID NO: 863779 - RNA, 13 nt, Homo sapiens
ugugcucagggaa

SEQ ID NO: 863780 - RNA, 17 nt, Homo sapiens
uguguauuuaacugccu

SEQ ID NO: 863781 - RNA, 18 nt, Homo sapiens
ugugucccccucugucca

SEQ ID NO: 863782 - RNA, 19 nt, Homo sapiens
ugugucccccucuguccag

SEQ ID NO: 863783 - RNA, 13 nt, Homo sapiens
ugugugaagauca

SEQ ID NO: 863784 - RNA, 16 nt, Homo sapiens
uguguuucaggacagc

SEQ ID NO: 863785 - RNA, 13 nt, Homo sapiens
uguuaaguugaug

SEQ ID NO: 863786 - RNA, 23 nt, Homo sapiens
uguuaccugaaaacacugugcac

SEQ ID NO: 863787 - RNA, 14 nt, Homo sapiens
uguuaucagucaua

SEQ ID NO: 863788 - RNA, 23 nt, Homo sapiens
uguucccuauuuugccaguggga

SEQ ID NO: 863789 - RNA, 22 nt, Homo sapiens
uguuguagcuaauuaggaagcu

SEQ ID NO: 863790 - RNA, 17 nt, Homo sapiens
uguuucguagccauauu

SEQ ID NO: 863791 - RNA, 18 nt, Homo sapiens
uguuucugaucugaugca

SEQ ID NO: 863792 - RNA, 13 nt, Homo sapiens
uguuuuacaguau

SEQ ID NO: 863793 - RNA, 18 nt, Homo sapiens
uguuuucuacuuugccac

SEQ ID NO: 863794 - RNA, 20 nt, Homo sapiens
uguuuuuguucaaagccagc

SEQ ID NO: 863795 - RNA, 17 nt, Homo sapiens
uuaaaaaaaaacauuca

SEQ ID NO: 863796 - RNA, 18 nt, Homo sapiens
uuaaaaucugucacguag

SEQ ID NO: 863797 - RNA, 15 nt, Homo sapiens
uuaaaauguauuuac

SEQ ID NO: 863798 - RNA, 17 nt, Homo sapiens
uuaaauacagucuucca

SEQ ID NO: 863799 - RNA, 20 nt, Homo sapiens
uuaagaauguucuuauguug

SEQ ID NO: 863800 - RNA, 20 nt, Homo sapiens
uuaaguugauggugaugaaa

SEQ ID NO: 863801 - RNA, 18 nt, Homo sapiens
uuaaugaagaaaguggaa

SEQ ID NO: 863802 - RNA, 14 nt, Homo sapiens
uuacaacuccugca

SEQ ID NO: 863803 - RNA, 17 nt, Homo sapiens
uuacacucuagugccau

SEQ ID NO: 863804 - RNA, 22 nt, Homo sapiens
uuaccugggcauucuuguuuca

SEQ ID NO: 863805 - RNA, 14 nt, Homo sapiens
uuacuuuucacagu

SEQ ID NO: 863806 - RNA, 17 nt, Homo sapiens
uuagagugucuuuccac

SEQ ID NO: 863807 - RNA, 14 nt, Homo sapiens
uuaucagucauaac

SEQ ID NO: 863808 - RNA, 18 nt, Homo sapiens
uuauccagaugaacugag

SEQ ID NO: 863809 - RNA, 18 nt, Homo sapiens
uuauccuuaagaauucca

SEQ ID NO: 863810 - RNA, 18 nt, Homo sapiens
uuauucuagggucuuacu

SEQ ID NO: 863811 - RNA, 23 nt, Homo sapiens
uucaaaauaaacaauaaaugggc

SEQ ID NO: 863812 - RNA, 20 nt, Homo sapiens
uucaaucuuaacaaaaguga

SEQ ID NO: 863813 - RNA, 17 nt, Homo sapiens
uucaaugguugggacaa

SEQ ID NO: 863814 - RNA, 17 nt, Homo sapiens
uucacaacacaaucaaa

SEQ ID NO: 863815 - RNA, 18 nt, Homo sapiens
uuucaucaccagacuuug

SEQ ID NO: 863816 - RNA, 17 nt, Homo sapiens
uuucaucucauuaauuc

SEQ ID NO: 863817 - RNA, 16 nt, Homo sapiens
uuucaugauuugcaac

SEQ ID NO: 863818 - RNA, 14 nt, Homo sapiens
uuucaugugugauu

SEQ ID NO: 863819 - RNA, 15 nt, Homo sapiens
uuuccgaaaucagaa

SEQ ID NO: 863820 - RNA, 22 nt, Homo sapiens
uuucuacuuugaagucauacca

SEQ ID NO: 863821 - RNA, 21 nt, Homo sapiens
uuucuuguaaacauugccuga

SEQ ID NO: 863822 - RNA, 14 nt, Homo sapiens
uuugacaaccauga

SEQ ID NO: 863823 - RNA, 15 nt, Homo sapiens
uuugauuauucagug

SEQ ID NO: 863824 - RNA, 18 nt, Homo sapiens
uuugccagugggaacucc

SEQ ID NO: 863825 - RNA, 16 nt, Homo sapiens
uuugcugcagacucau

SEQ ID NO: 863826 - RNA, 15 nt, Homo sapiens
uuuggguagugccau

SEQ ID NO: 863827 - RNA, 15 nt, Homo sapiens
uuuguaagguacuga

SEQ ID NO: 863828 - RNA, 22 nt, Homo sapiens
uuuguccacacaagacagcaga

SEQ ID NO: 863829 - RNA, 21 nt, Homo sapiens
uuuuaaugauacugucuaaga

SEQ ID NO: 863830 - RNA, 23 nt, Homo sapiens
uuuucaauguuagccacagugua

SEQ ID NO: 863831 - RNA, 10 nt, Homo sapiens
uuuucacugc

SEQ ID NO: 863832 - RNA, 18 nt, Homo sapiens
uuuuccaaacacaggcaa

SEQ ID NO: 863833 - RNA, 19 nt, Homo sapiens
uuuuccuucacaaugguuu

SEQ ID NO: 863834 - RNA, 16 nt, Homo sapiens
uuuucuacuuugccac

SEQ ID NO: 863835 - RNA, 22 nt, Homo sapiens
uuuucuuguaaacauugccuga

SEQ ID NO: 863836 - RNA, 17 nt, Homo sapiens
uuuugaaauuaaccucu

SEQ ID NO: 863837 - RNA, 15 nt, Homo sapiens
uuuuuccuaacagga

SEQ ID NO: 863838 - RNA, 22 nt, Homo sapiens
aaagcauugccagcucuuccaa

SEQ ID NO: 863839 - RNA, 23 nt, Homo sapiens
aaagccauauuccagcagugaaa

SEQ ID NO: 863840 - RNA, 14 nt, Homo sapiens
aaaggacaaaaaua

SEQ ID NO: 863841 - RNA, 19 nt, Homo sapiens
aaagugagaaauuaugaaa

SEQ ID NO: 863842 - RNA, 20 nt, Homo sapiens
aaauaaacaugaagcacaaa

SEQ ID NO: 863843 - RNA, 21 nt, Homo sapiens
aaauaaauccaagacugucau

SEQ ID NO: 863844 - RNA, 21 nt, Homo sapiens
aaauacagucuuccauuugca

SEQ ID NO: 863845 - RNA, 19 nt, Homo sapiens
aaauacuucuugaagccga

SEQ ID NO: 863846 - RNA, 13 nt, Homo sapiens
aaauaugcaugua

SEQ ID NO: 863847 - RNA, 18 nt, Homo sapiens
aaaucuaugaaauaucau

SEQ ID NO: 863848 - RNA, 21 nt, Homo sapiens
aaaucucagaacagucugaaa

SEQ ID NO: 863849 - RNA, 15 nt, Homo sapiens
aaaucuugacuacag

SEQ ID NO: 863850 - RNA, 14 nt, Homo sapiens
aaaugagaacauga

SEQ ID NO: 863851 - RNA, 13 nt, Homo sapiens
aaauggaacauua

SEQ ID NO: 863852 - RNA, 13 nt, Homo sapiens
aaauuaaagcuga

SEQ ID NO: 863853 - RNA, 14 nt, Homo sapiens
aaauugcagaagaa

SEQ ID NO: 863854 - RNA, 14 nt, Homo sapiens
aaauuguauuauca

SEQ ID NO: 863855 - RNA, 16 nt, Homo sapiens
aaauuuuuguuuauaa

SEQ ID NO: 863856 - RNA, 12 nt, Homo sapiens
aacaccaugaag

SEQ ID NO: 863857 - RNA, 21 nt, Homo sapiens
acccaacagagaccagcuucu

SEQ ID NO: 863858 - RNA, 18 nt, Homo sapiens
acccaauaguuguugauu

SEQ ID NO: 863859 - RNA, 17 nt, Homo sapiens
acccacaaaaguacaau

SEQ ID NO: 863860 - RNA, 18 nt, Homo sapiens
accccuccccuaaugccu

SEQ ID NO: 863861 - RNA, 19 nt, Homo sapiens
accccuccccuaaugccug

SEQ ID NO: 863862 - RNA, 17 nt, Homo sapiens
acccucacgaggugucu

SEQ ID NO: 863863 - RNA, 18 nt, Homo sapiens
acccugcaccucauucca

SEQ ID NO: 863864 - RNA, 19 nt, Homo sapiens
acccuuggagccaauggag

SEQ ID NO: 863865 - RNA, 15 nt, Homo sapiens
accgggcgcucgccc

SEQ ID NO: 863866 - RNA, 17 nt, Homo sapiens
accgugggcucccugac

SEQ ID NO: 863867 - RNA, 11 nt, Homo sapiens
accucagggcu

SEQ ID NO: 863868 - RNA, 22 nt, Homo sapiens
accucagggcuguguguacuaa

SEQ ID NO: 863869 - RNA, 18 nt, Homo sapiens
accucagguuccaaauuc

SEQ ID NO: 863870 - RNA, 17 nt, Homo sapiens
accucgcuggacucuca

SEQ ID NO: 863871 - RNA, 22 nt, Homo sapiens
accucuggccaaauaugcacuu

SEQ ID NO: 863872 - RNA, 18 nt, Homo sapiens
accugaaaacacugugca

SEQ ID NO: 863873 - RNA, 20 nt, Homo sapiens
accugaaaacacugugcaca

SEQ ID NO: 863874 - RNA, 15 nt, Homo sapiens
accugggcaaagccu

SEQ ID NO: 863875 - RNA, 21 nt, Homo sapiens
accuucaguaaacaccaugaa

SEQ ID NO: 863876 - RNA, 16 nt, Homo sapiens
accuucaugguguuca

SEQ ID NO: 863877 - RNA, 16 nt, Homo sapiens
accuucuuccacagca

SEQ ID NO: 863878 - RNA, 15 nt, Homo sapiens
acgauuucacugaca

SEQ ID NO: 863879 - RNA, 23 nt, Homo sapiens
acguccugggugcugucaugccc

SEQ ID NO: 863880 - RNA, 14 nt, Homo sapiens
acgugccuccagca

SEQ ID NO: 863881 - RNA, 15 nt, Homo sapiens
acguggggcagcaca

SEQ ID NO: 863882 - RNA, 22 nt, Homo sapiens
acuaaaauuguaucaaauguga

SEQ ID NO: 863883 - RNA, 15 nt, Homo sapiens
acuaagaaauaugca

SEQ ID NO: 863884 - RNA, 23 nt, Homo sapiens
acuacagccaaauugcagaagaa

SEQ ID NO: 863885 - RNA, 12 nt, Homo sapiens
acuauuacuggg

SEQ ID NO: 863886 - RNA, 21 nt, Homo sapiens
acucaaucucugauucuguca

SEQ ID NO: 863887 - RNA, 17 nt, Homo sapiens
acucagucagcccagug

SEQ ID NO: 863888 - RNA, 22 nt, Homo sapiens
acucauccuuuuuaaaugagac

SEQ ID NO: 863889 - RNA, 13 nt, Homo sapiens
acucauucaggga

SEQ ID NO: 863890 - RNA, 17 nt, Homo sapiens
acuccccgggccucggg

SEQ ID NO: 863891 - RNA, 14 nt, Homo sapiens
acuccuaaaucaag

SEQ ID NO: 863892 - RNA, 12 nt, Homo sapiens
acuccuugccau

SEQ ID NO: 863893 - RNA, 20 nt, Homo sapiens
acucgcaauccgagccagcu

SEQ ID NO: 863894 - RNA, 17 nt, Homo sapiens
acucucaggcauggaug

SEQ ID NO: 863895 - RNA, 18 nt, Homo sapiens
acucucuuucuuccacua

SEQ ID NO: 863896 - RNA, 18 nt, Homo sapiens
acucugccugaacacugc

SEQ ID NO: 863897 - RNA, 20 nt, Homo sapiens
acucugccugaacacugcuu

SEQ ID NO: 863898 - RNA, 16 nt, Homo sapiens
acucuggcugccaaga

SEQ ID NO: 863899 - RNA, 15 nt, Homo sapiens
acugacuuucucagc

SEQ ID NO: 863900 - RNA, 19 nt, Homo sapiens
acugcacagugcaucucag

SEQ ID NO: 863901 - RNA, 14 nt, Homo sapiens
acugcuugaggaaa

SEQ ID NO: 863902 - RNA, 16 nt, Homo sapiens
acugucaugcccagcu

SEQ ID NO: 863903 - RNA, 20 nt, Homo sapiens
acuguuagucauuugcugag

SEQ ID NO: 863904 - RNA, 18 nt, Homo sapiens
acuguugacauccaagcu

SEQ ID NO: 863905 - RNA, 22 nt, Homo sapiens
acuuagaaauugcauuuccuga

SEQ ID NO: 863906 - RNA, 23 nt, Homo sapiens
acuuagaaauugcauuuccugac

SEQ ID NO: 863907 - RNA, 17 nt, Homo sapiens
acuuagcaugucccuac

SEQ ID NO: 863908 - RNA, 14 nt, Homo sapiens
acuucagacucucu

SEQ ID NO: 863909 - RNA, 20 nt, Homo sapiens
acuucagcucacacaugaga

SEQ ID NO: 863910 - RNA, 14 nt, Homo sapiens
acuugcaaguccca

SEQ ID NO: 863911 - RNA, 15 nt, Homo sapiens
acuugcaagucccau

SEQ ID NO: 863912 - RNA, 23 nt, Homo sapiens
acuugcugcugagugcaccacuu

SEQ ID NO: 863913 - RNA, 20 nt, Homo sapiens
acuuggauaggagcuuccag

SEQ ID NO: 863914 - RNA, 20 nt, Homo sapiens
acuuggauugggagauuuca

SEQ ID NO: 863915 - RNA, 20 nt, Homo sapiens
acuugggacggaaguggccu

SEQ ID NO: 863916 - RNA, 20 nt, Homo sapiens
acuugugccucuugggagac

SEQ ID NO: 863917 - RNA, 21 nt, Homo sapiens
acuuuugcagcuuccuuccaa

SEQ ID NO: 863918 - RNA, 12 nt, Homo sapiens
agaaaagacaug

SEQ ID NO: 863919 - RNA, 13 nt, Homo sapiens
agaaacaacagaa

SEQ ID NO: 863920 - RNA, 12 nt, Homo sapiens
agaaacugaguc

SEQ ID NO: 863921 - RNA, 14 nt, Homo sapiens
agaaagccauauuc

SEQ ID NO: 863922 - RNA, 14 nt, Homo sapiens
agaaagcucaucuc

SEQ ID NO: 863923 - RNA, 15 nt, Homo sapiens
agaaaguacaaccac

SEQ ID NO: 863924 - RNA, 23 nt, Homo sapiens
agaagaagcuccugaaucccuuu

SEQ ID NO: 863925 - RNA, 16 nt, Homo sapiens
agaauaacacuggcuu

SEQ ID NO: 863926 - RNA, 21 nt, Homo sapiens
agaauggggcuuccauggugg

SEQ ID NO: 863927 - RNA, 16 nt, Homo sapiens
agaauggugggcucca

SEQ ID NO: 863928 - RNA, 18 nt, Homo sapiens
agaauuugagugcucuga

SEQ ID NO: 863929 - RNA, 23 nt, Homo sapiens
agacaaucuaaaaaauaucuuag

SEQ ID NO: 863930 - RNA, 14 nt, Homo sapiens
agacagaagccuca

SEQ ID NO: 863931 - RNA, 18 nt, Homo sapiens
agacccacagagugccau

SEQ ID NO: 863932 - RNA, 14 nt, Homo sapiens
agacccugccaggg

SEQ ID NO: 863933 - RNA, 17 nt, Homo sapiens
agacucccaagcuggac

SEQ ID NO: 863934 - RNA, 18 nt, Homo sapiens
agacuggaacacaaccau

SEQ ID NO: 863935 - RNA, 16 nt, Homo sapiens
agacugggcugaggga

SEQ ID NO: 863936 - RNA, 20 nt, Homo sapiens
agacuuugacucuccagaaa

SEQ ID NO: 863937 - RNA, 14 nt, Homo sapiens
agacuuuucuuucc

SEQ ID NO: 863938 - RNA, 18 nt, Homo sapiens
agagaacaaucacuauuc

SEQ ID NO: 863939 - RNA, 18 nt, Homo sapiens
agagaauccacauaaaag

SEQ ID NO: 863940 - RNA, 20 nt, Homo sapiens
agagccuauggaaagggugu

SEQ ID NO: 863941 - RNA, 13 nt, Homo sapiens
agaggaagccacg

SEQ ID NO: 863942 - RNA, 18 nt, Homo sapiens
agaggacauauucacagu

SEQ ID NO: 863943 - RNA, 15 nt, Homo sapiens
agaggagaaggaggg

SEQ ID NO: 863944 - RNA, 15 nt, Homo sapiens
agaggccaggcaugg

SEQ ID NO: 863945 - RNA, 11 nt, Homo sapiens
agaggcccaag

SEQ ID NO: 863946 - RNA, 12 nt, Homo sapiens
agagugccaucc

SEQ ID NO: 863947 - RNA, 13 nt, Homo sapiens
agagugucuuucc

SEQ ID NO: 863948 - RNA, 17 nt, Homo sapiens
agauaauuauaauauac

SEQ ID NO: 863949 - RNA, 17 nt, Homo sapiens
agauaauucuagcuuug

SEQ ID NO: 863950 - RNA, 23 nt, Homo sapiens
agauaccuucaugguguucauga

SEQ ID NO: 863951 - RNA, 13 nt, Homo sapiens
agaugaacugaga

SEQ ID NO: 863952 - RNA, 16 nt, Homo sapiens
agaugagaagccaaag

SEQ ID NO: 863953 - RNA, 15 nt, Homo sapiens
agaugcaucuguggc

SEQ ID NO: 863954 - RNA, 10 nt, Homo sapiens
agaugcauua

SEQ ID NO: 863955 - RNA, 19 nt, Homo sapiens
agaugcauuaucuaugaua

SEQ ID NO: 863956 - RNA, 20 nt, Homo sapiens
agaugcugacuguacuccuc

SEQ ID NO: 863957 - RNA, 20 nt, Homo sapiens
agcaaaauacaugacauuua

SEQ ID NO: 863958 - RNA, 18 nt, Homo sapiens
agcaaacagggcuuuacu

SEQ ID NO: 863959 - RNA, 13 nt, Homo sapiens
agcaaagggcuca

SEQ ID NO: 863960 - RNA, 12 nt, Homo sapiens
agcaaaugagau

SEQ ID NO: 863961 - RNA, 20 nt, Homo sapiens
agcacagauucaagugcaau

SEQ ID NO: 863962 - RNA, 19 nt, Homo sapiens
agcacugagcaaagcauug

SEQ ID NO: 863963 - RNA, 14 nt, Homo sapiens
agcagaacuuucac

SEQ ID NO: 863964 - RNA, 21 nt, Homo sapiens
agcagaugaccccuccccuaa

SEQ ID NO: 863965 - RNA, 21 nt, Homo sapiens
agcagccaaaccuuuccugua

SEQ ID NO: 863966 - RNA, 21 nt, Homo sapiens
agcaggacgacuguuuuccca

SEQ ID NO: 863967 - RNA, 20 nt, Homo sapiens
agcagguuuauccagaugaa

SEQ ID NO: 863968 - RNA, 20 nt, Homo sapiens
ucuaauaaaaaacaccuucu

SEQ ID NO: 863969 - RNA, 17 nt, Homo sapiens
ucuaugaaauaucaugc

SEQ ID NO: 863970 - RNA, 20 nt, Homo sapiens
ucuauggcacccaugcaccu

SEQ ID NO: 863971 - RNA, 22 nt, Homo sapiens
ucuauugcuggcaaagacagaa

SEQ ID NO: 863972 - RNA, 16 nt, Homo sapiens
ucucaaacuacuggca

SEQ ID NO: 863973 - RNA, 22 nt, Homo sapiens
ucucaaaguuuuuacaguguau

SEQ ID NO: 863974 - RNA, 15 nt, Homo sapiens
ucucacuauaccagu

SEQ ID NO: 863975 - RNA, 14 nt, Homo sapiens
ucucaggaccaaag

SEQ ID NO: 863976 - RNA, 12 nt, Homo sapiens
ucucauaugauu

SEQ ID NO: 863977 - RNA, 22 nt, Homo sapiens
ucucauaugauugugcacauac

SEQ ID NO: 863978 - RNA, 10 nt, Homo sapiens
ucucauuucu

SEQ ID NO: 863979 - RNA, 16 nt, Homo sapiens
ucuccagaaagcucau

SEQ ID NO: 863980 - RNA, 19 nt, Homo sapiens
ucucugagcagugaaugau

SEQ ID NO: 863981 - RNA, 16 nt, Homo sapiens
ucucuuaggacaguaa

SEQ ID NO: 863982 - RNA, 17 nt, Homo sapiens
ucugaagucacugcaca

SEQ ID NO: 863983 - RNA, 13 nt, Homo sapiens
ucugagcugugca

SEQ ID NO: 863984 - RNA, 16 nt, Homo sapiens
ucugaugcaagcaaga

SEQ ID NO: 863985 - RNA, 21 nt, Homo sapiens
ucuggcacuugcaagucccau

SEQ ID NO: 863986 - RNA, 20 nt, Homo sapiens
ucuggccaaauaugcacuuu

SEQ ID NO: 863987 - RNA, 21 nt, Homo sapiens
ucuggcccuguugugggggug

SEQ ID NO: 863988 - RNA, 16 nt, Homo sapiens
ucuggcuggagaggaa

SEQ ID NO: 863989 - RNA, 16 nt, Homo sapiens
ucuggggcuuugccau

SEQ ID NO: 863990 - RNA, 13 nt, Homo sapiens
ucuguaaauaucc

SEQ ID NO: 863991 - RNA, 18 nt, Homo sapiens
ucuguaacccuugaauuu

SEQ ID NO: 863992 - RNA, 16 nt, Homo sapiens
ucugugauugccauuu

SEQ ID NO: 863993 - RNA, 19 nt, Homo sapiens
ucugugggcuccauguaga

SEQ ID NO: 863994 - RNA, 14 nt, Homo sapiens
ucuuaagcacuuug

SEQ ID NO: 863995 - RNA, 14 nt, Homo sapiens
ucuuauuuccucaa

SEQ ID NO: 863996 - RNA, 13 nt, Homo sapiens
ucuucaagcagau

SEQ ID NO: 863997 - RNA, 23 nt, Homo sapiens
ucuuggagaggagguguggagug

SEQ ID NO: 863998 - RNA, 16 nt, Homo sapiens
ucuuguguuaccugaa

SEQ ID NO: 863999 - RNA, 19 nt, Homo sapiens
ucuuuaaaugcguuccuca

SEQ ID NO: 864000 - RNA, 18 nt, Homo sapiens
ucuuugacuauaacaaaa

SEQ ID NO: 864001 - RNA, 21 nt, Homo sapiens
ucuuuucuggaauguaaucaa

SEQ ID NO: 864002 - RNA, 12 nt, Homo sapiens
ugaaaacacugc

SEQ ID NO: 864003 - RNA, 16 nt, Homo sapiens
ugaaaaccucuuucca

SEQ ID NO: 864004 - RNA, 22 nt, Homo sapiens
ugaaccaagaccauugaauucu

SEQ ID NO: 864005 - RNA, 19 nt, Homo sapiens
ugaagaagagaaugugaca

SEQ ID NO: 864006 - RNA, 14 nt, Homo sapiens
ugaaggcaaaucuc

SEQ ID NO: 864007 - RNA, 23 nt, Homo sapiens
ugaaggguucaccaggucaggga

SEQ ID NO: 864008 - RNA, 22 nt, Homo sapiens
ugaauaaauguuauagcugcau

SEQ ID NO: 864009 - RNA, 22 nt, Homo sapiens
ugaaucccuuucaguuugucca

SEQ ID NO: 864010 - RNA, 23 nt, Homo sapiens
ugacaagguguuucucuguaaaa

SEQ ID NO: 864011 - RNA, 19 nt, Homo sapiens
ugacacaggggacacugaa

SEQ ID NO: 864012 - RNA, 20 nt, Homo sapiens
ugacacucccuugggcuccc

SEQ ID NO: 864013 - RNA, 17 nt, Homo sapiens
ugacacuuuucaugugu

SEQ ID NO: 864014 - RNA, 21 nt, Homo sapiens
ugacagucagcaacaugauac

SEQ ID NO: 864015 - RNA, 18 nt, Homo sapiens
ugacauccaagcuuccuu

SEQ ID NO: 864016 - RNA, 14 nt, Homo sapiens
ugacauuauaugca

SEQ ID NO: 864017 - RNA, 22 nt, Homo sapiens
ugaccaggcauccuccacaaua

SEQ ID NO: 864018 - RNA, 17 nt, Homo sapiens
ugacuauggcuaccaaa

SEQ ID NO: 864019 - RNA, 19 nt, Homo sapiens
ugacuauggcuaccaaaaa

SEQ ID NO: 864020 - RNA, 20 nt, Homo sapiens
ugacucuccagaaagcucau

SEQ ID NO: 864021 - RNA, 23 nt, Homo sapiens
ugacucuccagaaagcucaucuc

SEQ ID NO: 864022 - RNA, 17 nt, Homo sapiens
ugagaacuacucaggga

SEQ ID NO: 864023 - RNA, 20 nt, Homo sapiens
ugagagcccaaucacugccu

SEQ ID NO: 864024 - RNA, 19 nt, Homo sapiens
ugagaggagagagacucca

SEQ ID NO: 864025 - RNA, 12 nt, Homo sapiens
ugagcugugcag

SEQ ID NO: 864026 - RNA, 14 nt, Homo sapiens
ugagcuugauucua

SEQ ID NO: 864027 - RNA, 15 nt, Homo sapiens
ugaggaaaauuaaua

SEQ ID NO: 864028 - RNA, 19 nt, Homo sapiens
ugaggaaaauuaauaucac

SEQ ID NO: 864029 - RNA, 15 nt, Homo sapiens
ugaggacaauccccc

SEQ ID NO: 864030 - RNA, 12 nt, Homo sapiens
ugagucaaguca

SEQ ID NO: 864031 - RNA, 20 nt, Homo sapiens
ugaguuggggcgacugugaa

SEQ ID NO: 864032 - RNA, 15 nt, Homo sapiens
ugaguuuagugaucu

SEQ ID NO: 864033 - RNA, 17 nt, Homo sapiens
aggacuguugacaucca

SEQ ID NO: 864034 - RNA, 22 nt, Homo sapiens
aggaggaccuggggggggcaag

SEQ ID NO: 864035 - RNA, 14 nt, Homo sapiens
aggaggguggcacu

SEQ ID NO: 864036 - RNA, 17 nt, Homo sapiens
aggagguuuaggucaag

SEQ ID NO: 864037 - RNA, 14 nt, Homo sapiens
aggcaagcuggcag

SEQ ID NO: 864038 - RNA, 14 nt, Homo sapiens
aggcaccagcagca

SEQ ID NO: 864039 - RNA, 16 nt, Homo sapiens
aggcccaagcugccug

SEQ ID NO: 864040 - RNA, 18 nt, Homo sapiens
aggccuaugccaccugca

SEQ ID NO: 864041 - RNA, 22 nt, Homo sapiens
aggcuccagagggcacucugcu

SEQ ID NO: 864042 - RNA, 12 nt, Homo sapiens
aggcuuacaacu

SEQ ID NO: 864043 - RNA, 18 nt, Homo sapiens
agggaaaauuauuugcau

SEQ ID NO: 864044 - RNA, 15 nt, Homo sapiens
agggaauaauccaga

SEQ ID NO: 864045 - RNA, 21 nt, Homo sapiens
agggacucuuguuaacaguaa

SEQ ID NO: 864046 - RNA, 12 nt, Homo sapiens
agggagggagca

SEQ ID NO: 864047 - RNA, 16 nt, Homo sapiens
agggcagaggugauca

SEQ ID NO: 864048 - RNA, 14 nt, Homo sapiens
agggccacauggga

SEQ ID NO: 864049 - RNA, 15 nt, Homo sapiens
aggggucagcagggg

SEQ ID NO: 864050 - RNA, 22 nt, Homo sapiens
aggguuacccugggcacuggcc

SEQ ID NO: 864051 - RNA, 19 nt, Homo sapiens
aggguugccaguccugcaa

SEQ ID NO: 864052 - RNA, 15 nt, Homo sapiens
agguaaggugaggga

SEQ ID NO: 864053 - RNA, 21 nt, Homo sapiens
agguaugguuaauaaguuuca

SEQ ID NO: 864054 - RNA, 17 nt, Homo sapiens
aggucuccaccccucaa

SEQ ID NO: 864055 - RNA, 15 nt, Homo sapiens
aggugcuacugacuu

SEQ ID NO: 864056 - RNA, 15 nt, Homo sapiens
agguggccacuccag

SEQ ID NO: 864057 - RNA, 18 nt, Homo sapiens
agguugucugaagucacu

SEQ ID NO: 864058 - RNA, 21 nt, Homo sapiens
agguugucugaagucacugca

SEQ ID NO: 864059 - RNA, 13 nt, Homo sapiens
agguuugcaaaga

SEQ ID NO: 864060 - RNA, 12 nt, Homo sapiens
aguaaagccacg

SEQ ID NO: 864061 - RNA, 11 nt, Homo sapiens
aguaacaugug

SEQ ID NO: 864062 - RNA, 22 nt, Homo sapiens
aguaaguuugauuucauuaaua

SEQ ID NO: 864063 - RNA, 15 nt, Homo sapiens
aguacuuugucuuga

SEQ ID NO: 864064 - RNA, 22 nt, Homo sapiens
aguacuuugucuugauccucac

SEQ ID NO: 864065 - RNA, 21 nt, Homo sapiens
aguagacuucauuuuuccuaa

SEQ ID NO: 864066 - RNA, 20 nt, Homo sapiens
aguauugccaccucuggcca

SEQ ID NO: 864067 - RNA, 16 nt, Homo sapiens
aguauuugcauauucu

SEQ ID NO: 864068 - RNA, 20 nt, Homo sapiens
agucaaauuuggauuuucca

SEQ ID NO: 864069 - RNA, 20 nt, Homo sapiens
agucacagagauaauucuag

SEQ ID NO: 864070 - RNA, 23 nt, Homo sapiens
agucacugcacagugcaucucag

SEQ ID NO: 864071 - RNA, 21 nt, Homo sapiens
agucauuugcugagcauguac

SEQ ID NO: 864072 - RNA, 21 nt, Homo sapiens
aguccugcaaguccauagcug

SEQ ID NO: 864073 - RNA, 12 nt, Homo sapiens
agucuucuuuca

SEQ ID NO: 864074 - RNA, 13 nt, Homo sapiens
agucuucuuucau

SEQ ID NO: 864075 - RNA, 16 nt, Homo sapiens
agugagaaauuaugaa

SEQ ID NO: 864076 - RNA, 15 nt, Homo sapiens
agugagggucagaga

SEQ ID NO: 864077 - RNA, 21 nt, Homo sapiens
agugauaucccccagccucaa

SEQ ID NO: 864078 - RNA, 12 nt, Homo sapiens
agugauggagcu

SEQ ID NO: 864079 - RNA, 12 nt, Homo sapiens
agugauguaauc

SEQ ID NO: 864080 - RNA, 18 nt, Homo sapiens
agugauuugggggugcaa

SEQ ID NO: 864081 - RNA, 12 nt, Homo sapiens
aguggaaaaaga

SEQ ID NO: 864082 - RNA, 15 nt, Homo sapiens
aguguagguaucauu

SEQ ID NO: 864083 - RNA, 20 nt, Homo sapiens
aguguauaccaccuguacau

SEQ ID NO: 864084 - RNA, 22 nt, Homo sapiens
agugugcaaagaaaagaacugc

SEQ ID NO: 864085 - RNA, 23 nt, Homo sapiens
aguguuuggguauauucauuuca

SEQ ID NO: 864086 - RNA, 14 nt, Homo sapiens
aguuacucucaggc

SEQ ID NO: 864087 - RNA, 23 nt, Homo sapiens
aguuccucauuuuugaauacagg

SEQ ID NO: 864088 - RNA, 17 nt, Homo sapiens
aguugauggugaugaaa

SEQ ID NO: 864089 - RNA, 17 nt, Homo sapiens
aguugcugaugaacucu

SEQ ID NO: 864090 - RNA, 22 nt, Homo sapiens
aguuguauaguuuuacacucua

SEQ ID NO: 864091 - RNA, 22 nt, Homo sapiens
aguuucuugagaucugcugaca

SEQ ID NO: 864092 - RNA, 20 nt, Homo sapiens
aguuuuacacucuagugcca

SEQ ID NO: 864093 - RNA, 16 nt, Homo sapiens
auaaaauucauuaguu

SEQ ID NO: 864094 - RNA, 20 nt, Homo sapiens
auaaauguuauagcugcauu

SEQ ID NO: 864095 - RNA, 22 nt, Homo sapiens
auaacaaggaaaacaguaacua

SEQ ID NO: 864096 - RNA, 11 nt, Homo sapiens
auaacacuggc

SEQ ID NO: 864097 - RNA, 16 nt, Homo sapiens
auaacuguaacauaua

SEQ ID NO: 864098 - RNA, 13 nt, Homo sapiens
auaacuuguguua

SEQ ID NO: 864099 - RNA, 17 nt, Homo sapiens
auaagaggugcuacuga

SEQ ID NO: 864100 - RNA, 14 nt, Homo sapiens
auaaguaacuuguc

SEQ ID NO: 864101 - RNA, 16 nt, Homo sapiens
auaauguuacauuauu

SEQ ID NO: 864102 - RNA, 13 nt, Homo sapiens
auaauuacuuucc

SEQ ID NO: 864103 - RNA, 22 nt, Homo sapiens
auacuguaugccggcuccuuca

SEQ ID NO: 864104 - RNA, 13 nt, Homo sapiens
auagagccugagg

SEQ ID NO: 864105 - RNA, 18 nt, Homo sapiens
auagaggaggauggucau

SEQ ID NO: 864106 - RNA, 22 nt, Homo sapiens
auagagggucuaagauucaucc

SEQ ID NO: 864107 - RNA, 18 nt, Homo sapiens
auagcccgaagucucaug

SEQ ID NO: 864108 - RNA, 12 nt, Homo sapiens
auaggaggacag

SEQ ID NO: 864109 - RNA, 17 nt, Homo sapiens
auaggauauacuguaug

SEQ ID NO: 864110 - RNA, 22 nt, Homo sapiens
auagguaauuaaggcagcugaa

SEQ ID NO: 864111 - RNA, 14 nt, Homo sapiens
auaguaauaucaau

SEQ ID NO: 864112 - RNA, 23 nt, Homo sapiens
auaguacagguaaggugagggaa

SEQ ID NO: 864113 - RNA, 14 nt, Homo sapiens
auauaaauaucaca

SEQ ID NO: 864114 - RNA, 21 nt, Homo sapiens
auauaaaugugauugcagcuu

SEQ ID NO: 864115 - RNA, 13 nt, Homo sapiens
auauaacugccuu

SEQ ID NO: 864116 - RNA, 21 nt, Homo sapiens
auauauguaaauuauaaguaa

SEQ ID NO: 864117 - RNA, 15 nt, Homo sapiens
auaucacagcauaac

SEQ ID NO: 864118 - RNA, 17 nt, Homo sapiens
auaugaaugucaguagu

SEQ ID NO: 864119 - RNA, 16 nt, Homo sapiens
auaugauuaguaaaga

SEQ ID NO: 864120 - RNA, 15 nt, Homo sapiens
auaugauugugcaca

SEQ ID NO: 864121 - RNA, 21 nt, Homo sapiens
auaugcacaauagcaguugaa

SEQ ID NO: 864122 - RNA, 23 nt, Homo sapiens
auauguugaugaaaaauagcaac

SEQ ID NO: 864123 - RNA, 18 nt, Homo sapiens
auauucauuucaaaggga

SEQ ID NO: 864124 - RNA, 14 nt, Homo sapiens
auauuccagcagug

SEQ ID NO: 864125 - RNA, 23 nt, Homo sapiens
auauucuuguccacauucuacuu

SEQ ID NO: 864126 - RNA, 22 nt, Homo sapiens
auauuuaaaaaaaaacauucaa

SEQ ID NO: 864127 - RNA, 19 nt, Homo sapiens
auauuuuaaaaucugucac

SEQ ID NO: 864128 - RNA, 15 nt, Homo sapiens
auauuuucaccauuu

SEQ ID NO: 864129 - RNA, 16 nt, Homo sapiens
aucaacgaguacuuca

SEQ ID NO: 864130 - RNA, 21 nt, Homo sapiens
aucaauacccuuggcacugau

SEQ ID NO: 864131 - RNA, 19 nt, Homo sapiens
aucaauuauagaaagccaa

SEQ ID NO: 864132 - RNA, 19 nt, Homo sapiens
aucacauucgaguguuuca

SEQ ID NO: 864133 - RNA, 18 nt, Homo sapiens
aucaccaaaaaaucuaua

SEQ ID NO: 864134 - RNA, 20 nt, Homo sapiens
aucaccgugggcucccugac

SEQ ID NO: 864135 - RNA, 16 nt, Homo sapiens
aucagaccauaauguu

SEQ ID NO: 864136 - RNA, 14 nt, Homo sapiens
aucagaguggccaa

SEQ ID NO: 864137 - RNA, 17 nt, Homo sapiens
aucagggaggucauuuu

SEQ ID NO: 864138 - RNA, 19 nt, Homo sapiens
aucagugaauaaaccauca

SEQ ID NO: 864139 - RNA, 15 nt, Homo sapiens
aucagugaugggagu

SEQ ID NO: 864140 - RNA, 13 nt, Homo sapiens
aucaucauucuca

SEQ ID NO: 864141 - RNA, 21 nt, Homo sapiens
aaauucauuaguuguuaguga

SEQ ID NO: 864142 - RNA, 20 nt, Homo sapiens
aaauuguaucaaaugugaca

SEQ ID NO: 864143 - RNA, 22 nt, Homo sapiens
aaauuguaucaaaugugacauu

SEQ ID NO: 864144 - RNA, 22 nt, Homo sapiens
aaauuguauuaucaacagcauu

SEQ ID NO: 864145 - RNA, 17 nt, Homo sapiens
aaauuguuuuucugaaa

SEQ ID NO: 864146 - RNA, 19 nt, Homo sapiens
aacaaaugauuuacacuga

SEQ ID NO: 864147 - RNA, 16 nt, Homo sapiens
aacaaauguauuucaa

SEQ ID NO: 864148 - RNA, 16 nt, Homo sapiens
aacacaaccauagccu

SEQ ID NO: 864149 - RNA, 14 nt, Homo sapiens
aacacuuuggccac

SEQ ID NO: 864150 - RNA, 16 nt, Homo sapiens
aacaugugcucaggga

SEQ ID NO: 864151 - RNA, 13 nt, Homo sapiens
aacauuucugcca

SEQ ID NO: 864152 - RNA, 19 nt, Homo sapiens
aaccaaacggaacucuuca

SEQ ID NO: 864153 - RNA, 16 nt, Homo sapiens
aaccaacgggucugug

SEQ ID NO: 864154 - RNA, 18 nt, Homo sapiens
aaccagaauuaggucaag

SEQ ID NO: 864155 - RNA, 19 nt, Homo sapiens
aaccagcucuuuggugcca

SEQ ID NO: 864156 - RNA, 19 nt, Homo sapiens
aacccuauugguaaagaau

SEQ ID NO: 864157 - RNA, 13 nt, Homo sapiens
aaccucuuuccaa

SEQ ID NO: 864158 - RNA, 14 nt, Homo sapiens
aacggaacucuuca

SEQ ID NO: 864159 - RNA, 21 nt, Homo sapiens
aacgggucugugggacuggcc

SEQ ID NO: 864160 - RNA, 23 nt, Homo sapiens
aacguuaucucauugcaaaaaua

SEQ ID NO: 864161 - RNA, 20 nt, Homo sapiens
aacuccaucugcugccauga

SEQ ID NO: 864162 - RNA, 19 nt, Homo sapiens
aacuguaacauauaugaaa

SEQ ID NO: 864163 - RNA, 15 nt, Homo sapiens
aacugucucuuucag

SEQ ID NO: 864164 - RNA, 23 nt, Homo sapiens
aacuuugacaaccaugagaccac

SEQ ID NO: 864165 - RNA, 21 nt, Homo sapiens
aacuuuuguaagguacugaau

SEQ ID NO: 864166 - RNA, 19 nt, Homo sapiens
aacuuuuugcaaggcauuu

SEQ ID NO: 864167 - RNA, 14 nt, Homo sapiens
aagaacaccugaca

SEQ ID NO: 864168 - RNA, 18 nt, Homo sapiens
aagaacugcuugcauuuc

SEQ ID NO: 864169 - RNA, 15 nt, Homo sapiens
aagaagccacagacc

SEQ ID NO: 864170 - RNA, 23 nt, Homo sapiens
aagacacgcccgacucucuccau

SEQ ID NO: 864171 - RNA, 18 nt, Homo sapiens
aagacugaccuugauguc

SEQ ID NO: 864172 - RNA, 14 nt, Homo sapiens
aagaguggaaccaa

SEQ ID NO: 864173 - RNA, 20 nt, Homo sapiens
aagaugcauuaucuaugaua

SEQ ID NO: 864174 - RNA, 20 nt, Homo sapiens
guaggagcugagcuuuccag

SEQ ID NO: 864175 - RNA, 15 nt, Homo sapiens
guagggugaggcgug

SEQ ID NO: 864176 - RNA, 19 nt, Homo sapiens
guauaccaccuguacauac

SEQ ID NO: 864177 - RNA, 13 nt, Homo sapiens
guauacuaaugcc

SEQ ID NO: 864178 - RNA, 15 nt, Homo sapiens
guaucaaaugugaca

SEQ ID NO: 864179 - RNA, 15 nt, Homo sapiens
guaucaggacccaga

SEQ ID NO: 864180 - RNA, 15 nt, Homo sapiens
guauccucgcuggug

SEQ ID NO: 864181 - RNA, 21 nt, Homo sapiens
guaucucgaagucuuccauca

SEQ ID NO: 864182 - RNA, 23 nt, Homo sapiens
guauguuugggagacugcugagu

SEQ ID NO: 864183 - RNA, 23 nt, Homo sapiens
gucaaaaaccagaauuaggucaa

SEQ ID NO: 864184 - RNA, 22 nt, Homo sapiens
gucaacccaauaguuguugauu

SEQ ID NO: 864185 - RNA, 17 nt, Homo sapiens
gucaauaggcaaagggg

SEQ ID NO: 864186 - RNA, 20 nt, Homo sapiens
guccaaucacauucaggcau

SEQ ID NO: 864187 - RNA, 24 nt, Homo sapiens
guccacgagcuguuuacuagggau

SEQ ID NO: 864188 - RNA, 16 nt, Homo sapiens
guccaggcacugagau

SEQ ID NO: 864189 - RNA, 21 nt, Homo sapiens
guccaugauguccuuguuauu

SEQ ID NO: 864190 - RNA, 17 nt, Homo sapiens
guccauuguccaauccu

SEQ ID NO: 864191 - RNA, 14 nt, Homo sapiens
gucccaccagggac

SEQ ID NO: 864192 - RNA, 15 nt, Homo sapiens
gucccgggcacuguc

SEQ ID NO: 864193 - RNA, 19 nt, Homo sapiens
guccugggugcugucaugc

SEQ ID NO: 864194 - RNA, 21 nt, Homo sapiens
guccugggugcugucaugccc

SEQ ID NO: 864195 - RNA, 14 nt, Homo sapiens
guccuguucuuguu

SEQ ID NO: 864196 - RNA, 20 nt, Homo sapiens
guccuuagccccaucugcca

SEQ ID NO: 864197 - RNA, 23 nt, Homo sapiens
guccuuuccuucucgucuuccuc

SEQ ID NO: 864198 - RNA, 16 nt, Homo sapiens
gucgaacaauucauau

SEQ ID NO: 864199 - RNA, 17 nt, Homo sapiens
gucuacguuaccaggca

SEQ ID NO: 864200 - RNA, 20 nt, Homo sapiens
gucucauaugauugugcaca

SEQ ID NO: 864201 - RNA, 15 nt, Homo sapiens
gucugugauugccau

SEQ ID NO: 864202 - RNA, 18 nt, Homo sapiens
gucuuacucuuuguauga

SEQ ID NO: 864203 - RNA, 20 nt, Homo sapiens
gucuugauccucacugagaa

SEQ ID NO: 864204 - RNA, 21 nt, Homo sapiens
gugaagaucacguuccuuccc

SEQ ID NO: 864205 - RNA, 16 nt, Homo sapiens
gugacauuuccaugca

SEQ ID NO: 864206 - RNA, 16 nt, Homo sapiens
gugagcaaagggcuca

SEQ ID NO: 864207 - RNA, 11 nt, Homo sapiens
gugaugccuga

SEQ ID NO: 864208 - RNA, 16 nt, Homo sapiens
gugcacaucugugucu

SEQ ID NO: 864209 - RNA, 14 nt, Homo sapiens
gugcagaaacuacc

SEQ ID NO: 864210 - RNA, 17 nt, Homo sapiens
gugcaugcagcaucuaa

SEQ ID NO: 864211 - RNA, 23 nt, Homo sapiens
gugccaucccugagagaccagac

SEQ ID NO: 864212 - RNA, 19 nt, Homo sapiens
gugcccugcaucccucucc

SEQ ID NO: 864213 - RNA, 12 nt, Homo sapiens
gugccugugauc

SEQ ID NO: 864214 - RNA, 23 nt, Homo sapiens
gugcuaaaaaauuaaaccaagca

SEQ ID NO: 864215 - RNA, 12 nt, Homo sapiens
gugcugucaugc

SEQ ID NO: 864216 - RNA, 22 nt, Homo sapiens
gugcugucaugcccagcuugga

SEQ ID NO: 864217 - RNA, 23 nt, Homo sapiens
guggcagcaacaaaggauuugaa

SEQ ID NO: 864218 - RNA, 17 nt, Homo sapiens
guggccggcaucuggcc

SEQ ID NO: 864219 - RNA, 20 nt, Homo sapiens
gugggcucccugacugggag

SEQ ID NO: 864220 - RNA, 15 nt, Homo sapiens
gugucaccugugcuu

SEQ ID NO: 864221 - RNA, 16 nt, Homo sapiens
gugugggggucuggga

SEQ ID NO: 864222 - RNA, 13 nt, Homo sapiens
guuaacaucugaa

SEQ ID NO: 864223 - RNA, 18 nt, Homo sapiens
guuaauaaguuucacuga

SEQ ID NO: 864224 - RNA, 10 nt, Homo sapiens
guuaccuaau

SEQ ID NO: 864225 - RNA, 21 nt, Homo sapiens
guuacuaagaugaaauugcca

SEQ ID NO: 864226 - RNA, 12 nt, Homo sapiens
guuagugcauuu

SEQ ID NO: 864227 - RNA, 17 nt, Homo sapiens
guuauagcugcauuugu

SEQ ID NO: 864228 - RNA, 16 nt, Homo sapiens
guucccuauuuugcca

SEQ ID NO: 864229 - RNA, 20 nt, Homo sapiens
guugcuaaugccaggccagu

SEQ ID NO: 864230 - RNA, 12 nt, Homo sapiens
guuggcuucuaa

SEQ ID NO: 864231 - RNA, 20 nt, Homo sapiens
guuuaaaauaaaaguaccua

SEQ ID NO: 864232 - RNA, 12 nt, Homo sapiens
guuuagagcagu

SEQ ID NO: 864233 - RNA, 14 nt, Homo sapiens
guuuagugaucuga

SEQ ID NO: 864234 - RNA, 19 nt, Homo sapiens
guuuuacacucuagugcca

SEQ ID NO: 864235 - RNA, 23 nt, Homo sapiens
guuuuuuuuuuccacuuagaaau

SEQ ID NO: 864236 - RNA, 21 nt, Homo sapiens
uaaaaaacaaagccuuaucca

SEQ ID NO: 864237 - RNA, 15 nt, Homo sapiens
uaaaaauugugauca

SEQ ID NO: 864238 - RNA, 23 nt, Homo sapiens
uaaaaauugugaucagaccauaa

SEQ ID NO: 864239 - RNA, 12 nt, Homo sapiens
uaaaaccaaaga

SEQ ID NO: 864240 - RNA, 18 nt, Homo sapiens
uaaaaccaucauaguaca

SEQ ID NO: 864241 - RNA, 20 nt, Homo sapiens
uaaaacccacaaaaguacaa

SEQ ID NO: 864242 - RNA, 22 nt, Homo sapiens
uaaaauaaaaguaccuauugaa

SEQ ID NO: 864243 - RNA, 16 nt, Homo sapiens
uaaaauaaacaugaag

SEQ ID NO: 864244 - RNA, 18 nt, Homo sapiens
uaaaauuagaugaacuca

SEQ ID NO: 864245 - RNA, 16 nt, Homo sapiens
uaaacaugaagcacaa

SEQ ID NO: 864246 - RNA, 21 nt, Homo sapiens
ccacgucccgggcacugucau

SEQ ID NO: 864247 - RNA, 21 nt, Homo sapiens
ccacguccugggugcugucau

SEQ ID NO: 864248 - RNA, 23 nt, Homo sapiens
ccacguccugggugcugucaugc

SEQ ID NO: 864249 - RNA, 11 nt, Homo sapiens
ccacuguaaau

SEQ ID NO: 864250 - RNA, 17 nt, Homo sapiens
ccacuugccccuguuac

SEQ ID NO: 864251 - RNA, 20 nt, Homo sapiens
ccagagccuauggaaagggu

SEQ ID NO: 864252 - RNA, 18 nt, Homo sapiens
ccagauaaaaacaauaua

SEQ ID NO: 864253 - RNA, 12 nt, Homo sapiens
ccagccauuccu

SEQ ID NO: 864254 - RNA, 20 nt, Homo sapiens
ccagcuguacugaguucuca

SEQ ID NO: 864255 - RNA, 20 nt, Homo sapiens
ccaggacucucuuucuucca

SEQ ID NO: 864256 - RNA, 17 nt, Homo sapiens
ccagggcucuguauucu

SEQ ID NO: 864257 - RNA, 16 nt, Homo sapiens
ccaguaauugguccga

SEQ ID NO: 864258 - RNA, 20 nt, Homo sapiens
ccaguguguuucugaucuga

SEQ ID NO: 864259 - RNA, 14 nt, Homo sapiens
ccauaauguuacau

SEQ ID NO: 864260 - RNA, 17 nt, Homo sapiens
ccaucugcugccaugag

SEQ ID NO: 864261 - RNA, 17 nt, Homo sapiens
ccaugaaaaacagcaga

SEQ ID NO: 864262 - RNA, 16 nt, Homo sapiens
ccaugugacuguauua

SEQ ID NO: 864263 - RNA, 22 nt, Homo sapiens
ccauuacucaaaaugcaggaca

SEQ ID NO: 864264 - RNA, 16 nt, Homo sapiens
cccaagguggucuugg

SEQ ID NO: 864265 - RNA, 16 nt, Homo sapiens
cccacaaaaguacaau

SEQ ID NO: 864266 - RNA, 16 nt, Homo sapiens
cccagcggcucuuccu

SEQ ID NO: 864267 - RNA, 17 nt, Homo sapiens
cccagcuuggagugcca

SEQ ID NO: 864268 - RNA, 12 nt, Homo sapiens
cccccugugcag

SEQ ID NO: 864269 - RNA, 21 nt, Homo sapiens
ccccuccuccagagccugggc

SEQ ID NO: 864270 - RNA, 14 nt, Homo sapiens
ccccuggcuuuuca

SEQ ID NO: 864271 - RNA, 16 nt, Homo sapiens
cccuauggaagucuca

SEQ ID NO: 864272 - RNA, 19 nt, Homo sapiens
cccuauugguaaagaaugg

SEQ ID NO: 864273 - RNA, 20 nt, Homo sapiens
cccucugcuaugucugugau

SEQ ID NO: 864274 - RNA, 17 nt, Homo sapiens
cccuuaaaacuuccacu

SEQ ID NO: 864275 - RNA, 16 nt, Homo sapiens
cccuuggagccaaugg

SEQ ID NO: 864276 - RNA, 19 nt, Homo sapiens
cccuuucaugauuugcaac

SEQ ID NO: 864277 - RNA, 20 nt, Homo sapiens
ccgagucucuucuccacugg

SEQ ID NO: 864278 - RNA, 15 nt, Homo sapiens
ccgcugaccuugcac

SEQ ID NO: 864279 - RNA, 13 nt, Homo sapiens
ccggcaucuggcc

SEQ ID NO: 864280 - RNA, 11 nt, Homo sapiens
ccgugccuuca

SEQ ID NO: 864281 - RNA, 20 nt, Homo sapiens
ccgugggguguauugacugg

SEQ ID NO: 864282 - RNA, 18 nt, Homo sapiens
ccguucgcugagucccag

SEQ ID NO: 864283 - RNA, 19 nt, Homo sapiens
ccuaacaggauuagacagu

SEQ ID NO: 864284 - RNA, 11 nt, Homo sapiens
ccuaguacaag

SEQ ID NO: 864285 - RNA, 22 nt, Homo sapiens
ccuaguaggagcugagcuuucc

SEQ ID NO: 864286 - RNA, 19 nt, Homo sapiens
ccuaguuuguuagugcauu

SEQ ID NO: 864287 - RNA, 14 nt, Homo sapiens
ccuauguaugccau

SEQ ID NO: 864288 - RNA, 15 nt, Homo sapiens
ccucagcaacagcca

SEQ ID NO: 864289 - RNA, 21 nt, Homo sapiens
ccucaggcccaauucugccac

SEQ ID NO: 864290 - RNA, 14 nt, Homo sapiens
ccucauucuucucu

SEQ ID NO: 864291 - RNA, 17 nt, Homo sapiens
ccuccuaaaguagacuu

SEQ ID NO: 864292 - RNA, 13 nt, Homo sapiens
ccucucacacugg

SEQ ID NO: 864293 - RNA, 12 nt, Homo sapiens
ccucucugcucu

SEQ ID NO: 864294 - RNA, 17 nt, Homo sapiens
ccucucuguuuacccuc

SEQ ID NO: 864295 - RNA, 18 nt, Homo sapiens
ccucugggccaagucaaa

SEQ ID NO: 864296 - RNA, 20 nt, Homo sapiens
ccucuuuuucuagucuucau

SEQ ID NO: 864297 - RNA, 20 nt, Homo sapiens
ccugacacaggggacacuga

SEQ ID NO: 864298 - RNA, 21 nt, Homo sapiens
ccugacccugugaugccugac

SEQ ID NO: 864299 - RNA, 17 nt, Homo sapiens
ccugacuacagaaauua

SEQ ID NO: 864300 - RNA, 15 nt, Homo sapiens
ccugagaagagucga

SEQ ID NO: 864301 - RNA, 21 nt, Homo sapiens
ccugaucagagccgugguccu

SEQ ID NO: 864302 - RNA, 21 nt, Homo sapiens
ccugauuuguuccuucugggg

SEQ ID NO: 864303 - RNA, 16 nt, Homo sapiens
ccugcccagugcacac

SEQ ID NO: 864304 - RNA, 20 nt, Homo sapiens
ccugcccccacucagcauuu

SEQ ID NO: 864305 - RNA, 18 nt, Homo sapiens
ccugccucaugcucucua

SEQ ID NO: 864306 - RNA, 14 nt, Homo sapiens
ccugggcaaagccu

SEQ ID NO: 864307 - RNA, 19 nt, Homo sapiens
ccuggggagucugggcaca

SEQ ID NO: 864308 - RNA, 16 nt, Homo sapiens
ccugggggugccagga

SEQ ID NO: 864309 - RNA, 15 nt, Homo sapiens
ccugggugcugucau

SEQ ID NO: 864310 - RNA, 16 nt, Homo sapiens
ccuguaccugugcacg

SEQ ID NO: 864311 - RNA, 16 nt, Homo sapiens
ccugucuaaaaauuca

SEQ ID NO: 864312 - RNA, 23 nt, Homo sapiens
ccugugcuuuuggagcugagauc

SEQ ID NO: 864313 - RNA, 23 nt, Homo sapiens
ccuguucuuguuacggcagucac

SEQ ID NO: 864314 - RNA, 20 nt, Homo sapiens
ccuuauuagagugucuuucc

SEQ ID NO: 864315 - RNA, 17 nt, Homo sapiens
ccuucaugaucaucaca

SEQ ID NO: 864316 - RNA, 20 nt, Homo sapiens
ccuucucucaccuccuaaag

SEQ ID NO: 864317 - RNA, 15 nt, Homo sapiens
ccuugaaaagacauc

SEQ ID NO: 864318 - RNA, 13 nt, Homo sapiens
ccuugaaggguuc

SEQ ID NO: 864319 - RNA, 14 nt, Homo sapiens
ccuugaugcucaua

SEQ ID NO: 864320 - RNA, 21 nt, Homo sapiens
ccuugcacuauuggacuuugg

SEQ ID NO: 864321 - RNA, 21 nt, Homo sapiens
ccuuguguacaguuauuuaug

SEQ ID NO: 864322 - RNA, 12 nt, Homo sapiens
ccuugugucugu

SEQ ID NO: 864323 - RNA, 21 nt, Homo sapiens
ccuuguuauuuuauugccuuu

SEQ ID NO: 864324 - RNA, 13 nt, Homo sapiens
ccuuuaaaaaaca

SEQ ID NO: 864325 - RNA, 20 nt, Homo sapiens
ccuuucugacaauaaauaau

SEQ ID NO: 864326 - RNA, 18 nt, Homo sapiens
ccuuucuucagacacuga

SEQ ID NO: 864327 - RNA, 17 nt, Homo sapiens
ccuuuggcaauucuucu

SEQ ID NO: 864328 - RNA, 21 nt, Homo sapiens
ccuuuggcaauucuucuucuc

SEQ ID NO: 864329 - RNA, 16 nt, Homo sapiens
cuguccucauucuucu

SEQ ID NO: 864330 - RNA, 21 nt, Homo sapiens
cuguccuggaucugcucuaga

SEQ ID NO: 864331 - RNA, 13 nt, Homo sapiens
cugucuccauggc

SEQ ID NO: 864332 - RNA, 23 nt, Homo sapiens
cugugaugucaguagugccugug

SEQ ID NO: 864333 - RNA, 18 nt, Homo sapiens
cugugcaauggaauauaa

SEQ ID NO: 864334 - RNA, 23 nt, Homo sapiens
cuguggugugucccccucugucc

SEQ ID NO: 864335 - RNA, 17 nt, Homo sapiens
cuguguguacuaauaca

SEQ ID NO: 864336 - RNA, 17 nt, Homo sapiens
cuguuggcaaggugaca

SEQ ID NO: 864337 - RNA, 15 nt, Homo sapiens
cuguuuucaccaucu

SEQ ID NO: 864338 - RNA, 15 nt, Homo sapiens
cuuaagagaauccac

SEQ ID NO: 864339 - RNA, 23 nt, Homo sapiens
cuuaagagaauccacauaaaaga

SEQ ID NO: 864340 - RNA, 16 nt, Homo sapiens
cuuacaaugugcacug

SEQ ID NO: 864341 - RNA, 14 nt, Homo sapiens
cuuagccccaugag

SEQ ID NO: 864342 - RNA, 22 nt, Homo sapiens
cuuagguuggagaugacagaaa

SEQ ID NO: 864343 - RNA, 18 nt, Homo sapiens
cuuauauucauccaugcc

SEQ ID NO: 864344 - RNA, 18 nt, Homo sapiens
cuuauguaugccuauuca

SEQ ID NO: 864345 - RNA, 15 nt, Homo sapiens
cuucacaugcaucaa

SEQ ID NO: 864346 - RNA, 15 nt, Homo sapiens
cuucacggacaggaa

SEQ ID NO: 864347 - RNA, 23 nt, Homo sapiens
cuucagcagcuagagcucaguau

SEQ ID NO: 864348 - RNA, 21 nt, Homo sapiens
cuucaugaucaucacaaucau

SEQ ID NO: 864349 - RNA, 11 nt, Homo sapiens
cuuccauuugc

SEQ ID NO: 864350 - RNA, 14 nt, Homo sapiens
cuucuaaucaaagc

SEQ ID NO: 864351 - RNA, 12 nt, Homo sapiens
cuucucauuucu

SEQ ID NO: 864352 - RNA, 14 nt, Homo sapiens
cuucuccacuggau

SEQ ID NO: 864353 - RNA, 18 nt, Homo sapiens
cuucuccauccacauggg

SEQ ID NO: 864354 - RNA, 14 nt, Homo sapiens
cuucuucucaagca

SEQ ID NO: 864355 - RNA, 15 nt, Homo sapiens
cuugaaaagacauca

SEQ ID NO: 864356 - RNA, 21 nt, Homo sapiens
cuugaaaagacaucaagcaca

SEQ ID NO: 864357 - RNA, 14 nt, Homo sapiens
cuugaacacagucu

SEQ ID NO: 864358 - RNA, 14 nt, Homo sapiens
cuugaauuucuaga

SEQ ID NO: 864359 - RNA, 16 nt, Homo sapiens
cuugagcaaggcaaga

SEQ ID NO: 864360 - RNA, 15 nt, Homo sapiens
cuugagccaguaauu

SEQ ID NO: 864361 - RNA, 16 nt, Homo sapiens
cuugauucuaaagggg

SEQ ID NO: 864362 - RNA, 14 nt, Homo sapiens
cuugcaagucccau

SEQ ID NO: 864363 - RNA, 12 nt, Homo sapiens
cuugcacuauug

SEQ ID NO: 864364 - RNA, 18 nt, Homo sapiens
cuugcugccaaaagccuu

SEQ ID NO: 864365 - RNA, 13 nt, Homo sapiens
cuuggagugccac

SEQ ID NO: 864366 - RNA, 20 nt, Homo sapiens
cuuggccaccaggacuccuu

SEQ ID NO: 864367 - RNA, 16 nt, Homo sapiens
cuuguaaacauugccu

SEQ ID NO: 864368 - RNA, 23 nt, Homo sapiens
cuuguaaacauugccugauuugu

SEQ ID NO: 864369 - RNA, 20 nt, Homo sapiens
cuuguuuucuacuuugccac

SEQ ID NO: 864370 - RNA, 19 nt, Homo sapiens
cuuuacauuuugugcagug

SEQ ID NO: 864371 - RNA, 15 nt, Homo sapiens
cuuuagaaacugagu

SEQ ID NO: 864372 - RNA, 16 nt, Homo sapiens
cuuuagaaacugaguc

SEQ ID NO: 864373 - RNA, 14 nt, Homo sapiens
cuuucacuaugucc

SEQ ID NO: 864374 - RNA, 19 nt, Homo sapiens
cuuucacuauguccaugaa

SEQ ID NO: 864375 - RNA, 21 nt, Homo sapiens
cuuucaggccacauggcuaaa

SEQ ID NO: 864376 - RNA, 14 nt, Homo sapiens
cuuucaguuugucc

SEQ ID NO: 864377 - RNA, 14 nt, Homo sapiens
cuuucaugauuugc

SEQ ID NO: 864378 - RNA, 16 nt, Homo sapiens
cuuucauucccuuuca

SEQ ID NO: 864379 - RNA, 18 nt, Homo sapiens
cuuuccucagcaccuggg

SEQ ID NO: 864380 - RNA, 22 nt, Homo sapiens
cuuuccuucucgucuuccucuc

SEQ ID NO: 864381 - RNA, 13 nt, Homo sapiens
cuuucuuccacua

SEQ ID NO: 864382 - RNA, 14 nt, Homo sapiens
cuuugccacagauu

SEQ ID NO: 864383 - RNA, 15 nt, Homo sapiens
cuuuggcaauucuuc

SEQ ID NO: 864384 - RNA, 23 nt, Homo sapiens
acucggaauucccugaagcaaca

SEQ ID NO: 864385 - RNA, 22 nt, Homo sapiens
acucuccagaaagcucaucuca

SEQ ID NO: 864386 - RNA, 22 nt, Homo sapiens
acucuccuaaaauaaacaugaa

SEQ ID NO: 864387 - RNA, 15 nt, Homo sapiens
acucuggcugccaag

SEQ ID NO: 864388 - RNA, 22 nt, Homo sapiens
acucuuuuccaaacacaggcaa

SEQ ID NO: 864389 - RNA, 13 nt, Homo sapiens
acugacacucauu

SEQ ID NO: 864390 - RNA, 21 nt, Homo sapiens
acugacacugcgaacucucag

SEQ ID NO: 864391 - RNA, 17 nt, Homo sapiens
acugagcaaagcauuga

SEQ ID NO: 864392 - RNA, 15 nt, Homo sapiens
acugcaagcacugca

SEQ ID NO: 864393 - RNA, 18 nt, Homo sapiens
acugcacagugcaucuca

SEQ ID NO: 864394 - RNA, 23 nt, Homo sapiens
acugcagggaaaauuauuugcau

SEQ ID NO: 864395 - RNA, 22 nt, Homo sapiens
acugccauggaggcacacagcu

SEQ ID NO: 864396 - RNA, 13 nt, Homo sapiens
acugggcuucuag

SEQ ID NO: 864397 - RNA, 20 nt, Homo sapiens
acugguuaaaucaauucuga

SEQ ID NO: 864398 - RNA, 16 nt, Homo sapiens
acuguaugaagucaua

SEQ ID NO: 864399 - RNA, 18 nt, Homo sapiens
acuguaugugggaauuua

SEQ ID NO: 864400 - RNA, 12 nt, Homo sapiens
acugucaugccc

SEQ ID NO: 864401 - RNA, 14 nt, Homo sapiens
acugucaugcccag

SEQ ID NO: 864402 - RNA, 13 nt, Homo sapiens
acugucuccaugg

SEQ ID NO: 864403 - RNA, 18 nt, Homo sapiens
acuguucccccugugcag

SEQ ID NO: 864404 - RNA, 13 nt, Homo sapiens
acuguuuucccaa

SEQ ID NO: 864405 - RNA, 19 nt, Homo sapiens
acuuaaggauggagccagc

SEQ ID NO: 864406 - RNA, 13 nt, Homo sapiens
acuucaaggguuu

SEQ ID NO: 864407 - RNA, 22 nt, Homo sapiens
acuucaaggguuuguugaacaa

SEQ ID NO: 864408 - RNA, 22 nt, Homo sapiens
acuucaguggugagacuguauc

SEQ ID NO: 864409 - RNA, 13 nt, Homo sapiens
acuuccacuaccu

SEQ ID NO: 864410 - RNA, 18 nt, Homo sapiens
acuucucuauuaucucaa

SEQ ID NO: 864411 - RNA, 18 nt, Homo sapiens
acuugcaagucccaugau

SEQ ID NO: 864412 - RNA, 20 nt, Homo sapiens
acuuggcaguagaaauccag

SEQ ID NO: 864413 - RNA, 20 nt, Homo sapiens
acuuucccuagaaagccaua

SEQ ID NO: 864414 - RNA, 12 nt, Homo sapiens
acuuugaaaaua

SEQ ID NO: 864415 - RNA, 17 nt, Homo sapiens
acuuuuaaguugcugau

SEQ ID NO: 864416 - RNA, 12 nt, Homo sapiens
agaaagccucag

SEQ ID NO: 864417 - RNA, 17 nt, Homo sapiens
agaaagcucaucucagc

SEQ ID NO: 864418 - RNA, 12 nt, Homo sapiens
agaaauguacaa

SEQ ID NO: 864419 - RNA, 22 nt, Homo sapiens
agaaauugcauuuccugacaga

SEQ ID NO: 864420 - RNA, 20 nt, Homo sapiens
agaacaccugacaacuucug

SEQ ID NO: 864421 - RNA, 20 nt, Homo sapiens
agaacagcuucauguuccca

SEQ ID NO: 864422 - RNA, 15 nt, Homo sapiens
agaacaucaagauac

SEQ ID NO: 864423 - RNA, 15 nt, Homo sapiens
agaacugcuugcauu

SEQ ID NO: 864424 - RNA, 23 nt, Homo sapiens
agaagaaacuccuggaucccuuu

SEQ ID NO: 864425 - RNA, 23 nt, Homo sapiens
agaagcuccugaaucccuuucag

SEQ ID NO: 864426 - RNA, 18 nt, Homo sapiens
agaagugggagugggaga

SEQ ID NO: 864427 - RNA, 15 nt, Homo sapiens
agaauggaaggugga

SEQ ID NO: 864428 - RNA, 12 nt, Homo sapiens
agaauggagcug

SEQ ID NO: 864429 - RNA, 15 nt, Homo sapiens
agacaggguggggcu

SEQ ID NO: 864430 - RNA, 15 nt, Homo sapiens
agacaguauugccac

SEQ ID NO: 864431 - RNA, 15 nt, Homo sapiens
agaccauaauguuac

SEQ ID NO: 864432 - RNA, 16 nt, Homo sapiens
agaccauaauguuaca

SEQ ID NO: 864433 - RNA, 20 nt, Homo sapiens
agaccccucucccagcuauu

SEQ ID NO: 864434 - RNA, 13 nt, Homo sapiens
agacccugccagg

SEQ ID NO: 864435 - RNA, 15 nt, Homo sapiens
agaccgcuccccaau

SEQ ID NO: 864436 - RNA, 19 nt, Homo sapiens
agaccuguaaucauauaau

SEQ ID NO: 864437 - RNA, 13 nt, Homo sapiens
agacuaaggccau

SEQ ID NO: 864438 - RNA, 15 nt, Homo sapiens
agacuaugucaccca

SEQ ID NO: 864439 - RNA, 19 nt, Homo sapiens
agagacuuugacucuccag

SEQ ID NO: 864440 - RNA, 16 nt, Homo sapiens
agagagaguucucaca

SEQ ID NO: 864441 - RNA, 14 nt, Homo sapiens
agagagggggccac

SEQ ID NO: 864442 - RNA, 13 nt, Homo sapiens
agagaguggcucc

SEQ ID NO: 864443 - RNA, 17 nt, Homo sapiens
agaggacaguuuaggac

SEQ ID NO: 864444 - RNA, 21 nt, Homo sapiens
agaggagagagacuccagcug

SEQ ID NO: 864445 - RNA, 21 nt, Homo sapiens
agaguggccaaucccugugug

SEQ ID NO: 864446 - RNA, 19 nt, Homo sapiens
agaguguuaucagucauaa

SEQ ID NO: 864447 - RNA, 14 nt, Homo sapiens
agaguugugcacau

SEQ ID NO: 864448 - RNA, 15 nt, Homo sapiens
agauccugguuggug

SEQ ID NO: 864449 - RNA, 16 nt, Homo sapiens
agaucuuggggugcag

SEQ ID NO: 864450 - RNA, 14 nt, Homo sapiens
agaugaacugagaa

SEQ ID NO: 864451 - RNA, 14 nt, Homo sapiens
agaugaaugggagu

SEQ ID NO: 864452 - RNA, 20 nt, Homo sapiens
agaugccuccucuguccuca

SEQ ID NO: 864453 - RNA, 14 nt, Homo sapiens
agaugcgcaaagag

SEQ ID NO: 864454 - RNA, 21 nt, Homo sapiens
agaugcgcaaagagugugcuc

SEQ ID NO: 864455 - RNA, 16 nt, Homo sapiens
agauuaacaacacugc

SEQ ID NO: 864456 - RNA, 12 nt, Homo sapiens
agcaaagacuuu

SEQ ID NO: 864457 - RNA, 22 nt, Homo sapiens
agcaaaugagauguaugcccaa

SEQ ID NO: 864458 - RNA, 19 nt, Homo sapiens
agcacagauucaagugcaa

SEQ ID NO: 864459 - RNA, 21 nt, Homo sapiens
agcacagcagguuuauccaga

SEQ ID NO: 864460 - RNA, 19 nt, Homo sapiens
agcagccaaaccuuuccug

SEQ ID NO: 864461 - RNA, 11 nt, Homo sapiens
agcagccucag

SEQ ID NO: 864462 - RNA, 18 nt, Homo sapiens
agcagcggccgcucgccc

SEQ ID NO: 864463 - RNA, 20 nt, Homo sapiens
agcauccggcaugagggcug

SEQ ID NO: 864464 - RNA, 18 nt, Homo sapiens
agcauuuagcacauacua

SEQ ID NO: 864465 - RNA, 16 nt, Homo sapiens
agccacccagccagga

SEQ ID NO: 864466 - RNA, 17 nt, Homo sapiens
agccauaugaaugucag

SEQ ID NO: 864467 - RNA, 18 nt, Homo sapiens
agccaucugcgacaccac

SEQ ID NO: 864468 - RNA, 15 nt, Homo sapiens
agccauucacaacac

SEQ ID NO: 864469 - RNA, 18 nt, Homo sapiens
agcccucaggucagggug

SEQ ID NO: 864470 - RNA, 15 nt, Homo sapiens
agcccugcugucaga

SEQ ID NO: 864471 - RNA, 14 nt, Homo sapiens
agcccuuuacuuga

SEQ ID NO: 864472 - RNA, 17 nt, Homo sapiens
agccguugcuaaugcca

SEQ ID NO: 864473 - RNA, 16 nt, Homo sapiens
agccguuggcaccucu

SEQ ID NO: 864474 - RNA, 23 nt, Homo sapiens
agccuauguaugccauggaggca

SEQ ID NO: 864475 - RNA, 16 nt, Homo sapiens
agccucaagaugaagg

SEQ ID NO: 864476 - RNA, 20 nt, Homo sapiens
agccuccugacccugugaug

SEQ ID NO: 864477 - RNA, 14 nt, Homo sapiens
agccucugaauaug

SEQ ID NO: 864478 - RNA, 17 nt, Homo sapiens
agccuggccccaagcau

SEQ ID NO: 864479 - RNA, 14 nt, Homo sapiens
agccugugggagaa

SEQ ID NO: 864480 - RNA, 20 nt, Homo sapiens
agcuaaggaggccguucagc

SEQ ID NO: 864481 - RNA, 15 nt, Homo sapiens
agcuauuucucauca

SEQ ID NO: 864482 - RNA, 13 nt, Homo sapiens
agcucaaguuuca

SEQ ID NO: 864483 - RNA, 12 nt, Homo sapiens
agcucaucucag

SEQ ID NO: 864484 - RNA, 21 nt, Homo sapiens
agcuccgaguggcucccgugu

SEQ ID NO: 864485 - RNA, 20 nt, Homo sapiens
agcucgggcccucugugaga

SEQ ID NO: 864486 - RNA, 20 nt, Homo sapiens
agcucugaaaccaguguuag

SEQ ID NO: 864487 - RNA, 14 nt, Homo sapiens
agcugagcuuucca

SEQ ID NO: 864488 - RNA, 15 nt, Homo sapiens
agcugagcuuuccag

SEQ ID NO: 864489 - RNA, 16 nt, Homo sapiens
agcugcugacucacuu

SEQ ID NO: 864490 - RNA, 21 nt, Homo sapiens
agcuggguuggaaaacaguau

SEQ ID NO: 864491 - RNA, 22 nt, Homo sapiens
agcuggguuggaaaacaguauu

SEQ ID NO: 864492 - RNA, 13 nt, Homo sapiens
agcuuaagaauuu

SEQ ID NO: 864493 - RNA, 18 nt, Homo sapiens
agcuucuagcagcuaagg

SEQ ID NO: 864494 - RNA, 14 nt, Homo sapiens
agcuugcaacaaaa

SEQ ID NO: 864495 - RNA, 22 nt, Homo sapiens
agcuuucauguaaacugugcac

SEQ ID NO: 864496 - RNA, 21 nt, Homo sapiens
agcuuugagcuuaagaauuuu

SEQ ID NO: 864497 - RNA, 18 nt, Homo sapiens
aggaacuuuccagcagua

SEQ ID NO: 864498 - RNA, 16 nt, Homo sapiens
aggaagagcaggcacc

SEQ ID NO: 864499 - RNA, 13 nt, Homo sapiens
aggaccagagcua

SEQ ID NO: 864500 - RNA, 18 nt, Homo sapiens
aggacuguugacauccaa

SEQ ID NO: 864501 - RNA, 19 nt, Homo sapiens
aggagaggcugcugucacu

SEQ ID NO: 864502 - RNA, 18 nt, Homo sapiens
aggagcugagcuuuccag

SEQ ID NO: 864503 - RNA, 13 nt, Homo sapiens
aggaggacaggga

SEQ ID NO: 864504 - RNA, 21 nt, Homo sapiens
aggaggccacaugauacuuau

SEQ ID NO: 864505 - RNA, 20 nt, Homo sapiens
aggaggcuuacaacuccugc

SEQ ID NO: 864506 - RNA, 15 nt, Homo sapiens
aggaggggcugucca

SEQ ID NO: 864507 - RNA, 19 nt, Homo sapiens
aggagggguuaaagcugcc

SEQ ID NO: 864508 - RNA, 21 nt, Homo sapiens
aggagggucaggaaggaugag

SEQ ID NO: 864509 - RNA, 21 nt, Homo sapiens
aggaugagcauuuagggcaag

SEQ ID NO: 864510 - RNA, 16 nt, Homo sapiens
aggaugcuucugcuca

SEQ ID NO: 864511 - RNA, 16 nt, Homo sapiens
aggaugggaaggaggg

SEQ ID NO: 864512 - RNA, 15 nt, Homo sapiens
aggauuagacaguca

SEQ ID NO: 864513 - RNA, 20 nt, Homo sapiens
aggauuuguguuuuacagua

SEQ ID NO: 864514 - RNA, 21 nt, Homo sapiens
aggauuuguguuuuacaguau

SEQ ID NO: 864515 - RNA, 21 nt, Homo sapiens
aggcaaauccgaaaucagcag

SEQ ID NO: 864516 - RNA, 12 nt, Homo sapiens
aggcaagcacuu

SEQ ID NO: 864517 - RNA, 14 nt, Homo sapiens
aggcaagccacaga

SEQ ID NO: 864518 - RNA, 15 nt, Homo sapiens
aggcagaaugguggg

SEQ ID NO: 864519 - RNA, 13 nt, Homo sapiens
gccccagugaccg

SEQ ID NO: 864520 - RNA, 16 nt, Homo sapiens
gccccaucagcagcuu

SEQ ID NO: 864521 - RNA, 21 nt, Homo sapiens
gccccaugaguuugccauguu

SEQ ID NO: 864522 - RNA, 17 nt, Homo sapiens
gccccccucauuacugc

SEQ ID NO: 864523 - RNA, 23 nt, Homo sapiens
gcccccggcucggccucuugaga

SEQ ID NO: 864524 - RNA, 21 nt, Homo sapiens
gcccccggguccccggcacca

SEQ ID NO: 864525 - RNA, 22 nt, Homo sapiens
gccccuccccauggugcaguga

SEQ ID NO: 864526 - RNA, 13 nt, Homo sapiens
gccgcugggagag

SEQ ID NO: 864527 - RNA, 19 nt, Homo sapiens
gccgugccuucagcucuac

SEQ ID NO: 864528 - RNA, 17 nt, Homo sapiens
gccuaugccaccugcag

SEQ ID NO: 864529 - RNA, 19 nt, Homo sapiens
gccucaagaugaaggcaaa

SEQ ID NO: 864530 - RNA, 22 nt, Homo sapiens
gccuccccuggggcuggcagcu

SEQ ID NO: 864531 - RNA, 20 nt, Homo sapiens
gccuccuccagaauggagcu

SEQ ID NO: 864532 - RNA, 14 nt, Homo sapiens
gccucugaagccua

SEQ ID NO: 864533 - RNA, 19 nt, Homo sapiens
gccuggcaagugggugaaa

SEQ ID NO: 864534 - RNA, 20 nt, Homo sapiens
gccuggcagccgugccuuca

SEQ ID NO: 864535 - RNA, 14 nt, Homo sapiens
gccuguccuggauc

SEQ ID NO: 864536 - RNA, 14 nt, Homo sapiens
gccuguuugggagg

SEQ ID NO: 864537 - RNA, 15 nt, Homo sapiens
gccuuaaccaugagg

SEQ ID NO: 864538 - RNA, 16 nt, Homo sapiens
gcgcaagcgacacagg

SEQ ID NO: 864539 - RNA, 15 nt, Homo sapiens
gcgcccucuaccucc

SEQ ID NO: 864540 - RNA, 13 nt, Homo sapiens
gcggccaccagcg

SEQ ID NO: 864541 - RNA, 15 nt, Homo sapiens
gcggccgccuguccu

SEQ ID NO: 864542 - RNA, 22 nt, Homo sapiens
gcgguccugggauggggcaugu

SEQ ID NO: 864543 - RNA, 22 nt, Homo sapiens
gcuacugacuauggcuaccaaa

SEQ ID NO: 864544 - RNA, 20 nt, Homo sapiens
gcuccaucgcugucaucuca

SEQ ID NO: 864545 - RNA, 19 nt, Homo sapiens
gcuccugaaucccuuucag

SEQ ID NO: 864546 - RNA, 18 nt, Homo sapiens
gcucuuggggccagccua

SEQ ID NO: 864547 - RNA, 14 nt, Homo sapiens
gcucuuuggugcca

SEQ ID NO: 864548 - RNA, 14 nt, Homo sapiens
gcugggagagccaa

SEQ ID NO: 864549 - RNA, 15 nt, Homo sapiens
gcugggagagccaag

SEQ ID NO: 864550 - RNA, 14 nt, Homo sapiens
gcugggcacugggc

SEQ ID NO: 864551 - RNA, 18 nt, Homo sapiens
gcuggguuugggcagugg

SEQ ID NO: 864552 - RNA, 20 nt, Homo sapiens
gcugucaugcccagcuugga

SEQ ID NO: 864553 - RNA, 15 nt, Homo sapiens
gcuuagaauggggcu

SEQ ID NO: 864554 - RNA, 19 nt, Homo sapiens
gcuucacagaugugugauu

SEQ ID NO: 864555 - RNA, 17 nt, Homo sapiens
gcuucuagaaccaggca

SEQ ID NO: 864556 - RNA, 13 nt, Homo sapiens
gcuucuagcagcu

SEQ ID NO: 864557 - RNA, 21 nt, Homo sapiens
gcuucuuaauauaacugccuu

SEQ ID NO: 864558 - RNA, 16 nt, Homo sapiens
gcuugcauuucuuuau

SEQ ID NO: 864559 - RNA, 14 nt, Homo sapiens
gcuuggagugccac

SEQ ID NO: 864560 - RNA, 18 nt, Homo sapiens
gcuugggcuccauuccca

SEQ ID NO: 864561 - RNA, 21 nt, Homo sapiens
gcuuguuuucuacuuugccac

SEQ ID NO: 864562 - RNA, 16 nt, Homo sapiens
gcuuucugucugugaa

SEQ ID NO: 864563 - RNA, 13 nt, Homo sapiens
gcuuuggggagcg

SEQ ID NO: 864564 - RNA, 16 nt, Homo sapiens
ggaaaauuaauaucac

SEQ ID NO: 864565 - RNA, 13 nt, Homo sapiens
ggaacacaaccau

SEQ ID NO: 864566 - RNA, 22 nt, Homo sapiens
ggaagcacagcagguuuaucca

SEQ ID NO: 864567 - RNA, 20 nt, Homo sapiens
ggaagggucuuaacacuuac

SEQ ID NO: 864568 - RNA, 18 nt, Homo sapiens
ggaaugggccaagccagg

SEQ ID NO: 864569 - RNA, 20 nt, Homo sapiens
ggaauggggugggagccaca

SEQ ID NO: 864570 - RNA, 22 nt, Homo sapiens
ggaauggugcccuuggaggcaa

SEQ ID NO: 864571 - RNA, 21 nt, Homo sapiens
ggacagcugcuucugugcauu

SEQ ID NO: 864572 - RNA, 23 nt, Homo sapiens
ggacauggugugccacaggcugc

SEQ ID NO: 864573 - RNA, 21 nt, Homo sapiens
ggaccaauuagcauuccauca

SEQ ID NO: 864574 - RNA, 19 nt, Homo sapiens
ggacgacuguuuucccaac

SEQ ID NO: 864575 - RNA, 18 nt, Homo sapiens
ggagaaacccuugaaaag

SEQ ID NO: 864576 - RNA, 14 nt, Homo sapiens
ggagaacuagagaa

SEQ ID NO: 864577 - RNA, 17 nt, Homo sapiens
ggagacacuguucccaa

SEQ ID NO: 864578 - RNA, 15 nt, Homo sapiens
ggagacuagauuuau

SEQ ID NO: 864579 - RNA, 22 nt, Homo sapiens
ggagagaaugagagagugugga

SEQ ID NO: 864580 - RNA, 20 nt, Homo sapiens
ggagaucuuggggugcagca

SEQ ID NO: 864581 - RNA, 18 nt, Homo sapiens
ggagccuccugacccugu

SEQ ID NO: 864582 - RNA, 22 nt, Homo sapiens
ggaggccugggagaugcagcug

SEQ ID NO: 864583 - RNA, 21 nt, Homo sapiens
ggaggcuccagagggcacucu

SEQ ID NO: 864584 - RNA, 16 nt, Homo sapiens
ggaguggaaacaaagg

SEQ ID NO: 864585 - RNA, 18 nt, Homo sapiens
ggauuuuccaccaaauuc

SEQ ID NO: 864586 - RNA, 22 nt, Homo sapiens
ggcaaccacaggcagcauuuag

SEQ ID NO: 864587 - RNA, 15 nt, Homo sapiens
ggcacugucaugccc

SEQ ID NO: 864588 - RNA, 17 nt, Homo sapiens
ggcagagaggacuguug

SEQ ID NO: 864589 - RNA, 18 nt, Homo sapiens
ggccaaauaugcacuuuc

SEQ ID NO: 864590 - RNA, 22 nt, Homo sapiens
ggccaaauaugcacuuucccua

SEQ ID NO: 864591 - RNA, 17 nt, Homo sapiens
ggccacuggcaucucug

SEQ ID NO: 864592 - RNA, 14 nt, Homo sapiens
ggcccgcacguguc

SEQ ID NO: 864593 - RNA, 17 nt, Homo sapiens
ggcccgguggccggcau

SEQ ID NO: 864594 - RNA, 17 nt, Homo sapiens
ggccuggcaagugggug

SEQ ID NO: 864595 - RNA, 18 nt, Homo sapiens
ggcgacugugaaacugga

SEQ ID NO: 864596 - RNA, 14 nt, Homo sapiens
ggcgggucccaggc

SEQ ID NO: 864597 - RNA, 15 nt, Homo sapiens
ggcuaaaaccaucau

SEQ ID NO: 864598 - RNA, 21 nt, Homo sapiens
ggcuagucugugccucaguga

SEQ ID NO: 864599 - RNA, 17 nt, Homo sapiens
uaauaucacagcauaac

SEQ ID NO: 864600 - RNA, 18 nt, Homo sapiens
uaaugacguauugugaaa

SEQ ID NO: 864601 - RNA, 19 nt, Homo sapiens
uaauucuguauuaacugaa

SEQ ID NO: 864602 - RNA, 19 nt, Homo sapiens
uacaaauaaauccaagacu

SEQ ID NO: 864603 - RNA, 23 nt, Homo sapiens
uacaacuuuuuaccuaguacaag

SEQ ID NO: 864604 - RNA, 21 nt, Homo sapiens
uacaaugaguaaaaucacaga

SEQ ID NO: 864605 - RNA, 13 nt, Homo sapiens
uacaccugaguca

SEQ ID NO: 864606 - RNA, 19 nt, Homo sapiens
uacacgagguaugaggucu

SEQ ID NO: 864607 - RNA, 20 nt, Homo sapiens
uacagaaucaaaugcaauuu

SEQ ID NO: 864608 - RNA, 13 nt, Homo sapiens
uacagacccacag

SEQ ID NO: 864609 - RNA, 22 nt, Homo sapiens
uacaguaggagcccagcucuga

SEQ ID NO: 864610 - RNA, 18 nt, Homo sapiens
uacagucuuccauuugca

SEQ ID NO: 864611 - RNA, 15 nt, Homo sapiens
uacauuaauuaccuu

SEQ ID NO: 864612 - RNA, 21 nt, Homo sapiens
uacauuuggcuccacuguaaa

SEQ ID NO: 864613 - RNA, 15 nt, Homo sapiens
uacauuuugugcagu

SEQ ID NO: 864614 - RNA, 21 nt, Homo sapiens
uaccugaaaacacugugcaca

SEQ ID NO: 864615 - RNA, 14 nt, Homo sapiens
uaccugacacuccc

SEQ ID NO: 864616 - RNA, 17 nt, Homo sapiens
uacgacucuuuuccaaa

SEQ ID NO: 864617 - RNA, 13 nt, Homo sapiens
uacggcagucaca

SEQ ID NO: 864618 - RNA, 11 nt, Homo sapiens
uacucagucag

SEQ ID NO: 864619 - RNA, 15 nt, Homo sapiens
uacucauucagggau

SEQ ID NO: 864620 - RNA, 13 nt, Homo sapiens
uacucucaggcau

SEQ ID NO: 864621 - RNA, 20 nt, Homo sapiens
uacucucaggcauggaugaa

SEQ ID NO: 864622 - RNA, 23 nt, Homo sapiens
uacucucaggcauggaugaauaa

SEQ ID NO: 864623 - RNA, 19 nt, Homo sapiens
uacucuuuguaugaugaaa

SEQ ID NO: 864624 - RNA, 17 nt, Homo sapiens
uacugaguucucaucca

SEQ ID NO: 864625 - RNA, 14 nt, Homo sapiens
uacuggcaauuugu

SEQ ID NO: 864626 - RNA, 16 nt, Homo sapiens
uacuucaagaucugaa

SEQ ID NO: 864627 - RNA, 19 nt, Homo sapiens
uacuugggagaccuguaau

SEQ ID NO: 864628 - RNA, 21 nt, Homo sapiens
uacuuuugcccuuugauuaaa

SEQ ID NO: 864629 - RNA, 13 nt, Homo sapiens
uagaaccaggcaa

SEQ ID NO: 864630 - RNA, 22 nt, Homo sapiens
uagaagccacuauuacugggac

SEQ ID NO: 864631 - RNA, 20 nt, Homo sapiens
uagacaucccccuccuugcc

SEQ ID NO: 864632 - RNA, 20 nt, Homo sapiens
uagagaaaauggaacauuaa

SEQ ID NO: 864633 - RNA, 14 nt, Homo sapiens
uagagacuguaaau

SEQ ID NO: 864634 - RNA, 12 nt, Homo sapiens
uagagaggacag

SEQ ID NO: 864635 - RNA, 22 nt, Homo sapiens
uagagcucaguauacuaaugcc

SEQ ID NO: 864636 - RNA, 14 nt, Homo sapiens
uagaggugagggaa

SEQ ID NO: 864637 - RNA, 13 nt, Homo sapiens
uagaguguuauca

SEQ ID NO: 864638 - RNA, 17 nt, Homo sapiens
uagaugcugacuguacu

SEQ ID NO: 864639 - RNA, 23 nt, Homo sapiens
uagauugccuuuggcaauucuuc

SEQ ID NO: 864640 - RNA, 20 nt, Homo sapiens
uagcaaaauacaugacauuu

SEQ ID NO: 864641 - RNA, 12 nt, Homo sapiens
uagcacauacua

SEQ ID NO: 864642 - RNA, 18 nt, Homo sapiens
uagcauacgguaugauau

SEQ ID NO: 864643 - RNA, 14 nt, Homo sapiens
uagcauuccaucaa

SEQ ID NO: 864644 - RNA, 22 nt, Homo sapiens
uagcuggagagagaguucucac

SEQ ID NO: 864645 - RNA, 13 nt, Homo sapiens
uaggaagaauuac

SEQ ID NO: 864646 - RNA, 22 nt, Homo sapiens
uaggaguuuuguuuagagcagu

SEQ ID NO: 864647 - RNA, 16 nt, Homo sapiens
uaggauauacuguaug

SEQ ID NO: 864648 - RNA, 14 nt, Homo sapiens
uagggaucccucau

SEQ ID NO: 864649 - RNA, 13 nt, Homo sapiens
uaggucaagaaga

SEQ ID NO: 864650 - RNA, 19 nt, Homo sapiens
uaguaacuguaugaaguca

SEQ ID NO: 864651 - RNA, 11 nt, Homo sapiens
uaguaggagcu

SEQ ID NO: 864652 - RNA, 20 nt, Homo sapiens
uagucaagugcguccacgag

SEQ ID NO: 864653 - RNA, 18 nt, Homo sapiens
uaguuacucauucaggga

SEQ ID NO: 864654 - RNA, 12 nt, Homo sapiens
uauaaacacaua

SEQ ID NO: 864655 - RNA, 14 nt, Homo sapiens
uauaaacacauaau

SEQ ID NO: 864656 - RNA, 15 nt, Homo sapiens
cucugcuccacagaa

SEQ ID NO: 864657 - RNA, 16 nt, Homo sapiens
cucugggccaagucaa

SEQ ID NO: 864658 - RNA, 17 nt, Homo sapiens
cucugggccaagucaaa

SEQ ID NO: 864659 - RNA, 14 nt, Homo sapiens
cucuguuuacccuc

SEQ ID NO: 864660 - RNA, 17 nt, Homo sapiens
cucuuuuuagauguagc

SEQ ID NO: 864661 - RNA, 17 nt, Homo sapiens
cugaaauaaaauucauu

SEQ ID NO: 864662 - RNA, 19 nt, Homo sapiens
cugaaggagccccauuccu

SEQ ID NO: 864663 - RNA, 23 nt, Homo sapiens
cugaaggcaaaucuccuuugucc

SEQ ID NO: 864664 - RNA, 17 nt, Homo sapiens
cugaaguaagcaaagac

SEQ ID NO: 864665 - RNA, 15 nt, Homo sapiens
cugaaucccuuucag

SEQ ID NO: 864666 - RNA, 19 nt, Homo sapiens
cugaauuuguagacauacu

SEQ ID NO: 864667 - RNA, 16 nt, Homo sapiens
cugacacaggggacac

SEQ ID NO: 864668 - RNA, 13 nt, Homo sapiens
cugaccagacugu

SEQ ID NO: 864669 - RNA, 16 nt, Homo sapiens
cugacuguacuccucc

SEQ ID NO: 864670 - RNA, 16 nt, Homo sapiens
cugagaucacucgcuu

SEQ ID NO: 864671 - RNA, 18 nt, Homo sapiens
cugagggacuuggcagua

SEQ ID NO: 864672 - RNA, 22 nt, Homo sapiens
cugagugcaccacuucaaguga

SEQ ID NO: 864673 - RNA, 22 nt, Homo sapiens
cugauucugucaaugucuugaa

SEQ ID NO: 864674 - RNA, 13 nt, Homo sapiens
cugcaagcacugc

SEQ ID NO: 864675 - RNA, 17 nt, Homo sapiens
cugcacagugcaucuca

SEQ ID NO: 864676 - RNA, 22 nt, Homo sapiens
cugcaccucauuccaacuccua

SEQ ID NO: 864677 - RNA, 23 nt, Homo sapiens
cugcccacucugaccgggcuucc

SEQ ID NO: 864678 - RNA, 16 nt, Homo sapiens
cugcccccaauccaug

SEQ ID NO: 864679 - RNA, 21 nt, Homo sapiens
cugccccccuucccaccccua

SEQ ID NO: 864680 - RNA, 20 nt, Homo sapiens
cugcggcacccuugcgcuuu

SEQ ID NO: 864681 - RNA, 19 nt, Homo sapiens
cugcuaugucugugauguc

SEQ ID NO: 864682 - RNA, 18 nt, Homo sapiens
cugcuucugugcauuugu

SEQ ID NO: 864683 - RNA, 16 nt, Homo sapiens
cuggaaaccagaauga

SEQ ID NO: 864684 - RNA, 17 nt, Homo sapiens
cuggacuuuugcagcuu

SEQ ID NO: 864685 - RNA, 17 nt, Homo sapiens
cuggagugugugggggu

SEQ ID NO: 864686 - RNA, 17 nt, Homo sapiens
cuggcaagagacuacuc

SEQ ID NO: 864687 - RNA, 17 nt, Homo sapiens
cuggccaaauaugcacu

SEQ ID NO: 864688 - RNA, 19 nt, Homo sapiens
cuggccaaauaugcacuuu

SEQ ID NO: 864689 - RNA, 16 nt, Homo sapiens
cuggccaggccccgcg

SEQ ID NO: 864690 - RNA, 15 nt, Homo sapiens
cuggcuugcacuuuc

SEQ ID NO: 864691 - RNA, 20 nt, Homo sapiens
cuggcuuuggguagugccau

SEQ ID NO: 864692 - RNA, 19 nt, Homo sapiens
cugggacugugcucagaga

SEQ ID NO: 864693 - RNA, 22 nt, Homo sapiens
cugggauggggcauguggccaa

SEQ ID NO: 864694 - RNA, 14 nt, Homo sapiens
cugggcacuccucc

SEQ ID NO: 864695 - RNA, 14 nt, Homo sapiens
cugggccacuggca

SEQ ID NO: 864696 - RNA, 22 nt, Homo sapiens
cugggcccucucugcucugcgu

SEQ ID NO: 864697 - RNA, 14 nt, Homo sapiens
cuggguguguuuca

SEQ ID NO: 864698 - RNA, 19 nt, Homo sapiens
cugguggcccgacagccug

SEQ ID NO: 864699 - RNA, 21 nt, Homo sapiens
cugguugguguugcagaaggu

SEQ ID NO: 864700 - RNA, 12 nt, Homo sapiens
cuguacauacau

SEQ ID NO: 864701 - RNA, 16 nt, Homo sapiens
cuguaccugugcacgu

SEQ ID NO: 864702 - RNA, 15 nt, Homo sapiens
cugucaugcccagcu

SEQ ID NO: 864703 - RNA, 19 nt, Homo sapiens
cuguccaggaacuuuccag

SEQ ID NO: 864704 - RNA, 18 nt, Homo sapiens
cuguccuucccacggcca

SEQ ID NO: 864705 - RNA, 13 nt, Homo sapiens
cugucucauauga

SEQ ID NO: 864706 - RNA, 23 nt, Homo sapiens
cugugauugccauuucuucccaa

SEQ ID NO: 864707 - RNA, 15 nt, Homo sapiens
cugugccucagugag

SEQ ID NO: 864708 - RNA, 17 nt, Homo sapiens
cuguuaugucauugugu

SEQ ID NO: 864709 - RNA, 13 nt, Homo sapiens
cuguugacaucca

SEQ ID NO: 864710 - RNA, 14 nt, Homo sapiens
cuuaacaaaaguga

SEQ ID NO: 864711 - RNA, 12 nt, Homo sapiens
cuuaagcacuuu

SEQ ID NO: 864712 - RNA, 13 nt, Homo sapiens
cuuaagcacuuug

SEQ ID NO: 864713 - RNA, 23 nt, Homo sapiens
cuuaaguuguggagagugcaaca

SEQ ID NO: 864714 - RNA, 17 nt, Homo sapiens
cuuacaacuccugcauc

SEQ ID NO: 864715 - RNA, 18 nt, Homo sapiens
cuuacaauacaauaguau

SEQ ID NO: 864716 - RNA, 20 nt, Homo sapiens
cuuacauuugaaaucuauga

SEQ ID NO: 864717 - RNA, 17 nt, Homo sapiens
cuuagcuuagcuuucug

SEQ ID NO: 864718 - RNA, 16 nt, Homo sapiens
cuuauuuaaauuuuca

SEQ ID NO: 864719 - RNA, 17 nt, Homo sapiens
cuucaaaaucagugaug

SEQ ID NO: 864720 - RNA, 17 nt, Homo sapiens
cuucacucaaucucuga

SEQ ID NO: 864721 - RNA, 23 nt, Homo sapiens
cuucagggggccaggugcacaga

SEQ ID NO: 864722 - RNA, 21 nt, Homo sapiens
cuucauccucugagugugacc

SEQ ID NO: 864723 - RNA, 22 nt, Homo sapiens
cuucauccucugagugugacca

SEQ ID NO: 864724 - RNA, 21 nt, Homo sapiens
cuucaucgcaguggacugugu

SEQ ID NO: 864725 - RNA, 16 nt, Homo sapiens
cuuccaaucuccauca

SEQ ID NO: 864726 - RNA, 13 nt, Homo sapiens
cuucccuuugauu

SEQ ID NO: 864727 - RNA, 23 nt, Homo sapiens
cuucgauacaccgggccuggaga

SEQ ID NO: 864728 - RNA, 13 nt, Homo sapiens
cuucuagaaccag

SEQ ID NO: 864729 - RNA, 17 nt, Homo sapiens
cuucucaagcacugaca

SEQ ID NO: 864730 - RNA, 19 nt, Homo sapiens
cuucucucaccuccuaaag

SEQ ID NO: 864731 - RNA, 15 nt, Homo sapiens
cuucugcucacauuc

SEQ ID NO: 864732 - RNA, 19 nt, Homo sapiens
cuucuggggcuuugccauu

SEQ ID NO: 864733 - RNA, 22 nt, Homo sapiens
cuucuuaauauaacugccuuaa

SEQ ID NO: 864734 - RNA, 14 nt, Homo sapiens
cuucuuccacagca

SEQ ID NO: 864735 - RNA, 18 nt, Homo sapiens
cuucuugggggcagacca

SEQ ID NO: 864736 - RNA, 22 nt, Homo sapiens
cuugaaagaaaauaugcaucua

SEQ ID NO: 864737 - RNA, 15 nt, Homo sapiens
cuugaaaucaagggc

SEQ ID NO: 864738 - RNA, 20 nt, Homo sapiens
cuugaguuuagugaucugaa

SEQ ID NO: 864739 - RNA, 17 nt, Homo sapiens
cuugcacaaacuccauc

SEQ ID NO: 864740 - RNA, 13 nt, Homo sapiens
gaacucuucaucu

SEQ ID NO: 864741 - RNA, 22 nt, Homo sapiens
gaacucuucaucuuaaacuaca

SEQ ID NO: 864742 - RNA, 15 nt, Homo sapiens
gaacugcuugcauuu

SEQ ID NO: 864743 - RNA, 20 nt, Homo sapiens
gaacuugcugcugagugcac

SEQ ID NO: 864744 - RNA, 16 nt, Homo sapiens
gaacuuucaccuucau

SEQ ID NO: 864745 - RNA, 12 nt, Homo sapiens
gaagaagcuaaa

SEQ ID NO: 864746 - RNA, 23 nt, Homo sapiens
gaagacacgcccgacucucucca

SEQ ID NO: 864747 - RNA, 21 nt, Homo sapiens
gaagagcaggcaccagcagca

SEQ ID NO: 864748 - RNA, 22 nt, Homo sapiens
gaagagcauccggcaugagggc

SEQ ID NO: 864749 - RNA, 19 nt, Homo sapiens
gaagaguaaaauggcuguu

SEQ ID NO: 864750 - RNA, 16 nt, Homo sapiens
gaagccacugccagcu

SEQ ID NO: 864751 - RNA, 21 nt, Homo sapiens
gaagccucacugcaagcacug

SEQ ID NO: 864752 - RNA, 21 nt, Homo sapiens
gaagguuggaacugcugccau

SEQ ID NO: 864753 - RNA, 16 nt, Homo sapiens
gaagucacugcacagu

SEQ ID NO: 864754 - RNA, 16 nt, Homo sapiens
gaagugugugaucugu

SEQ ID NO: 864755 - RNA, 13 nt, Homo sapiens
gaauaacaaggaa

SEQ ID NO: 864756 - RNA, 14 nt, Homo sapiens
gaauaauccagaaa

SEQ ID NO: 864757 - RNA, 14 nt, Homo sapiens
gaaucggugcuguc

SEQ ID NO: 864758 - RNA, 14 nt, Homo sapiens
gaaugauucagugu

SEQ ID NO: 864759 - RNA, 17 nt, Homo sapiens
gaauguuuacacucuuu

SEQ ID NO: 864760 - RNA, 22 nt, Homo sapiens
gacaaaccagaagcaacagaaa

SEQ ID NO: 864761 - RNA, 16 nt, Homo sapiens
gacacggcggggcccg

SEQ ID NO: 864762 - RNA, 23 nt, Homo sapiens
gacaggcacagaugaaugggagu

SEQ ID NO: 864763 - RNA, 14 nt, Homo sapiens
gacaguauugccac

SEQ ID NO: 864764 - RNA, 17 nt, Homo sapiens
gacaucaagcacagaag

SEQ ID NO: 864765 - RNA, 21 nt, Homo sapiens
gacaugcgggcugggcagcug

SEQ ID NO: 864766 - RNA, 19 nt, Homo sapiens
gaccaaugucuugaugcau

SEQ ID NO: 864767 - RNA, 21 nt, Homo sapiens
gaccacagcagggauugggau

SEQ ID NO: 864768 - RNA, 23 nt, Homo sapiens
gacccagucagaguugugcacau

SEQ ID NO: 864769 - RNA, 17 nt, Homo sapiens
gacgauuucacugacac

SEQ ID NO: 864770 - RNA, 17 nt, Homo sapiens
gacuauggcuaccaaaa

SEQ ID NO: 864771 - RNA, 13 nt, Homo sapiens
gacuccaguuaaa

SEQ ID NO: 864772 - RNA, 19 nt, Homo sapiens
gacucuccagaaagcucau

SEQ ID NO: 864773 - RNA, 20 nt, Homo sapiens
gacuggguuuugugauugcc

SEQ ID NO: 864774 - RNA, 14 nt, Homo sapiens
gacuguacuccucc

SEQ ID NO: 864775 - RNA, 17 nt, Homo sapiens
gacuucauuuuuccuaa

SEQ ID NO: 864776 - RNA, 12 nt, Homo sapiens
gacuuggcagua

SEQ ID NO: 864777 - RNA, 20 nt, Homo sapiens
gacuuuuuuuaaauaguaaa

SEQ ID NO: 864778 - RNA, 16 nt, Homo sapiens
gagagccaccaagagg

SEQ ID NO: 864779 - RNA, 14 nt, Homo sapiens
gagaggaagccacg

SEQ ID NO: 864780 - RNA, 19 nt, Homo sapiens
gagaggagagaaugagaga

SEQ ID NO: 864781 - RNA, 15 nt, Homo sapiens
gagaggcugcuguca

SEQ ID NO: 864782 - RNA, 21 nt, Homo sapiens
gagaguguggaaaaaaaaaga

SEQ ID NO: 864783 - RNA, 13 nt, Homo sapiens
gagauauuuacau

SEQ ID NO: 864784 - RNA, 17 nt, Homo sapiens
gagauggaggaaaguga

SEQ ID NO: 864785 - RNA, 19 nt, Homo sapiens
gagauguaugcccaaagac

SEQ ID NO: 864786 - RNA, 17 nt, Homo sapiens
gagauuaccuccugaga

SEQ ID NO: 864787 - RNA, 21 nt, Homo sapiens
gagcauggccgcaacuuccca

SEQ ID NO: 864788 - RNA, 21 nt, Homo sapiens
gagcauuguggcugucagcag

SEQ ID NO: 864789 - RNA, 17 nt, Homo sapiens
gagccaccccuaaagag

SEQ ID NO: 864790 - RNA, 13 nt, Homo sapiens
gagccauaugaau

SEQ ID NO: 864791 - RNA, 17 nt, Homo sapiens
gagccuccugacccugu

SEQ ID NO: 864792 - RNA, 18 nt, Homo sapiens
gagccuccugacccugug

SEQ ID NO: 864793 - RNA, 21 nt, Homo sapiens
gaggacagggagggaacagac

SEQ ID NO: 864794 - RNA, 20 nt, Homo sapiens
gaggacccucccagguuucc

SEQ ID NO: 864795 - RNA, 19 nt, Homo sapiens
gaggacuguugacauccaa

SEQ ID NO: 864796 - RNA, 21 nt, Homo sapiens
gaggcagaauggugggcucca

SEQ ID NO: 864797 - RNA, 15 nt, Homo sapiens
gaggcaguggcagca

SEQ ID NO: 864798 - RNA, 22 nt, Homo sapiens
gagggaacccugacuacagaaa

SEQ ID NO: 864799 - RNA, 18 nt, Homo sapiens
gagggcagaggugaucac

SEQ ID NO: 864800 - RNA, 16 nt, Homo sapiens
gagggcagucgauaga

SEQ ID NO: 864801 - RNA, 20 nt, Homo sapiens
gaggggagaggaagcacaag

SEQ ID NO: 864802 - RNA, 21 nt, Homo sapiens
gaggugguaagaacaccugac

SEQ ID NO: 864803 - RNA, 22 nt, Homo sapiens
gaguaaauauugucacaacacu

SEQ ID NO: 864804 - RNA, 13 nt, Homo sapiens
gaguggaaacaaa

SEQ ID NO: 864805 - RNA, 13 nt, Homo sapiens
gaguggaucugga

SEQ ID NO: 864806 - RNA, 21 nt, Homo sapiens
gaguuugggaacugcaauaac

SEQ ID NO: 864807 - RNA, 20 nt, Homo sapiens
gauaaguaaguuugauuuca

SEQ ID NO: 864808 - RNA, 13 nt, Homo sapiens
gauaauuacuuuc

SEQ ID NO: 864809 - RNA, 15 nt, Homo sapiens
gauacagaacucuuu

SEQ ID NO: 864810 - RNA, 14 nt, Homo sapiens
gauaggagcuucca

SEQ ID NO: 864811 - RNA, 21 nt, Homo sapiens
gauauucaaucuuaacaaaag

SEQ ID NO: 864812 - RNA, 19 nt, Homo sapiens
gauccaccgccacacuggc

SEQ ID NO: 864813 - RNA, 17 nt, Homo sapiens
gaucugaugcaagcaag

SEQ ID NO: 864814 - RNA, 12 nt, Homo sapiens
gaucugcagcuc

SEQ ID NO: 864815 - RNA, 15 nt, Homo sapiens
gaucuuugacucuuu

SEQ ID NO: 864816 - RNA, 23 nt, Homo sapiens
gaugaccccuccccuaaugccug

SEQ ID NO: 864817 - RNA, 13 nt, Homo sapiens
gaugcaagcaaga

SEQ ID NO: 864818 - RNA, 16 nt, Homo sapiens
gaugccuccucugucc

SEQ ID NO: 864819 - RNA, 19 nt, Homo sapiens
gauggagauauuuacauga

SEQ ID NO: 864820 - RNA, 9 nt, Homo sapiens
gauggagcu

SEQ ID NO: 864821 - RNA, 18 nt, Homo sapiens
gaugucguuugaaucaca

SEQ ID NO: 864822 - RNA, 19 nt, Homo sapiens
uuaaguugauggugaugaa

SEQ ID NO: 864823 - RNA, 13 nt, Homo sapiens
uuaauagccauuu

SEQ ID NO: 864824 - RNA, 14 nt, Homo sapiens
uuaauauaacugcc

SEQ ID NO: 864825 - RNA, 14 nt, Homo sapiens
uuaaugaaauacca

SEQ ID NO: 864826 - RNA, 14 nt, Homo sapiens
uuaauguacuuuca

SEQ ID NO: 864827 - RNA, 16 nt, Homo sapiens
uuacaaugugcacuga

SEQ ID NO: 864828 - RNA, 23 nt, Homo sapiens
uuacaguaggagcccagcucuga

SEQ ID NO: 864829 - RNA, 17 nt, Homo sapiens
uuacauuugaaaucuau

SEQ ID NO: 864830 - RNA, 17 nt, Homo sapiens
uuaccgaguaucuguaa

SEQ ID NO: 864831 - RNA, 14 nt, Homo sapiens
uuaccuaguacaag

SEQ ID NO: 864832 - RNA, 16 nt, Homo sapiens
uuaccuugugcuaauc

SEQ ID NO: 864833 - RNA, 14 nt, Homo sapiens
uuacuaucauguca

SEQ ID NO: 864834 - RNA, 16 nt, Homo sapiens
uuacuaucaugucaaa

SEQ ID NO: 864835 - RNA, 23 nt, Homo sapiens
uuagaaaagacugaccuugaugu

SEQ ID NO: 864836 - RNA, 12 nt, Homo sapiens
uuagaaacugag

SEQ ID NO: 864837 - RNA, 15 nt, Homo sapiens
uuagaaauugcauuu

SEQ ID NO: 864838 - RNA, 16 nt, Homo sapiens
uuagauguagcacuga

SEQ ID NO: 864839 - RNA, 23 nt, Homo sapiens
uuagauguucuaagucuuuccau

SEQ ID NO: 864840 - RNA, 12 nt, Homo sapiens
uuagccccauga

SEQ ID NO: 864841 - RNA, 12 nt, Homo sapiens
uuaggcacuugg

SEQ ID NO: 864842 - RNA, 17 nt, Homo sapiens
uuauaaaagaugcauua

SEQ ID NO: 864843 - RNA, 23 nt, Homo sapiens
uuauaaagggagauaacaaucug

SEQ ID NO: 864844 - RNA, 13 nt, Homo sapiens
uuauaaguaacuu

SEQ ID NO: 864845 - RNA, 19 nt, Homo sapiens
uuauuagagugucuuucca

SEQ ID NO: 864846 - RNA, 18 nt, Homo sapiens
uucaaaauaaacaauaaa

SEQ ID NO: 864847 - RNA, 14 nt, Homo sapiens
uucaaacuacugua

SEQ ID NO: 864848 - RNA, 18 nt, Homo sapiens
uucaagaaagcauugcca

SEQ ID NO: 864849 - RNA, 20 nt, Homo sapiens
uucaagugcaauccauguau

SEQ ID NO: 864850 - RNA, 12 nt, Homo sapiens
uucaagugcuaa

SEQ ID NO: 864851 - RNA, 23 nt, Homo sapiens
uucaaguuuuuuucaaaguccaa

SEQ ID NO: 864852 - RNA, 13 nt, Homo sapiens
uucagaaagaagu

SEQ ID NO: 864853 - RNA, 16 nt, Homo sapiens
uucagaauaaaugggu

SEQ ID NO: 864854 - RNA, 23 nt, Homo sapiens
uucagccauucacaacacaauca

SEQ ID NO: 864855 - RNA, 13 nt, Homo sapiens
uucagcucuacag

SEQ ID NO: 864856 - RNA, 17 nt, Homo sapiens
uucagggauagcacuga

SEQ ID NO: 864857 - RNA, 23 nt, Homo sapiens
uucagggggccaggugcacagac

SEQ ID NO: 864858 - RNA, 14 nt, Homo sapiens
uucaguaaacacca

SEQ ID NO: 864859 - RNA, 18 nt, Homo sapiens
uucauauauuuguaugau

SEQ ID NO: 864860 - RNA, 20 nt, Homo sapiens
uucauauauuuguaugaucc

SEQ ID NO: 864861 - RNA, 20 nt, Homo sapiens
uucauauguaccauguacau

SEQ ID NO: 864862 - RNA, 14 nt, Homo sapiens
uucaucucauuaau

SEQ ID NO: 864863 - RNA, 15 nt, Homo sapiens
uucaugaucaucaca

SEQ ID NO: 864864 - RNA, 15 nt, Homo sapiens
uucauucccuuucau

SEQ ID NO: 864865 - RNA, 10 nt, Homo sapiens
uuccacugag

SEQ ID NO: 864866 - RNA, 22 nt, Homo sapiens
uuccagccguguuguagcuaau

SEQ ID NO: 864867 - RNA, 23 nt, Homo sapiens
uucccaaugcuuuguccaugaug

SEQ ID NO: 864868 - RNA, 15 nt, Homo sapiens
uucccccgcaaugug

SEQ ID NO: 864869 - RNA, 20 nt, Homo sapiens
uucccuauuuugccaguggg

SEQ ID NO: 864870 - RNA, 21 nt, Homo sapiens
uucccuauuuugccaguggga

SEQ ID NO: 864871 - RNA, 22 nt, Homo sapiens
uucccuuugauuuuuugcugca

SEQ ID NO: 864872 - RNA, 17 nt, Homo sapiens
uuccgagggcacuaccg

SEQ ID NO: 864873 - RNA, 22 nt, Homo sapiens
uuccuaacaggauuagacaguc

SEQ ID NO: 864874 - RNA, 22 nt, Homo sapiens
uuccuguguccacaucuaacaa

SEQ ID NO: 864875 - RNA, 15 nt, Homo sapiens
uucgcugagucccag

SEQ ID NO: 864876 - RNA, 13 nt, Homo sapiens
uucuaaucaaagc

SEQ ID NO: 864877 - RNA, 11 nt, Homo sapiens
uucuccacugg

SEQ ID NO: 864878 - RNA, 17 nt, Homo sapiens
uucucuuuucaaacaca

SEQ ID NO: 864879 - RNA, 19 nt, Homo sapiens
uucugcauuuaaccgucaa

SEQ ID NO: 864880 - RNA, 15 nt, Homo sapiens
uucuguacucaaaug

SEQ ID NO: 864881 - RNA, 12 nt, Homo sapiens
uucuguggcuca

SEQ ID NO: 864882 - RNA, 14 nt, Homo sapiens
uucuuaggccacau

SEQ ID NO: 864883 - RNA, 14 nt, Homo sapiens
uucuuucugcuaua

SEQ ID NO: 864884 - RNA, 18 nt, Homo sapiens
uugaaaaccucuuuccaa

SEQ ID NO: 864885 - RNA, 13 nt, Homo sapiens
uugaaaagacauc

SEQ ID NO: 864886 - RNA, 16 nt, Homo sapiens
cccuacaacuccagcc

SEQ ID NO: 864887 - RNA, 20 nt, Homo sapiens
cccucauuacugccaacagu

SEQ ID NO: 864888 - RNA, 23 nt, Homo sapiens
cccucuuucagggguccuaagcc

SEQ ID NO: 864889 - RNA, 14 nt, Homo sapiens
cccugaacuggccc

SEQ ID NO: 864890 - RNA, 21 nt, Homo sapiens
cccugacugggaguugaucgc

SEQ ID NO: 864891 - RNA, 22 nt, Homo sapiens
cccugagggacuuggcaguaga

SEQ ID NO: 864892 - RNA, 17 nt, Homo sapiens
cccugcaccucauucca

SEQ ID NO: 864893 - RNA, 19 nt, Homo sapiens
cccugcgucuccugcccac

SEQ ID NO: 864894 - RNA, 17 nt, Homo sapiens
cccugcucuucagcacc

SEQ ID NO: 864895 - RNA, 17 nt, Homo sapiens
cccuguaccugugcacg

SEQ ID NO: 864896 - RNA, 17 nt, Homo sapiens
cccugucuaaaaauuca

SEQ ID NO: 864897 - RNA, 14 nt, Homo sapiens
cccuguuaccuaau

SEQ ID NO: 864898 - RNA, 22 nt, Homo sapiens
cccuucaaccauuccccauggg

SEQ ID NO: 864899 - RNA, 23 nt, Homo sapiens
cccuugaauuucuagacaguauu

SEQ ID NO: 864900 - RNA, 14 nt, Homo sapiens
cccuugugucuguu

SEQ ID NO: 864901 - RNA, 13 nt, Homo sapiens
ccgaaaucagaag

SEQ ID NO: 864902 - RNA, 15 nt, Homo sapiens
ccgagccagcagcug

SEQ ID NO: 864903 - RNA, 19 nt, Homo sapiens
ccgcaaaagacaagucuuu

SEQ ID NO: 864904 - RNA, 23 nt, Homo sapiens
ccgcaacaguuuuuuaugcuaau

SEQ ID NO: 864905 - RNA, 22 nt, Homo sapiens
ccgcuguuuuggggucuuaggg

SEQ ID NO: 864906 - RNA, 14 nt, Homo sapiens
ccgggcacugucau

SEQ ID NO: 864907 - RNA, 18 nt, Homo sapiens
ccguacgacucuuuucca

SEQ ID NO: 864908 - RNA, 17 nt, Homo sapiens
ccuaaaauaaacaugaa

SEQ ID NO: 864909 - RNA, 22 nt, Homo sapiens
ccuaaaucaaguuggcuucuaa

SEQ ID NO: 864910 - RNA, 23 nt, Homo sapiens
ccuaauagacuuagccccaugag

SEQ ID NO: 864911 - RNA, 22 nt, Homo sapiens
ccuacuuagacccagucauucu

SEQ ID NO: 864912 - RNA, 20 nt, Homo sapiens
ccuaggauuucaugauuuca

SEQ ID NO: 864913 - RNA, 14 nt, Homo sapiens
ccuauggaaagggu

SEQ ID NO: 864914 - RNA, 13 nt, Homo sapiens
ccucacuccacuc

SEQ ID NO: 864915 - RNA, 17 nt, Homo sapiens
ccucaguuuuaucauuu

SEQ ID NO: 864916 - RNA, 20 nt, Homo sapiens
ccucaguuuucagucaaguu

SEQ ID NO: 864917 - RNA, 14 nt, Homo sapiens
ccucauccaugcag

SEQ ID NO: 864918 - RNA, 21 nt, Homo sapiens
ccucauuacugccaacaguuu

SEQ ID NO: 864919 - RNA, 15 nt, Homo sapiens
ccucauucuucucuc

SEQ ID NO: 864920 - RNA, 20 nt, Homo sapiens
ccuccccaaggaagaacaaa

SEQ ID NO: 864921 - RNA, 17 nt, Homo sapiens
ccucccugcagcuuuga

SEQ ID NO: 864922 - RNA, 16 nt, Homo sapiens
ccuccugggcccucuc

SEQ ID NO: 864923 - RNA, 15 nt, Homo sapiens
ccucgcuggacucuc

SEQ ID NO: 864924 - RNA, 16 nt, Homo sapiens
ccucgggcccggccug

SEQ ID NO: 864925 - RNA, 19 nt, Homo sapiens
ccucucucucccuccacuc

SEQ ID NO: 864926 - RNA, 12 nt, Homo sapiens
ccucugacucag

SEQ ID NO: 864927 - RNA, 18 nt, Homo sapiens
ccucuggccaaauaugca

SEQ ID NO: 864928 - RNA, 21 nt, Homo sapiens
ccucuggccaaauaugcacuu

SEQ ID NO: 864929 - RNA, 20 nt, Homo sapiens
ccugagguugcuuuauccua

SEQ ID NO: 864930 - RNA, 15 nt, Homo sapiens
ccugagguuugccag

SEQ ID NO: 864931 - RNA, 20 nt, Homo sapiens
ccugagguuugccagcauuu

SEQ ID NO: 864932 - RNA, 22 nt, Homo sapiens
ccugagguuugccagcauuuag

SEQ ID NO: 864933 - RNA, 16 nt, Homo sapiens
ccugauuuguuccuuc

SEQ ID NO: 864934 - RNA, 15 nt, Homo sapiens
ccugggccacuggca

SEQ ID NO: 864935 - RNA, 20 nt, Homo sapiens
ccuggguggggcagggccug

SEQ ID NO: 864936 - RNA, 14 nt, Homo sapiens
ccuguguggugcca

SEQ ID NO: 864937 - RNA, 21 nt, Homo sapiens
ccuuaaaauuuuuuucuuucg

SEQ ID NO: 864938 - RNA, 22 nt, Homo sapiens
ccuucaugaucaucacaaucau

SEQ ID NO: 864939 - RNA, 12 nt, Homo sapiens
ccuuccacugag

SEQ ID NO: 864940 - RNA, 15 nt, Homo sapiens
ccuucuccagacaaa

SEQ ID NO: 864941 - RNA, 17 nt, Homo sapiens
ccuucuggggcuuugcc

SEQ ID NO: 864942 - RNA, 14 nt, Homo sapiens
ccuucuguggcuca

SEQ ID NO: 864943 - RNA, 15 nt, Homo sapiens
ccuugccauuuucaa

SEQ ID NO: 864944 - RNA, 19 nt, Homo sapiens
ccuugguucccccacugau

SEQ ID NO: 864945 - RNA, 14 nt, Homo sapiens
cgaacaauucauau

SEQ ID NO: 864946 - RNA, 19 nt, Homo sapiens
cgagccaaguuaagaaugu

SEQ ID NO: 864947 - RNA, 22 nt, Homo sapiens
cgagggcacuaccgggggcucu

SEQ ID NO: 864948 - RNA, 16 nt, Homo sapiens
cgcaccacuguguauu

SEQ ID NO: 864949 - RNA, 13 nt, Homo sapiens
cgccucugagcca

SEQ ID NO: 864950 - RNA, 16 nt, Homo sapiens
cgccuggguccuccca

SEQ ID NO: 864951 - RNA, 22 nt, Homo sapiens
cgcugagcgaggagaugcuccu

SEQ ID NO: 864952 - RNA, 17 nt, Homo sapiens
cggagccuccucucuca

SEQ ID NO: 864953 - RNA, 15 nt, Homo sapiens
cggagggaacccuga

SEQ ID NO: 864954 - RNA, 20 nt, Homo sapiens
cggcacggccggcgacuccc

SEQ ID NO: 864955 - RNA, 15 nt, Homo sapiens
cggccacacgugucc

SEQ ID NO: 864956 - RNA, 13 nt, Homo sapiens
cggguccccggca

SEQ ID NO: 864957 - RNA, 21 nt, Homo sapiens
cguauuuuggggaacuguugu

SEQ ID NO: 864958 - RNA, 22 nt, Homo sapiens
cgucccgggcacugucaugccc

SEQ ID NO: 864959 - RNA, 14 nt, Homo sapiens
cgucuccucuccag

SEQ ID NO: 864960 - RNA, 12 nt, Homo sapiens
cguuuaaucaca

SEQ ID NO: 864961 - RNA, 22 nt, Homo sapiens
cuaaaauuguaucaaaugugac

SEQ ID NO: 864962 - RNA, 23 nt, Homo sapiens
cuaaagaaacucagcagccucag

SEQ ID NO: 864963 - RNA, 22 nt, Homo sapiens
cuaaagaagguuucagaaagaa

SEQ ID NO: 864964 - RNA, 15 nt, Homo sapiens
cuaaagcaauaugca

SEQ ID NO: 864965 - RNA, 22 nt, Homo sapiens
cuaacaaguagcacccuggauu

SEQ ID NO: 864966 - RNA, 19 nt, Homo sapiens
cuaagaccuuggcauccuu

SEQ ID NO: 864967 - RNA, 19 nt, Homo sapiens
cuaauacagacuaugucac

SEQ ID NO: 864968 - RNA, 22 nt, Homo sapiens
cuaauagacuuagccccaugag

SEQ ID NO: 864969 - RNA, 23 nt, Homo sapiens
cuaaucagaguggccaaucccug

SEQ ID NO: 864970 - RNA, 17 nt, Homo sapiens
cuaaucagcauucucac

SEQ ID NO: 864971 - RNA, 18 nt, Homo sapiens
auggguaacacugauuac

SEQ ID NO: 864972 - RNA, 15 nt, Homo sapiens
auguaaacugugcac

SEQ ID NO: 864973 - RNA, 13 nt, Homo sapiens
auguaaauacugu

SEQ ID NO: 864974 - RNA, 23 nt, Homo sapiens
auguaacauguaggaaguaggaa

SEQ ID NO: 864975 - RNA, 12 nt, Homo sapiens
auguccaugaaa

SEQ ID NO: 864976 - RNA, 19 nt, Homo sapiens
augucccagccccugguac

SEQ ID NO: 864977 - RNA, 17 nt, Homo sapiens
augucguuugaaucaca

SEQ ID NO: 864978 - RNA, 21 nt, Homo sapiens
augucguuugaaucacaguau

SEQ ID NO: 864979 - RNA, 11 nt, Homo sapiens
augucugugau

SEQ ID NO: 864980 - RNA, 20 nt, Homo sapiens
augucuuuccuuuugcucuu

SEQ ID NO: 864981 - RNA, 11 nt, Homo sapiens
augugaugaau

SEQ ID NO: 864982 - RNA, 15 nt, Homo sapiens
auguuaucaguauua

SEQ ID NO: 864983 - RNA, 20 nt, Homo sapiens
auguugaugaaaaauagcaa

SEQ ID NO: 864984 - RNA, 14 nt, Homo sapiens
auguugcccagugu

SEQ ID NO: 864985 - RNA, 15 nt, Homo sapiens
auuaaaaugugcagu

SEQ ID NO: 864986 - RNA, 16 nt, Homo sapiens
auuaaaaugugcagua

SEQ ID NO: 864987 - RNA, 23 nt, Homo sapiens
auuaauugguuugugccuuacau

SEQ ID NO: 864988 - RNA, 20 nt, Homo sapiens
auuacaauuucuuuaaauca

SEQ ID NO: 864989 - RNA, 13 nt, Homo sapiens
auuaccuauucaa

SEQ ID NO: 864990 - RNA, 16 nt, Homo sapiens
auuaccuccugagaaa

SEQ ID NO: 864991 - RNA, 16 nt, Homo sapiens
auuagaugaacucaac

SEQ ID NO: 864992 - RNA, 13 nt, Homo sapiens
auuagcauuccau

SEQ ID NO: 864993 - RNA, 17 nt, Homo sapiens
auuauaauauacuauau

SEQ ID NO: 864994 - RNA, 16 nt, Homo sapiens
auuauaugcacuagca

SEQ ID NO: 864995 - RNA, 17 nt, Homo sapiens
auuauaugcacuagcaa

SEQ ID NO: 864996 - RNA, 13 nt, Homo sapiens
auuaugaagucau

SEQ ID NO: 864997 - RNA, 15 nt, Homo sapiens
auucaaaaaaauccu

SEQ ID NO: 864998 - RNA, 17 nt, Homo sapiens
auucacaacacaaucaa

SEQ ID NO: 864999 - RNA, 13 nt, Homo sapiens
auucacaguguga

SEQ ID NO: 865000 - RNA, 17 nt, Homo sapiens
auucagaauaaaugggu

SEQ ID NO: 865001 - RNA, 21 nt, Homo sapiens
auucaggcaugcgaaugagcu

SEQ ID NO: 865002 - RNA, 12 nt, Homo sapiens
auucaguguuaa

SEQ ID NO: 865003 - RNA, 13 nt, Homo sapiens
auucuaguacuug

SEQ ID NO: 865004 - RNA, 15 nt, Homo sapiens
auucucacagguuca

SEQ ID NO: 865005 - RNA, 14 nt, Homo sapiens
auucucaccugaau

SEQ ID NO: 865006 - RNA, 13 nt, Homo sapiens
auucucauucuca

SEQ ID NO: 865007 - RNA, 18 nt, Homo sapiens
auucucugagcugugcag

SEQ ID NO: 865008 - RNA, 19 nt, Homo sapiens
auucucugucucauccauc

SEQ ID NO: 865009 - RNA, 14 nt, Homo sapiens
auucugaguauuca

SEQ ID NO: 865010 - RNA, 18 nt, Homo sapiens
auugaaaaccucuuucca

SEQ ID NO: 865011 - RNA, 22 nt, Homo sapiens
auugaggaaaauuaauaucaca

SEQ ID NO: 865012 - RNA, 21 nt, Homo sapiens
auugccuuuggcaauucuucu

SEQ ID NO: 865013 - RNA, 19 nt, Homo sapiens
auugugcacauacuugaga

SEQ ID NO: 865014 - RNA, 14 nt, Homo sapiens
auuuaccuggaaac

SEQ ID NO: 865015 - RNA, 22 nt, Homo sapiens
auuuaguuugauuauucagugu

SEQ ID NO: 865016 - RNA, 20 nt, Homo sapiens
auuuaugccucuguauuuaa

SEQ ID NO: 865017 - RNA, 15 nt, Homo sapiens
auuucacugacacug

SEQ ID NO: 865018 - RNA, 15 nt, Homo sapiens
auuuccggccaacag

SEQ ID NO: 865019 - RNA, 21 nt, Homo sapiens
auuuccugacagaaggacuca

SEQ ID NO: 865020 - RNA, 19 nt, Homo sapiens
auuucuccuccaugggaga

SEQ ID NO: 865021 - RNA, 16 nt, Homo sapiens
auuucuucacgcaccu

SEQ ID NO: 865022 - RNA, 19 nt, Homo sapiens
auuucuucacucaaucucu

SEQ ID NO: 865023 - RNA, 18 nt, Homo sapiens
auuuggaaaauaaaucaa

SEQ ID NO: 865024 - RNA, 21 nt, Homo sapiens
auuuuaauaacuaaaccagau

SEQ ID NO: 865025 - RNA, 17 nt, Homo sapiens
auuuuccuguguccaca

SEQ ID NO: 865026 - RNA, 15 nt, Homo sapiens
auuuucugcauuuaa

SEQ ID NO: 865027 - RNA, 13 nt, Homo sapiens
auuuuugaauaca

SEQ ID NO: 865028 - RNA, 19 nt, Homo sapiens
auuuuuugcugcagacuca

SEQ ID NO: 865029 - RNA, 17 nt, Homo sapiens
caaaaauugucccuuaa

SEQ ID NO: 865030 - RNA, 15 nt, Homo sapiens
caaaaggacucucag

SEQ ID NO: 865031 - RNA, 20 nt, Homo sapiens
caaaaucagugaugggagua

SEQ ID NO: 865032 - RNA, 13 nt, Homo sapiens
caaacacuuuggc

SEQ ID NO: 865033 - RNA, 18 nt, Homo sapiens
caaaccuuuccuguaaca

SEQ ID NO: 865034 - RNA, 14 nt, Homo sapiens
caaacuaccuucca

SEQ ID NO: 865035 - RNA, 23 nt, Homo sapiens
caaacuaccuuccaguuccucau

SEQ ID NO: 865036 - RNA, 21 nt, Homo sapiens
caaacuacuggcaauuuguaa

SEQ ID NO: 865037 - RNA, 15 nt, Homo sapiens
caaacucucccuuca

SEQ ID NO: 865038 - RNA, 13 nt, Homo sapiens
caaagacauucug

SEQ ID NO: 865039 - RNA, 13 nt, Homo sapiens
caaagacuuuccu

SEQ ID NO: 865040 - RNA, 23 nt, Homo sapiens
caaagcaaggaaacuauguaaca

SEQ ID NO: 865041 - RNA, 23 nt, Homo sapiens
caaagccccuacaacuccagcca

SEQ ID NO: 865042 - RNA, 22 nt, Homo sapiens
caaagcuuucauguaaacugug

SEQ ID NO: 865043 - RNA, 18 nt, Homo sapiens
caaaggagggucaggaag

SEQ ID NO: 865044 - RNA, 20 nt, Homo sapiens
caaaggagggucaggaagga

SEQ ID NO: 865045 - RNA, 16 nt, Homo sapiens
caaaggugauuuuccu

SEQ ID NO: 865046 - RNA, 18 nt, Homo sapiens
caaauaccagagcacaga

SEQ ID NO: 865047 - RNA, 21 nt, Homo sapiens
caaaucuuaagagaauccaca

SEQ ID NO: 865048 - RNA, 13 nt, Homo sapiens
caaauguauuuca

SEQ ID NO: 865049 - RNA, 13 nt, Homo sapiens
caaaugugacauu

SEQ ID NO: 865050 - RNA, 18 nt, Homo sapiens
caaauuucaucuuuccaa

SEQ ID NO: 865051 - RNA, 19 nt, Homo sapiens
caacaaacuucaaggguuu

SEQ ID NO: 865052 - RNA, 17 nt, Homo sapiens
caacaugugcucaggga

SEQ ID NO: 865053 - RNA, 19 nt, Homo sapiens
caaccacaggcagcauuua

SEQ ID NO: 865054 - RNA, 20 nt, Homo sapiens
caacccaauaguuguugauu

SEQ ID NO: 865055 - RNA, 12 nt, Homo sapiens
caaccucaguga

SEQ ID NO: 865056 - RNA, 19 nt, Homo sapiens
caacguggggcagcacaga

SEQ ID NO: 865057 - RNA, 17 nt, Homo sapiens
caacuccagccacccag

SEQ ID NO: 865058 - RNA, 14 nt, Homo sapiens
caacuccaggguua

SEQ ID NO: 865059 - RNA, 22 nt, Homo sapiens
caacuccaggguuaaagaaagg

SEQ ID NO: 865060 - RNA, 15 nt, Homo sapiens
caacucuuugagaaa

SEQ ID NO: 865061 - RNA, 13 nt, Homo sapiens
caacuucugaaua

SEQ ID NO: 865062 - RNA, 17 nt, Homo sapiens
caacuugggaacuagac

SEQ ID NO: 865063 - RNA, 20 nt, Homo sapiens
caagaagugggauucaggaa

SEQ ID NO: 865064 - RNA, 16 nt, Homo sapiens
caagagguuaggugaa

SEQ ID NO: 865065 - RNA, 18 nt, Homo sapiens
caagaguaaauauuguca

SEQ ID NO: 865066 - RNA, 22 nt, Homo sapiens
caagauaccuucaugguguuca

SEQ ID NO: 865067 - RNA, 18 nt, Homo sapiens
caagccacagaaaugugu

SEQ ID NO: 865068 - RNA, 13 nt, Homo sapiens
caagccaggguuc

SEQ ID NO: 865069 - RNA, 20 nt, Homo sapiens
caagcuuggcuguagaagga

SEQ ID NO: 865070 - RNA, 15 nt, Homo sapiens
caaggaaaacaguaa

SEQ ID NO: 865071 - RNA, 21 nt, Homo sapiens
caaggaauguuaucaguauua

SEQ ID NO: 865072 - RNA, 21 nt, Homo sapiens
caaggccuaugccaccugcag

SEQ ID NO: 865073 - RNA, 13 nt, Homo sapiens
caagucccaugau

SEQ ID NO: 865074 - RNA, 19 nt, Homo sapiens
caagugauuugggggugca

SEQ ID NO: 865075 - RNA, 21 nt, Homo sapiens
caagugauuugggggugcaau

SEQ ID NO: 865076 - RNA, 16 nt, Homo sapiens
caauaauucuguauua

SEQ ID NO: 865077 - RNA, 18 nt, Homo sapiens
caauacccuuggcacuga

SEQ ID NO: 865078 - RNA, 18 nt, Homo sapiens
caauccagcuauguuaua

SEQ ID NO: 865079 - RNA, 18 nt, Homo sapiens
caaucuuaacaaaaguga

SEQ ID NO: 865080 - RNA, 14 nt, Homo sapiens
caaugcuuugucca

SEQ ID NO: 865081 - RNA, 18 nt, Homo sapiens
caauuauagaaagccaaa

SEQ ID NO: 865082 - RNA, 13 nt, Homo sapiens
cacaacacaauca

SEQ ID NO: 865083 - RNA, 12 nt, Homo sapiens
cacaacacugaa

SEQ ID NO: 865084 - RNA, 20 nt, Homo sapiens
cacaauagcaguugaaacaa

SEQ ID NO: 865085 - RNA, 23 nt, Homo sapiens
cacacaagcagucuuuuucuaca

SEQ ID NO: 865086 - RNA, 13 nt, Homo sapiens
cacagaggcagug

SEQ ID NO: 865087 - RNA, 23 nt, Homo sapiens
cacagauuaucuuguacagccuu

SEQ ID NO: 865088 - RNA, 22 nt, Homo sapiens
cacagcagguuuauccagauga

SEQ ID NO: 865089 - RNA, 17 nt, Homo sapiens
cacagccuccccugcca

SEQ ID NO: 865090 - RNA, 19 nt, Homo sapiens
cacaggacgauuucacuga

SEQ ID NO: 865091 - RNA, 22 nt, Homo sapiens
cacaggcagcauuuagcacaua

SEQ ID NO: 865092 - RNA, 19 nt, Homo sapiens
cacaucuaacaaagucaag

SEQ ID NO: 865093 - RNA, 18 nt, Homo sapiens
caccauuaacaggucuuu

SEQ ID NO: 865094 - RNA, 14 nt, Homo sapiens
cacccaaugcauau

SEQ ID NO: 865095 - RNA, 15 nt, Homo sapiens
cacgcguccucgggc

SEQ ID NO: 865096 - RNA, 19 nt, Homo sapiens
cacgucccgggcacuguca

SEQ ID NO: 865097 - RNA, 21 nt, Homo sapiens
cacgucccgggcacugucaug

SEQ ID NO: 865098 - RNA, 20 nt, Homo sapiens
cacugcacagugcaucucag

SEQ ID NO: 865099 - RNA, 22 nt, Homo sapiens
cacuggcuuuggguagugccau

SEQ ID NO: 865100 - RNA, 13 nt, Homo sapiens
cacugucaugccc

SEQ ID NO: 865101 - RNA, 21 nt, Homo sapiens
cacuucccauuuguguuucag

SEQ ID NO: 865102 - RNA, 21 nt, Homo sapiens
cacuugccccuguuaccuaau

SEQ ID NO: 865103 - RNA, 16 nt, Homo sapiens
cacuuggccaccagga

SEQ ID NO: 865104 - RNA, 22 nt, Homo sapiens
cacuuggccaccaggacuccuu

SEQ ID NO: 865105 - RNA, 17 nt, Homo sapiens
cagaaaaacugugggua

SEQ ID NO: 865106 - RNA, 15 nt, Homo sapiens
aaguguacuggauuu

SEQ ID NO: 865107 - RNA, 19 nt, Homo sapiens
aaguuuugccuauccuaag

SEQ ID NO: 865108 - RNA, 17 nt, Homo sapiens
aauaacccugaaucaga

SEQ ID NO: 865109 - RNA, 19 nt, Homo sapiens
aauaaggccucauccucca

SEQ ID NO: 865110 - RNA, 16 nt, Homo sapiens
aauacaauacaguacu

SEQ ID NO: 865111 - RNA, 16 nt, Homo sapiens
aauacaguacaguacu

SEQ ID NO: 865112 - RNA, 23 nt, Homo sapiens
aauaguaaaggaaagcaguguug

SEQ ID NO: 865113 - RNA, 12 nt, Homo sapiens
aauauaaacugu

SEQ ID NO: 865114 - RNA, 16 nt, Homo sapiens
aauauaaacugugaga

SEQ ID NO: 865115 - RNA, 21 nt, Homo sapiens
aauauaggguuuguuugcugc

SEQ ID NO: 865116 - RNA, 19 nt, Homo sapiens
aaucuagagcuaugcacac

SEQ ID NO: 865117 - RNA, 22 nt, Homo sapiens
aaucuagagcuaugcacaccaa

SEQ ID NO: 865118 - RNA, 15 nt, Homo sapiens
aaugcaaugcucagu

SEQ ID NO: 865119 - RNA, 15 nt, Homo sapiens
aaugcuaagccaguu

SEQ ID NO: 865120 - RNA, 14 nt, Homo sapiens
aaugcuaagggcag

SEQ ID NO: 865121 - RNA, 14 nt, Homo sapiens
aaugcucaaugugc

SEQ ID NO: 865122 - RNA, 17 nt, Homo sapiens
aauguaucaacauauuu

SEQ ID NO: 865123 - RNA, 13 nt, Homo sapiens
aaugucucaaaau

SEQ ID NO: 865124 - RNA, 15 nt, Homo sapiens
aauuccaaucauugu

SEQ ID NO: 865125 - RNA, 20 nt, Homo sapiens
aauuuaaggccugcacucuu

SEQ ID NO: 865126 - RNA, 15 nt, Homo sapiens
acaacaggauuuuca

SEQ ID NO: 865127 - RNA, 14 nt, Homo sapiens
acaaccauguucuu

SEQ ID NO: 865128 - RNA, 18 nt, Homo sapiens
acacagugcaguacucag

SEQ ID NO: 865129 - RNA, 11 nt, Homo sapiens
acacugucaag

SEQ ID NO: 865130 - RNA, 17 nt, Homo sapiens
acaguacaguacucagu

SEQ ID NO: 865131 - RNA, 20 nt, Homo sapiens
acaguacucaggcagugcaa

SEQ ID NO: 865132 - RNA, 15 nt, Homo sapiens
acagugcaguacuca

SEQ ID NO: 865133 - RNA, 17 nt, Homo sapiens
acagugcaguacucagu

SEQ ID NO: 865134 - RNA, 15 nt, Homo sapiens
acaguguaguacuca

SEQ ID NO: 865135 - RNA, 15 nt, Homo sapiens
acaguguagugcuca

SEQ ID NO: 865136 - RNA, 13 nt, Homo sapiens
acauaacacacau

SEQ ID NO: 865137 - RNA, 18 nt, Homo sapiens
acauaacacacaucaguc

SEQ ID NO: 865138 - RNA, 14 nt, Homo sapiens
acauaccacacuua

SEQ ID NO: 865139 - RNA, 23 nt, Homo sapiens
acaucaguccacccccauuguga

SEQ ID NO: 865140 - RNA, 14 nt, Homo sapiens
acaucucuucaugc

SEQ ID NO: 865141 - RNA, 18 nt, Homo sapiens
acauucccaugaauauca

SEQ ID NO: 865142 - RNA, 22 nt, Homo sapiens
accaaaugccuuucuagcaauu

SEQ ID NO: 865143 - RNA, 16 nt, Homo sapiens
accagagcgauguguu

SEQ ID NO: 865144 - RNA, 17 nt, Homo sapiens
accauuuccccuguggu

SEQ ID NO: 865145 - RNA, 14 nt, Homo sapiens
accccauagugccu

SEQ ID NO: 865146 - RNA, 14 nt, Homo sapiens
acccugaaucagag

SEQ ID NO: 865147 - RNA, 21 nt, Homo sapiens
accucucugaacugcaacacu

SEQ ID NO: 865148 - RNA, 11 nt, Homo sapiens
accucuuguuu

SEQ ID NO: 865149 - RNA, 20 nt, Homo sapiens
accucuuuucauggaguaga

SEQ ID NO: 865150 - RNA, 19 nt, Homo sapiens
accugagcauauguacaca

SEQ ID NO: 865151 - RNA, 23 nt, Homo sapiens
accugcuuugagauuuccugaca

SEQ ID NO: 865152 - RNA, 19 nt, Homo sapiens
accuggagccaucuuccua

SEQ ID NO: 865153 - RNA, 21 nt, Homo sapiens
accuggcuacaauuacuuuga

SEQ ID NO: 865154 - RNA, 19 nt, Homo sapiens
accuggguaacaaagugag

SEQ ID NO: 865155 - RNA, 19 nt, Homo sapiens
accuguaggucuaugaugu

SEQ ID NO: 865156 - RNA, 12 nt, Homo sapiens
accuugcugcua

SEQ ID NO: 865157 - RNA, 13 nt, Homo sapiens
acgugacuccuca

SEQ ID NO: 865158 - RNA, 19 nt, Homo sapiens
acuaaugucagcacauguu

SEQ ID NO: 865159 - RNA, 16 nt, Homo sapiens
acuaauuaaacugaug

SEQ ID NO: 865160 - RNA, 14 nt, Homo sapiens
acuacgacuggcau

SEQ ID NO: 865161 - RNA, 17 nt, Homo sapiens
acuaucauaguuauuaa

SEQ ID NO: 865162 - RNA, 18 nt, Homo sapiens
acucaggcagugcaguac

SEQ ID NO: 865163 - RNA, 13 nt, Homo sapiens
uuuaaucauuucc

SEQ ID NO: 865164 - RNA, 18 nt, Homo sapiens
uuuagaaucaagucugug

SEQ ID NO: 865165 - RNA, 20 nt, Homo sapiens
uuuaggaaagcagugcagua

SEQ ID NO: 865166 - RNA, 23 nt, Homo sapiens
uuuaggaaugcucaaugugcugu

SEQ ID NO: 865167 - RNA, 19 nt, Homo sapiens
uuuagguaaaaagcuuaaa

SEQ ID NO: 865168 - RNA, 16 nt, Homo sapiens
uuuaggugccuggaua

SEQ ID NO: 865169 - RNA, 17 nt, Homo sapiens
uuuauaaaagacaugaa

SEQ ID NO: 865170 - RNA, 16 nt, Homo sapiens
uuucccacauucccau

SEQ ID NO: 865171 - RNA, 22 nt, Homo sapiens
uuuccccugugguuuguuauca

SEQ ID NO: 865172 - RNA, 14 nt, Homo sapiens
uuuccugaaauucu

SEQ ID NO: 865173 - RNA, 16 nt, Homo sapiens
uuuccugugccuaaca

SEQ ID NO: 865174 - RNA, 22 nt, Homo sapiens
uuucucaugguauuaucuagua

SEQ ID NO: 865175 - RNA, 13 nt, Homo sapiens
uuugggaaauucu

SEQ ID NO: 865176 - RNA, 16 nt, Homo sapiens
uuugugaagugauuga

SEQ ID NO: 865177 - RNA, 23 nt, Homo sapiens
uuuuaaaaaagauggauuugaca

SEQ ID NO: 865178 - RNA, 12 nt, Homo sapiens
uuuugauugcau

SEQ ID NO: 865179 - RNA, 21 nt, Homo sapiens
cauuuaagaauuuaccagaaa

SEQ ID NO: 865180 - RNA, 13 nt, Homo sapiens
cauuuauguguga

SEQ ID NO: 865181 - RNA, 15 nt, Homo sapiens
cauuuuucuacugcu

SEQ ID NO: 865182 - RNA, 20 nt, Homo sapiens
ccaagaggaaaauauugaca

SEQ ID NO: 865183 - RNA, 19 nt, Homo sapiens
ccaagguaaacaguuugaa

SEQ ID NO: 865184 - RNA, 17 nt, Homo sapiens
ccaaguuggagugcagu

SEQ ID NO: 865185 - RNA, 12 nt, Homo sapiens
ccacccuaucau

SEQ ID NO: 865186 - RNA, 14 nt, Homo sapiens
ccacugaagaguau

SEQ ID NO: 865187 - RNA, 15 nt, Homo sapiens
ccagaagcagcagcu

SEQ ID NO: 865188 - RNA, 18 nt, Homo sapiens
ccagaggcucuaauguac

SEQ ID NO: 865189 - RNA, 20 nt, Homo sapiens
ccagccugcucccuagccag

SEQ ID NO: 865190 - RNA, 15 nt, Homo sapiens
ccaguuaacuguuaa

SEQ ID NO: 865191 - RNA, 14 nt, Homo sapiens
ccaguucugaugag

SEQ ID NO: 865192 - RNA, 21 nt, Homo sapiens
ccaugguagacugugacacag

SEQ ID NO: 865193 - RNA, 14 nt, Homo sapiens
ccauggugaacuga

SEQ ID NO: 865194 - RNA, 16 nt, Homo sapiens
ccaugugcugcugugg

SEQ ID NO: 865195 - RNA, 19 nt, Homo sapiens
ccauguucuugagcagcug

SEQ ID NO: 865196 - RNA, 21 nt, Homo sapiens
ccauguuuaaguguacuggau

SEQ ID NO: 865197 - RNA, 17 nt, Homo sapiens
cccaaaucucaaaagau

SEQ ID NO: 865198 - RNA, 21 nt, Homo sapiens
cccaagguaaacaguuugaaa

SEQ ID NO: 865199 - RNA, 19 nt, Homo sapiens
cccaaguuggagugcagug

SEQ ID NO: 865200 - RNA, 18 nt, Homo sapiens
cccaugguagacugugac

SEQ ID NO: 865201 - RNA, 21 nt, Homo sapiens
cccaugguagacugugacaca

SEQ ID NO: 865202 - RNA, 22 nt, Homo sapiens
ccccagccugcucccuagccag

SEQ ID NO: 865203 - RNA, 21 nt, Homo sapiens
ccccagguaucugaugauguu

SEQ ID NO: 865204 - RNA, 17 nt, Homo sapiens
ccccuccgugcuuuucu

SEQ ID NO: 865205 - RNA, 17 nt, Homo sapiens
ccccuggacauauuccc

SEQ ID NO: 865206 - RNA, 17 nt, Homo sapiens
cccugacuucccagcug

SEQ ID NO: 865207 - RNA, 13 nt, Homo sapiens
cccugcuggacca

SEQ ID NO: 865208 - RNA, 19 nt, Homo sapiens
cccuucaaugcaaaauaca

SEQ ID NO: 865209 - RNA, 20 nt, Homo sapiens
ccuagacucuaaaacuauca

SEQ ID NO: 865210 - RNA, 16 nt, Homo sapiens
ccuagccagaggcucu

SEQ ID NO: 865211 - RNA, 14 nt, Homo sapiens
ccuaucaucaguua

SEQ ID NO: 865212 - RNA, 20 nt, Homo sapiens
ccucauuguucagaaaagca

SEQ ID NO: 865213 - RNA, 13 nt, Homo sapiens
ccuccugaugucu

SEQ ID NO: 865214 - RNA, 17 nt, Homo sapiens
ccucuucuugcggcacc

SEQ ID NO: 865215 - RNA, 16 nt, Homo sapiens
ccucuuucucucugug

SEQ ID NO: 865216 - RNA, 16 nt, Homo sapiens
ccugagccugucucuc

SEQ ID NO: 865217 - RNA, 16 nt, Homo sapiens
ccuggacauauuccca

SEQ ID NO: 865218 - RNA, 18 nt, Homo sapiens
ccugggcaacagagugag

SEQ ID NO: 865219 - RNA, 18 nt, Homo sapiens
ccuggguaacaaagugag

SEQ ID NO: 865220 - RNA, 18 nt, Homo sapiens
ccuguccucuacauacca

SEQ ID NO: 865221 - RNA, 17 nt, Homo sapiens
ccugugccuaacagcau

SEQ ID NO: 865222 - RNA, 21 nt, Homo sapiens
ccugugggaguccacuuuccu

SEQ ID NO: 865223 - RNA, 23 nt, Homo sapiens
ccuucaaugcaaaauacaugaug

SEQ ID NO: 865224 - RNA, 16 nt, Homo sapiens
ccuucuaauccaugug

SEQ ID NO: 865225 - RNA, 18 nt, Homo sapiens
ccuucugugcaucuggcc

SEQ ID NO: 865226 - RNA, 21 nt, Homo sapiens
ccuugcauuuuagcuaauuua

SEQ ID NO: 865227 - RNA, 17 nt, Homo sapiens
ccuuuggcaauaucaua

SEQ ID NO: 865228 - RNA, 13 nt, Homo sapiens
cgcgcaccgccca

SEQ ID NO: 865229 - RNA, 18 nt, Homo sapiens
cgguugguaccaugcuaa

SEQ ID NO: 865230 - RNA, 19 nt, Homo sapiens
cgucuaaacuguuuacuca

SEQ ID NO: 865231 - RNA, 19 nt, Homo sapiens
cgucugggguggcucugca

SEQ ID NO: 865232 - RNA, 13 nt, Homo sapiens
cgugcccccagcg

SEQ ID NO: 865233 - RNA, 14 nt, Homo sapiens
cguggcaacugugg

SEQ ID NO: 865234 - RNA, 14 nt, Homo sapiens
cgugugaggaugug

SEQ ID NO: 865235 - RNA, 11 nt, Homo sapiens
ucauuauuagu

SEQ ID NO: 865236 - RNA, 21 nt, Homo sapiens
ucauuguucagaaaagcaccu

SEQ ID NO: 865237 - RNA, 17 nt, Homo sapiens
uccacaguuaggccaag

SEQ ID NO: 865238 - RNA, 19 nt, Homo sapiens
uccagaugugccuagacac

SEQ ID NO: 865239 - RNA, 18 nt, Homo sapiens
uccagcuaagccugauga

SEQ ID NO: 865240 - RNA, 22 nt, Homo sapiens
uccaggagaugaggcuggauag

SEQ ID NO: 865241 - RNA, 17 nt, Homo sapiens
ucccaguuaacuguuaa

SEQ ID NO: 865242 - RNA, 21 nt, Homo sapiens
ucccaugguagacugugacac

SEQ ID NO: 865243 - RNA, 16 nt, Homo sapiens
uccccaagagcuguua

SEQ ID NO: 865244 - RNA, 13 nt, Homo sapiens
uccccagccugcu

SEQ ID NO: 865245 - RNA, 12 nt, Homo sapiens
uccccagggugc

SEQ ID NO: 865246 - RNA, 21 nt, Homo sapiens
ucccgguguaugcagugguga

SEQ ID NO: 865247 - RNA, 20 nt, Homo sapiens
ucccuagccagaggcucuaa

SEQ ID NO: 865248 - RNA, 23 nt, Homo sapiens
ucccuagccagaggcucuaaugu

SEQ ID NO: 865249 - RNA, 14 nt, Homo sapiens
ucccuugauucaaa

SEQ ID NO: 865250 - RNA, 11 nt, Homo sapiens
uccgugcuuuu

SEQ ID NO: 865251 - RNA, 11 nt, Homo sapiens
uccuacaaggg

SEQ ID NO: 865252 - RNA, 14 nt, Homo sapiens
uccucauggcuguu

SEQ ID NO: 865253 - RNA, 17 nt, Homo sapiens
uccugaacucccaguca

SEQ ID NO: 865254 - RNA, 22 nt, Homo sapiens
uccugcgggcgggcgucugcug

SEQ ID NO: 865255 - RNA, 23 nt, Homo sapiens
uccugcugcucgggaaggccuga

SEQ ID NO: 865256 - RNA, 19 nt, Homo sapiens
uccugucuccucugucagu

SEQ ID NO: 865257 - RNA, 19 nt, Homo sapiens
uccuucaugcuuuucucau

SEQ ID NO: 865258 - RNA, 16 nt, Homo sapiens
uccuuuggcaauauca

SEQ ID NO: 865259 - RNA, 17 nt, Homo sapiens
ucggacaccaucuuggg

SEQ ID NO: 865260 - RNA, 21 nt, Homo sapiens
ucgucugggguggcucugcag

SEQ ID NO: 865261 - RNA, 16 nt, Homo sapiens
ucuaaaucauaaucau

SEQ ID NO: 865262 - RNA, 20 nt, Homo sapiens
ucuaagaaauggcuuuccac

SEQ ID NO: 865263 - RNA, 16 nt, Homo sapiens
ucuaauccaugugcug

SEQ ID NO: 865264 - RNA, 14 nt, Homo sapiens
ucuaauguacaaua

SEQ ID NO: 865265 - RNA, 21 nt, Homo sapiens
ucuaauguacaauaaagcaau

SEQ ID NO: 865266 - RNA, 15 nt, Homo sapiens
ucuauuucaacuuca

SEQ ID NO: 865267 - RNA, 16 nt, Homo sapiens
ucuauuucaacuucag

SEQ ID NO: 865268 - RNA, 23 nt, Homo sapiens
ucucaaaauaaaaccagaaagag

SEQ ID NO: 865269 - RNA, 16 nt, Homo sapiens
ucucaacuuacauaug

SEQ ID NO: 865270 - RNA, 14 nt, Homo sapiens
ucucaaucauggga

SEQ ID NO: 865271 - RNA, 16 nt, Homo sapiens
ucucacgauaugcaag

SEQ ID NO: 865272 - RNA, 21 nt, Homo sapiens
ucucaugguauuaucuaguag

SEQ ID NO: 865273 - RNA, 13 nt, Homo sapiens
ucuccucugucag

SEQ ID NO: 865274 - RNA, 18 nt, Homo sapiens
ucuccugugcaccugacu

SEQ ID NO: 865275 - RNA, 18 nt, Homo sapiens
ucugcauuucuacauguu

SEQ ID NO: 865276 - RNA, 16 nt, Homo sapiens
ucugcuuugcuguuau

SEQ ID NO: 865277 - RNA, 20 nt, Homo sapiens
ucugucccaguuaacuguua

SEQ ID NO: 865278 - RNA, 23 nt, Homo sapiens
ucugugaaagucuccuguaucau

SEQ ID NO: 865279 - RNA, 14 nt, Homo sapiens
ucugugcaacaaac

SEQ ID NO: 865280 - RNA, 14 nt, Homo sapiens
ucuguuccaagugu

SEQ ID NO: 865281 - RNA, 20 nt, Homo sapiens
ucuuacuaaccaccauuucc

SEQ ID NO: 865282 - RNA, 19 nt, Homo sapiens
ucuuaggcacuuuuuaaca

SEQ ID NO: 865283 - RNA, 15 nt, Homo sapiens
ucuucaauccccaua

SEQ ID NO: 865284 - RNA, 20 nt, Homo sapiens
ucuucucagcuccacucuga

SEQ ID NO: 865285 - RNA, 17 nt, Homo sapiens
ucuuguaaaacugugac

SEQ ID NO: 865286 - RNA, 24 nt, Homo sapiens
ucuuuaccuugcauuuuagcuaau

SEQ ID NO: 865287 - RNA, 16 nt, Homo sapiens
ucuuuacuaacacugg

SEQ ID NO: 865288 - RNA, 12 nt, Homo sapiens
ucuuuuuacaau

SEQ ID NO: 865289 - RNA, 21 nt, Homo sapiens
ugaaaaauaguguguccaugc

SEQ ID NO: 865290 - RNA, 22 nt, Homo sapiens
ugaaaaauaguguguccaugca

SEQ ID NO: 865291 - RNA, 15 nt, Homo sapiens
auucaaucauuuugg

SEQ ID NO: 865292 - RNA, 15 nt, Homo sapiens
auucaguaaggcagu

SEQ ID NO: 865293 - RNA, 22 nt, Homo sapiens
auucccaugguagacugugaca

SEQ ID NO: 865294 - RNA, 23 nt, Homo sapiens
auuccuccugucuccucugucag

SEQ ID NO: 865295 - RNA, 18 nt, Homo sapiens
auucuaauuagauuaacc

SEQ ID NO: 865296 - RNA, 22 nt, Homo sapiens
auucugcuugguuccacaauca

SEQ ID NO: 865297 - RNA, 23 nt, Homo sapiens
auucugcuugguuccacaaucau

SEQ ID NO: 865298 - RNA, 22 nt, Homo sapiens
auucuuucaauccacaguauug

SEQ ID NO: 865299 - RNA, 17 nt, Homo sapiens
auugaaggauugugaac

SEQ ID NO: 865300 - RNA, 15 nt, Homo sapiens
auugagacacuguca

SEQ ID NO: 865301 - RNA, 15 nt, Homo sapiens
auugaugaacugcca

SEQ ID NO: 865302 - RNA, 16 nt, Homo sapiens
auugauguaacugugu

SEQ ID NO: 865303 - RNA, 21 nt, Homo sapiens
auuguucuuuuuuaagacuca

SEQ ID NO: 865304 - RNA, 23 nt, Homo sapiens
auuuaaaaaacauuuuacagauu

SEQ ID NO: 865305 - RNA, 16 nt, Homo sapiens
auuuaaucauuuccag

SEQ ID NO: 865306 - RNA, 21 nt, Homo sapiens
auuuaggaaagcagugcagua

SEQ ID NO: 865307 - RNA, 15 nt, Homo sapiens
auuugcugcauuuca

SEQ ID NO: 865308 - RNA, 19 nt, Homo sapiens
auuuuauugcuggaaucua

SEQ ID NO: 865309 - RNA, 20 nt, Homo sapiens
auuuucaaguggaaaccuug

SEQ ID NO: 865310 - RNA, 22 nt, Homo sapiens
auuuuuccucuuucacuucuua

SEQ ID NO: 865311 - RNA, 19 nt, Homo sapiens
caaaaacuuuccaugacag

SEQ ID NO: 865312 - RNA, 21 nt, Homo sapiens
caaaacaacagcaacaacaac

SEQ ID NO: 865313 - RNA, 18 nt, Homo sapiens
caaaagguuaauggaugg

SEQ ID NO: 865314 - RNA, 17 nt, Homo sapiens
caaaccugauacaauuu

SEQ ID NO: 865315 - RNA, 15 nt, Homo sapiens
caaacuguacaguuu

SEQ ID NO: 865316 - RNA, 22 nt, Homo sapiens
caaacuguacaguuucuucccc

SEQ ID NO: 865317 - RNA, 14 nt, Homo sapiens
caaagcaugcucag

SEQ ID NO: 865318 - RNA, 21 nt, Homo sapiens
caaauguuauucaauaacuau

SEQ ID NO: 865319 - RNA, 18 nt, Homo sapiens
caaauucucuauguacag

SEQ ID NO: 865320 - RNA, 13 nt, Homo sapiens
caaauugcugaga

SEQ ID NO: 865321 - RNA, 13 nt, Homo sapiens
caacuuacauaug

SEQ ID NO: 865322 - RNA, 22 nt, Homo sapiens
caagcacuggacuacaagggca

SEQ ID NO: 865323 - RNA, 21 nt, Homo sapiens
caagccugaaaguaauuucaa

SEQ ID NO: 865324 - RNA, 12 nt, Homo sapiens
caaguguuacag

SEQ ID NO: 865325 - RNA, 13 nt, Homo sapiens
caauaaagcaaug

SEQ ID NO: 865326 - RNA, 15 nt, Homo sapiens
caauaaagcaaugug

SEQ ID NO: 865327 - RNA, 22 nt, Homo sapiens
caauacaaguuacauacauuua

SEQ ID NO: 865328 - RNA, 17 nt, Homo sapiens
caauggugaacugucau

SEQ ID NO: 865329 - RNA, 16 nt, Homo sapiens
caauguaguacucagu

SEQ ID NO: 865330 - RNA, 23 nt, Homo sapiens
caaugugcuguugauucuuucaa

SEQ ID NO: 865331 - RNA, 20 nt, Homo sapiens
caauguggaauuacauaaca

SEQ ID NO: 865332 - RNA, 20 nt, Homo sapiens
cacaaccuccuccuccaguu

SEQ ID NO: 865333 - RNA, 23 nt, Homo sapiens
cacaagguugcuggcauuugcug

SEQ ID NO: 865334 - RNA, 19 nt, Homo sapiens
cacaaguuuuuuuguucau

SEQ ID NO: 865335 - RNA, 15 nt, Homo sapiens
cacaauacaguacuc

SEQ ID NO: 865336 - RNA, 13 nt, Homo sapiens
cacacaacugugg

SEQ ID NO: 865337 - RNA, 13 nt, Homo sapiens
cacagggacacag

SEQ ID NO: 865338 - RNA, 21 nt, Homo sapiens
cacaguaguguucuguucacu

SEQ ID NO: 865339 - RNA, 23 nt, Homo sapiens
cacagugcaguacucaguaauac

SEQ ID NO: 865340 - RNA, 18 nt, Homo sapiens
cacauguugcuaaugaca

SEQ ID NO: 865341 - RNA, 15 nt, Homo sapiens
caccagccugagcca

SEQ ID NO: 865342 - RNA, 13 nt, Homo sapiens
cacccguguucuc

SEQ ID NO: 865343 - RNA, 16 nt, Homo sapiens
caccgagaggaaaaag

SEQ ID NO: 865344 - RNA, 15 nt, Homo sapiens
caccuaucuggaaaa

SEQ ID NO: 865345 - RNA, 18 nt, Homo sapiens
cacucaucagguaaacug

SEQ ID NO: 865346 - RNA, 22 nt, Homo sapiens
cacuccacaguuaggccaagaa

SEQ ID NO: 865347 - RNA, 20 nt, Homo sapiens
agcccuguguauaaagccau

SEQ ID NO: 865348 - RNA, 12 nt, Homo sapiens
agccugcucccu

SEQ ID NO: 865349 - RNA, 17 nt, Homo sapiens
agccugucucucccuac

SEQ ID NO: 865350 - RNA, 18 nt, Homo sapiens
agccuuuaauaggcuugu

SEQ ID NO: 865351 - RNA, 15 nt, Homo sapiens
agcuaagccugauga

SEQ ID NO: 865352 - RNA, 16 nt, Homo sapiens
agcugcuguuuuuaga

SEQ ID NO: 865353 - RNA, 16 nt, Homo sapiens
aggaaaauauugacaa

SEQ ID NO: 865354 - RNA, 20 nt, Homo sapiens
aggaaaauauugacaaguuu

SEQ ID NO: 865355 - RNA, 13 nt, Homo sapiens
aggaaagauccca

SEQ ID NO: 865356 - RNA, 16 nt, Homo sapiens
aggaaagcagugcagu

SEQ ID NO: 865357 - RNA, 15 nt, Homo sapiens
aggacucccugcuua

SEQ ID NO: 865358 - RNA, 13 nt, Homo sapiens
aggagaguguuua

SEQ ID NO: 865359 - RNA, 13 nt, Homo sapiens
aggcaauggugaa

SEQ ID NO: 865360 - RNA, 22 nt, Homo sapiens
aggcaauggugaacugucauua

SEQ ID NO: 865361 - RNA, 11 nt, Homo sapiens
aggcagugcag

SEQ ID NO: 865362 - RNA, 13 nt, Homo sapiens
aggcagugcagug

SEQ ID NO: 865363 - RNA, 12 nt, Homo sapiens
aggccaagcccc

SEQ ID NO: 865364 - RNA, 12 nt, Homo sapiens
aggcucuaaugu

SEQ ID NO: 865365 - RNA, 16 nt, Homo sapiens
aggcucuaauguacaa

SEQ ID NO: 865366 - RNA, 17 nt, Homo sapiens
aggcucuaauguacaau

SEQ ID NO: 865367 - RNA, 23 nt, Homo sapiens
aggcugagucagccccacuccac

SEQ ID NO: 865368 - RNA, 15 nt, Homo sapiens
aggcuuagugcuugg

SEQ ID NO: 865369 - RNA, 18 nt, Homo sapiens
agggacuccagaagcagc

SEQ ID NO: 865370 - RNA, 20 nt, Homo sapiens
agggguuugcuuacagugau

SEQ ID NO: 865371 - RNA, 22 nt, Homo sapiens
agguaaauaaucauacacagaa

SEQ ID NO: 865372 - RNA, 18 nt, Homo sapiens
agguaucaaaauguuguc

SEQ ID NO: 865373 - RNA, 14 nt, Homo sapiens
agguaucugaugau

SEQ ID NO: 865374 - RNA, 23 nt, Homo sapiens
aggugacuuuccuaugacacuca

SEQ ID NO: 865375 - RNA, 16 nt, Homo sapiens
agguggaguaggugaa

SEQ ID NO: 865376 - RNA, 21 nt, Homo sapiens
agguuggagugcauucauuca

SEQ ID NO: 865377 - RNA, 21 nt, Homo sapiens
aguaaaucagugcaguacuca

SEQ ID NO: 865378 - RNA, 13 nt, Homo sapiens
aguaacacagugc

SEQ ID NO: 865379 - RNA, 21 nt, Homo sapiens
aguaacacagugcagugcuca

SEQ ID NO: 865380 - RNA, 13 nt, Homo sapiens
aguaacacagugu

SEQ ID NO: 865381 - RNA, 19 nt, Homo sapiens
aguaacagugcaguacuca

SEQ ID NO: 865382 - RNA, 16 nt, Homo sapiens
aguaagacagugcagu

SEQ ID NO: 865383 - RNA, 16 nt, Homo sapiens
aguaaggcagugcagu

SEQ ID NO: 865384 - RNA, 22 nt, Homo sapiens
aguaauuucaagaauguuucag

SEQ ID NO: 865385 - RNA, 14 nt, Homo sapiens
aguacucaguaaau

SEQ ID NO: 865386 - RNA, 19 nt, Homo sapiens
aguacucaguaacacagug

SEQ ID NO: 865387 - RNA, 22 nt, Homo sapiens
aguacucaguaacagugcagua

SEQ ID NO: 865388 - RNA, 15 nt, Homo sapiens
aguacucaguacuau

SEQ ID NO: 865389 - RNA, 23 nt, Homo sapiens
aguauggauugaaggauugugaa

SEQ ID NO: 865390 - RNA, 13 nt, Homo sapiens
aguauugagacac

SEQ ID NO: 865391 - RNA, 15 nt, Homo sapiens
agucaagcugaugaa

SEQ ID NO: 865392 - RNA, 21 nt, Homo sapiens
aguccaaaauaucgagugaau

SEQ ID NO: 865393 - RNA, 17 nt, Homo sapiens
aguccacccccauugug

SEQ ID NO: 865394 - RNA, 17 nt, Homo sapiens
aguccagaugugccuag

SEQ ID NO: 865395 - RNA, 23 nt, Homo sapiens
agucccuccgacuucucuagaca

SEQ ID NO: 865396 - RNA, 15 nt, Homo sapiens
agugcagugcucagu

SEQ ID NO: 865397 - RNA, 16 nt, Homo sapiens
agugcagugcucagua

SEQ ID NO: 865398 - RNA, 14 nt, Homo sapiens
agugcauucauuca

SEQ ID NO: 865399 - RNA, 12 nt, Homo sapiens
agugcuacagau

SEQ ID NO: 865400 - RNA, 15 nt, Homo sapiens
aguguaauaaaucaa

SEQ ID NO: 865401 - RNA, 17 nt, Homo sapiens
aguguacuggauuuaac

SEQ ID NO: 865402 - RNA, 17 nt, Homo sapiens
aguguagaucaacucau

SEQ ID NO: 865403 - RNA, 17 nt, Homo sapiens
aguuaggcagugcagua

SEQ ID NO: 865404 - RNA, 15 nt, Homo sapiens
aaacuguacaguuuc

SEQ ID NO: 865405 - RNA, 16 nt, Homo sapiens
aaagcaaugugguagu

SEQ ID NO: 865406 - RNA, 18 nt, Homo sapiens
aaagcagugcaguacuca

SEQ ID NO: 865407 - RNA, 15 nt, Homo sapiens
aaaguuaaacgugau

SEQ ID NO: 865408 - RNA, 18 nt, Homo sapiens
aaauaacccugaaucaga

SEQ ID NO: 865409 - RNA, 17 nt, Homo sapiens
aaauaaucauacacaga

SEQ ID NO: 865410 - RNA, 15 nt, Homo sapiens
aaauaccagccagca

SEQ ID NO: 865411 - RNA, 15 nt, Homo sapiens
aaauauaaacuguga

SEQ ID NO: 865412 - RNA, 18 nt, Homo sapiens
aaauaucccucauuucau

SEQ ID NO: 865413 - RNA, 15 nt, Homo sapiens
aaauauuugcucaau

SEQ ID NO: 865414 - RNA, 20 nt, Homo sapiens
aaaucuguauugcuaagaua

SEQ ID NO: 865415 - RNA, 16 nt, Homo sapiens
aaaugaaauacuugac

SEQ ID NO: 865416 - RNA, 20 nt, Homo sapiens
aaaugagccuuucugccuca

SEQ ID NO: 865417 - RNA, 16 nt, Homo sapiens
aaaugaguucccuuga

SEQ ID NO: 865418 - RNA, 21 nt, Homo sapiens
aaauuagggcucuaauuuccu

SEQ ID NO: 865419 - RNA, 14 nt, Homo sapiens
aaauuaucuuuaaa

SEQ ID NO: 865420 - RNA, 22 nt, Homo sapiens
aaauuaugucaaauggauguaa

SEQ ID NO: 865421 - RNA, 13 nt, Homo sapiens
aaauucacaaagu

SEQ ID NO: 865422 - RNA, 16 nt, Homo sapiens
aacaaagcaugcucag

SEQ ID NO: 865423 - RNA, 20 nt, Homo sapiens
aacacacacacacacaaaac

SEQ ID NO: 865424 - RNA, 16 nt, Homo sapiens
aacaugguuaccucug

SEQ ID NO: 865425 - RNA, 19 nt, Homo sapiens
aaccacccuaucaucaguu

SEQ ID NO: 865426 - RNA, 17 nt, Homo sapiens
aacccgggcgcugccug

SEQ ID NO: 865427 - RNA, 17 nt, Homo sapiens
aaccuccuccuccaguu

SEQ ID NO: 865428 - RNA, 23 nt, Homo sapiens
aaccuguucacgugacuccucaa

SEQ ID NO: 865429 - RNA, 20 nt, Homo sapiens
aacugaguuagaauguugaa

SEQ ID NO: 865430 - RNA, 19 nt, Homo sapiens
aacuguaaaauacuucuuu

SEQ ID NO: 865431 - RNA, 15 nt, Homo sapiens
aacuuacauaugucu

SEQ ID NO: 865432 - RNA, 15 nt, Homo sapiens
aacuucuauuuucaa

SEQ ID NO: 865433 - RNA, 17 nt, Homo sapiens
aacuucuuaacuggcaa

SEQ ID NO: 865434 - RNA, 14 nt, Homo sapiens
aacuuggugccuaa

SEQ ID NO: 865435 - RNA, 13 nt, Homo sapiens
aagaaaacaacca

SEQ ID NO: 865436 - RNA, 20 nt, Homo sapiens
aagaaauuagggcucuaauu

SEQ ID NO: 865437 - RNA, 17 nt, Homo sapiens
aagaauauauugccaaa

SEQ ID NO: 865438 - RNA, 16 nt, Homo sapiens
aagaauuuaccagaaa

SEQ ID NO: 865439 - RNA, 13 nt, Homo sapiens
aagacaaaugggc

SEQ ID NO: 865440 - RNA, 22 nt, Homo sapiens
aagacaaaugggccugccaaac

SEQ ID NO: 865441 - RNA, 21 nt, Homo sapiens
aagagaaaaagcccucuucaa

SEQ ID NO: 865442 - RNA, 13 nt, Homo sapiens
aagaucaagcucc

SEQ ID NO: 865443 - RNA, 20 nt, Homo sapiens
aagaucaagcuccaucuuau

SEQ ID NO: 865444 - RNA, 11 nt, Homo sapiens
aagauggauuu

SEQ ID NO: 865445 - RNA, 12 nt, Homo sapiens
aagcaauguggu

SEQ ID NO: 865446 - RNA, 20 nt, Homo sapiens
aagcauuugacuuucugucu

SEQ ID NO: 865447 - RNA, 22 nt, Homo sapiens
aagcccagccuaucucucuucu

SEQ ID NO: 865448 - RNA, 21 nt, Homo sapiens
aagcuccaucuuauuugucag

SEQ ID NO: 865449 - RNA, 22 nt, Homo sapiens
aagcugaugaaguuaagcacaa

SEQ ID NO: 865450 - RNA, 20 nt, Homo sapiens
aagcuuaaacauugccuuau

SEQ ID NO: 865451 - RNA, 14 nt, Homo sapiens
aaggaaagcagugu

SEQ ID NO: 865452 - RNA, 18 nt, Homo sapiens
aaggcagugcaguacuca

SEQ ID NO: 865453 - RNA, 18 nt, Homo sapiens
aaggcagugcagugcuca

SEQ ID NO: 865454 - RNA, 22 nt, Homo sapiens
aaggcccagccuguaacugucc

SEQ ID NO: 865455 - RNA, 21 nt, Homo sapiens
aaggcuucuccacaaccuccu

SEQ ID NO: 865456 - RNA, 15 nt, Homo sapiens
aagguaaacaguuug

SEQ ID NO: 865457 - RNA, 19 nt, Homo sapiens
aaguacugaaauacauaug

SEQ ID NO: 865458 - RNA, 15 nt, Homo sapiens
aagucuccuguauca

SEQ ID NO: 865459 - RNA, 15 nt, Homo sapiens
uacugaaauacauau

SEQ ID NO: 865460 - RNA, 14 nt, Homo sapiens
uacugaugagacaa

SEQ ID NO: 865461 - RNA, 16 nt, Homo sapiens
uacuucuugugcuuua

SEQ ID NO: 865462 - RNA, 23 nt, Homo sapiens
uacuucuugugcuuuacucugaa

SEQ ID NO: 865463 - RNA, 17 nt, Homo sapiens
uagaaucaagucuguga

SEQ ID NO: 865464 - RNA, 14 nt, Homo sapiens
uagacauaccucuc

SEQ ID NO: 865465 - RNA, 19 nt, Homo sapiens
uagagauuucccacauucc

SEQ ID NO: 865466 - RNA, 13 nt, Homo sapiens
uagcauauauaau

SEQ ID NO: 865467 - RNA, 12 nt, Homo sapiens
uaguacucagua

SEQ ID NO: 865468 - RNA, 22 nt, Homo sapiens
uauauaggcaauguaguacuca

SEQ ID NO: 865469 - RNA, 16 nt, Homo sapiens
uauaugaaaacuaagu

SEQ ID NO: 865470 - RNA, 12 nt, Homo sapiens
uauauucccaaa

SEQ ID NO: 865471 - RNA, 21 nt, Homo sapiens
uauauuuucugaguagcauau

SEQ ID NO: 865472 - RNA, 18 nt, Homo sapiens
uaucaaaaugaaugccag

SEQ ID NO: 865473 - RNA, 19 nt, Homo sapiens
uaucaaaauguuguccuuu

SEQ ID NO: 865474 - RNA, 18 nt, Homo sapiens
uaucauuauagcauguaa

SEQ ID NO: 865475 - RNA, 23 nt, Homo sapiens
uauccuuaaggcauauacuuugu

SEQ ID NO: 865476 - RNA, 19 nt, Homo sapiens
uaucucgcuagccauauau

SEQ ID NO: 865477 - RNA, 16 nt, Homo sapiens
uaucuguuugcuucua

SEQ ID NO: 865478 - RNA, 19 nt, Homo sapiens
uaugaagucccucuauguc

SEQ ID NO: 865479 - RNA, 13 nt, Homo sapiens
uaugaucuugaua

SEQ ID NO: 865480 - RNA, 18 nt, Homo sapiens
uaugccuucacuacaaca

SEQ ID NO: 865481 - RNA, 20 nt, Homo sapiens
uauggauugaaggauuguga

SEQ ID NO: 865482 - RNA, 14 nt, Homo sapiens
uauuaaauuccucc

SEQ ID NO: 865483 - RNA, 16 nt, Homo sapiens
uauucccaaaucucaa

SEQ ID NO: 865484 - RNA, 18 nt, Homo sapiens
uauugagacacugucaag

SEQ ID NO: 865485 - RNA, 18 nt, Homo sapiens
uauuuaaggggaauuaac

SEQ ID NO: 865486 - RNA, 20 nt, Homo sapiens
ucaaaagaucuccugugcac

SEQ ID NO: 865487 - RNA, 20 nt, Homo sapiens
ucaaaauguuguccuuuccc

SEQ ID NO: 865488 - RNA, 15 nt, Homo sapiens
ucaaacagaaaagaa

SEQ ID NO: 865489 - RNA, 20 nt, Homo sapiens
ucaagacauaaguaaaugag

SEQ ID NO: 865490 - RNA, 18 nt, Homo sapiens
ucaauaacuauugcugcu

SEQ ID NO: 865491 - RNA, 17 nt, Homo sapiens
ucaauaaggcagugcag

SEQ ID NO: 865492 - RNA, 18 nt, Homo sapiens
ucacaaaguuaaacguga

SEQ ID NO: 865493 - RNA, 16 nt, Homo sapiens
ucacaguuuguucagu

SEQ ID NO: 865494 - RNA, 18 nt, Homo sapiens
ucacaugccccucuuaga

SEQ ID NO: 865495 - RNA, 21 nt, Homo sapiens
ucaccauuuaaucauuuccag

SEQ ID NO: 865496 - RNA, 17 nt, Homo sapiens
ucaccuaauuaauuuca

SEQ ID NO: 865497 - RNA, 12 nt, Homo sapiens
ucagcacauguu

SEQ ID NO: 865498 - RNA, 15 nt, Homo sapiens
ucaggcagugcagua

SEQ ID NO: 865499 - RNA, 16 nt, Homo sapiens
ucaggcagugcaguac

SEQ ID NO: 865500 - RNA, 15 nt, Homo sapiens
ucaguaacacagugc

SEQ ID NO: 865501 - RNA, 17 nt, Homo sapiens
ucaguaacacagugcag

SEQ ID NO: 865502 - RNA, 18 nt, Homo sapiens
ucaguaacacagugcagu

SEQ ID NO: 865503 - RNA, 19 nt, Homo sapiens
ucaguaacacagugcagua

SEQ ID NO: 865504 - RNA, 15 nt, Homo sapiens
ucaguaacagugaag

SEQ ID NO: 865505 - RNA, 21 nt, Homo sapiens
ucaguaacagugcaguacuca

SEQ ID NO: 865506 - RNA, 21 nt, Homo sapiens
ucaguaacaguguaguacuca

SEQ ID NO: 865507 - RNA, 13 nt, Homo sapiens
ucaguaaggcagu

SEQ ID NO: 865508 - RNA, 18 nt, Homo sapiens
ucaguaaggcagugcagu

SEQ ID NO: 865509 - RNA, 15 nt, Homo sapiens
ucaguguacucugag

SEQ ID NO: 865510 - RNA, 21 nt, Homo sapiens
ucaguguacucugaguccuca

SEQ ID NO: 865511 - RNA, 18 nt, Homo sapiens
ucaguuaggcagugcagu

SEQ ID NO: 865512 - RNA, 23 nt, Homo sapiens
ucaguuguaacauucuauuucaa

SEQ ID NO: 865513 - RNA, 23 nt, Homo sapiens
ucaugucauugaugaacugccaa

SEQ ID NO: 865514 - RNA, 18 nt, Homo sapiens
cugauuuaaacuucuuaa

SEQ ID NO: 865515 - RNA, 14 nt, Homo sapiens
cugcacacauaaca

SEQ ID NO: 865516 - RNA, 21 nt, Homo sapiens
cugcgcuccucugcagccuga

SEQ ID NO: 865517 - RNA, 17 nt, Homo sapiens
cugcucacgucugugag

SEQ ID NO: 865518 - RNA, 15 nt, Homo sapiens
cugcucccuagccag

SEQ ID NO: 865519 - RNA, 17 nt, Homo sapiens
cugcuccuacaagggaa

SEQ ID NO: 865520 - RNA, 18 nt, Homo sapiens
cugcuccuccaguacaau

SEQ ID NO: 865521 - RNA, 18 nt, Homo sapiens
cugcuuugagaaaucuca

SEQ ID NO: 865522 - RNA, 19 nt, Homo sapiens
cuggcuacaauuacuuuga

SEQ ID NO: 865523 - RNA, 14 nt, Homo sapiens
cuggggucugugau

SEQ ID NO: 865524 - RNA, 20 nt, Homo sapiens
cugguugagaucaugucauu

SEQ ID NO: 865525 - RNA, 23 nt, Homo sapiens
cuguacaguuucuuccccaagag

SEQ ID NO: 865526 - RNA, 17 nt, Homo sapiens
cuguccucuacauacca

SEQ ID NO: 865527 - RNA, 16 nt, Homo sapiens
cuguccugcucacguc

SEQ ID NO: 865528 - RNA, 15 nt, Homo sapiens
cugugaaaugacugc

SEQ ID NO: 865529 - RNA, 13 nt, Homo sapiens
cugugcaucuggc

SEQ ID NO: 865530 - RNA, 11 nt, Homo sapiens
cugugccuaac

SEQ ID NO: 865531 - RNA, 22 nt, Homo sapiens
cuguuauccuuaaggcauauac

SEQ ID NO: 865532 - RNA, 16 nt, Homo sapiens
cuguugauucuuucaa

SEQ ID NO: 865533 - RNA, 18 nt, Homo sapiens
cuuaaacaaaaacuuucc

SEQ ID NO: 865534 - RNA, 16 nt, Homo sapiens
cuuaaaugaucaagga

SEQ ID NO: 865535 - RNA, 16 nt, Homo sapiens
cuuagaagaaauauga

SEQ ID NO: 865536 - RNA, 21 nt, Homo sapiens
cuuagccccagggcacucaga

SEQ ID NO: 865537 - RNA, 16 nt, Homo sapiens
cuucuaauccaugugc

SEQ ID NO: 865538 - RNA, 14 nt, Homo sapiens
cuucuacaaaagaa

SEQ ID NO: 865539 - RNA, 13 nt, Homo sapiens
cuucucuagacau

SEQ ID NO: 865540 - RNA, 14 nt, Homo sapiens
cuugcacuguaucc

SEQ ID NO: 865541 - RNA, 16 nt, Homo sapiens
cuugcacuguauccaa

SEQ ID NO: 865542 - RNA, 18 nt, Homo sapiens
cuuggccuugguuuugau

SEQ ID NO: 865543 - RNA, 18 nt, Homo sapiens
cuugguuuccaucaaagc

SEQ ID NO: 865544 - RNA, 15 nt, Homo sapiens
cuuguaaaacuguga

SEQ ID NO: 865545 - RNA, 15 nt, Homo sapiens
cuuuaaaaugauuca

SEQ ID NO: 865546 - RNA, 15 nt, Homo sapiens
cuuuaugauucuuac

SEQ ID NO: 865547 - RNA, 15 nt, Homo sapiens
cuuuggcaauaucau

SEQ ID NO: 865548 - RNA, 16 nt, Homo sapiens
cuuuggcuuaauucca

SEQ ID NO: 865549 - RNA, 23 nt, Homo sapiens
gaaaacgauuuaauuuauucuaa

SEQ ID NO: 865550 - RNA, 21 nt, Homo sapiens
gaaaaggcuugagucuggaua

SEQ ID NO: 865551 - RNA, 15 nt, Homo sapiens
gaaacaaagcauuug

SEQ ID NO: 865552 - RNA, 18 nt, Homo sapiens
gaaaccccugacaccuuu

SEQ ID NO: 865553 - RNA, 18 nt, Homo sapiens
gaaagucuccuguaucau

SEQ ID NO: 865554 - RNA, 14 nt, Homo sapiens
gaaauacuugacaa

SEQ ID NO: 865555 - RNA, 13 nt, Homo sapiens
gaaauauucacaa

SEQ ID NO: 865556 - RNA, 12 nt, Homo sapiens
gaaaugcugauu

SEQ ID NO: 865557 - RNA, 17 nt, Homo sapiens
gaaauggcuuuccacau

SEQ ID NO: 865558 - RNA, 16 nt, Homo sapiens
gaacugcaacacugga

SEQ ID NO: 865559 - RNA, 18 nt, Homo sapiens
gaagauguaagaagcuaa

SEQ ID NO: 865560 - RNA, 17 nt, Homo sapiens
gaagcuucuugcugcca

SEQ ID NO: 865561 - RNA, 16 nt, Homo sapiens
gaaggcagcuagacac

SEQ ID NO: 865562 - RNA, 22 nt, Homo sapiens
gaaugaguuuccagcuaagccu

SEQ ID NO: 865563 - RNA, 19 nt, Homo sapiens
gaauguuguccugugucau

SEQ ID NO: 865564 - RNA, 21 nt, Homo sapiens
gaauuuuaaaaaagauggauu

SEQ ID NO: 865565 - RNA, 12 nt, Homo sapiens
gacagugcagug

SEQ ID NO: 865566 - RNA, 22 nt, Homo sapiens
gacaguguuuuaggugccugga

SEQ ID NO: 865567 - RNA, 21 nt, Homo sapiens
gacaugaaauugagucauuuu

SEQ ID NO: 865568 - RNA, 23 nt, Homo sapiens
ucacuaaagaaaaacuaauguca

SEQ ID NO: 865569 - RNA, 16 nt, Homo sapiens
ucacuguucaugaaua

SEQ ID NO: 865570 - RNA, 21 nt, Homo sapiens
ucagaaacaaagcauuugacu

SEQ ID NO: 865571 - RNA, 16 nt, Homo sapiens
ucagagcaagcacugg

SEQ ID NO: 865572 - RNA, 21 nt, Homo sapiens
ucagaucccucggucagcacc

SEQ ID NO: 865573 - RNA, 19 nt, Homo sapiens
ucaggaaaggaagauguaa

SEQ ID NO: 865574 - RNA, 21 nt, Homo sapiens
ucaggaaugcagcacaguacu

SEQ ID NO: 865575 - RNA, 18 nt, Homo sapiens
ucaguaaaucagugcagu

SEQ ID NO: 865576 - RNA, 21 nt, Homo sapiens
ucaguaacacaauacaguacu

SEQ ID NO: 865577 - RNA, 19 nt, Homo sapiens
ucaguaacacagugcagug

SEQ ID NO: 865578 - RNA, 19 nt, Homo sapiens
ucaguaaggcagugcagua

SEQ ID NO: 865579 - RNA, 21 nt, Homo sapiens
ucaguauugagacacugucaa

SEQ ID NO: 865580 - RNA, 17 nt, Homo sapiens
ucaguuaggcagugcag

SEQ ID NO: 865581 - RNA, 12 nt, Homo sapiens
ucaguuugcuaa

SEQ ID NO: 865582 - RNA, 13 nt, Homo sapiens
ucauccaacguga

SEQ ID NO: 865583 - RNA, 15 nt, Homo sapiens
ucauccuccacugaa

SEQ ID NO: 865584 - RNA, 17 nt, Homo sapiens
ucaucugaggaguccaa

SEQ ID NO: 865585 - RNA, 19 nt, Homo sapiens
ucaucugucugucccaguu

SEQ ID NO: 865586 - RNA, 17 nt, Homo sapiens
ucaugugauuuacccuu

SEQ ID NO: 865587 - RNA, 18 nt, Homo sapiens
ucauugggccauguuuaa

SEQ ID NO: 865588 - RNA, 17 nt, Homo sapiens
uccaagugugugugcaa

SEQ ID NO: 865589 - RNA, 19 nt, Homo sapiens
uccacaguuaggccaagaa

SEQ ID NO: 865590 - RNA, 17 nt, Homo sapiens
uccagccacuuauuucc

SEQ ID NO: 865591 - RNA, 22 nt, Homo sapiens
uccagccacuuauuuccaugga

SEQ ID NO: 865592 - RNA, 17 nt, Homo sapiens
uccaggcagacacagcu

SEQ ID NO: 865593 - RNA, 21 nt, Homo sapiens
uccaugacaguagcauacuga

SEQ ID NO: 865594 - RNA, 23 nt, Homo sapiens
uccaugacaguagcauacugaug

SEQ ID NO: 865595 - RNA, 17 nt, Homo sapiens
ucccaugguagacugug

SEQ ID NO: 865596 - RNA, 21 nt, Homo sapiens
ucccccacggccgucccugac

SEQ ID NO: 865597 - RNA, 14 nt, Homo sapiens
uccccuccaaguga

SEQ ID NO: 865598 - RNA, 19 nt, Homo sapiens
ucccucagcccucauuaaa

SEQ ID NO: 865599 - RNA, 12 nt, Homo sapiens
ucccugcaguaa

SEQ ID NO: 865600 - RNA, 16 nt, Homo sapiens
uccucaauuccaggga

SEQ ID NO: 865601 - RNA, 17 nt, Homo sapiens
uccucucuugacaucaa

SEQ ID NO: 865602 - RNA, 11 nt, Homo sapiens
uccucuuucac

SEQ ID NO: 865603 - RNA, 24 nt, Homo sapiens
uccuuccaaccuguucacgugacu

SEQ ID NO: 865604 - RNA, 22 nt, Homo sapiens
uccuugaggucuugaguuucau

SEQ ID NO: 865605 - RNA, 15 nt, Homo sapiens
uccuuuuguuuacaa

SEQ ID NO: 865606 - RNA, 18 nt, Homo sapiens
ucuaaacuguuuacucac

SEQ ID NO: 865607 - RNA, 13 nt, Homo sapiens
ucuaauguacaau

SEQ ID NO: 865608 - RNA, 12 nt, Homo sapiens
ucuacaaaagaa

SEQ ID NO: 865609 - RNA, 23 nt, Homo sapiens
ucuacauguuuuagacagagaca

SEQ ID NO: 865610 - RNA, 22 nt, Homo sapiens
ucuacuagaaccuucuaaucca

SEQ ID NO: 865611 - RNA, 16 nt, Homo sapiens
ucuacuucuugugcuu

SEQ ID NO: 865612 - RNA, 18 nt, Homo sapiens
ucuauugaguguacauuu

SEQ ID NO: 865613 - RNA, 17 nt, Homo sapiens
ucucaacuuacauaugu

SEQ ID NO: 865614 - RNA, 17 nt, Homo sapiens
ucucagugcuagcuuau

SEQ ID NO: 865615 - RNA, 17 nt, Homo sapiens
uaaaacuaucagcagcg

SEQ ID NO: 865616 - RNA, 19 nt, Homo sapiens
uaaaagaaagaugcugaug

SEQ ID NO: 865617 - RNA, 23 nt, Homo sapiens
uaaaagauggugaacugugagua

SEQ ID NO: 865618 - RNA, 19 nt, Homo sapiens
uaaacaguuugaaaagaca

SEQ ID NO: 865619 - RNA, 22 nt, Homo sapiens
uaaacaguuugaaaagacaaau

SEQ ID NO: 865620 - RNA, 22 nt, Homo sapiens
uaaacgugaacuaagauuuccu

SEQ ID NO: 865621 - RNA, 17 nt, Homo sapiens
uaaacgugaugugcuca

SEQ ID NO: 865622 - RNA, 13 nt, Homo sapiens
uaaacugaugcuu

SEQ ID NO: 865623 - RNA, 16 nt, Homo sapiens
uaaagaggucagggga

SEQ ID NO: 865624 - RNA, 15 nt, Homo sapiens
uaaagcaauguggua

SEQ ID NO: 865625 - RNA, 22 nt, Homo sapiens
uaaaggagcagcuagcugcuuu

SEQ ID NO: 865626 - RNA, 14 nt, Homo sapiens
uaaaggcuguguca

SEQ ID NO: 865627 - RNA, 19 nt, Homo sapiens
uaaagguuucacuguucau

SEQ ID NO: 865628 - RNA, 14 nt, Homo sapiens
uaaaucagugcagu

SEQ ID NO: 865629 - RNA, 15 nt, Homo sapiens
uaaaucuuccaaagu

SEQ ID NO: 865630 - RNA, 16 nt, Homo sapiens
uaaauucaaaccuaag

SEQ ID NO: 865631 - RNA, 14 nt, Homo sapiens
uaacagugcaguac

SEQ ID NO: 865632 - RNA, 20 nt, Homo sapiens
uaaccuaaugcagaauugcu

SEQ ID NO: 865633 - RNA, 13 nt, Homo sapiens
uaagacagugcag

SEQ ID NO: 865634 - RNA, 14 nt, Homo sapiens
uaagauuuugccug

SEQ ID NO: 865635 - RNA, 14 nt, Homo sapiens
uaaggcagugcagu

SEQ ID NO: 865636 - RNA, 18 nt, Homo sapiens
uaaggggaauuaacaauu

SEQ ID NO: 865637 - RNA, 12 nt, Homo sapiens
uaauaaauucca

SEQ ID NO: 865638 - RNA, 21 nt, Homo sapiens
uaauauaggguuuguuugcug

SEQ ID NO: 865639 - RNA, 20 nt, Homo sapiens
uaauauuuguuccucuaggu

SEQ ID NO: 865640 - RNA, 14 nt, Homo sapiens
uaauguacaauaaa

SEQ ID NO: 865641 - RNA, 16 nt, Homo sapiens
uaaugucagcacaugu

SEQ ID NO: 865642 - RNA, 13 nt, Homo sapiens
uaauuagauuaac

SEQ ID NO: 865643 - RNA, 16 nt, Homo sapiens
uacaaguuacauacau

SEQ ID NO: 865644 - RNA, 16 nt, Homo sapiens
uacaauaaagcaaugu

SEQ ID NO: 865645 - RNA, 15 nt, Homo sapiens
uacaauacaguacuc

SEQ ID NO: 865646 - RNA, 18 nt, Homo sapiens
uacaauguaucaacauau

SEQ ID NO: 865647 - RNA, 14 nt, Homo sapiens
uacaauuacuuuga

SEQ ID NO: 865648 - RNA, 22 nt, Homo sapiens
uacaguacucaggcagugcagu

SEQ ID NO: 865649 - RNA, 19 nt, Homo sapiens
uacagugauagaacaaaag

SEQ ID NO: 865650 - RNA, 20 nt, Homo sapiens
uacauaguggucauuuggug

SEQ ID NO: 865651 - RNA, 13 nt, Homo sapiens
uaccaaaugccuu

SEQ ID NO: 865652 - RNA, 22 nt, Homo sapiens
uaccauaagcuuuuucucugaa

SEQ ID NO: 865653 - RNA, 18 nt, Homo sapiens
uacuaaccaccauuuccc

SEQ ID NO: 865654 - RNA, 16 nt, Homo sapiens
uacucaggcagugcag

SEQ ID NO: 865655 - RNA, 22 nt, Homo sapiens
uacucaguaaaucagugcagua

SEQ ID NO: 865656 - RNA, 21 nt, Homo sapiens
uacucaguaacacagugcagu

SEQ ID NO: 865657 - RNA, 19 nt, Homo sapiens
uacucaguaacagugcagu

SEQ ID NO: 865658 - RNA, 21 nt, Homo sapiens
uacucaguaaggcagugcagu

SEQ ID NO: 865659 - RNA, 14 nt, Homo sapiens
uacugauuaacuca

SEQ ID NO: 865660 - RNA, 20 nt, Homo sapiens
uacuggauuuaacuaccuuu

SEQ ID NO: 865661 - RNA, 16 nt, Homo sapiens
uacuuuggcugugaug

SEQ ID NO: 865662 - RNA, 22 nt, Homo sapiens
uacuuugugucuuuuguucucu

SEQ ID NO: 865663 - RNA, 19 nt, Homo sapiens
uagaaucaagucugugaaa

SEQ ID NO: 865664 - RNA, 23 nt, Homo sapiens
uagccagaggcucuaauguacaa

SEQ ID NO: 865665 - RNA, 14 nt, Homo sapiens
uaggaaugcucaau

SEQ ID NO: 865666 - RNA, 17 nt, Homo sapiens
uaggagagaacagggau

SEQ ID NO: 865667 - RNA, 18 nt, Homo sapiens
uaggcaauguaguacuca

SEQ ID NO: 865668 - RNA, 22 nt, Homo sapiens
uagugggccaccccuaaucacu

SEQ ID NO: 865669 - RNA, 23 nt, Homo sapiens
uaguugccguggcaacuguggaa

SEQ ID NO: 865670 - RNA, 20 nt, Homo sapiens
uauaauuuuauugcuggaau

SEQ ID NO: 865671 - RNA, 18 nt, Homo sapiens
uauauaauuuuauugcug

SEQ ID NO: 865672 - RNA, 17 nt, Homo sapiens
uauauaugaaaacuaag

SEQ ID NO: 865673 - RNA, 16 nt, Homo sapiens
uauauguuuggcugaa

SEQ ID NO: 865674 - RNA, 15 nt, Homo sapiens
uaucauuaaccuuau

SEQ ID NO: 865675 - RNA, 22 nt, Homo sapiens
uaucauuaaccuuaucauaaau

SEQ ID NO: 865676 - RNA, 15 nt, Homo sapiens
uaugaagucccucua

SEQ ID NO: 865677 - RNA, 14 nt, Homo sapiens
uaugaccauaaaau

SEQ ID NO: 865678 - RNA, 20 nt, Homo sapiens
uaugcacaccaaauugcuga

SEQ ID NO: 865679 - RNA, 11 nt, Homo sapiens
uaugcauuuau

SEQ ID NO: 865680 - RNA, 19 nt, Homo sapiens
uaugccuucacuacaacau

SEQ ID NO: 865681 - RNA, 15 nt, Homo sapiens
uauguacagaugaug

SEQ ID NO: 865682 - RNA, 23 nt, Homo sapiens
uaugucugugugccccuccugcc

SEQ ID NO: 865683 - RNA, 17 nt, Homo sapiens
uaugugcagcuuuccag

SEQ ID NO: 865684 - RNA, 21 nt, Homo sapiens
uauucccaugguagacuguga

SEQ ID NO: 865685 - RNA, 14 nt, Homo sapiens
uauuuauaacauug

SEQ ID NO: 865686 - RNA, 21 nt, Homo sapiens
ucaaaauugaccucaaaagaa

SEQ ID NO: 865687 - RNA, 18 nt, Homo sapiens
ucaaagaaucaccuaauu

SEQ ID NO: 865688 - RNA, 15 nt, Homo sapiens
ucaaggcugcaguga

SEQ ID NO: 865689 - RNA, 14 nt, Homo sapiens
ucaaguuaauucuc

SEQ ID NO: 865690 - RNA, 13 nt, Homo sapiens
ucaauaaggcagu

SEQ ID NO: 865691 - RNA, 17 nt, Homo sapiens
ucaauaccaccaagagg

SEQ ID NO: 865692 - RNA, 19 nt, Homo sapiens
ucaaugccaggcagugcag

SEQ ID NO: 865693 - RNA, 19 nt, Homo sapiens
ucaaugugcuguugauucu

SEQ ID NO: 865694 - RNA, 12 nt, Homo sapiens
ucacaugccuuc

SEQ ID NO: 865695 - RNA, 18 nt, Homo sapiens
ucacuuuuuuccugucaa

SEQ ID NO: 865696 - RNA, 18 nt, Homo sapiens
ucagagcaagcacuggac

SEQ ID NO: 865697 - RNA, 20 nt, Homo sapiens
ucagccccacuccacaguua

SEQ ID NO: 865698 - RNA, 17 nt, Homo sapiens
ucaggagaaaccccuga

SEQ ID NO: 865699 - RNA, 21 nt, Homo sapiens
ucaggauugaggaugaacuca

SEQ ID NO: 865700 - RNA, 14 nt, Homo sapiens
ucaggcagugcagu

SEQ ID NO: 865701 - RNA, 16 nt, Homo sapiens
ucaggcucugaaucuc

SEQ ID NO: 865702 - RNA, 20 nt, Homo sapiens
ucaggcucugaaucucucaa

SEQ ID NO: 865703 - RNA, 19 nt, Homo sapiens
ucaguaaaucagugcagua

SEQ ID NO: 865704 - RNA, 23 nt, Homo sapiens
ucaguaacacagugcaguacuca

SEQ ID NO: 865705 - RNA, 17 nt, Homo sapiens
ucaguaacagugcagua

SEQ ID NO: 865706 - RNA, 17 nt, Homo sapiens
ucaguaagacagugcag

SEQ ID NO: 865707 - RNA, 23 nt, Homo sapiens
ucaguaaggcagugaaguacuca

SEQ ID NO: 865708 - RNA, 17 nt, Homo sapiens
ucaguaaggcagugcaa

SEQ ID NO: 865709 - RNA, 23 nt, Homo sapiens
ucaguaauacaguacaguacuca

SEQ ID NO: 865710 - RNA, 15 nt, Homo sapiens
ucaguauugagacac

SEQ ID NO: 865711 - RNA, 12 nt, Homo sapiens
ucagugcaguac

SEQ ID NO: 865712 - RNA, 20 nt, Homo sapiens
ucaguguuauaaaaucugua

SEQ ID NO: 865713 - RNA, 15 nt, Homo sapiens
ucaucagaaacaauu

SEQ ID NO: 865714 - RNA, 12 nt, Homo sapiens
ucaucugucagc

SEQ ID NO: 865715 - RNA, 15 nt, Homo sapiens
ucauuauuuuucaau

SEQ ID NO: 865716 - RNA, 19 nt, Homo sapiens
uccaaaauaucgagugaau

SEQ ID NO: 865717 - RNA, 18 nt, Homo sapiens
uccaagugugugugcaau

SEQ ID NO: 865718 - RNA, 22 nt, Homo sapiens
uccagaugugccuagacacgaa

SEQ ID NO: 865719 - RNA, 15 nt, Homo sapiens
uccaguucugaugag

SEQ ID NO: 865720 - RNA, 13 nt, Homo sapiens
ucccaggcacucu

SEQ ID NO: 865721 - RNA, 18 nt, Homo sapiens
ucccaugguagacuguga

SEQ ID NO: 865722 - RNA, 13 nt, Homo sapiens
ucccccgcuguaa

SEQ ID NO: 865723 - RNA, 17 nt, Homo sapiens
uccccuuccauucccaa

SEQ ID NO: 865724 - RNA, 13 nt, Homo sapiens
ucccuagccagag

SEQ ID NO: 865725 - RNA, 22 nt, Homo sapiens
ucccuccagggccacugcuuga

SEQ ID NO: 865726 - RNA, 21 nt, Homo sapiens
aaaaggcuugagucuggauaa

SEQ ID NO: 865727 - RNA, 14 nt, Homo sapiens
aaaauagcuauaaa

SEQ ID NO: 865728 - RNA, 22 nt, Homo sapiens
aaaaugcugccuagugcuacag

SEQ ID NO: 865729 - RNA, 21 nt, Homo sapiens
aaaauguucugacagcauuuc

SEQ ID NO: 865730 - RNA, 19 nt, Homo sapiens
aaaauugaccucaaaagaa

SEQ ID NO: 865731 - RNA, 13 nt, Homo sapiens
aaacaguguggau

SEQ ID NO: 865732 - RNA, 22 nt, Homo sapiens
aaaccucuuucggaaaugauug

SEQ ID NO: 865733 - RNA, 22 nt, Homo sapiens
aaaccugauacaauuugcccaa

SEQ ID NO: 865734 - RNA, 11 nt, Homo sapiens
aaacuguacag

SEQ ID NO: 865735 - RNA, 23 nt, Homo sapiens
aaacuguacaguuucuuccccaa

SEQ ID NO: 865736 - RNA, 16 nt, Homo sapiens
aaacuugagcauucaa

SEQ ID NO: 865737 - RNA, 17 nt, Homo sapiens
aaagauaccaaauagaa

SEQ ID NO: 865738 - RNA, 12 nt, Homo sapiens
aaagcagugcag

SEQ ID NO: 865739 - RNA, 14 nt, Homo sapiens
aaagcagugcagua

SEQ ID NO: 865740 - RNA, 14 nt, Homo sapiens
aaagcaugccaauu

SEQ ID NO: 865741 - RNA, 18 nt, Homo sapiens
aaagcaugcucaguauug

SEQ ID NO: 865742 - RNA, 16 nt, Homo sapiens
aaagccauuauucucu

SEQ ID NO: 865743 - RNA, 23 nt, Homo sapiens
aaagguuguacauaguggucauu

SEQ ID NO: 865744 - RNA, 19 nt, Homo sapiens
aaagugcaguagugucacu

SEQ ID NO: 865745 - RNA, 15 nt, Homo sapiens
aaauaggauuugcac

SEQ ID NO: 865746 - RNA, 21 nt, Homo sapiens
aaauaucauuauagcauguaa

SEQ ID NO: 865747 - RNA, 17 nt, Homo sapiens
aaauauguauaugucua

SEQ ID NO: 865748 - RNA, 12 nt, Homo sapiens
aaaucagugcag

SEQ ID NO: 865749 - RNA, 18 nt, Homo sapiens
aaaugauuaagugcuuga

SEQ ID NO: 865750 - RNA, 18 nt, Homo sapiens
aaaugcugccuagugcua

SEQ ID NO: 865751 - RNA, 16 nt, Homo sapiens
aaauuaucugauccuu

SEQ ID NO: 865752 - RNA, 20 nt, Homo sapiens
aaauucugacaccaugugca

SEQ ID NO: 865753 - RNA, 14 nt, Homo sapiens
aaauuugacuguua

SEQ ID NO: 865754 - RNA, 15 nt, Homo sapiens
aacaaagcauuugac

SEQ ID NO: 865755 - RNA, 13 nt, Homo sapiens
aacaagccugaaa

SEQ ID NO: 865756 - RNA, 12 nt, Homo sapiens
aacacagugcag

SEQ ID NO: 865757 - RNA, 18 nt, Homo sapiens
aacacaguguagugcuca

SEQ ID NO: 865758 - RNA, 16 nt, Homo sapiens
aacaccuuccagcuuu

SEQ ID NO: 865759 - RNA, 22 nt, Homo sapiens
aacagaucacaugccccucuua

SEQ ID NO: 865760 - RNA, 18 nt, Homo sapiens
aacagggaugcuaucucg

SEQ ID NO: 865761 - RNA, 12 nt, Homo sapiens
aacagugcagua

SEQ ID NO: 865762 - RNA, 19 nt, Homo sapiens
aacaugguuaccucugcau

SEQ ID NO: 865763 - RNA, 16 nt, Homo sapiens
aacauucucaaucaug

SEQ ID NO: 865764 - RNA, 23 nt, Homo sapiens
aacauuuuguaugcugcaugaaa

SEQ ID NO: 865765 - RNA, 17 nt, Homo sapiens
aaccuucuaauccaugu

SEQ ID NO: 865766 - RNA, 20 nt, Homo sapiens
aacuaaugucagcacauguu

SEQ ID NO: 865767 - RNA, 22 nt, Homo sapiens
aacuaaugucagcacauguugc

SEQ ID NO: 865768 - RNA, 13 nt, Homo sapiens
aacuauugcugcu

SEQ ID NO: 865769 - RNA, 12 nt, Homo sapiens
aacuccuuacag

SEQ ID NO: 865770 - RNA, 16 nt, Homo sapiens
aacugugacauuccac

SEQ ID NO: 865771 - RNA, 22 nt, Homo sapiens
aacugugacauuccacagaguu

SEQ ID NO: 865772 - RNA, 16 nt, Homo sapiens
aacuuggugccuaaug

SEQ ID NO: 865773 - RNA, 14 nt, Homo sapiens
agguaaauaaucau

SEQ ID NO: 865774 - RNA, 12 nt, Homo sapiens
agguaucugaug

SEQ ID NO: 865775 - RNA, 21 nt, Homo sapiens
aggugacuuuccuaugacacu

SEQ ID NO: 865776 - RNA, 14 nt, Homo sapiens
agguuggagugcau

SEQ ID NO: 865777 - RNA, 16 nt, Homo sapiens
aguaacacagugcagu

SEQ ID NO: 865778 - RNA, 23 nt, Homo sapiens
aguaacagugaaguacucaguaa

SEQ ID NO: 865779 - RNA, 17 nt, Homo sapiens
aguaaggcagugcagua

SEQ ID NO: 865780 - RNA, 21 nt, Homo sapiens
aguacauaaggaguugccgca

SEQ ID NO: 865781 - RNA, 18 nt, Homo sapiens
aguacucaggcagugcaa

SEQ ID NO: 865782 - RNA, 19 nt, Homo sapiens
aguacucaguaacacaggg

SEQ ID NO: 865783 - RNA, 24 nt, Homo sapiens
aguacucaguuaggcagugcagua

SEQ ID NO: 865784 - RNA, 17 nt, Homo sapiens
aguacugaaauacauau

SEQ ID NO: 865785 - RNA, 22 nt, Homo sapiens
aguagaggguccagucuucuag

SEQ ID NO: 865786 - RNA, 12 nt, Homo sapiens
aguagcauauau

SEQ ID NO: 865787 - RNA, 20 nt, Homo sapiens
aguaggucugcacacauaac

SEQ ID NO: 865788 - RNA, 14 nt, Homo sapiens
aguauacacaucau

SEQ ID NO: 865789 - RNA, 11 nt, Homo sapiens
agucauugucc

SEQ ID NO: 865790 - RNA, 20 nt, Homo sapiens
aguccccagccugcucccua

SEQ ID NO: 865791 - RNA, 15 nt, Homo sapiens
agugaugccaugaag

SEQ ID NO: 865792 - RNA, 16 nt, Homo sapiens
aguguagugcucagua

SEQ ID NO: 865793 - RNA, 11 nt, Homo sapiens
aguucugauga

SEQ ID NO: 865794 - RNA, 12 nt, Homo sapiens
aguucugaugag

SEQ ID NO: 865795 - RNA, 21 nt, Homo sapiens
aguugguuaccuauugcugua

SEQ ID NO: 865796 - RNA, 20 nt, Homo sapiens
auaaaaaauguuauuacuga

SEQ ID NO: 865797 - RNA, 15 nt, Homo sapiens
auaaaagacaugaaa

SEQ ID NO: 865798 - RNA, 12 nt, Homo sapiens
auaaacugugag

SEQ ID NO: 865799 - RNA, 13 nt, Homo sapiens
auaaacugugaga

SEQ ID NO: 865800 - RNA, 16 nt, Homo sapiens
auaaaucuuccaaagu

SEQ ID NO: 865801 - RNA, 15 nt, Homo sapiens
auaacaggcauugca

SEQ ID NO: 865802 - RNA, 23 nt, Homo sapiens
auaaggccucauccuccacugaa

SEQ ID NO: 865803 - RNA, 11 nt, Homo sapiens
auaaugcuucu

SEQ ID NO: 865804 - RNA, 14 nt, Homo sapiens
auacaaguuacaua

SEQ ID NO: 865805 - RNA, 16 nt, Homo sapiens
auacaauuugcccaag

SEQ ID NO: 865806 - RNA, 22 nt, Homo sapiens
auacaguacucaggcagugcag

SEQ ID NO: 865807 - RNA, 13 nt, Homo sapiens
auacauuauuaga

SEQ ID NO: 865808 - RNA, 24 nt, Homo sapiens
auaccuagugauacggauuuagcu

SEQ ID NO: 865809 - RNA, 22 nt, Homo sapiens
auaccucucaacuuacauaugu

SEQ ID NO: 865810 - RNA, 15 nt, Homo sapiens
auacugaugagacaa

SEQ ID NO: 865811 - RNA, 17 nt, Homo sapiens
auaguauacacaucaua

SEQ ID NO: 865812 - RNA, 15 nt, Homo sapiens
auauaaacugugaga

SEQ ID NO: 865813 - RNA, 19 nt, Homo sapiens
auaugagcaugcucccuca

SEQ ID NO: 865814 - RNA, 16 nt, Homo sapiens
auauggcaauagcauu

SEQ ID NO: 865815 - RNA, 13 nt, Homo sapiens
auaugucuagaua

SEQ ID NO: 865816 - RNA, 12 nt, Homo sapiens
auauucccaugg

SEQ ID NO: 865817 - RNA, 18 nt, Homo sapiens
auauuuaaagucuugaau

SEQ ID NO: 865818 - RNA, 14 nt, Homo sapiens
aucaaaauguuguc

SEQ ID NO: 865819 - RNA, 15 nt, Homo sapiens
aucaacucauguuaa

SEQ ID NO: 865820 - RNA, 17 nt, Homo sapiens
aucaagcuccaucuuau

SEQ ID NO: 865821 - RNA, 14 nt, Homo sapiens
aucaagucugugaa

SEQ ID NO: 865822 - RNA, 22 nt, Homo sapiens
aucacuauugcuuccuaaaggu

SEQ ID NO: 865823 - RNA, 18 nt, Homo sapiens
aucagacugcuuugagaa

SEQ ID NO: 865824 - RNA, 12 nt, Homo sapiens
auccaacgugaa

SEQ ID NO: 865825 - RNA, 23 nt, Homo sapiens
auccaugugcugcuguggcauca

SEQ ID NO: 865826 - RNA, 20 nt, Homo sapiens
aucccaaaucuauagcauuu

SEQ ID NO: 865827 - RNA, 14 nt, Homo sapiens
aucccaagucaaac

SEQ ID NO: 865828 - RNA, 20 nt, Homo sapiens
aucccaagucaaacagugug

SEQ ID NO: 865829 - RNA, 18 nt, Homo sapiens
aucccuagucuauugcag

SEQ ID NO: 865830 - RNA, 21 nt, Homo sapiens
aucuacuagaaccuucuaauc

SEQ ID NO: 865831 - RNA, 15 nt, Homo sapiens
aucugaggaguccaa

SEQ ID NO: 865832 - RNA, 17 nt, Homo sapiens
aucugucuuuaugauuu

SEQ ID NO: 865833 - RNA, 20 nt, Homo sapiens
augaaaaccacccuaucauc

SEQ ID NO: 865834 - RNA, 13 nt, Homo sapiens
augaacugccaaa

SEQ ID NO: 865835 - RNA, 21 nt, Homo sapiens
augaagucccucuaugucguc

SEQ ID NO: 865836 - RNA, 21 nt, Homo sapiens
augacuucuuuacuaacacug

SEQ ID NO: 865837 - RNA, 14 nt, Homo sapiens
augagaacuaaaua

SEQ ID NO: 865838 - RNA, 15 nt, Homo sapiens
augauaaauuugacu

SEQ ID NO: 865839 - RNA, 20 nt, Homo sapiens
augauaaauuugacuguuau

SEQ ID NO: 865840 - RNA, 16 nt, Homo sapiens
augauuaagugcuuga

SEQ ID NO: 865841 - RNA, 13 nt, Homo sapiens
augcugcaugaaa

SEQ ID NO: 865842 - RNA, 22 nt, Homo sapiens
augcugcugagcacaucucuuc

SEQ ID NO: 865843 - RNA, 14 nt, Homo sapiens
auggauccuuguca

SEQ ID NO: 865844 - RNA, 16 nt, Homo sapiens
auggcucggccaggca

SEQ ID NO: 865845 - RNA, 16 nt, Homo sapiens
augggaggaucacuug

SEQ ID NO: 865846 - RNA, 18 nt, Homo sapiens
augguauauauuuugaaa

SEQ ID NO: 865847 - RNA, 22 nt, Homo sapiens
augguuuucaacaagccugaaa

SEQ ID NO: 865848 - RNA, 18 nt, Homo sapiens
auguacaauaaagcaaug

SEQ ID NO: 865849 - RNA, 23 nt, Homo sapiens
auguacaauaaagcaauguggua

SEQ ID NO: 865850 - RNA, 14 nt, Homo sapiens
augucuuuaaaaug

SEQ ID NO: 865851 - RNA, 19 nt, Homo sapiens
augucuuuaaaaugauuca

SEQ ID NO: 865852 - RNA, 19 nt, Homo sapiens
auguggaauuacauaacag

SEQ ID NO: 865853 - RNA, 14 nt, Homo sapiens
augugugugcuuug

SEQ ID NO: 865854 - RNA, 16 nt, Homo sapiens
auguuccguucaucug

SEQ ID NO: 865855 - RNA, 14 nt, Homo sapiens
auuaaaauuuuccu

SEQ ID NO: 865856 - RNA, 14 nt, Homo sapiens
auuagacaaugugg

SEQ ID NO: 865857 - RNA, 21 nt, Homo sapiens
auuagauuuuaaaacuucauc

SEQ ID NO: 865858 - RNA, 17 nt, Homo sapiens
auuagcuuacugauuaa

SEQ ID NO: 865859 - RNA, 17 nt, Homo sapiens
auuauagcauguaauau

SEQ ID NO: 865860 - RNA, 19 nt, Homo sapiens
auuauguggaagaagcaaa

SEQ ID NO: 865861 - RNA, 16 nt, Homo sapiens
auuauucucugaugca

SEQ ID NO: 865862 - RNA, 17 nt, Homo sapiens
auucaaagaaucaccua

SEQ ID NO: 865863 - RNA, 23 nt, Homo sapiens
auucaaauaacccugaaucagag

SEQ ID NO: 865864 - RNA, 19 nt, Homo sapiens
auucaguaaggcagugaag

SEQ ID NO: 865865 - RNA, 17 nt, Homo sapiens
auucccaugaauaucaa

SEQ ID NO: 865866 - RNA, 21 nt, Homo sapiens
auucuauuucaacuucaggaa

SEQ ID NO: 865867 - RNA, 16 nt, Homo sapiens
auugagacacugucaa

SEQ ID NO: 865868 - RNA, 19 nt, Homo sapiens
auugagacacugucaagau

SEQ ID NO: 865869 - RNA, 16 nt, Homo sapiens
auugaggaugaacuca

SEQ ID NO: 865870 - RNA, 22 nt, Homo sapiens
auuggaucaggaacccuuacag

SEQ ID NO: 865871 - RNA, 21 nt, Homo sapiens
auugguacuuacccuucuaca

SEQ ID NO: 865872 - RNA, 15 nt, Homo sapiens
auuuccuccugggca

SEQ ID NO: 865873 - RNA, 16 nt, Homo sapiens
auuugcugaauaacaa

SEQ ID NO: 865874 - RNA, 21 nt, Homo sapiens
auuuucaaguuauucagaaau

SEQ ID NO: 865875 - RNA, 22 nt, Homo sapiens
auuuucucuccucgguggcauu

SEQ ID NO: 865876 - RNA, 15 nt, Homo sapiens
auuuuggacguguga

SEQ ID NO: 865877 - RNA, 16 nt, Homo sapiens
auuuuggacgugugag

SEQ ID NO: 865878 - RNA, 14 nt, Homo sapiens
caaaauccuugccu

SEQ ID NO: 865879 - RNA, 21 nt, Homo sapiens
caaacaguguggcuuaaacau

SEQ ID NO: 865880 - RNA, 20 nt, Homo sapiens
caaacuguacaguuucuucc

SEQ ID NO: 865881 - RNA, 22 nt, Homo sapiens
caaacuuaacagaucacaugcc

SEQ ID NO: 865882 - RNA, 14 nt, Homo sapiens
caaagcauuugacu

SEQ ID NO: 865883 - RNA, 16 nt, Homo sapiens
caaaguuaaacgugau

SEQ ID NO: 865884 - RNA, 16 nt, Homo sapiens
aauuugcuuagccuuu

SEQ ID NO: 865885 - RNA, 18 nt, Homo sapiens
aauuuuauugcuggaauc

SEQ ID NO: 865886 - RNA, 18 nt, Homo sapiens
acaaaacaucuuaggcac

SEQ ID NO: 865887 - RNA, 18 nt, Homo sapiens
acaaaauauccaagccca

SEQ ID NO: 865888 - RNA, 19 nt, Homo sapiens
acaaagcauuugacuuucu

SEQ ID NO: 865889 - RNA, 20 nt, Homo sapiens
acaaaugauuucgugacugu

SEQ ID NO: 865890 - RNA, 22 nt, Homo sapiens
acaacaaagcaugcucaguauu

SEQ ID NO: 865891 - RNA, 23 nt, Homo sapiens
acaagggaagcuucuugcugcca

SEQ ID NO: 865892 - RNA, 14 nt, Homo sapiens
acaauaaagcaaug

SEQ ID NO: 865893 - RNA, 17 nt, Homo sapiens
acaauacaguacucagg

SEQ ID NO: 865894 - RNA, 13 nt, Homo sapiens
acaauuacuuuga

SEQ ID NO: 865895 - RNA, 14 nt, Homo sapiens
acaauuugcccaag

SEQ ID NO: 865896 - RNA, 22 nt, Homo sapiens
acacaguaguguucuguucacu

SEQ ID NO: 865897 - RNA, 18 nt, Homo sapiens
acacaguguagugcucag

SEQ ID NO: 865898 - RNA, 14 nt, Homo sapiens
acacaucaguccac

SEQ ID NO: 865899 - RNA, 13 nt, Homo sapiens
acacucaccauuu

SEQ ID NO: 865900 - RNA, 21 nt, Homo sapiens
acagaacaacaacaaagcaug

SEQ ID NO: 865901 - RNA, 15 nt, Homo sapiens
acagaggacauacca

SEQ ID NO: 865902 - RNA, 16 nt, Homo sapiens
acagcauaauugccuu

SEQ ID NO: 865903 - RNA, 11 nt, Homo sapiens
acagcauuuca

SEQ ID NO: 865904 - RNA, 19 nt, Homo sapiens
acaguacucaggcagugca

SEQ ID NO: 865905 - RNA, 23 nt, Homo sapiens
acaguacucaguuaggcagugca

SEQ ID NO: 865906 - RNA, 11 nt, Homo sapiens
acagugcagua

SEQ ID NO: 865907 - RNA, 21 nt, Homo sapiens
acauaacacacaucaguccac

SEQ ID NO: 865908 - RNA, 18 nt, Homo sapiens
acauaacaggcauugcac

SEQ ID NO: 865909 - RNA, 23 nt, Homo sapiens
acauauucccaugguagacugug

SEQ ID NO: 865910 - RNA, 15 nt, Homo sapiens
acaucugcauuucua

SEQ ID NO: 865911 - RNA, 22 nt, Homo sapiens
acauguuuuagacagagacaau

SEQ ID NO: 865912 - RNA, 19 nt, Homo sapiens
accagaauggggacaucuu

SEQ ID NO: 865913 - RNA, 21 nt, Homo sapiens
accauaagcuuuuucucugaa

SEQ ID NO: 865914 - RNA, 22 nt, Homo sapiens
acccaaguuuauuauaucauua

SEQ ID NO: 865915 - RNA, 19 nt, Homo sapiens
accccgucugccccuugac

SEQ ID NO: 865916 - RNA, 15 nt, Homo sapiens
acccuaucaucaguu

SEQ ID NO: 865917 - RNA, 16 nt, Homo sapiens
acccugccccaugaaa

SEQ ID NO: 865918 - RNA, 13 nt, Homo sapiens
accuauugcugua

SEQ ID NO: 865919 - RNA, 21 nt, Homo sapiens
accuccuccuccaguucugau

SEQ ID NO: 865920 - RNA, 22 nt, Homo sapiens
accugacuuuggagacgaugcu

SEQ ID NO: 865921 - RNA, 13 nt, Homo sapiens
accuucuaaucca

SEQ ID NO: 865922 - RNA, 23 nt, Homo sapiens
accuucuaauccaugugcugcug

SEQ ID NO: 865923 - RNA, 21 nt, Homo sapiens
accuuguacagaaccagcacu

SEQ ID NO: 865924 - RNA, 19 nt, Homo sapiens
acgguccuuugagugucag

SEQ ID NO: 865925 - RNA, 12 nt, Homo sapiens
acgucugugagu

SEQ ID NO: 865926 - RNA, 14 nt, Homo sapiens
acgugacuccucaa

SEQ ID NO: 865927 - RNA, 12 nt, Homo sapiens
acuaacacuggc

SEQ ID NO: 865928 - RNA, 13 nt, Homo sapiens
acuacaagggcau

SEQ ID NO: 865929 - RNA, 13 nt, Homo sapiens
acuauugcugcuu

SEQ ID NO: 865930 - RNA, 18 nt, Homo sapiens
acucaaggccuccagcca

SEQ ID NO: 865931 - RNA, 22 nt, Homo sapiens
acucaccauuuaaucauuucca

SEQ ID NO: 865932 - RNA, 20 nt, Homo sapiens
acucaguaaaucagugcagu

SEQ ID NO: 865933 - RNA, 21 nt, Homo sapiens
acucaguuaggcagugcagua

SEQ ID NO: 865934 - RNA, 14 nt, Homo sapiens
acugugacacagcu

SEQ ID NO: 865935 - RNA, 21 nt, Homo sapiens
acuguuaaauaaggccucauc

SEQ ID NO: 865936 - RNA, 13 nt, Homo sapiens
acuguuugcccca

SEQ ID NO: 865937 - RNA, 17 nt, Homo sapiens
acuucaaauguuauuca

SEQ ID NO: 865938 - RNA, 21 nt, Homo sapiens
acuucuuaacuggcaacaguu

SEQ ID NO: 865939 - RNA, 19 nt, Homo sapiens
acuuuuuuccugucaauau

SEQ ID NO: 865940 - RNA, 17 nt, Homo sapiens
agaaaacaaccaaagaa

SEQ ID NO: 865941 - RNA, 15 nt, Homo sapiens
agaaauggcuuucca

SEQ ID NO: 865942 - RNA, 23 nt, Homo sapiens
agaaauggcuuuccacaucccca

SEQ ID NO: 865943 - RNA, 16 nt, Homo sapiens
agaacucaugugauuu

SEQ ID NO: 865944 - RNA, 21 nt, Homo sapiens
agaagaauauguauguuucua

SEQ ID NO: 865945 - RNA, 13 nt, Homo sapiens
agaagcagcagcu

SEQ ID NO: 865946 - RNA, 17 nt, Homo sapiens
agaagugugacuagaua

SEQ ID NO: 865947 - RNA, 14 nt, Homo sapiens
agaaucaagucugu

SEQ ID NO: 865948 - RNA, 15 nt, Homo sapiens
agaaucaagucugug

SEQ ID NO: 865949 - RNA, 13 nt, Homo sapiens
agacagagacaau

SEQ ID NO: 865950 - RNA, 23 nt, Homo sapiens
ccccagccugcucccuagccaga

SEQ ID NO: 865951 - RNA, 17 nt, Homo sapiens
cccuagccagaggcucu

SEQ ID NO: 865952 - RNA, 19 nt, Homo sapiens
cccuccagggccacugcuu

SEQ ID NO: 865953 - RNA, 15 nt, Homo sapiens
cccuccgacuucucu

SEQ ID NO: 865954 - RNA, 21 nt, Homo sapiens
ccgcgcucugccccuccgucc

SEQ ID NO: 865955 - RNA, 23 nt, Homo sapiens
ccguggugugaggcccccggagg

SEQ ID NO: 865956 - RNA, 21 nt, Homo sapiens
ccuaacacuaucauaguuauu

SEQ ID NO: 865957 - RNA, 18 nt, Homo sapiens
ccuagccagaggcucuaa

SEQ ID NO: 865958 - RNA, 22 nt, Homo sapiens
ccuaguccccagccugcucccu

SEQ ID NO: 865959 - RNA, 21 nt, Homo sapiens
ccucuagguaaacuagcaaaa

SEQ ID NO: 865960 - RNA, 19 nt, Homo sapiens
ccucuuagaagaaauauga

SEQ ID NO: 865961 - RNA, 23 nt, Homo sapiens
ccucuugaaugcuuaaaugauca

SEQ ID NO: 865962 - RNA, 23 nt, Homo sapiens
ccugagcauauguacacagacaa

SEQ ID NO: 865963 - RNA, 14 nt, Homo sapiens
ccugcccuccccca

SEQ ID NO: 865964 - RNA, 17 nt, Homo sapiens
ccugcucccuagccaga

SEQ ID NO: 865965 - RNA, 22 nt, Homo sapiens
ccugcucccuagccagaggcuc

SEQ ID NO: 865966 - RNA, 15 nt, Homo sapiens
ccugcuccuccagua

SEQ ID NO: 865967 - RNA, 14 nt, Homo sapiens
ccuggaaggcagcu

SEQ ID NO: 865968 - RNA, 20 nt, Homo sapiens
ccuguaggucuaugaugucc

SEQ ID NO: 865969 - RNA, 17 nt, Homo sapiens
ccugugucaucugucag

SEQ ID NO: 865970 - RNA, 19 nt, Homo sapiens
ccuuaguaccuuuuuaaca

SEQ ID NO: 865971 - RNA, 18 nt, Homo sapiens
ccuucaaugcaaaauaca

SEQ ID NO: 865972 - RNA, 23 nt, Homo sapiens
ccuuccccacaauaggcuuagug

SEQ ID NO: 865973 - RNA, 22 nt, Homo sapiens
ccuucccgcagcaccagccuga

SEQ ID NO: 865974 - RNA, 16 nt, Homo sapiens
ccuucuccacagggac

SEQ ID NO: 865975 - RNA, 13 nt, Homo sapiens
cggaaaugauuga

SEQ ID NO: 865976 - RNA, 16 nt, Homo sapiens
cggacaccaucuuggg

SEQ ID NO: 865977 - RNA, 23 nt, Homo sapiens
cggccgaggccugcgcccugaca

SEQ ID NO: 865978 - RNA, 14 nt, Homo sapiens
cgggccuccccggg

SEQ ID NO: 865979 - RNA, 17 nt, Homo sapiens
cgugccuuccccgugcg

SEQ ID NO: 865980 - RNA, 15 nt, Homo sapiens
cguuuucaccagcaa

SEQ ID NO: 865981 - RNA, 22 nt, Homo sapiens
cuaaaauuguuuccuaaaucag

SEQ ID NO: 865982 - RNA, 11 nt, Homo sapiens
cuaacaaaaga

SEQ ID NO: 865983 - RNA, 20 nt, Homo sapiens
cuaauuccccuuccauuccc

SEQ ID NO: 865984 - RNA, 20 nt, Homo sapiens
cuagagcuaugcacaccaaa

SEQ ID NO: 865985 - RNA, 15 nt, Homo sapiens
cucaaaauaaaacca

SEQ ID NO: 865986 - RNA, 22 nt, Homo sapiens
cucaacuuacauaugucuucaa

SEQ ID NO: 865987 - RNA, 21 nt, Homo sapiens
cucaaucaugggaauuuuaac

SEQ ID NO: 865988 - RNA, 20 nt, Homo sapiens
cucacugguuuucaauacca

SEQ ID NO: 865989 - RNA, 18 nt, Homo sapiens
cucagacaccuagacucu

SEQ ID NO: 865990 - RNA, 22 nt, Homo sapiens
cucaggaaugcagcacaguacu

SEQ ID NO: 865991 - RNA, 16 nt, Homo sapiens
cucaggcagugcaaua

SEQ ID NO: 865992 - RNA, 16 nt, Homo sapiens
cucaggcagugcagua

SEQ ID NO: 865993 - RNA, 17 nt, Homo sapiens
cucaggcagugcaguac

SEQ ID NO: 865994 - RNA, 21 nt, Homo sapiens
cucaguaaaucagugcaguac

SEQ ID NO: 865995 - RNA, 20 nt, Homo sapiens
cucaguaacacagugcagua

SEQ ID NO: 865996 - RNA, 15 nt, Homo sapiens
cucaguaacagugca

SEQ ID NO: 865997 - RNA, 17 nt, Homo sapiens
cucaguaagacagugca

SEQ ID NO: 865998 - RNA, 15 nt, Homo sapiens
cuccacucugaaguc

SEQ ID NO: 865999 - RNA, 22 nt, Homo sapiens
cucccuagccagaggcucuaau

SEQ ID NO: 866000 - RNA, 23 nt, Homo sapiens
cucucuuuugguuugugggucca

SEQ ID NO: 866001 - RNA, 16 nt, Homo sapiens
cucugaaccagagaaa

SEQ ID NO: 866002 - RNA, 14 nt, Homo sapiens
cucugaugcacugu

SEQ ID NO: 866003 - RNA, 20 nt, Homo sapiens
cucuuaaguacugaaauaca

SEQ ID NO: 866004 - RNA, 18 nt, Homo sapiens
cucuuaucaaguguuaca

SEQ ID NO: 866005 - RNA, 20 nt, Homo sapiens
cucuucagagcaagcacugg

SEQ ID NO: 866006 - RNA, 14 nt, Homo sapiens
cugaacucccaguc

SEQ ID NO: 866007 - RNA, 18 nt, Homo sapiens
cugaacugcaacacugga

SEQ ID NO: 866008 - RNA, 14 nt, Homo sapiens
cugacuuccugaac

SEQ ID NO: 866009 - RNA, 13 nt, Homo sapiens
cugagcagugggg

SEQ ID NO: 866010 - RNA, 14 nt, Homo sapiens
cugaggaguccaaa

SEQ ID NO: 866011 - RNA, 23 nt, Homo sapiens
cugauacaauuugcccaagguaa

SEQ ID NO: 866012 - RNA, 16 nt, Homo sapiens
cugccacgguccuuug

SEQ ID NO: 866013 - RNA, 18 nt, Homo sapiens
cugccccgaaagugcuga

SEQ ID NO: 866014 - RNA, 15 nt, Homo sapiens
cugcuccuccaguac

SEQ ID NO: 866015 - RNA, 19 nt, Homo sapiens
cugcugggaauggauuuuu

SEQ ID NO: 866016 - RNA, 16 nt, Homo sapiens
ucuccccuccaaguga

SEQ ID NO: 866017 - RNA, 17 nt, Homo sapiens
ucucgcuagccauauau

SEQ ID NO: 866018 - RNA, 20 nt, Homo sapiens
ucucuagacaucuagucuca

SEQ ID NO: 866019 - RNA, 14 nt, Homo sapiens
ucucucccuacccu

SEQ ID NO: 866020 - RNA, 15 nt, Homo sapiens
ucucugaacugcaac

SEQ ID NO: 866021 - RNA, 15 nt, Homo sapiens
ucucugaugcacugu

SEQ ID NO: 866022 - RNA, 15 nt, Homo sapiens
ucugaaggcugaguc

SEQ ID NO: 866023 - RNA, 15 nt, Homo sapiens
ucugaggaguccaaa

SEQ ID NO: 866024 - RNA, 16 nt, Homo sapiens
ucugccccuccguccc

SEQ ID NO: 866025 - RNA, 15 nt, Homo sapiens
ucuggggucugugau

SEQ ID NO: 866026 - RNA, 22 nt, Homo sapiens
ucuguuccaagugugugugcaa

SEQ ID NO: 866027 - RNA, 13 nt, Homo sapiens
ucuuaaugucuca

SEQ ID NO: 866028 - RNA, 14 nt, Homo sapiens
ucuuaaugucucaa

SEQ ID NO: 866029 - RNA, 15 nt, Homo sapiens
ucuuaaugucucaaa

SEQ ID NO: 866030 - RNA, 14 nt, Homo sapiens
ucuucaacaugguu

SEQ ID NO: 866031 - RNA, 17 nt, Homo sapiens
ucuucagagcaagcacu

SEQ ID NO: 866032 - RNA, 20 nt, Homo sapiens
ucuucccuuaggcaauggug

SEQ ID NO: 866033 - RNA, 21 nt, Homo sapiens
ucuugaaugcuuaaaugauca

SEQ ID NO: 866034 - RNA, 22 nt, Homo sapiens
ucuugaauguugaagaacucau

SEQ ID NO: 866035 - RNA, 18 nt, Homo sapiens
ucuugcggcaccgcccac

SEQ ID NO: 866036 - RNA, 14 nt, Homo sapiens
ucuugcugccaggc

SEQ ID NO: 866037 - RNA, 16 nt, Homo sapiens
ucuugguuuccaucaa

SEQ ID NO: 866038 - RNA, 17 nt, Homo sapiens
ucuuucggaaaugauug

SEQ ID NO: 866039 - RNA, 18 nt, Homo sapiens
ucuuucggaaaugauuga

SEQ ID NO: 866040 - RNA, 14 nt, Homo sapiens
ucuuugguuccuca

SEQ ID NO: 866041 - RNA, 16 nt, Homo sapiens
ugaaaagacaaauggg

SEQ ID NO: 866042 - RNA, 14 nt, Homo sapiens
ugaaauacauauga

SEQ ID NO: 866043 - RNA, 18 nt, Homo sapiens
ugaaauauaaacugugag

SEQ ID NO: 866044 - RNA, 17 nt, Homo sapiens
ugaacugcaacacugga

SEQ ID NO: 866045 - RNA, 13 nt, Homo sapiens
ugaacugccaaag

SEQ ID NO: 866046 - RNA, 20 nt, Homo sapiens
ugaagaacucaugugauuua

SEQ ID NO: 866047 - RNA, 13 nt, Homo sapiens
ugaaucucucaaa

SEQ ID NO: 866048 - RNA, 22 nt, Homo sapiens
ugaaugaaauauaaacugugag

SEQ ID NO: 866049 - RNA, 14 nt, Homo sapiens
ugaaugccagucca

SEQ ID NO: 866050 - RNA, 13 nt, Homo sapiens
ugacuauggggaa

SEQ ID NO: 866051 - RNA, 21 nt, Homo sapiens
ugacuuuccuaugacacucau

SEQ ID NO: 866052 - RNA, 14 nt, Homo sapiens
ugagacacugucaa

SEQ ID NO: 866053 - RNA, 13 nt, Homo sapiens
ugagaucauguca

SEQ ID NO: 866054 - RNA, 23 nt, Homo sapiens
ugagcaaguuuucaccuaucugg

SEQ ID NO: 866055 - RNA, 23 nt, Homo sapiens
ugagcaugcucccucaugcagau

SEQ ID NO: 866056 - RNA, 20 nt, Homo sapiens
ugauaaauuugacuguuauu

SEQ ID NO: 866057 - RNA, 16 nt, Homo sapiens
ugauagaauaaagccu

SEQ ID NO: 866058 - RNA, 16 nt, Homo sapiens
ugaucuugauauuccu

SEQ ID NO: 866059 - RNA, 12 nt, Homo sapiens
ugaugauguucu

SEQ ID NO: 866060 - RNA, 13 nt, Homo sapiens
ugaugauguucug

SEQ ID NO: 866061 - RNA, 14 nt, Homo sapiens
ugauguaacugugu

SEQ ID NO: 866062 - RNA, 23 nt, Homo sapiens
ugauguccaaacuuaacagauca

SEQ ID NO: 866063 - RNA, 15 nt, Homo sapiens
ugauuaacucagucc

SEQ ID NO: 866064 - RNA, 17 nt, Homo sapiens
ugcaaugcaagcccuuu

SEQ ID NO: 866065 - RNA, 23 nt, Homo sapiens
ugcagcacaguacucaggcagug

SEQ ID NO: 866066 - RNA, 14 nt, Homo sapiens
ugcagcaguaccau

SEQ ID NO: 866067 - RNA, 22 nt, Homo sapiens
ugcagcccagaacgggccuccc

SEQ ID NO: 866068 - RNA, 17 nt, Homo sapiens
ugcaguacucaguaaua

SEQ ID NO: 866069 - RNA, 22 nt, Homo sapiens
ugcauaaauauuagcaaagcau

SEQ ID NO: 866070 - RNA, 12 nt, Homo sapiens
ugccaggcagug

SEQ ID NO: 866071 - RNA, 17 nt, Homo sapiens
ugcccacccguguucuc

SEQ ID NO: 866072 - RNA, 20 nt, Homo sapiens
ugcccagacucaaggccucc

SEQ ID NO: 866073 - RNA, 13 nt, Homo sapiens
ugccccuccgucc

SEQ ID NO: 866074 - RNA, 17 nt, Homo sapiens
ugccguggcaacugugg

SEQ ID NO: 866075 - RNA, 22 nt, Homo sapiens
ugcuaucucgcuagccauauau

SEQ ID NO: 866076 - RNA, 21 nt, Homo sapiens
ugcucaguaaggcagugcaau

SEQ ID NO: 866077 - RNA, 20 nt, Homo sapiens
ugcucccuagccagaggcuc

SEQ ID NO: 866078 - RNA, 15 nt, Homo sapiens
aauuaaccauugcua

SEQ ID NO: 866079 - RNA, 17 nt, Homo sapiens
aauuagacauaccucuc

SEQ ID NO: 866080 - RNA, 18 nt, Homo sapiens
aauuaugucaaauggaug

SEQ ID NO: 866081 - RNA, 21 nt, Homo sapiens
aauucaaagaaucaccuaauu

SEQ ID NO: 866082 - RNA, 17 nt, Homo sapiens
aauuuaaggccugcacu

SEQ ID NO: 866083 - RNA, 17 nt, Homo sapiens
aauuuaggaaugcucaa

SEQ ID NO: 866084 - RNA, 16 nt, Homo sapiens
aauuuguucugugcaa

SEQ ID NO: 866085 - RNA, 15 nt, Homo sapiens
acaaaaacuuuccau

SEQ ID NO: 866086 - RNA, 20 nt, Homo sapiens
acaaaagaagugugacuaga

SEQ ID NO: 866087 - RNA, 18 nt, Homo sapiens
acaaaugggccugccaaa

SEQ ID NO: 866088 - RNA, 23 nt, Homo sapiens
acaaccuccuccuccaguucuga

SEQ ID NO: 866089 - RNA, 16 nt, Homo sapiens
acaaguuacauacauu

SEQ ID NO: 866090 - RNA, 13 nt, Homo sapiens
acaauaaagcaau

SEQ ID NO: 866091 - RNA, 18 nt, Homo sapiens
acaauaggcuuagugcuu

SEQ ID NO: 866092 - RNA, 22 nt, Homo sapiens
acaauguggaauuacauaacag

SEQ ID NO: 866093 - RNA, 20 nt, Homo sapiens
acaauuacuuugaacauuaa

SEQ ID NO: 866094 - RNA, 18 nt, Homo sapiens
acacaauacaguacucag

SEQ ID NO: 866095 - RNA, 13 nt, Homo sapiens
acacagugcagug

SEQ ID NO: 866096 - RNA, 21 nt, Homo sapiens
acacucaucagguaaacugau

SEQ ID NO: 866097 - RNA, 23 nt, Homo sapiens
acacugagcaaguuuucaccuau

SEQ ID NO: 866098 - RNA, 19 nt, Homo sapiens
acagauguacauuaaauac

SEQ ID NO: 866099 - RNA, 15 nt, Homo sapiens
acagcauaauugccu

SEQ ID NO: 866100 - RNA, 22 nt, Homo sapiens
acagcggcccggcccacgcaga

SEQ ID NO: 866101 - RNA, 15 nt, Homo sapiens
acaggaaaaugacuu

SEQ ID NO: 866102 - RNA, 20 nt, Homo sapiens
acaguagcauacugaugaga

SEQ ID NO: 866103 - RNA, 14 nt, Homo sapiens
acagugaugccaug

SEQ ID NO: 866104 - RNA, 15 nt, Homo sapiens
acagugcagugcuca

SEQ ID NO: 866105 - RNA, 17 nt, Homo sapiens
acaguguaguacucagu

SEQ ID NO: 866106 - RNA, 16 nt, Homo sapiens
acaguuucuuccccaa

SEQ ID NO: 866107 - RNA, 13 nt, Homo sapiens
acaguuuguucag

SEQ ID NO: 866108 - RNA, 23 nt, Homo sapiens
acauaccucucaacuuacauaug

SEQ ID NO: 866109 - RNA, 17 nt, Homo sapiens
acauacgcacugggcau

SEQ ID NO: 866110 - RNA, 12 nt, Homo sapiens
acaucucuucau

SEQ ID NO: 866111 - RNA, 16 nt, Homo sapiens
acaucugcauuucuac

SEQ ID NO: 866112 - RNA, 19 nt, Homo sapiens
acauguugcuaaugacagu

SEQ ID NO: 866113 - RNA, 14 nt, Homo sapiens
acauuguaaaugau

SEQ ID NO: 866114 - RNA, 22 nt, Homo sapiens
acauuuaaaaaacauuuuacag

SEQ ID NO: 866115 - RNA, 20 nt, Homo sapiens
accagagaaaugaaagucag

SEQ ID NO: 866116 - RNA, 12 nt, Homo sapiens
accauugcuaau

SEQ ID NO: 866117 - RNA, 19 nt, Homo sapiens
acccaaguuggagugcagu

SEQ ID NO: 866118 - RNA, 20 nt, Homo sapiens
acccaaguuggagugcagug

SEQ ID NO: 866119 - RNA, 16 nt, Homo sapiens
acccuucuacaaaaga

SEQ ID NO: 866120 - RNA, 19 nt, Homo sapiens
accuaguccccagccugcu

SEQ ID NO: 866121 - RNA, 17 nt, Homo sapiens
accuaugugugugcuuu

SEQ ID NO: 866122 - RNA, 23 nt, Homo sapiens
accuaugugugugcuuugccacu

SEQ ID NO: 866123 - RNA, 16 nt, Homo sapiens
accuccuccuccaguu

SEQ ID NO: 866124 - RNA, 21 nt, Homo sapiens
uuucaugauuagacaaugugg

SEQ ID NO: 866125 - RNA, 21 nt, Homo sapiens
uuuccaaagguuucaacugua

SEQ ID NO: 866126 - RNA, 22 nt, Homo sapiens
uuuccccuuuuaaaaacucaga

SEQ ID NO: 866127 - RNA, 17 nt, Homo sapiens
uuuccugcuccuccagu

SEQ ID NO: 866128 - RNA, 19 nt, Homo sapiens
uuuccuuuuguuuacaaca

SEQ ID NO: 866129 - RNA, 17 nt, Homo sapiens
uuucugcagaaaauucu

SEQ ID NO: 866130 - RNA, 13 nt, Homo sapiens
uuucugccucaca

SEQ ID NO: 866131 - RNA, 13 nt, Homo sapiens
uuugacacacuca

SEQ ID NO: 866132 - RNA, 20 nt, Homo sapiens
uuugacuuucugucugugga

SEQ ID NO: 866133 - RNA, 23 nt, Homo sapiens
uuugucaguguagaucaacucau

SEQ ID NO: 866134 - RNA, 13 nt, Homo sapiens
uuuguucagugag

SEQ ID NO: 866135 - RNA, 14 nt, Homo sapiens
uuuguuuacaacac

SEQ ID NO: 866136 - RNA, 18 nt, Homo sapiens
caauaaagcaauguggua

SEQ ID NO: 866137 - RNA, 19 nt, Homo sapiens
caauacaaguuacauacau

SEQ ID NO: 866138 - RNA, 23 nt, Homo sapiens
caaucaguaauuaacauaucaag

SEQ ID NO: 866139 - RNA, 22 nt, Homo sapiens
caaugcucaguaacacagugca

SEQ ID NO: 866140 - RNA, 17 nt, Homo sapiens
cacagaguuacugccac

SEQ ID NO: 866141 - RNA, 12 nt, Homo sapiens
cacagugcagug

SEQ ID NO: 866142 - RNA, 14 nt, Homo sapiens
cacaucagcccugu

SEQ ID NO: 866143 - RNA, 19 nt, Homo sapiens
cacaugccccucuuagaag

SEQ ID NO: 866144 - RNA, 15 nt, Homo sapiens
cacccuaucaucagu

SEQ ID NO: 866145 - RNA, 23 nt, Homo sapiens
cacucaaugccaggcagugcagc

SEQ ID NO: 866146 - RNA, 21 nt, Homo sapiens
cacucuuauuucacuaaagaa

SEQ ID NO: 866147 - RNA, 16 nt, Homo sapiens
cacuuauuuccaugga

SEQ ID NO: 866148 - RNA, 17 nt, Homo sapiens
cacuuuuuuccugucaa

SEQ ID NO: 866149 - RNA, 13 nt, Homo sapiens
cagaaaagcaccu

SEQ ID NO: 866150 - RNA, 17 nt, Homo sapiens
cagaauggggacaucuu

SEQ ID NO: 866151 - RNA, 15 nt, Homo sapiens
cagacaccuagacuc

SEQ ID NO: 866152 - RNA, 14 nt, Homo sapiens
cagaggcucuaaug

SEQ ID NO: 866153 - RNA, 22 nt, Homo sapiens
cagaggcucuaauguacaauaa

SEQ ID NO: 866154 - RNA, 15 nt, Homo sapiens
cagcaaaagugcagu

SEQ ID NO: 866155 - RNA, 16 nt, Homo sapiens
cagcaaaagugcagua

SEQ ID NO: 866156 - RNA, 15 nt, Homo sapiens
cagcaccagccugag

SEQ ID NO: 866157 - RNA, 21 nt, Homo sapiens
cagcacuucccaaagugcacu

SEQ ID NO: 866158 - RNA, 17 nt, Homo sapiens
cagcauuucagcuguga

SEQ ID NO: 866159 - RNA, 21 nt, Homo sapiens
caggugacuuuccuaugacac

SEQ ID NO: 866160 - RNA, 22 nt, Homo sapiens
caguaaaucagugcaguacuca

SEQ ID NO: 866161 - RNA, 18 nt, Homo sapiens
caguaacacagugcagug

SEQ ID NO: 866162 - RNA, 22 nt, Homo sapiens
caguaacacagugcagugcuca

SEQ ID NO: 866163 - RNA, 13 nt, Homo sapiens
caguaacagugaa

SEQ ID NO: 866164 - RNA, 15 nt, Homo sapiens
caguaagacagugca

SEQ ID NO: 866165 - RNA, 18 nt, Homo sapiens
caguaaggcagugcagua

SEQ ID NO: 866166 - RNA, 19 nt, Homo sapiens
caguacaauaaauaaaaga

SEQ ID NO: 866167 - RNA, 22 nt, Homo sapiens
caguacuauaaguacugaguac

SEQ ID NO: 866168 - RNA, 19 nt, Homo sapiens
caguacucaggcagugcaa

SEQ ID NO: 866169 - RNA, 21 nt, Homo sapiens
caguccccagguaucugauga

SEQ ID NO: 866170 - RNA, 15 nt, Homo sapiens
cagucuggugcccag

SEQ ID NO: 866171 - RNA, 14 nt, Homo sapiens
cagugaaguacuca

SEQ ID NO: 866172 - RNA, 15 nt, Homo sapiens
cagugaugccaugaa

SEQ ID NO: 866173 - RNA, 18 nt, Homo sapiens
cagugcaauacucaguaa

SEQ ID NO: 866174 - RNA, 13 nt, Homo sapiens
cagugccuaacuc

SEQ ID NO: 866175 - RNA, 17 nt, Homo sapiens
caguguagaucaacuca

SEQ ID NO: 866176 - RNA, 24 nt, Homo sapiens
cauauauaauuuuauugcuggaau

SEQ ID NO: 866177 - RNA, 17 nt, Homo sapiens
cauaucuguaugccuca

SEQ ID NO: 866178 - RNA, 20 nt, Homo sapiens
cauauuauaucagacugcuu

SEQ ID NO: 866179 - RNA, 16 nt, Homo sapiens
cauauuuaaagucuug

SEQ ID NO: 866180 - RNA, 12 nt, Homo sapiens
caucaaagcccu

SEQ ID NO: 866181 - RNA, 22 nt, Homo sapiens
cauccuucccgcagcaccagcc

SEQ ID NO: 866182 - RNA, 18 nt, Homo sapiens
ugacacacucaccauuua

SEQ ID NO: 866183 - RNA, 21 nt, Homo sapiens
ugacacagcugagcuggccua

SEQ ID NO: 866184 - RNA, 14 nt, Homo sapiens
ugacagggaaaaga

SEQ ID NO: 866185 - RNA, 20 nt, Homo sapiens
ugacaguagcauacugauga

SEQ ID NO: 866186 - RNA, 16 nt, Homo sapiens
ugaccacuuguagucc

SEQ ID NO: 866187 - RNA, 14 nt, Homo sapiens
ugauaaauuugacu

SEQ ID NO: 866188 - RNA, 15 nt, Homo sapiens
ugauagaacaaaaga

SEQ ID NO: 866189 - RNA, 15 nt, Homo sapiens
ugaugaaaaccaccc

SEQ ID NO: 866190 - RNA, 19 nt, Homo sapiens
ugaugagacaacacacaca

SEQ ID NO: 866191 - RNA, 12 nt, Homo sapiens
ugaugugcucau

SEQ ID NO: 866192 - RNA, 21 nt, Homo sapiens
ugauugagagcagccucuuga

SEQ ID NO: 866193 - RNA, 14 nt, Homo sapiens
ugcaauacucagua

SEQ ID NO: 866194 - RNA, 14 nt, Homo sapiens
ugcaauuuacuugg

SEQ ID NO: 866195 - RNA, 19 nt, Homo sapiens
ugcaucaugcaugcacucu

SEQ ID NO: 866196 - RNA, 16 nt, Homo sapiens
ugccacgguccuuuga

SEQ ID NO: 866197 - RNA, 14 nt, Homo sapiens
ugccuucacuacaa

SEQ ID NO: 866198 - RNA, 17 nt, Homo sapiens
ugccuuuuccuauguaa

SEQ ID NO: 866199 - RNA, 18 nt, Homo sapiens
ugccuuuuccuauguaaa

SEQ ID NO: 866200 - RNA, 21 nt, Homo sapiens
ugcucagccuuccaugcugug

SEQ ID NO: 866201 - RNA, 22 nt, Homo sapiens
ugcucaguaacacagugcagug

SEQ ID NO: 866202 - RNA, 17 nt, Homo sapiens
ugcucaguaaggcagug

SEQ ID NO: 866203 - RNA, 14 nt, Homo sapiens
ugcucuuuaccuug

SEQ ID NO: 866204 - RNA, 16 nt, Homo sapiens
ugcugugaaacagugu

SEQ ID NO: 866205 - RNA, 14 nt, Homo sapiens
ugcuuacagugaug

SEQ ID NO: 866206 - RNA, 19 nt, Homo sapiens
uggagagagcaaucuugcu

SEQ ID NO: 866207 - RNA, 13 nt, Homo sapiens
uggcaaacauuua

SEQ ID NO: 866208 - RNA, 13 nt, Homo sapiens
uggccacucuuga

SEQ ID NO: 866209 - RNA, 12 nt, Homo sapiens
uggcccuguuaa

SEQ ID NO: 866210 - RNA, 22 nt, Homo sapiens
uggccuugggagagaugccuuc

SEQ ID NO: 866211 - RNA, 22 nt, Homo sapiens
uggcucacaaaagguuaaugga

SEQ ID NO: 866212 - RNA, 22 nt, Homo sapiens
ugggcaacagagugagacccua

SEQ ID NO: 866213 - RNA, 21 nt, Homo sapiens
uggucauuugguggcucuaac

SEQ ID NO: 866214 - RNA, 19 nt, Homo sapiens
uggugugaggcccccggag

SEQ ID NO: 866215 - RNA, 13 nt, Homo sapiens
uguaaaacuguga

SEQ ID NO: 866216 - RNA, 22 nt, Homo sapiens
uguaaaacugugacauuccaca

SEQ ID NO: 866217 - RNA, 18 nt, Homo sapiens
uguaaauauacacuauuu

SEQ ID NO: 866218 - RNA, 22 nt, Homo sapiens
uguaacucacaugccuucuaaa

SEQ ID NO: 866219 - RNA, 19 nt, Homo sapiens
uguaauccuagcacuuugg

SEQ ID NO: 866220 - RNA, 14 nt, Homo sapiens
uguacaaaauaucc

SEQ ID NO: 866221 - RNA, 18 nt, Homo sapiens
uguacaaaauauccaagc

SEQ ID NO: 866222 - RNA, 14 nt, Homo sapiens
uguacaauaaagca

SEQ ID NO: 866223 - RNA, 12 nt, Homo sapiens
uguacagaugau

SEQ ID NO: 866224 - RNA, 18 nt, Homo sapiens
uguauaagaugcugcuga

SEQ ID NO: 866225 - RNA, 18 nt, Homo sapiens
ugucaagauuaaguuaua

SEQ ID NO: 866226 - RNA, 23 nt, Homo sapiens
ugucacccaaguuggagugcagu

SEQ ID NO: 866227 - RNA, 24 nt, Homo sapiens
ugucagggguuugcuuacagugau

SEQ ID NO: 866228 - RNA, 17 nt, Homo sapiens
ugucaguguagaucaac

SEQ ID NO: 866229 - RNA, 13 nt, Homo sapiens
ugucaucugucag

SEQ ID NO: 866230 - RNA, 15 nt, Homo sapiens
uguccuaaaugcaaa

SEQ ID NO: 866231 - RNA, 18 nt, Homo sapiens
ugucucaaaauaaaacca

SEQ ID NO: 866232 - RNA, 16 nt, Homo sapiens
ugucuccucugucagu

SEQ ID NO: 866233 - RNA, 13 nt, Homo sapiens
ugucucucuuuug

SEQ ID NO: 866234 - RNA, 10 nt, Homo sapiens
ugugccuaac

SEQ ID NO: 866235 - RNA, 18 nt, Homo sapiens
uguggcacacaacugugg

SEQ ID NO: 866236 - RNA, 15 nt, Homo sapiens
ugugucaucugucag

SEQ ID NO: 866237 - RNA, 16 nt, Homo sapiens
ugugucaucugucagc

SEQ ID NO: 866238 - RNA, 15 nt, Homo sapiens
ugugugugcaauguu

SEQ ID NO: 866239 - RNA, 20 nt, Homo sapiens
uguuaaauaaggccucaucc

SEQ ID NO: 866240 - RNA, 16 nt, Homo sapiens
uuaaaacuuacuaugg

SEQ ID NO: 866241 - RNA, 17 nt, Homo sapiens
uuaaauaaaaaaguuua

SEQ ID NO: 866242 - RNA, 15 nt, Homo sapiens
uuaaccauugcuaau

SEQ ID NO: 866243 - RNA, 23 nt, Homo sapiens
uuaagcacaaccauguucuugag

SEQ ID NO: 866244 - RNA, 14 nt, Homo sapiens
uuaaucauuuccag

SEQ ID NO: 866245 - RNA, 21 nt, Homo sapiens
uuacauaacaggcauugcacu

SEQ ID NO: 866246 - RNA, 13 nt, Homo sapiens
uuacuaacacugg

SEQ ID NO: 866247 - RNA, 14 nt, Homo sapiens
uuagacauaccucu

SEQ ID NO: 866248 - RNA, 22 nt, Homo sapiens
uuagauuaacccuauuaaucua

SEQ ID NO: 866249 - RNA, 12 nt, Homo sapiens
uuagcaaagcau

SEQ ID NO: 866250 - RNA, 18 nt, Homo sapiens
uuagcaaagcaugccaau

SEQ ID NO: 866251 - RNA, 16 nt, Homo sapiens
uuagcuuacugauuaa

SEQ ID NO: 866252 - RNA, 19 nt, Homo sapiens
uuaggaaagcagugcagua

SEQ ID NO: 866253 - RNA, 20 nt, Homo sapiens
cugaguagcauauauaauuu

SEQ ID NO: 866254 - RNA, 20 nt, Homo sapiens
cugauacaauuugcccaagg

SEQ ID NO: 866255 - RNA, 15 nt, Homo sapiens
cugauccuuguggca

SEQ ID NO: 866256 - RNA, 13 nt, Homo sapiens
cugcaacacugga

SEQ ID NO: 866257 - RNA, 23 nt, Homo sapiens
cugcacucuuauuucacuaaaga

SEQ ID NO: 866258 - RNA, 10 nt, Homo sapiens
cugcauuuca

SEQ ID NO: 866259 - RNA, 15 nt, Homo sapiens
cugccaagaguccaa

SEQ ID NO: 866260 - RNA, 17 nt, Homo sapiens
cugccaagaguccaagc

SEQ ID NO: 866261 - RNA, 19 nt, Homo sapiens
cugcccccucccccgcaga

SEQ ID NO: 866262 - RNA, 14 nt, Homo sapiens
cugcuuagaauuaa

SEQ ID NO: 866263 - RNA, 15 nt, Homo sapiens
cuggcauuugcugca

SEQ ID NO: 866264 - RNA, 13 nt, Homo sapiens
cuggccccaggcg

SEQ ID NO: 866265 - RNA, 23 nt, Homo sapiens
cuggccuauuuuggacgugugag

SEQ ID NO: 866266 - RNA, 13 nt, Homo sapiens
cuguauccaaguu

SEQ ID NO: 866267 - RNA, 20 nt, Homo sapiens
cugugcaacaaacucaaaau

SEQ ID NO: 866268 - RNA, 16 nt, Homo sapiens
cugugucaucugucag

SEQ ID NO: 866269 - RNA, 17 nt, Homo sapiens
cuuaguaccuuuuuaac

SEQ ID NO: 866270 - RNA, 17 nt, Homo sapiens
cuuauauacuaauauca

SEQ ID NO: 866271 - RNA, 14 nt, Homo sapiens
cuuauuuccaugga

SEQ ID NO: 866272 - RNA, 15 nt, Homo sapiens
cuucaaacgaaaugg

SEQ ID NO: 866273 - RNA, 18 nt, Homo sapiens
cuucagagcaagcacugg

SEQ ID NO: 866274 - RNA, 17 nt, Homo sapiens
cuucuccacaaccuccu

SEQ ID NO: 866275 - RNA, 14 nt, Homo sapiens
cuucuccacaggga

SEQ ID NO: 866276 - RNA, 15 nt, Homo sapiens
cuucuccacagggac

SEQ ID NO: 866277 - RNA, 23 nt, Homo sapiens
cuucuccacagggacacagucug

SEQ ID NO: 866278 - RNA, 17 nt, Homo sapiens
cuucuccccuccaagug

SEQ ID NO: 866279 - RNA, 18 nt, Homo sapiens
cuucuuuacuaacacugg

SEQ ID NO: 866280 - RNA, 19 nt, Homo sapiens
cuucuuuacuaacacuggc

SEQ ID NO: 866281 - RNA, 16 nt, Homo sapiens
cuugaggccaaaugag

SEQ ID NO: 866282 - RNA, 16 nt, Homo sapiens
cuuggcucagacaccu

SEQ ID NO: 866283 - RNA, 18 nt, Homo sapiens
cuugguuuugauguugaa

SEQ ID NO: 866284 - RNA, 15 nt, Homo sapiens
cuuuacuaacacugg

SEQ ID NO: 866285 - RNA, 14 nt, Homo sapiens
cuuucaauccacag

SEQ ID NO: 866286 - RNA, 23 nt, Homo sapiens
cuuuccucuuaaugucucaaaau

SEQ ID NO: 866287 - RNA, 13 nt, Homo sapiens
cuuugcaaugcaa

SEQ ID NO: 866288 - RNA, 12 nt, Homo sapiens
cuuuggcaauau

SEQ ID NO: 866289 - RNA, 19 nt, Homo sapiens
cuuuuuuaagacucaauca

SEQ ID NO: 866290 - RNA, 22 nt, Homo sapiens
gaaaaccucuuucggaaaugau

SEQ ID NO: 866291 - RNA, 16 nt, Homo sapiens
gaaaagcaccucuuga

SEQ ID NO: 866292 - RNA, 19 nt, Homo sapiens
gaaaccagccaacccaagu

SEQ ID NO: 866293 - RNA, 14 nt, Homo sapiens
gaaagcagugcagu

SEQ ID NO: 866294 - RNA, 12 nt, Homo sapiens
gaaauacauaug

SEQ ID NO: 866295 - RNA, 13 nt, Homo sapiens
gaaauacauauga

SEQ ID NO: 866296 - RNA, 15 nt, Homo sapiens
gaaauacuugacaac

SEQ ID NO: 866297 - RNA, 22 nt, Homo sapiens
gaacagggaugcuaucucgcua

SEQ ID NO: 866298 - RNA, 15 nt, Homo sapiens
gaacugcaacacugg

SEQ ID NO: 866299 - RNA, 12 nt, Homo sapiens
gaagaagcaaac

SEQ ID NO: 866300 - RNA, 14 nt, Homo sapiens
gaagauaccauaag

SEQ ID NO: 866301 - RNA, 17 nt, Homo sapiens
gaagcucagcuaugaaa

SEQ ID NO: 866302 - RNA, 23 nt, Homo sapiens
gaagggccuucuccacagggaca

SEQ ID NO: 866303 - RNA, 14 nt, Homo sapiens
gaauaaaaugauua

SEQ ID NO: 866304 - RNA, 16 nt, Homo sapiens
gaauauggcaauagca

SEQ ID NO: 866305 - RNA, 16 nt, Homo sapiens
gaauauguauguuucu

SEQ ID NO: 866306 - RNA, 15 nt, Homo sapiens
gaaugcuuaaaugau

SEQ ID NO: 866307 - RNA, 13 nt, Homo sapiens
gaauuacauaaca

SEQ ID NO: 866308 - RNA, 19 nt, Homo sapiens
gacaaaugggccugccaaa

SEQ ID NO: 866309 - RNA, 20 nt, Homo sapiens
gacaaaugggccugccaaac

SEQ ID NO: 866310 - RNA, 19 nt, Homo sapiens
gaccucccugucucuacaa

SEQ ID NO: 866311 - RNA, 20 nt, Homo sapiens
gaccugcuuugagauuuccu

SEQ ID NO: 866312 - RNA, 15 nt, Homo sapiens
gacgugugaggaugu

SEQ ID NO: 866313 - RNA, 15 nt, Homo sapiens
gacugugacacagcu

SEQ ID NO: 866314 - RNA, 16 nt, Homo sapiens
gagaacagggaugcua

SEQ ID NO: 866315 - RNA, 14 nt, Homo sapiens
gagagaacagggau

SEQ ID NO: 866316 - RNA, 20 nt, Homo sapiens
gagagcaaucuugcugugaa

SEQ ID NO: 866317 - RNA, 22 nt, Homo sapiens
gagagcaaucuugcugugaaac

SEQ ID NO: 866318 - RNA, 14 nt, Homo sapiens
gagagcagccucuu

SEQ ID NO: 866319 - RNA, 12 nt, Homo sapiens
ggcagugcagua

SEQ ID NO: 866320 - RNA, 22 nt, Homo sapiens
ggcccuguuaaggcauccacuu

SEQ ID NO: 866321 - RNA, 18 nt, Homo sapiens
ggccugccaaacuguaca

SEQ ID NO: 866322 - RNA, 15 nt, Homo sapiens
ggcucuaauguacaa

SEQ ID NO: 866323 - RNA, 19 nt, Homo sapiens
ggcucuaauguacaauaaa

SEQ ID NO: 866324 - RNA, 11 nt, Homo sapiens
ggcucucucac

SEQ ID NO: 866325 - RNA, 21 nt, Homo sapiens
gggccacugcuugaagaagaa

SEQ ID NO: 866326 - RNA, 23 nt, Homo sapiens
ggguaccuaguccccagccugcu

SEQ ID NO: 866327 - RNA, 21 nt, Homo sapiens
gguaaauaaucauacacagaa

SEQ ID NO: 866328 - RNA, 17 nt, Homo sapiens
gguaagggacuccagaa

SEQ ID NO: 866329 - RNA, 13 nt, Homo sapiens
guaaaauacuucu

SEQ ID NO: 866330 - RNA, 19 nt, Homo sapiens
guaaaucagugcaguacuc

SEQ ID NO: 866331 - RNA, 20 nt, Homo sapiens
guaaaucagugcaguacuca

SEQ ID NO: 866332 - RNA, 15 nt, Homo sapiens
guaagacagugcagu

SEQ ID NO: 866333 - RNA, 19 nt, Homo sapiens
guaauacaauacaguacuc

SEQ ID NO: 866334 - RNA, 16 nt, Homo sapiens
guaauccuagcacuuu

SEQ ID NO: 866335 - RNA, 19 nt, Homo sapiens
guacucaggcagugcagua

SEQ ID NO: 866336 - RNA, 10 nt, Homo sapiens
guacucagua

SEQ ID NO: 866337 - RNA, 23 nt, Homo sapiens
guacucaguaacacagugcagua

SEQ ID NO: 866338 - RNA, 22 nt, Homo sapiens
guacucaguaaggcagugcagu

SEQ ID NO: 866339 - RNA, 13 nt, Homo sapiens
guacucugagucc

SEQ ID NO: 866340 - RNA, 22 nt, Homo sapiens
gucagcacauguugcuaaugac

SEQ ID NO: 866341 - RNA, 12 nt, Homo sapiens
gucaucugucag

SEQ ID NO: 866342 - RNA, 17 nt, Homo sapiens
guccacccccauuguga

SEQ ID NO: 866343 - RNA, 22 nt, Homo sapiens
guccaggagaugaggcuggaua

SEQ ID NO: 866344 - RNA, 15 nt, Homo sapiens
guccuuucccaccca

SEQ ID NO: 866345 - RNA, 15 nt, Homo sapiens
gucuaguggaaccaa

SEQ ID NO: 866346 - RNA, 13 nt, Homo sapiens
gucuccucuguca

SEQ ID NO: 866347 - RNA, 16 nt, Homo sapiens
gucuguccuuucccac

SEQ ID NO: 866348 - RNA, 14 nt, Homo sapiens
gucugucucucuuu

SEQ ID NO: 866349 - RNA, 22 nt, Homo sapiens
gucugugaaagucuccuguauc

SEQ ID NO: 866350 - RNA, 16 nt, Homo sapiens
gugauagaacaaaaga

SEQ ID NO: 866351 - RNA, 20 nt, Homo sapiens
gugcauucauucauccucuu

SEQ ID NO: 866352 - RNA, 16 nt, Homo sapiens
gugccuaauguuccau

SEQ ID NO: 866353 - RNA, 19 nt, Homo sapiens
gugcuccugcugaccuucu

SEQ ID NO: 866354 - RNA, 21 nt, Homo sapiens
gugcugcuguggcaucaggaa

SEQ ID NO: 866355 - RNA, 17 nt, Homo sapiens
guggaccaguucccuca

SEQ ID NO: 866356 - RNA, 13 nt, Homo sapiens
gugucaucuguca

SEQ ID NO: 866357 - RNA, 17 nt, Homo sapiens
guguggcuuaaacauuu

SEQ ID NO: 866358 - RNA, 15 nt, Homo sapiens
guuaggcagugcagu

SEQ ID NO: 866359 - RNA, 20 nt, Homo sapiens
guuagguaucaaaauguugu

SEQ ID NO: 866360 - RNA, 16 nt, Homo sapiens
guucagaaaagcaccu

SEQ ID NO: 866361 - RNA, 20 nt, Homo sapiens
guuccucauggcuguuaucu

SEQ ID NO: 866362 - RNA, 18 nt, Homo sapiens
guugcuaaugacagugga

SEQ ID NO: 866363 - RNA, 21 nt, Homo sapiens
guuuagaaucaagucugugaa

SEQ ID NO: 866364 - RNA, 17 nt, Homo sapiens
uaaaaccucucuuucca

SEQ ID NO: 866365 - RNA, 13 nt, Homo sapiens
gcggaggggcuug

SEQ ID NO: 866366 - RNA, 13 nt, Homo sapiens
gcgucugcugcuc

SEQ ID NO: 866367 - RNA, 12 nt, Homo sapiens
gcuaaccucucu

SEQ ID NO: 866368 - RNA, 17 nt, Homo sapiens
gcuaaccucucugaacu

SEQ ID NO: 866369 - RNA, 14 nt, Homo sapiens
gcuaagccugauga

SEQ ID NO: 866370 - RNA, 15 nt, Homo sapiens
gcuaagccugaugau

SEQ ID NO: 866371 - RNA, 15 nt, Homo sapiens
gcucaaugugcuguu

SEQ ID NO: 866372 - RNA, 18 nt, Homo sapiens
gcucaaugugcuguugau

SEQ ID NO: 866373 - RNA, 15 nt, Homo sapiens
gcucacgucugugag

SEQ ID NO: 866374 - RNA, 14 nt, Homo sapiens
gcuccgggugcgug

SEQ ID NO: 866375 - RNA, 18 nt, Homo sapiens
gcuccucugcagccugag

SEQ ID NO: 866376 - RNA, 21 nt, Homo sapiens
gcuggcauuugcugcauuuca

SEQ ID NO: 866377 - RNA, 17 nt, Homo sapiens
ggaaaaaauuagacaag

SEQ ID NO: 866378 - RNA, 22 nt, Homo sapiens
ggaaaaagaauauauugccaaa

SEQ ID NO: 866379 - RNA, 18 nt, Homo sapiens
ggaaaaaggcuucuccac

SEQ ID NO: 866380 - RNA, 18 nt, Homo sapiens
ggaaaagauuucugucca

SEQ ID NO: 866381 - RNA, 16 nt, Homo sapiens
ggaaagcagugcagua

SEQ ID NO: 866382 - RNA, 19 nt, Homo sapiens
ggaaaugauugagagcagc

SEQ ID NO: 866383 - RNA, 17 nt, Homo sapiens
ggaacaguaauuacuuu

SEQ ID NO: 866384 - RNA, 19 nt, Homo sapiens
ggaaugcagcacaguacuc

SEQ ID NO: 866385 - RNA, 13 nt, Homo sapiens
ggacagugccuaa

SEQ ID NO: 866386 - RNA, 20 nt, Homo sapiens
ggaccugcuuugagauuucc

SEQ ID NO: 866387 - RNA, 23 nt, Homo sapiens
ggagagagcaaucuugcugugaa

SEQ ID NO: 866388 - RNA, 15 nt, Homo sapiens
ggccugcacucuuau

SEQ ID NO: 866389 - RNA, 17 nt, Homo sapiens
ggccuucuccacaggga

SEQ ID NO: 866390 - RNA, 18 nt, Homo sapiens
ggccuucuccacagggac

SEQ ID NO: 866391 - RNA, 14 nt, Homo sapiens
gggccgccuccucc

SEQ ID NO: 866392 - RNA, 12 nt, Homo sapiens
gggucugugaug

SEQ ID NO: 866393 - RNA, 17 nt, Homo sapiens
gguagaguccuaggaca

SEQ ID NO: 866394 - RNA, 17 nt, Homo sapiens
gguaucugaugauguuc

SEQ ID NO: 866395 - RNA, 17 nt, Homo sapiens
ggugaacugaagcagag

SEQ ID NO: 866396 - RNA, 18 nt, Homo sapiens
ggugacuuuccuaugaca

SEQ ID NO: 866397 - RNA, 13 nt, Homo sapiens
gguuuagaaucaa

SEQ ID NO: 866398 - RNA, 14 nt, Homo sapiens
guaaaacugugaca

SEQ ID NO: 866399 - RNA, 16 nt, Homo sapiens
guaaaucagugcagua

SEQ ID NO: 866400 - RNA, 11 nt, Homo sapiens
guaaggcagua

SEQ ID NO: 866401 - RNA, 21 nt, Homo sapiens
guacaauaaagcaauguggua

SEQ ID NO: 866402 - RNA, 23 nt, Homo sapiens
guacucaguaaaucagugcagua

SEQ ID NO: 866403 - RNA, 20 nt, Homo sapiens
guacucaguaacacagugca

SEQ ID NO: 866404 - RNA, 23 nt, Homo sapiens
guacucaguaaggcagugcagua

SEQ ID NO: 866405 - RNA, 22 nt, Homo sapiens
guacucaguuaggcagugcagu

SEQ ID NO: 866406 - RNA, 21 nt, Homo sapiens
guaucaaaaugaaugccaguc

SEQ ID NO: 866407 - RNA, 13 nt, Homo sapiens
gucauugaugaac

SEQ ID NO: 866408 - RNA, 21 nt, Homo sapiens
gucauugaugaacugccaaag

SEQ ID NO: 866409 - RNA, 20 nt, Homo sapiens
guccaaaauaucgagugaau

SEQ ID NO: 866410 - RNA, 17 nt, Homo sapiens
gucccaguuaacuguua

SEQ ID NO: 866411 - RNA, 14 nt, Homo sapiens
guccccagccugcu

SEQ ID NO: 866412 - RNA, 22 nt, Homo sapiens
guccccagccugcucccuagcc

SEQ ID NO: 866413 - RNA, 22 nt, Homo sapiens
guccccggacgcuggcucggga

SEQ ID NO: 866414 - RNA, 18 nt, Homo sapiens
guccugugucaucuguca

SEQ ID NO: 866415 - RNA, 15 nt, Homo sapiens
gucucucccuacccu

SEQ ID NO: 866416 - RNA, 15 nt, Homo sapiens
gugaacugaagcaga

SEQ ID NO: 866417 - RNA, 12 nt, Homo sapiens
gugacauuccac

SEQ ID NO: 866418 - RNA, 16 nt, Homo sapiens
gugacauuccacagag

SEQ ID NO: 866419 - RNA, 22 nt, Homo sapiens
gugacugucccuucgacacgga

SEQ ID NO: 866420 - RNA, 16 nt, Homo sapiens
aaaaagaaaacaacca

SEQ ID NO: 866421 - RNA, 12 nt, Homo sapiens
aaaaaguuuaca

SEQ ID NO: 866422 - RNA, 19 nt, Homo sapiens
aaaaaucccauuuaugcaa

SEQ ID NO: 866423 - RNA, 16 nt, Homo sapiens
aaaaguuuacagauca

SEQ ID NO: 866424 - RNA, 12 nt, Homo sapiens
aaaauacauuau

SEQ ID NO: 866425 - RNA, 13 nt, Homo sapiens
aaaauacuucuuu

SEQ ID NO: 866426 - RNA, 18 nt, Homo sapiens
aaaauaguguguccaugc

SEQ ID NO: 866427 - RNA, 14 nt, Homo sapiens
aaaauguguaacag

SEQ ID NO: 866428 - RNA, 17 nt, Homo sapiens
aaacaguguggauguaa

SEQ ID NO: 866429 - RNA, 11 nt, Homo sapiens
aaacucaaaau

SEQ ID NO: 866430 - RNA, 12 nt, Homo sapiens
aaacugugagau

SEQ ID NO: 866431 - RNA, 17 nt, Homo sapiens
aaagagaaaaagcccuc

SEQ ID NO: 866432 - RNA, 13 nt, Homo sapiens
aaagcagugcagu

SEQ ID NO: 866433 - RNA, 20 nt, Homo sapiens
aaagcuuaaacauugccuua

SEQ ID NO: 866434 - RNA, 13 nt, Homo sapiens
aaaggaagaugua

SEQ ID NO: 866435 - RNA, 14 nt, Homo sapiens
aaaguuuugccuau

SEQ ID NO: 866436 - RNA, 19 nt, Homo sapiens
aaauaaauaugaauggagu

SEQ ID NO: 866437 - RNA, 23 nt, Homo sapiens
aaauaaggccucauccuccacug

SEQ ID NO: 866438 - RNA, 12 nt, Homo sapiens
aaauacauauga

SEQ ID NO: 866439 - RNA, 15 nt, Homo sapiens
aaauaguguguccau

SEQ ID NO: 866440 - RNA, 16 nt, Homo sapiens
aaauauugacaaguuu

SEQ ID NO: 866441 - RNA, 16 nt, Homo sapiens
aaaugaaagucaguuu

SEQ ID NO: 866442 - RNA, 14 nt, Homo sapiens
aaaugauucacuuu

SEQ ID NO: 866443 - RNA, 16 nt, Homo sapiens
aaauggauguaauaua

SEQ ID NO: 866444 - RNA, 20 nt, Homo sapiens
aaauggcuuuccacaucccc

SEQ ID NO: 866445 - RNA, 14 nt, Homo sapiens
aaauuuacagugau

SEQ ID NO: 866446 - RNA, 15 nt, Homo sapiens
aacaaagcaugcuca

SEQ ID NO: 866447 - RNA, 22 nt, Homo sapiens
aacaacaauuuaggaaugcuca

SEQ ID NO: 866448 - RNA, 13 nt, Homo sapiens
aacacagugcagu

SEQ ID NO: 866449 - RNA, 20 nt, Homo sapiens
aaccaauuuguucugugcaa

SEQ ID NO: 866450 - RNA, 12 nt, Homo sapiens
aaccauucugcu

SEQ ID NO: 866451 - RNA, 23 nt, Homo sapiens
aaccauucugcuugguuccacaa

SEQ ID NO: 866452 - RNA, 15 nt, Homo sapiens
aacuagcaaaaggau

SEQ ID NO: 866453 - RNA, 12 nt, Homo sapiens
aacuagugcucu

SEQ ID NO: 866454 - RNA, 15 nt, Homo sapiens
aacucaguccugaca

SEQ ID NO: 866455 - RNA, 17 nt, Homo sapiens
aacugaagcagagucaa

SEQ ID NO: 866456 - RNA, 19 nt, Homo sapiens
aacugauggguaucaugcu

SEQ ID NO: 866457 - RNA, 15 nt, Homo sapiens
aacugcaacacugga

SEQ ID NO: 866458 - RNA, 14 nt, Homo sapiens
aacuguacaguuuc

SEQ ID NO: 866459 - RNA, 23 nt, Homo sapiens
aacuguacaguuucuuccccaag

SEQ ID NO: 866460 - RNA, 22 nt, Homo sapiens
aacuguggaaggcacacugagc

SEQ ID NO: 866461 - RNA, 21 nt, Homo sapiens
aacuguuuacucacauugucc

SEQ ID NO: 866462 - RNA, 21 nt, Homo sapiens
aacuuggugccuaauguucca

SEQ ID NO: 866463 - RNA, 15 nt, Homo sapiens
aagaagaauauguau

SEQ ID NO: 866464 - RNA, 12 nt, Homo sapiens
aagacagugcag

SEQ ID NO: 866465 - RNA, 18 nt, Homo sapiens
aagauuuccuuuggcaau

SEQ ID NO: 866466 - RNA, 12 nt, Homo sapiens
aagcaagcucac

SEQ ID NO: 866467 - RNA, 12 nt, Homo sapiens
aagcagcagcua

SEQ ID NO: 866468 - RNA, 13 nt, Homo sapiens
agacaacacacac

SEQ ID NO: 866469 - RNA, 18 nt, Homo sapiens
agacauaaguaaaugagc

SEQ ID NO: 866470 - RNA, 22 nt, Homo sapiens
agacauaccucucaacuuacau

SEQ ID NO: 866471 - RNA, 12 nt, Homo sapiens
agacccucagac

SEQ ID NO: 866472 - RNA, 21 nt, Homo sapiens
agacgcaaggaucacuugagc

SEQ ID NO: 866473 - RNA, 21 nt, Homo sapiens
agagaaaaagcccucuucaau

SEQ ID NO: 866474 - RNA, 13 nt, Homo sapiens
agagaacagggau

SEQ ID NO: 866475 - RNA, 21 nt, Homo sapiens
agagcaaucuugcugugaaac

SEQ ID NO: 866476 - RNA, 17 nt, Homo sapiens
agagccuagaggcucac

SEQ ID NO: 866477 - RNA, 15 nt, Homo sapiens
agaggaaaaggcuug

SEQ ID NO: 866478 - RNA, 15 nt, Homo sapiens
agauaguauacacau

SEQ ID NO: 866479 - RNA, 23 nt, Homo sapiens
agaucaugucauugaugaacugc

SEQ ID NO: 866480 - RNA, 15 nt, Homo sapiens
agaucuccugugcac

SEQ ID NO: 866481 - RNA, 18 nt, Homo sapiens
agaugggaggaucacuug

SEQ ID NO: 866482 - RNA, 21 nt, Homo sapiens
agaugggaggaucacuugagg

SEQ ID NO: 866483 - RNA, 19 nt, Homo sapiens
agcaagcucacuugcuuua

SEQ ID NO: 866484 - RNA, 15 nt, Homo sapiens
agcacaucucuucau

SEQ ID NO: 866485 - RNA, 16 nt, Homo sapiens
agcacaucucuucaug

SEQ ID NO: 866486 - RNA, 23 nt, Homo sapiens
agcaguguuggggguagcggcau

SEQ ID NO: 866487 - RNA, 13 nt, Homo sapiens
agccacagugggg

SEQ ID NO: 866488 - RNA, 21 nt, Homo sapiens
agccacaguggggcccauggc

SEQ ID NO: 866489 - RNA, 15 nt, Homo sapiens
agccagaggcucuaa

SEQ ID NO: 866490 - RNA, 14 nt, Homo sapiens
agccugcucccuag

SEQ ID NO: 866491 - RNA, 20 nt, Homo sapiens
agccugcucccuagccagag

SEQ ID NO: 866492 - RNA, 13 nt, Homo sapiens
agcguggggcuaa

SEQ ID NO: 866493 - RNA, 20 nt, Homo sapiens
agcucagcauuguguacaaa

SEQ ID NO: 866494 - RNA, 17 nt, Homo sapiens
agcucugugggagacca

SEQ ID NO: 866495 - RNA, 15 nt, Homo sapiens
agcuuaaacauugcc

SEQ ID NO: 866496 - RNA, 13 nt, Homo sapiens
agcuuacugauua

SEQ ID NO: 866497 - RNA, 14 nt, Homo sapiens
aggaaagaucccaa

SEQ ID NO: 866498 - RNA, 17 nt, Homo sapiens
aggaaagcagugcagua

SEQ ID NO: 866499 - RNA, 15 nt, Homo sapiens
aggagaugaggcugg

SEQ ID NO: 866500 - RNA, 17 nt, Homo sapiens
aggagaugaggcuggau

SEQ ID NO: 866501 - RNA, 22 nt, Homo sapiens
aggagggcagagacuuuguguu

SEQ ID NO: 866502 - RNA, 20 nt, Homo sapiens
aggcaauggugaacugucau

SEQ ID NO: 866503 - RNA, 16 nt, Homo sapiens
aggcagugcaguacuc

SEQ ID NO: 866504 - RNA, 23 nt, Homo sapiens
aggccuccagccacuuauuucca

SEQ ID NO: 866505 - RNA, 21 nt, Homo sapiens
aggccuguccucuacauacca

SEQ ID NO: 866506 - RNA, 14 nt, Homo sapiens
aggcucuaauguac

SEQ ID NO: 866507 - RNA, 16 nt, Homo sapiens
aguaaaucagugcagu

SEQ ID NO: 866508 - RNA, 17 nt, Homo sapiens
aguaaaucagugcagua

SEQ ID NO: 866509 - RNA, 21 nt, Homo sapiens
aguaacacagugcaguacuca

SEQ ID NO: 866510 - RNA, 21 nt, Homo sapiens
aguaacacaguguagugcuca

SEQ ID NO: 866511 - RNA, 14 nt, Homo sapiens
aguaacagugcagu

SEQ ID NO: 866512 - RNA, 19 nt, Homo sapiens
aguaacaguguaguacuca

SEQ ID NO: 866513 - RNA, 17 nt, Homo sapiens
aguaagacagugcagug

SEQ ID NO: 866514 - RNA, 23 nt, Homo sapiens
aguaagacagugcagugcucagu

SEQ ID NO: 866515 - RNA, 21 nt, Homo sapiens
aguaauacaauacaguacuca

SEQ ID NO: 866516 - RNA, 21 nt, Homo sapiens
aguaauacaguacaguacuca

SEQ ID NO: 866517 - RNA, 19 nt, Homo sapiens
aguaauagucccaguucca

SEQ ID NO: 866518 - RNA, 23 nt, Homo sapiens
aguacucaguaaaucagugcagu

SEQ ID NO: 866519 - RNA, 24 nt, Homo sapiens
aguacucaguaaaucagugcagua

SEQ ID NO: 866520 - RNA, 24 nt, Homo sapiens
aguacucaguaaggcagugcagua

SEQ ID NO: 866521 - RNA, 19 nt, Homo sapiens
aguccacccccauugugaa

SEQ ID NO: 866522 - RNA, 20 nt, Homo sapiens
aguccacuuuccucucucuc

SEQ ID NO: 866523 - RNA, 14 nt, Homo sapiens
agucuauugcaguu

SEQ ID NO: 866524 - RNA, 20 nt, Homo sapiens
agugaaaauuuuauugaaua

SEQ ID NO: 866525 - RNA, 13 nt, Homo sapiens
agugauacggauu

SEQ ID NO: 866526 - RNA, 17 nt, Homo sapiens
agugauagaacaaaaga

SEQ ID NO: 866527 - RNA, 14 nt, Homo sapiens
agugaugccaugaa

SEQ ID NO: 866528 - RNA, 16 nt, Homo sapiens
agugcaguagugucac

SEQ ID NO: 866529 - RNA, 19 nt, Homo sapiens
aguggaaaccuugcugcua

SEQ ID NO: 866530 - RNA, 14 nt, Homo sapiens
aguguagugcucag

SEQ ID NO: 866531 - RNA, 15 nt, Homo sapiens
aguguagugcucagu

SEQ ID NO: 866532 - RNA, 22 nt, Homo sapiens
agugucacuuuuuuccugucaa

SEQ ID NO: 866533 - RNA, 14 nt, Homo sapiens
agugugauugugaa

SEQ ID NO: 866534 - RNA, 16 nt, Homo sapiens
agugugauugugaacu

SEQ ID NO: 866535 - RNA, 14 nt, Homo sapiens
agugugugugcaau

SEQ ID NO: 866536 - RNA, 23 nt, Homo sapiens
aguuagcccggccaaggacacug

SEQ ID NO: 866537 - RNA, 16 nt, Homo sapiens
auaaauuccaauacaa

SEQ ID NO: 866538 - RNA, 14 nt, Homo sapiens
auaacccugaauca

SEQ ID NO: 866539 - RNA, 18 nt, Homo sapiens
auaaguaaaugagccuuu

SEQ ID NO: 866540 - RNA, 14 nt, Homo sapiens
auaaucauacacag

SEQ ID NO: 866541 - RNA, 20 nt, Homo sapiens
auaauuaaaugaaauacuug

SEQ ID NO: 866542 - RNA, 21 nt, Homo sapiens
auaauugccuuuuccuaugua

SEQ ID NO: 866543 - RNA, 14 nt, Homo sapiens
auacaacaggauuu

SEQ ID NO: 866544 - RNA, 13 nt, Homo sapiens
auacaauuugccc

SEQ ID NO: 866545 - RNA, 10 nt, Homo sapiens
auacaguacu

SEQ ID NO: 866546 - RNA, 13 nt, Homo sapiens
auagcauguaaua

SEQ ID NO: 866547 - RNA, 14 nt, Homo sapiens
auaguguguccaug

SEQ ID NO: 866548 - RNA, 21 nt, Homo sapiens
auaugauaaauuugacuguua

SEQ ID NO: 866549 - RNA, 20 nt, Homo sapiens
auauuauaucagacugcuuu

SEQ ID NO: 866550 - RNA, 22 nt, Homo sapiens
aucaagucugugaaagucuccu

SEQ ID NO: 866551 - RNA, 22 nt, Homo sapiens
aucagcauuuuucuuuagucau

SEQ ID NO: 866552 - RNA, 14 nt, Homo sapiens
aucaugcaugcacu

SEQ ID NO: 866553 - RNA, 17 nt, Homo sapiens
aucaugcaugcacucuu

SEQ ID NO: 866554 - RNA, 22 nt, Homo sapiens
auccaagcccagccuaucucuc

SEQ ID NO: 866555 - RNA, 17 nt, Homo sapiens
auccacaguauuguucu

SEQ ID NO: 866556 - RNA, 15 nt, Homo sapiens
auccacuucacaguu

SEQ ID NO: 866557 - RNA, 14 nt, Homo sapiens
auccaugugcugcu

SEQ ID NO: 866558 - RNA, 18 nt, Homo sapiens
auccuucccgcagcacca

SEQ ID NO: 866559 - RNA, 16 nt, Homo sapiens
aucucaucccuagucu

SEQ ID NO: 866560 - RNA, 19 nt, Homo sapiens
aucugcauuucuacauguu

SEQ ID NO: 866561 - RNA, 24 nt, Homo sapiens
aucuuauuugucaguguagaucaa

SEQ ID NO: 866562 - RNA, 23 nt, Homo sapiens
augaaaaauaguguguccaugca

SEQ ID NO: 866563 - RNA, 16 nt, Homo sapiens
augaaauacuugacaa

SEQ ID NO: 866564 - RNA, 16 nt, Homo sapiens
augaaauuuacaguga

SEQ ID NO: 866565 - RNA, 14 nt, Homo sapiens
augauuaagugcuu

SEQ ID NO: 866566 - RNA, 21 nt, Homo sapiens
augcacaccaaauugcugaga

SEQ ID NO: 866567 - RNA, 17 nt, Homo sapiens
augccaauuucucuuaa

SEQ ID NO: 866568 - RNA, 13 nt, Homo sapiens
augcucaguauug

SEQ ID NO: 866569 - RNA, 19 nt, Homo sapiens
augcucaguauugagacac

SEQ ID NO: 866570 - RNA, 15 nt, Homo sapiens
augggccugccaaac

SEQ ID NO: 866571 - RNA, 17 nt, Homo sapiens
auguacaauaaagcaau

SEQ ID NO: 866572 - RNA, 20 nt, Homo sapiens
auguacaauaaagcaaugug

SEQ ID NO: 866573 - RNA, 17 nt, Homo sapiens
auguacauuaaauacca

SEQ ID NO: 866574 - RNA, 20 nt, Homo sapiens
auguauuggauacgcuccag

SEQ ID NO: 866575 - RNA, 20 nt, Homo sapiens
augucugaaguuugccccag

SEQ ID NO: 866576 - RNA, 14 nt, Homo sapiens
augugccuagacac

SEQ ID NO: 866577 - RNA, 21 nt, Homo sapiens
augugcuguugauucuuucaa

SEQ ID NO: 866578 - RNA, 22 nt, Homo sapiens
augugugaagcaaauuucuaga

SEQ ID NO: 866579 - RNA, 15 nt, Homo sapiens
ccauccuucccgcag

SEQ ID NO: 866580 - RNA, 16 nt, Homo sapiens
ccaugaagacagucca

SEQ ID NO: 866581 - RNA, 18 nt, Homo sapiens
ccaugguagacugugaca

SEQ ID NO: 866582 - RNA, 11 nt, Homo sapiens
ccauucugcuu

SEQ ID NO: 866583 - RNA, 13 nt, Homo sapiens
ccauuuugaaaua

SEQ ID NO: 866584 - RNA, 18 nt, Homo sapiens
cccaaguuggagugcagu

SEQ ID NO: 866585 - RNA, 22 nt, Homo sapiens
cccagccugcucccuagccaga

SEQ ID NO: 866586 - RNA, 20 nt, Homo sapiens
cccaguuguugguuuggcca

SEQ ID NO: 866587 - RNA, 11 nt, Homo sapiens
cccuuccccac

SEQ ID NO: 866588 - RNA, 21 nt, Homo sapiens
cccuucgacacggaccugcuu

SEQ ID NO: 866589 - RNA, 18 nt, Homo sapiens
ccgcagggcgcuccggca

SEQ ID NO: 866590 - RNA, 14 nt, Homo sapiens
ccuaauuaauuuca

SEQ ID NO: 866591 - RNA, 16 nt, Homo sapiens
ccuacccucuucucag

SEQ ID NO: 866592 - RNA, 11 nt, Homo sapiens
ccucaaaagaa

SEQ ID NO: 866593 - RNA, 13 nt, Homo sapiens
ccuccgacuucuc

SEQ ID NO: 866594 - RNA, 22 nt, Homo sapiens
ccucucugaacugcaacacugg

SEQ ID NO: 866595 - RNA, 14 nt, Homo sapiens
ccucugcagccuga

SEQ ID NO: 866596 - RNA, 17 nt, Homo sapiens
ccucugcauaaauauua

SEQ ID NO: 866597 - RNA, 19 nt, Homo sapiens
ccucuuaaugucucaaaau

SEQ ID NO: 866598 - RNA, 22 nt, Homo sapiens
ccugaugucuugguuuccauca

SEQ ID NO: 866599 - RNA, 16 nt, Homo sapiens
ccugcucccuagccag

SEQ ID NO: 866600 - RNA, 21 nt, Homo sapiens
ccuggcgggcagccccugcug

SEQ ID NO: 866601 - RNA, 18 nt, Homo sapiens
ccuguaggucuaugaugu

SEQ ID NO: 866602 - RNA, 17 nt, Homo sapiens
ccugucuccucugucag

SEQ ID NO: 866603 - RNA, 16 nt, Homo sapiens
ccugugccuaacagca

SEQ ID NO: 866604 - RNA, 16 nt, Homo sapiens
ccuguguauaaagcca

SEQ ID NO: 866605 - RNA, 19 nt, Homo sapiens
ccuguguauaaagccauua

SEQ ID NO: 866606 - RNA, 23 nt, Homo sapiens
ccuguuaaggcauccacuucaca

SEQ ID NO: 866607 - RNA, 16 nt, Homo sapiens
ccuuaucauaaauuca

SEQ ID NO: 866608 - RNA, 14 nt, Homo sapiens
ccuucuacaaaaga

SEQ ID NO: 866609 - RNA, 17 nt, Homo sapiens
ccuucuccacagggaca

SEQ ID NO: 866610 - RNA, 11 nt, Homo sapiens
ccuugcugcua

SEQ ID NO: 866611 - RNA, 23 nt, Homo sapiens
ccuuugagugucaggcucugaau

SEQ ID NO: 866612 - RNA, 19 nt, Homo sapiens
cgcacugggcauuggguaa

SEQ ID NO: 866613 - RNA, 16 nt, Homo sapiens
cuaaaagugaugugau

SEQ ID NO: 866614 - RNA, 17 nt, Homo sapiens
cuaagccaguucuuaag

SEQ ID NO: 866615 - RNA, 20 nt, Homo sapiens
cuaauguacaauaaagcaau

SEQ ID NO: 866616 - RNA, 22 nt, Homo sapiens
cuaauguacaauaaagcaaugu

SEQ ID NO: 866617 - RNA, 17 nt, Homo sapiens
cuaaugucagcacaugu

SEQ ID NO: 866618 - RNA, 21 nt, Homo sapiens
cuaauuccccuuccauuccca

SEQ ID NO: 866619 - RNA, 23 nt, Homo sapiens
cuacaggggaggcugagacgcaa

SEQ ID NO: 866620 - RNA, 17 nt, Homo sapiens
cuagccagaggcucuaa

SEQ ID NO: 866621 - RNA, 19 nt, Homo sapiens
cuagccagaggcucuaaug

SEQ ID NO: 866622 - RNA, 16 nt, Homo sapiens
cuaguacucaguacua

SEQ ID NO: 866623 - RNA, 22 nt, Homo sapiens
cuaguaggucugcacacauaac

SEQ ID NO: 866624 - RNA, 22 nt, Homo sapiens
cuaguccccagccugcucccua

SEQ ID NO: 866625 - RNA, 17 nt, Homo sapiens
cuaugccuucacuacaa

SEQ ID NO: 866626 - RNA, 19 nt, Homo sapiens
cuaugucgucguuuucacc

SEQ ID NO: 866627 - RNA, 16 nt, Homo sapiens
cuauuuuggacgugug

SEQ ID NO: 866628 - RNA, 15 nt, Homo sapiens
cucaaugugcuguug

SEQ ID NO: 866629 - RNA, 15 nt, Homo sapiens
cucagcauuguguac

SEQ ID NO: 866630 - RNA, 19 nt, Homo sapiens
cucaguaaaucagugcagu

SEQ ID NO: 866631 - RNA, 21 nt, Homo sapiens
cucaguaacacagugcaguac

SEQ ID NO: 866632 - RNA, 20 nt, Homo sapiens
cucaguaacacagugcagug

SEQ ID NO: 866633 - RNA, 19 nt, Homo sapiens
cucaguaacagugcaguac

SEQ ID NO: 866634 - RNA, 21 nt, Homo sapiens
cucaguaacagugcaguacuc

SEQ ID NO: 866635 - RNA, 20 nt, Homo sapiens
cucaguaaggcagugcagua

SEQ ID NO: 866636 - RNA, 23 nt, Homo sapiens
cucaguaaggcagugcaguacuc

SEQ ID NO: 866637 - RNA, 22 nt, Homo sapiens
cucaguaauacaauacaguacu

SEQ ID NO: 866638 - RNA, 22 nt, Homo sapiens
cucaguaauacaguacaguacu

SEQ ID NO: 866639 - RNA, 12 nt, Homo sapiens
cucaucagaaac

SEQ ID NO: 866640 - RNA, 16 nt, Homo sapiens
cuccaaggaguggaaa

SEQ ID NO: 866641 - RNA, 12 nt, Homo sapiens
cucccuagccag

SEQ ID NO: 866642 - RNA, 14 nt, Homo sapiens
cucccuagccagag

SEQ ID NO: 866643 - RNA, 15 nt, Homo sapiens
cucuaaaacuaucag

SEQ ID NO: 866644 - RNA, 15 nt, Homo sapiens
cucuaauguacaaua

SEQ ID NO: 866645 - RNA, 19 nt, Homo sapiens
cucugaacugcaacacugg

SEQ ID NO: 866646 - RNA, 20 nt, Homo sapiens
cucuucaugcgcagucccca

SEQ ID NO: 866647 - RNA, 22 nt, Homo sapiens
cugauuuaaacuucuuaacugg

SEQ ID NO: 866648 - RNA, 20 nt, Homo sapiens
cugcauuucaaguuaauucu

SEQ ID NO: 866649 - RNA, 16 nt, Homo sapiens
cugccaagaguccaag

SEQ ID NO: 866650 - RNA, 16 nt, Homo sapiens
cugccaugucaggggu

SEQ ID NO: 866651 - RNA, 13 nt, Homo sapiens
cugccccaugaaa

SEQ ID NO: 866652 - RNA, 22 nt, Homo sapiens
cugccuucuccccuccaaguga

SEQ ID NO: 866653 - RNA, 22 nt, Homo sapiens
cugcguaggagagaacagggau

SEQ ID NO: 866654 - RNA, 14 nt, Homo sapiens
cugcucccuagcca

SEQ ID NO: 866655 - RNA, 18 nt, Homo sapiens
cugcucgggaaggccuga

SEQ ID NO: 866656 - RNA, 21 nt, Homo sapiens
cuggaaaaaaaaaaauaugag

SEQ ID NO: 866657 - RNA, 22 nt, Homo sapiens
cuguaguuuuuguucaccuucu

SEQ ID NO: 866658 - RNA, 15 nt, Homo sapiens
cugugccuaacagca

SEQ ID NO: 866659 - RNA, 14 nt, Homo sapiens
cugugggaguccac

SEQ ID NO: 866660 - RNA, 23 nt, Homo sapiens
cugugguuuguuaucaguacaau

SEQ ID NO: 866661 - RNA, 22 nt, Homo sapiens
cuuacaguagaggguccagucu

SEQ ID NO: 866662 - RNA, 17 nt, Homo sapiens
cuuaggcacuuuuuaac

SEQ ID NO: 866663 - RNA, 16 nt, Homo sapiens
cuuaucauaaauucaa

SEQ ID NO: 866664 - RNA, 19 nt, Homo sapiens
cuucaacaugguuaccucu

SEQ ID NO: 866665 - RNA, 15 nt, Homo sapiens
cuucaauuauuuccc

SEQ ID NO: 866666 - RNA, 14 nt, Homo sapiens
cuucacaauuucaa

SEQ ID NO: 866667 - RNA, 19 nt, Homo sapiens
cuuccugaacucccaguca

SEQ ID NO: 866668 - RNA, 20 nt, Homo sapiens
cuuccugaacucccagucau

SEQ ID NO: 866669 - RNA, 15 nt, Homo sapiens
cuucuaguggguuua

SEQ ID NO: 866670 - RNA, 23 nt, Homo sapiens
cuucuccacaaccuccuccucca

SEQ ID NO: 866671 - RNA, 20 nt, Homo sapiens
cuugaaugcuuaaaugauca

SEQ ID NO: 866672 - RNA, 12 nt, Homo sapiens
cuugagcagcug

SEQ ID NO: 866673 - RNA, 15 nt, Homo sapiens
cuugcugugaaauga

SEQ ID NO: 866674 - RNA, 20 nt, Homo sapiens
cuugcugugaaaugacugca

SEQ ID NO: 866675 - RNA, 19 nt, Homo sapiens
cuuggucucuuucuuucca

SEQ ID NO: 866676 - RNA, 19 nt, Homo sapiens
cuugguguuguuauggcaa

SEQ ID NO: 866677 - RNA, 16 nt, Homo sapiens
cuuuacuaacacuggc

SEQ ID NO: 866678 - RNA, 13 nt, Homo sapiens
cuuuaugauuuca

SEQ ID NO: 866679 - RNA, 20 nt, Homo sapiens
cuuuccucuuaaugucucaa

SEQ ID NO: 866680 - RNA, 15 nt, Homo sapiens
cuuucugaaauucac

SEQ ID NO: 866681 - RNA, 13 nt, Homo sapiens
cuuugccacugaa

SEQ ID NO: 866682 - RNA, 15 nt, Homo sapiens
cuuuggaucaggaaa

SEQ ID NO: 866683 - RNA, 21 nt, Homo sapiens
cuuuggcuuaauuccaaucau

SEQ ID NO: 866684 - RNA, 17 nt, Homo sapiens
cuuuuuacaauguauca

SEQ ID NO: 866685 - RNA, 15 nt, Homo sapiens
gaaaaagcccucuuc

SEQ ID NO: 866686 - RNA, 13 nt, Homo sapiens
gaaaaccucuuuc

SEQ ID NO: 866687 - RNA, 17 nt, Homo sapiens
gaaaagauuucugucca

SEQ ID NO: 866688 - RNA, 15 nt, Homo sapiens
gaaaaggcuugaguc

SEQ ID NO: 866689 - RNA, 15 nt, Homo sapiens
gaaaauacauuauua

SEQ ID NO: 866690 - RNA, 22 nt, Homo sapiens
guacucaguaacacagugcagu

SEQ ID NO: 866691 - RNA, 18 nt, Homo sapiens
guacucaguaacagugca

SEQ ID NO: 866692 - RNA, 21 nt, Homo sapiens
guacucaguaacagugcagua

SEQ ID NO: 866693 - RNA, 23 nt, Homo sapiens
guacucaguuaggcagugcagua

SEQ ID NO: 866694 - RNA, 20 nt, Homo sapiens
guacuguuuuguuuguuaau

SEQ ID NO: 866695 - RNA, 21 nt, Homo sapiens
guagacucacgcugacugcag

SEQ ID NO: 866696 - RNA, 20 nt, Homo sapiens
guagaucaacucauguuaau

SEQ ID NO: 866697 - RNA, 14 nt, Homo sapiens
guauaaagccauua

SEQ ID NO: 866698 - RNA, 20 nt, Homo sapiens
guauauugauguaacugugu

SEQ ID NO: 866699 - RNA, 19 nt, Homo sapiens
guaucaugcuucuacucca

SEQ ID NO: 866700 - RNA, 20 nt, Homo sapiens
guaucaugcuucuacuccau

SEQ ID NO: 866701 - RNA, 22 nt, Homo sapiens
guaugcugcaugaaagcguuau

SEQ ID NO: 866702 - RNA, 14 nt, Homo sapiens
guaugguacucagu

SEQ ID NO: 866703 - RNA, 18 nt, Homo sapiens
guauugagacacugucaa

SEQ ID NO: 866704 - RNA, 18 nt, Homo sapiens
guauuuuuccucuuucac

SEQ ID NO: 866705 - RNA, 22 nt, Homo sapiens
gucacccaaguuggagugcagu

SEQ ID NO: 866706 - RNA, 14 nt, Homo sapiens
gucagcacauguug

SEQ ID NO: 866707 - RNA, 21 nt, Homo sapiens
gucaggcucugaaucucucaa

SEQ ID NO: 866708 - RNA, 19 nt, Homo sapiens
guccaaacuuaacagauca

SEQ ID NO: 866709 - RNA, 22 nt, Homo sapiens
guccacccccauugugaauguu

SEQ ID NO: 866710 - RNA, 20 nt, Homo sapiens
guccuuuaaaaaaaucccau

SEQ ID NO: 866711 - RNA, 24 nt, Homo sapiens
guccuuuuucuucccuuaggcaau

SEQ ID NO: 866712 - RNA, 20 nt, Homo sapiens
gucucaaaauaaaaccagaa

SEQ ID NO: 866713 - RNA, 15 nt, Homo sapiens
gucuccucugucagu

SEQ ID NO: 866714 - RNA, 18 nt, Homo sapiens
gugcaacaaacucaaaau

SEQ ID NO: 866715 - RNA, 15 nt, Homo sapiens
gugccuaacuccuua

SEQ ID NO: 866716 - RNA, 17 nt, Homo sapiens
guggaauauggcaauag

SEQ ID NO: 866717 - RNA, 14 nt, Homo sapiens
guggcaucaggaaa

SEQ ID NO: 866718 - RNA, 18 nt, Homo sapiens
guggucugcugccucagg

SEQ ID NO: 866719 - RNA, 15 nt, Homo sapiens
gugucaucugucagc

SEQ ID NO: 866720 - RNA, 21 nt, Homo sapiens
guguccuguuuuuauucccuu

SEQ ID NO: 866721 - RNA, 21 nt, Homo sapiens
gugugcccacccguguucucc

SEQ ID NO: 866722 - RNA, 13 nt, Homo sapiens
guguguccaugca

SEQ ID NO: 866723 - RNA, 21 nt, Homo sapiens
guguucccucucucccuccag

SEQ ID NO: 866724 - RNA, 19 nt, Homo sapiens
guucacgugacuccucaau

SEQ ID NO: 866725 - RNA, 19 nt, Homo sapiens
guucuuguaaaacugugac

SEQ ID NO: 866726 - RNA, 14 nt, Homo sapiens
guugcuaaugacag

SEQ ID NO: 866727 - RNA, 14 nt, Homo sapiens
guuggagugcagug

SEQ ID NO: 866728 - RNA, 19 nt, Homo sapiens
guugguuaccuauugcugu

SEQ ID NO: 866729 - RNA, 22 nt, Homo sapiens
guugguuuggccacucuugacc

SEQ ID NO: 866730 - RNA, 18 nt, Homo sapiens
guuuaacugaguuagaau

SEQ ID NO: 866731 - RNA, 18 nt, Homo sapiens
guuuagaaucaagucugu

SEQ ID NO: 866732 - RNA, 20 nt, Homo sapiens
guuuagaaucaagucuguga

SEQ ID NO: 866733 - RNA, 18 nt, Homo sapiens
guuuagugugauugugaa

SEQ ID NO: 866734 - RNA, 14 nt, Homo sapiens
guuucacuguucau

SEQ ID NO: 866735 - RNA, 22 nt, Homo sapiens
guuuccagcuaagccugaugau

SEQ ID NO: 866736 - RNA, 14 nt, Homo sapiens
uaaaacugugacau

SEQ ID NO: 866737 - RNA, 18 nt, Homo sapiens
uaaaaugugaaguaauag

SEQ ID NO: 866738 - RNA, 21 nt, Homo sapiens
uaaaauuuuccuuuaugauuc

SEQ ID NO: 866739 - RNA, 17 nt, Homo sapiens
uaaagcaaugugguagu

SEQ ID NO: 866740 - RNA, 16 nt, Homo sapiens
uaaagccuugugauca

SEQ ID NO: 866741 - RNA, 16 nt, Homo sapiens
uaaauuugacuguuau

SEQ ID NO: 866742 - RNA, 12 nt, Homo sapiens
uaacacagugca

SEQ ID NO: 866743 - RNA, 14 nt, Homo sapiens
uaacacagugcagu

SEQ ID NO: 866744 - RNA, 19 nt, Homo sapiens
uaacagcauaauugccuuu

SEQ ID NO: 866745 - RNA, 21 nt, Homo sapiens
uaacaggcauugcacuaaaag

SEQ ID NO: 866746 - RNA, 17 nt, Homo sapiens
uaagaauuuaccagaaa

SEQ ID NO: 866747 - RNA, 20 nt, Homo sapiens
uaagacagugcagugcucag

SEQ ID NO: 866748 - RNA, 19 nt, Homo sapiens
uaagaguuacucagaugac

SEQ ID NO: 866749 - RNA, 19 nt, Homo sapiens
uaagcacaaccauguucuu

SEQ ID NO: 866750 - RNA, 13 nt, Homo sapiens
uaagccugaugau

SEQ ID NO: 866751 - RNA, 15 nt, Homo sapiens
uaaggcagugcagua

SEQ ID NO: 866752 - RNA, 16 nt, Homo sapiens
uaaggcagugcagugc

SEQ ID NO: 866753 - RNA, 20 nt, Homo sapiens
uaaggcagugcagugcucag

SEQ ID NO: 866754 - RNA, 22 nt, Homo sapiens
uaaguacugaaauacauaugau

SEQ ID NO: 866755 - RNA, 19 nt, Homo sapiens
uaaguuauaccagcaaaag

SEQ ID NO: 866756 - RNA, 13 nt, Homo sapiens
uaauaaagugcac

SEQ ID NO: 866757 - RNA, 14 nt, Homo sapiens
uaauccuagcacuu

SEQ ID NO: 866758 - RNA, 17 nt, Homo sapiens
uaaucuagagcuaugca

SEQ ID NO: 866759 - RNA, 20 nt, Homo sapiens
uaaucuagagcuaugcacac

SEQ ID NO: 866760 - RNA, 12 nt, Homo sapiens
uacaauguauca

SEQ ID NO: 866761 - RNA, 20 nt, Homo sapiens
uacaauucuuuguugcuuaa

SEQ ID NO: 866762 - RNA, 16 nt, Homo sapiens
uacagaggacauacca

SEQ ID NO: 866763 - RNA, 16 nt, Homo sapiens
uacagugaugccauga

SEQ ID NO: 866764 - RNA, 20 nt, Homo sapiens
uaccaaaugccuuucuagca

SEQ ID NO: 866765 - RNA, 22 nt, Homo sapiens
uaccuggcuacaauuacuuuga

SEQ ID NO: 866766 - RNA, 23 nt, Homo sapiens
uacuaaugaaauuuacagugaua

SEQ ID NO: 866767 - RNA, 16 nt, Homo sapiens
uacucaggcagugcaa

SEQ ID NO: 866768 - RNA, 22 nt, Homo sapiens
uacucaguaacacagugcagua

SEQ ID NO: 866769 - RNA, 21 nt, Homo sapiens
uacucaguuaggcagugcagu

SEQ ID NO: 866770 - RNA, 22 nt, Homo sapiens
uacucaguuaggcagugcagua

SEQ ID NO: 866771 - RNA, 17 nt, Homo sapiens
uacugaaauacauauga

SEQ ID NO: 866772 - RNA, 14 nt, Homo sapiens
uagacagagacaau

SEQ ID NO: 866773 - RNA, 16 nt, Homo sapiens
uagacagagacaauuu

SEQ ID NO: 866774 - RNA, 17 nt, Homo sapiens
uagcauacugaugagac

SEQ ID NO: 866775 - RNA, 17 nt, Homo sapiens
uagcuaauuuaggaguu

SEQ ID NO: 866776 - RNA, 16 nt, Homo sapiens
uagcuuacugauuaac

SEQ ID NO: 866777 - RNA, 16 nt, Homo sapiens
uaggaaagcagugcag

SEQ ID NO: 866778 - RNA, 19 nt, Homo sapiens
uaggaaagcagugcaguac

SEQ ID NO: 866779 - RNA, 20 nt, Homo sapiens
uaggcaauggugaacuguca

SEQ ID NO: 866780 - RNA, 14 nt, Homo sapiens
uaggcagugcagua

SEQ ID NO: 866781 - RNA, 18 nt, Homo sapiens
uaggcuuguguaauuucc

SEQ ID NO: 866782 - RNA, 11 nt, Homo sapiens
uagugccuuga

SEQ ID NO: 866783 - RNA, 20 nt, Homo sapiens
uaguugccguggcaacugug

SEQ ID NO: 866784 - RNA, 12 nt, Homo sapiens
uauaaacuguga

SEQ ID NO: 866785 - RNA, 19 nt, Homo sapiens
uaucaugcuucuacuccau

SEQ ID NO: 866786 - RNA, 14 nt, Homo sapiens
uaucccucauuuca

SEQ ID NO: 866787 - RNA, 17 nt, Homo sapiens
uauccuucacaauuuca

SEQ ID NO: 866788 - RNA, 20 nt, Homo sapiens
uaucuaguaggucugcacac

SEQ ID NO: 866789 - RNA, 20 nt, Homo sapiens
uaugauaaauuugacuguua

SEQ ID NO: 866790 - RNA, 23 nt, Homo sapiens
uaugaugguggaucaagacauaa

SEQ ID NO: 866791 - RNA, 18 nt, Homo sapiens
uaugcuguucauugauga

SEQ ID NO: 866792 - RNA, 17 nt, Homo sapiens
uauggauugaaggauug

SEQ ID NO: 866793 - RNA, 20 nt, Homo sapiens
uauguuuagugugauuguga

SEQ ID NO: 866794 - RNA, 15 nt, Homo sapiens
uauuauaucauuaac

SEQ ID NO: 866795 - RNA, 16 nt, Homo sapiens
uauuuuggacguguga

SEQ ID NO: 866796 - RNA, 17 nt, Homo sapiens
uauuuuuccucuuucac

SEQ ID NO: 866797 - RNA, 15 nt, Homo sapiens
ucaacaagccugaaa

SEQ ID NO: 866798 - RNA, 18 nt, Homo sapiens
ucaacaugguuaccucug

SEQ ID NO: 866799 - RNA, 16 nt, Homo sapiens
ucaauaacuauugcug

SEQ ID NO: 866800 - RNA, 18 nt, Homo sapiens
ucaauaaggcagugcagu

SEQ ID NO: 866801 - RNA, 23 nt, Homo sapiens
aagaaauggcuuuccacaucccc

SEQ ID NO: 866802 - RNA, 13 nt, Homo sapiens
aagacagugcagu

SEQ ID NO: 866803 - RNA, 18 nt, Homo sapiens
aagacagugcagugcuca

SEQ ID NO: 866804 - RNA, 11 nt, Homo sapiens
aagcaaugugg

SEQ ID NO: 866805 - RNA, 19 nt, Homo sapiens
aagcacuggacuacaaggg

SEQ ID NO: 866806 - RNA, 13 nt, Homo sapiens
aagcagccuccac

SEQ ID NO: 866807 - RNA, 13 nt, Homo sapiens
aagcccucuucaa

SEQ ID NO: 866808 - RNA, 16 nt, Homo sapiens
aagcucagcuaugaaa

SEQ ID NO: 866809 - RNA, 19 nt, Homo sapiens
aaggaagauguaagaagcu

SEQ ID NO: 866810 - RNA, 12 nt, Homo sapiens
aaggaucacuug

SEQ ID NO: 866811 - RNA, 14 nt, Homo sapiens
aaggauugugaacu

SEQ ID NO: 866812 - RNA, 13 nt, Homo sapiens
aaggcagugcagu

SEQ ID NO: 866813 - RNA, 14 nt, Homo sapiens
aaggcagugcagua

SEQ ID NO: 866814 - RNA, 16 nt, Homo sapiens
aaggcauauacuuugu

SEQ ID NO: 866815 - RNA, 24 nt, Homo sapiens
aaggcauccacuucacaguucuga

SEQ ID NO: 866816 - RNA, 17 nt, Homo sapiens
aagggugcccaccucuu

SEQ ID NO: 866817 - RNA, 21 nt, Homo sapiens
aagguuguacauaguggucau

SEQ ID NO: 866818 - RNA, 16 nt, Homo sapiens
aagguuucacuguuca

SEQ ID NO: 866819 - RNA, 13 nt, Homo sapiens
aaguguacuggau

SEQ ID NO: 866820 - RNA, 13 nt, Homo sapiens
aauaaaaugauua

SEQ ID NO: 866821 - RNA, 22 nt, Homo sapiens
aauaaagccuugugaucacuuu

SEQ ID NO: 866822 - RNA, 18 nt, Homo sapiens
aauaaauaugaauggagu

SEQ ID NO: 866823 - RNA, 17 nt, Homo sapiens
aauaauauaaaugaaug

SEQ ID NO: 866824 - RNA, 17 nt, Homo sapiens
aauaguguguccaugca

SEQ ID NO: 866825 - RNA, 20 nt, Homo sapiens
aauauccaagcccagccuau

SEQ ID NO: 866826 - RNA, 15 nt, Homo sapiens
aaucaagucugugaa

SEQ ID NO: 866827 - RNA, 23 nt, Homo sapiens
aaucaagucugugaaagucuccu

SEQ ID NO: 866828 - RNA, 14 nt, Homo sapiens
aauccacaguauug

SEQ ID NO: 866829 - RNA, 21 nt, Homo sapiens
aauccaugugcugcuguggca

SEQ ID NO: 866830 - RNA, 23 nt, Homo sapiens
aauccaugugcugcuguggcauc

SEQ ID NO: 866831 - RNA, 22 nt, Homo sapiens
aauccuaacauuauauucccaa

SEQ ID NO: 866832 - RNA, 23 nt, Homo sapiens
aaucuugcugugaaacagugugg

SEQ ID NO: 866833 - RNA, 19 nt, Homo sapiens
aaugaaauauaaacuguga

SEQ ID NO: 866834 - RNA, 23 nt, Homo sapiens
aaugaaugaaauauaaacuguga

SEQ ID NO: 866835 - RNA, 17 nt, Homo sapiens
aaugauaugucuuuaaa

SEQ ID NO: 866836 - RNA, 23 nt, Homo sapiens
aaugcucaguaacacagugcagu

SEQ ID NO: 866837 - RNA, 21 nt, Homo sapiens
aaugcugauuuaaacuucuua

SEQ ID NO: 866838 - RNA, 19 nt, Homo sapiens
aauggauccuugucaguug

SEQ ID NO: 866839 - RNA, 16 nt, Homo sapiens
aauguacaauaaagca

SEQ ID NO: 866840 - RNA, 16 nt, Homo sapiens
aaugucagcacauguu

SEQ ID NO: 866841 - RNA, 19 nt, Homo sapiens
aaugucagcacauguugcu

SEQ ID NO: 866842 - RNA, 17 nt, Homo sapiens
aauguugaaacugacuu

SEQ ID NO: 866843 - RNA, 16 nt, Homo sapiens
aauuaugucaaaugga

SEQ ID NO: 866844 - RNA, 22 nt, Homo sapiens
aauuuaggaaugcucaaugugc

SEQ ID NO: 866845 - RNA, 21 nt, Homo sapiens
aauuuccuuaaagcaagcuca

SEQ ID NO: 866846 - RNA, 12 nt, Homo sapiens
agacagugcagu

SEQ ID NO: 866847 - RNA, 19 nt, Homo sapiens
agacauaccucucaacuua

SEQ ID NO: 866848 - RNA, 15 nt, Homo sapiens
agacaugaaauugag

SEQ ID NO: 866849 - RNA, 23 nt, Homo sapiens
agacaugaaauugagucauuuua

SEQ ID NO: 866850 - RNA, 13 nt, Homo sapiens
agacccucagacc

SEQ ID NO: 866851 - RNA, 18 nt, Homo sapiens
agacgcaaggaucacuug

SEQ ID NO: 866852 - RNA, 17 nt, Homo sapiens
agacucgagagggcuga

SEQ ID NO: 866853 - RNA, 17 nt, Homo sapiens
agagaccuccugauguc

SEQ ID NO: 866854 - RNA, 21 nt, Homo sapiens
agagagcaaucuugcugugaa

SEQ ID NO: 866855 - RNA, 19 nt, Homo sapiens
agaggcucuaauguacaau

SEQ ID NO: 866856 - RNA, 20 nt, Homo sapiens
agaggcucuaauguacaaua

SEQ ID NO: 866857 - RNA, 15 nt, Homo sapiens
agauggauuugacac

SEQ ID NO: 866858 - RNA, 21 nt, Homo sapiens
agauggauuugacacacucac

SEQ ID NO: 866859 - RNA, 15 nt, Homo sapiens
agaugugccuagaca

SEQ ID NO: 866860 - RNA, 20 nt, Homo sapiens
agcaaagcaugccaauuucu

SEQ ID NO: 866861 - RNA, 18 nt, Homo sapiens
agcaacuggugacugucc

SEQ ID NO: 866862 - RNA, 15 nt, Homo sapiens
agcagcagcagcagc

SEQ ID NO: 866863 - RNA, 12 nt, Homo sapiens
agcagugcagua

SEQ ID NO: 866864 - RNA, 23 nt, Homo sapiens
agcauuuaggaaagcagugcagu

SEQ ID NO: 866865 - RNA, 19 nt, Homo sapiens
agccacuuauuuccaugga

SEQ ID NO: 866866 - RNA, 23 nt, Homo sapiens
agccagaggcucuaauguacaau

SEQ ID NO: 866867 - RNA, 20 nt, Homo sapiens
agccauauauuuucugagua

SEQ ID NO: 866868 - RNA, 20 nt, Homo sapiens
agccauuauucucugaugca

SEQ ID NO: 866869 - RNA, 13 nt, Homo sapiens
agcccucacagcu

SEQ ID NO: 866870 - RNA, 23 nt, Homo sapiens
agccuccacuuuggaucaggaaa

SEQ ID NO: 866871 - RNA, 15 nt, Homo sapiens
agccugaugauggaa

SEQ ID NO: 866872 - RNA, 13 nt, Homo sapiens
agcuaacaaaaga

SEQ ID NO: 866873 - RNA, 16 nt, Homo sapiens
agcuaagccugaugau

SEQ ID NO: 866874 - RNA, 13 nt, Homo sapiens
agcuccacucuga

SEQ ID NO: 866875 - RNA, 23 nt, Homo sapiens
agcuuauuuguauuuuuccucuu

SEQ ID NO: 866876 - RNA, 17 nt, Homo sapiens
agcuuucugauacuuau

SEQ ID NO: 866877 - RNA, 15 nt, Homo sapiens
aggaaaaggcuugag

SEQ ID NO: 866878 - RNA, 15 nt, Homo sapiens
aggacacugaugggu

SEQ ID NO: 866879 - RNA, 22 nt, Homo sapiens
aggacauaccacugccauguca

SEQ ID NO: 866880 - RNA, 16 nt, Homo sapiens
aggagagaacagggau

SEQ ID NO: 866881 - RNA, 14 nt, Homo sapiens
aggaguuuugagaa

SEQ ID NO: 866882 - RNA, 12 nt, Homo sapiens
aggaucacuuga

SEQ ID NO: 866883 - RNA, 16 nt, Homo sapiens
aggcagcuagacacca

SEQ ID NO: 866884 - RNA, 12 nt, Homo sapiens
aggcagugcagu

SEQ ID NO: 866885 - RNA, 13 nt, Homo sapiens
aggcagugcagua

SEQ ID NO: 866886 - RNA, 15 nt, Homo sapiens
aggcauccacuucac

SEQ ID NO: 866887 - RNA, 21 nt, Homo sapiens
aggccugcacucuuauuucac

SEQ ID NO: 866888 - RNA, 22 nt, Homo sapiens
aggcucuaauguacaauaaagc

SEQ ID NO: 866889 - RNA, 15 nt, Homo sapiens
agggaaaagauuucu

SEQ ID NO: 866890 - RNA, 20 nt, Homo sapiens
agggccuucuccacagggac

SEQ ID NO: 866891 - RNA, 22 nt, Homo sapiens
gagcagccucuugaaugcuuaa

SEQ ID NO: 866892 - RNA, 19 nt, Homo sapiens
gagcaugcucccucaugca

SEQ ID NO: 866893 - RNA, 21 nt, Homo sapiens
gagccaaguucacaccacugc

SEQ ID NO: 866894 - RNA, 19 nt, Homo sapiens
gagcccagaagcucaaggc

SEQ ID NO: 866895 - RNA, 13 nt, Homo sapiens
gagcuuucugaua

SEQ ID NO: 866896 - RNA, 17 nt, Homo sapiens
gaggaaaauaguggcag

SEQ ID NO: 866897 - RNA, 23 nt, Homo sapiens
gaggaaaauaguggcaggacugu

SEQ ID NO: 866898 - RNA, 18 nt, Homo sapiens
gaggacucucacgauaug

SEQ ID NO: 866899 - RNA, 21 nt, Homo sapiens
gauaaauuugacuguuauuug

SEQ ID NO: 866900 - RNA, 20 nt, Homo sapiens
gauagaucuuggcccuguua

SEQ ID NO: 866901 - RNA, 14 nt, Homo sapiens
gaucaagcuccauc

SEQ ID NO: 866902 - RNA, 18 nt, Homo sapiens
gauggguaucaugcuucu

SEQ ID NO: 866903 - RNA, 22 nt, Homo sapiens
gauucaaauaacccugaaucag

SEQ ID NO: 866904 - RNA, 17 nt, Homo sapiens
gauuccccuggacauau

SEQ ID NO: 866905 - RNA, 17 nt, Homo sapiens
gauugaaggauugugaa

SEQ ID NO: 866906 - RNA, 18 nt, Homo sapiens
gauugagagcagccucuu

SEQ ID NO: 866907 - RNA, 15 nt, Homo sapiens
gcaacaaacucaaaa

SEQ ID NO: 866908 - RNA, 14 nt, Homo sapiens
gcaaggaucacuug

SEQ ID NO: 866909 - RNA, 13 nt, Homo sapiens
gcaauugcuucuc

SEQ ID NO: 866910 - RNA, 14 nt, Homo sapiens
gcacacaacugugg

SEQ ID NO: 866911 - RNA, 23 nt, Homo sapiens
gcaccuuuccugaaauucugaca

SEQ ID NO: 866912 - RNA, 17 nt, Homo sapiens
gcacuguauccaaguua

SEQ ID NO: 866913 - RNA, 22 nt, Homo sapiens
gcagcuagcugcuuuucuguca

SEQ ID NO: 866914 - RNA, 23 nt, Homo sapiens
gcaguacucaguaacagugcagu

SEQ ID NO: 866915 - RNA, 15 nt, Homo sapiens
gcagugaaguacuca

SEQ ID NO: 866916 - RNA, 12 nt, Homo sapiens
gcauaguacuca

SEQ ID NO: 866917 - RNA, 22 nt, Homo sapiens
gcauccacuucacaguucugaa

SEQ ID NO: 866918 - RNA, 23 nt, Homo sapiens
gcauuuaggaaagcagugcagua

SEQ ID NO: 866919 - RNA, 23 nt, Homo sapiens
gcauuucuacauguuuuagacag

SEQ ID NO: 866920 - RNA, 15 nt, Homo sapiens
gccaaggacacugau

SEQ ID NO: 866921 - RNA, 20 nt, Homo sapiens
gccagaggcucuaauguaca

SEQ ID NO: 866922 - RNA, 21 nt, Homo sapiens
gccagaggcucuaauguacaa

SEQ ID NO: 866923 - RNA, 23 nt, Homo sapiens
gccagaggcucuaauguacaaua

SEQ ID NO: 866924 - RNA, 17 nt, Homo sapiens
gcccaguuagcccggcc

SEQ ID NO: 866925 - RNA, 13 nt, Homo sapiens
gcccugcaccuug

SEQ ID NO: 866926 - RNA, 19 nt, Homo sapiens
gccucccgccgccucgggc

SEQ ID NO: 866927 - RNA, 16 nt, Homo sapiens
gccugcucccuagcca

SEQ ID NO: 866928 - RNA, 19 nt, Homo sapiens
gccugcucccuagccagag

SEQ ID NO: 866929 - RNA, 16 nt, Homo sapiens
gccuucuccacaggga

SEQ ID NO: 866930 - RNA, 20 nt, Homo sapiens
gccuucuccccuccaaguga

SEQ ID NO: 866931 - RNA, 13 nt, Homo sapiens
gccuugugaucac

SEQ ID NO: 866932 - RNA, 13 nt, Homo sapiens
ucccucuaugucg

SEQ ID NO: 866933 - RNA, 23 nt, Homo sapiens
ucccugucugucugucucucuuu

SEQ ID NO: 866934 - RNA, 16 nt, Homo sapiens
ucccuuccccacaaua

SEQ ID NO: 866935 - RNA, 21 nt, Homo sapiens
ucccuuccccacaauaggcuu

SEQ ID NO: 866936 - RNA, 14 nt, Homo sapiens
uccucuacauacca

SEQ ID NO: 866937 - RNA, 18 nt, Homo sapiens
uccucuuucacuucuuau

SEQ ID NO: 866938 - RNA, 14 nt, Homo sapiens
uccugaacucccag

SEQ ID NO: 866939 - RNA, 19 nt, Homo sapiens
uccugcuccuccaguacaa

SEQ ID NO: 866940 - RNA, 17 nt, Homo sapiens
ucuacauguuuuagaca

SEQ ID NO: 866941 - RNA, 11 nt, Homo sapiens
ucucauuccca

SEQ ID NO: 866942 - RNA, 13 nt, Homo sapiens
ucuccacagggac

SEQ ID NO: 866943 - RNA, 18 nt, Homo sapiens
ucucuaaaacagcacuau

SEQ ID NO: 866944 - RNA, 14 nt, Homo sapiens
ucucuagacaucua

SEQ ID NO: 866945 - RNA, 15 nt, Homo sapiens
ucucuauguacagau

SEQ ID NO: 866946 - RNA, 16 nt, Homo sapiens
ucucugaaccagagaa

SEQ ID NO: 866947 - RNA, 14 nt, Homo sapiens
ucucugaacugcaa

SEQ ID NO: 866948 - RNA, 16 nt, Homo sapiens
ucucuuccuuacaggu

SEQ ID NO: 866949 - RNA, 21 nt, Homo sapiens
ucugaaauuuacccacaguga

SEQ ID NO: 866950 - RNA, 18 nt, Homo sapiens
ucugaacugcaacacugg

SEQ ID NO: 866951 - RNA, 17 nt, Homo sapiens
ucugaguagcauauaua

SEQ ID NO: 866952 - RNA, 13 nt, Homo sapiens
ucugcagccugag

SEQ ID NO: 866953 - RNA, 14 nt, Homo sapiens
ucugccucacauca

SEQ ID NO: 866954 - RNA, 14 nt, Homo sapiens
ucugugcaucuggc

SEQ ID NO: 866955 - RNA, 22 nt, Homo sapiens
ucuuauggaggagaguguuuaa

SEQ ID NO: 866956 - RNA, 22 nt, Homo sapiens
ucuucucagcuccacucugaag

SEQ ID NO: 866957 - RNA, 13 nt, Homo sapiens
ucuugaauguuga

SEQ ID NO: 866958 - RNA, 16 nt, Homo sapiens
ucuugacaucaaggga

SEQ ID NO: 866959 - RNA, 22 nt, Homo sapiens
ucuugcugccaggcccacacau

SEQ ID NO: 866960 - RNA, 17 nt, Homo sapiens
ucuugguuuccaucaaa

SEQ ID NO: 866961 - RNA, 22 nt, Homo sapiens
ucuuguaaaacugugacauucc

SEQ ID NO: 866962 - RNA, 23 nt, Homo sapiens
ucuuguaaaacugugacauucca

SEQ ID NO: 866963 - RNA, 14 nt, Homo sapiens
ucuuuaccuugcau

SEQ ID NO: 866964 - RNA, 18 nt, Homo sapiens
ucuuuacuaacacuggcu

SEQ ID NO: 866965 - RNA, 20 nt, Homo sapiens
ugaaaaccacccuaucauca

SEQ ID NO: 866966 - RNA, 18 nt, Homo sapiens
ugaaacaguguggaugua

SEQ ID NO: 866967 - RNA, 15 nt, Homo sapiens
ugaaauuaugucaaa

SEQ ID NO: 866968 - RNA, 13 nt, Homo sapiens
ugaaauucacaaa

SEQ ID NO: 866969 - RNA, 15 nt, Homo sapiens
ugaacugcaacacug

SEQ ID NO: 866970 - RNA, 14 nt, Homo sapiens
ugaaggauugugaa

SEQ ID NO: 866971 - RNA, 16 nt, Homo sapiens
ugaaggauugugaacu

SEQ ID NO: 866972 - RNA, 21 nt, Homo sapiens
ugaaugaaauauaaacuguga

SEQ ID NO: 866973 - RNA, 17 nt, Homo sapiens
uaaaacuuacuauggua

SEQ ID NO: 866974 - RNA, 19 nt, Homo sapiens
uaaaagacaugaaauugag

SEQ ID NO: 866975 - RNA, 16 nt, Homo sapiens
uaaaagcccuuuccaa

SEQ ID NO: 866976 - RNA, 22 nt, Homo sapiens
uaaaaucuguauugcuaagaua

SEQ ID NO: 866977 - RNA, 12 nt, Homo sapiens
uaaaaugauuaa

SEQ ID NO: 866978 - RNA, 13 nt, Homo sapiens
uaaacugugagau

SEQ ID NO: 866979 - RNA, 22 nt, Homo sapiens
uaaauauuagcaaagcaugcca

SEQ ID NO: 866980 - RNA, 17 nt, Homo sapiens
uaaauucaaaccuaagu

SEQ ID NO: 866981 - RNA, 12 nt, Homo sapiens
uaacagugcagu

SEQ ID NO: 866982 - RNA, 15 nt, Homo sapiens
uaacuauugcugcuu

SEQ ID NO: 866983 - RNA, 17 nt, Homo sapiens
uaacuuuugggauuugu

SEQ ID NO: 866984 - RNA, 20 nt, Homo sapiens
uaagaagcucagcuaugaaa

SEQ ID NO: 866985 - RNA, 14 nt, Homo sapiens
uaagacagugcagu

SEQ ID NO: 866986 - RNA, 16 nt, Homo sapiens
uaagacagugcagugc

SEQ ID NO: 866987 - RNA, 22 nt, Homo sapiens
uaaggcauccacuucacaguuc

SEQ ID NO: 866988 - RNA, 18 nt, Homo sapiens
uaauauaaaugaaugaaa

SEQ ID NO: 866989 - RNA, 20 nt, Homo sapiens
uaaugaaauuuacagugaua

SEQ ID NO: 866990 - RNA, 20 nt, Homo sapiens
uaauuaaaugaaauacuuga

SEQ ID NO: 866991 - RNA, 14 nt, Homo sapiens
uaauuaacauauca

SEQ ID NO: 866992 - RNA, 15 nt, Homo sapiens
uaauuccccuuccau

SEQ ID NO: 866993 - RNA, 15 nt, Homo sapiens
uacaauaaagcaaug

SEQ ID NO: 866994 - RNA, 18 nt, Homo sapiens
uacaauaaagcaaugugg

SEQ ID NO: 866995 - RNA, 21 nt, Homo sapiens
uacaauaaagcaaugugguag

SEQ ID NO: 866996 - RNA, 16 nt, Homo sapiens
uacaauacaguacuca

SEQ ID NO: 866997 - RNA, 21 nt, Homo sapiens
uacacguuggaguauaccuau

SEQ ID NO: 866998 - RNA, 20 nt, Homo sapiens
uacauaacaggcauugcacu

SEQ ID NO: 866999 - RNA, 19 nt, Homo sapiens
uacauguuuuagacagaga

SEQ ID NO: 867000 - RNA, 23 nt, Homo sapiens
uaccuaugugugugcuuugccac

SEQ ID NO: 867001 - RNA, 13 nt, Homo sapiens
uacuaacacuggc

SEQ ID NO: 867002 - RNA, 13 nt, Homo sapiens
uacucaggcagug

SEQ ID NO: 867003 - RNA, 17 nt, Homo sapiens
uacucaggcagugcagu

SEQ ID NO: 867004 - RNA, 20 nt, Homo sapiens
uacuuacccuucuacaaaag

SEQ ID NO: 867005 - RNA, 15 nt, Homo sapiens
uacuuggaauuugcu

SEQ ID NO: 867006 - RNA, 18 nt, Homo sapiens
uagaaucaagucugugaa

SEQ ID NO: 867007 - RNA, 24 nt, Homo sapiens
uagagacuucuaaaucauaaucau

SEQ ID NO: 867008 - RNA, 19 nt, Homo sapiens
uagaggguccagucuucua

SEQ ID NO: 867009 - RNA, 14 nt, Homo sapiens
uagauuaacccuau

SEQ ID NO: 867010 - RNA, 20 nt, Homo sapiens
uagauuuuuagauuccuacu

SEQ ID NO: 867011 - RNA, 16 nt, Homo sapiens
uagccaaagcuguuag

SEQ ID NO: 867012 - RNA, 17 nt, Homo sapiens
uagccagaggcucuaau

SEQ ID NO: 867013 - RNA, 19 nt, Homo sapiens
uagccagaggcucuaaugu

SEQ ID NO: 867014 - RNA, 21 nt, Homo sapiens
uagcccucuuucucucugugu

SEQ ID NO: 867015 - RNA, 15 nt, Homo sapiens
uagcuaacaaaagau

SEQ ID NO: 867016 - RNA, 17 nt, Homo sapiens
uaggaaagcagugcagu

SEQ ID NO: 867017 - RNA, 18 nt, Homo sapiens
uaggaaagcagugcagua

SEQ ID NO: 867018 - RNA, 13 nt, Homo sapiens
uaggcagugcagu

SEQ ID NO: 867019 - RNA, 15 nt, Homo sapiens
uaggcagugcaguac

SEQ ID NO: 867020 - RNA, 16 nt, Homo sapiens
uagggcucuaauuucc

SEQ ID NO: 867021 - RNA, 21 nt, Homo sapiens
uagucaguguacucugagucc

SEQ ID NO: 867022 - RNA, 20 nt, Homo sapiens
uaguccccagccugcucccu

SEQ ID NO: 867023 - RNA, 15 nt, Homo sapiens
uaguggucauuuggu

SEQ ID NO: 867024 - RNA, 21 nt, Homo sapiens
uaguugccguggcaacugugg

SEQ ID NO: 867025 - RNA, 15 nt, Homo sapiens
uauagcauguaauau

SEQ ID NO: 867026 - RNA, 23 nt, Homo sapiens
uaugaccauaaaauuagacauac

SEQ ID NO: 867027 - RNA, 20 nt, Homo sapiens
uaugaugguggaucaagaca

SEQ ID NO: 867028 - RNA, 13 nt, Homo sapiens
ucaaaauguggac

SEQ ID NO: 867029 - RNA, 22 nt, Homo sapiens
ucaaaauguggaccaguucccu

SEQ ID NO: 867030 - RNA, 13 nt, Homo sapiens
ucaaauggaugua

SEQ ID NO: 867031 - RNA, 15 nt, Homo sapiens
ucaacuuacauaugu

SEQ ID NO: 867032 - RNA, 14 nt, Homo sapiens
ucaacuucaggaaa

SEQ ID NO: 867033 - RNA, 23 nt, Homo sapiens
ucaacuucaggaaagcagcaguu

SEQ ID NO: 867034 - RNA, 19 nt, Homo sapiens
ucaauaacuauugcugcuu

SEQ ID NO: 867035 - RNA, 23 nt, Homo sapiens
ucaaucaguaauuaacauaucaa

SEQ ID NO: 867036 - RNA, 13 nt, Homo sapiens
ucacaauuucaau

SEQ ID NO: 867037 - RNA, 20 nt, Homo sapiens
gugaucauaggggcauagcc

SEQ ID NO: 867038 - RNA, 23 nt, Homo sapiens
gugaucuguccuuccaaccuguu

SEQ ID NO: 867039 - RNA, 14 nt, Homo sapiens
gugcaacaaacuca

SEQ ID NO: 867040 - RNA, 22 nt, Homo sapiens
gugcaauguuccguucaucuga

SEQ ID NO: 867041 - RNA, 22 nt, Homo sapiens
gugcuuggaaaauguucugaca

SEQ ID NO: 867042 - RNA, 18 nt, Homo sapiens
guggaaaccuugcugcua

SEQ ID NO: 867043 - RNA, 12 nt, Homo sapiens
gugggaguccac

SEQ ID NO: 867044 - RNA, 18 nt, Homo sapiens
gugggaguccacuuuccu

SEQ ID NO: 867045 - RNA, 15 nt, Homo sapiens
guguggcaaacauuu

SEQ ID NO: 867046 - RNA, 16 nt, Homo sapiens
gugugugugcaauguu

SEQ ID NO: 867047 - RNA, 23 nt, Homo sapiens
guuaaaaucccaaaucuauagca

SEQ ID NO: 867048 - RNA, 11 nt, Homo sapiens
guuaggcagug

SEQ ID NO: 867049 - RNA, 16 nt, Homo sapiens
guuauucaauaacuau

SEQ ID NO: 867050 - RNA, 22 nt, Homo sapiens
guucagaaaagcaccucuugaa

SEQ ID NO: 867051 - RNA, 13 nt, Homo sapiens
guucauacuuugg

SEQ ID NO: 867052 - RNA, 14 nt, Homo sapiens
guuccaugucugaa

SEQ ID NO: 867053 - RNA, 17 nt, Homo sapiens
guuuagugugauuguga

SEQ ID NO: 867054 - RNA, 19 nt, Homo sapiens
uaaaaaauguuauuacuga

SEQ ID NO: 867055 - RNA, 11 nt, Homo sapiens
uaaaacuguga

SEQ ID NO: 867056 - RNA, 12 nt, Homo sapiens
uaaaacugugac

SEQ ID NO: 867057 - RNA, 19 nt, Homo sapiens
uaaaauuugcacacaaaac

SEQ ID NO: 867058 - RNA, 16 nt, Homo sapiens
uaaacgugaugugcuc

SEQ ID NO: 867059 - RNA, 15 nt, Homo sapiens
uaaagugcacugcca

SEQ ID NO: 867060 - RNA, 13 nt, Homo sapiens
uaaaucagugcag

SEQ ID NO: 867061 - RNA, 17 nt, Homo sapiens
uaacaaagugagaccuc

SEQ ID NO: 867062 - RNA, 13 nt, Homo sapiens
uaacacagugcag

SEQ ID NO: 867063 - RNA, 16 nt, Homo sapiens
uaacacagugcagugc

SEQ ID NO: 867064 - RNA, 18 nt, Homo sapiens
uaacaggcauugcacuaa

SEQ ID NO: 867065 - RNA, 19 nt, Homo sapiens
uaaccucucugaacugcaa

SEQ ID NO: 867066 - RNA, 21 nt, Homo sapiens
uaaccucucugaacugcaaca

SEQ ID NO: 867067 - RNA, 12 nt, Homo sapiens
uaagacagugca

SEQ ID NO: 867068 - RNA, 16 nt, Homo sapiens
uaaggcagugcaguac

SEQ ID NO: 867069 - RNA, 15 nt, Homo sapiens
uaaggcagugcagug

SEQ ID NO: 867070 - RNA, 17 nt, Homo sapiens
uaaguaaaugagccuuu

SEQ ID NO: 867071 - RNA, 12 nt, Homo sapiens
uaaucacuauug

SEQ ID NO: 867072 - RNA, 12 nt, Homo sapiens
uaauccaugugc

SEQ ID NO: 867073 - RNA, 11 nt, Homo sapiens
uaaugcuucuu

SEQ ID NO: 867074 - RNA, 20 nt, Homo sapiens
uaauguacaauaaagcaaug

SEQ ID NO: 867075 - RNA, 21 nt, Homo sapiens
uaauguacaauaaagcaaugu

SEQ ID NO: 867076 - RNA, 23 nt, Homo sapiens
uaauguacaauaaagcaaugugg

SEQ ID NO: 867077 - RNA, 18 nt, Homo sapiens
uaauguuccaugucugaa

SEQ ID NO: 867078 - RNA, 14 nt, Homo sapiens
uaauuaaacugaug

SEQ ID NO: 867079 - RNA, 14 nt, Homo sapiens
uacaaaauauccaa

SEQ ID NO: 867080 - RNA, 17 nt, Homo sapiens
uacaaaauauccaagcc

SEQ ID NO: 867081 - RNA, 15 nt, Homo sapiens
uacaaguuacauaca

SEQ ID NO: 867082 - RNA, 21 nt, Homo sapiens
uacaauucuuuguugcuuaau

SEQ ID NO: 867083 - RNA, 14 nt, Homo sapiens
uacaauuugcccaa

SEQ ID NO: 867084 - RNA, 21 nt, Homo sapiens
uacagugauagaacaaaagag

SEQ ID NO: 867085 - RNA, 20 nt, Homo sapiens
uacaugaugauuucagaaac

SEQ ID NO: 867086 - RNA, 22 nt, Homo sapiens
uaccaccaagaggaaaauauug

SEQ ID NO: 867087 - RNA, 14 nt, Homo sapiens
uaccuauugcugua

SEQ ID NO: 867088 - RNA, 21 nt, Homo sapiens
uacggauuuagcuaacaaaag

SEQ ID NO: 867089 - RNA, 12 nt, Homo sapiens
uacuaacacugg

SEQ ID NO: 867090 - RNA, 17 nt, Homo sapiens
uacucaggcagugcaau

SEQ ID NO: 867091 - RNA, 18 nt, Homo sapiens
uacucaggcagugcagua

SEQ ID NO: 867092 - RNA, 21 nt, Homo sapiens
uacucaguaaaucagugcagu

SEQ ID NO: 867093 - RNA, 20 nt, Homo sapiens
uacucaguaacagugcagua

SEQ ID NO: 867094 - RNA, 15 nt, Homo sapiens
gaaggcccagccugu

SEQ ID NO: 867095 - RNA, 19 nt, Homo sapiens
gaaucuccugaccacuugu

SEQ ID NO: 867096 - RNA, 22 nt, Homo sapiens
gaaugaaauauaaacugugaga

SEQ ID NO: 867097 - RNA, 17 nt, Homo sapiens
gaauuacauaacaggca

SEQ ID NO: 867098 - RNA, 17 nt, Homo sapiens
gaauuugcuuagccuuu

SEQ ID NO: 867099 - RNA, 14 nt, Homo sapiens
gacacacucaccau

SEQ ID NO: 867100 - RNA, 18 nt, Homo sapiens
gacaccuagacucuaaaa

SEQ ID NO: 867101 - RNA, 11 nt, Homo sapiens
gacagugcagu

SEQ ID NO: 867102 - RNA, 16 nt, Homo sapiens
gacagugcagugcuca

SEQ ID NO: 867103 - RNA, 12 nt, Homo sapiens
gacauaccucuc

SEQ ID NO: 867104 - RNA, 16 nt, Homo sapiens
gacaucuagucucagu

SEQ ID NO: 867105 - RNA, 21 nt, Homo sapiens
gacucucacgauaugcaaguu

SEQ ID NO: 867106 - RNA, 21 nt, Homo sapiens
gacuucuuuacuaacacuggc

SEQ ID NO: 867107 - RNA, 18 nt, Homo sapiens
gagaaaaagcccucuuca

SEQ ID NO: 867108 - RNA, 12 nt, Homo sapiens
gagaacagggau

SEQ ID NO: 867109 - RNA, 16 nt, Homo sapiens
gagagcgccacccgcc

SEQ ID NO: 867110 - RNA, 20 nt, Homo sapiens
gagaucaugucauugaugaa

SEQ ID NO: 867111 - RNA, 14 nt, Homo sapiens
gagaugccuuccag

SEQ ID NO: 867112 - RNA, 17 nt, Homo sapiens
gagcugaggacucucac

SEQ ID NO: 867113 - RNA, 18 nt, Homo sapiens
gaggcugagacgcaagga

SEQ ID NO: 867114 - RNA, 15 nt, Homo sapiens
gaguuauuuuguguc

SEQ ID NO: 867115 - RNA, 18 nt, Homo sapiens
gauaaauuugacuguuau

SEQ ID NO: 867116 - RNA, 17 nt, Homo sapiens
gauaauuaaaugaaaua

SEQ ID NO: 867117 - RNA, 18 nt, Homo sapiens
gaucauugguaucugaua

SEQ ID NO: 867118 - RNA, 17 nt, Homo sapiens
gaucccugagagucucu

SEQ ID NO: 867119 - RNA, 12 nt, Homo sapiens
gaugccaugaag

SEQ ID NO: 867120 - RNA, 21 nt, Homo sapiens
gauguggauggaggugaugaa

SEQ ID NO: 867121 - RNA, 21 nt, Homo sapiens
gauugagagcagccucuugaa

SEQ ID NO: 867122 - RNA, 18 nt, Homo sapiens
gauuuccuuuggcaauau

SEQ ID NO: 867123 - RNA, 22 nt, Homo sapiens
gcaaaagugcaguagugucacu

SEQ ID NO: 867124 - RNA, 16 nt, Homo sapiens
gcaauuuacuuggaau

SEQ ID NO: 867125 - RNA, 19 nt, Homo sapiens
gcacauguugcuaaugaca

SEQ ID NO: 867126 - RNA, 17 nt, Homo sapiens
gcaccagccugagccac

SEQ ID NO: 867127 - RNA, 13 nt, Homo sapiens
gcaccucuugaag

SEQ ID NO: 867128 - RNA, 12 nt, Homo sapiens
gcagcuagacac

SEQ ID NO: 867129 - RNA, 17 nt, Homo sapiens
gcagugaaguacucagu

SEQ ID NO: 867130 - RNA, 17 nt, Homo sapiens
gcagugcaguacucagu

SEQ ID NO: 867131 - RNA, 20 nt, Homo sapiens
gcaguggggagcgggggcua

SEQ ID NO: 867132 - RNA, 12 nt, Homo sapiens
gcccagaacggg

SEQ ID NO: 867133 - RNA, 19 nt, Homo sapiens
gcccagccuaucucucuuc

SEQ ID NO: 867134 - RNA, 16 nt, Homo sapiens
gccccucuuagaagaa

SEQ ID NO: 867135 - RNA, 21 nt, Homo sapiens
gcccugcaccuugggcacggg

SEQ ID NO: 867136 - RNA, 18 nt, Homo sapiens
gccucauccuccacugaa

SEQ ID NO: 867137 - RNA, 20 nt, Homo sapiens
gccugcacucuuauuucacu

SEQ ID NO: 867138 - RNA, 21 nt, Homo sapiens
gccugcgcccugacaugcuaa

SEQ ID NO: 867139 - RNA, 21 nt, Homo sapiens
gccuuccaggcagacacagcu

SEQ ID NO: 867140 - RNA, 22 nt, Homo sapiens
gccuugggagagaugccuucca

SEQ ID NO: 867141 - RNA, 22 nt, Homo sapiens
gccuuucugccucacaucagcc

SEQ ID NO: 867142 - RNA, 12 nt, Homo sapiens
gcuaacaaaaga

SEQ ID NO: 867143 - RNA, 17 nt, Homo sapiens
gcuaucucgcuagccau

SEQ ID NO: 867144 - RNA, 20 nt, Homo sapiens
gcucaauaaggcagugcagu

SEQ ID NO: 867145 - RNA, 21 nt, Homo sapiens
gcucaauaaggcagugcagug

SEQ ID NO: 867146 - RNA, 12 nt, Homo sapiens
gcuccacucuga

SEQ ID NO: 867147 - RNA, 14 nt, Homo sapiens
gcucuaauguacaa

SEQ ID NO: 867148 - RNA, 17 nt, Homo sapiens
gcucuaauguacaauaa

SEQ ID NO: 867149 - RNA, 18 nt, Homo sapiens
gcugaaauuaugucaaau

SEQ ID NO: 867150 - RNA, 20 nt, Homo sapiens
gcugaugaaguuaagcacaa

SEQ ID NO: 867151 - RNA, 22 nt, Homo sapiens
gcugccucaggaaucuccugac

SEQ ID NO: 867152 - RNA, 13 nt, Homo sapiens
ggaaaagauuucu

SEQ ID NO: 867153 - RNA, 21 nt, Homo sapiens
ggaagaagcaaaccugauaca

SEQ ID NO: 867154 - RNA, 14 nt, Homo sapiens
ggaauuacauaaca

SEQ ID NO: 867155 - RNA, 15 nt, Homo sapiens
ggaucaggaacccuu

SEQ ID NO: 867156 - RNA, 18 nt, Homo sapiens
ggcaauggugaacuguca

SEQ ID NO: 867157 - RNA, 14 nt, Homo sapiens
ggcacucucuuuug

SEQ ID NO: 867158 - RNA, 11 nt, Homo sapiens
ggcagugcagu

SEQ ID NO: 867159 - RNA, 17 nt, Homo sapiens
ugcuuuagguaaaaagc

SEQ ID NO: 867160 - RNA, 22 nt, Homo sapiens
uggaaccaacgaucauaucugu

SEQ ID NO: 867161 - RNA, 18 nt, Homo sapiens
uggaagggccuucuccac

SEQ ID NO: 867162 - RNA, 15 nt, Homo sapiens
uggaauuacauaaca

SEQ ID NO: 867163 - RNA, 13 nt, Homo sapiens
uggcuaugccuuc

SEQ ID NO: 867164 - RNA, 16 nt, Homo sapiens
ugggaggaucacuuga

SEQ ID NO: 867165 - RNA, 14 nt, Homo sapiens
uggggucugugaug

SEQ ID NO: 867166 - RNA, 23 nt, Homo sapiens
uguacaauaaagcaaugugguag

SEQ ID NO: 867167 - RNA, 13 nt, Homo sapiens
uguauccaaguua

SEQ ID NO: 867168 - RNA, 13 nt, Homo sapiens
uguccuaaaugca

SEQ ID NO: 867169 - RNA, 21 nt, Homo sapiens
ugugaaaugacugcaucaugc

SEQ ID NO: 867170 - RNA, 16 nt, Homo sapiens
ugugaagugauugaca

SEQ ID NO: 867171 - RNA, 20 nt, Homo sapiens
ugugagcuuucugauacuua

SEQ ID NO: 867172 - RNA, 18 nt, Homo sapiens
ugugccccuuccccaugc

SEQ ID NO: 867173 - RNA, 18 nt, Homo sapiens
ugugcuguugauucuuuc

SEQ ID NO: 867174 - RNA, 17 nt, Homo sapiens
ugugcuuugccacugaa

SEQ ID NO: 867175 - RNA, 20 nt, Homo sapiens
uguguauaaagccauuauuc

SEQ ID NO: 867176 - RNA, 18 nt, Homo sapiens
uguucauucucaucagug

SEQ ID NO: 867177 - RNA, 19 nt, Homo sapiens
uguugaagaacucauguga

SEQ ID NO: 867178 - RNA, 13 nt, Homo sapiens
uuaaacauugccu

SEQ ID NO: 867179 - RNA, 20 nt, Homo sapiens
uuaaaguaaaaacaauucaa

SEQ ID NO: 867180 - RNA, 21 nt, Homo sapiens
uuaagaagcucagcuaugaaa

SEQ ID NO: 867181 - RNA, 19 nt, Homo sapiens
uuacaauguaucaacauau

SEQ ID NO: 867182 - RNA, 18 nt, Homo sapiens
uuaccucugcauaaauau

SEQ ID NO: 867183 - RNA, 15 nt, Homo sapiens
uuacugauuaacuca

SEQ ID NO: 867184 - RNA, 15 nt, Homo sapiens
uuagacauaccucuc

SEQ ID NO: 867185 - RNA, 18 nt, Homo sapiens
uuaggaaagcagugcagu

SEQ ID NO: 867186 - RNA, 14 nt, Homo sapiens
uuaggcagugcagu

SEQ ID NO: 867187 - RNA, 21 nt, Homo sapiens
uuagucuccuaauaaguuccu

SEQ ID NO: 867188 - RNA, 18 nt, Homo sapiens
uuauauaugaaaacuaag

SEQ ID NO: 867189 - RNA, 19 nt, Homo sapiens
uuauaucagacugcuuuga

SEQ ID NO: 867190 - RNA, 19 nt, Homo sapiens
uuaucugauccuuguggca

SEQ ID NO: 867191 - RNA, 13 nt, Homo sapiens
uuaucugucuuua

SEQ ID NO: 867192 - RNA, 22 nt, Homo sapiens
uuauuggcaauaccuagugaua

SEQ ID NO: 867193 - RNA, 17 nt, Homo sapiens
uucaaacgaaauggcuc

SEQ ID NO: 867194 - RNA, 20 nt, Homo sapiens
uucaauccccauaaugcuuc

SEQ ID NO: 867195 - RNA, 21 nt, Homo sapiens
uucaaugcuucuuuuagucag

SEQ ID NO: 867196 - RNA, 19 nt, Homo sapiens
uuccaagugugugugcaau

SEQ ID NO: 867197 - RNA, 23 nt, Homo sapiens
uuccaugucugaaguuugcccca

SEQ ID NO: 867198 - RNA, 15 nt, Homo sapiens
uuccugcuccuccag

SEQ ID NO: 867199 - RNA, 16 nt, Homo sapiens
uuccugucaauauaua

SEQ ID NO: 867200 - RNA, 17 nt, Homo sapiens
uuccuuuggcaauauca

SEQ ID NO: 867201 - RNA, 15 nt, Homo sapiens
uucuaauccaugugc

SEQ ID NO: 867202 - RNA, 21 nt, Homo sapiens
uucuacuccauggugaacuga

SEQ ID NO: 867203 - RNA, 21 nt, Homo sapiens
uucucuagacaucuagucuca

SEQ ID NO: 867204 - RNA, 19 nt, Homo sapiens
uucucucuguguggcaaac

SEQ ID NO: 867205 - RNA, 17 nt, Homo sapiens
uucugaguagcauauau

SEQ ID NO: 867206 - RNA, 22 nt, Homo sapiens
uucugccucacaucagcccugu

SEQ ID NO: 867207 - RNA, 13 nt, Homo sapiens
uucuugcacugua

SEQ ID NO: 867208 - RNA, 18 nt, Homo sapiens
uugaaugcuuaaaugauc

SEQ ID NO: 867209 - RNA, 20 nt, Homo sapiens
uugaauuuugucauguaauu

SEQ ID NO: 867210 - RNA, 13 nt, Homo sapiens
uugagaucauguc

SEQ ID NO: 867211 - RNA, 15 nt, Homo sapiens
uugauguaacugugu

SEQ ID NO: 867212 - RNA, 14 nt, Homo sapiens
uugccgcauauuau

SEQ ID NO: 867213 - RNA, 12 nt, Homo sapiens
uugcuaacauau

SEQ ID NO: 867214 - RNA, 18 nt, Homo sapiens
uugcugaauaacaacaau

SEQ ID NO: 867215 - RNA, 19 nt, Homo sapiens
uuggucucuuucuuuccaa

SEQ ID NO: 867216 - RNA, 18 nt, Homo sapiens
uugguuaccuauugcugu

SEQ ID NO: 867217 - RNA, 19 nt, Homo sapiens
uuguaacucacaugccuuc

SEQ ID NO: 867218 - RNA, 14 nt, Homo sapiens
uuguauauguaauu

SEQ ID NO: 867219 - RNA, 20 nt, Homo sapiens
uuguucuuguaaaacuguga

SEQ ID NO: 867220 - RNA, 15 nt, Homo sapiens
uuuaaucauuuccag

SEQ ID NO: 867221 - RNA, 16 nt, Homo sapiens
uuuaccuugcauuuua

SEQ ID NO: 867222 - RNA, 12 nt, Homo sapiens
uuuauauaugaa

SEQ ID NO: 867223 - RNA, 23 nt, Homo sapiens
uuuauuuaaggggaauuaacaau

SEQ ID NO: 867224 - RNA, 18 nt, Homo sapiens
uuuccuaugacacucauc

SEQ ID NO: 867225 - RNA, 15 nt, Homo sapiens
uuuccugacagggaa

SEQ ID NO: 867226 - RNA, 15 nt, Homo sapiens
uuucggaaaugauug

SEQ ID NO: 867227 - RNA, 18 nt, Homo sapiens
uuucugccucacaucagc

SEQ ID NO: 867228 - RNA, 12 nt, Homo sapiens
uuugccacugaa

SEQ ID NO: 867229 - RNA, 17 nt, Homo sapiens
uuugcucucucauuccc

SEQ ID NO: 867230 - RNA, 13 nt, Homo sapiens
uuuguguuuacau

SEQ ID NO: 867231 - RNA, 13 nt, Homo sapiens
uuuuagauuccua

SEQ ID NO: 867232 - RNA, 20 nt, Homo sapiens
cauaagcuuuuucucugaac

SEQ ID NO: 867233 - RNA, 15 nt, Homo sapiens
cauauuuuguuauag

SEQ ID NO: 867234 - RNA, 16 nt, Homo sapiens
caucaguuaggauuag

SEQ ID NO: 867235 - RNA, 16 nt, Homo sapiens
caucuagucucagugc

SEQ ID NO: 867236 - RNA, 15 nt, Homo sapiens
caucugaggagucca

SEQ ID NO: 867237 - RNA, 16 nt, Homo sapiens
caucugcauuucuaca

SEQ ID NO: 867238 - RNA, 20 nt, Homo sapiens
caugcacucuuuugagcagu

SEQ ID NO: 867239 - RNA, 17 nt, Homo sapiens
cauguugcuaaugacag

SEQ ID NO: 867240 - RNA, 23 nt, Homo sapiens
cauuaaacuaauuaaacugaugg

SEQ ID NO: 867241 - RNA, 23 nt, Homo sapiens
cauugaugacaugggauugaguu

SEQ ID NO: 867242 - RNA, 22 nt, Homo sapiens
cauuuaaucauuuccagcaaaa

SEQ ID NO: 867243 - RNA, 21 nt, Homo sapiens
cauuuaggaaagcagugcagu

SEQ ID NO: 867244 - RNA, 23 nt, Homo sapiens
cauuuaggaaagcagugcaguac

SEQ ID NO: 867245 - RNA, 15 nt, Homo sapiens
cauuuaugcaugaga

SEQ ID NO: 867246 - RNA, 14 nt, Homo sapiens
cauuucagcuguga

SEQ ID NO: 867247 - RNA, 21 nt, Homo sapiens
cauuuccccugugguuuguua

SEQ ID NO: 867248 - RNA, 18 nt, Homo sapiens
cauuucuugguaugauca

SEQ ID NO: 867249 - RNA, 11 nt, Homo sapiens
cauuugcugaa

SEQ ID NO: 867250 - RNA, 16 nt, Homo sapiens
cauuugcugcauuuca

SEQ ID NO: 867251 - RNA, 18 nt, Homo sapiens
ccaaacuguacaguuucu

SEQ ID NO: 867252 - RNA, 14 nt, Homo sapiens
ccaaaucucaaaag

SEQ ID NO: 867253 - RNA, 16 nt, Homo sapiens
ccaagguaaacaguuu

SEQ ID NO: 867254 - RNA, 18 nt, Homo sapiens
ccaagguaaacaguuuga

SEQ ID NO: 867255 - RNA, 18 nt, Homo sapiens
ccaaguuggagugcagug

SEQ ID NO: 867256 - RNA, 14 nt, Homo sapiens
ccaauuucucuuaa

SEQ ID NO: 867257 - RNA, 20 nt, Homo sapiens
ccaccauuuccccugugguu

SEQ ID NO: 867258 - RNA, 19 nt, Homo sapiens
ccacgcagagccccggagc

SEQ ID NO: 867259 - RNA, 17 nt, Homo sapiens
ccacuuauuuccaugga

SEQ ID NO: 867260 - RNA, 14 nt, Homo sapiens
ccagaggcucuaau

SEQ ID NO: 867261 - RNA, 21 nt, Homo sapiens
ccagaggcucuaauguacaau

SEQ ID NO: 867262 - RNA, 22 nt, Homo sapiens
ccagaggcucuaauguacaaua

SEQ ID NO: 867263 - RNA, 19 nt, Homo sapiens
ccagccccuucaauuauuu

SEQ ID NO: 867264 - RNA, 15 nt, Homo sapiens
ccagccugcucccua

SEQ ID NO: 867265 - RNA, 20 nt, Homo sapiens
ccagggugcaggcgcgcacc

SEQ ID NO: 867266 - RNA, 12 nt, Homo sapiens
ccaguuaacugu

SEQ ID NO: 867267 - RNA, 13 nt, Homo sapiens
ccaucccacugau

SEQ ID NO: 867268 - RNA, 19 nt, Homo sapiens
ccaugcucagcucagcauu

SEQ ID NO: 867269 - RNA, 15 nt, Homo sapiens
ccauggccccagcug

SEQ ID NO: 867270 - RNA, 14 nt, Homo sapiens
cccaaagugcacug

SEQ ID NO: 867271 - RNA, 23 nt, Homo sapiens
cccagaagcucaaggcugcagug

SEQ ID NO: 867272 - RNA, 19 nt, Homo sapiens
cccagccucccccaggcug

SEQ ID NO: 867273 - RNA, 19 nt, Homo sapiens
cccaugguagacugugaca

SEQ ID NO: 867274 - RNA, 18 nt, Homo sapiens
cccauugugaauguuguc

SEQ ID NO: 867275 - RNA, 21 nt, Homo sapiens
ccccagccugcucccuagcca

SEQ ID NO: 867276 - RNA, 19 nt, Homo sapiens
cuaaaaguaauaaauucca

SEQ ID NO: 867277 - RNA, 17 nt, Homo sapiens
cuaaaagugaugugauu

SEQ ID NO: 867278 - RNA, 20 nt, Homo sapiens
cuaaagaaaaacuaauguca

SEQ ID NO: 867279 - RNA, 21 nt, Homo sapiens
cuaagaaauggcuuuccacau

SEQ ID NO: 867280 - RNA, 14 nt, Homo sapiens
cuaagccugaugau

SEQ ID NO: 867281 - RNA, 13 nt, Homo sapiens
cuaauccaugugc

SEQ ID NO: 867282 - RNA, 13 nt, Homo sapiens
cuaauguacaaua

SEQ ID NO: 867283 - RNA, 15 nt, Homo sapiens
cuaauguacaauaaa

SEQ ID NO: 867284 - RNA, 14 nt, Homo sapiens
cuaaugucagcaca

SEQ ID NO: 867285 - RNA, 17 nt, Homo sapiens
cuacagauguacauuaa

SEQ ID NO: 867286 - RNA, 20 nt, Homo sapiens
cuacuuaaacaaaaacuuuc

SEQ ID NO: 867287 - RNA, 19 nt, Homo sapiens
cuagaaagagaaaaagccc

SEQ ID NO: 867288 - RNA, 23 nt, Homo sapiens
cuagaaccuucuaauccaugugc

SEQ ID NO: 867289 - RNA, 16 nt, Homo sapiens
cuagagcuaugcacac

SEQ ID NO: 867290 - RNA, 18 nt, Homo sapiens
cuagcaauugcuucucua

SEQ ID NO: 867291 - RNA, 23 nt, Homo sapiens
cuaguaggucugcacacauaaca

SEQ ID NO: 867292 - RNA, 12 nt, Homo sapiens
cuaucaguaaua

SEQ ID NO: 867293 - RNA, 15 nt, Homo sapiens
cuaugcacaccaaau

SEQ ID NO: 867294 - RNA, 22 nt, Homo sapiens
cuaugcacaccaaauugcugag

SEQ ID NO: 867295 - RNA, 23 nt, Homo sapiens
cuaugucgucguuuucaccagca

SEQ ID NO: 867296 - RNA, 17 nt, Homo sapiens
cuauuuuggacguguga

SEQ ID NO: 867297 - RNA, 16 nt, Homo sapiens
cucaacuuacauaugu

SEQ ID NO: 867298 - RNA, 21 nt, Homo sapiens
cucaaggcugcagugagccaa

SEQ ID NO: 867299 - RNA, 19 nt, Homo sapiens
cucaauaaggcagugcagu

SEQ ID NO: 867300 - RNA, 20 nt, Homo sapiens
cucaauaaggcagugcagug

SEQ ID NO: 867301 - RNA, 18 nt, Homo sapiens
cucaaugugcuguugauu

SEQ ID NO: 867302 - RNA, 15 nt, Homo sapiens
cucacugguuuucaa

SEQ ID NO: 867303 - RNA, 21 nt, Homo sapiens
cucacuugcuuuaguuguuaa

SEQ ID NO: 867304 - RNA, 15 nt, Homo sapiens
cucaggcagugcagu

SEQ ID NO: 867305 - RNA, 20 nt, Homo sapiens
cucaguaaaucagugcagua

SEQ ID NO: 867306 - RNA, 23 nt, Homo sapiens
cucaguaaaucagugcaguacuc

SEQ ID NO: 867307 - RNA, 22 nt, Homo sapiens
cucaguaacacaauacaguacu

SEQ ID NO: 867308 - RNA, 23 nt, Homo sapiens
cucaguaacacagugcaguacuc

SEQ ID NO: 867309 - RNA, 20 nt, Homo sapiens
cucaguaagacagugcagug

SEQ ID NO: 867310 - RNA, 11 nt, Homo sapiens
cucaguaauac

SEQ ID NO: 867311 - RNA, 16 nt, Homo sapiens
cucauccuccacugaa

SEQ ID NO: 867312 - RNA, 21 nt, Homo sapiens
cucaugcagauaguauacaca

SEQ ID NO: 867313 - RNA, 22 nt, Homo sapiens
cucauuuauuuauuggcaauac

SEQ ID NO: 867314 - RNA, 20 nt, Homo sapiens
cuccacaguuaggccaagaa

SEQ ID NO: 867315 - RNA, 15 nt, Homo sapiens
cuccaguucugauga

SEQ ID NO: 867316 - RNA, 17 nt, Homo sapiens
cucccuagccagaggcu

SEQ ID NO: 867317 - RNA, 19 nt, Homo sapiens
cuccucgguggcauuugcu

SEQ ID NO: 867318 - RNA, 14 nt, Homo sapiens
cucggacaccaucu

SEQ ID NO: 867319 - RNA, 18 nt, Homo sapiens
cucuaaaacagcacuauc

SEQ ID NO: 867320 - RNA, 21 nt, Homo sapiens
cucuaagaaauggcuuuccac

SEQ ID NO: 867321 - RNA, 16 nt, Homo sapiens
cucuaauguacaauaa

SEQ ID NO: 867322 - RNA, 23 nt, Homo sapiens
cucuaauguacaauaaagcaaug

SEQ ID NO: 867323 - RNA, 17 nt, Homo sapiens
cucuagacaucuagucu

SEQ ID NO: 867324 - RNA, 23 nt, Homo sapiens
cucuagacaucuagucucagugc

SEQ ID NO: 867325 - RNA, 12 nt, Homo sapiens
cucucaacuuac

SEQ ID NO: 867326 - RNA, 15 nt, Homo sapiens
cucucugaacugcaa

SEQ ID NO: 867327 - RNA, 17 nt, Homo sapiens
cucuugaagaacugacu

SEQ ID NO: 867328 - RNA, 17 nt, Homo sapiens
cugaacugcaacacugg

SEQ ID NO: 867329 - RNA, 22 nt, Homo sapiens
cugagacgcaaggaucacuuga

SEQ ID NO: 867330 - RNA, 13 nt, Homo sapiens
cugaugcacuguu

SEQ ID NO: 867331 - RNA, 14 nt, Homo sapiens
ugaaacugacuugc

SEQ ID NO: 867332 - RNA, 21 nt, Homo sapiens
ugaaacugacuugcugugacu

SEQ ID NO: 867333 - RNA, 19 nt, Homo sapiens
ugaaacuugagcauucaaa

SEQ ID NO: 867334 - RNA, 18 nt, Homo sapiens
ugaaagucuccuguauca

SEQ ID NO: 867335 - RNA, 12 nt, Homo sapiens
ugaacugccaaa

SEQ ID NO: 867336 - RNA, 17 nt, Homo sapiens
ugaagaacucaugugau

SEQ ID NO: 867337 - RNA, 19 nt, Homo sapiens
ugaagcaaauuucuagaua

SEQ ID NO: 867338 - RNA, 17 nt, Homo sapiens
ugaaguacucaguaaua

SEQ ID NO: 867339 - RNA, 17 nt, Homo sapiens
ugaagucccucuauguc

SEQ ID NO: 867340 - RNA, 20 nt, Homo sapiens
ugaaguuugccccagugcua

SEQ ID NO: 867341 - RNA, 23 nt, Homo sapiens
ugaaugaaauauaaacugugaga

SEQ ID NO: 867342 - RNA, 14 nt, Homo sapiens
ugacuuaugugcag

SEQ ID NO: 867343 - RNA, 23 nt, Homo sapiens
ugacuuccugaacucccagucau

SEQ ID NO: 867344 - RNA, 23 nt, Homo sapiens
ugacuucuuuacuaacacuggcu

SEQ ID NO: 867345 - RNA, 15 nt, Homo sapiens
ugagaaaucucaucc

SEQ ID NO: 867346 - RNA, 21 nt, Homo sapiens
ugagacgcaaggaucacuuga

SEQ ID NO: 867347 - RNA, 20 nt, Homo sapiens
ugagauuuccugacagggaa

SEQ ID NO: 867348 - RNA, 22 nt, Homo sapiens
ugaguuucauuuuucauuuucu

SEQ ID NO: 867349 - RNA, 19 nt, Homo sapiens
ugauaaccuaacacuauca

SEQ ID NO: 867350 - RNA, 14 nt, Homo sapiens
ugauacaacaggau

SEQ ID NO: 867351 - RNA, 14 nt, Homo sapiens
ugaugaacugccaa

SEQ ID NO: 867352 - RNA, 13 nt, Homo sapiens
ugaugccaugaag

SEQ ID NO: 867353 - RNA, 18 nt, Homo sapiens
ugaugugcucaucagaaa

SEQ ID NO: 867354 - RNA, 20 nt, Homo sapiens
ugauucaaauaacccugaau

SEQ ID NO: 867355 - RNA, 14 nt, Homo sapiens
ugcaauacucagug

SEQ ID NO: 867356 - RNA, 16 nt, Homo sapiens
ugcacuguuugcccca

SEQ ID NO: 867357 - RNA, 11 nt, Homo sapiens
ugcaguacuca

SEQ ID NO: 867358 - RNA, 14 nt, Homo sapiens
ugcaguacucagua

SEQ ID NO: 867359 - RNA, 14 nt, Homo sapiens
ugcaguagugucac

SEQ ID NO: 867360 - RNA, 17 nt, Homo sapiens
ugcaguggugaugccua

SEQ ID NO: 867361 - RNA, 17 nt, Homo sapiens
ugcauguaauccuagca

SEQ ID NO: 867362 - RNA, 21 nt, Homo sapiens
ugccccaguaacucacuuuaa

SEQ ID NO: 867363 - RNA, 14 nt, Homo sapiens
ugccccagugcuac

SEQ ID NO: 867364 - RNA, 17 nt, Homo sapiens
ugccuagugcuacagau

SEQ ID NO: 867365 - RNA, 22 nt, Homo sapiens
ugccucacaucagcccugugua

SEQ ID NO: 867366 - RNA, 21 nt, Homo sapiens
ugcguaggagagaacagggau

SEQ ID NO: 867367 - RNA, 22 nt, Homo sapiens
ugcguaggagagaacagggaug

SEQ ID NO: 867368 - RNA, 20 nt, Homo sapiens
ugcuaucucgcuagccauau

SEQ ID NO: 867369 - RNA, 21 nt, Homo sapiens
ugcucaguaacacagugcagu

SEQ ID NO: 867370 - RNA, 16 nt, Homo sapiens
ugcucaguauugagac

SEQ ID NO: 867371 - RNA, 14 nt, Homo sapiens
ugcucucugcucac

SEQ ID NO: 867372 - RNA, 14 nt, Homo sapiens
ugcuguugauucuu

SEQ ID NO: 867373 - RNA, 22 nt, Homo sapiens
ugcuucucuaaaacagcacuau

SEQ ID NO: 867374 - RNA, 19 nt, Homo sapiens
ugcuucuuuccucuuaaug

SEQ ID NO: 867375 - RNA, 17 nt, Homo sapiens
uggaaaaaauuagacaa

SEQ ID NO: 867376 - RNA, 22 nt, Homo sapiens
uggaaaaagaauauauugccaa

SEQ ID NO: 867377 - RNA, 16 nt, Homo sapiens
uggaaauuauguggaa

SEQ ID NO: 867378 - RNA, 16 nt, Homo sapiens
uggagacgaugcuuua

SEQ ID NO: 867379 - RNA, 13 nt, Homo sapiens
uggagugcagugg

SEQ ID NO: 867380 - RNA, 17 nt, Homo sapiens
uggaucaggaacccuua

SEQ ID NO: 867381 - RNA, 14 nt, Homo sapiens
uggcagcgccuccc

SEQ ID NO: 867382 - RNA, 19 nt, Homo sapiens
uggcuaauuccccuuccau

SEQ ID NO: 867383 - RNA, 15 nt, Homo sapiens
ugggaaauucuugca

SEQ ID NO: 867384 - RNA, 20 nt, Homo sapiens
ugggaaauucuugcacugua

SEQ ID NO: 867385 - RNA, 23 nt, Homo sapiens
ugggccaccccuaaucacuauug

SEQ ID NO: 867386 - RNA, 14 nt, Homo sapiens
ugggccugccaaac

SEQ ID NO: 867387 - RNA, 15 nt, Homo sapiens
ugguagacugugaca

SEQ ID NO: 867388 - RNA, 10 nt, Homo sapiens
uggucucuuu

SEQ ID NO: 867389 - RNA, 12 nt, Homo sapiens
ugguuaccucug

SEQ ID NO: 867390 - RNA, 18 nt, Homo sapiens
uguacaauaaagcaaugu

SEQ ID NO: 867391 - RNA, 20 nt, Homo sapiens
uguacauaguggucauuugg

SEQ ID NO: 867392 - RNA, 23 nt, Homo sapiens
uguacuggauuuaacuaccuuug

SEQ ID NO: 867393 - RNA, 20 nt, Homo sapiens
ugucaguuugugaagugauu

SEQ ID NO: 867394 - RNA, 22 nt, Homo sapiens
ugucauugaugaacugccaaag

SEQ ID NO: 867395 - RNA, 15 nt, Homo sapiens
uguccucuacauacc

SEQ ID NO: 867396 - RNA, 21 nt, Homo sapiens
ugucucaaaauaaaaccagaa

SEQ ID NO: 867397 - RNA, 23 nt, Homo sapiens
ugucugucccaguuaacuguuaa

SEQ ID NO: 867398 - RNA, 22 nt, Homo sapiens
ugugaaauaaauaugaauggag

SEQ ID NO: 867399 - RNA, 15 nt, Homo sapiens
ugugacuagauauca

SEQ ID NO: 867400 - RNA, 18 nt, Homo sapiens
uguggaauauggcaauag

SEQ ID NO: 867401 - RNA, 14 nt, Homo sapiens
ugugugcaauguuc

SEQ ID NO: 867402 - RNA, 22 nt, Homo sapiens
ugugugcuuugccacugaagua

SEQ ID NO: 867403 - RNA, 19 nt, Homo sapiens
uguuacagaggacauacca

SEQ ID NO: 867404 - RNA, 22 nt, Homo sapiens
uguuauuuguugagacuaucaa

SEQ ID NO: 867405 - RNA, 14 nt, Homo sapiens
uguuguuauggcaa

SEQ ID NO: 867406 - RNA, 18 nt, Homo sapiens
uuaaauuuggguugcaaa

SEQ ID NO: 867407 - RNA, 18 nt, Homo sapiens
uuaagaauuuaccagaaa

SEQ ID NO: 867408 - RNA, 19 nt, Homo sapiens
uuacagugaugccaugaag

SEQ ID NO: 867409 - RNA, 19 nt, Homo sapiens
uuagaauguugaaacugac

SEQ ID NO: 867410 - RNA, 19 nt, Homo sapiens
uuagacaagucuaguggaa

SEQ ID NO: 867411 - RNA, 15 nt, Homo sapiens
uuagacaauguggaa

SEQ ID NO: 867412 - RNA, 16 nt, Homo sapiens
uuagcuaacaaaagau

SEQ ID NO: 867413 - RNA, 23 nt, Homo sapiens
uuaggaaagcagugcaguacuca

SEQ ID NO: 867414 - RNA, 22 nt, Homo sapiens
uuaggacaugcuaucaguaaua

SEQ ID NO: 867415 - RNA, 22 nt, Homo sapiens
uuaggcaauggugaacugucau

SEQ ID NO: 867416 - RNA, 15 nt, Homo sapiens
uuaggcagugcagua

SEQ ID NO: 867417 - RNA, 23 nt, Homo sapiens
uuauucaauaacuauugcugcuu

SEQ ID NO: 867418 - RNA, 15 nt, Homo sapiens
uuauuuccauggauu

SEQ ID NO: 867419 - RNA, 19 nt, Homo sapiens
uucaacaugguuaccucug

SEQ ID NO: 867420 - RNA, 15 nt, Homo sapiens
uucagaaaagcaccu

SEQ ID NO: 867421 - RNA, 19 nt, Homo sapiens
uucagugagguaugaugug

SEQ ID NO: 867422 - RNA, 13 nt, Homo sapiens
uuccaaaguuuug

SEQ ID NO: 867423 - RNA, 18 nt, Homo sapiens
uuccauggauuccccugg

SEQ ID NO: 867424 - RNA, 17 nt, Homo sapiens
uucccaaaucucaaaag

SEQ ID NO: 867425 - RNA, 15 nt, Homo sapiens
uucccaacaauacuu

SEQ ID NO: 867426 - RNA, 19 nt, Homo sapiens
uuccccacaauaggcuuag

SEQ ID NO: 867427 - RNA, 16 nt, Homo sapiens
uuccugaacucccagu

SEQ ID NO: 867428 - RNA, 18 nt, Homo sapiens
uuccugcuccuccaguac

SEQ ID NO: 867429 - RNA, 22 nt, Homo sapiens
uucuaguggguuuaauguuuag

SEQ ID NO: 867430 - RNA, 21 nt, Homo sapiens
uucuauuagcuuacugauuaa

SEQ ID NO: 867431 - RNA, 22 nt, Homo sapiens
uucuauuucaacuucaggaaag

SEQ ID NO: 867432 - RNA, 22 nt, Homo sapiens
uucucuauguacagaugaugua

SEQ ID NO: 867433 - RNA, 16 nt, Homo sapiens
uucuugagcagcugaa

SEQ ID NO: 867434 - RNA, 19 nt, Homo sapiens
uugauacaacaggauuuuc

SEQ ID NO: 867435 - RNA, 13 nt, Homo sapiens
uugcugcauuuca

SEQ ID NO: 867436 - RNA, 21 nt, Homo sapiens
uugcugugaaaugacugcauc

SEQ ID NO: 867437 - RNA, 12 nt, Homo sapiens
uuggagugcagu

SEQ ID NO: 867438 - RNA, 18 nt, Homo sapiens
uugggaaaugcugauuua

SEQ ID NO: 867439 - RNA, 15 nt, Homo sapiens
uuguaaaacugugac

SEQ ID NO: 867440 - RNA, 23 nt, Homo sapiens
uuguugguuuggccacucuugac

SEQ ID NO: 867441 - RNA, 13 nt, Homo sapiens
cacugguuuucaa

SEQ ID NO: 867442 - RNA, 9 nt, Homo sapiens
cacuucuua

SEQ ID NO: 867443 - RNA, 19 nt, Homo sapiens
cacuuuuuaacauucucaa

SEQ ID NO: 867444 - RNA, 21 nt, Homo sapiens
cacuuuuuuccugucaauaua

SEQ ID NO: 867445 - RNA, 22 nt, Homo sapiens
cagaaaugauucaggguuauuu

SEQ ID NO: 867446 - RNA, 15 nt, Homo sapiens
cagaagggagugaaa

SEQ ID NO: 867447 - RNA, 19 nt, Homo sapiens
cagacucaaggccuccagc

SEQ ID NO: 867448 - RNA, 19 nt, Homo sapiens
cagagacuuuguguuuaca

SEQ ID NO: 867449 - RNA, 17 nt, Homo sapiens
cagaggcucuaauguac

SEQ ID NO: 867450 - RNA, 18 nt, Homo sapiens
cagaggcucuaauguaca

SEQ ID NO: 867451 - RNA, 17 nt, Homo sapiens
cagagucaagcugauga

SEQ ID NO: 867452 - RNA, 12 nt, Homo sapiens
cagcacaguacu

SEQ ID NO: 867453 - RNA, 15 nt, Homo sapiens
cagcacauguugcua

SEQ ID NO: 867454 - RNA, 17 nt, Homo sapiens
cagcaguuuucuuuuaa

SEQ ID NO: 867455 - RNA, 16 nt, Homo sapiens
cagccacuuauuucca

SEQ ID NO: 867456 - RNA, 14 nt, Homo sapiens
cagccugcucccua

SEQ ID NO: 867457 - RNA, 16 nt, Homo sapiens
cagccuguaacugucc

SEQ ID NO: 867458 - RNA, 17 nt, Homo sapiens
cagcuaagccugaugau

SEQ ID NO: 867459 - RNA, 23 nt, Homo sapiens
cagcuagaaagagaaaaagcccu

SEQ ID NO: 867460 - RNA, 21 nt, Homo sapiens
caggaaagaucccaagucaaa

SEQ ID NO: 867461 - RNA, 21 nt, Homo sapiens
caggagaaaccccugacaccu

SEQ ID NO: 867462 - RNA, 13 nt, Homo sapiens
caggcagugcagu

SEQ ID NO: 867463 - RNA, 17 nt, Homo sapiens
cagggcgcuccggcaga

SEQ ID NO: 867464 - RNA, 22 nt, Homo sapiens
cagguaucugaugauguucuga

SEQ ID NO: 867465 - RNA, 15 nt, Homo sapiens
caguaaagcaaugca

SEQ ID NO: 867466 - RNA, 18 nt, Homo sapiens
caguaaaucagugcagua

SEQ ID NO: 867467 - RNA, 15 nt, Homo sapiens
caguaacacagugca

SEQ ID NO: 867468 - RNA, 22 nt, Homo sapiens
caguaacacagugcaguacuca

SEQ ID NO: 867469 - RNA, 23 nt, Homo sapiens
caguaagaucaagcuccaucuua

SEQ ID NO: 867470 - RNA, 15 nt, Homo sapiens
caguaaggcagugaa

SEQ ID NO: 867471 - RNA, 21 nt, Homo sapiens
caguacucaggcagugcagua

SEQ ID NO: 867472 - RNA, 17 nt, Homo sapiens
caguagaggguccaguc

SEQ ID NO: 867473 - RNA, 18 nt, Homo sapiens
caguaugguacucaguaa

SEQ ID NO: 867474 - RNA, 18 nt, Homo sapiens
cagugcagugcucaguaa

SEQ ID NO: 867475 - RNA, 18 nt, Homo sapiens
cagugcgguacucaguaa

SEQ ID NO: 867476 - RNA, 16 nt, Homo sapiens
caguuaggcagugcag

SEQ ID NO: 867477 - RNA, 17 nt, Homo sapiens
caguuugaaaagacaaa

SEQ ID NO: 867478 - RNA, 15 nt, Homo sapiens
caguuugugaucugu

SEQ ID NO: 867479 - RNA, 22 nt, Homo sapiens
caguuugugaucuguccuucca

SEQ ID NO: 867480 - RNA, 23 nt, Homo sapiens
cauaugauaaauuugacuguuau

SEQ ID NO: 867481 - RNA, 13 nt, Homo sapiens
cauaugucuucaa

SEQ ID NO: 867482 - RNA, 13 nt, Homo sapiens
caucaaagcccuc

SEQ ID NO: 867483 - RNA, 17 nt, Homo sapiens
cauccacuucacaguuc

SEQ ID NO: 867484 - RNA, 13 nt, Homo sapiens
caucucuguaaaa

SEQ ID NO: 867485 - RNA, 15 nt, Homo sapiens
caucucuguaaaaag

SEQ ID NO: 867486 - RNA, 11 nt, Homo sapiens
caucuuccuag

SEQ ID NO: 867487 - RNA, 23 nt, Homo sapiens
caugacuucuuuacuaacacugg

SEQ ID NO: 867488 - RNA, 17 nt, Homo sapiens
caugguagacugugaca

SEQ ID NO: 867489 - RNA, 18 nt, Homo sapiens
caugugcugcuguggcau

SEQ ID NO: 867490 - RNA, 20 nt, Homo sapiens
cauuauucucugaugcacug

SEQ ID NO: 867491 - RNA, 22 nt, Homo sapiens
cauuauucucugaugcacuguu

SEQ ID NO: 867492 - RNA, 22 nt, Homo sapiens
cauugcacuaaaagugauguga

SEQ ID NO: 867493 - RNA, 14 nt, Homo sapiens
cauugguaucugau

SEQ ID NO: 867494 - RNA, 19 nt, Homo sapiens
cauuguguacaaaauaucc

SEQ ID NO: 867495 - RNA, 15 nt, Homo sapiens
cauuuaaagauacca

SEQ ID NO: 867496 - RNA, 22 nt, Homo sapiens
aguuuccagcuaagccugauga

SEQ ID NO: 867497 - RNA, 23 nt, Homo sapiens
aguuuccagcuaagccugaugau

SEQ ID NO: 867498 - RNA, 19 nt, Homo sapiens
aguuucuuccccaagagcu

SEQ ID NO: 867499 - RNA, 16 nt, Homo sapiens
auaaacugugagauaa

SEQ ID NO: 867500 - RNA, 19 nt, Homo sapiens
auaaccuaacacuaucaua

SEQ ID NO: 867501 - RNA, 16 nt, Homo sapiens
auaacuauugcugcuu

SEQ ID NO: 867502 - RNA, 18 nt, Homo sapiens
auaagaugcugcugagca

SEQ ID NO: 867503 - RNA, 22 nt, Homo sapiens
auaaggaguugccgcauauuau

SEQ ID NO: 867504 - RNA, 21 nt, Homo sapiens
auaaggcagugcagugcucag

SEQ ID NO: 867505 - RNA, 18 nt, Homo sapiens
auacaauacaguacucag

SEQ ID NO: 867506 - RNA, 15 nt, Homo sapiens
auacaauuugcccaa

SEQ ID NO: 867507 - RNA, 14 nt, Homo sapiens
auacaugaugauuu

SEQ ID NO: 867508 - RNA, 13 nt, Homo sapiens
auacuucuuuuua

SEQ ID NO: 867509 - RNA, 14 nt, Homo sapiens
auauaaacugugag

SEQ ID NO: 867510 - RNA, 18 nt, Homo sapiens
auaugaagaacuauuaua

SEQ ID NO: 867511 - RNA, 14 nt, Homo sapiens
auaugaucuugaua

SEQ ID NO: 867512 - RNA, 18 nt, Homo sapiens
auauucuaaaaguaauaa

SEQ ID NO: 867513 - RNA, 17 nt, Homo sapiens
auauugccaaauauuaa

SEQ ID NO: 867514 - RNA, 18 nt, Homo sapiens
auauuuucugaguagcau

SEQ ID NO: 867515 - RNA, 20 nt, Homo sapiens
aucaguccacccccauugug

SEQ ID NO: 867516 - RNA, 14 nt, Homo sapiens
aucauaguuauuaa

SEQ ID NO: 867517 - RNA, 20 nt, Homo sapiens
aucaugcuucuacuccaugg

SEQ ID NO: 867518 - RNA, 24 nt, Homo sapiens
aucaugcuucuacuccauggugaa

SEQ ID NO: 867519 - RNA, 14 nt, Homo sapiens
aucaugucauugau

SEQ ID NO: 867520 - RNA, 18 nt, Homo sapiens
aucccucggucagcaccg

SEQ ID NO: 867521 - RNA, 20 nt, Homo sapiens
aucuauggauuggguaucaa

SEQ ID NO: 867522 - RNA, 18 nt, Homo sapiens
aucucaaaagaucuccug

SEQ ID NO: 867523 - RNA, 13 nt, Homo sapiens
aucuggugcgugu

SEQ ID NO: 867524 - RNA, 22 nt, Homo sapiens
aucuuguggucugcugccucag

SEQ ID NO: 867525 - RNA, 14 nt, Homo sapiens
augaacugccaaag

SEQ ID NO: 867526 - RNA, 23 nt, Homo sapiens
augaaugaaauauaaacugugag

SEQ ID NO: 867527 - RNA, 16 nt, Homo sapiens
augaccauaaaauuag

SEQ ID NO: 867528 - RNA, 20 nt, Homo sapiens
augaccauccaguagagauu

SEQ ID NO: 867529 - RNA, 22 nt, Homo sapiens
augacuucuuuacuaacacugg

SEQ ID NO: 867530 - RNA, 21 nt, Homo sapiens
augaggcacgccugccuucuc

SEQ ID NO: 867531 - RNA, 19 nt, Homo sapiens
augauaaauuugacuguua

SEQ ID NO: 867532 - RNA, 23 nt, Homo sapiens
augcaugagaacuaaauagauuu

SEQ ID NO: 867533 - RNA, 17 nt, Homo sapiens
augcuaagggcagcccu

SEQ ID NO: 867534 - RNA, 23 nt, Homo sapiens
augcuaucucgcuagccauauau

SEQ ID NO: 867535 - RNA, 22 nt, Homo sapiens
augcucaguaacacagugcagu

SEQ ID NO: 867536 - RNA, 16 nt, Homo sapiens
augcugugcagcacuu

SEQ ID NO: 867537 - RNA, 14 nt, Homo sapiens
augcuuaaaugauc

SEQ ID NO: 867538 - RNA, 16 nt, Homo sapiens
auggaagggccuucuc

SEQ ID NO: 867539 - RNA, 18 nt, Homo sapiens
auggaagggccuucucca

SEQ ID NO: 867540 - RNA, 12 nt, Homo sapiens
augucaaaugga

SEQ ID NO: 867541 - RNA, 20 nt, Homo sapiens
augucaaauggauguaauau

SEQ ID NO: 867542 - RNA, 17 nt, Homo sapiens
auguuccguucaucuga

SEQ ID NO: 867543 - RNA, 17 nt, Homo sapiens
auguucuugagcagcug

SEQ ID NO: 867544 - RNA, 22 nt, Homo sapiens
auguugaaaaagaaaacaacca

SEQ ID NO: 867545 - RNA, 14 nt, Homo sapiens
auuaacccuauuaa

SEQ ID NO: 867546 - RNA, 12 nt, Homo sapiens
auuacauaacag

SEQ ID NO: 867547 - RNA, 16 nt, Homo sapiens
auuagacauaccucuc

SEQ ID NO: 867548 - RNA, 20 nt, Homo sapiens
auuauauucccaaaucucaa

SEQ ID NO: 867549 - RNA, 22 nt, Homo sapiens
auucaaagaaucaccuaauuaa

SEQ ID NO: 867550 - RNA, 22 nt, Homo sapiens
acucaguaaaucagugcaguac

SEQ ID NO: 867551 - RNA, 20 nt, Homo sapiens
acucaguaacacagugcagu

SEQ ID NO: 867552 - RNA, 18 nt, Homo sapiens
acucaguaacagugcagu

SEQ ID NO: 867553 - RNA, 20 nt, Homo sapiens
acucaguaacagugcaguac

SEQ ID NO: 867554 - RNA, 15 nt, Homo sapiens
acucaguaaggcagu

SEQ ID NO: 867555 - RNA, 22 nt, Homo sapiens
acucaguuaggcagugcaguac

SEQ ID NO: 867556 - RNA, 16 nt, Homo sapiens
acucaugugauuuacc

SEQ ID NO: 867557 - RNA, 14 nt, Homo sapiens
acuccuuacagaag

SEQ ID NO: 867558 - RNA, 16 nt, Homo sapiens
acucuaaaacuaucag

SEQ ID NO: 867559 - RNA, 18 nt, Homo sapiens
acucuuacuaaccaccau

SEQ ID NO: 867560 - RNA, 20 nt, Homo sapiens
acucuuacuaaccaccauuu

SEQ ID NO: 867561 - RNA, 16 nt, Homo sapiens
acucuuauuucacuaa

SEQ ID NO: 867562 - RNA, 16 nt, Homo sapiens
acugauuaacucaguc

SEQ ID NO: 867563 - RNA, 14 nt, Homo sapiens
acugcaacacugga

SEQ ID NO: 867564 - RNA, 15 nt, Homo sapiens
acugcaacacuggau

SEQ ID NO: 867565 - RNA, 21 nt, Homo sapiens
acugcuuugagaaaucucauc

SEQ ID NO: 867566 - RNA, 21 nt, Homo sapiens
acuguacaguuucuuccccaa

SEQ ID NO: 867567 - RNA, 18 nt, Homo sapiens
acugucuucaacccugcc

SEQ ID NO: 867568 - RNA, 13 nt, Homo sapiens
acuguucaugaau

SEQ ID NO: 867569 - RNA, 14 nt, Homo sapiens
acuucucuagacau

SEQ ID NO: 867570 - RNA, 15 nt, Homo sapiens
acuuuggaucaggaa

SEQ ID NO: 867571 - RNA, 24 nt, Homo sapiens
agaaauaugagcaugcucccucau

SEQ ID NO: 867572 - RNA, 18 nt, Homo sapiens
agaagcaaaccugauaca

SEQ ID NO: 867573 - RNA, 18 nt, Homo sapiens
agaagcucagcuaugaaa

SEQ ID NO: 867574 - RNA, 12 nt, Homo sapiens
agaaucaagucu

SEQ ID NO: 867575 - RNA, 21 nt, Homo sapiens
agaaucaccuaauuaauuuca

SEQ ID NO: 867576 - RNA, 23 nt, Homo sapiens
agaauuagauuuuaaaacuucau

SEQ ID NO: 867577 - RNA, 20 nt, Homo sapiens
agacaccaauggauccuugu

SEQ ID NO: 867578 - RNA, 14 nt, Homo sapiens
agacacgaaauugg

SEQ ID NO: 867579 - RNA, 16 nt, Homo sapiens
agacacugucaagauu

SEQ ID NO: 867580 - RNA, 13 nt, Homo sapiens
agacagugcagug

SEQ ID NO: 867581 - RNA, 21 nt, Homo sapiens
agacauaaguaaaugagccuu

SEQ ID NO: 867582 - RNA, 13 nt, Homo sapiens
agacauaccucuc

SEQ ID NO: 867583 - RNA, 16 nt, Homo sapiens
agacaucuagucucag

SEQ ID NO: 867584 - RNA, 23 nt, Homo sapiens
agacuuuguguuuacaucugcau

SEQ ID NO: 867585 - RNA, 20 nt, Homo sapiens
agagaaaaagcccucuucaa

SEQ ID NO: 867586 - RNA, 16 nt, Homo sapiens
agagacuuuguguuua

SEQ ID NO: 867587 - RNA, 18 nt, Homo sapiens
agaggcucuaauguacaa

SEQ ID NO: 867588 - RNA, 15 nt, Homo sapiens
agaguguuuaacuga

SEQ ID NO: 867589 - RNA, 13 nt, Homo sapiens
agaugccuuccag

SEQ ID NO: 867590 - RNA, 23 nt, Homo sapiens
agauuucccacauucccaugaau

SEQ ID NO: 867591 - RNA, 17 nt, Homo sapiens
agauuuuaaaacuucau

SEQ ID NO: 867592 - RNA, 21 nt, Homo sapiens
agcaaaagugcaguaguguca

SEQ ID NO: 867593 - RNA, 22 nt, Homo sapiens
agcaacuggugacugucccuuc

SEQ ID NO: 867594 - RNA, 15 nt, Homo sapiens
agcaagcucacuugc

SEQ ID NO: 867595 - RNA, 23 nt, Homo sapiens
agcacauguugcuaaugacagug

SEQ ID NO: 867596 - RNA, 14 nt, Homo sapiens
agcaccagccugag

SEQ ID NO: 867597 - RNA, 14 nt, Homo sapiens
agcaccucuugaag

SEQ ID NO: 867598 - RNA, 16 nt, Homo sapiens
agcagcagcagcagca

SEQ ID NO: 867599 - RNA, 12 nt, Homo sapiens
agcauguaauau

SEQ ID NO: 867600 - RNA, 20 nt, Homo sapiens
agccaaguucacaccacugc

SEQ ID NO: 867601 - RNA, 19 nt, Homo sapiens
agccagaggcucuaaugua

SEQ ID NO: 867602 - RNA, 14 nt, Homo sapiens
agccccacuccaca

SEQ ID NO: 867603 - RNA, 16 nt, Homo sapiens
agcccucuuucucucu

SEQ ID NO: 867604 - RNA, 17 nt, Homo sapiens
agcccucuuucucucug

SEQ ID NO: 867605 - RNA, 14 nt, Homo sapiens
aaaucagugcagua

SEQ ID NO: 867606 - RNA, 14 nt, Homo sapiens
aaaucuauagcauu

SEQ ID NO: 867607 - RNA, 17 nt, Homo sapiens
aaaugcaaagcacaccu

SEQ ID NO: 867608 - RNA, 23 nt, Homo sapiens
aaauugagucauuuuauauauga

SEQ ID NO: 867609 - RNA, 18 nt, Homo sapiens
aacaacaaagcaugcuca

SEQ ID NO: 867610 - RNA, 16 nt, Homo sapiens
aacaauuucugugucc

SEQ ID NO: 867611 - RNA, 16 nt, Homo sapiens
aacacaauacaguacu

SEQ ID NO: 867612 - RNA, 18 nt, Homo sapiens
aacacagugcagugcuca

SEQ ID NO: 867613 - RNA, 21 nt, Homo sapiens
aacagaguugagguuguuaaa

SEQ ID NO: 867614 - RNA, 15 nt, Homo sapiens
aacaguuugaaaaga

SEQ ID NO: 867615 - RNA, 20 nt, Homo sapiens
aacauauuuaaagucuugaa

SEQ ID NO: 867616 - RNA, 21 nt, Homo sapiens
aacauucuauuucaacuucag

SEQ ID NO: 867617 - RNA, 17 nt, Homo sapiens
aacccugcccugcaccu

SEQ ID NO: 867618 - RNA, 12 nt, Homo sapiens
aaccuugcugcu

SEQ ID NO: 867619 - RNA, 17 nt, Homo sapiens
aacuaaguucucuaucu

SEQ ID NO: 867620 - RNA, 18 nt, Homo sapiens
aacuauguuuagugugau

SEQ ID NO: 867621 - RNA, 17 nt, Homo sapiens
aacuguaaaauacuucu

SEQ ID NO: 867622 - RNA, 18 nt, Homo sapiens
aacuguaaaauacuucuu

SEQ ID NO: 867623 - RNA, 19 nt, Homo sapiens
aacuguacaguuucuuccc

SEQ ID NO: 867624 - RNA, 13 nt, Homo sapiens
aacuuacauaugu

SEQ ID NO: 867625 - RNA, 22 nt, Homo sapiens
aacuucaggaaagcagcaguuu

SEQ ID NO: 867626 - RNA, 14 nt, Homo sapiens
aacuucaucugucu

SEQ ID NO: 867627 - RNA, 15 nt, Homo sapiens
aagaacucaugugau

SEQ ID NO: 867628 - RNA, 14 nt, Homo sapiens
aagaaucaccuaau

SEQ ID NO: 867629 - RNA, 20 nt, Homo sapiens
aagacaaaugggccugccaa

SEQ ID NO: 867630 - RNA, 21 nt, Homo sapiens
aagacaaaugggccugccaaa

SEQ ID NO: 867631 - RNA, 17 nt, Homo sapiens
aagauucagcagugucu

SEQ ID NO: 867632 - RNA, 17 nt, Homo sapiens
aagcaaaccugauacaa

SEQ ID NO: 867633 - RNA, 24 nt, Homo sapiens
aagcacaaccauguucuugagcag

SEQ ID NO: 867634 - RNA, 23 nt, Homo sapiens
aagcaugcucaguauugagacac

SEQ ID NO: 867635 - RNA, 21 nt, Homo sapiens
aagcccagccuaucucucuuc

SEQ ID NO: 867636 - RNA, 15 nt, Homo sapiens
aaggcacacugagca

SEQ ID NO: 867637 - RNA, 12 nt, Homo sapiens
aaggcagugcag

SEQ ID NO: 867638 - RNA, 12 nt, Homo sapiens
aaggcauccacu

SEQ ID NO: 867639 - RNA, 12 nt, Homo sapiens
aaggcuguguca

SEQ ID NO: 867640 - RNA, 16 nt, Homo sapiens
aagggugcccaccucu

SEQ ID NO: 867641 - RNA, 17 nt, Homo sapiens
aaguaauaaauuccaau

SEQ ID NO: 867642 - RNA, 12 nt, Homo sapiens
aagugaugugau

SEQ ID NO: 867643 - RNA, 14 nt, Homo sapiens
aagugaugugauuu

SEQ ID NO: 867644 - RNA, 16 nt, Homo sapiens
aagugcuugaggccaa

SEQ ID NO: 867645 - RNA, 14 nt, Homo sapiens
aaguuaauucucag

SEQ ID NO: 867646 - RNA, 17 nt, Homo sapiens
aaguucauccaacguga

SEQ ID NO: 867647 - RNA, 22 nt, Homo sapiens
aaguuuucaccuaucuggaaaa

SEQ ID NO: 867648 - RNA, 18 nt, Homo sapiens
aauaacccugaaucagag

SEQ ID NO: 867649 - RNA, 19 nt, Homo sapiens
aauauauguuuggcugaaa

SEQ ID NO: 867650 - RNA, 15 nt, Homo sapiens
aauaugaauggagug

SEQ ID NO: 867651 - RNA, 12 nt, Homo sapiens
aauauuugcuca

SEQ ID NO: 867652 - RNA, 18 nt, Homo sapiens
aaucacuauugcuuccua

SEQ ID NO: 867653 - RNA, 19 nt, Homo sapiens
aaucacuauugcuuccuaa

SEQ ID NO: 867654 - RNA, 20 nt, Homo sapiens
aauccacaguauuguucuug

SEQ ID NO: 867655 - RNA, 19 nt, Homo sapiens
aaucccauuuaugcaauuu

SEQ ID NO: 867656 - RNA, 15 nt, Homo sapiens
aaugaaauacuugac

SEQ ID NO: 867657 - RNA, 16 nt, Homo sapiens
aaugaaauacuugaca

SEQ ID NO: 867658 - RNA, 16 nt, Homo sapiens
aaugagccuuucugcc

SEQ ID NO: 867659 - RNA, 20 nt, Homo sapiens
aaugaguucccuugauucaa

SEQ ID NO: 867660 - RNA, 17 nt, Homo sapiens
aaugauggaacaguaau

SEQ ID NO: 867661 - RNA, 21 nt, Homo sapiens
aaugcaaaauacaugaugauu

SEQ ID NO: 867662 - RNA, 17 nt, Homo sapiens
aauguacaauaaagcaa

SEQ ID NO: 867663 - RNA, 18 nt, Homo sapiens
aauguacaauaaagcaau

SEQ ID NO: 867664 - RNA, 23 nt, Homo sapiens
aauguauauugauguaacugugu

SEQ ID NO: 867665 - RNA, 13 nt, Homo sapiens
aaugucagcacau

SEQ ID NO: 867666 - RNA, 20 nt, Homo sapiens
aauguucugacagcauuuca

SEQ ID NO: 867667 - RNA, 22 nt, Homo sapiens
aauguugaagaacucaugugau

SEQ ID NO: 867668 - RNA, 18 nt, Homo sapiens
aauguuguccugugucau

SEQ ID NO: 867669 - RNA, 15 nt, Homo sapiens
aucgaggggugcuua

SEQ ID NO: 867670 - RNA, 12 nt, Homo sapiens
aucuauggauug

SEQ ID NO: 867671 - RNA, 16 nt, Homo sapiens
aucugaggaguccaaa

SEQ ID NO: 867672 - RNA, 14 nt, Homo sapiens
aucugauaucuguu

SEQ ID NO: 867673 - RNA, 20 nt, Homo sapiens
augaaauugagucauuuuau

SEQ ID NO: 867674 - RNA, 23 nt, Homo sapiens
augacuucuuuacuaacacuggc

SEQ ID NO: 867675 - RNA, 14 nt, Homo sapiens
augagauuggaaaa

SEQ ID NO: 867676 - RNA, 20 nt, Homo sapiens
augagcaugcucccucaugc

SEQ ID NO: 867677 - RNA, 14 nt, Homo sapiens
augaugguggauca

SEQ ID NO: 867678 - RNA, 18 nt, Homo sapiens
augauguuaguaacuuuu

SEQ ID NO: 867679 - RNA, 13 nt, Homo sapiens
augauuucagaaa

SEQ ID NO: 867680 - RNA, 13 nt, Homo sapiens
augcaagcccuuu

SEQ ID NO: 867681 - RNA, 23 nt, Homo sapiens
augccaauuucucuuaaguacug

SEQ ID NO: 867682 - RNA, 20 nt, Homo sapiens
augcugauuuaaacuucuua

SEQ ID NO: 867683 - RNA, 23 nt, Homo sapiens
auggauggggguuaccuagcccu

SEQ ID NO: 867684 - RNA, 18 nt, Homo sapiens
auggcuuuccacaucccc

SEQ ID NO: 867685 - RNA, 18 nt, Homo sapiens
augggaauuuuaacuuuu

SEQ ID NO: 867686 - RNA, 15 nt, Homo sapiens
augguagacugugac

SEQ ID NO: 867687 - RNA, 16 nt, Homo sapiens
augguagacugugaca

SEQ ID NO: 867688 - RNA, 15 nt, Homo sapiens
auggugaacugucau

SEQ ID NO: 867689 - RNA, 24 nt, Homo sapiens
augucagggguuugcuuacaguga

SEQ ID NO: 867690 - RNA, 20 nt, Homo sapiens
augucauugaugaacugcca

SEQ ID NO: 867691 - RNA, 17 nt, Homo sapiens
auguccaaacuuaacag

SEQ ID NO: 867692 - RNA, 17 nt, Homo sapiens
augugauuuaugcauuu

SEQ ID NO: 867693 - RNA, 19 nt, Homo sapiens
augugccgucuuugguucc

SEQ ID NO: 867694 - RNA, 13 nt, Homo sapiens
auguucugacagc

SEQ ID NO: 867695 - RNA, 23 nt, Homo sapiens
auguugguacccuggacagugcc

SEQ ID NO: 867696 - RNA, 16 nt, Homo sapiens
auguuuagugugauug

SEQ ID NO: 867697 - RNA, 20 nt, Homo sapiens
auguuucuaucuuguauguc

SEQ ID NO: 867698 - RNA, 18 nt, Homo sapiens
auuaagaagcucagcuau

SEQ ID NO: 867699 - RNA, 14 nt, Homo sapiens
auuacuuucagaau

SEQ ID NO: 867700 - RNA, 20 nt, Homo sapiens
auuagaauauuguaacucac

SEQ ID NO: 867701 - RNA, 23 nt, Homo sapiens
auuauauucccaaaucucaaaag

SEQ ID NO: 867702 - RNA, 22 nt, Homo sapiens
auucaaaccuaaguugcuggac

SEQ ID NO: 867703 - RNA, 22 nt, Homo sapiens
auucaaaugaagauucagcagu

SEQ ID NO: 867704 - RNA, 22 nt, Homo sapiens
auuccaaucauuguuaaaguaa

SEQ ID NO: 867705 - RNA, 16 nt, Homo sapiens
auuccagggaaccaga

SEQ ID NO: 867706 - RNA, 17 nt, Homo sapiens
auuccagggaaccagag

SEQ ID NO: 867707 - RNA, 18 nt, Homo sapiens
auucucuauguacagaug

SEQ ID NO: 867708 - RNA, 14 nt, Homo sapiens
auugaggaugaacu

SEQ ID NO: 867709 - RNA, 17 nt, Homo sapiens
auugaugaacugccaaa

SEQ ID NO: 867710 - RNA, 21 nt, Homo sapiens
auuguucuuguaaaacuguga

SEQ ID NO: 867711 - RNA, 14 nt, Homo sapiens
auuuaaacuucuua

SEQ ID NO: 867712 - RNA, 22 nt, Homo sapiens
auuuaaagucuugaauguugaa

SEQ ID NO: 867713 - RNA, 11 nt, Homo sapiens
auuuccaugga

SEQ ID NO: 867714 - RNA, 15 nt, Homo sapiens
auuuccuuaaagcaa

SEQ ID NO: 867715 - RNA, 14 nt, Homo sapiens
auuuuauauaugaa

SEQ ID NO: 867716 - RNA, 20 nt, Homo sapiens
caaaaugaaugccaguccag

SEQ ID NO: 867717 - RNA, 14 nt, Homo sapiens
caaaaugugugcuu

SEQ ID NO: 867718 - RNA, 18 nt, Homo sapiens
caaaucuauagcauuuaa

SEQ ID NO: 867719 - RNA, 19 nt, Homo sapiens
caaaugccuuucuagcaau

SEQ ID NO: 867720 - RNA, 15 nt, Homo sapiens
caaauggauguaaua

SEQ ID NO: 867721 - RNA, 17 nt, Homo sapiens
caaaugggccugccaaa

SEQ ID NO: 867722 - RNA, 20 nt, Homo sapiens
caaccuggguaacaaaguga

SEQ ID NO: 867723 - RNA, 21 nt, Homo sapiens
caaccuguucacgugacuccu

SEQ ID NO: 867724 - RNA, 12 nt, Homo sapiens
caagauagcucc

SEQ ID NO: 867725 - RNA, 17 nt, Homo sapiens
caaggaucacuugagcc

SEQ ID NO: 867726 - RNA, 14 nt, Homo sapiens
caaggcugcaguga

SEQ ID NO: 867727 - RNA, 17 nt, Homo sapiens
caaggcugcagugagcc

SEQ ID NO: 867728 - RNA, 14 nt, Homo sapiens
caagucuaguggaa

SEQ ID NO: 867729 - RNA, 13 nt, Homo sapiens
caagucugugaaa

SEQ ID NO: 867730 - RNA, 18 nt, Homo sapiens
caaguuacauacauuuaa

SEQ ID NO: 867731 - RNA, 23 nt, Homo sapiens
caaguucacaccacugccauuuc

SEQ ID NO: 867732 - RNA, 17 nt, Homo sapiens
caaguuggagugcagug

SEQ ID NO: 867733 - RNA, 16 nt, Homo sapiens
caaguuuuugguaaug

SEQ ID NO: 867734 - RNA, 21 nt, Homo sapiens
ugcucaauaaggcagugcagu

SEQ ID NO: 867735 - RNA, 20 nt, Homo sapiens
ugcucaguaaggcagugaau

SEQ ID NO: 867736 - RNA, 15 nt, Homo sapiens
ugcucccuagccaga

SEQ ID NO: 867737 - RNA, 16 nt, Homo sapiens
ugcucccuagccagag

SEQ ID NO: 867738 - RNA, 21 nt, Homo sapiens
ugcucccuagccagaggcucu

SEQ ID NO: 867739 - RNA, 17 nt, Homo sapiens
ugcuucuuuccucuuaa

SEQ ID NO: 867740 - RNA, 16 nt, Homo sapiens
ugcuuucagauccauc

SEQ ID NO: 867741 - RNA, 20 nt, Homo sapiens
ugcuuucucuucuacuucuu

SEQ ID NO: 867742 - RNA, 17 nt, Homo sapiens
ugcuuugagaaaucuca

SEQ ID NO: 867743 - RNA, 23 nt, Homo sapiens
uggaaaccuugcugcuaugcugu

SEQ ID NO: 867744 - RNA, 20 nt, Homo sapiens
uggaauuaguuggcagagaa

SEQ ID NO: 867745 - RNA, 13 nt, Homo sapiens
uggaggugaugaa

SEQ ID NO: 867746 - RNA, 14 nt, Homo sapiens
uggcauuugcugaa

SEQ ID NO: 867747 - RNA, 21 nt, Homo sapiens
uggccuauuuuggacguguga

SEQ ID NO: 867748 - RNA, 18 nt, Homo sapiens
uggcuacaauuacuuuga

SEQ ID NO: 867749 - RNA, 13 nt, Homo sapiens
ugggccugccaaa

SEQ ID NO: 867750 - RNA, 17 nt, Homo sapiens
uggguaucaugcuucua

SEQ ID NO: 867751 - RNA, 12 nt, Homo sapiens
ugguacucagua

SEQ ID NO: 867752 - RNA, 14 nt, Homo sapiens
ugguagacugugac

SEQ ID NO: 867753 - RNA, 20 nt, Homo sapiens
ugguucaggccaagccccuu

SEQ ID NO: 867754 - RNA, 16 nt, Homo sapiens
ugguuuccaucaaagc

SEQ ID NO: 867755 - RNA, 21 nt, Homo sapiens
uguaaaacugugacauuccac

SEQ ID NO: 867756 - RNA, 21 nt, Homo sapiens
uguaaauauuaugauggugga

SEQ ID NO: 867757 - RNA, 13 nt, Homo sapiens
uguacaauaaagc

SEQ ID NO: 867758 - RNA, 20 nt, Homo sapiens
uguacaauaaagcaaugugg

SEQ ID NO: 867759 - RNA, 18 nt, Homo sapiens
uguauaaagccauuauuc

SEQ ID NO: 867760 - RNA, 21 nt, Homo sapiens
uguauauugauguaacugugu

SEQ ID NO: 867761 - RNA, 15 nt, Homo sapiens
ugucaaauggaugua

SEQ ID NO: 867762 - RNA, 19 nt, Homo sapiens
ugucccaguuaacuguuaa

SEQ ID NO: 867763 - RNA, 15 nt, Homo sapiens
ugugcagcuuuccag

SEQ ID NO: 867764 - RNA, 18 nt, Homo sapiens
uguggaauuacauaacag

SEQ ID NO: 867765 - RNA, 16 nt, Homo sapiens
uguggaccaguucccu

SEQ ID NO: 867766 - RNA, 20 nt, Homo sapiens
uguggucugcugccucagga

SEQ ID NO: 867767 - RNA, 16 nt, Homo sapiens
uguguacaaaauaucc

SEQ ID NO: 867768 - RNA, 22 nt, Homo sapiens
uguguccuaaaugcaaagcaca

SEQ ID NO: 867769 - RNA, 15 nt, Homo sapiens
ugugugaagcaaauu

SEQ ID NO: 867770 - RNA, 14 nt, Homo sapiens
uguucagaaaagca

SEQ ID NO: 867771 - RNA, 22 nt, Homo sapiens
uguucccucucucccuccaggg

SEQ ID NO: 867772 - RNA, 19 nt, Homo sapiens
uguucuuguaaaacuguga

SEQ ID NO: 867773 - RNA, 20 nt, Homo sapiens
uuaaaacuuacuaugguaua

SEQ ID NO: 867774 - RNA, 19 nt, Homo sapiens
uuaaacaaaaacuuuccau

SEQ ID NO: 867775 - RNA, 19 nt, Homo sapiens
uuaaacuucuuaacuggca

SEQ ID NO: 867776 - RNA, 14 nt, Homo sapiens
uuaacaauugccag

SEQ ID NO: 867777 - RNA, 19 nt, Homo sapiens
uuaacaauugccagggaaa

SEQ ID NO: 867778 - RNA, 18 nt, Homo sapiens
uuaaggcauauacuuugu

SEQ ID NO: 867779 - RNA, 20 nt, Homo sapiens
uuaaguacugaaauacauau

SEQ ID NO: 867780 - RNA, 15 nt, Homo sapiens
uuaccuauugcugua

SEQ ID NO: 867781 - RNA, 19 nt, Homo sapiens
uuagauuuuaaaacuucau

SEQ ID NO: 867782 - RNA, 17 nt, Homo sapiens
uuagucagaaaugauuc

SEQ ID NO: 867783 - RNA, 19 nt, Homo sapiens
uuagucaguguacucugag

SEQ ID NO: 867784 - RNA, 16 nt, Homo sapiens
uuagugugauugugaa

SEQ ID NO: 867785 - RNA, 14 nt, Homo sapiens
uuauaccagcaaaa

SEQ ID NO: 867786 - RNA, 19 nt, Homo sapiens
uuauauaugaaaacuaagu

SEQ ID NO: 867787 - RNA, 19 nt, Homo sapiens
uuauauucccaaaucucaa

SEQ ID NO: 867788 - RNA, 22 nt, Homo sapiens
uuauauucccaaaucucaaaag

SEQ ID NO: 867789 - RNA, 15 nt, Homo sapiens
uuaucauaaauucaa

SEQ ID NO: 867790 - RNA, 13 nt, Homo sapiens
uuauuuccaugga

SEQ ID NO: 867791 - RNA, 14 nt, Homo sapiens
uuauuuccauggau

SEQ ID NO: 867792 - RNA, 13 nt, Homo sapiens
uuauuugaucugg

SEQ ID NO: 867793 - RNA, 15 nt, Homo sapiens
uucaacuucaggaaa

SEQ ID NO: 867794 - RNA, 18 nt, Homo sapiens
uucaaguuaauucucaga

SEQ ID NO: 867795 - RNA, 23 nt, Homo sapiens
uucauggaguagagucaggagaa

SEQ ID NO: 867796 - RNA, 18 nt, Homo sapiens
uuccaagugugugugcaa

SEQ ID NO: 867797 - RNA, 21 nt, Homo sapiens
uuccaauacaaguuacauaca

SEQ ID NO: 867798 - RNA, 15 nt, Homo sapiens
uuccagcaaaauaua

SEQ ID NO: 867799 - RNA, 21 nt, Homo sapiens
uucccgcagcaccagccugag

SEQ ID NO: 867800 - RNA, 21 nt, Homo sapiens
uucuaaaucauaaucauccuu

SEQ ID NO: 867801 - RNA, 20 nt, Homo sapiens
uucuauuagcuuacugauua

SEQ ID NO: 867802 - RNA, 12 nt, Homo sapiens
uucucuagacau

SEQ ID NO: 867803 - RNA, 16 nt, Homo sapiens
uucugacagcauuuca

SEQ ID NO: 867804 - RNA, 16 nt, Homo sapiens
uucuucccuuaggcaa

SEQ ID NO: 867805 - RNA, 18 nt, Homo sapiens
uucuuguaaaacugugac

SEQ ID NO: 867806 - RNA, 23 nt, Homo sapiens
uugaaaggagaaaaaaaaagcca

SEQ ID NO: 867807 - RNA, 13 nt, Homo sapiens
uugagucuggaua

SEQ ID NO: 867808 - RNA, 16 nt, Homo sapiens
uugaugaacugccaaa

SEQ ID NO: 867809 - RNA, 20 nt, Homo sapiens
uugauucaaauaacccugaa

SEQ ID NO: 867810 - RNA, 16 nt, Homo sapiens
uugcaaugcaagcccu

SEQ ID NO: 867811 - RNA, 17 nt, Homo sapiens
uugcacuaaaagugaug

SEQ ID NO: 867812 - RNA, 21 nt, Homo sapiens
uugcacuaaaagugaugugau

SEQ ID NO: 867813 - RNA, 14 nt, Homo sapiens
uugcacugcuuuau

SEQ ID NO: 867814 - RNA, 23 nt, Homo sapiens
uugcuaacauauuuaaagucuug

SEQ ID NO: 867815 - RNA, 19 nt, Homo sapiens
uugcuuacagugaugccau

SEQ ID NO: 867816 - RNA, 22 nt, Homo sapiens
uugcuuagccuuuaauaggcuu

SEQ ID NO: 867817 - RNA, 14 nt, Homo sapiens
uuggcuaugccuuc

SEQ ID NO: 867818 - RNA, 15 nt, Homo sapiens
uuggcuuaauuccaa

SEQ ID NO: 867819 - RNA, 19 nt, Homo sapiens
uuggguaagggacuccaga

SEQ ID NO: 867820 - RNA, 21 nt, Homo sapiens
uuggguaagggacuccagaag

SEQ ID NO: 867821 - RNA, 12 nt, Homo sapiens
uugguacccugg

SEQ ID NO: 867822 - RNA, 22 nt, Homo sapiens
uugucaguguagaucaacucau

SEQ ID NO: 867823 - RNA, 19 nt, Homo sapiens
uuguggcacacaacugugg

SEQ ID NO: 867824 - RNA, 17 nt, Homo sapiens
uuguguacaaaauaucc

SEQ ID NO: 867825 - RNA, 16 nt, Homo sapiens
uuguuaucaguacaau

SEQ ID NO: 867826 - RNA, 15 nt, Homo sapiens
uuguuauggcaaguu

SEQ ID NO: 867827 - RNA, 15 nt, Homo sapiens
uuguucauacuuugg

SEQ ID NO: 867828 - RNA, 15 nt, Homo sapiens
uuucacuguucauga

SEQ ID NO: 867829 - RNA, 22 nt, Homo sapiens
uuuccucuuaaugucucaaaau

SEQ ID NO: 867830 - RNA, 13 nt, Homo sapiens
uuuccugacaggg

SEQ ID NO: 867831 - RNA, 19 nt, Homo sapiens
uuuccugcuccuccaguac

SEQ ID NO: 867832 - RNA, 19 nt, Homo sapiens
uuucucucuguguggcaaa

SEQ ID NO: 867833 - RNA, 13 nt, Homo sapiens
uuuggcugugaug

SEQ ID NO: 867834 - RNA, 17 nt, Homo sapiens
uuuguaccuguaggucu

SEQ ID NO: 867835 - RNA, 17 nt, Homo sapiens
uuuguauuuuuccucuu

SEQ ID NO: 867836 - RNA, 17 nt, Homo sapiens
uuugucaguguagauca

SEQ ID NO: 867837 - RNA, 12 nt, Homo sapiens
uuugugaucugu

SEQ ID NO: 867838 - RNA, 17 nt, Homo sapiens
uuuguugagacuaucaa

SEQ ID NO: 867839 - RNA, 13 nt, Homo sapiens
uuuugauggcuau

SEQ ID NO: 867840 - RNA, 20 nt, Homo sapiens
uuuuuaaaagcccuuuccaa

SEQ ID NO: 867841 - RNA, 15 nt, Homo sapiens
uuuuuaagacucaau

SEQ ID NO: 867842 - RNA, 20 nt, Homo sapiens
aaaaauaguguguccaugca

SEQ ID NO: 867843 - RNA, 11 nt, Homo sapiens
aaaacugugac

SEQ ID NO: 867844 - RNA, 12 nt, Homo sapiens
aaaacugugaca

SEQ ID NO: 867845 - RNA, 12 nt, Homo sapiens
aaaauacaugau

SEQ ID NO: 867846 - RNA, 11 nt, Homo sapiens
aaaauuugcac

SEQ ID NO: 867847 - RNA, 15 nt, Homo sapiens
aaacaaagaguagaa

SEQ ID NO: 867848 - RNA, 13 nt, Homo sapiens
aaacauugccuua

SEQ ID NO: 867849 - RNA, 14 nt, Homo sapiens
aaacauuuuacaga

SEQ ID NO: 867850 - RNA, 17 nt, Homo sapiens
aaacauuuuacagauuu

SEQ ID NO: 867851 - RNA, 23 nt, Homo sapiens
aaaccaauuuguucugugcaaca

SEQ ID NO: 867852 - RNA, 21 nt, Homo sapiens
aaacugugagauaaauaucau

SEQ ID NO: 867853 - RNA, 22 nt, Homo sapiens
aaacuuuccaugacaguagcau

SEQ ID NO: 867854 - RNA, 22 nt, Homo sapiens
aaagacaaaugggccugccaaa

SEQ ID NO: 867855 - RNA, 22 nt, Homo sapiens
aaagcaugcucaguauugagac

SEQ ID NO: 867856 - RNA, 19 nt, Homo sapiens
aaagccuugugaucacuuu

SEQ ID NO: 867857 - RNA, 14 nt, Homo sapiens
aaagguauuuucac

SEQ ID NO: 867858 - RNA, 18 nt, Homo sapiens
aaaguaauaaauuccaau

SEQ ID NO: 867859 - RNA, 17 nt, Homo sapiens
aaauaaaaauagcuaua

SEQ ID NO: 867860 - RNA, 14 nt, Homo sapiens
aaauaggauuugca

SEQ ID NO: 867861 - RNA, 16 nt, Homo sapiens
aaauauaaacugugag

SEQ ID NO: 867862 - RNA, 18 nt, Homo sapiens
aaauauaaacugugagau

SEQ ID NO: 867863 - RNA, 19 nt, Homo sapiens
aaauauaaacugugagaua

SEQ ID NO: 867864 - RNA, 12 nt, Homo sapiens
aaaucagcauuu

SEQ ID NO: 867865 - RNA, 13 nt, Homo sapiens
aaaucagugcagu

SEQ ID NO: 867866 - RNA, 22 nt, Homo sapiens
accuccuccuccaguucugaug

SEQ ID NO: 867867 - RNA, 18 nt, Homo sapiens
accugcuuugagauuucc

SEQ ID NO: 867868 - RNA, 23 nt, Homo sapiens
accuuuugggaaaugcugauuua

SEQ ID NO: 867869 - RNA, 17 nt, Homo sapiens
acgauaugcaaguucau

SEQ ID NO: 867870 - RNA, 15 nt, Homo sapiens
acgugaacuaagauu

SEQ ID NO: 867871 - RNA, 12 nt, Homo sapiens
acgugugaggau

SEQ ID NO: 867872 - RNA, 17 nt, Homo sapiens
acuaaugaaauuuacag

SEQ ID NO: 867873 - RNA, 18 nt, Homo sapiens
acuagcccucuuucucuc

SEQ ID NO: 867874 - RNA, 20 nt, Homo sapiens
acuauguuuagugugauugu

SEQ ID NO: 867875 - RNA, 17 nt, Homo sapiens
acucaggcagugcagua

SEQ ID NO: 867876 - RNA, 21 nt, Homo sapiens
acucaguaaaucagugcagua

SEQ ID NO: 867877 - RNA, 22 nt, Homo sapiens
acucaguaacacagugcaguac

SEQ ID NO: 867878 - RNA, 19 nt, Homo sapiens
acucaguaacagugcagua

SEQ ID NO: 867879 - RNA, 21 nt, Homo sapiens
acucaguaaggcagugcagua

SEQ ID NO: 867880 - RNA, 14 nt, Homo sapiens
acucuaaaacuauc

SEQ ID NO: 867881 - RNA, 15 nt, Homo sapiens
acucugaguccucau

SEQ ID NO: 867882 - RNA, 17 nt, Homo sapiens
acugaagcagagucaag

SEQ ID NO: 867883 - RNA, 18 nt, Homo sapiens
acugaguuagaauguuga

SEQ ID NO: 867884 - RNA, 13 nt, Homo sapiens
acugaugagacaa

SEQ ID NO: 867885 - RNA, 21 nt, Homo sapiens
acuggagguacaaauaauuua

SEQ ID NO: 867886 - RNA, 15 nt, Homo sapiens
acugugacauuccac

SEQ ID NO: 867887 - RNA, 17 nt, Homo sapiens
acugugacauuccacag

SEQ ID NO: 867888 - RNA, 16 nt, Homo sapiens
acuguuuuguuuguua

SEQ ID NO: 867889 - RNA, 21 nt, Homo sapiens
acuuaaacaaaaacuuuccau

SEQ ID NO: 867890 - RNA, 20 nt, Homo sapiens
acuuuggcugugaugucaca

SEQ ID NO: 867891 - RNA, 21 nt, Homo sapiens
agaaaauucuaccuggcuaca

SEQ ID NO: 867892 - RNA, 19 nt, Homo sapiens
agaacagggaugcuaucuc

SEQ ID NO: 867893 - RNA, 20 nt, Homo sapiens
agaauaaagccuugugauca

SEQ ID NO: 867894 - RNA, 16 nt, Homo sapiens
agaauauauugccaaa

SEQ ID NO: 867895 - RNA, 14 nt, Homo sapiens
agacaccuagacuc

SEQ ID NO: 867896 - RNA, 17 nt, Homo sapiens
agacucacgcugacugc

SEQ ID NO: 867897 - RNA, 19 nt, Homo sapiens
agagcaaucuugcugugaa

SEQ ID NO: 867898 - RNA, 23 nt, Homo sapiens
agagcaaucuugcugugaaacag

SEQ ID NO: 867899 - RNA, 14 nt, Homo sapiens
agagcuaugcacac

SEQ ID NO: 867900 - RNA, 20 nt, Homo sapiens
agaggaaaaaggcuucucca

SEQ ID NO: 867901 - RNA, 13 nt, Homo sapiens
agaguauggauug

SEQ ID NO: 867902 - RNA, 17 nt, Homo sapiens
agagucaagcugaugaa

SEQ ID NO: 867903 - RNA, 22 nt, Homo sapiens
agaguuauuuuguguccuuuaa

SEQ ID NO: 867904 - RNA, 18 nt, Homo sapiens
agaucuuggcccuguuaa

SEQ ID NO: 867905 - RNA, 16 nt, Homo sapiens
agaugugccuagacac

SEQ ID NO: 867906 - RNA, 13 nt, Homo sapiens
agcaacaacaaca

SEQ ID NO: 867907 - RNA, 13 nt, Homo sapiens
agcaaugugguag

SEQ ID NO: 867908 - RNA, 21 nt, Homo sapiens
agcagaggaaaauaguggcag

SEQ ID NO: 867909 - RNA, 12 nt, Homo sapiens
agcagagucaag

SEQ ID NO: 867910 - RNA, 21 nt, Homo sapiens
agcaggaaagaucccaaguca

SEQ ID NO: 867911 - RNA, 23 nt, Homo sapiens
agccaaguucacaccacugccau

SEQ ID NO: 867912 - RNA, 16 nt, Homo sapiens
agccagaggcucuaau

SEQ ID NO: 867913 - RNA, 18 nt, Homo sapiens
agccagaggcucuaaugu

SEQ ID NO: 867914 - RNA, 14 nt, Homo sapiens
agccaguucugaca

SEQ ID NO: 867915 - RNA, 21 nt, Homo sapiens
agccauuauucucugaugcac

SEQ ID NO: 867916 - RNA, 22 nt, Homo sapiens
agcccacccgccccagagacug

SEQ ID NO: 867917 - RNA, 22 nt, Homo sapiens
agcccucuuucucucugugugg

SEQ ID NO: 867918 - RNA, 17 nt, Homo sapiens
agccugcucccuagcca

SEQ ID NO: 867919 - RNA, 18 nt, Homo sapiens
agccugcucccuagccag

SEQ ID NO: 867920 - RNA, 13 nt, Homo sapiens
agccuugugauca

SEQ ID NO: 867921 - RNA, 18 nt, Homo sapiens
agcugcuguuuuuagacu

SEQ ID NO: 867922 - RNA, 17 nt, Homo sapiens
aggaagcagccuccacu

SEQ ID NO: 867923 - RNA, 21 nt, Homo sapiens
aggcacuuuuuaacauucuca

SEQ ID NO: 867924 - RNA, 11 nt, Homo sapiens
aggcagcacuu

SEQ ID NO: 867925 - RNA, 15 nt, Homo sapiens
aggcauauacuuugu

SEQ ID NO: 867926 - RNA, 15 nt, Homo sapiens
aggcucuaauguaca

SEQ ID NO: 867927 - RNA, 18 nt, Homo sapiens
aggcucuaauguacaaua

SEQ ID NO: 867928 - RNA, 19 nt, Homo sapiens
aggcucuaauguacaauaa

SEQ ID NO: 867929 - RNA, 17 nt, Homo sapiens
aggcuucccacacugcc

SEQ ID NO: 867930 - RNA, 15 nt, Homo sapiens
agguaaacuagcaaa

SEQ ID NO: 867931 - RNA, 15 nt, Homo sapiens
agguaucaaaauguu

SEQ ID NO: 867932 - RNA, 15 nt, Homo sapiens
agguaugaugugcug

SEQ ID NO: 867933 - RNA, 16 nt, Homo sapiens
aggucuugaguuucau

SEQ ID NO: 867934 - RNA, 19 nt, Homo sapiens
agguuucacuguucaugaa

SEQ ID NO: 867935 - RNA, 14 nt, Homo sapiens
aguaaaaacaauuc

SEQ ID NO: 867936 - RNA, 21 nt, Homo sapiens
aguaacacaauacaguacuca

SEQ ID NO: 867937 - RNA, 22 nt, Homo sapiens
aguaacacagggcagcuaguac

SEQ ID NO: 867938 - RNA, 23 nt, Homo sapiens
aguaacagugcaguacucaguaa

SEQ ID NO: 867939 - RNA, 21 nt, Homo sapiens
aguaagacagugcagugcuca

SEQ ID NO: 867940 - RNA, 20 nt, Homo sapiens
aguacucaggcagugcagua

SEQ ID NO: 867941 - RNA, 24 nt, Homo sapiens
aguacucaguaacacagugcagua

SEQ ID NO: 867942 - RNA, 15 nt, Homo sapiens
aguacucaguaauac

SEQ ID NO: 867943 - RNA, 17 nt, Homo sapiens
aguauuguacagcacug

SEQ ID NO: 867944 - RNA, 15 nt, Homo sapiens
agucaaacagugugg

SEQ ID NO: 867945 - RNA, 16 nt, Homo sapiens
aguccacuuuccucuc

SEQ ID NO: 867946 - RNA, 16 nt, Homo sapiens
aguuaggcagugcagu

SEQ ID NO: 867947 - RNA, 20 nt, Homo sapiens
aguugccguggcaacugugg

SEQ ID NO: 867948 - RNA, 14 nt, Homo sapiens
aguuggagugcagu

SEQ ID NO: 867949 - RNA, 21 nt, Homo sapiens
aguuugugaucuguccuucca

SEQ ID NO: 867950 - RNA, 19 nt, Homo sapiens
auaaaagaaagaugcugau

SEQ ID NO: 867951 - RNA, 14 nt, Homo sapiens
auaaagcaaugugg

SEQ ID NO: 867952 - RNA, 15 nt, Homo sapiens
auaaagcaauguggu

SEQ ID NO: 867953 - RNA, 17 nt, Homo sapiens
auaaagcaaugugguag

SEQ ID NO: 867954 - RNA, 23 nt, Homo sapiens
auaaagccuugugaucacuuucu

SEQ ID NO: 867955 - RNA, 15 nt, Homo sapiens
auaaauauuagcaaa

SEQ ID NO: 867956 - RNA, 15 nt, Homo sapiens
auaaggcagugcagu

SEQ ID NO: 867957 - RNA, 20 nt, Homo sapiens
auagagguaaaauuugcaca

SEQ ID NO: 867958 - RNA, 18 nt, Homo sapiens
auagauaccauuuugaaa

SEQ ID NO: 867959 - RNA, 18 nt, Homo sapiens
auagcuccuucaugcuuu

SEQ ID NO: 867960 - RNA, 16 nt, Homo sapiens
auaggcuuagugcuug

SEQ ID NO: 867961 - RNA, 15 nt, Homo sapiens
auaucaaucaguaau

SEQ ID NO: 867962 - RNA, 17 nt, Homo sapiens
auaugaaaacuaaguuc

SEQ ID NO: 867963 - RNA, 22 nt, Homo sapiens
auauucccaugguagacuguga

SEQ ID NO: 867964 - RNA, 12 nt, Homo sapiens
aucaaacagaaa

SEQ ID NO: 867965 - RNA, 17 nt, Homo sapiens
aucacuauugcuuccua

SEQ ID NO: 867966 - RNA, 15 nt, Homo sapiens
aucagaaacaauuuc

SEQ ID NO: 867967 - RNA, 20 nt, Homo sapiens
aucaguaauuaacauaucaa

SEQ ID NO: 867968 - RNA, 11 nt, Homo sapiens
aucagugcagu

SEQ ID NO: 867969 - RNA, 12 nt, Homo sapiens
aucagugcagua

SEQ ID NO: 867970 - RNA, 20 nt, Homo sapiens
aucaguuugcuaacauauuu

SEQ ID NO: 867971 - RNA, 21 nt, Homo sapiens
aucauaggggcauagccaguu

SEQ ID NO: 867972 - RNA, 20 nt, Homo sapiens
aucauuucuugguaugauca

SEQ ID NO: 867973 - RNA, 20 nt, Homo sapiens
auccaugugcugcuguggca

SEQ ID NO: 867974 - RNA, 21 nt, Homo sapiens
auccaugugcugcuguggcau

SEQ ID NO: 867975 - RNA, 13 nt, Homo sapiens
auccuagcacuuu

SEQ ID NO: 867976 - RNA, 22 nt, Homo sapiens
auccuuaaggcauauacuuugu

SEQ ID NO: 867977 - RNA, 21 nt, Homo sapiens
uuaggcaauggugaacuguca

SEQ ID NO: 867978 - RNA, 17 nt, Homo sapiens
uuauaucagacugcuuu

SEQ ID NO: 867979 - RNA, 17 nt, Homo sapiens
uuaucaguacaauucuu

SEQ ID NO: 867980 - RNA, 21 nt, Homo sapiens
uuauucaauaacuauugcugc

SEQ ID NO: 867981 - RNA, 14 nt, Homo sapiens
uuauugauacaaca

SEQ ID NO: 867982 - RNA, 19 nt, Homo sapiens
uuauugcuggaaucuacua

SEQ ID NO: 867983 - RNA, 16 nt, Homo sapiens
uucagaaacaaagcau

SEQ ID NO: 867984 - RNA, 17 nt, Homo sapiens
uucagagcaagcacugg

SEQ ID NO: 867985 - RNA, 12 nt, Homo sapiens
uucauacuuugg

SEQ ID NO: 867986 - RNA, 22 nt, Homo sapiens
uucauccaacgugaagauacca

SEQ ID NO: 867987 - RNA, 18 nt, Homo sapiens
uucaucugaggaguccaa

SEQ ID NO: 867988 - RNA, 21 nt, Homo sapiens
uuccaaagguuucaacuguaa

SEQ ID NO: 867989 - RNA, 20 nt, Homo sapiens
uuccagcuaagccugaugau

SEQ ID NO: 867990 - RNA, 16 nt, Homo sapiens
uuccagggaaccagag

SEQ ID NO: 867991 - RNA, 18 nt, Homo sapiens
uuccaugucugaaguuug

SEQ ID NO: 867992 - RNA, 15 nt, Homo sapiens
uucccuucaaugcaa

SEQ ID NO: 867993 - RNA, 14 nt, Homo sapiens
uuccguucaucuga

SEQ ID NO: 867994 - RNA, 18 nt, Homo sapiens
uuccucuuucacuucuua

SEQ ID NO: 867995 - RNA, 16 nt, Homo sapiens
uucuaauccaugugcu

SEQ ID NO: 867996 - RNA, 12 nt, Homo sapiens
uucucucugugu

SEQ ID NO: 867997 - RNA, 23 nt, Homo sapiens
uucucucuguguggcaaacauuu

SEQ ID NO: 867998 - RNA, 15 nt, Homo sapiens
uucugaaauucacaa

SEQ ID NO: 867999 - RNA, 13 nt, Homo sapiens
uucugaguagcau

SEQ ID NO: 868000 - RNA, 15 nt, Homo sapiens
uugaaaccuuaguac

SEQ ID NO: 868001 - RNA, 13 nt, Homo sapiens
uugaagaacucau

SEQ ID NO: 868002 - RNA, 17 nt, Homo sapiens
uugaauauaauggccuc

SEQ ID NO: 868003 - RNA, 12 nt, Homo sapiens
uugauacaacag

SEQ ID NO: 868004 - RNA, 14 nt, Homo sapiens
uugauagcacacau

SEQ ID NO: 868005 - RNA, 14 nt, Homo sapiens
uugcugaauaacaa

SEQ ID NO: 868006 - RNA, 19 nt, Homo sapiens
uuggacuggagguacaaau

SEQ ID NO: 868007 - RNA, 13 nt, Homo sapiens
uuggagugcagug

SEQ ID NO: 868008 - RNA, 23 nt, Homo sapiens
uuguaaaacugugacauuccaca

SEQ ID NO: 868009 - RNA, 21 nt, Homo sapiens
uuuaaauaaaaaaguuuacag

SEQ ID NO: 868010 - RNA, 13 nt, Homo sapiens
uuuacuaacacug

SEQ ID NO: 868011 - RNA, 20 nt, Homo sapiens
uuuagaaucaagucugugaa

SEQ ID NO: 868012 - RNA, 11 nt, Homo sapiens
uuuaugcauuu

SEQ ID NO: 868013 - RNA, 14 nt, Homo sapiens
uuuauuggcaauac

SEQ ID NO: 868014 - RNA, 13 nt, Homo sapiens
uuucaaauugccu

SEQ ID NO: 868015 - RNA, 23 nt, Homo sapiens
uuucaaguggaaaccuugcugcu

SEQ ID NO: 868016 - RNA, 21 nt, Homo sapiens
uuucagaaacaaagcauuuga

SEQ ID NO: 868017 - RNA, 23 nt, Homo sapiens
uuucagaaacaaagcauuugacu

SEQ ID NO: 868018 - RNA, 23 nt, Homo sapiens
caaaguuaaacgugaugugcuca

SEQ ID NO: 868019 - RNA, 15 nt, Homo sapiens
caacaggauuuucaa

SEQ ID NO: 868020 - RNA, 17 nt, Homo sapiens
caagcacuggacuacaa

SEQ ID NO: 868021 - RNA, 17 nt, Homo sapiens
caagcccagccuaucuc

SEQ ID NO: 868022 - RNA, 20 nt, Homo sapiens
caagugugugugcaauguuc

SEQ ID NO: 868023 - RNA, 20 nt, Homo sapiens
caaguuuaaaggcuguguca

SEQ ID NO: 868024 - RNA, 14 nt, Homo sapiens
caauaaagcaaugu

SEQ ID NO: 868025 - RNA, 16 nt, Homo sapiens
caauaaggcagugcag

SEQ ID NO: 868026 - RNA, 17 nt, Homo sapiens
caauaaggcagugcagu

SEQ ID NO: 868027 - RNA, 18 nt, Homo sapiens
caauaaggcagugcagug

SEQ ID NO: 868028 - RNA, 13 nt, Homo sapiens
caauacaguacuc

SEQ ID NO: 868029 - RNA, 23 nt, Homo sapiens
caauacucagugcgguacucagu

SEQ ID NO: 868030 - RNA, 14 nt, Homo sapiens
caaucuugcuguga

SEQ ID NO: 868031 - RNA, 18 nt, Homo sapiens
caaugccaggcagugcag

SEQ ID NO: 868032 - RNA, 19 nt, Homo sapiens
caauguuccguucaucuga

SEQ ID NO: 868033 - RNA, 16 nt, Homo sapiens
caauucuuuguugcuu

SEQ ID NO: 868034 - RNA, 12 nt, Homo sapiens
cacacaacugug

SEQ ID NO: 868035 - RNA, 14 nt, Homo sapiens
cacagggacacagu

SEQ ID NO: 868036 - RNA, 22 nt, Homo sapiens
cacagucuggugcccagacuca

SEQ ID NO: 868037 - RNA, 13 nt, Homo sapiens
cacagugcaguac

SEQ ID NO: 868038 - RNA, 20 nt, Homo sapiens
cacaucagcccuguguauaa

SEQ ID NO: 868039 - RNA, 17 nt, Homo sapiens
cacauguugcuaaugac

SEQ ID NO: 868040 - RNA, 21 nt, Homo sapiens
cacauucccaugaauaucaag

SEQ ID NO: 868041 - RNA, 17 nt, Homo sapiens
caccuuguacagaacca

SEQ ID NO: 868042 - RNA, 19 nt, Homo sapiens
cacugucaagauuaaguua

SEQ ID NO: 868043 - RNA, 15 nt, Homo sapiens
cacuuauuuccaugg

SEQ ID NO: 868044 - RNA, 16 nt, Homo sapiens
cacuuucugaaauuca

SEQ ID NO: 868045 - RNA, 18 nt, Homo sapiens
cacuuuuuuccugucaau

SEQ ID NO: 868046 - RNA, 17 nt, Homo sapiens
cagaaauauuugcucaa

SEQ ID NO: 868047 - RNA, 18 nt, Homo sapiens
cagagcaagcacuggacu

SEQ ID NO: 868048 - RNA, 19 nt, Homo sapiens
cagaggcucuaauguacaa

SEQ ID NO: 868049 - RNA, 18 nt, Homo sapiens
cagcaguuugugaucugu

SEQ ID NO: 868050 - RNA, 19 nt, Homo sapiens
cagccccacuccacaguua

SEQ ID NO: 868051 - RNA, 16 nt, Homo sapiens
cagcuaagccugauga

SEQ ID NO: 868052 - RNA, 11 nt, Homo sapiens
cagcuagacac

SEQ ID NO: 868053 - RNA, 18 nt, Homo sapiens
caggaaagaucccaaguc

SEQ ID NO: 868054 - RNA, 19 nt, Homo sapiens
caggauuggccacauugcc

SEQ ID NO: 868055 - RNA, 19 nt, Homo sapiens
caggauuuucaaguuauuc

SEQ ID NO: 868056 - RNA, 15 nt, Homo sapiens
caggcagacacagcu

SEQ ID NO: 868057 - RNA, 12 nt, Homo sapiens
caggcagugcag

SEQ ID NO: 868058 - RNA, 14 nt, Homo sapiens
caggcagugcagua

SEQ ID NO: 868059 - RNA, 17 nt, Homo sapiens
caguaaaucagugcagu

SEQ ID NO: 868060 - RNA, 22 nt, Homo sapiens
caguaacacaauacaguacuca

SEQ ID NO: 868061 - RNA, 16 nt, Homo sapiens
caguaacacagugcag

SEQ ID NO: 868062 - RNA, 13 nt, Homo sapiens
caguaacagugca

SEQ ID NO: 868063 - RNA, 16 nt, Homo sapiens
caguaacagugcagua

SEQ ID NO: 868064 - RNA, 20 nt, Homo sapiens
caguaacagugcaguacuca

SEQ ID NO: 868065 - RNA, 20 nt, Homo sapiens
caguaacaguguaguacuca

SEQ ID NO: 868066 - RNA, 17 nt, Homo sapiens
caguaagacagugcagu

SEQ ID NO: 868067 - RNA, 18 nt, Homo sapiens
caguaagacagugcagug

SEQ ID NO: 868068 - RNA, 22 nt, Homo sapiens
caguaagacagugcagugcuca

SEQ ID NO: 868069 - RNA, 17 nt, Homo sapiens
caguaaggcagugcaau

SEQ ID NO: 868070 - RNA, 16 nt, Homo sapiens
caguaaggcagugcag

SEQ ID NO: 868071 - RNA, 22 nt, Homo sapiens
caguaaggcagugcaguacuca

SEQ ID NO: 868072 - RNA, 15 nt, Homo sapiens
caguaauacaguaca

SEQ ID NO: 868073 - RNA, 22 nt, Homo sapiens
caguaauacaguacaguacuca

SEQ ID NO: 868074 - RNA, 17 nt, Homo sapiens
caguaauuaacauauca

SEQ ID NO: 868075 - RNA, 19 nt, Homo sapiens
caguacucaggcagugcag

SEQ ID NO: 868076 - RNA, 23 nt, Homo sapiens
caguacucaguaacagugcagua

SEQ ID NO: 868077 - RNA, 15 nt, Homo sapiens
caguacucaguaaua

SEQ ID NO: 868078 - RNA, 16 nt, Homo sapiens
caguauugaguguucu

SEQ ID NO: 868079 - RNA, 19 nt, Homo sapiens
cagugauagaacaaaagag

SEQ ID NO: 868080 - RNA, 13 nt, Homo sapiens
cagugcaguacuc

SEQ ID NO: 868081 - RNA, 18 nt, Homo sapiens
caguggauuuuuuuuuaa

SEQ ID NO: 868082 - RNA, 20 nt, Homo sapiens
caguguacucugaguccuca

SEQ ID NO: 868083 - RNA, 22 nt, Homo sapiens
caguuagcccggccaaggacac

SEQ ID NO: 868084 - RNA, 14 nt, Homo sapiens
cauaaaucuuccaa

SEQ ID NO: 868085 - RNA, 17 nt, Homo sapiens
cugcuguggcaucagga

SEQ ID NO: 868086 - RNA, 18 nt, Homo sapiens
cuggcagcgccucccgcc

SEQ ID NO: 868087 - RNA, 22 nt, Homo sapiens
cuggccuauuuuggacguguga

SEQ ID NO: 868088 - RNA, 17 nt, Homo sapiens
cuguaaaauacuucuuu

SEQ ID NO: 868089 - RNA, 16 nt, Homo sapiens
cugucuccucugucag

SEQ ID NO: 868090 - RNA, 18 nt, Homo sapiens
cugugcaacaaacucaaa

SEQ ID NO: 868091 - RNA, 12 nt, Homo sapiens
cuguuccaagug

SEQ ID NO: 868092 - RNA, 22 nt, Homo sapiens
cuuaaguacugaaauacauaug

SEQ ID NO: 868093 - RNA, 20 nt, Homo sapiens
cuuaaucuagagcuaugcac

SEQ ID NO: 868094 - RNA, 20 nt, Homo sapiens
cuucaacaugguuaccucug

SEQ ID NO: 868095 - RNA, 17 nt, Homo sapiens
cuucaaugcaaaauaca

SEQ ID NO: 868096 - RNA, 22 nt, Homo sapiens
cuucaugcgcaguccccaggua

SEQ ID NO: 868097 - RNA, 18 nt, Homo sapiens
cuucuaguggguuuaaug

SEQ ID NO: 868098 - RNA, 18 nt, Homo sapiens
cuucuccccuccaaguga

SEQ ID NO: 868099 - RNA, 17 nt, Homo sapiens
cuucuuuccucuuaaug

SEQ ID NO: 868100 - RNA, 18 nt, Homo sapiens
cuugaccuggagccaucu

SEQ ID NO: 868101 - RNA, 22 nt, Homo sapiens
cuugaggccaaaugaguucccu

SEQ ID NO: 868102 - RNA, 13 nt, Homo sapiens
cuugccaugcuaa

SEQ ID NO: 868103 - RNA, 12 nt, Homo sapiens
cuugcugugaaa

SEQ ID NO: 868104 - RNA, 18 nt, Homo sapiens
cuuguaaaacugugacau

SEQ ID NO: 868105 - RNA, 21 nt, Homo sapiens
cuuuccucuuaaugucucaaa

SEQ ID NO: 868106 - RNA, 15 nt, Homo sapiens
cuuucugauacuuau

SEQ ID NO: 868107 - RNA, 20 nt, Homo sapiens
cuuugcaaugcaagcccuuu

SEQ ID NO: 868108 - RNA, 19 nt, Homo sapiens
cuuugggaggcugagaugg

SEQ ID NO: 868109 - RNA, 19 nt, Homo sapiens
cuuuguaccuguaggucua

SEQ ID NO: 868110 - RNA, 16 nt, Homo sapiens
cuuuuuuccugucaau

SEQ ID NO: 868111 - RNA, 13 nt, Homo sapiens
gaaaaaggcuucu

SEQ ID NO: 868112 - RNA, 18 nt, Homo sapiens
gaaaaauaguguguccau

SEQ ID NO: 868113 - RNA, 17 nt, Homo sapiens
gaaaacuaaguucucua

SEQ ID NO: 868114 - RNA, 22 nt, Homo sapiens
gaaaaggcuugagucuggauaa

SEQ ID NO: 868115 - RNA, 16 nt, Homo sapiens
gaaaauaggauuugca

SEQ ID NO: 868116 - RNA, 17 nt, Homo sapiens
gaaacaauuucuguguc

SEQ ID NO: 868117 - RNA, 14 nt, Homo sapiens
gaaaccccugacac

SEQ ID NO: 868118 - RNA, 19 nt, Homo sapiens
gaaacugacuugcugugac

SEQ ID NO: 868119 - RNA, 15 nt, Homo sapiens
gaaagcagugcagua

SEQ ID NO: 868120 - RNA, 21 nt, Homo sapiens
gaaaugcugauuuaaacuucu

SEQ ID NO: 868121 - RNA, 14 nt, Homo sapiens
gaaauucacaaagu

SEQ ID NO: 868122 - RNA, 16 nt, Homo sapiens
gaaauucacaaaguua

SEQ ID NO: 868123 - RNA, 14 nt, Homo sapiens
gaacucaugugauu

SEQ ID NO: 868124 - RNA, 17 nt, Homo sapiens
gaacugaagcagaguca

SEQ ID NO: 868125 - RNA, 12 nt, Homo sapiens
gaagcagcagcu

SEQ ID NO: 868126 - RNA, 16 nt, Homo sapiens
gaagcagccuccacuu

SEQ ID NO: 868127 - RNA, 14 nt, Homo sapiens
gaagcccacccgcc

SEQ ID NO: 868128 - RNA, 21 nt, Homo sapiens
gaaggcagcuagacaccaaug

SEQ ID NO: 868129 - RNA, 15 nt, Homo sapiens
gccuuuuccuaugua

SEQ ID NO: 868130 - RNA, 22 nt, Homo sapiens
gcgugggaguauguuauuucuc

SEQ ID NO: 868131 - RNA, 23 nt, Homo sapiens
gcuacacguuggaguauaccuau

SEQ ID NO: 868132 - RNA, 17 nt, Homo sapiens
gcuaguacucaguacua

SEQ ID NO: 868133 - RNA, 21 nt, Homo sapiens
gcucaguaacacagugcagug

SEQ ID NO: 868134 - RNA, 21 nt, Homo sapiens
gcucaguaaggcagugcaaua

SEQ ID NO: 868135 - RNA, 20 nt, Homo sapiens
gcucccuagccagaggcucu

SEQ ID NO: 868136 - RNA, 12 nt, Homo sapiens
gcucgggacugu

SEQ ID NO: 868137 - RNA, 23 nt, Homo sapiens
gcucuaauguacaauaaagcaau

SEQ ID NO: 868138 - RNA, 18 nt, Homo sapiens
gcuucuacuccaugguga

SEQ ID NO: 868139 - RNA, 17 nt, Homo sapiens
gcuuuacucugaauuuc

SEQ ID NO: 868140 - RNA, 14 nt, Homo sapiens
gcuuugccacugaa

SEQ ID NO: 868141 - RNA, 23 nt, Homo sapiens
ggaaaauguucugacagcauuuc

SEQ ID NO: 868142 - RNA, 15 nt, Homo sapiens
ggaaagcagugcagu

SEQ ID NO: 868143 - RNA, 11 nt, Homo sapiens
ggaagaagcaa

SEQ ID NO: 868144 - RNA, 19 nt, Homo sapiens
ggaagcuucuugcugccag

SEQ ID NO: 868145 - RNA, 12 nt, Homo sapiens
ggaaugcucaau

SEQ ID NO: 868146 - RNA, 14 nt, Homo sapiens
ggcccgccaccuug

SEQ ID NO: 868147 - RNA, 17 nt, Homo sapiens
ggcucuaauguacaaua

SEQ ID NO: 868148 - RNA, 21 nt, Homo sapiens
ggcucuaauguacaauaaagc

SEQ ID NO: 868149 - RNA, 11 nt, Homo sapiens
gggaaccagag

SEQ ID NO: 868150 - RNA, 19 nt, Homo sapiens
gggccgccuccuccagacu

SEQ ID NO: 868151 - RNA, 20 nt, Homo sapiens
gggcugagccccuccucucc

SEQ ID NO: 868152 - RNA, 14 nt, Homo sapiens
gguagacugugaca

SEQ ID NO: 868153 - RNA, 17 nt, Homo sapiens
gguccuuugagugucag

SEQ ID NO: 868154 - RNA, 15 nt, Homo sapiens
guaaaacugugacau

SEQ ID NO: 868155 - RNA, 12 nt, Homo sapiens
guaaacaguuug

SEQ ID NO: 868156 - RNA, 22 nt, Homo sapiens
guaaacaguuugaaaagacaaa

SEQ ID NO: 868157 - RNA, 15 nt, Homo sapiens
guaaaucagugcagu

SEQ ID NO: 868158 - RNA, 15 nt, Homo sapiens
guaaaugagccuuuc

SEQ ID NO: 868159 - RNA, 19 nt, Homo sapiens
guaaaugagccuuucugcc

SEQ ID NO: 868160 - RNA, 16 nt, Homo sapiens
guaacacagugcagua

SEQ ID NO: 868161 - RNA, 20 nt, Homo sapiens
guaacacagugcaguacuca

SEQ ID NO: 868162 - RNA, 18 nt, Homo sapiens
guaacagugcaguacuca

SEQ ID NO: 868163 - RNA, 15 nt, Homo sapiens
guaacucacuuuaaa

SEQ ID NO: 868164 - RNA, 16 nt, Homo sapiens
guaagacagugcagug

SEQ ID NO: 868165 - RNA, 15 nt, Homo sapiens
guaaggcagugcagu

SEQ ID NO: 868166 - RNA, 19 nt, Homo sapiens
guaauacaguacaguacuc

SEQ ID NO: 868167 - RNA, 16 nt, Homo sapiens
guacaauaaagcaaug

SEQ ID NO: 868168 - RNA, 17 nt, Homo sapiens
guacaauaaagcaaugu

SEQ ID NO: 868169 - RNA, 12 nt, Homo sapiens
guacaguacuca

SEQ ID NO: 868170 - RNA, 22 nt, Homo sapiens
guacucaguaaaucagugcagu

SEQ ID NO: 868171 - RNA, 20 nt, Homo sapiens
guacucaguaacagugcagu

SEQ ID NO: 868172 - RNA, 20 nt, Homo sapiens
guacucaguaagacagugca

SEQ ID NO: 868173 - RNA, 22 nt, Homo sapiens
guacuuacccuucuacaaaaga

SEQ ID NO: 868174 - RNA, 23 nt, Homo sapiens
guaugccucauuuuauucuguca

SEQ ID NO: 868175 - RNA, 18 nt, Homo sapiens
guauucaguaaggcagug

SEQ ID NO: 868176 - RNA, 19 nt, Homo sapiens
gucacuuuuuuccugucaa

SEQ ID NO: 868177 - RNA, 20 nt, Homo sapiens
guccccagccugcucccuag

SEQ ID NO: 868178 - RNA, 15 nt, Homo sapiens
guccucauuguucag

SEQ ID NO: 868179 - RNA, 23 nt, Homo sapiens
gucugcacacauaacacacauca

SEQ ID NO: 868180 - RNA, 15 nt, Homo sapiens
gucuguccuuuccca

SEQ ID NO: 868181 - RNA, 22 nt, Homo sapiens
gucuucaacaugguuaccucug

SEQ ID NO: 868182 - RNA, 20 nt, Homo sapiens
gugaaagucuccuguaucau

SEQ ID NO: 868183 - RNA, 16 nt, Homo sapiens
gugcagcuuuccaguu

SEQ ID NO: 868184 - RNA, 12 nt, Homo sapiens
gugcaguacuca

SEQ ID NO: 868185 - RNA, 22 nt, Homo sapiens
gugcucaauaaggcagugcagu

SEQ ID NO: 868186 - RNA, 14 nt, Homo sapiens
gugguuuguuauca

SEQ ID NO: 868187 - RNA, 16 nt, Homo sapiens
gugucuuuuguucucu

SEQ ID NO: 868188 - RNA, 20 nt, Homo sapiens
guuaauaaagugcacugcca

SEQ ID NO: 868189 - RNA, 16 nt, Homo sapiens
guuaggcagugcagua

SEQ ID NO: 868190 - RNA, 20 nt, Homo sapiens
guucauacuuuggcugugau

SEQ ID NO: 868191 - RNA, 11 nt, Homo sapiens
guuccaagugu

SEQ ID NO: 868192 - RNA, 18 nt, Homo sapiens
guuccucauggcuguuau

SEQ ID NO: 868193 - RNA, 22 nt, Homo sapiens
guuccucuagguaaacuagcaa

SEQ ID NO: 868194 - RNA, 13 nt, Homo sapiens
guuggagugcagu

SEQ ID NO: 868195 - RNA, 15 nt, Homo sapiens
guuguccugugucau

SEQ ID NO: 868196 - RNA, 15 nt, Homo sapiens
guuuaauguuuaguc

SEQ ID NO: 868197 - RNA, 22 nt, Homo sapiens
guuucaacuguaaaauacuucu

SEQ ID NO: 868198 - RNA, 14 nt, Homo sapiens
uaaaaaaguuuaca

SEQ ID NO: 868199 - RNA, 20 nt, Homo sapiens
ccuuuaauaggcuuguguaa

SEQ ID NO: 868200 - RNA, 15 nt, Homo sapiens
ccuuugcaaugcaag

SEQ ID NO: 868201 - RNA, 21 nt, Homo sapiens
cgcaaggaucacuugagccca

SEQ ID NO: 868202 - RNA, 16 nt, Homo sapiens
cgcugccugcucugcg

SEQ ID NO: 868203 - RNA, 15 nt, Homo sapiens
cggaccugcuuugag

SEQ ID NO: 868204 - RNA, 14 nt, Homo sapiens
cguccguccgcccg

SEQ ID NO: 868205 - RNA, 11 nt, Homo sapiens
cuaacacuggc

SEQ ID NO: 868206 - RNA, 12 nt, Homo sapiens
cuaacagcauaa

SEQ ID NO: 868207 - RNA, 21 nt, Homo sapiens
cuaagauaauuaaaugaaaua

SEQ ID NO: 868208 - RNA, 19 nt, Homo sapiens
cuaauguacaauaaagcaa

SEQ ID NO: 868209 - RNA, 21 nt, Homo sapiens
cuaauguacaauaaagcaaug

SEQ ID NO: 868210 - RNA, 19 nt, Homo sapiens
cuacauauuuuaauaauaa

SEQ ID NO: 868211 - RNA, 16 nt, Homo sapiens
cuacuuaaacaaaaac

SEQ ID NO: 868212 - RNA, 16 nt, Homo sapiens
cuagccagaggcucua

SEQ ID NO: 868213 - RNA, 13 nt, Homo sapiens
cuagcuaaaugac

SEQ ID NO: 868214 - RNA, 23 nt, Homo sapiens
cuaguccccagccugcucccuag

SEQ ID NO: 868215 - RNA, 23 nt, Homo sapiens
cuaguugccguggcaacugugga

SEQ ID NO: 868216 - RNA, 13 nt, Homo sapiens
cuaucaguaauag

SEQ ID NO: 868217 - RNA, 15 nt, Homo sapiens
cuaucuuaggaguaa

SEQ ID NO: 868218 - RNA, 20 nt, Homo sapiens
cucaaaaugugccgucuuug

SEQ ID NO: 868219 - RNA, 20 nt, Homo sapiens
cucaaggcugcagugagcca

SEQ ID NO: 868220 - RNA, 14 nt, Homo sapiens
cucacccagccugg

SEQ ID NO: 868221 - RNA, 17 nt, Homo sapiens
cucaguaacacagugca

SEQ ID NO: 868222 - RNA, 19 nt, Homo sapiens
cucaguaacacagugcagu

SEQ ID NO: 868223 - RNA, 17 nt, Homo sapiens
cucaguaacagugcagu

SEQ ID NO: 868224 - RNA, 18 nt, Homo sapiens
cucaguaacagugcagua

SEQ ID NO: 868225 - RNA, 19 nt, Homo sapiens
cucaguaaggcagugcagu

SEQ ID NO: 868226 - RNA, 21 nt, Homo sapiens
cucaguaaggcagugcaguac

SEQ ID NO: 868227 - RNA, 19 nt, Homo sapiens
cucaguuaggcagugcagu

SEQ ID NO: 868228 - RNA, 20 nt, Homo sapiens
cucaguuaggcagugcagua

SEQ ID NO: 868229 - RNA, 21 nt, Homo sapiens
cucaguuaggcagugcaguac

SEQ ID NO: 868230 - RNA, 16 nt, Homo sapiens
cucauuguucagaaaa

SEQ ID NO: 868231 - RNA, 16 nt, Homo sapiens
cuccaguucugaugag

SEQ ID NO: 868232 - RNA, 20 nt, Homo sapiens
cuccugucuccucugucagu

SEQ ID NO: 868233 - RNA, 16 nt, Homo sapiens
cuccuugaggucuuga

SEQ ID NO: 868234 - RNA, 22 nt, Homo sapiens
cucuaauguacaauaaagcaau

SEQ ID NO: 868235 - RNA, 13 nt, Homo sapiens
cucuagacaucua

SEQ ID NO: 868236 - RNA, 15 nt, Homo sapiens
cucucuugacaucaa

SEQ ID NO: 868237 - RNA, 18 nt, Homo sapiens
cucuuaaugucucaaaau

SEQ ID NO: 868238 - RNA, 13 nt, Homo sapiens
cucuucuacuucu

SEQ ID NO: 868239 - RNA, 23 nt, Homo sapiens
cucuuuuuaaagaaaaaugcuaa

SEQ ID NO: 868240 - RNA, 15 nt, Homo sapiens
cugaaauacauauga

SEQ ID NO: 868241 - RNA, 12 nt, Homo sapiens
cugaaccagaga

SEQ ID NO: 868242 - RNA, 16 nt, Homo sapiens
cugaacugcaacacug

SEQ ID NO: 868243 - RNA, 15 nt, Homo sapiens
cugaagcagagucaa

SEQ ID NO: 868244 - RNA, 16 nt, Homo sapiens
cugacaccaugugcaa

SEQ ID NO: 868245 - RNA, 13 nt, Homo sapiens
caucugcauuucu

SEQ ID NO: 868246 - RNA, 22 nt, Homo sapiens
caucugucagcuucccaacaau

SEQ ID NO: 868247 - RNA, 18 nt, Homo sapiens
caucugucugucccaguu

SEQ ID NO: 868248 - RNA, 24 nt, Homo sapiens
caucuuauuugucaguguagauca

SEQ ID NO: 868249 - RNA, 18 nt, Homo sapiens
caugcagacccucagacc

SEQ ID NO: 868250 - RNA, 14 nt, Homo sapiens
caugguagacugug

SEQ ID NO: 868251 - RNA, 16 nt, Homo sapiens
caugguagacugugac

SEQ ID NO: 868252 - RNA, 17 nt, Homo sapiens
caugguauuaucuagua

SEQ ID NO: 868253 - RNA, 21 nt, Homo sapiens
cauuauucucugaugcacugu

SEQ ID NO: 868254 - RNA, 13 nt, Homo sapiens
cauucccaugaau

SEQ ID NO: 868255 - RNA, 18 nt, Homo sapiens
cauugaugaacugccaaa

SEQ ID NO: 868256 - RNA, 17 nt, Homo sapiens
cauugcacuaaaaguga

SEQ ID NO: 868257 - RNA, 22 nt, Homo sapiens
cauuuaggaaagcagugcagua

SEQ ID NO: 868258 - RNA, 17 nt, Homo sapiens
cauuugacuuucugucu

SEQ ID NO: 868259 - RNA, 21 nt, Homo sapiens
cauuugcugaauaacaacaau

SEQ ID NO: 868260 - RNA, 11 nt, Homo sapiens
cauuugcugca

SEQ ID NO: 868261 - RNA, 19 nt, Homo sapiens
cauuuuucauagauaccau

SEQ ID NO: 868262 - RNA, 19 nt, Homo sapiens
ccaaagguuucaacuguaa

SEQ ID NO: 868263 - RNA, 23 nt, Homo sapiens
ccaaaugaguucccuugauucaa

SEQ ID NO: 868264 - RNA, 15 nt, Homo sapiens
ccaagaguccaagcc

SEQ ID NO: 868265 - RNA, 17 nt, Homo sapiens
ccaagaguuugagacca

SEQ ID NO: 868266 - RNA, 13 nt, Homo sapiens
ccaaggaguggaa

SEQ ID NO: 868267 - RNA, 16 nt, Homo sapiens
ccaagugaaugaguuu

SEQ ID NO: 868268 - RNA, 23 nt, Homo sapiens
ccaagugaaugaguuuccagcua

SEQ ID NO: 868269 - RNA, 17 nt, Homo sapiens
ccaagugugugugcaau

SEQ ID NO: 868270 - RNA, 18 nt, Homo sapiens
ccaagugugugugcaaug

SEQ ID NO: 868271 - RNA, 13 nt, Homo sapiens
ccacuccacaguu

SEQ ID NO: 868272 - RNA, 22 nt, Homo sapiens
ccagaagcucaaggcugcagug

SEQ ID NO: 868273 - RNA, 23 nt, Homo sapiens
ccagaggcucuaauguacaauaa

SEQ ID NO: 868274 - RNA, 16 nt, Homo sapiens
ccagcaaaagugcagu

SEQ ID NO: 868275 - RNA, 17 nt, Homo sapiens
ccaguacauaaggaguu

SEQ ID NO: 868276 - RNA, 23 nt, Homo sapiens
ccauaaaauuagacauaccucuc

SEQ ID NO: 868277 - RNA, 19 nt, Homo sapiens
ccauccuucccgcagcacc

SEQ ID NO: 868278 - RNA, 15 nt, Homo sapiens
ccaugguagacugug

SEQ ID NO: 868279 - RNA, 18 nt, Homo sapiens
ccauuccauauauaucug

SEQ ID NO: 868280 - RNA, 14 nt, Homo sapiens
ccauuuaaucauuu

SEQ ID NO: 868281 - RNA, 23 nt, Homo sapiens
cccaccucccgguguaugcagug

SEQ ID NO: 868282 - RNA, 20 nt, Homo sapiens
cccagaagcucaaggcugca

SEQ ID NO: 868283 - RNA, 13 nt, Homo sapiens
cccagggugcagg

SEQ ID NO: 868284 - RNA, 13 nt, Homo sapiens
cccagguaucuga

SEQ ID NO: 868285 - RNA, 14 nt, Homo sapiens
ccccagccugcucc

SEQ ID NO: 868286 - RNA, 13 nt, Homo sapiens
cccgccccagaga

SEQ ID NO: 868287 - RNA, 16 nt, Homo sapiens
cccgguguaugcagug

SEQ ID NO: 868288 - RNA, 18 nt, Homo sapiens
cccuggggucucugagca

SEQ ID NO: 868289 - RNA, 15 nt, Homo sapiens
cccugugggagucca

SEQ ID NO: 868290 - RNA, 20 nt, Homo sapiens
cccuucaaugcaaaauacau

SEQ ID NO: 868291 - RNA, 11 nt, Homo sapiens
cccuuccccau

SEQ ID NO: 868292 - RNA, 16 nt, Homo sapiens
ccuauugcuguaaaua

SEQ ID NO: 868293 - RNA, 18 nt, Homo sapiens
ccuauuuuggacguguga

SEQ ID NO: 868294 - RNA, 17 nt, Homo sapiens
ccucauccuccacugaa

SEQ ID NO: 868295 - RNA, 19 nt, Homo sapiens
ccuccaagugaaugaguuu

SEQ ID NO: 868296 - RNA, 13 nt, Homo sapiens
ccuccagccacuu

SEQ ID NO: 868297 - RNA, 13 nt, Homo sapiens
ccucccccgcaga

SEQ ID NO: 868298 - RNA, 19 nt, Homo sapiens
ccucuugaaugcuuaaaug

SEQ ID NO: 868299 - RNA, 16 nt, Homo sapiens
ccucuuucacuucuua

SEQ ID NO: 868300 - RNA, 14 nt, Homo sapiens
ccugaaaguaauuu

SEQ ID NO: 868301 - RNA, 17 nt, Homo sapiens
ccugaaucagaggcaga

SEQ ID NO: 868302 - RNA, 16 nt, Homo sapiens
ccugagggaagcccac

SEQ ID NO: 868303 - RNA, 19 nt, Homo sapiens
ccugcacucuuauuucacu

SEQ ID NO: 868304 - RNA, 15 nt, Homo sapiens
ccugcccucccccac

SEQ ID NO: 868305 - RNA, 15 nt, Homo sapiens
ccugucucuacaaaa

SEQ ID NO: 868306 - RNA, 15 nt, Homo sapiens
ccuguuaaggcaucc

SEQ ID NO: 868307 - RNA, 22 nt, Homo sapiens
ccuguuuuuccuuuuguuuaca

SEQ ID NO: 868308 - RNA, 15 nt, Homo sapiens
ccuuaugccauucca

SEQ ID NO: 868309 - RNA, 12 nt, Homo sapiens
ccuucaugcuuu

SEQ ID NO: 868310 - RNA, 12 nt, Homo sapiens
aagcagugcagu

SEQ ID NO: 868311 - RNA, 12 nt, Homo sapiens
aagccugaugau

SEQ ID NO: 868312 - RNA, 23 nt, Homo sapiens
aagcuaaaaugaaaaauagugug

SEQ ID NO: 868313 - RNA, 12 nt, Homo sapiens
aagcuucuugcu

SEQ ID NO: 868314 - RNA, 13 nt, Homo sapiens
aaggaucacuuga

SEQ ID NO: 868315 - RNA, 17 nt, Homo sapiens
aaggcacuaaugauguu

SEQ ID NO: 868316 - RNA, 15 nt, Homo sapiens
aaggcagcuagacac

SEQ ID NO: 868317 - RNA, 12 nt, Homo sapiens
aaggcagugcaa

SEQ ID NO: 868318 - RNA, 18 nt, Homo sapiens
aaggccucauccuccacu

SEQ ID NO: 868319 - RNA, 17 nt, Homo sapiens
aagggaagcuucuugcu

SEQ ID NO: 868320 - RNA, 18 nt, Homo sapiens
aagguuucacuguucaug

SEQ ID NO: 868321 - RNA, 20 nt, Homo sapiens
aagguuucacuguucaugaa

SEQ ID NO: 868322 - RNA, 16 nt, Homo sapiens
aaguaaaugagccuuu

SEQ ID NO: 868323 - RNA, 18 nt, Homo sapiens
aagucaaacaguguggcu

SEQ ID NO: 868324 - RNA, 16 nt, Homo sapiens
aagucuccuguaucau

SEQ ID NO: 868325 - RNA, 15 nt, Homo sapiens
aagugaugugauuua

SEQ ID NO: 868326 - RNA, 16 nt, Homo sapiens
aaguuggagugcagug

SEQ ID NO: 868327 - RNA, 18 nt, Homo sapiens
aaguuugccccagugcua

SEQ ID NO: 868328 - RNA, 21 nt, Homo sapiens
aaguuuuauaaaagacaugaa

SEQ ID NO: 868329 - RNA, 13 nt, Homo sapiens
aauaaaaccagaa

SEQ ID NO: 868330 - RNA, 15 nt, Homo sapiens
aauaaagcaaugugg

SEQ ID NO: 868331 - RNA, 18 nt, Homo sapiens
aauaaagcaaugugguag

SEQ ID NO: 868332 - RNA, 18 nt, Homo sapiens
aauacaugaugauuucag

SEQ ID NO: 868333 - RNA, 18 nt, Homo sapiens
aauacuuugugucuuuug

SEQ ID NO: 868334 - RNA, 11 nt, Homo sapiens
aauaggcuugu

SEQ ID NO: 868335 - RNA, 20 nt, Homo sapiens
aaucaccuaauuaauuucag

SEQ ID NO: 868336 - RNA, 11 nt, Homo sapiens
aaucaguuugc

SEQ ID NO: 868337 - RNA, 15 nt, Homo sapiens
aauccaugugcugcu

SEQ ID NO: 868338 - RNA, 19 nt, Homo sapiens
aauguacaauaaagcaaug

SEQ ID NO: 868339 - RNA, 20 nt, Homo sapiens
aauguacaauaaagcaaugu

SEQ ID NO: 868340 - RNA, 21 nt, Homo sapiens
aauguuccaugucugaaguuu

SEQ ID NO: 868341 - RNA, 18 nt, Homo sapiens
aauguuccguucaucuga

SEQ ID NO: 868342 - RNA, 16 nt, Homo sapiens
aauuaaccauugcuaa

SEQ ID NO: 868343 - RNA, 19 nt, Homo sapiens
aauuagacauaccucucaa

SEQ ID NO: 868344 - RNA, 13 nt, Homo sapiens
aauuauugauaca

SEQ ID NO: 868345 - RNA, 17 nt, Homo sapiens
aauucuaccuggcuaca

SEQ ID NO: 868346 - RNA, 15 nt, Homo sapiens
aauugaccucaaaag

SEQ ID NO: 868347 - RNA, 20 nt, Homo sapiens
aauuggcugccaagagucca

SEQ ID NO: 868348 - RNA, 12 nt, Homo sapiens
aauuucucuuaa

SEQ ID NO: 868349 - RNA, 19 nt, Homo sapiens
acaacaaagcaugcucagu

SEQ ID NO: 868350 - RNA, 22 nt, Homo sapiens
acaacaauuuaggaaugcucaa

SEQ ID NO: 868351 - RNA, 19 nt, Homo sapiens
acaaguuacauacauuuaa

SEQ ID NO: 868352 - RNA, 16 nt, Homo sapiens
acaauaaagcaaugug

SEQ ID NO: 868353 - RNA, 17 nt, Homo sapiens
acaauaaagcaaugugg

SEQ ID NO: 868354 - RNA, 12 nt, Homo sapiens
acacaacugugg

SEQ ID NO: 868355 - RNA, 12 nt, Homo sapiens
acacagugcagu

SEQ ID NO: 868356 - RNA, 13 nt, Homo sapiens
acacagugcagua

SEQ ID NO: 868357 - RNA, 13 nt, Homo sapiens
acaccuagacucu

SEQ ID NO: 868358 - RNA, 18 nt, Homo sapiens
acacuauuuuugauagca

SEQ ID NO: 868359 - RNA, 15 nt, Homo sapiens
acacucaccauuuaa

SEQ ID NO: 868360 - RNA, 21 nt, Homo sapiens
acacucaccauuuaaucauuu

SEQ ID NO: 868361 - RNA, 16 nt, Homo sapiens
acagaaaagaaauuag

SEQ ID NO: 868362 - RNA, 15 nt, Homo sapiens
acagaguuacugcca

SEQ ID NO: 868363 - RNA, 16 nt, Homo sapiens
acagaucaaaugugaa

SEQ ID NO: 868364 - RNA, 21 nt, Homo sapiens
acagauguacauuaaauacca

SEQ ID NO: 868365 - RNA, 16 nt, Homo sapiens
acagggacacagucug

SEQ ID NO: 868366 - RNA, 21 nt, Homo sapiens
acaguagcauacugaugagac

SEQ ID NO: 868367 - RNA, 13 nt, Homo sapiens
acaguaguguucu

SEQ ID NO: 868368 - RNA, 11 nt, Homo sapiens
acagugcagug

SEQ ID NO: 868369 - RNA, 16 nt, Homo sapiens
acagugcagugcucag

SEQ ID NO: 868370 - RNA, 17 nt, Homo sapiens
acaguuggaacaguaau

SEQ ID NO: 868371 - RNA, 22 nt, Homo sapiens
acaucauaaacaaagaguagaa

SEQ ID NO: 868372 - RNA, 19 nt, Homo sapiens
acaucuagucucagugcua

SEQ ID NO: 868373 - RNA, 15 nt, Homo sapiens
acaugguuaccucug

SEQ ID NO: 868374 - RNA, 14 nt, Homo sapiens
acauucccaugaau

SEQ ID NO: 868375 - RNA, 20 nt, Homo sapiens
acauuuuucauagauaccau

SEQ ID NO: 868376 - RNA, 21 nt, Homo sapiens
accauuuugaaauauucacaa

SEQ ID NO: 868377 - RNA, 15 nt, Homo sapiens
acccuggacagugcc

SEQ ID NO: 868378 - RNA, 12 nt, Homo sapiens
accuauugcugu

SEQ ID NO: 868379 - RNA, 16 nt, Homo sapiens
accucucaacuuacau

SEQ ID NO: 868380 - RNA, 23 nt, Homo sapiens
accucucugaacugcaacacugg

SEQ ID NO: 868381 - RNA, 18 nt, Homo sapiens
accucuugaagaacugac

SEQ ID NO: 868382 - RNA, 19 nt, Homo sapiens
accugauacaauuugccca

SEQ ID NO: 868383 - RNA, 17 nt, Homo sapiens
accuggagccaucuucc

SEQ ID NO: 868384 - RNA, 22 nt, Homo sapiens
accuguucacgugacuccucaa

SEQ ID NO: 868385 - RNA, 23 nt, Homo sapiens
accuguucacgugacuccucaau

SEQ ID NO: 868386 - RNA, 22 nt, Homo sapiens
acggaccugcuuugagauuucc

SEQ ID NO: 868387 - RNA, 16 nt, Homo sapiens
acggccgucccugacu

SEQ ID NO: 868388 - RNA, 16 nt, Homo sapiens
acuaaaagugauguga

SEQ ID NO: 868389 - RNA, 13 nt, Homo sapiens
acuaacacuggcu

SEQ ID NO: 868390 - RNA, 23 nt, Homo sapiens
acuaagauuuccuuuggcaauau

SEQ ID NO: 868391 - RNA, 16 nt, Homo sapiens
acuaaugucagcacau

SEQ ID NO: 868392 - RNA, 21 nt, Homo sapiens
acuaccuuuggcuuaauucca

SEQ ID NO: 868393 - RNA, 16 nt, Homo sapiens
acuacgacuggcaucu

SEQ ID NO: 868394 - RNA, 22 nt, Homo sapiens
acuagaaccuucuaauccaugu

SEQ ID NO: 868395 - RNA, 23 nt, Homo sapiens
acuagauaucaaucaguaauuaa

SEQ ID NO: 868396 - RNA, 21 nt, Homo sapiens
acuauuuuugauagcacacau

SEQ ID NO: 868397 - RNA, 18 nt, Homo sapiens
acucacaugccuucuaaa

SEQ ID NO: 868398 - RNA, 16 nt, Homo sapiens
acucaggcagugcagu

SEQ ID NO: 868399 - RNA, 21 nt, Homo sapiens
acucaguaacacagugcagua

SEQ ID NO: 868400 - RNA, 20 nt, Homo sapiens
acucaguaaggcagugcagu

SEQ ID NO: 868401 - RNA, 22 nt, Homo sapiens
acucaguaaggcagugcaguac

SEQ ID NO: 868402 - RNA, 20 nt, Homo sapiens
acucaguuaggcagugcagu

SEQ ID NO: 868403 - RNA, 13 nt, Homo sapiens
acucccugcuuag

SEQ ID NO: 868404 - RNA, 22 nt, Homo sapiens
acuccuuacagaagggagugaa

SEQ ID NO: 868405 - RNA, 19 nt, Homo sapiens
acucuaaaacuaucagcag

SEQ ID NO: 868406 - RNA, 15 nt, Homo sapiens
acucugaauuuccag

SEQ ID NO: 868407 - RNA, 23 nt, Homo sapiens
acugcguaggagagaacagggau

SEQ ID NO: 868408 - RNA, 16 nt, Homo sapiens
acuggcaacaguugga

SEQ ID NO: 868409 - RNA, 17 nt, Homo sapiens
acugugaguacuacuua

SEQ ID NO: 868410 - RNA, 22 nt, Homo sapiens
acuguggucccagcuacagggg

SEQ ID NO: 868411 - RNA, 22 nt, Homo sapiens
acuguuaaauaaggccucaucc

SEQ ID NO: 868412 - RNA, 19 nt, Homo sapiens
acuuaacagaucacaugcc

SEQ ID NO: 868413 - RNA, 16 nt, Homo sapiens
acuuauuuccauggau

SEQ ID NO: 868414 - RNA, 19 nt, Homo sapiens
acuucuuuacuaacacugg

SEQ ID NO: 868415 - RNA, 20 nt, Homo sapiens
acuucuuuacuaacacuggc

SEQ ID NO: 868416 - RNA, 13 nt, Homo sapiens
acuuuccucucuc

SEQ ID NO: 868417 - RNA, 19 nt, Homo sapiens
agaaauaucccucauuuca

SEQ ID NO: 868418 - RNA, 14 nt, Homo sapiens
agaaauaugagcau

SEQ ID NO: 868419 - RNA, 19 nt, Homo sapiens
agaauuaaccauugcuaau

SEQ ID NO: 868420 - RNA, 21 nt, Homo sapiens
agacaaaugggccugccaaac

SEQ ID NO: 868421 - RNA, 16 nt, Homo sapiens
augugugcuuggaaaa

SEQ ID NO: 868422 - RNA, 15 nt, Homo sapiens
auguucugacagcau

SEQ ID NO: 868423 - RNA, 23 nt, Homo sapiens
auguugaagaacucaugugauuu

SEQ ID NO: 868424 - RNA, 22 nt, Homo sapiens
auuaaccuuaucauaaauucaa

SEQ ID NO: 868425 - RNA, 12 nt, Homo sapiens
auuagaauauaa

SEQ ID NO: 868426 - RNA, 23 nt, Homo sapiens
auuagacaauguggaauuacaua

SEQ ID NO: 868427 - RNA, 15 nt, Homo sapiens
auuauccuucacaau

SEQ ID NO: 868428 - RNA, 20 nt, Homo sapiens
auuaucuaguaggucugcac

SEQ ID NO: 868429 - RNA, 16 nt, Homo sapiens
auuccaaucauuguua

SEQ ID NO: 868430 - RNA, 20 nt, Homo sapiens
auucccaugguagacuguga

SEQ ID NO: 868431 - RNA, 17 nt, Homo sapiens
auucucugaugcacugu

SEQ ID NO: 868432 - RNA, 16 nt, Homo sapiens
auugaaggauugugaa

SEQ ID NO: 868433 - RNA, 19 nt, Homo sapiens
auugcugagauguuuagua

SEQ ID NO: 868434 - RNA, 18 nt, Homo sapiens
auuguauaauuaugaagc

SEQ ID NO: 868435 - RNA, 15 nt, Homo sapiens
auuuaaacuucuuaa

SEQ ID NO: 868436 - RNA, 15 nt, Homo sapiens
auuuauuggcaauac

SEQ ID NO: 868437 - RNA, 13 nt, Homo sapiens
auuucaacuucag

SEQ ID NO: 868438 - RNA, 23 nt, Homo sapiens
auuucaugauuagacaaugugga

SEQ ID NO: 868439 - RNA, 20 nt, Homo sapiens
caaaauguuguccuuucccc

SEQ ID NO: 868440 - RNA, 22 nt, Homo sapiens
caaagcaugccaauuucucuua

SEQ ID NO: 868441 - RNA, 22 nt, Homo sapiens
caaaugccuuucuagcaauugc

SEQ ID NO: 868442 - RNA, 17 nt, Homo sapiens
caacaaagcaugcucag

SEQ ID NO: 868443 - RNA, 14 nt, Homo sapiens
caacaagccugaaa

SEQ ID NO: 868444 - RNA, 21 nt, Homo sapiens
caacaauuuaggaaugcucaa

SEQ ID NO: 868445 - RNA, 17 nt, Homo sapiens
caacaugguuaccucug

SEQ ID NO: 868446 - RNA, 15 nt, Homo sapiens
caaggcugcagugag

SEQ ID NO: 868447 - RNA, 13 nt, Homo sapiens
caaguuacauaca

SEQ ID NO: 868448 - RNA, 16 nt, Homo sapiens
caaguuggagugcagu

SEQ ID NO: 868449 - RNA, 17 nt, Homo sapiens
caauaaagcaauguggu

SEQ ID NO: 868450 - RNA, 19 nt, Homo sapiens
caauaaagcaaugugguag

SEQ ID NO: 868451 - RNA, 22 nt, Homo sapiens
caauaaggcagugcagugcuca

SEQ ID NO: 868452 - RNA, 14 nt, Homo sapiens
caaucaguaauuaa

SEQ ID NO: 868453 - RNA, 17 nt, Homo sapiens
caaucaucuauugagug

SEQ ID NO: 868454 - RNA, 23 nt, Homo sapiens
caaugcucaguaacacagugcag

SEQ ID NO: 868455 - RNA, 17 nt, Homo sapiens
cacaaccuccuccucca

SEQ ID NO: 868456 - RNA, 21 nt, Homo sapiens
cacaagguugcuggcauuugc

SEQ ID NO: 868457 - RNA, 13 nt, Homo sapiens
cacacugagcaag

SEQ ID NO: 868458 - RNA, 11 nt, Homo sapiens
cacagugcagu

SEQ ID NO: 868459 - RNA, 12 nt, Homo sapiens
cacagugcagua

SEQ ID NO: 868460 - RNA, 20 nt, Homo sapiens
cacccaaguuggagugcagu

SEQ ID NO: 868461 - RNA, 22 nt, Homo sapiens
caccgagaggaaaaaggcuucu

SEQ ID NO: 868462 - RNA, 22 nt, Homo sapiens
cacgauaugcaaguucauccaa

SEQ ID NO: 868463 - RNA, 23 nt, Homo sapiens
cacuaaagaaaaacuaaugucag

SEQ ID NO: 868464 - RNA, 21 nt, Homo sapiens
cacucaaugccaggcagugca

SEQ ID NO: 868465 - RNA, 21 nt, Homo sapiens
cacucuuuugagcaguaaaug

SEQ ID NO: 868466 - RNA, 15 nt, Homo sapiens
cacuguuugccccag

SEQ ID NO: 868467 - RNA, 15 nt, Homo sapiens
cacuuuaaaaccucu

SEQ ID NO: 868468 - RNA, 17 nt, Homo sapiens
cacuuucugaaauucac

SEQ ID NO: 868469 - RNA, 15 nt, Homo sapiens
cagaagcagcagcua

SEQ ID NO: 868470 - RNA, 18 nt, Homo sapiens
cagaauggggacaucuug

SEQ ID NO: 868471 - RNA, 15 nt, Homo sapiens
cagacggacgggaca

SEQ ID NO: 868472 - RNA, 13 nt, Homo sapiens
cagagcugagucg

SEQ ID NO: 868473 - RNA, 20 nt, Homo sapiens
cagaggcucuaauguacaau

SEQ ID NO: 868474 - RNA, 16 nt, Homo sapiens
cagaucaaaugugaaa

SEQ ID NO: 868475 - RNA, 15 nt, Homo sapiens
cagcaacuggugacu

SEQ ID NO: 868476 - RNA, 14 nt, Homo sapiens
cagcagcagcaguu

SEQ ID NO: 868477 - RNA, 23 nt, Homo sapiens
cagcaugugggugucagugucau

SEQ ID NO: 868478 - RNA, 20 nt, Homo sapiens
cagccacuuauuuccaugga

SEQ ID NO: 868479 - RNA, 21 nt, Homo sapiens
cagccccauccuucccgcagc

SEQ ID NO: 868480 - RNA, 23 nt, Homo sapiens
cagccugcucccuagccagaggc

SEQ ID NO: 868481 - RNA, 14 nt, Homo sapiens
cagcuccacucuga

SEQ ID NO: 868482 - RNA, 21 nt, Homo sapiens
caggaaugcagcacaguacuc

SEQ ID NO: 868483 - RNA, 20 nt, Homo sapiens
caggauugaggaugaacuca

SEQ ID NO: 868484 - RNA, 12 nt, Homo sapiens
caggcagugcaa

SEQ ID NO: 868485 - RNA, 15 nt, Homo sapiens
caguaaaucagugca

SEQ ID NO: 868486 - RNA, 21 nt, Homo sapiens
caguaaauguauauugaugua

SEQ ID NO: 868487 - RNA, 17 nt, Homo sapiens
caguaacacagugcagu

SEQ ID NO: 868488 - RNA, 18 nt, Homo sapiens
caguaacacagugcagua

SEQ ID NO: 868489 - RNA, 14 nt, Homo sapiens
caguaacagugcag

SEQ ID NO: 868490 - RNA, 15 nt, Homo sapiens
caguaacagugcagu

SEQ ID NO: 868491 - RNA, 15 nt, Homo sapiens
caguaaggcagugca

SEQ ID NO: 868492 - RNA, 17 nt, Homo sapiens
caguaaggcagugcagu

SEQ ID NO: 868493 - RNA, 21 nt, Homo sapiens
caguaauacaguacaguacuc

SEQ ID NO: 868494 - RNA, 19 nt, Homo sapiens
caguaaucaguuugcuaac

SEQ ID NO: 868495 - RNA, 13 nt, Homo sapiens
caguacaguacuc

SEQ ID NO: 868496 - RNA, 14 nt, Homo sapiens
caguacaguacuca

SEQ ID NO: 868497 - RNA, 13 nt, Homo sapiens
caguacucaguaa

SEQ ID NO: 868498 - RNA, 23 nt, Homo sapiens
caguagagauuucccacauuccc

SEQ ID NO: 868499 - RNA, 17 nt, Homo sapiens
caguauugagacacugu

SEQ ID NO: 868500 - RNA, 23 nt, Homo sapiens
caguauuguucuuguaaaacugu

SEQ ID NO: 868501 - RNA, 20 nt, Homo sapiens
cagucuggugcccagacuca

SEQ ID NO: 868502 - RNA, 16 nt, Homo sapiens
cagugaaguacucagu

SEQ ID NO: 868503 - RNA, 18 nt, Homo sapiens
cagugaaguacucaguaa

SEQ ID NO: 868504 - RNA, 20 nt, Homo sapiens
cagugaaguacucaguaaua

SEQ ID NO: 868505 - RNA, 17 nt, Homo sapiens
caguuaggcagugcagu

SEQ ID NO: 868506 - RNA, 18 nt, Homo sapiens
caguuaggcagugcagua

SEQ ID NO: 868507 - RNA, 18 nt, Homo sapiens
caguucccucagcccuca

SEQ ID NO: 868508 - RNA, 19 nt, Homo sapiens
caguucccucagcccucau

SEQ ID NO: 868509 - RNA, 12 nt, Homo sapiens
caguucugauga

SEQ ID NO: 868510 - RNA, 13 nt, Homo sapiens
caguucugaugag

SEQ ID NO: 868511 - RNA, 22 nt, Homo sapiens
caguuguaacauucuauuucaa

SEQ ID NO: 868512 - RNA, 22 nt, Homo sapiens
cauaacaggcauugcacuaaaa

SEQ ID NO: 868513 - RNA, 10 nt, Homo sapiens
cauacuuugg

SEQ ID NO: 868514 - RNA, 12 nt, Homo sapiens
cauauacuuugu

SEQ ID NO: 868515 - RNA, 16 nt, Homo sapiens
caucgguuuauacuau

SEQ ID NO: 868516 - RNA, 17 nt, Homo sapiens
caucugaggaguccaaa

SEQ ID NO: 868517 - RNA, 22 nt, Homo sapiens
caugcagauaguauacacauca

SEQ ID NO: 868518 - RNA, 15 nt, Homo sapiens
caugcgcagucccca

SEQ ID NO: 868519 - RNA, 14 nt, Homo sapiens
caugcucaguauug

SEQ ID NO: 868520 - RNA, 13 nt, Homo sapiens
caugcucccucau

SEQ ID NO: 868521 - RNA, 17 nt, Homo sapiens
cauggaguagagucagg

SEQ ID NO: 868522 - RNA, 22 nt, Homo sapiens
caugguagacugugacacagcu

SEQ ID NO: 868523 - RNA, 19 nt, Homo sapiens
cauugaugaacugccaaag

SEQ ID NO: 868524 - RNA, 22 nt, Homo sapiens
cauuguucagaaaagcaccucu

SEQ ID NO: 868525 - RNA, 18 nt, Homo sapiens
cauuuuucuacugcucuu

SEQ ID NO: 868526 - RNA, 20 nt, Homo sapiens
ccaaauagaaacaccuucca

SEQ ID NO: 868527 - RNA, 13 nt, Homo sapiens
ccaaauugcugag

SEQ ID NO: 868528 - RNA, 15 nt, Homo sapiens
ccaacaauacuuugu

SEQ ID NO: 868529 - RNA, 13 nt, Homo sapiens
ccacuucacaguu

SEQ ID NO: 868530 - RNA, 16 nt, Homo sapiens
ccagaagcagcagcua

SEQ ID NO: 868531 - RNA, 22 nt, Homo sapiens
ccagugcuacacguuggaguau

SEQ ID NO: 868532 - RNA, 21 nt, Homo sapiens
gaaaauaguggcaggacuguc

SEQ ID NO: 868533 - RNA, 23 nt, Homo sapiens
gaaaauaguggcaggacuguccc

SEQ ID NO: 868534 - RNA, 21 nt, Homo sapiens
gaaagaucccaagucaaacag

SEQ ID NO: 868535 - RNA, 13 nt, Homo sapiens
gaaagugcugacu

SEQ ID NO: 868536 - RNA, 14 nt, Homo sapiens
gaaauauucacaag

SEQ ID NO: 868537 - RNA, 15 nt, Homo sapiens
gaaauuagggcucua

SEQ ID NO: 868538 - RNA, 18 nt, Homo sapiens
gaaauuuacccacaguga

SEQ ID NO: 868539 - RNA, 14 nt, Homo sapiens
gaacugcaacacug

SEQ ID NO: 868540 - RNA, 13 nt, Homo sapiens
gaagcuucuugcu

SEQ ID NO: 868541 - RNA, 22 nt, Homo sapiens
gaagggccuucuccacagggac

SEQ ID NO: 868542 - RNA, 16 nt, Homo sapiens
gaaucaagucugugaa

SEQ ID NO: 868543 - RNA, 21 nt, Homo sapiens
gaaugaaauauaaacugugag

SEQ ID NO: 868544 - RNA, 17 nt, Homo sapiens
gaaugaguuuccagcua

SEQ ID NO: 868545 - RNA, 17 nt, Homo sapiens
gaaugcagcacaguacu

SEQ ID NO: 868546 - RNA, 20 nt, Homo sapiens
gacaacauuuuucauagaua

SEQ ID NO: 868547 - RNA, 22 nt, Homo sapiens
gacaaguuuaaaggcuguguca

SEQ ID NO: 868548 - RNA, 15 nt, Homo sapiens
gacagugccuaacuc

SEQ ID NO: 868549 - RNA, 19 nt, Homo sapiens
gacauaaaucuuccaaagu

SEQ ID NO: 868550 - RNA, 20 nt, Homo sapiens
gacuucuuuacuaacacugg

SEQ ID NO: 868551 - RNA, 16 nt, Homo sapiens
gagagaacagggaugc

SEQ ID NO: 868552 - RNA, 15 nt, Homo sapiens
gagcacaucucuuca

SEQ ID NO: 868553 - RNA, 17 nt, Homo sapiens
gagcaccuuuccugaaa

SEQ ID NO: 868554 - RNA, 13 nt, Homo sapiens
gagcgggggcuaa

SEQ ID NO: 868555 - RNA, 20 nt, Homo sapiens
gaggacauaccacugccaug

SEQ ID NO: 868556 - RNA, 23 nt, Homo sapiens
gaggacucccugcuuagcucugu

SEQ ID NO: 868557 - RNA, 12 nt, Homo sapiens
gaggaucacuug

SEQ ID NO: 868558 - RNA, 22 nt, Homo sapiens
gagguauuugguaacuugcugu

SEQ ID NO: 868559 - RNA, 23 nt, Homo sapiens
gaguauggauugaaggauuguga

SEQ ID NO: 868560 - RNA, 17 nt, Homo sapiens
gaguauguuauuucucu

SEQ ID NO: 868561 - RNA, 15 nt, Homo sapiens
gagucagccccacuc

SEQ ID NO: 868562 - RNA, 22 nt, Homo sapiens
gagucuggauaauuuguauaag

SEQ ID NO: 868563 - RNA, 23 nt, Homo sapiens
gaguuuccagcuaagccugauga

SEQ ID NO: 868564 - RNA, 17 nt, Homo sapiens
gauaaauuugacuguua

SEQ ID NO: 868565 - RNA, 14 nt, Homo sapiens
gaugaggcuggaua

SEQ ID NO: 868566 - RNA, 22 nt, Homo sapiens
gaugcuaucucgcuagccauau

SEQ ID NO: 868567 - RNA, 20 nt, Homo sapiens
gaugcugcugagcacaucuc

SEQ ID NO: 868568 - RNA, 23 nt, Homo sapiens
gauguccaaacuuaacagaucac

SEQ ID NO: 868569 - RNA, 15 nt, Homo sapiens
gaugugccuagacac

SEQ ID NO: 868570 - RNA, 20 nt, Homo sapiens
gauuaacccuauuaaucuau

SEQ ID NO: 868571 - RNA, 15 nt, Homo sapiens
gauuccccuggacau

SEQ ID NO: 868572 - RNA, 17 nt, Homo sapiens
gcaauggugaacuguca

SEQ ID NO: 868573 - RNA, 12 nt, Homo sapiens
gcacaguacuca

SEQ ID NO: 868574 - RNA, 19 nt, Homo sapiens
gcaccuugggcacgggaga

SEQ ID NO: 868575 - RNA, 22 nt, Homo sapiens
gcacuaaaagugaugugauuua

SEQ ID NO: 868576 - RNA, 11 nt, Homo sapiens
gcacucucuuu

SEQ ID NO: 868577 - RNA, 15 nt, Homo sapiens
gcagcagcagcagca

SEQ ID NO: 868578 - RNA, 14 nt, Homo sapiens
gcagcuuuccaguu

SEQ ID NO: 868579 - RNA, 17 nt, Homo sapiens
gcagugcaguacucagg

SEQ ID NO: 868580 - RNA, 15 nt, Homo sapiens
gcagugcagugcuca

SEQ ID NO: 868581 - RNA, 16 nt, Homo sapiens
gcauuucuacauguuu

SEQ ID NO: 868582 - RNA, 20 nt, Homo sapiens
gcauuugcugaauaacaaca

SEQ ID NO: 868583 - RNA, 22 nt, Homo sapiens
gccagacgugcuccugcugacc

SEQ ID NO: 868584 - RNA, 13 nt, Homo sapiens
gccagggaaacca

SEQ ID NO: 868585 - RNA, 18 nt, Homo sapiens
gcccaagguaaacaguuu

SEQ ID NO: 868586 - RNA, 22 nt, Homo sapiens
gcccaccucuuguuuuccccuu

SEQ ID NO: 868587 - RNA, 20 nt, Homo sapiens
gcccagacucaaggccucca

SEQ ID NO: 868588 - RNA, 11 nt, Homo sapiens
gccccaugaaa

SEQ ID NO: 868589 - RNA, 14 nt, Homo sapiens
gccccuccucgggc

SEQ ID NO: 868590 - RNA, 22 nt, Homo sapiens
gcccuggggucucugagcagug

SEQ ID NO: 868591 - RNA, 11 nt, Homo sapiens
gccugccaaac

SEQ ID NO: 868592 - RNA, 22 nt, Homo sapiens
gccuucuccacagggacacagu

SEQ ID NO: 868593 - RNA, 20 nt, Homo sapiens
gcgcuccucugcagccugag

SEQ ID NO: 868594 - RNA, 20 nt, Homo sapiens
gcguaggagagaacagggau

SEQ ID NO: 868595 - RNA, 22 nt, Homo sapiens
gcuaaaaugaaaaauagugugu

SEQ ID NO: 868596 - RNA, 14 nt, Homo sapiens
gcuacaauuacuuu

SEQ ID NO: 868597 - RNA, 20 nt, Homo sapiens
gcuagaaagagaaaaagccc

SEQ ID NO: 868598 - RNA, 18 nt, Homo sapiens
gcucaguaacacagugca

SEQ ID NO: 868599 - RNA, 20 nt, Homo sapiens
gcucaguaacacagugcagu

SEQ ID NO: 868600 - RNA, 13 nt, Homo sapiens
gcucccuagccag

SEQ ID NO: 868601 - RNA, 14 nt, Homo sapiens
gcuccugcugaccu

SEQ ID NO: 868602 - RNA, 15 nt, Homo sapiens
gcucuaauguacaau

SEQ ID NO: 868603 - RNA, 18 nt, Homo sapiens
gcugugagcuuucugaua

SEQ ID NO: 868604 - RNA, 13 nt, Homo sapiens
gcuuaaacauuuu

SEQ ID NO: 868605 - RNA, 14 nt, Homo sapiens
gcuuaaaugaucaa

SEQ ID NO: 868606 - RNA, 22 nt, Homo sapiens
gcuuaaucuagagcuaugcaca

SEQ ID NO: 868607 - RNA, 20 nt, Homo sapiens
gcuucucuaaaacagcacua

SEQ ID NO: 868608 - RNA, 20 nt, Homo sapiens
gcuuuagguaaaaagcuuaa

SEQ ID NO: 868609 - RNA, 16 nt, Homo sapiens
gcuuuccacaucccca

SEQ ID NO: 868610 - RNA, 17 nt, Homo sapiens
gcuuugccacugaagua

SEQ ID NO: 868611 - RNA, 17 nt, Homo sapiens
gcuuuucucaugguauu

SEQ ID NO: 868612 - RNA, 22 nt, Homo sapiens
ggaaaaaaaaaaauaugagauu

SEQ ID NO: 868613 - RNA, 19 nt, Homo sapiens
ggaaagcagugcaguacuc

SEQ ID NO: 868614 - RNA, 17 nt, Homo sapiens
ggaaauauuugcguaaa

SEQ ID NO: 868615 - RNA, 19 nt, Homo sapiens
ggaguccacuuuccucucu

SEQ ID NO: 868616 - RNA, 15 nt, Homo sapiens
ggagugaaaaccucu

SEQ ID NO: 868617 - RNA, 14 nt, Homo sapiens
ggaucaagacauaa

SEQ ID NO: 868618 - RNA, 14 nt, Homo sapiens
ggcaagauagcucc

SEQ ID NO: 868619 - RNA, 14 nt, Homo sapiens
ggcauauacuuugu

SEQ ID NO: 868620 - RNA, 21 nt, Homo sapiens
ggcauuggguaagggacucca

SEQ ID NO: 868621 - RNA, 18 nt, Homo sapiens
ggccacucuugaccugga

SEQ ID NO: 868622 - RNA, 16 nt, Homo sapiens
gggaaggccugaggga

SEQ ID NO: 868623 - RNA, 20 nt, Homo sapiens
gguaaugaugauucaaucau

SEQ ID NO: 868624 - RNA, 23 nt, Homo sapiens
gguacucaguaacacagugcagu

SEQ ID NO: 868625 - RNA, 13 nt, Homo sapiens
ggucuaugauguc

SEQ ID NO: 868626 - RNA, 22 nt, Homo sapiens
ggugaacugugaguacuacuua

SEQ ID NO: 868627 - RNA, 18 nt, Homo sapiens
ggugaaggcccagccugu

SEQ ID NO: 868628 - RNA, 11 nt, Homo sapiens
gguuaccucug

SEQ ID NO: 868629 - RNA, 13 nt, Homo sapiens
guaaaacugugac

SEQ ID NO: 868630 - RNA, 15 nt, Homo sapiens
guaacacagugcagu

SEQ ID NO: 868631 - RNA, 20 nt, Homo sapiens
guaacacaguguagugcuca

SEQ ID NO: 868632 - RNA, 13 nt, Homo sapiens
guaacagugcagu

SEQ ID NO: 868633 - RNA, 14 nt, Homo sapiens
guaacagugcagua

SEQ ID NO: 868634 - RNA, 18 nt, Homo sapiens
guaacaguguaguacuca

SEQ ID NO: 868635 - RNA, 11 nt, Homo sapiens
guaacuguccu

SEQ ID NO: 868636 - RNA, 16 nt, Homo sapiens
guaaggcagugcagua

SEQ ID NO: 868637 - RNA, 18 nt, Homo sapiens
guacaauaaagcaaugug

SEQ ID NO: 868638 - RNA, 19 nt, Homo sapiens
guacaauaaagcaaugugg

SEQ ID NO: 868639 - RNA, 10 nt, Homo sapiens
guacaguacu

SEQ ID NO: 868640 - RNA, 15 nt, Homo sapiens
guacauaguggucau

SEQ ID NO: 868641 - RNA, 18 nt, Homo sapiens
guacucaggcagugcagu

SEQ ID NO: 868642 - RNA, 23 nt, Homo sapiens
guacucaggcagugcaguacuca

SEQ ID NO: 868643 - RNA, 13 nt, Homo sapiens
ucaccuaucugga

SEQ ID NO: 868644 - RNA, 23 nt, Homo sapiens
ucacucaaugccaggcagugcag

SEQ ID NO: 868645 - RNA, 15 nt, Homo sapiens
ucagaaacaaagcau

SEQ ID NO: 868646 - RNA, 19 nt, Homo sapiens
ucagauuuuuaaaagcccu

SEQ ID NO: 868647 - RNA, 22 nt, Homo sapiens
ucagcccuguguauaaagccau

SEQ ID NO: 868648 - RNA, 19 nt, Homo sapiens
ucaggaaugcagcacagua

SEQ ID NO: 868649 - RNA, 18 nt, Homo sapiens
ucaggcucugaaucucuc

SEQ ID NO: 868650 - RNA, 17 nt, Homo sapiens
ucaguaaaucagugcag

SEQ ID NO: 868651 - RNA, 23 nt, Homo sapiens
ucaguaacacaauacaguacuca

SEQ ID NO: 868652 - RNA, 15 nt, Homo sapiens
ucaguaacagugcag

SEQ ID NO: 868653 - RNA, 16 nt, Homo sapiens
ucaguaacagugcagu

SEQ ID NO: 868654 - RNA, 18 nt, Homo sapiens
ucaguaagacagugcagu

SEQ ID NO: 868655 - RNA, 19 nt, Homo sapiens
ucaguaagacagugcagug

SEQ ID NO: 868656 - RNA, 14 nt, Homo sapiens
ucaguaagaucaag

SEQ ID NO: 868657 - RNA, 17 nt, Homo sapiens
ucaguaaggcagugcag

SEQ ID NO: 868658 - RNA, 23 nt, Homo sapiens
ucaguaaggcagugcaguacuca

SEQ ID NO: 868659 - RNA, 21 nt, Homo sapiens
ucaguaauacaauacaguacu

SEQ ID NO: 868660 - RNA, 21 nt, Homo sapiens
ucaguaauacaguacaguacu

SEQ ID NO: 868661 - RNA, 22 nt, Homo sapiens
ucaguccacccccauugugaau

SEQ ID NO: 868662 - RNA, 13 nt, Homo sapiens
ucauaaacaaaga

SEQ ID NO: 868663 - RNA, 17 nt, Homo sapiens
ucauaucuguaugccuc

SEQ ID NO: 868664 - RNA, 19 nt, Homo sapiens
ucauccucuuauaugugcc

SEQ ID NO: 868665 - RNA, 16 nt, Homo sapiens
ucaugcuucuacucca

SEQ ID NO: 868666 - RNA, 17 nt, Homo sapiens
ucauucccaggcacucu

SEQ ID NO: 868667 - RNA, 21 nt, Homo sapiens
ucauucccaggcacucucuuu

SEQ ID NO: 868668 - RNA, 18 nt, Homo sapiens
ucauuuaagaauuuacca

SEQ ID NO: 868669 - RNA, 18 nt, Homo sapiens
uccaaaauaucgagugaa

SEQ ID NO: 868670 - RNA, 19 nt, Homo sapiens
uccaaagguuucaacugua

SEQ ID NO: 868671 - RNA, 19 nt, Homo sapiens
uccaagugaaugaguuucc

SEQ ID NO: 868672 - RNA, 22 nt, Homo sapiens
uccaagugaaugaguuuccagc

SEQ ID NO: 868673 - RNA, 19 nt, Homo sapiens
uccacaaauagucggggga

SEQ ID NO: 868674 - RNA, 22 nt, Homo sapiens
uccacaaccuccuccuccaguu

SEQ ID NO: 868675 - RNA, 14 nt, Homo sapiens
uccaguucugauga

SEQ ID NO: 868676 - RNA, 15 nt, Homo sapiens
uccaugucugaaguu

SEQ ID NO: 868677 - RNA, 17 nt, Homo sapiens
uccauucccaacucucu

SEQ ID NO: 868678 - RNA, 22 nt, Homo sapiens
ucccaaaucuauagcauuuaaa

SEQ ID NO: 868679 - RNA, 16 nt, Homo sapiens
ucccaaaucucaaaag

SEQ ID NO: 868680 - RNA, 14 nt, Homo sapiens
ucccaagucaaaca

SEQ ID NO: 868681 - RNA, 18 nt, Homo sapiens
ucccacauucccaugaau

SEQ ID NO: 868682 - RNA, 14 nt, Homo sapiens
ucccagcuacaggg

SEQ ID NO: 868683 - RNA, 16 nt, Homo sapiens
ucccaguuaacuguua

SEQ ID NO: 868684 - RNA, 18 nt, Homo sapiens
uccccagccugcucccua

SEQ ID NO: 868685 - RNA, 19 nt, Homo sapiens
uccccagccugcucccuag

SEQ ID NO: 868686 - RNA, 14 nt, Homo sapiens
uccccuggacauau

SEQ ID NO: 868687 - RNA, 15 nt, Homo sapiens
uccccuggacauauu

SEQ ID NO: 868688 - RNA, 20 nt, Homo sapiens
uccgacuucucuagacaucu

SEQ ID NO: 868689 - RNA, 13 nt, Homo sapiens
uccgcccgcccac

SEQ ID NO: 868690 - RNA, 18 nt, Homo sapiens
uccuccaguucugaugag

SEQ ID NO: 868691 - RNA, 18 nt, Homo sapiens
uccucuccucguccggcc

SEQ ID NO: 868692 - RNA, 15 nt, Homo sapiens
uccucugcagccuga

SEQ ID NO: 868693 - RNA, 23 nt, Homo sapiens
uccuucccgcagcaccagccuga

SEQ ID NO: 868694 - RNA, 23 nt, Homo sapiens
uccuugaguuaauuccagugaag

SEQ ID NO: 868695 - RNA, 14 nt, Homo sapiens
uccuuucccaccca

SEQ ID NO: 868696 - RNA, 15 nt, Homo sapiens
uccuuucccacccac

SEQ ID NO: 868697 - RNA, 15 nt, Homo sapiens
ucgguggcauuugcu

SEQ ID NO: 868698 - RNA, 16 nt, Homo sapiens
ucgguggcauuugcug

SEQ ID NO: 868699 - RNA, 14 nt, Homo sapiens
ucuaauccaugugc

SEQ ID NO: 868700 - RNA, 21 nt, Homo sapiens
ucuaauccaugugcugcugug

SEQ ID NO: 868701 - RNA, 21 nt, Homo sapiens
ucucaaaauaaaaccagaaag

SEQ ID NO: 868702 - RNA, 22 nt, Homo sapiens
ucucaaaaugugccgucuuugg

SEQ ID NO: 868703 - RNA, 16 nt, Homo sapiens
ucucauucccaggcac

SEQ ID NO: 868704 - RNA, 12 nt, Homo sapiens
ucucuaucuuag

SEQ ID NO: 868705 - RNA, 20 nt, Homo sapiens
ucucugaacugcaacacugg

SEQ ID NO: 868706 - RNA, 21 nt, Homo sapiens
ucucuucaugcgcagucccca

SEQ ID NO: 868707 - RNA, 15 nt, Homo sapiens
ucucuuucuuuccaa

SEQ ID NO: 868708 - RNA, 16 nt, Homo sapiens
ucugcacacauaacac

SEQ ID NO: 868709 - RNA, 23 nt, Homo sapiens
ucugcauaaauauuagcaaagca

SEQ ID NO: 868710 - RNA, 18 nt, Homo sapiens
ucugugcaacaaacucaa

SEQ ID NO: 868711 - RNA, 23 nt, Homo sapiens
ucuuaaguacugaaauacauaug

SEQ ID NO: 868712 - RNA, 17 nt, Homo sapiens
ucuuagaagaaauauga

SEQ ID NO: 868713 - RNA, 17 nt, Homo sapiens
ucuucauuucuauagcc

SEQ ID NO: 868714 - RNA, 13 nt, Homo sapiens
ucuugaccuggag

SEQ ID NO: 868715 - RNA, 12 nt, Homo sapiens
ucuugguguugu

SEQ ID NO: 868716 - RNA, 20 nt, Homo sapiens
ucuuucaauccacaguauug

SEQ ID NO: 868717 - RNA, 14 nt, Homo sapiens
ucuuucucucugug

SEQ ID NO: 868718 - RNA, 21 nt, Homo sapiens
ucuuugguuccucauggcugu

SEQ ID NO: 868719 - RNA, 21 nt, Homo sapiens
ucuuuugcucucucauuccca

SEQ ID NO: 868720 - RNA, 17 nt, Homo sapiens
ugaaauauaaacuguga

SEQ ID NO: 868721 - RNA, 20 nt, Homo sapiens
ugaaauauaaacugugagau

SEQ ID NO: 868722 - RNA, 13 nt, Homo sapiens
ugaaauugaguca

SEQ ID NO: 868723 - RNA, 16 nt, Homo sapiens
ugaacugcaacacugg

SEQ ID NO: 868724 - RNA, 21 nt, Homo sapiens
ugaaugccaguccagaugugc

SEQ ID NO: 868725 - RNA, 22 nt, Homo sapiens
ugaaugccaguccagaugugcc

SEQ ID NO: 868726 - RNA, 21 nt, Homo sapiens
ugacaguagcauacugaugag

SEQ ID NO: 868727 - RNA, 20 nt, Homo sapiens
ugaccauaaaauuagacaua

SEQ ID NO: 868728 - RNA, 16 nt, Homo sapiens
ugacugucccuucgac

SEQ ID NO: 868729 - RNA, 21 nt, Homo sapiens
ugacuucuuuacuaacacugg

SEQ ID NO: 868730 - RNA, 22 nt, Homo sapiens
ugacuucuuuacuaacacuggc

SEQ ID NO: 868731 - RNA, 21 nt, Homo sapiens
ugagaugggaggaucacuuga

SEQ ID NO: 868732 - RNA, 19 nt, Homo sapiens
ugaggacauaaaucuucca

SEQ ID NO: 868733 - RNA, 22 nt, Homo sapiens
ugaggccaagaguuugagacca

SEQ ID NO: 868734 - RNA, 23 nt, Homo sapiens
ugaggccuguccucuacauacca

SEQ ID NO: 868735 - RNA, 19 nt, Homo sapiens
ugaguucccuugauucaaa

SEQ ID NO: 868736 - RNA, 12 nt, Homo sapiens
ugauugugaacu

SEQ ID NO: 868737 - RNA, 21 nt, Homo sapiens
ugcaauguuccguucaucuga

SEQ ID NO: 868738 - RNA, 14 nt, Homo sapiens
ugcacacauaacac

SEQ ID NO: 868739 - RNA, 14 nt, Homo sapiens
ugcacuaaaaguga

SEQ ID NO: 868740 - RNA, 16 nt, Homo sapiens
ugcagcacaguacuca

SEQ ID NO: 868741 - RNA, 12 nt, Homo sapiens
ugcagcaguacc

SEQ ID NO: 868742 - RNA, 22 nt, Homo sapiens
ugcaguacucaguaaggcagug

SEQ ID NO: 868743 - RNA, 16 nt, Homo sapiens
ugcaugagaacuaaau

SEQ ID NO: 868744 - RNA, 22 nt, Homo sapiens
ugcauucauucauccucuuaua

SEQ ID NO: 868745 - RNA, 23 nt, Homo sapiens
ugccacgguccuuugagugucag

SEQ ID NO: 868746 - RNA, 16 nt, Homo sapiens
ugccaggcagugcagc

SEQ ID NO: 868747 - RNA, 12 nt, Homo sapiens
ugccccaugaaa

SEQ ID NO: 868748 - RNA, 12 nt, Homo sapiens
ugccucaggaau

SEQ ID NO: 868749 - RNA, 17 nt, Homo sapiens
ugccucuuugcugcuuu

SEQ ID NO: 868750 - RNA, 22 nt, Homo sapiens
ugccuuccaggcagacacagcu

SEQ ID NO: 868751 - RNA, 23 nt, Homo sapiens
ugccuuuuccuauguaaauauua

SEQ ID NO: 868752 - RNA, 17 nt, Homo sapiens
ugcucaauaaggcagug

SEQ ID NO: 868753 - RNA, 20 nt, Homo sapiens
aaaaagaauauauugccaaa

SEQ ID NO: 868754 - RNA, 20 nt, Homo sapiens
aaaaaucccauuuaugcaau

SEQ ID NO: 868755 - RNA, 14 nt, Homo sapiens
aaaagcaccucuug

SEQ ID NO: 868756 - RNA, 19 nt, Homo sapiens
aaaagcaggaaagauccca

SEQ ID NO: 868757 - RNA, 18 nt, Homo sapiens
aaaagcccuuuccaaagg

SEQ ID NO: 868758 - RNA, 22 nt, Homo sapiens
aaaauguucugacagcauuuca

SEQ ID NO: 868759 - RNA, 14 nt, Homo sapiens
aaaauguuguccuu

SEQ ID NO: 868760 - RNA, 14 nt, Homo sapiens
aaacaaaauccuug

SEQ ID NO: 868761 - RNA, 14 nt, Homo sapiens
aaacaauucaaaga

SEQ ID NO: 868762 - RNA, 22 nt, Homo sapiens
aaacaguguggcuuaaacauuu

SEQ ID NO: 868763 - RNA, 20 nt, Homo sapiens
gacaugcuaaccucucugaa

SEQ ID NO: 868764 - RNA, 15 nt, Homo sapiens
gaccuccugaugucu

SEQ ID NO: 868765 - RNA, 14 nt, Homo sapiens
gacuuccugaacuc

SEQ ID NO: 868766 - RNA, 15 nt, Homo sapiens
gacuucuaaaucaua

SEQ ID NO: 868767 - RNA, 15 nt, Homo sapiens
gacuucucuagacau

SEQ ID NO: 868768 - RNA, 21 nt, Homo sapiens
gagaccaacuacgacuggcau

SEQ ID NO: 868769 - RNA, 13 nt, Homo sapiens
gagacgaugcuuu

SEQ ID NO: 868770 - RNA, 21 nt, Homo sapiens
gagagaacagggaugcuaucu

SEQ ID NO: 868771 - RNA, 21 nt, Homo sapiens
gagagagcaaucuugcuguga

SEQ ID NO: 868772 - RNA, 16 nt, Homo sapiens
gagagcagccucuuga

SEQ ID NO: 868773 - RNA, 17 nt, Homo sapiens
gagaugaggcuggauag

SEQ ID NO: 868774 - RNA, 22 nt, Homo sapiens
gagauuuccugacagggaaaag

SEQ ID NO: 868775 - RNA, 14 nt, Homo sapiens
gagcagccucuuga

SEQ ID NO: 868776 - RNA, 11 nt, Homo sapiens
gagcagugggg

SEQ ID NO: 868777 - RNA, 15 nt, Homo sapiens
gaggaauaaaaugau

SEQ ID NO: 868778 - RNA, 21 nt, Homo sapiens
gaggcucuaauguacaauaaa

SEQ ID NO: 868779 - RNA, 18 nt, Homo sapiens
gagggaagcccacccgcc

SEQ ID NO: 868780 - RNA, 20 nt, Homo sapiens
gaguuuccagcuaagccuga

SEQ ID NO: 868781 - RNA, 15 nt, Homo sapiens
gauacgcuccaguac

SEQ ID NO: 868782 - RNA, 22 nt, Homo sapiens
gauagaauaaagccuugugauc

SEQ ID NO: 868783 - RNA, 15 nt, Homo sapiens
gaucaacucauguua

SEQ ID NO: 868784 - RNA, 19 nt, Homo sapiens
gaugaaaaccacccuauca

SEQ ID NO: 868785 - RNA, 14 nt, Homo sapiens
gaugcugcugagca

SEQ ID NO: 868786 - RNA, 20 nt, Homo sapiens
gaugucuugguuuccaucaa

SEQ ID NO: 868787 - RNA, 16 nt, Homo sapiens
gaugugccuagacacg

SEQ ID NO: 868788 - RNA, 18 nt, Homo sapiens
gauuggguaucaaaauga

SEQ ID NO: 868789 - RNA, 12 nt, Homo sapiens
gauuuaugcauu

SEQ ID NO: 868790 - RNA, 20 nt, Homo sapiens
gauuuccuuuggcaauauca

SEQ ID NO: 868791 - RNA, 11 nt, Homo sapiens
gcaaacauuua

SEQ ID NO: 868792 - RNA, 18 nt, Homo sapiens
gcaacuggugacuguccc

SEQ ID NO: 868793 - RNA, 12 nt, Homo sapiens
gcacacauaaca

SEQ ID NO: 868794 - RNA, 14 nt, Homo sapiens
gcagccugagcucc

SEQ ID NO: 868795 - RNA, 13 nt, Homo sapiens
gcagcuagacacc

SEQ ID NO: 868796 - RNA, 14 nt, Homo sapiens
gcagcuaguacuca

SEQ ID NO: 868797 - RNA, 13 nt, Homo sapiens
gcaguagugucac

SEQ ID NO: 868798 - RNA, 17 nt, Homo sapiens
gcagugcaauacucagu

SEQ ID NO: 868799 - RNA, 17 nt, Homo sapiens
gcauaaauauuagcaaa

SEQ ID NO: 868800 - RNA, 21 nt, Homo sapiens
gcauauuauaucagacugcuu

SEQ ID NO: 868801 - RNA, 18 nt, Homo sapiens
gcauucauucauccucuu

SEQ ID NO: 868802 - RNA, 22 nt, Homo sapiens
gcauuuaggaaagcagugcagu

SEQ ID NO: 868803 - RNA, 16 nt, Homo sapiens
gcauuugcugcauuuc

SEQ ID NO: 868804 - RNA, 18 nt, Homo sapiens
gcauuugcugcauuucaa

SEQ ID NO: 868805 - RNA, 18 nt, Homo sapiens
gcauuuuucuacugcucu

SEQ ID NO: 868806 - RNA, 17 nt, Homo sapiens
gccaaacuguacaguuu

SEQ ID NO: 868807 - RNA, 20 nt, Homo sapiens
gccaccccuaaucacuauug

SEQ ID NO: 868808 - RNA, 15 nt, Homo sapiens
gccagaggcucuaau

SEQ ID NO: 868809 - RNA, 18 nt, Homo sapiens
gccagaggcucuaaugua

SEQ ID NO: 868810 - RNA, 22 nt, Homo sapiens
gccagaggcucuaauguacaau

SEQ ID NO: 868811 - RNA, 15 nt, Homo sapiens
gccaggcagugcagc

SEQ ID NO: 868812 - RNA, 13 nt, Homo sapiens
gcccgccaccuug

SEQ ID NO: 868813 - RNA, 15 nt, Homo sapiens
gcccucuucaauccc

SEQ ID NO: 868814 - RNA, 22 nt, Homo sapiens
gcccuggcuaauuccccuucca

SEQ ID NO: 868815 - RNA, 15 nt, Homo sapiens
gccucccguccgucc

SEQ ID NO: 868816 - RNA, 15 nt, Homo sapiens
gccugaugauggaag

SEQ ID NO: 868817 - RNA, 23 nt, Homo sapiens
gccugaugauggaagggccuucu

SEQ ID NO: 868818 - RNA, 23 nt, Homo sapiens
gccugcucccuagccagaggcuc

SEQ ID NO: 868819 - RNA, 23 nt, Homo sapiens
gccuucuccacagggacacaguc

SEQ ID NO: 868820 - RNA, 12 nt, Homo sapiens
gcgccacccgcc

SEQ ID NO: 868821 - RNA, 19 nt, Homo sapiens
aacugguauauacauauau

SEQ ID NO: 868822 - RNA, 17 nt, Homo sapiens
aacugguuuagcacaau

SEQ ID NO: 868823 - RNA, 14 nt, Homo sapiens
aacuguacauguga

SEQ ID NO: 868824 - RNA, 15 nt, Homo sapiens
aacuguggucaaucc

SEQ ID NO: 868825 - RNA, 23 nt, Homo sapiens
aacuguguacgacaaagcaucau

SEQ ID NO: 868826 - RNA, 20 nt, Homo sapiens
aacuguugauugcaggaaua

SEQ ID NO: 868827 - RNA, 16 nt, Homo sapiens
aacuuaauaguauuua

SEQ ID NO: 868828 - RNA, 22 nt, Homo sapiens
aacuuaccaggcaccaaaagaa

SEQ ID NO: 868829 - RNA, 15 nt, Homo sapiens
aacuuauugucuagg

SEQ ID NO: 868830 - RNA, 13 nt, Homo sapiens
aacuucaagcaaa

SEQ ID NO: 868831 - RNA, 21 nt, Homo sapiens
aacuuccuaaugauuagcacu

SEQ ID NO: 868832 - RNA, 11 nt, Homo sapiens
aacuuccucag

SEQ ID NO: 868833 - RNA, 15 nt, Homo sapiens
aacuugcugcugagu

SEQ ID NO: 868834 - RNA, 21 nt, Homo sapiens
aacuugggggaccucauuccu

SEQ ID NO: 868835 - RNA, 17 nt, Homo sapiens
aacuuguguacugauaa

SEQ ID NO: 868836 - RNA, 21 nt, Homo sapiens
aacuuuaaauucaagcugcuu

SEQ ID NO: 868837 - RNA, 13 nt, Homo sapiens
aacuuuugugcuc

SEQ ID NO: 868838 - RNA, 15 nt, Homo sapiens
aagaaaaaauaucuu

SEQ ID NO: 868839 - RNA, 16 nt, Homo sapiens
aagaaaaaauaucuug

SEQ ID NO: 868840 - RNA, 14 nt, Homo sapiens
aagaaaaaaucugc

SEQ ID NO: 868841 - RNA, 23 nt, Homo sapiens
aagaaaaagggcugccgggccag

SEQ ID NO: 868842 - RNA, 16 nt, Homo sapiens
aagaaaaccauuuuag

SEQ ID NO: 868843 - RNA, 23 nt, Homo sapiens
aagaaaaccuuucuucaccaaau

SEQ ID NO: 868844 - RNA, 13 nt, Homo sapiens
aagaaaagcaauc

SEQ ID NO: 868845 - RNA, 13 nt, Homo sapiens
aagaaacccaagu

SEQ ID NO: 868846 - RNA, 13 nt, Homo sapiens
aagaaagauccac

SEQ ID NO: 868847 - RNA, 18 nt, Homo sapiens
aagaaaucauggcauuca

SEQ ID NO: 868848 - RNA, 23 nt, Homo sapiens
aagaaauguaagggaaacugcca

SEQ ID NO: 868849 - RNA, 13 nt, Homo sapiens
aagaaauugccuc

SEQ ID NO: 868850 - RNA, 14 nt, Homo sapiens
aagaacgucauuuu

SEQ ID NO: 868851 - RNA, 18 nt, Homo sapiens
aagaacucugggcugcua

SEQ ID NO: 868852 - RNA, 18 nt, Homo sapiens
aagaacugccccaucucc

SEQ ID NO: 868853 - RNA, 19 nt, Homo sapiens
aagaacugccccaucuccu

SEQ ID NO: 868854 - RNA, 16 nt, Homo sapiens
aagaagacacauuccu

SEQ ID NO: 868855 - RNA, 16 nt, Homo sapiens
aagaagcuucaugcca

SEQ ID NO: 868856 - RNA, 18 nt, Homo sapiens
aagaaggaagaagccaga

SEQ ID NO: 868857 - RNA, 13 nt, Homo sapiens
aagaaguguuccu

SEQ ID NO: 868858 - RNA, 19 nt, Homo sapiens
aagaaguuaacuacagugu

SEQ ID NO: 868859 - RNA, 14 nt, Homo sapiens
aagaaguugcucug

SEQ ID NO: 868860 - RNA, 17 nt, Homo sapiens
aagaauaaaauugcacu

SEQ ID NO: 868861 - RNA, 17 nt, Homo sapiens
aagaauauuuacaauaa

SEQ ID NO: 868862 - RNA, 14 nt, Homo sapiens
aagaaucaccucaa

SEQ ID NO: 868863 - RNA, 15 nt, Homo sapiens
aagaaucaccucaaa

SEQ ID NO: 868864 - RNA, 15 nt, Homo sapiens
aagaaucacuugaac

SEQ ID NO: 868865 - RNA, 21 nt, Homo sapiens
aagaaucagaaacaggugcau

SEQ ID NO: 868866 - RNA, 18 nt, Homo sapiens
aagaauuacaaguagaau

SEQ ID NO: 868867 - RNA, 18 nt, Homo sapiens
aagacaacagcauaacua

SEQ ID NO: 868868 - RNA, 14 nt, Homo sapiens
aagacaacauuucu

SEQ ID NO: 868869 - RNA, 17 nt, Homo sapiens
aagacacaccucuggau

SEQ ID NO: 868870 - RNA, 14 nt, Homo sapiens
aagacacagacugc

SEQ ID NO: 868871 - RNA, 19 nt, Homo sapiens
aagacagggaagagcagaa

SEQ ID NO: 868872 - RNA, 11 nt, Homo sapiens
aagaccaaaaa

SEQ ID NO: 868873 - RNA, 15 nt, Homo sapiens
aagaccaaagcauug

SEQ ID NO: 868874 - RNA, 22 nt, Homo sapiens
aagaccaauauucaaaugcgua

SEQ ID NO: 868875 - RNA, 17 nt, Homo sapiens
aagaccagccuggccaa

SEQ ID NO: 868876 - RNA, 12 nt, Homo sapiens
aagacccagugu

SEQ ID NO: 868877 - RNA, 16 nt, Homo sapiens
aagacccaguguaaag

SEQ ID NO: 868878 - RNA, 19 nt, Homo sapiens
aagacccaguguaaagaau

SEQ ID NO: 868879 - RNA, 13 nt, Homo sapiens
aagacuacuauac

SEQ ID NO: 868880 - RNA, 17 nt, Homo sapiens
aagacuauauuguacac

SEQ ID NO: 868881 - RNA, 20 nt, Homo sapiens
aagacuauucaaacagucuc

SEQ ID NO: 868882 - RNA, 18 nt, Homo sapiens
aagacugcagcugcugaa

SEQ ID NO: 868883 - RNA, 14 nt, Homo sapiens
aagacuucuugggu

SEQ ID NO: 868884 - RNA, 17 nt, Homo sapiens
aaaugacaugcacugac

SEQ ID NO: 868885 - RNA, 18 nt, Homo sapiens
aaaugacccaaagaccaa

SEQ ID NO: 868886 - RNA, 19 nt, Homo sapiens
aaaugauauauaccacuuu

SEQ ID NO: 868887 - RNA, 17 nt, Homo sapiens
aaaugaugccacuuccc

SEQ ID NO: 868888 - RNA, 17 nt, Homo sapiens
aaaugcaacaacaugua

SEQ ID NO: 868889 - RNA, 13 nt, Homo sapiens
aaaugcaagguga

SEQ ID NO: 868890 - RNA, 13 nt, Homo sapiens
aaaugcacuguga

SEQ ID NO: 868891 - RNA, 14 nt, Homo sapiens
aaaugccacaaaga

SEQ ID NO: 868892 - RNA, 21 nt, Homo sapiens
aaaugcccaucuaugucccuu

SEQ ID NO: 868893 - RNA, 21 nt, Homo sapiens
aaaugcgcgugugcacgugug

SEQ ID NO: 868894 - RNA, 17 nt, Homo sapiens
aaaugcuacaaacauau

SEQ ID NO: 868895 - RNA, 21 nt, Homo sapiens
aaauggagggagccaucccuu

SEQ ID NO: 868896 - RNA, 19 nt, Homo sapiens
aaauggggauauguuaacu

SEQ ID NO: 868897 - RNA, 20 nt, Homo sapiens
aaauguaauacuccuaagac

SEQ ID NO: 868898 - RNA, 19 nt, Homo sapiens
aaauguaauuaugagguga

SEQ ID NO: 868899 - RNA, 11 nt, Homo sapiens
aaauguacaau

SEQ ID NO: 868900 - RNA, 13 nt, Homo sapiens
aaauguacacugg

SEQ ID NO: 868901 - RNA, 20 nt, Homo sapiens
aaauguaguauggccugugu

SEQ ID NO: 868902 - RNA, 13 nt, Homo sapiens
aaauguccaugau

SEQ ID NO: 868903 - RNA, 22 nt, Homo sapiens
aaauguccuccaacaauaaaga

SEQ ID NO: 868904 - RNA, 16 nt, Homo sapiens
aaaugucuggucuguc

SEQ ID NO: 868905 - RNA, 19 nt, Homo sapiens
aaaugucuggucuguccac

SEQ ID NO: 868906 - RNA, 18 nt, Homo sapiens
aaaugucuuucuauucau

SEQ ID NO: 868907 - RNA, 14 nt, Homo sapiens
aaaugugcuuaugu

SEQ ID NO: 868908 - RNA, 17 nt, Homo sapiens
aaauguggacaucauga

SEQ ID NO: 868909 - RNA, 22 nt, Homo sapiens
aaauguuugaguuuucaaagau

SEQ ID NO: 868910 - RNA, 16 nt, Homo sapiens
aaauuaaaugcauguc

SEQ ID NO: 868911 - RNA, 17 nt, Homo sapiens
aaauuaacaguccuaac

SEQ ID NO: 868912 - RNA, 19 nt, Homo sapiens
aaauuaagagauacauucc

SEQ ID NO: 868913 - RNA, 21 nt, Homo sapiens
aaauuaagagauacauucccu

SEQ ID NO: 868914 - RNA, 14 nt, Homo sapiens
aaauuauaucucag

SEQ ID NO: 868915 - RNA, 14 nt, Homo sapiens
aaauucacuuaggg

SEQ ID NO: 868916 - RNA, 23 nt, Homo sapiens
aaauucauacauaguacauacaa

SEQ ID NO: 868917 - RNA, 23 nt, Homo sapiens
aaauuccuuagcuuagaccucag

SEQ ID NO: 868918 - RNA, 18 nt, Homo sapiens
aaauucucaaccuaccac

SEQ ID NO: 868919 - RNA, 24 nt, Homo sapiens
aaauucucagucaguaauugccaa

SEQ ID NO: 868920 - RNA, 22 nt, Homo sapiens
aaauucuuuuucacacugaugu

SEQ ID NO: 868921 - RNA, 11 nt, Homo sapiens
aaauugcacaa

SEQ ID NO: 868922 - RNA, 13 nt, Homo sapiens
aaauugcuucuag

SEQ ID NO: 868923 - RNA, 20 nt, Homo sapiens
aaauuggaauuuucuuaccc

SEQ ID NO: 868924 - RNA, 18 nt, Homo sapiens
aaauuguaacuacacuaa

SEQ ID NO: 868925 - RNA, 15 nt, Homo sapiens
aaauuguacauuuga

SEQ ID NO: 868926 - RNA, 22 nt, Homo sapiens
aaauuguauacauuuuguuaua

SEQ ID NO: 868927 - RNA, 22 nt, Homo sapiens
aaauuuaggaccaauaccuccu

SEQ ID NO: 868928 - RNA, 23 nt, Homo sapiens
aaauuuccaguaccuuugucaca

SEQ ID NO: 868929 - RNA, 21 nt, Homo sapiens
aaauuugggggacuuacauga

SEQ ID NO: 868930 - RNA, 22 nt, Homo sapiens
aaauuugggggacuuacaugau

SEQ ID NO: 868931 - RNA, 22 nt, Homo sapiens
aaauuuguccaauggcuguaaa

SEQ ID NO: 868932 - RNA, 18 nt, Homo sapiens
aaauuuuacugacagaaa

SEQ ID NO: 868933 - RNA, 22 nt, Homo sapiens
aaauuuuagagcauaccaguac

SEQ ID NO: 868934 - RNA, 18 nt, Homo sapiens
aaauuuuguccauuuuaa

SEQ ID NO: 868935 - RNA, 16 nt, Homo sapiens
aaauuuuuacugagaa

SEQ ID NO: 868936 - RNA, 18 nt, Homo sapiens
aaauuuuugucauuuuaa

SEQ ID NO: 868937 - RNA, 14 nt, Homo sapiens
aacaaaaucaugga

SEQ ID NO: 868938 - RNA, 23 nt, Homo sapiens
aacaaacuacauguaauccauca

SEQ ID NO: 868939 - RNA, 13 nt, Homo sapiens
aacaaaucuucaa

SEQ ID NO: 868940 - RNA, 18 nt, Homo sapiens
aacaaauuagguuuugua

SEQ ID NO: 868941 - RNA, 15 nt, Homo sapiens
aacaaccuggucaca

SEQ ID NO: 868942 - RNA, 12 nt, Homo sapiens
aacaacuguggu

SEQ ID NO: 868943 - RNA, 14 nt, Homo sapiens
agaaagaaagggaa

SEQ ID NO: 868944 - RNA, 18 nt, Homo sapiens
agaaagaaguuaacuaca

SEQ ID NO: 868945 - RNA, 14 nt, Homo sapiens
agaaagacuauuca

SEQ ID NO: 868946 - RNA, 21 nt, Homo sapiens
agaaagcauccuaaauauauc

SEQ ID NO: 868947 - RNA, 15 nt, Homo sapiens
agaaagccuucauaa

SEQ ID NO: 868948 - RNA, 17 nt, Homo sapiens
agaaagggaaacuggcu

SEQ ID NO: 868949 - RNA, 14 nt, Homo sapiens
agaaaguacuucuc

SEQ ID NO: 868950 - RNA, 12 nt, Homo sapiens
agaaaguauuug

SEQ ID NO: 868951 - RNA, 20 nt, Homo sapiens
agaaaguguuuaacuuguca

SEQ ID NO: 868952 - RNA, 12 nt, Homo sapiens
agaaauaagccc

SEQ ID NO: 868953 - RNA, 19 nt, Homo sapiens
agaaauacccacuaacaaa

SEQ ID NO: 868954 - RNA, 13 nt, Homo sapiens
agaaaugcugaaa

SEQ ID NO: 868955 - RNA, 12 nt, Homo sapiens
agaaaugggaga

SEQ ID NO: 868956 - RNA, 23 nt, Homo sapiens
agaaauuccaggaaaaucugcac

SEQ ID NO: 868957 - RNA, 23 nt, Homo sapiens
agaacaaaucugggcauugagca

SEQ ID NO: 868958 - RNA, 16 nt, Homo sapiens
agaacaacuacuguga

SEQ ID NO: 868959 - RNA, 23 nt, Homo sapiens
agaacaaugcuauaauauauaau

SEQ ID NO: 868960 - RNA, 16 nt, Homo sapiens
agaacacgaauugcuc

SEQ ID NO: 868961 - RNA, 16 nt, Homo sapiens
agaacagaggcauuua

SEQ ID NO: 868962 - RNA, 16 nt, Homo sapiens
agaacaugcacauuua

SEQ ID NO: 868963 - RNA, 18 nt, Homo sapiens
agaacauggccuaagggc

SEQ ID NO: 868964 - RNA, 14 nt, Homo sapiens
agaaccaaaagaga

SEQ ID NO: 868965 - RNA, 20 nt, Homo sapiens
agaaccaaaaguuuuccuga

SEQ ID NO: 868966 - RNA, 14 nt, Homo sapiens
agaaccacacuguu

SEQ ID NO: 868967 - RNA, 15 nt, Homo sapiens
agaacccagauuucc

SEQ ID NO: 868968 - RNA, 17 nt, Homo sapiens
agaacccagauuuccua

SEQ ID NO: 868969 - RNA, 23 nt, Homo sapiens
agaaccuggcagguuagaaccua

SEQ ID NO: 868970 - RNA, 23 nt, Homo sapiens
agaacggaagaagagaucaggaa

SEQ ID NO: 868971 - RNA, 21 nt, Homo sapiens
agaacggcaugugaauucugu

SEQ ID NO: 868972 - RNA, 12 nt, Homo sapiens
agaacuauccaa

SEQ ID NO: 868973 - RNA, 22 nt, Homo sapiens
agaacucuccaucuuauuuuca

SEQ ID NO: 868974 - RNA, 21 nt, Homo sapiens
agaacugcuaaauacuguaca

SEQ ID NO: 868975 - RNA, 22 nt, Homo sapiens
agaacuggaggaguuccuugau

SEQ ID NO: 868976 - RNA, 19 nt, Homo sapiens
agaagaaaacgaacuggga

SEQ ID NO: 868977 - RNA, 18 nt, Homo sapiens
agaagaaauucugucaua

SEQ ID NO: 868978 - RNA, 16 nt, Homo sapiens
agaagaaugacuaugc

SEQ ID NO: 868979 - RNA, 15 nt, Homo sapiens
agaagacacagggga

SEQ ID NO: 868980 - RNA, 23 nt, Homo sapiens
agaagaguuucuccuuuugacca

SEQ ID NO: 868981 - RNA, 21 nt, Homo sapiens
agaagauaauguucuuuaaug

SEQ ID NO: 868982 - RNA, 17 nt, Homo sapiens
agaagcagguucuugau

SEQ ID NO: 868983 - RNA, 21 nt, Homo sapiens
agaagccagacugguuagaca

SEQ ID NO: 868984 - RNA, 23 nt, Homo sapiens
agaagccucugccucccuagcuu

SEQ ID NO: 868985 - RNA, 18 nt, Homo sapiens
agaagccugggggccugg

SEQ ID NO: 868986 - RNA, 16 nt, Homo sapiens
agaagcucuggcccca

SEQ ID NO: 868987 - RNA, 15 nt, Homo sapiens
agaagcuguccuuga

SEQ ID NO: 868988 - RNA, 17 nt, Homo sapiens
agaaggaaaaauuccag

SEQ ID NO: 868989 - RNA, 18 nt, Homo sapiens
agaaggaaggcuccaucu

SEQ ID NO: 868990 - RNA, 13 nt, Homo sapiens
agaaggcaaaaag

SEQ ID NO: 868991 - RNA, 16 nt, Homo sapiens
agaaggcacaggugua

SEQ ID NO: 868992 - RNA, 17 nt, Homo sapiens
agaaggccaagaaucaa

SEQ ID NO: 868993 - RNA, 21 nt, Homo sapiens
agaaggcuuccuccagcggcu

SEQ ID NO: 868994 - RNA, 22 nt, Homo sapiens
agaaggggacagcgccaccucu

SEQ ID NO: 868995 - RNA, 21 nt, Homo sapiens
agaaguacaugaagagcagcu

SEQ ID NO: 868996 - RNA, 16 nt, Homo sapiens
agaaguauaaagugau

SEQ ID NO: 868997 - RNA, 21 nt, Homo sapiens
agaagucauaaacagcauuua

SEQ ID NO: 868998 - RNA, 16 nt, Homo sapiens
agaagucauggcccaa

SEQ ID NO: 868999 - RNA, 14 nt, Homo sapiens
agaagucucuucca

SEQ ID NO: 869000 - RNA, 14 nt, Homo sapiens
agaagucuugagaa

SEQ ID NO: 869001 - RNA, 18 nt, Homo sapiens
agaagucuugucucaaga

SEQ ID NO: 869002 - RNA, 14 nt, Homo sapiens
agaaguggagacuu

SEQ ID NO: 869003 - RNA, 19 nt, Homo sapiens
agaagugucguuuucauaa

SEQ ID NO: 869004 - RNA, 18 nt, Homo sapiens
agaaguuaacuacagugu

SEQ ID NO: 869005 - RNA, 17 nt, Homo sapiens
agaaguugagagagcaa

SEQ ID NO: 869006 - RNA, 14 nt, Homo sapiens
agaauaaaugaauc

SEQ ID NO: 869007 - RNA, 20 nt, Homo sapiens
agaauaagaaaacaaucaca

SEQ ID NO: 869008 - RNA, 17 nt, Homo sapiens
agaauaauuguguacaa

SEQ ID NO: 869009 - RNA, 15 nt, Homo sapiens
agaauacaagccacu

SEQ ID NO: 869010 - RNA, 18 nt, Homo sapiens
agaauaggguaugauccu

SEQ ID NO: 869011 - RNA, 14 nt, Homo sapiens
agaauauuguuaaa

SEQ ID NO: 869012 - RNA, 17 nt, Homo sapiens
agaauauuuacaauaaa

SEQ ID NO: 869013 - RNA, 12 nt, Homo sapiens
agaaucaccuca

SEQ ID NO: 869014 - RNA, 18 nt, Homo sapiens
agaaucacuugaacccgg

SEQ ID NO: 869015 - RNA, 18 nt, Homo sapiens
agaaucauuaauacaaag

SEQ ID NO: 869016 - RNA, 18 nt, Homo sapiens
agaaucauugaaguauuu

SEQ ID NO: 869017 - RNA, 11 nt, Homo sapiens
agaauccaaag

SEQ ID NO: 869018 - RNA, 23 nt, Homo sapiens
agaauccacaaagccgugccuuu

SEQ ID NO: 869019 - RNA, 18 nt, Homo sapiens
agaauccuacaacuucca

SEQ ID NO: 869020 - RNA, 18 nt, Homo sapiens
agaaucgaccucacuguc

SEQ ID NO: 869021 - RNA, 14 nt, Homo sapiens
agaaucgcuuaaac

SEQ ID NO: 869022 - RNA, 17 nt, Homo sapiens
agaaucugcagcuaacu

SEQ ID NO: 869023 - RNA, 22 nt, Homo sapiens
agaauggggguggggaggcaag

SEQ ID NO: 869024 - RNA, 12 nt, Homo sapiens
agaaugugauuc

SEQ ID NO: 869025 - RNA, 20 nt, Homo sapiens
agaauguucuccuaaaagac

SEQ ID NO: 869026 - RNA, 12 nt, Homo sapiens
agaauuaaucuu

SEQ ID NO: 869027 - RNA, 19 nt, Homo sapiens
agaauucacuuuaccuuca

SEQ ID NO: 869028 - RNA, 19 nt, Homo sapiens
agaauuccugaagccagau

SEQ ID NO: 869029 - RNA, 23 nt, Homo sapiens
agaauuccuuuucuaacucuccc

SEQ ID NO: 869030 - RNA, 19 nt, Homo sapiens
agaauugcuugaacccagg

SEQ ID NO: 869031 - RNA, 13 nt, Homo sapiens
agaauugugcaaa

SEQ ID NO: 869032 - RNA, 13 nt, Homo sapiens
agacaaaguucaa

SEQ ID NO: 869033 - RNA, 16 nt, Homo sapiens
agacaacagaagucau

SEQ ID NO: 869034 - RNA, 17 nt, Homo sapiens
agacaaguaaucacuaa

SEQ ID NO: 869035 - RNA, 19 nt, Homo sapiens
agacaauccacucucagga

SEQ ID NO: 869036 - RNA, 17 nt, Homo sapiens
agacaccuugacagggc

SEQ ID NO: 869037 - RNA, 19 nt, Homo sapiens
agacaccuuuuguauuuaa

SEQ ID NO: 869038 - RNA, 15 nt, Homo sapiens
agacacugugcuaua

SEQ ID NO: 869039 - RNA, 17 nt, Homo sapiens
agacagagaagaccaaa

SEQ ID NO: 869040 - RNA, 15 nt, Homo sapiens
agacagagacagaga

SEQ ID NO: 869041 - RNA, 19 nt, Homo sapiens
agacagagcccccaagccu

SEQ ID NO: 869042 - RNA, 22 nt, Homo sapiens
agacagaguuuucacucuuauu

SEQ ID NO: 869043 - RNA, 20 nt, Homo sapiens
agacagcaggcauaaggcac

SEQ ID NO: 869044 - RNA, 16 nt, Homo sapiens
agacaggcccaagaga

SEQ ID NO: 869045 - RNA, 18 nt, Homo sapiens
agacaguacucuuaacuc

SEQ ID NO: 869046 - RNA, 21 nt, Homo sapiens
agacaguacucuuaacuccua

SEQ ID NO: 869047 - RNA, 23 nt, Homo sapiens
agacaguacucuuaacuccuagc

SEQ ID NO: 869048 - RNA, 14 nt, Homo sapiens
agacauccauguuu

SEQ ID NO: 869049 - RNA, 18 nt, Homo sapiens
agacauggagacuccugc

SEQ ID NO: 869050 - RNA, 15 nt, Homo sapiens
agacauggauuugau

SEQ ID NO: 869051 - RNA, 23 nt, Homo sapiens
agacauuaacucauuagacugga

SEQ ID NO: 869052 - RNA, 19 nt, Homo sapiens
agaccaaagcauugccugc

SEQ ID NO: 869053 - RNA, 21 nt, Homo sapiens
agaccacaaaaauugacucaa

SEQ ID NO: 869054 - RNA, 18 nt, Homo sapiens
agaccaccucucaauauu

SEQ ID NO: 869055 - RNA, 14 nt, Homo sapiens
agaccacuauucuu

SEQ ID NO: 869056 - RNA, 18 nt, Homo sapiens
agaccagcccagccaaca

SEQ ID NO: 869057 - RNA, 13 nt, Homo sapiens
agaguuccacaaa

SEQ ID NO: 869058 - RNA, 12 nt, Homo sapiens
agaguugaaccu

SEQ ID NO: 869059 - RNA, 16 nt, Homo sapiens
agaguuguacacugug

SEQ ID NO: 869060 - RNA, 20 nt, Homo sapiens
agaguuucuccuuuugacca

SEQ ID NO: 869061 - RNA, 21 nt, Homo sapiens
agauaaaaccagagcaggaaa

SEQ ID NO: 869062 - RNA, 17 nt, Homo sapiens
agauaaacaacaaauaa

SEQ ID NO: 869063 - RNA, 13 nt, Homo sapiens
agauaacucuccu

SEQ ID NO: 869064 - RNA, 17 nt, Homo sapiens
agauaauuauaauauac

SEQ ID NO: 869065 - RNA, 12 nt, Homo sapiens
agauacauuuca

SEQ ID NO: 869066 - RNA, 19 nt, Homo sapiens
agauacauuucaucugcug

SEQ ID NO: 869067 - RNA, 22 nt, Homo sapiens
agauacauuucaucugcugcug

SEQ ID NO: 869068 - RNA, 17 nt, Homo sapiens
agauacgcaaacacacc

SEQ ID NO: 869069 - RNA, 18 nt, Homo sapiens
agauacuuuuguaaauaa

SEQ ID NO: 869070 - RNA, 20 nt, Homo sapiens
agauagaaccuggagccacu

SEQ ID NO: 869071 - RNA, 12 nt, Homo sapiens
agauaguaucuu

SEQ ID NO: 869072 - RNA, 15 nt, Homo sapiens
agauauaugaauaug

SEQ ID NO: 869073 - RNA, 17 nt, Homo sapiens
agauaucaugauuuuau

SEQ ID NO: 869074 - RNA, 11 nt, Homo sapiens
agauaugcaaa

SEQ ID NO: 869075 - RNA, 14 nt, Homo sapiens
agauaugcacacac

SEQ ID NO: 869076 - RNA, 17 nt, Homo sapiens
agauaugcacacacaga

SEQ ID NO: 869077 - RNA, 19 nt, Homo sapiens
agauaugcacacacaugga

SEQ ID NO: 869078 - RNA, 18 nt, Homo sapiens
agauauuaaaugauguuu

SEQ ID NO: 869079 - RNA, 22 nt, Homo sapiens
agauauugucagaguucugcuc

SEQ ID NO: 869080 - RNA, 16 nt, Homo sapiens
agauauuuccauuucu

SEQ ID NO: 869081 - RNA, 18 nt, Homo sapiens
agauccacccuaucccug

SEQ ID NO: 869082 - RNA, 24 nt, Homo sapiens
agauccacccuaucccuguacaga

SEQ ID NO: 869083 - RNA, 16 nt, Homo sapiens
agauccuaggugcugg

SEQ ID NO: 869084 - RNA, 15 nt, Homo sapiens
agauccucugcugac

SEQ ID NO: 869085 - RNA, 20 nt, Homo sapiens
agaucgauccuggauucacu

SEQ ID NO: 869086 - RNA, 21 nt, Homo sapiens
agaucgauccuggauucacuc

SEQ ID NO: 869087 - RNA, 17 nt, Homo sapiens
agaucgcgccacugcac

SEQ ID NO: 869088 - RNA, 16 nt, Homo sapiens
agaucuauguacugua

SEQ ID NO: 869089 - RNA, 18 nt, Homo sapiens
agaucuauguacuguaau

SEQ ID NO: 869090 - RNA, 17 nt, Homo sapiens
agaucuccacggucaga

SEQ ID NO: 869091 - RNA, 17 nt, Homo sapiens
agaucuggaaccuuacc

SEQ ID NO: 869092 - RNA, 22 nt, Homo sapiens
agaucugucuugaugugucauc

SEQ ID NO: 869093 - RNA, 10 nt, Homo sapiens
agaucuugau

SEQ ID NO: 869094 - RNA, 17 nt, Homo sapiens
agaucuuucaggaaaga

SEQ ID NO: 869095 - RNA, 17 nt, Homo sapiens
agaugaagacaacagca

SEQ ID NO: 869096 - RNA, 12 nt, Homo sapiens
agaugaugcaag

SEQ ID NO: 869097 - RNA, 20 nt, Homo sapiens
agaugauuaaacagacuuua

SEQ ID NO: 869098 - RNA, 15 nt, Homo sapiens
agaugcaaccucacu

SEQ ID NO: 869099 - RNA, 18 nt, Homo sapiens
agaugcaaucucuugucu

SEQ ID NO: 869100 - RNA, 20 nt, Homo sapiens
agaugcugcaaauaaauuca

SEQ ID NO: 869101 - RNA, 18 nt, Homo sapiens
agaugcugcaaugugagu

SEQ ID NO: 869102 - RNA, 12 nt, Homo sapiens
agauggaguucu

SEQ ID NO: 869103 - RNA, 18 nt, Homo sapiens
agauggauagucugucca

SEQ ID NO: 869104 - RNA, 13 nt, Homo sapiens
agauggauuucac

SEQ ID NO: 869105 - RNA, 19 nt, Homo sapiens
agauggccgggacaugcag

SEQ ID NO: 869106 - RNA, 20 nt, Homo sapiens
agauggcgcuauugcacucc

SEQ ID NO: 869107 - RNA, 16 nt, Homo sapiens
agauggcugugccucu

SEQ ID NO: 869108 - RNA, 21 nt, Homo sapiens
agaugguggugagcacaucug

SEQ ID NO: 869109 - RNA, 15 nt, Homo sapiens
agauguaaaugccac

SEQ ID NO: 869110 - RNA, 22 nt, Homo sapiens
agauguaagguaauuucugugu

SEQ ID NO: 869111 - RNA, 12 nt, Homo sapiens
agauguacuugu

SEQ ID NO: 869112 - RNA, 19 nt, Homo sapiens
agaugugaacacaucagcu

SEQ ID NO: 869113 - RNA, 17 nt, Homo sapiens
agaugugaucacugaga

SEQ ID NO: 869114 - RNA, 19 nt, Homo sapiens
agaugugcaagucuuguca

SEQ ID NO: 869115 - RNA, 17 nt, Homo sapiens
agaugugggcagugaug

SEQ ID NO: 869116 - RNA, 22 nt, Homo sapiens
agaugugggcagugaugucacu

SEQ ID NO: 869117 - RNA, 13 nt, Homo sapiens
agauuaccugcca

SEQ ID NO: 869118 - RNA, 20 nt, Homo sapiens
agauuagcucuggaccagcc

SEQ ID NO: 869119 - RNA, 23 nt, Homo sapiens
agauuauauaucauaaaguaugc

SEQ ID NO: 869120 - RNA, 22 nt, Homo sapiens
agauucaaacucaaugaugcua

SEQ ID NO: 869121 - RNA, 13 nt, Homo sapiens
agauucccucucc

SEQ ID NO: 869122 - RNA, 18 nt, Homo sapiens
agauucuccaaaugauuu

SEQ ID NO: 869123 - RNA, 17 nt, Homo sapiens
agauuguccagugcaac

SEQ ID NO: 869124 - RNA, 20 nt, Homo sapiens
agauuuaaaaaccaacuuau

SEQ ID NO: 869125 - RNA, 17 nt, Homo sapiens
agauuuaacaauuccaa

SEQ ID NO: 869126 - RNA, 19 nt, Homo sapiens
agauuuauguaaugcuuua

SEQ ID NO: 869127 - RNA, 20 nt, Homo sapiens
agauuuauguaaugcuuuau

SEQ ID NO: 869128 - RNA, 18 nt, Homo sapiens
agauuuugucgggacaga

SEQ ID NO: 869129 - RNA, 21 nt, Homo sapiens
agauuuuuuuuguaacuucaa

SEQ ID NO: 869130 - RNA, 20 nt, Homo sapiens
agcaaaaccacugagcuucu

SEQ ID NO: 869131 - RNA, 15 nt, Homo sapiens
agcaaagcaaaacaa

SEQ ID NO: 869132 - RNA, 17 nt, Homo sapiens
agcaaagcuuaaaugcc

SEQ ID NO: 869133 - RNA, 20 nt, Homo sapiens
agcaaaggaaaccaaaggaa

SEQ ID NO: 869134 - RNA, 17 nt, Homo sapiens
agcaaaguuuuaccugu

SEQ ID NO: 869135 - RNA, 17 nt, Homo sapiens
agcaaauaaauaucauc

SEQ ID NO: 869136 - RNA, 22 nt, Homo sapiens
agcaaauccucuucuaacucau

SEQ ID NO: 869137 - RNA, 21 nt, Homo sapiens
agcaaauggagaaguucagga

SEQ ID NO: 869138 - RNA, 24 nt, Homo sapiens
agcaacagauggauagucugucca

SEQ ID NO: 869139 - RNA, 18 nt, Homo sapiens
agcaacaggaaucucaga

SEQ ID NO: 869140 - RNA, 12 nt, Homo sapiens
agcaacauacca

SEQ ID NO: 869141 - RNA, 23 nt, Homo sapiens
agcaagaggugguagaaccacuu

SEQ ID NO: 869142 - RNA, 17 nt, Homo sapiens
agcaagccaauuuggaa

SEQ ID NO: 869143 - RNA, 17 nt, Homo sapiens
agcaauagggugcaguu

SEQ ID NO: 869144 - RNA, 21 nt, Homo sapiens
agcaaucucgcaguacauguu

SEQ ID NO: 869145 - RNA, 18 nt, Homo sapiens
agcaaucugagagauuug

SEQ ID NO: 869146 - RNA, 11 nt, Homo sapiens
agcacacugua

SEQ ID NO: 869147 - RNA, 20 nt, Homo sapiens
agcacagaaggaaucugugc

SEQ ID NO: 869148 - RNA, 14 nt, Homo sapiens
agcacaucugggag

SEQ ID NO: 869149 - RNA, 21 nt, Homo sapiens
agcaccaauuguacauucccu

SEQ ID NO: 869150 - RNA, 22 nt, Homo sapiens
agcaccaauuguacauucccug

SEQ ID NO: 869151 - RNA, 17 nt, Homo sapiens
agcacccugggugccau

SEQ ID NO: 869152 - RNA, 19 nt, Homo sapiens
agcaccuacuuacaugcau

SEQ ID NO: 869153 - RNA, 23 nt, Homo sapiens
agcaccucuuuuugaacagggaa

SEQ ID NO: 869154 - RNA, 20 nt, Homo sapiens
agcaccuuuccuucaagcca

SEQ ID NO: 869155 - RNA, 21 nt, Homo sapiens
agcacuaauucaacauauacc

SEQ ID NO: 869156 - RNA, 19 nt, Homo sapiens
agcacuauuauggaugaag

SEQ ID NO: 869157 - RNA, 16 nt, Homo sapiens
agcacucgagaccauc

SEQ ID NO: 869158 - RNA, 12 nt, Homo sapiens
agcacucugaaa

SEQ ID NO: 869159 - RNA, 13 nt, Homo sapiens
agcacugacaaua

SEQ ID NO: 869160 - RNA, 15 nt, Homo sapiens
agcacugacugggac

SEQ ID NO: 869161 - RNA, 17 nt, Homo sapiens
agcacuuaauaauugca

SEQ ID NO: 869162 - RNA, 22 nt, Homo sapiens
agcacuuucccucuuggugccu

SEQ ID NO: 869163 - RNA, 22 nt, Homo sapiens
agcagaaaccaagucuacuuca

SEQ ID NO: 869164 - RNA, 12 nt, Homo sapiens
agcagaaagcca

SEQ ID NO: 869165 - RNA, 23 nt, Homo sapiens
agcagagcugauggagaaggaag

SEQ ID NO: 869166 - RNA, 21 nt, Homo sapiens
agcagaugcaaucucuugucu

SEQ ID NO: 869167 - RNA, 21 nt, Homo sapiens
agcagaugguccuccauuuca

SEQ ID NO: 869168 - RNA, 22 nt, Homo sapiens
agcagcagugagcuucuauuaa

SEQ ID NO: 869169 - RNA, 15 nt, Homo sapiens
agcagcaucuucaaa

SEQ ID NO: 869170 - RNA, 19 nt, Homo sapiens
agcagcccccagguugccu

SEQ ID NO: 869171 - RNA, 15 nt, Homo sapiens
agccugggcaacaaa

SEQ ID NO: 869172 - RNA, 16 nt, Homo sapiens
agccugucacgugguc

SEQ ID NO: 869173 - RNA, 21 nt, Homo sapiens
agccuguccugguacagcagg

SEQ ID NO: 869174 - RNA, 13 nt, Homo sapiens
agccugucuuuca

SEQ ID NO: 869175 - RNA, 20 nt, Homo sapiens
agccugugaauaaaaacccu

SEQ ID NO: 869176 - RNA, 22 nt, Homo sapiens
agccuucucuguucauuuccuc

SEQ ID NO: 869177 - RNA, 17 nt, Homo sapiens
agccuucugacaagcaa

SEQ ID NO: 869178 - RNA, 13 nt, Homo sapiens
agccuuuccauaa

SEQ ID NO: 869179 - RNA, 22 nt, Homo sapiens
agcgaaauauuacaguagugca

SEQ ID NO: 869180 - RNA, 16 nt, Homo sapiens
agcgagcugcucugcu

SEQ ID NO: 869181 - RNA, 18 nt, Homo sapiens
agcgaugaauuuggagac

SEQ ID NO: 869182 - RNA, 19 nt, Homo sapiens
agcgcagguuuaguuuacu

SEQ ID NO: 869183 - RNA, 22 nt, Homo sapiens
agcgcagguuuaguuuacucaa

SEQ ID NO: 869184 - RNA, 18 nt, Homo sapiens
agcgguugcuucuggcuc

SEQ ID NO: 869185 - RNA, 16 nt, Homo sapiens
agcgugagccacugca

SEQ ID NO: 869186 - RNA, 14 nt, Homo sapiens
agcgugcucacuga

SEQ ID NO: 869187 - RNA, 23 nt, Homo sapiens
agcuaaggucacauugugccuuu

SEQ ID NO: 869188 - RNA, 12 nt, Homo sapiens
agcuaagugaaa

SEQ ID NO: 869189 - RNA, 18 nt, Homo sapiens
agcuacauuccucagcug

SEQ ID NO: 869190 - RNA, 21 nt, Homo sapiens
agcuaccucacuaugcugcuu

SEQ ID NO: 869191 - RNA, 23 nt, Homo sapiens
agcuacguauuuaauagcaaaga

SEQ ID NO: 869192 - RNA, 19 nt, Homo sapiens
agcuacucagaagccugag

SEQ ID NO: 869193 - RNA, 12 nt, Homo sapiens
agcuagaaggcc

SEQ ID NO: 869194 - RNA, 14 nt, Homo sapiens
agcuagaaggccac

SEQ ID NO: 869195 - RNA, 16 nt, Homo sapiens
agcuaucugucaucuc

SEQ ID NO: 869196 - RNA, 22 nt, Homo sapiens
agcuaugaaggcuguacacugc

SEQ ID NO: 869197 - RNA, 16 nt, Homo sapiens
agcuaugaucgcgcca

SEQ ID NO: 869198 - RNA, 14 nt, Homo sapiens
agcuauggccccag

SEQ ID NO: 869199 - RNA, 19 nt, Homo sapiens
agcucaagucuucccugau

SEQ ID NO: 869200 - RNA, 12 nt, Homo sapiens
agcucaccagcc

SEQ ID NO: 869201 - RNA, 19 nt, Homo sapiens
agcucagaggcccaggaau

SEQ ID NO: 869202 - RNA, 17 nt, Homo sapiens
agcucagccgugcacuc

SEQ ID NO: 869203 - RNA, 18 nt, Homo sapiens
agcucagccgugcacucc

SEQ ID NO: 869204 - RNA, 14 nt, Homo sapiens
agcucagccucccc

SEQ ID NO: 869205 - RNA, 14 nt, Homo sapiens
agcucaggcauuug

SEQ ID NO: 869206 - RNA, 18 nt, Homo sapiens
agcucaggugguccucuu

SEQ ID NO: 869207 - RNA, 22 nt, Homo sapiens
agcuccccaggacucacccuca

SEQ ID NO: 869208 - RNA, 14 nt, Homo sapiens
agcuccuugacucc

SEQ ID NO: 869209 - RNA, 12 nt, Homo sapiens
agcucugaucag

SEQ ID NO: 869210 - RNA, 22 nt, Homo sapiens
agcucuggccccaggcuuguca

SEQ ID NO: 869211 - RNA, 12 nt, Homo sapiens
agcucuguccac

SEQ ID NO: 869212 - RNA, 19 nt, Homo sapiens
agcucuguuuuacaauaaa

SEQ ID NO: 869213 - RNA, 23 nt, Homo sapiens
agcucuucgguuucugagcauaa

SEQ ID NO: 869214 - RNA, 22 nt, Homo sapiens
agcugaagcccaugcuuuccca

SEQ ID NO: 869215 - RNA, 16 nt, Homo sapiens
agcugacaccuggauu

SEQ ID NO: 869216 - RNA, 18 nt, Homo sapiens
agcugagaggaagaugaa

SEQ ID NO: 869217 - RNA, 14 nt, Homo sapiens
agcugcaccugcca

SEQ ID NO: 869218 - RNA, 15 nt, Homo sapiens
agcugcaccugccag

SEQ ID NO: 869219 - RNA, 23 nt, Homo sapiens
agcugcaugggugccugcugcug

SEQ ID NO: 869220 - RNA, 14 nt, Homo sapiens
agcugcuacaagaa

SEQ ID NO: 869221 - RNA, 13 nt, Homo sapiens
agcugcugaagag

SEQ ID NO: 869222 - RNA, 23 nt, Homo sapiens
agcugcuuccuccccuccuggca

SEQ ID NO: 869223 - RNA, 18 nt, Homo sapiens
agcuggaaauaaaccugg

SEQ ID NO: 869224 - RNA, 23 nt, Homo sapiens
agcuggaggacuagaaccuggag

SEQ ID NO: 869225 - RNA, 14 nt, Homo sapiens
agcuggcaaaggug

SEQ ID NO: 869226 - RNA, 17 nt, Homo sapiens
agcugggccccaugcuc

SEQ ID NO: 869227 - RNA, 13 nt, Homo sapiens
agcuggguggugu

SEQ ID NO: 869228 - RNA, 17 nt, Homo sapiens
agcuguagccauggcuc

SEQ ID NO: 869229 - RNA, 20 nt, Homo sapiens
agcuguauauauauaugugu

SEQ ID NO: 869230 - RNA, 21 nt, Homo sapiens
agcuguccuugagcuguccua

SEQ ID NO: 869231 - RNA, 13 nt, Homo sapiens
agcugucugcuca

SEQ ID NO: 869232 - RNA, 17 nt, Homo sapiens
agcuguguucacacugu

SEQ ID NO: 869233 - RNA, 14 nt, Homo sapiens
agcuguuuccauag

SEQ ID NO: 869234 - RNA, 14 nt, Homo sapiens
agcuuaaauugcuu

SEQ ID NO: 869235 - RNA, 13 nt, Homo sapiens
agcuuaccugaca

SEQ ID NO: 869236 - RNA, 17 nt, Homo sapiens
agcuuaccugacacaag

SEQ ID NO: 869237 - RNA, 18 nt, Homo sapiens
agcuuaccugacacaaga

SEQ ID NO: 869238 - RNA, 16 nt, Homo sapiens
agcuuauuaaaacuca

SEQ ID NO: 869239 - RNA, 18 nt, Homo sapiens
agcuucauuaugcagcug

SEQ ID NO: 869240 - RNA, 19 nt, Homo sapiens
agcuucauuuccgugaagg

SEQ ID NO: 869241 - RNA, 12 nt, Homo sapiens
agcuuccaugag

SEQ ID NO: 869242 - RNA, 18 nt, Homo sapiens
agcuucucugaugugaua

SEQ ID NO: 869243 - RNA, 17 nt, Homo sapiens
agcuugaaagcaguuaa

SEQ ID NO: 869244 - RNA, 14 nt, Homo sapiens
agcuuggacagucu

SEQ ID NO: 869245 - RNA, 14 nt, Homo sapiens
agcuuggagggaug

SEQ ID NO: 869246 - RNA, 15 nt, Homo sapiens
agcuuggagggaugg

SEQ ID NO: 869247 - RNA, 20 nt, Homo sapiens
agcuugucugaucguucaaa

SEQ ID NO: 869248 - RNA, 13 nt, Homo sapiens
agcuuucucaggg

SEQ ID NO: 869249 - RNA, 12 nt, Homo sapiens
agcuuucugucc

SEQ ID NO: 869250 - RNA, 13 nt, Homo sapiens
agcuuugcaggau

SEQ ID NO: 869251 - RNA, 21 nt, Homo sapiens
agcuuuucccaggagaccauu

SEQ ID NO: 869252 - RNA, 14 nt, Homo sapiens
agcuuuugcuucau

SEQ ID NO: 869253 - RNA, 15 nt, Homo sapiens
aggaaaaacaaacua

SEQ ID NO: 869254 - RNA, 20 nt, Homo sapiens
aggaaaaaccaauagcuuua

SEQ ID NO: 869255 - RNA, 20 nt, Homo sapiens
aggaaaaucuuaaaauucuu

SEQ ID NO: 869256 - RNA, 20 nt, Homo sapiens
aggaaaccuggcauggugcu

SEQ ID NO: 869257 - RNA, 22 nt, Homo sapiens
aggaaaccuggcauggugcuuu

SEQ ID NO: 869258 - RNA, 20 nt, Homo sapiens
aggaaagaauuugccuucuc

SEQ ID NO: 869259 - RNA, 17 nt, Homo sapiens
aggaaagcacacaguca

SEQ ID NO: 869260 - RNA, 21 nt, Homo sapiens
aggaaagccucacugauauau

SEQ ID NO: 869261 - RNA, 23 nt, Homo sapiens
aggaaagggauaguccaaagacu

SEQ ID NO: 869262 - RNA, 22 nt, Homo sapiens
aggaaaucaaauaugcaaagca

SEQ ID NO: 869263 - RNA, 20 nt, Homo sapiens
aggaaauuaaagucuuccau

SEQ ID NO: 869264 - RNA, 15 nt, Homo sapiens
aggaacaagagaaaa

SEQ ID NO: 869265 - RNA, 19 nt, Homo sapiens
aggaacagagacucuggaa

SEQ ID NO: 869266 - RNA, 14 nt, Homo sapiens
aggaacagaguaua

SEQ ID NO: 869267 - RNA, 12 nt, Homo sapiens
aggaaccuacca

SEQ ID NO: 869268 - RNA, 12 nt, Homo sapiens
aggaacucuggc

SEQ ID NO: 869269 - RNA, 14 nt, Homo sapiens
aggaagaagccaga

SEQ ID NO: 869270 - RNA, 12 nt, Homo sapiens
aggaagauuccc

SEQ ID NO: 869271 - RNA, 21 nt, Homo sapiens
aggaaggaaagaaagaaggaa

SEQ ID NO: 869272 - RNA, 23 nt, Homo sapiens
aggaaggugcuugccugggacca

SEQ ID NO: 869273 - RNA, 15 nt, Homo sapiens
aggaagucaccaaaa

SEQ ID NO: 869274 - RNA, 12 nt, Homo sapiens
aggaaguggcug

SEQ ID NO: 869275 - RNA, 17 nt, Homo sapiens
aggaaguucaacuucca

SEQ ID NO: 869276 - RNA, 14 nt, Homo sapiens
aggaauacauuugg

SEQ ID NO: 869277 - RNA, 22 nt, Homo sapiens
aggaaucggaauccugucgauu

SEQ ID NO: 869278 - RNA, 12 nt, Homo sapiens
aggaaucugcca

SEQ ID NO: 869279 - RNA, 17 nt, Homo sapiens
aggaauguccagacugu

SEQ ID NO: 869280 - RNA, 16 nt, Homo sapiens
aggaauucuaggcauc

SEQ ID NO: 869281 - RNA, 18 nt, Homo sapiens
aggacaaccauuccagac

SEQ ID NO: 869282 - RNA, 16 nt, Homo sapiens
aggacaccagccuggu

SEQ ID NO: 869283 - RNA, 19 nt, Homo sapiens
aggacaccagccuggugcc

SEQ ID NO: 869284 - RNA, 19 nt, Homo sapiens
aggaccaauguugugauua

SEQ ID NO: 869285 - RNA, 14 nt, Homo sapiens
aggaccuccgggga

SEQ ID NO: 869286 - RNA, 15 nt, Homo sapiens
agggcacucacaugc

SEQ ID NO: 869287 - RNA, 17 nt, Homo sapiens
agggcacucacaugccg

SEQ ID NO: 869288 - RNA, 15 nt, Homo sapiens
agggcagagccaugg

SEQ ID NO: 869289 - RNA, 23 nt, Homo sapiens
agggcagccaggggcugcucauc

SEQ ID NO: 869290 - RNA, 20 nt, Homo sapiens
agggcagucaguaguauucu

SEQ ID NO: 869291 - RNA, 18 nt, Homo sapiens
agggccagcucacaagcc

SEQ ID NO: 869292 - RNA, 16 nt, Homo sapiens
agggccccuguucccc

SEQ ID NO: 869293 - RNA, 14 nt, Homo sapiens
agggccucugggag

SEQ ID NO: 869294 - RNA, 17 nt, Homo sapiens
agggcuagaaccuggaa

SEQ ID NO: 869295 - RNA, 19 nt, Homo sapiens
agggcuccagcauccagcc

SEQ ID NO: 869296 - RNA, 18 nt, Homo sapiens
agggcugcgagcauuucc

SEQ ID NO: 869297 - RNA, 19 nt, Homo sapiens
agggcuggagggacaggga

SEQ ID NO: 869298 - RNA, 15 nt, Homo sapiens
agggcuuauggccag

SEQ ID NO: 869299 - RNA, 17 nt, Homo sapiens
aggggaaggccuuuuca

SEQ ID NO: 869300 - RNA, 22 nt, Homo sapiens
aggggaagggccagucugggcu

SEQ ID NO: 869301 - RNA, 13 nt, Homo sapiens
aggggacauuucc

SEQ ID NO: 869302 - RNA, 10 nt, Homo sapiens
aggggaccau

SEQ ID NO: 869303 - RNA, 20 nt, Homo sapiens
aggggagcaacagaggacau

SEQ ID NO: 869304 - RNA, 12 nt, Homo sapiens
aggggcaaagaa

SEQ ID NO: 869305 - RNA, 20 nt, Homo sapiens
aggggcaaagaaaagccaga

SEQ ID NO: 869306 - RNA, 16 nt, Homo sapiens
aggggcaccugggaaa

SEQ ID NO: 869307 - RNA, 14 nt, Homo sapiens
aggggcccacaggg

SEQ ID NO: 869308 - RNA, 12 nt, Homo sapiens
aggggcugucca

SEQ ID NO: 869309 - RNA, 16 nt, Homo sapiens
agggggaacaaaucac

SEQ ID NO: 869310 - RNA, 21 nt, Homo sapiens
agggggccuuuaaagacuuaa

SEQ ID NO: 869311 - RNA, 21 nt, Homo sapiens
agggggugucuggaagcugag

SEQ ID NO: 869312 - RNA, 23 nt, Homo sapiens
aggggugcuaugacaugcaagug

SEQ ID NO: 869313 - RNA, 22 nt, Homo sapiens
aggggugggagagccagcucuc

SEQ ID NO: 869314 - RNA, 20 nt, Homo sapiens
aggguaucaggugcugccau

SEQ ID NO: 869315 - RNA, 20 nt, Homo sapiens
aggguccugaguggcugaaa

SEQ ID NO: 869316 - RNA, 11 nt, Homo sapiens
agggugacugu

SEQ ID NO: 869317 - RNA, 16 nt, Homo sapiens
agggugcuaacguauc

SEQ ID NO: 869318 - RNA, 22 nt, Homo sapiens
agggugggggagggagguuccu

SEQ ID NO: 869319 - RNA, 23 nt, Homo sapiens
agggugggguaaccaaauguugg

SEQ ID NO: 869320 - RNA, 13 nt, Homo sapiens
aggguggugaccu

SEQ ID NO: 869321 - RNA, 19 nt, Homo sapiens
aggguguaucuagcucuag

SEQ ID NO: 869322 - RNA, 13 nt, Homo sapiens
aggguuacuaugc

SEQ ID NO: 869323 - RNA, 22 nt, Homo sapiens
agguaaaucuaguuuacuuccu

SEQ ID NO: 869324 - RNA, 22 nt, Homo sapiens
agguaaugauuauguguccuuu

SEQ ID NO: 869325 - RNA, 19 nt, Homo sapiens
agguagacauggauuugau

SEQ ID NO: 869326 - RNA, 17 nt, Homo sapiens
agguagcccagcacugu

SEQ ID NO: 869327 - RNA, 15 nt, Homo sapiens
agguaguacugggaa

SEQ ID NO: 869328 - RNA, 12 nt, Homo sapiens
agguaugggaga

SEQ ID NO: 869329 - RNA, 15 nt, Homo sapiens
aggucaaaacauuca

SEQ ID NO: 869330 - RNA, 14 nt, Homo sapiens
aggucaacaucuaa

SEQ ID NO: 869331 - RNA, 22 nt, Homo sapiens
aggucagagccugcaguuauua

SEQ ID NO: 869332 - RNA, 14 nt, Homo sapiens
aggucagcgugcuu

SEQ ID NO: 869333 - RNA, 15 nt, Homo sapiens
aggucagcgugcuua

SEQ ID NO: 869334 - RNA, 15 nt, Homo sapiens
aggucaggaguucga

SEQ ID NO: 869335 - RNA, 13 nt, Homo sapiens
agguccaccugcg

SEQ ID NO: 869336 - RNA, 17 nt, Homo sapiens
aggucccagagggugga

SEQ ID NO: 869337 - RNA, 13 nt, Homo sapiens
agguccuccucuc

SEQ ID NO: 869338 - RNA, 14 nt, Homo sapiens
agguccuccucucu

SEQ ID NO: 869339 - RNA, 21 nt, Homo sapiens
agguccugaaagucugugucc

SEQ ID NO: 869340 - RNA, 15 nt, Homo sapiens
agguccugcauuucu

SEQ ID NO: 869341 - RNA, 12 nt, Homo sapiens
aggucuccauca

SEQ ID NO: 869342 - RNA, 22 nt, Homo sapiens
aggucuccaucauggcagugau

SEQ ID NO: 869343 - RNA, 15 nt, Homo sapiens
aggucuugccugaau

SEQ ID NO: 869344 - RNA, 21 nt, Homo sapiens
aggugacuggagcccgagggc

SEQ ID NO: 869345 - RNA, 19 nt, Homo sapiens
aggugaugguaacugcaca

SEQ ID NO: 869346 - RNA, 20 nt, Homo sapiens
aggugccuuguaaacaugaa

SEQ ID NO: 869347 - RNA, 18 nt, Homo sapiens
aggugcuacaaaaacaca

SEQ ID NO: 869348 - RNA, 19 nt, Homo sapiens
aggugcuaucgcaccacug

SEQ ID NO: 869349 - RNA, 14 nt, Homo sapiens
aggugcugacaaag

SEQ ID NO: 869350 - RNA, 22 nt, Homo sapiens
aggugcugacaaagaugaccug

SEQ ID NO: 869351 - RNA, 13 nt, Homo sapiens
agguggacagucc

SEQ ID NO: 869352 - RNA, 20 nt, Homo sapiens
agguggguuuguaccuuccu

SEQ ID NO: 869353 - RNA, 19 nt, Homo sapiens
aggugucccaagcuuugaa

SEQ ID NO: 869354 - RNA, 15 nt, Homo sapiens
aggugucugcaccca

SEQ ID NO: 869355 - RNA, 21 nt, Homo sapiens
aggugucugcacccaggggug

SEQ ID NO: 869356 - RNA, 17 nt, Homo sapiens
aggugucuuaagccuuu

SEQ ID NO: 869357 - RNA, 16 nt, Homo sapiens
agguguugccauuucu

SEQ ID NO: 869358 - RNA, 21 nt, Homo sapiens
agguuacccuguaacaugcaa

SEQ ID NO: 869359 - RNA, 19 nt, Homo sapiens
agguuaucaaccauaugaa

SEQ ID NO: 869360 - RNA, 19 nt, Homo sapiens
agguucuucuaaaauugaa

SEQ ID NO: 869361 - RNA, 12 nt, Homo sapiens
agguucuugaua

SEQ ID NO: 869362 - RNA, 22 nt, Homo sapiens
agguucuugaugucauguacuu

SEQ ID NO: 869363 - RNA, 16 nt, Homo sapiens
agguugaagaaugaga

SEQ ID NO: 869364 - RNA, 14 nt, Homo sapiens
agguuggugacuga

SEQ ID NO: 869365 - RNA, 14 nt, Homo sapiens
agguuuacauucau

SEQ ID NO: 869366 - RNA, 20 nt, Homo sapiens
agguuucaccugaucauaua

SEQ ID NO: 869367 - RNA, 19 nt, Homo sapiens
agguuuccuuccuucgcag

SEQ ID NO: 869368 - RNA, 15 nt, Homo sapiens
agguuugcccugccu

SEQ ID NO: 869369 - RNA, 22 nt, Homo sapiens
agguuuuuggucugacccacug

SEQ ID NO: 869370 - RNA, 18 nt, Homo sapiens
aguaaacuuucucugcaa

SEQ ID NO: 869371 - RNA, 20 nt, Homo sapiens
aguaacuuaaccagcacauu

SEQ ID NO: 869372 - RNA, 20 nt, Homo sapiens
aguaagguuauaacuguggc

SEQ ID NO: 869373 - RNA, 21 nt, Homo sapiens
aguaagguuauaacuguggcu

SEQ ID NO: 869374 - RNA, 12 nt, Homo sapiens
aguaaguacaaa

SEQ ID NO: 869375 - RNA, 18 nt, Homo sapiens
aguaaguacaaauauucc

SEQ ID NO: 869376 - RNA, 21 nt, Homo sapiens
aguaaguaccacucaggccaa

SEQ ID NO: 869377 - RNA, 19 nt, Homo sapiens
aguaaucaaguuaaaaccu

SEQ ID NO: 869378 - RNA, 15 nt, Homo sapiens
aguaaugcaaauuaa

SEQ ID NO: 869379 - RNA, 16 nt, Homo sapiens
aguaaugcacucucag

SEQ ID NO: 869380 - RNA, 13 nt, Homo sapiens
aguaauuguaagu

SEQ ID NO: 869381 - RNA, 13 nt, Homo sapiens
aguacaaccugaa

SEQ ID NO: 869382 - RNA, 15 nt, Homo sapiens
aguacagacgucuca

SEQ ID NO: 869383 - RNA, 19 nt, Homo sapiens
aguacagauguaaaugcca

SEQ ID NO: 869384 - RNA, 15 nt, Homo sapiens
aguaccacucaggcc

SEQ ID NO: 869385 - RNA, 13 nt, Homo sapiens
aguaccagugugc

SEQ ID NO: 869386 - RNA, 15 nt, Homo sapiens
aguacuccugcaaaa

SEQ ID NO: 869387 - RNA, 15 nt, Homo sapiens
aguacucuuaacucc

SEQ ID NO: 869388 - RNA, 22 nt, Homo sapiens
aguacucuuaacuccuagccca

SEQ ID NO: 869389 - RNA, 22 nt, Homo sapiens
aguagaagauuuuaugcugcug

SEQ ID NO: 869390 - RNA, 18 nt, Homo sapiens
aguagacuauaagcagaa

SEQ ID NO: 869391 - RNA, 19 nt, Homo sapiens
aguagcaaguucuagagaa

SEQ ID NO: 869392 - RNA, 14 nt, Homo sapiens
aguagcugagcuca

SEQ ID NO: 869393 - RNA, 14 nt, Homo sapiens
aguaggagcaagag

SEQ ID NO: 869394 - RNA, 14 nt, Homo sapiens
aguagugcauuuaa

SEQ ID NO: 869395 - RNA, 18 nt, Homo sapiens
aguagugcccacuugagg

SEQ ID NO: 869396 - RNA, 14 nt, Homo sapiens
aguagugucuuccu

SEQ ID NO: 869397 - RNA, 20 nt, Homo sapiens
aguaguuucucuguaaggca

SEQ ID NO: 869398 - RNA, 15 nt, Homo sapiens
aguauaauuaauaga

SEQ ID NO: 869399 - RNA, 15 nt, Homo sapiens
aguauauaguauauu

SEQ ID NO: 869400 - RNA, 21 nt, Homo sapiens
aguauauuuauagucacaaga

SEQ ID NO: 869401 - RNA, 22 nt, Homo sapiens
cagcugcagucaacaguucaaa

SEQ ID NO: 869402 - RNA, 17 nt, Homo sapiens
cagcugcaucuacucag

SEQ ID NO: 869403 - RNA, 14 nt, Homo sapiens
cagcugcugaagag

SEQ ID NO: 869404 - RNA, 18 nt, Homo sapiens
cagcugcuuguugucaag

SEQ ID NO: 869405 - RNA, 21 nt, Homo sapiens
cagcugggugguguacaagca

SEQ ID NO: 869406 - RNA, 16 nt, Homo sapiens
cagcuggucuuuauuc

SEQ ID NO: 869407 - RNA, 11 nt, Homo sapiens
cagcugucauc

SEQ ID NO: 869408 - RNA, 16 nt, Homo sapiens
cagcugucuguggcuu

SEQ ID NO: 869409 - RNA, 23 nt, Homo sapiens
cagcuguguucacacuguaaaca

SEQ ID NO: 869410 - RNA, 15 nt, Homo sapiens
cagcuucaucaauuu

SEQ ID NO: 869411 - RNA, 22 nt, Homo sapiens
cagcuucaucaauuuuuauaca

SEQ ID NO: 869412 - RNA, 21 nt, Homo sapiens
cagcuucauuaugcagcugag

SEQ ID NO: 869413 - RNA, 17 nt, Homo sapiens
cagcuucauuuccguga

SEQ ID NO: 869414 - RNA, 18 nt, Homo sapiens
cagcuucuucaucuuuaa

SEQ ID NO: 869415 - RNA, 19 nt, Homo sapiens
cagcuuguaaauagcucag

SEQ ID NO: 869416 - RNA, 20 nt, Homo sapiens
caggaaaccaacacccaaag

SEQ ID NO: 869417 - RNA, 15 nt, Homo sapiens
caggaacagaaggau

SEQ ID NO: 869418 - RNA, 16 nt, Homo sapiens
caggaaggacuaugaa

SEQ ID NO: 869419 - RNA, 15 nt, Homo sapiens
caggaaggacugugc

SEQ ID NO: 869420 - RNA, 22 nt, Homo sapiens
caggaagguagcccagcacugu

SEQ ID NO: 869421 - RNA, 14 nt, Homo sapiens
caggaaguacucau

SEQ ID NO: 869422 - RNA, 14 nt, Homo sapiens
caggaauacauuug

SEQ ID NO: 869423 - RNA, 16 nt, Homo sapiens
caggaaucaugaucug

SEQ ID NO: 869424 - RNA, 15 nt, Homo sapiens
caggaaucucagaga

SEQ ID NO: 869425 - RNA, 13 nt, Homo sapiens
caggaaucugcca

SEQ ID NO: 869426 - RNA, 20 nt, Homo sapiens
caggacacaggccuguguag

SEQ ID NO: 869427 - RNA, 13 nt, Homo sapiens
caggacaccugcc

SEQ ID NO: 869428 - RNA, 15 nt, Homo sapiens
caggacggaauauag

SEQ ID NO: 869429 - RNA, 17 nt, Homo sapiens
caggacuugaacccagg

SEQ ID NO: 869430 - RNA, 17 nt, Homo sapiens
caggacuuggucugauu

SEQ ID NO: 869431 - RNA, 21 nt, Homo sapiens
caggacuuugaugcauuucca

SEQ ID NO: 869432 - RNA, 14 nt, Homo sapiens
caggagacauuggu

SEQ ID NO: 869433 - RNA, 18 nt, Homo sapiens
caggagcaggaacagaga

SEQ ID NO: 869434 - RNA, 20 nt, Homo sapiens
caggaggcggagguugcagu

SEQ ID NO: 869435 - RNA, 17 nt, Homo sapiens
caggaggugcuaucgca

SEQ ID NO: 869436 - RNA, 18 nt, Homo sapiens
caggagguuggugacuga

SEQ ID NO: 869437 - RNA, 19 nt, Homo sapiens
caggaguagcugagcucac

SEQ ID NO: 869438 - RNA, 20 nt, Homo sapiens
caggaguaucuuaccuguaa

SEQ ID NO: 869439 - RNA, 22 nt, Homo sapiens
caggaucaaaccccgaccaccu

SEQ ID NO: 869440 - RNA, 14 nt, Homo sapiens
caggaucugaguua

SEQ ID NO: 869441 - RNA, 21 nt, Homo sapiens
caggauggggacacuaaugaa

SEQ ID NO: 869442 - RNA, 12 nt, Homo sapiens
caggauucauug

SEQ ID NO: 869443 - RNA, 15 nt, Homo sapiens
caggauugacaggcc

SEQ ID NO: 869444 - RNA, 14 nt, Homo sapiens
caggcaaacuugca

SEQ ID NO: 869445 - RNA, 13 nt, Homo sapiens
caggcagccccac

SEQ ID NO: 869446 - RNA, 19 nt, Homo sapiens
caggcauggcgaggcugag

SEQ ID NO: 869447 - RNA, 23 nt, Homo sapiens
caggcauuugaggcugucgugag

SEQ ID NO: 869448 - RNA, 14 nt, Homo sapiens
caggccaccaggau

SEQ ID NO: 869449 - RNA, 23 nt, Homo sapiens
caggccagggaaagcccguguca

SEQ ID NO: 869450 - RNA, 15 nt, Homo sapiens
caggccauccauuca

SEQ ID NO: 869451 - RNA, 18 nt, Homo sapiens
caggccauccauucacag

SEQ ID NO: 869452 - RNA, 13 nt, Homo sapiens
caggccccaugac

SEQ ID NO: 869453 - RNA, 16 nt, Homo sapiens
caggcccugccuucag

SEQ ID NO: 869454 - RNA, 21 nt, Homo sapiens
caggcccuuccucuccacugc

SEQ ID NO: 869455 - RNA, 17 nt, Homo sapiens
caggccgccugccauac

SEQ ID NO: 869456 - RNA, 22 nt, Homo sapiens
caggccuguguagcugugaccu

SEQ ID NO: 869457 - RNA, 21 nt, Homo sapiens
caggccuuaauuuucaguaua

SEQ ID NO: 869458 - RNA, 17 nt, Homo sapiens
caggcuacugucagcuc

SEQ ID NO: 869459 - RNA, 14 nt, Homo sapiens
caggcucggagcca

SEQ ID NO: 869460 - RNA, 21 nt, Homo sapiens
caggcucuggagccagagaga

SEQ ID NO: 869461 - RNA, 14 nt, Homo sapiens
caggcuggagccca

SEQ ID NO: 869462 - RNA, 17 nt, Homo sapiens
caggcuggagugcagua

SEQ ID NO: 869463 - RNA, 22 nt, Homo sapiens
caggcuguaagcauucugagcu

SEQ ID NO: 869464 - RNA, 17 nt, Homo sapiens
caggcuugucacuagca

SEQ ID NO: 869465 - RNA, 22 nt, Homo sapiens
cagggaacccugcuugcacuuu

SEQ ID NO: 869466 - RNA, 13 nt, Homo sapiens
cagggaagaaggu

SEQ ID NO: 869467 - RNA, 16 nt, Homo sapiens
cagggaagagggcagu

SEQ ID NO: 869468 - RNA, 21 nt, Homo sapiens
cagggacaaaacacugugucc

SEQ ID NO: 869469 - RNA, 11 nt, Homo sapiens
cagggacccac

SEQ ID NO: 869470 - RNA, 15 nt, Homo sapiens
cagggagacugcauc

SEQ ID NO: 869471 - RNA, 23 nt, Homo sapiens
cagggagcaacucuccacuccau

SEQ ID NO: 869472 - RNA, 14 nt, Homo sapiens
cagggaggugaccc

SEQ ID NO: 869473 - RNA, 20 nt, Homo sapiens
cagggaugccaacaccuucu

SEQ ID NO: 869474 - RNA, 23 nt, Homo sapiens
cagggcaaaugacaugcacugac

SEQ ID NO: 869475 - RNA, 17 nt, Homo sapiens
cagggcaaaugcuugau

SEQ ID NO: 869476 - RNA, 16 nt, Homo sapiens
cagggcagaaaacaca

SEQ ID NO: 869477 - RNA, 18 nt, Homo sapiens
cagggcaggcuugccacc

SEQ ID NO: 869478 - RNA, 21 nt, Homo sapiens
cagggcccugcagaggggaaa

SEQ ID NO: 869479 - RNA, 14 nt, Homo sapiens
cagggccucaaagu

SEQ ID NO: 869480 - RNA, 20 nt, Homo sapiens
cagggccucugggagccuga

SEQ ID NO: 869481 - RNA, 13 nt, Homo sapiens
cagggcucugccc

SEQ ID NO: 869482 - RNA, 23 nt, Homo sapiens
cagggcuggaaaagucacacaga

SEQ ID NO: 869483 - RNA, 16 nt, Homo sapiens
caggggccucagggga

SEQ ID NO: 869484 - RNA, 20 nt, Homo sapiens
caggggccugcccagugcac

SEQ ID NO: 869485 - RNA, 13 nt, Homo sapiens
caggggcugcuca

SEQ ID NO: 869486 - RNA, 17 nt, Homo sapiens
caggguauuaauaugcu

SEQ ID NO: 869487 - RNA, 17 nt, Homo sapiens
cagggucucacuauguu

SEQ ID NO: 869488 - RNA, 19 nt, Homo sapiens
cagggucucacucugucgc

SEQ ID NO: 869489 - RNA, 21 nt, Homo sapiens
cagggucucacucugucgccc

SEQ ID NO: 869490 - RNA, 15 nt, Homo sapiens
cagggugagugaaug

SEQ ID NO: 869491 - RNA, 22 nt, Homo sapiens
caggguguuaaggcagugacuu

SEQ ID NO: 869492 - RNA, 20 nt, Homo sapiens
caggguuuugccauguuggc

SEQ ID NO: 869493 - RNA, 21 nt, Homo sapiens
caggguuuugccauguuggcc

SEQ ID NO: 869494 - RNA, 13 nt, Homo sapiens
caggguuuuuaga

SEQ ID NO: 869495 - RNA, 22 nt, Homo sapiens
cagguaggcccuuguccugcca

SEQ ID NO: 869496 - RNA, 16 nt, Homo sapiens
cagguaguacugggaa

SEQ ID NO: 869497 - RNA, 21 nt, Homo sapiens
caggucaacuucagagacuau

SEQ ID NO: 869498 - RNA, 19 nt, Homo sapiens
caggucauuauuuuuuaca

SEQ ID NO: 869499 - RNA, 14 nt, Homo sapiens
caggugagcaauua

SEQ ID NO: 869500 - RNA, 22 nt, Homo sapiens
caggugagcaauuagauuagua

SEQ ID NO: 869501 - RNA, 22 nt, Homo sapiens
caggugauccacccaccuuggc

SEQ ID NO: 869502 - RNA, 20 nt, Homo sapiens
caggugcaagccacuauguc

SEQ ID NO: 869503 - RNA, 20 nt, Homo sapiens
cagguggacacacaaggugc

SEQ ID NO: 869504 - RNA, 13 nt, Homo sapiens
cagguguaccucc

SEQ ID NO: 869505 - RNA, 16 nt, Homo sapiens
caggugugaaccacca

SEQ ID NO: 869506 - RNA, 14 nt, Homo sapiens
caggugugagucac

SEQ ID NO: 869507 - RNA, 17 nt, Homo sapiens
cagguuccaucccgaaa

SEQ ID NO: 869508 - RNA, 18 nt, Homo sapiens
caguaaauccacagccaa

SEQ ID NO: 869509 - RNA, 21 nt, Homo sapiens
caguaacauuuggagugugua

SEQ ID NO: 869510 - RNA, 17 nt, Homo sapiens
caguaagcuaucuucaa

SEQ ID NO: 869511 - RNA, 16 nt, Homo sapiens
caguaaugcaaauuaa

SEQ ID NO: 869512 - RNA, 19 nt, Homo sapiens
caguacaugggaaaggagg

SEQ ID NO: 869513 - RNA, 18 nt, Homo sapiens
caguaggaacuguacaug

SEQ ID NO: 869514 - RNA, 20 nt, Homo sapiens
caguaggcaguagacuauaa

SEQ ID NO: 869515 - RNA, 20 nt, Homo sapiens
cauauggacucugcacauga

SEQ ID NO: 869516 - RNA, 17 nt, Homo sapiens
cauauguaccauguaca

SEQ ID NO: 869517 - RNA, 22 nt, Homo sapiens
cauauguauuuugucauaugua

SEQ ID NO: 869518 - RNA, 19 nt, Homo sapiens
cauauucccacagcacuaa

SEQ ID NO: 869519 - RNA, 17 nt, Homo sapiens
cauauucuguucacuug

SEQ ID NO: 869520 - RNA, 21 nt, Homo sapiens
cauauuggacugauaaucucu

SEQ ID NO: 869521 - RNA, 22 nt, Homo sapiens
cauauuggcaguuggaggacac

SEQ ID NO: 869522 - RNA, 14 nt, Homo sapiens
cauauuuguuaaau

SEQ ID NO: 869523 - RNA, 19 nt, Homo sapiens
caucaaauauuaccaaaaa

SEQ ID NO: 869524 - RNA, 20 nt, Homo sapiens
caucaaauauuaccaaaaaa

SEQ ID NO: 869525 - RNA, 21 nt, Homo sapiens
caucaacaaagaaauauuauu

SEQ ID NO: 869526 - RNA, 17 nt, Homo sapiens
caucaagagacugaguc

SEQ ID NO: 869527 - RNA, 14 nt, Homo sapiens
caucaauaucacaa

SEQ ID NO: 869528 - RNA, 16 nt, Homo sapiens
caucaauuuuuauaca

SEQ ID NO: 869529 - RNA, 12 nt, Homo sapiens
caucacaacauu

SEQ ID NO: 869530 - RNA, 19 nt, Homo sapiens
caucacuacaguacaguga

SEQ ID NO: 869531 - RNA, 14 nt, Homo sapiens
caucacuuugccaa

SEQ ID NO: 869532 - RNA, 17 nt, Homo sapiens
caucagagugacaucca

SEQ ID NO: 869533 - RNA, 19 nt, Homo sapiens
caucagcagagaacuggaa

SEQ ID NO: 869534 - RNA, 14 nt, Homo sapiens
caucagcauaccuu

SEQ ID NO: 869535 - RNA, 20 nt, Homo sapiens
caucagcuugcccuguuaaa

SEQ ID NO: 869536 - RNA, 21 nt, Homo sapiens
caucaguguccucuugcucaa

SEQ ID NO: 869537 - RNA, 16 nt, Homo sapiens
caucauauuguaugua

SEQ ID NO: 869538 - RNA, 11 nt, Homo sapiens
caucaucccag

SEQ ID NO: 869539 - RNA, 15 nt, Homo sapiens
caucauggcagugau

SEQ ID NO: 869540 - RNA, 16 nt, Homo sapiens
caucaugugccuggaa

SEQ ID NO: 869541 - RNA, 13 nt, Homo sapiens
caucauuccuuga

SEQ ID NO: 869542 - RNA, 18 nt, Homo sapiens
cauccaaggagaaacaga

SEQ ID NO: 869543 - RNA, 22 nt, Homo sapiens
cauccaaugcauaguuuguuca

SEQ ID NO: 869544 - RNA, 22 nt, Homo sapiens
cauccaauucuuugaauuuccc

SEQ ID NO: 869545 - RNA, 19 nt, Homo sapiens
cauccauaaagcaagcuca

SEQ ID NO: 869546 - RNA, 20 nt, Homo sapiens
cauccaucaggguuugcaaa

SEQ ID NO: 869547 - RNA, 22 nt, Homo sapiens
cauccaucccuuaggugagcuu

SEQ ID NO: 869548 - RNA, 13 nt, Homo sapiens
cauccaucugugg

SEQ ID NO: 869549 - RNA, 12 nt, Homo sapiens
cauccauuucag

SEQ ID NO: 869550 - RNA, 12 nt, Homo sapiens
caucccaaagga

SEQ ID NO: 869551 - RNA, 15 nt, Homo sapiens
caucccaagccagaa

SEQ ID NO: 869552 - RNA, 17 nt, Homo sapiens
caucccagcugcuccca

SEQ ID NO: 869553 - RNA, 15 nt, Homo sapiens
caucccaucaucuug

SEQ ID NO: 869554 - RNA, 13 nt, Homo sapiens
caucccaucuaag

SEQ ID NO: 869555 - RNA, 15 nt, Homo sapiens
cauccccagccagaa

SEQ ID NO: 869556 - RNA, 15 nt, Homo sapiens
cauccucaaagcccc

SEQ ID NO: 869557 - RNA, 20 nt, Homo sapiens
cauccuggcuaacacgugaa

SEQ ID NO: 869558 - RNA, 16 nt, Homo sapiens
cauccuucaucuggau

SEQ ID NO: 869559 - RNA, 16 nt, Homo sapiens
caucuacaagcauuug

SEQ ID NO: 869560 - RNA, 20 nt, Homo sapiens
caucucacuuugccccaguu

SEQ ID NO: 869561 - RNA, 12 nt, Homo sapiens
caucucagccua

SEQ ID NO: 869562 - RNA, 19 nt, Homo sapiens
caucucaggccucccucaa

SEQ ID NO: 869563 - RNA, 16 nt, Homo sapiens
caucucauuccaacuu

SEQ ID NO: 869564 - RNA, 12 nt, Homo sapiens
caucuccagugg

SEQ ID NO: 869565 - RNA, 14 nt, Homo sapiens
caucucucuuuaau

SEQ ID NO: 869566 - RNA, 16 nt, Homo sapiens
caucucuuucugcaaa

SEQ ID NO: 869567 - RNA, 12 nt, Homo sapiens
caucucuuugau

SEQ ID NO: 869568 - RNA, 21 nt, Homo sapiens
caucugacaugcaucaucuca

SEQ ID NO: 869569 - RNA, 15 nt, Homo sapiens
caucugacucacaag

SEQ ID NO: 869570 - RNA, 13 nt, Homo sapiens
caucugagcuccu

SEQ ID NO: 869571 - RNA, 15 nt, Homo sapiens
caucugcagcucuuu

SEQ ID NO: 869572 - RNA, 16 nt, Homo sapiens
caucugccucuauuca

SEQ ID NO: 869573 - RNA, 16 nt, Homo sapiens
caucugugucucugga

SEQ ID NO: 869574 - RNA, 13 nt, Homo sapiens
caucuguucauuc

SEQ ID NO: 869575 - RNA, 20 nt, Homo sapiens
caucuuacaaaaacaagaca

SEQ ID NO: 869576 - RNA, 15 nt, Homo sapiens
caucuucuccaucug

SEQ ID NO: 869577 - RNA, 23 nt, Homo sapiens
caucuugcucugcugacagacac

SEQ ID NO: 869578 - RNA, 15 nt, Homo sapiens
caugaaaaacacggc

SEQ ID NO: 869579 - RNA, 19 nt, Homo sapiens
caugaaaauagcucuuuca

SEQ ID NO: 869580 - RNA, 13 nt, Homo sapiens
caugaaaucugag

SEQ ID NO: 869581 - RNA, 16 nt, Homo sapiens
caugaaaucugaggaa

SEQ ID NO: 869582 - RNA, 22 nt, Homo sapiens
caugaacaucuuuaggagacua

SEQ ID NO: 869583 - RNA, 22 nt, Homo sapiens
caugaacuauuuacauuuucca

SEQ ID NO: 869584 - RNA, 21 nt, Homo sapiens
caugaaggugucauacagauu

SEQ ID NO: 869585 - RNA, 22 nt, Homo sapiens
caugaaucccacccacauguga

SEQ ID NO: 869586 - RNA, 16 nt, Homo sapiens
caugaauuauuuccag

SEQ ID NO: 869587 - RNA, 18 nt, Homo sapiens
caugaauucuuaugcuua

SEQ ID NO: 869588 - RNA, 16 nt, Homo sapiens
caugacaaaguuacaa

SEQ ID NO: 869589 - RNA, 18 nt, Homo sapiens
caugacacucuagugacu

SEQ ID NO: 869590 - RNA, 11 nt, Homo sapiens
caugacacuga

SEQ ID NO: 869591 - RNA, 13 nt, Homo sapiens
caugacacugacc

SEQ ID NO: 869592 - RNA, 17 nt, Homo sapiens
caugacagccagagccu

SEQ ID NO: 869593 - RNA, 18 nt, Homo sapiens
caugaccagaaacaggga

SEQ ID NO: 869594 - RNA, 13 nt, Homo sapiens
caugaccuggaaa

SEQ ID NO: 869595 - RNA, 20 nt, Homo sapiens
caugacucguauaugucuca

SEQ ID NO: 869596 - RNA, 22 nt, Homo sapiens
caugacuucugccccagcuuua

SEQ ID NO: 869597 - RNA, 17 nt, Homo sapiens
caugacuuuuccaugua

SEQ ID NO: 869598 - RNA, 21 nt, Homo sapiens
caugagagaauuguaucauuu

SEQ ID NO: 869599 - RNA, 14 nt, Homo sapiens
caugaugagaguuu

SEQ ID NO: 869600 - RNA, 21 nt, Homo sapiens
caugaugccgcucuucuguca

SEQ ID NO: 869601 - RNA, 19 nt, Homo sapiens
caugauggagcgcaccugc

SEQ ID NO: 869602 - RNA, 15 nt, Homo sapiens
caugauuuauauaug

SEQ ID NO: 869603 - RNA, 16 nt, Homo sapiens
caugauuucauuucaa

SEQ ID NO: 869604 - RNA, 13 nt, Homo sapiens
caugcaaugacau

SEQ ID NO: 869605 - RNA, 14 nt, Homo sapiens
caugcacacaaaca

SEQ ID NO: 869606 - RNA, 13 nt, Homo sapiens
caugcacggugag

SEQ ID NO: 869607 - RNA, 14 nt, Homo sapiens
caugcacucaggca

SEQ ID NO: 869608 - RNA, 15 nt, Homo sapiens
caugcacucaggcag

SEQ ID NO: 869609 - RNA, 13 nt, Homo sapiens
caugcacugaccc

SEQ ID NO: 869610 - RNA, 16 nt, Homo sapiens
caugcauuacugcaug

SEQ ID NO: 869611 - RNA, 18 nt, Homo sapiens
caugcauuacugcaugca

SEQ ID NO: 869612 - RNA, 21 nt, Homo sapiens
caugcauuacugcaugcacuu

SEQ ID NO: 869613 - RNA, 15 nt, Homo sapiens
caugccacugccagg

SEQ ID NO: 869614 - RNA, 20 nt, Homo sapiens
caugccaucuccacccugag

SEQ ID NO: 869615 - RNA, 22 nt, Homo sapiens
caugccucugaggccagccugg

SEQ ID NO: 869616 - RNA, 13 nt, Homo sapiens
caugccucugaua

SEQ ID NO: 869617 - RNA, 16 nt, Homo sapiens
caugccuggucuuucc

SEQ ID NO: 869618 - RNA, 17 nt, Homo sapiens
caugcguauaugugcgu

SEQ ID NO: 869619 - RNA, 19 nt, Homo sapiens
caugcucaaccacuguggc

SEQ ID NO: 869620 - RNA, 22 nt, Homo sapiens
caugcugcuaauucaaagcucu

SEQ ID NO: 869621 - RNA, 14 nt, Homo sapiens
caugcuggccugug

SEQ ID NO: 869622 - RNA, 13 nt, Homo sapiens
caugcuucuugcc

SEQ ID NO: 869623 - RNA, 17 nt, Homo sapiens
cauggaacagugcagga

SEQ ID NO: 869624 - RNA, 16 nt, Homo sapiens
cauggaauaaaccauu

SEQ ID NO: 869625 - RNA, 19 nt, Homo sapiens
cauggaccaagaaugagcu

SEQ ID NO: 869626 - RNA, 21 nt, Homo sapiens
cauggagagagacucaaagag

SEQ ID NO: 869627 - RNA, 19 nt, Homo sapiens
cauggcaccuuuugcacau

SEQ ID NO: 869628 - RNA, 21 nt, Homo sapiens
cauggccagguggccacucca

SEQ ID NO: 869629 - RNA, 16 nt, Homo sapiens
cauggcccaaauccag

SEQ ID NO: 869630 - RNA, 14 nt, Homo sapiens
cauggccuaugcac

SEQ ID NO: 869631 - RNA, 15 nt, Homo sapiens
cauggccuaugcaca

SEQ ID NO: 869632 - RNA, 17 nt, Homo sapiens
cauggcgaggcugaggu

SEQ ID NO: 869633 - RNA, 14 nt, Homo sapiens
cauggcuauccuag

SEQ ID NO: 869634 - RNA, 17 nt, Homo sapiens
cauggggaagugcuccc

SEQ ID NO: 869635 - RNA, 19 nt, Homo sapiens
cauggucccacaucccugg

SEQ ID NO: 869636 - RNA, 21 nt, Homo sapiens
caugguccuggaggaugacca

SEQ ID NO: 869637 - RNA, 14 nt, Homo sapiens
cauggugcuuucag

SEQ ID NO: 869638 - RNA, 15 nt, Homo sapiens
caugguuaccgagga

SEQ ID NO: 869639 - RNA, 22 nt, Homo sapiens
cauguaaggucuucuugugucc

SEQ ID NO: 869640 - RNA, 14 nt, Homo sapiens
cauguaccacugag

SEQ ID NO: 869641 - RNA, 15 nt, Homo sapiens
cauguaccaucaaua

SEQ ID NO: 869642 - RNA, 17 nt, Homo sapiens
cauguacuauaauguga

SEQ ID NO: 869643 - RNA, 14 nt, Homo sapiens
cauguaucuaugca

SEQ ID NO: 869644 - RNA, 23 nt, Homo sapiens
caugucaccucagcugauauuau

SEQ ID NO: 869645 - RNA, 15 nt, Homo sapiens
cauguccaaguccaa

SEQ ID NO: 869646 - RNA, 22 nt, Homo sapiens
cauguccuauccaaaggaauca

SEQ ID NO: 869647 - RNA, 17 nt, Homo sapiens
caugucucaauaguaaa

SEQ ID NO: 869648 - RNA, 12 nt, Homo sapiens
caugucuuucag

SEQ ID NO: 869649 - RNA, 22 nt, Homo sapiens
caugugccagguuuuuggucug

SEQ ID NO: 869650 - RNA, 19 nt, Homo sapiens
cauguggccccaggugcca

SEQ ID NO: 869651 - RNA, 16 nt, Homo sapiens
cauguguguauauaug

SEQ ID NO: 869652 - RNA, 22 nt, Homo sapiens
cauguguugccuggaagcacau

SEQ ID NO: 869653 - RNA, 21 nt, Homo sapiens
cauguuaggaaaauuucacau

SEQ ID NO: 869654 - RNA, 18 nt, Homo sapiens
cauguuauccacaagcaa

SEQ ID NO: 869655 - RNA, 20 nt, Homo sapiens
cauguugaagccacugccuu

SEQ ID NO: 869656 - RNA, 22 nt, Homo sapiens
cauguugccaugaggccuuucc

SEQ ID NO: 869657 - RNA, 17 nt, Homo sapiens
cauguuggauagucagc

SEQ ID NO: 869658 - RNA, 15 nt, Homo sapiens
cauguuguaagcacu

SEQ ID NO: 869659 - RNA, 23 nt, Homo sapiens
cauguuucccgcuccaagagaau

SEQ ID NO: 869660 - RNA, 17 nt, Homo sapiens
cauuaaaaaugcauaua

SEQ ID NO: 869661 - RNA, 13 nt, Homo sapiens
cauuaaacacugu

SEQ ID NO: 869662 - RNA, 13 nt, Homo sapiens
cauuaaaccugga

SEQ ID NO: 869663 - RNA, 16 nt, Homo sapiens
cauuaaucaccaaagu

SEQ ID NO: 869664 - RNA, 13 nt, Homo sapiens
cauuagagucagc

SEQ ID NO: 869665 - RNA, 15 nt, Homo sapiens
cauuagucacuuuga

SEQ ID NO: 869666 - RNA, 16 nt, Homo sapiens
cauuagucacuuugaa

SEQ ID NO: 869667 - RNA, 14 nt, Homo sapiens
cauuauacauuuga

SEQ ID NO: 869668 - RNA, 16 nt, Homo sapiens
cauuauuccuccagga

SEQ ID NO: 869669 - RNA, 17 nt, Homo sapiens
cauucaaaaaccugguu

SEQ ID NO: 869670 - RNA, 14 nt, Homo sapiens
cauucaacagauca

SEQ ID NO: 869671 - RNA, 22 nt, Homo sapiens
cauucaauguuuaugcaaggaa

SEQ ID NO: 869672 - RNA, 21 nt, Homo sapiens
cauucacauuugauguacaug

SEQ ID NO: 869673 - RNA, 16 nt, Homo sapiens
cauucagaccagugaa

SEQ ID NO: 869674 - RNA, 16 nt, Homo sapiens
cauucaucucauucca

SEQ ID NO: 869675 - RNA, 18 nt, Homo sapiens
cauuccagacugcuucca

SEQ ID NO: 869676 - RNA, 11 nt, Homo sapiens
cauucccugag

SEQ ID NO: 869677 - RNA, 21 nt, Homo sapiens
cauucccugagucaccaggaa

SEQ ID NO: 869678 - RNA, 21 nt, Homo sapiens
cauuccugaaagaaacaguua

SEQ ID NO: 869679 - RNA, 17 nt, Homo sapiens
cauucuaguacuuggga

SEQ ID NO: 869680 - RNA, 11 nt, Homo sapiens
cauucugacca

SEQ ID NO: 869681 - RNA, 14 nt, Homo sapiens
cauucugaccauuu

SEQ ID NO: 869682 - RNA, 20 nt, Homo sapiens
cauucugauucgaaugacac

SEQ ID NO: 869683 - RNA, 16 nt, Homo sapiens
cauucugucuugaagg

SEQ ID NO: 869684 - RNA, 22 nt, Homo sapiens
cauucuuaaaggaaaagucaac

SEQ ID NO: 869685 - RNA, 16 nt, Homo sapiens
cauucuuacucgggcg

SEQ ID NO: 869686 - RNA, 23 nt, Homo sapiens
cauucuuguccuggcuggaccag

SEQ ID NO: 869687 - RNA, 23 nt, Homo sapiens
cauucuuguuuuaagugccuuua

SEQ ID NO: 869688 - RNA, 18 nt, Homo sapiens
cauucuuuaucuugacau

SEQ ID NO: 869689 - RNA, 10 nt, Homo sapiens
cauugaacaa

SEQ ID NO: 869690 - RNA, 13 nt, Homo sapiens
cauugaauuugcc

SEQ ID NO: 869691 - RNA, 15 nt, Homo sapiens
cauugaauuugccuu

SEQ ID NO: 869692 - RNA, 20 nt, Homo sapiens
cauugacugaacugcacguu

SEQ ID NO: 869693 - RNA, 21 nt, Homo sapiens
cauuuaaauuagauaacaaaa

SEQ ID NO: 869694 - RNA, 15 nt, Homo sapiens
cauuuauaaaaccau

SEQ ID NO: 869695 - RNA, 20 nt, Homo sapiens
cauuuauuuacaucuaugua

SEQ ID NO: 869696 - RNA, 17 nt, Homo sapiens
cauuucaggggucguca

SEQ ID NO: 869697 - RNA, 21 nt, Homo sapiens
cauuucaucucauuuaaggga

SEQ ID NO: 869698 - RNA, 19 nt, Homo sapiens
cauuuccugacagaaggac

SEQ ID NO: 869699 - RNA, 18 nt, Homo sapiens
cauuucuaauguaugcau

SEQ ID NO: 869700 - RNA, 22 nt, Homo sapiens
cauuucucaaaugcacaucuca

SEQ ID NO: 869701 - RNA, 19 nt, Homo sapiens
cauuucucugcuuacccuu

SEQ ID NO: 869702 - RNA, 13 nt, Homo sapiens
cauuucuugaugu

SEQ ID NO: 869703 - RNA, 16 nt, Homo sapiens
cauuugaguauuacaa

SEQ ID NO: 869704 - RNA, 14 nt, Homo sapiens
cauuugagugucuu

SEQ ID NO: 869705 - RNA, 15 nt, Homo sapiens
cauuugauguacaug

SEQ ID NO: 869706 - RNA, 18 nt, Homo sapiens
cauuuggguacgucuggg

SEQ ID NO: 869707 - RNA, 15 nt, Homo sapiens
cauuuguacugaccc

SEQ ID NO: 869708 - RNA, 21 nt, Homo sapiens
cauuuguacugaccccaucac

SEQ ID NO: 869709 - RNA, 21 nt, Homo sapiens
cauuuguuggaaugaauuaaa

SEQ ID NO: 869710 - RNA, 18 nt, Homo sapiens
cauuuuaaaaaauggaac

SEQ ID NO: 869711 - RNA, 16 nt, Homo sapiens
cauuuuacagaagcau

SEQ ID NO: 869712 - RNA, 15 nt, Homo sapiens
cauuuuagugacugu

SEQ ID NO: 869713 - RNA, 15 nt, Homo sapiens
cauuuuauaucugga

SEQ ID NO: 869714 - RNA, 16 nt, Homo sapiens
cauuuucaaugcacau

SEQ ID NO: 869715 - RNA, 12 nt, Homo sapiens
cauuuuccaaaa

SEQ ID NO: 869716 - RNA, 13 nt, Homo sapiens
cauuuucuauuca

SEQ ID NO: 869717 - RNA, 19 nt, Homo sapiens
cauuuucuuguggagcaau

SEQ ID NO: 869718 - RNA, 14 nt, Homo sapiens
cauuuugcaaaauu

SEQ ID NO: 869719 - RNA, 21 nt, Homo sapiens
cauuuugcauuagacagauga

SEQ ID NO: 869720 - RNA, 22 nt, Homo sapiens
cauuuuggaaguuuucaggacu

SEQ ID NO: 869721 - RNA, 14 nt, Homo sapiens
cauuuugguuuaaa

SEQ ID NO: 869722 - RNA, 15 nt, Homo sapiens
cauuuuguucuacau

SEQ ID NO: 869723 - RNA, 17 nt, Homo sapiens
cauuuuuaauaugacaa

SEQ ID NO: 869724 - RNA, 21 nt, Homo sapiens
cauuuuuaguagagacagggu

SEQ ID NO: 869725 - RNA, 13 nt, Homo sapiens
cauuuuuggugua

SEQ ID NO: 869726 - RNA, 22 nt, Homo sapiens
cauuuuuuucacuggaguuaca

SEQ ID NO: 869727 - RNA, 13 nt, Homo sapiens
ccaaaaacuaaau

SEQ ID NO: 869728 - RNA, 9 nt, Homo sapiens
ccaaaaagg

SEQ ID NO: 869729 - RNA, 18 nt, Homo sapiens
ccaaaauaaaaccagcuc

SEQ ID NO: 869730 - RNA, 14 nt, Homo sapiens
ccaaaauacuacac

SEQ ID NO: 869731 - RNA, 20 nt, Homo sapiens
ccaaaauuaccaaaaaucuu

SEQ ID NO: 869732 - RNA, 18 nt, Homo sapiens
ccaaaauuacuucucucu

SEQ ID NO: 869733 - RNA, 19 nt, Homo sapiens
ccaaacucauucaccaaau

SEQ ID NO: 869734 - RNA, 14 nt, Homo sapiens
ccaaacucugccag

SEQ ID NO: 869735 - RNA, 15 nt, Homo sapiens
ccaaacucugccagc

SEQ ID NO: 869736 - RNA, 17 nt, Homo sapiens
ccaaagagaaaagauua

SEQ ID NO: 869737 - RNA, 22 nt, Homo sapiens
ccaaagcaugauugugaccucc

SEQ ID NO: 869738 - RNA, 22 nt, Homo sapiens
ccaaagcauggacuaaccccaa

SEQ ID NO: 869739 - RNA, 13 nt, Homo sapiens
ccaaagcauugcc

SEQ ID NO: 869740 - RNA, 21 nt, Homo sapiens
ccaaagugacacagagcaaug

SEQ ID NO: 869741 - RNA, 20 nt, Homo sapiens
ccaaagugccacucauuccu

SEQ ID NO: 869742 - RNA, 17 nt, Homo sapiens
ccaaagugcugggauua

SEQ ID NO: 869743 - RNA, 23 nt, Homo sapiens
ccaaauaaacucuaaacauuaau

SEQ ID NO: 869744 - RNA, 17 nt, Homo sapiens
ccaaauaaaguaccauu

SEQ ID NO: 869745 - RNA, 13 nt, Homo sapiens
ccagagugcugcc

SEQ ID NO: 869746 - RNA, 18 nt, Homo sapiens
ccagaucgauccuggauu

SEQ ID NO: 869747 - RNA, 12 nt, Homo sapiens
ccagaucugccu

SEQ ID NO: 869748 - RNA, 20 nt, Homo sapiens
ccagauggccgggacaugca

SEQ ID NO: 869749 - RNA, 16 nt, Homo sapiens
ccagcaacacaagcug

SEQ ID NO: 869750 - RNA, 20 nt, Homo sapiens
ccagcaaugauguccagaag

SEQ ID NO: 869751 - RNA, 21 nt, Homo sapiens
ccagcacuuugggaggcugag

SEQ ID NO: 869752 - RNA, 23 nt, Homo sapiens
ccagcaggaaaguacagaugcag

SEQ ID NO: 869753 - RNA, 21 nt, Homo sapiens
ccagcagguagugggugaaug

SEQ ID NO: 869754 - RNA, 13 nt, Homo sapiens
ccagcaugcaucc

SEQ ID NO: 869755 - RNA, 18 nt, Homo sapiens
ccagcaugcugagauuac

SEQ ID NO: 869756 - RNA, 14 nt, Homo sapiens
ccagcauguacaaa

SEQ ID NO: 869757 - RNA, 22 nt, Homo sapiens
ccagccaccucccaaggacuuu

SEQ ID NO: 869758 - RNA, 13 nt, Homo sapiens
ccagccaccucuu

SEQ ID NO: 869759 - RNA, 13 nt, Homo sapiens
ccagccaugguga

SEQ ID NO: 869760 - RNA, 14 nt, Homo sapiens
ccagccauggugag

SEQ ID NO: 869761 - RNA, 20 nt, Homo sapiens
ccagccgugaugcucaggcu

SEQ ID NO: 869762 - RNA, 16 nt, Homo sapiens
ccagccuagcccacuu

SEQ ID NO: 869763 - RNA, 22 nt, Homo sapiens
ccagccugcuaauuccccagau

SEQ ID NO: 869764 - RNA, 21 nt, Homo sapiens
ccagccugggacucccaguga

SEQ ID NO: 869765 - RNA, 18 nt, Homo sapiens
ccagccugggcaacaaag

SEQ ID NO: 869766 - RNA, 18 nt, Homo sapiens
ccagccugggcaacagau

SEQ ID NO: 869767 - RNA, 18 nt, Homo sapiens
ccagcgagggcgugucua

SEQ ID NO: 869768 - RNA, 14 nt, Homo sapiens
ccagcuacucagga

SEQ ID NO: 869769 - RNA, 13 nt, Homo sapiens
ccagcuagugacc

SEQ ID NO: 869770 - RNA, 15 nt, Homo sapiens
ccagcucagucccau

SEQ ID NO: 869771 - RNA, 18 nt, Homo sapiens
ccagcugcaccugccagc

SEQ ID NO: 869772 - RNA, 19 nt, Homo sapiens
ccagcugcaggaaucaaaa

SEQ ID NO: 869773 - RNA, 16 nt, Homo sapiens
ccagcuguagccaugg

SEQ ID NO: 869774 - RNA, 21 nt, Homo sapiens
ccagcuguguucacacuguaa

SEQ ID NO: 869775 - RNA, 16 nt, Homo sapiens
ccaggaaggacugugc

SEQ ID NO: 869776 - RNA, 14 nt, Homo sapiens
ccaggacaccugcc

SEQ ID NO: 869777 - RNA, 16 nt, Homo sapiens
ccaggacucacccuca

SEQ ID NO: 869778 - RNA, 13 nt, Homo sapiens
ccaggagacaguu

SEQ ID NO: 869779 - RNA, 21 nt, Homo sapiens
ccaggagauggaaguugcagu

SEQ ID NO: 869780 - RNA, 22 nt, Homo sapiens
ccaggaguucgaggcugcaguc

SEQ ID NO: 869781 - RNA, 11 nt, Homo sapiens
ccaggauuuug

SEQ ID NO: 869782 - RNA, 18 nt, Homo sapiens
ccaggcaccaucucccuu

SEQ ID NO: 869783 - RNA, 22 nt, Homo sapiens
ccaggcagagaucaggugggca

SEQ ID NO: 869784 - RNA, 17 nt, Homo sapiens
ccaggcaggugccugga

SEQ ID NO: 869785 - RNA, 17 nt, Homo sapiens
ccaggcccaaggaguaa

SEQ ID NO: 869786 - RNA, 17 nt, Homo sapiens
ccaggccgccugccaua

SEQ ID NO: 869787 - RNA, 20 nt, Homo sapiens
ccaggcgggcggcacgccaa

SEQ ID NO: 869788 - RNA, 17 nt, Homo sapiens
ccaggcugcacugcagu

SEQ ID NO: 869789 - RNA, 17 nt, Homo sapiens
ccaggcuggaguacagu

SEQ ID NO: 869790 - RNA, 20 nt, Homo sapiens
ccaggcuggagugcaguggu

SEQ ID NO: 869791 - RNA, 18 nt, Homo sapiens
ccaggcuggcgugcagug

SEQ ID NO: 869792 - RNA, 19 nt, Homo sapiens
ccagggacaaaacacugug

SEQ ID NO: 869793 - RNA, 23 nt, Homo sapiens
ccagggaugggggaugggccagg

SEQ ID NO: 869794 - RNA, 21 nt, Homo sapiens
ccagggccugggggcagugac

SEQ ID NO: 869795 - RNA, 16 nt, Homo sapiens
ccaggggcugcucauc

SEQ ID NO: 869796 - RNA, 22 nt, Homo sapiens
ccagggucuugggcuacuggca

SEQ ID NO: 869797 - RNA, 12 nt, Homo sapiens
ccagggugcaug

SEQ ID NO: 869798 - RNA, 15 nt, Homo sapiens
ccaggucaacaucua

SEQ ID NO: 869799 - RNA, 19 nt, Homo sapiens
ccagguguugccauuucuc

SEQ ID NO: 869800 - RNA, 16 nt, Homo sapiens
ccaguacgugcuaaca

SEQ ID NO: 869801 - RNA, 14 nt, Homo sapiens
ccagucagcaggag

SEQ ID NO: 869802 - RNA, 15 nt, Homo sapiens
ccagucccagagcag

SEQ ID NO: 869803 - RNA, 18 nt, Homo sapiens
ccagugaaaaacuauuaa

SEQ ID NO: 869804 - RNA, 13 nt, Homo sapiens
ccagugaaccaaa

SEQ ID NO: 869805 - RNA, 13 nt, Homo sapiens
ccagugacaccga

SEQ ID NO: 869806 - RNA, 19 nt, Homo sapiens
ccagugagauuacagagga

SEQ ID NO: 869807 - RNA, 17 nt, Homo sapiens
ccagugcaacaaaauca

SEQ ID NO: 869808 - RNA, 20 nt, Homo sapiens
ccagugcauguugccaugag

SEQ ID NO: 869809 - RNA, 12 nt, Homo sapiens
ccagugccagga

SEQ ID NO: 869810 - RNA, 15 nt, Homo sapiens
ccagugcuaccucuc

SEQ ID NO: 869811 - RNA, 17 nt, Homo sapiens
ccaguggaccugaagga

SEQ ID NO: 869812 - RNA, 21 nt, Homo sapiens
ccaguguaaagaauaaaugaa

SEQ ID NO: 869813 - RNA, 18 nt, Homo sapiens
ccaguguuauuaaugaca

SEQ ID NO: 869814 - RNA, 20 nt, Homo sapiens
ccaguguuuagaagagccug

SEQ ID NO: 869815 - RNA, 21 nt, Homo sapiens
ccauaaccccaggcaucccau

SEQ ID NO: 869816 - RNA, 15 nt, Homo sapiens
ccauaaucucauuca

SEQ ID NO: 869817 - RNA, 17 nt, Homo sapiens
ccauacauuaucauuca

SEQ ID NO: 869818 - RNA, 15 nt, Homo sapiens
ccauagagacuuugu

SEQ ID NO: 869819 - RNA, 15 nt, Homo sapiens
ccauagucacauggc

SEQ ID NO: 869820 - RNA, 16 nt, Homo sapiens
ccauagucacauggcc

SEQ ID NO: 869821 - RNA, 20 nt, Homo sapiens
ccauagugcacuagcauuuu

SEQ ID NO: 869822 - RNA, 16 nt, Homo sapiens
ccauaucuacccagaa

SEQ ID NO: 869823 - RNA, 22 nt, Homo sapiens
ccauaugauauuuugucuccua

SEQ ID NO: 869824 - RNA, 12 nt, Homo sapiens
ccauauucacac

SEQ ID NO: 869825 - RNA, 14 nt, Homo sapiens
ccaucaaaugcugu

SEQ ID NO: 869826 - RNA, 12 nt, Homo sapiens
ccaucacuggag

SEQ ID NO: 869827 - RNA, 16 nt, Homo sapiens
ccaucauggcagugau

SEQ ID NO: 869828 - RNA, 21 nt, Homo sapiens
ccauccgggacgcuuccagac

SEQ ID NO: 869829 - RNA, 16 nt, Homo sapiens
ccaucgcaaccaggau

SEQ ID NO: 869830 - RNA, 15 nt, Homo sapiens
ccaucuaagcugcag

SEQ ID NO: 869831 - RNA, 13 nt, Homo sapiens
ccaucuccagugg

SEQ ID NO: 869832 - RNA, 16 nt, Homo sapiens
ccaucuccauuucaca

SEQ ID NO: 869833 - RNA, 18 nt, Homo sapiens
ccaucugcuugguuggcu

SEQ ID NO: 869834 - RNA, 12 nt, Homo sapiens
ccaucuguagag

SEQ ID NO: 869835 - RNA, 17 nt, Homo sapiens
ccaucuugguccuguca

SEQ ID NO: 869836 - RNA, 15 nt, Homo sapiens
ccaucuuuugugaga

SEQ ID NO: 869837 - RNA, 22 nt, Homo sapiens
ccaucuuuugugagauguaauu

SEQ ID NO: 869838 - RNA, 23 nt, Homo sapiens
ccaugaaaaugcaacaacaugua

SEQ ID NO: 869839 - RNA, 16 nt, Homo sapiens
ccaugaaucuuuuuga

SEQ ID NO: 869840 - RNA, 17 nt, Homo sapiens
ccaugaggacaaagugu

SEQ ID NO: 869841 - RNA, 17 nt, Homo sapiens
ccaugcauggugcauca

SEQ ID NO: 869842 - RNA, 10 nt, Homo sapiens
ccaugccacc

SEQ ID NO: 869843 - RNA, 15 nt, Homo sapiens
ccaugccucaagaac

SEQ ID NO: 869844 - RNA, 21 nt, Homo sapiens
ccauggacagaagaaggcagc

SEQ ID NO: 869845 - RNA, 19 nt, Homo sapiens
ccauguaccaguguacugc

SEQ ID NO: 869846 - RNA, 17 nt, Homo sapiens
ccauguggguguggcag

SEQ ID NO: 869847 - RNA, 15 nt, Homo sapiens
ccaugugugacucca

SEQ ID NO: 869848 - RNA, 15 nt, Homo sapiens
ccauuaggcaugccu

SEQ ID NO: 869849 - RNA, 18 nt, Homo sapiens
ccauuaggcaugccuaau

SEQ ID NO: 869850 - RNA, 16 nt, Homo sapiens
ccauucccccaugugg

SEQ ID NO: 869851 - RNA, 15 nt, Homo sapiens
ccauucccguggucu

SEQ ID NO: 869852 - RNA, 11 nt, Homo sapiens
ccauucuugga

SEQ ID NO: 869853 - RNA, 22 nt, Homo sapiens
ccauugucgucuuuauguccgc

SEQ ID NO: 869854 - RNA, 15 nt, Homo sapiens
ccauuuuaaaaacca

SEQ ID NO: 869855 - RNA, 16 nt, Homo sapiens
ccauuuuaaaaaccaa

SEQ ID NO: 869856 - RNA, 20 nt, Homo sapiens
ccauuuuacagaagcauuuu

SEQ ID NO: 869857 - RNA, 14 nt, Homo sapiens
ccauuuugcaaaau

SEQ ID NO: 869858 - RNA, 20 nt, Homo sapiens
cccaaagcucagacuugcca

SEQ ID NO: 869859 - RNA, 14 nt, Homo sapiens
cccaaaggcaucca

SEQ ID NO: 869860 - RNA, 22 nt, Homo sapiens
cccgccucuucuucuucagaag

SEQ ID NO: 869861 - RNA, 22 nt, Homo sapiens
cccgccuguccugccucucugc

SEQ ID NO: 869862 - RNA, 23 nt, Homo sapiens
cccgcugggauuucuucgcugcu

SEQ ID NO: 869863 - RNA, 18 nt, Homo sapiens
cccggaguaaucaggcag

SEQ ID NO: 869864 - RNA, 13 nt, Homo sapiens
cccgggacagggu

SEQ ID NO: 869865 - RNA, 21 nt, Homo sapiens
cccgggguggccacaccacag

SEQ ID NO: 869866 - RNA, 22 nt, Homo sapiens
cccguaggcagccucucugcua

SEQ ID NO: 869867 - RNA, 20 nt, Homo sapiens
cccgucauguuccucaaaag

SEQ ID NO: 869868 - RNA, 14 nt, Homo sapiens
cccuaaaacaugug

SEQ ID NO: 869869 - RNA, 15 nt, Homo sapiens
cccuaaacucaggag

SEQ ID NO: 869870 - RNA, 20 nt, Homo sapiens
cccuaagagagcaccuggug

SEQ ID NO: 869871 - RNA, 20 nt, Homo sapiens
cccuaauuagggcauccugc

SEQ ID NO: 869872 - RNA, 13 nt, Homo sapiens
cccuacugagaaa

SEQ ID NO: 869873 - RNA, 14 nt, Homo sapiens
cccuaggagaccaa

SEQ ID NO: 869874 - RNA, 18 nt, Homo sapiens
cccuaucaaaacauauca

SEQ ID NO: 869875 - RNA, 15 nt, Homo sapiens
cccuauuuuugcaau

SEQ ID NO: 869876 - RNA, 19 nt, Homo sapiens
cccucaaaaaaagccuuua

SEQ ID NO: 869877 - RNA, 13 nt, Homo sapiens
cccucaaaagcac

SEQ ID NO: 869878 - RNA, 21 nt, Homo sapiens
cccucaaucccagcuacucaa

SEQ ID NO: 869879 - RNA, 16 nt, Homo sapiens
cccucaggccagugcc

SEQ ID NO: 869880 - RNA, 20 nt, Homo sapiens
cccuccccauucagacacuu

SEQ ID NO: 869881 - RNA, 22 nt, Homo sapiens
cccucccgggggcacugccuga

SEQ ID NO: 869882 - RNA, 16 nt, Homo sapiens
cccuccugcugccuaa

SEQ ID NO: 869883 - RNA, 16 nt, Homo sapiens
cccucuacuccaugca

SEQ ID NO: 869884 - RNA, 19 nt, Homo sapiens
cccucuuuccccaccucuu

SEQ ID NO: 869885 - RNA, 22 nt, Homo sapiens
cccugagagcucacaguacaau

SEQ ID NO: 869886 - RNA, 13 nt, Homo sapiens
cccugccaguguu

SEQ ID NO: 869887 - RNA, 17 nt, Homo sapiens
cccugccccucuggcca

SEQ ID NO: 869888 - RNA, 24 nt, Homo sapiens
cccugcccgaccccaucucauuca

SEQ ID NO: 869889 - RNA, 14 nt, Homo sapiens
cccuggagugcagu

SEQ ID NO: 869890 - RNA, 20 nt, Homo sapiens
cccuggcugaccccaaagag

SEQ ID NO: 869891 - RNA, 21 nt, Homo sapiens
cccuggcugaccccaaagagc

SEQ ID NO: 869892 - RNA, 21 nt, Homo sapiens
cccugggacguggcuagucau

SEQ ID NO: 869893 - RNA, 17 nt, Homo sapiens
cccugggcuugugaaca

SEQ ID NO: 869894 - RNA, 15 nt, Homo sapiens
cccugguguguuucc

SEQ ID NO: 869895 - RNA, 21 nt, Homo sapiens
cccuguaccacaaacacauua

SEQ ID NO: 869896 - RNA, 22 nt, Homo sapiens
cccugucaugguguccagacag

SEQ ID NO: 869897 - RNA, 21 nt, Homo sapiens
cccugucccaccaacucugca

SEQ ID NO: 869898 - RNA, 15 nt, Homo sapiens
cccugucucuacuaa

SEQ ID NO: 869899 - RNA, 15 nt, Homo sapiens
cccugucucuagcca

SEQ ID NO: 869900 - RNA, 11 nt, Homo sapiens
cccugugcuga

SEQ ID NO: 869901 - RNA, 16 nt, Homo sapiens
cccuguuucucuugaa

SEQ ID NO: 869902 - RNA, 19 nt, Homo sapiens
cccuguuucucuugaagaa

SEQ ID NO: 869903 - RNA, 20 nt, Homo sapiens
cccuuaaggguugaaggcag

SEQ ID NO: 869904 - RNA, 20 nt, Homo sapiens
cccuuacuaugaucucagga

SEQ ID NO: 869905 - RNA, 22 nt, Homo sapiens
cccuuauccaggacucugucaa

SEQ ID NO: 869906 - RNA, 13 nt, Homo sapiens
cccuucuucccua

SEQ ID NO: 869907 - RNA, 18 nt, Homo sapiens
cccuucuuuacuagauau

SEQ ID NO: 869908 - RNA, 12 nt, Homo sapiens
cccuugcauuag

SEQ ID NO: 869909 - RNA, 13 nt, Homo sapiens
cccuuuccacgag

SEQ ID NO: 869910 - RNA, 12 nt, Homo sapiens
cccuuuccagcc

SEQ ID NO: 869911 - RNA, 22 nt, Homo sapiens
cccuuuccugggggaugugcac

SEQ ID NO: 869912 - RNA, 21 nt, Homo sapiens
cccuuuuccuccagacagaua

SEQ ID NO: 869913 - RNA, 21 nt, Homo sapiens
ccgacaggcaugcaccagugc

SEQ ID NO: 869914 - RNA, 19 nt, Homo sapiens
ccgacugugaaaguaugug

SEQ ID NO: 869915 - RNA, 21 nt, Homo sapiens
ccgacuuauucugauuucaga

SEQ ID NO: 869916 - RNA, 19 nt, Homo sapiens
ccgagaaaacaaacccagg

SEQ ID NO: 869917 - RNA, 23 nt, Homo sapiens
ccgagcccagcuacauuccucag

SEQ ID NO: 869918 - RNA, 18 nt, Homo sapiens
ccgagcuagagugcagug

SEQ ID NO: 869919 - RNA, 21 nt, Homo sapiens
ccgauaucaaaaagacugugg

SEQ ID NO: 869920 - RNA, 16 nt, Homo sapiens
ccgcaaguucagggaa

SEQ ID NO: 869921 - RNA, 22 nt, Homo sapiens
ccgcacuuggaaagguuucaag

SEQ ID NO: 869922 - RNA, 14 nt, Homo sapiens
ccgcagagcucccu

SEQ ID NO: 869923 - RNA, 13 nt, Homo sapiens
ccgccccagacac

SEQ ID NO: 869924 - RNA, 16 nt, Homo sapiens
ccgcccccagcagcuc

SEQ ID NO: 869925 - RNA, 22 nt, Homo sapiens
ccgccuguccugccucucugcu

SEQ ID NO: 869926 - RNA, 22 nt, Homo sapiens
ccgccuuccuccuccacagugc

SEQ ID NO: 869927 - RNA, 16 nt, Homo sapiens
ccgcgugugacagucu

SEQ ID NO: 869928 - RNA, 11 nt, Homo sapiens
ccgcugcugag

SEQ ID NO: 869929 - RNA, 19 nt, Homo sapiens
ccgggaccauugaccucag

SEQ ID NO: 869930 - RNA, 19 nt, Homo sapiens
ccgggcaagcacuaccagg

SEQ ID NO: 869931 - RNA, 18 nt, Homo sapiens
ccgggcacugguggguga

SEQ ID NO: 869932 - RNA, 16 nt, Homo sapiens
ccgggcccgggcacug

SEQ ID NO: 869933 - RNA, 15 nt, Homo sapiens
ccggggcagcccugc

SEQ ID NO: 869934 - RNA, 18 nt, Homo sapiens
ccguaacaacugugguca

SEQ ID NO: 869935 - RNA, 12 nt, Homo sapiens
ccguacauucaa

SEQ ID NO: 869936 - RNA, 19 nt, Homo sapiens
ccgucaaaagagucuuaau

SEQ ID NO: 869937 - RNA, 11 nt, Homo sapiens
ccgugccuuca

SEQ ID NO: 869938 - RNA, 19 nt, Homo sapiens
ccguguuacuguugcacug

SEQ ID NO: 869939 - RNA, 22 nt, Homo sapiens
ccuaaaucugccuuuucaucua

SEQ ID NO: 869940 - RNA, 22 nt, Homo sapiens
ccuaaaucuuccagcaugcauc

SEQ ID NO: 869941 - RNA, 13 nt, Homo sapiens
ccuaaauuucagu

SEQ ID NO: 869942 - RNA, 19 nt, Homo sapiens
ccuaacaggcuaguucuaa

SEQ ID NO: 869943 - RNA, 17 nt, Homo sapiens
ccuaagagagcaccugg

SEQ ID NO: 869944 - RNA, 14 nt, Homo sapiens
ccuaagaggcagug

SEQ ID NO: 869945 - RNA, 18 nt, Homo sapiens
ccuaaggacacacuaauc

SEQ ID NO: 869946 - RNA, 22 nt, Homo sapiens
ccuaauaaacauccuucaagaa

SEQ ID NO: 869947 - RNA, 16 nt, Homo sapiens
ccuaauaugcuuuaca

SEQ ID NO: 869948 - RNA, 23 nt, Homo sapiens
ccuaaugaaggaguucacuguaa

SEQ ID NO: 869949 - RNA, 15 nt, Homo sapiens
ccuacagauagucaa

SEQ ID NO: 869950 - RNA, 19 nt, Homo sapiens
ccuacccucccagcgaguu

SEQ ID NO: 869951 - RNA, 21 nt, Homo sapiens
ccuacucagacuguugcacuc

SEQ ID NO: 869952 - RNA, 15 nt, Homo sapiens
ccuacugaaugcucu

SEQ ID NO: 869953 - RNA, 19 nt, Homo sapiens
ccuacugccucuccagcac

SEQ ID NO: 869954 - RNA, 16 nt, Homo sapiens
ccuacuucuuuugcuc

SEQ ID NO: 869955 - RNA, 20 nt, Homo sapiens
ccuacuuuucuuuccucaga

SEQ ID NO: 869956 - RNA, 16 nt, Homo sapiens
ccuagaagcaaaugga

SEQ ID NO: 869957 - RNA, 16 nt, Homo sapiens
ccuagaccugggccaa

SEQ ID NO: 869958 - RNA, 13 nt, Homo sapiens
ccuagaggugcuc

SEQ ID NO: 869959 - RNA, 22 nt, Homo sapiens
ccuagagugacucuaccugcaa

SEQ ID NO: 869960 - RNA, 16 nt, Homo sapiens
ccuagauucuacauau

SEQ ID NO: 869961 - RNA, 21 nt, Homo sapiens
ccuagccuuagaagucacaca

SEQ ID NO: 869962 - RNA, 12 nt, Homo sapiens
ccuagcuaccuu

SEQ ID NO: 869963 - RNA, 19 nt, Homo sapiens
ccuaggagaagcagccucc

SEQ ID NO: 869964 - RNA, 19 nt, Homo sapiens
ccuagggguccacgggaag

SEQ ID NO: 869965 - RNA, 20 nt, Homo sapiens
ccuaggguccuguccaugcc

SEQ ID NO: 869966 - RNA, 22 nt, Homo sapiens
ccuaguaagggaacuauggaaa

SEQ ID NO: 869967 - RNA, 21 nt, Homo sapiens
ccuaguuugaccucacaguga

SEQ ID NO: 869968 - RNA, 13 nt, Homo sapiens
ccuauaaauauua

SEQ ID NO: 869969 - RNA, 15 nt, Homo sapiens
ccuauaaugugugua

SEQ ID NO: 869970 - RNA, 23 nt, Homo sapiens
ccuauacauuucuguucaucuua

SEQ ID NO: 869971 - RNA, 20 nt, Homo sapiens
ccuauagucccagcuacuca

SEQ ID NO: 869972 - RNA, 14 nt, Homo sapiens
ccuaucacugauag

SEQ ID NO: 869973 - RNA, 22 nt, Homo sapiens
ccuaucauuuauuuacaucuau

SEQ ID NO: 869974 - RNA, 18 nt, Homo sapiens
gauaucaccucucuucag

SEQ ID NO: 869975 - RNA, 21 nt, Homo sapiens
gauauccaguaagcacauguu

SEQ ID NO: 869976 - RNA, 13 nt, Homo sapiens
gauaugcacacac

SEQ ID NO: 869977 - RNA, 19 nt, Homo sapiens
gauaugcacacacacggau

SEQ ID NO: 869978 - RNA, 13 nt, Homo sapiens
gauaugggacuga

SEQ ID NO: 869979 - RNA, 16 nt, Homo sapiens
gauaugggacugagcc

SEQ ID NO: 869980 - RNA, 23 nt, Homo sapiens
gauauuugaaucuuucuuacuau

SEQ ID NO: 869981 - RNA, 15 nt, Homo sapiens
gauauuuuaugcaaa

SEQ ID NO: 869982 - RNA, 19 nt, Homo sapiens
gaucaaaccccauggagca

SEQ ID NO: 869983 - RNA, 16 nt, Homo sapiens
gaucaauagacuguac

SEQ ID NO: 869984 - RNA, 23 nt, Homo sapiens
gaucacagggccccagaaggcag

SEQ ID NO: 869985 - RNA, 17 nt, Homo sapiens
gaucacuaaaguauauc

SEQ ID NO: 869986 - RNA, 16 nt, Homo sapiens
gaucacuggcaaugaa

SEQ ID NO: 869987 - RNA, 18 nt, Homo sapiens
gaucacuugaguucagga

SEQ ID NO: 869988 - RNA, 21 nt, Homo sapiens
gaucagccuccgccauuccaa

SEQ ID NO: 869989 - RNA, 15 nt, Homo sapiens
gaucaguaugggaac

SEQ ID NO: 869990 - RNA, 19 nt, Homo sapiens
gaucauagguauuucaaaa

SEQ ID NO: 869991 - RNA, 20 nt, Homo sapiens
gaucaucuuuccuguuccag

SEQ ID NO: 869992 - RNA, 17 nt, Homo sapiens
gauccacaaaaacaacu

SEQ ID NO: 869993 - RNA, 14 nt, Homo sapiens
gauccacugugcag

SEQ ID NO: 869994 - RNA, 12 nt, Homo sapiens
gaucgcaccuuu

SEQ ID NO: 869995 - RNA, 13 nt, Homo sapiens
gaucgcugugaaa

SEQ ID NO: 869996 - RNA, 23 nt, Homo sapiens
gaucuaaauagcccuuggaucag

SEQ ID NO: 869997 - RNA, 19 nt, Homo sapiens
gaucuaagccuuuccauaa

SEQ ID NO: 869998 - RNA, 20 nt, Homo sapiens
gaucuaagccuuuccauaag

SEQ ID NO: 869999 - RNA, 22 nt, Homo sapiens
gaucuagcuucaugccucaguu

SEQ ID NO: 870000 - RNA, 17 nt, Homo sapiens
gaucuaucaauagucaa

SEQ ID NO: 870001 - RNA, 17 nt, Homo sapiens
gaucuauguacuguaau

SEQ ID NO: 870002 - RNA, 18 nt, Homo sapiens
gaucuccaaggaccaggu

SEQ ID NO: 870003 - RNA, 22 nt, Homo sapiens
gaucuccacaccaaagucaggg

SEQ ID NO: 870004 - RNA, 15 nt, Homo sapiens
gaucuccccacucua

SEQ ID NO: 870005 - RNA, 19 nt, Homo sapiens
gaucuguaaggaacuggaa

SEQ ID NO: 870006 - RNA, 22 nt, Homo sapiens
gaugaaaaauaugugcuugaaa

SEQ ID NO: 870007 - RNA, 16 nt, Homo sapiens
gaugaaaaaugguccc

SEQ ID NO: 870008 - RNA, 19 nt, Homo sapiens
gaugaauuuuaucagccau

SEQ ID NO: 870009 - RNA, 18 nt, Homo sapiens
gaugaccaaucucuguga

SEQ ID NO: 870010 - RNA, 15 nt, Homo sapiens
gaugcaauacaagau

SEQ ID NO: 870011 - RNA, 19 nt, Homo sapiens
gaugcacacacagaugcac

SEQ ID NO: 870012 - RNA, 17 nt, Homo sapiens
gaugcagccgugcagga

SEQ ID NO: 870013 - RNA, 16 nt, Homo sapiens
gaugcaggauuucuuc

SEQ ID NO: 870014 - RNA, 15 nt, Homo sapiens
gaugcauccauuuca

SEQ ID NO: 870015 - RNA, 20 nt, Homo sapiens
gaugcauuccugagucuucc

SEQ ID NO: 870016 - RNA, 13 nt, Homo sapiens
gaugcauuuccac

SEQ ID NO: 870017 - RNA, 23 nt, Homo sapiens
gaugcuccuaguuugaccucaca

SEQ ID NO: 870018 - RNA, 17 nt, Homo sapiens
gauggaauaaagcccuu

SEQ ID NO: 870019 - RNA, 22 nt, Homo sapiens
gauggaauauuccccuaucucu

SEQ ID NO: 870020 - RNA, 19 nt, Homo sapiens
gauggaggucacacuggua

SEQ ID NO: 870021 - RNA, 16 nt, Homo sapiens
gauggcaccacugcac

SEQ ID NO: 870022 - RNA, 17 nt, Homo sapiens
gaugggaccagggaugg

SEQ ID NO: 870023 - RNA, 22 nt, Homo sapiens
gaugggucuccgcacuuggaaa

SEQ ID NO: 870024 - RNA, 16 nt, Homo sapiens
gauguaaaugccacaa

SEQ ID NO: 870025 - RNA, 23 nt, Homo sapiens
gauguacacacacagaugcacac

SEQ ID NO: 870026 - RNA, 16 nt, Homo sapiens
gauguaccauguuaaa

SEQ ID NO: 870027 - RNA, 23 nt, Homo sapiens
gaugucaauaggaauugcauuag

SEQ ID NO: 870028 - RNA, 16 nt, Homo sapiens
gaugucauuaaugugu

SEQ ID NO: 870029 - RNA, 14 nt, Homo sapiens
gaugugaacacauc

SEQ ID NO: 870030 - RNA, 15 nt, Homo sapiens
gaugugaguugcaca

SEQ ID NO: 870031 - RNA, 17 nt, Homo sapiens
gaugugaucacugagac

SEQ ID NO: 870032 - RNA, 13 nt, Homo sapiens
gaugugauuuauu

SEQ ID NO: 870033 - RNA, 15 nt, Homo sapiens
gauguguaaauggag

SEQ ID NO: 870034 - RNA, 21 nt, Homo sapiens
gauguguaaauggagcuugua

SEQ ID NO: 870035 - RNA, 23 nt, Homo sapiens
gauguuaagcaaaggaaaccaaa

SEQ ID NO: 870036 - RNA, 15 nt, Homo sapiens
gauguucugggacac

SEQ ID NO: 870037 - RNA, 15 nt, Homo sapiens
gauguuucugucaca

SEQ ID NO: 870038 - RNA, 20 nt, Homo sapiens
gauguuuuuaaaaguuucaa

SEQ ID NO: 870039 - RNA, 23 nt, Homo sapiens
gauuaaaaucuggcaaaguuaua

SEQ ID NO: 870040 - RNA, 16 nt, Homo sapiens
gauuaaggugauguga

SEQ ID NO: 870041 - RNA, 15 nt, Homo sapiens
gauuaauguuuugua

SEQ ID NO: 870042 - RNA, 20 nt, Homo sapiens
gauuacaggugcgcacuacc

SEQ ID NO: 870043 - RNA, 14 nt, Homo sapiens
gauuagaaugccuc

SEQ ID NO: 870044 - RNA, 18 nt, Homo sapiens
gauuagcucuggaccagc

SEQ ID NO: 870045 - RNA, 21 nt, Homo sapiens
gauucaucuauggagggcaga

SEQ ID NO: 870046 - RNA, 13 nt, Homo sapiens
gauuccacuuuua

SEQ ID NO: 870047 - RNA, 15 nt, Homo sapiens
gauucccaccaaggu

SEQ ID NO: 870048 - RNA, 18 nt, Homo sapiens
gauucggauuugacaaaa

SEQ ID NO: 870049 - RNA, 20 nt, Homo sapiens
gauucuucucuuaauuucau

SEQ ID NO: 870050 - RNA, 15 nt, Homo sapiens
gauucuucugccuca

SEQ ID NO: 870051 - RNA, 21 nt, Homo sapiens
gauugagugcuccugugugcu

SEQ ID NO: 870052 - RNA, 22 nt, Homo sapiens
gauuggccccacugacguuggc

SEQ ID NO: 870053 - RNA, 14 nt, Homo sapiens
gauuggcucaccca

SEQ ID NO: 870054 - RNA, 17 nt, Homo sapiens
gauuggcucacccaagc

SEQ ID NO: 870055 - RNA, 19 nt, Homo sapiens
gauuguuuuugcucaaggc

SEQ ID NO: 870056 - RNA, 14 nt, Homo sapiens
gauuuaagcauuuu

SEQ ID NO: 870057 - RNA, 21 nt, Homo sapiens
gauuuacgcucauuguagaaa

SEQ ID NO: 870058 - RNA, 23 nt, Homo sapiens
gauuucagaagccaaguuuuucu

SEQ ID NO: 870059 - RNA, 18 nt, Homo sapiens
gauuucaguuacuuaccu

SEQ ID NO: 870060 - RNA, 21 nt, Homo sapiens
gauuucaguuacuuaccugca

SEQ ID NO: 870061 - RNA, 15 nt, Homo sapiens
gauuucaugauuuca

SEQ ID NO: 870062 - RNA, 12 nt, Homo sapiens
gauuugaacccc

SEQ ID NO: 870063 - RNA, 20 nt, Homo sapiens
gauuugcacccaugccauag

SEQ ID NO: 870064 - RNA, 19 nt, Homo sapiens
gauuuguucacaugcauca

SEQ ID NO: 870065 - RNA, 12 nt, Homo sapiens
gauuuguuuaaa

SEQ ID NO: 870066 - RNA, 16 nt, Homo sapiens
gauuuuauuugacaaa

SEQ ID NO: 870067 - RNA, 13 nt, Homo sapiens
gauuuuccuuccu

SEQ ID NO: 870068 - RNA, 17 nt, Homo sapiens
gauuuuuagcuuuacaa

SEQ ID NO: 870069 - RNA, 23 nt, Homo sapiens
gauuuuuuguuauguuugcacuu

SEQ ID NO: 870070 - RNA, 19 nt, Homo sapiens
gcaaaaccacuagaacucu

SEQ ID NO: 870071 - RNA, 23 nt, Homo sapiens
gcaaaacugccgcaagucugcag

SEQ ID NO: 870072 - RNA, 21 nt, Homo sapiens
gcaaaaguggaaucacuguau

SEQ ID NO: 870073 - RNA, 23 nt, Homo sapiens
gcaaaaguggggcuaaaugaagu

SEQ ID NO: 870074 - RNA, 14 nt, Homo sapiens
gcaaaauaaucuaa

SEQ ID NO: 870075 - RNA, 22 nt, Homo sapiens
gcaaacagagugaaaugccauu

SEQ ID NO: 870076 - RNA, 18 nt, Homo sapiens
gcaaacucacugcucaag

SEQ ID NO: 870077 - RNA, 18 nt, Homo sapiens
gcaaagacuagauccuuu

SEQ ID NO: 870078 - RNA, 20 nt, Homo sapiens
gcaaagagugggccgcugug

SEQ ID NO: 870079 - RNA, 21 nt, Homo sapiens
gcaaagcaccagcuucuccag

SEQ ID NO: 870080 - RNA, 16 nt, Homo sapiens
gcaaagcuggcuuccu

SEQ ID NO: 870081 - RNA, 18 nt, Homo sapiens
gcaaaggaagacgugaug

SEQ ID NO: 870082 - RNA, 15 nt, Homo sapiens
gcaaaggccagcagc

SEQ ID NO: 870083 - RNA, 16 nt, Homo sapiens
gcaaaggccagcagca

SEQ ID NO: 870084 - RNA, 19 nt, Homo sapiens
gcaaagggcugaaagccau

SEQ ID NO: 870085 - RNA, 18 nt, Homo sapiens
gcaaagguggcucuccag

SEQ ID NO: 870086 - RNA, 13 nt, Homo sapiens
gcaaagugcugua

SEQ ID NO: 870087 - RNA, 19 nt, Homo sapiens
gcaaaguggggaguaguca

SEQ ID NO: 870088 - RNA, 22 nt, Homo sapiens
gcaguucgcagccacccugagg

SEQ ID NO: 870089 - RNA, 19 nt, Homo sapiens
gcaguucucgcagauguua

SEQ ID NO: 870090 - RNA, 19 nt, Homo sapiens
gcaguugaaaagacuccaa

SEQ ID NO: 870091 - RNA, 18 nt, Homo sapiens
gcaguuuuguaaauaagu

SEQ ID NO: 870092 - RNA, 17 nt, Homo sapiens
gcauaacuaaauuauuu

SEQ ID NO: 870093 - RNA, 16 nt, Homo sapiens
gcauaaguuucuggga

SEQ ID NO: 870094 - RNA, 15 nt, Homo sapiens
gcauacagagacaga

SEQ ID NO: 870095 - RNA, 13 nt, Homo sapiens
gcauacauguuca

SEQ ID NO: 870096 - RNA, 20 nt, Homo sapiens
gcauaggccauauaauguua

SEQ ID NO: 870097 - RNA, 15 nt, Homo sapiens
gcauauauacauaua

SEQ ID NO: 870098 - RNA, 12 nt, Homo sapiens
gcauaugcaaua

SEQ ID NO: 870099 - RNA, 19 nt, Homo sapiens
gcaucagccuuuguacucu

SEQ ID NO: 870100 - RNA, 23 nt, Homo sapiens
gcaucagcugcugaaacaacaaa

SEQ ID NO: 870101 - RNA, 20 nt, Homo sapiens
gcauccacccagugcugcca

SEQ ID NO: 870102 - RNA, 19 nt, Homo sapiens
gcaucccaugggggugcug

SEQ ID NO: 870103 - RNA, 17 nt, Homo sapiens
gcauccugugugcugac

SEQ ID NO: 870104 - RNA, 23 nt, Homo sapiens
gcaucucagcggggcgcacaugu

SEQ ID NO: 870105 - RNA, 9 nt, Homo sapiens
gcaucucau

SEQ ID NO: 870106 - RNA, 21 nt, Homo sapiens
gcaucugacaugcaucaucuc

SEQ ID NO: 870107 - RNA, 20 nt, Homo sapiens
gcaugaaggcagccacagac

SEQ ID NO: 870108 - RNA, 17 nt, Homo sapiens
gcaugagaaucacuuga

SEQ ID NO: 870109 - RNA, 20 nt, Homo sapiens
gcaugagagaauuguaucau

SEQ ID NO: 870110 - RNA, 19 nt, Homo sapiens
gcaugcacagcugcuuguc

SEQ ID NO: 870111 - RNA, 14 nt, Homo sapiens
gcaugccuauguac

SEQ ID NO: 870112 - RNA, 13 nt, Homo sapiens
gcaugcucaggac

SEQ ID NO: 870113 - RNA, 21 nt, Homo sapiens
gcaugcuuaaauauugaauaa

SEQ ID NO: 870114 - RNA, 15 nt, Homo sapiens
gcauggugcuuucag

SEQ ID NO: 870115 - RNA, 15 nt, Homo sapiens
gcauguccucaaaac

SEQ ID NO: 870116 - RNA, 14 nt, Homo sapiens
gcaugugugugaug

SEQ ID NO: 870117 - RNA, 14 nt, Homo sapiens
gcauguugccauga

SEQ ID NO: 870118 - RNA, 15 nt, Homo sapiens
gcauuaaacauuuga

SEQ ID NO: 870119 - RNA, 22 nt, Homo sapiens
gcauucagcacaccccaaggga

SEQ ID NO: 870120 - RNA, 15 nt, Homo sapiens
gcauucauccaacag

SEQ ID NO: 870121 - RNA, 23 nt, Homo sapiens
gcauucccccuaagaggcaguga

SEQ ID NO: 870122 - RNA, 22 nt, Homo sapiens
gcauugaauauauuauaaucuu

SEQ ID NO: 870123 - RNA, 19 nt, Homo sapiens
gcauuuacuuuguguucac

SEQ ID NO: 870124 - RNA, 22 nt, Homo sapiens
gcauuuauggucaacacuuaag

SEQ ID NO: 870125 - RNA, 17 nt, Homo sapiens
gcauuugcccuguggau

SEQ ID NO: 870126 - RNA, 18 nt, Homo sapiens
gcauuuguuccaugccug

SEQ ID NO: 870127 - RNA, 14 nt, Homo sapiens
gccaaaaauagcua

SEQ ID NO: 870128 - RNA, 16 nt, Homo sapiens
gccaaaauauugcuua

SEQ ID NO: 870129 - RNA, 14 nt, Homo sapiens
gccaaacacacugu

SEQ ID NO: 870130 - RNA, 17 nt, Homo sapiens
gccaaacacccaugccc

SEQ ID NO: 870131 - RNA, 17 nt, Homo sapiens
gccaaacccaugaggca

SEQ ID NO: 870132 - RNA, 20 nt, Homo sapiens
gccaaacccaugaggcaaug

SEQ ID NO: 870133 - RNA, 14 nt, Homo sapiens
gccaaauuuuggcc

SEQ ID NO: 870134 - RNA, 16 nt, Homo sapiens
gccaacaaacauagaa

SEQ ID NO: 870135 - RNA, 17 nt, Homo sapiens
gccaaccugaugccccu

SEQ ID NO: 870136 - RNA, 13 nt, Homo sapiens
gccaacugcugau

SEQ ID NO: 870137 - RNA, 15 nt, Homo sapiens
gccaacuuguaaaua

SEQ ID NO: 870138 - RNA, 20 nt, Homo sapiens
gccaagaucgcgccacugca

SEQ ID NO: 870139 - RNA, 15 nt, Homo sapiens
gccaagccaugucua

SEQ ID NO: 870140 - RNA, 18 nt, Homo sapiens
gccaaggaugacacugcc

SEQ ID NO: 870141 - RNA, 13 nt, Homo sapiens
gccaaugcagcua

SEQ ID NO: 870142 - RNA, 17 nt, Homo sapiens
gccacaaaauguugcaa

SEQ ID NO: 870143 - RNA, 14 nt, Homo sapiens
gccacacacuguuc

SEQ ID NO: 870144 - RNA, 19 nt, Homo sapiens
gccacacccuccccauuca

SEQ ID NO: 870145 - RNA, 16 nt, Homo sapiens
gccacagaagccagga

SEQ ID NO: 870146 - RNA, 21 nt, Homo sapiens
gccacagcuggugguaucuga

SEQ ID NO: 870147 - RNA, 18 nt, Homo sapiens
gccacaucacuacaguac

SEQ ID NO: 870148 - RNA, 12 nt, Homo sapiens
gccacauuugau

SEQ ID NO: 870149 - RNA, 15 nt, Homo sapiens
gccacauuugauuau

SEQ ID NO: 870150 - RNA, 16 nt, Homo sapiens
gccaccacgucugcca

SEQ ID NO: 870151 - RNA, 22 nt, Homo sapiens
gccacccugugggccgggcaau

SEQ ID NO: 870152 - RNA, 17 nt, Homo sapiens
gccacggccuugugucu

SEQ ID NO: 870153 - RNA, 20 nt, Homo sapiens
gccacuaccuucugaccucc

SEQ ID NO: 870154 - RNA, 16 nt, Homo sapiens
gccacuguggccagag

SEQ ID NO: 870155 - RNA, 14 nt, Homo sapiens
gccacuugacauuc

SEQ ID NO: 870156 - RNA, 16 nt, Homo sapiens
gccacuugacauuccu

SEQ ID NO: 870157 - RNA, 23 nt, Homo sapiens
gccacuugguuuuuggcucuuuc

SEQ ID NO: 870158 - RNA, 22 nt, Homo sapiens
gccagaaacguaacugugugca

SEQ ID NO: 870159 - RNA, 19 nt, Homo sapiens
gccagacugguuagacagu

SEQ ID NO: 870160 - RNA, 20 nt, Homo sapiens
gccagagcccaagugccauc

SEQ ID NO: 870161 - RNA, 21 nt, Homo sapiens
gccagagccuggggcauccca

SEQ ID NO: 870162 - RNA, 22 nt, Homo sapiens
gccagagccuggggcaucccag

SEQ ID NO: 870163 - RNA, 16 nt, Homo sapiens
gccagauccacccuau

SEQ ID NO: 870164 - RNA, 21 nt, Homo sapiens
gccagauguggagucuguguc

SEQ ID NO: 870165 - RNA, 22 nt, Homo sapiens
gccagauuuuuuaaaauuuaua

SEQ ID NO: 870166 - RNA, 17 nt, Homo sapiens
gccagcaaugaugucca

SEQ ID NO: 870167 - RNA, 22 nt, Homo sapiens
gccagccggguaccucaguuuc

SEQ ID NO: 870168 - RNA, 13 nt, Homo sapiens
gccagccucagug

SEQ ID NO: 870169 - RNA, 17 nt, Homo sapiens
gccagccucagugccac

SEQ ID NO: 870170 - RNA, 23 nt, Homo sapiens
gccagcugggcuuggaaggaaaa

SEQ ID NO: 870171 - RNA, 23 nt, Homo sapiens
gccaggacagcuggcugcugaca

SEQ ID NO: 870172 - RNA, 21 nt, Homo sapiens
gccaggacaugcagcccagaa

SEQ ID NO: 870173 - RNA, 19 nt, Homo sapiens
gccaggagcuucucugaug

SEQ ID NO: 870174 - RNA, 22 nt, Homo sapiens
gccaggauuccucucucagguc

SEQ ID NO: 870175 - RNA, 17 nt, Homo sapiens
gccaggcuguaagcauu

SEQ ID NO: 870176 - RNA, 21 nt, Homo sapiens
gccaggcuguaagcauucuga

SEQ ID NO: 870177 - RNA, 23 nt, Homo sapiens
gccagggaaagcccgugucaaug

SEQ ID NO: 870178 - RNA, 13 nt, Homo sapiens
gccaggugcagug

SEQ ID NO: 870179 - RNA, 15 nt, Homo sapiens
gccauaaagugccag

SEQ ID NO: 870180 - RNA, 14 nt, Homo sapiens
gccauaacagacca

SEQ ID NO: 870181 - RNA, 14 nt, Homo sapiens
gccauauauauuuc

SEQ ID NO: 870182 - RNA, 21 nt, Homo sapiens
gccauccuaggcuuaaaugca

SEQ ID NO: 870183 - RNA, 23 nt, Homo sapiens
gccaugaggccuuuccccagugu

SEQ ID NO: 870184 - RNA, 22 nt, Homo sapiens
gccaugauaacugcaauuuuaa

SEQ ID NO: 870185 - RNA, 21 nt, Homo sapiens
gccaugaucgagccacugcac

SEQ ID NO: 870186 - RNA, 17 nt, Homo sapiens
gccaugauggugcugac

SEQ ID NO: 870187 - RNA, 19 nt, Homo sapiens
gccaugauggugcugaccu

SEQ ID NO: 870188 - RNA, 20 nt, Homo sapiens
gccaugauggugcugaccuc

SEQ ID NO: 870189 - RNA, 18 nt, Homo sapiens
gccaugggccuccugugu

SEQ ID NO: 870190 - RNA, 21 nt, Homo sapiens
gccauguuuagauuccaggau

SEQ ID NO: 870191 - RNA, 14 nt, Homo sapiens
gccauucacuuccc

SEQ ID NO: 870192 - RNA, 14 nt, Homo sapiens
gccauuccuggaau

SEQ ID NO: 870193 - RNA, 11 nt, Homo sapiens
gccauucugau

SEQ ID NO: 870194 - RNA, 15 nt, Homo sapiens
gcccaaauccagugu

SEQ ID NO: 870195 - RNA, 14 nt, Homo sapiens
gcccaagaauagau

SEQ ID NO: 870196 - RNA, 13 nt, Homo sapiens
gcccaagugccau

SEQ ID NO: 870197 - RNA, 16 nt, Homo sapiens
gcccaaucauuugcaa

SEQ ID NO: 870198 - RNA, 19 nt, Homo sapiens
gcccacgugugcagacugu

SEQ ID NO: 870199 - RNA, 19 nt, Homo sapiens
gcccacugugaaaccacua

SEQ ID NO: 870200 - RNA, 21 nt, Homo sapiens
gcccagaaaaccuccaguagu

SEQ ID NO: 870201 - RNA, 22 nt, Homo sapiens
gcccagagaagcaaguggcuuu

SEQ ID NO: 870202 - RNA, 20 nt, Homo sapiens
gcccagcagggccucaaagu

SEQ ID NO: 870203 - RNA, 14 nt, Homo sapiens
gcccagcuacauuc

SEQ ID NO: 870204 - RNA, 14 nt, Homo sapiens
gcccagcugcaccu

SEQ ID NO: 870205 - RNA, 20 nt, Homo sapiens
gcccaggcuggcgugcagug

SEQ ID NO: 870206 - RNA, 20 nt, Homo sapiens
gcccaggggcccacagggaa

SEQ ID NO: 870207 - RNA, 14 nt, Homo sapiens
gcccagugcacuug

SEQ ID NO: 870208 - RNA, 17 nt, Homo sapiens
gccccaaaccagggugc

SEQ ID NO: 870209 - RNA, 20 nt, Homo sapiens
gccccaacuccuuccagcua

SEQ ID NO: 870210 - RNA, 22 nt, Homo sapiens
gccccacuucucuacucuggaa

SEQ ID NO: 870211 - RNA, 13 nt, Homo sapiens
gccccagugacag

SEQ ID NO: 870212 - RNA, 19 nt, Homo sapiens
gccccaugaccuccagcuu

SEQ ID NO: 870213 - RNA, 15 nt, Homo sapiens
gcccccacccagucc

SEQ ID NO: 870214 - RNA, 13 nt, Homo sapiens
gccccccccaugu

SEQ ID NO: 870215 - RNA, 21 nt, Homo sapiens
gccccccccuugaaucugcag

SEQ ID NO: 870216 - RNA, 18 nt, Homo sapiens
gccccccguguggcuuac

SEQ ID NO: 870217 - RNA, 20 nt, Homo sapiens
gcccccucaucucacugccc

SEQ ID NO: 870218 - RNA, 17 nt, Homo sapiens
gcccccugugccagcuc

SEQ ID NO: 870219 - RNA, 23 nt, Homo sapiens
gccccgaaccucaccugaccuca

SEQ ID NO: 870220 - RNA, 13 nt, Homo sapiens
gccccgacuccag

SEQ ID NO: 870221 - RNA, 23 nt, Homo sapiens
gccccucgccuuuuaggcucagg

SEQ ID NO: 870222 - RNA, 16 nt, Homo sapiens
gccccugcacaaagcc

SEQ ID NO: 870223 - RNA, 18 nt, Homo sapiens
gcccgacaggcaugcacc

SEQ ID NO: 870224 - RNA, 13 nt, Homo sapiens
gcccgggacaggg

SEQ ID NO: 870225 - RNA, 22 nt, Homo sapiens
gcccgggacagggucuugcaag

SEQ ID NO: 870226 - RNA, 22 nt, Homo sapiens
gcccuacaucuucagcucccau

SEQ ID NO: 870227 - RNA, 16 nt, Homo sapiens
gcccucagaacaaucc

SEQ ID NO: 870228 - RNA, 14 nt, Homo sapiens
gcccucaggccagu

SEQ ID NO: 870229 - RNA, 23 nt, Homo sapiens
gcccuccuuaauagccauaugca

SEQ ID NO: 870230 - RNA, 16 nt, Homo sapiens
gcccugcaccugugca

SEQ ID NO: 870231 - RNA, 17 nt, Homo sapiens
gcccugcaccugugcag

SEQ ID NO: 870232 - RNA, 15 nt, Homo sapiens
gcccugcccugccac

SEQ ID NO: 870233 - RNA, 18 nt, Homo sapiens
gcccugccuggaggaccu

SEQ ID NO: 870234 - RNA, 19 nt, Homo sapiens
gcccugggccccaccaccu

SEQ ID NO: 870235 - RNA, 16 nt, Homo sapiens
gcccuggggccuguac

SEQ ID NO: 870236 - RNA, 21 nt, Homo sapiens
gcccugggguaugagcugcca

SEQ ID NO: 870237 - RNA, 20 nt, Homo sapiens
gcccugugagggcucacucg

SEQ ID NO: 870238 - RNA, 15 nt, Homo sapiens
gcccuucugaugaga

SEQ ID NO: 870239 - RNA, 20 nt, Homo sapiens
gcccuugggguaagccagag

SEQ ID NO: 870240 - RNA, 17 nt, Homo sapiens
gcccuuuggguacuacu

SEQ ID NO: 870241 - RNA, 19 nt, Homo sapiens
gccgcauucccugagucac

SEQ ID NO: 870242 - RNA, 19 nt, Homo sapiens
gccggcucuucaaagacaa

SEQ ID NO: 870243 - RNA, 13 nt, Homo sapiens
gccgggacaugca

SEQ ID NO: 870244 - RNA, 15 nt, Homo sapiens
gccguacugucuaug

SEQ ID NO: 870245 - RNA, 18 nt, Homo sapiens
gccguguuacuguugcac

SEQ ID NO: 870246 - RNA, 17 nt, Homo sapiens
gccuaaaaaugcaacuu

SEQ ID NO: 870247 - RNA, 20 nt, Homo sapiens
gccuaagggccacaucccac

SEQ ID NO: 870248 - RNA, 17 nt, Homo sapiens
gccuaauucuuguuguu

SEQ ID NO: 870249 - RNA, 19 nt, Homo sapiens
gccuacaggagugagcacu

SEQ ID NO: 870250 - RNA, 16 nt, Homo sapiens
gccuacguuaacccau

SEQ ID NO: 870251 - RNA, 16 nt, Homo sapiens
gccuagccgaccucag

SEQ ID NO: 870252 - RNA, 14 nt, Homo sapiens
gccuaggaccucag

SEQ ID NO: 870253 - RNA, 14 nt, Homo sapiens
gccuaggugacaga

SEQ ID NO: 870254 - RNA, 15 nt, Homo sapiens
gccuauugugccucu

SEQ ID NO: 870255 - RNA, 12 nt, Homo sapiens
gccucaagaaca

SEQ ID NO: 870256 - RNA, 13 nt, Homo sapiens
gccucagaccuga

SEQ ID NO: 870257 - RNA, 18 nt, Homo sapiens
gccucaggggccucaggg

SEQ ID NO: 870258 - RNA, 20 nt, Homo sapiens
gccucauuuuuuuccuugca

SEQ ID NO: 870259 - RNA, 17 nt, Homo sapiens
gccuccaagccauucac

SEQ ID NO: 870260 - RNA, 16 nt, Homo sapiens
gccuccaagcuccauc

SEQ ID NO: 870261 - RNA, 14 nt, Homo sapiens
gccuccaccucucc

SEQ ID NO: 870262 - RNA, 10 nt, Homo sapiens
gccuccacuc

SEQ ID NO: 870263 - RNA, 20 nt, Homo sapiens
gccuccauucugaccauuuc

SEQ ID NO: 870264 - RNA, 12 nt, Homo sapiens
gccucccaaagu

SEQ ID NO: 870265 - RNA, 20 nt, Homo sapiens
gccucccccucagaugaucu

SEQ ID NO: 870266 - RNA, 16 nt, Homo sapiens
gccucccuuucuggga

SEQ ID NO: 870267 - RNA, 22 nt, Homo sapiens
gccuccucgggggaaagcacac

SEQ ID NO: 870268 - RNA, 16 nt, Homo sapiens
gccuccuuauuuauca

SEQ ID NO: 870269 - RNA, 14 nt, Homo sapiens
gccucgaugccucu

SEQ ID NO: 870270 - RNA, 18 nt, Homo sapiens
gccucgugccaugaucug

SEQ ID NO: 870271 - RNA, 17 nt, Homo sapiens
gccucuccagcacuucu

SEQ ID NO: 870272 - RNA, 13 nt, Homo sapiens
gccucugacucac

SEQ ID NO: 870273 - RNA, 21 nt, Homo sapiens
gccucuggaaaacucaggauu

SEQ ID NO: 870274 - RNA, 19 nt, Homo sapiens
gccucuuccucccucauuc

SEQ ID NO: 870275 - RNA, 19 nt, Homo sapiens
gccucuucgcugaccucga

SEQ ID NO: 870276 - RNA, 20 nt, Homo sapiens
gccucuucgcugaccucgac

SEQ ID NO: 870277 - RNA, 19 nt, Homo sapiens
gccucuuuucucugugcuu

SEQ ID NO: 870278 - RNA, 13 nt, Homo sapiens
gccugaccaacau

SEQ ID NO: 870279 - RNA, 16 nt, Homo sapiens
gccugagcccagggag

SEQ ID NO: 870280 - RNA, 18 nt, Homo sapiens
gccugagucuccugugcc

SEQ ID NO: 870281 - RNA, 20 nt, Homo sapiens
gccugagugcuuuaccuuua

SEQ ID NO: 870282 - RNA, 16 nt, Homo sapiens
gccugcacuaauuuga

SEQ ID NO: 870283 - RNA, 19 nt, Homo sapiens
gccugcccccagcacuccu

SEQ ID NO: 870284 - RNA, 12 nt, Homo sapiens
gccugcccuccc

SEQ ID NO: 870285 - RNA, 13 nt, Homo sapiens
gccugccuugaag

SEQ ID NO: 870286 - RNA, 22 nt, Homo sapiens
gccugcuauuugaaguguaauu

SEQ ID NO: 870287 - RNA, 22 nt, Homo sapiens
gccugcuuggggggugaugagg

SEQ ID NO: 870288 - RNA, 20 nt, Homo sapiens
gccuggaaauuaaacccugc

SEQ ID NO: 870289 - RNA, 19 nt, Homo sapiens
gccuggcaagugggugaaa

SEQ ID NO: 870290 - RNA, 18 nt, Homo sapiens
gccuggcacaggacugau

SEQ ID NO: 870291 - RNA, 14 nt, Homo sapiens
gccuggcaucgcau

SEQ ID NO: 870292 - RNA, 15 nt, Homo sapiens
gccuggcuucuggag

SEQ ID NO: 870293 - RNA, 16 nt, Homo sapiens
gccugggcaacaacag

SEQ ID NO: 870294 - RNA, 19 nt, Homo sapiens
gccugggucaagggccagu

SEQ ID NO: 870295 - RNA, 19 nt, Homo sapiens
gccuguaaucccagcacuu

SEQ ID NO: 870296 - RNA, 22 nt, Homo sapiens
gccuguaaucccagcacuuugg

SEQ ID NO: 870297 - RNA, 17 nt, Homo sapiens
gccuguagccccaguga

SEQ ID NO: 870298 - RNA, 13 nt, Homo sapiens
gccugugcaugua

SEQ ID NO: 870299 - RNA, 20 nt, Homo sapiens
gccugugcauguaugucuug

SEQ ID NO: 870300 - RNA, 14 nt, Homo sapiens
gccugugcuaaaga

SEQ ID NO: 870301 - RNA, 17 nt, Homo sapiens
gccuguguagcugugac

SEQ ID NO: 870302 - RNA, 15 nt, Homo sapiens
gccuguuaacuggua

SEQ ID NO: 870303 - RNA, 22 nt, Homo sapiens
gccuuaccuccugcccaggaga

SEQ ID NO: 870304 - RNA, 15 nt, Homo sapiens
gccuuccacaauuca

SEQ ID NO: 870305 - RNA, 13 nt, Homo sapiens
gccuucugaugag

SEQ ID NO: 870306 - RNA, 12 nt, Homo sapiens
gccuugaugaag

SEQ ID NO: 870307 - RNA, 14 nt, Homo sapiens
gccuugccaugucu

SEQ ID NO: 870308 - RNA, 22 nt, Homo sapiens
gccuuggggauucuuccaucug

SEQ ID NO: 870309 - RNA, 21 nt, Homo sapiens
gccuuuauuaaaaacugagug

SEQ ID NO: 870310 - RNA, 18 nt, Homo sapiens
gccuuucuuauggaagaa

SEQ ID NO: 870311 - RNA, 17 nt, Homo sapiens
gcgaaaggaaagccaaa

SEQ ID NO: 870312 - RNA, 18 nt, Homo sapiens
gcgaaggggcccuggucc

SEQ ID NO: 870313 - RNA, 14 nt, Homo sapiens
gcgaaucaucucaa

SEQ ID NO: 870314 - RNA, 12 nt, Homo sapiens
gcgaaugugcag

SEQ ID NO: 870315 - RNA, 20 nt, Homo sapiens
gcgaucuggguucacugcaa

SEQ ID NO: 870316 - RNA, 17 nt, Homo sapiens
gcgauugaaagggcaau

SEQ ID NO: 870317 - RNA, 23 nt, Homo sapiens
gcuguaaacuauaaacuacugua

SEQ ID NO: 870318 - RNA, 17 nt, Homo sapiens
gcuguauacuguacuga

SEQ ID NO: 870319 - RNA, 18 nt, Homo sapiens
gcuguccauguauucaca

SEQ ID NO: 870320 - RNA, 12 nt, Homo sapiens
gcugucugcuca

SEQ ID NO: 870321 - RNA, 17 nt, Homo sapiens
gcugugaaagaaccaaa

SEQ ID NO: 870322 - RNA, 22 nt, Homo sapiens
gcugugcccucccauagcacug

SEQ ID NO: 870323 - RNA, 15 nt, Homo sapiens
gcuguggccagggug

SEQ ID NO: 870324 - RNA, 20 nt, Homo sapiens
gcugugugugugugaguaug

SEQ ID NO: 870325 - RNA, 19 nt, Homo sapiens
gcuguuauuuaauuagcca

SEQ ID NO: 870326 - RNA, 14 nt, Homo sapiens
gcuguuucuggaaa

SEQ ID NO: 870327 - RNA, 15 nt, Homo sapiens
gcuguuuucuucuau

SEQ ID NO: 870328 - RNA, 21 nt, Homo sapiens
gcuguuuugauuuguacugaa

SEQ ID NO: 870329 - RNA, 18 nt, Homo sapiens
gcuuaaaacaacacucac

SEQ ID NO: 870330 - RNA, 21 nt, Homo sapiens
gcuuaaacuugacccaggugg

SEQ ID NO: 870331 - RNA, 16 nt, Homo sapiens
gcuuaaaugcaauauu

SEQ ID NO: 870332 - RNA, 18 nt, Homo sapiens
gcuuacauuuuuacaaua

SEQ ID NO: 870333 - RNA, 13 nt, Homo sapiens
gcuuagaccucag

SEQ ID NO: 870334 - RNA, 18 nt, Homo sapiens
gcuuauauauauuugauu

SEQ ID NO: 870335 - RNA, 18 nt, Homo sapiens
gcuuauccaugccuggga

SEQ ID NO: 870336 - RNA, 20 nt, Homo sapiens
gcuuauucaucuguuuuucu

SEQ ID NO: 870337 - RNA, 21 nt, Homo sapiens
gcuuauucuaggucuguaauu

SEQ ID NO: 870338 - RNA, 19 nt, Homo sapiens
gcuucaccccugcacuuca

SEQ ID NO: 870339 - RNA, 13 nt, Homo sapiens
gcuucagccucuc

SEQ ID NO: 870340 - RNA, 18 nt, Homo sapiens
gcuucaguggcagcugcu

SEQ ID NO: 870341 - RNA, 21 nt, Homo sapiens
gcuucaucaauuuuuauacau

SEQ ID NO: 870342 - RNA, 20 nt, Homo sapiens
gcuucauuugggaaauucag

SEQ ID NO: 870343 - RNA, 18 nt, Homo sapiens
gcuucauuuuugggagaa

SEQ ID NO: 870344 - RNA, 21 nt, Homo sapiens
gcuuccgugugucaucagggu

SEQ ID NO: 870345 - RNA, 12 nt, Homo sapiens
gcuuccuaacug

SEQ ID NO: 870346 - RNA, 14 nt, Homo sapiens
gcuuccuaacugcu

SEQ ID NO: 870347 - RNA, 17 nt, Homo sapiens
gcuuccugacugacaca

SEQ ID NO: 870348 - RNA, 22 nt, Homo sapiens
gcuuccuuagguugaugcugga

SEQ ID NO: 870349 - RNA, 17 nt, Homo sapiens
gcuuccuucauuuccuc

SEQ ID NO: 870350 - RNA, 22 nt, Homo sapiens
gcuuccuucauuuccuccguca

SEQ ID NO: 870351 - RNA, 17 nt, Homo sapiens
gcuucuaugguugacau

SEQ ID NO: 870352 - RNA, 14 nt, Homo sapiens
gcuucucaucccca

SEQ ID NO: 870353 - RNA, 16 nt, Homo sapiens
gcuucuggagcccuug

SEQ ID NO: 870354 - RNA, 17 nt, Homo sapiens
gcuucuguccaggacau

SEQ ID NO: 870355 - RNA, 17 nt, Homo sapiens
gcuucuucaucuuuaaa

SEQ ID NO: 870356 - RNA, 23 nt, Homo sapiens
gcuucuuuucacuucagagcaca

SEQ ID NO: 870357 - RNA, 15 nt, Homo sapiens
gcuugagcccaggag

SEQ ID NO: 870358 - RNA, 11 nt, Homo sapiens
gcuugccauau

SEQ ID NO: 870359 - RNA, 21 nt, Homo sapiens
gcuugccccacccaacaagcc

SEQ ID NO: 870360 - RNA, 15 nt, Homo sapiens
gcuuggcccuauuaa

SEQ ID NO: 870361 - RNA, 19 nt, Homo sapiens
gcuugggcccugcacagau

SEQ ID NO: 870362 - RNA, 21 nt, Homo sapiens
gcuugggggcuccacuggcuc

SEQ ID NO: 870363 - RNA, 13 nt, Homo sapiens
gcuuguagcagaa

SEQ ID NO: 870364 - RNA, 22 nt, Homo sapiens
gcuuguuguuuuuaaguccugu

SEQ ID NO: 870365 - RNA, 14 nt, Homo sapiens
gcuuguuuguucua

SEQ ID NO: 870366 - RNA, 19 nt, Homo sapiens
gcuuuacccucaggugcua

SEQ ID NO: 870367 - RNA, 13 nt, Homo sapiens
gcuuuaccuuuau

SEQ ID NO: 870368 - RNA, 20 nt, Homo sapiens
gcuuuauuuuuuaaguauuu

SEQ ID NO: 870369 - RNA, 21 nt, Homo sapiens
gcuuuauuuuuuaaguauuua

SEQ ID NO: 870370 - RNA, 18 nt, Homo sapiens
gcuuucaugaacacagcc

SEQ ID NO: 870371 - RNA, 19 nt, Homo sapiens
gcuuucccggacugcaagc

SEQ ID NO: 870372 - RNA, 20 nt, Homo sapiens
gcuuucuucuacaaccagag

SEQ ID NO: 870373 - RNA, 13 nt, Homo sapiens
gcuuugcaggcuc

SEQ ID NO: 870374 - RNA, 13 nt, Homo sapiens
gcuuuguaccaaa

SEQ ID NO: 870375 - RNA, 21 nt, Homo sapiens
gcuuuguuucuuucauaugaa

SEQ ID NO: 870376 - RNA, 19 nt, Homo sapiens
gcuuuuaagaaacacaggg

SEQ ID NO: 870377 - RNA, 22 nt, Homo sapiens
gcuuuuuucuugaguacuagaa

SEQ ID NO: 870378 - RNA, 19 nt, Homo sapiens
ggaaaaaccaauagcuuua

SEQ ID NO: 870379 - RNA, 21 nt, Homo sapiens
ggaaaagagcgcaucaggccu

SEQ ID NO: 870380 - RNA, 12 nt, Homo sapiens
ggaaaaugagua

SEQ ID NO: 870381 - RNA, 17 nt, Homo sapiens
ggaaaaugugacccaga

SEQ ID NO: 870382 - RNA, 15 nt, Homo sapiens
ggaaaaugugcaaua

SEQ ID NO: 870383 - RNA, 12 nt, Homo sapiens
ggaaacagagaa

SEQ ID NO: 870384 - RNA, 14 nt, Homo sapiens
ggaaaccaguguag

SEQ ID NO: 870385 - RNA, 19 nt, Homo sapiens
ggaaaccuugcagcauuuu

SEQ ID NO: 870386 - RNA, 23 nt, Homo sapiens
ggaaagaaaacuaacaaccaacc

SEQ ID NO: 870387 - RNA, 16 nt, Homo sapiens
ggaaagaugaucagcu

SEQ ID NO: 870388 - RNA, 12 nt, Homo sapiens
ggaaagccaaac

SEQ ID NO: 870389 - RNA, 14 nt, Homo sapiens
ggaaaggauucaug

SEQ ID NO: 870390 - RNA, 22 nt, Homo sapiens
ggaaaguaaauauuucaggcau

SEQ ID NO: 870391 - RNA, 16 nt, Homo sapiens
ggaaaguucagccaga

SEQ ID NO: 870392 - RNA, 22 nt, Homo sapiens
ggaaauauguucuaacagcauc

SEQ ID NO: 870393 - RNA, 18 nt, Homo sapiens
ggaacagaaggaugaaug

SEQ ID NO: 870394 - RNA, 20 nt, Homo sapiens
ggaacccugcuugcacuuug

SEQ ID NO: 870395 - RNA, 20 nt, Homo sapiens
ggaacucuggcuuccaggua

SEQ ID NO: 870396 - RNA, 17 nt, Homo sapiens
ggaacugguucaagaga

SEQ ID NO: 870397 - RNA, 19 nt, Homo sapiens
ggaacugucucucaugaac

SEQ ID NO: 870398 - RNA, 13 nt, Homo sapiens
ggaagaagccaga

SEQ ID NO: 870399 - RNA, 14 nt, Homo sapiens
ggaagacuugccac

SEQ ID NO: 870400 - RNA, 23 nt, Homo sapiens
ggaagauucccucuuccugccaa

SEQ ID NO: 870401 - RNA, 13 nt, Homo sapiens
ggaagccaaacaa

SEQ ID NO: 870402 - RNA, 14 nt, Homo sapiens
ggaagcuccacugu

SEQ ID NO: 870403 - RNA, 21 nt, Homo sapiens
ggaagcuccgcuuucuaccca

SEQ ID NO: 870404 - RNA, 11 nt, Homo sapiens
ggaagcuguuu

SEQ ID NO: 870405 - RNA, 14 nt, Homo sapiens
ggaaggagugagau

SEQ ID NO: 870406 - RNA, 12 nt, Homo sapiens
ggaagguacaaa

SEQ ID NO: 870407 - RNA, 22 nt, Homo sapiens
ggaagguagcccagcacuguga

SEQ ID NO: 870408 - RNA, 19 nt, Homo sapiens
ggaaggucccuuguuucca

SEQ ID NO: 870409 - RNA, 22 nt, Homo sapiens
ggaagucucuuuuuuuacucuu

SEQ ID NO: 870410 - RNA, 22 nt, Homo sapiens
ggaauaaauugcuccuugacau

SEQ ID NO: 870411 - RNA, 16 nt, Homo sapiens
ggaauaagaagcaaau

SEQ ID NO: 870412 - RNA, 23 nt, Homo sapiens
ggaauauauuugugugugugaua

SEQ ID NO: 870413 - RNA, 20 nt, Homo sapiens
ggaauauuugcaagacauag

SEQ ID NO: 870414 - RNA, 22 nt, Homo sapiens
ggaauauuugcaagacauagaa

SEQ ID NO: 870415 - RNA, 16 nt, Homo sapiens
ggaaucaauuucccag

SEQ ID NO: 870416 - RNA, 17 nt, Homo sapiens
ggaauccagacccggcu

SEQ ID NO: 870417 - RNA, 21 nt, Homo sapiens
ggaauccgccugcagaggaca

SEQ ID NO: 870418 - RNA, 19 nt, Homo sapiens
ggaauguccagacuguggg

SEQ ID NO: 870419 - RNA, 15 nt, Homo sapiens
ggaauugcaugccau

SEQ ID NO: 870420 - RNA, 21 nt, Homo sapiens
ggacaaaguguagcagccucc

SEQ ID NO: 870421 - RNA, 13 nt, Homo sapiens
ggacacuuguaug

SEQ ID NO: 870422 - RNA, 18 nt, Homo sapiens
ggacaggauaagagggau

SEQ ID NO: 870423 - RNA, 17 nt, Homo sapiens
ggacaggugaauggagg

SEQ ID NO: 870424 - RNA, 15 nt, Homo sapiens
ggacaguugggcuau

SEQ ID NO: 870425 - RNA, 13 nt, Homo sapiens
ggaccaauaccuc

SEQ ID NO: 870426 - RNA, 16 nt, Homo sapiens
ggaccacauguguucu

SEQ ID NO: 870427 - RNA, 15 nt, Homo sapiens
ggaccagccacugug

SEQ ID NO: 870428 - RNA, 15 nt, Homo sapiens
ggaccgcuacaccac

SEQ ID NO: 870429 - RNA, 13 nt, Homo sapiens
ggaccucugcucu

SEQ ID NO: 870430 - RNA, 18 nt, Homo sapiens
ggacgccacucauuucau

SEQ ID NO: 870431 - RNA, 21 nt, Homo sapiens
ucuaacuacaaggacaaugcc

SEQ ID NO: 870432 - RNA, 17 nt, Homo sapiens
ucuaagccuuuccauaa

SEQ ID NO: 870433 - RNA, 19 nt, Homo sapiens
ucuaagguaguaacuuucc

SEQ ID NO: 870434 - RNA, 15 nt, Homo sapiens
ucuaagucuccaaga

SEQ ID NO: 870435 - RNA, 18 nt, Homo sapiens
ucuaagucuccaagaaua

SEQ ID NO: 870436 - RNA, 19 nt, Homo sapiens
ucuaagugguauauacaua

SEQ ID NO: 870437 - RNA, 13 nt, Homo sapiens
ucuaaucuaugca

SEQ ID NO: 870438 - RNA, 12 nt, Homo sapiens
ucuaaugucuuc

SEQ ID NO: 870439 - RNA, 18 nt, Homo sapiens
ucuaauucucuuacccag

SEQ ID NO: 870440 - RNA, 15 nt, Homo sapiens
ucuaauuggcaugaa

SEQ ID NO: 870441 - RNA, 23 nt, Homo sapiens
ucuaauuuauacaaaauaauuua

SEQ ID NO: 870442 - RNA, 17 nt, Homo sapiens
ucuacaagcaaauggag

SEQ ID NO: 870443 - RNA, 15 nt, Homo sapiens
ucuacaagcauuugc

SEQ ID NO: 870444 - RNA, 23 nt, Homo sapiens
ucuacacagcaguaugaaugaug

SEQ ID NO: 870445 - RNA, 21 nt, Homo sapiens
ucuacaccuguugcaccucag

SEQ ID NO: 870446 - RNA, 21 nt, Homo sapiens
ucuacaguuaggguugaguua

SEQ ID NO: 870447 - RNA, 16 nt, Homo sapiens
ucuacauacuauggaa

SEQ ID NO: 870448 - RNA, 13 nt, Homo sapiens
ucuacauauaugu

SEQ ID NO: 870449 - RNA, 17 nt, Homo sapiens
ucuaccaggucaaaaua

SEQ ID NO: 870450 - RNA, 13 nt, Homo sapiens
ucuaccauuugaa

SEQ ID NO: 870451 - RNA, 18 nt, Homo sapiens
ucuacccggcccagagac

SEQ ID NO: 870452 - RNA, 20 nt, Homo sapiens
ucuaccuaggaugcaugaca

SEQ ID NO: 870453 - RNA, 21 nt, Homo sapiens
ucuaccuuuuuuucucuccua

SEQ ID NO: 870454 - RNA, 16 nt, Homo sapiens
ucuacuccaugcacau

SEQ ID NO: 870455 - RNA, 22 nt, Homo sapiens
ucuacuuauccucauuacccag

SEQ ID NO: 870456 - RNA, 15 nt, Homo sapiens
ucuacuucagucuuc

SEQ ID NO: 870457 - RNA, 17 nt, Homo sapiens
ucuacuucugucuuccu

SEQ ID NO: 870458 - RNA, 17 nt, Homo sapiens
ucuagaagauaucauga

SEQ ID NO: 870459 - RNA, 19 nt, Homo sapiens
ucuagaagcgguuuccagg

SEQ ID NO: 870460 - RNA, 20 nt, Homo sapiens
ucuagaagcgguuuccaggc

SEQ ID NO: 870461 - RNA, 22 nt, Homo sapiens
ucuagacugucucuguggaaua

SEQ ID NO: 870462 - RNA, 21 nt, Homo sapiens
ucuagccugaauucuuuucaa

SEQ ID NO: 870463 - RNA, 17 nt, Homo sapiens
ucuagcucuaguucaaa

SEQ ID NO: 870464 - RNA, 15 nt, Homo sapiens
ucuagcuuuagggga

SEQ ID NO: 870465 - RNA, 20 nt, Homo sapiens
ucuaguauuccagaccugaa

SEQ ID NO: 870466 - RNA, 14 nt, Homo sapiens
ucuagugacuuccu

SEQ ID NO: 870467 - RNA, 16 nt, Homo sapiens
ucuauaaaauacuggu

SEQ ID NO: 870468 - RNA, 16 nt, Homo sapiens
ucuauauaauguagua

SEQ ID NO: 870469 - RNA, 18 nt, Homo sapiens
ucuauauuggucauugcc

SEQ ID NO: 870470 - RNA, 17 nt, Homo sapiens
ucuauccuguacauuuc

SEQ ID NO: 870471 - RNA, 22 nt, Homo sapiens
ucuaugagauagguacuauuau

SEQ ID NO: 870472 - RNA, 21 nt, Homo sapiens
ucuaugccagcucagucccau

SEQ ID NO: 870473 - RNA, 12 nt, Homo sapiens
ucuauguaucua

SEQ ID NO: 870474 - RNA, 21 nt, Homo sapiens
ucuauuaccuguuaguauuau

SEQ ID NO: 870475 - RNA, 13 nt, Homo sapiens
ucuauuaucugua

SEQ ID NO: 870476 - RNA, 15 nt, Homo sapiens
ucuauucuuucccua

SEQ ID NO: 870477 - RNA, 20 nt, Homo sapiens
ucuauucuuuguaccaucug

SEQ ID NO: 870478 - RNA, 16 nt, Homo sapiens
ucuauuuccuccccca

SEQ ID NO: 870479 - RNA, 17 nt, Homo sapiens
ucucaaagaaagcauuu

SEQ ID NO: 870480 - RNA, 22 nt, Homo sapiens
ucucaaauucauggugcacuga

SEQ ID NO: 870481 - RNA, 14 nt, Homo sapiens
ucucaagacugaaa

SEQ ID NO: 870482 - RNA, 16 nt, Homo sapiens
ucucaagcuagccaga

SEQ ID NO: 870483 - RNA, 19 nt, Homo sapiens
ucucaagcucuuccuuacu

SEQ ID NO: 870484 - RNA, 17 nt, Homo sapiens
ucucacuaaaauggaua

SEQ ID NO: 870485 - RNA, 12 nt, Homo sapiens
ucucacuauguu

SEQ ID NO: 870486 - RNA, 18 nt, Homo sapiens
ucucacuugugcaguguu

SEQ ID NO: 870487 - RNA, 14 nt, Homo sapiens
ucucagaauucuuc

SEQ ID NO: 870488 - RNA, 20 nt, Homo sapiens
ucucagaccugcgcacucca

SEQ ID NO: 870489 - RNA, 17 nt, Homo sapiens
ucucagcuccgucaucu

SEQ ID NO: 870490 - RNA, 19 nt, Homo sapiens
ucucaggagcuugcaagaa

SEQ ID NO: 870491 - RNA, 20 nt, Homo sapiens
ucucaggagcuugcaagaag

SEQ ID NO: 870492 - RNA, 23 nt, Homo sapiens
ucucaggaguaucuuaccuguaa

SEQ ID NO: 870493 - RNA, 16 nt, Homo sapiens
ucucagugcucuccua

SEQ ID NO: 870494 - RNA, 23 nt, Homo sapiens
ucucaucaacaaagaaauauuau

SEQ ID NO: 870495 - RNA, 18 nt, Homo sapiens
ucucauuuaaaaugagau

SEQ ID NO: 870496 - RNA, 19 nt, Homo sapiens
ucucauuuaaaaugagauc

SEQ ID NO: 870497 - RNA, 15 nt, Homo sapiens
ucucauuugucacac

SEQ ID NO: 870498 - RNA, 20 nt, Homo sapiens
ucuccacgguagcacuugac

SEQ ID NO: 870499 - RNA, 12 nt, Homo sapiens
ucuccacuccau

SEQ ID NO: 870500 - RNA, 17 nt, Homo sapiens
ucuccagacccaccaca

SEQ ID NO: 870501 - RNA, 22 nt, Homo sapiens
ucuccagccagcaaugaugucc

SEQ ID NO: 870502 - RNA, 18 nt, Homo sapiens
ucuccaucucugucucaa

SEQ ID NO: 870503 - RNA, 22 nt, Homo sapiens
ucucccacauauucacauacgu

SEQ ID NO: 870504 - RNA, 22 nt, Homo sapiens
ucuccccccaacacaaucuuuc

SEQ ID NO: 870505 - RNA, 17 nt, Homo sapiens
ucucccccugggcucug

SEQ ID NO: 870506 - RNA, 18 nt, Homo sapiens
ucuccuccaacccaaccu

SEQ ID NO: 870507 - RNA, 21 nt, Homo sapiens
ucuccugucagagaucuggga

SEQ ID NO: 870508 - RNA, 16 nt, Homo sapiens
ucuccuguccaaccua

SEQ ID NO: 870509 - RNA, 14 nt, Homo sapiens
ucuccuugcacuuu

SEQ ID NO: 870510 - RNA, 13 nt, Homo sapiens
ucuccuuugaggg

SEQ ID NO: 870511 - RNA, 17 nt, Homo sapiens
ucuccuuugcacugagg

SEQ ID NO: 870512 - RNA, 14 nt, Homo sapiens
ucuccuuuugacca

SEQ ID NO: 870513 - RNA, 23 nt, Homo sapiens
ucuccuuuugaccaaauaaagua

SEQ ID NO: 870514 - RNA, 17 nt, Homo sapiens
ucucgcagauguuaccu

SEQ ID NO: 870515 - RNA, 23 nt, Homo sapiens
ucucuaaaauagccacuuaccuu

SEQ ID NO: 870516 - RNA, 22 nt, Homo sapiens
ucucuaauuggaagaaauuccu

SEQ ID NO: 870517 - RNA, 23 nt, Homo sapiens
ucucuacaaacucccacuuguca

SEQ ID NO: 870518 - RNA, 20 nt, Homo sapiens
ucucuacccggcccagagac

SEQ ID NO: 870519 - RNA, 23 nt, Homo sapiens
ucucuaucccaagccaaccaaga

SEQ ID NO: 870520 - RNA, 15 nt, Homo sapiens
ucucuauugcugcuc

SEQ ID NO: 870521 - RNA, 14 nt, Homo sapiens
ucucuccagccuga

SEQ ID NO: 870522 - RNA, 22 nt, Homo sapiens
ucucucccaccccggccuccac

SEQ ID NO: 870523 - RNA, 20 nt, Homo sapiens
ucucuccucagacugcucaa

SEQ ID NO: 870524 - RNA, 23 nt, Homo sapiens
ucucucuaaaaauaaaaugaugu

SEQ ID NO: 870525 - RNA, 11 nt, Homo sapiens
ucucucucuuu

SEQ ID NO: 870526 - RNA, 15 nt, Homo sapiens
ucucucuugcaggaa

SEQ ID NO: 870527 - RNA, 14 nt, Homo sapiens
ucucugagaacaga

SEQ ID NO: 870528 - RNA, 17 nt, Homo sapiens
ucucugaggacacuaac

SEQ ID NO: 870529 - RNA, 20 nt, Homo sapiens
ucucugggagacuuucccua

SEQ ID NO: 870530 - RNA, 20 nt, Homo sapiens
ucucuggguagguguugaaa

SEQ ID NO: 870531 - RNA, 16 nt, Homo sapiens
ucucugugugcacaaa

SEQ ID NO: 870532 - RNA, 14 nt, Homo sapiens
ucucuuaauuuuuc

SEQ ID NO: 870533 - RNA, 23 nt, Homo sapiens
ucucuuucuuuuucugucucucu

SEQ ID NO: 870534 - RNA, 22 nt, Homo sapiens
ucucuuuuguuccuggcuuuga

SEQ ID NO: 870535 - RNA, 18 nt, Homo sapiens
ucugaaaauuaacacugc

SEQ ID NO: 870536 - RNA, 18 nt, Homo sapiens
ucugaaacuuaauuacau

SEQ ID NO: 870537 - RNA, 17 nt, Homo sapiens
ucugaacaaacacugaa

SEQ ID NO: 870538 - RNA, 18 nt, Homo sapiens
ucugaaccauuacuguaa

SEQ ID NO: 870539 - RNA, 13 nt, Homo sapiens
ucugaagaucuca

SEQ ID NO: 870540 - RNA, 23 nt, Homo sapiens
ucugaagucacaucacaggacac

SEQ ID NO: 870541 - RNA, 17 nt, Homo sapiens
ucugaagucaguuucua

SEQ ID NO: 870542 - RNA, 13 nt, Homo sapiens
ucugaauugacug

SEQ ID NO: 870543 - RNA, 13 nt, Homo sapiens
ucugaccauuuca

SEQ ID NO: 870544 - RNA, 18 nt, Homo sapiens
ucugaccauuucaggggu

SEQ ID NO: 870545 - RNA, 15 nt, Homo sapiens
ugaaugauacccuga

SEQ ID NO: 870546 - RNA, 11 nt, Homo sapiens
ugaaugcuauu

SEQ ID NO: 870547 - RNA, 22 nt, Homo sapiens
ugaauguagugugucagaguaa

SEQ ID NO: 870548 - RNA, 18 nt, Homo sapiens
ugaauguauaaagacacc

SEQ ID NO: 870549 - RNA, 17 nt, Homo sapiens
ugaaugucuuacuguga

SEQ ID NO: 870550 - RNA, 19 nt, Homo sapiens
ugaaugucuuacugugauc

SEQ ID NO: 870551 - RNA, 19 nt, Homo sapiens
ugaaugugccuaauggaga

SEQ ID NO: 870552 - RNA, 19 nt, Homo sapiens
ugaauguguugauuugaga

SEQ ID NO: 870553 - RNA, 17 nt, Homo sapiens
ugaauuggaccauccua

SEQ ID NO: 870554 - RNA, 18 nt, Homo sapiens
ugaauuggauacaaggau

SEQ ID NO: 870555 - RNA, 14 nt, Homo sapiens
ugaauuucaguaaa

SEQ ID NO: 870556 - RNA, 15 nt, Homo sapiens
ugaauuuccuaucug

SEQ ID NO: 870557 - RNA, 18 nt, Homo sapiens
ugaauuugccuuccucau

SEQ ID NO: 870558 - RNA, 18 nt, Homo sapiens
ugaauuuggccagacaca

SEQ ID NO: 870559 - RNA, 16 nt, Homo sapiens
ugacaaaauuggccag

SEQ ID NO: 870560 - RNA, 21 nt, Homo sapiens
ugacaagcaagggcugugcug

SEQ ID NO: 870561 - RNA, 14 nt, Homo sapiens
ugacacacagcagc

SEQ ID NO: 870562 - RNA, 15 nt, Homo sapiens
ugacacauaugcacc

SEQ ID NO: 870563 - RNA, 13 nt, Homo sapiens
ugacacauucucu

SEQ ID NO: 870564 - RNA, 15 nt, Homo sapiens
ugacaccaccaucua

SEQ ID NO: 870565 - RNA, 19 nt, Homo sapiens
ugacaccagaauaaugagu

SEQ ID NO: 870566 - RNA, 15 nt, Homo sapiens
ugacacgguaggcca

SEQ ID NO: 870567 - RNA, 16 nt, Homo sapiens
ugacacugccagucac

SEQ ID NO: 870568 - RNA, 18 nt, Homo sapiens
ugacagaagcuucugccc

SEQ ID NO: 870569 - RNA, 18 nt, Homo sapiens
ugacagaguucacuauaa

SEQ ID NO: 870570 - RNA, 15 nt, Homo sapiens
ugacagcacuacaaa

SEQ ID NO: 870571 - RNA, 17 nt, Homo sapiens
ugacagcaggugggaaa

SEQ ID NO: 870572 - RNA, 17 nt, Homo sapiens
ugacagccagagccugu

SEQ ID NO: 870573 - RNA, 21 nt, Homo sapiens
ugacaggaagcccaaggcagu

SEQ ID NO: 870574 - RNA, 16 nt, Homo sapiens
ugacagggaugccaac

SEQ ID NO: 870575 - RNA, 15 nt, Homo sapiens
ugacaguaugcauua

SEQ ID NO: 870576 - RNA, 16 nt, Homo sapiens
ugacagucuugcauuc

SEQ ID NO: 870577 - RNA, 16 nt, Homo sapiens
ugacagucuugugcuu

SEQ ID NO: 870578 - RNA, 16 nt, Homo sapiens
ugacaugggugugcca

SEQ ID NO: 870579 - RNA, 17 nt, Homo sapiens
ugacaugggugugccag

SEQ ID NO: 870580 - RNA, 18 nt, Homo sapiens
ugacauuaagacacaccu

SEQ ID NO: 870581 - RNA, 23 nt, Homo sapiens
ugacauucacccuucaacauaaa

SEQ ID NO: 870582 - RNA, 20 nt, Homo sapiens
ugaccaagagagaaagaagu

SEQ ID NO: 870583 - RNA, 20 nt, Homo sapiens
ugaccaagauacuuaagugc

SEQ ID NO: 870584 - RNA, 18 nt, Homo sapiens
ugaccaggacuaaugcau

SEQ ID NO: 870585 - RNA, 15 nt, Homo sapiens
ugacccacccagugu

SEQ ID NO: 870586 - RNA, 20 nt, Homo sapiens
ugacccacucacacuuggag

SEQ ID NO: 870587 - RNA, 16 nt, Homo sapiens
ugacccuccaccgcag

SEQ ID NO: 870588 - RNA, 19 nt, Homo sapiens
ugaccggcagaauguucug

SEQ ID NO: 870589 - RNA, 19 nt, Homo sapiens
ugaccuaguaaacuuugua

SEQ ID NO: 870590 - RNA, 15 nt, Homo sapiens
ugaccucacagugac

SEQ ID NO: 870591 - RNA, 18 nt, Homo sapiens
ugaccucauuuguaaaau

SEQ ID NO: 870592 - RNA, 15 nt, Homo sapiens
ugaccuccuccugcc

SEQ ID NO: 870593 - RNA, 22 nt, Homo sapiens
ugaccugaggcuccugugcuac

SEQ ID NO: 870594 - RNA, 16 nt, Homo sapiens
ugaccuguuauuacca

SEQ ID NO: 870595 - RNA, 21 nt, Homo sapiens
ugaccuuguugcaugauguau

SEQ ID NO: 870596 - RNA, 22 nt, Homo sapiens
ugaccuuguugcaugauguauu

SEQ ID NO: 870597 - RNA, 19 nt, Homo sapiens
ugaccuuucugagugacau

SEQ ID NO: 870598 - RNA, 16 nt, Homo sapiens
ugacggacguccugcu

SEQ ID NO: 870599 - RNA, 12 nt, Homo sapiens
ugacuaaacaac

SEQ ID NO: 870600 - RNA, 20 nt, Homo sapiens
ugacuaaacaacuaccuccu

SEQ ID NO: 870601 - RNA, 13 nt, Homo sapiens
ugacuaccagcua

SEQ ID NO: 870602 - RNA, 16 nt, Homo sapiens
ugacuaucacauacaa

SEQ ID NO: 870603 - RNA, 21 nt, Homo sapiens
ugacuaucacauacaauuugc

SEQ ID NO: 870604 - RNA, 17 nt, Homo sapiens
ugacuauggcuaccaaa

SEQ ID NO: 870605 - RNA, 19 nt, Homo sapiens
ugacuauggcuaccaaaaa

SEQ ID NO: 870606 - RNA, 19 nt, Homo sapiens
ugacucaacgagagcacuu

SEQ ID NO: 870607 - RNA, 23 nt, Homo sapiens
ugacucacaagaagaccagacug

SEQ ID NO: 870608 - RNA, 22 nt, Homo sapiens
ugacuccuuucucuaaaacugc

SEQ ID NO: 870609 - RNA, 14 nt, Homo sapiens
ugacucugacuuug

SEQ ID NO: 870610 - RNA, 14 nt, Homo sapiens
ugacuggcacccaa

SEQ ID NO: 870611 - RNA, 17 nt, Homo sapiens
ugacugggaccaggcac

SEQ ID NO: 870612 - RNA, 23 nt, Homo sapiens
ugacuguaaacauagauagugcu

SEQ ID NO: 870613 - RNA, 20 nt, Homo sapiens
ugacuuccucgccucuccca

SEQ ID NO: 870614 - RNA, 21 nt, Homo sapiens
ugacuucuugcuuguacauau

SEQ ID NO: 870615 - RNA, 16 nt, Homo sapiens
ugagaaaagcuuugaa

SEQ ID NO: 870616 - RNA, 17 nt, Homo sapiens
ugagaaaagcuuugaac

SEQ ID NO: 870617 - RNA, 13 nt, Homo sapiens
ugagaaaaucagu

SEQ ID NO: 870618 - RNA, 17 nt, Homo sapiens
ugagaaacccaccagcc

SEQ ID NO: 870619 - RNA, 23 nt, Homo sapiens
ugagaaaccuuauuguaccucuc

SEQ ID NO: 870620 - RNA, 17 nt, Homo sapiens
ugagaaacuuccuuuga

SEQ ID NO: 870621 - RNA, 16 nt, Homo sapiens
ugagaacauuuacaca

SEQ ID NO: 870622 - RNA, 23 nt, Homo sapiens
ugagaacauuuacacauucucac

SEQ ID NO: 870623 - RNA, 15 nt, Homo sapiens
ugagaagaaaugaca

SEQ ID NO: 870624 - RNA, 20 nt, Homo sapiens
ugagaagugucuaaaaacac

SEQ ID NO: 870625 - RNA, 20 nt, Homo sapiens
ugagaaucgaccucacuguc

SEQ ID NO: 870626 - RNA, 17 nt, Homo sapiens
ugagaccacuguuauca

SEQ ID NO: 870627 - RNA, 22 nt, Homo sapiens
ugagaccagccugggcagcaua

SEQ ID NO: 870628 - RNA, 16 nt, Homo sapiens
ugagacccccaucucu

SEQ ID NO: 870629 - RNA, 16 nt, Homo sapiens
ugagaccgaaucucac

SEQ ID NO: 870630 - RNA, 21 nt, Homo sapiens
ugagagggauuuggguguuua

SEQ ID NO: 870631 - RNA, 18 nt, Homo sapiens
ugagaggguuugagucaa

SEQ ID NO: 870632 - RNA, 22 nt, Homo sapiens
ugagaguaucaggucucccacg

SEQ ID NO: 870633 - RNA, 11 nt, Homo sapiens
ugagauaacca

SEQ ID NO: 870634 - RNA, 22 nt, Homo sapiens
ugagaugcaggauuucuucaca

SEQ ID NO: 870635 - RNA, 17 nt, Homo sapiens
ugagcaauucauuucac

SEQ ID NO: 870636 - RNA, 22 nt, Homo sapiens
ugagcacugccaggagggacaa

SEQ ID NO: 870637 - RNA, 19 nt, Homo sapiens
ugagcagacugcaaaucug

SEQ ID NO: 870638 - RNA, 16 nt, Homo sapiens
ugagcagucacacugu

SEQ ID NO: 870639 - RNA, 22 nt, Homo sapiens
ugagccagccuugcaguaggca

SEQ ID NO: 870640 - RNA, 12 nt, Homo sapiens
ugagccagguaa

SEQ ID NO: 870641 - RNA, 13 nt, Homo sapiens
ugagccugagaug

SEQ ID NO: 870642 - RNA, 14 nt, Homo sapiens
ugagccugauuauc

SEQ ID NO: 870643 - RNA, 14 nt, Homo sapiens
ugagcgcugaugau

SEQ ID NO: 870644 - RNA, 15 nt, Homo sapiens
ugagcgcugaugauu

SEQ ID NO: 870645 - RNA, 19 nt, Homo sapiens
ugagcuccccaaaaaccuc

SEQ ID NO: 870646 - RNA, 20 nt, Homo sapiens
ugagcugaagacaaaccacu

SEQ ID NO: 870647 - RNA, 12 nt, Homo sapiens
ugagcugggaag

SEQ ID NO: 870648 - RNA, 20 nt, Homo sapiens
ugagcugguuugucaaacaa

SEQ ID NO: 870649 - RNA, 18 nt, Homo sapiens
ugaggaaagcacacaguc

SEQ ID NO: 870650 - RNA, 20 nt, Homo sapiens
ugaggaagccuaaauaaaaa

SEQ ID NO: 870651 - RNA, 12 nt, Homo sapiens
ugaggacaaaga

SEQ ID NO: 870652 - RNA, 15 nt, Homo sapiens
ugaggacauguggaa

SEQ ID NO: 870653 - RNA, 23 nt, Homo sapiens
ugaggacuuaaaauauuccugca

SEQ ID NO: 870654 - RNA, 22 nt, Homo sapiens
ugaggagcugacauagggguaa

SEQ ID NO: 870655 - RNA, 22 nt, Homo sapiens
ugaggaggcuugccccacccaa

SEQ ID NO: 870656 - RNA, 18 nt, Homo sapiens
ugaggaugugagccugau

SEQ ID NO: 870657 - RNA, 22 nt, Homo sapiens
ugaggcaaauggcacauggcug

SEQ ID NO: 870658 - RNA, 22 nt, Homo sapiens
ugaggcagacagcagcucaggc

SEQ ID NO: 870659 - RNA, 18 nt, Homo sapiens
aguuuaauaacuaccuaa

SEQ ID NO: 870660 - RNA, 16 nt, Homo sapiens
aguuuaucaugucagu

SEQ ID NO: 870661 - RNA, 15 nt, Homo sapiens
aguuuauugacaaua

SEQ ID NO: 870662 - RNA, 17 nt, Homo sapiens
aguuuauugacaauaau

SEQ ID NO: 870663 - RNA, 22 nt, Homo sapiens
aguuucaaugugauucuaaugu

SEQ ID NO: 870664 - RNA, 16 nt, Homo sapiens
aguuucuaguaucaca

SEQ ID NO: 870665 - RNA, 22 nt, Homo sapiens
aguuucuccuuuugaccaaaua

SEQ ID NO: 870666 - RNA, 13 nt, Homo sapiens
aguuucucuccac

SEQ ID NO: 870667 - RNA, 20 nt, Homo sapiens
aguuugacauuguauguauc

SEQ ID NO: 870668 - RNA, 17 nt, Homo sapiens
aguuugcuuuguaugca

SEQ ID NO: 870669 - RNA, 23 nt, Homo sapiens
aguuuggaaguguuaacuauuua

SEQ ID NO: 870670 - RNA, 20 nt, Homo sapiens
aguuuggcugguuaauucca

SEQ ID NO: 870671 - RNA, 22 nt, Homo sapiens
aguuuguacagacguaugcuua

SEQ ID NO: 870672 - RNA, 22 nt, Homo sapiens
aguuuguuuuuaaaaaaaucua

SEQ ID NO: 870673 - RNA, 18 nt, Homo sapiens
aguuuuauggcaugauuu

SEQ ID NO: 870674 - RNA, 21 nt, Homo sapiens
aguuuucaaagaucccgugaa

SEQ ID NO: 870675 - RNA, 19 nt, Homo sapiens
aguuuuuacaaaauacuau

SEQ ID NO: 870676 - RNA, 13 nt, Homo sapiens
auaaaaacauaaa

SEQ ID NO: 870677 - RNA, 13 nt, Homo sapiens
auaaaaacccugu

SEQ ID NO: 870678 - RNA, 15 nt, Homo sapiens
auagagccacguaug

SEQ ID NO: 870679 - RNA, 13 nt, Homo sapiens
auagagguacaug

SEQ ID NO: 870680 - RNA, 21 nt, Homo sapiens
auagagugguacagcacuguu

SEQ ID NO: 870681 - RNA, 23 nt, Homo sapiens
auagauauuccuauugugcaaug

SEQ ID NO: 870682 - RNA, 21 nt, Homo sapiens
auagauggauuuguaucaaua

SEQ ID NO: 870683 - RNA, 19 nt, Homo sapiens
auagauggguuauuucaac

SEQ ID NO: 870684 - RNA, 16 nt, Homo sapiens
auagauuaauggcacu

SEQ ID NO: 870685 - RNA, 22 nt, Homo sapiens
auagauuaccugaucaugguca

SEQ ID NO: 870686 - RNA, 24 nt, Homo sapiens
auagauugagaaguuuuguacaga

SEQ ID NO: 870687 - RNA, 14 nt, Homo sapiens
auagcaauuucgcc

SEQ ID NO: 870688 - RNA, 18 nt, Homo sapiens
auagcagauuguguaaca

SEQ ID NO: 870689 - RNA, 18 nt, Homo sapiens
auagccacuuaccuucaa

SEQ ID NO: 870690 - RNA, 17 nt, Homo sapiens
auagccuacguuaaccc

SEQ ID NO: 870691 - RNA, 17 nt, Homo sapiens
auagcgaaucaucucaa

SEQ ID NO: 870692 - RNA, 16 nt, Homo sapiens
auaggacccauauucc

SEQ ID NO: 870693 - RNA, 19 nt, Homo sapiens
auaggaccuuccacacagg

SEQ ID NO: 870694 - RNA, 19 nt, Homo sapiens
auaggccaucaauaucaca

SEQ ID NO: 870695 - RNA, 16 nt, Homo sapiens
auaggcugcauaugag

SEQ ID NO: 870696 - RNA, 22 nt, Homo sapiens
auaggcuggagaagcucaccca

SEQ ID NO: 870697 - RNA, 16 nt, Homo sapiens
auagguaugagccagg

SEQ ID NO: 870698 - RNA, 17 nt, Homo sapiens
auagguaugagccaggg

SEQ ID NO: 870699 - RNA, 23 nt, Homo sapiens
auaguaauagggcccuuagcucu

SEQ ID NO: 870700 - RNA, 13 nt, Homo sapiens
auaguacuggcau

SEQ ID NO: 870701 - RNA, 13 nt, Homo sapiens
auaguagcauuuc

SEQ ID NO: 870702 - RNA, 20 nt, Homo sapiens
auaguauucaggugagcaau

SEQ ID NO: 870703 - RNA, 14 nt, Homo sapiens
auaguauugugcau

SEQ ID NO: 870704 - RNA, 15 nt, Homo sapiens
auaguauugugcaua

SEQ ID NO: 870705 - RNA, 22 nt, Homo sapiens
auaguauugugcauagagccac

SEQ ID NO: 870706 - RNA, 17 nt, Homo sapiens
auagucccagcuacuca

SEQ ID NO: 870707 - RNA, 14 nt, Homo sapiens
auagugcacacuug

SEQ ID NO: 870708 - RNA, 18 nt, Homo sapiens
auagugcacuagcauuuu

SEQ ID NO: 870709 - RNA, 16 nt, Homo sapiens
auaguggagagaacug

SEQ ID NO: 870710 - RNA, 17 nt, Homo sapiens
auaguuauuuacuugaa

SEQ ID NO: 870711 - RNA, 15 nt, Homo sapiens
auauaaaguguaaua

SEQ ID NO: 870712 - RNA, 16 nt, Homo sapiens
auauaaauuuguguuc

SEQ ID NO: 870713 - RNA, 19 nt, Homo sapiens
auauaaauuuguguucuca

SEQ ID NO: 870714 - RNA, 16 nt, Homo sapiens
auauaacaaccuuuaa

SEQ ID NO: 870715 - RNA, 15 nt, Homo sapiens
auauaaccauuacau

SEQ ID NO: 870716 - RNA, 20 nt, Homo sapiens
auauaacuaagacauaugca

SEQ ID NO: 870717 - RNA, 13 nt, Homo sapiens
auauaagccauag

SEQ ID NO: 870718 - RNA, 19 nt, Homo sapiens
auauaaugguuuacugcug

SEQ ID NO: 870719 - RNA, 15 nt, Homo sapiens
auauacaaacaugug

SEQ ID NO: 870720 - RNA, 22 nt, Homo sapiens
auauacagcucagaaguuucuu

SEQ ID NO: 870721 - RNA, 13 nt, Homo sapiens
auauacauaugac

SEQ ID NO: 870722 - RNA, 15 nt, Homo sapiens
auauacauuucauaa

SEQ ID NO: 870723 - RNA, 12 nt, Homo sapiens
auauaccaagcu

SEQ ID NO: 870724 - RNA, 16 nt, Homo sapiens
auauagaggagcacua

SEQ ID NO: 870725 - RNA, 19 nt, Homo sapiens
auauagaggagcacuauua

SEQ ID NO: 870726 - RNA, 20 nt, Homo sapiens
auauaguaacuacuuuuuau

SEQ ID NO: 870727 - RNA, 22 nt, Homo sapiens
auauaguauauuuauacucuag

SEQ ID NO: 870728 - RNA, 15 nt, Homo sapiens
auauauagugcuaua

SEQ ID NO: 870729 - RNA, 15 nt, Homo sapiens
auauauauauaguaa

SEQ ID NO: 870730 - RNA, 13 nt, Homo sapiens
auauauccaagaa

SEQ ID NO: 870731 - RNA, 18 nt, Homo sapiens
auauaugacuuuuucuca

SEQ ID NO: 870732 - RNA, 18 nt, Homo sapiens
auauaugcucaaccagaa

SEQ ID NO: 870733 - RNA, 19 nt, Homo sapiens
auauauuccgcacucaagg

SEQ ID NO: 870734 - RNA, 12 nt, Homo sapiens
auauauucuaca

SEQ ID NO: 870735 - RNA, 14 nt, Homo sapiens
auauauugcugcug

SEQ ID NO: 870736 - RNA, 22 nt, Homo sapiens
auauauuuauuuaagcuuaugu

SEQ ID NO: 870737 - RNA, 21 nt, Homo sapiens
auauauuuuugguugucaaua

SEQ ID NO: 870738 - RNA, 15 nt, Homo sapiens
auaucaagauguuaa

SEQ ID NO: 870739 - RNA, 18 nt, Homo sapiens
auaucacuuacucaguua

SEQ ID NO: 870740 - RNA, 13 nt, Homo sapiens
auaucaucagcau

SEQ ID NO: 870741 - RNA, 18 nt, Homo sapiens
auaucaucagcauaccuu

SEQ ID NO: 870742 - RNA, 20 nt, Homo sapiens
auauccccucaaaauccaag

SEQ ID NO: 870743 - RNA, 20 nt, Homo sapiens
auauccuggcccccugggcu

SEQ ID NO: 870744 - RNA, 13 nt, Homo sapiens
auaucucaucucu

SEQ ID NO: 870745 - RNA, 21 nt, Homo sapiens
auaucugaacacauacuagaa

SEQ ID NO: 870746 - RNA, 17 nt, Homo sapiens
auaucuguggucuucaa

SEQ ID NO: 870747 - RNA, 17 nt, Homo sapiens
auaucuugaaagggguu

SEQ ID NO: 870748 - RNA, 22 nt, Homo sapiens
auaugaaaugauaaagauguca

SEQ ID NO: 870749 - RNA, 19 nt, Homo sapiens
auaugacuccuuucucuau

SEQ ID NO: 870750 - RNA, 17 nt, Homo sapiens
auaugacuuuuucucag

SEQ ID NO: 870751 - RNA, 13 nt, Homo sapiens
auaugaguauaca

SEQ ID NO: 870752 - RNA, 21 nt, Homo sapiens
auaugaucauguaaaugauua

SEQ ID NO: 870753 - RNA, 17 nt, Homo sapiens
auaugcaauauuuacau

SEQ ID NO: 870754 - RNA, 22 nt, Homo sapiens
auaugcacacacagaugcacac

SEQ ID NO: 870755 - RNA, 17 nt, Homo sapiens
auaugcacacacaugga

SEQ ID NO: 870756 - RNA, 16 nt, Homo sapiens
auauggacucugcaca

SEQ ID NO: 870757 - RNA, 17 nt, Homo sapiens
auauggacucugcacau

SEQ ID NO: 870758 - RNA, 14 nt, Homo sapiens
auauggaggccuca

SEQ ID NO: 870759 - RNA, 19 nt, Homo sapiens
auauguacaguuauacaua

SEQ ID NO: 870760 - RNA, 14 nt, Homo sapiens
auauguaccaugua

SEQ ID NO: 870761 - RNA, 20 nt, Homo sapiens
auauguagcuuuauccuuag

SEQ ID NO: 870762 - RNA, 14 nt, Homo sapiens
auauguauauacau

SEQ ID NO: 870763 - RNA, 22 nt, Homo sapiens
auauguauuuugucauauguau

SEQ ID NO: 870764 - RNA, 18 nt, Homo sapiens
auauguauuuuugucaua

SEQ ID NO: 870765 - RNA, 16 nt, Homo sapiens
auaugucuaauucuau

SEQ ID NO: 870766 - RNA, 20 nt, Homo sapiens
auaugucucaggucccugca

SEQ ID NO: 870767 - RNA, 14 nt, Homo sapiens
auauguucauuaaa

SEQ ID NO: 870768 - RNA, 13 nt, Homo sapiens
auauguugcugaa

SEQ ID NO: 870769 - RNA, 16 nt, Homo sapiens
auauguuuccaucacu

SEQ ID NO: 870770 - RNA, 17 nt, Homo sapiens
auauuaaaauauggcua

SEQ ID NO: 870771 - RNA, 21 nt, Homo sapiens
auauuaaucaacuuuccuuaa

SEQ ID NO: 870772 - RNA, 14 nt, Homo sapiens
auauuaccaaaaaa

SEQ ID NO: 870773 - RNA, 22 nt, Homo sapiens
auauuaucacgcagaucacuaa

SEQ ID NO: 870774 - RNA, 20 nt, Homo sapiens
auauucagauauaaaacagu

SEQ ID NO: 870775 - RNA, 14 nt, Homo sapiens
ccuguggugacuga

SEQ ID NO: 870776 - RNA, 23 nt, Homo sapiens
ccugugucuuauagguuuccacu

SEQ ID NO: 870777 - RNA, 17 nt, Homo sapiens
ccugugugccauuuuaa

SEQ ID NO: 870778 - RNA, 20 nt, Homo sapiens
ccuguuaaaauguacacugg

SEQ ID NO: 870779 - RNA, 16 nt, Homo sapiens
ccuguuacacaugaca

SEQ ID NO: 870780 - RNA, 19 nt, Homo sapiens
ccuguucuuccuaccaaau

SEQ ID NO: 870781 - RNA, 17 nt, Homo sapiens
ccuguuuaaaaaaagua

SEQ ID NO: 870782 - RNA, 18 nt, Homo sapiens
ccuguuuuccacaccauc

SEQ ID NO: 870783 - RNA, 16 nt, Homo sapiens
ccuuaaaaaugcacac

SEQ ID NO: 870784 - RNA, 21 nt, Homo sapiens
ccuuaagccaauauuuacuca

SEQ ID NO: 870785 - RNA, 17 nt, Homo sapiens
ccuuaaggagguagcuc

SEQ ID NO: 870786 - RNA, 23 nt, Homo sapiens
ccuuaaugauccguuccauugca

SEQ ID NO: 870787 - RNA, 13 nt, Homo sapiens
ccuuacauuccua

SEQ ID NO: 870788 - RNA, 12 nt, Homo sapiens
ccuuacccaaac

SEQ ID NO: 870789 - RNA, 18 nt, Homo sapiens
ccuuacuauggaaagcag

SEQ ID NO: 870790 - RNA, 18 nt, Homo sapiens
ccuuagcuuagaccucag

SEQ ID NO: 870791 - RNA, 20 nt, Homo sapiens
ccuuauaagaauuaaucuua

SEQ ID NO: 870792 - RNA, 12 nt, Homo sapiens
ccuuauaguguu

SEQ ID NO: 870793 - RNA, 21 nt, Homo sapiens
ccuuauuuuugaauugacuga

SEQ ID NO: 870794 - RNA, 14 nt, Homo sapiens
ccuucaacccgaga

SEQ ID NO: 870795 - RNA, 12 nt, Homo sapiens
ccuucacauuua

SEQ ID NO: 870796 - RNA, 14 nt, Homo sapiens
ccuucacuuuacaa

SEQ ID NO: 870797 - RNA, 22 nt, Homo sapiens
ccuucagaacagaggcauuuaa

SEQ ID NO: 870798 - RNA, 17 nt, Homo sapiens
ccuucauuuuacauucu

SEQ ID NO: 870799 - RNA, 20 nt, Homo sapiens
ccuuccaaccccuuuccacg

SEQ ID NO: 870800 - RNA, 20 nt, Homo sapiens
ccuuccacuuugaguaccaa

SEQ ID NO: 870801 - RNA, 17 nt, Homo sapiens
ccuuccccagacuucuc

SEQ ID NO: 870802 - RNA, 19 nt, Homo sapiens
ccuucccuccccacagucc

SEQ ID NO: 870803 - RNA, 17 nt, Homo sapiens
ccuucccucuucuucuc

SEQ ID NO: 870804 - RNA, 23 nt, Homo sapiens
ccuuccggaagaaaaagagccau

SEQ ID NO: 870805 - RNA, 17 nt, Homo sapiens
ccuuccuaauaugcuuu

SEQ ID NO: 870806 - RNA, 23 nt, Homo sapiens
ccuuccuccccagucuacguucu

SEQ ID NO: 870807 - RNA, 17 nt, Homo sapiens
ccuucgauauaugacuu

SEQ ID NO: 870808 - RNA, 15 nt, Homo sapiens
ccuucuaaacauuuu

SEQ ID NO: 870809 - RNA, 12 nt, Homo sapiens
ccuucuccaaau

SEQ ID NO: 870810 - RNA, 18 nt, Homo sapiens
ccuucugcacccagaaau

SEQ ID NO: 870811 - RNA, 13 nt, Homo sapiens
ccuucuucaggga

SEQ ID NO: 870812 - RNA, 20 nt, Homo sapiens
ccuucuucuuagcaccacaa

SEQ ID NO: 870813 - RNA, 19 nt, Homo sapiens
ccuucuuggcuucugggac

SEQ ID NO: 870814 - RNA, 15 nt, Homo sapiens
ccuucuuucucuucc

SEQ ID NO: 870815 - RNA, 22 nt, Homo sapiens
ccuucuuuucaaaacugcuaaa

SEQ ID NO: 870816 - RNA, 11 nt, Homo sapiens
ccuugaaccag

SEQ ID NO: 870817 - RNA, 13 nt, Homo sapiens
ccuugcagcauuu

SEQ ID NO: 870818 - RNA, 13 nt, Homo sapiens
ccuugcccagaga

SEQ ID NO: 870819 - RNA, 14 nt, Homo sapiens
ccuugcccagagau

SEQ ID NO: 870820 - RNA, 18 nt, Homo sapiens
ccuugcccugaccuccca

SEQ ID NO: 870821 - RNA, 18 nt, Homo sapiens
ccuugcuagacagccagg

SEQ ID NO: 870822 - RNA, 11 nt, Homo sapiens
ccuugcucugc

SEQ ID NO: 870823 - RNA, 12 nt, Homo sapiens
ccuugcucugca

SEQ ID NO: 870824 - RNA, 18 nt, Homo sapiens
ccuugcuguuuucaucuc

SEQ ID NO: 870825 - RNA, 19 nt, Homo sapiens
ccuuggacaacuuuucuca

SEQ ID NO: 870826 - RNA, 13 nt, Homo sapiens
ccuuggagccuga

SEQ ID NO: 870827 - RNA, 15 nt, Homo sapiens
ccuuggcucaauccu

SEQ ID NO: 870828 - RNA, 15 nt, Homo sapiens
ccuugggaugaucuu

SEQ ID NO: 870829 - RNA, 12 nt, Homo sapiens
ccuuggggccug

SEQ ID NO: 870830 - RNA, 14 nt, Homo sapiens
ccuuggugugaccc

SEQ ID NO: 870831 - RNA, 15 nt, Homo sapiens
ccuuguaaacaugaa

SEQ ID NO: 870832 - RNA, 14 nt, Homo sapiens
ccuugugucuguac

SEQ ID NO: 870833 - RNA, 19 nt, Homo sapiens
ccuuguguguuuugagagu

SEQ ID NO: 870834 - RNA, 18 nt, Homo sapiens
ccuuguucugauaaugaa

SEQ ID NO: 870835 - RNA, 16 nt, Homo sapiens
ccuuuaaaauuuacca

SEQ ID NO: 870836 - RNA, 20 nt, Homo sapiens
ccuuuaaauccuuccaugaa

SEQ ID NO: 870837 - RNA, 13 nt, Homo sapiens
ccuuuaccuacca

SEQ ID NO: 870838 - RNA, 14 nt, Homo sapiens
ccuuuacuaaucca

SEQ ID NO: 870839 - RNA, 18 nt, Homo sapiens
ccuuuacuauuaagggaa

SEQ ID NO: 870840 - RNA, 16 nt, Homo sapiens
ccuuucaaauuucaca

SEQ ID NO: 870841 - RNA, 16 nt, Homo sapiens
ccuuuccauaaggaau

SEQ ID NO: 870842 - RNA, 15 nt, Homo sapiens
ccuuuccccagugug

SEQ ID NO: 870843 - RNA, 15 nt, Homo sapiens
ccuuuccuccacucc

SEQ ID NO: 870844 - RNA, 14 nt, Homo sapiens
ccuuuccugguccc

SEQ ID NO: 870845 - RNA, 21 nt, Homo sapiens
ccuuucucuaucccaagccaa

SEQ ID NO: 870846 - RNA, 22 nt, Homo sapiens
ccuuucuuucuaacuccaguga

SEQ ID NO: 870847 - RNA, 17 nt, Homo sapiens
ccuuucuuucuuccuuc

SEQ ID NO: 870848 - RNA, 18 nt, Homo sapiens
ccuuugaaauucccccac

SEQ ID NO: 870849 - RNA, 22 nt, Homo sapiens
ccuuugcaggcccagcagacuu

SEQ ID NO: 870850 - RNA, 23 nt, Homo sapiens
ccuuugccccaaggcugcucaga

SEQ ID NO: 870851 - RNA, 22 nt, Homo sapiens
ccuuugggaggcagcaucaggg

SEQ ID NO: 870852 - RNA, 14 nt, Homo sapiens
ccuuugucaucauu

SEQ ID NO: 870853 - RNA, 20 nt, Homo sapiens
ccuuugugggcccagcuaca

SEQ ID NO: 870854 - RNA, 18 nt, Homo sapiens
ccuuuguguauucaucuu

SEQ ID NO: 870855 - RNA, 14 nt, Homo sapiens
ccuuuuaaaacacu

SEQ ID NO: 870856 - RNA, 21 nt, Homo sapiens
ccuuuuauucauauuuucaca

SEQ ID NO: 870857 - RNA, 22 nt, Homo sapiens
ccuuuuauucauauuuucacau

SEQ ID NO: 870858 - RNA, 17 nt, Homo sapiens
ccuuuuauuucuuaaac

SEQ ID NO: 870859 - RNA, 15 nt, Homo sapiens
ccuuuucaucuccag

SEQ ID NO: 870860 - RNA, 22 nt, Homo sapiens
ccuuuugcaacaagacaaagca

SEQ ID NO: 870861 - RNA, 22 nt, Homo sapiens
ccuuuugcacauaacaugcuuu

SEQ ID NO: 870862 - RNA, 10 nt, Homo sapiens
ccuuuugcca

SEQ ID NO: 870863 - RNA, 16 nt, Homo sapiens
ccuuuuggcacugaga

SEQ ID NO: 870864 - RNA, 20 nt, Homo sapiens
cgaaaauucauuucacauua

SEQ ID NO: 870865 - RNA, 13 nt, Homo sapiens
cgaaagcaacuca

SEQ ID NO: 870866 - RNA, 14 nt, Homo sapiens
cgaacaaacugaug

SEQ ID NO: 870867 - RNA, 15 nt, Homo sapiens
cuaauucaacauaua

SEQ ID NO: 870868 - RNA, 22 nt, Homo sapiens
cuaauuccuggcaugacacucu

SEQ ID NO: 870869 - RNA, 17 nt, Homo sapiens
cuaauuggcaugaaggu

SEQ ID NO: 870870 - RNA, 19 nt, Homo sapiens
cuaauuggcaugaaggugu

SEQ ID NO: 870871 - RNA, 17 nt, Homo sapiens
cuaauuuuaaguuauuu

SEQ ID NO: 870872 - RNA, 17 nt, Homo sapiens
cuaauuuuuuguuguuu

SEQ ID NO: 870873 - RNA, 23 nt, Homo sapiens
cuacaaacucccacuugucaugu

SEQ ID NO: 870874 - RNA, 21 nt, Homo sapiens
cuacaagcauuugcccugugg

SEQ ID NO: 870875 - RNA, 18 nt, Homo sapiens
cuacaagguugugcccuc

SEQ ID NO: 870876 - RNA, 22 nt, Homo sapiens
cuacacaguaaaaacuuguacu

SEQ ID NO: 870877 - RNA, 11 nt, Homo sapiens
cuacacauaua

SEQ ID NO: 870878 - RNA, 13 nt, Homo sapiens
cuacaccuguugc

SEQ ID NO: 870879 - RNA, 11 nt, Homo sapiens
cuacaggguga

SEQ ID NO: 870880 - RNA, 22 nt, Homo sapiens
cuacaguggcugucacgcagcc

SEQ ID NO: 870881 - RNA, 14 nt, Homo sapiens
cuacauaguuauuc

SEQ ID NO: 870882 - RNA, 19 nt, Homo sapiens
cuacaucuucagcucccau

SEQ ID NO: 870883 - RNA, 12 nt, Homo sapiens
cuacaugcacuu

SEQ ID NO: 870884 - RNA, 14 nt, Homo sapiens
cuaccaauguagac

SEQ ID NO: 870885 - RNA, 13 nt, Homo sapiens
cuaccacaguguc

SEQ ID NO: 870886 - RNA, 15 nt, Homo sapiens
cuaccacagugucug

SEQ ID NO: 870887 - RNA, 23 nt, Homo sapiens
cuaccaucuaaucuaugcaugua

SEQ ID NO: 870888 - RNA, 23 nt, Homo sapiens
cuaccgagucucuucuccacugg

SEQ ID NO: 870889 - RNA, 20 nt, Homo sapiens
cuaccugagcauucaggcag

SEQ ID NO: 870890 - RNA, 19 nt, Homo sapiens
cuaccuggucucuccuugu

SEQ ID NO: 870891 - RNA, 13 nt, Homo sapiens
cuaccuucagggu

SEQ ID NO: 870892 - RNA, 14 nt, Homo sapiens
cuacgccaaagugc

SEQ ID NO: 870893 - RNA, 18 nt, Homo sapiens
cuacguauaaauaugaaa

SEQ ID NO: 870894 - RNA, 15 nt, Homo sapiens
cuacuaaagugccua

SEQ ID NO: 870895 - RNA, 19 nt, Homo sapiens
cuacucaagaggcugaggc

SEQ ID NO: 870896 - RNA, 20 nt, Homo sapiens
cuacucuauguaugcaucua

SEQ ID NO: 870897 - RNA, 16 nt, Homo sapiens
cuacucucaccgacuu

SEQ ID NO: 870898 - RNA, 15 nt, Homo sapiens
cuacugagacaugac

SEQ ID NO: 870899 - RNA, 20 nt, Homo sapiens
cuacugcuagauaucacuua

SEQ ID NO: 870900 - RNA, 19 nt, Homo sapiens
cuacugggaaauuacuuau

SEQ ID NO: 870901 - RNA, 15 nt, Homo sapiens
cuacuuaaugagaua

SEQ ID NO: 870902 - RNA, 18 nt, Homo sapiens
cuacuucacuaaugacga

SEQ ID NO: 870903 - RNA, 14 nt, Homo sapiens
cuacuucccuuucc

SEQ ID NO: 870904 - RNA, 12 nt, Homo sapiens
cuacuugccaca

SEQ ID NO: 870905 - RNA, 20 nt, Homo sapiens
cuacuugggaggcugaggca

SEQ ID NO: 870906 - RNA, 17 nt, Homo sapiens
cuacuuguaaaggugcu

SEQ ID NO: 870907 - RNA, 18 nt, Homo sapiens
cuacuuuucuuuccucag

SEQ ID NO: 870908 - RNA, 20 nt, Homo sapiens
cuacuuuuucuagcuacaau

SEQ ID NO: 870909 - RNA, 20 nt, Homo sapiens
cuagaaauaagcccaacaga

SEQ ID NO: 870910 - RNA, 16 nt, Homo sapiens
cuagaaaucugccaau

SEQ ID NO: 870911 - RNA, 19 nt, Homo sapiens
cuagaacacccacuggcca

SEQ ID NO: 870912 - RNA, 19 nt, Homo sapiens
cuagaaccuggagggcuag

SEQ ID NO: 870913 - RNA, 18 nt, Homo sapiens
cuagaaccuguagagcua

SEQ ID NO: 870914 - RNA, 12 nt, Homo sapiens
cuagaaugcaca

SEQ ID NO: 870915 - RNA, 16 nt, Homo sapiens
cuagaaugguagcacu

SEQ ID NO: 870916 - RNA, 12 nt, Homo sapiens
cuagacuuucug

SEQ ID NO: 870917 - RNA, 23 nt, Homo sapiens
cuagagaagaggcuggugcugug

SEQ ID NO: 870918 - RNA, 14 nt, Homo sapiens
cuagauacuguuga

SEQ ID NO: 870919 - RNA, 18 nt, Homo sapiens
cuagaucuuacaucugca

SEQ ID NO: 870920 - RNA, 20 nt, Homo sapiens
cuagaugugcaaaugcaagc

SEQ ID NO: 870921 - RNA, 13 nt, Homo sapiens
cuagcaaagcuua

SEQ ID NO: 870922 - RNA, 21 nt, Homo sapiens
cuagcaucucaugagugccaa

SEQ ID NO: 870923 - RNA, 22 nt, Homo sapiens
cuagcauuuucuugaaccaaua

SEQ ID NO: 870924 - RNA, 14 nt, Homo sapiens
cuagccacaucacu

SEQ ID NO: 870925 - RNA, 22 nt, Homo sapiens
cuagccaugauaacugcaauuu

SEQ ID NO: 870926 - RNA, 18 nt, Homo sapiens
cuagcccucucacauuua

SEQ ID NO: 870927 - RNA, 18 nt, Homo sapiens
cuagccugggccagagaa

SEQ ID NO: 870928 - RNA, 16 nt, Homo sapiens
cuagcucuaguucaaa

SEQ ID NO: 870929 - RNA, 21 nt, Homo sapiens
cuagcuuuaggggaccaugaa

SEQ ID NO: 870930 - RNA, 22 nt, Homo sapiens
cuaggaaacccaaggaacaaga

SEQ ID NO: 870931 - RNA, 12 nt, Homo sapiens
cuaggacauaua

SEQ ID NO: 870932 - RNA, 15 nt, Homo sapiens
cuaggagaccaaggc

SEQ ID NO: 870933 - RNA, 19 nt, Homo sapiens
cuaggaguugaguacagug

SEQ ID NO: 870934 - RNA, 17 nt, Homo sapiens
cuaggucaaaacauuca

SEQ ID NO: 870935 - RNA, 23 nt, Homo sapiens
cuagguucuaaaaauugugauca

SEQ ID NO: 870936 - RNA, 17 nt, Homo sapiens
cuagguucuagguccug

SEQ ID NO: 870937 - RNA, 21 nt, Homo sapiens
cuaguaccacagaaguucaau

SEQ ID NO: 870938 - RNA, 20 nt, Homo sapiens
cuaguagcggaucucacuca

SEQ ID NO: 870939 - RNA, 13 nt, Homo sapiens
cuagucauaaccu

SEQ ID NO: 870940 - RNA, 23 nt, Homo sapiens
cuagucuauggucaguugaggaa

SEQ ID NO: 870941 - RNA, 18 nt, Homo sapiens
cuagugacuuccugguga

SEQ ID NO: 870942 - RNA, 14 nt, Homo sapiens
cuagugauuugccu

SEQ ID NO: 870943 - RNA, 23 nt, Homo sapiens
cuagugcuuccacuucuaugcaa

SEQ ID NO: 870944 - RNA, 14 nt, Homo sapiens
cuaguguugcuugg

SEQ ID NO: 870945 - RNA, 20 nt, Homo sapiens
cuaguucaaauuauuuggaa

SEQ ID NO: 870946 - RNA, 17 nt, Homo sapiens
cuaguucuaauucccua

SEQ ID NO: 870947 - RNA, 15 nt, Homo sapiens
cuaguuugaccucau

SEQ ID NO: 870948 - RNA, 14 nt, Homo sapiens
cuauaaaaugaaua

SEQ ID NO: 870949 - RNA, 22 nt, Homo sapiens
cuauaaccaucaguuacugguu

SEQ ID NO: 870950 - RNA, 21 nt, Homo sapiens
cuauaaucucuugaauuuggu

SEQ ID NO: 870951 - RNA, 23 nt, Homo sapiens
cuauaggugcuacaaaaacacag

SEQ ID NO: 870952 - RNA, 21 nt, Homo sapiens
cuauagucccagcuacucaga

SEQ ID NO: 870953 - RNA, 22 nt, Homo sapiens
cuauauauccaagaagcaugca

SEQ ID NO: 870954 - RNA, 16 nt, Homo sapiens
cuauauggcagugucu

SEQ ID NO: 870955 - RNA, 15 nt, Homo sapiens
cuauauguugcugaa

SEQ ID NO: 870956 - RNA, 17 nt, Homo sapiens
cuauauucucaguguag

SEQ ID NO: 870957 - RNA, 20 nt, Homo sapiens
cuauauucucaguguagggc

SEQ ID NO: 870958 - RNA, 14 nt, Homo sapiens
cuauauugcacugu

SEQ ID NO: 870959 - RNA, 17 nt, Homo sapiens
cuauauuggucauugcc

SEQ ID NO: 870960 - RNA, 17 nt, Homo sapiens
cuauauuguacacaccu

SEQ ID NO: 870961 - RNA, 12 nt, Homo sapiens
cuauauugugcc

SEQ ID NO: 870962 - RNA, 15 nt, Homo sapiens
cuaucacacaguggg

SEQ ID NO: 870963 - RNA, 12 nt, Homo sapiens
cuaucacauaca

SEQ ID NO: 870964 - RNA, 14 nt, Homo sapiens
cuaucacauuacau

SEQ ID NO: 870965 - RNA, 17 nt, Homo sapiens
cuaucacauuacaucau

SEQ ID NO: 870966 - RNA, 15 nt, Homo sapiens
cuaucauucugcucu

SEQ ID NO: 870967 - RNA, 19 nt, Homo sapiens
cuauccaaaacuaauuucc

SEQ ID NO: 870968 - RNA, 11 nt, Homo sapiens
cuauccagcua

SEQ ID NO: 870969 - RNA, 14 nt, Homo sapiens
cuaucccaagccaa

SEQ ID NO: 870970 - RNA, 23 nt, Homo sapiens
cuauccuaaaggcccacuggcau

SEQ ID NO: 870971 - RNA, 14 nt, Homo sapiens
cuaucgcaccacug

SEQ ID NO: 870972 - RNA, 15 nt, Homo sapiens
cuaucgcaccacugu

SEQ ID NO: 870973 - RNA, 20 nt, Homo sapiens
cuaucuacugagacaugacu

SEQ ID NO: 870974 - RNA, 14 nt, Homo sapiens
cuaucuccaaauga

SEQ ID NO: 870975 - RNA, 17 nt, Homo sapiens
cuaucucuugucauaua

SEQ ID NO: 870976 - RNA, 15 nt, Homo sapiens
cuaucuguauuuuca

SEQ ID NO: 870977 - RNA, 12 nt, Homo sapiens
cuaucugugaag

SEQ ID NO: 870978 - RNA, 17 nt, Homo sapiens
cuaucuuuuaguuuuag

SEQ ID NO: 870979 - RNA, 15 nt, Homo sapiens
cuaucuuuuugcuua

SEQ ID NO: 870980 - RNA, 18 nt, Homo sapiens
cuaugaaaauuauaucuc

SEQ ID NO: 870981 - RNA, 19 nt, Homo sapiens
cuaugaaugauacccugaa

SEQ ID NO: 870982 - RNA, 20 nt, Homo sapiens
auucugcuaccucacugggg

SEQ ID NO: 870983 - RNA, 17 nt, Homo sapiens
auucuggaaaagcaaaa

SEQ ID NO: 870984 - RNA, 23 nt, Homo sapiens
auucugggcuccuggaaccaauc

SEQ ID NO: 870985 - RNA, 18 nt, Homo sapiens
auucugguuuugacauca

SEQ ID NO: 870986 - RNA, 23 nt, Homo sapiens
auucuguggugggaacauucgag

SEQ ID NO: 870987 - RNA, 18 nt, Homo sapiens
auucuguuggccagugug

SEQ ID NO: 870988 - RNA, 17 nt, Homo sapiens
auucuucaucagcauuu

SEQ ID NO: 870989 - RNA, 13 nt, Homo sapiens
auucuucugcuuc

SEQ ID NO: 870990 - RNA, 15 nt, Homo sapiens
auucuugaguucugg

SEQ ID NO: 870991 - RNA, 22 nt, Homo sapiens
auucuuuccccucagagcucuu

SEQ ID NO: 870992 - RNA, 22 nt, Homo sapiens
auucuuugaauuucccagucuc

SEQ ID NO: 870993 - RNA, 14 nt, Homo sapiens
auucuuugcaagau

SEQ ID NO: 870994 - RNA, 18 nt, Homo sapiens
auugaaauuuacugugag

SEQ ID NO: 870995 - RNA, 18 nt, Homo sapiens
auugaacuuucacauagc

SEQ ID NO: 870996 - RNA, 24 nt, Homo sapiens
auugaacuuucacauagcacagaa

SEQ ID NO: 870997 - RNA, 21 nt, Homo sapiens
auugaagugucgaaagcaacu

SEQ ID NO: 870998 - RNA, 21 nt, Homo sapiens
auugaaugauuacuauaugca

SEQ ID NO: 870999 - RNA, 20 nt, Homo sapiens
auugaauuugccuuccucau

SEQ ID NO: 871000 - RNA, 14 nt, Homo sapiens
auugacacacagca

SEQ ID NO: 871001 - RNA, 14 nt, Homo sapiens
auugaccucagcug

SEQ ID NO: 871002 - RNA, 15 nt, Homo sapiens
auugacgcauauuua

SEQ ID NO: 871003 - RNA, 22 nt, Homo sapiens
auugacuugcacaucucugcag

SEQ ID NO: 871004 - RNA, 14 nt, Homo sapiens
auugagaaacauga

SEQ ID NO: 871005 - RNA, 23 nt, Homo sapiens
auugagaaguuuuguacagagaa

SEQ ID NO: 871006 - RNA, 19 nt, Homo sapiens
auugaucaaauauuucaac

SEQ ID NO: 871007 - RNA, 13 nt, Homo sapiens
auugauguugcug

SEQ ID NO: 871008 - RNA, 11 nt, Homo sapiens
auugauuucaa

SEQ ID NO: 871009 - RNA, 10 nt, Homo sapiens
auugcacaau

SEQ ID NO: 871010 - RNA, 14 nt, Homo sapiens
auugcacuccaguc

SEQ ID NO: 871011 - RNA, 15 nt, Homo sapiens
auugcacuccagucu

SEQ ID NO: 871012 - RNA, 15 nt, Homo sapiens
auugcauuaguccaa

SEQ ID NO: 871013 - RNA, 15 nt, Homo sapiens
auugcgaaugugcag

SEQ ID NO: 871014 - RNA, 17 nt, Homo sapiens
auugcuuaaaagacauu

SEQ ID NO: 871015 - RNA, 20 nt, Homo sapiens
auugcuuuuguugugacuuu

SEQ ID NO: 871016 - RNA, 17 nt, Homo sapiens
auuggaccauccuauuu

SEQ ID NO: 871017 - RNA, 21 nt, Homo sapiens
auuggcaaacuuuguauuaau

SEQ ID NO: 871018 - RNA, 13 nt, Homo sapiens
auuggcagugugu

SEQ ID NO: 871019 - RNA, 14 nt, Homo sapiens
auuggcaugaaggu

SEQ ID NO: 871020 - RNA, 22 nt, Homo sapiens
auugggaagcugggggaagggu

SEQ ID NO: 871021 - RNA, 17 nt, Homo sapiens
auugguacuuguuucac

SEQ ID NO: 871022 - RNA, 19 nt, Homo sapiens
auugguauauuuccauuca

SEQ ID NO: 871023 - RNA, 21 nt, Homo sapiens
auugguccgaucuuugacucu

SEQ ID NO: 871024 - RNA, 15 nt, Homo sapiens
auuguaaugaauauc

SEQ ID NO: 871025 - RNA, 15 nt, Homo sapiens
auuguaguguucaaa

SEQ ID NO: 871026 - RNA, 22 nt, Homo sapiens
auuguauuuuagcaggguacau

SEQ ID NO: 871027 - RNA, 18 nt, Homo sapiens
auugugaucagaccauaa

SEQ ID NO: 871028 - RNA, 12 nt, Homo sapiens
auuguguucucu

SEQ ID NO: 871029 - RNA, 20 nt, Homo sapiens
auuguuaaaaccuuacuuaa

SEQ ID NO: 871030 - RNA, 21 nt, Homo sapiens
auuguuccaaaugaauguugu

SEQ ID NO: 871031 - RNA, 21 nt, Homo sapiens
auuguucuuauccucaauuca

SEQ ID NO: 871032 - RNA, 22 nt, Homo sapiens
auuuaaaggggagauacucucc

SEQ ID NO: 871033 - RNA, 14 nt, Homo sapiens
auuuaaauauuaau

SEQ ID NO: 871034 - RNA, 13 nt, Homo sapiens
auuuaacagagcu

SEQ ID NO: 871035 - RNA, 20 nt, Homo sapiens
auuuaacauagguuuugauu

SEQ ID NO: 871036 - RNA, 22 nt, Homo sapiens
auuuaaggaagaaucuucugcc

SEQ ID NO: 871037 - RNA, 21 nt, Homo sapiens
auuuaauaaaugugccuucau

SEQ ID NO: 871038 - RNA, 19 nt, Homo sapiens
auuuaauaagaaacaugau

SEQ ID NO: 871039 - RNA, 19 nt, Homo sapiens
auuuaauaugggugaacac

SEQ ID NO: 871040 - RNA, 17 nt, Homo sapiens
auuuaauggcaaugcaa

SEQ ID NO: 871041 - RNA, 19 nt, Homo sapiens
auuuaauggcaaugcaaaa

SEQ ID NO: 871042 - RNA, 18 nt, Homo sapiens
auuuacagccucacuuga

SEQ ID NO: 871043 - RNA, 16 nt, Homo sapiens
auuuacgacugaagaa

SEQ ID NO: 871044 - RNA, 23 nt, Homo sapiens
auuuacugcaagaaguacaugaa

SEQ ID NO: 871045 - RNA, 19 nt, Homo sapiens
auuuacuuaacagaacagu

SEQ ID NO: 871046 - RNA, 20 nt, Homo sapiens
auuuagaaaacauucaucca

SEQ ID NO: 871047 - RNA, 18 nt, Homo sapiens
auuuagaacuguauguca

SEQ ID NO: 871048 - RNA, 17 nt, Homo sapiens
auuuagacaaaguucaa

SEQ ID NO: 871049 - RNA, 20 nt, Homo sapiens
auuuagauaugcaaaagcug

SEQ ID NO: 871050 - RNA, 13 nt, Homo sapiens
auuuauaacucau

SEQ ID NO: 871051 - RNA, 15 nt, Homo sapiens
auuuauaacucauca

SEQ ID NO: 871052 - RNA, 12 nt, Homo sapiens
auuuauauucaa

SEQ ID NO: 871053 - RNA, 19 nt, Homo sapiens
auuuaucugugcaaauccu

SEQ ID NO: 871054 - RNA, 19 nt, Homo sapiens
auuuauggucaacacuuaa

SEQ ID NO: 871055 - RNA, 23 nt, Homo sapiens
auuuaugguuucugcgugcuuua

SEQ ID NO: 871056 - RNA, 13 nt, Homo sapiens
auuuauucugcuc

SEQ ID NO: 871057 - RNA, 23 nt, Homo sapiens
auuuauugucggaagacuugcca

SEQ ID NO: 871058 - RNA, 15 nt, Homo sapiens
auuuauuuaagcuua

SEQ ID NO: 871059 - RNA, 16 nt, Homo sapiens
auuuauuuauggagga

SEQ ID NO: 871060 - RNA, 16 nt, Homo sapiens
auuuauuucauccagu

SEQ ID NO: 871061 - RNA, 20 nt, Homo sapiens
auuuauuuuuuuacuuccuc

SEQ ID NO: 871062 - RNA, 17 nt, Homo sapiens
auuucacaucagcuuua

SEQ ID NO: 871063 - RNA, 13 nt, Homo sapiens
auuucacauuaau

SEQ ID NO: 871064 - RNA, 12 nt, Homo sapiens
auuucaggcaua

SEQ ID NO: 871065 - RNA, 16 nt, Homo sapiens
auuucaucuacuacag

SEQ ID NO: 871066 - RNA, 17 nt, Homo sapiens
auuucauguaaccaaga

SEQ ID NO: 871067 - RNA, 22 nt, Homo sapiens
auuucauguaaccaagaguauu

SEQ ID NO: 871068 - RNA, 17 nt, Homo sapiens
auuucauuguaugaugu

SEQ ID NO: 871069 - RNA, 15 nt, Homo sapiens
auuucccaauacaua

SEQ ID NO: 871070 - RNA, 19 nt, Homo sapiens
auuucccaccgcuuuguga

SEQ ID NO: 871071 - RNA, 22 nt, Homo sapiens
auuucccuggaauuuaauucaa

SEQ ID NO: 871072 - RNA, 16 nt, Homo sapiens
auuucccugugcugac

SEQ ID NO: 871073 - RNA, 20 nt, Homo sapiens
auuuccuaaugucagaguag

SEQ ID NO: 871074 - RNA, 20 nt, Homo sapiens
auuuccuacagaaauacugc

SEQ ID NO: 871075 - RNA, 19 nt, Homo sapiens
auuuccuggugauucugau

SEQ ID NO: 871076 - RNA, 15 nt, Homo sapiens
auuucggagcaugaa

SEQ ID NO: 871077 - RNA, 20 nt, Homo sapiens
auuucuaauguaugcauuca

SEQ ID NO: 871078 - RNA, 16 nt, Homo sapiens
auuucuauagccaaaa

SEQ ID NO: 871079 - RNA, 19 nt, Homo sapiens
auuucuauuuuuguagaag

SEQ ID NO: 871080 - RNA, 13 nt, Homo sapiens
auuucucuugcaa

SEQ ID NO: 871081 - RNA, 19 nt, Homo sapiens
auuucuggaaaacugccuu

SEQ ID NO: 871082 - RNA, 21 nt, Homo sapiens
auuucugggucuuucugacau

SEQ ID NO: 871083 - RNA, 19 nt, Homo sapiens
auuugaagcaucacauaaa

SEQ ID NO: 871084 - RNA, 15 nt, Homo sapiens
cucuggauggcacca

SEQ ID NO: 871085 - RNA, 23 nt, Homo sapiens
cucuggccucagccgacugcaca

SEQ ID NO: 871086 - RNA, 22 nt, Homo sapiens
cucuggcggcuuccuguccacu

SEQ ID NO: 871087 - RNA, 19 nt, Homo sapiens
cucuggcuuugucucuagc

SEQ ID NO: 871088 - RNA, 21 nt, Homo sapiens
cucuggcuuugucucuagccg

SEQ ID NO: 871089 - RNA, 19 nt, Homo sapiens
cucugggagccugacagug

SEQ ID NO: 871090 - RNA, 16 nt, Homo sapiens
cucugggcagcuguca

SEQ ID NO: 871091 - RNA, 20 nt, Homo sapiens
cucugggccaagacuccugu

SEQ ID NO: 871092 - RNA, 12 nt, Homo sapiens
cucugucagcca

SEQ ID NO: 871093 - RNA, 18 nt, Homo sapiens
cucuguccacucugaaua

SEQ ID NO: 871094 - RNA, 19 nt, Homo sapiens
cucugugaggaaagcacac

SEQ ID NO: 871095 - RNA, 23 nt, Homo sapiens
cucuguguuacccaguaacucau

SEQ ID NO: 871096 - RNA, 15 nt, Homo sapiens
cucuuaacuccuagc

SEQ ID NO: 871097 - RNA, 15 nt, Homo sapiens
cucuuacaaccaaga

SEQ ID NO: 871098 - RNA, 19 nt, Homo sapiens
cucuuauagaaaguucaaa

SEQ ID NO: 871099 - RNA, 15 nt, Homo sapiens
cucuucaacugacca

SEQ ID NO: 871100 - RNA, 19 nt, Homo sapiens
cucuucaacugaccagccu

SEQ ID NO: 871101 - RNA, 20 nt, Homo sapiens
cucuuccaaaggcauaagac

SEQ ID NO: 871102 - RNA, 15 nt, Homo sapiens
cucuucccaccucag

SEQ ID NO: 871103 - RNA, 21 nt, Homo sapiens
cucuucccaccucagugccca

SEQ ID NO: 871104 - RNA, 18 nt, Homo sapiens
cucuuccccuugcccuug

SEQ ID NO: 871105 - RNA, 17 nt, Homo sapiens
cucuuccuuacucccag

SEQ ID NO: 871106 - RNA, 22 nt, Homo sapiens
cucuucuaacucauggguaccc

SEQ ID NO: 871107 - RNA, 13 nt, Homo sapiens
cucuucuaugcaa

SEQ ID NO: 871108 - RNA, 16 nt, Homo sapiens
cucuucucuauuccug

SEQ ID NO: 871109 - RNA, 23 nt, Homo sapiens
cucuucugagcaccuacuuacau

SEQ ID NO: 871110 - RNA, 13 nt, Homo sapiens
cucuucuuuaugu

SEQ ID NO: 871111 - RNA, 14 nt, Homo sapiens
cucuugaaccacag

SEQ ID NO: 871112 - RNA, 12 nt, Homo sapiens
cucuugcucaaa

SEQ ID NO: 871113 - RNA, 20 nt, Homo sapiens
cucuugcuuuguucuuuauu

SEQ ID NO: 871114 - RNA, 14 nt, Homo sapiens
cucuuguugcugag

SEQ ID NO: 871115 - RNA, 15 nt, Homo sapiens
cucuuucuacauucu

SEQ ID NO: 871116 - RNA, 16 nt, Homo sapiens
cucuuucuucuuugaa

SEQ ID NO: 871117 - RNA, 13 nt, Homo sapiens
cucuuuucaauua

SEQ ID NO: 871118 - RNA, 17 nt, Homo sapiens
cucuuuucccacauuca

SEQ ID NO: 871119 - RNA, 17 nt, Homo sapiens
cucuuuugaauccaugc

SEQ ID NO: 871120 - RNA, 20 nt, Homo sapiens
cucuuuuguuccuggcuuug

SEQ ID NO: 871121 - RNA, 23 nt, Homo sapiens
cugaaaaccauccaucuguggaa

SEQ ID NO: 871122 - RNA, 19 nt, Homo sapiens
cugaaaagacucaguguuc

SEQ ID NO: 871123 - RNA, 21 nt, Homo sapiens
cugaaagaguccuuucaggaa

SEQ ID NO: 871124 - RNA, 15 nt, Homo sapiens
cugaaagccauuugu

SEQ ID NO: 871125 - RNA, 19 nt, Homo sapiens
cugaaaggcacacuuugau

SEQ ID NO: 871126 - RNA, 15 nt, Homo sapiens
cugaaauaaaagccu

SEQ ID NO: 871127 - RNA, 19 nt, Homo sapiens
cugaaaugcuagcugcaag

SEQ ID NO: 871128 - RNA, 18 nt, Homo sapiens
cugugaggccccuggaca

SEQ ID NO: 871129 - RNA, 12 nt, Homo sapiens
cugugaucccag

SEQ ID NO: 871130 - RNA, 15 nt, Homo sapiens
cugugaucccagcua

SEQ ID NO: 871131 - RNA, 22 nt, Homo sapiens
cugugcccucccauagcacugc

SEQ ID NO: 871132 - RNA, 16 nt, Homo sapiens
cugugcucuaagugaa

SEQ ID NO: 871133 - RNA, 21 nt, Homo sapiens
cugugcuuugagagggauuug

SEQ ID NO: 871134 - RNA, 22 nt, Homo sapiens
cuguggagaaauaaaaauaccu

SEQ ID NO: 871135 - RNA, 20 nt, Homo sapiens
cuguggaugaugguugcaaa

SEQ ID NO: 871136 - RNA, 16 nt, Homo sapiens
cuguggauuauuucau

SEQ ID NO: 871137 - RNA, 14 nt, Homo sapiens
cuguggccugggca

SEQ ID NO: 871138 - RNA, 18 nt, Homo sapiens
cuguggccuguuaacugg

SEQ ID NO: 871139 - RNA, 19 nt, Homo sapiens
cuguggcuucccaugucuu

SEQ ID NO: 871140 - RNA, 13 nt, Homo sapiens
cugugguggagaa

SEQ ID NO: 871141 - RNA, 21 nt, Homo sapiens
cuguguaaaacuauauucuca

SEQ ID NO: 871142 - RNA, 12 nt, Homo sapiens
cuguguacccac

SEQ ID NO: 871143 - RNA, 15 nt, Homo sapiens
cuguguagcugugac

SEQ ID NO: 871144 - RNA, 19 nt, Homo sapiens
cugugucaguggaugcugc

SEQ ID NO: 871145 - RNA, 20 nt, Homo sapiens
cugugucuugcaauggcagc

SEQ ID NO: 871146 - RNA, 19 nt, Homo sapiens
cugugugaugaacuuucuc

SEQ ID NO: 871147 - RNA, 15 nt, Homo sapiens
cuguguuugcugagg

SEQ ID NO: 871148 - RNA, 18 nt, Homo sapiens
cuguuacuugaaauacca

SEQ ID NO: 871149 - RNA, 23 nt, Homo sapiens
cuguuacuugaaauaccagugaa

SEQ ID NO: 871150 - RNA, 20 nt, Homo sapiens
cuguuacuuuuuagucuuuu

SEQ ID NO: 871151 - RNA, 12 nt, Homo sapiens
cuguuaguauua

SEQ ID NO: 871152 - RNA, 23 nt, Homo sapiens
cuguuauccugcuagcuguagaa

SEQ ID NO: 871153 - RNA, 15 nt, Homo sapiens
cuguuaucugcuaga

SEQ ID NO: 871154 - RNA, 19 nt, Homo sapiens
cuguuccacuucucuagag

SEQ ID NO: 871155 - RNA, 11 nt, Homo sapiens
cuguuccucaa

SEQ ID NO: 871156 - RNA, 21 nt, Homo sapiens
cuguucuaagugcuggcaauu

SEQ ID NO: 871157 - RNA, 22 nt, Homo sapiens
cuguucugugugggucugggga

SEQ ID NO: 871158 - RNA, 12 nt, Homo sapiens
cuguugaaucuu

SEQ ID NO: 871159 - RNA, 14 nt, Homo sapiens
cuguugagugcaac

SEQ ID NO: 871160 - RNA, 16 nt, Homo sapiens
cuguugauaauaucuc

SEQ ID NO: 871161 - RNA, 23 nt, Homo sapiens
cuguugaucccacuucacuguga

SEQ ID NO: 871162 - RNA, 16 nt, Homo sapiens
cugggcgccaacugcu

SEQ ID NO: 871163 - RNA, 23 nt, Homo sapiens
cugggcucgccacaucccaugag

SEQ ID NO: 871164 - RNA, 12 nt, Homo sapiens
cugggcucucca

SEQ ID NO: 871165 - RNA, 16 nt, Homo sapiens
cugggcugucugucac

SEQ ID NO: 871166 - RNA, 15 nt, Homo sapiens
cugggcuucagccuc

SEQ ID NO: 871167 - RNA, 17 nt, Homo sapiens
cuggggaacuagaggga

SEQ ID NO: 871168 - RNA, 19 nt, Homo sapiens
cuggggcugagggcauuaa

SEQ ID NO: 871169 - RNA, 22 nt, Homo sapiens
cugggggaggggacauugaaca

SEQ ID NO: 871170 - RNA, 21 nt, Homo sapiens
cugggggccucuuucugugcu

SEQ ID NO: 871171 - RNA, 19 nt, Homo sapiens
cuggggucuguguggugcc

SEQ ID NO: 871172 - RNA, 16 nt, Homo sapiens
cugggucucacuccug

SEQ ID NO: 871173 - RNA, 19 nt, Homo sapiens
cuggguggccucgggacac

SEQ ID NO: 871174 - RNA, 23 nt, Homo sapiens
cuggguggcuacucugugccaga

SEQ ID NO: 871175 - RNA, 15 nt, Homo sapiens
cuggguguugaccac

SEQ ID NO: 871176 - RNA, 23 nt, Homo sapiens
cuggguuuugucucugcaucuca

SEQ ID NO: 871177 - RNA, 17 nt, Homo sapiens
cugguaauuuguaucug

SEQ ID NO: 871178 - RNA, 14 nt, Homo sapiens
cugguacaauccuu

SEQ ID NO: 871179 - RNA, 16 nt, Homo sapiens
cuggucccacucaguc

SEQ ID NO: 871180 - RNA, 16 nt, Homo sapiens
cugguccugagucuug

SEQ ID NO: 871181 - RNA, 13 nt, Homo sapiens
cugguccuuccag

SEQ ID NO: 871182 - RNA, 22 nt, Homo sapiens
cugguccuucucguuugcucua

SEQ ID NO: 871183 - RNA, 23 nt, Homo sapiens
cuggucuccucccaaaauacuac

SEQ ID NO: 871184 - RNA, 16 nt, Homo sapiens
cuggugaccuacuaaa

SEQ ID NO: 871185 - RNA, 15 nt, Homo sapiens
cugguggaaccugca

SEQ ID NO: 871186 - RNA, 14 nt, Homo sapiens
cugguggaggagcu

SEQ ID NO: 871187 - RNA, 14 nt, Homo sapiens
cugguggucaggga

SEQ ID NO: 871188 - RNA, 15 nt, Homo sapiens
cugguuagaaaugca

SEQ ID NO: 871189 - RNA, 15 nt, Homo sapiens
cugguuuaaccuccu

SEQ ID NO: 871190 - RNA, 19 nt, Homo sapiens
cugguuucucagaauccaa

SEQ ID NO: 871191 - RNA, 18 nt, Homo sapiens
cugguuugucaaacaaca

SEQ ID NO: 871192 - RNA, 21 nt, Homo sapiens
cugguuuugacaucagcauua

SEQ ID NO: 871193 - RNA, 17 nt, Homo sapiens
cuguaaacuauaaacua

SEQ ID NO: 871194 - RNA, 16 nt, Homo sapiens
cuguaaaucacuugua

SEQ ID NO: 871195 - RNA, 12 nt, Homo sapiens
cuguaaaugcag

SEQ ID NO: 871196 - RNA, 15 nt, Homo sapiens
cuguaacaugcaauu

SEQ ID NO: 871197 - RNA, 14 nt, Homo sapiens
cuguaaccagauua

SEQ ID NO: 871198 - RNA, 18 nt, Homo sapiens
cuguaacucagacauucc

SEQ ID NO: 871199 - RNA, 12 nt, Homo sapiens
cuguaauagugu

SEQ ID NO: 871200 - RNA, 23 nt, Homo sapiens
cuguaaucccagcacuuugggag

SEQ ID NO: 871201 - RNA, 19 nt, Homo sapiens
cuguaaucccagcuacuca

SEQ ID NO: 871202 - RNA, 16 nt, Homo sapiens
cuguaauuuuguagua

SEQ ID NO: 871203 - RNA, 22 nt, Homo sapiens
cuguacuccagccugggugaca

SEQ ID NO: 871204 - RNA, 17 nt, Homo sapiens
cuguacugagacauuac

SEQ ID NO: 871205 - RNA, 16 nt, Homo sapiens
cuguagaaauguaucc

SEQ ID NO: 871206 - RNA, 22 nt, Homo sapiens
cuguagaaugauuucaugcuau

SEQ ID NO: 871207 - RNA, 20 nt, Homo sapiens
cuguagagccgcauggcacu

SEQ ID NO: 871208 - RNA, 16 nt, Homo sapiens
cuguagagucacugac

SEQ ID NO: 871209 - RNA, 18 nt, Homo sapiens
cuguagccccagugacag

SEQ ID NO: 871210 - RNA, 16 nt, Homo sapiens
cuguaggggcaaaaau

SEQ ID NO: 871211 - RNA, 15 nt, Homo sapiens
cuguagguucuugau

SEQ ID NO: 871212 - RNA, 16 nt, Homo sapiens
cuguaguuuuacauau

SEQ ID NO: 871213 - RNA, 23 nt, Homo sapiens
cuguauaguuaggauagcauuuu

SEQ ID NO: 871214 - RNA, 16 nt, Homo sapiens
cuguauauacaauaac

SEQ ID NO: 871215 - RNA, 19 nt, Homo sapiens
cuguauuuugccagacuua

SEQ ID NO: 871216 - RNA, 21 nt, Homo sapiens
cugucaacacuucucacaucu

SEQ ID NO: 871217 - RNA, 12 nt, Homo sapiens
cugucaccuugc

SEQ ID NO: 871218 - RNA, 15 nt, Homo sapiens
cugucaggacaccag

SEQ ID NO: 871219 - RNA, 13 nt, Homo sapiens
cuguccaaaugga

SEQ ID NO: 871220 - RNA, 22 nt, Homo sapiens
cuguccaaggcacaaaccuuac

SEQ ID NO: 871221 - RNA, 19 nt, Homo sapiens
cuguccaggacaugauacu

SEQ ID NO: 871222 - RNA, 12 nt, Homo sapiens
cuguccuaggcc

SEQ ID NO: 871223 - RNA, 22 nt, Homo sapiens
cuguccucgucucucugcaagg

SEQ ID NO: 871224 - RNA, 21 nt, Homo sapiens
cuguccugccucucugcucca

SEQ ID NO: 871225 - RNA, 22 nt, Homo sapiens
cuguccugccucucugcuccag

SEQ ID NO: 871226 - RNA, 13 nt, Homo sapiens
cugucgcaucuca

SEQ ID NO: 871227 - RNA, 14 nt, Homo sapiens
cugucgcaucucag

SEQ ID NO: 871228 - RNA, 14 nt, Homo sapiens
cugucgcccagucu

SEQ ID NO: 871229 - RNA, 15 nt, Homo sapiens
cugucucaagcucuu

SEQ ID NO: 871230 - RNA, 13 nt, Homo sapiens
cugucuccaggau

SEQ ID NO: 871231 - RNA, 13 nt, Homo sapiens
cugucucuacuaa

SEQ ID NO: 871232 - RNA, 19 nt, Homo sapiens
cugucucucaugaaccuca

SEQ ID NO: 871233 - RNA, 16 nt, Homo sapiens
cugucugucccaaaga

SEQ ID NO: 871234 - RNA, 20 nt, Homo sapiens
cugucuuaaggcaucugaca

SEQ ID NO: 871235 - RNA, 17 nt, Homo sapiens
cugucuuccuucauuau

SEQ ID NO: 871236 - RNA, 14 nt, Homo sapiens
cugucuuuguggga

SEQ ID NO: 871237 - RNA, 20 nt, Homo sapiens
cugugaaagaaccaaaagag

SEQ ID NO: 871238 - RNA, 23 nt, Homo sapiens
cugugaauagucugugugcacaa

SEQ ID NO: 871239 - RNA, 19 nt, Homo sapiens
cugugaccugcugagcucu

SEQ ID NO: 871240 - RNA, 22 nt, Homo sapiens
cugugaccugcugagcucugag

SEQ ID NO: 871241 - RNA, 16 nt, Homo sapiens
cugugagauaaccaca

SEQ ID NO: 871242 - RNA, 15 nt, Homo sapiens
agaccugacaagcac

SEQ ID NO: 871243 - RNA, 15 nt, Homo sapiens
agaccugagaaccuu

SEQ ID NO: 871244 - RNA, 12 nt, Homo sapiens
agacguguacau

SEQ ID NO: 871245 - RNA, 23 nt, Homo sapiens
agacuaaccugcccacccacucc

SEQ ID NO: 871246 - RNA, 24 nt, Homo sapiens
agacuaagcccugucgagacacuu

SEQ ID NO: 871247 - RNA, 22 nt, Homo sapiens
agacuauaagcagaagcacaua

SEQ ID NO: 871248 - RNA, 17 nt, Homo sapiens
agacuauucaaacaguc

SEQ ID NO: 871249 - RNA, 15 nt, Homo sapiens
agacuauugagauau

SEQ ID NO: 871250 - RNA, 17 nt, Homo sapiens
agacuauugugccuuag

SEQ ID NO: 871251 - RNA, 23 nt, Homo sapiens
agacucaaagagggagugcauuu

SEQ ID NO: 871252 - RNA, 21 nt, Homo sapiens
acaagaauuguccaugugcuu

SEQ ID NO: 871253 - RNA, 22 nt, Homo sapiens
acaagaauuucuugguaagaag

SEQ ID NO: 871254 - RNA, 18 nt, Homo sapiens
acaagagacuuaacuuau

SEQ ID NO: 871255 - RNA, 21 nt, Homo sapiens
acaagaugcugcaaugugagu

SEQ ID NO: 871256 - RNA, 11 nt, Homo sapiens
acaagauuccc

SEQ ID NO: 871257 - RNA, 14 nt, Homo sapiens
acaagcauauuuga

SEQ ID NO: 871258 - RNA, 14 nt, Homo sapiens
acaagcauuugccc

SEQ ID NO: 871259 - RNA, 16 nt, Homo sapiens
acugucucaacuacuc

SEQ ID NO: 871260 - RNA, 21 nt, Homo sapiens
acugucuugaagacaauggcu

SEQ ID NO: 871261 - RNA, 18 nt, Homo sapiens
acugugccaugugccagg

SEQ ID NO: 871262 - RNA, 20 nt, Homo sapiens
acugugcguuuuagaguaug

SEQ ID NO: 871263 - RNA, 21 nt, Homo sapiens
aaugucuuaaucaugagauaa

SEQ ID NO: 871264 - RNA, 17 nt, Homo sapiens
aaugucuuucuauucau

SEQ ID NO: 871265 - RNA, 21 nt, Homo sapiens
aaugugccucggccuccaagg

SEQ ID NO: 871266 - RNA, 15 nt, Homo sapiens
aaugugguacaagca

SEQ ID NO: 871267 - RNA, 22 nt, Homo sapiens
aauguguauugaagaaaagcac

SEQ ID NO: 871268 - RNA, 12 nt, Homo sapiens
aaugugucacua

SEQ ID NO: 871269 - RNA, 23 nt, Homo sapiens
aauguuaagacuugacaguggaa

SEQ ID NO: 871270 - RNA, 15 nt, Homo sapiens
aauguuacauuauua

SEQ ID NO: 871271 - RNA, 14 nt, Homo sapiens
aauguucacaacau

SEQ ID NO: 871272 - RNA, 19 nt, Homo sapiens
aauguucuauaugcauuua

SEQ ID NO: 871273 - RNA, 17 nt, Homo sapiens
gaccucaggugcuaggg

SEQ ID NO: 871274 - RNA, 20 nt, Homo sapiens
gaccuccccacccccgcugg

SEQ ID NO: 871275 - RNA, 15 nt, Homo sapiens
gaccucuacaagcaa

SEQ ID NO: 871276 - RNA, 14 nt, Homo sapiens
gaccucuacugccu

SEQ ID NO: 871277 - RNA, 23 nt, Homo sapiens
gaccucucaacagaucugugggc

SEQ ID NO: 871278 - RNA, 18 nt, Homo sapiens
gaccucugccugaaguca

SEQ ID NO: 871279 - RNA, 18 nt, Homo sapiens
gaccugaccggcaccugc

SEQ ID NO: 871280 - RNA, 12 nt, Homo sapiens
gaccuguguucc

SEQ ID NO: 871281 - RNA, 16 nt, Homo sapiens
gaccuguguucuugcu

SEQ ID NO: 871282 - RNA, 22 nt, Homo sapiens
gaccuucaucagaccacucccu

SEQ ID NO: 871283 - RNA, 23 nt, Homo sapiens
gaccuuccugccaccagucacug

SEQ ID NO: 871284 - RNA, 17 nt, Homo sapiens
gaccuucuccccauucu

SEQ ID NO: 871285 - RNA, 21 nt, Homo sapiens
gaccuucucccucacuccugc

SEQ ID NO: 871286 - RNA, 21 nt, Homo sapiens
gaccuuuuuuaggaagcaagc

SEQ ID NO: 871287 - RNA, 15 nt, Homo sapiens
gacgaacaggggcca

SEQ ID NO: 871288 - RNA, 17 nt, Homo sapiens
gacgaacaggggccaaa

SEQ ID NO: 871289 - RNA, 18 nt, Homo sapiens
gacgcagguguaccuccc

SEQ ID NO: 871290 - RNA, 15 nt, Homo sapiens
gacggaugauuggau

SEQ ID NO: 871291 - RNA, 19 nt, Homo sapiens
gacuaaaugaaaucuugca

SEQ ID NO: 871292 - RNA, 23 nt, Homo sapiens
gacuaaccccaacgcacaggaaa

SEQ ID NO: 871293 - RNA, 19 nt, Homo sapiens
gacuaauagagacacagag

SEQ ID NO: 871294 - RNA, 16 nt, Homo sapiens
gacuaauggaaauauu

SEQ ID NO: 871295 - RNA, 18 nt, Homo sapiens
gauguugcuggacuguca

SEQ ID NO: 871296 - RNA, 22 nt, Homo sapiens
gauguuuuaaguuuaucuuuca

SEQ ID NO: 871297 - RNA, 19 nt, Homo sapiens
gauuaagauacacuccugc

SEQ ID NO: 871298 - RNA, 18 nt, Homo sapiens
gauuaaggugaugugauu

SEQ ID NO: 871299 - RNA, 20 nt, Homo sapiens
gauuaauuuguguagauugu

SEQ ID NO: 871300 - RNA, 22 nt, Homo sapiens
gauuacaagcgugagccacugc

SEQ ID NO: 871301 - RNA, 16 nt, Homo sapiens
gauuacuucagggcug

SEQ ID NO: 871302 - RNA, 13 nt, Homo sapiens
gauuagcacuuaa

SEQ ID NO: 871303 - RNA, 13 nt, Homo sapiens
gauuauuugcacg

SEQ ID NO: 871304 - RNA, 20 nt, Homo sapiens
gauucacaaugaaaugcucu

SEQ ID NO: 871305 - RNA, 20 nt, Homo sapiens
gauucacaucucauuuuucc

SEQ ID NO: 871306 - RNA, 23 nt, Homo sapiens
gauucacuaaagcagcacauagc

SEQ ID NO: 871307 - RNA, 13 nt, Homo sapiens
gauucacuauuag

SEQ ID NO: 871308 - RNA, 14 nt, Homo sapiens
gauucaugccaauu

SEQ ID NO: 871309 - RNA, 14 nt, Homo sapiens
gauucauuuuaaca

SEQ ID NO: 871310 - RNA, 23 nt, Homo sapiens
gauuccauuuggugaccaucugu

SEQ ID NO: 871311 - RNA, 23 nt, Homo sapiens
gauucccccagucauucugggaa

SEQ ID NO: 871312 - RNA, 18 nt, Homo sapiens
gauuccugggcaagaacc

SEQ ID NO: 871313 - RNA, 21 nt, Homo sapiens
gauuccugggcaagaaccuaa

SEQ ID NO: 871314 - RNA, 20 nt, Homo sapiens
gauucgugacaacaugcgac

SEQ ID NO: 871315 - RNA, 13 nt, Homo sapiens
gauugcagacuca

SEQ ID NO: 871316 - RNA, 18 nt, Homo sapiens
gauugcuuaaaauagcaa

SEQ ID NO: 871317 - RNA, 15 nt, Homo sapiens
gauuggccccacuga

SEQ ID NO: 871318 - RNA, 19 nt, Homo sapiens
gauuggcuauaacaugucu

SEQ ID NO: 871319 - RNA, 15 nt, Homo sapiens
gauuuaacacuaaaa

SEQ ID NO: 871320 - RNA, 15 nt, Homo sapiens
gauuuagauaugcaa

SEQ ID NO: 871321 - RNA, 20 nt, Homo sapiens
gauuuccaaaagacuugaag

SEQ ID NO: 871322 - RNA, 18 nt, Homo sapiens
gauuucuccaaaucuggg

SEQ ID NO: 871323 - RNA, 22 nt, Homo sapiens
gauuugccagcacaggggcccc

SEQ ID NO: 871324 - RNA, 23 nt, Homo sapiens
gauuuguauuuauauuagagugc

SEQ ID NO: 871325 - RNA, 20 nt, Homo sapiens
gauuuuacagagaaucugaa

SEQ ID NO: 871326 - RNA, 14 nt, Homo sapiens
gauuuuaguucacu

SEQ ID NO: 871327 - RNA, 15 nt, Homo sapiens
gauuuucuauuuaug

SEQ ID NO: 871328 - RNA, 12 nt, Homo sapiens
gauuuuuacaca

SEQ ID NO: 871329 - RNA, 13 nt, Homo sapiens
gauuuuuacacau

SEQ ID NO: 871330 - RNA, 21 nt, Homo sapiens
gauuuuuacacauguaucuau

SEQ ID NO: 871331 - RNA, 23 nt, Homo sapiens
gauuuuuuuuuuaaaacuaucca

SEQ ID NO: 871332 - RNA, 18 nt, Homo sapiens
gcaaaaaaaaaaauauua

SEQ ID NO: 871333 - RNA, 21 nt, Homo sapiens
gcaaaaaaaaacuuugacaaa

SEQ ID NO: 871334 - RNA, 22 nt, Homo sapiens
gcaaaaaaucuuccaaagacaa

SEQ ID NO: 871335 - RNA, 16 nt, Homo sapiens
gcaaaacuccaucuca

SEQ ID NO: 871336 - RNA, 17 nt, Homo sapiens
gcaaaacuccaucucaa

SEQ ID NO: 871337 - RNA, 14 nt, Homo sapiens
gcaaaagcucugug

SEQ ID NO: 871338 - RNA, 17 nt, Homo sapiens
gcaaaaucuaccagguc

SEQ ID NO: 871339 - RNA, 20 nt, Homo sapiens
gcaaacacaccgaugcacac

SEQ ID NO: 871340 - RNA, 23 nt, Homo sapiens
gcaaacagagugaaaugccauuu

SEQ ID NO: 871341 - RNA, 11 nt, Homo sapiens
gcaaagccugu

SEQ ID NO: 871342 - RNA, 17 nt, Homo sapiens
gcaaaggaaaccaaagg

SEQ ID NO: 871343 - RNA, 18 nt, Homo sapiens
gcaaagggagcacugggu

SEQ ID NO: 871344 - RNA, 21 nt, Homo sapiens
gcaaaggggaggcaucagugu

SEQ ID NO: 871345 - RNA, 14 nt, Homo sapiens
gcaaauaaauauca

SEQ ID NO: 871346 - RNA, 16 nt, Homo sapiens
gcaaauccucuucuaa

SEQ ID NO: 871347 - RNA, 21 nt, Homo sapiens
gcaaauguaguauggccugug

SEQ ID NO: 871348 - RNA, 16 nt, Homo sapiens
gcaaauuaaacuuuaa

SEQ ID NO: 871349 - RNA, 13 nt, Homo sapiens
gcaacaaagugag

SEQ ID NO: 871350 - RNA, 14 nt, Homo sapiens
gcaacaagaucuga

SEQ ID NO: 871351 - RNA, 22 nt, Homo sapiens
gcaacuuaagcugggauaauca

SEQ ID NO: 871352 - RNA, 18 nt, Homo sapiens
gcaagacuguugcucaaa

SEQ ID NO: 871353 - RNA, 14 nt, Homo sapiens
gcaagcaccaggcu

SEQ ID NO: 871354 - RNA, 13 nt, Homo sapiens
gcaagcagggaaa

SEQ ID NO: 871355 - RNA, 17 nt, Homo sapiens
gcaagccuugcuagaca

SEQ ID NO: 871356 - RNA, 16 nt, Homo sapiens
gcaagcgacaggaaag

SEQ ID NO: 871357 - RNA, 17 nt, Homo sapiens
gcaaggacggccuucaa

SEQ ID NO: 871358 - RNA, 20 nt, Homo sapiens
gcaaggcccgagcagcugag

SEQ ID NO: 871359 - RNA, 11 nt, Homo sapiens
gcaagggccag

SEQ ID NO: 871360 - RNA, 16 nt, Homo sapiens
gcaagggcugugcuga

SEQ ID NO: 871361 - RNA, 22 nt, Homo sapiens
gcaagugauugaaaauaguaaa

SEQ ID NO: 871362 - RNA, 11 nt, Homo sapiens
gcaagugcccg

SEQ ID NO: 871363 - RNA, 21 nt, Homo sapiens
gcaagugcuaugccaagccau

SEQ ID NO: 871364 - RNA, 17 nt, Homo sapiens
gcaauacauguaucuaa

SEQ ID NO: 871365 - RNA, 23 nt, Homo sapiens
gcaaucaaguccuacaagcuaaa

SEQ ID NO: 871366 - RNA, 21 nt, Homo sapiens
gcaaucucuugucucacaugc

SEQ ID NO: 871367 - RNA, 22 nt, Homo sapiens
gcaaucucuugucucacaugcu

SEQ ID NO: 871368 - RNA, 15 nt, Homo sapiens
gcaaugaaaccaaag

SEQ ID NO: 871369 - RNA, 17 nt, Homo sapiens
gcaaugggcacugggau

SEQ ID NO: 871370 - RNA, 19 nt, Homo sapiens
gcaauuagauuaguauuuu

SEQ ID NO: 871371 - RNA, 12 nt, Homo sapiens
gcacaaaccuua

SEQ ID NO: 871372 - RNA, 17 nt, Homo sapiens
gcacaaaccuuacuaug

SEQ ID NO: 871373 - RNA, 20 nt, Homo sapiens
gcacaaagcucaagaugaca

SEQ ID NO: 871374 - RNA, 14 nt, Homo sapiens
gcacaaaugcaccu

SEQ ID NO: 871375 - RNA, 21 nt, Homo sapiens
gcacacacacagagauaugca

SEQ ID NO: 871376 - RNA, 22 nt, Homo sapiens
gcacacacacagagauaugcac

SEQ ID NO: 871377 - RNA, 14 nt, Homo sapiens
gcacacacaccgau

SEQ ID NO: 871378 - RNA, 17 nt, Homo sapiens
gcacacacaccgaugua

SEQ ID NO: 871379 - RNA, 20 nt, Homo sapiens
gcacacacagauaugcacac

SEQ ID NO: 871380 - RNA, 24 nt, Homo sapiens
gcacacacagaugcacacacagau

SEQ ID NO: 871381 - RNA, 12 nt, Homo sapiens
gcacacaccgau

SEQ ID NO: 871382 - RNA, 16 nt, Homo sapiens
gcacacaccgaugugc

SEQ ID NO: 871383 - RNA, 14 nt, Homo sapiens
gcacacagucaccu

SEQ ID NO: 871384 - RNA, 17 nt, Homo sapiens
gcacacaugguuuccaa

SEQ ID NO: 871385 - RNA, 20 nt, Homo sapiens
gcacacaugguuuccaaggg

SEQ ID NO: 871386 - RNA, 16 nt, Homo sapiens
gcacacggaugcacag

SEQ ID NO: 871387 - RNA, 20 nt, Homo sapiens
gcacacuuaugggccaagcc

SEQ ID NO: 871388 - RNA, 23 nt, Homo sapiens
gcacagcccugggagggggcuau

SEQ ID NO: 871389 - RNA, 16 nt, Homo sapiens
gcacagcuaugaaggc

SEQ ID NO: 871390 - RNA, 15 nt, Homo sapiens
gcacauaacaugcuu

SEQ ID NO: 871391 - RNA, 16 nt, Homo sapiens
gcacauagagauaugc

SEQ ID NO: 871392 - RNA, 17 nt, Homo sapiens
gcacauagagauaugca

SEQ ID NO: 871393 - RNA, 18 nt, Homo sapiens
gcacauagagauaugcac

SEQ ID NO: 871394 - RNA, 14 nt, Homo sapiens
augucaauugucag

SEQ ID NO: 871395 - RNA, 17 nt, Homo sapiens
augucacaauccugucc

SEQ ID NO: 871396 - RNA, 12 nt, Homo sapiens
augucaccucag

SEQ ID NO: 871397 - RNA, 14 nt, Homo sapiens
augucagagccagg

SEQ ID NO: 871398 - RNA, 19 nt, Homo sapiens
augucagagcuauguuccc

SEQ ID NO: 871399 - RNA, 13 nt, Homo sapiens
augucaguuacaa

SEQ ID NO: 871400 - RNA, 23 nt, Homo sapiens
augucaucaaauauuaccaaaaa

SEQ ID NO: 871401 - RNA, 17 nt, Homo sapiens
augucaucauacaugac

SEQ ID NO: 871402 - RNA, 20 nt, Homo sapiens
augucauuuugguacuuugg

SEQ ID NO: 871403 - RNA, 18 nt, Homo sapiens
augucuaaauggcuuuaa

SEQ ID NO: 871404 - RNA, 18 nt, Homo sapiens
augucuagccacugauca

SEQ ID NO: 871405 - RNA, 12 nt, Homo sapiens
augucuagcuca

SEQ ID NO: 871406 - RNA, 15 nt, Homo sapiens
augucuagcucaucu

SEQ ID NO: 871407 - RNA, 18 nt, Homo sapiens
augucucagccuccucag

SEQ ID NO: 871408 - RNA, 16 nt, Homo sapiens
augucucuuguagaag

SEQ ID NO: 871409 - RNA, 19 nt, Homo sapiens
augucucuuuaaugucaca

SEQ ID NO: 871410 - RNA, 12 nt, Homo sapiens
augucugagcua

SEQ ID NO: 871411 - RNA, 14 nt, Homo sapiens
augucuggucuguc

SEQ ID NO: 871412 - RNA, 17 nt, Homo sapiens
augucuguaucuacuua

SEQ ID NO: 871413 - RNA, 23 nt, Homo sapiens
augucuguuucaaugaccuguau

SEQ ID NO: 871414 - RNA, 20 nt, Homo sapiens
augugaaaaaugugucugua

SEQ ID NO: 871415 - RNA, 22 nt, Homo sapiens
augugaguugcacagcuaugaa

SEQ ID NO: 871416 - RNA, 19 nt, Homo sapiens
augugcagguuuugaaaau

SEQ ID NO: 871417 - RNA, 15 nt, Homo sapiens
augugcccacaggga

SEQ ID NO: 871418 - RNA, 16 nt, Homo sapiens
augugcccacagggac

SEQ ID NO: 871419 - RNA, 16 nt, Homo sapiens
augugcuauugaacug

SEQ ID NO: 871420 - RNA, 15 nt, Homo sapiens
augugcuucacauaa

SEQ ID NO: 871421 - RNA, 23 nt, Homo sapiens
augugcuuuuaaaaaaaaauacu

SEQ ID NO: 871422 - RNA, 15 nt, Homo sapiens
auguggaucugggga

SEQ ID NO: 871423 - RNA, 18 nt, Homo sapiens
auguggcaaagugcugua

SEQ ID NO: 871424 - RNA, 20 nt, Homo sapiens
augugggguccccaucaucc

SEQ ID NO: 871425 - RNA, 21 nt, Homo sapiens
augugggguccccaucauccc

SEQ ID NO: 871426 - RNA, 22 nt, Homo sapiens
augugggguccccaucauccca

SEQ ID NO: 871427 - RNA, 24 nt, Homo sapiens
augugguuaaugccauggacagaa

SEQ ID NO: 871428 - RNA, 20 nt, Homo sapiens
auguguaaauggagcuugua

SEQ ID NO: 871429 - RNA, 20 nt, Homo sapiens
auguguagggaaaguuaaaa

SEQ ID NO: 871430 - RNA, 22 nt, Homo sapiens
auguguauugaagaaaagcacu

SEQ ID NO: 871431 - RNA, 18 nt, Homo sapiens
auguguauuuguauguac

SEQ ID NO: 871432 - RNA, 21 nt, Homo sapiens
augugucacuacucacagucu

SEQ ID NO: 871433 - RNA, 18 nt, Homo sapiens
auguguccccucacucug

SEQ ID NO: 871434 - RNA, 16 nt, Homo sapiens
auguguguguauauau

SEQ ID NO: 871435 - RNA, 17 nt, Homo sapiens
auguguuuuaauuccaa

SEQ ID NO: 871436 - RNA, 16 nt, Homo sapiens
auguuaaccucagugu

SEQ ID NO: 871437 - RNA, 17 nt, Homo sapiens
auguuaacuaaauaacu

SEQ ID NO: 871438 - RNA, 19 nt, Homo sapiens
auguuaagacuugacagug

SEQ ID NO: 871439 - RNA, 22 nt, Homo sapiens
auguuaagacuugacaguggaa

SEQ ID NO: 871440 - RNA, 12 nt, Homo sapiens
auguuacuuugg

SEQ ID NO: 871441 - RNA, 18 nt, Homo sapiens
auguuagaaguccaggca

SEQ ID NO: 871442 - RNA, 19 nt, Homo sapiens
auguuagggugcucuggaa

SEQ ID NO: 871443 - RNA, 17 nt, Homo sapiens
auguuauccacaagcaa

SEQ ID NO: 871444 - RNA, 19 nt, Homo sapiens
auguucagaauguacggaa

SEQ ID NO: 871445 - RNA, 20 nt, Homo sapiens
auguuccaauaaaacuuuau

SEQ ID NO: 871446 - RNA, 14 nt, Homo sapiens
auguuccucaaaag

SEQ ID NO: 871447 - RNA, 20 nt, Homo sapiens
auguugagcugaguuccuua

SEQ ID NO: 871448 - RNA, 13 nt, Homo sapiens
auguuucuauucu

SEQ ID NO: 871449 - RNA, 22 nt, Homo sapiens
auguuugcuauugacaagucau

SEQ ID NO: 871450 - RNA, 18 nt, Homo sapiens
auguuuuaagaagcauuu

SEQ ID NO: 871451 - RNA, 17 nt, Homo sapiens
auguuuuagccagugau

SEQ ID NO: 871452 - RNA, 22 nt, Homo sapiens
auuaaaaaagcucaaugcauug

SEQ ID NO: 871453 - RNA, 15 nt, Homo sapiens
auuaaaaacugagug

SEQ ID NO: 871454 - RNA, 18 nt, Homo sapiens
auuaaaaaugaaagccaa

SEQ ID NO: 871455 - RNA, 17 nt, Homo sapiens
cuguauaaaaugcaaaa

SEQ ID NO: 871456 - RNA, 21 nt, Homo sapiens
cuguauaaucuauuuacauaa

SEQ ID NO: 871457 - RNA, 19 nt, Homo sapiens
cuguauauacaauaacaua

SEQ ID NO: 871458 - RNA, 20 nt, Homo sapiens
cuguauuuugccagacuuaa

SEQ ID NO: 871459 - RNA, 16 nt, Homo sapiens
cugucaccaagccuug

SEQ ID NO: 871460 - RNA, 13 nt, Homo sapiens
cugucacccuggc

SEQ ID NO: 871461 - RNA, 15 nt, Homo sapiens
cugucaccuugcuca

SEQ ID NO: 871462 - RNA, 20 nt, Homo sapiens
cugucaucaauuaaaggcaa

SEQ ID NO: 871463 - RNA, 19 nt, Homo sapiens
cugucaugguguccagaca

SEQ ID NO: 871464 - RNA, 15 nt, Homo sapiens
cuguccccacacuga

SEQ ID NO: 871465 - RNA, 17 nt, Homo sapiens
cuguccccacacugacc

SEQ ID NO: 871466 - RNA, 21 nt, Homo sapiens
cuguccccacagcaggugccu

SEQ ID NO: 871467 - RNA, 13 nt, Homo sapiens
cuguccccugaaa

SEQ ID NO: 871468 - RNA, 15 nt, Homo sapiens
cugucccuacccacu

SEQ ID NO: 871469 - RNA, 19 nt, Homo sapiens
cugucccucaaaugaccca

SEQ ID NO: 871470 - RNA, 14 nt, Homo sapiens
cuguccuauggaag

SEQ ID NO: 871471 - RNA, 15 nt, Homo sapiens
cuguccuggcugcuc

SEQ ID NO: 871472 - RNA, 22 nt, Homo sapiens
cuguccuuuuggcacugagaua

SEQ ID NO: 871473 - RNA, 19 nt, Homo sapiens
cugucugucaccagcuauc

SEQ ID NO: 871474 - RNA, 17 nt, Homo sapiens
cugucuuucagcauuca

SEQ ID NO: 871475 - RNA, 19 nt, Homo sapiens
cugugaaagaaccaaaaga

SEQ ID NO: 871476 - RNA, 20 nt, Homo sapiens
cugugaauaaaaacccugua

SEQ ID NO: 871477 - RNA, 21 nt, Homo sapiens
cugugcauacauguucaucgu

SEQ ID NO: 871478 - RNA, 15 nt, Homo sapiens
cugugcaugaccuga

SEQ ID NO: 871479 - RNA, 23 nt, Homo sapiens
cugugccucgcuccccacucugc

SEQ ID NO: 871480 - RNA, 17 nt, Homo sapiens
cugugccucugccuguc

SEQ ID NO: 871481 - RNA, 16 nt, Homo sapiens
cugugcuuugacucac

SEQ ID NO: 871482 - RNA, 22 nt, Homo sapiens
cuguggcaggccuaggaccuca

SEQ ID NO: 871483 - RNA, 21 nt, Homo sapiens
cuguggcugcuagcacuugga

SEQ ID NO: 871484 - RNA, 19 nt, Homo sapiens
cugugggggaggucccugc

SEQ ID NO: 871485 - RNA, 14 nt, Homo sapiens
cuguggucauguaa

SEQ ID NO: 871486 - RNA, 21 nt, Homo sapiens
cuguggucuucaaauugucuu

SEQ ID NO: 871487 - RNA, 22 nt, Homo sapiens
cuguguaaaacuauauucucag

SEQ ID NO: 871488 - RNA, 14 nt, Homo sapiens
cuguguaaccucca

SEQ ID NO: 871489 - RNA, 21 nt, Homo sapiens
cuguguacagaauucugcuac

SEQ ID NO: 871490 - RNA, 16 nt, Homo sapiens
cuguguagcugugacc

SEQ ID NO: 871491 - RNA, 21 nt, Homo sapiens
cuguguauuuaacugccuugu

SEQ ID NO: 871492 - RNA, 19 nt, Homo sapiens
cuguguccuugcaccugca

SEQ ID NO: 871493 - RNA, 23 nt, Homo sapiens
cugugucuuauagguuuccacug

SEQ ID NO: 871494 - RNA, 12 nt, Homo sapiens
cugugugccauu

SEQ ID NO: 871495 - RNA, 23 nt, Homo sapiens
cugugugccauuuuaagaguuac

SEQ ID NO: 871496 - RNA, 12 nt, Homo sapiens
cugugugcugac

SEQ ID NO: 871497 - RNA, 20 nt, Homo sapiens
cuguguguccuugugugcau

SEQ ID NO: 871498 - RNA, 13 nt, Homo sapiens
cuguguugucucu

SEQ ID NO: 871499 - RNA, 17 nt, Homo sapiens
cuguguuucuugccuca

SEQ ID NO: 871500 - RNA, 20 nt, Homo sapiens
cuguuaacuuaauaguauuu

SEQ ID NO: 871501 - RNA, 17 nt, Homo sapiens
cuguuacugaaaguggu

SEQ ID NO: 871502 - RNA, 22 nt, Homo sapiens
cuguuagaugugacacauucuc

SEQ ID NO: 871503 - RNA, 22 nt, Homo sapiens
cuguuauuaccauuagcauucu

SEQ ID NO: 871504 - RNA, 13 nt, Homo sapiens
cuguucacagcca

SEQ ID NO: 871505 - RNA, 19 nt, Homo sapiens
cuguucucaaaugcuaaau

SEQ ID NO: 871506 - RNA, 13 nt, Homo sapiens
cuguugaaucuug

SEQ ID NO: 871507 - RNA, 22 nt, Homo sapiens
cuguugaguuggacacacugua

SEQ ID NO: 871508 - RNA, 16 nt, Homo sapiens
cuguuggccaguguga

SEQ ID NO: 871509 - RNA, 15 nt, Homo sapiens
cuguuguaauagucc

SEQ ID NO: 871510 - RNA, 20 nt, Homo sapiens
cuguuguaggguugccagau

SEQ ID NO: 871511 - RNA, 18 nt, Homo sapiens
cuguuucucucacugggc

SEQ ID NO: 871512 - RNA, 24 nt, Homo sapiens
cuguuuuugaagaagggaaauuca

SEQ ID NO: 871513 - RNA, 17 nt, Homo sapiens
cuguuuuuguaguggua

SEQ ID NO: 871514 - RNA, 15 nt, Homo sapiens
cuuaaaaaaugucca

SEQ ID NO: 871515 - RNA, 15 nt, Homo sapiens
cuuaaaaacuuccau

SEQ ID NO: 871516 - RNA, 17 nt, Homo sapiens
cuuaaaauauauuucag

SEQ ID NO: 871517 - RNA, 20 nt, Homo sapiens
cuuaaaauugguaauugaau

SEQ ID NO: 871518 - RNA, 19 nt, Homo sapiens
cuuaaagcacagucugaug

SEQ ID NO: 871519 - RNA, 23 nt, Homo sapiens
cuuaaagcuuguuuguucuaguu

SEQ ID NO: 871520 - RNA, 16 nt, Homo sapiens
cuuaaaggaccuuccc

SEQ ID NO: 871521 - RNA, 17 nt, Homo sapiens
cuuaaauauuaugugaa

SEQ ID NO: 871522 - RNA, 13 nt, Homo sapiens
cuuaaaucugccu

SEQ ID NO: 871523 - RNA, 18 nt, Homo sapiens
cuuaaaugacagugaauu

SEQ ID NO: 871524 - RNA, 19 nt, Homo sapiens
cuuaaccagcacauuucuc

SEQ ID NO: 871525 - RNA, 20 nt, Homo sapiens
cuuaagguacgcuugcuugu

SEQ ID NO: 871526 - RNA, 14 nt, Homo sapiens
cuuaauaguauuua

SEQ ID NO: 871527 - RNA, 22 nt, Homo sapiens
cuuaauggcucaugaccuggaa

SEQ ID NO: 871528 - RNA, 19 nt, Homo sapiens
cuuaauggguacaauguac

SEQ ID NO: 871529 - RNA, 22 nt, Homo sapiens
cuuaauguucugaauaauuucu

SEQ ID NO: 871530 - RNA, 14 nt, Homo sapiens
cuuaauuuucagua

SEQ ID NO: 871531 - RNA, 17 nt, Homo sapiens
cuuaauuuucaguauaa

SEQ ID NO: 871532 - RNA, 14 nt, Homo sapiens
cuuacaaacaugug

SEQ ID NO: 871533 - RNA, 19 nt, Homo sapiens
cuuacaucugcagcucuuu

SEQ ID NO: 871534 - RNA, 20 nt, Homo sapiens
cuuacauuuucccaguaauu

SEQ ID NO: 871535 - RNA, 22 nt, Homo sapiens
cuuaccuauuauaaaaucuuac

SEQ ID NO: 871536 - RNA, 14 nt, Homo sapiens
cuuaccugacacaa

SEQ ID NO: 871537 - RNA, 17 nt, Homo sapiens
cuuacuaaugugcccca

SEQ ID NO: 871538 - RNA, 20 nt, Homo sapiens
cuuacucccaggcacugucu

SEQ ID NO: 871539 - RNA, 14 nt, Homo sapiens
cuuacuguaacgga

SEQ ID NO: 871540 - RNA, 16 nt, Homo sapiens
cuuacuuaaacccagc

SEQ ID NO: 871541 - RNA, 21 nt, Homo sapiens
cuuacuucccuaaugaaguua

SEQ ID NO: 871542 - RNA, 20 nt, Homo sapiens
cuuacuucgugcgcaacaac

SEQ ID NO: 871543 - RNA, 14 nt, Homo sapiens
cuuacuuugaguua

SEQ ID NO: 871544 - RNA, 18 nt, Homo sapiens
cuuagaaauugcauuucc

SEQ ID NO: 871545 - RNA, 14 nt, Homo sapiens
cuuagaaauuguaa

SEQ ID NO: 871546 - RNA, 19 nt, Homo sapiens
cuuagaccgaaggggaaaa

SEQ ID NO: 871547 - RNA, 16 nt, Homo sapiens
cuuagacuucgacuca

SEQ ID NO: 871548 - RNA, 14 nt, Homo sapiens
cuuagcaacuuggg

SEQ ID NO: 871549 - RNA, 13 nt, Homo sapiens
cuuagcauguccc

SEQ ID NO: 871550 - RNA, 15 nt, Homo sapiens
cuuagccuacagaug

SEQ ID NO: 871551 - RNA, 18 nt, Homo sapiens
cuuagccuccugaccuga

SEQ ID NO: 871552 - RNA, 17 nt, Homo sapiens
cuuagcugaacaaugaa

SEQ ID NO: 871553 - RNA, 15 nt, Homo sapiens
cuuaggaaacccuuc

SEQ ID NO: 871554 - RNA, 23 nt, Homo sapiens
cuuaggaauuucuccuacuuuac

SEQ ID NO: 871555 - RNA, 13 nt, Homo sapiens
cuuagguuuuaac

SEQ ID NO: 871556 - RNA, 13 nt, Homo sapiens
cuuaguaucucau

SEQ ID NO: 871557 - RNA, 22 nt, Homo sapiens
cuuaguaucucaucaacaaaga

SEQ ID NO: 871558 - RNA, 22 nt, Homo sapiens
cuuaguccgcaaguucagggaa

SEQ ID NO: 871559 - RNA, 23 nt, Homo sapiens
cuuaguccgcaaguucagggaag

SEQ ID NO: 871560 - RNA, 13 nt, Homo sapiens
cuuaguggcuuuu

SEQ ID NO: 871561 - RNA, 18 nt, Homo sapiens
cuuauaaagcauugcaac

SEQ ID NO: 871562 - RNA, 15 nt, Homo sapiens
cuuauaccaaaggga

SEQ ID NO: 871563 - RNA, 23 nt, Homo sapiens
cuuauacgaguaauaugccugcu

SEQ ID NO: 871564 - RNA, 20 nt, Homo sapiens
cuuauaucaucagcauaccu

SEQ ID NO: 871565 - RNA, 21 nt, Homo sapiens
cuuauaucaucagcauaccuu

SEQ ID NO: 871566 - RNA, 16 nt, Homo sapiens
cuuaucugauacuuau

SEQ ID NO: 871567 - RNA, 20 nt, Homo sapiens
cuuaugccuauaccugaaua

SEQ ID NO: 871568 - RNA, 15 nt, Homo sapiens
cuuauguauuuauga

SEQ ID NO: 871569 - RNA, 18 nt, Homo sapiens
auuaaaagugacauuugu

SEQ ID NO: 871570 - RNA, 16 nt, Homo sapiens
auuaaaaucuggaaau

SEQ ID NO: 871571 - RNA, 13 nt, Homo sapiens
auuaaacaccuga

SEQ ID NO: 871572 - RNA, 13 nt, Homo sapiens
auuaaacacugua

SEQ ID NO: 871573 - RNA, 18 nt, Homo sapiens
auuaaacagacuuuagcu

SEQ ID NO: 871574 - RNA, 22 nt, Homo sapiens
auuaaagugccauuuccugucu

SEQ ID NO: 871575 - RNA, 15 nt, Homo sapiens
auuaaauaaaucauu

SEQ ID NO: 871576 - RNA, 21 nt, Homo sapiens
auuaaauaccuauaugaauau

SEQ ID NO: 871577 - RNA, 17 nt, Homo sapiens
auuaaaugcauguccuc

SEQ ID NO: 871578 - RNA, 18 nt, Homo sapiens
auuaaaugcauguccuca

SEQ ID NO: 871579 - RNA, 17 nt, Homo sapiens
auuaaauucacaugcag

SEQ ID NO: 871580 - RNA, 15 nt, Homo sapiens
auuaacaaaagauuc

SEQ ID NO: 871581 - RNA, 15 nt, Homo sapiens
auuaacaaaauauuc

SEQ ID NO: 871582 - RNA, 15 nt, Homo sapiens
auuaacuaugugaug

SEQ ID NO: 871583 - RNA, 14 nt, Homo sapiens
auuaagcaacacaa

SEQ ID NO: 871584 - RNA, 12 nt, Homo sapiens
auuaagugcaau

SEQ ID NO: 871585 - RNA, 13 nt, Homo sapiens
auuaagugcaauu

SEQ ID NO: 871586 - RNA, 18 nt, Homo sapiens
auuaaguucucaauguga

SEQ ID NO: 871587 - RNA, 23 nt, Homo sapiens
auuaaguuguuauuucaguuuua

SEQ ID NO: 871588 - RNA, 18 nt, Homo sapiens
auuaauauguucauuaaa

SEQ ID NO: 871589 - RNA, 17 nt, Homo sapiens
auuaaugaacugugaca

SEQ ID NO: 871590 - RNA, 15 nt, Homo sapiens
auuaauggcacugau

SEQ ID NO: 871591 - RNA, 20 nt, Homo sapiens
auuaauguguuaagugcagg

SEQ ID NO: 871592 - RNA, 14 nt, Homo sapiens
auuacaauugucau

SEQ ID NO: 871593 - RNA, 22 nt, Homo sapiens
auuacaguccguccaccaccuc

SEQ ID NO: 871594 - RNA, 20 nt, Homo sapiens
auuacaguuuggaaguguua

SEQ ID NO: 871595 - RNA, 16 nt, Homo sapiens
auuacauggcuguggu

SEQ ID NO: 871596 - RNA, 13 nt, Homo sapiens
auuacgugcaaua

SEQ ID NO: 871597 - RNA, 14 nt, Homo sapiens
auuacugauuuugu

SEQ ID NO: 871598 - RNA, 17 nt, Homo sapiens
auuacuuuaauacucac

SEQ ID NO: 871599 - RNA, 17 nt, Homo sapiens
auuagaaggcaaguuuc

SEQ ID NO: 871600 - RNA, 13 nt, Homo sapiens
auuagaaugcaug

SEQ ID NO: 871601 - RNA, 22 nt, Homo sapiens
auuagacuggaacuugaacuga

SEQ ID NO: 871602 - RNA, 13 nt, Homo sapiens
auuagaggaagaa

SEQ ID NO: 871603 - RNA, 13 nt, Homo sapiens
auuagaugaacuc

SEQ ID NO: 871604 - RNA, 16 nt, Homo sapiens
auuagaugaacucaac

SEQ ID NO: 871605 - RNA, 22 nt, Homo sapiens
auuagcauucugguuuugacau

SEQ ID NO: 871606 - RNA, 16 nt, Homo sapiens
auuagcucuggaccag

SEQ ID NO: 871607 - RNA, 13 nt, Homo sapiens
auuaggcaugccu

SEQ ID NO: 871608 - RNA, 19 nt, Homo sapiens
auuaguauucaggcacuga

SEQ ID NO: 871609 - RNA, 23 nt, Homo sapiens
auuauaaaaauaauauaugcuca

SEQ ID NO: 871610 - RNA, 15 nt, Homo sapiens
auuauaaaggccagc

SEQ ID NO: 871611 - RNA, 12 nt, Homo sapiens
auuauaacuuaa

SEQ ID NO: 871612 - RNA, 16 nt, Homo sapiens
auuauaagaugucauc

SEQ ID NO: 871613 - RNA, 17 nt, Homo sapiens
auuauaauauacuauau

SEQ ID NO: 871614 - RNA, 20 nt, Homo sapiens
auuauagaguauacuaaaaa

SEQ ID NO: 871615 - RNA, 16 nt, Homo sapiens
auuauauaguaaugca

SEQ ID NO: 871616 - RNA, 21 nt, Homo sapiens
auuaucccccaaaaugcauuu

SEQ ID NO: 871617 - RNA, 17 nt, Homo sapiens
auuaucgggagcagugu

SEQ ID NO: 871618 - RNA, 21 nt, Homo sapiens
auuaucgggagcagugucuuc

SEQ ID NO: 871619 - RNA, 18 nt, Homo sapiens
auuaugagucucuaugau

SEQ ID NO: 871620 - RNA, 11 nt, Homo sapiens
auuaugcagcu

SEQ ID NO: 871621 - RNA, 22 nt, Homo sapiens
auuaugggaaugacucugacuu

SEQ ID NO: 871622 - RNA, 17 nt, Homo sapiens
auuauguauuuuuguca

SEQ ID NO: 871623 - RNA, 14 nt, Homo sapiens
auuauuaugucuca

SEQ ID NO: 871624 - RNA, 18 nt, Homo sapiens
auuauucccuguacaaua

SEQ ID NO: 871625 - RNA, 21 nt, Homo sapiens
auuauuucaaccgcuugccau

SEQ ID NO: 871626 - RNA, 14 nt, Homo sapiens
auuauuuugcacug

SEQ ID NO: 871627 - RNA, 14 nt, Homo sapiens
auucaaacugacaa

SEQ ID NO: 871628 - RNA, 17 nt, Homo sapiens
auucaaacugccuauau

SEQ ID NO: 871629 - RNA, 13 nt, Homo sapiens
auucaaagcucua

SEQ ID NO: 871630 - RNA, 17 nt, Homo sapiens
auucaaaugggugauau

SEQ ID NO: 871631 - RNA, 18 nt, Homo sapiens
auucaacuaguaccacag

SEQ ID NO: 871632 - RNA, 15 nt, Homo sapiens
auucaagccugugaa

SEQ ID NO: 871633 - RNA, 21 nt, Homo sapiens
auucaauaaagcugcugagaa

SEQ ID NO: 871634 - RNA, 12 nt, Homo sapiens
auucacaaugaa

SEQ ID NO: 871635 - RNA, 20 nt, Homo sapiens
auucacauaguuuauuucaa

SEQ ID NO: 871636 - RNA, 19 nt, Homo sapiens
auucacauccaaugcauag

SEQ ID NO: 871637 - RNA, 12 nt, Homo sapiens
auucacaucuca

SEQ ID NO: 871638 - RNA, 22 nt, Homo sapiens
auucaccuuccagugucucgga

SEQ ID NO: 871639 - RNA, 15 nt, Homo sapiens
auucacuuuaccuuc

SEQ ID NO: 871640 - RNA, 16 nt, Homo sapiens
auucagagaauaucaa

SEQ ID NO: 871641 - RNA, 17 nt, Homo sapiens
auucagaucguauuaau

SEQ ID NO: 871642 - RNA, 17 nt, Homo sapiens
auucagcaaagaacaag

SEQ ID NO: 871643 - RNA, 16 nt, Homo sapiens
auucaggcacugagaa

SEQ ID NO: 871644 - RNA, 14 nt, Homo sapiens
auucaggugaaaau

SEQ ID NO: 871645 - RNA, 18 nt, Homo sapiens
auucagugagacacagag

SEQ ID NO: 871646 - RNA, 11 nt, Homo sapiens
auucauaacaa

SEQ ID NO: 871647 - RNA, 20 nt, Homo sapiens
auucauccaguugcaauaaa

SEQ ID NO: 871648 - RNA, 18 nt, Homo sapiens
auucaucugggaggcaga

SEQ ID NO: 871649 - RNA, 22 nt, Homo sapiens
auucaucugggaggcagaacag

SEQ ID NO: 871650 - RNA, 18 nt, Homo sapiens
auucauuagcugugauuu

SEQ ID NO: 871651 - RNA, 21 nt, Homo sapiens
auucauuuaucaccagcauau

SEQ ID NO: 871652 - RNA, 21 nt, Homo sapiens
auucauuuuaacaucugagaa

SEQ ID NO: 871653 - RNA, 21 nt, Homo sapiens
auuccacacaaaaugucacac

SEQ ID NO: 871654 - RNA, 17 nt, Homo sapiens
auuccaccugcaaucaa

SEQ ID NO: 871655 - RNA, 13 nt, Homo sapiens
auuccacuggacu

SEQ ID NO: 871656 - RNA, 13 nt, Homo sapiens
auuccagcauuug

SEQ ID NO: 871657 - RNA, 15 nt, Homo sapiens
auuccagcauuugcc

SEQ ID NO: 871658 - RNA, 23 nt, Homo sapiens
auuccauaaccccaggcauccca

SEQ ID NO: 871659 - RNA, 18 nt, Homo sapiens
auucccacagcacuaauu

SEQ ID NO: 871660 - RNA, 13 nt, Homo sapiens
auucccauucuac

SEQ ID NO: 871661 - RNA, 17 nt, Homo sapiens
auucccauuuugcaaaa

SEQ ID NO: 871662 - RNA, 17 nt, Homo sapiens
auuccccucgugugacu

SEQ ID NO: 871663 - RNA, 14 nt, Homo sapiens
auuccgucuuaaaa

SEQ ID NO: 871664 - RNA, 20 nt, Homo sapiens
auuccuaagcagugcuugua

SEQ ID NO: 871665 - RNA, 19 nt, Homo sapiens
auuccuauauaguuuauug

SEQ ID NO: 871666 - RNA, 20 nt, Homo sapiens
auuccugggcaagaaccuaa

SEQ ID NO: 871667 - RNA, 14 nt, Homo sapiens
auuccuuacuguaa

SEQ ID NO: 871668 - RNA, 20 nt, Homo sapiens
auuccuuagcuuagaccuca

SEQ ID NO: 871669 - RNA, 13 nt, Homo sapiens
auuccuucacuca

SEQ ID NO: 871670 - RNA, 16 nt, Homo sapiens
auucuaagauuguaca

SEQ ID NO: 871671 - RNA, 20 nt, Homo sapiens
auucuaaugucuucauuuca

SEQ ID NO: 871672 - RNA, 17 nt, Homo sapiens
auucuacccagagccuu

SEQ ID NO: 871673 - RNA, 15 nt, Homo sapiens
auucuagcuuucaaa

SEQ ID NO: 871674 - RNA, 17 nt, Homo sapiens
auucuaguguaacacug

SEQ ID NO: 871675 - RNA, 16 nt, Homo sapiens
auucuauuccuaucug

SEQ ID NO: 871676 - RNA, 15 nt, Homo sapiens
auucucaaccuacca

SEQ ID NO: 871677 - RNA, 21 nt, Homo sapiens
auucucaugugauccuuuuau

SEQ ID NO: 871678 - RNA, 16 nt, Homo sapiens
auucucauuugucaca

SEQ ID NO: 871679 - RNA, 15 nt, Homo sapiens
auucuccugccucag

SEQ ID NO: 871680 - RNA, 15 nt, Homo sapiens
auucucuuacugcuu

SEQ ID NO: 871681 - RNA, 16 nt, Homo sapiens
auucucuucacuccca

SEQ ID NO: 871682 - RNA, 15 nt, Homo sapiens
auucugaccauuuca

SEQ ID NO: 871683 - RNA, 22 nt, Homo sapiens
auucugccuccauucugaccau

SEQ ID NO: 871684 - RNA, 22 nt, Homo sapiens
auucugcucagauagaaugaca

SEQ ID NO: 871685 - RNA, 18 nt, Homo sapiens
cuuauucuaggucuguaa

SEQ ID NO: 871686 - RNA, 23 nt, Homo sapiens
cuuauuugagugauuauuuguua

SEQ ID NO: 871687 - RNA, 22 nt, Homo sapiens
cuuauuuuugaauugacugaga

SEQ ID NO: 871688 - RNA, 18 nt, Homo sapiens
cuucaagagccucuggca

SEQ ID NO: 871689 - RNA, 12 nt, Homo sapiens
cuucaauucaaa

SEQ ID NO: 871690 - RNA, 15 nt, Homo sapiens
cuucacccugaaugg

SEQ ID NO: 871691 - RNA, 15 nt, Homo sapiens
cuucacuaccaaaug

SEQ ID NO: 871692 - RNA, 13 nt, Homo sapiens
cuucacucuucau

SEQ ID NO: 871693 - RNA, 16 nt, Homo sapiens
cuucagagaagucagu

SEQ ID NO: 871694 - RNA, 15 nt, Homo sapiens
cuucagagacuaucu

SEQ ID NO: 871695 - RNA, 23 nt, Homo sapiens
cuucagagacuaucugauuuccu

SEQ ID NO: 871696 - RNA, 14 nt, Homo sapiens
cuucagauagaaaa

SEQ ID NO: 871697 - RNA, 13 nt, Homo sapiens
cuucagggccaga

SEQ ID NO: 871698 - RNA, 19 nt, Homo sapiens
cuucagggugagugaaugg

SEQ ID NO: 871699 - RNA, 13 nt, Homo sapiens
cuucaggugcuuu

SEQ ID NO: 871700 - RNA, 22 nt, Homo sapiens
cuucagguucuuagugucacuu

SEQ ID NO: 871701 - RNA, 16 nt, Homo sapiens
cuucaguuguuuuccc

SEQ ID NO: 871702 - RNA, 17 nt, Homo sapiens
cuucaucuggauuccag

SEQ ID NO: 871703 - RNA, 15 nt, Homo sapiens
cuucaugcaaugaca

SEQ ID NO: 871704 - RNA, 14 nt, Homo sapiens
cuucauggaacuca

SEQ ID NO: 871705 - RNA, 21 nt, Homo sapiens
cuucauggaacucagcugucu

SEQ ID NO: 871706 - RNA, 20 nt, Homo sapiens
cuucaugucacugcucuuga

SEQ ID NO: 871707 - RNA, 18 nt, Homo sapiens
cuucauuugaugcuaaau

SEQ ID NO: 871708 - RNA, 24 nt, Homo sapiens
cuucauuugaugcuaaauaggaga

SEQ ID NO: 871709 - RNA, 15 nt, Homo sapiens
cuuccacuccaagug

SEQ ID NO: 871710 - RNA, 19 nt, Homo sapiens
cuuccacuuugaguaccaa

SEQ ID NO: 871711 - RNA, 19 nt, Homo sapiens
cuuccagguaucuccagga

SEQ ID NO: 871712 - RNA, 16 nt, Homo sapiens
cuuccagugcauguug

SEQ ID NO: 871713 - RNA, 21 nt, Homo sapiens
cuuccauaauuaugacaguua

SEQ ID NO: 871714 - RNA, 24 nt, Homo sapiens
cuuccauuaacuuagcauguguug

SEQ ID NO: 871715 - RNA, 20 nt, Homo sapiens
cuucccaaucagcacugaaa

SEQ ID NO: 871716 - RNA, 16 nt, Homo sapiens
cuucccaccucagugc

SEQ ID NO: 871717 - RNA, 18 nt, Homo sapiens
cuucccagaggccaggaa

SEQ ID NO: 871718 - RNA, 15 nt, Homo sapiens
cuucccaggaucccu

SEQ ID NO: 871719 - RNA, 12 nt, Homo sapiens
cuuccccugugg

SEQ ID NO: 871720 - RNA, 13 nt, Homo sapiens
cuucccugaucaa

SEQ ID NO: 871721 - RNA, 13 nt, Homo sapiens
cuucccugcauuu

SEQ ID NO: 871722 - RNA, 14 nt, Homo sapiens
cuuccuaccaaaua

SEQ ID NO: 871723 - RNA, 20 nt, Homo sapiens
cuuccuccugauggccaaga

SEQ ID NO: 871724 - RNA, 13 nt, Homo sapiens
cuuccugccaagc

SEQ ID NO: 871725 - RNA, 22 nt, Homo sapiens
cuuccugcuuaaacuugaccca

SEQ ID NO: 871726 - RNA, 17 nt, Homo sapiens
cuuccuggcuucuuacu

SEQ ID NO: 871727 - RNA, 21 nt, Homo sapiens
cuuccuggguccuguucccua

SEQ ID NO: 871728 - RNA, 23 nt, Homo sapiens
cuuccuggguccuguucccuacc

SEQ ID NO: 871729 - RNA, 17 nt, Homo sapiens
cuuccugucaacacuuc

SEQ ID NO: 871730 - RNA, 13 nt, Homo sapiens
cuucgaugacugg

SEQ ID NO: 871731 - RNA, 21 nt, Homo sapiens
cuucgauggcauccugcagug

SEQ ID NO: 871732 - RNA, 14 nt, Homo sapiens
cuucgcugaccucg

SEQ ID NO: 871733 - RNA, 23 nt, Homo sapiens
cuucgcugccaggacaccugccc

SEQ ID NO: 871734 - RNA, 18 nt, Homo sapiens
cuucuaaaugaagugcaa

SEQ ID NO: 871735 - RNA, 11 nt, Homo sapiens
cuucuacagcc

SEQ ID NO: 871736 - RNA, 19 nt, Homo sapiens
cuucuaccuuaaaauguaa

SEQ ID NO: 871737 - RNA, 18 nt, Homo sapiens
cuucucaucauauuguau

SEQ ID NO: 871738 - RNA, 17 nt, Homo sapiens
cuucuccaaaugagauc

SEQ ID NO: 871739 - RNA, 14 nt, Homo sapiens
cuucuccacuggau

SEQ ID NO: 871740 - RNA, 13 nt, Homo sapiens
cuucucccugugu

SEQ ID NO: 871741 - RNA, 22 nt, Homo sapiens
cuucucuauaucaugcuuuaaa

SEQ ID NO: 871742 - RNA, 21 nt, Homo sapiens
cuucucucggggcgaccccuc

SEQ ID NO: 871743 - RNA, 15 nt, Homo sapiens
cuucucuuccuguaa

SEQ ID NO: 871744 - RNA, 22 nt, Homo sapiens
cuucucuugggaacuccacucu

SEQ ID NO: 871745 - RNA, 16 nt, Homo sapiens
cuucucuuugucccca

SEQ ID NO: 871746 - RNA, 19 nt, Homo sapiens
cuucugaagaucucagaua

SEQ ID NO: 871747 - RNA, 14 nt, Homo sapiens
cuucugacaagcaa

SEQ ID NO: 871748 - RNA, 17 nt, Homo sapiens
cuucugagcgagcacac

SEQ ID NO: 871749 - RNA, 18 nt, Homo sapiens
cuucugccccagcuuugc

SEQ ID NO: 871750 - RNA, 19 nt, Homo sapiens
cuucugcuguauacuguac

SEQ ID NO: 871751 - RNA, 19 nt, Homo sapiens
cuucuggaggacacacagu

SEQ ID NO: 871752 - RNA, 20 nt, Homo sapiens
cuucuggagucuccaguggu

SEQ ID NO: 871753 - RNA, 18 nt, Homo sapiens
cuucugggaacuuccuca

SEQ ID NO: 871754 - RNA, 16 nt, Homo sapiens
cuucugggaagacaac

SEQ ID NO: 871755 - RNA, 14 nt, Homo sapiens
cuucugggccucca

SEQ ID NO: 871756 - RNA, 15 nt, Homo sapiens
cuucuggguggcucc

SEQ ID NO: 871757 - RNA, 16 nt, Homo sapiens
cuucugguugcuucag

SEQ ID NO: 871758 - RNA, 15 nt, Homo sapiens
cuucugucugcagug

SEQ ID NO: 871759 - RNA, 22 nt, Homo sapiens
cuucuguucucaaaugcuaaau

SEQ ID NO: 871760 - RNA, 13 nt, Homo sapiens
cuucuguuuccau

SEQ ID NO: 871761 - RNA, 15 nt, Homo sapiens
cuucuuaaucuaaga

SEQ ID NO: 871762 - RNA, 14 nt, Homo sapiens
cuucuucuuagcac

SEQ ID NO: 871763 - RNA, 19 nt, Homo sapiens
cuucuugguuuggggagaa

SEQ ID NO: 871764 - RNA, 11 nt, Homo sapiens
cuucuugugaa

SEQ ID NO: 871765 - RNA, 17 nt, Homo sapiens
cuucuuuaggcauuaaa

SEQ ID NO: 871766 - RNA, 22 nt, Homo sapiens
cuucuuucaaaguguaagcacu

SEQ ID NO: 871767 - RNA, 19 nt, Homo sapiens
cuucuuuuauaacuagucc

SEQ ID NO: 871768 - RNA, 16 nt, Homo sapiens
cuugaaacugagaugu

SEQ ID NO: 871769 - RNA, 12 nt, Homo sapiens
cuugaaauacca

SEQ ID NO: 871770 - RNA, 13 nt, Homo sapiens
cuugaacugauuc

SEQ ID NO: 871771 - RNA, 22 nt, Homo sapiens
cuugaacugauucacaucucau

SEQ ID NO: 871772 - RNA, 22 nt, Homo sapiens
cuugaagauuagguacuaucug

SEQ ID NO: 871773 - RNA, 13 nt, Homo sapiens
cuugaagcacaga

SEQ ID NO: 871774 - RNA, 16 nt, Homo sapiens
cuugaaguaaccuuau

SEQ ID NO: 871775 - RNA, 13 nt, Homo sapiens
cuugaaucuguua

SEQ ID NO: 871776 - RNA, 19 nt, Homo sapiens
cuugaaucuguuacugaaa

SEQ ID NO: 871777 - RNA, 23 nt, Homo sapiens
cuugaauguaagaacaugaccuc

SEQ ID NO: 871778 - RNA, 19 nt, Homo sapiens
cuugaauuccugaccucag

SEQ ID NO: 871779 - RNA, 20 nt, Homo sapiens
cuugacacggugaaauccag

SEQ ID NO: 871780 - RNA, 12 nt, Homo sapiens
cuugacauuccu

SEQ ID NO: 871781 - RNA, 14 nt, Homo sapiens
cuugagucugaggc

SEQ ID NO: 871782 - RNA, 22 nt, Homo sapiens
cuugauaaugggaugaauggaa

SEQ ID NO: 871783 - RNA, 15 nt, Homo sapiens
cuugaugcaugcaca

SEQ ID NO: 871784 - RNA, 18 nt, Homo sapiens
cuugauggagauauuuac

SEQ ID NO: 871785 - RNA, 19 nt, Homo sapiens
cuugauguugcuuagucac

SEQ ID NO: 871786 - RNA, 17 nt, Homo sapiens
cuugauguuggaucuca

SEQ ID NO: 871787 - RNA, 15 nt, Homo sapiens
cuugauucacaauga

SEQ ID NO: 871788 - RNA, 15 nt, Homo sapiens
cuugauuucagguca

SEQ ID NO: 871789 - RNA, 14 nt, Homo sapiens
cuugauuuuagccu

SEQ ID NO: 871790 - RNA, 13 nt, Homo sapiens
cuugcauacagag

SEQ ID NO: 871791 - RNA, 13 nt, Homo sapiens
cuugcauucauuu

SEQ ID NO: 871792 - RNA, 12 nt, Homo sapiens
cuugccagacau

SEQ ID NO: 871793 - RNA, 21 nt, Homo sapiens
cuugccagccagaagccucug

SEQ ID NO: 871794 - RNA, 16 nt, Homo sapiens
cuugcccugaccuccc

SEQ ID NO: 871795 - RNA, 13 nt, Homo sapiens
cuugcccuuuacg

SEQ ID NO: 871796 - RNA, 15 nt, Homo sapiens
cuugccugaggcuca

SEQ ID NO: 871797 - RNA, 16 nt, Homo sapiens
cuugccuguuuuucaa

SEQ ID NO: 871798 - RNA, 14 nt, Homo sapiens
cuugcuauauugcc

SEQ ID NO: 871799 - RNA, 22 nt, Homo sapiens
cuugcuauuugagcaugcacag

SEQ ID NO: 871800 - RNA, 19 nt, Homo sapiens
cuugcugaauuucaggcau

SEQ ID NO: 871801 - RNA, 18 nt, Homo sapiens
auucugcucuuugauuca

SEQ ID NO: 871802 - RNA, 15 nt, Homo sapiens
auucuguuugucucg

SEQ ID NO: 871803 - RNA, 22 nt, Homo sapiens
auucuuaaaauauauuucagau

SEQ ID NO: 871804 - RNA, 15 nt, Homo sapiens
auucuucugccucag

SEQ ID NO: 871805 - RNA, 12 nt, Homo sapiens
auucuucuguac

SEQ ID NO: 871806 - RNA, 16 nt, Homo sapiens
auucuugaaguucaug

SEQ ID NO: 871807 - RNA, 14 nt, Homo sapiens
auucuugaaugagg

SEQ ID NO: 871808 - RNA, 11 nt, Homo sapiens
auucuuguccu

SEQ ID NO: 871809 - RNA, 24 nt, Homo sapiens
auucuuuccccucagagcucuuau

SEQ ID NO: 871810 - RNA, 14 nt, Homo sapiens
auugaaaauaugau

SEQ ID NO: 871811 - RNA, 23 nt, Homo sapiens
auugaaauauaaugcaaaccaua

SEQ ID NO: 871812 - RNA, 17 nt, Homo sapiens
auugaaaucaagcuuau

SEQ ID NO: 871813 - RNA, 12 nt, Homo sapiens
auugaacuacuu

SEQ ID NO: 871814 - RNA, 22 nt, Homo sapiens
auugaacuuucacauagcacag

SEQ ID NO: 871815 - RNA, 21 nt, Homo sapiens
auugaauguuuccaaccugga

SEQ ID NO: 871816 - RNA, 15 nt, Homo sapiens
auugacaacauuuua

SEQ ID NO: 871817 - RNA, 16 nt, Homo sapiens
auugacgccaccauaa

SEQ ID NO: 871818 - RNA, 17 nt, Homo sapiens
auugacuaucaaacuga

SEQ ID NO: 871819 - RNA, 19 nt, Homo sapiens
auugagauaauaucuguga

SEQ ID NO: 871820 - RNA, 14 nt, Homo sapiens
auugagcugcagaa

SEQ ID NO: 871821 - RNA, 20 nt, Homo sapiens
auugagugcuccugugugcu

SEQ ID NO: 871822 - RNA, 21 nt, Homo sapiens
auugagugcuccugugugcug

SEQ ID NO: 871823 - RNA, 18 nt, Homo sapiens
auugauagaguguuauca

SEQ ID NO: 871824 - RNA, 18 nt, Homo sapiens
auugaucacuuuguuaaa

SEQ ID NO: 871825 - RNA, 19 nt, Homo sapiens
auugaugccaguggaauac

SEQ ID NO: 871826 - RNA, 19 nt, Homo sapiens
auugauuauaagcauguau

SEQ ID NO: 871827 - RNA, 19 nt, Homo sapiens
auugcacuuuuaaaccucu

SEQ ID NO: 871828 - RNA, 12 nt, Homo sapiens
auugcagacuca

SEQ ID NO: 871829 - RNA, 14 nt, Homo sapiens
auugcaugccaucu

SEQ ID NO: 871830 - RNA, 18 nt, Homo sapiens
auugcaugccaucuccac

SEQ ID NO: 871831 - RNA, 17 nt, Homo sapiens
auugccuagaggugcuc

SEQ ID NO: 871832 - RNA, 16 nt, Homo sapiens
auugcgccacugcacu

SEQ ID NO: 871833 - RNA, 18 nt, Homo sapiens
auugcggggcccaccuua

SEQ ID NO: 871834 - RNA, 17 nt, Homo sapiens
auugcuacauaguccaa

SEQ ID NO: 871835 - RNA, 13 nt, Homo sapiens
auugcuaccucuu

SEQ ID NO: 871836 - RNA, 22 nt, Homo sapiens
auugcuaugaaugauacccuga

SEQ ID NO: 871837 - RNA, 13 nt, Homo sapiens
auugcugcucucu

SEQ ID NO: 871838 - RNA, 12 nt, Homo sapiens
auugcugugaau

SEQ ID NO: 871839 - RNA, 21 nt, Homo sapiens
auugcuucaauaauauuagcu

SEQ ID NO: 871840 - RNA, 19 nt, Homo sapiens
auuggaccauccuauuuaa

SEQ ID NO: 871841 - RNA, 19 nt, Homo sapiens
auuggagaguaaaaacuga

SEQ ID NO: 871842 - RNA, 23 nt, Homo sapiens
auuggccacugggucucacuccu

SEQ ID NO: 871843 - RNA, 19 nt, Homo sapiens
auuggccucaguguaguua

SEQ ID NO: 871844 - RNA, 23 nt, Homo sapiens
auugggagaagccgcagggacag

SEQ ID NO: 871845 - RNA, 22 nt, Homo sapiens
auugguccagcuugcucuucag

SEQ ID NO: 871846 - RNA, 22 nt, Homo sapiens
auuguaaacagcuaauaaugaa

SEQ ID NO: 871847 - RNA, 14 nt, Homo sapiens
auuguaaacaugug

SEQ ID NO: 871848 - RNA, 17 nt, Homo sapiens
auuguaaauuauuucau

SEQ ID NO: 871849 - RNA, 18 nt, Homo sapiens
auuguaacaauagcacaa

SEQ ID NO: 871850 - RNA, 14 nt, Homo sapiens
auuguacauucccu

SEQ ID NO: 871851 - RNA, 18 nt, Homo sapiens
auuguagaaaagcuauaa

SEQ ID NO: 871852 - RNA, 14 nt, Homo sapiens
auuguaguguucaa

SEQ ID NO: 871853 - RNA, 19 nt, Homo sapiens
auugucagaguucugcucu

SEQ ID NO: 871854 - RNA, 16 nt, Homo sapiens
auugucgucuuuaugu

SEQ ID NO: 871855 - RNA, 11 nt, Homo sapiens
auugucuucca

SEQ ID NO: 871856 - RNA, 22 nt, Homo sapiens
auuguguucucuauugcugcuc

SEQ ID NO: 871857 - RNA, 20 nt, Homo sapiens
auuguguugggaccugugau

SEQ ID NO: 871858 - RNA, 15 nt, Homo sapiens
auuguuaaaauaacu

SEQ ID NO: 871859 - RNA, 16 nt, Homo sapiens
auuguuaaaauaacua

SEQ ID NO: 871860 - RNA, 18 nt, Homo sapiens
auuguuacagguguacua

SEQ ID NO: 871861 - RNA, 16 nt, Homo sapiens
auuguucaucaugaca

SEQ ID NO: 871862 - RNA, 16 nt, Homo sapiens
auuuaaaaugagaucg

SEQ ID NO: 871863 - RNA, 21 nt, Homo sapiens
auuuaaaguuguuugugccuu

SEQ ID NO: 871864 - RNA, 13 nt, Homo sapiens
auuuaacaugacu

SEQ ID NO: 871865 - RNA, 12 nt, Homo sapiens
auuuaacuugag

SEQ ID NO: 871866 - RNA, 16 nt, Homo sapiens
auuuaagguacuuaaa

SEQ ID NO: 871867 - RNA, 20 nt, Homo sapiens
auuuacagccucacuugaau

SEQ ID NO: 871868 - RNA, 19 nt, Homo sapiens
auuuaccacagacuauuaa

SEQ ID NO: 871869 - RNA, 21 nt, Homo sapiens
auuuacugaaguuauuuauua

SEQ ID NO: 871870 - RNA, 11 nt, Homo sapiens
auuuacuuaac

SEQ ID NO: 871871 - RNA, 14 nt, Homo sapiens
auuuagauaugcaa

SEQ ID NO: 871872 - RNA, 18 nt, Homo sapiens
auuuaggaccaauaccuc

SEQ ID NO: 871873 - RNA, 17 nt, Homo sapiens
auuuagucacaccaucu

SEQ ID NO: 871874 - RNA, 12 nt, Homo sapiens
auuuagugucuu

SEQ ID NO: 871875 - RNA, 13 nt, Homo sapiens
auuuagugucuug

SEQ ID NO: 871876 - RNA, 16 nt, Homo sapiens
auuuauauauauaugu

SEQ ID NO: 871877 - RNA, 16 nt, Homo sapiens
auuuauauucaaggau

SEQ ID NO: 871878 - RNA, 23 nt, Homo sapiens
auuuaucugugcaaauccuugau

SEQ ID NO: 871879 - RNA, 12 nt, Homo sapiens
auuuaugaaggc

SEQ ID NO: 871880 - RNA, 23 nt, Homo sapiens
auuuaugaguuuuugauagcuuu

SEQ ID NO: 871881 - RNA, 22 nt, Homo sapiens
auuuaugucucagaccacuauu

SEQ ID NO: 871882 - RNA, 13 nt, Homo sapiens
auuuauguuuauu

SEQ ID NO: 871883 - RNA, 24 nt, Homo sapiens
auuuauuaguuaggugugccaaac

SEQ ID NO: 871884 - RNA, 14 nt, Homo sapiens
auuuauucauucag

SEQ ID NO: 871885 - RNA, 15 nt, Homo sapiens
auuuauucauucagu

SEQ ID NO: 871886 - RNA, 16 nt, Homo sapiens
auuuauuuaagcauca

SEQ ID NO: 871887 - RNA, 19 nt, Homo sapiens
auuucaaccgcuugccaua

SEQ ID NO: 871888 - RNA, 13 nt, Homo sapiens
auuucaaugauug

SEQ ID NO: 871889 - RNA, 14 nt, Homo sapiens
auuucacaucagcu

SEQ ID NO: 871890 - RNA, 15 nt, Homo sapiens
auuucaccaagaagu

SEQ ID NO: 871891 - RNA, 22 nt, Homo sapiens
auuucagauaaacaacaaauaa

SEQ ID NO: 871892 - RNA, 11 nt, Homo sapiens
auuucagggaa

SEQ ID NO: 871893 - RNA, 14 nt, Homo sapiens
auuucagggaaaug

SEQ ID NO: 871894 - RNA, 23 nt, Homo sapiens
auuucagguuuuguaaagaugcc

SEQ ID NO: 871895 - RNA, 20 nt, Homo sapiens
auuucauacaaaacuguuca

SEQ ID NO: 871896 - RNA, 20 nt, Homo sapiens
auuucauaccuaucaucuua

SEQ ID NO: 871897 - RNA, 21 nt, Homo sapiens
auuucauaccuaucaucuuaa

SEQ ID NO: 871898 - RNA, 13 nt, Homo sapiens
auuucaucuacua

SEQ ID NO: 871899 - RNA, 20 nt, Homo sapiens
auuucaugauuucauuucaa

SEQ ID NO: 871900 - RNA, 11 nt, Homo sapiens
auuuccagggg

SEQ ID NO: 871901 - RNA, 15 nt, Homo sapiens
auuucccacacccca

SEQ ID NO: 871902 - RNA, 14 nt, Homo sapiens
auuucccccaggga

SEQ ID NO: 871903 - RNA, 19 nt, Homo sapiens
auuucccuggaauuuaauu

SEQ ID NO: 871904 - RNA, 18 nt, Homo sapiens
auuuccugcuacacaaaa

SEQ ID NO: 871905 - RNA, 16 nt, Homo sapiens
auuucuagcagaguga

SEQ ID NO: 871906 - RNA, 19 nt, Homo sapiens
auuucuaucuugaauuuca

SEQ ID NO: 871907 - RNA, 20 nt, Homo sapiens
auuucuaucuugaauuucau

SEQ ID NO: 871908 - RNA, 12 nt, Homo sapiens
auuucuauucaa

SEQ ID NO: 871909 - RNA, 21 nt, Homo sapiens
auuucucaaaugcacaucuca

SEQ ID NO: 871910 - RNA, 21 nt, Homo sapiens
auuucugauauaacaaacuac

SEQ ID NO: 871911 - RNA, 16 nt, Homo sapiens
auuucuuauagucaau

SEQ ID NO: 871912 - RNA, 20 nt, Homo sapiens
auuugaaaacauaaucugca

SEQ ID NO: 871913 - RNA, 14 nt, Homo sapiens
auuugaaaugucau

SEQ ID NO: 871914 - RNA, 15 nt, Homo sapiens
auuugaagaagaguu

SEQ ID NO: 871915 - RNA, 16 nt, Homo sapiens
auuugaagaugggaug

SEQ ID NO: 871916 - RNA, 13 nt, Homo sapiens
cuugcugccugaa

SEQ ID NO: 871917 - RNA, 23 nt, Homo sapiens
cuugcuggacggggacuggggau

SEQ ID NO: 871918 - RNA, 12 nt, Homo sapiens
cuugcugugagc

SEQ ID NO: 871919 - RNA, 17 nt, Homo sapiens
cuugcuguuuucaucuc

SEQ ID NO: 871920 - RNA, 19 nt, Homo sapiens
cuugcuuugggcuuugcag

SEQ ID NO: 871921 - RNA, 22 nt, Homo sapiens
cuuggaaagcaucaccucaggc

SEQ ID NO: 871922 - RNA, 20 nt, Homo sapiens
cuuggaagucguuucaggac

SEQ ID NO: 871923 - RNA, 20 nt, Homo sapiens
cuuggagacaaaaucuuaaa

SEQ ID NO: 871924 - RNA, 18 nt, Homo sapiens
cuuggagagucggccaga

SEQ ID NO: 871925 - RNA, 19 nt, Homo sapiens
cuuggagagucggccagac

SEQ ID NO: 871926 - RNA, 17 nt, Homo sapiens
cuuggagcccgugcagu

SEQ ID NO: 871927 - RNA, 18 nt, Homo sapiens
cuuggagcccgugcagua

SEQ ID NO: 871928 - RNA, 18 nt, Homo sapiens
cuuggaggccaccgggac

SEQ ID NO: 871929 - RNA, 23 nt, Homo sapiens
cuuggggagaccucuacugccuu

SEQ ID NO: 871930 - RNA, 23 nt, Homo sapiens
cuugggggaggaggaacaaauaa

SEQ ID NO: 871931 - RNA, 18 nt, Homo sapiens
cuugggguucccccagac

SEQ ID NO: 871932 - RNA, 23 nt, Homo sapiens
cuuguaaaccaucgcgugcaaug

SEQ ID NO: 871933 - RNA, 15 nt, Homo sapiens
cuuguaucugaagac

SEQ ID NO: 871934 - RNA, 13 nt, Homo sapiens
cuuguaucuguag

SEQ ID NO: 871935 - RNA, 13 nt, Homo sapiens
cuugucagaauuu

SEQ ID NO: 871936 - RNA, 21 nt, Homo sapiens
cuugucagugcucggcuguaa

SEQ ID NO: 871937 - RNA, 20 nt, Homo sapiens
cuugucauggaaaauguccu

SEQ ID NO: 871938 - RNA, 15 nt, Homo sapiens
cuuguccacagucuc

SEQ ID NO: 871939 - RNA, 12 nt, Homo sapiens
cuugucucucau

SEQ ID NO: 871940 - RNA, 19 nt, Homo sapiens
cuugugaacaccuccuagc

SEQ ID NO: 871941 - RNA, 16 nt, Homo sapiens
cuugugaccauuguaa

SEQ ID NO: 871942 - RNA, 18 nt, Homo sapiens
cuugugguuuaugucauc

SEQ ID NO: 871943 - RNA, 23 nt, Homo sapiens
cuuguguguguguguugauccca

SEQ ID NO: 871944 - RNA, 15 nt, Homo sapiens
cuuguguuaugaagc

SEQ ID NO: 871945 - RNA, 14 nt, Homo sapiens
cuuguguuuuuaac

SEQ ID NO: 871946 - RNA, 15 nt, Homo sapiens
cuuguuaccuuuccc

SEQ ID NO: 871947 - RNA, 22 nt, Homo sapiens
cuuguucugucaccaauguacc

SEQ ID NO: 871948 - RNA, 14 nt, Homo sapiens
cuuguuuucuugcc

SEQ ID NO: 871949 - RNA, 20 nt, Homo sapiens
cuuuaagagagaaaucugaa

SEQ ID NO: 871950 - RNA, 20 nt, Homo sapiens
cuuuaauucucaugugaucc

SEQ ID NO: 871951 - RNA, 11 nt, Homo sapiens
cuuuaauuuca

SEQ ID NO: 871952 - RNA, 15 nt, Homo sapiens
cuuuacaaauauguc

SEQ ID NO: 871953 - RNA, 12 nt, Homo sapiens
cuuuacaauaaa

SEQ ID NO: 871954 - RNA, 21 nt, Homo sapiens
cuuuacaaucugcacuuuaac

SEQ ID NO: 871955 - RNA, 18 nt, Homo sapiens
cuuuaccugagaccaguu

SEQ ID NO: 871956 - RNA, 18 nt, Homo sapiens
cuuuacuguuagucauuu

SEQ ID NO: 871957 - RNA, 11 nt, Homo sapiens
cuuuacuugac

SEQ ID NO: 871958 - RNA, 15 nt, Homo sapiens
cuuuagcgcccaguu

SEQ ID NO: 871959 - RNA, 21 nt, Homo sapiens
cuuuagcuaccucacuaugcu

SEQ ID NO: 871960 - RNA, 14 nt, Homo sapiens
cuuuaggcauuaaa

SEQ ID NO: 871961 - RNA, 16 nt, Homo sapiens
cuuuaggugccuccug

SEQ ID NO: 871962 - RNA, 22 nt, Homo sapiens
cuuuaucaaaaaguacaauaau

SEQ ID NO: 871963 - RNA, 12 nt, Homo sapiens
cuuuaucaaaga

SEQ ID NO: 871964 - RNA, 17 nt, Homo sapiens
cuuuaucuugacauuca

SEQ ID NO: 871965 - RNA, 19 nt, Homo sapiens
cuuuauguuacuacaugca

SEQ ID NO: 871966 - RNA, 15 nt, Homo sapiens
cuuuauugcugugaa

SEQ ID NO: 871967 - RNA, 19 nt, Homo sapiens
cuuucaaaguguaagcacu

SEQ ID NO: 871968 - RNA, 17 nt, Homo sapiens
cuuucacauagcacaga

SEQ ID NO: 871969 - RNA, 19 nt, Homo sapiens
cuuucaccacaugugcaca

SEQ ID NO: 871970 - RNA, 15 nt, Homo sapiens
cuuucaccaguuucu

SEQ ID NO: 871971 - RNA, 14 nt, Homo sapiens
cuuucacucaggcu

SEQ ID NO: 871972 - RNA, 14 nt, Homo sapiens
cuuucagcauuagg

SEQ ID NO: 871973 - RNA, 13 nt, Homo sapiens
cuuucagcuguga

SEQ ID NO: 871974 - RNA, 18 nt, Homo sapiens
cuuucaugaacacagccu

SEQ ID NO: 871975 - RNA, 21 nt, Homo sapiens
cuuucaugaguuucccagaga

SEQ ID NO: 871976 - RNA, 19 nt, Homo sapiens
cuuuccccaccucuuccuu

SEQ ID NO: 871977 - RNA, 14 nt, Homo sapiens
cuuuccccagugug

SEQ ID NO: 871978 - RNA, 20 nt, Homo sapiens
cuuuccugggggaugugcac

SEQ ID NO: 871979 - RNA, 18 nt, Homo sapiens
cuuuccuguuccagagag

SEQ ID NO: 871980 - RNA, 20 nt, Homo sapiens
cuuucgagguggguuuguac

SEQ ID NO: 871981 - RNA, 15 nt, Homo sapiens
cuuucuacaccuguu

SEQ ID NO: 871982 - RNA, 14 nt, Homo sapiens
cuuucuacccagcg

SEQ ID NO: 871983 - RNA, 15 nt, Homo sapiens
cuuucucuggcucca

SEQ ID NO: 871984 - RNA, 22 nt, Homo sapiens
cuuucugacaagauaaaggaag

SEQ ID NO: 871985 - RNA, 23 nt, Homo sapiens
cuuucuggaccagauccuacucu

SEQ ID NO: 871986 - RNA, 21 nt, Homo sapiens
cuuucuguggagagugagaau

SEQ ID NO: 871987 - RNA, 22 nt, Homo sapiens
cuuucuuacauuagcaguuugc

SEQ ID NO: 871988 - RNA, 19 nt, Homo sapiens
cuuucuuauuuuguaauaa

SEQ ID NO: 871989 - RNA, 18 nt, Homo sapiens
cuuucuuucuaacuccag

SEQ ID NO: 871990 - RNA, 17 nt, Homo sapiens
cuuugaauuucccaguc

SEQ ID NO: 871991 - RNA, 17 nt, Homo sapiens
cuuugacucaccuguua

SEQ ID NO: 871992 - RNA, 19 nt, Homo sapiens
cuuugacucaccuguuacu

SEQ ID NO: 871993 - RNA, 22 nt, Homo sapiens
cuuugacuuggggagaccucua

SEQ ID NO: 871994 - RNA, 16 nt, Homo sapiens
cuuugagaacaaugga

SEQ ID NO: 871995 - RNA, 22 nt, Homo sapiens
cuuugaggugucucaaucugau

SEQ ID NO: 871996 - RNA, 13 nt, Homo sapiens
cuuugauuuccaa

SEQ ID NO: 871997 - RNA, 19 nt, Homo sapiens
cuuugccagaaagcauaaa

SEQ ID NO: 871998 - RNA, 17 nt, Homo sapiens
cuuugcugucuggugua

SEQ ID NO: 871999 - RNA, 14 nt, Homo sapiens
cuuuggccauucca

SEQ ID NO: 872000 - RNA, 18 nt, Homo sapiens
cuuuguacuuugugcaaa

SEQ ID NO: 872001 - RNA, 13 nt, Homo sapiens
cuuugugccuuug

SEQ ID NO: 872002 - RNA, 14 nt, Homo sapiens
cuuugugccuuuga

SEQ ID NO: 872003 - RNA, 16 nt, Homo sapiens
cuuugugugauugaau

SEQ ID NO: 872004 - RNA, 17 nt, Homo sapiens
cuuuguuuugcacugac

SEQ ID NO: 872005 - RNA, 19 nt, Homo sapiens
cuuuguuuuuuaauguugu

SEQ ID NO: 872006 - RNA, 19 nt, Homo sapiens
cuuuuaaugccuuccacau

SEQ ID NO: 872007 - RNA, 22 nt, Homo sapiens
cuuuuaauguauuuguuugcaa

SEQ ID NO: 872008 - RNA, 15 nt, Homo sapiens
cuuuuacagcucuug

SEQ ID NO: 872009 - RNA, 22 nt, Homo sapiens
cuuuuaggauguaacuuuauaa

SEQ ID NO: 872010 - RNA, 19 nt, Homo sapiens
cuuuuauccacuuaccuag

SEQ ID NO: 872011 - RNA, 23 nt, Homo sapiens
cuuuucacugcuggcugccuuag

SEQ ID NO: 872012 - RNA, 17 nt, Homo sapiens
cuuuucagcagagucua

SEQ ID NO: 872013 - RNA, 21 nt, Homo sapiens
cuuuucaguguuuuuucacuu

SEQ ID NO: 872014 - RNA, 15 nt, Homo sapiens
cuuuucauaaccuag

SEQ ID NO: 872015 - RNA, 18 nt, Homo sapiens
cuuuucauaaccuagccu

SEQ ID NO: 872016 - RNA, 17 nt, Homo sapiens
cuuuucaucuaauguga

SEQ ID NO: 872017 - RNA, 14 nt, Homo sapiens
cuuuucaucuccag

SEQ ID NO: 872018 - RNA, 18 nt, Homo sapiens
cuuuucaucuccagugug

SEQ ID NO: 872019 - RNA, 19 nt, Homo sapiens
cuuuuccacuccuauggaa

SEQ ID NO: 872020 - RNA, 17 nt, Homo sapiens
cuuuuccauugcuuauu

SEQ ID NO: 872021 - RNA, 20 nt, Homo sapiens
cuuuucuuauauaagacaag

SEQ ID NO: 872022 - RNA, 16 nt, Homo sapiens
cuuuugaaaagcuuuu

SEQ ID NO: 872023 - RNA, 15 nt, Homo sapiens
cuuuugaccaaauaa

SEQ ID NO: 872024 - RNA, 21 nt, Homo sapiens
cuuuugaggggcugacuucaa

SEQ ID NO: 872025 - RNA, 12 nt, Homo sapiens
cuuuuguaccag

SEQ ID NO: 872026 - RNA, 18 nt, Homo sapiens
cuuuugucucacacagca

SEQ ID NO: 872027 - RNA, 20 nt, Homo sapiens
cuuuuucaaaaaacauuaaa

SEQ ID NO: 872028 - RNA, 14 nt, Homo sapiens
cuuuuucacacuga

SEQ ID NO: 872029 - RNA, 12 nt, Homo sapiens
cuuuuuccagag

SEQ ID NO: 872030 - RNA, 13 nt, Homo sapiens
cuuuuucuggaaa

SEQ ID NO: 872031 - RNA, 16 nt, Homo sapiens
auuugacucaugaacu

SEQ ID NO: 872032 - RNA, 17 nt, Homo sapiens
auuugacucaugaacua

SEQ ID NO: 872033 - RNA, 15 nt, Homo sapiens
auuugauaguauugu

SEQ ID NO: 872034 - RNA, 15 nt, Homo sapiens
auuugauuuugccca

SEQ ID NO: 872035 - RNA, 11 nt, Homo sapiens
auuugcacuau

SEQ ID NO: 872036 - RNA, 15 nt, Homo sapiens
auuuggccugcacua

SEQ ID NO: 872037 - RNA, 17 nt, Homo sapiens
auuuguacaaauacugc

SEQ ID NO: 872038 - RNA, 14 nt, Homo sapiens
auuuguauuugcca

SEQ ID NO: 872039 - RNA, 15 nt, Homo sapiens
auuuguucagugacu

SEQ ID NO: 872040 - RNA, 17 nt, Homo sapiens
auuuguugagaguguga

SEQ ID NO: 872041 - RNA, 17 nt, Homo sapiens
auuuuaaaacagaagaa

SEQ ID NO: 872042 - RNA, 16 nt, Homo sapiens
auuuuaaaacauaaga

SEQ ID NO: 872043 - RNA, 22 nt, Homo sapiens
auuuuaacuuccuuggacucau

SEQ ID NO: 872044 - RNA, 23 nt, Homo sapiens
auuuuaccugggauaugacaagc

SEQ ID NO: 872045 - RNA, 21 nt, Homo sapiens
auuuuaggcagggauuugagg

SEQ ID NO: 872046 - RNA, 15 nt, Homo sapiens
auuuuagugcuugcc

SEQ ID NO: 872047 - RNA, 23 nt, Homo sapiens
auuuuauaugaaauguuucacua

SEQ ID NO: 872048 - RNA, 19 nt, Homo sapiens
auuuuaucugccuuagaca

SEQ ID NO: 872049 - RNA, 18 nt, Homo sapiens
auuuuauucccuuucaca

SEQ ID NO: 872050 - RNA, 18 nt, Homo sapiens
auuuucaaauucuacuga

SEQ ID NO: 872051 - RNA, 19 nt, Homo sapiens
auuuucaacauaacugaag

SEQ ID NO: 872052 - RNA, 19 nt, Homo sapiens
auuuucaagaaacugagga

SEQ ID NO: 872053 - RNA, 22 nt, Homo sapiens
auuuucacaggugugguguaau

SEQ ID NO: 872054 - RNA, 21 nt, Homo sapiens
auuuucagagugacacccaag

SEQ ID NO: 872055 - RNA, 15 nt, Homo sapiens
auuuucagguuucuu

SEQ ID NO: 872056 - RNA, 12 nt, Homo sapiens
auuuucaguaua

SEQ ID NO: 872057 - RNA, 22 nt, Homo sapiens
auuuucauguucuugcagucau

SEQ ID NO: 872058 - RNA, 15 nt, Homo sapiens
auuuucauuuaacua

SEQ ID NO: 872059 - RNA, 18 nt, Homo sapiens
auuuucauuuaacuacaa

SEQ ID NO: 872060 - RNA, 16 nt, Homo sapiens
auuuuccuccaggcaa

SEQ ID NO: 872061 - RNA, 20 nt, Homo sapiens
auuuuccugaauauuaaucc

SEQ ID NO: 872062 - RNA, 18 nt, Homo sapiens
auuuuccugcauaaucau

SEQ ID NO: 872063 - RNA, 15 nt, Homo sapiens
auuuucuagacuuuc

SEQ ID NO: 872064 - RNA, 12 nt, Homo sapiens
auuuucuauuca

SEQ ID NO: 872065 - RNA, 23 nt, Homo sapiens
auuuucuuucuuuuucuggaaau

SEQ ID NO: 872066 - RNA, 14 nt, Homo sapiens
auuuucuuuuccau

SEQ ID NO: 872067 - RNA, 22 nt, Homo sapiens
auuuugaaauaaacagguaaua

SEQ ID NO: 872068 - RNA, 18 nt, Homo sapiens
auuuugagucucaggccc

SEQ ID NO: 872069 - RNA, 13 nt, Homo sapiens
auuuugcacuguu

SEQ ID NO: 872070 - RNA, 23 nt, Homo sapiens
auuuugcauugugugagcuucua

SEQ ID NO: 872071 - RNA, 15 nt, Homo sapiens
auuuuggccaaagug

SEQ ID NO: 872072 - RNA, 18 nt, Homo sapiens
auuuugggguaagacuuu

SEQ ID NO: 872073 - RNA, 23 nt, Homo sapiens
auuuuggugaccaauacuacugu

SEQ ID NO: 872074 - RNA, 22 nt, Homo sapiens
auuuugguuucuuccuuuccuc

SEQ ID NO: 872075 - RNA, 19 nt, Homo sapiens
auuuuguaacgaagacaca

SEQ ID NO: 872076 - RNA, 21 nt, Homo sapiens
auuuuguauuuuuuccuguaa

SEQ ID NO: 872077 - RNA, 19 nt, Homo sapiens
auuuugucaaaucauggcc

SEQ ID NO: 872078 - RNA, 15 nt, Homo sapiens
auuuuguuacacuaa

SEQ ID NO: 872079 - RNA, 16 nt, Homo sapiens
auuuuuacacauguau

SEQ ID NO: 872080 - RNA, 13 nt, Homo sapiens
auuuuuauuaaau

SEQ ID NO: 872081 - RNA, 22 nt, Homo sapiens
auuuuugucgaguuuacuucau

SEQ ID NO: 872082 - RNA, 18 nt, Homo sapiens
auuuuuuuauacuaccaa

SEQ ID NO: 872083 - RNA, 15 nt, Homo sapiens
auuuuuuugagacag

SEQ ID NO: 872084 - RNA, 22 nt, Homo sapiens
auuuuuuuuuuaaaacuaucca

SEQ ID NO: 872085 - RNA, 14 nt, Homo sapiens
caaaaaacuuuuaa

SEQ ID NO: 872086 - RNA, 18 nt, Homo sapiens
caaaaaaguuguuaacua

SEQ ID NO: 872087 - RNA, 14 nt, Homo sapiens
caaaaaaucuucca

SEQ ID NO: 872088 - RNA, 20 nt, Homo sapiens
caaaaauauaaccauuacau

SEQ ID NO: 872089 - RNA, 21 nt, Homo sapiens
caaaaaugaaagcaugucuca

SEQ ID NO: 872090 - RNA, 23 nt, Homo sapiens
caaaaaugaaagcaugucucaau

SEQ ID NO: 872091 - RNA, 12 nt, Homo sapiens
caaaaauguaau

SEQ ID NO: 872092 - RNA, 13 nt, Homo sapiens
caaaacacugugu

SEQ ID NO: 872093 - RNA, 16 nt, Homo sapiens
caaaacagagauguga

SEQ ID NO: 872094 - RNA, 18 nt, Homo sapiens
caaaacagauuguuugca

SEQ ID NO: 872095 - RNA, 14 nt, Homo sapiens
caaaacauugugcc

SEQ ID NO: 872096 - RNA, 12 nt, Homo sapiens
caaaaccagcug

SEQ ID NO: 872097 - RNA, 19 nt, Homo sapiens
caaaacgcaaaacccagua

SEQ ID NO: 872098 - RNA, 15 nt, Homo sapiens
caaaacuaauuuccu

SEQ ID NO: 872099 - RNA, 14 nt, Homo sapiens
caaaacugcuaaau

SEQ ID NO: 872100 - RNA, 13 nt, Homo sapiens
caaaagaagacaa

SEQ ID NO: 872101 - RNA, 18 nt, Homo sapiens
caaaagaugccauucaua

SEQ ID NO: 872102 - RNA, 12 nt, Homo sapiens
caaaagccaaaa

SEQ ID NO: 872103 - RNA, 21 nt, Homo sapiens
caaaagcccaauguaaugcau

SEQ ID NO: 872104 - RNA, 20 nt, Homo sapiens
caaaagcuuauucaucuguu

SEQ ID NO: 872105 - RNA, 23 nt, Homo sapiens
caaaaguauuuaacgacccaguc

SEQ ID NO: 872106 - RNA, 22 nt, Homo sapiens
caaaaucaauuuuuugcuaaac

SEQ ID NO: 872107 - RNA, 18 nt, Homo sapiens
caaaauggaagguuggag

SEQ ID NO: 872108 - RNA, 22 nt, Homo sapiens
caaaauuucaaaagugaucugu

SEQ ID NO: 872109 - RNA, 23 nt, Homo sapiens
caaacaaaacgcaaaacccagua

SEQ ID NO: 872110 - RNA, 19 nt, Homo sapiens
caaacaaaaucauggagcu

SEQ ID NO: 872111 - RNA, 18 nt, Homo sapiens
caaacaaugccaucacug

SEQ ID NO: 872112 - RNA, 16 nt, Homo sapiens
caaacacacuguaaau

SEQ ID NO: 872113 - RNA, 15 nt, Homo sapiens
caaacacccaugccc

SEQ ID NO: 872114 - RNA, 12 nt, Homo sapiens
caaacagaacua

SEQ ID NO: 872115 - RNA, 17 nt, Homo sapiens
caaacagaacuauggaa

SEQ ID NO: 872116 - RNA, 14 nt, Homo sapiens
caaacauaaagaga

SEQ ID NO: 872117 - RNA, 15 nt, Homo sapiens
caaacaugaagugug

SEQ ID NO: 872118 - RNA, 19 nt, Homo sapiens
caaaccaagagccaaaaau

SEQ ID NO: 872119 - RNA, 15 nt, Homo sapiens
caaaccuuacuaugg

SEQ ID NO: 872120 - RNA, 17 nt, Homo sapiens
caaaccuuacuauggaa

SEQ ID NO: 872121 - RNA, 19 nt, Homo sapiens
caaacguuuugaacuaaua

SEQ ID NO: 872122 - RNA, 18 nt, Homo sapiens
caaacucacugcucaaga

SEQ ID NO: 872123 - RNA, 20 nt, Homo sapiens
caaacucucccccaaaugua

SEQ ID NO: 872124 - RNA, 17 nt, Homo sapiens
caaacugacaaccugug

SEQ ID NO: 872125 - RNA, 22 nt, Homo sapiens
caaacugccuauauugauaaaa

SEQ ID NO: 872126 - RNA, 17 nt, Homo sapiens
caaagaagaaguuuaaa

SEQ ID NO: 872127 - RNA, 13 nt, Homo sapiens
caaagcaaagcca

SEQ ID NO: 872128 - RNA, 15 nt, Homo sapiens
caaagcaagcauuca

SEQ ID NO: 872129 - RNA, 20 nt, Homo sapiens
caaagcacuguuucucucac

SEQ ID NO: 872130 - RNA, 21 nt, Homo sapiens
caaagcaggguucugaggcaa

SEQ ID NO: 872131 - RNA, 21 nt, Homo sapiens
caaagcuuaaaugccuccuuc

SEQ ID NO: 872132 - RNA, 16 nt, Homo sapiens
caaaggaaaccaaagg

SEQ ID NO: 872133 - RNA, 15 nt, Homo sapiens
caaaggaaucagcug

SEQ ID NO: 872134 - RNA, 16 nt, Homo sapiens
caaaggcucuacacau

SEQ ID NO: 872135 - RNA, 20 nt, Homo sapiens
caaagggaaggcugcugugu

SEQ ID NO: 872136 - RNA, 14 nt, Homo sapiens
caaaguauuugcug

SEQ ID NO: 872137 - RNA, 17 nt, Homo sapiens
caaaguuuugaagucau

SEQ ID NO: 872138 - RNA, 16 nt, Homo sapiens
caaauaaauucauaca

SEQ ID NO: 872139 - RNA, 22 nt, Homo sapiens
caaauaagcaucuguguaaccu

SEQ ID NO: 872140 - RNA, 18 nt, Homo sapiens
caaauaaugaacagcaga

SEQ ID NO: 872141 - RNA, 16 nt, Homo sapiens
caaauauuaccaaaaa

SEQ ID NO: 872142 - RNA, 22 nt, Homo sapiens
caaaucaguccuuugauuccau

SEQ ID NO: 872143 - RNA, 18 nt, Homo sapiens
caaaucuuaacuugaagg

SEQ ID NO: 872144 - RNA, 16 nt, Homo sapiens
caaaucuucaaggugu

SEQ ID NO: 872145 - RNA, 17 nt, Homo sapiens
caaaugacaugcacuga

SEQ ID NO: 872146 - RNA, 19 nt, Homo sapiens
cuuuuuuccaccugccaau

SEQ ID NO: 872147 - RNA, 20 nt, Homo sapiens
cuuuuuuguggugucuagca

SEQ ID NO: 872148 - RNA, 22 nt, Homo sapiens
cuuuuuuuauaucagaaugagg

SEQ ID NO: 872149 - RNA, 13 nt, Homo sapiens
gaaaaaccaauga

SEQ ID NO: 872150 - RNA, 16 nt, Homo sapiens
gaaaaacuuuguuaua

SEQ ID NO: 872151 - RNA, 17 nt, Homo sapiens
gaaaaaggccucugucc

SEQ ID NO: 872152 - RNA, 18 nt, Homo sapiens
gaaaaaguugcagucuca

SEQ ID NO: 872153 - RNA, 20 nt, Homo sapiens
gaaaaaugggaacaaggcaa

SEQ ID NO: 872154 - RNA, 14 nt, Homo sapiens
gaaaacaaacccag

SEQ ID NO: 872155 - RNA, 16 nt, Homo sapiens
gaaaacaugacuuuau

SEQ ID NO: 872156 - RNA, 21 nt, Homo sapiens
gaaaacauuccaaaacuuuaa

SEQ ID NO: 872157 - RNA, 17 nt, Homo sapiens
gaaaaccauuaccugac

SEQ ID NO: 872158 - RNA, 16 nt, Homo sapiens
gaaaaccucacuugaa

SEQ ID NO: 872159 - RNA, 23 nt, Homo sapiens
gaaaacugccuuuuaucugccca

SEQ ID NO: 872160 - RNA, 19 nt, Homo sapiens
gaaaacuggaaaucuggau

SEQ ID NO: 872161 - RNA, 15 nt, Homo sapiens
gaaaacuuauuugag

SEQ ID NO: 872162 - RNA, 21 nt, Homo sapiens
gaaaagaaaccagagucaaau

SEQ ID NO: 872163 - RNA, 13 nt, Homo sapiens
gaaaagcacuuua

SEQ ID NO: 872164 - RNA, 12 nt, Homo sapiens
gaaaaguguuau

SEQ ID NO: 872165 - RNA, 16 nt, Homo sapiens
gaaaaguuaugagggu

SEQ ID NO: 872166 - RNA, 22 nt, Homo sapiens
gaaaaguuaugagggucagggc

SEQ ID NO: 872167 - RNA, 16 nt, Homo sapiens
gaaaauaaaguguaua

SEQ ID NO: 872168 - RNA, 15 nt, Homo sapiens
gaaaauaauagccau

SEQ ID NO: 872169 - RNA, 18 nt, Homo sapiens
gaaaauacauaagaccau

SEQ ID NO: 872170 - RNA, 20 nt, Homo sapiens
gaaaauauauuuaauaccuu

SEQ ID NO: 872171 - RNA, 19 nt, Homo sapiens
gaaaaucaaccagcaggaa

SEQ ID NO: 872172 - RNA, 11 nt, Homo sapiens
gaaaaugucag

SEQ ID NO: 872173 - RNA, 14 nt, Homo sapiens
gaaaauguccuccc

SEQ ID NO: 872174 - RNA, 12 nt, Homo sapiens
gaaaauguucau

SEQ ID NO: 872175 - RNA, 14 nt, Homo sapiens
gaaaauuauaucuc

SEQ ID NO: 872176 - RNA, 20 nt, Homo sapiens
gaaaauucaaaaaguguuua

SEQ ID NO: 872177 - RNA, 21 nt, Homo sapiens
gaaaauucuguagguucugug

SEQ ID NO: 872178 - RNA, 18 nt, Homo sapiens
gaaacaaaaaaguguucc

SEQ ID NO: 872179 - RNA, 20 nt, Homo sapiens
gaaacaaauaagaccauaaa

SEQ ID NO: 872180 - RNA, 19 nt, Homo sapiens
gaaacaagcaacagaugga

SEQ ID NO: 872181 - RNA, 22 nt, Homo sapiens
gaaacacaaaccacaacugaca

SEQ ID NO: 872182 - RNA, 18 nt, Homo sapiens
gaaacacacaggccauuu

SEQ ID NO: 872183 - RNA, 22 nt, Homo sapiens
gaaacagaggcgucucacauuu

SEQ ID NO: 872184 - RNA, 19 nt, Homo sapiens
gaaacaugacacugaccuu

SEQ ID NO: 872185 - RNA, 17 nt, Homo sapiens
gaaacauuaugccuuaa

SEQ ID NO: 872186 - RNA, 16 nt, Homo sapiens
gaaacauuccgaagag

SEQ ID NO: 872187 - RNA, 11 nt, Homo sapiens
gaaacauuuac

SEQ ID NO: 872188 - RNA, 23 nt, Homo sapiens
gaaaccagaaggauauuuacuac

SEQ ID NO: 872189 - RNA, 15 nt, Homo sapiens
gaaaccagagucaaa

SEQ ID NO: 872190 - RNA, 20 nt, Homo sapiens
gaaaccaguuaagaauggaa

SEQ ID NO: 872191 - RNA, 12 nt, Homo sapiens
gaaaccuugcag

SEQ ID NO: 872192 - RNA, 17 nt, Homo sapiens
gaaaccuugcagcauuu

SEQ ID NO: 872193 - RNA, 21 nt, Homo sapiens
gaaacugaggccauuauuuca

SEQ ID NO: 872194 - RNA, 16 nt, Homo sapiens
gaaacuguaaauaugu

SEQ ID NO: 872195 - RNA, 16 nt, Homo sapiens
gaaagaaaaauaccau

SEQ ID NO: 872196 - RNA, 18 nt, Homo sapiens
gaaagaaagcaccuguuu

SEQ ID NO: 872197 - RNA, 17 nt, Homo sapiens
gagcuugauccagaccu

SEQ ID NO: 872198 - RNA, 16 nt, Homo sapiens
gagcuugcaagaagca

SEQ ID NO: 872199 - RNA, 21 nt, Homo sapiens
gagcuuggacagucugagcug

SEQ ID NO: 872200 - RNA, 17 nt, Homo sapiens
gagcuuuaguccuagag

SEQ ID NO: 872201 - RNA, 23 nt, Homo sapiens
gaggaaaaacgaucgcugugaaa

SEQ ID NO: 872202 - RNA, 21 nt, Homo sapiens
gaggaagaggaggaagguugg

SEQ ID NO: 872203 - RNA, 17 nt, Homo sapiens
gaggacacacagucuca

SEQ ID NO: 872204 - RNA, 22 nt, Homo sapiens
gaggacacaguuucuauuguaa

SEQ ID NO: 872205 - RNA, 18 nt, Homo sapiens
gaggacacuaaccacgcu

SEQ ID NO: 872206 - RNA, 13 nt, Homo sapiens
gaggacucaaggg

SEQ ID NO: 872207 - RNA, 14 nt, Homo sapiens
gaggagaaacugag

SEQ ID NO: 872208 - RNA, 14 nt, Homo sapiens
gaggagaucagggc

SEQ ID NO: 872209 - RNA, 19 nt, Homo sapiens
gaggagcuuccagugcaug

SEQ ID NO: 872210 - RNA, 22 nt, Homo sapiens
gaggagggaugcugccugaguc

SEQ ID NO: 872211 - RNA, 18 nt, Homo sapiens
gaggagggcgugacucac

SEQ ID NO: 872212 - RNA, 11 nt, Homo sapiens
gaggauaucau

SEQ ID NO: 872213 - RNA, 15 nt, Homo sapiens
gaggaucacagugac

SEQ ID NO: 872214 - RNA, 19 nt, Homo sapiens
gaggaugguuugagcucag

SEQ ID NO: 872215 - RNA, 14 nt, Homo sapiens
gaggcaagaaccag

SEQ ID NO: 872216 - RNA, 20 nt, Homo sapiens
gaggcaagagaauugcuuga

SEQ ID NO: 872217 - RNA, 22 nt, Homo sapiens
gaggcagaccauccaccaggcc

SEQ ID NO: 872218 - RNA, 22 nt, Homo sapiens
gaggcagccccauucugccugc

SEQ ID NO: 872219 - RNA, 21 nt, Homo sapiens
gaggcaggaggaucacaguga

SEQ ID NO: 872220 - RNA, 21 nt, Homo sapiens
gaggcauuugcagcugugcca

SEQ ID NO: 872221 - RNA, 17 nt, Homo sapiens
gaggccgggcgcagugg

SEQ ID NO: 872222 - RNA, 20 nt, Homo sapiens
gaggccugcccucagggauc

SEQ ID NO: 872223 - RNA, 21 nt, Homo sapiens
gaggccuuacuuaaacccagc

SEQ ID NO: 872224 - RNA, 21 nt, Homo sapiens
gaggcgcagcccgaagcccag

SEQ ID NO: 872225 - RNA, 13 nt, Homo sapiens
gaggcuagcaaag

SEQ ID NO: 872226 - RNA, 15 nt, Homo sapiens
gaggcucagccacac

SEQ ID NO: 872227 - RNA, 17 nt, Homo sapiens
gaggcucagccacacag

SEQ ID NO: 872228 - RNA, 18 nt, Homo sapiens
gaggcugagacaggagaa

SEQ ID NO: 872229 - RNA, 16 nt, Homo sapiens
gaggcugagcuggauc

SEQ ID NO: 872230 - RNA, 16 nt, Homo sapiens
gaggcugaggcaagag

SEQ ID NO: 872231 - RNA, 16 nt, Homo sapiens
gaggcugcagaaggcc

SEQ ID NO: 872232 - RNA, 16 nt, Homo sapiens
gaggcugcaugcucug

SEQ ID NO: 872233 - RNA, 20 nt, Homo sapiens
gaggcugggccccugggaug

SEQ ID NO: 872234 - RNA, 20 nt, Homo sapiens
gagggaaaguaaauauuuca

SEQ ID NO: 872235 - RNA, 14 nt, Homo sapiens
gagggagugacaga

SEQ ID NO: 872236 - RNA, 21 nt, Homo sapiens
gagggaugccacccagcaaca

SEQ ID NO: 872237 - RNA, 14 nt, Homo sapiens
gagggcaaacccaa

SEQ ID NO: 872238 - RNA, 20 nt, Homo sapiens
gagggcucacucggcuucca

SEQ ID NO: 872239 - RNA, 19 nt, Homo sapiens
gagggcugggggcugaccc

SEQ ID NO: 872240 - RNA, 23 nt, Homo sapiens
gaggggaaacgcaaaaccugcag

SEQ ID NO: 872241 - RNA, 15 nt, Homo sapiens
gaggggaagggccag

SEQ ID NO: 872242 - RNA, 21 nt, Homo sapiens
gaggggacuauuuaugaaggc

SEQ ID NO: 872243 - RNA, 20 nt, Homo sapiens
gagggggccuucacagugac

SEQ ID NO: 872244 - RNA, 19 nt, Homo sapiens
gaggguaaauaugacuccu

SEQ ID NO: 872245 - RNA, 18 nt, Homo sapiens
gagggugggguaaccaaa

SEQ ID NO: 872246 - RNA, 21 nt, Homo sapiens
gagguaaaagugugagcagug

SEQ ID NO: 872247 - RNA, 22 nt, Homo sapiens
gagguaccagcaauauguaaau

SEQ ID NO: 872248 - RNA, 14 nt, Homo sapiens
gagguccugaucag

SEQ ID NO: 872249 - RNA, 22 nt, Homo sapiens
gaggucuccaucauggcaguga

SEQ ID NO: 872250 - RNA, 14 nt, Homo sapiens
gaggugagaccaaa

SEQ ID NO: 872251 - RNA, 16 nt, Homo sapiens
gaggugagaccaccuc

SEQ ID NO: 872252 - RNA, 19 nt, Homo sapiens
gaggugagagaagaccucu

SEQ ID NO: 872253 - RNA, 18 nt, Homo sapiens
gagguggagguugcagug

SEQ ID NO: 872254 - RNA, 19 nt, Homo sapiens
gagguggagguugcaguga

SEQ ID NO: 872255 - RNA, 19 nt, Homo sapiens
gaggugggcagcagcucag

SEQ ID NO: 872256 - RNA, 17 nt, Homo sapiens
gaggugguagaaccacu

SEQ ID NO: 872257 - RNA, 17 nt, Homo sapiens
gagguggugccuucuca

SEQ ID NO: 872258 - RNA, 16 nt, Homo sapiens
gaggugucuuaagccu

SEQ ID NO: 872259 - RNA, 18 nt, Homo sapiens
gagguugcagugagccau

SEQ ID NO: 872260 - RNA, 19 nt, Homo sapiens
gaguaacaugccagcuucc

SEQ ID NO: 872261 - RNA, 23 nt, Homo sapiens
gaguacagauguaaaugccacaa

SEQ ID NO: 872262 - RNA, 21 nt, Homo sapiens
cagaauguauauuaaggugug

SEQ ID NO: 872263 - RNA, 11 nt, Homo sapiens
cagaaugucac

SEQ ID NO: 872264 - RNA, 14 nt, Homo sapiens
cagaauugugcaaa

SEQ ID NO: 872265 - RNA, 16 nt, Homo sapiens
cagacaacagaaguca

SEQ ID NO: 872266 - RNA, 18 nt, Homo sapiens
cagacagcaggcuggagc

SEQ ID NO: 872267 - RNA, 17 nt, Homo sapiens
cagaccaguacugggaa

SEQ ID NO: 872268 - RNA, 18 nt, Homo sapiens
cagaccuuuuauccacuu

SEQ ID NO: 872269 - RNA, 17 nt, Homo sapiens
cagacgucucaagacug

SEQ ID NO: 872270 - RNA, 19 nt, Homo sapiens
cagacuauuaaaacuaaua

SEQ ID NO: 872271 - RNA, 15 nt, Homo sapiens
cagacucacuguggg

SEQ ID NO: 872272 - RNA, 19 nt, Homo sapiens
cagacucagacuccauuug

SEQ ID NO: 872273 - RNA, 16 nt, Homo sapiens
cagacucaguuuguca

SEQ ID NO: 872274 - RNA, 16 nt, Homo sapiens
cagacuccugugcaac

SEQ ID NO: 872275 - RNA, 18 nt, Homo sapiens
cagacucguucuucuggg

SEQ ID NO: 872276 - RNA, 21 nt, Homo sapiens
cagacucuacagaggccaugg

SEQ ID NO: 872277 - RNA, 17 nt, Homo sapiens
cagacuucacacugcaa

SEQ ID NO: 872278 - RNA, 14 nt, Homo sapiens
cagacuucccugaa

SEQ ID NO: 872279 - RNA, 20 nt, Homo sapiens
cagacuucccugaauguauu

SEQ ID NO: 872280 - RNA, 14 nt, Homo sapiens
cagacuuuaccacu

SEQ ID NO: 872281 - RNA, 14 nt, Homo sapiens
cagacuuuagcuua

SEQ ID NO: 872282 - RNA, 14 nt, Homo sapiens
cagagaaaguacuu

SEQ ID NO: 872283 - RNA, 15 nt, Homo sapiens
cagagaaauucugug

SEQ ID NO: 872284 - RNA, 14 nt, Homo sapiens
cagagaacccugug

SEQ ID NO: 872285 - RNA, 20 nt, Homo sapiens
cagagaaggcuuccuccagc

SEQ ID NO: 872286 - RNA, 13 nt, Homo sapiens
cagagaagucagu

SEQ ID NO: 872287 - RNA, 20 nt, Homo sapiens
cagagaaucauacuuagcaa

SEQ ID NO: 872288 - RNA, 14 nt, Homo sapiens
cagagacaccugca

SEQ ID NO: 872289 - RNA, 13 nt, Homo sapiens
cagagacagagag

SEQ ID NO: 872290 - RNA, 20 nt, Homo sapiens
cagagacaggcccaagagau

SEQ ID NO: 872291 - RNA, 21 nt, Homo sapiens
cagagacccagaucucaugga

SEQ ID NO: 872292 - RNA, 15 nt, Homo sapiens
cagagaccugaggca

SEQ ID NO: 872293 - RNA, 23 nt, Homo sapiens
cagagaccuuuucucucccauac

SEQ ID NO: 872294 - RNA, 17 nt, Homo sapiens
cagagacggaagccuuu

SEQ ID NO: 872295 - RNA, 14 nt, Homo sapiens
cagagacuaucuga

SEQ ID NO: 872296 - RNA, 17 nt, Homo sapiens
cagagacuuggggacca

SEQ ID NO: 872297 - RNA, 22 nt, Homo sapiens
cagagagaggggagaagccugg

SEQ ID NO: 872298 - RNA, 21 nt, Homo sapiens
cagagaggcaugugaugugca

SEQ ID NO: 872299 - RNA, 19 nt, Homo sapiens
cagagaggggacauuuccc

SEQ ID NO: 872300 - RNA, 19 nt, Homo sapiens
cagagauacgcaaacacac

SEQ ID NO: 872301 - RNA, 19 nt, Homo sapiens
cagagaugccuccaccgcu

SEQ ID NO: 872302 - RNA, 13 nt, Homo sapiens
cagagcaggcuca

SEQ ID NO: 872303 - RNA, 15 nt, Homo sapiens
cagagccacuaccuu

SEQ ID NO: 872304 - RNA, 12 nt, Homo sapiens
cagagccaguga

SEQ ID NO: 872305 - RNA, 17 nt, Homo sapiens
cagagcccaagugccau

SEQ ID NO: 872306 - RNA, 20 nt, Homo sapiens
cagagccuagccaccuccca

SEQ ID NO: 872307 - RNA, 14 nt, Homo sapiens
cagagccugaguca

SEQ ID NO: 872308 - RNA, 14 nt, Homo sapiens
cagagccuucacaa

SEQ ID NO: 872309 - RNA, 20 nt, Homo sapiens
cagagcgagacuccgucuca

SEQ ID NO: 872310 - RNA, 20 nt, Homo sapiens
cagagcgagauuccgucuua

SEQ ID NO: 872311 - RNA, 14 nt, Homo sapiens
cagagcuggaacac

SEQ ID NO: 872312 - RNA, 17 nt, Homo sapiens
cagaggaggccggugaa

SEQ ID NO: 872313 - RNA, 20 nt, Homo sapiens
cagaggagggcgugacucac

SEQ ID NO: 872314 - RNA, 22 nt, Homo sapiens
cagaggcggaaaccuugcagca

SEQ ID NO: 872315 - RNA, 18 nt, Homo sapiens
cagaggcuggcagugcug

SEQ ID NO: 872316 - RNA, 14 nt, Homo sapiens
cagagggccuagga

SEQ ID NO: 872317 - RNA, 19 nt, Homo sapiens
cagaggggugcugcuccua

SEQ ID NO: 872318 - RNA, 15 nt, Homo sapiens
cagagguggcugcug

SEQ ID NO: 872319 - RNA, 20 nt, Homo sapiens
cagagguggcugcugugcua

SEQ ID NO: 872320 - RNA, 23 nt, Homo sapiens
cagagguggcugcugugcuagug

SEQ ID NO: 872321 - RNA, 12 nt, Homo sapiens
cagaguccuaca

SEQ ID NO: 872322 - RNA, 19 nt, Homo sapiens
cagagucucacuguugccc

SEQ ID NO: 872323 - RNA, 17 nt, Homo sapiens
cagagugacauccagga

SEQ ID NO: 872324 - RNA, 20 nt, Homo sapiens
cagagugagacucugucuca

SEQ ID NO: 872325 - RNA, 21 nt, Homo sapiens
cagaguggccccucaccuggg

SEQ ID NO: 872326 - RNA, 11 nt, Homo sapiens
cagagugugaa

SEQ ID NO: 872327 - RNA, 24 nt, Homo sapiens
cagaguugcuuuaaaguaccugua

SEQ ID NO: 872328 - RNA, 18 nt, Homo sapiens
cagauaaacaacaaauaa

SEQ ID NO: 872329 - RNA, 17 nt, Homo sapiens
cagauaaagacagcuga

SEQ ID NO: 872330 - RNA, 14 nt, Homo sapiens
cagauaacucuccu

SEQ ID NO: 872331 - RNA, 12 nt, Homo sapiens
cagauagcaucu

SEQ ID NO: 872332 - RNA, 22 nt, Homo sapiens
cagaucacccggggcuuacuua

SEQ ID NO: 872333 - RNA, 21 nt, Homo sapiens
cagauccucugcugacuccau

SEQ ID NO: 872334 - RNA, 21 nt, Homo sapiens
cagaugcaaucucuugucuca

SEQ ID NO: 872335 - RNA, 13 nt, Homo sapiens
cagaugcacacac

SEQ ID NO: 872336 - RNA, 16 nt, Homo sapiens
cagaugccuuccuguc

SEQ ID NO: 872337 - RNA, 17 nt, Homo sapiens
cagauggaaagaaagca

SEQ ID NO: 872338 - RNA, 13 nt, Homo sapiens
cagauggagacau

SEQ ID NO: 872339 - RNA, 17 nt, Homo sapiens
cagauggccgggacaug

SEQ ID NO: 872340 - RNA, 23 nt, Homo sapiens
cagaugggcuguuucguguagug

SEQ ID NO: 872341 - RNA, 16 nt, Homo sapiens
cagauggucacacaga

SEQ ID NO: 872342 - RNA, 15 nt, Homo sapiens
cagauuaccaaagaa

SEQ ID NO: 872343 - RNA, 13 nt, Homo sapiens
cagauugacaagg

SEQ ID NO: 872344 - RNA, 18 nt, Homo sapiens
cagcaaaacuccaucuca

SEQ ID NO: 872345 - RNA, 14 nt, Homo sapiens
cagcaaaccucagu

SEQ ID NO: 872346 - RNA, 18 nt, Homo sapiens
cagcaacaggaaucucag

SEQ ID NO: 872347 - RNA, 21 nt, Homo sapiens
cagcaacuggugauuguuuca

SEQ ID NO: 872348 - RNA, 20 nt, Homo sapiens
cagcaagacuucucuuugcc

SEQ ID NO: 872349 - RNA, 21 nt, Homo sapiens
cagcaagacuucucuuugccu

SEQ ID NO: 872350 - RNA, 23 nt, Homo sapiens
cagcaagacuucucuuugccuca

SEQ ID NO: 872351 - RNA, 16 nt, Homo sapiens
cagcaaggugugaaug

SEQ ID NO: 872352 - RNA, 18 nt, Homo sapiens
cagcaagugagagcuggg

SEQ ID NO: 872353 - RNA, 18 nt, Homo sapiens
cagcacagacucuuucag

SEQ ID NO: 872354 - RNA, 15 nt, Homo sapiens
cagcacaugguguug

SEQ ID NO: 872355 - RNA, 21 nt, Homo sapiens
cagcaccccugucucuagcca

SEQ ID NO: 872356 - RNA, 21 nt, Homo sapiens
cagcacuaaagcaguggacac

SEQ ID NO: 872357 - RNA, 20 nt, Homo sapiens
cagcacucugaaacugagaa

SEQ ID NO: 872358 - RNA, 20 nt, Homo sapiens
cagcacugaaaauaccauca

SEQ ID NO: 872359 - RNA, 23 nt, Homo sapiens
cagcagcccuaaggaucucucag

SEQ ID NO: 872360 - RNA, 12 nt, Homo sapiens
cagcagcucagc

SEQ ID NO: 872361 - RNA, 12 nt, Homo sapiens
cagcagcugaac

SEQ ID NO: 872362 - RNA, 23 nt, Homo sapiens
cagcaggcauaaggcaccaguua

SEQ ID NO: 872363 - RNA, 17 nt, Homo sapiens
cagcaugcugagauuac

SEQ ID NO: 872364 - RNA, 17 nt, Homo sapiens
cagcauuugccauuccu

SEQ ID NO: 872365 - RNA, 15 nt, Homo sapiens
cagccacaaaguagu

SEQ ID NO: 872366 - RNA, 12 nt, Homo sapiens
cagccacacaga

SEQ ID NO: 872367 - RNA, 14 nt, Homo sapiens
cagccagacuggca

SEQ ID NO: 872368 - RNA, 14 nt, Homo sapiens
cagccaggggcugc

SEQ ID NO: 872369 - RNA, 21 nt, Homo sapiens
cagccaucaagagacugaguc

SEQ ID NO: 872370 - RNA, 13 nt, Homo sapiens
cagccaucaaggg

SEQ ID NO: 872371 - RNA, 15 nt, Homo sapiens
cagccaucaagggaa

SEQ ID NO: 872372 - RNA, 19 nt, Homo sapiens
cagccaucaugugccugga

SEQ ID NO: 872373 - RNA, 23 nt, Homo sapiens
cagccaucccgucuucuccaaca

SEQ ID NO: 872374 - RNA, 21 nt, Homo sapiens
cagcccaagaggacugagacu

SEQ ID NO: 872375 - RNA, 15 nt, Homo sapiens
cagcccagcuggugg

SEQ ID NO: 872376 - RNA, 15 nt, Homo sapiens
cagcccauggcuuua

SEQ ID NO: 872377 - RNA, 17 nt, Homo sapiens
gaguagaagucucuucc

SEQ ID NO: 872378 - RNA, 13 nt, Homo sapiens
gagucaccaggaa

SEQ ID NO: 872379 - RNA, 23 nt, Homo sapiens
gagucacccaugaagacaggaca

SEQ ID NO: 872380 - RNA, 11 nt, Homo sapiens
gagucacugac

SEQ ID NO: 872381 - RNA, 13 nt, Homo sapiens
gagucaugcacuc

SEQ ID NO: 872382 - RNA, 21 nt, Homo sapiens
gaguccccagaaccagcugca

SEQ ID NO: 872383 - RNA, 12 nt, Homo sapiens
gagucuaccucu

SEQ ID NO: 872384 - RNA, 13 nt, Homo sapiens
gagucuaccucuu

SEQ ID NO: 872385 - RNA, 14 nt, Homo sapiens
gagucucuguauaa

SEQ ID NO: 872386 - RNA, 17 nt, Homo sapiens
gagucucuucuccacug

SEQ ID NO: 872387 - RNA, 20 nt, Homo sapiens
gagucuugguuccucuacua

SEQ ID NO: 872388 - RNA, 12 nt, Homo sapiens
gagugacaccca

SEQ ID NO: 872389 - RNA, 18 nt, Homo sapiens
gagugagacuccgucuca

SEQ ID NO: 872390 - RNA, 19 nt, Homo sapiens
gagugagacuccgucucaa

SEQ ID NO: 872391 - RNA, 17 nt, Homo sapiens
gagugagacucgucuca

SEQ ID NO: 872392 - RNA, 13 nt, Homo sapiens
gagugagcugguu

SEQ ID NO: 872393 - RNA, 19 nt, Homo sapiens
gagugcaguuuccaauccc

SEQ ID NO: 872394 - RNA, 23 nt, Homo sapiens
gagugcuagcuagccagcugugu

SEQ ID NO: 872395 - RNA, 14 nt, Homo sapiens
gaguggaucuccaa

SEQ ID NO: 872396 - RNA, 19 nt, Homo sapiens
gaguggccccucaccuggg

SEQ ID NO: 872397 - RNA, 22 nt, Homo sapiens
gaguggcuugugauucugggau

SEQ ID NO: 872398 - RNA, 15 nt, Homo sapiens
gagugguuguugcca

SEQ ID NO: 872399 - RNA, 20 nt, Homo sapiens
gaguguggcuuaguaauaga

SEQ ID NO: 872400 - RNA, 24 nt, Homo sapiens
gagugugugugaugggaucuguaa

SEQ ID NO: 872401 - RNA, 22 nt, Homo sapiens
gaguguucauuuuagugacugu

SEQ ID NO: 872402 - RNA, 15 nt, Homo sapiens
gaguucaacuuugag

SEQ ID NO: 872403 - RNA, 17 nt, Homo sapiens
gaguucagcaaagagug

SEQ ID NO: 872404 - RNA, 16 nt, Homo sapiens
gaguugcgcugggaga

SEQ ID NO: 872405 - RNA, 18 nt, Homo sapiens
gaguuggaacugcauucu

SEQ ID NO: 872406 - RNA, 16 nt, Homo sapiens
gaguuguacacugugu

SEQ ID NO: 872407 - RNA, 17 nt, Homo sapiens
gaguuuaagucucugac

SEQ ID NO: 872408 - RNA, 10 nt, Homo sapiens
gauaaacuaa

SEQ ID NO: 872409 - RNA, 17 nt, Homo sapiens
gauaaacuaaaagcaua

SEQ ID NO: 872410 - RNA, 19 nt, Homo sapiens
gauaaagaugucaaauauc

SEQ ID NO: 872411 - RNA, 16 nt, Homo sapiens
gauaaagcaguauuug

SEQ ID NO: 872412 - RNA, 20 nt, Homo sapiens
gauaaaucaguuaugucaau

SEQ ID NO: 872413 - RNA, 14 nt, Homo sapiens
gauaaaugccucau

SEQ ID NO: 872414 - RNA, 16 nt, Homo sapiens
gauaaauuccacugga

SEQ ID NO: 872415 - RNA, 22 nt, Homo sapiens
gauaacaaaaucacaagcaaua

SEQ ID NO: 872416 - RNA, 21 nt, Homo sapiens
gauaacccauacuacccucau

SEQ ID NO: 872417 - RNA, 20 nt, Homo sapiens
gauaaucgagucuaccucuu

SEQ ID NO: 872418 - RNA, 23 nt, Homo sapiens
gauacacugaaguuaacagagac

SEQ ID NO: 872419 - RNA, 17 nt, Homo sapiens
gauaccagauauuugaa

SEQ ID NO: 872420 - RNA, 16 nt, Homo sapiens
gauacccagagcauua

SEQ ID NO: 872421 - RNA, 21 nt, Homo sapiens
gauaccucaacccccauuucu

SEQ ID NO: 872422 - RNA, 12 nt, Homo sapiens
gauacuauucag

SEQ ID NO: 872423 - RNA, 22 nt, Homo sapiens
gauacugcucaucauuccuuga

SEQ ID NO: 872424 - RNA, 13 nt, Homo sapiens
gauacuguugauc

SEQ ID NO: 872425 - RNA, 18 nt, Homo sapiens
gauagaacaaugcuauaa

SEQ ID NO: 872426 - RNA, 19 nt, Homo sapiens
gauagcuauuuucuuacag

SEQ ID NO: 872427 - RNA, 20 nt, Homo sapiens
gauagucagcuguaccaagc

SEQ ID NO: 872428 - RNA, 15 nt, Homo sapiens
gauaguccaaagacu

SEQ ID NO: 872429 - RNA, 23 nt, Homo sapiens
gauauauacauguuuaguauuau

SEQ ID NO: 872430 - RNA, 15 nt, Homo sapiens
gauauauaccacuuu

SEQ ID NO: 872431 - RNA, 18 nt, Homo sapiens
gauauauuucauucucuu

SEQ ID NO: 872432 - RNA, 15 nt, Homo sapiens
gauaucacuuacuca

SEQ ID NO: 872433 - RNA, 14 nt, Homo sapiens
gauaucucaucucu

SEQ ID NO: 872434 - RNA, 17 nt, Homo sapiens
gauaucugaacacauac

SEQ ID NO: 872435 - RNA, 22 nt, Homo sapiens
gauaucugaacacauacuagaa

SEQ ID NO: 872436 - RNA, 23 nt, Homo sapiens
gauauguuacauuagagugagag

SEQ ID NO: 872437 - RNA, 15 nt, Homo sapiens
gauauuuccauuucu

SEQ ID NO: 872438 - RNA, 19 nt, Homo sapiens
gauauuugaagcaucacau

SEQ ID NO: 872439 - RNA, 14 nt, Homo sapiens
gaucacacagccac

SEQ ID NO: 872440 - RNA, 16 nt, Homo sapiens
gaucacuuggagccag

SEQ ID NO: 872441 - RNA, 19 nt, Homo sapiens
gaucacuuuguuaaaaaua

SEQ ID NO: 872442 - RNA, 17 nt, Homo sapiens
gaucauggucagcucac

SEQ ID NO: 872443 - RNA, 23 nt, Homo sapiens
gauccaaacagaaaagugcaaag

SEQ ID NO: 872444 - RNA, 16 nt, Homo sapiens
gauccacccaccucag

SEQ ID NO: 872445 - RNA, 15 nt, Homo sapiens
gauccaguugcacua

SEQ ID NO: 872446 - RNA, 18 nt, Homo sapiens
gaucccacuucacuguga

SEQ ID NO: 872447 - RNA, 14 nt, Homo sapiens
gaucccaggccagg

SEQ ID NO: 872448 - RNA, 20 nt, Homo sapiens
gauccccagccuacugccuc

SEQ ID NO: 872449 - RNA, 13 nt, Homo sapiens
gaucccuagcugu

SEQ ID NO: 872450 - RNA, 19 nt, Homo sapiens
gaucccuagcugugaccuc

SEQ ID NO: 872451 - RNA, 23 nt, Homo sapiens
gauccugcuguggccucacuucc

SEQ ID NO: 872452 - RNA, 21 nt, Homo sapiens
gauccuugauaaaugccucau

SEQ ID NO: 872453 - RNA, 12 nt, Homo sapiens
gaucgcugugaa

SEQ ID NO: 872454 - RNA, 17 nt, Homo sapiens
gaucuagcuucaugccu

SEQ ID NO: 872455 - RNA, 13 nt, Homo sapiens
gaucuaguucuca

SEQ ID NO: 872456 - RNA, 18 nt, Homo sapiens
gaucuaucaauagucaag

SEQ ID NO: 872457 - RNA, 16 nt, Homo sapiens
gaucucacaagcacuu

SEQ ID NO: 872458 - RNA, 19 nt, Homo sapiens
gaucucccugccgccucaa

SEQ ID NO: 872459 - RNA, 21 nt, Homo sapiens
gaucuguuuuuaaaaaucaua

SEQ ID NO: 872460 - RNA, 17 nt, Homo sapiens
gaucuucuuggagcgag

SEQ ID NO: 872461 - RNA, 14 nt, Homo sapiens
gaucuucuuuauaa

SEQ ID NO: 872462 - RNA, 20 nt, Homo sapiens
gaucuugcauucccaguggu

SEQ ID NO: 872463 - RNA, 17 nt, Homo sapiens
gaucuuucuauuccaaa

SEQ ID NO: 872464 - RNA, 15 nt, Homo sapiens
gaucuuugacucuuu

SEQ ID NO: 872465 - RNA, 20 nt, Homo sapiens
gaugaaauuuucuagacuuu

SEQ ID NO: 872466 - RNA, 16 nt, Homo sapiens
gaugagaaaggccuga

SEQ ID NO: 872467 - RNA, 21 nt, Homo sapiens
gaugaggucauagcagugcuu

SEQ ID NO: 872468 - RNA, 20 nt, Homo sapiens
gaugaugcaagcgacaggaa

SEQ ID NO: 872469 - RNA, 20 nt, Homo sapiens
gaugcaaucucuugucucac

SEQ ID NO: 872470 - RNA, 21 nt, Homo sapiens
gaugcacacacagauauacac

SEQ ID NO: 872471 - RNA, 18 nt, Homo sapiens
gaugcacagagauaugca

SEQ ID NO: 872472 - RNA, 19 nt, Homo sapiens
gaugcacagagauaugcac

SEQ ID NO: 872473 - RNA, 20 nt, Homo sapiens
gaugcacggcggcagggugg

SEQ ID NO: 872474 - RNA, 22 nt, Homo sapiens
gaugccacuucccagaggcaga

SEQ ID NO: 872475 - RNA, 23 nt, Homo sapiens
gaugccagccggguaccucaguu

SEQ ID NO: 872476 - RNA, 16 nt, Homo sapiens
gaugcugccugaguca

SEQ ID NO: 872477 - RNA, 15 nt, Homo sapiens
gaugcuguugggaaa

SEQ ID NO: 872478 - RNA, 18 nt, Homo sapiens
gauggaaguugcagugag

SEQ ID NO: 872479 - RNA, 23 nt, Homo sapiens
gauggaauaaagcccuugaacca

SEQ ID NO: 872480 - RNA, 22 nt, Homo sapiens
gauggacaagauuaccccaccu

SEQ ID NO: 872481 - RNA, 22 nt, Homo sapiens
gauggacucugaaaaacauucc

SEQ ID NO: 872482 - RNA, 18 nt, Homo sapiens
gauggagaggggguacaa

SEQ ID NO: 872483 - RNA, 18 nt, Homo sapiens
gauggagccagcucugca

SEQ ID NO: 872484 - RNA, 16 nt, Homo sapiens
gauggagcgcaccugc

SEQ ID NO: 872485 - RNA, 18 nt, Homo sapiens
gauggaggggcugacuca

SEQ ID NO: 872486 - RNA, 19 nt, Homo sapiens
gauggcauugggcaaacag

SEQ ID NO: 872487 - RNA, 21 nt, Homo sapiens
gauggcauuuuuugcaaguua

SEQ ID NO: 872488 - RNA, 15 nt, Homo sapiens
gauggccaggccaga

SEQ ID NO: 872489 - RNA, 19 nt, Homo sapiens
gauggcuuuuucuccuugg

SEQ ID NO: 872490 - RNA, 22 nt, Homo sapiens
gaugggguuucaccaucuuggc

SEQ ID NO: 872491 - RNA, 14 nt, Homo sapiens
cagcccccacuuuc

SEQ ID NO: 872492 - RNA, 21 nt, Homo sapiens
cagccccggcugacaccugga

SEQ ID NO: 872493 - RNA, 16 nt, Homo sapiens
cagcccgacaggcaug

SEQ ID NO: 872494 - RNA, 23 nt, Homo sapiens
cagcccugggguaugagcugcca

SEQ ID NO: 872495 - RNA, 20 nt, Homo sapiens
cagccucccaaguagcugga

SEQ ID NO: 872496 - RNA, 20 nt, Homo sapiens
cagccucccgaauagcuggg

SEQ ID NO: 872497 - RNA, 20 nt, Homo sapiens
cagccucccucugaccugca

SEQ ID NO: 872498 - RNA, 14 nt, Homo sapiens
cagccuccucagua

SEQ ID NO: 872499 - RNA, 19 nt, Homo sapiens
cagccuccucaguagcuag

SEQ ID NO: 872500 - RNA, 16 nt, Homo sapiens
cagccuccuccugacc

SEQ ID NO: 872501 - RNA, 17 nt, Homo sapiens
cagccucgcaugccaga

SEQ ID NO: 872502 - RNA, 12 nt, Homo sapiens
cagccucucugc

SEQ ID NO: 872503 - RNA, 15 nt, Homo sapiens
cagccucucugcuau

SEQ ID NO: 872504 - RNA, 18 nt, Homo sapiens
cagccugcagacucacug

SEQ ID NO: 872505 - RNA, 18 nt, Homo sapiens
cagccuggaagagggcaa

SEQ ID NO: 872506 - RNA, 17 nt, Homo sapiens
cagccuggccaacaugg

SEQ ID NO: 872507 - RNA, 21 nt, Homo sapiens
cagccuggccaacauggugaa

SEQ ID NO: 872508 - RNA, 14 nt, Homo sapiens
cagccugggaccag

SEQ ID NO: 872509 - RNA, 19 nt, Homo sapiens
cagccugggcaacagagca

SEQ ID NO: 872510 - RNA, 19 nt, Homo sapiens
cagccugggcagcauagca

SEQ ID NO: 872511 - RNA, 17 nt, Homo sapiens
cagcgaaaggauguaaa

SEQ ID NO: 872512 - RNA, 21 nt, Homo sapiens
cagcgagcuaugaucgcgcca

SEQ ID NO: 872513 - RNA, 14 nt, Homo sapiens
cagcgaugugucac

SEQ ID NO: 872514 - RNA, 13 nt, Homo sapiens
cagcgccaccucu

SEQ ID NO: 872515 - RNA, 13 nt, Homo sapiens
cagcgcgugcaca

SEQ ID NO: 872516 - RNA, 15 nt, Homo sapiens
cagcgcgugcacagc

SEQ ID NO: 872517 - RNA, 20 nt, Homo sapiens
cagcggcacaaaugcaccuc

SEQ ID NO: 872518 - RNA, 21 nt, Homo sapiens
cagcuaagcccccuacugaga

SEQ ID NO: 872519 - RNA, 19 nt, Homo sapiens
cagcuaauaaugaaguuau

SEQ ID NO: 872520 - RNA, 13 nt, Homo sapiens
cagcuacauuccu

SEQ ID NO: 872521 - RNA, 15 nt, Homo sapiens
cagcuacauuccuca

SEQ ID NO: 872522 - RNA, 23 nt, Homo sapiens
cagcuacauuccucagcugccaa

SEQ ID NO: 872523 - RNA, 19 nt, Homo sapiens
cagcuauuuucaacauaac

SEQ ID NO: 872524 - RNA, 23 nt, Homo sapiens
cagcuauuuucaacauaacugaa

SEQ ID NO: 872525 - RNA, 15 nt, Homo sapiens
cagcuccuucugucc

SEQ ID NO: 872526 - RNA, 16 nt, Homo sapiens
cagcucuccugcugca

SEQ ID NO: 872527 - RNA, 17 nt, Homo sapiens
cagcucuccugcugcag

SEQ ID NO: 872528 - RNA, 13 nt, Homo sapiens
cagcucugaugag

SEQ ID NO: 872529 - RNA, 14 nt, Homo sapiens
cagcugaacagcca

SEQ ID NO: 872530 - RNA, 15 nt, Homo sapiens
cagcugaacagccaa

SEQ ID NO: 872531 - RNA, 21 nt, Homo sapiens
cagcugauuuugucacugucu

SEQ ID NO: 872532 - RNA, 14 nt, Homo sapiens
cagcugcaccugcc

SEQ ID NO: 872533 - RNA, 20 nt, Homo sapiens
cagcugcagucaacaguuca

SEQ ID NO: 872534 - RNA, 16 nt, Homo sapiens
cagcugcaucuacuca

SEQ ID NO: 872535 - RNA, 23 nt, Homo sapiens
cagcugccaaaaucguagguguu

SEQ ID NO: 872536 - RNA, 13 nt, Homo sapiens
cagcuggugcugc

SEQ ID NO: 872537 - RNA, 23 nt, Homo sapiens
cagcugugaacauggacucuucc

SEQ ID NO: 872538 - RNA, 16 nt, Homo sapiens
cagcuugcucuucagu

SEQ ID NO: 872539 - RNA, 19 nt, Homo sapiens
cagcuuguggcaagugaau

SEQ ID NO: 872540 - RNA, 15 nt, Homo sapiens
cagcuuuaucuguca

SEQ ID NO: 872541 - RNA, 17 nt, Homo sapiens
caggaaaacaaaucacu

SEQ ID NO: 872542 - RNA, 14 nt, Homo sapiens
caggaaaccaacac

SEQ ID NO: 872543 - RNA, 17 nt, Homo sapiens
caggaaagaugaugcaa

SEQ ID NO: 872544 - RNA, 14 nt, Homo sapiens
caggaaauaguguu

SEQ ID NO: 872545 - RNA, 14 nt, Homo sapiens
caggaaaucaaaua

SEQ ID NO: 872546 - RNA, 19 nt, Homo sapiens
caggaaaucaaauaugcaa

SEQ ID NO: 872547 - RNA, 15 nt, Homo sapiens
caggaacucccagca

SEQ ID NO: 872548 - RNA, 16 nt, Homo sapiens
caggaagaugaaagag

SEQ ID NO: 872549 - RNA, 18 nt, Homo sapiens
caggaagcccaaggcagu

SEQ ID NO: 872550 - RNA, 14 nt, Homo sapiens
caggaaggagcaaa

SEQ ID NO: 872551 - RNA, 21 nt, Homo sapiens
caggaagguagcccagcacug

SEQ ID NO: 872552 - RNA, 17 nt, Homo sapiens
caggaaucaugaucuga

SEQ ID NO: 872553 - RNA, 14 nt, Homo sapiens
caggacacaggccu

SEQ ID NO: 872554 - RNA, 23 nt, Homo sapiens
caggacaccagccuggugcccau

SEQ ID NO: 872555 - RNA, 19 nt, Homo sapiens
caggacgcacccccacugc

SEQ ID NO: 872556 - RNA, 20 nt, Homo sapiens
caggacgcacccccacugcu

SEQ ID NO: 872557 - RNA, 22 nt, Homo sapiens
caggacggaauauagaggagca

SEQ ID NO: 872558 - RNA, 22 nt, Homo sapiens
caggagaagcucaguagccuuu

SEQ ID NO: 872559 - RNA, 18 nt, Homo sapiens
caggagaaucaauaaaaa

SEQ ID NO: 872560 - RNA, 13 nt, Homo sapiens
caggagaaucacu

SEQ ID NO: 872561 - RNA, 18 nt, Homo sapiens
caggagaauggugugaac

SEQ ID NO: 872562 - RNA, 14 nt, Homo sapiens
caggagcacacggc

SEQ ID NO: 872563 - RNA, 17 nt, Homo sapiens
caggagcauggggauaa

SEQ ID NO: 872564 - RNA, 16 nt, Homo sapiens
caggagccgagccaau

SEQ ID NO: 872565 - RNA, 19 nt, Homo sapiens
caggagcuugauccagacc

SEQ ID NO: 872566 - RNA, 20 nt, Homo sapiens
caggaggguugggcgugcua

SEQ ID NO: 872567 - RNA, 23 nt, Homo sapiens
caggagguggagguugcagugag

SEQ ID NO: 872568 - RNA, 19 nt, Homo sapiens
caggagguuguggaugcuc

SEQ ID NO: 872569 - RNA, 20 nt, Homo sapiens
caggagguuguggaugcucc

SEQ ID NO: 872570 - RNA, 19 nt, Homo sapiens
caggaguucaauaaauguc

SEQ ID NO: 872571 - RNA, 17 nt, Homo sapiens
caggauaagagggauua

SEQ ID NO: 872572 - RNA, 16 nt, Homo sapiens
caggaucccucccaga

SEQ ID NO: 872573 - RNA, 22 nt, Homo sapiens
caggauccuauucucaccagga

SEQ ID NO: 872574 - RNA, 10 nt, Homo sapiens
caggaucuca

SEQ ID NO: 872575 - RNA, 23 nt, Homo sapiens
caggaucugaguuauuuugcuaa

SEQ ID NO: 872576 - RNA, 19 nt, Homo sapiens
caggaugaaggcgugcaag

SEQ ID NO: 872577 - RNA, 19 nt, Homo sapiens
caggaugaguuacuugaaa

SEQ ID NO: 872578 - RNA, 22 nt, Homo sapiens
caggauuaaugguccugugaug

SEQ ID NO: 872579 - RNA, 16 nt, Homo sapiens
caggauuucauugacu

SEQ ID NO: 872580 - RNA, 18 nt, Homo sapiens
caggcagcgauggucuca

SEQ ID NO: 872581 - RNA, 12 nt, Homo sapiens
caggcaggccac

SEQ ID NO: 872582 - RNA, 16 nt, Homo sapiens
caggcagguccagggu

SEQ ID NO: 872583 - RNA, 14 nt, Homo sapiens
caggcaucccaucc

SEQ ID NO: 872584 - RNA, 17 nt, Homo sapiens
caggcaugcaccagugc

SEQ ID NO: 872585 - RNA, 15 nt, Homo sapiens
caggcauguucucug

SEQ ID NO: 872586 - RNA, 18 nt, Homo sapiens
caggccacuguggccaga

SEQ ID NO: 872587 - RNA, 18 nt, Homo sapiens
caggccagaaaacauaug

SEQ ID NO: 872588 - RNA, 14 nt, Homo sapiens
caggccaggccacc

SEQ ID NO: 872589 - RNA, 17 nt, Homo sapiens
caggccaggugcagugg

SEQ ID NO: 872590 - RNA, 15 nt, Homo sapiens
caggccauacuuuac

SEQ ID NO: 872591 - RNA, 17 nt, Homo sapiens
caggccauacuuuacaa

SEQ ID NO: 872592 - RNA, 14 nt, Homo sapiens
caggcccaagagau

SEQ ID NO: 872593 - RNA, 14 nt, Homo sapiens
caggccccugccac

SEQ ID NO: 872594 - RNA, 22 nt, Homo sapiens
caggcccggcccagccuaggcc

SEQ ID NO: 872595 - RNA, 18 nt, Homo sapiens
caggcccggcuccaggcu

SEQ ID NO: 872596 - RNA, 14 nt, Homo sapiens
caggcgcaugugcc

SEQ ID NO: 872597 - RNA, 13 nt, Homo sapiens
caggcucugggaa

SEQ ID NO: 872598 - RNA, 13 nt, Homo sapiens
caggcucuucucc

SEQ ID NO: 872599 - RNA, 18 nt, Homo sapiens
caggcugagugagccaca

SEQ ID NO: 872600 - RNA, 16 nt, Homo sapiens
caggcuggagugcagu

SEQ ID NO: 872601 - RNA, 20 nt, Homo sapiens
caggcugggauggagcacuu

SEQ ID NO: 872602 - RNA, 20 nt, Homo sapiens
caggcugggcuucaguggca

SEQ ID NO: 872603 - RNA, 18 nt, Homo sapiens
caggcuguucugcacuga

SEQ ID NO: 872604 - RNA, 19 nt, Homo sapiens
caggcuguucugcacugaa

SEQ ID NO: 872605 - RNA, 17 nt, Homo sapiens
caggcuucggacagugc

SEQ ID NO: 872606 - RNA, 18 nt, Homo sapiens
gaugguaacugcacacau

SEQ ID NO: 872607 - RNA, 16 nt, Homo sapiens
gauggugcugaccucu

SEQ ID NO: 872608 - RNA, 17 nt, Homo sapiens
gauguacacacacagau

SEQ ID NO: 872609 - RNA, 16 nt, Homo sapiens
gauguacgagcugcgc

SEQ ID NO: 872610 - RNA, 17 nt, Homo sapiens
gaugucucuuguagaag

SEQ ID NO: 872611 - RNA, 17 nt, Homo sapiens
gaugugaaaaucaugaa

SEQ ID NO: 872612 - RNA, 21 nt, Homo sapiens
gaugugaauugccugcagaga

SEQ ID NO: 872613 - RNA, 16 nt, Homo sapiens
gaugugaucacugaga

SEQ ID NO: 872614 - RNA, 18 nt, Homo sapiens
gaugugcaagucuuguca

SEQ ID NO: 872615 - RNA, 18 nt, Homo sapiens
gauguuaagcaaaggaaa

SEQ ID NO: 872616 - RNA, 17 nt, Homo sapiens
gauguucuggaccuccc

SEQ ID NO: 872617 - RNA, 19 nt, Homo sapiens
gauguuuacagacugugag

SEQ ID NO: 872618 - RNA, 14 nt, Homo sapiens
gauguuuguugcua

SEQ ID NO: 872619 - RNA, 20 nt, Homo sapiens
gauguuuugucccauuuccu

SEQ ID NO: 872620 - RNA, 20 nt, Homo sapiens
gauuaaacaaacaaacaauu

SEQ ID NO: 872621 - RNA, 18 nt, Homo sapiens
gauuacaggugugaacca

SEQ ID NO: 872622 - RNA, 12 nt, Homo sapiens
gauuagacugga

SEQ ID NO: 872623 - RNA, 17 nt, Homo sapiens
gauuagaugacucucag

SEQ ID NO: 872624 - RNA, 21 nt, Homo sapiens
gauuaguauucaggcacugag

SEQ ID NO: 872625 - RNA, 13 nt, Homo sapiens
gauuauauaucau

SEQ ID NO: 872626 - RNA, 17 nt, Homo sapiens
gauuaugccacugcuuu

SEQ ID NO: 872627 - RNA, 12 nt, Homo sapiens
gauuauucugau

SEQ ID NO: 872628 - RNA, 19 nt, Homo sapiens
gauucaacugcaucuccaa

SEQ ID NO: 872629 - RNA, 21 nt, Homo sapiens
gauucacaaugaaaugcucuc

SEQ ID NO: 872630 - RNA, 21 nt, Homo sapiens
gauucacauaguuuauuucaa

SEQ ID NO: 872631 - RNA, 23 nt, Homo sapiens
gauucagcauuauuccuccagga

SEQ ID NO: 872632 - RNA, 19 nt, Homo sapiens
gauucccccagucauucug

SEQ ID NO: 872633 - RNA, 19 nt, Homo sapiens
gauuccuuuaugagucagu

SEQ ID NO: 872634 - RNA, 17 nt, Homo sapiens
gauucuaaugucuucau

SEQ ID NO: 872635 - RNA, 18 nt, Homo sapiens
gauucuaaugucuucauu

SEQ ID NO: 872636 - RNA, 12 nt, Homo sapiens
gauucucugggu

SEQ ID NO: 872637 - RNA, 22 nt, Homo sapiens
gauucuuccacuggcuccacau

SEQ ID NO: 872638 - RNA, 15 nt, Homo sapiens
gauucuucucuuaau

SEQ ID NO: 872639 - RNA, 23 nt, Homo sapiens
gauucuucucuuaauuucauaga

SEQ ID NO: 872640 - RNA, 16 nt, Homo sapiens
gauucuucugccucag

SEQ ID NO: 872641 - RNA, 18 nt, Homo sapiens
gauugacacacagcacuc

SEQ ID NO: 872642 - RNA, 12 nt, Homo sapiens
gauugagugcuc

SEQ ID NO: 872643 - RNA, 19 nt, Homo sapiens
gauugauagaguguuauca

SEQ ID NO: 872644 - RNA, 20 nt, Homo sapiens
gauuggauuauucauuuaaa

SEQ ID NO: 872645 - RNA, 13 nt, Homo sapiens
gauuguauugcaa

SEQ ID NO: 872646 - RNA, 20 nt, Homo sapiens
gauuguccagugcaaccaca

SEQ ID NO: 872647 - RNA, 15 nt, Homo sapiens
gauuuaacugugaac

SEQ ID NO: 872648 - RNA, 15 nt, Homo sapiens
gauuucacaucagcu

SEQ ID NO: 872649 - RNA, 22 nt, Homo sapiens
gauuucaggauacucugucaga

SEQ ID NO: 872650 - RNA, 21 nt, Homo sapiens
gauuucuuccagaaggcaaaa

SEQ ID NO: 872651 - RNA, 18 nt, Homo sapiens
gauuucuucgcugcucua

SEQ ID NO: 872652 - RNA, 15 nt, Homo sapiens
gauuugccaaaguga

SEQ ID NO: 872653 - RNA, 12 nt, Homo sapiens
gauuuuauacau

SEQ ID NO: 872654 - RNA, 14 nt, Homo sapiens
gauuuuaugcugcu

SEQ ID NO: 872655 - RNA, 19 nt, Homo sapiens
gcaaaaaaaaaaauauuaa

SEQ ID NO: 872656 - RNA, 21 nt, Homo sapiens
gcaaaaaaauuaaauuauuua

SEQ ID NO: 872657 - RNA, 23 nt, Homo sapiens
gcaaaaacaaaugggaaaauguc

SEQ ID NO: 872658 - RNA, 11 nt, Homo sapiens
gcaaaaaucuc

SEQ ID NO: 872659 - RNA, 15 nt, Homo sapiens
gcaaaagucagucuu

SEQ ID NO: 872660 - RNA, 20 nt, Homo sapiens
gcaaaauaauaagaaggaaa

SEQ ID NO: 872661 - RNA, 13 nt, Homo sapiens
gcaaaaucuacca

SEQ ID NO: 872662 - RNA, 23 nt, Homo sapiens
gcaaacccaaaaccucaugacag

SEQ ID NO: 872663 - RNA, 23 nt, Homo sapiens
gcaaacggaguacagacgucuca

SEQ ID NO: 872664 - RNA, 17 nt, Homo sapiens
gcaaacuuuguauuaau

SEQ ID NO: 872665 - RNA, 16 nt, Homo sapiens
gcaaagaaaagccaga

SEQ ID NO: 872666 - RNA, 23 nt, Homo sapiens
gcaaagcuaaaauugaacuacuu

SEQ ID NO: 872667 - RNA, 16 nt, Homo sapiens
gcaaaggaaaccaaag

SEQ ID NO: 872668 - RNA, 16 nt, Homo sapiens
gcaaaggcgucugaau

SEQ ID NO: 872669 - RNA, 17 nt, Homo sapiens
gcaaagggagcacuggg

SEQ ID NO: 872670 - RNA, 19 nt, Homo sapiens
gcaaaguagugauauucua

SEQ ID NO: 872671 - RNA, 12 nt, Homo sapiens
gcaaagucuaaa

SEQ ID NO: 872672 - RNA, 23 nt, Homo sapiens
gcaaagugcugcuggaaguagaa

SEQ ID NO: 872673 - RNA, 13 nt, Homo sapiens
gcaaauaucuuga

SEQ ID NO: 872674 - RNA, 21 nt, Homo sapiens
gcaaauccuugauacugcuca

SEQ ID NO: 872675 - RNA, 21 nt, Homo sapiens
gcaaaugacaugcacugaccc

SEQ ID NO: 872676 - RNA, 14 nt, Homo sapiens
gcaaauuugauaca

SEQ ID NO: 872677 - RNA, 17 nt, Homo sapiens
gcaacaggaacuuggag

SEQ ID NO: 872678 - RNA, 11 nt, Homo sapiens
gcaacauaaaa

SEQ ID NO: 872679 - RNA, 17 nt, Homo sapiens
gcaacccucacuguguu

SEQ ID NO: 872680 - RNA, 19 nt, Homo sapiens
gcaaccuuuggaugcacuu

SEQ ID NO: 872681 - RNA, 22 nt, Homo sapiens
gcaacugaggcagacagcagcu

SEQ ID NO: 872682 - RNA, 22 nt, Homo sapiens
gcaagaaagccguacugucuau

SEQ ID NO: 872683 - RNA, 16 nt, Homo sapiens
gcaagacguccuggaa

SEQ ID NO: 872684 - RNA, 22 nt, Homo sapiens
gcaagaggugguagaaccacuu

SEQ ID NO: 872685 - RNA, 13 nt, Homo sapiens
gcaagaugaccua

SEQ ID NO: 872686 - RNA, 20 nt, Homo sapiens
gcaagaugaccuacuaguuu

SEQ ID NO: 872687 - RNA, 15 nt, Homo sapiens
gcaagccacuauguc

SEQ ID NO: 872688 - RNA, 19 nt, Homo sapiens
gcaaggggcauuacuggga

SEQ ID NO: 872689 - RNA, 15 nt, Homo sapiens
gcaaggugugaauga

SEQ ID NO: 872690 - RNA, 15 nt, Homo sapiens
gcaaguuaaagaaaa

SEQ ID NO: 872691 - RNA, 16 nt, Homo sapiens
gcaauaaaauguauuu

SEQ ID NO: 872692 - RNA, 22 nt, Homo sapiens
gcaauaacguuuaagccaaaac

SEQ ID NO: 872693 - RNA, 17 nt, Homo sapiens
gcaauacuaauugagaa

SEQ ID NO: 872694 - RNA, 19 nt, Homo sapiens
gcaaucuuguccacagucu

SEQ ID NO: 872695 - RNA, 14 nt, Homo sapiens
gcaaugaaacagau

SEQ ID NO: 872696 - RNA, 19 nt, Homo sapiens
gcaaugguagcaaaacaag

SEQ ID NO: 872697 - RNA, 20 nt, Homo sapiens
gcaaugugaguuaucacuuc

SEQ ID NO: 872698 - RNA, 22 nt, Homo sapiens
gcaauucuaacuuuuuugcuau

SEQ ID NO: 872699 - RNA, 19 nt, Homo sapiens
gcaauucuacccagagccu

SEQ ID NO: 872700 - RNA, 18 nt, Homo sapiens
gcaauuuucgaacauucu

SEQ ID NO: 872701 - RNA, 13 nt, Homo sapiens
gcacaaacuuuaa

SEQ ID NO: 872702 - RNA, 22 nt, Homo sapiens
gcacaagcuuguauauacauau

SEQ ID NO: 872703 - RNA, 16 nt, Homo sapiens
gcacaaggcugaccaa

SEQ ID NO: 872704 - RNA, 19 nt, Homo sapiens
gcacacaauaagcauucaa

SEQ ID NO: 872705 - RNA, 13 nt, Homo sapiens
gcacacacagaua

SEQ ID NO: 872706 - RNA, 17 nt, Homo sapiens
gcacacacagauaugca

SEQ ID NO: 872707 - RNA, 18 nt, Homo sapiens
gcacacacagauaugcac

SEQ ID NO: 872708 - RNA, 12 nt, Homo sapiens
gcacacacaugg

SEQ ID NO: 872709 - RNA, 15 nt, Homo sapiens
gcacaccccaaggga

SEQ ID NO: 872710 - RNA, 20 nt, Homo sapiens
gcacacuagccucuccagga

SEQ ID NO: 872711 - RNA, 12 nt, Homo sapiens
gcacacuuguau

SEQ ID NO: 872712 - RNA, 19 nt, Homo sapiens
gcacagaaggaaucugugc

SEQ ID NO: 872713 - RNA, 21 nt, Homo sapiens
gcacagaaggaaucugugcag

SEQ ID NO: 872714 - RNA, 15 nt, Homo sapiens
gcacagagauaugca

SEQ ID NO: 872715 - RNA, 16 nt, Homo sapiens
gcacagagauaugcac

SEQ ID NO: 872716 - RNA, 12 nt, Homo sapiens
gcacauauuuga

SEQ ID NO: 872717 - RNA, 14 nt, Homo sapiens
gcacauauuugaau

SEQ ID NO: 872718 - RNA, 22 nt, Homo sapiens
gcacaucccugcccuccuacag

SEQ ID NO: 872719 - RNA, 11 nt, Homo sapiens
gcacaucucug

SEQ ID NO: 872720 - RNA, 18 nt, Homo sapiens
gcacauggcuggcacuga

SEQ ID NO: 872721 - RNA, 23 nt, Homo sapiens
caggcuugccaccggggaaccca

SEQ ID NO: 872722 - RNA, 18 nt, Homo sapiens
cagggaaagcccguguca

SEQ ID NO: 872723 - RNA, 22 nt, Homo sapiens
cagggaaccgugauaagccuuu

SEQ ID NO: 872724 - RNA, 17 nt, Homo sapiens
cagggaagagggcagua

SEQ ID NO: 872725 - RNA, 13 nt, Homo sapiens
cagggaagccaaa

SEQ ID NO: 872726 - RNA, 18 nt, Homo sapiens
cagggagacugcaucuca

SEQ ID NO: 872727 - RNA, 21 nt, Homo sapiens
cagggagacugcaucucaaaa

SEQ ID NO: 872728 - RNA, 15 nt, Homo sapiens
cagggagcagggcag

SEQ ID NO: 872729 - RNA, 23 nt, Homo sapiens
cagggagcagggcagaaaacaca

SEQ ID NO: 872730 - RNA, 13 nt, Homo sapiens
cagggcagggaaa

SEQ ID NO: 872731 - RNA, 14 nt, Homo sapiens
cagggcaguaucuc

SEQ ID NO: 872732 - RNA, 18 nt, Homo sapiens
cagggccucugggagccu

SEQ ID NO: 872733 - RNA, 18 nt, Homo sapiens
caggggaaaaugaagguu

SEQ ID NO: 872734 - RNA, 15 nt, Homo sapiens
caggggaccacaccu

SEQ ID NO: 872735 - RNA, 14 nt, Homo sapiens
caggggaguuccug

SEQ ID NO: 872736 - RNA, 18 nt, Homo sapiens
caggggccugcccagugc

SEQ ID NO: 872737 - RNA, 22 nt, Homo sapiens
caggggccugcccagugcacuu

SEQ ID NO: 872738 - RNA, 21 nt, Homo sapiens
caggggcuucuuucuuuucga

SEQ ID NO: 872739 - RNA, 14 nt, Homo sapiens
caggguagggagaa

SEQ ID NO: 872740 - RNA, 18 nt, Homo sapiens
caggguccgcaccagcug

SEQ ID NO: 872741 - RNA, 19 nt, Homo sapiens
cagggucuaccucugucac

SEQ ID NO: 872742 - RNA, 12 nt, Homo sapiens
cagggucucacu

SEQ ID NO: 872743 - RNA, 20 nt, Homo sapiens
cagggucucacuauguugcc

SEQ ID NO: 872744 - RNA, 21 nt, Homo sapiens
cagggucucacuauguugccc

SEQ ID NO: 872745 - RNA, 23 nt, Homo sapiens
cagggugaggugcuugcccccau

SEQ ID NO: 872746 - RNA, 21 nt, Homo sapiens
caggguuagcucacgugucuu

SEQ ID NO: 872747 - RNA, 17 nt, Homo sapiens
cagguaaccacaauuuu

SEQ ID NO: 872748 - RNA, 15 nt, Homo sapiens
cagguaaugagggac

SEQ ID NO: 872749 - RNA, 13 nt, Homo sapiens
cagguaguacugg

SEQ ID NO: 872750 - RNA, 16 nt, Homo sapiens
caggucccagagggug

SEQ ID NO: 872751 - RNA, 19 nt, Homo sapiens
cagguccucuacuuaauga

SEQ ID NO: 872752 - RNA, 22 nt, Homo sapiens
cagguccucuacuuaaugagau

SEQ ID NO: 872753 - RNA, 14 nt, Homo sapiens
cagguccuuccuuu

SEQ ID NO: 872754 - RNA, 14 nt, Homo sapiens
caggucucccugga

SEQ ID NO: 872755 - RNA, 22 nt, Homo sapiens
caggugagcugaagacaaacca

SEQ ID NO: 872756 - RNA, 17 nt, Homo sapiens
caggugcgcacuaccac

SEQ ID NO: 872757 - RNA, 15 nt, Homo sapiens
caggugcugacaaua

SEQ ID NO: 872758 - RNA, 17 nt, Homo sapiens
caggugguccugagacc

SEQ ID NO: 872759 - RNA, 19 nt, Homo sapiens
caggugugaaccaccacac

SEQ ID NO: 872760 - RNA, 16 nt, Homo sapiens
cagguguuuauacagc

SEQ ID NO: 872761 - RNA, 15 nt, Homo sapiens
cagguuagccuuugc

SEQ ID NO: 872762 - RNA, 17 nt, Homo sapiens
cagguucagacugagcu

SEQ ID NO: 872763 - RNA, 23 nt, Homo sapiens
caguaaacuuucucugcaaagac

SEQ ID NO: 872764 - RNA, 21 nt, Homo sapiens
caguaaacuuuggcuuauaaa

SEQ ID NO: 872765 - RNA, 19 nt, Homo sapiens
caguaaauauuaaccugaa

SEQ ID NO: 872766 - RNA, 19 nt, Homo sapiens
caguaaugggggaccagcu

SEQ ID NO: 872767 - RNA, 15 nt, Homo sapiens
caguagcacaaguua

SEQ ID NO: 872768 - RNA, 17 nt, Homo sapiens
caguagcacaaguuauu

SEQ ID NO: 872769 - RNA, 13 nt, Homo sapiens
caguagugcauug

SEQ ID NO: 872770 - RNA, 21 nt, Homo sapiens
caguauaggccaucaauauca

SEQ ID NO: 872771 - RNA, 17 nt, Homo sapiens
caguauauuuauaguca

SEQ ID NO: 872772 - RNA, 15 nt, Homo sapiens
caguauggaagggag

SEQ ID NO: 872773 - RNA, 17 nt, Homo sapiens
caguauuccaugggaug

SEQ ID NO: 872774 - RNA, 15 nt, Homo sapiens
cagucaacaguucaa

SEQ ID NO: 872775 - RNA, 14 nt, Homo sapiens
cagucacacuguua

SEQ ID NO: 872776 - RNA, 17 nt, Homo sapiens
cagucacccuucugggc

SEQ ID NO: 872777 - RNA, 13 nt, Homo sapiens
cagucauuucaau

SEQ ID NO: 872778 - RNA, 15 nt, Homo sapiens
cagucccaucagaga

SEQ ID NO: 872779 - RNA, 13 nt, Homo sapiens
caguccucccacc

SEQ ID NO: 872780 - RNA, 19 nt, Homo sapiens
cagucucccauucucauau

SEQ ID NO: 872781 - RNA, 13 nt, Homo sapiens
cagucucugggag

SEQ ID NO: 872782 - RNA, 19 nt, Homo sapiens
cagugaaagaguagugcau

SEQ ID NO: 872783 - RNA, 21 nt, Homo sapiens
cagugaaagaguagugcauuu

SEQ ID NO: 872784 - RNA, 14 nt, Homo sapiens
cagugaaagccaga

SEQ ID NO: 872785 - RNA, 17 nt, Homo sapiens
cagugaagaugccagug

SEQ ID NO: 872786 - RNA, 17 nt, Homo sapiens
cagugacuuuagaaaca

SEQ ID NO: 872787 - RNA, 18 nt, Homo sapiens
cagugagaaaaagcuccu

SEQ ID NO: 872788 - RNA, 18 nt, Homo sapiens
cagugagaagacuggcag

SEQ ID NO: 872789 - RNA, 22 nt, Homo sapiens
cagugagccgcaucuucuccau

SEQ ID NO: 872790 - RNA, 15 nt, Homo sapiens
cagugagcucuggau

SEQ ID NO: 872791 - RNA, 20 nt, Homo sapiens
cagugagcugagauugcgcc

SEQ ID NO: 872792 - RNA, 17 nt, Homo sapiens
cagugagucucuucaga

SEQ ID NO: 872793 - RNA, 13 nt, Homo sapiens
cagugaucuccau

SEQ ID NO: 872794 - RNA, 20 nt, Homo sapiens
cagugaugaaaaccuaacag

SEQ ID NO: 872795 - RNA, 23 nt, Homo sapiens
cagugauggcgcgggaggcacca

SEQ ID NO: 872796 - RNA, 11 nt, Homo sapiens
cagugcaagag

SEQ ID NO: 872797 - RNA, 19 nt, Homo sapiens
cagugcaagagacucuggc

SEQ ID NO: 872798 - RNA, 16 nt, Homo sapiens
cagugcauguugccau

SEQ ID NO: 872799 - RNA, 18 nt, Homo sapiens
cagugcauguugccauga

SEQ ID NO: 872800 - RNA, 13 nt, Homo sapiens
cagugcccaugca

SEQ ID NO: 872801 - RNA, 18 nt, Homo sapiens
cagugcccaugcaauggc

SEQ ID NO: 872802 - RNA, 16 nt, Homo sapiens
cagugcccucauuuua

SEQ ID NO: 872803 - RNA, 18 nt, Homo sapiens
cagugccuccugggacca

SEQ ID NO: 872804 - RNA, 14 nt, Homo sapiens
cagugcuaccucuc

SEQ ID NO: 872805 - RNA, 17 nt, Homo sapiens
cagugcuauuuugugcc

SEQ ID NO: 872806 - RNA, 15 nt, Homo sapiens
cagugcuguacuuga

SEQ ID NO: 872807 - RNA, 22 nt, Homo sapiens
cagugcuguacuugaugacaga

SEQ ID NO: 872808 - RNA, 14 nt, Homo sapiens
caguggcaguguau

SEQ ID NO: 872809 - RNA, 17 nt, Homo sapiens
caguggcaguguaugcu

SEQ ID NO: 872810 - RNA, 15 nt, Homo sapiens
cagugguaugaucac

SEQ ID NO: 872811 - RNA, 20 nt, Homo sapiens
caguggugaagaaaacuccu

SEQ ID NO: 872812 - RNA, 19 nt, Homo sapiens
caguguaaagaauaaauga

SEQ ID NO: 872813 - RNA, 16 nt, Homo sapiens
caguguauguacuaag

SEQ ID NO: 872814 - RNA, 21 nt, Homo sapiens
caguguccccuccacugucac

SEQ ID NO: 872815 - RNA, 16 nt, Homo sapiens
cagugucuuccauaau

SEQ ID NO: 872816 - RNA, 17 nt, Homo sapiens
cagugucuuuccaccuu

SEQ ID NO: 872817 - RNA, 12 nt, Homo sapiens
cagugugacaag

SEQ ID NO: 872818 - RNA, 22 nt, Homo sapiens
caguguggcccagggaagccaa

SEQ ID NO: 872819 - RNA, 19 nt, Homo sapiens
caguguuugcaaugguguu

SEQ ID NO: 872820 - RNA, 17 nt, Homo sapiens
caguguuuucaccucau

SEQ ID NO: 872821 - RNA, 22 nt, Homo sapiens
caguuaacuuuaagacugagca

SEQ ID NO: 872822 - RNA, 22 nt, Homo sapiens
caguuaaggggagcaacagagg

SEQ ID NO: 872823 - RNA, 17 nt, Homo sapiens
caguuaucuaaguuaau

SEQ ID NO: 872824 - RNA, 16 nt, Homo sapiens
caguucaguuccucuu

SEQ ID NO: 872825 - RNA, 16 nt, Homo sapiens
caguuccuccaagagg

SEQ ID NO: 872826 - RNA, 18 nt, Homo sapiens
caguuccugaguaccuuc

SEQ ID NO: 872827 - RNA, 17 nt, Homo sapiens
caguucugaacuggaac

SEQ ID NO: 872828 - RNA, 14 nt, Homo sapiens
caguugacagcagg

SEQ ID NO: 872829 - RNA, 16 nt, Homo sapiens
caguuuagaacagagg

SEQ ID NO: 872830 - RNA, 15 nt, Homo sapiens
caguuugacuguggc

SEQ ID NO: 872831 - RNA, 16 nt, Homo sapiens
caguuugcuuugcccu

SEQ ID NO: 872832 - RNA, 17 nt, Homo sapiens
caguuuggaaguguuaa

SEQ ID NO: 872833 - RNA, 21 nt, Homo sapiens
caguuuuaucuuuaaucuccu

SEQ ID NO: 872834 - RNA, 15 nt, Homo sapiens
cauaaaacaaugaag

SEQ ID NO: 872835 - RNA, 16 nt, Homo sapiens
cauaaaaucugugaau

SEQ ID NO: 872836 - RNA, 17 nt, Homo sapiens
gcaccaaauucauguac

SEQ ID NO: 872837 - RNA, 15 nt, Homo sapiens
gcaccacuguguauu

SEQ ID NO: 872838 - RNA, 21 nt, Homo sapiens
gcaccaggcacgaacccaccu

SEQ ID NO: 872839 - RNA, 21 nt, Homo sapiens
gcaccauggaggcaggcuccc

SEQ ID NO: 872840 - RNA, 18 nt, Homo sapiens
gcacccaugccauagaaa

SEQ ID NO: 872841 - RNA, 16 nt, Homo sapiens
gcacccccugcagcuu

SEQ ID NO: 872842 - RNA, 15 nt, Homo sapiens
gcacccccuggagag

SEQ ID NO: 872843 - RNA, 13 nt, Homo sapiens
gcaccgagaccaa

SEQ ID NO: 872844 - RNA, 19 nt, Homo sapiens
gcaccgagagagauggaau

SEQ ID NO: 872845 - RNA, 22 nt, Homo sapiens
gcaccgagagagauggaauaaa

SEQ ID NO: 872846 - RNA, 14 nt, Homo sapiens
gcaccgucauggcu

SEQ ID NO: 872847 - RNA, 13 nt, Homo sapiens
gcaccuacuuuau

SEQ ID NO: 872848 - RNA, 24 nt, Homo sapiens
gcaccuacuuuauguauggagcuc

SEQ ID NO: 872849 - RNA, 14 nt, Homo sapiens
gcaccuaucaccca

SEQ ID NO: 872850 - RNA, 21 nt, Homo sapiens
gcaccucuagugcuacugcua

SEQ ID NO: 872851 - RNA, 17 nt, Homo sapiens
gcaccuguacucaggag

SEQ ID NO: 872852 - RNA, 20 nt, Homo sapiens
gcaccuucaauacuucauga

SEQ ID NO: 872853 - RNA, 19 nt, Homo sapiens
gcaccuuuuauaccagaga

SEQ ID NO: 872854 - RNA, 23 nt, Homo sapiens
gcacggccuuguucuaacccgga

SEQ ID NO: 872855 - RNA, 16 nt, Homo sapiens
gcacgugccugugauc

SEQ ID NO: 872856 - RNA, 18 nt, Homo sapiens
gcacguguguguguuuca

SEQ ID NO: 872857 - RNA, 21 nt, Homo sapiens
gcacuauuauggaugaaggac

SEQ ID NO: 872858 - RNA, 14 nt, Homo sapiens
gcacucacaugccg

SEQ ID NO: 872859 - RNA, 17 nt, Homo sapiens
gcacucccucccagaga

SEQ ID NO: 872860 - RNA, 20 nt, Homo sapiens
gcacucccucccagagaaca

SEQ ID NO: 872861 - RNA, 19 nt, Homo sapiens
gcacuccucugucucugcu

SEQ ID NO: 872862 - RNA, 14 nt, Homo sapiens
gcacugacugggac

SEQ ID NO: 872863 - RNA, 15 nt, Homo sapiens
gcacugauguuguua

SEQ ID NO: 872864 - RNA, 12 nt, Homo sapiens
gcacugggauga

SEQ ID NO: 872865 - RNA, 22 nt, Homo sapiens
gcacuggguugacuuucaggua

SEQ ID NO: 872866 - RNA, 19 nt, Homo sapiens
gcacuggguuguccaggga

SEQ ID NO: 872867 - RNA, 18 nt, Homo sapiens
gcacuguaaaugcagccu

SEQ ID NO: 872868 - RNA, 12 nt, Homo sapiens
gcacugugacac

SEQ ID NO: 872869 - RNA, 16 nt, Homo sapiens
gcacuguuucucucac

SEQ ID NO: 872870 - RNA, 15 nt, Homo sapiens
gcacuuagcccaaga

SEQ ID NO: 872871 - RNA, 21 nt, Homo sapiens
gcacuugaacauuuuaauauu

SEQ ID NO: 872872 - RNA, 14 nt, Homo sapiens
gcagaaaagugcuu

SEQ ID NO: 872873 - RNA, 16 nt, Homo sapiens
gcagaaauguaucuau

SEQ ID NO: 872874 - RNA, 13 nt, Homo sapiens
gcagaauaaucuu

SEQ ID NO: 872875 - RNA, 16 nt, Homo sapiens
gcagacaccugccuua

SEQ ID NO: 872876 - RNA, 12 nt, Homo sapiens
gcagacaccugu

SEQ ID NO: 872877 - RNA, 15 nt, Homo sapiens
gcagaccgggggcca

SEQ ID NO: 872878 - RNA, 17 nt, Homo sapiens
gcagacucacuguggga

SEQ ID NO: 872879 - RNA, 21 nt, Homo sapiens
gcagacucuacagaggccaug

SEQ ID NO: 872880 - RNA, 14 nt, Homo sapiens
gcagagagaagccu

SEQ ID NO: 872881 - RNA, 23 nt, Homo sapiens
gcagagccaccagggcacugucu

SEQ ID NO: 872882 - RNA, 16 nt, Homo sapiens
gcagagccugagucac

SEQ ID NO: 872883 - RNA, 21 nt, Homo sapiens
gcagagccugagucacugguc

SEQ ID NO: 872884 - RNA, 15 nt, Homo sapiens
gcagagcuuccucag

SEQ ID NO: 872885 - RNA, 23 nt, Homo sapiens
gcagaggauguucuggaccuccc

SEQ ID NO: 872886 - RNA, 18 nt, Homo sapiens
gcagaggcggaaaccuug

SEQ ID NO: 872887 - RNA, 19 nt, Homo sapiens
gcagaucauguaaggaagg

SEQ ID NO: 872888 - RNA, 14 nt, Homo sapiens
gcagcaacucccac

SEQ ID NO: 872889 - RNA, 13 nt, Homo sapiens
gcagcaauaugcu

SEQ ID NO: 872890 - RNA, 22 nt, Homo sapiens
gcagcacuuuaacccucucuuc

SEQ ID NO: 872891 - RNA, 15 nt, Homo sapiens
gcagcagaagccaaa

SEQ ID NO: 872892 - RNA, 18 nt, Homo sapiens
gcagccaaacccaugagg

SEQ ID NO: 872893 - RNA, 17 nt, Homo sapiens
gcagccugcagacucac

SEQ ID NO: 872894 - RNA, 20 nt, Homo sapiens
gcagccuucugacaagcaag

SEQ ID NO: 872895 - RNA, 17 nt, Homo sapiens
gcagccuucuuuucaaa

SEQ ID NO: 872896 - RNA, 18 nt, Homo sapiens
gcagcgccucaucuucaa

SEQ ID NO: 872897 - RNA, 15 nt, Homo sapiens
gcagcgguaccccag

SEQ ID NO: 872898 - RNA, 16 nt, Homo sapiens
gcagcgguaccccagg

SEQ ID NO: 872899 - RNA, 14 nt, Homo sapiens
gcagcuaagccaca

SEQ ID NO: 872900 - RNA, 18 nt, Homo sapiens
gcagcucaggcacacuuc

SEQ ID NO: 872901 - RNA, 17 nt, Homo sapiens
gcagcuugaaacugaga

SEQ ID NO: 872902 - RNA, 22 nt, Homo sapiens
gcaggaacucccagcaacacaa

SEQ ID NO: 872903 - RNA, 20 nt, Homo sapiens
gcaggaggaucacagugacc

SEQ ID NO: 872904 - RNA, 22 nt, Homo sapiens
gcaggaggcuagcaaagcuuaa

SEQ ID NO: 872905 - RNA, 14 nt, Homo sapiens
gcaggaguagcuga

SEQ ID NO: 872906 - RNA, 12 nt, Homo sapiens
gcaggaucucag

SEQ ID NO: 872907 - RNA, 24 nt, Homo sapiens
gcaggauuucuucacaccucuccu

SEQ ID NO: 872908 - RNA, 15 nt, Homo sapiens
gcaggcuagaaccug

SEQ ID NO: 872909 - RNA, 15 nt, Homo sapiens
gcagggaaacagcua

SEQ ID NO: 872910 - RNA, 18 nt, Homo sapiens
gcagggacaauuugcugc

SEQ ID NO: 872911 - RNA, 16 nt, Homo sapiens
gcagggacugccaguc

SEQ ID NO: 872912 - RNA, 19 nt, Homo sapiens
gcagggcaaaugacaugca

SEQ ID NO: 872913 - RNA, 20 nt, Homo sapiens
gcagggggugugucugcuca

SEQ ID NO: 872914 - RNA, 19 nt, Homo sapiens
gcagggguccuugguguga

SEQ ID NO: 872915 - RNA, 21 nt, Homo sapiens
gcaggguauugcgaaacaacu

SEQ ID NO: 872916 - RNA, 21 nt, Homo sapiens
gcaggugcuucaggauaccau

SEQ ID NO: 872917 - RNA, 16 nt, Homo sapiens
gcagguggcaucucua

SEQ ID NO: 872918 - RNA, 15 nt, Homo sapiens
gcagguguaccuccc

SEQ ID NO: 872919 - RNA, 13 nt, Homo sapiens
gcaggugucuauc

SEQ ID NO: 872920 - RNA, 13 nt, Homo sapiens
gcaguacauguua

SEQ ID NO: 872921 - RNA, 14 nt, Homo sapiens
gcaguauuccaugg

SEQ ID NO: 872922 - RNA, 20 nt, Homo sapiens
gcagucacacuguuacucca

SEQ ID NO: 872923 - RNA, 18 nt, Homo sapiens
gcagugagcuucuauuaa

SEQ ID NO: 872924 - RNA, 15 nt, Homo sapiens
gcagugauacaugua

SEQ ID NO: 872925 - RNA, 16 nt, Homo sapiens
gcaguguaggcuuuac

SEQ ID NO: 872926 - RNA, 18 nt, Homo sapiens
gcagugugucacacugag

SEQ ID NO: 872927 - RNA, 21 nt, Homo sapiens
gcaguguuucccguauugaca

SEQ ID NO: 872928 - RNA, 17 nt, Homo sapiens
gcaguguuuucaccuca

SEQ ID NO: 872929 - RNA, 13 nt, Homo sapiens
gcauaaaugcauu

SEQ ID NO: 872930 - RNA, 20 nt, Homo sapiens
gcauaaaugugguacaagca

SEQ ID NO: 872931 - RNA, 19 nt, Homo sapiens
gcauaagaaaacuaagaaa

SEQ ID NO: 872932 - RNA, 14 nt, Homo sapiens
gcauaccuuggacu

SEQ ID NO: 872933 - RNA, 16 nt, Homo sapiens
gcauagaaacugagga

SEQ ID NO: 872934 - RNA, 17 nt, Homo sapiens
gcauaguuuguucaaau

SEQ ID NO: 872935 - RNA, 19 nt, Homo sapiens
gcauauaaaaugcuuuauu

SEQ ID NO: 872936 - RNA, 13 nt, Homo sapiens
gcauaugucuaua

SEQ ID NO: 872937 - RNA, 21 nt, Homo sapiens
gcaucaauuuuucuuauuuca

SEQ ID NO: 872938 - RNA, 14 nt, Homo sapiens
gcaucccaggggac

SEQ ID NO: 872939 - RNA, 19 nt, Homo sapiens
gcauccccuuggcugugag

SEQ ID NO: 872940 - RNA, 20 nt, Homo sapiens
gcauccccuuggcugugagg

SEQ ID NO: 872941 - RNA, 14 nt, Homo sapiens
gcauccugcagugg

SEQ ID NO: 872942 - RNA, 18 nt, Homo sapiens
gcauccuggcacccggcc

SEQ ID NO: 872943 - RNA, 16 nt, Homo sapiens
gcauccugugugcuga

SEQ ID NO: 872944 - RNA, 18 nt, Homo sapiens
gcauccugugugcugaca

SEQ ID NO: 872945 - RNA, 23 nt, Homo sapiens
gcaucguggugugucaaugccac

SEQ ID NO: 872946 - RNA, 20 nt, Homo sapiens
gcaucuacacagccuggacu

SEQ ID NO: 872947 - RNA, 22 nt, Homo sapiens
gcaucuagaauuaguggagcuu

SEQ ID NO: 872948 - RNA, 12 nt, Homo sapiens
gcaucucaaaaa

SEQ ID NO: 872949 - RNA, 17 nt, Homo sapiens
gcaucucuguguaccca

SEQ ID NO: 872950 - RNA, 15 nt, Homo sapiens
gcaucugacaugcau

SEQ ID NO: 872951 - RNA, 15 nt, Homo sapiens
cauaaacuucaucuu

SEQ ID NO: 872952 - RNA, 16 nt, Homo sapiens
cauaacaugcuuuaga

SEQ ID NO: 872953 - RNA, 17 nt, Homo sapiens
cauaacuugcugaauuu

SEQ ID NO: 872954 - RNA, 18 nt, Homo sapiens
cauaagcaaagacuauga

SEQ ID NO: 872955 - RNA, 20 nt, Homo sapiens
cauaagccuccauuuaguuc

SEQ ID NO: 872956 - RNA, 16 nt, Homo sapiens
cauaauguuacauuau

SEQ ID NO: 872957 - RNA, 21 nt, Homo sapiens
cauaauguuacauuauuauca

SEQ ID NO: 872958 - RNA, 19 nt, Homo sapiens
cauaauuuguacauaugua

SEQ ID NO: 872959 - RNA, 15 nt, Homo sapiens
cauacaaaacuguuc

SEQ ID NO: 872960 - RNA, 21 nt, Homo sapiens
cauacaccuaugucauuucau

SEQ ID NO: 872961 - RNA, 19 nt, Homo sapiens
cauacacucaaacaaucau

SEQ ID NO: 872962 - RNA, 21 nt, Homo sapiens
cauacagagguaacuaucaau

SEQ ID NO: 872963 - RNA, 14 nt, Homo sapiens
cauacauacauaca

SEQ ID NO: 872964 - RNA, 15 nt, Homo sapiens
cauacauacauacau

SEQ ID NO: 872965 - RNA, 18 nt, Homo sapiens
cauacauacauacauaua

SEQ ID NO: 872966 - RNA, 14 nt, Homo sapiens
cauacauacauaua

SEQ ID NO: 872967 - RNA, 15 nt, Homo sapiens
cauacauacauauau

SEQ ID NO: 872968 - RNA, 17 nt, Homo sapiens
cauacauaguacauaca

SEQ ID NO: 872969 - RNA, 13 nt, Homo sapiens
cauaccucugacc

SEQ ID NO: 872970 - RNA, 18 nt, Homo sapiens
cauaccucugaccaacag

SEQ ID NO: 872971 - RNA, 22 nt, Homo sapiens
cauacguguuaggaggcugcau

SEQ ID NO: 872972 - RNA, 18 nt, Homo sapiens
cauacugcaugcucagga

SEQ ID NO: 872973 - RNA, 20 nt, Homo sapiens
cauacuuggacaguuaggga

SEQ ID NO: 872974 - RNA, 19 nt, Homo sapiens
cauagaaacaugacacuga

SEQ ID NO: 872975 - RNA, 19 nt, Homo sapiens
cauagagaagaucuaauac

SEQ ID NO: 872976 - RNA, 16 nt, Homo sapiens
cauagaugaacuauua

SEQ ID NO: 872977 - RNA, 19 nt, Homo sapiens
cauagcaagacacaucccu

SEQ ID NO: 872978 - RNA, 22 nt, Homo sapiens
cauagcauuagcugcuuccucc

SEQ ID NO: 872979 - RNA, 19 nt, Homo sapiens
cauagcgcuggcucaggaa

SEQ ID NO: 872980 - RNA, 20 nt, Homo sapiens
cauagcgcuggcucaggaag

SEQ ID NO: 872981 - RNA, 22 nt, Homo sapiens
cauagucacauggccuaugcac

SEQ ID NO: 872982 - RNA, 14 nt, Homo sapiens
cauagugcacacuu

SEQ ID NO: 872983 - RNA, 15 nt, Homo sapiens
cauaguuuauuucaa

SEQ ID NO: 872984 - RNA, 15 nt, Homo sapiens
cauauaccuauaaug

SEQ ID NO: 872985 - RNA, 12 nt, Homo sapiens
cauauacuuuaa

SEQ ID NO: 872986 - RNA, 19 nt, Homo sapiens
cauauauauucuacauaua

SEQ ID NO: 872987 - RNA, 21 nt, Homo sapiens
cauaucaaacauauguauaca

SEQ ID NO: 872988 - RNA, 20 nt, Homo sapiens
cauaucuuccaggucccaga

SEQ ID NO: 872989 - RNA, 13 nt, Homo sapiens
cauauggaaaucc

SEQ ID NO: 872990 - RNA, 19 nt, Homo sapiens
cauauguagacuauauaca

SEQ ID NO: 872991 - RNA, 13 nt, Homo sapiens
cauaugucugcuu

SEQ ID NO: 872992 - RNA, 15 nt, Homo sapiens
cauauucccacagca

SEQ ID NO: 872993 - RNA, 19 nt, Homo sapiens
cauauucuuuaaauuucau

SEQ ID NO: 872994 - RNA, 14 nt, Homo sapiens
cauauuuauagaau

SEQ ID NO: 872995 - RNA, 23 nt, Homo sapiens
cauauuuuaggacagguaaaaua

SEQ ID NO: 872996 - RNA, 23 nt, Homo sapiens
cauauuuucacagguguggugua

SEQ ID NO: 872997 - RNA, 23 nt, Homo sapiens
caucaacaagaguugucuugucc

SEQ ID NO: 872998 - RNA, 17 nt, Homo sapiens
caucaauucccauugca

SEQ ID NO: 872999 - RNA, 18 nt, Homo sapiens
caucaggccuaaucucau

SEQ ID NO: 873000 - RNA, 15 nt, Homo sapiens
caucagggcaguggc

SEQ ID NO: 873001 - RNA, 16 nt, Homo sapiens
caucauacaugacuca

SEQ ID NO: 873002 - RNA, 21 nt, Homo sapiens
caucauucauuuuuguuguug

SEQ ID NO: 873003 - RNA, 19 nt, Homo sapiens
cauccaacuccuggagauu

SEQ ID NO: 873004 - RNA, 21 nt, Homo sapiens
cauccaaggagaaacagagac

SEQ ID NO: 873005 - RNA, 16 nt, Homo sapiens
cauccaauucuuugaa

SEQ ID NO: 873006 - RNA, 17 nt, Homo sapiens
cauccaguucaugagaa

SEQ ID NO: 873007 - RNA, 22 nt, Homo sapiens
cauccauagugcacuagcauuu

SEQ ID NO: 873008 - RNA, 12 nt, Homo sapiens
cauccaucagcu

SEQ ID NO: 873009 - RNA, 19 nt, Homo sapiens
cauccaugagaguuucaaa

SEQ ID NO: 873010 - RNA, 22 nt, Homo sapiens
caucccacaugaucuugagauu

SEQ ID NO: 873011 - RNA, 10 nt, Homo sapiens
caucccaugg

SEQ ID NO: 873012 - RNA, 21 nt, Homo sapiens
caucccaugggggugcugcag

SEQ ID NO: 873013 - RNA, 16 nt, Homo sapiens
caucccccagcacuga

SEQ ID NO: 873014 - RNA, 13 nt, Homo sapiens
cauccccuacacu

SEQ ID NO: 873015 - RNA, 15 nt, Homo sapiens
cauccccuuguguca

SEQ ID NO: 873016 - RNA, 15 nt, Homo sapiens
cauccccuuuccucc

SEQ ID NO: 873017 - RNA, 21 nt, Homo sapiens
cauccuaagugggaagugaag

SEQ ID NO: 873018 - RNA, 21 nt, Homo sapiens
cauccuaaucugaauggugcu

SEQ ID NO: 873019 - RNA, 14 nt, Homo sapiens
cauccuccuucuuc

SEQ ID NO: 873020 - RNA, 17 nt, Homo sapiens
cauccuccuucuucagg

SEQ ID NO: 873021 - RNA, 15 nt, Homo sapiens
cauccugugugcuga

SEQ ID NO: 873022 - RNA, 17 nt, Homo sapiens
cauccuucaagaacucu

SEQ ID NO: 873023 - RNA, 19 nt, Homo sapiens
caucuagaggcuuccuuca

SEQ ID NO: 873024 - RNA, 13 nt, Homo sapiens
caucuauguaucu

SEQ ID NO: 873025 - RNA, 19 nt, Homo sapiens
caucuauuauaaaaccaug

SEQ ID NO: 873026 - RNA, 13 nt, Homo sapiens
caucucauuccaa

SEQ ID NO: 873027 - RNA, 16 nt, Homo sapiens
caucuccacccugagc

SEQ ID NO: 873028 - RNA, 13 nt, Homo sapiens
caucucugccaag

SEQ ID NO: 873029 - RNA, 11 nt, Homo sapiens
caucucugucu

SEQ ID NO: 873030 - RNA, 14 nt, Homo sapiens
caucugaaccacuu

SEQ ID NO: 873031 - RNA, 17 nt, Homo sapiens
caucugaaccacuuugc

SEQ ID NO: 873032 - RNA, 22 nt, Homo sapiens
caucugaaccacuuugccucug

SEQ ID NO: 873033 - RNA, 12 nt, Homo sapiens
caucugacucac

SEQ ID NO: 873034 - RNA, 18 nt, Homo sapiens
caucugacucacaagaag

SEQ ID NO: 873035 - RNA, 20 nt, Homo sapiens
caucugacucacaagaagac

SEQ ID NO: 873036 - RNA, 12 nt, Homo sapiens
caucuguacuca

SEQ ID NO: 873037 - RNA, 14 nt, Homo sapiens
caucuguccagagg

SEQ ID NO: 873038 - RNA, 23 nt, Homo sapiens
caucugucuugccagccagaagc

SEQ ID NO: 873039 - RNA, 23 nt, Homo sapiens
caucugugucucuggaacccagg

SEQ ID NO: 873040 - RNA, 14 nt, Homo sapiens
caucuucucagugu

SEQ ID NO: 873041 - RNA, 22 nt, Homo sapiens
caucuucuggagucuccagugg

SEQ ID NO: 873042 - RNA, 21 nt, Homo sapiens
caucuugcccccucaucucac

SEQ ID NO: 873043 - RNA, 22 nt, Homo sapiens
caucuugcucugcugacagaca

SEQ ID NO: 873044 - RNA, 21 nt, Homo sapiens
caugaaaaauugcuaugacua

SEQ ID NO: 873045 - RNA, 19 nt, Homo sapiens
caugaaauggauacuuaua

SEQ ID NO: 873046 - RNA, 16 nt, Homo sapiens
caugaacacacaugga

SEQ ID NO: 873047 - RNA, 18 nt, Homo sapiens
caugaagcccaagugaaa

SEQ ID NO: 873048 - RNA, 21 nt, Homo sapiens
caugaagcccaagugaaauca

SEQ ID NO: 873049 - RNA, 12 nt, Homo sapiens
caugaagcugga

SEQ ID NO: 873050 - RNA, 20 nt, Homo sapiens
caugaagcuggaagcacugc

SEQ ID NO: 873051 - RNA, 20 nt, Homo sapiens
caugaaguguguuuccuuca

SEQ ID NO: 873052 - RNA, 11 nt, Homo sapiens
caugaaucuuu

SEQ ID NO: 873053 - RNA, 12 nt, Homo sapiens
caugaaucuuuu

SEQ ID NO: 873054 - RNA, 16 nt, Homo sapiens
caugacacucuaguga

SEQ ID NO: 873055 - RNA, 14 nt, Homo sapiens
caugacacugaccu

SEQ ID NO: 873056 - RNA, 13 nt, Homo sapiens
caugacuucugcc

SEQ ID NO: 873057 - RNA, 14 nt, Homo sapiens
caugagaauaagag

SEQ ID NO: 873058 - RNA, 19 nt, Homo sapiens
caugagaccacuguuauca

SEQ ID NO: 873059 - RNA, 21 nt, Homo sapiens
caugagccucagcauccuggc

SEQ ID NO: 873060 - RNA, 16 nt, Homo sapiens
caugagcgcugaugau

SEQ ID NO: 873061 - RNA, 16 nt, Homo sapiens
caugaggacaaagugu

SEQ ID NO: 873062 - RNA, 22 nt, Homo sapiens
caugagugauucuugacauuca

SEQ ID NO: 873063 - RNA, 17 nt, Homo sapiens
caugaguuuaugggaau

SEQ ID NO: 873064 - RNA, 22 nt, Homo sapiens
caugauaaucugggcaucucgu

SEQ ID NO: 873065 - RNA, 15 nt, Homo sapiens
caugaugaauuacuu

SEQ ID NO: 873066 - RNA, 17 nt, Homo sapiens
gcaucugccucuauuca

SEQ ID NO: 873067 - RNA, 23 nt, Homo sapiens
gcaucugggauucccaccaaggu

SEQ ID NO: 873068 - RNA, 20 nt, Homo sapiens
gcaugaaagagaaagacuga

SEQ ID NO: 873069 - RNA, 17 nt, Homo sapiens
gcaugaagguuucugaa

SEQ ID NO: 873070 - RNA, 16 nt, Homo sapiens
gcaugacaauugucag

SEQ ID NO: 873071 - RNA, 13 nt, Homo sapiens
gcaugaccauccu

SEQ ID NO: 873072 - RNA, 22 nt, Homo sapiens
gcaugcacuucuuacaauaauu

SEQ ID NO: 873073 - RNA, 21 nt, Homo sapiens
gcaugcauuuugcagcaguga

SEQ ID NO: 873074 - RNA, 14 nt, Homo sapiens
gcaugccagagccu

SEQ ID NO: 873075 - RNA, 16 nt, Homo sapiens
gcaugccuccaaaaau

SEQ ID NO: 873076 - RNA, 15 nt, Homo sapiens
gcaugcucagcccuu

SEQ ID NO: 873077 - RNA, 20 nt, Homo sapiens
gcaugcuuaaauauugaaua

SEQ ID NO: 873078 - RNA, 17 nt, Homo sapiens
gcauggagagccucuua

SEQ ID NO: 873079 - RNA, 24 nt, Homo sapiens
gcauguaugucuuggacacuguac

SEQ ID NO: 873080 - RNA, 13 nt, Homo sapiens
gcauguaugugca

SEQ ID NO: 873081 - RNA, 14 nt, Homo sapiens
gcaugucacuccca

SEQ ID NO: 873082 - RNA, 12 nt, Homo sapiens
gcauguccucaa

SEQ ID NO: 873083 - RNA, 11 nt, Homo sapiens
gcaugugccag

SEQ ID NO: 873084 - RNA, 15 nt, Homo sapiens
gcauguugccaugag

SEQ ID NO: 873085 - RNA, 14 nt, Homo sapiens
gcauuaaaaaugca

SEQ ID NO: 873086 - RNA, 18 nt, Homo sapiens
gcauuaaaaaugcauaua

SEQ ID NO: 873087 - RNA, 11 nt, Homo sapiens
gcauucacaag

SEQ ID NO: 873088 - RNA, 14 nt, Homo sapiens
gcauuccaugacca

SEQ ID NO: 873089 - RNA, 14 nt, Homo sapiens
gcauugcauggaca

SEQ ID NO: 873090 - RNA, 17 nt, Homo sapiens
gcauuguaaaugugcuu

SEQ ID NO: 873091 - RNA, 18 nt, Homo sapiens
gcauuuaaauuagauaac

SEQ ID NO: 873092 - RNA, 15 nt, Homo sapiens
gcauuucugucucuc

SEQ ID NO: 873093 - RNA, 15 nt, Homo sapiens
gcauuugauuuugcc

SEQ ID NO: 873094 - RNA, 19 nt, Homo sapiens
gcauuuguuccaugccugc

SEQ ID NO: 873095 - RNA, 15 nt, Homo sapiens
gcauuuucauuucac

SEQ ID NO: 873096 - RNA, 21 nt, Homo sapiens
gcauuuucauuucacugcaca

SEQ ID NO: 873097 - RNA, 17 nt, Homo sapiens
gccaaacacacuguaaa

SEQ ID NO: 873098 - RNA, 18 nt, Homo sapiens
gccaaagugacacagagc

SEQ ID NO: 873099 - RNA, 19 nt, Homo sapiens
gccaagaaucaagcuagaa

SEQ ID NO: 873100 - RNA, 18 nt, Homo sapiens
gccaagaccccagcuuca

SEQ ID NO: 873101 - RNA, 16 nt, Homo sapiens
gccaagcccucaauaa

SEQ ID NO: 873102 - RNA, 16 nt, Homo sapiens
gccaagcugaagugaa

SEQ ID NO: 873103 - RNA, 23 nt, Homo sapiens
gccaaggugggguauuuaccaca

SEQ ID NO: 873104 - RNA, 20 nt, Homo sapiens
gccaaugcacacacacagag

SEQ ID NO: 873105 - RNA, 14 nt, Homo sapiens
gccaauuagcaauu

SEQ ID NO: 873106 - RNA, 20 nt, Homo sapiens
gccacagacaacauggaaau

SEQ ID NO: 873107 - RNA, 17 nt, Homo sapiens
gccacaucacuacagua

SEQ ID NO: 873108 - RNA, 21 nt, Homo sapiens
gccacaucugugucucuggaa

SEQ ID NO: 873109 - RNA, 17 nt, Homo sapiens
gccacauggcugggauu

SEQ ID NO: 873110 - RNA, 19 nt, Homo sapiens
gccacccagcaacacagag

SEQ ID NO: 873111 - RNA, 21 nt, Homo sapiens
gccaccucuugggcaugcuca

SEQ ID NO: 873112 - RNA, 14 nt, Homo sapiens
gccacgaggagcuu

SEQ ID NO: 873113 - RNA, 21 nt, Homo sapiens
gccacgaggagcuuccagugc

SEQ ID NO: 873114 - RNA, 21 nt, Homo sapiens
gccacguauguuuuuguguau

SEQ ID NO: 873115 - RNA, 13 nt, Homo sapiens
gccacuaccuuug

SEQ ID NO: 873116 - RNA, 20 nt, Homo sapiens
gccacuccagaccccuggcu

SEQ ID NO: 873117 - RNA, 23 nt, Homo sapiens
gccacuugacauuccuugucacc

SEQ ID NO: 873118 - RNA, 22 nt, Homo sapiens
gccagaaagcauaaaauucuua

SEQ ID NO: 873119 - RNA, 21 nt, Homo sapiens
gccagacacagauacaugggg

SEQ ID NO: 873120 - RNA, 11 nt, Homo sapiens
gccagcauuuu

SEQ ID NO: 873121 - RNA, 13 nt, Homo sapiens
gccagccaucaca

SEQ ID NO: 873122 - RNA, 23 nt, Homo sapiens
gccagcccugccuggaggaccug

SEQ ID NO: 873123 - RNA, 20 nt, Homo sapiens
gccaggagguuggugacuga

SEQ ID NO: 873124 - RNA, 20 nt, Homo sapiens
gccaggcaggugccuggaca

SEQ ID NO: 873125 - RNA, 15 nt, Homo sapiens
gccaggccaccagga

SEQ ID NO: 873126 - RNA, 23 nt, Homo sapiens
gccaggccagagggagugacaga

SEQ ID NO: 873127 - RNA, 18 nt, Homo sapiens
gccaggcguuggugccac

SEQ ID NO: 873128 - RNA, 14 nt, Homo sapiens
gccaggcucugccu

SEQ ID NO: 873129 - RNA, 12 nt, Homo sapiens
gccagguggcca

SEQ ID NO: 873130 - RNA, 22 nt, Homo sapiens
gccaguacagagaaauucugug

SEQ ID NO: 873131 - RNA, 11 nt, Homo sapiens
gccaguauuuu

SEQ ID NO: 873132 - RNA, 14 nt, Homo sapiens
gccauaaagccauu

SEQ ID NO: 873133 - RNA, 18 nt, Homo sapiens
gccaucacccccuacccc

SEQ ID NO: 873134 - RNA, 18 nt, Homo sapiens
gccaucaugugccuggaa

SEQ ID NO: 873135 - RNA, 14 nt, Homo sapiens
gccauccauucaca

SEQ ID NO: 873136 - RNA, 18 nt, Homo sapiens
gccauguaccaguguacu

SEQ ID NO: 873137 - RNA, 22 nt, Homo sapiens
gccauguaccaguguacugcuu

SEQ ID NO: 873138 - RNA, 23 nt, Homo sapiens
gccauuauuucaaccgcuugcca

SEQ ID NO: 873139 - RNA, 21 nt, Homo sapiens
gcccaaauggcucugugaaau

SEQ ID NO: 873140 - RNA, 15 nt, Homo sapiens
gcccaagaggacuga

SEQ ID NO: 873141 - RNA, 18 nt, Homo sapiens
gcccaagugccaucccac

SEQ ID NO: 873142 - RNA, 15 nt, Homo sapiens
gcccaauguaaugca

SEQ ID NO: 873143 - RNA, 23 nt, Homo sapiens
gcccacccacuccuuauauugcu

SEQ ID NO: 873144 - RNA, 20 nt, Homo sapiens
gcccacgcuggagugcagug

SEQ ID NO: 873145 - RNA, 23 nt, Homo sapiens
gcccacguggaggcccaccugcc

SEQ ID NO: 873146 - RNA, 14 nt, Homo sapiens
gcccacuacgugcc

SEQ ID NO: 873147 - RNA, 16 nt, Homo sapiens
gcccacuucugccaua

SEQ ID NO: 873148 - RNA, 18 nt, Homo sapiens
gcccagaaagaggcagug

SEQ ID NO: 873149 - RNA, 19 nt, Homo sapiens
gcccagaauucccagcugu

SEQ ID NO: 873150 - RNA, 13 nt, Homo sapiens
gcccagcccagcu

SEQ ID NO: 873151 - RNA, 16 nt, Homo sapiens
gcccagcuacauuccu

SEQ ID NO: 873152 - RNA, 16 nt, Homo sapiens
gcccagcugcaccugc

SEQ ID NO: 873153 - RNA, 15 nt, Homo sapiens
gcccaggcaggccac

SEQ ID NO: 873154 - RNA, 17 nt, Homo sapiens
gcccaggcaggucuuga

SEQ ID NO: 873155 - RNA, 17 nt, Homo sapiens
gcccaggcuggucuuga

SEQ ID NO: 873156 - RNA, 16 nt, Homo sapiens
gcccagggaagccaaa

SEQ ID NO: 873157 - RNA, 15 nt, Homo sapiens
gcccagggcauccca

SEQ ID NO: 873158 - RNA, 20 nt, Homo sapiens
gcccagggcaucccaugggg

SEQ ID NO: 873159 - RNA, 17 nt, Homo sapiens
gcccaggucaacaucua

SEQ ID NO: 873160 - RNA, 15 nt, Homo sapiens
gcccagugaccugac

SEQ ID NO: 873161 - RNA, 18 nt, Homo sapiens
gcccaucucaggugccac

SEQ ID NO: 873162 - RNA, 21 nt, Homo sapiens
gccccagagaggggacauuuc

SEQ ID NO: 873163 - RNA, 22 nt, Homo sapiens
gccccagagaggggacauuucc

SEQ ID NO: 873164 - RNA, 14 nt, Homo sapiens
gccccagcuuuauc

SEQ ID NO: 873165 - RNA, 17 nt, Homo sapiens
gcccccaccuggcucac

SEQ ID NO: 873166 - RNA, 14 nt, Homo sapiens
gccccccuccuugc

SEQ ID NO: 873167 - RNA, 21 nt, Homo sapiens
gccccccuccuugcucugcag

SEQ ID NO: 873168 - RNA, 20 nt, Homo sapiens
gcccccugggcuugugaaca

SEQ ID NO: 873169 - RNA, 18 nt, Homo sapiens
gccccguuuuaaggacau

SEQ ID NO: 873170 - RNA, 14 nt, Homo sapiens
gccccucaccugcc

SEQ ID NO: 873171 - RNA, 23 nt, Homo sapiens
gccccucccugcuaccaaggccc

SEQ ID NO: 873172 - RNA, 14 nt, Homo sapiens
gccccucuggccac

SEQ ID NO: 873173 - RNA, 23 nt, Homo sapiens
gccccugguuaagggagaucugg

SEQ ID NO: 873174 - RNA, 22 nt, Homo sapiens
gccccuuacuaugaucucagga

SEQ ID NO: 873175 - RNA, 16 nt, Homo sapiens
gcccgaccccaucuca

SEQ ID NO: 873176 - RNA, 20 nt, Homo sapiens
gcccgucauguuccucaaaa

SEQ ID NO: 873177 - RNA, 21 nt, Homo sapiens
gcccgucauguuccucaaaag

SEQ ID NO: 873178 - RNA, 17 nt, Homo sapiens
gcccuagagcacacugu

SEQ ID NO: 873179 - RNA, 19 nt, Homo sapiens
gcccugguguguuuccaga

SEQ ID NO: 873180 - RNA, 21 nt, Homo sapiens
gcccuucccacuggaggucac

SEQ ID NO: 873181 - RNA, 23 nt, Homo sapiens
caugauggcaccacugcacucca

SEQ ID NO: 873182 - RNA, 14 nt, Homo sapiens
caugauggugcuga

SEQ ID NO: 873183 - RNA, 18 nt, Homo sapiens
caugauggugcugaccuc

SEQ ID NO: 873184 - RNA, 17 nt, Homo sapiens
caugauugugaccucca

SEQ ID NO: 873185 - RNA, 16 nt, Homo sapiens
caugauuuuauacaua

SEQ ID NO: 873186 - RNA, 22 nt, Homo sapiens
caugauuuuuuuuuuucagucc

SEQ ID NO: 873187 - RNA, 17 nt, Homo sapiens
caugcaauaaugugcaa

SEQ ID NO: 873188 - RNA, 12 nt, Homo sapiens
caugcacugacc

SEQ ID NO: 873189 - RNA, 19 nt, Homo sapiens
caugcacuuggcugcauaa

SEQ ID NO: 873190 - RNA, 20 nt, Homo sapiens
caugcacuuggcugcauaaa

SEQ ID NO: 873191 - RNA, 13 nt, Homo sapiens
caugcagccucuu

SEQ ID NO: 873192 - RNA, 21 nt, Homo sapiens
caugccaaugcacgcacacau

SEQ ID NO: 873193 - RNA, 19 nt, Homo sapiens
caugccacccuguuuucag

SEQ ID NO: 873194 - RNA, 13 nt, Homo sapiens
caugcccucaauc

SEQ ID NO: 873195 - RNA, 23 nt, Homo sapiens
caugcccuggauccaucaggcca

SEQ ID NO: 873196 - RNA, 13 nt, Homo sapiens
caugccuacagau

SEQ ID NO: 873197 - RNA, 20 nt, Homo sapiens
caugccucugauaugggacu

SEQ ID NO: 873198 - RNA, 14 nt, Homo sapiens
caugcgcugcucaa

SEQ ID NO: 873199 - RNA, 17 nt, Homo sapiens
caugcgggccaccaagu

SEQ ID NO: 873200 - RNA, 16 nt, Homo sapiens
caugcugcuguugcug

SEQ ID NO: 873201 - RNA, 11 nt, Homo sapiens
caugcuuucuc

SEQ ID NO: 873202 - RNA, 14 nt, Homo sapiens
caugcuuuugccac

SEQ ID NO: 873203 - RNA, 18 nt, Homo sapiens
cauggaacagugcaggac

SEQ ID NO: 873204 - RNA, 13 nt, Homo sapiens
cauggacacagac

SEQ ID NO: 873205 - RNA, 19 nt, Homo sapiens
cauggacaccccuuaucca

SEQ ID NO: 873206 - RNA, 21 nt, Homo sapiens
cauggacagauagacagugcu

SEQ ID NO: 873207 - RNA, 15 nt, Homo sapiens
cauggagaaacaucc

SEQ ID NO: 873208 - RNA, 18 nt, Homo sapiens
cauggaugagcacacaca

SEQ ID NO: 873209 - RNA, 13 nt, Homo sapiens
cauggaugcacac

SEQ ID NO: 873210 - RNA, 22 nt, Homo sapiens
cauggaugcacgcacaugccaa

SEQ ID NO: 873211 - RNA, 23 nt, Homo sapiens
cauggcaccuuuugcacauaaca

SEQ ID NO: 873212 - RNA, 23 nt, Homo sapiens
cauggccuaagggccacauccca

SEQ ID NO: 873213 - RNA, 16 nt, Homo sapiens
cauggccuaugcacau

SEQ ID NO: 873214 - RNA, 18 nt, Homo sapiens
cauggcguaaugggccug

SEQ ID NO: 873215 - RNA, 22 nt, Homo sapiens
cauggggcauagaaacugagga

SEQ ID NO: 873216 - RNA, 16 nt, Homo sapiens
caugguacuaguguuu

SEQ ID NO: 873217 - RNA, 16 nt, Homo sapiens
cauggugaaaauguac

SEQ ID NO: 873218 - RNA, 18 nt, Homo sapiens
cauggugaaaauguacug

SEQ ID NO: 873219 - RNA, 15 nt, Homo sapiens
caugguguccagaca

SEQ ID NO: 873220 - RNA, 22 nt, Homo sapiens
cauguaaccaagaguauuccau

SEQ ID NO: 873221 - RNA, 23 nt, Homo sapiens
cauguagauuuuaguucacuaaa

SEQ ID NO: 873222 - RNA, 14 nt, Homo sapiens
cauguauguaggca

SEQ ID NO: 873223 - RNA, 12 nt, Homo sapiens
caugucaccuca

SEQ ID NO: 873224 - RNA, 21 nt, Homo sapiens
caugucaccucagcugauauu

SEQ ID NO: 873225 - RNA, 13 nt, Homo sapiens
cauguccucaaaa

SEQ ID NO: 873226 - RNA, 15 nt, Homo sapiens
caugucucaauagua

SEQ ID NO: 873227 - RNA, 15 nt, Homo sapiens
caugugacacauaug

SEQ ID NO: 873228 - RNA, 20 nt, Homo sapiens
caugugacacauaugcaccu

SEQ ID NO: 873229 - RNA, 18 nt, Homo sapiens
caugugacuuuuaucugu

SEQ ID NO: 873230 - RNA, 17 nt, Homo sapiens
caugugcacaugcacgu

SEQ ID NO: 873231 - RNA, 16 nt, Homo sapiens
cauguggaagcacuuu

SEQ ID NO: 873232 - RNA, 20 nt, Homo sapiens
cauguggaguggacauucaa

SEQ ID NO: 873233 - RNA, 20 nt, Homo sapiens
cauguggcauguucaucgua

SEQ ID NO: 873234 - RNA, 17 nt, Homo sapiens
cauguggcuaaaugccu

SEQ ID NO: 873235 - RNA, 22 nt, Homo sapiens
cauguggcuaaaugccuaauaa

SEQ ID NO: 873236 - RNA, 18 nt, Homo sapiens
cauguguagccugugcau

SEQ ID NO: 873237 - RNA, 23 nt, Homo sapiens
cauguguccccucacucugucag

SEQ ID NO: 873238 - RNA, 21 nt, Homo sapiens
cauguguucucuauuuugccu

SEQ ID NO: 873239 - RNA, 19 nt, Homo sapiens
cauguguuguacaauacca

SEQ ID NO: 873240 - RNA, 16 nt, Homo sapiens
cauguguuuacuuuau

SEQ ID NO: 873241 - RNA, 17 nt, Homo sapiens
cauguuauccacaagca

SEQ ID NO: 873242 - RNA, 14 nt, Homo sapiens
cauguuccucaaaa

SEQ ID NO: 873243 - RNA, 19 nt, Homo sapiens
cauguuguaagcacugacu

SEQ ID NO: 873244 - RNA, 22 nt, Homo sapiens
cauguuuuguauguuaaauuca

SEQ ID NO: 873245 - RNA, 20 nt, Homo sapiens
cauuaaaaaugaaagccaaa

SEQ ID NO: 873246 - RNA, 15 nt, Homo sapiens
cauuaaacacuguaa

SEQ ID NO: 873247 - RNA, 14 nt, Homo sapiens
cauuaauacaaaga

SEQ ID NO: 873248 - RNA, 15 nt, Homo sapiens
cauuaauguuaauuc

SEQ ID NO: 873249 - RNA, 17 nt, Homo sapiens
cauuaccauggagacaa

SEQ ID NO: 873250 - RNA, 13 nt, Homo sapiens
cauuacugcaugc

SEQ ID NO: 873251 - RNA, 15 nt, Homo sapiens
cauuacugcaugcac

SEQ ID NO: 873252 - RNA, 21 nt, Homo sapiens
cauuacugcaugcacuucuua

SEQ ID NO: 873253 - RNA, 14 nt, Homo sapiens
cauuacuugcacaa

SEQ ID NO: 873254 - RNA, 17 nt, Homo sapiens
cauuacuugcacaagcu

SEQ ID NO: 873255 - RNA, 16 nt, Homo sapiens
cauuacuuguauaaau

SEQ ID NO: 873256 - RNA, 19 nt, Homo sapiens
cauuagaacacugcauuag

SEQ ID NO: 873257 - RNA, 23 nt, Homo sapiens
cauuagcauucugguuuugacau

SEQ ID NO: 873258 - RNA, 23 nt, Homo sapiens
cauuagcugcccaggaugcugcu

SEQ ID NO: 873259 - RNA, 18 nt, Homo sapiens
cauuaggaacagaguaua

SEQ ID NO: 873260 - RNA, 18 nt, Homo sapiens
cauuauaacugaaggaga

SEQ ID NO: 873261 - RNA, 15 nt, Homo sapiens
cauuauacauuugau

SEQ ID NO: 873262 - RNA, 21 nt, Homo sapiens
cauuauagauuuucauguucu

SEQ ID NO: 873263 - RNA, 18 nt, Homo sapiens
cauuaucgggagcagugu

SEQ ID NO: 873264 - RNA, 17 nt, Homo sapiens
cauuauuaaauguuucu

SEQ ID NO: 873265 - RNA, 19 nt, Homo sapiens
cauuauuaaauguuucuca

SEQ ID NO: 873266 - RNA, 12 nt, Homo sapiens
cauuauuccucc

SEQ ID NO: 873267 - RNA, 23 nt, Homo sapiens
cauuauuucaaccgcuugccaua

SEQ ID NO: 873268 - RNA, 14 nt, Homo sapiens
cauucaacugaaaa

SEQ ID NO: 873269 - RNA, 23 nt, Homo sapiens
cauucaauaaauauuaguuaaua

SEQ ID NO: 873270 - RNA, 18 nt, Homo sapiens
cauucaauguuuaugcaa

SEQ ID NO: 873271 - RNA, 12 nt, Homo sapiens
cauucacaucuc

SEQ ID NO: 873272 - RNA, 19 nt, Homo sapiens
cauucacauuugauguaca

SEQ ID NO: 873273 - RNA, 23 nt, Homo sapiens
cauucagaagaaaaagaagcaac

SEQ ID NO: 873274 - RNA, 15 nt, Homo sapiens
cauucagaccaguga

SEQ ID NO: 873275 - RNA, 21 nt, Homo sapiens
cauucagugagacacagagug

SEQ ID NO: 873276 - RNA, 23 nt, Homo sapiens
cauucaucaagcuguacauuugg

SEQ ID NO: 873277 - RNA, 19 nt, Homo sapiens
cauucauccaacagaguua

SEQ ID NO: 873278 - RNA, 14 nt, Homo sapiens
cauuccaccuuccc

SEQ ID NO: 873279 - RNA, 13 nt, Homo sapiens
cauuccaggaaac

SEQ ID NO: 873280 - RNA, 13 nt, Homo sapiens
cauucccccaugu

SEQ ID NO: 873281 - RNA, 19 nt, Homo sapiens
cauuccuucacucauccag

SEQ ID NO: 873282 - RNA, 14 nt, Homo sapiens
cauuccuugucacc

SEQ ID NO: 873283 - RNA, 16 nt, Homo sapiens
cauucucaucuacuca

SEQ ID NO: 873284 - RNA, 18 nt, Homo sapiens
cauucucuuauauaguau

SEQ ID NO: 873285 - RNA, 16 nt, Homo sapiens
cauucugcucuuugau

SEQ ID NO: 873286 - RNA, 17 nt, Homo sapiens
cauucuggaaaagcaaa

SEQ ID NO: 873287 - RNA, 20 nt, Homo sapiens
cauugaaagagaaccaguuu

SEQ ID NO: 873288 - RNA, 19 nt, Homo sapiens
cauugaucaaauauuucaa

SEQ ID NO: 873289 - RNA, 17 nt, Homo sapiens
cauugccuccaccucuc

SEQ ID NO: 873290 - RNA, 14 nt, Homo sapiens
cauugccuugccaa

SEQ ID NO: 873291 - RNA, 17 nt, Homo sapiens
cauugguaagaaugagc

SEQ ID NO: 873292 - RNA, 14 nt, Homo sapiens
cauuguaaucaaaa

SEQ ID NO: 873293 - RNA, 22 nt, Homo sapiens
cauuguaugauguguugugaua

SEQ ID NO: 873294 - RNA, 23 nt, Homo sapiens
cauuguguguuagcagcagugag

SEQ ID NO: 873295 - RNA, 14 nt, Homo sapiens
gcccuuguccugcc

SEQ ID NO: 873296 - RNA, 13 nt, Homo sapiens
gccgcccaaagag

SEQ ID NO: 873297 - RNA, 21 nt, Homo sapiens
gccgcugcugagcugcgugcc

SEQ ID NO: 873298 - RNA, 23 nt, Homo sapiens
gccggcaaccccaguucugcucc

SEQ ID NO: 873299 - RNA, 17 nt, Homo sapiens
gccgggcccgggcacug

SEQ ID NO: 873300 - RNA, 14 nt, Homo sapiens
gccgggcgcagugg

SEQ ID NO: 873301 - RNA, 18 nt, Homo sapiens
gccguuccgucccaaaca

SEQ ID NO: 873302 - RNA, 20 nt, Homo sapiens
gccuacaucccaucauggcu

SEQ ID NO: 873303 - RNA, 12 nt, Homo sapiens
gccuacugccuc

SEQ ID NO: 873304 - RNA, 19 nt, Homo sapiens
gccuagcaggcacaggaca

SEQ ID NO: 873305 - RNA, 13 nt, Homo sapiens
gccuagcuuucau

SEQ ID NO: 873306 - RNA, 16 nt, Homo sapiens
gccuaggaggccuucu

SEQ ID NO: 873307 - RNA, 14 nt, Homo sapiens
gccuauaaucccag

SEQ ID NO: 873308 - RNA, 16 nt, Homo sapiens
gccuauggagagcccu

SEQ ID NO: 873309 - RNA, 14 nt, Homo sapiens
gccucaaagcaagc

SEQ ID NO: 873310 - RNA, 19 nt, Homo sapiens
gccucaagaugaaggcaaa

SEQ ID NO: 873311 - RNA, 13 nt, Homo sapiens
gccucagugccac

SEQ ID NO: 873312 - RNA, 14 nt, Homo sapiens
gccucagugccacu

SEQ ID NO: 873313 - RNA, 17 nt, Homo sapiens
gccucagugccacuuga

SEQ ID NO: 873314 - RNA, 19 nt, Homo sapiens
gccuccaaggggcuuuguc

SEQ ID NO: 873315 - RNA, 18 nt, Homo sapiens
gccuccaccgcugccuaa

SEQ ID NO: 873316 - RNA, 18 nt, Homo sapiens
gccuccaccucuccuugg

SEQ ID NO: 873317 - RNA, 14 nt, Homo sapiens
gccuccaugcugcc

SEQ ID NO: 873318 - RNA, 21 nt, Homo sapiens
gccuccucaguagcuaggacu

SEQ ID NO: 873319 - RNA, 22 nt, Homo sapiens
gccuccucccugggcagaaagu

SEQ ID NO: 873320 - RNA, 21 nt, Homo sapiens
gccuccucucucaaacugggg

SEQ ID NO: 873321 - RNA, 21 nt, Homo sapiens
gccuccucuguccagggcccu

SEQ ID NO: 873322 - RNA, 14 nt, Homo sapiens
gccuccugaccuga

SEQ ID NO: 873323 - RNA, 18 nt, Homo sapiens
gccuccuuuugcuugaaa

SEQ ID NO: 873324 - RNA, 17 nt, Homo sapiens
gccucgugccaugaucu

SEQ ID NO: 873325 - RNA, 23 nt, Homo sapiens
gccucuagaacacccacuggcca

SEQ ID NO: 873326 - RNA, 12 nt, Homo sapiens
gccucuccccaa

SEQ ID NO: 873327 - RNA, 16 nt, Homo sapiens
gccucucgaguucucc

SEQ ID NO: 873328 - RNA, 13 nt, Homo sapiens
gccucucugcucc

SEQ ID NO: 873329 - RNA, 12 nt, Homo sapiens
gccucuggaaaa

SEQ ID NO: 873330 - RNA, 17 nt, Homo sapiens
gccucuggaaagcaaag

SEQ ID NO: 873331 - RNA, 14 nt, Homo sapiens
gccucuuccagggc

SEQ ID NO: 873332 - RNA, 18 nt, Homo sapiens
gccucuucgcugaccucg

SEQ ID NO: 873333 - RNA, 20 nt, Homo sapiens
gccucuuucugugcuucucu

SEQ ID NO: 873334 - RNA, 17 nt, Homo sapiens
gccugaagaacaguaac

SEQ ID NO: 873335 - RNA, 15 nt, Homo sapiens
gccugaagucacaca

SEQ ID NO: 873336 - RNA, 21 nt, Homo sapiens
gccugaagucccagcauugau

SEQ ID NO: 873337 - RNA, 21 nt, Homo sapiens
gccugaaugucuuacugugau

SEQ ID NO: 873338 - RNA, 22 nt, Homo sapiens
gccugacuuggggagauggagu

SEQ ID NO: 873339 - RNA, 16 nt, Homo sapiens
gccugaggcaugagaa

SEQ ID NO: 873340 - RNA, 19 nt, Homo sapiens
gccugagucacccaugaag

SEQ ID NO: 873341 - RNA, 18 nt, Homo sapiens
gccugauaggacccauau

SEQ ID NO: 873342 - RNA, 23 nt, Homo sapiens
gccugauggugcucacgacucuu

SEQ ID NO: 873343 - RNA, 22 nt, Homo sapiens
gccugcaaacucacugcucaag

SEQ ID NO: 873344 - RNA, 15 nt, Homo sapiens
gccugcagacucacu

SEQ ID NO: 873345 - RNA, 21 nt, Homo sapiens
gccugccaaggaugacacugc

SEQ ID NO: 873346 - RNA, 13 nt, Homo sapiens
gccugcugcugag

SEQ ID NO: 873347 - RNA, 13 nt, Homo sapiens
gccugcuggagag

SEQ ID NO: 873348 - RNA, 12 nt, Homo sapiens
gccugcugugcc

SEQ ID NO: 873349 - RNA, 21 nt, Homo sapiens
gccuggaucucacaagcacuu

SEQ ID NO: 873350 - RNA, 15 nt, Homo sapiens
gccugggacccagcu

SEQ ID NO: 873351 - RNA, 16 nt, Homo sapiens
gccugggggcagugac

SEQ ID NO: 873352 - RNA, 14 nt, Homo sapiens
gccuguaaucccag

SEQ ID NO: 873353 - RNA, 18 nt, Homo sapiens
gccugucaguuucaugga

SEQ ID NO: 873354 - RNA, 20 nt, Homo sapiens
gccugugagguaacugggau

SEQ ID NO: 873355 - RNA, 23 nt, Homo sapiens
gccugugauuaacuugcuuagua

SEQ ID NO: 873356 - RNA, 17 nt, Homo sapiens
gccugugugagcaucuc

SEQ ID NO: 873357 - RNA, 17 nt, Homo sapiens
gccuguucauggcagau

SEQ ID NO: 873358 - RNA, 13 nt, Homo sapiens
gccuguugccucg

SEQ ID NO: 873359 - RNA, 18 nt, Homo sapiens
gccuuaaaggaccuuccc

SEQ ID NO: 873360 - RNA, 19 nt, Homo sapiens
gccuuaaugagaacauuua

SEQ ID NO: 873361 - RNA, 20 nt, Homo sapiens
gccuuaaugagaacauuuac

SEQ ID NO: 873362 - RNA, 21 nt, Homo sapiens
gccuuaccuccccugccaggg

SEQ ID NO: 873363 - RNA, 18 nt, Homo sapiens
gccuuacuuaaacccagc

SEQ ID NO: 873364 - RNA, 15 nt, Homo sapiens
gccuucaguguaccg

SEQ ID NO: 873365 - RNA, 21 nt, Homo sapiens
gccuuccaggagcaauuugca

SEQ ID NO: 873366 - RNA, 20 nt, Homo sapiens
gccuuccauaauuaugacag

SEQ ID NO: 873367 - RNA, 22 nt, Homo sapiens
gccuucugggccuccaaagccc

SEQ ID NO: 873368 - RNA, 15 nt, Homo sapiens
gccuucuucacccag

SEQ ID NO: 873369 - RNA, 23 nt, Homo sapiens
gccuucuuuucaaaacugcuaaa

SEQ ID NO: 873370 - RNA, 15 nt, Homo sapiens
gccuugcaguaggca

SEQ ID NO: 873371 - RNA, 15 nt, Homo sapiens
gccuugccaugucuu

SEQ ID NO: 873372 - RNA, 19 nt, Homo sapiens
gccuuuccaccugcuuucu

SEQ ID NO: 873373 - RNA, 23 nt, Homo sapiens
gccuuuggggacggccacucugu

SEQ ID NO: 873374 - RNA, 13 nt, Homo sapiens
gccuuuucuuaua

SEQ ID NO: 873375 - RNA, 23 nt, Homo sapiens
gcgaaaaaaaaaaaugcacugug

SEQ ID NO: 873376 - RNA, 22 nt, Homo sapiens
gcgacagaagucuugucucaag

SEQ ID NO: 873377 - RNA, 22 nt, Homo sapiens
gcgcaagccuguaaucccagcu

SEQ ID NO: 873378 - RNA, 15 nt, Homo sapiens
gcgcagcgcgugcac

SEQ ID NO: 873379 - RNA, 14 nt, Homo sapiens
gcgcaguggcucac

SEQ ID NO: 873380 - RNA, 13 nt, Homo sapiens
gcgccugugcuga

SEQ ID NO: 873381 - RNA, 13 nt, Homo sapiens
gcgcgugcacagc

SEQ ID NO: 873382 - RNA, 17 nt, Homo sapiens
gcgcugcucaaccucuc

SEQ ID NO: 873383 - RNA, 15 nt, Homo sapiens
gcggagaguacagug

SEQ ID NO: 873384 - RNA, 16 nt, Homo sapiens
gcggagguuccaguga

SEQ ID NO: 873385 - RNA, 21 nt, Homo sapiens
gcggccucgugccaugaucug

SEQ ID NO: 873386 - RNA, 14 nt, Homo sapiens
gcggggugcagaag

SEQ ID NO: 873387 - RNA, 21 nt, Homo sapiens
gcguagcugggacuacaggug

SEQ ID NO: 873388 - RNA, 15 nt, Homo sapiens
gcgucccuguacaga

SEQ ID NO: 873389 - RNA, 19 nt, Homo sapiens
gcguccugcccucugggag

SEQ ID NO: 873390 - RNA, 16 nt, Homo sapiens
gcgucucugcuuuaaa

SEQ ID NO: 873391 - RNA, 19 nt, Homo sapiens
gcgucugccccacccucaa

SEQ ID NO: 873392 - RNA, 16 nt, Homo sapiens
gcgugagccacugcac

SEQ ID NO: 873393 - RNA, 20 nt, Homo sapiens
gcguggacucugcacauguc

SEQ ID NO: 873394 - RNA, 19 nt, Homo sapiens
gcgugugacagucuugcau

SEQ ID NO: 873395 - RNA, 19 nt, Homo sapiens
gcuaaacaagggcagugag

SEQ ID NO: 873396 - RNA, 20 nt, Homo sapiens
gcuaacccccuucuacugag

SEQ ID NO: 873397 - RNA, 15 nt, Homo sapiens
gcuaaggcugccuca

SEQ ID NO: 873398 - RNA, 23 nt, Homo sapiens
gcuaaggcugccucagaccugac

SEQ ID NO: 873399 - RNA, 15 nt, Homo sapiens
gcuaauagcugcuag

SEQ ID NO: 873400 - RNA, 19 nt, Homo sapiens
gcuaaucuucuuaugcaau

SEQ ID NO: 873401 - RNA, 20 nt, Homo sapiens
gcuaaugaagcuauugagaa

SEQ ID NO: 873402 - RNA, 21 nt, Homo sapiens
gcuacaagaaugcaaaaaauc

SEQ ID NO: 873403 - RNA, 15 nt, Homo sapiens
gcuacaccacucugg

SEQ ID NO: 873404 - RNA, 22 nt, Homo sapiens
gcuacaccugaggcugaggcag

SEQ ID NO: 873405 - RNA, 19 nt, Homo sapiens
gcuacacuauugcauuguu

SEQ ID NO: 873406 - RNA, 15 nt, Homo sapiens
gcuacucuaguauuc

SEQ ID NO: 873407 - RNA, 21 nt, Homo sapiens
gcuacucucuugccagcauuu

SEQ ID NO: 873408 - RNA, 22 nt, Homo sapiens
gcuacugacuauggcuaccaaa

SEQ ID NO: 873409 - RNA, 22 nt, Homo sapiens
cauuguguucucuauugcugcu

SEQ ID NO: 873410 - RNA, 20 nt, Homo sapiens
cauuguuacagguguacuau

SEQ ID NO: 873411 - RNA, 20 nt, Homo sapiens
cauuuaauacagcaguguca

SEQ ID NO: 873412 - RNA, 23 nt, Homo sapiens
cauuuacuuaacagaacagucac

SEQ ID NO: 873413 - RNA, 21 nt, Homo sapiens
cauuuauaaaauaaugaacug

SEQ ID NO: 873414 - RNA, 14 nt, Homo sapiens
cauuuaucccucaa

SEQ ID NO: 873415 - RNA, 22 nt, Homo sapiens
cauuuaugucucagaccacuau

SEQ ID NO: 873416 - RNA, 23 nt, Homo sapiens
cauuucagagaggccuuuuggaa

SEQ ID NO: 873417 - RNA, 20 nt, Homo sapiens
cauuucaucuacuacagggu

SEQ ID NO: 873418 - RNA, 12 nt, Homo sapiens
cauuucaucuca

SEQ ID NO: 873419 - RNA, 22 nt, Homo sapiens
cauuucauuguaugauguguug

SEQ ID NO: 873420 - RNA, 12 nt, Homo sapiens
cauuucuaacau

SEQ ID NO: 873421 - RNA, 21 nt, Homo sapiens
cauuucuauuuauuuacugag

SEQ ID NO: 873422 - RNA, 20 nt, Homo sapiens
cauuugaguugcccaucuug

SEQ ID NO: 873423 - RNA, 22 nt, Homo sapiens
cauuuguggucacagccaugaa

SEQ ID NO: 873424 - RNA, 15 nt, Homo sapiens
cauuugugucaaugg

SEQ ID NO: 873425 - RNA, 22 nt, Homo sapiens
cauuuguguuauuauuuugcac

SEQ ID NO: 873426 - RNA, 18 nt, Homo sapiens
cauuuguugugacuggca

SEQ ID NO: 873427 - RNA, 18 nt, Homo sapiens
cauuuuaacaucugagaa

SEQ ID NO: 873428 - RNA, 16 nt, Homo sapiens
cauuuuacauucuguc

SEQ ID NO: 873429 - RNA, 22 nt, Homo sapiens
cauuuuacccuuggcucaaucc

SEQ ID NO: 873430 - RNA, 17 nt, Homo sapiens
cauuuucaauaauguga

SEQ ID NO: 873431 - RNA, 17 nt, Homo sapiens
cauuuucaaugcacauu

SEQ ID NO: 873432 - RNA, 22 nt, Homo sapiens
cauuuuccaaaucuuaauucaa

SEQ ID NO: 873433 - RNA, 13 nt, Homo sapiens
cauuuugcauuag

SEQ ID NO: 873434 - RNA, 21 nt, Homo sapiens
cauuuuguaaguugaagcaaa

SEQ ID NO: 873435 - RNA, 16 nt, Homo sapiens
cauuuuguacaaagau

SEQ ID NO: 873436 - RNA, 15 nt, Homo sapiens
cauuuuucauauucu

SEQ ID NO: 873437 - RNA, 17 nt, Homo sapiens
cauuuuuuucacuggag

SEQ ID NO: 873438 - RNA, 19 nt, Homo sapiens
ccaaaaaggaacacuggaa

SEQ ID NO: 873439 - RNA, 18 nt, Homo sapiens
ccaaaaucggaucugggg

SEQ ID NO: 873440 - RNA, 17 nt, Homo sapiens
ccaaaauuaccaaaaau

SEQ ID NO: 873441 - RNA, 14 nt, Homo sapiens
ccaaacacacugua

SEQ ID NO: 873442 - RNA, 16 nt, Homo sapiens
ccaaacacacuguaaa

SEQ ID NO: 873443 - RNA, 17 nt, Homo sapiens
ccaaaccagggugcaug

SEQ ID NO: 873444 - RNA, 12 nt, Homo sapiens
ccaaacuccugc

SEQ ID NO: 873445 - RNA, 21 nt, Homo sapiens
ccaaagaacagccugagccaa

SEQ ID NO: 873446 - RNA, 17 nt, Homo sapiens
ccaaagaccaauauuca

SEQ ID NO: 873447 - RNA, 13 nt, Homo sapiens
ccaaagacuacac

SEQ ID NO: 873448 - RNA, 18 nt, Homo sapiens
ccaaagacuacacuguug

SEQ ID NO: 873449 - RNA, 13 nt, Homo sapiens
ccaaagagacugg

SEQ ID NO: 873450 - RNA, 16 nt, Homo sapiens
ccaaagagacuggagc

SEQ ID NO: 873451 - RNA, 11 nt, Homo sapiens
ccaaagcaaau

SEQ ID NO: 873452 - RNA, 15 nt, Homo sapiens
ccaaagcauggacua

SEQ ID NO: 873453 - RNA, 16 nt, Homo sapiens
ccaaagcucagacuug

SEQ ID NO: 873454 - RNA, 18 nt, Homo sapiens
ccaaaggcauaagacccu

SEQ ID NO: 873455 - RNA, 15 nt, Homo sapiens
ccaaagugacacaga

SEQ ID NO: 873456 - RNA, 16 nt, Homo sapiens
ccaaagugacacagag

SEQ ID NO: 873457 - RNA, 14 nt, Homo sapiens
ccaaaguuauccag

SEQ ID NO: 873458 - RNA, 16 nt, Homo sapiens
ccaaauaaaaccucag

SEQ ID NO: 873459 - RNA, 14 nt, Homo sapiens
ccaaauaaacucca

SEQ ID NO: 873460 - RNA, 18 nt, Homo sapiens
ccaaauaaauguguaaau

SEQ ID NO: 873461 - RNA, 16 nt, Homo sapiens
ccaaauaagcaucugu

SEQ ID NO: 873462 - RNA, 24 nt, Homo sapiens
ccaaauaaggauuuguucacaugc

SEQ ID NO: 873463 - RNA, 23 nt, Homo sapiens
ccaaauccagugugcaccccucc

SEQ ID NO: 873464 - RNA, 19 nt, Homo sapiens
ccaaaugagacacauuaaa

SEQ ID NO: 873465 - RNA, 18 nt, Homo sapiens
ccaaaugaugccacuucc

SEQ ID NO: 873466 - RNA, 22 nt, Homo sapiens
ccaaauuggauacugcugccaa

SEQ ID NO: 873467 - RNA, 17 nt, Homo sapiens
ccaacaaacaaugccau

SEQ ID NO: 873468 - RNA, 12 nt, Homo sapiens
ccaacaauguug

SEQ ID NO: 873469 - RNA, 13 nt, Homo sapiens
ccaacacccaaag

SEQ ID NO: 873470 - RNA, 17 nt, Homo sapiens
ccaacagagcugggcua

SEQ ID NO: 873471 - RNA, 23 nt, Homo sapiens
ccaacaggcuguucugcacugaa

SEQ ID NO: 873472 - RNA, 18 nt, Homo sapiens
ccaacagucaaaacagag

SEQ ID NO: 873473 - RNA, 23 nt, Homo sapiens
ccaacauuacuccauuacuaaag

SEQ ID NO: 873474 - RNA, 21 nt, Homo sapiens
ccaaccaacaaacaaugccau

SEQ ID NO: 873475 - RNA, 23 nt, Homo sapiens
ccaaccauguucccuucuucuua

SEQ ID NO: 873476 - RNA, 14 nt, Homo sapiens
ccaacccaucagaa

SEQ ID NO: 873477 - RNA, 19 nt, Homo sapiens
ccaacuaacguacauucaa

SEQ ID NO: 873478 - RNA, 16 nt, Homo sapiens
ccaacucugcacucca

SEQ ID NO: 873479 - RNA, 20 nt, Homo sapiens
ccaacugcugaucaaugaaa

SEQ ID NO: 873480 - RNA, 19 nt, Homo sapiens
ccaacuucauuugaugcua

SEQ ID NO: 873481 - RNA, 23 nt, Homo sapiens
ccaagaacuuuucccccaaagau

SEQ ID NO: 873482 - RNA, 15 nt, Homo sapiens
ccaagaagcaugcag

SEQ ID NO: 873483 - RNA, 20 nt, Homo sapiens
ccaagacucugaaaucucag

SEQ ID NO: 873484 - RNA, 19 nt, Homo sapiens
ccaagaggacugagacugg

SEQ ID NO: 873485 - RNA, 13 nt, Homo sapiens
ccaagauuucaga

SEQ ID NO: 873486 - RNA, 22 nt, Homo sapiens
ccaagcagagugauucaggggc

SEQ ID NO: 873487 - RNA, 14 nt, Homo sapiens
ccaagccauucacu

SEQ ID NO: 873488 - RNA, 22 nt, Homo sapiens
ccaagccucugccccaaggggc

SEQ ID NO: 873489 - RNA, 21 nt, Homo sapiens
ccaagcuguuccacuucucua

SEQ ID NO: 873490 - RNA, 15 nt, Homo sapiens
ccaaggaaaauggac

SEQ ID NO: 873491 - RNA, 13 nt, Homo sapiens
ccaaggaacaaga

SEQ ID NO: 873492 - RNA, 20 nt, Homo sapiens
ccaaggcuauauuucuggga

SEQ ID NO: 873493 - RNA, 18 nt, Homo sapiens
ccaaggggguggacgcaa

SEQ ID NO: 873494 - RNA, 21 nt, Homo sapiens
ccaaggguaugggaagccaua

SEQ ID NO: 873495 - RNA, 16 nt, Homo sapiens
ccaagugccagucuug

SEQ ID NO: 873496 - RNA, 23 nt, Homo sapiens
ccaauacaugguguauagcacca

SEQ ID NO: 873497 - RNA, 23 nt, Homo sapiens
ccaaugcauugcuaaaauauuau

SEQ ID NO: 873498 - RNA, 20 nt, Homo sapiens
ccaaugcgcacacacaccga

SEQ ID NO: 873499 - RNA, 15 nt, Homo sapiens
ccaauuaugugacaa

SEQ ID NO: 873500 - RNA, 16 nt, Homo sapiens
ccaauuccaaguuuua

SEQ ID NO: 873501 - RNA, 20 nt, Homo sapiens
ccaauucuuugaauuuccca

SEQ ID NO: 873502 - RNA, 14 nt, Homo sapiens
ccaauuuacuuugu

SEQ ID NO: 873503 - RNA, 23 nt, Homo sapiens
ccaauuuucuggaauacaugaaa

SEQ ID NO: 873504 - RNA, 15 nt, Homo sapiens
ccacaacugacacag

SEQ ID NO: 873505 - RNA, 20 nt, Homo sapiens
ccacaauucacuagaccaga

SEQ ID NO: 873506 - RNA, 13 nt, Homo sapiens
ccacacagggugc

SEQ ID NO: 873507 - RNA, 16 nt, Homo sapiens
ccacacggaggcaucu

SEQ ID NO: 873508 - RNA, 22 nt, Homo sapiens
ccacacuucucaggacacaggc

SEQ ID NO: 873509 - RNA, 15 nt, Homo sapiens
ccacagaaauacaug

SEQ ID NO: 873510 - RNA, 14 nt, Homo sapiens
ccacagagaugcau

SEQ ID NO: 873511 - RNA, 12 nt, Homo sapiens
ccacagcaguug

SEQ ID NO: 873512 - RNA, 14 nt, Homo sapiens
ccacagccaacaaa

SEQ ID NO: 873513 - RNA, 24 nt, Homo sapiens
ccacagccuggcuauacagugcau

SEQ ID NO: 873514 - RNA, 10 nt, Homo sapiens
ccacagugaa

SEQ ID NO: 873515 - RNA, 14 nt, Homo sapiens
ccacagugagcuga

SEQ ID NO: 873516 - RNA, 10 nt, Homo sapiens
ccacauaaca

SEQ ID NO: 873517 - RNA, 18 nt, Homo sapiens
ccacauauggcacaacug

SEQ ID NO: 873518 - RNA, 16 nt, Homo sapiens
ccacaucacuacagua

SEQ ID NO: 873519 - RNA, 18 nt, Homo sapiens
ccacaucccuaacaucau

SEQ ID NO: 873520 - RNA, 19 nt, Homo sapiens
ccacaucugugucucugga

SEQ ID NO: 873521 - RNA, 13 nt, Homo sapiens
ccacaucuucuca

SEQ ID NO: 873522 - RNA, 14 nt, Homo sapiens
ccacaugugcacau

SEQ ID NO: 873523 - RNA, 20 nt, Homo sapiens
gcuagaaauaagcccaacag

SEQ ID NO: 873524 - RNA, 11 nt, Homo sapiens
gcuagaaccua

SEQ ID NO: 873525 - RNA, 18 nt, Homo sapiens
gcuagccagcuguguuca

SEQ ID NO: 873526 - RNA, 14 nt, Homo sapiens
gcuaggaagugacc

SEQ ID NO: 873527 - RNA, 17 nt, Homo sapiens
gcuaggaaugaaauccu

SEQ ID NO: 873528 - RNA, 15 nt, Homo sapiens
gcuaggaugugcauu

SEQ ID NO: 873529 - RNA, 15 nt, Homo sapiens
gcuagggaaggcggg

SEQ ID NO: 873530 - RNA, 21 nt, Homo sapiens
gcuagucuauggucaguugag

SEQ ID NO: 873531 - RNA, 13 nt, Homo sapiens
gcuauaggugcua

SEQ ID NO: 873532 - RNA, 13 nt, Homo sapiens
gcuauauugcacu

SEQ ID NO: 873533 - RNA, 23 nt, Homo sapiens
gcuauauuuauuucuccgaauaa

SEQ ID NO: 873534 - RNA, 16 nt, Homo sapiens
gcuaucacacaguggg

SEQ ID NO: 873535 - RNA, 23 nt, Homo sapiens
gcuaucagacuguaggauuugaa

SEQ ID NO: 873536 - RNA, 15 nt, Homo sapiens
gcuaucugcauuuau

SEQ ID NO: 873537 - RNA, 14 nt, Homo sapiens
gcuaugccaagcca

SEQ ID NO: 873538 - RNA, 22 nt, Homo sapiens
gcuauuuuauuuguauucauga

SEQ ID NO: 873539 - RNA, 16 nt, Homo sapiens
gcucaaaucuauucag

SEQ ID NO: 873540 - RNA, 22 nt, Homo sapiens
gcucaaccacuguggcguucug

SEQ ID NO: 873541 - RNA, 21 nt, Homo sapiens
gcucaagucacuuuuauuuga

SEQ ID NO: 873542 - RNA, 19 nt, Homo sapiens
gcucaauauuccugaauga

SEQ ID NO: 873543 - RNA, 17 nt, Homo sapiens
gcucaaugcaugaaucu

SEQ ID NO: 873544 - RNA, 15 nt, Homo sapiens
gcucacaagcccagg

SEQ ID NO: 873545 - RNA, 18 nt, Homo sapiens
gcucacauaucugucauu

SEQ ID NO: 873546 - RNA, 18 nt, Homo sapiens
gcucaccagccccagugc

SEQ ID NO: 873547 - RNA, 21 nt, Homo sapiens
gcucacccaagcaaggccaaa

SEQ ID NO: 873548 - RNA, 13 nt, Homo sapiens
gcucacucaggac

SEQ ID NO: 873549 - RNA, 19 nt, Homo sapiens
gcucagagcagaaccaaag

SEQ ID NO: 873550 - RNA, 19 nt, Homo sapiens
gcucagcggggacagcucc

SEQ ID NO: 873551 - RNA, 22 nt, Homo sapiens
gcucaggaggcuuggaaagcau

SEQ ID NO: 873552 - RNA, 13 nt, Homo sapiens
gcucaggugcaag

SEQ ID NO: 873553 - RNA, 20 nt, Homo sapiens
gcucaggugucccugcacuu

SEQ ID NO: 873554 - RNA, 20 nt, Homo sapiens
gcucaugaccuggaaauaaa

SEQ ID NO: 873555 - RNA, 19 nt, Homo sapiens
gcucauuuuaggccuccuc

SEQ ID NO: 873556 - RNA, 14 nt, Homo sapiens
gcuccaagagaauu

SEQ ID NO: 873557 - RNA, 22 nt, Homo sapiens
gcuccacuuucagugaaagcau

SEQ ID NO: 873558 - RNA, 17 nt, Homo sapiens
gcuccagaauaugcaua

SEQ ID NO: 873559 - RNA, 15 nt, Homo sapiens
gcuccaggacucccu

SEQ ID NO: 873560 - RNA, 14 nt, Homo sapiens
gcucccagcacuca

SEQ ID NO: 873561 - RNA, 14 nt, Homo sapiens
gcuccccacucugc

SEQ ID NO: 873562 - RNA, 15 nt, Homo sapiens
gcuccccagugcuac

SEQ ID NO: 873563 - RNA, 20 nt, Homo sapiens
gcuccccagugcuaccucuc

SEQ ID NO: 873564 - RNA, 22 nt, Homo sapiens
gcucccccuucccaguagcucu

SEQ ID NO: 873565 - RNA, 17 nt, Homo sapiens
gcuccuaguuugaccuc

SEQ ID NO: 873566 - RNA, 18 nt, Homo sapiens
gcuccugccacugaccuc

SEQ ID NO: 873567 - RNA, 15 nt, Homo sapiens
gcuccuucuguccua

SEQ ID NO: 873568 - RNA, 14 nt, Homo sapiens
gcucgcucuuggga

SEQ ID NO: 873569 - RNA, 19 nt, Homo sapiens
gcucgggcgcuguggcucc

SEQ ID NO: 873570 - RNA, 20 nt, Homo sapiens
gcucuagagaaaagucuacc

SEQ ID NO: 873571 - RNA, 21 nt, Homo sapiens
gcucuagccugggcaacaaca

SEQ ID NO: 873572 - RNA, 15 nt, Homo sapiens
gcucucaccgggcua

SEQ ID NO: 873573 - RNA, 22 nt, Homo sapiens
gcucucaccgggcuacuaccug

SEQ ID NO: 873574 - RNA, 24 nt, Homo sapiens
gcucugaacaaacacugaaucaug

SEQ ID NO: 873575 - RNA, 18 nt, Homo sapiens
gcucugaucauccacugu

SEQ ID NO: 873576 - RNA, 22 nt, Homo sapiens
gcucugcacagggaugaccugg

SEQ ID NO: 873577 - RNA, 16 nt, Homo sapiens
gcucugcccacuguga

SEQ ID NO: 873578 - RNA, 16 nt, Homo sapiens
gcucugcugacagaca

SEQ ID NO: 873579 - RNA, 17 nt, Homo sapiens
gcucugcuggucacugg

SEQ ID NO: 873580 - RNA, 20 nt, Homo sapiens
gcucuggaccaacccuguuu

SEQ ID NO: 873581 - RNA, 20 nt, Homo sapiens
gcucuggccaaccaaagaca

SEQ ID NO: 873582 - RNA, 21 nt, Homo sapiens
gcucugggagggauguucuag

SEQ ID NO: 873583 - RNA, 13 nt, Homo sapiens
gcucuuaggugcu

SEQ ID NO: 873584 - RNA, 19 nt, Homo sapiens
gcucuucuaccauuugaau

SEQ ID NO: 873585 - RNA, 10 nt, Homo sapiens
gcucuugccu

SEQ ID NO: 873586 - RNA, 13 nt, Homo sapiens
gcucuuucagaga

SEQ ID NO: 873587 - RNA, 13 nt, Homo sapiens
gcugaaaaucacu

SEQ ID NO: 873588 - RNA, 13 nt, Homo sapiens
gcugaagucauug

SEQ ID NO: 873589 - RNA, 13 nt, Homo sapiens
gcugacauggcuu

SEQ ID NO: 873590 - RNA, 14 nt, Homo sapiens
gcugagaaggacac

SEQ ID NO: 873591 - RNA, 16 nt, Homo sapiens
gcugaggcaagagaau

SEQ ID NO: 873592 - RNA, 21 nt, Homo sapiens
gcugaggggcuucaaccacuc

SEQ ID NO: 873593 - RNA, 16 nt, Homo sapiens
gcugagucaaucaaua

SEQ ID NO: 873594 - RNA, 19 nt, Homo sapiens
gcugagugcaccacuucaa

SEQ ID NO: 873595 - RNA, 18 nt, Homo sapiens
gcugaguugguguugaca

SEQ ID NO: 873596 - RNA, 17 nt, Homo sapiens
gcugaugaugucucuug

SEQ ID NO: 873597 - RNA, 19 nt, Homo sapiens
gcugauuuugucacugucu

SEQ ID NO: 873598 - RNA, 18 nt, Homo sapiens
gcugcaaagugcaaauac

SEQ ID NO: 873599 - RNA, 20 nt, Homo sapiens
gcugcagcugggccccaugc

SEQ ID NO: 873600 - RNA, 20 nt, Homo sapiens
gcugcagugacgugcaccug

SEQ ID NO: 873601 - RNA, 16 nt, Homo sapiens
gcugccaagcacucga

SEQ ID NO: 873602 - RNA, 21 nt, Homo sapiens
gcugccaccacgucugccagg

SEQ ID NO: 873603 - RNA, 15 nt, Homo sapiens
gcugccucaugaccc

SEQ ID NO: 873604 - RNA, 14 nt, Homo sapiens
gcugcucuggaaaa

SEQ ID NO: 873605 - RNA, 23 nt, Homo sapiens
gcugcucuuagugcccgccuagg

SEQ ID NO: 873606 - RNA, 15 nt, Homo sapiens
gcugcugaaacugug

SEQ ID NO: 873607 - RNA, 10 nt, Homo sapiens
gcugcugaga

SEQ ID NO: 873608 - RNA, 19 nt, Homo sapiens
gcugcugagaaucuagccu

SEQ ID NO: 873609 - RNA, 13 nt, Homo sapiens
gcugcuggaagaa

SEQ ID NO: 873610 - RNA, 23 nt, Homo sapiens
gcuggaagaaggaagaagccaga

SEQ ID NO: 873611 - RNA, 20 nt, Homo sapiens
gcuggaguggaguggcacga

SEQ ID NO: 873612 - RNA, 17 nt, Homo sapiens
gcuggauaaaaugucag

SEQ ID NO: 873613 - RNA, 22 nt, Homo sapiens
gcuggaucacuugaguucagga

SEQ ID NO: 873614 - RNA, 16 nt, Homo sapiens
gcuggcaagcagggaa

SEQ ID NO: 873615 - RNA, 20 nt, Homo sapiens
gcuggcaccucagacaaucc

SEQ ID NO: 873616 - RNA, 18 nt, Homo sapiens
gcuggcagccacccccuc

SEQ ID NO: 873617 - RNA, 14 nt, Homo sapiens
gcuggcgugcagug

SEQ ID NO: 873618 - RNA, 20 nt, Homo sapiens
gcuggcuccuccaggcacgu

SEQ ID NO: 873619 - RNA, 20 nt, Homo sapiens
gcugggaaaaaaguuuugau

SEQ ID NO: 873620 - RNA, 19 nt, Homo sapiens
gcugggaaauucaugugga

SEQ ID NO: 873621 - RNA, 21 nt, Homo sapiens
gcugggauguuucugucacau

SEQ ID NO: 873622 - RNA, 14 nt, Homo sapiens
gcuggggagcgaaa

SEQ ID NO: 873623 - RNA, 14 nt, Homo sapiens
gcuggggagggaga

SEQ ID NO: 873624 - RNA, 22 nt, Homo sapiens
gcugguacuaagaggcuauuua

SEQ ID NO: 873625 - RNA, 15 nt, Homo sapiens
gcuguaaauacaugu

SEQ ID NO: 873626 - RNA, 16 nt, Homo sapiens
gcuguaccaagccccu

SEQ ID NO: 873627 - RNA, 20 nt, Homo sapiens
gcuguacccuuccaccuccu

SEQ ID NO: 873628 - RNA, 22 nt, Homo sapiens
gcuguagcucccgagcuacucu

SEQ ID NO: 873629 - RNA, 23 nt, Homo sapiens
gcuguauauaggggucaauguga

SEQ ID NO: 873630 - RNA, 13 nt, Homo sapiens
gcuguccuuuuag

SEQ ID NO: 873631 - RNA, 15 nt, Homo sapiens
gcugucgcaucucag

SEQ ID NO: 873632 - RNA, 18 nt, Homo sapiens
gcugugaaagaaccaaaa

SEQ ID NO: 873633 - RNA, 16 nt, Homo sapiens
gcugugaacauggacu

SEQ ID NO: 873634 - RNA, 22 nt, Homo sapiens
gcugugagccccugguccugag

SEQ ID NO: 873635 - RNA, 20 nt, Homo sapiens
gcugugguuccuaagccugu

SEQ ID NO: 873636 - RNA, 18 nt, Homo sapiens
gcuguguucacacuguaa

SEQ ID NO: 873637 - RNA, 19 nt, Homo sapiens
ccacauuauacauuugaug

SEQ ID NO: 873638 - RNA, 19 nt, Homo sapiens
ccaccauucacauuugaug

SEQ ID NO: 873639 - RNA, 17 nt, Homo sapiens
ccaccccauaaucucau

SEQ ID NO: 873640 - RNA, 16 nt, Homo sapiens
ccacccccucccccau

SEQ ID NO: 873641 - RNA, 21 nt, Homo sapiens
ccacccccucccccaucauau

SEQ ID NO: 873642 - RNA, 17 nt, Homo sapiens
ccaccccuaaagagaua

SEQ ID NO: 873643 - RNA, 20 nt, Homo sapiens
ccacccguaggcagccucuc

SEQ ID NO: 873644 - RNA, 21 nt, Homo sapiens
ccaccuaaaaacauuuacuga

SEQ ID NO: 873645 - RNA, 12 nt, Homo sapiens
ccaccugccauu

SEQ ID NO: 873646 - RNA, 21 nt, Homo sapiens
ccaccuggaaggggcaaagaa

SEQ ID NO: 873647 - RNA, 19 nt, Homo sapiens
ccaccuguacucuggagag

SEQ ID NO: 873648 - RNA, 22 nt, Homo sapiens
ccaccuguuaaaauguacacug

SEQ ID NO: 873649 - RNA, 12 nt, Homo sapiens
ccaccuucuuca

SEQ ID NO: 873650 - RNA, 21 nt, Homo sapiens
ccaccuuucucgcuggaauca

SEQ ID NO: 873651 - RNA, 14 nt, Homo sapiens
ccacggcuggauac

SEQ ID NO: 873652 - RNA, 19 nt, Homo sapiens
ccacgugugcagacugugg

SEQ ID NO: 873653 - RNA, 16 nt, Homo sapiens
ccacuaggacucugag

SEQ ID NO: 873654 - RNA, 17 nt, Homo sapiens
ccacuauccucacuccc

SEQ ID NO: 873655 - RNA, 13 nt, Homo sapiens
ccacuauggucau

SEQ ID NO: 873656 - RNA, 17 nt, Homo sapiens
ccacucauuucaucuca

SEQ ID NO: 873657 - RNA, 22 nt, Homo sapiens
ccacuccccccauaucuuuaaa

SEQ ID NO: 873658 - RNA, 12 nt, Homo sapiens
ccacucuaauau

SEQ ID NO: 873659 - RNA, 21 nt, Homo sapiens
ccacucugaauaccaagugug

SEQ ID NO: 873660 - RNA, 15 nt, Homo sapiens
ccacucugcucugau

SEQ ID NO: 873661 - RNA, 13 nt, Homo sapiens
ccacugaccucac

SEQ ID NO: 873662 - RNA, 21 nt, Homo sapiens
ccacugaggaugugagccuga

SEQ ID NO: 873663 - RNA, 17 nt, Homo sapiens
ccacugccacacccucc

SEQ ID NO: 873664 - RNA, 10 nt, Homo sapiens
ccacugccag

SEQ ID NO: 873665 - RNA, 14 nt, Homo sapiens
ccacugccagcagc

SEQ ID NO: 873666 - RNA, 15 nt, Homo sapiens
ccacuguguauuuaa

SEQ ID NO: 873667 - RNA, 16 nt, Homo sapiens
ccacuucuaaauagca

SEQ ID NO: 873668 - RNA, 21 nt, Homo sapiens
ccacuucuaugcaaaugccuc

SEQ ID NO: 873669 - RNA, 12 nt, Homo sapiens
ccacuucugcca

SEQ ID NO: 873670 - RNA, 21 nt, Homo sapiens
ccacuugacauuccuugucac

SEQ ID NO: 873671 - RNA, 14 nt, Homo sapiens
ccacuugucaucca

SEQ ID NO: 873672 - RNA, 16 nt, Homo sapiens
ccacuuugucucugag

SEQ ID NO: 873673 - RNA, 19 nt, Homo sapiens
ccagaaaaaaaaaaacuua

SEQ ID NO: 873674 - RNA, 17 nt, Homo sapiens
ccagaaaaccuccagua

SEQ ID NO: 873675 - RNA, 13 nt, Homo sapiens
ccagaaccuggag

SEQ ID NO: 873676 - RNA, 16 nt, Homo sapiens
ccagaacuauuuauuu

SEQ ID NO: 873677 - RNA, 21 nt, Homo sapiens
ccagaagaauauucaggacuu

SEQ ID NO: 873678 - RNA, 16 nt, Homo sapiens
ccagaaggauauuuac

SEQ ID NO: 873679 - RNA, 15 nt, Homo sapiens
ccagaaggcaaaaag

SEQ ID NO: 873680 - RNA, 22 nt, Homo sapiens
ccagaauauuuauccuucacca

SEQ ID NO: 873681 - RNA, 17 nt, Homo sapiens
ccagacaggcucagguu

SEQ ID NO: 873682 - RNA, 22 nt, Homo sapiens
ccagaccccaaggcccagacag

SEQ ID NO: 873683 - RNA, 20 nt, Homo sapiens
ccagaccuagaccugggcca

SEQ ID NO: 873684 - RNA, 20 nt, Homo sapiens
ccagacucguucuucuggga

SEQ ID NO: 873685 - RNA, 20 nt, Homo sapiens
ccagacucuaaauauuucau

SEQ ID NO: 873686 - RNA, 21 nt, Homo sapiens
ccagagaggggacauuucccu

SEQ ID NO: 873687 - RNA, 15 nt, Homo sapiens
ccagagaguggcucc

SEQ ID NO: 873688 - RNA, 20 nt, Homo sapiens
ccagagcacugcuccagugg

SEQ ID NO: 873689 - RNA, 16 nt, Homo sapiens
ccagagcaggaaagau

SEQ ID NO: 873690 - RNA, 20 nt, Homo sapiens
ccagagccggggcacuuuca

SEQ ID NO: 873691 - RNA, 16 nt, Homo sapiens
ccagagcuacugacua

SEQ ID NO: 873692 - RNA, 18 nt, Homo sapiens
ccagagcuggaaggcagg

SEQ ID NO: 873693 - RNA, 19 nt, Homo sapiens
ccagagcuguggacuuugu

SEQ ID NO: 873694 - RNA, 19 nt, Homo sapiens
ccagagugugcagacugau

SEQ ID NO: 873695 - RNA, 17 nt, Homo sapiens
ccagauccucugcugac

SEQ ID NO: 873696 - RNA, 12 nt, Homo sapiens
ccagauugcaac

SEQ ID NO: 873697 - RNA, 12 nt, Homo sapiens
ccagcaaagagu

SEQ ID NO: 873698 - RNA, 14 nt, Homo sapiens
ccagcaaagguugg

SEQ ID NO: 873699 - RNA, 12 nt, Homo sapiens
ccagcacccucu

SEQ ID NO: 873700 - RNA, 11 nt, Homo sapiens
ccagcacucug

SEQ ID NO: 873701 - RNA, 16 nt, Homo sapiens
ccagcacuuugggagg

SEQ ID NO: 873702 - RNA, 13 nt, Homo sapiens
ccagccacacaga

SEQ ID NO: 873703 - RNA, 13 nt, Homo sapiens
ccagccaucacaa

SEQ ID NO: 873704 - RNA, 17 nt, Homo sapiens
ccagccgaaaagcuuuu

SEQ ID NO: 873705 - RNA, 14 nt, Homo sapiens
ccagccuccaugcu

SEQ ID NO: 873706 - RNA, 16 nt, Homo sapiens
ccagccuccaugcugc

SEQ ID NO: 873707 - RNA, 15 nt, Homo sapiens
ccagccugggcaaca

SEQ ID NO: 873708 - RNA, 20 nt, Homo sapiens
ccagccugggugacagagca

SEQ ID NO: 873709 - RNA, 13 nt, Homo sapiens
ccagcuacaagga

SEQ ID NO: 873710 - RNA, 13 nt, Homo sapiens
ccagcuacauucc

SEQ ID NO: 873711 - RNA, 14 nt, Homo sapiens
ccagcuacauuccu

SEQ ID NO: 873712 - RNA, 21 nt, Homo sapiens
ccagcuacucaagaggcugag

SEQ ID NO: 873713 - RNA, 14 nt, Homo sapiens
ccagcuaucuguca

SEQ ID NO: 873714 - RNA, 21 nt, Homo sapiens
ccagcucagucccaucagaga

SEQ ID NO: 873715 - RNA, 15 nt, Homo sapiens
ccagcuccaguuucc

SEQ ID NO: 873716 - RNA, 15 nt, Homo sapiens
ccagcuccugggcag

SEQ ID NO: 873717 - RNA, 22 nt, Homo sapiens
ccagcugaggcugggggcgggg

SEQ ID NO: 873718 - RNA, 16 nt, Homo sapiens
ccagcugcaucuacuc

SEQ ID NO: 873719 - RNA, 13 nt, Homo sapiens
ccagcugcuccca

SEQ ID NO: 873720 - RNA, 16 nt, Homo sapiens
ccagcuggugcugcaa

SEQ ID NO: 873721 - RNA, 22 nt, Homo sapiens
ccagcuguguucacacuguaaa

SEQ ID NO: 873722 - RNA, 21 nt, Homo sapiens
ccagcuuguuugugaaacaaa

SEQ ID NO: 873723 - RNA, 23 nt, Homo sapiens
ccaggagaagaaagaggugaccc

SEQ ID NO: 873724 - RNA, 19 nt, Homo sapiens
ccaggagaugcugggccag

SEQ ID NO: 873725 - RNA, 21 nt, Homo sapiens
ccaggagaugcugggccaguu

SEQ ID NO: 873726 - RNA, 17 nt, Homo sapiens
ccaggaguuugagacca

SEQ ID NO: 873727 - RNA, 18 nt, Homo sapiens
ccaggaguuugagaccag

SEQ ID NO: 873728 - RNA, 18 nt, Homo sapiens
ccaggaucccucccagau

SEQ ID NO: 873729 - RNA, 17 nt, Homo sapiens
ccaggauccugcaggaa

SEQ ID NO: 873730 - RNA, 21 nt, Homo sapiens
ccaggauuccucucucagguc

SEQ ID NO: 873731 - RNA, 13 nt, Homo sapiens
ccaggauugacag

SEQ ID NO: 873732 - RNA, 23 nt, Homo sapiens
ccaggcaggggugggagagccag

SEQ ID NO: 873733 - RNA, 15 nt, Homo sapiens
ccaggccugagcaac

SEQ ID NO: 873734 - RNA, 16 nt, Homo sapiens
ccaggccugagcaaca

SEQ ID NO: 873735 - RNA, 18 nt, Homo sapiens
ccaggccugagcaacaaa

SEQ ID NO: 873736 - RNA, 15 nt, Homo sapiens
ccaggccugccuguu

SEQ ID NO: 873737 - RNA, 15 nt, Homo sapiens
ccaggcuagagugca

SEQ ID NO: 873738 - RNA, 12 nt, Homo sapiens
ccaggcucugcc

SEQ ID NO: 873739 - RNA, 14 nt, Homo sapiens
ccaggcucugggaa

SEQ ID NO: 873740 - RNA, 12 nt, Homo sapiens
ccaggcugcacg

SEQ ID NO: 873741 - RNA, 19 nt, Homo sapiens
ccaggcuugucacuagcag

SEQ ID NO: 873742 - RNA, 14 nt, Homo sapiens
ccagggacaagcag

SEQ ID NO: 873743 - RNA, 14 nt, Homo sapiens
ccaggggacacugu

SEQ ID NO: 873744 - RNA, 13 nt, Homo sapiens
ccagggucucacu

SEQ ID NO: 873745 - RNA, 21 nt, Homo sapiens
ccagguccggagggguugcgg

SEQ ID NO: 873746 - RNA, 14 nt, Homo sapiens
ccagguguugccau

SEQ ID NO: 873747 - RNA, 20 nt, Homo sapiens
ccagguuuuuggucugaccc

SEQ ID NO: 873748 - RNA, 16 nt, Homo sapiens
ccaguaauugguccga

SEQ ID NO: 873749 - RNA, 15 nt, Homo sapiens
ccaguagcucuugca

SEQ ID NO: 873750 - RNA, 22 nt, Homo sapiens
ccagucacugucccucaaauga

SEQ ID NO: 873751 - RNA, 15 nt, Homo sapiens
ccagucccaaugcac

SEQ ID NO: 873752 - RNA, 15 nt, Homo sapiens
ccagugaaccaaaga

SEQ ID NO: 873753 - RNA, 19 nt, Homo sapiens
gcuguguuugagcuuucau

SEQ ID NO: 873754 - RNA, 16 nt, Homo sapiens
gcuguuauucuuccac

SEQ ID NO: 873755 - RNA, 23 nt, Homo sapiens
gcuguucauguuacucaugacuc

SEQ ID NO: 873756 - RNA, 15 nt, Homo sapiens
gcuguucugcacuga

SEQ ID NO: 873757 - RNA, 18 nt, Homo sapiens
gcuguugaugaggccucu

SEQ ID NO: 873758 - RNA, 20 nt, Homo sapiens
gcuguuuuaaaaacaaagaa

SEQ ID NO: 873759 - RNA, 23 nt, Homo sapiens
gcuguuuuaauaauuaugugcca

SEQ ID NO: 873760 - RNA, 14 nt, Homo sapiens
gcuuaaaugcaaua

SEQ ID NO: 873761 - RNA, 23 nt, Homo sapiens
gcuuaaggagaggagaaacugag

SEQ ID NO: 873762 - RNA, 14 nt, Homo sapiens
gcuuaauguuuauu

SEQ ID NO: 873763 - RNA, 15 nt, Homo sapiens
gcuuaccaaguccug

SEQ ID NO: 873764 - RNA, 22 nt, Homo sapiens
gcuuagaugagggugacuguca

SEQ ID NO: 873765 - RNA, 16 nt, Homo sapiens
gcuuagccuccugacc

SEQ ID NO: 873766 - RNA, 18 nt, Homo sapiens
gcuuagccuccugaccug

SEQ ID NO: 873767 - RNA, 14 nt, Homo sapiens
gcuuaggauguuuu

SEQ ID NO: 873768 - RNA, 18 nt, Homo sapiens
gcuuaggugccaggcugu

SEQ ID NO: 873769 - RNA, 21 nt, Homo sapiens
gcuuaguuaagucauccacag

SEQ ID NO: 873770 - RNA, 13 nt, Homo sapiens
gcuucagccugag

SEQ ID NO: 873771 - RNA, 16 nt, Homo sapiens
gcuucaugccagguua

SEQ ID NO: 873772 - RNA, 18 nt, Homo sapiens
gcuucauuugugucaaug

SEQ ID NO: 873773 - RNA, 16 nt, Homo sapiens
gcuuccagaaaacccc

SEQ ID NO: 873774 - RNA, 18 nt, Homo sapiens
gcuuccagaccaccugcc

SEQ ID NO: 873775 - RNA, 18 nt, Homo sapiens
gcuuccagggagcccuuu

SEQ ID NO: 873776 - RNA, 20 nt, Homo sapiens
gcuucccaugucuuucucca

SEQ ID NO: 873777 - RNA, 18 nt, Homo sapiens
gcuuccuucauuuccucc

SEQ ID NO: 873778 - RNA, 13 nt, Homo sapiens
gcuucucaucccc

SEQ ID NO: 873779 - RNA, 18 nt, Homo sapiens
gcuucucauggauggcac

SEQ ID NO: 873780 - RNA, 19 nt, Homo sapiens
gcuucucugggggccucuu

SEQ ID NO: 873781 - RNA, 15 nt, Homo sapiens
gcuugagccugucac

SEQ ID NO: 873782 - RNA, 19 nt, Homo sapiens
gcuugauccagaccucuac

SEQ ID NO: 873783 - RNA, 23 nt, Homo sapiens
gcuugauugcguggaauugugcu

SEQ ID NO: 873784 - RNA, 14 nt, Homo sapiens
gcuugcaugccaaa

SEQ ID NO: 873785 - RNA, 20 nt, Homo sapiens
gcuuguaaauagcucaggug

SEQ ID NO: 873786 - RNA, 22 nt, Homo sapiens
gcuuguaacuccaccaacccau

SEQ ID NO: 873787 - RNA, 22 nt, Homo sapiens
gcuugugaacaccuccuagcca

SEQ ID NO: 873788 - RNA, 22 nt, Homo sapiens
gcuugugauuuuugaacaauac

SEQ ID NO: 873789 - RNA, 20 nt, Homo sapiens
gcuuuaaacacccuucacau

SEQ ID NO: 873790 - RNA, 15 nt, Homo sapiens
gcuuuaguaaugugg

SEQ ID NO: 873791 - RNA, 22 nt, Homo sapiens
gcuuuaucaaaaaguacaauaa

SEQ ID NO: 873792 - RNA, 14 nt, Homo sapiens
gcuuucaacacaca

SEQ ID NO: 873793 - RNA, 16 nt, Homo sapiens
gcuuucuacccagcga

SEQ ID NO: 873794 - RNA, 21 nt, Homo sapiens
gcuuugaauacccccagagac

SEQ ID NO: 873795 - RNA, 18 nt, Homo sapiens
gcuuugucuucagccucu

SEQ ID NO: 873796 - RNA, 22 nt, Homo sapiens
gcuuuguuugggccacugccag

SEQ ID NO: 873797 - RNA, 21 nt, Homo sapiens
gcuuuuccuauuuguuuucau

SEQ ID NO: 873798 - RNA, 16 nt, Homo sapiens
ggaaaaaaaauaaugu

SEQ ID NO: 873799 - RNA, 15 nt, Homo sapiens
ggaaaacaggacuua

SEQ ID NO: 873800 - RNA, 15 nt, Homo sapiens
ggaaaaccagggaua

SEQ ID NO: 873801 - RNA, 13 nt, Homo sapiens
ggaaaagcaaaac

SEQ ID NO: 873802 - RNA, 15 nt, Homo sapiens
ggaaaaugucuuaaa

SEQ ID NO: 873803 - RNA, 12 nt, Homo sapiens
ggaaaaugugac

SEQ ID NO: 873804 - RNA, 20 nt, Homo sapiens
ggaaacagcuaaugggacac

SEQ ID NO: 873805 - RNA, 12 nt, Homo sapiens
ggaaaccaaagg

SEQ ID NO: 873806 - RNA, 19 nt, Homo sapiens
ggaaacuggaugaggucau

SEQ ID NO: 873807 - RNA, 22 nt, Homo sapiens
ggaaagacguuuuugugcugug

SEQ ID NO: 873808 - RNA, 16 nt, Homo sapiens
ggaaagcacaccucau

SEQ ID NO: 873809 - RNA, 15 nt, Homo sapiens
ggaaagccucacuga

SEQ ID NO: 873810 - RNA, 23 nt, Homo sapiens
ggaaauucaaaacaauuggcaaa

SEQ ID NO: 873811 - RNA, 12 nt, Homo sapiens
ggaacagugcag

SEQ ID NO: 873812 - RNA, 13 nt, Homo sapiens
ggaaccaugaagc

SEQ ID NO: 873813 - RNA, 22 nt, Homo sapiens
ggaacccccagaauaaauaugc

SEQ ID NO: 873814 - RNA, 14 nt, Homo sapiens
ggaacucucuccac

SEQ ID NO: 873815 - RNA, 10 nt, Homo sapiens
ggaacuuccu

SEQ ID NO: 873816 - RNA, 19 nt, Homo sapiens
ggaagaaacaaaguugaac

SEQ ID NO: 873817 - RNA, 16 nt, Homo sapiens
ggaagaaaugggagaa

SEQ ID NO: 873818 - RNA, 20 nt, Homo sapiens
ggaagaaggaagaagccaga

SEQ ID NO: 873819 - RNA, 14 nt, Homo sapiens
ggaagaccaagaca

SEQ ID NO: 873820 - RNA, 19 nt, Homo sapiens
ggaagagagagacccucac

SEQ ID NO: 873821 - RNA, 18 nt, Homo sapiens
ggaagagcugcaacggaa

SEQ ID NO: 873822 - RNA, 19 nt, Homo sapiens
ggaagagcugcaacggaau

SEQ ID NO: 873823 - RNA, 14 nt, Homo sapiens
ggaagagggcagua

SEQ ID NO: 873824 - RNA, 19 nt, Homo sapiens
ggaagagugugcuugucau

SEQ ID NO: 873825 - RNA, 20 nt, Homo sapiens
ggaagauacugacuagucau

SEQ ID NO: 873826 - RNA, 15 nt, Homo sapiens
ggaagaugaaagagg

SEQ ID NO: 873827 - RNA, 22 nt, Homo sapiens
ggaagauucccucuuccugcca

SEQ ID NO: 873828 - RNA, 23 nt, Homo sapiens
ggaagcauuuguuucuacuuuga

SEQ ID NO: 873829 - RNA, 20 nt, Homo sapiens
ggaagcggagcuugcaguga

SEQ ID NO: 873830 - RNA, 15 nt, Homo sapiens
ggaagcuccacuguc

SEQ ID NO: 873831 - RNA, 17 nt, Homo sapiens
ggaagcuccacugucac

SEQ ID NO: 873832 - RNA, 14 nt, Homo sapiens
ggaaggcagggaca

SEQ ID NO: 873833 - RNA, 16 nt, Homo sapiens
ggaaggcugcugugua

SEQ ID NO: 873834 - RNA, 15 nt, Homo sapiens
ggaagggacacacac

SEQ ID NO: 873835 - RNA, 22 nt, Homo sapiens
ggaaggugcuugccugggacca

SEQ ID NO: 873836 - RNA, 14 nt, Homo sapiens
ggaagucaccaaaa

SEQ ID NO: 873837 - RNA, 18 nt, Homo sapiens
ggaagucguuucaggaca

SEQ ID NO: 873838 - RNA, 21 nt, Homo sapiens
ggaagucucucccgauaucac

SEQ ID NO: 873839 - RNA, 23 nt, Homo sapiens
ggaagugaagagggagaagggau

SEQ ID NO: 873840 - RNA, 15 nt, Homo sapiens
ggaaguucaacuucc

SEQ ID NO: 873841 - RNA, 12 nt, Homo sapiens
ggaaguuuucag

SEQ ID NO: 873842 - RNA, 18 nt, Homo sapiens
ggaauaaagcccuugaac

SEQ ID NO: 873843 - RNA, 16 nt, Homo sapiens
ggaauaauuauuuauu

SEQ ID NO: 873844 - RNA, 18 nt, Homo sapiens
ggaauagcccgaggaccg

SEQ ID NO: 873845 - RNA, 21 nt, Homo sapiens
ggaaugugccucggccuccaa

SEQ ID NO: 873846 - RNA, 21 nt, Homo sapiens
ggaauuaggaagaccaagaca

SEQ ID NO: 873847 - RNA, 17 nt, Homo sapiens
ggacaaaacacuguguc

SEQ ID NO: 873848 - RNA, 20 nt, Homo sapiens
ggacaaaggagccugugaac

SEQ ID NO: 873849 - RNA, 19 nt, Homo sapiens
ggacaccccuuauccagga

SEQ ID NO: 873850 - RNA, 22 nt, Homo sapiens
ggacaccuggccgccuccagga

SEQ ID NO: 873851 - RNA, 11 nt, Homo sapiens
ggacacuguac

SEQ ID NO: 873852 - RNA, 21 nt, Homo sapiens
ggacagaccuucaacuuccaa

SEQ ID NO: 873853 - RNA, 16 nt, Homo sapiens
ggacagcgccaccucu

SEQ ID NO: 873854 - RNA, 15 nt, Homo sapiens
ggacagggaggugac

SEQ ID NO: 873855 - RNA, 23 nt, Homo sapiens
ggacagugcccaugcaauggcuu

SEQ ID NO: 873856 - RNA, 16 nt, Homo sapiens
ggacaugaaaaauugc

SEQ ID NO: 873857 - RNA, 17 nt, Homo sapiens
ggacaugauacugaugc

SEQ ID NO: 873858 - RNA, 18 nt, Homo sapiens
ggacaugcuuuggcaauu

SEQ ID NO: 873859 - RNA, 18 nt, Homo sapiens
ggacauugcggacagcca

SEQ ID NO: 873860 - RNA, 14 nt, Homo sapiens
ggaccaacccuguu

SEQ ID NO: 873861 - RNA, 21 nt, Homo sapiens
ggaccaacccuguuuccugag

SEQ ID NO: 873862 - RNA, 17 nt, Homo sapiens
ggaccaagaugggcaca

SEQ ID NO: 873863 - RNA, 13 nt, Homo sapiens
ggaccacaccucc

SEQ ID NO: 873864 - RNA, 14 nt, Homo sapiens
ggaccagaggugac

SEQ ID NO: 873865 - RNA, 22 nt, Homo sapiens
ggaccaggacuauagcccaggu

SEQ ID NO: 873866 - RNA, 21 nt, Homo sapiens
ggaccuguuuagagaagccgg

SEQ ID NO: 873867 - RNA, 11 nt, Homo sapiens
ccagugcaacc

SEQ ID NO: 873868 - RNA, 13 nt, Homo sapiens
ccagugcagggaa

SEQ ID NO: 873869 - RNA, 19 nt, Homo sapiens
ccagugguaccagcucacu

SEQ ID NO: 873870 - RNA, 22 nt, Homo sapiens
ccaguguccccuccacugucac

SEQ ID NO: 873871 - RNA, 11 nt, Homo sapiens
ccaguuuccaa

SEQ ID NO: 873872 - RNA, 16 nt, Homo sapiens
ccaguuugcuuugccc

SEQ ID NO: 873873 - RNA, 20 nt, Homo sapiens
ccauaaagccauucuuacuc

SEQ ID NO: 873874 - RNA, 15 nt, Homo sapiens
ccauacuacccucau

SEQ ID NO: 873875 - RNA, 21 nt, Homo sapiens
ccauacuuucccacagcacua

SEQ ID NO: 873876 - RNA, 16 nt, Homo sapiens
ccauagaaacugaggc

SEQ ID NO: 873877 - RNA, 16 nt, Homo sapiens
ccauagagacuuugug

SEQ ID NO: 873878 - RNA, 11 nt, Homo sapiens
ccauagauggu

SEQ ID NO: 873879 - RNA, 20 nt, Homo sapiens
ccauagcaagauugcuuaaa

SEQ ID NO: 873880 - RNA, 16 nt, Homo sapiens
ccauagcuuccaugag

SEQ ID NO: 873881 - RNA, 19 nt, Homo sapiens
ccauauaucuuauguuaaa

SEQ ID NO: 873882 - RNA, 18 nt, Homo sapiens
ccauaucuuuaaagugug

SEQ ID NO: 873883 - RNA, 23 nt, Homo sapiens
ccauaugaauuuacuacuuuaaa

SEQ ID NO: 873884 - RNA, 14 nt, Homo sapiens
ccauaugucugcuu

SEQ ID NO: 873885 - RNA, 13 nt, Homo sapiens
ccaucaaaugcug

SEQ ID NO: 873886 - RNA, 19 nt, Homo sapiens
ccaucaacaagucuugaaa

SEQ ID NO: 873887 - RNA, 15 nt, Homo sapiens
ccaucacaaggggaa

SEQ ID NO: 873888 - RNA, 13 nt, Homo sapiens
ccaucacuggaau

SEQ ID NO: 873889 - RNA, 13 nt, Homo sapiens
ccaucaucacugg

SEQ ID NO: 873890 - RNA, 12 nt, Homo sapiens
ccaucaucccag

SEQ ID NO: 873891 - RNA, 14 nt, Homo sapiens
ccauccccuggacu

SEQ ID NO: 873892 - RNA, 18 nt, Homo sapiens
ccauccccuggacuggga

SEQ ID NO: 873893 - RNA, 17 nt, Homo sapiens
ccaucccucggacccac

SEQ ID NO: 873894 - RNA, 21 nt, Homo sapiens
ccauccuaggcuuaaaugcaa

SEQ ID NO: 873895 - RNA, 15 nt, Homo sapiens
ccaucuaugucccuu

SEQ ID NO: 873896 - RNA, 17 nt, Homo sapiens
ccaucuccuuucaggga

SEQ ID NO: 873897 - RNA, 10 nt, Homo sapiens
ccaucugauu

SEQ ID NO: 873898 - RNA, 14 nt, Homo sapiens
ccaugaaucaaaga

SEQ ID NO: 873899 - RNA, 16 nt, Homo sapiens
ccaugaaucaaagaca

SEQ ID NO: 873900 - RNA, 20 nt, Homo sapiens
ccaugaggcaaugucaggaa

SEQ ID NO: 873901 - RNA, 19 nt, Homo sapiens
ccaugauaacugcaauuuu

SEQ ID NO: 873902 - RNA, 22 nt, Homo sapiens
ccaugauggugcugaccucugg

SEQ ID NO: 873903 - RNA, 13 nt, Homo sapiens
ccaugcaauucau

SEQ ID NO: 873904 - RNA, 21 nt, Homo sapiens
ccaugcauggugcaucagcag

SEQ ID NO: 873905 - RNA, 21 nt, Homo sapiens
ccaugccacugccaggcaccu

SEQ ID NO: 873906 - RNA, 14 nt, Homo sapiens
ccaugccugagggu

SEQ ID NO: 873907 - RNA, 15 nt, Homo sapiens
ccaugcucaaccacu

SEQ ID NO: 873908 - RNA, 17 nt, Homo sapiens
ccaugcucaaccacugu

SEQ ID NO: 873909 - RNA, 15 nt, Homo sapiens
ccaugcuucuugccc

SEQ ID NO: 873910 - RNA, 19 nt, Homo sapiens
ccaugggauguuaagcaaa

SEQ ID NO: 873911 - RNA, 19 nt, Homo sapiens
ccaugguaugaaggugauu

SEQ ID NO: 873912 - RNA, 13 nt, Homo sapiens
ccaugguuuuacu

SEQ ID NO: 873913 - RNA, 16 nt, Homo sapiens
ccauguacaugaagaa

SEQ ID NO: 873914 - RNA, 18 nt, Homo sapiens
ccauguaccaguguacug

SEQ ID NO: 873915 - RNA, 17 nt, Homo sapiens
ccauguauuuaucucua

SEQ ID NO: 873916 - RNA, 20 nt, Homo sapiens
ccauguggaguggacauuca

SEQ ID NO: 873917 - RNA, 21 nt, Homo sapiens
ccauguggaguggacauucaa

SEQ ID NO: 873918 - RNA, 23 nt, Homo sapiens
ccauguggcugaagacauuccaa

SEQ ID NO: 873919 - RNA, 13 nt, Homo sapiens
ccauuaccugacu

SEQ ID NO: 873920 - RNA, 16 nt, Homo sapiens
ccauuaggcaugccua

SEQ ID NO: 873921 - RNA, 14 nt, Homo sapiens
ccauucacagagcc

SEQ ID NO: 873922 - RNA, 17 nt, Homo sapiens
ccauucacagccaggag

SEQ ID NO: 873923 - RNA, 18 nt, Homo sapiens
ccauucacagccaggaga

SEQ ID NO: 873924 - RNA, 22 nt, Homo sapiens
ccauuccaagucaacacucuuc

SEQ ID NO: 873925 - RNA, 17 nt, Homo sapiens
ccauuccagacugcuuc

SEQ ID NO: 873926 - RNA, 13 nt, Homo sapiens
ccauucugaccau

SEQ ID NO: 873927 - RNA, 21 nt, Homo sapiens
ccauugaauuugccuuccuca

SEQ ID NO: 873928 - RNA, 19 nt, Homo sapiens
ccauugaccucagcugcac

SEQ ID NO: 873929 - RNA, 11 nt, Homo sapiens
ccauugcauca

SEQ ID NO: 873930 - RNA, 16 nt, Homo sapiens
ccauugcccugugagg

SEQ ID NO: 873931 - RNA, 23 nt, Homo sapiens
ccauuguguugggaccugugauc

SEQ ID NO: 873932 - RNA, 23 nt, Homo sapiens
ccauuuuuuucauuguguucucu

SEQ ID NO: 873933 - RNA, 12 nt, Homo sapiens
cccaaagagccu

SEQ ID NO: 873934 - RNA, 14 nt, Homo sapiens
cccaacugcucugc

SEQ ID NO: 873935 - RNA, 11 nt, Homo sapiens
cccaagacagc

SEQ ID NO: 873936 - RNA, 22 nt, Homo sapiens
cccaagaggacugagacuggca

SEQ ID NO: 873937 - RNA, 12 nt, Homo sapiens
cccaagccaugg

SEQ ID NO: 873938 - RNA, 22 nt, Homo sapiens
cccaaggaaaauggacauauuc

SEQ ID NO: 873939 - RNA, 19 nt, Homo sapiens
cccaaggggacuugugcca

SEQ ID NO: 873940 - RNA, 16 nt, Homo sapiens
cccaauucauuucauc

SEQ ID NO: 873941 - RNA, 18 nt, Homo sapiens
cccacagcacccaggcuc

SEQ ID NO: 873942 - RNA, 15 nt, Homo sapiens
cccacagcacuaauu

SEQ ID NO: 873943 - RNA, 13 nt, Homo sapiens
cccacagguauga

SEQ ID NO: 873944 - RNA, 15 nt, Homo sapiens
cccacaugaucuuga

SEQ ID NO: 873945 - RNA, 19 nt, Homo sapiens
cccacaugugacacauaug

SEQ ID NO: 873946 - RNA, 20 nt, Homo sapiens
cccaccacgugcucaaucau

SEQ ID NO: 873947 - RNA, 15 nt, Homo sapiens
cccaccaucaugucu

SEQ ID NO: 873948 - RNA, 14 nt, Homo sapiens
cccacccacaugug

SEQ ID NO: 873949 - RNA, 15 nt, Homo sapiens
cccaccccacuccag

SEQ ID NO: 873950 - RNA, 16 nt, Homo sapiens
cccacccccucuuugu

SEQ ID NO: 873951 - RNA, 22 nt, Homo sapiens
cccacucccuggcucucagaag

SEQ ID NO: 873952 - RNA, 22 nt, Homo sapiens
cccacugaguuugcuguuugca

SEQ ID NO: 873953 - RNA, 16 nt, Homo sapiens
cccacugcucugguua

SEQ ID NO: 873954 - RNA, 18 nt, Homo sapiens
cccacuggaucuucagaa

SEQ ID NO: 873955 - RNA, 15 nt, Homo sapiens
cccacuggcauuaaa

SEQ ID NO: 873956 - RNA, 21 nt, Homo sapiens
cccacuuacuaaccugguccu

SEQ ID NO: 873957 - RNA, 15 nt, Homo sapiens
cccacuucacuguga

SEQ ID NO: 873958 - RNA, 15 nt, Homo sapiens
cccacuucugccaua

SEQ ID NO: 873959 - RNA, 17 nt, Homo sapiens
cccagaaagaggcagug

SEQ ID NO: 873960 - RNA, 21 nt, Homo sapiens
cccagacucuaaauauuucau

SEQ ID NO: 873961 - RNA, 14 nt, Homo sapiens
cccagagaccccuu

SEQ ID NO: 873962 - RNA, 22 nt, Homo sapiens
cccagagcacaaguuccagcug

SEQ ID NO: 873963 - RNA, 12 nt, Homo sapiens
cccagauuuccu

SEQ ID NO: 873964 - RNA, 18 nt, Homo sapiens
cccagcaugcugagauua

SEQ ID NO: 873965 - RNA, 14 nt, Homo sapiens
cccagccaugguga

SEQ ID NO: 873966 - RNA, 20 nt, Homo sapiens
cccagcccacuucugccaua

SEQ ID NO: 873967 - RNA, 17 nt, Homo sapiens
cccagccccaggggugc

SEQ ID NO: 873968 - RNA, 23 nt, Homo sapiens
cccagccccuguggagggggugc

SEQ ID NO: 873969 - RNA, 17 nt, Homo sapiens
cccagcccuauggaugu

SEQ ID NO: 873970 - RNA, 23 nt, Homo sapiens
cccagcccucaggccagugccag

SEQ ID NO: 873971 - RNA, 13 nt, Homo sapiens
cccagcuacucag

SEQ ID NO: 873972 - RNA, 21 nt, Homo sapiens
cccagcuucauuaugcagcug

SEQ ID NO: 873973 - RNA, 12 nt, Homo sapiens
cccagcuuuauc

SEQ ID NO: 873974 - RNA, 23 nt, Homo sapiens
cccaggagaagaaagaggugacc

SEQ ID NO: 873975 - RNA, 17 nt, Homo sapiens
cccaggcaaacuugcac

SEQ ID NO: 873976 - RNA, 21 nt, Homo sapiens
cccaggcccuaggauuccucc

SEQ ID NO: 873977 - RNA, 17 nt, Homo sapiens
cccaggccuccagccuc

SEQ ID NO: 873978 - RNA, 23 nt, Homo sapiens
cccaggcuggagugcaguagcac

SEQ ID NO: 873979 - RNA, 19 nt, Homo sapiens
cccaggcuggcgugcagug

SEQ ID NO: 873980 - RNA, 15 nt, Homo sapiens
cccagggacaaaaca

SEQ ID NO: 873981 - RNA, 17 nt, Homo sapiens
cccagggggcggggugc

SEQ ID NO: 873982 - RNA, 19 nt, Homo sapiens
ggacgagacccuacaggag

SEQ ID NO: 873983 - RNA, 18 nt, Homo sapiens
ggacgcaauugugggaug

SEQ ID NO: 873984 - RNA, 15 nt, Homo sapiens
ggacgcuuccagacc

SEQ ID NO: 873985 - RNA, 20 nt, Homo sapiens
ggacuacuauuugaagcaau

SEQ ID NO: 873986 - RNA, 22 nt, Homo sapiens
ggacuauuauaauuuaaugcau

SEQ ID NO: 873987 - RNA, 13 nt, Homo sapiens
ggacuccugucug

SEQ ID NO: 873988 - RNA, 14 nt, Homo sapiens
ggacugacauuucu

SEQ ID NO: 873989 - RNA, 17 nt, Homo sapiens
ggacugcauaaaccaau

SEQ ID NO: 873990 - RNA, 23 nt, Homo sapiens
ggacuggcuucucuuucucugag

SEQ ID NO: 873991 - RNA, 22 nt, Homo sapiens
ggacuucuccuccaguggaccu

SEQ ID NO: 873992 - RNA, 22 nt, Homo sapiens
ggacuuugguucucuccaggaa

SEQ ID NO: 873993 - RNA, 17 nt, Homo sapiens
ggacuuuugaaaagcuu

SEQ ID NO: 873994 - RNA, 18 nt, Homo sapiens
ggagaagagcuguucaca

SEQ ID NO: 873995 - RNA, 17 nt, Homo sapiens
ggagacaaaacuagaga

SEQ ID NO: 873996 - RNA, 22 nt, Homo sapiens
ggagacaauaacuccagugaug

SEQ ID NO: 873997 - RNA, 17 nt, Homo sapiens
ggagacacugugcuaua

SEQ ID NO: 873998 - RNA, 21 nt, Homo sapiens
ggagacucaccucugccucaa

SEQ ID NO: 873999 - RNA, 15 nt, Homo sapiens
ggagacugcaucuca

SEQ ID NO: 874000 - RNA, 14 nt, Homo sapiens
ggagagaaguuucu

SEQ ID NO: 874001 - RNA, 14 nt, Homo sapiens
ggagagacagugac

SEQ ID NO: 874002 - RNA, 13 nt, Homo sapiens
ggagagcccuuca

SEQ ID NO: 874003 - RNA, 22 nt, Homo sapiens
ggagaggcggccucgugccaug

SEQ ID NO: 874004 - RNA, 19 nt, Homo sapiens
ggagaguugaccguuuuca

SEQ ID NO: 874005 - RNA, 21 nt, Homo sapiens
ggagauggguuuggaggccaa

SEQ ID NO: 874006 - RNA, 14 nt, Homo sapiens
ggagcaaauguuuc

SEQ ID NO: 874007 - RNA, 13 nt, Homo sapiens
ggagcacuggguu

SEQ ID NO: 874008 - RNA, 16 nt, Homo sapiens
ggagcaggaacagaga

SEQ ID NO: 874009 - RNA, 23 nt, Homo sapiens
ggagcaguaaacuuucucugcaa

SEQ ID NO: 874010 - RNA, 15 nt, Homo sapiens
ggagccagugcccac

SEQ ID NO: 874011 - RNA, 21 nt, Homo sapiens
ggagccucgguggccaugcuu

SEQ ID NO: 874012 - RNA, 21 nt, Homo sapiens
ggagccugaacaugacauuuc

SEQ ID NO: 874013 - RNA, 15 nt, Homo sapiens
ggagccugaggcaug

SEQ ID NO: 874014 - RNA, 19 nt, Homo sapiens
ggagcuggaaauaaaccug

SEQ ID NO: 874015 - RNA, 21 nt, Homo sapiens
ggagcuggaaauaaaccugga

SEQ ID NO: 874016 - RNA, 13 nt, Homo sapiens
ggagcuugcagug

SEQ ID NO: 874017 - RNA, 16 nt, Homo sapiens
ggaggaccugagccug

SEQ ID NO: 874018 - RNA, 19 nt, Homo sapiens
ggaggacgguuaacuugua

SEQ ID NO: 874019 - RNA, 12 nt, Homo sapiens
ggaggaugacca

SEQ ID NO: 874020 - RNA, 21 nt, Homo sapiens
ggaggauugcuucuugugaaa

SEQ ID NO: 874021 - RNA, 23 nt, Homo sapiens
ggaggcaccagcucuguggccug

SEQ ID NO: 874022 - RNA, 17 nt, Homo sapiens
ggaggccucacacccag

SEQ ID NO: 874023 - RNA, 14 nt, Homo sapiens
ggagggagggacaa

SEQ ID NO: 874024 - RNA, 21 nt, Homo sapiens
ggaggucccugccaguguuua

SEQ ID NO: 874025 - RNA, 14 nt, Homo sapiens
ggaggucgacccca

SEQ ID NO: 874026 - RNA, 20 nt, Homo sapiens
ggaggugaccccagguuucu

SEQ ID NO: 874027 - RNA, 22 nt, Homo sapiens
ggagguugcagugagcugagau

SEQ ID NO: 874028 - RNA, 23 nt, Homo sapiens
gugcaccccuccccauucacaga

SEQ ID NO: 874029 - RNA, 15 nt, Homo sapiens
gugcacuagcauuuu

SEQ ID NO: 874030 - RNA, 17 nt, Homo sapiens
gugcagaagaauccgag

SEQ ID NO: 874031 - RNA, 18 nt, Homo sapiens
gugcaguaguaauugauu

SEQ ID NO: 874032 - RNA, 16 nt, Homo sapiens
gugcauguugccauga

SEQ ID NO: 874033 - RNA, 18 nt, Homo sapiens
gugcauuuaugagcucuu

SEQ ID NO: 874034 - RNA, 16 nt, Homo sapiens
gugcauuucuugacuu

SEQ ID NO: 874035 - RNA, 11 nt, Homo sapiens
gugcauuuuau

SEQ ID NO: 874036 - RNA, 18 nt, Homo sapiens
gugccaauauuucugaua

SEQ ID NO: 874037 - RNA, 21 nt, Homo sapiens
gugccaggcuguaagcauucu

SEQ ID NO: 874038 - RNA, 17 nt, Homo sapiens
gugccaguuauggcuau

SEQ ID NO: 874039 - RNA, 12 nt, Homo sapiens
gugccaucccac

SEQ ID NO: 874040 - RNA, 21 nt, Homo sapiens
gugccauuuuaagaguuacuu

SEQ ID NO: 874041 - RNA, 17 nt, Homo sapiens
gugcccucccauagcac

SEQ ID NO: 874042 - RNA, 20 nt, Homo sapiens
gugccuauuuauucauucag

SEQ ID NO: 874043 - RNA, 11 nt, Homo sapiens
gugccugagac

SEQ ID NO: 874044 - RNA, 14 nt, Homo sapiens
gugccugagacacc

SEQ ID NO: 874045 - RNA, 15 nt, Homo sapiens
gugccuguaauccca

SEQ ID NO: 874046 - RNA, 12 nt, Homo sapiens
gugccugugauc

SEQ ID NO: 874047 - RNA, 22 nt, Homo sapiens
gugccuuucucuggcuccagaa

SEQ ID NO: 874048 - RNA, 17 nt, Homo sapiens
gugccuuugaccaucuc

SEQ ID NO: 874049 - RNA, 21 nt, Homo sapiens
gugcuaagaaagcaagccaau

SEQ ID NO: 874050 - RNA, 13 nt, Homo sapiens
gugcuacaaaaac

SEQ ID NO: 874051 - RNA, 17 nt, Homo sapiens
gugcuacacuugcaccu

SEQ ID NO: 874052 - RNA, 16 nt, Homo sapiens
gugcuaugccaagcca

SEQ ID NO: 874053 - RNA, 21 nt, Homo sapiens
gugcucauucauuuaacagag

SEQ ID NO: 874054 - RNA, 20 nt, Homo sapiens
gugcuccuccuuggugccug

SEQ ID NO: 874055 - RNA, 15 nt, Homo sapiens
gugcucggcagucau

SEQ ID NO: 874056 - RNA, 15 nt, Homo sapiens
gugcucuccuacccc

SEQ ID NO: 874057 - RNA, 13 nt, Homo sapiens
gugcugcaaggaa

SEQ ID NO: 874058 - RNA, 15 nt, Homo sapiens
gugcugcagccagga

SEQ ID NO: 874059 - RNA, 16 nt, Homo sapiens
gugcugccaguccucu

SEQ ID NO: 874060 - RNA, 18 nt, Homo sapiens
gugcugggauuacaggug

SEQ ID NO: 874061 - RNA, 21 nt, Homo sapiens
gugcugggauuacagguguga

SEQ ID NO: 874062 - RNA, 22 nt, Homo sapiens
gugcuuccacuucuaugcaaau

SEQ ID NO: 874063 - RNA, 14 nt, Homo sapiens
guggaagaaggaaa

SEQ ID NO: 874064 - RNA, 19 nt, Homo sapiens
guggaauagccucccugua

SEQ ID NO: 874065 - RNA, 16 nt, Homo sapiens
guggagcuccugcugg

SEQ ID NO: 874066 - RNA, 18 nt, Homo sapiens
guggaggaaaauccaugg

SEQ ID NO: 874067 - RNA, 15 nt, Homo sapiens
guggagguugcagug

SEQ ID NO: 874068 - RNA, 16 nt, Homo sapiens
guggagguugcaguga

SEQ ID NO: 874069 - RNA, 22 nt, Homo sapiens
guggcagaauggggugcaugaa

SEQ ID NO: 874070 - RNA, 22 nt, Homo sapiens
guggcaucucuaauuggaagaa

SEQ ID NO: 874071 - RNA, 17 nt, Homo sapiens
guggcauuaaacauuug

SEQ ID NO: 874072 - RNA, 17 nt, Homo sapiens
guggccagcacucugaa

SEQ ID NO: 874073 - RNA, 15 nt, Homo sapiens
guggccccaacacaa

SEQ ID NO: 874074 - RNA, 17 nt, Homo sapiens
guggcuaaaugccuaau

SEQ ID NO: 874075 - RNA, 18 nt, Homo sapiens
guggcuaauucaauuuau

SEQ ID NO: 874076 - RNA, 18 nt, Homo sapiens
guggcuucccgcucagcc

SEQ ID NO: 874077 - RNA, 18 nt, Homo sapiens
gugggagagacacuccca

SEQ ID NO: 874078 - RNA, 20 nt, Homo sapiens
gugggagagagacguguaca

SEQ ID NO: 874079 - RNA, 15 nt, Homo sapiens
gugggcuccuuacag

SEQ ID NO: 874080 - RNA, 21 nt, Homo sapiens
gugggguaaccaaauguuggc

SEQ ID NO: 874081 - RNA, 20 nt, Homo sapiens
gugggguccccaucauccca

SEQ ID NO: 874082 - RNA, 22 nt, Homo sapiens
gugggugccccccuugccagac

SEQ ID NO: 874083 - RNA, 14 nt, Homo sapiens
gugguacagcacug

SEQ ID NO: 874084 - RNA, 15 nt, Homo sapiens
gugguaccagcucac

SEQ ID NO: 874085 - RNA, 14 nt, Homo sapiens
guggugauguugcc

SEQ ID NO: 874086 - RNA, 19 nt, Homo sapiens
guggugcccaugaggacaa

SEQ ID NO: 874087 - RNA, 23 nt, Homo sapiens
gugguggcauacgccuguagucc

SEQ ID NO: 874088 - RNA, 11 nt, Homo sapiens
guguacaggga

SEQ ID NO: 874089 - RNA, 15 nt, Homo sapiens
guguagugucuguaa

SEQ ID NO: 874090 - RNA, 22 nt, Homo sapiens
guguauuuugagauaaugucaa

SEQ ID NO: 874091 - RNA, 14 nt, Homo sapiens
gugucagagcuggg

SEQ ID NO: 874092 - RNA, 22 nt, Homo sapiens
gugucagagcugggaguagcau

SEQ ID NO: 874093 - RNA, 14 nt, Homo sapiens
guguccagcacaga

SEQ ID NO: 874094 - RNA, 14 nt, Homo sapiens
guguccugccuuga

SEQ ID NO: 874095 - RNA, 18 nt, Homo sapiens
guguccugccuugaugaa

SEQ ID NO: 874096 - RNA, 21 nt, Homo sapiens
guguccugccuugaugaagcc

SEQ ID NO: 874097 - RNA, 12 nt, Homo sapiens
gugucucaggag

SEQ ID NO: 874098 - RNA, 17 nt, Homo sapiens
gugugaagaaauggaau

SEQ ID NO: 874099 - RNA, 17 nt, Homo sapiens
cggacaguuuauuuguu

SEQ ID NO: 874100 - RNA, 21 nt, Homo sapiens
cggacucacuauggccagaaa

SEQ ID NO: 874101 - RNA, 22 nt, Homo sapiens
cggagaagagcuguucacagcc

SEQ ID NO: 874102 - RNA, 20 nt, Homo sapiens
cggagcaggggucugagcca

SEQ ID NO: 874103 - RNA, 12 nt, Homo sapiens
cggagcugccag

SEQ ID NO: 874104 - RNA, 16 nt, Homo sapiens
cggagguugcagugag

SEQ ID NO: 874105 - RNA, 17 nt, Homo sapiens
cggagucuugcucuguu

SEQ ID NO: 874106 - RNA, 14 nt, Homo sapiens
cggaugcacagaga

SEQ ID NO: 874107 - RNA, 21 nt, Homo sapiens
cggaugucccaucugcuccuc

SEQ ID NO: 874108 - RNA, 22 nt, Homo sapiens
cggaugugugucucaccccuca

SEQ ID NO: 874109 - RNA, 14 nt, Homo sapiens
cggcacacaaggca

SEQ ID NO: 874110 - RNA, 21 nt, Homo sapiens
cggcaucgggccaucucagau

SEQ ID NO: 874111 - RNA, 17 nt, Homo sapiens
cggcccagaaguuuccc

SEQ ID NO: 874112 - RNA, 14 nt, Homo sapiens
cggccucccaaagu

SEQ ID NO: 874113 - RNA, 14 nt, Homo sapiens
cggcggcagggugg

SEQ ID NO: 874114 - RNA, 21 nt, Homo sapiens
cggcugagucaugaucucccu

SEQ ID NO: 874115 - RNA, 16 nt, Homo sapiens
cggcugcccgacucag

SEQ ID NO: 874116 - RNA, 15 nt, Homo sapiens
cggcugccucaggag

SEQ ID NO: 874117 - RNA, 13 nt, Homo sapiens
cggcuuccaggga

SEQ ID NO: 874118 - RNA, 15 nt, Homo sapiens
cgggagcagugucuu

SEQ ID NO: 874119 - RNA, 22 nt, Homo sapiens
cgggaggauguucugggacaca

SEQ ID NO: 874120 - RNA, 17 nt, Homo sapiens
cgggauuugaagcugua

SEQ ID NO: 874121 - RNA, 19 nt, Homo sapiens
cgggcacucagaagacacu

SEQ ID NO: 874122 - RNA, 18 nt, Homo sapiens
cgggccaccaaguucugg

SEQ ID NO: 874123 - RNA, 21 nt, Homo sapiens
cgggccuggagaacuagagaa

SEQ ID NO: 874124 - RNA, 22 nt, Homo sapiens
cggggaggaaagcaaaauccaa

SEQ ID NO: 874125 - RNA, 14 nt, Homo sapiens
cggggcacugcagg

SEQ ID NO: 874126 - RNA, 22 nt, Homo sapiens
cgggggaaagcacaccucaugc

SEQ ID NO: 874127 - RNA, 17 nt, Homo sapiens
cgggggagcuggaaaua

SEQ ID NO: 874128 - RNA, 15 nt, Homo sapiens
cgggggcacugccug

SEQ ID NO: 874129 - RNA, 19 nt, Homo sapiens
cggguguguacaccaaggu

SEQ ID NO: 874130 - RNA, 15 nt, Homo sapiens
cggguuacuuucaca

SEQ ID NO: 874131 - RNA, 18 nt, Homo sapiens
cgguaccuggcaauguuu

SEQ ID NO: 874132 - RNA, 17 nt, Homo sapiens
cggucccacacugguga

SEQ ID NO: 874133 - RNA, 20 nt, Homo sapiens
cgguuuguauuuagugucuu

SEQ ID NO: 874134 - RNA, 12 nt, Homo sapiens
cguacauucaau

SEQ ID NO: 874135 - RNA, 17 nt, Homo sapiens
cgucaaagcaguaguca

SEQ ID NO: 874136 - RNA, 16 nt, Homo sapiens
cgucagaccaguacug

SEQ ID NO: 874137 - RNA, 14 nt, Homo sapiens
cguccauggcacca

SEQ ID NO: 874138 - RNA, 13 nt, Homo sapiens
cgucccaaacaga

SEQ ID NO: 874139 - RNA, 19 nt, Homo sapiens
cgucuccugacaugucuca

SEQ ID NO: 874140 - RNA, 15 nt, Homo sapiens
cgucuccuuugacau

SEQ ID NO: 874141 - RNA, 14 nt, Homo sapiens
cgucuucucuccau

SEQ ID NO: 874142 - RNA, 19 nt, Homo sapiens
cgucuucuguauacugugg

SEQ ID NO: 874143 - RNA, 15 nt, Homo sapiens
cgugaaauugaugcc

SEQ ID NO: 874144 - RNA, 18 nt, Homo sapiens
cgugagagaaucugccug

SEQ ID NO: 874145 - RNA, 17 nt, Homo sapiens
cgugagcagcuuuggaa

SEQ ID NO: 874146 - RNA, 13 nt, Homo sapiens
cgugauaaugcag

SEQ ID NO: 874147 - RNA, 20 nt, Homo sapiens
cgugauaaugcagacuuccu

SEQ ID NO: 874148 - RNA, 15 nt, Homo sapiens
cgugauuucaguuga

SEQ ID NO: 874149 - RNA, 13 nt, Homo sapiens
cgugcacucccua

SEQ ID NO: 874150 - RNA, 20 nt, Homo sapiens
cguggaauugugcugaguug

SEQ ID NO: 874151 - RNA, 17 nt, Homo sapiens
cguggacucugcacaug

SEQ ID NO: 874152 - RNA, 22 nt, Homo sapiens
cguggggggagguggacagucc

SEQ ID NO: 874153 - RNA, 19 nt, Homo sapiens
cguggucuccuugcacuuu

SEQ ID NO: 874154 - RNA, 20 nt, Homo sapiens
cguggucuccuugcacuuuc

SEQ ID NO: 874155 - RNA, 19 nt, Homo sapiens
cguggugugucaaugccac

SEQ ID NO: 874156 - RNA, 17 nt, Homo sapiens
cguguacuacaauuuaa

SEQ ID NO: 874157 - RNA, 21 nt, Homo sapiens
cguguguauuagaaugcaugu

SEQ ID NO: 874158 - RNA, 22 nt, Homo sapiens
cguuaagggaaggaacucuggc

SEQ ID NO: 874159 - RNA, 19 nt, Homo sapiens
cguuggccuaacacugggc

SEQ ID NO: 874160 - RNA, 23 nt, Homo sapiens
cguuuccugagaagugucuaaaa

SEQ ID NO: 874161 - RNA, 19 nt, Homo sapiens
cuaaaaauaaaccaaagga

SEQ ID NO: 874162 - RNA, 17 nt, Homo sapiens
cuaaaaaucaugagauc

SEQ ID NO: 874163 - RNA, 18 nt, Homo sapiens
cuaaaacuaugguuccca

SEQ ID NO: 874164 - RNA, 13 nt, Homo sapiens
cuaaaauauuauu

SEQ ID NO: 874165 - RNA, 19 nt, Homo sapiens
cuaaaauuagaugaacuca

SEQ ID NO: 874166 - RNA, 15 nt, Homo sapiens
cuaaacaauguauuu

SEQ ID NO: 874167 - RNA, 12 nt, Homo sapiens
cuaaagacagaa

SEQ ID NO: 874168 - RNA, 15 nt, Homo sapiens
cuaaagagcuuuagu

SEQ ID NO: 874169 - RNA, 23 nt, Homo sapiens
cuaaagaguuauucaaaugaagg

SEQ ID NO: 874170 - RNA, 14 nt, Homo sapiens
cuaaagccaguggc

SEQ ID NO: 874171 - RNA, 17 nt, Homo sapiens
cuaaagccaguggcagu

SEQ ID NO: 874172 - RNA, 16 nt, Homo sapiens
cuaaagguuguauugc

SEQ ID NO: 874173 - RNA, 21 nt, Homo sapiens
cuaaagucacauauaaaaguu

SEQ ID NO: 874174 - RNA, 13 nt, Homo sapiens
cuaaauaaaugaa

SEQ ID NO: 874175 - RNA, 20 nt, Homo sapiens
cuaaauaauguuaucugugu

SEQ ID NO: 874176 - RNA, 22 nt, Homo sapiens
cuaaauaguucuaucaggaaaa

SEQ ID NO: 874177 - RNA, 23 nt, Homo sapiens
cuaaauccaaaugaggauaucau

SEQ ID NO: 874178 - RNA, 18 nt, Homo sapiens
cuaaaugaauguuuacac

SEQ ID NO: 874179 - RNA, 15 nt, Homo sapiens
cuaaauuugguucua

SEQ ID NO: 874180 - RNA, 19 nt, Homo sapiens
cuaacaaagaacaagcauu

SEQ ID NO: 874181 - RNA, 22 nt, Homo sapiens
cuaacaaguagcacccuggauu

SEQ ID NO: 874182 - RNA, 20 nt, Homo sapiens
cuaacacagccaucaaggga

SEQ ID NO: 874183 - RNA, 15 nt, Homo sapiens
cuaacaccaacauaa

SEQ ID NO: 874184 - RNA, 23 nt, Homo sapiens
cuaaccauaguuauuuacuugaa

SEQ ID NO: 874185 - RNA, 23 nt, Homo sapiens
cuaacccccagcccacagagccu

SEQ ID NO: 874186 - RNA, 23 nt, Homo sapiens
cuaacccccagugccacagagaa

SEQ ID NO: 874187 - RNA, 17 nt, Homo sapiens
cuaacuguaaaucacuu

SEQ ID NO: 874188 - RNA, 14 nt, Homo sapiens
cuaacuguaugugu

SEQ ID NO: 874189 - RNA, 19 nt, Homo sapiens
cuaacuguaugugucuuua

SEQ ID NO: 874190 - RNA, 19 nt, Homo sapiens
cuaagaaauaugcacaaua

SEQ ID NO: 874191 - RNA, 20 nt, Homo sapiens
cuaagaaaucauggcauuca

SEQ ID NO: 874192 - RNA, 23 nt, Homo sapiens
cuaagaaaucauggcauucacac

SEQ ID NO: 874193 - RNA, 20 nt, Homo sapiens
cuaagaaaugcugaaaauca

SEQ ID NO: 874194 - RNA, 15 nt, Homo sapiens
cuaagcaaaaccacu

SEQ ID NO: 874195 - RNA, 12 nt, Homo sapiens
cuaagccuccuu

SEQ ID NO: 874196 - RNA, 18 nt, Homo sapiens
cuaagccuguugagacuu

SEQ ID NO: 874197 - RNA, 13 nt, Homo sapiens
cuaagccuguugc

SEQ ID NO: 874198 - RNA, 21 nt, Homo sapiens
cuaagccuguugcugaaguca

SEQ ID NO: 874199 - RNA, 17 nt, Homo sapiens
cuaagccuuuccauaag

SEQ ID NO: 874200 - RNA, 22 nt, Homo sapiens
cuaagcuggugccccacugaau

SEQ ID NO: 874201 - RNA, 18 nt, Homo sapiens
cuaagggccacaucccac

SEQ ID NO: 874202 - RNA, 18 nt, Homo sapiens
cuaaguggaauagccucc

SEQ ID NO: 874203 - RNA, 14 nt, Homo sapiens
cuaauacuaauuca

SEQ ID NO: 874204 - RNA, 22 nt, Homo sapiens
cuaaucagcauucucacuccua

SEQ ID NO: 874205 - RNA, 19 nt, Homo sapiens
cuaauccuccaagucuuca

SEQ ID NO: 874206 - RNA, 14 nt, Homo sapiens
cuaaucuaugcaug

SEQ ID NO: 874207 - RNA, 22 nt, Homo sapiens
cuaaucucauaccucugaccaa

SEQ ID NO: 874208 - RNA, 21 nt, Homo sapiens
cuaaucuucuuaugcaauuuc

SEQ ID NO: 874209 - RNA, 15 nt, Homo sapiens
cuaaugauuagcacu

SEQ ID NO: 874210 - RNA, 20 nt, Homo sapiens
cuaaugguauauauuguagg

SEQ ID NO: 874211 - RNA, 18 nt, Homo sapiens
cuaauguaugcauucauc

SEQ ID NO: 874212 - RNA, 23 nt, Homo sapiens
cuaaugugccccauguccaaguc

SEQ ID NO: 874213 - RNA, 19 nt, Homo sapiens
gugugcgugugcgugcgug

SEQ ID NO: 874214 - RNA, 18 nt, Homo sapiens
guguggccccagcccgac

SEQ ID NO: 874215 - RNA, 15 nt, Homo sapiens
guguguacauauaua

SEQ ID NO: 874216 - RNA, 14 nt, Homo sapiens
gugugucucgucuc

SEQ ID NO: 874217 - RNA, 22 nt, Homo sapiens
gugugugcacguacacacacau

SEQ ID NO: 874218 - RNA, 14 nt, Homo sapiens
guguguguguauau

SEQ ID NO: 874219 - RNA, 14 nt, Homo sapiens
guguguugauccca

SEQ ID NO: 874220 - RNA, 19 nt, Homo sapiens
guguguuugugugcaugaa

SEQ ID NO: 874221 - RNA, 23 nt, Homo sapiens
guguuacccaguaacucaucugu

SEQ ID NO: 874222 - RNA, 21 nt, Homo sapiens
guguuacgcacacguacuuaa

SEQ ID NO: 874223 - RNA, 23 nt, Homo sapiens
guguuauuauuuggcaugcuuaa

SEQ ID NO: 874224 - RNA, 18 nt, Homo sapiens
guguuauuauuuugcacu

SEQ ID NO: 874225 - RNA, 19 nt, Homo sapiens
guguuauuauuuugcacug

SEQ ID NO: 874226 - RNA, 17 nt, Homo sapiens
guguugacaugugcuuu

SEQ ID NO: 874227 - RNA, 21 nt, Homo sapiens
guguugaggggaccaaagcca

SEQ ID NO: 874228 - RNA, 20 nt, Homo sapiens
guguugggaaaaaggccucu

SEQ ID NO: 874229 - RNA, 20 nt, Homo sapiens
guguuucaucuguucauuca

SEQ ID NO: 874230 - RNA, 13 nt, Homo sapiens
guguuuccuucag

SEQ ID NO: 874231 - RNA, 15 nt, Homo sapiens
guguuucuggggaca

SEQ ID NO: 874232 - RNA, 16 nt, Homo sapiens
guguuucuggggacac

SEQ ID NO: 874233 - RNA, 13 nt, Homo sapiens
guguuucuuacag

SEQ ID NO: 874234 - RNA, 22 nt, Homo sapiens
guguuuuugcuaucacacagug

SEQ ID NO: 874235 - RNA, 17 nt, Homo sapiens
guuaaaaauauuuucug

SEQ ID NO: 874236 - RNA, 19 nt, Homo sapiens
guuaaauaucacaucacuu

SEQ ID NO: 874237 - RNA, 13 nt, Homo sapiens
guuaacaguuuuu

SEQ ID NO: 874238 - RNA, 16 nt, Homo sapiens
guuaaccucaguguca

SEQ ID NO: 874239 - RNA, 19 nt, Homo sapiens
guuaacuauuuauucccug

SEQ ID NO: 874240 - RNA, 11 nt, Homo sapiens
guuaacuuaau

SEQ ID NO: 874241 - RNA, 14 nt, Homo sapiens
guuaagaauggaag

SEQ ID NO: 874242 - RNA, 14 nt, Homo sapiens
guuaagcaaaggaa

SEQ ID NO: 874243 - RNA, 11 nt, Homo sapiens
guuacauauua

SEQ ID NO: 874244 - RNA, 18 nt, Homo sapiens
guuacauguuugcaccuu

SEQ ID NO: 874245 - RNA, 15 nt, Homo sapiens
guuaccaaagcaaua

SEQ ID NO: 874246 - RNA, 20 nt, Homo sapiens
guuaccgaggacccugguua

SEQ ID NO: 874247 - RNA, 17 nt, Homo sapiens
guuaccuuucccaugcu

SEQ ID NO: 874248 - RNA, 14 nt, Homo sapiens
guuacuacaugcac

SEQ ID NO: 874249 - RNA, 11 nt, Homo sapiens
guuacuauuau

SEQ ID NO: 874250 - RNA, 15 nt, Homo sapiens
guuacuguugcacug

SEQ ID NO: 874251 - RNA, 17 nt, Homo sapiens
guuacuguugcacugau

SEQ ID NO: 874252 - RNA, 21 nt, Homo sapiens
guuacuugaaauaccagugaa

SEQ ID NO: 874253 - RNA, 14 nt, Homo sapiens
guuagaugaggcac

SEQ ID NO: 874254 - RNA, 18 nt, Homo sapiens
guuaggaaauaaaaccuu

SEQ ID NO: 874255 - RNA, 17 nt, Homo sapiens
guuagggaugacuguga

SEQ ID NO: 874256 - RNA, 17 nt, Homo sapiens
guuauaaaucaauguca

SEQ ID NO: 874257 - RNA, 22 nt, Homo sapiens
guuauaaaucaaugucacuuaa

SEQ ID NO: 874258 - RNA, 23 nt, Homo sapiens
guuauaaaucaaugucacuuaaa

SEQ ID NO: 874259 - RNA, 15 nt, Homo sapiens
guuauagaaacugau

SEQ ID NO: 874260 - RNA, 19 nt, Homo sapiens
guuauagaaacugauauau

SEQ ID NO: 874261 - RNA, 14 nt, Homo sapiens
guuauagacugcca

SEQ ID NO: 874262 - RNA, 19 nt, Homo sapiens
guuauagauauguagauaa

SEQ ID NO: 874263 - RNA, 13 nt, Homo sapiens
guuauauauauca

SEQ ID NO: 874264 - RNA, 14 nt, Homo sapiens
guuaucaaccauau

SEQ ID NO: 874265 - RNA, 15 nt, Homo sapiens
guuaucaaccauaug

SEQ ID NO: 874266 - RNA, 22 nt, Homo sapiens
guuaucacuucauuuaucuuaa

SEQ ID NO: 874267 - RNA, 18 nt, Homo sapiens
guuaucuaauauguaaca

SEQ ID NO: 874268 - RNA, 12 nt, Homo sapiens
guuaucugcuag

SEQ ID NO: 874269 - RNA, 16 nt, Homo sapiens
guuauggucaauccca

SEQ ID NO: 874270 - RNA, 16 nt, Homo sapiens
guuaugugacuaucuu

SEQ ID NO: 874271 - RNA, 22 nt, Homo sapiens
guuauuaguccaaaugugauca

SEQ ID NO: 874272 - RNA, 18 nt, Homo sapiens
guuauuauuuugcacugu

SEQ ID NO: 874273 - RNA, 13 nt, Homo sapiens
guuauucuugaca

SEQ ID NO: 874274 - RNA, 13 nt, Homo sapiens
guuauuguaggca

SEQ ID NO: 874275 - RNA, 14 nt, Homo sapiens
guuauuuacuugaa

SEQ ID NO: 874276 - RNA, 19 nt, Homo sapiens
guuauuuuaaaaaaauuca

SEQ ID NO: 874277 - RNA, 15 nt, Homo sapiens
guuauuuuaauuauc

SEQ ID NO: 874278 - RNA, 17 nt, Homo sapiens
guucaaauccucaccau

SEQ ID NO: 874279 - RNA, 20 nt, Homo sapiens
guucaaguuauagauucaau

SEQ ID NO: 874280 - RNA, 13 nt, Homo sapiens
guucaccuugccg

SEQ ID NO: 874281 - RNA, 17 nt, Homo sapiens
guucacgcaacuugaaa

SEQ ID NO: 874282 - RNA, 17 nt, Homo sapiens
guucacucuacuuagca

SEQ ID NO: 874283 - RNA, 16 nt, Homo sapiens
guucagguaacaggca

SEQ ID NO: 874284 - RNA, 17 nt, Homo sapiens
guucaguggugugaucu

SEQ ID NO: 874285 - RNA, 20 nt, Homo sapiens
guucauguuuguaaauuaau

SEQ ID NO: 874286 - RNA, 17 nt, Homo sapiens
guucauuuuagugacug

SEQ ID NO: 874287 - RNA, 21 nt, Homo sapiens
guucccccucccugugugaaa

SEQ ID NO: 874288 - RNA, 12 nt, Homo sapiens
guuccugcacuc

SEQ ID NO: 874289 - RNA, 16 nt, Homo sapiens
guucgagaccaaccug

SEQ ID NO: 874290 - RNA, 21 nt, Homo sapiens
guucgccgcguggaaugugag

SEQ ID NO: 874291 - RNA, 15 nt, Homo sapiens
guucguggcugcaaa

SEQ ID NO: 874292 - RNA, 15 nt, Homo sapiens
guucuaaguucaugu

SEQ ID NO: 874293 - RNA, 14 nt, Homo sapiens
guucuauaugcauu

SEQ ID NO: 874294 - RNA, 13 nt, Homo sapiens
guucuaucccacc

SEQ ID NO: 874295 - RNA, 17 nt, Homo sapiens
guucuauuuguauauau

SEQ ID NO: 874296 - RNA, 14 nt, Homo sapiens
guucucacacuggu

SEQ ID NO: 874297 - RNA, 16 nt, Homo sapiens
guucucuauuuugccu

SEQ ID NO: 874298 - RNA, 20 nt, Homo sapiens
guucucuucuuuaaagggau

SEQ ID NO: 874299 - RNA, 15 nt, Homo sapiens
guucuggaaaccacg

SEQ ID NO: 874300 - RNA, 11 nt, Homo sapiens
guucuuaccug

SEQ ID NO: 874301 - RNA, 23 nt, Homo sapiens
guucuugugcauguuuacuuuau

SEQ ID NO: 874302 - RNA, 18 nt, Homo sapiens
guucuuuagcugucacuu

SEQ ID NO: 874303 - RNA, 14 nt, Homo sapiens
guucuuuuacugua

SEQ ID NO: 874304 - RNA, 21 nt, Homo sapiens
guucuuuuuuguuacagcuau

SEQ ID NO: 874305 - RNA, 21 nt, Homo sapiens
guugaagaagaguuugcaaau

SEQ ID NO: 874306 - RNA, 18 nt, Homo sapiens
guugagguacaguuugca

SEQ ID NO: 874307 - RNA, 23 nt, Homo sapiens
guugcagucucagaaagccuucc

SEQ ID NO: 874308 - RNA, 14 nt, Homo sapiens
guugcauuugucaa

SEQ ID NO: 874309 - RNA, 22 nt, Homo sapiens
guugcucaaaucuauucagaca

SEQ ID NO: 874310 - RNA, 16 nt, Homo sapiens
guuggaaaaugugcaa

SEQ ID NO: 874311 - RNA, 18 nt, Homo sapiens
guuggaaaaugugcaaua

SEQ ID NO: 874312 - RNA, 21 nt, Homo sapiens
guuggaacugcauucuuuuaa

SEQ ID NO: 874313 - RNA, 22 nt, Homo sapiens
guuggauuuguuuaaaaaccaa

SEQ ID NO: 874314 - RNA, 21 nt, Homo sapiens
guuggccgugguccagcucuu

SEQ ID NO: 874315 - RNA, 13 nt, Homo sapiens
guugggaauugca

SEQ ID NO: 874316 - RNA, 15 nt, Homo sapiens
guugggagcacugga

SEQ ID NO: 874317 - RNA, 19 nt, Homo sapiens
guugguugaacuaugcuga

SEQ ID NO: 874318 - RNA, 17 nt, Homo sapiens
guuguaagcacugacug

SEQ ID NO: 874319 - RNA, 19 nt, Homo sapiens
guuguucgccgcguggaau

SEQ ID NO: 874320 - RNA, 13 nt, Homo sapiens
guuguuugggaga

SEQ ID NO: 874321 - RNA, 21 nt, Homo sapiens
guuuacccaguauuccauuuu

SEQ ID NO: 874322 - RNA, 15 nt, Homo sapiens
guuuaccucuucuau

SEQ ID NO: 874323 - RNA, 22 nt, Homo sapiens
guuuagaagagccugacugugu

SEQ ID NO: 874324 - RNA, 13 nt, Homo sapiens
guuuagaucccau

SEQ ID NO: 874325 - RNA, 22 nt, Homo sapiens
guuuagaucccaugucaccuca

SEQ ID NO: 874326 - RNA, 16 nt, Homo sapiens
guuuaguuacuauuac

SEQ ID NO: 874327 - RNA, 22 nt, Homo sapiens
guuuauccacccacaacaucua

SEQ ID NO: 874328 - RNA, 19 nt, Homo sapiens
cuaauuggaagaaauuccu

SEQ ID NO: 874329 - RNA, 18 nt, Homo sapiens
cuaauuggccucuuuaag

SEQ ID NO: 874330 - RNA, 17 nt, Homo sapiens
cuaauuuaaaccagcag

SEQ ID NO: 874331 - RNA, 21 nt, Homo sapiens
cuaauuuauccugaaauuuca

SEQ ID NO: 874332 - RNA, 21 nt, Homo sapiens
cuaauuuccucugacauguaa

SEQ ID NO: 874333 - RNA, 16 nt, Homo sapiens
cuacaaagcugaagaa

SEQ ID NO: 874334 - RNA, 15 nt, Homo sapiens
cuacaaccagagccc

SEQ ID NO: 874335 - RNA, 16 nt, Homo sapiens
cuacaagcaaauggag

SEQ ID NO: 874336 - RNA, 13 nt, Homo sapiens
cuacacagccugg

SEQ ID NO: 874337 - RNA, 20 nt, Homo sapiens
cuacacaguaaaaacuugua

SEQ ID NO: 874338 - RNA, 22 nt, Homo sapiens
cuacacagugggaacucugaca

SEQ ID NO: 874339 - RNA, 19 nt, Homo sapiens
cuacagauagucaaaccau

SEQ ID NO: 874340 - RNA, 19 nt, Homo sapiens
cuacagccuccucggggga

SEQ ID NO: 874341 - RNA, 17 nt, Homo sapiens
cuacaggugcaagccac

SEQ ID NO: 874342 - RNA, 14 nt, Homo sapiens
cuacaguacuaugu

SEQ ID NO: 874343 - RNA, 23 nt, Homo sapiens
cuacauuaguacacagcaccaga

SEQ ID NO: 874344 - RNA, 18 nt, Homo sapiens
cuaccaagugaccauaaa

SEQ ID NO: 874345 - RNA, 18 nt, Homo sapiens
cuaccaucuaaucuaugc

SEQ ID NO: 874346 - RNA, 18 nt, Homo sapiens
cuaccauuugaauuugug

SEQ ID NO: 874347 - RNA, 13 nt, Homo sapiens
cuacccacuucca

SEQ ID NO: 874348 - RNA, 23 nt, Homo sapiens
cuacccugcuggggaaaguacaa

SEQ ID NO: 874349 - RNA, 15 nt, Homo sapiens
cuaccuaaacauguu

SEQ ID NO: 874350 - RNA, 20 nt, Homo sapiens
cuaccuguguucauucuuac

SEQ ID NO: 874351 - RNA, 17 nt, Homo sapiens
cuaccuucucuacccau

SEQ ID NO: 874352 - RNA, 17 nt, Homo sapiens
cuaccuuuguccaggcc

SEQ ID NO: 874353 - RNA, 22 nt, Homo sapiens
cuacgucaaacaugaagugugu

SEQ ID NO: 874354 - RNA, 18 nt, Homo sapiens
cuacgugccaggcacugu

SEQ ID NO: 874355 - RNA, 14 nt, Homo sapiens
cuacuaaaaacaca

SEQ ID NO: 874356 - RNA, 14 nt, Homo sapiens
cuacucagacuguu

SEQ ID NO: 874357 - RNA, 23 nt, Homo sapiens
cuacucagacuguugcacucuaa

SEQ ID NO: 874358 - RNA, 21 nt, Homo sapiens
cuacucugugccagagccugg

SEQ ID NO: 874359 - RNA, 13 nt, Homo sapiens
cuacuggcagcuc

SEQ ID NO: 874360 - RNA, 18 nt, Homo sapiens
cuacuugccacacacugu

SEQ ID NO: 874361 - RNA, 17 nt, Homo sapiens
cuacuugggagcuauga

SEQ ID NO: 874362 - RNA, 16 nt, Homo sapiens
cuacuuuuuauacucc

SEQ ID NO: 874363 - RNA, 15 nt, Homo sapiens
cuagaaaacauucca

SEQ ID NO: 874364 - RNA, 15 nt, Homo sapiens
cuagaaaucugccaa

SEQ ID NO: 874365 - RNA, 22 nt, Homo sapiens
cuagaacacccacuggccaguc

SEQ ID NO: 874366 - RNA, 19 nt, Homo sapiens
cuagaaccaagaagggcua

SEQ ID NO: 874367 - RNA, 22 nt, Homo sapiens
cuagaaccaagcuucagagccu

SEQ ID NO: 874368 - RNA, 18 nt, Homo sapiens
cuagaaccuggagagcua

SEQ ID NO: 874369 - RNA, 14 nt, Homo sapiens
cuagaacucuccau

SEQ ID NO: 874370 - RNA, 12 nt, Homo sapiens
cuagaaggccac

SEQ ID NO: 874371 - RNA, 12 nt, Homo sapiens
cuagaagucaaa

SEQ ID NO: 874372 - RNA, 23 nt, Homo sapiens
cuagaagugguuuccugauaaca

SEQ ID NO: 874373 - RNA, 12 nt, Homo sapiens
cuagaauuauuc

SEQ ID NO: 874374 - RNA, 14 nt, Homo sapiens
cuagagaacaugcc

SEQ ID NO: 874375 - RNA, 15 nt, Homo sapiens
cuagagaacaugccc

SEQ ID NO: 874376 - RNA, 12 nt, Homo sapiens
cuagagacucaa

SEQ ID NO: 874377 - RNA, 14 nt, Homo sapiens
cuagagaugacuga

SEQ ID NO: 874378 - RNA, 18 nt, Homo sapiens
cuagagcugagagucuga

SEQ ID NO: 874379 - RNA, 21 nt, Homo sapiens
cuagaggcuuccuucauuucc

SEQ ID NO: 874380 - RNA, 22 nt, Homo sapiens
cuagaggcuuccuucauuuccu

SEQ ID NO: 874381 - RNA, 18 nt, Homo sapiens
cuagagugcaguggugca

SEQ ID NO: 874382 - RNA, 20 nt, Homo sapiens
cuagaucaaggagcccagaa

SEQ ID NO: 874383 - RNA, 15 nt, Homo sapiens
cuagauccacacaca

SEQ ID NO: 874384 - RNA, 17 nt, Homo sapiens
cuagcaagaccuguugg

SEQ ID NO: 874385 - RNA, 12 nt, Homo sapiens
cuagcaucucau

SEQ ID NO: 874386 - RNA, 21 nt, Homo sapiens
cuagccaccucccaccccacu

SEQ ID NO: 874387 - RNA, 19 nt, Homo sapiens
cuagcgugcccugccccuc

SEQ ID NO: 874388 - RNA, 23 nt, Homo sapiens
cuagcuaaggaagggaaagggaa

SEQ ID NO: 874389 - RNA, 17 nt, Homo sapiens
cuagcuagaaauaugau

SEQ ID NO: 874390 - RNA, 19 nt, Homo sapiens
cuagcuagaaauaugauuu

SEQ ID NO: 874391 - RNA, 16 nt, Homo sapiens
cuaggaccucauaucu

SEQ ID NO: 874392 - RNA, 23 nt, Homo sapiens
cuaggaccucauaucuuccucau

SEQ ID NO: 874393 - RNA, 13 nt, Homo sapiens
cuaggagaccaag

SEQ ID NO: 874394 - RNA, 21 nt, Homo sapiens
cuaggagguuccggugucugg

SEQ ID NO: 874395 - RNA, 18 nt, Homo sapiens
cuaggaguugaguacagu

SEQ ID NO: 874396 - RNA, 18 nt, Homo sapiens
cuaggcaaagacuggccu

SEQ ID NO: 874397 - RNA, 21 nt, Homo sapiens
cuaggcaaagacuggccugau

SEQ ID NO: 874398 - RNA, 13 nt, Homo sapiens
cuaggggagacac

SEQ ID NO: 874399 - RNA, 17 nt, Homo sapiens
cuaguagcggaucucac

SEQ ID NO: 874400 - RNA, 19 nt, Homo sapiens
cuagucuccuuugcacuga

SEQ ID NO: 874401 - RNA, 15 nt, Homo sapiens
cuagugauuucauua

SEQ ID NO: 874402 - RNA, 21 nt, Homo sapiens
cuagugccugagaugcacgau

SEQ ID NO: 874403 - RNA, 22 nt, Homo sapiens
cuagugugaguggcagccaugc

SEQ ID NO: 874404 - RNA, 16 nt, Homo sapiens
cuaguugaacaucuca

SEQ ID NO: 874405 - RNA, 13 nt, Homo sapiens
cuaguuucauuca

SEQ ID NO: 874406 - RNA, 16 nt, Homo sapiens
cuauaaaaaaaugcau

SEQ ID NO: 874407 - RNA, 20 nt, Homo sapiens
cuauaaagguugacaauaaa

SEQ ID NO: 874408 - RNA, 12 nt, Homo sapiens
cuauagucccag

SEQ ID NO: 874409 - RNA, 17 nt, Homo sapiens
cuauauacuauaugauu

SEQ ID NO: 874410 - RNA, 18 nt, Homo sapiens
cuauauacuauaugauuc

SEQ ID NO: 874411 - RNA, 23 nt, Homo sapiens
cuauauaguuuauugacaauaau

SEQ ID NO: 874412 - RNA, 18 nt, Homo sapiens
cuauaugcauuuaauucu

SEQ ID NO: 874413 - RNA, 16 nt, Homo sapiens
cuauauguagcuuuau

SEQ ID NO: 874414 - RNA, 17 nt, Homo sapiens
cuauaugucuagcucau

SEQ ID NO: 874415 - RNA, 21 nt, Homo sapiens
cuaucacauacaauuugcacu

SEQ ID NO: 874416 - RNA, 20 nt, Homo sapiens
cuaucauuuauuuacaucua

SEQ ID NO: 874417 - RNA, 22 nt, Homo sapiens
cuaucauuucuuuuccaaaauu

SEQ ID NO: 874418 - RNA, 15 nt, Homo sapiens
cuaucccaagccaac

SEQ ID NO: 874419 - RNA, 12 nt, Homo sapiens
cuaucuuuauga

SEQ ID NO: 874420 - RNA, 13 nt, Homo sapiens
cuaugaagucuuu

SEQ ID NO: 874421 - RNA, 15 nt, Homo sapiens
cuaugacacugagca

SEQ ID NO: 874422 - RNA, 15 nt, Homo sapiens
cuaugacuugggcac

SEQ ID NO: 874423 - RNA, 23 nt, Homo sapiens
cuaugaucacagugacuuuacag

SEQ ID NO: 874424 - RNA, 13 nt, Homo sapiens
cuaugaucuuggc

SEQ ID NO: 874425 - RNA, 15 nt, Homo sapiens
cuaugcaaaugccuc

SEQ ID NO: 874426 - RNA, 22 nt, Homo sapiens
cuauggcccugcaaaaauauaa

SEQ ID NO: 874427 - RNA, 15 nt, Homo sapiens
cuaugggggcacuga

SEQ ID NO: 874428 - RNA, 14 nt, Homo sapiens
cuauggucaguuga

SEQ ID NO: 874429 - RNA, 13 nt, Homo sapiens
cuauguacuguaa

SEQ ID NO: 874430 - RNA, 15 nt, Homo sapiens
cuauguacuguaaua

SEQ ID NO: 874431 - RNA, 13 nt, Homo sapiens
cuauguacuuuaa

SEQ ID NO: 874432 - RNA, 20 nt, Homo sapiens
cuauguaucuaccaucuaau

SEQ ID NO: 874433 - RNA, 13 nt, Homo sapiens
cuauguaugcauc

SEQ ID NO: 874434 - RNA, 20 nt, Homo sapiens
cuauguauggaugaaagcaa

SEQ ID NO: 874435 - RNA, 18 nt, Homo sapiens
cuaugucauuucauuucc

SEQ ID NO: 874436 - RNA, 14 nt, Homo sapiens
cuauguugcccagg

SEQ ID NO: 874437 - RNA, 19 nt, Homo sapiens
cuauguugcccaggcaggu

SEQ ID NO: 874438 - RNA, 15 nt, Homo sapiens
cuauuaaagugccau

SEQ ID NO: 874439 - RNA, 21 nt, Homo sapiens
cuauuaaagugccauuuccug

SEQ ID NO: 874440 - RNA, 15 nt, Homo sapiens
cuauuaaccuagaga

SEQ ID NO: 874441 - RNA, 13 nt, Homo sapiens
cuauuaagggaaa

SEQ ID NO: 874442 - RNA, 19 nt, Homo sapiens
cuauuaccuguuaguauua

SEQ ID NO: 874443 - RNA, 15 nt, Homo sapiens
guuuaugucaucaua

SEQ ID NO: 874444 - RNA, 18 nt, Homo sapiens
guuuauuucaacuauuua

SEQ ID NO: 874445 - RNA, 21 nt, Homo sapiens
guuuauuuuuuuaaaacacaa

SEQ ID NO: 874446 - RNA, 21 nt, Homo sapiens
guuucacaacaggcauuccag

SEQ ID NO: 874447 - RNA, 17 nt, Homo sapiens
guuucacacuagucaca

SEQ ID NO: 874448 - RNA, 18 nt, Homo sapiens
guuucacacuagucacau

SEQ ID NO: 874449 - RNA, 18 nt, Homo sapiens
guuucacagccuauaacc

SEQ ID NO: 874450 - RNA, 18 nt, Homo sapiens
guuucacuaugauuuucu

SEQ ID NO: 874451 - RNA, 20 nt, Homo sapiens
guuucauauccagcugagug

SEQ ID NO: 874452 - RNA, 19 nt, Homo sapiens
guuuccaucagguuccauc

SEQ ID NO: 874453 - RNA, 16 nt, Homo sapiens
guuuccucauuccuga

SEQ ID NO: 874454 - RNA, 16 nt, Homo sapiens
guuuccugaguaccag

SEQ ID NO: 874455 - RNA, 16 nt, Homo sapiens
guuucuaacucagggg

SEQ ID NO: 874456 - RNA, 22 nt, Homo sapiens
guuucugaaccauuacuguaau

SEQ ID NO: 874457 - RNA, 12 nt, Homo sapiens
guuucugagaaa

SEQ ID NO: 874458 - RNA, 21 nt, Homo sapiens
guuucuggggacaccagccau

SEQ ID NO: 874459 - RNA, 15 nt, Homo sapiens
guuucuuucuguuau

SEQ ID NO: 874460 - RNA, 20 nt, Homo sapiens
guuugaauggagauucugau

SEQ ID NO: 874461 - RNA, 22 nt, Homo sapiens
guuugagaauaugaucauguaa

SEQ ID NO: 874462 - RNA, 19 nt, Homo sapiens
guuugagcgcagaguaaaa

SEQ ID NO: 874463 - RNA, 13 nt, Homo sapiens
guuugaguucaaa

SEQ ID NO: 874464 - RNA, 18 nt, Homo sapiens
guuugaucacacagccac

SEQ ID NO: 874465 - RNA, 20 nt, Homo sapiens
guuugaucacacagccacuu

SEQ ID NO: 874466 - RNA, 12 nt, Homo sapiens
guuugcacuuug

SEQ ID NO: 874467 - RNA, 21 nt, Homo sapiens
guuugcuauugacaagucauu

SEQ ID NO: 874468 - RNA, 13 nt, Homo sapiens
guuuggggagaaa

SEQ ID NO: 874469 - RNA, 15 nt, Homo sapiens
guuuggucacugcua

SEQ ID NO: 874470 - RNA, 16 nt, Homo sapiens
guuugucagacuuuaa

SEQ ID NO: 874471 - RNA, 21 nt, Homo sapiens
guuugucaggauggaauccua

SEQ ID NO: 874472 - RNA, 14 nt, Homo sapiens
guuugugaaacaaa

SEQ ID NO: 874473 - RNA, 15 nt, Homo sapiens
guuuguuuacuuuau

SEQ ID NO: 874474 - RNA, 12 nt, Homo sapiens
guuuuaagacug

SEQ ID NO: 874475 - RNA, 15 nt, Homo sapiens
guuuuaaucuucuca

SEQ ID NO: 874476 - RNA, 18 nt, Homo sapiens
guuuuaauuuuugugauu

SEQ ID NO: 874477 - RNA, 17 nt, Homo sapiens
guuuucagauuccacac

SEQ ID NO: 874478 - RNA, 17 nt, Homo sapiens
guuuucauccuggccuc

SEQ ID NO: 874479 - RNA, 21 nt, Homo sapiens
guuuucccugaccucccucua

SEQ ID NO: 874480 - RNA, 17 nt, Homo sapiens
guuuuccuaaaugcagu

SEQ ID NO: 874481 - RNA, 19 nt, Homo sapiens
guuuuccuaaaugcaguga

SEQ ID NO: 874482 - RNA, 16 nt, Homo sapiens
guuuucuaacuguaaa

SEQ ID NO: 874483 - RNA, 13 nt, Homo sapiens
guuuugccuuaaa

SEQ ID NO: 874484 - RNA, 19 nt, Homo sapiens
guuuuguggaggagcucag

SEQ ID NO: 874485 - RNA, 15 nt, Homo sapiens
guuuuuaagcuguuu

SEQ ID NO: 874486 - RNA, 11 nt, Homo sapiens
guuuuuacuaa

SEQ ID NO: 874487 - RNA, 20 nt, Homo sapiens
guuuuuagauuaaacaaaca

SEQ ID NO: 874488 - RNA, 17 nt, Homo sapiens
guuuuuguuuuuuucca

SEQ ID NO: 874489 - RNA, 19 nt, Homo sapiens
guuuuuuacuuccacagaa

SEQ ID NO: 874490 - RNA, 20 nt, Homo sapiens
guuuuuucaucauaacauaa

SEQ ID NO: 874491 - RNA, 18 nt, Homo sapiens
guuuuuuuacaacauuca

SEQ ID NO: 874492 - RNA, 20 nt, Homo sapiens
uaaaaacaccaaaaagggau

SEQ ID NO: 874493 - RNA, 20 nt, Homo sapiens
uaaaaacaugagaaauguga

SEQ ID NO: 874494 - RNA, 23 nt, Homo sapiens
uaaaaacaugagaaaugugaacu

SEQ ID NO: 874495 - RNA, 21 nt, Homo sapiens
uaaaaaccaaauaagcaucug

SEQ ID NO: 874496 - RNA, 17 nt, Homo sapiens
uaaaaacugagugacuc

SEQ ID NO: 874497 - RNA, 13 nt, Homo sapiens
uaaaaacuuguac

SEQ ID NO: 874498 - RNA, 13 nt, Homo sapiens
uaaaaagaggcau

SEQ ID NO: 874499 - RNA, 14 nt, Homo sapiens
uaaaaaguggcuaa

SEQ ID NO: 874500 - RNA, 13 nt, Homo sapiens
uaaaaaguucaua

SEQ ID NO: 874501 - RNA, 15 nt, Homo sapiens
uaaaaauaagcuuua

SEQ ID NO: 874502 - RNA, 17 nt, Homo sapiens
uaaaaauauaagaacuu

SEQ ID NO: 874503 - RNA, 22 nt, Homo sapiens
uaaaaauauauauagugcuaua

SEQ ID NO: 874504 - RNA, 15 nt, Homo sapiens
uaaaaaugaaagcca

SEQ ID NO: 874505 - RNA, 18 nt, Homo sapiens
uaaaaauggccauuugcu

SEQ ID NO: 874506 - RNA, 19 nt, Homo sapiens
uaaaaauggccauuugcuu

SEQ ID NO: 874507 - RNA, 20 nt, Homo sapiens
uaaaaauuccaaauggacua

SEQ ID NO: 874508 - RNA, 17 nt, Homo sapiens
uaaaaauugacuucuug

SEQ ID NO: 874509 - RNA, 15 nt, Homo sapiens
uaaaaauugugauca

SEQ ID NO: 874510 - RNA, 23 nt, Homo sapiens
uaaaaauugugaucagaccauaa

SEQ ID NO: 874511 - RNA, 20 nt, Homo sapiens
uaaaacaacacucacauuua

SEQ ID NO: 874512 - RNA, 12 nt, Homo sapiens
uaaaacauuccu

SEQ ID NO: 874513 - RNA, 18 nt, Homo sapiens
uaaaacauuccugugaaa

SEQ ID NO: 874514 - RNA, 13 nt, Homo sapiens
uaaaaccagagca

SEQ ID NO: 874515 - RNA, 22 nt, Homo sapiens
uaaaaccaucaaaaauauucca

SEQ ID NO: 874516 - RNA, 15 nt, Homo sapiens
uaaaacccagcaugu

SEQ ID NO: 874517 - RNA, 15 nt, Homo sapiens
uaaaaccccaucucu

SEQ ID NO: 874518 - RNA, 18 nt, Homo sapiens
uaaaaccugucaaugaua

SEQ ID NO: 874519 - RNA, 17 nt, Homo sapiens
uaaaaccugugugccau

SEQ ID NO: 874520 - RNA, 16 nt, Homo sapiens
uaaaacuuaugcuagu

SEQ ID NO: 874521 - RNA, 16 nt, Homo sapiens
uaaaagaaaucuucau

SEQ ID NO: 874522 - RNA, 21 nt, Homo sapiens
uaaaagaauaaaauugcacuu

SEQ ID NO: 874523 - RNA, 15 nt, Homo sapiens
uaaaagccacauaga

SEQ ID NO: 874524 - RNA, 14 nt, Homo sapiens
uaaaagguauugag

SEQ ID NO: 874525 - RNA, 16 nt, Homo sapiens
uaaaagugacucucag

SEQ ID NO: 874526 - RNA, 23 nt, Homo sapiens
uaaaaguuuaggguuuucucuug

SEQ ID NO: 874527 - RNA, 17 nt, Homo sapiens
uaaaauaaaaguuuaca

SEQ ID NO: 874528 - RNA, 24 nt, Homo sapiens
uaaaauaacuuauaucaucagcau

SEQ ID NO: 874529 - RNA, 23 nt, Homo sapiens
uaaaauaauuuuaaaaguuggga

SEQ ID NO: 874530 - RNA, 13 nt, Homo sapiens
uaaaauacaaaca

SEQ ID NO: 874531 - RNA, 22 nt, Homo sapiens
uaaaauagauccuaggugcugg

SEQ ID NO: 874532 - RNA, 18 nt, Homo sapiens
uaaaauagccacuuaccu

SEQ ID NO: 874533 - RNA, 13 nt, Homo sapiens
uaaaaucugugaa

SEQ ID NO: 874534 - RNA, 19 nt, Homo sapiens
uaaaaucuuggcacagaaa

SEQ ID NO: 874535 - RNA, 21 nt, Homo sapiens
uaaaaugauuguaguaaucug

SEQ ID NO: 874536 - RNA, 17 nt, Homo sapiens
uaaaauuaaaugcaugu

SEQ ID NO: 874537 - RNA, 22 nt, Homo sapiens
uaaaauuaaaugcauguccuca

SEQ ID NO: 874538 - RNA, 14 nt, Homo sapiens
uaaaauugcacuuu

SEQ ID NO: 874539 - RNA, 15 nt, Homo sapiens
uaaaauugcacuuuu

SEQ ID NO: 874540 - RNA, 22 nt, Homo sapiens
uaaaauuuaaccuacuagacaa

SEQ ID NO: 874541 - RNA, 13 nt, Homo sapiens
uaaaauuucaaca

SEQ ID NO: 874542 - RNA, 14 nt, Homo sapiens
uaaacaaacaaaca

SEQ ID NO: 874543 - RNA, 17 nt, Homo sapiens
uaaacaaauaacaaugu

SEQ ID NO: 874544 - RNA, 14 nt, Homo sapiens
uaaacaaauguaug

SEQ ID NO: 874545 - RNA, 16 nt, Homo sapiens
uaaacaauguauuugu

SEQ ID NO: 874546 - RNA, 11 nt, Homo sapiens
uaaacagugcc

SEQ ID NO: 874547 - RNA, 14 nt, Homo sapiens
uaaacauccuucaa

SEQ ID NO: 874548 - RNA, 20 nt, Homo sapiens
uaaacaugagcgcugaugau

SEQ ID NO: 874549 - RNA, 22 nt, Homo sapiens
uaaaccaaaggacauuaugugu

SEQ ID NO: 874550 - RNA, 14 nt, Homo sapiens
uaaacccuuaccaa

SEQ ID NO: 874551 - RNA, 14 nt, Homo sapiens
uaaacuagaucucc

SEQ ID NO: 874552 - RNA, 18 nt, Homo sapiens
uaaacugaaaaaugucag

SEQ ID NO: 874553 - RNA, 18 nt, Homo sapiens
uaaacuugacccaggugg

SEQ ID NO: 874554 - RNA, 15 nt, Homo sapiens
uaaacuuguguauga

SEQ ID NO: 874555 - RNA, 17 nt, Homo sapiens
uaaacuuucucugcaaa

SEQ ID NO: 874556 - RNA, 17 nt, Homo sapiens
uaaagaauaaaugaauc

SEQ ID NO: 874557 - RNA, 18 nt, Homo sapiens
uaaagaauaaaugaaucu

SEQ ID NO: 874558 - RNA, 18 nt, Homo sapiens
cuauuaguuuucuuugua

SEQ ID NO: 874559 - RNA, 15 nt, Homo sapiens
cuauuauaaaaccau

SEQ ID NO: 874560 - RNA, 16 nt, Homo sapiens
cuauuauuaacacuga

SEQ ID NO: 874561 - RNA, 17 nt, Homo sapiens
cuauuauuuucuuuaaa

SEQ ID NO: 874562 - RNA, 17 nt, Homo sapiens
cuauucaaacagucuca

SEQ ID NO: 874563 - RNA, 14 nt, Homo sapiens
cuauucagaauuga

SEQ ID NO: 874564 - RNA, 14 nt, Homo sapiens
cuauuccaaagugc

SEQ ID NO: 874565 - RNA, 13 nt, Homo sapiens
cuauucuauugca

SEQ ID NO: 874566 - RNA, 14 nt, Homo sapiens
cuauucucuccuca

SEQ ID NO: 874567 - RNA, 22 nt, Homo sapiens
cuauucucuccucagacugcuc

SEQ ID NO: 874568 - RNA, 13 nt, Homo sapiens
cuauugaauugga

SEQ ID NO: 874569 - RNA, 19 nt, Homo sapiens
cuauugcauguaaaaugca

SEQ ID NO: 874570 - RNA, 23 nt, Homo sapiens
cuauuuauuauaaauuaugagau

SEQ ID NO: 874571 - RNA, 16 nt, Homo sapiens
cuauuuccuuuccagu

SEQ ID NO: 874572 - RNA, 13 nt, Homo sapiens
cuauuugaagugu

SEQ ID NO: 874573 - RNA, 19 nt, Homo sapiens
cuauuugcacuguagccuc

SEQ ID NO: 874574 - RNA, 21 nt, Homo sapiens
cuauuuggggcuugcaugcca

SEQ ID NO: 874575 - RNA, 17 nt, Homo sapiens
cuauuuguuuacaugca

SEQ ID NO: 874576 - RNA, 15 nt, Homo sapiens
cuauuuuaaaaccau

SEQ ID NO: 874577 - RNA, 18 nt, Homo sapiens
cucaaaaaggugugucaa

SEQ ID NO: 874578 - RNA, 13 nt, Homo sapiens
cucaaaacuuaac

SEQ ID NO: 874579 - RNA, 21 nt, Homo sapiens
cucaaaagaaaaaaaaaagca

SEQ ID NO: 874580 - RNA, 21 nt, Homo sapiens
cucaaacccuguggggccuga

SEQ ID NO: 874581 - RNA, 20 nt, Homo sapiens
cucaaauccuugagcacuca

SEQ ID NO: 874582 - RNA, 23 nt, Homo sapiens
cucaaaucuauucagacaagcaa

SEQ ID NO: 874583 - RNA, 18 nt, Homo sapiens
cucaaaugacccaaagac

SEQ ID NO: 874584 - RNA, 20 nt, Homo sapiens
cucaaaugacccaaagacca

SEQ ID NO: 874585 - RNA, 22 nt, Homo sapiens
cucaaaugacccaaagaccaau

SEQ ID NO: 874586 - RNA, 17 nt, Homo sapiens
cucaaaugcugggggua

SEQ ID NO: 874587 - RNA, 19 nt, Homo sapiens
cucaacgagagcacuugaa

SEQ ID NO: 874588 - RNA, 19 nt, Homo sapiens
cucaagaaauugccuccuu

SEQ ID NO: 874589 - RNA, 13 nt, Homo sapiens
cucaagacugaaa

SEQ ID NO: 874590 - RNA, 15 nt, Homo sapiens
cucaauauuccugaa

SEQ ID NO: 874591 - RNA, 12 nt, Homo sapiens
cucaaugcauga

SEQ ID NO: 874592 - RNA, 23 nt, Homo sapiens
cucaaugcauuuucaagauacau

SEQ ID NO: 874593 - RNA, 18 nt, Homo sapiens
cucacaaaccaugcaaau

SEQ ID NO: 874594 - RNA, 19 nt, Homo sapiens
cucacaagaagaccagacu

SEQ ID NO: 874595 - RNA, 21 nt, Homo sapiens
cucacaagaagaccagacugu

SEQ ID NO: 874596 - RNA, 13 nt, Homo sapiens
cucacaagcacuu

SEQ ID NO: 874597 - RNA, 16 nt, Homo sapiens
cucacagaacuaugua

SEQ ID NO: 874598 - RNA, 22 nt, Homo sapiens
cucacaggagcagacagagaaa

SEQ ID NO: 874599 - RNA, 15 nt, Homo sapiens
cucacauaucuguca

SEQ ID NO: 874600 - RNA, 19 nt, Homo sapiens
cucacauuuauucugcuca

SEQ ID NO: 874601 - RNA, 20 nt, Homo sapiens
cucaccgggcuacuaccugg

SEQ ID NO: 874602 - RNA, 20 nt, Homo sapiens
cucaccuugugcuggggaca

SEQ ID NO: 874603 - RNA, 18 nt, Homo sapiens
cucacgccuaugauccca

SEQ ID NO: 874604 - RNA, 11 nt, Homo sapiens
cucacuauguu

SEQ ID NO: 874605 - RNA, 23 nt, Homo sapiens
cucacuauucaaguauuaggggu

SEQ ID NO: 874606 - RNA, 21 nt, Homo sapiens
cucacucuuaugaaaugggcu

SEQ ID NO: 874607 - RNA, 18 nt, Homo sapiens
cucacuggggucugugug

SEQ ID NO: 874608 - RNA, 20 nt, Homo sapiens
cucacuugaaugugucacua

SEQ ID NO: 874609 - RNA, 12 nt, Homo sapiens
cucacuuugccc

SEQ ID NO: 874610 - RNA, 16 nt, Homo sapiens
cucagaauccaaagau

SEQ ID NO: 874611 - RNA, 12 nt, Homo sapiens
cucagacuguug

SEQ ID NO: 874612 - RNA, 18 nt, Homo sapiens
cucagaucugaacacagu

SEQ ID NO: 874613 - RNA, 14 nt, Homo sapiens
cucagcauaccugc

SEQ ID NO: 874614 - RNA, 15 nt, Homo sapiens
cucagccgugcacuc

SEQ ID NO: 874615 - RNA, 18 nt, Homo sapiens
cucagccucccaaagugc

SEQ ID NO: 874616 - RNA, 20 nt, Homo sapiens
cucagccucccaaguagcug

SEQ ID NO: 874617 - RNA, 20 nt, Homo sapiens
cucagcugccaagcacucga

SEQ ID NO: 874618 - RNA, 22 nt, Homo sapiens
cucaggacacuaauacaccagg

SEQ ID NO: 874619 - RNA, 14 nt, Homo sapiens
cucaggggccagug

SEQ ID NO: 874620 - RNA, 16 nt, Homo sapiens
cucaggucacuccagu

SEQ ID NO: 874621 - RNA, 21 nt, Homo sapiens
cucagugggacaaaccagagc

SEQ ID NO: 874622 - RNA, 15 nt, Homo sapiens
cucagugucauuuau

SEQ ID NO: 874623 - RNA, 13 nt, Homo sapiens
cucaguuccugcc

SEQ ID NO: 874624 - RNA, 22 nt, Homo sapiens
cucaguuuccucaccagaaaaa

SEQ ID NO: 874625 - RNA, 22 nt, Homo sapiens
cucaucaacaaagaaauauuau

SEQ ID NO: 874626 - RNA, 14 nt, Homo sapiens
cucaucacccaguc

SEQ ID NO: 874627 - RNA, 19 nt, Homo sapiens
cucaucacccaguccuggc

SEQ ID NO: 874628 - RNA, 13 nt, Homo sapiens
cucaucagccuuc

SEQ ID NO: 874629 - RNA, 22 nt, Homo sapiens
cucaucaguguccucuugcuca

SEQ ID NO: 874630 - RNA, 13 nt, Homo sapiens
cucauccuccuuc

SEQ ID NO: 874631 - RNA, 15 nt, Homo sapiens
cucaucuacaagcau

SEQ ID NO: 874632 - RNA, 19 nt, Homo sapiens
cucaucuguuauccugcua

SEQ ID NO: 874633 - RNA, 14 nt, Homo sapiens
cucaugaaccucaa

SEQ ID NO: 874634 - RNA, 11 nt, Homo sapiens
cucaugccacu

SEQ ID NO: 874635 - RNA, 17 nt, Homo sapiens
cucaugcugagcgcugu

SEQ ID NO: 874636 - RNA, 12 nt, Homo sapiens
cucaugugaucc

SEQ ID NO: 874637 - RNA, 16 nt, Homo sapiens
cucauuccaccuuccc

SEQ ID NO: 874638 - RNA, 18 nt, Homo sapiens
cucauuccuguagucaaa

SEQ ID NO: 874639 - RNA, 13 nt, Homo sapiens
cucauuguagaaa

SEQ ID NO: 874640 - RNA, 22 nt, Homo sapiens
cucauuguagaaaagcuauaaa

SEQ ID NO: 874641 - RNA, 19 nt, Homo sapiens
cucauuuaauccucccuuc

SEQ ID NO: 874642 - RNA, 15 nt, Homo sapiens
cucauuucaucucau

SEQ ID NO: 874643 - RNA, 17 nt, Homo sapiens
cucauuuuuguuuucau

SEQ ID NO: 874644 - RNA, 23 nt, Homo sapiens
cucauuuuuguuuucauuaucuc

SEQ ID NO: 874645 - RNA, 14 nt, Homo sapiens
cuccaaacauuacu

SEQ ID NO: 874646 - RNA, 22 nt, Homo sapiens
cuccaaagaaauguaagggaaa

SEQ ID NO: 874647 - RNA, 20 nt, Homo sapiens
cuccaaaugagacacauuaa

SEQ ID NO: 874648 - RNA, 19 nt, Homo sapiens
cuccaagccauucacuucc

SEQ ID NO: 874649 - RNA, 14 nt, Homo sapiens
cuccaauuccacag

SEQ ID NO: 874650 - RNA, 18 nt, Homo sapiens
cuccacaguuuugccuua

SEQ ID NO: 874651 - RNA, 12 nt, Homo sapiens
cuccacauccac

SEQ ID NO: 874652 - RNA, 22 nt, Homo sapiens
cuccacauccaccccacuggau

SEQ ID NO: 874653 - RNA, 14 nt, Homo sapiens
cuccaccucuucac

SEQ ID NO: 874654 - RNA, 19 nt, Homo sapiens
cuccacgguagcacuugac

SEQ ID NO: 874655 - RNA, 14 nt, Homo sapiens
cuccacucacucca

SEQ ID NO: 874656 - RNA, 16 nt, Homo sapiens
cuccacuccaccucca

SEQ ID NO: 874657 - RNA, 13 nt, Homo sapiens
cuccacugucaca

SEQ ID NO: 874658 - RNA, 13 nt, Homo sapiens
cuccacugucacc

SEQ ID NO: 874659 - RNA, 18 nt, Homo sapiens
cuccagaauccacaaagc

SEQ ID NO: 874660 - RNA, 13 nt, Homo sapiens
cuccagaggccaa

SEQ ID NO: 874661 - RNA, 16 nt, Homo sapiens
cuccagccagcaauga

SEQ ID NO: 874662 - RNA, 21 nt, Homo sapiens
cuccagccugacuuggggaga

SEQ ID NO: 874663 - RNA, 16 nt, Homo sapiens
cuccagcucaccagcc

SEQ ID NO: 874664 - RNA, 19 nt, Homo sapiens
cuccaggagccuacccccu

SEQ ID NO: 874665 - RNA, 19 nt, Homo sapiens
cuccaggauugaagagcau

SEQ ID NO: 874666 - RNA, 20 nt, Homo sapiens
cuccaguuuccaaguuccug

SEQ ID NO: 874667 - RNA, 21 nt, Homo sapiens
cuccaucauggcagugaugaa

SEQ ID NO: 874668 - RNA, 18 nt, Homo sapiens
cuccaucuuagauagaug

SEQ ID NO: 874669 - RNA, 20 nt, Homo sapiens
cuccauugcuguuguugcag

SEQ ID NO: 874670 - RNA, 19 nt, Homo sapiens
cuccauuucaacuccagaa

SEQ ID NO: 874671 - RNA, 15 nt, Homo sapiens
cucccaaagcucaga

SEQ ID NO: 874672 - RNA, 14 nt, Homo sapiens
cucccaaccucaau

SEQ ID NO: 874673 - RNA, 21 nt, Homo sapiens
uaaagaauaaaugaaucuuac

SEQ ID NO: 874674 - RNA, 22 nt, Homo sapiens
uaaagaauaaaugaaucuuacu

SEQ ID NO: 874675 - RNA, 23 nt, Homo sapiens
uaaagaaugcuggguguugcauu

SEQ ID NO: 874676 - RNA, 14 nt, Homo sapiens
uaaagacagcugac

SEQ ID NO: 874677 - RNA, 21 nt, Homo sapiens
uaaagacagggaagagcagaa

SEQ ID NO: 874678 - RNA, 15 nt, Homo sapiens
uaaagagaacucugg

SEQ ID NO: 874679 - RNA, 16 nt, Homo sapiens
uaaagaguauuuacaa

SEQ ID NO: 874680 - RNA, 18 nt, Homo sapiens
uaaagaugaucuacucag

SEQ ID NO: 874681 - RNA, 24 nt, Homo sapiens
uaaagcaguagacaauccccacau

SEQ ID NO: 874682 - RNA, 14 nt, Homo sapiens
uaaagcauugcaac

SEQ ID NO: 874683 - RNA, 21 nt, Homo sapiens
uaaagccaacacccugucuaa

SEQ ID NO: 874684 - RNA, 15 nt, Homo sapiens
uaaagcuacaacaaa

SEQ ID NO: 874685 - RNA, 17 nt, Homo sapiens
uaaagcuacaaucuguu

SEQ ID NO: 874686 - RNA, 16 nt, Homo sapiens
uaaaggcccacuggca

SEQ ID NO: 874687 - RNA, 17 nt, Homo sapiens
uaaagguagagaugugu

SEQ ID NO: 874688 - RNA, 17 nt, Homo sapiens
uaaaggugcugcacugg

SEQ ID NO: 874689 - RNA, 15 nt, Homo sapiens
uaaaguacauaacaa

SEQ ID NO: 874690 - RNA, 20 nt, Homo sapiens
uaaaguauguuauugcauaa

SEQ ID NO: 874691 - RNA, 21 nt, Homo sapiens
uaaaguauuauuuauuugaau

SEQ ID NO: 874692 - RNA, 20 nt, Homo sapiens
uaaagugaauaaccacuuaa

SEQ ID NO: 874693 - RNA, 21 nt, Homo sapiens
uaaauaaauguaucuuauuca

SEQ ID NO: 874694 - RNA, 15 nt, Homo sapiens
uaaauacuguacaua

SEQ ID NO: 874695 - RNA, 15 nt, Homo sapiens
uaaauagcauucucu

SEQ ID NO: 874696 - RNA, 22 nt, Homo sapiens
uaaauaguuuuaaauaugaaca

SEQ ID NO: 874697 - RNA, 17 nt, Homo sapiens
uaaauaugauuacuuua

SEQ ID NO: 874698 - RNA, 21 nt, Homo sapiens
uaaauaugccuaaaauacuua

SEQ ID NO: 874699 - RNA, 22 nt, Homo sapiens
uaaauauuaaccugaauuauuc

SEQ ID NO: 874700 - RNA, 23 nt, Homo sapiens
uaaauauucccugacgacacuga

SEQ ID NO: 874701 - RNA, 21 nt, Homo sapiens
uaaaucacggauggcagauug

SEQ ID NO: 874702 - RNA, 13 nt, Homo sapiens
uaaauccuuccau

SEQ ID NO: 874703 - RNA, 13 nt, Homo sapiens
uaaaucuaucuau

SEQ ID NO: 874704 - RNA, 14 nt, Homo sapiens
uaaaucugagaucu

SEQ ID NO: 874705 - RNA, 20 nt, Homo sapiens
uaaaucugagccuaaaucua

SEQ ID NO: 874706 - RNA, 16 nt, Homo sapiens
uaaaugaagugcaaau

SEQ ID NO: 874707 - RNA, 17 nt, Homo sapiens
uaaaugaaucuuacucc

SEQ ID NO: 874708 - RNA, 18 nt, Homo sapiens
uaaaugaaucuuacuccu

SEQ ID NO: 874709 - RNA, 18 nt, Homo sapiens
uaaaugcaaacacugugu

SEQ ID NO: 874710 - RNA, 16 nt, Homo sapiens
uaaaugcaauauguau

SEQ ID NO: 874711 - RNA, 15 nt, Homo sapiens
uaaaugcauguccuc

SEQ ID NO: 874712 - RNA, 12 nt, Homo sapiens
uaaaugcauuag

SEQ ID NO: 874713 - RNA, 17 nt, Homo sapiens
uaaaugccaacugguca

SEQ ID NO: 874714 - RNA, 13 nt, Homo sapiens
uaaaugccuaaua

SEQ ID NO: 874715 - RNA, 20 nt, Homo sapiens
uaaauggacaaaugcuuaug

SEQ ID NO: 874716 - RNA, 16 nt, Homo sapiens
uaaauggugggaaccc

SEQ ID NO: 874717 - RNA, 16 nt, Homo sapiens
uaaauguauaggcaga

SEQ ID NO: 874718 - RNA, 13 nt, Homo sapiens
uaaauguauauac

SEQ ID NO: 874719 - RNA, 19 nt, Homo sapiens
uaaauguauaugucauuua

SEQ ID NO: 874720 - RNA, 14 nt, Homo sapiens
uaaauguaucuuau

SEQ ID NO: 874721 - RNA, 15 nt, Homo sapiens
uaaaugucaguuaca

SEQ ID NO: 874722 - RNA, 18 nt, Homo sapiens
uaaaugucuuaaucauga

SEQ ID NO: 874723 - RNA, 11 nt, Homo sapiens
uaaaugugauu

SEQ ID NO: 874724 - RNA, 19 nt, Homo sapiens
uaaaugugauuuacgcuca

SEQ ID NO: 874725 - RNA, 17 nt, Homo sapiens
uaaauguguggugcuaa

SEQ ID NO: 874726 - RNA, 22 nt, Homo sapiens
uaaauuauuuauuuauggagga

SEQ ID NO: 874727 - RNA, 19 nt, Homo sapiens
uaaauugcuccuugacauu

SEQ ID NO: 874728 - RNA, 19 nt, Homo sapiens
uaaauugcuuauucuaggu

SEQ ID NO: 874729 - RNA, 16 nt, Homo sapiens
uaaauuuaucaucucg

SEQ ID NO: 874730 - RNA, 17 nt, Homo sapiens
uaaauuuguguucucaa

SEQ ID NO: 874731 - RNA, 17 nt, Homo sapiens
uaacaaagaacaagcau

SEQ ID NO: 874732 - RNA, 16 nt, Homo sapiens
uaacaacaaugguuua

SEQ ID NO: 874733 - RNA, 14 nt, Homo sapiens
uaacaagccagauu

SEQ ID NO: 874734 - RNA, 21 nt, Homo sapiens
uaacaaggugucuuuuccacu

SEQ ID NO: 874735 - RNA, 22 nt, Homo sapiens
uaacacgaauccugacaccacc

SEQ ID NO: 874736 - RNA, 16 nt, Homo sapiens
uaacagacuuguuuaa

SEQ ID NO: 874737 - RNA, 20 nt, Homo sapiens
uaacagggagacugcaucuc

SEQ ID NO: 874738 - RNA, 21 nt, Homo sapiens
uaacagggagacugcaucuca

SEQ ID NO: 874739 - RNA, 20 nt, Homo sapiens
uaacauaaaauaaucgucuc

SEQ ID NO: 874740 - RNA, 23 nt, Homo sapiens
uaacauaaauuuaucaucucgac

SEQ ID NO: 874741 - RNA, 20 nt, Homo sapiens
uaacauagauuuauguaaug

SEQ ID NO: 874742 - RNA, 22 nt, Homo sapiens
uaacaugaaaaacacggcagcu

SEQ ID NO: 874743 - RNA, 14 nt, Homo sapiens
uaacauugauuuau

SEQ ID NO: 874744 - RNA, 19 nt, Homo sapiens
uaaccagacacauacucau

SEQ ID NO: 874745 - RNA, 17 nt, Homo sapiens
uaaccauuacauguuua

SEQ ID NO: 874746 - RNA, 18 nt, Homo sapiens
uaaccccaggcaucccau

SEQ ID NO: 874747 - RNA, 20 nt, Homo sapiens
uaacccgcucaucacuggau

SEQ ID NO: 874748 - RNA, 13 nt, Homo sapiens
uaacccucucuuc

SEQ ID NO: 874749 - RNA, 14 nt, Homo sapiens
uaaccucaguguca

SEQ ID NO: 874750 - RNA, 12 nt, Homo sapiens
uaaccugaauua

SEQ ID NO: 874751 - RNA, 17 nt, Homo sapiens
uaaccugaauuauucca

SEQ ID NO: 874752 - RNA, 19 nt, Homo sapiens
uaaccugcccacccacucc

SEQ ID NO: 874753 - RNA, 12 nt, Homo sapiens
uaacuaaauaac

SEQ ID NO: 874754 - RNA, 19 nt, Homo sapiens
uaacuagaaaucugccaau

SEQ ID NO: 874755 - RNA, 13 nt, Homo sapiens
uaacuaucaauau

SEQ ID NO: 874756 - RNA, 21 nt, Homo sapiens
uaacucaggggugauucugaa

SEQ ID NO: 874757 - RNA, 21 nt, Homo sapiens
uaacugaaggagaaggugccc

SEQ ID NO: 874758 - RNA, 22 nt, Homo sapiens
uaacugcacacaugguuuccaa

SEQ ID NO: 874759 - RNA, 22 nt, Homo sapiens
uaacuggguaaugaaacaaaga

SEQ ID NO: 874760 - RNA, 21 nt, Homo sapiens
uaacuguggcuaauucacaua

SEQ ID NO: 874761 - RNA, 21 nt, Homo sapiens
uaacuuaaauuuuaagcuuga

SEQ ID NO: 874762 - RNA, 13 nt, Homo sapiens
uaacuuagaagga

SEQ ID NO: 874763 - RNA, 19 nt, Homo sapiens
uaacuucucugagucugaa

SEQ ID NO: 874764 - RNA, 21 nt, Homo sapiens
uaacuuggagagggacgaaga

SEQ ID NO: 874765 - RNA, 16 nt, Homo sapiens
uaagaaaauacauaag

SEQ ID NO: 874766 - RNA, 23 nt, Homo sapiens
uaagaacuugauauauuucauuc

SEQ ID NO: 874767 - RNA, 15 nt, Homo sapiens
uaagaagacaugaca

SEQ ID NO: 874768 - RNA, 13 nt, Homo sapiens
uaagaagcauuuu

SEQ ID NO: 874769 - RNA, 12 nt, Homo sapiens
uaagaagcucug

SEQ ID NO: 874770 - RNA, 15 nt, Homo sapiens
uaagaagcucuggcc

SEQ ID NO: 874771 - RNA, 23 nt, Homo sapiens
uaagaaggaguucugacauucau

SEQ ID NO: 874772 - RNA, 14 nt, Homo sapiens
uaagaaugcugguu

SEQ ID NO: 874773 - RNA, 23 nt, Homo sapiens
uaagaauggagcaguacauggga

SEQ ID NO: 874774 - RNA, 15 nt, Homo sapiens
uaagaccccaucucu

SEQ ID NO: 874775 - RNA, 16 nt, Homo sapiens
uaagacgaaugauuua

SEQ ID NO: 874776 - RNA, 14 nt, Homo sapiens
uaagacuacuauac

SEQ ID NO: 874777 - RNA, 17 nt, Homo sapiens
uaagagaagaugugauu

SEQ ID NO: 874778 - RNA, 16 nt, Homo sapiens
uaagagauacauuccc

SEQ ID NO: 874779 - RNA, 14 nt, Homo sapiens
uaagaggcuauuua

SEQ ID NO: 874780 - RNA, 19 nt, Homo sapiens
uaagauaaauagaguucca

SEQ ID NO: 874781 - RNA, 15 nt, Homo sapiens
uaagauuguaauuca

SEQ ID NO: 874782 - RNA, 18 nt, Homo sapiens
uaagauuuccaagugcca

SEQ ID NO: 874783 - RNA, 14 nt, Homo sapiens
uaagcaaaaccacu

SEQ ID NO: 874784 - RNA, 17 nt, Homo sapiens
uaagcaacuugcuucua

SEQ ID NO: 874785 - RNA, 15 nt, Homo sapiens
uaagcagaagcacau

SEQ ID NO: 874786 - RNA, 23 nt, Homo sapiens
uaagcccagcucugcuuuuucca

SEQ ID NO: 874787 - RNA, 19 nt, Homo sapiens
uaagcccccuacugagaaa

SEQ ID NO: 874788 - RNA, 15 nt, Homo sapiens
cucccaaggcucuga

SEQ ID NO: 874789 - RNA, 20 nt, Homo sapiens
cucccaaggugcuaggauua

SEQ ID NO: 874790 - RNA, 22 nt, Homo sapiens
cucccacauugucaccauuuca

SEQ ID NO: 874791 - RNA, 22 nt, Homo sapiens
cucccaccccggccuccacucc

SEQ ID NO: 874792 - RNA, 14 nt, Homo sapiens
cucccacuauggug

SEQ ID NO: 874793 - RNA, 17 nt, Homo sapiens
cucccagguggauuuug

SEQ ID NO: 874794 - RNA, 19 nt, Homo sapiens
cucccauagcgcuggcuca

SEQ ID NO: 874795 - RNA, 23 nt, Homo sapiens
cucccauagcgcuggcucaggaa

SEQ ID NO: 874796 - RNA, 21 nt, Homo sapiens
cuccccacaccucccuacucc

SEQ ID NO: 874797 - RNA, 14 nt, Homo sapiens
cucccccaccuuca

SEQ ID NO: 874798 - RNA, 23 nt, Homo sapiens
cuccccgggggcagacaccugug

SEQ ID NO: 874799 - RNA, 12 nt, Homo sapiens
cuccccuaucca

SEQ ID NO: 874800 - RNA, 18 nt, Homo sapiens
cuccccuuguacucuugc

SEQ ID NO: 874801 - RNA, 19 nt, Homo sapiens
cucccgggggcacugccug

SEQ ID NO: 874802 - RNA, 22 nt, Homo sapiens
cucccuaaaauaaaaaccagaa

SEQ ID NO: 874803 - RNA, 20 nt, Homo sapiens
cucccuaaggaaucugaaag

SEQ ID NO: 874804 - RNA, 16 nt, Homo sapiens
cucccuaggagaccaa

SEQ ID NO: 874805 - RNA, 22 nt, Homo sapiens
cucccuauuaaccuagagauug

SEQ ID NO: 874806 - RNA, 15 nt, Homo sapiens
cucccucauuccacc

SEQ ID NO: 874807 - RNA, 16 nt, Homo sapiens
cucccuggaucagaac

SEQ ID NO: 874808 - RNA, 15 nt, Homo sapiens
cucccuuccucccua

SEQ ID NO: 874809 - RNA, 20 nt, Homo sapiens
cucccuugcucagugccucc

SEQ ID NO: 874810 - RNA, 20 nt, Homo sapiens
cuccgaauaaacgugcuccc

SEQ ID NO: 874811 - RNA, 19 nt, Homo sapiens
cuccgcuuucuacccagcg

SEQ ID NO: 874812 - RNA, 14 nt, Homo sapiens
cuccgucaccucag

SEQ ID NO: 874813 - RNA, 14 nt, Homo sapiens
cuccuaaauuucca

SEQ ID NO: 874814 - RNA, 13 nt, Homo sapiens
cuccucagacugc

SEQ ID NO: 874815 - RNA, 17 nt, Homo sapiens
cuccucccaacucuagc

SEQ ID NO: 874816 - RNA, 19 nt, Homo sapiens
cuccucccaggaacugggc

SEQ ID NO: 874817 - RNA, 21 nt, Homo sapiens
cuccucccaggaacugggcca

SEQ ID NO: 874818 - RNA, 17 nt, Homo sapiens
cuccugacuccagugag

SEQ ID NO: 874819 - RNA, 23 nt, Homo sapiens
cuccuggaaaggcucagucucag

SEQ ID NO: 874820 - RNA, 14 nt, Homo sapiens
cuccugugugcugg

SEQ ID NO: 874821 - RNA, 12 nt, Homo sapiens
cuccuugcacuu

SEQ ID NO: 874822 - RNA, 14 nt, Homo sapiens
cuccuugguauuuc

SEQ ID NO: 874823 - RNA, 18 nt, Homo sapiens
cuccuuuaccuaccaccu

SEQ ID NO: 874824 - RNA, 14 nt, Homo sapiens
cuccuuugcacuga

SEQ ID NO: 874825 - RNA, 15 nt, Homo sapiens
cuccuuuugaccaaa

SEQ ID NO: 874826 - RNA, 16 nt, Homo sapiens
cuccuuuugaccaaau

SEQ ID NO: 874827 - RNA, 23 nt, Homo sapiens
cuccuuuugcuugaaaccaaaga

SEQ ID NO: 874828 - RNA, 17 nt, Homo sapiens
cucgaagcccuuccagu

SEQ ID NO: 874829 - RNA, 16 nt, Homo sapiens
cucgaccucccaaagu

SEQ ID NO: 874830 - RNA, 21 nt, Homo sapiens
cucgcaguacauguuacuugu

SEQ ID NO: 874831 - RNA, 17 nt, Homo sapiens
cucgccuaggccuguga

SEQ ID NO: 874832 - RNA, 16 nt, Homo sapiens
cucggccuccaagggg

SEQ ID NO: 874833 - RNA, 22 nt, Homo sapiens
cucgguggccaugcuucuugcc

SEQ ID NO: 874834 - RNA, 23 nt, Homo sapiens
cucgguggccaugcuucuugccc

SEQ ID NO: 874835 - RNA, 15 nt, Homo sapiens
cucgugugauuuccu

SEQ ID NO: 874836 - RNA, 19 nt, Homo sapiens
cucuaaaaauaaaaugaug

SEQ ID NO: 874837 - RNA, 22 nt, Homo sapiens
cucuaagccacucuuccaaagg

SEQ ID NO: 874838 - RNA, 22 nt, Homo sapiens
cucuacccuauacaacuggaca

SEQ ID NO: 874839 - RNA, 16 nt, Homo sapiens
cucuaccgggcgaguc

SEQ ID NO: 874840 - RNA, 17 nt, Homo sapiens
cucuacuccuaccucag

SEQ ID NO: 874841 - RNA, 14 nt, Homo sapiens
cucuacugccuugg

SEQ ID NO: 874842 - RNA, 14 nt, Homo sapiens
cucuagauugagag

SEQ ID NO: 874843 - RNA, 14 nt, Homo sapiens
cucuagugcuacug

SEQ ID NO: 874844 - RNA, 21 nt, Homo sapiens
cucuauagacucuaggacaua

SEQ ID NO: 874845 - RNA, 19 nt, Homo sapiens
cucuaugccagcucagucc

SEQ ID NO: 874846 - RNA, 16 nt, Homo sapiens
cucuaugccccaaaua

SEQ ID NO: 874847 - RNA, 14 nt, Homo sapiens
cucuauguaugcau

SEQ ID NO: 874848 - RNA, 14 nt, Homo sapiens
cucuauugcugcuc

SEQ ID NO: 874849 - RNA, 19 nt, Homo sapiens
cucuauugcugcucucuca

SEQ ID NO: 874850 - RNA, 22 nt, Homo sapiens
cucucaggcgcaugugccaguu

SEQ ID NO: 874851 - RNA, 18 nt, Homo sapiens
cucucaguuauucagauu

SEQ ID NO: 874852 - RNA, 22 nt, Homo sapiens
cucuccauaucuccuuccccua

SEQ ID NO: 874853 - RNA, 20 nt, Homo sapiens
cucucccaccccggccucca

SEQ ID NO: 874854 - RNA, 14 nt, Homo sapiens
cucuccuugccugg

SEQ ID NO: 874855 - RNA, 21 nt, Homo sapiens
cucucuaaaucuuccuuguga

SEQ ID NO: 874856 - RNA, 20 nt, Homo sapiens
cucucuacccggcccagaga

SEQ ID NO: 874857 - RNA, 14 nt, Homo sapiens
cucucuccugucca

SEQ ID NO: 874858 - RNA, 21 nt, Homo sapiens
cucucuggcgcaucaccugau

SEQ ID NO: 874859 - RNA, 11 nt, Homo sapiens
cucugaaguca

SEQ ID NO: 874860 - RNA, 23 nt, Homo sapiens
cucugaagucacaucacaggaca

SEQ ID NO: 874861 - RNA, 22 nt, Homo sapiens
cucugagaacagacguuaccaa

SEQ ID NO: 874862 - RNA, 16 nt, Homo sapiens
cucugauaugggacug

SEQ ID NO: 874863 - RNA, 21 nt, Homo sapiens
cucugcaaugggcacugggau

SEQ ID NO: 874864 - RNA, 22 nt, Homo sapiens
cucugcacagggaugaccugga

SEQ ID NO: 874865 - RNA, 18 nt, Homo sapiens
cucugcacaugucuugua

SEQ ID NO: 874866 - RNA, 20 nt, Homo sapiens
cucugcacaugucuuguaca

SEQ ID NO: 874867 - RNA, 16 nt, Homo sapiens
cucugcaucagcacug

SEQ ID NO: 874868 - RNA, 21 nt, Homo sapiens
cucugcauccgacacccaccc

SEQ ID NO: 874869 - RNA, 12 nt, Homo sapiens
cucugcaucuca

SEQ ID NO: 874870 - RNA, 20 nt, Homo sapiens
cucugcauuaucugagguca

SEQ ID NO: 874871 - RNA, 15 nt, Homo sapiens
cucugcauucuagua

SEQ ID NO: 874872 - RNA, 22 nt, Homo sapiens
cucugccugaagucacacagug

SEQ ID NO: 874873 - RNA, 14 nt, Homo sapiens
cucugcugaaggaa

SEQ ID NO: 874874 - RNA, 17 nt, Homo sapiens
cucuggaaaaugugacc

SEQ ID NO: 874875 - RNA, 17 nt, Homo sapiens
cucugucgccaggcuag

SEQ ID NO: 874876 - RNA, 21 nt, Homo sapiens
cucugugaacgauuuagaaag

SEQ ID NO: 874877 - RNA, 12 nt, Homo sapiens
cucugugcuuug

SEQ ID NO: 874878 - RNA, 13 nt, Homo sapiens
cucugugcuuuga

SEQ ID NO: 874879 - RNA, 22 nt, Homo sapiens
cucuguguuucuggggacacca

SEQ ID NO: 874880 - RNA, 14 nt, Homo sapiens
cucuguucauuucc

SEQ ID NO: 874881 - RNA, 16 nt, Homo sapiens
cucuuaguaacauaga

SEQ ID NO: 874882 - RNA, 18 nt, Homo sapiens
cucuuauagaaaguucaa

SEQ ID NO: 874883 - RNA, 15 nt, Homo sapiens
cucuuauuugcucac

SEQ ID NO: 874884 - RNA, 19 nt, Homo sapiens
cucuucagaaaacccuuuu

SEQ ID NO: 874885 - RNA, 22 nt, Homo sapiens
cucuucagaauauggacaaaga

SEQ ID NO: 874886 - RNA, 22 nt, Homo sapiens
cucuucagguucuuagugucac

SEQ ID NO: 874887 - RNA, 19 nt, Homo sapiens
cucuuccagaagaugcccu

SEQ ID NO: 874888 - RNA, 22 nt, Homo sapiens
cucuuccaguuugcuuugcccu

SEQ ID NO: 874889 - RNA, 22 nt, Homo sapiens
cucuuccuacccaaccacucaa

SEQ ID NO: 874890 - RNA, 23 nt, Homo sapiens
cucuucuacguauaaauaugaaa

SEQ ID NO: 874891 - RNA, 17 nt, Homo sapiens
cucuucugggaacuucc

SEQ ID NO: 874892 - RNA, 20 nt, Homo sapiens
cucuucugggaacuuccuca

SEQ ID NO: 874893 - RNA, 17 nt, Homo sapiens
cucuucugucugcagug

SEQ ID NO: 874894 - RNA, 14 nt, Homo sapiens
cucuugcauugcaa

SEQ ID NO: 874895 - RNA, 16 nt, Homo sapiens
cucuugccagcauuuu

SEQ ID NO: 874896 - RNA, 14 nt, Homo sapiens
cucuuggcauuuuc

SEQ ID NO: 874897 - RNA, 16 nt, Homo sapiens
cucuugucucacaugc

SEQ ID NO: 874898 - RNA, 18 nt, Homo sapiens
cucuugucucacaugcua

SEQ ID NO: 874899 - RNA, 15 nt, Homo sapiens
cucuuuaaucuucag

SEQ ID NO: 874900 - RNA, 20 nt, Homo sapiens
cucuuuucccucucuaggcc

SEQ ID NO: 874901 - RNA, 23 nt, Homo sapiens
cugaaaaaugguaauuguugcua

SEQ ID NO: 874902 - RNA, 17 nt, Homo sapiens
uaagccuuuugcucaca

SEQ ID NO: 874903 - RNA, 21 nt, Homo sapiens
uaagcuaucuucaaaugucua

SEQ ID NO: 874904 - RNA, 18 nt, Homo sapiens
uaagcugggauaaucaca

SEQ ID NO: 874905 - RNA, 20 nt, Homo sapiens
uaagcugggauaaucacauu

SEQ ID NO: 874906 - RNA, 12 nt, Homo sapiens
uaaggaacugga

SEQ ID NO: 874907 - RNA, 24 nt, Homo sapiens
uaaggacuuagcuggccacaguga

SEQ ID NO: 874908 - RNA, 16 nt, Homo sapiens
uaaggacuucugcagc

SEQ ID NO: 874909 - RNA, 20 nt, Homo sapiens
uaaggagaggagaaacugag

SEQ ID NO: 874910 - RNA, 16 nt, Homo sapiens
uaagggaaacugccag

SEQ ID NO: 874911 - RNA, 17 nt, Homo sapiens
uaagguaauucauggca

SEQ ID NO: 874912 - RNA, 20 nt, Homo sapiens
uaagguaauuucuguguauu

SEQ ID NO: 874913 - RNA, 15 nt, Homo sapiens
uaaggucaaugccag

SEQ ID NO: 874914 - RNA, 13 nt, Homo sapiens
uaaggugggucca

SEQ ID NO: 874915 - RNA, 13 nt, Homo sapiens
uaaguaauuauuc

SEQ ID NO: 874916 - RNA, 14 nt, Homo sapiens
uaaguaauuuugcc

SEQ ID NO: 874917 - RNA, 12 nt, Homo sapiens
uaaguacaaaua

SEQ ID NO: 874918 - RNA, 17 nt, Homo sapiens
uaaguaccacucaggcc

SEQ ID NO: 874919 - RNA, 22 nt, Homo sapiens
uaaguaccccugauaagcaaau

SEQ ID NO: 874920 - RNA, 23 nt, Homo sapiens
uaaguaccccugauaagcaaauu

SEQ ID NO: 874921 - RNA, 19 nt, Homo sapiens
uaagugcauuuguaauuca

SEQ ID NO: 874922 - RNA, 16 nt, Homo sapiens
uaagugccugagacac

SEQ ID NO: 874923 - RNA, 19 nt, Homo sapiens
uaagugguaaaauaaucca

SEQ ID NO: 874924 - RNA, 15 nt, Homo sapiens
uaaguuugauuucau

SEQ ID NO: 874925 - RNA, 19 nt, Homo sapiens
uaauaaaggucuuugcaca

SEQ ID NO: 874926 - RNA, 24 nt, Homo sapiens
uaauaaaggucuuugcacauguga

SEQ ID NO: 874927 - RNA, 21 nt, Homo sapiens
uaauaauagaaaaauacucau

SEQ ID NO: 874928 - RNA, 15 nt, Homo sapiens
uaauaccuguccaca

SEQ ID NO: 874929 - RNA, 22 nt, Homo sapiens
uaauaccuuaguuuuuuccaca

SEQ ID NO: 874930 - RNA, 19 nt, Homo sapiens
uaauacugccggucaccca

SEQ ID NO: 874931 - RNA, 18 nt, Homo sapiens
uaauacuugaugcaugca

SEQ ID NO: 874932 - RNA, 14 nt, Homo sapiens
uaauagacacauca

SEQ ID NO: 874933 - RNA, 21 nt, Homo sapiens
uaauagacaguagccaaguua

SEQ ID NO: 874934 - RNA, 18 nt, Homo sapiens
uaauagauguuacucaaa

SEQ ID NO: 874935 - RNA, 17 nt, Homo sapiens
uaauagccauaugcaau

SEQ ID NO: 874936 - RNA, 18 nt, Homo sapiens
uaauaguuuugauccuaa

SEQ ID NO: 874937 - RNA, 19 nt, Homo sapiens
uaauauaagaaucauagug

SEQ ID NO: 874938 - RNA, 14 nt, Homo sapiens
uaauauaugcucaa

SEQ ID NO: 874939 - RNA, 15 nt, Homo sapiens
uaauauauugcugcu

SEQ ID NO: 874940 - RNA, 16 nt, Homo sapiens
uaauauccacugcaau

SEQ ID NO: 874941 - RNA, 13 nt, Homo sapiens
uaauaugcuuuac

SEQ ID NO: 874942 - RNA, 16 nt, Homo sapiens
uaauaugguaaugcac

SEQ ID NO: 874943 - RNA, 16 nt, Homo sapiens
uaauauuuuuagcucu

SEQ ID NO: 874944 - RNA, 21 nt, Homo sapiens
uaaucagacaaaguaauuccu

SEQ ID NO: 874945 - RNA, 22 nt, Homo sapiens
cugacccuaaauguggacauca

SEQ ID NO: 874946 - RNA, 16 nt, Homo sapiens
cugaccuguguucccu

SEQ ID NO: 874947 - RNA, 15 nt, Homo sapiens
cugaccuugugaucu

SEQ ID NO: 874948 - RNA, 14 nt, Homo sapiens
cugacgaacuccuu

SEQ ID NO: 874949 - RNA, 16 nt, Homo sapiens
cugacgacacugaaga

SEQ ID NO: 874950 - RNA, 15 nt, Homo sapiens
cugacugacacaggc

SEQ ID NO: 874951 - RNA, 23 nt, Homo sapiens
cugacugggaccaggcaccaggc

SEQ ID NO: 874952 - RNA, 18 nt, Homo sapiens
cugacuuaaguggcauua

SEQ ID NO: 874953 - RNA, 15 nt, Homo sapiens
cugagaaacuuccuu

SEQ ID NO: 874954 - RNA, 18 nt, Homo sapiens
cugagaaagacuauucaa

SEQ ID NO: 874955 - RNA, 15 nt, Homo sapiens
cugagaagacaauau

SEQ ID NO: 874956 - RNA, 23 nt, Homo sapiens
cugagaccaguugggagcacugg

SEQ ID NO: 874957 - RNA, 21 nt, Homo sapiens
cugagacggcagagaccccag

SEQ ID NO: 874958 - RNA, 18 nt, Homo sapiens
cugagacuggaaauauga

SEQ ID NO: 874959 - RNA, 16 nt, Homo sapiens
cugagagaaacugagg

SEQ ID NO: 874960 - RNA, 20 nt, Homo sapiens
cugagagucugaaagacaga

SEQ ID NO: 874961 - RNA, 16 nt, Homo sapiens
cugagcauaaugcucc

SEQ ID NO: 874962 - RNA, 19 nt, Homo sapiens
cugagccaaacacacugua

SEQ ID NO: 874963 - RNA, 22 nt, Homo sapiens
cugagccaaacacacuguaaau

SEQ ID NO: 874964 - RNA, 21 nt, Homo sapiens
cugagcccugguguguuucca

SEQ ID NO: 874965 - RNA, 19 nt, Homo sapiens
cugagccuggcccauagaa

SEQ ID NO: 874966 - RNA, 18 nt, Homo sapiens
cugagcgagcacaccuuc

SEQ ID NO: 874967 - RNA, 15 nt, Homo sapiens
cugagcgcuguguua

SEQ ID NO: 874968 - RNA, 17 nt, Homo sapiens
cugagcucgguggaccc

SEQ ID NO: 874969 - RNA, 13 nt, Homo sapiens
cugagcucugaga

SEQ ID NO: 874970 - RNA, 14 nt, Homo sapiens
cugaggacauggag

SEQ ID NO: 874971 - RNA, 22 nt, Homo sapiens
cugaggcaagagaauugcuuga

SEQ ID NO: 874972 - RNA, 22 nt, Homo sapiens
cugaggcaggaggauugcuuga

SEQ ID NO: 874973 - RNA, 23 nt, Homo sapiens
cugaggcuguauguuugaucaca

SEQ ID NO: 874974 - RNA, 16 nt, Homo sapiens
cugaggcuuccagaga

SEQ ID NO: 874975 - RNA, 15 nt, Homo sapiens
cugagggcauuaaaa

SEQ ID NO: 874976 - RNA, 18 nt, Homo sapiens
cugaggggauaccauaaa

SEQ ID NO: 874977 - RNA, 20 nt, Homo sapiens
cugaggggauaccauaaaaa

SEQ ID NO: 874978 - RNA, 22 nt, Homo sapiens
cugaggguccccaccugggacc

SEQ ID NO: 874979 - RNA, 14 nt, Homo sapiens
cugagucaccuccu

SEQ ID NO: 874980 - RNA, 18 nt, Homo sapiens
cugaguccaacaauguug

SEQ ID NO: 874981 - RNA, 18 nt, Homo sapiens
cugagucccuccaugcaa

SEQ ID NO: 874982 - RNA, 15 nt, Homo sapiens
cugagugagccacag

SEQ ID NO: 874983 - RNA, 16 nt, Homo sapiens
cugagugagccacaga

SEQ ID NO: 874984 - RNA, 22 nt, Homo sapiens
cugagugcaccacuucaaguga

SEQ ID NO: 874985 - RNA, 14 nt, Homo sapiens
cugaguggaucucc

SEQ ID NO: 874986 - RNA, 15 nt, Homo sapiens
cugaguggcuuguga

SEQ ID NO: 874987 - RNA, 16 nt, Homo sapiens
cugaguuccugcaugc

SEQ ID NO: 874988 - RNA, 21 nt, Homo sapiens
cugaguuugcuguuugcaauu

SEQ ID NO: 874989 - RNA, 21 nt, Homo sapiens
cugauaaacauuaaacacugu

SEQ ID NO: 874990 - RNA, 19 nt, Homo sapiens
cugauaaugaaaauuauga

SEQ ID NO: 874991 - RNA, 15 nt, Homo sapiens
cugauacccagagca

SEQ ID NO: 874992 - RNA, 23 nt, Homo sapiens
cugauauaacaaacuacauguaa

SEQ ID NO: 874993 - RNA, 16 nt, Homo sapiens
cugaucagcaugggaa

SEQ ID NO: 874994 - RNA, 18 nt, Homo sapiens
cugaucauggucagcuca

SEQ ID NO: 874995 - RNA, 23 nt, Homo sapiens
cugaucccuuucccaugauccag

SEQ ID NO: 874996 - RNA, 15 nt, Homo sapiens
cugaugacaaaccca

SEQ ID NO: 874997 - RNA, 12 nt, Homo sapiens
cugaugcuguug

SEQ ID NO: 874998 - RNA, 16 nt, Homo sapiens
cugaugcuuuggugug

SEQ ID NO: 874999 - RNA, 12 nt, Homo sapiens
cugaugugccag

SEQ ID NO: 875000 - RNA, 17 nt, Homo sapiens
cugauguuaaaauucca

SEQ ID NO: 875001 - RNA, 18 nt, Homo sapiens
cugauguuaaaauuccau

SEQ ID NO: 875002 - RNA, 22 nt, Homo sapiens
cugauuaccuccuguguggaag

SEQ ID NO: 875003 - RNA, 13 nt, Homo sapiens
cugauucaagaaa

SEQ ID NO: 875004 - RNA, 16 nt, Homo sapiens
cugauucuccugucag

SEQ ID NO: 875005 - RNA, 15 nt, Homo sapiens
cugauuucagggaaa

SEQ ID NO: 875006 - RNA, 17 nt, Homo sapiens
cugauuuuuagcuuuac

SEQ ID NO: 875007 - RNA, 19 nt, Homo sapiens
cugcaaacucacugcucaa

SEQ ID NO: 875008 - RNA, 19 nt, Homo sapiens
cugcaaaggcgcagugcuu

SEQ ID NO: 875009 - RNA, 16 nt, Homo sapiens
cugcaaauaaauucau

SEQ ID NO: 875010 - RNA, 17 nt, Homo sapiens
cugcaaaucugccugau

SEQ ID NO: 875011 - RNA, 19 nt, Homo sapiens
cugcaagaaguacaugaag

SEQ ID NO: 875012 - RNA, 15 nt, Homo sapiens
cugcaagauuucaca

SEQ ID NO: 875013 - RNA, 12 nt, Homo sapiens
cugcacagggau

SEQ ID NO: 875014 - RNA, 13 nt, Homo sapiens
cugcacauuccug

SEQ ID NO: 875015 - RNA, 20 nt, Homo sapiens
cugcacccguacccccgugg

SEQ ID NO: 875016 - RNA, 13 nt, Homo sapiens
cugcaccgagaga

SEQ ID NO: 875017 - RNA, 14 nt, Homo sapiens
uacacacacagaug

SEQ ID NO: 875018 - RNA, 18 nt, Homo sapiens
uacacacacagaugcaca

SEQ ID NO: 875019 - RNA, 15 nt, Homo sapiens
uacacacauauacau

SEQ ID NO: 875020 - RNA, 19 nt, Homo sapiens
uacacacauauacauauau

SEQ ID NO: 875021 - RNA, 17 nt, Homo sapiens
uacacauacauacacau

SEQ ID NO: 875022 - RNA, 18 nt, Homo sapiens
uacacauguaucuaugca

SEQ ID NO: 875023 - RNA, 13 nt, Homo sapiens
uacaccauaugca

SEQ ID NO: 875024 - RNA, 18 nt, Homo sapiens
uacaccuaugucauuuca

SEQ ID NO: 875025 - RNA, 19 nt, Homo sapiens
uacaccuguugcaccucag

SEQ ID NO: 875026 - RNA, 23 nt, Homo sapiens
uacacuaagcgaauguguacaaa

SEQ ID NO: 875027 - RNA, 16 nt, Homo sapiens
uacacucaaacaauca

SEQ ID NO: 875028 - RNA, 22 nt, Homo sapiens
uacacuuguauaaauguauaua

SEQ ID NO: 875029 - RNA, 16 nt, Homo sapiens
uacacuuugaaguauu

SEQ ID NO: 875030 - RNA, 20 nt, Homo sapiens
uacagaaauacugcucugaa

SEQ ID NO: 875031 - RNA, 21 nt, Homo sapiens
uacagaaauacugcucugaau

SEQ ID NO: 875032 - RNA, 15 nt, Homo sapiens
uacagacguaugcuu

SEQ ID NO: 875033 - RNA, 14 nt, Homo sapiens
uacagacgucucaa

SEQ ID NO: 875034 - RNA, 19 nt, Homo sapiens
uacagaguuuaugauuuaa

SEQ ID NO: 875035 - RNA, 13 nt, Homo sapiens
uacagauagucaa

SEQ ID NO: 875036 - RNA, 13 nt, Homo sapiens
uacagaugcagcc

SEQ ID NO: 875037 - RNA, 13 nt, Homo sapiens
uacagaugggcaa

SEQ ID NO: 875038 - RNA, 17 nt, Homo sapiens
uacagcagugucaucag

SEQ ID NO: 875039 - RNA, 17 nt, Homo sapiens
uacagccagaagcccau

SEQ ID NO: 875040 - RNA, 16 nt, Homo sapiens
uacagggcccagguga

SEQ ID NO: 875041 - RNA, 18 nt, Homo sapiens
uacaggugcaagccacua

SEQ ID NO: 875042 - RNA, 21 nt, Homo sapiens
uacaggugcaagccacuaugu

SEQ ID NO: 875043 - RNA, 14 nt, Homo sapiens
uacaggugugaguc

SEQ ID NO: 875044 - RNA, 16 nt, Homo sapiens
uacaggugugagucac

SEQ ID NO: 875045 - RNA, 14 nt, Homo sapiens
uacaguacagugag

SEQ ID NO: 875046 - RNA, 15 nt, Homo sapiens
uacaguagugcauug

SEQ ID NO: 875047 - RNA, 15 nt, Homo sapiens
uacaguggaucucaa

SEQ ID NO: 875048 - RNA, 14 nt, Homo sapiens
uacaguggcuguca

SEQ ID NO: 875049 - RNA, 18 nt, Homo sapiens
uacauaaucacaauaaua

SEQ ID NO: 875050 - RNA, 17 nt, Homo sapiens
uacauacauacauacau

SEQ ID NO: 875051 - RNA, 15 nt, Homo sapiens
uacauacauacauau

SEQ ID NO: 875052 - RNA, 17 nt, Homo sapiens
uacauacauacauauau

SEQ ID NO: 875053 - RNA, 19 nt, Homo sapiens
uacauaccacuuugaauag

SEQ ID NO: 875054 - RNA, 15 nt, Homo sapiens
uacauagauggacca

SEQ ID NO: 875055 - RNA, 18 nt, Homo sapiens
uacauaguucuuacuacu

SEQ ID NO: 875056 - RNA, 22 nt, Homo sapiens
uacauauauauauacacauaca

SEQ ID NO: 875057 - RNA, 20 nt, Homo sapiens
uacauauggaaauccuguua

SEQ ID NO: 875058 - RNA, 14 nt, Homo sapiens
uacaugcaauuuau

SEQ ID NO: 875059 - RNA, 14 nt, Homo sapiens
uacaugcauuacug

SEQ ID NO: 875060 - RNA, 17 nt, Homo sapiens
uagagaagaucuaauac

SEQ ID NO: 875061 - RNA, 18 nt, Homo sapiens
uagagaauaccaguguua

SEQ ID NO: 875062 - RNA, 14 nt, Homo sapiens
uagagacucaaaga

SEQ ID NO: 875063 - RNA, 18 nt, Homo sapiens
uagagaucuauguacugu

SEQ ID NO: 875064 - RNA, 20 nt, Homo sapiens
uagagaucuauguacuguaa

SEQ ID NO: 875065 - RNA, 11 nt, Homo sapiens
uagagccugug

SEQ ID NO: 875066 - RNA, 18 nt, Homo sapiens
uagagcucaggccugcug

SEQ ID NO: 875067 - RNA, 17 nt, Homo sapiens
uagagcugagagucuga

SEQ ID NO: 875068 - RNA, 13 nt, Homo sapiens
uagagcugggaaa

SEQ ID NO: 875069 - RNA, 19 nt, Homo sapiens
uagaggaagaaaaccagcg

SEQ ID NO: 875070 - RNA, 21 nt, Homo sapiens
uagaggacagcaacuggugau

SEQ ID NO: 875071 - RNA, 17 nt, Homo sapiens
uagagugcaguggcaug

SEQ ID NO: 875072 - RNA, 17 nt, Homo sapiens
uagagugcaguggugca

SEQ ID NO: 875073 - RNA, 18 nt, Homo sapiens
uagaguguuaucagucau

SEQ ID NO: 875074 - RNA, 18 nt, Homo sapiens
uagaguuccaaauaagga

SEQ ID NO: 875075 - RNA, 17 nt, Homo sapiens
uagaucccaugucaccu

SEQ ID NO: 875076 - RNA, 14 nt, Homo sapiens
uagaucuaguucuc

SEQ ID NO: 875077 - RNA, 19 nt, Homo sapiens
uagauguauaaaucuuucu

SEQ ID NO: 875078 - RNA, 14 nt, Homo sapiens
uagauguaucauua

SEQ ID NO: 875079 - RNA, 18 nt, Homo sapiens
uagaugugacacauucuc

SEQ ID NO: 875080 - RNA, 18 nt, Homo sapiens
uagauuaauggcacugau

SEQ ID NO: 875081 - RNA, 20 nt, Homo sapiens
uagauuaccugccacuucca

SEQ ID NO: 875082 - RNA, 16 nt, Homo sapiens
uagauuccucuugccu

SEQ ID NO: 875083 - RNA, 13 nt, Homo sapiens
uagcaacuacagu

SEQ ID NO: 875084 - RNA, 19 nt, Homo sapiens
uagcaagaauugaggaaga

SEQ ID NO: 875085 - RNA, 21 nt, Homo sapiens
uagcacaauuuauauuuuccc

SEQ ID NO: 875086 - RNA, 21 nt, Homo sapiens
uagcagaaguauaaagugauc

SEQ ID NO: 875087 - RNA, 23 nt, Homo sapiens
uagcagaaguauaaagugaucag

SEQ ID NO: 875088 - RNA, 14 nt, Homo sapiens
uagcagauggagua

SEQ ID NO: 875089 - RNA, 18 nt, Homo sapiens
uagcaggaaguacucaua

SEQ ID NO: 875090 - RNA, 16 nt, Homo sapiens
uagcauugagugcuuu

SEQ ID NO: 875091 - RNA, 15 nt, Homo sapiens
uagcauuuuuauuca

SEQ ID NO: 875092 - RNA, 15 nt, Homo sapiens
uagccaacuccuccu

SEQ ID NO: 875093 - RNA, 19 nt, Homo sapiens
uagccacugaucauuuuua

SEQ ID NO: 875094 - RNA, 16 nt, Homo sapiens
uagccagugaaaaacu

SEQ ID NO: 875095 - RNA, 15 nt, Homo sapiens
uagccauaugcaaua

SEQ ID NO: 875096 - RNA, 18 nt, Homo sapiens
uagccaucucucuacucc

SEQ ID NO: 875097 - RNA, 14 nt, Homo sapiens
uagcccagcacugu

SEQ ID NO: 875098 - RNA, 20 nt, Homo sapiens
uagccuaauacaacauguag

SEQ ID NO: 875099 - RNA, 16 nt, Homo sapiens
uagccucuccaggaau

SEQ ID NO: 875100 - RNA, 18 nt, Homo sapiens
uagccuuagaagucacac

SEQ ID NO: 875101 - RNA, 21 nt, Homo sapiens
uagccuucucuguucauuucc

SEQ ID NO: 875102 - RNA, 19 nt, Homo sapiens
uagccuuuggggacggcca

SEQ ID NO: 875103 - RNA, 17 nt, Homo sapiens
uagcggucaauuugccu

SEQ ID NO: 875104 - RNA, 21 nt, Homo sapiens
uagcuaacguguccgaaacca

SEQ ID NO: 875105 - RNA, 12 nt, Homo sapiens
uagcucuauggg

SEQ ID NO: 875106 - RNA, 22 nt, Homo sapiens
uagcucuccugggguucuggga

SEQ ID NO: 875107 - RNA, 17 nt, Homo sapiens
uagcucuggugaccuug

SEQ ID NO: 875108 - RNA, 13 nt, Homo sapiens
uagcucuguccac

SEQ ID NO: 875109 - RNA, 18 nt, Homo sapiens
uagcucuguccacucuga

SEQ ID NO: 875110 - RNA, 19 nt, Homo sapiens
uagcugacaaugcacagcu

SEQ ID NO: 875111 - RNA, 17 nt, Homo sapiens
uagcugagcgugguggc

SEQ ID NO: 875112 - RNA, 12 nt, Homo sapiens
uagcugagcuca

SEQ ID NO: 875113 - RNA, 23 nt, Homo sapiens
uagcugcuuuaaaucuaucuaua

SEQ ID NO: 875114 - RNA, 16 nt, Homo sapiens
uagcugugaccugcug

SEQ ID NO: 875115 - RNA, 19 nt, Homo sapiens
uagcuuagaccucagccug

SEQ ID NO: 875116 - RNA, 21 nt, Homo sapiens
uagcuugauguuggaucucaa

SEQ ID NO: 875117 - RNA, 20 nt, Homo sapiens
uagcuuguauaguguaaaau

SEQ ID NO: 875118 - RNA, 23 nt, Homo sapiens
uagcuuuagggcaauauugccau

SEQ ID NO: 875119 - RNA, 14 nt, Homo sapiens
uagcuuuuauucau

SEQ ID NO: 875120 - RNA, 17 nt, Homo sapiens
uaggaaaaguacauuua

SEQ ID NO: 875121 - RNA, 17 nt, Homo sapiens
uaggaaauuccuucaua

SEQ ID NO: 875122 - RNA, 12 nt, Homo sapiens
uaggaacagcuc

SEQ ID NO: 875123 - RNA, 21 nt, Homo sapiens
uaggaaggcagcauuccauga

SEQ ID NO: 875124 - RNA, 19 nt, Homo sapiens
uaggaaggcuacuggcauu

SEQ ID NO: 875125 - RNA, 17 nt, Homo sapiens
uaggacauauaccuucu

SEQ ID NO: 875126 - RNA, 16 nt, Homo sapiens
uaggacucugaggcuc

SEQ ID NO: 875127 - RNA, 22 nt, Homo sapiens
uaggaggaaaaagaaaugcauu

SEQ ID NO: 875128 - RNA, 17 nt, Homo sapiens
uaggaguugaguacagu

SEQ ID NO: 875129 - RNA, 16 nt, Homo sapiens
uaggauagaugugauu

SEQ ID NO: 875130 - RNA, 16 nt, Homo sapiens
uaggauggauugcagu

SEQ ID NO: 875131 - RNA, 11 nt, Homo sapiens
uaggauuuaua

SEQ ID NO: 875132 - RNA, 17 nt, Homo sapiens
uaggcagccucucugcu

SEQ ID NO: 875133 - RNA, 23 nt, Homo sapiens
cugggauuacagguguaagccac

SEQ ID NO: 875134 - RNA, 18 nt, Homo sapiens
cugggauuacagguguga

SEQ ID NO: 875135 - RNA, 17 nt, Homo sapiens
cugggcaccucuagugc

SEQ ID NO: 875136 - RNA, 20 nt, Homo sapiens
cugggcagcugucauggaaa

SEQ ID NO: 875137 - RNA, 16 nt, Homo sapiens
cugggccccaccaccu

SEQ ID NO: 875138 - RNA, 15 nt, Homo sapiens
cugggccucaguuca

SEQ ID NO: 875139 - RNA, 17 nt, Homo sapiens
cugggccugcugcugag

SEQ ID NO: 875140 - RNA, 14 nt, Homo sapiens
cugggcuaccguga

SEQ ID NO: 875141 - RNA, 19 nt, Homo sapiens
cugggcugcagagacugga

SEQ ID NO: 875142 - RNA, 21 nt, Homo sapiens
cugggcugucugucaccagcu

SEQ ID NO: 875143 - RNA, 18 nt, Homo sapiens
cugggcuucuguccaagg

SEQ ID NO: 875144 - RNA, 15 nt, Homo sapiens
cuggggacaccagcc

SEQ ID NO: 875145 - RNA, 18 nt, Homo sapiens
cuggggacaccagccauc

SEQ ID NO: 875146 - RNA, 17 nt, Homo sapiens
cuggggaguuauaaaaa

SEQ ID NO: 875147 - RNA, 19 nt, Homo sapiens
cuggggccuguacugccug

SEQ ID NO: 875148 - RNA, 18 nt, Homo sapiens
cugggggcagauauuucc

SEQ ID NO: 875149 - RNA, 16 nt, Homo sapiens
cugggggccucagugc

SEQ ID NO: 875150 - RNA, 19 nt, Homo sapiens
cuggggucacaugcuuugu

SEQ ID NO: 875151 - RNA, 22 nt, Homo sapiens
cuggguacaagagccauguacc

SEQ ID NO: 875152 - RNA, 22 nt, Homo sapiens
cugggucuuucugacaucagca

SEQ ID NO: 875153 - RNA, 18 nt, Homo sapiens
cugggugagaauccugcc

SEQ ID NO: 875154 - RNA, 21 nt, Homo sapiens
cugggugccgggcugcacaga

SEQ ID NO: 875155 - RNA, 15 nt, Homo sapiens
cuggguggugaagga

SEQ ID NO: 875156 - RNA, 15 nt, Homo sapiens
cugguaacauagguu

SEQ ID NO: 875157 - RNA, 22 nt, Homo sapiens
cugguauuauuuacaaugcaga

SEQ ID NO: 875158 - RNA, 14 nt, Homo sapiens
cuggucuucacugc

SEQ ID NO: 875159 - RNA, 15 nt, Homo sapiens
cuggucuucacugcc

SEQ ID NO: 875160 - RNA, 16 nt, Homo sapiens
cuggucuucacugcca

SEQ ID NO: 875161 - RNA, 17 nt, Homo sapiens
cuggugccccacugaau

SEQ ID NO: 875162 - RNA, 19 nt, Homo sapiens
cugguggcccgacagccug

SEQ ID NO: 875163 - RNA, 12 nt, Homo sapiens
cugguggccgau

SEQ ID NO: 875164 - RNA, 14 nt, Homo sapiens
cugguuacucuggu

SEQ ID NO: 875165 - RNA, 15 nt, Homo sapiens
cugguuugaaagccu

SEQ ID NO: 875166 - RNA, 12 nt, Homo sapiens
cugguuuuaaca

SEQ ID NO: 875167 - RNA, 18 nt, Homo sapiens
cuguaacuucuuaaucua

SEQ ID NO: 875168 - RNA, 12 nt, Homo sapiens
cuguaagcauuc

SEQ ID NO: 875169 - RNA, 13 nt, Homo sapiens
cuguaagcauucu

SEQ ID NO: 875170 - RNA, 19 nt, Homo sapiens
cuguaaggaacuggaacac

SEQ ID NO: 875171 - RNA, 17 nt, Homo sapiens
cuguaaucccagcacuu

SEQ ID NO: 875172 - RNA, 18 nt, Homo sapiens
cuguaaucccagcacuuu

SEQ ID NO: 875173 - RNA, 17 nt, Homo sapiens
cuguaaucccagcaugc

SEQ ID NO: 875174 - RNA, 22 nt, Homo sapiens
cuguaauuaaguaaaccaaaaa

SEQ ID NO: 875175 - RNA, 22 nt, Homo sapiens
uauaagaaaagcagacgcagca

SEQ ID NO: 875176 - RNA, 20 nt, Homo sapiens
uauaagcagauuuaacaauu

SEQ ID NO: 875177 - RNA, 16 nt, Homo sapiens
uauaauacuaaagugu

SEQ ID NO: 875178 - RNA, 22 nt, Homo sapiens
uauaaucuuccauacuucuuca

SEQ ID NO: 875179 - RNA, 14 nt, Homo sapiens
uauacaaacaugug

SEQ ID NO: 875180 - RNA, 12 nt, Homo sapiens
uauacacauaca

SEQ ID NO: 875181 - RNA, 12 nt, Homo sapiens
uauacacaugga

SEQ ID NO: 875182 - RNA, 11 nt, Homo sapiens
uauacagcuca

SEQ ID NO: 875183 - RNA, 14 nt, Homo sapiens
uauacagcucagcu

SEQ ID NO: 875184 - RNA, 12 nt, Homo sapiens
uauacagugcau

SEQ ID NO: 875185 - RNA, 17 nt, Homo sapiens
uauacauguauagugag

SEQ ID NO: 875186 - RNA, 18 nt, Homo sapiens
uauacauguauagugagu

SEQ ID NO: 875187 - RNA, 17 nt, Homo sapiens
uauacauguguguauau

SEQ ID NO: 875188 - RNA, 18 nt, Homo sapiens
uauacauuugauguauug

SEQ ID NO: 875189 - RNA, 17 nt, Homo sapiens
uauacuguacugagaca

SEQ ID NO: 875190 - RNA, 18 nt, Homo sapiens
uauacuguggcuaugcaa

SEQ ID NO: 875191 - RNA, 22 nt, Homo sapiens
uauacuuuuuucuuauuuaacu

SEQ ID NO: 875192 - RNA, 14 nt, Homo sapiens
uauagagauaugca

SEQ ID NO: 875193 - RNA, 20 nt, Homo sapiens
uauagcaauguaacauuaau

SEQ ID NO: 875194 - RNA, 18 nt, Homo sapiens
uauagcguggguuaucag

SEQ ID NO: 875195 - RNA, 15 nt, Homo sapiens
uauagcguucccaac

SEQ ID NO: 875196 - RNA, 23 nt, Homo sapiens
uauaguauucauuuuccuaccua

SEQ ID NO: 875197 - RNA, 14 nt, Homo sapiens
uauagucacaagag

SEQ ID NO: 875198 - RNA, 16 nt, Homo sapiens
uauaguuuauugacaa

SEQ ID NO: 875199 - RNA, 12 nt, Homo sapiens
uauauaauacua

SEQ ID NO: 875200 - RNA, 20 nt, Homo sapiens
uauauaaugguuuacugcug

SEQ ID NO: 875201 - RNA, 16 nt, Homo sapiens
uauauaguauaccaua

SEQ ID NO: 875202 - RNA, 15 nt, Homo sapiens
uauauauacauaugu

SEQ ID NO: 875203 - RNA, 13 nt, Homo sapiens
uauauauauagua

SEQ ID NO: 875204 - RNA, 16 nt, Homo sapiens
uauauauauguguaua

SEQ ID NO: 875205 - RNA, 14 nt, Homo sapiens
uauauaucaaggau

SEQ ID NO: 875206 - RNA, 15 nt, Homo sapiens
uauauaucaaggaug

SEQ ID NO: 875207 - RNA, 18 nt, Homo sapiens
uauauauguguguguaua

SEQ ID NO: 875208 - RNA, 19 nt, Homo sapiens
uauauauuuuuucaauuua

SEQ ID NO: 875209 - RNA, 17 nt, Homo sapiens
uauaucuauaguaguca

SEQ ID NO: 875210 - RNA, 14 nt, Homo sapiens
uauaucuaugucua

SEQ ID NO: 875211 - RNA, 17 nt, Homo sapiens
uauaucuguggucuuca

SEQ ID NO: 875212 - RNA, 15 nt, Homo sapiens
uauaugacauuguua

SEQ ID NO: 875213 - RNA, 18 nt, Homo sapiens
uauaugauauacuaugac

SEQ ID NO: 875214 - RNA, 20 nt, Homo sapiens
uauauguaguacuaacuaag

SEQ ID NO: 875215 - RNA, 13 nt, Homo sapiens
uauauguaugugu

SEQ ID NO: 875216 - RNA, 20 nt, Homo sapiens
uauauguguauauauacaua

SEQ ID NO: 875217 - RNA, 22 nt, Homo sapiens
uauauuggaaucuguaucagaa

SEQ ID NO: 875218 - RNA, 16 nt, Homo sapiens
uauauuuaauggcaau

SEQ ID NO: 875219 - RNA, 19 nt, Homo sapiens
uauauuuuugguugucaau

SEQ ID NO: 875220 - RNA, 16 nt, Homo sapiens
uaucaaaaaguauuaa

SEQ ID NO: 875221 - RNA, 15 nt, Homo sapiens
uaucaaaacauauca

SEQ ID NO: 875222 - RNA, 16 nt, Homo sapiens
uaucaaaaucacuauc

SEQ ID NO: 875223 - RNA, 24 nt, Homo sapiens
uaucaaagagaaguuacauauuag

SEQ ID NO: 875224 - RNA, 21 nt, Homo sapiens
uaucaaaucuguauauguugu

SEQ ID NO: 875225 - RNA, 14 nt, Homo sapiens
uaucaaugaagauu

SEQ ID NO: 875226 - RNA, 13 nt, Homo sapiens
uaucacgcagauc

SEQ ID NO: 875227 - RNA, 20 nt, Homo sapiens
uaucauccugccuucaugga

SEQ ID NO: 875228 - RNA, 19 nt, Homo sapiens
uaucauuuauuuacaucua

SEQ ID NO: 875229 - RNA, 18 nt, Homo sapiens
uauccaauaggcauuuga

SEQ ID NO: 875230 - RNA, 22 nt, Homo sapiens
uauccacccagcccauucucuc

SEQ ID NO: 875231 - RNA, 17 nt, Homo sapiens
uauccaggacucuguca

SEQ ID NO: 875232 - RNA, 11 nt, Homo sapiens
uauccaugccu

SEQ ID NO: 875233 - RNA, 12 nt, Homo sapiens
uauccauggcaa

SEQ ID NO: 875234 - RNA, 14 nt, Homo sapiens
uauccccucaaaau

SEQ ID NO: 875235 - RNA, 20 nt, Homo sapiens
uauccgaacuuuaauuucag

SEQ ID NO: 875236 - RNA, 17 nt, Homo sapiens
uaucgggaacaguguuu

SEQ ID NO: 875237 - RNA, 13 nt, Homo sapiens
uaucgggucacug

SEQ ID NO: 875238 - RNA, 22 nt, Homo sapiens
uaucuaccaucuaaucuaugca

SEQ ID NO: 875239 - RNA, 19 nt, Homo sapiens
uaucucggaccuuucagcu

SEQ ID NO: 875240 - RNA, 23 nt, Homo sapiens
uaucugauuuccuaaugucagag

SEQ ID NO: 875241 - RNA, 19 nt, Homo sapiens
uaucugccuuagacaaagg

SEQ ID NO: 875242 - RNA, 21 nt, Homo sapiens
uaucugcucuuaggugcuucu

SEQ ID NO: 875243 - RNA, 15 nt, Homo sapiens
uaucuggacaagcca

SEQ ID NO: 875244 - RNA, 14 nt, Homo sapiens
uaucugucaucucu

SEQ ID NO: 875245 - RNA, 17 nt, Homo sapiens
uaucugugaggugcuga

SEQ ID NO: 875246 - RNA, 11 nt, Homo sapiens
uaucugugaua

SEQ ID NO: 875247 - RNA, 13 nt, Homo sapiens
uaucuguguauau

SEQ ID NO: 875248 - RNA, 20 nt, Homo sapiens
uaucuucaggacuauuucac

SEQ ID NO: 875249 - RNA, 15 nt, Homo sapiens
cuguuucugaaccau

SEQ ID NO: 875250 - RNA, 19 nt, Homo sapiens
cuguuugagaauaugauca

SEQ ID NO: 875251 - RNA, 24 nt, Homo sapiens
cuguuugucuauaugucuagcuca

SEQ ID NO: 875252 - RNA, 12 nt, Homo sapiens
cuguuugucucg

SEQ ID NO: 875253 - RNA, 20 nt, Homo sapiens
cuguuuuguuuuuaaaucaa

SEQ ID NO: 875254 - RNA, 17 nt, Homo sapiens
cuguuuuucggacaguu

SEQ ID NO: 875255 - RNA, 16 nt, Homo sapiens
cuuaaaaaauguccau

SEQ ID NO: 875256 - RNA, 15 nt, Homo sapiens
cuuaaaaaugcacac

SEQ ID NO: 875257 - RNA, 21 nt, Homo sapiens
cuuaaaacugaaaaauuuuau

SEQ ID NO: 875258 - RNA, 19 nt, Homo sapiens
cuuaaaagauucacuaaag

SEQ ID NO: 875259 - RNA, 23 nt, Homo sapiens
cuuaaaauagaaauaagugguua

SEQ ID NO: 875260 - RNA, 14 nt, Homo sapiens
cuuaaaauguuaac

SEQ ID NO: 875261 - RNA, 21 nt, Homo sapiens
cuuaaaggcaccaucuaauag

SEQ ID NO: 875262 - RNA, 23 nt, Homo sapiens
cuuaaaggccuggaaccagggag

SEQ ID NO: 875263 - RNA, 16 nt, Homo sapiens
cuuaaaggcuguggua

SEQ ID NO: 875264 - RNA, 21 nt, Homo sapiens
cuuaaauaaauucaaaccauu

SEQ ID NO: 875265 - RNA, 13 nt, Homo sapiens
cuuaaaucacuga

SEQ ID NO: 875266 - RNA, 17 nt, Homo sapiens
cuuaacggcuccaggau

SEQ ID NO: 875267 - RNA, 16 nt, Homo sapiens
cuuaagccuuuugcuc

SEQ ID NO: 875268 - RNA, 21 nt, Homo sapiens
cuuaagccuuuugcucacaaa

SEQ ID NO: 875269 - RNA, 17 nt, Homo sapiens
cuuaaggcuugaaguaa

SEQ ID NO: 875270 - RNA, 19 nt, Homo sapiens
cuuaaggggauggggguca

SEQ ID NO: 875271 - RNA, 14 nt, Homo sapiens
cuuaauaggcuuua

SEQ ID NO: 875272 - RNA, 14 nt, Homo sapiens
cuuaauauguuaac

SEQ ID NO: 875273 - RNA, 20 nt, Homo sapiens
cuuaaucaagaauauucaaa

SEQ ID NO: 875274 - RNA, 20 nt, Homo sapiens
cuuaaucugccauaaagcca

SEQ ID NO: 875275 - RNA, 21 nt, Homo sapiens
cuuaaugauccguuccauugc

SEQ ID NO: 875276 - RNA, 22 nt, Homo sapiens
cuuacaauaauucuaugagaua

SEQ ID NO: 875277 - RNA, 13 nt, Homo sapiens
cuuacaugcauua

SEQ ID NO: 875278 - RNA, 15 nt, Homo sapiens
cuuaccaacuuucug

SEQ ID NO: 875279 - RNA, 19 nt, Homo sapiens
cuuaccuagauucuacaua

SEQ ID NO: 875280 - RNA, 19 nt, Homo sapiens
cuuaccuuaaaaaguaauu

SEQ ID NO: 875281 - RNA, 18 nt, Homo sapiens
cuuacuuaaacccagcuc

SEQ ID NO: 875282 - RNA, 15 nt, Homo sapiens
cuuacuuauucuucc

SEQ ID NO: 875283 - RNA, 21 nt, Homo sapiens
cuuacuuuuggauaauaucca

SEQ ID NO: 875284 - RNA, 13 nt, Homo sapiens
cuuagaccucagc

SEQ ID NO: 875285 - RNA, 21 nt, Homo sapiens
cuuagcuucuauuauagccac

SEQ ID NO: 875286 - RNA, 15 nt, Homo sapiens
cuuagcuuuccacag

SEQ ID NO: 875287 - RNA, 20 nt, Homo sapiens
cuuaggaaacccuucuuuac

SEQ ID NO: 875288 - RNA, 22 nt, Homo sapiens
cuuaggaacagcucuucacuca

SEQ ID NO: 875289 - RNA, 18 nt, Homo sapiens
cuuagggauaacacuguc

SEQ ID NO: 875290 - RNA, 23 nt, Homo sapiens
uccccaaacaccaugaaucuuuu

SEQ ID NO: 875291 - RNA, 23 nt, Homo sapiens
uccccaaacauuaaucaccaaag

SEQ ID NO: 875292 - RNA, 22 nt, Homo sapiens
uccccaagugaccuauaccugu

SEQ ID NO: 875293 - RNA, 17 nt, Homo sapiens
uccccacauaccaucug

SEQ ID NO: 875294 - RNA, 21 nt, Homo sapiens
uccccacccccgcugggggug

SEQ ID NO: 875295 - RNA, 11 nt, Homo sapiens
uccccagacac

SEQ ID NO: 875296 - RNA, 22 nt, Homo sapiens
uccccagacuucucuuucuuau

SEQ ID NO: 875297 - RNA, 17 nt, Homo sapiens
uccccagccuacugccu

SEQ ID NO: 875298 - RNA, 24 nt, Homo sapiens
uccccagucccaaugcacauccau

SEQ ID NO: 875299 - RNA, 23 nt, Homo sapiens
uccccaugcaugggaaagugcaa

SEQ ID NO: 875300 - RNA, 20 nt, Homo sapiens
uccccauucacagagccuuu

SEQ ID NO: 875301 - RNA, 17 nt, Homo sapiens
ucccccaaaaugcauuu

SEQ ID NO: 875302 - RNA, 20 nt, Homo sapiens
ucccccaccuucaagcaccc

SEQ ID NO: 875303 - RNA, 17 nt, Homo sapiens
ucccccagccucaaguc

SEQ ID NO: 875304 - RNA, 20 nt, Homo sapiens
ucccccuaagaggcagugag

SEQ ID NO: 875305 - RNA, 21 nt, Homo sapiens
ucccccuaugcuccaguaugg

SEQ ID NO: 875306 - RNA, 22 nt, Homo sapiens
ucccccuggggcuucuccugac

SEQ ID NO: 875307 - RNA, 18 nt, Homo sapiens
uccccgcagagcucccuu

SEQ ID NO: 875308 - RNA, 23 nt, Homo sapiens
uccccgggggcagacaccugugc

SEQ ID NO: 875309 - RNA, 13 nt, Homo sapiens
uccccuccacugu

SEQ ID NO: 875310 - RNA, 12 nt, Homo sapiens
uccccuccccca

SEQ ID NO: 875311 - RNA, 21 nt, Homo sapiens
uccccucgugugacucucuug

SEQ ID NO: 875312 - RNA, 17 nt, Homo sapiens
uccccugaaaaacugau

SEQ ID NO: 875313 - RNA, 21 nt, Homo sapiens
uccccugaaaaacugaucaaa

SEQ ID NO: 875314 - RNA, 16 nt, Homo sapiens
uccccuggacugggag

SEQ ID NO: 875315 - RNA, 15 nt, Homo sapiens
uccccugucccacca

SEQ ID NO: 875316 - RNA, 17 nt, Homo sapiens
uccccuguggucuugga

SEQ ID NO: 875317 - RNA, 18 nt, Homo sapiens
uccccuguggucuuggaa

SEQ ID NO: 875318 - RNA, 22 nt, Homo sapiens
uccccuugcccagggcucagcc

SEQ ID NO: 875319 - RNA, 19 nt, Homo sapiens
uccccuugcccuugcccug

SEQ ID NO: 875320 - RNA, 14 nt, Homo sapiens
ucccgagcuacucu

SEQ ID NO: 875321 - RNA, 20 nt, Homo sapiens
ucccgaguagcugggauuac

SEQ ID NO: 875322 - RNA, 17 nt, Homo sapiens
ucccgagucaugcacuc

SEQ ID NO: 875323 - RNA, 21 nt, Homo sapiens
ucccgagucaugcacucaggc

SEQ ID NO: 875324 - RNA, 14 nt, Homo sapiens
ucccggaccugugg

SEQ ID NO: 875325 - RNA, 14 nt, Homo sapiens
ucccggacugcaag

SEQ ID NO: 875326 - RNA, 18 nt, Homo sapiens
ucccgggggcacugccug

SEQ ID NO: 875327 - RNA, 13 nt, Homo sapiens
ucccuaucaaaac

SEQ ID NO: 875328 - RNA, 16 nt, Homo sapiens
ucccuauuaaccuaga

SEQ ID NO: 875329 - RNA, 23 nt, Homo sapiens
ucccucccagauccucugcugac

SEQ ID NO: 875330 - RNA, 20 nt, Homo sapiens
ucccucccuggcucugccag

SEQ ID NO: 875331 - RNA, 15 nt, Homo sapiens
ucccuccuaaccuag

SEQ ID NO: 875332 - RNA, 21 nt, Homo sapiens
ucccuccuuauuuuugaauug

SEQ ID NO: 875333 - RNA, 15 nt, Homo sapiens
ucccucuaaguggaa

SEQ ID NO: 875334 - RNA, 19 nt, Homo sapiens
ucccucuaauuuaucuugu

SEQ ID NO: 875335 - RNA, 14 nt, Homo sapiens
ucccucuggcccug

SEQ ID NO: 875336 - RNA, 18 nt, Homo sapiens
ucccucuuugccugugug

SEQ ID NO: 875337 - RNA, 19 nt, Homo sapiens
ucccucuuugccuguguga

SEQ ID NO: 875338 - RNA, 18 nt, Homo sapiens
ucccugaacaucugugug

SEQ ID NO: 875339 - RNA, 22 nt, Homo sapiens
ucccugagagcucacaguacaa

SEQ ID NO: 875340 - RNA, 19 nt, Homo sapiens
ucccugauaacaaccugga

SEQ ID NO: 875341 - RNA, 20 nt, Homo sapiens
ucccugauaacaaccuggag

SEQ ID NO: 875342 - RNA, 11 nt, Homo sapiens
ucccugggaag

SEQ ID NO: 875343 - RNA, 19 nt, Homo sapiens
ucccuggucccucguccac

SEQ ID NO: 875344 - RNA, 12 nt, Homo sapiens
ucccuguacaau

SEQ ID NO: 875345 - RNA, 21 nt, Homo sapiens
ucccuguccuccucggaucac

SEQ ID NO: 875346 - RNA, 18 nt, Homo sapiens
ucccugugcugacggaag

SEQ ID NO: 875347 - RNA, 20 nt, Homo sapiens
ucccuuaggcauuauuuaau

SEQ ID NO: 875348 - RNA, 20 nt, Homo sapiens
ucccuucccccauccuccag

SEQ ID NO: 875349 - RNA, 15 nt, Homo sapiens
ucccuucuacagccu

SEQ ID NO: 875350 - RNA, 13 nt, Homo sapiens
ucccuugaaauuu

SEQ ID NO: 875351 - RNA, 17 nt, Homo sapiens
ucccuuuaucaguuuga

SEQ ID NO: 875352 - RNA, 18 nt, Homo sapiens
uccgccaaacacuccacc

SEQ ID NO: 875353 - RNA, 22 nt, Homo sapiens
uccgcugccaccacgucugcca

SEQ ID NO: 875354 - RNA, 20 nt, Homo sapiens
uccggaagaaaaagagccau

SEQ ID NO: 875355 - RNA, 22 nt, Homo sapiens
uccggagggguugcgggggagc

SEQ ID NO: 875356 - RNA, 23 nt, Homo sapiens
uccggagggguugcgggggagcu

SEQ ID NO: 875357 - RNA, 12 nt, Homo sapiens
uccguacauuca

SEQ ID NO: 875358 - RNA, 16 nt, Homo sapiens
uccguaguucccugaa

SEQ ID NO: 875359 - RNA, 16 nt, Homo sapiens
uccgucaccucagaga

SEQ ID NO: 875360 - RNA, 23 nt, Homo sapiens
uccgugguggcaccgagaccaaa

SEQ ID NO: 875361 - RNA, 19 nt, Homo sapiens
uccuaaaaauaagcuuuau

SEQ ID NO: 875362 - RNA, 19 nt, Homo sapiens
uccuaaaggcccacuggca

SEQ ID NO: 875363 - RNA, 20 nt, Homo sapiens
uccuaacaaguagcacccug

SEQ ID NO: 875364 - RNA, 18 nt, Homo sapiens
gaccaaagccaccaagac

SEQ ID NO: 875365 - RNA, 16 nt, Homo sapiens
gaccaaauaaaguacc

SEQ ID NO: 875366 - RNA, 17 nt, Homo sapiens
gaccaaauaaaguacca

SEQ ID NO: 875367 - RNA, 15 nt, Homo sapiens
gaccaauacuacugu

SEQ ID NO: 875368 - RNA, 19 nt, Homo sapiens
gaccaccucucaauauuca

SEQ ID NO: 875369 - RNA, 21 nt, Homo sapiens
gaccacgcuuucuagcuguug

SEQ ID NO: 875370 - RNA, 21 nt, Homo sapiens
gaccacuuuucaguucagugg

SEQ ID NO: 875371 - RNA, 14 nt, Homo sapiens
gaccagaaguggac

SEQ ID NO: 875372 - RNA, 14 nt, Homo sapiens
gaccagccugggca

SEQ ID NO: 875373 - RNA, 18 nt, Homo sapiens
gaccaggaugacaccucc

SEQ ID NO: 875374 - RNA, 17 nt, Homo sapiens
gaccaggccugagcaac

SEQ ID NO: 875375 - RNA, 17 nt, Homo sapiens
gaccagggcuuuuccca

SEQ ID NO: 875376 - RNA, 20 nt, Homo sapiens
gaccauaaaggcauggcauu

SEQ ID NO: 875377 - RNA, 23 nt, Homo sapiens
gaccauaaaggcauggcauuugu

SEQ ID NO: 875378 - RNA, 16 nt, Homo sapiens
gaccauccuauuuaac

SEQ ID NO: 875379 - RNA, 23 nt, Homo sapiens
gaccaucgcaaccaggauugaca

SEQ ID NO: 875380 - RNA, 22 nt, Homo sapiens
gacccaagagguggggaccaaa

SEQ ID NO: 875381 - RNA, 13 nt, Homo sapiens
gacccacacaugu

SEQ ID NO: 875382 - RNA, 15 nt, Homo sapiens
gacccagucaaugaa

SEQ ID NO: 875383 - RNA, 16 nt, Homo sapiens
gaccccucccaaccuc

SEQ ID NO: 875384 - RNA, 20 nt, Homo sapiens
gacccggaggggccuggcag

SEQ ID NO: 875385 - RNA, 21 nt, Homo sapiens
gacccuccuccacuccaccuc

SEQ ID NO: 875386 - RNA, 14 nt, Homo sapiens
gacccuccugucca

SEQ ID NO: 875387 - RNA, 21 nt, Homo sapiens
gacccucugaaugguccaggg

SEQ ID NO: 875388 - RNA, 18 nt, Homo sapiens
gacccuucagggccagaa

SEQ ID NO: 875389 - RNA, 23 nt, Homo sapiens
gaccuagugguuucuacucucac

SEQ ID NO: 875390 - RNA, 20 nt, Homo sapiens
gaccucaggugauccaccca

SEQ ID NO: 875391 - RNA, 16 nt, Homo sapiens
gaccucauuccuggga

SEQ ID NO: 875392 - RNA, 13 nt, Homo sapiens
gaccucccaaagu

SEQ ID NO: 875393 - RNA, 16 nt, Homo sapiens
gaccucccagcccuau

SEQ ID NO: 875394 - RNA, 18 nt, Homo sapiens
gaccucccccucuugguc

SEQ ID NO: 875395 - RNA, 18 nt, Homo sapiens
gaccuccguguagugucu

SEQ ID NO: 875396 - RNA, 21 nt, Homo sapiens
gaccucuacaagcaaauggag

SEQ ID NO: 875397 - RNA, 15 nt, Homo sapiens
gaccucuacugccuu

SEQ ID NO: 875398 - RNA, 16 nt, Homo sapiens
gaccugaccggcaccu

SEQ ID NO: 875399 - RNA, 14 nt, Homo sapiens
gaccugcaggccaa

SEQ ID NO: 875400 - RNA, 17 nt, Homo sapiens
gaccuguaaucauauaa

SEQ ID NO: 875401 - RNA, 18 nt, Homo sapiens
gaccuguuuuuguguuuu

SEQ ID NO: 875402 - RNA, 16 nt, Homo sapiens
gaccuuccacacaggg

SEQ ID NO: 875403 - RNA, 20 nt, Homo sapiens
ucucaauuauuggccugcua

SEQ ID NO: 875404 - RNA, 12 nt, Homo sapiens
ucucacaaacau

SEQ ID NO: 875405 - RNA, 14 nt, Homo sapiens
ucucacaagcacuu

SEQ ID NO: 875406 - RNA, 15 nt, Homo sapiens
ucucacuaaaaugga

SEQ ID NO: 875407 - RNA, 18 nt, Homo sapiens
ucucacuguugcccaggc

SEQ ID NO: 875408 - RNA, 21 nt, Homo sapiens
ucucacuuauaccaaagggaa

SEQ ID NO: 875409 - RNA, 14 nt, Homo sapiens
ucucagaagguauu

SEQ ID NO: 875410 - RNA, 23 nt, Homo sapiens
ucucaggaaaucaaauaugcaaa

SEQ ID NO: 875411 - RNA, 21 nt, Homo sapiens
ucucaggcgcaugugccaguu

SEQ ID NO: 875412 - RNA, 22 nt, Homo sapiens
ucucaguuauucagauugacaa

SEQ ID NO: 875413 - RNA, 17 nt, Homo sapiens
ucucauaccucugacca

SEQ ID NO: 875414 - RNA, 17 nt, Homo sapiens
ucucauagguugccaau

SEQ ID NO: 875415 - RNA, 14 nt, Homo sapiens
ucucaucacuuuuc

SEQ ID NO: 875416 - RNA, 15 nt, Homo sapiens
ucucaugaaccucaa

SEQ ID NO: 875417 - RNA, 15 nt, Homo sapiens
ucucaugagugccaa

SEQ ID NO: 875418 - RNA, 12 nt, Homo sapiens
ucucauucaaag

SEQ ID NO: 875419 - RNA, 17 nt, Homo sapiens
ucuccaaaugagaucua

SEQ ID NO: 875420 - RNA, 18 nt, Homo sapiens
ucuccaacaccaccucuc

SEQ ID NO: 875421 - RNA, 18 nt, Homo sapiens
ucuccaagaauacagaaa

SEQ ID NO: 875422 - RNA, 14 nt, Homo sapiens
ucuccacuuuguug

SEQ ID NO: 875423 - RNA, 24 nt, Homo sapiens
ucuccagccagcaaugauguccag

SEQ ID NO: 875424 - RNA, 21 nt, Homo sapiens
ucuccagguccucuacuuaau

SEQ ID NO: 875425 - RNA, 12 nt, Homo sapiens
ucucccaugcac

SEQ ID NO: 875426 - RNA, 21 nt, Homo sapiens
ucuccccacucuaggggucag

SEQ ID NO: 875427 - RNA, 16 nt, Homo sapiens
ucucccuggggucaca

SEQ ID NO: 875428 - RNA, 17 nt, Homo sapiens
ucucccuuagggcccug

SEQ ID NO: 875429 - RNA, 15 nt, Homo sapiens
ucuccgcacuuggaa

SEQ ID NO: 875430 - RNA, 16 nt, Homo sapiens
ucuccgcacuuggaaa

SEQ ID NO: 875431 - RNA, 19 nt, Homo sapiens
ucuccucccaaaauacuac

SEQ ID NO: 875432 - RNA, 15 nt, Homo sapiens
ucuccucuaucacau

SEQ ID NO: 875433 - RNA, 22 nt, Homo sapiens
ucuccucuaucacauuacauca

SEQ ID NO: 875434 - RNA, 15 nt, Homo sapiens
ucuccucuccuagcc

SEQ ID NO: 875435 - RNA, 17 nt, Homo sapiens
ucuccugacaugucuca

SEQ ID NO: 875436 - RNA, 14 nt, Homo sapiens
ucuccuucugaaag

SEQ ID NO: 875437 - RNA, 13 nt, Homo sapiens
ucuccuugcacuu

SEQ ID NO: 875438 - RNA, 21 nt, Homo sapiens
ucuccuuggaaauacuuuauc

SEQ ID NO: 875439 - RNA, 18 nt, Homo sapiens
ucuccuuugcacugaggg

SEQ ID NO: 875440 - RNA, 17 nt, Homo sapiens
ucuccuuuugaccaaau

SEQ ID NO: 875441 - RNA, 14 nt, Homo sapiens
ucucgaacuccuga

SEQ ID NO: 875442 - RNA, 17 nt, Homo sapiens
ucucgagcccagaugga

SEQ ID NO: 875443 - RNA, 19 nt, Homo sapiens
ucucgcaguacauguuacu

SEQ ID NO: 875444 - RNA, 19 nt, Homo sapiens
ucucgcauuuucucuagcu

SEQ ID NO: 875445 - RNA, 18 nt, Homo sapiens
ucucgucuccugacaugu

SEQ ID NO: 875446 - RNA, 15 nt, Homo sapiens
ucucuaaaauagcca

SEQ ID NO: 875447 - RNA, 15 nt, Homo sapiens
ucucuagccacuuug

SEQ ID NO: 875448 - RNA, 20 nt, Homo sapiens
ucucuagcugaucagaauuu

SEQ ID NO: 875449 - RNA, 22 nt, Homo sapiens
ucucuaucuggaauuuaauuaa

SEQ ID NO: 875450 - RNA, 15 nt, Homo sapiens
ucucuccagccugac

SEQ ID NO: 875451 - RNA, 16 nt, Homo sapiens
ucucucucucuacaaa

SEQ ID NO: 875452 - RNA, 16 nt, Homo sapiens
ucucugacucuugccu

SEQ ID NO: 875453 - RNA, 18 nt, Homo sapiens
ucucugagaacagacguu

SEQ ID NO: 875454 - RNA, 21 nt, Homo sapiens
ucucugauguaguuaaguauu

SEQ ID NO: 875455 - RNA, 23 nt, Homo sapiens
ucucugcccccagccucuguccc

SEQ ID NO: 875456 - RNA, 16 nt, Homo sapiens
ucucugcugcauuugu

SEQ ID NO: 875457 - RNA, 20 nt, Homo sapiens
ucucuggaacccaggaccuc

SEQ ID NO: 875458 - RNA, 16 nt, Homo sapiens
ucucuuauauaguauu

SEQ ID NO: 875459 - RNA, 22 nt, Homo sapiens
ucucuucagccccuagugcuau

SEQ ID NO: 875460 - RNA, 22 nt, Homo sapiens
ucucuugaauuugguaucuuau

SEQ ID NO: 875461 - RNA, 17 nt, Homo sapiens
ucucuugucucacaugc

SEQ ID NO: 875462 - RNA, 21 nt, Homo sapiens
ucucuuuaaauggcuuuaugc

SEQ ID NO: 875463 - RNA, 20 nt, Homo sapiens
ucugaaaaacauuccaggaa

SEQ ID NO: 875464 - RNA, 18 nt, Homo sapiens
ucugaaacucacacaacu

SEQ ID NO: 875465 - RNA, 13 nt, Homo sapiens
ucugaaacuucau

SEQ ID NO: 875466 - RNA, 14 nt, Homo sapiens
ucugaaagacagaa

SEQ ID NO: 875467 - RNA, 21 nt, Homo sapiens
ucugaaaucagucuaccaagg

SEQ ID NO: 875468 - RNA, 14 nt, Homo sapiens
ucugaaauuuccca

SEQ ID NO: 875469 - RNA, 20 nt, Homo sapiens
ucugaaauuuuaauugaacu

SEQ ID NO: 875470 - RNA, 15 nt, Homo sapiens
ucugaaccacuuugc

SEQ ID NO: 875471 - RNA, 17 nt, Homo sapiens
ucugaaccauuacugua

SEQ ID NO: 875472 - RNA, 20 nt, Homo sapiens
ucugaagacuaucuuugaag

SEQ ID NO: 875473 - RNA, 19 nt, Homo sapiens
ucugaaggucccaccucca

SEQ ID NO: 875474 - RNA, 13 nt, Homo sapiens
ucugaagucacau

SEQ ID NO: 875475 - RNA, 17 nt, Homo sapiens
ucugaagucacugcaca

SEQ ID NO: 875476 - RNA, 22 nt, Homo sapiens
ucugaauggugcuguuucuaua

SEQ ID NO: 875477 - RNA, 15 nt, Homo sapiens
ucugaauugacugua

SEQ ID NO: 875478 - RNA, 14 nt, Homo sapiens
ucugacacacagcu

SEQ ID NO: 875479 - RNA, 19 nt, Homo sapiens
ucugagaaaagcuuugaac

SEQ ID NO: 875480 - RNA, 20 nt, Homo sapiens
gaggucuccacugaggaugu

SEQ ID NO: 875481 - RNA, 21 nt, Homo sapiens
gaggucuccaucauggcagug

SEQ ID NO: 875482 - RNA, 20 nt, Homo sapiens
gagguggagguugcagugag

SEQ ID NO: 875483 - RNA, 20 nt, Homo sapiens
gaguaacaugccagcuuccu

SEQ ID NO: 875484 - RNA, 15 nt, Homo sapiens
gaguaauaugccugc

SEQ ID NO: 875485 - RNA, 19 nt, Homo sapiens
gaguaauucuagcuuucaa

SEQ ID NO: 875486 - RNA, 16 nt, Homo sapiens
gaguacagugagccaa

SEQ ID NO: 875487 - RNA, 22 nt, Homo sapiens
gaguaccaugaggguugcuauu

SEQ ID NO: 875488 - RNA, 14 nt, Homo sapiens
gaguauaauauuca

SEQ ID NO: 875489 - RNA, 13 nt, Homo sapiens
gaguauacuaaaa

SEQ ID NO: 875490 - RNA, 22 nt, Homo sapiens
gagucaauccccucauucagga

SEQ ID NO: 875491 - RNA, 23 nt, Homo sapiens
gagucaccuccuccacucacucc

SEQ ID NO: 875492 - RNA, 21 nt, Homo sapiens
gagucaggacuugaacccagg

SEQ ID NO: 875493 - RNA, 16 nt, Homo sapiens
gaguccaacaauguug

SEQ ID NO: 875494 - RNA, 17 nt, Homo sapiens
gagucgaggacagggag

SEQ ID NO: 875495 - RNA, 19 nt, Homo sapiens
gagucucccuuagggcccu

SEQ ID NO: 875496 - RNA, 18 nt, Homo sapiens
gagucuccucucugagac

SEQ ID NO: 875497 - RNA, 18 nt, Homo sapiens
gagucucuucuccacugg

SEQ ID NO: 875498 - RNA, 14 nt, Homo sapiens
gagucugugcucuu

SEQ ID NO: 875499 - RNA, 22 nt, Homo sapiens
gagucuuaauauauauauccag

SEQ ID NO: 875500 - RNA, 15 nt, Homo sapiens
gagugacacccaaga

SEQ ID NO: 875501 - RNA, 18 nt, Homo sapiens
gagugacucgaggguugg

SEQ ID NO: 875502 - RNA, 22 nt, Homo sapiens
gagugagaauaauuguguacaa

SEQ ID NO: 875503 - RNA, 23 nt, Homo sapiens
gagugauugacacacagcacucu

SEQ ID NO: 875504 - RNA, 20 nt, Homo sapiens
gagugcaccacuucaaguga

SEQ ID NO: 875505 - RNA, 12 nt, Homo sapiens
gagugcugagaa

SEQ ID NO: 875506 - RNA, 18 nt, Homo sapiens
gagugggccgcuguguuu

SEQ ID NO: 875507 - RNA, 17 nt, Homo sapiens
gaguguuuuuguaucac

SEQ ID NO: 875508 - RNA, 21 nt, Homo sapiens
gaguuaauauauagaagggua

SEQ ID NO: 875509 - RNA, 13 nt, Homo sapiens
gaguuagugccau

SEQ ID NO: 875510 - RNA, 21 nt, Homo sapiens
gaguuauuuauuggcuggaga

SEQ ID NO: 875511 - RNA, 15 nt, Homo sapiens
gaguucaagccugug

SEQ ID NO: 875512 - RNA, 23 nt, Homo sapiens
gaguuccaugaagaccacaucca

SEQ ID NO: 875513 - RNA, 18 nt, Homo sapiens
gaguucccugaacaucug

SEQ ID NO: 875514 - RNA, 14 nt, Homo sapiens
gaguuccucaggga

SEQ ID NO: 875515 - RNA, 20 nt, Homo sapiens
gaguuccugugggugugucu

SEQ ID NO: 875516 - RNA, 19 nt, Homo sapiens
gaguucgaggcugcaguca

SEQ ID NO: 875517 - RNA, 13 nt, Homo sapiens
gauuuauaucuau

SEQ ID NO: 875518 - RNA, 16 nt, Homo sapiens
gauuuaugaucacuug

SEQ ID NO: 875519 - RNA, 19 nt, Homo sapiens
gauuuaugaucacuuggaa

SEQ ID NO: 875520 - RNA, 13 nt, Homo sapiens
gauuucaggauac

SEQ ID NO: 875521 - RNA, 16 nt, Homo sapiens
gauuucauuaccaagu

SEQ ID NO: 875522 - RNA, 21 nt, Homo sapiens
gauuucauugacugaacugca

SEQ ID NO: 875523 - RNA, 22 nt, Homo sapiens
gauuuccuacagaaauacugcu

SEQ ID NO: 875524 - RNA, 21 nt, Homo sapiens
gauuugaacccccgccauccu

SEQ ID NO: 875525 - RNA, 13 nt, Homo sapiens
gauuuguguuaua

SEQ ID NO: 875526 - RNA, 16 nt, Homo sapiens
gauuuguucacaugca

SEQ ID NO: 875527 - RNA, 20 nt, Homo sapiens
gauuuuuguuuuccacugug

SEQ ID NO: 875528 - RNA, 20 nt, Homo sapiens
gcaaaaaaauuaaauuauuu

SEQ ID NO: 875529 - RNA, 23 nt, Homo sapiens
gcaaaacaaggacuagagcucag

SEQ ID NO: 875530 - RNA, 12 nt, Homo sapiens
gcaaaagcgcag

SEQ ID NO: 875531 - RNA, 17 nt, Homo sapiens
gcaaaagcucuguguaa

SEQ ID NO: 875532 - RNA, 12 nt, Homo sapiens
gcaaaagucauu

SEQ ID NO: 875533 - RNA, 16 nt, Homo sapiens
gcaaaagucauuacac

SEQ ID NO: 875534 - RNA, 15 nt, Homo sapiens
gcaaacacuguguau

SEQ ID NO: 875535 - RNA, 17 nt, Homo sapiens
gcaaacaguucuuggac

SEQ ID NO: 875536 - RNA, 17 nt, Homo sapiens
gcaaagaaaagccagag

SEQ ID NO: 875537 - RNA, 16 nt, Homo sapiens
gcaaagcugugcacuu

SEQ ID NO: 875538 - RNA, 22 nt, Homo sapiens
gcaaagucuaaaguuuacagua

SEQ ID NO: 875539 - RNA, 19 nt, Homo sapiens
gcaaaguucccuacuuccu

SEQ ID NO: 875540 - RNA, 18 nt, Homo sapiens
gcaaauaaagaccugaga

SEQ ID NO: 875541 - RNA, 15 nt, Homo sapiens
gcaaaugacaugcac

SEQ ID NO: 875542 - RNA, 14 nt, Homo sapiens
gcaaaugaguauuu

SEQ ID NO: 875543 - RNA, 19 nt, Homo sapiens
gcaaaugccuccaagccau

SEQ ID NO: 875544 - RNA, 17 nt, Homo sapiens
gcaaauuuugcauuuag

SEQ ID NO: 875545 - RNA, 20 nt, Homo sapiens
gcaacaaugagcagaccaac

SEQ ID NO: 875546 - RNA, 19 nt, Homo sapiens
gcaacaccuccuugcuuug

SEQ ID NO: 875547 - RNA, 24 nt, Homo sapiens
gcaacagauggauagucuguccaa

SEQ ID NO: 875548 - RNA, 12 nt, Homo sapiens
gcaacaguuuuu

SEQ ID NO: 875549 - RNA, 17 nt, Homo sapiens
gcaaccacacaccucac

SEQ ID NO: 875550 - RNA, 20 nt, Homo sapiens
gcaaccagaggaaacuugca

SEQ ID NO: 875551 - RNA, 22 nt, Homo sapiens
gcaaccaggauugacaggccau

SEQ ID NO: 875552 - RNA, 20 nt, Homo sapiens
gcaacccaccaucuacccac

SEQ ID NO: 875553 - RNA, 13 nt, Homo sapiens
gcaaccccaguuc

SEQ ID NO: 875554 - RNA, 16 nt, Homo sapiens
gcaacccucacugugu

SEQ ID NO: 875555 - RNA, 19 nt, Homo sapiens
gcaaccucccaacccagag

SEQ ID NO: 875556 - RNA, 23 nt, Homo sapiens
gcaaccuuuuugauuucuuccag

SEQ ID NO: 875557 - RNA, 23 nt, Homo sapiens
gcaacgcaggcccccaggugcca

SEQ ID NO: 875558 - RNA, 18 nt, Homo sapiens
gcaacucuauagacuuuu

SEQ ID NO: 875559 - RNA, 23 nt, Homo sapiens
gcaacuuaagcugggauaaucac

SEQ ID NO: 875560 - RNA, 15 nt, Homo sapiens
gcaacuugcuucuaa

SEQ ID NO: 875561 - RNA, 16 nt, Homo sapiens
gcaagaaggaaggagg

SEQ ID NO: 875562 - RNA, 17 nt, Homo sapiens
gcaagacuguugcucaa

SEQ ID NO: 875563 - RNA, 18 nt, Homo sapiens
gcaagacuucucuuugcc

SEQ ID NO: 875564 - RNA, 18 nt, Homo sapiens
gcaagagaaaauaaacca

SEQ ID NO: 875565 - RNA, 16 nt, Homo sapiens
gcaagaguggacugaa

SEQ ID NO: 875566 - RNA, 22 nt, Homo sapiens
gcaagccuugcuagacagccag

SEQ ID NO: 875567 - RNA, 15 nt, Homo sapiens
gcaagcuauucaaug

SEQ ID NO: 875568 - RNA, 14 nt, Homo sapiens
gcaaggaagggugg

SEQ ID NO: 875569 - RNA, 22 nt, Homo sapiens
gcaaggacugcagggacugcca

SEQ ID NO: 875570 - RNA, 22 nt, Homo sapiens
gcaagggcugugcugaggucac

SEQ ID NO: 875571 - RNA, 14 nt, Homo sapiens
gcaaggugugaaug

SEQ ID NO: 875572 - RNA, 14 nt, Homo sapiens
gcaagucuugucag

SEQ ID NO: 875573 - RNA, 12 nt, Homo sapiens
gcaagugauauc

SEQ ID NO: 875574 - RNA, 15 nt, Homo sapiens
gcaaguggcuuucaa

SEQ ID NO: 875575 - RNA, 14 nt, Homo sapiens
gcaaguucagggaa

SEQ ID NO: 875576 - RNA, 21 nt, Homo sapiens
gcaauaaaugcccucucugaa

SEQ ID NO: 875577 - RNA, 21 nt, Homo sapiens
gcaauagggugcaguuuucca

SEQ ID NO: 875578 - RNA, 16 nt, Homo sapiens
gcaaucacugaucuca

SEQ ID NO: 875579 - RNA, 18 nt, Homo sapiens
gcaaugucccuugcacag

SEQ ID NO: 875580 - RNA, 13 nt, Homo sapiens
gcaauucauccca

SEQ ID NO: 875581 - RNA, 17 nt, Homo sapiens
gcaauucuccugccuca

SEQ ID NO: 875582 - RNA, 17 nt, Homo sapiens
gcaauuuucgaacauuc

SEQ ID NO: 875583 - RNA, 17 nt, Homo sapiens
gcaauuuugcauuugaa

SEQ ID NO: 875584 - RNA, 23 nt, Homo sapiens
gcaauuuuuuuauacuaccaagu

SEQ ID NO: 875585 - RNA, 19 nt, Homo sapiens
gcacaaaccuuacuaugga

SEQ ID NO: 875586 - RNA, 15 nt, Homo sapiens
gcacaaauuguacau

SEQ ID NO: 875587 - RNA, 16 nt, Homo sapiens
gcacacacacaccaau

SEQ ID NO: 875588 - RNA, 20 nt, Homo sapiens
gcacacacacggaugcacac

SEQ ID NO: 875589 - RNA, 12 nt, Homo sapiens
gcacacacagau

SEQ ID NO: 875590 - RNA, 22 nt, Homo sapiens
gcacacacagauauacacaugg

SEQ ID NO: 875591 - RNA, 22 nt, Homo sapiens
gcacacacagauaugcacacac

SEQ ID NO: 875592 - RNA, 19 nt, Homo sapiens
gcacacggaugcacagaga

SEQ ID NO: 875593 - RNA, 21 nt, Homo sapiens
gcacacuagccucuccaggaa

SEQ ID NO: 875594 - RNA, 18 nt, Homo sapiens
gcacagaaggaaucugug

SEQ ID NO: 875595 - RNA, 22 nt, Homo sapiens
ucuuguuguggaggcugaaaag

SEQ ID NO: 875596 - RNA, 22 nt, Homo sapiens
ucuuguuucaauuccaccugca

SEQ ID NO: 875597 - RNA, 17 nt, Homo sapiens
ucuuuaaaauaaggaua

SEQ ID NO: 875598 - RNA, 14 nt, Homo sapiens
ucuuuaaaucaaaa

SEQ ID NO: 875599 - RNA, 18 nt, Homo sapiens
ucuuuaaauuucaucuca

SEQ ID NO: 875600 - RNA, 16 nt, Homo sapiens
ucuuuaaccucaucua

SEQ ID NO: 875601 - RNA, 13 nt, Homo sapiens
ucuuuaaguauug

SEQ ID NO: 875602 - RNA, 17 nt, Homo sapiens
ucuuuaaugucacaggc

SEQ ID NO: 875603 - RNA, 21 nt, Homo sapiens
ucuuuaauguuguccaggaaa

SEQ ID NO: 875604 - RNA, 20 nt, Homo sapiens
ucuuuaauuuguuaucucaa

SEQ ID NO: 875605 - RNA, 17 nt, Homo sapiens
ucuuuacaauaaacaua

SEQ ID NO: 875606 - RNA, 16 nt, Homo sapiens
ucuuuaguucugucag

SEQ ID NO: 875607 - RNA, 22 nt, Homo sapiens
ucuuuauucuuagggcagucag

SEQ ID NO: 875608 - RNA, 18 nt, Homo sapiens
ucuuucccagaugcccca

SEQ ID NO: 875609 - RNA, 12 nt, Homo sapiens
ucuuuccuccaa

SEQ ID NO: 875610 - RNA, 14 nt, Homo sapiens
ucuuuccuugucuc

SEQ ID NO: 875611 - RNA, 22 nt, Homo sapiens
ucuuucuaacuccagugaagua

SEQ ID NO: 875612 - RNA, 18 nt, Homo sapiens
ucuuucuaaugugugaau

SEQ ID NO: 875613 - RNA, 14 nt, Homo sapiens
ucuuucugauaaca

SEQ ID NO: 875614 - RNA, 20 nt, Homo sapiens
ucuuugcagacaggcaagca

SEQ ID NO: 875615 - RNA, 17 nt, Homo sapiens
ucuuuggggucagccag

SEQ ID NO: 875616 - RNA, 21 nt, Homo sapiens
ucuuuguaaugucaccaccuu

SEQ ID NO: 875617 - RNA, 13 nt, Homo sapiens
ucuuuuuccuccc

SEQ ID NO: 875618 - RNA, 14 nt, Homo sapiens
ucuuuuucugucuc

SEQ ID NO: 875619 - RNA, 19 nt, Homo sapiens
ugaaaaacagaaagcaucc

SEQ ID NO: 875620 - RNA, 16 nt, Homo sapiens
ugaaaaauaugugcuu

SEQ ID NO: 875621 - RNA, 22 nt, Homo sapiens
ugaaaaaugguaauuguugcua

SEQ ID NO: 875622 - RNA, 22 nt, Homo sapiens
ugaaaaauucucagucaguaau

SEQ ID NO: 875623 - RNA, 17 nt, Homo sapiens
ugaaaacauaaucugca

SEQ ID NO: 875624 - RNA, 22 nt, Homo sapiens
ugaaaacucacagaacuaugua

SEQ ID NO: 875625 - RNA, 17 nt, Homo sapiens
ugaaaaggaaguuaaua

SEQ ID NO: 875626 - RNA, 17 nt, Homo sapiens
ugaaaauauuuguauca

SEQ ID NO: 875627 - RNA, 14 nt, Homo sapiens
ugaaaaucacuaua

SEQ ID NO: 875628 - RNA, 14 nt, Homo sapiens
ugaaaaucuaauau

SEQ ID NO: 875629 - RNA, 16 nt, Homo sapiens
ugaaaauuaacacugc

SEQ ID NO: 875630 - RNA, 16 nt, Homo sapiens
ugaaacacacaggcca

SEQ ID NO: 875631 - RNA, 17 nt, Homo sapiens
ugaccgagaacuuuuaa

SEQ ID NO: 875632 - RNA, 19 nt, Homo sapiens
ugaccuaaccuaagcaaaa

SEQ ID NO: 875633 - RNA, 18 nt, Homo sapiens
ugaccuaugaugaaguca

SEQ ID NO: 875634 - RNA, 14 nt, Homo sapiens
ugaccucaggugau

SEQ ID NO: 875635 - RNA, 21 nt, Homo sapiens
ugaccugucaccgugagcagc

SEQ ID NO: 875636 - RNA, 15 nt, Homo sapiens
ugaccuguguucccu

SEQ ID NO: 875637 - RNA, 18 nt, Homo sapiens
ugaccuuggagagacaca

SEQ ID NO: 875638 - RNA, 16 nt, Homo sapiens
ugacuaccagcuaacu

SEQ ID NO: 875639 - RNA, 15 nt, Homo sapiens
ugacuaucacauaca

SEQ ID NO: 875640 - RNA, 13 nt, Homo sapiens
ugacucaccuguu

SEQ ID NO: 875641 - RNA, 18 nt, Homo sapiens
ugacucagcauaccugcu

SEQ ID NO: 875642 - RNA, 21 nt, Homo sapiens
ugacucaugaacuauuuacau

SEQ ID NO: 875643 - RNA, 13 nt, Homo sapiens
ugacuccaagaac

SEQ ID NO: 875644 - RNA, 19 nt, Homo sapiens
ugacuccucuaagccacuc

SEQ ID NO: 875645 - RNA, 17 nt, Homo sapiens
ugacucuaccugcaaga

SEQ ID NO: 875646 - RNA, 15 nt, Homo sapiens
ugacugaaacauuca

SEQ ID NO: 875647 - RNA, 17 nt, Homo sapiens
ugacugaacugcacguu

SEQ ID NO: 875648 - RNA, 21 nt, Homo sapiens
ugacugaauuugggccucuug

SEQ ID NO: 875649 - RNA, 18 nt, Homo sapiens
ugacugauguuacaucac

SEQ ID NO: 875650 - RNA, 21 nt, Homo sapiens
ugacuggcacccaauguuuga

SEQ ID NO: 875651 - RNA, 14 nt, Homo sapiens
ugacuucacagcag

SEQ ID NO: 875652 - RNA, 20 nt, Homo sapiens
ugacuucacagcagccacuu

SEQ ID NO: 875653 - RNA, 17 nt, Homo sapiens
ugacuuuuucagaguug

SEQ ID NO: 875654 - RNA, 15 nt, Homo sapiens
ugagaaacugauuua

SEQ ID NO: 875655 - RNA, 22 nt, Homo sapiens
ugagaaacuuugaucucugcuu

SEQ ID NO: 875656 - RNA, 12 nt, Homo sapiens
ugagaaagccuu

SEQ ID NO: 875657 - RNA, 18 nt, Homo sapiens
ugagaaauuuaaacuaua

SEQ ID NO: 875658 - RNA, 12 nt, Homo sapiens
ugagaaccugug

SEQ ID NO: 875659 - RNA, 18 nt, Homo sapiens
ugagaagcugggcaugaa

SEQ ID NO: 875660 - RNA, 16 nt, Homo sapiens
ugagaauaauugugua

SEQ ID NO: 875661 - RNA, 17 nt, Homo sapiens
ugagacggagucuugcu

SEQ ID NO: 875662 - RNA, 22 nt, Homo sapiens
ugagacuauaaagcaguagaca

SEQ ID NO: 875663 - RNA, 17 nt, Homo sapiens
ugagacucugucucaaa

SEQ ID NO: 875664 - RNA, 13 nt, Homo sapiens
ugagacuggaaau

SEQ ID NO: 875665 - RNA, 20 nt, Homo sapiens
ugagaggaagggugggucug

SEQ ID NO: 875666 - RNA, 17 nt, Homo sapiens
ugagaggguuugaguca

SEQ ID NO: 875667 - RNA, 18 nt, Homo sapiens
ugagauaaccacaaccag

SEQ ID NO: 875668 - RNA, 19 nt, Homo sapiens
ugagaucuccacggucaga

SEQ ID NO: 875669 - RNA, 23 nt, Homo sapiens
ugagauguagccuggcccuggaa

SEQ ID NO: 875670 - RNA, 14 nt, Homo sapiens
ugagauguguucag

SEQ ID NO: 875671 - RNA, 14 nt, Homo sapiens
ugagauugccccua

SEQ ID NO: 875672 - RNA, 20 nt, Homo sapiens
ugagauuuaccagggaugua

SEQ ID NO: 875673 - RNA, 14 nt, Homo sapiens
ugagcaccuacuua

SEQ ID NO: 875674 - RNA, 23 nt, Homo sapiens
ugagcaccuacuuacaugcauua

SEQ ID NO: 875675 - RNA, 14 nt, Homo sapiens
ugagcacugccagg

SEQ ID NO: 875676 - RNA, 17 nt, Homo sapiens
ugagcaguagaagccug

SEQ ID NO: 875677 - RNA, 16 nt, Homo sapiens
ugagcauuagcuacuu

SEQ ID NO: 875678 - RNA, 14 nt, Homo sapiens
ugagccacagacca

SEQ ID NO: 875679 - RNA, 21 nt, Homo sapiens
ugagccuggcccauagaaaca

SEQ ID NO: 875680 - RNA, 17 nt, Homo sapiens
ugagccugucacguggu

SEQ ID NO: 875681 - RNA, 13 nt, Homo sapiens
ugagcgcuguguu

SEQ ID NO: 875682 - RNA, 18 nt, Homo sapiens
ugagcuagugauuugccu

SEQ ID NO: 875683 - RNA, 17 nt, Homo sapiens
ugagcucccccuuccca

SEQ ID NO: 875684 - RNA, 19 nt, Homo sapiens
ugagcugcccccaaaucaa

SEQ ID NO: 875685 - RNA, 17 nt, Homo sapiens
ugaggaauauuugcaag

SEQ ID NO: 875686 - RNA, 20 nt, Homo sapiens
ugaggagagaaggacaugug

SEQ ID NO: 875687 - RNA, 15 nt, Homo sapiens
ugaggcaaaggccag

SEQ ID NO: 875688 - RNA, 17 nt, Homo sapiens
ugaggcaggaggaucac

SEQ ID NO: 875689 - RNA, 20 nt, Homo sapiens
ugaggcaugagaaucacuug

SEQ ID NO: 875690 - RNA, 17 nt, Homo sapiens
ugaggcauuuuuacuac

SEQ ID NO: 875691 - RNA, 20 nt, Homo sapiens
ugaggcauuuuuacuacuau

SEQ ID NO: 875692 - RNA, 14 nt, Homo sapiens
ugaggcugcagcga

SEQ ID NO: 875693 - RNA, 15 nt, Homo sapiens
ugaggcuuccaggcu

SEQ ID NO: 875694 - RNA, 15 nt, Homo sapiens
ugagggaaaaugagu

SEQ ID NO: 875695 - RNA, 18 nt, Homo sapiens
ugagggaaauugcuauuu

SEQ ID NO: 875696 - RNA, 12 nt, Homo sapiens
ugagggcucacu

SEQ ID NO: 875697 - RNA, 21 nt, Homo sapiens
ugaggggaauagauuaccuga

SEQ ID NO: 875698 - RNA, 22 nt, Homo sapiens
ugagguggagucucauucuguu

SEQ ID NO: 875699 - RNA, 15 nt, Homo sapiens
ugagguggugccuuc

SEQ ID NO: 875700 - RNA, 21 nt, Homo sapiens
ugagguuaaaauauaaauuaa

SEQ ID NO: 875701 - RNA, 23 nt, Homo sapiens
ugagucaaaagccugggugagaa

SEQ ID NO: 875702 - RNA, 17 nt, Homo sapiens
ugagucagacauuuggu

SEQ ID NO: 875703 - RNA, 14 nt, Homo sapiens
ugagucaugaucuc

SEQ ID NO: 875704 - RNA, 23 nt, Homo sapiens
ugagucugggcaaugaaaccaaa

SEQ ID NO: 875705 - RNA, 21 nt, Homo sapiens
ugagugacaugggugugccag

SEQ ID NO: 875706 - RNA, 18 nt, Homo sapiens
ugagugcuugucauggaa

SEQ ID NO: 875707 - RNA, 22 nt, Homo sapiens
ugaguggcugaaauaaaagccu

SEQ ID NO: 875708 - RNA, 15 nt, Homo sapiens
ugagugugacuaugu

SEQ ID NO: 875709 - RNA, 12 nt, Homo sapiens
ugaguuacuuga

SEQ ID NO: 875710 - RNA, 22 nt, Homo sapiens
gcaucaugccucugaggccagc

SEQ ID NO: 875711 - RNA, 22 nt, Homo sapiens
gcaucauuauuugcagagacag

SEQ ID NO: 875712 - RNA, 18 nt, Homo sapiens
gcauccagccuguguguu

SEQ ID NO: 875713 - RNA, 22 nt, Homo sapiens
gcauccaucugggcuaccccac

SEQ ID NO: 875714 - RNA, 14 nt, Homo sapiens
gcauccuggccaac

SEQ ID NO: 875715 - RNA, 20 nt, Homo sapiens
gcauccuggccaacauggug

SEQ ID NO: 875716 - RNA, 17 nt, Homo sapiens
gcaucguggugugucaa

SEQ ID NO: 875717 - RNA, 14 nt, Homo sapiens
gcaucucuguguac

SEQ ID NO: 875718 - RNA, 14 nt, Homo sapiens
gcaucugacucaca

SEQ ID NO: 875719 - RNA, 18 nt, Homo sapiens
gcaucugccucuauucaa

SEQ ID NO: 875720 - RNA, 17 nt, Homo sapiens
gcaugaacuguccuucc

SEQ ID NO: 875721 - RNA, 13 nt, Homo sapiens
gcaugacacucua

SEQ ID NO: 875722 - RNA, 14 nt, Homo sapiens
gcaugaccugauca

SEQ ID NO: 875723 - RNA, 18 nt, Homo sapiens
gcaugauugugaccucca

SEQ ID NO: 875724 - RNA, 19 nt, Homo sapiens
gcaugauuuuauacauagu

SEQ ID NO: 875725 - RNA, 22 nt, Homo sapiens
gcaugccuccaaaaauucacau

SEQ ID NO: 875726 - RNA, 15 nt, Homo sapiens
gcaugcgcaggcuca

SEQ ID NO: 875727 - RNA, 13 nt, Homo sapiens
gcaugcucuggaa

SEQ ID NO: 875728 - RNA, 18 nt, Homo sapiens
gcauggaacagugcagga

SEQ ID NO: 875729 - RNA, 21 nt, Homo sapiens
gcauggacaccccuuauccag

SEQ ID NO: 875730 - RNA, 20 nt, Homo sapiens
gcauggacucuggguuucau

SEQ ID NO: 875731 - RNA, 13 nt, Homo sapiens
gcauggugcaguu

SEQ ID NO: 875732 - RNA, 22 nt, Homo sapiens
gcaugguuugauuuugaccugg

SEQ ID NO: 875733 - RNA, 16 nt, Homo sapiens
gcauguaugugcacau

SEQ ID NO: 875734 - RNA, 22 nt, Homo sapiens
gcauguuuugcccaccagauca

SEQ ID NO: 875735 - RNA, 15 nt, Homo sapiens
gcauuaaagugcugu

SEQ ID NO: 875736 - RNA, 19 nt, Homo sapiens
gcauuacugggaagacaau

SEQ ID NO: 875737 - RNA, 13 nt, Homo sapiens
gcauuagcuacuu

SEQ ID NO: 875738 - RNA, 14 nt, Homo sapiens
gcauucacaucuca

SEQ ID NO: 875739 - RNA, 21 nt, Homo sapiens
gcauuccaccacacauggcua

SEQ ID NO: 875740 - RNA, 20 nt, Homo sapiens
gcauuccagccccuauguua

SEQ ID NO: 875741 - RNA, 12 nt, Homo sapiens
gcauuccaugau

SEQ ID NO: 875742 - RNA, 18 nt, Homo sapiens
gcauuccugagucuucca

SEQ ID NO: 875743 - RNA, 15 nt, Homo sapiens
gcauugaagugucga

SEQ ID NO: 875744 - RNA, 12 nt, Homo sapiens
gcauuucuuauu

SEQ ID NO: 875745 - RNA, 16 nt, Homo sapiens
gcauuugauuuugccc

SEQ ID NO: 875746 - RNA, 19 nt, Homo sapiens
gccuaugcacauauggacu

SEQ ID NO: 875747 - RNA, 19 nt, Homo sapiens
gccucaaugugaccagggg

SEQ ID NO: 875748 - RNA, 19 nt, Homo sapiens
gccucacacccagagggua

SEQ ID NO: 875749 - RNA, 15 nt, Homo sapiens
gccucaucuccuuua

SEQ ID NO: 875750 - RNA, 17 nt, Homo sapiens
gccucccaaagugcugg

SEQ ID NO: 875751 - RNA, 20 nt, Homo sapiens
gccucccaaggaaaauggac

SEQ ID NO: 875752 - RNA, 21 nt, Homo sapiens
gccucccccucagaugaucuc

SEQ ID NO: 875753 - RNA, 15 nt, Homo sapiens
gccucgcuacaagaa

SEQ ID NO: 875754 - RNA, 9 nt, Homo sapiens
gccucggga

SEQ ID NO: 875755 - RNA, 20 nt, Homo sapiens
gccucgguggccaugcuucu

SEQ ID NO: 875756 - RNA, 18 nt, Homo sapiens
gccucguaccagccagga

SEQ ID NO: 875757 - RNA, 16 nt, Homo sapiens
gccucuccagcacuuc

SEQ ID NO: 875758 - RNA, 19 nt, Homo sapiens
gccucuccccaaacauuaa

SEQ ID NO: 875759 - RNA, 22 nt, Homo sapiens
gccucuccugcugcugaccuga

SEQ ID NO: 875760 - RNA, 16 nt, Homo sapiens
gccucugaaaugccuc

SEQ ID NO: 875761 - RNA, 15 nt, Homo sapiens
gccucugccaugccc

SEQ ID NO: 875762 - RNA, 22 nt, Homo sapiens
gccucuuccgugacgucacugg

SEQ ID NO: 875763 - RNA, 14 nt, Homo sapiens
gccugaaagcaaga

SEQ ID NO: 875764 - RNA, 12 nt, Homo sapiens
gccugaaccugg

SEQ ID NO: 875765 - RNA, 22 nt, Homo sapiens
gccugaaugucuuacugugauc

SEQ ID NO: 875766 - RNA, 18 nt, Homo sapiens
gccugacuguguucagug

SEQ ID NO: 875767 - RNA, 13 nt, Homo sapiens
gccugagacaccc

SEQ ID NO: 875768 - RNA, 17 nt, Homo sapiens
gccugagcuggggccac

SEQ ID NO: 875769 - RNA, 22 nt, Homo sapiens
gccugaugggguggaaggcaug

SEQ ID NO: 875770 - RNA, 14 nt, Homo sapiens
gccugcagacucac

SEQ ID NO: 875771 - RNA, 14 nt, Homo sapiens
gccugccucugcca

SEQ ID NO: 875772 - RNA, 19 nt, Homo sapiens
gccugcuaauagcugcuag

SEQ ID NO: 875773 - RNA, 18 nt, Homo sapiens
gccugcugcugagaaccu

SEQ ID NO: 875774 - RNA, 20 nt, Homo sapiens
gccuggcagccgugccuuca

SEQ ID NO: 875775 - RNA, 15 nt, Homo sapiens
gccuggcccuggaac

SEQ ID NO: 875776 - RNA, 16 nt, Homo sapiens
gccuggccuccugccu

SEQ ID NO: 875777 - RNA, 20 nt, Homo sapiens
gccuggccuccugccucuac

SEQ ID NO: 875778 - RNA, 16 nt, Homo sapiens
gccuggcuccccacga

SEQ ID NO: 875779 - RNA, 14 nt, Homo sapiens
gccugggacccagc

SEQ ID NO: 875780 - RNA, 16 nt, Homo sapiens
gccugggcaacaaagu

SEQ ID NO: 875781 - RNA, 16 nt, Homo sapiens
gccuggggcaucccag

SEQ ID NO: 875782 - RNA, 22 nt, Homo sapiens
gccugggucaagggccagucag

SEQ ID NO: 875783 - RNA, 17 nt, Homo sapiens
gccugguagaauuggga

SEQ ID NO: 875784 - RNA, 20 nt, Homo sapiens
gccuguaaucccagcacuuu

SEQ ID NO: 875785 - RNA, 16 nt, Homo sapiens
gccugucacgugguca

SEQ ID NO: 875786 - RNA, 13 nt, Homo sapiens
gccuguguagcug

SEQ ID NO: 875787 - RNA, 18 nt, Homo sapiens
gccuguguuuguguggau

SEQ ID NO: 875788 - RNA, 13 nt, Homo sapiens
gccuguugcugaa

SEQ ID NO: 875789 - RNA, 19 nt, Homo sapiens
gccuuaaguaauguuaauu

SEQ ID NO: 875790 - RNA, 21 nt, Homo sapiens
gccuuaggaaaagcauuugcu

SEQ ID NO: 875791 - RNA, 15 nt, Homo sapiens
gccuucacuuuacaa

SEQ ID NO: 875792 - RNA, 20 nt, Homo sapiens
gccuucauaagccuaccaau

SEQ ID NO: 875793 - RNA, 18 nt, Homo sapiens
gccuucucuguucauuuc

SEQ ID NO: 875794 - RNA, 22 nt, Homo sapiens
gccuucucuguucauuuccuca

SEQ ID NO: 875795 - RNA, 16 nt, Homo sapiens
gccuugacaacagacu

SEQ ID NO: 875796 - RNA, 18 nt, Homo sapiens
gccuuuagaugugagcuu

SEQ ID NO: 875797 - RNA, 21 nt, Homo sapiens
gccuuuaguuuuaacaguuca

SEQ ID NO: 875798 - RNA, 16 nt, Homo sapiens
gccuuuccccagugug

SEQ ID NO: 875799 - RNA, 14 nt, Homo sapiens
gccuuucuccucca

SEQ ID NO: 875800 - RNA, 20 nt, Homo sapiens
gccuuucucuggcuccagaa

SEQ ID NO: 875801 - RNA, 14 nt, Homo sapiens
gccuuugaggcaaa

SEQ ID NO: 875802 - RNA, 22 nt, Homo sapiens
gccuuuugcucacaaaaccugg

SEQ ID NO: 875803 - RNA, 19 nt, Homo sapiens
gccuuuuguggauugacag

SEQ ID NO: 875804 - RNA, 17 nt, Homo sapiens
gcgaccccucagugcuc

SEQ ID NO: 875805 - RNA, 23 nt, Homo sapiens
gcgaccgccgcagggacggggac

SEQ ID NO: 875806 - RNA, 13 nt, Homo sapiens
gcgagacugagag

SEQ ID NO: 875807 - RNA, 13 nt, Homo sapiens
gcgagcacaccuu

SEQ ID NO: 875808 - RNA, 20 nt, Homo sapiens
gcgagcccugguggcagugg

SEQ ID NO: 875809 - RNA, 13 nt, Homo sapiens
gcgagguguaaag

SEQ ID NO: 875810 - RNA, 17 nt, Homo sapiens
gcgagucuuacuuugag

SEQ ID NO: 875811 - RNA, 20 nt, Homo sapiens
gcgcacacacagauaugcac

SEQ ID NO: 875812 - RNA, 16 nt, Homo sapiens
gcgcagcgcgugcaca

SEQ ID NO: 875813 - RNA, 14 nt, Homo sapiens
gcgcaucaggccug

SEQ ID NO: 875814 - RNA, 13 nt, Homo sapiens
gcgcaugugccag

SEQ ID NO: 875815 - RNA, 15 nt, Homo sapiens
gcgcaugugccaguu

SEQ ID NO: 875816 - RNA, 19 nt, Homo sapiens
gcgcccugcagacccugcc

SEQ ID NO: 875817 - RNA, 17 nt, Homo sapiens
gcgccuccuuccuugcu

SEQ ID NO: 875818 - RNA, 20 nt, Homo sapiens
gcgcugguggaccacaggca

SEQ ID NO: 875819 - RNA, 15 nt, Homo sapiens
gcggaaccauagcug

SEQ ID NO: 875820 - RNA, 16 nt, Homo sapiens
gcgggaggcaccagcu

SEQ ID NO: 875821 - RNA, 11 nt, Homo sapiens
gcgguggugcc

SEQ ID NO: 875822 - RNA, 22 nt, Homo sapiens
gcguacucagcacagcagugga

SEQ ID NO: 875823 - RNA, 19 nt, Homo sapiens
gcgugguggcgggcaccua

SEQ ID NO: 875824 - RNA, 18 nt, Homo sapiens
gcgugucccucucggaag

SEQ ID NO: 875825 - RNA, 18 nt, Homo sapiens
gcguuuggcccugugacu

SEQ ID NO: 875826 - RNA, 13 nt, Homo sapiens
ugcauauauacau

SEQ ID NO: 875827 - RNA, 14 nt, Homo sapiens
ugcauauauuuuag

SEQ ID NO: 875828 - RNA, 13 nt, Homo sapiens
ugcauauguauuu

SEQ ID NO: 875829 - RNA, 22 nt, Homo sapiens
ugcauauguauuuuguauuugc

SEQ ID NO: 875830 - RNA, 21 nt, Homo sapiens
ugcaucaagggcuuuaucaaa

SEQ ID NO: 875831 - RNA, 18 nt, Homo sapiens
ugcaucccccagcacuga

SEQ ID NO: 875832 - RNA, 17 nt, Homo sapiens
ugcaucuauauguguau

SEQ ID NO: 875833 - RNA, 19 nt, Homo sapiens
ugcaugaaucuguacccuu

SEQ ID NO: 875834 - RNA, 13 nt, Homo sapiens
ugcaugaccugau

SEQ ID NO: 875835 - RNA, 15 nt, Homo sapiens
ugcaugaccugauca

SEQ ID NO: 875836 - RNA, 15 nt, Homo sapiens
ugcauguugccauga

SEQ ID NO: 875837 - RNA, 15 nt, Homo sapiens
ugcauuccccgcugc

SEQ ID NO: 875838 - RNA, 18 nt, Homo sapiens
ugcauugcuaaaauauua

SEQ ID NO: 875839 - RNA, 14 nt, Homo sapiens
ugcauuguauuuag

SEQ ID NO: 875840 - RNA, 22 nt, Homo sapiens
ugcauuuauggucaacacuuaa

SEQ ID NO: 875841 - RNA, 14 nt, Homo sapiens
ugcauuugcacuau

SEQ ID NO: 875842 - RNA, 21 nt, Homo sapiens
ugcauuuucccagauacuucc

SEQ ID NO: 875843 - RNA, 14 nt, Homo sapiens
ugccaaaacaaugc

SEQ ID NO: 875844 - RNA, 13 nt, Homo sapiens
ugccaacauaccc

SEQ ID NO: 875845 - RNA, 17 nt, Homo sapiens
ugccaagccaccuucca

SEQ ID NO: 875846 - RNA, 24 nt, Homo sapiens
ugccaagcccucaauaagccagca

SEQ ID NO: 875847 - RNA, 19 nt, Homo sapiens
ugccaaggaugacacugcc

SEQ ID NO: 875848 - RNA, 11 nt, Homo sapiens
ugccacaaaga

SEQ ID NO: 875849 - RNA, 13 nt, Homo sapiens
ugccaccagucac

SEQ ID NO: 875850 - RNA, 12 nt, Homo sapiens
ugccagacaugu

SEQ ID NO: 875851 - RNA, 21 nt, Homo sapiens
ugccagagcccaagugccauc

SEQ ID NO: 875852 - RNA, 17 nt, Homo sapiens
ugccagaugcaauacaa

SEQ ID NO: 875853 - RNA, 11 nt, Homo sapiens
ugccagcagcu

SEQ ID NO: 875854 - RNA, 15 nt, Homo sapiens
ugccaggacaccugc

SEQ ID NO: 875855 - RNA, 23 nt, Homo sapiens
ugccauccuaggcuuaaaugcaa

SEQ ID NO: 875856 - RNA, 12 nt, Homo sapiens
ugccaugaucug

SEQ ID NO: 875857 - RNA, 15 nt, Homo sapiens
ugccaugccucaaga

SEQ ID NO: 875858 - RNA, 18 nt, Homo sapiens
ugccaugguuaccgagga

SEQ ID NO: 875859 - RNA, 15 nt, Homo sapiens
ugccauuuccugucu

SEQ ID NO: 875860 - RNA, 19 nt, Homo sapiens
ugcccacgcuggagugcag

SEQ ID NO: 875861 - RNA, 21 nt, Homo sapiens
uguuuacuucucaccauuuga

SEQ ID NO: 875862 - RNA, 15 nt, Homo sapiens
uguuuauacagcuca

SEQ ID NO: 875863 - RNA, 20 nt, Homo sapiens
uguuucagcccgaagcugcu

SEQ ID NO: 875864 - RNA, 17 nt, Homo sapiens
uguuucccgcuccaaga

SEQ ID NO: 875865 - RNA, 18 nt, Homo sapiens
uguuucuaaaacuauggu

SEQ ID NO: 875866 - RNA, 22 nt, Homo sapiens
uguuucuauauuggucauugcc

SEQ ID NO: 875867 - RNA, 14 nt, Homo sapiens
uguuucuauucuaa

SEQ ID NO: 875868 - RNA, 23 nt, Homo sapiens
uguuucugaaccauuacuguaau

SEQ ID NO: 875869 - RNA, 22 nt, Homo sapiens
uguuucuggggacaccagccau

SEQ ID NO: 875870 - RNA, 23 nt, Homo sapiens
uguuugaaugaguuuauauggaa

SEQ ID NO: 875871 - RNA, 17 nt, Homo sapiens
uguuugagcgcagagua

SEQ ID NO: 875872 - RNA, 14 nt, Homo sapiens
uguuugagguuaaa

SEQ ID NO: 875873 - RNA, 13 nt, Homo sapiens
uguuugcacuuug

SEQ ID NO: 875874 - RNA, 16 nt, Homo sapiens
uguuugggccacugcc

SEQ ID NO: 875875 - RNA, 17 nt, Homo sapiens
uguuugucagauaugau

SEQ ID NO: 875876 - RNA, 20 nt, Homo sapiens
uguuuuaauuuuugugauuu

SEQ ID NO: 875877 - RNA, 22 nt, Homo sapiens
uguuuuagcuccuugacuccuu

SEQ ID NO: 875878 - RNA, 21 nt, Homo sapiens
uguuuucuaaaguuguucaca

SEQ ID NO: 875879 - RNA, 20 nt, Homo sapiens
uguuuucuugccaaugaggu

SEQ ID NO: 875880 - RNA, 15 nt, Homo sapiens
uguuuugcacugaca

SEQ ID NO: 875881 - RNA, 13 nt, Homo sapiens
uguuuuuaagcug

SEQ ID NO: 875882 - RNA, 19 nt, Homo sapiens
uuaaaaaaaaauacugaug

SEQ ID NO: 875883 - RNA, 20 nt, Homo sapiens
uuaaaaaaaaauacugaugu

SEQ ID NO: 875884 - RNA, 19 nt, Homo sapiens
uuaaaaaauaaaaacugac

SEQ ID NO: 875885 - RNA, 23 nt, Homo sapiens
uuaaaaacuaaaaagccaucuga

SEQ ID NO: 875886 - RNA, 19 nt, Homo sapiens
uuaaaaagauguauguucc

SEQ ID NO: 875887 - RNA, 20 nt, Homo sapiens
uuaaaacaacacucacauuu

SEQ ID NO: 875888 - RNA, 22 nt, Homo sapiens
uuaaaacaacacucacauuuau

SEQ ID NO: 875889 - RNA, 19 nt, Homo sapiens
uuaaaacacagcuuuacaa

SEQ ID NO: 875890 - RNA, 17 nt, Homo sapiens
uuaaaagaagacuggaa

SEQ ID NO: 875891 - RNA, 16 nt, Homo sapiens
uuaaaaucauucaaua

SEQ ID NO: 875892 - RNA, 12 nt, Homo sapiens
uuaaaaugauug

SEQ ID NO: 875893 - RNA, 20 nt, Homo sapiens
uuaaaauguacacuggauau

SEQ ID NO: 875894 - RNA, 21 nt, Homo sapiens
uuaaacaaaauagaagcugua

SEQ ID NO: 875895 - RNA, 19 nt, Homo sapiens
uuaaacauaggaaagaaga

SEQ ID NO: 875896 - RNA, 13 nt, Homo sapiens
uuaaacaugagaa

SEQ ID NO: 875897 - RNA, 24 nt, Homo sapiens
uuaaacauuugagagcuaacuaua

SEQ ID NO: 875898 - RNA, 21 nt, Homo sapiens
uuaaacccugccccacuucuc

SEQ ID NO: 875899 - RNA, 15 nt, Homo sapiens
uuaaacccuuaccaa

SEQ ID NO: 875900 - RNA, 18 nt, Homo sapiens
uuaaacuauaagcaagaa

SEQ ID NO: 875901 - RNA, 21 nt, Homo sapiens
uuaaagaaguaaauuugucca

SEQ ID NO: 875902 - RNA, 16 nt, Homo sapiens
uuaaaggcuuuuggca

SEQ ID NO: 875903 - RNA, 13 nt, Homo sapiens
uuaaaguaccugu

SEQ ID NO: 875904 - RNA, 21 nt, Homo sapiens
uuaaauauuaugugaaaucaa

SEQ ID NO: 875905 - RNA, 18 nt, Homo sapiens
uuaaaugcaauauuccug

SEQ ID NO: 875906 - RNA, 15 nt, Homo sapiens
uuaaaugcauguccu

SEQ ID NO: 875907 - RNA, 17 nt, Homo sapiens
uuaaaugcauguccuca

SEQ ID NO: 875908 - RNA, 19 nt, Homo sapiens
uuaaaugcauguccucaaa

SEQ ID NO: 875909 - RNA, 20 nt, Homo sapiens
uuaaaugcauguccucaaaa

SEQ ID NO: 875910 - RNA, 16 nt, Homo sapiens
uuaaauuaauauugau

SEQ ID NO: 875911 - RNA, 22 nt, Homo sapiens
uuaaauucugaacaauucucuc

SEQ ID NO: 875912 - RNA, 20 nt, Homo sapiens
uuaacaucuugaacugguug

SEQ ID NO: 875913 - RNA, 14 nt, Homo sapiens
uuaacgucaucuca

SEQ ID NO: 875914 - RNA, 10 nt, Homo sapiens
uuaacuauug

SEQ ID NO: 875915 - RNA, 21 nt, Homo sapiens
uuaacugguauauacauauau

SEQ ID NO: 875916 - RNA, 14 nt, Homo sapiens
uuaagaaacacagg

SEQ ID NO: 875917 - RNA, 13 nt, Homo sapiens
uuaagacuuuaaa

SEQ ID NO: 875918 - RNA, 14 nt, Homo sapiens
uuaagagauacauu

SEQ ID NO: 875919 - RNA, 17 nt, Homo sapiens
uuaagagauacauuccc

SEQ ID NO: 875920 - RNA, 18 nt, Homo sapiens
uuaagauaguuuugccag

SEQ ID NO: 875921 - RNA, 14 nt, Homo sapiens
uuaagcaacacaag

SEQ ID NO: 875922 - RNA, 23 nt, Homo sapiens
uuaagcugggauaaucacauuau

SEQ ID NO: 875923 - RNA, 18 nt, Homo sapiens
uuaaggagguagcuccca

SEQ ID NO: 875924 - RNA, 16 nt, Homo sapiens
uuaagggaaggaacuc

SEQ ID NO: 875925 - RNA, 23 nt, Homo sapiens
uuaagguguugguguauuugcca

SEQ ID NO: 875926 - RNA, 20 nt, Homo sapiens
uuaagucauccacagcccaa

SEQ ID NO: 875927 - RNA, 15 nt, Homo sapiens
uuaauacucaccucc

SEQ ID NO: 875928 - RNA, 12 nt, Homo sapiens
uuaauauguuca

SEQ ID NO: 875929 - RNA, 14 nt, Homo sapiens
uuaaucaugagaua

SEQ ID NO: 875930 - RNA, 17 nt, Homo sapiens
uuaaugacaaggugaua

SEQ ID NO: 875931 - RNA, 12 nt, Homo sapiens
uuaaugagauag

SEQ ID NO: 875932 - RNA, 14 nt, Homo sapiens
uuaauggcacugau

SEQ ID NO: 875933 - RNA, 18 nt, Homo sapiens
uuaauggugccuucauuu

SEQ ID NO: 875934 - RNA, 13 nt, Homo sapiens
uuaauguacaagu

SEQ ID NO: 875935 - RNA, 21 nt, Homo sapiens
uuaauguauuuguuugcaauu

SEQ ID NO: 875936 - RNA, 18 nt, Homo sapiens
uuaauuagauuuucuugc

SEQ ID NO: 875937 - RNA, 13 nt, Homo sapiens
uuaauuauauagu

SEQ ID NO: 875938 - RNA, 19 nt, Homo sapiens
uuaauuccaauaugaugac

SEQ ID NO: 875939 - RNA, 14 nt, Homo sapiens
uuaauugcauuuaa

SEQ ID NO: 875940 - RNA, 15 nt, Homo sapiens
uuaauuuucaguaua

SEQ ID NO: 875941 - RNA, 13 nt, Homo sapiens
uuaauuuuugcaa

SEQ ID NO: 875942 - RNA, 16 nt, Homo sapiens
uuacaaaaacaagaca

SEQ ID NO: 875943 - RNA, 12 nt, Homo sapiens
uuacacauguau

SEQ ID NO: 875944 - RNA, 18 nt, Homo sapiens
uuacagagaaaagacaua

SEQ ID NO: 875945 - RNA, 13 nt, Homo sapiens
gguugcagugagc

SEQ ID NO: 875946 - RNA, 15 nt, Homo sapiens
gguugccugggccac

SEQ ID NO: 875947 - RNA, 22 nt, Homo sapiens
gguugcuguauuuguucaguga

SEQ ID NO: 875948 - RNA, 22 nt, Homo sapiens
gguugugcccuccaccuaccug

SEQ ID NO: 875949 - RNA, 12 nt, Homo sapiens
gguuuacugcug

SEQ ID NO: 875950 - RNA, 19 nt, Homo sapiens
gguuuguguuugaguuuua

SEQ ID NO: 875951 - RNA, 17 nt, Homo sapiens
gguuuguugcagccaaa

SEQ ID NO: 875952 - RNA, 21 nt, Homo sapiens
gguuuugucucugcaucucau

SEQ ID NO: 875953 - RNA, 13 nt, Homo sapiens
gguuuuuucacau

SEQ ID NO: 875954 - RNA, 14 nt, Homo sapiens
guaaaaaaauauga

SEQ ID NO: 875955 - RNA, 21 nt, Homo sapiens
guaaaacuauauucucagugu

SEQ ID NO: 875956 - RNA, 23 nt, Homo sapiens
guaaaacuauauucucaguguag

SEQ ID NO: 875957 - RNA, 19 nt, Homo sapiens
guaaaacuuagcaacuugg

SEQ ID NO: 875958 - RNA, 14 nt, Homo sapiens
guaaaagcaaaaaa

SEQ ID NO: 875959 - RNA, 18 nt, Homo sapiens
guaaaauaucuaccugcc

SEQ ID NO: 875960 - RNA, 12 nt, Homo sapiens
guaaacaaugaa

SEQ ID NO: 875961 - RNA, 16 nt, Homo sapiens
guaaacauguguuuua

SEQ ID NO: 875962 - RNA, 13 nt, Homo sapiens
guaaaccaaaaag

SEQ ID NO: 875963 - RNA, 22 nt, Homo sapiens
guaaaguauuauuuauuugaau

SEQ ID NO: 875964 - RNA, 17 nt, Homo sapiens
guaaauagcucaggugu

SEQ ID NO: 875965 - RNA, 18 nt, Homo sapiens
guaaauauccacagacuc

SEQ ID NO: 875966 - RNA, 19 nt, Homo sapiens
guaaaucacacaacagguu

SEQ ID NO: 875967 - RNA, 21 nt, Homo sapiens
guaaaugcucgugugauuucc

SEQ ID NO: 875968 - RNA, 15 nt, Homo sapiens
guaaauguccugcua

SEQ ID NO: 875969 - RNA, 14 nt, Homo sapiens
guaaauuacauuaa

SEQ ID NO: 875970 - RNA, 15 nt, Homo sapiens
guaaauuaguauuua

SEQ ID NO: 875971 - RNA, 14 nt, Homo sapiens
guaacaacuguggu

SEQ ID NO: 875972 - RNA, 14 nt, Homo sapiens
guaacaagccagau

SEQ ID NO: 875973 - RNA, 21 nt, Homo sapiens
guaaccaggucguccaagcaa

SEQ ID NO: 875974 - RNA, 16 nt, Homo sapiens
guaacuccaccaaccc

SEQ ID NO: 875975 - RNA, 15 nt, Homo sapiens
guaacugucaaguca

SEQ ID NO: 875976 - RNA, 14 nt, Homo sapiens
guaagacucauucc

SEQ ID NO: 875977 - RNA, 14 nt, Homo sapiens
guaagcaacuugcu

SEQ ID NO: 875978 - RNA, 16 nt, Homo sapiens
guaagccaugaucaua

SEQ ID NO: 875979 - RNA, 22 nt, Homo sapiens
guaaggucuucuuguguccuga

SEQ ID NO: 875980 - RNA, 14 nt, Homo sapiens
guaauaaaucugag

SEQ ID NO: 875981 - RNA, 21 nt, Homo sapiens
guaauaccuuaguuuuuucca

SEQ ID NO: 875982 - RNA, 17 nt, Homo sapiens
guaauagauguuugaua

SEQ ID NO: 875983 - RNA, 15 nt, Homo sapiens
guaaucccagcacuu

SEQ ID NO: 875984 - RNA, 17 nt, Homo sapiens
guaaucccagcuacuca

SEQ ID NO: 875985 - RNA, 20 nt, Homo sapiens
guaaucccagcuacuuggga

SEQ ID NO: 875986 - RNA, 19 nt, Homo sapiens
guaaucccccuugccaaau

SEQ ID NO: 875987 - RNA, 16 nt, Homo sapiens
guaauuaagugcaauu

SEQ ID NO: 875988 - RNA, 17 nt, Homo sapiens
guaauuaauaaacgaag

SEQ ID NO: 875989 - RNA, 23 nt, Homo sapiens
guaauucuaaaugaauguuuaca

SEQ ID NO: 875990 - RNA, 21 nt, Homo sapiens
guaauuucuguguauuuugag

SEQ ID NO: 875991 - RNA, 19 nt, Homo sapiens
guaauuugauacugaccuu

SEQ ID NO: 875992 - RNA, 19 nt, Homo sapiens
guaauuuugugaaagaagg

SEQ ID NO: 875993 - RNA, 15 nt, Homo sapiens
guacaagcauucugu

SEQ ID NO: 875994 - RNA, 12 nt, Homo sapiens
guacaaucucaa

SEQ ID NO: 875995 - RNA, 13 nt, Homo sapiens
guacacacacaga

SEQ ID NO: 875996 - RNA, 20 nt, Homo sapiens
guacagacgucucaagacug

SEQ ID NO: 875997 - RNA, 18 nt, Homo sapiens
guacagagaaauucugug

SEQ ID NO: 875998 - RNA, 15 nt, Homo sapiens
guacaggcaacaaug

SEQ ID NO: 875999 - RNA, 14 nt, Homo sapiens
guacagugagccaa

SEQ ID NO: 876000 - RNA, 22 nt, Homo sapiens
guacauucaauguuuaugcaag

SEQ ID NO: 876001 - RNA, 17 nt, Homo sapiens
guacauuuggcauuugu

SEQ ID NO: 876002 - RNA, 22 nt, Homo sapiens
guacauuuggcauuuguguuau

SEQ ID NO: 876003 - RNA, 21 nt, Homo sapiens
guaccaaauccacaagccauu

SEQ ID NO: 876004 - RNA, 14 nt, Homo sapiens
guacccuuccaccu

SEQ ID NO: 876005 - RNA, 16 nt, Homo sapiens
guacgguggcacgugc

SEQ ID NO: 876006 - RNA, 18 nt, Homo sapiens
guacguaacuauuuccaa

SEQ ID NO: 876007 - RNA, 19 nt, Homo sapiens
guacgucugguguucucaa

SEQ ID NO: 876008 - RNA, 15 nt, Homo sapiens
guacuaguccaucau

SEQ ID NO: 876009 - RNA, 14 nt, Homo sapiens
guacuauaauguga

SEQ ID NO: 876010 - RNA, 12 nt, Homo sapiens
guacuauguaaa

SEQ ID NO: 876011 - RNA, 16 nt, Homo sapiens
guacucagcgaaugaa

SEQ ID NO: 876012 - RNA, 15 nt, Homo sapiens
guacucucugcucua

SEQ ID NO: 876013 - RNA, 16 nt, Homo sapiens
guacuuuuuauucaau

SEQ ID NO: 876014 - RNA, 19 nt, Homo sapiens
guagaaacacaguuuugaa

SEQ ID NO: 876015 - RNA, 14 nt, Homo sapiens
guagaaaucuguaa

SEQ ID NO: 876016 - RNA, 21 nt, Homo sapiens
guagaacaccccugugcaaau

SEQ ID NO: 876017 - RNA, 19 nt, Homo sapiens
guagaagccugcagcggca

SEQ ID NO: 876018 - RNA, 14 nt, Homo sapiens
guagaccacugucc

SEQ ID NO: 876019 - RNA, 20 nt, Homo sapiens
guagagacaggguuuugcca

SEQ ID NO: 876020 - RNA, 14 nt, Homo sapiens
guagauaacagauu

SEQ ID NO: 876021 - RNA, 14 nt, Homo sapiens
guagauaacagcuu

SEQ ID NO: 876022 - RNA, 17 nt, Homo sapiens
guagcccagcacuguga

SEQ ID NO: 876023 - RNA, 20 nt, Homo sapiens
guagcgagcugcucugcuau

SEQ ID NO: 876024 - RNA, 20 nt, Homo sapiens
guagcuaagugaaaagguca

SEQ ID NO: 876025 - RNA, 20 nt, Homo sapiens
guagcucuguccacucugaa

SEQ ID NO: 876026 - RNA, 13 nt, Homo sapiens
guagcugaugaaa

SEQ ID NO: 876027 - RNA, 12 nt, Homo sapiens
guagggcagcag

SEQ ID NO: 876028 - RNA, 14 nt, Homo sapiens
guaggguugccaga

SEQ ID NO: 876029 - RNA, 19 nt, Homo sapiens
guagguggauccagggaaa

SEQ ID NO: 876030 - RNA, 19 nt, Homo sapiens
guagugauguuguuuggga

SEQ ID NO: 876031 - RNA, 17 nt, Homo sapiens
guaguggcauccauuuc

SEQ ID NO: 876032 - RNA, 21 nt, Homo sapiens
guaguuucucuguaaggcaaa

SEQ ID NO: 876033 - RNA, 12 nt, Homo sapiens
guauaaacauua

SEQ ID NO: 876034 - RNA, 19 nt, Homo sapiens
guauaacacaauaugaaua

SEQ ID NO: 876035 - RNA, 12 nt, Homo sapiens
guauaauggggc

SEQ ID NO: 876036 - RNA, 18 nt, Homo sapiens
guauaaugguugacuggg

SEQ ID NO: 876037 - RNA, 19 nt, Homo sapiens
guauaaugguugacugggu

SEQ ID NO: 876038 - RNA, 16 nt, Homo sapiens
guauaauuuaacuuca

SEQ ID NO: 876039 - RNA, 16 nt, Homo sapiens
guauagaguacugcag

SEQ ID NO: 876040 - RNA, 23 nt, Homo sapiens
guauagcauuuuuauucaugcca

SEQ ID NO: 876041 - RNA, 15 nt, Homo sapiens
guauauacaauaaca

SEQ ID NO: 876042 - RNA, 14 nt, Homo sapiens
guauauacauauua

SEQ ID NO: 876043 - RNA, 15 nt, Homo sapiens
guauauauauauagu

SEQ ID NO: 876044 - RNA, 22 nt, Homo sapiens
guauaucaugaaacacuucuca

SEQ ID NO: 876045 - RNA, 23 nt, Homo sapiens
guauaucaugaaacacuucucau

SEQ ID NO: 876046 - RNA, 20 nt, Homo sapiens
guauccaauaggcauuugau

SEQ ID NO: 876047 - RNA, 18 nt, Homo sapiens
guauccaauuaugugaca

SEQ ID NO: 876048 - RNA, 18 nt, Homo sapiens
guaucccaugagccucag

SEQ ID NO: 876049 - RNA, 14 nt, Homo sapiens
guauccuacuacuu

SEQ ID NO: 876050 - RNA, 20 nt, Homo sapiens
guaucucuuuugaauccaug

SEQ ID NO: 876051 - RNA, 21 nt, Homo sapiens
guaucucuuuugaauccaugc

SEQ ID NO: 876052 - RNA, 15 nt, Homo sapiens
guaugacucuccucu

SEQ ID NO: 876053 - RNA, 12 nt, Homo sapiens
guaugcauucau

SEQ ID NO: 876054 - RNA, 18 nt, Homo sapiens
guauggaauacaguguua

SEQ ID NO: 876055 - RNA, 19 nt, Homo sapiens
guaugucuuggacacugua

SEQ ID NO: 876056 - RNA, 11 nt, Homo sapiens
guaugugaaua

SEQ ID NO: 876057 - RNA, 15 nt, Homo sapiens
guauguuugaucaca

SEQ ID NO: 876058 - RNA, 22 nt, Homo sapiens
guauguuuuaauugcauuuaaa

SEQ ID NO: 876059 - RNA, 22 nt, Homo sapiens
guauuaauaugcuacaguacua

SEQ ID NO: 876060 - RNA, 22 nt, Homo sapiens
uuacagguguacuauggcugua

SEQ ID NO: 876061 - RNA, 12 nt, Homo sapiens
uuacaguguaug

SEQ ID NO: 876062 - RNA, 15 nt, Homo sapiens
uuacaugauucauuu

SEQ ID NO: 876063 - RNA, 13 nt, Homo sapiens
uuacaugcauuac

SEQ ID NO: 876064 - RNA, 22 nt, Homo sapiens
uuacaugcauuacugcaugcac

SEQ ID NO: 876065 - RNA, 20 nt, Homo sapiens
uuaccaggcaccaaaagaag

SEQ ID NO: 876066 - RNA, 12 nt, Homo sapiens
uuacccauauau

SEQ ID NO: 876067 - RNA, 18 nt, Homo sapiens
uuaccuaaaacugcugaa

SEQ ID NO: 876068 - RNA, 12 nt, Homo sapiens
uuaccucugaua

SEQ ID NO: 876069 - RNA, 13 nt, Homo sapiens
uuaccugacacaa

SEQ ID NO: 876070 - RNA, 17 nt, Homo sapiens
uuaccuuaaaaaguaau

SEQ ID NO: 876071 - RNA, 17 nt, Homo sapiens
uuaccuuggucaugcuu

SEQ ID NO: 876072 - RNA, 13 nt, Homo sapiens
uuacgugagccag

SEQ ID NO: 876073 - RNA, 12 nt, Homo sapiens
uuacuaaagaca

SEQ ID NO: 876074 - RNA, 15 nt, Homo sapiens
uuacuacaugcacuu

SEQ ID NO: 876075 - RNA, 14 nt, Homo sapiens
uuacuaugaucuca

SEQ ID NO: 876076 - RNA, 18 nt, Homo sapiens
uuacuauuucacaacagc

SEQ ID NO: 876077 - RNA, 20 nt, Homo sapiens
uuacugaaaacaaaauaucu

SEQ ID NO: 876078 - RNA, 19 nt, Homo sapiens
uuacugcaaccuuugccuc

SEQ ID NO: 876079 - RNA, 22 nt, Homo sapiens
uuacuggaccccgccucccagc

SEQ ID NO: 876080 - RNA, 24 nt, Homo sapiens
uuacuguaauuggugacaauguca

SEQ ID NO: 876081 - RNA, 13 nt, Homo sapiens
uuacuuauucuuc

SEQ ID NO: 876082 - RNA, 21 nt, Homo sapiens
uuacuucacuuuaauucucau

SEQ ID NO: 876083 - RNA, 17 nt, Homo sapiens
uuagaaacaccauucau

SEQ ID NO: 876084 - RNA, 12 nt, Homo sapiens
uuagaacuauua

SEQ ID NO: 876085 - RNA, 14 nt, Homo sapiens
uuagauuaguauuu

SEQ ID NO: 876086 - RNA, 15 nt, Homo sapiens
uuagccagugaugcu

SEQ ID NO: 876087 - RNA, 23 nt, Homo sapiens
uuagcuaccucacuaugcugcuu

SEQ ID NO: 876088 - RNA, 21 nt, Homo sapiens
uuagcugagccuucugaugag

SEQ ID NO: 876089 - RNA, 17 nt, Homo sapiens
uuagcuuagaccucagc

SEQ ID NO: 876090 - RNA, 16 nt, Homo sapiens
uuagcuucucugccaa

SEQ ID NO: 876091 - RNA, 14 nt, Homo sapiens
uucaguggcagcug

SEQ ID NO: 876092 - RNA, 22 nt, Homo sapiens
uucaguuccucuuugcauggaa

SEQ ID NO: 876093 - RNA, 16 nt, Homo sapiens
uucaguuguacuucca

SEQ ID NO: 876094 - RNA, 21 nt, Homo sapiens
uucauaagguaauucauggca

SEQ ID NO: 876095 - RNA, 20 nt, Homo sapiens
uucauauguaccauguacau

SEQ ID NO: 876096 - RNA, 22 nt, Homo sapiens
uucauccaguuuguucuccggg

SEQ ID NO: 876097 - RNA, 18 nt, Homo sapiens
uucaucuauuucugagaa

SEQ ID NO: 876098 - RNA, 14 nt, Homo sapiens
uucaucucugccaa

SEQ ID NO: 876099 - RNA, 13 nt, Homo sapiens
uucaucuguucau

SEQ ID NO: 876100 - RNA, 14 nt, Homo sapiens
uucaugccagguua

SEQ ID NO: 876101 - RNA, 18 nt, Homo sapiens
uucauggugcacugagcu

SEQ ID NO: 876102 - RNA, 14 nt, Homo sapiens
uucaugucacugcu

SEQ ID NO: 876103 - RNA, 22 nt, Homo sapiens
uucauuaaauuuucuaugcuua

SEQ ID NO: 876104 - RNA, 18 nt, Homo sapiens
uucauuaauacagggcau

SEQ ID NO: 876105 - RNA, 16 nt, Homo sapiens
uucauuguaugaugug

SEQ ID NO: 876106 - RNA, 18 nt, Homo sapiens
uucauuuaaaaugauuag

SEQ ID NO: 876107 - RNA, 18 nt, Homo sapiens
uucauuuuaacaucugag

SEQ ID NO: 876108 - RNA, 11 nt, Homo sapiens
uuccaaagcaa

SEQ ID NO: 876109 - RNA, 17 nt, Homo sapiens
uuccaagauaaaaccag

SEQ ID NO: 876110 - RNA, 17 nt, Homo sapiens
uuccaagucaacacucu

SEQ ID NO: 876111 - RNA, 21 nt, Homo sapiens
uuccaaguuccugcacuccag

SEQ ID NO: 876112 - RNA, 21 nt, Homo sapiens
uuccacagaauacaagccacu

SEQ ID NO: 876113 - RNA, 16 nt, Homo sapiens
uuccacuucuaugcaa

SEQ ID NO: 876114 - RNA, 18 nt, Homo sapiens
uuccacuucucuagagaa

SEQ ID NO: 876115 - RNA, 23 nt, Homo sapiens
uuccacuuugaguaccaaaucca

SEQ ID NO: 876116 - RNA, 22 nt, Homo sapiens
uuccagaaggcaaaaagacauu

SEQ ID NO: 876117 - RNA, 13 nt, Homo sapiens
uuccagcauuugc

SEQ ID NO: 876118 - RNA, 17 nt, Homo sapiens
uuccagcuagugaccca

SEQ ID NO: 876119 - RNA, 19 nt, Homo sapiens
uuccaggaaaaucugcacu

SEQ ID NO: 876120 - RNA, 17 nt, Homo sapiens
uuccaggggcacacaau

SEQ ID NO: 876121 - RNA, 23 nt, Homo sapiens
uuccaggggcacacaaugcuauu

SEQ ID NO: 876122 - RNA, 18 nt, Homo sapiens
uuccauaaacacccauga

SEQ ID NO: 876123 - RNA, 17 nt, Homo sapiens
uuccauccccaaacugu

SEQ ID NO: 876124 - RNA, 14 nt, Homo sapiens
uuccaugaaguuug

SEQ ID NO: 876125 - RNA, 21 nt, Homo sapiens
uuccaugggauguuaagcaaa

SEQ ID NO: 876126 - RNA, 18 nt, Homo sapiens
uuccauuucgccccucau

SEQ ID NO: 876127 - RNA, 16 nt, Homo sapiens
uucccaaacuugacag

SEQ ID NO: 876128 - RNA, 14 nt, Homo sapiens
uucccaauacauac

SEQ ID NO: 876129 - RNA, 16 nt, Homo sapiens
uucccaauacauacca

SEQ ID NO: 876130 - RNA, 21 nt, Homo sapiens
uucccagaagggaguugcuca

SEQ ID NO: 876131 - RNA, 14 nt, Homo sapiens
uucccagcucuccc

SEQ ID NO: 876132 - RNA, 17 nt, Homo sapiens
uucccaggaauauccca

SEQ ID NO: 876133 - RNA, 20 nt, Homo sapiens
uucccaguggucaaaccgca

SEQ ID NO: 876134 - RNA, 23 nt, Homo sapiens
uucccaucacuggagcaccaggc

SEQ ID NO: 876135 - RNA, 18 nt, Homo sapiens
uucccauccauaaggugc

SEQ ID NO: 876136 - RNA, 14 nt, Homo sapiens
uucccauucuugca

SEQ ID NO: 876137 - RNA, 16 nt, Homo sapiens
uucccccacuugggag

SEQ ID NO: 876138 - RNA, 18 nt, Homo sapiens
uucccguauugacaggaa

SEQ ID NO: 876139 - RNA, 19 nt, Homo sapiens
uucccuacuuccugugacu

SEQ ID NO: 876140 - RNA, 14 nt, Homo sapiens
uucccucucuugcc

SEQ ID NO: 876141 - RNA, 18 nt, Homo sapiens
uucccugaccucccucua

SEQ ID NO: 876142 - RNA, 20 nt, Homo sapiens
uucccuguaugauuccuuga

SEQ ID NO: 876143 - RNA, 23 nt, Homo sapiens
uuccggaagaaaaagagccauug

SEQ ID NO: 876144 - RNA, 13 nt, Homo sapiens
uuccuaaugauua

SEQ ID NO: 876145 - RNA, 15 nt, Homo sapiens
uuccuacaaaaugga

SEQ ID NO: 876146 - RNA, 16 nt, Homo sapiens
uuccuacagauaguca

SEQ ID NO: 876147 - RNA, 17 nt, Homo sapiens
uuccucagauggacaag

SEQ ID NO: 876148 - RNA, 18 nt, Homo sapiens
uuccucccuauuaaccua

SEQ ID NO: 876149 - RNA, 22 nt, Homo sapiens
uuccucuaugaaaauuauaucu

SEQ ID NO: 876150 - RNA, 13 nt, Homo sapiens
uuccucuccagcc

SEQ ID NO: 876151 - RNA, 14 nt, Homo sapiens
uuccucuugccucu

SEQ ID NO: 876152 - RNA, 23 nt, Homo sapiens
uuccugaaggacgcgccagggga

SEQ ID NO: 876153 - RNA, 13 nt, Homo sapiens
uuccugaguaccu

SEQ ID NO: 876154 - RNA, 17 nt, Homo sapiens
uuccugcacuccagaau

SEQ ID NO: 876155 - RNA, 20 nt, Homo sapiens
uuccugggacuaugcuguaa

SEQ ID NO: 876156 - RNA, 21 nt, Homo sapiens
uuccugggcaagaaccuaaag

SEQ ID NO: 876157 - RNA, 22 nt, Homo sapiens
uuccuguaacacaagccacaga

SEQ ID NO: 876158 - RNA, 21 nt, Homo sapiens
uuccuuuuaaaacacuuccau

SEQ ID NO: 876159 - RNA, 19 nt, Homo sapiens
uuccuuuugauggggagaa

SEQ ID NO: 876160 - RNA, 13 nt, Homo sapiens
uucgagggguccu

SEQ ID NO: 876161 - RNA, 15 nt, Homo sapiens
uucgcugccaggaca

SEQ ID NO: 876162 - RNA, 20 nt, Homo sapiens
uucggacagugcccaugcaa

SEQ ID NO: 876163 - RNA, 15 nt, Homo sapiens
uucgugacaacaugc

SEQ ID NO: 876164 - RNA, 19 nt, Homo sapiens
uucuaaagcucugaacaaa

SEQ ID NO: 876165 - RNA, 17 nt, Homo sapiens
uucuaaaugaagugcaa

SEQ ID NO: 876166 - RNA, 16 nt, Homo sapiens
uucuaacuccagugaa

SEQ ID NO: 876167 - RNA, 19 nt, Homo sapiens
uucuaaguaaaaccacagc

SEQ ID NO: 876168 - RNA, 12 nt, Homo sapiens
uucuaaguauuu

SEQ ID NO: 876169 - RNA, 18 nt, Homo sapiens
uucuaaguauuuuauucc

SEQ ID NO: 876170 - RNA, 21 nt, Homo sapiens
uucuaauauuuuuagcucugu

SEQ ID NO: 876171 - RNA, 14 nt, Homo sapiens
uucuacaaccagag

SEQ ID NO: 876172 - RNA, 13 nt, Homo sapiens
uucuacaagcaua

SEQ ID NO: 876173 - RNA, 13 nt, Homo sapiens
uucuacacaguaa

SEQ ID NO: 876174 - RNA, 22 nt, Homo sapiens
uucuacaccuguugcaccucag

SEQ ID NO: 876175 - RNA, 17 nt, Homo sapiens
uucuaccuggucucucc

SEQ ID NO: 876176 - RNA, 13 nt, Homo sapiens
gucucaaucugau

SEQ ID NO: 876177 - RNA, 23 nt, Homo sapiens
gucucaccccucauccuuuuacu

SEQ ID NO: 876178 - RNA, 18 nt, Homo sapiens
gucuccaucucugucuca

SEQ ID NO: 876179 - RNA, 16 nt, Homo sapiens
gucuccuggucugugc

SEQ ID NO: 876180 - RNA, 14 nt, Homo sapiens
gucuccuugcacuu

SEQ ID NO: 876181 - RNA, 18 nt, Homo sapiens
gucuccuuugcacugagg

SEQ ID NO: 876182 - RNA, 13 nt, Homo sapiens
gucucucauucuc

SEQ ID NO: 876183 - RNA, 21 nt, Homo sapiens
gucucucauucucuuucuuuu

SEQ ID NO: 876184 - RNA, 18 nt, Homo sapiens
gucucucuaaacccaaau

SEQ ID NO: 876185 - RNA, 21 nt, Homo sapiens
gucucugccugcggcccagaa

SEQ ID NO: 876186 - RNA, 14 nt, Homo sapiens
gucucugcugcuaa

SEQ ID NO: 876187 - RNA, 16 nt, Homo sapiens
gucucuggaacccagg

SEQ ID NO: 876188 - RNA, 17 nt, Homo sapiens
gucucuuccaguuugcu

SEQ ID NO: 876189 - RNA, 16 nt, Homo sapiens
gucugagcuucaguau

SEQ ID NO: 876190 - RNA, 19 nt, Homo sapiens
gucugccccacccucaaac

SEQ ID NO: 876191 - RNA, 19 nt, Homo sapiens
gucuggcugaggauuucaa

SEQ ID NO: 876192 - RNA, 15 nt, Homo sapiens
gucuggggcuuuuag

SEQ ID NO: 876193 - RNA, 15 nt, Homo sapiens
gucuguacacguguc

SEQ ID NO: 876194 - RNA, 22 nt, Homo sapiens
gucuguagagccgcauggcacu

SEQ ID NO: 876195 - RNA, 14 nt, Homo sapiens
gucugucaccagcu

SEQ ID NO: 876196 - RNA, 15 nt, Homo sapiens
gucuguccaccccau

SEQ ID NO: 876197 - RNA, 12 nt, Homo sapiens
gucugugucugc

SEQ ID NO: 876198 - RNA, 20 nt, Homo sapiens
gucugugugaugaacuuucu

SEQ ID NO: 876199 - RNA, 14 nt, Homo sapiens
gucuguguggugcc

SEQ ID NO: 876200 - RNA, 13 nt, Homo sapiens
gucuguuaacuua

SEQ ID NO: 876201 - RNA, 21 nt, Homo sapiens
gucuguuucaaugaccuguau

SEQ ID NO: 876202 - RNA, 17 nt, Homo sapiens
gucuuaaucaugagaua

SEQ ID NO: 876203 - RNA, 15 nt, Homo sapiens
gucuucacucuucau

SEQ ID NO: 876204 - RNA, 19 nt, Homo sapiens
gucuucccugaucaaguca

SEQ ID NO: 876205 - RNA, 16 nt, Homo sapiens
gucuucuuacuuggaa

SEQ ID NO: 876206 - RNA, 19 nt, Homo sapiens
gugucccccuaugcuccag

SEQ ID NO: 876207 - RNA, 15 nt, Homo sapiens
guguccgcuuucaug

SEQ ID NO: 876208 - RNA, 23 nt, Homo sapiens
gugucugcacccaggggugggga

SEQ ID NO: 876209 - RNA, 14 nt, Homo sapiens
gugucuguguguau

SEQ ID NO: 876210 - RNA, 23 nt, Homo sapiens
gugugaaguguaguggcauccau

SEQ ID NO: 876211 - RNA, 19 nt, Homo sapiens
gugugagcaucucugugua

SEQ ID NO: 876212 - RNA, 16 nt, Homo sapiens
gugugcagacugaugg

SEQ ID NO: 876213 - RNA, 11 nt, Homo sapiens
gugugccaaac

SEQ ID NO: 876214 - RNA, 20 nt, Homo sapiens
guguguauauauguguauau

SEQ ID NO: 876215 - RNA, 22 nt, Homo sapiens
guguguaucgcugccuugccau

SEQ ID NO: 876216 - RNA, 13 nt, Homo sapiens
guguguauucaag

SEQ ID NO: 876217 - RNA, 14 nt, Homo sapiens
gugugucaaugcca

SEQ ID NO: 876218 - RNA, 15 nt, Homo sapiens
gugugucaaugccac

SEQ ID NO: 876219 - RNA, 19 nt, Homo sapiens
guguguccguggaaccagu

SEQ ID NO: 876220 - RNA, 13 nt, Homo sapiens
gugugugugauau

SEQ ID NO: 876221 - RNA, 13 nt, Homo sapiens
gugugugugcaug

SEQ ID NO: 876222 - RNA, 21 nt, Homo sapiens
guguuaucagucauaacuaaa

SEQ ID NO: 876223 - RNA, 20 nt, Homo sapiens
guguuauuauuuugcacugu

SEQ ID NO: 876224 - RNA, 16 nt, Homo sapiens
guguucacacuguaaa

SEQ ID NO: 876225 - RNA, 16 nt, Homo sapiens
guguuccucaccaaua

SEQ ID NO: 876226 - RNA, 17 nt, Homo sapiens
guguucucacacuggug

SEQ ID NO: 876227 - RNA, 18 nt, Homo sapiens
guguucucuauuuugccu

SEQ ID NO: 876228 - RNA, 16 nt, Homo sapiens
guguucuguaaucaaa

SEQ ID NO: 876229 - RNA, 12 nt, Homo sapiens
guguugauccca

SEQ ID NO: 876230 - RNA, 21 nt, Homo sapiens
guguugggaauugcaugccau

SEQ ID NO: 876231 - RNA, 14 nt, Homo sapiens
guguuucaagcuac

SEQ ID NO: 876232 - RNA, 13 nt, Homo sapiens
guguuucuugccu

SEQ ID NO: 876233 - RNA, 16 nt, Homo sapiens
guguuucuugccucau

SEQ ID NO: 876234 - RNA, 13 nt, Homo sapiens
guguuugcugagg

SEQ ID NO: 876235 - RNA, 17 nt, Homo sapiens
guuaaacuacuuguaaa

SEQ ID NO: 876236 - RNA, 18 nt, Homo sapiens
guuaaaugaaauuguaaa

SEQ ID NO: 876237 - RNA, 18 nt, Homo sapiens
guuaacgucaucucaggg

SEQ ID NO: 876238 - RNA, 18 nt, Homo sapiens
guuacaacaguaacacau

SEQ ID NO: 876239 - RNA, 16 nt, Homo sapiens
guuacacagcccaaga

SEQ ID NO: 876240 - RNA, 21 nt, Homo sapiens
guuacaucacaguguuugcaa

SEQ ID NO: 876241 - RNA, 13 nt, Homo sapiens
guuacucaugacu

SEQ ID NO: 876242 - RNA, 18 nt, Homo sapiens
guuagaauuuuccuaaaa

SEQ ID NO: 876243 - RNA, 23 nt, Homo sapiens
guuaggaaaauuucacauuaaua

SEQ ID NO: 876244 - RNA, 13 nt, Homo sapiens
guuauaacugugg

SEQ ID NO: 876245 - RNA, 12 nt, Homo sapiens
guuaucacuuau

SEQ ID NO: 876246 - RNA, 22 nt, Homo sapiens
guuauccugcuagcuguagaaa

SEQ ID NO: 876247 - RNA, 19 nt, Homo sapiens
guuaucuguguagcaagcu

SEQ ID NO: 876248 - RNA, 13 nt, Homo sapiens
guuaugugaauga

SEQ ID NO: 876249 - RNA, 14 nt, Homo sapiens
guuauguuugcacu

SEQ ID NO: 876250 - RNA, 17 nt, Homo sapiens
guuauguuugcacuuug

SEQ ID NO: 876251 - RNA, 16 nt, Homo sapiens
guuauuauuuugcacu

SEQ ID NO: 876252 - RNA, 17 nt, Homo sapiens
guuauuauuuugcacug

SEQ ID NO: 876253 - RNA, 21 nt, Homo sapiens
guuauuguaggcaaccuuccc

SEQ ID NO: 876254 - RNA, 21 nt, Homo sapiens
guuauuuuugucccugcuccu

SEQ ID NO: 876255 - RNA, 19 nt, Homo sapiens
guucaacuuuuccuuugaa

SEQ ID NO: 876256 - RNA, 23 nt, Homo sapiens
guucaauucucauuugucacaca

SEQ ID NO: 876257 - RNA, 22 nt, Homo sapiens
guucagaguuguacacugugua

SEQ ID NO: 876258 - RNA, 20 nt, Homo sapiens
guucaggagucccaaggaaa

SEQ ID NO: 876259 - RNA, 13 nt, Homo sapiens
guucccagcagcu

SEQ ID NO: 876260 - RNA, 21 nt, Homo sapiens
guuccuaagccuguugcugaa

SEQ ID NO: 876261 - RNA, 21 nt, Homo sapiens
guuccuauuuggggcuugcau

SEQ ID NO: 876262 - RNA, 23 nt, Homo sapiens
guuccuccaagaggucuccauca

SEQ ID NO: 876263 - RNA, 14 nt, Homo sapiens
guuccugcacucca

SEQ ID NO: 876264 - RNA, 17 nt, Homo sapiens
guuccugcacuccagaa

SEQ ID NO: 876265 - RNA, 16 nt, Homo sapiens
guuccuuacugcagaa

SEQ ID NO: 876266 - RNA, 12 nt, Homo sapiens
guucuacaugag

SEQ ID NO: 876267 - RNA, 14 nt, Homo sapiens
guucucacugucuc

SEQ ID NO: 876268 - RNA, 21 nt, Homo sapiens
guucucacugucuccuggucu

SEQ ID NO: 876269 - RNA, 18 nt, Homo sapiens
guucucucguaacugguu

SEQ ID NO: 876270 - RNA, 21 nt, Homo sapiens
guucucucuuaguaacauaga

SEQ ID NO: 876271 - RNA, 14 nt, Homo sapiens
guucugaguguuuu

SEQ ID NO: 876272 - RNA, 18 nt, Homo sapiens
guucuuacuacuugccac

SEQ ID NO: 876273 - RNA, 19 nt, Homo sapiens
guucuuagcugaacaauga

SEQ ID NO: 876274 - RNA, 13 nt, Homo sapiens
guucuuaguguca

SEQ ID NO: 876275 - RNA, 15 nt, Homo sapiens
guucuuccuaccaaa

SEQ ID NO: 876276 - RNA, 14 nt, Homo sapiens
guugaaacuguuau

SEQ ID NO: 876277 - RNA, 17 nt, Homo sapiens
guugaagccacugccuu

SEQ ID NO: 876278 - RNA, 18 nt, Homo sapiens
guugaggggcuccuggaa

SEQ ID NO: 876279 - RNA, 12 nt, Homo sapiens
guugaguguuca

SEQ ID NO: 876280 - RNA, 12 nt, Homo sapiens
guugaguucaag

SEQ ID NO: 876281 - RNA, 20 nt, Homo sapiens
guugauaaauuccacuggac

SEQ ID NO: 876282 - RNA, 19 nt, Homo sapiens
guugcaugccuauguacuc

SEQ ID NO: 876283 - RNA, 21 nt, Homo sapiens
guugcccaggcugcucuugaa

SEQ ID NO: 876284 - RNA, 16 nt, Homo sapiens
guugcccuaucgugau

SEQ ID NO: 876285 - RNA, 20 nt, Homo sapiens
guugcguggacucugcacau

SEQ ID NO: 876286 - RNA, 16 nt, Homo sapiens
guugcucacucaggac

SEQ ID NO: 876287 - RNA, 22 nt, Homo sapiens
guuggacccgcucuggaccaac

SEQ ID NO: 876288 - RNA, 22 nt, Homo sapiens
guuggaccuucaucagaccacu

SEQ ID NO: 876289 - RNA, 16 nt, Homo sapiens
guuggauguaguuuag

SEQ ID NO: 876290 - RNA, 16 nt, Homo sapiens
guugggaccugugauc

SEQ ID NO: 876291 - RNA, 14 nt, Homo sapiens
guuguauugcauau

SEQ ID NO: 876292 - RNA, 10 nt, Homo sapiens
uugauuucaa

SEQ ID NO: 876293 - RNA, 22 nt, Homo sapiens
uugcacagcccacacaugaacc

SEQ ID NO: 876294 - RNA, 19 nt, Homo sapiens
uugcacauaacaugcuuua

SEQ ID NO: 876295 - RNA, 13 nt, Homo sapiens
uugcacaugugac

SEQ ID NO: 876296 - RNA, 20 nt, Homo sapiens
uugcagcagugagucucuuc

SEQ ID NO: 876297 - RNA, 16 nt, Homo sapiens
uugcauaugucuauau

SEQ ID NO: 876298 - RNA, 18 nt, Homo sapiens
uugcauuaaaaaugcaua

SEQ ID NO: 876299 - RNA, 16 nt, Homo sapiens
uugccacaacccuguu

SEQ ID NO: 876300 - RNA, 15 nt, Homo sapiens
uugccauaaagucaa

SEQ ID NO: 876301 - RNA, 19 nt, Homo sapiens
uugccauuaaacuuaccug

SEQ ID NO: 876302 - RNA, 21 nt, Homo sapiens
uugcccaggcuggagugcagu

SEQ ID NO: 876303 - RNA, 21 nt, Homo sapiens
uugcccccugugcccucugga

SEQ ID NO: 876304 - RNA, 17 nt, Homo sapiens
uugccuaaauccaaaga

SEQ ID NO: 876305 - RNA, 16 nt, Homo sapiens
uugccucucucaggag

SEQ ID NO: 876306 - RNA, 13 nt, Homo sapiens
uugcgggggagcu

SEQ ID NO: 876307 - RNA, 22 nt, Homo sapiens
uugcuaagaagcgagcacugac

SEQ ID NO: 876308 - RNA, 14 nt, Homo sapiens
uugcucagugccuc

SEQ ID NO: 876309 - RNA, 21 nt, Homo sapiens
uugcugucauaagaaugaaua

SEQ ID NO: 876310 - RNA, 16 nt, Homo sapiens
uugcuguucacccaca

SEQ ID NO: 876311 - RNA, 22 nt, Homo sapiens
uugcuuauucuaggucuguaau

SEQ ID NO: 876312 - RNA, 15 nt, Homo sapiens
uuggaaaaugugcaa

SEQ ID NO: 876313 - RNA, 13 nt, Homo sapiens
uuggaaucuguau

SEQ ID NO: 876314 - RNA, 19 nt, Homo sapiens
uuggacagucugagcugua

SEQ ID NO: 876315 - RNA, 16 nt, Homo sapiens
uuggacauuuucuuca

SEQ ID NO: 876316 - RNA, 17 nt, Homo sapiens
uuggacugauaaucucu

SEQ ID NO: 876317 - RNA, 23 nt, Homo sapiens
uuggagaaggcccacugaggcag

SEQ ID NO: 876318 - RNA, 15 nt, Homo sapiens
uuggagcuguuccau

SEQ ID NO: 876319 - RNA, 17 nt, Homo sapiens
uuggagggugucccaaa

SEQ ID NO: 876320 - RNA, 21 nt, Homo sapiens
uuggauaauauccacugcaau

SEQ ID NO: 876321 - RNA, 23 nt, Homo sapiens
uuuauaaaagaauaaaauugcac

SEQ ID NO: 876322 - RNA, 16 nt, Homo sapiens
uuuauaaauggacaaa

SEQ ID NO: 876323 - RNA, 18 nt, Homo sapiens
uuuauacaccauuguucc

SEQ ID NO: 876324 - RNA, 14 nt, Homo sapiens
uuuauacauaguca

SEQ ID NO: 876325 - RNA, 14 nt, Homo sapiens
uuuaucugugcaaa

SEQ ID NO: 876326 - RNA, 14 nt, Homo sapiens
uuuaugagcucuuc

SEQ ID NO: 876327 - RNA, 12 nt, Homo sapiens
uuuaugcugcug

SEQ ID NO: 876328 - RNA, 18 nt, Homo sapiens
uuuaugguguguuccuaa

SEQ ID NO: 876329 - RNA, 13 nt, Homo sapiens
uuuaugugcaaua

SEQ ID NO: 876330 - RNA, 18 nt, Homo sapiens
uuuaugugcucuccaaau

SEQ ID NO: 876331 - RNA, 22 nt, Homo sapiens
uuuauuaguuaauauaucccag

SEQ ID NO: 876332 - RNA, 23 nt, Homo sapiens
uuuauuaguuaggugugccaaac

SEQ ID NO: 876333 - RNA, 17 nt, Homo sapiens
uuuauuauuuucaccug

SEQ ID NO: 876334 - RNA, 21 nt, Homo sapiens
uuuauucauuagcugugauuu

SEQ ID NO: 876335 - RNA, 13 nt, Homo sapiens
uuuauugccauga

SEQ ID NO: 876336 - RNA, 15 nt, Homo sapiens
uuuauugcuuaaucc

SEQ ID NO: 876337 - RNA, 15 nt, Homo sapiens
uuucaaaacacaucu

SEQ ID NO: 876338 - RNA, 13 nt, Homo sapiens
uuucaaacuauug

SEQ ID NO: 876339 - RNA, 19 nt, Homo sapiens
uuucaaagauguguugcua

SEQ ID NO: 876340 - RNA, 19 nt, Homo sapiens
uuucaaaugucagcuuaaa

SEQ ID NO: 876341 - RNA, 12 nt, Homo sapiens
uuucaaccagca

SEQ ID NO: 876342 - RNA, 18 nt, Homo sapiens
uuucaaccgcuugccaua

SEQ ID NO: 876343 - RNA, 23 nt, Homo sapiens
uuucaagaccuucuccccauucu

SEQ ID NO: 876344 - RNA, 16 nt, Homo sapiens
uuucaaggaaagugaa

SEQ ID NO: 876345 - RNA, 15 nt, Homo sapiens
uuucacauaaaaccu

SEQ ID NO: 876346 - RNA, 11 nt, Homo sapiens
uuucaccucau

SEQ ID NO: 876347 - RNA, 14 nt, Homo sapiens
uuucagaauuuugu

SEQ ID NO: 876348 - RNA, 20 nt, Homo sapiens
uuucagauggaggugccaua

SEQ ID NO: 876349 - RNA, 12 nt, Homo sapiens
uuucagcuaaag

SEQ ID NO: 876350 - RNA, 17 nt, Homo sapiens
uuucaguugacaaaaua

SEQ ID NO: 876351 - RNA, 17 nt, Homo sapiens
uuucaucauaacauaaa

SEQ ID NO: 876352 - RNA, 15 nt, Homo sapiens
uuucaucuaauguga

SEQ ID NO: 876353 - RNA, 17 nt, Homo sapiens
uuucaucugcugcugaa

SEQ ID NO: 876354 - RNA, 13 nt, Homo sapiens
uuucauucaucca

SEQ ID NO: 876355 - RNA, 22 nt, Homo sapiens
uuuccacaagauucccagagac

SEQ ID NO: 876356 - RNA, 12 nt, Homo sapiens
uuuccacaccau

SEQ ID NO: 876357 - RNA, 21 nt, Homo sapiens
uuuccaccaucaaaugcugua

SEQ ID NO: 876358 - RNA, 20 nt, Homo sapiens
uuuccaguucaucuauggca

SEQ ID NO: 876359 - RNA, 23 nt, Homo sapiens
uuuccauugcuuauucuugagca

SEQ ID NO: 876360 - RNA, 14 nt, Homo sapiens
uuucccacacccca

SEQ ID NO: 876361 - RNA, 22 nt, Homo sapiens
uuucccaccaccuuggacuccu

SEQ ID NO: 876362 - RNA, 19 nt, Homo sapiens
uuucccaccucaccugaga

SEQ ID NO: 876363 - RNA, 17 nt, Homo sapiens
uuucccauuacuuuaau

SEQ ID NO: 876364 - RNA, 16 nt, Homo sapiens
uuuccccucugugucc

SEQ ID NO: 876365 - RNA, 18 nt, Homo sapiens
uuuccuaaaugcagugaa

SEQ ID NO: 876366 - RNA, 15 nt, Homo sapiens
uuuccuccaggcaaa

SEQ ID NO: 876367 - RNA, 23 nt, Homo sapiens
uuuccucccuccucccacagccu

SEQ ID NO: 876368 - RNA, 20 nt, Homo sapiens
uuuccucgccuaggccugug

SEQ ID NO: 876369 - RNA, 21 nt, Homo sapiens
uuuccucuuccccuugcccuu

SEQ ID NO: 876370 - RNA, 18 nt, Homo sapiens
uuuccuuuguaaguuccu

SEQ ID NO: 876371 - RNA, 12 nt, Homo sapiens
uuucuacccagc

SEQ ID NO: 876372 - RNA, 19 nt, Homo sapiens
uuucuaccuguguucauuc

SEQ ID NO: 876373 - RNA, 16 nt, Homo sapiens
uuucuaccuuuacuac

SEQ ID NO: 876374 - RNA, 16 nt, Homo sapiens
uuucuaucacauauuu

SEQ ID NO: 876375 - RNA, 21 nt, Homo sapiens
uuucucagcucccaaggcucu

SEQ ID NO: 876376 - RNA, 21 nt, Homo sapiens
uuucuccuuuugaccaaauaa

SEQ ID NO: 876377 - RNA, 18 nt, Homo sapiens
uuucucgggugcauuuga

SEQ ID NO: 876378 - RNA, 14 nt, Homo sapiens
uuucugaguuucau

SEQ ID NO: 876379 - RNA, 16 nt, Homo sapiens
uuucugcggccuucca

SEQ ID NO: 876380 - RNA, 17 nt, Homo sapiens
uuucuggaaaacugccu

SEQ ID NO: 876381 - RNA, 15 nt, Homo sapiens
uuucuggaccagauc

SEQ ID NO: 876382 - RNA, 12 nt, Homo sapiens
uuucuggagcaa

SEQ ID NO: 876383 - RNA, 13 nt, Homo sapiens
uuucuguaaacuc

SEQ ID NO: 876384 - RNA, 15 nt, Homo sapiens
uuucuguaaccaaaa

SEQ ID NO: 876385 - RNA, 17 nt, Homo sapiens
uuucuguugccacaacc

SEQ ID NO: 876386 - RNA, 15 nt, Homo sapiens
uuucuuaaaaacagc

SEQ ID NO: 876387 - RNA, 22 nt, Homo sapiens
uuucuuauagucaauguuucuu

SEQ ID NO: 876388 - RNA, 14 nt, Homo sapiens
uuucuucaccaaau

SEQ ID NO: 876389 - RNA, 21 nt, Homo sapiens
uuucuuccaaagcacauugaa

SEQ ID NO: 876390 - RNA, 23 nt, Homo sapiens
uuucuuccagaaggcaaaaagac

SEQ ID NO: 876391 - RNA, 19 nt, Homo sapiens
uuucuuggucucagcuuca

SEQ ID NO: 876392 - RNA, 19 nt, Homo sapiens
uuucuuuaccugagaccag

SEQ ID NO: 876393 - RNA, 13 nt, Homo sapiens
uuucuuuccucag

SEQ ID NO: 876394 - RNA, 17 nt, Homo sapiens
uuucuuucucacuaaau

SEQ ID NO: 876395 - RNA, 15 nt, Homo sapiens
uuucuuuuccauuua

SEQ ID NO: 876396 - RNA, 16 nt, Homo sapiens
uuugaaaacauaaucu

SEQ ID NO: 876397 - RNA, 13 nt, Homo sapiens
uuugaaaugucau

SEQ ID NO: 876398 - RNA, 13 nt, Homo sapiens
uuugaagcaaagc

SEQ ID NO: 876399 - RNA, 17 nt, Homo sapiens
uuugaagguaacugaga

SEQ ID NO: 876400 - RNA, 12 nt, Homo sapiens
uuugaaguagga

SEQ ID NO: 876401 - RNA, 17 nt, Homo sapiens
uuugaauugacugagac

SEQ ID NO: 876402 - RNA, 12 nt, Homo sapiens
uuugaccaaaua

SEQ ID NO: 876403 - RNA, 13 nt, Homo sapiens
uuugacucaugaa

SEQ ID NO: 876404 - RNA, 23 nt, Homo sapiens
uuugacucaugaacuauuuacau

SEQ ID NO: 876405 - RNA, 20 nt, Homo sapiens
uuugaggaauuaucauggga

SEQ ID NO: 876406 - RNA, 18 nt, Homo sapiens
uuugaggagcagcuucag

SEQ ID NO: 876407 - RNA, 16 nt, Homo sapiens
uuugaguaauucuagc

SEQ ID NO: 876408 - RNA, 15 nt, Homo sapiens
uuugaguuucucucc

SEQ ID NO: 876409 - RNA, 13 nt, Homo sapiens
uuugauacaaaau

SEQ ID NO: 876410 - RNA, 18 nt, Homo sapiens
uuugauacuaagcauuga

SEQ ID NO: 876411 - RNA, 20 nt, Homo sapiens
uuugauaguugguguucaaa

SEQ ID NO: 876412 - RNA, 19 nt, Homo sapiens
uuugaucacacagccacuu

SEQ ID NO: 876413 - RNA, 14 nt, Homo sapiens
uuugcagacaggca

SEQ ID NO: 876414 - RNA, 13 nt, Homo sapiens
uuugcagagccuu

SEQ ID NO: 876415 - RNA, 16 nt, Homo sapiens
uuugcagcagaagcca

SEQ ID NO: 876416 - RNA, 20 nt, Homo sapiens
uuugccaaguuuuaagagaa

SEQ ID NO: 876417 - RNA, 18 nt, Homo sapiens
uuugccauccuaggcuua

SEQ ID NO: 876418 - RNA, 16 nt, Homo sapiens
uuugcccaccagauca

SEQ ID NO: 876419 - RNA, 23 nt, Homo sapiens
uuugcgcugguggaccacaggca

SEQ ID NO: 876420 - RNA, 15 nt, Homo sapiens
uuugcuuaguucuca

SEQ ID NO: 876421 - RNA, 19 nt, Homo sapiens
uuuggaagaggacuccuua

SEQ ID NO: 876422 - RNA, 13 nt, Homo sapiens
cuucaguuuuagg

SEQ ID NO: 876423 - RNA, 22 nt, Homo sapiens
cuucauaagguaauucauggca

SEQ ID NO: 876424 - RNA, 23 nt, Homo sapiens
cuucauauguuggguaagaaaca

SEQ ID NO: 876425 - RNA, 21 nt, Homo sapiens
cuucauccucugagugugacc

SEQ ID NO: 876426 - RNA, 18 nt, Homo sapiens
cuucauggaacucagcug

SEQ ID NO: 876427 - RNA, 14 nt, Homo sapiens
cuucauuaugcagc

SEQ ID NO: 876428 - RNA, 19 nt, Homo sapiens
cuuccaaacagaacuaugg

SEQ ID NO: 876429 - RNA, 21 nt, Homo sapiens
cuuccaaacagaacuauggaa

SEQ ID NO: 876430 - RNA, 19 nt, Homo sapiens
cuuccacaauucacuagac

SEQ ID NO: 876431 - RNA, 23 nt, Homo sapiens
cuuccacaccuagcaucucauga

SEQ ID NO: 876432 - RNA, 15 nt, Homo sapiens
cuuccagcuagugac

SEQ ID NO: 876433 - RNA, 22 nt, Homo sapiens
cuuccagugcauguugccauga

SEQ ID NO: 876434 - RNA, 16 nt, Homo sapiens
cuuccauaauguauaa

SEQ ID NO: 876435 - RNA, 22 nt, Homo sapiens
cuuccauaauuaugacaguuau

SEQ ID NO: 876436 - RNA, 18 nt, Homo sapiens
cuuccaucugauugugau

SEQ ID NO: 876437 - RNA, 16 nt, Homo sapiens
cuuccauuugggauau

SEQ ID NO: 876438 - RNA, 22 nt, Homo sapiens
cuucccaggaucccucccagau

SEQ ID NO: 876439 - RNA, 21 nt, Homo sapiens
cuucccaugucuuucuccaaa

SEQ ID NO: 876440 - RNA, 13 nt, Homo sapiens
cuuccccacagaa

SEQ ID NO: 876441 - RNA, 15 nt, Homo sapiens
cuuccccaucuccau

SEQ ID NO: 876442 - RNA, 14 nt, Homo sapiens
cuucccuaaugaag

SEQ ID NO: 876443 - RNA, 18 nt, Homo sapiens
cuucccuguccaccucac

SEQ ID NO: 876444 - RNA, 22 nt, Homo sapiens
cuucccuucucuccuucccucu

SEQ ID NO: 876445 - RNA, 20 nt, Homo sapiens
cuucccuuguauccagugau

SEQ ID NO: 876446 - RNA, 15 nt, Homo sapiens
cuucccuuuccucca

SEQ ID NO: 876447 - RNA, 21 nt, Homo sapiens
cuuccggaagaaaaagagcca

SEQ ID NO: 876448 - RNA, 15 nt, Homo sapiens
cuuccuaccaaauau

SEQ ID NO: 876449 - RNA, 18 nt, Homo sapiens
cuuccucacuaugacacu

SEQ ID NO: 876450 - RNA, 16 nt, Homo sapiens
cuuccucagcuguaga

SEQ ID NO: 876451 - RNA, 20 nt, Homo sapiens
cuuccucccuauuaaccuag

SEQ ID NO: 876452 - RNA, 15 nt, Homo sapiens
cuuccucuccacugc

SEQ ID NO: 876453 - RNA, 10 nt, Homo sapiens
cuuccugacu

SEQ ID NO: 876454 - RNA, 18 nt, Homo sapiens
cuuccuggacagcugugc

SEQ ID NO: 876455 - RNA, 20 nt, Homo sapiens
ucccaagagcaucaugccuc

SEQ ID NO: 876456 - RNA, 22 nt, Homo sapiens
ucccaagagcaucaugccucug

SEQ ID NO: 876457 - RNA, 23 nt, Homo sapiens
ucccaaguauugcgaaugugcag

SEQ ID NO: 876458 - RNA, 16 nt, Homo sapiens
ucccaaucagcacuga

SEQ ID NO: 876459 - RNA, 19 nt, Homo sapiens
ucccaaucagcacugaaaa

SEQ ID NO: 876460 - RNA, 18 nt, Homo sapiens
ucccacacccuguuuuac

SEQ ID NO: 876461 - RNA, 14 nt, Homo sapiens
ucccacagggccag

SEQ ID NO: 876462 - RNA, 20 nt, Homo sapiens
ucccaccaugcgcugcucaa

SEQ ID NO: 876463 - RNA, 17 nt, Homo sapiens
ucccaccccacuccagc

SEQ ID NO: 876464 - RNA, 14 nt, Homo sapiens
ucccaccucagccu

SEQ ID NO: 876465 - RNA, 23 nt, Homo sapiens
ucccaccuccauuugcaauugac

SEQ ID NO: 876466 - RNA, 22 nt, Homo sapiens
ucccaccucuucucuuccugua

SEQ ID NO: 876467 - RNA, 24 nt, Homo sapiens
ucccagauccucugcugacuccau

SEQ ID NO: 876468 - RNA, 20 nt, Homo sapiens
ucccagccccaggggugccu

SEQ ID NO: 876469 - RNA, 17 nt, Homo sapiens
ucccagcuacucaggag

SEQ ID NO: 876470 - RNA, 15 nt, Homo sapiens
ucccagcuacucggg

SEQ ID NO: 876471 - RNA, 14 nt, Homo sapiens
ucccaggaccaaga

SEQ ID NO: 876472 - RNA, 14 nt, Homo sapiens
ucccaguggucaaa

SEQ ID NO: 876473 - RNA, 20 nt, Homo sapiens
ucugccuauuuauuggggug

SEQ ID NO: 876474 - RNA, 18 nt, Homo sapiens
ucugccucuauucaauuu

SEQ ID NO: 876475 - RNA, 22 nt, Homo sapiens
ucugccugauaggacccauauu

SEQ ID NO: 876476 - RNA, 22 nt, Homo sapiens
ucugccugggcuuaugcccuca

SEQ ID NO: 876477 - RNA, 17 nt, Homo sapiens
ucugccuuagacaaagg

SEQ ID NO: 876478 - RNA, 14 nt, Homo sapiens
ucugcggccuucca

SEQ ID NO: 876479 - RNA, 15 nt, Homo sapiens
ucugcguuacaacag

SEQ ID NO: 876480 - RNA, 15 nt, Homo sapiens
ucugcuaaauuuaau

SEQ ID NO: 876481 - RNA, 17 nt, Homo sapiens
ucuggaaaagcacuuua

SEQ ID NO: 876482 - RNA, 21 nt, Homo sapiens
ucuggaaaagcacuuuacaga

SEQ ID NO: 876483 - RNA, 15 nt, Homo sapiens
ucuggaagacaugau

SEQ ID NO: 876484 - RNA, 17 nt, Homo sapiens
ucuggaccagccuguug

SEQ ID NO: 876485 - RNA, 20 nt, Homo sapiens
ucuggacccuccacuucaau

SEQ ID NO: 876486 - RNA, 13 nt, Homo sapiens
ucuggagccagag

SEQ ID NO: 876487 - RNA, 17 nt, Homo sapiens
ugaaaacaaaauaucug

SEQ ID NO: 876488 - RNA, 18 nt, Homo sapiens
ugaaaaccauaugauauu

SEQ ID NO: 876489 - RNA, 21 nt, Homo sapiens
ugaaaagcuagaauugagugu

SEQ ID NO: 876490 - RNA, 16 nt, Homo sapiens
ugaaaaucaaaguaaa

SEQ ID NO: 876491 - RNA, 16 nt, Homo sapiens
ugaaaaucacuauaac

SEQ ID NO: 876492 - RNA, 18 nt, Homo sapiens
ugaaaaucaguuauauuc

SEQ ID NO: 876493 - RNA, 12 nt, Homo sapiens
ugaaaauguacu

SEQ ID NO: 876494 - RNA, 14 nt, Homo sapiens
ugaaaauguacuga

SEQ ID NO: 876495 - RNA, 12 nt, Homo sapiens
ugaaaauguuca

SEQ ID NO: 876496 - RNA, 20 nt, Homo sapiens
ugaaacaagauaacugagaa

SEQ ID NO: 876497 - RNA, 21 nt, Homo sapiens
ugaaacucuaccaacagccac

SEQ ID NO: 876498 - RNA, 21 nt, Homo sapiens
ugaaacuguguacgacaaagc

SEQ ID NO: 876499 - RNA, 18 nt, Homo sapiens
ugaaagaggcagcuugaa

SEQ ID NO: 876500 - RNA, 18 nt, Homo sapiens
ugaaagaguagugcauuu

SEQ ID NO: 876501 - RNA, 19 nt, Homo sapiens
ugaaagaugcaagcaccug

SEQ ID NO: 876502 - RNA, 13 nt, Homo sapiens
ugaaagauggguc

SEQ ID NO: 876503 - RNA, 11 nt, Homo sapiens
ugaaagcaauc

SEQ ID NO: 876504 - RNA, 11 nt, Homo sapiens
ugaaagcacag

SEQ ID NO: 876505 - RNA, 23 nt, Homo sapiens
ugaaaggaagcuccacugucacc

SEQ ID NO: 876506 - RNA, 21 nt, Homo sapiens
ugaaagggaaagucagcuuuc

SEQ ID NO: 876507 - RNA, 23 nt, Homo sapiens
ugaaaguaugugauaucugaaca

SEQ ID NO: 876508 - RNA, 16 nt, Homo sapiens
ugaaaucagucuacca

SEQ ID NO: 876509 - RNA, 21 nt, Homo sapiens
ugaaaucugguuagauaauga

SEQ ID NO: 876510 - RNA, 20 nt, Homo sapiens
ugaaaucuuugcagcaauga

SEQ ID NO: 876511 - RNA, 15 nt, Homo sapiens
ugaaaugacugucua

SEQ ID NO: 876512 - RNA, 14 nt, Homo sapiens
ugaaaugggcuuua

SEQ ID NO: 876513 - RNA, 20 nt, Homo sapiens
ugaaaugucuggucugucca

SEQ ID NO: 876514 - RNA, 20 nt, Homo sapiens
ugaacaaaaaaaacaaaaag

SEQ ID NO: 876515 - RNA, 14 nt, Homo sapiens
ugaacacacaugga

SEQ ID NO: 876516 - RNA, 23 nt, Homo sapiens
ugaacacacauggaugcacacac

SEQ ID NO: 876517 - RNA, 19 nt, Homo sapiens
ugaacacagccugggacca

SEQ ID NO: 876518 - RNA, 19 nt, Homo sapiens
ugaacaccacuuugucucu

SEQ ID NO: 876519 - RNA, 17 nt, Homo sapiens
ugaacaucucacuuugc

SEQ ID NO: 876520 - RNA, 18 nt, Homo sapiens
ugaacaugugaaguuaua

SEQ ID NO: 876521 - RNA, 12 nt, Homo sapiens
ugaacauuugcu

SEQ ID NO: 876522 - RNA, 13 nt, Homo sapiens
ugaaccacaucuu

SEQ ID NO: 876523 - RNA, 19 nt, Homo sapiens
ugaacccaggacaagcaug

SEQ ID NO: 876524 - RNA, 18 nt, Homo sapiens
ugaacgccaaacuaaagu

SEQ ID NO: 876525 - RNA, 22 nt, Homo sapiens
ugaacuggguacuuguggacac

SEQ ID NO: 876526 - RNA, 23 nt, Homo sapiens
ugaacugucagcccacagcagca

SEQ ID NO: 876527 - RNA, 16 nt, Homo sapiens
ugaacuuucacauagc

SEQ ID NO: 876528 - RNA, 15 nt, Homo sapiens
ugaagaaaacuccuu

SEQ ID NO: 876529 - RNA, 17 nt, Homo sapiens
ugaagaaaggaacugag

SEQ ID NO: 876530 - RNA, 12 nt, Homo sapiens
ugaagaaaggga

SEQ ID NO: 876531 - RNA, 12 nt, Homo sapiens
ugaagaacugac

SEQ ID NO: 876532 - RNA, 19 nt, Homo sapiens
ugaagaagaguuucuccuu

SEQ ID NO: 876533 - RNA, 13 nt, Homo sapiens
ugaagacccagug

SEQ ID NO: 876534 - RNA, 20 nt, Homo sapiens
ugaagacccuggaguucaaa

SEQ ID NO: 876535 - RNA, 14 nt, Homo sapiens
ugaagagauuucaa

SEQ ID NO: 876536 - RNA, 21 nt, Homo sapiens
ugaagagauuucaacauauca

SEQ ID NO: 876537 - RNA, 19 nt, Homo sapiens
ugaagagugagagggcaug

SEQ ID NO: 876538 - RNA, 22 nt, Homo sapiens
ugaagauacgguugcuucaccu

SEQ ID NO: 876539 - RNA, 21 nt, Homo sapiens
ugaagauggauguuugucaaa

SEQ ID NO: 876540 - RNA, 17 nt, Homo sapiens
ugaagauguaaggaauu

SEQ ID NO: 876541 - RNA, 18 nt, Homo sapiens
ugaagcaaccuacuuuug

SEQ ID NO: 876542 - RNA, 14 nt, Homo sapiens
ugaagccacugccu

SEQ ID NO: 876543 - RNA, 17 nt, Homo sapiens
ugaagccacugccuuca

SEQ ID NO: 876544 - RNA, 15 nt, Homo sapiens
ugaagccagauccac

SEQ ID NO: 876545 - RNA, 12 nt, Homo sapiens
ugaagcuggaag

SEQ ID NO: 876546 - RNA, 22 nt, Homo sapiens
ugaaggaggugagggaugugaa

SEQ ID NO: 876547 - RNA, 14 nt, Homo sapiens
ugaaggauaagaga

SEQ ID NO: 876548 - RNA, 12 nt, Homo sapiens
ugaaggccuuca

SEQ ID NO: 876549 - RNA, 14 nt, Homo sapiens
ugaaggcgugcaag

SEQ ID NO: 876550 - RNA, 16 nt, Homo sapiens
ugaaggguaaagaagu

SEQ ID NO: 876551 - RNA, 16 nt, Homo sapiens
ugaaggucacucuucc

SEQ ID NO: 876552 - RNA, 17 nt, Homo sapiens
ugaaggucuugccugaa

SEQ ID NO: 876553 - RNA, 18 nt, Homo sapiens
ugaaggugcugacaaaga

SEQ ID NO: 876554 - RNA, 16 nt, Homo sapiens
ugaaguagaauccuaa

SEQ ID NO: 876555 - RNA, 15 nt, Homo sapiens
ugaaguauuucucac

SEQ ID NO: 876556 - RNA, 23 nt, Homo sapiens
ugaagucaguuucuaucauucug

SEQ ID NO: 876557 - RNA, 17 nt, Homo sapiens
ugaagucaucagcuuug

SEQ ID NO: 876558 - RNA, 18 nt, Homo sapiens
ugaagugaugauggauga

SEQ ID NO: 876559 - RNA, 22 nt, Homo sapiens
ugaagugcaaauuugauacaua

SEQ ID NO: 876560 - RNA, 19 nt, Homo sapiens
ugaaguguaguggcaucca

SEQ ID NO: 876561 - RNA, 16 nt, Homo sapiens
ugaaguuacacaauua

SEQ ID NO: 876562 - RNA, 18 nt, Homo sapiens
ugaaguugcaaugcuuca

SEQ ID NO: 876563 - RNA, 22 nt, Homo sapiens
ugaaguuguguuaacaaugcag

SEQ ID NO: 876564 - RNA, 19 nt, Homo sapiens
ugaauaaaguugaagcuaa

SEQ ID NO: 876565 - RNA, 22 nt, Homo sapiens
ugaauaauuuucuggcacuggu

SEQ ID NO: 876566 - RNA, 22 nt, Homo sapiens
ugaauauaaauuuguguucuca

SEQ ID NO: 876567 - RNA, 12 nt, Homo sapiens
ugaauaucgaga

SEQ ID NO: 876568 - RNA, 20 nt, Homo sapiens
ugaauaucgagaacugccau

SEQ ID NO: 876569 - RNA, 17 nt, Homo sapiens
ugaaucagacccuaccc

SEQ ID NO: 876570 - RNA, 14 nt, Homo sapiens
ugaaucaggggcaa

SEQ ID NO: 876571 - RNA, 20 nt, Homo sapiens
ugaaucaggggcaaacggag

SEQ ID NO: 876572 - RNA, 19 nt, Homo sapiens
ugaaucccauaucuaccca

SEQ ID NO: 876573 - RNA, 15 nt, Homo sapiens
ugaaucuguacccuu

SEQ ID NO: 876574 - RNA, 19 nt, Homo sapiens
ugaaucuuucuuacuauug

SEQ ID NO: 876575 - RNA, 15 nt, Homo sapiens
ugaaucuuuuccacu

SEQ ID NO: 876576 - RNA, 15 nt, Homo sapiens
ugaaugcaaaccaua

SEQ ID NO: 876577 - RNA, 18 nt, Homo sapiens
ugaaugcacacuagccuc

SEQ ID NO: 876578 - RNA, 19 nt, Homo sapiens
ugaaugccucaaugugacc

SEQ ID NO: 876579 - RNA, 14 nt, Homo sapiens
ugaaugcuauugaa

SEQ ID NO: 876580 - RNA, 15 nt, Homo sapiens
ugaauggccugccuu

SEQ ID NO: 876581 - RNA, 22 nt, Homo sapiens
ugaaugguccaggguugaucac

SEQ ID NO: 876582 - RNA, 13 nt, Homo sapiens
ugaaugugucacu

SEQ ID NO: 876583 - RNA, 12 nt, Homo sapiens
ugaauguucaau

SEQ ID NO: 876584 - RNA, 13 nt, Homo sapiens
ugaauguuuccaa

SEQ ID NO: 876585 - RNA, 22 nt, Homo sapiens
ugaauguuugaacugccaagaa

SEQ ID NO: 876586 - RNA, 15 nt, Homo sapiens
ugaauucuuaugcuu

SEQ ID NO: 876587 - RNA, 14 nt, Homo sapiens
ugaauugucuucac

SEQ ID NO: 876588 - RNA, 17 nt, Homo sapiens
ugaauuugccuuccuca

SEQ ID NO: 876589 - RNA, 14 nt, Homo sapiens
guuucuggggacac

SEQ ID NO: 876590 - RNA, 13 nt, Homo sapiens
guuucuugccuca

SEQ ID NO: 876591 - RNA, 14 nt, Homo sapiens
guuucuugccucau

SEQ ID NO: 876592 - RNA, 21 nt, Homo sapiens
guuucuuggucucagcuucau

SEQ ID NO: 876593 - RNA, 15 nt, Homo sapiens
guuugagaccagccu

SEQ ID NO: 876594 - RNA, 23 nt, Homo sapiens
guuugaucccuguuacccagaga

SEQ ID NO: 876595 - RNA, 23 nt, Homo sapiens
guuuggccgggugcgguggcuca

SEQ ID NO: 876596 - RNA, 19 nt, Homo sapiens
guuugguuguaaaugcucg

SEQ ID NO: 876597 - RNA, 22 nt, Homo sapiens
guuuguugaugugaaacauuau

SEQ ID NO: 876598 - RNA, 20 nt, Homo sapiens
guuuuagagacuauggagcc

SEQ ID NO: 876599 - RNA, 21 nt, Homo sapiens
guuuuagcggucaauuugccu

SEQ ID NO: 876600 - RNA, 18 nt, Homo sapiens
guuuuauguucuagugau

SEQ ID NO: 876601 - RNA, 21 nt, Homo sapiens
guuuuauucugacuuccucug

SEQ ID NO: 876602 - RNA, 12 nt, Homo sapiens
guuuucaucucu

SEQ ID NO: 876603 - RNA, 15 nt, Homo sapiens
guuuuccacugugcu

SEQ ID NO: 876604 - RNA, 16 nt, Homo sapiens
guuuucuugccaauga

SEQ ID NO: 876605 - RNA, 16 nt, Homo sapiens
guuuugaaaugcagaa

SEQ ID NO: 876606 - RNA, 17 nt, Homo sapiens
guuuuggaagcucugaa

SEQ ID NO: 876607 - RNA, 23 nt, Homo sapiens
guuuuggaagcucugaagucaca

SEQ ID NO: 876608 - RNA, 17 nt, Homo sapiens
guuuugucucugcaucu

SEQ ID NO: 876609 - RNA, 20 nt, Homo sapiens
guuuugucucugcaucucau

SEQ ID NO: 876610 - RNA, 17 nt, Homo sapiens
guuuuuaaaaaucuguu

SEQ ID NO: 876611 - RNA, 12 nt, Homo sapiens
guuuuuuuccaa

SEQ ID NO: 876612 - RNA, 23 nt, Homo sapiens
guuuuuuuuuuccacuuagaaau

SEQ ID NO: 876613 - RNA, 23 nt, Homo sapiens
uaaaaaaaaaaaauggcuucaga

SEQ ID NO: 876614 - RNA, 22 nt, Homo sapiens
uaaaaaacauaaauuucuuuaa

SEQ ID NO: 876615 - RNA, 15 nt, Homo sapiens
uaaaaaacauuugua

SEQ ID NO: 876616 - RNA, 23 nt, Homo sapiens
uaaaaaaguuucuaguaucacau

SEQ ID NO: 876617 - RNA, 22 nt, Homo sapiens
uaaaaaauaaauauaauuggga

SEQ ID NO: 876618 - RNA, 21 nt, Homo sapiens
uaaaaacauaaaauauacaaa

SEQ ID NO: 876619 - RNA, 22 nt, Homo sapiens
uaaaaaccaaauaagcaucugu

SEQ ID NO: 876620 - RNA, 14 nt, Homo sapiens
uaaaaacuuccauc

SEQ ID NO: 876621 - RNA, 17 nt, Homo sapiens
uaaaaacuuccaucccu

SEQ ID NO: 876622 - RNA, 12 nt, Homo sapiens
uaaaaacuugua

SEQ ID NO: 876623 - RNA, 15 nt, Homo sapiens
uaaaaacuuguacua

SEQ ID NO: 876624 - RNA, 18 nt, Homo sapiens
uaaaaaguuaaucuucau

SEQ ID NO: 876625 - RNA, 14 nt, Homo sapiens
uaaaaaugcaacuu

SEQ ID NO: 876626 - RNA, 15 nt, Homo sapiens
uaaaaaugcaacuuc

SEQ ID NO: 876627 - RNA, 11 nt, Homo sapiens
uaaaacaaaca

SEQ ID NO: 876628 - RNA, 19 nt, Homo sapiens
uaaaacacaccuaagagaa

SEQ ID NO: 876629 - RNA, 12 nt, Homo sapiens
uaaaacaugugu

SEQ ID NO: 876630 - RNA, 23 nt, Homo sapiens
uaaaacauuauagauuuucaugu

SEQ ID NO: 876631 - RNA, 15 nt, Homo sapiens
uaaaaccacagcagu

SEQ ID NO: 876632 - RNA, 18 nt, Homo sapiens
uaaaaccugugugccauu

SEQ ID NO: 876633 - RNA, 22 nt, Homo sapiens
uaaaaccuuacuuaaagcuugu

SEQ ID NO: 876634 - RNA, 12 nt, Homo sapiens
uaaaaccuuuca

SEQ ID NO: 876635 - RNA, 16 nt, Homo sapiens
uaaaacuauauucuca

SEQ ID NO: 876636 - RNA, 12 nt, Homo sapiens
uaaaacuaucca

SEQ ID NO: 876637 - RNA, 19 nt, Homo sapiens
uaaaacuaugguucccaau

SEQ ID NO: 876638 - RNA, 22 nt, Homo sapiens
uaaaagaaaaaguaugugaaua

SEQ ID NO: 876639 - RNA, 19 nt, Homo sapiens
uaaaagaaccgagcaauuu

SEQ ID NO: 876640 - RNA, 14 nt, Homo sapiens
uaaaagaauauuca

SEQ ID NO: 876641 - RNA, 14 nt, Homo sapiens
uaaaagaccacaga

SEQ ID NO: 876642 - RNA, 15 nt, Homo sapiens
uaaaagauucacuaa

SEQ ID NO: 876643 - RNA, 11 nt, Homo sapiens
uaaaagcacuu

SEQ ID NO: 876644 - RNA, 12 nt, Homo sapiens
uaaaagcacuua

SEQ ID NO: 876645 - RNA, 19 nt, Homo sapiens
uaaaagcagcaucugcuaa

SEQ ID NO: 876646 - RNA, 18 nt, Homo sapiens
uaaaaguuucaaugugau

SEQ ID NO: 876647 - RNA, 20 nt, Homo sapiens
uaaaauaacuuauaucauca

SEQ ID NO: 876648 - RNA, 18 nt, Homo sapiens
uaaaauaaggcuccuuca

SEQ ID NO: 876649 - RNA, 17 nt, Homo sapiens
uaaaauaaguauuucca

SEQ ID NO: 876650 - RNA, 16 nt, Homo sapiens
uaaaauacacacucaa

SEQ ID NO: 876651 - RNA, 17 nt, Homo sapiens
uaaaauacacacucaaa

SEQ ID NO: 876652 - RNA, 22 nt, Homo sapiens
uaaaauagccacuuaccuucaa

SEQ ID NO: 876653 - RNA, 18 nt, Homo sapiens
uaaaauauauuucagaua

SEQ ID NO: 876654 - RNA, 21 nt, Homo sapiens
uaaaauauuuuuaugugcaau

SEQ ID NO: 876655 - RNA, 23 nt, Homo sapiens
uaaaauauuuuuaugugcaauaa

SEQ ID NO: 876656 - RNA, 16 nt, Homo sapiens
uaaaaucaggauuuua

SEQ ID NO: 876657 - RNA, 18 nt, Homo sapiens
uaaaaucauguacauuuc

SEQ ID NO: 876658 - RNA, 15 nt, Homo sapiens
uaaaaucuggcaaag

SEQ ID NO: 876659 - RNA, 16 nt, Homo sapiens
uaaaaucuuacuuugu

SEQ ID NO: 876660 - RNA, 18 nt, Homo sapiens
uaaaauuaugccauagca

SEQ ID NO: 876661 - RNA, 17 nt, Homo sapiens
uaaaauuuccacaagca

SEQ ID NO: 876662 - RNA, 14 nt, Homo sapiens
uaaacaaauaacaa

SEQ ID NO: 876663 - RNA, 18 nt, Homo sapiens
uaaacaaauguaugauua

SEQ ID NO: 876664 - RNA, 14 nt, Homo sapiens
uaaacaacuaccuc

SEQ ID NO: 876665 - RNA, 17 nt, Homo sapiens
uaaacacccaugaauca

SEQ ID NO: 876666 - RNA, 21 nt, Homo sapiens
uaaacagacuuuagcuuacag

SEQ ID NO: 876667 - RNA, 11 nt, Homo sapiens
uaaacaugaag

SEQ ID NO: 876668 - RNA, 12 nt, Homo sapiens
uaaacauucucu

SEQ ID NO: 876669 - RNA, 21 nt, Homo sapiens
uaaacauuugagagcuaacua

SEQ ID NO: 876670 - RNA, 19 nt, Homo sapiens
uaaacuauaaacuacugua

SEQ ID NO: 876671 - RNA, 17 nt, Homo sapiens
uaaacugaaaaauguca

SEQ ID NO: 876672 - RNA, 21 nt, Homo sapiens
uaaagaaaaguagguuuacau

SEQ ID NO: 876673 - RNA, 21 nt, Homo sapiens
uaaagaagucauaaacagcau

SEQ ID NO: 876674 - RNA, 16 nt, Homo sapiens
uaaagaauauuuacaa

SEQ ID NO: 876675 - RNA, 14 nt, Homo sapiens
uaaagaccugagaa

SEQ ID NO: 876676 - RNA, 14 nt, Homo sapiens
uuuaauagcaaaga

SEQ ID NO: 876677 - RNA, 16 nt, Homo sapiens
uuuaauauacuuuaaa

SEQ ID NO: 876678 - RNA, 19 nt, Homo sapiens
uuuaaucauuuugccucuu

SEQ ID NO: 876679 - RNA, 17 nt, Homo sapiens
uuuaaugccuuccacau

SEQ ID NO: 876680 - RNA, 17 nt, Homo sapiens
uuuaauuucuauggaag

SEQ ID NO: 876681 - RNA, 16 nt, Homo sapiens
uuuaauuugauaguau

SEQ ID NO: 876682 - RNA, 17 nt, Homo sapiens
uuuaauuuguuaucuca

SEQ ID NO: 876683 - RNA, 21 nt, Homo sapiens
uuuacaauccuaaucauauug

SEQ ID NO: 876684 - RNA, 15 nt, Homo sapiens
uuuacaaucugcacu

SEQ ID NO: 876685 - RNA, 20 nt, Homo sapiens
uuuacacauguaucuaugca

SEQ ID NO: 876686 - RNA, 18 nt, Homo sapiens
uuuacacucucuguacaa

SEQ ID NO: 876687 - RNA, 16 nt, Homo sapiens
uuuacagcucuuggca

SEQ ID NO: 876688 - RNA, 13 nt, Homo sapiens
uuuacagcugccu

SEQ ID NO: 876689 - RNA, 15 nt, Homo sapiens
uuuacauucaucuca

SEQ ID NO: 876690 - RNA, 21 nt, Homo sapiens
uuuacuggaccccgccuccca

SEQ ID NO: 876691 - RNA, 14 nt, Homo sapiens
uuuagcuaccucac

SEQ ID NO: 876692 - RNA, 23 nt, Homo sapiens
uuuagcuaccucacuaugcugcu

SEQ ID NO: 876693 - RNA, 19 nt, Homo sapiens
uuuaggaccaauaccuccu

SEQ ID NO: 876694 - RNA, 13 nt, Homo sapiens
uuuaggcauuaaa

SEQ ID NO: 876695 - RNA, 23 nt, Homo sapiens
uuuagucaacaugccauaucuca

SEQ ID NO: 876696 - RNA, 17 nt, Homo sapiens
uuuauaaauguguggug

SEQ ID NO: 876697 - RNA, 17 nt, Homo sapiens
uuuauacauaucagaaa

SEQ ID NO: 876698 - RNA, 18 nt, Homo sapiens
uuuauauuuuuauagaca

SEQ ID NO: 876699 - RNA, 14 nt, Homo sapiens
uuuaucugugacca

SEQ ID NO: 876700 - RNA, 17 nt, Homo sapiens
uuuaucuugucucuggg

SEQ ID NO: 876701 - RNA, 14 nt, Homo sapiens
uuuauguucucaga

SEQ ID NO: 876702 - RNA, 13 nt, Homo sapiens
uuuauuaccucug

SEQ ID NO: 876703 - RNA, 14 nt, Homo sapiens
uuuauugugaucua

SEQ ID NO: 876704 - RNA, 18 nt, Homo sapiens
uaaguaaguuugauuuca

SEQ ID NO: 876705 - RNA, 21 nt, Homo sapiens
uaaguaauugcauuucugcuc

SEQ ID NO: 876706 - RNA, 20 nt, Homo sapiens
uaagugggguugcaaccacu

SEQ ID NO: 876707 - RNA, 18 nt, Homo sapiens
uaagugguauauacauau

SEQ ID NO: 876708 - RNA, 15 nt, Homo sapiens
uaaguguuugucaua

SEQ ID NO: 876709 - RNA, 15 nt, Homo sapiens
uaaguuacuucacuu

SEQ ID NO: 876710 - RNA, 14 nt, Homo sapiens
uaaguuuaucuuuc

SEQ ID NO: 876711 - RNA, 13 nt, Homo sapiens
uaauaaacauccu

SEQ ID NO: 876712 - RNA, 14 nt, Homo sapiens
uaauaaguacugug

SEQ ID NO: 876713 - RNA, 14 nt, Homo sapiens
uaauacucaccucc

SEQ ID NO: 876714 - RNA, 14 nt, Homo sapiens
uaauagacacugga

SEQ ID NO: 876715 - RNA, 11 nt, Homo sapiens
uaauagccauc

SEQ ID NO: 876716 - RNA, 13 nt, Homo sapiens
uaauagcugcuag

SEQ ID NO: 876717 - RNA, 19 nt, Homo sapiens
uaauagcuuuuauuguaua

SEQ ID NO: 876718 - RNA, 16 nt, Homo sapiens
uaauagugacauauau

SEQ ID NO: 876719 - RNA, 17 nt, Homo sapiens
uaauauccacugcaaua

SEQ ID NO: 876720 - RNA, 21 nt, Homo sapiens
uaauaucugagaaguguauau

SEQ ID NO: 876721 - RNA, 20 nt, Homo sapiens
uaauaucugugaggugcuga

SEQ ID NO: 876722 - RNA, 14 nt, Homo sapiens
uaauaugcugccaa

SEQ ID NO: 876723 - RNA, 19 nt, Homo sapiens
uaauauggggaugcagcau

SEQ ID NO: 876724 - RNA, 14 nt, Homo sapiens
uaauauguucauua

SEQ ID NO: 876725 - RNA, 18 nt, Homo sapiens
uaauauucaacaauuaua

SEQ ID NO: 876726 - RNA, 21 nt, Homo sapiens
uaaucaaaacccaacaugacu

SEQ ID NO: 876727 - RNA, 18 nt, Homo sapiens
uaaucaguuuuauccaca

SEQ ID NO: 876728 - RNA, 17 nt, Homo sapiens
uaauccaucacuagcca

SEQ ID NO: 876729 - RNA, 14 nt, Homo sapiens
uaaucccagcacuu

SEQ ID NO: 876730 - RNA, 21 nt, Homo sapiens
uaaucccagcaugcugagauu

SEQ ID NO: 876731 - RNA, 20 nt, Homo sapiens
uaaucccagcuacuugggag

SEQ ID NO: 876732 - RNA, 12 nt, Homo sapiens
uaaucccaguuu

SEQ ID NO: 876733 - RNA, 18 nt, Homo sapiens
uaaucccccuugccaaau

SEQ ID NO: 876734 - RNA, 15 nt, Homo sapiens
uaaucguaagccaug

SEQ ID NO: 876735 - RNA, 11 nt, Homo sapiens
uaaucuaagaa

SEQ ID NO: 876736 - RNA, 15 nt, Homo sapiens
uaaucuaugcaugua

SEQ ID NO: 876737 - RNA, 13 nt, Homo sapiens
uaaucuguagggc

SEQ ID NO: 876738 - RNA, 15 nt, Homo sapiens
uaaucuucauggcca

SEQ ID NO: 876739 - RNA, 14 nt, Homo sapiens
uaaugaacauguga

SEQ ID NO: 876740 - RNA, 15 nt, Homo sapiens
uaaugaacugugaca

SEQ ID NO: 876741 - RNA, 17 nt, Homo sapiens
uaaugaagacccagugu

SEQ ID NO: 876742 - RNA, 19 nt, Homo sapiens
uaaugaagacccaguguaa

SEQ ID NO: 876743 - RNA, 19 nt, Homo sapiens
uaaugaaguuaagaaccug

SEQ ID NO: 876744 - RNA, 16 nt, Homo sapiens
uaaugauuagcacuua

SEQ ID NO: 876745 - RNA, 17 nt, Homo sapiens
uaaugauuagcacuuaa

SEQ ID NO: 876746 - RNA, 13 nt, Homo sapiens
uaaugcacucuca

SEQ ID NO: 876747 - RNA, 10 nt, Homo sapiens
uaaugccuuc

SEQ ID NO: 876748 - RNA, 16 nt, Homo sapiens
uaaugcucgucugugu

SEQ ID NO: 876749 - RNA, 17 nt, Homo sapiens
uaaugcuguugccucau

SEQ ID NO: 876750 - RNA, 21 nt, Homo sapiens
uaauggaaacauuuacaauaa

SEQ ID NO: 876751 - RNA, 13 nt, Homo sapiens
uaauggcacugau

SEQ ID NO: 876752 - RNA, 13 nt, Homo sapiens
uaaugggacacua

SEQ ID NO: 876753 - RNA, 14 nt, Homo sapiens
uaauguaugcauuc

SEQ ID NO: 876754 - RNA, 23 nt, Homo sapiens
uaaugugaaguagaauccuaaau

SEQ ID NO: 876755 - RNA, 18 nt, Homo sapiens
uaauguguuaagugcagg

SEQ ID NO: 876756 - RNA, 20 nt, Homo sapiens
uaauuaaacaagugcacuug

SEQ ID NO: 876757 - RNA, 21 nt, Homo sapiens
uaauuaaacaagugcacuuga

SEQ ID NO: 876758 - RNA, 19 nt, Homo sapiens
uaauuaaguaaaccaaaaa

SEQ ID NO: 876759 - RNA, 22 nt, Homo sapiens
uaauuacaauaaugaguucacu

SEQ ID NO: 876760 - RNA, 22 nt, Homo sapiens
uaauuacauccagaaagaagga

SEQ ID NO: 876761 - RNA, 17 nt, Homo sapiens
uaauuagaacaauagcu

SEQ ID NO: 876762 - RNA, 23 nt, Homo sapiens
uaauuagaacaauagcuauugca

SEQ ID NO: 876763 - RNA, 13 nt, Homo sapiens
uaauucauaauua

SEQ ID NO: 876764 - RNA, 13 nt, Homo sapiens
uaauucauggcau

SEQ ID NO: 876765 - RNA, 16 nt, Homo sapiens
uaauucauggcauuga

SEQ ID NO: 876766 - RNA, 14 nt, Homo sapiens
uaauuccaauauga

SEQ ID NO: 876767 - RNA, 12 nt, Homo sapiens
uaauucuacuaa

SEQ ID NO: 876768 - RNA, 18 nt, Homo sapiens
uaauucucaugugauccu

SEQ ID NO: 876769 - RNA, 20 nt, Homo sapiens
uaauucuuauuuaaguuauu

SEQ ID NO: 876770 - RNA, 13 nt, Homo sapiens
uaauugauuucaa

SEQ ID NO: 876771 - RNA, 14 nt, Homo sapiens
uaauugauuucaag

SEQ ID NO: 876772 - RNA, 18 nt, Homo sapiens
uaauuggaagaaauuccu

SEQ ID NO: 876773 - RNA, 16 nt, Homo sapiens
uaauuggcaugaaggu

SEQ ID NO: 876774 - RNA, 22 nt, Homo sapiens
uaauuugaaauuugacucauga

SEQ ID NO: 876775 - RNA, 15 nt, Homo sapiens
uaauuuucacucugg

SEQ ID NO: 876776 - RNA, 21 nt, Homo sapiens
uaauuuuccuggaaagacuga

SEQ ID NO: 876777 - RNA, 13 nt, Homo sapiens
uaauuuugucaaa

SEQ ID NO: 876778 - RNA, 20 nt, Homo sapiens
uaauuuuuuugagacagagu

SEQ ID NO: 876779 - RNA, 14 nt, Homo sapiens
uacaaaaacacagc

SEQ ID NO: 876780 - RNA, 16 nt, Homo sapiens
uacaaaaaugagcuag

SEQ ID NO: 876781 - RNA, 14 nt, Homo sapiens
uacaaaacuguuca

SEQ ID NO: 876782 - RNA, 22 nt, Homo sapiens
uacaaaauguacgaaacuguau

SEQ ID NO: 876783 - RNA, 20 nt, Homo sapiens
uacaaacaagcacagacauu

SEQ ID NO: 876784 - RNA, 14 nt, Homo sapiens
uacaaacauaucaa

SEQ ID NO: 876785 - RNA, 15 nt, Homo sapiens
uacaaccaauuccaa

SEQ ID NO: 876786 - RNA, 17 nt, Homo sapiens
uacaacuucaagugcau

SEQ ID NO: 876787 - RNA, 21 nt, Homo sapiens
uacaacuuccacuccaaguga

SEQ ID NO: 876788 - RNA, 15 nt, Homo sapiens
uacaagagccaugua

SEQ ID NO: 876789 - RNA, 23 nt, Homo sapiens
uacaagcauuuguuccaugccug

SEQ ID NO: 876790 - RNA, 16 nt, Homo sapiens
uacaaggacaaugccu

SEQ ID NO: 876791 - RNA, 16 nt, Homo sapiens
uacaagguuuggcaaa

SEQ ID NO: 876792 - RNA, 13 nt, Homo sapiens
uacaaguguauau

SEQ ID NO: 876793 - RNA, 16 nt, Homo sapiens
ucagaaguuuggauaa

SEQ ID NO: 876794 - RNA, 22 nt, Homo sapiens
ucagaaucauugaaguauuuuc

SEQ ID NO: 876795 - RNA, 17 nt, Homo sapiens
ucagaauccacucuucu

SEQ ID NO: 876796 - RNA, 12 nt, Homo sapiens
ucagacaugaaa

SEQ ID NO: 876797 - RNA, 21 nt, Homo sapiens
ucagaccaacucucuccugua

SEQ ID NO: 876798 - RNA, 15 nt, Homo sapiens
ucagaccaguacugg

SEQ ID NO: 876799 - RNA, 18 nt, Homo sapiens
ucagaccaguacugggaa

SEQ ID NO: 876800 - RNA, 20 nt, Homo sapiens
ucagacccuaccccaccacg

SEQ ID NO: 876801 - RNA, 17 nt, Homo sapiens
ucagacucccgcgugaa

SEQ ID NO: 876802 - RNA, 19 nt, Homo sapiens
ucagacuccugugcaacuu

SEQ ID NO: 876803 - RNA, 21 nt, Homo sapiens
ucagacuccugugcaacuuuc

SEQ ID NO: 876804 - RNA, 16 nt, Homo sapiens
ucagacuuacuuacuc

SEQ ID NO: 876805 - RNA, 20 nt, Homo sapiens
ucagagacuauuuagacaaa

SEQ ID NO: 876806 - RNA, 15 nt, Homo sapiens
ucagagcaggcucag

SEQ ID NO: 876807 - RNA, 20 nt, Homo sapiens
ucagagcuauguucccucca

SEQ ID NO: 876808 - RNA, 15 nt, Homo sapiens
ucagaggagccagaa

SEQ ID NO: 876809 - RNA, 18 nt, Homo sapiens
ucagagggcguguuguuu

SEQ ID NO: 876810 - RNA, 17 nt, Homo sapiens
ucagaguugcuuuucua

SEQ ID NO: 876811 - RNA, 20 nt, Homo sapiens
ucagauauuuuuucagaaau

SEQ ID NO: 876812 - RNA, 16 nt, Homo sapiens
ucagaucugaacacag

SEQ ID NO: 876813 - RNA, 16 nt, Homo sapiens
ucagauucuucucuua

SEQ ID NO: 876814 - RNA, 20 nt, Homo sapiens
ucagcaccccugucucuagc

SEQ ID NO: 876815 - RNA, 23 nt, Homo sapiens
ucagcacugaaaauaccaucagg

SEQ ID NO: 876816 - RNA, 21 nt, Homo sapiens
ucagccuccccccgcugggga

SEQ ID NO: 876817 - RNA, 19 nt, Homo sapiens
ucagccuccgccauuccaa

SEQ ID NO: 876818 - RNA, 15 nt, Homo sapiens
ucagcuguaccaagc

SEQ ID NO: 876819 - RNA, 17 nt, Homo sapiens
ucagcuucaaggaguau

SEQ ID NO: 876820 - RNA, 14 nt, Homo sapiens
ucaggaaaacugac

SEQ ID NO: 876821 - RNA, 20 nt, Homo sapiens
ucaggaaaucaaauaugcaa

SEQ ID NO: 876822 - RNA, 15 nt, Homo sapiens
ucaggaauacauuug

SEQ ID NO: 876823 - RNA, 17 nt, Homo sapiens
ucaggaauacauuugga

SEQ ID NO: 876824 - RNA, 19 nt, Homo sapiens
ucaggaauacauuuggaaa

SEQ ID NO: 876825 - RNA, 23 nt, Homo sapiens
ucaggagaggggcagaacagccg

SEQ ID NO: 876826 - RNA, 13 nt, Homo sapiens
ucaggagucccaa

SEQ ID NO: 876827 - RNA, 15 nt, Homo sapiens
ucaggauaccauaua

SEQ ID NO: 876828 - RNA, 15 nt, Homo sapiens
ucaggaucaucugag

SEQ ID NO: 876829 - RNA, 19 nt, Homo sapiens
ucaggauuucauugacuga

SEQ ID NO: 876830 - RNA, 23 nt, Homo sapiens
ucaggcccagagaagcaaguggc

SEQ ID NO: 876831 - RNA, 15 nt, Homo sapiens
ucaggcuucugagua

SEQ ID NO: 876832 - RNA, 19 nt, Homo sapiens
ucaggggccugcccagugc

SEQ ID NO: 876833 - RNA, 14 nt, Homo sapiens
ucagguaguacugg

SEQ ID NO: 876834 - RNA, 16 nt, Homo sapiens
ucagguaguacuggga

SEQ ID NO: 876835 - RNA, 22 nt, Homo sapiens
ucagguauagcugacaucuccu

SEQ ID NO: 876836 - RNA, 19 nt, Homo sapiens
ucaggugcauuccaccaca

SEQ ID NO: 876837 - RNA, 14 nt, Homo sapiens
ucagguggaaaaac

SEQ ID NO: 876838 - RNA, 16 nt, Homo sapiens
ucagguggggcagcuu

SEQ ID NO: 876839 - RNA, 18 nt, Homo sapiens
ucaguauaaaagacaaaa

SEQ ID NO: 876840 - RNA, 13 nt, Homo sapiens
ucagucacuugaa

SEQ ID NO: 876841 - RNA, 13 nt, Homo sapiens
ucaguccuggaag

SEQ ID NO: 876842 - RNA, 17 nt, Homo sapiens
ucagucuagcuuuuaag

SEQ ID NO: 876843 - RNA, 14 nt, Homo sapiens
ucagugaaagccag

SEQ ID NO: 876844 - RNA, 22 nt, Homo sapiens
ucagugacagaguucacuauaa

SEQ ID NO: 876845 - RNA, 23 nt, Homo sapiens
ucagugacagaguucacuauaaa

SEQ ID NO: 876846 - RNA, 21 nt, Homo sapiens
ucaguguaugauauacuuuau

SEQ ID NO: 876847 - RNA, 19 nt, Homo sapiens
ucaguguccucuugcucaa

SEQ ID NO: 876848 - RNA, 14 nt, Homo sapiens
ucaguuggagaaaa

SEQ ID NO: 876849 - RNA, 17 nt, Homo sapiens
ucaguuguuccuacuca

SEQ ID NO: 876850 - RNA, 21 nt, Homo sapiens
ucauaaaaguagcaaccuuca

SEQ ID NO: 876851 - RNA, 16 nt, Homo sapiens
ucauaaacagcauuua

SEQ ID NO: 876852 - RNA, 15 nt, Homo sapiens
ucauaaauauaaucu

SEQ ID NO: 876853 - RNA, 14 nt, Homo sapiens
ucauaaccauuccc

SEQ ID NO: 876854 - RNA, 20 nt, Homo sapiens
ucauaaggcauauacaaaua

SEQ ID NO: 876855 - RNA, 22 nt, Homo sapiens
ucauaauguuaacuaaauaacu

SEQ ID NO: 876856 - RNA, 12 nt, Homo sapiens
ucauaccacaau

SEQ ID NO: 876857 - RNA, 16 nt, Homo sapiens
ucauaccaucugcugc

SEQ ID NO: 876858 - RNA, 16 nt, Homo sapiens
ucauaccucugaccaa

SEQ ID NO: 876859 - RNA, 16 nt, Homo sapiens
ucauacuuggacaguu

SEQ ID NO: 876860 - RNA, 15 nt, Homo sapiens
ucauagcugagauuc

SEQ ID NO: 876861 - RNA, 20 nt, Homo sapiens
ucauaggaaaaguacauuua

SEQ ID NO: 876862 - RNA, 12 nt, Homo sapiens
ucauaucuuccu

SEQ ID NO: 876863 - RNA, 21 nt, Homo sapiens
ucauaucuuccucaucaguag

SEQ ID NO: 876864 - RNA, 17 nt, Homo sapiens
ucauaugacaugccacc

SEQ ID NO: 876865 - RNA, 12 nt, Homo sapiens
ucauauguauuu

SEQ ID NO: 876866 - RNA, 22 nt, Homo sapiens
ucauauuggacugauaaucucu

SEQ ID NO: 876867 - RNA, 20 nt, Homo sapiens
ucaucaaauauuaccaaaaa

SEQ ID NO: 876868 - RNA, 21 nt, Homo sapiens
ucaucaacaaagaaauauuau

SEQ ID NO: 876869 - RNA, 19 nt, Homo sapiens
ucaucacuggaugaagauu

SEQ ID NO: 876870 - RNA, 17 nt, Homo sapiens
ucaucagccuuccugac

SEQ ID NO: 876871 - RNA, 18 nt, Homo sapiens
ucaucauacaugacucag

SEQ ID NO: 876872 - RNA, 19 nt, Homo sapiens
ucaucauauuguauguaag

SEQ ID NO: 876873 - RNA, 12 nt, Homo sapiens
ucaucauggcaa

SEQ ID NO: 876874 - RNA, 21 nt, Homo sapiens
ucauccuccuuauaagcccag

SEQ ID NO: 876875 - RNA, 19 nt, Homo sapiens
ucaucuacaagcauuugcc

SEQ ID NO: 876876 - RNA, 15 nt, Homo sapiens
ucaucuacuacaggg

SEQ ID NO: 876877 - RNA, 16 nt, Homo sapiens
ucaucuauaacaugca

SEQ ID NO: 876878 - RNA, 14 nt, Homo sapiens
ucaucucacugccc

SEQ ID NO: 876879 - RNA, 20 nt, Homo sapiens
ucaucucaggccucccucaa

SEQ ID NO: 876880 - RNA, 16 nt, Homo sapiens
ucaucugaaaaucugg

SEQ ID NO: 876881 - RNA, 21 nt, Homo sapiens
ucaucuugcccccucaucuca

SEQ ID NO: 876882 - RNA, 18 nt, Homo sapiens
ucaucuuggccacuuuaa

SEQ ID NO: 876883 - RNA, 16 nt, Homo sapiens
ucaugacacuauacag

SEQ ID NO: 876884 - RNA, 16 nt, Homo sapiens
ucaugacauguuauau

SEQ ID NO: 876885 - RNA, 18 nt, Homo sapiens
ucaugacccuccugucca

SEQ ID NO: 876886 - RNA, 19 nt, Homo sapiens
ucaugaguaccucaaagga

SEQ ID NO: 876887 - RNA, 16 nt, Homo sapiens
uccucgguacucccau

SEQ ID NO: 876888 - RNA, 13 nt, Homo sapiens
uccucuccacugc

SEQ ID NO: 876889 - RNA, 19 nt, Homo sapiens
uccucuccccagcaaguga

SEQ ID NO: 876890 - RNA, 17 nt, Homo sapiens
uccucucccugcaccug

SEQ ID NO: 876891 - RNA, 15 nt, Homo sapiens
uccucugccaccucc

SEQ ID NO: 876892 - RNA, 12 nt, Homo sapiens
uccucugcugac

SEQ ID NO: 876893 - RNA, 17 nt, Homo sapiens
uccucugcuugcaucac

SEQ ID NO: 876894 - RNA, 19 nt, Homo sapiens
uccucuguccaggcacugc

SEQ ID NO: 876895 - RNA, 11 nt, Homo sapiens
uccucuucuau

SEQ ID NO: 876896 - RNA, 14 nt, Homo sapiens
uccugaagccucug

SEQ ID NO: 876897 - RNA, 19 nt, Homo sapiens
uccugacagaaggacucag

SEQ ID NO: 876898 - RNA, 13 nt, Homo sapiens
uccugacccuccc

SEQ ID NO: 876899 - RNA, 21 nt, Homo sapiens
uccugauaaacauuaaacacu

SEQ ID NO: 876900 - RNA, 15 nt, Homo sapiens
uccugauuucaggga

SEQ ID NO: 876901 - RNA, 20 nt, Homo sapiens
uccugcacgccguggagcau

SEQ ID NO: 876902 - RNA, 21 nt, Homo sapiens
uccugcagccuccuccugacc

SEQ ID NO: 876903 - RNA, 18 nt, Homo sapiens
uccugccacugaccucac

SEQ ID NO: 876904 - RNA, 11 nt, Homo sapiens
uccugcccaua

SEQ ID NO: 876905 - RNA, 16 nt, Homo sapiens
ugacacauaugcaccu

SEQ ID NO: 876906 - RNA, 21 nt, Homo sapiens
ugacaccgucccucagugaua

SEQ ID NO: 876907 - RNA, 23 nt, Homo sapiens
ugacaccgucccucagugauacg

SEQ ID NO: 876908 - RNA, 14 nt, Homo sapiens
ugacaccucacuga

SEQ ID NO: 876909 - RNA, 15 nt, Homo sapiens
ugacaccucacugag

SEQ ID NO: 876910 - RNA, 14 nt, Homo sapiens
ugacagaacacugu

SEQ ID NO: 876911 - RNA, 16 nt, Homo sapiens
ugacagacacaggccc

SEQ ID NO: 876912 - RNA, 16 nt, Homo sapiens
ugacagagacccagau

SEQ ID NO: 876913 - RNA, 19 nt, Homo sapiens
ugacagaguucacuauaaa

SEQ ID NO: 876914 - RNA, 14 nt, Homo sapiens
ugacagcacuacaa

SEQ ID NO: 876915 - RNA, 16 nt, Homo sapiens
ugacaggaaagcccuc

SEQ ID NO: 876916 - RNA, 14 nt, Homo sapiens
ugacaggaagccca

SEQ ID NO: 876917 - RNA, 16 nt, Homo sapiens
ugacaggauguggcac

SEQ ID NO: 876918 - RNA, 18 nt, Homo sapiens
ugacaguaaaucacacaa

SEQ ID NO: 876919 - RNA, 21 nt, Homo sapiens
ugacaguauauuugaaacugu

SEQ ID NO: 876920 - RNA, 13 nt, Homo sapiens
ugacaguaugcau

SEQ ID NO: 876921 - RNA, 18 nt, Homo sapiens
ugacagugcccagcauga

SEQ ID NO: 876922 - RNA, 20 nt, Homo sapiens
ugacaguggaacuacauuag

SEQ ID NO: 876923 - RNA, 18 nt, Homo sapiens
ugacauauauauguauau

SEQ ID NO: 876924 - RNA, 21 nt, Homo sapiens
ugacaucuuauuuacuuguag

SEQ ID NO: 876925 - RNA, 14 nt, Homo sapiens
ugacaugcacugac

SEQ ID NO: 876926 - RNA, 15 nt, Homo sapiens
ugacaugcacugacc

SEQ ID NO: 876927 - RNA, 17 nt, Homo sapiens
ugacaugcaucaucuca

SEQ ID NO: 876928 - RNA, 13 nt, Homo sapiens
ugacauuaagaca

SEQ ID NO: 876929 - RNA, 19 nt, Homo sapiens
ugacauuucuaacauaugu

SEQ ID NO: 876930 - RNA, 10 nt, Homo sapiens
ugaccaaaua

SEQ ID NO: 876931 - RNA, 20 nt, Homo sapiens
ugaccaaauaaaguaccauu

SEQ ID NO: 876932 - RNA, 24 nt, Homo sapiens
ugaccaaguuauaaaucaauguca

SEQ ID NO: 876933 - RNA, 22 nt, Homo sapiens
ugaccaggcauccuccacaaua

SEQ ID NO: 876934 - RNA, 23 nt, Homo sapiens
ugacccaagagguggggaccaaa

SEQ ID NO: 876935 - RNA, 23 nt, Homo sapiens
ugaccccuguccccacacugacc

SEQ ID NO: 876936 - RNA, 21 nt, Homo sapiens
ugacccuccaccgcagaagga

SEQ ID NO: 876937 - RNA, 16 nt, Homo sapiens
ugacccuuccagacau

SEQ ID NO: 876938 - RNA, 23 nt, Homo sapiens
ugaccgagucuaggaaugcuuuu

SEQ ID NO: 876939 - RNA, 14 nt, Homo sapiens
ugaccucacaguga

SEQ ID NO: 876940 - RNA, 12 nt, Homo sapiens
ugaccucagcug

SEQ ID NO: 876941 - RNA, 21 nt, Homo sapiens
ugaccucagcugcacauuccu

SEQ ID NO: 876942 - RNA, 22 nt, Homo sapiens
ugaccugcugugcaccuuacau

SEQ ID NO: 876943 - RNA, 23 nt, Homo sapiens
ugaccuguuagaugugacacauu

SEQ ID NO: 876944 - RNA, 22 nt, Homo sapiens
ugacguuggccuaacacugggc

SEQ ID NO: 876945 - RNA, 22 nt, Homo sapiens
ugacuaaacaacuaccuccuca

SEQ ID NO: 876946 - RNA, 12 nt, Homo sapiens
ugacuaccagcu

SEQ ID NO: 876947 - RNA, 20 nt, Homo sapiens
ugacuagaccccacccugag

SEQ ID NO: 876948 - RNA, 17 nt, Homo sapiens
ugacuaucacauacaau

SEQ ID NO: 876949 - RNA, 16 nt, Homo sapiens
ugacuccuuucucuaa

SEQ ID NO: 876950 - RNA, 13 nt, Homo sapiens
ugacucgguguaa

SEQ ID NO: 876951 - RNA, 12 nt, Homo sapiens
ugacucuugccu

SEQ ID NO: 876952 - RNA, 14 nt, Homo sapiens
ugacugaaacauuc

SEQ ID NO: 876953 - RNA, 11 nt, Homo sapiens
ugacugaugac

SEQ ID NO: 876954 - RNA, 22 nt, Homo sapiens
ugacuucugccccagcuuuauc

SEQ ID NO: 876955 - RNA, 19 nt, Homo sapiens
ugagaaaagcuuugaaccc

SEQ ID NO: 876956 - RNA, 21 nt, Homo sapiens
ugagaaacaugaauuauuucc

SEQ ID NO: 876957 - RNA, 18 nt, Homo sapiens
ugagaaagacuauucaaa

SEQ ID NO: 876958 - RNA, 14 nt, Homo sapiens
ugagaaaguucuca

SEQ ID NO: 876959 - RNA, 21 nt, Homo sapiens
ugagaacaagucacagcugca

SEQ ID NO: 876960 - RNA, 22 nt, Homo sapiens
ugagaacagacguuaccaauua

SEQ ID NO: 876961 - RNA, 14 nt, Homo sapiens
ugagaagaaugacu

SEQ ID NO: 876962 - RNA, 20 nt, Homo sapiens
ugagaaggacaccuccuucc

SEQ ID NO: 876963 - RNA, 18 nt, Homo sapiens
ugagaaucacuugaacuc

SEQ ID NO: 876964 - RNA, 12 nt, Homo sapiens
ugagacaaucac

SEQ ID NO: 876965 - RNA, 18 nt, Homo sapiens
ugagaccagccuggccaa

SEQ ID NO: 876966 - RNA, 21 nt, Homo sapiens
ugagacccucgccacggggag

SEQ ID NO: 876967 - RNA, 14 nt, Homo sapiens
ugagagacccaagg

SEQ ID NO: 876968 - RNA, 20 nt, Homo sapiens
ugagagcccuucaugcauuu

SEQ ID NO: 876969 - RNA, 17 nt, Homo sapiens
ugagaguaaugaggcuu

SEQ ID NO: 876970 - RNA, 17 nt, Homo sapiens
ugagaucguuguuuaca

SEQ ID NO: 876971 - RNA, 17 nt, Homo sapiens
ugagaugggacauucca

SEQ ID NO: 876972 - RNA, 13 nt, Homo sapiens
ugagauuacaggu

SEQ ID NO: 876973 - RNA, 17 nt, Homo sapiens
ugagcaaggacaaccug

SEQ ID NO: 876974 - RNA, 16 nt, Homo sapiens
ugagcacaucugggag

SEQ ID NO: 876975 - RNA, 18 nt, Homo sapiens
ugagcaugcacagcugcu

SEQ ID NO: 876976 - RNA, 20 nt, Homo sapiens
ugagccaaacacacuguaaa

SEQ ID NO: 876977 - RNA, 20 nt, Homo sapiens
ugagccaugaucgagccacu

SEQ ID NO: 876978 - RNA, 17 nt, Homo sapiens
ugagcucaggcauuuga

SEQ ID NO: 876979 - RNA, 16 nt, Homo sapiens
ugagcuccccaaaaac

SEQ ID NO: 876980 - RNA, 21 nt, Homo sapiens
ugagcucuucauguuucagga

SEQ ID NO: 876981 - RNA, 17 nt, Homo sapiens
ugagcuggaucacuuga

SEQ ID NO: 876982 - RNA, 14 nt, Homo sapiens
ugagcuggcccuuu

SEQ ID NO: 876983 - RNA, 17 nt, Homo sapiens
ugagcugggcaccacag

SEQ ID NO: 876984 - RNA, 14 nt, Homo sapiens
ugagcuucaguaua

SEQ ID NO: 876985 - RNA, 14 nt, Homo sapiens
ugaggaagccuaaa

SEQ ID NO: 876986 - RNA, 13 nt, Homo sapiens
ugaggacauggag

SEQ ID NO: 876987 - RNA, 17 nt, Homo sapiens
ugaggauguguuuugca

SEQ ID NO: 876988 - RNA, 13 nt, Homo sapiens
ugaggauuucaag

SEQ ID NO: 876989 - RNA, 19 nt, Homo sapiens
ugaggcagggcaaaugaca

SEQ ID NO: 876990 - RNA, 16 nt, Homo sapiens
ugaggcauuuuuacua

SEQ ID NO: 876991 - RNA, 18 nt, Homo sapiens
ugaggcuccugugcuacu

SEQ ID NO: 876992 - RNA, 16 nt, Homo sapiens
ugagggaaaaugagua

SEQ ID NO: 876993 - RNA, 16 nt, Homo sapiens
ugagggaagacgccuu

SEQ ID NO: 876994 - RNA, 16 nt, Homo sapiens
ugaggggcuccuggaa

SEQ ID NO: 876995 - RNA, 22 nt, Homo sapiens
ugaggggcuccuggaaaggcuc

SEQ ID NO: 876996 - RNA, 18 nt, Homo sapiens
ugagggucuuugcaagaa

SEQ ID NO: 876997 - RNA, 22 nt, Homo sapiens
ugagguacagcagaaaggagaa

SEQ ID NO: 876998 - RNA, 17 nt, Homo sapiens
ugaggugcccaggagaa

SEQ ID NO: 876999 - RNA, 19 nt, Homo sapiens
ugagguggugccuucucac

SEQ ID NO: 877000 - RNA, 20 nt, Homo sapiens
ugagucaccaagcccaguua

SEQ ID NO: 877001 - RNA, 15 nt, Homo sapiens
ugagucuccugugcc

SEQ ID NO: 877002 - RNA, 20 nt, Homo sapiens
ugagucugaguccugucucu

SEQ ID NO: 877003 - RNA, 21 nt, Homo sapiens
ugagucuuggccugccuccca

SEQ ID NO: 877004 - RNA, 18 nt, Homo sapiens
ugagugaauagcuuucag

SEQ ID NO: 877005 - RNA, 21 nt, Homo sapiens
ugagugagaggguuugaguca

SEQ ID NO: 877006 - RNA, 16 nt, Homo sapiens
ugagugcuccugugug

SEQ ID NO: 877007 - RNA, 18 nt, Homo sapiens
ugaguggaucuccaagga

SEQ ID NO: 877008 - RNA, 18 nt, Homo sapiens
uggugcagccuacacuau

SEQ ID NO: 877009 - RNA, 20 nt, Homo sapiens
uggugcuguggccaggguga

SEQ ID NO: 877010 - RNA, 15 nt, Homo sapiens
ugguggaucugucca

SEQ ID NO: 877011 - RNA, 12 nt, Homo sapiens
uggugggaauca

SEQ ID NO: 877012 - RNA, 14 nt, Homo sapiens
ugguggucagggag

SEQ ID NO: 877013 - RNA, 14 nt, Homo sapiens
ugguguauuugcca

SEQ ID NO: 877014 - RNA, 15 nt, Homo sapiens
ugguguauuugccag

SEQ ID NO: 877015 - RNA, 13 nt, Homo sapiens
ugguguccagaca

SEQ ID NO: 877016 - RNA, 16 nt, Homo sapiens
uggugucuagcauuaa

SEQ ID NO: 877017 - RNA, 12 nt, Homo sapiens
uggugucugucc

SEQ ID NO: 877018 - RNA, 16 nt, Homo sapiens
uggugugucaaugcca

SEQ ID NO: 877019 - RNA, 19 nt, Homo sapiens
ugguguucaaaaaaacacu

SEQ ID NO: 877020 - RNA, 12 nt, Homo sapiens
ugguucucucca

SEQ ID NO: 877021 - RNA, 22 nt, Homo sapiens
ugguugcauuugucaaagcauu

SEQ ID NO: 877022 - RNA, 22 nt, Homo sapiens
ugguuggccgugguccagcucu

SEQ ID NO: 877023 - RNA, 21 nt, Homo sapiens
ugguuuucacauacacucaaa

SEQ ID NO: 877024 - RNA, 18 nt, Homo sapiens
uguaaaacuauauucuca

SEQ ID NO: 877025 - RNA, 17 nt, Homo sapiens
uguaaaauagaauguua

SEQ ID NO: 877026 - RNA, 23 nt, Homo sapiens
uguaaaaugucuguuaacuuaau

SEQ ID NO: 877027 - RNA, 12 nt, Homo sapiens
uguaaacaugaa

SEQ ID NO: 877028 - RNA, 22 nt, Homo sapiens
uguaaacauucaucaagcugua

SEQ ID NO: 877029 - RNA, 22 nt, Homo sapiens
uguaaaccaucgcgugcaauga

SEQ ID NO: 877030 - RNA, 17 nt, Homo sapiens
uguaaagaauaaaugaa

SEQ ID NO: 877031 - RNA, 18 nt, Homo sapiens
uguaaagaauaaaugaau

SEQ ID NO: 877032 - RNA, 22 nt, Homo sapiens
uguaaagaguggagcaaaugcu

SEQ ID NO: 877033 - RNA, 15 nt, Homo sapiens
uguaaaucacuugua

SEQ ID NO: 877034 - RNA, 17 nt, Homo sapiens
uguaaaugaccaagaaa

SEQ ID NO: 877035 - RNA, 14 nt, Homo sapiens
uguaaaugcauuag

SEQ ID NO: 877036 - RNA, 18 nt, Homo sapiens
uguaaaugccacaaagaa

SEQ ID NO: 877037 - RNA, 19 nt, Homo sapiens
uguaacaugcaauuuugca

SEQ ID NO: 877038 - RNA, 15 nt, Homo sapiens
uguaacauuaauucu

SEQ ID NO: 877039 - RNA, 17 nt, Homo sapiens
uguaacuucuuaaucua

SEQ ID NO: 877040 - RNA, 15 nt, Homo sapiens
uguaagacucauucc

SEQ ID NO: 877041 - RNA, 17 nt, Homo sapiens
uguaagauuuagcaccc

SEQ ID NO: 877042 - RNA, 14 nt, Homo sapiens
uguaagcacugacu

SEQ ID NO: 877043 - RNA, 18 nt, Homo sapiens
uguaagcauucugagcug

SEQ ID NO: 877044 - RNA, 15 nt, Homo sapiens
uguaagguaauuucu

SEQ ID NO: 877045 - RNA, 23 nt, Homo sapiens
uguaaguaccccugauaagcaaa

SEQ ID NO: 877046 - RNA, 18 nt, Homo sapiens
uguaaguuuaugucuaaa

SEQ ID NO: 877047 - RNA, 13 nt, Homo sapiens
uguaauaaacucu

SEQ ID NO: 877048 - RNA, 15 nt, Homo sapiens
uguaauaaacucucu

SEQ ID NO: 877049 - RNA, 19 nt, Homo sapiens
uguaauaaacucucuaggg

SEQ ID NO: 877050 - RNA, 16 nt, Homo sapiens
uguaauagugacauau

SEQ ID NO: 877051 - RNA, 20 nt, Homo sapiens
uguaaucccagcacuuuggc

SEQ ID NO: 877052 - RNA, 14 nt, Homo sapiens
uguaauugcuacau

SEQ ID NO: 877053 - RNA, 11 nt, Homo sapiens
uguacacugug

SEQ ID NO: 877054 - RNA, 16 nt, Homo sapiens
uguacauauauauucu

SEQ ID NO: 877055 - RNA, 17 nt, Homo sapiens
uguacauuugagugucu

SEQ ID NO: 877056 - RNA, 19 nt, Homo sapiens
uguaccaagccccuuggcc

SEQ ID NO: 877057 - RNA, 13 nt, Homo sapiens
uguaccauguaca

SEQ ID NO: 877058 - RNA, 15 nt, Homo sapiens
uguacuaagcaguaa

SEQ ID NO: 877059 - RNA, 15 nt, Homo sapiens
uguacuuccugugua

SEQ ID NO: 877060 - RNA, 10 nt, Homo sapiens
uguacuugug

SEQ ID NO: 877061 - RNA, 22 nt, Homo sapiens
uguacuuuauuuguauuugcca

SEQ ID NO: 877062 - RNA, 13 nt, Homo sapiens
uguagaacuucaa

SEQ ID NO: 877063 - RNA, 16 nt, Homo sapiens
uguagaauaaaugaag

SEQ ID NO: 877064 - RNA, 16 nt, Homo sapiens
uguagagcuucuggca

SEQ ID NO: 877065 - RNA, 20 nt, Homo sapiens
uguagcaauagguagcugac

SEQ ID NO: 877066 - RNA, 13 nt, Homo sapiens
uguagcagugaga

SEQ ID NO: 877067 - RNA, 15 nt, Homo sapiens
uguagcauuucuuga

SEQ ID NO: 877068 - RNA, 14 nt, Homo sapiens
uguagccccaguga

SEQ ID NO: 877069 - RNA, 22 nt, Homo sapiens
uguagccucgccgucugugaau

SEQ ID NO: 877070 - RNA, 21 nt, Homo sapiens
uguagcggugaagaguacaga

SEQ ID NO: 877071 - RNA, 23 nt, Homo sapiens
uguagcuuugcucuuugguagaa

SEQ ID NO: 877072 - RNA, 18 nt, Homo sapiens
uguaguccuagccacuca

SEQ ID NO: 877073 - RNA, 22 nt, Homo sapiens
uguagugucuguaauaccuuag

SEQ ID NO: 877074 - RNA, 15 nt, Homo sapiens
uguauaaacuaucag

SEQ ID NO: 877075 - RNA, 21 nt, Homo sapiens
uguauacagauucuagccaaa

SEQ ID NO: 877076 - RNA, 17 nt, Homo sapiens
uguauauaaaugaacaa

SEQ ID NO: 877077 - RNA, 20 nt, Homo sapiens
uguauaucaugaaacacuuc

SEQ ID NO: 877078 - RNA, 20 nt, Homo sapiens
uguauauuccaccauucaca

SEQ ID NO: 877079 - RNA, 22 nt, Homo sapiens
uguauauugguugaaacuguua

SEQ ID NO: 877080 - RNA, 18 nt, Homo sapiens
uguaucaaaaucacuauc

SEQ ID NO: 877081 - RNA, 22 nt, Homo sapiens
uguaucagaguugcuuuucuaa

SEQ ID NO: 877082 - RNA, 17 nt, Homo sapiens
uguaucauuugaacaac

SEQ ID NO: 877083 - RNA, 19 nt, Homo sapiens
uguaucccaacuccuauaa

SEQ ID NO: 877084 - RNA, 17 nt, Homo sapiens
uguaucggagacaguga

SEQ ID NO: 877085 - RNA, 20 nt, Homo sapiens
uguaucuguaauuaauauuc

SEQ ID NO: 877086 - RNA, 23 nt, Homo sapiens
uguaucuucugcagacacugugg

SEQ ID NO: 877087 - RNA, 15 nt, Homo sapiens
uguaugcucauacuu

SEQ ID NO: 877088 - RNA, 17 nt, Homo sapiens
uguauguuccucuauga

SEQ ID NO: 877089 - RNA, 18 nt, Homo sapiens
uguauuguuaaugcauca

SEQ ID NO: 877090 - RNA, 12 nt, Homo sapiens
uguauuugccag

SEQ ID NO: 877091 - RNA, 19 nt, Homo sapiens
uguauuugucaaugcauca

SEQ ID NO: 877092 - RNA, 14 nt, Homo sapiens
uguauuuguuccca

SEQ ID NO: 877093 - RNA, 18 nt, Homo sapiens
uguauuuuugucauagca

SEQ ID NO: 877094 - RNA, 19 nt, Homo sapiens
uguauuuuuuccuguaaga

SEQ ID NO: 877095 - RNA, 14 nt, Homo sapiens
ugucaaguacaagc

SEQ ID NO: 877096 - RNA, 12 nt, Homo sapiens
ugucaaugauac

SEQ ID NO: 877097 - RNA, 22 nt, Homo sapiens
ugucaccagcuaucugucaucu

SEQ ID NO: 877098 - RNA, 20 nt, Homo sapiens
ugucaccucagcugauauua

SEQ ID NO: 877099 - RNA, 17 nt, Homo sapiens
ugucaccuugcucagcc

SEQ ID NO: 877100 - RNA, 14 nt, Homo sapiens
ugucacuaugcuau

SEQ ID NO: 877101 - RNA, 18 nt, Homo sapiens
ugucagaaacucgaugaa

SEQ ID NO: 877102 - RNA, 13 nt, Homo sapiens
ugucagaguagaa

SEQ ID NO: 877103 - RNA, 17 nt, Homo sapiens
ugucagcccacagcagc

SEQ ID NO: 877104 - RNA, 14 nt, Homo sapiens
ugucaggacaccag

SEQ ID NO: 877105 - RNA, 19 nt, Homo sapiens
ugucaguuacaauaugaga

SEQ ID NO: 877106 - RNA, 21 nt, Homo sapiens
ugucaucuuccuggaagcaga

SEQ ID NO: 877107 - RNA, 16 nt, Homo sapiens
ugucauuaauguguug

SEQ ID NO: 877108 - RNA, 15 nt, Homo sapiens
uguccaaguccaacc

SEQ ID NO: 877109 - RNA, 13 nt, Homo sapiens
uguccagcagcug

SEQ ID NO: 877110 - RNA, 17 nt, Homo sapiens
uguccaugccuacagau

SEQ ID NO: 877111 - RNA, 22 nt, Homo sapiens
ugucccaacucgaugggcacag

SEQ ID NO: 877112 - RNA, 18 nt, Homo sapiens
ugucccccuaugcuccag

SEQ ID NO: 877113 - RNA, 15 nt, Homo sapiens
uguccccuccacugu

SEQ ID NO: 877114 - RNA, 19 nt, Homo sapiens
uguccccuccacugucaca

SEQ ID NO: 877115 - RNA, 23 nt, Homo sapiens
ugucccucaaaugacccaaagac

SEQ ID NO: 877116 - RNA, 15 nt, Homo sapiens
uuacacguaccucuc

SEQ ID NO: 877117 - RNA, 14 nt, Homo sapiens
uuacagacugugag

SEQ ID NO: 877118 - RNA, 22 nt, Homo sapiens
uuacagugacugucguguuuac

SEQ ID NO: 877119 - RNA, 13 nt, Homo sapiens
uuacauauacauu

SEQ ID NO: 877120 - RNA, 17 nt, Homo sapiens
uuaccacguuacugcau

SEQ ID NO: 877121 - RNA, 22 nt, Homo sapiens
uuaccacguuacugcauacuga

SEQ ID NO: 877122 - RNA, 22 nt, Homo sapiens
uuacccagagaauauauacauu

SEQ ID NO: 877123 - RNA, 18 nt, Homo sapiens
uuaccuccccugccaggg

SEQ ID NO: 877124 - RNA, 22 nt, Homo sapiens
uuaccugcauguguuguacaau

SEQ ID NO: 877125 - RNA, 13 nt, Homo sapiens
uuacuaaacauuu

SEQ ID NO: 877126 - RNA, 18 nt, Homo sapiens
uuacuaaagucacauaua

SEQ ID NO: 877127 - RNA, 13 nt, Homo sapiens
uuacuacagugac

SEQ ID NO: 877128 - RNA, 16 nt, Homo sapiens
uuacuaugaucucagg

SEQ ID NO: 877129 - RNA, 22 nt, Homo sapiens
uuacuauuuauugcugaaugac

SEQ ID NO: 877130 - RNA, 22 nt, Homo sapiens
uuacucauaaggcauauacaaa

SEQ ID NO: 877131 - RNA, 21 nt, Homo sapiens
uuacucaugugcagguuuuga

SEQ ID NO: 877132 - RNA, 22 nt, Homo sapiens
uuacuccuuugcauuccaugau

SEQ ID NO: 877133 - RNA, 21 nt, Homo sapiens
uuacugcuucuuuucacuuca

SEQ ID NO: 877134 - RNA, 21 nt, Homo sapiens
uuacugguuucaguugacaaa

SEQ ID NO: 877135 - RNA, 14 nt, Homo sapiens
uuacugugcauaca

SEQ ID NO: 877136 - RNA, 17 nt, Homo sapiens
uuacuuauuuucuggau

SEQ ID NO: 877137 - RNA, 12 nt, Homo sapiens
uuacuucaugag

SEQ ID NO: 877138 - RNA, 16 nt, Homo sapiens
uuacuucccuaaugaa

SEQ ID NO: 877139 - RNA, 16 nt, Homo sapiens
uuacuugcauugaaua

SEQ ID NO: 877140 - RNA, 15 nt, Homo sapiens
uuagaaauugcauuu

SEQ ID NO: 877141 - RNA, 19 nt, Homo sapiens
uuagacaaaggcucuacac

SEQ ID NO: 877142 - RNA, 17 nt, Homo sapiens
uuagagauugccccaga

SEQ ID NO: 877143 - RNA, 20 nt, Homo sapiens
uuagaggaagaaaaccagcg

SEQ ID NO: 877144 - RNA, 22 nt, Homo sapiens
uuagauaaucgagucuaccucu

SEQ ID NO: 877145 - RNA, 22 nt, Homo sapiens
uuagauacagagacuuggggaa

SEQ ID NO: 877146 - RNA, 13 nt, Homo sapiens
uuagaugugacac

SEQ ID NO: 877147 - RNA, 16 nt, Homo sapiens
uuagauuauauauucc

SEQ ID NO: 877148 - RNA, 18 nt, Homo sapiens
uuagcacuauuuacauac

SEQ ID NO: 877149 - RNA, 16 nt, Homo sapiens
uuagcaggguacauau

SEQ ID NO: 877150 - RNA, 12 nt, Homo sapiens
uuagcccaagag

SEQ ID NO: 877151 - RNA, 17 nt, Homo sapiens
uuagccuuaguuucuca

SEQ ID NO: 877152 - RNA, 13 nt, Homo sapiens
uuagcuaccucac

SEQ ID NO: 877153 - RNA, 22 nt, Homo sapiens
uuagcucuguucuuuauaacaa

SEQ ID NO: 877154 - RNA, 16 nt, Homo sapiens
uuagcugaagaaguua

SEQ ID NO: 877155 - RNA, 15 nt, Homo sapiens
uuagcugucugcuca

SEQ ID NO: 877156 - RNA, 12 nt, Homo sapiens
uuagcuuuacaa

SEQ ID NO: 877157 - RNA, 14 nt, Homo sapiens
uuagcuuuacaaau

SEQ ID NO: 877158 - RNA, 20 nt, Homo sapiens
uuaggauagaauauuuacaa

SEQ ID NO: 877159 - RNA, 16 nt, Homo sapiens
uuaggccauauauauu

SEQ ID NO: 877160 - RNA, 14 nt, Homo sapiens
uuagggcuguagac

SEQ ID NO: 877161 - RNA, 13 nt, Homo sapiens
uuagguagcuuua

SEQ ID NO: 877162 - RNA, 15 nt, Homo sapiens
uuaguaauaaaaccc

SEQ ID NO: 877163 - RNA, 13 nt, Homo sapiens
uuaguaauuguaa

SEQ ID NO: 877164 - RNA, 13 nt, Homo sapiens
uuaguaauuguca

SEQ ID NO: 877165 - RNA, 15 nt, Homo sapiens
uuaguaucucaucaa

SEQ ID NO: 877166 - RNA, 15 nt, Homo sapiens
uuaguuuuuuccaca

SEQ ID NO: 877167 - RNA, 16 nt, Homo sapiens
uuauaaacuagaucuc

SEQ ID NO: 877168 - RNA, 21 nt, Homo sapiens
uuauaaacuuuagaguagcau

SEQ ID NO: 877169 - RNA, 16 nt, Homo sapiens
uuauaaauccaaagua

SEQ ID NO: 877170 - RNA, 17 nt, Homo sapiens
uuauaagaugucauccc

SEQ ID NO: 877171 - RNA, 14 nt, Homo sapiens
uuauaagcauguau

SEQ ID NO: 877172 - RNA, 14 nt, Homo sapiens
uuauaauauacuau

SEQ ID NO: 877173 - RNA, 21 nt, Homo sapiens
uuauaauucuugaaugaggca

SEQ ID NO: 877174 - RNA, 20 nt, Homo sapiens
uuauacaaaauaauuuaacu

SEQ ID NO: 877175 - RNA, 13 nt, Homo sapiens
uuauacauaucag

SEQ ID NO: 877176 - RNA, 18 nt, Homo sapiens
uuauaccagagaccugag

SEQ ID NO: 877177 - RNA, 16 nt, Homo sapiens
uuauacuccauacaua

SEQ ID NO: 877178 - RNA, 17 nt, Homo sapiens
uuauagguuuccacugc

SEQ ID NO: 877179 - RNA, 19 nt, Homo sapiens
uuauauaaggcaguauuau

SEQ ID NO: 877180 - RNA, 18 nt, Homo sapiens
uuauaucuguggucuuca

SEQ ID NO: 877181 - RNA, 17 nt, Homo sapiens
uuauaugaaauguuuca

SEQ ID NO: 877182 - RNA, 18 nt, Homo sapiens
uuauauucaaggaucuca

SEQ ID NO: 877183 - RNA, 14 nt, Homo sapiens
uuauauugguauaa

SEQ ID NO: 877184 - RNA, 18 nt, Homo sapiens
uuauauuuugugcuauca

SEQ ID NO: 877185 - RNA, 19 nt, Homo sapiens
uuaucacgcagaucacuaa

SEQ ID NO: 877186 - RNA, 13 nt, Homo sapiens
uuauccacaagca

SEQ ID NO: 877187 - RNA, 21 nt, Homo sapiens
uuauccagaggguugugauuu

SEQ ID NO: 877188 - RNA, 12 nt, Homo sapiens
uuauccaugccu

SEQ ID NO: 877189 - RNA, 20 nt, Homo sapiens
uuaucccccaaaaugcauuu

SEQ ID NO: 877190 - RNA, 13 nt, Homo sapiens
uuaucugauacuu

SEQ ID NO: 877191 - RNA, 20 nt, Homo sapiens
uuaucuuauuuaauuuuugc

SEQ ID NO: 877192 - RNA, 14 nt, Homo sapiens
uuaugaaaaagaag

SEQ ID NO: 877193 - RNA, 22 nt, Homo sapiens
uuaugaagcaagccccacuuau

SEQ ID NO: 877194 - RNA, 22 nt, Homo sapiens
uuaugacuguuuuuguaguggu

SEQ ID NO: 877195 - RNA, 23 nt, Homo sapiens
uuaugagucucuaugaucuuggc

SEQ ID NO: 877196 - RNA, 20 nt, Homo sapiens
uuauggggacagcauaccuu

SEQ ID NO: 877197 - RNA, 14 nt, Homo sapiens
uuauguaacaucca

SEQ ID NO: 877198 - RNA, 17 nt, Homo sapiens
uuauguaacauccagaa

SEQ ID NO: 877199 - RNA, 17 nt, Homo sapiens
uuauguauuuaugaccu

SEQ ID NO: 877200 - RNA, 23 nt, Homo sapiens
uuauguauuugaaaacucacaga

SEQ ID NO: 877201 - RNA, 19 nt, Homo sapiens
uuaugucaucauacaugac

SEQ ID NO: 877202 - RNA, 22 nt, Homo sapiens
uuaugucaucauacaugacuca

SEQ ID NO: 877203 - RNA, 16 nt, Homo sapiens
uuauuaagauguauaa

SEQ ID NO: 877204 - RNA, 18 nt, Homo sapiens
uuauuaauuaaacaagug

SEQ ID NO: 877205 - RNA, 13 nt, Homo sapiens
uuauuagcaguag

SEQ ID NO: 877206 - RNA, 13 nt, Homo sapiens
uuauuaugucuca

SEQ ID NO: 877207 - RNA, 16 nt, Homo sapiens
uuauuauuagauucuc

SEQ ID NO: 877208 - RNA, 18 nt, Homo sapiens
uuauuauuguucuuuaag

SEQ ID NO: 877209 - RNA, 17 nt, Homo sapiens
uuauucauuagcuguga

SEQ ID NO: 877210 - RNA, 15 nt, Homo sapiens
uuauuccuccaggaa

SEQ ID NO: 877211 - RNA, 14 nt, Homo sapiens
uuauuccucccuca

SEQ ID NO: 877212 - RNA, 21 nt, Homo sapiens
uuauuccucccucaugagcac

SEQ ID NO: 877213 - RNA, 15 nt, Homo sapiens
uuauucugauuccac

SEQ ID NO: 877214 - RNA, 23 nt, Homo sapiens
uuauugccucugaaaugccucuu

SEQ ID NO: 877215 - RNA, 16 nt, Homo sapiens
uuauugugaucuauca

SEQ ID NO: 877216 - RNA, 16 nt, Homo sapiens
uuauuuacaaugcaga

SEQ ID NO: 877217 - RNA, 12 nt, Homo sapiens
uuauuucauaca

SEQ ID NO: 877218 - RNA, 11 nt, Homo sapiens
uuauuuccaca

SEQ ID NO: 877219 - RNA, 16 nt, Homo sapiens
uuauuuguauuugcca

SEQ ID NO: 877220 - RNA, 21 nt, Homo sapiens
uucaaaaauacucacauggcu

SEQ ID NO: 877221 - RNA, 13 nt, Homo sapiens
uucaaaccaggau

SEQ ID NO: 877222 - RNA, 17 nt, Homo sapiens
uucaaacugcaugauuc

SEQ ID NO: 877223 - RNA, 18 nt, Homo sapiens
uucaaagaagucauggcc

SEQ ID NO: 877224 - RNA, 16 nt, Homo sapiens
uucaaauuuaagguua

SEQ ID NO: 877225 - RNA, 20 nt, Homo sapiens
uucaacaaugacuaaugagu

SEQ ID NO: 877226 - RNA, 14 nt, Homo sapiens
uucaacauauaccu

SEQ ID NO: 877227 - RNA, 11 nt, Homo sapiens
uucaaccacug

SEQ ID NO: 877228 - RNA, 12 nt, Homo sapiens
uucaaccagcau

SEQ ID NO: 877229 - RNA, 16 nt, Homo sapiens
uuguacauuccugaua

SEQ ID NO: 877230 - RNA, 20 nt, Homo sapiens
uggagccaggaguuugagac

SEQ ID NO: 877231 - RNA, 14 nt, Homo sapiens
uggagcuacuuuaa

SEQ ID NO: 877232 - RNA, 18 nt, Homo sapiens
uggaggaaaauccaugga

SEQ ID NO: 877233 - RNA, 14 nt, Homo sapiens
uggagggagccauc

SEQ ID NO: 877234 - RNA, 19 nt, Homo sapiens
uggagggcuagaaucugga

SEQ ID NO: 877235 - RNA, 20 nt, Homo sapiens
uggaggucacauucaggaag

SEQ ID NO: 877236 - RNA, 16 nt, Homo sapiens
uggagucugugucugc

SEQ ID NO: 877237 - RNA, 15 nt, Homo sapiens
uggauaaaaugaggu

SEQ ID NO: 877238 - RNA, 16 nt, Homo sapiens
uggauacugcugccaa

SEQ ID NO: 877239 - RNA, 18 nt, Homo sapiens
uggaucucacaagcacuu

SEQ ID NO: 877240 - RNA, 19 nt, Homo sapiens
uggaugaagcucuggccaa

SEQ ID NO: 877241 - RNA, 11 nt, Homo sapiens
uggaugcacac

SEQ ID NO: 877242 - RNA, 23 nt, Homo sapiens
uggaugucuccaucucugucuca

SEQ ID NO: 877243 - RNA, 14 nt, Homo sapiens
uggaugugcucacu

SEQ ID NO: 877244 - RNA, 16 nt, Homo sapiens
uggauguggggucccc

SEQ ID NO: 877245 - RNA, 15 nt, Homo sapiens
uggauucgugacaac

SEQ ID NO: 877246 - RNA, 17 nt, Homo sapiens
uggauugcagacucaug

SEQ ID NO: 877247 - RNA, 18 nt, Homo sapiens
uggauugcagacucauga

SEQ ID NO: 877248 - RNA, 21 nt, Homo sapiens
uggauuuuguggaggugagaa

SEQ ID NO: 877249 - RNA, 17 nt, Homo sapiens
uggcaaagguggcucuc

SEQ ID NO: 877250 - RNA, 22 nt, Homo sapiens
uggcaaaucucuauuaggaaau

SEQ ID NO: 877251 - RNA, 18 nt, Homo sapiens
uggcaacaacaaagccaa

SEQ ID NO: 877252 - RNA, 14 nt, Homo sapiens
uggcaacaccuccu

SEQ ID NO: 877253 - RNA, 15 nt, Homo sapiens
uggcaaccuguucuu

SEQ ID NO: 877254 - RNA, 15 nt, Homo sapiens
uggcaagcagggaaa

SEQ ID NO: 877255 - RNA, 20 nt, Homo sapiens
uggcacauggcuggcacuga

SEQ ID NO: 877256 - RNA, 21 nt, Homo sapiens
uggcaccucagacaauccacu

SEQ ID NO: 877257 - RNA, 18 nt, Homo sapiens
uggcacgugccugugauc

SEQ ID NO: 877258 - RNA, 17 nt, Homo sapiens
uggcagcaaagugucag

SEQ ID NO: 877259 - RNA, 21 nt, Homo sapiens
uggcagcgccucaucuucaac

SEQ ID NO: 877260 - RNA, 20 nt, Homo sapiens
uggcagugugucacacugag

SEQ ID NO: 877261 - RNA, 21 nt, Homo sapiens
uggcaguucucgcagauguua

SEQ ID NO: 877262 - RNA, 19 nt, Homo sapiens
uggcauacgccuguagucc

SEQ ID NO: 877263 - RNA, 15 nt, Homo sapiens
uggcaucacagggca

SEQ ID NO: 877264 - RNA, 15 nt, Homo sapiens
uggcaugauuuauau

SEQ ID NO: 877265 - RNA, 19 nt, Homo sapiens
uggcauuaaagugcuguau

SEQ ID NO: 877266 - RNA, 13 nt, Homo sapiens
uggccaaagccaa

SEQ ID NO: 877267 - RNA, 20 nt, Homo sapiens
uggccaaccaaagacacugu

SEQ ID NO: 877268 - RNA, 18 nt, Homo sapiens
uggccaggcuggucucaa

SEQ ID NO: 877269 - RNA, 18 nt, Homo sapiens
uggccagugugaucccaa

SEQ ID NO: 877270 - RNA, 17 nt, Homo sapiens
uggccaugcuucuugcc

SEQ ID NO: 877271 - RNA, 19 nt, Homo sapiens
uggcccagggaagccaaaa

SEQ ID NO: 877272 - RNA, 20 nt, Homo sapiens
uggcccauagaaacaugaca

SEQ ID NO: 877273 - RNA, 14 nt, Homo sapiens
uggccccaugucuc

SEQ ID NO: 877274 - RNA, 16 nt, Homo sapiens
uggcccccugugccag

SEQ ID NO: 877275 - RNA, 17 nt, Homo sapiens
uggccccucaccugggc

SEQ ID NO: 877276 - RNA, 15 nt, Homo sapiens
uggccccugggccug

SEQ ID NO: 877277 - RNA, 17 nt, Homo sapiens
uggcccgccccucgcug

SEQ ID NO: 877278 - RNA, 14 nt, Homo sapiens
uggcccugccucau

SEQ ID NO: 877279 - RNA, 22 nt, Homo sapiens
uggccgaucggggcacugcagg

SEQ ID NO: 877280 - RNA, 22 nt, Homo sapiens
uggccgggugcgguggcucacg

SEQ ID NO: 877281 - RNA, 21 nt, Homo sapiens
uggccuagcaggcacaggaca

SEQ ID NO: 877282 - RNA, 18 nt, Homo sapiens
uggccugcuaauagcugc

SEQ ID NO: 877283 - RNA, 15 nt, Homo sapiens
uggccugcugggaac

SEQ ID NO: 877284 - RNA, 19 nt, Homo sapiens
uggccugcugggcucucca

SEQ ID NO: 877285 - RNA, 23 nt, Homo sapiens
uggccugcugggcucuccaccuc

SEQ ID NO: 877286 - RNA, 13 nt, Homo sapiens
uggccuggcacac

SEQ ID NO: 877287 - RNA, 16 nt, Homo sapiens
uggccuggcaucgcau

SEQ ID NO: 877288 - RNA, 15 nt, Homo sapiens
uggccuucaguguac

SEQ ID NO: 877289 - RNA, 19 nt, Homo sapiens
uggcgcaagagaacauuuc

SEQ ID NO: 877290 - RNA, 15 nt, Homo sapiens
uggcgcaucauaugc

SEQ ID NO: 877291 - RNA, 21 nt, Homo sapiens
uggcgcgggaggcaccagcuc

SEQ ID NO: 877292 - RNA, 17 nt, Homo sapiens
uggcggcgcagagggaa

SEQ ID NO: 877293 - RNA, 14 nt, Homo sapiens
uggcuaacuggcga

SEQ ID NO: 877294 - RNA, 13 nt, Homo sapiens
uggcuaugcaaca

SEQ ID NO: 877295 - RNA, 16 nt, Homo sapiens
uggcucacgccuguaa

SEQ ID NO: 877296 - RNA, 23 nt, Homo sapiens
uggcucccaucugaaccacuuug

SEQ ID NO: 877297 - RNA, 19 nt, Homo sapiens
uggcuccuuaggaacagcu

SEQ ID NO: 877298 - RNA, 12 nt, Homo sapiens
uggcucuucacc

SEQ ID NO: 877299 - RNA, 16 nt, Homo sapiens
uggcucuugccuguaa

SEQ ID NO: 877300 - RNA, 14 nt, Homo sapiens
uggcugaaaaucac

SEQ ID NO: 877301 - RNA, 15 nt, Homo sapiens
uggcugaaaaucacu

SEQ ID NO: 877302 - RNA, 16 nt, Homo sapiens
uggcugccugcaucua

SEQ ID NO: 877303 - RNA, 14 nt, Homo sapiens
uggcugcugugcua

SEQ ID NO: 877304 - RNA, 15 nt, Homo sapiens
uggcuggcacugagc

SEQ ID NO: 877305 - RNA, 16 nt, Homo sapiens
uggcuguaaacuauaa

SEQ ID NO: 877306 - RNA, 14 nt, Homo sapiens
uggcuuacuccagg

SEQ ID NO: 877307 - RNA, 22 nt, Homo sapiens
uggcuuccagguaucuccagga

SEQ ID NO: 877308 - RNA, 17 nt, Homo sapiens
uggcuucgucauuugca

SEQ ID NO: 877309 - RNA, 21 nt, Homo sapiens
uggcuucugugcacuagccug

SEQ ID NO: 877310 - RNA, 17 nt, Homo sapiens
uggcuucuguugcgcca

SEQ ID NO: 877311 - RNA, 14 nt, Homo sapiens
uggcuugacuggau

SEQ ID NO: 877312 - RNA, 15 nt, Homo sapiens
uggcuuuuucuccuu

SEQ ID NO: 877313 - RNA, 23 nt, Homo sapiens
uggcuuuuuuccuccuguguaca

SEQ ID NO: 877314 - RNA, 22 nt, Homo sapiens
ugggaaaaauucagagaguuag

SEQ ID NO: 877315 - RNA, 21 nt, Homo sapiens
ugggaaaggaaaaccagggau

SEQ ID NO: 877316 - RNA, 18 nt, Homo sapiens
ugggaacccgacugugaa

SEQ ID NO: 877317 - RNA, 21 nt, Homo sapiens
ugggaaugacucugacuuuga

SEQ ID NO: 877318 - RNA, 12 nt, Homo sapiens
ugggaauugcau

SEQ ID NO: 877319 - RNA, 19 nt, Homo sapiens
ugggaauugcaugccaucu

SEQ ID NO: 877320 - RNA, 13 nt, Homo sapiens
ugggacagaggag

SEQ ID NO: 877321 - RNA, 23 nt, Homo sapiens
ugggaccucaguuuuaucauuuu

SEQ ID NO: 877322 - RNA, 15 nt, Homo sapiens
ugggacuauucauug

SEQ ID NO: 877323 - RNA, 12 nt, Homo sapiens
ugggacugagau

SEQ ID NO: 877324 - RNA, 18 nt, Homo sapiens
ugggagaucagccacgga

SEQ ID NO: 877325 - RNA, 21 nt, Homo sapiens
ugggagccugacagugcccag

SEQ ID NO: 877326 - RNA, 16 nt, Homo sapiens
ugggaggguaccagca

SEQ ID NO: 877327 - RNA, 14 nt, Homo sapiens
ugggauaaucacau

SEQ ID NO: 877328 - RNA, 18 nt, Homo sapiens
ugggcaacauaguaagac

SEQ ID NO: 877329 - RNA, 14 nt, Homo sapiens
ugggcagaaagugg

SEQ ID NO: 877330 - RNA, 21 nt, Homo sapiens
ugggccagcugucgcaucuca

SEQ ID NO: 877331 - RNA, 16 nt, Homo sapiens
ugggccccaccaccua

SEQ ID NO: 877332 - RNA, 16 nt, Homo sapiens
ugggccggccagccuu

SEQ ID NO: 877333 - RNA, 22 nt, Homo sapiens
ugggccggccagccuugcacug

SEQ ID NO: 877334 - RNA, 21 nt, Homo sapiens
ugggcgacagaagucuugucu

SEQ ID NO: 877335 - RNA, 14 nt, Homo sapiens
ugggcgugcuaccu

SEQ ID NO: 877336 - RNA, 13 nt, Homo sapiens
ugggcuacuggca

SEQ ID NO: 877337 - RNA, 19 nt, Homo sapiens
ugggcugggcucgccacau

SEQ ID NO: 877338 - RNA, 14 nt, Homo sapiens
ugggcugucuguca

SEQ ID NO: 877339 - RNA, 14 nt, Homo sapiens
ugggcuuccagaaa

SEQ ID NO: 877340 - RNA, 14 nt, Homo sapiens
ugggcuucugucca

SEQ ID NO: 877341 - RNA, 14 nt, Homo sapiens
uggggaacagagcg

SEQ ID NO: 877342 - RNA, 18 nt, Homo sapiens
uggggaagaccuuguccc

SEQ ID NO: 877343 - RNA, 14 nt, Homo sapiens
uggggaagacugug

SEQ ID NO: 877344 - RNA, 16 nt, Homo sapiens
uuggagcagaaagcca

SEQ ID NO: 877345 - RNA, 16 nt, Homo sapiens
uuggagccacuccugu

SEQ ID NO: 877346 - RNA, 11 nt, Homo sapiens
uuggagccagg

SEQ ID NO: 877347 - RNA, 14 nt, Homo sapiens
uuggauguggagcu

SEQ ID NO: 877348 - RNA, 12 nt, Homo sapiens
uuggauuccagu

SEQ ID NO: 877349 - RNA, 15 nt, Homo sapiens
uuggcaaacuuugua

SEQ ID NO: 877350 - RNA, 15 nt, Homo sapiens
uuggccagugugaca

SEQ ID NO: 877351 - RNA, 21 nt, Homo sapiens
uuggccgugguccagcucuug

SEQ ID NO: 877352 - RNA, 21 nt, Homo sapiens
uuggccuuguggauaagggag

SEQ ID NO: 877353 - RNA, 14 nt, Homo sapiens
uuggcucaauccuc

SEQ ID NO: 877354 - RNA, 21 nt, Homo sapiens
uuggcugacggugaaccgcau

SEQ ID NO: 877355 - RNA, 10 nt, Homo sapiens
ggggcuuccu

SEQ ID NO: 877356 - RNA, 16 nt, Homo sapiens
gggggccuucacagug

SEQ ID NO: 877357 - RNA, 17 nt, Homo sapiens
gggggccuucacaguga

SEQ ID NO: 877358 - RNA, 21 nt, Homo sapiens
gggguauuuuaggcagggauu

SEQ ID NO: 877359 - RNA, 20 nt, Homo sapiens
ggggucgucaccaccucucc

SEQ ID NO: 877360 - RNA, 22 nt, Homo sapiens
ggguaggcgggaaggaggguua

SEQ ID NO: 877361 - RNA, 21 nt, Homo sapiens
ggguauccuacuacuuugugu

SEQ ID NO: 877362 - RNA, 15 nt, Homo sapiens
ggguccuugguguga

SEQ ID NO: 877363 - RNA, 20 nt, Homo sapiens
gggucuuugugagagugagc

SEQ ID NO: 877364 - RNA, 20 nt, Homo sapiens
gggugcgagagaggugggca

SEQ ID NO: 877365 - RNA, 15 nt, Homo sapiens
ggguggaucaccuga

SEQ ID NO: 877366 - RNA, 21 nt, Homo sapiens
ggguggcccccugugccagcu

SEQ ID NO: 877367 - RNA, 21 nt, Homo sapiens
ggguggcuccugccacugacc

SEQ ID NO: 877368 - RNA, 18 nt, Homo sapiens
gggugggccagauccaaa

SEQ ID NO: 877369 - RNA, 19 nt, Homo sapiens
ggguggucugagcaccccc

SEQ ID NO: 877370 - RNA, 14 nt, Homo sapiens
gggugugucugcuc

SEQ ID NO: 877371 - RNA, 19 nt, Homo sapiens
ggguguuaaggcagugacu

SEQ ID NO: 877372 - RNA, 14 nt, Homo sapiens
ggguuacuuucaca

SEQ ID NO: 877373 - RNA, 18 nt, Homo sapiens
ggguuagcucacgugucu

SEQ ID NO: 877374 - RNA, 13 nt, Homo sapiens
ggguucacugcaa

SEQ ID NO: 877375 - RNA, 14 nt, Homo sapiens
ggguuuacucucaa

SEQ ID NO: 877376 - RNA, 20 nt, Homo sapiens
ggguuucaccaucuuggcca

SEQ ID NO: 877377 - RNA, 21 nt, Homo sapiens
ggguuuguuuuucaaagccug

SEQ ID NO: 877378 - RNA, 22 nt, Homo sapiens
ggguuuugucucugcaucucau

SEQ ID NO: 877379 - RNA, 18 nt, Homo sapiens
gguaauauaaaguguaau

SEQ ID NO: 877380 - RNA, 11 nt, Homo sapiens
gguaaucagca

SEQ ID NO: 877381 - RNA, 14 nt, Homo sapiens
gguacauauuucuu

SEQ ID NO: 877382 - RNA, 19 nt, Homo sapiens
gguacauuucccugugcug

SEQ ID NO: 877383 - RNA, 18 nt, Homo sapiens
gguagcuauuuguuuaca

SEQ ID NO: 877384 - RNA, 16 nt, Homo sapiens
gguagggccagcucac

SEQ ID NO: 877385 - RNA, 13 nt, Homo sapiens
gguaguacuggga

SEQ ID NO: 877386 - RNA, 14 nt, Homo sapiens
gguaguacugggaa

SEQ ID NO: 877387 - RNA, 12 nt, Homo sapiens
gguaguggguga

SEQ ID NO: 877388 - RNA, 22 nt, Homo sapiens
gguaguuuagaucccaugucac

SEQ ID NO: 877389 - RNA, 12 nt, Homo sapiens
gguaugagcuga

SEQ ID NO: 877390 - RNA, 16 nt, Homo sapiens
gguaugaguugcccau

SEQ ID NO: 877391 - RNA, 23 nt, Homo sapiens
gguaugaucacggcucacugcag

SEQ ID NO: 877392 - RNA, 16 nt, Homo sapiens
gguauuacacuguauu

SEQ ID NO: 877393 - RNA, 14 nt, Homo sapiens
gguauuagcaccuc

SEQ ID NO: 877394 - RNA, 14 nt, Homo sapiens
ggucaagggccagu

SEQ ID NO: 877395 - RNA, 22 nt, Homo sapiens
ggucaggcggggugcuguggug

SEQ ID NO: 877396 - RNA, 17 nt, Homo sapiens
ggucaugcuuuugccac

SEQ ID NO: 877397 - RNA, 11 nt, Homo sapiens
ggucauuugcu

SEQ ID NO: 877398 - RNA, 16 nt, Homo sapiens
gguccagacccacucc

SEQ ID NO: 877399 - RNA, 17 nt, Homo sapiens
ggucccaccuccauuug

SEQ ID NO: 877400 - RNA, 14 nt, Homo sapiens
ggucccagagggug

SEQ ID NO: 877401 - RNA, 19 nt, Homo sapiens
ggucccaggcagagaauca

SEQ ID NO: 877402 - RNA, 16 nt, Homo sapiens
ggucccugccaguguu

SEQ ID NO: 877403 - RNA, 17 nt, Homo sapiens
gguccgaagucuuccau

SEQ ID NO: 877404 - RNA, 15 nt, Homo sapiens
gguccugagcacugc

SEQ ID NO: 877405 - RNA, 20 nt, Homo sapiens
gguccugcaaucuccagggc

SEQ ID NO: 877406 - RNA, 12 nt, Homo sapiens
gguccugucacc

SEQ ID NO: 877407 - RNA, 22 nt, Homo sapiens
gguccuguuaacgucaucucag

SEQ ID NO: 877408 - RNA, 22 nt, Homo sapiens
gguccuugcaccccucacucug

SEQ ID NO: 877409 - RNA, 20 nt, Homo sapiens
gguccuugucccaagcccag

SEQ ID NO: 877410 - RNA, 21 nt, Homo sapiens
ggucguggagagcuaggagca

SEQ ID NO: 877411 - RNA, 16 nt, Homo sapiens
ggucucgaacuccuga

SEQ ID NO: 877412 - RNA, 21 nt, Homo sapiens
ggucuuucuacauaguuauuc

SEQ ID NO: 877413 - RNA, 18 nt, Homo sapiens
ggugaaaccucaucucua

SEQ ID NO: 877414 - RNA, 19 nt, Homo sapiens
ggugaaaccucaucucuac

SEQ ID NO: 877415 - RNA, 12 nt, Homo sapiens
ggugaaauccag

SEQ ID NO: 877416 - RNA, 18 nt, Homo sapiens
ggugacaggcccagugga

SEQ ID NO: 877417 - RNA, 18 nt, Homo sapiens
ggugcaaauccuacugaa

SEQ ID NO: 877418 - RNA, 20 nt, Homo sapiens
ggugcagucuuggcucacua

SEQ ID NO: 877419 - RNA, 18 nt, Homo sapiens
ggugccugccucugccau

SEQ ID NO: 877420 - RNA, 16 nt, Homo sapiens
ggugcucacgacucuu

SEQ ID NO: 877421 - RNA, 23 nt, Homo sapiens
ggugcucauucauuuaacagagc

SEQ ID NO: 877422 - RNA, 13 nt, Homo sapiens
gguggaucaccug

SEQ ID NO: 877423 - RNA, 22 nt, Homo sapiens
gguggauuccugggcaagaacc

SEQ ID NO: 877424 - RNA, 18 nt, Homo sapiens
aaaagaaccgagcaauuu

SEQ ID NO: 877425 - RNA, 16 nt, Homo sapiens
aaaagaagcaaccuca

SEQ ID NO: 877426 - RNA, 15 nt, Homo sapiens
aaaagacauguugua

SEQ ID NO: 877427 - RNA, 15 nt, Homo sapiens
aaaagaccaguccau

SEQ ID NO: 877428 - RNA, 22 nt, Homo sapiens
aaaagauuguuuuauauguagu

SEQ ID NO: 877429 - RNA, 17 nt, Homo sapiens
aaaagauuuaaguaauu

SEQ ID NO: 877430 - RNA, 18 nt, Homo sapiens
aaaagauuuguuuuguca

SEQ ID NO: 877431 - RNA, 22 nt, Homo sapiens
aaaagcaagacuguugcucaaa

SEQ ID NO: 877432 - RNA, 14 nt, Homo sapiens
aaaagccacauaga

SEQ ID NO: 877433 - RNA, 22 nt, Homo sapiens
aaaagccuccgguuuccacuac

SEQ ID NO: 877434 - RNA, 16 nt, Homo sapiens
aaaagcuacaguuuug

SEQ ID NO: 877435 - RNA, 20 nt, Homo sapiens
aaaagcuuauucaucuguuu

SEQ ID NO: 877436 - RNA, 14 nt, Homo sapiens
aaaaggaacacugg

SEQ ID NO: 877437 - RNA, 21 nt, Homo sapiens
aaaagggauccguacauucaa

SEQ ID NO: 877438 - RNA, 20 nt, Homo sapiens
aaaaggucauagcugagauu

SEQ ID NO: 877439 - RNA, 22 nt, Homo sapiens
aaaagugaucuguccccucucc

SEQ ID NO: 877440 - RNA, 18 nt, Homo sapiens
aaaaguggauggaagugu

SEQ ID NO: 877441 - RNA, 15 nt, Homo sapiens
aaaaguuacauguuu

SEQ ID NO: 877442 - RNA, 16 nt, Homo sapiens
aaaaguuauguagaaa

SEQ ID NO: 877443 - RNA, 16 nt, Homo sapiens
aaaaguuuugaugaaa

SEQ ID NO: 877444 - RNA, 13 nt, Homo sapiens
aaaauacuaugaa

SEQ ID NO: 877445 - RNA, 23 nt, Homo sapiens
aaaauacuaugugggacaccuca

SEQ ID NO: 877446 - RNA, 13 nt, Homo sapiens
aaaauagcaaaag

SEQ ID NO: 877447 - RNA, 13 nt, Homo sapiens
aaaauagcaacac

SEQ ID NO: 877448 - RNA, 20 nt, Homo sapiens
aaaauagcuaaauaccucaa

SEQ ID NO: 877449 - RNA, 15 nt, Homo sapiens
aaaauaguaagccuc

SEQ ID NO: 877450 - RNA, 12 nt, Homo sapiens
aaaauaguagca

SEQ ID NO: 877451 - RNA, 21 nt, Homo sapiens
aaaauauauuucagauaucag

SEQ ID NO: 877452 - RNA, 21 nt, Homo sapiens
aaaauaugugcuugaaaugag

SEQ ID NO: 877453 - RNA, 14 nt, Homo sapiens
aaaauauugcuuau

SEQ ID NO: 877454 - RNA, 13 nt, Homo sapiens
aaaauauugcuuc

SEQ ID NO: 877455 - RNA, 24 nt, Homo sapiens
aaaaucacaacacagagcugcuau

SEQ ID NO: 877456 - RNA, 15 nt, Homo sapiens
aaaaucauuucugca

SEQ ID NO: 877457 - RNA, 15 nt, Homo sapiens
aaaaucuuacuuugu

SEQ ID NO: 877458 - RNA, 11 nt, Homo sapiens
aaaaugaacuu

SEQ ID NO: 877459 - RNA, 22 nt, Homo sapiens
aaaaugagguucaacuguugau

SEQ ID NO: 877460 - RNA, 15 nt, Homo sapiens
aaaaugcaacaacau

SEQ ID NO: 877461 - RNA, 13 nt, Homo sapiens
aaaaugcauuuaa

SEQ ID NO: 877462 - RNA, 19 nt, Homo sapiens
aaaauggaagguuggagac

SEQ ID NO: 877463 - RNA, 22 nt, Homo sapiens
aaaauggagggagccaucccuu

SEQ ID NO: 877464 - RNA, 13 nt, Homo sapiens
aaaauguccauga

SEQ ID NO: 877465 - RNA, 12 nt, Homo sapiens
aaaaugugcaau

SEQ ID NO: 877466 - RNA, 22 nt, Homo sapiens
aaaauguucguauucuauucaa

SEQ ID NO: 877467 - RNA, 20 nt, Homo sapiens
aaaauuaaaugcauguccuc

SEQ ID NO: 877468 - RNA, 16 nt, Homo sapiens
aaaauuaaauugcaga

SEQ ID NO: 877469 - RNA, 14 nt, Homo sapiens
aaaauuaugccaua

SEQ ID NO: 877470 - RNA, 23 nt, Homo sapiens
aaaauuauuuaaaccgcuaaaag

SEQ ID NO: 877471 - RNA, 20 nt, Homo sapiens
aaaauucuugggaguguugu

SEQ ID NO: 877472 - RNA, 19 nt, Homo sapiens
aaaauuuaccacagacuau

SEQ ID NO: 877473 - RNA, 19 nt, Homo sapiens
aaaauuucaaaagugaucu

SEQ ID NO: 877474 - RNA, 18 nt, Homo sapiens
aaaauuuguuuugacgga

SEQ ID NO: 877475 - RNA, 15 nt, Homo sapiens
cacauauggcacaac

SEQ ID NO: 877476 - RNA, 17 nt, Homo sapiens
cacaucacuacaguaca

SEQ ID NO: 877477 - RNA, 20 nt, Homo sapiens
cacaucagagugacauccag

SEQ ID NO: 877478 - RNA, 13 nt, Homo sapiens
cacaucagcuuua

SEQ ID NO: 877479 - RNA, 16 nt, Homo sapiens
cacaucuaaugucucu

SEQ ID NO: 877480 - RNA, 19 nt, Homo sapiens
cacaucugugucucuggaa

SEQ ID NO: 877481 - RNA, 23 nt, Homo sapiens
cacaugaaucccacccacaugug

SEQ ID NO: 877482 - RNA, 19 nt, Homo sapiens
cacaugaggagggugcccu

SEQ ID NO: 877483 - RNA, 19 nt, Homo sapiens
cacaugcacgugugugcac

SEQ ID NO: 877484 - RNA, 15 nt, Homo sapiens
cacauggccuaugca

SEQ ID NO: 877485 - RNA, 14 nt, Homo sapiens
cacauggcugggau

SEQ ID NO: 877486 - RNA, 18 nt, Homo sapiens
cacauguaacauagauuu

SEQ ID NO: 877487 - RNA, 15 nt, Homo sapiens
cacaugugacacaua

SEQ ID NO: 877488 - RNA, 17 nt, Homo sapiens
cacaugugacacauaug

SEQ ID NO: 877489 - RNA, 18 nt, Homo sapiens
cacaugugacacauaugc

SEQ ID NO: 877490 - RNA, 17 nt, Homo sapiens
cacauuacuugcacaag

SEQ ID NO: 877491 - RNA, 23 nt, Homo sapiens
cacauuaucgggagcagugucuu

SEQ ID NO: 877492 - RNA, 17 nt, Homo sapiens
cacauucccaucuguca

SEQ ID NO: 877493 - RNA, 18 nt, Homo sapiens
cacauucccaucugucac

SEQ ID NO: 877494 - RNA, 15 nt, Homo sapiens
cacauucggacccug

SEQ ID NO: 877495 - RNA, 16 nt, Homo sapiens
cacauuggcagugugu

SEQ ID NO: 877496 - RNA, 18 nt, Homo sapiens
cacauuuauauauauaug

SEQ ID NO: 877497 - RNA, 23 nt, Homo sapiens
cacauuugauuauauacuaugua

SEQ ID NO: 877498 - RNA, 15 nt, Homo sapiens
caccaaaaagggauc

SEQ ID NO: 877499 - RNA, 15 nt, Homo sapiens
caccaaagucaggga

SEQ ID NO: 877500 - RNA, 19 nt, Homo sapiens
caccaacucugcacuccau

SEQ ID NO: 877501 - RNA, 20 nt, Homo sapiens
caccaauuguacauucccug

SEQ ID NO: 877502 - RNA, 15 nt, Homo sapiens
caccacaugugcaca

SEQ ID NO: 877503 - RNA, 21 nt, Homo sapiens
caccagaggucagguguucaa

SEQ ID NO: 877504 - RNA, 14 nt, Homo sapiens
caccagccaucaug

SEQ ID NO: 877505 - RNA, 17 nt, Homo sapiens
caccagccaucaugugc

SEQ ID NO: 877506 - RNA, 17 nt, Homo sapiens
caccagccccagcaaga

SEQ ID NO: 877507 - RNA, 15 nt, Homo sapiens
caccaggccuuugag

SEQ ID NO: 877508 - RNA, 16 nt, Homo sapiens
caccagggcacugucu

SEQ ID NO: 877509 - RNA, 15 nt, Homo sapiens
caccagucacugucc

SEQ ID NO: 877510 - RNA, 16 nt, Homo sapiens
caccaguuccuuucaa

SEQ ID NO: 877511 - RNA, 22 nt, Homo sapiens
caccaucuuuugugagauguaa

SEQ ID NO: 877512 - RNA, 16 nt, Homo sapiens
caccauguaacaacca

SEQ ID NO: 877513 - RNA, 15 nt, Homo sapiens
cacccaacaagccau

SEQ ID NO: 877514 - RNA, 14 nt, Homo sapiens
cacccaauguuuga

SEQ ID NO: 877515 - RNA, 12 nt, Homo sapiens
cacccacaugug

SEQ ID NO: 877516 - RNA, 15 nt, Homo sapiens
cacccaggcuccaug

SEQ ID NO: 877517 - RNA, 16 nt, Homo sapiens
cacccaucuuccugcu

SEQ ID NO: 877518 - RNA, 14 nt, Homo sapiens
cacccaugccauag

SEQ ID NO: 877519 - RNA, 17 nt, Homo sapiens
cacccaugcccagcugu

SEQ ID NO: 877520 - RNA, 14 nt, Homo sapiens
cacccaugugccaa

SEQ ID NO: 877521 - RNA, 14 nt, Homo sapiens
caccccacggaugu

SEQ ID NO: 877522 - RNA, 20 nt, Homo sapiens
caccccagcgccugugcuga

SEQ ID NO: 877523 - RNA, 17 nt, Homo sapiens
caccccaucggcuucca

SEQ ID NO: 877524 - RNA, 19 nt, Homo sapiens
cacccccaugcagccucuu

SEQ ID NO: 877525 - RNA, 14 nt, Homo sapiens
cacccccgugucca

SEQ ID NO: 877526 - RNA, 21 nt, Homo sapiens
caccccucaaaaaaagccuuu

SEQ ID NO: 877527 - RNA, 16 nt, Homo sapiens
caccccuuauccagga

SEQ ID NO: 877528 - RNA, 17 nt, Homo sapiens
cacccgacuccucaaaa

SEQ ID NO: 877529 - RNA, 18 nt, Homo sapiens
cacccgccgccuccugca

SEQ ID NO: 877530 - RNA, 15 nt, Homo sapiens
cacccucaaauguca

SEQ ID NO: 877531 - RNA, 21 nt, Homo sapiens
cacccucaaaugucagagcua

SEQ ID NO: 877532 - RNA, 22 nt, Homo sapiens
cacccuccuuucaccacaugug

SEQ ID NO: 877533 - RNA, 20 nt, Homo sapiens
caccgaugcacacgcacaua

SEQ ID NO: 877534 - RNA, 14 nt, Homo sapiens
caccgcagaaggaa

SEQ ID NO: 877535 - RNA, 14 nt, Homo sapiens
caccgcgugccaug

SEQ ID NO: 877536 - RNA, 20 nt, Homo sapiens
caccuaccugccggacacag

SEQ ID NO: 877537 - RNA, 17 nt, Homo sapiens
caccuaugucauuucau

SEQ ID NO: 877538 - RNA, 22 nt, Homo sapiens
caccucacgcucuggacaugau

SEQ ID NO: 877539 - RNA, 20 nt, Homo sapiens
aaagaaugagcauugagacg

SEQ ID NO: 877540 - RNA, 23 nt, Homo sapiens
aaagaauuuuuuaagaacuguau

SEQ ID NO: 877541 - RNA, 20 nt, Homo sapiens
aaagacaaaacuuccuguuu

SEQ ID NO: 877542 - RNA, 17 nt, Homo sapiens
aaagacugauuaccucc

SEQ ID NO: 877543 - RNA, 14 nt, Homo sapiens
aaagacuggccuga

SEQ ID NO: 877544 - RNA, 18 nt, Homo sapiens
aaagacuuaacugguuca

SEQ ID NO: 877545 - RNA, 17 nt, Homo sapiens
aaagagaaaaaccaaug

SEQ ID NO: 877546 - RNA, 20 nt, Homo sapiens
aaagagaauaaagacuucau

SEQ ID NO: 877547 - RNA, 23 nt, Homo sapiens
aaagagagaucuugauccacaga

SEQ ID NO: 877548 - RNA, 22 nt, Homo sapiens
aaagagagcccugguccuagac

SEQ ID NO: 877549 - RNA, 16 nt, Homo sapiens
aaagagccuggagaag

SEQ ID NO: 877550 - RNA, 15 nt, Homo sapiens
aaagaggcagcuuga

SEQ ID NO: 877551 - RNA, 16 nt, Homo sapiens
aaagagggagugcauu

SEQ ID NO: 877552 - RNA, 14 nt, Homo sapiens
aaagaguccuauuu

SEQ ID NO: 877553 - RNA, 21 nt, Homo sapiens
aaagagucuugguuccucuac

SEQ ID NO: 877554 - RNA, 20 nt, Homo sapiens
aaagauauaugaauaugaca

SEQ ID NO: 877555 - RNA, 20 nt, Homo sapiens
aaagaugaucuacucagaaa

SEQ ID NO: 877556 - RNA, 21 nt, Homo sapiens
aaagaugaucuacucagaaau

SEQ ID NO: 877557 - RNA, 14 nt, Homo sapiens
aaagaugaugcaag

SEQ ID NO: 877558 - RNA, 19 nt, Homo sapiens
aaagaugcuugaugcccag

SEQ ID NO: 877559 - RNA, 21 nt, Homo sapiens
aaagauggcugugccucugcc

SEQ ID NO: 877560 - RNA, 18 nt, Homo sapiens
aaagauguguuguugguu

SEQ ID NO: 877561 - RNA, 16 nt, Homo sapiens
aaagauguuugucaga

SEQ ID NO: 877562 - RNA, 21 nt, Homo sapiens
aaagauucccacccaauucaa

SEQ ID NO: 877563 - RNA, 15 nt, Homo sapiens
aaagauuuggaaaac

SEQ ID NO: 877564 - RNA, 16 nt, Homo sapiens
aaagcaaaagcucugu

SEQ ID NO: 877565 - RNA, 15 nt, Homo sapiens
aaagcaaaauccaac

SEQ ID NO: 877566 - RNA, 23 nt, Homo sapiens
aaagcaagacagauuaccaaaga

SEQ ID NO: 877567 - RNA, 19 nt, Homo sapiens
aaagcacuuuacagaugag

SEQ ID NO: 877568 - RNA, 17 nt, Homo sapiens
aaagcagaugagcugug

SEQ ID NO: 877569 - RNA, 20 nt, Homo sapiens
aaagcagaugagcuguggac

SEQ ID NO: 877570 - RNA, 13 nt, Homo sapiens
aaagcaguauuug

SEQ ID NO: 877571 - RNA, 22 nt, Homo sapiens
aaagcaguguuuucaccucaua

SEQ ID NO: 877572 - RNA, 20 nt, Homo sapiens
aaagcauguggcauguucau

SEQ ID NO: 877573 - RNA, 15 nt, Homo sapiens
aaagcauugagaucu

SEQ ID NO: 877574 - RNA, 18 nt, Homo sapiens
aaagcccaaccuccugac

SEQ ID NO: 877575 - RNA, 22 nt, Homo sapiens
aaagccucuggaaaacucagga

SEQ ID NO: 877576 - RNA, 17 nt, Homo sapiens
aaagcugcuugacuauc

SEQ ID NO: 877577 - RNA, 15 nt, Homo sapiens
aaagcuuaggcugcu

SEQ ID NO: 877578 - RNA, 18 nt, Homo sapiens
aaagcuucuaucccagga

SEQ ID NO: 877579 - RNA, 15 nt, Homo sapiens
aaaggaaaagucaac

SEQ ID NO: 877580 - RNA, 14 nt, Homo sapiens
aaaggaaaccaaag

SEQ ID NO: 877581 - RNA, 20 nt, Homo sapiens
aaaggaagcuccacugucac

SEQ ID NO: 877582 - RNA, 13 nt, Homo sapiens
aaaggaaucucca

SEQ ID NO: 877583 - RNA, 19 nt, Homo sapiens
aaaggaccugcauuuuccu

SEQ ID NO: 877584 - RNA, 22 nt, Homo sapiens
aaaggaccuuaccuguguuuca

SEQ ID NO: 877585 - RNA, 22 nt, Homo sapiens
aaaggaccuucccaagucuccc

SEQ ID NO: 877586 - RNA, 17 nt, Homo sapiens
aaaggagaacuauccaa

SEQ ID NO: 877587 - RNA, 21 nt, Homo sapiens
aaaggagaaguagcugugaac

SEQ ID NO: 877588 - RNA, 14 nt, Homo sapiens
aaaggagcucugaa

SEQ ID NO: 877589 - RNA, 16 nt, Homo sapiens
aaaggaggcaugccuc

SEQ ID NO: 877590 - RNA, 18 nt, Homo sapiens
cacugacauuauaucaug

SEQ ID NO: 877591 - RNA, 13 nt, Homo sapiens
cacugagggccac

SEQ ID NO: 877592 - RNA, 18 nt, Homo sapiens
cacugaugggcaaccccc

SEQ ID NO: 877593 - RNA, 13 nt, Homo sapiens
cacugcacccucc

SEQ ID NO: 877594 - RNA, 19 nt, Homo sapiens
cacugcacuauagccuagg

SEQ ID NO: 877595 - RNA, 14 nt, Homo sapiens
cacugcucaagaag

SEQ ID NO: 877596 - RNA, 14 nt, Homo sapiens
cacugcuccagugg

SEQ ID NO: 877597 - RNA, 14 nt, Homo sapiens
cacugcugcugcag

SEQ ID NO: 877598 - RNA, 14 nt, Homo sapiens
cacuggaggucaca

SEQ ID NO: 877599 - RNA, 14 nt, Homo sapiens
cacuggaucuucag

SEQ ID NO: 877600 - RNA, 15 nt, Homo sapiens
cacuguaaaugcagc

SEQ ID NO: 877601 - RNA, 12 nt, Homo sapiens
cacuguccagca

SEQ ID NO: 877602 - RNA, 14 nt, Homo sapiens
cacugugggaccaa

SEQ ID NO: 877603 - RNA, 16 nt, Homo sapiens
cacugugggcuuuuau

SEQ ID NO: 877604 - RNA, 21 nt, Homo sapiens
cacugugggggcugguccuga

SEQ ID NO: 877605 - RNA, 22 nt, Homo sapiens
cacuguguuggaggauggcacu

SEQ ID NO: 877606 - RNA, 14 nt, Homo sapiens
cacuguugcccagg

SEQ ID NO: 877607 - RNA, 23 nt, Homo sapiens
cacuuacuaaccugguccuaacc

SEQ ID NO: 877608 - RNA, 18 nt, Homo sapiens
cacuuagcuaucagaaga

SEQ ID NO: 877609 - RNA, 15 nt, Homo sapiens
cacuuauaccaaagg

SEQ ID NO: 877610 - RNA, 16 nt, Homo sapiens
cacuuauugacuauua

SEQ ID NO: 877611 - RNA, 15 nt, Homo sapiens
cacuucaaucugaga

SEQ ID NO: 877612 - RNA, 16 nt, Homo sapiens
cacuucacuaccaaau

SEQ ID NO: 877613 - RNA, 20 nt, Homo sapiens
cacuucucaggacacaggcc

SEQ ID NO: 877614 - RNA, 19 nt, Homo sapiens
cacuucucaucauauugua

SEQ ID NO: 877615 - RNA, 18 nt, Homo sapiens
cacuucucuacucuggaa

SEQ ID NO: 877616 - RNA, 20 nt, Homo sapiens
cacuucuuacaauaauucua

SEQ ID NO: 877617 - RNA, 21 nt, Homo sapiens
cacuucuuacaauaauucuau

SEQ ID NO: 877618 - RNA, 14 nt, Homo sapiens
cacuugacauuccu

SEQ ID NO: 877619 - RNA, 22 nt, Homo sapiens
cacuugcccugccacuuugcau

SEQ ID NO: 877620 - RNA, 14 nt, Homo sapiens
cacuuguauaaaug

SEQ ID NO: 877621 - RNA, 12 nt, Homo sapiens
cacuuguaugcu

SEQ ID NO: 877622 - RNA, 20 nt, Homo sapiens
cacuuuaauucucaugugau

SEQ ID NO: 877623 - RNA, 12 nt, Homo sapiens
cacuuucaccag

SEQ ID NO: 877624 - RNA, 19 nt, Homo sapiens
cacuuugggaggcugaggc

SEQ ID NO: 877625 - RNA, 22 nt, Homo sapiens
cagaaaaaaauaaaaacauaaa

SEQ ID NO: 877626 - RNA, 16 nt, Homo sapiens
cagaaaacauaugcau

SEQ ID NO: 877627 - RNA, 22 nt, Homo sapiens
cagaaaacauaugcauuaugaa

SEQ ID NO: 877628 - RNA, 16 nt, Homo sapiens
cagaaaagaaaaccau

SEQ ID NO: 877629 - RNA, 23 nt, Homo sapiens
cagaaaagugcuuagaaaguuau

SEQ ID NO: 877630 - RNA, 23 nt, Homo sapiens
cagaaagaaguuaacuacagugu

SEQ ID NO: 877631 - RNA, 12 nt, Homo sapiens
cagaaagcauua

SEQ ID NO: 877632 - RNA, 15 nt, Homo sapiens
cagaaagcauuacau

SEQ ID NO: 877633 - RNA, 19 nt, Homo sapiens
cagaaagccaggguccuga

SEQ ID NO: 877634 - RNA, 15 nt, Homo sapiens
cagaaauacaugaaa

SEQ ID NO: 877635 - RNA, 16 nt, Homo sapiens
cagaaauacugcucug

SEQ ID NO: 877636 - RNA, 21 nt, Homo sapiens
cagaaauguuaaacugagaca

SEQ ID NO: 877637 - RNA, 22 nt, Homo sapiens
cagaacacugucuugaagacaa

SEQ ID NO: 877638 - RNA, 11 nt, Homo sapiens
cagaacagagg

SEQ ID NO: 877639 - RNA, 14 nt, Homo sapiens
cagaacaguuugua

SEQ ID NO: 877640 - RNA, 13 nt, Homo sapiens
cagaaccaaagca

SEQ ID NO: 877641 - RNA, 18 nt, Homo sapiens
cagaaccucaagucuaga

SEQ ID NO: 877642 - RNA, 20 nt, Homo sapiens
cagaagaaaaaguugcaguc

SEQ ID NO: 877643 - RNA, 23 nt, Homo sapiens
cagaagaaaaaguugcagucuca

SEQ ID NO: 877644 - RNA, 18 nt, Homo sapiens
cagaagaauauucaggac

SEQ ID NO: 877645 - RNA, 22 nt, Homo sapiens
cagaagauaacuugagcaccgu

SEQ ID NO: 877646 - RNA, 15 nt, Homo sapiens
cagaagcacauauga

SEQ ID NO: 877647 - RNA, 21 nt, Homo sapiens
cagaaggauauuuacuacuuu

SEQ ID NO: 877648 - RNA, 19 nt, Homo sapiens
cagaaggcaaaaagacauu

SEQ ID NO: 877649 - RNA, 22 nt, Homo sapiens
cagaauaauucuuccagugcaa

SEQ ID NO: 877650 - RNA, 19 nt, Homo sapiens
cagaauacaguaagcugcu

SEQ ID NO: 877651 - RNA, 13 nt, Homo sapiens
cagaauccaaaga

SEQ ID NO: 877652 - RNA, 18 nt, Homo sapiens
cagaaucccggcugucaa

SEQ ID NO: 877653 - RNA, 20 nt, Homo sapiens
acagggagacugcaucucaa

SEQ ID NO: 877654 - RNA, 15 nt, Homo sapiens
acagggcauggccag

SEQ ID NO: 877655 - RNA, 17 nt, Homo sapiens
acagggcucccgaguca

SEQ ID NO: 877656 - RNA, 24 nt, Homo sapiens
acagggcucccgagucaugcacuc

SEQ ID NO: 877657 - RNA, 20 nt, Homo sapiens
acagggucuaccucugucac

SEQ ID NO: 877658 - RNA, 22 nt, Homo sapiens
acaggguuuugccauguuggcc

SEQ ID NO: 877659 - RNA, 19 nt, Homo sapiens
acagguggcaggaccagga

SEQ ID NO: 877660 - RNA, 21 nt, Homo sapiens
acagguggccuagcaggcaca

SEQ ID NO: 877661 - RNA, 12 nt, Homo sapiens
acagguguaaau

SEQ ID NO: 877662 - RNA, 15 nt, Homo sapiens
acaggugugagucac

SEQ ID NO: 877663 - RNA, 19 nt, Homo sapiens
acagguguuuauacagcuc

SEQ ID NO: 877664 - RNA, 23 nt, Homo sapiens
acaguaaauaaauuguuugacca

SEQ ID NO: 877665 - RNA, 14 nt, Homo sapiens
acaguaacugccau

SEQ ID NO: 877666 - RNA, 15 nt, Homo sapiens
acaguauuacuucug

SEQ ID NO: 877667 - RNA, 13 nt, Homo sapiens
acagucauuuaaa

SEQ ID NO: 877668 - RNA, 19 nt, Homo sapiens
acaguccuaccucaguuca

SEQ ID NO: 877669 - RNA, 18 nt, Homo sapiens
acaguccucacagccucu

SEQ ID NO: 877670 - RNA, 22 nt, Homo sapiens
acaguccugggagaaccucagg

SEQ ID NO: 877671 - RNA, 17 nt, Homo sapiens
acagucucaagcacuaa

SEQ ID NO: 877672 - RNA, 22 nt, Homo sapiens
acagucucugggagacuuuccc

SEQ ID NO: 877673 - RNA, 22 nt, Homo sapiens
acagugaucuccauauguuaca

SEQ ID NO: 877674 - RNA, 21 nt, Homo sapiens
acagugcccuuuucaucucca

SEQ ID NO: 877675 - RNA, 20 nt, Homo sapiens
acagugccuggcaaggccuc

SEQ ID NO: 877676 - RNA, 18 nt, Homo sapiens
acagugggaacucugaca

SEQ ID NO: 877677 - RNA, 22 nt, Homo sapiens
acaguguauguacuaagcagua

SEQ ID NO: 877678 - RNA, 18 nt, Homo sapiens
acaguuaugggacacuga

SEQ ID NO: 877679 - RNA, 13 nt, Homo sapiens
acaguuccuucag

SEQ ID NO: 877680 - RNA, 16 nt, Homo sapiens
acaguuccuucagcuu

SEQ ID NO: 877681 - RNA, 20 nt, Homo sapiens
acaguuuagugcuuuacaug

SEQ ID NO: 877682 - RNA, 22 nt, Homo sapiens
acaguuuagugcuuuacaugcu

SEQ ID NO: 877683 - RNA, 15 nt, Homo sapiens
acaguuugaugucau

SEQ ID NO: 877684 - RNA, 15 nt, Homo sapiens
acaguuuggaagugu

SEQ ID NO: 877685 - RNA, 16 nt, Homo sapiens
acauaaacacauacau

SEQ ID NO: 877686 - RNA, 15 nt, Homo sapiens
acauaacaugcuuua

SEQ ID NO: 877687 - RNA, 13 nt, Homo sapiens
acauaacuugaua

SEQ ID NO: 877688 - RNA, 15 nt, Homo sapiens
acauaagacagacag

SEQ ID NO: 877689 - RNA, 20 nt, Homo sapiens
acauaagaccauaacagcca

SEQ ID NO: 877690 - RNA, 15 nt, Homo sapiens
acauaaucacaauaa

SEQ ID NO: 877691 - RNA, 21 nt, Homo sapiens
acauacaauuugcacuguuac

SEQ ID NO: 877692 - RNA, 13 nt, Homo sapiens
acauacacucaaa

SEQ ID NO: 877693 - RNA, 20 nt, Homo sapiens
acauacagagguaacuauca

SEQ ID NO: 877694 - RNA, 12 nt, Homo sapiens
acauacauacau

SEQ ID NO: 877695 - RNA, 12 nt, Homo sapiens
acauacauauau

SEQ ID NO: 877696 - RNA, 15 nt, Homo sapiens
acauacgugucugug

SEQ ID NO: 877697 - RNA, 19 nt, Homo sapiens
acauagacaaaaaauuuga

SEQ ID NO: 877698 - RNA, 15 nt, Homo sapiens
acauagacagaagaa

SEQ ID NO: 877699 - RNA, 17 nt, Homo sapiens
acauaguuauucuauca

SEQ ID NO: 877700 - RNA, 22 nt, Homo sapiens
acauaguucuuacuacuugcca

SEQ ID NO: 877701 - RNA, 16 nt, Homo sapiens
acauauaccuucucaa

SEQ ID NO: 877702 - RNA, 16 nt, Homo sapiens
acauauauaugucagg

SEQ ID NO: 877703 - RNA, 20 nt, Homo sapiens
acauaucaccucauggccua

SEQ ID NO: 877704 - RNA, 12 nt, Homo sapiens
acauaugcauuu

SEQ ID NO: 877705 - RNA, 23 nt, Homo sapiens
acauauucuaguguaacacugca

SEQ ID NO: 877706 - RNA, 22 nt, Homo sapiens
acauauucuuggagaacuuucc

SEQ ID NO: 877707 - RNA, 23 nt, Homo sapiens
acauauucuuuaaauuucaucuc

SEQ ID NO: 877708 - RNA, 20 nt, Homo sapiens
acaucaaauuugccaccacu

SEQ ID NO: 877709 - RNA, 19 nt, Homo sapiens
acaucaccuuuuugacuuu

SEQ ID NO: 877710 - RNA, 17 nt, Homo sapiens
ccuauuaaaacacagcu

SEQ ID NO: 877711 - RNA, 16 nt, Homo sapiens
ccuauucuauugcagu

SEQ ID NO: 877712 - RNA, 9 nt, Homo sapiens
ccuauuuau

SEQ ID NO: 877713 - RNA, 16 nt, Homo sapiens
ccuauuuuuggaagag

SEQ ID NO: 877714 - RNA, 20 nt, Homo sapiens
ccucaaagcccccacuucuc

SEQ ID NO: 877715 - RNA, 18 nt, Homo sapiens
ccucaaaugacccaaaga

SEQ ID NO: 877716 - RNA, 19 nt, Homo sapiens
ccucaacaacaaaccaaaa

SEQ ID NO: 877717 - RNA, 19 nt, Homo sapiens
ccucaauaagccagcaaac

SEQ ID NO: 877718 - RNA, 13 nt, Homo sapiens
ccucaaugugacc

SEQ ID NO: 877719 - RNA, 21 nt, Homo sapiens
ccucacuaugacacugagcaa

SEQ ID NO: 877720 - RNA, 12 nt, Homo sapiens
ccucacugaaaa

SEQ ID NO: 877721 - RNA, 14 nt, Homo sapiens
ccucacuguguugg

SEQ ID NO: 877722 - RNA, 14 nt, Homo sapiens
ccucagccaaacac

SEQ ID NO: 877723 - RNA, 14 nt, Homo sapiens
ccucagccaugagg

SEQ ID NO: 877724 - RNA, 18 nt, Homo sapiens
ccucagcugcacauuccu

SEQ ID NO: 877725 - RNA, 19 nt, Homo sapiens
ccucaggccaggugcagug

SEQ ID NO: 877726 - RNA, 23 nt, Homo sapiens
ccucagggaguuugacgagcuca

SEQ ID NO: 877727 - RNA, 22 nt, Homo sapiens
ccucagggaucuugcauuccca

SEQ ID NO: 877728 - RNA, 15 nt, Homo sapiens
ccucauaucuuccuc

SEQ ID NO: 877729 - RNA, 17 nt, Homo sapiens
ccucaucaguagauggu

SEQ ID NO: 877730 - RNA, 23 nt, Homo sapiens
ccucaucuugcccccucaucuca

SEQ ID NO: 877731 - RNA, 18 nt, Homo sapiens
ccucaugugugcugugcu

SEQ ID NO: 877732 - RNA, 16 nt, Homo sapiens
ccuccaaaugccaacu

SEQ ID NO: 877733 - RNA, 14 nt, Homo sapiens
ccuccaaggggcuu

SEQ ID NO: 877734 - RNA, 17 nt, Homo sapiens
ccuccaguaguggacaa

SEQ ID NO: 877735 - RNA, 21 nt, Homo sapiens
ccuccaguaguggacaacagg

SEQ ID NO: 877736 - RNA, 15 nt, Homo sapiens
ccuccauucugacca

SEQ ID NO: 877737 - RNA, 17 nt, Homo sapiens
ccuccauucugaccauu

SEQ ID NO: 877738 - RNA, 20 nt, Homo sapiens
ccuccauuucucuccaggaa

SEQ ID NO: 877739 - RNA, 22 nt, Homo sapiens
ccuccauuugcaauugaccucu

SEQ ID NO: 877740 - RNA, 12 nt, Homo sapiens
ccucccaaagug

SEQ ID NO: 877741 - RNA, 22 nt, Homo sapiens
ccucccagcagcgguaccccag

SEQ ID NO: 877742 - RNA, 16 nt, Homo sapiens
ccucccauagcacugc

SEQ ID NO: 877743 - RNA, 13 nt, Homo sapiens
ccucccugggguc

SEQ ID NO: 877744 - RNA, 15 nt, Homo sapiens
ccuccuaaauuucca

SEQ ID NO: 877745 - RNA, 16 nt, Homo sapiens
ccuccuaaccuagaga

SEQ ID NO: 877746 - RNA, 19 nt, Homo sapiens
ccuccuaaccuagagauug

SEQ ID NO: 877747 - RNA, 13 nt, Homo sapiens
ccuccucuuccuc

SEQ ID NO: 877748 - RNA, 19 nt, Homo sapiens
ccuccugccuccagcacuc

SEQ ID NO: 877749 - RNA, 23 nt, Homo sapiens
ccuccugccugcgggcaccuaca

SEQ ID NO: 877750 - RNA, 14 nt, Homo sapiens
ccucgccacgggga

SEQ ID NO: 877751 - RNA, 16 nt, Homo sapiens
ccucguagccaucucu

SEQ ID NO: 877752 - RNA, 13 nt, Homo sapiens
ccucuaauugcau

SEQ ID NO: 877753 - RNA, 16 nt, Homo sapiens
ccucuacuuaaugaga

SEQ ID NO: 877754 - RNA, 19 nt, Homo sapiens
ccucuaguuuuaagacuga

SEQ ID NO: 877755 - RNA, 13 nt, Homo sapiens
ccucuccuuggaa

SEQ ID NO: 877756 - RNA, 22 nt, Homo sapiens
ccucucuaagccacagcuucuu

SEQ ID NO: 877757 - RNA, 12 nt, Homo sapiens
ccucucucagga

SEQ ID NO: 877758 - RNA, 17 nt, Homo sapiens
ccucucugcuccagaga

SEQ ID NO: 877759 - RNA, 16 nt, Homo sapiens
ccucucuuauagaaua

SEQ ID NO: 877760 - RNA, 19 nt, Homo sapiens
ccucugaaauuucccacac

SEQ ID NO: 877761 - RNA, 15 nt, Homo sapiens
ccucugaucaguuuc

SEQ ID NO: 877762 - RNA, 14 nt, Homo sapiens
ccucugcagcacuu

SEQ ID NO: 877763 - RNA, 17 nt, Homo sapiens
ccucugcagcacuuuaa

SEQ ID NO: 877764 - RNA, 21 nt, Homo sapiens
ccucuggauucucugggucua

SEQ ID NO: 877765 - RNA, 15 nt, Homo sapiens
ccucugggagccuga

SEQ ID NO: 877766 - RNA, 22 nt, Homo sapiens
ccucugucaaugaaaaaaagua

SEQ ID NO: 877767 - RNA, 21 nt, Homo sapiens
ccucugucucugcucuugccu

SEQ ID NO: 877768 - RNA, 22 nt, Homo sapiens
ccuuaaucugccauaaagccau

SEQ ID NO: 877769 - RNA, 19 nt, Homo sapiens
ccuuaaugagaacauuuac

SEQ ID NO: 877770 - RNA, 22 nt, Homo sapiens
ccuuacagaacacgcuuucaca

SEQ ID NO: 877771 - RNA, 14 nt, Homo sapiens
ccuuacucaccucu

SEQ ID NO: 877772 - RNA, 11 nt, Homo sapiens
ccuuacucuga

SEQ ID NO: 877773 - RNA, 22 nt, Homo sapiens
ccuuagcuggcauuacagcugg

SEQ ID NO: 877774 - RNA, 23 nt, Homo sapiens
ccuuaggaaaaugcuucuguugu

SEQ ID NO: 877775 - RNA, 14 nt, Homo sapiens
ccuuauuguaccuc

SEQ ID NO: 877776 - RNA, 21 nt, Homo sapiens
ccuuauuguaccucucuuaua

SEQ ID NO: 877777 - RNA, 19 nt, Homo sapiens
ccuucaaguuagcucagga

SEQ ID NO: 877778 - RNA, 14 nt, Homo sapiens
ccuucacagugacc

SEQ ID NO: 877779 - RNA, 13 nt, Homo sapiens
ccuucacauuuaa

SEQ ID NO: 877780 - RNA, 17 nt, Homo sapiens
ccuucaccagagcccau

SEQ ID NO: 877781 - RNA, 12 nt, Homo sapiens
ccuucaccuuca

SEQ ID NO: 877782 - RNA, 22 nt, Homo sapiens
ccuucaggguuggauguaguuu

SEQ ID NO: 877783 - RNA, 18 nt, Homo sapiens
ccuuccagcuagugaccc

SEQ ID NO: 877784 - RNA, 19 nt, Homo sapiens
ccuucccaaucagcacuga

SEQ ID NO: 877785 - RNA, 21 nt, Homo sapiens
ccuucccaaucagcacugaaa

SEQ ID NO: 877786 - RNA, 17 nt, Homo sapiens
ccuucccucuuucccca

SEQ ID NO: 877787 - RNA, 18 nt, Homo sapiens
ccuuccuaauaugcuuua

SEQ ID NO: 877788 - RNA, 21 nt, Homo sapiens
ccuuccucucaagcuagccag

SEQ ID NO: 877789 - RNA, 18 nt, Homo sapiens
ccuuccugccaccaguca

SEQ ID NO: 877790 - RNA, 12 nt, Homo sapiens
ccuucucaaaag

SEQ ID NO: 877791 - RNA, 19 nt, Homo sapiens
ccuucuccugccuacauuc

SEQ ID NO: 877792 - RNA, 14 nt, Homo sapiens
ccuucucuacccau

SEQ ID NO: 877793 - RNA, 12 nt, Homo sapiens
ccuucucuucuc

SEQ ID NO: 877794 - RNA, 16 nt, Homo sapiens
ccuucugaagaucuca

SEQ ID NO: 877795 - RNA, 18 nt, Homo sapiens
ccuucugcuguauacugu

SEQ ID NO: 877796 - RNA, 13 nt, Homo sapiens
ccuugaagccacu

SEQ ID NO: 877797 - RNA, 14 nt, Homo sapiens
ccuugaccaagaag

SEQ ID NO: 877798 - RNA, 13 nt, Homo sapiens
ccuugagcacuca

SEQ ID NO: 877799 - RNA, 18 nt, Homo sapiens
ccuugagcuccccaaaaa

SEQ ID NO: 877800 - RNA, 13 nt, Homo sapiens
ccuugcaccugca

SEQ ID NO: 877801 - RNA, 10 nt, Homo sapiens
ccuugcagca

SEQ ID NO: 877802 - RNA, 20 nt, Homo sapiens
ccuugcaucaagggcuuuau

SEQ ID NO: 877803 - RNA, 20 nt, Homo sapiens
ccuugcauccaucugggcua

SEQ ID NO: 877804 - RNA, 22 nt, Homo sapiens
ccuugccuguuuuucaaucuca

SEQ ID NO: 877805 - RNA, 23 nt, Homo sapiens
ccuugcuggacggggacugggga

SEQ ID NO: 877806 - RNA, 21 nt, Homo sapiens
ccuugcuguuuucaucucugc

SEQ ID NO: 877807 - RNA, 19 nt, Homo sapiens
ccuugggagguuuuauucu

SEQ ID NO: 877808 - RNA, 16 nt, Homo sapiens
ccuuggggauucuucc

SEQ ID NO: 877809 - RNA, 21 nt, Homo sapiens
ccuugguaggggacuaauuca

SEQ ID NO: 877810 - RNA, 16 nt, Homo sapiens
ccuuguaaacaugaag

SEQ ID NO: 877811 - RNA, 24 nt, Homo sapiens
ccuugugaccuucucuauaucaug

SEQ ID NO: 877812 - RNA, 20 nt, Homo sapiens
ccuuuacauaauugcaauau

SEQ ID NO: 877813 - RNA, 22 nt, Homo sapiens
ccuuuagauauuauucauucau

SEQ ID NO: 877814 - RNA, 20 nt, Homo sapiens
ccuuuauuaaaaacugagug

SEQ ID NO: 877815 - RNA, 15 nt, Homo sapiens
ccuuuauugcuccug

SEQ ID NO: 877816 - RNA, 13 nt, Homo sapiens
ccuuuauugugau

SEQ ID NO: 877817 - RNA, 16 nt, Homo sapiens
ccuuucaccacaugug

SEQ ID NO: 877818 - RNA, 22 nt, Homo sapiens
ccuuuccucugcagcacuuuaa

SEQ ID NO: 877819 - RNA, 21 nt, Homo sapiens
ccuuucuaaaucugagaucuc

SEQ ID NO: 877820 - RNA, 21 nt, Homo sapiens
ccuuucucuccagccugacuu

SEQ ID NO: 877821 - RNA, 16 nt, Homo sapiens
ccuuucuucaccaaau

SEQ ID NO: 877822 - RNA, 19 nt, Homo sapiens
ccuuugaggcaaaggccag

SEQ ID NO: 877823 - RNA, 19 nt, Homo sapiens
ccuuuggaugcacuuuaua

SEQ ID NO: 877824 - RNA, 11 nt, Homo sapiens
ccuuuguguaa

SEQ ID NO: 877825 - RNA, 15 nt, Homo sapiens
accaguagacaacug

SEQ ID NO: 877826 - RNA, 14 nt, Homo sapiens
accagucacugucc

SEQ ID NO: 877827 - RNA, 13 nt, Homo sapiens
accaguguagccu

SEQ ID NO: 877828 - RNA, 20 nt, Homo sapiens
accaguguccccuccacugu

SEQ ID NO: 877829 - RNA, 23 nt, Homo sapiens
accaguguccccuccacugucac

SEQ ID NO: 877830 - RNA, 19 nt, Homo sapiens
accaguugggagcacugga

SEQ ID NO: 877831 - RNA, 21 nt, Homo sapiens
accaguuucugcggccuucca

SEQ ID NO: 877832 - RNA, 21 nt, Homo sapiens
accauaagggacugugccaga

SEQ ID NO: 877833 - RNA, 14 nt, Homo sapiens
accauaauguuaca

SEQ ID NO: 877834 - RNA, 11 nt, Homo sapiens
accauccacag

SEQ ID NO: 877835 - RNA, 11 nt, Homo sapiens
accaucugucu

SEQ ID NO: 877836 - RNA, 11 nt, Homo sapiens
accaugaagcu

SEQ ID NO: 877837 - RNA, 21 nt, Homo sapiens
accaugagaccacuguuauca

SEQ ID NO: 877838 - RNA, 18 nt, Homo sapiens
accaugcauggugcauca

SEQ ID NO: 877839 - RNA, 13 nt, Homo sapiens
accaugccaggcu

SEQ ID NO: 877840 - RNA, 17 nt, Homo sapiens
accaugcgcugcucaac

SEQ ID NO: 877841 - RNA, 12 nt, Homo sapiens
accauuacugua

SEQ ID NO: 877842 - RNA, 15 nt, Homo sapiens
accauuacuguaauu

SEQ ID NO: 877843 - RNA, 14 nt, Homo sapiens
accauugucuucca

SEQ ID NO: 877844 - RNA, 21 nt, Homo sapiens
accauuguuccuuaccuuuac

SEQ ID NO: 877845 - RNA, 21 nt, Homo sapiens
acccaauucaggacuggcuca

SEQ ID NO: 877846 - RNA, 22 nt, Homo sapiens
acccaccaucuacccacuuacu

SEQ ID NO: 877847 - RNA, 13 nt, Homo sapiens
acccacuccucac

SEQ ID NO: 877848 - RNA, 14 nt, Homo sapiens
acccacuccucacu

SEQ ID NO: 877849 - RNA, 21 nt, Homo sapiens
acccacugcuuuuggucugug

SEQ ID NO: 877850 - RNA, 16 nt, Homo sapiens
acccagagccuucucc

SEQ ID NO: 877851 - RNA, 18 nt, Homo sapiens
acccagauauugcacuag

SEQ ID NO: 877852 - RNA, 19 nt, Homo sapiens
acccagauuuccuaacucu

SEQ ID NO: 877853 - RNA, 21 nt, Homo sapiens
acccagcuacucuguccaggc

SEQ ID NO: 877854 - RNA, 12 nt, Homo sapiens
acccaggaguuu

SEQ ID NO: 877855 - RNA, 22 nt, Homo sapiens
acccaggccgccugccauaccg

SEQ ID NO: 877856 - RNA, 21 nt, Homo sapiens
acccauagugcacacuuguau

SEQ ID NO: 877857 - RNA, 14 nt, Homo sapiens
acccauauuacaga

SEQ ID NO: 877858 - RNA, 22 nt, Homo sapiens
acccaugaaucaaagacaugga

SEQ ID NO: 877859 - RNA, 13 nt, Homo sapiens
acccaugccauag

SEQ ID NO: 877860 - RNA, 15 nt, Homo sapiens
acccaugccauagaa

SEQ ID NO: 877861 - RNA, 19 nt, Homo sapiens
acccauggguccaugggaa

SEQ ID NO: 877862 - RNA, 22 nt, Homo sapiens
accccaccuugccaagcuuucu

SEQ ID NO: 877863 - RNA, 23 nt, Homo sapiens
accccagauggccgggacaugca

SEQ ID NO: 877864 - RNA, 21 nt, Homo sapiens
accccagccuccugccuaccc

SEQ ID NO: 877865 - RNA, 23 nt, Homo sapiens
accccagccuccugccuacccca

SEQ ID NO: 877866 - RNA, 20 nt, Homo sapiens
accccagcuagggcuggacu

SEQ ID NO: 877867 - RNA, 19 nt, Homo sapiens
accccagggccuacugcca

SEQ ID NO: 877868 - RNA, 12 nt, Homo sapiens
accccaguuuuu

SEQ ID NO: 877869 - RNA, 11 nt, Homo sapiens
accccaucucu

SEQ ID NO: 877870 - RNA, 14 nt, Homo sapiens
acccccagccuggg

SEQ ID NO: 877871 - RNA, 13 nt, Homo sapiens
acccccaucuuuu

SEQ ID NO: 877872 - RNA, 19 nt, Homo sapiens
acccccguguccaccguga

SEQ ID NO: 877873 - RNA, 23 nt, Homo sapiens
acccccuccagcuccaguuucca

SEQ ID NO: 877874 - RNA, 22 nt, Homo sapiens
accccgaccaccugcccaaccu

SEQ ID NO: 877875 - RNA, 23 nt, Homo sapiens
accccugucucuagccacuuugg

SEQ ID NO: 877876 - RNA, 19 nt, Homo sapiens
acccgagcccagcuacauu

SEQ ID NO: 877877 - RNA, 18 nt, Homo sapiens
acccguacaggcaauucc

SEQ ID NO: 877878 - RNA, 21 nt, Homo sapiens
acccuaagccuccuuuugcuu

SEQ ID NO: 877879 - RNA, 23 nt, Homo sapiens
acccuccccauuaguauccuguu

SEQ ID NO: 877880 - RNA, 22 nt, Homo sapiens
acccucccuaccugaggccuau

SEQ ID NO: 877881 - RNA, 17 nt, Homo sapiens
acccuccuccacuccac

SEQ ID NO: 877882 - RNA, 15 nt, Homo sapiens
acgccacugcacucc

SEQ ID NO: 877883 - RNA, 19 nt, Homo sapiens
acgcccagccuccucccac

SEQ ID NO: 877884 - RNA, 15 nt, Homo sapiens
acgccuccuggccag

SEQ ID NO: 877885 - RNA, 13 nt, Homo sapiens
acgcucucugucu

SEQ ID NO: 877886 - RNA, 17 nt, Homo sapiens
acgcuuccagaccaccu

SEQ ID NO: 877887 - RNA, 18 nt, Homo sapiens
acgcuuccagaccaccug

SEQ ID NO: 877888 - RNA, 20 nt, Homo sapiens
acgcuuuuugggagaaugau

SEQ ID NO: 877889 - RNA, 15 nt, Homo sapiens
acggaaggcaaagag

SEQ ID NO: 877890 - RNA, 19 nt, Homo sapiens
acggaaggucaguugccau

SEQ ID NO: 877891 - RNA, 21 nt, Homo sapiens
acggaaggucaguugccaugg

SEQ ID NO: 877892 - RNA, 19 nt, Homo sapiens
acggaguacagacgucuca

SEQ ID NO: 877893 - RNA, 12 nt, Homo sapiens
acggccagcugc

SEQ ID NO: 877894 - RNA, 23 nt, Homo sapiens
acggcuuauuagugaaacugggg

SEQ ID NO: 877895 - RNA, 15 nt, Homo sapiens
acgguaggccaagcu

SEQ ID NO: 877896 - RNA, 18 nt, Homo sapiens
acgguaggccaagcugaa

SEQ ID NO: 877897 - RNA, 20 nt, Homo sapiens
acgguggcucacgccuguaa

SEQ ID NO: 877898 - RNA, 12 nt, Homo sapiens
acgguguugcag

SEQ ID NO: 877899 - RNA, 13 nt, Homo sapiens
acguaaacuuccu

SEQ ID NO: 877900 - RNA, 14 nt, Homo sapiens
acgucaagucuccu

SEQ ID NO: 877901 - RNA, 16 nt, Homo sapiens
acgucccaugugcaug

SEQ ID NO: 877902 - RNA, 14 nt, Homo sapiens
acgucugacaggca

SEQ ID NO: 877903 - RNA, 18 nt, Homo sapiens
acgugcucuucuguucuc

SEQ ID NO: 877904 - RNA, 18 nt, Homo sapiens
acguguucucacacuggu

SEQ ID NO: 877905 - RNA, 17 nt, Homo sapiens
acguuaaguccaaggag

SEQ ID NO: 877906 - RNA, 16 nt, Homo sapiens
acguuuauagccgaaa

SEQ ID NO: 877907 - RNA, 16 nt, Homo sapiens
acuaaaaauacaaaaa

SEQ ID NO: 877908 - RNA, 14 nt, Homo sapiens
acuaaacauuuugu

SEQ ID NO: 877909 - RNA, 15 nt, Homo sapiens
acuaaagugucuauu

SEQ ID NO: 877910 - RNA, 21 nt, Homo sapiens
acuaaaugguugucuggguca

SEQ ID NO: 877911 - RNA, 11 nt, Homo sapiens
acuaaccauag

SEQ ID NO: 877912 - RNA, 15 nt, Homo sapiens
acuaaggagcaugau

SEQ ID NO: 877913 - RNA, 20 nt, Homo sapiens
acuaagggauggggcagucu

SEQ ID NO: 877914 - RNA, 22 nt, Homo sapiens
acuaaggugugcucugaucauc

SEQ ID NO: 877915 - RNA, 20 nt, Homo sapiens
acuaauaaucaccauaugcu

SEQ ID NO: 877916 - RNA, 17 nt, Homo sapiens
acuaauagagacacaga

SEQ ID NO: 877917 - RNA, 17 nt, Homo sapiens
acuaauggaaauauuau

SEQ ID NO: 877918 - RNA, 16 nt, Homo sapiens
acuacaaagcuucuau

SEQ ID NO: 877919 - RNA, 21 nt, Homo sapiens
acuacacacuguguacugcag

SEQ ID NO: 877920 - RNA, 21 nt, Homo sapiens
acuacagaauaauguguuaaa

SEQ ID NO: 877921 - RNA, 16 nt, Homo sapiens
acuacaggcucaugcc

SEQ ID NO: 877922 - RNA, 10 nt, Homo sapiens
acuacagggu

SEQ ID NO: 877923 - RNA, 11 nt, Homo sapiens
acuacaguguu

SEQ ID NO: 877924 - RNA, 15 nt, Homo sapiens
acuacgcuugcucau

SEQ ID NO: 877925 - RNA, 16 nt, Homo sapiens
acuacuaaagugccua

SEQ ID NO: 877926 - RNA, 20 nt, Homo sapiens
acuacugcugcaaagugcaa

SEQ ID NO: 877927 - RNA, 14 nt, Homo sapiens
acuacugugaucag

SEQ ID NO: 877928 - RNA, 20 nt, Homo sapiens
acuacuugccacacacuguu

SEQ ID NO: 877929 - RNA, 16 nt, Homo sapiens
acuacuuuuacuacag

SEQ ID NO: 877930 - RNA, 21 nt, Homo sapiens
acuacuuuuacuacagugaca

SEQ ID NO: 877931 - RNA, 16 nt, Homo sapiens
acuagaagaaagggca

SEQ ID NO: 877932 - RNA, 17 nt, Homo sapiens
acuagaagaaagggcaa

SEQ ID NO: 877933 - RNA, 15 nt, Homo sapiens
acuagaauagugcau

SEQ ID NO: 877934 - RNA, 16 nt, Homo sapiens
acuagcaggcaugccg

SEQ ID NO: 877935 - RNA, 14 nt, Homo sapiens
acuagccugugauu

SEQ ID NO: 877936 - RNA, 19 nt, Homo sapiens
acuaguauuguccauauca

SEQ ID NO: 877937 - RNA, 12 nt, Homo sapiens
acuaguuuccag

SEQ ID NO: 877938 - RNA, 22 nt, Homo sapiens
acuauaaauaauauucuauuca

SEQ ID NO: 877939 - RNA, 14 nt, Homo sapiens
acuauaaccaucag

SEQ ID NO: 877940 - RNA, 19 nt, Homo sapiens
ucacuccacaacccaagaa

SEQ ID NO: 877941 - RNA, 11 nt, Homo sapiens
ucacucccacu

SEQ ID NO: 877942 - RNA, 15 nt, Homo sapiens
ucacucuuaugaaau

SEQ ID NO: 877943 - RNA, 17 nt, Homo sapiens
ucacucuuauugcccac

SEQ ID NO: 877944 - RNA, 19 nt, Homo sapiens
ucacucuucauucuuugaa

SEQ ID NO: 877945 - RNA, 23 nt, Homo sapiens
ucacugaggcauuuuuacuacua

SEQ ID NO: 877946 - RNA, 18 nt, Homo sapiens
ucacugauauauuuucca

SEQ ID NO: 877947 - RNA, 14 nt, Homo sapiens
ucacugcuaccucu

SEQ ID NO: 877948 - RNA, 20 nt, Homo sapiens
ucacugcucccccgugugua

SEQ ID NO: 877949 - RNA, 21 nt, Homo sapiens
ucacugggccuccaaccaugu

SEQ ID NO: 877950 - RNA, 17 nt, Homo sapiens
ucacuucagacaauuca

SEQ ID NO: 877951 - RNA, 13 nt, Homo sapiens
ucacuucaguugc

SEQ ID NO: 877952 - RNA, 16 nt, Homo sapiens
ucacuucccugggaac

SEQ ID NO: 877953 - RNA, 20 nt, Homo sapiens
ucacuuuacaaauucaagcc

SEQ ID NO: 877954 - RNA, 20 nt, Homo sapiens
ucagaaacaggugcaucugg

SEQ ID NO: 877955 - RNA, 23 nt, Homo sapiens
ucagaaagggagggcucugaggc

SEQ ID NO: 877956 - RNA, 22 nt, Homo sapiens
ucagaagaaagaaucuuuccau

SEQ ID NO: 877957 - RNA, 22 nt, Homo sapiens
ucagaagacacugaugggcaac

SEQ ID NO: 877958 - RNA, 15 nt, Homo sapiens
ucagaagacacugca

SEQ ID NO: 877959 - RNA, 13 nt, Homo sapiens
ucagaagccugag

SEQ ID NO: 877960 - RNA, 19 nt, Homo sapiens
ucagaaguuucucagcucc

SEQ ID NO: 877961 - RNA, 19 nt, Homo sapiens
ucagaaguuuggauaaccu

SEQ ID NO: 877962 - RNA, 23 nt, Homo sapiens
ucagaaucagguugacagucccu

SEQ ID NO: 877963 - RNA, 19 nt, Homo sapiens
ucagaauuucuuugucauu

SEQ ID NO: 877964 - RNA, 16 nt, Homo sapiens
ucagaccaacucucuc

SEQ ID NO: 877965 - RNA, 16 nt, Homo sapiens
ucagacuccugugcaa

SEQ ID NO: 877966 - RNA, 13 nt, Homo sapiens
ucagagacauaca

SEQ ID NO: 877967 - RNA, 16 nt, Homo sapiens
ucagagacuaucugau

SEQ ID NO: 877968 - RNA, 14 nt, Homo sapiens
ucagagcacagcag

SEQ ID NO: 877969 - RNA, 15 nt, Homo sapiens
ucagagccaccccua

SEQ ID NO: 877970 - RNA, 14 nt, Homo sapiens
ucagagccagugaa

SEQ ID NO: 877971 - RNA, 23 nt, Homo sapiens
ucagaguuugaagguaacugaga

SEQ ID NO: 877972 - RNA, 16 nt, Homo sapiens
ucagauagaaugacag

SEQ ID NO: 877973 - RNA, 20 nt, Homo sapiens
ucagaucugaacacaguuua

SEQ ID NO: 877974 - RNA, 21 nt, Homo sapiens
ucagaugauucagaaauuuuc

SEQ ID NO: 877975 - RNA, 18 nt, Homo sapiens
ucagauggacaagauuac

SEQ ID NO: 877976 - RNA, 18 nt, Homo sapiens
ucagauggagacauugga

SEQ ID NO: 877977 - RNA, 20 nt, Homo sapiens
ucagauuugcuguucaccca

SEQ ID NO: 877978 - RNA, 15 nt, Homo sapiens
ucagauuuguguuau

SEQ ID NO: 877979 - RNA, 17 nt, Homo sapiens
ucagcaauacuaaggga

SEQ ID NO: 877980 - RNA, 22 nt, Homo sapiens
ucagcacugccggcccagugac

SEQ ID NO: 877981 - RNA, 15 nt, Homo sapiens
ucagcagagaacugg

SEQ ID NO: 877982 - RNA, 22 nt, Homo sapiens
ucagcaggaaccuguacugggu

SEQ ID NO: 877983 - RNA, 18 nt, Homo sapiens
ucagcauucucacuccua

SEQ ID NO: 877984 - RNA, 18 nt, Homo sapiens
ucagccacaccugucagc

SEQ ID NO: 877985 - RNA, 22 nt, Homo sapiens
ucagccaucccgucuucuccaa

SEQ ID NO: 877986 - RNA, 23 nt, Homo sapiens
ucagcccgggacagggucuugca

SEQ ID NO: 877987 - RNA, 13 nt, Homo sapiens
ucagcccucagaa

SEQ ID NO: 877988 - RNA, 22 nt, Homo sapiens
ucagccucugaucaguuucaca

SEQ ID NO: 877989 - RNA, 15 nt, Homo sapiens
ucagcgugcuuagcc

SEQ ID NO: 877990 - RNA, 16 nt, Homo sapiens
ucagcucacacccuaa

SEQ ID NO: 877991 - RNA, 19 nt, Homo sapiens
ucagcuccagaauaccuuc

SEQ ID NO: 877992 - RNA, 16 nt, Homo sapiens
ucagcucucuguauaa

SEQ ID NO: 877993 - RNA, 17 nt, Homo sapiens
ucagcugugaacaugga

SEQ ID NO: 877994 - RNA, 19 nt, Homo sapiens
ucagcuuguaaauagcuca

SEQ ID NO: 877995 - RNA, 17 nt, Homo sapiens
ucagcuuugcuuuuccu

SEQ ID NO: 877996 - RNA, 22 nt, Homo sapiens
ucagcuuuuaauaaaauugaca

SEQ ID NO: 877997 - RNA, 15 nt, Homo sapiens
ugccaggccuggcaa

SEQ ID NO: 877998 - RNA, 21 nt, Homo sapiens
ugccaggcguuggugccacuu

SEQ ID NO: 877999 - RNA, 18 nt, Homo sapiens
ugccaggcuguaagcauu

SEQ ID NO: 878000 - RNA, 18 nt, Homo sapiens
ugccagggacugacaaaa

SEQ ID NO: 878001 - RNA, 11 nt, Homo sapiens
ugccagugaaa

SEQ ID NO: 878002 - RNA, 22 nt, Homo sapiens
ugccagugccuuaccuccugcc

SEQ ID NO: 878003 - RNA, 21 nt, Homo sapiens
ugccauagaggacagcaacug

SEQ ID NO: 878004 - RNA, 14 nt, Homo sapiens
ugccauagcaagau

SEQ ID NO: 878005 - RNA, 18 nt, Homo sapiens
ugccauauucuguuggcc

SEQ ID NO: 878006 - RNA, 17 nt, Homo sapiens
ugccaucuccacccuga

SEQ ID NO: 878007 - RNA, 15 nt, Homo sapiens
ugccaugcccagaga

SEQ ID NO: 878008 - RNA, 13 nt, Homo sapiens
ugccaugccucaa

SEQ ID NO: 878009 - RNA, 18 nt, Homo sapiens
ugccauucccacuaagcu

SEQ ID NO: 878010 - RNA, 22 nt, Homo sapiens
ugcccaccaccgugucaugaga

SEQ ID NO: 878011 - RNA, 15 nt, Homo sapiens
ugcccacucuaauau

SEQ ID NO: 878012 - RNA, 19 nt, Homo sapiens
ugcccagagaaucagggca

SEQ ID NO: 878013 - RNA, 19 nt, Homo sapiens
ugcccagccucgcaugcca

SEQ ID NO: 878014 - RNA, 21 nt, Homo sapiens
ugcccagccucgcaugccaga

SEQ ID NO: 878015 - RNA, 20 nt, Homo sapiens
ugcccaggcuggagugcagu

SEQ ID NO: 878016 - RNA, 20 nt, Homo sapiens
ugcccaggcuggcgugcagu

SEQ ID NO: 878017 - RNA, 22 nt, Homo sapiens
ugcccauuguccuuaccguccu

SEQ ID NO: 878018 - RNA, 14 nt, Homo sapiens
ugccccagcuuuau

SEQ ID NO: 878019 - RNA, 15 nt, Homo sapiens
ugccccagcuuuauc

SEQ ID NO: 878020 - RNA, 22 nt, Homo sapiens
ugccccagcuuuaucugucaca

SEQ ID NO: 878021 - RNA, 21 nt, Homo sapiens
ugccccuccagagacaggaaa

SEQ ID NO: 878022 - RNA, 17 nt, Homo sapiens
ugccccucuucccggga

SEQ ID NO: 878023 - RNA, 17 nt, Homo sapiens
ugcccgaccccaucuca

SEQ ID NO: 878024 - RNA, 18 nt, Homo sapiens
ugcccgaccccaucucau

SEQ ID NO: 878025 - RNA, 20 nt, Homo sapiens
ugcccuaucauuuauuuaca

SEQ ID NO: 878026 - RNA, 14 nt, Homo sapiens
ugcccugccugcau

SEQ ID NO: 878027 - RNA, 17 nt, Homo sapiens
ugcccuggauccaucag

SEQ ID NO: 878028 - RNA, 20 nt, Homo sapiens
ugcccugugagggcucacuc

SEQ ID NO: 878029 - RNA, 23 nt, Homo sapiens
ugcccuguuguguauagaugcaa

SEQ ID NO: 878030 - RNA, 19 nt, Homo sapiens
ugcccuuaaaauaaugauu

SEQ ID NO: 878031 - RNA, 20 nt, Homo sapiens
ugcccuugggguaagccaga

SEQ ID NO: 878032 - RNA, 16 nt, Homo sapiens
ugccgggcugcacaga

SEQ ID NO: 878033 - RNA, 19 nt, Homo sapiens
ugccggguucuagucuccu

SEQ ID NO: 878034 - RNA, 17 nt, Homo sapiens
ugccguaacaacugugg

SEQ ID NO: 878035 - RNA, 17 nt, Homo sapiens
ugccguauaggauguca

SEQ ID NO: 878036 - RNA, 16 nt, Homo sapiens
ugccuaauuccuggca

SEQ ID NO: 878037 - RNA, 13 nt, Homo sapiens
ugccuacauuccc

SEQ ID NO: 878038 - RNA, 22 nt, Homo sapiens
ugccuaggguccuguccaugcc

SEQ ID NO: 878039 - RNA, 15 nt, Homo sapiens
ugccucagaccugac

SEQ ID NO: 878040 - RNA, 22 nt, Homo sapiens
ugccucagccucccaaagugcu

SEQ ID NO: 878041 - RNA, 15 nt, Homo sapiens
ugccucauaccccac

SEQ ID NO: 878042 - RNA, 13 nt, Homo sapiens
ugccuccaaaaau

SEQ ID NO: 878043 - RNA, 18 nt, Homo sapiens
ugccucucugcuccagag

SEQ ID NO: 878044 - RNA, 17 nt, Homo sapiens
ugccucugaaacuuaau

SEQ ID NO: 878045 - RNA, 21 nt, Homo sapiens
ugccucugccaugcccagaga

SEQ ID NO: 878046 - RNA, 15 nt, Homo sapiens
ugccucuucuuuaug

SEQ ID NO: 878047 - RNA, 15 nt, Homo sapiens
ugccugagaugcacg

SEQ ID NO: 878048 - RNA, 19 nt, Homo sapiens
ugccugggccugugcagca

SEQ ID NO: 878049 - RNA, 19 nt, Homo sapiens
ugccuggugggccacgugu

SEQ ID NO: 878050 - RNA, 21 nt, Homo sapiens
ugccuggugggccacguguuc

SEQ ID NO: 878051 - RNA, 20 nt, Homo sapiens
ugccuguaaucccagcacuu

SEQ ID NO: 878052 - RNA, 12 nt, Homo sapiens
ugccuuauguaa

SEQ ID NO: 878053 - RNA, 12 nt, Homo sapiens
ugccuucaccuu

SEQ ID NO: 878054 - RNA, 22 nt, Homo sapiens
agguacagcaacaggaaucuca

SEQ ID NO: 878055 - RNA, 16 nt, Homo sapiens
agguacagcagaaagg

SEQ ID NO: 878056 - RNA, 19 nt, Homo sapiens
agguagcccagcacuguga

SEQ ID NO: 878057 - RNA, 14 nt, Homo sapiens
agguagcucccagc

SEQ ID NO: 878058 - RNA, 14 nt, Homo sapiens
agguagcuuaccug

SEQ ID NO: 878059 - RNA, 18 nt, Homo sapiens
agguagcuuuagggcaau

SEQ ID NO: 878060 - RNA, 18 nt, Homo sapiens
aggucacauugugccuuu

SEQ ID NO: 878061 - RNA, 18 nt, Homo sapiens
aggucagcgugcuuagcc

SEQ ID NO: 878062 - RNA, 13 nt, Homo sapiens
agguccucuacuu

SEQ ID NO: 878063 - RNA, 18 nt, Homo sapiens
agguccugagcacugcca

SEQ ID NO: 878064 - RNA, 16 nt, Homo sapiens
agguccugcauuucuc

SEQ ID NO: 878065 - RNA, 21 nt, Homo sapiens
aggucgaccccaaagccccuu

SEQ ID NO: 878066 - RNA, 15 nt, Homo sapiens
aggucucagcccggg

SEQ ID NO: 878067 - RNA, 19 nt, Homo sapiens
aggucuucuuguguccuga

SEQ ID NO: 878068 - RNA, 11 nt, Homo sapiens
aggucuugccu

SEQ ID NO: 878069 - RNA, 13 nt, Homo sapiens
aggugacugggaa

SEQ ID NO: 878070 - RNA, 18 nt, Homo sapiens
aggugagaaaaggggcau

SEQ ID NO: 878071 - RNA, 17 nt, Homo sapiens
aggugagaccaaaggau

SEQ ID NO: 878072 - RNA, 21 nt, Homo sapiens
aggugagaugggacauuccaa

SEQ ID NO: 878073 - RNA, 19 nt, Homo sapiens
aggugagccggcucugccu

SEQ ID NO: 878074 - RNA, 21 nt, Homo sapiens
aggugagugcuugucauggaa

SEQ ID NO: 878075 - RNA, 18 nt, Homo sapiens
aggugcaagagacagagc

SEQ ID NO: 878076 - RNA, 21 nt, Homo sapiens
aggugcuacaaaaacacagca

SEQ ID NO: 878077 - RNA, 13 nt, Homo sapiens
aggugcugaugag

SEQ ID NO: 878078 - RNA, 17 nt, Homo sapiens
aggugcugucagcucag

SEQ ID NO: 878079 - RNA, 13 nt, Homo sapiens
agguggacagauu

SEQ ID NO: 878080 - RNA, 20 nt, Homo sapiens
agguggagucucauucuguu

SEQ ID NO: 878081 - RNA, 19 nt, Homo sapiens
agguggcaggaccaggacu

SEQ ID NO: 878082 - RNA, 16 nt, Homo sapiens
aggugggaaaugguau

SEQ ID NO: 878083 - RNA, 11 nt, Homo sapiens
aggugggagag

SEQ ID NO: 878084 - RNA, 14 nt, Homo sapiens
agguggggcagcuu

SEQ ID NO: 878085 - RNA, 12 nt, Homo sapiens
aggugguucuga

SEQ ID NO: 878086 - RNA, 22 nt, Homo sapiens
aggugugcaaacuuguaucuga

SEQ ID NO: 878087 - RNA, 13 nt, Homo sapiens
aggugugccaaac

SEQ ID NO: 878088 - RNA, 16 nt, Homo sapiens
agguguucaagaccag

SEQ ID NO: 878089 - RNA, 22 nt, Homo sapiens
agguguucaagaccagccugac

SEQ ID NO: 878090 - RNA, 15 nt, Homo sapiens
agguguuuaguugca

SEQ ID NO: 878091 - RNA, 18 nt, Homo sapiens
agguucuuagugucacuu

SEQ ID NO: 878092 - RNA, 20 nt, Homo sapiens
agguugaggggcuccuggaa

SEQ ID NO: 878093 - RNA, 23 nt, Homo sapiens
agguugucugaagucacugcaca

SEQ ID NO: 878094 - RNA, 12 nt, Homo sapiens
agguuucaagac

SEQ ID NO: 878095 - RNA, 13 nt, Homo sapiens
agguuucaagacu

SEQ ID NO: 878096 - RNA, 18 nt, Homo sapiens
agguuucaagacuugaua

SEQ ID NO: 878097 - RNA, 23 nt, Homo sapiens
agguuuggcccccucacuaucuc

SEQ ID NO: 878098 - RNA, 20 nt, Homo sapiens
agguuuuaugaaaagaauaa

SEQ ID NO: 878099 - RNA, 19 nt, Homo sapiens
aguaaaacuuuaaugggag

SEQ ID NO: 878100 - RNA, 17 nt, Homo sapiens
aguaaauauuucaggca

SEQ ID NO: 878101 - RNA, 17 nt, Homo sapiens
aguaacacucaccauca

SEQ ID NO: 878102 - RNA, 17 nt, Homo sapiens
aguaacucaucugucac

SEQ ID NO: 878103 - RNA, 16 nt, Homo sapiens
aguaagcugcucuauu

SEQ ID NO: 878104 - RNA, 19 nt, Homo sapiens
aguaauaaacgucuugcca

SEQ ID NO: 878105 - RNA, 13 nt, Homo sapiens
aguaaucaggcag

SEQ ID NO: 878106 - RNA, 17 nt, Homo sapiens
aguaauucuagcuuuca

SEQ ID NO: 878107 - RNA, 15 nt, Homo sapiens
aguaauugauuugac

SEQ ID NO: 878108 - RNA, 19 nt, Homo sapiens
aguaauuguaaguaccccu

SEQ ID NO: 878109 - RNA, 21 nt, Homo sapiens
aguacaauaauaaauccucag

SEQ ID NO: 878110 - RNA, 16 nt, Homo sapiens
aguacagacgucucaa

SEQ ID NO: 878111 - RNA, 20 nt, Homo sapiens
aguacagauguaaaugccac

SEQ ID NO: 878112 - RNA, 15 nt, Homo sapiens
cuaaugaaauugaga

SEQ ID NO: 878113 - RNA, 19 nt, Homo sapiens
cuaaugauuagcacuuaau

SEQ ID NO: 878114 - RNA, 20 nt, Homo sapiens
cuaaugcuucaaguguugcu

SEQ ID NO: 878115 - RNA, 14 nt, Homo sapiens
cuaauguaugcauu

SEQ ID NO: 878116 - RNA, 15 nt, Homo sapiens
cuaaugucagaguag

SEQ ID NO: 878117 - RNA, 18 nt, Homo sapiens
cuaauucccagaguguga

SEQ ID NO: 878118 - RNA, 21 nt, Homo sapiens
cuaauucccauuuugcaaaau

SEQ ID NO: 878119 - RNA, 14 nt, Homo sapiens
cuaauuugaucaca

SEQ ID NO: 878120 - RNA, 13 nt, Homo sapiens
cuacaaaauggag

SEQ ID NO: 878121 - RNA, 18 nt, Homo sapiens
cuacacaaaagccaaaag

SEQ ID NO: 878122 - RNA, 21 nt, Homo sapiens
cuacacacccauagugcacac

SEQ ID NO: 878123 - RNA, 12 nt, Homo sapiens
cuacacauauau

SEQ ID NO: 878124 - RNA, 20 nt, Homo sapiens
cuacacccuuggacuugagg

SEQ ID NO: 878125 - RNA, 14 nt, Homo sapiens
cuacagaggccaug

SEQ ID NO: 878126 - RNA, 11 nt, Homo sapiens
cuacauuccuc

SEQ ID NO: 878127 - RNA, 17 nt, Homo sapiens
cuaccaguuggccauga

SEQ ID NO: 878128 - RNA, 19 nt, Homo sapiens
cuaccaucuaaucuaugca

SEQ ID NO: 878129 - RNA, 19 nt, Homo sapiens
cuaccucacuaugcugcuu

SEQ ID NO: 878130 - RNA, 14 nt, Homo sapiens
cuaccugagcauuc

SEQ ID NO: 878131 - RNA, 15 nt, Homo sapiens
cuaccugagcauuca

SEQ ID NO: 878132 - RNA, 23 nt, Homo sapiens
cuaccugcccucucucaguuauu

SEQ ID NO: 878133 - RNA, 20 nt, Homo sapiens
cuaccugcugcugcuauuau

SEQ ID NO: 878134 - RNA, 17 nt, Homo sapiens
cuaccuguggugauguu

SEQ ID NO: 878135 - RNA, 23 nt, Homo sapiens
cuaccuguuacuauuaucugugc

SEQ ID NO: 878136 - RNA, 14 nt, Homo sapiens
cuaccuucauguca

SEQ ID NO: 878137 - RNA, 21 nt, Homo sapiens
cuacguuaugaaaacagaugc

SEQ ID NO: 878138 - RNA, 17 nt, Homo sapiens
cuacuacccgagcccag

SEQ ID NO: 878139 - RNA, 21 nt, Homo sapiens
cuacucacacaggcauuuccu

SEQ ID NO: 878140 - RNA, 23 nt, Homo sapiens
cuacucaggaggcugaggcagaa

SEQ ID NO: 878141 - RNA, 19 nt, Homo sapiens
cuacucgggaggcugaggc

SEQ ID NO: 878142 - RNA, 17 nt, Homo sapiens
cuacugagacaugacua

SEQ ID NO: 878143 - RNA, 14 nt, Homo sapiens
cuacugagccuuca

SEQ ID NO: 878144 - RNA, 13 nt, Homo sapiens
cuacuggcauuaa

SEQ ID NO: 878145 - RNA, 16 nt, Homo sapiens
cuacuuacaugcauua

SEQ ID NO: 878146 - RNA, 13 nt, Homo sapiens
cuacuucagucuu

SEQ ID NO: 878147 - RNA, 19 nt, Homo sapiens
cuacuuccugugacuucag

SEQ ID NO: 878148 - RNA, 23 nt, Homo sapiens
cuacuucuuggaaaaaaauuaca

SEQ ID NO: 878149 - RNA, 19 nt, Homo sapiens
cuacuugggaggcugaggc

SEQ ID NO: 878150 - RNA, 15 nt, Homo sapiens
cuacuuguaaaggug

SEQ ID NO: 878151 - RNA, 20 nt, Homo sapiens
cuacuuguaaaggugcugca

SEQ ID NO: 878152 - RNA, 18 nt, Homo sapiens
cuacuuugauaugacugu

SEQ ID NO: 878153 - RNA, 15 nt, Homo sapiens
cuacuuuuuauacuc

SEQ ID NO: 878154 - RNA, 20 nt, Homo sapiens
cuagaaaacauuccaaaacu

SEQ ID NO: 878155 - RNA, 20 nt, Homo sapiens
cuagaacccccacauuuacc

SEQ ID NO: 878156 - RNA, 18 nt, Homo sapiens
cuagaaccuggagggcua

SEQ ID NO: 878157 - RNA, 19 nt, Homo sapiens
cuagaacucuccaucuuau

SEQ ID NO: 878158 - RNA, 17 nt, Homo sapiens
cuagaagaaagggcaag

SEQ ID NO: 878159 - RNA, 18 nt, Homo sapiens
cuagaaggccacauguca

SEQ ID NO: 878160 - RNA, 13 nt, Homo sapiens
cuagaagggcuag

SEQ ID NO: 878161 - RNA, 13 nt, Homo sapiens
cuagaaugcacac

SEQ ID NO: 878162 - RNA, 23 nt, Homo sapiens
cuagagauauggcagcgaaagga

SEQ ID NO: 878163 - RNA, 19 nt, Homo sapiens
cuagagccugugcuaaaga

SEQ ID NO: 878164 - RNA, 14 nt, Homo sapiens
cuagagcucaggcc

SEQ ID NO: 878165 - RNA, 14 nt, Homo sapiens
cuagagcugggaaa

SEQ ID NO: 878166 - RNA, 18 nt, Homo sapiens
cuagaggugagaccaaag

SEQ ID NO: 878167 - RNA, 15 nt, Homo sapiens
cuagauacugaaugu

SEQ ID NO: 878168 - RNA, 15 nt, Homo sapiens
cuagauuagaagugu

SEQ ID NO: 878169 - RNA, 14 nt, Homo sapiens
cuagcugcaaguga

SEQ ID NO: 878170 - RNA, 20 nt, Homo sapiens
aguuccuguagaacugagaa

SEQ ID NO: 878171 - RNA, 15 nt, Homo sapiens
aguuccuucagcuuc

SEQ ID NO: 878172 - RNA, 18 nt, Homo sapiens
aguucgaggcugcaguca

SEQ ID NO: 878173 - RNA, 15 nt, Homo sapiens
aguucuugugccaua

SEQ ID NO: 878174 - RNA, 17 nt, Homo sapiens
aguucuuuuacuguaau

SEQ ID NO: 878175 - RNA, 23 nt, Homo sapiens
aguugaaagaguccuauuugcac

SEQ ID NO: 878176 - RNA, 15 nt, Homo sapiens
aguugaacaucucac

SEQ ID NO: 878177 - RNA, 16 nt, Homo sapiens
aguugaccguuuucau

SEQ ID NO: 878178 - RNA, 22 nt, Homo sapiens
aguuggaaccguguccagcaca

SEQ ID NO: 878179 - RNA, 17 nt, Homo sapiens
aguuggaccagaggaag

SEQ ID NO: 878180 - RNA, 11 nt, Homo sapiens
aguuggcagaa

SEQ ID NO: 878181 - RNA, 16 nt, Homo sapiens
aguuguacacugugua

SEQ ID NO: 878182 - RNA, 22 nt, Homo sapiens
aguugugagcacucuacugcaa

SEQ ID NO: 878183 - RNA, 21 nt, Homo sapiens
aguugugucagcuacugcgga

SEQ ID NO: 878184 - RNA, 15 nt, Homo sapiens
aguuguuccuacuca

SEQ ID NO: 878185 - RNA, 20 nt, Homo sapiens
aguuguuccuuaagucagaa

SEQ ID NO: 878186 - RNA, 19 nt, Homo sapiens
aguuguucgccgcguggaa

SEQ ID NO: 878187 - RNA, 18 nt, Homo sapiens
aguuuaauagauguuacu

SEQ ID NO: 878188 - RNA, 22 nt, Homo sapiens
aguuuacagaauggaaccaaaa

SEQ ID NO: 878189 - RNA, 12 nt, Homo sapiens
aguuuacuucau

SEQ ID NO: 878190 - RNA, 15 nt, Homo sapiens
aguuucaaugugauu

SEQ ID NO: 878191 - RNA, 17 nt, Homo sapiens
aguuucacaaaguuugu

SEQ ID NO: 878192 - RNA, 23 nt, Homo sapiens
aguuuccaaguuccugcacucca

SEQ ID NO: 878193 - RNA, 19 nt, Homo sapiens
aguuuccaaucccauagau

SEQ ID NO: 878194 - RNA, 15 nt, Homo sapiens
aguuucugauucacu

SEQ ID NO: 878195 - RNA, 14 nt, Homo sapiens
aguuugaccucaca

SEQ ID NO: 878196 - RNA, 13 nt, Homo sapiens
aguuugauuucau

SEQ ID NO: 878197 - RNA, 19 nt, Homo sapiens
aguuugcuuuguaugcacu

SEQ ID NO: 878198 - RNA, 17 nt, Homo sapiens
aguuuggaacucuaccc

SEQ ID NO: 878199 - RNA, 18 nt, Homo sapiens
aguuuggaaguguuaacu

SEQ ID NO: 878200 - RNA, 17 nt, Homo sapiens
aguuugucagacuuuaa

SEQ ID NO: 878201 - RNA, 13 nt, Homo sapiens
aguuuguuuuaca

SEQ ID NO: 878202 - RNA, 20 nt, Homo sapiens
aguuuucaaagaucccguga

SEQ ID NO: 878203 - RNA, 14 nt, Homo sapiens
aguuuugccuuaaa

SEQ ID NO: 878204 - RNA, 13 nt, Homo sapiens
auaaaaacacuua

SEQ ID NO: 878205 - RNA, 14 nt, Homo sapiens
auaaaaacccugua

SEQ ID NO: 878206 - RNA, 13 nt, Homo sapiens
auaaaacauuaug

SEQ ID NO: 878207 - RNA, 22 nt, Homo sapiens
auaaaacgcaaagggcugaaag

SEQ ID NO: 878208 - RNA, 17 nt, Homo sapiens
auaaaagcacuuacuuc

SEQ ID NO: 878209 - RNA, 16 nt, Homo sapiens
auaaaauaguauugaa

SEQ ID NO: 878210 - RNA, 17 nt, Homo sapiens
auaaaauaguuguccau

SEQ ID NO: 878211 - RNA, 23 nt, Homo sapiens
auaaaauauuuuugaaaggcaug

SEQ ID NO: 878212 - RNA, 18 nt, Homo sapiens
auaaaaugaaagggucaa

SEQ ID NO: 878213 - RNA, 20 nt, Homo sapiens
auaaaauuguaaaauuguau

SEQ ID NO: 878214 - RNA, 21 nt, Homo sapiens
auaaacaacuuaauguucuga

SEQ ID NO: 878215 - RNA, 20 nt, Homo sapiens
auaaacacccaugaaucaaa

SEQ ID NO: 878216 - RNA, 15 nt, Homo sapiens
auaaacagcauuuau

SEQ ID NO: 878217 - RNA, 15 nt, Homo sapiens
auaaacauccuucaa

SEQ ID NO: 878218 - RNA, 14 nt, Homo sapiens
auaaacauuuggca

SEQ ID NO: 878219 - RNA, 21 nt, Homo sapiens
auaaaccuggagaugaugaug

SEQ ID NO: 878220 - RNA, 15 nt, Homo sapiens
auaaacuagaucucc

SEQ ID NO: 878221 - RNA, 19 nt, Homo sapiens
auaaacuaguuuccagugg

SEQ ID NO: 878222 - RNA, 20 nt, Homo sapiens
auaaacuaguuuccagugga

SEQ ID NO: 878223 - RNA, 14 nt, Homo sapiens
auaaagacugagac

SEQ ID NO: 878224 - RNA, 13 nt, Homo sapiens
auaaagacuucau

SEQ ID NO: 878225 - RNA, 16 nt, Homo sapiens
auaaagagacugagcc

SEQ ID NO: 878226 - RNA, 22 nt, Homo sapiens
auaaagagagcccugguccuag

SEQ ID NO: 878227 - RNA, 17 nt, Homo sapiens
accuggcuuggcuuuaa

SEQ ID NO: 878228 - RNA, 20 nt, Homo sapiens
accuguagugagaaacugau

SEQ ID NO: 878229 - RNA, 16 nt, Homo sapiens
accuguauuuugccag

SEQ ID NO: 878230 - RNA, 11 nt, Homo sapiens
accugucaaug

SEQ ID NO: 878231 - RNA, 22 nt, Homo sapiens
accugugacuaaacaacuaccu

SEQ ID NO: 878232 - RNA, 19 nt, Homo sapiens
accugugcucuaagugaau

SEQ ID NO: 878233 - RNA, 20 nt, Homo sapiens
accuguguggacaggacuaa

SEQ ID NO: 878234 - RNA, 15 nt, Homo sapiens
accuguguucuugcu

SEQ ID NO: 878235 - RNA, 19 nt, Homo sapiens
accuguuacugaaaguggu

SEQ ID NO: 878236 - RNA, 16 nt, Homo sapiens
accuuaaaaaguaauu

SEQ ID NO: 878237 - RNA, 15 nt, Homo sapiens
accuuaccagauuuu

SEQ ID NO: 878238 - RNA, 19 nt, Homo sapiens
accuuacuuaaagcuuguu

SEQ ID NO: 878239 - RNA, 13 nt, Homo sapiens
accuucaauacuu

SEQ ID NO: 878240 - RNA, 16 nt, Homo sapiens
accuucaauacuucau

SEQ ID NO: 878241 - RNA, 15 nt, Homo sapiens
accuucaauuccugg

SEQ ID NO: 878242 - RNA, 21 nt, Homo sapiens
accuucagauuuguguuauaa

SEQ ID NO: 878243 - RNA, 19 nt, Homo sapiens
accuucaugucacugcucu

SEQ ID NO: 878244 - RNA, 20 nt, Homo sapiens
accuucaugucacugcucuu

SEQ ID NO: 878245 - RNA, 21 nt, Homo sapiens
accuucccaagucucccuuuc

SEQ ID NO: 878246 - RNA, 19 nt, Homo sapiens
accuuccuuaagccaggaa

SEQ ID NO: 878247 - RNA, 17 nt, Homo sapiens
accuugcuccuccuucu

SEQ ID NO: 878248 - RNA, 15 nt, Homo sapiens
accuuggacuccucc

SEQ ID NO: 878249 - RNA, 18 nt, Homo sapiens
accuuggacuccucccac

SEQ ID NO: 878250 - RNA, 21 nt, Homo sapiens
accuuuauugugaucuaucaa

SEQ ID NO: 878251 - RNA, 17 nt, Homo sapiens
accuuuggaugcacuuu

SEQ ID NO: 878252 - RNA, 20 nt, Homo sapiens
accuuuugucucacacagca

SEQ ID NO: 878253 - RNA, 12 nt, Homo sapiens
acgaauugcuca

SEQ ID NO: 878254 - RNA, 18 nt, Homo sapiens
acgacuguuguacaagcu

SEQ ID NO: 878255 - RNA, 16 nt, Homo sapiens
acgagagagucuucca

SEQ ID NO: 878256 - RNA, 22 nt, Homo sapiens
acgcaagggagaagaaauccau

SEQ ID NO: 878257 - RNA, 13 nt, Homo sapiens
acgcacacaucag

SEQ ID NO: 878258 - RNA, 19 nt, Homo sapiens
acgcacauagagauaugca

SEQ ID NO: 878259 - RNA, 18 nt, Homo sapiens
acgcacucaacuuccuuu

SEQ ID NO: 878260 - RNA, 18 nt, Homo sapiens
acgcagccugcagacuca

SEQ ID NO: 878261 - RNA, 22 nt, Homo sapiens
acgcagccugcagacucacugu

SEQ ID NO: 878262 - RNA, 14 nt, Homo sapiens
acgcagguguaccu

SEQ ID NO: 878263 - RNA, 15 nt, Homo sapiens
acgcagguguaccuc

SEQ ID NO: 878264 - RNA, 20 nt, Homo sapiens
acgccaaagugcagcccuuc

SEQ ID NO: 878265 - RNA, 16 nt, Homo sapiens
acgccaaugcacacac

SEQ ID NO: 878266 - RNA, 23 nt, Homo sapiens
acgccaaugcacacacacagaga

SEQ ID NO: 878267 - RNA, 19 nt, Homo sapiens
acgccacucauuucaucuc

SEQ ID NO: 878268 - RNA, 15 nt, Homo sapiens
acgccuaugauccca

SEQ ID NO: 878269 - RNA, 13 nt, Homo sapiens
acgccuguagucc

SEQ ID NO: 878270 - RNA, 20 nt, Homo sapiens
acgcgugcacacaccagagc

SEQ ID NO: 878271 - RNA, 20 nt, Homo sapiens
acgcuuccagaccaccugcc

SEQ ID NO: 878272 - RNA, 23 nt, Homo sapiens
acggaugauuggauuauucauuu

SEQ ID NO: 878273 - RNA, 21 nt, Homo sapiens
acggcagagaccccaggaucc

SEQ ID NO: 878274 - RNA, 15 nt, Homo sapiens
acggcagcuguagcu

SEQ ID NO: 878275 - RNA, 21 nt, Homo sapiens
acggcuggaccugcacgccac

SEQ ID NO: 878276 - RNA, 17 nt, Homo sapiens
acgggagaauauacaaa

SEQ ID NO: 878277 - RNA, 22 nt, Homo sapiens
acgguggccuaggguacaggca

SEQ ID NO: 878278 - RNA, 14 nt, Homo sapiens
acguaaacuuccua

SEQ ID NO: 878279 - RNA, 10 nt, Homo sapiens
acgugcaaua

SEQ ID NO: 878280 - RNA, 15 nt, Homo sapiens
acgugugcagacugu

SEQ ID NO: 878281 - RNA, 13 nt, Homo sapiens
acguuuaagccaa

SEQ ID NO: 878282 - RNA, 23 nt, Homo sapiens
acguuuggcauuucucuuugaga

SEQ ID NO: 878283 - RNA, 15 nt, Homo sapiens
acuaaaaaaugucua

SEQ ID NO: 878284 - RNA, 14 nt, Homo sapiens
acuaaaaauauuau

SEQ ID NO: 878285 - RNA, 14 nt, Homo sapiens
acuaaaagaauuug

SEQ ID NO: 878286 - RNA, 17 nt, Homo sapiens
acuaaacagacuauuua

SEQ ID NO: 878287 - RNA, 19 nt, Homo sapiens
acuaaacugguugucaguu

SEQ ID NO: 878288 - RNA, 14 nt, Homo sapiens
acuaaagauaucag

SEQ ID NO: 878289 - RNA, 12 nt, Homo sapiens
acuaacacagcc

SEQ ID NO: 878290 - RNA, 15 nt, Homo sapiens
acuaacguacauuca

SEQ ID NO: 878291 - RNA, 13 nt, Homo sapiens
acuaagaggcuau

SEQ ID NO: 878292 - RNA, 22 nt, Homo sapiens
acuaauaaaugccaacugguca

SEQ ID NO: 878293 - RNA, 15 nt, Homo sapiens
acuaaugaagauacg

SEQ ID NO: 878294 - RNA, 14 nt, Homo sapiens
acuaauggaaauau

SEQ ID NO: 878295 - RNA, 17 nt, Homo sapiens
acuaauuuaaaccagca

SEQ ID NO: 878296 - RNA, 13 nt, Homo sapiens
acuacagccagaa

SEQ ID NO: 878297 - RNA, 17 nt, Homo sapiens
acuacaggugcaagcca

SEQ ID NO: 878298 - RNA, 18 nt, Homo sapiens
acuacaggugcaagccac

SEQ ID NO: 878299 - RNA, 16 nt, Homo sapiens
acuacaguacagugag

SEQ ID NO: 878300 - RNA, 21 nt, Homo sapiens
acuacaugcacuuggcugcau

SEQ ID NO: 878301 - RNA, 20 nt, Homo sapiens
acuaccuaacauuauuuauu

SEQ ID NO: 878302 - RNA, 21 nt, Homo sapiens
acuacgugccaggcacuguug

SEQ ID NO: 878303 - RNA, 21 nt, Homo sapiens
acuacuaaagugccuacccca

SEQ ID NO: 878304 - RNA, 19 nt, Homo sapiens
acuacucagcucuccugcu

SEQ ID NO: 878305 - RNA, 12 nt, Homo sapiens
acuacuguaaau

SEQ ID NO: 878306 - RNA, 14 nt, Homo sapiens
acuagaaacagagg

SEQ ID NO: 878307 - RNA, 14 nt, Homo sapiens
acuagaacucucca

SEQ ID NO: 878308 - RNA, 20 nt, Homo sapiens
acuagaauagugcauuguau

SEQ ID NO: 878309 - RNA, 17 nt, Homo sapiens
acuagcagcugcaguca

SEQ ID NO: 878310 - RNA, 13 nt, Homo sapiens
acuaggaccucau

SEQ ID NO: 878311 - RNA, 15 nt, Homo sapiens
acuaggacucugagg

SEQ ID NO: 878312 - RNA, 23 nt, Homo sapiens
acuagggacuggaucucagccuc

SEQ ID NO: 878313 - RNA, 20 nt, Homo sapiens
acuagggcuuauccaugccu

SEQ ID NO: 878314 - RNA, 18 nt, Homo sapiens
acuagucauagaaauacc

SEQ ID NO: 878315 - RNA, 23 nt, Homo sapiens
acuagucauagaaauaccucauu

SEQ ID NO: 878316 - RNA, 22 nt, Homo sapiens
acuaguguguguguguauauau

SEQ ID NO: 878317 - RNA, 23 nt, Homo sapiens
acuaguugaacaucucacuuugc

SEQ ID NO: 878318 - RNA, 16 nt, Homo sapiens
acuauaaacuacugua

SEQ ID NO: 878319 - RNA, 17 nt, Homo sapiens
acuauaaacuacuguaa

SEQ ID NO: 878320 - RNA, 21 nt, Homo sapiens
acuauaagcagaagcacauau

SEQ ID NO: 878321 - RNA, 15 nt, Homo sapiens
acuauccucacuccc

SEQ ID NO: 878322 - RNA, 22 nt, Homo sapiens
acuauccucacucccauaagcu

SEQ ID NO: 878323 - RNA, 15 nt, Homo sapiens
acuaucucuugucau

SEQ ID NO: 878324 - RNA, 18 nt, Homo sapiens
acuaucugugaaguuaca

SEQ ID NO: 878325 - RNA, 13 nt, Homo sapiens
acuaugacacuga

SEQ ID NO: 878326 - RNA, 16 nt, Homo sapiens
acuaugaucacaguga

SEQ ID NO: 878327 - RNA, 12 nt, Homo sapiens
acuaugcugcuu

SEQ ID NO: 878328 - RNA, 19 nt, Homo sapiens
acuauggagccuggcacag

SEQ ID NO: 878329 - RNA, 17 nt, Homo sapiens
acuauggguacauucca

SEQ ID NO: 878330 - RNA, 22 nt, Homo sapiens
acuauuaaaacuaauaaucacc

SEQ ID NO: 878331 - RNA, 14 nt, Homo sapiens
acuauuaagggaaa

SEQ ID NO: 878332 - RNA, 16 nt, Homo sapiens
acuauuagacaugaaa

SEQ ID NO: 878333 - RNA, 20 nt, Homo sapiens
acuauugaaaucaagcuuau

SEQ ID NO: 878334 - RNA, 15 nt, Homo sapiens
acuauuugaagcaau

SEQ ID NO: 878335 - RNA, 16 nt, Homo sapiens
acuauuuguuccacau

SEQ ID NO: 878336 - RNA, 16 nt, Homo sapiens
acuauuuuaacuggga

SEQ ID NO: 878337 - RNA, 12 nt, Homo sapiens
acucaacaauaa

SEQ ID NO: 878338 - RNA, 13 nt, Homo sapiens
acucaacaauaaa

SEQ ID NO: 878339 - RNA, 17 nt, Homo sapiens
acucaaggaauuugcau

SEQ ID NO: 878340 - RNA, 15 nt, Homo sapiens
acucaagucuggauc

SEQ ID NO: 878341 - RNA, 19 nt, Homo sapiens
aaacauucacacagggcuc

SEQ ID NO: 878342 - RNA, 21 nt, Homo sapiens
aaacauucaucaagcuguaca

SEQ ID NO: 878343 - RNA, 17 nt, Homo sapiens
aaaccaagauagaucca

SEQ ID NO: 878344 - RNA, 19 nt, Homo sapiens
aaaccaagccguggcuucc

SEQ ID NO: 878345 - RNA, 21 nt, Homo sapiens
aaaccacaacugacacaggaa

SEQ ID NO: 878346 - RNA, 15 nt, Homo sapiens
aaaccacuagaacuc

SEQ ID NO: 878347 - RNA, 17 nt, Homo sapiens
aaaccaggacucugccc

SEQ ID NO: 878348 - RNA, 20 nt, Homo sapiens
aaaccaucaaaaauauucca

SEQ ID NO: 878349 - RNA, 23 nt, Homo sapiens
aaaccaugcagcuucaucaauuu

SEQ ID NO: 878350 - RNA, 18 nt, Homo sapiens
aaacccccgcuccagauc

SEQ ID NO: 878351 - RNA, 15 nt, Homo sapiens
aaaccuaagcacgua

SEQ ID NO: 878352 - RNA, 16 nt, Homo sapiens
aaaccuggagaugaug

SEQ ID NO: 878353 - RNA, 17 nt, Homo sapiens
aaaccuggagaugauga

SEQ ID NO: 878354 - RNA, 18 nt, Homo sapiens
aaaccuggagaugaugau

SEQ ID NO: 878355 - RNA, 12 nt, Homo sapiens
aaaccuuacuua

SEQ ID NO: 878356 - RNA, 15 nt, Homo sapiens
aaaccuugauuuaaa

SEQ ID NO: 878357 - RNA, 19 nt, Homo sapiens
aaaccuuuccccagacaca

SEQ ID NO: 878358 - RNA, 16 nt, Homo sapiens
aaacuaaaucucuaau

SEQ ID NO: 878359 - RNA, 23 nt, Homo sapiens
aaacuacuuuuguaccaguguga

SEQ ID NO: 878360 - RNA, 13 nt, Homo sapiens
aaacucaaaauau

SEQ ID NO: 878361 - RNA, 15 nt, Homo sapiens
aaacucacugcucaa

SEQ ID NO: 878362 - RNA, 19 nt, Homo sapiens
aaacugauuuuuagcuuua

SEQ ID NO: 878363 - RNA, 13 nt, Homo sapiens
aaacugcacugcc

SEQ ID NO: 878364 - RNA, 19 nt, Homo sapiens
aaacugcacugucaagaug

SEQ ID NO: 878365 - RNA, 17 nt, Homo sapiens
aaacuggcuguuugaua

SEQ ID NO: 878366 - RNA, 22 nt, Homo sapiens
aaacugggugggauggaugcug

SEQ ID NO: 878367 - RNA, 18 nt, Homo sapiens
aaacugguuuagcacaau

SEQ ID NO: 878368 - RNA, 16 nt, Homo sapiens
aaacuuauuccuccuu

SEQ ID NO: 878369 - RNA, 12 nt, Homo sapiens
aaacuugacagu

SEQ ID NO: 878370 - RNA, 16 nt, Homo sapiens
aaacuugggucucuua

SEQ ID NO: 878371 - RNA, 16 nt, Homo sapiens
aaacuuuaaugggagg

SEQ ID NO: 878372 - RNA, 17 nt, Homo sapiens
aaacuuuagaguagcau

SEQ ID NO: 878373 - RNA, 21 nt, Homo sapiens
aaacuuuagaguagcaugaga

SEQ ID NO: 878374 - RNA, 18 nt, Homo sapiens
aaacuuuuuuuguuugcu

SEQ ID NO: 878375 - RNA, 16 nt, Homo sapiens
aaagaaaaaaaaagca

SEQ ID NO: 878376 - RNA, 14 nt, Homo sapiens
aaagaaaagccaga

SEQ ID NO: 878377 - RNA, 15 nt, Homo sapiens
aaagaaagaaggaag

SEQ ID NO: 878378 - RNA, 16 nt, Homo sapiens
aaagaaaugcccaucu

SEQ ID NO: 878379 - RNA, 19 nt, Homo sapiens
aaagaacugccccaucucc

SEQ ID NO: 878380 - RNA, 15 nt, Homo sapiens
aaagaagauuuugcc

SEQ ID NO: 878381 - RNA, 22 nt, Homo sapiens
aaagaagauuuugccacauuug

SEQ ID NO: 878382 - RNA, 17 nt, Homo sapiens
aaagaaggaagugaaga

SEQ ID NO: 878383 - RNA, 22 nt, Homo sapiens
aaagaaggaauucuaggcaucc

SEQ ID NO: 878384 - RNA, 22 nt, Homo sapiens
aaagaauaauaugcugccaaau

SEQ ID NO: 878385 - RNA, 14 nt, Homo sapiens
aaagaaucagucuu

SEQ ID NO: 878386 - RNA, 20 nt, Homo sapiens
aaagaauuccugaagccaga

SEQ ID NO: 878387 - RNA, 18 nt, Homo sapiens
aaagacaccuacugagug

SEQ ID NO: 878388 - RNA, 15 nt, Homo sapiens
aaagacagaauguca

SEQ ID NO: 878389 - RNA, 18 nt, Homo sapiens
aaagacagaaugucacca

SEQ ID NO: 878390 - RNA, 14 nt, Homo sapiens
aaagaccugagaac

SEQ ID NO: 878391 - RNA, 17 nt, Homo sapiens
aaagacuaugaggaaua

SEQ ID NO: 878392 - RNA, 14 nt, Homo sapiens
aaagacuccaaaga

SEQ ID NO: 878393 - RNA, 16 nt, Homo sapiens
aaagacugcagcugcu

SEQ ID NO: 878394 - RNA, 19 nt, Homo sapiens
aaagacugcagcugcugaa

SEQ ID NO: 878395 - RNA, 23 nt, Homo sapiens
aaagacuuacaggccucgcuaca

SEQ ID NO: 878396 - RNA, 21 nt, Homo sapiens
aaagagacuggagcaucugac

SEQ ID NO: 878397 - RNA, 13 nt, Homo sapiens
aaagagagcccug

SEQ ID NO: 878398 - RNA, 23 nt, Homo sapiens
aaagaggagagaggaagcucucu

SEQ ID NO: 878399 - RNA, 18 nt, Homo sapiens
aaagaguagugcauuuaa

SEQ ID NO: 878400 - RNA, 16 nt, Homo sapiens
aaagauaucagagcuc

SEQ ID NO: 878401 - RNA, 19 nt, Homo sapiens
aaagauaugcuaagcagua

SEQ ID NO: 878402 - RNA, 21 nt, Homo sapiens
aaagcaaucugagagauuuga

SEQ ID NO: 878403 - RNA, 15 nt, Homo sapiens
aaagcaccuuagcug

SEQ ID NO: 878404 - RNA, 20 nt, Homo sapiens
aaagcacuguuuaacuggga

SEQ ID NO: 878405 - RNA, 23 nt, Homo sapiens
aaagcagcacauagcacugggaa

SEQ ID NO: 878406 - RNA, 14 nt, Homo sapiens
aaagcaguggggac

SEQ ID NO: 878407 - RNA, 12 nt, Homo sapiens
aaagcagugugu

SEQ ID NO: 878408 - RNA, 15 nt, Homo sapiens
aaagcaguguuuuca

SEQ ID NO: 878409 - RNA, 16 nt, Homo sapiens
aaagcaguguuuucac

SEQ ID NO: 878410 - RNA, 13 nt, Homo sapiens
aaagcaucaccuc

SEQ ID NO: 878411 - RNA, 16 nt, Homo sapiens
aaagcaucauuguaaa

SEQ ID NO: 878412 - RNA, 13 nt, Homo sapiens
aaagcaugucuca

SEQ ID NO: 878413 - RNA, 19 nt, Homo sapiens
aaagcauuuucauuucacu

SEQ ID NO: 878414 - RNA, 15 nt, Homo sapiens
aaagccaacagucaa

SEQ ID NO: 878415 - RNA, 15 nt, Homo sapiens
cauauuggacugaua

SEQ ID NO: 878416 - RNA, 16 nt, Homo sapiens
cauauugugccaauau

SEQ ID NO: 878417 - RNA, 13 nt, Homo sapiens
cauauuuucacau

SEQ ID NO: 878418 - RNA, 23 nt, Homo sapiens
caucaaaucaguccuuugauucc

SEQ ID NO: 878419 - RNA, 21 nt, Homo sapiens
caucaagaugagagaacugga

SEQ ID NO: 878420 - RNA, 21 nt, Homo sapiens
caucaauuuuuauacauauca

SEQ ID NO: 878421 - RNA, 16 nt, Homo sapiens
caucacaggacacggg

SEQ ID NO: 878422 - RNA, 19 nt, Homo sapiens
caucacccaguccuggcca

SEQ ID NO: 878423 - RNA, 22 nt, Homo sapiens
caucaccuugauaaugggauga

SEQ ID NO: 878424 - RNA, 14 nt, Homo sapiens
caucacugaaaugc

SEQ ID NO: 878425 - RNA, 23 nt, Homo sapiens
caucacugaaaugcuagcugcaa

SEQ ID NO: 878426 - RNA, 18 nt, Homo sapiens
caucagacuccugugcaa

SEQ ID NO: 878427 - RNA, 21 nt, Homo sapiens
caucagacuccugugcaacuu

SEQ ID NO: 878428 - RNA, 22 nt, Homo sapiens
caucagagaugguaaucuacag

SEQ ID NO: 878429 - RNA, 16 nt, Homo sapiens
caucagcaccauggag

SEQ ID NO: 878430 - RNA, 15 nt, Homo sapiens
caucagcauaccuuu

SEQ ID NO: 878431 - RNA, 22 nt, Homo sapiens
caucagcauuuaauaaauguau

SEQ ID NO: 878432 - RNA, 20 nt, Homo sapiens
caucagcugcugaaacaaca

SEQ ID NO: 878433 - RNA, 23 nt, Homo sapiens
caucagugcacacggaugcacag

SEQ ID NO: 878434 - RNA, 18 nt, Homo sapiens
caucauggcuaucugugg

SEQ ID NO: 878435 - RNA, 16 nt, Homo sapiens
cauccagguucagcuu

SEQ ID NO: 878436 - RNA, 13 nt, Homo sapiens
caucccacagugg

SEQ ID NO: 878437 - RNA, 19 nt, Homo sapiens
caucccaucauggcugcug

SEQ ID NO: 878438 - RNA, 16 nt, Homo sapiens
caucccuacuuuucaa

SEQ ID NO: 878439 - RNA, 17 nt, Homo sapiens
cauccuccacaauagca

SEQ ID NO: 878440 - RNA, 20 nt, Homo sapiens
cauccuggccaacaugguga

SEQ ID NO: 878441 - RNA, 14 nt, Homo sapiens
cauccugugugcug

SEQ ID NO: 878442 - RNA, 20 nt, Homo sapiens
cauccuuuuacuuuuugccc

SEQ ID NO: 878443 - RNA, 17 nt, Homo sapiens
caucgauucaaacugcu

SEQ ID NO: 878444 - RNA, 16 nt, Homo sapiens
caucgggccaucucag

SEQ ID NO: 878445 - RNA, 22 nt, Homo sapiens
caucuaagaaaauuuacuguaa

SEQ ID NO: 878446 - RNA, 17 nt, Homo sapiens
caucuaagcugcagcuu

SEQ ID NO: 878447 - RNA, 16 nt, Homo sapiens
caucuaaucuaugcau

SEQ ID NO: 878448 - RNA, 17 nt, Homo sapiens
caucuaaucuaugcaug

SEQ ID NO: 878449 - RNA, 18 nt, Homo sapiens
caucuacaagcauuugcc

SEQ ID NO: 878450 - RNA, 19 nt, Homo sapiens
caucuacaagcauuugccc

SEQ ID NO: 878451 - RNA, 16 nt, Homo sapiens
caucuacuacagggug

SEQ ID NO: 878452 - RNA, 18 nt, Homo sapiens
caucuacucauugucuca

SEQ ID NO: 878453 - RNA, 11 nt, Homo sapiens
caucuauguau

SEQ ID NO: 878454 - RNA, 20 nt, Homo sapiens
caucuauguaucuaccaucu

SEQ ID NO: 878455 - RNA, 23 nt, Homo sapiens
caucuauguaucuaccaucuaau

SEQ ID NO: 878456 - RNA, 16 nt, Homo sapiens
caucucagugaagaau

SEQ ID NO: 878457 - RNA, 16 nt, Homo sapiens
caucuccauguagaau

SEQ ID NO: 878458 - RNA, 16 nt, Homo sapiens
caucucccucccacau

SEQ ID NO: 878459 - RNA, 15 nt, Homo sapiens
caucuccugauuucu

SEQ ID NO: 878460 - RNA, 14 nt, Homo sapiens
caucugacucacaa

SEQ ID NO: 878461 - RNA, 23 nt, Homo sapiens
caucugacucacaagaagaccag

SEQ ID NO: 878462 - RNA, 14 nt, Homo sapiens
caucugauaugcag

SEQ ID NO: 878463 - RNA, 14 nt, Homo sapiens
caucugauugugau

SEQ ID NO: 878464 - RNA, 23 nt, Homo sapiens
caucugcacuaauugacccaaaa

SEQ ID NO: 878465 - RNA, 12 nt, Homo sapiens
caucugcuccuc

SEQ ID NO: 878466 - RNA, 18 nt, Homo sapiens
caucuuccuggaagcaga

SEQ ID NO: 878467 - RNA, 14 nt, Homo sapiens
caucuucuggaguc

SEQ ID NO: 878468 - RNA, 16 nt, Homo sapiens
caucuuuccuguucca

SEQ ID NO: 878469 - RNA, 17 nt, Homo sapiens
caugaacacacauggau

SEQ ID NO: 878470 - RNA, 19 nt, Homo sapiens
caugaacacacauggaugc

SEQ ID NO: 878471 - RNA, 23 nt, Homo sapiens
caugaacacacauggaugcacac

SEQ ID NO: 878472 - RNA, 23 nt, Homo sapiens
caugaacaucuuuaggagacuaa

SEQ ID NO: 878473 - RNA, 22 nt, Homo sapiens
caugaaccucaagcugcaucua

SEQ ID NO: 878474 - RNA, 15 nt, Homo sapiens
caugaaucaaagaca

SEQ ID NO: 878475 - RNA, 23 nt, Homo sapiens
caugaaucccacccacaugugac

SEQ ID NO: 878476 - RNA, 12 nt, Homo sapiens
caugaccagaaa

SEQ ID NO: 878477 - RNA, 17 nt, Homo sapiens
caugaccaguucuggcc

SEQ ID NO: 878478 - RNA, 19 nt, Homo sapiens
caugacucagcauaccugc

SEQ ID NO: 878479 - RNA, 18 nt, Homo sapiens
caugagaccacuguuauc

SEQ ID NO: 878480 - RNA, 20 nt, Homo sapiens
caugaggaggucagcccauu

SEQ ID NO: 878481 - RNA, 21 nt, Homo sapiens
caugaggccuuuccccagugu

SEQ ID NO: 878482 - RNA, 17 nt, Homo sapiens
caugagguacagcagaa

SEQ ID NO: 878483 - RNA, 18 nt, Homo sapiens
caugagugauucuugaca

SEQ ID NO: 878484 - RNA, 15 nt, Homo sapiens
caugauaacugcaau

SEQ ID NO: 878485 - RNA, 22 nt, Homo sapiens
caugauacaccuacuacucaau

SEQ ID NO: 878486 - RNA, 20 nt, Homo sapiens
caugauggagcgcaccugcc

SEQ ID NO: 878487 - RNA, 19 nt, Homo sapiens
caugauguuaaccagaaua

SEQ ID NO: 878488 - RNA, 14 nt, Homo sapiens
caugcaagugagaa

SEQ ID NO: 878489 - RNA, 19 nt, Homo sapiens
caugcaugggaaagugcaa

SEQ ID NO: 878490 - RNA, 21 nt, Homo sapiens
caugcauuuugcagcagugag

SEQ ID NO: 878491 - RNA, 16 nt, Homo sapiens
caugcccucaauccca

SEQ ID NO: 878492 - RNA, 13 nt, Homo sapiens
caugccucugagg

SEQ ID NO: 878493 - RNA, 14 nt, Homo sapiens
caugccucugaggc

SEQ ID NO: 878494 - RNA, 15 nt, Homo sapiens
caugccugggaaaug

SEQ ID NO: 878495 - RNA, 18 nt, Homo sapiens
caugcuagcaacauacca

SEQ ID NO: 878496 - RNA, 13 nt, Homo sapiens
caugcuggggcaa

SEQ ID NO: 878497 - RNA, 15 nt, Homo sapiens
caugcugugugcugg

SEQ ID NO: 878498 - RNA, 21 nt, Homo sapiens
caugcugugugcuggagacac

SEQ ID NO: 878499 - RNA, 17 nt, Homo sapiens
caugcuuuggcaauuuu

SEQ ID NO: 878500 - RNA, 18 nt, Homo sapiens
cauggaaacgcaaaugag

SEQ ID NO: 878501 - RNA, 17 nt, Homo sapiens
cauggaaauguccucca

SEQ ID NO: 878502 - RNA, 17 nt, Homo sapiens
cauggaauaaaccauuu

SEQ ID NO: 878503 - RNA, 13 nt, Homo sapiens
cauggaauuaccu

SEQ ID NO: 878504 - RNA, 15 nt, Homo sapiens
cauggagaaacccug

SEQ ID NO: 878505 - RNA, 19 nt, Homo sapiens
cauggagcagccagcguua

SEQ ID NO: 878506 - RNA, 12 nt, Homo sapiens
cauggaugcaca

SEQ ID NO: 878507 - RNA, 21 nt, Homo sapiens
cauggcaacauaauucacuuu

SEQ ID NO: 878508 - RNA, 19 nt, Homo sapiens
cauggccaccccgugccac

SEQ ID NO: 878509 - RNA, 23 nt, Homo sapiens
cauggcugggauuuaaagccuuu

SEQ ID NO: 878510 - RNA, 15 nt, Homo sapiens
cauggcuuugcuuug

SEQ ID NO: 878511 - RNA, 13 nt, Homo sapiens
caugggacugugc

SEQ ID NO: 878512 - RNA, 16 nt, Homo sapiens
caugggccuagcauag

SEQ ID NO: 878513 - RNA, 20 nt, Homo sapiens
caugguaaaaccccaucucu

SEQ ID NO: 878514 - RNA, 21 nt, Homo sapiens
cauggugacuaacaguuacau

SEQ ID NO: 878515 - RNA, 13 nt, Homo sapiens
cauggugcacuga

SEQ ID NO: 878516 - RNA, 15 nt, Homo sapiens
cauggugcacugagc

SEQ ID NO: 878517 - RNA, 16 nt, Homo sapiens
caugguuuugaaaugc

SEQ ID NO: 878518 - RNA, 13 nt, Homo sapiens
cauguaaccaaga

SEQ ID NO: 878519 - RNA, 17 nt, Homo sapiens
cauguaauaaaucugag

SEQ ID NO: 878520 - RNA, 12 nt, Homo sapiens
cauguacaugaa

SEQ ID NO: 878521 - RNA, 17 nt, Homo sapiens
cauguagauuuuaguuc

SEQ ID NO: 878522 - RNA, 22 nt, Homo sapiens
cauguaucuaccucacuauuca

SEQ ID NO: 878523 - RNA, 15 nt, Homo sapiens
cauguaucuaugcau

SEQ ID NO: 878524 - RNA, 17 nt, Homo sapiens
cauguaucuaugcauuu

SEQ ID NO: 878525 - RNA, 13 nt, Homo sapiens
cauguaugucuug

SEQ ID NO: 878526 - RNA, 17 nt, Homo sapiens
cauguaugucuuggaca

SEQ ID NO: 878527 - RNA, 16 nt, Homo sapiens
caugucgccucugcau

SEQ ID NO: 878528 - RNA, 16 nt, Homo sapiens
caugucuuguucagaa

SEQ ID NO: 878529 - RNA, 19 nt, Homo sapiens
caugugaaaauaauagcca

SEQ ID NO: 878530 - RNA, 22 nt, Homo sapiens
auucucaguguagggcagagag

SEQ ID NO: 878531 - RNA, 14 nt, Homo sapiens
auucucaucuacuc

SEQ ID NO: 878532 - RNA, 17 nt, Homo sapiens
auucucauuugucacac

SEQ ID NO: 878533 - RNA, 19 nt, Homo sapiens
auucucggggcccugugua

SEQ ID NO: 878534 - RNA, 18 nt, Homo sapiens
auucucuccucagacugc

SEQ ID NO: 878535 - RNA, 22 nt, Homo sapiens
auucucuccucagacugcucaa

SEQ ID NO: 878536 - RNA, 22 nt, Homo sapiens
auucucugugguauccaagaau

SEQ ID NO: 878537 - RNA, 19 nt, Homo sapiens
auucucuuacccagaauau

SEQ ID NO: 878538 - RNA, 20 nt, Homo sapiens
auucugaaaucagucuacca

SEQ ID NO: 878539 - RNA, 14 nt, Homo sapiens
auucugaaugaaua

SEQ ID NO: 878540 - RNA, 11 nt, Homo sapiens
auucugaccau

SEQ ID NO: 878541 - RNA, 18 nt, Homo sapiens
auucugauucgaaugaca

SEQ ID NO: 878542 - RNA, 17 nt, Homo sapiens
auuaaaaaugcauauac

SEQ ID NO: 878543 - RNA, 17 nt, Homo sapiens
auuaaaacacagcuuua

SEQ ID NO: 878544 - RNA, 14 nt, Homo sapiens
auuaaaacuaugaa

SEQ ID NO: 878545 - RNA, 23 nt, Homo sapiens
auuaaaacucauuuuuguuuuca

SEQ ID NO: 878546 - RNA, 15 nt, Homo sapiens
auuaaaacugcacug

SEQ ID NO: 878547 - RNA, 13 nt, Homo sapiens
auuaaaagaaucc

SEQ ID NO: 878548 - RNA, 13 nt, Homo sapiens
auuaaaagcuauc

SEQ ID NO: 878549 - RNA, 19 nt, Homo sapiens
auuaaacaagugcacuuga

SEQ ID NO: 878550 - RNA, 14 nt, Homo sapiens
auuaaacacuguaa

SEQ ID NO: 878551 - RNA, 19 nt, Homo sapiens
auuaaacuugucagaauuu

SEQ ID NO: 878552 - RNA, 20 nt, Homo sapiens
auuaaacuugucagaauuuc

SEQ ID NO: 878553 - RNA, 11 nt, Homo sapiens
auuaaagggua

SEQ ID NO: 878554 - RNA, 22 nt, Homo sapiens
auuaaaugcauguccucaaaac

SEQ ID NO: 878555 - RNA, 19 nt, Homo sapiens
auuaacagaagccaaaaua

SEQ ID NO: 878556 - RNA, 21 nt, Homo sapiens
auuaacuaugugauguuaacu

SEQ ID NO: 878557 - RNA, 20 nt, Homo sapiens
augacaucacuuguacaaaa

SEQ ID NO: 878558 - RNA, 13 nt, Homo sapiens
augacaugcacug

SEQ ID NO: 878559 - RNA, 16 nt, Homo sapiens
augacauuuuugauaa

SEQ ID NO: 878560 - RNA, 22 nt, Homo sapiens
augaccagaaaacaaaucuuca

SEQ ID NO: 878561 - RNA, 17 nt, Homo sapiens
augacccacccaguguc

SEQ ID NO: 878562 - RNA, 20 nt, Homo sapiens
augacuauguuucuauucua

SEQ ID NO: 878563 - RNA, 15 nt, Homo sapiens
augacucagcauacc

SEQ ID NO: 878564 - RNA, 15 nt, Homo sapiens
augacuccuuucucu

SEQ ID NO: 878565 - RNA, 23 nt, Homo sapiens
augacuucugccccagcuuuauc

SEQ ID NO: 878566 - RNA, 21 nt, Homo sapiens
augacuuuuuuucugauucaa

SEQ ID NO: 878567 - RNA, 14 nt, Homo sapiens
augagagaacugga

SEQ ID NO: 878568 - RNA, 15 nt, Homo sapiens
augagagaacuggag

SEQ ID NO: 878569 - RNA, 22 nt, Homo sapiens
augagcaauucuccugccucag

SEQ ID NO: 878570 - RNA, 19 nt, Homo sapiens
augagcucugaacaaacac

SEQ ID NO: 878571 - RNA, 22 nt, Homo sapiens
augagcuguggacuagcaauau

SEQ ID NO: 878572 - RNA, 17 nt, Homo sapiens
augaggauaucaucuuu

SEQ ID NO: 878573 - RNA, 20 nt, Homo sapiens
augaggccuuuccccagugu

SEQ ID NO: 878574 - RNA, 18 nt, Homo sapiens
augagggaaauugcuauu

SEQ ID NO: 878575 - RNA, 16 nt, Homo sapiens
augagggugacuguca

SEQ ID NO: 878576 - RNA, 17 nt, Homo sapiens
augagggugacugucaa

SEQ ID NO: 878577 - RNA, 12 nt, Homo sapiens
augaguggcuuc

SEQ ID NO: 878578 - RNA, 14 nt, Homo sapiens
augaguuacuugaa

SEQ ID NO: 878579 - RNA, 22 nt, Homo sapiens
augaguuacuugaaauuugccu

SEQ ID NO: 878580 - RNA, 20 nt, Homo sapiens
augaguuuuugauagcuuua

SEQ ID NO: 878581 - RNA, 17 nt, Homo sapiens
augauaaaagcacuuac

SEQ ID NO: 878582 - RNA, 16 nt, Homo sapiens
augauaauuuacuuaa

SEQ ID NO: 878583 - RNA, 23 nt, Homo sapiens
augauauuuuaugcaaacaguuc

SEQ ID NO: 878584 - RNA, 19 nt, Homo sapiens
augaucgagccacugcacu

SEQ ID NO: 878585 - RNA, 12 nt, Homo sapiens
augaucuuggca

SEQ ID NO: 878586 - RNA, 18 nt, Homo sapiens
augaucuuguuaaugcau

SEQ ID NO: 878587 - RNA, 14 nt, Homo sapiens
augaugaugaucuu

SEQ ID NO: 878588 - RNA, 15 nt, Homo sapiens
augaugccacuuccc

SEQ ID NO: 878589 - RNA, 17 nt, Homo sapiens
augaugcuaccaugccu

SEQ ID NO: 878590 - RNA, 19 nt, Homo sapiens
augauggcaccacugcacu

SEQ ID NO: 878591 - RNA, 18 nt, Homo sapiens
augaugugggucaaggaa

SEQ ID NO: 878592 - RNA, 21 nt, Homo sapiens
augauuggauuauucauuuaa

SEQ ID NO: 878593 - RNA, 18 nt, Homo sapiens
augauuuagggaagcagg

SEQ ID NO: 878594 - RNA, 20 nt, Homo sapiens
augauuuuugucgaguuuac

SEQ ID NO: 878595 - RNA, 21 nt, Homo sapiens
augcaaaauaaauguuuuuau

SEQ ID NO: 878596 - RNA, 13 nt, Homo sapiens
augcaagugagaa

SEQ ID NO: 878597 - RNA, 14 nt, Homo sapiens
augcacacaaacac

SEQ ID NO: 878598 - RNA, 22 nt, Homo sapiens
augcacacacacggaugcacac

SEQ ID NO: 878599 - RNA, 13 nt, Homo sapiens
augcacacacaga

SEQ ID NO: 878600 - RNA, 17 nt, Homo sapiens
augcacacacagaugca

SEQ ID NO: 878601 - RNA, 23 nt, Homo sapiens
augcacaccaaaaaaauacuuga

SEQ ID NO: 878602 - RNA, 21 nt, Homo sapiens
augcacauauggacucugcac

SEQ ID NO: 878603 - RNA, 20 nt, Homo sapiens
augcaccaaaucaucucuca

SEQ ID NO: 878604 - RNA, 17 nt, Homo sapiens
augcaccccaacauuga

SEQ ID NO: 878605 - RNA, 18 nt, Homo sapiens
augcaccuugugucugua

SEQ ID NO: 878606 - RNA, 22 nt, Homo sapiens
augcagccacugugcugaauuc

SEQ ID NO: 878607 - RNA, 16 nt, Homo sapiens
augcagccgugcagga

SEQ ID NO: 878608 - RNA, 17 nt, Homo sapiens
augcaguccagaauaag

SEQ ID NO: 878609 - RNA, 19 nt, Homo sapiens
augcaugcagccacugugc

SEQ ID NO: 878610 - RNA, 14 nt, Homo sapiens
augcauggugcauc

SEQ ID NO: 878611 - RNA, 15 nt, Homo sapiens
augcauguauguagg

SEQ ID NO: 878612 - RNA, 14 nt, Homo sapiens
augccaaauucuua

SEQ ID NO: 878613 - RNA, 18 nt, Homo sapiens
augccacccucuccaugc

SEQ ID NO: 878614 - RNA, 17 nt, Homo sapiens
augccacccuguuuuca

SEQ ID NO: 878615 - RNA, 13 nt, Homo sapiens
augccagagccug

SEQ ID NO: 878616 - RNA, 11 nt, Homo sapiens
augccaggacc

SEQ ID NO: 878617 - RNA, 17 nt, Homo sapiens
augccagugaaacuuca

SEQ ID NO: 878618 - RNA, 22 nt, Homo sapiens
augccagugaaacuucaagcaa

SEQ ID NO: 878619 - RNA, 15 nt, Homo sapiens
augccauagcaagau

SEQ ID NO: 878620 - RNA, 13 nt, Homo sapiens
augcccagcugua

SEQ ID NO: 878621 - RNA, 20 nt, Homo sapiens
augccgggcgcaguggcuca

SEQ ID NO: 878622 - RNA, 15 nt, Homo sapiens
augccggugaucccu

SEQ ID NO: 878623 - RNA, 12 nt, Homo sapiens
augccucugagg

SEQ ID NO: 878624 - RNA, 16 nt, Homo sapiens
augccucuguauuuaa

SEQ ID NO: 878625 - RNA, 21 nt, Homo sapiens
augccuuucuguaaccaaaaa

SEQ ID NO: 878626 - RNA, 20 nt, Homo sapiens
augcuaaauaguucuaucag

SEQ ID NO: 878627 - RNA, 15 nt, Homo sapiens
augcucauacuugga

SEQ ID NO: 878628 - RNA, 15 nt, Homo sapiens
augcucgugugauuu

SEQ ID NO: 878629 - RNA, 15 nt, Homo sapiens
augcugccaaccagc

SEQ ID NO: 878630 - RNA, 15 nt, Homo sapiens
augcugcuaauucaa

SEQ ID NO: 878631 - RNA, 22 nt, Homo sapiens
augcuggccuguggcaggccua

SEQ ID NO: 878632 - RNA, 21 nt, Homo sapiens
augcugggccaguuccuccaa

SEQ ID NO: 878633 - RNA, 20 nt, Homo sapiens
augcuguggacaccaccuau

SEQ ID NO: 878634 - RNA, 21 nt, Homo sapiens
augcuguuuuaaaaacaaaga

SEQ ID NO: 878635 - RNA, 22 nt, Homo sapiens
augcuucccuuguauccaguga

SEQ ID NO: 878636 - RNA, 22 nt, Homo sapiens
augcuugugauuuuugaacaau

SEQ ID NO: 878637 - RNA, 20 nt, Homo sapiens
auggaaagaaucuaauagag

SEQ ID NO: 878638 - RNA, 21 nt, Homo sapiens
auggaaauucugcucagauag

SEQ ID NO: 878639 - RNA, 13 nt, Homo sapiens
auggaacauaaaa

SEQ ID NO: 878640 - RNA, 16 nt, Homo sapiens
auggaacucucuccac

SEQ ID NO: 878641 - RNA, 16 nt, Homo sapiens
auggaagaaaugggag

SEQ ID NO: 878642 - RNA, 15 nt, Homo sapiens
auggaagugucugga

SEQ ID NO: 878643 - RNA, 16 nt, Homo sapiens
auggaauaaagcccuu

SEQ ID NO: 878644 - RNA, 17 nt, Homo sapiens
auggaaucagcugcuac

SEQ ID NO: 878645 - RNA, 20 nt, Homo sapiens
auggaauuucucccagucau

SEQ ID NO: 878646 - RNA, 20 nt, Homo sapiens
auggaauuuuucauugauau

SEQ ID NO: 878647 - RNA, 15 nt, Homo sapiens
auggacaagauuacc

SEQ ID NO: 878648 - RNA, 23 nt, Homo sapiens
auggacaccccuuauccaggacu

SEQ ID NO: 878649 - RNA, 15 nt, Homo sapiens
auggacauaagacag

SEQ ID NO: 878650 - RNA, 15 nt, Homo sapiens
auggacucaguuuuc

SEQ ID NO: 878651 - RNA, 20 nt, Homo sapiens
auggacucugaaaaacauuc

SEQ ID NO: 878652 - RNA, 12 nt, Homo sapiens
auggacucugca

SEQ ID NO: 878653 - RNA, 14 nt, Homo sapiens
auggagauucugau

SEQ ID NO: 878654 - RNA, 15 nt, Homo sapiens
auggaggagaaauaa

SEQ ID NO: 878655 - RNA, 11 nt, Homo sapiens
auggagugugc

SEQ ID NO: 878656 - RNA, 13 nt, Homo sapiens
aguacagaugcag

SEQ ID NO: 878657 - RNA, 18 nt, Homo sapiens
aguacagugagccaagau

SEQ ID NO: 878658 - RNA, 19 nt, Homo sapiens
aguacaugaagagcagcug

SEQ ID NO: 878659 - RNA, 14 nt, Homo sapiens
aguaccagugugcu

SEQ ID NO: 878660 - RNA, 19 nt, Homo sapiens
aguacucucugcucuagcc

SEQ ID NO: 878661 - RNA, 15 nt, Homo sapiens
aguacuuuaccuccu

SEQ ID NO: 878662 - RNA, 15 nt, Homo sapiens
aguagagaaguaucc

SEQ ID NO: 878663 - RNA, 14 nt, Homo sapiens
aguagagacagggu

SEQ ID NO: 878664 - RNA, 17 nt, Homo sapiens
aguagagggcacugggu

SEQ ID NO: 878665 - RNA, 13 nt, Homo sapiens
aguagcagggaau

SEQ ID NO: 878666 - RNA, 19 nt, Homo sapiens
aguagcggaucucacucag

SEQ ID NO: 878667 - RNA, 10 nt, Homo sapiens
aguagcugag

SEQ ID NO: 878668 - RNA, 14 nt, Homo sapiens
aguagcugggacua

SEQ ID NO: 878669 - RNA, 17 nt, Homo sapiens
aguagcugugaacauug

SEQ ID NO: 878670 - RNA, 16 nt, Homo sapiens
aguaggacuuuccuaa

SEQ ID NO: 878671 - RNA, 21 nt, Homo sapiens
aguaggcccggugugguggcu

SEQ ID NO: 878672 - RNA, 16 nt, Homo sapiens
aguagguuuacauuca

SEQ ID NO: 878673 - RNA, 22 nt, Homo sapiens
aguagguuuacauucaucucau

SEQ ID NO: 878674 - RNA, 12 nt, Homo sapiens
aguagucucugu

SEQ ID NO: 878675 - RNA, 17 nt, Homo sapiens
aguauaaagucacuucc

SEQ ID NO: 878676 - RNA, 14 nt, Homo sapiens
aguauaaagugauc

SEQ ID NO: 878677 - RNA, 23 nt, Homo sapiens
aguauacaauaaagucuuaccuc

SEQ ID NO: 878678 - RNA, 18 nt, Homo sapiens
aguauacuuuuguuucag

SEQ ID NO: 878679 - RNA, 20 nt, Homo sapiens
aguaucacauagaagcuguc

SEQ ID NO: 878680 - RNA, 13 nt, Homo sapiens
aguauccacuuug

SEQ ID NO: 878681 - RNA, 12 nt, Homo sapiens
aguaucuuaccu

SEQ ID NO: 878682 - RNA, 16 nt, Homo sapiens
aguauggaaucagcug

SEQ ID NO: 878683 - RNA, 19 nt, Homo sapiens
aguauucaggcacugagaa

SEQ ID NO: 878684 - RNA, 14 nt, Homo sapiens
aguauucauuuucc

SEQ ID NO: 878685 - RNA, 20 nt, Homo sapiens
aguauuccagaccugaagaa

SEQ ID NO: 878686 - RNA, 23 nt, Homo sapiens
aguauuccaugggauguuaagca

SEQ ID NO: 878687 - RNA, 18 nt, Homo sapiens
aguauugcgaaugugcag

SEQ ID NO: 878688 - RNA, 20 nt, Homo sapiens
aguauugcgaaugugcagaa

SEQ ID NO: 878689 - RNA, 17 nt, Homo sapiens
aguauuguuuguaauca

SEQ ID NO: 878690 - RNA, 22 nt, Homo sapiens
aguauuugcugaauggggaccu

SEQ ID NO: 878691 - RNA, 22 nt, Homo sapiens
aguauuuuauuaaagcaacauu

SEQ ID NO: 878692 - RNA, 16 nt, Homo sapiens
agucaacaaccaugcc

SEQ ID NO: 878693 - RNA, 14 nt, Homo sapiens
agucaacaguucaa

SEQ ID NO: 878694 - RNA, 20 nt, Homo sapiens
agucacacuguuacuccaca

SEQ ID NO: 878695 - RNA, 21 nt, Homo sapiens
agucacaguuagguagcuuua

SEQ ID NO: 878696 - RNA, 21 nt, Homo sapiens
agucacauggccuaugcacau

SEQ ID NO: 878697 - RNA, 12 nt, Homo sapiens
agucaccaaaau

SEQ ID NO: 878698 - RNA, 14 nt, Homo sapiens
agucacugcacagu

SEQ ID NO: 878699 - RNA, 15 nt, Homo sapiens
agucacuuccagugu

SEQ ID NO: 878700 - RNA, 17 nt, Homo sapiens
agucagaacucuguguu

SEQ ID NO: 878701 - RNA, 21 nt, Homo sapiens
agucagaggagaagagacaug

SEQ ID NO: 878702 - RNA, 14 nt, Homo sapiens
agucagaugcccag

SEQ ID NO: 878703 - RNA, 20 nt, Homo sapiens
agucaggacuugaacccagg

SEQ ID NO: 878704 - RNA, 23 nt, Homo sapiens
agucaggccuuaauuuucaguau

SEQ ID NO: 878705 - RNA, 16 nt, Homo sapiens
agucaguaauugccaa

SEQ ID NO: 878706 - RNA, 22 nt, Homo sapiens
agucaguuucuaucauucugcu

SEQ ID NO: 878707 - RNA, 17 nt, Homo sapiens
agucauaaacagcauuu

SEQ ID NO: 878708 - RNA, 15 nt, Homo sapiens
agucauacugucacu

SEQ ID NO: 878709 - RNA, 17 nt, Homo sapiens
agucaucuuagcuuucc

SEQ ID NO: 878710 - RNA, 21 nt, Homo sapiens
agucaugauggauggaaauau

SEQ ID NO: 878711 - RNA, 13 nt, Homo sapiens
agucaugcacuca

SEQ ID NO: 878712 - RNA, 14 nt, Homo sapiens
agucaugcacucag

SEQ ID NO: 878713 - RNA, 12 nt, Homo sapiens
agucauuaccac

SEQ ID NO: 878714 - RNA, 15 nt, Homo sapiens
agucauucugggaac

SEQ ID NO: 878715 - RNA, 21 nt, Homo sapiens
agucauugucgcucagcaaua

SEQ ID NO: 878716 - RNA, 21 nt, Homo sapiens
agucccucccaucucuacccc

SEQ ID NO: 878717 - RNA, 23 nt, Homo sapiens
agucccugacucucugugaccug

SEQ ID NO: 878718 - RNA, 19 nt, Homo sapiens
agucccuguucucagcucc

SEQ ID NO: 878719 - RNA, 22 nt, Homo sapiens
agucccuucugagcgagcacac

SEQ ID NO: 878720 - RNA, 18 nt, Homo sapiens
aguccgcagucuggccug

SEQ ID NO: 878721 - RNA, 17 nt, Homo sapiens
aguccuagccacucagg

SEQ ID NO: 878722 - RNA, 21 nt, Homo sapiens
aguccuaucgacuuuauacag

SEQ ID NO: 878723 - RNA, 10 nt, Homo sapiens
aguccucaca

SEQ ID NO: 878724 - RNA, 19 nt, Homo sapiens
aguccucguagccaucucu

SEQ ID NO: 878725 - RNA, 19 nt, Homo sapiens
aguccuuucuaaguauuuu

SEQ ID NO: 878726 - RNA, 18 nt, Homo sapiens
aaauuaaaugcauguccu

SEQ ID NO: 878727 - RNA, 18 nt, Homo sapiens
aaauuaaauugcagaugg

SEQ ID NO: 878728 - RNA, 20 nt, Homo sapiens
aaauuaagagauacauuccc

SEQ ID NO: 878729 - RNA, 15 nt, Homo sapiens
aaauuacaauuguca

SEQ ID NO: 878730 - RNA, 12 nt, Homo sapiens
aaauuacuuauu

SEQ ID NO: 878731 - RNA, 15 nt, Homo sapiens
aaauuacuucucucu

SEQ ID NO: 878732 - RNA, 15 nt, Homo sapiens
aaauuaugauaagga

SEQ ID NO: 878733 - RNA, 21 nt, Homo sapiens
aaauuauuuuaaaaacuaaaa

SEQ ID NO: 878734 - RNA, 17 nt, Homo sapiens
aaauucaaccacuguaa

SEQ ID NO: 878735 - RNA, 15 nt, Homo sapiens
aaauucaagccuuag

SEQ ID NO: 878736 - RNA, 16 nt, Homo sapiens
aaauucaagcugcuuu

SEQ ID NO: 878737 - RNA, 20 nt, Homo sapiens
aaauucauggugcacugagc

SEQ ID NO: 878738 - RNA, 17 nt, Homo sapiens
aaauucuugaaguucau

SEQ ID NO: 878739 - RNA, 20 nt, Homo sapiens
aaauugcuacauaguccaaa

SEQ ID NO: 878740 - RNA, 14 nt, Homo sapiens
aaauugcuuauucu

SEQ ID NO: 878741 - RNA, 17 nt, Homo sapiens
aaauuuaauauagcuau

SEQ ID NO: 878742 - RNA, 23 nt, Homo sapiens
aaauuuccaggggccucccaagg

SEQ ID NO: 878743 - RNA, 24 nt, Homo sapiens
aaauuuggauuuacgacugaagaa

SEQ ID NO: 878744 - RNA, 21 nt, Homo sapiens
aaauuuguccaauggcuguaa

SEQ ID NO: 878745 - RNA, 12 nt, Homo sapiens
aaauuuuacuuu

SEQ ID NO: 878746 - RNA, 22 nt, Homo sapiens
aaauuuuauugguaggauuuau

SEQ ID NO: 878747 - RNA, 19 nt, Homo sapiens
aacaaaaauguaaugauca

SEQ ID NO: 878748 - RNA, 20 nt, Homo sapiens
aacaaaaauguaaugaucau

SEQ ID NO: 878749 - RNA, 17 nt, Homo sapiens
aacaaauagucuaucaa

SEQ ID NO: 878750 - RNA, 14 nt, Homo sapiens
aacaaauggccuuu

SEQ ID NO: 878751 - RNA, 22 nt, Homo sapiens
aacaaauuagguuuuguacaau

SEQ ID NO: 878752 - RNA, 20 nt, Homo sapiens
aacaacaaagccaacaguca

SEQ ID NO: 878753 - RNA, 18 nt, Homo sapiens
aacaacaauaacaacaau

SEQ ID NO: 878754 - RNA, 20 nt, Homo sapiens
aacaacauccauguccuaug

SEQ ID NO: 878755 - RNA, 13 nt, Homo sapiens
aacaaccaugcca

SEQ ID NO: 878756 - RNA, 19 nt, Homo sapiens
aacaacguaaacuuccuaa

SEQ ID NO: 878757 - RNA, 22 nt, Homo sapiens
aacaacuaggcuucagcauauu

SEQ ID NO: 878758 - RNA, 17 nt, Homo sapiens
aacaacuguggucaauc

SEQ ID NO: 878759 - RNA, 21 nt, Homo sapiens
aacaacuugucuauuaccugu

SEQ ID NO: 878760 - RNA, 17 nt, Homo sapiens
aacaagacaaagcaaag

SEQ ID NO: 878761 - RNA, 20 nt, Homo sapiens
aacaagguucccucugagaa

SEQ ID NO: 878762 - RNA, 20 nt, Homo sapiens
aacaauacgugaaagaugca

SEQ ID NO: 878763 - RNA, 22 nt, Homo sapiens
aacaauuccaaaggaaucucca

SEQ ID NO: 878764 - RNA, 13 nt, Homo sapiens
cagguuucuuaaa

SEQ ID NO: 878765 - RNA, 15 nt, Homo sapiens
cagguuuuuggucug

SEQ ID NO: 878766 - RNA, 23 nt, Homo sapiens
caguaaaaaacaacuucuuugua

SEQ ID NO: 878767 - RNA, 14 nt, Homo sapiens
caguaaauccacag

SEQ ID NO: 878768 - RNA, 17 nt, Homo sapiens
caguaacucaucuguca

SEQ ID NO: 878769 - RNA, 20 nt, Homo sapiens
caguaagcugcucuauugua

SEQ ID NO: 878770 - RNA, 13 nt, Homo sapiens
caguacaauguuu

SEQ ID NO: 878771 - RNA, 15 nt, Homo sapiens
caguacuauguaaau

SEQ ID NO: 878772 - RNA, 20 nt, Homo sapiens
caguagaggcaugaacacac

SEQ ID NO: 878773 - RNA, 20 nt, Homo sapiens
caguagcuuaaauaaauuca

SEQ ID NO: 878774 - RNA, 17 nt, Homo sapiens
caguauucuugucaaaa

SEQ ID NO: 878775 - RNA, 16 nt, Homo sapiens
cagucaaaggcauuuu

SEQ ID NO: 878776 - RNA, 16 nt, Homo sapiens
cagucaacaguucaaa

SEQ ID NO: 878777 - RNA, 19 nt, Homo sapiens
cagucaccgacaacaugcu

SEQ ID NO: 878778 - RNA, 21 nt, Homo sapiens
cagucauaacuaaauaaagcu

SEQ ID NO: 878779 - RNA, 20 nt, Homo sapiens
cagucauuauuagcuuuuau

SEQ ID NO: 878780 - RNA, 22 nt, Homo sapiens
caguccagaugccuuccugucu

SEQ ID NO: 878781 - RNA, 11 nt, Homo sapiens
cagucucaagc

SEQ ID NO: 878782 - RNA, 18 nt, Homo sapiens
cagucuggaucguuugac

SEQ ID NO: 878783 - RNA, 14 nt, Homo sapiens
cagucuugccuagg

SEQ ID NO: 878784 - RNA, 16 nt, Homo sapiens
cagucuuggcucacua

SEQ ID NO: 878785 - RNA, 22 nt, Homo sapiens
cagucuuggcucacuacagccu

SEQ ID NO: 878786 - RNA, 14 nt, Homo sapiens
cagugaaccaaaga

SEQ ID NO: 878787 - RNA, 21 nt, Homo sapiens
cagugaauuaaauuuucacua

SEQ ID NO: 878788 - RNA, 20 nt, Homo sapiens
cagugagacacagaguggag

SEQ ID NO: 878789 - RNA, 20 nt, Homo sapiens
cagugagccgagauugcgcc

SEQ ID NO: 878790 - RNA, 21 nt, Homo sapiens
cagugagcucuggaugaagcu

SEQ ID NO: 878791 - RNA, 20 nt, Homo sapiens
cagugagcugauaucaugcc

SEQ ID NO: 878792 - RNA, 18 nt, Homo sapiens
cagugauuugccaaagug

SEQ ID NO: 878793 - RNA, 20 nt, Homo sapiens
cagugcagggaaccgugaua

SEQ ID NO: 878794 - RNA, 15 nt, Homo sapiens
cagugcccacagcca

SEQ ID NO: 878795 - RNA, 19 nt, Homo sapiens
cagugcccuuuucaucucc

SEQ ID NO: 878796 - RNA, 22 nt, Homo sapiens
cagugccuccugggaccaugga

SEQ ID NO: 878797 - RNA, 13 nt, Homo sapiens
cagugcuaccucu

SEQ ID NO: 878798 - RNA, 17 nt, Homo sapiens
cagugcucggcuguaaa

SEQ ID NO: 878799 - RNA, 21 nt, Homo sapiens
cagugcuggggguuucuguag

SEQ ID NO: 878800 - RNA, 17 nt, Homo sapiens
cagugcuguacuugaug

SEQ ID NO: 878801 - RNA, 21 nt, Homo sapiens
cagugcuguggccugggcaag

SEQ ID NO: 878802 - RNA, 18 nt, Homo sapiens
caguggcauucacaucuc

SEQ ID NO: 878803 - RNA, 19 nt, Homo sapiens
caguggcauucacaucuca

SEQ ID NO: 878804 - RNA, 23 nt, Homo sapiens
caguggcauucacaucucaugua

SEQ ID NO: 878805 - RNA, 21 nt, Homo sapiens
cagugggugccccccuugcca

SEQ ID NO: 878806 - RNA, 15 nt, Homo sapiens
caguggugugaucuu

SEQ ID NO: 878807 - RNA, 13 nt, Homo sapiens
caguguacugcuu

SEQ ID NO: 878808 - RNA, 14 nt, Homo sapiens
caguguaugcucau

SEQ ID NO: 878809 - RNA, 12 nt, Homo sapiens
cagugucauuua

SEQ ID NO: 878810 - RNA, 18 nt, Homo sapiens
caguguccccuccacugu

SEQ ID NO: 878811 - RNA, 16 nt, Homo sapiens
caguguccucaggggc

SEQ ID NO: 878812 - RNA, 13 nt, Homo sapiens
cagugucuuccau

SEQ ID NO: 878813 - RNA, 13 nt, Homo sapiens
cagugugucacac

SEQ ID NO: 878814 - RNA, 18 nt, Homo sapiens
caguguuccccaucuggg

SEQ ID NO: 878815 - RNA, 18 nt, Homo sapiens
caguguuuagaagagccu

SEQ ID NO: 878816 - RNA, 23 nt, Homo sapiens
caguguuuagaagagccugacug

SEQ ID NO: 878817 - RNA, 16 nt, Homo sapiens
caguguuuucaccuca

SEQ ID NO: 878818 - RNA, 19 nt, Homo sapiens
caguguuuuccuuugcacc

SEQ ID NO: 878819 - RNA, 20 nt, Homo sapiens
caguuaugugaaugaucucu

SEQ ID NO: 878820 - RNA, 16 nt, Homo sapiens
caguucaaagcaggau

SEQ ID NO: 878821 - RNA, 23 nt, Homo sapiens
caguucacuucuuugcagagccu

SEQ ID NO: 878822 - RNA, 16 nt, Homo sapiens
caguuccuuucaaugg

SEQ ID NO: 878823 - RNA, 14 nt, Homo sapiens
caguucugcuccuc

SEQ ID NO: 878824 - RNA, 15 nt, Homo sapiens
caguugacaaaaagc

SEQ ID NO: 878825 - RNA, 19 nt, Homo sapiens
caguugauucugaaucuga

SEQ ID NO: 878826 - RNA, 18 nt, Homo sapiens
caguugugucagcuacug

SEQ ID NO: 878827 - RNA, 20 nt, Homo sapiens
caguuugcuuuguaugcacu

SEQ ID NO: 878828 - RNA, 13 nt, Homo sapiens
caguuuucuugca

SEQ ID NO: 878829 - RNA, 14 nt, Homo sapiens
cauaaaaucuguga

SEQ ID NO: 878830 - RNA, 21 nt, Homo sapiens
cauaaacaacuuaauguucug

SEQ ID NO: 878831 - RNA, 17 nt, Homo sapiens
cauaaacugugugcaga

SEQ ID NO: 878832 - RNA, 16 nt, Homo sapiens
cauaaagguauuuaga

SEQ ID NO: 878833 - RNA, 13 nt, Homo sapiens
cauaaagugccag

SEQ ID NO: 878834 - RNA, 20 nt, Homo sapiens
cauaaaugugguacaagcau

SEQ ID NO: 878835 - RNA, 14 nt, Homo sapiens
cauaacaugcuuua

SEQ ID NO: 878836 - RNA, 15 nt, Homo sapiens
cauaacuaguuuaau

SEQ ID NO: 878837 - RNA, 17 nt, Homo sapiens
cauaacuaguuuaauua

SEQ ID NO: 878838 - RNA, 17 nt, Homo sapiens
cauaacucauugucugu

SEQ ID NO: 878839 - RNA, 11 nt, Homo sapiens
cauaagccuac

SEQ ID NO: 878840 - RNA, 19 nt, Homo sapiens
cauaaugaaugcuauugaa

SEQ ID NO: 878841 - RNA, 18 nt, Homo sapiens
cauaauguuacauuauua

SEQ ID NO: 878842 - RNA, 14 nt, Homo sapiens
cauaauuagaacaa

SEQ ID NO: 878843 - RNA, 13 nt, Homo sapiens
cauacacauugga

SEQ ID NO: 878844 - RNA, 16 nt, Homo sapiens
cauacagagacagaua

SEQ ID NO: 878845 - RNA, 16 nt, Homo sapiens
cauacauauauaucug

SEQ ID NO: 878846 - RNA, 14 nt, Homo sapiens
cauacauugccaau

SEQ ID NO: 878847 - RNA, 21 nt, Homo sapiens
cauaccgcuggggaacagagc

SEQ ID NO: 878848 - RNA, 14 nt, Homo sapiens
cauaccucugacca

SEQ ID NO: 878849 - RNA, 19 nt, Homo sapiens
cauacuuucccacagcacu

SEQ ID NO: 878850 - RNA, 21 nt, Homo sapiens
cauagaaauuacacccaaaga

SEQ ID NO: 878851 - RNA, 17 nt, Homo sapiens
cauagagauaugcacac

SEQ ID NO: 878852 - RNA, 20 nt, Homo sapiens
cauagagauaugcacacaca

SEQ ID NO: 878853 - RNA, 13 nt, Homo sapiens
cauagagaucuau

SEQ ID NO: 878854 - RNA, 11 nt, Homo sapiens
cauagcacugc

SEQ ID NO: 878855 - RNA, 15 nt, Homo sapiens
cauagcuuccaugag

SEQ ID NO: 878856 - RNA, 18 nt, Homo sapiens
cauagugcacacuuguau

SEQ ID NO: 878857 - RNA, 18 nt, Homo sapiens
cauaguuauuuacuugaa

SEQ ID NO: 878858 - RNA, 21 nt, Homo sapiens
cauauaacuaagacauaugca

SEQ ID NO: 878859 - RNA, 22 nt, Homo sapiens
cauauaacuaagacauaugcau

SEQ ID NO: 878860 - RNA, 15 nt, Homo sapiens
cauauauauauguau

SEQ ID NO: 878861 - RNA, 19 nt, Homo sapiens
cauauauaugccuuaugua

SEQ ID NO: 878862 - RNA, 18 nt, Homo sapiens
cauauauaugucaggcaa

SEQ ID NO: 878863 - RNA, 18 nt, Homo sapiens
cauauauauugaaaugca

SEQ ID NO: 878864 - RNA, 24 nt, Homo sapiens
cauauauguauauauaugcacaua

SEQ ID NO: 878865 - RNA, 17 nt, Homo sapiens
cauauauuuaugaaugu

SEQ ID NO: 878866 - RNA, 17 nt, Homo sapiens
cauaucacguacaccau

SEQ ID NO: 878867 - RNA, 22 nt, Homo sapiens
cauaucacguacaccauaugca

SEQ ID NO: 878868 - RNA, 14 nt, Homo sapiens
cauaucagaccucu

SEQ ID NO: 878869 - RNA, 22 nt, Homo sapiens
cauaucauuuuuuuaacacaua

SEQ ID NO: 878870 - RNA, 18 nt, Homo sapiens
cauaugaaaaaaaugcau

SEQ ID NO: 878871 - RNA, 14 nt, Homo sapiens
cauaugcuguggac

SEQ ID NO: 878872 - RNA, 23 nt, Homo sapiens
cauauguauuuugucauauguau

SEQ ID NO: 878873 - RNA, 22 nt, Homo sapiens
cauauguauuuuugucauagca

SEQ ID NO: 878874 - RNA, 16 nt, Homo sapiens
cauauuaaacuucuga

SEQ ID NO: 878875 - RNA, 13 nt, Homo sapiens
cauauuauuccau

SEQ ID NO: 878876 - RNA, 23 nt, Homo sapiens
cauauucugggcuccuggaacca

SEQ ID NO: 878877 - RNA, 16 nt, Homo sapiens
cauauucuguuggcca

SEQ ID NO: 878878 - RNA, 22 nt, Homo sapiens
cauauugacuuaauugcagcuu

SEQ ID NO: 878879 - RNA, 16 nt, Homo sapiens
ccaagacacagaucac

SEQ ID NO: 878880 - RNA, 17 nt, Homo sapiens
ccaagaggucuccauca

SEQ ID NO: 878881 - RNA, 17 nt, Homo sapiens
ccaagauaaaaccagag

SEQ ID NO: 878882 - RNA, 20 nt, Homo sapiens
ccaagauaaaaccagagcag

SEQ ID NO: 878883 - RNA, 11 nt, Homo sapiens
ccaagccaugg

SEQ ID NO: 878884 - RNA, 20 nt, Homo sapiens
ccaagccuuggggauucuuc

SEQ ID NO: 878885 - RNA, 12 nt, Homo sapiens
ccaagcucugcu

SEQ ID NO: 878886 - RNA, 22 nt, Homo sapiens
ccaagcuucaacccucagccuu

SEQ ID NO: 878887 - RNA, 12 nt, Homo sapiens
ccaagcuuucuu

SEQ ID NO: 878888 - RNA, 16 nt, Homo sapiens
ccaaggaaacuugaau

SEQ ID NO: 878889 - RNA, 19 nt, Homo sapiens
ccaaggaggaaaaacagac

SEQ ID NO: 878890 - RNA, 16 nt, Homo sapiens
ccaaggcucugagcaa

SEQ ID NO: 878891 - RNA, 16 nt, Homo sapiens
ccaaggguaugggaag

SEQ ID NO: 878892 - RNA, 24 nt, Homo sapiens
ccaaguccugggaauaugcuagug

SEQ ID NO: 878893 - RNA, 14 nt, Homo sapiens
ccaagucuacuuca

SEQ ID NO: 878894 - RNA, 17 nt, Homo sapiens
ccaagugagaaggagau

SEQ ID NO: 878895 - RNA, 16 nt, Homo sapiens
ccaagugccaauauuu

SEQ ID NO: 878896 - RNA, 21 nt, Homo sapiens
ccaagugccaucccacauucg

SEQ ID NO: 878897 - RNA, 14 nt, Homo sapiens
ccaauaaaacuuua

SEQ ID NO: 878898 - RNA, 15 nt, Homo sapiens
ccaaucagcacugaa

SEQ ID NO: 878899 - RNA, 17 nt, Homo sapiens
ccaaugcacacacacag

SEQ ID NO: 878900 - RNA, 14 nt, Homo sapiens
ccaauggcuguaaa

SEQ ID NO: 878901 - RNA, 15 nt, Homo sapiens
ccaauggcuguaaac

SEQ ID NO: 878902 - RNA, 17 nt, Homo sapiens
ccaauucauuucaucua

SEQ ID NO: 878903 - RNA, 17 nt, Homo sapiens
ccaauugccucuugcag

SEQ ID NO: 878904 - RNA, 17 nt, Homo sapiens
ccacaacugacacagga

SEQ ID NO: 878905 - RNA, 19 nt, Homo sapiens
ccacaacugacacaggaaa

SEQ ID NO: 878906 - RNA, 14 nt, Homo sapiens
ccacaaugccucuc

SEQ ID NO: 878907 - RNA, 13 nt, Homo sapiens
ccacaccaucucc

SEQ ID NO: 878908 - RNA, 21 nt, Homo sapiens
ccacacgcugucucuugagaa

SEQ ID NO: 878909 - RNA, 14 nt, Homo sapiens
ccacagaagccagg

SEQ ID NO: 878910 - RNA, 24 nt, Homo sapiens
ccacagaauacaagccacuaccuu

SEQ ID NO: 878911 - RNA, 20 nt, Homo sapiens
ccacagaccuaggauuucau

SEQ ID NO: 878912 - RNA, 22 nt, Homo sapiens
ccacagcacuacgauguguuga

SEQ ID NO: 878913 - RNA, 16 nt, Homo sapiens
ccacaguuuugccuua

SEQ ID NO: 878914 - RNA, 18 nt, Homo sapiens
ccacaucacuacaguaca

SEQ ID NO: 878915 - RNA, 23 nt, Homo sapiens
ccacaucacuacaguacagugag

SEQ ID NO: 878916 - RNA, 21 nt, Homo sapiens
ccacaucuugcucugcugaca

SEQ ID NO: 878917 - RNA, 19 nt, Homo sapiens
ccacaugugacacauaugc

SEQ ID NO: 878918 - RNA, 19 nt, Homo sapiens
ccacccaccuguacucugg

SEQ ID NO: 878919 - RNA, 17 nt, Homo sapiens
ccacccccuucagugcc

SEQ ID NO: 878920 - RNA, 21 nt, Homo sapiens
ccacccugaggagucugaggu

SEQ ID NO: 878921 - RNA, 17 nt, Homo sapiens
ccaccgggccugaacca

SEQ ID NO: 878922 - RNA, 14 nt, Homo sapiens
ccaccggggaaccc

SEQ ID NO: 878923 - RNA, 22 nt, Homo sapiens
ccaccuaccugccggacacaga

SEQ ID NO: 878924 - RNA, 16 nt, Homo sapiens
ccaccucaggcugcca

SEQ ID NO: 878925 - RNA, 16 nt, Homo sapiens
ccaccucuccuuuggc

SEQ ID NO: 878926 - RNA, 21 nt, Homo sapiens
ccaccucuugggcaugcucag

SEQ ID NO: 878927 - RNA, 20 nt, Homo sapiens
ccaccugacaauggcagcua

SEQ ID NO: 878928 - RNA, 14 nt, Homo sapiens
ccaccugacaggcc

SEQ ID NO: 878929 - RNA, 20 nt, Homo sapiens
ccaccuuugggaucagccuc

SEQ ID NO: 878930 - RNA, 21 nt, Homo sapiens
ccacgaggagcuuccagugca

SEQ ID NO: 878931 - RNA, 18 nt, Homo sapiens
ccacgcuggagugcagug

SEQ ID NO: 878932 - RNA, 19 nt, Homo sapiens
ccacgggaagccuccguca

SEQ ID NO: 878933 - RNA, 20 nt, Homo sapiens
ccacgugagagaaucugccu

SEQ ID NO: 878934 - RNA, 16 nt, Homo sapiens
ccacguguuuugacau

SEQ ID NO: 878935 - RNA, 15 nt, Homo sapiens
ccacucaggccaaca

SEQ ID NO: 878936 - RNA, 12 nt, Homo sapiens
ccacuccagaga

SEQ ID NO: 878937 - RNA, 14 nt, Homo sapiens
ccacucccaaagcu

SEQ ID NO: 878938 - RNA, 20 nt, Homo sapiens
ccacuccccccauaucuuua

SEQ ID NO: 878939 - RNA, 24 nt, Homo sapiens
ccacuccuuauauugcugugagau

SEQ ID NO: 878940 - RNA, 15 nt, Homo sapiens
ccacugcugcugcag

SEQ ID NO: 878941 - RNA, 23 nt, Homo sapiens
ccacuuaccuagauucuacauau

SEQ ID NO: 878942 - RNA, 19 nt, Homo sapiens
ccacuuagaaauugcauuu

SEQ ID NO: 878943 - RNA, 16 nt, Homo sapiens
ccacuuugaguaccaa

SEQ ID NO: 878944 - RNA, 18 nt, Homo sapiens
ccagaaagaggcagugau

SEQ ID NO: 878945 - RNA, 19 nt, Homo sapiens
ccagaaagaggcagugauu

SEQ ID NO: 878946 - RNA, 19 nt, Homo sapiens
ccagaaguccuaucgacuu

SEQ ID NO: 878947 - RNA, 15 nt, Homo sapiens
ccagaauugugcaaa

SEQ ID NO: 878948 - RNA, 13 nt, Homo sapiens
ccagacacauggc

SEQ ID NO: 878949 - RNA, 18 nt, Homo sapiens
ccagaccauugucuucca

SEQ ID NO: 878950 - RNA, 18 nt, Homo sapiens
ccagaccccuguggcaga

SEQ ID NO: 878951 - RNA, 19 nt, Homo sapiens
ccagacccugaagauuuca

SEQ ID NO: 878952 - RNA, 17 nt, Homo sapiens
ccagaccucaggugcua

SEQ ID NO: 878953 - RNA, 13 nt, Homo sapiens
ccagaccuuuuau

SEQ ID NO: 878954 - RNA, 15 nt, Homo sapiens
ccagacucagcucca

SEQ ID NO: 878955 - RNA, 14 nt, Homo sapiens
ccagacuggcacag

SEQ ID NO: 878956 - RNA, 16 nt, Homo sapiens
ccagacuggcacaguu

SEQ ID NO: 878957 - RNA, 11 nt, Homo sapiens
ccagacugugg

SEQ ID NO: 878958 - RNA, 23 nt, Homo sapiens
ccagacuuuaccacuaugcaaua

SEQ ID NO: 878959 - RNA, 14 nt, Homo sapiens
ccagacuuucuaca

SEQ ID NO: 878960 - RNA, 18 nt, Homo sapiens
ccagagaccugaggcaga

SEQ ID NO: 878961 - RNA, 21 nt, Homo sapiens
ccagagacuuggggaccagag

SEQ ID NO: 878962 - RNA, 20 nt, Homo sapiens
ccagagaggguggugaccuc

SEQ ID NO: 878963 - RNA, 18 nt, Homo sapiens
ccagagcaggaaugggaa

SEQ ID NO: 878964 - RNA, 23 nt, Homo sapiens
ccagagccccccacaaugaugau

SEQ ID NO: 878965 - RNA, 20 nt, Homo sapiens
ccagagccuggggcucuaac

SEQ ID NO: 878966 - RNA, 22 nt, Homo sapiens
ccagagccugucuuucagcauu

SEQ ID NO: 878967 - RNA, 19 nt, Homo sapiens
ccagaggcuauuauuuuca

SEQ ID NO: 878968 - RNA, 14 nt, Homo sapiens
ccagaggcugcaga

SEQ ID NO: 878969 - RNA, 18 nt, Homo sapiens
ccagaggguagggcagca

SEQ ID NO: 878970 - RNA, 17 nt, Homo sapiens
ccagagucaaauuugaa

SEQ ID NO: 878971 - RNA, 15 nt, Homo sapiens
ccagagugcugccag

SEQ ID NO: 878972 - RNA, 16 nt, Homo sapiens
ccagaguggagucuga

SEQ ID NO: 878973 - RNA, 12 nt, Homo sapiens
ccagcacagggg

SEQ ID NO: 878974 - RNA, 22 nt, Homo sapiens
ccagcacuaacguaaauacaca

SEQ ID NO: 878975 - RNA, 13 nt, Homo sapiens
ccagcacucugaa

SEQ ID NO: 878976 - RNA, 23 nt, Homo sapiens
ccagcagugugucaggugcugca

SEQ ID NO: 878977 - RNA, 23 nt, Homo sapiens
ccagcaugaagguggggccagug

SEQ ID NO: 878978 - RNA, 14 nt, Homo sapiens
ccagccaacauggc

SEQ ID NO: 878979 - RNA, 23 nt, Homo sapiens
ccagccaucaugugccuggaaau

SEQ ID NO: 878980 - RNA, 17 nt, Homo sapiens
ccagcccauggcuuuag

SEQ ID NO: 878981 - RNA, 22 nt, Homo sapiens
ccagcccgacaggcaugcacca

SEQ ID NO: 878982 - RNA, 14 nt, Homo sapiens
ccagcccucaggcc

SEQ ID NO: 878983 - RNA, 12 nt, Homo sapiens
ccagccuaagaa

SEQ ID NO: 878984 - RNA, 15 nt, Homo sapiens
ccagccuggccaaca

SEQ ID NO: 878985 - RNA, 22 nt, Homo sapiens
ccagccugggacucccagugaa

SEQ ID NO: 878986 - RNA, 20 nt, Homo sapiens
ccagccugggcaacagagca

SEQ ID NO: 878987 - RNA, 20 nt, Homo sapiens
ccagccugggcaacauagua

SEQ ID NO: 878988 - RNA, 20 nt, Homo sapiens
ccagccugggcagcauagca

SEQ ID NO: 878989 - RNA, 23 nt, Homo sapiens
ccagcuacauuccucagcugcca

SEQ ID NO: 878990 - RNA, 21 nt, Homo sapiens
ccagcuacuugggaggcugag

SEQ ID NO: 878991 - RNA, 19 nt, Homo sapiens
ccagcuccaguuuccaagu

SEQ ID NO: 878992 - RNA, 11 nt, Homo sapiens
ccagcugucau

SEQ ID NO: 878993 - RNA, 19 nt, Homo sapiens
caugugacacauaugcacc

SEQ ID NO: 878994 - RNA, 22 nt, Homo sapiens
caugugacacauaugcaccuug

SEQ ID NO: 878995 - RNA, 22 nt, Homo sapiens
caugugcagucccagcuacuca

SEQ ID NO: 878996 - RNA, 21 nt, Homo sapiens
cauguggaguggacauucaaa

SEQ ID NO: 878997 - RNA, 23 nt, Homo sapiens
cauguggaguggacauucaaaaa

SEQ ID NO: 878998 - RNA, 19 nt, Homo sapiens
cauguggcuaaaugccuaa

SEQ ID NO: 878999 - RNA, 16 nt, Homo sapiens
cauguuacucaugacu

SEQ ID NO: 879000 - RNA, 19 nt, Homo sapiens
cauguugaagccacugccu

SEQ ID NO: 879001 - RNA, 22 nt, Homo sapiens
cauguugagguacaguuugcau

SEQ ID NO: 879002 - RNA, 21 nt, Homo sapiens
cauguugccaugaggccuuuc

SEQ ID NO: 879003 - RNA, 22 nt, Homo sapiens
cauguuggccaggcuggucuca

SEQ ID NO: 879004 - RNA, 18 nt, Homo sapiens
cauguuuuguauguuaaa

SEQ ID NO: 879005 - RNA, 21 nt, Homo sapiens
cauuaaaaaugaaagccaaau

SEQ ID NO: 879006 - RNA, 14 nt, Homo sapiens
cauuaaaaaugcau

SEQ ID NO: 879007 - RNA, 13 nt, Homo sapiens
cauuaaaagcuac

SEQ ID NO: 879008 - RNA, 20 nt, Homo sapiens
cauuaaauaccuauaugaau

SEQ ID NO: 879009 - RNA, 16 nt, Homo sapiens
cauuaauauuugcuga

SEQ ID NO: 879010 - RNA, 13 nt, Homo sapiens
cauuacauggcug

SEQ ID NO: 879011 - RNA, 17 nt, Homo sapiens
cauuacuuuaauacuca

SEQ ID NO: 879012 - RNA, 22 nt, Homo sapiens
cauuagaaacugaaaacuguaa

SEQ ID NO: 879013 - RNA, 20 nt, Homo sapiens
cauuagcauucugguuuuga

SEQ ID NO: 879014 - RNA, 16 nt, Homo sapiens
cauuaggaacagagua

SEQ ID NO: 879015 - RNA, 15 nt, Homo sapiens
cauuaggcaugccua

SEQ ID NO: 879016 - RNA, 17 nt, Homo sapiens
cauuauaaacgugauga

SEQ ID NO: 879017 - RNA, 22 nt, Homo sapiens
cauuaucucaaaacugcacugu

SEQ ID NO: 879018 - RNA, 17 nt, Homo sapiens
cauuauguaauguccuu

SEQ ID NO: 879019 - RNA, 21 nt, Homo sapiens
cauuaugugugcaugugugua

SEQ ID NO: 879020 - RNA, 17 nt, Homo sapiens
cauuauuucaaccgcuu

SEQ ID NO: 879021 - RNA, 19 nt, Homo sapiens
cauuauuuuuuacaauggc

SEQ ID NO: 879022 - RNA, 14 nt, Homo sapiens
cauucacaucucau

SEQ ID NO: 879023 - RNA, 18 nt, Homo sapiens
cauucaggcagcacugac

SEQ ID NO: 879024 - RNA, 18 nt, Homo sapiens
cauucagguauagcugac

SEQ ID NO: 879025 - RNA, 16 nt, Homo sapiens
cauucagucuagcuuu

SEQ ID NO: 879026 - RNA, 15 nt, Homo sapiens
cauucagugagacac

SEQ ID NO: 879027 - RNA, 16 nt, Homo sapiens
cauucaucaagcugua

SEQ ID NO: 879028 - RNA, 19 nt, Homo sapiens
cauucauuuauucauucau

SEQ ID NO: 879029 - RNA, 18 nt, Homo sapiens
cauuccaaagaacagccu

SEQ ID NO: 879030 - RNA, 19 nt, Homo sapiens
cauuccaaggguaugggaa

SEQ ID NO: 879031 - RNA, 15 nt, Homo sapiens
cauucccaucuguca

SEQ ID NO: 879032 - RNA, 18 nt, Homo sapiens
cauucccuuuuccauaua

SEQ ID NO: 879033 - RNA, 18 nt, Homo sapiens
cauuccugagucuuccag

SEQ ID NO: 879034 - RNA, 21 nt, Homo sapiens
cauuccugggacuaugcugua

SEQ ID NO: 879035 - RNA, 17 nt, Homo sapiens
cauuccuguagucaaaa

SEQ ID NO: 879036 - RNA, 14 nt, Homo sapiens
cauucgagguguca

SEQ ID NO: 879037 - RNA, 17 nt, Homo sapiens
cauucugccugcccagg

SEQ ID NO: 879038 - RNA, 22 nt, Homo sapiens
cauucugguuuugacaucagca

SEQ ID NO: 879039 - RNA, 16 nt, Homo sapiens
cauucuuagacuaguu

SEQ ID NO: 879040 - RNA, 18 nt, Homo sapiens
cauugaaauuuacuguga

SEQ ID NO: 879041 - RNA, 22 nt, Homo sapiens
cauugcaagcuucuuuuaguug

SEQ ID NO: 879042 - RNA, 17 nt, Homo sapiens
cauugcuucugcuaaau

SEQ ID NO: 879043 - RNA, 18 nt, Homo sapiens
cauugguuuuuguaguau

SEQ ID NO: 879044 - RNA, 15 nt, Homo sapiens
cauuguagaaacaca

SEQ ID NO: 879045 - RNA, 17 nt, Homo sapiens
cauuguagaaacacagu

SEQ ID NO: 879046 - RNA, 13 nt, Homo sapiens
cauuguaugugcu

SEQ ID NO: 879047 - RNA, 12 nt, Homo sapiens
cauuuacuuaac

SEQ ID NO: 879048 - RNA, 20 nt, Homo sapiens
cauuucauugagggaaaaca

SEQ ID NO: 879049 - RNA, 17 nt, Homo sapiens
cauuuccgaagaccuuc

SEQ ID NO: 879050 - RNA, 19 nt, Homo sapiens
cauuucuaauguaugcauu

SEQ ID NO: 879051 - RNA, 14 nt, Homo sapiens
cauuucuacuguga

SEQ ID NO: 879052 - RNA, 16 nt, Homo sapiens
cauuucuauagccaaa

SEQ ID NO: 879053 - RNA, 19 nt, Homo sapiens
cauuucucaaaugcacauc

SEQ ID NO: 879054 - RNA, 23 nt, Homo sapiens
cauuucucaaaugcacaucucau

SEQ ID NO: 879055 - RNA, 22 nt, Homo sapiens
cauuucucaaucagugcaguga

SEQ ID NO: 879056 - RNA, 22 nt, Homo sapiens
cauuucuggacccuccacuuca

SEQ ID NO: 879057 - RNA, 21 nt, Homo sapiens
cauuucugucucucucugucc

SEQ ID NO: 879058 - RNA, 18 nt, Homo sapiens
cauuucuugacuucacag

SEQ ID NO: 879059 - RNA, 19 nt, Homo sapiens
cauuugcacagguuuucag

SEQ ID NO: 879060 - RNA, 13 nt, Homo sapiens
cauuugcacuauu

SEQ ID NO: 879061 - RNA, 15 nt, Homo sapiens
cauuugccuaauucc

SEQ ID NO: 879062 - RNA, 12 nt, Homo sapiens
cauuugugucaa

SEQ ID NO: 879063 - RNA, 17 nt, Homo sapiens
cauuuuaacaucugaga

SEQ ID NO: 879064 - RNA, 20 nt, Homo sapiens
cauuuuaagaagacaugaca

SEQ ID NO: 879065 - RNA, 15 nt, Homo sapiens
cauuuuaagaguuac

SEQ ID NO: 879066 - RNA, 15 nt, Homo sapiens
cauuuuauaaauuca

SEQ ID NO: 879067 - RNA, 17 nt, Homo sapiens
cauuuuaugucauuaaa

SEQ ID NO: 879068 - RNA, 13 nt, Homo sapiens
cauuuugcaaaau

SEQ ID NO: 879069 - RNA, 23 nt, Homo sapiens
ccaaaaaaaaauacaugcuaaga

SEQ ID NO: 879070 - RNA, 17 nt, Homo sapiens
ccaaaaaaauacuugag

SEQ ID NO: 879071 - RNA, 20 nt, Homo sapiens
ccaaaaagggauccguacau

SEQ ID NO: 879072 - RNA, 15 nt, Homo sapiens
ccaaaacuaauuucc

SEQ ID NO: 879073 - RNA, 17 nt, Homo sapiens
ccaaaaucguagguguu

SEQ ID NO: 879074 - RNA, 13 nt, Homo sapiens
ccaaaaugcauuu

SEQ ID NO: 879075 - RNA, 13 nt, Homo sapiens
ccaaaauguuaau

SEQ ID NO: 879076 - RNA, 17 nt, Homo sapiens
ccaaacacacuguaaau

SEQ ID NO: 879077 - RNA, 14 nt, Homo sapiens
ccaaaccgcaggca

SEQ ID NO: 879078 - RNA, 22 nt, Homo sapiens
ccaaaccgcaggcaaacggguc

SEQ ID NO: 879079 - RNA, 17 nt, Homo sapiens
ccaaacuugacaguaaa

SEQ ID NO: 879080 - RNA, 16 nt, Homo sapiens
ccaaagacuacacugu

SEQ ID NO: 879081 - RNA, 23 nt, Homo sapiens
ccaaagagacuggagcaucugac

SEQ ID NO: 879082 - RNA, 15 nt, Homo sapiens
ccaaagccaccaaga

SEQ ID NO: 879083 - RNA, 22 nt, Homo sapiens
ccaaagccaccaagacaggcuc

SEQ ID NO: 879084 - RNA, 20 nt, Homo sapiens
ccaaagggaaaacucuucau

SEQ ID NO: 879085 - RNA, 14 nt, Homo sapiens
ccaaaguaaauguc

SEQ ID NO: 879086 - RNA, 20 nt, Homo sapiens
ccaaaguaaauguccugcua

SEQ ID NO: 879087 - RNA, 16 nt, Homo sapiens
ccaaauaaauguguaa

SEQ ID NO: 879088 - RNA, 21 nt, Homo sapiens
ccaaauaaggauuuguucaca

SEQ ID NO: 879089 - RNA, 22 nt, Homo sapiens
ccaaaucuuaauucaacuagua

SEQ ID NO: 879090 - RNA, 21 nt, Homo sapiens
ccaaauuaaguauguuugaau

SEQ ID NO: 879091 - RNA, 14 nt, Homo sapiens
ccaaauuacgugua

SEQ ID NO: 879092 - RNA, 12 nt, Homo sapiens
ccaaauucccug

SEQ ID NO: 879093 - RNA, 19 nt, Homo sapiens
ccaaauuucauaccuauca

SEQ ID NO: 879094 - RNA, 18 nt, Homo sapiens
ccaacaacuccaggaaaa

SEQ ID NO: 879095 - RNA, 14 nt, Homo sapiens
ccaacaccaccucu

SEQ ID NO: 879096 - RNA, 15 nt, Homo sapiens
ccaacacccugucua

SEQ ID NO: 879097 - RNA, 16 nt, Homo sapiens
ccaacagcuuuuccca

SEQ ID NO: 879098 - RNA, 22 nt, Homo sapiens
ccaacaggcuguucugcacuga

SEQ ID NO: 879099 - RNA, 11 nt, Homo sapiens
ccaacaugacu

SEQ ID NO: 879100 - RNA, 14 nt, Homo sapiens
ccaaccuccugacc

SEQ ID NO: 879101 - RNA, 18 nt, Homo sapiens
ccaacuauuaaagugcca

SEQ ID NO: 879102 - RNA, 12 nt, Homo sapiens
ccaacucuagcc

SEQ ID NO: 879103 - RNA, 14 nt, Homo sapiens
ccaacugcucugcc

SEQ ID NO: 879104 - RNA, 23 nt, Homo sapiens
ccaacugcuguucauguuacuca

SEQ ID NO: 879105 - RNA, 23 nt, Homo sapiens
ccaacuuguaaauacaccaccuc

SEQ ID NO: 879106 - RNA, 13 nt, Homo sapiens
ccaagaaggugag

SEQ ID NO: 879107 - RNA, 22 nt, Homo sapiens
ggcaagggcaacccaccaucua

SEQ ID NO: 879108 - RNA, 15 nt, Homo sapiens
ggcaagggguuucca

SEQ ID NO: 879109 - RNA, 13 nt, Homo sapiens
ggcaagugauauc

SEQ ID NO: 879110 - RNA, 18 nt, Homo sapiens
ggcaauccagacagcagg

SEQ ID NO: 879111 - RNA, 18 nt, Homo sapiens
ggcaauuguccccaggga

SEQ ID NO: 879112 - RNA, 20 nt, Homo sapiens
ggcacaaauuguacauuuga

SEQ ID NO: 879113 - RNA, 20 nt, Homo sapiens
ggcacacaaugcuauugaaa

SEQ ID NO: 879114 - RNA, 19 nt, Homo sapiens
ggcacccggccccugcugg

SEQ ID NO: 879115 - RNA, 15 nt, Homo sapiens
ggcaccgagaacucg

SEQ ID NO: 879116 - RNA, 14 nt, Homo sapiens
ggcacgguggcuca

SEQ ID NO: 879117 - RNA, 16 nt, Homo sapiens
ggcacgucccaugugc

SEQ ID NO: 879118 - RNA, 19 nt, Homo sapiens
ggcacucagaagacacuga

SEQ ID NO: 879119 - RNA, 11 nt, Homo sapiens
ggcacuggguc

SEQ ID NO: 879120 - RNA, 22 nt, Homo sapiens
ggcagaagaauugaacccagga

SEQ ID NO: 879121 - RNA, 21 nt, Homo sapiens
ggcagagaagccccuaggcaa

SEQ ID NO: 879122 - RNA, 20 nt, Homo sapiens
ggcagagccaccagggcacu

SEQ ID NO: 879123 - RNA, 13 nt, Homo sapiens
ggcagcagcucag

SEQ ID NO: 879124 - RNA, 14 nt, Homo sapiens
ggcagguuugccag

SEQ ID NO: 879125 - RNA, 21 nt, Homo sapiens
ggcaguagacuauaagcagaa

SEQ ID NO: 879126 - RNA, 16 nt, Homo sapiens
ggcagucauacugggg

SEQ ID NO: 879127 - RNA, 15 nt, Homo sapiens
ggcaguccagccagc

SEQ ID NO: 879128 - RNA, 20 nt, Homo sapiens
ggcagugccuccugggacca

SEQ ID NO: 879129 - RNA, 23 nt, Homo sapiens
ggcauagcauuagcugcuuccuc

SEQ ID NO: 879130 - RNA, 16 nt, Homo sapiens
ggcauccacccagugc

SEQ ID NO: 879131 - RNA, 13 nt, Homo sapiens
ggcauccugugug

SEQ ID NO: 879132 - RNA, 15 nt, Homo sapiens
ggcaucugacaugca

SEQ ID NO: 879133 - RNA, 14 nt, Homo sapiens
ggcaugcaccagug

SEQ ID NO: 879134 - RNA, 19 nt, Homo sapiens
ggcaugccuuucuguaacc

SEQ ID NO: 879135 - RNA, 15 nt, Homo sapiens
ggcauggcuggggug

SEQ ID NO: 879136 - RNA, 16 nt, Homo sapiens
ggcauucacaucucau

SEQ ID NO: 879137 - RNA, 11 nt, Homo sapiens
ggcauuugccu

SEQ ID NO: 879138 - RNA, 18 nt, Homo sapiens
ggccaagcaccuagccuc

SEQ ID NO: 879139 - RNA, 15 nt, Homo sapiens
ggccaagcugaggug

SEQ ID NO: 879140 - RNA, 15 nt, Homo sapiens
ggccaaguuccucua

SEQ ID NO: 879141 - RNA, 17 nt, Homo sapiens
ggccagcugcaucuacu

SEQ ID NO: 879142 - RNA, 17 nt, Homo sapiens
ggccaggcuggucucaa

SEQ ID NO: 879143 - RNA, 16 nt, Homo sapiens
ggccagguuaugccuc

SEQ ID NO: 879144 - RNA, 20 nt, Homo sapiens
ggccauccauucacagccag

SEQ ID NO: 879145 - RNA, 18 nt, Homo sapiens
ggccaugcuucuugcccc

SEQ ID NO: 879146 - RNA, 21 nt, Homo sapiens
ggccauggaauaaaccauuuu

SEQ ID NO: 879147 - RNA, 15 nt, Homo sapiens
ggccccagaacacag

SEQ ID NO: 879148 - RNA, 15 nt, Homo sapiens
ggcccccacaggccc

SEQ ID NO: 879149 - RNA, 15 nt, Homo sapiens
ggcccucuucuuauu

SEQ ID NO: 879150 - RNA, 18 nt, Homo sapiens
ggcccuggaugugcccac

SEQ ID NO: 879151 - RNA, 15 nt, Homo sapiens
ggccgaguaccuuaa

SEQ ID NO: 879152 - RNA, 20 nt, Homo sapiens
ggccuagggguccacgggaa

SEQ ID NO: 879153 - RNA, 14 nt, Homo sapiens
gaaagaaaugccca

SEQ ID NO: 879154 - RNA, 18 nt, Homo sapiens
gaaagaaucagucuugca

SEQ ID NO: 879155 - RNA, 23 nt, Homo sapiens
gaaagaauuauuuuuguguuucu

SEQ ID NO: 879156 - RNA, 15 nt, Homo sapiens
gaaagaggcagugau

SEQ ID NO: 879157 - RNA, 17 nt, Homo sapiens
gaaagcaaucugagaga

SEQ ID NO: 879158 - RNA, 18 nt, Homo sapiens
gaaagcaccgcagcaugu

SEQ ID NO: 879159 - RNA, 18 nt, Homo sapiens
gaaagcaucaccucaggc

SEQ ID NO: 879160 - RNA, 23 nt, Homo sapiens
gaaagcaucauuauuugcagaga

SEQ ID NO: 879161 - RNA, 18 nt, Homo sapiens
gaaagcccgccucugucc

SEQ ID NO: 879162 - RNA, 20 nt, Homo sapiens
gaaagcuuaggcugcuuauu

SEQ ID NO: 879163 - RNA, 23 nt, Homo sapiens
gaaaggaccuuaccuguguuuca

SEQ ID NO: 879164 - RNA, 22 nt, Homo sapiens
gaaaggagaacuauccaaaacu

SEQ ID NO: 879165 - RNA, 18 nt, Homo sapiens
gaaaggagccggaccaag

SEQ ID NO: 879166 - RNA, 22 nt, Homo sapiens
gaaaguaaauauuucaggcaua

SEQ ID NO: 879167 - RNA, 17 nt, Homo sapiens
gaaaguauaaagucacu

SEQ ID NO: 879168 - RNA, 14 nt, Homo sapiens
gaaaguaugugaua

SEQ ID NO: 879169 - RNA, 16 nt, Homo sapiens
gaaagugacuaccaga

SEQ ID NO: 879170 - RNA, 21 nt, Homo sapiens
gaaagugcaaagugcccucau

SEQ ID NO: 879171 - RNA, 16 nt, Homo sapiens
gaaaguucagccagaa

SEQ ID NO: 879172 - RNA, 15 nt, Homo sapiens
gaaaguuugcacugu

SEQ ID NO: 879173 - RNA, 17 nt, Homo sapiens
gaaauaaaaagcaugac

SEQ ID NO: 879174 - RNA, 15 nt, Homo sapiens
gaaauaaaaauaccu

SEQ ID NO: 879175 - RNA, 13 nt, Homo sapiens
gaaauaaaagccu

SEQ ID NO: 879176 - RNA, 16 nt, Homo sapiens
gaaauaaaccuggaga

SEQ ID NO: 879177 - RNA, 18 nt, Homo sapiens
gaaauaaaguuggugaca

SEQ ID NO: 879178 - RNA, 16 nt, Homo sapiens
gaaauaaaugauguac

SEQ ID NO: 879179 - RNA, 19 nt, Homo sapiens
gaaauaaguuuuuguuuca

SEQ ID NO: 879180 - RNA, 23 nt, Homo sapiens
gaaauaauuguugauuaauuuga

SEQ ID NO: 879181 - RNA, 22 nt, Homo sapiens
gaaauaccagugaaccaaagag

SEQ ID NO: 879182 - RNA, 15 nt, Homo sapiens
gaaauauaaugcaaa

SEQ ID NO: 879183 - RNA, 19 nt, Homo sapiens
gaaauauccagaacauacu

SEQ ID NO: 879184 - RNA, 17 nt, Homo sapiens
gaaauauuuaaguauau

SEQ ID NO: 879185 - RNA, 15 nt, Homo sapiens
gaaaucgaugagaaa

SEQ ID NO: 879186 - RNA, 12 nt, Homo sapiens
gaaaucuugcaa

SEQ ID NO: 879187 - RNA, 21 nt, Homo sapiens
gaaaugaaacaaauaaucaca

SEQ ID NO: 879188 - RNA, 13 nt, Homo sapiens
gaaaugagcgaaa

SEQ ID NO: 879189 - RNA, 17 nt, Homo sapiens
gaaaugauaaagauguc

SEQ ID NO: 879190 - RNA, 15 nt, Homo sapiens
gaaauggagaagcuc

SEQ ID NO: 879191 - RNA, 21 nt, Homo sapiens
gaaaugggagaagagagacag

SEQ ID NO: 879192 - RNA, 21 nt, Homo sapiens
gaaaugggcuuuaacaaaaca

SEQ ID NO: 879193 - RNA, 15 nt, Homo sapiens
gaaauguauccugau

SEQ ID NO: 879194 - RNA, 16 nt, Homo sapiens
gaaaugugucuugucu

SEQ ID NO: 879195 - RNA, 20 nt, Homo sapiens
gaaauucaaccugugucuua

SEQ ID NO: 879196 - RNA, 15 nt, Homo sapiens
gaaauugaaccuggu

SEQ ID NO: 879197 - RNA, 20 nt, Homo sapiens
gaaauuugacucaugaacua

SEQ ID NO: 879198 - RNA, 22 nt, Homo sapiens
gaacaaacuaugaucacaguga

SEQ ID NO: 879199 - RNA, 14 nt, Homo sapiens
gaacacaaggucau

SEQ ID NO: 879200 - RNA, 13 nt, Homo sapiens
gaacacagugccu

SEQ ID NO: 879201 - RNA, 21 nt, Homo sapiens
gaacacaguuuagugcuuuac

SEQ ID NO: 879202 - RNA, 17 nt, Homo sapiens
gaacacgaauugcucaa

SEQ ID NO: 879203 - RNA, 21 nt, Homo sapiens
gaacacuggcaacaacaaagc

SEQ ID NO: 879204 - RNA, 19 nt, Homo sapiens
gaacagaaggaugaaugag

SEQ ID NO: 879205 - RNA, 20 nt, Homo sapiens
gaacagacaacagaagucau

SEQ ID NO: 879206 - RNA, 20 nt, Homo sapiens
gaacagucacccuucugggc

SEQ ID NO: 879207 - RNA, 19 nt, Homo sapiens
gaacaguuuuuaagcuaua

SEQ ID NO: 879208 - RNA, 15 nt, Homo sapiens
gaacauucgaggugu

SEQ ID NO: 879209 - RNA, 17 nt, Homo sapiens
gaacauugucuggauac

SEQ ID NO: 879210 - RNA, 17 nt, Homo sapiens
gaaccaagaagggcuag

SEQ ID NO: 879211 - RNA, 18 nt, Homo sapiens
gaaccaaggcagccucca

SEQ ID NO: 879212 - RNA, 12 nt, Homo sapiens
gaaccacuuugc

SEQ ID NO: 879213 - RNA, 15 nt, Homo sapiens
gaaccauccuuccca

SEQ ID NO: 879214 - RNA, 14 nt, Homo sapiens
gaaccaugaagcug

SEQ ID NO: 879215 - RNA, 17 nt, Homo sapiens
gaaccaugguaugaagg

SEQ ID NO: 879216 - RNA, 21 nt, Homo sapiens
gaaccgagcaauuuucugcua

SEQ ID NO: 879217 - RNA, 14 nt, Homo sapiens
caaaugacccaaag

SEQ ID NO: 879218 - RNA, 15 nt, Homo sapiens
caaaugacccaaaga

SEQ ID NO: 879219 - RNA, 16 nt, Homo sapiens
caaaugaggauaucau

SEQ ID NO: 879220 - RNA, 16 nt, Homo sapiens
caaaugcacaucucau

SEQ ID NO: 879221 - RNA, 21 nt, Homo sapiens
caaaugccuccaagccauuca

SEQ ID NO: 879222 - RNA, 16 nt, Homo sapiens
caaaugcuauauugca

SEQ ID NO: 879223 - RNA, 20 nt, Homo sapiens
caaaugcuguagaaugcuug

SEQ ID NO: 879224 - RNA, 23 nt, Homo sapiens
caaauguaaaauaaguauuucca

SEQ ID NO: 879225 - RNA, 20 nt, Homo sapiens
caaauuagaaacaccauuca

SEQ ID NO: 879226 - RNA, 17 nt, Homo sapiens
caaauucuuuuucacac

SEQ ID NO: 879227 - RNA, 17 nt, Homo sapiens
caacaaacaaaacgcaa

SEQ ID NO: 879228 - RNA, 23 nt, Homo sapiens
caacaaauuagguuuuguacaau

SEQ ID NO: 879229 - RNA, 15 nt, Homo sapiens
caacaaccaugccag

SEQ ID NO: 879230 - RNA, 14 nt, Homo sapiens
caacaaguugccuc

SEQ ID NO: 879231 - RNA, 17 nt, Homo sapiens
caacaauaaagacugag

SEQ ID NO: 879232 - RNA, 19 nt, Homo sapiens
caacacauuacuugcacaa

SEQ ID NO: 879233 - RNA, 17 nt, Homo sapiens
caacacccaaagcaugg

SEQ ID NO: 879234 - RNA, 23 nt, Homo sapiens
caacaccuucuuggcuucuggga

SEQ ID NO: 879235 - RNA, 23 nt, Homo sapiens
caacacgagcaggcuacugucag

SEQ ID NO: 879236 - RNA, 19 nt, Homo sapiens
caacacuucucacaucuua

SEQ ID NO: 879237 - RNA, 22 nt, Homo sapiens
caacagauggauagucugucca

SEQ ID NO: 879238 - RNA, 16 nt, Homo sapiens
caacagauuauuaccu

SEQ ID NO: 879239 - RNA, 20 nt, Homo sapiens
caacagccugacaacauuuc

SEQ ID NO: 879240 - RNA, 18 nt, Homo sapiens
caacaguuuuuuaugcua

SEQ ID NO: 879241 - RNA, 15 nt, Homo sapiens
caacauaacugaagg

SEQ ID NO: 879242 - RNA, 20 nt, Homo sapiens
caacauaacugaaggcauau

SEQ ID NO: 879243 - RNA, 16 nt, Homo sapiens
caacaucucgagcccc

SEQ ID NO: 879244 - RNA, 21 nt, Homo sapiens
caacaugguaaaaccccaucu

SEQ ID NO: 879245 - RNA, 21 nt, Homo sapiens
caacauggugaaaccucaucu

SEQ ID NO: 879246 - RNA, 21 nt, Homo sapiens
caacauuacuccauuacuaaa

SEQ ID NO: 879247 - RNA, 13 nt, Homo sapiens
caacauucuuugc

SEQ ID NO: 879248 - RNA, 16 nt, Homo sapiens
caacauuuaaugagca

SEQ ID NO: 879249 - RNA, 13 nt, Homo sapiens
caaccaaccacaa

SEQ ID NO: 879250 - RNA, 21 nt, Homo sapiens
caaccacuguaaaaugaaauu

SEQ ID NO: 879251 - RNA, 12 nt, Homo sapiens
caaccacugugg

SEQ ID NO: 879252 - RNA, 14 nt, Homo sapiens
caaccauaugaauu

SEQ ID NO: 879253 - RNA, 13 nt, Homo sapiens
caacccaccaucu

SEQ ID NO: 879254 - RNA, 14 nt, Homo sapiens
caacccaccaucua

SEQ ID NO: 879255 - RNA, 21 nt, Homo sapiens
caacccccgacuucaucccaa

SEQ ID NO: 879256 - RNA, 15 nt, Homo sapiens
caaccccugcuuccc

SEQ ID NO: 879257 - RNA, 23 nt, Homo sapiens
caaccuccccgcagagcucccuu

SEQ ID NO: 879258 - RNA, 19 nt, Homo sapiens
caaccugaucccacgaggg

SEQ ID NO: 879259 - RNA, 20 nt, Homo sapiens
caaccugcucuccucuugcc

SEQ ID NO: 879260 - RNA, 21 nt, Homo sapiens
caaccugcucuccucuugcca

SEQ ID NO: 879261 - RNA, 23 nt, Homo sapiens
caaccuguuuuggucacaucacu

SEQ ID NO: 879262 - RNA, 15 nt, Homo sapiens
caacgagagcacuug

SEQ ID NO: 879263 - RNA, 21 nt, Homo sapiens
caacuaggaccucauaucuuc

SEQ ID NO: 879264 - RNA, 17 nt, Homo sapiens
caacuccuccuugccug

SEQ ID NO: 879265 - RNA, 20 nt, Homo sapiens
caacuccugguucagccauu

SEQ ID NO: 879266 - RNA, 15 nt, Homo sapiens
caacucgaugggcac

SEQ ID NO: 879267 - RNA, 19 nt, Homo sapiens
gacagagugagacucuguc

SEQ ID NO: 879268 - RNA, 15 nt, Homo sapiens
gacagaucauuucag

SEQ ID NO: 879269 - RNA, 22 nt, Homo sapiens
gacagcuuguggcaagugaauu

SEQ ID NO: 879270 - RNA, 18 nt, Homo sapiens
gacaggagacccagagag

SEQ ID NO: 879271 - RNA, 23 nt, Homo sapiens
gacaggcccaagagaugaagagu

SEQ ID NO: 879272 - RNA, 19 nt, Homo sapiens
gacagggccuagcuuucau

SEQ ID NO: 879273 - RNA, 12 nt, Homo sapiens
gacaggugaaug

SEQ ID NO: 879274 - RNA, 18 nt, Homo sapiens
gacaguagccaaguuaua

SEQ ID NO: 879275 - RNA, 22 nt, Homo sapiens
gacauccaggaggaauaagcuc

SEQ ID NO: 879276 - RNA, 19 nt, Homo sapiens
gacaucuccucuaucacau

SEQ ID NO: 879277 - RNA, 14 nt, Homo sapiens
gacaugcacugacc

SEQ ID NO: 879278 - RNA, 21 nt, Homo sapiens
gacaugcagcucugaugagag

SEQ ID NO: 879279 - RNA, 19 nt, Homo sapiens
gacaugccacccucuccau

SEQ ID NO: 879280 - RNA, 20 nt, Homo sapiens
gacauggauuugaugaaagu

SEQ ID NO: 879281 - RNA, 19 nt, Homo sapiens
gacauggguagcaauucua

SEQ ID NO: 879282 - RNA, 16 nt, Homo sapiens
gacauuaaaccuggau

SEQ ID NO: 879283 - RNA, 16 nt, Homo sapiens
gacauucaaggcauuu

SEQ ID NO: 879284 - RNA, 14 nt, Homo sapiens
gacauugccuccac

SEQ ID NO: 879285 - RNA, 18 nt, Homo sapiens
gacauugcggacagccac

SEQ ID NO: 879286 - RNA, 16 nt, Homo sapiens
gacauuguuggccaaa

SEQ ID NO: 879287 - RNA, 14 nt, Homo sapiens
gaccaauaccuccu

SEQ ID NO: 879288 - RNA, 13 nt, Homo sapiens
gaccaauacuacu

SEQ ID NO: 879289 - RNA, 22 nt, Homo sapiens
gaccacacgcugucucuugaga

SEQ ID NO: 879290 - RNA, 18 nt, Homo sapiens
gaccacaggugccuacca

SEQ ID NO: 879291 - RNA, 17 nt, Homo sapiens
gaccacauguguucucu

SEQ ID NO: 879292 - RNA, 17 nt, Homo sapiens
gaccaccugccagccau

SEQ ID NO: 879293 - RNA, 24 nt, Homo sapiens
gaccacugggcaaugauggcaauu

SEQ ID NO: 879294 - RNA, 11 nt, Homo sapiens
gaccacugucc

SEQ ID NO: 879295 - RNA, 17 nt, Homo sapiens
gaccacuguuaucaaaa

SEQ ID NO: 879296 - RNA, 14 nt, Homo sapiens
gaccaggcaccagg

SEQ ID NO: 879297 - RNA, 15 nt, Homo sapiens
gaccaguacugggaa

SEQ ID NO: 879298 - RNA, 23 nt, Homo sapiens
gaccagugaaagaguagugcauu

SEQ ID NO: 879299 - RNA, 16 nt, Homo sapiens
gaccaucgcaaccagg

SEQ ID NO: 879300 - RNA, 20 nt, Homo sapiens
gacccaaagaccaauauuca

SEQ ID NO: 879301 - RNA, 14 nt, Homo sapiens
gacccacccagugu

SEQ ID NO: 879302 - RNA, 16 nt, Homo sapiens
gacccagggaugacau

SEQ ID NO: 879303 - RNA, 23 nt, Homo sapiens
gaccccagcuucauuaugcagcu

SEQ ID NO: 879304 - RNA, 13 nt, Homo sapiens
gaccccaucucau

SEQ ID NO: 879305 - RNA, 13 nt, Homo sapiens
gaccccaucucuu

SEQ ID NO: 879306 - RNA, 17 nt, Homo sapiens
gaccccgcccagcauug

SEQ ID NO: 879307 - RNA, 17 nt, Homo sapiens
gacccgcucuggaccaa

SEQ ID NO: 879308 - RNA, 21 nt, Homo sapiens
gacccuacuucuuuugcucuu

SEQ ID NO: 879309 - RNA, 23 nt, Homo sapiens
gacccuccuggggcucucagugu

SEQ ID NO: 879310 - RNA, 12 nt, Homo sapiens
gaccgugcagcu

SEQ ID NO: 879311 - RNA, 18 nt, Homo sapiens
gaccguuuuuacuaagua

SEQ ID NO: 879312 - RNA, 16 nt, Homo sapiens
gaccucauaucuuccu

SEQ ID NO: 879313 - RNA, 19 nt, Homo sapiens
gaccuccagcuuuccugua

SEQ ID NO: 879314 - RNA, 19 nt, Homo sapiens
gaccuccuccugcccuccc

SEQ ID NO: 879315 - RNA, 14 nt, Homo sapiens
gaccugagaaccuu

SEQ ID NO: 879316 - RNA, 19 nt, Homo sapiens
gaccugccucucacacaca

SEQ ID NO: 879317 - RNA, 17 nt, Homo sapiens
gaccuucaacuuccaaa

SEQ ID NO: 879318 - RNA, 19 nt, Homo sapiens
gaccuuccugccaccaguc

SEQ ID NO: 879319 - RNA, 18 nt, Homo sapiens
gaccuugaaggguaaaga

SEQ ID NO: 879320 - RNA, 20 nt, Homo sapiens
gaccuuggagagacacagcg

SEQ ID NO: 879321 - RNA, 16 nt, Homo sapiens
gaccuuguagcuauau

SEQ ID NO: 879322 - RNA, 17 nt, Homo sapiens
gaccuuucagcugugaa

SEQ ID NO: 879323 - RNA, 17 nt, Homo sapiens
gaccuuucugagugaca

SEQ ID NO: 879324 - RNA, 18 nt, Homo sapiens
gaccuuucugagugacau

SEQ ID NO: 879325 - RNA, 18 nt, Homo sapiens
gacgaacaggggccaaac

SEQ ID NO: 879326 - RNA, 20 nt, Homo sapiens
gacgcaacuuaagcugggau

SEQ ID NO: 879327 - RNA, 22 nt, Homo sapiens
gacgccacucauuucaucucau

SEQ ID NO: 879328 - RNA, 17 nt, Homo sapiens
gacgcccugcucuggau

SEQ ID NO: 879329 - RNA, 14 nt, Homo sapiens
gacggccacucugu

SEQ ID NO: 879330 - RNA, 16 nt, Homo sapiens
gacggccacucuguug

SEQ ID NO: 879331 - RNA, 21 nt, Homo sapiens
gacgguuucaaaccaggauuu

SEQ ID NO: 879332 - RNA, 15 nt, Homo sapiens
cacacggaugcacag

SEQ ID NO: 879333 - RNA, 14 nt, Homo sapiens
cacacguacuuaaa

SEQ ID NO: 879334 - RNA, 15 nt, Homo sapiens
cacacuggugacugc

SEQ ID NO: 879335 - RNA, 21 nt, Homo sapiens
cacacuguagcauuacagugg

SEQ ID NO: 879336 - RNA, 18 nt, Homo sapiens
cacacugugcguuuuaga

SEQ ID NO: 879337 - RNA, 22 nt, Homo sapiens
cacagacccacacauguuuaca

SEQ ID NO: 879338 - RNA, 13 nt, Homo sapiens
cacagacucccuc

SEQ ID NO: 879339 - RNA, 18 nt, Homo sapiens
cacagagauaugcacaca

SEQ ID NO: 879340 - RNA, 19 nt, Homo sapiens
cacagauauacacauggau

SEQ ID NO: 879341 - RNA, 13 nt, Homo sapiens
cacagauaugcac

SEQ ID NO: 879342 - RNA, 13 nt, Homo sapiens
cacagaugcacac

SEQ ID NO: 879343 - RNA, 19 nt, Homo sapiens
cacagaugcacacacagau

SEQ ID NO: 879344 - RNA, 21 nt, Homo sapiens
cacagcaagggugaugggaaa

SEQ ID NO: 879345 - RNA, 16 nt, Homo sapiens
cacagcacuaauucaa

SEQ ID NO: 879346 - RNA, 16 nt, Homo sapiens
cacagcacucucuaaa

SEQ ID NO: 879347 - RNA, 17 nt, Homo sapiens
cacagcccgggugugcc

SEQ ID NO: 879348 - RNA, 18 nt, Homo sapiens
cacagccuggcuauacag

SEQ ID NO: 879349 - RNA, 23 nt, Homo sapiens
cacagcgucccuagcagugaacu

SEQ ID NO: 879350 - RNA, 21 nt, Homo sapiens
cacagcuaaaauaauagauaa

SEQ ID NO: 879351 - RNA, 14 nt, Homo sapiens
cacagcuaugaagg

SEQ ID NO: 879352 - RNA, 22 nt, Homo sapiens
cacagcuucugcagcagacugu

SEQ ID NO: 879353 - RNA, 19 nt, Homo sapiens
cacaggcaucuacacagcc

SEQ ID NO: 879354 - RNA, 14 nt, Homo sapiens
cacaggcccggcuc

SEQ ID NO: 879355 - RNA, 13 nt, Homo sapiens
cacaggggcccca

SEQ ID NO: 879356 - RNA, 13 nt, Homo sapiens
cacagguguaaau

SEQ ID NO: 879357 - RNA, 16 nt, Homo sapiens
cacagguuuucagcaa

SEQ ID NO: 879358 - RNA, 13 nt, Homo sapiens
cacagucauucac

SEQ ID NO: 879359 - RNA, 18 nt, Homo sapiens
cacagugggugaggagau

SEQ ID NO: 879360 - RNA, 18 nt, Homo sapiens
cacaguuagguagcuuua

SEQ ID NO: 879361 - RNA, 15 nt, Homo sapiens
cacaguugccaugua

SEQ ID NO: 879362 - RNA, 15 nt, Homo sapiens
cacaguuuugccuua

SEQ ID NO: 879363 - RNA, 19 nt, Homo sapiens
cacauaacuucucugaguc

SEQ ID NO: 879364 - RNA, 21 nt, Homo sapiens
cacauacugcaugcucaggac

SEQ ID NO: 879365 - RNA, 19 nt, Homo sapiens
cacauagaagcuguccuug

SEQ ID NO: 879366 - RNA, 24 nt, Homo sapiens
cacauagagauaugcacacacaga

SEQ ID NO: 879367 - RNA, 19 nt, Homo sapiens
cacauagauuaauggcacu

SEQ ID NO: 879368 - RNA, 13 nt, Homo sapiens
cacauaugcaccu

SEQ ID NO: 879369 - RNA, 13 nt, Homo sapiens
cacauauucacau

SEQ ID NO: 879370 - RNA, 22 nt, Homo sapiens
cacaucagcuuuaggacugaca

SEQ ID NO: 879371 - RNA, 20 nt, Homo sapiens
cacauccaccccacuggauc

SEQ ID NO: 879372 - RNA, 15 nt, Homo sapiens
cacaucccacugcca

SEQ ID NO: 879373 - RNA, 21 nt, Homo sapiens
cacaucccuaacaucaugcau

SEQ ID NO: 879374 - RNA, 15 nt, Homo sapiens
cacaucccuuugaaa

SEQ ID NO: 879375 - RNA, 12 nt, Homo sapiens
cacaucugggag

SEQ ID NO: 879376 - RNA, 14 nt, Homo sapiens
cacaucuugcucug

SEQ ID NO: 879377 - RNA, 21 nt, Homo sapiens
cacaugaaaaccauuaccuga

SEQ ID NO: 879378 - RNA, 14 nt, Homo sapiens
cacaugcacgugug

SEQ ID NO: 879379 - RNA, 15 nt, Homo sapiens
cacaugcagucucag

SEQ ID NO: 879380 - RNA, 14 nt, Homo sapiens
cacauggacacaga

SEQ ID NO: 879381 - RNA, 18 nt, Homo sapiens
cacauggccuaugcacau

SEQ ID NO: 879382 - RNA, 20 nt, Homo sapiens
cacugaggcagguucgugcc

SEQ ID NO: 879383 - RNA, 22 nt, Homo sapiens
cacugaggcauuuuuacuacua

SEQ ID NO: 879384 - RNA, 20 nt, Homo sapiens
cacugcacagugcaucucag

SEQ ID NO: 879385 - RNA, 13 nt, Homo sapiens
cacugcacuccag

SEQ ID NO: 879386 - RNA, 19 nt, Homo sapiens
cacugcaggggccgagcca

SEQ ID NO: 879387 - RNA, 17 nt, Homo sapiens
cacugccagcagcuguu

SEQ ID NO: 879388 - RNA, 14 nt, Homo sapiens
cacugccaugccuc

SEQ ID NO: 879389 - RNA, 19 nt, Homo sapiens
cacugccggcccagugaca

SEQ ID NO: 879390 - RNA, 12 nt, Homo sapiens
cacugccuucac

SEQ ID NO: 879391 - RNA, 23 nt, Homo sapiens
cacugcugcagacaccugccuua

SEQ ID NO: 879392 - RNA, 22 nt, Homo sapiens
cacuggaucuucagaaggcuag

SEQ ID NO: 879393 - RNA, 21 nt, Homo sapiens
cacuggcauuaaagugcugua

SEQ ID NO: 879394 - RNA, 22 nt, Homo sapiens
cacugggaugagccgcugugag

SEQ ID NO: 879395 - RNA, 18 nt, Homo sapiens
cacugggccuccaaccau

SEQ ID NO: 879396 - RNA, 18 nt, Homo sapiens
cacuguaaauauccacag

SEQ ID NO: 879397 - RNA, 20 nt, Homo sapiens
cacuguacaagguaccccuu

SEQ ID NO: 879398 - RNA, 16 nt, Homo sapiens
cacugucacccuccac

SEQ ID NO: 879399 - RNA, 15 nt, Homo sapiens
cacugugaaaccacu

SEQ ID NO: 879400 - RNA, 15 nt, Homo sapiens
cacugugaagacaau

SEQ ID NO: 879401 - RNA, 17 nt, Homo sapiens
cacugugcuuacaguga

SEQ ID NO: 879402 - RNA, 10 nt, Homo sapiens
cacuguguaa

SEQ ID NO: 879403 - RNA, 16 nt, Homo sapiens
cacuguguaaccaggu

SEQ ID NO: 879404 - RNA, 22 nt, Homo sapiens
cacuguuuaacugggagugaua

SEQ ID NO: 879405 - RNA, 14 nt, Homo sapiens
cacuguuucucuca

SEQ ID NO: 879406 - RNA, 18 nt, Homo sapiens
cacuuaaaaaauguccau

SEQ ID NO: 879407 - RNA, 20 nt, Homo sapiens
cacuuaaaaaauguccauga

SEQ ID NO: 879408 - RNA, 16 nt, Homo sapiens
cacuuaauaauugcau

SEQ ID NO: 879409 - RNA, 21 nt, Homo sapiens
cacuuagcaggaaguacucau

SEQ ID NO: 879410 - RNA, 24 nt, Homo sapiens
cacuucauugaccaagaugaucac

SEQ ID NO: 879411 - RNA, 12 nt, Homo sapiens
cacuuccagugu

SEQ ID NO: 879412 - RNA, 19 nt, Homo sapiens
cacuucuaaaugaagugca

SEQ ID NO: 879413 - RNA, 13 nt, Homo sapiens
cacuucuaugcaa

SEQ ID NO: 879414 - RNA, 17 nt, Homo sapiens
cacuucucacaucuuau

SEQ ID NO: 879415 - RNA, 21 nt, Homo sapiens
cacuucucuagagaacaugcc

SEQ ID NO: 879416 - RNA, 13 nt, Homo sapiens
cacuucugagcuc

SEQ ID NO: 879417 - RNA, 21 nt, Homo sapiens
cacuugcagacucuacagagg

SEQ ID NO: 879418 - RNA, 18 nt, Homo sapiens
cacuuggcugcucauucc

SEQ ID NO: 879419 - RNA, 22 nt, Homo sapiens
cacuuguauauugaaaagauag

SEQ ID NO: 879420 - RNA, 21 nt, Homo sapiens
cacuugugcaguguugacagu

SEQ ID NO: 879421 - RNA, 20 nt, Homo sapiens
cacuuuaccuucagcaguua

SEQ ID NO: 879422 - RNA, 13 nt, Homo sapiens
cacuuucaccagu

SEQ ID NO: 879423 - RNA, 20 nt, Homo sapiens
cacuuugggaggcugaggcg

SEQ ID NO: 879424 - RNA, 20 nt, Homo sapiens
cagaaaaaugggaacaaggc

SEQ ID NO: 879425 - RNA, 17 nt, Homo sapiens
cagaaaacaaaucuuca

SEQ ID NO: 879426 - RNA, 20 nt, Homo sapiens
cagaaaacacagccugugua

SEQ ID NO: 879427 - RNA, 17 nt, Homo sapiens
cagaaaaguagaauuau

SEQ ID NO: 879428 - RNA, 18 nt, Homo sapiens
cagaaacaaaaacacuaa

SEQ ID NO: 879429 - RNA, 20 nt, Homo sapiens
cagaaagaaggacacuugua

SEQ ID NO: 879430 - RNA, 14 nt, Homo sapiens
cagaacacagugcc

SEQ ID NO: 879431 - RNA, 13 nt, Homo sapiens
cagaacacugucu

SEQ ID NO: 879432 - RNA, 21 nt, Homo sapiens
cagaaccagaggguuguacua

SEQ ID NO: 879433 - RNA, 16 nt, Homo sapiens
cagaacuguuguuuac

SEQ ID NO: 879434 - RNA, 20 nt, Homo sapiens
cagaacuuaaggauggagcc

SEQ ID NO: 879435 - RNA, 14 nt, Homo sapiens
cagaagacacugca

SEQ ID NO: 879436 - RNA, 17 nt, Homo sapiens
cagaagcagguucuuga

SEQ ID NO: 879437 - RNA, 21 nt, Homo sapiens
cagaagcagguucuugauguc

SEQ ID NO: 879438 - RNA, 23 nt, Homo sapiens
cagaagcagguucuugaugucau

SEQ ID NO: 879439 - RNA, 23 nt, Homo sapiens
cagaagcauuuuaaauguaguuu

SEQ ID NO: 879440 - RNA, 14 nt, Homo sapiens
cagaagccucugcc

SEQ ID NO: 879441 - RNA, 20 nt, Homo sapiens
cagaagucuugucucaagaa

SEQ ID NO: 879442 - RNA, 21 nt, Homo sapiens
cagaauacaagccacuaccuu

SEQ ID NO: 879443 - RNA, 19 nt, Homo sapiens
cagaauccuacaacuucca

SEQ ID NO: 879444 - RNA, 20 nt, Homo sapiens
cagaaucgcuaauagaacca

SEQ ID NO: 879445 - RNA, 23 nt, Homo sapiens
cagaaucucauagguugccaaua

SEQ ID NO: 879446 - RNA, 19 nt, Homo sapiens
cagaaugcucuacuucuuu

SEQ ID NO: 879447 - RNA, 21 nt, Homo sapiens
gagaucacgccacugcacuau

SEQ ID NO: 879448 - RNA, 21 nt, Homo sapiens
gagaucguuguuuacagugua

SEQ ID NO: 879449 - RNA, 15 nt, Homo sapiens
gagaugcugggccag

SEQ ID NO: 879450 - RNA, 16 nt, Homo sapiens
gagaugcugggccagu

SEQ ID NO: 879451 - RNA, 19 nt, Homo sapiens
gagauggaauaaagcccuu

SEQ ID NO: 879452 - RNA, 13 nt, Homo sapiens
gagauggaguucu

SEQ ID NO: 879453 - RNA, 21 nt, Homo sapiens
gagauggcgcuauugcacucc

SEQ ID NO: 879454 - RNA, 12 nt, Homo sapiens
gagaugucuucu

SEQ ID NO: 879455 - RNA, 21 nt, Homo sapiens
gagauugcaccauugcgcucu

SEQ ID NO: 879456 - RNA, 20 nt, Homo sapiens
gagauugcgccacugcacuc

SEQ ID NO: 879457 - RNA, 21 nt, Homo sapiens
gagauugcgccacugcacucc

SEQ ID NO: 879458 - RNA, 21 nt, Homo sapiens
gagcaaagucuaaaguuuaca

SEQ ID NO: 879459 - RNA, 19 nt, Homo sapiens
gagcaaauaaagaccugag

SEQ ID NO: 879460 - RNA, 18 nt, Homo sapiens
gagcaaauguggcuccug

SEQ ID NO: 879461 - RNA, 23 nt, Homo sapiens
gagcaacaguuaugggacacuga

SEQ ID NO: 879462 - RNA, 14 nt, Homo sapiens
gagcaacucuccac

SEQ ID NO: 879463 - RNA, 22 nt, Homo sapiens
gagcaagacucugucucaaaaa

SEQ ID NO: 879464 - RNA, 15 nt, Homo sapiens
gagcacuggccagag

SEQ ID NO: 879465 - RNA, 18 nt, Homo sapiens
gagcaggcucagacucug

SEQ ID NO: 879466 - RNA, 17 nt, Homo sapiens
gagcaggguuagcucac

SEQ ID NO: 879467 - RNA, 14 nt, Homo sapiens
gagcagugucuucc

SEQ ID NO: 879468 - RNA, 15 nt, Homo sapiens
gagcauuacgugagc

SEQ ID NO: 879469 - RNA, 21 nt, Homo sapiens
gagcauugagacggugcucgc

SEQ ID NO: 879470 - RNA, 19 nt, Homo sapiens
gagccaaacacacuguaaa

SEQ ID NO: 879471 - RNA, 13 nt, Homo sapiens
gagccaaggguuc

SEQ ID NO: 879472 - RNA, 18 nt, Homo sapiens
gagccaccagggcacugu

SEQ ID NO: 879473 - RNA, 16 nt, Homo sapiens
gagccacguauguuuu

SEQ ID NO: 879474 - RNA, 22 nt, Homo sapiens
gagcccaagugccaucccacau

SEQ ID NO: 879475 - RNA, 16 nt, Homo sapiens
gagcccagagggccaa

SEQ ID NO: 879476 - RNA, 21 nt, Homo sapiens
gagcccauuucaauucucaaa

SEQ ID NO: 879477 - RNA, 16 nt, Homo sapiens
gagcccuggcaggaug

SEQ ID NO: 879478 - RNA, 16 nt, Homo sapiens
gagcccugucaguaga

SEQ ID NO: 879479 - RNA, 21 nt, Homo sapiens
gagccgagauugcaccacugc

SEQ ID NO: 879480 - RNA, 19 nt, Homo sapiens
gagccgcaccuugucaugu

SEQ ID NO: 879481 - RNA, 14 nt, Homo sapiens
gagccgcugcugag

SEQ ID NO: 879482 - RNA, 16 nt, Homo sapiens
gagccucgguggccau

SEQ ID NO: 879483 - RNA, 17 nt, Homo sapiens
gagccugacuguguuca

SEQ ID NO: 879484 - RNA, 19 nt, Homo sapiens
gagccuggaagccaaacaa

SEQ ID NO: 879485 - RNA, 22 nt, Homo sapiens
gagccugucuuucagcauucag

SEQ ID NO: 879486 - RNA, 13 nt, Homo sapiens
gagcuagaaccua

SEQ ID NO: 879487 - RNA, 21 nt, Homo sapiens
gagcuaugauccacaaaaaca

SEQ ID NO: 879488 - RNA, 14 nt, Homo sapiens
gagcucagccgugc

SEQ ID NO: 879489 - RNA, 20 nt, Homo sapiens
gagcucuggcuuugcaaggg

SEQ ID NO: 879490 - RNA, 17 nt, Homo sapiens
gagcugcucugcuauau

SEQ ID NO: 879491 - RNA, 23 nt, Homo sapiens
gagcuggcauuggucugcugacc

SEQ ID NO: 879492 - RNA, 16 nt, Homo sapiens
gagcuggcugucuucc

SEQ ID NO: 879493 - RNA, 23 nt, Homo sapiens
gagcugggaguagcauggacucu

SEQ ID NO: 879494 - RNA, 21 nt, Homo sapiens
gagcuguaucuguaauuaaua

SEQ ID NO: 879495 - RNA, 16 nt, Homo sapiens
ggcuguaggugguguu

SEQ ID NO: 879496 - RNA, 17 nt, Homo sapiens
ggcuguccauguauuca

SEQ ID NO: 879497 - RNA, 15 nt, Homo sapiens
ggcugucuuccccca

SEQ ID NO: 879498 - RNA, 23 nt, Homo sapiens
ggcuuaaggagaggagaaacuga

SEQ ID NO: 879499 - RNA, 19 nt, Homo sapiens
ggcuuccagguaucuccag

SEQ ID NO: 879500 - RNA, 22 nt, Homo sapiens
ggcuuccuccagcggcugggug

SEQ ID NO: 879501 - RNA, 17 nt, Homo sapiens
ggcuuccuucauuuccu

SEQ ID NO: 879502 - RNA, 14 nt, Homo sapiens
ggcuucugggagau

SEQ ID NO: 879503 - RNA, 17 nt, Homo sapiens
ggcuucuguccaaggca

SEQ ID NO: 879504 - RNA, 14 nt, Homo sapiens
ggcuucuucuuaua

SEQ ID NO: 879505 - RNA, 19 nt, Homo sapiens
ggcuuguagaccacugucc

SEQ ID NO: 879506 - RNA, 20 nt, Homo sapiens
ggcuuuaugcuaguuugacc

SEQ ID NO: 879507 - RNA, 14 nt, Homo sapiens
ggcuuugggguccu

SEQ ID NO: 879508 - RNA, 18 nt, Homo sapiens
ggcuuuuggcagcaaagu

SEQ ID NO: 879509 - RNA, 19 nt, Homo sapiens
gggaaaguaaauauuucag

SEQ ID NO: 879510 - RNA, 17 nt, Homo sapiens
gggaacaagcauucucc

SEQ ID NO: 879511 - RNA, 22 nt, Homo sapiens
gggaacauguaccacugagccu

SEQ ID NO: 879512 - RNA, 11 nt, Homo sapiens
gggaaccauga

SEQ ID NO: 879513 - RNA, 12 nt, Homo sapiens
gggaagccaaaa

SEQ ID NO: 879514 - RNA, 20 nt, Homo sapiens
gggaagcggagcuugcagug

SEQ ID NO: 879515 - RNA, 21 nt, Homo sapiens
gggacaaaggagccugugaac

SEQ ID NO: 879516 - RNA, 22 nt, Homo sapiens
gggacacguuaggaauguccag

SEQ ID NO: 879517 - RNA, 17 nt, Homo sapiens
gggacacuuacccaagg

SEQ ID NO: 879518 - RNA, 21 nt, Homo sapiens
gggacauuaguaacugcacac

SEQ ID NO: 879519 - RNA, 15 nt, Homo sapiens
gggaccuauaucuca

SEQ ID NO: 879520 - RNA, 13 nt, Homo sapiens
gggaccugugauc

SEQ ID NO: 879521 - RNA, 14 nt, Homo sapiens
gggacuuacaugau

SEQ ID NO: 879522 - RNA, 18 nt, Homo sapiens
gggacuucugucuucaca

SEQ ID NO: 879523 - RNA, 20 nt, Homo sapiens
gggagacggagguugcagug

SEQ ID NO: 879524 - RNA, 17 nt, Homo sapiens
gggagacugcaucucaa

SEQ ID NO: 879525 - RNA, 15 nt, Homo sapiens
gggagaguucuugcu

SEQ ID NO: 879526 - RNA, 22 nt, Homo sapiens
gggaggcggcacauuggcagug

SEQ ID NO: 879527 - RNA, 15 nt, Homo sapiens
gggaggugggguaca

SEQ ID NO: 879528 - RNA, 15 nt, Homo sapiens
gggaguguugucaca

SEQ ID NO: 879529 - RNA, 20 nt, Homo sapiens
gggauaauagacacaucaaa

SEQ ID NO: 879530 - RNA, 15 nt, Homo sapiens
gggaucacuaaggga

SEQ ID NO: 879531 - RNA, 19 nt, Homo sapiens
gggaugagccgcugugagc

SEQ ID NO: 879532 - RNA, 19 nt, Homo sapiens
gggauucuaggaaacccaa

SEQ ID NO: 879533 - RNA, 23 nt, Homo sapiens
gggcaaagaacugccccaucucc

SEQ ID NO: 879534 - RNA, 12 nt, Homo sapiens
gggcaacaaagu

SEQ ID NO: 879535 - RNA, 17 nt, Homo sapiens
gggcaacagagcaagau

SEQ ID NO: 879536 - RNA, 18 nt, Homo sapiens
gggcacugaggaccagcc

SEQ ID NO: 879537 - RNA, 14 nt, Homo sapiens
gggcacugcagggg

SEQ ID NO: 879538 - RNA, 11 nt, Homo sapiens
gggcacugccu

SEQ ID NO: 879539 - RNA, 12 nt, Homo sapiens
gggcacugucug

SEQ ID NO: 879540 - RNA, 18 nt, Homo sapiens
gggcagacaccugugcac

SEQ ID NO: 879541 - RNA, 23 nt, Homo sapiens
gggcagaguuucugcaguuccau

SEQ ID NO: 879542 - RNA, 22 nt, Homo sapiens
gggcaugcuggggcaagucccu

SEQ ID NO: 879543 - RNA, 13 nt, Homo sapiens
gggccagugcugg

SEQ ID NO: 879544 - RNA, 12 nt, Homo sapiens
gggccaguuccu

SEQ ID NO: 879545 - RNA, 23 nt, Homo sapiens
gggccccuuggcgggcagcccag

SEQ ID NO: 879546 - RNA, 13 nt, Homo sapiens
gggccuacugcca

SEQ ID NO: 879547 - RNA, 23 nt, Homo sapiens
gggccugccaaggaugacacugc

SEQ ID NO: 879548 - RNA, 22 nt, Homo sapiens
gggccugcugcgucagaccagu

SEQ ID NO: 879549 - RNA, 15 nt, Homo sapiens
gggccugcugcugag

SEQ ID NO: 879550 - RNA, 16 nt, Homo sapiens
gggccuggcuggcuga

SEQ ID NO: 879551 - RNA, 19 nt, Homo sapiens
gggccuguuacacaugaca

SEQ ID NO: 879552 - RNA, 16 nt, Homo sapiens
gggcugagcccuggca

SEQ ID NO: 879553 - RNA, 13 nt, Homo sapiens
gggcugcagauuu

SEQ ID NO: 879554 - RNA, 15 nt, Homo sapiens
gggcugcccuggugc

SEQ ID NO: 879555 - RNA, 15 nt, Homo sapiens
gggcugcgagcauuu

SEQ ID NO: 879556 - RNA, 19 nt, Homo sapiens
gggcugcgagcauuucccu

SEQ ID NO: 879557 - RNA, 19 nt, Homo sapiens
gggcugugucguagccaag

SEQ ID NO: 879558 - RNA, 16 nt, Homo sapiens
gggcuuuuacaccagu

SEQ ID NO: 879559 - RNA, 17 nt, Homo sapiens
ggggaagaccuuguccc

SEQ ID NO: 879560 - RNA, 19 nt, Homo sapiens
ggggaccaggaugacaccu

SEQ ID NO: 879561 - RNA, 19 nt, Homo sapiens
ggggagcaguaaacuuucu

SEQ ID NO: 879562 - RNA, 19 nt, Homo sapiens
ggggcaagugagacaauca

SEQ ID NO: 879563 - RNA, 21 nt, Homo sapiens
ccgggacuucaaagccgugau

SEQ ID NO: 879564 - RNA, 19 nt, Homo sapiens
ccgggagccucuccuugcc

SEQ ID NO: 879565 - RNA, 17 nt, Homo sapiens
ccgggcaauccagacag

SEQ ID NO: 879566 - RNA, 19 nt, Homo sapiens
ccgggcaauccagacagca

SEQ ID NO: 879567 - RNA, 20 nt, Homo sapiens
ccgggcugggagcucugcag

SEQ ID NO: 879568 - RNA, 16 nt, Homo sapiens
ccggggcgaguggcac

SEQ ID NO: 879569 - RNA, 16 nt, Homo sapiens
ccggggguggugacau

SEQ ID NO: 879570 - RNA, 23 nt, Homo sapiens
ccggguaccgugcaugugcaguc

SEQ ID NO: 879571 - RNA, 15 nt, Homo sapiens
ccggguccccagcuc

SEQ ID NO: 879572 - RNA, 12 nt, Homo sapiens
ccguaacaacug

SEQ ID NO: 879573 - RNA, 14 nt, Homo sapiens
ccgucccucaguga

SEQ ID NO: 879574 - RNA, 11 nt, Homo sapiens
ccgucuucucc

SEQ ID NO: 879575 - RNA, 14 nt, Homo sapiens
ccgucuuuguauca

SEQ ID NO: 879576 - RNA, 12 nt, Homo sapiens
ccgugacagggc

SEQ ID NO: 879577 - RNA, 14 nt, Homo sapiens
ccgugcacucccua

SEQ ID NO: 879578 - RNA, 15 nt, Homo sapiens
ccgugcuaacugugu

SEQ ID NO: 879579 - RNA, 16 nt, Homo sapiens
ccgugcuaacugugug

SEQ ID NO: 879580 - RNA, 12 nt, Homo sapiens
ccguggaaccag

SEQ ID NO: 879581 - RNA, 17 nt, Homo sapiens
ccguguccagcacagaa

SEQ ID NO: 879582 - RNA, 23 nt, Homo sapiens
ccguuuuucaagaaaacuggaaa

SEQ ID NO: 879583 - RNA, 17 nt, Homo sapiens
ccuaaacuguacaugug

SEQ ID NO: 879584 - RNA, 20 nt, Homo sapiens
ccuaaagaggaaaagugcaa

SEQ ID NO: 879585 - RNA, 13 nt, Homo sapiens
ccuaaaugaccuc

SEQ ID NO: 879586 - RNA, 15 nt, Homo sapiens
ccuaaaugaccucag

SEQ ID NO: 879587 - RNA, 21 nt, Homo sapiens
ccuaacacugggcugcagaga

SEQ ID NO: 879588 - RNA, 16 nt, Homo sapiens
ccuaacaucaugcauu

SEQ ID NO: 879589 - RNA, 21 nt, Homo sapiens
ccuaaccaaaugcugucucca

SEQ ID NO: 879590 - RNA, 15 nt, Homo sapiens
ccuaagaaaccccag

SEQ ID NO: 879591 - RNA, 22 nt, Homo sapiens
ccuaagcacguagagaugauuc

SEQ ID NO: 879592 - RNA, 18 nt, Homo sapiens
ccuaagggccacauccca

SEQ ID NO: 879593 - RNA, 16 nt, Homo sapiens
ccuaagucacuuugag

SEQ ID NO: 879594 - RNA, 23 nt, Homo sapiens
ccuaauaaguccacaucuucuca

SEQ ID NO: 879595 - RNA, 16 nt, Homo sapiens
ccuaaucucauaccuc

SEQ ID NO: 879596 - RNA, 18 nt, Homo sapiens
ccuacaucccaucauggc

SEQ ID NO: 879597 - RNA, 16 nt, Homo sapiens
ccuacauugaggagcu

SEQ ID NO: 879598 - RNA, 12 nt, Homo sapiens
ccuaccaaauau

SEQ ID NO: 879599 - RNA, 14 nt, Homo sapiens
ccuacccacuucca

SEQ ID NO: 879600 - RNA, 16 nt, Homo sapiens
ccuaccccaagaugcc

SEQ ID NO: 879601 - RNA, 14 nt, Homo sapiens
ccuacccucacuca

SEQ ID NO: 879602 - RNA, 13 nt, Homo sapiens
ccuacuacuuugu

SEQ ID NO: 879603 - RNA, 14 nt, Homo sapiens
ccuacucagacugu

SEQ ID NO: 879604 - RNA, 11 nt, Homo sapiens
ccuacugccuc

SEQ ID NO: 879605 - RNA, 19 nt, Homo sapiens
ccuacuuuucuuuccucag

SEQ ID NO: 879606 - RNA, 16 nt, Homo sapiens
ccuagacauaguucag

SEQ ID NO: 879607 - RNA, 22 nt, Homo sapiens
ccuagaccugggccaaaagggc

SEQ ID NO: 879608 - RNA, 21 nt, Homo sapiens
ccuagagugacucuaccugca

SEQ ID NO: 879609 - RNA, 19 nt, Homo sapiens
ccuagcaccuggcuaguuu

SEQ ID NO: 879610 - RNA, 21 nt, Homo sapiens
ccugcagagccucuacacaga

SEQ ID NO: 879611 - RNA, 21 nt, Homo sapiens
ccugcaguuauuaacacuaac

SEQ ID NO: 879612 - RNA, 12 nt, Homo sapiens
ccugccaagcca

SEQ ID NO: 879613 - RNA, 15 nt, Homo sapiens
ccugccaguguuuag

SEQ ID NO: 879614 - RNA, 21 nt, Homo sapiens
ccugcccacuuagccguccau

SEQ ID NO: 879615 - RNA, 15 nt, Homo sapiens
ccugcccucugggag

SEQ ID NO: 879616 - RNA, 13 nt, Homo sapiens
ccugccucaggcu

SEQ ID NO: 879617 - RNA, 18 nt, Homo sapiens
ccugccucaggcuucuga

SEQ ID NO: 879618 - RNA, 17 nt, Homo sapiens
ccugccucucugcucca

SEQ ID NO: 879619 - RNA, 16 nt, Homo sapiens
ccugccuugaugaagc

SEQ ID NO: 879620 - RNA, 15 nt, Homo sapiens
ccugcggcccagaag

SEQ ID NO: 879621 - RNA, 19 nt, Homo sapiens
ccugcgggcaccuacaagg

SEQ ID NO: 879622 - RNA, 13 nt, Homo sapiens
ccugcuaaggagu

SEQ ID NO: 879623 - RNA, 19 nt, Homo sapiens
ccugcuccaucaugcuuga

SEQ ID NO: 879624 - RNA, 19 nt, Homo sapiens
ccugcucccagcagcccua

SEQ ID NO: 879625 - RNA, 21 nt, Homo sapiens
ccugcucuucuaccauuugaa

SEQ ID NO: 879626 - RNA, 19 nt, Homo sapiens
ccugcugaaagcaguguau

SEQ ID NO: 879627 - RNA, 13 nt, Homo sapiens
ccugcugagcucu

SEQ ID NO: 879628 - RNA, 16 nt, Homo sapiens
ccugcugagcucugag

SEQ ID NO: 879629 - RNA, 16 nt, Homo sapiens
ccugcugcagcaugaa

SEQ ID NO: 879630 - RNA, 15 nt, Homo sapiens
ccugcugcucaucca

SEQ ID NO: 879631 - RNA, 16 nt, Homo sapiens
ccugcuugcacuuugu

SEQ ID NO: 879632 - RNA, 23 nt, Homo sapiens
ccuggaacuagaaacagaggugg

SEQ ID NO: 879633 - RNA, 17 nt, Homo sapiens
ccuggaacugucucuca

SEQ ID NO: 879634 - RNA, 18 nt, Homo sapiens
ccuggaaggggcaaagaa

SEQ ID NO: 879635 - RNA, 16 nt, Homo sapiens
ccuggacagcugugcc

SEQ ID NO: 879636 - RNA, 16 nt, Homo sapiens
ccuggagggaggcucu

SEQ ID NO: 879637 - RNA, 21 nt, Homo sapiens
ccuggaugaucacuaauacua

SEQ ID NO: 879638 - RNA, 13 nt, Homo sapiens
ccuggcaauguuu

SEQ ID NO: 879639 - RNA, 14 nt, Homo sapiens
ccuggcaguugaau

SEQ ID NO: 879640 - RNA, 20 nt, Homo sapiens
ccuggccaacaugaugaaac

SEQ ID NO: 879641 - RNA, 19 nt, Homo sapiens
ccuggcuggcugagggcag

SEQ ID NO: 879642 - RNA, 23 nt, Homo sapiens
ccugggaauuuacagagccugcc

SEQ ID NO: 879643 - RNA, 19 nt, Homo sapiens
ccugggagaaccucaggcu

SEQ ID NO: 879644 - RNA, 20 nt, Homo sapiens
ccugggauguagcggugaag

SEQ ID NO: 879645 - RNA, 14 nt, Homo sapiens
ccugggccuaugga

SEQ ID NO: 879646 - RNA, 15 nt, Homo sapiens
ccugggcucaucagc

SEQ ID NO: 879647 - RNA, 19 nt, Homo sapiens
ccuggggcuucuccugacc

SEQ ID NO: 879648 - RNA, 18 nt, Homo sapiens
ccugggggcagugacugg

SEQ ID NO: 879649 - RNA, 12 nt, Homo sapiens
ccugggggccag

SEQ ID NO: 879650 - RNA, 16 nt, Homo sapiens
ccugggugacgguccu

SEQ ID NO: 879651 - RNA, 16 nt, Homo sapiens
ccuggguggcuacucu

SEQ ID NO: 879652 - RNA, 16 nt, Homo sapiens
ccugguccuagacaua

SEQ ID NO: 879653 - RNA, 22 nt, Homo sapiens
ccuggugggccuccucugucca

SEQ ID NO: 879654 - RNA, 15 nt, Homo sapiens
ccugguggucaggga

SEQ ID NO: 879655 - RNA, 14 nt, Homo sapiens
ccuguaaauaguuu

SEQ ID NO: 879656 - RNA, 12 nt, Homo sapiens
ccuguaacacaa

SEQ ID NO: 879657 - RNA, 12 nt, Homo sapiens
ccuguacccagc

SEQ ID NO: 879658 - RNA, 16 nt, Homo sapiens
ccuguagucccagcua

SEQ ID NO: 879659 - RNA, 14 nt, Homo sapiens
ccuguagugagaaa

SEQ ID NO: 879660 - RNA, 16 nt, Homo sapiens
ccuguauauaauacua

SEQ ID NO: 879661 - RNA, 22 nt, Homo sapiens
ccuguaucuacuaaaaauacaa

SEQ ID NO: 879662 - RNA, 18 nt, Homo sapiens
ccuguauucuacagcaga

SEQ ID NO: 879663 - RNA, 22 nt, Homo sapiens
ccugucauccccuacacuuugg

SEQ ID NO: 879664 - RNA, 15 nt, Homo sapiens
ccuguccagcaggua

SEQ ID NO: 879665 - RNA, 12 nt, Homo sapiens
ccugugaucucc

SEQ ID NO: 879666 - RNA, 23 nt, Homo sapiens
ccugugaugcuuugaaguacaau

SEQ ID NO: 879667 - RNA, 11 nt, Homo sapiens
ccugugcagca

SEQ ID NO: 879668 - RNA, 17 nt, Homo sapiens
ccugugcuggacuguuu

SEQ ID NO: 879669 - RNA, 21 nt, Homo sapiens
ccugugggaagagaagggaag

SEQ ID NO: 879670 - RNA, 23 nt, Homo sapiens
ccugugggggcggcuguggggga

SEQ ID NO: 879671 - RNA, 22 nt, Homo sapiens
ccuguguaaaacuauauucuca

SEQ ID NO: 879672 - RNA, 17 nt, Homo sapiens
ccugugucacucagcag

SEQ ID NO: 879673 - RNA, 17 nt, Homo sapiens
ccuguguccagcagcug

SEQ ID NO: 879674 - RNA, 12 nt, Homo sapiens
ccugugugagca

SEQ ID NO: 879675 - RNA, 17 nt, Homo sapiens
ccugugugagcaucucu

SEQ ID NO: 879676 - RNA, 18 nt, Homo sapiens
ccuguuaacgucaucuca

SEQ ID NO: 879677 - RNA, 14 nt, Homo sapiens
ccuguuaagcaauu

SEQ ID NO: 879678 - RNA, 23 nt, Homo sapiens
ccuguuacuugaaauaccaguga

SEQ ID NO: 879679 - RNA, 20 nt, Homo sapiens
ccuguuaggggaaaauagua

SEQ ID NO: 879680 - RNA, 22 nt, Homo sapiens
guacuuguuucaccauacuuca

SEQ ID NO: 879681 - RNA, 21 nt, Homo sapiens
guacuuuauuuguauuugcca

SEQ ID NO: 879682 - RNA, 12 nt, Homo sapiens
guagaagccagu

SEQ ID NO: 879683 - RNA, 22 nt, Homo sapiens
guagagacaggguuuugccaug

SEQ ID NO: 879684 - RNA, 14 nt, Homo sapiens
guagagucacugac

SEQ ID NO: 879685 - RNA, 22 nt, Homo sapiens
guagauuaccugccacuuccag

SEQ ID NO: 879686 - RNA, 18 nt, Homo sapiens
guagcagagucauuguua

SEQ ID NO: 879687 - RNA, 19 nt, Homo sapiens
guagcagauaaagacagcu

SEQ ID NO: 879688 - RNA, 18 nt, Homo sapiens
guagcauuucuugauguu

SEQ ID NO: 879689 - RNA, 16 nt, Homo sapiens
guagccugugcaugua

SEQ ID NO: 879690 - RNA, 14 nt, Homo sapiens
guaggggcaaaaau

SEQ ID NO: 879691 - RNA, 19 nt, Homo sapiens
guaggggguuauugccucu

SEQ ID NO: 879692 - RNA, 21 nt, Homo sapiens
guagucacuuuggagcuuuag

SEQ ID NO: 879693 - RNA, 23 nt, Homo sapiens
guaguuaaagggcagaaggggaa

SEQ ID NO: 879694 - RNA, 23 nt, Homo sapiens
guauaaauguuauguuugcuaaa

SEQ ID NO: 879695 - RNA, 20 nt, Homo sapiens
guauaaccccaccuugccaa

SEQ ID NO: 879696 - RNA, 19 nt, Homo sapiens
guauaaugguguuacuaaa

SEQ ID NO: 879697 - RNA, 15 nt, Homo sapiens
guauauauacauaca

SEQ ID NO: 879698 - RNA, 21 nt, Homo sapiens
guauauauucuacacauauau

SEQ ID NO: 879699 - RNA, 20 nt, Homo sapiens
guauaugugcauggacugug

SEQ ID NO: 879700 - RNA, 17 nt, Homo sapiens
guaucacguuaccccaa

SEQ ID NO: 879701 - RNA, 16 nt, Homo sapiens
guaucaggugcugcca

SEQ ID NO: 879702 - RNA, 23 nt, Homo sapiens
guaucuaaagccaguggcagugu

SEQ ID NO: 879703 - RNA, 20 nt, Homo sapiens
guaucuaccaucuaaucuau

SEQ ID NO: 879704 - RNA, 19 nt, Homo sapiens
guaucuagcucuaguucaa

SEQ ID NO: 879705 - RNA, 14 nt, Homo sapiens
guaucuaugcauuu

SEQ ID NO: 879706 - RNA, 22 nt, Homo sapiens
guaugaccuaguaaacuuugua

SEQ ID NO: 879707 - RNA, 15 nt, Homo sapiens
guaugagcugccaag

SEQ ID NO: 879708 - RNA, 16 nt, Homo sapiens
guaugcagaauguuuu

SEQ ID NO: 879709 - RNA, 22 nt, Homo sapiens
guaugcucauacuuggacaguu

SEQ ID NO: 879710 - RNA, 18 nt, Homo sapiens
guauggcaugaacaucuu

SEQ ID NO: 879711 - RNA, 20 nt, Homo sapiens
guauuaaagauguguuguug

SEQ ID NO: 879712 - RNA, 12 nt, Homo sapiens
guauuccauuuu

SEQ ID NO: 879713 - RNA, 18 nt, Homo sapiens
guauuccuuuuguguaca

SEQ ID NO: 879714 - RNA, 13 nt, Homo sapiens
guauucuucauca

SEQ ID NO: 879715 - RNA, 17 nt, Homo sapiens
guauuuaccacagcagc

SEQ ID NO: 879716 - RNA, 11 nt, Homo sapiens
guauuugccau

SEQ ID NO: 879717 - RNA, 23 nt, Homo sapiens
guauuuuccauacacauccccag

SEQ ID NO: 879718 - RNA, 14 nt, Homo sapiens
guauuuugccagac

SEQ ID NO: 879719 - RNA, 18 nt, Homo sapiens
gucaaaacauucagguau

SEQ ID NO: 879720 - RNA, 14 nt, Homo sapiens
gucaaaaggugccu

SEQ ID NO: 879721 - RNA, 13 nt, Homo sapiens
gucaaaugucauu

SEQ ID NO: 879722 - RNA, 16 nt, Homo sapiens
gucaaccagugaggcu

SEQ ID NO: 879723 - RNA, 22 nt, Homo sapiens
gucaauacugccuuaaugagaa

SEQ ID NO: 879724 - RNA, 18 nt, Homo sapiens
gucaauccccucauucag

SEQ ID NO: 879725 - RNA, 20 nt, Homo sapiens
uaugucaggcaaagugcugc

SEQ ID NO: 879726 - RNA, 15 nt, Homo sapiens
uaugucucagaccac

SEQ ID NO: 879727 - RNA, 20 nt, Homo sapiens
uaugucuuggacacuguaca

SEQ ID NO: 879728 - RNA, 14 nt, Homo sapiens
uaugugauguuaac

SEQ ID NO: 879729 - RNA, 15 nt, Homo sapiens
uaugugcgugcaugu

SEQ ID NO: 879730 - RNA, 18 nt, Homo sapiens
uauguggcguaucaugca

SEQ ID NO: 879731 - RNA, 12 nt, Homo sapiens
uauguuacauua

SEQ ID NO: 879732 - RNA, 17 nt, Homo sapiens
uauguuacuacaugcac

SEQ ID NO: 879733 - RNA, 13 nt, Homo sapiens
uauguuauugcau

SEQ ID NO: 879734 - RNA, 23 nt, Homo sapiens
uauuaagauuuccaagugccaau

SEQ ID NO: 879735 - RNA, 22 nt, Homo sapiens
uauuaaguucucaaugugaaaa

SEQ ID NO: 879736 - RNA, 16 nt, Homo sapiens
uauuaauauucauugu

SEQ ID NO: 879737 - RNA, 23 nt, Homo sapiens
uauuaauuuguuuuucuuaucca

SEQ ID NO: 879738 - RNA, 15 nt, Homo sapiens
uauuagaacaggcaa

SEQ ID NO: 879739 - RNA, 13 nt, Homo sapiens
uauuagacaugaa

SEQ ID NO: 879740 - RNA, 17 nt, Homo sapiens
uauuagauaaauuucaa

SEQ ID NO: 879741 - RNA, 22 nt, Homo sapiens
uauuagcagaaauguaucuaua

SEQ ID NO: 879742 - RNA, 13 nt, Homo sapiens
uauuagcuuauau

SEQ ID NO: 879743 - RNA, 15 nt, Homo sapiens
uauuaggccauauau

SEQ ID NO: 879744 - RNA, 14 nt, Homo sapiens
uauuaucacaucaa

SEQ ID NO: 879745 - RNA, 13 nt, Homo sapiens
uauuaucaccagc

SEQ ID NO: 879746 - RNA, 16 nt, Homo sapiens
uauuaucaguggcugc

SEQ ID NO: 879747 - RNA, 19 nt, Homo sapiens
uauuaugggaaugacucug

SEQ ID NO: 879748 - RNA, 20 nt, Homo sapiens
uauuauguaguccguuaaca

SEQ ID NO: 879749 - RNA, 19 nt, Homo sapiens
uauuauugaagauuuacca

SEQ ID NO: 879750 - RNA, 13 nt, Homo sapiens
uauuauuguggaa

SEQ ID NO: 879751 - RNA, 13 nt, Homo sapiens
uauucauaugcuu

SEQ ID NO: 879752 - RNA, 23 nt, Homo sapiens
uauucauucauuuacucauucau

SEQ ID NO: 879753 - RNA, 13 nt, Homo sapiens
uauuccugcauuu

SEQ ID NO: 879754 - RNA, 21 nt, Homo sapiens
uauuccuguuucugaaccauu

SEQ ID NO: 879755 - RNA, 17 nt, Homo sapiens
uauucucacuccaccac

SEQ ID NO: 879756 - RNA, 16 nt, Homo sapiens
uauucucaguguaggg

SEQ ID NO: 879757 - RNA, 14 nt, Homo sapiens
uauucucuaagaua

SEQ ID NO: 879758 - RNA, 17 nt, Homo sapiens
uauucucuuaauuuuuc

SEQ ID NO: 879759 - RNA, 15 nt, Homo sapiens
uauucugcauggaaa

SEQ ID NO: 879760 - RNA, 11 nt, Homo sapiens
uauucuggaaa

SEQ ID NO: 879761 - RNA, 15 nt, Homo sapiens
uauucuucauaacaa

SEQ ID NO: 879762 - RNA, 16 nt, Homo sapiens
uauucuuccgucacau

SEQ ID NO: 879763 - RNA, 21 nt, Homo sapiens
uauucuuggagaacuuuccau

SEQ ID NO: 879764 - RNA, 21 nt, Homo sapiens
uauucuuuaaauuucaucuca

SEQ ID NO: 879765 - RNA, 23 nt, Homo sapiens
uauucuuuuuggaaauaaaauac

SEQ ID NO: 879766 - RNA, 22 nt, Homo sapiens
uauugaaaaaucaccacaccaa

SEQ ID NO: 879767 - RNA, 18 nt, Homo sapiens
uauugaaaagguuaacag

SEQ ID NO: 879768 - RNA, 19 nt, Homo sapiens
uauugaagaaaagcacuuu

SEQ ID NO: 879769 - RNA, 20 nt, Homo sapiens
uauugauguuuccagaaaau

SEQ ID NO: 879770 - RNA, 16 nt, Homo sapiens
uauugccuuugccucu

SEQ ID NO: 879771 - RNA, 15 nt, Homo sapiens
uauugcgaaugugca

SEQ ID NO: 879772 - RNA, 14 nt, Homo sapiens
uauuggaacauguc

SEQ ID NO: 879773 - RNA, 20 nt, Homo sapiens
uauuggaccagaaguccuau

SEQ ID NO: 879774 - RNA, 20 nt, Homo sapiens
uauuggcaguuggaggacac

SEQ ID NO: 879775 - RNA, 17 nt, Homo sapiens
uauugguaggauuuaua

SEQ ID NO: 879776 - RNA, 22 nt, Homo sapiens
uauugguccagcuugcucuuca

SEQ ID NO: 879777 - RNA, 16 nt, Homo sapiens
uauugguguugcccua

SEQ ID NO: 879778 - RNA, 17 nt, Homo sapiens
uauugguguuuacccag

SEQ ID NO: 879779 - RNA, 15 nt, Homo sapiens
uauuguauuacauuu

SEQ ID NO: 879780 - RNA, 16 nt, Homo sapiens
uauugucggaagacuu

SEQ ID NO: 879781 - RNA, 14 nt, Homo sapiens
uauugugaucuauc

SEQ ID NO: 879782 - RNA, 14 nt, Homo sapiens
uauuuaaaaguaua

SEQ ID NO: 879783 - RNA, 23 nt, Homo sapiens
uauuuaaaauuuauugcuugaua

SEQ ID NO: 879784 - RNA, 21 nt, Homo sapiens
uauuuacugagcuucucugug

SEQ ID NO: 879785 - RNA, 15 nt, Homo sapiens
uauuuagacaaaguu

SEQ ID NO: 879786 - RNA, 22 nt, Homo sapiens
uauuuagaucuagaaacagauc

SEQ ID NO: 879787 - RNA, 15 nt, Homo sapiens
uauuuagugaacuac

SEQ ID NO: 879788 - RNA, 16 nt, Homo sapiens
uauuuaguucuugagu

SEQ ID NO: 879789 - RNA, 18 nt, Homo sapiens
uauuuauaagagugccgu

SEQ ID NO: 879790 - RNA, 21 nt, Homo sapiens
uauuuaugagaaaguucucau

SEQ ID NO: 879791 - RNA, 15 nt, Homo sapiens
uauuuauugcugaau

SEQ ID NO: 879792 - RNA, 19 nt, Homo sapiens
uauuuauuggggaucugca

SEQ ID NO: 879793 - RNA, 13 nt, Homo sapiens
uauuuauuuacug

SEQ ID NO: 879794 - RNA, 21 nt, Homo sapiens
uauuucaaaacacaucuuucc

SEQ ID NO: 879795 - RNA, 19 nt, Homo sapiens
uauuucaauguuagccuca

SEQ ID NO: 879796 - RNA, 14 nt, Homo sapiens
uauuuccuuuccag

SEQ ID NO: 879797 - RNA, 14 nt, Homo sapiens
uauuucuacacagu

SEQ ID NO: 879798 - RNA, 16 nt, Homo sapiens
uauuugaaucuacaaa

SEQ ID NO: 879799 - RNA, 21 nt, Homo sapiens
cuucucuguucauuuccucaa

SEQ ID NO: 879800 - RNA, 15 nt, Homo sapiens
cuucucuuucucuga

SEQ ID NO: 879801 - RNA, 19 nt, Homo sapiens
cuucugacuuuuagaaaca

SEQ ID NO: 879802 - RNA, 17 nt, Homo sapiens
cuucugcuguauacugu

SEQ ID NO: 879803 - RNA, 16 nt, Homo sapiens
cuucugggaacuuccu

SEQ ID NO: 879804 - RNA, 15 nt, Homo sapiens
cuucuguccuacucu

SEQ ID NO: 879805 - RNA, 17 nt, Homo sapiens
cuucuguccuacucugu

SEQ ID NO: 879806 - RNA, 21 nt, Homo sapiens
cuucuuacaauaauucuauga

SEQ ID NO: 879807 - RNA, 15 nt, Homo sapiens
cuucuugugaaacca

SEQ ID NO: 879808 - RNA, 15 nt, Homo sapiens
cuucuuuacuagaua

SEQ ID NO: 879809 - RNA, 16 nt, Homo sapiens
cuucuuucaaagugua

SEQ ID NO: 879810 - RNA, 14 nt, Homo sapiens
cuucuuuuccaauu

SEQ ID NO: 879811 - RNA, 19 nt, Homo sapiens
cuugaaaaugaaaugacug

SEQ ID NO: 879812 - RNA, 18 nt, Homo sapiens
cuugaaacaagcaacaga

SEQ ID NO: 879813 - RNA, 22 nt, Homo sapiens
cuugaaacaagcaacagaugga

SEQ ID NO: 879814 - RNA, 14 nt, Homo sapiens
cuugaaaccaaaga

SEQ ID NO: 879815 - RNA, 23 nt, Homo sapiens
cuugaaauaccagugaaccaaag

SEQ ID NO: 879816 - RNA, 17 nt, Homo sapiens
cuugaaccacaguucua

SEQ ID NO: 879817 - RNA, 16 nt, Homo sapiens
cuugaagaauauuguu

SEQ ID NO: 879818 - RNA, 18 nt, Homo sapiens
cuugaagacaauggcuua

SEQ ID NO: 879819 - RNA, 17 nt, Homo sapiens
cuugacaacagacugaa

SEQ ID NO: 879820 - RNA, 14 nt, Homo sapiens
cuugacagggcaca

SEQ ID NO: 879821 - RNA, 20 nt, Homo sapiens
cuugacaguaaaucacacaa

SEQ ID NO: 879822 - RNA, 13 nt, Homo sapiens
cuugacauguaau

SEQ ID NO: 879823 - RNA, 12 nt, Homo sapiens
cuugacuaucac

SEQ ID NO: 879824 - RNA, 16 nt, Homo sapiens
cuugacuaucacauac

SEQ ID NO: 879825 - RNA, 22 nt, Homo sapiens
cuugacucaacgagagcacuug

SEQ ID NO: 879826 - RNA, 21 nt, Homo sapiens
cuugagaaaccuuauuguacc

SEQ ID NO: 879827 - RNA, 15 nt, Homo sapiens
cuugagccaguaauu

SEQ ID NO: 879828 - RNA, 12 nt, Homo sapiens
cuugagcugucc

SEQ ID NO: 879829 - RNA, 14 nt, Homo sapiens
cuugaguagaucug

SEQ ID NO: 879830 - RNA, 14 nt, Homo sapiens
cuugaguguguuac

SEQ ID NO: 879831 - RNA, 16 nt, Homo sapiens
cuugauaaaugccuca

SEQ ID NO: 879832 - RNA, 15 nt, Homo sapiens
cuugauaugaccugu

SEQ ID NO: 879833 - RNA, 12 nt, Homo sapiens
cuugaugaagcc

SEQ ID NO: 879834 - RNA, 12 nt, Homo sapiens
cuugauucacaa

SEQ ID NO: 879835 - RNA, 15 nt, Homo sapiens
cuugcacauauuuga

SEQ ID NO: 879836 - RNA, 15 nt, Homo sapiens
cuugcauacagagac

SEQ ID NO: 879837 - RNA, 15 nt, Homo sapiens
cuugccaaauuccau

SEQ ID NO: 879838 - RNA, 16 nt, Homo sapiens
cuugccucucucagga

SEQ ID NO: 879839 - RNA, 17 nt, Homo sapiens
cuugccucucucaggag

SEQ ID NO: 879840 - RNA, 18 nt, Homo sapiens
cuugccugggaccagugg

SEQ ID NO: 879841 - RNA, 18 nt, Homo sapiens
gaaaaacauuccaggaaa

SEQ ID NO: 879842 - RNA, 15 nt, Homo sapiens
gaaaaaccaaugauu

SEQ ID NO: 879843 - RNA, 20 nt, Homo sapiens
gaaaaacgaucgcugugaaa

SEQ ID NO: 879844 - RNA, 15 nt, Homo sapiens
gaaaaacuuccauga

SEQ ID NO: 879845 - RNA, 22 nt, Homo sapiens
gaaaaaggccaguggaaauuca

SEQ ID NO: 879846 - RNA, 12 nt, Homo sapiens
gaaaacaugacu

SEQ ID NO: 879847 - RNA, 13 nt, Homo sapiens
gaaaacaugacuu

SEQ ID NO: 879848 - RNA, 22 nt, Homo sapiens
gaaaaccucauuuaccauaaaa

SEQ ID NO: 879849 - RNA, 13 nt, Homo sapiens
gaaaacucuucau

SEQ ID NO: 879850 - RNA, 14 nt, Homo sapiens
gaaaacuucucaca

SEQ ID NO: 879851 - RNA, 18 nt, Homo sapiens
gaaaagaaaaaaaauaau

SEQ ID NO: 879852 - RNA, 15 nt, Homo sapiens
gaaaagaaaccagag

SEQ ID NO: 879853 - RNA, 19 nt, Homo sapiens
gaaaagaccaguccaugag

SEQ ID NO: 879854 - RNA, 21 nt, Homo sapiens
gaaaagcacuuuacagaugag

SEQ ID NO: 879855 - RNA, 11 nt, Homo sapiens
gaaaagccaga

SEQ ID NO: 879856 - RNA, 12 nt, Homo sapiens
gaaaagccagag

SEQ ID NO: 879857 - RNA, 22 nt, Homo sapiens
gaaaagccagaguuccauguuu

SEQ ID NO: 879858 - RNA, 14 nt, Homo sapiens
gaaaagcccaguga

SEQ ID NO: 879859 - RNA, 20 nt, Homo sapiens
gaaaagcugcugacaguguu

SEQ ID NO: 879860 - RNA, 22 nt, Homo sapiens
gaaaagguagcuuaccugacac

SEQ ID NO: 879861 - RNA, 19 nt, Homo sapiens
gaaaagguucuucaucccu

SEQ ID NO: 879862 - RNA, 16 nt, Homo sapiens
gaaaaguacauuuaau

SEQ ID NO: 879863 - RNA, 20 nt, Homo sapiens
gaaaaguagaauuauaucua

SEQ ID NO: 879864 - RNA, 22 nt, Homo sapiens
gaaaaguggauggaagugucug

SEQ ID NO: 879865 - RNA, 13 nt, Homo sapiens
gaaaaguguuauu

SEQ ID NO: 879866 - RNA, 17 nt, Homo sapiens
gaaaauaaaagcacuua

SEQ ID NO: 879867 - RNA, 13 nt, Homo sapiens
gaaaauaaagugu

SEQ ID NO: 879868 - RNA, 16 nt, Homo sapiens
gaaaauagcucuuuca

SEQ ID NO: 879869 - RNA, 20 nt, Homo sapiens
gaaaaucaguuauauucuuu

SEQ ID NO: 879870 - RNA, 17 nt, Homo sapiens
gaaaauccauggauauc

SEQ ID NO: 879871 - RNA, 14 nt, Homo sapiens
gaaaaugaacacag

SEQ ID NO: 879872 - RNA, 13 nt, Homo sapiens
gaaaaugcauuau

SEQ ID NO: 879873 - RNA, 14 nt, Homo sapiens
gaaaauguacaaua

SEQ ID NO: 879874 - RNA, 15 nt, Homo sapiens
gaaaauguccucccu

SEQ ID NO: 879875 - RNA, 14 nt, Homo sapiens
gaaaaugugcaaua

SEQ ID NO: 879876 - RNA, 22 nt, Homo sapiens
gaaacaacuuguguucuauuaa

SEQ ID NO: 879877 - RNA, 23 nt, Homo sapiens
gaaacagagguggcugcugugcu

SEQ ID NO: 879878 - RNA, 20 nt, Homo sapiens
gaaacagggcagugacaagu

SEQ ID NO: 879879 - RNA, 16 nt, Homo sapiens
gaaacaugaauuauuu

SEQ ID NO: 879880 - RNA, 18 nt, Homo sapiens
gaaacaugacacugaccu

SEQ ID NO: 879881 - RNA, 14 nt, Homo sapiens
gaaacaugauguga

SEQ ID NO: 879882 - RNA, 16 nt, Homo sapiens
gaaacaugaugugaga

SEQ ID NO: 879883 - RNA, 16 nt, Homo sapiens
gaaaccaacacccaaa

SEQ ID NO: 879884 - RNA, 13 nt, Homo sapiens
gaaaccacagguu

SEQ ID NO: 879885 - RNA, 12 nt, Homo sapiens
gaaaccuggcau

SEQ ID NO: 879886 - RNA, 20 nt, Homo sapiens
gaaaccuguccauaaaguaa

SEQ ID NO: 879887 - RNA, 21 nt, Homo sapiens
gaaacuccuuuugcugucuuu

SEQ ID NO: 879888 - RNA, 17 nt, Homo sapiens
gaaagaaggacacuugu

SEQ ID NO: 879889 - RNA, 14 nt, Homo sapiens
gaaagaaugcaaga

SEQ ID NO: 879890 - RNA, 17 nt, Homo sapiens
gaaagacuuacaggccu

SEQ ID NO: 879891 - RNA, 16 nt, Homo sapiens
gaaagaguagugcauu

SEQ ID NO: 879892 - RNA, 18 nt, Homo sapiens
gaaagaguccuauuugca

SEQ ID NO: 879893 - RNA, 18 nt, Homo sapiens
gaaagauccacccucaaa

SEQ ID NO: 879894 - RNA, 15 nt, Homo sapiens
gaaagcacaccucau

SEQ ID NO: 879895 - RNA, 19 nt, Homo sapiens
gaaagccucugcugccaug

SEQ ID NO: 879896 - RNA, 15 nt, Homo sapiens
gaaagccucuggaaa

SEQ ID NO: 879897 - RNA, 17 nt, Homo sapiens
gaaaggaagcuccacug

SEQ ID NO: 879898 - RNA, 13 nt, Homo sapiens
gaaaggcucaguc

SEQ ID NO: 879899 - RNA, 18 nt, Homo sapiens
gaaagggauaguccaaag

SEQ ID NO: 879900 - RNA, 14 nt, Homo sapiens
gaaaguucaaaaag

SEQ ID NO: 879901 - RNA, 19 nt, Homo sapiens
gaaauaaaagccucuggug

SEQ ID NO: 879902 - RNA, 21 nt, Homo sapiens
gaaauaaaagccucuggugga

SEQ ID NO: 879903 - RNA, 14 nt, Homo sapiens
gaaauaaaccugga

SEQ ID NO: 879904 - RNA, 18 nt, Homo sapiens
gaaauaagcccaacagac

SEQ ID NO: 879905 - RNA, 15 nt, Homo sapiens
gaaauaccagugaac

SEQ ID NO: 879906 - RNA, 15 nt, Homo sapiens
gaaauagacaguaua

SEQ ID NO: 879907 - RNA, 16 nt, Homo sapiens
gaaauagacaguauau

SEQ ID NO: 879908 - RNA, 21 nt, Homo sapiens
gaaauagccaccgucuacaga

SEQ ID NO: 879909 - RNA, 13 nt, Homo sapiens
gaaauauaaugca

SEQ ID NO: 879910 - RNA, 15 nt, Homo sapiens
gaaauaugaugccuu

SEQ ID NO: 879911 - RNA, 21 nt, Homo sapiens
gaaauauuacaguagugcauu

SEQ ID NO: 879912 - RNA, 13 nt, Homo sapiens
gaaauauucucuc

SEQ ID NO: 879913 - RNA, 20 nt, Homo sapiens
gaaaucagaagccuacuuug

SEQ ID NO: 879914 - RNA, 18 nt, Homo sapiens
gaaaucagaagugcaaag

SEQ ID NO: 879915 - RNA, 13 nt, Homo sapiens
gaaaucuguaauu

SEQ ID NO: 879916 - RNA, 14 nt, Homo sapiens
ucacccuucugggc

SEQ ID NO: 879917 - RNA, 21 nt, Homo sapiens
ucaccguggaccuuccugcca

SEQ ID NO: 879918 - RNA, 14 nt, Homo sapiens
ucaccucucuucag

SEQ ID NO: 879919 - RNA, 17 nt, Homo sapiens
ucaccuguuacuugaaa

SEQ ID NO: 879920 - RNA, 16 nt, Homo sapiens
ucaccuuggagccuga

SEQ ID NO: 879921 - RNA, 22 nt, Homo sapiens
ucacgacucuaccauguccaau

SEQ ID NO: 879922 - RNA, 13 nt, Homo sapiens
ucacgacucuucc

SEQ ID NO: 879923 - RNA, 14 nt, Homo sapiens
ucacgauauuauua

SEQ ID NO: 879924 - RNA, 15 nt, Homo sapiens
ucacgaugaaauuga

SEQ ID NO: 879925 - RNA, 19 nt, Homo sapiens
ucacgcaacuugaaauuau

SEQ ID NO: 879926 - RNA, 23 nt, Homo sapiens
ucacgugucuuuagaacuccagu

SEQ ID NO: 879927 - RNA, 18 nt, Homo sapiens
ucacuaaccaagccagaa

SEQ ID NO: 879928 - RNA, 15 nt, Homo sapiens
ucacuacaguacagu

SEQ ID NO: 879929 - RNA, 19 nt, Homo sapiens
ucacuacuuaaagugcuau

SEQ ID NO: 879930 - RNA, 23 nt, Homo sapiens
ucacuagagcugggaaacaggga

SEQ ID NO: 879931 - RNA, 15 nt, Homo sapiens
ucacuaugguaugcu

SEQ ID NO: 879932 - RNA, 15 nt, Homo sapiens
ucacucacucauucc

SEQ ID NO: 879933 - RNA, 18 nt, Homo sapiens
ucacucuuccugcaagga

SEQ ID NO: 879934 - RNA, 22 nt, Homo sapiens
ucacugaagaaaccuucagauu

SEQ ID NO: 879935 - RNA, 19 nt, Homo sapiens
ucacugaguggcuugugau

SEQ ID NO: 879936 - RNA, 18 nt, Homo sapiens
ucacugcuggcugccuua

SEQ ID NO: 879937 - RNA, 17 nt, Homo sapiens
ucacuggaccacugggc

SEQ ID NO: 879938 - RNA, 14 nt, Homo sapiens
ucacuggguucuag

SEQ ID NO: 879939 - RNA, 23 nt, Homo sapiens
ucacuguagaaugauuucaugcu

SEQ ID NO: 879940 - RNA, 15 nt, Homo sapiens
ucacugucccucaaa

SEQ ID NO: 879941 - RNA, 17 nt, Homo sapiens
ucacugucccucaaaug

SEQ ID NO: 879942 - RNA, 22 nt, Homo sapiens
ucacuuaacugauguuacugaa

SEQ ID NO: 879943 - RNA, 18 nt, Homo sapiens
ucacuucauuuaucuuaa

SEQ ID NO: 879944 - RNA, 21 nt, Homo sapiens
ucacuucccugggaacucauc

SEQ ID NO: 879945 - RNA, 14 nt, Homo sapiens
ucacuucgaugacu

SEQ ID NO: 879946 - RNA, 16 nt, Homo sapiens
ucacuugaacucggga

SEQ ID NO: 879947 - RNA, 18 nt, Homo sapiens
ucacuuuaaagucuuucc

SEQ ID NO: 879948 - RNA, 16 nt, Homo sapiens
ucacuuuaauucucau

SEQ ID NO: 879949 - RNA, 17 nt, Homo sapiens
ucagaaaagaaaaccau

SEQ ID NO: 879950 - RNA, 18 nt, Homo sapiens
ucagaaggauggcauuuu

SEQ ID NO: 879951 - RNA, 18 nt, Homo sapiens
ucagaaguuucuucuuua

SEQ ID NO: 879952 - RNA, 12 nt, Homo sapiens
ucagaaucugug

SEQ ID NO: 879953 - RNA, 22 nt, Homo sapiens
ucagaauuucuuugucauucaa

SEQ ID NO: 879954 - RNA, 20 nt, Homo sapiens
ucagacagguaaaugggcag

SEQ ID NO: 879955 - RNA, 13 nt, Homo sapiens
ucagacauuccaa

SEQ ID NO: 879956 - RNA, 17 nt, Homo sapiens
gaacuauuagacaugaa

SEQ ID NO: 879957 - RNA, 15 nt, Homo sapiens
gaacucagagccccu

SEQ ID NO: 879958 - RNA, 15 nt, Homo sapiens
gaacuccaguacuca

SEQ ID NO: 879959 - RNA, 22 nt, Homo sapiens
gaacucuggggagccugagcca

SEQ ID NO: 879960 - RNA, 16 nt, Homo sapiens
gaacugaagaccucca

SEQ ID NO: 879961 - RNA, 23 nt, Homo sapiens
gaacugagccaaacacacuguaa

SEQ ID NO: 879962 - RNA, 18 nt, Homo sapiens
gaacugcacguucuauau

SEQ ID NO: 879963 - RNA, 17 nt, Homo sapiens
gaacugccccaucuccu

SEQ ID NO: 879964 - RNA, 20 nt, Homo sapiens
gaacugccccaucuccuccc

SEQ ID NO: 879965 - RNA, 17 nt, Homo sapiens
gaacugcgugccagugu

SEQ ID NO: 879966 - RNA, 18 nt, Homo sapiens
gaacugcgugccaguguc

SEQ ID NO: 879967 - RNA, 19 nt, Homo sapiens
gaacuggaggaguuccuug

SEQ ID NO: 879968 - RNA, 23 nt, Homo sapiens
gaacuggugcuuuaguaaugugg

SEQ ID NO: 879969 - RNA, 17 nt, Homo sapiens
gaacuugaacugauuca

SEQ ID NO: 879970 - RNA, 18 nt, Homo sapiens
gaagaaaaucaaccagca

SEQ ID NO: 879971 - RNA, 21 nt, Homo sapiens
gaagaaauccauaacaccccc

SEQ ID NO: 879972 - RNA, 22 nt, Homo sapiens
gaagaaauggaaucagcuuuua

SEQ ID NO: 879973 - RNA, 14 nt, Homo sapiens
gaagaaaugggaga

SEQ ID NO: 879974 - RNA, 21 nt, Homo sapiens
gaagaacaucccaagccagaa

SEQ ID NO: 879975 - RNA, 14 nt, Homo sapiens
gaagaagaaaauca

SEQ ID NO: 879976 - RNA, 14 nt, Homo sapiens
gaagaagaguuucu

SEQ ID NO: 879977 - RNA, 12 nt, Homo sapiens
gaagaagccaga

SEQ ID NO: 879978 - RNA, 19 nt, Homo sapiens
gaagaauauucaggacuua

SEQ ID NO: 879979 - RNA, 23 nt, Homo sapiens
gaagacaauggcuuacuccagga

SEQ ID NO: 879980 - RNA, 15 nt, Homo sapiens
gaagacacugcaaag

SEQ ID NO: 879981 - RNA, 20 nt, Homo sapiens
gaagaccaagacacagauca

SEQ ID NO: 879982 - RNA, 17 nt, Homo sapiens
gaagacccaguguaaag

SEQ ID NO: 879983 - RNA, 20 nt, Homo sapiens
gaagaccuaaaugaccucag

SEQ ID NO: 879984 - RNA, 12 nt, Homo sapiens
gaagacuguggc

SEQ ID NO: 879985 - RNA, 18 nt, Homo sapiens
gaagagacucucuuaggg

SEQ ID NO: 879986 - RNA, 17 nt, Homo sapiens
gaagagagagacccuca

SEQ ID NO: 879987 - RNA, 16 nt, Homo sapiens
gaagagagauauaucu

SEQ ID NO: 879988 - RNA, 18 nt, Homo sapiens
gaagagauuucaacauau

SEQ ID NO: 879989 - RNA, 11 nt, Homo sapiens
gaagagcauug

SEQ ID NO: 879990 - RNA, 24 nt, Homo sapiens
gaagaggccuagccugagccaaag

SEQ ID NO: 879991 - RNA, 17 nt, Homo sapiens
gaagauggaaaaaguau

SEQ ID NO: 879992 - RNA, 20 nt, Homo sapiens
gaagauggauguuugucaaa

SEQ ID NO: 879993 - RNA, 21 nt, Homo sapiens
gaagauggauguuugucaaaa

SEQ ID NO: 879994 - RNA, 21 nt, Homo sapiens
gaagauucccucuuccugcca

SEQ ID NO: 879995 - RNA, 12 nt, Homo sapiens
gaagcaaccucc

SEQ ID NO: 879996 - RNA, 23 nt, Homo sapiens
gaagcacuccucgguacucccau

SEQ ID NO: 879997 - RNA, 19 nt, Homo sapiens
gaagcagagagguggagaa

SEQ ID NO: 879998 - RNA, 20 nt, Homo sapiens
gaagcagguucuugauguca

SEQ ID NO: 879999 - RNA, 15 nt, Homo sapiens
gaagcagugccuucc

SEQ ID NO: 880000 - RNA, 14 nt, Homo sapiens
gaagccacaggagc

SEQ ID NO: 880001 - RNA, 18 nt, Homo sapiens
gaagccccauuugcacag

SEQ ID NO: 880002 - RNA, 23 nt, Homo sapiens
gaagcgacuauaaagguuuuuga

SEQ ID NO: 880003 - RNA, 14 nt, Homo sapiens
gaagcucuggccaa

SEQ ID NO: 880004 - RNA, 19 nt, Homo sapiens
gaagcugggagcuacaggg

SEQ ID NO: 880005 - RNA, 23 nt, Homo sapiens
gaagcuguccuugagcuguccua

SEQ ID NO: 880006 - RNA, 21 nt, Homo sapiens
gaagcuguguccuugcaccug

SEQ ID NO: 880007 - RNA, 22 nt, Homo sapiens
gaagcuguguccuugcaccugc

SEQ ID NO: 880008 - RNA, 18 nt, Homo sapiens
gaaggaauagccagagag

SEQ ID NO: 880009 - RNA, 15 nt, Homo sapiens
gaaggacacuuguau

SEQ ID NO: 880010 - RNA, 14 nt, Homo sapiens
gaaggacauuuucu

SEQ ID NO: 880011 - RNA, 12 nt, Homo sapiens
gaaggacugugc

SEQ ID NO: 880012 - RNA, 12 nt, Homo sapiens
gaaggagaaaau

SEQ ID NO: 880013 - RNA, 21 nt, Homo sapiens
gaaggagaguccccugaaggu

SEQ ID NO: 880014 - RNA, 17 nt, Homo sapiens
gaaggagccagugccca

SEQ ID NO: 880015 - RNA, 14 nt, Homo sapiens
gaaggaguucacug

SEQ ID NO: 880016 - RNA, 16 nt, Homo sapiens
gaaggauuuacugcaa

SEQ ID NO: 880017 - RNA, 17 nt, Homo sapiens
gaaggcaaagagaccac

SEQ ID NO: 880018 - RNA, 11 nt, Homo sapiens
gaaggcagcug

SEQ ID NO: 880019 - RNA, 21 nt, Homo sapiens
gaaggcccaggucaacaucua

SEQ ID NO: 880020 - RNA, 18 nt, Homo sapiens
gaaggcuuugccaugggc

SEQ ID NO: 880021 - RNA, 15 nt, Homo sapiens
gaagggaaagccaga

SEQ ID NO: 880022 - RNA, 19 nt, Homo sapiens
gaagggcuagaaccuggag

SEQ ID NO: 880023 - RNA, 19 nt, Homo sapiens
gaagguagcccagcacugu

SEQ ID NO: 880024 - RNA, 22 nt, Homo sapiens
gaagguauuccuuuuguguaca

SEQ ID NO: 880025 - RNA, 21 nt, Homo sapiens
gaaggucccaccuccauuugc

SEQ ID NO: 880026 - RNA, 17 nt, Homo sapiens
gaaggugcugacaaaga

SEQ ID NO: 880027 - RNA, 20 nt, Homo sapiens
gaaggugcugacaaagauga

SEQ ID NO: 880028 - RNA, 20 nt, Homo sapiens
gaagguuauggucaauccca

SEQ ID NO: 880029 - RNA, 14 nt, Homo sapiens
gaaguaaaagcaaa

SEQ ID NO: 880030 - RNA, 18 nt, Homo sapiens
gaaguagaauuuguccaa

SEQ ID NO: 880031 - RNA, 18 nt, Homo sapiens
ucaucaauuuucacuugc

SEQ ID NO: 880032 - RNA, 12 nt, Homo sapiens
ucaucacuggau

SEQ ID NO: 880033 - RNA, 22 nt, Homo sapiens
ucaucagaagauaacuugagca

SEQ ID NO: 880034 - RNA, 23 nt, Homo sapiens
ucaucagcuaucguuaguguauu

SEQ ID NO: 880035 - RNA, 18 nt, Homo sapiens
ucaucagcuuugugccac

SEQ ID NO: 880036 - RNA, 23 nt, Homo sapiens
ucaucaguguccucuugcucaaa

SEQ ID NO: 880037 - RNA, 21 nt, Homo sapiens
ucaucauaaaauaaaguauau

SEQ ID NO: 880038 - RNA, 19 nt, Homo sapiens
ucaucauguuggccaggcu

SEQ ID NO: 880039 - RNA, 13 nt, Homo sapiens
ucauccaaggaac

SEQ ID NO: 880040 - RNA, 16 nt, Homo sapiens
ucauccauguccaacc

SEQ ID NO: 880041 - RNA, 19 nt, Homo sapiens
ucaucccuuuccaguuaag

SEQ ID NO: 880042 - RNA, 13 nt, Homo sapiens
ucaucuacuacag

SEQ ID NO: 880043 - RNA, 11 nt, Homo sapiens
ucaucucugcc

SEQ ID NO: 880044 - RNA, 15 nt, Homo sapiens
ucaucuuagcuuucc

SEQ ID NO: 880045 - RNA, 17 nt, Homo sapiens
ucaucuuagcuuuccac

SEQ ID NO: 880046 - RNA, 18 nt, Homo sapiens
ucaucuugacauguaaug

SEQ ID NO: 880047 - RNA, 22 nt, Homo sapiens
ucaugaacacagccugggacca

SEQ ID NO: 880048 - RNA, 12 nt, Homo sapiens
ucaugacaaagu

SEQ ID NO: 880049 - RNA, 16 nt, Homo sapiens
ucaugagcacaggguc

SEQ ID NO: 880050 - RNA, 22 nt, Homo sapiens
ucaugaguggauggauggacag

SEQ ID NO: 880051 - RNA, 14 nt, Homo sapiens
ucaugauucacaac

SEQ ID NO: 880052 - RNA, 16 nt, Homo sapiens
ucaugauuucauuuca

SEQ ID NO: 880053 - RNA, 13 nt, Homo sapiens
ucaugcauucaca

SEQ ID NO: 880054 - RNA, 14 nt, Homo sapiens
ucaugccucugagg

SEQ ID NO: 880055 - RNA, 17 nt, Homo sapiens
ucauggaaacuggccag

SEQ ID NO: 880056 - RNA, 17 nt, Homo sapiens
ucauggcagcuaagcca

SEQ ID NO: 880057 - RNA, 13 nt, Homo sapiens
ucauggcauucac

SEQ ID NO: 880058 - RNA, 19 nt, Homo sapiens
ucauggugacuaacaguua

SEQ ID NO: 880059 - RNA, 14 nt, Homo sapiens
ucauguaccaucaa

SEQ ID NO: 880060 - RNA, 22 nt, Homo sapiens
ucauguauauguguucauuaaa

SEQ ID NO: 880061 - RNA, 12 nt, Homo sapiens
ucaugugccugg

SEQ ID NO: 880062 - RNA, 14 nt, Homo sapiens
ucaugugugcaugu

SEQ ID NO: 880063 - RNA, 13 nt, Homo sapiens
ucauuagcuguga

SEQ ID NO: 880064 - RNA, 16 nt, Homo sapiens
ucauuagcugugauuu

SEQ ID NO: 880065 - RNA, 20 nt, Homo sapiens
ucauuaucucaaaacugcac

SEQ ID NO: 880066 - RNA, 22 nt, Homo sapiens
ucauuauuuuuuacaauggcca

SEQ ID NO: 880067 - RNA, 16 nt, Homo sapiens
ucauucaagccuguga

SEQ ID NO: 880068 - RNA, 15 nt, Homo sapiens
ucauucagaccagug

SEQ ID NO: 880069 - RNA, 19 nt, Homo sapiens
ucauucauuuaacagagcu

SEQ ID NO: 880070 - RNA, 13 nt, Homo sapiens
ucauuccaccuuc

SEQ ID NO: 880071 - RNA, 21 nt, Homo sapiens
ugcuuuguuuccauucuuguc

SEQ ID NO: 880072 - RNA, 15 nt, Homo sapiens
ugcuuuuuccagauu

SEQ ID NO: 880073 - RNA, 16 nt, Homo sapiens
ugcuuuuugacaugaa

SEQ ID NO: 880074 - RNA, 13 nt, Homo sapiens
uggaaaagcaaaa

SEQ ID NO: 880075 - RNA, 19 nt, Homo sapiens
uggaaaagcaaaacuguag

SEQ ID NO: 880076 - RNA, 21 nt, Homo sapiens
uggaaaagucacacagacaca

SEQ ID NO: 880077 - RNA, 17 nt, Homo sapiens
uggaaaaucacaccacc

SEQ ID NO: 880078 - RNA, 14 nt, Homo sapiens
uggaaaaugugacc

SEQ ID NO: 880079 - RNA, 17 nt, Homo sapiens
uggaaaaugugacccag

SEQ ID NO: 880080 - RNA, 14 nt, Homo sapiens
uggaaaaugugcaa

SEQ ID NO: 880081 - RNA, 15 nt, Homo sapiens
uggaaaaugugcaau

SEQ ID NO: 880082 - RNA, 17 nt, Homo sapiens
uggaaagaaucuaauag

SEQ ID NO: 880083 - RNA, 20 nt, Homo sapiens
uggaaagccucugcugccau

SEQ ID NO: 880084 - RNA, 15 nt, Homo sapiens
uggaaaguucagcca

SEQ ID NO: 880085 - RNA, 19 nt, Homo sapiens
uggaaauccuguuacuuaa

SEQ ID NO: 880086 - RNA, 12 nt, Homo sapiens
uggaaaucuguu

SEQ ID NO: 880087 - RNA, 21 nt, Homo sapiens
uggaaaugucuuucuauucau

SEQ ID NO: 880088 - RNA, 18 nt, Homo sapiens
uggaaauuaaacccugcc

SEQ ID NO: 880089 - RNA, 16 nt, Homo sapiens
uggaacacucucugag

SEQ ID NO: 880090 - RNA, 18 nt, Homo sapiens
uggaacacucucugagau

SEQ ID NO: 880091 - RNA, 15 nt, Homo sapiens
uggaacagugcagga

SEQ ID NO: 880092 - RNA, 15 nt, Homo sapiens
uggaacccaggaccu

SEQ ID NO: 880093 - RNA, 16 nt, Homo sapiens
uggaacccccagaaua

SEQ ID NO: 880094 - RNA, 23 nt, Homo sapiens
uggaacuacauuaguacacagca

SEQ ID NO: 880095 - RNA, 15 nt, Homo sapiens
uggaacucaaggaaa

SEQ ID NO: 880096 - RNA, 15 nt, Homo sapiens
uggaacugucucuca

SEQ ID NO: 880097 - RNA, 20 nt, Homo sapiens
uggaagaaggaaacaccgag

SEQ ID NO: 880098 - RNA, 22 nt, Homo sapiens
uggaagaaggaagaagccagac

SEQ ID NO: 880099 - RNA, 17 nt, Homo sapiens
uggaagacuaucuuacu

SEQ ID NO: 880100 - RNA, 18 nt, Homo sapiens
uggaagaggcaccugucc

SEQ ID NO: 880101 - RNA, 20 nt, Homo sapiens
uggaagaggcaccuguccca

SEQ ID NO: 880102 - RNA, 17 nt, Homo sapiens
uggaagcucugaaguca

SEQ ID NO: 880103 - RNA, 22 nt, Homo sapiens
uggaagcucugaagucacauca

SEQ ID NO: 880104 - RNA, 15 nt, Homo sapiens
uggaaggcccacugu

SEQ ID NO: 880105 - RNA, 21 nt, Homo sapiens
uggaauacuugaaaaccucau

SEQ ID NO: 880106 - RNA, 19 nt, Homo sapiens
uggaaucagcuuuuaauaa

SEQ ID NO: 880107 - RNA, 21 nt, Homo sapiens
uggaauccuuucagcaagacu

SEQ ID NO: 880108 - RNA, 19 nt, Homo sapiens
uggaauugcugcucucuga

SEQ ID NO: 880109 - RNA, 17 nt, Homo sapiens
uggaauuuguaaguuua

SEQ ID NO: 880110 - RNA, 15 nt, Homo sapiens
uggacaaaauggaag

SEQ ID NO: 880111 - RNA, 22 nt, Homo sapiens
uggacaauaugaaucuuuucca

SEQ ID NO: 880112 - RNA, 15 nt, Homo sapiens
uggacauaagacaga

SEQ ID NO: 880113 - RNA, 17 nt, Homo sapiens
uggacauaagacagaca

SEQ ID NO: 880114 - RNA, 24 nt, Homo sapiens
uggacaucauguuuucuggugaug

SEQ ID NO: 880115 - RNA, 13 nt, Homo sapiens
uggacaugauuua

SEQ ID NO: 880116 - RNA, 14 nt, Homo sapiens
uggacauuugccuu

SEQ ID NO: 880117 - RNA, 13 nt, Homo sapiens
uggaccacaggca

SEQ ID NO: 880118 - RNA, 12 nt, Homo sapiens
uggaccaguaga

SEQ ID NO: 880119 - RNA, 19 nt, Homo sapiens
uggaccuauguccuaagga

SEQ ID NO: 880120 - RNA, 17 nt, Homo sapiens
uggacucugcacauguc

SEQ ID NO: 880121 - RNA, 11 nt, Homo sapiens
uggacugggag

SEQ ID NO: 880122 - RNA, 15 nt, Homo sapiens
uggagaaaaugaaga

SEQ ID NO: 880123 - RNA, 19 nt, Homo sapiens
uggagaaauaaaaauaccu

SEQ ID NO: 880124 - RNA, 22 nt, Homo sapiens
uggagaccaggccugagcaaca

SEQ ID NO: 880125 - RNA, 15 nt, Homo sapiens
uggagagaacugaau

SEQ ID NO: 880126 - RNA, 17 nt, Homo sapiens
uggagauuggcucccaa

SEQ ID NO: 880127 - RNA, 20 nt, Homo sapiens
uggagcaagugacaugccau

SEQ ID NO: 880128 - RNA, 21 nt, Homo sapiens
uggagcaagugacaugccauc

SEQ ID NO: 880129 - RNA, 21 nt, Homo sapiens
uggagcccagcauucaggggu

SEQ ID NO: 880130 - RNA, 15 nt, Homo sapiens
uggagcccgugcagu

SEQ ID NO: 880131 - RNA, 18 nt, Homo sapiens
uggagcuggcuuugccaa

SEQ ID NO: 880132 - RNA, 23 nt, Homo sapiens
uggaggacagugggaacuggagg

SEQ ID NO: 880133 - RNA, 19 nt, Homo sapiens
uggaggacuagaaccugga

SEQ ID NO: 880134 - RNA, 17 nt, Homo sapiens
uggaggagaaggacauu

SEQ ID NO: 880135 - RNA, 23 nt, Homo sapiens
uggaggagcugggcuucugucca

SEQ ID NO: 880136 - RNA, 19 nt, Homo sapiens
uggaggccucacacccaga

SEQ ID NO: 880137 - RNA, 14 nt, Homo sapiens
uggagggaauuuga

SEQ ID NO: 880138 - RNA, 19 nt, Homo sapiens
uggagggcuggaaucugga

SEQ ID NO: 880139 - RNA, 14 nt, Homo sapiens
uggagguugcagug

SEQ ID NO: 880140 - RNA, 15 nt, Homo sapiens
uggagguugcaguga

SEQ ID NO: 880141 - RNA, 16 nt, Homo sapiens
uggaguauaauauuca

SEQ ID NO: 880142 - RNA, 15 nt, Homo sapiens
uggaguggacauuca

SEQ ID NO: 880143 - RNA, 17 nt, Homo sapiens
uggaguucuugugccau

SEQ ID NO: 880144 - RNA, 18 nt, Homo sapiens
uggaguuugacauuguau

SEQ ID NO: 880145 - RNA, 20 nt, Homo sapiens
uggauaauaacuagaucucc

SEQ ID NO: 880146 - RNA, 19 nt, Homo sapiens
uggauacaagguuuggcaa

SEQ ID NO: 880147 - RNA, 21 nt, Homo sapiens
uggauacagaaugaaucccau

SEQ ID NO: 880148 - RNA, 17 nt, Homo sapiens
uggauauccacgcagca

SEQ ID NO: 880149 - RNA, 14 nt, Homo sapiens
uggauccacugugc

SEQ ID NO: 880150 - RNA, 19 nt, Homo sapiens
uggaucccaauucauuuca

SEQ ID NO: 880151 - RNA, 15 nt, Homo sapiens
uggaucucaagagcc

SEQ ID NO: 880152 - RNA, 19 nt, Homo sapiens
uggaucucacaagcacuuu

SEQ ID NO: 880153 - RNA, 14 nt, Homo sapiens
gcugggccccaccu

SEQ ID NO: 880154 - RNA, 15 nt, Homo sapiens
gcugggcucgccaca

SEQ ID NO: 880155 - RNA, 15 nt, Homo sapiens
gcugggcuucagugg

SEQ ID NO: 880156 - RNA, 18 nt, Homo sapiens
gcugggcuucaguggcag

SEQ ID NO: 880157 - RNA, 15 nt, Homo sapiens
gcuggggaacagagc

SEQ ID NO: 880158 - RNA, 14 nt, Homo sapiens
gcugguacuaagag

SEQ ID NO: 880159 - RNA, 12 nt, Homo sapiens
gcugguccugag

SEQ ID NO: 880160 - RNA, 21 nt, Homo sapiens
gcugguccuucucguuugcuc

SEQ ID NO: 880161 - RNA, 19 nt, Homo sapiens
gcuggucucugcugaaggu

SEQ ID NO: 880162 - RNA, 16 nt, Homo sapiens
gcuggugccccacuga

SEQ ID NO: 880163 - RNA, 21 nt, Homo sapiens
gcuggugucugagcuucagua

SEQ ID NO: 880164 - RNA, 18 nt, Homo sapiens
gcuguauuuguucaguga

SEQ ID NO: 880165 - RNA, 16 nt, Homo sapiens
gcugucaacauucaaa

SEQ ID NO: 880166 - RNA, 16 nt, Homo sapiens
gcugucagcucaggug

SEQ ID NO: 880167 - RNA, 14 nt, Homo sapiens
gcugucgcaucuca

SEQ ID NO: 880168 - RNA, 19 nt, Homo sapiens
gcugucuccauaaugccac

SEQ ID NO: 880169 - RNA, 19 nt, Homo sapiens
gcuguggcuccugccuuga

SEQ ID NO: 880170 - RNA, 16 nt, Homo sapiens
gcuguggggcauagaa

SEQ ID NO: 880171 - RNA, 15 nt, Homo sapiens
gcugugggugcuaag

SEQ ID NO: 880172 - RNA, 16 nt, Homo sapiens
gcugugugaauuccca

SEQ ID NO: 880173 - RNA, 23 nt, Homo sapiens
gcuguucacagccagacuggcac

SEQ ID NO: 880174 - RNA, 15 nt, Homo sapiens
gcuguuccacuucuc

SEQ ID NO: 880175 - RNA, 13 nt, Homo sapiens
gcuguugagugag

SEQ ID NO: 880176 - RNA, 21 nt, Homo sapiens
gcuguuggacagcugcuugug

SEQ ID NO: 880177 - RNA, 21 nt, Homo sapiens
gcuguuuauuuauucacugua

SEQ ID NO: 880178 - RNA, 17 nt, Homo sapiens
gcuguuugauagcagaa

SEQ ID NO: 880179 - RNA, 14 nt, Homo sapiens
gcuguuugucuaua

SEQ ID NO: 880180 - RNA, 19 nt, Homo sapiens
gcuguuuuuauauauguga

SEQ ID NO: 880181 - RNA, 22 nt, Homo sapiens
gcuuaauggcucaugaccugga

SEQ ID NO: 880182 - RNA, 14 nt, Homo sapiens
gcuuacuaaugugc

SEQ ID NO: 880183 - RNA, 14 nt, Homo sapiens
gcuuagccuccuga

SEQ ID NO: 880184 - RNA, 15 nt, Homo sapiens
gcuuaggacuuucca

SEQ ID NO: 880185 - RNA, 14 nt, Homo sapiens
gcuuaguaucucau

SEQ ID NO: 880186 - RNA, 21 nt, Homo sapiens
ggagccuggcuccguccagga

SEQ ID NO: 880187 - RNA, 16 nt, Homo sapiens
ggagcgaagcagagag

SEQ ID NO: 880188 - RNA, 19 nt, Homo sapiens
ggagcugccuguucagcuc

SEQ ID NO: 880189 - RNA, 16 nt, Homo sapiens
ggagcuuccagugcau

SEQ ID NO: 880190 - RNA, 15 nt, Homo sapiens
ggagcuugauccaga

SEQ ID NO: 880191 - RNA, 19 nt, Homo sapiens
ggaggaucgccugagccca

SEQ ID NO: 880192 - RNA, 12 nt, Homo sapiens
ggaggauguucu

SEQ ID NO: 880193 - RNA, 23 nt, Homo sapiens
ggaggcaccacgaagcugugaac

SEQ ID NO: 880194 - RNA, 16 nt, Homo sapiens
ggaggcaugccucuga

SEQ ID NO: 880195 - RNA, 22 nt, Homo sapiens
ggaggccgaagcuaacagggaa

SEQ ID NO: 880196 - RNA, 20 nt, Homo sapiens
ggaggcggagguugcaguga

SEQ ID NO: 880197 - RNA, 21 nt, Homo sapiens
ggaggcggcacauuggcagug

SEQ ID NO: 880198 - RNA, 16 nt, Homo sapiens
ggaggcugcggccuag

SEQ ID NO: 880199 - RNA, 21 nt, Homo sapiens
ggaggcugcucggggugcaca

SEQ ID NO: 880200 - RNA, 20 nt, Homo sapiens
ggagggacacuuacccaagg

SEQ ID NO: 880201 - RNA, 22 nt, Homo sapiens
ggagguagcucccagcacucaa

SEQ ID NO: 880202 - RNA, 15 nt, Homo sapiens
ggaggugaagucccu

SEQ ID NO: 880203 - RNA, 20 nt, Homo sapiens
ggagguggagguugcaguga

SEQ ID NO: 880204 - RNA, 16 nt, Homo sapiens
ggaggugggagacaag

SEQ ID NO: 880205 - RNA, 17 nt, Homo sapiens
ggagguuccggugucug

SEQ ID NO: 880206 - RNA, 22 nt, Homo sapiens
ggaguaaucaggcagccuucau

SEQ ID NO: 880207 - RNA, 18 nt, Homo sapiens
ggaguagaaaaaucucau

SEQ ID NO: 880208 - RNA, 20 nt, Homo sapiens
ggaguagcauggacucuggg

SEQ ID NO: 880209 - RNA, 23 nt, Homo sapiens
ggaguaguugcuacucuucagaa

SEQ ID NO: 880210 - RNA, 20 nt, Homo sapiens
ggagugacggucccacacug

SEQ ID NO: 880211 - RNA, 14 nt, Homo sapiens
ggagugagaucuua

SEQ ID NO: 880212 - RNA, 17 nt, Homo sapiens
ggagugagaucuuacag

SEQ ID NO: 880213 - RNA, 18 nt, Homo sapiens
ggaguuugacgagcucac

SEQ ID NO: 880214 - RNA, 19 nt, Homo sapiens
ggauaccagauauuugaau

SEQ ID NO: 880215 - RNA, 20 nt, Homo sapiens
ggauaguccaaagacuuaac

SEQ ID NO: 880216 - RNA, 20 nt, Homo sapiens
ggauaucuguguauaugccc

SEQ ID NO: 880217 - RNA, 18 nt, Homo sapiens
ggaucaagaaggggacag

SEQ ID NO: 880218 - RNA, 20 nt, Homo sapiens
ggaucacaaggucacuagau

SEQ ID NO: 880219 - RNA, 19 nt, Homo sapiens
ggaucacuugaguucagga

SEQ ID NO: 880220 - RNA, 21 nt, Homo sapiens
ggauccuauucucaccaggaa

SEQ ID NO: 880221 - RNA, 16 nt, Homo sapiens
ggaucuguccaaggaa

SEQ ID NO: 880222 - RNA, 19 nt, Homo sapiens
ggaugaucuugauuguggg

SEQ ID NO: 880223 - RNA, 21 nt, Homo sapiens
ggauggaauccuacagccucc

SEQ ID NO: 880224 - RNA, 23 nt, Homo sapiens
ggauggcacuccggccaccuccu

SEQ ID NO: 880225 - RNA, 22 nt, Homo sapiens
ggaugucuccaucucugucuca

SEQ ID NO: 880226 - RNA, 16 nt, Homo sapiens
ggaugugcauucucca

SEQ ID NO: 880227 - RNA, 15 nt, Homo sapiens
ggauguguuuugcac

SEQ ID NO: 880228 - RNA, 21 nt, Homo sapiens
ggauuaauguuuuguacaauu

SEQ ID NO: 880229 - RNA, 18 nt, Homo sapiens
ggauuccagcauuugcca

SEQ ID NO: 880230 - RNA, 15 nt, Homo sapiens
ggauugcagacucau

SEQ ID NO: 880231 - RNA, 15 nt, Homo sapiens
ggauuuauauucaag

SEQ ID NO: 880232 - RNA, 14 nt, Homo sapiens
ggauuuccucccuc

SEQ ID NO: 880233 - RNA, 23 nt, Homo sapiens
ggauuuuuuuguuuucugaugac

SEQ ID NO: 880234 - RNA, 18 nt, Homo sapiens
ggcaaagaaaagccagag

SEQ ID NO: 880235 - RNA, 15 nt, Homo sapiens
ggcaaagagaccacu

SEQ ID NO: 880236 - RNA, 18 nt, Homo sapiens
ggcaaagugagacugaca

SEQ ID NO: 880237 - RNA, 18 nt, Homo sapiens
ggcaacagagcaagaucc

SEQ ID NO: 880238 - RNA, 18 nt, Homo sapiens
ggcaacagaugaagaccc

SEQ ID NO: 880239 - RNA, 18 nt, Homo sapiens
ggcaacauaguaagaccc

SEQ ID NO: 880240 - RNA, 15 nt, Homo sapiens
ggcaacccaccaucu

SEQ ID NO: 880241 - RNA, 19 nt, Homo sapiens
ggcaacccucacuguguug

SEQ ID NO: 880242 - RNA, 14 nt, Homo sapiens
ggcaacucggagag

SEQ ID NO: 880243 - RNA, 16 nt, Homo sapiens
ggcaagggcaacccac

SEQ ID NO: 880244 - RNA, 12 nt, Homo sapiens
ggcaagugauau

SEQ ID NO: 880245 - RNA, 16 nt, Homo sapiens
ggcaauaaaugcccuc

SEQ ID NO: 880246 - RNA, 16 nt, Homo sapiens
ggcaauaucuuuaaua

SEQ ID NO: 880247 - RNA, 21 nt, Homo sapiens
ggcaauuuuuuuauacuacca

SEQ ID NO: 880248 - RNA, 15 nt, Homo sapiens
ggcacaccgggcacu

SEQ ID NO: 880249 - RNA, 21 nt, Homo sapiens
ggcacagccagccaaccuaag

SEQ ID NO: 880250 - RNA, 20 nt, Homo sapiens
ggcaccacaggcugccucau

SEQ ID NO: 880251 - RNA, 16 nt, Homo sapiens
ggcacccaauguuuga

SEQ ID NO: 880252 - RNA, 22 nt, Homo sapiens
ggcaccuccuacgucaaacaug

SEQ ID NO: 880253 - RNA, 16 nt, Homo sapiens
ggcacgccaacagccc

SEQ ID NO: 880254 - RNA, 22 nt, Homo sapiens
ggcagaaaacacagccugugua

SEQ ID NO: 880255 - RNA, 22 nt, Homo sapiens
ggcagagacaauaaaacauucc

SEQ ID NO: 880256 - RNA, 13 nt, Homo sapiens
ggcagagccuuug

SEQ ID NO: 880257 - RNA, 16 nt, Homo sapiens
ggcagcacucagugag

SEQ ID NO: 880258 - RNA, 18 nt, Homo sapiens
ggcagcauagcaagacac

SEQ ID NO: 880259 - RNA, 18 nt, Homo sapiens
ggcagccaggcuggcaga

SEQ ID NO: 880260 - RNA, 23 nt, Homo sapiens
ggcagcugauuuugucacugucu

SEQ ID NO: 880261 - RNA, 22 nt, Homo sapiens
ggcagcuguagcucccgagcua

SEQ ID NO: 880262 - RNA, 16 nt, Homo sapiens
ggcagcugucauggaa

SEQ ID NO: 880263 - RNA, 16 nt, Homo sapiens
ggcagcugucauucag

SEQ ID NO: 880264 - RNA, 17 nt, Homo sapiens
ggcaguccagccagcuc

SEQ ID NO: 880265 - RNA, 23 nt, Homo sapiens
ggcaguguaugcucauacuugga

SEQ ID NO: 880266 - RNA, 14 nt, Homo sapiens
ggcaguuacagggc

SEQ ID NO: 880267 - RNA, 22 nt, Homo sapiens
ggcaguuacagggcccagguga

SEQ ID NO: 880268 - RNA, 20 nt, Homo sapiens
uggucacacagagauacgca

SEQ ID NO: 880269 - RNA, 17 nt, Homo sapiens
uggucauggacagauag

SEQ ID NO: 880270 - RNA, 18 nt, Homo sapiens
uggucauugccuugccaa

SEQ ID NO: 880271 - RNA, 16 nt, Homo sapiens
ugguccccacagccuc

SEQ ID NO: 880272 - RNA, 14 nt, Homo sapiens
ugguccgaucuuug

SEQ ID NO: 880273 - RNA, 14 nt, Homo sapiens
uggucugugcugcc

SEQ ID NO: 880274 - RNA, 21 nt, Homo sapiens
uggucuucacugccaugccuc

SEQ ID NO: 880275 - RNA, 16 nt, Homo sapiens
uggugaaaauguacug

SEQ ID NO: 880276 - RNA, 17 nt, Homo sapiens
uggugcacugagcugca

SEQ ID NO: 880277 - RNA, 14 nt, Homo sapiens
ugguggcaccagau

SEQ ID NO: 880278 - RNA, 12 nt, Homo sapiens
uggugggaaccc

SEQ ID NO: 880279 - RNA, 17 nt, Homo sapiens
uggugggggcagggaug

SEQ ID NO: 880280 - RNA, 17 nt, Homo sapiens
uggugggugccuguaau

SEQ ID NO: 880281 - RNA, 13 nt, Homo sapiens
uggugucuguccu

SEQ ID NO: 880282 - RNA, 17 nt, Homo sapiens
ugguguggccagcacuc

SEQ ID NO: 880283 - RNA, 23 nt, Homo sapiens
ugguguuguauacuucauuagca

SEQ ID NO: 880284 - RNA, 20 nt, Homo sapiens
ugguuauuucucaacaaagc

SEQ ID NO: 880285 - RNA, 15 nt, Homo sapiens
ugguuccuaagccug

SEQ ID NO: 880286 - RNA, 13 nt, Homo sapiens
ugguuuaugucau

SEQ ID NO: 880287 - RNA, 15 nt, Homo sapiens
ugguuuaugucauca

SEQ ID NO: 880288 - RNA, 16 nt, Homo sapiens
ugguuuaugucaucau

SEQ ID NO: 880289 - RNA, 21 nt, Homo sapiens
ugguuucauuucuacugugac

SEQ ID NO: 880290 - RNA, 19 nt, Homo sapiens
ugguuuuuugcaguucaca

SEQ ID NO: 880291 - RNA, 18 nt, Homo sapiens
uguaaaagagucaucugg

SEQ ID NO: 880292 - RNA, 19 nt, Homo sapiens
uguaaaauagaauguuacu

SEQ ID NO: 880293 - RNA, 15 nt, Homo sapiens
uguaaauacagugga

SEQ ID NO: 880294 - RNA, 13 nt, Homo sapiens
uguaaaugccaca

SEQ ID NO: 880295 - RNA, 17 nt, Homo sapiens
uguaaaugcucguguga

SEQ ID NO: 880296 - RNA, 23 nt, Homo sapiens
uguaacacagcugagagacuuuu

SEQ ID NO: 880297 - RNA, 14 nt, Homo sapiens
uguaacccgcucau

SEQ ID NO: 880298 - RNA, 11 nt, Homo sapiens
uguaacuauug

SEQ ID NO: 880299 - RNA, 18 nt, Homo sapiens
uguaacuucuuaaucuaa

SEQ ID NO: 880300 - RNA, 19 nt, Homo sapiens
ggggcaaagaaaagccaga

SEQ ID NO: 880301 - RNA, 23 nt, Homo sapiens
ggggcagcccugccugcggggga

SEQ ID NO: 880302 - RNA, 19 nt, Homo sapiens
ggggccuagggagccgcac

SEQ ID NO: 880303 - RNA, 14 nt, Homo sapiens
ggggccuguuacac

SEQ ID NO: 880304 - RNA, 17 nt, Homo sapiens
ggggcuuuuacaccagu

SEQ ID NO: 880305 - RNA, 14 nt, Homo sapiens
gggggagcuggaaa

SEQ ID NO: 880306 - RNA, 15 nt, Homo sapiens
gggggccgugcccag

SEQ ID NO: 880307 - RNA, 16 nt, Homo sapiens
gggggcggccuaugac

SEQ ID NO: 880308 - RNA, 17 nt, Homo sapiens
ggggguuuuuaaucuuu

SEQ ID NO: 880309 - RNA, 17 nt, Homo sapiens
gggguaugagcugccaa

SEQ ID NO: 880310 - RNA, 15 nt, Homo sapiens
gggguccugauuuca

SEQ ID NO: 880311 - RNA, 20 nt, Homo sapiens
ggggucuguauauacauuuc

SEQ ID NO: 880312 - RNA, 17 nt, Homo sapiens
ggggucuguguggugcc

SEQ ID NO: 880313 - RNA, 19 nt, Homo sapiens
ggguaaccaaauguuggcc

SEQ ID NO: 880314 - RNA, 18 nt, Homo sapiens
ggguaagguaugggagag

SEQ ID NO: 880315 - RNA, 19 nt, Homo sapiens
ggguauuuaccacagcagc

SEQ ID NO: 880316 - RNA, 21 nt, Homo sapiens
gggucaaagccgguugcagag

SEQ ID NO: 880317 - RNA, 15 nt, Homo sapiens
gggucaucgauucaa

SEQ ID NO: 880318 - RNA, 23 nt, Homo sapiens
gggucccugauaacaaccuggag

SEQ ID NO: 880319 - RNA, 16 nt, Homo sapiens
gggucuguguggugcc

SEQ ID NO: 880320 - RNA, 14 nt, Homo sapiens
gggugccccacuaa

SEQ ID NO: 880321 - RNA, 11 nt, Homo sapiens
gggugggagag

SEQ ID NO: 880322 - RNA, 16 nt, Homo sapiens
gggugggccacucucc

SEQ ID NO: 880323 - RNA, 16 nt, Homo sapiens
ggguggggggaaugag

SEQ ID NO: 880324 - RNA, 12 nt, Homo sapiens
gggugugucucu

SEQ ID NO: 880325 - RNA, 13 nt, Homo sapiens
ggguguguguagc

SEQ ID NO: 880326 - RNA, 23 nt, Homo sapiens
ggguucccccucccugugugaaa

SEQ ID NO: 880327 - RNA, 17 nt, Homo sapiens
gguaaaaccccaucucu

SEQ ID NO: 880328 - RNA, 15 nt, Homo sapiens
gguaaaaguuacuua

SEQ ID NO: 880329 - RNA, 14 nt, Homo sapiens
gguaaacauucucu

SEQ ID NO: 880330 - RNA, 14 nt, Homo sapiens
gguaauuguugcua

SEQ ID NO: 880331 - RNA, 22 nt, Homo sapiens
gguaauuugauacugaccuugu

SEQ ID NO: 880332 - RNA, 16 nt, Homo sapiens
gguacauuucccugug

SEQ ID NO: 880333 - RNA, 14 nt, Homo sapiens
gguagcgagcugcu

SEQ ID NO: 880334 - RNA, 16 nt, Homo sapiens
gguagcuuaccugaca

SEQ ID NO: 880335 - RNA, 13 nt, Homo sapiens
gguaggccaagcu

SEQ ID NO: 880336 - RNA, 20 nt, Homo sapiens
gguaguacuccugcaaaauu

SEQ ID NO: 880337 - RNA, 20 nt, Homo sapiens
gguauaaugguugacugggu

SEQ ID NO: 880338 - RNA, 17 nt, Homo sapiens
gguauaauuuuuaucca

SEQ ID NO: 880339 - RNA, 13 nt, Homo sapiens
gguauauuuccau

SEQ ID NO: 880340 - RNA, 13 nt, Homo sapiens
gguaucaggugcu

SEQ ID NO: 880341 - RNA, 21 nt, Homo sapiens
gguauuaaauugauguugcug

SEQ ID NO: 880342 - RNA, 14 nt, Homo sapiens
gguauuaauaugcu

SEQ ID NO: 880343 - RNA, 18 nt, Homo sapiens
ggucaaaauagugccacu

SEQ ID NO: 880344 - RNA, 15 nt, Homo sapiens
ggucacauucaggaa

SEQ ID NO: 880345 - RNA, 14 nt, Homo sapiens
ggucagcgugcuua

SEQ ID NO: 880346 - RNA, 19 nt, Homo sapiens
ggucagguguucaagacca

SEQ ID NO: 880347 - RNA, 18 nt, Homo sapiens
gguccacccagcaaagag

SEQ ID NO: 880348 - RNA, 22 nt, Homo sapiens
gguccagcuugcucuucagugg

SEQ ID NO: 880349 - RNA, 23 nt, Homo sapiens
gguccuaacccccuuacugugcg

SEQ ID NO: 880350 - RNA, 18 nt, Homo sapiens
ggucggggggguccccau

SEQ ID NO: 880351 - RNA, 18 nt, Homo sapiens
ggucuccgcacuuggaaa

SEQ ID NO: 880352 - RNA, 15 nt, Homo sapiens
ggucuccuugcacuu

SEQ ID NO: 880353 - RNA, 16 nt, Homo sapiens
ggucugauuucaggau

SEQ ID NO: 880354 - RNA, 20 nt, Homo sapiens
ggucuuggccgacucaggga

SEQ ID NO: 880355 - RNA, 20 nt, Homo sapiens
ggucuuugcaagaaucauua

SEQ ID NO: 880356 - RNA, 23 nt, Homo sapiens
ggugaagaacaucccaagccaga

SEQ ID NO: 880357 - RNA, 19 nt, Homo sapiens
ggugcacuuuucuguguca

SEQ ID NO: 880358 - RNA, 15 nt, Homo sapiens
ggugcagaggugagc

SEQ ID NO: 880359 - RNA, 22 nt, Homo sapiens
ggugccuucucacaucugucca

SEQ ID NO: 880360 - RNA, 22 nt, Homo sapiens
ggugcgaucuuggcucacugca

SEQ ID NO: 880361 - RNA, 18 nt, Homo sapiens
ggugcugugguggggaga

SEQ ID NO: 880362 - RNA, 12 nt, Homo sapiens
ggugcuucagga

SEQ ID NO: 880363 - RNA, 17 nt, Homo sapiens
gguggagguugcaguga

SEQ ID NO: 880364 - RNA, 16 nt, Homo sapiens
gguggaucuguccaag

SEQ ID NO: 880365 - RNA, 13 nt, Homo sapiens
gguggaugccugg

SEQ ID NO: 880366 - RNA, 16 nt, Homo sapiens
gguggcucuccaguua

SEQ ID NO: 880367 - RNA, 19 nt, Homo sapiens
ggugggccuccucugucca

SEQ ID NO: 880368 - RNA, 18 nt, Homo sapiens
gguguaaaauaucuaccu

SEQ ID NO: 880369 - RNA, 13 nt, Homo sapiens
gguguauuugcca

SEQ ID NO: 880370 - RNA, 19 nt, Homo sapiens
gguguauuugccagcuuua

SEQ ID NO: 880371 - RNA, 22 nt, Homo sapiens
ggugucauacagauuugcaaag

SEQ ID NO: 880372 - RNA, 18 nt, Homo sapiens
ggugucuagcauuaacuu

SEQ ID NO: 880373 - RNA, 19 nt, Homo sapiens
ggugucuggaaaagcacuu

SEQ ID NO: 880374 - RNA, 15 nt, Homo sapiens
gguguuuaaagucaa

SEQ ID NO: 880375 - RNA, 17 nt, Homo sapiens
gguuaccuuuguuccca

SEQ ID NO: 880376 - RNA, 20 nt, Homo sapiens
gguuaggauuuaacagucau

SEQ ID NO: 880377 - RNA, 15 nt, Homo sapiens
gguuauagacugcca

SEQ ID NO: 880378 - RNA, 19 nt, Homo sapiens
gguucagcuaagcuaggaa

SEQ ID NO: 880379 - RNA, 23 nt, Homo sapiens
gguucugaaaguggcucuucuaa

SEQ ID NO: 880380 - RNA, 23 nt, Homo sapiens
gguucuggggaggaagggccagg

SEQ ID NO: 880381 - RNA, 18 nt, Homo sapiens
gguucuuuagcugucacu

SEQ ID NO: 880382 - RNA, 21 nt, Homo sapiens
gguugaaacuguuaucacuua

SEQ ID NO: 880383 - RNA, 12 nt, Homo sapiens
gguugaaggcag

SEQ ID NO: 880384 - RNA, 16 nt, Homo sapiens
uguuauuuguacaguu

SEQ ID NO: 880385 - RNA, 18 nt, Homo sapiens
uguuauuuguacaguuca

SEQ ID NO: 880386 - RNA, 20 nt, Homo sapiens
uguucacagccagacuggca

SEQ ID NO: 880387 - RNA, 17 nt, Homo sapiens
uguucagcuccagcuca

SEQ ID NO: 880388 - RNA, 15 nt, Homo sapiens
uguucaguugacuua

SEQ ID NO: 880389 - RNA, 18 nt, Homo sapiens
uguucauguuacucauga

SEQ ID NO: 880390 - RNA, 12 nt, Homo sapiens
uguucauuuccu

SEQ ID NO: 880391 - RNA, 17 nt, Homo sapiens
uguuccugaugugccag

SEQ ID NO: 880392 - RNA, 21 nt, Homo sapiens
uguucuacaugaggacucaua

SEQ ID NO: 880393 - RNA, 16 nt, Homo sapiens
uguucugggacacagu

SEQ ID NO: 880394 - RNA, 15 nt, Homo sapiens
uguucugucaccaau

SEQ ID NO: 880395 - RNA, 21 nt, Homo sapiens
uguucuguccaguuuccaaag

SEQ ID NO: 880396 - RNA, 16 nt, Homo sapiens
uguucuguugauccca

SEQ ID NO: 880397 - RNA, 20 nt, Homo sapiens
uguucuugcugagcacccuc

SEQ ID NO: 880398 - RNA, 18 nt, Homo sapiens
uguugaagccacugccuu

SEQ ID NO: 880399 - RNA, 13 nt, Homo sapiens
uguugacaugugc

SEQ ID NO: 880400 - RNA, 14 nt, Homo sapiens
uguugacaugugcu

SEQ ID NO: 880401 - RNA, 12 nt, Homo sapiens
uguugaucccaa

SEQ ID NO: 880402 - RNA, 21 nt, Homo sapiens
uguugaugaggccucuuggac

SEQ ID NO: 880403 - RNA, 14 nt, Homo sapiens
uguugauuacauaa

SEQ ID NO: 880404 - RNA, 21 nt, Homo sapiens
uguuggaaaggaccuuaccug

SEQ ID NO: 880405 - RNA, 19 nt, Homo sapiens
uguuggacccgcucuggac

SEQ ID NO: 880406 - RNA, 20 nt, Homo sapiens
uguuggccaaagccaaagcu

SEQ ID NO: 880407 - RNA, 15 nt, Homo sapiens
uguugguuuccaaaa

SEQ ID NO: 880408 - RNA, 23 nt, Homo sapiens
uguuguaaauaaaaguauuuaau

SEQ ID NO: 880409 - RNA, 17 nt, Homo sapiens
uguuguacauacagagg

SEQ ID NO: 880410 - RNA, 22 nt, Homo sapiens
uguuguacuuuuuauucaauuc

SEQ ID NO: 880411 - RNA, 14 nt, Homo sapiens
uguuguccaggaaa

SEQ ID NO: 880412 - RNA, 21 nt, Homo sapiens
uguuuaaaaucauuucugcau

SEQ ID NO: 880413 - RNA, 15 nt, Homo sapiens
uguuuaaguggcuuu

SEQ ID NO: 880414 - RNA, 18 nt, Homo sapiens
uguuuaccucuucuaugc

SEQ ID NO: 880415 - RNA, 20 nt, Homo sapiens
aaaaaauuaaauugcagaug

SEQ ID NO: 880416 - RNA, 12 nt, Homo sapiens
aaaaaauuccgg

SEQ ID NO: 880417 - RNA, 13 nt, Homo sapiens
aaaaacauuugua

SEQ ID NO: 880418 - RNA, 11 nt, Homo sapiens
aaaaacuaaaa

SEQ ID NO: 880419 - RNA, 12 nt, Homo sapiens
aaaaacuugggu

SEQ ID NO: 880420 - RNA, 15 nt, Homo sapiens
aaaaagccaucugau

SEQ ID NO: 880421 - RNA, 16 nt, Homo sapiens
aaaaaggcauaugcaa

SEQ ID NO: 880422 - RNA, 21 nt, Homo sapiens
aaaaagggauccguacauuca

SEQ ID NO: 880423 - RNA, 16 nt, Homo sapiens
aaaaaguaaaugugau

SEQ ID NO: 880424 - RNA, 15 nt, Homo sapiens
aaaaaguaugugaau

SEQ ID NO: 880425 - RNA, 17 nt, Homo sapiens
aaaaaguuaaucuucau

SEQ ID NO: 880426 - RNA, 15 nt, Homo sapiens
aaaaaguugcacauu

SEQ ID NO: 880427 - RNA, 23 nt, Homo sapiens
aaaaauaaagcuacugaauuuau

SEQ ID NO: 880428 - RNA, 15 nt, Homo sapiens
aaaaauaagcuuuau

SEQ ID NO: 880429 - RNA, 23 nt, Homo sapiens
aaaaauagaaaauuuucuagucc

SEQ ID NO: 880430 - RNA, 13 nt, Homo sapiens
aaaaauauuauaa

SEQ ID NO: 880431 - RNA, 21 nt, Homo sapiens
aaaaaucaugagauccuuuaa

SEQ ID NO: 880432 - RNA, 13 nt, Homo sapiens
aaaaaucuuugau

SEQ ID NO: 880433 - RNA, 14 nt, Homo sapiens
aaaaaugacuaaaa

SEQ ID NO: 880434 - RNA, 12 nt, Homo sapiens
aaaaaugcacug

SEQ ID NO: 880435 - RNA, 16 nt, Homo sapiens
aaaaaugcauauacuu

SEQ ID NO: 880436 - RNA, 23 nt, Homo sapiens
aaaaauuaacaaaagauucugua

SEQ ID NO: 880437 - RNA, 24 nt, Homo sapiens
aaaaauugacuucuugcuuguaca

SEQ ID NO: 880438 - RNA, 13 nt, Homo sapiens
aaaaauugcacaa

SEQ ID NO: 880439 - RNA, 14 nt, Homo sapiens
aaaacaaacccagg

SEQ ID NO: 880440 - RNA, 17 nt, Homo sapiens
aaaacacaaaaguuucu

SEQ ID NO: 880441 - RNA, 16 nt, Homo sapiens
aaaacacccuuuccaa

SEQ ID NO: 880442 - RNA, 13 nt, Homo sapiens
aaaacacuuccau

SEQ ID NO: 880443 - RNA, 18 nt, Homo sapiens
aaaacagauuguuugcaa

SEQ ID NO: 880444 - RNA, 18 nt, Homo sapiens
aaaacagccucacagaag

SEQ ID NO: 880445 - RNA, 11 nt, Homo sapiens
aaaacauaugc

SEQ ID NO: 880446 - RNA, 12 nt, Homo sapiens
aaaacauaugca

SEQ ID NO: 880447 - RNA, 22 nt, Homo sapiens
aaaacauaugcauuaugaaguu

SEQ ID NO: 880448 - RNA, 16 nt, Homo sapiens
aaaaccaauagcuuua

SEQ ID NO: 880449 - RNA, 13 nt, Homo sapiens
aaaacccagagag

SEQ ID NO: 880450 - RNA, 14 nt, Homo sapiens
aaaaccccaucucu

SEQ ID NO: 880451 - RNA, 13 nt, Homo sapiens
aaaaccucacuug

SEQ ID NO: 880452 - RNA, 18 nt, Homo sapiens
aaaaccugugugccauuu

SEQ ID NO: 880453 - RNA, 20 nt, Homo sapiens
aaaacuaauuuccucugaca

SEQ ID NO: 880454 - RNA, 16 nt, Homo sapiens
aaaacuccaucucaaa

SEQ ID NO: 880455 - RNA, 11 nt, Homo sapiens
aaaacucuccu

SEQ ID NO: 880456 - RNA, 22 nt, Homo sapiens
aaaacucugggaaauaagagag

SEQ ID NO: 880457 - RNA, 11 nt, Homo sapiens
aaaacugacuc

SEQ ID NO: 880458 - RNA, 23 nt, Homo sapiens
aaaacugaucaaaaauaaacuag

SEQ ID NO: 880459 - RNA, 14 nt, Homo sapiens
aaaacuugcugccu

SEQ ID NO: 880460 - RNA, 15 nt, Homo sapiens
aaaacuuugacaaau

SEQ ID NO: 880461 - RNA, 18 nt, Homo sapiens
aaaacuuugacaaauuga

SEQ ID NO: 880462 - RNA, 20 nt, Homo sapiens
aaaagacauuuuuauuuagu

SEQ ID NO: 880463 - RNA, 15 nt, Homo sapiens
aaaagacuccaaaga

SEQ ID NO: 880464 - RNA, 15 nt, Homo sapiens
aaaagauuauauauc

SEQ ID NO: 880465 - RNA, 22 nt, Homo sapiens
aaaagauucccacccaauucaa

SEQ ID NO: 880466 - RNA, 23 nt, Homo sapiens
aaaagcaugacuauuuccaccau

SEQ ID NO: 880467 - RNA, 13 nt, Homo sapiens
aaaagcuuagcag

SEQ ID NO: 880468 - RNA, 21 nt, Homo sapiens
aaaagcuuuucuuuccuuuug

SEQ ID NO: 880469 - RNA, 18 nt, Homo sapiens
aaaaguaaguaccacuca

SEQ ID NO: 880470 - RNA, 14 nt, Homo sapiens
aaaaguacauguau

SEQ ID NO: 880471 - RNA, 12 nt, Homo sapiens
aaaaguacugaa

SEQ ID NO: 880472 - RNA, 19 nt, Homo sapiens
aaaaguagguuuacauuca

SEQ ID NO: 880473 - RNA, 14 nt, Homo sapiens
aaaaguauauauuc

SEQ ID NO: 880474 - RNA, 13 nt, Homo sapiens
aaaagucagucuu

SEQ ID NO: 880475 - RNA, 18 nt, Homo sapiens
aaaagucuacgcucuccu

SEQ ID NO: 880476 - RNA, 15 nt, Homo sapiens
aaaaguuaugguacu

SEQ ID NO: 880477 - RNA, 22 nt, Homo sapiens
aaaaguuuggccgggugcggug

SEQ ID NO: 880478 - RNA, 14 nt, Homo sapiens
aaaauaagcuuuau

SEQ ID NO: 880479 - RNA, 12 nt, Homo sapiens
aaaauacuacac

SEQ ID NO: 880480 - RNA, 13 nt, Homo sapiens
aaaauacuacaca

SEQ ID NO: 880481 - RNA, 15 nt, Homo sapiens
aaaauaguagaacaa

SEQ ID NO: 880482 - RNA, 14 nt, Homo sapiens
aaaauauauuucag

SEQ ID NO: 880483 - RNA, 14 nt, Homo sapiens
aaaauauggcuaua

SEQ ID NO: 880484 - RNA, 22 nt, Homo sapiens
aaaauauuuuuaugugcaauaa

SEQ ID NO: 880485 - RNA, 20 nt, Homo sapiens
aaaaucacaagcaauaauua

SEQ ID NO: 880486 - RNA, 22 nt, Homo sapiens
aaaaucacaaggcaacugugag

SEQ ID NO: 880487 - RNA, 14 nt, Homo sapiens
aaaaucaugaauau

SEQ ID NO: 880488 - RNA, 13 nt, Homo sapiens
aaaauccaacuaa

SEQ ID NO: 880489 - RNA, 14 nt, Homo sapiens
aaaaugaagcccua

SEQ ID NO: 880490 - RNA, 23 nt, Homo sapiens
aaaaugagcuaggcaugguggca

SEQ ID NO: 880491 - RNA, 18 nt, Homo sapiens
aaaaugaugggacaauaa

SEQ ID NO: 880492 - RNA, 15 nt, Homo sapiens
aaaaugcacugugac

SEQ ID NO: 880493 - RNA, 16 nt, Homo sapiens
aaaauggaaaagagag

SEQ ID NO: 880494 - RNA, 14 nt, Homo sapiens
aaaauggacauauu

SEQ ID NO: 880495 - RNA, 17 nt, Homo sapiens
aaaaugucagucugguu

SEQ ID NO: 880496 - RNA, 22 nt, Homo sapiens
aaaauguccucccuuguggcuu

SEQ ID NO: 880497 - RNA, 13 nt, Homo sapiens
aaaaugugcaaua

SEQ ID NO: 880498 - RNA, 15 nt, Homo sapiens
aaaaugugcaauaug

SEQ ID NO: 880499 - RNA, 16 nt, Homo sapiens
aaaaugugucuguaag

SEQ ID NO: 880500 - RNA, 13 nt, Homo sapiens
aaaauuaaauugc

SEQ ID NO: 880501 - RNA, 18 nt, Homo sapiens
aaaauuaaggucugggag

SEQ ID NO: 880502 - RNA, 15 nt, Homo sapiens
aaaauuauacucaaa

SEQ ID NO: 880503 - RNA, 17 nt, Homo sapiens
aaaauucagagaguuag

SEQ ID NO: 880504 - RNA, 15 nt, Homo sapiens
aaaauucuuggaaua

SEQ ID NO: 880505 - RNA, 16 nt, Homo sapiens
aaaauugaacuacuug

SEQ ID NO: 880506 - RNA, 17 nt, Homo sapiens
aaaauugacuucuugcu

SEQ ID NO: 880507 - RNA, 12 nt, Homo sapiens
aaaauugcacaa

SEQ ID NO: 880508 - RNA, 17 nt, Homo sapiens
aaaauugugaucagacc

SEQ ID NO: 880509 - RNA, 21 nt, Homo sapiens
aaaauuuaggaccaauaccuc

SEQ ID NO: 880510 - RNA, 20 nt, Homo sapiens
aaaauuuuucuagaagauau

SEQ ID NO: 880511 - RNA, 13 nt, Homo sapiens
aaacaaacccagg

SEQ ID NO: 880512 - RNA, 21 nt, Homo sapiens
aaacaaauaaucacauugacu

SEQ ID NO: 880513 - RNA, 15 nt, Homo sapiens
aaacaacuaccuccu

SEQ ID NO: 880514 - RNA, 16 nt, Homo sapiens
aaacaagcaacagaug

SEQ ID NO: 880515 - RNA, 14 nt, Homo sapiens
aaacaaguauuugu

SEQ ID NO: 880516 - RNA, 17 nt, Homo sapiens
aaacaaugaagacaauu

SEQ ID NO: 880517 - RNA, 17 nt, Homo sapiens
aaacaaugccaucacug

SEQ ID NO: 880518 - RNA, 20 nt, Homo sapiens
aaacaauuguaaauuucuuu

SEQ ID NO: 880519 - RNA, 22 nt, Homo sapiens
aaacacaagugcgccuugcaaa

SEQ ID NO: 880520 - RNA, 16 nt, Homo sapiens
aaacacagcuuuacaa

SEQ ID NO: 880521 - RNA, 20 nt, Homo sapiens
aaacacccaugaaucaaaga

SEQ ID NO: 880522 - RNA, 14 nt, Homo sapiens
aaacacccaugccc

SEQ ID NO: 880523 - RNA, 22 nt, Homo sapiens
aaacacuauauggcagugucuu

SEQ ID NO: 880524 - RNA, 11 nt, Homo sapiens
aaacacuccac

SEQ ID NO: 880525 - RNA, 13 nt, Homo sapiens
aaacacuucucau

SEQ ID NO: 880526 - RNA, 17 nt, Homo sapiens
aaacagagaacccugug

SEQ ID NO: 880527 - RNA, 18 nt, Homo sapiens
aaacagagaacccugugg

SEQ ID NO: 880528 - RNA, 22 nt, Homo sapiens
aaacagagacaggcccaagaga

SEQ ID NO: 880529 - RNA, 15 nt, Homo sapiens
aaacagagaugugau

SEQ ID NO: 880530 - RNA, 16 nt, Homo sapiens
aaacagggacaaagaa

SEQ ID NO: 880531 - RNA, 17 nt, Homo sapiens
aagagagacauugccuc

SEQ ID NO: 880532 - RNA, 20 nt, Homo sapiens
aagagaucacaauacucaaa

SEQ ID NO: 880533 - RNA, 21 nt, Homo sapiens
aagagauuucaacauaucauu

SEQ ID NO: 880534 - RNA, 18 nt, Homo sapiens
aagagcauagaacucaaa

SEQ ID NO: 880535 - RNA, 21 nt, Homo sapiens
aagagcaucaugccucugagg

SEQ ID NO: 880536 - RNA, 19 nt, Homo sapiens
aagagccugacuguguuca

SEQ ID NO: 880537 - RNA, 19 nt, Homo sapiens
aagagcuggcaaagguggc

SEQ ID NO: 880538 - RNA, 21 nt, Homo sapiens
aagagcuuacaagacccuaug

SEQ ID NO: 880539 - RNA, 18 nt, Homo sapiens
aagaggaaaaaaagccgu

SEQ ID NO: 880540 - RNA, 14 nt, Homo sapiens
aagaggacugagac

SEQ ID NO: 880541 - RNA, 14 nt, Homo sapiens
aagaggcagggucu

SEQ ID NO: 880542 - RNA, 14 nt, Homo sapiens
aagaggcagugaga

SEQ ID NO: 880543 - RNA, 22 nt, Homo sapiens
aagagggcgaguucagcaaaga

SEQ ID NO: 880544 - RNA, 14 nt, Homo sapiens
aagaggugacccca

SEQ ID NO: 880545 - RNA, 17 nt, Homo sapiens
aagaguauuuacaauaa

SEQ ID NO: 880546 - RNA, 22 nt, Homo sapiens
aagagucuuaauauauauaucc

SEQ ID NO: 880547 - RNA, 18 nt, Homo sapiens
aagaguuucuccuuuuga

SEQ ID NO: 880548 - RNA, 24 nt, Homo sapiens
aagaguuucuccuuuugaccaaau

SEQ ID NO: 880549 - RNA, 12 nt, Homo sapiens
aagauaaagguu

SEQ ID NO: 880550 - RNA, 21 nt, Homo sapiens
aagauaaauagaguuccaaau

SEQ ID NO: 880551 - RNA, 19 nt, Homo sapiens
aagauaacaagaucuuuca

SEQ ID NO: 880552 - RNA, 15 nt, Homo sapiens
aagauaacugagaau

SEQ ID NO: 880553 - RNA, 15 nt, Homo sapiens
aagauaauucacucu

SEQ ID NO: 880554 - RNA, 13 nt, Homo sapiens
aagauacacuccu

SEQ ID NO: 880555 - RNA, 23 nt, Homo sapiens
aagaucaaaagcuuauucaucug

SEQ ID NO: 880556 - RNA, 13 nt, Homo sapiens
aagauccacccuc

SEQ ID NO: 880557 - RNA, 21 nt, Homo sapiens
aagauccacccucaaauguca

SEQ ID NO: 880558 - RNA, 15 nt, Homo sapiens
aagaucuauauugua

SEQ ID NO: 880559 - RNA, 23 nt, Homo sapiens
aagaugagauuugccagcacagg

SEQ ID NO: 880560 - RNA, 20 nt, Homo sapiens
aagaugauucuggcugaaaa

SEQ ID NO: 880561 - RNA, 17 nt, Homo sapiens
aagauggauguuuguca

SEQ ID NO: 880562 - RNA, 18 nt, Homo sapiens
aagauggcugacuuugcu

SEQ ID NO: 880563 - RNA, 14 nt, Homo sapiens
aagauguaaggaau

SEQ ID NO: 880564 - RNA, 14 nt, Homo sapiens
aagauguacuugug

SEQ ID NO: 880565 - RNA, 15 nt, Homo sapiens
aagaugucaaauauc

SEQ ID NO: 880566 - RNA, 18 nt, Homo sapiens
aagaugucacaagggauu

SEQ ID NO: 880567 - RNA, 15 nt, Homo sapiens
aagaugugauuuauu

SEQ ID NO: 880568 - RNA, 15 nt, Homo sapiens
aagauuauauaucau

SEQ ID NO: 880569 - RNA, 18 nt, Homo sapiens
aagauuguccagugcaac

SEQ ID NO: 880570 - RNA, 16 nt, Homo sapiens
aagauuuuaugcugcu

SEQ ID NO: 880571 - RNA, 18 nt, Homo sapiens
aagcaaaacaauaaacua

SEQ ID NO: 880572 - RNA, 17 nt, Homo sapiens
aagcaaaggaaaccaaa

SEQ ID NO: 880573 - RNA, 11 nt, Homo sapiens
aagcaaauaga

SEQ ID NO: 880574 - RNA, 14 nt, Homo sapiens
aagcaaauggaugg

SEQ ID NO: 880575 - RNA, 11 nt, Homo sapiens
aagcaaccucc

SEQ ID NO: 880576 - RNA, 15 nt, Homo sapiens
aagcaaguggcuuuc

SEQ ID NO: 880577 - RNA, 13 nt, Homo sapiens
aagcaauugucug

SEQ ID NO: 880578 - RNA, 13 nt, Homo sapiens
aagcacaccucau

SEQ ID NO: 880579 - RNA, 15 nt, Homo sapiens
aagcagaagcacaua

SEQ ID NO: 880580 - RNA, 18 nt, Homo sapiens
aagcagguggcaucucua

SEQ ID NO: 880581 - RNA, 14 nt, Homo sapiens
aagcagguucuuga

SEQ ID NO: 880582 - RNA, 19 nt, Homo sapiens
aagcaguaagcuaucuuca

SEQ ID NO: 880583 - RNA, 15 nt, Homo sapiens
aagcaguccucccac

SEQ ID NO: 880584 - RNA, 21 nt, Homo sapiens
aagcagugccucgaggcaccg

SEQ ID NO: 880585 - RNA, 23 nt, Homo sapiens
aagcaguuguuauuuagugauau

SEQ ID NO: 880586 - RNA, 16 nt, Homo sapiens
aagcaucacuugggau

SEQ ID NO: 880587 - RNA, 11 nt, Homo sapiens
aagcauuguaa

SEQ ID NO: 880588 - RNA, 14 nt, Homo sapiens
aagcauuuacuuug

SEQ ID NO: 880589 - RNA, 15 nt, Homo sapiens
aagcauuuacuuuga

SEQ ID NO: 880590 - RNA, 17 nt, Homo sapiens
aagccacagaagccagg

SEQ ID NO: 880591 - RNA, 22 nt, Homo sapiens
aagccacguuaaguccaaggag

SEQ ID NO: 880592 - RNA, 11 nt, Homo sapiens
aagccacugcc

SEQ ID NO: 880593 - RNA, 13 nt, Homo sapiens
aagccacugccuu

SEQ ID NO: 880594 - RNA, 13 nt, Homo sapiens
aagccaggaguug

SEQ ID NO: 880595 - RNA, 13 nt, Homo sapiens
aagccaguggcag

SEQ ID NO: 880596 - RNA, 23 nt, Homo sapiens
aagccauaguggagagaacugaa

SEQ ID NO: 880597 - RNA, 16 nt, Homo sapiens
aagccauucacuuccc

SEQ ID NO: 880598 - RNA, 17 nt, Homo sapiens
aagcccaagugaaauca

SEQ ID NO: 880599 - RNA, 10 nt, Homo sapiens
aagcccaguu

SEQ ID NO: 880600 - RNA, 14 nt, Homo sapiens
aagccccaagccau

SEQ ID NO: 880601 - RNA, 22 nt, Homo sapiens
aagccccaccuuuaaguccucu

SEQ ID NO: 880602 - RNA, 20 nt, Homo sapiens
aagcccccacuucucuccag

SEQ ID NO: 880603 - RNA, 18 nt, Homo sapiens
aagcccccuacugagaaa

SEQ ID NO: 880604 - RNA, 18 nt, Homo sapiens
aagcccuccccaucccau

SEQ ID NO: 880605 - RNA, 13 nt, Homo sapiens
aagcccuugaacc

SEQ ID NO: 880606 - RNA, 15 nt, Homo sapiens
aagcccuuuacuuga

SEQ ID NO: 880607 - RNA, 15 nt, Homo sapiens
aagccggcucuucaa

SEQ ID NO: 880608 - RNA, 22 nt, Homo sapiens
aagccggcucuucaaagacaau

SEQ ID NO: 880609 - RNA, 13 nt, Homo sapiens
aagccugaggcug

SEQ ID NO: 880610 - RNA, 15 nt, Homo sapiens
aagccuguugcugaa

SEQ ID NO: 880611 - RNA, 18 nt, Homo sapiens
aagccuuuugcucacaaa

SEQ ID NO: 880612 - RNA, 17 nt, Homo sapiens
aagcgaauguguacaaa

SEQ ID NO: 880613 - RNA, 18 nt, Homo sapiens
aagcggagguugcaggga

SEQ ID NO: 880614 - RNA, 17 nt, Homo sapiens
aagcgugagccacugca

SEQ ID NO: 880615 - RNA, 14 nt, Homo sapiens
aagcuaagccuuau

SEQ ID NO: 880616 - RNA, 17 nt, Homo sapiens
aagcuaguggcuucaaa

SEQ ID NO: 880617 - RNA, 24 nt, Homo sapiens
aagcuauugauguuuccagaaaau

SEQ ID NO: 880618 - RNA, 13 nt, Homo sapiens
aagcuccucguga

SEQ ID NO: 880619 - RNA, 15 nt, Homo sapiens
aagcuccucgugaua

SEQ ID NO: 880620 - RNA, 17 nt, Homo sapiens
aagcucuauuaagauuu

SEQ ID NO: 880621 - RNA, 16 nt, Homo sapiens
aagcucugaagucaca

SEQ ID NO: 880622 - RNA, 21 nt, Homo sapiens
aagcuggauuauuuagaucua

SEQ ID NO: 880623 - RNA, 19 nt, Homo sapiens
aagcugggauaaucacauu

SEQ ID NO: 880624 - RNA, 23 nt, Homo sapiens
aagcuguccuugagcuguccuau

SEQ ID NO: 880625 - RNA, 22 nt, Homo sapiens
aagcuguguccuugcaccugca

SEQ ID NO: 880626 - RNA, 23 nt, Homo sapiens
aagcuguguccuugcaccugcau

SEQ ID NO: 880627 - RNA, 15 nt, Homo sapiens
aagcuuaaauugcuu

SEQ ID NO: 880628 - RNA, 12 nt, Homo sapiens
aagcuuauguca

SEQ ID NO: 880629 - RNA, 12 nt, Homo sapiens
aagcuucuaucc

SEQ ID NO: 880630 - RNA, 23 nt, Homo sapiens
aaggaaacuuuuuuuguuugcuc

SEQ ID NO: 880631 - RNA, 12 nt, Homo sapiens
aaggaaccuaau

SEQ ID NO: 880632 - RNA, 21 nt, Homo sapiens
aaggaacugaggcccagaaag

SEQ ID NO: 880633 - RNA, 12 nt, Homo sapiens
aaggaacuggaa

SEQ ID NO: 880634 - RNA, 13 nt, Homo sapiens
aaggaacuggaac

SEQ ID NO: 880635 - RNA, 13 nt, Homo sapiens
aaggaagacuuga

SEQ ID NO: 880636 - RNA, 12 nt, Homo sapiens
aaggaagcucca

SEQ ID NO: 880637 - RNA, 12 nt, Homo sapiens
aaggacaccucc

SEQ ID NO: 880638 - RNA, 22 nt, Homo sapiens
aaggacaccuccuuccucaguc

SEQ ID NO: 880639 - RNA, 14 nt, Homo sapiens
aaggacacuuguau

SEQ ID NO: 880640 - RNA, 16 nt, Homo sapiens
aaggacuaugaaaagc

SEQ ID NO: 880641 - RNA, 19 nt, Homo sapiens
aaggacuccugucuguccu

SEQ ID NO: 880642 - RNA, 17 nt, Homo sapiens
aaggacuuuccagugag

SEQ ID NO: 880643 - RNA, 14 nt, Homo sapiens
aaggagaaaaugca

SEQ ID NO: 880644 - RNA, 23 nt, Homo sapiens
aaggagacucaccucugccucaa

SEQ ID NO: 880645 - RNA, 22 nt, Homo sapiens
aaggagauauggcuaguggcaa

SEQ ID NO: 880646 - RNA, 20 nt, Homo sapiens
aaggagcucugaaucugaua

SEQ ID NO: 880647 - RNA, 16 nt, Homo sapiens
acacagagauaugcac

SEQ ID NO: 880648 - RNA, 21 nt, Homo sapiens
acacagagguuuuaaacaguc

SEQ ID NO: 880649 - RNA, 14 nt, Homo sapiens
acacagcacucucu

SEQ ID NO: 880650 - RNA, 22 nt, Homo sapiens
acacagcaguaugaaugauguu

SEQ ID NO: 880651 - RNA, 14 nt, Homo sapiens
acacaggcaaaauc

SEQ ID NO: 880652 - RNA, 22 nt, Homo sapiens
acacaggggcaaagaacugccc

SEQ ID NO: 880653 - RNA, 14 nt, Homo sapiens
acacagucucaguc

SEQ ID NO: 880654 - RNA, 11 nt, Homo sapiens
acacagugcug

SEQ ID NO: 880655 - RNA, 13 nt, Homo sapiens
acacauaugcacc

SEQ ID NO: 880656 - RNA, 19 nt, Homo sapiens
acacaucagugcacacgga

SEQ ID NO: 880657 - RNA, 22 nt, Homo sapiens
acacaugaaccauccuucccau

SEQ ID NO: 880658 - RNA, 17 nt, Homo sapiens
acacaugacacucuucu

SEQ ID NO: 880659 - RNA, 14 nt, Homo sapiens
acacauggaugcac

SEQ ID NO: 880660 - RNA, 19 nt, Homo sapiens
acacaugguuuccaagggu

SEQ ID NO: 880661 - RNA, 20 nt, Homo sapiens
acacauguaucuaugcauuu

SEQ ID NO: 880662 - RNA, 17 nt, Homo sapiens
acacauuacuugcacaa

SEQ ID NO: 880663 - RNA, 18 nt, Homo sapiens
acacauuacuugcacaag

SEQ ID NO: 880664 - RNA, 20 nt, Homo sapiens
acacauucuuaacacauguc

SEQ ID NO: 880665 - RNA, 17 nt, Homo sapiens
acacauuuggcaguuua

SEQ ID NO: 880666 - RNA, 14 nt, Homo sapiens
acaccauaugcaag

SEQ ID NO: 880667 - RNA, 11 nt, Homo sapiens
acaccaucucc

SEQ ID NO: 880668 - RNA, 17 nt, Homo sapiens
acacccacccacuucuc

SEQ ID NO: 880669 - RNA, 14 nt, Homo sapiens
acacccacuggcca

SEQ ID NO: 880670 - RNA, 23 nt, Homo sapiens
acacccuauauuuugcauaguac

SEQ ID NO: 880671 - RNA, 14 nt, Homo sapiens
acaccgaugcacac

SEQ ID NO: 880672 - RNA, 16 nt, Homo sapiens
acaccgaugugcgcac

SEQ ID NO: 880673 - RNA, 16 nt, Homo sapiens
acaccgucccucagug

SEQ ID NO: 880674 - RNA, 19 nt, Homo sapiens
acaccgucccucagugaua

SEQ ID NO: 880675 - RNA, 13 nt, Homo sapiens
acaccuaagagaa

SEQ ID NO: 880676 - RNA, 15 nt, Homo sapiens
acaccuaugucauuu

SEQ ID NO: 880677 - RNA, 13 nt, Homo sapiens
acaccucaaauac

SEQ ID NO: 880678 - RNA, 20 nt, Homo sapiens
acaccuccauuucucuccag

SEQ ID NO: 880679 - RNA, 14 nt, Homo sapiens
acaccugccuuaac

SEQ ID NO: 880680 - RNA, 19 nt, Homo sapiens
acaccuugacagggcacac

SEQ ID NO: 880681 - RNA, 14 nt, Homo sapiens
acacggaugcacac

SEQ ID NO: 880682 - RNA, 14 nt, Homo sapiens
acacggaugcacag

SEQ ID NO: 880683 - RNA, 15 nt, Homo sapiens
acacggaugcacaga

SEQ ID NO: 880684 - RNA, 17 nt, Homo sapiens
acacggaugcacagaga

SEQ ID NO: 880685 - RNA, 15 nt, Homo sapiens
acacggggcaguggc

SEQ ID NO: 880686 - RNA, 15 nt, Homo sapiens
acacguguccuguag

SEQ ID NO: 880687 - RNA, 23 nt, Homo sapiens
acacguuaggaauguccagacug

SEQ ID NO: 880688 - RNA, 18 nt, Homo sapiens
acacuaacauauaauguu

SEQ ID NO: 880689 - RNA, 17 nt, Homo sapiens
acacuaauacaccaggu

SEQ ID NO: 880690 - RNA, 15 nt, Homo sapiens
acacuacaaguuuau

SEQ ID NO: 880691 - RNA, 21 nt, Homo sapiens
acacuaguuuugugccagccg

SEQ ID NO: 880692 - RNA, 18 nt, Homo sapiens
acacuauugcauuguuca

SEQ ID NO: 880693 - RNA, 20 nt, Homo sapiens
acacuauuuaucugugcaaa

SEQ ID NO: 880694 - RNA, 15 nt, Homo sapiens
acacugucuugaaga

SEQ ID NO: 880695 - RNA, 13 nt, Homo sapiens
acacugugcuaua

SEQ ID NO: 880696 - RNA, 21 nt, Homo sapiens
acacuuggagcccgugcagua

SEQ ID NO: 880697 - RNA, 13 nt, Homo sapiens
acagaaacagaga

SEQ ID NO: 880698 - RNA, 16 nt, Homo sapiens
acagaaauacaugaaa

SEQ ID NO: 880699 - RNA, 18 nt, Homo sapiens
acagaaauacugcucuga

SEQ ID NO: 880700 - RNA, 15 nt, Homo sapiens
acagaaggauguccc

SEQ ID NO: 880701 - RNA, 15 nt, Homo sapiens
acagaagucuugucu

SEQ ID NO: 880702 - RNA, 17 nt, Homo sapiens
acagaagucuugucuca

SEQ ID NO: 880703 - RNA, 18 nt, Homo sapiens
acagaauaauguguuaaa

SEQ ID NO: 880704 - RNA, 16 nt, Homo sapiens
acagaaugauggacuu

SEQ ID NO: 880705 - RNA, 22 nt, Homo sapiens
acagaauggaaccaaaauguau

SEQ ID NO: 880706 - RNA, 19 nt, Homo sapiens
acagacagggccuagcuuu

SEQ ID NO: 880707 - RNA, 18 nt, Homo sapiens
acagacauuaaaccugga

SEQ ID NO: 880708 - RNA, 21 nt, Homo sapiens
acagacgauuaacacaccaca

SEQ ID NO: 880709 - RNA, 15 nt, Homo sapiens
acagacgcuccugaa

SEQ ID NO: 880710 - RNA, 23 nt, Homo sapiens
acagacugaauuuuaaauguuca

SEQ ID NO: 880711 - RNA, 12 nt, Homo sapiens
acagacugugag

SEQ ID NO: 880712 - RNA, 13 nt, Homo sapiens
acagacugugagu

SEQ ID NO: 880713 - RNA, 16 nt, Homo sapiens
acagagaaaagacaua

SEQ ID NO: 880714 - RNA, 17 nt, Homo sapiens
acagagaagaccaaagc

SEQ ID NO: 880715 - RNA, 19 nt, Homo sapiens
acagagauaugcacacacc

SEQ ID NO: 880716 - RNA, 15 nt, Homo sapiens
acagagaugcaugcg

SEQ ID NO: 880717 - RNA, 15 nt, Homo sapiens
acagagaugugauaa

SEQ ID NO: 880718 - RNA, 20 nt, Homo sapiens
acagagcgagacuccgucuc

SEQ ID NO: 880719 - RNA, 20 nt, Homo sapiens
acagagcgagagucugucuc

SEQ ID NO: 880720 - RNA, 20 nt, Homo sapiens
acagagcgagauuccgucuu

SEQ ID NO: 880721 - RNA, 19 nt, Homo sapiens
acagagcuggcugucuucc

SEQ ID NO: 880722 - RNA, 12 nt, Homo sapiens
acagagggccac

SEQ ID NO: 880723 - RNA, 16 nt, Homo sapiens
acagagggccacacag

SEQ ID NO: 880724 - RNA, 20 nt, Homo sapiens
acagagggggccuucacagu

SEQ ID NO: 880725 - RNA, 20 nt, Homo sapiens
acagagugagacucugucuc

SEQ ID NO: 880726 - RNA, 20 nt, Homo sapiens
acagauacauagauggacca

SEQ ID NO: 880727 - RNA, 13 nt, Homo sapiens
acagauagucaaa

SEQ ID NO: 880728 - RNA, 18 nt, Homo sapiens
acagauauacacauggau

SEQ ID NO: 880729 - RNA, 13 nt, Homo sapiens
acagauaugcaca

SEQ ID NO: 880730 - RNA, 13 nt, Homo sapiens
acagaucauuuca

SEQ ID NO: 880731 - RNA, 17 nt, Homo sapiens
acagaugauaauaugcu

SEQ ID NO: 880732 - RNA, 16 nt, Homo sapiens
acagaugcacacacag

SEQ ID NO: 880733 - RNA, 17 nt, Homo sapiens
acagaugcacacacaga

SEQ ID NO: 880734 - RNA, 20 nt, Homo sapiens
acagaugcagccgugcagga

SEQ ID NO: 880735 - RNA, 19 nt, Homo sapiens
acagauggauagucugucc

SEQ ID NO: 880736 - RNA, 17 nt, Homo sapiens
acagauggucacacaga

SEQ ID NO: 880737 - RNA, 20 nt, Homo sapiens
acagauguaaaugccacaaa

SEQ ID NO: 880738 - RNA, 17 nt, Homo sapiens
acagaugugggcuuuga

SEQ ID NO: 880739 - RNA, 19 nt, Homo sapiens
acagauuuuagacaaggac

SEQ ID NO: 880740 - RNA, 13 nt, Homo sapiens
acagcacccaggc

SEQ ID NO: 880741 - RNA, 21 nt, Homo sapiens
acagcacccaggcuccauggg

SEQ ID NO: 880742 - RNA, 18 nt, Homo sapiens
acagcagcucaggcacac

SEQ ID NO: 880743 - RNA, 20 nt, Homo sapiens
acagcagggucuugcuguaa

SEQ ID NO: 880744 - RNA, 17 nt, Homo sapiens
acagcaggugccuggug

SEQ ID NO: 880745 - RNA, 13 nt, Homo sapiens
acagcaguaugaa

SEQ ID NO: 880746 - RNA, 15 nt, Homo sapiens
acagccaucaaggga

SEQ ID NO: 880747 - RNA, 22 nt, Homo sapiens
acagcccgggugugccugcccu

SEQ ID NO: 880748 - RNA, 21 nt, Homo sapiens
acagccuauaaccagacacau

SEQ ID NO: 880749 - RNA, 18 nt, Homo sapiens
acagccuggcacagggca

SEQ ID NO: 880750 - RNA, 19 nt, Homo sapiens
acagcgucccuagcaguga

SEQ ID NO: 880751 - RNA, 12 nt, Homo sapiens
acagcuaauaau

SEQ ID NO: 880752 - RNA, 20 nt, Homo sapiens
acagcuaugaaggcuguaca

SEQ ID NO: 880753 - RNA, 20 nt, Homo sapiens
acagcucuagacacugccac

SEQ ID NO: 880754 - RNA, 17 nt, Homo sapiens
acagcucuguguuucug

SEQ ID NO: 880755 - RNA, 16 nt, Homo sapiens
acagcucuucuaagga

SEQ ID NO: 880756 - RNA, 15 nt, Homo sapiens
acagcugaacuauuu

SEQ ID NO: 880757 - RNA, 19 nt, Homo sapiens
acagcuucuucaucuuuaa

SEQ ID NO: 880758 - RNA, 14 nt, Homo sapiens
acaggaaaaugcca

SEQ ID NO: 880759 - RNA, 13 nt, Homo sapiens
acaggaaaccacu

SEQ ID NO: 880760 - RNA, 18 nt, Homo sapiens
acaggaauacuuaacuca

SEQ ID NO: 880761 - RNA, 19 nt, Homo sapiens
acaggaauacuuaacucaa

SEQ ID NO: 880762 - RNA, 18 nt, Homo sapiens
acuacaauuuaaagcaaa

SEQ ID NO: 880763 - RNA, 13 nt, Homo sapiens
acuacacauccaa

SEQ ID NO: 880764 - RNA, 13 nt, Homo sapiens
acuacacuccagc

SEQ ID NO: 880765 - RNA, 15 nt, Homo sapiens
acuacaguacaguga

SEQ ID NO: 880766 - RNA, 11 nt, Homo sapiens
acuacaugcac

SEQ ID NO: 880767 - RNA, 16 nt, Homo sapiens
acuacccgagcccagc

SEQ ID NO: 880768 - RNA, 22 nt, Homo sapiens
acuacccgagcccagcuacauu

SEQ ID NO: 880769 - RNA, 21 nt, Homo sapiens
acuaccggcuacaucaaauca

SEQ ID NO: 880770 - RNA, 20 nt, Homo sapiens
acuacgugccaggcacuguu

SEQ ID NO: 880771 - RNA, 16 nt, Homo sapiens
acuacuacucaauggc

SEQ ID NO: 880772 - RNA, 19 nt, Homo sapiens
acuacuugccacacacugu

SEQ ID NO: 880773 - RNA, 17 nt, Homo sapiens
acuagagccugugcuaa

SEQ ID NO: 880774 - RNA, 18 nt, Homo sapiens
acuagagggauacacuga

SEQ ID NO: 880775 - RNA, 13 nt, Homo sapiens
acuagauacugaa

SEQ ID NO: 880776 - RNA, 14 nt, Homo sapiens
acuagaucuccuau

SEQ ID NO: 880777 - RNA, 14 nt, Homo sapiens
acuaggcuguguau

SEQ ID NO: 880778 - RNA, 19 nt, Homo sapiens
acuagucacauucuuguuu

SEQ ID NO: 880779 - RNA, 15 nt, Homo sapiens
acuauaaacauuaaa

SEQ ID NO: 880780 - RNA, 18 nt, Homo sapiens
acuauaaacuacuguaau

SEQ ID NO: 880781 - RNA, 17 nt, Homo sapiens
acuauaaugugaugauu

SEQ ID NO: 880782 - RNA, 22 nt, Homo sapiens
acuauagccuaggugacagagu

SEQ ID NO: 880783 - RNA, 15 nt, Homo sapiens
acuaucacauacaau

SEQ ID NO: 880784 - RNA, 18 nt, Homo sapiens
acuaucacauacaauuug

SEQ ID NO: 880785 - RNA, 16 nt, Homo sapiens
acuaugacacugagca

SEQ ID NO: 880786 - RNA, 13 nt, Homo sapiens
acuaugaucacag

SEQ ID NO: 880787 - RNA, 13 nt, Homo sapiens
acuaugaucucag

SEQ ID NO: 880788 - RNA, 14 nt, Homo sapiens
acuaugaucucagg

SEQ ID NO: 880789 - RNA, 11 nt, Homo sapiens
acuaugcacaa

SEQ ID NO: 880790 - RNA, 18 nt, Homo sapiens
acuauggaaagcagccau

SEQ ID NO: 880791 - RNA, 18 nt, Homo sapiens
acuauggcccugggagag

SEQ ID NO: 880792 - RNA, 17 nt, Homo sapiens
acuauggcuuauucagu

SEQ ID NO: 880793 - RNA, 15 nt, Homo sapiens
acuauguccagcuag

SEQ ID NO: 880794 - RNA, 15 nt, Homo sapiens
acuauguugcccagg

SEQ ID NO: 880795 - RNA, 18 nt, Homo sapiens
acuauguugcccaggcag

SEQ ID NO: 880796 - RNA, 18 nt, Homo sapiens
acuauguugcccaggcug

SEQ ID NO: 880797 - RNA, 23 nt, Homo sapiens
acuauuaacaacuugucuauuac

SEQ ID NO: 880798 - RNA, 16 nt, Homo sapiens
acuauucuagcaggag

SEQ ID NO: 880799 - RNA, 13 nt, Homo sapiens
acuauugagauau

SEQ ID NO: 880800 - RNA, 23 nt, Homo sapiens
acuauuucacuaauaaacauuug

SEQ ID NO: 880801 - RNA, 14 nt, Homo sapiens
acucaaaagagaga

SEQ ID NO: 880802 - RNA, 21 nt, Homo sapiens
acucaaagagggagugcauuu

SEQ ID NO: 880803 - RNA, 15 nt, Homo sapiens
acucaauaugugauu

SEQ ID NO: 880804 - RNA, 15 nt, Homo sapiens
acucacagucucuuu

SEQ ID NO: 880805 - RNA, 23 nt, Homo sapiens
acucacaugccgcccccagcagc

SEQ ID NO: 880806 - RNA, 11 nt, Homo sapiens
acucacuccag

SEQ ID NO: 880807 - RNA, 14 nt, Homo sapiens
acucacugcucaag

SEQ ID NO: 880808 - RNA, 12 nt, Homo sapiens
acucacuguggg

SEQ ID NO: 880809 - RNA, 16 nt, Homo sapiens
acucagacauuccaag

SEQ ID NO: 880810 - RNA, 20 nt, Homo sapiens
acucagacuguugcacucua

SEQ ID NO: 880811 - RNA, 14 nt, Homo sapiens
acucagcagcagag

SEQ ID NO: 880812 - RNA, 20 nt, Homo sapiens
acucagccgcagacaaguaa

SEQ ID NO: 880813 - RNA, 17 nt, Homo sapiens
acucagcggucauucua

SEQ ID NO: 880814 - RNA, 12 nt, Homo sapiens
acucaggaucca

SEQ ID NO: 880815 - RNA, 18 nt, Homo sapiens
acucaggccaacaagcca

SEQ ID NO: 880816 - RNA, 14 nt, Homo sapiens
acucauaaggcaua

SEQ ID NO: 880817 - RNA, 18 nt, Homo sapiens
acucaucccuguuccuca

SEQ ID NO: 880818 - RNA, 21 nt, Homo sapiens
acucaucugucaccaagccuu

SEQ ID NO: 880819 - RNA, 15 nt, Homo sapiens
acucaucuguuaucc

SEQ ID NO: 880820 - RNA, 12 nt, Homo sapiens
acucaugaacua

SEQ ID NO: 880821 - RNA, 15 nt, Homo sapiens
acucauuucaucuca

SEQ ID NO: 880822 - RNA, 22 nt, Homo sapiens
acuccaaagaaauguaagggaa

SEQ ID NO: 880823 - RNA, 13 nt, Homo sapiens
acuccagaaucca

SEQ ID NO: 880824 - RNA, 22 nt, Homo sapiens
acuccagcccuguccccugaaa

SEQ ID NO: 880825 - RNA, 15 nt, Homo sapiens
acuccagccugggca

SEQ ID NO: 880826 - RNA, 12 nt, Homo sapiens
acuccaucucaa

SEQ ID NO: 880827 - RNA, 21 nt, Homo sapiens
acucccuucccccauccucca

SEQ ID NO: 880828 - RNA, 18 nt, Homo sapiens
acuccuaagacuuaugua

SEQ ID NO: 880829 - RNA, 15 nt, Homo sapiens
acuccuccuugccug

SEQ ID NO: 880830 - RNA, 13 nt, Homo sapiens
acuccucugacug

SEQ ID NO: 880831 - RNA, 12 nt, Homo sapiens
acuccugcaaaa

SEQ ID NO: 880832 - RNA, 16 nt, Homo sapiens
acuccugccaguugaa

SEQ ID NO: 880833 - RNA, 15 nt, Homo sapiens
acuccugucuguccu

SEQ ID NO: 880834 - RNA, 19 nt, Homo sapiens
acuccuuugcauuccauga

SEQ ID NO: 880835 - RNA, 19 nt, Homo sapiens
acucgagaccauccuggcc

SEQ ID NO: 880836 - RNA, 16 nt, Homo sapiens
acucuaaauauuucau

SEQ ID NO: 880837 - RNA, 15 nt, Homo sapiens
acucuaccugcaaga

SEQ ID NO: 880838 - RNA, 16 nt, Homo sapiens
acucuacgccaaagug

SEQ ID NO: 880839 - RNA, 21 nt, Homo sapiens
acucuagccugggccagagaa

SEQ ID NO: 880840 - RNA, 21 nt, Homo sapiens
acucuaggggucaggcuccau

SEQ ID NO: 880841 - RNA, 23 nt, Homo sapiens
acucucauuccccagguggcuga

SEQ ID NO: 880842 - RNA, 13 nt, Homo sapiens
acucucugagaug

SEQ ID NO: 880843 - RNA, 23 nt, Homo sapiens
acucugaggcucuuucugggcca

SEQ ID NO: 880844 - RNA, 14 nt, Homo sapiens
acucugcacaugaa

SEQ ID NO: 880845 - RNA, 15 nt, Homo sapiens
acucugcacaugucu

SEQ ID NO: 880846 - RNA, 19 nt, Homo sapiens
acucugcacaugucuugua

SEQ ID NO: 880847 - RNA, 14 nt, Homo sapiens
acucugcaucagca

SEQ ID NO: 880848 - RNA, 17 nt, Homo sapiens
acucugcaucagcacug

SEQ ID NO: 880849 - RNA, 13 nt, Homo sapiens
acucugcucugau

SEQ ID NO: 880850 - RNA, 19 nt, Homo sapiens
acucuggagagacugugcu

SEQ ID NO: 880851 - RNA, 16 nt, Homo sapiens
acucuuaugaaauggg

SEQ ID NO: 880852 - RNA, 21 nt, Homo sapiens
acucuuauucccaaacuacag

SEQ ID NO: 880853 - RNA, 14 nt, Homo sapiens
acugaaggggcaca

SEQ ID NO: 880854 - RNA, 18 nt, Homo sapiens
acugaauguaaacaaagg

SEQ ID NO: 880855 - RNA, 19 nt, Homo sapiens
acugaauguuuauuccuug

SEQ ID NO: 880856 - RNA, 12 nt, Homo sapiens
acugacacagga

SEQ ID NO: 880857 - RNA, 16 nt, Homo sapiens
acugacacaggccagc

SEQ ID NO: 880858 - RNA, 20 nt, Homo sapiens
acugacauuauaucauggca

SEQ ID NO: 880859 - RNA, 12 nt, Homo sapiens
acugacauuucu

SEQ ID NO: 880860 - RNA, 12 nt, Homo sapiens
acugacuccuua

SEQ ID NO: 880861 - RNA, 12 nt, Homo sapiens
acugacuuucau

SEQ ID NO: 880862 - RNA, 19 nt, Homo sapiens
acugagcugggcaccacag

SEQ ID NO: 880863 - RNA, 14 nt, Homo sapiens
acugaggcagacag

SEQ ID NO: 880864 - RNA, 20 nt, Homo sapiens
acugaggcagacagcagcuc

SEQ ID NO: 880865 - RNA, 23 nt, Homo sapiens
acugaggcccagggaggugaccc

SEQ ID NO: 880866 - RNA, 18 nt, Homo sapiens
acugaugacaaacccagg

SEQ ID NO: 880867 - RNA, 14 nt, Homo sapiens
acugauuucacaac

SEQ ID NO: 880868 - RNA, 19 nt, Homo sapiens
acugauuucacaacagauc

SEQ ID NO: 880869 - RNA, 17 nt, Homo sapiens
acugauuuuuagcuuua

SEQ ID NO: 880870 - RNA, 18 nt, Homo sapiens
acugcaaauauugucaua

SEQ ID NO: 880871 - RNA, 14 nt, Homo sapiens
acugcaaaucugcc

SEQ ID NO: 880872 - RNA, 19 nt, Homo sapiens
acugcaaaucugccugaua

SEQ ID NO: 880873 - RNA, 14 nt, Homo sapiens
acugcaaauuucaa

SEQ ID NO: 880874 - RNA, 20 nt, Homo sapiens
acugcacuauagccuaggug

SEQ ID NO: 880875 - RNA, 21 nt, Homo sapiens
acugcacuauagccuagguga

SEQ ID NO: 880876 - RNA, 20 nt, Homo sapiens
acugcacuccagccugggca

SEQ ID NO: 880877 - RNA, 14 nt, Homo sapiens
acugcacuccaguc

SEQ ID NO: 880878 - RNA, 17 nt, Homo sapiens
aucccagcuacucaaga

SEQ ID NO: 880879 - RNA, 22 nt, Homo sapiens
aucccaggcgggcggcacgcca

SEQ ID NO: 880880 - RNA, 15 nt, Homo sapiens
aucccaugagccuca

SEQ ID NO: 880881 - RNA, 15 nt, Homo sapiens
aucccauguauuuau

SEQ ID NO: 880882 - RNA, 13 nt, Homo sapiens
aucccaugucacc

SEQ ID NO: 880883 - RNA, 19 nt, Homo sapiens
aucccccagccucaagucu

SEQ ID NO: 880884 - RNA, 17 nt, Homo sapiens
auccccuuggcugugag

SEQ ID NO: 880885 - RNA, 17 nt, Homo sapiens
aucccgaaaaucucucg

SEQ ID NO: 880886 - RNA, 18 nt, Homo sapiens
aucccgugaaagaauuau

SEQ ID NO: 880887 - RNA, 18 nt, Homo sapiens
aucccuaacaucaugcau

SEQ ID NO: 880888 - RNA, 22 nt, Homo sapiens
auccgaggcagggucaggagag

SEQ ID NO: 880889 - RNA, 16 nt, Homo sapiens
auccggcuccugucau

SEQ ID NO: 880890 - RNA, 23 nt, Homo sapiens
auccgggacgcuuccagaccacc

SEQ ID NO: 880891 - RNA, 20 nt, Homo sapiens
auccguacauucaauguuua

SEQ ID NO: 880892 - RNA, 17 nt, Homo sapiens
auccguaguucccugaa

SEQ ID NO: 880893 - RNA, 15 nt, Homo sapiens
auccuaacacauuau

SEQ ID NO: 880894 - RNA, 19 nt, Homo sapiens
auccuauuaaaacacagcu

SEQ ID NO: 880895 - RNA, 11 nt, Homo sapiens
auccuauuuau

SEQ ID NO: 880896 - RNA, 16 nt, Homo sapiens
auccucacaggagcag

SEQ ID NO: 880897 - RNA, 21 nt, Homo sapiens
auccucagguaguacugggaa

SEQ ID NO: 880898 - RNA, 22 nt, Homo sapiens
auccuccucccaacucuagccu

SEQ ID NO: 880899 - RNA, 13 nt, Homo sapiens
auccucucucugu

SEQ ID NO: 880900 - RNA, 17 nt, Homo sapiens
auccugccucuccccaa

SEQ ID NO: 880901 - RNA, 21 nt, Homo sapiens
auccuggccaacauggugaaa

SEQ ID NO: 880902 - RNA, 18 nt, Homo sapiens
auccuggcuaacacguga

SEQ ID NO: 880903 - RNA, 18 nt, Homo sapiens
auccugucuuuaaggaaa

SEQ ID NO: 880904 - RNA, 13 nt, Homo sapiens
auccugugugcug

SEQ ID NO: 880905 - RNA, 12 nt, Homo sapiens
auccuguuacuu

SEQ ID NO: 880906 - RNA, 19 nt, Homo sapiens
auccuuaggaaaaugcuuc

SEQ ID NO: 880907 - RNA, 20 nt, Homo sapiens
auccuugauaaaugccucau

SEQ ID NO: 880908 - RNA, 22 nt, Homo sapiens
auccuuuccacccuauucccua

SEQ ID NO: 880909 - RNA, 20 nt, Homo sapiens
auccuuugagaaugugauuc

SEQ ID NO: 880910 - RNA, 16 nt, Homo sapiens
aucgggagcagugucu

SEQ ID NO: 880911 - RNA, 17 nt, Homo sapiens
aucguuguuuacagugu

SEQ ID NO: 880912 - RNA, 21 nt, Homo sapiens
aucuaaaaagacuaaccugcc

SEQ ID NO: 880913 - RNA, 21 nt, Homo sapiens
aucuaagaaaauuuacuguaa

SEQ ID NO: 880914 - RNA, 18 nt, Homo sapiens
aucuacaaaaaacaacaa

SEQ ID NO: 880915 - RNA, 22 nt, Homo sapiens
aucuacaaaaaacaacaaauaa

SEQ ID NO: 880916 - RNA, 18 nt, Homo sapiens
aucuacaagcauuugccc

SEQ ID NO: 880917 - RNA, 22 nt, Homo sapiens
aucuacacagcaguaugaauga

SEQ ID NO: 880918 - RNA, 12 nt, Homo sapiens
aucuacacagcc

SEQ ID NO: 880919 - RNA, 16 nt, Homo sapiens
aucuaccaucuaaucu

SEQ ID NO: 880920 - RNA, 17 nt, Homo sapiens
aucuaccucacuauuca

SEQ ID NO: 880921 - RNA, 11 nt, Homo sapiens
aucuaccugcc

SEQ ID NO: 880922 - RNA, 14 nt, Homo sapiens
aucuacuacagggu

SEQ ID NO: 880923 - RNA, 17 nt, Homo sapiens
aucuacucauugucuca

SEQ ID NO: 880924 - RNA, 18 nt, Homo sapiens
aucuacuucaacacuuca

SEQ ID NO: 880925 - RNA, 19 nt, Homo sapiens
aucuagcuucaugccucag

SEQ ID NO: 880926 - RNA, 18 nt, Homo sapiens
aucuagugcuagauguau

SEQ ID NO: 880927 - RNA, 13 nt, Homo sapiens
aucuaguuuacuu

SEQ ID NO: 880928 - RNA, 20 nt, Homo sapiens
aucuauguaucuaccaucua

SEQ ID NO: 880929 - RNA, 14 nt, Homo sapiens
aucucaaaacugca

SEQ ID NO: 880930 - RNA, 14 nt, Homo sapiens
aucucaaauucuca

SEQ ID NO: 880931 - RNA, 22 nt, Homo sapiens
aucucaggagcuugcaagaagc

SEQ ID NO: 880932 - RNA, 15 nt, Homo sapiens
aucucaggugccacu

SEQ ID NO: 880933 - RNA, 23 nt, Homo sapiens
aucucaguggcacagguuuaaga

SEQ ID NO: 880934 - RNA, 17 nt, Homo sapiens
aucucauagguugccaa

SEQ ID NO: 880935 - RNA, 20 nt, Homo sapiens
aucucaugagugccaagcaa

SEQ ID NO: 880936 - RNA, 16 nt, Homo sapiens
aucucauggcagcuaa

SEQ ID NO: 880937 - RNA, 17 nt, Homo sapiens
aucuccacaccaaaguc

SEQ ID NO: 880938 - RNA, 19 nt, Homo sapiens
aucuccacccugagccuga

SEQ ID NO: 880939 - RNA, 16 nt, Homo sapiens
aucuccagcauccugc

SEQ ID NO: 880940 - RNA, 16 nt, Homo sapiens
aucuccucuaucacau

SEQ ID NO: 880941 - RNA, 17 nt, Homo sapiens
aucuccucuaucacauu

SEQ ID NO: 880942 - RNA, 23 nt, Homo sapiens
aucucuaauuggaagaaauuccu

SEQ ID NO: 880943 - RNA, 23 nt, Homo sapiens
aucucuacaaaaaauaaaaacac

SEQ ID NO: 880944 - RNA, 13 nt, Homo sapiens
aucucuaugugga

SEQ ID NO: 880945 - RNA, 20 nt, Homo sapiens
aucucugaagcauguuucau

SEQ ID NO: 880946 - RNA, 18 nt, Homo sapiens
aucucugccaagccuauu

SEQ ID NO: 880947 - RNA, 20 nt, Homo sapiens
aucucuggccauauccugcc

SEQ ID NO: 880948 - RNA, 21 nt, Homo sapiens
aucucuuuugaauccaugcuu

SEQ ID NO: 880949 - RNA, 16 nt, Homo sapiens
aucugaacacauacua

SEQ ID NO: 880950 - RNA, 19 nt, Homo sapiens
aucugaacacauacuagaa

SEQ ID NO: 880951 - RNA, 16 nt, Homo sapiens
aucugagaaacuuaaa

SEQ ID NO: 880952 - RNA, 22 nt, Homo sapiens
aucugagacuauaacugucauc

SEQ ID NO: 880953 - RNA, 11 nt, Homo sapiens
aucugagcucc

SEQ ID NO: 880954 - RNA, 22 nt, Homo sapiens
aucugaggaaggugcuugccug

SEQ ID NO: 880955 - RNA, 13 nt, Homo sapiens
aucugcacugggu

SEQ ID NO: 880956 - RNA, 18 nt, Homo sapiens
aucugccucuauucaauu

SEQ ID NO: 880957 - RNA, 18 nt, Homo sapiens
aucugcuuguauuuucca

SEQ ID NO: 880958 - RNA, 20 nt, Homo sapiens
aucuggaguugaacagcaaa

SEQ ID NO: 880959 - RNA, 17 nt, Homo sapiens
aucuggauuccagagca

SEQ ID NO: 880960 - RNA, 15 nt, Homo sapiens
aucugggauucccac

SEQ ID NO: 880961 - RNA, 22 nt, Homo sapiens
aucugggcuaccccacccaagu

SEQ ID NO: 880962 - RNA, 23 nt, Homo sapiens
aucuguauauacaauaacauaau

SEQ ID NO: 880963 - RNA, 22 nt, Homo sapiens
aucuguccagaggcugcaagga

SEQ ID NO: 880964 - RNA, 13 nt, Homo sapiens
aucuguguauaug

SEQ ID NO: 880965 - RNA, 15 nt, Homo sapiens
aucuguucaauguuu

SEQ ID NO: 880966 - RNA, 13 nt, Homo sapiens
aucuguucauuca

SEQ ID NO: 880967 - RNA, 14 nt, Homo sapiens
aucuguuuugugac

SEQ ID NO: 880968 - RNA, 19 nt, Homo sapiens
aucuuaaaugacagugaau

SEQ ID NO: 880969 - RNA, 12 nt, Homo sapiens
aucuuacauaua

SEQ ID NO: 880970 - RNA, 21 nt, Homo sapiens
aucuuacauauaauaaacuuu

SEQ ID NO: 880971 - RNA, 22 nt, Homo sapiens
aucuuauuuaauuuuugcaauu

SEQ ID NO: 880972 - RNA, 18 nt, Homo sapiens
aucuucggggugugauga

SEQ ID NO: 880973 - RNA, 12 nt, Homo sapiens
aucuucuuggag

SEQ ID NO: 880974 - RNA, 17 nt, Homo sapiens
aucuugacauguaauga

SEQ ID NO: 880975 - RNA, 14 nt, Homo sapiens
aucuuggacugaca

SEQ ID NO: 880976 - RNA, 23 nt, Homo sapiens
aucuuggccaggcuggucuugaa

SEQ ID NO: 880977 - RNA, 23 nt, Homo sapiens
aucuuuaggagacuaauggaaau

SEQ ID NO: 880978 - RNA, 13 nt, Homo sapiens
aucuuuccuccaa

SEQ ID NO: 880979 - RNA, 14 nt, Homo sapiens
aucuuugugcuuca

SEQ ID NO: 880980 - RNA, 23 nt, Homo sapiens
aucuuuuaguuuuaguugcagaa

SEQ ID NO: 880981 - RNA, 12 nt, Homo sapiens
aucuuuuccacu

SEQ ID NO: 880982 - RNA, 20 nt, Homo sapiens
augaaaaaaaugcauuuuau

SEQ ID NO: 880983 - RNA, 17 nt, Homo sapiens
augaaaaccauuaccug

SEQ ID NO: 880984 - RNA, 16 nt, Homo sapiens
augaaaauuaggauuu

SEQ ID NO: 880985 - RNA, 22 nt, Homo sapiens
augaaacuccugauuuuguagu

SEQ ID NO: 880986 - RNA, 14 nt, Homo sapiens
augaaagugcaaag

SEQ ID NO: 880987 - RNA, 22 nt, Homo sapiens
augaaauccugcuucaguguau

SEQ ID NO: 880988 - RNA, 20 nt, Homo sapiens
augaaaugucuggucugucc

SEQ ID NO: 880989 - RNA, 13 nt, Homo sapiens
augaaauguuuca

SEQ ID NO: 880990 - RNA, 21 nt, Homo sapiens
augaacaaacuaugaucacag

SEQ ID NO: 880991 - RNA, 17 nt, Homo sapiens
augaacacacauggaug

SEQ ID NO: 880992 - RNA, 14 nt, Homo sapiens
auuuaucugaauau

SEQ ID NO: 880993 - RNA, 15 nt, Homo sapiens
auuuaucugugcaaa

SEQ ID NO: 880994 - RNA, 19 nt, Homo sapiens
auuuaugagaaaguucuca

SEQ ID NO: 880995 - RNA, 14 nt, Homo sapiens
auuuaugagcucuu

SEQ ID NO: 880996 - RNA, 15 nt, Homo sapiens
auuuaugagcucuuc

SEQ ID NO: 880997 - RNA, 20 nt, Homo sapiens
auuuaugccucuguauuuaa

SEQ ID NO: 880998 - RNA, 13 nt, Homo sapiens
auuuaugucucag

SEQ ID NO: 880999 - RNA, 14 nt, Homo sapiens
auuuauuaccucug

SEQ ID NO: 881000 - RNA, 17 nt, Homo sapiens
auuuauuaccucugaua

SEQ ID NO: 881001 - RNA, 22 nt, Homo sapiens
auuuauucaucugggaggcaga

SEQ ID NO: 881002 - RNA, 13 nt, Homo sapiens
auuuauucauuca

SEQ ID NO: 881003 - RNA, 19 nt, Homo sapiens
auuuauucuucuuuuccaa

SEQ ID NO: 881004 - RNA, 18 nt, Homo sapiens
auuuauuggggaucugca

SEQ ID NO: 881005 - RNA, 20 nt, Homo sapiens
auuuauuggggaucugcauu

SEQ ID NO: 881006 - RNA, 13 nt, Homo sapiens
auuucaaaacaca

SEQ ID NO: 881007 - RNA, 15 nt, Homo sapiens
auuucaacaagaaua

SEQ ID NO: 881008 - RNA, 15 nt, Homo sapiens
auuucaacauaucau

SEQ ID NO: 881009 - RNA, 19 nt, Homo sapiens
auuucacacagguccugaa

SEQ ID NO: 881010 - RNA, 12 nt, Homo sapiens
auuucagauauc

SEQ ID NO: 881011 - RNA, 10 nt, Homo sapiens
auuucaggga

SEQ ID NO: 881012 - RNA, 15 nt, Homo sapiens
auuucaguuacuuac

SEQ ID NO: 881013 - RNA, 22 nt, Homo sapiens
auuucaguuuguuuacuuuauc

SEQ ID NO: 881014 - RNA, 15 nt, Homo sapiens
auuucauaaacaacu

SEQ ID NO: 881015 - RNA, 18 nt, Homo sapiens
auuucaucuacuacaggg

SEQ ID NO: 881016 - RNA, 19 nt, Homo sapiens
auuucaucuacuacagggu

SEQ ID NO: 881017 - RNA, 16 nt, Homo sapiens
auuucauuagaggaag

SEQ ID NO: 881018 - RNA, 17 nt, Homo sapiens
auuuccaaaugaaugac

SEQ ID NO: 881019 - RNA, 23 nt, Homo sapiens
auuuccaggggccucccaaggaa

SEQ ID NO: 881020 - RNA, 15 nt, Homo sapiens
auuuccauaacucau

SEQ ID NO: 881021 - RNA, 15 nt, Homo sapiens
auuucccccagggaa

SEQ ID NO: 881022 - RNA, 15 nt, Homo sapiens
auuucccucccggga

SEQ ID NO: 881023 - RNA, 22 nt, Homo sapiens
auuuccuaaugucagaguagaa

SEQ ID NO: 881024 - RNA, 21 nt, Homo sapiens
auuuccugacagaaggacuca

SEQ ID NO: 881025 - RNA, 23 nt, Homo sapiens
auuuccugcuacacaaaagccaa

SEQ ID NO: 881026 - RNA, 23 nt, Homo sapiens
auuuccugugucuuuuuucacua

SEQ ID NO: 881027 - RNA, 17 nt, Homo sapiens
auuucucaaaugcacau

SEQ ID NO: 881028 - RNA, 15 nt, Homo sapiens
auuucugcaucagcu

SEQ ID NO: 881029 - RNA, 22 nt, Homo sapiens
auuucuggacccuccacuucaa

SEQ ID NO: 881030 - RNA, 21 nt, Homo sapiens
auuucugucucucucuguccu

SEQ ID NO: 881031 - RNA, 15 nt, Homo sapiens
auuucuugcauucau

SEQ ID NO: 881032 - RNA, 18 nt, Homo sapiens
auuucuuuaagaaucuau

SEQ ID NO: 881033 - RNA, 17 nt, Homo sapiens
auuucuuuuccaaaauu

SEQ ID NO: 881034 - RNA, 16 nt, Homo sapiens
auuugaaaguccuugu

SEQ ID NO: 881035 - RNA, 17 nt, Homo sapiens
auuugaagaagaguuuc

SEQ ID NO: 881036 - RNA, 17 nt, Homo sapiens
auuugagagcuaacuau

SEQ ID NO: 881037 - RNA, 14 nt, Homo sapiens
auuugagcaauuca

SEQ ID NO: 881038 - RNA, 21 nt, Homo sapiens
auuugagcaugcacagcugcu

SEQ ID NO: 881039 - RNA, 21 nt, Homo sapiens
auuugauaaacuaaaagcaua

SEQ ID NO: 881040 - RNA, 23 nt, Homo sapiens
auuugauaguugguguucaaaaa

SEQ ID NO: 881041 - RNA, 19 nt, Homo sapiens
auuugcacccaugccauag

SEQ ID NO: 881042 - RNA, 14 nt, Homo sapiens
auuugcagagacag

SEQ ID NO: 881043 - RNA, 14 nt, Homo sapiens
auuugcauauguau

SEQ ID NO: 881044 - RNA, 13 nt, Homo sapiens
auuugccaaagug

SEQ ID NO: 881045 - RNA, 13 nt, Homo sapiens
auuugccaccacu

SEQ ID NO: 881046 - RNA, 15 nt, Homo sapiens
auuugccagcuuuau

SEQ ID NO: 881047 - RNA, 19 nt, Homo sapiens
auuugcugagcauguacug

SEQ ID NO: 881048 - RNA, 21 nt, Homo sapiens
auuugcuguucacccacaucu

SEQ ID NO: 881049 - RNA, 13 nt, Homo sapiens
auuuggaaauuca

SEQ ID NO: 881050 - RNA, 19 nt, Homo sapiens
auuuguacaaauacugccu

SEQ ID NO: 881051 - RNA, 20 nt, Homo sapiens
auuuguauaaugguguuacu

SEQ ID NO: 881052 - RNA, 22 nt, Homo sapiens
auuuguauucaugaacuuggcu

SEQ ID NO: 881053 - RNA, 15 nt, Homo sapiens
auuuguauuugccau

SEQ ID NO: 881054 - RNA, 21 nt, Homo sapiens
auuuguggucacagccaugaa

SEQ ID NO: 881055 - RNA, 18 nt, Homo sapiens
auuugugugugugauaua

SEQ ID NO: 881056 - RNA, 23 nt, Homo sapiens
auuugugugugugauauaugcau

SEQ ID NO: 881057 - RNA, 21 nt, Homo sapiens
auuuguuauagcaauguaaca

SEQ ID NO: 881058 - RNA, 14 nt, Homo sapiens
auuuguuaucucaa

SEQ ID NO: 881059 - RNA, 13 nt, Homo sapiens
auuuguucagaga

SEQ ID NO: 881060 - RNA, 14 nt, Homo sapiens
auuuguucagagag

SEQ ID NO: 881061 - RNA, 22 nt, Homo sapiens
auuuguuguacuuuuuauucaa

SEQ ID NO: 881062 - RNA, 14 nt, Homo sapiens
auuuguuugugcau

SEQ ID NO: 881063 - RNA, 17 nt, Homo sapiens
auuuuaacaucugagaa

SEQ ID NO: 881064 - RNA, 18 nt, Homo sapiens
auuuuaacauuuuccaaa

SEQ ID NO: 881065 - RNA, 20 nt, Homo sapiens
auuuuaauugauuauucuga

SEQ ID NO: 881066 - RNA, 17 nt, Homo sapiens
auuuuacagaagcauuu

SEQ ID NO: 881067 - RNA, 19 nt, Homo sapiens
auuuuacagaagcauuuua

SEQ ID NO: 881068 - RNA, 17 nt, Homo sapiens
auuuuagggcuguagac

SEQ ID NO: 881069 - RNA, 21 nt, Homo sapiens
auuuuagucugucauccagaa

SEQ ID NO: 881070 - RNA, 13 nt, Homo sapiens
auuuuaugcugcu

SEQ ID NO: 881071 - RNA, 22 nt, Homo sapiens
auuuuauguaaagucucucaau

SEQ ID NO: 881072 - RNA, 13 nt, Homo sapiens
auuuuauuauaau

SEQ ID NO: 881073 - RNA, 21 nt, Homo sapiens
auuuucacuagguuugaauga

SEQ ID NO: 881074 - RNA, 15 nt, Homo sapiens
auuuucacucugggc

SEQ ID NO: 881075 - RNA, 14 nt, Homo sapiens
auuuucauuucacu

SEQ ID NO: 881076 - RNA, 18 nt, Homo sapiens
auuuuccccuagcuuucc

SEQ ID NO: 881077 - RNA, 17 nt, Homo sapiens
auuuuccuccaggcaaa

SEQ ID NO: 881078 - RNA, 16 nt, Homo sapiens
auuuuccugaauauua

SEQ ID NO: 881079 - RNA, 19 nt, Homo sapiens
auuuuccuuccuacacccu

SEQ ID NO: 881080 - RNA, 13 nt, Homo sapiens
auuuucuaccugu

SEQ ID NO: 881081 - RNA, 15 nt, Homo sapiens
auuuugauccaagcu

SEQ ID NO: 881082 - RNA, 13 nt, Homo sapiens
auuuugcauuaga

SEQ ID NO: 881083 - RNA, 18 nt, Homo sapiens
auuuugccauaaagucaa

SEQ ID NO: 881084 - RNA, 20 nt, Homo sapiens
auuuugggguacccacugcu

SEQ ID NO: 881085 - RNA, 21 nt, Homo sapiens
auuuuggugaccaauacuacu

SEQ ID NO: 881086 - RNA, 17 nt, Homo sapiens
auuuuguaauaaacucu

SEQ ID NO: 881087 - RNA, 21 nt, Homo sapiens
auuuuguaauaaacucucuag

SEQ ID NO: 881088 - RNA, 23 nt, Homo sapiens
auuuugucugcuuaguaucucau

SEQ ID NO: 881089 - RNA, 21 nt, Homo sapiens
auuuugugaaagaaggagcaa

SEQ ID NO: 881090 - RNA, 16 nt, Homo sapiens
auuuuuaacaccaugg

SEQ ID NO: 881091 - RNA, 18 nt, Homo sapiens
auuuuuaacaggaauuua

SEQ ID NO: 881092 - RNA, 20 nt, Homo sapiens
auuuuucaaccagcauuuua

SEQ ID NO: 881093 - RNA, 23 nt, Homo sapiens
auuuuuggaagaggacuccuuaa

SEQ ID NO: 881094 - RNA, 19 nt, Homo sapiens
auuuuuguagagccagggu

SEQ ID NO: 881095 - RNA, 13 nt, Homo sapiens
auuuuugugauuu

SEQ ID NO: 881096 - RNA, 12 nt, Homo sapiens
auuuuuuccaca

SEQ ID NO: 881097 - RNA, 16 nt, Homo sapiens
auuuuuuuaacacaua

SEQ ID NO: 881098 - RNA, 18 nt, Homo sapiens
auuuuuuugagacagagu

SEQ ID NO: 881099 - RNA, 20 nt, Homo sapiens
auuuuuuuuacugugcauac

SEQ ID NO: 881100 - RNA, 20 nt, Homo sapiens
caaaaaaaaccuucagugaa

SEQ ID NO: 881101 - RNA, 13 nt, Homo sapiens
caaaaaauuugag

SEQ ID NO: 881102 - RNA, 14 nt, Homo sapiens
caaaaagacugugg

SEQ ID NO: 881103 - RNA, 16 nt, Homo sapiens
caaaaaggcauaugca

SEQ ID NO: 881104 - RNA, 22 nt, Homo sapiens
caaaaagggauccguacauuca

SEQ ID NO: 881105 - RNA, 18 nt, Homo sapiens
caaaaauacucacauggc

SEQ ID NO: 881106 - RNA, 18 nt, Homo sapiens
caaaaauguaaugaucau

SEQ ID NO: 881107 - RNA, 14 nt, Homo sapiens
cagagauaugcaca

SEQ ID NO: 881108 - RNA, 12 nt, Homo sapiens
cagagcaauggu

SEQ ID NO: 881109 - RNA, 16 nt, Homo sapiens
cagagcagaaccaaag

SEQ ID NO: 881110 - RNA, 13 nt, Homo sapiens
cagagccuagcca

SEQ ID NO: 881111 - RNA, 16 nt, Homo sapiens
cagagccuuuuacccc

SEQ ID NO: 881112 - RNA, 14 nt, Homo sapiens
cagagcucccuucc

SEQ ID NO: 881113 - RNA, 13 nt, Homo sapiens
cagagcugggaaa

SEQ ID NO: 881114 - RNA, 13 nt, Homo sapiens
cagagcugggcua

SEQ ID NO: 881115 - RNA, 17 nt, Homo sapiens
cagaggauguucuggac

SEQ ID NO: 881116 - RNA, 20 nt, Homo sapiens
cagaggcacagagagaguca

SEQ ID NO: 881117 - RNA, 23 nt, Homo sapiens
cagaggcgucucacauuuuuacu

SEQ ID NO: 881118 - RNA, 19 nt, Homo sapiens
cagaggcugcagaaggcca

SEQ ID NO: 881119 - RNA, 19 nt, Homo sapiens
cagagggggccuucacagu

SEQ ID NO: 881120 - RNA, 22 nt, Homo sapiens
cagagggggccuucacagugac

SEQ ID NO: 881121 - RNA, 23 nt, Homo sapiens
cagagggggccuucacagugacc

SEQ ID NO: 881122 - RNA, 17 nt, Homo sapiens
cagaggguagggcagca

SEQ ID NO: 881123 - RNA, 14 nt, Homo sapiens
cagaggguugugau

SEQ ID NO: 881124 - RNA, 18 nt, Homo sapiens
cagagguaaaagugugag

SEQ ID NO: 881125 - RNA, 20 nt, Homo sapiens
cagaggugacccaaugcucc

SEQ ID NO: 881126 - RNA, 15 nt, Homo sapiens
cagaggugcugucag

SEQ ID NO: 881127 - RNA, 14 nt, Homo sapiens
cagagguuucuuga

SEQ ID NO: 881128 - RNA, 17 nt, Homo sapiens
cagagugaaaugccauu

SEQ ID NO: 881129 - RNA, 14 nt, Homo sapiens
cagagugacaucca

SEQ ID NO: 881130 - RNA, 19 nt, Homo sapiens
cagagugagacucgucuca

SEQ ID NO: 881131 - RNA, 17 nt, Homo sapiens
cagaguggagcccucag

SEQ ID NO: 881132 - RNA, 13 nt, Homo sapiens
cagaguggagucu

SEQ ID NO: 881133 - RNA, 18 nt, Homo sapiens
cagagugugcagacugau

SEQ ID NO: 881134 - RNA, 15 nt, Homo sapiens
cagaguugcuuuaaa

SEQ ID NO: 881135 - RNA, 18 nt, Homo sapiens
cagauaaaacauggacaa

SEQ ID NO: 881136 - RNA, 18 nt, Homo sapiens
cagauaaaggaaggagau

SEQ ID NO: 881137 - RNA, 23 nt, Homo sapiens
cagauaaaggaaggagauacuca

SEQ ID NO: 881138 - RNA, 16 nt, Homo sapiens
cagauagacagugcug

SEQ ID NO: 881139 - RNA, 16 nt, Homo sapiens
cagauauacacaugga

SEQ ID NO: 881140 - RNA, 12 nt, Homo sapiens
cagauaugcaca

SEQ ID NO: 881141 - RNA, 19 nt, Homo sapiens
cagauauuaaauaacagug

SEQ ID NO: 881142 - RNA, 15 nt, Homo sapiens
cagaucaauuuguaa

SEQ ID NO: 881143 - RNA, 14 nt, Homo sapiens
cagaucacucaaaa

SEQ ID NO: 881144 - RNA, 16 nt, Homo sapiens
cagauccucugcugac

SEQ ID NO: 881145 - RNA, 20 nt, Homo sapiens
cagaugaaauuuauuuccau

SEQ ID NO: 881146 - RNA, 14 nt, Homo sapiens
cagaugcaccagcc

SEQ ID NO: 881147 - RNA, 19 nt, Homo sapiens
cagaugcagccgugcagga

SEQ ID NO: 881148 - RNA, 15 nt, Homo sapiens
cagaugcccccguga

SEQ ID NO: 881149 - RNA, 15 nt, Homo sapiens
cagauggagacauug

SEQ ID NO: 881150 - RNA, 15 nt, Homo sapiens
cagauggguauuaaa

SEQ ID NO: 881151 - RNA, 15 nt, Homo sapiens
cagauguaaaugcca

SEQ ID NO: 881152 - RNA, 19 nt, Homo sapiens
cagauguuuacagacugug

SEQ ID NO: 881153 - RNA, 15 nt, Homo sapiens
cagauuccacacaaa

SEQ ID NO: 881154 - RNA, 15 nt, Homo sapiens
cagauucccagagca

SEQ ID NO: 881155 - RNA, 21 nt, Homo sapiens
cagauucuuccacuggcucca

SEQ ID NO: 881156 - RNA, 16 nt, Homo sapiens
cagauugacaagguag

SEQ ID NO: 881157 - RNA, 19 nt, Homo sapiens
cagauugcaacaggcuggg

SEQ ID NO: 881158 - RNA, 19 nt, Homo sapiens
cagauuuccuaacucuggu

SEQ ID NO: 881159 - RNA, 20 nt, Homo sapiens
cagauuugggaggccccucc

SEQ ID NO: 881160 - RNA, 14 nt, Homo sapiens
cagauuuguguuau

SEQ ID NO: 881161 - RNA, 16 nt, Homo sapiens
cagcaaaccucaguca

SEQ ID NO: 881162 - RNA, 15 nt, Homo sapiens
cagcacaguuuuuaa

SEQ ID NO: 881163 - RNA, 14 nt, Homo sapiens
cagcacuaauucaa

SEQ ID NO: 881164 - RNA, 19 nt, Homo sapiens
cagcacucugaaacugaga

SEQ ID NO: 881165 - RNA, 22 nt, Homo sapiens
cagcacugccggcccagugaca

SEQ ID NO: 881166 - RNA, 16 nt, Homo sapiens
cagcagaaaaucuuuu

SEQ ID NO: 881167 - RNA, 20 nt, Homo sapiens
cagcagaaagguuaguauca

SEQ ID NO: 881168 - RNA, 21 nt, Homo sapiens
cagcagccacuugacuaauac

SEQ ID NO: 881169 - RNA, 16 nt, Homo sapiens
cagcagcccuaaggau

SEQ ID NO: 881170 - RNA, 21 nt, Homo sapiens
cagcagcucaggcacacuucu

SEQ ID NO: 881171 - RNA, 17 nt, Homo sapiens
cagcagcugaacagcca

SEQ ID NO: 881172 - RNA, 22 nt, Homo sapiens
cagcagugugucaggugcugca

SEQ ID NO: 881173 - RNA, 21 nt, Homo sapiens
cagcaguugaaaagacuccaa

SEQ ID NO: 881174 - RNA, 21 nt, Homo sapiens
cagcauaccugcuggugcaga

SEQ ID NO: 881175 - RNA, 22 nt, Homo sapiens
cagcauaccuuuauugugaucu

SEQ ID NO: 881176 - RNA, 11 nt, Homo sapiens
cagcaucaggg

SEQ ID NO: 881177 - RNA, 15 nt, Homo sapiens
cagcaucugcuaaua

SEQ ID NO: 881178 - RNA, 23 nt, Homo sapiens
cagcaugaaggcagccacagaca

SEQ ID NO: 881179 - RNA, 16 nt, Homo sapiens
cagcauuauucuucag

SEQ ID NO: 881180 - RNA, 14 nt, Homo sapiens
cagcauucaggggu

SEQ ID NO: 881181 - RNA, 17 nt, Homo sapiens
cagcauucucacuccua

SEQ ID NO: 881182 - RNA, 21 nt, Homo sapiens
cagcauuuucacauuuugccu

SEQ ID NO: 881183 - RNA, 14 nt, Homo sapiens
cagccaaacacaga

SEQ ID NO: 881184 - RNA, 16 nt, Homo sapiens
cagccaaacagagccu

SEQ ID NO: 881185 - RNA, 14 nt, Homo sapiens
cagccaacugcccc

SEQ ID NO: 881186 - RNA, 16 nt, Homo sapiens
cagccacacagagccu

SEQ ID NO: 881187 - RNA, 18 nt, Homo sapiens
cagccaggagaugcuggg

SEQ ID NO: 881188 - RNA, 17 nt, Homo sapiens
cagccagguuagccuuu

SEQ ID NO: 881189 - RNA, 21 nt, Homo sapiens
cagccaucccgucuucuccaa

SEQ ID NO: 881190 - RNA, 18 nt, Homo sapiens
cagccauuaccauggaga

SEQ ID NO: 881191 - RNA, 21 nt, Homo sapiens
cagccccagcugacaccugga

SEQ ID NO: 881192 - RNA, 19 nt, Homo sapiens
cagcccccaccuccgcccc

SEQ ID NO: 881193 - RNA, 13 nt, Homo sapiens
cagcccuauggau

SEQ ID NO: 881194 - RNA, 15 nt, Homo sapiens
cagcccucaggccag

SEQ ID NO: 881195 - RNA, 18 nt, Homo sapiens
cagcccuguccccugaaa

SEQ ID NO: 881196 - RNA, 14 nt, Homo sapiens
cagccggguaccuc

SEQ ID NO: 881197 - RNA, 20 nt, Homo sapiens
cagccucagaaaccagacuc

SEQ ID NO: 881198 - RNA, 19 nt, Homo sapiens
cagccucagugccacuuga

SEQ ID NO: 881199 - RNA, 18 nt, Homo sapiens
cagccucccaaguagcug

SEQ ID NO: 881200 - RNA, 19 nt, Homo sapiens
cagccucccaaguagcugg

SEQ ID NO: 881201 - RNA, 22 nt, Homo sapiens
cagccuccccacauauggcaca

SEQ ID NO: 881202 - RNA, 20 nt, Homo sapiens
cagccucccgaguagcugag

SEQ ID NO: 881203 - RNA, 19 nt, Homo sapiens
cagccucccgaguagcugg

SEQ ID NO: 881204 - RNA, 17 nt, Homo sapiens
cagccuccuccugacca

SEQ ID NO: 881205 - RNA, 14 nt, Homo sapiens
cagccugauggcca

SEQ ID NO: 881206 - RNA, 17 nt, Homo sapiens
cagccugcagacucacu

SEQ ID NO: 881207 - RNA, 18 nt, Homo sapiens
cagccugggcaacagagc

SEQ ID NO: 881208 - RNA, 22 nt, Homo sapiens
cagccuggggggucguggcaga

SEQ ID NO: 881209 - RNA, 21 nt, Homo sapiens
cagccuggucaacauggugaa

SEQ ID NO: 881210 - RNA, 22 nt, Homo sapiens
cagccuugcaucaagggcuuua

SEQ ID NO: 881211 - RNA, 16 nt, Homo sapiens
cagcgagcccuggugg

SEQ ID NO: 881212 - RNA, 14 nt, Homo sapiens
cagcgccaccucuu

SEQ ID NO: 881213 - RNA, 24 nt, Homo sapiens
cagcgccaccucuugucagugcuc

SEQ ID NO: 881214 - RNA, 16 nt, Homo sapiens
cagcgcgugcacagcg

SEQ ID NO: 881215 - RNA, 19 nt, Homo sapiens
cagcgucccgcguagcugg

SEQ ID NO: 881216 - RNA, 18 nt, Homo sapiens
cagcgucccuagcaguga

SEQ ID NO: 881217 - RNA, 13 nt, Homo sapiens
cagcuacucagga

SEQ ID NO: 881218 - RNA, 18 nt, Homo sapiens
cagcuaucugucaucucu

SEQ ID NO: 881219 - RNA, 19 nt, Homo sapiens
cagcucacacccuaauaag

SEQ ID NO: 881220 - RNA, 20 nt, Homo sapiens
cagcugaccuuugucaucuu

SEQ ID NO: 881221 - RNA, 13 nt, Homo sapiens
cagcugcaccugc

SEQ ID NO: 881222 - RNA, 22 nt, Homo sapiens
cuacaaaggagacgggggagca

SEQ ID NO: 881223 - RNA, 14 nt, Homo sapiens
cuacaaaggccaug

SEQ ID NO: 881224 - RNA, 14 nt, Homo sapiens
cuacaaauuaucau

SEQ ID NO: 881225 - RNA, 21 nt, Homo sapiens
cuacaacaaauacuacaggcc

SEQ ID NO: 881226 - RNA, 22 nt, Homo sapiens
cuacaccacucuggcagccaca

SEQ ID NO: 881227 - RNA, 22 nt, Homo sapiens
cuacaccuuagcagcucuuccc

SEQ ID NO: 881228 - RNA, 14 nt, Homo sapiens
cuacagauuuuaga

SEQ ID NO: 881229 - RNA, 23 nt, Homo sapiens
cuacaggugcaagccacuauguc

SEQ ID NO: 881230 - RNA, 16 nt, Homo sapiens
cuacaguggcugucac

SEQ ID NO: 881231 - RNA, 21 nt, Homo sapiens
cuacauauucuuuaaauuuca

SEQ ID NO: 881232 - RNA, 21 nt, Homo sapiens
cuaccaaagcaccuuagcugg

SEQ ID NO: 881233 - RNA, 19 nt, Homo sapiens
cuaccccaagaugccccuc

SEQ ID NO: 881234 - RNA, 13 nt, Homo sapiens
cuacccccugaaa

SEQ ID NO: 881235 - RNA, 14 nt, Homo sapiens
cuacccgagcccag

SEQ ID NO: 881236 - RNA, 23 nt, Homo sapiens
cuacccggcccagagaccccuuc

SEQ ID NO: 881237 - RNA, 17 nt, Homo sapiens
cuaccugaggccuaucu

SEQ ID NO: 881238 - RNA, 14 nt, Homo sapiens
cuacguuaacccau

SEQ ID NO: 881239 - RNA, 21 nt, Homo sapiens
cuacuaaagugccuaccccag

SEQ ID NO: 881240 - RNA, 13 nt, Homo sapiens
cuacuauucuguu

SEQ ID NO: 881241 - RNA, 14 nt, Homo sapiens
cuacucaagcugcu

SEQ ID NO: 881242 - RNA, 13 nt, Homo sapiens
cuacucuauguau

SEQ ID NO: 881243 - RNA, 14 nt, Homo sapiens
cuacucucuugcca

SEQ ID NO: 881244 - RNA, 19 nt, Homo sapiens
cuacuucugucuuccuuca

SEQ ID NO: 881245 - RNA, 17 nt, Homo sapiens
cuacuucuuuugcucuu

SEQ ID NO: 881246 - RNA, 16 nt, Homo sapiens
cuacuuguaaaggugc

SEQ ID NO: 881247 - RNA, 19 nt, Homo sapiens
cuagaacaugcacauuuau

SEQ ID NO: 881248 - RNA, 19 nt, Homo sapiens
cuagaaccuagaagggcua

SEQ ID NO: 881249 - RNA, 19 nt, Homo sapiens
cuagaaccuggaagggcua

SEQ ID NO: 881250 - RNA, 13 nt, Homo sapiens
cuagaaccuggag

SEQ ID NO: 881251 - RNA, 18 nt, Homo sapiens
cuagaaucuggagagcua

SEQ ID NO: 881252 - RNA, 18 nt, Homo sapiens
cuagaaugcacaccaaaa

SEQ ID NO: 881253 - RNA, 17 nt, Homo sapiens
cuagagaaaagucuacc

SEQ ID NO: 881254 - RNA, 19 nt, Homo sapiens
cuagagaaggacccggagg

SEQ ID NO: 881255 - RNA, 18 nt, Homo sapiens
cuagagcacacuguagca

SEQ ID NO: 881256 - RNA, 12 nt, Homo sapiens
cuagaggugcuc

SEQ ID NO: 881257 - RNA, 14 nt, Homo sapiens
cuagagugcagugg

SEQ ID NO: 881258 - RNA, 20 nt, Homo sapiens
cuagagugcgguggcgcgau

SEQ ID NO: 881259 - RNA, 14 nt, Homo sapiens
cuagaucaauuaau

SEQ ID NO: 881260 - RNA, 15 nt, Homo sapiens
cuagcaauuccauca

SEQ ID NO: 881261 - RNA, 16 nt, Homo sapiens
cuagcacuuggagcca

SEQ ID NO: 881262 - RNA, 15 nt, Homo sapiens
cuagcagcugcaguc

SEQ ID NO: 881263 - RNA, 16 nt, Homo sapiens
cuagcaggaauauuuc

SEQ ID NO: 881264 - RNA, 17 nt, Homo sapiens
cuagcaggcacaggaca

SEQ ID NO: 881265 - RNA, 17 nt, Homo sapiens
cuagcaucucaugagug

SEQ ID NO: 881266 - RNA, 22 nt, Homo sapiens
cuagcaucucaugagugccaag

SEQ ID NO: 881267 - RNA, 16 nt, Homo sapiens
cuagcauuuucuugaa

SEQ ID NO: 881268 - RNA, 20 nt, Homo sapiens
cuagccacaucacuacagua

SEQ ID NO: 881269 - RNA, 15 nt, Homo sapiens
cuagcccacuuguca

SEQ ID NO: 881270 - RNA, 14 nt, Homo sapiens
cuagccgaccucag

SEQ ID NO: 881271 - RNA, 20 nt, Homo sapiens
cuagccgcgugugacagucu

SEQ ID NO: 881272 - RNA, 17 nt, Homo sapiens
cuagcugcaagugacau

SEQ ID NO: 881273 - RNA, 15 nt, Homo sapiens
cuagcugugaccucu

SEQ ID NO: 881274 - RNA, 14 nt, Homo sapiens
cuaggaaugcuuuu

SEQ ID NO: 881275 - RNA, 12 nt, Homo sapiens
cuaggaccucau

SEQ ID NO: 881276 - RNA, 16 nt, Homo sapiens
cuaggacuccacaguu

SEQ ID NO: 881277 - RNA, 19 nt, Homo sapiens
cuaggagcugggaggaaaa

SEQ ID NO: 881278 - RNA, 22 nt, Homo sapiens
cuaggauuacaggcaugagcca

SEQ ID NO: 881279 - RNA, 18 nt, Homo sapiens
cuaggccacaccaucucc

SEQ ID NO: 881280 - RNA, 21 nt, Homo sapiens
cuaggcugagcuggcauuggu

SEQ ID NO: 881281 - RNA, 17 nt, Homo sapiens
cuaggcuuaaaugcaau

SEQ ID NO: 881282 - RNA, 18 nt, Homo sapiens
cuagggccuuuuguggau

SEQ ID NO: 881283 - RNA, 22 nt, Homo sapiens
cuagggcuggagggacagggag

SEQ ID NO: 881284 - RNA, 18 nt, Homo sapiens
cuaggggucaggcuccau

SEQ ID NO: 881285 - RNA, 23 nt, Homo sapiens
cuaguaucacauagaagcugucc

SEQ ID NO: 881286 - RNA, 18 nt, Homo sapiens
cuaguauuguccauauca

SEQ ID NO: 881287 - RNA, 16 nt, Homo sapiens
cuaguccuuuacuaau

SEQ ID NO: 881288 - RNA, 19 nt, Homo sapiens
cuagucugcuagccaggau

SEQ ID NO: 881289 - RNA, 22 nt, Homo sapiens
cuagugaaagaggcagcuugaa

SEQ ID NO: 881290 - RNA, 22 nt, Homo sapiens
cuagugauuugccucaacaacg

SEQ ID NO: 881291 - RNA, 18 nt, Homo sapiens
cuaguuccucuucuuaag

SEQ ID NO: 881292 - RNA, 16 nt, Homo sapiens
cuaguucuaauucccu

SEQ ID NO: 881293 - RNA, 22 nt, Homo sapiens
cuaguugaacaucucacuuugc

SEQ ID NO: 881294 - RNA, 23 nt, Homo sapiens
cuaguugaacaucucacuuugcc

SEQ ID NO: 881295 - RNA, 14 nt, Homo sapiens
cuaguuugaccuca

SEQ ID NO: 881296 - RNA, 20 nt, Homo sapiens
cuauaaaaagaaguguuccu

SEQ ID NO: 881297 - RNA, 15 nt, Homo sapiens
cuauaaacuacugua

SEQ ID NO: 881298 - RNA, 17 nt, Homo sapiens
cuauaacaugucuuuca

SEQ ID NO: 881299 - RNA, 16 nt, Homo sapiens
cuauaagcaugaucuu

SEQ ID NO: 881300 - RNA, 23 nt, Homo sapiens
cuauacaaacuacagaguuuaug

SEQ ID NO: 881301 - RNA, 23 nt, Homo sapiens
cuauagccuaggugacagaguga

SEQ ID NO: 881302 - RNA, 15 nt, Homo sapiens
cuauauacaugugug

SEQ ID NO: 881303 - RNA, 18 nt, Homo sapiens
cuauauguaguauaaaga

SEQ ID NO: 881304 - RNA, 17 nt, Homo sapiens
cuauauugcacugugac

SEQ ID NO: 881305 - RNA, 20 nt, Homo sapiens
cuauauuggaaucuguauca

SEQ ID NO: 881306 - RNA, 17 nt, Homo sapiens
cuaucaaaacauaucaa

SEQ ID NO: 881307 - RNA, 21 nt, Homo sapiens
cuaucaaccuaagcaacagaa

SEQ ID NO: 881308 - RNA, 14 nt, Homo sapiens
cuaucaauagucaa

SEQ ID NO: 881309 - RNA, 16 nt, Homo sapiens
cuaucaauuacagucc

SEQ ID NO: 881310 - RNA, 21 nt, Homo sapiens
cuaucauuuauuuacaucuau

SEQ ID NO: 881311 - RNA, 23 nt, Homo sapiens
cuaucauuuauuuacaucuaugu

SEQ ID NO: 881312 - RNA, 19 nt, Homo sapiens
cuaucuauggcccugcaaa

SEQ ID NO: 881313 - RNA, 20 nt, Homo sapiens
cuaucuauggcccugcaaaa

SEQ ID NO: 881314 - RNA, 17 nt, Homo sapiens
cuaucuccaaaugagac

SEQ ID NO: 881315 - RNA, 20 nt, Homo sapiens
cuaucugauuuccuaauguc

SEQ ID NO: 881316 - RNA, 15 nt, Homo sapiens
cuaucugugaaguua

SEQ ID NO: 881317 - RNA, 15 nt, Homo sapiens
cuaugaucacaguga

SEQ ID NO: 881318 - RNA, 19 nt, Homo sapiens
cuaugcaacagcucucacc

SEQ ID NO: 881319 - RNA, 22 nt, Homo sapiens
cuaugcaacagcucucaccuac

SEQ ID NO: 881320 - RNA, 15 nt, Homo sapiens
cuaugcaagccuugc

SEQ ID NO: 881321 - RNA, 23 nt, Homo sapiens
cuaugcacauauggacucugcac

SEQ ID NO: 881322 - RNA, 19 nt, Homo sapiens
cuauggaaggguaauuuga

SEQ ID NO: 881323 - RNA, 20 nt, Homo sapiens
cuauggagagcccugggacc

SEQ ID NO: 881324 - RNA, 19 nt, Homo sapiens
cuauggcagccauccauga

SEQ ID NO: 881325 - RNA, 11 nt, Homo sapiens
cuaugggacuc

SEQ ID NO: 881326 - RNA, 22 nt, Homo sapiens
cuauguauggaugaaagcaauc

SEQ ID NO: 881327 - RNA, 22 nt, Homo sapiens
cuaugucuuguuuuaaguugcu

SEQ ID NO: 881328 - RNA, 16 nt, Homo sapiens
cuauuacgugcaauac

SEQ ID NO: 881329 - RNA, 15 nt, Homo sapiens
cuauuagacaugaaa

SEQ ID NO: 881330 - RNA, 21 nt, Homo sapiens
cuauuagacaugaaaucugag

SEQ ID NO: 881331 - RNA, 18 nt, Homo sapiens
cuauuagagaaacaaaca

SEQ ID NO: 881332 - RNA, 19 nt, Homo sapiens
cuauucaaaaggaaauaua

SEQ ID NO: 881333 - RNA, 19 nt, Homo sapiens
cuauucaaguauuaggggu

SEQ ID NO: 881334 - RNA, 22 nt, Homo sapiens
cuauuccauggcuaacuggcga

SEQ ID NO: 881335 - RNA, 17 nt, Homo sapiens
cuauucuaaguaauucc

SEQ ID NO: 881336 - RNA, 20 nt, Homo sapiens
cugcaauuuuaauugauuau

SEQ ID NO: 881337 - RNA, 22 nt, Homo sapiens
cugcacagauauuuccauuucu

SEQ ID NO: 881338 - RNA, 15 nt, Homo sapiens
cugcacccucgauga

SEQ ID NO: 881339 - RNA, 20 nt, Homo sapiens
cugcaccgagagagauggaa

SEQ ID NO: 881340 - RNA, 22 nt, Homo sapiens
cugcaccgagagagauggaaua

SEQ ID NO: 881341 - RNA, 20 nt, Homo sapiens
cugcacuaauuugauguuua

SEQ ID NO: 881342 - RNA, 23 nt, Homo sapiens
cugcacuaauuugauguuuacag

SEQ ID NO: 881343 - RNA, 20 nt, Homo sapiens
cugcacuccagccugggcaa

SEQ ID NO: 881344 - RNA, 17 nt, Homo sapiens
cugcagaaggccaagaa

SEQ ID NO: 881345 - RNA, 19 nt, Homo sapiens
cugcagacaccugccuuaa

SEQ ID NO: 881346 - RNA, 18 nt, Homo sapiens
cugcagacucacuguggg

SEQ ID NO: 881347 - RNA, 19 nt, Homo sapiens
cugcagacucacuguggga

SEQ ID NO: 881348 - RNA, 18 nt, Homo sapiens
cugcagagagaagccugu

SEQ ID NO: 881349 - RNA, 14 nt, Homo sapiens
cugcagaggauuua

SEQ ID NO: 881350 - RNA, 21 nt, Homo sapiens
cugcagcacuucacuaccaaa

SEQ ID NO: 881351 - RNA, 19 nt, Homo sapiens
cugcagccccagcugacac

SEQ ID NO: 881352 - RNA, 21 nt, Homo sapiens
cugcagccccgcgccuccuuc

SEQ ID NO: 881353 - RNA, 16 nt, Homo sapiens
cugcagccugguagaa

SEQ ID NO: 881354 - RNA, 19 nt, Homo sapiens
cugcagcggcacaaaugca

SEQ ID NO: 881355 - RNA, 19 nt, Homo sapiens
cugcagcugggccccaugc

SEQ ID NO: 881356 - RNA, 13 nt, Homo sapiens
cugcaggccaaga

SEQ ID NO: 881357 - RNA, 21 nt, Homo sapiens
cugcagugacgugcaccugua

SEQ ID NO: 881358 - RNA, 15 nt, Homo sapiens
cugcaguuccaucag

SEQ ID NO: 881359 - RNA, 17 nt, Homo sapiens
cugcauaaacuucaucu

SEQ ID NO: 881360 - RNA, 18 nt, Homo sapiens
cugcaugcacuucuuaca

SEQ ID NO: 881361 - RNA, 22 nt, Homo sapiens
cugcauucuuuuaaaguuuuau

SEQ ID NO: 881362 - RNA, 13 nt, Homo sapiens
cugcauugcugag

SEQ ID NO: 881363 - RNA, 12 nt, Homo sapiens
cugccaagccac

SEQ ID NO: 881364 - RNA, 22 nt, Homo sapiens
cugccaagcccucaauaagcca

SEQ ID NO: 881365 - RNA, 11 nt, Homo sapiens
cugccaccacc

SEQ ID NO: 881366 - RNA, 16 nt, Homo sapiens
cugccacccuggggag

SEQ ID NO: 881367 - RNA, 15 nt, Homo sapiens
cugccacugaccuca

SEQ ID NO: 881368 - RNA, 16 nt, Homo sapiens
cugccagccacaucca

SEQ ID NO: 881369 - RNA, 20 nt, Homo sapiens
cugccagugccuuaccuccu

SEQ ID NO: 881370 - RNA, 19 nt, Homo sapiens
cugccauauucuguuggcc

SEQ ID NO: 881371 - RNA, 15 nt, Homo sapiens
cugccauuacucugc

SEQ ID NO: 881372 - RNA, 19 nt, Homo sapiens
cugccauugucgucuuuau

SEQ ID NO: 881373 - RNA, 20 nt, Homo sapiens
cugcccaaacauaaagagaa

SEQ ID NO: 881374 - RNA, 18 nt, Homo sapiens
cugcccacccacuccuua

SEQ ID NO: 881375 - RNA, 20 nt, Homo sapiens
cugcccacucccaggaccaa

SEQ ID NO: 881376 - RNA, 15 nt, Homo sapiens
cugcccagugcacuu

SEQ ID NO: 881377 - RNA, 19 nt, Homo sapiens
cugcccgaccccaucucau

SEQ ID NO: 881378 - RNA, 16 nt, Homo sapiens
cugcccuagagcacac

SEQ ID NO: 881379 - RNA, 18 nt, Homo sapiens
cugcccugccaccugucu

SEQ ID NO: 881380 - RNA, 23 nt, Homo sapiens
cugccuccauucugaccauuuca

SEQ ID NO: 881381 - RNA, 14 nt, Homo sapiens
cugccugagcccag

SEQ ID NO: 881382 - RNA, 17 nt, Homo sapiens
cugccugcaucuauucu

SEQ ID NO: 881383 - RNA, 23 nt, Homo sapiens
cugccuggguuuucuaacuguaa

SEQ ID NO: 881384 - RNA, 22 nt, Homo sapiens
cugccugguaugaguugcccau

SEQ ID NO: 881385 - RNA, 14 nt, Homo sapiens
cugccugugcauga

SEQ ID NO: 881386 - RNA, 22 nt, Homo sapiens
cugccuuaacacacacaccucu

SEQ ID NO: 881387 - RNA, 20 nt, Homo sapiens
cugccuuccacaauucacua

SEQ ID NO: 881388 - RNA, 18 nt, Homo sapiens
cugccuugauuagacucc

SEQ ID NO: 881389 - RNA, 13 nt, Homo sapiens
cugccuugccaug

SEQ ID NO: 881390 - RNA, 21 nt, Homo sapiens
cugccuugccaugucuuguuc

SEQ ID NO: 881391 - RNA, 17 nt, Homo sapiens
cugccuuuucaucuaau

SEQ ID NO: 881392 - RNA, 16 nt, Homo sapiens
cugcgagcauuucccu

SEQ ID NO: 881393 - RNA, 13 nt, Homo sapiens
cugcggcgaccgc

SEQ ID NO: 881394 - RNA, 21 nt, Homo sapiens
cugcguccgcaucacucugca

SEQ ID NO: 881395 - RNA, 17 nt, Homo sapiens
cugcgugguugaugauc

SEQ ID NO: 881396 - RNA, 12 nt, Homo sapiens
cugcuaccaagg

SEQ ID NO: 881397 - RNA, 17 nt, Homo sapiens
cugcuaccucacugggg

SEQ ID NO: 881398 - RNA, 21 nt, Homo sapiens
cugcuagauaucacuuacuca

SEQ ID NO: 881399 - RNA, 18 nt, Homo sapiens
cugcuauaggucagagau

SEQ ID NO: 881400 - RNA, 16 nt, Homo sapiens
cugcuauuauguaaca

SEQ ID NO: 881401 - RNA, 15 nt, Homo sapiens
cugcucaaaucauuu

SEQ ID NO: 881402 - RNA, 15 nt, Homo sapiens
cugcucauccagggu

SEQ ID NO: 881403 - RNA, 21 nt, Homo sapiens
cugcucccaaauaaacuccag

SEQ ID NO: 881404 - RNA, 14 nt, Homo sapiens
cugcuccgagucuu

SEQ ID NO: 881405 - RNA, 16 nt, Homo sapiens
cugcuccucccauucc

SEQ ID NO: 881406 - RNA, 19 nt, Homo sapiens
cugcucggggugcacagga

SEQ ID NO: 881407 - RNA, 18 nt, Homo sapiens
cugcucuccgaccagaca

SEQ ID NO: 881408 - RNA, 22 nt, Homo sapiens
cugcucuggaaaaugugaccca

SEQ ID NO: 881409 - RNA, 14 nt, Homo sapiens
cugcugacaguguu

SEQ ID NO: 881410 - RNA, 20 nt, Homo sapiens
cugcugagcugcgugccaca

SEQ ID NO: 881411 - RNA, 19 nt, Homo sapiens
cugcugagugcaccacuuc

SEQ ID NO: 881412 - RNA, 19 nt, Homo sapiens
cugcugaucaaugaaaugc

SEQ ID NO: 881413 - RNA, 15 nt, Homo sapiens
cugcugcaaagugca

SEQ ID NO: 881414 - RNA, 19 nt, Homo sapiens
cugcugcagcaugaaggca

SEQ ID NO: 881415 - RNA, 13 nt, Homo sapiens
cugcugcugcuau

SEQ ID NO: 881416 - RNA, 20 nt, Homo sapiens
cugcugguaauuuguaucug

SEQ ID NO: 881417 - RNA, 15 nt, Homo sapiens
cugcuguauacugua

SEQ ID NO: 881418 - RNA, 22 nt, Homo sapiens
cugcugugcccucccauagcac

SEQ ID NO: 881419 - RNA, 17 nt, Homo sapiens
cugcuguguagcucugu

SEQ ID NO: 881420 - RNA, 19 nt, Homo sapiens
cugcuguucauguuacuca

SEQ ID NO: 881421 - RNA, 12 nt, Homo sapiens
cugcuguugcca

SEQ ID NO: 881422 - RNA, 16 nt, Homo sapiens
cugcuuacuaaugugc

SEQ ID NO: 881423 - RNA, 14 nt, Homo sapiens
cugcuuaguaucuc

SEQ ID NO: 881424 - RNA, 19 nt, Homo sapiens
cugcuucccagcuucacaa

SEQ ID NO: 881425 - RNA, 21 nt, Homo sapiens
cugcuuccuccccuccuggca

SEQ ID NO: 881426 - RNA, 12 nt, Homo sapiens
cugcuuggucaa

SEQ ID NO: 881427 - RNA, 18 nt, Homo sapiens
cugcuuuguauccaugag

SEQ ID NO: 881428 - RNA, 18 nt, Homo sapiens
cugcuuuugaggacaguu

SEQ ID NO: 881429 - RNA, 19 nt, Homo sapiens
cuggaaaagucacacagac

SEQ ID NO: 881430 - RNA, 14 nt, Homo sapiens
cuggaaaaugugac

SEQ ID NO: 881431 - RNA, 16 nt, Homo sapiens
cuggaaaccacguggu

SEQ ID NO: 881432 - RNA, 16 nt, Homo sapiens
cuggaaagacauagcc

SEQ ID NO: 881433 - RNA, 16 nt, Homo sapiens
cuggaaauaaaccugg

SEQ ID NO: 881434 - RNA, 13 nt, Homo sapiens
cuggaacaccagg

SEQ ID NO: 881435 - RNA, 13 nt, Homo sapiens
cuggaacccagga

SEQ ID NO: 881436 - RNA, 22 nt, Homo sapiens
cuggaagaaggaagaagccaga

SEQ ID NO: 881437 - RNA, 15 nt, Homo sapiens
cuggaagcauuuguu

SEQ ID NO: 881438 - RNA, 15 nt, Homo sapiens
cuggaagccaaacaa

SEQ ID NO: 881439 - RNA, 19 nt, Homo sapiens
cuggaauaagaagcaaaua

SEQ ID NO: 881440 - RNA, 15 nt, Homo sapiens
cuggaauuuaauuca

SEQ ID NO: 881441 - RNA, 13 nt, Homo sapiens
cuggacaagccaa

SEQ ID NO: 881442 - RNA, 20 nt, Homo sapiens
cuggacacuuauggggacag

SEQ ID NO: 881443 - RNA, 14 nt, Homo sapiens
cuggaccagccugu

SEQ ID NO: 881444 - RNA, 14 nt, Homo sapiens
cuggaccucagguu

SEQ ID NO: 881445 - RNA, 15 nt, Homo sapiens
cuggacugaggacca

SEQ ID NO: 881446 - RNA, 17 nt, Homo sapiens
cuggacugugugcaacg

SEQ ID NO: 881447 - RNA, 20 nt, Homo sapiens
cuggagaacuagagaaggac

SEQ ID NO: 881448 - RNA, 22 nt, Homo sapiens
cuggagauggaaaaucacacca

SEQ ID NO: 881449 - RNA, 17 nt, Homo sapiens
cuggagcaucugacuca

SEQ ID NO: 881450 - RNA, 13 nt, Homo sapiens
cuuguugcugagu

SEQ ID NO: 881451 - RNA, 18 nt, Homo sapiens
cuuguuguuuuuaagucc

SEQ ID NO: 881452 - RNA, 22 nt, Homo sapiens
cuuuaaacuacccuccagagug

SEQ ID NO: 881453 - RNA, 14 nt, Homo sapiens
cuuuaaagacuuaa

SEQ ID NO: 881454 - RNA, 17 nt, Homo sapiens
cuuuaaaguaccuguag

SEQ ID NO: 881455 - RNA, 15 nt, Homo sapiens
cuuuaaauccuucca

SEQ ID NO: 881456 - RNA, 15 nt, Homo sapiens
cuuuaaauggcuuua

SEQ ID NO: 881457 - RNA, 18 nt, Homo sapiens
cuuuaaauuucaucucag

SEQ ID NO: 881458 - RNA, 16 nt, Homo sapiens
cuuuaaccauggugcu

SEQ ID NO: 881459 - RNA, 18 nt, Homo sapiens
cuuuaagguguuggugua

SEQ ID NO: 881460 - RNA, 14 nt, Homo sapiens
cuuuaaguuuagaa

SEQ ID NO: 881461 - RNA, 18 nt, Homo sapiens
cuuuaauacucaccuccu

SEQ ID NO: 881462 - RNA, 21 nt, Homo sapiens
cuuuaauacucaccuccuccc

SEQ ID NO: 881463 - RNA, 12 nt, Homo sapiens
cuuuaaugggag

SEQ ID NO: 881464 - RNA, 19 nt, Homo sapiens
cuuuaauucucaugugauc

SEQ ID NO: 881465 - RNA, 20 nt, Homo sapiens
cuuuacaaucugcacuuuaa

SEQ ID NO: 881466 - RNA, 20 nt, Homo sapiens
cuuuacaggagguuguggau

SEQ ID NO: 881467 - RNA, 15 nt, Homo sapiens
cuuuaccacuaugca

SEQ ID NO: 881468 - RNA, 15 nt, Homo sapiens
cuuuacguaucugcu

SEQ ID NO: 881469 - RNA, 21 nt, Homo sapiens
cuuuagagaauaccaguguua

SEQ ID NO: 881470 - RNA, 14 nt, Homo sapiens
cuuuagcuaccuca

SEQ ID NO: 881471 - RNA, 19 nt, Homo sapiens
cuuuaggagacuaauggaa

SEQ ID NO: 881472 - RNA, 18 nt, Homo sapiens
cuuuaggcagcagcuuuu

SEQ ID NO: 881473 - RNA, 19 nt, Homo sapiens
cuuuagggcuuauggccag

SEQ ID NO: 881474 - RNA, 14 nt, Homo sapiens
cuuuaggggaccau

SEQ ID NO: 881475 - RNA, 18 nt, Homo sapiens
cuuuauaugauauacuau

SEQ ID NO: 881476 - RNA, 21 nt, Homo sapiens
cuuuauauuuuuaacuuuaag

SEQ ID NO: 881477 - RNA, 14 nt, Homo sapiens
cuuuaucagugaug

SEQ ID NO: 881478 - RNA, 14 nt, Homo sapiens
cuuuaucugugaua

SEQ ID NO: 881479 - RNA, 22 nt, Homo sapiens
cuuuaugcuaguuugaccucau

SEQ ID NO: 881480 - RNA, 19 nt, Homo sapiens
cuuuauguauggagcucua

SEQ ID NO: 881481 - RNA, 16 nt, Homo sapiens
cuuuauugcugugaau

SEQ ID NO: 881482 - RNA, 14 nt, Homo sapiens
cuuuauugugaucu

SEQ ID NO: 881483 - RNA, 15 nt, Homo sapiens
cuuuauugugaucua

SEQ ID NO: 881484 - RNA, 19 nt, Homo sapiens
cuuuauuuguauuugccau

SEQ ID NO: 881485 - RNA, 24 nt, Homo sapiens
cuuucaacuuaaaucacugaggca

SEQ ID NO: 881486 - RNA, 15 nt, Homo sapiens
cuuucaggaccuuuu

SEQ ID NO: 881487 - RNA, 13 nt, Homo sapiens
cuuucccaaauaa

SEQ ID NO: 881488 - RNA, 22 nt, Homo sapiens
cuuucccagaaaaaaaaaaacu

SEQ ID NO: 881489 - RNA, 21 nt, Homo sapiens
cuuucccggacugcaagcagg

SEQ ID NO: 881490 - RNA, 15 nt, Homo sapiens
cuuucccuuuaucag

SEQ ID NO: 881491 - RNA, 16 nt, Homo sapiens
cuuuccgucucccuaa

SEQ ID NO: 881492 - RNA, 19 nt, Homo sapiens
cuuuccucagaucauccag

SEQ ID NO: 881493 - RNA, 13 nt, Homo sapiens
cuuucuccuccaa

SEQ ID NO: 881494 - RNA, 23 nt, Homo sapiens
cuuucucgugguagaagccagua

SEQ ID NO: 881495 - RNA, 20 nt, Homo sapiens
cuuucucuaucccaagccaa

SEQ ID NO: 881496 - RNA, 13 nt, Homo sapiens
cuuucugagugac

SEQ ID NO: 881497 - RNA, 15 nt, Homo sapiens
cuuucuggaaaagag

SEQ ID NO: 881498 - RNA, 15 nt, Homo sapiens
cuuucuguugccaca

SEQ ID NO: 881499 - RNA, 13 nt, Homo sapiens
cuuucuugacucu

SEQ ID NO: 881500 - RNA, 17 nt, Homo sapiens
cuuucuuuuucuggaaa

SEQ ID NO: 881501 - RNA, 22 nt, Homo sapiens
cuuugaaggauuuacugcaaga

SEQ ID NO: 881502 - RNA, 14 nt, Homo sapiens
cuuugcuuugugua

SEQ ID NO: 881503 - RNA, 15 nt, Homo sapiens
cuuugggaucagccu

SEQ ID NO: 881504 - RNA, 21 nt, Homo sapiens
cuuugggauugcuaugaauga

SEQ ID NO: 881505 - RNA, 14 nt, Homo sapiens
cuuuguaccaucug

SEQ ID NO: 881506 - RNA, 15 nt, Homo sapiens
cuuuguacuuugugc

SEQ ID NO: 881507 - RNA, 17 nt, Homo sapiens
cuuuguaugcacuuugu

SEQ ID NO: 881508 - RNA, 11 nt, Homo sapiens
cuuugucacaa

SEQ ID NO: 881509 - RNA, 15 nt, Homo sapiens
cuuugucagcaauac

SEQ ID NO: 881510 - RNA, 22 nt, Homo sapiens
cuuugugggcccagcuacaagg

SEQ ID NO: 881511 - RNA, 14 nt, Homo sapiens
cuuuguucaguuga

SEQ ID NO: 881512 - RNA, 18 nt, Homo sapiens
cuuuuaaaaaaaaauacu

SEQ ID NO: 881513 - RNA, 18 nt, Homo sapiens
cuuuuaaaacacuuccau

SEQ ID NO: 881514 - RNA, 15 nt, Homo sapiens
cuuuuaaaugcauaa

SEQ ID NO: 881515 - RNA, 17 nt, Homo sapiens
cuuuuaagaaacacagg

SEQ ID NO: 881516 - RNA, 18 nt, Homo sapiens
cuuuuaagaaacacaggg

SEQ ID NO: 881517 - RNA, 19 nt, Homo sapiens
cuuuuaagaaacacagggu

SEQ ID NO: 881518 - RNA, 13 nt, Homo sapiens
cuuuuaaguugcu

SEQ ID NO: 881519 - RNA, 23 nt, Homo sapiens
cuuuuaaguugcugaugaacucu

SEQ ID NO: 881520 - RNA, 16 nt, Homo sapiens
cuuuuacuacagugac

SEQ ID NO: 881521 - RNA, 17 nt, Homo sapiens
cuuuuacuacagugaca

SEQ ID NO: 881522 - RNA, 23 nt, Homo sapiens
cuuuuagaccaaaauaugaaaga

SEQ ID NO: 881523 - RNA, 14 nt, Homo sapiens
cuuuuaggaugugg

SEQ ID NO: 881524 - RNA, 20 nt, Homo sapiens
cuuuuaugagacccauuccu

SEQ ID NO: 881525 - RNA, 17 nt, Homo sapiens
cuuuuauucauuagcug

SEQ ID NO: 881526 - RNA, 20 nt, Homo sapiens
cuuuuauucauuagcuguga

SEQ ID NO: 881527 - RNA, 15 nt, Homo sapiens
cuuuuauugccauga

SEQ ID NO: 881528 - RNA, 18 nt, Homo sapiens
cuuuucaauuauuucaau

SEQ ID NO: 881529 - RNA, 12 nt, Homo sapiens
cuuuucacggga

SEQ ID NO: 881530 - RNA, 17 nt, Homo sapiens
cuuuuccaaaauuacuu

SEQ ID NO: 881531 - RNA, 16 nt, Homo sapiens
cuuuucccacauucau

SEQ ID NO: 881532 - RNA, 18 nt, Homo sapiens
cuuuucugaccaaagaga

SEQ ID NO: 881533 - RNA, 17 nt, Homo sapiens
cuuuucugaggacucaa

SEQ ID NO: 881534 - RNA, 19 nt, Homo sapiens
cuuuucuggaauguaauca

SEQ ID NO: 881535 - RNA, 16 nt, Homo sapiens
cuuuucuuuuucuccc

SEQ ID NO: 881536 - RNA, 13 nt, Homo sapiens
cuuuugaccaaau

SEQ ID NO: 881537 - RNA, 14 nt, Homo sapiens
cuuuugaccaaaua

SEQ ID NO: 881538 - RNA, 23 nt, Homo sapiens
cuuuugaccaaauaaaguaccau

SEQ ID NO: 881539 - RNA, 20 nt, Homo sapiens
cuuuugaggggcugacuuca

SEQ ID NO: 881540 - RNA, 11 nt, Homo sapiens
cuuuugcacau

SEQ ID NO: 881541 - RNA, 15 nt, Homo sapiens
cuuuuggccuugugg

SEQ ID NO: 881542 - RNA, 22 nt, Homo sapiens
cuuuugugcuccccuuugccua

SEQ ID NO: 881543 - RNA, 13 nt, Homo sapiens
cuuuuguguacag

SEQ ID NO: 881544 - RNA, 11 nt, Homo sapiens
cuuuuucacac

SEQ ID NO: 881545 - RNA, 14 nt, Homo sapiens
cuuuuucuaccuuu

SEQ ID NO: 881546 - RNA, 13 nt, Homo sapiens
cuuuuucuuugaa

SEQ ID NO: 881547 - RNA, 17 nt, Homo sapiens
cuuuuuuaaaugaagaa

SEQ ID NO: 881548 - RNA, 21 nt, Homo sapiens
cuuuuuucaaugguaugcaaa

SEQ ID NO: 881549 - RNA, 22 nt, Homo sapiens
cuuuuuuguggugucuagcauu

SEQ ID NO: 881550 - RNA, 18 nt, Homo sapiens
gaaaaaaagccguuuuca

SEQ ID NO: 881551 - RNA, 17 nt, Homo sapiens
gaaaaaaaguacaugua

SEQ ID NO: 881552 - RNA, 14 nt, Homo sapiens
gaaaaaaugaacuu

SEQ ID NO: 881553 - RNA, 19 nt, Homo sapiens
gaaaaacauuccaggaaac

SEQ ID NO: 881554 - RNA, 12 nt, Homo sapiens
gaaaaacuauua

SEQ ID NO: 881555 - RNA, 13 nt, Homo sapiens
gaaaaacuuccau

SEQ ID NO: 881556 - RNA, 20 nt, Homo sapiens
gaaaaaggcuggcugaaaau

SEQ ID NO: 881557 - RNA, 15 nt, Homo sapiens
gaaaaaguugcaguc

SEQ ID NO: 881558 - RNA, 20 nt, Homo sapiens
gaaaaaucaccacaccaaac

SEQ ID NO: 881559 - RNA, 12 nt, Homo sapiens
gaaaaauuccag

SEQ ID NO: 881560 - RNA, 15 nt, Homo sapiens
gaaaaauuccaggag

SEQ ID NO: 881561 - RNA, 15 nt, Homo sapiens
gaaaacaaacccagg

SEQ ID NO: 881562 - RNA, 18 nt, Homo sapiens
gaaaacaaucacacucau

SEQ ID NO: 881563 - RNA, 12 nt, Homo sapiens
gaaaacauaugc

SEQ ID NO: 881564 - RNA, 13 nt, Homo sapiens
gaaaaccagcgca

SEQ ID NO: 881565 - RNA, 15 nt, Homo sapiens
gaaaaccagcgcaag

SEQ ID NO: 881566 - RNA, 17 nt, Homo sapiens
gacuaguugaacaucuc

SEQ ID NO: 881567 - RNA, 14 nt, Homo sapiens
gacuauaacuguca

SEQ ID NO: 881568 - RNA, 14 nt, Homo sapiens
gacuaugaaaagcu

SEQ ID NO: 881569 - RNA, 19 nt, Homo sapiens
gacuaugaggaauauuugc

SEQ ID NO: 881570 - RNA, 20 nt, Homo sapiens
gacuauuucacuaauaaaca

SEQ ID NO: 881571 - RNA, 22 nt, Homo sapiens
gacucaagccccggacucaggc

SEQ ID NO: 881572 - RNA, 12 nt, Homo sapiens
gacucaaugcac

SEQ ID NO: 881573 - RNA, 18 nt, Homo sapiens
gacucacaagaagaccag

SEQ ID NO: 881574 - RNA, 19 nt, Homo sapiens
gacucacacuugggcgcuc

SEQ ID NO: 881575 - RNA, 12 nt, Homo sapiens
gacucacugugg

SEQ ID NO: 881576 - RNA, 18 nt, Homo sapiens
gacucagcggucauucua

SEQ ID NO: 881577 - RNA, 23 nt, Homo sapiens
gacuccaaagaaauguaagggaa

SEQ ID NO: 881578 - RNA, 16 nt, Homo sapiens
gacucccgcgugaaga

SEQ ID NO: 881579 - RNA, 17 nt, Homo sapiens
gacuccgagaacaacag

SEQ ID NO: 881580 - RNA, 19 nt, Homo sapiens
gacuccugggcuucagccu

SEQ ID NO: 881581 - RNA, 17 nt, Homo sapiens
gacucuuccugcaaagg

SEQ ID NO: 881582 - RNA, 20 nt, Homo sapiens
gacucuuguuuucaguuuca

SEQ ID NO: 881583 - RNA, 23 nt, Homo sapiens
gacugaauauggacccugcugaa

SEQ ID NO: 881584 - RNA, 21 nt, Homo sapiens
gacugccaugcuagacaagcu

SEQ ID NO: 881585 - RNA, 22 nt, Homo sapiens
gacugcgacgcagguguaccuc

SEQ ID NO: 881586 - RNA, 17 nt, Homo sapiens
gacugguuagacaguac

SEQ ID NO: 881587 - RNA, 13 nt, Homo sapiens
gacuguugcacuc

SEQ ID NO: 881588 - RNA, 19 nt, Homo sapiens
gacuuccucgccucuccca

SEQ ID NO: 881589 - RNA, 16 nt, Homo sapiens
gacuuccuggggcccc

SEQ ID NO: 881590 - RNA, 14 nt, Homo sapiens
gacuuccuggugag

SEQ ID NO: 881591 - RNA, 16 nt, Homo sapiens
gacuucucuuugccuc

SEQ ID NO: 881592 - RNA, 20 nt, Homo sapiens
gacuugacagaacacugucu

SEQ ID NO: 881593 - RNA, 17 nt, Homo sapiens
gacuugauacugcaaua

SEQ ID NO: 881594 - RNA, 17 nt, Homo sapiens
gacuuggggaccagagg

SEQ ID NO: 881595 - RNA, 14 nt, Homo sapiens
gacuuucuacaccu

SEQ ID NO: 881596 - RNA, 14 nt, Homo sapiens
gagaaaagacauaa

SEQ ID NO: 881597 - RNA, 20 nt, Homo sapiens
gagaaaccuuauuguaccuc

SEQ ID NO: 881598 - RNA, 22 nt, Homo sapiens
gagaaaccuuauuguaccucuc

SEQ ID NO: 881599 - RNA, 20 nt, Homo sapiens
gagaaauaaaaauaccucuu

SEQ ID NO: 881600 - RNA, 18 nt, Homo sapiens
gagaaauuccuugauuca

SEQ ID NO: 881601 - RNA, 12 nt, Homo sapiens
gagaacauuuac

SEQ ID NO: 881602 - RNA, 12 nt, Homo sapiens
gagaaccuucca

SEQ ID NO: 881603 - RNA, 18 nt, Homo sapiens
gagaacuggaaagacaua

SEQ ID NO: 881604 - RNA, 13 nt, Homo sapiens
gagaacuuuccau

SEQ ID NO: 881605 - RNA, 18 nt, Homo sapiens
gagaagaaugacuaugca

SEQ ID NO: 881606 - RNA, 18 nt, Homo sapiens
gagaagacccacgugcua

SEQ ID NO: 881607 - RNA, 22 nt, Homo sapiens
gagaagaugugauuuauuuuga

SEQ ID NO: 881608 - RNA, 17 nt, Homo sapiens
gagaagcaaguggcuuu

SEQ ID NO: 881609 - RNA, 19 nt, Homo sapiens
gagaaggaaggagacucac

SEQ ID NO: 881610 - RNA, 19 nt, Homo sapiens
gagaaggacaccuccuucc

SEQ ID NO: 881611 - RNA, 17 nt, Homo sapiens
gagaaggagaucagggc

SEQ ID NO: 881612 - RNA, 20 nt, Homo sapiens
gagaaucgaccucacuguca

SEQ ID NO: 881613 - RNA, 12 nt, Homo sapiens
gagaauugccuc

SEQ ID NO: 881614 - RNA, 12 nt, Homo sapiens
gagacacuccca

SEQ ID NO: 881615 - RNA, 19 nt, Homo sapiens
gagacagaguuuucacucu

SEQ ID NO: 881616 - RNA, 14 nt, Homo sapiens
gagacagauaacuc

SEQ ID NO: 881617 - RNA, 16 nt, Homo sapiens
gagacaggcccaagag

SEQ ID NO: 881618 - RNA, 22 nt, Homo sapiens
gagaccaagacucugaaaucuc

SEQ ID NO: 881619 - RNA, 18 nt, Homo sapiens
gagacccagaucucaugg

SEQ ID NO: 881620 - RNA, 16 nt, Homo sapiens
gagacuauaacuguca

SEQ ID NO: 881621 - RNA, 14 nt, Homo sapiens
gagacuauguguca

SEQ ID NO: 881622 - RNA, 20 nt, Homo sapiens
gagacucaccucugccucaa

SEQ ID NO: 881623 - RNA, 23 nt, Homo sapiens
gagacucagggccccagcacuaa

SEQ ID NO: 881624 - RNA, 20 nt, Homo sapiens
gagacuuggggaccagaggu

SEQ ID NO: 881625 - RNA, 23 nt, Homo sapiens
gagagaauggguuuacucucaau

SEQ ID NO: 881626 - RNA, 17 nt, Homo sapiens
gagagacacucccaggg

SEQ ID NO: 881627 - RNA, 15 nt, Homo sapiens
gagagacauugccuc

SEQ ID NO: 881628 - RNA, 22 nt, Homo sapiens
gagagacgcagcccugggggcc

SEQ ID NO: 881629 - RNA, 20 nt, Homo sapiens
gagagcacuagaagugguuu

SEQ ID NO: 881630 - RNA, 14 nt, Homo sapiens
gagagcaggacagg

SEQ ID NO: 881631 - RNA, 17 nt, Homo sapiens
gagagcuaggagcaaag

SEQ ID NO: 881632 - RNA, 18 nt, Homo sapiens
gagaggccuuuuggaaug

SEQ ID NO: 881633 - RNA, 21 nt, Homo sapiens
gagaggggcuguccauggcag

SEQ ID NO: 881634 - RNA, 20 nt, Homo sapiens
gagagggggcucuccaaagg

SEQ ID NO: 881635 - RNA, 18 nt, Homo sapiens
gagagguagguggaucca

SEQ ID NO: 881636 - RNA, 20 nt, Homo sapiens
gagaggugggcagcagcuca

SEQ ID NO: 881637 - RNA, 18 nt, Homo sapiens
gagauaagaucuauagcc

SEQ ID NO: 881638 - RNA, 17 nt, Homo sapiens
gagauaauaucugugag

SEQ ID NO: 881639 - RNA, 23 nt, Homo sapiens
gagauacucucccugacauuucu

SEQ ID NO: 881640 - RNA, 13 nt, Homo sapiens
gagauaugcacac

SEQ ID NO: 881641 - RNA, 15 nt, Homo sapiens
gagauaugcacacac

SEQ ID NO: 881642 - RNA, 23 nt, Homo sapiens
gagaucuucaaugcuuccuccuu

SEQ ID NO: 881643 - RNA, 14 nt, Homo sapiens
gagaucuugaucca

SEQ ID NO: 881644 - RNA, 21 nt, Homo sapiens
gagaugcaggauuucuucaca

SEQ ID NO: 881645 - RNA, 20 nt, Homo sapiens
gagauggaaguugcagugag

SEQ ID NO: 881646 - RNA, 21 nt, Homo sapiens
gagauguggcaaagugcugua

SEQ ID NO: 881647 - RNA, 12 nt, Homo sapiens
gagauguguuca

SEQ ID NO: 881648 - RNA, 16 nt, Homo sapiens
gagcaauucauuucac

SEQ ID NO: 881649 - RNA, 19 nt, Homo sapiens
gagcaauuugcacauguaa

SEQ ID NO: 881650 - RNA, 18 nt, Homo sapiens
gagcacccccucauuccc

SEQ ID NO: 881651 - RNA, 22 nt, Homo sapiens
gagcaccuacuuacaugcauua

SEQ ID NO: 881652 - RNA, 14 nt, Homo sapiens
gagcagacagagaa

SEQ ID NO: 881653 - RNA, 23 nt, Homo sapiens
gagcagaugguccuccauuucaa

SEQ ID NO: 881654 - RNA, 15 nt, Homo sapiens
gagcagccagcguua

SEQ ID NO: 881655 - RNA, 20 nt, Homo sapiens
gagcaggcuacugucagcuc

SEQ ID NO: 881656 - RNA, 16 nt, Homo sapiens
gagcaguaaacuuucu

SEQ ID NO: 881657 - RNA, 17 nt, Homo sapiens
gagcaguagaagccugc

SEQ ID NO: 881658 - RNA, 23 nt, Homo sapiens
gagcagugggaggguaccagcag

SEQ ID NO: 881659 - RNA, 17 nt, Homo sapiens
gagcauaaugcucccau

SEQ ID NO: 881660 - RNA, 14 nt, Homo sapiens
gagcaucucugugu

SEQ ID NO: 881661 - RNA, 21 nt, Homo sapiens
gagcaugggacugugccuuug

SEQ ID NO: 881662 - RNA, 19 nt, Homo sapiens
gagcauuacgugagccagg

SEQ ID NO: 881663 - RNA, 20 nt, Homo sapiens
gagccaccagggcacugucu

SEQ ID NO: 881664 - RNA, 13 nt, Homo sapiens
gagccacuaccuu

SEQ ID NO: 881665 - RNA, 18 nt, Homo sapiens
gagccacugcaccgggcc

SEQ ID NO: 881666 - RNA, 17 nt, Homo sapiens
gagccagccuugcagua

SEQ ID NO: 881667 - RNA, 20 nt, Homo sapiens
gagcccaagugccaucccac

SEQ ID NO: 881668 - RNA, 18 nt, Homo sapiens
gagcccagcuacauuccu

SEQ ID NO: 881669 - RNA, 20 nt, Homo sapiens
gagcccaggccguuccccuu

SEQ ID NO: 881670 - RNA, 21 nt, Homo sapiens
gagcccaugcucaaccacugu

SEQ ID NO: 881671 - RNA, 14 nt, Homo sapiens
gagccccacacgga

SEQ ID NO: 881672 - RNA, 23 nt, Homo sapiens
gagccucccccucagaugaucuc

SEQ ID NO: 881673 - RNA, 18 nt, Homo sapiens
gagccucgguggccaugc

SEQ ID NO: 881674 - RNA, 15 nt, Homo sapiens
gagccucuccuugcc

SEQ ID NO: 881675 - RNA, 12 nt, Homo sapiens
gagccucuuagu

SEQ ID NO: 881676 - RNA, 16 nt, Homo sapiens
gagccugaggcaugag

SEQ ID NO: 881677 - RNA, 17 nt, Homo sapiens
gagccugcaaacucacu

SEQ ID NO: 881678 - RNA, 12 nt, Homo sapiens
gagccuggagaa

SEQ ID NO: 881679 - RNA, 20 nt, Homo sapiens
gagccuggagggaugccacc

SEQ ID NO: 881680 - RNA, 22 nt, Homo sapiens
guauuuuaggcagggauuugag

SEQ ID NO: 881681 - RNA, 13 nt, Homo sapiens
guauuuucauuua

SEQ ID NO: 881682 - RNA, 17 nt, Homo sapiens
guauuuuguauuugcau

SEQ ID NO: 881683 - RNA, 13 nt, Homo sapiens
guauuuuugucau

SEQ ID NO: 881684 - RNA, 14 nt, Homo sapiens
gucaaaacauucag

SEQ ID NO: 881685 - RNA, 20 nt, Homo sapiens
gucaaaccgcacucacccau

SEQ ID NO: 881686 - RNA, 14 nt, Homo sapiens
gucaaaggcauuuu

SEQ ID NO: 881687 - RNA, 22 nt, Homo sapiens
gucaaauaucucagaggcuaua

SEQ ID NO: 881688 - RNA, 14 nt, Homo sapiens
gucaacaguucaaa

SEQ ID NO: 881689 - RNA, 14 nt, Homo sapiens
gucaaccaggaaca

SEQ ID NO: 881690 - RNA, 15 nt, Homo sapiens
gucaaggacuccugu

SEQ ID NO: 881691 - RNA, 13 nt, Homo sapiens
gucaagggccagu

SEQ ID NO: 881692 - RNA, 13 nt, Homo sapiens
gucaauacugccu

SEQ ID NO: 881693 - RNA, 23 nt, Homo sapiens
gucaauuucaguguaugauauac

SEQ ID NO: 881694 - RNA, 21 nt, Homo sapiens
gucacaauccuaacacauuau

SEQ ID NO: 881695 - RNA, 21 nt, Homo sapiens
gucaccgggaugaaccuaucc

SEQ ID NO: 881696 - RNA, 19 nt, Homo sapiens
gucacuaaccaagccagaa

SEQ ID NO: 881697 - RNA, 13 nt, Homo sapiens
gucacugggcuac

SEQ ID NO: 881698 - RNA, 11 nt, Homo sapiens
gucacugucuu

SEQ ID NO: 881699 - RNA, 18 nt, Homo sapiens
gucagaccaguacuggga

SEQ ID NO: 881700 - RNA, 15 nt, Homo sapiens
gucagaguucugcuc

SEQ ID NO: 881701 - RNA, 16 nt, Homo sapiens
gucagccuugcaucaa

SEQ ID NO: 881702 - RNA, 20 nt, Homo sapiens
gucagccuugcaucaagggc

SEQ ID NO: 881703 - RNA, 14 nt, Homo sapiens
gucaggaacagaag

SEQ ID NO: 881704 - RNA, 23 nt, Homo sapiens
gucaggaacagaaggaugaauga

SEQ ID NO: 881705 - RNA, 21 nt, Homo sapiens
gucaggcagguuugccaguga

SEQ ID NO: 881706 - RNA, 15 nt, Homo sapiens
gucaggcccagagaa

SEQ ID NO: 881707 - RNA, 21 nt, Homo sapiens
gucaggcggggugcuguggug

SEQ ID NO: 881708 - RNA, 23 nt, Homo sapiens
gucagggagccuggaagccaaac

SEQ ID NO: 881709 - RNA, 10 nt, Homo sapiens
gucauagaaa

SEQ ID NO: 881710 - RNA, 19 nt, Homo sapiens
gucaugauggagacuucag

SEQ ID NO: 881711 - RNA, 23 nt, Homo sapiens
gucaugauggcaccacugcacuc

SEQ ID NO: 881712 - RNA, 17 nt, Homo sapiens
gucauggaaaauguccu

SEQ ID NO: 881713 - RNA, 19 nt, Homo sapiens
gucauucaagccugugaau

SEQ ID NO: 881714 - RNA, 17 nt, Homo sapiens
guccaaagaacaagaaa

SEQ ID NO: 881715 - RNA, 19 nt, Homo sapiens
guccaaggcacaaaccuua

SEQ ID NO: 881716 - RNA, 23 nt, Homo sapiens
guccaaggcuauauuucugggau

SEQ ID NO: 881717 - RNA, 13 nt, Homo sapiens
guccaauauuugg

SEQ ID NO: 881718 - RNA, 22 nt, Homo sapiens
guccaauggcuguaaacuauaa

SEQ ID NO: 881719 - RNA, 21 nt, Homo sapiens
guccacccaggcugcacugca

SEQ ID NO: 881720 - RNA, 17 nt, Homo sapiens
guccaccugccuaucca

SEQ ID NO: 881721 - RNA, 20 nt, Homo sapiens
guccacucugaauaccaagu

SEQ ID NO: 881722 - RNA, 11 nt, Homo sapiens
guccaggaaac

SEQ ID NO: 881723 - RNA, 19 nt, Homo sapiens
guccaggaaggcagcugcu

SEQ ID NO: 881724 - RNA, 13 nt, Homo sapiens
guccagggcggga

SEQ ID NO: 881725 - RNA, 19 nt, Homo sapiens
guccauguaauauucccau

SEQ ID NO: 881726 - RNA, 19 nt, Homo sapiens
guccaugugguucuucaaa

SEQ ID NO: 881727 - RNA, 17 nt, Homo sapiens
gucccaagcccagggac

SEQ ID NO: 881728 - RNA, 14 nt, Homo sapiens
gucccacacuggug

SEQ ID NO: 881729 - RNA, 18 nt, Homo sapiens
gucccacaucccugggcc

SEQ ID NO: 881730 - RNA, 21 nt, Homo sapiens
gucccagagcaggaaugggaa

SEQ ID NO: 881731 - RNA, 14 nt, Homo sapiens
gucccagcuacuca

SEQ ID NO: 881732 - RNA, 13 nt, Homo sapiens
guccccaccucag

SEQ ID NO: 881733 - RNA, 17 nt, Homo sapiens
guccccaguuugcagaa

SEQ ID NO: 881734 - RNA, 15 nt, Homo sapiens
gucccccccaggugc

SEQ ID NO: 881735 - RNA, 23 nt, Homo sapiens
gucccccuaugcuccaguaugga

SEQ ID NO: 881736 - RNA, 17 nt, Homo sapiens
guccccugccucaagaa

SEQ ID NO: 881737 - RNA, 18 nt, Homo sapiens
gucccucccaucucuacc

SEQ ID NO: 881738 - RNA, 18 nt, Homo sapiens
gucccugccacacucagu

SEQ ID NO: 881739 - RNA, 14 nt, Homo sapiens
gucccugccagugu

SEQ ID NO: 881740 - RNA, 18 nt, Homo sapiens
gucccugucaccaagcuc

SEQ ID NO: 881741 - RNA, 18 nt, Homo sapiens
gucccuugcuguuuucau

SEQ ID NO: 881742 - RNA, 14 nt, Homo sapiens
guccgcaccagcug

SEQ ID NO: 881743 - RNA, 18 nt, Homo sapiens
guccgcaucacucugcau

SEQ ID NO: 881744 - RNA, 21 nt, Homo sapiens
guccgcuuucaugaacacagc

SEQ ID NO: 881745 - RNA, 21 nt, Homo sapiens
guccuaugucaauuuguauau

SEQ ID NO: 881746 - RNA, 21 nt, Homo sapiens
guccuccucucucuacuugaa

SEQ ID NO: 881747 - RNA, 12 nt, Homo sapiens
guccucuuuaca

SEQ ID NO: 881748 - RNA, 14 nt, Homo sapiens
guccugagcaccug

SEQ ID NO: 881749 - RNA, 13 nt, Homo sapiens
guccuuccugugc

SEQ ID NO: 881750 - RNA, 20 nt, Homo sapiens
guccuucuuuaucugugaua

SEQ ID NO: 881751 - RNA, 18 nt, Homo sapiens
guccuuucuaaguauuuu

SEQ ID NO: 881752 - RNA, 15 nt, Homo sapiens
gucgacuuugagcug

SEQ ID NO: 881753 - RNA, 13 nt, Homo sapiens
gucgguguguaau

SEQ ID NO: 881754 - RNA, 21 nt, Homo sapiens
gucguuuuuuucuugugcuga

SEQ ID NO: 881755 - RNA, 18 nt, Homo sapiens
gucuaaaaacaccaaaaa

SEQ ID NO: 881756 - RNA, 18 nt, Homo sapiens
gucuagaaaccaguaugg

SEQ ID NO: 881757 - RNA, 21 nt, Homo sapiens
gucuagacuuucucaguggga

SEQ ID NO: 881758 - RNA, 20 nt, Homo sapiens
gucuagcauuaacuuauugu

SEQ ID NO: 881759 - RNA, 17 nt, Homo sapiens
gucuagccacugaucau

SEQ ID NO: 881760 - RNA, 21 nt, Homo sapiens
gucuauggucaguugaggaau

SEQ ID NO: 881761 - RNA, 15 nt, Homo sapiens
gucuauuaucuguag

SEQ ID NO: 881762 - RNA, 19 nt, Homo sapiens
gucucaaaaaaagggcaau

SEQ ID NO: 881763 - RNA, 22 nt, Homo sapiens
gucuccuaccugcugcugcuau

SEQ ID NO: 881764 - RNA, 22 nt, Homo sapiens
gucuccucuuaaaaaauaaaaa

SEQ ID NO: 881765 - RNA, 16 nt, Homo sapiens
gucuccuugcacuuuc

SEQ ID NO: 881766 - RNA, 23 nt, Homo sapiens
gucuccuuugcacugagggccac

SEQ ID NO: 881767 - RNA, 22 nt, Homo sapiens
gucucucccaccccggccucca

SEQ ID NO: 881768 - RNA, 17 nt, Homo sapiens
gucucuccugaugcuca

SEQ ID NO: 881769 - RNA, 21 nt, Homo sapiens
gucucucggguucaagcaauu

SEQ ID NO: 881770 - RNA, 24 nt, Homo sapiens
gucucucuugcuuuguucuuuauu

SEQ ID NO: 881771 - RNA, 14 nt, Homo sapiens
gucucugcaucuca

SEQ ID NO: 881772 - RNA, 16 nt, Homo sapiens
gucucugcucuugccu

SEQ ID NO: 881773 - RNA, 21 nt, Homo sapiens
gucugaaagacagaaugucac

SEQ ID NO: 881774 - RNA, 18 nt, Homo sapiens
gucugaaagcagguuaac

SEQ ID NO: 881775 - RNA, 12 nt, Homo sapiens
gucugacaggca

SEQ ID NO: 881776 - RNA, 19 nt, Homo sapiens
gucugauuggcucacccaa

SEQ ID NO: 881777 - RNA, 15 nt, Homo sapiens
gucugcauaaacuuc

SEQ ID NO: 881778 - RNA, 17 nt, Homo sapiens
gucugcuuaguaucuca

SEQ ID NO: 881779 - RNA, 12 nt, Homo sapiens
gucugucccaaa

SEQ ID NO: 881780 - RNA, 20 nt, Homo sapiens
gucuuagccucccaaagugc

SEQ ID NO: 881781 - RNA, 23 nt, Homo sapiens
gucuucagccuagccgaccucag

SEQ ID NO: 881782 - RNA, 14 nt, Homo sapiens
gucuuccacuguac

SEQ ID NO: 881783 - RNA, 13 nt, Homo sapiens
gucuucccuguau

SEQ ID NO: 881784 - RNA, 21 nt, Homo sapiens
gucuuccuccuaaauuuccag

SEQ ID NO: 881785 - RNA, 17 nt, Homo sapiens
gucuucucucaaaggga

SEQ ID NO: 881786 - RNA, 15 nt, Homo sapiens
gucuugaaacaagca

SEQ ID NO: 881787 - RNA, 15 nt, Homo sapiens
gucuuggacacugua

SEQ ID NO: 881788 - RNA, 18 nt, Homo sapiens
gucuugguuccucuacua

SEQ ID NO: 881789 - RNA, 19 nt, Homo sapiens
gucuugucagaauuggccu

SEQ ID NO: 881790 - RNA, 12 nt, Homo sapiens
gugaaaccacua

SEQ ID NO: 881791 - RNA, 15 nt, Homo sapiens
gugaaagaggcagcu

SEQ ID NO: 881792 - RNA, 20 nt, Homo sapiens
gugaaagcaucacuugggau

SEQ ID NO: 881793 - RNA, 14 nt, Homo sapiens
gugaacacaucagc

SEQ ID NO: 881794 - RNA, 18 nt, Homo sapiens
gugaacaccuccuagcca

SEQ ID NO: 881795 - RNA, 15 nt, Homo sapiens
uaaaguguuugccuc

SEQ ID NO: 881796 - RNA, 18 nt, Homo sapiens
uaaaguuaaaaaaaagcc

SEQ ID NO: 881797 - RNA, 18 nt, Homo sapiens
uaaaguuguucacauaua

SEQ ID NO: 881798 - RNA, 19 nt, Homo sapiens
uaaaguuguuugugccuuu

SEQ ID NO: 881799 - RNA, 22 nt, Homo sapiens
uaaaguuuccccucuauuuugg

SEQ ID NO: 881800 - RNA, 18 nt, Homo sapiens
uaaauaaaaaguauacuu

SEQ ID NO: 881801 - RNA, 16 nt, Homo sapiens
uaaauaaauguaaaua

SEQ ID NO: 881802 - RNA, 14 nt, Homo sapiens
uaaauacaguggau

SEQ ID NO: 881803 - RNA, 21 nt, Homo sapiens
uaaauacaguggaucucaauc

SEQ ID NO: 881804 - RNA, 12 nt, Homo sapiens
uaaauacuguac

SEQ ID NO: 881805 - RNA, 21 nt, Homo sapiens
uaaauacuguacauagaugua

SEQ ID NO: 881806 - RNA, 17 nt, Homo sapiens
uaaauagaguuccaaau

SEQ ID NO: 881807 - RNA, 18 nt, Homo sapiens
uaaauaucacaucacuua

SEQ ID NO: 881808 - RNA, 17 nt, Homo sapiens
uaaauauguacacaagu

SEQ ID NO: 881809 - RNA, 16 nt, Homo sapiens
uaaauauuucaggcau

SEQ ID NO: 881810 - RNA, 17 nt, Homo sapiens
uaaauauuucaggcaua

SEQ ID NO: 881811 - RNA, 23 nt, Homo sapiens
uaaaucccauucauaacuuucau

SEQ ID NO: 881812 - RNA, 21 nt, Homo sapiens
uaaauccucagguaguacugg

SEQ ID NO: 881813 - RNA, 20 nt, Homo sapiens
uaaaucuuccagcaugcauc

SEQ ID NO: 881814 - RNA, 18 nt, Homo sapiens
uaaaucuuccuugugagg

SEQ ID NO: 881815 - RNA, 17 nt, Homo sapiens
uaaaugauguacuacau

SEQ ID NO: 881816 - RNA, 18 nt, Homo sapiens
uaaaugauguacuacauu

SEQ ID NO: 881817 - RNA, 15 nt, Homo sapiens
uaaaugauuaucucc

SEQ ID NO: 881818 - RNA, 17 nt, Homo sapiens
uaaaugcauguccucaa

SEQ ID NO: 881819 - RNA, 19 nt, Homo sapiens
uaaaugccaggccuggcaa

SEQ ID NO: 881820 - RNA, 14 nt, Homo sapiens
uaaaugugcuuaug

SEQ ID NO: 881821 - RNA, 22 nt, Homo sapiens
uaaaugugguacaagcauucug

SEQ ID NO: 881822 - RNA, 13 nt, Homo sapiens
uaaauguguauuc

SEQ ID NO: 881823 - RNA, 23 nt, Homo sapiens
uaaauucacauaggcaauaucuu

SEQ ID NO: 881824 - RNA, 13 nt, Homo sapiens
uaaauugcagaug

SEQ ID NO: 881825 - RNA, 13 nt, Homo sapiens
uaaauugcuuauu

SEQ ID NO: 881826 - RNA, 17 nt, Homo sapiens
uaaauuguuugaccaug

SEQ ID NO: 881827 - RNA, 22 nt, Homo sapiens
uaaauuugggggacuuacauga

SEQ ID NO: 881828 - RNA, 23 nt, Homo sapiens
uaaauuugggggacuuacaugau

SEQ ID NO: 881829 - RNA, 16 nt, Homo sapiens
uaaauuuguguucuca

SEQ ID NO: 881830 - RNA, 23 nt, Homo sapiens
uaaauuuuaacauuuuccaaaau

SEQ ID NO: 881831 - RNA, 18 nt, Homo sapiens
uaaauuuuauaaucauga

SEQ ID NO: 881832 - RNA, 15 nt, Homo sapiens
uaaauuuucuaugcu

SEQ ID NO: 881833 - RNA, 19 nt, Homo sapiens
uaaauuuucuaugcuuauu

SEQ ID NO: 881834 - RNA, 20 nt, Homo sapiens
uaacaaaacuauacuuguac

SEQ ID NO: 881835 - RNA, 15 nt, Homo sapiens
uaacaaagaacaagc

SEQ ID NO: 881836 - RNA, 22 nt, Homo sapiens
uaacaaccagagaugacugaaa

SEQ ID NO: 881837 - RNA, 12 nt, Homo sapiens
uaacaaccugga

SEQ ID NO: 881838 - RNA, 19 nt, Homo sapiens
uaacaagguucuucuaaaa

SEQ ID NO: 881839 - RNA, 21 nt, Homo sapiens
uaacaauguaugugaaagugu

SEQ ID NO: 881840 - RNA, 18 nt, Homo sapiens
uaacacaagccacagaag

SEQ ID NO: 881841 - RNA, 14 nt, Homo sapiens
uaacacuacuuaaa

SEQ ID NO: 881842 - RNA, 15 nt, Homo sapiens
uaacagaacagucac

SEQ ID NO: 881843 - RNA, 20 nt, Homo sapiens
uaacagaggcaggaguggca

SEQ ID NO: 881844 - RNA, 22 nt, Homo sapiens
uaacagauuugcauaugucuau

SEQ ID NO: 881845 - RNA, 18 nt, Homo sapiens
uaacagcugucuauguau

SEQ ID NO: 881846 - RNA, 21 nt, Homo sapiens
uaacaggguggcccccugugc

SEQ ID NO: 881847 - RNA, 15 nt, Homo sapiens
uaacagucauuuaaa

SEQ ID NO: 881848 - RNA, 14 nt, Homo sapiens
uaacaguucacuuu

SEQ ID NO: 881849 - RNA, 19 nt, Homo sapiens
uaacaguucacuuuuuaca

SEQ ID NO: 881850 - RNA, 16 nt, Homo sapiens
uaacauauuugcacaa

SEQ ID NO: 881851 - RNA, 18 nt, Homo sapiens
uaacaucaugcauucaca

SEQ ID NO: 881852 - RNA, 17 nt, Homo sapiens
uaacaugacuucugccc

SEQ ID NO: 881853 - RNA, 17 nt, Homo sapiens
uaacaugcaauuuugca

SEQ ID NO: 881854 - RNA, 12 nt, Homo sapiens
uaacaugcuuua

SEQ ID NO: 881855 - RNA, 20 nt, Homo sapiens
uaacauugggaaaucuuaua

SEQ ID NO: 881856 - RNA, 20 nt, Homo sapiens
uaaccccaacgcacaggaaa

SEQ ID NO: 881857 - RNA, 19 nt, Homo sapiens
uaaccucagugucauuuau

SEQ ID NO: 881858 - RNA, 13 nt, Homo sapiens
uaaccucaucuac

SEQ ID NO: 881859 - RNA, 20 nt, Homo sapiens
uaaccuccacaguagcauuu

SEQ ID NO: 881860 - RNA, 22 nt, Homo sapiens
uaaccuguuuauauaauuuugc

SEQ ID NO: 881861 - RNA, 22 nt, Homo sapiens
uaaccuuccuucuaaacauuuu

SEQ ID NO: 881862 - RNA, 15 nt, Homo sapiens
uaacgucaucucagg

SEQ ID NO: 881863 - RNA, 16 nt, Homo sapiens
uaacgucaucucaggg

SEQ ID NO: 881864 - RNA, 12 nt, Homo sapiens
uaacuacagugu

SEQ ID NO: 881865 - RNA, 20 nt, Homo sapiens
uaacuaccuaaacauguuau

SEQ ID NO: 881866 - RNA, 17 nt, Homo sapiens
uaacuagaauuuauuca

SEQ ID NO: 881867 - RNA, 14 nt, Homo sapiens
uaacuauaaucucu

SEQ ID NO: 881868 - RNA, 11 nt, Homo sapiens
uaacuauucaa

SEQ ID NO: 881869 - RNA, 15 nt, Homo sapiens
uaacucagacauucc

SEQ ID NO: 881870 - RNA, 20 nt, Homo sapiens
uaacuccagucuccugacau

SEQ ID NO: 881871 - RNA, 16 nt, Homo sapiens
uaacuccagugaagua

SEQ ID NO: 881872 - RNA, 15 nt, Homo sapiens
uaacucuggugcucu

SEQ ID NO: 881873 - RNA, 21 nt, Homo sapiens
uaacugcaaagugaaguugcu

SEQ ID NO: 881874 - RNA, 12 nt, Homo sapiens
uaacugcaauuu

SEQ ID NO: 881875 - RNA, 18 nt, Homo sapiens
uaacuggcuacugggaaa

SEQ ID NO: 881876 - RNA, 15 nt, Homo sapiens
uaacugucaagucau

SEQ ID NO: 881877 - RNA, 13 nt, Homo sapiens
uaacuucucugag

SEQ ID NO: 881878 - RNA, 16 nt, Homo sapiens
uaacuuguauauucca

SEQ ID NO: 881879 - RNA, 17 nt, Homo sapiens
uaagaaaauaaccuuua

SEQ ID NO: 881880 - RNA, 17 nt, Homo sapiens
uaagaaaucauggcauu

SEQ ID NO: 881881 - RNA, 22 nt, Homo sapiens
uaagaagaaauacccacuaaca

SEQ ID NO: 881882 - RNA, 17 nt, Homo sapiens
uaagaaugcagauuccu

SEQ ID NO: 881883 - RNA, 15 nt, Homo sapiens
uaagacacaccucug

SEQ ID NO: 881884 - RNA, 18 nt, Homo sapiens
uaagaccauaacagccaa

SEQ ID NO: 881885 - RNA, 20 nt, Homo sapiens
uaagagaagaugugauuuau

SEQ ID NO: 881886 - RNA, 19 nt, Homo sapiens
uaagagcauagaacucaaa

SEQ ID NO: 881887 - RNA, 15 nt, Homo sapiens
uaagaggcuauuuaa

SEQ ID NO: 881888 - RNA, 19 nt, Homo sapiens
uaagagugccguaacaacu

SEQ ID NO: 881889 - RNA, 15 nt, Homo sapiens
uaagauuagaaugaa

SEQ ID NO: 881890 - RNA, 16 nt, Homo sapiens
uaagcaaagacuauga

SEQ ID NO: 881891 - RNA, 17 nt, Homo sapiens
uaagcaaaggaaaccaa

SEQ ID NO: 881892 - RNA, 14 nt, Homo sapiens
uaagcacauguuua

SEQ ID NO: 881893 - RNA, 19 nt, Homo sapiens
uaagcagaagcacauauga

SEQ ID NO: 881894 - RNA, 22 nt, Homo sapiens
uaagcaucaaauauuugugcaa

SEQ ID NO: 881895 - RNA, 12 nt, Homo sapiens
uaagcauuguau

SEQ ID NO: 881896 - RNA, 19 nt, Homo sapiens
uaagcauuguauacauuga

SEQ ID NO: 881897 - RNA, 19 nt, Homo sapiens
uaagccacguuaaguccaa

SEQ ID NO: 881898 - RNA, 20 nt, Homo sapiens
uaagccacucuuccaaaggc

SEQ ID NO: 881899 - RNA, 22 nt, Homo sapiens
uaagcugggaaaaaaguuuuga

SEQ ID NO: 881900 - RNA, 13 nt, Homo sapiens
uaagcuguaaaaa

SEQ ID NO: 881901 - RNA, 20 nt, Homo sapiens
uaagcuucaaagcugcuuua

SEQ ID NO: 881902 - RNA, 13 nt, Homo sapiens
uaaggaagggaaa

SEQ ID NO: 881903 - RNA, 14 nt, Homo sapiens
uaaggaucucucag

SEQ ID NO: 881904 - RNA, 16 nt, Homo sapiens
uaaggcauagggaaua

SEQ ID NO: 881905 - RNA, 14 nt, Homo sapiens
uaagggaaacugcc

SEQ ID NO: 881906 - RNA, 20 nt, Homo sapiens
uaagggaaggaacucuggcu

SEQ ID NO: 881907 - RNA, 15 nt, Homo sapiens
uaaggggaugggggu

SEQ ID NO: 881908 - RNA, 18 nt, Homo sapiens
uaaggggcaccugggaaa

SEQ ID NO: 881909 - RNA, 13 nt, Homo sapiens
uaagguacuagca

SEQ ID NO: 881910 - RNA, 22 nt, Homo sapiens
uagugguauagaguacugcaga

SEQ ID NO: 881911 - RNA, 16 nt, Homo sapiens
uaguguccgaagaccg

SEQ ID NO: 881912 - RNA, 16 nt, Homo sapiens
uagugugugugcaugu

SEQ ID NO: 881913 - RNA, 18 nt, Homo sapiens
uaguguguguguguauau

SEQ ID NO: 881914 - RNA, 19 nt, Homo sapiens
uaguguuggaaaaugugca

SEQ ID NO: 881915 - RNA, 14 nt, Homo sapiens
uaguuaaaguaaug

SEQ ID NO: 881916 - RNA, 15 nt, Homo sapiens
uaguuauuuacuuga

SEQ ID NO: 881917 - RNA, 22 nt, Homo sapiens
uaguucccugaaaacccagaga

SEQ ID NO: 881918 - RNA, 16 nt, Homo sapiens
uaguucuaucaggaaa

SEQ ID NO: 881919 - RNA, 15 nt, Homo sapiens
uaguucuugugcaug

SEQ ID NO: 881920 - RNA, 19 nt, Homo sapiens
uaguugcguggacucugca

SEQ ID NO: 881921 - RNA, 20 nt, Homo sapiens
uaguugcguggacucugcac

SEQ ID NO: 881922 - RNA, 22 nt, Homo sapiens
uaguugcguggacucugcacau

SEQ ID NO: 881923 - RNA, 14 nt, Homo sapiens
uaguuucugauuca

SEQ ID NO: 881924 - RNA, 17 nt, Homo sapiens
uaguuucugauucacua

SEQ ID NO: 881925 - RNA, 19 nt, Homo sapiens
uaguuugaccucacaguga

SEQ ID NO: 881926 - RNA, 22 nt, Homo sapiens
uaguuugauacucccagucuug

SEQ ID NO: 881927 - RNA, 14 nt, Homo sapiens
uaguuuuacauaua

SEQ ID NO: 881928 - RNA, 21 nt, Homo sapiens
uauaaaagaauaaaauugcac

SEQ ID NO: 881929 - RNA, 21 nt, Homo sapiens
uauaaaauauguacauaauau

SEQ ID NO: 881930 - RNA, 23 nt, Homo sapiens
uauaaacauugguauauuuccau

SEQ ID NO: 881931 - RNA, 12 nt, Homo sapiens
uauaaaccugau

SEQ ID NO: 881932 - RNA, 14 nt, Homo sapiens
uauaaaugcaugau

SEQ ID NO: 881933 - RNA, 18 nt, Homo sapiens
uauaaauguauauacaca

SEQ ID NO: 881934 - RNA, 19 nt, Homo sapiens
uauaaauguuugucuggau

SEQ ID NO: 881935 - RNA, 21 nt, Homo sapiens
uauaacaaacuacauguaauc

SEQ ID NO: 881936 - RNA, 22 nt, Homo sapiens
uauaacaugucuuucagcauua

SEQ ID NO: 881937 - RNA, 21 nt, Homo sapiens
uauaaccagacacauacucau

SEQ ID NO: 881938 - RNA, 17 nt, Homo sapiens
uauaaguguuugucaua

SEQ ID NO: 881939 - RNA, 19 nt, Homo sapiens
uauaauacuaaagugucua

SEQ ID NO: 881940 - RNA, 14 nt, Homo sapiens
uauaauauaccaau

SEQ ID NO: 881941 - RNA, 19 nt, Homo sapiens
uauaaugaacacgugggua

SEQ ID NO: 881942 - RNA, 19 nt, Homo sapiens
uauaauuauuuacucuuau

SEQ ID NO: 881943 - RNA, 21 nt, Homo sapiens
uauacaaauuguuucuggaau

SEQ ID NO: 881944 - RNA, 23 nt, Homo sapiens
uauacaauaaagucuuaccucag

SEQ ID NO: 881945 - RNA, 13 nt, Homo sapiens
uauacacauggau

SEQ ID NO: 881946 - RNA, 18 nt, Homo sapiens
uauacauaugacauauau

SEQ ID NO: 881947 - RNA, 16 nt, Homo sapiens
uauacauguguguaua

SEQ ID NO: 881948 - RNA, 21 nt, Homo sapiens
uauacauucuuuaucuugaca

SEQ ID NO: 881949 - RNA, 20 nt, Homo sapiens
uauaccuguguuucuugccu

SEQ ID NO: 881950 - RNA, 15 nt, Homo sapiens
uauagacaaauaaua

SEQ ID NO: 881951 - RNA, 16 nt, Homo sapiens
uauagacaauuugccc

SEQ ID NO: 881952 - RNA, 17 nt, Homo sapiens
uauagcagauuguguaa

SEQ ID NO: 881953 - RNA, 23 nt, Homo sapiens
uauagcguucccaacaacaucca

SEQ ID NO: 881954 - RNA, 14 nt, Homo sapiens
uauaguacuggcau

SEQ ID NO: 881955 - RNA, 14 nt, Homo sapiens
uauaguagcauuuc

SEQ ID NO: 881956 - RNA, 21 nt, Homo sapiens
uauagugucuugggaauuuuc

SEQ ID NO: 881957 - RNA, 21 nt, Homo sapiens
uauauaaugguuuacugcugu

SEQ ID NO: 881958 - RNA, 13 nt, Homo sapiens
uauauacauucuu

SEQ ID NO: 881959 - RNA, 12 nt, Homo sapiens
uauauacauuuc

SEQ ID NO: 881960 - RNA, 13 nt, Homo sapiens
uauauaccaagcu

SEQ ID NO: 881961 - RNA, 19 nt, Homo sapiens
uauauaggaaacauuguua

SEQ ID NO: 881962 - RNA, 17 nt, Homo sapiens
uauauagguugugcaaa

SEQ ID NO: 881963 - RNA, 13 nt, Homo sapiens
uauauaguagcau

SEQ ID NO: 881964 - RNA, 22 nt, Homo sapiens
uauauauacauacacuuguaua

SEQ ID NO: 881965 - RNA, 16 nt, Homo sapiens
uauauauacauguaua

SEQ ID NO: 881966 - RNA, 19 nt, Homo sapiens
uauauauucuacacauaua

SEQ ID NO: 881967 - RNA, 19 nt, Homo sapiens
uauauauuuauaacucauc

SEQ ID NO: 881968 - RNA, 21 nt, Homo sapiens
uauaucauaaaguaugccuuc

SEQ ID NO: 881969 - RNA, 14 nt, Homo sapiens
uauaucaucuauca

SEQ ID NO: 881970 - RNA, 20 nt, Homo sapiens
uauauccagauggcaugugu

SEQ ID NO: 881971 - RNA, 15 nt, Homo sapiens
uauaucccauugaaa

SEQ ID NO: 881972 - RNA, 17 nt, Homo sapiens
uauaucgcuuaaucuua

SEQ ID NO: 881973 - RNA, 17 nt, Homo sapiens
uauaucuuuuuccauca

SEQ ID NO: 881974 - RNA, 23 nt, Homo sapiens
uauauguauauuaaaacugcacu

SEQ ID NO: 881975 - RNA, 17 nt, Homo sapiens
uauauguguguguauau

SEQ ID NO: 881976 - RNA, 17 nt, Homo sapiens
uauauuauaaucuucca

SEQ ID NO: 881977 - RNA, 19 nt, Homo sapiens
uauauuaugguguaaugca

SEQ ID NO: 881978 - RNA, 19 nt, Homo sapiens
uauauuccgcacucaagga

SEQ ID NO: 881979 - RNA, 13 nt, Homo sapiens
uauauucuuuaaa

SEQ ID NO: 881980 - RNA, 15 nt, Homo sapiens
uauauugcugcuggu

SEQ ID NO: 881981 - RNA, 16 nt, Homo sapiens
uauauuggaaucugua

SEQ ID NO: 881982 - RNA, 23 nt, Homo sapiens
uauauuggucauugccuugccaa

SEQ ID NO: 881983 - RNA, 17 nt, Homo sapiens
uauauugugccaagcga

SEQ ID NO: 881984 - RNA, 14 nt, Homo sapiens
uauauuuauacucu

SEQ ID NO: 881985 - RNA, 17 nt, Homo sapiens
uauauuugaauaucauu

SEQ ID NO: 881986 - RNA, 20 nt, Homo sapiens
uauauuuugugcuaucagac

SEQ ID NO: 881987 - RNA, 17 nt, Homo sapiens
uaucaaaaagacugugg

SEQ ID NO: 881988 - RNA, 20 nt, Homo sapiens
uaucaaaaaguacaauaaua

SEQ ID NO: 881989 - RNA, 15 nt, Homo sapiens
uaucaaaaaguauua

SEQ ID NO: 881990 - RNA, 19 nt, Homo sapiens
uaucaaccccagacacugg

SEQ ID NO: 881991 - RNA, 21 nt, Homo sapiens
uaucaagccaguacgugcuaa

SEQ ID NO: 881992 - RNA, 16 nt, Homo sapiens
uaucacauauuugaua

SEQ ID NO: 881993 - RNA, 16 nt, Homo sapiens
uaucagaccucugauc

SEQ ID NO: 881994 - RNA, 19 nt, Homo sapiens
uaucaggccaagaccccag

SEQ ID NO: 881995 - RNA, 23 nt, Homo sapiens
uaucauuuauuuacaucuaugua

SEQ ID NO: 881996 - RNA, 17 nt, Homo sapiens
uaucauuuugcacgugc

SEQ ID NO: 881997 - RNA, 23 nt, Homo sapiens
uauccacaucccuaacaucaugc

SEQ ID NO: 881998 - RNA, 16 nt, Homo sapiens
uauccacaucuaagaa

SEQ ID NO: 881999 - RNA, 21 nt, Homo sapiens
uauccacaucuuuaaguauug

SEQ ID NO: 882000 - RNA, 17 nt, Homo sapiens
uauccacuuaccuagau

SEQ ID NO: 882001 - RNA, 24 nt, Homo sapiens
uauccacuuaccuagauucuacau

SEQ ID NO: 882002 - RNA, 20 nt, Homo sapiens
uauccugcuagcuguagaaa

SEQ ID NO: 882003 - RNA, 15 nt, Homo sapiens
uaucgcugccuugcc

SEQ ID NO: 882004 - RNA, 15 nt, Homo sapiens
uaucgggaacagugu

SEQ ID NO: 882005 - RNA, 21 nt, Homo sapiens
uaucuaccugcccucucucag

SEQ ID NO: 882006 - RNA, 12 nt, Homo sapiens
uaucuaugcauu

SEQ ID NO: 882007 - RNA, 13 nt, Homo sapiens
uaucuaugcauuu

SEQ ID NO: 882008 - RNA, 12 nt, Homo sapiens
uaucucaucucu

SEQ ID NO: 882009 - RNA, 21 nt, Homo sapiens
uaucucugaagcauguuucau

SEQ ID NO: 882010 - RNA, 21 nt, Homo sapiens
uaucugaacacauacuagaaa

SEQ ID NO: 882011 - RNA, 16 nt, Homo sapiens
uaucugacaucuuauu

SEQ ID NO: 882012 - RNA, 11 nt, Homo sapiens
uaucuuaccug

SEQ ID NO: 882013 - RNA, 22 nt, Homo sapiens
uaucuugaaacauagagaucua

SEQ ID NO: 882014 - RNA, 20 nt, Homo sapiens
uaugaaagacuuacaggccu

SEQ ID NO: 882015 - RNA, 18 nt, Homo sapiens
uaugaauugacagacugu

SEQ ID NO: 882016 - RNA, 19 nt, Homo sapiens
uaugacacugagcaagauc

SEQ ID NO: 882017 - RNA, 22 nt, Homo sapiens
uaugacuguuuuuauaugcaca

SEQ ID NO: 882018 - RNA, 16 nt, Homo sapiens
uaugagggucagggca

SEQ ID NO: 882019 - RNA, 20 nt, Homo sapiens
uaugagucucuaugaucuug

SEQ ID NO: 882020 - RNA, 21 nt, Homo sapiens
uaugaguuuuugauagcuuua

SEQ ID NO: 882021 - RNA, 13 nt, Homo sapiens
uaugaucauguaa

SEQ ID NO: 882022 - RNA, 12 nt, Homo sapiens
uaugaugccuuu

SEQ ID NO: 882023 - RNA, 20 nt, Homo sapiens
uaugauuuaagguacuuaaa

SEQ ID NO: 882024 - RNA, 23 nt, Homo sapiens
ucaguguaccgcgucuacccugg

SEQ ID NO: 882025 - RNA, 20 nt, Homo sapiens
ucaguguuuuuucacuuuag

SEQ ID NO: 882026 - RNA, 13 nt, Homo sapiens
ucaguuaacauua

SEQ ID NO: 882027 - RNA, 18 nt, Homo sapiens
ucaguuacucagcccugg

SEQ ID NO: 882028 - RNA, 17 nt, Homo sapiens
ucaguuacuuaccugca

SEQ ID NO: 882029 - RNA, 20 nt, Homo sapiens
ucaguuauaauuauuccacu

SEQ ID NO: 882030 - RNA, 19 nt, Homo sapiens
ucaguuauucagauugaca

SEQ ID NO: 882031 - RNA, 16 nt, Homo sapiens
ucaguugacaaaauau

SEQ ID NO: 882032 - RNA, 18 nt, Homo sapiens
ucaguuguuccuacucag

SEQ ID NO: 882033 - RNA, 15 nt, Homo sapiens
ucaguuuccucacca

SEQ ID NO: 882034 - RNA, 22 nt, Homo sapiens
ucaguuuuaucuuuaaucuccu

SEQ ID NO: 882035 - RNA, 14 nt, Homo sapiens
ucauaaacagcauu

SEQ ID NO: 882036 - RNA, 15 nt, Homo sapiens
ucauaaccauuccca

SEQ ID NO: 882037 - RNA, 16 nt, Homo sapiens
ucauaaccuuaccaga

SEQ ID NO: 882038 - RNA, 23 nt, Homo sapiens
ucauaagccuaccaauguagaca

SEQ ID NO: 882039 - RNA, 17 nt, Homo sapiens
ucauaaggcauauacaa

SEQ ID NO: 882040 - RNA, 18 nt, Homo sapiens
ucauaaggcauauacaaa

SEQ ID NO: 882041 - RNA, 16 nt, Homo sapiens
ucauaaguuggaccag

SEQ ID NO: 882042 - RNA, 14 nt, Homo sapiens
ucauacaugacuca

SEQ ID NO: 882043 - RNA, 16 nt, Homo sapiens
ucauaccuaucaucuu

SEQ ID NO: 882044 - RNA, 16 nt, Homo sapiens
ucauagcucacuguaa

SEQ ID NO: 882045 - RNA, 20 nt, Homo sapiens
ucaucaccuguuaucugugu

SEQ ID NO: 882046 - RNA, 18 nt, Homo sapiens
ucaucagcauaccuuuau

SEQ ID NO: 882047 - RNA, 14 nt, Homo sapiens
ucaucagcauuuaa

SEQ ID NO: 882048 - RNA, 16 nt, Homo sapiens
ucaucaggcuuggaau

SEQ ID NO: 882049 - RNA, 20 nt, Homo sapiens
ucaucaggcuuggaaugaau

SEQ ID NO: 882050 - RNA, 23 nt, Homo sapiens
ucaucagucauuauuagcuuuua

SEQ ID NO: 882051 - RNA, 17 nt, Homo sapiens
ucaucauacaugacuca

SEQ ID NO: 882052 - RNA, 23 nt, Homo sapiens
ucaucccaucuaagcugcagcuu

SEQ ID NO: 882053 - RNA, 15 nt, Homo sapiens
ucaucccuaugggau

SEQ ID NO: 882054 - RNA, 19 nt, Homo sapiens
ucauccugccuucauggaa

SEQ ID NO: 882055 - RNA, 20 nt, Homo sapiens
ucaucuacaagcauuugccc

SEQ ID NO: 882056 - RNA, 17 nt, Homo sapiens
ucaucuauaacaugcau

SEQ ID NO: 882057 - RNA, 14 nt, Homo sapiens
ucaucucauuccaa

SEQ ID NO: 882058 - RNA, 20 nt, Homo sapiens
ucaucucauuccaacuuccc

SEQ ID NO: 882059 - RNA, 13 nt, Homo sapiens
ucaucucuacuaa

SEQ ID NO: 882060 - RNA, 14 nt, Homo sapiens
ucaucugauaugca

SEQ ID NO: 882061 - RNA, 13 nt, Homo sapiens
ucaucuguuguuu

SEQ ID NO: 882062 - RNA, 21 nt, Homo sapiens
ucaucuuguugccauggaguu

SEQ ID NO: 882063 - RNA, 13 nt, Homo sapiens
ucaugaaccucaa

SEQ ID NO: 882064 - RNA, 23 nt, Homo sapiens
ucaugaacuauuuacauuuucca

SEQ ID NO: 882065 - RNA, 17 nt, Homo sapiens
ucaugaagcccaaguga

SEQ ID NO: 882066 - RNA, 14 nt, Homo sapiens
ucaugacagccaga

SEQ ID NO: 882067 - RNA, 19 nt, Homo sapiens
ucaugacccuccuguccag

SEQ ID NO: 882068 - RNA, 14 nt, Homo sapiens
ucaugacuuuucca

SEQ ID NO: 882069 - RNA, 22 nt, Homo sapiens
ucaugacuuuuccauguaucua

SEQ ID NO: 882070 - RNA, 15 nt, Homo sapiens
ucaugauaaucuggg

SEQ ID NO: 882071 - RNA, 16 nt, Homo sapiens
ucaugauggagacuuc

SEQ ID NO: 882072 - RNA, 15 nt, Homo sapiens
ucaugcacucaggca

SEQ ID NO: 882073 - RNA, 13 nt, Homo sapiens
ucaugccucugag

SEQ ID NO: 882074 - RNA, 19 nt, Homo sapiens
ucauggaaguggcagugaa

SEQ ID NO: 882075 - RNA, 23 nt, Homo sapiens
ucauggccauagcuuuuauucau

SEQ ID NO: 882076 - RNA, 20 nt, Homo sapiens
ucauggcuuagaaaucuuua

SEQ ID NO: 882077 - RNA, 16 nt, Homo sapiens
ucaugugugcauguga

SEQ ID NO: 882078 - RNA, 17 nt, Homo sapiens
ucaugugugcaugugag

SEQ ID NO: 882079 - RNA, 15 nt, Homo sapiens
ucauguuccucaaaa

SEQ ID NO: 882080 - RNA, 20 nt, Homo sapiens
ucauguucuugcagucauca

SEQ ID NO: 882081 - RNA, 23 nt, Homo sapiens
ucauuaccacgccuugaccuucc

SEQ ID NO: 882082 - RNA, 15 nt, Homo sapiens
ucauuacuaaccaua

SEQ ID NO: 882083 - RNA, 11 nt, Homo sapiens
ucauuaucuca

SEQ ID NO: 882084 - RNA, 19 nt, Homo sapiens
ucauuaugcagcugagguc

SEQ ID NO: 882085 - RNA, 14 nt, Homo sapiens
ucauucaaaacaac

SEQ ID NO: 882086 - RNA, 18 nt, Homo sapiens
ucauucaaaacaaccauc

SEQ ID NO: 882087 - RNA, 20 nt, Homo sapiens
ucauucagguauuuguaaua

SEQ ID NO: 882088 - RNA, 19 nt, Homo sapiens
ucauucccuagaucuuucu

SEQ ID NO: 882089 - RNA, 15 nt, Homo sapiens
ucauuccuucacuca

SEQ ID NO: 882090 - RNA, 23 nt, Homo sapiens
ucauucucuuauauaguauucau

SEQ ID NO: 882091 - RNA, 19 nt, Homo sapiens
ucauugucgcucagcaaua

SEQ ID NO: 882092 - RNA, 14 nt, Homo sapiens
ucauugucugugga

SEQ ID NO: 882093 - RNA, 20 nt, Homo sapiens
ucauuguuuauuaacaaauu

SEQ ID NO: 882094 - RNA, 17 nt, Homo sapiens
ucauuuauaaaaccauc

SEQ ID NO: 882095 - RNA, 21 nt, Homo sapiens
ucauuuccuccgucaccucag

SEQ ID NO: 882096 - RNA, 23 nt, Homo sapiens
ucauuucuuuucauuguaaucaa

SEQ ID NO: 882097 - RNA, 23 nt, Homo sapiens
ucauuuuaacuuuaucacauuau

SEQ ID NO: 882098 - RNA, 18 nt, Homo sapiens
ucauuuucaaugcacauu

SEQ ID NO: 882099 - RNA, 16 nt, Homo sapiens
ucauuuugagucucag

SEQ ID NO: 882100 - RNA, 23 nt, Homo sapiens
ucauuuuugguaggcuuaucaaa

SEQ ID NO: 882101 - RNA, 21 nt, Homo sapiens
uccaaaacuaauuuccucuga

SEQ ID NO: 882102 - RNA, 15 nt, Homo sapiens
uccaaagacaagaaa

SEQ ID NO: 882103 - RNA, 12 nt, Homo sapiens
uccaaagcaaau

SEQ ID NO: 882104 - RNA, 16 nt, Homo sapiens
uccaaaggcccuacca

SEQ ID NO: 882105 - RNA, 13 nt, Homo sapiens
uccaaaugccaac

SEQ ID NO: 882106 - RNA, 21 nt, Homo sapiens
uccaaccccccaccugccauu

SEQ ID NO: 882107 - RNA, 16 nt, Homo sapiens
uccaaccccuuuccac

SEQ ID NO: 882108 - RNA, 17 nt, Homo sapiens
uccaaccccuuuccacg

SEQ ID NO: 882109 - RNA, 19 nt, Homo sapiens
uccaaccugccugugcaug

SEQ ID NO: 882110 - RNA, 20 nt, Homo sapiens
uccaaccugccugugcauga

SEQ ID NO: 882111 - RNA, 20 nt, Homo sapiens
uccaacuccuggagauuuca

SEQ ID NO: 882112 - RNA, 16 nt, Homo sapiens
uccaacuccugguuca

SEQ ID NO: 882113 - RNA, 19 nt, Homo sapiens
uccaagaggucuccaucau

SEQ ID NO: 882114 - RNA, 22 nt, Homo sapiens
uccaagccauucacuuccccaa

SEQ ID NO: 882115 - RNA, 12 nt, Homo sapiens
uccaagcccuuu

SEQ ID NO: 882116 - RNA, 18 nt, Homo sapiens
uccaagcuucaagugaua

SEQ ID NO: 882117 - RNA, 22 nt, Homo sapiens
uccaaggguaugggaagccaua

SEQ ID NO: 882118 - RNA, 15 nt, Homo sapiens
uccaauaggcauuug

SEQ ID NO: 882119 - RNA, 12 nt, Homo sapiens
uccaauaugaug

SEQ ID NO: 882120 - RNA, 17 nt, Homo sapiens
uccaauauuggagcaua

SEQ ID NO: 882121 - RNA, 16 nt, Homo sapiens
uccaaugcauugcuaa

SEQ ID NO: 882122 - RNA, 13 nt, Homo sapiens
uccaauggcugua

SEQ ID NO: 882123 - RNA, 16 nt, Homo sapiens
uccaauuaugugacaa

SEQ ID NO: 882124 - RNA, 12 nt, Homo sapiens
uccaauugaacu

SEQ ID NO: 882125 - RNA, 20 nt, Homo sapiens
uccacaagauucccagagac

SEQ ID NO: 882126 - RNA, 19 nt, Homo sapiens
uccacaccaaagucaggga

SEQ ID NO: 882127 - RNA, 20 nt, Homo sapiens
uccacaccaaagucagggag

SEQ ID NO: 882128 - RNA, 15 nt, Homo sapiens
uccacagucucccau

SEQ ID NO: 882129 - RNA, 14 nt, Homo sapiens
uccacagugcugcu

SEQ ID NO: 882130 - RNA, 19 nt, Homo sapiens
uccacauuauacauuugau

SEQ ID NO: 882131 - RNA, 16 nt, Homo sapiens
uccacccuauucccua

SEQ ID NO: 882132 - RNA, 17 nt, Homo sapiens
uccacccugagccugac

SEQ ID NO: 882133 - RNA, 18 nt, Homo sapiens
uccaccgcagaaggaagg

SEQ ID NO: 882134 - RNA, 20 nt, Homo sapiens
uccaccuuguuacacauuau

SEQ ID NO: 882135 - RNA, 11 nt, Homo sapiens
uccacgagcua

SEQ ID NO: 882136 - RNA, 14 nt, Homo sapiens
uccacgagcuauau

SEQ ID NO: 882137 - RNA, 15 nt, Homo sapiens
uccacgcacacaugg

SEQ ID NO: 882138 - RNA, 16 nt, Homo sapiens
uccacgcacacaugga

SEQ ID NO: 882139 - RNA, 17 nt, Homo sapiens
uggcagccgugccuuca

SEQ ID NO: 882140 - RNA, 14 nt, Homo sapiens
uggcaggaccagga

SEQ ID NO: 882141 - RNA, 16 nt, Homo sapiens
uggcaggagaaucaau

SEQ ID NO: 882142 - RNA, 13 nt, Homo sapiens
uggcaggugcaga

SEQ ID NO: 882143 - RNA, 15 nt, Homo sapiens
uggcaguuacagggc

SEQ ID NO: 882144 - RNA, 18 nt, Homo sapiens
uggcaucucuuucugcaa

SEQ ID NO: 882145 - RNA, 11 nt, Homo sapiens
uggcaugucag

SEQ ID NO: 882146 - RNA, 16 nt, Homo sapiens
uggcauucacacagcc

SEQ ID NO: 882147 - RNA, 17 nt, Homo sapiens
uggcauuuguugugacu

SEQ ID NO: 882148 - RNA, 16 nt, Homo sapiens
uggccaacaugaugaa

SEQ ID NO: 882149 - RNA, 22 nt, Homo sapiens
uggccaggagguuggugacuga

SEQ ID NO: 882150 - RNA, 18 nt, Homo sapiens
uggccaugcuucuugccc

SEQ ID NO: 882151 - RNA, 18 nt, Homo sapiens
uggccccgggcucuggcc

SEQ ID NO: 882152 - RNA, 14 nt, Homo sapiens
uggcccuucuugcc

SEQ ID NO: 882153 - RNA, 19 nt, Homo sapiens
uggcccuuucuggaccaga

SEQ ID NO: 882154 - RNA, 14 nt, Homo sapiens
uggccgugaggaca

SEQ ID NO: 882155 - RNA, 22 nt, Homo sapiens
uggccuaugcacauauggacuc

SEQ ID NO: 882156 - RNA, 15 nt, Homo sapiens
uggccuccugugcau

SEQ ID NO: 882157 - RNA, 12 nt, Homo sapiens
uggccuggcaca

SEQ ID NO: 882158 - RNA, 18 nt, Homo sapiens
uggccuggcacacaucag

SEQ ID NO: 882159 - RNA, 21 nt, Homo sapiens
uggccuggggaagcugugaaa

SEQ ID NO: 882160 - RNA, 13 nt, Homo sapiens
uggccuguggcag

SEQ ID NO: 882161 - RNA, 21 nt, Homo sapiens
uggcggcuuccuguccacucu

SEQ ID NO: 882162 - RNA, 14 nt, Homo sapiens
uggcuaauucccag

SEQ ID NO: 882163 - RNA, 22 nt, Homo sapiens
uggcuaauucccagagugugaa

SEQ ID NO: 882164 - RNA, 15 nt, Homo sapiens
uggcucucagaaggu

SEQ ID NO: 882165 - RNA, 13 nt, Homo sapiens
uggcucugugaaa

SEQ ID NO: 882166 - RNA, 15 nt, Homo sapiens
uggcucuugccugua

SEQ ID NO: 882167 - RNA, 19 nt, Homo sapiens
uggcugaaaaucacuauaa

SEQ ID NO: 882168 - RNA, 15 nt, Homo sapiens
uggcugaccccaaag

SEQ ID NO: 882169 - RNA, 12 nt, Homo sapiens
uggcugcaguga

SEQ ID NO: 882170 - RNA, 22 nt, Homo sapiens
uggcugcagugacccagauauu

SEQ ID NO: 882171 - RNA, 17 nt, Homo sapiens
uggcugcucauuccuuc

SEQ ID NO: 882172 - RNA, 22 nt, Homo sapiens
uggcuguaaacuauaaacuacu

SEQ ID NO: 882173 - RNA, 11 nt, Homo sapiens
uggcugugagg

SEQ ID NO: 882174 - RNA, 19 nt, Homo sapiens
uggcuucuagaucuggaac

SEQ ID NO: 882175 - RNA, 11 nt, Homo sapiens
uggcuucuuac

SEQ ID NO: 882176 - RNA, 15 nt, Homo sapiens
uggcuucuuacugaa

SEQ ID NO: 882177 - RNA, 21 nt, Homo sapiens
uggcuuuuuuccuccugugua

SEQ ID NO: 882178 - RNA, 14 nt, Homo sapiens
ugggaaagcauugu

SEQ ID NO: 882179 - RNA, 14 nt, Homo sapiens
ugggaaauuacuua

SEQ ID NO: 882180 - RNA, 23 nt, Homo sapiens
ugggaagccauauucacaccuca

SEQ ID NO: 882181 - RNA, 22 nt, Homo sapiens
ugggaagucguccuuacuccug

SEQ ID NO: 882182 - RNA, 22 nt, Homo sapiens
ugggaauugcaugccaucucca

SEQ ID NO: 882183 - RNA, 19 nt, Homo sapiens
ugggaccuguguucuugcu

SEQ ID NO: 882184 - RNA, 14 nt, Homo sapiens
ugggacuuauguau

SEQ ID NO: 882185 - RNA, 23 nt, Homo sapiens
ugggagagaaggagaucagggca

SEQ ID NO: 882186 - RNA, 13 nt, Homo sapiens
ugggagagccaga

SEQ ID NO: 882187 - RNA, 14 nt, Homo sapiens
ugggagagugcagu

SEQ ID NO: 882188 - RNA, 14 nt, Homo sapiens
ugggagaucagcca

SEQ ID NO: 882189 - RNA, 20 nt, Homo sapiens
ugggaucaagaaggggacag

SEQ ID NO: 882190 - RNA, 11 nt, Homo sapiens
ugggaugcuac

SEQ ID NO: 882191 - RNA, 17 nt, Homo sapiens
ugggauuacagguguga

SEQ ID NO: 882192 - RNA, 19 nt, Homo sapiens
ugggauuuaaagccuuuag

SEQ ID NO: 882193 - RNA, 18 nt, Homo sapiens
ugggcaaagcugugcacu

SEQ ID NO: 882194 - RNA, 19 nt, Homo sapiens
ugggcaacaacagcaaaac

SEQ ID NO: 882195 - RNA, 15 nt, Homo sapiens
ugggcaacagaugaa

SEQ ID NO: 882196 - RNA, 14 nt, Homo sapiens
ugggcaauucugac

SEQ ID NO: 882197 - RNA, 13 nt, Homo sapiens
ugggcacugggau

SEQ ID NO: 882198 - RNA, 15 nt, Homo sapiens
ugggcagcagcucag

SEQ ID NO: 882199 - RNA, 18 nt, Homo sapiens
ugggcagcauagcaagac

SEQ ID NO: 882200 - RNA, 18 nt, Homo sapiens
ugggcagcugucauggaa

SEQ ID NO: 882201 - RNA, 13 nt, Homo sapiens
ugggccacugcca

SEQ ID NO: 882202 - RNA, 18 nt, Homo sapiens
ugggccagccucagcuca

SEQ ID NO: 882203 - RNA, 17 nt, Homo sapiens
ugggcccugcacagaua

SEQ ID NO: 882204 - RNA, 15 nt, Homo sapiens
ugggccucaguucaa

SEQ ID NO: 882205 - RNA, 15 nt, Homo sapiens
ugggcguuuguaaau

SEQ ID NO: 882206 - RNA, 21 nt, Homo sapiens
ugggcucgccacaucccauga

SEQ ID NO: 882207 - RNA, 21 nt, Homo sapiens
ugggcuuguagaccacugucc

SEQ ID NO: 882208 - RNA, 15 nt, Homo sapiens
uggggaagcugugaa

SEQ ID NO: 882209 - RNA, 18 nt, Homo sapiens
uggggacagcauaccuug

SEQ ID NO: 882210 - RNA, 15 nt, Homo sapiens
uggggagggagacag

SEQ ID NO: 882211 - RNA, 21 nt, Homo sapiens
uggggcaauggggagaggcaa

SEQ ID NO: 882212 - RNA, 16 nt, Homo sapiens
uggggcaccuugcucc

SEQ ID NO: 882213 - RNA, 10 nt, Homo sapiens
uggggcuccu

SEQ ID NO: 882214 - RNA, 19 nt, Homo sapiens
uggggcuccucacauagcu

SEQ ID NO: 882215 - RNA, 18 nt, Homo sapiens
uggggcuccuuucuccag

SEQ ID NO: 882216 - RNA, 21 nt, Homo sapiens
uggggcuggaugucuccaucu

SEQ ID NO: 882217 - RNA, 19 nt, Homo sapiens
ugggggucagucacuugaa

SEQ ID NO: 882218 - RNA, 21 nt, Homo sapiens
ugggguauuuaccacagcagc

SEQ ID NO: 882219 - RNA, 14 nt, Homo sapiens
uggggucaaagacu

SEQ ID NO: 882220 - RNA, 15 nt, Homo sapiens
ugggguucaucuagg

SEQ ID NO: 882221 - RNA, 20 nt, Homo sapiens
ugggguucaucuagggacac

SEQ ID NO: 882222 - RNA, 16 nt, Homo sapiens
uggguaacugucaagu

SEQ ID NO: 882223 - RNA, 15 nt, Homo sapiens
ugggucuucccugua

SEQ ID NO: 882224 - RNA, 20 nt, Homo sapiens
uggguggggcugcuccucca

SEQ ID NO: 882225 - RNA, 21 nt, Homo sapiens
uggguggggcugcuccuccag

SEQ ID NO: 882226 - RNA, 18 nt, Homo sapiens
uggguuuucuaacuguaa

SEQ ID NO: 882227 - RNA, 22 nt, Homo sapiens
uggguuuugucucugcaucuca

SEQ ID NO: 882228 - RNA, 15 nt, Homo sapiens
ugguaaacauucucu

SEQ ID NO: 882229 - RNA, 16 nt, Homo sapiens
ugguaaauuaguauuu

SEQ ID NO: 882230 - RNA, 23 nt, Homo sapiens
ugguaacuuuuuuuuaaagcuca

SEQ ID NO: 882231 - RNA, 19 nt, Homo sapiens
ugguaauaaguacugugua

SEQ ID NO: 882232 - RNA, 14 nt, Homo sapiens
ugguacaaggaaua

SEQ ID NO: 882233 - RNA, 13 nt, Homo sapiens
ugguacaauccuu

SEQ ID NO: 882234 - RNA, 13 nt, Homo sapiens
ugguaccagcuca

SEQ ID NO: 882235 - RNA, 12 nt, Homo sapiens
ugguagaaccac

SEQ ID NO: 882236 - RNA, 22 nt, Homo sapiens
ugguagaacguaaccacggaaa

SEQ ID NO: 882237 - RNA, 21 nt, Homo sapiens
ugguauaauuauuuacucuua

SEQ ID NO: 882238 - RNA, 14 nt, Homo sapiens
ugguauccaaguua

SEQ ID NO: 882239 - RNA, 12 nt, Homo sapiens
ugguaugaucac

SEQ ID NO: 882240 - RNA, 21 nt, Homo sapiens
ugguauguguguguaugcuac

SEQ ID NO: 882241 - RNA, 23 nt, Homo sapiens
ugguauguguguguaugcuacua

SEQ ID NO: 882242 - RNA, 20 nt, Homo sapiens
uggucaauccgaaguaugag

SEQ ID NO: 882243 - RNA, 18 nt, Homo sapiens
uggucacaagcacaaagc

SEQ ID NO: 882244 - RNA, 21 nt, Homo sapiens
uggucacacagagauacgcaa

SEQ ID NO: 882245 - RNA, 21 nt, Homo sapiens
uggucccaaguaguagugucu

SEQ ID NO: 882246 - RNA, 23 nt, Homo sapiens
ugguccgccacgaggagcuucca

SEQ ID NO: 882247 - RNA, 20 nt, Homo sapiens
uggucucaagcaguccuccu

SEQ ID NO: 882248 - RNA, 13 nt, Homo sapiens
uggucugacccac

SEQ ID NO: 882249 - RNA, 12 nt, Homo sapiens
uggucuuugaau

SEQ ID NO: 882250 - RNA, 19 nt, Homo sapiens
uggugaaaccucaucucua

SEQ ID NO: 882251 - RNA, 20 nt, Homo sapiens
uggugaagaacaucccaagc

SEQ ID NO: 882252 - RNA, 19 nt, Homo sapiens
uggugacaugugccuguaa

SEQ ID NO: 882253 - RNA, 22 nt, Homo sapiens
uggugagaaucgaccucacugu

SEQ ID NO: 882254 - RNA, 12 nt, Homo sapiens
uuacuacaugca

SEQ ID NO: 882255 - RNA, 13 nt, Homo sapiens
uuacuacuugcca

SEQ ID NO: 882256 - RNA, 19 nt, Homo sapiens
uuacuaugacugcucccca

SEQ ID NO: 882257 - RNA, 17 nt, Homo sapiens
uuacuaugaucucagga

SEQ ID NO: 882258 - RNA, 21 nt, Homo sapiens
uuacuauuuauugcugaauga

SEQ ID NO: 882259 - RNA, 23 nt, Homo sapiens
uuacuauuuauugcugaaugacu

SEQ ID NO: 882260 - RNA, 16 nt, Homo sapiens
uuacucaugacuccuu

SEQ ID NO: 882261 - RNA, 19 nt, Homo sapiens
uuacucccaggcacugucu

SEQ ID NO: 882262 - RNA, 15 nt, Homo sapiens
uuacucuggugcugu

SEQ ID NO: 882263 - RNA, 20 nt, Homo sapiens
uuacugagcuucucugugaa

SEQ ID NO: 882264 - RNA, 22 nt, Homo sapiens
uuacugauucuccugucagaga

SEQ ID NO: 882265 - RNA, 20 nt, Homo sapiens
uuacuguaauuggugacaau

SEQ ID NO: 882266 - RNA, 17 nt, Homo sapiens
uuacuuaccuaaacaga

SEQ ID NO: 882267 - RNA, 13 nt, Homo sapiens
uuacuuaggaaac

SEQ ID NO: 882268 - RNA, 15 nt, Homo sapiens
uuacuucacuuuaau

SEQ ID NO: 882269 - RNA, 23 nt, Homo sapiens
uuacuuuaaaauaaaaaaguaac

SEQ ID NO: 882270 - RNA, 19 nt, Homo sapiens
uuacuuuaauacucaccuc

SEQ ID NO: 882271 - RNA, 16 nt, Homo sapiens
uuacuuuauguuacua

SEQ ID NO: 882272 - RNA, 16 nt, Homo sapiens
uuacuuuguguucacc

SEQ ID NO: 882273 - RNA, 22 nt, Homo sapiens
uuacuuuuggauaauauccacu

SEQ ID NO: 882274 - RNA, 12 nt, Homo sapiens
uuagaaugccuc

SEQ ID NO: 882275 - RNA, 17 nt, Homo sapiens
uuagacagagucucacu

SEQ ID NO: 882276 - RNA, 13 nt, Homo sapiens
uuagacagaugac

SEQ ID NO: 882277 - RNA, 22 nt, Homo sapiens
uuagacaugacugaugacauau

SEQ ID NO: 882278 - RNA, 13 nt, Homo sapiens
uuagagaauguuc

SEQ ID NO: 882279 - RNA, 14 nt, Homo sapiens
uuagagacaucaaa

SEQ ID NO: 882280 - RNA, 21 nt, Homo sapiens
uuagaugagggugacugucaa

SEQ ID NO: 882281 - RNA, 16 nt, Homo sapiens
uuagcaaccauaauau

SEQ ID NO: 882282 - RNA, 17 nt, Homo sapiens
uuagcaauugacuguca

SEQ ID NO: 882283 - RNA, 15 nt, Homo sapiens
uuagcagcucuuccc

SEQ ID NO: 882284 - RNA, 20 nt, Homo sapiens
uuagccuugcucaggugcaa

SEQ ID NO: 882285 - RNA, 22 nt, Homo sapiens
uuagcuaccucacuaugcugcu

SEQ ID NO: 882286 - RNA, 17 nt, Homo sapiens
uuagcuagaaugcacac

SEQ ID NO: 882287 - RNA, 12 nt, Homo sapiens
uuagcucugauc

SEQ ID NO: 882288 - RNA, 19 nt, Homo sapiens
uuagcuguuuuuuucauua

SEQ ID NO: 882289 - RNA, 21 nt, Homo sapiens
uuagcuucucugccaagcccu

SEQ ID NO: 882290 - RNA, 12 nt, Homo sapiens
uuaggaacagcu

SEQ ID NO: 882291 - RNA, 20 nt, Homo sapiens
uuaggaaggcagcauuccau

SEQ ID NO: 882292 - RNA, 20 nt, Homo sapiens
uuaggaggaggugggggcua

SEQ ID NO: 882293 - RNA, 19 nt, Homo sapiens
uuaggaugugggaguaaaa

SEQ ID NO: 882294 - RNA, 12 nt, Homo sapiens
uuaggcauuaaa

SEQ ID NO: 882295 - RNA, 18 nt, Homo sapiens
uuagggaugacugugauu

SEQ ID NO: 882296 - RNA, 14 nt, Homo sapiens
uuagguuuuguaca

SEQ ID NO: 882297 - RNA, 16 nt, Homo sapiens
uuagguuuuguacaau

SEQ ID NO: 882298 - RNA, 16 nt, Homo sapiens
uuaguaauuucuugcu

SEQ ID NO: 882299 - RNA, 19 nt, Homo sapiens
uuagugugugugcaugugu

SEQ ID NO: 882300 - RNA, 23 nt, Homo sapiens
uuaguuuguuuuacaaauuuuuc

SEQ ID NO: 882301 - RNA, 19 nt, Homo sapiens
uuauaaaaauacaacuaga

SEQ ID NO: 882302 - RNA, 19 nt, Homo sapiens
uuauaaaaucuuacuuugu

SEQ ID NO: 882303 - RNA, 12 nt, Homo sapiens
uuauaaauccaa

SEQ ID NO: 882304 - RNA, 19 nt, Homo sapiens
uuauaauaauguucucugg

SEQ ID NO: 882305 - RNA, 12 nt, Homo sapiens
uuauaaucuuuu

SEQ ID NO: 882306 - RNA, 21 nt, Homo sapiens
uuauacaucaccuuuuugacu

SEQ ID NO: 882307 - RNA, 18 nt, Homo sapiens
uuauauagguugugcaaa

SEQ ID NO: 882308 - RNA, 19 nt, Homo sapiens
uuauauauuuauaacucau

SEQ ID NO: 882309 - RNA, 16 nt, Homo sapiens
uuauaugauauacuau

SEQ ID NO: 882310 - RNA, 16 nt, Homo sapiens
uuauauuaaaauaugg

SEQ ID NO: 882311 - RNA, 17 nt, Homo sapiens
uuauccugcuagcugua

SEQ ID NO: 882312 - RNA, 11 nt, Homo sapiens
uuaucugcuag

SEQ ID NO: 882313 - RNA, 17 nt, Homo sapiens
uuaucuguguugucucu

SEQ ID NO: 882314 - RNA, 15 nt, Homo sapiens
uuaucuugucucugg

SEQ ID NO: 882315 - RNA, 16 nt, Homo sapiens
uuaugaaaaccauaug

SEQ ID NO: 882316 - RNA, 12 nt, Homo sapiens
uuaugacuguuu

SEQ ID NO: 882317 - RNA, 18 nt, Homo sapiens
uuaugagaaaguucucau

SEQ ID NO: 882318 - RNA, 21 nt, Homo sapiens
uuaugcagaauccaaaguaaa

SEQ ID NO: 882319 - RNA, 23 nt, Homo sapiens
uuaugccauagcaagauugcuua

SEQ ID NO: 882320 - RNA, 15 nt, Homo sapiens
uuaugcccucagaug

SEQ ID NO: 882321 - RNA, 15 nt, Homo sapiens
uuaugccuucacuuu

SEQ ID NO: 882322 - RNA, 21 nt, Homo sapiens
uuaugccuucacuuuacaaau

SEQ ID NO: 882323 - RNA, 13 nt, Homo sapiens
uuauguaaucuca

SEQ ID NO: 882324 - RNA, 12 nt, Homo sapiens
uuaugugacaac

SEQ ID NO: 882325 - RNA, 18 nt, Homo sapiens
uuaugugagccccuucag

SEQ ID NO: 882326 - RNA, 14 nt, Homo sapiens
uuauguuagcauug

SEQ ID NO: 882327 - RNA, 16 nt, Homo sapiens
uuauuaccauuagcau

SEQ ID NO: 882328 - RNA, 21 nt, Homo sapiens
uuauuccuaaaucuuccagca

SEQ ID NO: 882329 - RNA, 12 nt, Homo sapiens
uuauugcauaau

SEQ ID NO: 882330 - RNA, 22 nt, Homo sapiens
uuauugcuugauacuuuugaca

SEQ ID NO: 882331 - RNA, 19 nt, Homo sapiens
uuauugggcaagugauuga

SEQ ID NO: 882332 - RNA, 14 nt, Homo sapiens
uuauuguaccucuc

SEQ ID NO: 882333 - RNA, 14 nt, Homo sapiens
uuauuguugcauua

SEQ ID NO: 882334 - RNA, 14 nt, Homo sapiens
uuauuuacaaugca

SEQ ID NO: 882335 - RNA, 16 nt, Homo sapiens
uuauuuguagucuaau

SEQ ID NO: 882336 - RNA, 16 nt, Homo sapiens
uuauuuugaaaauaau

SEQ ID NO: 882337 - RNA, 19 nt, Homo sapiens
uuauuuuuauaucagccug

SEQ ID NO: 882338 - RNA, 19 nt, Homo sapiens
uucaaacagucucaggaaa

SEQ ID NO: 882339 - RNA, 13 nt, Homo sapiens
uucaaaguguaag

SEQ ID NO: 882340 - RNA, 18 nt, Homo sapiens
uucaaaguuaauuuuccc

SEQ ID NO: 882341 - RNA, 17 nt, Homo sapiens
uucaaaugucagcuuaa

SEQ ID NO: 882342 - RNA, 19 nt, Homo sapiens
uucaaauuuuuacugagaa

SEQ ID NO: 882343 - RNA, 20 nt, Homo sapiens
uucaacccucagccuugaaa

SEQ ID NO: 882344 - RNA, 15 nt, Homo sapiens
uucaagaaagcuuca

SEQ ID NO: 882345 - RNA, 20 nt, Homo sapiens
uucaagaccagccugaccaa

SEQ ID NO: 882346 - RNA, 12 nt, Homo sapiens
uucaagacuuga

SEQ ID NO: 882347 - RNA, 14 nt, Homo sapiens
uucaagagugcagu

SEQ ID NO: 882348 - RNA, 18 nt, Homo sapiens
uucaagcacccuguuccc

SEQ ID NO: 882349 - RNA, 16 nt, Homo sapiens
uucaagccuuagauaa

SEQ ID NO: 882350 - RNA, 16 nt, Homo sapiens
uucaaguuaaagugaa

SEQ ID NO: 882351 - RNA, 21 nt, Homo sapiens
uucaauaaaguaucuacaugc

SEQ ID NO: 882352 - RNA, 13 nt, Homo sapiens
uucaauacuucau

SEQ ID NO: 882353 - RNA, 16 nt, Homo sapiens
uucaauacuucaugau

SEQ ID NO: 882354 - RNA, 15 nt, Homo sapiens
uucaaugaccuguau

SEQ ID NO: 882355 - RNA, 16 nt, Homo sapiens
uucacaaccagccaca

SEQ ID NO: 882356 - RNA, 20 nt, Homo sapiens
uucacacagggcucuuugau

SEQ ID NO: 882357 - RNA, 15 nt, Homo sapiens
uucacagccaggaga

SEQ ID NO: 882358 - RNA, 16 nt, Homo sapiens
uucacaggguauuaau

SEQ ID NO: 882359 - RNA, 20 nt, Homo sapiens
uucacauaaacacauacauu

SEQ ID NO: 882360 - RNA, 21 nt, Homo sapiens
uucacauuugauguacaugug

SEQ ID NO: 882361 - RNA, 22 nt, Homo sapiens
uucaccaaaucuugguugaugc

SEQ ID NO: 882362 - RNA, 18 nt, Homo sapiens
uucaccacaugugcacau

SEQ ID NO: 882363 - RNA, 14 nt, Homo sapiens
uucaccugaucaua

SEQ ID NO: 882364 - RNA, 21 nt, Homo sapiens
uucacuaauaaacauuuggca

SEQ ID NO: 882365 - RNA, 18 nt, Homo sapiens
uucacuguaagacucauu

SEQ ID NO: 882366 - RNA, 18 nt, Homo sapiens
uucacuguagaaugauuu

SEQ ID NO: 882367 - RNA, 16 nt, Homo sapiens
uucacuuauugacuau

SEQ ID NO: 882368 - RNA, 14 nt, Homo sapiens
uucacuuuacaaau

SEQ ID NO: 882369 - RNA, 15 nt, Homo sapiens
uugugucuguacacg

SEQ ID NO: 882370 - RNA, 23 nt, Homo sapiens
uuguguuuuuuuuuuaaauagac

SEQ ID NO: 882371 - RNA, 12 nt, Homo sapiens
uuguuaaugcau

SEQ ID NO: 882372 - RNA, 13 nt, Homo sapiens
uuguuaaugcauu

SEQ ID NO: 882373 - RNA, 12 nt, Homo sapiens
uuguuaugcuau

SEQ ID NO: 882374 - RNA, 15 nt, Homo sapiens
uuguuauuuguacag

SEQ ID NO: 882375 - RNA, 14 nt, Homo sapiens
uuguucacauauau

SEQ ID NO: 882376 - RNA, 15 nt, Homo sapiens
uuguucaguugacuu

SEQ ID NO: 882377 - RNA, 21 nt, Homo sapiens
uuguuccuacucagacuguug

SEQ ID NO: 882378 - RNA, 15 nt, Homo sapiens
uuguucugucuuuag

SEQ ID NO: 882379 - RNA, 14 nt, Homo sapiens
uuguugcagccaaa

SEQ ID NO: 882380 - RNA, 17 nt, Homo sapiens
uuguuggccaaagccaa

SEQ ID NO: 882381 - RNA, 17 nt, Homo sapiens
uuguuuccauucuuguc

SEQ ID NO: 882382 - RNA, 23 nt, Homo sapiens
uuguuuggucacugcuacaccuu

SEQ ID NO: 882383 - RNA, 19 nt, Homo sapiens
uuguuuugacggaugauug

SEQ ID NO: 882384 - RNA, 12 nt, Homo sapiens
uuguuuugcacu

SEQ ID NO: 882385 - RNA, 13 nt, Homo sapiens
uuuaaaaaaugga

SEQ ID NO: 882386 - RNA, 20 nt, Homo sapiens
uuuaaaaauaaagcuacuga

SEQ ID NO: 882387 - RNA, 21 nt, Homo sapiens
uuuaaaaauaaagcuacugaa

SEQ ID NO: 882388 - RNA, 15 nt, Homo sapiens
uuuaaaaccaugcag

SEQ ID NO: 882389 - RNA, 15 nt, Homo sapiens
uuuaaaagcaucuca

SEQ ID NO: 882390 - RNA, 19 nt, Homo sapiens
uuuaaaauuaaaugcaugu

SEQ ID NO: 882391 - RNA, 12 nt, Homo sapiens
uuuaaacaguga

SEQ ID NO: 882392 - RNA, 17 nt, Homo sapiens
uuuaaagagcauaauaa

SEQ ID NO: 882393 - RNA, 18 nt, Homo sapiens
uuuaaagauguaaaaccu

SEQ ID NO: 882394 - RNA, 23 nt, Homo sapiens
uuuaaagcuacaaucuguucaau

SEQ ID NO: 882395 - RNA, 20 nt, Homo sapiens
uuuaaagguuaguauggaau

SEQ ID NO: 882396 - RNA, 20 nt, Homo sapiens
uuuaaaguauguuauugcau

SEQ ID NO: 882397 - RNA, 15 nt, Homo sapiens
uuuaaauccuuccau

SEQ ID NO: 882398 - RNA, 22 nt, Homo sapiens
uuuaacacuagaaaacauucca

SEQ ID NO: 882399 - RNA, 21 nt, Homo sapiens
uuuaacaugacuucugcccca

SEQ ID NO: 882400 - RNA, 16 nt, Homo sapiens
uuuaacuugaggguaa

SEQ ID NO: 882401 - RNA, 23 nt, Homo sapiens
uuuaacuuggaguuucauuucuu

SEQ ID NO: 882402 - RNA, 13 nt, Homo sapiens
uuuaagaaucuau

SEQ ID NO: 882403 - RNA, 21 nt, Homo sapiens
uuuaagagaagaugugauuua

SEQ ID NO: 882404 - RNA, 13 nt, Homo sapiens
uuuaagcaucaaa

SEQ ID NO: 882405 - RNA, 17 nt, Homo sapiens
uuuaaguauauaguaua

SEQ ID NO: 882406 - RNA, 17 nt, Homo sapiens
uuuaauacucaccuccu

SEQ ID NO: 882407 - RNA, 20 nt, Homo sapiens
uuuaauaucugagaagugua

SEQ ID NO: 882408 - RNA, 12 nt, Homo sapiens
uuuaaugagcac

SEQ ID NO: 882409 - RNA, 15 nt, Homo sapiens
uuuaauuuuugcaau

SEQ ID NO: 882410 - RNA, 17 nt, Homo sapiens
uuuacaaaguauuugcu

SEQ ID NO: 882411 - RNA, 14 nt, Homo sapiens
uuuacacauucuca

SEQ ID NO: 882412 - RNA, 20 nt, Homo sapiens
uuuacagaauggaaccaaaa

SEQ ID NO: 882413 - RNA, 21 nt, Homo sapiens
uuuacauaucaccucauggcc

SEQ ID NO: 882414 - RNA, 10 nt, Homo sapiens
uuuacauuca

SEQ ID NO: 882415 - RNA, 20 nt, Homo sapiens
uuuaccacuaugcaauauau

SEQ ID NO: 882416 - RNA, 22 nt, Homo sapiens
uuuaccauaaaaauccuucuca

SEQ ID NO: 882417 - RNA, 15 nt, Homo sapiens
uuuacgacugaagaa

SEQ ID NO: 882418 - RNA, 14 nt, Homo sapiens
uuuacuagugugug

SEQ ID NO: 882419 - RNA, 19 nt, Homo sapiens
uuuacugucuguaagagaa

SEQ ID NO: 882420 - RNA, 20 nt, Homo sapiens
uuuagaacagagggaccaaa

SEQ ID NO: 882421 - RNA, 17 nt, Homo sapiens
uuuagaacuguauguca

SEQ ID NO: 882422 - RNA, 13 nt, Homo sapiens
uuuagaagagccu

SEQ ID NO: 882423 - RNA, 22 nt, Homo sapiens
uuuagaguaugcaagaagaaua

SEQ ID NO: 882424 - RNA, 18 nt, Homo sapiens
uuuagauuaaacaaacaa

SEQ ID NO: 882425 - RNA, 14 nt, Homo sapiens
uuuagccagugacu

SEQ ID NO: 882426 - RNA, 19 nt, Homo sapiens
uuuagcuucucugccaagc

SEQ ID NO: 882427 - RNA, 22 nt, Homo sapiens
uuuaguauguggcguaucaugc

SEQ ID NO: 882428 - RNA, 16 nt, Homo sapiens
uuuauaagagugccgu

SEQ ID NO: 882429 - RNA, 19 nt, Homo sapiens
uuuauagcacaaacuuuaa

SEQ ID NO: 882430 - RNA, 13 nt, Homo sapiens
uuuauauaugaag

SEQ ID NO: 882431 - RNA, 15 nt, Homo sapiens
uuuauauauuauguc

SEQ ID NO: 882432 - RNA, 19 nt, Homo sapiens
uuuauauauuugaauauca

SEQ ID NO: 882433 - RNA, 18 nt, Homo sapiens
uuuauaugaaauguuuca

SEQ ID NO: 882434 - RNA, 22 nt, Homo sapiens
uuuauauuguauauucuggaaa

SEQ ID NO: 882435 - RNA, 16 nt, Homo sapiens
uuuaucauuaccauua

SEQ ID NO: 882436 - RNA, 13 nt, Homo sapiens
uuuaucugucaca

SEQ ID NO: 882437 - RNA, 13 nt, Homo sapiens
uuuaugaguacuu

SEQ ID NO: 882438 - RNA, 18 nt, Homo sapiens
uuuaugagucagucucuc

SEQ ID NO: 882439 - RNA, 21 nt, Homo sapiens
uuuaugucaucauacaugacu

SEQ ID NO: 882440 - RNA, 22 nt, Homo sapiens
uuuaugucucagaccacuauuc

SEQ ID NO: 882441 - RNA, 18 nt, Homo sapiens
uuuauuauaugauuauca

SEQ ID NO: 882442 - RNA, 19 nt, Homo sapiens
uuuauucauuagcugugau

SEQ ID NO: 882443 - RNA, 15 nt, Homo sapiens
uuuauugcugaauga

SEQ ID NO: 882444 - RNA, 16 nt, Homo sapiens
uuuauuggggugccua

SEQ ID NO: 882445 - RNA, 22 nt, Homo sapiens
uuuauugucggaagacuugcca

SEQ ID NO: 882446 - RNA, 13 nt, Homo sapiens
uuuauuucucggg

SEQ ID NO: 882447 - RNA, 13 nt, Homo sapiens
uuuauuucuguca

SEQ ID NO: 882448 - RNA, 20 nt, Homo sapiens
uuuauuuuucauauugugcc

SEQ ID NO: 882449 - RNA, 23 nt, Homo sapiens
uuucaaagaaggaauucuaggca

SEQ ID NO: 882450 - RNA, 16 nt, Homo sapiens
uuucaacauaucauuu

SEQ ID NO: 882451 - RNA, 13 nt, Homo sapiens
uuucaacuccaga

SEQ ID NO: 882452 - RNA, 19 nt, Homo sapiens
uuucaaguguaacuuauua

SEQ ID NO: 882453 - RNA, 15 nt, Homo sapiens
uuucaaugaccugua

SEQ ID NO: 882454 - RNA, 15 nt, Homo sapiens
uuucaauuauuucaa

SEQ ID NO: 882455 - RNA, 14 nt, Homo sapiens
uuucacaauuccau

SEQ ID NO: 882456 - RNA, 17 nt, Homo sapiens
uuucacauaaacacaua

SEQ ID NO: 882457 - RNA, 20 nt, Homo sapiens
uuucacauaaacacauacau

SEQ ID NO: 882458 - RNA, 19 nt, Homo sapiens
uuucacauacacucaaaca

SEQ ID NO: 882459 - RNA, 21 nt, Homo sapiens
uuucagaauugaaggagaaaa

SEQ ID NO: 882460 - RNA, 16 nt, Homo sapiens
uuucagcacucagaaa

SEQ ID NO: 882461 - RNA, 22 nt, Homo sapiens
uuucaguauaauuuaacuucag

SEQ ID NO: 882462 - RNA, 19 nt, Homo sapiens
uuucagugaaagcaucacu

SEQ ID NO: 882463 - RNA, 23 nt, Homo sapiens
uuucaguguaugauauacuuuau

SEQ ID NO: 882464 - RNA, 17 nt, Homo sapiens
uuucaugcuuuccuaaa

SEQ ID NO: 882465 - RNA, 17 nt, Homo sapiens
uuucauguaaauuuugu

SEQ ID NO: 882466 - RNA, 17 nt, Homo sapiens
uuucaugucauuugaca

SEQ ID NO: 882467 - RNA, 15 nt, Homo sapiens
uuucauugauaugaa

SEQ ID NO: 882468 - RNA, 21 nt, Homo sapiens
uuuccaaaaaggaacacugga

SEQ ID NO: 882469 - RNA, 16 nt, Homo sapiens
uuuccaauugaacuuu

SEQ ID NO: 882470 - RNA, 15 nt, Homo sapiens
uuuccacugccaaaa

SEQ ID NO: 882471 - RNA, 20 nt, Homo sapiens
uuuccacugugcuauuacaa

SEQ ID NO: 882472 - RNA, 18 nt, Homo sapiens
uuuccaggggccucccaa

SEQ ID NO: 882473 - RNA, 21 nt, Homo sapiens
uuuccauaaacacccaugaau

SEQ ID NO: 882474 - RNA, 20 nt, Homo sapiens
uuuccauguaucuaccucac

SEQ ID NO: 882475 - RNA, 17 nt, Homo sapiens
uuuccauuuaguaacag

SEQ ID NO: 882476 - RNA, 15 nt, Homo sapiens
uuucccaauacauac

SEQ ID NO: 882477 - RNA, 13 nt, Homo sapiens
uuuccccagacac

SEQ ID NO: 882478 - RNA, 14 nt, Homo sapiens
uuuccccucagagc

SEQ ID NO: 882479 - RNA, 18 nt, Homo sapiens
uuuccccucuauuuuggu

SEQ ID NO: 882480 - RNA, 17 nt, Homo sapiens
uuuccgucuuuguauca

SEQ ID NO: 882481 - RNA, 15 nt, Homo sapiens
uuuccugugccaacc

SEQ ID NO: 882482 - RNA, 13 nt, Homo sapiens
uuuccuugcaaau

SEQ ID NO: 882483 - RNA, 18 nt, Homo sapiens
uuuccuugucucucauuc

SEQ ID NO: 882484 - RNA, 14 nt, Homo sapiens
aaaaaaauugcaca

SEQ ID NO: 882485 - RNA, 21 nt, Homo sapiens
aaaaaaauuuuauagugucuu

SEQ ID NO: 882486 - RNA, 12 nt, Homo sapiens
aaaaaacagagg

SEQ ID NO: 882487 - RNA, 23 nt, Homo sapiens
aacaagagcaaaaugaugcuuuc

SEQ ID NO: 882488 - RNA, 22 nt, Homo sapiens
aacaagccaacgacaaagccaa

SEQ ID NO: 882489 - RNA, 12 nt, Homo sapiens
aacaaggcaaug

SEQ ID NO: 882490 - RNA, 14 nt, Homo sapiens
aacaagggcaguga

SEQ ID NO: 882491 - RNA, 14 nt, Homo sapiens
aacaaggugucuuu

SEQ ID NO: 882492 - RNA, 16 nt, Homo sapiens
aacaauggagauauca

SEQ ID NO: 882493 - RNA, 21 nt, Homo sapiens
aacaaugugggcguuuguaaa

SEQ ID NO: 882494 - RNA, 23 nt, Homo sapiens
aacaauuuuaggaggaccagagc

SEQ ID NO: 882495 - RNA, 16 nt, Homo sapiens
aacacaagccacagaa

SEQ ID NO: 882496 - RNA, 21 nt, Homo sapiens
aacacaguuuagugcuuuaca

SEQ ID NO: 882497 - RNA, 18 nt, Homo sapiens
aacacauuacuugcacaa

SEQ ID NO: 882498 - RNA, 22 nt, Homo sapiens
aacacccuguagguucuugaua

SEQ ID NO: 882499 - RNA, 17 nt, Homo sapiens
aacacccuuuccaaagc

SEQ ID NO: 882500 - RNA, 15 nt, Homo sapiens
aacaccuucuuggcu

SEQ ID NO: 882501 - RNA, 23 nt, Homo sapiens
aacaccuucuuggcuucugggac

SEQ ID NO: 882502 - RNA, 14 nt, Homo sapiens
aacacugaaucaug

SEQ ID NO: 882503 - RNA, 14 nt, Homo sapiens
aacagaagcuucca

SEQ ID NO: 882504 - RNA, 16 nt, Homo sapiens
aacagaagcuuccauu

SEQ ID NO: 882505 - RNA, 18 nt, Homo sapiens
aacagacguuaccaauua

SEQ ID NO: 882506 - RNA, 16 nt, Homo sapiens
aacagagagagacaga

SEQ ID NO: 882507 - RNA, 13 nt, Homo sapiens
aacagagggccac

SEQ ID NO: 882508 - RNA, 12 nt, Homo sapiens
aacagaguaaau

SEQ ID NO: 882509 - RNA, 14 nt, Homo sapiens
aacagauauuguca

SEQ ID NO: 882510 - RNA, 16 nt, Homo sapiens
aacagauuguuugcaa

SEQ ID NO: 882511 - RNA, 15 nt, Homo sapiens
aacagccccaaaguc

SEQ ID NO: 882512 - RNA, 23 nt, Homo sapiens
aacagcucccuaguggcuuccuc

SEQ ID NO: 882513 - RNA, 17 nt, Homo sapiens
aacaggggccaaacugg

SEQ ID NO: 882514 - RNA, 22 nt, Homo sapiens
aacagguuuucaccauagccua

SEQ ID NO: 882515 - RNA, 16 nt, Homo sapiens
aacaguagcagggaau

SEQ ID NO: 882516 - RNA, 18 nt, Homo sapiens
aacaguauuuguacaaau

SEQ ID NO: 882517 - RNA, 14 nt, Homo sapiens
aacagugcuguucu

SEQ ID NO: 882518 - RNA, 18 nt, Homo sapiens
aacaguugugaugacuau

SEQ ID NO: 882519 - RNA, 16 nt, Homo sapiens
aacauaaauuuaucau

SEQ ID NO: 882520 - RNA, 18 nt, Homo sapiens
aacauaccagaccacucu

SEQ ID NO: 882521 - RNA, 16 nt, Homo sapiens
aacauagagaucuaug

SEQ ID NO: 882522 - RNA, 19 nt, Homo sapiens
aacauaucaaacauaugua

SEQ ID NO: 882523 - RNA, 16 nt, Homo sapiens
aacaucauucuugaga

SEQ ID NO: 882524 - RNA, 23 nt, Homo sapiens
aacauccauguccuaugugugac

SEQ ID NO: 882525 - RNA, 15 nt, Homo sapiens
aacaucccacagugg

SEQ ID NO: 882526 - RNA, 20 nt, Homo sapiens
aacaucuauuauaaaaccau

SEQ ID NO: 882527 - RNA, 15 nt, Homo sapiens
aacaucucacuuugc

SEQ ID NO: 882528 - RNA, 15 nt, Homo sapiens
aacaugacacugacc

SEQ ID NO: 882529 - RNA, 18 nt, Homo sapiens
aacaugacacugaccuug

SEQ ID NO: 882530 - RNA, 12 nt, Homo sapiens
aacaugcacggu

SEQ ID NO: 882531 - RNA, 16 nt, Homo sapiens
aacaugccauaucuca

SEQ ID NO: 882532 - RNA, 20 nt, Homo sapiens
aacaugcuaaauaguucuau

SEQ ID NO: 882533 - RNA, 21 nt, Homo sapiens
aacauguaccacugagccuga

SEQ ID NO: 882534 - RNA, 21 nt, Homo sapiens
aacauguggcaaccuguucuu

SEQ ID NO: 882535 - RNA, 14 nt, Homo sapiens
aacauguucacuua

SEQ ID NO: 882536 - RNA, 20 nt, Homo sapiens
aacauguuugggaaguccua

SEQ ID NO: 882537 - RNA, 20 nt, Homo sapiens
aacauguuuuguauguuaaa

SEQ ID NO: 882538 - RNA, 22 nt, Homo sapiens
aacauguuuugugcagcacagu

SEQ ID NO: 882539 - RNA, 18 nt, Homo sapiens
aacauuaaacacuguaau

SEQ ID NO: 882540 - RNA, 13 nt, Homo sapiens
aacauuaugccuu

SEQ ID NO: 882541 - RNA, 17 nt, Homo sapiens
aacauugacuucuuggu

SEQ ID NO: 882542 - RNA, 13 nt, Homo sapiens
aacauuuauuuca

SEQ ID NO: 882543 - RNA, 17 nt, Homo sapiens
aacauuucuuaugauuu

SEQ ID NO: 882544 - RNA, 16 nt, Homo sapiens
aaccaaagagacugga

SEQ ID NO: 882545 - RNA, 20 nt, Homo sapiens
aaccaaaggaaucguuucaa

SEQ ID NO: 882546 - RNA, 14 nt, Homo sapiens
aaccaaccaaccaa

SEQ ID NO: 882547 - RNA, 13 nt, Homo sapiens
aaccaaccucccc

SEQ ID NO: 882548 - RNA, 17 nt, Homo sapiens
aaccaagaguauuccau

SEQ ID NO: 882549 - RNA, 14 nt, Homo sapiens
aaccaagucuacuu

SEQ ID NO: 882550 - RNA, 23 nt, Homo sapiens
aaccaagucuacuucacuaauga

SEQ ID NO: 882551 - RNA, 15 nt, Homo sapiens
aaccaauagcuuuaa

SEQ ID NO: 882552 - RNA, 19 nt, Homo sapiens
aaccaaucauuuuaagaag

SEQ ID NO: 882553 - RNA, 21 nt, Homo sapiens
aaccaauuuuaaauacauucu

SEQ ID NO: 882554 - RNA, 15 nt, Homo sapiens
aaccacaaaccaccc

SEQ ID NO: 882555 - RNA, 18 nt, Homo sapiens
aaccacagaacacugggu

SEQ ID NO: 882556 - RNA, 18 nt, Homo sapiens
aaccacuucauucuugaa

SEQ ID NO: 882557 - RNA, 18 nt, Homo sapiens
aaccagcagaaaagugcu

SEQ ID NO: 882558 - RNA, 18 nt, Homo sapiens
aaccagguuaagugguaa

SEQ ID NO: 882559 - RNA, 22 nt, Homo sapiens
aaccaguaagguuauaacugug

SEQ ID NO: 882560 - RNA, 16 nt, Homo sapiens
aaccaguuaugugaau

SEQ ID NO: 882561 - RNA, 12 nt, Homo sapiens
aaccauaguuau

SEQ ID NO: 882562 - RNA, 21 nt, Homo sapiens
aaccauaguuauuuacuugaa

SEQ ID NO: 882563 - RNA, 15 nt, Homo sapiens
aaccaugaaaauggg

SEQ ID NO: 882564 - RNA, 22 nt, Homo sapiens
aaccaugagaccacuguuauca

SEQ ID NO: 882565 - RNA, 12 nt, Homo sapiens
aacccaccaucu

SEQ ID NO: 882566 - RNA, 12 nt, Homo sapiens
aacccaccugcu

SEQ ID NO: 882567 - RNA, 15 nt, Homo sapiens
aacccacugugcuua

SEQ ID NO: 882568 - RNA, 17 nt, Homo sapiens
aacccagcauguacaaa

SEQ ID NO: 882569 - RNA, 15 nt, Homo sapiens
aacccaguauaugcu

SEQ ID NO: 882570 - RNA, 21 nt, Homo sapiens
aacccauuaggcaugccuaau

SEQ ID NO: 882571 - RNA, 16 nt, Homo sapiens
aaccccagacacuggu

SEQ ID NO: 882572 - RNA, 21 nt, Homo sapiens
aaccccagacucaaacucaag

SEQ ID NO: 882573 - RNA, 12 nt, Homo sapiens
aaccccaucucu

SEQ ID NO: 882574 - RNA, 18 nt, Homo sapiens
aacccccgacuucauccc

SEQ ID NO: 882575 - RNA, 16 nt, Homo sapiens
aacccccgcuccagau

SEQ ID NO: 882576 - RNA, 19 nt, Homo sapiens
aacccgugccaaguccagg

SEQ ID NO: 882577 - RNA, 16 nt, Homo sapiens
aacccguuuuauucua

SEQ ID NO: 882578 - RNA, 18 nt, Homo sapiens
aacccucacuguguugga

SEQ ID NO: 882579 - RNA, 20 nt, Homo sapiens
aacccuguggggccugaugg

SEQ ID NO: 882580 - RNA, 17 nt, Homo sapiens
aacccuuaaaaaugcac

SEQ ID NO: 882581 - RNA, 21 nt, Homo sapiens
aacccuuccuuucccaaguau

SEQ ID NO: 882582 - RNA, 18 nt, Homo sapiens
aaccgacuuuucuaaagc

SEQ ID NO: 882583 - RNA, 14 nt, Homo sapiens
aaccgagcaauuuu

SEQ ID NO: 882584 - RNA, 20 nt, Homo sapiens
aaccgcauggaacagugcag

SEQ ID NO: 882585 - RNA, 22 nt, Homo sapiens
aaccuacuagacaaugauguga

SEQ ID NO: 882586 - RNA, 18 nt, Homo sapiens
aaccuagcacgugccagu

SEQ ID NO: 882587 - RNA, 17 nt, Homo sapiens
aaccucaagcugcaucu

SEQ ID NO: 882588 - RNA, 23 nt, Homo sapiens
aaccucaguaauuuagaaaucau

SEQ ID NO: 882589 - RNA, 21 nt, Homo sapiens
aaccucaucuacaagcauuug

SEQ ID NO: 882590 - RNA, 20 nt, Homo sapiens
aaccucucuaagccacagcu

SEQ ID NO: 882591 - RNA, 23 nt, Homo sapiens
aaccugaauauaaauuuguguuc

SEQ ID NO: 882592 - RNA, 16 nt, Homo sapiens
aaccuggagaugauga

SEQ ID NO: 882593 - RNA, 17 nt, Homo sapiens
aaccuggagaugaugau

SEQ ID NO: 882594 - RNA, 23 nt, Homo sapiens
aaccuggagggcuagaaccugga

SEQ ID NO: 882595 - RNA, 22 nt, Homo sapiens
aaccuggaggggcuagaaccua

SEQ ID NO: 882596 - RNA, 16 nt, Homo sapiens
aaccugguccuaaccc

SEQ ID NO: 882597 - RNA, 16 nt, Homo sapiens
aaccuuucaaauuuca

SEQ ID NO: 882598 - RNA, 14 nt, Homo sapiens
aaccuuucccucac

SEQ ID NO: 882599 - RNA, 15 nt, Homo sapiens
aacgauauguagcag

SEQ ID NO: 882600 - RNA, 22 nt, Homo sapiens
aacgcaaagggcugaaagccau

SEQ ID NO: 882601 - RNA, 21 nt, Homo sapiens
aauaaaccuggagaugaugau

SEQ ID NO: 882602 - RNA, 13 nt, Homo sapiens
aauaaaccuugau

SEQ ID NO: 882603 - RNA, 15 nt, Homo sapiens
aauaaacgugcuccc

SEQ ID NO: 882604 - RNA, 14 nt, Homo sapiens
aauaaagcuucauu

SEQ ID NO: 882605 - RNA, 20 nt, Homo sapiens
aauaaaguacccugugcuca

SEQ ID NO: 882606 - RNA, 16 nt, Homo sapiens
aauaaaguuagugugu

SEQ ID NO: 882607 - RNA, 15 nt, Homo sapiens
aauaaauaaucugua

SEQ ID NO: 882608 - RNA, 19 nt, Homo sapiens
aauaaaugauguacuacau

SEQ ID NO: 882609 - RNA, 14 nt, Homo sapiens
aauaaaugugcuua

SEQ ID NO: 882610 - RNA, 14 nt, Homo sapiens
aauaaauugcuccu

SEQ ID NO: 882611 - RNA, 23 nt, Homo sapiens
aauaaauuggugauaaguggaaa

SEQ ID NO: 882612 - RNA, 13 nt, Homo sapiens
aauaacagugugu

SEQ ID NO: 882613 - RNA, 17 nt, Homo sapiens
aauaacuuauaucauca

SEQ ID NO: 882614 - RNA, 17 nt, Homo sapiens
aauaagaaacaugaugu

SEQ ID NO: 882615 - RNA, 15 nt, Homo sapiens
aauaagcaucugugu

SEQ ID NO: 882616 - RNA, 17 nt, Homo sapiens
aauaagccagcaaacca

SEQ ID NO: 882617 - RNA, 17 nt, Homo sapiens
aauaagugcauuuguaa

SEQ ID NO: 882618 - RNA, 20 nt, Homo sapiens
aauaauaaaaagacuauuaa

SEQ ID NO: 882619 - RNA, 14 nt, Homo sapiens
aauaauaccuaagc

SEQ ID NO: 882620 - RNA, 15 nt, Homo sapiens
aauaauauaugcuca

SEQ ID NO: 882621 - RNA, 15 nt, Homo sapiens
aauaauauuagcuua

SEQ ID NO: 882622 - RNA, 13 nt, Homo sapiens
aauaaugauuuaa

SEQ ID NO: 882623 - RNA, 20 nt, Homo sapiens
aauaauuaaaaaccacugaa

SEQ ID NO: 882624 - RNA, 22 nt, Homo sapiens
aauaauugcauauaaaaugcuu

SEQ ID NO: 882625 - RNA, 16 nt, Homo sapiens
aauaauuuaacuaauu

SEQ ID NO: 882626 - RNA, 14 nt, Homo sapiens
aauacaacauguag

SEQ ID NO: 882627 - RNA, 24 nt, Homo sapiens
aauacagcagugucaucagaagau

SEQ ID NO: 882628 - RNA, 19 nt, Homo sapiens
aauacaugcugcuaauuca

SEQ ID NO: 882629 - RNA, 20 nt, Homo sapiens
aauacauuuuauaucuggau

SEQ ID NO: 882630 - RNA, 18 nt, Homo sapiens
aauaccagugaaccaaag

SEQ ID NO: 882631 - RNA, 18 nt, Homo sapiens
aauaccccuguuaagcaa

SEQ ID NO: 882632 - RNA, 20 nt, Homo sapiens
aauaccucaaccuaugguau

SEQ ID NO: 882633 - RNA, 22 nt, Homo sapiens
aauacgguaccuggcaauguuu

SEQ ID NO: 882634 - RNA, 14 nt, Homo sapiens
aauacuccuaagac

SEQ ID NO: 882635 - RNA, 18 nt, Homo sapiens
aauacugccggucaccca

SEQ ID NO: 882636 - RNA, 13 nt, Homo sapiens
aauacuguacaua

SEQ ID NO: 882637 - RNA, 11 nt, Homo sapiens
aauacuugagc

SEQ ID NO: 882638 - RNA, 11 nt, Homo sapiens
aauacuuuauc

SEQ ID NO: 882639 - RNA, 19 nt, Homo sapiens
aauagaaccaagaauucua

SEQ ID NO: 882640 - RNA, 17 nt, Homo sapiens
aauagaguuccaaauaa

SEQ ID NO: 882641 - RNA, 23 nt, Homo sapiens
aauagccauguacuauaauguga

SEQ ID NO: 882642 - RNA, 21 nt, Homo sapiens
aauagccuaauacaacaugua

SEQ ID NO: 882643 - RNA, 22 nt, Homo sapiens
aauagcugcuaggguaggaaag

SEQ ID NO: 882644 - RNA, 12 nt, Homo sapiens
aauagggagaaa

SEQ ID NO: 882645 - RNA, 12 nt, Homo sapiens
aauaguauuuau

SEQ ID NO: 882646 - RNA, 19 nt, Homo sapiens
aauaguuuugauccuaaau

SEQ ID NO: 882647 - RNA, 16 nt, Homo sapiens
aauauaaaaguaaaua

SEQ ID NO: 882648 - RNA, 14 nt, Homo sapiens
aauauaaacacuau

SEQ ID NO: 882649 - RNA, 14 nt, Homo sapiens
aauauaagaaucau

SEQ ID NO: 882650 - RNA, 12 nt, Homo sapiens
aauauaaugcaa

SEQ ID NO: 882651 - RNA, 15 nt, Homo sapiens
aauauauuuugccau

SEQ ID NO: 882652 - RNA, 17 nt, Homo sapiens
aauaucgagaacugcca

SEQ ID NO: 882653 - RNA, 14 nt, Homo sapiens
aauaucucucaccc

SEQ ID NO: 882654 - RNA, 12 nt, Homo sapiens
aauaucugacau

SEQ ID NO: 882655 - RNA, 22 nt, Homo sapiens
aauaucugagaaguguauauag

SEQ ID NO: 882656 - RNA, 21 nt, Homo sapiens
aauaucuuuaauagguuaaua

SEQ ID NO: 882657 - RNA, 15 nt, Homo sapiens
aauaugauuacuuua

SEQ ID NO: 882658 - RNA, 18 nt, Homo sapiens
aauaugauuuuauuugac

SEQ ID NO: 882659 - RNA, 19 nt, Homo sapiens
aauaugcaccaaaucaucu

SEQ ID NO: 882660 - RNA, 21 nt, Homo sapiens
aauaugguaaugcacaauucc

SEQ ID NO: 882661 - RNA, 14 nt, Homo sapiens
aauauguaagucag

SEQ ID NO: 882662 - RNA, 11 nt, Homo sapiens
aauaugugauu

SEQ ID NO: 882663 - RNA, 14 nt, Homo sapiens
aauauuaccaaaaa

SEQ ID NO: 882664 - RNA, 21 nt, Homo sapiens
aauauuagcaaagaagcuuca

SEQ ID NO: 882665 - RNA, 23 nt, Homo sapiens
aauauucaauaaagcugcugaga

SEQ ID NO: 882666 - RNA, 15 nt, Homo sapiens
aauauucagauauaa

SEQ ID NO: 882667 - RNA, 22 nt, Homo sapiens
aauauugaauaaguauucuuca

SEQ ID NO: 882668 - RNA, 18 nt, Homo sapiens
aauauuuaaacagcagug

SEQ ID NO: 882669 - RNA, 18 nt, Homo sapiens
aauauuuauauauuugaa

SEQ ID NO: 882670 - RNA, 17 nt, Homo sapiens
aauauuuauuaccucug

SEQ ID NO: 882671 - RNA, 20 nt, Homo sapiens
aauauuuauuaccucugaua

SEQ ID NO: 882672 - RNA, 20 nt, Homo sapiens
aauauuuauuauuuucaccu

SEQ ID NO: 882673 - RNA, 17 nt, Homo sapiens
aauauuugcaagacaua

SEQ ID NO: 882674 - RNA, 18 nt, Homo sapiens
aauauuugcaagacauag

SEQ ID NO: 882675 - RNA, 20 nt, Homo sapiens
aaucaaaacccaacaugacu

SEQ ID NO: 882676 - RNA, 14 nt, Homo sapiens
aaucaaacaauaau

SEQ ID NO: 882677 - RNA, 13 nt, Homo sapiens
aaucaaauagcau

SEQ ID NO: 882678 - RNA, 15 nt, Homo sapiens
aaucaaauugcuaca

SEQ ID NO: 882679 - RNA, 15 nt, Homo sapiens
aaucaaccagcagga

SEQ ID NO: 882680 - RNA, 17 nt, Homo sapiens
aaucaauguucacgcaa

SEQ ID NO: 882681 - RNA, 16 nt, Homo sapiens
aaucacaacacagagc

SEQ ID NO: 882682 - RNA, 20 nt, Homo sapiens
aaucacaacacagagcugcu

SEQ ID NO: 882683 - RNA, 21 nt, Homo sapiens
aaucaccaauaaauaagugca

SEQ ID NO: 882684 - RNA, 14 nt, Homo sapiens
aaucaccacaccaa

SEQ ID NO: 882685 - RNA, 21 nt, Homo sapiens
aaucaccauguaacaaccaga

SEQ ID NO: 882686 - RNA, 17 nt, Homo sapiens
aaucacuuuuaggaugu

SEQ ID NO: 882687 - RNA, 12 nt, Homo sapiens
aaucagcacuga

SEQ ID NO: 882688 - RNA, 20 nt, Homo sapiens
aaucaggggcaaacggagua

SEQ ID NO: 882689 - RNA, 18 nt, Homo sapiens
aaucagguccucagagaa

SEQ ID NO: 882690 - RNA, 18 nt, Homo sapiens
aaucauaugguugacagu

SEQ ID NO: 882691 - RNA, 21 nt, Homo sapiens
aaucaucucucaucacuuuuc

SEQ ID NO: 882692 - RNA, 15 nt, Homo sapiens
aaucauggcauucac

SEQ ID NO: 882693 - RNA, 23 nt, Homo sapiens
aaucauguuggauagucagcugu

SEQ ID NO: 882694 - RNA, 20 nt, Homo sapiens
aaucauuguagaaacacagu

SEQ ID NO: 882695 - RNA, 15 nt, Homo sapiens
aauccacaagccauu

SEQ ID NO: 882696 - RNA, 12 nt, Homo sapiens
aauccacagcca

SEQ ID NO: 882697 - RNA, 15 nt, Homo sapiens
aaucccagcacuuug

SEQ ID NO: 882698 - RNA, 22 nt, Homo sapiens
aaucccuguaggcgugcuagca

SEQ ID NO: 882699 - RNA, 17 nt, Homo sapiens
aauccucccuuccuccc

SEQ ID NO: 882700 - RNA, 12 nt, Homo sapiens
aauccugaagaa

SEQ ID NO: 882701 - RNA, 15 nt, Homo sapiens
aauccugacaccacc

SEQ ID NO: 882702 - RNA, 23 nt, Homo sapiens
aauccugcccccagccaugguga

SEQ ID NO: 882703 - RNA, 14 nt, Homo sapiens
aauccuuccaugaa

SEQ ID NO: 882704 - RNA, 15 nt, Homo sapiens
aauccuuccaugaaa

SEQ ID NO: 882705 - RNA, 17 nt, Homo sapiens
aauccuucucacuaaaa

SEQ ID NO: 882706 - RNA, 18 nt, Homo sapiens
aauccuuuacuguuaguc

SEQ ID NO: 882707 - RNA, 20 nt, Homo sapiens
aauccuuugugucgauuuca

SEQ ID NO: 882708 - RNA, 14 nt, Homo sapiens
aaucgaacuaugaa

SEQ ID NO: 882709 - RNA, 17 nt, Homo sapiens
aaucgaccucacuguca

SEQ ID NO: 882710 - RNA, 16 nt, Homo sapiens
aaucuaacuacaagga

SEQ ID NO: 882711 - RNA, 15 nt, Homo sapiens
aaucuaauacacuuu

SEQ ID NO: 882712 - RNA, 19 nt, Homo sapiens
aaucuccacuguuauucua

SEQ ID NO: 882713 - RNA, 15 nt, Homo sapiens
aaucucuugucucac

SEQ ID NO: 882714 - RNA, 23 nt, Homo sapiens
aaucuggagagcuagaaccugga

SEQ ID NO: 882715 - RNA, 15 nt, Homo sapiens
aaucugggcaucucg

SEQ ID NO: 882716 - RNA, 13 nt, Homo sapiens
acaggacugauuc

SEQ ID NO: 882717 - RNA, 22 nt, Homo sapiens
acaggaggggcccacaauggag

SEQ ID NO: 882718 - RNA, 23 nt, Homo sapiens
acaggcaaugcuggcuguuggcu

SEQ ID NO: 882719 - RNA, 12 nt, Homo sapiens
acaggcaugcac

SEQ ID NO: 882720 - RNA, 20 nt, Homo sapiens
acaggccauccauucacagc

SEQ ID NO: 882721 - RNA, 17 nt, Homo sapiens
acaggccucgcuacaag

SEQ ID NO: 882722 - RNA, 15 nt, Homo sapiens
acaggggaucaaagu

SEQ ID NO: 882723 - RNA, 12 nt, Homo sapiens
acagggugcaug

SEQ ID NO: 882724 - RNA, 15 nt, Homo sapiens
acagguaaaugggca

SEQ ID NO: 882725 - RNA, 14 nt, Homo sapiens
acagguaaccacaa

SEQ ID NO: 882726 - RNA, 18 nt, Homo sapiens
acagguccucaguguccu

SEQ ID NO: 882727 - RNA, 14 nt, Homo sapiens
acaggugcaagcca

SEQ ID NO: 882728 - RNA, 16 nt, Homo sapiens
acaguaaaaacuugua

SEQ ID NO: 882729 - RNA, 17 nt, Homo sapiens
acaguaacugccaucaa

SEQ ID NO: 882730 - RNA, 20 nt, Homo sapiens
acagucaccgacaacaugcu

SEQ ID NO: 882731 - RNA, 15 nt, Homo sapiens
acaguccugggagaa

SEQ ID NO: 882732 - RNA, 18 nt, Homo sapiens
acagucucugggagacuu

SEQ ID NO: 882733 - RNA, 13 nt, Homo sapiens
acagugaagggag

SEQ ID NO: 882734 - RNA, 21 nt, Homo sapiens
acagugcccaugcaauggcuu

SEQ ID NO: 882735 - RNA, 19 nt, Homo sapiens
acagugccuggcaaggccu

SEQ ID NO: 882736 - RNA, 17 nt, Homo sapiens
acagugggugaggagau

SEQ ID NO: 882737 - RNA, 17 nt, Homo sapiens
acaguuagguagcuuua

SEQ ID NO: 882738 - RNA, 18 nt, Homo sapiens
acaguuagguagcuuuag

SEQ ID NO: 882739 - RNA, 22 nt, Homo sapiens
acaguucaauucucauuuguca

SEQ ID NO: 882740 - RNA, 23 nt, Homo sapiens
acaguucaauucucauuugucac

SEQ ID NO: 882741 - RNA, 16 nt, Homo sapiens
acaguuuucugagaaa

SEQ ID NO: 882742 - RNA, 16 nt, Homo sapiens
acaguuuugccuuaaa

SEQ ID NO: 882743 - RNA, 14 nt, Homo sapiens
acauaacuaguuua

SEQ ID NO: 882744 - RNA, 12 nt, Homo sapiens
acauaagacaga

SEQ ID NO: 882745 - RNA, 18 nt, Homo sapiens
acauaauaaagacagauc

SEQ ID NO: 882746 - RNA, 22 nt, Homo sapiens
acauacaggccauacuuuacaa

SEQ ID NO: 882747 - RNA, 15 nt, Homo sapiens
acauacauacauaca

SEQ ID NO: 882748 - RNA, 17 nt, Homo sapiens
acauacauacauauaua

SEQ ID NO: 882749 - RNA, 20 nt, Homo sapiens
acauagagauaugcacacac

SEQ ID NO: 882750 - RNA, 22 nt, Homo sapiens
acauagagauaugcacacacag

SEQ ID NO: 882751 - RNA, 14 nt, Homo sapiens
acauaguaacucuu

SEQ ID NO: 882752 - RNA, 18 nt, Homo sapiens
acauaguucagccacaaa

SEQ ID NO: 882753 - RNA, 22 nt, Homo sapiens
acauaguuuauuucaacuauuu

SEQ ID NO: 882754 - RNA, 22 nt, Homo sapiens
acauauaggagcaauacuauua

SEQ ID NO: 882755 - RNA, 22 nt, Homo sapiens
acauauauauauacacauacau

SEQ ID NO: 882756 - RNA, 19 nt, Homo sapiens
acauaucaauucaacacau

SEQ ID NO: 882757 - RNA, 20 nt, Homo sapiens
acauauggacucugcacaug

SEQ ID NO: 882758 - RNA, 22 nt, Homo sapiens
acauauguauuaagccaaacau

SEQ ID NO: 882759 - RNA, 12 nt, Homo sapiens
acaucaccuuuu

SEQ ID NO: 882760 - RNA, 23 nt, Homo sapiens
acaucaccuuuuugacuuuucca

SEQ ID NO: 882761 - RNA, 20 nt, Homo sapiens
acaucagcagagaacuggaa

SEQ ID NO: 882762 - RNA, 21 nt, Homo sapiens
acauccaaccccccaccugcc

SEQ ID NO: 882763 - RNA, 13 nt, Homo sapiens
acauccaaugcau

SEQ ID NO: 882764 - RNA, 16 nt, Homo sapiens
acaucccauugcccug

SEQ ID NO: 882765 - RNA, 23 nt, Homo sapiens
acaucuaagaaaauuuacuguaa

SEQ ID NO: 882766 - RNA, 15 nt, Homo sapiens
acaucugcagcucuu

SEQ ID NO: 882767 - RNA, 16 nt, Homo sapiens
acaucuuauuuacuug

SEQ ID NO: 882768 - RNA, 18 nt, Homo sapiens
acaucuugcucugcugac

SEQ ID NO: 882769 - RNA, 19 nt, Homo sapiens
acaucuugcucugcugaca

SEQ ID NO: 882770 - RNA, 14 nt, Homo sapiens
acaucuuuccuguc

SEQ ID NO: 882771 - RNA, 14 nt, Homo sapiens
acaugaagaagcua

SEQ ID NO: 882772 - RNA, 15 nt, Homo sapiens
acaugacucagcaua

SEQ ID NO: 882773 - RNA, 12 nt, Homo sapiens
acaugacuguuu

SEQ ID NO: 882774 - RNA, 14 nt, Homo sapiens
acaugauacugaug

SEQ ID NO: 882775 - RNA, 15 nt, Homo sapiens
acaugauccugaguu

SEQ ID NO: 882776 - RNA, 15 nt, Homo sapiens
acaugcacgugugug

SEQ ID NO: 882777 - RNA, 15 nt, Homo sapiens
acaugcacugacccu

SEQ ID NO: 882778 - RNA, 19 nt, Homo sapiens
acaugcacuuggcugcaua

SEQ ID NO: 882779 - RNA, 21 nt, Homo sapiens
acaugcacuuggcugcauaaa

SEQ ID NO: 882780 - RNA, 17 nt, Homo sapiens
acaugcauuacugcaug

SEQ ID NO: 882781 - RNA, 20 nt, Homo sapiens
acaugcgaccgugaccagga

SEQ ID NO: 882782 - RNA, 22 nt, Homo sapiens
acaugcuggauaaaaugucagu

SEQ ID NO: 882783 - RNA, 14 nt, Homo sapiens
acauggaauuaccu

SEQ ID NO: 882784 - RNA, 16 nt, Homo sapiens
acauggaugagcacac

SEQ ID NO: 882785 - RNA, 19 nt, Homo sapiens
acauggccuaugcacauau

SEQ ID NO: 882786 - RNA, 21 nt, Homo sapiens
acauggccuaugcacauaugg

SEQ ID NO: 882787 - RNA, 20 nt, Homo sapiens
acaugggugugccaggcuag

SEQ ID NO: 882788 - RNA, 13 nt, Homo sapiens
acaugugccugua

SEQ ID NO: 882789 - RNA, 16 nt, Homo sapiens
acauguguguauauau

SEQ ID NO: 882790 - RNA, 22 nt, Homo sapiens
acauguguuuuaauuccaauau

SEQ ID NO: 882791 - RNA, 16 nt, Homo sapiens
acauuaaacacuguaa

SEQ ID NO: 882792 - RNA, 18 nt, Homo sapiens
acauuaaauucacaugca

SEQ ID NO: 882793 - RNA, 16 nt, Homo sapiens
acauuaagacacaccu

SEQ ID NO: 882794 - RNA, 15 nt, Homo sapiens
acauuccacagugcc

SEQ ID NO: 882795 - RNA, 16 nt, Homo sapiens
acauucccugcaucca

SEQ ID NO: 882796 - RNA, 17 nt, Homo sapiens
acauucccugcauccaa

SEQ ID NO: 882797 - RNA, 19 nt, Homo sapiens
acauuccugauacugggua

SEQ ID NO: 882798 - RNA, 19 nt, Homo sapiens
acauucuggaaaagcaaaa

SEQ ID NO: 882799 - RNA, 18 nt, Homo sapiens
acauugcuucugcuaaau

SEQ ID NO: 882800 - RNA, 12 nt, Homo sapiens
acauugugccuu

SEQ ID NO: 882801 - RNA, 13 nt, Homo sapiens
acauugugcuugg

SEQ ID NO: 882802 - RNA, 18 nt, Homo sapiens
acauuuauucugcucaca

SEQ ID NO: 882803 - RNA, 20 nt, Homo sapiens
acauuucccuccugggagag

SEQ ID NO: 882804 - RNA, 18 nt, Homo sapiens
acauuucccugugcugac

SEQ ID NO: 882805 - RNA, 18 nt, Homo sapiens
acauuucuauagccaaaa

SEQ ID NO: 882806 - RNA, 19 nt, Homo sapiens
acauuugauguacaugugu

SEQ ID NO: 882807 - RNA, 21 nt, Homo sapiens
acauuugauuauauacuaugu

SEQ ID NO: 882808 - RNA, 17 nt, Homo sapiens
acauuuuuuguuugcug

SEQ ID NO: 882809 - RNA, 13 nt, Homo sapiens
accaaaaagggau

SEQ ID NO: 882810 - RNA, 22 nt, Homo sapiens
accaaaaguuacauguuugcac

SEQ ID NO: 882811 - RNA, 23 nt, Homo sapiens
accaaagagacuggagcaucuga

SEQ ID NO: 882812 - RNA, 16 nt, Homo sapiens
accaaauaaaguacca

SEQ ID NO: 882813 - RNA, 11 nt, Homo sapiens
accaaaucauc

SEQ ID NO: 882814 - RNA, 15 nt, Homo sapiens
accaaaugagcauua

SEQ ID NO: 882815 - RNA, 16 nt, Homo sapiens
accaaauuauugucca

SEQ ID NO: 882816 - RNA, 16 nt, Homo sapiens
accaacaaacaaugcc

SEQ ID NO: 882817 - RNA, 13 nt, Homo sapiens
accaacaugguga

SEQ ID NO: 882818 - RNA, 15 nt, Homo sapiens
accaacccucagagc

SEQ ID NO: 882819 - RNA, 21 nt, Homo sapiens
accaaccuccccgcagagcuc

SEQ ID NO: 882820 - RNA, 23 nt, Homo sapiens
accaacuuauaaagcauugcaac

SEQ ID NO: 882821 - RNA, 12 nt, Homo sapiens
accaacuuucug

SEQ ID NO: 882822 - RNA, 14 nt, Homo sapiens
accaagagcacauu

SEQ ID NO: 882823 - RNA, 19 nt, Homo sapiens
accaagaugaucacaugga

SEQ ID NO: 882824 - RNA, 16 nt, Homo sapiens
accaagauuggccuga

SEQ ID NO: 882825 - RNA, 14 nt, Homo sapiens
accaagcuucagag

SEQ ID NO: 882826 - RNA, 17 nt, Homo sapiens
accaagucuacuucacu

SEQ ID NO: 882827 - RNA, 23 nt, Homo sapiens
accaaguuauaaaucaaugucac

SEQ ID NO: 882828 - RNA, 13 nt, Homo sapiens
accaauaauguau

SEQ ID NO: 882829 - RNA, 16 nt, Homo sapiens
accaauacuacuguaa

SEQ ID NO: 882830 - RNA, 13 nt, Homo sapiens
accaauagcuuua

SEQ ID NO: 882831 - RNA, 16 nt, Homo sapiens
aguguuuucaccucau

SEQ ID NO: 882832 - RNA, 23 nt, Homo sapiens
aguuaaagugaauaaccacuuaa

SEQ ID NO: 882833 - RNA, 13 nt, Homo sapiens
aguuaauacuuaa

SEQ ID NO: 882834 - RNA, 13 nt, Homo sapiens
aguuaaucuucau

SEQ ID NO: 882835 - RNA, 18 nt, Homo sapiens
aguuacagaugcacccca

SEQ ID NO: 882836 - RNA, 11 nt, Homo sapiens
aguuacagggc

SEQ ID NO: 882837 - RNA, 15 nt, Homo sapiens
aguuacuuaccugca

SEQ ID NO: 882838 - RNA, 12 nt, Homo sapiens
aguuacuugaaa

SEQ ID NO: 882839 - RNA, 13 nt, Homo sapiens
aguuaggggagag

SEQ ID NO: 882840 - RNA, 17 nt, Homo sapiens
aguuaggucauuacuaa

SEQ ID NO: 882841 - RNA, 17 nt, Homo sapiens
aguuaggugugccaaac

SEQ ID NO: 882842 - RNA, 19 nt, Homo sapiens
aguuauggcuauaggugcu

SEQ ID NO: 882843 - RNA, 16 nt, Homo sapiens
aguuauuaaacagugu

SEQ ID NO: 882844 - RNA, 20 nt, Homo sapiens
aguucacaggguauuaauau

SEQ ID NO: 882845 - RNA, 13 nt, Homo sapiens
aguucagcaaaga

SEQ ID NO: 882846 - RNA, 21 nt, Homo sapiens
aguucagccagaaucuucguc

SEQ ID NO: 882847 - RNA, 18 nt, Homo sapiens
aguucaggaagguacaaa

SEQ ID NO: 882848 - RNA, 20 nt, Homo sapiens
aguucaggaagguacaaaca

SEQ ID NO: 882849 - RNA, 10 nt, Homo sapiens
aguucagugg

SEQ ID NO: 882850 - RNA, 19 nt, Homo sapiens
aguucauacccuguuacca

SEQ ID NO: 882851 - RNA, 22 nt, Homo sapiens
aguucaucuauggcaguccagc

SEQ ID NO: 882852 - RNA, 20 nt, Homo sapiens
aguuccagauuguucugucc

SEQ ID NO: 882853 - RNA, 17 nt, Homo sapiens
aguucgaccugcggcug

SEQ ID NO: 882854 - RNA, 19 nt, Homo sapiens
aguucgcagccacccugag

SEQ ID NO: 882855 - RNA, 13 nt, Homo sapiens
aguucuaucagga

SEQ ID NO: 882856 - RNA, 15 nt, Homo sapiens
aguucugaacuggaa

SEQ ID NO: 882857 - RNA, 16 nt, Homo sapiens
aguucuggaaaccacg

SEQ ID NO: 882858 - RNA, 19 nt, Homo sapiens
aguucuggcugaacacugg

SEQ ID NO: 882859 - RNA, 16 nt, Homo sapiens
aguugaacaucucacu

SEQ ID NO: 882860 - RNA, 19 nt, Homo sapiens
aguugagaaagaagagaag

SEQ ID NO: 882861 - RNA, 14 nt, Homo sapiens
aguugaggaauaug

SEQ ID NO: 882862 - RNA, 21 nt, Homo sapiens
aguugagucuccucucugaga

SEQ ID NO: 882863 - RNA, 16 nt, Homo sapiens
aguugcacauuaggaa

SEQ ID NO: 882864 - RNA, 13 nt, Homo sapiens
aguugcagucuca

SEQ ID NO: 882865 - RNA, 20 nt, Homo sapiens
aguugcgcugggagacgcug

SEQ ID NO: 882866 - RNA, 19 nt, Homo sapiens
aguugcguggacucugcac

SEQ ID NO: 882867 - RNA, 16 nt, Homo sapiens
aguugcugaugaacuc

SEQ ID NO: 882868 - RNA, 22 nt, Homo sapiens
aguugcuuuaaaguaccuguag

SEQ ID NO: 882869 - RNA, 20 nt, Homo sapiens
aguuggaaccguguccagca

SEQ ID NO: 882870 - RNA, 23 nt, Homo sapiens
aguugggaugcggggcagagcca

SEQ ID NO: 882871 - RNA, 19 nt, Homo sapiens
aguuguuuucccgagcaaa

SEQ ID NO: 882872 - RNA, 20 nt, Homo sapiens
aguuguuuuggugccugccu

SEQ ID NO: 882873 - RNA, 14 nt, Homo sapiens
aguuuaugauuuaa

SEQ ID NO: 882874 - RNA, 19 nt, Homo sapiens
aguuuauuggaaguguuca

SEQ ID NO: 882875 - RNA, 23 nt, Homo sapiens
aguuuauuuguugagagugugac

SEQ ID NO: 882876 - RNA, 17 nt, Homo sapiens
aguuuauuuuguuacac

SEQ ID NO: 882877 - RNA, 18 nt, Homo sapiens
aguuuccucaccagaaaa

SEQ ID NO: 882878 - RNA, 18 nt, Homo sapiens
aguuucuaucauucugcu

SEQ ID NO: 882879 - RNA, 21 nt, Homo sapiens
aguuucucagcucccaaggcu

SEQ ID NO: 882880 - RNA, 23 nt, Homo sapiens
aguuucuccuuuugaccaaauaa

SEQ ID NO: 882881 - RNA, 19 nt, Homo sapiens
aguuucuucuuuaggcauu

SEQ ID NO: 882882 - RNA, 18 nt, Homo sapiens
aguuugaccucacaguga

SEQ ID NO: 882883 - RNA, 10 nt, Homo sapiens
aguuugauau

SEQ ID NO: 882884 - RNA, 18 nt, Homo sapiens
aguuugcaguuaugcaga

SEQ ID NO: 882885 - RNA, 16 nt, Homo sapiens
aguuuguuuacuuuau

SEQ ID NO: 882886 - RNA, 20 nt, Homo sapiens
aguuuuaacagaaccagagg

SEQ ID NO: 882887 - RNA, 13 nt, Homo sapiens
aguuuuaguugca

SEQ ID NO: 882888 - RNA, 15 nt, Homo sapiens
aguuuuccaggaaua

SEQ ID NO: 882889 - RNA, 13 nt, Homo sapiens
aguuuuccucaau

SEQ ID NO: 882890 - RNA, 19 nt, Homo sapiens
aguuuuucagaaagcauua

SEQ ID NO: 882891 - RNA, 22 nt, Homo sapiens
auaaaaaucauggcaacauaau

SEQ ID NO: 882892 - RNA, 13 nt, Homo sapiens
auaaaacacauca

SEQ ID NO: 882893 - RNA, 16 nt, Homo sapiens
auaaaacacaucaagu

SEQ ID NO: 882894 - RNA, 13 nt, Homo sapiens
auaaaagcacuua

SEQ ID NO: 882895 - RNA, 22 nt, Homo sapiens
auaaaagccucugguggaaccu

SEQ ID NO: 882896 - RNA, 15 nt, Homo sapiens
auaaaauaaugaacu

SEQ ID NO: 882897 - RNA, 14 nt, Homo sapiens
auaaaaucuuacuu

SEQ ID NO: 882898 - RNA, 15 nt, Homo sapiens
auaaaauuaugccau

SEQ ID NO: 882899 - RNA, 20 nt, Homo sapiens
auaaaauuaugccauagcaa

SEQ ID NO: 882900 - RNA, 22 nt, Homo sapiens
auaaacaggaaaaugccagagc

SEQ ID NO: 882901 - RNA, 17 nt, Homo sapiens
auaaaccuggagaugau

SEQ ID NO: 882902 - RNA, 15 nt, Homo sapiens
auaaacuaguuucca

SEQ ID NO: 882903 - RNA, 21 nt, Homo sapiens
auaaacuaguuuccaguggau

SEQ ID NO: 882904 - RNA, 14 nt, Homo sapiens
auaaacucucuagg

SEQ ID NO: 882905 - RNA, 13 nt, Homo sapiens
auaaagacugaga

SEQ ID NO: 882906 - RNA, 14 nt, Homo sapiens
auaaagcccuugaa

SEQ ID NO: 882907 - RNA, 19 nt, Homo sapiens
auaaaggaagucaccaaaa

SEQ ID NO: 882908 - RNA, 18 nt, Homo sapiens
auaaaggcugagcucuua

SEQ ID NO: 882909 - RNA, 14 nt, Homo sapiens
auaaagucacuucc

SEQ ID NO: 882910 - RNA, 18 nt, Homo sapiens
auaaagucacuuccagug

SEQ ID NO: 882911 - RNA, 15 nt, Homo sapiens
auaaauaaaguuucu

SEQ ID NO: 882912 - RNA, 19 nt, Homo sapiens
auaaaucaacuccagcucc

SEQ ID NO: 882913 - RNA, 15 nt, Homo sapiens
auaaaucaguuaugu

SEQ ID NO: 882914 - RNA, 23 nt, Homo sapiens
auaaauccucagguaguacuggg

SEQ ID NO: 882915 - RNA, 21 nt, Homo sapiens
auaaaucugagccuaaaucua

SEQ ID NO: 882916 - RNA, 14 nt, Homo sapiens
auaaauggacaaau

SEQ ID NO: 882917 - RNA, 17 nt, Homo sapiens
auaaauguacauuaauu

SEQ ID NO: 882918 - RNA, 14 nt, Homo sapiens
auaaauguguaaau

SEQ ID NO: 882919 - RNA, 18 nt, Homo sapiens
auaaauguguaaaugugg

SEQ ID NO: 882920 - RNA, 13 nt, Homo sapiens
auaaauguuuaaa

SEQ ID NO: 882921 - RNA, 22 nt, Homo sapiens
auaaauuggugauaaguggaaa

SEQ ID NO: 882922 - RNA, 17 nt, Homo sapiens
auaaauuuuaacauuuu

SEQ ID NO: 882923 - RNA, 20 nt, Homo sapiens
auaacacugucuaccucaca

SEQ ID NO: 882924 - RNA, 20 nt, Homo sapiens
auaaccuucaugaugaauua

SEQ ID NO: 882925 - RNA, 19 nt, Homo sapiens
auaaccuuuauaugauaua

SEQ ID NO: 882926 - RNA, 17 nt, Homo sapiens
auaacucauugucugug

SEQ ID NO: 882927 - RNA, 13 nt, Homo sapiens
auaacuugauaua

SEQ ID NO: 882928 - RNA, 15 nt, Homo sapiens
auaagaaacaugaug

SEQ ID NO: 882929 - RNA, 19 nt, Homo sapiens
auaagaaucauagugccau

SEQ ID NO: 882930 - RNA, 16 nt, Homo sapiens
auaagauuaaaggaag

SEQ ID NO: 882931 - RNA, 20 nt, Homo sapiens
auaagauugacuuugaaucu

SEQ ID NO: 882932 - RNA, 17 nt, Homo sapiens
auaagcaaagacuauga

SEQ ID NO: 882933 - RNA, 19 nt, Homo sapiens
auaagcucaugagaugaca

SEQ ID NO: 882934 - RNA, 15 nt, Homo sapiens
auaagcuguuuuuau

SEQ ID NO: 882935 - RNA, 12 nt, Homo sapiens
auaagcuuuauu

SEQ ID NO: 882936 - RNA, 13 nt, Homo sapiens
auaaguauuucca

SEQ ID NO: 882937 - RNA, 22 nt, Homo sapiens
auaaguauuuccauaacucaua

SEQ ID NO: 882938 - RNA, 18 nt, Homo sapiens
auaauacaggauugucua

SEQ ID NO: 882939 - RNA, 15 nt, Homo sapiens
auaauaucugugagg

SEQ ID NO: 882940 - RNA, 16 nt, Homo sapiens
auaauaugcugccaaa

SEQ ID NO: 882941 - RNA, 21 nt, Homo sapiens
auaaucacauuaucaucugaa

SEQ ID NO: 882942 - RNA, 16 nt, Homo sapiens
auaaucgagucuaccu

SEQ ID NO: 882943 - RNA, 20 nt, Homo sapiens
auaaucuuuggguaacuuca

SEQ ID NO: 882944 - RNA, 15 nt, Homo sapiens
auaaugaacagcaga

SEQ ID NO: 882945 - RNA, 15 nt, Homo sapiens
auaaugagucugcau

SEQ ID NO: 882946 - RNA, 15 nt, Homo sapiens
augccuacagauaau

SEQ ID NO: 882947 - RNA, 16 nt, Homo sapiens
augccuccaagccauu

SEQ ID NO: 882948 - RNA, 22 nt, Homo sapiens
augccugauuuuaaaagguuga

SEQ ID NO: 882949 - RNA, 19 nt, Homo sapiens
augcguacguuuccugaga

SEQ ID NO: 882950 - RNA, 17 nt, Homo sapiens
augcuacaguacuaugu

SEQ ID NO: 882951 - RNA, 20 nt, Homo sapiens
augcuaccaugccucuccaa

SEQ ID NO: 882952 - RNA, 16 nt, Homo sapiens
augcuacucuaguauu

SEQ ID NO: 882953 - RNA, 17 nt, Homo sapiens
augcuaguuugaccuca

SEQ ID NO: 882954 - RNA, 15 nt, Homo sapiens
augcuaucucugugu

SEQ ID NO: 882955 - RNA, 21 nt, Homo sapiens
augcucauacuuggacaguua

SEQ ID NO: 882956 - RNA, 14 nt, Homo sapiens
augcuccaguaugg

SEQ ID NO: 882957 - RNA, 19 nt, Homo sapiens
augcucugccccaagcccc

SEQ ID NO: 882958 - RNA, 13 nt, Homo sapiens
augcugacuguac

SEQ ID NO: 882959 - RNA, 15 nt, Homo sapiens
augcugcuguuuaca

SEQ ID NO: 882960 - RNA, 20 nt, Homo sapiens
augcuggacggcauuccugc

SEQ ID NO: 882961 - RNA, 15 nt, Homo sapiens
augcuguugccucau

SEQ ID NO: 882962 - RNA, 14 nt, Homo sapiens
augcuuacaaaguc

SEQ ID NO: 882963 - RNA, 22 nt, Homo sapiens
augcuuaccaaguccugggaau

SEQ ID NO: 882964 - RNA, 16 nt, Homo sapiens
augcuuaccugugaga

SEQ ID NO: 882965 - RNA, 22 nt, Homo sapiens
augcuuauuguacuuguuauca

SEQ ID NO: 882966 - RNA, 14 nt, Homo sapiens
augcuucaguugua

SEQ ID NO: 882967 - RNA, 20 nt, Homo sapiens
augcuucaguuguacuucca

SEQ ID NO: 882968 - RNA, 20 nt, Homo sapiens
augcuucccagagaagcuca

SEQ ID NO: 882969 - RNA, 21 nt, Homo sapiens
auggaagaggcaccuguccca

SEQ ID NO: 882970 - RNA, 15 nt, Homo sapiens
auggaauaaaccauu

SEQ ID NO: 882971 - RNA, 15 nt, Homo sapiens
auggaauaaagcccu

SEQ ID NO: 882972 - RNA, 19 nt, Homo sapiens
auggaaugugguacaaauu

SEQ ID NO: 882973 - RNA, 18 nt, Homo sapiens
auggacauaagacagaca

SEQ ID NO: 882974 - RNA, 22 nt, Homo sapiens
auggacuaaccccaacgcacag

SEQ ID NO: 882975 - RNA, 22 nt, Homo sapiens
auggacucuucccccacuccuc

SEQ ID NO: 882976 - RNA, 15 nt, Homo sapiens
auggacuguguuucc

SEQ ID NO: 882977 - RNA, 18 nt, Homo sapiens
auggagaaauaggaccuu

SEQ ID NO: 882978 - RNA, 21 nt, Homo sapiens
auggagauauuuacaugaauu

SEQ ID NO: 882979 - RNA, 22 nt, Homo sapiens
auggagcugaggaggugccuug

SEQ ID NO: 882980 - RNA, 18 nt, Homo sapiens
auggaggaaagugauauc

SEQ ID NO: 882981 - RNA, 18 nt, Homo sapiens
auggaguucuugugccau

SEQ ID NO: 882982 - RNA, 16 nt, Homo sapiens
auggauagucugucca

SEQ ID NO: 882983 - RNA, 12 nt, Homo sapiens
auggaugaagga

SEQ ID NO: 882984 - RNA, 15 nt, Homo sapiens
auggaugcacgcaca

SEQ ID NO: 882985 - RNA, 15 nt, Homo sapiens
auggauguuugucaa

SEQ ID NO: 882986 - RNA, 20 nt, Homo sapiens
auggcaccuuuugcacauaa

SEQ ID NO: 882987 - RNA, 18 nt, Homo sapiens
auggcaguccagccagcu

SEQ ID NO: 882988 - RNA, 14 nt, Homo sapiens
auggccaggccaga

SEQ ID NO: 882989 - RNA, 15 nt, Homo sapiens
auggcccaaauccag

SEQ ID NO: 882990 - RNA, 22 nt, Homo sapiens
auggcggcccccccagcuguca

SEQ ID NO: 882991 - RNA, 15 nt, Homo sapiens
auggcuauauggcaa

SEQ ID NO: 882992 - RNA, 16 nt, Homo sapiens
auggcuggcacugagc

SEQ ID NO: 882993 - RNA, 22 nt, Homo sapiens
auggcuuaauguuuauuccuga

SEQ ID NO: 882994 - RNA, 18 nt, Homo sapiens
auggcuuggggagcagag

SEQ ID NO: 882995 - RNA, 20 nt, Homo sapiens
augggaaccuaguacucucu

SEQ ID NO: 882996 - RNA, 13 nt, Homo sapiens
augggacaucaaa

SEQ ID NO: 882997 - RNA, 13 nt, Homo sapiens
augggacauucca

SEQ ID NO: 882998 - RNA, 17 nt, Homo sapiens
augggagggggcuccau

SEQ ID NO: 882999 - RNA, 20 nt, Homo sapiens
augggagggggcuccaugga

SEQ ID NO: 883000 - RNA, 12 nt, Homo sapiens
augggaugaaug

SEQ ID NO: 883001 - RNA, 20 nt, Homo sapiens
auggggguggggaggcaaga

SEQ ID NO: 883002 - RNA, 13 nt, Homo sapiens
auggguacauucc

SEQ ID NO: 883003 - RNA, 22 nt, Homo sapiens
augggucuggcugagcugaacc

SEQ ID NO: 883004 - RNA, 15 nt, Homo sapiens
augguaagacuguaa

SEQ ID NO: 883005 - RNA, 20 nt, Homo sapiens
augguauggaacucucucca

SEQ ID NO: 883006 - RNA, 20 nt, Homo sapiens
auggucaacacuuaaggguu

SEQ ID NO: 883007 - RNA, 15 nt, Homo sapiens
auggucacaagcaca

SEQ ID NO: 883008 - RNA, 22 nt, Homo sapiens
auggucacaagcacaaagcuca

SEQ ID NO: 883009 - RNA, 18 nt, Homo sapiens
augguccuggaggaugac

SEQ ID NO: 883010 - RNA, 20 nt, Homo sapiens
augguccuggggcucugugc

SEQ ID NO: 883011 - RNA, 21 nt, Homo sapiens
augguccuugucccaagccca

SEQ ID NO: 883012 - RNA, 19 nt, Homo sapiens
auggugcacugagcugcaa

SEQ ID NO: 883013 - RNA, 20 nt, Homo sapiens
auggugcucacgacucuucc

SEQ ID NO: 883014 - RNA, 17 nt, Homo sapiens
auggugggaacccuccc

SEQ ID NO: 883015 - RNA, 17 nt, Homo sapiens
augguggugagcacauc

SEQ ID NO: 883016 - RNA, 17 nt, Homo sapiens
augguguaaugcacaau

SEQ ID NO: 883017 - RNA, 19 nt, Homo sapiens
augguuuuacucaugugca

SEQ ID NO: 883018 - RNA, 20 nt, Homo sapiens
auguaaacauaauucuugua

SEQ ID NO: 883019 - RNA, 12 nt, Homo sapiens
auguaaccaaga

SEQ ID NO: 883020 - RNA, 17 nt, Homo sapiens
auguaacuauaaucucu

SEQ ID NO: 883021 - RNA, 16 nt, Homo sapiens
auguaaucucaccuca

SEQ ID NO: 883022 - RNA, 20 nt, Homo sapiens
auguaaugaucauaagucua

SEQ ID NO: 883023 - RNA, 21 nt, Homo sapiens
auguaauugaauaaaguugaa

SEQ ID NO: 883024 - RNA, 20 nt, Homo sapiens
auguacacacacagaugcac

SEQ ID NO: 883025 - RNA, 18 nt, Homo sapiens
auguacaugaagaagcua

SEQ ID NO: 883026 - RNA, 20 nt, Homo sapiens
auguaccacugagccugaga

SEQ ID NO: 883027 - RNA, 22 nt, Homo sapiens
auguagcggugaagaguacaga

SEQ ID NO: 883028 - RNA, 22 nt, Homo sapiens
auguaguuugaauauuuuccac

SEQ ID NO: 883029 - RNA, 17 nt, Homo sapiens
auguauauguauaucua

SEQ ID NO: 883030 - RNA, 20 nt, Homo sapiens
auguaucccaacuccuauaa

SEQ ID NO: 883031 - RNA, 15 nt, Homo sapiens
auguaugaguggcuu

SEQ ID NO: 883032 - RNA, 19 nt, Homo sapiens
auguauggaugaaagcaau

SEQ ID NO: 883033 - RNA, 19 nt, Homo sapiens
auguaugugcacauguguc

SEQ ID NO: 883034 - RNA, 18 nt, Homo sapiens
auguauguuuacauauca

SEQ ID NO: 883035 - RNA, 17 nt, Homo sapiens
auguauuugucaaugca

SEQ ID NO: 883036 - RNA, 20 nt, Homo sapiens
auguauuuguuugcaauuuu

SEQ ID NO: 883037 - RNA, 16 nt, Homo sapiens
augucaaauaucucag

SEQ ID NO: 883038 - RNA, 13 nt, Homo sapiens
augucaccucagc

SEQ ID NO: 883039 - RNA, 17 nt, Homo sapiens
augucagaaaccaguua

SEQ ID NO: 883040 - RNA, 19 nt, Homo sapiens
augucagaguagaagauuu

SEQ ID NO: 883041 - RNA, 16 nt, Homo sapiens
augucaucauacauga

SEQ ID NO: 883042 - RNA, 17 nt, Homo sapiens
augucauuucauuuccu

SEQ ID NO: 883043 - RNA, 11 nt, Homo sapiens
augucauuuga

SEQ ID NO: 883044 - RNA, 15 nt, Homo sapiens
augucccaacuugua

SEQ ID NO: 883045 - RNA, 16 nt, Homo sapiens
auguccccugucccac

SEQ ID NO: 883046 - RNA, 18 nt, Homo sapiens
augucccuucucaugccu

SEQ ID NO: 883047 - RNA, 20 nt, Homo sapiens
auguccggagagacagugac

SEQ ID NO: 883048 - RNA, 13 nt, Homo sapiens
auguccuauccaa

SEQ ID NO: 883049 - RNA, 19 nt, Homo sapiens
auguccucuuguugcugag

SEQ ID NO: 883050 - RNA, 17 nt, Homo sapiens
augucucagaccacuau

SEQ ID NO: 883051 - RNA, 22 nt, Homo sapiens
augucuccaucucugucucaaa

SEQ ID NO: 883052 - RNA, 21 nt, Homo sapiens
augucucuaagccaacuuuaa

SEQ ID NO: 883053 - RNA, 20 nt, Homo sapiens
augucucuuuaaugucacag

SEQ ID NO: 883054 - RNA, 20 nt, Homo sapiens
augucuuaaucaugagauaa

SEQ ID NO: 883055 - RNA, 17 nt, Homo sapiens
augucuuggacacugua

SEQ ID NO: 883056 - RNA, 19 nt, Homo sapiens
augucuuuuauuuacuuuu

SEQ ID NO: 883057 - RNA, 17 nt, Homo sapiens
augugaacacaucagcu

SEQ ID NO: 883058 - RNA, 18 nt, Homo sapiens
augugagauuacuuuguc

SEQ ID NO: 883059 - RNA, 16 nt, Homo sapiens
augugauuuauuuuga

SEQ ID NO: 883060 - RNA, 17 nt, Homo sapiens
caaaacaaaaaaaaacu

SEQ ID NO: 883061 - RNA, 17 nt, Homo sapiens
caaaacaaaacaacaac

SEQ ID NO: 883062 - RNA, 18 nt, Homo sapiens
caaaacagagaugugaua

SEQ ID NO: 883063 - RNA, 17 nt, Homo sapiens
caaaaccugauguuaaa

SEQ ID NO: 883064 - RNA, 18 nt, Homo sapiens
caaaaccugauguuaaaa

SEQ ID NO: 883065 - RNA, 21 nt, Homo sapiens
caaaacguggguauuuccugc

SEQ ID NO: 883066 - RNA, 16 nt, Homo sapiens
caaaacuccaucucaa

SEQ ID NO: 883067 - RNA, 22 nt, Homo sapiens
caaaacucuccuacacuuccau

SEQ ID NO: 883068 - RNA, 23 nt, Homo sapiens
caaaagaagacaacauuucucaa

SEQ ID NO: 883069 - RNA, 12 nt, Homo sapiens
caaaagaagauu

SEQ ID NO: 883070 - RNA, 14 nt, Homo sapiens
caaaagauucugua

SEQ ID NO: 883071 - RNA, 20 nt, Homo sapiens
caaaagcugcuugacuauca

SEQ ID NO: 883072 - RNA, 20 nt, Homo sapiens
caaaagguuucauguagauu

SEQ ID NO: 883073 - RNA, 21 nt, Homo sapiens
caaaagucaccacuccauucc

SEQ ID NO: 883074 - RNA, 22 nt, Homo sapiens
caaaagucaccacuccauuccc

SEQ ID NO: 883075 - RNA, 14 nt, Homo sapiens
caaaagucagucuu

SEQ ID NO: 883076 - RNA, 15 nt, Homo sapiens
caaaagucagucuua

SEQ ID NO: 883077 - RNA, 19 nt, Homo sapiens
caaaaguuacauguuugca

SEQ ID NO: 883078 - RNA, 20 nt, Homo sapiens
caaaaguuacauguuugcac

SEQ ID NO: 883079 - RNA, 22 nt, Homo sapiens
caaaaguuucuuacucaaggaa

SEQ ID NO: 883080 - RNA, 19 nt, Homo sapiens
caaaauagagaaucccacu

SEQ ID NO: 883081 - RNA, 14 nt, Homo sapiens
caaaaucaugaaua

SEQ ID NO: 883082 - RNA, 16 nt, Homo sapiens
caaaauccaacuaaug

SEQ ID NO: 883083 - RNA, 11 nt, Homo sapiens
caaaauuacuu

SEQ ID NO: 883084 - RNA, 14 nt, Homo sapiens
caaacaaugccauc

SEQ ID NO: 883085 - RNA, 23 nt, Homo sapiens
caaacaccuccuagcaagaccug

SEQ ID NO: 883086 - RNA, 16 nt, Homo sapiens
caaacagccccaaagu

SEQ ID NO: 883087 - RNA, 15 nt, Homo sapiens
caaaccacaacugac

SEQ ID NO: 883088 - RNA, 16 nt, Homo sapiens
caaaccacuguacaua

SEQ ID NO: 883089 - RNA, 18 nt, Homo sapiens
caaaccauaaacuucaug

SEQ ID NO: 883090 - RNA, 12 nt, Homo sapiens
caaaccauuuaa

SEQ ID NO: 883091 - RNA, 16 nt, Homo sapiens
caaaccccgaccaccu

SEQ ID NO: 883092 - RNA, 22 nt, Homo sapiens
caaacggaguacagacgucuca

SEQ ID NO: 883093 - RNA, 16 nt, Homo sapiens
caaacuacaaagcuga

SEQ ID NO: 883094 - RNA, 16 nt, Homo sapiens
caaacuacauguaauc

SEQ ID NO: 883095 - RNA, 19 nt, Homo sapiens
caaacuaugaucacaguga

SEQ ID NO: 883096 - RNA, 17 nt, Homo sapiens
caaacucacugcucaag

SEQ ID NO: 883097 - RNA, 21 nt, Homo sapiens
caaacucacugcucaagaaga

SEQ ID NO: 883098 - RNA, 20 nt, Homo sapiens
caaacugccuauauugauaa

SEQ ID NO: 883099 - RNA, 21 nt, Homo sapiens
caaacuggggccucccugguc

SEQ ID NO: 883100 - RNA, 23 nt, Homo sapiens
caaacuguaaaacuuaaaacuga

SEQ ID NO: 883101 - RNA, 18 nt, Homo sapiens
caaagaaaugcugaugga

SEQ ID NO: 883102 - RNA, 20 nt, Homo sapiens
caaagaacugccccaucucc

SEQ ID NO: 883103 - RNA, 20 nt, Homo sapiens
caaagaaggaauucuaggca

SEQ ID NO: 883104 - RNA, 14 nt, Homo sapiens
caaagaauacuaga

SEQ ID NO: 883105 - RNA, 22 nt, Homo sapiens
caaagaauuccugaagccagau

SEQ ID NO: 883106 - RNA, 23 nt, Homo sapiens
caaagacagagaagaccaaagca

SEQ ID NO: 883107 - RNA, 12 nt, Homo sapiens
caaagacaugga

SEQ ID NO: 883108 - RNA, 22 nt, Homo sapiens
caaagagaaaaagaaaugcaaa

SEQ ID NO: 883109 - RNA, 14 nt, Homo sapiens
caaagagguauuua

SEQ ID NO: 883110 - RNA, 18 nt, Homo sapiens
caaagagguuuuaugaaa

SEQ ID NO: 883111 - RNA, 15 nt, Homo sapiens
caaagcaacuggaua

SEQ ID NO: 883112 - RNA, 13 nt, Homo sapiens
caaagcaccagcu

SEQ ID NO: 883113 - RNA, 23 nt, Homo sapiens
caaaggcacugaggcccagggag

SEQ ID NO: 883114 - RNA, 14 nt, Homo sapiens
caaaggugugcaaa

SEQ ID NO: 883115 - RNA, 15 nt, Homo sapiens
caaaguagcaauuuc

SEQ ID NO: 883116 - RNA, 21 nt, Homo sapiens
caaauaaagaccugagaaccu

SEQ ID NO: 883117 - RNA, 17 nt, Homo sapiens
caaauaaauguguaaau

SEQ ID NO: 883118 - RNA, 12 nt, Homo sapiens
caaauagcacau

SEQ ID NO: 883119 - RNA, 15 nt, Homo sapiens
caaauaucucagagg

SEQ ID NO: 883120 - RNA, 16 nt, Homo sapiens
caaauaucuugaaagg

SEQ ID NO: 883121 - RNA, 18 nt, Homo sapiens
caaauauuagcaaagaag

SEQ ID NO: 883122 - RNA, 17 nt, Homo sapiens
caaauccacaagccauu

SEQ ID NO: 883123 - RNA, 21 nt, Homo sapiens
caaauccccggcugcuuccuu

SEQ ID NO: 883124 - RNA, 17 nt, Homo sapiens
caaauccucaccaucca

SEQ ID NO: 883125 - RNA, 19 nt, Homo sapiens
caaauccucuucuaacuca

SEQ ID NO: 883126 - RNA, 16 nt, Homo sapiens
caaauccugaugcugu

SEQ ID NO: 883127 - RNA, 13 nt, Homo sapiens
caaaucucuauua

SEQ ID NO: 883128 - RNA, 14 nt, Homo sapiens
caaaugaacacgug

SEQ ID NO: 883129 - RNA, 16 nt, Homo sapiens
caaaugacccaaagac

SEQ ID NO: 883130 - RNA, 17 nt, Homo sapiens
caaaugaggauaucauc

SEQ ID NO: 883131 - RNA, 15 nt, Homo sapiens
caaaugcacaucuca

SEQ ID NO: 883132 - RNA, 18 nt, Homo sapiens
caaaugcacaucucaugg

SEQ ID NO: 883133 - RNA, 20 nt, Homo sapiens
caaaugcacaucucauggca

SEQ ID NO: 883134 - RNA, 13 nt, Homo sapiens
caaauggacauaa
